United States Patent 11,464,842 (COMPOSITIONS AND METHOD FOR OPTIMIZED PEPTIDE VACCINES USING RESIDUE OPTIMIZATION) - sequence listing, part 5

SEQ ID NO: 59700 - protein, 8 aa, Homo sapiens
  Native (MAGA3_HUMAN)
ASSSLQLV

SEQ ID NO: 59701 - protein, 10 aa, Homo sapiens
  Native (MAGA3_HUMAN)
LSVLEVFEGR

SEQ ID NO: 59702 - protein, 10 aa, Homo sapiens
  Native (MAGA3_HUMAN)
ISYPPLHEWV

SEQ ID NO: 59703 - protein, 9 aa, Homo sapiens
  Native (MAGA3_HUMAN)
LSRKVAELV

SEQ ID NO: 59704 - protein, 9 aa, Homo sapiens
  Native (MAGA3_HUMAN)
DSILGDPKK

SEQ ID NO: 59705 - protein, 11 aa, Homo sapiens
  Native (MAGA3_HUMAN)
GEVPAAESPDP

SEQ ID NO: 59706 - protein, 11 aa, Homo sapiens
  Native (MAGA3_HUMAN)
HFVQENYLEYR

SEQ ID NO: 59707 - protein, 11 aa, Homo sapiens
  Native (MAGA3_HUMAN)
SSLPTTMNYPL

SEQ ID NO: 59708 - protein, 9 aa, Homo sapiens
  Native (MAGA3_HUMAN)
QEAASSSST

SEQ ID NO: 59709 - protein, 8 aa, Homo sapiens
  Native (MAGA3_HUMAN)
IMPKAGLL

SEQ ID NO: 59710 - protein, 9 aa, Homo sapiens
  Native (MAGA3_HUMAN)
ISGGPHISY

SEQ ID NO: 59711 - protein, 8 aa, Homo sapiens
  Native (MAGA3_HUMAN)
AELVHFLL

SEQ ID NO: 59712 - protein, 11 aa, Homo sapiens
  Native (MAGA3_HUMAN)
VHFLLLKYRAR

SEQ ID NO: 59713 - protein, 10 aa, Homo sapiens
  Native (MAGA3_HUMAN)
RQVPGSDPAC

SEQ ID NO: 59714 - protein, 10 aa, Homo sapiens
  Native (MAGA3_HUMAN)
FFPVIFSKAS

SEQ ID NO: 59715 - protein, 11 aa, Homo sapiens
  Native (MAGA3_HUMAN)
SRKVAELVHFL

SEQ ID NO: 59716 - protein, 8 aa, Homo sapiens
  Native (MAGA3_HUMAN)
HEWVLREG

SEQ ID NO: 59717 - protein, 10 aa, Homo sapiens
  Native (MAGA3_HUMAN)
AALSRKVAEL

SEQ ID NO: 59718 - protein, 8 aa, Homo sapiens
  Native (MAGA3_HUMAN)
GPRALVET

SEQ ID NO: 59719 - protein, 9 aa, Homo sapiens
  Native (MAGA3_HUMAN)
KAGLLIIVL

SEQ ID NO: 59720 - protein, 8 aa, Homo sapiens
  Native (MAGA3_HUMAN)
ARGEALGL

SEQ ID NO: 59721 - protein, 8 aa, Homo sapiens
  Native (MAGA3_HUMAN)
SEFQAALS

SEQ ID NO: 59722 - protein, 10 aa, Homo sapiens
  Native (MAGA3_HUMAN)
SEFQAALSRK

SEQ ID NO: 59723 - protein, 8 aa, Homo sapiens
  Native (MAGA3_HUMAN)
SVVGNWQY

SEQ ID NO: 59724 - protein, 9 aa, Homo sapiens
  Native (MAGA3_HUMAN)
GDNQIMPKA

SEQ ID NO: 59725 - protein, 11 aa, Homo sapiens
  Native (MAGA3_HUMAN)
EEKIWEELSVL

SEQ ID NO: 59726 - protein, 9 aa, Homo sapiens
  Native (MAGA3_HUMAN)
QEEEGPSTF

SEQ ID NO: 59727 - protein, 10 aa, Homo sapiens
  Native (MAGA3_HUMAN)
SYVKVLHHMV

SEQ ID NO: 59728 - protein, 10 aa, Homo sapiens
  Native (MAGA3_HUMAN)
LPTTMNYPLW

SEQ ID NO: 59729 - protein, 9 aa, Homo sapiens
  Native (MAGA3_HUMAN)
SPQGASSLP

SEQ ID NO: 59730 - protein, 11 aa, Homo sapiens
  Native (MAGA3_HUMAN)
IWEELSVLEVF

SEQ ID NO: 59731 - protein, 10 aa, Homo sapiens
  Native (MAGA3_HUMAN)
STFPDLESEF

SEQ ID NO: 59732 - protein, 11 aa, Homo sapiens
  Native (MAGA3_HUMAN)
ALGLVGAQAPA

SEQ ID NO: 59733 - protein, 11 aa, Homo sapiens
  Native (MAGA3_HUMAN)
AREGDCAPEEK

SEQ ID NO: 59734 - protein, 10 aa, Homo sapiens
  Native (MAGA3_HUMAN)
LESEFQAALS

SEQ ID NO: 59735 - protein, 10 aa, Homo sapiens
  Native (MAGA3_HUMAN)
SPDPPQSPQG

SEQ ID NO: 59736 - protein, 8 aa, Homo sapiens
  Native (MAGA3_HUMAN)
SLPTTMNY

SEQ ID NO: 59737 - protein, 10 aa, Homo sapiens
  Native (MAGA3_HUMAN)
ASSLPTTMNY

SEQ ID NO: 59738 - protein, 9 aa, Homo sapiens
  Native (MAGA3_HUMAN)
ILGDPKKLL

SEQ ID NO: 59739 - protein, 10 aa, Homo sapiens
  Native (MAGA3_HUMAN)
GGPHISYPPL

SEQ ID NO: 59740 - protein, 11 aa, Homo sapiens
  Native (MAGA3_HUMAN)
IFSKASSSLQL

SEQ ID NO: 59741 - protein, 10 aa, Homo sapiens
  Native (MAGA3_HUMAN)
TSYVKVLHHM

SEQ ID NO: 59742 - protein, 9 aa, Homo sapiens
  Native (MAGA3_HUMAN)
LVHFLLLKY

SEQ ID NO: 59743 - protein, 9 aa, Homo sapiens
  Native (MAGA3_HUMAN)
VKISGGPHI

SEQ ID NO: 59744 - protein, 9 aa, Homo sapiens
  Native (MAGA3_HUMAN)
PRALVETSY

SEQ ID NO: 59745 - protein, 8 aa, Homo sapiens
  Native (MAGA3_HUMAN)
IFATCLGL

SEQ ID NO: 59746 - protein, 11 aa, Homo sapiens
  Native (MAGA3_HUMAN)
AQAPATEEQEA

SEQ ID NO: 59747 - protein, 11 aa, Homo sapiens
  Native (MAGA3_HUMAN)
ESEFQAALSRK

SEQ ID NO: 59748 - protein, 11 aa, Homo sapiens
  Native (MAGA3_HUMAN)
RALVETSYVKV

SEQ ID NO: 59749 - protein, 8 aa, Homo sapiens
  Native (MAGA3_HUMAN)
QIMPKAGL

SEQ ID NO: 59750 - protein, 8 aa, Homo sapiens
  Native (MAGA3_HUMAN)
FSKASSSL

SEQ ID NO: 59751 - protein, 8 aa, Homo sapiens
  Native (MAGA3_HUMAN)
QAALSRKV

SEQ ID NO: 59752 - protein, 11 aa, Homo sapiens
  Native (MAGA3_HUMAN)
LEARGEALGLV

SEQ ID NO: 59753 - protein, 10 aa, Homo sapiens
  Native (MAGA3_HUMAN)
EEQEAASSSS

SEQ ID NO: 59754 - protein, 10 aa, Homo sapiens
  Native (MAGA3_HUMAN)
SYPPLHEWVL

SEQ ID NO: 59755 - protein, 9 aa, Homo sapiens
  Native (MAGA3_HUMAN)
ENYLEYRQV

SEQ ID NO: 59756 - protein, 11 aa, Homo sapiens
  Native (MAGA3_HUMAN)
AELVHFLLLKY

SEQ ID NO: 59757 - protein, 9 aa, Homo sapiens
  Native (MAGA3_HUMAN)
QHCKPEEGL

SEQ ID NO: 59758 - protein, 11 aa, Homo sapiens
  Native (MAGA3_HUMAN)
SSSSTLVEVTL

SEQ ID NO: 59759 - protein, 9 aa, Homo sapiens
  Native (MAGA3_HUMAN)
DCAPEEKIW

SEQ ID NO: 59760 - protein, 10 aa, Homo sapiens
  Native (MAGA3_HUMAN)
LGSVVGNWQY

SEQ ID NO: 59761 - protein, 10 aa, Homo sapiens
  Native (MAGA3_HUMAN)
YPPLHEWVLR

SEQ ID NO: 59762 - protein, 11 aa, Homo sapiens
  Native (MAGA3_HUMAN)
ELMEVDPIGHL

SEQ ID NO: 59763 - protein, 8 aa, Homo sapiens
  Native (MAGA3_HUMAN)
STLVEVTL

SEQ ID NO: 59764 - protein, 10 aa, Homo sapiens
  Native (MAGA3_HUMAN)
SLPTTMNYPL

SEQ ID NO: 59765 - protein, 8 aa, Homo sapiens
  Native (MAGA3_HUMAN)
EFQAALSR

SEQ ID NO: 59766 - protein, 9 aa, Homo sapiens
  Native (MAGA3_HUMAN)
KPEEGLEAR

SEQ ID NO: 59767 - protein, 9 aa, Homo sapiens
  Native (MAGA3_HUMAN)
YRQVPGSDP

SEQ ID NO: 59768 - protein, 9 aa, Homo sapiens
  Native (MAGA3_HUMAN)
EAASSSSTL

SEQ ID NO: 59769 - protein, 11 aa, Homo sapiens
  Native (MAGA3_HUMAN)
FLWGPRALVET

SEQ ID NO: 59770 - protein, 10 aa, Homo sapiens
  Native (MAGA3_HUMAN)
RALVETSYVK

SEQ ID NO: 59771 - protein, 8 aa, Homo sapiens
  Native (MAGA3_HUMAN)
HFVQENYL

SEQ ID NO: 59772 - protein, 10 aa, Homo sapiens
  Native (MAGA3_HUMAN)
LEARGEALGL

SEQ ID NO: 59773 - protein, 11 aa, Homo sapiens
  Native (MAGA3_HUMAN)
EVFEGREDSIL

SEQ ID NO: 59774 - protein, 10 aa, Homo sapiens
  Native (MAGA3_HUMAN)
QIMPKAGLLI

SEQ ID NO: 59775 - protein, 10 aa, Homo sapiens
  Native (MAGA3_HUMAN)
QENYLEYRQV

SEQ ID NO: 59776 - protein, 8 aa, Homo sapiens
  Native (MAGA3_HUMAN)
LESEFQAA

SEQ ID NO: 59777 - protein, 11 aa, Homo sapiens
  Native (MAGA3_HUMAN)
YEDSSNQEEEG

SEQ ID NO: 59778 - protein, 11 aa, Homo sapiens
  Native (MAGA3_HUMAN)
FPVIFSKASSS

SEQ ID NO: 59779 - protein, 8 aa, Homo sapiens
  Native (MAGA3_HUMAN)
IWEELSVL

SEQ ID NO: 59780 - protein, 9 aa, Homo sapiens
  Native (MAGA3_HUMAN)
SYPPLHEWV

SEQ ID NO: 59781 - protein, 11 aa, Homo sapiens
  Native (MAGA3_HUMAN)
WQYFFPVIFSK

SEQ ID NO: 59782 - protein, 10 aa, Homo sapiens
  Native (MAGA3_HUMAN)
AGLLIIVLAI

SEQ ID NO: 59783 - protein, 8 aa, Homo sapiens
  Native (MAGA3_HUMAN)
EEKIWEEL

SEQ ID NO: 59784 - protein, 9 aa, Homo sapiens
  Native (MAGA3_HUMAN)
GPRALVETS

SEQ ID NO: 59785 - protein, 8 aa, Homo sapiens
  Native (MAGA3_HUMAN)
LSRKVAEL

SEQ ID NO: 59786 - protein, 11 aa, Homo sapiens
  Native (MAGA3_HUMAN)
RKVAELVHFLL

SEQ ID NO: 59787 - protein, 10 aa, Homo sapiens
  Native (MAGA3_HUMAN)
QVPGSDPACY

SEQ ID NO: 59788 - protein, 10 aa, Homo sapiens
  Native (MAGA3_HUMAN)
ALVETSYVKV

SEQ ID NO: 59789 - protein, 10 aa, Homo sapiens
  Native (MAGA3_HUMAN)
ARGEALGLVG

SEQ ID NO: 59790 - protein, 8 aa, Homo sapiens
  Native (MAGA3_HUMAN)
HFLLLKYR

SEQ ID NO: 59791 - protein, 10 aa, Homo sapiens
  Native (MAGA3_HUMAN)
EARGEALGLV

SEQ ID NO: 59792 - protein, 8 aa, Homo sapiens
  Native (MAGA3_HUMAN)
KPEEGLEA

SEQ ID NO: 59793 - protein, 8 aa, Homo sapiens
  Native (MAGA3_HUMAN)
KIWEELSV

SEQ ID NO: 59794 - protein, 9 aa, Homo sapiens
  Native (MAGA3_HUMAN)
RKVAELVHF

SEQ ID NO: 59795 - protein, 9 aa, Homo sapiens
  Native (MAGA3_HUMAN)
LVETSYVKV

SEQ ID NO: 59796 - protein, 9 aa, Homo sapiens
  Native (MAGA3_HUMAN)
YPLWSQSYE

SEQ ID NO: 59797 - protein, 9 aa, Homo sapiens
  Native (MAGA3_HUMAN)
SKASSSLQL

SEQ ID NO: 59798 - protein, 10 aa, Homo sapiens
  Native (MAGA3_HUMAN)
WQYFFPVIFS

SEQ ID NO: 59799 - protein, 11 aa, Homo sapiens
  Native (MAGA3_HUMAN)
EEQEAASSSST

SEQ ID NO: 59800 - protein, 11 aa, Homo sapiens
  Native (MAGA3_HUMAN)
ELVHFLLLKYR

SEQ ID NO: 59801 - protein, 11 aa, Homo sapiens
  Native (MAGA3_HUMAN)
QHFVQENYLEY

SEQ ID NO: 59802 - protein, 8 aa, Homo sapiens
  Native (MAGA3_HUMAN)
EVDPIGHL

SEQ ID NO: 59803 - protein, 8 aa, Homo sapiens
  Native (MAGA3_HUMAN)
ASSLPTTM

SEQ ID NO: 59804 - protein, 10 aa, Homo sapiens
  Native (MAGA3_HUMAN)
TQHFVQENYL

SEQ ID NO: 59805 - protein, 8 aa, Homo sapiens
  Native (MAGA3_HUMAN)
KVAELVHF

SEQ ID NO: 59806 - protein, 11 aa, Homo sapiens
  Native (MAGA3_HUMAN)
APATEEQEAAS

SEQ ID NO: 59807 - protein, 10 aa, Homo sapiens
  Native (MAGA3_HUMAN)
LEQRSQHCKP

SEQ ID NO: 59808 - protein, 8 aa, Homo sapiens
  Native (MAGA3_HUMAN)
EEEGPSTF

SEQ ID NO: 59809 - protein, 10 aa, Homo sapiens
  Native (MAGA3_HUMAN)
LYIFATCLGL

SEQ ID NO: 59810 - protein, 10 aa, Homo sapiens
  Native (MAGA3_HUMAN)
RKVAELVHFL

SEQ ID NO: 59811 - protein, 8 aa, Homo sapiens
  Native (MAGA3_HUMAN)
SGGPHISY

SEQ ID NO: 59812 - protein, 11 aa, Homo sapiens
  Native (MAGA3_HUMAN)
VPGSDPACYEF

SEQ ID NO: 59813 - protein, 8 aa, Homo sapiens
  Native (MAGA3_HUMAN)
GEALGLVG

SEQ ID NO: 59814 - protein, 11 aa, Homo sapiens
  Native (MAGA3_HUMAN)
YIFATCLGLSY

SEQ ID NO: 59815 - protein, 10 aa, Homo sapiens
  Native (MAGA3_HUMAN)
ETSYVKVLHH

SEQ ID NO: 59816 - protein, 10 aa, Homo sapiens
  Native (MAGA3_HUMAN)
EALGLVGAQA

SEQ ID NO: 59817 - protein, 9 aa, Homo sapiens
  Native (MAGA3_HUMAN)
QHFVQENYL

SEQ ID NO: 59818 - protein, 10 aa, Homo sapiens
  Native (MAGA3_HUMAN)
QGASSLPTTM

SEQ ID NO: 59819 - protein, 8 aa, Homo sapiens
  Native (MAGA3_HUMAN)
TTMNYPLW

SEQ ID NO: 59820 - protein, 10 aa, Homo sapiens
  Native (MAGA3_HUMAN)
IMPKAGLLII

SEQ ID NO: 59821 - protein, 8 aa, Homo sapiens
  Native (MAGA3_HUMAN)
NYLEYRQV

SEQ ID NO: 59822 - protein, 10 aa, Homo sapiens
  Native (MAGA3_HUMAN)
EEKIWEELSV

SEQ ID NO: 59823 - protein, 8 aa, Homo sapiens
  Native (MAGA3_HUMAN)
RALVETSY

SEQ ID NO: 59824 - protein, 10 aa, Homo sapiens
  Native (MAGA3_HUMAN)
SSSTLVEVTL

SEQ ID NO: 59825 - protein, 11 aa, Homo sapiens
  Native (MAGA3_HUMAN)
ELSVLEVFEGR

SEQ ID NO: 59826 - protein, 8 aa, Homo sapiens
  Native (MAGA3_HUMAN)
KVLHHMVK

SEQ ID NO: 59827 - protein, 10 aa, Homo sapiens
  Native (MAGA3_HUMAN)
EVTLGEVPAA

SEQ ID NO: 59828 - protein, 9 aa, Homo sapiens
  Native (MAGA3_HUMAN)
ALGLVGAQA

SEQ ID NO: 59829 - protein, 10 aa, Homo sapiens
  Native (MAGA3_HUMAN)
FSKASSSLQL

SEQ ID NO: 59830 - protein, 11 aa, Homo sapiens
  Native (MAGA3_HUMAN)
GASSLPTTMNY

SEQ ID NO: 59831 - protein, 10 aa, Homo sapiens
  Native (MAGA3_HUMAN)
AESPDPPQSP

SEQ ID NO: 59832 - protein, 8 aa, Homo sapiens
  Native (MAGA3_HUMAN)
LYIFATCL

SEQ ID NO: 59833 - protein, 10 aa, Homo sapiens
  Native (MAGA3_HUMAN)
GIELMEVDPI

SEQ ID NO: 59834 - protein, 9 aa, Homo sapiens
  Native (MAGA3_HUMAN)
QIMPKAGLL

SEQ ID NO: 59835 - protein, 9 aa, Homo sapiens
  Native (MAGA3_HUMAN)
VTKAEMLGS

SEQ ID NO: 59836 - protein, 10 aa, Homo sapiens
  Native (MAGA3_HUMAN)
SSSLQLVFGI

SEQ ID NO: 59837 - protein, 10 aa, Homo sapiens
  Native (MAGA3_HUMAN)
ASSSSTLVEV

SEQ ID NO: 59838 - protein, 8 aa, Homo sapiens
  Native (MAGA3_HUMAN)
GHLYIFAT

SEQ ID NO: 59839 - protein, 11 aa, Homo sapiens
  Native (MAGA3_HUMAN)
TEEQEAASSSS

SEQ ID NO: 59840 - protein, 11 aa, Homo sapiens
  Native (MAGA3_HUMAN)
HISYPPLHEWV

SEQ ID NO: 59841 - protein, 9 aa, Homo sapiens
  Native (MAGA3_HUMAN)
EARGEALGL

SEQ ID NO: 59842 - protein, 11 aa, Homo sapiens
  Native (MAGA3_HUMAN)
ARGEALGLVGA

SEQ ID NO: 59843 - protein, 9 aa, Homo sapiens
  Native (MAGA3_HUMAN)
LEARGEALG

SEQ ID NO: 59844 - protein, 10 aa, Homo sapiens
  Native (MAGA3_HUMAN)
GNWQYFFPVI

SEQ ID NO: 59845 - protein, 9 aa, Homo sapiens
  Native (MAGA3_HUMAN)
LHHMVKISG

SEQ ID NO: 59846 - protein, 9 aa, Homo sapiens
  Native (MAGA3_HUMAN)
HHMVKISGG

SEQ ID NO: 59847 - protein, 11 aa, Homo sapiens
  Native (MAGA3_HUMAN)
VPAAESPDPPQ

SEQ ID NO: 59848 - protein, 9 aa, Homo sapiens
  Native (MAGA3_HUMAN)
SDPACYEFL

SEQ ID NO: 59849 - protein, 8 aa, Homo sapiens
  Native (MAGA3_HUMAN)
EELSVLEV

SEQ ID NO: 59850 - protein, 11 aa, Homo sapiens
  Native (MAGA3_HUMAN)
EVDPIGHLYIF

SEQ ID NO: 59851 - protein, 9 aa, Homo sapiens
  Native (MAGA3_HUMAN)
NWQYFFPVI

SEQ ID NO: 59852 - protein, 8 aa, Homo sapiens
  Native (MAGA3_HUMAN)
ATCLGLSY

SEQ ID NO: 59853 - protein, 10 aa, Homo sapiens
  Native (MAGA3_HUMAN)
VTKAEMLGSV

SEQ ID NO: 59854 - protein, 10 aa, Homo sapiens
  Native (MAGA3_HUMAN)
FPDLESEFQA

SEQ ID NO: 59855 - protein, 9 aa, Homo sapiens
  Native (MAGA3_HUMAN)
IFSKASSSL

SEQ ID NO: 59856 - protein, 8 aa, Homo sapiens
  Native (MAGA3_HUMAN)
QEEEGPST

SEQ ID NO: 59857 - protein, 9 aa, Homo sapiens
  Native (MAGA3_HUMAN)
SEFQAALSR

SEQ ID NO: 59858 - protein, 10 aa, Homo sapiens
  Native (MAGA3_HUMAN)
SPQGASSLPT

SEQ ID NO: 59859 - protein, 8 aa, Homo sapiens
  Native (MAGA3_HUMAN)
GPSTFPDL

SEQ ID NO: 59860 - protein, 10 aa, Homo sapiens
  Native (MAGA3_HUMAN)
LIIVLAIIAR

SEQ ID NO: 59861 - protein, 9 aa, Homo sapiens
  Native (MAGA3_HUMAN)
HEWVLREGE

SEQ ID NO: 59862 - protein, 9 aa, Homo sapiens
  Native (MAGA3_HUMAN)
CYEFLWGPR

SEQ ID NO: 59863 - protein, 10 aa, Homo sapiens
  Native (MAGA3_HUMAN)
APATEEQEAA

SEQ ID NO: 59864 - protein, 9 aa, Homo sapiens
  Native (MAGA3_HUMAN)
VDPIGHLYI

SEQ ID NO: 59865 - protein, 9 aa, Homo sapiens
  Native (MAGA3_HUMAN)
PTTMNYPLW

SEQ ID NO: 59866 - protein, 8 aa, Homo sapiens
  Native (MAGA3_HUMAN)
AGLLIIVL

SEQ ID NO: 59867 - protein, 9 aa, Homo sapiens
  Native (MAGA3_HUMAN)
VFGIELMEV

SEQ ID NO: 59868 - protein, 11 aa, Homo sapiens
  Native (MAGA3_HUMAN)
AASSSSTLVEV

SEQ ID NO: 59869 - protein, 11 aa, Homo sapiens
  Native (MAGA3_HUMAN)
VKISGGPHISY

SEQ ID NO: 59870 - protein, 10 aa, Homo sapiens
  Native (MAGA3_HUMAN)
NQEEEGPSTF

SEQ ID NO: 59871 - protein, 9 aa, Homo sapiens
  Native (MAGA3_HUMAN)
LEYRQVPGS

SEQ ID NO: 59872 - protein, 11 aa, Homo sapiens
  Native (MAGA3_HUMAN)
GSVVGNWQYFF

SEQ ID NO: 59873 - protein, 9 aa, Homo sapiens
  Native (MAGA3_HUMAN)
EALGLVGAQ

SEQ ID NO: 59874 - protein, 10 aa, Homo sapiens
  Native (MAGA3_HUMAN)
SDPACYEFLW

SEQ ID NO: 59875 - protein, 9 aa, Homo sapiens
  Native (MAGA3_HUMAN)
VQENYLEYR

SEQ ID NO: 59876 - protein, 10 aa, Homo sapiens
  Native (MAGA3_HUMAN)
LGLVGAQAPA

SEQ ID NO: 59877 - protein, 10 aa, Homo sapiens
  Native (MAGA3_HUMAN)
RGEALGLVGA

SEQ ID NO: 59878 - protein, 8 aa, Homo sapiens
  Native (MAGA3_HUMAN)
KAGLLIIV

SEQ ID NO: 59879 - protein, 11 aa, Homo sapiens
  Native (MAGA3_HUMAN)
SYVKVLHHMVK

SEQ ID NO: 59880 - protein, 9 aa, Homo sapiens
  Native (MAGA3_HUMAN)
GNWQYFFPV

SEQ ID NO: 59881 - protein, 8 aa, Homo sapiens
  Native (MAGA3_HUMAN)
WQYFFPVI

SEQ ID NO: 59882 - protein, 9 aa, Homo sapiens
  Native (MAGA3_HUMAN)
VAELVHFLL

SEQ ID NO: 59883 - protein, 11 aa, Homo sapiens
  Native (MAGA3_HUMAN)
GREDSILGDPK

SEQ ID NO: 59884 - protein, 11 aa, Homo sapiens
  Native (MAGA3_HUMAN)
EEEGPSTFPDL

SEQ ID NO: 59885 - protein, 9 aa, Homo sapiens
  Native (MAGA3_HUMAN)
EEQEAASSS

SEQ ID NO: 59886 - protein, 9 aa, Homo sapiens
  Native (MAGA3_HUMAN)
YPPLHEWVL

SEQ ID NO: 59887 - protein, 10 aa, Homo sapiens
  Native (MAGA3_HUMAN)
LTQHFVQENY

SEQ ID NO: 59888 - protein, 9 aa, Homo sapiens
  Native (MAGA3_HUMAN)
FEGREDSIL

SEQ ID NO: 59889 - protein, 9 aa, Homo sapiens
  Native (MAGA3_HUMAN)
PEEKIWEEL

SEQ ID NO: 59890 - protein, 11 aa, Homo sapiens
  Native (MAGA3_HUMAN)
TLVEVTLGEVP

SEQ ID NO: 59891 - protein, 11 aa, Homo sapiens
  Native (MAGA3_HUMAN)
AESPDPPQSPQ

SEQ ID NO: 59892 - protein, 10 aa, Homo sapiens
  Native (MAGA3_HUMAN)
MPLEQRSQHC

SEQ ID NO: 59893 - protein, 8 aa, Homo sapiens
  Native (MAGA3_HUMAN)
ELVHFLLL

SEQ ID NO: 59894 - protein, 11 aa, Homo sapiens
  Native (MAGA3_HUMAN)
KIWEELSVLEV

SEQ ID NO: 59895 - protein, 9 aa, Homo sapiens
  Native (MAGA3_HUMAN)
GSVVGNWQY

SEQ ID NO: 59896 - protein, 10 aa, Homo sapiens
  Native (MAGA3_HUMAN)
QEAASSSSTL

SEQ ID NO: 59897 - protein, 10 aa, Homo sapiens
  Native (MAGA3_HUMAN)
SQHCKPEEGL

SEQ ID NO: 59898 - protein, 9 aa, Homo sapiens
  Native (MAGA3_HUMAN)
LLIIVLAII

SEQ ID NO: 59899 - protein, 8 aa, Homo sapiens
  Native (MAGA3_HUMAN)
FEGREDSI

SEQ ID NO: 59900 - protein, 9 aa, Homo sapiens
  Native (MAGA3_HUMAN)
ARGEALGLV

SEQ ID NO: 59901 - protein, 8 aa, Homo sapiens
  Native (MAGA3_HUMAN)
VLHHMVKI

SEQ ID NO: 59902 - protein, 9 aa, Homo sapiens
  Native (MAGA3_HUMAN)
IELMEVDPI

SEQ ID NO: 59903 - protein, 9 aa, Homo sapiens
  Native (MAGA3_HUMAN)
EFQAALSRK

SEQ ID NO: 59904 - protein, 10 aa, Homo sapiens
  Native (MAGA3_HUMAN)
VFEGREDSIL

SEQ ID NO: 59905 - protein, 9 aa, Homo sapiens
  Native (MAGA3_HUMAN)
GHLYIFATC

SEQ ID NO: 59906 - protein, 8 aa, Homo sapiens
  Native (MAGA3_HUMAN)
YPLWSQSY

SEQ ID NO: 59907 - protein, 10 aa, Homo sapiens
  Native (MAGA3_HUMAN)
GSVVGNWQYF

SEQ ID NO: 59908 - protein, 11 aa, Homo sapiens
  Native (MAGA3_HUMAN)
REGDCAPEEKI

SEQ ID NO: 59909 - protein, 10 aa, Homo sapiens
  Native (MAGA3_HUMAN)
GPSTFPDLES

SEQ ID NO: 59910 - protein, 9 aa, Homo sapiens
  Native (MAGA3_HUMAN)
FQAALSRKV

SEQ ID NO: 59911 - protein, 9 aa, Homo sapiens
  Native (MAGA3_HUMAN)
SILGDPKKL

SEQ ID NO: 59912 - protein, 8 aa, Homo sapiens
  Native (MAGA3_HUMAN)
LGDPKKLL

SEQ ID NO: 59913 - protein, 8 aa, Homo sapiens
  Native (MAGA3_HUMAN)
LEARGEAL

SEQ ID NO: 59914 - protein, 11 aa, Homo sapiens
  Native (MAGA3_HUMAN)
SGGPHISYPPL

SEQ ID NO: 59915 - protein, 8 aa, Homo sapiens
  Native (MAGA3_HUMAN)
VHFLLLKY

SEQ ID NO: 59916 - protein, 8 aa, Homo sapiens
  Native (MAGA3_HUMAN)
IVLAIIAR

SEQ ID NO: 59917 - protein, 9 aa, Homo sapiens
  Native (MAGA3_HUMAN)
EGPSTFPDL

SEQ ID NO: 59918 - protein, 10 aa, Homo sapiens
  Native (MAGA3_HUMAN)
ELVHFLLLKY

SEQ ID NO: 59919 - protein, 10 aa, Homo sapiens
  Native (MAGA3_HUMAN)
KVAELVHFLL

SEQ ID NO: 59920 - protein, 10 aa, Homo sapiens
  Native (MAGA3_HUMAN)
YFFPVIFSKA

SEQ ID NO: 59921 - protein, 11 aa, Homo sapiens
  Native (MAGA3_HUMAN)
SKASSSLQLVF

SEQ ID NO: 59922 - protein, 10 aa, Homo sapiens
  Native (MAGA3_HUMAN)
TLVEVTLGEV

SEQ ID NO: 59923 - protein, 8 aa, Homo sapiens
  Native (MAGA3_HUMAN)
KKLLTQHF

SEQ ID NO: 59924 - protein, 11 aa, Homo sapiens
  Native (MAGA3_HUMAN)
GEALGLVGAQA

SEQ ID NO: 59925 - protein, 10 aa, Homo sapiens
  Native (MAGA3_HUMAN)
IFATCLGLSY

SEQ ID NO: 59926 - protein, 11 aa, Homo sapiens
  Native (MAGA3_HUMAN)
GDNQIMPKAGL

SEQ ID NO: 59927 - protein, 9 aa, Homo sapiens
  Native (MAGA3_HUMAN)
TKAEMLGSV

SEQ ID NO: 59928 - protein, 11 aa, Homo sapiens
  Native (MAGA3_HUMAN)
IMPKAGLLIIV

SEQ ID NO: 59929 - protein, 9 aa, Homo sapiens
  Native (MAGA3_HUMAN)
VVGNWQYFF

SEQ ID NO: 59930 - protein, 8 aa, Homo sapiens
  Native (MAGA3_HUMAN)
SYPPLHEW

SEQ ID NO: 59931 - protein, 10 aa, Homo sapiens
  Native (MAGA3_HUMAN)
VAELVHFLLL

SEQ ID NO: 59932 - protein, 10 aa, Homo sapiens
  Native (MAGA3_HUMAN)
APEEKIWEEL

SEQ ID NO: 59933 - protein, 10 aa, Homo sapiens
  Native (MAGA3_HUMAN)
QYFFPVIFSK

SEQ ID NO: 59934 - protein, 10 aa, Homo sapiens
  Native (MAGA3_HUMAN)
YEDSSNQEEE

SEQ ID NO: 59935 - protein, 11 aa, Homo sapiens
  Native (MAGA3_HUMAN)
GPRALVETSYV

SEQ ID NO: 59936 - protein, 9 aa, Homo sapiens
  Native (MAGA3_HUMAN)
WEELSVLEV

SEQ ID NO: 59937 - protein, 10 aa, Homo sapiens
  Native (MAGA3_HUMAN)
LQLVFGIELM

SEQ ID NO: 59938 - protein, 9 aa, Homo sapiens
  Native (MAGA3_HUMAN)
VFEGREDSI

SEQ ID NO: 59939 - protein, 11 aa, Homo sapiens
  Native (MAGA3_HUMAN)
SLPTTMNYPLW

SEQ ID NO: 59940 - protein, 10 aa, Homo sapiens
  Native (MAGA3_HUMAN)
HISYPPLHEW

SEQ ID NO: 59941 - protein, 11 aa, Homo sapiens
  Native (MAGA3_HUMAN)
STFPDLESEFQ

SEQ ID NO: 59942 - protein, 10 aa, Homo sapiens
  Native (MAGA3_HUMAN)
LVETSYVKVL

SEQ ID NO: 59943 - protein, 8 aa, Homo sapiens
  Native (MAGA3_HUMAN)
KASSSLQL

SEQ ID NO: 59944 - protein, 8 aa, Homo sapiens
  Native (MAGA3_HUMAN)
VETSYVKV

SEQ ID NO: 59945 - protein, 10 aa, Homo sapiens
  Native (MAGA3_HUMAN)
DLESEFQAAL

SEQ ID NO: 59946 - protein, 8 aa, Homo sapiens
  Native (MAGA3_HUMAN)
CAPEEKIW

SEQ ID NO: 59947 - protein, 9 aa, Homo sapiens
  Native (MAGA3_HUMAN)
SVVGNWQYF

SEQ ID NO: 59948 - protein, 10 aa, Homo sapiens
  Native (MAGA3_HUMAN)
LMEVDPIGHL

SEQ ID NO: 59949 - protein, 9 aa, Homo sapiens
  Native (MAGA3_HUMAN)
IIVLAIIAR

SEQ ID NO: 59950 - protein, 9 aa, Homo sapiens
  Native (MAGA3_HUMAN)
QAALSRKVA

SEQ ID NO: 59951 - protein, 11 aa, Homo sapiens
  Native (MAGA3_HUMAN)
QLVFGIELMEV

SEQ ID NO: 59952 - protein, 8 aa, Homo sapiens
  Native (MAGA3_HUMAN)
LGSVVGNW

SEQ ID NO: 59953 - protein, 11 aa, Homo sapiens
  Native (MAGA3_HUMAN)
SYPPLHEWVLR

SEQ ID NO: 59954 - protein, 10 aa, Homo sapiens
  Native (MAGA3_HUMAN)
HFVQENYLEY

SEQ ID NO: 59955 - protein, 8 aa, Homo sapiens
  Native (MAGA3_HUMAN)
DPIGHLYI

SEQ ID NO: 59956 - protein, 9 aa, Homo sapiens
  Native (MAGA3_HUMAN)
APATEEQEA

SEQ ID NO: 59957 - protein, 11 aa, Homo sapiens
  Native (MAGA3_HUMAN)
YRQVPGSDPAC

SEQ ID NO: 59958 - protein, 11 aa, Homo sapiens
  Native (MAGA3_HUMAN)
VEVTLGEVPAA

SEQ ID NO: 59959 - protein, 11 aa, Homo sapiens
  Native (MAGA3_HUMAN)
CAPEEKIWEEL

SEQ ID NO: 59960 - protein, 9 aa, Homo sapiens
  Native (MAGA3_HUMAN)
GLVGAQAPA

SEQ ID NO: 59961 - protein, 10 aa, Homo sapiens
  Native (MAGA3_HUMAN)
VEVTLGEVPA

SEQ ID NO: 59962 - protein, 9 aa, Homo sapiens
  Native (MAGA3_HUMAN)
AESPDPPQS

SEQ ID NO: 59963 - protein, 9 aa, Homo sapiens
  Native (MAGA3_HUMAN)
YEDSSNQEE

SEQ ID NO: 59964 - protein, 10 aa, Homo sapiens
  Native (MAGA3_HUMAN)
KAEMLGSVVG

SEQ ID NO: 59965 - protein, 10 aa, Homo sapiens
  Native (MAGA3_HUMAN)
FQAALSRKVA

SEQ ID NO: 59966 - protein, 8 aa, Homo sapiens
  Native (MAGA3_HUMAN)
DPACYEFL

SEQ ID NO: 59967 - protein, 10 aa, Homo sapiens
  Native (MAGA3_HUMAN)
YLEYRQVPGS

SEQ ID NO: 59968 - protein, 8 aa, Homo sapiens
  Native (MAGA3_HUMAN)
PACYEFLW

SEQ ID NO: 59969 - protein, 9 aa, Homo sapiens
  Native (MAGA3_HUMAN)
MVKISGGPH

SEQ ID NO: 59970 - protein, 10 aa, Homo sapiens
  Native (MAGA3_HUMAN)
FPVIFSKASS

SEQ ID NO: 59971 - protein, 8 aa, Homo sapiens
  Native (MAGA3_HUMAN)
SSSTLVEV

SEQ ID NO: 59972 - protein, 11 aa, Homo sapiens
  Native (MAGA3_HUMAN)
LGSVVGNWQYF

SEQ ID NO: 59973 - protein, 8 aa, Homo sapiens
  Native (MAGA3_HUMAN)
VDPIGHLY

SEQ ID NO: 59974 - protein, 10 aa, Homo sapiens
  Native (MAGA3_HUMAN)
YIFATCLGLS

SEQ ID NO: 59975 - protein, 9 aa, Homo sapiens
  Native (MAGA3_HUMAN)
REGDCAPEE

SEQ ID NO: 59976 - protein, 8 aa, Homo sapiens
  Native (MAGA3_HUMAN)
ALVETSYV

SEQ ID NO: 59977 - protein, 9 aa, Homo sapiens
  Native (MAGA3_HUMAN)
TEEQEAASS

SEQ ID NO: 59978 - protein, 11 aa, Homo sapiens
  Native (MAGA3_HUMAN)
LEYRQVPGSDP

SEQ ID NO: 59979 - protein, 11 aa, Homo sapiens
  Native (MAGA3_HUMAN)
LLTQHFVQENY

SEQ ID NO: 59980 - protein, 11 aa, Homo sapiens
  Native (MAGA3_HUMAN)
QEAASSSSTLV

SEQ ID NO: 59981 - protein, 8 aa, Homo sapiens
  Native (MAGA3_HUMAN)
VAELVHFL

SEQ ID NO: 59982 - protein, 11 aa, Homo sapiens
  Native (MAGA3_HUMAN)
ACYEFLWGPRA

SEQ ID NO: 59983 - protein, 11 aa, Homo sapiens
  Native (MAGA3_HUMAN)
HLYIFATCLGL

SEQ ID NO: 59984 - protein, 9 aa, Homo sapiens
  Native (MAGA3_HUMAN)
VEVTLGEVP

SEQ ID NO: 59985 - protein, 10 aa, Homo sapiens
  Native (MAGA3_HUMAN)
WEELSVLEVF

SEQ ID NO: 59986 - protein, 10 aa, Artificial Sequence
  Description of Artificial Sequence: Synthetic peptide
  Seed: AALSRKVAEL (MAGA3_HUMAN)
  misc_feature (2)..(2): Xaa can be Ala, Leu, Met, Thr, Ser, Val, Glu, Gln, Phe, Pro, Ile, Gly, Arg, Asn, His, Tyr, Cys, Lys, Trp, or Asp
  misc_feature (10)..(10): Xaa can be Ala, Val, Ile, Leu, Met, Tyr, Phe, Thr, Trp, or His
AXLSRKVAEX

SEQ ID NO: 59987 - protein, 8 aa, Artificial Sequence
  Description of Artificial Sequence: Synthetic peptide
  Seed: AASSSSTL (MAGA3_HUMAN)
  misc_feature (2)..(2): Xaa can be Ala, Ser, Val, Thr, or Ile
  misc_feature (8)..(8): Xaa can be Tyr, Leu, Phe, Met, His, Val, or Ile
AXSSSSTX

SEQ ID NO: 59988 - protein, 9 aa, Artificial Sequence
  Description of Artificial Sequence: Synthetic peptide
  Seed: AASSSSTLV (MAGA3_HUMAN)
  misc_feature (2)..(2): Xaa can be Ala, Thr, Val, Ile, Gln, Leu, Ser, Met, Gly, Pro, Glu, Phe, Arg, Asn, Tyr, Cys, His, Asp, Trp, or Lys
  misc_feature (9)..(9): Xaa can be Leu, Phe, Met, Tyr, Ile, Val, Lys, Arg, His, Ala, Trp, Thr, or Cys
AXSSSSTLX

SEQ ID NO: 59989 - protein, 11 aa, Artificial Sequence
  Description of Artificial Sequence: Synthetic peptide
  Seed: AASSSSTLVEV (MAGA3_HUMAN)
  misc_feature (2)..(2): Xaa can be Ala, Ile, Val, Met, Leu, Thr, Ser, Gly, Gln, Cys, Pro, Glu, Asn, Phe, or Asp
  misc_feature (11)..(11): Xaa can be Lys, Arg, Tyr, Leu, Phe, Met, Ile, His, Trp, Val, Ala, Cys, or Gln
AXSSSSTLVEX

SEQ ID NO: 59990 - protein, 10 aa, Artificial Sequence
  Description of Artificial Sequence: Synthetic peptide
  Seed: ACYEFLWGPR (MAGA3_HUMAN)
  misc_feature (2)..(2): Xaa can be Leu, Met, Ser, Thr, Trp, Val, Ile, Tyr, Phe, Gln, Asn, Asp, Pro, Gly, Arg, Glu, Lys, Cys, His, or Ala
  misc_feature (10)..(10): Xaa can be Lys, Arg, His, Tyr, or Leu
AXYEFLWGPX

SEQ ID NO: 59991 - protein, 11 aa, Artificial Sequence
  Description of Artificial Sequence: Synthetic peptide
  Seed: ACYEFLWGPRA (MAGA3_HUMAN)
  misc_feature (2)..(2): Xaa can be Glu, Lys, Asp, Cys, Leu, His, Phe, Val, Ala, Pro, Trp, Arg, Thr, Tyr, Met, Asn, Ser, Ile, Gly, or Gln
  misc_feature (11)..(11): Xaa can be Ala, Pro, Ile, or Val
AXYEFLWGPRX

SEQ ID NO: 59992 - protein, 8 aa, Artificial Sequence
  Description of Artificial Sequence: Synthetic peptide
  Seed: AELVHFLL (MAGA3_HUMAN)
  misc_feature (2)..(2): Xaa can be Glu, Asp, Gln, Ser, Ala, Met, Asn, Gly, or Arg
  misc_feature (8)..(8): Xaa can be Ile, Val, Leu, Phe, Trp, Met, Tyr, Ala, Pro, Gly, Ser, His, Thr, or Cys
AXLVHFLX

SEQ ID NO: 59993 - protein, 9 aa, Artificial Sequence
  Description of Artificial Sequence: Synthetic peptide
  Seed: AELVHFLLL (MAGA3_HUMAN)
  misc_feature (2)..(2): Xaa can be Glu, Gln, Asp, Arg, Met, Lys, Val, Leu, Ser, Ala, Ile, Asn, Thr, His, Gly, Pro, Tyr, or Ph e
  misc_feature (9)..(9): Xaa can be Leu, Tyr, Met, Phe, Val, Ile, Trp, Ala, Cys, His, Thr, Arg, Pro, Lys, Gly, Glu, Asn, Gln, Ser, or Asp
AXLVHFLLX

SEQ ID NO: 59994 - protein, 10 aa, Artificial Sequence
  Description of Artificial Sequence: Synthetic peptide
  Seed: AELVHFLLLK (MAGA3_HUMAN)
  misc_feature (2)..(2): Xaa can be Glu, Thr, Met, Ile, Val, Lys, Ser, Ala, Leu, Arg, Cys, Trp, Pro, Asp, Gly, His, Phe, Gln, Asn, or Tyr
  misc_feature (10)..(10): Xaa can be Arg, Lys, Tyr, His, Val, Gln, Ala, Thr, Phe, Asn, Cys, Pro, Trp, Ser, Glu, Asp, Gly, Leu, Met, or Ile
AXLVHFLLLX

SEQ ID NO: 59995 - protein, 11 aa, Artificial Sequence
  Description of Artificial Sequence: Synthetic peptide
  Seed: AELVHFLLLKY (MAGA3_HUMAN)
  misc_feature (2)..(2): Xaa can be , or Glu
  misc_feature (11)..(11): Xaa can be Tyr, Phe, or Trp
AXLVHFLLLKX

SEQ ID NO: 59996 - protein, 8 aa, Artificial Sequence
  Description of Artificial Sequence: Synthetic peptide
  Seed: AEMLGSVV (MAGA3_HUMAN)
  misc_feature (2)..(2): Xaa can be Glu, Asp, Gln, Ser, Met, Gly, Ala, Ile, Val, Leu, Thr, or Asn
  misc_feature (8)..(8): Xaa can be Val, Ile, Leu, Phe, Trp, Met, Tyr, Cys, Ala, Gly, Thr, His, Pro, or Ser
AXMLGSVX

SEQ ID NO: 59997 - protein, 9 aa, Artificial Sequence
  Description of Artificial Sequence: Synthetic peptide
  Seed: AEMLGSVVG (MAGA3_HUMAN)
  misc_feature (2)..(2): Xaa can be Glu, Asp, Gln, Ser, Lys, Asn, or Ala
  misc_feature (9)..(9): Xaa can be Trp, Leu, Phe, Tyr, Ile, Ala, Ser, Cys, Pro, Val, Thr, Met, Gly, Gln, Asn, Asp, Arg, Lys, Glu, or His
AXMLGSVVX

SEQ ID NO: 59998 - protein, 10 aa, Artificial Sequence
  Description of Artificial Sequence: Synthetic peptide
  Seed: AEMLGSVVGN (MAGA3_HUMAN)
  misc_feature (2)..(2): Xaa can be Glu, Asp, or Gln
  misc_feature (10)..(10): Xaa can be Trp, Asn, Leu, Gly, Ala, Thr, Val, Met, Ile, Phe, or Tyr
AXMLGSVVGX

SEQ ID NO: 59999 - protein, 11 aa, Artificial Sequence
  Description of Artificial Sequence: Synthetic peptide
  Seed: AEMLGSVVGNW (MAGA3_HUMAN)
  misc_feature (2)..(2): Xaa can be Glu, Gln, Asp, Ser, Thr, Met, Leu, Ala, Ile, Arg, Val, Lys, Gly, Cys, Asn, His, Tyr, Phe, Pro, or Trp
  misc_feature (11)..(11): Xaa can be Tyr, Trp, Phe, Met, Leu, Ile, Ala, His, Val, Cys, Arg, Thr, Pro, Lys, Ser, or Gly
AXMLGSVVGNX

SEQ ID NO: 60000 - protein, 9 aa, Artificial Sequence
  Description of Artificial Sequence: Synthetic peptide
  Seed: AESPDPPQS (MAGA3_HUMAN)
  misc_feature (2)..(2): Xaa can be Glu, Asp, Gln, Ala, Val, Ser, or Ile
  misc_feature (9)..(9): Xaa can be Leu, Met, Phe, Thr, Tyr, Val, Ile, Ala, Cys, Trp, Pro, Lys, Arg, Gly, Ser, Gln, Asp, His, Asn, or Glu
AXSPDPPQX

SEQ ID NO: 60001 - protein, 10 aa, Artificial Sequence
  Description of Artificial Sequence: Synthetic peptide
  Seed: AESPDPPQSP (MAGA3_HUMAN)
  misc_feature (2)..(2): Xaa can be Glu, Asp, Gln, Ala, Ser, Pro, Val, Ile, or Lys
  misc_feature (10)..(10): Xaa can be Leu, Phe, Met, Trp, Val, Pro, Tyr, Cys, Ile, Ala, Thr, Lys, Arg, Asn, Glu, Gly, Gln, Ser, Asp, or His
AXSPDPPQSX

SEQ ID NO: 60002 - protein, 11 aa, Artificial Sequence
  Description of Artificial Sequence: Synthetic peptide
  Seed: AESPDPPQSPQ (MAGA3_HUMAN)
  misc_feature (2)..(2): Xaa can be Glu, Gln, or Asp
  misc_feature (11)..(11): Xaa can be Val, Phe, Ala, Ile, Met, Leu, Cys, His, Trp, Asp, Ser, Tyr, Lys, Thr, Pro, Glu, Arg, Gly, Gln, or Asn
AXSPDPPQSPX

SEQ ID NO: 60003 - protein, 8 aa, Artificial Sequence
  Description of Artificial Sequence: Synthetic peptide
  Seed: AGLLIIVL (MAGA3_HUMAN)
  misc_feature (2)..(2): Xaa can be Gln, Glu, Met, Ser, Gly, Ala, His, Asp, Asn, Val, Pro, Thr, Lys, Leu, or Ile
  misc_feature (8)..(8): Xaa can be Val, Ile, Leu, Met, Ala, Cys, or Phe
AXLLIIVX

SEQ ID NO: 60004 - protein, 10 aa, Artificial Sequence
  Description of Artificial Sequence: Synthetic peptide
  Seed: AGLLIIVLAI (MAGA3_HUMAN)
  misc_feature (2)..(2): Xaa can be Met, Leu, Ala, Cys, Asn, Asp, Gly, Val, Thr, Arg, Trp, His, Glu, Lys, Pro, Tyr, Gln, Ile, Ser, or Phe
  misc_feature (10)..(10): Xaa can be Val, Leu, Ile, or Ala
AXLLIIVLAX

SEQ ID NO: 60005 - protein, 9 aa, Artificial Sequence
  Description of Artificial Sequence: Synthetic peptide
  Seed: ALGLVGAQA (MAGA3_HUMAN)
  misc_feature (2)..(2): Xaa can be Met, Leu, Ile, Gln, Val, Thr, Ser, or Ala
  misc_feature (9)..(9): Xaa can be Val, Ile, Leu, Ala, Thr, or Met
AXGLVGAQX

SEQ ID NO: 60006 - protein, 11 aa, Artificial Sequence
  Description of Artificial Sequence: Synthetic peptide
  Seed: ALGLVGAQAPA (MAGA3_HUMAN)
  misc_feature (2)..(2): Xaa can be Phe, Met, Asn, Gln, Leu, Lys, Cys, Arg, Asp, Trp, Glu, Ile, His, Val, Ser, Thr, Tyr, Gly, Pro, or Ala
  misc_feature (11)..(11): Xaa can be Ala, Val, Ile, or Leu
AXGLVGAQAPX

SEQ ID NO: 60007 - protein, 9 aa, Artificial Sequence
  Description of Artificial Sequence: Synthetic peptide
  Seed: ALSRKVAEL (MAGA3_HUMAN)
  misc_feature (2)..(2): Xaa can be Met, Leu, Arg, Gln, Ala, Val, Thr, Ile, Tyr, Gly, Ser, Glu, Asn, Pro, Phe, Lys, Asp, Trp, His, or Cys
  misc_feature (9)..(9): Xaa can be Phe, Leu, Tyr, Val, Met, Ile, Arg, Trp, Lys, His, Ala, Cys, Ser, Thr, or Gln
AXSRKVAEX

SEQ ID NO: 60008 - protein, 10 aa, Artificial Sequence
  Description of Artificial Sequence: Synthetic peptide
  Seed: ALSRKVAELV (MAGA3_HUMAN)
  misc_feature (2)..(2): Xaa can be Leu, Gln, Met, Ile, or Val
  misc_feature (10)..(10): Xaa can be Val, Leu, Ile, Met, Ala, or Phe
AXSRKVAELX

SEQ ID NO: 60009 - protein, 8 aa, Artificial Sequence
  Description of Artificial Sequence: Synthetic peptide
  Seed: ALVETSYV (MAGA3_HUMAN)
  misc_feature (2)..(2): Xaa can be Leu, or Met
  misc_feature (8)..(8): Xaa can be Val, Ile, or Leu
AXVETSYX

SEQ ID NO: 60010 - protein, 9 aa, Artificial Sequence
  Description of Artificial Sequence: Synthetic peptide
  Seed: ALVETSYVK (MAGA3_HUMAN)
  misc_feature (2)..(2): Xaa can be Ala, Met, Thr, Ser, Val, Leu, Ile, Gly, Gln, Asn, Asp, Phe, Cys, Trp, Tyr, or Pro
  misc_feature (9)..(9): Xaa can be Lys, Arg, Tyr, Leu, Met, Ile, Phe, Val, His, or Ala
AXVETSYVX

SEQ ID NO: 60011 - protein, 10 aa, Artificial Sequence
  Description of Artificial Sequence: Synthetic peptide
  Seed: ALVETSYVKV (MAGA3_HUMAN)
  misc_feature (2)..(2): Xaa can be Gln, Leu, Met, Val, Ile, Thr, Glu, Ser, Ala, Phe, Gly, Asn, Tyr, or Trp
  misc_feature (10)..(10): Xaa can be Arg, Lys, Val, Leu, Ile, Tyr, Met, Ala, Phe, Thr, Trp, or Cys
AXVETSYVKX

SEQ ID NO: 60012 - protein, 11 aa, Artificial Sequence
  Description of Artificial Sequence: Synthetic peptide
  Seed: ALVETSYVKVL (MAGA3_HUMAN)
  misc_feature (2)..(2): Xaa can be Leu, Met, Glu, Asp, Ile, Trp, Gln, Thr, Arg, Tyr, Asn, Gly, Ala, Phe, Val, His, Lys, Ser, Pro, or Cys
  misc_feature (11)..(11): Xaa can be Leu, Phe, Met, Ile, Val, Ser, Tyr, Arg, Ala, Trp, Asp, Pro, Gly, Thr, Glu, Asn, His, Gln, Cys, or Lys
AXVETSYVKVX

SEQ ID NO: 60013 - protein, 9 aa, Artificial Sequence
  Description of Artificial Sequence: Synthetic peptide
  Seed: APATEEQEA (MAGA3_HUMAN)
  misc_feature (2)..(2): Xaa can be Pro, or Ala
  misc_feature (9)..(9): Xaa can be Leu, Cys, Tyr, Val, Pro, Phe, Ala, Thr, Met, or Ile
AXATEEQEX

SEQ ID NO: 60014 - protein, 10 aa, Artificial Sequence
  Description of Artificial Sequence: Synthetic peptide
  Seed: APATEEQEAA (MAGA3_HUMAN)
  misc_feature (2)..(2): Xaa can be , or Pro
  misc_feature (10)..(10): Xaa can be Phe, Ile, Tyr, Ala, Pro, Thr, Met, Val, Cys, or Leu
AXATEEQEAX

SEQ ID NO: 60015 - protein, 11 aa, Artificial Sequence
  Description of Artificial Sequence: Synthetic peptide
  Seed: APATEEQEAAS (MAGA3_HUMAN)
  misc_feature (2)..(2): Xaa can be , or Pro
  misc_feature (11)..(11): Xaa can be Gly, Ala, Cys, Tyr, Phe, Met, Thr, Ser, Val, Pro, Leu, or Ile
AXATEEQEAAX

SEQ ID NO: 60016 - protein, 10 aa, Artificial Sequence
  Description of Artificial Sequence: Synthetic peptide
  Seed: APEEKIWEEL (MAGA3_HUMAN)
  misc_feature (2)..(2): Xaa can be Pro, Glu, Ala, Asp, Lys, Ser, Val, Thr, Met, Gly, Arg, Trp, Cys, His, Gln, Asn, Tyr, Leu, Ile, or Phe
  misc_feature (10)..(10): Xaa can be Met, Leu, Phe, Tyr, Ile, Ala, Trp, or Val
AXEEKIWEEX

SEQ ID NO: 60017 - protein, 9 aa, Artificial Sequence
  Description of Artificial Sequence: Synthetic peptide
  Seed: AQAPATEEQ (MAGA3_HUMAN)
  misc_feature (2)..(2): Xaa can be Gln, Met, Ala, Leu, Ser, Val, Ile, Thr, Glu, Pro, Lys, Gly, Phe, Arg, Tyr, Trp, Asn, Cys, His, or Asp
  misc_feature (9)..(9): Xaa can be Met, Phe, Tyr, Leu, Trp, Ile, His, Val, Ala, Cys, Lys, Thr, Arg, or Gln
AXAPATEEX

SEQ ID NO: 60018 - protein, 11 aa, Artificial Sequence
  Description of Artificial Sequence: Synthetic peptide
  Seed: AQAPATEEQEA (MAGA3_HUMAN)
  misc_feature (2)..(2): Xaa can be Glu, Gln, Met, Leu, Asp, Ile, Val, Ser, Thr, Ala, Asn, His, Gly, Arg, Lys, Phe, Cys, or Ty r
  misc_feature (11)..(11): Xaa can be Trp, Phe, Leu, Ile, Met, Val, Tyr, Cys, Ala, Thr, His, Arg, Pro, Asn, Asp, Gln, Ser, Gly, Glu, or Lys
AXAPATEEQEX

SEQ ID NO: 60019 - protein, 11 aa, Artificial Sequence
  Description of Artificial Sequence: Synthetic peptide
  Seed: AREGDCAPEEK (MAGA3_HUMAN)
  misc_feature (2)..(2): Xaa can be Arg, Gly, Glu, Gln, Val, Ile, Ala, Asp, or Asn
  misc_feature (11)..(11): Xaa can be Lys, Arg, Glu, Phe, Met, Leu, Tyr, or Trp
AXEGDCAPEEX

SEQ ID NO: 60020 - protein, 8 aa, Artificial Sequence
  Description of Artificial Sequence: Synthetic peptide
  Seed: ARGEALGL (MAGA3_HUMAN)
  misc_feature (2)..(2): Xaa can be Arg, Tyr, Phe, His, Ala, Gly, Gln, or Ser
  misc_feature (8)..(8): Xaa can be Leu, Tyr, Phe, Met, Ile, or Val
AXGEALGX

SEQ ID NO: 60021 - protein, 9 aa, Artificial Sequence
  Description of Artificial Sequence: Synthetic peptide
  Seed: ARGEALGLV (MAGA3_HUMAN)
  misc_feature (2)..(2): Xaa can be Arg, Ala, Gln, Tyr, Phe, His, Gly, Trp, Ser, Leu, Lys, Ile, Val, Met, Glu, Asn, or Thr
  misc_feature (9)..(9): Xaa can be Leu, Met, Phe, Tyr, Ile, Lys, Val, Arg, His, Cys, Pro, Ala, or Trp
AXGEALGLX

SEQ ID NO: 60022 - protein, 10 aa, Artificial Sequence
  Description of Artificial Sequence: Synthetic peptide
  Seed: ARGEALGLVG (MAGA3_HUMAN)
  misc_feature (2)..(2): Xaa can be Arg, Gln, or His
  misc_feature (10)..(10): Xaa can be Leu, Met, Phe, Ala, Trp, Cys, Ser, Ile, Val, Arg, Tyr, Thr, Pro, Gly, or Lys
AXGEALGLVX

SEQ ID NO: 60023 - protein, 11 aa, Artificial Sequence
  Description of Artificial Sequence: Synthetic peptide
  Seed: ARGEALGLVGA (MAGA3_HUMAN)
  misc_feature (2)..(2): Xaa can be Arg, Gly, His, Tyr, Gln, Asn, Ala, Lys, Phe, Glu, Met, Pro, Ser, Ile, Thr, Asp, Leu, Trp, Cys, or Val
  misc_feature (11)..(11): Xaa can be Ala, Lys, Phe, Arg, Leu, Tyr, Met, His, Glu, Gln, Asn, Trp, Ile, Val, Thr, Pro, Ser, Cys, or Gly
AXGEALGLVGX

SEQ ID NO: 60024 - protein, 8 aa, Artificial Sequence
  Description of Artificial Sequence: Synthetic peptide
  Seed: ASSLPTTM (MAGA3_HUMAN)
  misc_feature (2)..(2): Xaa can be Ala, Ile, Val, Ser, Thr, Gly, Gln, Arg, Glu, Phe, Asn, Cys, Leu, Met, His, Tyr, Pro, Asp, Lys, or Trp
  misc_feature (8)..(8): Xaa can be Leu, Met, Phe, Tyr, Ile, Val, His, Trp, Lys, Arg, Ala, or Gln
AXSLPTTX

SEQ ID NO: 60025 - protein, 10 aa, Artificial Sequence
  Description of Artificial Sequence: Synthetic peptide
  Seed: ASSLPTTMNY (MAGA3_HUMAN)
  misc_feature (2)..(2): Xaa can be Ala, Thr, His, Arg, Asp, Gln, Val, Ser, Glu, Lys, Trp, Cys, Pro, Tyr, Gly, Phe, Asn, Ile, Leu, or Met
  misc_feature (10)..(10): Xaa can be Trp, Ile, Leu, Met, Arg, Tyr, Lys, Phe, His, or Val
AXSLPTTMNX

SEQ ID NO: 60026 - protein, 8 aa, Artificial Sequence
  Description of Artificial Sequence: Synthetic peptide
  Seed: ASSSLQLV (MAGA3_HUMAN)
  misc_feature (2)..(2): Xaa can be Ala, Ser, or Thr
  misc_feature (8)..(8): Xaa can be Ile, Leu, Met, or Val
AXSSLQLX

SEQ ID NO: 60027 - protein, 9 aa, Artificial Sequence
  Description of Artificial Sequence: Synthetic peptide
  Seed: ASSSLQLVF (MAGA3_HUMAN)
  misc_feature (2)..(2): Xaa can be Arg, Gln, Ala, Ser, Met, Thr, Glu, Val, Leu, Ile, Gly, Pro, Asn, Asp, Lys, His, Cys, Tyr, Phe, or Trp
  misc_feature (9)..(9): Xaa can be Tyr, Trp, Leu, Phe, Met, Ile, Val, His, Lys, Arg, Ala, Cys, Thr, Gly, or Gln
AXSSLQLVX

SEQ ID NO: 60028 - protein, 10 aa, Artificial Sequence
  Description of Artificial Sequence: Synthetic peptide
  Seed: ASSSLQLVFG (MAGA3_HUMAN)
  misc_feature (2)..(2): Xaa can be Ser, Thr, Ala, Phe, Tyr, Met, Trp, Leu, Glu, Pro, Asn, Asp, Lys, Arg, Cys, Val, Gln, Gly, Ile, or His
  misc_feature (10)..(10): Xaa can be Phe, Trp, Met, Ile, Tyr, Leu, Gly, or Val
AXSSLQLVFX

SEQ ID NO: 60029 - protein, 10 aa, Artificial Sequence
  Description of Artificial Sequence: Synthetic peptide
  Seed: ASSSSTLVEV (MAGA3_HUMAN)
  misc_feature (2)..(2): Xaa can be Met, Gln, Ala, Leu, Val, Thr, Ile, Ser, Gly, Glu, Asn, Pro, Cys, Phe, Tyr, or Asp
  misc_feature (10)..(10): Xaa can be Tyr, Phe, Met, Lys, Leu, Val, Arg, Ile, Ala, Trp, Thr, Cys, or His
AXSSSTLVEX

SEQ ID NO: 60030 - protein, 8 aa, Artificial Sequence
  Description of Artificial Sequence: Synthetic peptide
  Seed: ATCLGLSY (MAGA3_HUMAN)
  misc_feature (2)..(2): Xaa can be Ala, Ser, Thr, Gln, Gly, Met, Val, Ile, Pro, Leu, Asn, Glu, Phe, His, Tyr, Trp, Arg, or Ly s
  misc_feature (8)..(8): Xaa can be Tyr, Phe, Leu, Met, Val, Ile, Trp, His, or Ala
AXCLGLSX

SEQ ID NO: 60031 - protein, 8 aa, Artificial Sequence
  Description of Artificial Sequence: Synthetic peptide
  Seed: CAPEEKIW (MAGA3_HUMAN)
  misc_feature (2)..(2): Xaa can be Thr, Ala, or Ser
  misc_feature (8)..(8): Xaa can be , or Trp
CXPEEKIX

SEQ ID NO: 60032 - protein, 11 aa, Artificial Sequence
  Description of Artificial Sequence: Synthetic peptide
  Seed: CAPEEKIWEEL (MAGA3_HUMAN)
  misc_feature (2)..(2): Xaa can be Ala, Thr, Ser, Ile, Val, Met, Leu, Gly, or Arg
  misc_feature (11)..(11): Xaa can be Leu, Lys, Phe, Tyr, or Met
CXPEEKIWEEX

SEQ ID NO: 60033 - protein, 9 aa, Artificial Sequence
  Description of Artificial Sequence: Synthetic peptide
  Seed: CYEFLWGPR (MAGA3_HUMAN)
  misc_feature (2)..(2): Xaa can be Met, Phe, Thr, Leu, Ile, Ser, Trp, Tyr, Gln, Val, Gly, Pro, Asn, or Ala
  misc_feature (9)..(9): Xaa can be Arg, or Lys
CXEFLWGPX

SEQ ID NO: 60034 - protein, 11 aa, Artificial Sequence
  Description of Artificial Sequence: Synthetic peptide
  Seed: CYEFLWGPRAL (MAGA3_HUMAN)
  misc_feature (2)..(2): Xaa can be Tyr, Arg, Trp, Phe, His, Ser, Gly, Ala, Lys, Glu, or Met
  misc_feature (11)..(11): Xaa can be Leu, Met, Phe, Ile, Tyr, or Trp
CXEFLWGPRAX

SEQ ID NO: 60035 - protein, 9 aa, Artificial Sequence
  Description of Artificial Sequence: Synthetic peptide
  Seed: DCAPEEKIW (MAGA3_HUMAN)
  misc_feature (2)..(2): Xaa can be Ala, Pro, Ser, Val, Thr, Gly, Met, Leu, Cys, Phe, Ile, Asn, or Gln
  misc_feature (9)..(9): Xaa can be Trp, Phe, Tyr, Met, or Leu
DXAPEEKIX

SEQ ID NO: 60036 - protein, 10 aa, Artificial Sequence
  Description of Artificial Sequence: Synthetic peptide
  Seed: DLESEFQAAL (MAGA3_HUMAN)
  misc_feature (2)..(2): Xaa can be Tyr, Glu, Trp, Lys, His, Met, Cys, Gln, Arg, Thr, Asn, Leu, Ala, Asp, Ile, Val, Phe, Pro, Ser, or Gly
  misc_feature (10)..(10): Xaa can be Leu, Phe, Met, Tyr, Ile, or His
DXESEFQAAX

SEQ ID NO: 60037 - protein, 8 aa, Artificial Sequence
  Description of Artificial Sequence: Synthetic peptide
  Seed: DPACYEFL (MAGA3_HUMAN)
  misc_feature (2)..(2): Xaa can be Pro, or Ala
  misc_feature (8)..(8): Xaa can be Leu, Ile, or Val
DXACYEFX

SEQ ID NO: 60038 - protein, 9 aa, Artificial Sequence
  Description of Artificial Sequence: Synthetic peptide
  Seed: DPACYEFLW (MAGA3_HUMAN)
  misc_feature (2)..(2): Xaa can be Pro, Ala, Thr, Val, Ile, Ser, Leu, Met, or Gly
  misc_feature (9)..(9): Xaa can be Trp, Phe, Met, Tyr, Leu, or Ile
DXACYEFLX

SEQ ID NO: 60039 - protein, 8 aa, Artificial Sequence
  Description of Artificial Sequence: Synthetic peptide
  Seed: DPIGHLYI (MAGA3_HUMAN)
  misc_feature (2)..(2): Xaa can be Ala, Pro, Gly, or Ser
  misc_feature (8)..(8): Xaa can be Val, Ile, Leu, or Met
DXIGHLYX

SEQ ID NO: 60040 - protein, 9 aa, Artificial Sequence
  Description of Artificial Sequence: Synthetic peptide
  Seed: DPIGHLYIF (MAGA3_HUMAN)
  misc_feature (2)..(2): Xaa can be Glu, Pro, Ala, Ser, Gly, Gln, Val, Met, Thr, Ile, Leu, Cys, Asn, Asp, His, Phe, Lys, Arg, Trp, or Tyr
  misc_feature (9)..(9): Xaa can be Tyr, Trp, Phe, Val, Ile, Met, Leu, Ala, His, Cys, Thr, Ser, Pro, Glu, Gln, or Gly
DXIGHLYIX

SEQ ID NO: 60041 - protein, 10 aa, Artificial Sequence
  Description of Artificial Sequence: Synthetic peptide
  Seed: DPIGHLYIFA (MAGA3_HUMAN)
  misc_feature (2)..(2): Xaa can be , or Pro
  misc_feature (10)..(10): Xaa can be , or Ala
DXIGHLYIFX

SEQ ID NO: 60042 - protein, 8 aa, Artificial Sequence
  Description of Artificial Sequence: Synthetic peptide
  Seed: DSILGDPK (MAGA3_HUMAN)
  misc_feature (2)..(2): Xaa can be Ala, Leu, Met, Ser, Val, Thr, Ile, or Gly
  misc_feature (8)..(8): Xaa can be Lys, or Arg
DXILGDPX

SEQ ID NO: 60043 - protein, 9 aa, Artificial Sequence
  Description of Artificial Sequence: Synthetic peptide
  Seed: DSILGDPKK (MAGA3_HUMAN)
  misc_feature (2)..(2): Xaa can be Val, Thr, Ala, Ser, Ile, Leu, Glu, Met, Asp, Gln, Gly, Asn, Phe, Tyr, Cys, or Pro
  misc_feature (9)..(9): Xaa can be Arg, Lys, Tyr, Met, Leu, or His
DXILGDPKX

SEQ ID NO: 60044 - protein, 9 aa, Artificial Sequence
  Description of Artificial Sequence: Synthetic peptide
  Seed: EAASSSSTL (MAGA3_HUMAN)
  misc_feature (2)..(2): Xaa can be Thr, Val, Ala, Glu, Ile, Ser, Pro, Met, Leu, Gln, Gly, Asp, Arg, Asn, Cys, Phe, His, Tyr, Lys, or Trp
  misc_feature (9)..(9): Xaa can be Tyr, Phe, Arg, Val, Lys, Leu, Met, Ile, Trp, Ala, His, Gln, Cys, Thr, Pro, or Ser
EXASSSSTX

SEQ ID NO: 60045 - protein, 10 aa, Artificial Sequence
  Description of Artificial Sequence: Synthetic peptide
  Seed: EAASSSSTLV (MAGA3_HUMAN)
  misc_feature (2)..(2): Xaa can be Thr, Ala, Val, Ser, Ile, Leu, Met, Asn, Phe, Pro, Asp, Arg, Trp, His, Tyr, Gly, Lys, Cys, Glu, or Gln
  misc_feature (10)..(10): Xaa can be Val, Ile, Leu, Ala, Met, or Thr
EXASSSSTLX

SEQ ID NO: 60046 - protein, 9 aa, Artificial Sequence
  Description of Artificial Sequence: Synthetic peptide
  Seed: EALGLVGAQ (MAGA3_HUMAN)
  misc_feature (2)..(2): Xaa can be Val, Thr, Ile, Ala, Ser, Leu, Met, Gly, Pro, Asp, Cys, Asn, Gln, Trp, Tyr, Glu, Phe, His, or Lys
  misc_feature (9)..(9): Xaa can be Arg, Lys, Tyr, Phe, His, Leu, Met, Val, Gln, Ile, Ala, Trp, Glu, Asn, or Thr
EXLGLVGAX

SEQ ID NO: 60047 - protein, 10 aa, Artificial Sequence
  Description of Artificial Sequence: Synthetic peptide
  Seed: EALGLVGAQA (MAGA3_HUMAN)
  misc_feature (2)..(2): Xaa can be Thr, Val, Ile, Ser, Ala, Met, Leu, Gln, Cys, or Gly
  misc_feature (10)..(10): Xaa can be Val, Ile, Leu, Ala, Met, Thr, or Cys
EXLGLVGAQX

SEQ ID NO: 60048 - protein, 9 aa, Artificial Sequence
  Description of Artificial Sequence: Synthetic peptide
  Seed: EARGEALGL (MAGA3_HUMAN)
  misc_feature (2)..(2): Xaa can be Val, Thr, Ala, Pro, Ile, Ser, Gln, Met, Leu, Glu, Asn, Gly, Phe, Tyr, Cys, Asp, or His
  misc_feature (9)..(9): Xaa can be Tyr, Arg, Lys, Phe, Met, Leu, Trp, His, Ile, Val, Gln, or Ala
EXRGEALGX

SEQ ID NO: 60049 - protein, 10 aa, Artificial Sequence
  Description of Artificial Sequence: Synthetic peptide
  Seed: EARGEALGLV (MAGA3_HUMAN)
  misc_feature (2)..(2): Xaa can be Thr, Val, Ile, Ser, or Ala
  misc_feature (10)..(10): Xaa can be Val, Ile, Ala, or Leu
EXRGEALGLX

SEQ ID NO: 60050 - protein, 9 aa, Artificial Sequence
  Description of Artificial Sequence: Synthetic peptide
  Seed: EDSILGDPK (MAGA3_HUMAN)
  misc_feature (2)..(2): Xaa can be Gly, Ala, Gln, Leu, Met, Ser, Thr, Ile, Val, Glu, Asp, Phe, Tyr, or Asn
  misc_feature (9)..(9): Xaa can be Lys, or Arg
EXSILGDPX

SEQ ID NO: 60051 - protein, 8 aa, Artificial Sequence
  Description of Artificial Sequence: Synthetic peptide
  Seed: EEEGPSTF (MAGA3_HUMAN)
  misc_feature (2)..(2): Xaa can be Glu, or Gln
  misc_feature (8)..(8): Xaa can be Leu, Trp, Cys, Tyr, Thr, Ala, Val, Ile, Met, or Phe
EXEGPSTX

SEQ ID NO: 60052 - protein, 9 aa, Artificial Sequence
  Description of Artificial Sequence: Synthetic peptide
  Seed: EEEGPSTFP (MAGA3_HUMAN)
  misc_feature (2)..(2): Xaa can be Glu, Gln, or Asp
  misc_feature (9)..(9): Xaa can be Leu, Ala, Ile, Val, Met, Cys, Pro, Ser, Thr, Gly, Tyr, Phe, or Trp
EXEGPSTFX

SEQ ID NO: 60053 - protein, 11 aa, Artificial Sequence
  Description of Artificial Sequence: Synthetic peptide
  Seed: EEEGPSTFPDL (MAGA3_HUMAN)
  misc_feature (2)..(2): Xaa can be , or Glu
  misc_feature (11)..(11): Xaa can be Pro, Thr, Cys, Val, Leu, Ala, Trp, Phe, Met, or Ile
EXEGPSTFPDX

SEQ ID NO: 60054 - protein, 10 aa, Artificial Sequence
  Description of Artificial Sequence: Synthetic peptide
  Seed: EEGLEARGEA (MAGA3_HUMAN)
  misc_feature (2)..(2): Xaa can be , or Glu
  misc_feature (10)..(10): Xaa can be Cys, Val, Leu, Ala, Ile, or Met
EXGLEARGEX

SEQ ID NO: 60055 - protein, 11 aa, Artificial Sequence
  Description of Artificial Sequence: Synthetic peptide
  Seed: EEGLEARGEAL (MAGA3_HUMAN)
  misc_feature (2)..(2): Xaa can be Glu, Gln, Asp, Ala, Arg, or Lys
  misc_feature (11)..(11): Xaa can be Trp, Phe, Leu, Cys, Tyr, Ala, Ser, Met, Ile, Pro, Val, Gly, or Thr
EXGLEARGEAX

SEQ ID NO: 60056 - protein, 8 aa, Artificial Sequence
  Description of Artificial Sequence: Synthetic peptide
  Seed: EEGPSTFP (MAGA3_HUMAN)
  misc_feature (2)..(2): Xaa can be , or Glu
  misc_feature (8)..(8): Xaa can be Cys, Phe, Met, Ile, Pro, Val, Ala, Leu, or Thr
EXGPSTFX

SEQ ID NO: 60057 - protein, 10 aa, Artificial Sequence
  Description of Artificial Sequence: Synthetic peptide
  Seed: EEGPSTFPDL (MAGA3_HUMAN)
  misc_feature (2)..(2): Xaa can be Glu, or Gln
  misc_feature (10)..(10): Xaa can be Trp, Pro, Ile, Ser, Thr, Tyr, Leu, Val, Phe, Ala, Cys, or Met
EXGPSTFPDX

SEQ ID NO: 60058 - protein, 8 aa, Artificial Sequence
  Description of Artificial Sequence: Synthetic peptide
  Seed: EEKIWEEL (MAGA3_HUMAN)
  misc_feature (2)..(2): Xaa can be Glu, Asp, or Gln
  misc_feature (8)..(8): Xaa can be Tyr, Leu, Trp, Phe, Ile, Met, Thr, His, Val, Cys, Ala, or Pro
EXKIWEEX

SEQ ID NO: 60059 - protein, 9 aa, Artificial Sequence
  Description of Artificial Sequence: Synthetic peptide
  Seed: EEKIWEELS (MAGA3_HUMAN)
  misc_feature (2)..(2): Xaa can be Glu, Asp, or Gln
  misc_feature (9)..(9): Xaa can be Leu, Ile, Ala, Val, Cys, Thr, Tyr, Met, Gly, Pro, Ser, or Phe
EXKIWEELX

SEQ ID NO: 60060 - protein, 10 aa, Artificial Sequence
  Description of Artificial Sequence: Synthetic peptide
  Seed: EEKIWEELSV (MAGA3_HUMAN)
  misc_feature (2)..(2): Xaa can be , or Glu
  misc_feature (10)..(10): Xaa can be Pro, Met, Cys, Val, Phe, Thr, Leu, Ala, or Ile
EXKIWEELSX

SEQ ID NO: 60061 - protein, 11 aa, Artificial Sequence
  Description of Artificial Sequence: Synthetic peptide
  Seed: EEKIWEELSVL (MAGA3_HUMAN)
  misc_feature (2)..(2): Xaa can be , or Glu
  misc_feature (11)..(11): Xaa can be Val, Leu, Ala, Met, Ile, Cys, or Phe
EXKIWEELSVX

SEQ ID NO: 60062 - protein, 8 aa, Artificial Sequence
  Description of Artificial Sequence: Synthetic peptide
  Seed: EELSVLEV (MAGA3_HUMAN)
  misc_feature (2)..(2): Xaa can be Glu, Gln, Asp, Ala, Met, His, Ile, Pro, Asn, Leu, Ser, Gly, Val, Phe, or Thr
  misc_feature (8)..(8): Xaa can be Val, Ile, Leu, Met, Phe, Ala, Tyr, His, Arg, Pro, Trp, Thr, Gln, Gly, Ser, Cys, or Lys
EXLSVLEX

SEQ ID NO: 60063 - protein, 9 aa, Artificial Sequence
  Description of Artificial Sequence: Synthetic peptide
  Seed: EELSVLEVF (MAGA3_HUMAN)
  misc_feature (2)..(2): Xaa can be Glu, Gln, Asp, His, Met, Leu, Ala, Ile, Arg, Val, Thr, Ser, Gly, Lys, Asn, Pro, Tyr, Phe, Cys, or Trp
  misc_feature (9)..(9): Xaa can be Tyr, Phe, Trp, Met, Leu, Ile, Val, Ser, His, Thr, Cys, Ala, Pro, Lys, Arg, Gln, Asp, Glu, Asn, or Gly
EXLSVLEVX

SEQ ID NO: 60064 - protein, 9 aa, Artificial Sequence
  Description of Artificial Sequence: Synthetic peptide
  Seed: EEQEAASSS (MAGA3_HUMAN)
  misc_feature (2)..(2): Xaa can be Glu, Gln, Asp, Ala, Val, Asn, Met, Ile, Leu, Thr, or Ser
  misc_feature (9)..(9): Xaa can be Leu, Met, Ile, Val, Ala, Phe, Cys, Pro, Thr, Asn, Asp, Gln, Gly, Trp, Lys, Glu, Ser, Arg, or Tyr
EXQEAASSX

SEQ ID NO: 60065 - protein, 10 aa, Artificial Sequence
  Description of Artificial Sequence: Synthetic peptide
  Seed: EEQEAASSSS (MAGA3_HUMAN)
  misc_feature (2)..(2): Xaa can be Glu, Gln, or Asp
  misc_feature (10)..(10): Xaa can be Leu, Ile, Val, Ala, Cys, Gly, Phe, Tyr, Pro, Ser, Met, or Thr
EXQEAASSSX

SEQ ID NO: 60066 - protein, 11 aa, Artificial Sequence
  Description of Artificial Sequence: Synthetic peptide
  Seed: EEQEAASSSST (MAGA3_HUMAN)
  misc_feature (2)..(2): Xaa can be Glu, Gln, or Asp
  misc_feature (11)..(11): Xaa can be Ala, Leu, Cys, Val, Pro, Thr, Ile, Trp, Tyr, Gly, Phe, Ser, or Met
EXQEAASSSSX

SEQ ID NO: 60067 - protein, 10 aa, Artificial Sequence
  Description of Artificial Sequence: Synthetic peptide
  Seed: EFLWGPRALV (MAGA3_HUMAN)
  misc_feature (2)..(2): Xaa can be Thr, Met, Tyr, Val, Ser, Phe, Ile, Ala, Leu, Lys, Trp, Arg, Gly, His, Asn, Glu, Cys, Asp, Gln, or Pro
  misc_feature (10)..(10): Xaa can be Val, Leu, Ile, Ala, Met, or Thr
EXLWGPRALX

SEQ ID NO: 60068 - protein, 8 aa, Artificial Sequence
  Description of Artificial Sequence: Synthetic peptide
  Seed: EFQAALSR (MAGA3_HUMAN)
  misc_feature (2)..(2): Xaa can be Thr, Tyr, Val, Ile, Phe, or Ala
  misc_feature (8)..(8): Xaa can be , or Arg
EXQAALSX

SEQ ID NO: 60069 - protein, 9 aa, Artificial Sequence
  Description of Artificial Sequence: Synthetic peptide
  Seed: EFQAALSRK (MAGA3_HUMAN)
  misc_feature (2)..(2): Xaa can be Val, Thr, Ile, Ala, Ser, Met, Leu, Gly, Trp, Phe, Glu, Pro, Asp, Gln, Asn, Cys, Tyr, His, Lys, or Arg
  misc_feature (9)..(9): Xaa can be Arg, Lys, His, Leu, Met, Tyr, Phe, Ile, Val, Ala, or Gln
EXQAALSRX

SEQ ID NO: 60070 - protein, 9 aa, Artificial Sequence
  Description of Artificial Sequence: Synthetic peptide
  Seed: EGDCAPEEK (MAGA3_HUMAN)
  misc_feature (2)..(2): Xaa can be Tyr, Thr, Met, Phe, Ile, Ser, Val, Trp, Ala, Leu, Asn, Gln, Glu, Asp, Gly, Cys, Pro, or Hi s
  misc_feature (9)..(9): Xaa can be Lys, Tyr, Arg, Phe, Leu, Met, Ile, His, Val, or Trp
EXDCAPEEX

SEQ ID NO: 60071 - protein, 11 aa, Artificial Sequence
  Description of Artificial Sequence: Synthetic peptide
  Seed: EGDCAPEEKIW (MAGA3_HUMAN)
  misc_feature (2)..(2): Xaa can be Ala, Thr, Ser, Met, Pro, Phe, Gln, Val, Tyr, Trp, Leu, Cys, Gly, Ile, or Asn
  misc_feature (11)..(11): Xaa can be Trp, or Phe
EXDCAPEEKIX

SEQ ID NO: 60072 - protein, 9 aa, Artificial Sequence
  Description of Artificial Sequence: Synthetic peptide
  Seed: EGPSTFPDL (MAGA3_HUMAN)
  misc_feature (2)..(2): Xaa can be Ala, Ile, Leu, Ser, Val, Met, Arg, Pro, Gln, Gly, Thr, Cys, Phe, or Tyr
  misc_feature (9)..(9): Xaa can be Leu, Met, Ile, Val, Phe, or Cys
EXPSTFPDX

SEQ ID NO: 60073 - protein, 10 aa, Artificial Sequence
  Description of Artificial Sequence: Synthetic peptide
  Seed: ELMEVDPIGH (MAGA3_HUMAN)
  misc_feature (2)..(2): Xaa can be Val, Thr, Ala, Ile, Ser, Met, Leu, Gly, Tyr, Trp, Asn, Gln, Phe, Pro, Lys, Glu, Asp, His, or Cys
  misc_feature (10)..(10): Xaa can be Lys, Arg, His, Tyr, Met, Leu, Gln, Phe, Asn, Glu, Ile, Ala, Val, or Trp
EXMEVDPIGX

SEQ ID NO: 60074 - protein, 11 aa, Artificial Sequence
  Description of Artificial Sequence: Synthetic peptide
  Seed: ELMEVDPIGHL (MAGA3_HUMAN)
  misc_feature (2)..(2): Xaa can be Leu, Met, Val, Ile, or Gln
  misc_feature (11)..(11): Xaa can be Val, Leu, Ala, Met, or Ile
EXMEVDPIGHX

SEQ ID NO: 60075 - protein, 11 aa, Artificial Sequence
  Description of Artificial Sequence: Synthetic peptide
  Seed: ELSVLEVFEGR (MAGA3_HUMAN)
  misc_feature (2)..(2): Xaa can be His, Cys, Met, Gly, Trp, Asp, Val, Thr, Pro, Ile, Phe, Ala, Gln, Lys, Arg, Asn, Leu, Ser, Tyr, or Glu
  misc_feature (11)..(11): Xaa can be Lys, or Arg
EXSVLEVFEGX

SEQ ID NO: 60076 - protein, 8 aa, Artificial Sequence
  Description of Artificial Sequence: Synthetic peptide
  Seed: ELVHFLLL (MAGA3_HUMAN)
  misc_feature (2)..(2): Xaa can be Met, Arg, Ala, Ile, Asn, Glu, His, Tyr, Phe, Gln, Trp, or Leu
  misc_feature (8)..(8): Xaa can be Leu, Val, Ile, or Met
EXVHFLLX

SEQ ID NO: 60077 - protein, 9 aa, Artificial Sequence
  Description of Artificial Sequence: Synthetic peptide
  Seed: ELVHFLLLK (MAGA3_HUMAN)
  misc_feature (2)..(2): Xaa can be Val, Thr, Ala, Ile, Met, Leu, Ser, Gly, Gln, Asn, Tyr, Arg, Pro, Phe, Cys, Lys, His, Glu, Asp, or Trp
  misc_feature (9)..(9): Xaa can be Arg, Lys, His, Tyr, Leu, Met, Val, Phe, Ile, Gln, or Ala
EXVHFLLLX

SEQ ID NO: 60078 - protein, 10 aa, Artificial Sequence
  Description of Artificial Sequence: Synthetic peptide
  Seed: ELVHFLLLKY (MAGA3_HUMAN)
  misc_feature (2)..(2): Xaa can be Thr, Val, Ala, Ser, Ile, Asn, Met, Leu, Gly, Gln, Trp, Asp, Phe, Tyr, Pro, Cys, Glu, His, Arg, or Lys
  misc_feature (10)..(10): Xaa can be Tyr, Lys, Arg, His, Phe, Met, Leu, or Gln
EXVHFLLLKX

SEQ ID NO: 60079 - protein, 11 aa, Artificial Sequence
  Description of Artificial Sequence: Synthetic peptide
  Seed: ELVHFLLLKYR (MAGA3_HUMAN)
  misc_feature (2)..(2): Xaa can be Ser, Met, Ala, Thr, Val, Arg, Ile, Lys, Asp, Phe, Trp, Leu, Asn, Tyr, His, Gly, or Gln
  misc_feature (11)..(11): Xaa can be Arg, or Lys
EXVHFLLLKYX

SEQ ID NO: 60080 - protein, 10 aa, Artificial Sequence
  Description of Artificial Sequence: Synthetic peptide
  Seed: EMLGSVVGNW (MAGA3_HUMAN)
  misc_feature (2)..(2): Xaa can be Thr, Val, Gln, Ile, Ser, Ala, Glu, Gly, Met, Leu, Asn, Phe, Arg, Pro, Trp, Lys, Cys, Asp, or Tyr
  misc_feature (10)..(10): Xaa can be Trp, Tyr, Phe, Ile, Met, Leu, or Val
EXLGSVVGNX

SEQ ID NO: 60081 - protein, 9 aa, Artificial Sequence
  Description of Artificial Sequence: Synthetic peptide
  Seed: ENYLEYRQV (MAGA3_HUMAN)
  misc_feature (2)..(2): Xaa can be Gln, Ala, Glu, Gly, Val, Met, Ser, Ile, Asn, Leu, Asp, His, Thr, Pro, or Lys
  misc_feature (9)..(9): Xaa can be Val, Ile, Leu, Met, Phe, Ala, Thr, or Cys
EXYLEYRQX

SEQ ID NO: 60082 - protein, 11 aa, Artificial Sequence
  Description of Artificial Sequence: Synthetic peptide
  Seed: EQEAASSSSTL (MAGA3_HUMAN)
  misc_feature (2)..(2): Xaa can be Glu, Gln, His, Arg, Met, or Leu
  misc_feature (11)..(11): Xaa can be Trp, Phe, Leu, Ile, Met, Val, Ala, Cys, Tyr, Ser, Pro, Thr, or Gly
EXEAASSSSTX

SEQ ID NO: 60083 - protein, 10 aa, Artificial Sequence
  Description of Artificial Sequence: Synthetic peptide
  Seed: ESEFQAALSR (MAGA3_HUMAN)
  misc_feature (2)..(2): Xaa can be Thr, Met, Ile, Val, Gly, Ala, Ser, Tyr, Leu, Trp, Phe, Gln, or Asn
  misc_feature (10)..(10): Xaa can be Arg, Lys, or Tyr
EXEFQAALSX

SEQ ID NO: 60084 - protein, 11 aa, Artificial Sequence
  Description of Artificial Sequence: Synthetic peptide
  Seed: ESEFQAALSRK (MAGA3_HUMAN)
  misc_feature (2)..(2): Xaa can be Thr, Val, Met, Ser, Ala, Ile, or Leu
  misc_feature (11)..(11): Xaa can be Lys, or Arg
EXEFQAALSRX

SEQ ID NO: 60085 - protein, 10 aa, Artificial Sequence
  Description of Artificial Sequence: Synthetic peptide
  Seed: ESPDPPQSPQ (MAGA3_HUMAN)
  misc_feature (2)..(2): Xaa can be Val, Ile, Thr, Ala, Met, Leu, Ser, Gly, Glu, Gln, Trp, Pro, Phe, Cys, Asp, His, Tyr, Asn, Lys, or Arg
  misc_feature (10)..(10): Xaa can be Arg, Lys, His, Tyr, Met, Gln, Leu, Phe, Ile, Ala, Trp, Val, Asn, or Glu
EXPDPPQSPX

SEQ ID NO: 60086 - protein, 9 aa, Artificial Sequence
  Description of Artificial Sequence: Synthetic peptide
  Seed: ETSYVKVLH (MAGA3_HUMAN)
  misc_feature (2)..(2): Xaa can be Val, Thr, Ile, Ala, Leu, Met, Ser, Trp, Phe, Glu, Pro, Cys, Gly, Asp, Asn, Gln, or Tyr
  misc_feature (9)..(9): Xaa can be Arg, Lys, His, Tyr, Leu, Met, Phe, Gln, Glu, or Val
EXSYVKVLX

SEQ ID NO: 60087 - protein, 10 aa, Artificial Sequence
  Description of Artificial Sequence: Synthetic peptide
  Seed: ETSYVKVLHH (MAGA3_HUMAN)
  misc_feature (2)..(2): Xaa can be Val, Thr, Ser, Ala, Ile, Leu, Met, Asn, Gly, Gln, Tyr, Cys, Trp, Pro, Asp, Glu, or Phe
  misc_feature (10)..(10): Xaa can be Lys, Arg, Tyr, His, Phe, Met, or Leu
EXSYVKVLHX

SEQ ID NO: 60088 - protein, 8 aa, Artificial Sequence
  Description of Artificial Sequence: Synthetic peptide
  Seed: EVDPIGHL (MAGA3_HUMAN)
  misc_feature (2)..(2): Xaa can be Ala, Phe, Tyr, Ile, Trp, Met, Thr, Val, Ser, Leu, Cys, Gly, Gln, Asn, Arg, His, Pro, or As p
  misc_feature (8)..(8): Xaa can be Leu, Met, Phe, Ile, Val, or Tyr
EXDPIGHX

SEQ ID NO: 60089 - protein, 9 aa, Artificial Sequence
  Description of Artificial Sequence: Synthetic peptide
  Seed: EVDPIGHLY (MAGA3_HUMAN)
  misc_feature (2)..(2): Xaa can be Thr, Ala, Leu, Ile, Ser, Met, Val, Phe, Gly, Tyr, Pro, Cys, Trp, Gln, Asn, Arg, Glu, Asp, Lys, or His
  misc_feature (9)..(9): Xaa can be Met, Leu, Tyr, Ile, Arg, Val, Lys, Phe, Trp, His, Cys, Ala, Thr, Gln, Ser, Pro, Asn, or Gl u
EXDPIGHLX

SEQ ID NO: 60090 - protein, 10 aa, Artificial Sequence
  Description of Artificial Sequence: Synthetic peptide
  Seed: EVDPIGHLYI (MAGA3_HUMAN)
  misc_feature (2)..(2): Xaa can be Ala, Leu, Met, Thr, Val, Ser, Ile, Tyr, Cys, Gly, Gln, Phe, Pro, Trp, Asn, or Glu
  misc_feature (10)..(10): Xaa can be Leu, Phe, Met, Val, Ile, Ala, Tyr, Cys, or Trp
EXDPIGHLYX

SEQ ID NO: 60091 - protein, 11 aa, Artificial Sequence
  Description of Artificial Sequence: Synthetic peptide
  Seed: EVDPIGHLYIF (MAGA3_HUMAN)
  misc_feature (2)..(2): Xaa can be Thr, Ser, Met, Val, Ile, Ala, Phe, Gly, Leu, Gln, Asn, Cys, Trp, Tyr, Glu, or Asp
  misc_feature (11)..(11): Xaa can be Tyr, Trp, Lys, Phe, His, Arg, Leu, or Met
EXDPIGHLYIX

SEQ ID NO: 60092 - protein, 10 aa, Artificial Sequence
  Description of Artificial Sequence: Synthetic peptide
  Seed: EVFEGREDSI (MAGA3_HUMAN)
  misc_feature (2)..(2): Xaa can be Thr, Val, Ile, Ser, Met, Ala, Leu, Gln, Cys, Asn, Glu, Gly, Phe, Tyr, Asp, Pro, or Trp
  misc_feature (10)..(10): Xaa can be Arg, Lys, Trp, Tyr, Phe, Met, Leu, Ile, Val, Ala, His, Gln, or Thr
EXFEGREDSX

SEQ ID NO: 60093 - protein, 11 aa, Artificial Sequence
  Description of Artificial Sequence: Synthetic peptide
  Seed: EVFEGREDSIL (MAGA3_HUMAN)
  misc_feature (2)..(2): Xaa can be Thr, Val, Ile, Ser, Ala, Gln, Leu, Met, Asn, Glu, Pro, Phe, Cys, Gly, Tyr, or Asp
  misc_feature (11)..(11): Xaa can be Arg, Lys, Trp, Tyr, Phe, His, Gln, Met, Val, Leu, or Ile
EXFEGREDSIX

SEQ ID NO: 60094 - protein, 9 aa, Artificial Sequence
  Description of Artificial Sequence: Synthetic peptide
  Seed: EVTLGEVPA (MAGA3_HUMAN)
  misc_feature (2)..(2): Xaa can be Thr, Val, Ser, Ile, Ala, Met, or Leu
  misc_feature (9)..(9): Xaa can be Val, Ile, Leu, Ala, Met, or Thr
EXTLGEVPX

SEQ ID NO: 60095 - protein, 10 aa, Artificial Sequence
  Description of Artificial Sequence: Synthetic peptide
  Seed: EVTLGEVPAA (MAGA3_HUMAN)
  misc_feature (2)..(2): Xaa can be Val, Thr, Gln, Met, Lys, Asn, Ala, His, Gly, Glu, Leu, Tyr, Arg, Trp, Pro, Cys, Ile, Ser, Asp, or Phe
  misc_feature (10)..(10): Xaa can be Val, Ile, Ala, or Leu
EXTLGEVPAX

SEQ ID NO: 60096 - protein, 9 aa, Artificial Sequence
  Description of Artificial Sequence: Synthetic peptide
  Seed: FATCLGLSY (MAGA3_HUMAN)
  misc_feature (2)..(2): Xaa can be Pro, Ala, Gln, Tyr, Ser, Met, Val, Thr, Arg, Leu, Gly, Asn, Ile, Phe, Lys, Cys, His, Glu, Asp, or Trp
  misc_feature (9)..(9): Xaa can be Met, Phe, Trp, Leu, Tyr, Ile, Val, Lys, His, Arg, Ala, Cys, Thr, Gly, Ser, Gln, Asn, Pro, Asp, or Glu
FXTCLGLSX

SEQ ID NO: 60097 - protein, 10 aa, Artificial Sequence
  Description of Artificial Sequence: Synthetic peptide
  Seed: FATCLGLSYD (MAGA3_HUMAN)
  misc_feature (2)..(2): Xaa can be Ala, Ser, Thr, Ile, Met, Val, Gln, Gly, Pro, or Leu
  misc_feature (10)..(10): Xaa can be Tyr, Phe, Met, Leu, Ile, Trp, Val, Gln, Cys, Ala, Gly, Glu, Lys, Asp, Asn, His, Arg, Thr, Pro, or Ser
FXTCLGLSYX

SEQ ID NO: 60098 - protein, 8 aa, Artificial Sequence
  Description of Artificial Sequence: Synthetic peptide
  Seed: FEGREDSI (MAGA3_HUMAN)
  misc_feature (2)..(2): Xaa can be Glu, or Asp
  misc_feature (8)..(8): Xaa can be Leu, Phe, Met, Val, Ala, or Ile
FXGREDSX

SEQ ID NO: 60099 - protein, 9 aa, Artificial Sequence
  Description of Artificial Sequence: Synthetic peptide
  Seed: FEGREDSIL (MAGA3_HUMAN)
  misc_feature (2)..(2): Xaa can be Glu, or Asp
  misc_feature (9)..(9): Xaa can be Phe, Met, Leu, Trp, Thr, Val, Pro, Ser, Cys, Ala, or Ile
FXGREDSIX

SEQ ID NO: 60100 - protein, 10 aa, Artificial Sequence
  Description of Artificial Sequence: Synthetic peptide
  Seed: FFPVIFSKAS (MAGA3_HUMAN)
  misc_feature (2)..(2): Xaa can be Pro, Ser, Arg, Ala, Lys, Cys, Glu, His, Leu, Gly, Gln, Phe, Tyr, Asn, Val, Trp, Met, Ile, Asp, or Thr
  misc_feature (10)..(10): Xaa can be Pro, Ala, Ile, Thr, Ser, Val, Cys, or Leu
FXPVIFSKAX

SEQ ID NO: 60101 - protein, 8 aa, Artificial Sequence
  Description of Artificial Sequence: Synthetic peptide
  Seed: FGIELMEV (MAGA3_HUMAN)
  misc_feature (2)..(2): Xaa can be Ala, Gln, Ser, Thr, Gly, Asn, Pro, Val, Ile, Met, Leu, Glu, Phe, Asp, Cys, His, Tyr, Arg, or Lys
  misc_feature (8)..(8): Xaa can be Leu, Ile, Val, Phe, Met, Tyr, Lys, Arg, Trp, Ala, Cys, or Thr
FXIELMEX

SEQ ID NO: 60102 - protein, 9 aa, Artificial Sequence
  Description of Artificial Sequence: Synthetic peptide
  Seed: FLWGPRALV (MAGA3_HUMAN)
  misc_feature (2)..(2): Xaa can be Leu, Met, Ala, Ile, Thr, Val, Gln, Ser, Gly, Phe, Cys, Glu, Pro, Asn, Arg, Tyr, Trp, Asp, His, or Lys
  misc_feature (9)..(9): Xaa can be Leu, Val, Met, Arg, Ile, Tyr, Phe, Lys, Ala, Trp, Cys, His, Thr, Ser, Gln, Pro, Glu, or Gl y
FXWGPRALX

SEQ ID NO: 60103 - protein, 10 aa, Artificial Sequence
  Description of Artificial Sequence: Synthetic peptide
  Seed: FLWGPRALVE (MAGA3_HUMAN)
  misc_feature (2)..(2): Xaa can be Leu, Ile, Val, Met, Gln, Thr, Ala, Ser, or Phe
  misc_feature (10)..(10): Xaa can be Val, Ile, Leu, Met, Ala, Ser, Phe, Cys, Thr, Asn, Glu, His, Trp, Asp, Lys, Pro, Gly, Gln, Arg, or Tyr
FXWGPRALVX

SEQ ID NO: 60104 - protein, 11 aa, Artificial Sequence
  Description of Artificial Sequence: Synthetic peptide
  Seed: FLWGPRALVET (MAGA3_HUMAN)
  misc_feature (2)..(2): Xaa can be Leu, Met, Gln, Ile, Val, Thr, Ser, Ala, Phe, or Gly
  misc_feature (11)..(11): Xaa can be Val, Leu, Ile, Ala, Met, Thr, Phe, Ser, Asn, Cys, Glu, Trp, His, Pro, Lys, Tyr, Gly, Gln, Arg, or Asp
FXWGPRALVEX

SEQ ID NO: 60105 - protein, 8 aa, Artificial Sequence
  Description of Artificial Sequence: Synthetic peptide
  Seed: FPDLESEF (MAGA3_HUMAN)
  misc_feature (2)..(2): Xaa can be Ala, Thr, Ile, Ser, Phe, Val, Tyr, Trp, Leu, Met, Gly, Gln, Pro, Cys, His, Glu, Asn, Arg, Asp, or Lys
  misc_feature (8)..(8): Xaa can be Leu, Ile, Phe, Met, Val, Tyr, Trp, Cys, Ala, Thr, Lys, or Gln
FXDLESEX

SEQ ID NO: 60106 - protein, 10 aa, Artificial Sequence
  Description of Artificial Sequence: Synthetic peptide
  Seed: FPDLESEFQA (MAGA3_HUMAN)
  misc_feature (2)..(2): Xaa can be , or Pro
  misc_feature (10)..(10): Xaa can be Leu, Val, Ile, or Ala
FXDLESEFQX

SEQ ID NO: 60107 - protein, 11 aa, Artificial Sequence
  Description of Artificial Sequence: Synthetic peptide
  Seed: FPDLESEFQAA (MAGA3_HUMAN)
  misc_feature (2)..(2): Xaa can be Pro, or Ala
  misc_feature (11)..(11): Xaa can be Leu, Met, Tyr, Thr, Val, Ala, Ile, Cys, Phe, or Trp
FXDLESEFQAX

SEQ ID NO: 60108 - protein, 8 aa, Artificial Sequence
  Description of Artificial Sequence: Synthetic peptide
  Seed: FPVIFSKA (MAGA3_HUMAN)
  misc_feature (2)..(2): Xaa can be Pro, or Ala
  misc_feature (8)..(8): Xaa can be Ile, Leu, Val, Phe, Thr, Met, Ala, Ser, Cys, or Pro
FXVIFSKX

SEQ ID NO: 60109 - protein, 9 aa, Artificial Sequence
  Description of Artificial Sequence: Synthetic peptide
  Seed: FPVIFSKAS (MAGA3_HUMAN)
  misc_feature (2)..(2): Xaa can be Pro, Ala, Ser, Val, Thr, Met, Ile, Gly, Cys, Leu, Glu, Phe, Gln, or Asp
  misc_feature (9)..(9): Xaa can be Tyr, Phe, Met, Ala, Trp, His, Val, Leu, Ile, Cys, Asp, Gln, Ser, Glu, Pro, Arg, Gly, Asn, Thr, or Lys
FXVIFSKAX

SEQ ID NO: 60110 - protein, 10 aa, Artificial Sequence
  Description of Artificial Sequence: Synthetic peptide
  Seed: FPVIFSKASS (MAGA3_HUMAN)
  misc_feature (2)..(2): Xaa can be Pro, or Ala
  misc_feature (10)..(10): Xaa can be Ala, Cys, Pro, Val, Phe, Thr, Gly, Leu, Tyr, Ser, Met, or Ile
FXVIFSKASX

SEQ ID NO: 60111 - protein, 11 aa, Artificial Sequence
  Description of Artificial Sequence: Synthetic peptide
  Seed: FPVIFSKASSS (MAGA3_HUMAN)
  misc_feature (2)..(2): Xaa can be , or Pro
  misc_feature (11)..(11): Xaa can be Cys, Ile, Ser, Gly, Phe, Ala, Val, Pro, Thr, Leu, or Met
FXVIFSKASSX

SEQ ID NO: 60112 - protein, 9 aa, Artificial Sequence
  Description of Artificial Sequence: Synthetic peptide
  Seed: FQAALSRKV (MAGA3_HUMAN)
  misc_feature (2)..(2): Xaa can be Met, Leu, His, Ala, Gln, Ser, Arg, Ile, Val, Thr, Gly, Pro, Glu, Lys, Cys, Tyr, Phe, Asn, Asp, or Trp
  misc_feature (9)..(9): Xaa can be Tyr, Leu, Ile, Phe, Val, Met, Trp, Ala, Thr, Cys, His, Ser, Gly, or Pro
FXAALSRKX

SEQ ID NO: 60113 - protein, 10 aa, Artificial Sequence
  Description of Artificial Sequence: Synthetic peptide
  Seed: FQAALSRKVA (MAGA3_HUMAN)
  misc_feature (2)..(2): Xaa can be His, Gln, or Arg
  misc_feature (10)..(10): Xaa can be Ala, Ile, Val, Met, Cys, Leu, or Thr
FXAALSRKVX

SEQ ID NO: 60114 - protein, 8 aa, Artificial Sequence
  Description of Artificial Sequence: Synthetic peptide
  Seed: FSKASSSL (MAGA3_HUMAN)
  misc_feature (2)..(2): Xaa can be Ala, Ser, Thr, Ile, Met, Gly, Gln, Val, Phe, Asn, Tyr, Leu, Arg, Glu, His, Asp, or Cys
  misc_feature (8)..(8): Xaa can be Leu, Tyr, Phe, Met, Ile, His, Val, or Trp
FXKASSSX

SEQ ID NO: 60115 - protein, 10 aa, Artificial Sequence
  Description of Artificial Sequence: Synthetic peptide
  Seed: FSKASSSLQL (MAGA3_HUMAN)
  misc_feature (2)..(2): Xaa can be Ala, Gln, Thr, Ser, Met, Gly, His, Val, Ile, Phe, Asn, Glu, Leu, Pro, Asp, Lys, Arg, Cys, Trp, or Tyr
  misc_feature (10)..(10): Xaa can be Tyr, Met, Leu, Phe, Trp, His, Ile, Val, or Ala
FXKASSSLQX

SEQ ID NO: 60116 - protein, 9 aa, Artificial Sequence
  Description of Artificial Sequence: Synthetic peptide
  Seed: FVQENYLEY (MAGA3_HUMAN)
  misc_feature (2)..(2): Xaa can be Pro, Tyr, Ala, Phe, Arg, Gln, Ser, Val, Ile, Thr, Gly, Leu, Met, Trp, Cys, Asp, Asn, Glu, His, or Lys
  misc_feature (9)..(9): Xaa can be Met, Phe, Val, Tyr, Trp, His, Leu, Ile, Lys, Arg, Ala, Cys, Gln, Thr, Ser, Gly, Asn, Glu, Pro, or Asp
FXQENYLEX

SEQ ID NO: 60117 - protein, 10 aa, Artificial Sequence
  Description of Artificial Sequence: Synthetic peptide
  Seed: FVQENYLEYR (MAGA3_HUMAN)
  misc_feature (2)..(2): Xaa can be Leu, Met, Thr, Ser, Gln, Phe, Asn, Ile, Tyr, Val, Trp, Gly, Ala, Cys, Arg, Lys, Pro, Asp, His, or Glu
  misc_feature (10)..(10): Xaa can be Arg, Tyr, Lys, Phe, Met, Val, Ile, His, Leu, or Trp
FXQENYLEYX

SEQ ID NO: 60118 - protein, 9 aa, Artificial Sequence
  Description of Artificial Sequence: Synthetic peptide
  Seed: GASSLPTTM (MAGA3_HUMAN)
  misc_feature (2)..(2): Xaa can be Pro, Ala, Arg, Gln, Val, Ser, Leu, Tyr, Thr, Ile, Met, Gly, Glu, Phe, Asp, Asn, Lys, His, Cys, or Trp
  misc_feature (9)..(9): Xaa can be Tyr, Met, Phe, Trp, Val, Leu, Ile, His, Lys, Arg, Ala, Cys, Thr, Gln, Ser, Pro, or Gly
GXSSLPTTX

SEQ ID NO: 60119 - protein, 11 aa, Artificial Sequence
  Description of Artificial Sequence: Synthetic peptide
  Seed: GASSLPTTMNY (MAGA3_HUMAN)
  misc_feature (2)..(2): Xaa can be Thr, Ala, Ser, Gly, Val, Ile, Arg, Phe, Met, Gln, Tyr, His, Pro, Cys, Asp, Leu, Lys, Trp, Glu, or Asn
  misc_feature (11)..(11): Xaa can be Phe, Tyr, Trp, Met, Lys, Arg, Leu, Ile, Val, or His
GXSSLPTTMNX

SEQ ID NO: 60120 - protein, 9 aa, Artificial Sequence
  Description of Artificial Sequence: Synthetic peptide
  Seed: GDCAPEEKI (MAGA3_HUMAN)
  misc_feature (2)..(2): Xaa can be Glu, Asp, or Gln
  misc_feature (9)..(9): Xaa can be Ala, Met, Leu, Ile, Phe, Val, Trp, Thr, Pro, Cys, Gly, Tyr, Asp, Ser, or Glu
GXCAPEEKX

SEQ ID NO: 60121 - protein, 10 aa, Artificial Sequence
  Description of Artificial Sequence: Synthetic peptide
  Seed: GDCAPEEKIW (MAGA3_HUMAN)
  misc_feature (2)..(2): Xaa can be Glu, Gln, Thr, Ser, Asp, Ala, Leu, Met, Asn, Val, Ile, Tyr, Pro, Cys, Gly, Phe, or Trp
  misc_feature (10)..(10): Xaa can be Trp, Phe, Tyr, Ile, His, Val, Leu, Arg, or Met
GXCAPEEKIX

SEQ ID NO: 60122 - protein, 9 aa, Artificial Sequence
  Description of Artificial Sequence: Synthetic peptide
  Seed: GDNQIMPKA (MAGA3_HUMAN)
  misc_feature (2)..(2): Xaa can be Glu, Asp, or Gln
  misc_feature (9)..(9): Xaa can be Met, Val, Leu, Ile, Ala, Cys, Phe, Trp, Pro, Thr, Tyr, Glu, Asp, Gly, Ser, or Gln
GXNQIMPKX

SEQ ID NO: 60123 - protein, 11 aa, Artificial Sequence
  Description of Artificial Sequence: Synthetic peptide
  Seed: GDNQIMPKAGL (MAGA3_HUMAN)
  misc_feature (2)..(2): Xaa can be Glu, or Asp
  misc_feature (11)..(11): Xaa can be Leu, Phe, Met, Ile, Val, or Trp
GXNQIMPKAGX

SEQ ID NO: 60124 - protein, 8 aa, Artificial Sequence
  Description of Artificial Sequence: Synthetic peptide
  Seed: GEALGLVG (MAGA3_HUMAN)
  misc_feature (2)..(2): Xaa can be Glu, or Asp
  misc_feature (8)..(8): Xaa can be Ile, Val, Ala, Leu, Gly, Phe, Ser, Tyr, Met, Pro, Thr, or Cys
GXALGLVX

SEQ ID NO: 60125 - protein, 9 aa, Artificial Sequence
  Description of Artificial Sequence: Synthetic peptide
  Seed: GEALGLVGA (MAGA3_HUMAN)
  misc_feature (2)..(2): Xaa can be Glu, Asp, or Gln
  misc_feature (9)..(9): Xaa can be Leu, Phe, Cys, Val, Ile, Ala, Met, Tyr, Pro, Thr, Glu, Gly, Ser, Asp, Arg, Trp, or Gln
GXALGLVGX

SEQ ID NO: 60126 - protein, 11 aa, Artificial Sequence
  Description of Artificial Sequence: Synthetic peptide
  Seed: GEALGLVGAQA (MAGA3_HUMAN)
  misc_feature (2)..(2): Xaa can be Glu, or Asp
  misc_feature (11)..(11): Xaa can be Cys, Leu, Ala, Trp, Phe, Gly, Val, Thr, Pro, Ser, Met, Ile, or Tyr
GXALGLVGAQX

SEQ ID NO: 60127 - protein, 8 aa, Artificial Sequence
  Description of Artificial Sequence: Synthetic peptide
  Seed: GEVPAAES (MAGA3_HUMAN)
  misc_feature (2)..(2): Xaa can be Glu, or Asp
  misc_feature (8)..(8): Xaa can be Leu, Ala, Val, Ile, Ser, Tyr, Pro, Phe, Met, Cys, Gly, or Thr
GXVPAAEX

SEQ ID NO: 60128 - protein, 9 aa, Artificial Sequence
  Description of Artificial Sequence: Synthetic peptide
  Seed: GEVPAAESP (MAGA3_HUMAN)
  misc_feature (2)..(2): Xaa can be Glu, Asp, Gln, Ala, or Ser
  misc_feature (9)..(9): Xaa can be Leu, Ala, Val, Ile, Tyr, Cys, Pro, Thr, Trp, Phe, Met, Ser, Arg, Gly, Lys, Glu, His, Gln, Asp, or Asn
GXVPAAESX

SEQ ID NO: 60129 - protein, 11 aa, Artificial Sequence
  Description of Artificial Sequence: Synthetic peptide
  Seed: GEVPAAESPDP (MAGA3_HUMAN)
  misc_feature (2)..(2): Xaa can be Glu, Asp, or Gln
  misc_feature (11)..(11): Xaa can be Cys, Ala, Leu, Thr, Trp, Ser, Tyr, Pro, Gly, Phe, Ile, Met, or Val
GXVPAAESPDX

SEQ ID NO: 60130 - protein, 10 aa, Artificial Sequence
  Description of Artificial Sequence: Synthetic peptide
  Seed: GGPHISYPPL (MAGA3_HUMAN)
  misc_feature (2)..(2): Xaa can be Arg, Met, Pro, Tyr, Phe, His, Ala, Cys, Thr, Gln, Trp, Ile, Ser, Val, Leu, Asp, Glu, Gly, Asn, or Lys
  misc_feature (10)..(10): Xaa can be Met, Phe, Leu, Ile, or Val
GXPHISYPPX

SEQ ID NO: 60131 - protein, 8 aa, Artificial Sequence
  Description of Artificial Sequence: Synthetic peptide
  Seed: GHLYIFAT (MAGA3_HUMAN)
  misc_feature (2)..(2): Xaa can be , or His
  misc_feature (8)..(8): Xaa can be Cys, Thr, Ala, Met, Val, Leu, or Ile
GXLYIFAX

SEQ ID NO: 60132 - protein, 9 aa, Artificial Sequence
  Description of Artificial Sequence: Synthetic peptide
  Seed: GHLYIFATC (MAGA3_HUMAN)
  misc_feature (2)..(2): Xaa can be His, Gln, or Arg
  misc_feature (9)..(9): Xaa can be Ala, Val, Ile, Cys, Leu, Pro, Ser, Met, or Thr
GXLYIFATX

SEQ ID NO: 60133 - protein, 10 aa, Artificial Sequence
  Description of Artificial Sequence: Synthetic peptide
  Seed: GHLYIFATCL (MAGA3_HUMAN)
  misc_feature (2)..(2): Xaa can be Met, Leu, Tyr, Ile, Val, Phe, Cys, Pro, His, Ala, Asn, Glu, Asp, Trp, Gly, Arg, Gln, Thr, Ser, or Lys
  misc_feature (10)..(10): Xaa can be Val, Ile, Leu, Ala, Thr, or Met
GXLYIFATCX

SEQ ID NO: 60134 - protein, 10 aa, Artificial Sequence
  Description of Artificial Sequence: Synthetic peptide
  Seed: GIELMEVDPI (MAGA3_HUMAN)
  misc_feature (2)..(2): Xaa can be Asp, Met, Pro, Asn, Thr, Phe, Lys, Val, Ile, Ala, Ser, Leu, Trp, Tyr, Glu, Gly, Arg, Cys, Gln, or His
  misc_feature (10)..(10): Xaa can be Met, Ile, Leu, Val, or Phe
GXELMEVDPX

SEQ ID NO: 60135 - protein, 9 aa, Artificial Sequence
  Description of Artificial Sequence: Synthetic peptide
  Seed: GLEARGEAL (MAGA3_HUMAN)
  misc_feature (2)..(2): Xaa can be Val, Ile, Gln, Phe, Leu, Trp, Ser, Met, Thr, Tyr, Arg, Ala, Pro, His, Glu, Gly, Asn, Cys, Lys, or Asp
  misc_feature (9)..(9): Xaa can be Leu, Met, Ile, Phe, Val, Trp, or Tyr
GXEARGEAX

SEQ ID NO: 60136 - protein, 9 aa, Artificial Sequence
  Description of Artificial Sequence: Synthetic peptide
  Seed: GLLIIVLAI (MAGA3_HUMAN)
  misc_feature (2)..(2): Xaa can be Gln, Met, Leu, Glu, Ile, Val, Thr, Ala, Ser, Gly, Asn, Asp, or His
  misc_feature (9)..(9): Xaa can be Val, Ile, Leu, Met, Ala, Phe, Trp, Thr, Cys, or Tyr
GXLIIVLAX

SEQ ID NO: 60137 - protein, 10 aa, Artificial Sequence
  Description of Artificial Sequence: Synthetic peptide
  Seed: GLLIIVLAII (MAGA3_HUMAN)
  misc_feature (2)..(2): Xaa can be Met, Leu, Val, Ile, Trp, Gly, Pro, Ala, Tyr, Thr, Asp, Gln, Ser, His, Lys, Cys, Asn, Glu, Arg, or Phe
  misc_feature (10)..(10): Xaa can be Val, Leu, Ile, Ala, or Met
GXLIIVLAIX

SEQ ID NO: 60138 - protein, 9 aa, Artificial Sequence
  Description of Artificial Sequence: Synthetic peptide
  Seed: GLVGAQAPA (MAGA3_HUMAN)
  misc_feature (2)..(2): Xaa can be Met, Leu, Gln, Ile, Thr, Val, Ala, or Ser
  misc_feature (9)..(9): Xaa can be Ile, Val, Leu, Ala, Met, Phe, Thr, Ser, or Cys
GXVGAQAPX

SEQ ID NO: 60139 - protein, 10 aa, Artificial Sequence
  Description of Artificial Sequence: Synthetic peptide
  Seed: GLVGAQAPAT (MAGA3_HUMAN)
  misc_feature (2)..(2): Xaa can be Leu, Met, Val, Ile, Gln, or Thr
  misc_feature (10)..(10): Xaa can be Val, Leu, Ile, Thr, Ala, or Met
GXVGAQAPAX

SEQ ID NO: 60140 - protein, 9 aa, Artificial Sequence
  Description of Artificial Sequence: Synthetic peptide
  Seed: GNWQYFFPV (MAGA3_HUMAN)
  misc_feature (2)..(2): Xaa can be Met, Leu, Gln, Ile, Thr, Val, Ala, Ser, Gly, Phe, Asn, Glu, Trp, Cys, Tyr, Asp, Arg, or Ly s
  misc_feature (9)..(9): Xaa can be Val, Leu, Ile, Ala, Met, Thr, Ser, Cys, Pro, Phe, Gly, Tyr, Gln, Glu, Arg, or Lys
GXWQYFFPX

SEQ ID NO: 60141 - protein, 10 aa, Artificial Sequence
  Description of Artificial Sequence: Synthetic peptide
  Seed: GNWQYFFPVI (MAGA3_HUMAN)
  misc_feature (2)..(2): Xaa can be Tyr, Arg, Val, Ser, Lys, Thr, Met, Ile, Phe, Trp, Ala, Asn, Cys, Leu, Glu, Gln, His, Pro, Gly, or Asp
  misc_feature (10)..(10): Xaa can be Trp, Phe, Ile, Leu, Met, Val, or Tyr
GXWQYFFPVX

SEQ ID NO: 60142 - protein, 11 aa, Artificial Sequence
  Description of Artificial Sequence: Synthetic peptide
  Seed: GNWQYFFPVIF (MAGA3_HUMAN)
  misc_feature (2)..(2): Xaa can be Thr, Arg, Met, Ile, Gln, Cys, Lys, Ser, Asp, Val, Asn, Phe, Leu, Tyr, Ala, Gly, Pro, Glu, His, or Trp
  misc_feature (11)..(11): Xaa can be Tyr, Met, or Phe
GXWQYFFPVIX

SEQ ID NO: 60143 - protein, 9 aa, Artificial Sequence
  Description of Artificial Sequence: Synthetic peptide
  Seed: GPHISYPPL (MAGA3_HUMAN)
  misc_feature (2)..(2): Xaa can be Pro, Ala, His, Arg, or Gln
  misc_feature (9)..(9): Xaa can be Val, Leu, Ile, Phe, Met, Ala, Tyr, Gly, Cys, Ser, Trp, Thr, Arg, or Pro
GXHISYPPX

SEQ ID NO: 60144 - protein, 8 aa, Artificial Sequence
  Description of Artificial Sequence: Synthetic peptide
  Seed: GPRALVET (MAGA3_HUMAN)
  misc_feature (2)..(2): Xaa can be , or Pro
  misc_feature (8)..(8): Xaa can be Ile, Thr, Met, Ala, Leu, Pro, or Val
GXRALVEX

SEQ ID NO: 60145 - protein, 9 aa, Artificial Sequence
  Description of Artificial Sequence: Synthetic peptide
  Seed: GPRALVETS (MAGA3_HUMAN)
  misc_feature (2)..(2): Xaa can be Pro, Ala, Val, Ile, Ser, or Thr
  misc_feature (9)..(9): Xaa can be Leu, Met, Ala, Ile, Val, Phe, Ser, His, Pro, Cys, Trp, Thr, Tyr, Gly, or Gln
GXRALVETX

SEQ ID NO: 60146 - protein, 10 aa, Artificial Sequence
  Description of Artificial Sequence: Synthetic peptide
  Seed: GPRALVETSY (MAGA3_HUMAN)
  misc_feature (2)..(2): Xaa can be Pro, Gln, Met, Leu, Val, Ile, Ser, Thr, Glu, Ala, Lys, Asn, Gly, or Phe
  misc_feature (10)..(10): Xaa can be Tyr, Phe, Met, Trp, Leu, Cys, Pro, Ile, Gly, Ser, Ala, Val, or Thr
GXRALVETSX

SEQ ID NO: 60147 - protein, 11 aa, Artificial Sequence
  Description of Artificial Sequence: Synthetic peptide
  Seed: GPRALVETSYV (MAGA3_HUMAN)
  misc_feature (2)..(2): Xaa can be , or Pro
  misc_feature (11)..(11): Xaa can be Met, Val, Phe, Ile, Leu, Cys, or Ala
GXRALVETSYX

SEQ ID NO: 60148 - protein, 8 aa, Artificial Sequence
  Description of Artificial Sequence: Synthetic peptide
  Seed: GPSTFPDL (MAGA3_HUMAN)
  misc_feature (2)..(2): Xaa can be , or Pro
  misc_feature (8)..(8): Xaa can be , or Leu
GXSTFPDX

SEQ ID NO: 60149 - protein, 10 aa, Artificial Sequence
  Description of Artificial Sequence: Synthetic peptide
  Seed: GPSTFPDLES (MAGA3_HUMAN)
  misc_feature (2)..(2): Xaa can be , or Pro
  misc_feature (10)..(10): Xaa can be Ser, Met, Ala, Pro, Leu, Phe, Thr, Ile, Cys, or Val
GXSTFPDLEX

SEQ ID NO: 60150 - protein, 11 aa, Artificial Sequence
  Description of Artificial Sequence: Synthetic peptide
  Seed: GREDSILGDPK (MAGA3_HUMAN)
  misc_feature (2)..(2): Xaa can be Arg, or Gly
  misc_feature (11)..(11): Xaa can be Lys, Leu, Tyr, Phe, Arg, Trp, or Met
GXEDSILGDPX

SEQ ID NO: 60151 - protein, 9 aa, Artificial Sequence
  Description of Artificial Sequence: Synthetic peptide
  Seed: GSDPACYEF (MAGA3_HUMAN)
  misc_feature (2)..(2): Xaa can be Thr, Ala, Ser, Tyr, Phe, Leu, Ile, Val, Met, Arg, Gly, Trp, Gln, Asn, Cys, Asp, Glu, Pro, His, or Lys
  misc_feature (9)..(9): Xaa can be Tyr, Ile, Trp, Leu, Met, Phe, Val, Lys, Arg, Cys, Ala, His, Thr, Gln, or Ser
GXDPACYEX

SEQ ID NO: 60152 - protein, 10 aa, Artificial Sequence
  Description of Artificial Sequence: Synthetic peptide
  Seed: GSDPACYEFL (MAGA3_HUMAN)
  misc_feature (2)..(2): Xaa can be Thr, Ala, Ser, Ile, Phe, Met, Leu, Val, Tyr, Gly, Cys, Trp, Asn, Gln, Pro, Asp, Glu, His, or Lys
  misc_feature (10)..(10): Xaa can be Tyr, Lys, Phe, Trp, Met, Leu, Val, Ile, Arg, His, Cys, or Gln
GXDPACYEFX

SEQ ID NO: 60153 - protein, 11 aa, Artificial Sequence
  Description of Artificial Sequence: Synthetic peptide
  Seed: GSDPACYEFLW (MAGA3_HUMAN)
  misc_feature (2)..(2): Xaa can be Thr, Ser, Ala, Cys, Val, Phe, Trp, Pro, Gln, Asn, Met, Gly, Ile, Leu, or Tyr
  misc_feature (11)..(11): Xaa can be Trp, Phe, or Tyr
GXDPACYEFLX

SEQ ID NO: 60154 - protein, 9 aa, Artificial Sequence
  Description of Artificial Sequence: Synthetic peptide
  Seed: GSVVGNWQY (MAGA3_HUMAN)
  misc_feature (2)..(2): Xaa can be Ala, Gln, Thr, Ser, Val, Ile, Met, Leu, Lys, Asp, Glu, Asn, Gly, Pro, Phe, Arg, Trp, Cys, His, or Tyr
  misc_feature (9)..(9): Xaa can be Tyr, Phe, Trp, Met, Lys, Leu, Arg, Ile, His, or Val
GXVVGNWQX

SEQ ID NO: 60155 - protein, 10 aa, Artificial Sequence
  Description of Artificial Sequence: Synthetic peptide
  Seed: GSVVGNWQYF (MAGA3_HUMAN)
  misc_feature (2)..(2): Xaa can be Ala, Gln, Met, Thr, Leu, Ile, Ser, Val, Arg, Gly, Asn, Cys, Lys, Glu, Tyr, Asp, Phe, Trp, His, or Pro
  misc_feature (10)..(10): Xaa can be Trp, Tyr, Phe, Met, Leu, or His
GXVVGNWQYX

SEQ ID NO: 60156 - protein, 11 aa, Artificial Sequence
  Description of Artificial Sequence: Synthetic peptide
  Seed: GSVVGNWQYFF (MAGA3_HUMAN)
  misc_feature (2)..(2): Xaa can be Ser, Thr, Arg, Cys, Val, Met, Gly, Ala, or Lys
  misc_feature (11)..(11): Xaa can be Trp, or Phe
GXVVGNWQYFX

SEQ ID NO: 60157 - protein, 11 aa, Artificial Sequence
  Description of Artificial Sequence: Synthetic peptide
  Seed: HCKPEEGLEAR (MAGA3_HUMAN)
  misc_feature (2)..(2): Xaa can be Val, Thr, Ala, Ser, Ile, Met, Phe, Gln, Gly, Leu, Cys, Tyr, Pro, Trp, Asn, Asp, Glu, or Hi s
  misc_feature (11)..(11): Xaa can be Arg, Lys, Tyr, Phe, Met, Trp, Leu, Ile, His, Val, or Gln
HXKPEEGLEAX

SEQ ID NO: 60158 - protein, 8 aa, Artificial Sequence
  Description of Artificial Sequence: Synthetic peptide
  Seed: HEWVLREG (MAGA3_HUMAN)
  misc_feature (2)..(2): Xaa can be Glu, Asp, or Gln
  misc_feature (8)..(8): Xaa can be Leu, Phe, Met, Ile, Ala, Tyr, Val, Pro, Trp, Ser, Thr, Cys, Arg, Lys, His, Glu, Gly, or Gl n
HXWVLREX

SEQ ID NO: 60159 - protein, 9 aa, Artificial Sequence
  Description of Artificial Sequence: Synthetic peptide
  Seed: HEWVLREGE (MAGA3_HUMAN)
  misc_feature (2)..(2): Xaa can be Glu, Asp, or Gln
  misc_feature (9)..(9): Xaa can be Val, Ala, Cys, Leu, Ile, Thr, Phe, Pro, Met, Trp, Gln, Lys, Ser, Tyr, Glu, Asp, or Gly
HXWVLREGX

SEQ ID NO: 60160 - protein, 8 aa, Artificial Sequence
  Description of Artificial Sequence: Synthetic peptide
  Seed: HFLLLKYR (MAGA3_HUMAN)
  misc_feature (2)..(2): Xaa can be Phe, Met, Ser, Leu, Ile, Ala, Tyr, Trp, Thr, Val, or Gln
  misc_feature (8)..(8): Xaa can be Arg, or Lys
HXLLLKYX

SEQ ID NO: 60161 - protein, 10 aa, Artificial Sequence
  Description of Artificial Sequence: Synthetic peptide
  Seed: HFLLLKYRAR (MAGA3_HUMAN)
  misc_feature (2)..(2): Xaa can be Trp, Ile, Tyr, Phe, Thr, Ser, Val, Leu, Met, Gln, Ala, His, Lys, Cys, Gly, Asn, Asp, Pro, Arg, or Glu
  misc_feature (10)..(10): Xaa can be Arg, or Lys
HXLLLKYRAX

SEQ ID NO: 60162 - protein, 8 aa, Artificial Sequence
  Description of Artificial Sequence: Synthetic peptide
  Seed: HFVQENYL (MAGA3_HUMAN)
  misc_feature (2)..(2): Xaa can be Tyr, or Phe
  misc_feature (8)..(8): Xaa can be Phe, Leu, Tyr, or Met
HXVQENYX

SEQ ID NO: 60163 - protein, 10 aa, Artificial Sequence
  Description of Artificial Sequence: Synthetic peptide
  Seed: HFVQENYLEY (MAGA3_HUMAN)
  misc_feature (2)..(2): Xaa can be Arg, Ala, Thr, Gln, Met, Ser, Leu, Val, Tyr, Ile, Pro, Glu, Phe, His, Gly, Trp, Asp, Asn, Lys, or Cys
  misc_feature (10)..(10): Xaa can be Phe, Tyr, Met, Leu, Lys, Trp, Arg, His, Val, or Ile
HXVQENYLEX

SEQ ID NO: 60164 - protein, 11 aa, Artificial Sequence
  Description of Artificial Sequence: Synthetic peptide
  Seed: HFVQENYLEYR (MAGA3_HUMAN)
  misc_feature (2)..(2): Xaa can be Met, Tyr, Val, Trp, Arg, Phe, Thr, Ala, Lys, Cys, Gln, Leu, Asn, Gly, Ile, Ser, or His
  misc_feature (11)..(11): Xaa can be Arg, or Lys
HXVQENYLEYX

SEQ ID NO: 60165 - protein, 8 aa, Artificial Sequence
  Description of Artificial Sequence: Synthetic peptide
  Seed: HHMVKISG (MAGA3_HUMAN)
  misc_feature (2)..(2): Xaa can be His, Gln, Glu, Arg, Pro, or Asn
  misc_feature (8)..(8): Xaa can be Ala, Val, Leu, Ile, Thr, Cys, Met, Gly, Pro, Phe, or Ser
HXMVKISX

SEQ ID NO: 60166 - protein, 9 aa, Artificial Sequence
  Description of Artificial Sequence: Synthetic peptide
  Seed: HHMVKISGG (MAGA3_HUMAN)
  misc_feature (2)..(2): Xaa can be His, Gln, Arg, Pro, Glu, Lys, Asn, Asp, or Ala
  misc_feature (9)..(9): Xaa can be Ala, Val, Ile, Leu, Cys, Met, Thr, Pro, Gly, Phe, Tyr, or Ser
HXMVKISGX

SEQ ID NO: 60167 - protein, 10 aa, Artificial Sequence
  Description of Artificial Sequence: Synthetic peptide
  Seed: HISYPPLHEW (MAGA3_HUMAN)
  misc_feature (2)..(2): Xaa can be Ser, Thr, Gly, Ala, Ile, Gln, Pro, Val, Asp, Arg, His, Lys, Tyr, Phe, Cys, Asn, Trp, Glu, Met, or Leu
  misc_feature (10)..(10): Xaa can be Leu, Tyr, Trp, Met, Ile, Phe, Lys, Val, or Arg
HXSYPPLHEX

SEQ ID NO: 60168 - protein, 11 aa, Artificial Sequence
  Description of Artificial Sequence: Synthetic peptide
  Seed: HISYPPLHEWV (MAGA3_HUMAN)
  misc_feature (2)..(2): Xaa can be Phe, Met, Tyr, Leu, Ser, Cys, Ala, Asn, Glu, His, Trp, Thr, Asp, Gln, Ile, Gly, Lys, Val, Arg, or Pro
  misc_feature (11)..(11): Xaa can be Thr, Gly, Pro, Leu, Ala, Cys, Ile, Met, Trp, Arg, Val, Tyr, Asn, Ser, Gln, Glu, Asp, His, Phe, or Lys
HXSYPPLHEWX

SEQ ID NO: 60169 - protein, 9 aa, Artificial Sequence
  Description of Artificial Sequence: Synthetic peptide
  Seed: HLYIFATCL (MAGA3_HUMAN)
  misc_feature (2)..(2): Xaa can be Gln, Met, Leu, Ala, Tyr, Val, Phe, Ser, Thr, Ile, Arg, Lys, Asn, His, Gly, Pro, Glu, Trp, Asp, or Cys
  misc_feature (9)..(9): Xaa can be Phe, Leu, Met, Tyr, Ile, Val, Trp, Arg, Lys, Ala, His, Cys, Thr, Gly, Ser, or Pro
HXYIFATCX

SEQ ID NO: 60170 - protein, 11 aa, Artificial Sequence
  Description of Artificial Sequence: Synthetic peptide
  Seed: HLYIFATCLGL (MAGA3_HUMAN)
  misc_feature (2)..(2): Xaa can be Leu, Met, Ile, Arg, Gln, Asn, Tyr, Cys, Ala, His, Ser, Asp, Phe, Pro, Lys, Glu, Val, Trp, Thr, or Gly
  misc_feature (11)..(11): Xaa can be Val, Ala, Ile, or Leu
HXYIFATCLGX

SEQ ID NO: 60171 - protein, 10 aa, Artificial Sequence
  Description of Artificial Sequence: Synthetic peptide
  Seed: HMVKISGGPH (MAGA3_HUMAN)
  misc_feature (2)..(2): Xaa can be Ala, Ser, Val, Met, Thr, Ile, Gly, Leu, Gln, Asn, Cys, Glu, or Phe
  misc_feature (10)..(10): Xaa can be Tyr, Lys, Phe, Met, His, Leu, Arg, Ile, Val, or Trp
HXVKISGGPX

SEQ ID NO: 60172 - protein, 11 aa, Artificial Sequence
  Description of Artificial Sequence: Synthetic peptide
  Seed: HMVKISGGPHI (MAGA3_HUMAN)
  misc_feature (2)..(2): Xaa can be Gln, Met, Leu, Ile, Glu, or Val
  misc_feature (11)..(11): Xaa can be Trp, Phe, Leu, Ile, Val, Met, or Tyr
HXVKISGGPHX

SEQ ID NO: 60173 - protein, 9 aa, Artificial Sequence
  Description of Artificial Sequence: Synthetic peptide
  Seed: IAREGDCAP (MAGA3_HUMAN)
  misc_feature (2)..(2): Xaa can be Ala, Pro, Ile, Ser, Val, Leu, Thr, Gly, Met, Gln, Asn, Cys, Phe, Asp, Glu, Tyr, or Lys
  misc_feature (9)..(9): Xaa can be Tyr, Phe, Met, Leu, Val, Ile, Lys, His, Ala, Arg, Trp, Thr, Cys, Ser, Pro, Gly, or Gln
IXREGDCAX

SEQ ID NO: 60174 - protein, 9 aa, Artificial Sequence
  Description of Artificial Sequence: Synthetic peptide
  Seed: IELMEVDPI (MAGA3_HUMAN)
  misc_feature (2)..(2): Xaa can be Glu, Asp, or Gln
  misc_feature (9)..(9): Xaa can be Leu, Val, Ile, Met, Ala, Phe, Gly, Thr, Cys, Pro, or Ser
IXLMEVDPX

SEQ ID NO: 60175 - protein, 8 aa, Artificial Sequence
  Description of Artificial Sequence: Synthetic peptide
  Seed: IFATCLGL (MAGA3_HUMAN)
  misc_feature (2)..(2): Xaa can be Phe, or Tyr
  misc_feature (8)..(8): Xaa can be Tyr, Leu, Met, or Phe
IXATCLGX

SEQ ID NO: 60176 - protein, 10 aa, Artificial Sequence
  Description of Artificial Sequence: Synthetic peptide
  Seed: IFATCLGLSY (MAGA3_HUMAN)
  misc_feature (2)..(2): Xaa can be Gln, Met, Thr, Ser, Tyr, Ile, Lys, Val, Ala, Leu, Trp, Pro, Asp, His, Phe, Gly, Asn, Glu, Cys, or Arg
  misc_feature (10)..(10): Xaa can be Tyr, Met, Phe, Trp, Lys, Leu, Ile, Arg, Val, His, or Ala
IXATCLGLSX

SEQ ID NO: 60177 - protein, 9 aa, Artificial Sequence
  Description of Artificial Sequence: Synthetic peptide
  Seed: IFSKASSSL (MAGA3_HUMAN)
  misc_feature (2)..(2): Xaa can be Ala, Tyr, Leu, Arg, Ser, Thr, Ile, Gln, Phe, Val, Gly, Met, Trp, Asn, Pro, Asp, Glu, Lys, Cys, or His
  misc_feature (9)..(9): Xaa can be Tyr, Met, Leu, Phe, Ile, Val, Trp, Lys, Arg, His, Ala, Cys, or Thr
IXSKASSSX

SEQ ID NO: 60178 - protein, 11 aa, Artificial Sequence
  Description of Artificial Sequence: Synthetic peptide
  Seed: IFSKASSSLQL (MAGA3_HUMAN)
  misc_feature (2)..(2): Xaa can be Tyr, Trp, or Phe
  misc_feature (11)..(11): Xaa can be Leu, Phe, Trp, Met, Tyr, Ile, or Val
IXSKASSSLQX

SEQ ID NO: 60179 - protein, 9 aa, Artificial Sequence
  Description of Artificial Sequence: Synthetic peptide
  Seed: IIVLAIIAR (MAGA3_HUMAN)
  misc_feature (2)..(2): Xaa can be Ala, Thr, Val, Ser, Gly, Met, Leu, Ile, Pro, Cys, Gln, Asn, Trp, Phe, Tyr, Glu, Asp, or Hi s
  misc_feature (9)..(9): Xaa can be Arg, Lys, Leu, Met, Val, Phe, Tyr, Ile, His, Ala, Cys, or Trp
IXVLAIIAX

SEQ ID NO: 60180 - protein, 8 aa, Artificial Sequence
  Description of Artificial Sequence: Synthetic peptide
  Seed: ILGDPKKL (MAGA3_HUMAN)
  misc_feature (2)..(2): Xaa can be Ala, Ser, Val, Ile, Thr, Leu, Met, Gly, Asn, Gln, Arg, Tyr, Phe, His, Trp, Glu, Cys, Asp, Pro, or Lys
  misc_feature (8)..(8): Xaa can be Leu, Tyr, Phe, Met, Ile, Val, Lys, Arg, His, Trp, or Ala
IXGDPKKX

SEQ ID NO: 60181 - protein, 9 aa, Artificial Sequence
  Description of Artificial Sequence: Synthetic peptide
  Seed: ILGDPKKLL (MAGA3_HUMAN)
  misc_feature (2)..(2): Xaa can be Ala, Ser, Arg, Tyr, Leu, Val, Phe, Met, Gly, Thr, Gln, Ile, Glu, Asn, Trp, His, Cys, Asp, Lys, or Pro
  misc_feature (9)..(9): Xaa can be Met, Tyr, Leu, Phe, Ile, Val, Arg, Lys, Trp, His, Ala, Cys, Gln, or Thr
IXGDPKKLX

SEQ ID NO: 60182 - protein, 8 aa, Artificial Sequence
  Description of Artificial Sequence: Synthetic peptide
  Seed: IMPKAGLL (MAGA3_HUMAN)
  misc_feature (2)..(2): Xaa can be Thr, Ala, Ser, Phe, Tyr, Gly, Val, Met, Leu, Trp, Gln, Ile, Asn, Pro, Glu, Cys, His, Asp, or Arg
  misc_feature (8)..(8): Xaa can be Leu, Val, Ile, Met, Phe, or Tyr
IXPKAGLX

SEQ ID NO: 60183 - protein, 9 aa, Artificial Sequence
  Description of Artificial Sequence: Synthetic peptide
  Seed: IMPKAGLLI (MAGA3_HUMAN)
  misc_feature (2)..(2): Xaa can be Ala, Tyr, Leu, Met, Arg, Phe, Ser, Gln, Val, Thr, Gly, Ile, Asn, Pro, Trp, Asp, Glu, His, Cys, or Lys
  misc_feature (9)..(9): Xaa can be Tyr, Val, Ile, Met, Leu, Phe, Trp, Lys, Arg, Ala, Cys, His, Thr, Ser, or Pro
IXPKAGLLX

SEQ ID NO: 60184 - protein, 10 aa, Artificial Sequence
  Description of Artificial Sequence: Synthetic peptide
  Seed: IMPKAGLLII (MAGA3_HUMAN)
  misc_feature (2)..(2): Xaa can be Leu, Met, Ile, Val, Arg, Pro, Ala, His, Thr, Lys, Phe, Tyr, Ser, Trp, Gly, Asp, Gln, Glu, Asn, or Cys
  misc_feature (10)..(10): Xaa can be Leu, Met, Ile, Phe, Val, or Ala
IXPKAGLLIX

SEQ ID NO: 60185 - protein, 11 aa, Artificial Sequence
  Description of Artificial Sequence: Synthetic peptide
  Seed: IMPKAGLLIIV (MAGA3_HUMAN)
  misc_feature (2)..(2): Xaa can be Leu, or Met
  misc_feature (11)..(11): Xaa can be Leu, Val, or Ile
IXPKAGLLIIX

SEQ ID NO: 60186 - protein, 9 aa, Artificial Sequence
  Description of Artificial Sequence: Synthetic peptide
  Seed: ISGGPHISY (MAGA3_HUMAN)
  misc_feature (2)..(2): Xaa can be Ala, Pro, Ser, Tyr, Arg, Val, Ile, Phe, Thr, Gly, Gln, Leu, Met, Asn, Trp, Glu, Cys, His, Asp, or Lys
  misc_feature (9)..(9): Xaa can be Tyr, Ile, Leu, Met, Trp, Phe, Arg, Lys, Val, His, Ala, Cys, Thr, Gln, Ser, Pro, Gly, or As n
IXGGPHISX

SEQ ID NO: 60187 - protein, 9 aa, Artificial Sequence
  Description of Artificial Sequence: Synthetic peptide
  Seed: ISYPPLHEW (MAGA3_HUMAN)
  misc_feature (2)..(2): Xaa can be Ala, Arg, Val, Ser, Thr, Gln, Gly, Tyr, Pro, Ile, Met, Leu, Glu, His, Asn, Phe, Cys, Lys, Trp, or Asp
  misc_feature (9)..(9): Xaa can be Leu, Met, Phe, His, Ile, Lys, Tyr, Trp, Val, Cys, Arg, Ala, Thr, Gln, Ser, Pro, Gly, Asn, Glu, or Asp
IXYPPLHEX

SEQ ID NO: 60188 - protein, 10 aa, Artificial Sequence
  Description of Artificial Sequence: Synthetic peptide
  Seed: ISYPPLHEWV (MAGA3_HUMAN)
  misc_feature (2)..(2): Xaa can be Tyr, Ala, Ser, Thr, Trp, Met, Leu, Gln, Ile, Val, Cys, Pro, Lys, Glu, Asn, Phe, Gly, Asp, Arg, or His
  misc_feature (10)..(10): Xaa can be Val, Phe, Tyr, Trp, Leu, Ile, Met, Ala, Ser, Thr, Cys, Arg, Asp, Pro, Gly, Glu, His, Lys, Gln, or Asn
IXYPPLHEWX

SEQ ID NO: 60189 - protein, 11 aa, Artificial Sequence
  Description of Artificial Sequence: Synthetic peptide
  Seed: ISYPPLHEWVL (MAGA3_HUMAN)
  misc_feature (2)..(2): Xaa can be Thr, Ser, Tyr, Ala, Arg, Met, Trp, Val, Ile, Phe, Lys, Leu, His, Gln, Asn, Cys, Gly, Pro, Asp, or Glu
  misc_feature (11)..(11): Xaa can be Trp, Phe, Ile, Leu, Met, Tyr, Val, Thr, Cys, Ala, Pro, Gly, Lys, Glu, Gln, Ser, Arg, His, Asn, or Asp
IXYPPLHEWVX

SEQ ID NO: 60190 - protein, 8 aa, Artificial Sequence
  Description of Artificial Sequence: Synthetic peptide
  Seed: IVLAIIAR (MAGA3_HUMAN)
  misc_feature (2)..(2): Xaa can be Leu, Ser, Trp, Thr, Val, Tyr, Met, or Phe
  misc_feature (8)..(8): Xaa can be , or Arg
IXLAIIAX

SEQ ID NO: 60191 - protein, 8 aa, Artificial Sequence
  Description of Artificial Sequence: Synthetic peptide
  Seed: IWEELSVL (MAGA3_HUMAN)
  misc_feature (2)..(2): Xaa can be Tyr, Phe, Arg, Trp, Met, Gly, Gln, Glu, His, Ser, Asn, Ala, or Thr
  misc_feature (8)..(8): Xaa can be Leu, Phe, Met, Tyr, Ile, or Val
IXEELSVX

SEQ ID NO: 60192 - protein, 11 aa, Artificial Sequence
  Description of Artificial Sequence: Synthetic peptide
  Seed: IWEELSVLEVF (MAGA3_HUMAN)
  misc_feature (2)..(2): Xaa can be Tyr, Trp, or Phe
  misc_feature (11)..(11): Xaa can be Phe, Trp, Leu, Ile, or Met
IXEELSVLEVX

SEQ ID NO: 60193 - protein, 9 aa, Artificial Sequence
  Description of Artificial Sequence: Synthetic peptide
  Seed: KAEMLGSVV (MAGA3_HUMAN)
  misc_feature (2)..(2): Xaa can be Ala, Ser, Gln, Val, Thr, Ile, Phe, Met, Tyr, Arg, Leu, Gly, Glu, Asn, Trp, His, Asp, or Cy s
  misc_feature (9)..(9): Xaa can be Leu, Met, Phe, Ile, Val, Tyr, Lys, His, or Trp
KXEMLGSVX

SEQ ID NO: 60194 - protein, 10 aa, Artificial Sequence
  Description of Artificial Sequence: Synthetic peptide
  Seed: KAEMLGSVVG (MAGA3_HUMAN)
  misc_feature (2)..(2): Xaa can be Cys, Tyr, Lys, Glu, Asp, Ile, Thr, Gly, Asn, Ser, Leu, Ala, His, Gln, Phe, Met, Arg, Pro, Val, or Trp
  misc_feature (10)..(10): Xaa can be Ser, Pro, Gly, Ile, Cys, Met, Phe, Val, Ala, Leu, or Thr
KXEMLGSVVX

SEQ ID NO: 60195 - protein, 8 aa, Artificial Sequence
  Description of Artificial Sequence: Synthetic peptide
  Seed: KAGLLIIV (MAGA3_HUMAN)
  misc_feature (2)..(2): Xaa can be Ala, Ser, Thr, Gln, Glu, Ile, or Val
  misc_feature (8)..(8): Xaa can be Leu, Ile, Val, Met, Phe, or Tyr
KXGLLIIX

SEQ ID NO: 60196 - protein, 9 aa, Artificial Sequence
  Description of Artificial Sequence: Synthetic peptide
  Seed: KAGLLIIVL (MAGA3_HUMAN)
  misc_feature (2)..(2): Xaa can be Gln, Arg, Ala, Ser, Val, Thr, Leu, Gly, Ile, Asn, Met, Glu, His, Tyr, Cys, Phe, Lys, Pro, Asp, or Trp
  misc_feature (9)..(9): Xaa can be Tyr, Leu, Trp, Phe, Met, Val, Ile, His, Cys, Lys, Ala, Arg, Gln, or Thr
KXGLLIIVX

SEQ ID NO: 60197 - protein, 8 aa, Artificial Sequence
  Description of Artificial Sequence: Synthetic peptide
  Seed: KASSSLQL (MAGA3_HUMAN)
  misc_feature (2)..(2): Xaa can be Ala, Ser, Thr, Val, Ile, Met, Gly, Gln, Leu, Arg, Asn, or Cys
  misc_feature (8)..(8): Xaa can be Trp, Leu, Phe, Tyr, Met, Val, or Ile
KXSSSLQX

SEQ ID NO: 60198 - protein, 9 aa, Artificial Sequence
  Description of Artificial Sequence: Synthetic peptide
  Seed: KASSSLQLV (MAGA3_HUMAN)
  misc_feature (2)..(2): Xaa can be Thr, Met, Ser, Val, Gln, Leu, Ala, Ile, Tyr, Phe, Gly, Asn, Arg, Cys, Trp, His, Glu, Asp, Pro, or Lys
  misc_feature (9)..(9): Xaa can be Tyr, Trp, Leu, Phe, Met, Val, Ile, Lys, Arg, Ala, His, Cys, Thr, Gly, or Ser
KXSSSLQLX

SEQ ID NO: 60199 - protein, 10 aa, Artificial Sequence
  Description of Artificial Sequence: Synthetic peptide
  Seed: KASSSLQLVF (MAGA3_HUMAN)
  misc_feature (2)..(2): Xaa can be Ala, Met, Ser, Thr, Gln, Leu, Cys, Phe, Ile, Tyr, His, Val, Trp, Asp, Pro, Asn, Arg, Gly, Lys, or Glu
  misc_feature (10)..(10): Xaa can be Tyr, Ile, Cys, Trp, Met, Leu, Val, Phe, Gly, His, or Asn
KXSSSLQLVX

SEQ ID NO: 60200 - protein, 10 aa, Artificial Sequence
  Description of Artificial Sequence: Synthetic peptide
  Seed: KISGGPHISY (MAGA3_HUMAN)
  misc_feature (2)..(2): Xaa can be Ala, Arg, Met, Val, Thr, Ser, Gln, Leu, Ile, Glu, Gly, Tyr, Cys, Phe, Asn, Lys, Trp, Pro, His, or Asp
  misc_feature (10)..(10): Xaa can be Tyr, Met, Trp, Phe, Lys, Leu, Arg, Ile, Val, His, Cys, Ala, Thr, Gln, or Ser
KXSGGPHISX

SEQ ID NO: 60201 - protein, 8 aa, Artificial Sequence
  Description of Artificial Sequence: Synthetic peptide
  Seed: KIWEELSV (MAGA3_HUMAN)
  misc_feature (2)..(2): Xaa can be Leu, Met, Ile, Gln, or Val
  misc_feature (8)..(8): Xaa can be Val, Ile, Met, Ala, or Leu
KXWEELSX

SEQ ID NO: 60202 - protein, 9 aa, Artificial Sequence
  Description of Artificial Sequence: Synthetic peptide
  Seed: KIWEELSVL (MAGA3_HUMAN)
  misc_feature (2)..(2): Xaa can be Leu, Met, Gln, Ala, Arg, Thr, Val, Ile, Ser, Glu, Phe, Tyr, Gly, Asn, Asp, Cys, Lys, His, Trp, or Pro
  misc_feature (9)..(9): Xaa can be Met, Trp, Val, Tyr, Phe, Leu, Ile, Arg, Lys, His, Ala, Cys, Thr, Gln, Ser, Gly, Pro, Glu, or Asn
KXWEELSVX

SEQ ID NO: 60203 - protein, 11 aa, Artificial Sequence
  Description of Artificial Sequence: Synthetic peptide
  Seed: KIWEELSVLEV (MAGA3_HUMAN)
  misc_feature (2)..(2): Xaa can be Leu, Met, Gln, Ile, Val, Thr, Ala, Glu, Ser, Asn, His, Lys, Gly, Phe, or Arg
  misc_feature (11)..(11): Xaa can be Trp, Phe, Leu, Val, Ile, Met, Ala, Thr, Cys, Tyr, Lys, Gly, Pro, Ser, Arg, Asp, Glu, Gln, His, or Asn
KXWEELSVLEX

SEQ ID NO: 60204 - protein, 8 aa, Artificial Sequence
  Description of Artificial Sequence: Synthetic peptide
  Seed: KKLLTQHF (MAGA3_HUMAN)
  misc_feature (2)..(2): Xaa can be Gln, Met, Glu, Lys, His, or Arg
  misc_feature (8)..(8): Xaa can be Tyr, Phe, Met, or Leu
KXLLTQHX

SEQ ID NO: 60205 - protein, 8 aa, Artificial Sequence
  Description of Artificial Sequence: Synthetic peptide
  Seed: KLLTQHFV (MAGA3_HUMAN)
  misc_feature (2)..(2): Xaa can be Leu, or Met
  misc_feature (8)..(8): Xaa can be Leu, Val, or Ile
KXLTQHFX

SEQ ID NO: 60206 - protein, 8 aa, Artificial Sequence
  Description of Artificial Sequence: Synthetic peptide
  Seed: KPEEGLEA (MAGA3_HUMAN)
  misc_feature (2)..(2): Xaa can be , or Pro
  misc_feature (8)..(8): Xaa can be Leu, Val, or Ala
KXEEGLEX

SEQ ID NO: 60207 - protein, 9 aa, Artificial Sequence
  Description of Artificial Sequence: Synthetic peptide
  Seed: KPEEGLEAR (MAGA3_HUMAN)
  misc_feature (2)..(2): Xaa can be Val, Ala, Ile, Thr, Tyr, Pro, Met, Asn, Phe, Leu, Ser, Gln, Trp, or Gly
  misc_feature (9)..(9): Xaa can be Arg, or Lys
KXEEGLEAX

SEQ ID NO: 60208 - protein, 8 aa, Artificial Sequence
  Description of Artificial Sequence: Synthetic peptide
  Seed: KVAELVHF (MAGA3_HUMAN)
  misc_feature (2)..(2): Xaa can be Ala, Thr, Ser, Val, Ile, Gln, Gly, Leu, Met, Asn, Glu, Cys, Lys, Asp, Pro, or Phe
  misc_feature (8)..(8): Xaa can be Trp, Tyr, Phe, Leu, Met, Lys, Ile, Val, or His
KXAELVHX

SEQ ID NO: 60209 - protein, 9 aa, Artificial Sequence
  Description of Artificial Sequence: Synthetic peptide
  Seed: KVAELVHFL (MAGA3_HUMAN)
  misc_feature (2)..(2): Xaa can be Met, Leu, Ile, Val, Thr, Gln, Ser, Ala, Pro, Arg, Tyr, Phe, Asn, Glu, Trp, Gly, Cys, Lys, His, or Asp
  misc_feature (9)..(9): Xaa can be Trp, Lys, Met, Phe, Arg, Ile, Tyr, Leu, Val, Ala, His, Cys, Thr, Gly, Ser, Pro, Gln, Asn, Glu, or Asp
KXAELVHFX

SEQ ID NO: 60210 - protein, 10 aa, Artificial Sequence
  Description of Artificial Sequence: Synthetic peptide
  Seed: KVAELVHFLL (MAGA3_HUMAN)
  misc_feature (2)..(2): Xaa can be Ile, Thr, Met, Val, Gln, Leu, Ser, Ala, Gly, Glu, Phe, Cys, Asn, Trp, Tyr, Pro, His, Lys, Asp, or Arg
  misc_feature (10)..(10): Xaa can be Trp, Phe, Lys, Arg, Leu, Tyr, Met, Ile, Val, Ala, Asn, Gly, Thr, His, Ser, Asp, Cys, Pro, Gln, or Glu
KXAELVHFLX

SEQ ID NO: 60211 - protein, 11 aa, Artificial Sequence
  Description of Artificial Sequence: Synthetic peptide
  Seed: KVAELVHFLLL (MAGA3_HUMAN)
  misc_feature (2)..(2): Xaa can be Ile, Gln, Leu, Met, Glu, Asp, Val, His, Lys, Tyr, Arg, Phe, Pro, Gly, Ser, Trp, Cys, Ala, Asn, or Thr
  misc_feature (11)..(11): Xaa can be Met, Val, Leu, Ile, Phe, Ala, Asn, Pro, Cys, Glu, Lys, Gly, Thr, Tyr, Asp, His, Trp, Ser, Gln, or Arg
KXAELVHFLLX

SEQ ID NO: 60212 - protein, 8 aa, Artificial Sequence
  Description of Artificial Sequence: Synthetic peptide
  Seed: KVLHHMVK (MAGA3_HUMAN)
  misc_feature (2)..(2): Xaa can be Thr, His, Val, Tyr, Leu, Ile, Ser, Lys, Met, Ala, Arg, Gln, or Phe
  misc_feature (8)..(8): Xaa can be Lys, Ala, or Val
KXLHHMVX

SEQ ID NO: 60213 - protein, 9 aa, Artificial Sequence
  Description of Artificial Sequence: Synthetic peptide
  Seed: KVLHHMVKI (MAGA3_HUMAN)
  misc_feature (2)..(2): Xaa can be Thr, Leu, Ser, Met, Val, Gln, Ile, Ala, Tyr, Trp, Phe, Glu, Gly, Arg, Asn, Asp, Cys, His, Lys, or Pro
  misc_feature (9)..(9): Xaa can be Trp, Tyr, Leu, Met, Phe, Ile, Arg, Val, Lys, Ala, His, Cys, Thr, Ser, Gly, Gln, or Pro
KXLHHMVKX

SEQ ID NO: 60214 - protein, 8 aa, Artificial Sequence
  Description of Artificial Sequence: Synthetic peptide
  Seed: LEARGEAL (MAGA3_HUMAN)
  misc_feature (2)..(2): Xaa can be Glu, Asp, Gln, Ser, Ala, or Arg
  misc_feature (8)..(8): Xaa can be Leu, Trp, Val, Ala, Phe, Ile, Met, Thr, Pro, Cys, or Tyr
LXARGEAX

SEQ ID NO: 60215 - protein, 9 aa, Artificial Sequence
  Description of Artificial Sequence: Synthetic peptide
  Seed: LEARGEALG (MAGA3_HUMAN)
  misc_feature (2)..(2): Xaa can be Glu, or Asp
  misc_feature (9)..(9): Xaa can be Leu, Val, Ile, Ala, Cys, Thr, Met, Pro, Ser, Phe, or Gly
LXARGEALX

SEQ ID NO: 60216 - protein, 10 aa, Artificial Sequence
  Description of Artificial Sequence: Synthetic peptide
  Seed: LEARGEALGL (MAGA3_HUMAN)
  misc_feature (2)..(2): Xaa can be Glu, Arg, Gln, Gly, Asn, Met, Leu, Ala, Thr, Ile, Ser, Val, Asp, Cys, Pro, Phe, Lys, or Tr p
  misc_feature (10)..(10): Xaa can be Leu, Phe, Ile, Met, Lys, Tyr, Trp, Val, Arg, Thr, Pro, Ser, His, Cys, or Ala
LXARGEALGX

SEQ ID NO: 60217 - protein, 11 aa, Artificial Sequence
  Description of Artificial Sequence: Synthetic peptide
  Seed: LEARGEALGLV (MAGA3_HUMAN)
  misc_feature (2)..(2): Xaa can be , or Glu
  misc_feature (11)..(11): Xaa can be Ala, Ile, Met, Phe, Cys, Val, or Leu
LXARGEALGLX

SEQ ID NO: 60218 - protein, 8 aa, Artificial Sequence
  Description of Artificial Sequence: Synthetic peptide
  Seed: LEQRSQHC (MAGA3_HUMAN)
  misc_feature (2)..(2): Xaa can be , or Glu
  misc_feature (8)..(8): Xaa can be Cys, Thr, Phe, Ala, Ile, Leu, Pro, Met, or Val
LXQRSQHX

SEQ ID NO: 60219 - protein, 10 aa, Artificial Sequence
  Description of Artificial Sequence: Synthetic peptide
  Seed: LEQRSQHCKP (MAGA3_HUMAN)
  misc_feature (2)..(2): Xaa can be , or Glu
  misc_feature (10)..(10): Xaa can be Leu, Pro, Met, Ile, Val, Ala, Cys, or Thr
LXQRSQHCKX

SEQ ID NO: 60220 - protein, 8 aa, Artificial Sequence
  Description of Artificial Sequence: Synthetic peptide
  Seed: LESEFQAA (MAGA3_HUMAN)
  misc_feature (2)..(2): Xaa can be Glu, Asp, or Gln
  misc_feature (8)..(8): Xaa can be Leu, Phe, Ala, Met, Ile, Val, Gly, Ser, Tyr, Cys, Pro, or Thr
LXSEFQAX

SEQ ID NO: 60221 - protein, 9 aa, Artificial Sequence
  Description of Artificial Sequence: Synthetic peptide
  Seed: LESEFQAAL (MAGA3_HUMAN)
  misc_feature (2)..(2): Xaa can be Glu, His, Gln, Met, Leu, Arg, Asp, Val, Ile, Ala, Lys, Thr, Ser, Pro, Gly, Asn, Phe, Tyr, Cys, or Trp
  misc_feature (9)..(9): Xaa can be Leu, Phe, Met, Tyr, Val, Ile, Trp, Ala, Thr, His, Cys, Ser, Pro, Gly, Lys, Asn, Arg, Gln, Glu, or Asp
LXSEFQAAX

SEQ ID NO: 60222 - protein, 10 aa, Artificial Sequence
  Description of Artificial Sequence: Synthetic peptide
  Seed: LESEFQAALS (MAGA3_HUMAN)
  misc_feature (2)..(2): Xaa can be , or Glu
  misc_feature (10)..(10): Xaa can be Val, Met, Gly, Cys, Ile, Leu, Ser, Thr, Ala, Phe, or Pro
LXSEFQAALX

SEQ ID NO: 60223 - protein, 11 aa, Artificial Sequence
  Description of Artificial Sequence: Synthetic peptide
  Seed: LEVFEGREDSI (MAGA3_HUMAN)
  misc_feature (2)..(2): Xaa can be , or Glu
  misc_feature (11)..(11): Xaa can be Leu, Trp, Met, Val, Pro, Thr, Phe, Ile, Ala, or Cys
LXVFEGREDSX

SEQ ID NO: 60224 - protein, 9 aa, Artificial Sequence
  Description of Artificial Sequence: Synthetic peptide
  Seed: LEYRQVPGS (MAGA3_HUMAN)
  misc_feature (2)..(2): Xaa can be Glu, Asp, or Gln
  misc_feature (9)..(9): Xaa can be Ile, Leu, Val, Pro, Cys, Ala, Phe, Met, Gly, Trp, Tyr, Thr, or Ser
LXYRQVPGX

SEQ ID NO: 60225 - protein, 11 aa, Artificial Sequence
  Description of Artificial Sequence: Synthetic peptide
  Seed: LEYRQVPGSDP (MAGA3_HUMAN)
  misc_feature (2)..(2): Xaa can be , or Glu
  misc_feature (11)..(11): Xaa can be Ala, Val, Pro, Thr, Phe, Ile, Met, Cys, or Leu
LXYRQVPGSDX

SEQ ID NO: 60226 - protein, 8 aa, Artificial Sequence
  Description of Artificial Sequence: Synthetic peptide
  Seed: LGDPKKLL (MAGA3_HUMAN)
  misc_feature (2)..(2): Xaa can be Phe, Ala, Tyr, Ser, Thr, Val, Met, Asn, Arg, Leu, Gln, His, Ile, Trp, Gly, Asp, Cys, Pro, Glu, or Lys
  misc_feature (8)..(8): Xaa can be Leu, Phe, Met, Ile, Val, Tyr, Trp, Cys, or Ala
LXDPKKLX

SEQ ID NO: 60227 - protein, 9 aa, Artificial Sequence
  Description of Artificial Sequence: Synthetic peptide
  Seed: LGDPKKLLT (MAGA3_HUMAN)
  misc_feature (2)..(2): Xaa can be Ala, Ser, Val, Thr, Gly, Leu, Ile, Phe, Met, Tyr, Gln, Cys, Asn, Pro, Trp, Asp, Glu, His, Arg, or Lys
  misc_feature (9)..(9): Xaa can be Phe, Ile, Val, Leu, Met, Tyr, Cys, Ala, Thr, Trp, Ser, Pro, Lys, Asn, Arg, His, Gly, Glu, or Gln
LXDPKKLLX

SEQ ID NO: 60228 - protein, 10 aa, Artificial Sequence
  Description of Artificial Sequence: Synthetic peptide
  Seed: LGLVGAQAPA (MAGA3_HUMAN)
  misc_feature (2)..(2): Xaa can be His, Val, Cys, Leu, Trp, Pro, Asp, Tyr, Glu, Ala, Asn, Arg, Phe, Gly, Ile, Met, Ser, Thr, Lys, or Gln
  misc_feature (10)..(10): Xaa can be Thr, Ile, Met, Val, Leu, or Ala
LXLVGAQAPX

SEQ ID NO: 60229 - protein, 8 aa, Artificial Sequence
  Description of Artificial Sequence: Synthetic peptide
  Seed: LGSVVGNW (MAGA3_HUMAN)
  misc_feature (2)..(2): Xaa can be Ser, Thr, Phe, Val, Cys, Asn, Pro, Asp, Ile, Leu, Gln, Met, Gly, or Ala
  misc_feature (8)..(8): Xaa can be Trp, or Phe
LXSVVGNX

SEQ ID NO: 60230 - protein, 10 aa, Artificial Sequence
  Description of Artificial Sequence: Synthetic peptide
  Seed: LGSVVGNWQY (MAGA3_HUMAN)
  misc_feature (2)..(2): Xaa can be Ser, Thr, Ala, Met, Gln, Val, Leu, Gly, Asn, Ile, Pro, Lys, Cys, His, Asp, Tyr, Phe, Trp, Arg, or Glu
  misc_feature (10)..(10): Xaa can be Leu, Met, Phe, Tyr, Ile, Trp, Lys, Arg, Asn, Val, or Gly
LXSVVGNWQX

SEQ ID NO: 60231 - protein, 11 aa, Artificial Sequence
  Description of Artificial Sequence: Synthetic peptide
  Seed: LGSVVGNWQYF (MAGA3_HUMAN)
  misc_feature (2)..(2): Xaa can be Ser, Thr, Ala, Met, Val, Asn, Gly, Ile, Cys, Arg, Gln, Asp, Tyr, Phe, Leu, Trp, Glu, Lys, or Pro
  misc_feature (11)..(11): Xaa can be Trp, Phe, Tyr, Leu, Ile, Met, or Val
LXSVVGNWQYX

SEQ ID NO: 60232 - protein, 9 aa, Artificial Sequence
  Description of Artificial Sequence: Synthetic peptide
  Seed: LHHMVKISG (MAGA3_HUMAN)
  misc_feature (2)..(2): Xaa can be His, Arg, Gln, Pro, Glu, or Lys
  misc_feature (9)..(9): Xaa can be Val, Ala, Leu, Ile, Met, Thr, Cys, Pro, Ser, Gly, or Phe
LXHMVKISX

SEQ ID NO: 60233 - protein, 10 aa, Artificial Sequence
  Description of Artificial Sequence: Synthetic peptide
  Seed: LIIVLAIIAR (MAGA3_HUMAN)
  misc_feature (2)..(2): Xaa can be Ser, Ala, Thr, Leu, Met, Tyr, Phe, Val, Ile, Gly, Cys, Lys, Trp, Pro, Glu, His, Gln, Asp, Arg, or Asn
  misc_feature (10)..(10): Xaa can be Arg, or Lys
LXIVLAIIAX

SEQ ID NO: 60234 - protein, 11 aa, Artificial Sequence
  Description of Artificial Sequence: Synthetic peptide
  Seed: LLGDNQIMPKA (MAGA3_HUMAN)
  misc_feature (2)..(2): Xaa can be Met, Leu, Ile, or Val
  misc_feature (11)..(11): Xaa can be Val, Leu, Met, Ala, or Ile
LXGDNQIMPKX

SEQ ID NO: 60235 - protein, 9 aa, Artificial Sequence
  Description of Artificial Sequence: Synthetic peptide
  Seed: LLIIVLAII (MAGA3_HUMAN)
  misc_feature (2)..(2): Xaa can be Leu, Met, Gln, Ile, Val, Thr, Ala, or Ser
  misc_feature (9)..(9): Xaa can be Leu, Val, Ile, Ala, Met, or Thr
LXIIVLAIX

SEQ ID NO: 60236 - protein, 11 aa, Artificial Sequence
  Description of Artificial Sequence: Synthetic peptide
  Seed: LLTQHFVQENY (MAGA3_HUMAN)
  misc_feature (2)..(2): Xaa can be Gln, Met, Lys, Arg, His, Leu, Ala, Ile, Thr, Ser, or Val
  misc_feature (11)..(11): Xaa can be Tyr, Phe, or Met
LXTQHFVQENX

SEQ ID NO: 60237 - protein, 10 aa, Artificial Sequence
  Description of Artificial Sequence: Synthetic peptide
  Seed: LMEVDPIGHL (MAGA3_HUMAN)
  misc_feature (2)..(2): Xaa can be Leu, Met, Arg, Gln, Trp, Val, Glu, Ile, or Tyr
  misc_feature (10)..(10): Xaa can be Leu, Val, Ala, Met, Ile, or Thr
LXEVDPIGHX

SEQ ID NO: 60238 - protein, 11 aa, Artificial Sequence
  Description of Artificial Sequence: Synthetic peptide
  Seed: LMEVDPIGHLY (MAGA3_HUMAN)
  misc_feature (2)..(2): Xaa can be Thr, Ser, Met, Val, Ile, Ala, Leu, Gly, Gln, Pro, Cys, Phe, Asp, Glu, Asn, Trp, Arg, His, Tyr, or Lys
  misc_feature (11)..(11): Xaa can be Tyr, Lys, Arg, His, Phe, Trp, or Met
LXEVDPIGHLX

SEQ ID NO: 60239 - protein, 9 aa, Artificial Sequence
  Description of Artificial Sequence: Synthetic peptide
  Seed: LPTTMNYPL (MAGA3_HUMAN)
  misc_feature (2)..(2): Xaa can be Pro, His, Ala, Gln, Arg, Val, Leu, Ile, Met, Ser, Thr, Lys, Gly, Phe, Cys, Tyr, Glu, or As n
  misc_feature (9)..(9): Xaa can be Tyr, Phe, Met, Leu, Trp, Ile, Val, Ala, Thr, Cys, His, Ser, Glu, Gly, Asn, Gln, or Pro
LXTTMNYPX

SEQ ID NO: 60240 - protein, 10 aa, Artificial Sequence
  Description of Artificial Sequence: Synthetic peptide
  Seed: LPTTMNYPLW (MAGA3_HUMAN)
  misc_feature (2)..(2): Xaa can be Pro, Ser, Thr, Ala, Trp, Lys, Gln, Ile, Glu, Asp, Met, Asn, Val, Arg, His, Tyr, Cys, Gly, Leu, or Phe
  misc_feature (10)..(10): Xaa can be Phe, Tyr, Met, Trp, Ile, Leu, Val, Asn, Arg, Ala, Glu, Thr, Pro, Lys, Ser, Asp, Gln, His, Cys, or Gly
LXTTMNYPLX

SEQ ID NO: 60241 - protein, 9 aa, Artificial Sequence
  Description of Artificial Sequence: Synthetic peptide
  Seed: LQLVFGIEL (MAGA3_HUMAN)
  misc_feature (2)..(2): Xaa can be Arg, His, Glu, Ala, Gln, Met, Leu, Thr, Lys, Ile, Ser, Pro, Val, Gly, Asp, Asn, Tyr, Phe, Cys, or Trp
  misc_feature (9)..(9): Xaa can be Met, Phe, Tyr, Leu, Ile, Val, Ala, Trp, Lys, Cys, Thr, His, Pro, Ser, Arg, or Gly
LXLVFGIEX

SEQ ID NO: 60242 - protein, 10 aa, Artificial Sequence
  Description of Artificial Sequence: Synthetic peptide
  Seed: LQLVFGIELM (MAGA3_HUMAN)
  misc_feature (2)..(2): Xaa can be Leu, Tyr, Phe, Gln, Met, Arg, Ala, Ile, Cys, Thr, Gly, Asn, Val, Ser, Lys, His, Pro, Trp, Glu, or Asp
  misc_feature (10)..(10): Xaa can be Ala, Val, Ile, Tyr, Phe, Met, Leu, Thr, or Trp
LXLVFGIELX

SEQ ID NO: 60243 - protein, 8 aa, Artificial Sequence
  Description of Artificial Sequence: Synthetic peptide
  Seed: LSRKVAEL (MAGA3_HUMAN)
  misc_feature (2)..(2): Xaa can be Ser, Ala, Ile, Val, Thr, Gln, Gly, Leu, Met, Pro, Asn, Glu, Asp, His, Cys, Arg, or Phe
  misc_feature (8)..(8): Xaa can be Leu, Val, Ile, Trp, Tyr, Met, Phe, or His
LXRKVAEX

SEQ ID NO: 60244 - protein, 9 aa, Artificial Sequence
  Description of Artificial Sequence: Synthetic peptide
  Seed: LSRKVAELV (MAGA3_HUMAN)
  misc_feature (2)..(2): Xaa can be Thr, Ser, Gln, Ala, Arg, Val, Ile, Met, Pro, Gly, Leu, Glu, Phe, Asn, Asp, Cys, Trp, Tyr, Lys, or His
  misc_feature (9)..(9): Xaa can be Trp, Leu, Ile, Lys, Tyr, Phe, Met, Val, Ala, His, Cys, Ser, Arg, Thr, Gln, or Gly
LXRKVAELX

SEQ ID NO: 60245 - protein, 11 aa, Artificial Sequence
  Description of Artificial Sequence: Synthetic peptide
  Seed: LSRKVAELVHF (MAGA3_HUMAN)
  misc_feature (2)..(2): Xaa can be Thr, Ser, Ala, Glu, Asn, Pro, Leu, Val, Ile, Met, Gln, Gly, Cys, or Asp
  misc_feature (11)..(11): Xaa can be Trp, Phe, Met, Tyr, or Leu
LXRKVAELVHX

SEQ ID NO: 60246 - protein, 10 aa, Artificial Sequence
  Description of Artificial Sequence: Synthetic peptide
  Seed: LSVLEVFEGR (MAGA3_HUMAN)
  misc_feature (2)..(2): Xaa can be Asn, Val, Cys, His, Ser, Ile, Asp, Pro, Glu, Gly, Ala, Gln, Trp, Tyr, Phe, Thr, Leu, Met, Lys, or Arg
  misc_feature (10)..(10): Xaa can be Arg, or Lys
LXVLEVFEGX

SEQ ID NO: 60247 - protein, 10 aa, Artificial Sequence
  Description of Artificial Sequence: Synthetic peptide
  Seed: LTQHFVQENY (MAGA3_HUMAN)
  misc_feature (2)..(2): Xaa can be Thr, Ser, Leu, Met, Ala, Gln, Val, Ile, Tyr, Glu, Lys, His, Pro, Cys, Phe, Trp, Asn, Arg, Gly, or Asp
  misc_feature (10)..(10): Xaa can be Phe, Tyr, Trp, Met, Lys, Leu, Ile, or Arg
LXQHFVQENX

SEQ ID NO: 60248 - protein, 9 aa, Artificial Sequence
  Description of Artificial Sequence: Synthetic peptide
  Seed: LVETSYVKV (MAGA3_HUMAN)
  misc_feature (2)..(2): Xaa can be Val, Gly, Leu, Ile, Thr, Ala, Ser, Met, Gln, Cys, Phe, Pro, Asn, or Asp
  misc_feature (9)..(9): Xaa can be Leu, Met, Val, Ile, or Phe
LXETSYVKX

SEQ ID NO: 60249 - protein, 9 aa, Artificial Sequence
  Description of Artificial Sequence: Synthetic peptide
  Seed: LVEVTLGEV (MAGA3_HUMAN)
  misc_feature (2)..(2): Xaa can be Phe, Ala, Met, Gly, Thr, Ser, Ile, Leu, Val, Gln, Tyr, Asn, Cys, Pro, Trp, or Asp
  misc_feature (9)..(9): Xaa can be Leu, Met, Val, Ile, or Phe
LXEVTLGEX

SEQ ID NO: 60250 - protein, 10 aa, Artificial Sequence
  Description of Artificial Sequence: Synthetic peptide
  Seed: LVFGIELMEV (MAGA3_HUMAN)
  misc_feature (2)..(2): Xaa can be Met, Leu, Gln, Val, Thr, Ile, Ala, Ser, Glu, Gly, Asn, or Phe
  misc_feature (10)..(10): Xaa can be Val, Ile, Leu, Ala, Met, Thr, Cys, Phe, Ser, Gly, Pro, or Trp
LXFGIELMEX

SEQ ID NO: 60251 - protein, 11 aa, Artificial Sequence
  Description of Artificial Sequence: Synthetic peptide
  Seed: LVFGIELMEVD (MAGA3_HUMAN)
  misc_feature (2)..(2): Xaa can be Leu, Met, Gln, Ile, Val, or Thr
  misc_feature (11)..(11): Xaa can be Val, Met, Arg, Glu, Ala, Gly, Ser, Leu, Thr, Phe, Trp, Lys, Cys, Tyr, Ile, Asn, Pro, His, Asp, or Gln
LXFGIELMEVX

SEQ ID NO: 60252 - protein, 9 aa, Artificial Sequence
  Description of Artificial Sequence: Synthetic peptide
  Seed: LVHFLLLKY (MAGA3_HUMAN)
  misc_feature (2)..(2): Xaa can be Ala, Gln, Leu, Ser, Val, Met, Thr, Gly, Ile, Asn, Cys, Glu, Phe, Lys, Tyr, Pro, Arg, His, Asp, or Trp
  misc_feature (9)..(9): Xaa can be Phe, Tyr, Met, Lys, Leu, Trp, Arg, Ile, Val, His, or Ala
LXHFLLLKX

SEQ ID NO: 60253 - protein, 10 aa, Artificial Sequence
  Description of Artificial Sequence: Synthetic peptide
  Seed: LVHFLLLKYR (MAGA3_HUMAN)
  misc_feature (2)..(2): Xaa can be Tyr, Ile, Leu, Gln, Met, Gly, Val, Thr, Ser, Asn, Ala, Phe, Trp, His, Arg, Pro, Lys, Cys, Asp, or Glu
  misc_feature (10)..(10): Xaa can be Arg, or Lys
LXHFLLLKYX

SEQ ID NO: 60254 - protein, 8 aa, Artificial Sequence
  Description of Artificial Sequence: Synthetic peptide
  Seed: LYIFATCL (MAGA3_HUMAN)
  misc_feature (2)..(2): Xaa can be Tyr, or Phe
  misc_feature (8)..(8): Xaa can be Phe, Leu, Met, Trp, Tyr, or Ile
LXIFATCX

SEQ ID NO: 60255 - protein, 10 aa, Artificial Sequence
  Description of Artificial Sequence: Synthetic peptide
  Seed: LYIFATCLGL (MAGA3_HUMAN)
  misc_feature (2)..(2): Xaa can be Tyr, Met, Phe, Leu, Trp, Gln, Asn, Ser, Ala, Asp, Thr, Ile, Lys, Cys, Val, Glu, Pro, Arg, Gly, or His
  misc_feature (10)..(10): Xaa can be Ala, Leu, Val, Ile, Met, Phe, Trp, Thr, Tyr, or Ser
LXIFATCLGX

SEQ ID NO: 60256 - protein, 9 aa, Artificial Sequence
  Description of Artificial Sequence: Synthetic peptide
  Seed: MEVDPIGHL (MAGA3_HUMAN)
  misc_feature (2)..(2): Xaa can be Ala, Glu, Met, Leu, Ser, Val, Thr, Arg, Ile, Gln, His, Gly, Tyr, Asp, Pro, Lys, Asn, Phe, Cys, or Trp
  misc_feature (9)..(9): Xaa can be Arg, Met, Lys, Val, Ile, Leu, Phe, Tyr, His, Trp, Ala, Cys, Thr, Gln, Ser, Gly, Pro, Glu, Asn, or Asp
MXVDPIGHX

SEQ ID NO: 60257 - protein, 10 aa, Artificial Sequence
  Description of Artificial Sequence: Synthetic peptide
  Seed: MEVDPIGHLY (MAGA3_HUMAN)
  misc_feature (2)..(2): Xaa can be Glu, Ala, Pro, Arg, Gln, Thr, Ser, Met, Val, Tyr, Ile, Leu, Asp, His, Phe, Gly, Trp, Asn, Cys, or Lys
  misc_feature (10)..(10): Xaa can be Trp, Lys, Leu, Arg, Ile, Tyr, Met, Val, Phe, His, Cys, Ala, Thr, Gln, Pro, Gly, Ser, Asn, Glu, or Asp
MXVDPIGHLX

SEQ ID NO: 60258 - protein, 11 aa, Artificial Sequence
  Description of Artificial Sequence: Synthetic peptide
  Seed: MEVDPIGHLYI (MAGA3_HUMAN)
  misc_feature (2)..(2): Xaa can be Glu, Gln, Met, Leu, Val, Ile, Asp, Ala, Thr, Asn, or Ser
  misc_feature (11)..(11): Xaa can be Trp, Leu, Phe, Val, Ile, Met, Tyr, Cys, Ala, Ser, Gly, His, Thr, or Pro
MXVDPIGHLYX

SEQ ID NO: 60259 - protein, 9 aa, Artificial Sequence
  Description of Artificial Sequence: Synthetic peptide
  Seed: MLGSVVGNW (MAGA3_HUMAN)
  misc_feature (2)..(2): Xaa can be Met, Thr, Gln, Ser, Ala, Leu, Ile, Val, Glu, Pro, Phe, Gly, Asn, Cys, Lys, Arg, Trp, Tyr, or Asp
  misc_feature (9)..(9): Xaa can be Trp, Phe, Leu, Tyr, Ile, Met, or Val
MXGSVVGNX

SEQ ID NO: 60260 - protein, 11 aa, Artificial Sequence
  Description of Artificial Sequence: Synthetic peptide
  Seed: MLGSVVGNWQY (MAGA3_HUMAN)
  misc_feature (2)..(2): Xaa can be Ser, Thr, Val, Ile, Met, Glu, Asp, Ala, Gln, Asn, Gly, Leu, Phe, Cys, Trp, Tyr, Arg, Pro, Lys, or His
  misc_feature (11)..(11): Xaa can be Phe, Met, Leu, Trp, Ile, Tyr, Lys, Arg, or His
MXGSVVGNWQX

SEQ ID NO: 60261 - protein, 10 aa, Artificial Sequence
  Description of Artificial Sequence: Synthetic peptide
  Seed: MNYPLWSQSY (MAGA3_HUMAN)
  misc_feature (2)..(2): Xaa can be Gln, Tyr, Met, Trp, His, Lys, Phe, Ala, Leu, Glu, Thr, Val, Arg, Ile, Ser, Asp, Cys, Asn, Gly, or Pro
  misc_feature (10)..(10): Xaa can be Val, Leu, Phe, Ile, Trp, Met, Tyr, His, Ala, Gly, Thr, Cys, Ser, Pro, Gln, or Asn
MXYPLWSQSX

SEQ ID NO: 60262 - protein, 8 aa, Artificial Sequence
  Description of Artificial Sequence: Synthetic peptide
  Seed: MPKAGLLI (MAGA3_HUMAN)
  misc_feature (2)..(2): Xaa can be Pro, Ala, Glu, Met, Leu, or Gln
  misc_feature (8)..(8): Xaa can be Leu, Ile, Val, Met, Pro, Ser, Thr, Ala, Tyr, Cys, Phe, or Gly
MXKAGLLX

SEQ ID NO: 60263 - protein, 9 aa, Artificial Sequence
  Description of Artificial Sequence: Synthetic peptide
  Seed: MPKAGLLII (MAGA3_HUMAN)
  misc_feature (2)..(2): Xaa can be Pro, His, Ala, Gln, Met, Val, Arg, Leu, Thr, Ser, Gly, Ile, Asp, Glu, Lys, Asn, Cys, Phe, Trp, or Tyr
  misc_feature (9)..(9): Xaa can be Leu, Tyr, Phe, Met, Ile, Val, Ala, Trp, Cys, Thr, His, Pro, Ser, Gly, Glu, Asp, Lys, Asn, Gln, or Arg
MXKAGLLIX

SEQ ID NO: 60264 - protein, 10 aa, Artificial Sequence
  Description of Artificial Sequence: Synthetic peptide
  Seed: MPKAGLLIIV (MAGA3_HUMAN)
  misc_feature (2)..(2): Xaa can be Pro, Thr, Ala, Val, Ile, Ser, Asn, or Met
  misc_feature (10)..(10): Xaa can be Val, Leu, Ala, Ile, Met, Thr, Trp, Tyr, Pro, Gln, Lys, Glu, Cys, Phe, Arg, Ser, or Gly
MXKAGLLIIX

SEQ ID NO: 60265 - protein, 11 aa, Artificial Sequence
  Description of Artificial Sequence: Synthetic peptide
  Seed: MPKAGLLIIVL (MAGA3_HUMAN)
  misc_feature (2)..(2): Xaa can be , or Pro
  misc_feature (11)..(11): Xaa can be Trp, Met, Thr, Gly, Tyr, Val, Ala, Cys, Leu, Ser, Phe, Pro, or Ile
MXKAGLLIIVX

SEQ ID NO: 60266 - protein, 9 aa, Artificial Sequence
  Description of Artificial Sequence: Synthetic peptide
  Seed: MPLEQRSQH (MAGA3_HUMAN)
  misc_feature (2)..(2): Xaa can be Pro, Ala, Val, Gly, Ile, Ser, Thr, Met, Leu, Phe, Gln, Cys, or Asp
  misc_feature (9)..(9): Xaa can be Tyr, Leu, Phe, Met, Ala, Ile, Val, Cys, Trp, Ser, Glu, Thr, His, Asn, Gln, Gly, Lys, Pro, or Arg
MXLEQRSQX

SEQ ID NO: 60267 - protein, 10 aa, Artificial Sequence
  Description of Artificial Sequence: Synthetic peptide
  Seed: MPLEQRSQHC (MAGA3_HUMAN)
  misc_feature (2)..(2): Xaa can be Pro, or Ala
  misc_feature (10)..(10): Xaa can be Ile, Phe, Ser, Gly, Met, Pro, Tyr, Cys, Thr, Ala, Val, or Leu
MXLEQRSQHX

SEQ ID NO: 60268 - protein, 9 aa, Artificial Sequence
  Description of Artificial Sequence: Synthetic peptide
  Seed: MVKISGGPH (MAGA3_HUMAN)
  misc_feature (2)..(2): Xaa can be Ala, Ser, Val, Ile, Thr, Gly, Asn, Met, Leu, Gln, Cys, Phe, Glu, Asp, Pro, or Tyr
  misc_feature (9)..(9): Xaa can be Tyr, Phe, Leu, Met, His, Val, Ile, Lys, Ala, Trp, Arg, Cys, Pro, Ser, Gln, or Thr
MXKISGGPX

SEQ ID NO: 60269 - protein, 10 aa, Artificial Sequence
  Description of Artificial Sequence: Synthetic peptide
  Seed: MVKISGGPHI (MAGA3_HUMAN)
  misc_feature (2)..(2): Xaa can be Ser, Gln, Met, Thr, Val, Ala, Phe, Ile, Tyr, Leu, Lys, His, Arg, Gly, Trp, Asn, Glu, Pro, Asp, or Cys
  misc_feature (10)..(10): Xaa can be Met, Ile, Phe, Tyr, Leu, Lys, Trp, Ala, Val, His, Ser, or Arg
MXKISGGPHX

SEQ ID NO: 60270 - protein, 10 aa, Artificial Sequence
  Description of Artificial Sequence: Synthetic peptide
  Seed: NQEEEGPSTF (MAGA3_HUMAN)
  misc_feature (2)..(2): Xaa can be Glu, Leu, Val, His, Met, Gln, Ser, Ile, Ala, Thr, Phe, Tyr, Arg, Asp, Gly, Cys, Trp, Pro, Lys, or Asn
  misc_feature (10)..(10): Xaa can be Leu, Tyr, Phe, Met, Ile, Trp, Val, Lys, Arg, Ala, Cys, His, or Thr
NXEEEGPSTX

SEQ ID NO: 60271 - protein, 9 aa, Artificial Sequence
  Description of Artificial Sequence: Synthetic peptide
  Seed: NQIMPKAGL (MAGA3_HUMAN)
  misc_feature (2)..(2): Xaa can be Arg, His, Glu, Gln, Met, Ser, Ala, Asp, Lys, Pro, Val, Ile, Leu, Gly, Asn, Tyr, Thr, Phe, Cys, or Trp
  misc_feature (9)..(9): Xaa can be Tyr, Phe, Leu, Met, Val, Ile, Ala, Trp, Cys, Pro, Ser, His, Thr, Gly, Lys, or Arg
NXIMPKAGX

SEQ ID NO: 60272 - protein, 10 aa, Artificial Sequence
  Description of Artificial Sequence: Synthetic peptide
  Seed: NQIMPKAGLL (MAGA3_HUMAN)
  misc_feature (2)..(2): Xaa can be His, Gln, Arg, or Met
  misc_feature (10)..(10): Xaa can be Met, Ile, Trp, Leu, Phe, Val, Tyr, or Cys
NXIMPKAGLX

SEQ ID NO: 60273 - protein, 11 aa, Artificial Sequence
  Description of Artificial Sequence: Synthetic peptide
  Seed: NQIMPKAGLLI (MAGA3_HUMAN)
  misc_feature (2)..(2): Xaa can be His, Gln, Leu, Met, or Glu
  misc_feature (11)..(11): Xaa can be Phe, Trp, Leu, Val, Ile, Met, Tyr, or Cys
NXIMPKAGLLX

SEQ ID NO: 60274 - protein, 9 aa, Artificial Sequence
  Description of Artificial Sequence: Synthetic peptide
  Seed: NWQYFFPVI (MAGA3_HUMAN)
  misc_feature (2)..(2): Xaa can be Tyr, Phe, Trp, Met, Ala, Ser, His, Val, Gln, Ile, Leu, Thr, or Arg
  misc_feature (9)..(9): Xaa can be Met, Phe, Leu, Tyr, Trp, Ile, Val, Ala, or His
NXQYFFPVX

SEQ ID NO: 60275 - protein, 10 aa, Artificial Sequence
  Description of Artificial Sequence: Synthetic peptide
  Seed: NWQYFFPVIF (MAGA3_HUMAN)
  misc_feature (2)..(2): Xaa can be Arg, Met, Tyr, Trp, Phe, Asn, Pro, Gln, Ser, His, Asp, Gly, Cys, Thr, Ile, Lys, Val, Glu, Leu, or Ala
  misc_feature (10)..(10): Xaa can be Phe, Met, Tyr, Leu, Trp, Ile, His, or Val
NXQYFFPVIX

SEQ ID NO: 60276 - protein, 8 aa, Artificial Sequence
  Description of Artificial Sequence: Synthetic peptide
  Seed: NYLEYRQV (MAGA3_HUMAN)
  misc_feature (2)..(2): Xaa can be Tyr, Phe, or Trp
  misc_feature (8)..(8): Xaa can be Met, Tyr, Phe, Leu, Ile, or Val
NXLEYRQX

SEQ ID NO: 60277 - protein, 9 aa, Artificial Sequence
  Description of Artificial Sequence: Synthetic peptide
  Seed: NYPLWSQSY (MAGA3_HUMAN)
  misc_feature (2)..(2): Xaa can be Tyr, Ala, Phe, Ser, Arg, Gly, Thr, Trp, Gln, Met, Ile, Val, Leu, His, Asn, Pro, Cys, Lys, Glu, or Asp
  misc_feature (9)..(9): Xaa can be Phe, Tyr, Met, Leu, Ile, Val, Trp, His, Lys, Ala, Cys, Arg, or Thr
NXPLWSQSX

SEQ ID NO: 60278 - protein, 8 aa, Artificial Sequence
  Description of Artificial Sequence: Synthetic peptide
  Seed: PACYEFLW (MAGA3_HUMAN)
  misc_feature (2)..(2): Xaa can be Tyr, Ile, Val, Phe, His, Met, Ala, Trp, Asn, Ser, or Thr
  misc_feature (8)..(8): Xaa can be , or Trp
PXCYEFLX

SEQ ID NO: 60279 - protein, 9 aa, Artificial Sequence
  Description of Artificial Sequence: Synthetic peptide
  Seed: PEEKIWEEL (MAGA3_HUMAN)
  misc_feature (2)..(2): Xaa can be , or Glu
  misc_feature (9)..(9): Xaa can be Phe, Val, Pro, Met, Ile, Ala, or Leu
PXEKIWEEX

SEQ ID NO: 60280 - protein, 11 aa, Artificial Sequence
  Description of Artificial Sequence: Synthetic peptide
  Seed: PHISYPPLHEW (MAGA3_HUMAN)
  misc_feature (2)..(2): Xaa can be Met, Ile, Arg, Phe, Ser, Leu, Lys, Trp, His, Tyr, Val, Thr, Ala, Cys, Pro, Gly, Glu, Asp, Gln, or Asn
  misc_feature (11)..(11): Xaa can be Trp, Phe, Tyr, or Met
PXISYPPLHEX

SEQ ID NO: 60281 - protein, 11 aa, Artificial Sequence
  Description of Artificial Sequence: Synthetic peptide
  Seed: PPQSPQGASSL (MAGA3_HUMAN)
  misc_feature (2)..(2): Xaa can be Pro, or Ala
  misc_feature (11)..(11): Xaa can be Leu, Ala, Met, Val, Phe, Cys, or Ile
PXQSPQGASSX

SEQ ID NO: 60282 - protein, 9 aa, Artificial Sequence
  Description of Artificial Sequence: Synthetic peptide
  Seed: PRALVETSY (MAGA3_HUMAN)
  misc_feature (2)..(2): Xaa can be Arg, Met, His, Gln, Glu, Tyr, or Lys
  misc_feature (9)..(9): Xaa can be Tyr, Phe, Leu, Lys, or Met
PXALVETSX

SEQ ID NO: 60283 - protein, 9 aa, Artificial Sequence
  Description of Artificial Sequence: Synthetic peptide
  Seed: PTTMNYPLW (MAGA3_HUMAN)
  misc_feature (2)..(2): Xaa can be Ser, Thr, Ala, Met, Val, Leu, Asn, Gly, Cys, Asp, Gln, Pro, or Ile
  misc_feature (9)..(9): Xaa can be Trp, or Phe
PXTMNYPLX

SEQ ID NO: 60284 - protein, 8 aa, Artificial Sequence
  Description of Artificial Sequence: Synthetic peptide
  Seed: QAALSRKV (MAGA3_HUMAN)
  misc_feature (2)..(2): Xaa can be Ser, Ala, Gln, Thr, Glu, Met, Pro, Gly, Leu, Ile, or Val
  misc_feature (8)..(8): Xaa can be Ile, Val, Leu, Phe, Met, or Tyr
QXALSRKX

SEQ ID NO: 60285 - protein, 9 aa, Artificial Sequence
  Description of Artificial Sequence: Synthetic peptide
  Seed: QAALSRKVA (MAGA3_HUMAN)
  misc_feature (2)..(2): Xaa can be Pro, Ala, or Val
  misc_feature (9)..(9): Xaa can be Ala, Phe, Cys, Val, Leu, Gly, Ser, Ile, Met, Thr, Pro, or Tyr
QXALSRKVX

SEQ ID NO: 60286 - protein, 9 aa, Artificial Sequence
  Description of Artificial Sequence: Synthetic peptide
  Seed: QEAASSSST (MAGA3_HUMAN)
  misc_feature (2)..(2): Xaa can be Glu, Asp, or Gln
  misc_feature (9)..(9): Xaa can be Met, Val, Leu, Cys, Ile, Ala, Phe, Pro, Gly, Thr, Tyr, Ser, or Trp
QXAASSSSX

SEQ ID NO: 60287 - protein, 10 aa, Artificial Sequence
  Description of Artificial Sequence: Synthetic peptide
  Seed: QEAASSSSTL (MAGA3_HUMAN)
  misc_feature (2)..(2): Xaa can be Glu, Asp, Gln, Lys, Thr, His, Ala, Ser, Asn, or Arg
  misc_feature (10)..(10): Xaa can be Trp, Ala, Tyr, Phe, Leu, Met, Val, Thr, Cys, Ser, Pro, Ile, His, or Gly
QXAASSSSTX

SEQ ID NO: 60288 - protein, 11 aa, Artificial Sequence
  Description of Artificial Sequence: Synthetic peptide
  Seed: QEAASSSSTLV (MAGA3_HUMAN)
  misc_feature (2)..(2): Xaa can be Glu, Asp, Gln, Lys, or Ala
  misc_feature (11)..(11): Xaa can be Trp, Tyr, Phe, Leu, Val, Ile, Ala, Ser, His, Thr, Gly, Met, Pro, or Cys
QXAASSSSTLX

SEQ ID NO: 60289 - protein, 8 aa, Artificial Sequence
  Description of Artificial Sequence: Synthetic peptide
  Seed: QEEEGPST (MAGA3_HUMAN)
  misc_feature (2)..(2): Xaa can be Glu, or Asp
  misc_feature (8)..(8): Xaa can be Ile, Val, Leu, Ala, Cys, Thr, Ser, Pro, Met, or Phe
QXEEGPSX

SEQ ID NO: 60290 - protein, 9 aa, Artificial Sequence
  Description of Artificial Sequence: Synthetic peptide
  Seed: QEEEGPSTF (MAGA3_HUMAN)
  misc_feature (2)..(2): Xaa can be Glu, Gln, Ala, His, Asp, Ile, Val, Ser, Arg, Met, Leu, Thr, Tyr, Gly, Asn, Phe, Lys, Trp, Cys, or Pro
  misc_feature (9)..(9): Xaa can be Leu, Met, Phe, Tyr, Ile, Val, Trp, Lys, His, Ala, Cys, Arg, Pro, Thr, Gln, Gly, Ser, Asn, Asp, or Glu
QXEEGPSTX

SEQ ID NO: 60291 - protein, 10 aa, Artificial Sequence
  Description of Artificial Sequence: Synthetic peptide
  Seed: QEEEGPSTFP (MAGA3_HUMAN)
  misc_feature (2)..(2): Xaa can be Glu, Gln, or Asp
  misc_feature (10)..(10): Xaa can be Ala, Leu, Ile, Val, Met, Cys, Trp, Thr, Tyr, Gly, Phe, Pro, or Ser
QXEEGPSTFX

SEQ ID NO: 60292 - protein, 10 aa, Artificial Sequence
  Description of Artificial Sequence: Synthetic peptide
  Seed: QENYLEYRQV (MAGA3_HUMAN)
  misc_feature (2)..(2): Xaa can be Glu, Gln, or Asp
  misc_feature (10)..(10): Xaa can be Tyr, Phe, Trp, Val, His, Pro, Ala, Leu, Cys, Ile, Thr, or Met
QXNYLEYRQX

SEQ ID NO: 60293 - protein, 10 aa, Artificial Sequence
  Description of Artificial Sequence: Synthetic peptide
  Seed: QGASSLPTTM (MAGA3_HUMAN)
  misc_feature (2)..(2): Xaa can be Ala, Ser, Val, Thr, Ile, Gly, Leu, Met, Gln, Asn, Glu, Cys, Phe, Tyr, or Pro
  misc_feature (10)..(10): Xaa can be Tyr, Phe, Met, Leu, His, Lys, Trp, Ile, Arg, Val, or Ala
QXASSLPTTX

SEQ ID NO: 60294 - protein, 9 aa, Artificial Sequence
  Description of Artificial Sequence: Synthetic peptide
  Seed: QHCKPEEGL (MAGA3_HUMAN)
  misc_feature (2)..(2): Xaa can be His, Arg, Gln, or Glu
  misc_feature (9)..(9): Xaa can be Leu, Ala, Met, Ile, Val, Phe, Tyr, Pro, Trp, Cys, or Thr
QXCKPEEGX

SEQ ID NO: 60295 - protein, 11 aa, Artificial Sequence
  Description of Artificial Sequence: Synthetic peptide
  Seed: QHCKPEEGLEA (MAGA3_HUMAN)
  misc_feature (2)..(2): Xaa can be His, Arg, Gln, Glu, or Lys
  misc_feature (11)..(11): Xaa can be Leu, Phe, Trp, Met, Ile, Val, Ala, Cys, Thr, Pro, or Tyr
QXCKPEEGLEX

SEQ ID NO: 60296 - protein, 8 aa, Artificial Sequence
  Description of Artificial Sequence: Synthetic peptide
  Seed: QHFVQENY (MAGA3_HUMAN)
  misc_feature (2)..(2): Xaa can be His, or Arg
  misc_feature (8)..(8): Xaa can be Tyr, or Phe
QXFVQENX

SEQ ID NO: 60297 - protein, 9 aa, Artificial Sequence
  Description of Artificial Sequence: Synthetic peptide
  Seed: QHFVQENYL (MAGA3_HUMAN)
  misc_feature (2)..(2): Xaa can be His, Arg, Gln, Tyr, Phe, Glu, Ala, Lys, Ser, Asp, Thr, Pro, Asn, Met, or Gly
  misc_feature (9)..(9): Xaa can be Leu, Met, Tyr, Phe, Ile, Val, Ala, Trp, Cys, Gly, His, Ser, Pro, or Thr
QXFVQENYX

SEQ ID NO: 60298 - protein, 11 aa, Artificial Sequence
  Description of Artificial Sequence: Synthetic peptide
  Seed: QHFVQENYLEY (MAGA3_HUMAN)
  misc_feature (2)..(2): Xaa can be Gln, Met, Lys, His, or Arg
  misc_feature (11)..(11): Xaa can be Tyr, Phe, Met, or Leu
QXFVQENYLEX

SEQ ID NO: 60299 - protein, 8 aa, Artificial Sequence
  Description of Artificial Sequence: Synthetic peptide
  Seed: QIMPKAGL (MAGA3_HUMAN)
  misc_feature (2)..(2): Xaa can be Pro, Ala, Met, Ile, or Leu
  misc_feature (8)..(8): Xaa can be Leu, Ile, or Met
QXMPKAGX

SEQ ID NO: 60300 - protein, 9 aa, Artificial Sequence
  Description of Artificial Sequence: Synthetic peptide
  Seed: QIMPKAGLL (MAGA3_HUMAN)
  misc_feature (2)..(2): Xaa can be Pro, Met, Val, Gln, Ala, Thr, Leu, Ile, Ser, Gly, Glu, Asn, Arg, Asp, Phe, Tyr, Cys, His, Lys, or Trp
  misc_feature (9)..(9): Xaa can be Tyr, Leu, Phe, Met, Arg, Val, Lys, Ile, Trp, Ala, His, Thr, Cys, Gln, Pro, or Ser
QXMPKAGLX

SEQ ID NO: 60301 - protein, 10 aa, Artificial Sequence
  Description of Artificial Sequence: Synthetic peptide
  Seed: QIMPKAGLLI (MAGA3_HUMAN)
  misc_feature (2)..(2): Xaa can be Gln, Met, Leu, Ile, Glu, Val, Thr, or Ala
  misc_feature (10)..(10): Xaa can be Val, Leu, Ile, Met, Ala, Cys, Phe, Thr, or Trp
QXMPKAGLLX

SEQ ID NO: 60302 - protein, 9 aa, Artificial Sequence
  Description of Artificial Sequence: Synthetic peptide
  Seed: QLVFGIELM (MAGA3_HUMAN)
  misc_feature (2)..(2): Xaa can be Gln, Met, Leu, Val, Ala, Ile, Thr, Ser, Glu, Asn, Pro, Lys, Gly, Arg, Cys, Asp, Tyr, Phe, Trp, or His
  misc_feature (9)..(9): Xaa can be Tyr, Phe, Trp, Leu, Ile, Met, Val, Ala, Thr, or His
QXVFGIELX

SEQ ID NO: 60303 - protein, 11 aa, Artificial Sequence
  Description of Artificial Sequence: Synthetic peptide
  Seed: QLVFGIELMEV (MAGA3_HUMAN)
  misc_feature (2)..(2): Xaa can be Met, Leu, Tyr, Phe, Lys, Gln, His, Trp, Gly, Asn, Arg, Thr, Ile, Ala, Ser, or Val
  misc_feature (11)..(11): Xaa can be Val, Ile, Leu, or Ala
QXVFGIELMEX

SEQ ID NO: 60304 - protein, 9 aa, Artificial Sequence
  Description of Artificial Sequence: Synthetic peptide
  Seed: QSPQGASSL (MAGA3_HUMAN)
  misc_feature (2)..(2): Xaa can be Pro, Ala, Met, Thr, Phe, Ile, Leu, Ser, Val, Tyr, Arg, Gly, Glu, Gln, Cys, Asn, Asp, Trp, His, or Lys
  misc_feature (9)..(9): Xaa can be Met, Tyr, Leu, Phe, Ile, Val, Trp, Arg, Lys, Ala, His, Cys, Thr, Ser, or Pro
QXPQGASSX

SEQ ID NO: 60305 - protein, 10 aa, Artificial Sequence
  Description of Artificial Sequence: Synthetic peptide
  Seed: QVPGSDPACY (MAGA3_HUMAN)
  misc_feature (2)..(2): Xaa can be Met, Ser, Ala, Val, Thr, Ile, Gln, Leu, Pro, Phe, Cys, Tyr, Glu, Asn, Gly, Trp, Asp, Arg, Lys, or His
  misc_feature (10)..(10): Xaa can be Tyr, Lys, Phe, Arg, Trp, Met, Leu, or His
QXPGSDPACX

SEQ ID NO: 60306 - protein, 8 aa, Artificial Sequence
  Description of Artificial Sequence: Synthetic peptide
  Seed: QYFFPVIF (MAGA3_HUMAN)
  misc_feature (2)..(2): Xaa can be Tyr, Met, Phe, Gln, Arg, Lys, Asn, Leu, Ser, Ala, His, Ile, or Trp
  misc_feature (8)..(8): Xaa can be Tyr, Phe, Met, Leu, Trp, or Ile
QXFFPVIX

SEQ ID NO: 60307 - protein, 10 aa, Artificial Sequence
  Description of Artificial Sequence: Synthetic peptide
  Seed: QYFFPVIFSK (MAGA3_HUMAN)
  misc_feature (2)..(2): Xaa can be Thr, Ser, Met, Trp, Val, Tyr, Ala, Phe, Leu, Arg, Lys, Ile, Asp, Cys, Gln, Pro, Glu, His, Gly, or Asn
  misc_feature (10)..(10): Xaa can be Lys, Arg, His, Tyr, or Gln
QXFFPVIFSX

SEQ ID NO: 60308 - protein, 8 aa, Artificial Sequence
  Description of Artificial Sequence: Synthetic peptide
  Seed: RALVETSY (MAGA3_HUMAN)
  misc_feature (2)..(2): Xaa can be Gln, Ala, Ser, Met, Lys, Leu, Thr, Glu, Val, Gly, Ile, His, Asn, Pro, or Arg
  misc_feature (8)..(8): Xaa can be Tyr, Phe, Met, Leu, His, or Trp
RXLVETSX

SEQ ID NO: 60309 - protein, 9 aa, Artificial Sequence
  Description of Artificial Sequence: Synthetic peptide
  Seed: RALVETSYV (MAGA3_HUMAN)
  misc_feature (2)..(2): Xaa can be Thr, Ser, Leu, Val, Gln, Met, Ile, Tyr, Ala, Asn, Gly, Phe, Asp, Glu, Arg, Trp, Cys, His, Lys, or Pro
  misc_feature (9)..(9): Xaa can be Tyr, Leu, Phe, Trp, Met, Val, Lys, Ile, Arg, Ala, His, Cys, Thr, Ser, or Gly
RXLVETSYX

SEQ ID NO: 60310 - protein, 10 aa, Artificial Sequence
  Description of Artificial Sequence: Synthetic peptide
  Seed: RALVETSYVK (MAGA3_HUMAN)
  misc_feature (2)..(2): Xaa can be Thr, Val, Met, Ile, Tyr, Leu, Phe, Ser, Glu, Gly, Pro, Gln, Cys, Trp, Ala, Asp, Lys, His, Arg, or Asn
  misc_feature (10)..(10): Xaa can be Lys, Arg, Tyr, Ala, His, Ile, or Val
RXLVETSYVX

SEQ ID NO: 60311 - protein, 11 aa, Artificial Sequence
  Description of Artificial Sequence: Synthetic peptide
  Seed: RALVETSYVKV (MAGA3_HUMAN)
  misc_feature (2)..(2): Xaa can be Phe, Leu, Tyr, Met, Trp, Arg, Lys, Val, Ala, Ile, Gly, or Ser
  misc_feature (11)..(11): Xaa can be Val, Leu, Ile, or Ala
RXLVETSYVKX

SEQ ID NO: 60312 - protein, 9 aa, Artificial Sequence
  Description of Artificial Sequence: Synthetic peptide
  Seed: REDSILGDP (MAGA3_HUMAN)
  misc_feature (2)..(2): Xaa can be Glu, or Asp
  misc_feature (9)..(9): Xaa can be Leu, Ile, Ala, Val, Phe, Ser, Thr, Met, Pro, Gly, or Cys
RXDSILGDX

SEQ ID NO: 60313 - protein, 10 aa, Artificial Sequence
  Description of Artificial Sequence: Synthetic peptide
  Seed: REDSILGDPK (MAGA3_HUMAN)
  misc_feature (2)..(2): Xaa can be Glu, Gln, Asp, Thr, Ala, Ser, Ile, Met, Phe, Cys, Leu, Val, Asn, Gly, Tyr, Arg, or Trp
  misc_feature (10)..(10): Xaa can be Tyr, Lys, Arg, Phe, Leu, Met, Ile, Trp, Val, Cys, Ala, His, Gln, Thr, Pro, Asn, Asp, Ser, Glu, or Gly
RXDSILGDPX

SEQ ID NO: 60314 - protein, 11 aa, Artificial Sequence
  Description of Artificial Sequence: Synthetic peptide
  Seed: REDSILGDPKK (MAGA3_HUMAN)
  misc_feature (2)..(2): Xaa can be Gln, Glu, or Arg
  misc_feature (11)..(11): Xaa can be Tyr, Phe, Arg, Leu, Met, Lys, or Trp
RXDSILGDPKX

SEQ ID NO: 60315 - protein, 9 aa, Artificial Sequence
  Description of Artificial Sequence: Synthetic peptide
  Seed: REGDCAPEE (MAGA3_HUMAN)
  misc_feature (2)..(2): Xaa can be Glu, Asp, or Gln
  misc_feature (9)..(9): Xaa can be Ala, Met, Cys, Pro, Leu, Val, Ile, Asp, Thr, Gly, Ser, Tyr, Phe, Gln, or Glu
RXGDCAPEX

SEQ ID NO: 60316 - protein, 10 aa, Artificial Sequence
  Description of Artificial Sequence: Synthetic peptide
  Seed: REGDCAPEEK (MAGA3_HUMAN)
  misc_feature (2)..(2): Xaa can be Glu, Arg, Asp, Gln, Ala, Val, Ser, Ile, Thr, Met, Leu, Asn, Gly, Lys, Phe, His, Tyr, Cys, Trp, or Pro
  misc_feature (10)..(10): Xaa can be Tyr, Trp, Lys, Arg, Phe, Leu, Met, Cys, Ile, Ala, Val, His, Thr, Gln, Gly, Ser, Glu, Pro, Asn, or Asp
RXGDCAPEEX

SEQ ID NO: 60317 - protein, 11 aa, Artificial Sequence
  Description of Artificial Sequence: Synthetic peptide
  Seed: REGDCAPEEKI (MAGA3_HUMAN)
  misc_feature (2)..(2): Xaa can be Glu, Gln, Leu, Met, Val, Ile, Asp, Ala, Ser, Thr, His, Asn, Lys, Gly, Phe, or Arg
  misc_feature (11)..(11): Xaa can be Trp, Leu, Phe, Met, Ile, Tyr, Val, Cys, Ala, Thr, His, Pro, Gly, or Ser
RXGDCAPEEKX

SEQ ID NO: 60318 - protein, 10 aa, Artificial Sequence
  Description of Artificial Sequence: Synthetic peptide
  Seed: RGEALGLVGA (MAGA3_HUMAN)
  misc_feature (2)..(2): Xaa can be Glu, Thr, Trp, Gly, Ser, Tyr, Lys, Asp, Cys, Phe, Arg, Gln, His, Leu, Pro, Ile, Val, Ala, Met, or Asn
  misc_feature (10)..(10): Xaa can be Ala, Pro, Val, Ile, Met, Ser, Cys, Thr, or Leu
RXEALGLVGX

SEQ ID NO: 60319 - protein, 9 aa, Artificial Sequence
  Description of Artificial Sequence: Synthetic peptide
  Seed: RKVAELVHF (MAGA3_HUMAN)
  misc_feature (2)..(2): Xaa can be Arg, Gln, Met, Ala, Lys, His, Val, Leu, Glu, Gly, Ile, Tyr, Asn, Ser, Trp, Thr, Phe, Asp, Cys, or Pro
  misc_feature (9)..(9): Xaa can be Phe, Tyr, Leu, Met, Lys, Ile, Trp, His, Val, Arg, Ala, Cys, Gly, Thr, Gln, Asn, Ser, Glu, or Pro
RXVAELVHX

SEQ ID NO: 60320 - protein, 10 aa, Artificial Sequence
  Description of Artificial Sequence: Synthetic peptide
  Seed: RKVAELVHFL (MAGA3_HUMAN)
  misc_feature (2)..(2): Xaa can be Arg, Gln, Met, Leu, Ser, Phe, Ala, Asn, Val, Glu, His, Lys, Thr, Tyr, Ile, Trp, Gly, Pro, Cys, or Asp
  misc_feature (10)..(10): Xaa can be Ile, Leu, Met, Val, Ala, Phe, Tyr, Thr, Cys, Ser, Gly, Gln, Pro, Asp, His, Trp, Asn, Lys, Glu, or Arg
RXVAELVHFX

SEQ ID NO: 60321 - protein, 11 aa, Artificial Sequence
  Description of Artificial Sequence: Synthetic peptide
  Seed: RKVAELVHFLL (MAGA3_HUMAN)
  misc_feature (2)..(2): Xaa can be Arg, Gln, or Lys
  misc_feature (11)..(11): Xaa can be Leu, Ile, Met, Phe, Val, Ser, Pro, Ala, Glu, Tyr, His, Gln, Lys, Gly, Asp, Asn, Arg, Trp, Thr, or Cys
RXVAELVHFLX

SEQ ID NO: 60322 - protein, 9 aa, Artificial Sequence
  Description of Artificial Sequence: Synthetic peptide
  Seed: RQVPGSDPA (MAGA3_HUMAN)
  misc_feature (2)..(2): Xaa can be Glu, Gln, His, Arg, Asp, Met, Leu, Ile, Val, Thr, Lys, Ser, Ala, Pro, Gly, Asn, Phe, Cys, Tyr, or Trp
  misc_feature (9)..(9): Xaa can be Tyr, Met, Phe, Trp, Leu, Val, Ile, Ala, His, Thr, Cys, Pro, Gly, Ser, Arg, Lys, Asp, Gln, Glu, or Asn
RXVPGSDPX

SEQ ID NO: 60323 - protein, 10 aa, Artificial Sequence
  Description of Artificial Sequence: Synthetic peptide
  Seed: RQVPGSDPAC (MAGA3_HUMAN)
  misc_feature (2)..(2): Xaa can be Glu, Gln, Asp, His, Leu, Met, Ile, Val, Arg, Ala, Ser, Lys, Thr, Asn, Pro, Gly, Cys, Phe, Tyr, or Trp
  misc_feature (10)..(10): Xaa can be Met, Tyr, Phe, Leu, Trp, Ile, Val, Ala, Cys, His, Thr, Gly, Ser, Pro, Arg, Lys, Gln, Glu, Asp, or Asn
RXVPGSDPAX

SEQ ID NO: 60324 - protein, 11 aa, Artificial Sequence
  Description of Artificial Sequence: Synthetic peptide
  Seed: RQVPGSDPACY (MAGA3_HUMAN)
  misc_feature (2)..(2): Xaa can be Arg, Ala, Glu, Val, Gln, Ser, Gly, Leu, Thr, Met, Ile, Tyr, Asn, His, Phe, Asp, Pro, Cys, Lys, or Trp
  misc_feature (11)..(11): Xaa can be Leu, Lys, Tyr, Met, Phe, Arg, Trp, His, Ile, Val, Ala, Gln, Cys, Thr, Gly, Glu, Asn, Ser, or Pro
RXVPGSDPACX

SEQ ID NO: 60325 - protein, 8 aa, Artificial Sequence
  Description of Artificial Sequence: Synthetic peptide
  Seed: SDPACYEF (MAGA3_HUMAN)
  misc_feature (2)..(2): Xaa can be Glu, or Asp
  misc_feature (8)..(8): Xaa can be Leu, Phe, Ile, Val, Met, or Tyr
SXPACYEX

SEQ ID NO: 60326 - protein, 9 aa, Artificial Sequence
  Description of Artificial Sequence: Synthetic peptide
  Seed: SDPACYEFL (MAGA3_HUMAN)
  misc_feature (2)..(2): Xaa can be Glu, Gln, Ala, Arg, Gly, Ser, Phe, His, Asp, Tyr, Ile, Asn, Leu, Met, Thr, Val, Pro, Lys, Cys, or Trp
  misc_feature (9)..(9): Xaa can be Leu, Met, Phe, Ile, Val, or Tyr
SXPACYEFX

SEQ ID NO: 60327 - protein, 10 aa, Artificial Sequence
  Description of Artificial Sequence: Synthetic peptide
  Seed: SDPACYEFLW (MAGA3_HUMAN)
  misc_feature (2)..(2): Xaa can be Met, Phe, Tyr, Ala, Pro, Thr, His, Gly, Ile, Arg, Asn, Trp, Val, Lys, Leu, Cys, Glu, Ser, Gln, or Asp
  misc_feature (10)..(10): Xaa can be Trp, Phe, Tyr, Met, Leu, or Ile
SXPACYEFLX

SEQ ID NO: 60328 - protein, 8 aa, Artificial Sequence
  Description of Artificial Sequence: Synthetic peptide
  Seed: SEFQAALS (MAGA3_HUMAN)
  misc_feature (2)..(2): Xaa can be Glu, or Asp
  misc_feature (8)..(8): Xaa can be Ile, Met, Leu, Val, Ala, Cys, Pro, Phe, Ser, Thr, Tyr, or Gly
SXFQAALX

SEQ ID NO: 60329 - protein, 9 aa, Artificial Sequence
  Description of Artificial Sequence: Synthetic peptide
  Seed: SEFQAALSR (MAGA3_HUMAN)
  misc_feature (2)..(2): Xaa can be Glu, Asp, Gln, Thr, Val, Leu, Met, Ala, Ser, Ile, Gly, Asn, Arg, Pro, Lys, His, Phe, Tyr, Cys, or Trp
  misc_feature (9)..(9): Xaa can be Arg, Lys, Tyr, Phe, Leu, Met, His, Ile, Trp, Val, Ala, Cys, Gln, Pro, Thr, Ser, Gly, Asn, Glu, or Asp
SXFQAALSX

SEQ ID NO: 60330 - protein, 10 aa, Artificial Sequence
  Description of Artificial Sequence: Synthetic peptide
  Seed: SEFQAALSRK (MAGA3_HUMAN)
  misc_feature (2)..(2): Xaa can be Tyr, Phe, Met, Glu, Thr, Val, Leu, Ala, Ile, Gln, Ser, Asp, Arg, His, Asn, Lys, Pro, Cys, Trp, or Gly
  misc_feature (10)..(10): Xaa can be Arg, Lys, Tyr, Phe, Trp, Met, Leu, Val, His, Ile, Ala, Gln, Thr, Cys, Asn, Gly, Asp, Pro, Ser, or Glu
SXFQAALSRX

SEQ ID NO: 60331 - protein, 11 aa, Artificial Sequence
  Description of Artificial Sequence: Synthetic peptide
  Seed: SEFQAALSRKV (MAGA3_HUMAN)
  misc_feature (2)..(2): Xaa can be Glu, Asp, or Gln
  misc_feature (11)..(11): Xaa can be Leu, Tyr, Ile, Cys, Trp, Phe, Met, Val, Thr, His, Pro, Ser, Gly, or Ala
SXFQAALSRKX

SEQ ID NO: 60332 - protein, 8 aa, Artificial Sequence
  Description of Artificial Sequence: Synthetic peptide
  Seed: SGGPHISY (MAGA3_HUMAN)
  misc_feature (2)..(2): Xaa can be Ala, Arg, Ser, Val, Ile, Gly, Gln, Thr, Met, Phe, Tyr, Leu, His, Cys, Asn, Glu, Lys, Trp, Pro, or Asp
  misc_feature (8)..(8): Xaa can be Tyr, Leu, Phe, Met, Ile, Lys, Arg, Val, Trp, His, Ala, Ser, Thr, Pro, Gln, or Cys
SXGPHISX

SEQ ID NO: 60333 - protein, 11 aa, Artificial Sequence
  Description of Artificial Sequence: Synthetic peptide
  Seed: SGGPHISYPPL (MAGA3_HUMAN)
  misc_feature (2)..(2): Xaa can be Pro, His, Ser, Asn, Arg, Glu, Met, Leu, Gln, Val, Lys, Thr, Phe, Asp, Tyr, Gly, Trp, Ala, Ile, or Cys
  misc_feature (11)..(11): Xaa can be Leu, Met, Phe, Val, Ala, or Ile
SXGPHISYPPX

SEQ ID NO: 60334 - protein, 8 aa, Artificial Sequence
  Description of Artificial Sequence: Synthetic peptide
  Seed: SILGDPKK (MAGA3_HUMAN)
  misc_feature (2)..(2): Xaa can be Ala, Gly, Leu, Ile, Thr, Val, or Ser
  misc_feature (8)..(8): Xaa can be Arg, Lys, or Leu
SXLGDPKX

SEQ ID NO: 60335 - protein, 9 aa, Artificial Sequence
  Description of Artificial Sequence: Synthetic peptide
  Seed: SILGDPKKL (MAGA3_HUMAN)
  misc_feature (2)..(2): Xaa can be Gln, Arg, Ala, Leu, Met, Val, Ser, Ile, Thr, Gly, Tyr, Asn, Glu, Phe, Asp, Cys, His, Pro, Trp, or Lys
  misc_feature (9)..(9): Xaa can be Phe, Met, Leu, Tyr, Lys, Val, Arg, Ile, Trp, His, Ala, Cys, or Thr
SXLGDPKKX

SEQ ID NO: 60336 - protein, 10 aa, Artificial Sequence
  Description of Artificial Sequence: Synthetic peptide
  Seed: SILGDPKKLL (MAGA3_HUMAN)
  misc_feature (2)..(2): Xaa can be Leu, Met, Gln, Val, Ile, Glu, Thr, or Ala
  misc_feature (10)..(10): Xaa can be Trp, Val, Leu, Phe, Ile, Met, Ala, or Tyr
SXLGDPKKLX

SEQ ID NO: 60337 - protein, 9 aa, Artificial Sequence
  Description of Artificial Sequence: Synthetic peptide
  Seed: SKASSSLQL (MAGA3_HUMAN)
  misc_feature (2)..(2): Xaa can be Arg, His, Gln, Met, Lys, Glu, Ala, Gly, Tyr, Phe, Ser, Asn, Leu, Thr, Ile, Val, Trp, Asp, Pro, or Cys
  misc_feature (9)..(9): Xaa can be Tyr, Leu, Phe, Met, Ile, Val, Trp, His, Ala, Cys, Thr, Pro, Arg, Gly, or Lys
SXASSSLQX

SEQ ID NO: 60338 - protein, 11 aa, Artificial Sequence
  Description of Artificial Sequence: Synthetic peptide
  Seed: SKASSSLQLVF (MAGA3_HUMAN)
  misc_feature (2)..(2): Xaa can be Thr, Gln, Met, Ser, Lys, Tyr, Asp, Ile, Trp, Pro, Cys, Phe, Ala, Leu, Arg, His, Gly, Asn, Glu, or Val
  misc_feature (11)..(11): Xaa can be Met, Tyr, Trp, Phe, Leu, or Ile
SXASSSLQLVX

SEQ ID NO: 60339 - protein, 8 aa, Artificial Sequence
  Description of Artificial Sequence: Synthetic peptide
  Seed: SLPTTMNY (MAGA3_HUMAN)
  misc_feature (2)..(2): Xaa can be Gln, Met, Ala, or Leu
  misc_feature (8)..(8): Xaa can be Tyr, or Phe
SXPTTMNX

SEQ ID NO: 60340 - protein, 10 aa, Artificial Sequence
  Description of Artificial Sequence: Synthetic peptide
  Seed: SLPTTMNYPL (MAGA3_HUMAN)
  misc_feature (2)..(2): Xaa can be Pro, Phe, Ile, Leu, Tyr, Lys, Ser, Gln, Asn, Thr, Glu, His, Ala, Cys, Arg, Asp, Val, Trp, Gly, or Met
  misc_feature (10)..(10): Xaa can be Val, Ala, Phe, Ile, Leu, or Met
SXPTTMNYPX

SEQ ID NO: 60341 - protein, 11 aa, Artificial Sequence
  Description of Artificial Sequence: Synthetic peptide
  Seed: SLPTTMNYPLW (MAGA3_HUMAN)
  misc_feature (2)..(2): Xaa can be Tyr, Trp, Phe, Ser, Thr, Gly, Pro, Met, Leu, Ile, His, Arg, Ala, Asn, Cys, Val, Asp, Lys, Gln, or Glu
  misc_feature (11)..(11): Xaa can be Trp, Phe, Tyr, Ile, Met, Leu, or Val
SXPTTMNYPLX

SEQ ID NO: 60342 - protein, 10 aa, Artificial Sequence
  Description of Artificial Sequence: Synthetic peptide
  Seed: SLQLVFGIEL (MAGA3_HUMAN)
  misc_feature (2)..(2): Xaa can be Met, Ile, Leu, Val, Gln, Thr, Tyr, Asn, Asp, Cys, Ser, Ala, Glu, Pro, Lys, Phe, Arg, Gly, Trp, or His
  misc_feature (10)..(10): Xaa can be Val, Met, Tyr, Phe, Leu, Ile, or Ala
SXQLVFGIEX

SEQ ID NO: 60343 - protein, 11 aa, Artificial Sequence
  Description of Artificial Sequence: Synthetic peptide
  Seed: SNQEEEGPSTF (MAGA3_HUMAN)
  misc_feature (2)..(2): Xaa can be Arg, Glu, Gly, Ala, Gln, Met, Thr, Leu, Ile, Ser, Val, Asp, His, Phe, Tyr, Asn, Pro, Trp, Cys, or Lys
  misc_feature (11)..(11): Xaa can be Lys, Leu, Trp, Glu, Arg, Phe, Tyr, Met, Asn, Ile, Gln, His, Val, Asp, Cys, Ala, Gly, Ser, Pro, or Thr
SXQEEEGPSTX

SEQ ID NO: 60344 - protein, 9 aa, Artificial Sequence
  Description of Artificial Sequence: Synthetic peptide
  Seed: SPDPPQSPQ (MAGA3_HUMAN)
  misc_feature (2)..(2): Xaa can be Pro, Ala, Val, Phe, Tyr, Ser, Ile, Trp, Leu, Gly, Met, Thr, Gln, Cys, Glu, Asp, or Asn
  misc_feature (9)..(9): Xaa can be Tyr, Phe, Met, Leu, Ile, Val, Trp, Ala, Cys, His, Pro, Gly, Gln, Arg, Ser, Lys, Thr, or Gl u
SXDPPQSPX

SEQ ID NO: 60345 - protein, 10 aa, Artificial Sequence
  Description of Artificial Sequence: Synthetic peptide
  Seed: SPDPPQSPQG (MAGA3_HUMAN)
  misc_feature (2)..(2): Xaa can be Pro, Ala, Tyr, Phe, Val, Met, or Ile
  misc_feature (10)..(10): Xaa can be Leu, Met, Phe, Ala, Ser, Pro, Thr, Gln, Ile, Arg, Cys, Trp, Val, His, Tyr, Lys, or Gly
SXDPPQSPQX

SEQ ID NO: 60346 - protein, 11 aa, Artificial Sequence
  Description of Artificial Sequence: Synthetic peptide
  Seed: SPDPPQSPQGA (MAGA3_HUMAN)
  misc_feature (2)..(2): Xaa can be Pro, Ala, Val, Tyr, Ile, Phe, Gly, Met, Ser, Cys, Leu, Thr, Gln, Glu, Trp, or Asp
  misc_feature (11)..(11): Xaa can be Tyr, Phe, Leu, Met, Trp, Ile, Ala, Cys, Lys, Val, Ser, Arg, Thr, Gly, His, or Pro
SXDPPQSPQGX

SEQ ID NO: 60347 - protein, 8 aa, Artificial Sequence
  Description of Artificial Sequence: Synthetic peptide
  Seed: SPQGASSL (MAGA3_HUMAN)
  misc_feature (2)..(2): Xaa can be , or Pro
  misc_feature (8)..(8): Xaa can be Leu, Ala, Met, Phe, Val, or Ile
SXQGASSX

SEQ ID NO: 60348 - protein, 9 aa, Artificial Sequence
  Description of Artificial Sequence: Synthetic peptide
  Seed: SPQGASSLP (MAGA3_HUMAN)
  misc_feature (2)..(2): Xaa can be Pro, or Ala
  misc_feature (9)..(9): Xaa can be Met, Ala, Leu, Ile, Arg, Thr, Phe, Pro, Ser, Val, Cys, Gly, Tyr, or Trp
SXQGASSLX

SEQ ID NO: 60349 - protein, 10 aa, Artificial Sequence
  Description of Artificial Sequence: Synthetic peptide
  Seed: SPQGASSLPT (MAGA3_HUMAN)
  misc_feature (2)..(2): Xaa can be Pro, Ala, or Val
  misc_feature (10)..(10): Xaa can be Leu, Met, Ala, Tyr, Pro, Trp, Val, Thr, His, Phe, Cys, Gln, Ser, Lys, Gly, Ile, or Arg
SXQGASSLPX

SEQ ID NO: 60350 - protein, 11 aa, Artificial Sequence
  Description of Artificial Sequence: Synthetic peptide
  Seed: SPQGASSLPTT (MAGA3_HUMAN)
  misc_feature (2)..(2): Xaa can be Pro, Ala, or Val
  misc_feature (11)..(11): Xaa can be Ala, Cys, Leu, Met, Thr, Phe, Ile, Gln, Arg, Ser, His, Lys, Gly, Glu, Tyr, Val, Pro, Asn, or Trp
SXQGASSLPTX

SEQ ID NO: 60351 - protein, 10 aa, Artificial Sequence
  Description of Artificial Sequence: Synthetic peptide
  Seed: SQHCKPEEGL (MAGA3_HUMAN)
  misc_feature (2)..(2): Xaa can be His, Gln, Met, or Leu
  misc_feature (10)..(10): Xaa can be Trp, Phe, Ile, Val, Met, or Leu
SXHCKPEEGX

SEQ ID NO: 60352 - protein, 9 aa, Artificial Sequence
  Description of Artificial Sequence: Synthetic peptide
  Seed: SRKVAELVH (MAGA3_HUMAN)
  misc_feature (2)..(2): Xaa can be Arg, Tyr, Gln, Lys, Trp, Met, Ser, Ala, Phe, His, Asn, Thr, Gly, Leu, or Ile
  misc_feature (9)..(9): Xaa can be Leu, Phe, Tyr, Met, Lys, Val, Ile, Arg, Trp, Ala, His, Cys, or Gln
SXKVAELVX

SEQ ID NO: 60353 - protein, 10 aa, Artificial Sequence
  Description of Artificial Sequence: Synthetic peptide
  Seed: SRKVAELVHF (MAGA3_HUMAN)
  misc_feature (2)..(2): Xaa can be Arg, Gln, Thr, Met, Tyr, Leu, His, Trp, Phe, Glu, Val, Ala, Ile, Ser, Lys, Cys, Asp, Asn, Pro, or Gly
  misc_feature (10)..(10): Xaa can be Phe, Tyr, Met, Leu, Trp, Lys, Arg, Val, or Ile
SXKVAELVHX

SEQ ID NO: 60354 - protein, 11 aa, Artificial Sequence
  Description of Artificial Sequence: Synthetic peptide
  Seed: SRKVAELVHFL (MAGA3_HUMAN)
  misc_feature (2)..(2): Xaa can be Arg, Met, Leu, Gln, Thr, Glu, Phe, Pro, Ala, Asn, Val, His, Gly, Lys, Ser, Cys, Trp, Tyr, Ile, or Asp
  misc_feature (11)..(11): Xaa can be Val, Leu, Ile, Met, Ala, Cys, Thr, Trp, Phe, Tyr, or Lys
SXKVAELVHFX

SEQ ID NO: 60355 - protein, 9 aa, Artificial Sequence
  Description of Artificial Sequence: Synthetic peptide
  Seed: SSLPTTMNY (MAGA3_HUMAN)
  misc_feature (2)..(2): Xaa can be Arg, Ala, Ser, Tyr, Thr, Gln, Val, Phe, Leu, Pro, His, Met, Gly, Ile, Asn, Glu, Cys, Lys, Trp, or Asp
  misc_feature (9)..(9): Xaa can be Trp, Phe, Leu, Tyr, Arg, Met, Ile, Lys, Val, His, Ala, Cys, Gln, Thr, Ser, or Gly
SXLPTTMNX

SEQ ID NO: 60356 - protein, 11 aa, Artificial Sequence
  Description of Artificial Sequence: Synthetic peptide
  Seed: SSLPTTMNYPL (MAGA3_HUMAN)
  misc_feature (2)..(2): Xaa can be Ser, Pro, Thr, Val, Ala, Met, Ile, Arg, Tyr, Phe, Leu, Trp, Asn, Glu, Asp, Gly, Lys, Cys, His, or Gln
  misc_feature (11)..(11): Xaa can be Met, Leu, Phe, Trp, Tyr, Ile, Val, or Ala
SXLPTTMNYPX

SEQ ID NO: 60357 - protein, 9 aa, Artificial Sequence
  Description of Artificial Sequence: Synthetic peptide
  Seed: SSLQLVFGI (MAGA3_HUMAN)
  misc_feature (2)..(2): Xaa can be Met, Leu, Val, Ala, Gln, Thr, Ile, Ser, Glu, Gly, Asn, Asp, Cys, Phe, Tyr, Trp, Pro, Arg, or Lys
  misc_feature (9)..(9): Xaa can be Trp, Val, Ile, Leu, Phe, Tyr, Met, Ala, Thr, Cys, Lys, Ser, Arg, Pro, or Gly
SXLQLVFGX

SEQ ID NO: 60358 - protein, 8 aa, Artificial Sequence
  Description of Artificial Sequence: Synthetic peptide
  Seed: SSSLQLVF (MAGA3_HUMAN)
  misc_feature (2)..(2): Xaa can be Ala, Ser, Thr, Tyr, Gly, Val, Phe, Ile, Cys, Met, or Asn
  misc_feature (8)..(8): Xaa can be Trp, Leu, Phe, Tyr, Ile, Met, Val, Lys, or His
SXSLQLVX

SEQ ID NO: 60359 - protein, 10 aa, Artificial Sequence
  Description of Artificial Sequence: Synthetic peptide
  Seed: SSSLQLVFGI (MAGA3_HUMAN)
  misc_feature (2)..(2): Xaa can be Thr, Val, Ser, Met, Lys, Arg, Ala, Tyr, Gln, Phe, Leu, Trp, Gly, Glu, Pro, His, Asp, Ile, Cys, or Asn
  misc_feature (10)..(10): Xaa can be Val, Trp, Tyr, Ile, Phe, Met, Leu, or Ala
SXSLQLVFGX

SEQ ID NO: 60360 - protein, 9 aa, Artificial Sequence
  Description of Artificial Sequence: Synthetic peptide
  Seed: SSSSTLVEV (MAGA3_HUMAN)
  misc_feature (2)..(2): Xaa can be Ala, Met, Leu, Ile, Thr, Gln, Val, Ser, Pro, Arg, Cys, Gly, Asn, Tyr, Glu, Trp, Asp, Phe, His, or Lys
  misc_feature (9)..(9): Xaa can be Trp, Leu, Phe, Met, Val, Ile, Tyr, Lys, Arg, His, Cys, Ala, Thr, Ser, Gly, Pro, or Gln
SXSSTLVEX

SEQ ID NO: 60361 - protein, 11 aa, Artificial Sequence
  Description of Artificial Sequence: Synthetic peptide
  Seed: SSSSTLVEVTL (MAGA3_HUMAN)
  misc_feature (2)..(2): Xaa can be Ser, Thr, Ala, Val, Ile, Gly, Leu, Met, Asn, Gln, Pro, Cys, Asp, Glu, Phe, His, Arg, Lys, Trp, or Tyr
  misc_feature (11)..(11): Xaa can be Trp, Lys, Phe, Arg, Tyr, Leu, Met, Ile, or Val
SXSSTLVEVTX

SEQ ID NO: 60362 - protein, 8 aa, Artificial Sequence
  Description of Artificial Sequence: Synthetic peptide
  Seed: SSSTLVEV (MAGA3_HUMAN)
  misc_feature (2)..(2): Xaa can be Ala, Ser, Gly, Val, Ile, Thr, Gln, Leu, Phe, Asn, Met, Glu, Asp, Cys, or Pro
  misc_feature (8)..(8): Xaa can be Leu, Ile, Lys, Val, Phe, Tyr, Met, Arg, or Trp
SXSTLVEX

SEQ ID NO: 60363 - protein, 10 aa, Artificial Sequence
  Description of Artificial Sequence: Synthetic peptide
  Seed: SSSTLVEVTL (MAGA3_HUMAN)
  misc_feature (2)..(2): Xaa can be Ser, Thr, Ala, Met, Val, Gln, Arg, Glu, Leu, Ile, His, Asn, Pro, Gly, Tyr, Phe, Asp, Cys, Trp, or Lys
  misc_feature (10)..(10): Xaa can be Trp, Phe, Tyr, Lys, Arg, Leu, Met, Ile, or Val
SXSTLVEVTX

SEQ ID NO: 60364 - protein, 9 aa, Artificial Sequence
  Description of Artificial Sequence: Synthetic peptide
  Seed: SSTLVEVTL (MAGA3_HUMAN)
  misc_feature (2)..(2): Xaa can be Glu, Arg, Gln, Ala, Asp, Thr, Ser, Pro, Met, Val, Ile, Gly, Leu, Asn, Phe, Tyr, Cys, Lys, His, or Trp
  misc_feature (9)..(9): Xaa can be Leu, Tyr, Met, Trp, Phe, Lys, Ile, Val, Arg, His, Cys, Ala, Thr, Gln, Gly, Glu, Pro, Asn, or Ser
SXTLVEVTX

SEQ ID NO: 60365 - protein, 10 aa, Artificial Sequence
  Description of Artificial Sequence: Synthetic peptide
  Seed: STFPDLESEF (MAGA3_HUMAN)
  misc_feature (2)..(2): Xaa can be Arg, Ala, Gln, Thr, Val, Pro, Ser, Ile, Met, Tyr, Gly, Leu, Glu, His, Asn, Lys, Trp, Phe, Asp, or Cys
  misc_feature (10)..(10): Xaa can be Lys, Trp, Arg, Leu, Phe, Met, Tyr, Ile, Val, His, Cys, Gln, Ala, or Thr
SXFPDLESEX

SEQ ID NO: 60366 - protein, 11 aa, Artificial Sequence
  Description of Artificial Sequence: Synthetic peptide
  Seed: STFPDLESEFQ (MAGA3_HUMAN)
  misc_feature (2)..(2): Xaa can be Thr, Met, Ser, Val, Ile, Leu, Ala, Gly, Asn, Glu, Phe, Asp, Gln, Cys, Trp, Tyr, or Pro
  misc_feature (11)..(11): Xaa can be Lys, Tyr, Arg, His, Phe, Trp, Gln, or Met
SXFPDLESEFX

SEQ ID NO: 60367 - protein, 8 aa, Artificial Sequence
  Description of Artificial Sequence: Synthetic peptide
  Seed: STLVEVTL (MAGA3_HUMAN)
  misc_feature (2)..(2): Xaa can be Ala, Thr, Ser, Val, Gly, or Ile
  misc_feature (8)..(8): Xaa can be Lys, Leu, Phe, Met, Tyr, or Ile
SXLVEVTX

SEQ ID NO: 60368 - protein, 11 aa, Artificial Sequence
  Description of Artificial Sequence: Synthetic peptide
  Seed: STLVEVTLGEV (MAGA3_HUMAN)
  misc_feature (2)..(2): Xaa can be Phe, Tyr, Met, Leu, Lys, Ser, Arg, Ala, Ile, Trp, Gly, Thr, His, Gln, or Val
  misc_feature (11)..(11): Xaa can be Val, Leu, Ala, Ile, or Met
SXLVEVTLGEX

SEQ ID NO: 60369 - protein, 9 aa, Artificial Sequence
  Description of Artificial Sequence: Synthetic peptide
  Seed: SVLEVFEGR (MAGA3_HUMAN)
  misc_feature (2)..(2): Xaa can be Leu, Met, Thr, Ala, Val, Gln, Ile, Ser, Tyr, Phe, Gly, Cys, Asn, Trp, Glu, His, Lys, Pro, Arg, or Asp
  misc_feature (9)..(9): Xaa can be Tyr, Arg, Lys, Phe, Met, Leu, His, Trp, Val, Ile, Ala, Gln, or Thr
SXLEVFEGX

SEQ ID NO: 60370 - protein, 8 aa, Artificial Sequence
  Description of Artificial Sequence: Synthetic peptide
  Seed: SVVGNWQY (MAGA3_HUMAN)
  misc_feature (2)..(2): Xaa can be Gln, Val, Phe, Ile, Trp, Thr, Leu, Met, Tyr, or Ala
  misc_feature (8)..(8): Xaa can be Tyr, or Phe
SXVGNWQX

SEQ ID NO: 60371 - protein, 9 aa, Artificial Sequence
  Description of Artificial Sequence: Synthetic peptide
  Seed: SVVGNWQYF (MAGA3_HUMAN)
  misc_feature (2)..(2): Xaa can be Tyr, Val, Ala, Gln, Thr, Leu, Phe, Gly, Ser, Met, Arg, Ile, Asn, Glu, Pro, Trp, Cys, Lys, Asp, or His
  misc_feature (9)..(9): Xaa can be Tyr, Trp, Phe, Leu, Met, Arg, Ile, Lys, Val, His, Ala, Cys, Gly, or Thr
SXVGNWQYX

SEQ ID NO: 60372 - protein, 10 aa, Artificial Sequence
  Description of Artificial Sequence: Synthetic peptide
  Seed: SVVGNWQYFF (MAGA3_HUMAN)
  misc_feature (2)..(2): Xaa can be Phe, Tyr, Trp, Met, Thr, Ser, Gln, Ala, Gly, Leu, Val, His, Cys, Arg, Asn, Ile, Glu, Pro, Asp, or Lys
  misc_feature (10)..(10): Xaa can be Tyr, Trp, Phe, Met, Leu, Ile, Gly, His, Ser, Arg, Cys, Gln, Asn, Thr, Pro, Asp, Glu, Ala, Val, or Lys
SXVGNWQYFX

SEQ ID NO: 60373 - protein, 8 aa, Artificial Sequence
  Description of Artificial Sequence: Synthetic peptide
  Seed: SYPPLHEW (MAGA3_HUMAN)
  misc_feature (2)..(2): Xaa can be Tyr, Arg, Phe, His, Trp, Ala, Met, Ser, Gln, Thr, Asn, Leu, Gly, Lys, Pro, Val, Ile, Glu, Cys, or Asp
  misc_feature (8)..(8): Xaa can be Trp, Leu, Phe, Met, Tyr, Ile, Val, His, Ala, Arg, Cys, Lys, Thr, or Gln
SXPPLHEX

SEQ ID NO: 60374 - protein, 9 aa, Artificial Sequence
  Description of Artificial Sequence: Synthetic peptide
  Seed: SYPPLHEWV (MAGA3_HUMAN)
  misc_feature (2)..(2): Xaa can be Arg, Tyr, Trp, His, Gln, Met, Thr, Phe, Leu, Ile, Val, Ala, Ser, Gly, Asn, Glu, Lys, Cys, Pro, or Asp
  misc_feature (9)..(9): Xaa can be Met, Leu, Phe, Ile, Tyr, Val, Trp, Ala, His, Cys, or Lys
SXPPLHEWX

SEQ ID NO: 60375 - protein, 10 aa, Artificial Sequence
  Description of Artificial Sequence: Synthetic peptide
  Seed: SYPPLHEWVL (MAGA3_HUMAN)
  misc_feature (2)..(2): Xaa can be Tyr, Arg, Trp, Phe, Met, Ala, Gln, Leu, His, Ile, Val, Gly, Ser, Thr, Lys, Glu, or Cys
  misc_feature (10)..(10): Xaa can be Leu, Phe, Met, Tyr, Trp, Ile, Val, His, Arg, Cys, Ala, or Lys
SXPPLHEWVX

SEQ ID NO: 60376 - protein, 11 aa, Artificial Sequence
  Description of Artificial Sequence: Synthetic peptide
  Seed: SYPPLHEWVLR (MAGA3_HUMAN)
  misc_feature (2)..(2): Xaa can be Tyr, Trp, Phe, Leu, Met, Val, Thr, Gln, Ser, Ile, Ala, Gly, His, or Asn
  misc_feature (11)..(11): Xaa can be Arg, Phe, Lys, Trp, Leu, Tyr, Val, Ile, Met, Cys, Asp, Gln, His, Asn, Thr, Ser, Glu, Pro, Ala, or Gly
SXPPLHEWVLX

SEQ ID NO: 60377 - protein, 9 aa, Artificial Sequence
  Description of Artificial Sequence: Synthetic peptide
  Seed: SYVKVLHHM (MAGA3_HUMAN)
  misc_feature (2)..(2): Xaa can be Arg, Tyr, Ala, Gln, Val, Ser, Met, Thr, Phe, Gly, Ile, Leu, Trp, Asp, Asn, Glu, His, Cys, Lys, or Pro
  misc_feature (9)..(9): Xaa can be Leu, Tyr, Phe, Met, Val, Ile, Trp, Lys, Arg, His, Cys, Ala, Thr, Gly, or Gln
SXVKVLHHX

SEQ ID NO: 60378 - protein, 10 aa, Artificial Sequence
  Description of Artificial Sequence: Synthetic peptide
  Seed: SYVKVLHHMV (MAGA3_HUMAN)
  misc_feature (2)..(2): Xaa can be Tyr, Trp, Phe, or Met
  misc_feature (10)..(10): Xaa can be Phe, Trp, Ile, Leu, Met, Val, or Tyr
SXVKVLHHMX

SEQ ID NO: 60379 - protein, 11 aa, Artificial Sequence
  Description of Artificial Sequence: Synthetic peptide
  Seed: SYVKVLHHMVK (MAGA3_HUMAN)
  misc_feature (2)..(2): Xaa can be Phe, Tyr, Met, Ile, Val, Ser, Trp, Leu, Gln, Ala, Lys, Arg, or Thr
  misc_feature (11)..(11): Xaa can be Arg, or Lys
SXVKVLHHMVX

SEQ ID NO: 60380 - protein, 9 aa, Artificial Sequence
  Description of Artificial Sequence: Synthetic peptide
  Seed: TEEQEAASS (MAGA3_HUMAN)
  misc_feature (2)..(2): Xaa can be Glu, Asp, or Gln
  misc_feature (9)..(9): Xaa can be Ala, Leu, Ile, Val, Met, Cys, Tyr, Ser, Gly, Pro, Trp, Phe, or Thr
TXEQEAASX

SEQ ID NO: 60381 - protein, 10 aa, Artificial Sequence
  Description of Artificial Sequence: Synthetic peptide
  Seed: TEEQEAASSS (MAGA3_HUMAN)
  misc_feature (2)..(2): Xaa can be Glu, Gln, or Asp
  misc_feature (10)..(10): Xaa can be Ala, Val, Leu, Ile, Cys, Ser, Phe, Pro, Tyr, Met, Trp, Gly, or Thr
TXEQEAASSX

SEQ ID NO: 60382 - protein, 11 aa, Artificial Sequence
  Description of Artificial Sequence: Synthetic peptide
  Seed: TEEQEAASSSS (MAGA3_HUMAN)
  misc_feature (2)..(2): Xaa can be Glu, Gln, or Asp
  misc_feature (11)..(11): Xaa can be Ala, Leu, Cys, Ser, Thr, Ile, Trp, Phe, Met, Tyr, Val, Pro, or Gly
TXEQEAASSSX

SEQ ID NO: 60383 - protein, 9 aa, Artificial Sequence
  Description of Artificial Sequence: Synthetic peptide
  Seed: TFPDLESEF (MAGA3_HUMAN)
  misc_feature (2)..(2): Xaa can be Tyr, Ala, Leu, Ile, Met, Thr, Ser, Val, Phe, Arg, Gln, Trp, Gly, Pro, His, Cys, Asn, Glu, Asp, or Lys
  misc_feature (9)..(9): Xaa can be Lys, Met, Phe, Ile, Tyr, Leu, Val, Arg, Trp, His, Ala, Cys, or Thr
TXPDLESEX

SEQ ID NO: 60384 - protein, 9 aa, Artificial Sequence
  Description of Artificial Sequence: Synthetic peptide
  Seed: TKAEMLGSV (MAGA3_HUMAN)
  misc_feature (2)..(2): Xaa can be His, Arg, Gln, Pro, Glu, or Lys
  misc_feature (9)..(9): Xaa can be Val, Ala, Leu, Ile, Met, Cys, Thr, Pro, Phe, Ser, or Gly
TXAEMLGSX

SEQ ID NO: 60385 - protein, 10 aa, Artificial Sequence
  Description of Artificial Sequence: Synthetic peptide
  Seed: TLVEVTLGEV (MAGA3_HUMAN)
  misc_feature (2)..(2): Xaa can be Leu, Met, Gln, Thr, Ile, Val, Ser, Ala, or Asn
  misc_feature (10)..(10): Xaa can be Val, Ile, Leu, Ala, Met, Thr, Cys, Ser, Trp, or Phe
TXVEVTLGEX

SEQ ID NO: 60386 - protein, 11 aa, Artificial Sequence
  Description of Artificial Sequence: Synthetic peptide
  Seed: TLVEVTLGEVP (MAGA3_HUMAN)
  misc_feature (2)..(2): Xaa can be Leu, or Met
  misc_feature (11)..(11): Xaa can be Val, Leu, Ala, Ile, Met, Gln, Asp, Ser, Trp, Arg, Lys, Phe, Gly, Asn, Tyr, Pro, Cys, Thr, His, or Glu
TXVEVTLGEVX

SEQ ID NO: 60387 - protein, 11 aa, Artificial Sequence
  Description of Artificial Sequence: Synthetic peptide
  Seed: TMNYPLWSQSY (MAGA3_HUMAN)
  misc_feature (2)..(2): Xaa can be Leu, Lys, Ile, Ala, Val, Phe, Arg, Thr, Asn, Gly, Met, Asp, His, Gln, Pro, Cys, Trp, Ser, Glu, or Tyr
  misc_feature (11)..(11): Xaa can be Phe, Met, Tyr, or Leu
TXNYPLWSQSX

SEQ ID NO: 60388 - protein, 9 aa, Artificial Sequence
  Description of Artificial Sequence: Synthetic peptide
  Seed: TQHFVQENY (MAGA3_HUMAN)
  misc_feature (2)..(2): Xaa can be Gln, Glu, Arg, Ser, Ala, Val, Leu, Ile, Thr, Met, Tyr, Asp, His, Trp, Gly, Asn, Lys, Phe, Pro, or Cys
  misc_feature (9)..(9): Xaa can be Tyr, Phe, Met, Leu, Trp, Lys, Ile, Val, Arg, His, Cys, or Ala
TXHFVQENX

SEQ ID NO: 60389 - protein, 10 aa, Artificial Sequence
  Description of Artificial Sequence: Synthetic peptide
  Seed: TQHFVQENYL (MAGA3_HUMAN)
  misc_feature (2)..(2): Xaa can be Gln, Met, Leu, Ile, Thr, or Val
  misc_feature (10)..(10): Xaa can be Val, Ile, Leu, Trp, Met, or Phe
TXHFVQENYX

SEQ ID NO: 60390 - protein, 9 aa, Artificial Sequence
  Description of Artificial Sequence: Synthetic peptide
  Seed: TSYVKVLHH (MAGA3_HUMAN)
  misc_feature (2)..(2): Xaa can be Ala, Thr, Ser, Val, Ile, Gly, Met, Gln, Leu, Phe, Cys, Asn, Pro, Asp, Tyr, Trp, Glu, His, Lys, or Arg
  misc_feature (9)..(9): Xaa can be Arg, Lys, Tyr, Phe, Met, Leu, Ile, Val, His, Trp, Cys, Ala, Gln, or Thr
TXYVKVLHX

SEQ ID NO: 60391 - protein, 10 aa, Artificial Sequence
  Description of Artificial Sequence: Synthetic peptide
  Seed: TSYVKVLHHM (MAGA3_HUMAN)
  misc_feature (2)..(2): Xaa can be Thr, Tyr, Val, Ser, Ala, Trp, Asp, Lys, Arg, Gly, Glu, Asn, Phe, His, Leu, Gln, Pro, Ile, Met, or Cys
  misc_feature (10)..(10): Xaa can be Ile, Trp, Leu, Met, Val, Phe, or Tyr
TXYVKVLHHX

SEQ ID NO: 60392 - protein, 8 aa, Artificial Sequence
  Description of Artificial Sequence: Synthetic peptide
  Seed: TTMNYPLW (MAGA3_HUMAN)
  misc_feature (2)..(2): Xaa can be Ser, Thr, Asn, Phe, Gln, Tyr, Pro, Trp, Leu, Cys, Ala, Gly, Val, Met, Asp, or Ile
  misc_feature (8)..(8): Xaa can be Trp, Phe, or Tyr
TXMNYPLX

SEQ ID NO: 60393 - protein, 10 aa, Artificial Sequence
  Description of Artificial Sequence: Synthetic peptide
  Seed: TTMNYPLWSQ (MAGA3_HUMAN)
  misc_feature (2)..(2): Xaa can be Thr, Ala, Val, Ser, Phe, Arg, Gln, His, Trp, Lys, Gly, Met, Ile, Glu, Tyr, Asp, Leu, Pro, Asn, or Cys
  misc_feature (10)..(10): Xaa can be Lys, Arg, Tyr, or Gln
TXMNYPLWSX

SEQ ID NO: 60394 - protein, 8 aa, Artificial Sequence
  Description of Artificial Sequence: Synthetic peptide
  Seed: VAELVHFL (MAGA3_HUMAN)
  misc_feature (2)..(2): Xaa can be Ser, Ala, Thr, Pro, Tyr, Gln, Phe, Gly, Arg, Glu, Trp, His, Asp, Val, Met, Cys, Ile, Asn, or Leu
  misc_feature (8)..(8): Xaa can be Leu, Ile, Met, Phe, Val, Tyr, or Lys
VXELVHFX

SEQ ID NO: 60395 - protein, 9 aa, Artificial Sequence
  Description of Artificial Sequence: Synthetic peptide
  Seed: VAELVHFLL (MAGA3_HUMAN)
  misc_feature (2)..(2): Xaa can be Ser, Ala, Thr, Tyr, Phe, Trp, Arg, Val, Gly, Ile, Gln, Cys, Met, Leu, Asn, Pro, His, Asp, or Glu
  misc_feature (9)..(9): Xaa can be Trp, Phe, Leu, Met, Ile, Val, Tyr, or Lys
VXELVHFLX

SEQ ID NO: 60396 - protein, 10 aa, Artificial Sequence
  Description of Artificial Sequence: Synthetic peptide
  Seed: VAELVHFLLL (MAGA3_HUMAN)
  misc_feature (2)..(2): Xaa can be Glu, Met, Tyr, Trp, Thr, Ile, Asp, His, Ala, Arg, Cys, Gln, Pro, Asn, Leu, Gly, Lys, Ser, Val, or Phe
  misc_feature (10)..(10): Xaa can be Ile, Leu, Phe, Val, Met, or Ala
VXELVHFLLX

SEQ ID NO: 60397 - protein, 11 aa, Artificial Sequence
  Description of Artificial Sequence: Synthetic peptide
  Seed: VAELVHFLLLK (MAGA3_HUMAN)
  misc_feature (2)..(2): Xaa can be Ile, Gln, His, Lys, Arg, Gly, Glu, Pro, Ser, Leu, Met, Ala, Asn, Cys, Tyr, Thr, Val, Asp, Trp, or Phe
  misc_feature (11)..(11): Xaa can be , or Lys
VXELVHFLLLX

SEQ ID NO: 60398 - protein, 8 aa, Artificial Sequence
  Description of Artificial Sequence: Synthetic peptide
  Seed: VDPIGHLY (MAGA3_HUMAN)
  misc_feature (2)..(2): Xaa can be Ser, Gln, Ala, Ile, Thr, Leu, Val, Glu, Gly, Phe, Met, Pro, Asn, His, Tyr, or Asp
  misc_feature (8)..(8): Xaa can be Tyr, Phe, Lys, Leu, or Met
VXPIGHLX

SEQ ID NO: 60399 - protein, 9 aa, Artificial Sequence
  Description of Artificial Sequence: Synthetic peptide
  Seed: VDPIGHLYI (MAGA3_HUMAN)
  misc_feature (2)..(2): Xaa can be Arg, Ala, Gln, Glu, Phe, Asn, Pro, Asp, Val, Tyr, Met, His, Ile, Ser, Thr, Gly, Leu, Lys, Trp, or Cys
  misc_feature (9)..(9): Xaa can be Met, Ile, Leu, Val, Phe, Cys, or Ala
VXPIGHLYX

SEQ ID NO: 60400 - protein, 10 aa, Artificial Sequence
  Description of Artificial Sequence: Synthetic peptide
  Seed: VDPIGHLYIF (MAGA3_HUMAN)
  misc_feature (2)..(2): Xaa can be Phe, Lys, Asp, Ser, Arg, Cys, His, Val, Met, Leu, Thr, Pro, Asn, Gln, Ala, Ile, Tyr, Trp, Gly, or Glu
  misc_feature (10)..(10): Xaa can be Ile, Leu, Phe, Val, Tyr, Trp, Ala, or Met
VXPIGHLYIX

SEQ ID NO: 60401 - protein, 8 aa, Artificial Sequence
  Description of Artificial Sequence: Synthetic peptide
  Seed: VETSYVKV (MAGA3_HUMAN)
  misc_feature (2)..(2): Xaa can be Glu, Asp, Gln, Ala, Gly, Ser, or Met
  misc_feature (8)..(8): Xaa can be Ile, Val, Leu, Met, Phe, Cys, or Ala
VXTSYVKX

SEQ ID NO: 60402 - protein, 9 aa, Artificial Sequence
  Description of Artificial Sequence: Synthetic peptide
  Seed: VETSYVKVL (MAGA3_HUMAN)
  misc_feature (2)..(2): Xaa can be Glu, Asp, Gln, Gly, Ser, Arg, His, Ala, Ile, Tyr, Asn, Leu, Val, Met, Thr, Phe, Pro, Trp, Lys, or Cys
  misc_feature (9)..(9): Xaa can be Leu, Met, Ile, Val, Phe, Tyr, Cys, Ala, Trp, Pro, Thr, Gly, His, Arg, or Ser
VXTSYVKVX

SEQ ID NO: 60403 - protein, 8 aa, Artificial Sequence
  Description of Artificial Sequence: Synthetic peptide
  Seed: VEVTLGEV (MAGA3_HUMAN)
  misc_feature (2)..(2): Xaa can be Glu, Asp, Gln, Gly, Ala, Ser, Met, Asn, Leu, or Thr
  misc_feature (8)..(8): Xaa can be Ile, Val, Leu, Met, Phe, Tyr, Ala, Trp, Pro, Cys, or Thr
VXVTLGEX

SEQ ID NO: 60404 - protein, 9 aa, Artificial Sequence
  Description of Artificial Sequence: Synthetic peptide
  Seed: VEVTLGEVP (MAGA3_HUMAN)
  misc_feature (2)..(2): Xaa can be Glu, Asp, or Gln
  misc_feature (9)..(9): Xaa can be Cys, Ile, Leu, Pro, Met, Val, Phe, Ala, Ser, Thr, Asn, Gly, Gln, Tyr, Glu, Arg, Asp, Lys, or Trp
VXVTLGEVX

SEQ ID NO: 60405 - protein, 10 aa, Artificial Sequence
  Description of Artificial Sequence: Synthetic peptide
  Seed: VEVTLGEVPA (MAGA3_HUMAN)
  misc_feature (2)..(2): Xaa can be , or Glu
  misc_feature (10)..(10): Xaa can be Leu, Phe, Gly, Pro, Cys, Ser, Val, Thr, Ala, Ile, or Met
VXVTLGEVPX

SEQ ID NO: 60406 - protein, 11 aa, Artificial Sequence
  Description of Artificial Sequence: Synthetic peptide
  Seed: VEVTLGEVPAA (MAGA3_HUMAN)
  misc_feature (2)..(2): Xaa can be Glu, Asp, or Gln
  misc_feature (11)..(11): Xaa can be Leu, Cys, Met, Ala, Thr, Ile, Pro, Ser, Trp, Tyr, Val, Phe, or Gly
VXVTLGEVPAX

SEQ ID NO: 60407 - protein, 9 aa, Artificial Sequence
  Description of Artificial Sequence: Synthetic peptide
  Seed: VFEGREDSI (MAGA3_HUMAN)
  misc_feature (2)..(2): Xaa can be Tyr, Phe, Arg, Gln, Ser, His, Ala, Trp, Val, Leu, Cys, Ile, Gly, Thr, Met, Glu, Pro, Asn, Asp, or Lys
  misc_feature (9)..(9): Xaa can be Leu, Met, Val, Ile, Phe, Tyr, Lys, Cys, Trp, or Arg
VXEGREDSX

SEQ ID NO: 60408 - protein, 10 aa, Artificial Sequence
  Description of Artificial Sequence: Synthetic peptide
  Seed: VFEGREDSIL (MAGA3_HUMAN)
  misc_feature (2)..(2): Xaa can be Tyr, Phe, or Trp
  misc_feature (10)..(10): Xaa can be Leu, Met, or Phe
VXEGREDSIX

SEQ ID NO: 60409 - protein, 9 aa, Artificial Sequence
  Description of Artificial Sequence: Synthetic peptide
  Seed: VFGIELMEV (MAGA3_HUMAN)
  misc_feature (2)..(2): Xaa can be Tyr, Phe, Trp, or Ala
  misc_feature (9)..(9): Xaa can be Leu, Met, Tyr, Phe, Val, Ile, His, or Trp
VXGIELMEX

SEQ ID NO: 60410 - protein, 8 aa, Artificial Sequence
  Description of Artificial Sequence: Synthetic peptide
  Seed: VHFLLLKY (MAGA3_HUMAN)
  misc_feature (2)..(2): Xaa can be Tyr, Arg, Gln, His, Glu, or Lys
  misc_feature (8)..(8): Xaa can be Tyr, Phe, Leu, or Met
VXFLLLKX

SEQ ID NO: 60411 - protein, 9 aa, Artificial Sequence
  Description of Artificial Sequence: Synthetic peptide
  Seed: VHFLLLKYR (MAGA3_HUMAN)
  misc_feature (2)..(2): Xaa can be Ser, Val, Thr, Asn, Leu, Phe, Trp, Met, Tyr, Ala, Ile, Gly, Gln, Glu, Pro, Cys, His, or As p
  misc_feature (9)..(9): Xaa can be Arg, or Lys
VXFLLLKYX

SEQ ID NO: 60412 - protein, 10 aa, Artificial Sequence
  Description of Artificial Sequence: Synthetic peptide
  Seed: VIFSKASSSL (MAGA3_HUMAN)
  misc_feature (2)..(2): Xaa can be Val, Ala, Leu, Met, Ile, Ser, Thr, Gln, Tyr, Phe, Gly, Trp, Asp, Arg, Asn, Pro, Lys, His, Cys, or Glu
  misc_feature (10)..(10): Xaa can be Met, Phe, Leu, Tyr, Ile, His, Val, Trp, Ala, Lys, Arg, or Thr
VXFSKASSSX

SEQ ID NO: 60413 - protein, 9 aa, Artificial Sequence
  Description of Artificial Sequence: Synthetic peptide
  Seed: VKISGGPHI (MAGA3_HUMAN)
  misc_feature (2)..(2): Xaa can be Gln, Met, Lys, Ala, His, Leu, Ile, Thr, Ser, Asn, Val, Gly, Glu, Phe, Pro, Asp, Arg, Tyr, Trp, or Cys
  misc_feature (9)..(9): Xaa can be Phe, Tyr, Val, Leu, Ile, Met, Trp, His, Cys, Ala, Ser, Gly, or Thr
VXISGGPHX

SEQ ID NO: 60414 - protein, 11 aa, Artificial Sequence
  Description of Artificial Sequence: Synthetic peptide
  Seed: VKISGGPHISY (MAGA3_HUMAN)
  misc_feature (2)..(2): Xaa can be Arg, Tyr, Gln, His, Ala, Met, Gly, Val, Leu, Phe, Pro, Glu, Lys, Ile, Asn, Thr, Ser, Trp, Cys, or Asp
  misc_feature (11)..(11): Xaa can be Tyr, Phe, Leu, Met, Trp, His, Lys, Ile, Arg, Val, Cys, Gln, or Ala
VXISGGPHISX

SEQ ID NO: 60415 - protein, 8 aa, Artificial Sequence
  Description of Artificial Sequence: Synthetic peptide
  Seed: VLEVFEGR (MAGA3_HUMAN)
  misc_feature (2)..(2): Xaa can be Ala, Val, Gln, Ser, Ile, Leu, Gly, Thr, Asn, or Met
  misc_feature (8)..(8): Xaa can be Lys, or Arg
VXEVFEGX

SEQ ID NO: 60416 - protein, 8 aa, Artificial Sequence
  Description of Artificial Sequence: Synthetic peptide
  Seed: VLHHMVKI (MAGA3_HUMAN)
  misc_feature (2)..(2): Xaa can be Gln, Glu, Gly, Met, Asp, Ser, Pro, Leu, Ala, Asn, His, Val, Thr, Ile, or Lys
  misc_feature (8)..(8): Xaa can be Val, Ile, Leu, Met, Phe, Cys, or Ala
VXHHMVKX

SEQ ID NO: 60417 - protein, 9 aa, Artificial Sequence
  Description of Artificial Sequence: Synthetic peptide
  Seed: VPAAESPDP (MAGA3_HUMAN)
  misc_feature (2)..(2): Xaa can be , or Pro
  misc_feature (9)..(9): Xaa can be Phe, Met, Pro, Ala, Leu, Ser, Thr, Ile, Val, or Cys
VXAAESPDX

SEQ ID NO: 60418 - protein, 10 aa, Artificial Sequence
  Description of Artificial Sequence: Synthetic peptide
  Seed: VPAAESPDPP (MAGA3_HUMAN)
  misc_feature (2)..(2): Xaa can be , or Pro
  misc_feature (10)..(10): Xaa can be Val, Ser, Cys, Ala, Pro, Leu, Met, Ile, Gly, Tyr, Phe, or Thr
VXAAESPDPX

SEQ ID NO: 60419 - protein, 11 aa, Artificial Sequence
  Description of Artificial Sequence: Synthetic peptide
  Seed: VPAAESPDPPQ (MAGA3_HUMAN)
  misc_feature (2)..(2): Xaa can be , or Pro
  misc_feature (11)..(11): Xaa can be Arg, Leu, Cys, Thr, Val, Gln, Gly, Pro, Trp, His, Ile, Lys, Ser, Phe, Ala, Tyr, or Met
VXAAESPDPPX

SEQ ID NO: 60420 - protein, 9 aa, Artificial Sequence
  Description of Artificial Sequence: Synthetic peptide
  Seed: VPGSDPACY (MAGA3_HUMAN)
  misc_feature (2)..(2): Xaa can be Pro, Ala, Val, Leu, Ser, Gln, Met, His, Ile, Tyr, Phe, Arg, Glu, Gly, Thr, Lys, Cys, Trp, or Asn
  misc_feature (9)..(9): Xaa can be Tyr, Phe, Met, Leu, Trp, Val, His, or Ile
VXGSDPACX

SEQ ID NO: 60421 - protein, 11 aa, Artificial Sequence
  Description of Artificial Sequence: Synthetic peptide
  Seed: VPGSDPACYEF (MAGA3_HUMAN)
  misc_feature (2)..(2): Xaa can be Pro, Ala, Val, Met, Gln, Glu, Leu, or Ile
  misc_feature (11)..(11): Xaa can be Tyr, Phe, Trp, Thr, Cys, Met, Ala, Val, Ile, Pro, or Leu
VXGSDPACYEX

SEQ ID NO: 60422 - protein, 8 aa, Artificial Sequence
  Description of Artificial Sequence: Synthetic peptide
  Seed: VQENYLEY (MAGA3_HUMAN)
  misc_feature (2)..(2): Xaa can be Ala, Thr, Ser, Gln, Ile, Leu, Val, Met, Asn, Gly, Asp, Trp, Phe, Pro, Cys, or Tyr
  misc_feature (8)..(8): Xaa can be Tyr, Lys, Arg, Phe, Met, Leu, or His
VXENYLEX

SEQ ID NO: 60423 - protein, 9 aa, Artificial Sequence
  Description of Artificial Sequence: Synthetic peptide
  Seed: VQENYLEYR (MAGA3_HUMAN)
  misc_feature (2)..(2): Xaa can be Thr, Leu, Met, Ser, Val, Ile, Ala, Asn, Tyr, Asp, Phe, Glu, Gly, Trp, Gln, Pro, Cys, or Hi s
  misc_feature (9)..(9): Xaa can be Tyr, Arg, Lys, Phe, His, Met, Leu, Val, or Trp
VXENYLEYX

SEQ ID NO: 60424 - protein, 9 aa, Artificial Sequence
  Description of Artificial Sequence: Synthetic peptide
  Seed: VTKAEMLGS (MAGA3_HUMAN)
  misc_feature (2)..(2): Xaa can be Thr, Ser, Val, Tyr, Ala, Gly, Phe, Met, Leu, Trp, Gln, or Ile
  misc_feature (9)..(9): Xaa can be Lys, Ala, Ile, Val, Leu, Met, or Ser
VXKAEMLGX

SEQ ID NO: 60425 - protein, 10 aa, Artificial Sequence
  Description of Artificial Sequence: Synthetic peptide
  Seed: VTKAEMLGSV (MAGA3_HUMAN)
  misc_feature (2)..(2): Xaa can be Met, Leu, Gln, Val, Thr, Ile, Ser, Ala, Phe, or Tyr
  misc_feature (10)..(10): Xaa can be Lys, Val, Ala, Ile, Leu, Met, Ser, Cys, or Thr
VXKAEMLGSX

SEQ ID NO: 60426 - protein, 9 aa, Artificial Sequence
  Description of Artificial Sequence: Synthetic peptide
  Seed: VTLGEVPAA (MAGA3_HUMAN)
  misc_feature (2)..(2): Xaa can be Ala, Leu, Met, Ser, Val, Gln, Ile, Gly, Thr, Asn, Phe, Cys, Glu, Tyr, Pro, Asp, Lys, or Tr p
  misc_feature (9)..(9): Xaa can be Tyr, Val, Phe, Leu, Met, Ile, Lys, His, Ala, Thr, Arg, Cys, Ser, Trp, Pro, Gly, or Gln
VXLGEVPAX

SEQ ID NO: 60427 - protein, 9 aa, Artificial Sequence
  Description of Artificial Sequence: Synthetic peptide
  Seed: VVGNWQYFF (MAGA3_HUMAN)
  misc_feature (2)..(2): Xaa can be Tyr, Phe, Met, Ala, Gln, Leu, Trp, Ser, Val, Thr, Ile, His, Gly, Asn, Cys, Glu, Arg, Asp, Pro, or Lys
  misc_feature (9)..(9): Xaa can be Tyr, Trp, Phe, Ile, Leu, Met, Val, His, Gly, Cys, or Ala
VXGNWQYFX

SEQ ID NO: 60428 - protein, 11 aa, Artificial Sequence
  Description of Artificial Sequence: Synthetic peptide
  Seed: VVGNWQYFFPV (MAGA3_HUMAN)
  misc_feature (2)..(2): Xaa can be Leu, Met, Gln, Ile, Val, Thr, or Ala
  misc_feature (11)..(11): Xaa can be Val, Ile, Leu, Ala, Thr, or Met
VXGNWQYFFPX

SEQ ID NO: 60429 - protein, 9 aa, Artificial Sequence
  Description of Artificial Sequence: Synthetic peptide
  Seed: WEELSVLEV (MAGA3_HUMAN)
  misc_feature (2)..(2): Xaa can be Glu, Gln, or Asp
  misc_feature (9)..(9): Xaa can be Met, Leu, Ile, Val, Ala, Phe, Ser, Pro, Trp, Tyr, Thr, Cys, or Gly
WXELSVLEX

SEQ ID NO: 60430 - protein, 10 aa, Artificial Sequence
  Description of Artificial Sequence: Synthetic peptide
  Seed: WEELSVLEVF (MAGA3_HUMAN)
  misc_feature (2)..(2): Xaa can be Glu, Pro, Gly, Asn, His, Cys, Trp, Ile, Asp, Met, Arg, Leu, Lys, Gln, Val, Thr, Phe, Ala, Tyr, or Ser
  misc_feature (10)..(10): Xaa can be Tyr, Trp, Phe, Ile, Met, Ala, Val, Leu, Cys, Thr, Ser, Gly, or Pro
WXELSVLEVX

SEQ ID NO: 60431 - protein, 8 aa, Artificial Sequence
  Description of Artificial Sequence: Synthetic peptide
  Seed: WQYFFPVI (MAGA3_HUMAN)
  misc_feature (2)..(2): Xaa can be Gln, Glu, Met, Ser, Ala, Gly, Asn, His, Lys, Pro, Arg, Leu, Asp, Thr, Val, or Ile
  misc_feature (8)..(8): Xaa can be Tyr, Phe, Leu, Ile, Met, Val, Trp, His, or Ala
WXYFFPVX

SEQ ID NO: 60432 - protein, 9 aa, Artificial Sequence
  Description of Artificial Sequence: Synthetic peptide
  Seed: WQYFFPVIF (MAGA3_HUMAN)
  misc_feature (2)..(2): Xaa can be Glu, Gln, Arg, Met, Lys, Ser, Ala, Val, His, Ile, Leu, Asp, Thr, Gly, Asn, Pro, Phe, Tyr, Cys, or Trp
  misc_feature (9)..(9): Xaa can be Phe, Tyr, Met, Leu, Ile, Val, Trp, His, Ala, Gly, Asn, Thr, Cys, Ser, Arg, Lys, Pro, Glu, or Gln
WXYFFPVIX

SEQ ID NO: 60433 - protein, 10 aa, Artificial Sequence
  Description of Artificial Sequence: Synthetic peptide
  Seed: WQYFFPVIFS (MAGA3_HUMAN)
  misc_feature (2)..(2): Xaa can be Gln, Lys, Met, Glu, Ala, Arg, His, Ser, Asn, Thr, or Leu
  misc_feature (10)..(10): Xaa can be Tyr, Phe, Met, His, Leu, Asp, Ser, Ala, Cys, Val, Trp, Glu, Asn, Lys, Thr, Ile, Arg, Pro, Gly, or Gln
WXYFFPVIFX

SEQ ID NO: 60434 - protein, 11 aa, Artificial Sequence
  Description of Artificial Sequence: Synthetic peptide
  Seed: WQYFFPVIFSK (MAGA3_HUMAN)
  misc_feature (2)..(2): Xaa can be Trp, Glu, His, Arg, Lys, Cys, Pro, Val, Ala, Asp, Thr, Asn, Ser, Tyr, Ile, Gln, Leu, Gly, Met, or Phe
  misc_feature (11)..(11): Xaa can be Lys, or Arg
WXYFFPVIFSX

SEQ ID NO: 60435 - protein, 9 aa, Artificial Sequence
  Description of Artificial Sequence: Synthetic peptide
  Seed: YEDSSNQEE (MAGA3_HUMAN)
  misc_feature (2)..(2): Xaa can be Glu, Asp, or Gln
  misc_feature (9)..(9): Xaa can be Leu, Ala, Ile, Val, Met, Cys, Pro, Thr, Phe, Arg, Glu, Asp, Gln, Asn, Trp, Gly, Ser, Tyr, or Lys
YXDSSNQEX

SEQ ID NO: 60436 - protein, 10 aa, Artificial Sequence
  Description of Artificial Sequence: Synthetic peptide
  Seed: YEDSSNQEEE (MAGA3_HUMAN)
  misc_feature (2)..(2): Xaa can be Glu, Gln, or Asp
  misc_feature (10)..(10): Xaa can be Ile, Leu, Met, Ala, Val, Cys, Glu, Arg, Lys, Gly, Trp, Gln, Pro, Ser, Thr, Phe, or Tyr
YXDSSNQEEX

SEQ ID NO: 60437 - protein, 11 aa, Artificial Sequence
  Description of Artificial Sequence: Synthetic peptide
  Seed: YEDSSNQEEEG (MAGA3_HUMAN)
  misc_feature (2)..(2): Xaa can be Glu, Gln, or Asp
  misc_feature (11)..(11): Xaa can be Leu, Cys, Phe, Val, Tyr, Gly, Ser, Thr, Met, Ile, Ala, Trp, or Pro
YXDSSNQEEEX

SEQ ID NO: 60438 - protein, 11 aa, Artificial Sequence
  Description of Artificial Sequence: Synthetic peptide
  Seed: YEFLWGPRALV (MAGA3_HUMAN)
  misc_feature (2)..(2): Xaa can be Leu, Met, Glu, Gln, Thr, Arg, Tyr, Lys, Cys, Phe, His, Pro, Asp, Trp, Ala, Gly, Ile, Val, Asn, or Ser
  misc_feature (11)..(11): Xaa can be Ala, Met, Thr, Ile, Leu, Val, Phe, Tyr, Asp, Trp, Lys, Ser, His, Cys, Glu, Pro, Gln, Gly, Arg, or Asn
YXFLWGPRALX

SEQ ID NO: 60439 - protein, 9 aa, Artificial Sequence
  Description of Artificial Sequence: Synthetic peptide
  Seed: YFFPVIFSK (MAGA3_HUMAN)
  misc_feature (2)..(2): Xaa can be Met, Leu, Thr, Val, Gln, Ile, Ser, Phe, Ala, Trp, Tyr, Asn, Gly, Cys, Glu, Pro, His, Arg, Asp, or Lys
  misc_feature (9)..(9): Xaa can be Lys, Tyr, Arg, Phe, Leu, Val, Met, Trp, His, Ile, Ala, Gln, Thr, Glu, Asn, Ser, Cys, Gly, or Pro
YXFPVIFSX

SEQ ID NO: 60440 - protein, 10 aa, Artificial Sequence
  Description of Artificial Sequence: Synthetic peptide
  Seed: YFFPVIFSKA (MAGA3_HUMAN)
  misc_feature (2)..(2): Xaa can be Trp, Met, Tyr, Phe, Leu, Thr, Ile, Gln, Val, Ala, Ser, Cys, Gly, Lys, Asn, Glu, His, Arg, Asp, or Pro
  misc_feature (10)..(10): Xaa can be Arg, Lys, Val, Ile, Leu, Ala, Met, Thr, Cys, Ser, Gly, His, Tyr, Glu, Pro, Phe, Trp, Gln, Asp, or Asn
YXFPVIFSKX

SEQ ID NO: 60441 - protein, 9 aa, Artificial Sequence
  Description of Artificial Sequence: Synthetic peptide
  Seed: YIFATCLGL (MAGA3_HUMAN)
  misc_feature (2)..(2): Xaa can be Met, Gln, Leu, Val, Ile, Ala, Thr, Ser, Tyr, Gly, Phe, Lys, Glu, Arg, Asn, His, Pro, Cys, Asp, or Trp
  misc_feature (9)..(9): Xaa can be Met, Val, Tyr, Leu, Phe, Ile, Trp, Arg, Lys, His, Ala, Thr, Cys, Ser, Gly, Pro, Glu, Asn, Asp, or Gln
YXFATCLGX

SEQ ID NO: 60442 - protein, 10 aa, Artificial Sequence
  Description of Artificial Sequence: Synthetic peptide
  Seed: YIFATCLGLS (MAGA3_HUMAN)
  misc_feature (2)..(2): Xaa can be Thr, Gln, Met, Val, Leu, Ile, Ser, Ala, Phe, Gly, Cys, or Asn
  misc_feature (10)..(10): Xaa can be Val, Leu, Met, Ala, Thr, Ile, Cys, Asp, Gln, Tyr, Gly, Phe, Lys, Asn, Ser, Pro, Trp, Arg, His, or Glu
YXFATCLGLX

SEQ ID NO: 60443 - protein, 11 aa, Artificial Sequence
  Description of Artificial Sequence: Synthetic peptide
  Seed: YIFATCLGLSY (MAGA3_HUMAN)
  misc_feature (2)..(2): Xaa can be Gln, Ala, Pro, Met, Ser, Lys, Thr, His, Val, Gly, Ile, Leu, Glu, Arg, Asn, Trp, Cys, Tyr, Phe, or Asp
  misc_feature (11)..(11): Xaa can be Tyr, Phe, Trp, Met, Leu, His, Ile, Val, Ala, Lys, Thr, Gly, or Ser
YXFATCLGLSX

SEQ ID NO: 60444 - protein, 10 aa, Artificial Sequence
  Description of Artificial Sequence: Synthetic peptide
  Seed: YLEYRQVPGS (MAGA3_HUMAN)
  misc_feature (2)..(2): Xaa can be Leu, Met, Ile, Val, Gln, Ser, Ala, or Thr
  misc_feature (10)..(10): Xaa can be Val, Ala, Leu, Ile, Met, Cys, Thr, or Ser
YXEYRQVPGX

SEQ ID NO: 60445 - protein, 8 aa, Artificial Sequence
  Description of Artificial Sequence: Synthetic peptide
  Seed: YPLWSQSY (MAGA3_HUMAN)
  misc_feature (2)..(2): Xaa can be Tyr, Phe, Trp, Pro, Val, His, Ser, Ala, Gln, Met, Arg, Ile, Thr, Asn, Leu, Glu, Asp, or Gl y
  misc_feature (8)..(8): Xaa can be Tyr, Met, Phe, Leu, Val, Ile, Trp, Ala, or His
YXLWSQSX

SEQ ID NO: 60446 - protein, 9 aa, Artificial Sequence
  Description of Artificial Sequence: Synthetic peptide
  Seed: YPLWSQSYE (MAGA3_HUMAN)
  misc_feature (2)..(2): Xaa can be Pro, Ala, Leu, Met, Thr, Gln, Phe, Ser, Val, Ile, Gly, Tyr, or Cys
  misc_feature (9)..(9): Xaa can be Tyr, Phe, Met, Trp, Ala, His, Leu, Thr, Gln, Gly, Cys, Asn, Glu, Val, Ile, or Ser
YXLWSQSYX

SEQ ID NO: 60447 - protein, 8 aa, Artificial Sequence
  Description of Artificial Sequence: Synthetic peptide
  Seed: YPPLHEWV (MAGA3_HUMAN)
  misc_feature (2)..(2): Xaa can be , or Pro
  misc_feature (8)..(8): Xaa can be Ile, Leu, or Val
YXPLHEWX

SEQ ID NO: 60448 - protein, 9 aa, Artificial Sequence
  Description of Artificial Sequence: Synthetic peptide
  Seed: YPPLHEWVL (MAGA3_HUMAN)
  misc_feature (2)..(2): Xaa can be Arg, Pro, Ala, His, Ser, Gly, Gln, Val, Thr, Glu, Phe, Asn, Ile, Lys, Tyr, Asp, Cys, Met, Leu, or Trp
  misc_feature (9)..(9): Xaa can be Met, Phe, Val, Leu, Ile, Tyr, Trp, Lys, Ala, Cys, His, Thr, Arg, Pro, Ser, or Gly
YXPLHEWVX

SEQ ID NO: 60449 - protein, 10 aa, Artificial Sequence
  Description of Artificial Sequence: Synthetic peptide
  Seed: YPPLHEWVLR (MAGA3_HUMAN)
  misc_feature (2)..(2): Xaa can be His, Leu, Pro, Tyr, Val, Met, Phe, Gly, Gln, Ser, Thr, Trp, Asn, Ala, or Ile
  misc_feature (10)..(10): Xaa can be , or Arg
YXPLHEWVLX

SEQ ID NO: 60450 - protein, 9 aa, Artificial Sequence
  Description of Artificial Sequence: Synthetic peptide
  Seed: YRQVPGSDP (MAGA3_HUMAN)
  misc_feature (2)..(2): Xaa can be , or Arg
  misc_feature (9)..(9): Xaa can be Val, Leu, Pro, Ile, Cys, or Ala
YXQVPGSDX

SEQ ID NO: 60451 - protein, 10 aa, Artificial Sequence
  Description of Artificial Sequence: Synthetic peptide
  Seed: YRQVPGSDPA (MAGA3_HUMAN)
  misc_feature (2)..(2): Xaa can be Thr, Val, His, Leu, Met, Ile, Pro, Gln, Phe, Trp, Lys, Tyr, Cys, Asn, Ala, Ser, Asp, Arg, Glu, or Gly
  misc_feature (10)..(10): Xaa can be Met, Leu, Ile, Ala, Val, Phe, or Cys
YXQVPGSDPX

SEQ ID NO: 60452 - protein, 11 aa, Artificial Sequence
  Description of Artificial Sequence: Synthetic peptide
  Seed: YRQVPGSDPAC (MAGA3_HUMAN)
  misc_feature (2)..(2): Xaa can be Arg, His, Gln, Ala, Tyr, Gly, Met, Trp, Ser, Phe, Val, Ile, Thr, Leu, Asn, Pro, Lys, or Gl u
  misc_feature (11)..(11): Xaa can be Leu, Met, Phe, Ile, Ala, Gly, Pro, Thr, Val, Cys, Ser, Trp, or Tyr
YXQVPGSDPAX

SEQ ID NO: 60453 - protein, 8 aa, Artificial Sequence
  Description of Artificial Sequence: Synthetic peptide
  Seed: YVKVLHHM (MAGA3_HUMAN)
  misc_feature (2)..(2): Xaa can be Ala, Ser, Thr, Met, Leu, Pro, Ile, Gly, Val, Tyr, Cys, Phe, Asn, Gln, Trp, Asp, or Glu
  misc_feature (8)..(8): Xaa can be Tyr, Phe, Leu, Met, Val, Ile, Trp, His, or Ala
YXKVLHHX

SEQ ID NO: 60454 - protein, 9 aa, Artificial Sequence
  Description of Artificial Sequence: Synthetic peptide
  Seed: YVKVLHHMV (MAGA3_HUMAN)
  misc_feature (2)..(2): Xaa can be Met, Ala, Leu, Pro, Ser, Thr, Ile, Val, Gln, Gly, Asn, Phe, Cys, Tyr, Trp, Lys, Glu, Arg, Asp, or His
  misc_feature (9)..(9): Xaa can be Leu, Met, Tyr, Phe, Ile, Val, Ala, His, Cys, Trp, Thr, or Gly
YXKVLHHMX

SEQ ID NO: 60455 - protein, 10 aa, Artificial Sequence
  Description of Artificial Sequence: Synthetic peptide
  Seed: YVKVLHHMVK (MAGA3_HUMAN)
  misc_feature (2)..(2): Xaa can be Thr, Ser, Met, Trp, Ile, Phe, Val, Ala, Tyr, Gln, Gly, Leu, or Asn
  misc_feature (10)..(10): Xaa can be Lys, Arg, Ala, Val, or Ile
YXKVLHHMVX

SEQ ID NO: 60456 - protein, 9 aa, Artificial Sequence
  Description of Artificial Sequence: Synthetic peptide
  Seed: AESLFREAL (MAGA4_HUMAN)
AESLFREAF

SEQ ID NO: 60457 - protein, 9 aa, Artificial Sequence
  Description of Artificial Sequence: Synthetic peptide
  Seed: EVDPASNTY (MAGA4_HUMAN)
ETDPASNTY

SEQ ID NO: 60458 - protein, 9 aa, Artificial Sequence
  Description of Artificial Sequence: Synthetic peptide
  Seed: EIWEELGVM (MAGA4_HUMAN)
ETWEELGVY

SEQ ID NO: 60459 - protein, 9 aa, Artificial Sequence
  Description of Artificial Sequence: Synthetic peptide
  Seed: IFPKTGLLI (MAGA4_HUMAN)
IWPKTGLLF

SEQ ID NO: 60460 - protein, 9 aa, Artificial Sequence
  Description of Artificial Sequence: Synthetic peptide
  Seed: IFPKTGLLI (MAGA4_HUMAN)
IYPKTGLLF

SEQ ID NO: 60461 - protein, 9 aa, Artificial Sequence
  Description of Artificial Sequence: Synthetic peptide
  Seed: KVDELAHFL (MAGA4_HUMAN)
KADELAHFL

SEQ ID NO: 60462 - protein, 9 aa, Artificial Sequence
  Description of Artificial Sequence: Synthetic peptide
  Seed: KVLEHVVRV (MAGA4_HUMAN)
KMLEHVVRL

SEQ ID NO: 60463 - protein, 9 aa, Artificial Sequence
  Description of Artificial Sequence: Synthetic peptide
  Seed: KVLEHVVRV (MAGA4_HUMAN)
KMLEHVVRM

SEQ ID NO: 60464 - protein, 9 aa, Artificial Sequence
  Description of Artificial Sequence: Synthetic peptide
  Seed: KVLEHVVRV (MAGA4_HUMAN)
KTLEHVVRL

SEQ ID NO: 60465 - protein, 10 aa, Artificial Sequence
  Description of Artificial Sequence: Synthetic peptide
  Seed: MIFGIDVKEV (MAGA4_HUMAN)
MTFGIDVKEV

SEQ ID NO: 60466 - protein, 10 aa, Artificial Sequence
  Description of Artificial Sequence: Synthetic peptide
  Seed: MIFGIDVKEV (MAGA4_HUMAN)
MVFGIDVKEV

SEQ ID NO: 60467 - protein, 10 aa, Artificial Sequence
  Description of Artificial Sequence: Synthetic peptide
  Seed: RVNARVRIAY (MAGA4_HUMAN)
RMNARVRIAY

SEQ ID NO: 60468 - protein, 10 aa, Artificial Sequence
  Description of Artificial Sequence: Synthetic peptide
  Seed: RVRIAYPSLR (MAGA4_HUMAN)
RTRIAYPSLK

SEQ ID NO: 60469 - protein, 9 aa, Artificial Sequence
  Description of Artificial Sequence: Synthetic peptide
  Seed: RVRIAYPSL (MAGA4_HUMAN)
RYRIAYPSY

SEQ ID NO: 60470 - protein, 9 aa, Artificial Sequence
  Description of Artificial Sequence: Synthetic peptide
  Seed: SALPTTISF (MAGA4_HUMAN)
SALPTTISW

SEQ ID NO: 60471 - protein, 9 aa, Artificial Sequence
  Description of Artificial Sequence: Synthetic peptide
  Seed: SSPLVPGTL (MAGA4_HUMAN)
SAPLVPGTL

SEQ ID NO: 60472 - protein, 9 aa, Artificial Sequence
  Description of Artificial Sequence: Synthetic peptide
  Seed: SSPLVPGTL (MAGA4_HUMAN)
SAPLVPGTM

SEQ ID NO: 60473 - protein, 9 aa, Artificial Sequence
  Description of Artificial Sequence: Synthetic peptide
  Seed: SALPTTISF (MAGA4_HUMAN)
SRLPTTISL

SEQ ID NO: 60474 - protein, 9 aa, Artificial Sequence
  Description of Artificial Sequence: Synthetic peptide
  Seed: SALPTTISF (MAGA4_HUMAN)
SSLPTTISF

SEQ ID NO: 60475 - protein, 10 aa, Artificial Sequence
  Description of Artificial Sequence: Synthetic peptide
  Seed: SLFREALSNK (MAGA4_HUMAN)
SVFREALSNK

SEQ ID NO: 60476 - protein, 9 aa, Artificial Sequence
  Description of Artificial Sequence: Synthetic peptide
  Seed: SYVKVLEHV (MAGA4_HUMAN)
SYVKVLEHF

SEQ ID NO: 60477 - protein, 9 aa, Artificial Sequence
  Description of Artificial Sequence: Synthetic peptide
  Seed: TTISFTCWR (MAGA4_HUMAN)
TMISFTCWR

SEQ ID NO: 60478 - protein, 9 aa, Artificial Sequence
  Description of Artificial Sequence: Synthetic peptide
  Seed: TTISFTCWR (MAGA4_HUMAN)
TVISFTCWR

SEQ ID NO: 60479 - protein, 9 aa, Artificial Sequence
  Description of Artificial Sequence: Synthetic peptide
  Seed: VYDGREHTV (MAGA4_HUMAN)
VADGREHTL

SEQ ID NO: 60480 - protein, 9 aa, Artificial Sequence
  Description of Artificial Sequence: Synthetic peptide
  Seed: VYDGREHTV (MAGA4_HUMAN)
VFDGREHTL

SEQ ID NO: 60481 - protein, 9 aa, Artificial Sequence
  Description of Artificial Sequence: Synthetic peptide
  Seed: VYDGREHTV (MAGA4_HUMAN)
VFDGREHTM

SEQ ID NO: 60482 - protein, 9 aa, Artificial Sequence
  Description of Artificial Sequence: Synthetic peptide
  Seed: VNARVRIAY (MAGA4_HUMAN)
VMARVRIAY

SEQ ID NO: 60483 - protein, 9 aa, Artificial Sequence
  Description of Artificial Sequence: Synthetic peptide
  Seed: VYDGREHTV (MAGA4_HUMAN)
VYDGREHTF

SEQ ID NO: 60484 - protein, 9 aa, Artificial Sequence
  Description of Artificial Sequence: Synthetic peptide
  Seed: VYDGREHTV (MAGA4_HUMAN)
VYDGREHTL

SEQ ID NO: 60485 - protein, 9 aa, Artificial Sequence
  Description of Artificial Sequence: Synthetic peptide
  Seed: WVQENYLEY (MAGA4_HUMAN)
WMQENYLEY

SEQ ID NO: 60486 - protein, 9 aa, Artificial Sequence
  Description of Artificial Sequence: Synthetic peptide
  Seed: WVQENYLEY (MAGA4_HUMAN)
WSQENYLEY

SEQ ID NO: 60487 - protein, 9 aa, Artificial Sequence
  Description of Artificial Sequence: Synthetic peptide
  Seed: WVQENYLEY (MAGA4_HUMAN)
WTQENYLEY

SEQ ID NO: 60488 - protein, 9 aa, Homo sapiens
  Native (MAGA4_HUMAN)
AAVSSSSPL

SEQ ID NO: 60489 - protein, 11 aa, Homo sapiens
  Native (MAGA4_HUMAN)
AEMLERVIKNY

SEQ ID NO: 60490 - protein, 9 aa, Homo sapiens
  Native (MAGA4_HUMAN)
AESLFREAL

SEQ ID NO: 60491 - protein, 9 aa, Homo sapiens
  Native (MAGA4_HUMAN)
EELGVMGVY

SEQ ID NO: 60492 - protein, 9 aa, Homo sapiens
  Native (MAGA4_HUMAN)
EEVPAAESA

SEQ ID NO: 60493 - protein, 9 aa, Homo sapiens
  Native (MAGA4_HUMAN)
ELAHFLLRK

SEQ ID NO: 60494 - protein, 11 aa, Homo sapiens
  Native (MAGA4_HUMAN)
FLLRKYRAKEL

SEQ ID NO: 60495 - protein, 9 aa, Homo sapiens
  Native (MAGA4_HUMAN)
FPKTGLLII

SEQ ID NO: 60496 - protein, 9 aa, Homo sapiens
  Native (MAGA4_HUMAN)
GSNPARYEF

SEQ ID NO: 60497 - protein, 9 aa, Homo sapiens
  Native (MAGA4_HUMAN)
HVVRVNARV

SEQ ID NO: 60498 - protein, 9 aa, Homo sapiens
  Native (MAGA4_HUMAN)
IAYPSLREA

SEQ ID NO: 60499 - protein, 9 aa, Homo sapiens
  Native (MAGA4_HUMAN)
IFPKTGLLI

SEQ ID NO: 60500 - protein, 10 aa, Homo sapiens
  Native (MAGA4_HUMAN)
KASESLKMIF

SEQ ID NO: 60501 - protein, 10 aa, Homo sapiens
  Native (MAGA4_HUMAN)
KEVDPASNTY

SEQ ID NO: 60502 - protein, 9 aa, Homo sapiens
  Native (MAGA4_HUMAN)
KVDELAHFL

SEQ ID NO: 60503 - protein, 9 aa, Homo sapiens
  Native (MAGA4_HUMAN)
KVLEHVVRV

SEQ ID NO: 60504 - protein, 10 aa, Homo sapiens
  Native (MAGA4_HUMAN)
KYRAKELVTK

SEQ ID NO: 60505 - protein, 10 aa, Homo sapiens
  Native (MAGA4_HUMAN)
LLGNNQIFPK

SEQ ID NO: 60506 - protein, 10 aa, Homo sapiens
  Native (MAGA4_HUMAN)
LTQDWVQENY

SEQ ID NO: 60507 - protein, 9 aa, Homo sapiens
  Native (MAGA4_HUMAN)
LVPGTLEEV

SEQ ID NO: 60508 - protein, 10 aa, Homo sapiens
  Native (MAGA4_HUMAN)
MIFGIDVKEV

SEQ ID NO: 60509 - protein, 9 aa, Homo sapiens
  Native (MAGA4_HUMAN)
NPARYEFLW

SEQ ID NO: 60510 - protein, 11 aa, Homo sapiens
  Native (MAGA4_HUMAN)
RQVPGSNPARY

SEQ ID NO: 60511 - protein, 10 aa, Homo sapiens
  Native (MAGA4_HUMAN)
RVNARVRIAY

SEQ ID NO: 60512 - protein, 9 aa, Homo sapiens
  Native (MAGA4_HUMAN)
RVRIAYPSL

SEQ ID NO: 60513 - protein, 10 aa, Homo sapiens
  Native (MAGA4_HUMAN)
RVRIAYPSLR

SEQ ID NO: 60514 - protein, 9 aa, Homo sapiens
  Native (MAGA4_HUMAN)
SALPTTISF

SEQ ID NO: 60515 - protein, 9 aa, Homo sapiens
  Native (MAGA4_HUMAN)
SEEEIWEEL

SEQ ID NO: 60516 - protein, 10 aa, Homo sapiens
  Native (MAGA4_HUMAN)
SLFREALSNK

SEQ ID NO: 60517 - protein, 9 aa, Homo sapiens
  Native (MAGA4_HUMAN)
SSPLVPGTL

SEQ ID NO: 60518 - protein, 9 aa, Homo sapiens
  Native (MAGA4_HUMAN)
STSPDAESL

SEQ ID NO: 60519 - protein, 9 aa, Homo sapiens
  Native (MAGA4_HUMAN)
SYVKVLEHV

SEQ ID NO: 60520 - protein, 10 aa, Homo sapiens
  Native (MAGA4_HUMAN)
TLVTCLGLSY

SEQ ID NO: 60521 - protein, 9 aa, Homo sapiens
  Native (MAGA4_HUMAN)
TTISFTCWR

SEQ ID NO: 60522 - protein, 9 aa, Homo sapiens
  Native (MAGA4_HUMAN)
VTKAEMLER

SEQ ID NO: 60523 - protein, 9 aa, Homo sapiens
  Native (MAGA4_HUMAN)
VYDGREHTV

SEQ ID NO: 60524 - protein, 8 aa, Homo sapiens
  Native (MAGA4_HUMAN)
VYGEPRKL

SEQ ID NO: 60525 - protein, 9 aa, Homo sapiens
  Native (MAGA4_HUMAN)
VYGEPRKLL

SEQ ID NO: 60526 - protein, 9 aa, Homo sapiens
  Native (MAGA4_HUMAN)
WVQENYLEY

SEQ ID NO: 60527 - protein, 9 aa, Homo sapiens
  Native (MAGA4_HUMAN)
YPSLREAAL

SEQ ID NO: 60528 - protein, 11 aa, Artificial Sequence
  Description of Artificial Sequence: Synthetic peptide
  Seed: VPAAESAGPPQ (MAGA4_HUMAN)
VPAAESAGPPL

SEQ ID NO: 60529 - protein, 9 aa, Artificial Sequence
  Description of Artificial Sequence: Synthetic peptide
  Seed: RAKELVTKA (MAGA4_HUMAN)
RMKELVTKY

SEQ ID NO: 60530 - protein, 10 aa, Artificial Sequence
  Description of Artificial Sequence: Synthetic peptide
  Seed: MIFGIDVKEV (MAGA4_HUMAN)
MAFGIDVKEI

SEQ ID NO: 60531 - protein, 9 aa, Artificial Sequence
  Description of Artificial Sequence: Synthetic peptide
  Seed: LLIIVLGTI (MAGA4_HUMAN)
LLIIVLGTL

SEQ ID NO: 60532 - protein, 10 aa, Artificial Sequence
  Description of Artificial Sequence: Synthetic peptide
  Seed: KEVDPASNTY (MAGA4_HUMAN)
KSVDPASNTF

SEQ ID NO: 60533 - protein, 9 aa, Artificial Sequence
  Description of Artificial Sequence: Synthetic peptide
  Seed: TQDWVQENY (MAGA4_HUMAN)
TTDWVQENM

SEQ ID NO: 60534 - protein, 9 aa, Artificial Sequence
  Description of Artificial Sequence: Synthetic peptide
  Seed: GTLEEVPAA (MAGA4_HUMAN)
GTLEEVPAV

SEQ ID NO: 60535 - protein, 9 aa, Artificial Sequence
  Description of Artificial Sequence: Synthetic peptide
  Seed: KYRAKELVT (MAGA4_HUMAN)
KTRAKELVL

SEQ ID NO: 60536 - protein, 10 aa, Artificial Sequence
  Description of Artificial Sequence: Synthetic peptide
  Seed: SESLKMIFGI (MAGA4_HUMAN)
SLSLKMIFGW

SEQ ID NO: 60537 - protein, 10 aa, Artificial Sequence
  Description of Artificial Sequence: Synthetic peptide
  Seed: EHVVRVNARV (MAGA4_HUMAN)
ETVVRVNARV

SEQ ID NO: 60538 - protein, 9 aa, Artificial Sequence
  Description of Artificial Sequence: Synthetic peptide
  Seed: KVDELAHFL (MAGA4_HUMAN)
KRDELAHFL

SEQ ID NO: 60539 - protein, 10 aa, Artificial Sequence
  Description of Artificial Sequence: Synthetic peptide
  Seed: RVRIAYPSLR (MAGA4_HUMAN)
RERIAYPSLI

SEQ ID NO: 60540 - protein, 10 aa, Artificial Sequence
  Description of Artificial Sequence: Synthetic peptide
  Seed: RVRIAYPSLR (MAGA4_HUMAN)
RRRIAYPSLF

SEQ ID NO: 60541 - protein, 10 aa, Artificial Sequence
  Description of Artificial Sequence: Synthetic peptide
  Seed: RVNARVRIAY (MAGA4_HUMAN)
RMNARVRIAM

SEQ ID NO: 60542 - protein, 10 aa, Artificial Sequence
  Description of Artificial Sequence: Synthetic peptide
  Seed: SLFREALSNK (MAGA4_HUMAN)
SEFREALSNR

SEQ ID NO: 60543 - protein, 9 aa, Artificial Sequence
  Description of Artificial Sequence: Synthetic peptide
  Seed: VYDGREHTV (MAGA4_HUMAN)
VMDGREHTW

SEQ ID NO: 60544 - protein, 10 aa, Artificial Sequence
  Description of Artificial Sequence: Synthetic peptide
  Seed: YRQVPGSNPA (MAGA4_HUMAN)
YRQVPGSNPM

SEQ ID NO: 60545 - protein, 9 aa, Artificial Sequence
  Description of Artificial Sequence: Synthetic peptide
  Seed: GSNPARYEF (MAGA4_HUMAN)
GLNPARYEF

SEQ ID NO: 60546 - protein, 9 aa, Artificial Sequence
  Description of Artificial Sequence: Synthetic peptide
  Seed: GASALPTTI (MAGA4_HUMAN)
GSSALPTTL

SEQ ID NO: 60547 - protein, 9 aa, Artificial Sequence
  Description of Artificial Sequence: Synthetic peptide
  Seed: QEAAVSSSS (MAGA4_HUMAN)
QEAAVSSSP

SEQ ID NO: 60548 - protein, 9 aa, Artificial Sequence
  Description of Artificial Sequence: Synthetic peptide
  Seed: SPDAESLFR (MAGA4_HUMAN)
SNDAESLFY

SEQ ID NO: 60549 - protein, 10 aa, Artificial Sequence
  Description of Artificial Sequence: Synthetic peptide
  Seed: ASALPTTISF (MAGA4_HUMAN)
ADALPTTISW

SEQ ID NO: 60550 - protein, 9 aa, Artificial Sequence
  Description of Artificial Sequence: Synthetic peptide
  Seed: SYVKVLEHV (MAGA4_HUMAN)
SLVKVLEHA

SEQ ID NO: 60551 - protein, 10 aa, Artificial Sequence
  Description of Artificial Sequence: Synthetic peptide
  Seed: VIFGKASESL (MAGA4_HUMAN)
VQFGKASESV

SEQ ID NO: 60552 - protein, 10 aa, Artificial Sequence
  Description of Artificial Sequence: Synthetic peptide
  Seed: VYDGREHTVY (MAGA4_HUMAN)
VSDGREHTVY

SEQ ID NO: 60553 - protein, 10 aa, Artificial Sequence
  Description of Artificial Sequence: Synthetic peptide
  Seed: LLRKYRAKEL (MAGA4_HUMAN)
LMRKYRAKEL

SEQ ID NO: 60554 - protein, 9 aa, Artificial Sequence
  Description of Artificial Sequence: Synthetic peptide
  Seed: RVRIAYPSL (MAGA4_HUMAN)
RLRIAYPSA

SEQ ID NO: 60555 - protein, 9 aa, Artificial Sequence
  Description of Artificial Sequence: Synthetic peptide
  Seed: RQVPGSNPA (MAGA4_HUMAN)
RLVPGSNPL

SEQ ID NO: 60556 - protein, 9 aa, Artificial Sequence
  Description of Artificial Sequence: Synthetic peptide
  Seed: STSPDAESL (MAGA4_HUMAN)
SQSPDAESM

SEQ ID NO: 60557 - protein, 10 aa, Artificial Sequence
  Description of Artificial Sequence: Synthetic peptide
  Seed: LIIVLGTIAM (MAGA4_HUMAN)
LTIVLGTIAY

SEQ ID NO: 60558 - protein, 9 aa, Artificial Sequence
  Description of Artificial Sequence: Synthetic peptide
  Seed: KASESLKMI (MAGA4_HUMAN)
KLSESLKMF

SEQ ID NO: 60559 - protein, 11 aa, Artificial Sequence
  Description of Artificial Sequence: Synthetic peptide
  Seed: ELAHFLLRKYR (MAGA4_HUMAN)
ETAHFLLRKYR

SEQ ID NO: 60560 - protein, 9 aa, Artificial Sequence
  Description of Artificial Sequence: Synthetic peptide
  Seed: KVDELAHFL (MAGA4_HUMAN)
KIDELAHFL

SEQ ID NO: 60561 - protein, 10 aa, Artificial Sequence
  Description of Artificial Sequence: Synthetic peptide
  Seed: QEEEGPSTSP (MAGA4_HUMAN)
QEEEGPSTSV

SEQ ID NO: 60562 - protein, 9 aa, Artificial Sequence
  Description of Artificial Sequence: Synthetic peptide
  Seed: TTISFTCWR (MAGA4_HUMAN)
TGISFTCWR

SEQ ID NO: 60563 - protein, 9 aa, Artificial Sequence
  Description of Artificial Sequence: Synthetic peptide
  Seed: EEVPAAESA (MAGA4_HUMAN)
EEVPAAESL

SEQ ID NO: 60564 - protein, 9 aa, Artificial Sequence
  Description of Artificial Sequence: Synthetic peptide
  Seed: STSPDAESL (MAGA4_HUMAN)
SISPDAESM

SEQ ID NO: 60565 - protein, 9 aa, Artificial Sequence
  Description of Artificial Sequence: Synthetic peptide
  Seed: NPARYEFLW (MAGA4_HUMAN)
NAARYEFLW

SEQ ID NO: 60566 - protein, 11 aa, Artificial Sequence
  Description of Artificial Sequence: Synthetic peptide
  Seed: IAYPSLREAAL (MAGA4_HUMAN)
ITYPSLREAAY

SEQ ID NO: 60567 - protein, 10 aa, Artificial Sequence
  Description of Artificial Sequence: Synthetic peptide
  Seed: MIFGIDVKEV (MAGA4_HUMAN)
MMFGIDVKEV

SEQ ID NO: 60568 - protein, 9 aa, Artificial Sequence
  Description of Artificial Sequence: Synthetic peptide
  Seed: NTYTLVTCL (MAGA4_HUMAN)
NAYTLVTCR

SEQ ID NO: 60569 - protein, 8 aa, Artificial Sequence
  Description of Artificial Sequence: Synthetic peptide
  Seed: RVRIAYPS (MAGA4_HUMAN)
RTRIAYPS

SEQ ID NO: 60570 - protein, 10 aa, Artificial Sequence
  Description of Artificial Sequence: Synthetic peptide
  Seed: QIFPKTGLLI (MAGA4_HUMAN)
QVFPKTGLLF

SEQ ID NO: 60571 - protein, 10 aa, Artificial Sequence
  Description of Artificial Sequence: Synthetic peptide
  Seed: QIFPKTGLLI (MAGA4_HUMAN)
QLFPKTGLLY

SEQ ID NO: 60572 - protein, 9 aa, Artificial Sequence
  Description of Artificial Sequence: Synthetic peptide
  Seed: RCFPVIFGK (MAGA4_HUMAN)
RIFPVIFGV

SEQ ID NO: 60573 - protein, 9 aa, Artificial Sequence
  Description of Artificial Sequence: Synthetic peptide
  Seed: SAGPPQSPQ (MAGA4_HUMAN)
SAGPPQSPV

SEQ ID NO: 60574 - protein, 9 aa, Artificial Sequence
  Description of Artificial Sequence: Synthetic peptide
  Seed: SNKVDELAH (MAGA4_HUMAN)
SAKVDELAL

SEQ ID NO: 60575 - protein, 11 aa, Artificial Sequence
  Description of Artificial Sequence: Synthetic peptide
  Seed: IAYPSLREAAL (MAGA4_HUMAN)
IPYPSLREAAL

SEQ ID NO: 60576 - protein, 9 aa, Artificial Sequence
  Description of Artificial Sequence: Synthetic peptide
  Seed: IAYPSLREA (MAGA4_HUMAN)
IVYPSLREV

SEQ ID NO: 60577 - protein, 9 aa, Artificial Sequence
  Description of Artificial Sequence: Synthetic peptide
  Seed: SSPLVPGTL (MAGA4_HUMAN)
SPPLVPGTV

SEQ ID NO: 60578 - protein, 9 aa, Artificial Sequence
  Description of Artificial Sequence: Synthetic peptide
  Seed: RAKELVTKA (MAGA4_HUMAN)
RNKELVTKL

SEQ ID NO: 60579 - protein, 10 aa, Artificial Sequence
  Description of Artificial Sequence: Synthetic peptide
  Seed: TLVTCLGLSY (MAGA4_HUMAN)
TKVTCLGLSY

SEQ ID NO: 60580 - protein, 9 aa, Artificial Sequence
  Description of Artificial Sequence: Synthetic peptide
  Seed: LVPGTLEEV (MAGA4_HUMAN)
LTPGTLEEV

SEQ ID NO: 60581 - protein, 10 aa, Artificial Sequence
  Description of Artificial Sequence: Synthetic peptide
  Seed: RVRIAYPSLR (MAGA4_HUMAN)
RVRIAYPSLS

SEQ ID NO: 60582 - protein, 10 aa, Artificial Sequence
  Description of Artificial Sequence: Synthetic peptide
  Seed: SSEQKSQHCK (MAGA4_HUMAN)
STEQKSQHCY

SEQ ID NO: 60583 - protein, 9 aa, Artificial Sequence
  Description of Artificial Sequence: Synthetic peptide
  Seed: IAYPSLREA (MAGA4_HUMAN)
ISYPSLREA

SEQ ID NO: 60584 - protein, 11 aa, Artificial Sequence
  Description of Artificial Sequence: Synthetic peptide
  Seed: LPTTISFTCWR (MAGA4_HUMAN)
LRTTISFTCWR

SEQ ID NO: 60585 - protein, 9 aa, Artificial Sequence
  Description of Artificial Sequence: Synthetic peptide
  Seed: KASESLKMI (MAGA4_HUMAN)
KLSESLKML

SEQ ID NO: 60586 - protein, 9 aa, Artificial Sequence
  Description of Artificial Sequence: Synthetic peptide
  Seed: WVQENYLEY (MAGA4_HUMAN)
WRQENYLEM

SEQ ID NO: 60587 - protein, 10 aa, Artificial Sequence
  Description of Artificial Sequence: Synthetic peptide
  Seed: RVRIAYPSLR (MAGA4_HUMAN)
RVRIAYPSLT

SEQ ID NO: 60588 - protein, 9 aa, Artificial Sequence
  Description of Artificial Sequence: Synthetic peptide
  Seed: KVLEHVVRV (MAGA4_HUMAN)
KQLEHVVRK

SEQ ID NO: 60589 - protein, 8 aa, Artificial Sequence
  Description of Artificial Sequence: Synthetic peptide
  Seed: KVDELAHF (MAGA4_HUMAN)
KLDELAHL

SEQ ID NO: 60590 - protein, 9 aa, Artificial Sequence
  Description of Artificial Sequence: Synthetic peptide
  Seed: SSPLVPGTL (MAGA4_HUMAN)
SPPLVPGTL

SEQ ID NO: 60591 - protein, 10 aa, Artificial Sequence
  Description of Artificial Sequence: Synthetic peptide
  Seed: VYDGREHTVY (MAGA4_HUMAN)
VWDGREHTVL

SEQ ID NO: 60592 - protein, 9 aa, Artificial Sequence
  Description of Artificial Sequence: Synthetic peptide
  Seed: ASESLKMIF (MAGA4_HUMAN)
ASESLKMIY

SEQ ID NO: 60593 - protein, 9 aa, Artificial Sequence
  Description of Artificial Sequence: Synthetic peptide
  Seed: GASALPTTI (MAGA4_HUMAN)
GTSALPTTV

SEQ ID NO: 60594 - protein, 10 aa, Artificial Sequence
  Description of Artificial Sequence: Synthetic peptide
  Seed: VDPASNTYTL (MAGA4_HUMAN)
VKPASNTYTY

SEQ ID NO: 60595 - protein, 9 aa, Artificial Sequence
  Description of Artificial Sequence: Synthetic peptide
  Seed: KNYKRCFPV (MAGA4_HUMAN)
KLYKRCFPK

SEQ ID NO: 60596 - protein, 9 aa, Artificial Sequence
  Description of Artificial Sequence: Synthetic peptide
  Seed: YVKVLEHVV (MAGA4_HUMAN)
YAKVLEHVH

SEQ ID NO: 60597 - protein, 9 aa, Artificial Sequence
  Description of Artificial Sequence: Synthetic peptide
  Seed: VRIAYPSLR (MAGA4_HUMAN)
VVIAYPSLR

SEQ ID NO: 60598 - protein, 9 aa, Artificial Sequence
  Description of Artificial Sequence: Synthetic peptide
  Seed: NQIFPKTGL (MAGA4_HUMAN)
NHIFPKTGA

SEQ ID NO: 60599 - protein, 10 aa, Artificial Sequence
  Description of Artificial Sequence: Synthetic peptide
  Seed: KEVDPASNTY (MAGA4_HUMAN)
KKVDPASNTF

SEQ ID NO: 60600 - protein, 10 aa, Artificial Sequence
  Description of Artificial Sequence: Synthetic peptide
  Seed: QIFPKTGLLI (MAGA4_HUMAN)
QTFPKTGLLW

SEQ ID NO: 60601 - protein, 9 aa, Artificial Sequence
  Description of Artificial Sequence: Synthetic peptide
  Seed: ALLEEEEGV (MAGA4_HUMAN)
ALLEEEEGF

SEQ ID NO: 60602 - protein, 9 aa, Artificial Sequence
  Description of Artificial Sequence: Synthetic peptide
  Seed: AHFLLRKYR (MAGA4_HUMAN)
AMFLLRKYR

SEQ ID NO: 60603 - protein, 9 aa, Artificial Sequence
  Description of Artificial Sequence: Synthetic peptide
  Seed: HVVRVNARV (MAGA4_HUMAN)
HQVRVNARV

SEQ ID NO: 60604 - protein, 10 aa, Artificial Sequence
  Description of Artificial Sequence: Synthetic peptide
  Seed: KYRAKELVTK (MAGA4_HUMAN)
KLRAKELVTR

SEQ ID NO: 60605 - protein, 9 aa, Artificial Sequence
  Description of Artificial Sequence: Synthetic peptide
  Seed: RQVPGSNPA (MAGA4_HUMAN)
RMVPGSNPI

SEQ ID NO: 60606 - protein, 9 aa, Artificial Sequence
  Description of Artificial Sequence: Synthetic peptide
  Seed: RCFPVIFGK (MAGA4_HUMAN)
RMFPVIFGY

SEQ ID NO: 60607 - protein, 9 aa, Artificial Sequence
  Description of Artificial Sequence: Synthetic peptide
  Seed: SSPLVPGTL (MAGA4_HUMAN)
STPLVPGTF

SEQ ID NO: 60608 - protein, 10 aa, Artificial Sequence
  Description of Artificial Sequence: Synthetic peptide
  Seed: KNYKRCFPVI (MAGA4_HUMAN)
KTYKRCFPVL

SEQ ID NO: 60609 - protein, 9 aa, Artificial Sequence
  Description of Artificial Sequence: Synthetic peptide
  Seed: RAKELVTKA (MAGA4_HUMAN)
RIKELVTKM

SEQ ID NO: 60610 - protein, 9 aa, Artificial Sequence
  Description of Artificial Sequence: Synthetic peptide
  Seed: MSSEQKSQH (MAGA4_HUMAN)
MVSEQKSQF

SEQ ID NO: 60611 - protein, 9 aa, Artificial Sequence
  Description of Artificial Sequence: Synthetic peptide
  Seed: VYDGREHTV (MAGA4_HUMAN)
VRDGREHTM

SEQ ID NO: 60612 - protein, 9 aa, Artificial Sequence
  Description of Artificial Sequence: Synthetic peptide
  Seed: LRKYRAKEL (MAGA4_HUMAN)
LLKYRAKEM

SEQ ID NO: 60613 - protein, 9 aa, Artificial Sequence
  Description of Artificial Sequence: Synthetic peptide
  Seed: EIWEELGVM (MAGA4_HUMAN)
EAWEELGVM

SEQ ID NO: 60614 - protein, 9 aa, Artificial Sequence
  Description of Artificial Sequence: Synthetic peptide
  Seed: RAKELVTKA (MAGA4_HUMAN)
RLKELVTKY

SEQ ID NO: 60615 - protein, 10 aa, Artificial Sequence
  Description of Artificial Sequence: Synthetic peptide
  Seed: ARVRIAYPSL (MAGA4_HUMAN)
AHVRIAYPSK

SEQ ID NO: 60616 - protein, 9 aa, Artificial Sequence
  Description of Artificial Sequence: Synthetic peptide
  Seed: GASALPTTI (MAGA4_HUMAN)
GLSALPTTM

SEQ ID NO: 60617 - protein, 9 aa, Artificial Sequence
  Description of Artificial Sequence: Synthetic peptide
  Seed: TVYGEPRKL (MAGA4_HUMAN)
TYYGEPRKF

SEQ ID NO: 60618 - protein, 10 aa, Artificial Sequence
  Description of Artificial Sequence: Synthetic peptide
  Seed: YRQVPGSNPA (MAGA4_HUMAN)
YCQVPGSNPL

SEQ ID NO: 60619 - protein, 9 aa, Artificial Sequence
  Description of Artificial Sequence: Synthetic peptide
  Seed: RVRIAYPSL (MAGA4_HUMAN)
RARIAYPSW

SEQ ID NO: 60620 - protein, 9 aa, Artificial Sequence
  Description of Artificial Sequence: Synthetic peptide
  Seed: SSPLVPGTL (MAGA4_HUMAN)
SNPLVPGTL

SEQ ID NO: 60621 - protein, 10 aa, Artificial Sequence
  Description of Artificial Sequence: Synthetic peptide
  Seed: AQEEALGLVG (MAGA4_HUMAN)
AEEEALGLVL

SEQ ID NO: 60622 - protein, 10 aa, Artificial Sequence
  Description of Artificial Sequence: Synthetic peptide
  Seed: SSSPLVPGTL (MAGA4_HUMAN)
SLSPLVPGTY

SEQ ID NO: 60623 - protein, 9 aa, Artificial Sequence
  Description of Artificial Sequence: Synthetic peptide
  Seed: WVQENYLEY (MAGA4_HUMAN)
WAQENYLEY

SEQ ID NO: 60624 - protein, 10 aa, Artificial Sequence
  Description of Artificial Sequence: Synthetic peptide
  Seed: AESAGPPQSP (MAGA4_HUMAN)
AESAGPPQSM

SEQ ID NO: 60625 - protein, 10 aa, Artificial Sequence
  Description of Artificial Sequence: Synthetic peptide
  Seed: RVRIAYPSLR (MAGA4_HUMAN)
RLRIAYPSLY

SEQ ID NO: 60626 - protein, 9 aa, Artificial Sequence
  Description of Artificial Sequence: Synthetic peptide
  Seed: IIVLGTIAM (MAGA4_HUMAN)
IPVLGTIAV

SEQ ID NO: 60627 - protein, 10 aa, Artificial Sequence
  Description of Artificial Sequence: Synthetic peptide
  Seed: LTQDWVQENY (MAGA4_HUMAN)
LYQDWVQENY

SEQ ID NO: 60628 - protein, 9 aa, Artificial Sequence
  Description of Artificial Sequence: Synthetic peptide
  Seed: RCFPVIFGK (MAGA4_HUMAN)
RQFPVIFGR

SEQ ID NO: 60629 - protein, 9 aa, Artificial Sequence
  Description of Artificial Sequence: Synthetic peptide
  Seed: TVYGEPRKL (MAGA4_HUMAN)
TAYGEPRKR

SEQ ID NO: 60630 - protein, 10 aa, Artificial Sequence
  Description of Artificial Sequence: Synthetic peptide
  Seed: KVLEHVVRVN (MAGA4_HUMAN)
KMLEHVVRVK

SEQ ID NO: 60631 - protein, 11 aa, Artificial Sequence
  Description of Artificial Sequence: Synthetic peptide
  Seed: RKYRAKELVTK (MAGA4_HUMAN)
RRYRAKELVTM

SEQ ID NO: 60632 - protein, 9 aa, Artificial Sequence
  Description of Artificial Sequence: Synthetic peptide
  Seed: SALPTTISF (MAGA4_HUMAN)
SFLPTTISL

SEQ ID NO: 60633 - protein, 10 aa, Artificial Sequence
  Description of Artificial Sequence: Synthetic peptide
  Seed: GVYDGREHTV (MAGA4_HUMAN)
GMYDGREHTR

SEQ ID NO: 60634 - protein, 10 aa, Artificial Sequence
  Description of Artificial Sequence: Synthetic peptide
  Seed: ASALPTTISF (MAGA4_HUMAN)
AKALPTTISW

SEQ ID NO: 60635 - protein, 10 aa, Artificial Sequence
  Description of Artificial Sequence: Synthetic peptide
  Seed: GVYDGREHTV (MAGA4_HUMAN)
GLYDGREHTL

SEQ ID NO: 60636 - protein, 9 aa, Artificial Sequence
  Description of Artificial Sequence: Synthetic peptide
  Seed: QSPQGASAL (MAGA4_HUMAN)
QPPQGASAL

SEQ ID NO: 60637 - protein, 9 aa, Artificial Sequence
  Description of Artificial Sequence: Synthetic peptide
  Seed: GVYDGREHT (MAGA4_HUMAN)
GTYDGREHL

SEQ ID NO: 60638 - protein, 9 aa, Artificial Sequence
  Description of Artificial Sequence: Synthetic peptide
  Seed: NQIFPKTGL (MAGA4_HUMAN)
NAIFPKTGY

SEQ ID NO: 60639 - protein, 10 aa, Artificial Sequence
  Description of Artificial Sequence: Synthetic peptide
  Seed: EAAVSSSSPL (MAGA4_HUMAN)
EIAVSSSSPI

SEQ ID NO: 60640 - protein, 9 aa, Artificial Sequence
  Description of Artificial Sequence: Synthetic peptide
  Seed: AAVSSSSPL (MAGA4_HUMAN)
AAVSSSSPI

SEQ ID NO: 60641 - protein, 9 aa, Artificial Sequence
  Description of Artificial Sequence: Synthetic peptide
  Seed: RVNARVRIA (MAGA4_HUMAN)
RVNARVRIK

SEQ ID NO: 60642 - protein, 9 aa, Artificial Sequence
  Description of Artificial Sequence: Synthetic peptide
  Seed: KYRAKELVT (MAGA4_HUMAN)
KQRAKELVK

SEQ ID NO: 60643 - protein, 10 aa, Artificial Sequence
  Description of Artificial Sequence: Synthetic peptide
  Seed: TSYVKVLEHV (MAGA4_HUMAN)
TLYVKVLEHV

SEQ ID NO: 60644 - protein, 9 aa, Artificial Sequence
  Description of Artificial Sequence: Synthetic peptide
  Seed: VYDGREHTV (MAGA4_HUMAN)
VLDGREHTL

SEQ ID NO: 60645 - protein, 10 aa, Artificial Sequence
  Description of Artificial Sequence: Synthetic peptide
  Seed: KVDELAHFLL (MAGA4_HUMAN)
KLDELAHFLA

SEQ ID NO: 60646 - protein, 11 aa, Artificial Sequence
  Description of Artificial Sequence: Synthetic peptide
  Seed: LPTTISFTCWR (MAGA4_HUMAN)
LTTTISFTCWR

SEQ ID NO: 60647 - protein, 10 aa, Artificial Sequence
  Description of Artificial Sequence: Synthetic peptide
  Seed: NKVDELAHFL (MAGA4_HUMAN)
NIVDELAHFV

SEQ ID NO: 60648 - protein, 10 aa, Artificial Sequence
  Description of Artificial Sequence: Synthetic peptide
  Seed: KVLEHVVRVN (MAGA4_HUMAN)
KLLEHVVRVA

SEQ ID NO: 60649 - protein, 9 aa, Artificial Sequence
  Description of Artificial Sequence: Synthetic peptide
  Seed: KELVTKAEM (MAGA4_HUMAN)
KELVTKAEC

SEQ ID NO: 60650 - protein, 9 aa, Artificial Sequence
  Description of Artificial Sequence: Synthetic peptide
  Seed: TVYGEPRKL (MAGA4_HUMAN)
TWYGEPRKY

SEQ ID NO: 60651 - protein, 10 aa, Artificial Sequence
  Description of Artificial Sequence: Synthetic peptide
  Seed: RVRIAYPSLR (MAGA4_HUMAN)
RWRIAYPSLV

SEQ ID NO: 60652 - protein, 9 aa, Artificial Sequence
  Description of Artificial Sequence: Synthetic peptide
  Seed: RCFPVIFGK (MAGA4_HUMAN)
RCFPVIFGR

SEQ ID NO: 60653 - protein, 10 aa, Artificial Sequence
  Description of Artificial Sequence: Synthetic peptide
  Seed: RVRIAYPSLR (MAGA4_HUMAN)
RMRIAYPSLA

SEQ ID NO: 60654 - protein, 9 aa, Artificial Sequence
  Description of Artificial Sequence: Synthetic peptide
  Seed: TQDWVQENY (MAGA4_HUMAN)
TFDWVQENM

SEQ ID NO: 60655 - protein, 9 aa, Artificial Sequence
  Description of Artificial Sequence: Synthetic peptide
  Seed: SEEEIWEEL (MAGA4_HUMAN)
SSEEIWEEL

SEQ ID NO: 60656 - protein, 9 aa, Artificial Sequence
  Description of Artificial Sequence: Synthetic peptide
  Seed: LAHFLLRKY (MAGA4_HUMAN)
LKHFLLRKF

SEQ ID NO: 60657 - protein, 9 aa, Artificial Sequence
  Description of Artificial Sequence: Synthetic peptide
  Seed: TVYGEPRKL (MAGA4_HUMAN)
TAYGEPRKM

SEQ ID NO: 60658 - protein, 10 aa, Artificial Sequence
  Description of Artificial Sequence: Synthetic peptide
  Seed: KNYKRCFPVI (MAGA4_HUMAN)
KTYKRCFPVG

SEQ ID NO: 60659 - protein, 9 aa, Artificial Sequence
  Description of Artificial Sequence: Synthetic peptide
  Seed: RQVPGSNPA (MAGA4_HUMAN)
RAVPGSNPV

SEQ ID NO: 60660 - protein, 11 aa, Artificial Sequence
  Description of Artificial Sequence: Synthetic peptide
  Seed: KNYKRCFPVIF (MAGA4_HUMAN)
KQYKRCFPVIF

SEQ ID NO: 60661 - protein, 10 aa, Artificial Sequence
  Description of Artificial Sequence: Synthetic peptide
  Seed: ASALPTTISF (MAGA4_HUMAN)
AIALPTTISF

SEQ ID NO: 60662 - protein, 9 aa, Artificial Sequence
  Description of Artificial Sequence: Synthetic peptide
  Seed: GASALPTTI (MAGA4_HUMAN)
GLSALPTTL

SEQ ID NO: 60663 - protein, 9 aa, Artificial Sequence
  Description of Artificial Sequence: Synthetic peptide
  Seed: QIFPKTGLL (MAGA4_HUMAN)
QRFPKTGLM

SEQ ID NO: 60664 - protein, 10 aa, Artificial Sequence
  Description of Artificial Sequence: Synthetic peptide
  Seed: FGKASESLKM (MAGA4_HUMAN)
FCKASESLKF

SEQ ID NO: 60665 - protein, 10 aa, Artificial Sequence
  Description of Artificial Sequence: Synthetic peptide
  Seed: GVYDGREHTV (MAGA4_HUMAN)
GIYDGREHTY

SEQ ID NO: 60666 - protein, 9 aa, Artificial Sequence
  Description of Artificial Sequence: Synthetic peptide
  Seed: RVRIAYPSL (MAGA4_HUMAN)
RLRIAYPSK

SEQ ID NO: 60667 - protein, 9 aa, Artificial Sequence
  Description of Artificial Sequence: Synthetic peptide
  Seed: VYDGREHTV (MAGA4_HUMAN)
VGDGREHTM

SEQ ID NO: 60668 - protein, 9 aa, Artificial Sequence
  Description of Artificial Sequence: Synthetic peptide
  Seed: DPASNTYTL (MAGA4_HUMAN)
DPASNTYTY

SEQ ID NO: 60669 - protein, 9 aa, Artificial Sequence
  Description of Artificial Sequence: Synthetic peptide
  Seed: TVYGEPRKL (MAGA4_HUMAN)
TWYGEPRKF

SEQ ID NO: 60670 - protein, 10 aa, Artificial Sequence
  Description of Artificial Sequence: Synthetic peptide
  Seed: RVRIAYPSLR (MAGA4_HUMAN)
RVRIAYPSLY

SEQ ID NO: 60671 - protein, 9 aa, Artificial Sequence
  Description of Artificial Sequence: Synthetic peptide
  Seed: DELAHFLLR (MAGA4_HUMAN)
DELAHFLLF

SEQ ID NO: 60672 - protein, 9 aa, Artificial Sequence
  Description of Artificial Sequence: Synthetic peptide
  Seed: STSPDAESL (MAGA4_HUMAN)
SLSPDAESM

SEQ ID NO: 60673 - protein, 11 aa, Artificial Sequence
  Description of Artificial Sequence: Synthetic peptide
  Seed: RVNARVRIAYP (MAGA4_HUMAN)
RCNARVRIAYK

SEQ ID NO: 60674 - protein, 9 aa, Artificial Sequence
  Description of Artificial Sequence: Synthetic peptide
  Seed: WVQENYLEY (MAGA4_HUMAN)
WYQENYLEF

SEQ ID NO: 60675 - protein, 10 aa, Artificial Sequence
  Description of Artificial Sequence: Synthetic peptide
  Seed: RVRIAYPSLR (MAGA4_HUMAN)
RNRIAYPSLK

SEQ ID NO: 60676 - protein, 9 aa, Artificial Sequence
  Description of Artificial Sequence: Synthetic peptide
  Seed: RVNARVRIA (MAGA4_HUMAN)
RSNARVRIA

SEQ ID NO: 60677 - protein, 9 aa, Artificial Sequence
  Description of Artificial Sequence: Synthetic peptide
  Seed: VYDGREHTV (MAGA4_HUMAN)
VCDGREHTF

SEQ ID NO: 60678 - protein, 9 aa, Artificial Sequence
  Description of Artificial Sequence: Synthetic peptide
  Seed: KVDELAHFL (MAGA4_HUMAN)
KGDELAHFL

SEQ ID NO: 60679 - protein, 9 aa, Artificial Sequence
  Description of Artificial Sequence: Synthetic peptide
  Seed: RAKELVTKA (MAGA4_HUMAN)
RWKELVTKK

SEQ ID NO: 60680 - protein, 9 aa, Artificial Sequence
  Description of Artificial Sequence: Synthetic peptide
  Seed: KASESLKMI (MAGA4_HUMAN)
KISESLKMF

SEQ ID NO: 60681 - protein, 10 aa, Artificial Sequence
  Description of Artificial Sequence: Synthetic peptide
  Seed: VDPASNTYTL (MAGA4_HUMAN)
VYPASNTYTL

SEQ ID NO: 60682 - protein, 9 aa, Artificial Sequence
  Description of Artificial Sequence: Synthetic peptide
  Seed: YVKVLEHVV (MAGA4_HUMAN)
YLKVLEHVL

SEQ ID NO: 60683 - protein, 11 aa, Artificial Sequence
  Description of Artificial Sequence: Synthetic peptide
  Seed: RVNARVRIAYP (MAGA4_HUMAN)
RRNARVRIAYK

SEQ ID NO: 60684 - protein, 9 aa, Artificial Sequence
  Description of Artificial Sequence: Synthetic peptide
  Seed: ALSNKVDEL (MAGA4_HUMAN)
AVSNKVDEL

SEQ ID NO: 60685 - protein, 10 aa, Artificial Sequence
  Description of Artificial Sequence: Synthetic peptide
  Seed: KEVDPASNTY (MAGA4_HUMAN)
KEVDPASNTS

SEQ ID NO: 60686 - protein, 10 aa, Artificial Sequence
  Description of Artificial Sequence: Synthetic peptide
  Seed: GVYDGREHTV (MAGA4_HUMAN)
GRYDGREHTM

SEQ ID NO: 60687 - protein, 9 aa, Artificial Sequence
  Description of Artificial Sequence: Synthetic peptide
  Seed: YPSLREAAL (MAGA4_HUMAN)
YQSLREAAY

SEQ ID NO: 60688 - protein, 9 aa, Artificial Sequence
  Description of Artificial Sequence: Synthetic peptide
  Seed: KNYKRCFPV (MAGA4_HUMAN)
KTYKRCFPA

SEQ ID NO: 60689 - protein, 9 aa, Artificial Sequence
  Description of Artificial Sequence: Synthetic peptide
  Seed: KYRAKELVT (MAGA4_HUMAN)
KTRAKELVM

SEQ ID NO: 60690 - protein, 9 aa, Artificial Sequence
  Description of Artificial Sequence: Synthetic peptide
  Seed: LRKYRAKEL (MAGA4_HUMAN)
LPKYRAKEL

SEQ ID NO: 60691 - protein, 11 aa, Artificial Sequence
  Description of Artificial Sequence: Synthetic peptide
  Seed: STSPDAESLFR (MAGA4_HUMAN)
STSPDAESLFK

SEQ ID NO: 60692 - protein, 9 aa, Artificial Sequence
  Description of Artificial Sequence: Synthetic peptide
  Seed: EVDPASNTY (MAGA4_HUMAN)
EVDPASNTV

SEQ ID NO: 60693 - protein, 10 aa, Artificial Sequence
  Description of Artificial Sequence: Synthetic peptide
  Seed: RVRIAYPSLR (MAGA4_HUMAN)
RSRIAYPSLC

SEQ ID NO: 60694 - protein, 10 aa, Artificial Sequence
  Description of Artificial Sequence: Synthetic peptide
  Seed: TLVTCLGLSY (MAGA4_HUMAN)
TMVTCLGLSY

SEQ ID NO: 60695 - protein, 9 aa, Artificial Sequence
  Description of Artificial Sequence: Synthetic peptide
  Seed: TSPDAESLF (MAGA4_HUMAN)
TVPDAESLI

SEQ ID NO: 60696 - protein, 10 aa, Artificial Sequence
  Description of Artificial Sequence: Synthetic peptide
  Seed: AYPSLREAAL (MAGA4_HUMAN)
ARPSLREAAM

SEQ ID NO: 60697 - protein, 9 aa, Artificial Sequence
  Description of Artificial Sequence: Synthetic peptide
  Seed: KVDELAHFL (MAGA4_HUMAN)
KWDELAHFL

SEQ ID NO: 60698 - protein, 9 aa, Artificial Sequence
  Description of Artificial Sequence: Synthetic peptide
  Seed: SNPARYEFL (MAGA4_HUMAN)
SGPARYEFL

SEQ ID NO: 60699 - protein, 9 aa, Artificial Sequence
  Description of Artificial Sequence: Synthetic peptide
  Seed: IAYPSLREA (MAGA4_HUMAN)
IIYPSLREY

SEQ ID NO: 60700 - protein, 9 aa, Artificial Sequence
  Description of Artificial Sequence: Synthetic peptide
  Seed: MGVYDGREH (MAGA4_HUMAN)
MAVYDGREL

SEQ ID NO: 60701 - protein, 9 aa, Artificial Sequence
  Description of Artificial Sequence: Synthetic peptide
  Seed: GSNPARYEF (MAGA4_HUMAN)
GYNPARYEM

SEQ ID NO: 60702 - protein, 10 aa, Artificial Sequence
  Description of Artificial Sequence: Synthetic peptide
  Seed: VDPASNTYTL (MAGA4_HUMAN)
VIPASNTYTL

SEQ ID NO: 60703 - protein, 8 aa, Artificial Sequence
  Description of Artificial Sequence: Synthetic peptide
  Seed: SLKMIFGI (MAGA4_HUMAN)
SMKMIFGV

SEQ ID NO: 60704 - protein, 10 aa, Artificial Sequence
  Description of Artificial Sequence: Synthetic peptide
  Seed: YRQVPGSNPA (MAGA4_HUMAN)
YNQVPGSNPL

SEQ ID NO: 60705 - protein, 9 aa, Artificial Sequence
  Description of Artificial Sequence: Synthetic peptide
  Seed: NTYTLVTCL (MAGA4_HUMAN)
NAYTLVTCW

SEQ ID NO: 60706 - protein, 9 aa, Artificial Sequence
  Description of Artificial Sequence: Synthetic peptide
  Seed: TQDWVQENY (MAGA4_HUMAN)
TYDWVQENM

SEQ ID NO: 60707 - protein, 9 aa, Artificial Sequence
  Description of Artificial Sequence: Synthetic peptide
  Seed: WVQENYLEY (MAGA4_HUMAN)
WPQENYLEV

SEQ ID NO: 60708 - protein, 11 aa, Artificial Sequence
  Description of Artificial Sequence: Synthetic peptide
  Seed: EMLERVIKNYK (MAGA4_HUMAN)
EILERVIKNYR

SEQ ID NO: 60709 - protein, 10 aa, Artificial Sequence
  Description of Artificial Sequence: Synthetic peptide
  Seed: RVRIAYPSLR (MAGA4_HUMAN)
RKRIAYPSLF

SEQ ID NO: 60710 - protein, 10 aa, Artificial Sequence
  Description of Artificial Sequence: Synthetic peptide
  Seed: KNYKRCFPVI (MAGA4_HUMAN)
KLYKRCFPVK

SEQ ID NO: 60711 - protein, 9 aa, Artificial Sequence
  Description of Artificial Sequence: Synthetic peptide
  Seed: VTKAEMLER (MAGA4_HUMAN)
VLKAEMLER

SEQ ID NO: 60712 - protein, 9 aa, Artificial Sequence
  Description of Artificial Sequence: Synthetic peptide
  Seed: LVPGTLEEV (MAGA4_HUMAN)
LYPGTLEEF

SEQ ID NO: 60713 - protein, 9 aa, Artificial Sequence
  Description of Artificial Sequence: Synthetic peptide
  Seed: NKVDELAHF (MAGA4_HUMAN)
NYVDELAHM

SEQ ID NO: 60714 - protein, 9 aa, Artificial Sequence
  Description of Artificial Sequence: Synthetic peptide
  Seed: AAVSSSSPL (MAGA4_HUMAN)
AQVSSSSPF

SEQ ID NO: 60715 - protein, 9 aa, Artificial Sequence
  Description of Artificial Sequence: Synthetic peptide
  Seed: QEAAVSSSS (MAGA4_HUMAN)
QEAAVSSSV

SEQ ID NO: 60716 - protein, 10 aa, Artificial Sequence
  Description of Artificial Sequence: Synthetic peptide
  Seed: KVDELAHFLL (MAGA4_HUMAN)
KLDELAHFLY

SEQ ID NO: 60717 - protein, 9 aa, Artificial Sequence
  Description of Artificial Sequence: Synthetic peptide
  Seed: VNARVRIAY (MAGA4_HUMAN)
VEARVRIAF

SEQ ID NO: 60718 - protein, 8 aa, Artificial Sequence
  Description of Artificial Sequence: Synthetic peptide
  Seed: ASALPTTI (MAGA4_HUMAN)
AQALPTTI

SEQ ID NO: 60719 - protein, 9 aa, Artificial Sequence
  Description of Artificial Sequence: Synthetic peptide
  Seed: KNYKRCFPV (MAGA4_HUMAN)
KMYKRCFPA

SEQ ID NO: 60720 - protein, 10 aa, Artificial Sequence
  Description of Artificial Sequence: Synthetic peptide
  Seed: KVDELAHFLL (MAGA4_HUMAN)
KQDELAHFLV

SEQ ID NO: 60721 - protein, 10 aa, Artificial Sequence
  Description of Artificial Sequence: Synthetic peptide
  Seed: AYPSLREAAL (MAGA4_HUMAN)
ARPSLREAAL

SEQ ID NO: 60722 - protein, 9 aa, Artificial Sequence
  Description of Artificial Sequence: Synthetic peptide
  Seed: RQVPGSNPA (MAGA4_HUMAN)
RHVPGSNPA

SEQ ID NO: 60723 - protein, 10 aa, Artificial Sequence
  Description of Artificial Sequence: Synthetic peptide
  Seed: YRQVPGSNPA (MAGA4_HUMAN)
YVQVPGSNPF

SEQ ID NO: 60724 - protein, 10 aa, Artificial Sequence
  Description of Artificial Sequence: Synthetic peptide
  Seed: KEVDPASNTY (MAGA4_HUMAN)
KIVDPASNTI

SEQ ID NO: 60725 - protein, 9 aa, Artificial Sequence
  Description of Artificial Sequence: Synthetic peptide
  Seed: DPASNTYTL (MAGA4_HUMAN)
DMASNTYTY

SEQ ID NO: 60726 - protein, 10 aa, Artificial Sequence
  Description of Artificial Sequence: Synthetic peptide
  Seed: TTISFTCWRQ (MAGA4_HUMAN)
TVISFTCWRF

SEQ ID NO: 60727 - protein, 9 aa, Artificial Sequence
  Description of Artificial Sequence: Synthetic peptide
  Seed: SAGPPQSPQ (MAGA4_HUMAN)
SSGPPQSPF

SEQ ID NO: 60728 - protein, 10 aa, Artificial Sequence
  Description of Artificial Sequence: Synthetic peptide
  Seed: VKVLEHVVRV (MAGA4_HUMAN)
VLVLEHVVRA

SEQ ID NO: 60729 - protein, 9 aa, Artificial Sequence
  Description of Artificial Sequence: Synthetic peptide
  Seed: EEALGLVGA (MAGA4_HUMAN)
EEALGLVGV

SEQ ID NO: 60730 - protein, 9 aa, Artificial Sequence
  Description of Artificial Sequence: Synthetic peptide
  Seed: LAHFLLRKY (MAGA4_HUMAN)
LAHFLLRKW

SEQ ID NO: 60731 - protein, 10 aa, Artificial Sequence
  Description of Artificial Sequence: Synthetic peptide
  Seed: YRAKELVTKA (MAGA4_HUMAN)
YRAKELVTKF

SEQ ID NO: 60732 - protein, 10 aa, Artificial Sequence
  Description of Artificial Sequence: Synthetic peptide
  Seed: TSYVKVLEHV (MAGA4_HUMAN)
TVYVKVLEHL

SEQ ID NO: 60733 - protein, 9 aa, Artificial Sequence
  Description of Artificial Sequence: Synthetic peptide
  Seed: IFPKTGLLI (MAGA4_HUMAN)
IAPKTGLLL

SEQ ID NO: 60734 - protein, 9 aa, Artificial Sequence
  Description of Artificial Sequence: Synthetic peptide
  Seed: KVDELAHFL (MAGA4_HUMAN)
KSDELAHFY

SEQ ID NO: 60735 - protein, 9 aa, Artificial Sequence
  Description of Artificial Sequence: Synthetic peptide
  Seed: SSPLVPGTL (MAGA4_HUMAN)
SMPLVPGTV

SEQ ID NO: 60736 - protein, 9 aa, Artificial Sequence
  Description of Artificial Sequence: Synthetic peptide
  Seed: STSPDAESL (MAGA4_HUMAN)
SSSPDAESW

SEQ ID NO: 60737 - protein, 9 aa, Artificial Sequence
  Description of Artificial Sequence: Synthetic peptide
  Seed: IAMEGDSAS (MAGA4_HUMAN)
IAMEGDSAF

SEQ ID NO: 60738 - protein, 9 aa, Artificial Sequence
  Description of Artificial Sequence: Synthetic peptide
  Seed: AESLFREAL (MAGA4_HUMAN)
AMSLFREAF

SEQ ID NO: 60739 - protein, 9 aa, Artificial Sequence
  Description of Artificial Sequence: Synthetic peptide
  Seed: EEIWEELGV (MAGA4_HUMAN)
EEIWEELGY

SEQ ID NO: 60740 - protein, 10 aa, Artificial Sequence
  Description of Artificial Sequence: Synthetic peptide
  Seed: YPSLREAALL (MAGA4_HUMAN)
YNSLREAALY

SEQ ID NO: 60741 - protein, 9 aa, Artificial Sequence
  Description of Artificial Sequence: Synthetic peptide
  Seed: TQDWVQENY (MAGA4_HUMAN)
TIDWVQENM

SEQ ID NO: 60742 - protein, 9 aa, Artificial Sequence
  Description of Artificial Sequence: Synthetic peptide
  Seed: RVRIAYPSL (MAGA4_HUMAN)
RTRIAYPSW

SEQ ID NO: 60743 - protein, 9 aa, Artificial Sequence
  Description of Artificial Sequence: Synthetic peptide
  Seed: SALPTTISF (MAGA4_HUMAN)
SVLPTTISR

SEQ ID NO: 60744 - protein, 10 aa, Artificial Sequence
  Description of Artificial Sequence: Synthetic peptide
  Seed: GVYDGREHTV (MAGA4_HUMAN)
GMYDGREHTK

SEQ ID NO: 60745 - protein, 9 aa, Artificial Sequence
  Description of Artificial Sequence: Synthetic peptide
  Seed: QIFPKTGLL (MAGA4_HUMAN)
QVFPKTGLW

SEQ ID NO: 60746 - protein, 9 aa, Artificial Sequence
  Description of Artificial Sequence: Synthetic peptide
  Seed: GSNPARYEF (MAGA4_HUMAN)
GMNPARYEF

SEQ ID NO: 60747 - protein, 9 aa, Artificial Sequence
  Description of Artificial Sequence: Synthetic peptide
  Seed: TTISFTCWR (MAGA4_HUMAN)
TQISFTCWR

SEQ ID NO: 60748 - protein, 9 aa, Artificial Sequence
  Description of Artificial Sequence: Synthetic peptide
  Seed: SALPTTISF (MAGA4_HUMAN)
SLLPTTISW

SEQ ID NO: 60749 - protein, 9 aa, Artificial Sequence
  Description of Artificial Sequence: Synthetic peptide
  Seed: AQEEALGLV (MAGA4_HUMAN)
AEEEALGLT

SEQ ID NO: 60750 - protein, 10 aa, Artificial Sequence
  Description of Artificial Sequence: Synthetic peptide
  Seed: GVYDGREHTV (MAGA4_HUMAN)
GTYDGREHTV

SEQ ID NO: 60751 - protein, 9 aa, Artificial Sequence
  Description of Artificial Sequence: Synthetic peptide
  Seed: RQVPGSNPA (MAGA4_HUMAN)
RQVPGSNPW

SEQ ID NO: 60752 - protein, 9 aa, Artificial Sequence
  Description of Artificial Sequence: Synthetic peptide
  Seed: RVRIAYPSL (MAGA4_HUMAN)
RARIAYPST

SEQ ID NO: 60753 - protein, 9 aa, Artificial Sequence
  Description of Artificial Sequence: Synthetic peptide
  Seed: QVPGSNPAR (MAGA4_HUMAN)
QAPGSNPAL

SEQ ID NO: 60754 - protein, 11 aa, Artificial Sequence
  Description of Artificial Sequence: Synthetic peptide
  Seed: RVRIAYPSLRE (MAGA4_HUMAN)
RIRIAYPSLRK

SEQ ID NO: 60755 - protein, 10 aa, Artificial Sequence
  Description of Artificial Sequence: Synthetic peptide
  Seed: RVRIAYPSLR (MAGA4_HUMAN)
RTRIAYPSLA

SEQ ID NO: 60756 - protein, 9 aa, Artificial Sequence
  Description of Artificial Sequence: Synthetic peptide
  Seed: RCFPVIFGK (MAGA4_HUMAN)
RTFPVIFGV

SEQ ID NO: 60757 - protein, 9 aa, Artificial Sequence
  Description of Artificial Sequence: Synthetic peptide
  Seed: NTYTLVTCL (MAGA4_HUMAN)
NIYTLVTCF

SEQ ID NO: 60758 - protein, 10 aa, Artificial Sequence
  Description of Artificial Sequence: Synthetic peptide
  Seed: TVYGEPRKLL (MAGA4_HUMAN)
TAYGEPRKLY

SEQ ID NO: 60759 - protein, 10 aa, Artificial Sequence
  Description of Artificial Sequence: Synthetic peptide
  Seed: ARVRIAYPSL (MAGA4_HUMAN)
AKVRIAYPSV

SEQ ID NO: 60760 - protein, 9 aa, Artificial Sequence
  Description of Artificial Sequence: Synthetic peptide
  Seed: RAKELVTKA (MAGA4_HUMAN)
RPKELVTKP

SEQ ID NO: 60761 - protein, 9 aa, Artificial Sequence
  Description of Artificial Sequence: Synthetic peptide
  Seed: WVQENYLEY (MAGA4_HUMAN)
WWQENYLEL

SEQ ID NO: 60762 - protein, 10 aa, Artificial Sequence
  Description of Artificial Sequence: Synthetic peptide
  Seed: RQVPGSNPAR (MAGA4_HUMAN)
RKVPGSNPAY

SEQ ID NO: 60763 - protein, 10 aa, Artificial Sequence
  Description of Artificial Sequence: Synthetic peptide
  Seed: SSSPLVPGTL (MAGA4_HUMAN)
SQSPLVPGTV

SEQ ID NO: 60764 - protein, 9 aa, Artificial Sequence
  Description of Artificial Sequence: Synthetic peptide
  Seed: EVDPASNTY (MAGA4_HUMAN)
EIDPASNTR

SEQ ID NO: 60765 - protein, 9 aa, Artificial Sequence
  Description of Artificial Sequence: Synthetic peptide
  Seed: FGKASESLK (MAGA4_HUMAN)
FSKASESLR

SEQ ID NO: 60766 - protein, 9 aa, Artificial Sequence
  Description of Artificial Sequence: Synthetic peptide
  Seed: RVRIAYPSL (MAGA4_HUMAN)
RWRIAYPSR

SEQ ID NO: 60767 - protein, 9 aa, Artificial Sequence
  Description of Artificial Sequence: Synthetic peptide
  Seed: RVRIAYPSL (MAGA4_HUMAN)
RARIAYPSC

SEQ ID NO: 60768 - protein, 9 aa, Artificial Sequence
  Description of Artificial Sequence: Synthetic peptide
  Seed: TVYGEPRKL (MAGA4_HUMAN)
TGYGEPRKY

SEQ ID NO: 60769 - protein, 10 aa, Artificial Sequence
  Description of Artificial Sequence: Synthetic peptide
  Seed: YPSLREAALL (MAGA4_HUMAN)
YDSLREAALY

SEQ ID NO: 60770 - protein, 9 aa, Artificial Sequence
  Description of Artificial Sequence: Synthetic peptide
  Seed: TVYGEPRKL (MAGA4_HUMAN)
TQYGEPRKW

SEQ ID NO: 60771 - protein, 9 aa, Artificial Sequence
  Description of Artificial Sequence: Synthetic peptide
  Seed: VRIAYPSLR (MAGA4_HUMAN)
VLIAYPSLR

SEQ ID NO: 60772 - protein, 10 aa, Artificial Sequence
  Description of Artificial Sequence: Synthetic peptide
  Seed: KVLEHVVRVN (MAGA4_HUMAN)
KMLEHVVRVE

SEQ ID NO: 60773 - protein, 11 aa, Artificial Sequence
  Description of Artificial Sequence: Synthetic peptide
  Seed: RVNARVRIAYP (MAGA4_HUMAN)
RYNARVRIAYA

SEQ ID NO: 60774 - protein, 9 aa, Artificial Sequence
  Description of Artificial Sequence: Synthetic peptide
  Seed: IIVLGTIAM (MAGA4_HUMAN)
IVVLGTIAM

SEQ ID NO: 60775 - protein, 9 aa, Artificial Sequence
  Description of Artificial Sequence: Synthetic peptide
  Seed: KVDELAHFL (MAGA4_HUMAN)
KQDELAHFV

SEQ ID NO: 60776 - protein, 10 aa, Artificial Sequence
  Description of Artificial Sequence: Synthetic peptide
  Seed: TSYVKVLEHV (MAGA4_HUMAN)
TTYVKVLEHV

SEQ ID NO: 60777 - protein, 10 aa, Artificial Sequence
  Description of Artificial Sequence: Synthetic peptide
  Seed: YPSLREAALL (MAGA4_HUMAN)
YWSLREAALY

SEQ ID NO: 60778 - protein, 9 aa, Artificial Sequence
  Description of Artificial Sequence: Synthetic peptide
  Seed: LVPGTLEEV (MAGA4_HUMAN)
LLPGTLEEL

SEQ ID NO: 60779 - protein, 9 aa, Artificial Sequence
  Description of Artificial Sequence: Synthetic peptide
  Seed: EHTVYGEPR (MAGA4_HUMAN)
EVTVYGEPR

SEQ ID NO: 60780 - protein, 9 aa, Artificial Sequence
  Description of Artificial Sequence: Synthetic peptide
  Seed: LEEVPAAES (MAGA4_HUMAN)
LEEVPAAEA

SEQ ID NO: 60781 - protein, 10 aa, Artificial Sequence
  Description of Artificial Sequence: Synthetic peptide
  Seed: AAVSSSSPLV (MAGA4_HUMAN)
AIVSSSSPLV

SEQ ID NO: 60782 - protein, 9 aa, Artificial Sequence
  Description of Artificial Sequence: Synthetic peptide
  Seed: RQVPGSNPA (MAGA4_HUMAN)
RSVPGSNPF

SEQ ID NO: 60783 - protein, 9 aa, Artificial Sequence
  Description of Artificial Sequence: Synthetic peptide
  Seed: IAYPSLREA (MAGA4_HUMAN)
INYPSLREL

SEQ ID NO: 60784 - protein, 9 aa, Artificial Sequence
  Description of Artificial Sequence: Synthetic peptide
  Seed: AAVSSSSPL (MAGA4_HUMAN)
AMVSSSSPA

SEQ ID NO: 60785 - protein, 9 aa, Artificial Sequence
  Description of Artificial Sequence: Synthetic peptide
  Seed: KNYKRCFPV (MAGA4_HUMAN)
KSYKRCFPY

SEQ ID NO: 60786 - protein, 11 aa, Artificial Sequence
  Description of Artificial Sequence: Synthetic peptide
  Seed: SPQGASALPTT (MAGA4_HUMAN)
SPQGASALPTC

SEQ ID NO: 60787 - protein, 9 aa, Artificial Sequence
  Description of Artificial Sequence: Synthetic peptide
  Seed: KVDELAHFL (MAGA4_HUMAN)
KWDELAHFY

SEQ ID NO: 60788 - protein, 9 aa, Artificial Sequence
  Description of Artificial Sequence: Synthetic peptide
  Seed: KVDELAHFL (MAGA4_HUMAN)
KIDELAHFM

SEQ ID NO: 60789 - protein, 11 aa, Artificial Sequence
  Description of Artificial Sequence: Synthetic peptide
  Seed: GVYDGREHTVY (MAGA4_HUMAN)
GEYDGREHTVY

SEQ ID NO: 60790 - protein, 10 aa, Artificial Sequence
  Description of Artificial Sequence: Synthetic peptide
  Seed: STSPDAESLF (MAGA4_HUMAN)
SSSPDAESLF

SEQ ID NO: 60791 - protein, 9 aa, Artificial Sequence
  Description of Artificial Sequence: Synthetic peptide
  Seed: YTLVTCLGL (MAGA4_HUMAN)
YALVTCLGM

SEQ ID NO: 60792 - protein, 9 aa, Artificial Sequence
  Description of Artificial Sequence: Synthetic peptide
  Seed: AAVSSSSPL (MAGA4_HUMAN)
ALVSSSSPL

SEQ ID NO: 60793 - protein, 9 aa, Artificial Sequence
  Description of Artificial Sequence: Synthetic peptide
  Seed: DELAHFLLR (MAGA4_HUMAN)
DALAHFLLK

SEQ ID NO: 60794 - protein, 10 aa, Artificial Sequence
  Description of Artificial Sequence: Synthetic peptide
  Seed: QVPGSNPARY (MAGA4_HUMAN)
QIPGSNPARR

SEQ ID NO: 60795 - protein, 10 aa, Artificial Sequence
  Description of Artificial Sequence: Synthetic peptide
  Seed: KVDELAHFLL (MAGA4_HUMAN)
KMDELAHFLS

SEQ ID NO: 60796 - protein, 10 aa, Artificial Sequence
  Description of Artificial Sequence: Synthetic peptide
  Seed: VDPASNTYTL (MAGA4_HUMAN)
VSPASNTYTY

SEQ ID NO: 60797 - protein, 11 aa, Artificial Sequence
  Description of Artificial Sequence: Synthetic peptide
  Seed: SYDGLLGNNQI (MAGA4_HUMAN)
SIDGLLGNNQL

SEQ ID NO: 60798 - protein, 10 aa, Artificial Sequence
  Description of Artificial Sequence: Synthetic peptide
  Seed: ESAGPPQSPQ (MAGA4_HUMAN)
EQAGPPQSPR

SEQ ID NO: 60799 - protein, 11 aa, Artificial Sequence
  Description of Artificial Sequence: Synthetic peptide
  Seed: KNYKRCFPVIF (MAGA4_HUMAN)
KQYKRCFPVIY

SEQ ID NO: 60800 - protein, 9 aa, Artificial Sequence
  Description of Artificial Sequence: Synthetic peptide
  Seed: YKRCFPVIF (MAGA4_HUMAN)
YMRCFPVIL

SEQ ID NO: 60801 - protein, 10 aa, Artificial Sequence
  Description of Artificial Sequence: Synthetic peptide
  Seed: ELAHFLLRKY (MAGA4_HUMAN)
ESAHFLLRKK

SEQ ID NO: 60802 - protein, 9 aa, Artificial Sequence
  Description of Artificial Sequence: Synthetic peptide
  Seed: REHTVYGEP (MAGA4_HUMAN)
REHTVYGEV

SEQ ID NO: 60803 - protein, 9 aa, Artificial Sequence
  Description of Artificial Sequence: Synthetic peptide
  Seed: YKRCFPVIF (MAGA4_HUMAN)
YRRCFPVIL

SEQ ID NO: 60804 - protein, 10 aa, Artificial Sequence
  Description of Artificial Sequence: Synthetic peptide
  Seed: KNYKRCFPVI (MAGA4_HUMAN)
KAYKRCFPVF

SEQ ID NO: 60805 - protein, 9 aa, Artificial Sequence
  Description of Artificial Sequence: Synthetic peptide
  Seed: RCFPVIFGK (MAGA4_HUMAN)
RTFPVIFGL

SEQ ID NO: 60806 - protein, 11 aa, Artificial Sequence
  Description of Artificial Sequence: Synthetic peptide
  Seed: AQAPTTEEQEA (MAGA4_HUMAN)
ALAPTTEEQEL

SEQ ID NO: 60807 - protein, 10 aa, Artificial Sequence
  Description of Artificial Sequence: Synthetic peptide
  Seed: YRAKELVTKA (MAGA4_HUMAN)
YRAKELVTKY

SEQ ID NO: 60808 - protein, 9 aa, Artificial Sequence
  Description of Artificial Sequence: Synthetic peptide
  Seed: VVRVNARVR (MAGA4_HUMAN)
VTRVNARVA

SEQ ID NO: 60809 - protein, 10 aa, Artificial Sequence
  Description of Artificial Sequence: Synthetic peptide
  Seed: YRQVPGSNPA (MAGA4_HUMAN)
YGQVPGSNPV

SEQ ID NO: 60810 - protein, 9 aa, Artificial Sequence
  Description of Artificial Sequence: Synthetic peptide
  Seed: IAYPSLREA (MAGA4_HUMAN)
IPYPSLREI

SEQ ID NO: 60811 - protein, 9 aa, Artificial Sequence
  Description of Artificial Sequence: Synthetic peptide
  Seed: GVMGVYDGR (MAGA4_HUMAN)
GFMGVYDGR

SEQ ID NO: 60812 - protein, 9 aa, Artificial Sequence
  Description of Artificial Sequence: Synthetic peptide
  Seed: VYDGREHTV (MAGA4_HUMAN)
VFDGREHTW

SEQ ID NO: 60813 - protein, 10 aa, Artificial Sequence
  Description of Artificial Sequence: Synthetic peptide
  Seed: YRQVPGSNPA (MAGA4_HUMAN)
YRQVPGSNPY

SEQ ID NO: 60814 - protein, 9 aa, Artificial Sequence
  Description of Artificial Sequence: Synthetic peptide
  Seed: IAMEGDSAS (MAGA4_HUMAN)
IIMEGDSAY

SEQ ID NO: 60815 - protein, 9 aa, Artificial Sequence
  Description of Artificial Sequence: Synthetic peptide
  Seed: RVRIAYPSL (MAGA4_HUMAN)
RMRIAYPSQ

SEQ ID NO: 60816 - protein, 9 aa, Artificial Sequence
  Description of Artificial Sequence: Synthetic peptide
  Seed: KNYKRCFPV (MAGA4_HUMAN)
KVYKRCFPV

SEQ ID NO: 60817 - protein, 9 aa, Artificial Sequence
  Description of Artificial Sequence: Synthetic peptide
  Seed: IAYPSLREA (MAGA4_HUMAN)
IMYPSLREY

SEQ ID NO: 60818 - protein, 9 aa, Artificial Sequence
  Description of Artificial Sequence: Synthetic peptide
  Seed: SSSPLVPGT (MAGA4_HUMAN)
STSPLVPGI

SEQ ID NO: 60819 - protein, 9 aa, Artificial Sequence
  Description of Artificial Sequence: Synthetic peptide
  Seed: TQDWVQENY (MAGA4_HUMAN)
TLDWVQENI

SEQ ID NO: 60820 - protein, 9 aa, Artificial Sequence
  Description of Artificial Sequence: Synthetic peptide
  Seed: AHFLLRKYR (MAGA4_HUMAN)
AQFLLRKYR

SEQ ID NO: 60821 - protein, 10 aa, Artificial Sequence
  Description of Artificial Sequence: Synthetic peptide
  Seed: YRQVPGSNPA (MAGA4_HUMAN)
YIQVPGSNPI

SEQ ID NO: 60822 - protein, 9 aa, Artificial Sequence
  Description of Artificial Sequence: Synthetic peptide
  Seed: AAVSSSSPL (MAGA4_HUMAN)
APVSSSSPI

SEQ ID NO: 60823 - protein, 10 aa, Artificial Sequence
  Description of Artificial Sequence: Synthetic peptide
  Seed: RVRIAYPSLR (MAGA4_HUMAN)
RTRIAYPSLF

SEQ ID NO: 60824 - protein, 10 aa, Artificial Sequence
  Description of Artificial Sequence: Synthetic peptide
  Seed: KYRAKELVTK (MAGA4_HUMAN)
KSRAKELVTV

SEQ ID NO: 60825 - protein, 9 aa, Artificial Sequence
  Description of Artificial Sequence: Synthetic peptide
  Seed: SALPTTISF (MAGA4_HUMAN)
SPLPTTISA

SEQ ID NO: 60826 - protein, 10 aa, Artificial Sequence
  Description of Artificial Sequence: Synthetic peptide
  Seed: KYRAKELVTK (MAGA4_HUMAN)
KFRAKELVTA

SEQ ID NO: 60827 - protein, 9 aa, Artificial Sequence
  Description of Artificial Sequence: Synthetic peptide
  Seed: RVRIAYPSL (MAGA4_HUMAN)
RVRIAYPSH

SEQ ID NO: 60828 - protein, 10 aa, Artificial Sequence
  Description of Artificial Sequence: Synthetic peptide
  Seed: LLIIVLGTIA (MAGA4_HUMAN)
LMIIVLGTIV

SEQ ID NO: 60829 - protein, 10 aa, Artificial Sequence
  Description of Artificial Sequence: Synthetic peptide
  Seed: GVYDGREHTV (MAGA4_HUMAN)
GVYDGREHTI

SEQ ID NO: 60830 - protein, 10 aa, Artificial Sequence
  Description of Artificial Sequence: Synthetic peptide
  Seed: SLFREALSNK (MAGA4_HUMAN)
SCFREALSNR

SEQ ID NO: 60831 - protein, 9 aa, Artificial Sequence
  Description of Artificial Sequence: Synthetic peptide
  Seed: SYVKVLEHV (MAGA4_HUMAN)
SFVKVLEHF

SEQ ID NO: 60832 - protein, 9 aa, Artificial Sequence
  Description of Artificial Sequence: Synthetic peptide
  Seed: VNARVRIAY (MAGA4_HUMAN)
VAARVRIAF

SEQ ID NO: 60833 - protein, 10 aa, Artificial Sequence
  Description of Artificial Sequence: Synthetic peptide
  Seed: ARVRIAYPSL (MAGA4_HUMAN)
ASVRIAYPSA

SEQ ID NO: 60834 - protein, 9 aa, Artificial Sequence
  Description of Artificial Sequence: Synthetic peptide
  Seed: DELAHFLLR (MAGA4_HUMAN)
DLLAHFLLR

SEQ ID NO: 60835 - protein, 10 aa, Artificial Sequence
  Description of Artificial Sequence: Synthetic peptide
  Seed: RQVPGSNPAR (MAGA4_HUMAN)
RMVPGSNPAK

SEQ ID NO: 60836 - protein, 9 aa, Artificial Sequence
  Description of Artificial Sequence: Synthetic peptide
  Seed: RVNARVRIA (MAGA4_HUMAN)
RMNARVRIA

SEQ ID NO: 60837 - protein, 9 aa, Artificial Sequence
  Description of Artificial Sequence: Synthetic peptide
  Seed: RCFPVIFGK (MAGA4_HUMAN)
RSFPVIFGY

SEQ ID NO: 60838 - protein, 9 aa, Artificial Sequence
  Description of Artificial Sequence: Synthetic peptide
  Seed: KNYKRCFPV (MAGA4_HUMAN)
KSYKRCFPK

SEQ ID NO: 60839 - protein, 11 aa, Artificial Sequence
  Description of Artificial Sequence: Synthetic peptide
  Seed: RQVPGSNPARY (MAGA4_HUMAN)
RTVPGSNPARW

SEQ ID NO: 60840 - protein, 11 aa, Artificial Sequence
  Description of Artificial Sequence: Synthetic peptide
  Seed: GLLGNNQIFPK (MAGA4_HUMAN)
GSLGNNQIFPK

SEQ ID NO: 60841 - protein, 10 aa, Artificial Sequence
  Description of Artificial Sequence: Synthetic peptide
  Seed: TEEQEAAVSS (MAGA4_HUMAN)
TEEQEAAVSA

SEQ ID NO: 60842 - protein, 10 aa, Artificial Sequence
  Description of Artificial Sequence: Synthetic peptide
  Seed: YRQVPGSNPA (MAGA4_HUMAN)
YAQVPGSNPY

SEQ ID NO: 60843 - protein, 9 aa, Artificial Sequence
  Description of Artificial Sequence: Synthetic peptide
  Seed: TVYGEPRKL (MAGA4_HUMAN)
TVYGEPRKM

SEQ ID NO: 60844 - protein, 10 aa, Artificial Sequence
  Description of Artificial Sequence: Synthetic peptide
  Seed: VDPASNTYTL (MAGA4_HUMAN)
VFPASNTYTM

SEQ ID NO: 60845 - protein, 9 aa, Artificial Sequence
  Description of Artificial Sequence: Synthetic peptide
  Seed: ELAHFLLRK (MAGA4_HUMAN)
EGAHFLLRK

SEQ ID NO: 60846 - protein, 10 aa, Artificial Sequence
  Description of Artificial Sequence: Synthetic peptide
  Seed: EAAVSSSSPL (MAGA4_HUMAN)
ELAVSSSSPV

SEQ ID NO: 60847 - protein, 9 aa, Artificial Sequence
  Description of Artificial Sequence: Synthetic peptide
  Seed: YPSLREAAL (MAGA4_HUMAN)
YLSLREAAM

SEQ ID NO: 60848 - protein, 9 aa, Artificial Sequence
  Description of Artificial Sequence: Synthetic peptide
  Seed: FPKTGLLII (MAGA4_HUMAN)
FPKTGLLIT

SEQ ID NO: 60849 - protein, 10 aa, Artificial Sequence
  Description of Artificial Sequence: Synthetic peptide
  Seed: KASESLKMIF (MAGA4_HUMAN)
KSSESLKMIM

SEQ ID NO: 60850 - protein, 9 aa, Artificial Sequence
  Description of Artificial Sequence: Synthetic peptide
  Seed: NYKRCFPVI (MAGA4_HUMAN)
NYKRCFPVM

SEQ ID NO: 60851 - protein, 10 aa, Artificial Sequence
  Description of Artificial Sequence: Synthetic peptide
  Seed: YRQVPGSNPA (MAGA4_HUMAN)
YIQVPGSNPM

SEQ ID NO: 60852 - protein, 10 aa, Artificial Sequence
  Description of Artificial Sequence: Synthetic peptide
  Seed: GVYDGREHTV (MAGA4_HUMAN)
GRYDGREHTY

SEQ ID NO: 60853 - protein, 9 aa, Artificial Sequence
  Description of Artificial Sequence: Synthetic peptide
  Seed: RVRIAYPSL (MAGA4_HUMAN)
RIRIAYPSM

SEQ ID NO: 60854 - protein, 10 aa, Artificial Sequence
  Description of Artificial Sequence: Synthetic peptide
  Seed: TTISFTCWRQ (MAGA4_HUMAN)
TTISFTCWRW

SEQ ID NO: 60855 - protein, 10 aa, Artificial Sequence
  Description of Artificial Sequence: Synthetic peptide
  Seed: KYRAKELVTK (MAGA4_HUMAN)
KSRAKELVTR

SEQ ID NO: 60856 - protein, 9 aa, Artificial Sequence
  Description of Artificial Sequence: Synthetic peptide
  Seed: LGNNQIFPK (MAGA4_HUMAN)
LWNNQIFPK

SEQ ID NO: 60857 - protein, 9 aa, Artificial Sequence
  Description of Artificial Sequence: Synthetic peptide
  Seed: TVYGEPRKL (MAGA4_HUMAN)
TRYGEPRKM

SEQ ID NO: 60858 - protein, 9 aa, Artificial Sequence
  Description of Artificial Sequence: Synthetic peptide
  Seed: KVDELAHFL (MAGA4_HUMAN)
KTDELAHFM

SEQ ID NO: 60859 - protein, 11 aa, Artificial Sequence
  Description of Artificial Sequence: Synthetic peptide
  Seed: YVKVLEHVVRV (MAGA4_HUMAN)
YEKVLEHVVRV

SEQ ID NO: 60860 - protein, 9 aa, Artificial Sequence
  Description of Artificial Sequence: Synthetic peptide
  Seed: SAGPPQSPQ (MAGA4_HUMAN)
SSGPPQSPR

SEQ ID NO: 60861 - protein, 9 aa, Artificial Sequence
  Description of Artificial Sequence: Synthetic peptide
  Seed: SALPTTISF (MAGA4_HUMAN)
SKLPTTISF

SEQ ID NO: 60862 - protein, 9 aa, Artificial Sequence
  Description of Artificial Sequence: Synthetic peptide
  Seed: IFPKTGLLI (MAGA4_HUMAN)
IRPKTGLLL

SEQ ID NO: 60863 - protein, 10 aa, Artificial Sequence
  Description of Artificial Sequence: Synthetic peptide
  Seed: RVRIAYPSLR (MAGA4_HUMAN)
RYRIAYPSLR

SEQ ID NO: 60864 - protein, 11 aa, Artificial Sequence
  Description of Artificial Sequence: Synthetic peptide
  Seed: RVRIAYPSLRE (MAGA4_HUMAN)
RTRIAYPSLRL

SEQ ID NO: 60865 - protein, 9 aa, Artificial Sequence
  Description of Artificial Sequence: Synthetic peptide
  Seed: VNARVRIAY (MAGA4_HUMAN)
VAARVRIAY

SEQ ID NO: 60866 - protein, 9 aa, Artificial Sequence
  Description of Artificial Sequence: Synthetic peptide
  Seed: YKRCFPVIF (MAGA4_HUMAN)
YSRCFPVIF

SEQ ID NO: 60867 - protein, 9 aa, Artificial Sequence
  Description of Artificial Sequence: Synthetic peptide
  Seed: ELAHFLLRK (MAGA4_HUMAN)
EQAHFLLRK

SEQ ID NO: 60868 - protein, 11 aa, Artificial Sequence
  Description of Artificial Sequence: Synthetic peptide
  Seed: KMIFGIDVKEV (MAGA4_HUMAN)
KLIFGIDVKEV

SEQ ID NO: 60869 - protein, 10 aa, Artificial Sequence
  Description of Artificial Sequence: Synthetic peptide
  Seed: YPSLREAALL (MAGA4_HUMAN)
YNSLREAALF

SEQ ID NO: 60870 - protein, 9 aa, Artificial Sequence
  Description of Artificial Sequence: Synthetic peptide
  Seed: KYRAKELVT (MAGA4_HUMAN)
KTRAKELVF

SEQ ID NO: 60871 - protein, 11 aa, Artificial Sequence
  Description of Artificial Sequence: Synthetic peptide
  Seed: RQVPGSNPARY (MAGA4_HUMAN)
RVVPGSNPARF

SEQ ID NO: 60872 - protein, 10 aa, Artificial Sequence
  Description of Artificial Sequence: Synthetic peptide
  Seed: TSYVKVLEHV (MAGA4_HUMAN)
TVYVKVLEHV

SEQ ID NO: 60873 - protein, 9 aa, Artificial Sequence
  Description of Artificial Sequence: Synthetic peptide
  Seed: RVRIAYPSL (MAGA4_HUMAN)
RFRIAYPSK

SEQ ID NO: 60874 - protein, 10 aa, Artificial Sequence
  Description of Artificial Sequence: Synthetic peptide
  Seed: KEVDPASNTY (MAGA4_HUMAN)
KSVDPASNTY

SEQ ID NO: 60875 - protein, 10 aa, Artificial Sequence
  Description of Artificial Sequence: Synthetic peptide
  Seed: FGKASESLKM (MAGA4_HUMAN)
FMKASESLKF

SEQ ID NO: 60876 - protein, 9 aa, Artificial Sequence
  Description of Artificial Sequence: Synthetic peptide
  Seed: SALPTTISF (MAGA4_HUMAN)
STLPTTISI

SEQ ID NO: 60877 - protein, 9 aa, Artificial Sequence
  Description of Artificial Sequence: Synthetic peptide
  Seed: YVKVLEHVV (MAGA4_HUMAN)
YSKVLEHVY

SEQ ID NO: 60878 - protein, 10 aa, Artificial Sequence
  Description of Artificial Sequence: Synthetic peptide
  Seed: EEQEAAVSSS (MAGA4_HUMAN)
EEQEAAVSSI

SEQ ID NO: 60879 - protein, 9 aa, Artificial Sequence
  Description of Artificial Sequence: Synthetic peptide
  Seed: EVDPASNTY (MAGA4_HUMAN)
EGDPASNTF

SEQ ID NO: 60880 - protein, 9 aa, Artificial Sequence
  Description of Artificial Sequence: Synthetic peptide
  Seed: SQEEEGPST (MAGA4_HUMAN)
SEEEEGPSV

SEQ ID NO: 60881 - protein, 10 aa, Artificial Sequence
  Description of Artificial Sequence: Synthetic peptide
  Seed: TTISFTCWRQ (MAGA4_HUMAN)
TTISFTCWRM

SEQ ID NO: 60882 - protein, 9 aa, Artificial Sequence
  Description of Artificial Sequence: Synthetic peptide
  Seed: AYPSLREAA (MAGA4_HUMAN)
AYPSLREAV

SEQ ID NO: 60883 - protein, 9 aa, Artificial Sequence
  Description of Artificial Sequence: Synthetic peptide
  Seed: SALPTTISF (MAGA4_HUMAN)
SRLPTTISF

SEQ ID NO: 60884 - protein, 11 aa, Artificial Sequence
  Description of Artificial Sequence: Synthetic peptide
  Seed: SSSSPLVPGTL (MAGA4_HUMAN)
SSSSPLVPGTW

SEQ ID NO: 60885 - protein, 10 aa, Artificial Sequence
  Description of Artificial Sequence: Synthetic peptide
  Seed: TSPDAESLFR (MAGA4_HUMAN)
TSPDAESLFY

SEQ ID NO: 60886 - protein, 11 aa, Artificial Sequence
  Description of Artificial Sequence: Synthetic peptide
  Seed: VPGSNPARYEF (MAGA4_HUMAN)
VPGSNPARYEL

SEQ ID NO: 60887 - protein, 9 aa, Artificial Sequence
  Description of Artificial Sequence: Synthetic peptide
  Seed: RCFPVIFGK (MAGA4_HUMAN)
RIFPVIFGM

SEQ ID NO: 60888 - protein, 9 aa, Artificial Sequence
  Description of Artificial Sequence: Synthetic peptide
  Seed: TVYGEPRKL (MAGA4_HUMAN)
TTYGEPRKL

SEQ ID NO: 60889 - protein, 9 aa, Artificial Sequence
  Description of Artificial Sequence: Synthetic peptide
  Seed: TSPDAESLF (MAGA4_HUMAN)
TLPDAESLM

SEQ ID NO: 60890 - protein, 9 aa, Artificial Sequence
  Description of Artificial Sequence: Synthetic peptide
  Seed: NYKRCFPVI (MAGA4_HUMAN)
NFKRCFPVF

SEQ ID NO: 60891 - protein, 9 aa, Artificial Sequence
  Description of Artificial Sequence: Synthetic peptide
  Seed: RVRIAYPSL (MAGA4_HUMAN)
RPRIAYPSL

SEQ ID NO: 60892 - protein, 9 aa, Artificial Sequence
  Description of Artificial Sequence: Synthetic peptide
  Seed: IIVLGTIAM (MAGA4_HUMAN)
IGVLGTIAL

SEQ ID NO: 60893 - protein, 9 aa, Artificial Sequence
  Description of Artificial Sequence: Synthetic peptide
  Seed: TSPDAESLF (MAGA4_HUMAN)
TYPDAESLL

SEQ ID NO: 60894 - protein, 10 aa, Artificial Sequence
  Description of Artificial Sequence: Synthetic peptide
  Seed: KNYKRCFPVI (MAGA4_HUMAN)
KHYKRCFPVF

SEQ ID NO: 60895 - protein, 11 aa, Artificial Sequence
  Description of Artificial Sequence: Synthetic peptide
  Seed: AYPSLREAALL (MAGA4_HUMAN)
AYPSLREAALW

SEQ ID NO: 60896 - protein, 10 aa, Artificial Sequence
  Description of Artificial Sequence: Synthetic peptide
  Seed: SYVKVLEHVV (MAGA4_HUMAN)
SYVKVLEHVW

SEQ ID NO: 60897 - protein, 9 aa, Artificial Sequence
  Description of Artificial Sequence: Synthetic peptide
  Seed: HVVRVNARV (MAGA4_HUMAN)
HVVRVNARR

SEQ ID NO: 60898 - protein, 9 aa, Artificial Sequence
  Description of Artificial Sequence: Synthetic peptide
  Seed: YRAKELVTK (MAGA4_HUMAN)
YHAKELVTY

SEQ ID NO: 60899 - protein, 9 aa, Artificial Sequence
  Description of Artificial Sequence: Synthetic peptide
  Seed: SALPTTISF (MAGA4_HUMAN)
SGLPTTISL

SEQ ID NO: 60900 - protein, 9 aa, Artificial Sequence
  Description of Artificial Sequence: Synthetic peptide
  Seed: KVLEHVVRV (MAGA4_HUMAN)
KLLEHVVRC

SEQ ID NO: 60901 - protein, 9 aa, Artificial Sequence
  Description of Artificial Sequence: Synthetic peptide
  Seed: LAHFLLRKY (MAGA4_HUMAN)
LAHFLLRKL

SEQ ID NO: 60902 - protein, 9 aa, Artificial Sequence
  Description of Artificial Sequence: Synthetic peptide
  Seed: VYDGREHTV (MAGA4_HUMAN)
VLDGREHTW

SEQ ID NO: 60903 - protein, 9 aa, Artificial Sequence
  Description of Artificial Sequence: Synthetic peptide
  Seed: AAVSSSSPL (MAGA4_HUMAN)
ARVSSSSPL

SEQ ID NO: 60904 - protein, 9 aa, Artificial Sequence
  Description of Artificial Sequence: Synthetic peptide
  Seed: AAVSSSSPL (MAGA4_HUMAN)
ANVSSSSPM

SEQ ID NO: 60905 - protein, 10 aa, Artificial Sequence
  Description of Artificial Sequence: Synthetic peptide
  Seed: KNYKRCFPVI (MAGA4_HUMAN)
KTYKRCFPVK

SEQ ID NO: 60906 - protein, 10 aa, Artificial Sequence
  Description of Artificial Sequence: Synthetic peptide
  Seed: RVRIAYPSLR (MAGA4_HUMAN)
RKRIAYPSLY

SEQ ID NO: 60907 - protein, 10 aa, Artificial Sequence
  Description of Artificial Sequence: Synthetic peptide
  Seed: VIFGKASESL (MAGA4_HUMAN)
VMFGKASESV

SEQ ID NO: 60908 - protein, 10 aa, Artificial Sequence
  Description of Artificial Sequence: Synthetic peptide
  Seed: EAAVSSSSPL (MAGA4_HUMAN)
ERAVSSSSPV

SEQ ID NO: 60909 - protein, 11 aa, Artificial Sequence
  Description of Artificial Sequence: Synthetic peptide
  Seed: SASEEEIWEEL (MAGA4_HUMAN)
SMSEEEIWEEF

SEQ ID NO: 60910 - protein, 11 aa, Artificial Sequence
  Description of Artificial Sequence: Synthetic peptide
  Seed: GASALPTTISF (MAGA4_HUMAN)
GASALPTTISW

SEQ ID NO: 60911 - protein, 10 aa, Artificial Sequence
  Description of Artificial Sequence: Synthetic peptide
  Seed: KNYKRCFPVI (MAGA4_HUMAN)
KYYKRCFPVF

SEQ ID NO: 60912 - protein, 10 aa, Artificial Sequence
  Description of Artificial Sequence: Synthetic peptide
  Seed: KASESLKMIF (MAGA4_HUMAN)
KTSESLKMIW

SEQ ID NO: 60913 - protein, 9 aa, Artificial Sequence
  Description of Artificial Sequence: Synthetic peptide
  Seed: AAVSSSSPL (MAGA4_HUMAN)
AQVSSSSPW

SEQ ID NO: 60914 - protein, 8 aa, Artificial Sequence
  Description of Artificial Sequence: Synthetic peptide
  Seed: RVRIAYPS (MAGA4_HUMAN)
RTRIAYPK

SEQ ID NO: 60915 - protein, 10 aa, Artificial Sequence
  Description of Artificial Sequence: Synthetic peptide
  Seed: RVRIAYPSLR (MAGA4_HUMAN)
RFRIAYPSLR

SEQ ID NO: 60916 - protein, 9 aa, Artificial Sequence
  Description of Artificial Sequence: Synthetic peptide
  Seed: RAKELVTKA (MAGA4_HUMAN)
RQKELVTKK

SEQ ID NO: 60917 - protein, 9 aa, Artificial Sequence
  Description of Artificial Sequence: Synthetic peptide
  Seed: KELVTKAEM (MAGA4_HUMAN)
KELVTKAEI

SEQ ID NO: 60918 - protein, 10 aa, Artificial Sequence
  Description of Artificial Sequence: Synthetic peptide
  Seed: YRQVPGSNPA (MAGA4_HUMAN)
YKQVPGSNPY

SEQ ID NO: 60919 - protein, 10 aa, Artificial Sequence
  Description of Artificial Sequence: Synthetic peptide
  Seed: RVNARVRIAY (MAGA4_HUMAN)
RVNARVRIAK

SEQ ID NO: 60920 - protein, 10 aa, Artificial Sequence
  Description of Artificial Sequence: Synthetic peptide
  Seed: KEVDPASNTY (MAGA4_HUMAN)
KVVDPASNTY

SEQ ID NO: 60921 - protein, 10 aa, Artificial Sequence
  Description of Artificial Sequence: Synthetic peptide
  Seed: GVYDGREHTV (MAGA4_HUMAN)
GTYDGREHTR

SEQ ID NO: 60922 - protein, 9 aa, Artificial Sequence
  Description of Artificial Sequence: Synthetic peptide
  Seed: TTEEQEAAV (MAGA4_HUMAN)
TMEEQEAAM

SEQ ID NO: 60923 - protein, 9 aa, Artificial Sequence
  Description of Artificial Sequence: Synthetic peptide
  Seed: GLLGNNQIF (MAGA4_HUMAN)
GQLGNNQIF

SEQ ID NO: 60924 - protein, 9 aa, Artificial Sequence
  Description of Artificial Sequence: Synthetic peptide
  Seed: GKASESLKM (MAGA4_HUMAN)
GKASESLKY

SEQ ID NO: 60925 - protein, 9 aa, Artificial Sequence
  Description of Artificial Sequence: Synthetic peptide
  Seed: GDSASEEEI (MAGA4_HUMAN)
GESASEEEV

SEQ ID NO: 60926 - protein, 9 aa, Artificial Sequence
  Description of Artificial Sequence: Synthetic peptide
  Seed: GSNPARYEF (MAGA4_HUMAN)
GRNPARYEM

SEQ ID NO: 60927 - protein, 10 aa, Artificial Sequence
  Description of Artificial Sequence: Synthetic peptide
  Seed: FPKTGLLIIV (MAGA4_HUMAN)
FPKTGLLIIL

SEQ ID NO: 60928 - protein, 9 aa, Artificial Sequence
  Description of Artificial Sequence: Synthetic peptide
  Seed: VNARVRIAY (MAGA4_HUMAN)
VEARVRIAY

SEQ ID NO: 60929 - protein, 9 aa, Artificial Sequence
  Description of Artificial Sequence: Synthetic peptide
  Seed: RVRIAYPSL (MAGA4_HUMAN)
RARIAYPSK

SEQ ID NO: 60930 - protein, 9 aa, Artificial Sequence
  Description of Artificial Sequence: Synthetic peptide
  Seed: KASESLKMI (MAGA4_HUMAN)
KSSESLKMF

SEQ ID NO: 60931 - protein, 10 aa, Artificial Sequence
  Description of Artificial Sequence: Synthetic peptide
  Seed: LLGNNQIFPK (MAGA4_HUMAN)
LVGNNQIFPK

SEQ ID NO: 60932 - protein, 9 aa, Artificial Sequence
  Description of Artificial Sequence: Synthetic peptide
  Seed: YVKVLEHVV (MAGA4_HUMAN)
YTKVLEHVY

SEQ ID NO: 60933 - protein, 9 aa, Artificial Sequence
  Description of Artificial Sequence: Synthetic peptide
  Seed: LEEVPAAES (MAGA4_HUMAN)
LEEVPAAEV

SEQ ID NO: 60934 - protein, 9 aa, Artificial Sequence
  Description of Artificial Sequence: Synthetic peptide
  Seed: SYVKVLEHV (MAGA4_HUMAN)
SRVKVLEHI

SEQ ID NO: 60935 - protein, 10 aa, Artificial Sequence
  Description of Artificial Sequence: Synthetic peptide
  Seed: YPSLREAALL (MAGA4_HUMAN)
YHSLREAALY

SEQ ID NO: 60936 - protein, 8 aa, Artificial Sequence
  Description of Artificial Sequence: Synthetic peptide
  Seed: ASALPTTI (MAGA4_HUMAN)
AAALPTTL

SEQ ID NO: 60937 - protein, 11 aa, Artificial Sequence
  Description of Artificial Sequence: Synthetic peptide
  Seed: KVDELAHFLLR (MAGA4_HUMAN)
KIDELAHFLLR

SEQ ID NO: 60938 - protein, 9 aa, Artificial Sequence
  Description of Artificial Sequence: Synthetic peptide
  Seed: EAQEEALGL (MAGA4_HUMAN)
EVQEEALGF

SEQ ID NO: 60939 - protein, 9 aa, Artificial Sequence
  Description of Artificial Sequence: Synthetic peptide
  Seed: YPSLREAAL (MAGA4_HUMAN)
YISLREAAF

SEQ ID NO: 60940 - protein, 9 aa, Artificial Sequence
  Description of Artificial Sequence: Synthetic peptide
  Seed: KYRAKELVT (MAGA4_HUMAN)
KVRAKELVM

SEQ ID NO: 60941 - protein, 9 aa, Artificial Sequence
  Description of Artificial Sequence: Synthetic peptide
  Seed: RVRIAYPSL (MAGA4_HUMAN)
RARIAYPSN

SEQ ID NO: 60942 - protein, 11 aa, Artificial Sequence
  Description of Artificial Sequence: Synthetic peptide
  Seed: YVKVLEHVVRV (MAGA4_HUMAN)
YGKVLEHVVRV

SEQ ID NO: 60943 - protein, 9 aa, Artificial Sequence
  Description of Artificial Sequence: Synthetic peptide
  Seed: DPASNTYTL (MAGA4_HUMAN)
DHASNTYTL

SEQ ID NO: 60944 - protein, 10 aa, Artificial Sequence
  Description of Artificial Sequence: Synthetic peptide
  Seed: MIFGIDVKEV (MAGA4_HUMAN)
MAFGIDVKEV

SEQ ID NO: 60945 - protein, 10 aa, Artificial Sequence
  Description of Artificial Sequence: Synthetic peptide
  Seed: GLVGAQAPTT (MAGA4_HUMAN)
GLVGAQAPTV

SEQ ID NO: 60946 - protein, 11 aa, Artificial Sequence
  Description of Artificial Sequence: Synthetic peptide
  Seed: EMLERVIKNYK (MAGA4_HUMAN)
EALERVIKNYR

SEQ ID NO: 60947 - protein, 11 aa, Artificial Sequence
  Description of Artificial Sequence: Synthetic peptide
  Seed: AQAPTTEEQEA (MAGA4_HUMAN)
AMAPTTEEQEL

SEQ ID NO: 60948 - protein, 10 aa, Artificial Sequence
  Description of Artificial Sequence: Synthetic peptide
  Seed: KRCFPVIFGK (MAGA4_HUMAN)
KTCFPVIFGK

SEQ ID NO: 60949 - protein, 9 aa, Artificial Sequence
  Description of Artificial Sequence: Synthetic peptide
  Seed: LVPGTLEEV (MAGA4_HUMAN)
LTPGTLEEF

SEQ ID NO: 60950 - protein, 9 aa, Artificial Sequence
  Description of Artificial Sequence: Synthetic peptide
  Seed: KYRAKELVT (MAGA4_HUMAN)
KTRAKELVT

SEQ ID NO: 60951 - protein, 9 aa, Artificial Sequence
  Description of Artificial Sequence: Synthetic peptide
  Seed: AAVSSSSPL (MAGA4_HUMAN)
ATVSSSSPL

SEQ ID NO: 60952 - protein, 10 aa, Artificial Sequence
  Description of Artificial Sequence: Synthetic peptide
  Seed: SSSPLVPGTL (MAGA4_HUMAN)
STSPLVPGTI

SEQ ID NO: 60953 - protein, 10 aa, Artificial Sequence
  Description of Artificial Sequence: Synthetic peptide
  Seed: KEVDPASNTY (MAGA4_HUMAN)
KSVDPASNTM

SEQ ID NO: 60954 - protein, 9 aa, Artificial Sequence
  Description of Artificial Sequence: Synthetic peptide
  Seed: IFPKTGLLI (MAGA4_HUMAN)
IVPKTGLLM

SEQ ID NO: 60955 - protein, 9 aa, Artificial Sequence
  Description of Artificial Sequence: Synthetic peptide
  Seed: KNYKRCFPV (MAGA4_HUMAN)
KVYKRCFPY

SEQ ID NO: 60956 - protein, 10 aa, Artificial Sequence
  Description of Artificial Sequence: Synthetic peptide
  Seed: QVPGSNPARY (MAGA4_HUMAN)
QVPGSNPARR

SEQ ID NO: 60957 - protein, 10 aa, Artificial Sequence
  Description of Artificial Sequence: Synthetic peptide
  Seed: RVRIAYPSLR (MAGA4_HUMAN)
RVRIAYPSLK

SEQ ID NO: 60958 - protein, 10 aa, Artificial Sequence
  Description of Artificial Sequence: Synthetic peptide
  Seed: EAAVSSSSPL (MAGA4_HUMAN)
EAAVSSSSPR

SEQ ID NO: 60959 - protein, 9 aa, Artificial Sequence
  Description of Artificial Sequence: Synthetic peptide
  Seed: WVQENYLEY (MAGA4_HUMAN)
WYQENYLEV

SEQ ID NO: 60960 - protein, 10 aa, Artificial Sequence
  Description of Artificial Sequence: Synthetic peptide
  Seed: LGVMGVYDGR (MAGA4_HUMAN)
LQVMGVYDGR

SEQ ID NO: 60961 - protein, 9 aa, Artificial Sequence
  Description of Artificial Sequence: Synthetic peptide
  Seed: STSPDAESL (MAGA4_HUMAN)
SISPDAESI

SEQ ID NO: 60962 - protein, 11 aa, Artificial Sequence
  Description of Artificial Sequence: Synthetic peptide
  Seed: ESLFREALSNK (MAGA4_HUMAN)
ETLFREALSNK

SEQ ID NO: 60963 - protein, 10 aa, Artificial Sequence
  Description of Artificial Sequence: Synthetic peptide
  Seed: QVPGSNPARY (MAGA4_HUMAN)
QIPGSNPARK

SEQ ID NO: 60964 - protein, 10 aa, Artificial Sequence
  Description of Artificial Sequence: Synthetic peptide
  Seed: VDPASNTYTL (MAGA4_HUMAN)
VGPASNTYTM

SEQ ID NO: 60965 - protein, 8 aa, Artificial Sequence
  Description of Artificial Sequence: Synthetic peptide
  Seed: DELAHFLL (MAGA4_HUMAN)
DELAHFLF

SEQ ID NO: 60966 - protein, 10 aa, Artificial Sequence
  Description of Artificial Sequence: Synthetic peptide
  Seed: RVRIAYPSLR (MAGA4_HUMAN)
RARIAYPSLF

SEQ ID NO: 60967 - protein, 10 aa, Artificial Sequence
  Description of Artificial Sequence: Synthetic peptide
  Seed: GVYDGREHTV (MAGA4_HUMAN)
GVYDGREHTA

SEQ ID NO: 60968 - protein, 9 aa, Artificial Sequence
  Description of Artificial Sequence: Synthetic peptide
  Seed: ALPTTISFT (MAGA4_HUMAN)
AMPTTISFI

SEQ ID NO: 60969 - protein, 9 aa, Artificial Sequence
  Description of Artificial Sequence: Synthetic peptide
  Seed: KVDELAHFL (MAGA4_HUMAN)
KSDELAHFF

SEQ ID NO: 60970 - protein, 10 aa, Artificial Sequence
  Description of Artificial Sequence: Synthetic peptide
  Seed: HVVRVNARVR (MAGA4_HUMAN)
HVVRVNARVK

SEQ ID NO: 60971 - protein, 9 aa, Artificial Sequence
  Description of Artificial Sequence: Synthetic peptide
  Seed: RVRIAYPSL (MAGA4_HUMAN)
RGRIAYPSR

SEQ ID NO: 60972 - protein, 9 aa, Artificial Sequence
  Description of Artificial Sequence: Synthetic peptide
  Seed: NTYTLVTCL (MAGA4_HUMAN)
NAYTLVTCY

SEQ ID NO: 60973 - protein, 9 aa, Artificial Sequence
  Description of Artificial Sequence: Synthetic peptide
  Seed: LPTTISFTC (MAGA4_HUMAN)
LPTTISFTM

SEQ ID NO: 60974 - protein, 9 aa, Artificial Sequence
  Description of Artificial Sequence: Synthetic peptide
  Seed: SNPARYEFL (MAGA4_HUMAN)
SAPARYEFY

SEQ ID NO: 60975 - protein, 10 aa, Artificial Sequence
  Description of Artificial Sequence: Synthetic peptide
  Seed: YRQVPGSNPA (MAGA4_HUMAN)
YEQVPGSNPM

SEQ ID NO: 60976 - protein, 9 aa, Artificial Sequence
  Description of Artificial Sequence: Synthetic peptide
  Seed: STSPDAESL (MAGA4_HUMAN)
SFSPDAESM

SEQ ID NO: 60977 - protein, 9 aa, Artificial Sequence
  Description of Artificial Sequence: Synthetic peptide
  Seed: EIWEELGVM (MAGA4_HUMAN)
EPWEELGVY

SEQ ID NO: 60978 - protein, 9 aa, Artificial Sequence
  Description of Artificial Sequence: Synthetic peptide
  Seed: RQVPGSNPA (MAGA4_HUMAN)
REVPGSNPC

SEQ ID NO: 60979 - protein, 9 aa, Artificial Sequence
  Description of Artificial Sequence: Synthetic peptide
  Seed: TEEQEAAVS (MAGA4_HUMAN)
TEEQEAAVA

SEQ ID NO: 60980 - protein, 9 aa, Artificial Sequence
  Description of Artificial Sequence: Synthetic peptide
  Seed: AHFLLRKYR (MAGA4_HUMAN)
AMFLLRKYK

SEQ ID NO: 60981 - protein, 10 aa, Artificial Sequence
  Description of Artificial Sequence: Synthetic peptide
  Seed: PTTISFTCWR (MAGA4_HUMAN)
PTTISFTCWK

SEQ ID NO: 60982 - protein, 10 aa, Artificial Sequence
  Description of Artificial Sequence: Synthetic peptide
  Seed: RVRIAYPSLR (MAGA4_HUMAN)
RYRIAYPSLG

SEQ ID NO: 60983 - protein, 10 aa, Artificial Sequence
  Description of Artificial Sequence: Synthetic peptide
  Seed: STSPDAESLF (MAGA4_HUMAN)
SASPDAESLY

SEQ ID NO: 60984 - protein, 10 aa, Artificial Sequence
  Description of Artificial Sequence: Synthetic peptide
  Seed: DPASNTYTLV (MAGA4_HUMAN)
DSASNTYTLV

SEQ ID NO: 60985 - protein, 9 aa, Artificial Sequence
  Description of Artificial Sequence: Synthetic peptide
  Seed: RQVPGSNPA (MAGA4_HUMAN)
REVPGSNPF

SEQ ID NO: 60986 - protein, 11 aa, Artificial Sequence
  Description of Artificial Sequence: Synthetic peptide
  Seed: MEGDSASEEEI (MAGA4_HUMAN)
MMGDSASEEEL

SEQ ID NO: 60987 - protein, 10 aa, Artificial Sequence
  Description of Artificial Sequence: Synthetic peptide
  Seed: VDPASNTYTL (MAGA4_HUMAN)
VFPASNTYTY

SEQ ID NO: 60988 - protein, 9 aa, Artificial Sequence
  Description of Artificial Sequence: Synthetic peptide
  Seed: EHTVYGEPR (MAGA4_HUMAN)
EFTVYGEPR

SEQ ID NO: 60989 - protein, 9 aa, Artificial Sequence
  Description of Artificial Sequence: Synthetic peptide
  Seed: VYDGREHTV (MAGA4_HUMAN)
VTDGREHTY

SEQ ID NO: 60990 - protein, 10 aa, Artificial Sequence
  Description of Artificial Sequence: Synthetic peptide
  Seed: VYDGREHTVY (MAGA4_HUMAN)
VIDGREHTVY

SEQ ID NO: 60991 - protein, 10 aa, Artificial Sequence
  Description of Artificial Sequence: Synthetic peptide
  Seed: IAYPSLREAA (MAGA4_HUMAN)
IAYPSLREAL

SEQ ID NO: 60992 - protein, 9 aa, Artificial Sequence
  Description of Artificial Sequence: Synthetic peptide
  Seed: AHFLLRKYR (MAGA4_HUMAN)
ATFLLRKYK

SEQ ID NO: 60993 - protein, 9 aa, Artificial Sequence
  Description of Artificial Sequence: Synthetic peptide
  Seed: NTYTLVTCL (MAGA4_HUMAN)
NLYTLVTCV

SEQ ID NO: 60994 - protein, 10 aa, Artificial Sequence
  Description of Artificial Sequence: Synthetic peptide
  Seed: GVYDGREHTV (MAGA4_HUMAN)
GVYDGREHTW

SEQ ID NO: 60995 - protein, 11 aa, Artificial Sequence
  Description of Artificial Sequence: Synthetic peptide
  Seed: REAALLEEEEG (MAGA4_HUMAN)
REAALLEEEEA

SEQ ID NO: 60996 - protein, 10 aa, Artificial Sequence
  Description of Artificial Sequence: Synthetic peptide
  Seed: ASALPTTISF (MAGA4_HUMAN)
AWALPTTISY

SEQ ID NO: 60997 - protein, 10 aa, Artificial Sequence
  Description of Artificial Sequence: Synthetic peptide
  Seed: AYPSLREAAL (MAGA4_HUMAN)
AHPSLREAAM

SEQ ID NO: 60998 - protein, 9 aa, Artificial Sequence
  Description of Artificial Sequence: Synthetic peptide
  Seed: IAYPSLREA (MAGA4_HUMAN)
IVYPSLREI

SEQ ID NO: 60999 - protein, 9 aa, Artificial Sequence
  Description of Artificial Sequence: Synthetic peptide
  Seed: NKVDELAHF (MAGA4_HUMAN)
NQVDELAHY

SEQ ID NO: 61000 - protein, 10 aa, Artificial Sequence
  Description of Artificial Sequence: Synthetic peptide
  Seed: RVRIAYPSLR (MAGA4_HUMAN)
RPRIAYPSLF

SEQ ID NO: 61001 - protein, 9 aa, Artificial Sequence
  Description of Artificial Sequence: Synthetic peptide
  Seed: VYDGREHTV (MAGA4_HUMAN)
VCDGREHTM

SEQ ID NO: 61002 - protein, 10 aa, Artificial Sequence
  Description of Artificial Sequence: Synthetic peptide
  Seed: TSPDAESLFR (MAGA4_HUMAN)
TTPDAESLFK

SEQ ID NO: 61003 - protein, 10 aa, Artificial Sequence
  Description of Artificial Sequence: Synthetic peptide
  Seed: RQVPGSNPAR (MAGA4_HUMAN)
RTVPGSNPAY

SEQ ID NO: 61004 - protein, 10 aa, Artificial Sequence
  Description of Artificial Sequence: Synthetic peptide
  Seed: KVDELAHFLL (MAGA4_HUMAN)
KMDELAHFLK

SEQ ID NO: 61005 - protein, 9 aa, Artificial Sequence
  Description of Artificial Sequence: Synthetic peptide
  Seed: RQVPGSNPA (MAGA4_HUMAN)
RNVPGSNPY

SEQ ID NO: 61006 - protein, 9 aa, Artificial Sequence
  Description of Artificial Sequence: Synthetic peptide
  Seed: EIWEELGVM (MAGA4_HUMAN)
EMWEELGVF

SEQ ID NO: 61007 - protein, 11 aa, Artificial Sequence
  Description of Artificial Sequence: Synthetic peptide
  Seed: KEVDPASNTYT (MAGA4_HUMAN)
KEVDPASNTYC

SEQ ID NO: 61008 - protein, 10 aa, Artificial Sequence
  Description of Artificial Sequence: Synthetic peptide
  Seed: RVRIAYPSLR (MAGA4_HUMAN)
RLRIAYPSLK

SEQ ID NO: 61009 - protein, 9 aa, Artificial Sequence
  Description of Artificial Sequence: Synthetic peptide
  Seed: SPDAESLFR (MAGA4_HUMAN)
SVDAESLFY

SEQ ID NO: 61010 - protein, 10 aa, Artificial Sequence
  Description of Artificial Sequence: Synthetic peptide
  Seed: HFLLRKYRAK (MAGA4_HUMAN)
HSLLRKYRAR

SEQ ID NO: 61011 - protein, 9 aa, Artificial Sequence
  Description of Artificial Sequence: Synthetic peptide
  Seed: SSSPLVPGT (MAGA4_HUMAN)
SISPLVPGV

SEQ ID NO: 61012 - protein, 9 aa, Artificial Sequence
  Description of Artificial Sequence: Synthetic peptide
  Seed: ALLEEEEGV (MAGA4_HUMAN)
AILEEEEGL

SEQ ID NO: 61013 - protein, 10 aa, Artificial Sequence
  Description of Artificial Sequence: Synthetic peptide
  Seed: VKVLEHVVRV (MAGA4_HUMAN)
VFVLEHVVRV

SEQ ID NO: 61014 - protein, 10 aa, Artificial Sequence
  Description of Artificial Sequence: Synthetic peptide
  Seed: YRQVPGSNPA (MAGA4_HUMAN)
YEQVPGSNPW

SEQ ID NO: 61015 - protein, 10 aa, Artificial Sequence
  Description of Artificial Sequence: Synthetic peptide
  Seed: VDPASNTYTL (MAGA4_HUMAN)
VLPASNTYTM

SEQ ID NO: 61016 - protein, 9 aa, Artificial Sequence
  Description of Artificial Sequence: Synthetic peptide
  Seed: REHTVYGEP (MAGA4_HUMAN)
REHTVYGEF

SEQ ID NO: 61017 - protein, 11 aa, Artificial Sequence
  Description of Artificial Sequence: Synthetic peptide
  Seed: SYDGLLGNNQI (MAGA4_HUMAN)
SADGLLGNNQL

SEQ ID NO: 61018 - protein, 9 aa, Artificial Sequence
  Description of Artificial Sequence: Synthetic peptide
  Seed: RVRIAYPSL (MAGA4_HUMAN)
RMRIAYPSF

SEQ ID NO: 61019 - protein, 9 aa, Artificial Sequence
  Description of Artificial Sequence: Synthetic peptide
  Seed: FPVIFGKAS (MAGA4_HUMAN)
FAVIFGKAF

SEQ ID NO: 61020 - protein, 9 aa, Artificial Sequence
  Description of Artificial Sequence: Synthetic peptide
  Seed: IFPKTGLLI (MAGA4_HUMAN)
IRPKTGLLF

SEQ ID NO: 61021 - protein, 9 aa, Artificial Sequence
  Description of Artificial Sequence: Synthetic peptide
  Seed: KASESLKMI (MAGA4_HUMAN)
KVSESLKMF

SEQ ID NO: 61022 - protein, 9 aa, Artificial Sequence
  Description of Artificial Sequence: Synthetic peptide
  Seed: RVRIAYPSL (MAGA4_HUMAN)
RWRIAYPSG

SEQ ID NO: 61023 - protein, 9 aa, Artificial Sequence
  Description of Artificial Sequence: Synthetic peptide
  Seed: RKYRAKELV (MAGA4_HUMAN)
RQYRAKELY

SEQ ID NO: 61024 - protein, 9 aa, Artificial Sequence
  Description of Artificial Sequence: Synthetic peptide
  Seed: IAYPSLREA (MAGA4_HUMAN)
IMYPSLREL

SEQ ID NO: 61025 - protein, 11 aa, Artificial Sequence
  Description of Artificial Sequence: Synthetic peptide
  Seed: VPAAESAGPPQ (MAGA4_HUMAN)
VPAAESAGPPM

SEQ ID NO: 61026 - protein, 9 aa, Artificial Sequence
  Description of Artificial Sequence: Synthetic peptide
  Seed: TQDWVQENY (MAGA4_HUMAN)
TQDWVQENI

SEQ ID NO: 61027 - protein, 10 aa, Artificial Sequence
  Description of Artificial Sequence: Synthetic peptide
  Seed: YPSLREAALL (MAGA4_HUMAN)
YASLREAALY

SEQ ID NO: 61028 - protein, 11 aa, Artificial Sequence
  Description of Artificial Sequence: Synthetic peptide
  Seed: RQVPGSNPARY (MAGA4_HUMAN)
RQVPGSNPARL

SEQ ID NO: 61029 - protein, 10 aa, Artificial Sequence
  Description of Artificial Sequence: Synthetic peptide
  Seed: TTISFTCWRQ (MAGA4_HUMAN)
TVISFTCWRK

SEQ ID NO: 61030 - protein, 10 aa, Artificial Sequence
  Description of Artificial Sequence: Synthetic peptide
  Seed: KEVDPASNTY (MAGA4_HUMAN)
KAVDPASNTY

SEQ ID NO: 61031 - protein, 11 aa, Artificial Sequence
  Description of Artificial Sequence: Synthetic peptide
  Seed: RQVPGSNPARY (MAGA4_HUMAN)
RQVPGSNPARV

SEQ ID NO: 61032 - protein, 9 aa, Artificial Sequence
  Description of Artificial Sequence: Synthetic peptide
  Seed: YRAKELVTK (MAGA4_HUMAN)
YRAKELVTL

SEQ ID NO: 61033 - protein, 10 aa, Artificial Sequence
  Description of Artificial Sequence: Synthetic peptide
  Seed: RVRIAYPSLR (MAGA4_HUMAN)
RCRIAYPSLY

SEQ ID NO: 61034 - protein, 10 aa, Artificial Sequence
  Description of Artificial Sequence: Synthetic peptide
  Seed: KVDELAHFLL (MAGA4_HUMAN)
KLDELAHFLM

SEQ ID NO: 61035 - protein, 11 aa, Artificial Sequence
  Description of Artificial Sequence: Synthetic peptide
  Seed: QEAAVSSSSPL (MAGA4_HUMAN)
QEAAVSSSSPA

SEQ ID NO: 61036 - protein, 10 aa, Artificial Sequence
  Description of Artificial Sequence: Synthetic peptide
  Seed: IAYPSLREAA (MAGA4_HUMAN)
IPYPSLREAM

SEQ ID NO: 61037 - protein, 10 aa, Artificial Sequence
  Description of Artificial Sequence: Synthetic peptide
  Seed: FGKASESLKM (MAGA4_HUMAN)
FGKASESLKF

SEQ ID NO: 61038 - protein, 11 aa, Artificial Sequence
  Description of Artificial Sequence: Synthetic peptide
  Seed: SLFREALSNKV (MAGA4_HUMAN)
SMFREALSNKK

SEQ ID NO: 61039 - protein, 10 aa, Artificial Sequence
  Description of Artificial Sequence: Synthetic peptide
  Seed: TSPDAESLFR (MAGA4_HUMAN)
TIPDAESLFY

SEQ ID NO: 61040 - protein, 9 aa, Artificial Sequence
  Description of Artificial Sequence: Synthetic peptide
  Seed: RVRIAYPSL (MAGA4_HUMAN)
RSRIAYPSY

SEQ ID NO: 61041 - protein, 8 aa, Artificial Sequence
  Description of Artificial Sequence: Synthetic peptide
  Seed: RVRIAYPS (MAGA4_HUMAN)
RTRIAYPY

SEQ ID NO: 61042 - protein, 9 aa, Artificial Sequence
  Description of Artificial Sequence: Synthetic peptide
  Seed: EVDPASNTY (MAGA4_HUMAN)
EQDPASNTL

SEQ ID NO: 61043 - protein, 9 aa, Artificial Sequence
  Description of Artificial Sequence: Synthetic peptide
  Seed: RVRIAYPSL (MAGA4_HUMAN)
RMRIAYPSG

SEQ ID NO: 61044 - protein, 9 aa, Artificial Sequence
  Description of Artificial Sequence: Synthetic peptide
  Seed: STSPDAESL (MAGA4_HUMAN)
SRSPDAESY

SEQ ID NO: 61045 - protein, 9 aa, Artificial Sequence
  Description of Artificial Sequence: Synthetic peptide
  Seed: RVNARVRIA (MAGA4_HUMAN)
RQNARVRIK

SEQ ID NO: 61046 - protein, 10 aa, Artificial Sequence
  Description of Artificial Sequence: Synthetic peptide
  Seed: KVLEHVVRVN (MAGA4_HUMAN)
KLLEHVVRVT

SEQ ID NO: 61047 - protein, 9 aa, Artificial Sequence
  Description of Artificial Sequence: Synthetic peptide
  Seed: DPASNTYTL (MAGA4_HUMAN)
DLASNTYTY

SEQ ID NO: 61048 - protein, 9 aa, Artificial Sequence
  Description of Artificial Sequence: Synthetic peptide
  Seed: YPSLREAAL (MAGA4_HUMAN)
YLSLREAAF

SEQ ID NO: 61049 - protein, 10 aa, Artificial Sequence
  Description of Artificial Sequence: Synthetic peptide
  Seed: KRCFPVIFGK (MAGA4_HUMAN)
KLCFPVIFGK

SEQ ID NO: 61050 - protein, 9 aa, Artificial Sequence
  Description of Artificial Sequence: Synthetic peptide
  Seed: KVLEHVVRV (MAGA4_HUMAN)
KGLEHVVRY

SEQ ID NO: 61051 - protein, 9 aa, Artificial Sequence
  Description of Artificial Sequence: Synthetic peptide
  Seed: TVYGEPRKL (MAGA4_HUMAN)
TYYGEPRKI

SEQ ID NO: 61052 - protein, 10 aa, Artificial Sequence
  Description of Artificial Sequence: Synthetic peptide
  Seed: VDPASNTYTL (MAGA4_HUMAN)
VGPASNTYTF

SEQ ID NO: 61053 - protein, 10 aa, Artificial Sequence
  Description of Artificial Sequence: Synthetic peptide
  Seed: FGKASESLKM (MAGA4_HUMAN)
FYKASESLKF

SEQ ID NO: 61054 - protein, 9 aa, Artificial Sequence
  Description of Artificial Sequence: Synthetic peptide
  Seed: RVRIAYPSL (MAGA4_HUMAN)
RTRIAYPST

SEQ ID NO: 61055 - protein, 10 aa, Artificial Sequence
  Description of Artificial Sequence: Synthetic peptide
  Seed: VDPASNTYTL (MAGA4_HUMAN)
VDPASNTYTM

SEQ ID NO: 61056 - protein, 9 aa, Artificial Sequence
  Description of Artificial Sequence: Synthetic peptide
  Seed: SNKVDELAH (MAGA4_HUMAN)
SSKVDELAY

SEQ ID NO: 61057 - protein, 9 aa, Artificial Sequence
  Description of Artificial Sequence: Synthetic peptide
  Seed: SQEEEGPST (MAGA4_HUMAN)
SEEEEGPSA

SEQ ID NO: 61058 - protein, 9 aa, Artificial Sequence
  Description of Artificial Sequence: Synthetic peptide
  Seed: VNARVRIAY (MAGA4_HUMAN)
VMARVRIAF

SEQ ID NO: 61059 - protein, 9 aa, Artificial Sequence
  Description of Artificial Sequence: Synthetic peptide
  Seed: KVLEHVVRV (MAGA4_HUMAN)
KWLEHVVRF

SEQ ID NO: 61060 - protein, 9 aa, Artificial Sequence
  Description of Artificial Sequence: Synthetic peptide
  Seed: LPTTISFTC (MAGA4_HUMAN)
LPTTISFTF

SEQ ID NO: 61061 - protein, 9 aa, Artificial Sequence
  Description of Artificial Sequence: Synthetic peptide
  Seed: IFPKTGLLI (MAGA4_HUMAN)
ICPKTGLLL

SEQ ID NO: 61062 - protein, 9 aa, Artificial Sequence
  Description of Artificial Sequence: Synthetic peptide
  Seed: RVRIAYPSL (MAGA4_HUMAN)
RVRIAYPSM

SEQ ID NO: 61063 - protein, 9 aa, Artificial Sequence
  Description of Artificial Sequence: Synthetic peptide
  Seed: STSPDAESL (MAGA4_HUMAN)
SMSPDAESW

SEQ ID NO: 61064 - protein, 9 aa, Artificial Sequence
  Description of Artificial Sequence: Synthetic peptide
  Seed: QIFPKTGLL (MAGA4_HUMAN)
QTFPKTGLY

SEQ ID NO: 61065 - protein, 10 aa, Artificial Sequence
  Description of Artificial Sequence: Synthetic peptide
  Seed: KEVDPASNTY (MAGA4_HUMAN)
KAVDPASNTL

SEQ ID NO: 61066 - protein, 10 aa, Artificial Sequence
  Description of Artificial Sequence: Synthetic peptide
  Seed: SSSPLVPGTL (MAGA4_HUMAN)
SVSPLVPGTL

SEQ ID NO: 61067 - protein, 9 aa, Artificial Sequence
  Description of Artificial Sequence: Synthetic peptide
  Seed: KVLEHVVRV (MAGA4_HUMAN)
KNLEHVVRV

SEQ ID NO: 61068 - protein, 9 aa, Artificial Sequence
  Description of Artificial Sequence: Synthetic peptide
  Seed: NQIFPKTGL (MAGA4_HUMAN)
NQIFPKTGF

SEQ ID NO: 61069 - protein, 9 aa, Artificial Sequence
  Description of Artificial Sequence: Synthetic peptide
  Seed: VNARVRIAY (MAGA4_HUMAN)
VMARVRIAM

SEQ ID NO: 61070 - protein, 9 aa, Artificial Sequence
  Description of Artificial Sequence: Synthetic peptide
  Seed: SALPTTISF (MAGA4_HUMAN)
SPLPTTISI

SEQ ID NO: 61071 - protein, 10 aa, Artificial Sequence
  Description of Artificial Sequence: Synthetic peptide
  Seed: SESLKMIFGI (MAGA4_HUMAN)
SFSLKMIFGW

SEQ ID NO: 61072 - protein, 10 aa, Artificial Sequence
  Description of Artificial Sequence: Synthetic peptide
  Seed: GVYDGREHTV (MAGA4_HUMAN)
GVYDGREHTL

SEQ ID NO: 61073 - protein, 11 aa, Artificial Sequence
  Description of Artificial Sequence: Synthetic peptide
  Seed: RVRIAYPSLRE (MAGA4_HUMAN)
RYRIAYPSLRR

SEQ ID NO: 61074 - protein, 10 aa, Artificial Sequence
  Description of Artificial Sequence: Synthetic peptide
  Seed: EAAVSSSSPL (MAGA4_HUMAN)
EMAVSSSSPR

SEQ ID NO: 61075 - protein, 9 aa, Artificial Sequence
  Description of Artificial Sequence: Synthetic peptide
  Seed: KVDELAHFL (MAGA4_HUMAN)
KTDELAHFI

SEQ ID NO: 61076 - protein, 9 aa, Artificial Sequence
  Description of Artificial Sequence: Synthetic peptide
  Seed: SEEEIWEEL (MAGA4_HUMAN)
SMEEIWEEI

SEQ ID NO: 61077 - protein, 9 aa, Artificial Sequence
  Description of Artificial Sequence: Synthetic peptide
  Seed: SSPLVPGTL (MAGA4_HUMAN)
SEPLVPGTL

SEQ ID NO: 61078 - protein, 10 aa, Artificial Sequence
  Description of Artificial Sequence: Synthetic peptide
  Seed: EHVVRVNARV (MAGA4_HUMAN)
ESVVRVNARV

SEQ ID NO: 61079 - protein, 10 aa, Artificial Sequence
  Description of Artificial Sequence: Synthetic peptide
  Seed: RVRIAYPSLR (MAGA4_HUMAN)
RKRIAYPSLK

SEQ ID NO: 61080 - protein, 9 aa, Artificial Sequence
  Description of Artificial Sequence: Synthetic peptide
  Seed: QIFPKTGLL (MAGA4_HUMAN)
QQFPKTGLF

SEQ ID NO: 61081 - protein, 11 aa, Artificial Sequence
  Description of Artificial Sequence: Synthetic peptide
  Seed: YVKVLEHVVRV (MAGA4_HUMAN)
YMKVLEHVVRI

SEQ ID NO: 61082 - protein, 10 aa, Artificial Sequence
  Description of Artificial Sequence: Synthetic peptide
  Seed: RIAYPSLREA (MAGA4_HUMAN)
RQAYPSLREK

SEQ ID NO: 61083 - protein, 9 aa, Artificial Sequence
  Description of Artificial Sequence: Synthetic peptide
  Seed: QIFPKTGLL (MAGA4_HUMAN)
QQFPKTGLW

SEQ ID NO: 61084 - protein, 9 aa, Artificial Sequence
  Description of Artificial Sequence: Synthetic peptide
  Seed: AAVSSSSPL (MAGA4_HUMAN)
ATVSSSSPM

SEQ ID NO: 61085 - protein, 10 aa, Artificial Sequence
  Description of Artificial Sequence: Synthetic peptide
  Seed: AQEEALGLVG (MAGA4_HUMAN)
AEEEALGLVP

SEQ ID NO: 61086 - protein, 8 aa, Artificial Sequence
  Description of Artificial Sequence: Synthetic peptide
  Seed: SAGPPQSP (MAGA4_HUMAN)
SAGPPQSM

SEQ ID NO: 61087 - protein, 9 aa, Artificial Sequence
  Description of Artificial Sequence: Synthetic peptide
  Seed: SYVKVLEHV (MAGA4_HUMAN)
SFVKVLEHY

SEQ ID NO: 61088 - protein, 10 aa, Artificial Sequence
  Description of Artificial Sequence: Synthetic peptide
  Seed: LLGNNQIFPK (MAGA4_HUMAN)
LTGNNQIFPK

SEQ ID NO: 61089 - protein, 11 aa, Artificial Sequence
  Description of Artificial Sequence: Synthetic peptide
  Seed: EIWEELGVMGV (MAGA4_HUMAN)
EMWEELGVMGV

SEQ ID NO: 61090 - protein, 9 aa, Artificial Sequence
  Description of Artificial Sequence: Synthetic peptide
  Seed: RQVPGSNPA (MAGA4_HUMAN)
RHVPGSNPY

SEQ ID NO: 61091 - protein, 10 aa, Artificial Sequence
  Description of Artificial Sequence: Synthetic peptide
  Seed: RVRIAYPSLR (MAGA4_HUMAN)
RMRIAYPSLI

SEQ ID NO: 61092 - protein, 9 aa, Artificial Sequence
  Description of Artificial Sequence: Synthetic peptide
  Seed: RAKELVTKA (MAGA4_HUMAN)
RVKELVTKR

SEQ ID NO: 61093 - protein, 9 aa, Artificial Sequence
  Description of Artificial Sequence: Synthetic peptide
  Seed: TEEQEAAVS (MAGA4_HUMAN)
TEEQEAAVL

SEQ ID NO: 61094 - protein, 8 aa, Artificial Sequence
  Description of Artificial Sequence: Synthetic peptide
  Seed: VYGEPRKL (MAGA4_HUMAN)
VYGEPRKM

SEQ ID NO: 61095 - protein, 9 aa, Artificial Sequence
  Description of Artificial Sequence: Synthetic peptide
  Seed: DPASNTYTL (MAGA4_HUMAN)
DRASNTYTM

SEQ ID NO: 61096 - protein, 9 aa, Artificial Sequence
  Description of Artificial Sequence: Synthetic peptide
  Seed: TVYGEPRKL (MAGA4_HUMAN)
TMYGEPRKF

SEQ ID NO: 61097 - protein, 9 aa, Artificial Sequence
  Description of Artificial Sequence: Synthetic peptide
  Seed: KNYKRCFPV (MAGA4_HUMAN)
KAYKRCFPL

SEQ ID NO: 61098 - protein, 10 aa, Artificial Sequence
  Description of Artificial Sequence: Synthetic peptide
  Seed: NYKRCFPVIF (MAGA4_HUMAN)
NQKRCFPVIY

SEQ ID NO: 61099 - protein, 9 aa, Artificial Sequence
  Description of Artificial Sequence: Synthetic peptide
  Seed: YPSLREAAL (MAGA4_HUMAN)
YTSLREAAY

SEQ ID NO: 61100 - protein, 9 aa, Artificial Sequence
  Description of Artificial Sequence: Synthetic peptide
  Seed: ALPTTISFT (MAGA4_HUMAN)
AVPTTISFI

SEQ ID NO: 61101 - protein, 9 aa, Artificial Sequence
  Description of Artificial Sequence: Synthetic peptide
  Seed: KVDELAHFL (MAGA4_HUMAN)
KMDELAHFL

SEQ ID NO: 61102 - protein, 9 aa, Artificial Sequence
  Description of Artificial Sequence: Synthetic peptide
  Seed: KVLEHVVRV (MAGA4_HUMAN)
KMLEHVVRW

SEQ ID NO: 61103 - protein, 9 aa, Artificial Sequence
  Description of Artificial Sequence: Synthetic peptide
  Seed: EVDPASNTY (MAGA4_HUMAN)
ESDPASNTV

SEQ ID NO: 61104 - protein, 9 aa, Artificial Sequence
  Description of Artificial Sequence: Synthetic peptide
  Seed: TSPDAESLF (MAGA4_HUMAN)
TRPDAESLM

SEQ ID NO: 61105 - protein, 9 aa, Artificial Sequence
  Description of Artificial Sequence: Synthetic peptide
  Seed: VYGEPRKLL (MAGA4_HUMAN)
VFGEPRKLL

SEQ ID NO: 61106 - protein, 10 aa, Artificial Sequence
  Description of Artificial Sequence: Synthetic peptide
  Seed: MIFGIDVKEV (MAGA4_HUMAN)
MTFGIDVKEM

SEQ ID NO: 61107 - protein, 9 aa, Artificial Sequence
  Description of Artificial Sequence: Synthetic peptide
  Seed: LFREALSNK (MAGA4_HUMAN)
LLREALSNK

SEQ ID NO: 61108 - protein, 10 aa, Artificial Sequence
  Description of Artificial Sequence: Synthetic peptide
  Seed: ASALPTTISF (MAGA4_HUMAN)
AQALPTTISY

SEQ ID NO: 61109 - protein, 11 aa, Artificial Sequence
  Description of Artificial Sequence: Synthetic peptide
  Seed: SSSSPLVPGTL (MAGA4_HUMAN)
SASSPLVPGTW

SEQ ID NO: 61110 - protein, 10 aa, Artificial Sequence
  Description of Artificial Sequence: Synthetic peptide
  Seed: KYRAKELVTK (MAGA4_HUMAN)
KSRAKELVTL

SEQ ID NO: 61111 - protein, 9 aa, Artificial Sequence
  Description of Artificial Sequence: Synthetic peptide
  Seed: RAKELVTKA (MAGA4_HUMAN)
RLKELVTKV

SEQ ID NO: 61112 - protein, 8 aa, Artificial Sequence
  Description of Artificial Sequence: Synthetic peptide
  Seed: VYGEPRKL (MAGA4_HUMAN)
VYGEPRKI

SEQ ID NO: 61113 - protein, 9 aa, Artificial Sequence
  Description of Artificial Sequence: Synthetic peptide
  Seed: STSPDAESL (MAGA4_HUMAN)
SQSPDAESV

SEQ ID NO: 61114 - protein, 9 aa, Artificial Sequence
  Description of Artificial Sequence: Synthetic peptide
  Seed: EEQEAAVSS (MAGA4_HUMAN)
EEQEAAVSC

SEQ ID NO: 61115 - protein, 10 aa, Artificial Sequence
  Description of Artificial Sequence: Synthetic peptide
  Seed: TSPDAESLFR (MAGA4_HUMAN)
TTPDAESLFR

SEQ ID NO: 61116 - protein, 9 aa, Artificial Sequence
  Description of Artificial Sequence: Synthetic peptide
  Seed: FPVIFGKAS (MAGA4_HUMAN)
FAVIFGKAM

SEQ ID NO: 61117 - protein, 9 aa, Artificial Sequence
  Description of Artificial Sequence: Synthetic peptide
  Seed: RVRIAYPSL (MAGA4_HUMAN)
RQRIAYPST

SEQ ID NO: 61118 - protein, 9 aa, Artificial Sequence
  Description of Artificial Sequence: Synthetic peptide
  Seed: SALPTTISF (MAGA4_HUMAN)
SELPTTISI

SEQ ID NO: 61119 - protein, 9 aa, Artificial Sequence
  Description of Artificial Sequence: Synthetic peptide
  Seed: RCFPVIFGK (MAGA4_HUMAN)
RIFPVIFGY

SEQ ID NO: 61120 - protein, 10 aa, Artificial Sequence
  Description of Artificial Sequence: Synthetic peptide
  Seed: LPTTISFTCW (MAGA4_HUMAN)
LSTTISFTCW

SEQ ID NO: 61121 - protein, 9 aa, Artificial Sequence
  Description of Artificial Sequence: Synthetic peptide
  Seed: AEMLERVIK (MAGA4_HUMAN)
AEMLERVIL

SEQ ID NO: 61122 - protein, 10 aa, Artificial Sequence
  Description of Artificial Sequence: Synthetic peptide
  Seed: LTQDWVQENY (MAGA4_HUMAN)
LVQDWVQENW

SEQ ID NO: 61123 - protein, 9 aa, Artificial Sequence
  Description of Artificial Sequence: Synthetic peptide
  Seed: IFPKTGLLI (MAGA4_HUMAN)
IWPKTGLLI

SEQ ID NO: 61124 - protein, 9 aa, Artificial Sequence
  Description of Artificial Sequence: Synthetic peptide
  Seed: GVYDGREHT (MAGA4_HUMAN)
GIYDGREHL

SEQ ID NO: 61125 - protein, 9 aa, Artificial Sequence
  Description of Artificial Sequence: Synthetic peptide
  Seed: HVVRVNARV (MAGA4_HUMAN)
HIVRVNARR

SEQ ID NO: 61126 - protein, 9 aa, Artificial Sequence
  Description of Artificial Sequence: Synthetic peptide
  Seed: IAYPSLREA (MAGA4_HUMAN)
IKYPSLREL

SEQ ID NO: 61127 - protein, 9 aa, Artificial Sequence
  Description of Artificial Sequence: Synthetic peptide
  Seed: RAKELVTKA (MAGA4_HUMAN)
RGKELVTKF

SEQ ID NO: 61128 - protein, 9 aa, Artificial Sequence
  Description of Artificial Sequence: Synthetic peptide
  Seed: KELVTKAEM (MAGA4_HUMAN)
KSLVTKAEY

SEQ ID NO: 61129 - protein, 9 aa, Artificial Sequence
  Description of Artificial Sequence: Synthetic peptide
  Seed: QIFPKTGLL (MAGA4_HUMAN)
QAFPKTGLW

SEQ ID NO: 61130 - protein, 9 aa, Artificial Sequence
  Description of Artificial Sequence: Synthetic peptide
  Seed: IFPKTGLLI (MAGA4_HUMAN)
IFPKTGLLL

SEQ ID NO: 61131 - protein, 8 aa, Artificial Sequence
  Description of Artificial Sequence: Synthetic peptide
  Seed: RVRIAYPS (MAGA4_HUMAN)
RIRIAYPK

SEQ ID NO: 61132 - protein, 11 aa, Artificial Sequence
  Description of Artificial Sequence: Synthetic peptide
  Seed: ELAHFLLRKYR (MAGA4_HUMAN)
EAAHFLLRKYK

SEQ ID NO: 61133 - protein, 9 aa, Artificial Sequence
  Description of Artificial Sequence: Synthetic peptide
  Seed: LVPGTLEEV (MAGA4_HUMAN)
LQPGTLEEI

SEQ ID NO: 61134 - protein, 10 aa, Artificial Sequence
  Description of Artificial Sequence: Synthetic peptide
  Seed: RVRIAYPSLR (MAGA4_HUMAN)
RGRIAYPSLF

SEQ ID NO: 61135 - protein, 10 aa, Artificial Sequence
  Description of Artificial Sequence: Synthetic peptide
  Seed: EAAVSSSSPL (MAGA4_HUMAN)
EVAVSSSSPK

SEQ ID NO: 61136 - protein, 9 aa, Artificial Sequence
  Description of Artificial Sequence: Synthetic peptide
  Seed: KASESLKMI (MAGA4_HUMAN)
KQSESLKMV

SEQ ID NO: 61137 - protein, 9 aa, Artificial Sequence
  Description of Artificial Sequence: Synthetic peptide
  Seed: STSPDAESL (MAGA4_HUMAN)
SGSPDAESY

SEQ ID NO: 61138 - protein, 9 aa, Artificial Sequence
  Description of Artificial Sequence: Synthetic peptide
  Seed: RQVPGSNPA (MAGA4_HUMAN)
RKVPGSNPY

SEQ ID NO: 61139 - protein, 10 aa, Artificial Sequence
  Description of Artificial Sequence: Synthetic peptide
  Seed: IFPKTGLLII (MAGA4_HUMAN)
IFPKTGLLIF

SEQ ID NO: 61140 - protein, 9 aa, Artificial Sequence
  Description of Artificial Sequence: Synthetic peptide
  Seed: AESLFREAL (MAGA4_HUMAN)
AQSLFREAV

SEQ ID NO: 61141 - protein, 9 aa, Artificial Sequence
  Description of Artificial Sequence: Synthetic peptide
  Seed: YDGREHTVY (MAGA4_HUMAN)
YKGREHTVY

SEQ ID NO: 61142 - protein, 9 aa, Artificial Sequence
  Description of Artificial Sequence: Synthetic peptide
  Seed: IFPKTGLLI (MAGA4_HUMAN)
IGPKTGLLM

SEQ ID NO: 61143 - protein, 9 aa, Artificial Sequence
  Description of Artificial Sequence: Synthetic peptide
  Seed: EHVVRVNAR (MAGA4_HUMAN)
ESVVRVNAR

SEQ ID NO: 61144 - protein, 10 aa, Artificial Sequence
  Description of Artificial Sequence: Synthetic peptide
  Seed: PTTISFTCWR (MAGA4_HUMAN)
PFTISFTCWR

SEQ ID NO: 61145 - protein, 9 aa, Artificial Sequence
  Description of Artificial Sequence: Synthetic peptide
  Seed: RQVPGSNPA (MAGA4_HUMAN)
RLVPGSNPA

SEQ ID NO: 61146 - protein, 11 aa, Artificial Sequence
  Description of Artificial Sequence: Synthetic peptide
  Seed: RVRIAYPSLRE (MAGA4_HUMAN)
RTRIAYPSLRM

SEQ ID NO: 61147 - protein, 9 aa, Artificial Sequence
  Description of Artificial Sequence: Synthetic peptide
  Seed: DELAHFLLR (MAGA4_HUMAN)
DGLAHFLLR

SEQ ID NO: 61148 - protein, 10 aa, Artificial Sequence
  Description of Artificial Sequence: Synthetic peptide
  Seed: ARVRIAYPSL (MAGA4_HUMAN)
ASVRIAYPSI

SEQ ID NO: 61149 - protein, 9 aa, Artificial Sequence
  Description of Artificial Sequence: Synthetic peptide
  Seed: WEELGVMGV (MAGA4_HUMAN)
WEELGVMGL

SEQ ID NO: 61150 - protein, 11 aa, Artificial Sequence
  Description of Artificial Sequence: Synthetic peptide
  Seed: SAGPPQSPQGA (MAGA4_HUMAN)
SPGPPQSPQGA

SEQ ID NO: 61151 - protein, 9 aa, Artificial Sequence
  Description of Artificial Sequence: Synthetic peptide
  Seed: ARVRIAYPS (MAGA4_HUMAN)
ARVRIAYPV

SEQ ID NO: 61152 - protein, 9 aa, Artificial Sequence
  Description of Artificial Sequence: Synthetic peptide
  Seed: IAYPSLREA (MAGA4_HUMAN)
IVYPSLREF

SEQ ID NO: 61153 - protein, 9 aa, Artificial Sequence
  Description of Artificial Sequence: Synthetic peptide
  Seed: WVQENYLEY (MAGA4_HUMAN)
WYQENYLEL

SEQ ID NO: 61154 - protein, 9 aa, Artificial Sequence
  Description of Artificial Sequence: Synthetic peptide
  Seed: RVRIAYPSL (MAGA4_HUMAN)
RQRIAYPSR

SEQ ID NO: 61155 - protein, 9 aa, Artificial Sequence
  Description of Artificial Sequence: Synthetic peptide
  Seed: GASALPTTI (MAGA4_HUMAN)
GQSALPTTM

SEQ ID NO: 61156 - protein, 9 aa, Artificial Sequence
  Description of Artificial Sequence: Synthetic peptide
  Seed: KVDELAHFL (MAGA4_HUMAN)
KLDELAHFA

SEQ ID NO: 61157 - protein, 9 aa, Artificial Sequence
  Description of Artificial Sequence: Synthetic peptide
  Seed: SEEEIWEEL (MAGA4_HUMAN)
SVEEIWEEL

SEQ ID NO: 61158 - protein, 9 aa, Artificial Sequence
  Description of Artificial Sequence: Synthetic peptide
  Seed: KVLEHVVRV (MAGA4_HUMAN)
KILEHVVRA

SEQ ID NO: 61159 - protein, 10 aa, Artificial Sequence
  Description of Artificial Sequence: Synthetic peptide
  Seed: SPQGASALPT (MAGA4_HUMAN)
SPQGASALPA

SEQ ID NO: 61160 - protein, 9 aa, Artificial Sequence
  Description of Artificial Sequence: Synthetic peptide
  Seed: WVQENYLEY (MAGA4_HUMAN)
WTQENYLEM

SEQ ID NO: 61161 - protein, 9 aa, Artificial Sequence
  Description of Artificial Sequence: Synthetic peptide
  Seed: RVRIAYPSL (MAGA4_HUMAN)
RIRIAYPSW

SEQ ID NO: 61162 - protein, 9 aa, Artificial Sequence
  Description of Artificial Sequence: Synthetic peptide
  Seed: RQVPGSNPA (MAGA4_HUMAN)
RRVPGSNPM

SEQ ID NO: 61163 - protein, 9 aa, Artificial Sequence
  Description of Artificial Sequence: Synthetic peptide
  Seed: IIVLGTIAM (MAGA4_HUMAN)
IMVLGTIAF

SEQ ID NO: 61164 - protein, 11 aa, Artificial Sequence
  Description of Artificial Sequence: Synthetic peptide
  Seed: SQEEEGPSTSP (MAGA4_HUMAN)
SEEEEGPSTSI

SEQ ID NO: 61165 - protein, 9 aa, Artificial Sequence
  Description of Artificial Sequence: Synthetic peptide
  Seed: RVRIAYPSL (MAGA4_HUMAN)
RIRIAYPSV

SEQ ID NO: 61166 - protein, 9 aa, Artificial Sequence
  Description of Artificial Sequence: Synthetic peptide
  Seed: RQVPGSNPA (MAGA4_HUMAN)
RVVPGSNPV

SEQ ID NO: 61167 - protein, 9 aa, Artificial Sequence
  Description of Artificial Sequence: Synthetic peptide
  Seed: GKASESLKM (MAGA4_HUMAN)
GMASESLKF

SEQ ID NO: 61168 - protein, 10 aa, Artificial Sequence
  Description of Artificial Sequence: Synthetic peptide
  Seed: RVRIAYPSLR (MAGA4_HUMAN)
RARIAYPSLY

SEQ ID NO: 61169 - protein, 9 aa, Artificial Sequence
  Description of Artificial Sequence: Synthetic peptide
  Seed: RVRIAYPSL (MAGA4_HUMAN)
RPRIAYPSG

SEQ ID NO: 61170 - protein, 9 aa, Artificial Sequence
  Description of Artificial Sequence: Synthetic peptide
  Seed: AVSSSSPLV (MAGA4_HUMAN)
AQSSSSPLW

SEQ ID NO: 61171 - protein, 10 aa, Artificial Sequence
  Description of Artificial Sequence: Synthetic peptide
  Seed: QIFPKTGLLI (MAGA4_HUMAN)
QMFPKTGLLY

SEQ ID NO: 61172 - protein, 9 aa, Artificial Sequence
  Description of Artificial Sequence: Synthetic peptide
  Seed: SYVKVLEHV (MAGA4_HUMAN)
SWVKVLEHL

SEQ ID NO: 61173 - protein, 10 aa, Artificial Sequence
  Description of Artificial Sequence: Synthetic peptide
  Seed: EHTVYGEPRK (MAGA4_HUMAN)
EPTVYGEPRR

SEQ ID NO: 61174 - protein, 9 aa, Artificial Sequence
  Description of Artificial Sequence: Synthetic peptide
  Seed: ELAHFLLRK (MAGA4_HUMAN)
EYAHFLLRK

SEQ ID NO: 61175 - protein, 9 aa, Artificial Sequence
  Description of Artificial Sequence: Synthetic peptide
  Seed: STSPDAESL (MAGA4_HUMAN)
SASPDAESW

SEQ ID NO: 61176 - protein, 9 aa, Artificial Sequence
  Description of Artificial Sequence: Synthetic peptide
  Seed: YKRCFPVIF (MAGA4_HUMAN)
YQRCFPVII

SEQ ID NO: 61177 - protein, 10 aa, Artificial Sequence
  Description of Artificial Sequence: Synthetic peptide
  Seed: RVRIAYPSLR (MAGA4_HUMAN)
RYRIAYPSLT

SEQ ID NO: 61178 - protein, 9 aa, Artificial Sequence
  Description of Artificial Sequence: Synthetic peptide
  Seed: YVKVLEHVV (MAGA4_HUMAN)
YIKVLEHVY

SEQ ID NO: 61179 - protein, 9 aa, Artificial Sequence
  Description of Artificial Sequence: Synthetic peptide
  Seed: AESLFREAL (MAGA4_HUMAN)
AESLFREAP

SEQ ID NO: 61180 - protein, 10 aa, Artificial Sequence
  Description of Artificial Sequence: Synthetic peptide
  Seed: RVNARVRIAY (MAGA4_HUMAN)
RSNARVRIAF

SEQ ID NO: 61181 - protein, 11 aa, Artificial Sequence
  Description of Artificial Sequence: Synthetic peptide
  Seed: RVRIAYPSLRE (MAGA4_HUMAN)
RTRIAYPSLRR

SEQ ID NO: 61182 - protein, 11 aa, Artificial Sequence
  Description of Artificial Sequence: Synthetic peptide
  Seed: RQVPGSNPARY (MAGA4_HUMAN)
RIVPGSNPARW

SEQ ID NO: 61183 - protein, 9 aa, Artificial Sequence
  Description of Artificial Sequence: Synthetic peptide
  Seed: LVPGTLEEV (MAGA4_HUMAN)
LMPGTLEEI

SEQ ID NO: 61184 - protein, 10 aa, Artificial Sequence
  Description of Artificial Sequence: Synthetic peptide
  Seed: RVRIAYPSLR (MAGA4_HUMAN)
RDRIAYPSLV

SEQ ID NO: 61185 - protein, 11 aa, Artificial Sequence
  Description of Artificial Sequence: Synthetic peptide
  Seed: YVKVLEHVVRV (MAGA4_HUMAN)
YPKVLEHVVRV

SEQ ID NO: 61186 - protein, 10 aa, Artificial Sequence
  Description of Artificial Sequence: Synthetic peptide
  Seed: RVNARVRIAY (MAGA4_HUMAN)
RVNARVRIAV

SEQ ID NO: 61187 - protein, 9 aa, Artificial Sequence
  Description of Artificial Sequence: Synthetic peptide
  Seed: RAKELVTKA (MAGA4_HUMAN)
RVKELVTKM

SEQ ID NO: 61188 - protein, 10 aa, Artificial Sequence
  Description of Artificial Sequence: Synthetic peptide
  Seed: KEVDPASNTY (MAGA4_HUMAN)
KQVDPASNTI

SEQ ID NO: 61189 - protein, 9 aa, Artificial Sequence
  Description of Artificial Sequence: Synthetic peptide
  Seed: TQDWVQENY (MAGA4_HUMAN)
TQDWVQENL

SEQ ID NO: 61190 - protein, 9 aa, Artificial Sequence
  Description of Artificial Sequence: Synthetic peptide
  Seed: IAYPSLREA (MAGA4_HUMAN)
IGYPSLREI

SEQ ID NO: 61191 - protein, 10 aa, Artificial Sequence
  Description of Artificial Sequence: Synthetic peptide
  Seed: RVRIAYPSLR (MAGA4_HUMAN)
RVRIAYPSLH

SEQ ID NO: 61192 - protein, 9 aa, Artificial Sequence
  Description of Artificial Sequence: Synthetic peptide
  Seed: RVRIAYPSL (MAGA4_HUMAN)
RMRIAYPST

SEQ ID NO: 61193 - protein, 9 aa, Artificial Sequence
  Description of Artificial Sequence: Synthetic peptide
  Seed: KNYKRCFPV (MAGA4_HUMAN)
KAYKRCFPV

SEQ ID NO: 61194 - protein, 9 aa, Artificial Sequence
  Description of Artificial Sequence: Synthetic peptide
  Seed: TQDWVQENY (MAGA4_HUMAN)
TFDWVQENF

SEQ ID NO: 61195 - protein, 9 aa, Artificial Sequence
  Description of Artificial Sequence: Synthetic peptide
  Seed: RVRIAYPSL (MAGA4_HUMAN)
RNRIAYPSM

SEQ ID NO: 61196 - protein, 9 aa, Artificial Sequence
  Description of Artificial Sequence: Synthetic peptide
  Seed: TQDWVQENY (MAGA4_HUMAN)
TGDWVQENM

SEQ ID NO: 61197 - protein, 10 aa, Artificial Sequence
  Description of Artificial Sequence: Synthetic peptide
  Seed: YRQVPGSNPA (MAGA4_HUMAN)
YLQVPGSNPF

SEQ ID NO: 61198 - protein, 11 aa, Artificial Sequence
  Description of Artificial Sequence: Synthetic peptide
  Seed: KVDELAHFLLR (MAGA4_HUMAN)
KSDELAHFLLR

SEQ ID NO: 61199 - protein, 9 aa, Artificial Sequence
  Description of Artificial Sequence: Synthetic peptide
  Seed: RVRIAYPSL (MAGA4_HUMAN)
RYRIAYPSH

SEQ ID NO: 61200 - protein, 10 aa, Artificial Sequence
  Description of Artificial Sequence: Synthetic peptide
  Seed: KEVDPASNTY (MAGA4_HUMAN)
KEVDPASNTI

SEQ ID NO: 61201 - protein, 11 aa, Artificial Sequence
  Description of Artificial Sequence: Synthetic peptide
  Seed: SSSSPLVPGTL (MAGA4_HUMAN)
SASSPLVPGTL

SEQ ID NO: 61202 - protein, 10 aa, Artificial Sequence
  Description of Artificial Sequence: Synthetic peptide
  Seed: TTISFTCWRQ (MAGA4_HUMAN)
THISFTCWRR

SEQ ID NO: 61203 - protein, 10 aa, Artificial Sequence
  Description of Artificial Sequence: Synthetic peptide
  Seed: LGVMGVYDGR (MAGA4_HUMAN)
LWVMGVYDGR

SEQ ID NO: 61204 - protein, 10 aa, Artificial Sequence
  Description of Artificial Sequence: Synthetic peptide
  Seed: KNYKRCFPVI (MAGA4_HUMAN)
KMYKRCFPVK

SEQ ID NO: 61205 - protein, 9 aa, Artificial Sequence
  Description of Artificial Sequence: Synthetic peptide
  Seed: SSPLVPGTL (MAGA4_HUMAN)
STPLVPGTY

SEQ ID NO: 61206 - protein, 9 aa, Artificial Sequence
  Description of Artificial Sequence: Synthetic peptide
  Seed: SYVKVLEHV (MAGA4_HUMAN)
SYVKVLEHW

SEQ ID NO: 61207 - protein, 11 aa, Artificial Sequence
  Description of Artificial Sequence: Synthetic peptide
  Seed: RQVPGSNPARY (MAGA4_HUMAN)
RTVPGSNPARL

SEQ ID NO: 61208 - protein, 11 aa, Artificial Sequence
  Description of Artificial Sequence: Synthetic peptide
  Seed: SYDGLLGNNQI (MAGA4_HUMAN)
SADGLLGNNQM

SEQ ID NO: 61209 - protein, 10 aa, Artificial Sequence
  Description of Artificial Sequence: Synthetic peptide
  Seed: KASESLKMIF (MAGA4_HUMAN)
KSSESLKMIF

SEQ ID NO: 61210 - protein, 10 aa, Artificial Sequence
  Description of Artificial Sequence: Synthetic peptide
  Seed: RIAYPSLREA (MAGA4_HUMAN)
RTAYPSLREA

SEQ ID NO: 61211 - protein, 9 aa, Artificial Sequence
  Description of Artificial Sequence: Synthetic peptide
  Seed: RCFPVIFGK (MAGA4_HUMAN)
RYFPVIFGR

SEQ ID NO: 61212 - protein, 9 aa, Artificial Sequence
  Description of Artificial Sequence: Synthetic peptide
  Seed: IIVLGTIAM (MAGA4_HUMAN)
IHVLGTIAM

SEQ ID NO: 61213 - protein, 9 aa, Artificial Sequence
  Description of Artificial Sequence: Synthetic peptide
  Seed: AAVSSSSPL (MAGA4_HUMAN)
AAVSSSSPH

SEQ ID NO: 61214 - protein, 9 aa, Artificial Sequence
  Description of Artificial Sequence: Synthetic peptide
  Seed: AAVSSSSPL (MAGA4_HUMAN)
AKVSSSSPY

SEQ ID NO: 61215 - protein, 9 aa, Artificial Sequence
  Description of Artificial Sequence: Synthetic peptide
  Seed: RVRIAYPSL (MAGA4_HUMAN)
RYRIAYPSR

SEQ ID NO: 61216 - protein, 10 aa, Artificial Sequence
  Description of Artificial Sequence: Synthetic peptide
  Seed: QIFPKTGLLI (MAGA4_HUMAN)
QTFPKTGLLY

SEQ ID NO: 61217 - protein, 8 aa, Artificial Sequence
  Description of Artificial Sequence: Synthetic peptide
  Seed: ASALPTTI (MAGA4_HUMAN)
ATALPTTL

SEQ ID NO: 61218 - protein, 9 aa, Artificial Sequence
  Description of Artificial Sequence: Synthetic peptide
  Seed: DELAHFLLR (MAGA4_HUMAN)
DVLAHFLLR

SEQ ID NO: 61219 - protein, 11 aa, Artificial Sequence
  Description of Artificial Sequence: Synthetic peptide
  Seed: GVYDGREHTVY (MAGA4_HUMAN)
GLYDGREHTVF

SEQ ID NO: 61220 - protein, 9 aa, Artificial Sequence
  Description of Artificial Sequence: Synthetic peptide
  Seed: VVRVNARVR (MAGA4_HUMAN)
VARVNARVK

SEQ ID NO: 61221 - protein, 9 aa, Artificial Sequence
  Description of Artificial Sequence: Synthetic peptide
  Seed: YVKVLEHVV (MAGA4_HUMAN)
YAKVLEHVL

SEQ ID NO: 61222 - protein, 10 aa, Artificial Sequence
  Description of Artificial Sequence: Synthetic peptide
  Seed: KVDELAHFLL (MAGA4_HUMAN)
KLDELAHFLW

SEQ ID NO: 61223 - protein, 9 aa, Artificial Sequence
  Description of Artificial Sequence: Synthetic peptide
  Seed: AYPSLREAA (MAGA4_HUMAN)
AWPSLREAM

SEQ ID NO: 61224 - protein, 9 aa, Artificial Sequence
  Description of Artificial Sequence: Synthetic peptide
  Seed: MSSEQKSQH (MAGA4_HUMAN)
MASEQKSQF

SEQ ID NO: 61225 - protein, 10 aa, Artificial Sequence
  Description of Artificial Sequence: Synthetic peptide
  Seed: EEIWEELGVM (MAGA4_HUMAN)
EEIWEELGVW

SEQ ID NO: 61226 - protein, 10 aa, Artificial Sequence
  Description of Artificial Sequence: Synthetic peptide
  Seed: RVIKNYKRCF (MAGA4_HUMAN)
RSIKNYKRCW

SEQ ID NO: 61227 - protein, 10 aa, Artificial Sequence
  Description of Artificial Sequence: Synthetic peptide
  Seed: SLFREALSNK (MAGA4_HUMAN)
SMFREALSNK

SEQ ID NO: 61228 - protein, 11 aa, Artificial Sequence
  Description of Artificial Sequence: Synthetic peptide
  Seed: GLLGNNQIFPK (MAGA4_HUMAN)
GILGNNQIFPR

SEQ ID NO: 61229 - protein, 9 aa, Artificial Sequence
  Description of Artificial Sequence: Synthetic peptide
  Seed: GTLEEVPAA (MAGA4_HUMAN)
GILEEVPAA

SEQ ID NO: 61230 - protein, 9 aa, Artificial Sequence
  Description of Artificial Sequence: Synthetic peptide
  Seed: GTLEEVPAA (MAGA4_HUMAN)
GALEEVPAI

SEQ ID NO: 61231 - protein, 9 aa, Artificial Sequence
  Description of Artificial Sequence: Synthetic peptide
  Seed: FGKASESLK (MAGA4_HUMAN)
FAKASESLL

SEQ ID NO: 61232 - protein, 10 aa, Artificial Sequence
  Description of Artificial Sequence: Synthetic peptide
  Seed: KEVDPASNTY (MAGA4_HUMAN)
KRVDPASNTF

SEQ ID NO: 61233 - protein, 10 aa, Artificial Sequence
  Description of Artificial Sequence: Synthetic peptide
  Seed: KYRAKELVTK (MAGA4_HUMAN)
KARAKELVTK

SEQ ID NO: 61234 - protein, 9 aa, Artificial Sequence
  Description of Artificial Sequence: Synthetic peptide
  Seed: LFREALSNK (MAGA4_HUMAN)
LIREALSNK

SEQ ID NO: 61235 - protein, 9 aa, Artificial Sequence
  Description of Artificial Sequence: Synthetic peptide
  Seed: LGNNQIFPK (MAGA4_HUMAN)
LLNNQIFPR

SEQ ID NO: 61236 - protein, 9 aa, Artificial Sequence
  Description of Artificial Sequence: Synthetic peptide
  Seed: SSPLVPGTL (MAGA4_HUMAN)
SMPLVPGTI

SEQ ID NO: 61237 - protein, 9 aa, Artificial Sequence
  Description of Artificial Sequence: Synthetic peptide
  Seed: REHTVYGEP (MAGA4_HUMAN)
REHTVYGET

SEQ ID NO: 61238 - protein, 9 aa, Artificial Sequence
  Description of Artificial Sequence: Synthetic peptide
  Seed: RVRIAYPSL (MAGA4_HUMAN)
RVRIAYPSI

SEQ ID NO: 61239 - protein, 10 aa, Artificial Sequence
  Description of Artificial Sequence: Synthetic peptide
  Seed: SSEQKSQHCK (MAGA4_HUMAN)
SSEQKSQHCY

SEQ ID NO: 61240 - protein, 10 aa, Artificial Sequence
  Description of Artificial Sequence: Synthetic peptide
  Seed: VDPASNTYTL (MAGA4_HUMAN)
VCPASNTYTL

SEQ ID NO: 61241 - protein, 9 aa, Artificial Sequence
  Description of Artificial Sequence: Synthetic peptide
  Seed: RCFPVIFGK (MAGA4_HUMAN)
RQFPVIFGK

SEQ ID NO: 61242 - protein, 9 aa, Artificial Sequence
  Description of Artificial Sequence: Synthetic peptide
  Seed: ERVIKNYKR (MAGA4_HUMAN)
EQVIKNYKR

SEQ ID NO: 61243 - protein, 10 aa, Artificial Sequence
  Description of Artificial Sequence: Synthetic peptide
  Seed: KEVDPASNTY (MAGA4_HUMAN)
KLVDPASNTF

SEQ ID NO: 61244 - protein, 10 aa, Artificial Sequence
  Description of Artificial Sequence: Synthetic peptide
  Seed: TTISFTCWRQ (MAGA4_HUMAN)
TTISFTCWRC

SEQ ID NO: 61245 - protein, 9 aa, Artificial Sequence
  Description of Artificial Sequence: Synthetic peptide
  Seed: RVNARVRIA (MAGA4_HUMAN)
RSNARVRIV

SEQ ID NO: 61246 - protein, 9 aa, Artificial Sequence
  Description of Artificial Sequence: Synthetic peptide
  Seed: TSPDAESLF (MAGA4_HUMAN)
TRPDAESLF

SEQ ID NO: 61247 - protein, 10 aa, Artificial Sequence
  Description of Artificial Sequence: Synthetic peptide
  Seed: RVRIAYPSLR (MAGA4_HUMAN)
RHRIAYPSLR

SEQ ID NO: 61248 - protein, 10 aa, Artificial Sequence
  Description of Artificial Sequence: Synthetic peptide
  Seed: MIFGIDVKEV (MAGA4_HUMAN)
MIFGIDVKEL

SEQ ID NO: 61249 - protein, 10 aa, Artificial Sequence
  Description of Artificial Sequence: Synthetic peptide
  Seed: SEEEIWEELG (MAGA4_HUMAN)
SEEEIWEELV

SEQ ID NO: 61250 - protein, 9 aa, Artificial Sequence
  Description of Artificial Sequence: Synthetic peptide
  Seed: QVPGSNPAR (MAGA4_HUMAN)
QTPGSNPAL

SEQ ID NO: 61251 - protein, 9 aa, Artificial Sequence
  Description of Artificial Sequence: Synthetic peptide
  Seed: SSPLVPGTL (MAGA4_HUMAN)
SFPLVPGTV

SEQ ID NO: 61252 - protein, 11 aa, Artificial Sequence
  Description of Artificial Sequence: Synthetic peptide
  Seed: RVRIAYPSLRE (MAGA4_HUMAN)
RSRIAYPSLRK

SEQ ID NO: 61253 - protein, 10 aa, Artificial Sequence
  Description of Artificial Sequence: Synthetic peptide
  Seed: RVRIAYPSLR (MAGA4_HUMAN)
RTRIAYPSLQ

SEQ ID NO: 61254 - protein, 9 aa, Artificial Sequence
  Description of Artificial Sequence: Synthetic peptide
  Seed: RVRIAYPSL (MAGA4_HUMAN)
RRRIAYPSK

SEQ ID NO: 61255 - protein, 10 aa, Artificial Sequence
  Description of Artificial Sequence: Synthetic peptide
  Seed: KVLEHVVRVN (MAGA4_HUMAN)
KLLEHVVRVV

SEQ ID NO: 61256 - protein, 9 aa, Artificial Sequence
  Description of Artificial Sequence: Synthetic peptide
  Seed: RVRIAYPSL (MAGA4_HUMAN)
RTRIAYPSR

SEQ ID NO: 61257 - protein, 9 aa, Artificial Sequence
  Description of Artificial Sequence: Synthetic peptide
  Seed: AESAGPPQS (MAGA4_HUMAN)
AESAGPPQM

SEQ ID NO: 61258 - protein, 9 aa, Artificial Sequence
  Description of Artificial Sequence: Synthetic peptide
  Seed: LEEVPAAES (MAGA4_HUMAN)
LEEVPAAEL

SEQ ID NO: 61259 - protein, 9 aa, Artificial Sequence
  Description of Artificial Sequence: Synthetic peptide
  Seed: SSSPLVPGT (MAGA4_HUMAN)
STSPLVPGV

SEQ ID NO: 61260 - protein, 9 aa, Artificial Sequence
  Description of Artificial Sequence: Synthetic peptide
  Seed: STSPDAESL (MAGA4_HUMAN)
SQSPDAESL

SEQ ID NO: 61261 - protein, 9 aa, Artificial Sequence
  Description of Artificial Sequence: Synthetic peptide
  Seed: MGVYDGREH (MAGA4_HUMAN)
MAVYDGREF

SEQ ID NO: 61262 - protein, 10 aa, Artificial Sequence
  Description of Artificial Sequence: Synthetic peptide
  Seed: TQDWVQENYL (MAGA4_HUMAN)
TADWVQENYF

SEQ ID NO: 61263 - protein, 9 aa, Artificial Sequence
  Description of Artificial Sequence: Synthetic peptide
  Seed: YPSLREAAL (MAGA4_HUMAN)
YHSLREAAL

SEQ ID NO: 61264 - protein, 9 aa, Artificial Sequence
  Description of Artificial Sequence: Synthetic peptide
  Seed: QIFPKTGLL (MAGA4_HUMAN)
QIFPKTGLY

SEQ ID NO: 61265 - protein, 9 aa, Artificial Sequence
  Description of Artificial Sequence: Synthetic peptide
  Seed: RAKELVTKA (MAGA4_HUMAN)
RAKELVTKF

SEQ ID NO: 61266 - protein, 10 aa, Artificial Sequence
  Description of Artificial Sequence: Synthetic peptide
  Seed: KNYKRCFPVI (MAGA4_HUMAN)
KVYKRCFPVA

SEQ ID NO: 61267 - protein, 9 aa, Artificial Sequence
  Description of Artificial Sequence: Synthetic peptide
  Seed: AAVSSSSPL (MAGA4_HUMAN)
AMVSSSSPW

SEQ ID NO: 61268 - protein, 10 aa, Artificial Sequence
  Description of Artificial Sequence: Synthetic peptide
  Seed: TLVTCLGLSY (MAGA4_HUMAN)
TTVTCLGLSK

SEQ ID NO: 61269 - protein, 9 aa, Artificial Sequence
  Description of Artificial Sequence: Synthetic peptide
  Seed: KVLEHVVRV (MAGA4_HUMAN)
KMLEHVVRI

SEQ ID NO: 61270 - protein, 10 aa, Artificial Sequence
  Description of Artificial Sequence: Synthetic peptide
  Seed: LTQDWVQENY (MAGA4_HUMAN)
LFQDWVQENY

SEQ ID NO: 61271 - protein, 9 aa, Artificial Sequence
  Description of Artificial Sequence: Synthetic peptide
  Seed: LAHFLLRKY (MAGA4_HUMAN)
LQHFLLRKM

SEQ ID NO: 61272 - protein, 9 aa, Artificial Sequence
  Description of Artificial Sequence: Synthetic peptide
  Seed: IAYPSLREA (MAGA4_HUMAN)
IPYPSLREA

SEQ ID NO: 61273 - protein, 9 aa, Artificial Sequence
  Description of Artificial Sequence: Synthetic peptide
  Seed: EAQEEALGL (MAGA4_HUMAN)
EIQEEALGR

SEQ ID NO: 61274 - protein, 10 aa, Artificial Sequence
  Description of Artificial Sequence: Synthetic peptide
  Seed: KNYKRCFPVI (MAGA4_HUMAN)
KSYKRCFPVI

SEQ ID NO: 61275 - protein, 10 aa, Artificial Sequence
  Description of Artificial Sequence: Synthetic peptide
  Seed: AYPSLREAAL (MAGA4_HUMAN)
ANPSLREAAM

SEQ ID NO: 61276 - protein, 10 aa, Artificial Sequence
  Description of Artificial Sequence: Synthetic peptide
  Seed: EHVVRVNARV (MAGA4_HUMAN)
EPVVRVNARV

SEQ ID NO: 61277 - protein, 10 aa, Artificial Sequence
  Description of Artificial Sequence: Synthetic peptide
  Seed: RVNARVRIAY (MAGA4_HUMAN)
RVNARVRIAW

SEQ ID NO: 61278 - protein, 11 aa, Artificial Sequence
  Description of Artificial Sequence: Synthetic peptide
  Seed: REALSNKVDEL (MAGA4_HUMAN)
RQALSNKVDEW

SEQ ID NO: 61279 - protein, 9 aa, Artificial Sequence
  Description of Artificial Sequence: Synthetic peptide
  Seed: AESAGPPQS (MAGA4_HUMAN)
AESAGPPQI

SEQ ID NO: 61280 - protein, 11 aa, Artificial Sequence
  Description of Artificial Sequence: Synthetic peptide
  Seed: MEGDSASEEEI (MAGA4_HUMAN)
MEGDSASEEEF

SEQ ID NO: 61281 - protein, 10 aa, Artificial Sequence
  Description of Artificial Sequence: Synthetic peptide
  Seed: KVLEHVVRVN (MAGA4_HUMAN)
KMLEHVVRVY

SEQ ID NO: 61282 - protein, 9 aa, Artificial Sequence
  Description of Artificial Sequence: Synthetic peptide
  Seed: AAVSSSSPL (MAGA4_HUMAN)
AAVSSSSPF

SEQ ID NO: 61283 - protein, 9 aa, Artificial Sequence
  Description of Artificial Sequence: Synthetic peptide
  Seed: LKMIFGIDV (MAGA4_HUMAN)
LQMIFGIDF

SEQ ID NO: 61284 - protein, 9 aa, Artificial Sequence
  Description of Artificial Sequence: Synthetic peptide
  Seed: GASALPTTI (MAGA4_HUMAN)
GVSALPTTF

SEQ ID NO: 61285 - protein, 10 aa, Artificial Sequence
  Description of Artificial Sequence: Synthetic peptide
  Seed: TSYVKVLEHV (MAGA4_HUMAN)
TFYVKVLEHF

SEQ ID NO: 61286 - protein, 10 aa, Artificial Sequence
  Description of Artificial Sequence: Synthetic peptide
  Seed: KRCFPVIFGK (MAGA4_HUMAN)
KMCFPVIFGR

SEQ ID NO: 61287 - protein, 11 aa, Artificial Sequence
  Description of Artificial Sequence: Synthetic peptide
  Seed: RVNARVRIAYP (MAGA4_HUMAN)
RMNARVRIAYK

SEQ ID NO: 61288 - protein, 9 aa, Artificial Sequence
  Description of Artificial Sequence: Synthetic peptide
  Seed: ALLEEEEGV (MAGA4_HUMAN)
AMLEEEEGI

SEQ ID NO: 61289 - protein, 9 aa, Artificial Sequence
  Description of Artificial Sequence: Synthetic peptide
  Seed: RVRIAYPSL (MAGA4_HUMAN)
RMRIAYPSL

SEQ ID NO: 61290 - protein, 9 aa, Artificial Sequence
  Description of Artificial Sequence: Synthetic peptide
  Seed: KYRAKELVT (MAGA4_HUMAN)
KSRAKELVY

SEQ ID NO: 61291 - protein, 8 aa, Artificial Sequence
  Description of Artificial Sequence: Synthetic peptide
  Seed: REALSNKV (MAGA4_HUMAN)
REALSNKW

SEQ ID NO: 61292 - protein, 11 aa, Artificial Sequence
  Description of Artificial Sequence: Synthetic peptide
  Seed: GASALPTTISF (MAGA4_HUMAN)
GISALPTTISW

SEQ ID NO: 61293 - protein, 10 aa, Artificial Sequence
  Description of Artificial Sequence: Synthetic peptide
  Seed: KVDELAHFLL (MAGA4_HUMAN)
KMDELAHFLL

SEQ ID NO: 61294 - protein, 9 aa, Artificial Sequence
  Description of Artificial Sequence: Synthetic peptide
  Seed: SYVKVLEHV (MAGA4_HUMAN)
SLVKVLEHM

SEQ ID NO: 61295 - protein, 10 aa, Artificial Sequence
  Description of Artificial Sequence: Synthetic peptide
  Seed: VKVLEHVVRV (MAGA4_HUMAN)
VLVLEHVVRL

SEQ ID NO: 61296 - protein, 9 aa, Artificial Sequence
  Description of Artificial Sequence: Synthetic peptide
  Seed: STSPDAESL (MAGA4_HUMAN)
SSSPDAESL

SEQ ID NO: 61297 - protein, 10 aa, Artificial Sequence
  Description of Artificial Sequence: Synthetic peptide
  Seed: VDPASNTYTL (MAGA4_HUMAN)
VTPASNTYTM

SEQ ID NO: 61298 - protein, 9 aa, Artificial Sequence
  Description of Artificial Sequence: Synthetic peptide
  Seed: SEEEIWEEL (MAGA4_HUMAN)
SEEEIWEEM

SEQ ID NO: 61299 - protein, 11 aa, Artificial Sequence
  Description of Artificial Sequence: Synthetic peptide
  Seed: GVYDGREHTVY (MAGA4_HUMAN)
GSYDGREHTVF

SEQ ID NO: 61300 - protein, 9 aa, Artificial Sequence
  Description of Artificial Sequence: Synthetic peptide
  Seed: LVPGTLEEV (MAGA4_HUMAN)
LRPGTLEEY

SEQ ID NO: 61301 - protein, 10 aa, Artificial Sequence
  Description of Artificial Sequence: Synthetic peptide
  Seed: GLLIIVLGTI (MAGA4_HUMAN)
GWLIIVLGTV

SEQ ID NO: 61302 - protein, 9 aa, Artificial Sequence
  Description of Artificial Sequence: Synthetic peptide
  Seed: VRIAYPSLR (MAGA4_HUMAN)
VQIAYPSLR

SEQ ID NO: 61303 - protein, 10 aa, Artificial Sequence
  Description of Artificial Sequence: Synthetic peptide
  Seed: ARVRIAYPSL (MAGA4_HUMAN)
AQVRIAYPSK

SEQ ID NO: 61304 - protein, 10 aa, Artificial Sequence
  Description of Artificial Sequence: Synthetic peptide
  Seed: KYRAKELVTK (MAGA4_HUMAN)
KLRAKELVTK

SEQ ID NO: 61305 - protein, 9 aa, Artificial Sequence
  Description of Artificial Sequence: Synthetic peptide
  Seed: SEEEIWEEL (MAGA4_HUMAN)
SLEEIWEEF

SEQ ID NO: 61306 - protein, 10 aa, Artificial Sequence
  Description of Artificial Sequence: Synthetic peptide
  Seed: NKVDELAHFL (MAGA4_HUMAN)
NHVDELAHFV

SEQ ID NO: 61307 - protein, 9 aa, Artificial Sequence
  Description of Artificial Sequence: Synthetic peptide
  Seed: RVRIAYPSL (MAGA4_HUMAN)
RSRIAYPSN

SEQ ID NO: 61308 - protein, 9 aa, Artificial Sequence
  Description of Artificial Sequence: Synthetic peptide
  Seed: KMIFGIDVK (MAGA4_HUMAN)
KMIFGIDVR

SEQ ID NO: 61309 - protein, 9 aa, Artificial Sequence
  Description of Artificial Sequence: Synthetic peptide
  Seed: EHVVRVNAR (MAGA4_HUMAN)
EGVVRVNAR

SEQ ID NO: 61310 - protein, 9 aa, Artificial Sequence
  Description of Artificial Sequence: Synthetic peptide
  Seed: KVLEHVVRV (MAGA4_HUMAN)
KHLEHVVRY

SEQ ID NO: 61311 - protein, 10 aa, Artificial Sequence
  Description of Artificial Sequence: Synthetic peptide
  Seed: RVRIAYPSLR (MAGA4_HUMAN)
RCRIAYPSLI

SEQ ID NO: 61312 - protein, 9 aa, Artificial Sequence
  Description of Artificial Sequence: Synthetic peptide
  Seed: SALPTTISF (MAGA4_HUMAN)
SNLPTTISF

SEQ ID NO: 61313 - protein, 10 aa, Artificial Sequence
  Description of Artificial Sequence: Synthetic peptide
  Seed: VIFGKASESL (MAGA4_HUMAN)
VMFGKASESI

SEQ ID NO: 61314 - protein, 9 aa, Artificial Sequence
  Description of Artificial Sequence: Synthetic peptide
  Seed: EAQEEALGL (MAGA4_HUMAN)
EVQEEALGY

SEQ ID NO: 61315 - protein, 11 aa, Artificial Sequence
  Description of Artificial Sequence: Synthetic peptide
  Seed: ELVTKAEMLER (MAGA4_HUMAN)
ETVTKAEMLEK

SEQ ID NO: 61316 - protein, 9 aa, Artificial Sequence
  Description of Artificial Sequence: Synthetic peptide
  Seed: RVRIAYPSL (MAGA4_HUMAN)
RSRIAYPSV

SEQ ID NO: 61317 - protein, 9 aa, Artificial Sequence
  Description of Artificial Sequence: Synthetic peptide
  Seed: RVRIAYPSL (MAGA4_HUMAN)
RLRIAYPSW

SEQ ID NO: 61318 - protein, 9 aa, Artificial Sequence
  Description of Artificial Sequence: Synthetic peptide
  Seed: ELAHFLLRK (MAGA4_HUMAN)
EAAHFLLRR

SEQ ID NO: 61319 - protein, 11 aa, Artificial Sequence
  Description of Artificial Sequence: Synthetic peptide
  Seed: RQVPGSNPARY (MAGA4_HUMAN)
RRVPGSNPARY

SEQ ID NO: 61320 - protein, 9 aa, Artificial Sequence
  Description of Artificial Sequence: Synthetic peptide
  Seed: ARVRIAYPS (MAGA4_HUMAN)
ARVRIAYPF

SEQ ID NO: 61321 - protein, 9 aa, Artificial Sequence
  Description of Artificial Sequence: Synthetic peptide
  Seed: IIVLGTIAM (MAGA4_HUMAN)
IEVLGTIAM

SEQ ID NO: 61322 - protein, 10 aa, Artificial Sequence
  Description of Artificial Sequence: Synthetic peptide
  Seed: EAAVSSSSPL (MAGA4_HUMAN)
EIAVSSSSPR

SEQ ID NO: 61323 - protein, 9 aa, Artificial Sequence
  Description of Artificial Sequence: Synthetic peptide
  Seed: TQDWVQENY (MAGA4_HUMAN)
TVDWVQENF

SEQ ID NO: 61324 - protein, 9 aa, Artificial Sequence
  Description of Artificial Sequence: Synthetic peptide
  Seed: IIVLGTIAM (MAGA4_HUMAN)
IQVLGTIAI

SEQ ID NO: 61325 - protein, 9 aa, Artificial Sequence
  Description of Artificial Sequence: Synthetic peptide
  Seed: IIVLGTIAM (MAGA4_HUMAN)
IAVLGTIAY

SEQ ID NO: 61326 - protein, 10 aa, Artificial Sequence
  Description of Artificial Sequence: Synthetic peptide
  Seed: RVNARVRIAY (MAGA4_HUMAN)
RQNARVRIAK

SEQ ID NO: 61327 - protein, 9 aa, Artificial Sequence
  Description of Artificial Sequence: Synthetic peptide
  Seed: YPSLREAAL (MAGA4_HUMAN)
YASLREAAL

SEQ ID NO: 61328 - protein, 10 aa, Artificial Sequence
  Description of Artificial Sequence: Synthetic peptide
  Seed: RVNARVRIAY (MAGA4_HUMAN)
RINARVRIAW

SEQ ID NO: 61329 - protein, 9 aa, Artificial Sequence
  Description of Artificial Sequence: Synthetic peptide
  Seed: QIFPKTGLL (MAGA4_HUMAN)
QIFPKTGLW

SEQ ID NO: 61330 - protein, 9 aa, Artificial Sequence
  Description of Artificial Sequence: Synthetic peptide
  Seed: VRIAYPSLR (MAGA4_HUMAN)
VYIAYPSLR

SEQ ID NO: 61331 - protein, 9 aa, Artificial Sequence
  Description of Artificial Sequence: Synthetic peptide
  Seed: RQVPGSNPA (MAGA4_HUMAN)
RVVPGSNPY

SEQ ID NO: 61332 - protein, 11 aa, Artificial Sequence
  Description of Artificial Sequence: Synthetic peptide
  Seed: KVDELAHFLLR (MAGA4_HUMAN)
KADELAHFLLR

SEQ ID NO: 61333 - protein, 10 aa, Artificial Sequence
  Description of Artificial Sequence: Synthetic peptide
  Seed: KNYKRCFPVI (MAGA4_HUMAN)
KFYKRCFPVK

SEQ ID NO: 61334 - protein, 9 aa, Artificial Sequence
  Description of Artificial Sequence: Synthetic peptide
  Seed: RAKELVTKA (MAGA4_HUMAN)
RVKELVTKF

SEQ ID NO: 61335 - protein, 9 aa, Artificial Sequence
  Description of Artificial Sequence: Synthetic peptide
  Seed: TVYGEPRKL (MAGA4_HUMAN)
TIYGEPRKW

SEQ ID NO: 61336 - protein, 10 aa, Artificial Sequence
  Description of Artificial Sequence: Synthetic peptide
  Seed: QIFPKTGLLI (MAGA4_HUMAN)
QVFPKTGLLY

SEQ ID NO: 61337 - protein, 9 aa, Artificial Sequence
  Description of Artificial Sequence: Synthetic peptide
  Seed: IIVLGTIAM (MAGA4_HUMAN)
IVVLGTIAL

SEQ ID NO: 61338 - protein, 10 aa, Artificial Sequence
  Description of Artificial Sequence: Synthetic peptide
  Seed: LPTTISFTCW (MAGA4_HUMAN)
LTTTISFTCF

SEQ ID NO: 61339 - protein, 10 aa, Artificial Sequence
  Description of Artificial Sequence: Synthetic peptide
  Seed: MIFGIDVKEV (MAGA4_HUMAN)
MIFGIDVKEI

SEQ ID NO: 61340 - protein, 9 aa, Artificial Sequence
  Description of Artificial Sequence: Synthetic peptide
  Seed: QIFPKTGLL (MAGA4_HUMAN)
QIFPKTGLR

SEQ ID NO: 61341 - protein, 9 aa, Artificial Sequence
  Description of Artificial Sequence: Synthetic peptide
  Seed: VVRVNARVR (MAGA4_HUMAN)
VSRVNARVK

SEQ ID NO: 61342 - protein, 10 aa, Artificial Sequence
  Description of Artificial Sequence: Synthetic peptide
  Seed: KNYKRCFPVI (MAGA4_HUMAN)
KLYKRCFPVA

SEQ ID NO: 61343 - protein, 9 aa, Artificial Sequence
  Description of Artificial Sequence: Synthetic peptide
  Seed: VYDGREHTV (MAGA4_HUMAN)
VWDGREHTM

SEQ ID NO: 61344 - protein, 9 aa, Artificial Sequence
  Description of Artificial Sequence: Synthetic peptide
  Seed: SAGPPQSPQ (MAGA4_HUMAN)
STGPPQSPM

SEQ ID NO: 61345 - protein, 9 aa, Artificial Sequence
  Description of Artificial Sequence: Synthetic peptide
  Seed: GASALPTTI (MAGA4_HUMAN)
GRSALPTTF

SEQ ID NO: 61346 - protein, 9 aa, Artificial Sequence
  Description of Artificial Sequence: Synthetic peptide
  Seed: ALSNKVDEL (MAGA4_HUMAN)
ALSNKVDEW

SEQ ID NO: 61347 - protein, 10 aa, Artificial Sequence
  Description of Artificial Sequence: Synthetic peptide
  Seed: KEVDPASNTY (MAGA4_HUMAN)
KSVDPASNTL

SEQ ID NO: 61348 - protein, 8 aa, Artificial Sequence
  Description of Artificial Sequence: Synthetic peptide
  Seed: FGIDVKEV (MAGA4_HUMAN)
FQIDVKEV

SEQ ID NO: 61349 - protein, 10 aa, Artificial Sequence
  Description of Artificial Sequence: Synthetic peptide
  Seed: VDPASNTYTL (MAGA4_HUMAN)
VCPASNTYTF

SEQ ID NO: 61350 - protein, 9 aa, Artificial Sequence
  Description of Artificial Sequence: Synthetic peptide
  Seed: RAKELVTKA (MAGA4_HUMAN)
RTKELVTKF

SEQ ID NO: 61351 - protein, 11 aa, Artificial Sequence
  Description of Artificial Sequence: Synthetic peptide
  Seed: AQAPTTEEQEA (MAGA4_HUMAN)
AEAPTTEEQEC

SEQ ID NO: 61352 - protein, 9 aa, Artificial Sequence
  Description of Artificial Sequence: Synthetic peptide
  Seed: AESLFREAL (MAGA4_HUMAN)
ARSLFREAY

SEQ ID NO: 61353 - protein, 9 aa, Artificial Sequence
  Description of Artificial Sequence: Synthetic peptide
  Seed: AEMLERVIK (MAGA4_HUMAN)
AEMLERVIM

SEQ ID NO: 61354 - protein, 11 aa, Artificial Sequence
  Description of Artificial Sequence: Synthetic peptide
  Seed: RQVPGSNPARY (MAGA4_HUMAN)
RAVPGSNPARY

SEQ ID NO: 61355 - protein, 9 aa, Artificial Sequence
  Description of Artificial Sequence: Synthetic peptide
  Seed: ASESLKMIF (MAGA4_HUMAN)
ATESLKMIW

SEQ ID NO: 61356 - protein, 9 aa, Artificial Sequence
  Description of Artificial Sequence: Synthetic peptide
  Seed: GVYDGREHT (MAGA4_HUMAN)
GQYDGREHL

SEQ ID NO: 61357 - protein, 10 aa, Artificial Sequence
  Description of Artificial Sequence: Synthetic peptide
  Seed: YRQVPGSNPA (MAGA4_HUMAN)
YHQVPGSNPM

SEQ ID NO: 61358 - protein, 10 aa, Artificial Sequence
  Description of Artificial Sequence: Synthetic peptide
  Seed: VEAQEEALGL (MAGA4_HUMAN)
VEAQEEALGF

SEQ ID NO: 61359 - protein, 9 aa, Artificial Sequence
  Description of Artificial Sequence: Synthetic peptide
  Seed: KVDELAHFL (MAGA4_HUMAN)
KADELAHFF

SEQ ID NO: 61360 - protein, 9 aa, Artificial Sequence
  Description of Artificial Sequence: Synthetic peptide
  Seed: RVNARVRIA (MAGA4_HUMAN)
RPNARVRIA

SEQ ID NO: 61361 - protein, 10 aa, Artificial Sequence
  Description of Artificial Sequence: Synthetic peptide
  Seed: RVNARVRIAY (MAGA4_HUMAN)
RKNARVRIAY

SEQ ID NO: 61362 - protein, 10 aa, Artificial Sequence
  Description of Artificial Sequence: Synthetic peptide
  Seed: QIFPKTGLLI (MAGA4_HUMAN)
QWFPKTGLLF

SEQ ID NO: 61363 - protein, 10 aa, Artificial Sequence
  Description of Artificial Sequence: Synthetic peptide
  Seed: KNYKRCFPVI (MAGA4_HUMAN)
KTYKRCFPVT

SEQ ID NO: 61364 - protein, 9 aa, Artificial Sequence
  Description of Artificial Sequence: Synthetic peptide
  Seed: SYVKVLEHV (MAGA4_HUMAN)
SAVKVLEHI

SEQ ID NO: 61365 - protein, 9 aa, Artificial Sequence
  Description of Artificial Sequence: Synthetic peptide
  Seed: HVVRVNARV (MAGA4_HUMAN)
HAVRVNARR

SEQ ID NO: 61366 - protein, 10 aa, Artificial Sequence
  Description of Artificial Sequence: Synthetic peptide
  Seed: LPTTISFTCW (MAGA4_HUMAN)
LSTTISFTCI

SEQ ID NO: 61367 - protein, 10 aa, Artificial Sequence
  Description of Artificial Sequence: Synthetic peptide
  Seed: RVRIAYPSLR (MAGA4_HUMAN)
RWRIAYPSLL

SEQ ID NO: 61368 - protein, 9 aa, Artificial Sequence
  Description of Artificial Sequence: Synthetic peptide
  Seed: KELVTKAEM (MAGA4_HUMAN)
KALVTKAEY

SEQ ID NO: 61369 - protein, 9 aa, Artificial Sequence
  Description of Artificial Sequence: Synthetic peptide
  Seed: EVDPASNTY (MAGA4_HUMAN)
EIDPASNTF

SEQ ID NO: 61370 - protein, 11 aa, Artificial Sequence
  Description of Artificial Sequence: Synthetic peptide
  Seed: STSPDAESLFR (MAGA4_HUMAN)
SVSPDAESLFY

SEQ ID NO: 61371 - protein, 9 aa, Artificial Sequence
  Description of Artificial Sequence: Synthetic peptide
  Seed: QIFPKTGLL (MAGA4_HUMAN)
QAFPKTGLL

SEQ ID NO: 61372 - protein, 9 aa, Artificial Sequence
  Description of Artificial Sequence: Synthetic peptide
  Seed: EVDPASNTY (MAGA4_HUMAN)
EWDPASNTL

SEQ ID NO: 61373 - protein, 9 aa, Artificial Sequence
  Description of Artificial Sequence: Synthetic peptide
  Seed: IIVLGTIAM (MAGA4_HUMAN)
IYVLGTIAI

SEQ ID NO: 61374 - protein, 9 aa, Artificial Sequence
  Description of Artificial Sequence: Synthetic peptide
  Seed: SSPLVPGTL (MAGA4_HUMAN)
SLPLVPGTM

SEQ ID NO: 61375 - protein, 9 aa, Artificial Sequence
  Description of Artificial Sequence: Synthetic peptide
  Seed: RQVPGSNPA (MAGA4_HUMAN)
RHVPGSNPF

SEQ ID NO: 61376 - protein, 9 aa, Artificial Sequence
  Description of Artificial Sequence: Synthetic peptide
  Seed: KYRAKELVT (MAGA4_HUMAN)
KIRAKELVA

SEQ ID NO: 61377 - protein, 9 aa, Artificial Sequence
  Description of Artificial Sequence: Synthetic peptide
  Seed: YPSLREAAL (MAGA4_HUMAN)
YTSLREAAM

SEQ ID NO: 61378 - protein, 9 aa, Artificial Sequence
  Description of Artificial Sequence: Synthetic peptide
  Seed: ERVIKNYKR (MAGA4_HUMAN)
EAVIKNYKR

SEQ ID NO: 61379 - protein, 9 aa, Artificial Sequence
  Description of Artificial Sequence: Synthetic peptide
  Seed: SYVKVLEHV (MAGA4_HUMAN)
SSVKVLEHI

SEQ ID NO: 61380 - protein, 10 aa, Artificial Sequence
  Description of Artificial Sequence: Synthetic peptide
  Seed: YRQVPGSNPA (MAGA4_HUMAN)
YHQVPGSNPV

SEQ ID NO: 61381 - protein, 9 aa, Artificial Sequence
  Description of Artificial Sequence: Synthetic peptide
  Seed: EHVVRVNAR (MAGA4_HUMAN)
EVVVRVNAR

SEQ ID NO: 61382 - protein, 9 aa, Artificial Sequence
  Description of Artificial Sequence: Synthetic peptide
  Seed: VYDGREHTV (MAGA4_HUMAN)
VYDGREHTC

SEQ ID NO: 61383 - protein, 9 aa, Artificial Sequence
  Description of Artificial Sequence: Synthetic peptide
  Seed: IAYPSLREA (MAGA4_HUMAN)
IIYPSLREL

SEQ ID NO: 61384 - protein, 9 aa, Artificial Sequence
  Description of Artificial Sequence: Synthetic peptide
  Seed: GTLEEVPAA (MAGA4_HUMAN)
GILEEVPAM

SEQ ID NO: 61385 - protein, 9 aa, Artificial Sequence
  Description of Artificial Sequence: Synthetic peptide
  Seed: GTLEEVPAA (MAGA4_HUMAN)
GMLEEVPAA

SEQ ID NO: 61386 - protein, 9 aa, Artificial Sequence
  Description of Artificial Sequence: Synthetic peptide
  Seed: IIVLGTIAM (MAGA4_HUMAN)
IHVLGTIAF

SEQ ID NO: 61387 - protein, 9 aa, Artificial Sequence
  Description of Artificial Sequence: Synthetic peptide
  Seed: AAVSSSSPL (MAGA4_HUMAN)
AAVSSSSPM

SEQ ID NO: 61388 - protein, 10 aa, Artificial Sequence
  Description of Artificial Sequence: Synthetic peptide
  Seed: KVDELAHFLL (MAGA4_HUMAN)
KMDELAHFLM

SEQ ID NO: 61389 - protein, 10 aa, Artificial Sequence
  Description of Artificial Sequence: Synthetic peptide
  Seed: YRQVPGSNPA (MAGA4_HUMAN)
YTQVPGSNPY

SEQ ID NO: 61390 - protein, 9 aa, Artificial Sequence
  Description of Artificial Sequence: Synthetic peptide
  Seed: RCFPVIFGK (MAGA4_HUMAN)
RLFPVIFGV

SEQ ID NO: 61391 - protein, 9 aa, Artificial Sequence
  Description of Artificial Sequence: Synthetic peptide
  Seed: VYDGREHTV (MAGA4_HUMAN)
VCDGREHTV

SEQ ID NO: 61392 - protein, 9 aa, Artificial Sequence
  Description of Artificial Sequence: Synthetic peptide
  Seed: SALPTTISF (MAGA4_HUMAN)
SFLPTTISV

SEQ ID NO: 61393 - protein, 10 aa, Artificial Sequence
  Description of Artificial Sequence: Synthetic peptide
  Seed: EEQEAAVSSS (MAGA4_HUMAN)
EEQEAAVSSL

SEQ ID NO: 61394 - protein, 9 aa, Artificial Sequence
  Description of Artificial Sequence: Synthetic peptide
  Seed: TVYGEPRKL (MAGA4_HUMAN)
TMYGEPRKY

SEQ ID NO: 61395 - protein, 10 aa, Artificial Sequence
  Description of Artificial Sequence: Synthetic peptide
  Seed: YRQVPGSNPA (MAGA4_HUMAN)
YAQVPGSNPL

SEQ ID NO: 61396 - protein, 9 aa, Artificial Sequence
  Description of Artificial Sequence: Synthetic peptide
  Seed: SALPTTISF (MAGA4_HUMAN)
SQLPTTISM

SEQ ID NO: 61397 - protein, 10 aa, Artificial Sequence
  Description of Artificial Sequence: Synthetic peptide
  Seed: VIFGKASESL (MAGA4_HUMAN)
VQFGKASESL

SEQ ID NO: 61398 - protein, 9 aa, Artificial Sequence
  Description of Artificial Sequence: Synthetic peptide
  Seed: KVDELAHFL (MAGA4_HUMAN)
KLDELAHFF

SEQ ID NO: 61399 - protein, 9 aa, Artificial Sequence
  Description of Artificial Sequence: Synthetic peptide
  Seed: SALPTTISF (MAGA4_HUMAN)
SHLPTTISI

SEQ ID NO: 61400 - protein, 9 aa, Artificial Sequence
  Description of Artificial Sequence: Synthetic peptide
  Seed: TQDWVQENY (MAGA4_HUMAN)
TIDWVQENF

SEQ ID NO: 61401 - protein, 10 aa, Artificial Sequence
  Description of Artificial Sequence: Synthetic peptide
  Seed: ARVRIAYPSL (MAGA4_HUMAN)
ATVRIAYPSL

SEQ ID NO: 61402 - protein, 9 aa, Artificial Sequence
  Description of Artificial Sequence: Synthetic peptide
  Seed: RKYRAKELV (MAGA4_HUMAN)
REYRAKELY

SEQ ID NO: 61403 - protein, 9 aa, Artificial Sequence
  Description of Artificial Sequence: Synthetic peptide
  Seed: RCFPVIFGK (MAGA4_HUMAN)
RWFPVIFGR

SEQ ID NO: 61404 - protein, 10 aa, Artificial Sequence
  Description of Artificial Sequence: Synthetic peptide
  Seed: KNYKRCFPVI (MAGA4_HUMAN)
KAYKRCFPVV

SEQ ID NO: 61405 - protein, 11 aa, Artificial Sequence
  Description of Artificial Sequence: Synthetic peptide
  Seed: RVNARVRIAYP (MAGA4_HUMAN)
RYNARVRIAYK

SEQ ID NO: 61406 - protein, 9 aa, Artificial Sequence
  Description of Artificial Sequence: Synthetic peptide
  Seed: TTISFTCWR (MAGA4_HUMAN)
TTISFTCWY

SEQ ID NO: 61407 - protein, 9 aa, Artificial Sequence
  Description of Artificial Sequence: Synthetic peptide
  Seed: LGNNQIFPK (MAGA4_HUMAN)
LANNQIFPL

SEQ ID NO: 61408 - protein, 10 aa, Artificial Sequence
  Description of Artificial Sequence: Synthetic peptide
  Seed: VDPASNTYTL (MAGA4_HUMAN)
VTPASNTYTF

SEQ ID NO: 61409 - protein, 9 aa, Artificial Sequence
  Description of Artificial Sequence: Synthetic peptide
  Seed: GKASESLKM (MAGA4_HUMAN)
GQASESLKM

SEQ ID NO: 61410 - protein, 10 aa, Artificial Sequence
  Description of Artificial Sequence: Synthetic peptide
  Seed: KNYKRCFPVI (MAGA4_HUMAN)
KIYKRCFPVK

SEQ ID NO: 61411 - protein, 10 aa, Artificial Sequence
  Description of Artificial Sequence: Synthetic peptide
  Seed: SYVKVLEHVV (MAGA4_HUMAN)
SYVKVLEHVI

SEQ ID NO: 61412 - protein, 9 aa, Artificial Sequence
  Description of Artificial Sequence: Synthetic peptide
  Seed: EAQEEALGL (MAGA4_HUMAN)
ETQEEALGF

SEQ ID NO: 61413 - protein, 9 aa, Artificial Sequence
  Description of Artificial Sequence: Synthetic peptide
  Seed: YPSLREAAL (MAGA4_HUMAN)
YSSLREAAL

SEQ ID NO: 61414 - protein, 9 aa, Artificial Sequence
  Description of Artificial Sequence: Synthetic peptide
  Seed: SALPTTISF (MAGA4_HUMAN)
SDLPTTISM

SEQ ID NO: 61415 - protein, 10 aa, Artificial Sequence
  Description of Artificial Sequence: Synthetic peptide
  Seed: RVRIAYPSLR (MAGA4_HUMAN)
RQRIAYPSLA

SEQ ID NO: 61416 - protein, 11 aa, Artificial Sequence
  Description of Artificial Sequence: Synthetic peptide
  Seed: ELGVMGVYDGR (MAGA4_HUMAN)
EMGVMGVYDGR

SEQ ID NO: 61417 - protein, 9 aa, Artificial Sequence
  Description of Artificial Sequence: Synthetic peptide
  Seed: LPTTISFTC (MAGA4_HUMAN)
LPTTISFTW

SEQ ID NO: 61418 - protein, 9 aa, Artificial Sequence
  Description of Artificial Sequence: Synthetic peptide
  Seed: ASESLKMIF (MAGA4_HUMAN)
AAESLKMIW

SEQ ID NO: 61419 - protein, 9 aa, Artificial Sequence
  Description of Artificial Sequence: Synthetic peptide
  Seed: KYRAKELVT (MAGA4_HUMAN)
KMRAKELVV

SEQ ID NO: 61420 - protein, 9 aa, Artificial Sequence
  Description of Artificial Sequence: Synthetic peptide
  Seed: TVYGEPRKL (MAGA4_HUMAN)
TTYGEPRKM

SEQ ID NO: 61421 - protein, 10 aa, Artificial Sequence
  Description of Artificial Sequence: Synthetic peptide
  Seed: HTVYGEPRKL (MAGA4_HUMAN)
HVVYGEPRKR

SEQ ID NO: 61422 - protein, 9 aa, Artificial Sequence
  Description of Artificial Sequence: Synthetic peptide
  Seed: VYDGREHTV (MAGA4_HUMAN)
VMDGREHTF

SEQ ID NO: 61423 - protein, 10 aa, Artificial Sequence
  Description of Artificial Sequence: Synthetic peptide
  Seed: KVLEHVVRVN (MAGA4_HUMAN)
KMLEHVVRVN

SEQ ID NO: 61424 - protein, 9 aa, Artificial Sequence
  Description of Artificial Sequence: Synthetic peptide
  Seed: KVDELAHFL (MAGA4_HUMAN)
KLDELAHFL

SEQ ID NO: 61425 - protein, 10 aa, Artificial Sequence
  Description of Artificial Sequence: Synthetic peptide
  Seed: ASALPTTISF (MAGA4_HUMAN)
AKALPTTISF

SEQ ID NO: 61426 - protein, 11 aa, Artificial Sequence
  Description of Artificial Sequence: Synthetic peptide
  Seed: RQVPGSNPARY (MAGA4_HUMAN)
RMVPGSNPARW

SEQ ID NO: 61427 - protein, 9 aa, Artificial Sequence
  Description of Artificial Sequence: Synthetic peptide
  Seed: QIFPKTGLL (MAGA4_HUMAN)
QIFPKTGLF

SEQ ID NO: 61428 - protein, 9 aa, Artificial Sequence
  Description of Artificial Sequence: Synthetic peptide
  Seed: EIWEELGVM (MAGA4_HUMAN)
EIWEELGVR

SEQ ID NO: 61429 - protein, 9 aa, Artificial Sequence
  Description of Artificial Sequence: Synthetic peptide
  Seed: KASESLKMI (MAGA4_HUMAN)
KASESLKMF

SEQ ID NO: 61430 - protein, 10 aa, Artificial Sequence
  Description of Artificial Sequence: Synthetic peptide
  Seed: TSYVKVLEHV (MAGA4_HUMAN)
TGYVKVLEHL

SEQ ID NO: 61431 - protein, 9 aa, Artificial Sequence
  Description of Artificial Sequence: Synthetic peptide
  Seed: RCFPVIFGK (MAGA4_HUMAN)
RIFPVIFGH

SEQ ID NO: 61432 - protein, 9 aa, Artificial Sequence
  Description of Artificial Sequence: Synthetic peptide
  Seed: TVYGEPRKL (MAGA4_HUMAN)
TGYGEPRKL

SEQ ID NO: 61433 - protein, 10 aa, Artificial Sequence
  Description of Artificial Sequence: Synthetic peptide
  Seed: ESAGPPQSPQ (MAGA4_HUMAN)
EAAGPPQSPK

SEQ ID NO: 61434 - protein, 10 aa, Artificial Sequence
  Description of Artificial Sequence: Synthetic peptide
  Seed: RVRIAYPSLR (MAGA4_HUMAN)
RTRIAYPSLI

SEQ ID NO: 61435 - protein, 9 aa, Artificial Sequence
  Description of Artificial Sequence: Synthetic peptide
  Seed: KNYKRCFPV (MAGA4_HUMAN)
KTYKRCFPG

SEQ ID NO: 61436 - protein, 10 aa, Artificial Sequence
  Description of Artificial Sequence: Synthetic peptide
  Seed: LAHFLLRKYR (MAGA4_HUMAN)
LFHFLLRKYK

SEQ ID NO: 61437 - protein, 9 aa, Artificial Sequence
  Description of Artificial Sequence: Synthetic peptide
  Seed: YPSLREAAL (MAGA4_HUMAN)
YSSLREAAV

SEQ ID NO: 61438 - protein, 9 aa, Artificial Sequence
  Description of Artificial Sequence: Synthetic peptide
  Seed: KVDELAHFL (MAGA4_HUMAN)
KMDELAHFT

SEQ ID NO: 61439 - protein, 10 aa, Artificial Sequence
  Description of Artificial Sequence: Synthetic peptide
  Seed: LAHFLLRKYR (MAGA4_HUMAN)
LTHFLLRKYR

SEQ ID NO: 61440 - protein, 9 aa, Artificial Sequence
  Description of Artificial Sequence: Synthetic peptide
  Seed: MSSEQKSQH (MAGA4_HUMAN)
MISEQKSQF

SEQ ID NO: 61441 - protein, 10 aa, Artificial Sequence
  Description of Artificial Sequence: Synthetic peptide
  Seed: KVDELAHFLL (MAGA4_HUMAN)
KMDELAHFLQ

SEQ ID NO: 61442 - protein, 10 aa, Artificial Sequence
  Description of Artificial Sequence: Synthetic peptide
  Seed: KVLEHVVRVN (MAGA4_HUMAN)
KMLEHVVRVR

SEQ ID NO: 61443 - protein, 9 aa, Artificial Sequence
  Description of Artificial Sequence: Synthetic peptide
  Seed: SALPTTISF (MAGA4_HUMAN)
SWLPTTISM

SEQ ID NO: 61444 - protein, 10 aa, Artificial Sequence
  Description of Artificial Sequence: Synthetic peptide
  Seed: RQVPGSNPAR (MAGA4_HUMAN)
RVVPGSNPAM

SEQ ID NO: 61445 - protein, 10 aa, Artificial Sequence
  Description of Artificial Sequence: Synthetic peptide
  Seed: NKVDELAHFL (MAGA4_HUMAN)
NHVDELAHFM

SEQ ID NO: 61446 - protein, 10 aa, Artificial Sequence
  Description of Artificial Sequence: Synthetic peptide
  Seed: KVDELAHFLL (MAGA4_HUMAN)
KMDELAHFLR

SEQ ID NO: 61447 - protein, 9 aa, Artificial Sequence
  Description of Artificial Sequence: Synthetic peptide
  Seed: EEALGLVGA (MAGA4_HUMAN)
EEALGLVGI

SEQ ID NO: 61448 - protein, 9 aa, Artificial Sequence
  Description of Artificial Sequence: Synthetic peptide
  Seed: VRIAYPSLR (MAGA4_HUMAN)
VRIAYPSLY

SEQ ID NO: 61449 - protein, 9 aa, Artificial Sequence
  Description of Artificial Sequence: Synthetic peptide
  Seed: EVDPASNTY (MAGA4_HUMAN)
ELDPASNTF

SEQ ID NO: 61450 - protein, 11 aa, Artificial Sequence
  Description of Artificial Sequence: Synthetic peptide
  Seed: SSSSPLVPGTL (MAGA4_HUMAN)
SMSSPLVPGTW

SEQ ID NO: 61451 - protein, 10 aa, Artificial Sequence
  Description of Artificial Sequence: Synthetic peptide
  Seed: MLERVIKNYK (MAGA4_HUMAN)
MVERVIKNYR

SEQ ID NO: 61452 - protein, 11 aa, Artificial Sequence
  Description of Artificial Sequence: Synthetic peptide
  Seed: AQAPTTEEQEA (MAGA4_HUMAN)
AEAPTTEEQEI

SEQ ID NO: 61453 - protein, 9 aa, Artificial Sequence
  Description of Artificial Sequence: Synthetic peptide
  Seed: STSPDAESL (MAGA4_HUMAN)
SYSPDAESF

SEQ ID NO: 61454 - protein, 9 aa, Artificial Sequence
  Description of Artificial Sequence: Synthetic peptide
  Seed: KVLEHVVRV (MAGA4_HUMAN)
KRLEHVVRY

SEQ ID NO: 61455 - protein, 9 aa, Artificial Sequence
  Description of Artificial Sequence: Synthetic peptide
  Seed: LEHVVRVNA (MAGA4_HUMAN)
LEHVVRVNM

SEQ ID NO: 61456 - protein, 10 aa, Artificial Sequence
  Description of Artificial Sequence: Synthetic peptide
  Seed: KVDELAHFLL (MAGA4_HUMAN)
KIDELAHFLL

SEQ ID NO: 61457 - protein, 9 aa, Artificial Sequence
  Description of Artificial Sequence: Synthetic peptide
  Seed: GTLEEVPAA (MAGA4_HUMAN)
GMLEEVPAL

SEQ ID NO: 61458 - protein, 10 aa, Artificial Sequence
  Description of Artificial Sequence: Synthetic peptide
  Seed: KEVDPASNTY (MAGA4_HUMAN)
KQVDPASNTM

SEQ ID NO: 61459 - protein, 9 aa, Artificial Sequence
  Description of Artificial Sequence: Synthetic peptide
  Seed: ERVIKNYKR (MAGA4_HUMAN)
ETVIKNYKR

SEQ ID NO: 61460 - protein, 10 aa, Artificial Sequence
  Description of Artificial Sequence: Synthetic peptide
  Seed: KEVDPASNTY (MAGA4_HUMAN)
KLVDPASNTV

SEQ ID NO: 61461 - protein, 9 aa, Artificial Sequence
  Description of Artificial Sequence: Synthetic peptide
  Seed: RAKELVTKA (MAGA4_HUMAN)
RQKELVTKL

SEQ ID NO: 61462 - protein, 11 aa, Artificial Sequence
  Description of Artificial Sequence: Synthetic peptide
  Seed: RVNARVRIAYP (MAGA4_HUMAN)
RTNARVRIAYL

SEQ ID NO: 61463 - protein, 9 aa, Artificial Sequence
  Description of Artificial Sequence: Synthetic peptide
  Seed: TQDWVQENY (MAGA4_HUMAN)
TVDWVQENL

SEQ ID NO: 61464 - protein, 10 aa, Artificial Sequence
  Description of Artificial Sequence: Synthetic peptide
  Seed: LPTTISFTCW (MAGA4_HUMAN)
LPTTISFTCF

SEQ ID NO: 61465 - protein, 10 aa, Artificial Sequence
  Description of Artificial Sequence: Synthetic peptide
  Seed: TSYVKVLEHV (MAGA4_HUMAN)
TTYVKVLEHF

SEQ ID NO: 61466 - protein, 9 aa, Artificial Sequence
  Description of Artificial Sequence: Synthetic peptide
  Seed: RAKELVTKA (MAGA4_HUMAN)
RGKELVTKK

SEQ ID NO: 61467 - protein, 10 aa, Artificial Sequence
  Description of Artificial Sequence: Synthetic peptide
  Seed: KASESLKMIF (MAGA4_HUMAN)
KMSESLKMIW

SEQ ID NO: 61468 - protein, 10 aa, Artificial Sequence
  Description of Artificial Sequence: Synthetic peptide
  Seed: EHTVYGEPRK (MAGA4_HUMAN)
EDTVYGEPRR

SEQ ID NO: 61469 - protein, 9 aa, Artificial Sequence
  Description of Artificial Sequence: Synthetic peptide
  Seed: ARVRIAYPS (MAGA4_HUMAN)
AQVRIAYPL

SEQ ID NO: 61470 - protein, 10 aa, Artificial Sequence
  Description of Artificial Sequence: Synthetic peptide
  Seed: YRQVPGSNPA (MAGA4_HUMAN)
YIQVPGSNPL

SEQ ID NO: 61471 - protein, 9 aa, Artificial Sequence
  Description of Artificial Sequence: Synthetic peptide
  Seed: TQDWVQENY (MAGA4_HUMAN)
TMDWVQENW

SEQ ID NO: 61472 - protein, 9 aa, Artificial Sequence
  Description of Artificial Sequence: Synthetic peptide
  Seed: EEQEAAVSS (MAGA4_HUMAN)
EEQEAAVSY

SEQ ID NO: 61473 - protein, 9 aa, Artificial Sequence
  Description of Artificial Sequence: Synthetic peptide
  Seed: GASALPTTI (MAGA4_HUMAN)
GASALPTTL

SEQ ID NO: 61474 - protein, 10 aa, Artificial Sequence
  Description of Artificial Sequence: Synthetic peptide
  Seed: MLERVIKNYK (MAGA4_HUMAN)
MQERVIKNYR

SEQ ID NO: 61475 - protein, 10 aa, Artificial Sequence
  Description of Artificial Sequence: Synthetic peptide
  Seed: YRQVPGSNPA (MAGA4_HUMAN)
YIQVPGSNPW

SEQ ID NO: 61476 - protein, 9 aa, Artificial Sequence
  Description of Artificial Sequence: Synthetic peptide
  Seed: KVLEHVVRV (MAGA4_HUMAN)
KSLEHVVRY

SEQ ID NO: 61477 - protein, 9 aa, Artificial Sequence
  Description of Artificial Sequence: Synthetic peptide
  Seed: VYDGREHTV (MAGA4_HUMAN)
VPDGREHTM

SEQ ID NO: 61478 - protein, 11 aa, Artificial Sequence
  Description of Artificial Sequence: Synthetic peptide
  Seed: RVNARVRIAYP (MAGA4_HUMAN)
RANARVRIAYK

SEQ ID NO: 61479 - protein, 11 aa, Artificial Sequence
  Description of Artificial Sequence: Synthetic peptide
  Seed: RVNARVRIAYP (MAGA4_HUMAN)
RQNARVRIAYK

SEQ ID NO: 61480 - protein, 10 aa, Artificial Sequence
  Description of Artificial Sequence: Synthetic peptide
  Seed: RVNARVRIAY (MAGA4_HUMAN)
RTNARVRIAW

SEQ ID NO: 61481 - protein, 10 aa, Artificial Sequence
  Description of Artificial Sequence: Synthetic peptide
  Seed: YPSLREAALL (MAGA4_HUMAN)
YYSLREAALY

SEQ ID NO: 61482 - protein, 9 aa, Artificial Sequence
  Description of Artificial Sequence: Synthetic peptide
  Seed: YVKVLEHVV (MAGA4_HUMAN)
YPKVLEHVV

SEQ ID NO: 61483 - protein, 9 aa, Artificial Sequence
  Description of Artificial Sequence: Synthetic peptide
  Seed: LVPGTLEEV (MAGA4_HUMAN)
LQPGTLEEF

SEQ ID NO: 61484 - protein, 10 aa, Artificial Sequence
  Description of Artificial Sequence: Synthetic peptide
  Seed: RVRIAYPSLR (MAGA4_HUMAN)
RMRIAYPSLR

SEQ ID NO: 61485 - protein, 9 aa, Artificial Sequence
  Description of Artificial Sequence: Synthetic peptide
  Seed: VYDGREHTV (MAGA4_HUMAN)
VLDGREHTC

SEQ ID NO: 61486 - protein, 9 aa, Artificial Sequence
  Description of Artificial Sequence: Synthetic peptide
  Seed: EHTVYGEPR (MAGA4_HUMAN)
ESTVYGEPR

SEQ ID NO: 61487 - protein, 10 aa, Artificial Sequence
  Description of Artificial Sequence: Synthetic peptide
  Seed: RVNARVRIAY (MAGA4_HUMAN)
RSNARVRIAY

SEQ ID NO: 61488 - protein, 11 aa, Artificial Sequence
  Description of Artificial Sequence: Synthetic peptide
  Seed: RVNARVRIAYP (MAGA4_HUMAN)
RFNARVRIAYA

SEQ ID NO: 61489 - protein, 9 aa, Artificial Sequence
  Description of Artificial Sequence: Synthetic peptide
  Seed: TSPDAESLF (MAGA4_HUMAN)
TCPDAESLL

SEQ ID NO: 61490 - protein, 9 aa, Artificial Sequence
  Description of Artificial Sequence: Synthetic peptide
  Seed: KVLEHVVRV (MAGA4_HUMAN)
KQLEHVVRW

SEQ ID NO: 61491 - protein, 9 aa, Artificial Sequence
  Description of Artificial Sequence: Synthetic peptide
  Seed: SALPTTISF (MAGA4_HUMAN)
SALPTTISY

SEQ ID NO: 61492 - protein, 9 aa, Artificial Sequence
  Description of Artificial Sequence: Synthetic peptide
  Seed: RAKELVTKA (MAGA4_HUMAN)
RPKELVTKF

SEQ ID NO: 61493 - protein, 9 aa, Artificial Sequence
  Description of Artificial Sequence: Synthetic peptide
  Seed: KASESLKMI (MAGA4_HUMAN)
KSSESLKMY

SEQ ID NO: 61494 - protein, 9 aa, Artificial Sequence
  Description of Artificial Sequence: Synthetic peptide
  Seed: KVDELAHFL (MAGA4_HUMAN)
KADELAHFC

SEQ ID NO: 61495 - protein, 9 aa, Artificial Sequence
  Description of Artificial Sequence: Synthetic peptide
  Seed: ALPTTISFT (MAGA4_HUMAN)
AIPTTISFV

SEQ ID NO: 61496 - protein, 11 aa, Artificial Sequence
  Description of Artificial Sequence: Synthetic peptide
  Seed: ESLFREALSNK (MAGA4_HUMAN)
ESLFREALSNR

SEQ ID NO: 61497 - protein, 10 aa, Artificial Sequence
  Description of Artificial Sequence: Synthetic peptide
  Seed: ASALPTTISF (MAGA4_HUMAN)
AMALPTTISY

SEQ ID NO: 61498 - protein, 10 aa, Artificial Sequence
  Description of Artificial Sequence: Synthetic peptide
  Seed: KVLEHVVRVN (MAGA4_HUMAN)
KMLEHVVRVT

SEQ ID NO: 61499 - protein, 10 aa, Artificial Sequence
  Description of Artificial Sequence: Synthetic peptide
  Seed: VDPASNTYTL (MAGA4_HUMAN)
VTPASNTYTL

SEQ ID NO: 61500 - protein, 9 aa, Artificial Sequence
  Description of Artificial Sequence: Synthetic peptide
  Seed: AESAGPPQS (MAGA4_HUMAN)
AESAGPPQL

SEQ ID NO: 61501 - protein, 9 aa, Artificial Sequence
  Description of Artificial Sequence: Synthetic peptide
  Seed: SNPARYEFL (MAGA4_HUMAN)
SSPARYEFL

SEQ ID NO: 61502 - protein, 9 aa, Artificial Sequence
  Description of Artificial Sequence: Synthetic peptide
  Seed: NKVDELAHF (MAGA4_HUMAN)
NHVDELAHV

SEQ ID NO: 61503 - protein, 9 aa, Artificial Sequence
  Description of Artificial Sequence: Synthetic peptide
  Seed: RVRIAYPSL (MAGA4_HUMAN)
RTRIAYPSH

SEQ ID NO: 61504 - protein, 11 aa, Artificial Sequence
  Description of Artificial Sequence: Synthetic peptide
  Seed: ESLFREALSNK (MAGA4_HUMAN)
EILFREALSNR

SEQ ID NO: 61505 - protein, 10 aa, Artificial Sequence
  Description of Artificial Sequence: Synthetic peptide
  Seed: IFPKTGLLII (MAGA4_HUMAN)
IYPKTGLLIM

SEQ ID NO: 61506 - protein, 9 aa, Artificial Sequence
  Description of Artificial Sequence: Synthetic peptide
  Seed: RVRIAYPSL (MAGA4_HUMAN)
RVRIAYPSD

SEQ ID NO: 61507 - protein, 9 aa, Artificial Sequence
  Description of Artificial Sequence: Synthetic peptide
  Seed: SYVKVLEHV (MAGA4_HUMAN)
SIVKVLEHA

SEQ ID NO: 61508 - protein, 9 aa, Artificial Sequence
  Description of Artificial Sequence: Synthetic peptide
  Seed: RVRIAYPSL (MAGA4_HUMAN)
RPRIAYPSS

SEQ ID NO: 61509 - protein, 9 aa, Artificial Sequence
  Description of Artificial Sequence: Synthetic peptide
  Seed: GVYDGREHT (MAGA4_HUMAN)
GVYDGREHL

SEQ ID NO: 61510 - protein, 10 aa, Artificial Sequence
  Description of Artificial Sequence: Synthetic peptide
  Seed: KYRAKELVTK (MAGA4_HUMAN)
KARAKELVTA

SEQ ID NO: 61511 - protein, 9 aa, Artificial Sequence
  Description of Artificial Sequence: Synthetic peptide
  Seed: AHFLLRKYR (MAGA4_HUMAN)
ALFLLRKYK

SEQ ID NO: 61512 - protein, 9 aa, Artificial Sequence
  Description of Artificial Sequence: Synthetic peptide
  Seed: TQDWVQENY (MAGA4_HUMAN)
TQDWVQENM

SEQ ID NO: 61513 - protein, 9 aa, Artificial Sequence
  Description of Artificial Sequence: Synthetic peptide
  Seed: KASESLKMI (MAGA4_HUMAN)
KVSESLKMY

SEQ ID NO: 61514 - protein, 9 aa, Artificial Sequence
  Description of Artificial Sequence: Synthetic peptide
  Seed: EVDPASNTY (MAGA4_HUMAN)
EYDPASNTF

SEQ ID NO: 61515 - protein, 9 aa, Artificial Sequence
  Description of Artificial Sequence: Synthetic peptide
  Seed: IIVLGTIAM (MAGA4_HUMAN)
IPVLGTIAI

SEQ ID NO: 61516 - protein, 9 aa, Artificial Sequence
  Description of Artificial Sequence: Synthetic peptide
  Seed: RVRIAYPSL (MAGA4_HUMAN)
RLRIAYPSE

SEQ ID NO: 61517 - protein, 10 aa, Artificial Sequence
  Description of Artificial Sequence: Synthetic peptide
  Seed: RQVPGSNPAR (MAGA4_HUMAN)
RAVPGSNPAK

SEQ ID NO: 61518 - protein, 10 aa, Artificial Sequence
  Description of Artificial Sequence: Synthetic peptide
  Seed: KASESLKMIF (MAGA4_HUMAN)
KESESLKMIW

SEQ ID NO: 61519 - protein, 9 aa, Artificial Sequence
  Description of Artificial Sequence: Synthetic peptide
  Seed: TQDWVQENY (MAGA4_HUMAN)
TFDWVQENY

SEQ ID NO: 61520 - protein, 9 aa, Artificial Sequence
  Description of Artificial Sequence: Synthetic peptide
  Seed: TVYGEPRKL (MAGA4_HUMAN)
TTYGEPRKV

SEQ ID NO: 61521 - protein, 9 aa, Artificial Sequence
  Description of Artificial Sequence: Synthetic peptide
  Seed: KVLEHVVRV (MAGA4_HUMAN)
KLLEHVVRR

SEQ ID NO: 61522 - protein, 9 aa, Artificial Sequence
  Description of Artificial Sequence: Synthetic peptide
  Seed: VYDGREHTV (MAGA4_HUMAN)
VQDGREHTF

SEQ ID NO: 61523 - protein, 10 aa, Artificial Sequence
  Description of Artificial Sequence: Synthetic peptide
  Seed: RVRIAYPSLR (MAGA4_HUMAN)
RDRIAYPSLM

SEQ ID NO: 61524 - protein, 9 aa, Artificial Sequence
  Description of Artificial Sequence: Synthetic peptide
  Seed: VYDGREHTV (MAGA4_HUMAN)
VWDGREHTV

SEQ ID NO: 61525 - protein, 10 aa, Artificial Sequence
  Description of Artificial Sequence: Synthetic peptide
  Seed: VYDGREHTVY (MAGA4_HUMAN)
VYDGREHTVL

SEQ ID NO: 61526 - protein, 11 aa, Artificial Sequence
  Description of Artificial Sequence: Synthetic peptide
  Seed: LSNKVDELAHF (MAGA4_HUMAN)
LTNKVDELAHF

SEQ ID NO: 61527 - protein, 10 aa, Artificial Sequence
  Description of Artificial Sequence: Synthetic peptide
  Seed: GVYDGREHTV (MAGA4_HUMAN)
GLYDGREHTK

SEQ ID NO: 61528 - protein, 9 aa, Artificial Sequence
  Description of Artificial Sequence: Synthetic peptide
  Seed: SYVKVLEHV (MAGA4_HUMAN)
SFVKVLEHM

SEQ ID NO: 61529 - protein, 9 aa, Artificial Sequence
  Description of Artificial Sequence: Synthetic peptide
  Seed: AAVSSSSPL (MAGA4_HUMAN)
ASVSSSSPM

SEQ ID NO: 61530 - protein, 10 aa, Artificial Sequence
  Description of Artificial Sequence: Synthetic peptide
  Seed: RVRIAYPSLR (MAGA4_HUMAN)
RSRIAYPSLK

SEQ ID NO: 61531 - protein, 9 aa, Artificial Sequence
  Description of Artificial Sequence: Synthetic peptide
  Seed: TQDWVQENY (MAGA4_HUMAN)
TSDWVQENI

SEQ ID NO: 61532 - protein, 9 aa, Artificial Sequence
  Description of Artificial Sequence: Synthetic peptide
  Seed: RVNARVRIA (MAGA4_HUMAN)
RMNARVRIK

SEQ ID NO: 61533 - protein, 10 aa, Artificial Sequence
  Description of Artificial Sequence: Synthetic peptide
  Seed: VDPASNTYTL (MAGA4_HUMAN)
VLPASNTYTL

SEQ ID NO: 61534 - protein, 9 aa, Artificial Sequence
  Description of Artificial Sequence: Synthetic peptide
  Seed: EVDPASNTY (MAGA4_HUMAN)
EVDPASNTK

SEQ ID NO: 61535 - protein, 11 aa, Artificial Sequence
  Description of Artificial Sequence: Synthetic peptide
  Seed: YVKVLEHVVRV (MAGA4_HUMAN)
YCKVLEHVVRV

SEQ ID NO: 61536 - protein, 9 aa, Artificial Sequence
  Description of Artificial Sequence: Synthetic peptide
  Seed: VNARVRIAY (MAGA4_HUMAN)
VSARVRIAM

SEQ ID NO: 61537 - protein, 10 aa, Artificial Sequence
  Description of Artificial Sequence: Synthetic peptide
  Seed: ASALPTTISF (MAGA4_HUMAN)
ARALPTTISY

SEQ ID NO: 61538 - protein, 10 aa, Artificial Sequence
  Description of Artificial Sequence: Synthetic peptide
  Seed: RVNARVRIAY (MAGA4_HUMAN)
RINARVRIAY

SEQ ID NO: 61539 - protein, 9 aa, Artificial Sequence
  Description of Artificial Sequence: Synthetic peptide
  Seed: DELAHFLLR (MAGA4_HUMAN)
DYLAHFLLK

SEQ ID NO: 61540 - protein, 9 aa, Artificial Sequence
  Description of Artificial Sequence: Synthetic peptide
  Seed: TQDWVQENY (MAGA4_HUMAN)
TSDWVQENV

SEQ ID NO: 61541 - protein, 9 aa, Artificial Sequence
  Description of Artificial Sequence: Synthetic peptide
  Seed: VYDGREHTV (MAGA4_HUMAN)
VADGREHTW

SEQ ID NO: 61542 - protein, 9 aa, Artificial Sequence
  Description of Artificial Sequence: Synthetic peptide
  Seed: NKVDELAHF (MAGA4_HUMAN)
NRVDELAHY

SEQ ID NO: 61543 - protein, 10 aa, Artificial Sequence
  Description of Artificial Sequence: Synthetic peptide
  Seed: KEVDPASNTY (MAGA4_HUMAN)
KMVDPASNTM

SEQ ID NO: 61544 - protein, 10 aa, Artificial Sequence
  Description of Artificial Sequence: Synthetic peptide
  Seed: KNYKRCFPVI (MAGA4_HUMAN)
KFYKRCFPVA

SEQ ID NO: 61545 - protein, 10 aa, Artificial Sequence
  Description of Artificial Sequence: Synthetic peptide
  Seed: LPTTISFTCW (MAGA4_HUMAN)
LDTTISFTCW

SEQ ID NO: 61546 - protein, 10 aa, Artificial Sequence
  Description of Artificial Sequence: Synthetic peptide
  Seed: FPKTGLLIIV (MAGA4_HUMAN)
FPKTGLLIIM

SEQ ID NO: 61547 - protein, 9 aa, Artificial Sequence
  Description of Artificial Sequence: Synthetic peptide
  Seed: KYRAKELVT (MAGA4_HUMAN)
KGRAKELVK

SEQ ID NO: 61548 - protein, 9 aa, Artificial Sequence
  Description of Artificial Sequence: Synthetic peptide
  Seed: HVVRVNARV (MAGA4_HUMAN)
HVVRVNARK

SEQ ID NO: 61549 - protein, 10 aa, Artificial Sequence
  Description of Artificial Sequence: Synthetic peptide
  Seed: KEVDPASNTY (MAGA4_HUMAN)
KFVDPASNTY

SEQ ID NO: 61550 - protein, 10 aa, Artificial Sequence
  Description of Artificial Sequence: Synthetic peptide
  Seed: ESAGPPQSPQ (MAGA4_HUMAN)
EAAGPPQSPR

SEQ ID NO: 61551 - protein, 9 aa, Artificial Sequence
  Description of Artificial Sequence: Synthetic peptide
  Seed: RAKELVTKA (MAGA4_HUMAN)
RSKELVTKV

SEQ ID NO: 61552 - protein, 9 aa, Artificial Sequence
  Description of Artificial Sequence: Synthetic peptide
  Seed: KVLEHVVRV (MAGA4_HUMAN)
KALEHVVRV

SEQ ID NO: 61553 - protein, 9 aa, Artificial Sequence
  Description of Artificial Sequence: Synthetic peptide
  Seed: ELAHFLLRK (MAGA4_HUMAN)
EVAHFLLRH

SEQ ID NO: 61554 - protein, 10 aa, Artificial Sequence
  Description of Artificial Sequence: Synthetic peptide
  Seed: ARVRIAYPSL (MAGA4_HUMAN)
AAVRIAYPSV

SEQ ID NO: 61555 - protein, 9 aa, Artificial Sequence
  Description of Artificial Sequence: Synthetic peptide
  Seed: KVLEHVVRV (MAGA4_HUMAN)
KFLEHVVRF

SEQ ID NO: 61556 - protein, 10 aa, Artificial Sequence
  Description of Artificial Sequence: Synthetic peptide
  Seed: KVLEHVVRVN (MAGA4_HUMAN)
KMLEHVVRVV

SEQ ID NO: 61557 - protein, 8 aa, Artificial Sequence
  Description of Artificial Sequence: Synthetic peptide
  Seed: ASALPTTI (MAGA4_HUMAN)
ASALPTTM

SEQ ID NO: 61558 - protein, 9 aa, Artificial Sequence
  Description of Artificial Sequence: Synthetic peptide
  Seed: RVRIAYPSL (MAGA4_HUMAN)
RCRIAYPSA

SEQ ID NO: 61559 - protein, 9 aa, Artificial Sequence
  Description of Artificial Sequence: Synthetic peptide
  Seed: EHVVRVNAR (MAGA4_HUMAN)
ETVVRVNAR

SEQ ID NO: 61560 - protein, 9 aa, Artificial Sequence
  Description of Artificial Sequence: Synthetic peptide
  Seed: IIVLGTIAM (MAGA4_HUMAN)
ITVLGTIAL

SEQ ID NO: 61561 - protein, 9 aa, Artificial Sequence
  Description of Artificial Sequence: Synthetic peptide
  Seed: DPASNTYTL (MAGA4_HUMAN)
DMASNTYTM

SEQ ID NO: 61562 - protein, 9 aa, Artificial Sequence
  Description of Artificial Sequence: Synthetic peptide
  Seed: RCFPVIFGK (MAGA4_HUMAN)
RLFPVIFGH

SEQ ID NO: 61563 - protein, 9 aa, Artificial Sequence
  Description of Artificial Sequence: Synthetic peptide
  Seed: VRVNARVRI (MAGA4_HUMAN)
VHVNARVRL

SEQ ID NO: 61564 - protein, 11 aa, Artificial Sequence
  Description of Artificial Sequence: Synthetic peptide
  Seed: ARVRIAYPSLR (MAGA4_HUMAN)
AYVRIAYPSLR

SEQ ID NO: 61565 - protein, 10 aa, Artificial Sequence
  Description of Artificial Sequence: Synthetic peptide
  Seed: RQVPGSNPAR (MAGA4_HUMAN)
RGVPGSNPAY

SEQ ID NO: 61566 - protein, 10 aa, Artificial Sequence
  Description of Artificial Sequence: Synthetic peptide
  Seed: VVRVNARVRI (MAGA4_HUMAN)
VMRVNARVRK

SEQ ID NO: 61567 - protein, 10 aa, Artificial Sequence
  Description of Artificial Sequence: Synthetic peptide
  Seed: KEVDPASNTY (MAGA4_HUMAN)
KPVDPASNTY

SEQ ID NO: 61568 - protein, 9 aa, Artificial Sequence
  Description of Artificial Sequence: Synthetic peptide
  Seed: WVQENYLEY (MAGA4_HUMAN)
WPQENYLEF

SEQ ID NO: 61569 - protein, 10 aa, Artificial Sequence
  Description of Artificial Sequence: Synthetic peptide
  Seed: LPTTISFTCW (MAGA4_HUMAN)
LHTTISFTCW

SEQ ID NO: 61570 - protein, 9 aa, Artificial Sequence
  Description of Artificial Sequence: Synthetic peptide
  Seed: RCFPVIFGK (MAGA4_HUMAN)
RMFPVIFGR

SEQ ID NO: 61571 - protein, 9 aa, Artificial Sequence
  Description of Artificial Sequence: Synthetic peptide
  Seed: SYVKVLEHV (MAGA4_HUMAN)
SQVKVLEHY

SEQ ID NO: 61572 - protein, 9 aa, Artificial Sequence
  Description of Artificial Sequence: Synthetic peptide
  Seed: TVYGEPRKL (MAGA4_HUMAN)
TSYGEPRKL

SEQ ID NO: 61573 - protein, 8 aa, Artificial Sequence
  Description of Artificial Sequence: Synthetic peptide
  Seed: KVDELAHF (MAGA4_HUMAN)
KADELAHF

SEQ ID NO: 61574 - protein, 9 aa, Artificial Sequence
  Description of Artificial Sequence: Synthetic peptide
  Seed: KVDELAHFL (MAGA4_HUMAN)
KTDELAHFH

SEQ ID NO: 61575 - protein, 9 aa, Artificial Sequence
  Description of Artificial Sequence: Synthetic peptide
  Seed: EVDPASNTY (MAGA4_HUMAN)
ETDPASNTI

SEQ ID NO: 61576 - protein, 10 aa, Artificial Sequence
  Description of Artificial Sequence: Synthetic peptide
  Seed: KNYKRCFPVI (MAGA4_HUMAN)
KSYKRCFPVA

SEQ ID NO: 61577 - protein, 9 aa, Artificial Sequence
  Description of Artificial Sequence: Synthetic peptide
  Seed: RVRIAYPSL (MAGA4_HUMAN)
RVRIAYPSF

SEQ ID NO: 61578 - protein, 8 aa, Artificial Sequence
  Description of Artificial Sequence: Synthetic peptide
  Seed: KVDELAHF (MAGA4_HUMAN)
KIDELAHI

SEQ ID NO: 61579 - protein, 9 aa, Artificial Sequence
  Description of Artificial Sequence: Synthetic peptide
  Seed: LVPGTLEEV (MAGA4_HUMAN)
LMPGTLEEM

SEQ ID NO: 61580 - protein, 9 aa, Artificial Sequence
  Description of Artificial Sequence: Synthetic peptide
  Seed: KASESLKMI (MAGA4_HUMAN)
KLSESLKMA

SEQ ID NO: 61581 - protein, 8 aa, Artificial Sequence
  Description of Artificial Sequence: Synthetic peptide
  Seed: IFPKTGLL (MAGA4_HUMAN)
IYPKTGLL

SEQ ID NO: 61582 - protein, 9 aa, Artificial Sequence
  Description of Artificial Sequence: Synthetic peptide
  Seed: EVDPASNTY (MAGA4_HUMAN)
EVDPASNTL

SEQ ID NO: 61583 - protein, 9 aa, Artificial Sequence
  Description of Artificial Sequence: Synthetic peptide
  Seed: AYPSLREAA (MAGA4_HUMAN)
AWPSLREAL

SEQ ID NO: 61584 - protein, 9 aa, Artificial Sequence
  Description of Artificial Sequence: Synthetic peptide
  Seed: ALSNKVDEL (MAGA4_HUMAN)
AVSNKVDEI

SEQ ID NO: 61585 - protein, 10 aa, Artificial Sequence
  Description of Artificial Sequence: Synthetic peptide
  Seed: VDPASNTYTL (MAGA4_HUMAN)
VQPASNTYTY

SEQ ID NO: 61586 - protein, 10 aa, Artificial Sequence
  Description of Artificial Sequence: Synthetic peptide
  Seed: YRQVPGSNPA (MAGA4_HUMAN)
YMQVPGSNPV

SEQ ID NO: 61587 - protein, 9 aa, Artificial Sequence
  Description of Artificial Sequence: Synthetic peptide
  Seed: SSPLVPGTL (MAGA4_HUMAN)
SYPLVPGTL

SEQ ID NO: 61588 - protein, 9 aa, Artificial Sequence
  Description of Artificial Sequence: Synthetic peptide
  Seed: SSPLVPGTL (MAGA4_HUMAN)
SRPLVPGTM

SEQ ID NO: 61589 - protein, 9 aa, Artificial Sequence
  Description of Artificial Sequence: Synthetic peptide
  Seed: IAYPSLREA (MAGA4_HUMAN)
ISYPSLREY

SEQ ID NO: 61590 - protein, 11 aa, Artificial Sequence
  Description of Artificial Sequence: Synthetic peptide
  Seed: LSNKVDELAHF (MAGA4_HUMAN)
LANKVDELAHW

SEQ ID NO: 61591 - protein, 9 aa, Artificial Sequence
  Description of Artificial Sequence: Synthetic peptide
  Seed: QIFPKTGLL (MAGA4_HUMAN)
QLFPKTGLK

SEQ ID NO: 61592 - protein, 10 aa, Artificial Sequence
  Description of Artificial Sequence: Synthetic peptide
  Seed: KYRAKELVTK (MAGA4_HUMAN)
KFRAKELVTR

SEQ ID NO: 61593 - protein, 10 aa, Artificial Sequence
  Description of Artificial Sequence: Synthetic peptide
  Seed: KEVDPASNTY (MAGA4_HUMAN)
KEVDPASNTA

SEQ ID NO: 61594 - protein, 9 aa, Artificial Sequence
  Description of Artificial Sequence: Synthetic peptide
  Seed: TTISFTCWR (MAGA4_HUMAN)
TMISFTCWK

SEQ ID NO: 61595 - protein, 10 aa, Artificial Sequence
  Description of Artificial Sequence: Synthetic peptide
  Seed: KEVDPASNTY (MAGA4_HUMAN)
KEVDPASNTM

SEQ ID NO: 61596 - protein, 9 aa, Artificial Sequence
  Description of Artificial Sequence: Synthetic peptide
  Seed: KYRAKELVT (MAGA4_HUMAN)
KFRAKELVV

SEQ ID NO: 61597 - protein, 9 aa, Artificial Sequence
  Description of Artificial Sequence: Synthetic peptide
  Seed: SEEEIWEEL (MAGA4_HUMAN)
SHEEIWEEM

SEQ ID NO: 61598 - protein, 10 aa, Artificial Sequence
  Description of Artificial Sequence: Synthetic peptide
  Seed: RVNARVRIAY (MAGA4_HUMAN)
RQNARVRIAM

SEQ ID NO: 61599 - protein, 9 aa, Artificial Sequence
  Description of Artificial Sequence: Synthetic peptide
  Seed: RVRIAYPSL (MAGA4_HUMAN)
RARIAYPSQ

SEQ ID NO: 61600 - protein, 9 aa, Artificial Sequence
  Description of Artificial Sequence: Synthetic peptide
  Seed: KYRAKELVT (MAGA4_HUMAN)
KVRAKELVL

SEQ ID NO: 61601 - protein, 9 aa, Artificial Sequence
  Description of Artificial Sequence: Synthetic peptide
  Seed: SALPTTISF (MAGA4_HUMAN)
SFLPTTISM

SEQ ID NO: 61602 - protein, 10 aa, Artificial Sequence
  Description of Artificial Sequence: Synthetic peptide
  Seed: TQDWVQENYL (MAGA4_HUMAN)
TADWVQENYL

SEQ ID NO: 61603 - protein, 9 aa, Artificial Sequence
  Description of Artificial Sequence: Synthetic peptide
  Seed: VNARVRIAY (MAGA4_HUMAN)
VAARVRIAL

SEQ ID NO: 61604 - protein, 10 aa, Artificial Sequence
  Description of Artificial Sequence: Synthetic peptide
  Seed: YRQVPGSNPA (MAGA4_HUMAN)
YQQVPGSNPV

SEQ ID NO: 61605 - protein, 10 aa, Artificial Sequence
  Description of Artificial Sequence: Synthetic peptide
  Seed: GDSASEEEIW (MAGA4_HUMAN)
GTSASEEEIW

SEQ ID NO: 61606 - protein, 10 aa, Artificial Sequence
  Description of Artificial Sequence: Synthetic peptide
  Seed: TYTLVTCLGL (MAGA4_HUMAN)
TYTLVTCLGW

SEQ ID NO: 61607 - protein, 10 aa, Artificial Sequence
  Description of Artificial Sequence: Synthetic peptide
  Seed: YPSLREAALL (MAGA4_HUMAN)
YVSLREAALF

SEQ ID NO: 61608 - protein, 10 aa, Artificial Sequence
  Description of Artificial Sequence: Synthetic peptide
  Seed: STSPDAESLF (MAGA4_HUMAN)
SQSPDAESLF

SEQ ID NO: 61609 - protein, 9 aa, Artificial Sequence
  Description of Artificial Sequence: Synthetic peptide
  Seed: LGNNQIFPK (MAGA4_HUMAN)
LSNNQIFPY

SEQ ID NO: 61610 - protein, 9 aa, Artificial Sequence
  Description of Artificial Sequence: Synthetic peptide
  Seed: EIWEELGVM (MAGA4_HUMAN)
EPWEELGVM

SEQ ID NO: 61611 - protein, 9 aa, Artificial Sequence
  Description of Artificial Sequence: Synthetic peptide
  Seed: IIVLGTIAM (MAGA4_HUMAN)
IKVLGTIAM

SEQ ID NO: 61612 - protein, 10 aa, Artificial Sequence
  Description of Artificial Sequence: Synthetic peptide
  Seed: RVRIAYPSLR (MAGA4_HUMAN)
RMRIAYPSLY

SEQ ID NO: 61613 - protein, 9 aa, Artificial Sequence
  Description of Artificial Sequence: Synthetic peptide
  Seed: DELAHFLLR (MAGA4_HUMAN)
DQLAHFLLR

SEQ ID NO: 61614 - protein, 10 aa, Artificial Sequence
  Description of Artificial Sequence: Synthetic peptide
  Seed: RVRIAYPSLR (MAGA4_HUMAN)
RWRIAYPSLI

SEQ ID NO: 61615 - protein, 9 aa, Artificial Sequence
  Description of Artificial Sequence: Synthetic peptide
  Seed: RAKELVTKA (MAGA4_HUMAN)
RSKELVTKK

SEQ ID NO: 61616 - protein, 9 aa, Artificial Sequence
  Description of Artificial Sequence: Synthetic peptide
  Seed: QSPQGASAL (MAGA4_HUMAN)
QTPQGASAV

SEQ ID NO: 61617 - protein, 10 aa, Artificial Sequence
  Description of Artificial Sequence: Synthetic peptide
  Seed: VDPASNTYTL (MAGA4_HUMAN)
VLPASNTYTF

SEQ ID NO: 61618 - protein, 10 aa, Artificial Sequence
  Description of Artificial Sequence: Synthetic peptide
  Seed: LGVMGVYDGR (MAGA4_HUMAN)
LHVMGVYDGR

SEQ ID NO: 61619 - protein, 9 aa, Artificial Sequence
  Description of Artificial Sequence: Synthetic peptide
  Seed: KVLEHVVRV (MAGA4_HUMAN)
KVLEHVVRR

SEQ ID NO: 61620 - protein, 10 aa, Artificial Sequence
  Description of Artificial Sequence: Synthetic peptide
  Seed: RVNARVRIAY (MAGA4_HUMAN)
RANARVRIAK

SEQ ID NO: 61621 - protein, 10 aa, Artificial Sequence
  Description of Artificial Sequence: Synthetic peptide
  Seed: RVRIAYPSLR (MAGA4_HUMAN)
RLRIAYPSLL

SEQ ID NO: 61622 - protein, 8 aa, Artificial Sequence
  Description of Artificial Sequence: Synthetic peptide
  Seed: SAGPPQSP (MAGA4_HUMAN)
SVGPPQSY

SEQ ID NO: 61623 - protein, 8 aa, Artificial Sequence
  Description of Artificial Sequence: Synthetic peptide
  Seed: FGIDVKEV (MAGA4_HUMAN)
FQIDVKEI

SEQ ID NO: 61624 - protein, 9 aa, Artificial Sequence
  Description of Artificial Sequence: Synthetic peptide
  Seed: SALPTTISF (MAGA4_HUMAN)
STLPTTISY

SEQ ID NO: 61625 - protein, 9 aa, Artificial Sequence
  Description of Artificial Sequence: Synthetic peptide
  Seed: RVRIAYPSL (MAGA4_HUMAN)
RIRIAYPSK

SEQ ID NO: 61626 - protein, 9 aa, Artificial Sequence
  Description of Artificial Sequence: Synthetic peptide
  Seed: TSPDAESLF (MAGA4_HUMAN)
TAPDAESLL

SEQ ID NO: 61627 - protein, 9 aa, Artificial Sequence
  Description of Artificial Sequence: Synthetic peptide
  Seed: RCFPVIFGK (MAGA4_HUMAN)
RGFPVIFGR

SEQ ID NO: 61628 - protein, 11 aa, Artificial Sequence
  Description of Artificial Sequence: Synthetic peptide
  Seed: KNYKRCFPVIF (MAGA4_HUMAN)
KQYKRCFPVIM

SEQ ID NO: 61629 - protein, 10 aa, Artificial Sequence
  Description of Artificial Sequence: Synthetic peptide
  Seed: TTISFTCWRQ (MAGA4_HUMAN)
TNISFTCWRR

SEQ ID NO: 61630 - protein, 11 aa, Artificial Sequence
  Description of Artificial Sequence: Synthetic peptide
  Seed: GSNPARYEFLW (MAGA4_HUMAN)
GANPARYEFLW

SEQ ID NO: 61631 - protein, 9 aa, Artificial Sequence
  Description of Artificial Sequence: Synthetic peptide
  Seed: YPSLREAAL (MAGA4_HUMAN)
YMSLREAAY

SEQ ID NO: 61632 - protein, 10 aa, Artificial Sequence
  Description of Artificial Sequence: Synthetic peptide
  Seed: YRQVPGSNPA (MAGA4_HUMAN)
YQQVPGSNPF

SEQ ID NO: 61633 - protein, 9 aa, Artificial Sequence
  Description of Artificial Sequence: Synthetic peptide
  Seed: SALPTTISF (MAGA4_HUMAN)
SALPTTISI

SEQ ID NO: 61634 - protein, 9 aa, Artificial Sequence
  Description of Artificial Sequence: Synthetic peptide
  Seed: KMIFGIDVK (MAGA4_HUMAN)
KTIFGIDVK

SEQ ID NO: 61635 - protein, 9 aa, Artificial Sequence
  Description of Artificial Sequence: Synthetic peptide
  Seed: EEVPAAESA (MAGA4_HUMAN)
EEVPAAESF

SEQ ID NO: 61636 - protein, 10 aa, Artificial Sequence
  Description of Artificial Sequence: Synthetic peptide
  Seed: SSSPLVPGTL (MAGA4_HUMAN)
SGSPLVPGTY

SEQ ID NO: 61637 - protein, 9 aa, Artificial Sequence
  Description of Artificial Sequence: Synthetic peptide
  Seed: YRAKELVTK (MAGA4_HUMAN)
YYAKELVTY

SEQ ID NO: 61638 - protein, 9 aa, Artificial Sequence
  Description of Artificial Sequence: Synthetic peptide
  Seed: LVPGTLEEV (MAGA4_HUMAN)
LTPGTLEEY

SEQ ID NO: 61639 - protein, 11 aa, Artificial Sequence
  Description of Artificial Sequence: Synthetic peptide
  Seed: STSPDAESLFR (MAGA4_HUMAN)
SISPDAESLFK

SEQ ID NO: 61640 - protein, 9 aa, Artificial Sequence
  Description of Artificial Sequence: Synthetic peptide
  Seed: LFREALSNK (MAGA4_HUMAN)
LSREALSNA

SEQ ID NO: 61641 - protein, 10 aa, Artificial Sequence
  Description of Artificial Sequence: Synthetic peptide
  Seed: TTISFTCWRQ (MAGA4_HUMAN)
TVISFTCWRM

SEQ ID NO: 61642 - protein, 9 aa, Artificial Sequence
  Description of Artificial Sequence: Synthetic peptide
  Seed: TVYGEPRKL (MAGA4_HUMAN)
TTYGEPRKF

SEQ ID NO: 61643 - protein, 9 aa, Artificial Sequence
  Description of Artificial Sequence: Synthetic peptide
  Seed: TQDWVQENY (MAGA4_HUMAN)
TGDWVQENL

SEQ ID NO: 61644 - protein, 10 aa, Artificial Sequence
  Description of Artificial Sequence: Synthetic peptide
  Seed: YRQVPGSNPA (MAGA4_HUMAN)
YSQVPGSNPF

SEQ ID NO: 61645 - protein, 10 aa, Artificial Sequence
  Description of Artificial Sequence: Synthetic peptide
  Seed: EAAVSSSSPL (MAGA4_HUMAN)
EVAVSSSSPR

SEQ ID NO: 61646 - protein, 9 aa, Artificial Sequence
  Description of Artificial Sequence: Synthetic peptide
  Seed: RQVPGSNPA (MAGA4_HUMAN)
RAVPGSNPY

SEQ ID NO: 61647 - protein, 9 aa, Artificial Sequence
  Description of Artificial Sequence: Synthetic peptide
  Seed: YRAKELVTK (MAGA4_HUMAN)
YYAKELVTF

SEQ ID NO: 61648 - protein, 9 aa, Artificial Sequence
  Description of Artificial Sequence: Synthetic peptide
  Seed: QIFPKTGLL (MAGA4_HUMAN)
QLFPKTGLL

SEQ ID NO: 61649 - protein, 9 aa, Artificial Sequence
  Description of Artificial Sequence: Synthetic peptide
  Seed: WVQENYLEY (MAGA4_HUMAN)
WAQENYLEW

SEQ ID NO: 61650 - protein, 10 aa, Artificial Sequence
  Description of Artificial Sequence: Synthetic peptide
  Seed: YPSLREAALL (MAGA4_HUMAN)
YFSLREAALY

SEQ ID NO: 61651 - protein, 9 aa, Artificial Sequence
  Description of Artificial Sequence: Synthetic peptide
  Seed: IIVLGTIAM (MAGA4_HUMAN)
IMVLGTIAL

SEQ ID NO: 61652 - protein, 9 aa, Artificial Sequence
  Description of Artificial Sequence: Synthetic peptide
  Seed: LVPGTLEEV (MAGA4_HUMAN)
LFPGTLEEY

SEQ ID NO: 61653 - protein, 9 aa, Artificial Sequence
  Description of Artificial Sequence: Synthetic peptide
  Seed: KYRAKELVT (MAGA4_HUMAN)
KTRAKELVV

SEQ ID NO: 61654 - protein, 10 aa, Artificial Sequence
  Description of Artificial Sequence: Synthetic peptide
  Seed: RVRIAYPSLR (MAGA4_HUMAN)
RNRIAYPSLI

SEQ ID NO: 61655 - protein, 9 aa, Artificial Sequence
  Description of Artificial Sequence: Synthetic peptide
  Seed: RVRIAYPSL (MAGA4_HUMAN)
RYRIAYPSV

SEQ ID NO: 61656 - protein, 9 aa, Artificial Sequence
  Description of Artificial Sequence: Synthetic peptide
  Seed: AHFLLRKYR (MAGA4_HUMAN)
AQFLLRKYK

SEQ ID NO: 61657 - protein, 9 aa, Artificial Sequence
  Description of Artificial Sequence: Synthetic peptide
  Seed: KYRAKELVT (MAGA4_HUMAN)
KTRAKELVI

SEQ ID NO: 61658 - protein, 9 aa, Artificial Sequence
  Description of Artificial Sequence: Synthetic peptide
  Seed: DPASNTYTL (MAGA4_HUMAN)
DVASNTYTM

SEQ ID NO: 61659 - protein, 9 aa, Artificial Sequence
  Description of Artificial Sequence: Synthetic peptide
  Seed: LFREALSNK (MAGA4_HUMAN)
LQREALSNK

SEQ ID NO: 61660 - protein, 8 aa, Artificial Sequence
  Description of Artificial Sequence: Synthetic peptide
  Seed: AHFLLRKY (MAGA4_HUMAN)
AQFLLRKF

SEQ ID NO: 61661 - protein, 11 aa, Artificial Sequence
  Description of Artificial Sequence: Synthetic peptide
  Seed: AQEEALGLVGA (MAGA4_HUMAN)
AEEEALGLVGC

SEQ ID NO: 61662 - protein, 9 aa, Artificial Sequence
  Description of Artificial Sequence: Synthetic peptide
  Seed: LPTTISFTC (MAGA4_HUMAN)
LPTTISFTS

SEQ ID NO: 61663 - protein, 9 aa, Artificial Sequence
  Description of Artificial Sequence: Synthetic peptide
  Seed: REAALLEEE (MAGA4_HUMAN)
RDAALLEEM

SEQ ID NO: 61664 - protein, 9 aa, Artificial Sequence
  Description of Artificial Sequence: Synthetic peptide
  Seed: KVDELAHFL (MAGA4_HUMAN)
KQDELAHFY

SEQ ID NO: 61665 - protein, 10 aa, Artificial Sequence
  Description of Artificial Sequence: Synthetic peptide
  Seed: MIFGIDVKEV (MAGA4_HUMAN)
MQFGIDVKEL

SEQ ID NO: 61666 - protein, 11 aa, Artificial Sequence
  Description of Artificial Sequence: Synthetic peptide
  Seed: YTLVTCLGLSY (MAGA4_HUMAN)
YSLVTCLGLSF

SEQ ID NO: 61667 - protein, 9 aa, Artificial Sequence
  Description of Artificial Sequence: Synthetic peptide
  Seed: KNYKRCFPV (MAGA4_HUMAN)
KSYKRCFPV

SEQ ID NO: 61668 - protein, 9 aa, Artificial Sequence
  Description of Artificial Sequence: Synthetic peptide
  Seed: YKRCFPVIF (MAGA4_HUMAN)
YLRCFPVIY

SEQ ID NO: 61669 - protein, 10 aa, Artificial Sequence
  Description of Artificial Sequence: Synthetic peptide
  Seed: RIAYPSLREA (MAGA4_HUMAN)
RMAYPSLREA

SEQ ID NO: 61670 - protein, 10 aa, Artificial Sequence
  Description of Artificial Sequence: Synthetic peptide
  Seed: RVRIAYPSLR (MAGA4_HUMAN)
RRRIAYPSLK

SEQ ID NO: 61671 - protein, 9 aa, Artificial Sequence
  Description of Artificial Sequence: Synthetic peptide
  Seed: SESLKMIFG (MAGA4_HUMAN)
SESLKMIFV

SEQ ID NO: 61672 - protein, 10 aa, Artificial Sequence
  Description of Artificial Sequence: Synthetic peptide
  Seed: IFPKTGLLII (MAGA4_HUMAN)
IYPKTGLLII

SEQ ID NO: 61673 - protein, 9 aa, Artificial Sequence
  Description of Artificial Sequence: Synthetic peptide
  Seed: ESLKMIFGI (MAGA4_HUMAN)
ETLKMIFGF

SEQ ID NO: 61674 - protein, 11 aa, Artificial Sequence
  Description of Artificial Sequence: Synthetic peptide
  Seed: VIFGKASESLK (MAGA4_HUMAN)
VLFGKASESLK

SEQ ID NO: 61675 - protein, 9 aa, Artificial Sequence
  Description of Artificial Sequence: Synthetic peptide
  Seed: KVDELAHFL (MAGA4_HUMAN)
KFDELAHFW

SEQ ID NO: 61676 - protein, 9 aa, Artificial Sequence
  Description of Artificial Sequence: Synthetic peptide
  Seed: VYDGREHTV (MAGA4_HUMAN)
VIDGREHTI

SEQ ID NO: 61677 - protein, 10 aa, Artificial Sequence
  Description of Artificial Sequence: Synthetic peptide
  Seed: TTISFTCWRQ (MAGA4_HUMAN)
TTISFTCWRH

SEQ ID NO: 61678 - protein, 9 aa, Artificial Sequence
  Description of Artificial Sequence: Synthetic peptide
  Seed: WVQENYLEY (MAGA4_HUMAN)
WVQENYLEF

SEQ ID NO: 61679 - protein, 9 aa, Artificial Sequence
  Description of Artificial Sequence: Synthetic peptide
  Seed: RAKELVTKA (MAGA4_HUMAN)
RQKELVTKV

SEQ ID NO: 61680 - protein, 9 aa, Artificial Sequence
  Description of Artificial Sequence: Synthetic peptide
  Seed: TVYGEPRKL (MAGA4_HUMAN)
TFYGEPRKI

SEQ ID NO: 61681 - protein, 9 aa, Artificial Sequence
  Description of Artificial Sequence: Synthetic peptide
  Seed: QIFPKTGLL (MAGA4_HUMAN)
QPFPKTGLI

SEQ ID NO: 61682 - protein, 11 aa, Artificial Sequence
  Description of Artificial Sequence: Synthetic peptide
  Seed: LPTTISFTCWR (MAGA4_HUMAN)
LVTTISFTCWR

SEQ ID NO: 61683 - protein, 9 aa, Artificial Sequence
  Description of Artificial Sequence: Synthetic peptide
  Seed: TSPDAESLF (MAGA4_HUMAN)
TTPDAESLM

SEQ ID NO: 61684 - protein, 9 aa, Artificial Sequence
  Description of Artificial Sequence: Synthetic peptide
  Seed: YDGREHTVY (MAGA4_HUMAN)
YVGREHTVF

SEQ ID NO: 61685 - protein, 9 aa, Artificial Sequence
  Description of Artificial Sequence: Synthetic peptide
  Seed: AAVSSSSPL (MAGA4_HUMAN)
AFVSSSSPY

SEQ ID NO: 61686 - protein, 10 aa, Artificial Sequence
  Description of Artificial Sequence: Synthetic peptide
  Seed: KEVDPASNTY (MAGA4_HUMAN)
KMVDPASNTI

SEQ ID NO: 61687 - protein, 9 aa, Artificial Sequence
  Description of Artificial Sequence: Synthetic peptide
  Seed: SALPTTISF (MAGA4_HUMAN)
SSLPTTISH

SEQ ID NO: 61688 - protein, 9 aa, Artificial Sequence
  Description of Artificial Sequence: Synthetic peptide
  Seed: VYDGREHTV (MAGA4_HUMAN)
VNDGREHTV

SEQ ID NO: 61689 - protein, 11 aa, Artificial Sequence
  Description of Artificial Sequence: Synthetic peptide
  Seed: SPLVPGTLEEV (MAGA4_HUMAN)
SPLVPGTLEEM

SEQ ID NO: 61690 - protein, 9 aa, Artificial Sequence
  Description of Artificial Sequence: Synthetic peptide
  Seed: YKRCFPVIF (MAGA4_HUMAN)
YRRCFPVIM

SEQ ID NO: 61691 - protein, 10 aa, Artificial Sequence
  Description of Artificial Sequence: Synthetic peptide
  Seed: YRQVPGSNPA (MAGA4_HUMAN)
YFQVPGSNPV

SEQ ID NO: 61692 - protein, 9 aa, Artificial Sequence
  Description of Artificial Sequence: Synthetic peptide
  Seed: IIVLGTIAM (MAGA4_HUMAN)
IAVLGTIAL

SEQ ID NO: 61693 - protein, 9 aa, Artificial Sequence
  Description of Artificial Sequence: Synthetic peptide
  Seed: RAKELVTKA (MAGA4_HUMAN)
RVKELVTKL

SEQ ID NO: 61694 - protein, 9 aa, Artificial Sequence
  Description of Artificial Sequence: Synthetic peptide
  Seed: TTEEQEAAV (MAGA4_HUMAN)
TIEEQEAAM

SEQ ID NO: 61695 - protein, 9 aa, Artificial Sequence
  Description of Artificial Sequence: Synthetic peptide
  Seed: SALPTTISF (MAGA4_HUMAN)
SFLPTTISI

SEQ ID NO: 61696 - protein, 9 aa, Artificial Sequence
  Description of Artificial Sequence: Synthetic peptide
  Seed: VNARVRIAY (MAGA4_HUMAN)
VRARVRIAY

SEQ ID NO: 61697 - protein, 9 aa, Artificial Sequence
  Description of Artificial Sequence: Synthetic peptide
  Seed: RVRIAYPSL (MAGA4_HUMAN)
RWRIAYPSS

SEQ ID NO: 61698 - protein, 9 aa, Artificial Sequence
  Description of Artificial Sequence: Synthetic peptide
  Seed: GASALPTTI (MAGA4_HUMAN)
GQSALPTTV

SEQ ID NO: 61699 - protein, 9 aa, Artificial Sequence
  Description of Artificial Sequence: Synthetic peptide
  Seed: EEVPAAESA (MAGA4_HUMAN)
EQVPAAESL

SEQ ID NO: 61700 - protein, 10 aa, Artificial Sequence
  Description of Artificial Sequence: Synthetic peptide
  Seed: SSSPLVPGTL (MAGA4_HUMAN)
SVSPLVPGTY

SEQ ID NO: 61701 - protein, 9 aa, Artificial Sequence
  Description of Artificial Sequence: Synthetic peptide
  Seed: KVDELAHFL (MAGA4_HUMAN)
KMDELAHFM

SEQ ID NO: 61702 - protein, 11 aa, Artificial Sequence
  Description of Artificial Sequence: Synthetic peptide
  Seed: YVKVLEHVVRV (MAGA4_HUMAN)
YAKVLEHVVRV

SEQ ID NO: 61703 - protein, 11 aa, Artificial Sequence
  Description of Artificial Sequence: Synthetic peptide
  Seed: GVYDGREHTVY (MAGA4_HUMAN)
GIYDGREHTVY

SEQ ID NO: 61704 - protein, 10 aa, Artificial Sequence
  Description of Artificial Sequence: Synthetic peptide
  Seed: SSSPLVPGTL (MAGA4_HUMAN)
SASPLVPGTF

SEQ ID NO: 61705 - protein, 11 aa, Artificial Sequence
  Description of Artificial Sequence: Synthetic peptide
  Seed: RVRIAYPSLRE (MAGA4_HUMAN)
RVRIAYPSLRL

SEQ ID NO: 61706 - protein, 9 aa, Artificial Sequence
  Description of Artificial Sequence: Synthetic peptide
  Seed: AAVSSSSPL (MAGA4_HUMAN)
APVSSSSPY

SEQ ID NO: 61707 - protein, 9 aa, Artificial Sequence
  Description of Artificial Sequence: Synthetic peptide
  Seed: IFPKTGLLI (MAGA4_HUMAN)
IWPKTGLLW

SEQ ID NO: 61708 - protein, 9 aa, Artificial Sequence
  Description of Artificial Sequence: Synthetic peptide
  Seed: VVRVNARVR (MAGA4_HUMAN)
VTRVNARVK

SEQ ID NO: 61709 - protein, 9 aa, Artificial Sequence
  Description of Artificial Sequence: Synthetic peptide
  Seed: EVDPASNTY (MAGA4_HUMAN)
EADPASNTI

SEQ ID NO: 61710 - protein, 9 aa, Artificial Sequence
  Description of Artificial Sequence: Synthetic peptide
  Seed: RAKELVTKA (MAGA4_HUMAN)
RMKELVTKL

SEQ ID NO: 61711 - protein, 9 aa, Artificial Sequence
  Description of Artificial Sequence: Synthetic peptide
  Seed: KVLEHVVRV (MAGA4_HUMAN)
KTLEHVVRA

SEQ ID NO: 61712 - protein, 10 aa, Artificial Sequence
  Description of Artificial Sequence: Synthetic peptide
  Seed: TSYVKVLEHV (MAGA4_HUMAN)
TMYVKVLEHF

SEQ ID NO: 61713 - protein, 10 aa, Artificial Sequence
  Description of Artificial Sequence: Synthetic peptide
  Seed: GVYDGREHTV (MAGA4_HUMAN)
GLYDGREHTR

SEQ ID NO: 61714 - protein, 9 aa, Artificial Sequence
  Description of Artificial Sequence: Synthetic peptide
  Seed: QIFPKTGLL (MAGA4_HUMAN)
QTFPKTGLV

SEQ ID NO: 61715 - protein, 9 aa, Artificial Sequence
  Description of Artificial Sequence: Synthetic peptide
  Seed: VYDGREHTV (MAGA4_HUMAN)
VTDGREHTW

SEQ ID NO: 61716 - protein, 9 aa, Artificial Sequence
  Description of Artificial Sequence: Synthetic peptide
  Seed: ASESLKMIF (MAGA4_HUMAN)
AVESLKMIY

SEQ ID NO: 61717 - protein, 9 aa, Artificial Sequence
  Description of Artificial Sequence: Synthetic peptide
  Seed: EEIWEELGV (MAGA4_HUMAN)
EEIWEELGF

SEQ ID NO: 61718 - protein, 8 aa, Artificial Sequence
  Description of Artificial Sequence: Synthetic peptide
  Seed: KVDELAHF (MAGA4_HUMAN)
KSDELAHI

SEQ ID NO: 61719 - protein, 9 aa, Artificial Sequence
  Description of Artificial Sequence: Synthetic peptide
  Seed: VIKNYKRCF (MAGA4_HUMAN)
VQKNYKRCY

SEQ ID NO: 61720 - protein, 9 aa, Artificial Sequence
  Description of Artificial Sequence: Synthetic peptide
  Seed: LLIIVLGTI (MAGA4_HUMAN)
LMIIVLGTV

SEQ ID NO: 61721 - protein, 9 aa, Artificial Sequence
  Description of Artificial Sequence: Synthetic peptide
  Seed: SQEEEGPST (MAGA4_HUMAN)
SEEEEGPSI

SEQ ID NO: 61722 - protein, 11 aa, Artificial Sequence
  Description of Artificial Sequence: Synthetic peptide
  Seed: IAYPSLREAAL (MAGA4_HUMAN)
ISYPSLREAAW

SEQ ID NO: 61723 - protein, 11 aa, Artificial Sequence
  Description of Artificial Sequence: Synthetic peptide
  Seed: AQAPTTEEQEA (MAGA4_HUMAN)
AVAPTTEEQEF

SEQ ID NO: 61724 - protein, 9 aa, Artificial Sequence
  Description of Artificial Sequence: Synthetic peptide
  Seed: DPASNTYTL (MAGA4_HUMAN)
DCASNTYTY

SEQ ID NO: 61725 - protein, 9 aa, Artificial Sequence
  Description of Artificial Sequence: Synthetic peptide
  Seed: SSPLVPGTL (MAGA4_HUMAN)
SQPLVPGTY

SEQ ID NO: 61726 - protein, 9 aa, Artificial Sequence
  Description of Artificial Sequence: Synthetic peptide
  Seed: STSPDAESL (MAGA4_HUMAN)
SVSPDAESM

SEQ ID NO: 61727 - protein, 10 aa, Artificial Sequence
  Description of Artificial Sequence: Synthetic peptide
  Seed: QIFPKTGLLI (MAGA4_HUMAN)
QMFPKTGLLI

SEQ ID NO: 61728 - protein, 11 aa, Artificial Sequence
  Description of Artificial Sequence: Synthetic peptide
  Seed: GASALPTTISF (MAGA4_HUMAN)
GGSALPTTISW

SEQ ID NO: 61729 - protein, 11 aa, Artificial Sequence
  Description of Artificial Sequence: Synthetic peptide
  Seed: YTLVTCLGLSY (MAGA4_HUMAN)
YSLVTCLGLSY

SEQ ID NO: 61730 - protein, 10 aa, Artificial Sequence
  Description of Artificial Sequence: Synthetic peptide
  Seed: RVRIAYPSLR (MAGA4_HUMAN)
RGRIAYPSLY

SEQ ID NO: 61731 - protein, 9 aa, Artificial Sequence
  Description of Artificial Sequence: Synthetic peptide
  Seed: SPQGASALP (MAGA4_HUMAN)
SPQGASALV

SEQ ID NO: 61732 - protein, 9 aa, Artificial Sequence
  Description of Artificial Sequence: Synthetic peptide
  Seed: EIWEELGVM (MAGA4_HUMAN)
EVWEELGVK

SEQ ID NO: 61733 - protein, 8 aa, Artificial Sequence
  Description of Artificial Sequence: Synthetic peptide
  Seed: RVRIAYPS (MAGA4_HUMAN)
RTRIAYPG

SEQ ID NO: 61734 - protein, 9 aa, Artificial Sequence
  Description of Artificial Sequence: Synthetic peptide
  Seed: LVPGTLEEV (MAGA4_HUMAN)
LIPGTLEEI

SEQ ID NO: 61735 - protein, 9 aa, Artificial Sequence
  Description of Artificial Sequence: Synthetic peptide
  Seed: FPVIFGKAS (MAGA4_HUMAN)
FPVIFGKAL

SEQ ID NO: 61736 - protein, 11 aa, Artificial Sequence
  Description of Artificial Sequence: Synthetic peptide
  Seed: GSNPARYEFLW (MAGA4_HUMAN)
GTNPARYEFLW

SEQ ID NO: 61737 - protein, 9 aa, Artificial Sequence
  Description of Artificial Sequence: Synthetic peptide
  Seed: VNARVRIAY (MAGA4_HUMAN)
VAARVRIAI

SEQ ID NO: 61738 - protein, 9 aa, Artificial Sequence
  Description of Artificial Sequence: Synthetic peptide
  Seed: GTLEEVPAA (MAGA4_HUMAN)
GTLEEVPAI

SEQ ID NO: 61739 - protein, 9 aa, Artificial Sequence
  Description of Artificial Sequence: Synthetic peptide
  Seed: KVDELAHFL (MAGA4_HUMAN)
KTDELAHFF

SEQ ID NO: 61740 - protein, 9 aa, Artificial Sequence
  Description of Artificial Sequence: Synthetic peptide
  Seed: SALPTTISF (MAGA4_HUMAN)
SQLPTTISF

SEQ ID NO: 61741 - protein, 9 aa, Artificial Sequence
  Description of Artificial Sequence: Synthetic peptide
  Seed: EAQEEALGL (MAGA4_HUMAN)
EVQEEALGK

SEQ ID NO: 61742 - protein, 9 aa, Artificial Sequence
  Description of Artificial Sequence: Synthetic peptide
  Seed: RCFPVIFGK (MAGA4_HUMAN)
RVFPVIFGY

SEQ ID NO: 61743 - protein, 9 aa, Artificial Sequence
  Description of Artificial Sequence: Synthetic peptide
  Seed: TQDWVQENY (MAGA4_HUMAN)
TADWVQENF

SEQ ID NO: 61744 - protein, 9 aa, Artificial Sequence
  Description of Artificial Sequence: Synthetic peptide
  Seed: KELVTKAEM (MAGA4_HUMAN)
KMLVTKAEF

SEQ ID NO: 61745 - protein, 9 aa, Artificial Sequence
  Description of Artificial Sequence: Synthetic peptide
  Seed: KVLEHVVRV (MAGA4_HUMAN)
KQLEHVVRV

SEQ ID NO: 61746 - protein, 9 aa, Artificial Sequence
  Description of Artificial Sequence: Synthetic peptide
  Seed: YRAKELVTK (MAGA4_HUMAN)
YRAKELVTI

SEQ ID NO: 61747 - protein, 9 aa, Artificial Sequence
  Description of Artificial Sequence: Synthetic peptide
  Seed: KVDELAHFL (MAGA4_HUMAN)
KGDELAHFI

SEQ ID NO: 61748 - protein, 9 aa, Artificial Sequence
  Description of Artificial Sequence: Synthetic peptide
  Seed: SALPTTISF (MAGA4_HUMAN)
SRLPTTISI

SEQ ID NO: 61749 - protein, 9 aa, Artificial Sequence
  Description of Artificial Sequence: Synthetic peptide
  Seed: IFPKTGLLI (MAGA4_HUMAN)
IFPKTGLLM

SEQ ID NO: 61750 - protein, 9 aa, Artificial Sequence
  Description of Artificial Sequence: Synthetic peptide
  Seed: YPSLREAAL (MAGA4_HUMAN)
YLSLREAAL

SEQ ID NO: 61751 - protein, 9 aa, Artificial Sequence
  Description of Artificial Sequence: Synthetic peptide
  Seed: IAYPSLREA (MAGA4_HUMAN)
ITYPSLREV

SEQ ID NO: 61752 - protein, 10 aa, Artificial Sequence
  Description of Artificial Sequence: Synthetic peptide
  Seed: ESAGPPQSPQ (MAGA4_HUMAN)
ETAGPPQSPK

SEQ ID NO: 61753 - protein, 10 aa, Artificial Sequence
  Description of Artificial Sequence: Synthetic peptide
  Seed: RQVPGSNPAR (MAGA4_HUMAN)
RFVPGSNPAY

SEQ ID NO: 61754 - protein, 9 aa, Artificial Sequence
  Description of Artificial Sequence: Synthetic peptide
  Seed: SYVKVLEHV (MAGA4_HUMAN)
SQVKVLEHM

SEQ ID NO: 61755 - protein, 9 aa, Artificial Sequence
  Description of Artificial Sequence: Synthetic peptide
  Seed: IIVLGTIAM (MAGA4_HUMAN)
ISVLGTIAF

SEQ ID NO: 61756 - protein, 10 aa, Artificial Sequence
  Description of Artificial Sequence: Synthetic peptide
  Seed: KVLEHVVRVN (MAGA4_HUMAN)
KLLEHVVRVH

SEQ ID NO: 61757 - protein, 9 aa, Artificial Sequence
  Description of Artificial Sequence: Synthetic peptide
  Seed: SSSPLVPGT (MAGA4_HUMAN)
SMSPLVPGA

SEQ ID NO: 61758 - protein, 9 aa, Artificial Sequence
  Description of Artificial Sequence: Synthetic peptide
  Seed: KYRAKELVT (MAGA4_HUMAN)
KWRAKELVK

SEQ ID NO: 61759 - protein, 10 aa, Artificial Sequence
  Description of Artificial Sequence: Synthetic peptide
  Seed: YRQVPGSNPA (MAGA4_HUMAN)
YGQVPGSNPY

SEQ ID NO: 61760 - protein, 11 aa, Artificial Sequence
  Description of Artificial Sequence: Synthetic peptide
  Seed: RQVPGSNPARY (MAGA4_HUMAN)
RSVPGSNPARY

SEQ ID NO: 61761 - protein, 10 aa, Artificial Sequence
  Description of Artificial Sequence: Synthetic peptide
  Seed: RVRIAYPSLR (MAGA4_HUMAN)
RQRIAYPSLV

SEQ ID NO: 61762 - protein, 9 aa, Artificial Sequence
  Description of Artificial Sequence: Synthetic peptide
  Seed: GTLEEVPAA (MAGA4_HUMAN)
GMLEEVPAC

SEQ ID NO: 61763 - protein, 9 aa, Artificial Sequence
  Description of Artificial Sequence: Synthetic peptide
  Seed: LVPGTLEEV (MAGA4_HUMAN)
LGPGTLEEL

SEQ ID NO: 61764 - protein, 9 aa, Artificial Sequence
  Description of Artificial Sequence: Synthetic peptide
  Seed: STSPDAESL (MAGA4_HUMAN)
SASPDAESM

SEQ ID NO: 61765 - protein, 9 aa, Artificial Sequence
  Description of Artificial Sequence: Synthetic peptide
  Seed: NTYTLVTCL (MAGA4_HUMAN)
NSYTLVTCF

SEQ ID NO: 61766 - protein, 9 aa, Artificial Sequence
  Description of Artificial Sequence: Synthetic peptide
  Seed: STSPDAESL (MAGA4_HUMAN)
SMSPDAESA

SEQ ID NO: 61767 - protein, 10 aa, Artificial Sequence
  Description of Artificial Sequence: Synthetic peptide
  Seed: AYPSLREAAL (MAGA4_HUMAN)
AYPSLREAAF

SEQ ID NO: 61768 - protein, 9 aa, Artificial Sequence
  Description of Artificial Sequence: Synthetic peptide
  Seed: STSPDAESL (MAGA4_HUMAN)
SDSPDAESL

SEQ ID NO: 61769 - protein, 9 aa, Artificial Sequence
  Description of Artificial Sequence: Synthetic peptide
  Seed: RVRIAYPSL (MAGA4_HUMAN)
RIRIAYPSG

SEQ ID NO: 61770 - protein, 9 aa, Artificial Sequence
  Description of Artificial Sequence: Synthetic peptide
  Seed: RQVPGSNPA (MAGA4_HUMAN)
RNVPGSNPF

SEQ ID NO: 61771 - protein, 9 aa, Artificial Sequence
  Description of Artificial Sequence: Synthetic peptide
  Seed: SALPTTISF (MAGA4_HUMAN)
SSLPTTISY

SEQ ID NO: 61772 - protein, 10 aa, Artificial Sequence
  Description of Artificial Sequence: Synthetic peptide
  Seed: MIFGIDVKEV (MAGA4_HUMAN)
MVFGIDVKEA

SEQ ID NO: 61773 - protein, 10 aa, Artificial Sequence
  Description of Artificial Sequence: Synthetic peptide
  Seed: TTISFTCWRQ (MAGA4_HUMAN)
TYISFTCWRR

SEQ ID NO: 61774 - protein, 9 aa, Artificial Sequence
  Description of Artificial Sequence: Synthetic peptide
  Seed: GTLEEVPAA (MAGA4_HUMAN)
GLLEEVPAM

SEQ ID NO: 61775 - protein, 10 aa, Artificial Sequence
  Description of Artificial Sequence: Synthetic peptide
  Seed: YRQVPGSNPA (MAGA4_HUMAN)
YYQVPGSNPV

SEQ ID NO: 61776 - protein, 10 aa, Artificial Sequence
  Description of Artificial Sequence: Synthetic peptide
  Seed: QVPGSNPARY (MAGA4_HUMAN)
QSPGSNPARR

SEQ ID NO: 61777 - protein, 9 aa, Artificial Sequence
  Description of Artificial Sequence: Synthetic peptide
  Seed: AVSSSSPLV (MAGA4_HUMAN)
AQSSSSPLM

SEQ ID NO: 61778 - protein, 10 aa, Artificial Sequence
  Description of Artificial Sequence: Synthetic peptide
  Seed: YPSLREAALL (MAGA4_HUMAN)
YFSLREAALF

SEQ ID NO: 61779 - protein, 9 aa, Artificial Sequence
  Description of Artificial Sequence: Synthetic peptide
  Seed: LLIIVLGTI (MAGA4_HUMAN)
LMIIVLGTL

SEQ ID NO: 61780 - protein, 9 aa, Artificial Sequence
  Description of Artificial Sequence: Synthetic peptide
  Seed: ALSNKVDEL (MAGA4_HUMAN)
AQSNKVDEF

SEQ ID NO: 61781 - protein, 9 aa, Artificial Sequence
  Description of Artificial Sequence: Synthetic peptide
  Seed: KASESLKMI (MAGA4_HUMAN)
KLSESLKMI

SEQ ID NO: 61782 - protein, 9 aa, Artificial Sequence
  Description of Artificial Sequence: Synthetic peptide
  Seed: RQVPGSNPA (MAGA4_HUMAN)
RRVPGSNPY

SEQ ID NO: 61783 - protein, 9 aa, Artificial Sequence
  Description of Artificial Sequence: Synthetic peptide
  Seed: SALPTTISF (MAGA4_HUMAN)
SILPTTISL

SEQ ID NO: 61784 - protein, 9 aa, Artificial Sequence
  Description of Artificial Sequence: Synthetic peptide
  Seed: RQVPGSNPA (MAGA4_HUMAN)
RKVPGSNPW

SEQ ID NO: 61785 - protein, 10 aa, Artificial Sequence
  Description of Artificial Sequence: Synthetic peptide
  Seed: ASALPTTISF (MAGA4_HUMAN)
AMALPTTISW

SEQ ID NO: 61786 - protein, 10 aa, Artificial Sequence
  Description of Artificial Sequence: Synthetic peptide
  Seed: RVRIAYPSLR (MAGA4_HUMAN)
RRRIAYPSLR

SEQ ID NO: 61787 - protein, 9 aa, Artificial Sequence
  Description of Artificial Sequence: Synthetic peptide
  Seed: DPASNTYTL (MAGA4_HUMAN)
DSASNTYTW

SEQ ID NO: 61788 - protein, 9 aa, Artificial Sequence
  Description of Artificial Sequence: Synthetic peptide
  Seed: LVPGTLEEV (MAGA4_HUMAN)
LSPGTLEEY

SEQ ID NO: 61789 - protein, 8 aa, Artificial Sequence
  Description of Artificial Sequence: Synthetic peptide
  Seed: RVRIAYPS (MAGA4_HUMAN)
RSRIAYPA

SEQ ID NO: 61790 - protein, 10 aa, Artificial Sequence
  Description of Artificial Sequence: Synthetic peptide
  Seed: RQVPGSNPAR (MAGA4_HUMAN)
RAVPGSNPAF

SEQ ID NO: 61791 - protein, 9 aa, Artificial Sequence
  Description of Artificial Sequence: Synthetic peptide
  Seed: NTYTLVTCL (MAGA4_HUMAN)
NMYTLVTCM

SEQ ID NO: 61792 - protein, 10 aa, Artificial Sequence
  Description of Artificial Sequence: Synthetic peptide
  Seed: RVRIAYPSLR (MAGA4_HUMAN)
RVRIAYPSLM

SEQ ID NO: 61793 - protein, 10 aa, Artificial Sequence
  Description of Artificial Sequence: Synthetic peptide
  Seed: GLLIIVLGTI (MAGA4_HUMAN)
GMLIIVLGTI

SEQ ID NO: 61794 - protein, 9 aa, Artificial Sequence
  Description of Artificial Sequence: Synthetic peptide
  Seed: SNKVDELAH (MAGA4_HUMAN)
SVKVDELAF

SEQ ID NO: 61795 - protein, 9 aa, Artificial Sequence
  Description of Artificial Sequence: Synthetic peptide
  Seed: IAYPSLREA (MAGA4_HUMAN)
IIYPSLREF

SEQ ID NO: 61796 - protein, 10 aa, Artificial Sequence
  Description of Artificial Sequence: Synthetic peptide
  Seed: AQEEALGLVG (MAGA4_HUMAN)
AEEEALGLVT

SEQ ID NO: 61797 - protein, 9 aa, Artificial Sequence
  Description of Artificial Sequence: Synthetic peptide
  Seed: KNYKRCFPV (MAGA4_HUMAN)
KVYKRCFPG

SEQ ID NO: 61798 - protein, 9 aa, Artificial Sequence
  Description of Artificial Sequence: Synthetic peptide
  Seed: KYRAKELVT (MAGA4_HUMAN)
KARAKELVK

SEQ ID NO: 61799 - protein, 10 aa, Artificial Sequence
  Description of Artificial Sequence: Synthetic peptide
  Seed: YPSLREAALL (MAGA4_HUMAN)
YPSLREAALF

SEQ ID NO: 61800 - protein, 10 aa, Artificial Sequence
  Description of Artificial Sequence: Synthetic peptide
  Seed: RVRIAYPSLR (MAGA4_HUMAN)
RFRIAYPSLK

SEQ ID NO: 61801 - protein, 10 aa, Artificial Sequence
  Description of Artificial Sequence: Synthetic peptide
  Seed: REAALLEEEE (MAGA4_HUMAN)
REAALLEEEI

SEQ ID NO: 61802 - protein, 9 aa, Artificial Sequence
  Description of Artificial Sequence: Synthetic peptide
  Seed: RVRIAYPSL (MAGA4_HUMAN)
RQRIAYPSW

SEQ ID NO: 61803 - protein, 10 aa, Artificial Sequence
  Description of Artificial Sequence: Synthetic peptide
  Seed: SSSPLVPGTL (MAGA4_HUMAN)
SRSPLVPGTF

SEQ ID NO: 61804 - protein, 9 aa, Artificial Sequence
  Description of Artificial Sequence: Synthetic peptide
  Seed: EAQEEALGL (MAGA4_HUMAN)
EEQEEALGL

SEQ ID NO: 61805 - protein, 10 aa, Artificial Sequence
  Description of Artificial Sequence: Synthetic peptide
  Seed: KEVDPASNTY (MAGA4_HUMAN)
KYVDPASNTY

SEQ ID NO: 61806 - protein, 9 aa, Artificial Sequence
  Description of Artificial Sequence: Synthetic peptide
  Seed: SNPARYEFL (MAGA4_HUMAN)
STPARYEFL

SEQ ID NO: 61807 - protein, 9 aa, Artificial Sequence
  Description of Artificial Sequence: Synthetic peptide
  Seed: LKMIFGIDV (MAGA4_HUMAN)
LKMIFGIDM

SEQ ID NO: 61808 - protein, 9 aa, Artificial Sequence
  Description of Artificial Sequence: Synthetic peptide
  Seed: LRKYRAKEL (MAGA4_HUMAN)
LLKYRAKEF

SEQ ID NO: 61809 - protein, 9 aa, Artificial Sequence
  Description of Artificial Sequence: Synthetic peptide
  Seed: ALLEEEEGV (MAGA4_HUMAN)
AQLEEEEGL

SEQ ID NO: 61810 - protein, 10 aa, Artificial Sequence
  Description of Artificial Sequence: Synthetic peptide
  Seed: TSYVKVLEHV (MAGA4_HUMAN)
TSYVKVLEHF

SEQ ID NO: 61811 - protein, 9 aa, Artificial Sequence
  Description of Artificial Sequence: Synthetic peptide
  Seed: TTISFTCWR (MAGA4_HUMAN)
TSISFTCWR

SEQ ID NO: 61812 - protein, 9 aa, Artificial Sequence
  Description of Artificial Sequence: Synthetic peptide
  Seed: LPTTISFTC (MAGA4_HUMAN)
LPTTISFTY

SEQ ID NO: 61813 - protein, 9 aa, Artificial Sequence
  Description of Artificial Sequence: Synthetic peptide
  Seed: VNARVRIAY (MAGA4_HUMAN)
VSARVRIAL

SEQ ID NO: 61814 - protein, 9 aa, Artificial Sequence
  Description of Artificial Sequence: Synthetic peptide
  Seed: WVQENYLEY (MAGA4_HUMAN)
WYQENYLEI

SEQ ID NO: 61815 - protein, 9 aa, Artificial Sequence
  Description of Artificial Sequence: Synthetic peptide
  Seed: KVDELAHFL (MAGA4_HUMAN)
KMDELAHFA

SEQ ID NO: 61816 - protein, 10 aa, Artificial Sequence
  Description of Artificial Sequence: Synthetic peptide
  Seed: ESAGPPQSPQ (MAGA4_HUMAN)
EVAGPPQSPR

SEQ ID NO: 61817 - protein, 10 aa, Artificial Sequence
  Description of Artificial Sequence: Synthetic peptide
  Seed: VEAQEEALGL (MAGA4_HUMAN)
VEAQEEALGW

SEQ ID NO: 61818 - protein, 9 aa, Artificial Sequence
  Description of Artificial Sequence: Synthetic peptide
  Seed: RAKELVTKA (MAGA4_HUMAN)
RRKELVTKL

SEQ ID NO: 61819 - protein, 10 aa, Artificial Sequence
  Description of Artificial Sequence: Synthetic peptide
  Seed: RVRIAYPSLR (MAGA4_HUMAN)
RDRIAYPSLI

SEQ ID NO: 61820 - protein, 10 aa, Artificial Sequence
  Description of Artificial Sequence: Synthetic peptide
  Seed: EEQEAAVSSS (MAGA4_HUMAN)
EEQEAAVSSV

SEQ ID NO: 61821 - protein, 9 aa, Artificial Sequence
  Description of Artificial Sequence: Synthetic peptide
  Seed: RCFPVIFGK (MAGA4_HUMAN)
RMFPVIFGH

SEQ ID NO: 61822 - protein, 10 aa, Artificial Sequence
  Description of Artificial Sequence: Synthetic peptide
  Seed: ARVRIAYPSL (MAGA4_HUMAN)
ATVRIAYPSA

SEQ ID NO: 61823 - protein, 8 aa, Artificial Sequence
  Description of Artificial Sequence: Synthetic peptide
  Seed: IFPKTGLL (MAGA4_HUMAN)
IAPKTGLL

SEQ ID NO: 61824 - protein, 11 aa, Artificial Sequence
  Description of Artificial Sequence: Synthetic peptide
  Seed: REAALLEEEEG (MAGA4_HUMAN)
REAALLEEEEI

SEQ ID NO: 61825 - protein, 9 aa, Artificial Sequence
  Description of Artificial Sequence: Synthetic peptide
  Seed: SAGPPQSPQ (MAGA4_HUMAN)
SVGPPQSPY

SEQ ID NO: 61826 - protein, 10 aa, Artificial Sequence
  Description of Artificial Sequence: Synthetic peptide
  Seed: LLGNNQIFPK (MAGA4_HUMAN)
LSGNNQIFPK

SEQ ID NO: 61827 - protein, 9 aa, Artificial Sequence
  Description of Artificial Sequence: Synthetic peptide
  Seed: ASESLKMIF (MAGA4_HUMAN)
ATESLKMIF

SEQ ID NO: 61828 - protein, 9 aa, Artificial Sequence
  Description of Artificial Sequence: Synthetic peptide
  Seed: KVLEHVVRV (MAGA4_HUMAN)
KRLEHVVRF

SEQ ID NO: 61829 - protein, 9 aa, Artificial Sequence
  Description of Artificial Sequence: Synthetic peptide
  Seed: LPTTISFTC (MAGA4_HUMAN)
LVTTISFTF

SEQ ID NO: 61830 - protein, 10 aa, Artificial Sequence
  Description of Artificial Sequence: Synthetic peptide
  Seed: RIAYPSLREA (MAGA4_HUMAN)
RLAYPSLREL

SEQ ID NO: 61831 - protein, 9 aa, Artificial Sequence
  Description of Artificial Sequence: Synthetic peptide
  Seed: LEHVVRVNA (MAGA4_HUMAN)
LEHVVRVNL

SEQ ID NO: 61832 - protein, 10 aa, Artificial Sequence
  Description of Artificial Sequence: Synthetic peptide
  Seed: RVRIAYPSLR (MAGA4_HUMAN)
RMRIAYPSLL

SEQ ID NO: 61833 - protein, 9 aa, Artificial Sequence
  Description of Artificial Sequence: Synthetic peptide
  Seed: LVPGTLEEV (MAGA4_HUMAN)
LSPGTLEEL

SEQ ID NO: 61834 - protein, 9 aa, Artificial Sequence
  Description of Artificial Sequence: Synthetic peptide
  Seed: RVRIAYPSL (MAGA4_HUMAN)
RVRIAYPSG

SEQ ID NO: 61835 - protein, 10 aa, Artificial Sequence
  Description of Artificial Sequence: Synthetic peptide
  Seed: RQVPGSNPAR (MAGA4_HUMAN)
REVPGSNPAY

SEQ ID NO: 61836 - protein, 9 aa, Artificial Sequence
  Description of Artificial Sequence: Synthetic peptide
  Seed: QIFPKTGLL (MAGA4_HUMAN)
QQFPKTGLI

SEQ ID NO: 61837 - protein, 9 aa, Artificial Sequence
  Description of Artificial Sequence: Synthetic peptide
  Seed: SALPTTISF (MAGA4_HUMAN)
SALPTTISM

SEQ ID NO: 61838 - protein, 10 aa, Artificial Sequence
  Description of Artificial Sequence: Synthetic peptide
  Seed: AAVSSSSPLV (MAGA4_HUMAN)
AVVSSSSPLV

SEQ ID NO: 61839 - protein, 9 aa, Artificial Sequence
  Description of Artificial Sequence: Synthetic peptide
  Seed: KVDELAHFL (MAGA4_HUMAN)
KYDELAHFM

SEQ ID NO: 61840 - protein, 10 aa, Artificial Sequence
  Description of Artificial Sequence: Synthetic peptide
  Seed: VDPASNTYTL (MAGA4_HUMAN)
VWPASNTYTL

SEQ ID NO: 61841 - protein, 10 aa, Artificial Sequence
  Description of Artificial Sequence: Synthetic peptide
  Seed: YRQVPGSNPA (MAGA4_HUMAN)
YLQVPGSNPV

SEQ ID NO: 61842 - protein, 10 aa, Artificial Sequence
  Description of Artificial Sequence: Synthetic peptide
  Seed: TSYVKVLEHV (MAGA4_HUMAN)
TNYVKVLEHF

SEQ ID NO: 61843 - protein, 9 aa, Artificial Sequence
  Description of Artificial Sequence: Synthetic peptide
  Seed: SALPTTISF (MAGA4_HUMAN)
SVLPTTISW

SEQ ID NO: 61844 - protein, 9 aa, Artificial Sequence
  Description of Artificial Sequence: Synthetic peptide
  Seed: GTLEEVPAA (MAGA4_HUMAN)
GFLEEVPAV

SEQ ID NO: 61845 - protein, 9 aa, Artificial Sequence
  Description of Artificial Sequence: Synthetic peptide
  Seed: EVDPASNTY (MAGA4_HUMAN)
EYDPASNTM

SEQ ID NO: 61846 - protein, 10 aa, Artificial Sequence
  Description of Artificial Sequence: Synthetic peptide
  Seed: RQVPGSNPAR (MAGA4_HUMAN)
RMVPGSNPAL

SEQ ID NO: 61847 - protein, 9 aa, Artificial Sequence
  Description of Artificial Sequence: Synthetic peptide
  Seed: RVNARVRIA (MAGA4_HUMAN)
RTNARVRIM

SEQ ID NO: 61848 - protein, 10 aa, Artificial Sequence
  Description of Artificial Sequence: Synthetic peptide
  Seed: GVYDGREHTV (MAGA4_HUMAN)
GVYDGREHTF

SEQ ID NO: 61849 - protein, 10 aa, Artificial Sequence
  Description of Artificial Sequence: Synthetic peptide
  Seed: AYPSLREAAL (MAGA4_HUMAN)
AWPSLREAAL

SEQ ID NO: 61850 - protein, 11 aa, Artificial Sequence
  Description of Artificial Sequence: Synthetic peptide
  Seed: YVKVLEHVVRV (MAGA4_HUMAN)
YMKVLEHVVRA

SEQ ID NO: 61851 - protein, 10 aa, Artificial Sequence
  Description of Artificial Sequence: Synthetic peptide
  Seed: YRQVPGSNPA (MAGA4_HUMAN)
YEQVPGSNPL

SEQ ID NO: 61852 - protein, 10 aa, Artificial Sequence
  Description of Artificial Sequence: Synthetic peptide
  Seed: EAAVSSSSPL (MAGA4_HUMAN)
ESAVSSSSPV

SEQ ID NO: 61853 - protein, 9 aa, Artificial Sequence
  Description of Artificial Sequence: Synthetic peptide
  Seed: SQEEEGPST (MAGA4_HUMAN)
SEEEEGPSP

SEQ ID NO: 61854 - protein, 10 aa, Artificial Sequence
  Description of Artificial Sequence: Synthetic peptide
  Seed: LAHFLLRKYR (MAGA4_HUMAN)
LVHFLLRKYR

SEQ ID NO: 61855 - protein, 9 aa, Artificial Sequence
  Description of Artificial Sequence: Synthetic peptide
  Seed: AESAGPPQS (MAGA4_HUMAN)
AESAGPPQA

SEQ ID NO: 61856 - protein, 10 aa, Artificial Sequence
  Description of Artificial Sequence: Synthetic peptide
  Seed: RVNARVRIAY (MAGA4_HUMAN)
RMNARVRIAW

SEQ ID NO: 61857 - protein, 9 aa, Artificial Sequence
  Description of Artificial Sequence: Synthetic peptide
  Seed: SPDAESLFR (MAGA4_HUMAN)
SADAESLFY

SEQ ID NO: 61858 - protein, 11 aa, Artificial Sequence
  Description of Artificial Sequence: Synthetic peptide
  Seed: AQAPTTEEQEA (MAGA4_HUMAN)
ALAPTTEEQEM

SEQ ID NO: 61859 - protein, 10 aa, Artificial Sequence
  Description of Artificial Sequence: Synthetic peptide
  Seed: HVVRVNARVR (MAGA4_HUMAN)
HFVRVNARVR

SEQ ID NO: 61860 - protein, 9 aa, Artificial Sequence
  Description of Artificial Sequence: Synthetic peptide
  Seed: IAMEGDSAS (MAGA4_HUMAN)
ITMEGDSAY

SEQ ID NO: 61861 - protein, 10 aa, Artificial Sequence
  Description of Artificial Sequence: Synthetic peptide
  Seed: LPTTISFTCW (MAGA4_HUMAN)
LSTTISFTCF

SEQ ID NO: 61862 - protein, 9 aa, Artificial Sequence
  Description of Artificial Sequence: Synthetic peptide
  Seed: RQVPGSNPA (MAGA4_HUMAN)
RKVPGSNPH

SEQ ID NO: 61863 - protein, 11 aa, Artificial Sequence
  Description of Artificial Sequence: Synthetic peptide
  Seed: ARVRIAYPSLR (MAGA4_HUMAN)
AFVRIAYPSLR

SEQ ID NO: 61864 - protein, 9 aa, Artificial Sequence
  Description of Artificial Sequence: Synthetic peptide
  Seed: RVRIAYPSL (MAGA4_HUMAN)
RSRIAYPSR

SEQ ID NO: 61865 - protein, 9 aa, Artificial Sequence
  Description of Artificial Sequence: Synthetic peptide
  Seed: IIVLGTIAM (MAGA4_HUMAN)
IFVLGTIAY

SEQ ID NO: 61866 - protein, 9 aa, Artificial Sequence
  Description of Artificial Sequence: Synthetic peptide
  Seed: SALPTTISF (MAGA4_HUMAN)
SILPTTISY

SEQ ID NO: 61867 - protein, 9 aa, Artificial Sequence
  Description of Artificial Sequence: Synthetic peptide
  Seed: RAKELVTKA (MAGA4_HUMAN)
RIKELVTKV

SEQ ID NO: 61868 - protein, 10 aa, Artificial Sequence
  Description of Artificial Sequence: Synthetic peptide
  Seed: PTTISFTCWR (MAGA4_HUMAN)
PETISFTCWK

SEQ ID NO: 61869 - protein, 10 aa, Artificial Sequence
  Description of Artificial Sequence: Synthetic peptide
  Seed: EHTVYGEPRK (MAGA4_HUMAN)
ENTVYGEPRR

SEQ ID NO: 61870 - protein, 9 aa, Artificial Sequence
  Description of Artificial Sequence: Synthetic peptide
  Seed: AEMLERVIK (MAGA4_HUMAN)
AEMLERVIV

SEQ ID NO: 61871 - protein, 10 aa, Artificial Sequence
  Description of Artificial Sequence: Synthetic peptide
  Seed: EHTVYGEPRK (MAGA4_HUMAN)
ECTVYGEPRR

SEQ ID NO: 61872 - protein, 9 aa, Artificial Sequence
  Description of Artificial Sequence: Synthetic peptide
  Seed: SALPTTISF (MAGA4_HUMAN)
SFLPTTISW

SEQ ID NO: 61873 - protein, 9 aa, Artificial Sequence
  Description of Artificial Sequence: Synthetic peptide
  Seed: EVDPASNTY (MAGA4_HUMAN)
EFDPASNTM

SEQ ID NO: 61874 - protein, 9 aa, Artificial Sequence
  Description of Artificial Sequence: Synthetic peptide
  Seed: LRKYRAKEL (MAGA4_HUMAN)
LMKYRAKEA

SEQ ID NO: 61875 - protein, 10 aa, Artificial Sequence
  Description of Artificial Sequence: Synthetic peptide
  Seed: KNYKRCFPVI (MAGA4_HUMAN)
KNYKRCFPVK

SEQ ID NO: 61876 - protein, 10 aa, Artificial Sequence
  Description of Artificial Sequence: Synthetic peptide
  Seed: GVYDGREHTV (MAGA4_HUMAN)
GSYDGREHTL

SEQ ID NO: 61877 - protein, 9 aa, Artificial Sequence
  Description of Artificial Sequence: Synthetic peptide
  Seed: FREALSNKV (MAGA4_HUMAN)
FHEALSNKF

SEQ ID NO: 61878 - protein, 9 aa, Artificial Sequence
  Description of Artificial Sequence: Synthetic peptide
  Seed: RAKELVTKA (MAGA4_HUMAN)
RMKELVTKA

SEQ ID NO: 61879 - protein, 9 aa, Artificial Sequence
  Description of Artificial Sequence: Synthetic peptide
  Seed: QIFPKTGLL (MAGA4_HUMAN)
QLFPKTGLF

SEQ ID NO: 61880 - protein, 9 aa, Artificial Sequence
  Description of Artificial Sequence: Synthetic peptide
  Seed: TSPDAESLF (MAGA4_HUMAN)
TAPDAESLF

SEQ ID NO: 61881 - protein, 9 aa, Artificial Sequence
  Description of Artificial Sequence: Synthetic peptide
  Seed: ALLEEEEGV (MAGA4_HUMAN)
AMLEEEEGL

SEQ ID NO: 61882 - protein, 10 aa, Artificial Sequence
  Description of Artificial Sequence: Synthetic peptide
  Seed: RVRIAYPSLR (MAGA4_HUMAN)
RHRIAYPSLL

SEQ ID NO: 61883 - protein, 9 aa, Artificial Sequence
  Description of Artificial Sequence: Synthetic peptide
  Seed: RCFPVIFGK (MAGA4_HUMAN)
RWFPVIFGK

SEQ ID NO: 61884 - protein, 9 aa, Artificial Sequence
  Description of Artificial Sequence: Synthetic peptide
  Seed: EIWEELGVM (MAGA4_HUMAN)
EIWEELGVW

SEQ ID NO: 61885 - protein, 9 aa, Artificial Sequence
  Description of Artificial Sequence: Synthetic peptide
  Seed: IIVLGTIAM (MAGA4_HUMAN)
IYVLGTIAF

SEQ ID NO: 61886 - protein, 8 aa, Artificial Sequence
  Description of Artificial Sequence: Synthetic peptide
  Seed: KVDELAHF (MAGA4_HUMAN)
KTDELAHY

SEQ ID NO: 61887 - protein, 9 aa, Artificial Sequence
  Description of Artificial Sequence: Synthetic peptide
  Seed: NTYTLVTCL (MAGA4_HUMAN)
NQYTLVTCL

SEQ ID NO: 61888 - protein, 9 aa, Artificial Sequence
  Description of Artificial Sequence: Synthetic peptide
  Seed: RQVPGSNPA (MAGA4_HUMAN)
RIVPGSNPV

SEQ ID NO: 61889 - protein, 9 aa, Artificial Sequence
  Description of Artificial Sequence: Synthetic peptide
  Seed: EHVVRVNAR (MAGA4_HUMAN)
EIVVRVNAR

SEQ ID NO: 61890 - protein, 11 aa, Artificial Sequence
  Description of Artificial Sequence: Synthetic peptide
  Seed: RVRIAYPSLRE (MAGA4_HUMAN)
RVRIAYPSLRM

SEQ ID NO: 61891 - protein, 9 aa, Artificial Sequence
  Description of Artificial Sequence: Synthetic peptide
  Seed: TVYGEPRKL (MAGA4_HUMAN)
TLYGEPRKI

SEQ ID NO: 61892 - protein, 10 aa, Artificial Sequence
  Description of Artificial Sequence: Synthetic peptide
  Seed: MIFGIDVKEV (MAGA4_HUMAN)
MTFGIDVKEL

SEQ ID NO: 61893 - protein, 10 aa, Artificial Sequence
  Description of Artificial Sequence: Synthetic peptide
  Seed: SSSPLVPGTL (MAGA4_HUMAN)
SLSPLVPGTW

SEQ ID NO: 61894 - protein, 9 aa, Artificial Sequence
  Description of Artificial Sequence: Synthetic peptide
  Seed: QIFPKTGLL (MAGA4_HUMAN)
QSFPKTGLW

SEQ ID NO: 61895 - protein, 8 aa, Artificial Sequence
  Description of Artificial Sequence: Synthetic peptide
  Seed: SPLVPGTL (MAGA4_HUMAN)
SPLVPGTA

SEQ ID NO: 61896 - protein, 10 aa, Artificial Sequence
  Description of Artificial Sequence: Synthetic peptide
  Seed: SSSPLVPGTL (MAGA4_HUMAN)
SISPLVPGTV

SEQ ID NO: 61897 - protein, 10 aa, Artificial Sequence
  Description of Artificial Sequence: Synthetic peptide
  Seed: ARVRIAYPSL (MAGA4_HUMAN)
AKVRIAYPSI

SEQ ID NO: 61898 - protein, 9 aa, Artificial Sequence
  Description of Artificial Sequence: Synthetic peptide
  Seed: KELVTKAEM (MAGA4_HUMAN)
KELVTKAEF

SEQ ID NO: 61899 - protein, 10 aa, Artificial Sequence
  Description of Artificial Sequence: Synthetic peptide
  Seed: KVLEHVVRVN (MAGA4_HUMAN)
KLLEHVVRVP

SEQ ID NO: 61900 - protein, 9 aa, Artificial Sequence
  Description of Artificial Sequence: Synthetic peptide
  Seed: KVLEHVVRV (MAGA4_HUMAN)
KMLEHVVRR

SEQ ID NO: 61901 - protein, 9 aa, Artificial Sequence
  Description of Artificial Sequence: Synthetic peptide
  Seed: LGNNQIFPK (MAGA4_HUMAN)
LANNQIFPM

SEQ ID NO: 61902 - protein, 9 aa, Artificial Sequence
  Description of Artificial Sequence: Synthetic peptide
  Seed: IIVLGTIAM (MAGA4_HUMAN)
IFVLGTIAL

SEQ ID NO: 61903 - protein, 10 aa, Artificial Sequence
  Description of Artificial Sequence: Synthetic peptide
  Seed: LTQDWVQENY (MAGA4_HUMAN)
LLQDWVQENY

SEQ ID NO: 61904 - protein, 9 aa, Artificial Sequence
  Description of Artificial Sequence: Synthetic peptide
  Seed: RQVPGSNPA (MAGA4_HUMAN)
RIVPGSNPI

SEQ ID NO: 61905 - protein, 9 aa, Artificial Sequence
  Description of Artificial Sequence: Synthetic peptide
  Seed: RVRIAYPSL (MAGA4_HUMAN)
RYRIAYPSK

SEQ ID NO: 61906 - protein, 9 aa, Artificial Sequence
  Description of Artificial Sequence: Synthetic peptide
  Seed: KVLEHVVRV (MAGA4_HUMAN)
KFLEHVVRR

SEQ ID NO: 61907 - protein, 9 aa, Artificial Sequence
  Description of Artificial Sequence: Synthetic peptide
  Seed: VYGEPRKLL (MAGA4_HUMAN)
VTGEPRKLL

SEQ ID NO: 61908 - protein, 9 aa, Artificial Sequence
  Description of Artificial Sequence: Synthetic peptide
  Seed: SSPLVPGTL (MAGA4_HUMAN)
SMPLVPGTL

SEQ ID NO: 61909 - protein, 9 aa, Artificial Sequence
  Description of Artificial Sequence: Synthetic peptide
  Seed: SYVKVLEHV (MAGA4_HUMAN)
SYVKVLEHL

SEQ ID NO: 61910 - protein, 9 aa, Artificial Sequence
  Description of Artificial Sequence: Synthetic peptide
  Seed: NQIFPKTGL (MAGA4_HUMAN)
NHIFPKTGM

SEQ ID NO: 61911 - protein, 9 aa, Artificial Sequence
  Description of Artificial Sequence: Synthetic peptide
  Seed: KNYKRCFPV (MAGA4_HUMAN)
KSYKRCFPT

SEQ ID NO: 61912 - protein, 9 aa, Artificial Sequence
  Description of Artificial Sequence: Synthetic peptide
  Seed: SALPTTISF (MAGA4_HUMAN)
SMLPTTISW

SEQ ID NO: 61913 - protein, 10 aa, Artificial Sequence
  Description of Artificial Sequence: Synthetic peptide
  Seed: VDPASNTYTL (MAGA4_HUMAN)
VHPASNTYTF

SEQ ID NO: 61914 - protein, 10 aa, Artificial Sequence
  Description of Artificial Sequence: Synthetic peptide
  Seed: KYRAKELVTK (MAGA4_HUMAN)
KVRAKELVTI

SEQ ID NO: 61915 - protein, 9 aa, Artificial Sequence
  Description of Artificial Sequence: Synthetic peptide
  Seed: VYDGREHTV (MAGA4_HUMAN)
VWDGREHTY

SEQ ID NO: 61916 - protein, 9 aa, Artificial Sequence
  Description of Artificial Sequence: Synthetic peptide
  Seed: TSPDAESLF (MAGA4_HUMAN)
TIPDAESLY

SEQ ID NO: 61917 - protein, 9 aa, Artificial Sequence
  Description of Artificial Sequence: Synthetic peptide
  Seed: AAVSSSSPL (MAGA4_HUMAN)
AFVSSSSPV

SEQ ID NO: 61918 - protein, 9 aa, Artificial Sequence
  Description of Artificial Sequence: Synthetic peptide
  Seed: SALPTTISF (MAGA4_HUMAN)
SHLPTTISF

SEQ ID NO: 61919 - protein, 9 aa, Artificial Sequence
  Description of Artificial Sequence: Synthetic peptide
  Seed: LFREALSNK (MAGA4_HUMAN)
LAREALSNK

SEQ ID NO: 61920 - protein, 9 aa, Artificial Sequence
  Description of Artificial Sequence: Synthetic peptide
  Seed: ALSNKVDEL (MAGA4_HUMAN)
AASNKVDEF

SEQ ID NO: 61921 - protein, 10 aa, Artificial Sequence
  Description of Artificial Sequence: Synthetic peptide
  Seed: ASALPTTISF (MAGA4_HUMAN)
ALALPTTISF

SEQ ID NO: 61922 - protein, 9 aa, Artificial Sequence
  Description of Artificial Sequence: Synthetic peptide
  Seed: LVPGTLEEV (MAGA4_HUMAN)
LPPGTLEEI

SEQ ID NO: 61923 - protein, 10 aa, Artificial Sequence
  Description of Artificial Sequence: Synthetic peptide
  Seed: TLVTCLGLSY (MAGA4_HUMAN)
TTVTCLGLSY

SEQ ID NO: 61924 - protein, 9 aa, Artificial Sequence
  Description of Artificial Sequence: Synthetic peptide
  Seed: TVYGEPRKL (MAGA4_HUMAN)
TYYGEPRKM

SEQ ID NO: 61925 - protein, 9 aa, Artificial Sequence
  Description of Artificial Sequence: Synthetic peptide
  Seed: SALPTTISF (MAGA4_HUMAN)
SLLPTTISK

SEQ ID NO: 61926 - protein, 9 aa, Artificial Sequence
  Description of Artificial Sequence: Synthetic peptide
  Seed: RQVPGSNPA (MAGA4_HUMAN)
RVVPGSNPF

SEQ ID NO: 61927 - protein, 9 aa, Artificial Sequence
  Description of Artificial Sequence: Synthetic peptide
  Seed: KAEMLERVI (MAGA4_HUMAN)
KAEMLERVW

SEQ ID NO: 61928 - protein, 9 aa, Artificial Sequence
  Description of Artificial Sequence: Synthetic peptide
  Seed: LRKYRAKEL (MAGA4_HUMAN)
LVKYRAKEL

SEQ ID NO: 61929 - protein, 9 aa, Artificial Sequence
  Description of Artificial Sequence: Synthetic peptide
  Seed: EHVVRVNAR (MAGA4_HUMAN)
EMVVRVNAR

SEQ ID NO: 61930 - protein, 9 aa, Artificial Sequence
  Description of Artificial Sequence: Synthetic peptide
  Seed: YPSLREAAL (MAGA4_HUMAN)
YQSLREAAL

SEQ ID NO: 61931 - protein, 11 aa, Artificial Sequence
  Description of Artificial Sequence: Synthetic peptide
  Seed: GVYDGREHTVY (MAGA4_HUMAN)
GQYDGREHTVM

SEQ ID NO: 61932 - protein, 10 aa, Artificial Sequence
  Description of Artificial Sequence: Synthetic peptide
  Seed: HFLLRKYRAK (MAGA4_HUMAN)
HTLLRKYRAR

SEQ ID NO: 61933 - protein, 9 aa, Artificial Sequence
  Description of Artificial Sequence: Synthetic peptide
  Seed: IAYPSLREA (MAGA4_HUMAN)
IRYPSLREL

SEQ ID NO: 61934 - protein, 9 aa, Artificial Sequence
  Description of Artificial Sequence: Synthetic peptide
  Seed: KVLEHVVRV (MAGA4_HUMAN)
KDLEHVVRL

SEQ ID NO: 61935 - protein, 9 aa, Artificial Sequence
  Description of Artificial Sequence: Synthetic peptide
  Seed: RAKELVTKA (MAGA4_HUMAN)
RVKELVTKV

SEQ ID NO: 61936 - protein, 11 aa, Artificial Sequence
  Description of Artificial Sequence: Synthetic peptide
  Seed: GLLGNNQIFPK (MAGA4_HUMAN)
GTLGNNQIFPR

SEQ ID NO: 61937 - protein, 10 aa, Artificial Sequence
  Description of Artificial Sequence: Synthetic peptide
  Seed: RQVPGSNPAR (MAGA4_HUMAN)
RLVPGSNPAM

SEQ ID NO: 61938 - protein, 9 aa, Artificial Sequence
  Description of Artificial Sequence: Synthetic peptide
  Seed: SYVKVLEHV (MAGA4_HUMAN)
SYVKVLEHY

SEQ ID NO: 61939 - protein, 9 aa, Artificial Sequence
  Description of Artificial Sequence: Synthetic peptide
  Seed: TTEEQEAAV (MAGA4_HUMAN)
TAEEQEAAI

SEQ ID NO: 61940 - protein, 10 aa, Artificial Sequence
  Description of Artificial Sequence: Synthetic peptide
  Seed: KASESLKMIF (MAGA4_HUMAN)
KQSESLKMIW

SEQ ID NO: 61941 - protein, 10 aa, Artificial Sequence
  Description of Artificial Sequence: Synthetic peptide
  Seed: ARVRIAYPSL (MAGA4_HUMAN)
ATVRIAYPSK

SEQ ID NO: 61942 - protein, 10 aa, Artificial Sequence
  Description of Artificial Sequence: Synthetic peptide
  Seed: VVRVNARVRI (MAGA4_HUMAN)
VTRVNARVRK

SEQ ID NO: 61943 - protein, 9 aa, Artificial Sequence
  Description of Artificial Sequence: Synthetic peptide
  Seed: SALPTTISF (MAGA4_HUMAN)
SELPTTISF

SEQ ID NO: 61944 - protein, 8 aa, Artificial Sequence
  Description of Artificial Sequence: Synthetic peptide
  Seed: VYGEPRKL (MAGA4_HUMAN)
VTGEPRKL

SEQ ID NO: 61945 - protein, 9 aa, Artificial Sequence
  Description of Artificial Sequence: Synthetic peptide
  Seed: VNARVRIAY (MAGA4_HUMAN)
VTARVRIAF

SEQ ID NO: 61946 - protein, 9 aa, Artificial Sequence
  Description of Artificial Sequence: Synthetic peptide
  Seed: TTEEQEAAV (MAGA4_HUMAN)
TSEEQEAAI

SEQ ID NO: 61947 - protein, 10 aa, Artificial Sequence
  Description of Artificial Sequence: Synthetic peptide
  Seed: MIFGIDVKEV (MAGA4_HUMAN)
MVFGIDVKEL

SEQ ID NO: 61948 - protein, 9 aa, Artificial Sequence
  Description of Artificial Sequence: Synthetic peptide
  Seed: SNKVDELAH (MAGA4_HUMAN)
SAKVDELAM

SEQ ID NO: 61949 - protein, 9 aa, Artificial Sequence
  Description of Artificial Sequence: Synthetic peptide
  Seed: SEEEIWEEL (MAGA4_HUMAN)
SAEEIWEEY

SEQ ID NO: 61950 - protein, 9 aa, Artificial Sequence
  Description of Artificial Sequence: Synthetic peptide
  Seed: SSPLVPGTL (MAGA4_HUMAN)
SPPLVPGTY

SEQ ID NO: 61951 - protein, 10 aa, Artificial Sequence
  Description of Artificial Sequence: Synthetic peptide
  Seed: STSPDAESLF (MAGA4_HUMAN)
SLSPDAESLL

SEQ ID NO: 61952 - protein, 9 aa, Artificial Sequence
  Description of Artificial Sequence: Synthetic peptide
  Seed: SSPLVPGTL (MAGA4_HUMAN)
SCPLVPGTM

SEQ ID NO: 61953 - protein, 9 aa, Artificial Sequence
  Description of Artificial Sequence: Synthetic peptide
  Seed: AAVSSSSPL (MAGA4_HUMAN)
AEVSSSSPY

SEQ ID NO: 61954 - protein, 10 aa, Artificial Sequence
  Description of Artificial Sequence: Synthetic peptide
  Seed: LPTTISFTCW (MAGA4_HUMAN)
LCTTISFTCW

SEQ ID NO: 61955 - protein, 8 aa, Artificial Sequence
  Description of Artificial Sequence: Synthetic peptide
  Seed: DELAHFLL (MAGA4_HUMAN)
DELAHFLM

SEQ ID NO: 61956 - protein, 9 aa, Artificial Sequence
  Description of Artificial Sequence: Synthetic peptide
  Seed: RVNARVRIA (MAGA4_HUMAN)
RTNARVRII

SEQ ID NO: 61957 - protein, 10 aa, Artificial Sequence
  Description of Artificial Sequence: Synthetic peptide
  Seed: KEVDPASNTY (MAGA4_HUMAN)
KMVDPASNTY

SEQ ID NO: 61958 - protein, 9 aa, Artificial Sequence
  Description of Artificial Sequence: Synthetic peptide
  Seed: KVDELAHFL (MAGA4_HUMAN)
KVDELAHFV

SEQ ID NO: 61959 - protein, 10 aa, Artificial Sequence
  Description of Artificial Sequence: Synthetic peptide
  Seed: LPTTISFTCW (MAGA4_HUMAN)
LRTTISFTCW

SEQ ID NO: 61960 - protein, 11 aa, Artificial Sequence
  Description of Artificial Sequence: Synthetic peptide
  Seed: IAMEGDSASEE (MAGA4_HUMAN)
IAMEGDSASEF

SEQ ID NO: 61961 - protein, 9 aa, Artificial Sequence
  Description of Artificial Sequence: Synthetic peptide
  Seed: NTYTLVTCL (MAGA4_HUMAN)
NQYTLVTCI

SEQ ID NO: 61962 - protein, 9 aa, Artificial Sequence
  Description of Artificial Sequence: Synthetic peptide
  Seed: RVRIAYPSL (MAGA4_HUMAN)
RWRIAYPSP

SEQ ID NO: 61963 - protein, 9 aa, Artificial Sequence
  Description of Artificial Sequence: Synthetic peptide
  Seed: LVPGTLEEV (MAGA4_HUMAN)
LWPGTLEEF

SEQ ID NO: 61964 - protein, 9 aa, Artificial Sequence
  Description of Artificial Sequence: Synthetic peptide
  Seed: GASALPTTI (MAGA4_HUMAN)
GPSALPTTM

SEQ ID NO: 61965 - protein, 10 aa, Artificial Sequence
  Description of Artificial Sequence: Synthetic peptide
  Seed: KNYKRCFPVI (MAGA4_HUMAN)
KTYKRCFPVS

SEQ ID NO: 61966 - protein, 10 aa, Artificial Sequence
  Description of Artificial Sequence: Synthetic peptide
  Seed: NKVDELAHFL (MAGA4_HUMAN)
NLVDELAHFV

SEQ ID NO: 61967 - protein, 9 aa, Artificial Sequence
  Description of Artificial Sequence: Synthetic peptide
  Seed: IIVLGTIAM (MAGA4_HUMAN)
IRVLGTIAM

SEQ ID NO: 61968 - protein, 10 aa, Artificial Sequence
  Description of Artificial Sequence: Synthetic peptide
  Seed: RVRIAYPSLR (MAGA4_HUMAN)
RERIAYPSLR

SEQ ID NO: 61969 - protein, 10 aa, Artificial Sequence
  Description of Artificial Sequence: Synthetic peptide
  Seed: YPSLREAALL (MAGA4_HUMAN)
YSSLREAALF

SEQ ID NO: 61970 - protein, 11 aa, Artificial Sequence
  Description of Artificial Sequence: Synthetic peptide
  Seed: RQVPGSNPARY (MAGA4_HUMAN)
RSVPGSNPARK

SEQ ID NO: 61971 - protein, 9 aa, Artificial Sequence
  Description of Artificial Sequence: Synthetic peptide
  Seed: ELAHFLLRK (MAGA4_HUMAN)
EVAHFLLRY

SEQ ID NO: 61972 - protein, 9 aa, Artificial Sequence
  Description of Artificial Sequence: Synthetic peptide
  Seed: SALPTTISF (MAGA4_HUMAN)
SKLPTTISL

SEQ ID NO: 61973 - protein, 9 aa, Artificial Sequence
  Description of Artificial Sequence: Synthetic peptide
  Seed: RVRIAYPSL (MAGA4_HUMAN)
RFRIAYPSM

SEQ ID NO: 61974 - protein, 10 aa, Artificial Sequence
  Description of Artificial Sequence: Synthetic peptide
  Seed: KEVDPASNTY (MAGA4_HUMAN)
KLVDPASNTI

SEQ ID NO: 61975 - protein, 10 aa, Artificial Sequence
  Description of Artificial Sequence: Synthetic peptide
  Seed: YRQVPGSNPA (MAGA4_HUMAN)
YTQVPGSNPL

SEQ ID NO: 61976 - protein, 9 aa, Artificial Sequence
  Description of Artificial Sequence: Synthetic peptide
  Seed: SEQKSQHCK (MAGA4_HUMAN)
SSQKSQHCY

SEQ ID NO: 61977 - protein, 9 aa, Artificial Sequence
  Description of Artificial Sequence: Synthetic peptide
  Seed: RAKELVTKA (MAGA4_HUMAN)
RAKELVTKK

SEQ ID NO: 61978 - protein, 9 aa, Artificial Sequence
  Description of Artificial Sequence: Synthetic peptide
  Seed: QIFPKTGLL (MAGA4_HUMAN)
QAFPKTGLY

SEQ ID NO: 61979 - protein, 10 aa, Artificial Sequence
  Description of Artificial Sequence: Synthetic peptide
  Seed: ALSNKVDELA (MAGA4_HUMAN)
ALSNKVDELL

SEQ ID NO: 61980 - protein, 10 aa, Artificial Sequence
  Description of Artificial Sequence: Synthetic peptide
  Seed: MIFGIDVKEV (MAGA4_HUMAN)
MLFGIDVKEA

SEQ ID NO: 61981 - protein, 9 aa, Artificial Sequence
  Description of Artificial Sequence: Synthetic peptide
  Seed: LFREALSNK (MAGA4_HUMAN)
LLREALSNR

SEQ ID NO: 61982 - protein, 9 aa, Artificial Sequence
  Description of Artificial Sequence: Synthetic peptide
  Seed: WVQENYLEY (MAGA4_HUMAN)
WAQENYLEV

SEQ ID NO: 61983 - protein, 9 aa, Artificial Sequence
  Description of Artificial Sequence: Synthetic peptide
  Seed: VPAAESAGP (MAGA4_HUMAN)
VPAAESAGA

SEQ ID NO: 61984 - protein, 9 aa, Artificial Sequence
  Description of Artificial Sequence: Synthetic peptide
  Seed: IAMEGDSAS (MAGA4_HUMAN)
IVMEGDSAM

SEQ ID NO: 61985 - protein, 9 aa, Artificial Sequence
  Description of Artificial Sequence: Synthetic peptide
  Seed: AEMLERVIK (MAGA4_HUMAN)
AEMLERVIF

SEQ ID NO: 61986 - protein, 10 aa, Artificial Sequence
  Description of Artificial Sequence: Synthetic peptide
  Seed: SESLKMIFGI (MAGA4_HUMAN)
SESLKMIFGY

SEQ ID NO: 61987 - protein, 9 aa, Artificial Sequence
  Description of Artificial Sequence: Synthetic peptide
  Seed: AESLFREAL (MAGA4_HUMAN)
AESLFREAC

SEQ ID NO: 61988 - protein, 10 aa, Artificial Sequence
  Description of Artificial Sequence: Synthetic peptide
  Seed: WEELGVMGVY (MAGA4_HUMAN)
WQELGVMGVY

SEQ ID NO: 61989 - protein, 9 aa, Artificial Sequence
  Description of Artificial Sequence: Synthetic peptide
  Seed: QIFPKTGLL (MAGA4_HUMAN)
QPFPKTGLM

SEQ ID NO: 61990 - protein, 9 aa, Artificial Sequence
  Description of Artificial Sequence: Synthetic peptide
  Seed: QIFPKTGLL (MAGA4_HUMAN)
QAFPKTGLV

SEQ ID NO: 61991 - protein, 9 aa, Artificial Sequence
  Description of Artificial Sequence: Synthetic peptide
  Seed: IIVLGTIAM (MAGA4_HUMAN)
IRVLGTIAL

SEQ ID NO: 61992 - protein, 10 aa, Artificial Sequence
  Description of Artificial Sequence: Synthetic peptide
  Seed: AYPSLREAAL (MAGA4_HUMAN)
AGPSLREAAL

SEQ ID NO: 61993 - protein, 9 aa, Artificial Sequence
  Description of Artificial Sequence: Synthetic peptide
  Seed: VRIAYPSLR (MAGA4_HUMAN)
VWIAYPSLR

SEQ ID NO: 61994 - protein, 10 aa, Artificial Sequence
  Description of Artificial Sequence: Synthetic peptide
  Seed: ESAGPPQSPQ (MAGA4_HUMAN)
EVAGPPQSPK

SEQ ID NO: 61995 - protein, 10 aa, Artificial Sequence
  Description of Artificial Sequence: Synthetic peptide
  Seed: YRQVPGSNPA (MAGA4_HUMAN)
YTQVPGSNPM

SEQ ID NO: 61996 - protein, 9 aa, Artificial Sequence
  Description of Artificial Sequence: Synthetic peptide
  Seed: FPVIFGKAS (MAGA4_HUMAN)
FVVIFGKAY

SEQ ID NO: 61997 - protein, 9 aa, Artificial Sequence
  Description of Artificial Sequence: Synthetic peptide
  Seed: RAKELVTKA (MAGA4_HUMAN)
RIKELVTKL

SEQ ID NO: 61998 - protein, 10 aa, Artificial Sequence
  Description of Artificial Sequence: Synthetic peptide
  Seed: EHVVRVNARV (MAGA4_HUMAN)
EMVVRVNARV

SEQ ID NO: 61999 - protein, 9 aa, Artificial Sequence
  Description of Artificial Sequence: Synthetic peptide
  Seed: QIFPKTGLL (MAGA4_HUMAN)
QLFPKTGLY

SEQ ID NO: 62000 - protein, 9 aa, Artificial Sequence
  Description of Artificial Sequence: Synthetic peptide
  Seed: SALPTTISF (MAGA4_HUMAN)
STLPTTISM

SEQ ID NO: 62001 - protein, 9 aa, Artificial Sequence
  Description of Artificial Sequence: Synthetic peptide
  Seed: YVKVLEHVV (MAGA4_HUMAN)
YMKVLEHVV

SEQ ID NO: 62002 - protein, 9 aa, Artificial Sequence
  Description of Artificial Sequence: Synthetic peptide
  Seed: RQVPGSNPA (MAGA4_HUMAN)
RFVPGSNPF

SEQ ID NO: 62003 - protein, 9 aa, Artificial Sequence
  Description of Artificial Sequence: Synthetic peptide
  Seed: RCFPVIFGK (MAGA4_HUMAN)
RMFPVIFGK

SEQ ID NO: 62004 - protein, 9 aa, Artificial Sequence
  Description of Artificial Sequence: Synthetic peptide
  Seed: AQEEALGLV (MAGA4_HUMAN)
AQEEALGLL

SEQ ID NO: 62005 - protein, 10 aa, Artificial Sequence
  Description of Artificial Sequence: Synthetic peptide
  Seed: LGVMGVYDGR (MAGA4_HUMAN)
LEVMGVYDGR

SEQ ID NO: 62006 - protein, 9 aa, Artificial Sequence
  Description of Artificial Sequence: Synthetic peptide
  Seed: IFPKTGLLI (MAGA4_HUMAN)
IVPKTGLLI

SEQ ID NO: 62007 - protein, 9 aa, Artificial Sequence
  Description of Artificial Sequence: Synthetic peptide
  Seed: ELAHFLLRK (MAGA4_HUMAN)
EMAHFLLRR

SEQ ID NO: 62008 - protein, 9 aa, Artificial Sequence
  Description of Artificial Sequence: Synthetic peptide
  Seed: TSPDAESLF (MAGA4_HUMAN)
TVPDAESLY

SEQ ID NO: 62009 - protein, 9 aa, Artificial Sequence
  Description of Artificial Sequence: Synthetic peptide
  Seed: VRIAYPSLR (MAGA4_HUMAN)
VAIAYPSLR

SEQ ID NO: 62010 - protein, 10 aa, Artificial Sequence
  Description of Artificial Sequence: Synthetic peptide
  Seed: PTTISFTCWR (MAGA4_HUMAN)
PKTISFTCWR

SEQ ID NO: 62011 - protein, 10 aa, Artificial Sequence
  Description of Artificial Sequence: Synthetic peptide
  Seed: SLFREALSNK (MAGA4_HUMAN)
SWFREALSNR

SEQ ID NO: 62012 - protein, 9 aa, Artificial Sequence
  Description of Artificial Sequence: Synthetic peptide
  Seed: IIVLGTIAM (MAGA4_HUMAN)
IMVLGTIAY

SEQ ID NO: 62013 - protein, 9 aa, Artificial Sequence
  Description of Artificial Sequence: Synthetic peptide
  Seed: KVLEHVVRV (MAGA4_HUMAN)
KTLEHVVRM

SEQ ID NO: 62014 - protein, 9 aa, Artificial Sequence
  Description of Artificial Sequence: Synthetic peptide
  Seed: DELAHFLLR (MAGA4_HUMAN)
DWLAHFLLR

SEQ ID NO: 62015 - protein, 9 aa, Artificial Sequence
  Description of Artificial Sequence: Synthetic peptide
  Seed: AYPSLREAA (MAGA4_HUMAN)
AYPSLREAM

SEQ ID NO: 62016 - protein, 9 aa, Artificial Sequence
  Description of Artificial Sequence: Synthetic peptide
  Seed: RVRIAYPSL (MAGA4_HUMAN)
RGRIAYPSI

SEQ ID NO: 62017 - protein, 9 aa, Artificial Sequence
  Description of Artificial Sequence: Synthetic peptide
  Seed: GVYDGREHT (MAGA4_HUMAN)
GLYDGREHM

SEQ ID NO: 62018 - protein, 9 aa, Artificial Sequence
  Description of Artificial Sequence: Synthetic peptide
  Seed: GSNPARYEF (MAGA4_HUMAN)
GSNPARYEW

SEQ ID NO: 62019 - protein, 11 aa, Artificial Sequence
  Description of Artificial Sequence: Synthetic peptide
  Seed: REALSNKVDEL (MAGA4_HUMAN)
RQALSNKVDEL

SEQ ID NO: 62020 - protein, 9 aa, Artificial Sequence
  Description of Artificial Sequence: Synthetic peptide
  Seed: YDGREHTVY (MAGA4_HUMAN)
YAGREHTVF

SEQ ID NO: 62021 - protein, 10 aa, Artificial Sequence
  Description of Artificial Sequence: Synthetic peptide
  Seed: YPSLREAALL (MAGA4_HUMAN)
YKSLREAALY

SEQ ID NO: 62022 - protein, 8 aa, Artificial Sequence
  Description of Artificial Sequence: Synthetic peptide
  Seed: RVRIAYPS (MAGA4_HUMAN)
RTRIAYPF

SEQ ID NO: 62023 - protein, 9 aa, Artificial Sequence
  Description of Artificial Sequence: Synthetic peptide
  Seed: KVLEHVVRV (MAGA4_HUMAN)
KTLEHVVRR

SEQ ID NO: 62024 - protein, 9 aa, Artificial Sequence
  Description of Artificial Sequence: Synthetic peptide
  Seed: GLLGNNQIF (MAGA4_HUMAN)
GQLGNNQIM

SEQ ID NO: 62025 - protein, 10 aa, Artificial Sequence
  Description of Artificial Sequence: Synthetic peptide
  Seed: GVYDGREHTV (MAGA4_HUMAN)
GAYDGREHTV

SEQ ID NO: 62026 - protein, 9 aa, Artificial Sequence
  Description of Artificial Sequence: Synthetic peptide
  Seed: DGLLGNNQI (MAGA4_HUMAN)
DALLGNNQV

SEQ ID NO: 62027 - protein, 8 aa, Artificial Sequence
  Description of Artificial Sequence: Synthetic peptide
  Seed: RVRIAYPS (MAGA4_HUMAN)
RTRIAYPV

SEQ ID NO: 62028 - protein, 9 aa, Artificial Sequence
  Description of Artificial Sequence: Synthetic peptide
  Seed: QIFPKTGLL (MAGA4_HUMAN)
QTFPKTGLK

SEQ ID NO: 62029 - protein, 9 aa, Artificial Sequence
  Description of Artificial Sequence: Synthetic peptide
  Seed: VTKAEMLER (MAGA4_HUMAN)
VSKAEMLER

SEQ ID NO: 62030 - protein, 10 aa, Artificial Sequence
  Description of Artificial Sequence: Synthetic peptide
  Seed: YRQVPGSNPA (MAGA4_HUMAN)
YDQVPGSNPL

SEQ ID NO: 62031 - protein, 9 aa, Artificial Sequence
  Description of Artificial Sequence: Synthetic peptide
  Seed: GSNPARYEF (MAGA4_HUMAN)
GENPARYEF

SEQ ID NO: 62032 - protein, 9 aa, Artificial Sequence
  Description of Artificial Sequence: Synthetic peptide
  Seed: KVLEHVVRV (MAGA4_HUMAN)
KHLEHVVRM

SEQ ID NO: 62033 - protein, 9 aa, Artificial Sequence
  Description of Artificial Sequence: Synthetic peptide
  Seed: WVQENYLEY (MAGA4_HUMAN)
WLQENYLEY

SEQ ID NO: 62034 - protein, 10 aa, Artificial Sequence
  Description of Artificial Sequence: Synthetic peptide
  Seed: LPTTISFTCW (MAGA4_HUMAN)
LETTISFTCW

SEQ ID NO: 62035 - protein, 10 aa, Artificial Sequence
  Description of Artificial Sequence: Synthetic peptide
  Seed: RVRIAYPSLR (MAGA4_HUMAN)
RNRIAYPSLM

SEQ ID NO: 62036 - protein, 9 aa, Artificial Sequence
  Description of Artificial Sequence: Synthetic peptide
  Seed: RAKELVTKA (MAGA4_HUMAN)
RPKELVTKT

SEQ ID NO: 62037 - protein, 9 aa, Artificial Sequence
  Description of Artificial Sequence: Synthetic peptide
  Seed: QIFPKTGLL (MAGA4_HUMAN)
QSFPKTGLM

SEQ ID NO: 62038 - protein, 8 aa, Artificial Sequence
  Description of Artificial Sequence: Synthetic peptide
  Seed: ASALPTTI (MAGA4_HUMAN)
ASALPTTL

SEQ ID NO: 62039 - protein, 9 aa, Artificial Sequence
  Description of Artificial Sequence: Synthetic peptide
  Seed: RAKELVTKA (MAGA4_HUMAN)
RLKELVTKK

SEQ ID NO: 62040 - protein, 9 aa, Artificial Sequence
  Description of Artificial Sequence: Synthetic peptide
  Seed: YDGREHTVY (MAGA4_HUMAN)
YIGREHTVY

SEQ ID NO: 62041 - protein, 8 aa, Artificial Sequence
  Description of Artificial Sequence: Synthetic peptide
  Seed: FLLRKYRA (MAGA4_HUMAN)
FALRKYRL

SEQ ID NO: 62042 - protein, 9 aa, Artificial Sequence
  Description of Artificial Sequence: Synthetic peptide
  Seed: SALPTTISF (MAGA4_HUMAN)
SMLPTTISR

SEQ ID NO: 62043 - protein, 9 aa, Artificial Sequence
  Description of Artificial Sequence: Synthetic peptide
  Seed: EVDPASNTY (MAGA4_HUMAN)
EADPASNTM

SEQ ID NO: 62044 - protein, 9 aa, Artificial Sequence
  Description of Artificial Sequence: Synthetic peptide
  Seed: IAMEGDSAS (MAGA4_HUMAN)
IVMEGDSAY

SEQ ID NO: 62045 - protein, 9 aa, Artificial Sequence
  Description of Artificial Sequence: Synthetic peptide
  Seed: VYGEPRKLL (MAGA4_HUMAN)
VAGEPRKLV

SEQ ID NO: 62046 - protein, 9 aa, Artificial Sequence
  Description of Artificial Sequence: Synthetic peptide
  Seed: EVDPASNTY (MAGA4_HUMAN)
EVDPASNTM

SEQ ID NO: 62047 - protein, 9 aa, Artificial Sequence
  Description of Artificial Sequence: Synthetic peptide
  Seed: VVRVNARVR (MAGA4_HUMAN)
VQRVNARVK

SEQ ID NO: 62048 - protein, 10 aa, Artificial Sequence
  Description of Artificial Sequence: Synthetic peptide
  Seed: ESAGPPQSPQ (MAGA4_HUMAN)
EIAGPPQSPK

SEQ ID NO: 62049 - protein, 9 aa, Artificial Sequence
  Description of Artificial Sequence: Synthetic peptide
  Seed: KNYKRCFPV (MAGA4_HUMAN)
KSYKRCFPR

SEQ ID NO: 62050 - protein, 8 aa, Artificial Sequence
  Description of Artificial Sequence: Synthetic peptide
  Seed: KVDELAHF (MAGA4_HUMAN)
KTDELAHV

SEQ ID NO: 62051 - protein, 9 aa, Artificial Sequence
  Description of Artificial Sequence: Synthetic peptide
  Seed: SSPLVPGTL (MAGA4_HUMAN)
SVPLVPGTY

SEQ ID NO: 62052 - protein, 10 aa, Artificial Sequence
  Description of Artificial Sequence: Synthetic peptide
  Seed: GLLIIVLGTI (MAGA4_HUMAN)
GNLIIVLGTV

SEQ ID NO: 62053 - protein, 9 aa, Artificial Sequence
  Description of Artificial Sequence: Synthetic peptide
  Seed: NTYTLVTCL (MAGA4_HUMAN)
NVYTLVTCF

SEQ ID NO: 62054 - protein, 10 aa, Artificial Sequence
  Description of Artificial Sequence: Synthetic peptide
  Seed: KASESLKMIF (MAGA4_HUMAN)
KMSESLKMIY

SEQ ID NO: 62055 - protein, 9 aa, Artificial Sequence
  Description of Artificial Sequence: Synthetic peptide
  Seed: WEELGVMGV (MAGA4_HUMAN)
WEELGVMGM

SEQ ID NO: 62056 - protein, 9 aa, Artificial Sequence
  Description of Artificial Sequence: Synthetic peptide
  Seed: FPVIFGKAS (MAGA4_HUMAN)
FAVIFGKAY

SEQ ID NO: 62057 - protein, 9 aa, Artificial Sequence
  Description of Artificial Sequence: Synthetic peptide
  Seed: SAGPPQSPQ (MAGA4_HUMAN)
SIGPPQSPY

SEQ ID NO: 62058 - protein, 11 aa, Artificial Sequence
  Description of Artificial Sequence: Synthetic peptide
  Seed: GASALPTTISF (MAGA4_HUMAN)
GLSALPTTISY

SEQ ID NO: 62059 - protein, 9 aa, Artificial Sequence
  Description of Artificial Sequence: Synthetic peptide
  Seed: VYDGREHTV (MAGA4_HUMAN)
VADGREHTC

SEQ ID NO: 62060 - protein, 10 aa, Artificial Sequence
  Description of Artificial Sequence: Synthetic peptide
  Seed: ASALPTTISF (MAGA4_HUMAN)
AYALPTTISF

SEQ ID NO: 62061 - protein, 9 aa, Artificial Sequence
  Description of Artificial Sequence: Synthetic peptide
  Seed: RVNARVRIA (MAGA4_HUMAN)
RVNARVRIL

SEQ ID NO: 62062 - protein, 9 aa, Artificial Sequence
  Description of Artificial Sequence: Synthetic peptide
  Seed: KYRAKELVT (MAGA4_HUMAN)
KVRAKELVV

SEQ ID NO: 62063 - protein, 9 aa, Artificial Sequence
  Description of Artificial Sequence: Synthetic peptide
  Seed: WEELGVMGV (MAGA4_HUMAN)
WEELGVMGI

SEQ ID NO: 62064 - protein, 9 aa, Artificial Sequence
  Description of Artificial Sequence: Synthetic peptide
  Seed: LVPGTLEEV (MAGA4_HUMAN)
LAPGTLEEI

SEQ ID NO: 62065 - protein, 9 aa, Artificial Sequence
  Description of Artificial Sequence: Synthetic peptide
  Seed: SSSPLVPGT (MAGA4_HUMAN)
SMSPLVPGT

SEQ ID NO: 62066 - protein, 9 aa, Artificial Sequence
  Description of Artificial Sequence: Synthetic peptide
  Seed: KVLEHVVRV (MAGA4_HUMAN)
KLLEHVVRM

SEQ ID NO: 62067 - protein, 9 aa, Artificial Sequence
  Description of Artificial Sequence: Synthetic peptide
  Seed: AQEEALGLV (MAGA4_HUMAN)
AMEEALGLL

SEQ ID NO: 62068 - protein, 9 aa, Artificial Sequence
  Description of Artificial Sequence: Synthetic peptide
  Seed: DPASNTYTL (MAGA4_HUMAN)
DGASNTYTY

SEQ ID NO: 62069 - protein, 10 aa, Artificial Sequence
  Description of Artificial Sequence: Synthetic peptide
  Seed: TTISFTCWRQ (MAGA4_HUMAN)
TVISFTCWRC

SEQ ID NO: 62070 - protein, 10 aa, Artificial Sequence
  Description of Artificial Sequence: Synthetic peptide
  Seed: YPSLREAALL (MAGA4_HUMAN)
YQSLREAALY

SEQ ID NO: 62071 - protein, 9 aa, Artificial Sequence
  Description of Artificial Sequence: Synthetic peptide
  Seed: SAGPPQSPQ (MAGA4_HUMAN)
SAGPPQSPY

SEQ ID NO: 62072 - protein, 9 aa, Artificial Sequence
  Description of Artificial Sequence: Synthetic peptide
  Seed: NTYTLVTCL (MAGA4_HUMAN)
NQYTLVTCY

SEQ ID NO: 62073 - protein, 10 aa, Artificial Sequence
  Description of Artificial Sequence: Synthetic peptide
  Seed: YRQVPGSNPA (MAGA4_HUMAN)
YKQVPGSNPF

SEQ ID NO: 62074 - protein, 10 aa, Artificial Sequence
  Description of Artificial Sequence: Synthetic peptide
  Seed: KEVDPASNTY (MAGA4_HUMAN)
KRVDPASNTY

SEQ ID NO: 62075 - protein, 11 aa, Artificial Sequence
  Description of Artificial Sequence: Synthetic peptide
  Seed: GVYDGREHTVY (MAGA4_HUMAN)
GKYDGREHTVF

SEQ ID NO: 62076 - protein, 9 aa, Artificial Sequence
  Description of Artificial Sequence: Synthetic peptide
  Seed: IIVLGTIAM (MAGA4_HUMAN)
ISVLGTIAM

SEQ ID NO: 62077 - protein, 10 aa, Artificial Sequence
  Description of Artificial Sequence: Synthetic peptide
  Seed: RVRIAYPSLR (MAGA4_HUMAN)
RLRIAYPSLM

SEQ ID NO: 62078 - protein, 9 aa, Artificial Sequence
  Description of Artificial Sequence: Synthetic peptide
  Seed: NPARYEFLW (MAGA4_HUMAN)
NSARYEFLF

SEQ ID NO: 62079 - protein, 9 aa, Artificial Sequence
  Description of Artificial Sequence: Synthetic peptide
  Seed: RCFPVIFGK (MAGA4_HUMAN)
RVFPVIFGL

SEQ ID NO: 62080 - protein, 9 aa, Artificial Sequence
  Description of Artificial Sequence: Synthetic peptide
  Seed: IFPKTGLLI (MAGA4_HUMAN)
IMPKTGLLL

SEQ ID NO: 62081 - protein, 9 aa, Artificial Sequence
  Description of Artificial Sequence: Synthetic peptide
  Seed: KVDELAHFL (MAGA4_HUMAN)
KQDELAHFM

SEQ ID NO: 62082 - protein, 9 aa, Artificial Sequence
  Description of Artificial Sequence: Synthetic peptide
  Seed: MSSEQKSQH (MAGA4_HUMAN)
MSSEQKSQY

SEQ ID NO: 62083 - protein, 10 aa, Artificial Sequence
  Description of Artificial Sequence: Synthetic peptide
  Seed: ARVRIAYPSL (MAGA4_HUMAN)
AFVRIAYPSK

SEQ ID NO: 62084 - protein, 9 aa, Artificial Sequence
  Description of Artificial Sequence: Synthetic peptide
  Seed: AESLFREAL (MAGA4_HUMAN)
ADSLFREAF

SEQ ID NO: 62085 - protein, 10 aa, Artificial Sequence
  Description of Artificial Sequence: Synthetic peptide
  Seed: LAHFLLRKYR (MAGA4_HUMAN)
LYHFLLRKYR

SEQ ID NO: 62086 - protein, 9 aa, Artificial Sequence
  Description of Artificial Sequence: Synthetic peptide
  Seed: IFGIDVKEV (MAGA4_HUMAN)
IYGIDVKEY

SEQ ID NO: 62087 - protein, 9 aa, Artificial Sequence
  Description of Artificial Sequence: Synthetic peptide
  Seed: TSPDAESLF (MAGA4_HUMAN)
TYPDAESLF

SEQ ID NO: 62088 - protein, 11 aa, Artificial Sequence
  Description of Artificial Sequence: Synthetic peptide
  Seed: YVKVLEHVVRV (MAGA4_HUMAN)
YLKVLEHVVRA

SEQ ID NO: 62089 - protein, 9 aa, Artificial Sequence
  Description of Artificial Sequence: Synthetic peptide
  Seed: AYPSLREAA (MAGA4_HUMAN)
AYPSLREAL

SEQ ID NO: 62090 - protein, 10 aa, Artificial Sequence
  Description of Artificial Sequence: Synthetic peptide
  Seed: SPQGASALPT (MAGA4_HUMAN)
SPQGASALPM

SEQ ID NO: 62091 - protein, 9 aa, Artificial Sequence
  Description of Artificial Sequence: Synthetic peptide
  Seed: SEQKSQHCK (MAGA4_HUMAN)
SEQKSQHCY

SEQ ID NO: 62092 - protein, 9 aa, Artificial Sequence
  Description of Artificial Sequence: Synthetic peptide
  Seed: RQVPGSNPA (MAGA4_HUMAN)
RVVPGSNPI

SEQ ID NO: 62093 - protein, 9 aa, Artificial Sequence
  Description of Artificial Sequence: Synthetic peptide
  Seed: RAKELVTKA (MAGA4_HUMAN)
RMKELVTKM

SEQ ID NO: 62094 - protein, 11 aa, Artificial Sequence
  Description of Artificial Sequence: Synthetic peptide
  Seed: RVNARVRIAYP (MAGA4_HUMAN)
RLNARVRIAYK

SEQ ID NO: 62095 - protein, 9 aa, Artificial Sequence
  Description of Artificial Sequence: Synthetic peptide
  Seed: EIWEELGVM (MAGA4_HUMAN)
EVWEELGVR

SEQ ID NO: 62096 - protein, 11 aa, Artificial Sequence
  Description of Artificial Sequence: Synthetic peptide
  Seed: RVNARVRIAYP (MAGA4_HUMAN)
RWNARVRIAYK

SEQ ID NO: 62097 - protein, 9 aa, Artificial Sequence
  Description of Artificial Sequence: Synthetic peptide
  Seed: RQVPGSNPA (MAGA4_HUMAN)
RQVPGSNPI

SEQ ID NO: 62098 - protein, 10 aa, Artificial Sequence
  Description of Artificial Sequence: Synthetic peptide
  Seed: RVRIAYPSLR (MAGA4_HUMAN)
RIRIAYPSLS

SEQ ID NO: 62099 - protein, 10 aa, Artificial Sequence
  Description of Artificial Sequence: Synthetic peptide
  Seed: EAAVSSSSPL (MAGA4_HUMAN)
ETAVSSSSPK

SEQ ID NO: 62100 - protein, 9 aa, Artificial Sequence
  Description of Artificial Sequence: Synthetic peptide
  Seed: SSSPLVPGT (MAGA4_HUMAN)
SVSPLVPGA

SEQ ID NO: 62101 - protein, 10 aa, Artificial Sequence
  Description of Artificial Sequence: Synthetic peptide
  Seed: KELVTKAEML (MAGA4_HUMAN)
KELVTKAEMA

SEQ ID NO: 62102 - protein, 9 aa, Artificial Sequence
  Description of Artificial Sequence: Synthetic peptide
  Seed: GTLEEVPAA (MAGA4_HUMAN)
GVLEEVPAL

SEQ ID NO: 62103 - protein, 9 aa, Artificial Sequence
  Description of Artificial Sequence: Synthetic peptide
  Seed: EVDPASNTY (MAGA4_HUMAN)
EHDPASNTY

SEQ ID NO: 62104 - protein, 9 aa, Artificial Sequence
  Description of Artificial Sequence: Synthetic peptide
  Seed: GASALPTTI (MAGA4_HUMAN)
GSSALPTTF

SEQ ID NO: 62105 - protein, 9 aa, Artificial Sequence
  Description of Artificial Sequence: Synthetic peptide
  Seed: RAKELVTKA (MAGA4_HUMAN)
RNKELVTKK

SEQ ID NO: 62106 - protein, 9 aa, Artificial Sequence
  Description of Artificial Sequence: Synthetic peptide
  Seed: KVDELAHFL (MAGA4_HUMAN)
KLDELAHFV

SEQ ID NO: 62107 - protein, 9 aa, Artificial Sequence
  Description of Artificial Sequence: Synthetic peptide
  Seed: NTYTLVTCL (MAGA4_HUMAN)
NLYTLVTCY

SEQ ID NO: 62108 - protein, 9 aa, Artificial Sequence
  Description of Artificial Sequence: Synthetic peptide
  Seed: KVDELAHFL (MAGA4_HUMAN)
KLDELAHFY

SEQ ID NO: 62109 - protein, 9 aa, Artificial Sequence
  Description of Artificial Sequence: Synthetic peptide
  Seed: DELAHFLLR (MAGA4_HUMAN)
DMLAHFLLR

SEQ ID NO: 62110 - protein, 10 aa, Artificial Sequence
  Description of Artificial Sequence: Synthetic peptide
  Seed: MLERVIKNYK (MAGA4_HUMAN)
MWERVIKNYR

SEQ ID NO: 62111 - protein, 11 aa, Artificial Sequence
  Description of Artificial Sequence: Synthetic peptide
  Seed: RQVPGSNPARY (MAGA4_HUMAN)
RAVPGSNPARK

SEQ ID NO: 62112 - protein, 11 aa, Artificial Sequence
  Description of Artificial Sequence: Synthetic peptide
  Seed: RQVPGSNPARY (MAGA4_HUMAN)
RVVPGSNPARY

SEQ ID NO: 62113 - protein, 11 aa, Artificial Sequence
  Description of Artificial Sequence: Synthetic peptide
  Seed: GLLGNNQIFPK (MAGA4_HUMAN)
GMLGNNQIFPR

SEQ ID NO: 62114 - protein, 9 aa, Artificial Sequence
  Description of Artificial Sequence: Synthetic peptide
  Seed: LRKYRAKEL (MAGA4_HUMAN)
LLKYRAKEI

SEQ ID NO: 62115 - protein, 9 aa, Artificial Sequence
  Description of Artificial Sequence: Synthetic peptide
  Seed: IIVLGTIAM (MAGA4_HUMAN)
IKVLGTIAI

SEQ ID NO: 62116 - protein, 9 aa, Artificial Sequence
  Description of Artificial Sequence: Synthetic peptide
  Seed: ESLKMIFGI (MAGA4_HUMAN)
EVLKMIFGI

SEQ ID NO: 62117 - protein, 10 aa, Artificial Sequence
  Description of Artificial Sequence: Synthetic peptide
  Seed: IAYPSLREAA (MAGA4_HUMAN)
IPYPSLREAT

SEQ ID NO: 62118 - protein, 9 aa, Artificial Sequence
  Description of Artificial Sequence: Synthetic peptide
  Seed: WVQENYLEY (MAGA4_HUMAN)
WHQENYLEF

SEQ ID NO: 62119 - protein, 11 aa, Artificial Sequence
  Description of Artificial Sequence: Synthetic peptide
  Seed: GVYDGREHTVY (MAGA4_HUMAN)
GSYDGREHTVY

SEQ ID NO: 62120 - protein, 9 aa, Artificial Sequence
  Description of Artificial Sequence: Synthetic peptide
  Seed: TTEEQEAAV (MAGA4_HUMAN)
TVEEQEAAM

SEQ ID NO: 62121 - protein, 10 aa, Artificial Sequence
  Description of Artificial Sequence: Synthetic peptide
  Seed: ARVRIAYPSL (MAGA4_HUMAN)
AGVRIAYPSA

SEQ ID NO: 62122 - protein, 9 aa, Artificial Sequence
  Description of Artificial Sequence: Synthetic peptide
  Seed: EVDPASNTY (MAGA4_HUMAN)
ESDPASNTY

SEQ ID NO: 62123 - protein, 9 aa, Artificial Sequence
  Description of Artificial Sequence: Synthetic peptide
  Seed: SSPLVPGTL (MAGA4_HUMAN)
SLPLVPGTY

SEQ ID NO: 62124 - protein, 9 aa, Artificial Sequence
  Description of Artificial Sequence: Synthetic peptide
  Seed: IIVLGTIAM (MAGA4_HUMAN)
IQVLGTIAV

SEQ ID NO: 62125 - protein, 10 aa, Artificial Sequence
  Description of Artificial Sequence: Synthetic peptide
  Seed: YPSLREAALL (MAGA4_HUMAN)
YPSLREAALW

SEQ ID NO: 62126 - protein, 9 aa, Artificial Sequence
  Description of Artificial Sequence: Synthetic peptide
  Seed: SALPTTISF (MAGA4_HUMAN)
SCLPTTISY

SEQ ID NO: 62127 - protein, 10 aa, Artificial Sequence
  Description of Artificial Sequence: Synthetic peptide
  Seed: RVRIAYPSLR (MAGA4_HUMAN)
RIRIAYPSLY

SEQ ID NO: 62128 - protein, 10 aa, Artificial Sequence
  Description of Artificial Sequence: Synthetic peptide
  Seed: IFPKTGLLII (MAGA4_HUMAN)
IYPKTGLLIL

SEQ ID NO: 62129 - protein, 9 aa, Artificial Sequence
  Description of Artificial Sequence: Synthetic peptide
  Seed: GDSASEEEI (MAGA4_HUMAN)
GESASEEEA

SEQ ID NO: 62130 - protein, 9 aa, Artificial Sequence
  Description of Artificial Sequence: Synthetic peptide
  Seed: SYVKVLEHV (MAGA4_HUMAN)
SQVKVLEHV

SEQ ID NO: 62131 - protein, 10 aa, Artificial Sequence
  Description of Artificial Sequence: Synthetic peptide
  Seed: TTISFTCWRQ (MAGA4_HUMAN)
TVISFTCWRP

SEQ ID NO: 62132 - protein, 10 aa, Artificial Sequence
  Description of Artificial Sequence: Synthetic peptide
  Seed: LGVMGVYDGR (MAGA4_HUMAN)
LDVMGVYDGR

SEQ ID NO: 62133 - protein, 9 aa, Artificial Sequence
  Description of Artificial Sequence: Synthetic peptide
  Seed: KVDELAHFL (MAGA4_HUMAN)
KADELAHFV

SEQ ID NO: 62134 - protein, 10 aa, Artificial Sequence
  Description of Artificial Sequence: Synthetic peptide
  Seed: RVRIAYPSLR (MAGA4_HUMAN)
RMRIAYPSLF

SEQ ID NO: 62135 - protein, 10 aa, Artificial Sequence
  Description of Artificial Sequence: Synthetic peptide
  Seed: ASALPTTISF (MAGA4_HUMAN)
AFALPTTISY

SEQ ID NO: 62136 - protein, 10 aa, Artificial Sequence
  Description of Artificial Sequence: Synthetic peptide
  Seed: KVLEHVVRVN (MAGA4_HUMAN)
KMLEHVVRVW

SEQ ID NO: 62137 - protein, 10 aa, Artificial Sequence
  Description of Artificial Sequence: Synthetic peptide
  Seed: ARVRIAYPSL (MAGA4_HUMAN)
ARVRIAYPSF

SEQ ID NO: 62138 - protein, 10 aa, Artificial Sequence
  Description of Artificial Sequence: Synthetic peptide
  Seed: RVNARVRIAY (MAGA4_HUMAN)
RTNARVRIAV

SEQ ID NO: 62139 - protein, 10 aa, Artificial Sequence
  Description of Artificial Sequence: Synthetic peptide
  Seed: KVLEHVVRVN (MAGA4_HUMAN)
KLLEHVVRVL

SEQ ID NO: 62140 - protein, 9 aa, Artificial Sequence
  Description of Artificial Sequence: Synthetic peptide
  Seed: KAEMLERVI (MAGA4_HUMAN)
KSEMLERVW

SEQ ID NO: 62141 - protein, 11 aa, Artificial Sequence
  Description of Artificial Sequence: Synthetic peptide
  Seed: REAALLEEEEG (MAGA4_HUMAN)
REAALLEEEEL

SEQ ID NO: 62142 - protein, 10 aa, Artificial Sequence
  Description of Artificial Sequence: Synthetic peptide
  Seed: TSYVKVLEHV (MAGA4_HUMAN)
TMYVKVLEHL

SEQ ID NO: 62143 - protein, 9 aa, Artificial Sequence
  Description of Artificial Sequence: Synthetic peptide
  Seed: ALPTTISFT (MAGA4_HUMAN)
AQPTTISFV

SEQ ID NO: 62144 - protein, 10 aa, Artificial Sequence
  Description of Artificial Sequence: Synthetic peptide
  Seed: KEVDPASNTY (MAGA4_HUMAN)
KGVDPASNTF

SEQ ID NO: 62145 - protein, 9 aa, Artificial Sequence
  Description of Artificial Sequence: Synthetic peptide
  Seed: RVRIAYPSL (MAGA4_HUMAN)
RNRIAYPSI

SEQ ID NO: 62146 - protein, 10 aa, Artificial Sequence
  Description of Artificial Sequence: Synthetic peptide
  Seed: TTISFTCWRQ (MAGA4_HUMAN)
TVISFTCWRT

SEQ ID NO: 62147 - protein, 9 aa, Artificial Sequence
  Description of Artificial Sequence: Synthetic peptide
  Seed: KNYKRCFPV (MAGA4_HUMAN)
KMYKRCFPV

SEQ ID NO: 62148 - protein, 10 aa, Artificial Sequence
  Description of Artificial Sequence: Synthetic peptide
  Seed: QEEALGLVGA (MAGA4_HUMAN)
QEEALGLVGL

SEQ ID NO: 62149 - protein, 9 aa, Artificial Sequence
  Description of Artificial Sequence: Synthetic peptide
  Seed: KVDELAHFL (MAGA4_HUMAN)
KIDELAHFR

SEQ ID NO: 62150 - protein, 10 aa, Artificial Sequence
  Description of Artificial Sequence: Synthetic peptide
  Seed: RIAYPSLREA (MAGA4_HUMAN)
RYAYPSLREK

SEQ ID NO: 62151 - protein, 9 aa, Artificial Sequence
  Description of Artificial Sequence: Synthetic peptide
  Seed: SSSPLVPGT (MAGA4_HUMAN)
SVSPLVPGI

SEQ ID NO: 62152 - protein, 10 aa, Artificial Sequence
  Description of Artificial Sequence: Synthetic peptide
  Seed: VYDGREHTVY (MAGA4_HUMAN)
VFDGREHTVF

SEQ ID NO: 62153 - protein, 9 aa, Artificial Sequence
  Description of Artificial Sequence: Synthetic peptide
  Seed: IAYPSLREA (MAGA4_HUMAN)
IVYPSLREM

SEQ ID NO: 62154 - protein, 10 aa, Artificial Sequence
  Description of Artificial Sequence: Synthetic peptide
  Seed: KNYKRCFPVI (MAGA4_HUMAN)
KVYKRCFPVI

SEQ ID NO: 62155 - protein, 9 aa, Artificial Sequence
  Description of Artificial Sequence: Synthetic peptide
  Seed: YKRCFPVIF (MAGA4_HUMAN)
YSRCFPVIM

SEQ ID NO: 62156 - protein, 9 aa, Artificial Sequence
  Description of Artificial Sequence: Synthetic peptide
  Seed: AESLFREAL (MAGA4_HUMAN)
AMSLFREAY

SEQ ID NO: 62157 - protein, 9 aa, Artificial Sequence
  Description of Artificial Sequence: Synthetic peptide
  Seed: GVMGVYDGR (MAGA4_HUMAN)
GTMGVYDGK

SEQ ID NO: 62158 - protein, 9 aa, Artificial Sequence
  Description of Artificial Sequence: Synthetic peptide
  Seed: SSSPLVPGT (MAGA4_HUMAN)
SLSPLVPGA

SEQ ID NO: 62159 - protein, 9 aa, Artificial Sequence
  Description of Artificial Sequence: Synthetic peptide
  Seed: WVQENYLEY (MAGA4_HUMAN)
WRQENYLEL

SEQ ID NO: 62160 - protein, 11 aa, Artificial Sequence
  Description of Artificial Sequence: Synthetic peptide
  Seed: YVKVLEHVVRV (MAGA4_HUMAN)
YIKVLEHVVRV

SEQ ID NO: 62161 - protein, 10 aa, Artificial Sequence
  Description of Artificial Sequence: Synthetic peptide
  Seed: VIFGKASESL (MAGA4_HUMAN)
VAFGKASESF

SEQ ID NO: 62162 - protein, 9 aa, Artificial Sequence
  Description of Artificial Sequence: Synthetic peptide
  Seed: RVNARVRIA (MAGA4_HUMAN)
RTNARVRIK

SEQ ID NO: 62163 - protein, 9 aa, Artificial Sequence
  Description of Artificial Sequence: Synthetic peptide
  Seed: YKRCFPVIF (MAGA4_HUMAN)
YQRCFPVIM

SEQ ID NO: 62164 - protein, 9 aa, Artificial Sequence
  Description of Artificial Sequence: Synthetic peptide
  Seed: GASALPTTI (MAGA4_HUMAN)
GMSALPTTM

SEQ ID NO: 62165 - protein, 9 aa, Artificial Sequence
  Description of Artificial Sequence: Synthetic peptide
  Seed: GSNPARYEF (MAGA4_HUMAN)
GKNPARYEY

SEQ ID NO: 62166 - protein, 9 aa, Artificial Sequence
  Description of Artificial Sequence: Synthetic peptide
  Seed: AESLFREAL (MAGA4_HUMAN)
AKSLFREAF

SEQ ID NO: 62167 - protein, 10 aa, Artificial Sequence
  Description of Artificial Sequence: Synthetic peptide
  Seed: TTISFTCWRQ (MAGA4_HUMAN)
TRISFTCWRR

SEQ ID NO: 62168 - protein, 9 aa, Artificial Sequence
  Description of Artificial Sequence: Synthetic peptide
  Seed: REAALLEEE (MAGA4_HUMAN)
RDAALLEEL

SEQ ID NO: 62169 - protein, 10 aa, Artificial Sequence
  Description of Artificial Sequence: Synthetic peptide
  Seed: SSSPLVPGTL (MAGA4_HUMAN)
SASPLVPGTW

SEQ ID NO: 62170 - protein, 9 aa, Artificial Sequence
  Description of Artificial Sequence: Synthetic peptide
  Seed: SEEEIWEEL (MAGA4_HUMAN)
SQEEIWEEV

SEQ ID NO: 62171 - protein, 9 aa, Artificial Sequence
  Description of Artificial Sequence: Synthetic peptide
  Seed: YTLVTCLGL (MAGA4_HUMAN)
YTLVTCLGM

SEQ ID NO: 62172 - protein, 10 aa, Artificial Sequence
  Description of Artificial Sequence: Synthetic peptide
  Seed: IFPKTGLLII (MAGA4_HUMAN)
IFPKTGLLIW

SEQ ID NO: 62173 - protein, 10 aa, Artificial Sequence
  Description of Artificial Sequence: Synthetic peptide
  Seed: VDPASNTYTL (MAGA4_HUMAN)
VAPASNTYTY

SEQ ID NO: 62174 - protein, 9 aa, Artificial Sequence
  Description of Artificial Sequence: Synthetic peptide
  Seed: SPQGASALP (MAGA4_HUMAN)
SPQGASALL

SEQ ID NO: 62175 - protein, 9 aa, Artificial Sequence
  Description of Artificial Sequence: Synthetic peptide
  Seed: VYDGREHTV (MAGA4_HUMAN)
VADGREHTM

SEQ ID NO: 62176 - protein, 9 aa, Artificial Sequence
  Description of Artificial Sequence: Synthetic peptide
  Seed: EIWEELGVM (MAGA4_HUMAN)
EVWEELGVF

SEQ ID NO: 62177 - protein, 9 aa, Artificial Sequence
  Description of Artificial Sequence: Synthetic peptide
  Seed: IIVLGTIAM (MAGA4_HUMAN)
ITVLGTIAF

SEQ ID NO: 62178 - protein, 11 aa, Artificial Sequence
  Description of Artificial Sequence: Synthetic peptide
  Seed: KVDELAHFLLR (MAGA4_HUMAN)
KMDELAHFLLY

SEQ ID NO: 62179 - protein, 9 aa, Artificial Sequence
  Description of Artificial Sequence: Synthetic peptide
  Seed: AAVSSSSPL (MAGA4_HUMAN)
AMVSSSSPY

SEQ ID NO: 62180 - protein, 10 aa, Artificial Sequence
  Description of Artificial Sequence: Synthetic peptide
  Seed: SSSPLVPGTL (MAGA4_HUMAN)
SSSPLVPGTY

SEQ ID NO: 62181 - protein, 9 aa, Artificial Sequence
  Description of Artificial Sequence: Synthetic peptide
  Seed: KYRAKELVT (MAGA4_HUMAN)
KVRAKELVY

SEQ ID NO: 62182 - protein, 10 aa, Artificial Sequence
  Description of Artificial Sequence: Synthetic peptide
  Seed: RVRIAYPSLR (MAGA4_HUMAN)
RGRIAYPSLK

SEQ ID NO: 62183 - protein, 9 aa, Artificial Sequence
  Description of Artificial Sequence: Synthetic peptide
  Seed: SSPLVPGTL (MAGA4_HUMAN)
SFPLVPGTL

SEQ ID NO: 62184 - protein, 9 aa, Artificial Sequence
  Description of Artificial Sequence: Synthetic peptide
  Seed: LFREALSNK (MAGA4_HUMAN)
LVREALSNR

SEQ ID NO: 62185 - protein, 9 aa, Artificial Sequence
  Description of Artificial Sequence: Synthetic peptide
  Seed: RKYRAKELV (MAGA4_HUMAN)
REYRAKELF

SEQ ID NO: 62186 - protein, 10 aa, Artificial Sequence
  Description of Artificial Sequence: Synthetic peptide
  Seed: ASALPTTISF (MAGA4_HUMAN)
AEALPTTISW

SEQ ID NO: 62187 - protein, 9 aa, Artificial Sequence
  Description of Artificial Sequence: Synthetic peptide
  Seed: IIVLGTIAM (MAGA4_HUMAN)
ILVLGTIAI

SEQ ID NO: 62188 - protein, 9 aa, Artificial Sequence
  Description of Artificial Sequence: Synthetic peptide
  Seed: RVRIAYPSL (MAGA4_HUMAN)
RYRIAYPSG

SEQ ID NO: 62189 - protein, 10 aa, Artificial Sequence
  Description of Artificial Sequence: Synthetic peptide
  Seed: SESLKMIFGI (MAGA4_HUMAN)
SESLKMIFGL

SEQ ID NO: 62190 - protein, 9 aa, Artificial Sequence
  Description of Artificial Sequence: Synthetic peptide
  Seed: AAVSSSSPL (MAGA4_HUMAN)
AFVSSSSPF

SEQ ID NO: 62191 - protein, 9 aa, Artificial Sequence
  Description of Artificial Sequence: Synthetic peptide
  Seed: TQDWVQENY (MAGA4_HUMAN)
TADWVQENI

SEQ ID NO: 62192 - protein, 9 aa, Artificial Sequence
  Description of Artificial Sequence: Synthetic peptide
  Seed: RCFPVIFGK (MAGA4_HUMAN)
RYFPVIFGH

SEQ ID NO: 62193 - protein, 11 aa, Artificial Sequence
  Description of Artificial Sequence: Synthetic peptide
  Seed: RQVPGSNPARY (MAGA4_HUMAN)
RVVPGSNPARW

SEQ ID NO: 62194 - protein, 10 aa, Artificial Sequence
  Description of Artificial Sequence: Synthetic peptide
  Seed: RVNARVRIAY (MAGA4_HUMAN)
RFNARVRIAK

SEQ ID NO: 62195 - protein, 10 aa, Artificial Sequence
  Description of Artificial Sequence: Synthetic peptide
  Seed: RVNARVRIAY (MAGA4_HUMAN)
RTNARVRIAF

SEQ ID NO: 62196 - protein, 10 aa, Artificial Sequence
  Description of Artificial Sequence: Synthetic peptide
  Seed: TSYVKVLEHV (MAGA4_HUMAN)
TIYVKVLEHL

SEQ ID NO: 62197 - protein, 9 aa, Artificial Sequence
  Description of Artificial Sequence: Synthetic peptide
  Seed: AAVSSSSPL (MAGA4_HUMAN)
AAVSSSSPW

SEQ ID NO: 62198 - protein, 9 aa, Artificial Sequence
  Description of Artificial Sequence: Synthetic peptide
  Seed: GSNPARYEF (MAGA4_HUMAN)
GRNPARYEF

SEQ ID NO: 62199 - protein, 9 aa, Artificial Sequence
  Description of Artificial Sequence: Synthetic peptide
  Seed: LGNNQIFPK (MAGA4_HUMAN)
LTNNQIFPY

SEQ ID NO: 62200 - protein, 10 aa, Artificial Sequence
  Description of Artificial Sequence: Synthetic peptide
  Seed: VDPASNTYTL (MAGA4_HUMAN)
VNPASNTYTY

SEQ ID NO: 62201 - protein, 10 aa, Artificial Sequence
  Description of Artificial Sequence: Synthetic peptide
  Seed: TTISFTCWRQ (MAGA4_HUMAN)
TVISFTCWRN

SEQ ID NO: 62202 - protein, 9 aa, Artificial Sequence
  Description of Artificial Sequence: Synthetic peptide
  Seed: SAGPPQSPQ (MAGA4_HUMAN)
SVGPPQSPM

SEQ ID NO: 62203 - protein, 9 aa, Artificial Sequence
  Description of Artificial Sequence: Synthetic peptide
  Seed: VYDGREHTV (MAGA4_HUMAN)
VSDGREHTY

SEQ ID NO: 62204 - protein, 9 aa, Artificial Sequence
  Description of Artificial Sequence: Synthetic peptide
  Seed: DPASNTYTL (MAGA4_HUMAN)
DPASNTYTF

SEQ ID NO: 62205 - protein, 10 aa, Artificial Sequence
  Description of Artificial Sequence: Synthetic peptide
  Seed: TTISFTCWRQ (MAGA4_HUMAN)
TCISFTCWRR

SEQ ID NO: 62206 - protein, 9 aa, Artificial Sequence
  Description of Artificial Sequence: Synthetic peptide
  Seed: VYDGREHTV (MAGA4_HUMAN)
VGDGREHTI

SEQ ID NO: 62207 - protein, 10 aa, Artificial Sequence
  Description of Artificial Sequence: Synthetic peptide
  Seed: QIFPKTGLLI (MAGA4_HUMAN)
QIFPKTGLLW

SEQ ID NO: 62208 - protein, 11 aa, Artificial Sequence
  Description of Artificial Sequence: Synthetic peptide
  Seed: RVNARVRIAYP (MAGA4_HUMAN)
RSNARVRIAYV

SEQ ID NO: 62209 - protein, 9 aa, Artificial Sequence
  Description of Artificial Sequence: Synthetic peptide
  Seed: IFPKTGLLI (MAGA4_HUMAN)
ILPKTGLLF

SEQ ID NO: 62210 - protein, 9 aa, Artificial Sequence
  Description of Artificial Sequence: Synthetic peptide
  Seed: SALPTTISF (MAGA4_HUMAN)
SRLPTTISM

SEQ ID NO: 62211 - protein, 9 aa, Artificial Sequence
  Description of Artificial Sequence: Synthetic peptide
  Seed: AESLFREAL (MAGA4_HUMAN)
AESLFREAT

SEQ ID NO: 62212 - protein, 10 aa, Artificial Sequence
  Description of Artificial Sequence: Synthetic peptide
  Seed: AESAGPPQSP (MAGA4_HUMAN)
AESAGPPQSL

SEQ ID NO: 62213 - protein, 9 aa, Artificial Sequence
  Description of Artificial Sequence: Synthetic peptide
  Seed: EHTVYGEPR (MAGA4_HUMAN)
EATVYGEPR

SEQ ID NO: 62214 - protein, 10 aa, Artificial Sequence
  Description of Artificial Sequence: Synthetic peptide
  Seed: AYPSLREAAL (MAGA4_HUMAN)
ASPSLREAAM

SEQ ID NO: 62215 - protein, 10 aa, Artificial Sequence
  Description of Artificial Sequence: Synthetic peptide
  Seed: EAAVSSSSPL (MAGA4_HUMAN)
ETAVSSSSPV

SEQ ID NO: 62216 - protein, 10 aa, Artificial Sequence
  Description of Artificial Sequence: Synthetic peptide
  Seed: SNKVDELAHF (MAGA4_HUMAN)
SQKVDELAHF

SEQ ID NO: 62217 - protein, 11 aa, Artificial Sequence
  Description of Artificial Sequence: Synthetic peptide
  Seed: YVKVLEHVVRV (MAGA4_HUMAN)
YQKVLEHVVRV

SEQ ID NO: 62218 - protein, 11 aa, Artificial Sequence
  Description of Artificial Sequence: Synthetic peptide
  Seed: RQVPGSNPARY (MAGA4_HUMAN)
RLVPGSNPARY

SEQ ID NO: 62219 - protein, 10 aa, Artificial Sequence
  Description of Artificial Sequence: Synthetic peptide
  Seed: SESLKMIFGI (MAGA4_HUMAN)
SESLKMIFGF

SEQ ID NO: 62220 - protein, 9 aa, Artificial Sequence
  Description of Artificial Sequence: Synthetic peptide
  Seed: RVRIAYPSL (MAGA4_HUMAN)
RIRIAYPSP

SEQ ID NO: 62221 - protein, 10 aa, Artificial Sequence
  Description of Artificial Sequence: Synthetic peptide
  Seed: LPTTISFTCW (MAGA4_HUMAN)
LLTTISFTCW

SEQ ID NO: 62222 - protein, 9 aa, Artificial Sequence
  Description of Artificial Sequence: Synthetic peptide
  Seed: KVDELAHFL (MAGA4_HUMAN)
KEDELAHFM

SEQ ID NO: 62223 - protein, 9 aa, Artificial Sequence
  Description of Artificial Sequence: Synthetic peptide
  Seed: SSPLVPGTL (MAGA4_HUMAN)
SIPLVPGTF

SEQ ID NO: 62224 - protein, 9 aa, Artificial Sequence
  Description of Artificial Sequence: Synthetic peptide
  Seed: RQVPGSNPA (MAGA4_HUMAN)
RLVPGSNPV

SEQ ID NO: 62225 - protein, 9 aa, Artificial Sequence
  Description of Artificial Sequence: Synthetic peptide
  Seed: KVDELAHFL (MAGA4_HUMAN)
KWDELAHFF

SEQ ID NO: 62226 - protein, 9 aa, Artificial Sequence
  Description of Artificial Sequence: Synthetic peptide
  Seed: QIFPKTGLL (MAGA4_HUMAN)
QTFPKTGLI

SEQ ID NO: 62227 - protein, 10 aa, Artificial Sequence
  Description of Artificial Sequence: Synthetic peptide
  Seed: PTTISFTCWR (MAGA4_HUMAN)
PFTISFTCWK

SEQ ID NO: 62228 - protein, 10 aa, Artificial Sequence
  Description of Artificial Sequence: Synthetic peptide
  Seed: YRQVPGSNPA (MAGA4_HUMAN)
YVQVPGSNPW

SEQ ID NO: 62229 - protein, 9 aa, Artificial Sequence
  Description of Artificial Sequence: Synthetic peptide
  Seed: NTYTLVTCL (MAGA4_HUMAN)
NAYTLVTCV

SEQ ID NO: 62230 - protein, 9 aa, Artificial Sequence
  Description of Artificial Sequence: Synthetic peptide
  Seed: GVMGVYDGR (MAGA4_HUMAN)
GVMGVYDGK

SEQ ID NO: 62231 - protein, 10 aa, Artificial Sequence
  Description of Artificial Sequence: Synthetic peptide
  Seed: ESAGPPQSPQ (MAGA4_HUMAN)
EMAGPPQSPR

SEQ ID NO: 62232 - protein, 9 aa, Artificial Sequence
  Description of Artificial Sequence: Synthetic peptide
  Seed: LVPGTLEEV (MAGA4_HUMAN)
LYPGTLEEV

SEQ ID NO: 62233 - protein, 9 aa, Artificial Sequence
  Description of Artificial Sequence: Synthetic peptide
  Seed: GASALPTTI (MAGA4_HUMAN)
GLSALPTTV

SEQ ID NO: 62234 - protein, 9 aa, Artificial Sequence
  Description of Artificial Sequence: Synthetic peptide
  Seed: SALPTTISF (MAGA4_HUMAN)
SWLPTTISF

SEQ ID NO: 62235 - protein, 10 aa, Artificial Sequence
  Description of Artificial Sequence: Synthetic peptide
  Seed: EEQEAAVSSS (MAGA4_HUMAN)
EEQEAAVSSA

SEQ ID NO: 62236 - protein, 9 aa, Artificial Sequence
  Description of Artificial Sequence: Synthetic peptide
  Seed: LVPGTLEEV (MAGA4_HUMAN)
LFPGTLEEL

SEQ ID NO: 62237 - protein, 9 aa, Artificial Sequence
  Description of Artificial Sequence: Synthetic peptide
  Seed: EIWEELGVM (MAGA4_HUMAN)
EVWEELGVM

SEQ ID NO: 62238 - protein, 10 aa, Artificial Sequence
  Description of Artificial Sequence: Synthetic peptide
  Seed: RQVPGSNPAR (MAGA4_HUMAN)
RVVPGSNPAR

SEQ ID NO: 62239 - protein, 9 aa, Artificial Sequence
  Description of Artificial Sequence: Synthetic peptide
  Seed: GSNPARYEF (MAGA4_HUMAN)
GINPARYEY

SEQ ID NO: 62240 - protein, 9 aa, Artificial Sequence
  Description of Artificial Sequence: Synthetic peptide
  Seed: IAYPSLREA (MAGA4_HUMAN)
ITYPSLREM

SEQ ID NO: 62241 - protein, 9 aa, Artificial Sequence
  Description of Artificial Sequence: Synthetic peptide
  Seed: RCFPVIFGK (MAGA4_HUMAN)
RGFPVIFGK

SEQ ID NO: 62242 - protein, 11 aa, Artificial Sequence
  Description of Artificial Sequence: Synthetic peptide
  Seed: GASALPTTISF (MAGA4_HUMAN)
GVSALPTTISW

SEQ ID NO: 62243 - protein, 9 aa, Artificial Sequence
  Description of Artificial Sequence: Synthetic peptide
  Seed: EVDPASNTY (MAGA4_HUMAN)
EGDPASNTL

SEQ ID NO: 62244 - protein, 9 aa, Artificial Sequence
  Description of Artificial Sequence: Synthetic peptide
  Seed: SEEEIWEEL (MAGA4_HUMAN)
SFEEIWEEM

SEQ ID NO: 62245 - protein, 11 aa, Artificial Sequence
  Description of Artificial Sequence: Synthetic peptide
  Seed: RQVPGSNPARY (MAGA4_HUMAN)
RSVPGSNPARF

SEQ ID NO: 62246 - protein, 10 aa, Artificial Sequence
  Description of Artificial Sequence: Synthetic peptide
  Seed: KVLEHVVRVN (MAGA4_HUMAN)
KMLEHVVRVM

SEQ ID NO: 62247 - protein, 9 aa, Artificial Sequence
  Description of Artificial Sequence: Synthetic peptide
  Seed: AESLFREAL (MAGA4_HUMAN)
AESLFREAI

SEQ ID NO: 62248 - protein, 9 aa, Artificial Sequence
  Description of Artificial Sequence: Synthetic peptide
  Seed: QIFPKTGLL (MAGA4_HUMAN)
QQFPKTGLL

SEQ ID NO: 62249 - protein, 9 aa, Artificial Sequence
  Description of Artificial Sequence: Synthetic peptide
  Seed: ESLKMIFGI (MAGA4_HUMAN)
EALKMIFGL

SEQ ID NO: 62250 - protein, 10 aa, Artificial Sequence
  Description of Artificial Sequence: Synthetic peptide
  Seed: ASALPTTISF (MAGA4_HUMAN)
AQALPTTISM

SEQ ID NO: 62251 - protein, 10 aa, Artificial Sequence
  Description of Artificial Sequence: Synthetic peptide
  Seed: MIFGIDVKEV (MAGA4_HUMAN)
MLFGIDVKEM

SEQ ID NO: 62252 - protein, 10 aa, Artificial Sequence
  Description of Artificial Sequence: Synthetic peptide
  Seed: KASESLKMIF (MAGA4_HUMAN)
KQSESLKMII

SEQ ID NO: 62253 - protein, 9 aa, Artificial Sequence
  Description of Artificial Sequence: Synthetic peptide
  Seed: GVYDGREHT (MAGA4_HUMAN)
GMYDGREHM

SEQ ID NO: 62254 - protein, 9 aa, Artificial Sequence
  Description of Artificial Sequence: Synthetic peptide
  Seed: ALPTTISFT (MAGA4_HUMAN)
ALPTTISFV

SEQ ID NO: 62255 - protein, 9 aa, Artificial Sequence
  Description of Artificial Sequence: Synthetic peptide
  Seed: LPTTISFTC (MAGA4_HUMAN)
LLTTISFTY

SEQ ID NO: 62256 - protein, 9 aa, Artificial Sequence
  Description of Artificial Sequence: Synthetic peptide
  Seed: RVRIAYPSL (MAGA4_HUMAN)
RGRIAYPSY

SEQ ID NO: 62257 - protein, 9 aa, Artificial Sequence
  Description of Artificial Sequence: Synthetic peptide
  Seed: KVDELAHFL (MAGA4_HUMAN)
KCDELAHFL

SEQ ID NO: 62258 - protein, 10 aa, Artificial Sequence
  Description of Artificial Sequence: Synthetic peptide
  Seed: TSYVKVLEHV (MAGA4_HUMAN)
TPYVKVLEHF

SEQ ID NO: 62259 - protein, 10 aa, Artificial Sequence
  Description of Artificial Sequence: Synthetic peptide
  Seed: YRQVPGSNPA (MAGA4_HUMAN)
YWQVPGSNPY

SEQ ID NO: 62260 - protein, 11 aa, Artificial Sequence
  Description of Artificial Sequence: Synthetic peptide
  Seed: RVRIAYPSLRE (MAGA4_HUMAN)
RVRIAYPSLRR

SEQ ID NO: 62261 - protein, 9 aa, Artificial Sequence
  Description of Artificial Sequence: Synthetic peptide
  Seed: KYRAKELVT (MAGA4_HUMAN)
KVRAKELVS

SEQ ID NO: 62262 - protein, 10 aa, Artificial Sequence
  Description of Artificial Sequence: Synthetic peptide
  Seed: LPTTISFTCW (MAGA4_HUMAN)
LATTISFTCW

SEQ ID NO: 62263 - protein, 9 aa, Artificial Sequence
  Description of Artificial Sequence: Synthetic peptide
  Seed: RVRIAYPSL (MAGA4_HUMAN)
RSRIAYPSG

SEQ ID NO: 62264 - protein, 9 aa, Artificial Sequence
  Description of Artificial Sequence: Synthetic peptide
  Seed: KVDELAHFL (MAGA4_HUMAN)
KRDELAHFY

SEQ ID NO: 62265 - protein, 10 aa, Artificial Sequence
  Description of Artificial Sequence: Synthetic peptide
  Seed: GLLIIVLGTI (MAGA4_HUMAN)
GQLIIVLGTV

SEQ ID NO: 62266 - protein, 9 aa, Artificial Sequence
  Description of Artificial Sequence: Synthetic peptide
  Seed: NKVDELAHF (MAGA4_HUMAN)
NYVDELAHY

SEQ ID NO: 62267 - protein, 10 aa, Artificial Sequence
  Description of Artificial Sequence: Synthetic peptide
  Seed: NKVDELAHFL (MAGA4_HUMAN)
NLVDELAHFL

SEQ ID NO: 62268 - protein, 10 aa, Artificial Sequence
  Description of Artificial Sequence: Synthetic peptide
  Seed: LLGNNQIFPK (MAGA4_HUMAN)
LFGNNQIFPR

SEQ ID NO: 62269 - protein, 9 aa, Artificial Sequence
  Description of Artificial Sequence: Synthetic peptide
  Seed: NQIFPKTGL (MAGA4_HUMAN)
NMIFPKTGF

SEQ ID NO: 62270 - protein, 10 aa, Artificial Sequence
  Description of Artificial Sequence: Synthetic peptide
  Seed: RVRIAYPSLR (MAGA4_HUMAN)
RARIAYPSLM

SEQ ID NO: 62271 - protein, 10 aa, Artificial Sequence
  Description of Artificial Sequence: Synthetic peptide
  Seed: KRCFPVIFGK (MAGA4_HUMAN)
KWCFPVIFGR

SEQ ID NO: 62272 - protein, 9 aa, Artificial Sequence
  Description of Artificial Sequence: Synthetic peptide
  Seed: VYDGREHTV (MAGA4_HUMAN)
VRDGREHTF

SEQ ID NO: 62273 - protein, 9 aa, Artificial Sequence
  Description of Artificial Sequence: Synthetic peptide
  Seed: SSSPLVPGT (MAGA4_HUMAN)
SLSPLVPGI

SEQ ID NO: 62274 - protein, 9 aa, Artificial Sequence
  Description of Artificial Sequence: Synthetic peptide
  Seed: TVYGEPRKL (MAGA4_HUMAN)
TTYGEPRKR

SEQ ID NO: 62275 - protein, 9 aa, Artificial Sequence
  Description of Artificial Sequence: Synthetic peptide
  Seed: SSSPLVPGT (MAGA4_HUMAN)
SQSPLVPGA

SEQ ID NO: 62276 - protein, 9 aa, Artificial Sequence
  Description of Artificial Sequence: Synthetic peptide
  Seed: VYDGREHTV (MAGA4_HUMAN)
VRDGREHTI

SEQ ID NO: 62277 - protein, 11 aa, Artificial Sequence
  Description of Artificial Sequence: Synthetic peptide
  Seed: IAYPSLREAAL (MAGA4_HUMAN)
ITYPSLREAAW

SEQ ID NO: 62278 - protein, 10 aa, Artificial Sequence
  Description of Artificial Sequence: Synthetic peptide
  Seed: WEELGVMGVY (MAGA4_HUMAN)
WQELGVMGVF

SEQ ID NO: 62279 - protein, 10 aa, Artificial Sequence
  Description of Artificial Sequence: Synthetic peptide
  Seed: RVRIAYPSLR (MAGA4_HUMAN)
RTRIAYPSLN

SEQ ID NO: 62280 - protein, 10 aa, Artificial Sequence
  Description of Artificial Sequence: Synthetic peptide
  Seed: RQVPGSNPAR (MAGA4_HUMAN)
RLVPGSNPAF

SEQ ID NO: 62281 - protein, 10 aa, Artificial Sequence
  Description of Artificial Sequence: Synthetic peptide
  Seed: EMLERVIKNY (MAGA4_HUMAN)
EVLERVIKNR

SEQ ID NO: 62282 - protein, 9 aa, Artificial Sequence
  Description of Artificial Sequence: Synthetic peptide
  Seed: SEQKSQHCK (MAGA4_HUMAN)
SEQKSQHCW

SEQ ID NO: 62283 - protein, 9 aa, Artificial Sequence
  Description of Artificial Sequence: Synthetic peptide
  Seed: KVDELAHFL (MAGA4_HUMAN)
KNDELAHFL

SEQ ID NO: 62284 - protein, 9 aa, Artificial Sequence
  Description of Artificial Sequence: Synthetic peptide
  Seed: TVYGEPRKL (MAGA4_HUMAN)
TFYGEPRKM

SEQ ID NO: 62285 - protein, 10 aa, Artificial Sequence
  Description of Artificial Sequence: Synthetic peptide
  Seed: EAAVSSSSPL (MAGA4_HUMAN)
ENAVSSSSPV

SEQ ID NO: 62286 - protein, 10 aa, Artificial Sequence
  Description of Artificial Sequence: Synthetic peptide
  Seed: ARVRIAYPSL (MAGA4_HUMAN)
ALVRIAYPSV

SEQ ID NO: 62287 - protein, 9 aa, Artificial Sequence
  Description of Artificial Sequence: Synthetic peptide
  Seed: AAVSSSSPL (MAGA4_HUMAN)
ATVSSSSPY

SEQ ID NO: 62288 - protein, 9 aa, Artificial Sequence
  Description of Artificial Sequence: Synthetic peptide
  Seed: AAVSSSSPL (MAGA4_HUMAN)
AIVSSSSPV

SEQ ID NO: 62289 - protein, 9 aa, Artificial Sequence
  Description of Artificial Sequence: Synthetic peptide
  Seed: TVYGEPRKL (MAGA4_HUMAN)
TAYGEPRKW

SEQ ID NO: 62290 - protein, 9 aa, Artificial Sequence
  Description of Artificial Sequence: Synthetic peptide
  Seed: AAVSSSSPL (MAGA4_HUMAN)
APVSSSSPC

SEQ ID NO: 62291 - protein, 10 aa, Artificial Sequence
  Description of Artificial Sequence: Synthetic peptide
  Seed: RVRIAYPSLR (MAGA4_HUMAN)
RIRIAYPSLT

SEQ ID NO: 62292 - protein, 9 aa, Artificial Sequence
  Description of Artificial Sequence: Synthetic peptide
  Seed: TVYGEPRKL (MAGA4_HUMAN)
TRYGEPRKI

SEQ ID NO: 62293 - protein, 10 aa, Artificial Sequence
  Description of Artificial Sequence: Synthetic peptide
  Seed: KNYKRCFPVI (MAGA4_HUMAN)
KCYKRCFPVF

SEQ ID NO: 62294 - protein, 9 aa, Artificial Sequence
  Description of Artificial Sequence: Synthetic peptide
  Seed: AYPSLREAA (MAGA4_HUMAN)
AWPSLREAY

SEQ ID NO: 62295 - protein, 10 aa, Artificial Sequence
  Description of Artificial Sequence: Synthetic peptide
  Seed: YPSLREAALL (MAGA4_HUMAN)
YESLREAALF

SEQ ID NO: 62296 - protein, 9 aa, Artificial Sequence
  Description of Artificial Sequence: Synthetic peptide
  Seed: NTYTLVTCL (MAGA4_HUMAN)
NSYTLVTCV

SEQ ID NO: 62297 - protein, 8 aa, Artificial Sequence
  Description of Artificial Sequence: Synthetic peptide
  Seed: AESLFREA (MAGA4_HUMAN)
AESLFREV

SEQ ID NO: 62298 - protein, 9 aa, Artificial Sequence
  Description of Artificial Sequence: Synthetic peptide
  Seed: SPLVPGTLE (MAGA4_HUMAN)
SPLVPGTLP

SEQ ID NO: 62299 - protein, 9 aa, Artificial Sequence
  Description of Artificial Sequence: Synthetic peptide
  Seed: KASESLKMI (MAGA4_HUMAN)
KLSESLKMV

SEQ ID NO: 62300 - protein, 10 aa, Artificial Sequence
  Description of Artificial Sequence: Synthetic peptide
  Seed: TTISFTCWRQ (MAGA4_HUMAN)
TVISFTCWRL

SEQ ID NO: 62301 - protein, 9 aa, Artificial Sequence
  Description of Artificial Sequence: Synthetic peptide
  Seed: EEQEAAVSS (MAGA4_HUMAN)
EQQEAAVSL

SEQ ID NO: 62302 - protein, 11 aa, Artificial Sequence
  Description of Artificial Sequence: Synthetic peptide
  Seed: EMLERVIKNYK (MAGA4_HUMAN)
ETLERVIKNYR

SEQ ID NO: 62303 - protein, 11 aa, Artificial Sequence
  Description of Artificial Sequence: Synthetic peptide
  Seed: VRVNARVRIAY (MAGA4_HUMAN)
VQVNARVRIAF

SEQ ID NO: 62304 - protein, 9 aa, Artificial Sequence
  Description of Artificial Sequence: Synthetic peptide
  Seed: TVYGEPRKL (MAGA4_HUMAN)
TSYGEPRKV

SEQ ID NO: 62305 - protein, 9 aa, Artificial Sequence
  Description of Artificial Sequence: Synthetic peptide
  Seed: LVPGTLEEV (MAGA4_HUMAN)
LYPGTLEEI

SEQ ID NO: 62306 - protein, 10 aa, Artificial Sequence
  Description of Artificial Sequence: Synthetic peptide
  Seed: ARVRIAYPSL (MAGA4_HUMAN)
AWVRIAYPSK

SEQ ID NO: 62307 - protein, 9 aa, Artificial Sequence
  Description of Artificial Sequence: Synthetic peptide
  Seed: RVRIAYPSL (MAGA4_HUMAN)
RVRIAYPSR

SEQ ID NO: 62308 - protein, 10 aa, Artificial Sequence
  Description of Artificial Sequence: Synthetic peptide
  Seed: KNYKRCFPVI (MAGA4_HUMAN)
KGYKRCFPVA

SEQ ID NO: 62309 - protein, 11 aa, Artificial Sequence
  Description of Artificial Sequence: Synthetic peptide
  Seed: RVRIAYPSLRE (MAGA4_HUMAN)
RMRIAYPSLRV

SEQ ID NO: 62310 - protein, 9 aa, Artificial Sequence
  Description of Artificial Sequence: Synthetic peptide
  Seed: SALPTTISF (MAGA4_HUMAN)
SDLPTTISF

SEQ ID NO: 62311 - protein, 9 aa, Artificial Sequence
  Description of Artificial Sequence: Synthetic peptide
  Seed: GVMGVYDGR (MAGA4_HUMAN)
GAMGVYDGR

SEQ ID NO: 62312 - protein, 9 aa, Artificial Sequence
  Description of Artificial Sequence: Synthetic peptide
  Seed: AAVSSSSPL (MAGA4_HUMAN)
AMVSSSSPM

SEQ ID NO: 62313 - protein, 10 aa, Artificial Sequence
  Description of Artificial Sequence: Synthetic peptide
  Seed: KEVDPASNTY (MAGA4_HUMAN)
KVVDPASNTM

SEQ ID NO: 62314 - protein, 9 aa, Artificial Sequence
  Description of Artificial Sequence: Synthetic peptide
  Seed: LGNNQIFPK (MAGA4_HUMAN)
LINNQIFPR

SEQ ID NO: 62315 - protein, 10 aa, Artificial Sequence
  Description of Artificial Sequence: Synthetic peptide
  Seed: RVNARVRIAY (MAGA4_HUMAN)
RLNARVRIAK

SEQ ID NO: 62316 - protein, 11 aa, Artificial Sequence
  Description of Artificial Sequence: Synthetic peptide
  Seed: RVNARVRIAYP (MAGA4_HUMAN)
RKNARVRIAYK

SEQ ID NO: 62317 - protein, 9 aa, Artificial Sequence
  Description of Artificial Sequence: Synthetic peptide
  Seed: ALSNKVDEL (MAGA4_HUMAN)
AISNKVDEL

SEQ ID NO: 62318 - protein, 10 aa, Artificial Sequence
  Description of Artificial Sequence: Synthetic peptide
  Seed: KEVDPASNTY (MAGA4_HUMAN)
KSVDPASNTW

SEQ ID NO: 62319 - protein, 9 aa, Artificial Sequence
  Description of Artificial Sequence: Synthetic peptide
  Seed: SSPLVPGTL (MAGA4_HUMAN)
SMPLVPGTY

SEQ ID NO: 62320 - protein, 9 aa, Artificial Sequence
  Description of Artificial Sequence: Synthetic peptide
  Seed: YVKVLEHVV (MAGA4_HUMAN)
YSKVLEHVF

SEQ ID NO: 62321 - protein, 9 aa, Artificial Sequence
  Description of Artificial Sequence: Synthetic peptide
  Seed: FGKASESLK (MAGA4_HUMAN)
FAKASESLF

SEQ ID NO: 62322 - protein, 9 aa, Artificial Sequence
  Description of Artificial Sequence: Synthetic peptide
  Seed: KNYKRCFPV (MAGA4_HUMAN)
KVYKRCFPM

SEQ ID NO: 62323 - protein, 9 aa, Artificial Sequence
  Description of Artificial Sequence: Synthetic peptide
  Seed: YPSLREAAL (MAGA4_HUMAN)
YASLREAAY

SEQ ID NO: 62324 - protein, 10 aa, Artificial Sequence
  Description of Artificial Sequence: Synthetic peptide
  Seed: SESLKMIFGI (MAGA4_HUMAN)
SDSLKMIFGW

SEQ ID NO: 62325 - protein, 9 aa, Artificial Sequence
  Description of Artificial Sequence: Synthetic peptide
  Seed: EVDPASNTY (MAGA4_HUMAN)
EIDPASNTY

SEQ ID NO: 62326 - protein, 9 aa, Artificial Sequence
  Description of Artificial Sequence: Synthetic peptide
  Seed: TQDWVQENY (MAGA4_HUMAN)
TSDWVQENL

SEQ ID NO: 62327 - protein, 9 aa, Artificial Sequence
  Description of Artificial Sequence: Synthetic peptide
  Seed: AAVSSSSPL (MAGA4_HUMAN)
AVVSSSSPF

SEQ ID NO: 62328 - protein, 9 aa, Artificial Sequence
  Description of Artificial Sequence: Synthetic peptide
  Seed: STSPDAESL (MAGA4_HUMAN)
STSPDAESF

SEQ ID NO: 62329 - protein, 9 aa, Artificial Sequence
  Description of Artificial Sequence: Synthetic peptide
  Seed: KVLEHVVRV (MAGA4_HUMAN)
KSLEHVVRV

SEQ ID NO: 62330 - protein, 10 aa, Artificial Sequence
  Description of Artificial Sequence: Synthetic peptide
  Seed: QIFPKTGLLI (MAGA4_HUMAN)
QYFPKTGLLI

SEQ ID NO: 62331 - protein, 9 aa, Artificial Sequence
  Description of Artificial Sequence: Synthetic peptide
  Seed: SEEEIWEEL (MAGA4_HUMAN)
STEEIWEEL

SEQ ID NO: 62332 - protein, 11 aa, Artificial Sequence
  Description of Artificial Sequence: Synthetic peptide
  Seed: RQVPGSNPARY (MAGA4_HUMAN)
RVVPGSNPARR

SEQ ID NO: 62333 - protein, 10 aa, Artificial Sequence
  Description of Artificial Sequence: Synthetic peptide
  Seed: ESAGPPQSPQ (MAGA4_HUMAN)
EMAGPPQSPK

SEQ ID NO: 62334 - protein, 9 aa, Artificial Sequence
  Description of Artificial Sequence: Synthetic peptide
  Seed: VYDGREHTV (MAGA4_HUMAN)
VQDGREHTV

SEQ ID NO: 62335 - protein, 11 aa, Artificial Sequence
  Description of Artificial Sequence: Synthetic peptide
  Seed: SYDGLLGNNQI (MAGA4_HUMAN)
SYDGLLGNNQF

SEQ ID NO: 62336 - protein, 9 aa, Artificial Sequence
  Description of Artificial Sequence: Synthetic peptide
  Seed: GASALPTTI (MAGA4_HUMAN)
GVSALPTTY

SEQ ID NO: 62337 - protein, 9 aa, Artificial Sequence
  Description of Artificial Sequence: Synthetic peptide
  Seed: AESLFREAL (MAGA4_HUMAN)
AHSLFREAL

SEQ ID NO: 62338 - protein, 9 aa, Artificial Sequence
  Description of Artificial Sequence: Synthetic peptide
  Seed: FPVIFGKAS (MAGA4_HUMAN)
FSVIFGKAY

SEQ ID NO: 62339 - protein, 10 aa, Artificial Sequence
  Description of Artificial Sequence: Synthetic peptide
  Seed: KVLEHVVRVN (MAGA4_HUMAN)
KLLEHVVRVM

SEQ ID NO: 62340 - protein, 9 aa, Artificial Sequence
  Description of Artificial Sequence: Synthetic peptide
  Seed: GASALPTTI (MAGA4_HUMAN)
GRSALPTTY

SEQ ID NO: 62341 - protein, 9 aa, Artificial Sequence
  Description of Artificial Sequence: Synthetic peptide
  Seed: SEEEIWEEL (MAGA4_HUMAN)
SHEEIWEEW

SEQ ID NO: 62342 - protein, 9 aa, Artificial Sequence
  Description of Artificial Sequence: Synthetic peptide
  Seed: GASALPTTI (MAGA4_HUMAN)
GPSALPTTA

SEQ ID NO: 62343 - protein, 9 aa, Artificial Sequence
  Description of Artificial Sequence: Synthetic peptide
  Seed: TVYGEPRKL (MAGA4_HUMAN)
TSYGEPRKY

SEQ ID NO: 62344 - protein, 10 aa, Artificial Sequence
  Description of Artificial Sequence: Synthetic peptide
  Seed: RQVPGSNPAR (MAGA4_HUMAN)
RVVPGSNPAK

SEQ ID NO: 62345 - protein, 10 aa, Artificial Sequence
  Description of Artificial Sequence: Synthetic peptide
  Seed: KEVDPASNTY (MAGA4_HUMAN)
KMVDPASNTF

SEQ ID NO: 62346 - protein, 9 aa, Artificial Sequence
  Description of Artificial Sequence: Synthetic peptide
  Seed: VNARVRIAY (MAGA4_HUMAN)
VKARVRIAY

SEQ ID NO: 62347 - protein, 9 aa, Artificial Sequence
  Description of Artificial Sequence: Synthetic peptide
  Seed: ERVIKNYKR (MAGA4_HUMAN)
EFVIKNYKK

SEQ ID NO: 62348 - protein, 9 aa, Artificial Sequence
  Description of Artificial Sequence: Synthetic peptide
  Seed: LPTTISFTC (MAGA4_HUMAN)
LPTTISFTL

SEQ ID NO: 62349 - protein, 9 aa, Artificial Sequence
  Description of Artificial Sequence: Synthetic peptide
  Seed: YKRCFPVIF (MAGA4_HUMAN)
YQRCFPVIW

SEQ ID NO: 62350 - protein, 10 aa, Artificial Sequence
  Description of Artificial Sequence: Synthetic peptide
  Seed: TTISFTCWRQ (MAGA4_HUMAN)
TLISFTCWRR

SEQ ID NO: 62351 - protein, 10 aa, Artificial Sequence
  Description of Artificial Sequence: Synthetic peptide
  Seed: ARVRIAYPSL (MAGA4_HUMAN)
AEVRIAYPSA

SEQ ID NO: 62352 - protein, 9 aa, Artificial Sequence
  Description of Artificial Sequence: Synthetic peptide
  Seed: KVDELAHFL (MAGA4_HUMAN)
KSDELAHFI

SEQ ID NO: 62353 - protein, 9 aa, Artificial Sequence
  Description of Artificial Sequence: Synthetic peptide
  Seed: SYVKVLEHV (MAGA4_HUMAN)
SIVKVLEHM

SEQ ID NO: 62354 - protein, 9 aa, Artificial Sequence
  Description of Artificial Sequence: Synthetic peptide
  Seed: YTLVTCLGL (MAGA4_HUMAN)
YSLVTCLGM

SEQ ID NO: 62355 - protein, 11 aa, Artificial Sequence
  Description of Artificial Sequence: Synthetic peptide
  Seed: GASALPTTISF (MAGA4_HUMAN)
GSSALPTTISW

SEQ ID NO: 62356 - protein, 9 aa, Artificial Sequence
  Description of Artificial Sequence: Synthetic peptide
  Seed: WVQENYLEY (MAGA4_HUMAN)
WWQENYLEF

SEQ ID NO: 62357 - protein, 10 aa, Artificial Sequence
  Description of Artificial Sequence: Synthetic peptide
  Seed: TLVTCLGLSY (MAGA4_HUMAN)
TKVTCLGLSF

SEQ ID NO: 62358 - protein, 10 aa, Artificial Sequence
  Description of Artificial Sequence: Synthetic peptide
  Seed: KVDELAHFLL (MAGA4_HUMAN)
KLDELAHFLG

SEQ ID NO: 62359 - protein, 9 aa, Artificial Sequence
  Description of Artificial Sequence: Synthetic peptide
  Seed: WVQENYLEY (MAGA4_HUMAN)
WPQENYLEM

SEQ ID NO: 62360 - protein, 10 aa, Artificial Sequence
  Description of Artificial Sequence: Synthetic peptide
  Seed: RVRIAYPSLR (MAGA4_HUMAN)
RSRIAYPSLG

SEQ ID NO: 62361 - protein, 10 aa, Artificial Sequence
  Description of Artificial Sequence: Synthetic peptide
  Seed: QEEEGPSTSP (MAGA4_HUMAN)
QEEEGPSTSI

SEQ ID NO: 62362 - protein, 10 aa, Artificial Sequence
  Description of Artificial Sequence: Synthetic peptide
  Seed: GVYDGREHTV (MAGA4_HUMAN)
GAYDGREHTF

SEQ ID NO: 62363 - protein, 10 aa, Artificial Sequence
  Description of Artificial Sequence: Synthetic peptide
  Seed: FGKASESLKM (MAGA4_HUMAN)
FIKASESLKF

SEQ ID NO: 62364 - protein, 9 aa, Artificial Sequence
  Description of Artificial Sequence: Synthetic peptide
  Seed: RVRIAYPSL (MAGA4_HUMAN)
RFRIAYPSF

SEQ ID NO: 62365 - protein, 10 aa, Artificial Sequence
  Description of Artificial Sequence: Synthetic peptide
  Seed: GVYDGREHTV (MAGA4_HUMAN)
GIYDGREHTM

SEQ ID NO: 62366 - protein, 9 aa, Artificial Sequence
  Description of Artificial Sequence: Synthetic peptide
  Seed: VVRVNARVR (MAGA4_HUMAN)
VFRVNARVK

SEQ ID NO: 62367 - protein, 9 aa, Artificial Sequence
  Description of Artificial Sequence: Synthetic peptide
  Seed: WVQENYLEY (MAGA4_HUMAN)
WWQENYLEY

SEQ ID NO: 62368 - protein, 9 aa, Artificial Sequence
  Description of Artificial Sequence: Synthetic peptide
  Seed: RCFPVIFGK (MAGA4_HUMAN)
RIFPVIFGF

SEQ ID NO: 62369 - protein, 10 aa, Artificial Sequence
  Description of Artificial Sequence: Synthetic peptide
  Seed: RVRIAYPSLR (MAGA4_HUMAN)
RYRIAYPSLS

SEQ ID NO: 62370 - protein, 10 aa, Artificial Sequence
  Description of Artificial Sequence: Synthetic peptide
  Seed: KRCFPVIFGK (MAGA4_HUMAN)
KRCFPVIFGY

SEQ ID NO: 62371 - protein, 9 aa, Artificial Sequence
  Description of Artificial Sequence: Synthetic peptide
  Seed: AAVSSSSPL (MAGA4_HUMAN)
ALVSSSSPY

SEQ ID NO: 62372 - protein, 11 aa, Artificial Sequence
  Description of Artificial Sequence: Synthetic peptide
  Seed: SPQGASALPTT (MAGA4_HUMAN)
SPQGASALPTL

SEQ ID NO: 62373 - protein, 10 aa, Artificial Sequence
  Description of Artificial Sequence: Synthetic peptide
  Seed: EAAVSSSSPL (MAGA4_HUMAN)
ESAVSSSSPI

SEQ ID NO: 62374 - protein, 9 aa, Artificial Sequence
  Description of Artificial Sequence: Synthetic peptide
  Seed: QDWVQENYL (MAGA4_HUMAN)
QEWVQENYL

SEQ ID NO: 62375 - protein, 9 aa, Artificial Sequence
  Description of Artificial Sequence: Synthetic peptide
  Seed: STSPDAESL (MAGA4_HUMAN)
SQSPDAESI

SEQ ID NO: 62376 - protein, 10 aa, Artificial Sequence
  Description of Artificial Sequence: Synthetic peptide
  Seed: YRQVPGSNPA (MAGA4_HUMAN)
YAQVPGSNPF

SEQ ID NO: 62377 - protein, 10 aa, Artificial Sequence
  Description of Artificial Sequence: Synthetic peptide
  Seed: KYRAKELVTK (MAGA4_HUMAN)
KIRAKELVTA

SEQ ID NO: 62378 - protein, 10 aa, Artificial Sequence
  Description of Artificial Sequence: Synthetic peptide
  Seed: STSPDAESLF (MAGA4_HUMAN)
SQSPDAESLW

SEQ ID NO: 62379 - protein, 10 aa, Artificial Sequence
  Description of Artificial Sequence: Synthetic peptide
  Seed: RVRIAYPSLR (MAGA4_HUMAN)
RLRIAYPSLR

SEQ ID NO: 62380 - protein, 9 aa, Artificial Sequence
  Description of Artificial Sequence: Synthetic peptide
  Seed: RQVPGSNPA (MAGA4_HUMAN)
RNVPGSNPM

SEQ ID NO: 62381 - protein, 9 aa, Artificial Sequence
  Description of Artificial Sequence: Synthetic peptide
  Seed: STSPDAESL (MAGA4_HUMAN)
SMSPDAESY

SEQ ID NO: 62382 - protein, 9 aa, Artificial Sequence
  Description of Artificial Sequence: Synthetic peptide
  Seed: KVDELAHFL (MAGA4_HUMAN)
KFDELAHFM

SEQ ID NO: 62383 - protein, 10 aa, Artificial Sequence
  Description of Artificial Sequence: Synthetic peptide
  Seed: YRQVPGSNPA (MAGA4_HUMAN)
YTQVPGSNPF

SEQ ID NO: 62384 - protein, 10 aa, Artificial Sequence
  Description of Artificial Sequence: Synthetic peptide
  Seed: KRCFPVIFGK (MAGA4_HUMAN)
KSCFPVIFGK

SEQ ID NO: 62385 - protein, 9 aa, Artificial Sequence
  Description of Artificial Sequence: Synthetic peptide
  Seed: KVLEHVVRV (MAGA4_HUMAN)
KILEHVVRC

SEQ ID NO: 62386 - protein, 9 aa, Artificial Sequence
  Description of Artificial Sequence: Synthetic peptide
  Seed: QDWVQENYL (MAGA4_HUMAN)
QEWVQENYI

SEQ ID NO: 62387 - protein, 9 aa, Artificial Sequence
  Description of Artificial Sequence: Synthetic peptide
  Seed: IIVLGTIAM (MAGA4_HUMAN)
INVLGTIAY

SEQ ID NO: 62388 - protein, 9 aa, Artificial Sequence
  Description of Artificial Sequence: Synthetic peptide
  Seed: RQVPGSNPA (MAGA4_HUMAN)
RMVPGSNPW

SEQ ID NO: 62389 - protein, 9 aa, Artificial Sequence
  Description of Artificial Sequence: Synthetic peptide
  Seed: GASALPTTI (MAGA4_HUMAN)
GPSALPTTL

SEQ ID NO: 62390 - protein, 9 aa, Artificial Sequence
  Description of Artificial Sequence: Synthetic peptide
  Seed: AESLFREAL (MAGA4_HUMAN)
ADSLFREAL

SEQ ID NO: 62391 - protein, 9 aa, Artificial Sequence
  Description of Artificial Sequence: Synthetic peptide
  Seed: EEVPAAESA (MAGA4_HUMAN)
EEVPAAESP

SEQ ID NO: 62392 - protein, 10 aa, Artificial Sequence
  Description of Artificial Sequence: Synthetic peptide
  Seed: KNYKRCFPVI (MAGA4_HUMAN)
KMYKRCFPVA

SEQ ID NO: 62393 - protein, 9 aa, Artificial Sequence
  Description of Artificial Sequence: Synthetic peptide
  Seed: EVDPASNTY (MAGA4_HUMAN)
EVDPASNTR

SEQ ID NO: 62394 - protein, 9 aa, Artificial Sequence
  Description of Artificial Sequence: Synthetic peptide
  Seed: SAGPPQSPQ (MAGA4_HUMAN)
SAGPPQSPR

SEQ ID NO: 62395 - protein, 10 aa, Artificial Sequence
  Description of Artificial Sequence: Synthetic peptide
  Seed: QIFPKTGLLI (MAGA4_HUMAN)
QMFPKTGLLV

SEQ ID NO: 62396 - protein, 9 aa, Artificial Sequence
  Description of Artificial Sequence: Synthetic peptide
  Seed: QIFPKTGLL (MAGA4_HUMAN)
QLFPKTGLR

SEQ ID NO: 62397 - protein, 9 aa, Artificial Sequence
  Description of Artificial Sequence: Synthetic peptide
  Seed: KVDELAHFL (MAGA4_HUMAN)
KFDELAHFY

SEQ ID NO: 62398 - protein, 9 aa, Artificial Sequence
  Description of Artificial Sequence: Synthetic peptide
  Seed: YRAKELVTK (MAGA4_HUMAN)
YAAKELVTL

SEQ ID NO: 62399 - protein, 9 aa, Artificial Sequence
  Description of Artificial Sequence: Synthetic peptide
  Seed: EHVVRVNAR (MAGA4_HUMAN)
EAVVRVNAR

SEQ ID NO: 62400 - protein, 9 aa, Artificial Sequence
  Description of Artificial Sequence: Synthetic peptide
  Seed: GASALPTTI (MAGA4_HUMAN)
GISALPTTF

SEQ ID NO: 62401 - protein, 10 aa, Artificial Sequence
  Description of Artificial Sequence: Synthetic peptide
  Seed: TSYVKVLEHV (MAGA4_HUMAN)
TSYVKVLEHL

SEQ ID NO: 62402 - protein, 9 aa, Artificial Sequence
  Description of Artificial Sequence: Synthetic peptide
  Seed: NTYTLVTCL (MAGA4_HUMAN)
NSYTLVTCY

SEQ ID NO: 62403 - protein, 9 aa, Artificial Sequence
  Description of Artificial Sequence: Synthetic peptide
  Seed: ALSNKVDEL (MAGA4_HUMAN)
ATSNKVDEL

SEQ ID NO: 62404 - protein, 9 aa, Artificial Sequence
  Description of Artificial Sequence: Synthetic peptide
  Seed: AAVSSSSPL (MAGA4_HUMAN)
AAVSSSSPY

SEQ ID NO: 62405 - protein, 9 aa, Artificial Sequence
  Description of Artificial Sequence: Synthetic peptide
  Seed: VYDGREHTV (MAGA4_HUMAN)
VCDGREHTL

SEQ ID NO: 62406 - protein, 9 aa, Artificial Sequence
  Description of Artificial Sequence: Synthetic peptide
  Seed: IAYPSLREA (MAGA4_HUMAN)
IMYPSLREA

SEQ ID NO: 62407 - protein, 9 aa, Artificial Sequence
  Description of Artificial Sequence: Synthetic peptide
  Seed: IIVLGTIAM (MAGA4_HUMAN)
ILVLGTIAY

SEQ ID NO: 62408 - protein, 10 aa, Artificial Sequence
  Description of Artificial Sequence: Synthetic peptide
  Seed: YRQVPGSNPA (MAGA4_HUMAN)
YMQVPGSNPY

SEQ ID NO: 62409 - protein, 10 aa, Artificial Sequence
  Description of Artificial Sequence: Synthetic peptide
  Seed: ASALPTTISF (MAGA4_HUMAN)
AVALPTTISY

SEQ ID NO: 62410 - protein, 9 aa, Artificial Sequence
  Description of Artificial Sequence: Synthetic peptide
  Seed: KELVTKAEM (MAGA4_HUMAN)
KKLVTKAEF

SEQ ID NO: 62411 - protein, 9 aa, Artificial Sequence
  Description of Artificial Sequence: Synthetic peptide
  Seed: YKRCFPVIF (MAGA4_HUMAN)
YMRCFPVIY

SEQ ID NO: 62412 - protein, 10 aa, Artificial Sequence
  Description of Artificial Sequence: Synthetic peptide
  Seed: ASALPTTISF (MAGA4_HUMAN)
ARALPTTISF

SEQ ID NO: 62413 - protein, 9 aa, Artificial Sequence
  Description of Artificial Sequence: Synthetic peptide
  Seed: VNARVRIAY (MAGA4_HUMAN)
VAARVRIAV

SEQ ID NO: 62414 - protein, 10 aa, Artificial Sequence
  Description of Artificial Sequence: Synthetic peptide
  Seed: ASALPTTISF (MAGA4_HUMAN)
APALPTTISW

SEQ ID NO: 62415 - protein, 10 aa, Artificial Sequence
  Description of Artificial Sequence: Synthetic peptide
  Seed: KNYKRCFPVI (MAGA4_HUMAN)
KWYKRCFPVI

SEQ ID NO: 62416 - protein, 9 aa, Artificial Sequence
  Description of Artificial Sequence: Synthetic peptide
  Seed: RQVPGSNPA (MAGA4_HUMAN)
RRVPGSNPL

SEQ ID NO: 62417 - protein, 9 aa, Artificial Sequence
  Description of Artificial Sequence: Synthetic peptide
  Seed: YKRCFPVIF (MAGA4_HUMAN)
YARCFPVIM

SEQ ID NO: 62418 - protein, 9 aa, Artificial Sequence
  Description of Artificial Sequence: Synthetic peptide
  Seed: SSPLVPGTL (MAGA4_HUMAN)
SLPLVPGTI

SEQ ID NO: 62419 - protein, 11 aa, Artificial Sequence
  Description of Artificial Sequence: Synthetic peptide
  Seed: LPTTISFTCWR (MAGA4_HUMAN)
LYTTISFTCWR

SEQ ID NO: 62420 - protein, 9 aa, Artificial Sequence
  Description of Artificial Sequence: Synthetic peptide
  Seed: RVRIAYPSL (MAGA4_HUMAN)
RERIAYPSM

SEQ ID NO: 62421 - protein, 10 aa, Artificial Sequence
  Description of Artificial Sequence: Synthetic peptide
  Seed: SSSPLVPGTL (MAGA4_HUMAN)
SLSPLVPGTM

SEQ ID NO: 62422 - protein, 9 aa, Artificial Sequence
  Description of Artificial Sequence: Synthetic peptide
  Seed: VNARVRIAY (MAGA4_HUMAN)
VLARVRIAM

SEQ ID NO: 62423 - protein, 9 aa, Artificial Sequence
  Description of Artificial Sequence: Synthetic peptide
  Seed: VYGEPRKLL (MAGA4_HUMAN)
VFGEPRKLY

SEQ ID NO: 62424 - protein, 9 aa, Artificial Sequence
  Description of Artificial Sequence: Synthetic peptide
  Seed: RQVPGSNPA (MAGA4_HUMAN)
RKVPGSNPL

SEQ ID NO: 62425 - protein, 10 aa, Artificial Sequence
  Description of Artificial Sequence: Synthetic peptide
  Seed: KEVDPASNTY (MAGA4_HUMAN)
KTVDPASNTF

SEQ ID NO: 62426 - protein, 9 aa, Artificial Sequence
  Description of Artificial Sequence: Synthetic peptide
  Seed: NQIFPKTGL (MAGA4_HUMAN)
NHIFPKTGI

SEQ ID NO: 62427 - protein, 9 aa, Artificial Sequence
  Description of Artificial Sequence: Synthetic peptide
  Seed: LVPGTLEEV (MAGA4_HUMAN)
LMPGTLEEV

SEQ ID NO: 62428 - protein, 9 aa, Artificial Sequence
  Description of Artificial Sequence: Synthetic peptide
  Seed: LAHFLLRKY (MAGA4_HUMAN)
LPHFLLRKY

SEQ ID NO: 62429 - protein, 9 aa, Artificial Sequence
  Description of Artificial Sequence: Synthetic peptide
  Seed: RVRIAYPSL (MAGA4_HUMAN)
RMRIAYPSK

SEQ ID NO: 62430 - protein, 9 aa, Artificial Sequence
  Description of Artificial Sequence: Synthetic peptide
  Seed: STSPDAESL (MAGA4_HUMAN)
SMSPDAESV

SEQ ID NO: 62431 - protein, 9 aa, Artificial Sequence
  Description of Artificial Sequence: Synthetic peptide
  Seed: SYVKVLEHV (MAGA4_HUMAN)
SRVKVLEHF

SEQ ID NO: 62432 - protein, 9 aa, Artificial Sequence
  Description of Artificial Sequence: Synthetic peptide
  Seed: SALPTTISF (MAGA4_HUMAN)
SPLPTTISY

SEQ ID NO: 62433 - protein, 9 aa, Artificial Sequence
  Description of Artificial Sequence: Synthetic peptide
  Seed: IFPKTGLLI (MAGA4_HUMAN)
IAPKTGLLI

SEQ ID NO: 62434 - protein, 9 aa, Artificial Sequence
  Description of Artificial Sequence: Synthetic peptide
  Seed: GASALPTTI (MAGA4_HUMAN)
GLSALPTTI

SEQ ID NO: 62435 - protein, 9 aa, Artificial Sequence
  Description of Artificial Sequence: Synthetic peptide
  Seed: TSPDAESLF (MAGA4_HUMAN)
TFPDAESLF

SEQ ID NO: 62436 - protein, 9 aa, Artificial Sequence
  Description of Artificial Sequence: Synthetic peptide
  Seed: ALSNKVDEL (MAGA4_HUMAN)
AMSNKVDEL

SEQ ID NO: 62437 - protein, 9 aa, Artificial Sequence
  Description of Artificial Sequence: Synthetic peptide
  Seed: KVDELAHFL (MAGA4_HUMAN)
KWDELAHFM

SEQ ID NO: 62438 - protein, 9 aa, Artificial Sequence
  Description of Artificial Sequence: Synthetic peptide
  Seed: QIFPKTGLL (MAGA4_HUMAN)
QSFPKTGLK

SEQ ID NO: 62439 - protein, 9 aa, Artificial Sequence
  Description of Artificial Sequence: Synthetic peptide
  Seed: KVDELAHFL (MAGA4_HUMAN)
KLDELAHFC

SEQ ID NO: 62440 - protein, 10 aa, Artificial Sequence
  Description of Artificial Sequence: Synthetic peptide
  Seed: EHTVYGEPRK (MAGA4_HUMAN)
EKTVYGEPRR

SEQ ID NO: 62441 - protein, 9 aa, Artificial Sequence
  Description of Artificial Sequence: Synthetic peptide
  Seed: REHTVYGEP (MAGA4_HUMAN)
REHTVYGEM

SEQ ID NO: 62442 - protein, 9 aa, Artificial Sequence
  Description of Artificial Sequence: Synthetic peptide
  Seed: KASESLKMI (MAGA4_HUMAN)
KTSESLKML

SEQ ID NO: 62443 - protein, 9 aa, Artificial Sequence
  Description of Artificial Sequence: Synthetic peptide
  Seed: SPDAESLFR (MAGA4_HUMAN)
STDAESLFF

SEQ ID NO: 62444 - protein, 10 aa, Artificial Sequence
  Description of Artificial Sequence: Synthetic peptide
  Seed: YPSLREAALL (MAGA4_HUMAN)
YCSLREAALY

SEQ ID NO: 62445 - protein, 9 aa, Artificial Sequence
  Description of Artificial Sequence: Synthetic peptide
  Seed: KVDELAHFL (MAGA4_HUMAN)
KEDELAHFF

SEQ ID NO: 62446 - protein, 10 aa, Artificial Sequence
  Description of Artificial Sequence: Synthetic peptide
  Seed: VYDGREHTVY (MAGA4_HUMAN)
VWDGREHTVF

SEQ ID NO: 62447 - protein, 9 aa, Artificial Sequence
  Description of Artificial Sequence: Synthetic peptide
  Seed: TTEEQEAAV (MAGA4_HUMAN)
TAEEQEAAL

SEQ ID NO: 62448 - protein, 9 aa, Artificial Sequence
  Description of Artificial Sequence: Synthetic peptide
  Seed: SYVKVLEHV (MAGA4_HUMAN)
SWVKVLEHW

SEQ ID NO: 62449 - protein, 9 aa, Artificial Sequence
  Description of Artificial Sequence: Synthetic peptide
  Seed: NQIFPKTGL (MAGA4_HUMAN)
NEIFPKTGL

SEQ ID NO: 62450 - protein, 10 aa, Artificial Sequence
  Description of Artificial Sequence: Synthetic peptide
  Seed: TSYVKVLEHV (MAGA4_HUMAN)
TMYVKVLEHV

SEQ ID NO: 62451 - protein, 10 aa, Artificial Sequence
  Description of Artificial Sequence: Synthetic peptide
  Seed: YRQVPGSNPA (MAGA4_HUMAN)
YDQVPGSNPY

SEQ ID NO: 62452 - protein, 9 aa, Artificial Sequence
  Description of Artificial Sequence: Synthetic peptide
  Seed: SSPLVPGTL (MAGA4_HUMAN)
SWPLVPGTY

SEQ ID NO: 62453 - protein, 11 aa, Artificial Sequence
  Description of Artificial Sequence: Synthetic peptide
  Seed: RVRIAYPSLRE (MAGA4_HUMAN)
RIRIAYPSLRR

SEQ ID NO: 62454 - protein, 9 aa, Artificial Sequence
  Description of Artificial Sequence: Synthetic peptide
  Seed: RVNARVRIA (MAGA4_HUMAN)
RSNARVRIK

SEQ ID NO: 62455 - protein, 10 aa, Artificial Sequence
  Description of Artificial Sequence: Synthetic peptide
  Seed: YRQVPGSNPA (MAGA4_HUMAN)
YDQVPGSNPF

SEQ ID NO: 62456 - protein, 9 aa, Artificial Sequence
  Description of Artificial Sequence: Synthetic peptide
  Seed: YKRCFPVIF (MAGA4_HUMAN)
YARCFPVIF

SEQ ID NO: 62457 - protein, 9 aa, Artificial Sequence
  Description of Artificial Sequence: Synthetic peptide
  Seed: RVRIAYPSL (MAGA4_HUMAN)
RQRIAYPSQ

SEQ ID NO: 62458 - protein, 9 aa, Artificial Sequence
  Description of Artificial Sequence: Synthetic peptide
  Seed: LFREALSNK (MAGA4_HUMAN)
LTREALSNV

SEQ ID NO: 62459 - protein, 10 aa, Artificial Sequence
  Description of Artificial Sequence: Synthetic peptide
  Seed: STSPDAESLF (MAGA4_HUMAN)
SSSPDAESLW

SEQ ID NO: 62460 - protein, 10 aa, Artificial Sequence
  Description of Artificial Sequence: Synthetic peptide
  Seed: KASESLKMIF (MAGA4_HUMAN)
KYSESLKMIW

SEQ ID NO: 62461 - protein, 10 aa, Artificial Sequence
  Description of Artificial Sequence: Synthetic peptide
  Seed: GDSASEEEIW (MAGA4_HUMAN)
GMSASEEEIW

SEQ ID NO: 62462 - protein, 10 aa, Artificial Sequence
  Description of Artificial Sequence: Synthetic peptide
  Seed: KEVDPASNTY (MAGA4_HUMAN)
KQVDPASNTW

SEQ ID NO: 62463 - protein, 10 aa, Artificial Sequence
  Description of Artificial Sequence: Synthetic peptide
  Seed: RQVPGSNPAR (MAGA4_HUMAN)
RTVPGSNPAR

SEQ ID NO: 62464 - protein, 9 aa, Artificial Sequence
  Description of Artificial Sequence: Synthetic peptide
  Seed: AAVSSSSPL (MAGA4_HUMAN)
AHVSSSSPY

SEQ ID NO: 62465 - protein, 10 aa, Artificial Sequence
  Description of Artificial Sequence: Synthetic peptide
  Seed: VDPASNTYTL (MAGA4_HUMAN)
VAPASNTYTF

SEQ ID NO: 62466 - protein, 9 aa, Artificial Sequence
  Description of Artificial Sequence: Synthetic peptide
  Seed: EEQEAAVSS (MAGA4_HUMAN)
EEQEAAVSM

SEQ ID NO: 62467 - protein, 9 aa, Artificial Sequence
  Description of Artificial Sequence: Synthetic peptide
  Seed: QIFPKTGLL (MAGA4_HUMAN)
QMFPKTGLM

SEQ ID NO: 62468 - protein, 9 aa, Artificial Sequence
  Description of Artificial Sequence: Synthetic peptide
  Seed: KNYKRCFPV (MAGA4_HUMAN)
KSYKRCFPL

SEQ ID NO: 62469 - protein, 10 aa, Artificial Sequence
  Description of Artificial Sequence: Synthetic peptide
  Seed: RVRIAYPSLR (MAGA4_HUMAN)
RSRIAYPSLF

SEQ ID NO: 62470 - protein, 9 aa, Artificial Sequence
  Description of Artificial Sequence: Synthetic peptide
  Seed: LRKYRAKEL (MAGA4_HUMAN)
LAKYRAKEL

SEQ ID NO: 62471 - protein, 9 aa, Artificial Sequence
  Description of Artificial Sequence: Synthetic peptide
  Seed: RKYRAKELV (MAGA4_HUMAN)
RMYRAKELY

SEQ ID NO: 62472 - protein, 9 aa, Artificial Sequence
  Description of Artificial Sequence: Synthetic peptide
  Seed: SSPLVPGTL (MAGA4_HUMAN)
SRPLVPGTY

SEQ ID NO: 62473 - protein, 10 aa, Artificial Sequence
  Description of Artificial Sequence: Synthetic peptide
  Seed: ALSNKVDELA (MAGA4_HUMAN)
ALSNKVDELV

SEQ ID NO: 62474 - protein, 10 aa, Artificial Sequence
  Description of Artificial Sequence: Synthetic peptide
  Seed: LPTTISFTCW (MAGA4_HUMAN)
LMTTISFTCW

SEQ ID NO: 62475 - protein, 10 aa, Artificial Sequence
  Description of Artificial Sequence: Synthetic peptide
  Seed: YRQVPGSNPA (MAGA4_HUMAN)
YMQVPGSNPM

SEQ ID NO: 62476 - protein, 11 aa, Artificial Sequence
  Description of Artificial Sequence: Synthetic peptide
  Seed: RQVPGSNPARY (MAGA4_HUMAN)
RAVPGSNPARW

SEQ ID NO: 62477 - protein, 9 aa, Artificial Sequence
  Description of Artificial Sequence: Synthetic peptide
  Seed: RCFPVIFGK (MAGA4_HUMAN)
RLFPVIFGM

SEQ ID NO: 62478 - protein, 9 aa, Artificial Sequence
  Description of Artificial Sequence: Synthetic peptide
  Seed: HVVRVNARV (MAGA4_HUMAN)
HVVRVNARI

SEQ ID NO: 62479 - protein, 9 aa, Artificial Sequence
  Description of Artificial Sequence: Synthetic peptide
  Seed: TSPDAESLF (MAGA4_HUMAN)
TGPDAESLL

SEQ ID NO: 62480 - protein, 9 aa, Artificial Sequence
  Description of Artificial Sequence: Synthetic peptide
  Seed: KVDELAHFL (MAGA4_HUMAN)
KMDELAHFR

SEQ ID NO: 62481 - protein, 9 aa, Artificial Sequence
  Description of Artificial Sequence: Synthetic peptide
  Seed: LKMIFGIDV (MAGA4_HUMAN)
LMMIFGIDF

SEQ ID NO: 62482 - protein, 9 aa, Artificial Sequence
  Description of Artificial Sequence: Synthetic peptide
  Seed: ALLEEEEGV (MAGA4_HUMAN)
AQLEEEEGI

SEQ ID NO: 62483 - protein, 10 aa, Artificial Sequence
  Description of Artificial Sequence: Synthetic peptide
  Seed: RVNARVRIAY (MAGA4_HUMAN)
RINARVRIAK

SEQ ID NO: 62484 - protein, 9 aa, Artificial Sequence
  Description of Artificial Sequence: Synthetic peptide
  Seed: LGNNQIFPK (MAGA4_HUMAN)
LGNNQIFPR

SEQ ID NO: 62485 - protein, 9 aa, Artificial Sequence
  Description of Artificial Sequence: Synthetic peptide
  Seed: ALPTTISFT (MAGA4_HUMAN)
AMPTTISFM

SEQ ID NO: 62486 - protein, 9 aa, Artificial Sequence
  Description of Artificial Sequence: Synthetic peptide
  Seed: NTYTLVTCL (MAGA4_HUMAN)
NMYTLVTCA

SEQ ID NO: 62487 - protein, 9 aa, Artificial Sequence
  Description of Artificial Sequence: Synthetic peptide
  Seed: KYRAKELVT (MAGA4_HUMAN)
KVRAKELVA

SEQ ID NO: 62488 - protein, 10 aa, Artificial Sequence
  Description of Artificial Sequence: Synthetic peptide
  Seed: RVRIAYPSLR (MAGA4_HUMAN)
RARIAYPSLK

SEQ ID NO: 62489 - protein, 10 aa, Artificial Sequence
  Description of Artificial Sequence: Synthetic peptide
  Seed: VDPASNTYTL (MAGA4_HUMAN)
VWPASNTYTY

SEQ ID NO: 62490 - protein, 10 aa, Artificial Sequence
  Description of Artificial Sequence: Synthetic peptide
  Seed: YPSLREAALL (MAGA4_HUMAN)
YISLREAALW

SEQ ID NO: 62491 - protein, 9 aa, Artificial Sequence
  Description of Artificial Sequence: Synthetic peptide
  Seed: AHFLLRKYR (MAGA4_HUMAN)
AFFLLRKYK

SEQ ID NO: 62492 - protein, 9 aa, Artificial Sequence
  Description of Artificial Sequence: Synthetic peptide
  Seed: RCFPVIFGK (MAGA4_HUMAN)
RLFPVIFGY

SEQ ID NO: 62493 - protein, 9 aa, Artificial Sequence
  Description of Artificial Sequence: Synthetic peptide
  Seed: GSNPARYEF (MAGA4_HUMAN)
GVNPARYEF

SEQ ID NO: 62494 - protein, 10 aa, Artificial Sequence
  Description of Artificial Sequence: Synthetic peptide
  Seed: TSYVKVLEHV (MAGA4_HUMAN)
TWYVKVLEHW

SEQ ID NO: 62495 - protein, 9 aa, Artificial Sequence
  Description of Artificial Sequence: Synthetic peptide
  Seed: RQVPGSNPA (MAGA4_HUMAN)
REVPGSNPM

SEQ ID NO: 62496 - protein, 10 aa, Artificial Sequence
  Description of Artificial Sequence: Synthetic peptide
  Seed: GDSASEEEIW (MAGA4_HUMAN)
GSSASEEEIW

SEQ ID NO: 62497 - protein, 9 aa, Artificial Sequence
  Description of Artificial Sequence: Synthetic peptide
  Seed: AEMLERVIK (MAGA4_HUMAN)
AEMLERVII

SEQ ID NO: 62498 - protein, 10 aa, Artificial Sequence
  Description of Artificial Sequence: Synthetic peptide
  Seed: AESAGPPQSP (MAGA4_HUMAN)
AESAGPPQSV

SEQ ID NO: 62499 - protein, 9 aa, Artificial Sequence
  Description of Artificial Sequence: Synthetic peptide
  Seed: SEEEIWEEL (MAGA4_HUMAN)
SEEEIWEEV

SEQ ID NO: 62500 - protein, 10 aa, Artificial Sequence
  Description of Artificial Sequence: Synthetic peptide
  Seed: RQVPGSNPAR (MAGA4_HUMAN)
RMVPGSNPAF

SEQ ID NO: 62501 - protein, 10 aa, Artificial Sequence
  Description of Artificial Sequence: Synthetic peptide
  Seed: PTTISFTCWR (MAGA4_HUMAN)
PYTISFTCWR

SEQ ID NO: 62502 - protein, 9 aa, Artificial Sequence
  Description of Artificial Sequence: Synthetic peptide
  Seed: GSNPARYEF (MAGA4_HUMAN)
GKNPARYEF

SEQ ID NO: 62503 - protein, 9 aa, Artificial Sequence
  Description of Artificial Sequence: Synthetic peptide
  Seed: RAKELVTKA (MAGA4_HUMAN)
RTKELVTKS

SEQ ID NO: 62504 - protein, 10 aa, Artificial Sequence
  Description of Artificial Sequence: Synthetic peptide
  Seed: STSPDAESLF (MAGA4_HUMAN)
SVSPDAESLY

SEQ ID NO: 62505 - protein, 9 aa, Artificial Sequence
  Description of Artificial Sequence: Synthetic peptide
  Seed: VYGEPRKLL (MAGA4_HUMAN)
VTGEPRKLM

SEQ ID NO: 62506 - protein, 9 aa, Artificial Sequence
  Description of Artificial Sequence: Synthetic peptide
  Seed: QSPQGASAL (MAGA4_HUMAN)
QTPQGASAK

SEQ ID NO: 62507 - protein, 10 aa, Artificial Sequence
  Description of Artificial Sequence: Synthetic peptide
  Seed: SSSPLVPGTL (MAGA4_HUMAN)
STSPLVPGTL

SEQ ID NO: 62508 - protein, 9 aa, Artificial Sequence
  Description of Artificial Sequence: Synthetic peptide
  Seed: AAVSSSSPL (MAGA4_HUMAN)
AIVSSSSPM

SEQ ID NO: 62509 - protein, 10 aa, Artificial Sequence
  Description of Artificial Sequence: Synthetic peptide
  Seed: RQVPGSNPAR (MAGA4_HUMAN)
RYVPGSNPAR

SEQ ID NO: 62510 - protein, 9 aa, Artificial Sequence
  Description of Artificial Sequence: Synthetic peptide
  Seed: KNYKRCFPV (MAGA4_HUMAN)
KTYKRCFPR

SEQ ID NO: 62511 - protein, 9 aa, Artificial Sequence
  Description of Artificial Sequence: Synthetic peptide
  Seed: TVYGEPRKL (MAGA4_HUMAN)
TRYGEPRKF

SEQ ID NO: 62512 - protein, 10 aa, Artificial Sequence
  Description of Artificial Sequence: Synthetic peptide
  Seed: EMLERVIKNY (MAGA4_HUMAN)
EVLERVIKNF

SEQ ID NO: 62513 - protein, 9 aa, Artificial Sequence
  Description of Artificial Sequence: Synthetic peptide
  Seed: EELGVMGVY (MAGA4_HUMAN)
EQLGVMGVY

SEQ ID NO: 62514 - protein, 9 aa, Artificial Sequence
  Description of Artificial Sequence: Synthetic peptide
  Seed: SSSPLVPGT (MAGA4_HUMAN)
SVSPLVPGT

SEQ ID NO: 62515 - protein, 9 aa, Artificial Sequence
  Description of Artificial Sequence: Synthetic peptide
  Seed: EIWEELGVM (MAGA4_HUMAN)
ETWEELGVF

SEQ ID NO: 62516 - protein, 10 aa, Artificial Sequence
  Description of Artificial Sequence: Synthetic peptide
  Seed: YPSLREAALL (MAGA4_HUMAN)
YTSLREAALY

SEQ ID NO: 62517 - protein, 10 aa, Artificial Sequence
  Description of Artificial Sequence: Synthetic peptide
  Seed: YPSLREAALL (MAGA4_HUMAN)
YASLREAALW

SEQ ID NO: 62518 - protein, 9 aa, Artificial Sequence
  Description of Artificial Sequence: Synthetic peptide
  Seed: LPTTISFTC (MAGA4_HUMAN)
LPTTISFTI

SEQ ID NO: 62519 - protein, 9 aa, Artificial Sequence
  Description of Artificial Sequence: Synthetic peptide
  Seed: KVDELAHFL (MAGA4_HUMAN)
KYDELAHFY

SEQ ID NO: 62520 - protein, 10 aa, Artificial Sequence
  Description of Artificial Sequence: Synthetic peptide
  Seed: AYPSLREAAL (MAGA4_HUMAN)
ADPSLREAAL

SEQ ID NO: 62521 - protein, 10 aa, Artificial Sequence
  Description of Artificial Sequence: Synthetic peptide
  Seed: STSPDAESLF (MAGA4_HUMAN)
SASPDAESLW

SEQ ID NO: 62522 - protein, 9 aa, Artificial Sequence
  Description of Artificial Sequence: Synthetic peptide
  Seed: YPSLREAAL (MAGA4_HUMAN)
YPSLREAAF

SEQ ID NO: 62523 - protein, 10 aa, Artificial Sequence
  Description of Artificial Sequence: Synthetic peptide
  Seed: KNYKRCFPVI (MAGA4_HUMAN)
KPYKRCFPVF

SEQ ID NO: 62524 - protein, 10 aa, Artificial Sequence
  Description of Artificial Sequence: Synthetic peptide
  Seed: YRQVPGSNPA (MAGA4_HUMAN)
YSQVPGSNPY

SEQ ID NO: 62525 - protein, 9 aa, Artificial Sequence
  Description of Artificial Sequence: Synthetic peptide
  Seed: SALPTTISF (MAGA4_HUMAN)
SDLPTTISI

SEQ ID NO: 62526 - protein, 10 aa, Artificial Sequence
  Description of Artificial Sequence: Synthetic peptide
  Seed: KYRAKELVTK (MAGA4_HUMAN)
KTRAKELVTG

SEQ ID NO: 62527 - protein, 11 aa, Artificial Sequence
  Description of Artificial Sequence: Synthetic peptide
  Seed: RVRIAYPSLRE (MAGA4_HUMAN)
RARIAYPSLRK

SEQ ID NO: 62528 - protein, 11 aa, Artificial Sequence
  Description of Artificial Sequence: Synthetic peptide
  Seed: STSPDAESLFR (MAGA4_HUMAN)
SMSPDAESLFK

SEQ ID NO: 62529 - protein, 9 aa, Artificial Sequence
  Description of Artificial Sequence: Synthetic peptide
  Seed: GASALPTTI (MAGA4_HUMAN)
GQSALPTTF

SEQ ID NO: 62530 - protein, 9 aa, Artificial Sequence
  Description of Artificial Sequence: Synthetic peptide
  Seed: RQVPGSNPA (MAGA4_HUMAN)
RIVPGSNPF

SEQ ID NO: 62531 - protein, 10 aa, Artificial Sequence
  Description of Artificial Sequence: Synthetic peptide
  Seed: VKVLEHVVRV (MAGA4_HUMAN)
VYVLEHVVRV

SEQ ID NO: 62532 - protein, 10 aa, Artificial Sequence
  Description of Artificial Sequence: Synthetic peptide
  Seed: MLERVIKNYK (MAGA4_HUMAN)
MVERVIKNYK

SEQ ID NO: 62533 - protein, 10 aa, Artificial Sequence
  Description of Artificial Sequence: Synthetic peptide
  Seed: VIFGKASESL (MAGA4_HUMAN)
VSFGKASESY

SEQ ID NO: 62534 - protein, 9 aa, Artificial Sequence
  Description of Artificial Sequence: Synthetic peptide
  Seed: TTEEQEAAV (MAGA4_HUMAN)
TSEEQEAAL

SEQ ID NO: 62535 - protein, 10 aa, Artificial Sequence
  Description of Artificial Sequence: Synthetic peptide
  Seed: MIFGIDVKEV (MAGA4_HUMAN)
MMFGIDVKEI

SEQ ID NO: 62536 - protein, 9 aa, Artificial Sequence
  Description of Artificial Sequence: Synthetic peptide
  Seed: TVYGEPRKL (MAGA4_HUMAN)
TIYGEPRKM

SEQ ID NO: 62537 - protein, 10 aa, Artificial Sequence
  Description of Artificial Sequence: Synthetic peptide
  Seed: GLLIIVLGTI (MAGA4_HUMAN)
GSLIIVLGTV

SEQ ID NO: 62538 - protein, 10 aa, Artificial Sequence
  Description of Artificial Sequence: Synthetic peptide
  Seed: RIAYPSLREA (MAGA4_HUMAN)
RGAYPSLREK

SEQ ID NO: 62539 - protein, 9 aa, Artificial Sequence
  Description of Artificial Sequence: Synthetic peptide
  Seed: RQVPGSNPA (MAGA4_HUMAN)
RQVPGSNPM

SEQ ID NO: 62540 - protein, 10 aa, Artificial Sequence
  Description of Artificial Sequence: Synthetic peptide
  Seed: QEEALGLVGA (MAGA4_HUMAN)
QEEALGLVGV

SEQ ID NO: 62541 - protein, 9 aa, Artificial Sequence
  Description of Artificial Sequence: Synthetic peptide
  Seed: SNKVDELAH (MAGA4_HUMAN)
SVKVDELAY

SEQ ID NO: 62542 - protein, 9 aa, Artificial Sequence
  Description of Artificial Sequence: Synthetic peptide
  Seed: KVLEHVVRV (MAGA4_HUMAN)
KLLEHVVRK

SEQ ID NO: 62543 - protein, 9 aa, Artificial Sequence
  Description of Artificial Sequence: Synthetic peptide
  Seed: EVDPASNTY (MAGA4_HUMAN)
EFDPASNTI

SEQ ID NO: 62544 - protein, 10 aa, Artificial Sequence
  Description of Artificial Sequence: Synthetic peptide
  Seed: RVRIAYPSLR (MAGA4_HUMAN)
RYRIAYPSLV

SEQ ID NO: 62545 - protein, 10 aa, Artificial Sequence
  Description of Artificial Sequence: Synthetic peptide
  Seed: KEVDPASNTY (MAGA4_HUMAN)
KEVDPASNTW

SEQ ID NO: 62546 - protein, 10 aa, Artificial Sequence
  Description of Artificial Sequence: Synthetic peptide
  Seed: TSYVKVLEHV (MAGA4_HUMAN)
TNYVKVLEHL

SEQ ID NO: 62547 - protein, 11 aa, Artificial Sequence
  Description of Artificial Sequence: Synthetic peptide
  Seed: AQAPTTEEQEA (MAGA4_HUMAN)
AQAPTTEEQEL

SEQ ID NO: 62548 - protein, 10 aa, Artificial Sequence
  Description of Artificial Sequence: Synthetic peptide
  Seed: YPSLREAALL (MAGA4_HUMAN)
YSSLREAALY

SEQ ID NO: 62549 - protein, 8 aa, Artificial Sequence
  Description of Artificial Sequence: Synthetic peptide
  Seed: SEQKSQHC (MAGA4_HUMAN)
SEQKSQHL

SEQ ID NO: 62550 - protein, 9 aa, Artificial Sequence
  Description of Artificial Sequence: Synthetic peptide
  Seed: AAVSSSSPL (MAGA4_HUMAN)
AKVSSSSPM

SEQ ID NO: 62551 - protein, 11 aa, Artificial Sequence
  Description of Artificial Sequence: Synthetic peptide
  Seed: EIWEELGVMGV (MAGA4_HUMAN)
ELWEELGVMGV

SEQ ID NO: 62552 - protein, 10 aa, Artificial Sequence
  Description of Artificial Sequence: Synthetic peptide
  Seed: LPTTISFTCW (MAGA4_HUMAN)
LATTISFTCF

SEQ ID NO: 62553 - protein, 10 aa, Artificial Sequence
  Description of Artificial Sequence: Synthetic peptide
  Seed: HTVYGEPRKL (MAGA4_HUMAN)
HAVYGEPRKW

SEQ ID NO: 62554 - protein, 10 aa, Artificial Sequence
  Description of Artificial Sequence: Synthetic peptide
  Seed: TTISFTCWRQ (MAGA4_HUMAN)
TFISFTCWRK

SEQ ID NO: 62555 - protein, 10 aa, Artificial Sequence
  Description of Artificial Sequence: Synthetic peptide
  Seed: VDPASNTYTL (MAGA4_HUMAN)
VKPASNTYTM

SEQ ID NO: 62556 - protein, 10 aa, Artificial Sequence
  Description of Artificial Sequence: Synthetic peptide
  Seed: FGKASESLKM (MAGA4_HUMAN)
FTKASESLKF

SEQ ID NO: 62557 - protein, 9 aa, Artificial Sequence
  Description of Artificial Sequence: Synthetic peptide
  Seed: HVVRVNARV (MAGA4_HUMAN)
HTVRVNARV

SEQ ID NO: 62558 - protein, 10 aa, Artificial Sequence
  Description of Artificial Sequence: Synthetic peptide
  Seed: SESLKMIFGI (MAGA4_HUMAN)
SESLKMIFGW

SEQ ID NO: 62559 - protein, 10 aa, Artificial Sequence
  Description of Artificial Sequence: Synthetic peptide
  Seed: PTTISFTCWR (MAGA4_HUMAN)
PQTISFTCWR

SEQ ID NO: 62560 - protein, 8 aa, Artificial Sequence
  Description of Artificial Sequence: Synthetic peptide
  Seed: AEMLERVI (MAGA4_HUMAN)
AEMLERVV

SEQ ID NO: 62561 - protein, 9 aa, Artificial Sequence
  Description of Artificial Sequence: Synthetic peptide
  Seed: SSSPLVPGT (MAGA4_HUMAN)
SVSPLVPGM

SEQ ID NO: 62562 - protein, 9 aa, Artificial Sequence
  Description of Artificial Sequence: Synthetic peptide
  Seed: YKRCFPVIF (MAGA4_HUMAN)
YNRCFPVIY

SEQ ID NO: 62563 - protein, 9 aa, Artificial Sequence
  Description of Artificial Sequence: Synthetic peptide
  Seed: NYKRCFPVI (MAGA4_HUMAN)
NYKRCFPVY

SEQ ID NO: 62564 - protein, 11 aa, Artificial Sequence
  Description of Artificial Sequence: Synthetic peptide
  Seed: EMLERVIKNYK (MAGA4_HUMAN)
ETLERVIKNYK

SEQ ID NO: 62565 - protein, 9 aa, Artificial Sequence
  Description of Artificial Sequence: Synthetic peptide
  Seed: VRIAYPSLR (MAGA4_HUMAN)
VMIAYPSLR

SEQ ID NO: 62566 - protein, 9 aa, Artificial Sequence
  Description of Artificial Sequence: Synthetic peptide
  Seed: MSSEQKSQH (MAGA4_HUMAN)
MVSEQKSQY

SEQ ID NO: 62567 - protein, 9 aa, Artificial Sequence
  Description of Artificial Sequence: Synthetic peptide
  Seed: IAMEGDSAS (MAGA4_HUMAN)
IAMEGDSAM

SEQ ID NO: 62568 - protein, 9 aa, Artificial Sequence
  Description of Artificial Sequence: Synthetic peptide
  Seed: STSPDAESL (MAGA4_HUMAN)
SFSPDAESL

SEQ ID NO: 62569 - protein, 10 aa, Artificial Sequence
  Description of Artificial Sequence: Synthetic peptide
  Seed: KEVDPASNTY (MAGA4_HUMAN)
KYVDPASNTM

SEQ ID NO: 62570 - protein, 10 aa, Artificial Sequence
  Description of Artificial Sequence: Synthetic peptide
  Seed: SLFREALSNK (MAGA4_HUMAN)
STFREALSNY

SEQ ID NO: 62571 - protein, 10 aa, Artificial Sequence
  Description of Artificial Sequence: Synthetic peptide
  Seed: KVDELAHFLL (MAGA4_HUMAN)
KSDELAHFLF

SEQ ID NO: 62572 - protein, 10 aa, Artificial Sequence
  Description of Artificial Sequence: Synthetic peptide
  Seed: VDPASNTYTL (MAGA4_HUMAN)
VYPASNTYTF

SEQ ID NO: 62573 - protein, 10 aa, Artificial Sequence
  Description of Artificial Sequence: Synthetic peptide
  Seed: TTISFTCWRQ (MAGA4_HUMAN)
TWISFTCWRR

SEQ ID NO: 62574 - protein, 10 aa, Artificial Sequence
  Description of Artificial Sequence: Synthetic peptide
  Seed: EHTVYGEPRK (MAGA4_HUMAN)
EATVYGEPRR

SEQ ID NO: 62575 - protein, 9 aa, Artificial Sequence
  Description of Artificial Sequence: Synthetic peptide
  Seed: RAKELVTKA (MAGA4_HUMAN)
RIKELVTKF

SEQ ID NO: 62576 - protein, 10 aa, Artificial Sequence
  Description of Artificial Sequence: Synthetic peptide
  Seed: TTISFTCWRQ (MAGA4_HUMAN)
TVISFTCWRG

SEQ ID NO: 62577 - protein, 9 aa, Artificial Sequence
  Description of Artificial Sequence: Synthetic peptide
  Seed: IAYPSLREA (MAGA4_HUMAN)
IQYPSLREI

SEQ ID NO: 62578 - protein, 10 aa, Artificial Sequence
  Description of Artificial Sequence: Synthetic peptide
  Seed: GVYDGREHTV (MAGA4_HUMAN)
GIYDGREHTL

SEQ ID NO: 62579 - protein, 9 aa, Artificial Sequence
  Description of Artificial Sequence: Synthetic peptide
  Seed: LGNNQIFPK (MAGA4_HUMAN)
LVNNQIFPK

SEQ ID NO: 62580 - protein, 10 aa, Artificial Sequence
  Description of Artificial Sequence: Synthetic peptide
  Seed: KVDELAHFLL (MAGA4_HUMAN)
KADELAHFLL

SEQ ID NO: 62581 - protein, 10 aa, Artificial Sequence
  Description of Artificial Sequence: Synthetic peptide
  Seed: YPSLREAALL (MAGA4_HUMAN)
YFSLREAALW

SEQ ID NO: 62582 - protein, 9 aa, Artificial Sequence
  Description of Artificial Sequence: Synthetic peptide
  Seed: RCFPVIFGK (MAGA4_HUMAN)
RLFPVIFGK

SEQ ID NO: 62583 - protein, 10 aa, Artificial Sequence
  Description of Artificial Sequence: Synthetic peptide
  Seed: RVRIAYPSLR (MAGA4_HUMAN)
RTRIAYPSLV

SEQ ID NO: 62584 - protein, 9 aa, Artificial Sequence
  Description of Artificial Sequence: Synthetic peptide
  Seed: KVDELAHFL (MAGA4_HUMAN)
KYDELAHFV

SEQ ID NO: 62585 - protein, 9 aa, Artificial Sequence
  Description of Artificial Sequence: Synthetic peptide
  Seed: KVLEHVVRV (MAGA4_HUMAN)
KKLEHVVRL

SEQ ID NO: 62586 - protein, 9 aa, Artificial Sequence
  Description of Artificial Sequence: Synthetic peptide
  Seed: WVQENYLEY (MAGA4_HUMAN)
WVQENYLER

SEQ ID NO: 62587 - protein, 9 aa, Artificial Sequence
  Description of Artificial Sequence: Synthetic peptide
  Seed: RAKELVTKA (MAGA4_HUMAN)
RSKELVTKR

SEQ ID NO: 62588 - protein, 9 aa, Artificial Sequence
  Description of Artificial Sequence: Synthetic peptide
  Seed: TSPDAESLF (MAGA4_HUMAN)
TMPDAESLF

SEQ ID NO: 62589 - protein, 9 aa, Artificial Sequence
  Description of Artificial Sequence: Synthetic peptide
  Seed: GASALPTTI (MAGA4_HUMAN)
GRSALPTTL

SEQ ID NO: 62590 - protein, 9 aa, Artificial Sequence
  Description of Artificial Sequence: Synthetic peptide
  Seed: AAVSSSSPL (MAGA4_HUMAN)
AYVSSSSPM

SEQ ID NO: 62591 - protein, 10 aa, Artificial Sequence
  Description of Artificial Sequence: Synthetic peptide
  Seed: VDPASNTYTL (MAGA4_HUMAN)
VAPASNTYTM

SEQ ID NO: 62592 - protein, 10 aa, Artificial Sequence
  Description of Artificial Sequence: Synthetic peptide
  Seed: TTISFTCWRQ (MAGA4_HUMAN)
TIISFTCWRK

SEQ ID NO: 62593 - protein, 10 aa, Artificial Sequence
  Description of Artificial Sequence: Synthetic peptide
  Seed: TSYVKVLEHV (MAGA4_HUMAN)
TDYVKVLEHF

SEQ ID NO: 62594 - protein, 10 aa, Artificial Sequence
  Description of Artificial Sequence: Synthetic peptide
  Seed: SSSPLVPGTL (MAGA4_HUMAN)
SVSPLVPGTI

SEQ ID NO: 62595 - protein, 9 aa, Artificial Sequence
  Description of Artificial Sequence: Synthetic peptide
  Seed: ESLKMIFGI (MAGA4_HUMAN)
EALKMIFGV

SEQ ID NO: 62596 - protein, 9 aa, Artificial Sequence
  Description of Artificial Sequence: Synthetic peptide
  Seed: NQIFPKTGL (MAGA4_HUMAN)
NQIFPKTGY

SEQ ID NO: 62597 - protein, 9 aa, Artificial Sequence
  Description of Artificial Sequence: Synthetic peptide
  Seed: NTYTLVTCL (MAGA4_HUMAN)
NTYTLVTCV

SEQ ID NO: 62598 - protein, 9 aa, Artificial Sequence
  Description of Artificial Sequence: Synthetic peptide
  Seed: YPSLREAAL (MAGA4_HUMAN)
YPSLREAAW

SEQ ID NO: 62599 - protein, 9 aa, Artificial Sequence
  Description of Artificial Sequence: Synthetic peptide
  Seed: TVYGEPRKL (MAGA4_HUMAN)
TAYGEPRKL

SEQ ID NO: 62600 - protein, 10 aa, Artificial Sequence
  Description of Artificial Sequence: Synthetic peptide
  Seed: DELAHFLLRK (MAGA4_HUMAN)
DTLAHFLLRR

SEQ ID NO: 62601 - protein, 10 aa, Artificial Sequence
  Description of Artificial Sequence: Synthetic peptide
  Seed: RVNARVRIAY (MAGA4_HUMAN)
RLNARVRIAW

SEQ ID NO: 62602 - protein, 10 aa, Artificial Sequence
  Description of Artificial Sequence: Synthetic peptide
  Seed: GLLIIVLGTI (MAGA4_HUMAN)
GVLIIVLGTV

SEQ ID NO: 62603 - protein, 10 aa, Artificial Sequence
  Description of Artificial Sequence: Synthetic peptide
  Seed: RVRIAYPSLR (MAGA4_HUMAN)
RFRIAYPSLV

SEQ ID NO: 62604 - protein, 9 aa, Artificial Sequence
  Description of Artificial Sequence: Synthetic peptide
  Seed: TVYGEPRKL (MAGA4_HUMAN)
TMYGEPRKI

SEQ ID NO: 62605 - protein, 9 aa, Artificial Sequence
  Description of Artificial Sequence: Synthetic peptide
  Seed: ESLKMIFGI (MAGA4_HUMAN)
EVLKMIFGL

SEQ ID NO: 62606 - protein, 9 aa, Artificial Sequence
  Description of Artificial Sequence: Synthetic peptide
  Seed: KASESLKMI (MAGA4_HUMAN)
KQSESLKMW

SEQ ID NO: 62607 - protein, 9 aa, Artificial Sequence
  Description of Artificial Sequence: Synthetic peptide
  Seed: YDGREHTVY (MAGA4_HUMAN)
YQGREHTVF

SEQ ID NO: 62608 - protein, 9 aa, Artificial Sequence
  Description of Artificial Sequence: Synthetic peptide
  Seed: SSPLVPGTL (MAGA4_HUMAN)
SGPLVPGTL

SEQ ID NO: 62609 - protein, 10 aa, Artificial Sequence
  Description of Artificial Sequence: Synthetic peptide
  Seed: RVRIAYPSLR (MAGA4_HUMAN)
RERIAYPSLK

SEQ ID NO: 62610 - protein, 9 aa, Artificial Sequence
  Description of Artificial Sequence: Synthetic peptide
  Seed: LKMIFGIDV (MAGA4_HUMAN)
LKMIFGIDY

SEQ ID NO: 62611 - protein, 9 aa, Artificial Sequence
  Description of Artificial Sequence: Synthetic peptide
  Seed: ARVRIAYPS (MAGA4_HUMAN)
ARVRIAYPM

SEQ ID NO: 62612 - protein, 9 aa, Artificial Sequence
  Description of Artificial Sequence: Synthetic peptide
  Seed: RQVPGSNPA (MAGA4_HUMAN)
REVPGSNPL

SEQ ID NO: 62613 - protein, 11 aa, Artificial Sequence
  Description of Artificial Sequence: Synthetic peptide
  Seed: RVNARVRIAYP (MAGA4_HUMAN)
RDNARVRIAYK

SEQ ID NO: 62614 - protein, 9 aa, Artificial Sequence
  Description of Artificial Sequence: Synthetic peptide
  Seed: GSNPARYEF (MAGA4_HUMAN)
GINPARYEF

SEQ ID NO: 62615 - protein, 9 aa, Artificial Sequence
  Description of Artificial Sequence: Synthetic peptide
  Seed: GSNPARYEF (MAGA4_HUMAN)
GQNPARYEL

SEQ ID NO: 62616 - protein, 9 aa, Artificial Sequence
  Description of Artificial Sequence: Synthetic peptide
  Seed: SPLVPGTLE (MAGA4_HUMAN)
SPLVPGTLM

SEQ ID NO: 62617 - protein, 9 aa, Artificial Sequence
  Description of Artificial Sequence: Synthetic peptide
  Seed: GTLEEVPAA (MAGA4_HUMAN)
GMLEEVPAM

SEQ ID NO: 62618 - protein, 9 aa, Artificial Sequence
  Description of Artificial Sequence: Synthetic peptide
  Seed: STSPDAESL (MAGA4_HUMAN)
SLSPDAESW

SEQ ID NO: 62619 - protein, 9 aa, Artificial Sequence
  Description of Artificial Sequence: Synthetic peptide
  Seed: GVYDGREHT (MAGA4_HUMAN)
GMYDGREHL

SEQ ID NO: 62620 - protein, 9 aa, Artificial Sequence
  Description of Artificial Sequence: Synthetic peptide
  Seed: KELVTKAEM (MAGA4_HUMAN)
KLLVTKAEF

SEQ ID NO: 62621 - protein, 10 aa, Artificial Sequence
  Description of Artificial Sequence: Synthetic peptide
  Seed: LLGNNQIFPK (MAGA4_HUMAN)
LVGNNQIFPR

SEQ ID NO: 62622 - protein, 10 aa, Artificial Sequence
  Description of Artificial Sequence: Synthetic peptide
  Seed: KVDELAHFLL (MAGA4_HUMAN)
KQDELAHFLM

SEQ ID NO: 62623 - protein, 9 aa, Artificial Sequence
  Description of Artificial Sequence: Synthetic peptide
  Seed: SALPTTISF (MAGA4_HUMAN)
SELPTTISY

SEQ ID NO: 62624 - protein, 10 aa, Artificial Sequence
  Description of Artificial Sequence: Synthetic peptide
  Seed: EMLERVIKNY (MAGA4_HUMAN)
EALERVIKNK

SEQ ID NO: 62625 - protein, 9 aa, Artificial Sequence
  Description of Artificial Sequence: Synthetic peptide
  Seed: TQDWVQENY (MAGA4_HUMAN)
TGDWVQENF

SEQ ID NO: 62626 - protein, 10 aa, Artificial Sequence
  Description of Artificial Sequence: Synthetic peptide
  Seed: KRCFPVIFGK (MAGA4_HUMAN)
KRCFPVIFGF

SEQ ID NO: 62627 - protein, 9 aa, Artificial Sequence
  Description of Artificial Sequence: Synthetic peptide
  Seed: ALSNKVDEL (MAGA4_HUMAN)
AQSNKVDEM

SEQ ID NO: 62628 - protein, 9 aa, Artificial Sequence
  Description of Artificial Sequence: Synthetic peptide
  Seed: ESLKMIFGI (MAGA4_HUMAN)
EMLKMIFGV

SEQ ID NO: 62629 - protein, 9 aa, Artificial Sequence
  Description of Artificial Sequence: Synthetic peptide
  Seed: RQVPGSNPA (MAGA4_HUMAN)
REVPGSNPY

SEQ ID NO: 62630 - protein, 9 aa, Artificial Sequence
  Description of Artificial Sequence: Synthetic peptide
  Seed: SYVKVLEHV (MAGA4_HUMAN)
STVKVLEHV

SEQ ID NO: 62631 - protein, 11 aa, Artificial Sequence
  Description of Artificial Sequence: Synthetic peptide
  Seed: YVKVLEHVVRV (MAGA4_HUMAN)
YMKVLEHVVRM

SEQ ID NO: 62632 - protein, 11 aa, Artificial Sequence
  Description of Artificial Sequence: Synthetic peptide
  Seed: RVRIAYPSLRE (MAGA4_HUMAN)
RTRIAYPSLRI

SEQ ID NO: 62633 - protein, 9 aa, Artificial Sequence
  Description of Artificial Sequence: Synthetic peptide
  Seed: LAHFLLRKY (MAGA4_HUMAN)
LMHFLLRKY

SEQ ID NO: 62634 - protein, 8 aa, Artificial Sequence
  Description of Artificial Sequence: Synthetic peptide
  Seed: ASALPTTI (MAGA4_HUMAN)
AAALPTTM

SEQ ID NO: 62635 - protein, 10 aa, Artificial Sequence
  Description of Artificial Sequence: Synthetic peptide
  Seed: KYRAKELVTK (MAGA4_HUMAN)
KMRAKELVTR

SEQ ID NO: 62636 - protein, 10 aa, Artificial Sequence
  Description of Artificial Sequence: Synthetic peptide
  Seed: TEEQEAAVSS (MAGA4_HUMAN)
TEEQEAAVSL

SEQ ID NO: 62637 - protein, 9 aa, Artificial Sequence
  Description of Artificial Sequence: Synthetic peptide
  Seed: KNYKRCFPV (MAGA4_HUMAN)
KVYKRCFPK

SEQ ID NO: 62638 - protein, 9 aa, Artificial Sequence
  Description of Artificial Sequence: Synthetic peptide
  Seed: DELAHFLLR (MAGA4_HUMAN)
DQLAHFLLK

SEQ ID NO: 62639 - protein, 10 aa, Artificial Sequence
  Description of Artificial Sequence: Synthetic peptide
  Seed: QIFPKTGLLI (MAGA4_HUMAN)
QRFPKTGLLF

SEQ ID NO: 62640 - protein, 10 aa, Artificial Sequence
  Description of Artificial Sequence: Synthetic peptide
  Seed: HVVRVNARVR (MAGA4_HUMAN)
HIVRVNARVR

SEQ ID NO: 62641 - protein, 11 aa, Artificial Sequence
  Description of Artificial Sequence: Synthetic peptide
  Seed: ARVRIAYPSLR (MAGA4_HUMAN)
ASVRIAYPSLR

SEQ ID NO: 62642 - protein, 9 aa, Artificial Sequence
  Description of Artificial Sequence: Synthetic peptide
  Seed: KNYKRCFPV (MAGA4_HUMAN)
KIYKRCFPK

SEQ ID NO: 62643 - protein, 10 aa, Artificial Sequence
  Description of Artificial Sequence: Synthetic peptide
  Seed: YRQVPGSNPA (MAGA4_HUMAN)
YQQVPGSNPL

SEQ ID NO: 62644 - protein, 9 aa, Artificial Sequence
  Description of Artificial Sequence: Synthetic peptide
  Seed: TQDWVQENY (MAGA4_HUMAN)
TMDWVQENY

SEQ ID NO: 62645 - protein, 10 aa, Artificial Sequence
  Description of Artificial Sequence: Synthetic peptide
  Seed: RVNARVRIAY (MAGA4_HUMAN)
RYNARVRIAK

SEQ ID NO: 62646 - protein, 9 aa, Artificial Sequence
  Description of Artificial Sequence: Synthetic peptide
  Seed: NQIFPKTGL (MAGA4_HUMAN)
NLIFPKTGY

SEQ ID NO: 62647 - protein, 10 aa, Artificial Sequence
  Description of Artificial Sequence: Synthetic peptide
  Seed: ARVRIAYPSL (MAGA4_HUMAN)
ACVRIAYPSK

SEQ ID NO: 62648 - protein, 9 aa, Artificial Sequence
  Description of Artificial Sequence: Synthetic peptide
  Seed: AAVSSSSPL (MAGA4_HUMAN)
ARVSSSSPM

SEQ ID NO: 62649 - protein, 10 aa, Artificial Sequence
  Description of Artificial Sequence: Synthetic peptide
  Seed: EHTVYGEPRK (MAGA4_HUMAN)
EMTVYGEPRR

SEQ ID NO: 62650 - protein, 10 aa, Artificial Sequence
  Description of Artificial Sequence: Synthetic peptide
  Seed: TTISFTCWRQ (MAGA4_HUMAN)
TTISFTCWRS

SEQ ID NO: 62651 - protein, 11 aa, Artificial Sequence
  Description of Artificial Sequence: Synthetic peptide
  Seed: GVYDGREHTVY (MAGA4_HUMAN)
GAYDGREHTVF

SEQ ID NO: 62652 - protein, 9 aa, Artificial Sequence
  Description of Artificial Sequence: Synthetic peptide
  Seed: SSPLVPGTL (MAGA4_HUMAN)
SSPLVPGTV

SEQ ID NO: 62653 - protein, 10 aa, Artificial Sequence
  Description of Artificial Sequence: Synthetic peptide
  Seed: STSPDAESLF (MAGA4_HUMAN)
SMSPDAESLW

SEQ ID NO: 62654 - protein, 9 aa, Artificial Sequence
  Description of Artificial Sequence: Synthetic peptide
  Seed: RVNARVRIA (MAGA4_HUMAN)
RANARVRIV

SEQ ID NO: 62655 - protein, 9 aa, Artificial Sequence
  Description of Artificial Sequence: Synthetic peptide
  Seed: DPASNTYTL (MAGA4_HUMAN)
DAASNTYTM

SEQ ID NO: 62656 - protein, 9 aa, Artificial Sequence
  Description of Artificial Sequence: Synthetic peptide
  Seed: GSNPARYEF (MAGA4_HUMAN)
GANPARYEL

SEQ ID NO: 62657 - protein, 9 aa, Artificial Sequence
  Description of Artificial Sequence: Synthetic peptide
  Seed: AAVSSSSPL (MAGA4_HUMAN)
AYVSSSSPF

SEQ ID NO: 62658 - protein, 9 aa, Artificial Sequence
  Description of Artificial Sequence: Synthetic peptide
  Seed: IIVLGTIAM (MAGA4_HUMAN)
ISVLGTIAY

SEQ ID NO: 62659 - protein, 9 aa, Artificial Sequence
  Description of Artificial Sequence: Synthetic peptide
  Seed: RQVPGSNPA (MAGA4_HUMAN)
RGVPGSNPF

SEQ ID NO: 62660 - protein, 9 aa, Artificial Sequence
  Description of Artificial Sequence: Synthetic peptide
  Seed: SYVKVLEHV (MAGA4_HUMAN)
SMVKVLEHI

SEQ ID NO: 62661 - protein, 9 aa, Artificial Sequence
  Description of Artificial Sequence: Synthetic peptide
  Seed: TTEEQEAAV (MAGA4_HUMAN)
TLEEQEAAM

SEQ ID NO: 62662 - protein, 10 aa, Artificial Sequence
  Description of Artificial Sequence: Synthetic peptide
  Seed: TSPDAESLFR (MAGA4_HUMAN)
TVPDAESLFK

SEQ ID NO: 62663 - protein, 9 aa, Artificial Sequence
  Description of Artificial Sequence: Synthetic peptide
  Seed: KVLEHVVRV (MAGA4_HUMAN)
KMLEHVVRC

SEQ ID NO: 62664 - protein, 10 aa, Artificial Sequence
  Description of Artificial Sequence: Synthetic peptide
  Seed: VDPASNTYTL (MAGA4_HUMAN)
VEPASNTYTF

SEQ ID NO: 62665 - protein, 9 aa, Artificial Sequence
  Description of Artificial Sequence: Synthetic peptide
  Seed: IAYPSLREA (MAGA4_HUMAN)
IVYPSLREL

SEQ ID NO: 62666 - protein, 11 aa, Artificial Sequence
  Description of Artificial Sequence: Synthetic peptide
  Seed: IAMEGDSASEE (MAGA4_HUMAN)
IAMEGDSASEM

SEQ ID NO: 62667 - protein, 9 aa, Artificial Sequence
  Description of Artificial Sequence: Synthetic peptide
  Seed: LVPGTLEEV (MAGA4_HUMAN)
LAPGTLEEV

SEQ ID NO: 62668 - protein, 9 aa, Artificial Sequence
  Description of Artificial Sequence: Synthetic peptide
  Seed: NKVDELAHF (MAGA4_HUMAN)
NHVDELAHL

SEQ ID NO: 62669 - protein, 9 aa, Artificial Sequence
  Description of Artificial Sequence: Synthetic peptide
  Seed: SSPLVPGTL (MAGA4_HUMAN)
SAPLVPGTY

SEQ ID NO: 62670 - protein, 9 aa, Artificial Sequence
  Description of Artificial Sequence: Synthetic peptide
  Seed: YKRCFPVIF (MAGA4_HUMAN)
YQRCFPVIV

SEQ ID NO: 62671 - protein, 9 aa, Artificial Sequence
  Description of Artificial Sequence: Synthetic peptide
  Seed: VYDGREHTV (MAGA4_HUMAN)
VYDGREHTM

SEQ ID NO: 62672 - protein, 9 aa, Artificial Sequence
  Description of Artificial Sequence: Synthetic peptide
  Seed: RVNARVRIA (MAGA4_HUMAN)
RINARVRIA

SEQ ID NO: 62673 - protein, 10 aa, Artificial Sequence
  Description of Artificial Sequence: Synthetic peptide
  Seed: EAAVSSSSPL (MAGA4_HUMAN)
ELAVSSSSPR

SEQ ID NO: 62674 - protein, 9 aa, Artificial Sequence
  Description of Artificial Sequence: Synthetic peptide
  Seed: YPSLREAAL (MAGA4_HUMAN)
YTSLREAAI

SEQ ID NO: 62675 - protein, 10 aa, Artificial Sequence
  Description of Artificial Sequence: Synthetic peptide
  Seed: AESLFREALS (MAGA4_HUMAN)
AESLFREALM

SEQ ID NO: 62676 - protein, 10 aa, Artificial Sequence
  Description of Artificial Sequence: Synthetic peptide
  Seed: GVYDGREHTV (MAGA4_HUMAN)
GQYDGREHTI

SEQ ID NO: 62677 - protein, 9 aa, Artificial Sequence
  Description of Artificial Sequence: Synthetic peptide
  Seed: SAGPPQSPQ (MAGA4_HUMAN)
SVGPPQSPL

SEQ ID NO: 62678 - protein, 9 aa, Artificial Sequence
  Description of Artificial Sequence: Synthetic peptide
  Seed: SALPTTISF (MAGA4_HUMAN)
SVLPTTISY

SEQ ID NO: 62679 - protein, 9 aa, Artificial Sequence
  Description of Artificial Sequence: Synthetic peptide
  Seed: KVDELAHFL (MAGA4_HUMAN)
KYDELAHFF

SEQ ID NO: 62680 - protein, 10 aa, Artificial Sequence
  Description of Artificial Sequence: Synthetic peptide
  Seed: YRQVPGSNPA (MAGA4_HUMAN)
YHQVPGSNPY

SEQ ID NO: 62681 - protein, 9 aa, Artificial Sequence
  Description of Artificial Sequence: Synthetic peptide
  Seed: AAVSSSSPL (MAGA4_HUMAN)
AQVSSSSPM

SEQ ID NO: 62682 - protein, 10 aa, Artificial Sequence
  Description of Artificial Sequence: Synthetic peptide
  Seed: LGVMGVYDGR (MAGA4_HUMAN)
LAVMGVYDGR

SEQ ID NO: 62683 - protein, 10 aa, Artificial Sequence
  Description of Artificial Sequence: Synthetic peptide
  Seed: GVYDGREHTV (MAGA4_HUMAN)
GEYDGREHTF

SEQ ID NO: 62684 - protein, 10 aa, Artificial Sequence
  Description of Artificial Sequence: Synthetic peptide
  Seed: TTISFTCWRQ (MAGA4_HUMAN)
TVISFTCWRW

SEQ ID NO: 62685 - protein, 9 aa, Artificial Sequence
  Description of Artificial Sequence: Synthetic peptide
  Seed: NKVDELAHF (MAGA4_HUMAN)
NHVDELAHM

SEQ ID NO: 62686 - protein, 9 aa, Artificial Sequence
  Description of Artificial Sequence: Synthetic peptide
  Seed: SYVKVLEHV (MAGA4_HUMAN)
SLVKVLEHI

SEQ ID NO: 62687 - protein, 9 aa, Artificial Sequence
  Description of Artificial Sequence: Synthetic peptide
  Seed: VNARVRIAY (MAGA4_HUMAN)
VTARVRIAM

SEQ ID NO: 62688 - protein, 10 aa, Artificial Sequence
  Description of Artificial Sequence: Synthetic peptide
  Seed: YRQVPGSNPA (MAGA4_HUMAN)
YKQVPGSNPV

SEQ ID NO: 62689 - protein, 11 aa, Artificial Sequence
  Description of Artificial Sequence: Synthetic peptide
  Seed: AQAPTTEEQEA (MAGA4_HUMAN)
AIAPTTEEQEL

SEQ ID NO: 62690 - protein, 9 aa, Artificial Sequence
  Description of Artificial Sequence: Synthetic peptide
  Seed: EVDPASNTY (MAGA4_HUMAN)
ELDPASNTY

SEQ ID NO: 62691 - protein, 8 aa, Artificial Sequence
  Description of Artificial Sequence: Synthetic peptide
  Seed: RVRIAYPS (MAGA4_HUMAN)
RFRIAYPK

SEQ ID NO: 62692 - protein, 9 aa, Artificial Sequence
  Description of Artificial Sequence: Synthetic peptide
  Seed: KVDELAHFL (MAGA4_HUMAN)
KDDELAHFF

SEQ ID NO: 62693 - protein, 9 aa, Artificial Sequence
  Description of Artificial Sequence: Synthetic peptide
  Seed: KYRAKELVT (MAGA4_HUMAN)
KIRAKELVV

SEQ ID NO: 62694 - protein, 10 aa, Artificial Sequence
  Description of Artificial Sequence: Synthetic peptide
  Seed: KRCFPVIFGK (MAGA4_HUMAN)
KQCFPVIFGR

SEQ ID NO: 62695 - protein, 10 aa, Artificial Sequence
  Description of Artificial Sequence: Synthetic peptide
  Seed: RVRIAYPSLR (MAGA4_HUMAN)
RCRIAYPSLM

SEQ ID NO: 62696 - protein, 9 aa, Artificial Sequence
  Description of Artificial Sequence: Synthetic peptide
  Seed: KYRAKELVT (MAGA4_HUMAN)
KIRAKELVI

SEQ ID NO: 62697 - protein, 9 aa, Artificial Sequence
  Description of Artificial Sequence: Synthetic peptide
  Seed: SYVKVLEHV (MAGA4_HUMAN)
SQVKVLEHL

SEQ ID NO: 62698 - protein, 9 aa, Artificial Sequence
  Description of Artificial Sequence: Synthetic peptide
  Seed: KASESLKMI (MAGA4_HUMAN)
KTSESLKMF

SEQ ID NO: 62699 - protein, 9 aa, Artificial Sequence
  Description of Artificial Sequence: Synthetic peptide
  Seed: YPSLREAAL (MAGA4_HUMAN)
YPSLREAAT

SEQ ID NO: 62700 - protein, 9 aa, Artificial Sequence
  Description of Artificial Sequence: Synthetic peptide
  Seed: WVQENYLEY (MAGA4_HUMAN)
WWQENYLEM

SEQ ID NO: 62701 - protein, 10 aa, Artificial Sequence
  Description of Artificial Sequence: Synthetic peptide
  Seed: YRQVPGSNPA (MAGA4_HUMAN)
YHQVPGSNPL

SEQ ID NO: 62702 - protein, 9 aa, Artificial Sequence
  Description of Artificial Sequence: Synthetic peptide
  Seed: SYVKVLEHV (MAGA4_HUMAN)
SYVKVLEHI

SEQ ID NO: 62703 - protein, 9 aa, Artificial Sequence
  Description of Artificial Sequence: Synthetic peptide
  Seed: KVLEHVVRV (MAGA4_HUMAN)
KMLEHVVRV

SEQ ID NO: 62704 - protein, 9 aa, Artificial Sequence
  Description of Artificial Sequence: Synthetic peptide
  Seed: AESLFREAL (MAGA4_HUMAN)
AESLFREAA

SEQ ID NO: 62705 - protein, 9 aa, Artificial Sequence
  Description of Artificial Sequence: Synthetic peptide
  Seed: VYGEPRKLL (MAGA4_HUMAN)
VAGEPRKLF

SEQ ID NO: 62706 - protein, 9 aa, Artificial Sequence
  Description of Artificial Sequence: Synthetic peptide
  Seed: AAVSSSSPL (MAGA4_HUMAN)
APVSSSSPL

SEQ ID NO: 62707 - protein, 9 aa, Artificial Sequence
  Description of Artificial Sequence: Synthetic peptide
  Seed: YPSLREAAL (MAGA4_HUMAN)
YMSLREAAI

SEQ ID NO: 62708 - protein, 9 aa, Artificial Sequence
  Description of Artificial Sequence: Synthetic peptide
  Seed: HTVYGEPRK (MAGA4_HUMAN)
HTVYGEPRR

SEQ ID NO: 62709 - protein, 9 aa, Artificial Sequence
  Description of Artificial Sequence: Synthetic peptide
  Seed: AQEEALGLV (MAGA4_HUMAN)
AEEEALGLM

SEQ ID NO: 62710 - protein, 9 aa, Artificial Sequence
  Description of Artificial Sequence: Synthetic peptide
  Seed: SYVKVLEHV (MAGA4_HUMAN)
SQVKVLEHI

SEQ ID NO: 62711 - protein, 10 aa, Artificial Sequence
  Description of Artificial Sequence: Synthetic peptide
  Seed: AYPSLREAAL (MAGA4_HUMAN)
AEPSLREAAL

SEQ ID NO: 62712 - protein, 10 aa, Artificial Sequence
  Description of Artificial Sequence: Synthetic peptide
  Seed: VIFGKASESL (MAGA4_HUMAN)
VTFGKASESY

SEQ ID NO: 62713 - protein, 11 aa, Artificial Sequence
  Description of Artificial Sequence: Synthetic peptide
  Seed: MEGDSASEEEI (MAGA4_HUMAN)
MQGDSASEEEF

SEQ ID NO: 62714 - protein, 11 aa, Artificial Sequence
  Description of Artificial Sequence: Synthetic peptide
  Seed: SLFREALSNKV (MAGA4_HUMAN)
SMFREALSNKV

SEQ ID NO: 62715 - protein, 9 aa, Artificial Sequence
  Description of Artificial Sequence: Synthetic peptide
  Seed: VYDGREHTV (MAGA4_HUMAN)
VIDGREHTC

SEQ ID NO: 62716 - protein, 9 aa, Artificial Sequence
  Description of Artificial Sequence: Synthetic peptide
  Seed: RAKELVTKA (MAGA4_HUMAN)
RMKELVTKV

SEQ ID NO: 62717 - protein, 9 aa, Artificial Sequence
  Description of Artificial Sequence: Synthetic peptide
  Seed: ELAHFLLRK (MAGA4_HUMAN)
ETAHFLLRL

SEQ ID NO: 62718 - protein, 9 aa, Artificial Sequence
  Description of Artificial Sequence: Synthetic peptide
  Seed: AAVSSSSPL (MAGA4_HUMAN)
APVSSSSPM

SEQ ID NO: 62719 - protein, 9 aa, Artificial Sequence
  Description of Artificial Sequence: Synthetic peptide
  Seed: KVDELAHFL (MAGA4_HUMAN)
KMDELAHFY

SEQ ID NO: 62720 - protein, 10 aa, Artificial Sequence
  Description of Artificial Sequence: Synthetic peptide
  Seed: VDPASNTYTL (MAGA4_HUMAN)
VNPASNTYTM

SEQ ID NO: 62721 - protein, 11 aa, Artificial Sequence
  Description of Artificial Sequence: Synthetic peptide
  Seed: RQVPGSNPARY (MAGA4_HUMAN)
RQVPGSNPARI

SEQ ID NO: 62722 - protein, 9 aa, Artificial Sequence
  Description of Artificial Sequence: Synthetic peptide
  Seed: ALSNKVDEL (MAGA4_HUMAN)
AASNKVDEL

SEQ ID NO: 62723 - protein, 9 aa, Artificial Sequence
  Description of Artificial Sequence: Synthetic peptide
  Seed: YVKVLEHVV (MAGA4_HUMAN)
YSKVLEHVL

SEQ ID NO: 62724 - protein, 10 aa, Artificial Sequence
  Description of Artificial Sequence: Synthetic peptide
  Seed: STSPDAESLF (MAGA4_HUMAN)
SQSPDAESLL

SEQ ID NO: 62725 - protein, 10 aa, Artificial Sequence
  Description of Artificial Sequence: Synthetic peptide
  Seed: ARVRIAYPSL (MAGA4_HUMAN)
ARVRIAYPSI

SEQ ID NO: 62726 - protein, 9 aa, Artificial Sequence
  Description of Artificial Sequence: Synthetic peptide
  Seed: RVRIAYPSL (MAGA4_HUMAN)
RMRIAYPSA

SEQ ID NO: 62727 - protein, 10 aa, Artificial Sequence
  Description of Artificial Sequence: Synthetic peptide
  Seed: ASALPTTISF (MAGA4_HUMAN)
ATALPTTISW

SEQ ID NO: 62728 - protein, 10 aa, Artificial Sequence
  Description of Artificial Sequence: Synthetic peptide
  Seed: IAYPSLREAA (MAGA4_HUMAN)
IAYPSLREAY

SEQ ID NO: 62729 - protein, 10 aa, Artificial Sequence
  Description of Artificial Sequence: Synthetic peptide
  Seed: KVDELAHFLL (MAGA4_HUMAN)
KTDELAHFLY

SEQ ID NO: 62730 - protein, 10 aa, Artificial Sequence
  Description of Artificial Sequence: Synthetic peptide
  Seed: IAYPSLREAA (MAGA4_HUMAN)
IPYPSLREAL

SEQ ID NO: 62731 - protein, 10 aa, Artificial Sequence
  Description of Artificial Sequence: Synthetic peptide
  Seed: MIFGIDVKEV (MAGA4_HUMAN)
MLFGIDVKEL

SEQ ID NO: 62732 - protein, 9 aa, Artificial Sequence
  Description of Artificial Sequence: Synthetic peptide
  Seed: RVRIAYPSL (MAGA4_HUMAN)
RPRIAYPSV

SEQ ID NO: 62733 - protein, 10 aa, Artificial Sequence
  Description of Artificial Sequence: Synthetic peptide
  Seed: YPSLREAALL (MAGA4_HUMAN)
YQSLREAALW

SEQ ID NO: 62734 - protein, 9 aa, Artificial Sequence
  Description of Artificial Sequence: Synthetic peptide
  Seed: VNARVRIAY (MAGA4_HUMAN)
VFARVRIAY

SEQ ID NO: 62735 - protein, 11 aa, Artificial Sequence
  Description of Artificial Sequence: Synthetic peptide
  Seed: YTLVTCLGLSY (MAGA4_HUMAN)
YSLVTCLGLSW

SEQ ID NO: 62736 - protein, 9 aa, Artificial Sequence
  Description of Artificial Sequence: Synthetic peptide
  Seed: NKVDELAHF (MAGA4_HUMAN)
NRVDELAHL

SEQ ID NO: 62737 - protein, 9 aa, Artificial Sequence
  Description of Artificial Sequence: Synthetic peptide
  Seed: IIVLGTIAM (MAGA4_HUMAN)
IAVLGTIAI

SEQ ID NO: 62738 - protein, 10 aa, Artificial Sequence
  Description of Artificial Sequence: Synthetic peptide
  Seed: YPSLREAALL (MAGA4_HUMAN)
YCSLREAALF

SEQ ID NO: 62739 - protein, 9 aa, Artificial Sequence
  Description of Artificial Sequence: Synthetic peptide
  Seed: RVRIAYPSL (MAGA4_HUMAN)
RARIAYPSP

SEQ ID NO: 62740 - protein, 9 aa, Artificial Sequence
  Description of Artificial Sequence: Synthetic peptide
  Seed: LKMIFGIDV (MAGA4_HUMAN)
LAMIFGIDY

SEQ ID NO: 62741 - protein, 11 aa, Artificial Sequence
  Description of Artificial Sequence: Synthetic peptide
  Seed: ELGVMGVYDGR (MAGA4_HUMAN)
ERGVMGVYDGR

SEQ ID NO: 62742 - protein, 9 aa, Artificial Sequence
  Description of Artificial Sequence: Synthetic peptide
  Seed: AAVSSSSPL (MAGA4_HUMAN)
AQVSSSSPL

SEQ ID NO: 62743 - protein, 10 aa, Artificial Sequence
  Description of Artificial Sequence: Synthetic peptide
  Seed: RVRIAYPSLR (MAGA4_HUMAN)
RPRIAYPSLY

SEQ ID NO: 62744 - protein, 8 aa, Artificial Sequence
  Description of Artificial Sequence: Synthetic peptide
  Seed: REALSNKV (MAGA4_HUMAN)
RDALSNKF

SEQ ID NO: 62745 - protein, 9 aa, Artificial Sequence
  Description of Artificial Sequence: Synthetic peptide
  Seed: EVDPASNTY (MAGA4_HUMAN)
EMDPASNTY

SEQ ID NO: 62746 - protein, 9 aa, Artificial Sequence
  Description of Artificial Sequence: Synthetic peptide
  Seed: QEAAVSSSS (MAGA4_HUMAN)
QEAAVSSSC

SEQ ID NO: 62747 - protein, 10 aa, Artificial Sequence
  Description of Artificial Sequence: Synthetic peptide
  Seed: RVRIAYPSLR (MAGA4_HUMAN)
RPRIAYPSLM

SEQ ID NO: 62748 - protein, 9 aa, Artificial Sequence
  Description of Artificial Sequence: Synthetic peptide
  Seed: TEEQEAAVS (MAGA4_HUMAN)
TEEQEAAVT

SEQ ID NO: 62749 - protein, 9 aa, Artificial Sequence
  Description of Artificial Sequence: Synthetic peptide
  Seed: IAYPSLREA (MAGA4_HUMAN)
IQYPSLREM

SEQ ID NO: 62750 - protein, 10 aa, Artificial Sequence
  Description of Artificial Sequence: Synthetic peptide
  Seed: KEVDPASNTY (MAGA4_HUMAN)
KVVDPASNTL

SEQ ID NO: 62751 - protein, 10 aa, Artificial Sequence
  Description of Artificial Sequence: Synthetic peptide
  Seed: YPSLREAALL (MAGA4_HUMAN)
YMSLREAALY

SEQ ID NO: 62752 - protein, 9 aa, Artificial Sequence
  Description of Artificial Sequence: Synthetic peptide
  Seed: RVRIAYPSL (MAGA4_HUMAN)
RWRIAYPSM

SEQ ID NO: 62753 - protein, 10 aa, Artificial Sequence
  Description of Artificial Sequence: Synthetic peptide
  Seed: WEELGVMGVY (MAGA4_HUMAN)
WKELGVMGVY

SEQ ID NO: 62754 - protein, 10 aa, Artificial Sequence
  Description of Artificial Sequence: Synthetic peptide
  Seed: TLVTCLGLSY (MAGA4_HUMAN)
TLVTCLGLSF

SEQ ID NO: 62755 - protein, 9 aa, Artificial Sequence
  Description of Artificial Sequence: Synthetic peptide
  Seed: IFPKTGLLI (MAGA4_HUMAN)
IAPKTGLLF

SEQ ID NO: 62756 - protein, 10 aa, Artificial Sequence
  Description of Artificial Sequence: Synthetic peptide
  Seed: RVNARVRIAY (MAGA4_HUMAN)
RKNARVRIAM

SEQ ID NO: 62757 - protein, 11 aa, Artificial Sequence
  Description of Artificial Sequence: Synthetic peptide
  Seed: SPLVPGTLEEV (MAGA4_HUMAN)
SPLVPGTLEEL

SEQ ID NO: 62758 - protein, 10 aa, Artificial Sequence
  Description of Artificial Sequence: Synthetic peptide
  Seed: KVLEHVVRVN (MAGA4_HUMAN)
KMLEHVVRVP

SEQ ID NO: 62759 - protein, 9 aa, Artificial Sequence
  Description of Artificial Sequence: Synthetic peptide
  Seed: RCFPVIFGK (MAGA4_HUMAN)
RVFPVIFGV

SEQ ID NO: 62760 - protein, 9 aa, Artificial Sequence
  Description of Artificial Sequence: Synthetic peptide
  Seed: RVRIAYPSL (MAGA4_HUMAN)
RVRIAYPSK

SEQ ID NO: 62761 - protein, 9 aa, Artificial Sequence
  Description of Artificial Sequence: Synthetic peptide
  Seed: SPDAESLFR (MAGA4_HUMAN)
SLDAESLFY

SEQ ID NO: 62762 - protein, 10 aa, Artificial Sequence
  Description of Artificial Sequence: Synthetic peptide
  Seed: RVRIAYPSLR (MAGA4_HUMAN)
RYRIAYPSLY

SEQ ID NO: 62763 - protein, 9 aa, Artificial Sequence
  Description of Artificial Sequence: Synthetic peptide
  Seed: WVQENYLEY (MAGA4_HUMAN)
WKQENYLEF

SEQ ID NO: 62764 - protein, 9 aa, Artificial Sequence
  Description of Artificial Sequence: Synthetic peptide
  Seed: SEEEIWEEL (MAGA4_HUMAN)
SEEEIWEEA

SEQ ID NO: 62765 - protein, 9 aa, Artificial Sequence
  Description of Artificial Sequence: Synthetic peptide
  Seed: AEMLERVIK (MAGA4_HUMAN)
AEMLERVIP

SEQ ID NO: 62766 - protein, 10 aa, Artificial Sequence
  Description of Artificial Sequence: Synthetic peptide
  Seed: ASALPTTISF (MAGA4_HUMAN)
ATALPTTISY

SEQ ID NO: 62767 - protein, 9 aa, Artificial Sequence
  Description of Artificial Sequence: Synthetic peptide
  Seed: YKRCFPVIF (MAGA4_HUMAN)
YERCFPVIY

SEQ ID NO: 62768 - protein, 10 aa, Artificial Sequence
  Description of Artificial Sequence: Synthetic peptide
  Seed: KEVDPASNTY (MAGA4_HUMAN)
KVVDPASNTI

SEQ ID NO: 62769 - protein, 9 aa, Artificial Sequence
  Description of Artificial Sequence: Synthetic peptide
  Seed: RVRIAYPSL (MAGA4_HUMAN)
RSRIAYPSM

SEQ ID NO: 62770 - protein, 9 aa, Artificial Sequence
  Description of Artificial Sequence: Synthetic peptide
  Seed: RVRIAYPSL (MAGA4_HUMAN)
RGRIAYPSK

SEQ ID NO: 62771 - protein, 9 aa, Artificial Sequence
  Description of Artificial Sequence: Synthetic peptide
  Seed: TQDWVQENY (MAGA4_HUMAN)
TQDWVQENW

SEQ ID NO: 62772 - protein, 9 aa, Artificial Sequence
  Description of Artificial Sequence: Synthetic peptide
  Seed: QIFPKTGLL (MAGA4_HUMAN)
QNFPKTGLY

SEQ ID NO: 62773 - protein, 10 aa, Artificial Sequence
  Description of Artificial Sequence: Synthetic peptide
  Seed: LGVMGVYDGR (MAGA4_HUMAN)
LMVMGVYDGR

SEQ ID NO: 62774 - protein, 9 aa, Artificial Sequence
  Description of Artificial Sequence: Synthetic peptide
  Seed: IAYPSLREA (MAGA4_HUMAN)
IAYPSLREI

SEQ ID NO: 62775 - protein, 9 aa, Artificial Sequence
  Description of Artificial Sequence: Synthetic peptide
  Seed: GVMGVYDGR (MAGA4_HUMAN)
GSMGVYDGK

SEQ ID NO: 62776 - protein, 9 aa, Artificial Sequence
  Description of Artificial Sequence: Synthetic peptide
  Seed: SPDAESLFR (MAGA4_HUMAN)
SMDAESLFY

SEQ ID NO: 62777 - protein, 11 aa, Artificial Sequence
  Description of Artificial Sequence: Synthetic peptide
  Seed: STSPDAESLFR (MAGA4_HUMAN)
SASPDAESLFK

SEQ ID NO: 62778 - protein, 9 aa, Artificial Sequence
  Description of Artificial Sequence: Synthetic peptide
  Seed: LVPGTLEEV (MAGA4_HUMAN)
LSPGTLEEM

SEQ ID NO: 62779 - protein, 9 aa, Artificial Sequence
  Description of Artificial Sequence: Synthetic peptide
  Seed: RAKELVTKA (MAGA4_HUMAN)
RTKELVTKL

SEQ ID NO: 62780 - protein, 9 aa, Artificial Sequence
  Description of Artificial Sequence: Synthetic peptide
  Seed: KASESLKMI (MAGA4_HUMAN)
KTSESLKMM

SEQ ID NO: 62781 - protein, 10 aa, Artificial Sequence
  Description of Artificial Sequence: Synthetic peptide
  Seed: EMLERVIKNY (MAGA4_HUMAN)
EVLERVIKNW

SEQ ID NO: 62782 - protein, 9 aa, Artificial Sequence
  Description of Artificial Sequence: Synthetic peptide
  Seed: YVKVLEHVV (MAGA4_HUMAN)
YSKVLEHVM

SEQ ID NO: 62783 - protein, 10 aa, Artificial Sequence
  Description of Artificial Sequence: Synthetic peptide
  Seed: KYRAKELVTK (MAGA4_HUMAN)
KSRAKELVTK

SEQ ID NO: 62784 - protein, 9 aa, Artificial Sequence
  Description of Artificial Sequence: Synthetic peptide
  Seed: REALSNKVD (MAGA4_HUMAN)
REALSNKVV

SEQ ID NO: 62785 - protein, 10 aa, Artificial Sequence
  Description of Artificial Sequence: Synthetic peptide
  Seed: KNYKRCFPVI (MAGA4_HUMAN)
KFYKRCFPVF

SEQ ID NO: 62786 - protein, 10 aa, Artificial Sequence
  Description of Artificial Sequence: Synthetic peptide
  Seed: EHTVYGEPRK (MAGA4_HUMAN)
EVTVYGEPRR

SEQ ID NO: 62787 - protein, 9 aa, Artificial Sequence
  Description of Artificial Sequence: Synthetic peptide
  Seed: KVLEHVVRV (MAGA4_HUMAN)
KYLEHVVRL

SEQ ID NO: 62788 - protein, 9 aa, Artificial Sequence
  Description of Artificial Sequence: Synthetic peptide
  Seed: ESLKMIFGI (MAGA4_HUMAN)
ETLKMIFGL

SEQ ID NO: 62789 - protein, 10 aa, Artificial Sequence
  Description of Artificial Sequence: Synthetic peptide
  Seed: YPSLREAALL (MAGA4_HUMAN)
YGSLREAALW

SEQ ID NO: 62790 - protein, 9 aa, Artificial Sequence
  Description of Artificial Sequence: Synthetic peptide
  Seed: RVRIAYPSL (MAGA4_HUMAN)
RIRIAYPSR

SEQ ID NO: 62791 - protein, 9 aa, Artificial Sequence
  Description of Artificial Sequence: Synthetic peptide
  Seed: EAQEEALGL (MAGA4_HUMAN)
ELQEEALGR

SEQ ID NO: 62792 - protein, 9 aa, Artificial Sequence
  Description of Artificial Sequence: Synthetic peptide
  Seed: KVLEHVVRV (MAGA4_HUMAN)
KYLEHVVRY

SEQ ID NO: 62793 - protein, 9 aa, Artificial Sequence
  Description of Artificial Sequence: Synthetic peptide
  Seed: SYVKVLEHV (MAGA4_HUMAN)
STVKVLEHM

SEQ ID NO: 62794 - protein, 10 aa, Artificial Sequence
  Description of Artificial Sequence: Synthetic peptide
  Seed: TSYVKVLEHV (MAGA4_HUMAN)
TPYVKVLEHL

SEQ ID NO: 62795 - protein, 10 aa, Artificial Sequence
  Description of Artificial Sequence: Synthetic peptide
  Seed: SSEQKSQHCK (MAGA4_HUMAN)
SMEQKSQHCY

SEQ ID NO: 62796 - protein, 9 aa, Artificial Sequence
  Description of Artificial Sequence: Synthetic peptide
  Seed: SALPTTISF (MAGA4_HUMAN)
SLLPTTISI

SEQ ID NO: 62797 - protein, 10 aa, Artificial Sequence
  Description of Artificial Sequence: Synthetic peptide
  Seed: GDSASEEEIW (MAGA4_HUMAN)
GESASEEEIF

SEQ ID NO: 62798 - protein, 9 aa, Artificial Sequence
  Description of Artificial Sequence: Synthetic peptide
  Seed: KVDELAHFL (MAGA4_HUMAN)
KVDELAHFM

SEQ ID NO: 62799 - protein, 9 aa, Artificial Sequence
  Description of Artificial Sequence: Synthetic peptide
  Seed: GSNPARYEF (MAGA4_HUMAN)
GINPARYEW

SEQ ID NO: 62800 - protein, 9 aa, Artificial Sequence
  Description of Artificial Sequence: Synthetic peptide
  Seed: DPASNTYTL (MAGA4_HUMAN)
DAASNTYTL

SEQ ID NO: 62801 - protein, 10 aa, Artificial Sequence
  Description of Artificial Sequence: Synthetic peptide
  Seed: RVRIAYPSLR (MAGA4_HUMAN)
RERIAYPSLL

SEQ ID NO: 62802 - protein, 9 aa, Artificial Sequence
  Description of Artificial Sequence: Synthetic peptide
  Seed: ELAHFLLRK (MAGA4_HUMAN)
EIAHFLLRY

SEQ ID NO: 62803 - protein, 9 aa, Artificial Sequence
  Description of Artificial Sequence: Synthetic peptide
  Seed: GTLEEVPAA (MAGA4_HUMAN)
GQLEEVPAA

SEQ ID NO: 62804 - protein, 11 aa, Artificial Sequence
  Description of Artificial Sequence: Synthetic peptide
  Seed: NARVRIAYPSL (MAGA4_HUMAN)
NLRVRIAYPSL

SEQ ID NO: 62805 - protein, 9 aa, Artificial Sequence
  Description of Artificial Sequence: Synthetic peptide
  Seed: NPARYEFLW (MAGA4_HUMAN)
NAARYEFLY

SEQ ID NO: 62806 - protein, 11 aa, Artificial Sequence
  Description of Artificial Sequence: Synthetic peptide
  Seed: YVKVLEHVVRV (MAGA4_HUMAN)
YWKVLEHVVRV

SEQ ID NO: 62807 - protein, 9 aa, Artificial Sequence
  Description of Artificial Sequence: Synthetic peptide
  Seed: TQDWVQENY (MAGA4_HUMAN)
TLDWVQENF

SEQ ID NO: 62808 - protein, 10 aa, Artificial Sequence
  Description of Artificial Sequence: Synthetic peptide
  Seed: QIFPKTGLLI (MAGA4_HUMAN)
QFFPKTGLLW

SEQ ID NO: 62809 - protein, 10 aa, Artificial Sequence
  Description of Artificial Sequence: Synthetic peptide
  Seed: GVYDGREHTV (MAGA4_HUMAN)
GIYDGREHTF

SEQ ID NO: 62810 - protein, 9 aa, Artificial Sequence
  Description of Artificial Sequence: Synthetic peptide
  Seed: KVDELAHFL (MAGA4_HUMAN)
KSDELAHFL

SEQ ID NO: 62811 - protein, 8 aa, Artificial Sequence
  Description of Artificial Sequence: Synthetic peptide
  Seed: KVDELAHF (MAGA4_HUMAN)
KTDELAHL

SEQ ID NO: 62812 - protein, 9 aa, Artificial Sequence
  Description of Artificial Sequence: Synthetic peptide
  Seed: SPLVPGTLE (MAGA4_HUMAN)
SPLVPGTLT

SEQ ID NO: 62813 - protein, 11 aa, Artificial Sequence
  Description of Artificial Sequence: Synthetic peptide
  Seed: RVRIAYPSLRE (MAGA4_HUMAN)
RMRIAYPSLRK

SEQ ID NO: 62814 - protein, 9 aa, Artificial Sequence
  Description of Artificial Sequence: Synthetic peptide
  Seed: ALSNKVDEL (MAGA4_HUMAN)
ASSNKVDEL

SEQ ID NO: 62815 - protein, 10 aa, Artificial Sequence
  Description of Artificial Sequence: Synthetic peptide
  Seed: RVRIAYPSLR (MAGA4_HUMAN)
RHRIAYPSLK

SEQ ID NO: 62816 - protein, 11 aa, Artificial Sequence
  Description of Artificial Sequence: Synthetic peptide
  Seed: RQVPGSNPARY (MAGA4_HUMAN)
RFVPGSNPARY

SEQ ID NO: 62817 - protein, 10 aa, Artificial Sequence
  Description of Artificial Sequence: Synthetic peptide
  Seed: SSSPLVPGTL (MAGA4_HUMAN)
STSPLVPGTF

SEQ ID NO: 62818 - protein, 9 aa, Artificial Sequence
  Description of Artificial Sequence: Synthetic peptide
  Seed: SAGPPQSPQ (MAGA4_HUMAN)
SIGPPQSPF

SEQ ID NO: 62819 - protein, 11 aa, Artificial Sequence
  Description of Artificial Sequence: Synthetic peptide
  Seed: RQVPGSNPARY (MAGA4_HUMAN)
RYVPGSNPARY

SEQ ID NO: 62820 - protein, 9 aa, Artificial Sequence
  Description of Artificial Sequence: Synthetic peptide
  Seed: TQDWVQENY (MAGA4_HUMAN)
TYDWVQENF

SEQ ID NO: 62821 - protein, 9 aa, Artificial Sequence
  Description of Artificial Sequence: Synthetic peptide
  Seed: SSPLVPGTL (MAGA4_HUMAN)
SLPLVPGTV

SEQ ID NO: 62822 - protein, 9 aa, Artificial Sequence
  Description of Artificial Sequence: Synthetic peptide
  Seed: RVRIAYPSL (MAGA4_HUMAN)
RLRIAYPSI

SEQ ID NO: 62823 - protein, 10 aa, Artificial Sequence
  Description of Artificial Sequence: Synthetic peptide
  Seed: KVLEHVVRVN (MAGA4_HUMAN)
KTLEHVVRVV

SEQ ID NO: 62824 - protein, 10 aa, Artificial Sequence
  Description of Artificial Sequence: Synthetic peptide
  Seed: YPSLREAALL (MAGA4_HUMAN)
YDSLREAALF

SEQ ID NO: 62825 - protein, 9 aa, Artificial Sequence
  Description of Artificial Sequence: Synthetic peptide
  Seed: ALLEEEEGV (MAGA4_HUMAN)
AQLEEEEGW

SEQ ID NO: 62826 - protein, 9 aa, Artificial Sequence
  Description of Artificial Sequence: Synthetic peptide
  Seed: IIVLGTIAM (MAGA4_HUMAN)
IRVLGTIAY

SEQ ID NO: 62827 - protein, 10 aa, Artificial Sequence
  Description of Artificial Sequence: Synthetic peptide
  Seed: SLFREALSNK (MAGA4_HUMAN)
SRFREALSNK

SEQ ID NO: 62828 - protein, 10 aa, Artificial Sequence
  Description of Artificial Sequence: Synthetic peptide
  Seed: VDPASNTYTL (MAGA4_HUMAN)
VRPASNTYTL

SEQ ID NO: 62829 - protein, 9 aa, Artificial Sequence
  Description of Artificial Sequence: Synthetic peptide
  Seed: GTLEEVPAA (MAGA4_HUMAN)
GSLEEVPAI

SEQ ID NO: 62830 - protein, 11 aa, Artificial Sequence
  Description of Artificial Sequence: Synthetic peptide
  Seed: RVNARVRIAYP (MAGA4_HUMAN)
RINARVRIAYK

SEQ ID NO: 62831 - protein, 11 aa, Artificial Sequence
  Description of Artificial Sequence: Synthetic peptide
  Seed: RQVPGSNPARY (MAGA4_HUMAN)
RRVPGSNPARW

SEQ ID NO: 62832 - protein, 9 aa, Artificial Sequence
  Description of Artificial Sequence: Synthetic peptide
  Seed: RQVPGSNPA (MAGA4_HUMAN)
RQVPGSNPF

SEQ ID NO: 62833 - protein, 10 aa, Artificial Sequence
  Description of Artificial Sequence: Synthetic peptide
  Seed: KRCFPVIFGK (MAGA4_HUMAN)
KLCFPVIFGR

SEQ ID NO: 62834 - protein, 10 aa, Artificial Sequence
  Description of Artificial Sequence: Synthetic peptide
  Seed: TSYVKVLEHV (MAGA4_HUMAN)
TWYVKVLEHL

SEQ ID NO: 62835 - protein, 9 aa, Artificial Sequence
  Description of Artificial Sequence: Synthetic peptide
  Seed: KVDELAHFL (MAGA4_HUMAN)
KLDELAHFS

SEQ ID NO: 62836 - protein, 9 aa, Artificial Sequence
  Description of Artificial Sequence: Synthetic peptide
  Seed: IFPKTGLLI (MAGA4_HUMAN)
ISPKTGLLI

SEQ ID NO: 62837 - protein, 9 aa, Artificial Sequence
  Description of Artificial Sequence: Synthetic peptide
  Seed: EAQEEALGL (MAGA4_HUMAN)
EVQEEALGR

SEQ ID NO: 62838 - protein, 11 aa, Artificial Sequence
  Description of Artificial Sequence: Synthetic peptide
  Seed: REALSNKVDEL (MAGA4_HUMAN)
REALSNKVDEV

SEQ ID NO: 62839 - protein, 9 aa, Artificial Sequence
  Description of Artificial Sequence: Synthetic peptide
  Seed: SAGPPQSPQ (MAGA4_HUMAN)
SVGPPQSPR

SEQ ID NO: 62840 - protein, 9 aa, Artificial Sequence
  Description of Artificial Sequence: Synthetic peptide
  Seed: VYDGREHTV (MAGA4_HUMAN)
VNDGREHTI

SEQ ID NO: 62841 - protein, 9 aa, Artificial Sequence
  Description of Artificial Sequence: Synthetic peptide
  Seed: LVPGTLEEV (MAGA4_HUMAN)
LWPGTLEEY

SEQ ID NO: 62842 - protein, 9 aa, Artificial Sequence
  Description of Artificial Sequence: Synthetic peptide
  Seed: FPVIFGKAS (MAGA4_HUMAN)
FPVIFGKAT

SEQ ID NO: 62843 - protein, 10 aa, Artificial Sequence
  Description of Artificial Sequence: Synthetic peptide
  Seed: QIFPKTGLLI (MAGA4_HUMAN)
QDFPKTGLLF

SEQ ID NO: 62844 - protein, 10 aa, Artificial Sequence
  Description of Artificial Sequence: Synthetic peptide
  Seed: VDPASNTYTL (MAGA4_HUMAN)
VPPASNTYTM

SEQ ID NO: 62845 - protein, 10 aa, Artificial Sequence
  Description of Artificial Sequence: Synthetic peptide
  Seed: SESLKMIFGI (MAGA4_HUMAN)
SMSLKMIFGW

SEQ ID NO: 62846 - protein, 9 aa, Artificial Sequence
  Description of Artificial Sequence: Synthetic peptide
  Seed: TVYGEPRKL (MAGA4_HUMAN)
TQYGEPRKF

SEQ ID NO: 62847 - protein, 9 aa, Artificial Sequence
  Description of Artificial Sequence: Synthetic peptide
  Seed: AQEEALGLV (MAGA4_HUMAN)
AEEEALGLV

SEQ ID NO: 62848 - protein, 9 aa, Artificial Sequence
  Description of Artificial Sequence: Synthetic peptide
  Seed: SQEEEGPST (MAGA4_HUMAN)
SEEEEGPSC

SEQ ID NO: 62849 - protein, 9 aa, Artificial Sequence
  Description of Artificial Sequence: Synthetic peptide
  Seed: GVYDGREHT (MAGA4_HUMAN)
GTYDGREHV

SEQ ID NO: 62850 - protein, 10 aa, Artificial Sequence
  Description of Artificial Sequence: Synthetic peptide
  Seed: KEVDPASNTY (MAGA4_HUMAN)
KLVDPASNTY

SEQ ID NO: 62851 - protein, 10 aa, Artificial Sequence
  Description of Artificial Sequence: Synthetic peptide
  Seed: SLFREALSNK (MAGA4_HUMAN)
STFREALSNA

SEQ ID NO: 62852 - protein, 8 aa, Artificial Sequence
  Description of Artificial Sequence: Synthetic peptide
  Seed: YDGREHTV (MAGA4_HUMAN)
YEGREHTL

SEQ ID NO: 62853 - protein, 9 aa, Artificial Sequence
  Description of Artificial Sequence: Synthetic peptide
  Seed: KVLEHVVRV (MAGA4_HUMAN)
KTLEHVVRF

SEQ ID NO: 62854 - protein, 11 aa, Artificial Sequence
  Description of Artificial Sequence: Synthetic peptide
  Seed: LTQDWVQENYL (MAGA4_HUMAN)
LSQDWVQENYW

SEQ ID NO: 62855 - protein, 10 aa, Artificial Sequence
  Description of Artificial Sequence: Synthetic peptide
  Seed: GDSASEEEIW (MAGA4_HUMAN)
GKSASEEEIW

SEQ ID NO: 62856 - protein, 9 aa, Artificial Sequence
  Description of Artificial Sequence: Synthetic peptide
  Seed: LPTTISFTC (MAGA4_HUMAN)
LVTTISFTM

SEQ ID NO: 62857 - protein, 9 aa, Artificial Sequence
  Description of Artificial Sequence: Synthetic peptide
  Seed: SALPTTISF (MAGA4_HUMAN)
SSLPTTISM

SEQ ID NO: 62858 - protein, 9 aa, Artificial Sequence
  Description of Artificial Sequence: Synthetic peptide
  Seed: TVYGEPRKL (MAGA4_HUMAN)
TTYGEPRKY

SEQ ID NO: 62859 - protein, 9 aa, Artificial Sequence
  Description of Artificial Sequence: Synthetic peptide
  Seed: RCFPVIFGK (MAGA4_HUMAN)
RMFPVIFGL

SEQ ID NO: 62860 - protein, 9 aa, Artificial Sequence
  Description of Artificial Sequence: Synthetic peptide
  Seed: SSPLVPGTL (MAGA4_HUMAN)
SIPLVPGTM

SEQ ID NO: 62861 - protein, 10 aa, Artificial Sequence
  Description of Artificial Sequence: Synthetic peptide
  Seed: EEVPAAESAG (MAGA4_HUMAN)
EEVPAAESAA

SEQ ID NO: 62862 - protein, 9 aa, Artificial Sequence
  Description of Artificial Sequence: Synthetic peptide
  Seed: SSSPLVPGT (MAGA4_HUMAN)
SISPLVPGM

SEQ ID NO: 62863 - protein, 9 aa, Artificial Sequence
  Description of Artificial Sequence: Synthetic peptide
  Seed: FPVIFGKAS (MAGA4_HUMAN)
FPVIFGKAI

SEQ ID NO: 62864 - protein, 9 aa, Artificial Sequence
  Description of Artificial Sequence: Synthetic peptide
  Seed: SSPLVPGTL (MAGA4_HUMAN)
SAPLVPGTW

SEQ ID NO: 62865 - protein, 10 aa, Artificial Sequence
  Description of Artificial Sequence: Synthetic peptide
  Seed: TTISFTCWRQ (MAGA4_HUMAN)
TSISFTCWRR

SEQ ID NO: 62866 - protein, 8 aa, Artificial Sequence
  Description of Artificial Sequence: Synthetic peptide
  Seed: KVDELAHF (MAGA4_HUMAN)
KTDELAHI

SEQ ID NO: 62867 - protein, 9 aa, Artificial Sequence
  Description of Artificial Sequence: Synthetic peptide
  Seed: EVDPASNTY (MAGA4_HUMAN)
ELDPASNTM

SEQ ID NO: 62868 - protein, 10 aa, Artificial Sequence
  Description of Artificial Sequence: Synthetic peptide
  Seed: YRQVPGSNPA (MAGA4_HUMAN)
YVQVPGSNPV

SEQ ID NO: 62869 - protein, 9 aa, Artificial Sequence
  Description of Artificial Sequence: Synthetic peptide
  Seed: GSNPARYEF (MAGA4_HUMAN)
GLNPARYEW

SEQ ID NO: 62870 - protein, 9 aa, Artificial Sequence
  Description of Artificial Sequence: Synthetic peptide
  Seed: RVNARVRIA (MAGA4_HUMAN)
RSNARVRII

SEQ ID NO: 62871 - protein, 9 aa, Artificial Sequence
  Description of Artificial Sequence: Synthetic peptide
  Seed: AAVSSSSPL (MAGA4_HUMAN)
AMVSSSSPV

SEQ ID NO: 62872 - protein, 9 aa, Artificial Sequence
  Description of Artificial Sequence: Synthetic peptide
  Seed: SYVKVLEHV (MAGA4_HUMAN)
SAVKVLEHV

SEQ ID NO: 62873 - protein, 9 aa, Artificial Sequence
  Description of Artificial Sequence: Synthetic peptide
  Seed: RVRIAYPSL (MAGA4_HUMAN)
RTRIAYPSN

SEQ ID NO: 62874 - protein, 10 aa, Artificial Sequence
  Description of Artificial Sequence: Synthetic peptide
  Seed: ESAGPPQSPQ (MAGA4_HUMAN)
ESAGPPQSPK

SEQ ID NO: 62875 - protein, 9 aa, Artificial Sequence
  Description of Artificial Sequence: Synthetic peptide
  Seed: QIFPKTGLL (MAGA4_HUMAN)
QSFPKTGLL

SEQ ID NO: 62876 - protein, 9 aa, Artificial Sequence
  Description of Artificial Sequence: Synthetic peptide
  Seed: KVDELAHFL (MAGA4_HUMAN)
KQDELAHFW

SEQ ID NO: 62877 - protein, 10 aa, Artificial Sequence
  Description of Artificial Sequence: Synthetic peptide
  Seed: QIFPKTGLLI (MAGA4_HUMAN)
QVFPKTGLLW

SEQ ID NO: 62878 - protein, 9 aa, Artificial Sequence
  Description of Artificial Sequence: Synthetic peptide
  Seed: SALPTTISF (MAGA4_HUMAN)
SDLPTTISY

SEQ ID NO: 62879 - protein, 9 aa, Artificial Sequence
  Description of Artificial Sequence: Synthetic peptide
  Seed: YPSLREAAL (MAGA4_HUMAN)
YHSLREAAA

SEQ ID NO: 62880 - protein, 9 aa, Artificial Sequence
  Description of Artificial Sequence: Synthetic peptide
  Seed: RVRIAYPSL (MAGA4_HUMAN)
RFRIAYPSE

SEQ ID NO: 62881 - protein, 9 aa, Artificial Sequence
  Description of Artificial Sequence: Synthetic peptide
  Seed: ALPTTISFT (MAGA4_HUMAN)
AMPTTISFL

SEQ ID NO: 62882 - protein, 9 aa, Artificial Sequence
  Description of Artificial Sequence: Synthetic peptide
  Seed: QIFPKTGLL (MAGA4_HUMAN)
QMFPKTGLF

SEQ ID NO: 62883 - protein, 9 aa, Artificial Sequence
  Description of Artificial Sequence: Synthetic peptide
  Seed: SSPLVPGTL (MAGA4_HUMAN)
SEPLVPGTM

SEQ ID NO: 62884 - protein, 10 aa, Artificial Sequence
  Description of Artificial Sequence: Synthetic peptide
  Seed: RQVPGSNPAR (MAGA4_HUMAN)
RLVPGSNPAY

SEQ ID NO: 62885 - protein, 9 aa, Artificial Sequence
  Description of Artificial Sequence: Synthetic peptide
  Seed: QSPQGASAL (MAGA4_HUMAN)
QHPQGASAL

SEQ ID NO: 62886 - protein, 8 aa, Artificial Sequence
  Description of Artificial Sequence: Synthetic peptide
  Seed: VYGEPRKL (MAGA4_HUMAN)
VFGEPRKM

SEQ ID NO: 62887 - protein, 9 aa, Artificial Sequence
  Description of Artificial Sequence: Synthetic peptide
  Seed: YPSLREAAL (MAGA4_HUMAN)
YVSLREAAL

SEQ ID NO: 62888 - protein, 10 aa, Artificial Sequence
  Description of Artificial Sequence: Synthetic peptide
  Seed: TSYVKVLEHV (MAGA4_HUMAN)
TWYVKVLEHI

SEQ ID NO: 62889 - protein, 9 aa, Artificial Sequence
  Description of Artificial Sequence: Synthetic peptide
  Seed: SSPLVPGTL (MAGA4_HUMAN)
SIPLVPGTY

SEQ ID NO: 62890 - protein, 11 aa, Artificial Sequence
  Description of Artificial Sequence: Synthetic peptide
  Seed: KVDELAHFLLR (MAGA4_HUMAN)
KVDELAHFLLK

SEQ ID NO: 62891 - protein, 9 aa, Artificial Sequence
  Description of Artificial Sequence: Synthetic peptide
  Seed: VYDGREHTV (MAGA4_HUMAN)
VFDGREHTY

SEQ ID NO: 62892 - protein, 10 aa, Artificial Sequence
  Description of Artificial Sequence: Synthetic peptide
  Seed: SSSPLVPGTL (MAGA4_HUMAN)
SVSPLVPGTW

SEQ ID NO: 62893 - protein, 9 aa, Artificial Sequence
  Description of Artificial Sequence: Synthetic peptide
  Seed: SALPTTISF (MAGA4_HUMAN)
SVLPTTISM

SEQ ID NO: 62894 - protein, 9 aa, Artificial Sequence
  Description of Artificial Sequence: Synthetic peptide
  Seed: RAKELVTKA (MAGA4_HUMAN)
RVKELVTKA

SEQ ID NO: 62895 - protein, 9 aa, Artificial Sequence
  Description of Artificial Sequence: Synthetic peptide
  Seed: WVQENYLEY (MAGA4_HUMAN)
WMQENYLEF

SEQ ID NO: 62896 - protein, 9 aa, Artificial Sequence
  Description of Artificial Sequence: Synthetic peptide
  Seed: ALPTTISFT (MAGA4_HUMAN)
AVPTTISFL

SEQ ID NO: 62897 - protein, 9 aa, Artificial Sequence
  Description of Artificial Sequence: Synthetic peptide
  Seed: LFREALSNK (MAGA4_HUMAN)
LTREALSNA

SEQ ID NO: 62898 - protein, 9 aa, Artificial Sequence
  Description of Artificial Sequence: Synthetic peptide
  Seed: KNYKRCFPV (MAGA4_HUMAN)
KAYKRCFPK

SEQ ID NO: 62899 - protein, 9 aa, Artificial Sequence
  Description of Artificial Sequence: Synthetic peptide
  Seed: GLLGNNQIF (MAGA4_HUMAN)
GQLGNNQIY

SEQ ID NO: 62900 - protein, 9 aa, Artificial Sequence
  Description of Artificial Sequence: Synthetic peptide
  Seed: STSPDAESL (MAGA4_HUMAN)
SMSPDAESM

SEQ ID NO: 62901 - protein, 9 aa, Artificial Sequence
  Description of Artificial Sequence: Synthetic peptide
  Seed: YPSLREAAL (MAGA4_HUMAN)
YQSLREAAF

SEQ ID NO: 62902 - protein, 9 aa, Artificial Sequence
  Description of Artificial Sequence: Synthetic peptide
  Seed: KAEMLERVI (MAGA4_HUMAN)
KTEMLERVW

SEQ ID NO: 62903 - protein, 9 aa, Artificial Sequence
  Description of Artificial Sequence: Synthetic peptide
  Seed: DELAHFLLR (MAGA4_HUMAN)
DGLAHFLLK

SEQ ID NO: 62904 - protein, 9 aa, Artificial Sequence
  Description of Artificial Sequence: Synthetic peptide
  Seed: NTYTLVTCL (MAGA4_HUMAN)
NSYTLVTCR

SEQ ID NO: 62905 - protein, 11 aa, Artificial Sequence
  Description of Artificial Sequence: Synthetic peptide
  Seed: KVDELAHFLLR (MAGA4_HUMAN)
KADELAHFLLY

SEQ ID NO: 62906 - protein, 10 aa, Artificial Sequence
  Description of Artificial Sequence: Synthetic peptide
  Seed: KVLEHVVRVN (MAGA4_HUMAN)
KILEHVVRVL

SEQ ID NO: 62907 - protein, 10 aa, Artificial Sequence
  Description of Artificial Sequence: Synthetic peptide
  Seed: HFLLRKYRAK (MAGA4_HUMAN)
HMLLRKYRAR

SEQ ID NO: 62908 - protein, 9 aa, Artificial Sequence
  Description of Artificial Sequence: Synthetic peptide
  Seed: TTISFTCWR (MAGA4_HUMAN)
TYISFTCWR

SEQ ID NO: 62909 - protein, 10 aa, Artificial Sequence
  Description of Artificial Sequence: Synthetic peptide
  Seed: STSPDAESLF (MAGA4_HUMAN)
SLSPDAESLF

SEQ ID NO: 62910 - protein, 10 aa, Artificial Sequence
  Description of Artificial Sequence: Synthetic peptide
  Seed: AYPSLREAAL (MAGA4_HUMAN)
ATPSLREAAL

SEQ ID NO: 62911 - protein, 10 aa, Artificial Sequence
  Description of Artificial Sequence: Synthetic peptide
  Seed: GVYDGREHTV (MAGA4_HUMAN)
GSYDGREHTV

SEQ ID NO: 62912 - protein, 10 aa, Artificial Sequence
  Description of Artificial Sequence: Synthetic peptide
  Seed: YPSLREAALL (MAGA4_HUMAN)
YHSLREAALW

SEQ ID NO: 62913 - protein, 10 aa, Artificial Sequence
  Description of Artificial Sequence: Synthetic peptide
  Seed: GVYDGREHTV (MAGA4_HUMAN)
GMYDGREHTF

SEQ ID NO: 62914 - protein, 9 aa, Artificial Sequence
  Description of Artificial Sequence: Synthetic peptide
  Seed: IAMEGDSAS (MAGA4_HUMAN)
IAMEGDSAH

SEQ ID NO: 62915 - protein, 9 aa, Artificial Sequence
  Description of Artificial Sequence: Synthetic peptide
  Seed: RVRIAYPSL (MAGA4_HUMAN)
RQRIAYPSK

SEQ ID NO: 62916 - protein, 8 aa, Artificial Sequence
  Description of Artificial Sequence: Synthetic peptide
  Seed: VYGEPRKL (MAGA4_HUMAN)
VFGEPRKY

SEQ ID NO: 62917 - protein, 10 aa, Artificial Sequence
  Description of Artificial Sequence: Synthetic peptide
  Seed: TSYVKVLEHV (MAGA4_HUMAN)
TKYVKVLEHL

SEQ ID NO: 62918 - protein, 10 aa, Artificial Sequence
  Description of Artificial Sequence: Synthetic peptide
  Seed: SLFREALSNK (MAGA4_HUMAN)
SKFREALSNR

SEQ ID NO: 62919 - protein, 9 aa, Artificial Sequence
  Description of Artificial Sequence: Synthetic peptide
  Seed: LKMIFGIDV (MAGA4_HUMAN)
LKMIFGIDF

SEQ ID NO: 62920 - protein, 11 aa, Artificial Sequence
  Description of Artificial Sequence: Synthetic peptide
  Seed: FLLRKYRAKEL (MAGA4_HUMAN)
FPLRKYRAKEL

SEQ ID NO: 62921 - protein, 9 aa, Artificial Sequence
  Description of Artificial Sequence: Synthetic peptide
  Seed: WVQENYLEY (MAGA4_HUMAN)
WQQENYLEI

SEQ ID NO: 62922 - protein, 9 aa, Artificial Sequence
  Description of Artificial Sequence: Synthetic peptide
  Seed: KNYKRCFPV (MAGA4_HUMAN)
KYYKRCFPK

SEQ ID NO: 62923 - protein, 9 aa, Artificial Sequence
  Description of Artificial Sequence: Synthetic peptide
  Seed: TQDWVQENY (MAGA4_HUMAN)
TADWVQENV

SEQ ID NO: 62924 - protein, 10 aa, Artificial Sequence
  Description of Artificial Sequence: Synthetic peptide
  Seed: VDPASNTYTL (MAGA4_HUMAN)
VPPASNTYTF

SEQ ID NO: 62925 - protein, 9 aa, Artificial Sequence
  Description of Artificial Sequence: Synthetic peptide
  Seed: AAVSSSSPL (MAGA4_HUMAN)
AMVSSSSPI

SEQ ID NO: 62926 - protein, 9 aa, Artificial Sequence
  Description of Artificial Sequence: Synthetic peptide
  Seed: ALSNKVDEL (MAGA4_HUMAN)
ALSNKVDEV

SEQ ID NO: 62927 - protein, 9 aa, Artificial Sequence
  Description of Artificial Sequence: Synthetic peptide
  Seed: TTEEQEAAV (MAGA4_HUMAN)
TIEEQEAAL

SEQ ID NO: 62928 - protein, 9 aa, Artificial Sequence
  Description of Artificial Sequence: Synthetic peptide
  Seed: VYDGREHTV (MAGA4_HUMAN)
VLDGREHTI

SEQ ID NO: 62929 - protein, 10 aa, Artificial Sequence
  Description of Artificial Sequence: Synthetic peptide
  Seed: RQVPGSNPAR (MAGA4_HUMAN)
RQVPGSNPAL

SEQ ID NO: 62930 - protein, 10 aa, Artificial Sequence
  Description of Artificial Sequence: Synthetic peptide
  Seed: RVNARVRIAY (MAGA4_HUMAN)
RQNARVRIAF

SEQ ID NO: 62931 - protein, 9 aa, Artificial Sequence
  Description of Artificial Sequence: Synthetic peptide
  Seed: FGKASESLK (MAGA4_HUMAN)
FTKASESLY

SEQ ID NO: 62932 - protein, 9 aa, Artificial Sequence
  Description of Artificial Sequence: Synthetic peptide
  Seed: KNYKRCFPV (MAGA4_HUMAN)
KMYKRCFPK

SEQ ID NO: 62933 - protein, 10 aa, Artificial Sequence
  Description of Artificial Sequence: Synthetic peptide
  Seed: RIAYPSLREA (MAGA4_HUMAN)
RMAYPSLREV

SEQ ID NO: 62934 - protein, 9 aa, Artificial Sequence
  Description of Artificial Sequence: Synthetic peptide
  Seed: YDGREHTVY (MAGA4_HUMAN)
YSGREHTVY

SEQ ID NO: 62935 - protein, 10 aa, Artificial Sequence
  Description of Artificial Sequence: Synthetic peptide
  Seed: AYPSLREAAL (MAGA4_HUMAN)
AVPSLREAAL

SEQ ID NO: 62936 - protein, 9 aa, Artificial Sequence
  Description of Artificial Sequence: Synthetic peptide
  Seed: KVDELAHFL (MAGA4_HUMAN)
KLDELAHFR

SEQ ID NO: 62937 - protein, 9 aa, Artificial Sequence
  Description of Artificial Sequence: Synthetic peptide
  Seed: ESLKMIFGI (MAGA4_HUMAN)
EALKMIFGI

SEQ ID NO: 62938 - protein, 9 aa, Artificial Sequence
  Description of Artificial Sequence: Synthetic peptide
  Seed: KYRAKELVT (MAGA4_HUMAN)
KSRAKELVI

SEQ ID NO: 62939 - protein, 9 aa, Artificial Sequence
  Description of Artificial Sequence: Synthetic peptide
  Seed: AAVSSSSPL (MAGA4_HUMAN)
AWVSSSSPF

SEQ ID NO: 62940 - protein, 10 aa, Artificial Sequence
  Description of Artificial Sequence: Synthetic peptide
  Seed: YPSLREAALL (MAGA4_HUMAN)
YLSLREAALF

SEQ ID NO: 62941 - protein, 9 aa, Artificial Sequence
  Description of Artificial Sequence: Synthetic peptide
  Seed: QIFPKTGLL (MAGA4_HUMAN)
QWFPKTGLY

SEQ ID NO: 62942 - protein, 10 aa, Artificial Sequence
  Description of Artificial Sequence: Synthetic peptide
  Seed: RQVPGSNPAR (MAGA4_HUMAN)
REVPGSNPAF

SEQ ID NO: 62943 - protein, 11 aa, Artificial Sequence
  Description of Artificial Sequence: Synthetic peptide
  Seed: ELGVMGVYDGR (MAGA4_HUMAN)
EKGVMGVYDGR

SEQ ID NO: 62944 - protein, 9 aa, Artificial Sequence
  Description of Artificial Sequence: Synthetic peptide
  Seed: ALSNKVDEL (MAGA4_HUMAN)
ARSNKVDEM

SEQ ID NO: 62945 - protein, 10 aa, Artificial Sequence
  Description of Artificial Sequence: Synthetic peptide
  Seed: TTISFTCWRQ (MAGA4_HUMAN)
TVISFTCWRA

SEQ ID NO: 62946 - protein, 10 aa, Artificial Sequence
  Description of Artificial Sequence: Synthetic peptide
  Seed: VDPASNTYTL (MAGA4_HUMAN)
VEPASNTYTL

SEQ ID NO: 62947 - protein, 10 aa, Artificial Sequence
  Description of Artificial Sequence: Synthetic peptide
  Seed: SSSPLVPGTL (MAGA4_HUMAN)
SCSPLVPGTW

SEQ ID NO: 62948 - protein, 9 aa, Artificial Sequence
  Description of Artificial Sequence: Synthetic peptide
  Seed: YKRCFPVIF (MAGA4_HUMAN)
YQRCFPVIL

SEQ ID NO: 62949 - protein, 9 aa, Artificial Sequence
  Description of Artificial Sequence: Synthetic peptide
  Seed: AAVSSSSPL (MAGA4_HUMAN)
AIVSSSSPL

SEQ ID NO: 62950 - protein, 10 aa, Artificial Sequence
  Description of Artificial Sequence: Synthetic peptide
  Seed: RVRIAYPSLR (MAGA4_HUMAN)
RIRIAYPSLL

SEQ ID NO: 62951 - protein, 10 aa, Artificial Sequence
  Description of Artificial Sequence: Synthetic peptide
  Seed: ESAGPPQSPQ (MAGA4_HUMAN)
ELAGPPQSPK

SEQ ID NO: 62952 - protein, 11 aa, Artificial Sequence
  Description of Artificial Sequence: Synthetic peptide
  Seed: GASALPTTISF (MAGA4_HUMAN)
GTSALPTTISF

SEQ ID NO: 62953 - protein, 10 aa, Artificial Sequence
  Description of Artificial Sequence: Synthetic peptide
  Seed: KYRAKELVTK (MAGA4_HUMAN)
KVRAKELVTK

SEQ ID NO: 62954 - protein, 10 aa, Artificial Sequence
  Description of Artificial Sequence: Synthetic peptide
  Seed: SSSPLVPGTL (MAGA4_HUMAN)
SVSPLVPGTF

SEQ ID NO: 62955 - protein, 9 aa, Artificial Sequence
  Description of Artificial Sequence: Synthetic peptide
  Seed: YPSLREAAL (MAGA4_HUMAN)
YTSLREAAF

SEQ ID NO: 62956 - protein, 9 aa, Artificial Sequence
  Description of Artificial Sequence: Synthetic peptide
  Seed: STSPDAESL (MAGA4_HUMAN)
STSPDAESI

SEQ ID NO: 62957 - protein, 10 aa, Artificial Sequence
  Description of Artificial Sequence: Synthetic peptide
  Seed: KASESLKMIF (MAGA4_HUMAN)
KCSESLKMIW

SEQ ID NO: 62958 - protein, 9 aa, Artificial Sequence
  Description of Artificial Sequence: Synthetic peptide
  Seed: GASALPTTI (MAGA4_HUMAN)
GASALPTTM

SEQ ID NO: 62959 - protein, 10 aa, Artificial Sequence
  Description of Artificial Sequence: Synthetic peptide
  Seed: TTISFTCWRQ (MAGA4_HUMAN)
TSISFTCWRK

SEQ ID NO: 62960 - protein, 9 aa, Artificial Sequence
  Description of Artificial Sequence: Synthetic peptide
  Seed: ALLEEEEGV (MAGA4_HUMAN)
AMLEEEEGF

SEQ ID NO: 62961 - protein, 9 aa, Artificial Sequence
  Description of Artificial Sequence: Synthetic peptide
  Seed: TTEEQEAAV (MAGA4_HUMAN)
TTEEQEAAM

SEQ ID NO: 62962 - protein, 9 aa, Artificial Sequence
  Description of Artificial Sequence: Synthetic peptide
  Seed: IAYPSLREA (MAGA4_HUMAN)
IIYPSLREM

SEQ ID NO: 62963 - protein, 9 aa, Artificial Sequence
  Description of Artificial Sequence: Synthetic peptide
  Seed: GSNPARYEF (MAGA4_HUMAN)
GQNPARYEI

SEQ ID NO: 62964 - protein, 9 aa, Artificial Sequence
  Description of Artificial Sequence: Synthetic peptide
  Seed: EHVVRVNAR (MAGA4_HUMAN)
ELVVRVNAR

SEQ ID NO: 62965 - protein, 9 aa, Artificial Sequence
  Description of Artificial Sequence: Synthetic peptide
  Seed: GASALPTTI (MAGA4_HUMAN)
GMSALPTTF

SEQ ID NO: 62966 - protein, 8 aa, Artificial Sequence
  Description of Artificial Sequence: Synthetic peptide
  Seed: AESLFREA (MAGA4_HUMAN)
AESLFREL

SEQ ID NO: 62967 - protein, 10 aa, Artificial Sequence
  Description of Artificial Sequence: Synthetic peptide
  Seed: YRQVPGSNPA (MAGA4_HUMAN)
YNQVPGSNPM

SEQ ID NO: 62968 - protein, 9 aa, Artificial Sequence
  Description of Artificial Sequence: Synthetic peptide
  Seed: EIWEELGVM (MAGA4_HUMAN)
EVWEELGVY

SEQ ID NO: 62969 - protein, 11 aa, Artificial Sequence
  Description of Artificial Sequence: Synthetic peptide
  Seed: LSNKVDELAHF (MAGA4_HUMAN)
LTNKVDELAHW

SEQ ID NO: 62970 - protein, 9 aa, Artificial Sequence
  Description of Artificial Sequence: Synthetic peptide
  Seed: SYVKVLEHV (MAGA4_HUMAN)
SVVKVLEHV

SEQ ID NO: 62971 - protein, 11 aa, Artificial Sequence
  Description of Artificial Sequence: Synthetic peptide
  Seed: RQVPGSNPARY (MAGA4_HUMAN)
REVPGSNPARW

SEQ ID NO: 62972 - protein, 10 aa, Artificial Sequence
  Description of Artificial Sequence: Synthetic peptide
  Seed: EAAVSSSSPL (MAGA4_HUMAN)
EVAVSSSSPL

SEQ ID NO: 62973 - protein, 9 aa, Artificial Sequence
  Description of Artificial Sequence: Synthetic peptide
  Seed: STSPDAESL (MAGA4_HUMAN)
SISPDAESL

SEQ ID NO: 62974 - protein, 9 aa, Artificial Sequence
  Description of Artificial Sequence: Synthetic peptide
  Seed: LPTTISFTC (MAGA4_HUMAN)
LPTTISFTT

SEQ ID NO: 62975 - protein, 9 aa, Artificial Sequence
  Description of Artificial Sequence: Synthetic peptide
  Seed: RVRIAYPSL (MAGA4_HUMAN)
RVRIAYPSC

SEQ ID NO: 62976 - protein, 9 aa, Artificial Sequence
  Description of Artificial Sequence: Synthetic peptide
  Seed: VYDGREHTV (MAGA4_HUMAN)
VADGREHTY

SEQ ID NO: 62977 - protein, 10 aa, Artificial Sequence
  Description of Artificial Sequence: Synthetic peptide
  Seed: DELAHFLLRK (MAGA4_HUMAN)
DVLAHFLLRR

SEQ ID NO: 62978 - protein, 10 aa, Artificial Sequence
  Description of Artificial Sequence: Synthetic peptide
  Seed: LPTTISFTCW (MAGA4_HUMAN)
LTTTISFTCW

SEQ ID NO: 62979 - protein, 9 aa, Artificial Sequence
  Description of Artificial Sequence: Synthetic peptide
  Seed: SYVKVLEHV (MAGA4_HUMAN)
SFVKVLEHL

SEQ ID NO: 62980 - protein, 10 aa, Artificial Sequence
  Description of Artificial Sequence: Synthetic peptide
  Seed: RVRIAYPSLR (MAGA4_HUMAN)
RFRIAYPSLA

SEQ ID NO: 62981 - protein, 9 aa, Artificial Sequence
  Description of Artificial Sequence: Synthetic peptide
  Seed: KVDELAHFL (MAGA4_HUMAN)
KCDELAHFY

SEQ ID NO: 62982 - protein, 9 aa, Artificial Sequence
  Description of Artificial Sequence: Synthetic peptide
  Seed: LEHVVRVNA (MAGA4_HUMAN)
LEHVVRVNI

SEQ ID NO: 62983 - protein, 10 aa, Artificial Sequence
  Description of Artificial Sequence: Synthetic peptide
  Seed: RVRIAYPSLR (MAGA4_HUMAN)
RVRIAYPSLF

SEQ ID NO: 62984 - protein, 9 aa, Artificial Sequence
  Description of Artificial Sequence: Synthetic peptide
  Seed: NTYTLVTCL (MAGA4_HUMAN)
NTYTLVTCF

SEQ ID NO: 62985 - protein, 9 aa, Artificial Sequence
  Description of Artificial Sequence: Synthetic peptide
  Seed: ALSNKVDEL (MAGA4_HUMAN)
ALSNKVDEY

SEQ ID NO: 62986 - protein, 10 aa, Artificial Sequence
  Description of Artificial Sequence: Synthetic peptide
  Seed: SSSPLVPGTL (MAGA4_HUMAN)
SISPLVPGTY

SEQ ID NO: 62987 - protein, 9 aa, Artificial Sequence
  Description of Artificial Sequence: Synthetic peptide
  Seed: HVVRVNARV (MAGA4_HUMAN)
HTVRVNARI

SEQ ID NO: 62988 - protein, 9 aa, Artificial Sequence
  Description of Artificial Sequence: Synthetic peptide
  Seed: RVRIAYPSL (MAGA4_HUMAN)
RPRIAYPSC

SEQ ID NO: 62989 - protein, 10 aa, Artificial Sequence
  Description of Artificial Sequence: Synthetic peptide
  Seed: KRCFPVIFGK (MAGA4_HUMAN)
KRCFPVIFGM

SEQ ID NO: 62990 - protein, 10 aa, Artificial Sequence
  Description of Artificial Sequence: Synthetic peptide
  Seed: SSSPLVPGTL (MAGA4_HUMAN)
SLSPLVPGTL

SEQ ID NO: 62991 - protein, 9 aa, Artificial Sequence
  Description of Artificial Sequence: Synthetic peptide
  Seed: RVRIAYPSL (MAGA4_HUMAN)
RKRIAYPSF

SEQ ID NO: 62992 - protein, 10 aa, Artificial Sequence
  Description of Artificial Sequence: Synthetic peptide
  Seed: DPASNTYTLV (MAGA4_HUMAN)
DTASNTYTLV

SEQ ID NO: 62993 - protein, 8 aa, Artificial Sequence
  Description of Artificial Sequence: Synthetic peptide
  Seed: SAGPPQSP (MAGA4_HUMAN)
SSGPPQSL

SEQ ID NO: 62994 - protein, 9 aa, Artificial Sequence
  Description of Artificial Sequence: Synthetic peptide
  Seed: SALPTTISF (MAGA4_HUMAN)
SPLPTTIST

SEQ ID NO: 62995 - protein, 9 aa, Artificial Sequence
  Description of Artificial Sequence: Synthetic peptide
  Seed: IAYPSLREA (MAGA4_HUMAN)
IRYPSLREM

SEQ ID NO: 62996 - protein, 9 aa, Artificial Sequence
  Description of Artificial Sequence: Synthetic peptide
  Seed: RVNARVRIA (MAGA4_HUMAN)
RSNARVRIS

SEQ ID NO: 62997 - protein, 9 aa, Artificial Sequence
  Description of Artificial Sequence: Synthetic peptide
  Seed: RCFPVIFGK (MAGA4_HUMAN)
RYFPVIFGK

SEQ ID NO: 62998 - protein, 10 aa, Artificial Sequence
  Description of Artificial Sequence: Synthetic peptide
  Seed: RVRIAYPSLR (MAGA4_HUMAN)
RLRIAYPSLI

SEQ ID NO: 62999 - protein, 9 aa, Artificial Sequence
  Description of Artificial Sequence: Synthetic peptide
  Seed: MGVYDGREH (MAGA4_HUMAN)
MAVYDGREM

SEQ ID NO: 63000 - protein, 9 aa, Artificial Sequence
  Description of Artificial Sequence: Synthetic peptide
  Seed: SEEEIWEEL (MAGA4_HUMAN)
SQEEIWEEW

SEQ ID NO: 63001 - protein, 9 aa, Artificial Sequence
  Description of Artificial Sequence: Synthetic peptide
  Seed: SALPTTISF (MAGA4_HUMAN)
SGLPTTISV

SEQ ID NO: 63002 - protein, 10 aa, Artificial Sequence
  Description of Artificial Sequence: Synthetic peptide
  Seed: TEEQEAAVSS (MAGA4_HUMAN)
TEEQEAAVST

SEQ ID NO: 63003 - protein, 9 aa, Artificial Sequence
  Description of Artificial Sequence: Synthetic peptide
  Seed: DELAHFLLR (MAGA4_HUMAN)
DILAHFLLK

SEQ ID NO: 63004 - protein, 11 aa, Artificial Sequence
  Description of Artificial Sequence: Synthetic peptide
  Seed: KEVDPASNTYT (MAGA4_HUMAN)
KEVDPASNTYW

SEQ ID NO: 63005 - protein, 9 aa, Artificial Sequence
  Description of Artificial Sequence: Synthetic peptide
  Seed: KYRAKELVT (MAGA4_HUMAN)
KSRAKELVK

SEQ ID NO: 63006 - protein, 11 aa, Artificial Sequence
  Description of Artificial Sequence: Synthetic peptide
  Seed: ARVRIAYPSLR (MAGA4_HUMAN)
ATVRIAYPSLR

SEQ ID NO: 63007 - protein, 8 aa, Artificial Sequence
  Description of Artificial Sequence: Synthetic peptide
  Seed: KVDELAHF (MAGA4_HUMAN)
KVDELAHM

SEQ ID NO: 63008 - protein, 9 aa, Artificial Sequence
  Description of Artificial Sequence: Synthetic peptide
  Seed: LKMIFGIDV (MAGA4_HUMAN)
LMMIFGIDM

SEQ ID NO: 63009 - protein, 9 aa, Artificial Sequence
  Description of Artificial Sequence: Synthetic peptide
  Seed: ESLKMIFGI (MAGA4_HUMAN)
EALKMIFGA

SEQ ID NO: 63010 - protein, 9 aa, Artificial Sequence
  Description of Artificial Sequence: Synthetic peptide
  Seed: VYDGREHTV (MAGA4_HUMAN)
VTDGREHTF

SEQ ID NO: 63011 - protein, 9 aa, Artificial Sequence
  Description of Artificial Sequence: Synthetic peptide
  Seed: GSNPARYEF (MAGA4_HUMAN)
GMNPARYEM

SEQ ID NO: 63012 - protein, 10 aa, Artificial Sequence
  Description of Artificial Sequence: Synthetic peptide
  Seed: GVYDGREHTV (MAGA4_HUMAN)
GQYDGREHTV

SEQ ID NO: 63013 - protein, 9 aa, Artificial Sequence
  Description of Artificial Sequence: Synthetic peptide
  Seed: VYDGREHTV (MAGA4_HUMAN)
VWDGREHTL

SEQ ID NO: 63014 - protein, 9 aa, Artificial Sequence
  Description of Artificial Sequence: Synthetic peptide
  Seed: YPSLREAAL (MAGA4_HUMAN)
YPSLREAAV

SEQ ID NO: 63015 - protein, 9 aa, Artificial Sequence
  Description of Artificial Sequence: Synthetic peptide
  Seed: ELAHFLLRK (MAGA4_HUMAN)
EVAHFLLRM

SEQ ID NO: 63016 - protein, 10 aa, Artificial Sequence
  Description of Artificial Sequence: Synthetic peptide
  Seed: YPSLREAALL (MAGA4_HUMAN)
YCSLREAALW

SEQ ID NO: 63017 - protein, 9 aa, Artificial Sequence
  Description of Artificial Sequence: Synthetic peptide
  Seed: GTLEEVPAA (MAGA4_HUMAN)
GVLEEVPAM

SEQ ID NO: 63018 - protein, 11 aa, Artificial Sequence
  Description of Artificial Sequence: Synthetic peptide
  Seed: GASALPTTISF (MAGA4_HUMAN)
GMSALPTTISW

SEQ ID NO: 63019 - protein, 9 aa, Artificial Sequence
  Description of Artificial Sequence: Synthetic peptide
  Seed: HVVRVNARV (MAGA4_HUMAN)
HAVRVNARV

SEQ ID NO: 63020 - protein, 9 aa, Artificial Sequence
  Description of Artificial Sequence: Synthetic peptide
  Seed: TVYGEPRKL (MAGA4_HUMAN)
TSYGEPRKM

SEQ ID NO: 63021 - protein, 10 aa, Artificial Sequence
  Description of Artificial Sequence: Synthetic peptide
  Seed: SSSPLVPGTL (MAGA4_HUMAN)
SGSPLVPGTW

SEQ ID NO: 63022 - protein, 9 aa, Artificial Sequence
  Description of Artificial Sequence: Synthetic peptide
  Seed: KEVDPASNT (MAGA4_HUMAN)
KEVDPASNL

SEQ ID NO: 63023 - protein, 9 aa, Artificial Sequence
  Description of Artificial Sequence: Synthetic peptide
  Seed: ERVIKNYKR (MAGA4_HUMAN)
EYVIKNYKR

SEQ ID NO: 63024 - protein, 11 aa, Artificial Sequence
  Description of Artificial Sequence: Synthetic peptide
  Seed: KYRAKELVTKA (MAGA4_HUMAN)
KTRAKELVTKA

SEQ ID NO: 63025 - protein, 9 aa, Artificial Sequence
  Description of Artificial Sequence: Synthetic peptide
  Seed: STSPDAESL (MAGA4_HUMAN)
SVSPDAESR

SEQ ID NO: 63026 - protein, 9 aa, Artificial Sequence
  Description of Artificial Sequence: Synthetic peptide
  Seed: SALPTTISF (MAGA4_HUMAN)
SLLPTTISV

SEQ ID NO: 63027 - protein, 9 aa, Artificial Sequence
  Description of Artificial Sequence: Synthetic peptide
  Seed: ALSNKVDEL (MAGA4_HUMAN)
AVSNKVDEY

SEQ ID NO: 63028 - protein, 9 aa, Artificial Sequence
  Description of Artificial Sequence: Synthetic peptide
  Seed: SYVKVLEHV (MAGA4_HUMAN)
SRVKVLEHV

SEQ ID NO: 63029 - protein, 10 aa, Artificial Sequence
  Description of Artificial Sequence: Synthetic peptide
  Seed: FGKASESLKM (MAGA4_HUMAN)
FMKASESLKY

SEQ ID NO: 63030 - protein, 9 aa, Artificial Sequence
  Description of Artificial Sequence: Synthetic peptide
  Seed: KVLEHVVRV (MAGA4_HUMAN)
KSLEHVVRI

SEQ ID NO: 63031 - protein, 10 aa, Artificial Sequence
  Description of Artificial Sequence: Synthetic peptide
  Seed: TSYVKVLEHV (MAGA4_HUMAN)
THYVKVLEHF

SEQ ID NO: 63032 - protein, 9 aa, Artificial Sequence
  Description of Artificial Sequence: Synthetic peptide
  Seed: RVRIAYPSL (MAGA4_HUMAN)
RVRIAYPSY

SEQ ID NO: 63033 - protein, 10 aa, Artificial Sequence
  Description of Artificial Sequence: Synthetic peptide
  Seed: FGKASESLKM (MAGA4_HUMAN)
FQKASESLKM

SEQ ID NO: 63034 - protein, 10 aa, Artificial Sequence
  Description of Artificial Sequence: Synthetic peptide
  Seed: VIFGKASESL (MAGA4_HUMAN)
VQFGKASESW

SEQ ID NO: 63035 - protein, 9 aa, Artificial Sequence
  Description of Artificial Sequence: Synthetic peptide
  Seed: SNPARYEFL (MAGA4_HUMAN)
SAPARYEFI

SEQ ID NO: 63036 - protein, 9 aa, Artificial Sequence
  Description of Artificial Sequence: Synthetic peptide
  Seed: YRAKELVTK (MAGA4_HUMAN)
YQAKELVTL

SEQ ID NO: 63037 - protein, 10 aa, Artificial Sequence
  Description of Artificial Sequence: Synthetic peptide
  Seed: QEAAVSSSSP (MAGA4_HUMAN)
QEAAVSSSSL

SEQ ID NO: 63038 - protein, 10 aa, Artificial Sequence
  Description of Artificial Sequence: Synthetic peptide
  Seed: SSSPLVPGTL (MAGA4_HUMAN)
SLSPLVPGTV

SEQ ID NO: 63039 - protein, 9 aa, Artificial Sequence
  Description of Artificial Sequence: Synthetic peptide
  Seed: SALPTTISF (MAGA4_HUMAN)
SQLPTTISV

SEQ ID NO: 63040 - protein, 8 aa, Artificial Sequence
  Description of Artificial Sequence: Synthetic peptide
  Seed: FLLRKYRA (MAGA4_HUMAN)
FPLRKYRL

SEQ ID NO: 63041 - protein, 10 aa, Artificial Sequence
  Description of Artificial Sequence: Synthetic peptide
  Seed: GVYDGREHTV (MAGA4_HUMAN)
GMYDGREHTY

SEQ ID NO: 63042 - protein, 10 aa, Artificial Sequence
  Description of Artificial Sequence: Synthetic peptide
  Seed: KYRAKELVTK (MAGA4_HUMAN)
KVRAKELVTR

SEQ ID NO: 63043 - protein, 9 aa, Artificial Sequence
  Description of Artificial Sequence: Synthetic peptide
  Seed: YPSLREAAL (MAGA4_HUMAN)
YVSLREAAM

SEQ ID NO: 63044 - protein, 10 aa, Artificial Sequence
  Description of Artificial Sequence: Synthetic peptide
  Seed: RVRIAYPSLR (MAGA4_HUMAN)
RARIAYPSLR

SEQ ID NO: 63045 - protein, 9 aa, Artificial Sequence
  Description of Artificial Sequence: Synthetic peptide
  Seed: NTYTLVTCL (MAGA4_HUMAN)
NTYTLVTCI

SEQ ID NO: 63046 - protein, 11 aa, Artificial Sequence
  Description of Artificial Sequence: Synthetic peptide
  Seed: SSSSPLVPGTL (MAGA4_HUMAN)
SLSSPLVPGTW

SEQ ID NO: 63047 - protein, 9 aa, Artificial Sequence
  Description of Artificial Sequence: Synthetic peptide
  Seed: KVDELAHFL (MAGA4_HUMAN)
KIDELAHFA

SEQ ID NO: 63048 - protein, 9 aa, Artificial Sequence
  Description of Artificial Sequence: Synthetic peptide
  Seed: KVLEHVVRV (MAGA4_HUMAN)
KVLEHVVRK

SEQ ID NO: 63049 - protein, 9 aa, Artificial Sequence
  Description of Artificial Sequence: Synthetic peptide
  Seed: SNPARYEFL (MAGA4_HUMAN)
SRPARYEFY

SEQ ID NO: 63050 - protein, 9 aa, Artificial Sequence
  Description of Artificial Sequence: Synthetic peptide
  Seed: LVPGTLEEV (MAGA4_HUMAN)
LYPGTLEEM

SEQ ID NO: 63051 - protein, 10 aa, Artificial Sequence
  Description of Artificial Sequence: Synthetic peptide
  Seed: SSSPLVPGTL (MAGA4_HUMAN)
SISPLVPGTI

SEQ ID NO: 63052 - protein, 8 aa, Artificial Sequence
  Description of Artificial Sequence: Synthetic peptide
  Seed: MIFGIDVK (MAGA4_HUMAN)
MTFGIDVR

SEQ ID NO: 63053 - protein, 9 aa, Artificial Sequence
  Description of Artificial Sequence: Synthetic peptide
  Seed: GLLIIVLGT (MAGA4_HUMAN)
GLLIIVLGV

SEQ ID NO: 63054 - protein, 10 aa, Artificial Sequence
  Description of Artificial Sequence: Synthetic peptide
  Seed: MIFGIDVKEV (MAGA4_HUMAN)
MTFGIDVKET

SEQ ID NO: 63055 - protein, 9 aa, Artificial Sequence
  Description of Artificial Sequence: Synthetic peptide
  Seed: AAVSSSSPL (MAGA4_HUMAN)
AVVSSSSPI

SEQ ID NO: 63056 - protein, 10 aa, Artificial Sequence
  Description of Artificial Sequence: Synthetic peptide
  Seed: RVRIAYPSLR (MAGA4_HUMAN)
RTRIAYPSLY

SEQ ID NO: 63057 - protein, 9 aa, Artificial Sequence
  Description of Artificial Sequence: Synthetic peptide
  Seed: STSPDAESL (MAGA4_HUMAN)
SQSPDAESW

SEQ ID NO: 63058 - protein, 8 aa, Artificial Sequence
  Description of Artificial Sequence: Synthetic peptide
  Seed: SEQKSQHC (MAGA4_HUMAN)
SEQKSQHI

SEQ ID NO: 63059 - protein, 8 aa, Artificial Sequence
  Description of Artificial Sequence: Synthetic peptide
  Seed: KVDELAHF (MAGA4_HUMAN)
KSDELAHV

SEQ ID NO: 63060 - protein, 11 aa, Artificial Sequence
  Description of Artificial Sequence: Synthetic peptide
  Seed: ELVTKAEMLER (MAGA4_HUMAN)
EVVTKAEMLEK

SEQ ID NO: 63061 - protein, 10 aa, Artificial Sequence
  Description of Artificial Sequence: Synthetic peptide
  Seed: KNYKRCFPVI (MAGA4_HUMAN)
KRYKRCFPVK

SEQ ID NO: 63062 - protein, 9 aa, Artificial Sequence
  Description of Artificial Sequence: Synthetic peptide
  Seed: IIVLGTIAM (MAGA4_HUMAN)
IIVLGTIAY

SEQ ID NO: 63063 - protein, 11 aa, Artificial Sequence
  Description of Artificial Sequence: Synthetic peptide
  Seed: YVKVLEHVVRV (MAGA4_HUMAN)
YLKVLEHVVRL

SEQ ID NO: 63064 - protein, 10 aa, Artificial Sequence
  Description of Artificial Sequence: Synthetic peptide
  Seed: LLGNNQIFPK (MAGA4_HUMAN)
LQGNNQIFPR

SEQ ID NO: 63065 - protein, 10 aa, Artificial Sequence
  Description of Artificial Sequence: Synthetic peptide
  Seed: PTTISFTCWR (MAGA4_HUMAN)
PYTISFTCWK

SEQ ID NO: 63066 - protein, 11 aa, Artificial Sequence
  Description of Artificial Sequence: Synthetic peptide
  Seed: YVKVLEHVVRV (MAGA4_HUMAN)
YSKVLEHVVRV

SEQ ID NO: 63067 - protein, 9 aa, Artificial Sequence
  Description of Artificial Sequence: Synthetic peptide
  Seed: LRKYRAKEL (MAGA4_HUMAN)
LPKYRAKEM

SEQ ID NO: 63068 - protein, 9 aa, Artificial Sequence
  Description of Artificial Sequence: Synthetic peptide
  Seed: RAKELVTKA (MAGA4_HUMAN)
RSKELVTKA

SEQ ID NO: 63069 - protein, 9 aa, Artificial Sequence
  Description of Artificial Sequence: Synthetic peptide
  Seed: SEEEIWEEL (MAGA4_HUMAN)
SLEEIWEEW

SEQ ID NO: 63070 - protein, 9 aa, Artificial Sequence
  Description of Artificial Sequence: Synthetic peptide
  Seed: YKRCFPVIF (MAGA4_HUMAN)
YMRCFPVIF

SEQ ID NO: 63071 - protein, 10 aa, Artificial Sequence
  Description of Artificial Sequence: Synthetic peptide
  Seed: GLVGAQAPTT (MAGA4_HUMAN)
GLVGAQAPTL

SEQ ID NO: 63072 - protein, 9 aa, Artificial Sequence
  Description of Artificial Sequence: Synthetic peptide
  Seed: GVMGVYDGR (MAGA4_HUMAN)
GMMGVYDGR

SEQ ID NO: 63073 - protein, 9 aa, Artificial Sequence
  Description of Artificial Sequence: Synthetic peptide
  Seed: WVQENYLEY (MAGA4_HUMAN)
WPQENYLEI

SEQ ID NO: 63074 - protein, 8 aa, Artificial Sequence
  Description of Artificial Sequence: Synthetic peptide
  Seed: KVDELAHF (MAGA4_HUMAN)
KYDELAHM

SEQ ID NO: 63075 - protein, 10 aa, Artificial Sequence
  Description of Artificial Sequence: Synthetic peptide
  Seed: VIFGKASESL (MAGA4_HUMAN)
VLFGKASESA

SEQ ID NO: 63076 - protein, 10 aa, Artificial Sequence
  Description of Artificial Sequence: Synthetic peptide
  Seed: GLLIIVLGTI (MAGA4_HUMAN)
GYLIIVLGTV

SEQ ID NO: 63077 - protein, 9 aa, Artificial Sequence
  Description of Artificial Sequence: Synthetic peptide
  Seed: VNARVRIAY (MAGA4_HUMAN)
VLARVRIAY

SEQ ID NO: 63078 - protein, 10 aa, Artificial Sequence
  Description of Artificial Sequence: Synthetic peptide
  Seed: LLGNNQIFPK (MAGA4_HUMAN)
LYGNNQIFPR

SEQ ID NO: 63079 - protein, 9 aa, Artificial Sequence
  Description of Artificial Sequence: Synthetic peptide
  Seed: SPDAESLFR (MAGA4_HUMAN)
SGDAESLFY

SEQ ID NO: 63080 - protein, 10 aa, Artificial Sequence
  Description of Artificial Sequence: Synthetic peptide
  Seed: ALSNKVDELA (MAGA4_HUMAN)
AMSNKVDELV

SEQ ID NO: 63081 - protein, 9 aa, Artificial Sequence
  Description of Artificial Sequence: Synthetic peptide
  Seed: RKYRAKELV (MAGA4_HUMAN)
RRYRAKELF

SEQ ID NO: 63082 - protein, 11 aa, Artificial Sequence
  Description of Artificial Sequence: Synthetic peptide
  Seed: SPQGASALPTT (MAGA4_HUMAN)
SPQGASALPTM

SEQ ID NO: 63083 - protein, 10 aa, Artificial Sequence
  Description of Artificial Sequence: Synthetic peptide
  Seed: RVRIAYPSLR (MAGA4_HUMAN)
RPRIAYPSLI

SEQ ID NO: 63084 - protein, 9 aa, Artificial Sequence
  Description of Artificial Sequence: Synthetic peptide
  Seed: IIVLGTIAM (MAGA4_HUMAN)
ILVLGTIAV

SEQ ID NO: 63085 - protein, 9 aa, Artificial Sequence
  Description of Artificial Sequence: Synthetic peptide
  Seed: RAKELVTKA (MAGA4_HUMAN)
RSKELVTKI

SEQ ID NO: 63086 - protein, 9 aa, Artificial Sequence
  Description of Artificial Sequence: Synthetic peptide
  Seed: TVYGEPRKL (MAGA4_HUMAN)
TRYGEPRKY

SEQ ID NO: 63087 - protein, 9 aa, Artificial Sequence
  Description of Artificial Sequence: Synthetic peptide
  Seed: TSPDAESLF (MAGA4_HUMAN)
TTPDAESLW

SEQ ID NO: 63088 - protein, 10 aa, Artificial Sequence
  Description of Artificial Sequence: Synthetic peptide
  Seed: LGVMGVYDGR (MAGA4_HUMAN)
LLVMGVYDGR

SEQ ID NO: 63089 - protein, 10 aa, Artificial Sequence
  Description of Artificial Sequence: Synthetic peptide
  Seed: KNYKRCFPVI (MAGA4_HUMAN)
KFYKRCFPVW

SEQ ID NO: 63090 - protein, 10 aa, Artificial Sequence
  Description of Artificial Sequence: Synthetic peptide
  Seed: TTISFTCWRQ (MAGA4_HUMAN)
TVISFTCWRI

SEQ ID NO: 63091 - protein, 11 aa, Artificial Sequence
  Description of Artificial Sequence: Synthetic peptide
  Seed: SSSSPLVPGTL (MAGA4_HUMAN)
STSSPLVPGTW

SEQ ID NO: 63092 - protein, 9 aa, Artificial Sequence
  Description of Artificial Sequence: Synthetic peptide
  Seed: LGNNQIFPK (MAGA4_HUMAN)
LVNNQIFPR

SEQ ID NO: 63093 - protein, 10 aa, Artificial Sequence
  Description of Artificial Sequence: Synthetic peptide
  Seed: GVYDGREHTV (MAGA4_HUMAN)
GVYDGREHTM

SEQ ID NO: 63094 - protein, 9 aa, Artificial Sequence
  Description of Artificial Sequence: Synthetic peptide
  Seed: RCFPVIFGK (MAGA4_HUMAN)
RTFPVIFGM

SEQ ID NO: 63095 - protein, 9 aa, Artificial Sequence
  Description of Artificial Sequence: Synthetic peptide
  Seed: YVKVLEHVV (MAGA4_HUMAN)
YAKVLEHVY

SEQ ID NO: 63096 - protein, 11 aa, Artificial Sequence
  Description of Artificial Sequence: Synthetic peptide
  Seed: GASALPTTISF (MAGA4_HUMAN)
GMSALPTTISY

SEQ ID NO: 63097 - protein, 9 aa, Artificial Sequence
  Description of Artificial Sequence: Synthetic peptide
  Seed: IIVLGTIAM (MAGA4_HUMAN)
IEVLGTIAF

SEQ ID NO: 63098 - protein, 9 aa, Artificial Sequence
  Description of Artificial Sequence: Synthetic peptide
  Seed: RVNARVRIA (MAGA4_HUMAN)
RVNARVRII

SEQ ID NO: 63099 - protein, 10 aa, Artificial Sequence
  Description of Artificial Sequence: Synthetic peptide
  Seed: YRQVPGSNPA (MAGA4_HUMAN)
YVQVPGSNPY

SEQ ID NO: 63100 - protein, 10 aa, Artificial Sequence
  Description of Artificial Sequence: Synthetic peptide
  Seed: DELAHFLLRK (MAGA4_HUMAN)
DSLAHFLLRR

SEQ ID NO: 63101 - protein, 9 aa, Artificial Sequence
  Description of Artificial Sequence: Synthetic peptide
  Seed: KYRAKELVT (MAGA4_HUMAN)
KTRAKELVS

SEQ ID NO: 63102 - protein, 9 aa, Artificial Sequence
  Description of Artificial Sequence: Synthetic peptide
  Seed: IFPKTGLLI (MAGA4_HUMAN)
ISPKTGLLL

SEQ ID NO: 63103 - protein, 9 aa, Artificial Sequence
  Description of Artificial Sequence: Synthetic peptide
  Seed: QVPGSNPAR (MAGA4_HUMAN)
QVPGSNPAK

SEQ ID NO: 63104 - protein, 11 aa, Artificial Sequence
  Description of Artificial Sequence: Synthetic peptide
  Seed: STSPDAESLFR (MAGA4_HUMAN)
SLSPDAESLFR

SEQ ID NO: 63105 - protein, 9 aa, Artificial Sequence
  Description of Artificial Sequence: Synthetic peptide
  Seed: QIFPKTGLL (MAGA4_HUMAN)
QAFPKTGLK

SEQ ID NO: 63106 - protein, 11 aa, Artificial Sequence
  Description of Artificial Sequence: Synthetic peptide
  Seed: STSPDAESLFR (MAGA4_HUMAN)
SMSPDAESLFR

SEQ ID NO: 63107 - protein, 10 aa, Artificial Sequence
  Description of Artificial Sequence: Synthetic peptide
  Seed: ARVRIAYPSL (MAGA4_HUMAN)
AMVRIAYPSK

SEQ ID NO: 63108 - protein, 9 aa, Artificial Sequence
  Description of Artificial Sequence: Synthetic peptide
  Seed: VTKAEMLER (MAGA4_HUMAN)
VYKAEMLER

SEQ ID NO: 63109 - protein, 9 aa, Artificial Sequence
  Description of Artificial Sequence: Synthetic peptide
  Seed: GSNPARYEF (MAGA4_HUMAN)
GQNPARYEV

SEQ ID NO: 63110 - protein, 9 aa, Artificial Sequence
  Description of Artificial Sequence: Synthetic peptide
  Seed: TSPDAESLF (MAGA4_HUMAN)
TFPDAESLL

SEQ ID NO: 63111 - protein, 9 aa, Artificial Sequence
  Description of Artificial Sequence: Synthetic peptide
  Seed: GASALPTTI (MAGA4_HUMAN)
GVSALPTTV

SEQ ID NO: 63112 - protein, 9 aa, Artificial Sequence
  Description of Artificial Sequence: Synthetic peptide
  Seed: KVLEHVVRV (MAGA4_HUMAN)
KNLEHVVRR

SEQ ID NO: 63113 - protein, 9 aa, Artificial Sequence
  Description of Artificial Sequence: Synthetic peptide
  Seed: YPSLREAAL (MAGA4_HUMAN)
YPSLREAAY

SEQ ID NO: 63114 - protein, 9 aa, Artificial Sequence
  Description of Artificial Sequence: Synthetic peptide
  Seed: LVPGTLEEV (MAGA4_HUMAN)
LIPGTLEEV

SEQ ID NO: 63115 - protein, 9 aa, Artificial Sequence
  Description of Artificial Sequence: Synthetic peptide
  Seed: ALLEEEEGV (MAGA4_HUMAN)
AMLEEEEGM

SEQ ID NO: 63116 - protein, 9 aa, Artificial Sequence
  Description of Artificial Sequence: Synthetic peptide
  Seed: LFREALSNK (MAGA4_HUMAN)
LMREALSNR

SEQ ID NO: 63117 - protein, 11 aa, Artificial Sequence
  Description of Artificial Sequence: Synthetic peptide
  Seed: EVDPASNTYTL (MAGA4_HUMAN)
EADPASNTYTL

SEQ ID NO: 63118 - protein, 10 aa, Artificial Sequence
  Description of Artificial Sequence: Synthetic peptide
  Seed: TLVTCLGLSY (MAGA4_HUMAN)
TMVTCLGLSM

SEQ ID NO: 63119 - protein, 10 aa, Artificial Sequence
  Description of Artificial Sequence: Synthetic peptide
  Seed: KVDELAHFLL (MAGA4_HUMAN)
KMDELAHFLN

SEQ ID NO: 63120 - protein, 9 aa, Artificial Sequence
  Description of Artificial Sequence: Synthetic peptide
  Seed: WVQENYLEY (MAGA4_HUMAN)
WKQENYLEY

SEQ ID NO: 63121 - protein, 10 aa, Artificial Sequence
  Description of Artificial Sequence: Synthetic peptide
  Seed: SYVKVLEHVV (MAGA4_HUMAN)
SYVKVLEHVF

SEQ ID NO: 63122 - protein, 9 aa, Artificial Sequence
  Description of Artificial Sequence: Synthetic peptide
  Seed: NYKRCFPVI (MAGA4_HUMAN)
NFKRCFPVL

SEQ ID NO: 63123 - protein, 9 aa, Artificial Sequence
  Description of Artificial Sequence: Synthetic peptide
  Seed: KELVTKAEM (MAGA4_HUMAN)
KTLVTKAEY

SEQ ID NO: 63124 - protein, 9 aa, Artificial Sequence
  Description of Artificial Sequence: Synthetic peptide
  Seed: GLLGNNQIF (MAGA4_HUMAN)
GQLGNNQIW

SEQ ID NO: 63125 - protein, 10 aa, Artificial Sequence
  Description of Artificial Sequence: Synthetic peptide
  Seed: SSSPLVPGTL (MAGA4_HUMAN)
SQSPLVPGTY

SEQ ID NO: 63126 - protein, 10 aa, Artificial Sequence
  Description of Artificial Sequence: Synthetic peptide
  Seed: KVDELAHFLL (MAGA4_HUMAN)
KLDELAHFLE

SEQ ID NO: 63127 - protein, 10 aa, Artificial Sequence
  Description of Artificial Sequence: Synthetic peptide
  Seed: QIFPKTGLLI (MAGA4_HUMAN)
QKFPKTGLLF

SEQ ID NO: 63128 - protein, 10 aa, Artificial Sequence
  Description of Artificial Sequence: Synthetic peptide
  Seed: NKVDELAHFL (MAGA4_HUMAN)
NYVDELAHFV

SEQ ID NO: 63129 - protein, 10 aa, Artificial Sequence
  Description of Artificial Sequence: Synthetic peptide
  Seed: AYPSLREAAL (MAGA4_HUMAN)
AIPSLREAAM

SEQ ID NO: 63130 - protein, 11 aa, Artificial Sequence
  Description of Artificial Sequence: Synthetic peptide
  Seed: ELGVMGVYDGR (MAGA4_HUMAN)
ETGVMGVYDGK

SEQ ID NO: 63131 - protein, 9 aa, Artificial Sequence
  Description of Artificial Sequence: Synthetic peptide
  Seed: RVRIAYPSL (MAGA4_HUMAN)
RPRIAYPST

SEQ ID NO: 63132 - protein, 11 aa, Artificial Sequence
  Description of Artificial Sequence: Synthetic peptide
  Seed: RQVPGSNPARY (MAGA4_HUMAN)
RIVPGSNPARY

SEQ ID NO: 63133 - protein, 9 aa, Artificial Sequence
  Description of Artificial Sequence: Synthetic peptide
  Seed: KYRAKELVT (MAGA4_HUMAN)
KMRAKELVA

SEQ ID NO: 63134 - protein, 9 aa, Artificial Sequence
  Description of Artificial Sequence: Synthetic peptide
  Seed: RVNARVRIA (MAGA4_HUMAN)
RSNARVRIM

SEQ ID NO: 63135 - protein, 10 aa, Artificial Sequence
  Description of Artificial Sequence: Synthetic peptide
  Seed: KVDELAHFLL (MAGA4_HUMAN)
KMDELAHFLY

SEQ ID NO: 63136 - protein, 9 aa, Artificial Sequence
  Description of Artificial Sequence: Synthetic peptide
  Seed: AYPSLREAA (MAGA4_HUMAN)
AYPSLREAF

SEQ ID NO: 63137 - protein, 9 aa, Artificial Sequence
  Description of Artificial Sequence: Synthetic peptide
  Seed: KELVTKAEM (MAGA4_HUMAN)
KQLVTKAEI

SEQ ID NO: 63138 - protein, 9 aa, Artificial Sequence
  Description of Artificial Sequence: Synthetic peptide
  Seed: SEEEIWEEL (MAGA4_HUMAN)
SEEEIWEEY

SEQ ID NO: 63139 - protein, 10 aa, Artificial Sequence
  Description of Artificial Sequence: Synthetic peptide
  Seed: SSSPLVPGTL (MAGA4_HUMAN)
SMSPLVPGTY

SEQ ID NO: 63140 - protein, 9 aa, Artificial Sequence
  Description of Artificial Sequence: Synthetic peptide
  Seed: DELAHFLLR (MAGA4_HUMAN)
DYLAHFLLR

SEQ ID NO: 63141 - protein, 9 aa, Artificial Sequence
  Description of Artificial Sequence: Synthetic peptide
  Seed: YKRCFPVIF (MAGA4_HUMAN)
YVRCFPVIY

SEQ ID NO: 63142 - protein, 9 aa, Artificial Sequence
  Description of Artificial Sequence: Synthetic peptide
  Seed: WVQENYLEY (MAGA4_HUMAN)
WGQENYLEY

SEQ ID NO: 63143 - protein, 10 aa, Artificial Sequence
  Description of Artificial Sequence: Synthetic peptide
  Seed: ARVRIAYPSL (MAGA4_HUMAN)
AWVRIAYPSV

SEQ ID NO: 63144 - protein, 9 aa, Artificial Sequence
  Description of Artificial Sequence: Synthetic peptide
  Seed: EEVPAAESA (MAGA4_HUMAN)
EEVPAAEST

SEQ ID NO: 63145 - protein, 9 aa, Artificial Sequence
  Description of Artificial Sequence: Synthetic peptide
  Seed: IAYPSLREA (MAGA4_HUMAN)
IQYPSLREF

SEQ ID NO: 63146 - protein, 9 aa, Artificial Sequence
  Description of Artificial Sequence: Synthetic peptide
  Seed: TQDWVQENY (MAGA4_HUMAN)
TSDWVQENM

SEQ ID NO: 63147 - protein, 10 aa, Artificial Sequence
  Description of Artificial Sequence: Synthetic peptide
  Seed: KEVDPASNTY (MAGA4_HUMAN)
KYVDPASNTF

SEQ ID NO: 63148 - protein, 9 aa, Artificial Sequence
  Description of Artificial Sequence: Synthetic peptide
  Seed: KNYKRCFPV (MAGA4_HUMAN)
KMYKRCFPR

SEQ ID NO: 63149 - protein, 10 aa, Artificial Sequence
  Description of Artificial Sequence: Synthetic peptide
  Seed: RIAYPSLREA (MAGA4_HUMAN)
RVAYPSLREK

SEQ ID NO: 63150 - protein, 10 aa, Artificial Sequence
  Description of Artificial Sequence: Synthetic peptide
  Seed: TSYVKVLEHV (MAGA4_HUMAN)
TRYVKVLEHL

SEQ ID NO: 63151 - protein, 9 aa, Artificial Sequence
  Description of Artificial Sequence: Synthetic peptide
  Seed: SALPTTISF (MAGA4_HUMAN)
SILPTTISW

SEQ ID NO: 63152 - protein, 9 aa, Artificial Sequence
  Description of Artificial Sequence: Synthetic peptide
  Seed: HVVRVNARV (MAGA4_HUMAN)
HSVRVNARR

SEQ ID NO: 63153 - protein, 10 aa, Artificial Sequence
  Description of Artificial Sequence: Synthetic peptide
  Seed: LGVMGVYDGR (MAGA4_HUMAN)
LNVMGVYDGR

SEQ ID NO: 63154 - protein, 9 aa, Artificial Sequence
  Description of Artificial Sequence: Synthetic peptide
  Seed: KVDELAHFL (MAGA4_HUMAN)
KVDELAHFF

SEQ ID NO: 63155 - protein, 9 aa, Artificial Sequence
  Description of Artificial Sequence: Synthetic peptide
  Seed: WVQENYLEY (MAGA4_HUMAN)
WQQENYLEF

SEQ ID NO: 63156 - protein, 9 aa, Artificial Sequence
  Description of Artificial Sequence: Synthetic peptide
  Seed: ELAHFLLRK (MAGA4_HUMAN)
EAAHFLLRK

SEQ ID NO: 63157 - protein, 10 aa, Artificial Sequence
  Description of Artificial Sequence: Synthetic peptide
  Seed: LTQDWVQENY (MAGA4_HUMAN)
LTQDWVQENF

SEQ ID NO: 63158 - protein, 10 aa, Artificial Sequence
  Description of Artificial Sequence: Synthetic peptide
  Seed: SSSPLVPGTL (MAGA4_HUMAN)
STSPLVPGTY

SEQ ID NO: 63159 - protein, 9 aa, Artificial Sequence
  Description of Artificial Sequence: Synthetic peptide
  Seed: QDWVQENYL (MAGA4_HUMAN)
QEWVQENYM

SEQ ID NO: 63160 - protein, 10 aa, Artificial Sequence
  Description of Artificial Sequence: Synthetic peptide
  Seed: EAAVSSSSPL (MAGA4_HUMAN)
EQAVSSSSPV

SEQ ID NO: 63161 - protein, 9 aa, Artificial Sequence
  Description of Artificial Sequence: Synthetic peptide
  Seed: SPDAESLFR (MAGA4_HUMAN)
SQDAESLFY

SEQ ID NO: 63162 - protein, 9 aa, Artificial Sequence
  Description of Artificial Sequence: Synthetic peptide
  Seed: GTLEEVPAA (MAGA4_HUMAN)
GILEEVPAL

SEQ ID NO: 63163 - protein, 10 aa, Artificial Sequence
  Description of Artificial Sequence: Synthetic peptide
  Seed: KEVDPASNTY (MAGA4_HUMAN)
KHVDPASNTF

SEQ ID NO: 63164 - protein, 9 aa, Artificial Sequence
  Description of Artificial Sequence: Synthetic peptide
  Seed: AESAGPPQS (MAGA4_HUMAN)
AESAGPPQF

SEQ ID NO: 63165 - protein, 8 aa, Artificial Sequence
  Description of Artificial Sequence: Synthetic peptide
  Seed: RVRIAYPS (MAGA4_HUMAN)
RYRIAYPK

SEQ ID NO: 63166 - protein, 9 aa, Artificial Sequence
  Description of Artificial Sequence: Synthetic peptide
  Seed: VYDGREHTV (MAGA4_HUMAN)
VFDGREHTC

SEQ ID NO: 63167 - protein, 11 aa, Artificial Sequence
  Description of Artificial Sequence: Synthetic peptide
  Seed: RVRIAYPSLRE (MAGA4_HUMAN)
RARIAYPSLRA

SEQ ID NO: 63168 - protein, 9 aa, Artificial Sequence
  Description of Artificial Sequence: Synthetic peptide
  Seed: WVQENYLEY (MAGA4_HUMAN)
WTQENYLER

SEQ ID NO: 63169 - protein, 9 aa, Artificial Sequence
  Description of Artificial Sequence: Synthetic peptide
  Seed: LPTTISFTC (MAGA4_HUMAN)
LATTISFTY

SEQ ID NO: 63170 - protein, 10 aa, Artificial Sequence
  Description of Artificial Sequence: Synthetic peptide
  Seed: FGKASESLKM (MAGA4_HUMAN)
FPKASESLKF

SEQ ID NO: 63171 - protein, 9 aa, Artificial Sequence
  Description of Artificial Sequence: Synthetic peptide
  Seed: IAYPSLREA (MAGA4_HUMAN)
IIYPSLREI

SEQ ID NO: 63172 - protein, 9 aa, Artificial Sequence
  Description of Artificial Sequence: Synthetic peptide
  Seed: AESLFREAL (MAGA4_HUMAN)
AHSLFREAI

SEQ ID NO: 63173 - protein, 10 aa, Artificial Sequence
  Description of Artificial Sequence: Synthetic peptide
  Seed: LLGNNQIFPK (MAGA4_HUMAN)
LIGNNQIFPR

SEQ ID NO: 63174 - protein, 10 aa, Artificial Sequence
  Description of Artificial Sequence: Synthetic peptide
  Seed: VDPASNTYTL (MAGA4_HUMAN)
VHPASNTYTY

SEQ ID NO: 63175 - protein, 9 aa, Artificial Sequence
  Description of Artificial Sequence: Synthetic peptide
  Seed: GLLIIVLGT (MAGA4_HUMAN)
GMLIIVLGV

SEQ ID NO: 63176 - protein, 10 aa, Artificial Sequence
  Description of Artificial Sequence: Synthetic peptide
  Seed: RVRIAYPSLR (MAGA4_HUMAN)
RMRIAYPSLM

SEQ ID NO: 63177 - protein, 9 aa, Artificial Sequence
  Description of Artificial Sequence: Synthetic peptide
  Seed: LVPGTLEEV (MAGA4_HUMAN)
LPPGTLEEV

SEQ ID NO: 63178 - protein, 8 aa, Artificial Sequence
  Description of Artificial Sequence: Synthetic peptide
  Seed: VYGEPRKL (MAGA4_HUMAN)
VAGEPRKV

SEQ ID NO: 63179 - protein, 10 aa, Artificial Sequence
  Description of Artificial Sequence: Synthetic peptide
  Seed: YRQVPGSNPA (MAGA4_HUMAN)
YYQVPGSNPM

SEQ ID NO: 63180 - protein, 9 aa, Artificial Sequence
  Description of Artificial Sequence: Synthetic peptide
  Seed: QVPGSNPAR (MAGA4_HUMAN)
QAPGSNPAF

SEQ ID NO: 63181 - protein, 10 aa, Artificial Sequence
  Description of Artificial Sequence: Synthetic peptide
  Seed: RVRIAYPSLR (MAGA4_HUMAN)
RNRIAYPSLY

SEQ ID NO: 63182 - protein, 9 aa, Artificial Sequence
  Description of Artificial Sequence: Synthetic peptide
  Seed: SNPARYEFL (MAGA4_HUMAN)
SAPARYEFL

SEQ ID NO: 63183 - protein, 9 aa, Artificial Sequence
  Description of Artificial Sequence: Synthetic peptide
  Seed: VYGEPRKLL (MAGA4_HUMAN)
VYGEPRKLF

SEQ ID NO: 63184 - protein, 10 aa, Artificial Sequence
  Description of Artificial Sequence: Synthetic peptide
  Seed: SLFREALSNK (MAGA4_HUMAN)
SQFREALSNK

SEQ ID NO: 63185 - protein, 10 aa, Artificial Sequence
  Description of Artificial Sequence: Synthetic peptide
  Seed: VEAQEEALGL (MAGA4_HUMAN)
VEAQEEALGY

SEQ ID NO: 63186 - protein, 10 aa, Artificial Sequence
  Description of Artificial Sequence: Synthetic peptide
  Seed: EAAVSSSSPL (MAGA4_HUMAN)
ESAVSSSSPR

SEQ ID NO: 63187 - protein, 10 aa, Artificial Sequence
  Description of Artificial Sequence: Synthetic peptide
  Seed: SESLKMIFGI (MAGA4_HUMAN)
SHSLKMIFGW

SEQ ID NO: 63188 - protein, 10 aa, Artificial Sequence
  Description of Artificial Sequence: Synthetic peptide
  Seed: KEVDPASNTY (MAGA4_HUMAN)
KEVDPASNTP

SEQ ID NO: 63189 - protein, 9 aa, Artificial Sequence
  Description of Artificial Sequence: Synthetic peptide
  Seed: STSPDAESL (MAGA4_HUMAN)
SSSPDAESY

SEQ ID NO: 63190 - protein, 9 aa, Artificial Sequence
  Description of Artificial Sequence: Synthetic peptide
  Seed: FGKASESLK (MAGA4_HUMAN)
FTKASESLK

SEQ ID NO: 63191 - protein, 9 aa, Artificial Sequence
  Description of Artificial Sequence: Synthetic peptide
  Seed: WVQENYLEY (MAGA4_HUMAN)
WTQENYLEL

SEQ ID NO: 63192 - protein, 9 aa, Artificial Sequence
  Description of Artificial Sequence: Synthetic peptide
  Seed: RVNARVRIA (MAGA4_HUMAN)
RVNARVRIV

SEQ ID NO: 63193 - protein, 9 aa, Artificial Sequence
  Description of Artificial Sequence: Synthetic peptide
  Seed: GSNPARYEF (MAGA4_HUMAN)
GMNPARYEY

SEQ ID NO: 63194 - protein, 9 aa, Artificial Sequence
  Description of Artificial Sequence: Synthetic peptide
  Seed: QDWVQENYL (MAGA4_HUMAN)
QEWVQENYA

SEQ ID NO: 63195 - protein, 9 aa, Artificial Sequence
  Description of Artificial Sequence: Synthetic peptide
  Seed: RQVPGSNPA (MAGA4_HUMAN)
RTVPGSNPF

SEQ ID NO: 63196 - protein, 9 aa, Artificial Sequence
  Description of Artificial Sequence: Synthetic peptide
  Seed: SSSPLVPGT (MAGA4_HUMAN)
SMSPLVPGM

SEQ ID NO: 63197 - protein, 9 aa, Artificial Sequence
  Description of Artificial Sequence: Synthetic peptide
  Seed: SALPTTISF (MAGA4_HUMAN)
SQLPTTISL

SEQ ID NO: 63198 - protein, 11 aa, Artificial Sequence
  Description of Artificial Sequence: Synthetic peptide
  Seed: MSSEQKSQHCK (MAGA4_HUMAN)
MTSEQKSQHCY

SEQ ID NO: 63199 - protein, 9 aa, Artificial Sequence
  Description of Artificial Sequence: Synthetic peptide
  Seed: AQEEALGLV (MAGA4_HUMAN)
AEEEALGLI

SEQ ID NO: 63200 - protein, 9 aa, Artificial Sequence
  Description of Artificial Sequence: Synthetic peptide
  Seed: NKVDELAHF (MAGA4_HUMAN)
NMVDELAHY

SEQ ID NO: 63201 - protein, 9 aa, Artificial Sequence
  Description of Artificial Sequence: Synthetic peptide
  Seed: KTGLLIIVL (MAGA4_HUMAN)
KMGLLIIVV

SEQ ID NO: 63202 - protein, 9 aa, Artificial Sequence
  Description of Artificial Sequence: Synthetic peptide
  Seed: SSSPLVPGT (MAGA4_HUMAN)
SASPLVPGI

SEQ ID NO: 63203 - protein, 9 aa, Artificial Sequence
  Description of Artificial Sequence: Synthetic peptide
  Seed: IFPKTGLLI (MAGA4_HUMAN)
ITPKTGLLL

SEQ ID NO: 63204 - protein, 10 aa, Artificial Sequence
  Description of Artificial Sequence: Synthetic peptide
  Seed: AESAGPPQSP (MAGA4_HUMAN)
AESAGPPQSI

SEQ ID NO: 63205 - protein, 10 aa, Artificial Sequence
  Description of Artificial Sequence: Synthetic peptide
  Seed: KEVDPASNTY (MAGA4_HUMAN)
KEVDPASNTL

SEQ ID NO: 63206 - protein, 9 aa, Artificial Sequence
  Description of Artificial Sequence: Synthetic peptide
  Seed: TQDWVQENY (MAGA4_HUMAN)
TLDWVQENL

SEQ ID NO: 63207 - protein, 9 aa, Artificial Sequence
  Description of Artificial Sequence: Synthetic peptide
  Seed: AEMLERVIK (MAGA4_HUMAN)
AEMLERVIW

SEQ ID NO: 63208 - protein, 11 aa, Artificial Sequence
  Description of Artificial Sequence: Synthetic peptide
  Seed: GVYDGREHTVY (MAGA4_HUMAN)
GKYDGREHTVY

SEQ ID NO: 63209 - protein, 10 aa, Artificial Sequence
  Description of Artificial Sequence: Synthetic peptide
  Seed: KNYKRCFPVI (MAGA4_HUMAN)
KIYKRCFPVV

SEQ ID NO: 63210 - protein, 11 aa, Artificial Sequence
  Description of Artificial Sequence: Synthetic peptide
  Seed: IAYPSLREAAL (MAGA4_HUMAN)
ISYPSLREAAF

SEQ ID NO: 63211 - protein, 9 aa, Artificial Sequence
  Description of Artificial Sequence: Synthetic peptide
  Seed: RVRIAYPSL (MAGA4_HUMAN)
RSRIAYPSL

SEQ ID NO: 63212 - protein, 10 aa, Artificial Sequence
  Description of Artificial Sequence: Synthetic peptide
  Seed: KEVDPASNTY (MAGA4_HUMAN)
KHVDPASNTY

SEQ ID NO: 63213 - protein, 11 aa, Artificial Sequence
  Description of Artificial Sequence: Synthetic peptide
  Seed: GLLGNNQIFPK (MAGA4_HUMAN)
GSLGNNQIFPR

SEQ ID NO: 63214 - protein, 9 aa, Artificial Sequence
  Description of Artificial Sequence: Synthetic peptide
  Seed: LVPGTLEEV (MAGA4_HUMAN)
LFPGTLEEM

SEQ ID NO: 63215 - protein, 9 aa, Artificial Sequence
  Description of Artificial Sequence: Synthetic peptide
  Seed: KVLEHVVRV (MAGA4_HUMAN)
KALEHVVRL

SEQ ID NO: 63216 - protein, 8 aa, Artificial Sequence
  Description of Artificial Sequence: Synthetic peptide
  Seed: RVRIAYPS (MAGA4_HUMAN)
RVRIAYPY

SEQ ID NO: 63217 - protein, 10 aa, Artificial Sequence
  Description of Artificial Sequence: Synthetic peptide
  Seed: SLFREALSNK (MAGA4_HUMAN)
SSFREALSNK

SEQ ID NO: 63218 - protein, 9 aa, Artificial Sequence
  Description of Artificial Sequence: Synthetic peptide
  Seed: ERVIKNYKR (MAGA4_HUMAN)
EFVIKNYKR

SEQ ID NO: 63219 - protein, 10 aa, Artificial Sequence
  Description of Artificial Sequence: Synthetic peptide
  Seed: KEVDPASNTY (MAGA4_HUMAN)
KTVDPASNTY

SEQ ID NO: 63220 - protein, 9 aa, Artificial Sequence
  Description of Artificial Sequence: Synthetic peptide
  Seed: SYVKVLEHV (MAGA4_HUMAN)
SWVKVLEHM

SEQ ID NO: 63221 - protein, 10 aa, Artificial Sequence
  Description of Artificial Sequence: Synthetic peptide
  Seed: RVRIAYPSLR (MAGA4_HUMAN)
RTRIAYPSLG

SEQ ID NO: 63222 - protein, 10 aa, Artificial Sequence
  Description of Artificial Sequence: Synthetic peptide
  Seed: VKVLEHVVRV (MAGA4_HUMAN)
VMVLEHVVRL

SEQ ID NO: 63223 - protein, 9 aa, Artificial Sequence
  Description of Artificial Sequence: Synthetic peptide
  Seed: LVPGTLEEV (MAGA4_HUMAN)
LLPGTLEEF

SEQ ID NO: 63224 - protein, 10 aa, Artificial Sequence
  Description of Artificial Sequence: Synthetic peptide
  Seed: SPQGASALPT (MAGA4_HUMAN)
SPQGASALPF

SEQ ID NO: 63225 - protein, 9 aa, Artificial Sequence
  Description of Artificial Sequence: Synthetic peptide
  Seed: TQDWVQENY (MAGA4_HUMAN)
TIDWVQENL

SEQ ID NO: 63226 - protein, 9 aa, Artificial Sequence
  Description of Artificial Sequence: Synthetic peptide
  Seed: REAALLEEE (MAGA4_HUMAN)
REAALLEEP

SEQ ID NO: 63227 - protein, 9 aa, Artificial Sequence
  Description of Artificial Sequence: Synthetic peptide
  Seed: VRIAYPSLR (MAGA4_HUMAN)
VYIAYPSLF

SEQ ID NO: 63228 - protein, 10 aa, Artificial Sequence
  Description of Artificial Sequence: Synthetic peptide
  Seed: EHTVYGEPRK (MAGA4_HUMAN)
ERTVYGEPRR

SEQ ID NO: 63229 - protein, 9 aa, Artificial Sequence
  Description of Artificial Sequence: Synthetic peptide
  Seed: SALPTTISF (MAGA4_HUMAN)
SMLPTTISV

SEQ ID NO: 63230 - protein, 11 aa, Artificial Sequence
  Description of Artificial Sequence: Synthetic peptide
  Seed: KEVDPASNTYT (MAGA4_HUMAN)
KEVDPASNTYF

SEQ ID NO: 63231 - protein, 10 aa, Artificial Sequence
  Description of Artificial Sequence: Synthetic peptide
  Seed: KELVTKAEML (MAGA4_HUMAN)
KELVTKAEMM

SEQ ID NO: 63232 - protein, 9 aa, Artificial Sequence
  Description of Artificial Sequence: Synthetic peptide
  Seed: RVRIAYPSL (MAGA4_HUMAN)
RQRIAYPSS

SEQ ID NO: 63233 - protein, 9 aa, Artificial Sequence
  Description of Artificial Sequence: Synthetic peptide
  Seed: RAKELVTKA (MAGA4_HUMAN)
RQKELVTKM

SEQ ID NO: 63234 - protein, 9 aa, Artificial Sequence
  Description of Artificial Sequence: Synthetic peptide
  Seed: LEHVVRVNA (MAGA4_HUMAN)
LHHVVRVNA

SEQ ID NO: 63235 - protein, 9 aa, Artificial Sequence
  Description of Artificial Sequence: Synthetic peptide
  Seed: SSPLVPGTL (MAGA4_HUMAN)
SFPLVPGTM

SEQ ID NO: 63236 - protein, 10 aa, Artificial Sequence
  Description of Artificial Sequence: Synthetic peptide
  Seed: ARVRIAYPSL (MAGA4_HUMAN)
AEVRIAYPSV

SEQ ID NO: 63237 - protein, 9 aa, Artificial Sequence
  Description of Artificial Sequence: Synthetic peptide
  Seed: AAVSSSSPL (MAGA4_HUMAN)
ASVSSSSPI

SEQ ID NO: 63238 - protein, 10 aa, Artificial Sequence
  Description of Artificial Sequence: Synthetic peptide
  Seed: ARVRIAYPSL (MAGA4_HUMAN)
ARVRIAYPSM

SEQ ID NO: 63239 - protein, 10 aa, Artificial Sequence
  Description of Artificial Sequence: Synthetic peptide
  Seed: RVRIAYPSLR (MAGA4_HUMAN)
RTRIAYPSLP

SEQ ID NO: 63240 - protein, 9 aa, Artificial Sequence
  Description of Artificial Sequence: Synthetic peptide
  Seed: AAVSSSSPL (MAGA4_HUMAN)
AQVSSSSPV

SEQ ID NO: 63241 - protein, 9 aa, Artificial Sequence
  Description of Artificial Sequence: Synthetic peptide
  Seed: ELAHFLLRK (MAGA4_HUMAN)
ESAHFLLRK

SEQ ID NO: 63242 - protein, 10 aa, Artificial Sequence
  Description of Artificial Sequence: Synthetic peptide
  Seed: RQVPGSNPAR (MAGA4_HUMAN)
RAVPGSNPAR

SEQ ID NO: 63243 - protein, 9 aa, Artificial Sequence
  Description of Artificial Sequence: Synthetic peptide
  Seed: MSSEQKSQH (MAGA4_HUMAN)
MASEQKSQY

SEQ ID NO: 63244 - protein, 9 aa, Artificial Sequence
  Description of Artificial Sequence: Synthetic peptide
  Seed: RVRIAYPSL (MAGA4_HUMAN)
RMRIAYPSC

SEQ ID NO: 63245 - protein, 10 aa, Artificial Sequence
  Description of Artificial Sequence: Synthetic peptide
  Seed: RIAYPSLREA (MAGA4_HUMAN)
RMAYPSLREI

SEQ ID NO: 63246 - protein, 10 aa, Artificial Sequence
  Description of Artificial Sequence: Synthetic peptide
  Seed: VEAQEEALGL (MAGA4_HUMAN)
VEAQEEALGA

SEQ ID NO: 63247 - protein, 10 aa, Artificial Sequence
  Description of Artificial Sequence: Synthetic peptide
  Seed: KYRAKELVTK (MAGA4_HUMAN)
KVRAKELVTS

SEQ ID NO: 63248 - protein, 9 aa, Artificial Sequence
  Description of Artificial Sequence: Synthetic peptide
  Seed: NTYTLVTCL (MAGA4_HUMAN)
NQYTLVTCV

SEQ ID NO: 63249 - protein, 9 aa, Artificial Sequence
  Description of Artificial Sequence: Synthetic peptide
  Seed: ALLEEEEGV (MAGA4_HUMAN)
ALLEEEEGI

SEQ ID NO: 63250 - protein, 9 aa, Artificial Sequence
  Description of Artificial Sequence: Synthetic peptide
  Seed: KASESLKMI (MAGA4_HUMAN)
KSSESLKMV

SEQ ID NO: 63251 - protein, 9 aa, Artificial Sequence
  Description of Artificial Sequence: Synthetic peptide
  Seed: IIVLGTIAM (MAGA4_HUMAN)
IPVLGTIAW

SEQ ID NO: 63252 - protein, 9 aa, Artificial Sequence
  Description of Artificial Sequence: Synthetic peptide
  Seed: ESLKMIFGI (MAGA4_HUMAN)
ETLKMIFGV

SEQ ID NO: 63253 - protein, 9 aa, Artificial Sequence
  Description of Artificial Sequence: Synthetic peptide
  Seed: NTYTLVTCL (MAGA4_HUMAN)
NTYTLVTCK

SEQ ID NO: 63254 - protein, 9 aa, Artificial Sequence
  Description of Artificial Sequence: Synthetic peptide
  Seed: TSPDAESLF (MAGA4_HUMAN)
TVPDAESLL

SEQ ID NO: 63255 - protein, 9 aa, Artificial Sequence
  Description of Artificial Sequence: Synthetic peptide
  Seed: FPKTGLLII (MAGA4_HUMAN)
FPKTGLLIA

SEQ ID NO: 63256 - protein, 10 aa, Artificial Sequence
  Description of Artificial Sequence: Synthetic peptide
  Seed: RVRIAYPSLR (MAGA4_HUMAN)
RFRIAYPSLF

SEQ ID NO: 63257 - protein, 9 aa, Artificial Sequence
  Description of Artificial Sequence: Synthetic peptide
  Seed: KVLEHVVRV (MAGA4_HUMAN)
KTLEHVVRI

SEQ ID NO: 63258 - protein, 9 aa, Artificial Sequence
  Description of Artificial Sequence: Synthetic peptide
  Seed: YPSLREAAL (MAGA4_HUMAN)
YTSLREAAV

SEQ ID NO: 63259 - protein, 9 aa, Artificial Sequence
  Description of Artificial Sequence: Synthetic peptide
  Seed: EVDPASNTY (MAGA4_HUMAN)
ETDPASNTM

SEQ ID NO: 63260 - protein, 10 aa, Artificial Sequence
  Description of Artificial Sequence: Synthetic peptide
  Seed: LGVMGVYDGR (MAGA4_HUMAN)
LVVMGVYDGR

SEQ ID NO: 63261 - protein, 10 aa, Artificial Sequence
  Description of Artificial Sequence: Synthetic peptide
  Seed: VDPASNTYTL (MAGA4_HUMAN)
VQPASNTYTL

SEQ ID NO: 63262 - protein, 9 aa, Artificial Sequence
  Description of Artificial Sequence: Synthetic peptide
  Seed: KNYKRCFPV (MAGA4_HUMAN)
KVYKRCFPL

SEQ ID NO: 63263 - protein, 11 aa, Artificial Sequence
  Description of Artificial Sequence: Synthetic peptide
  Seed: SSSSPLVPGTL (MAGA4_HUMAN)
SASSPLVPGTF

SEQ ID NO: 63264 - protein, 10 aa, Artificial Sequence
  Description of Artificial Sequence: Synthetic peptide
  Seed: YRQVPGSNPA (MAGA4_HUMAN)
YQQVPGSNPY

SEQ ID NO: 63265 - protein, 9 aa, Artificial Sequence
  Description of Artificial Sequence: Synthetic peptide
  Seed: YKRCFPVIF (MAGA4_HUMAN)
YTRCFPVIY

SEQ ID NO: 63266 - protein, 10 aa, Artificial Sequence
  Description of Artificial Sequence: Synthetic peptide
  Seed: KNYKRCFPVI (MAGA4_HUMAN)
KVYKRCFPVF

SEQ ID NO: 63267 - protein, 9 aa, Artificial Sequence
  Description of Artificial Sequence: Synthetic peptide
  Seed: RVRIAYPSL (MAGA4_HUMAN)
RWRIAYPSI

SEQ ID NO: 63268 - protein, 9 aa, Artificial Sequence
  Description of Artificial Sequence: Synthetic peptide
  Seed: LVPGTLEEV (MAGA4_HUMAN)
LLPGTLEEM

SEQ ID NO: 63269 - protein, 9 aa, Artificial Sequence
  Description of Artificial Sequence: Synthetic peptide
  Seed: VYDGREHTV (MAGA4_HUMAN)
VSDGREHTM

SEQ ID NO: 63270 - protein, 10 aa, Artificial Sequence
  Description of Artificial Sequence: Synthetic peptide
  Seed: RVNARVRIAY (MAGA4_HUMAN)
RANARVRIAY

SEQ ID NO: 63271 - protein, 9 aa, Artificial Sequence
  Description of Artificial Sequence: Synthetic peptide
  Seed: VNARVRIAY (MAGA4_HUMAN)
VQARVRIAY

SEQ ID NO: 63272 - protein, 9 aa, Artificial Sequence
  Description of Artificial Sequence: Synthetic peptide
  Seed: RKYRAKELV (MAGA4_HUMAN)
RMYRAKELF

SEQ ID NO: 63273 - protein, 10 aa, Artificial Sequence
  Description of Artificial Sequence: Synthetic peptide
  Seed: SSEQKSQHCK (MAGA4_HUMAN)
SLEQKSQHCY

SEQ ID NO: 63274 - protein, 8 aa, Artificial Sequence
  Description of Artificial Sequence: Synthetic peptide
  Seed: FLLRKYRA (MAGA4_HUMAN)
FLLRKYRL

SEQ ID NO: 63275 - protein, 10 aa, Artificial Sequence
  Description of Artificial Sequence: Synthetic peptide
  Seed: ASALPTTISF (MAGA4_HUMAN)
AYALPTTISY

SEQ ID NO: 63276 - protein, 10 aa, Artificial Sequence
  Description of Artificial Sequence: Synthetic peptide
  Seed: RVRIAYPSLR (MAGA4_HUMAN)
RKRIAYPSLI

SEQ ID NO: 63277 - protein, 10 aa, Artificial Sequence
  Description of Artificial Sequence: Synthetic peptide
  Seed: KYRAKELVTK (MAGA4_HUMAN)
KVRAKELVTV

SEQ ID NO: 63278 - protein, 8 aa, Artificial Sequence
  Description of Artificial Sequence: Synthetic peptide
  Seed: AESLFREA (MAGA4_HUMAN)
AESLFREF

SEQ ID NO: 63279 - protein, 9 aa, Artificial Sequence
  Description of Artificial Sequence: Synthetic peptide
  Seed: SEEEIWEEL (MAGA4_HUMAN)
SMEEIWEEW

SEQ ID NO: 63280 - protein, 9 aa, Artificial Sequence
  Description of Artificial Sequence: Synthetic peptide
  Seed: AAVSSSSPL (MAGA4_HUMAN)
AYVSSSSPY

SEQ ID NO: 63281 - protein, 9 aa, Artificial Sequence
  Description of Artificial Sequence: Synthetic peptide
  Seed: RVNARVRIA (MAGA4_HUMAN)
RTNARVRIY

SEQ ID NO: 63282 - protein, 9 aa, Artificial Sequence
  Description of Artificial Sequence: Synthetic peptide
  Seed: RVRIAYPSL (MAGA4_HUMAN)
RVRIAYPSN

SEQ ID NO: 63283 - protein, 10 aa, Artificial Sequence
  Description of Artificial Sequence: Synthetic peptide
  Seed: ELAHFLLRKY (MAGA4_HUMAN)
ESAHFLLRKR

SEQ ID NO: 63284 - protein, 10 aa, Artificial Sequence
  Description of Artificial Sequence: Synthetic peptide
  Seed: RQVPGSNPAR (MAGA4_HUMAN)
RFVPGSNPAR

SEQ ID NO: 63285 - protein, 10 aa, Artificial Sequence
  Description of Artificial Sequence: Synthetic peptide
  Seed: SPQGASALPT (MAGA4_HUMAN)
SPQGASALPI

SEQ ID NO: 63286 - protein, 9 aa, Artificial Sequence
  Description of Artificial Sequence: Synthetic peptide
  Seed: EEALGLVGA (MAGA4_HUMAN)
EEALGLVGM

SEQ ID NO: 63287 - protein, 10 aa, Artificial Sequence
  Description of Artificial Sequence: Synthetic peptide
  Seed: KEVDPASNTY (MAGA4_HUMAN)
KAVDPASNTW

SEQ ID NO: 63288 - protein, 9 aa, Artificial Sequence
  Description of Artificial Sequence: Synthetic peptide
  Seed: SALPTTISF (MAGA4_HUMAN)
SNLPTTISV

SEQ ID NO: 63289 - protein, 10 aa, Artificial Sequence
  Description of Artificial Sequence: Synthetic peptide
  Seed: EHTVYGEPRK (MAGA4_HUMAN)
EYTVYGEPRR

SEQ ID NO: 63290 - protein, 9 aa, Artificial Sequence
  Description of Artificial Sequence: Synthetic peptide
  Seed: RAKELVTKA (MAGA4_HUMAN)
RTKELVTKR

SEQ ID NO: 63291 - protein, 10 aa, Artificial Sequence
  Description of Artificial Sequence: Synthetic peptide
  Seed: YPSLREAALL (MAGA4_HUMAN)
YPSLREAALI

SEQ ID NO: 63292 - protein, 9 aa, Artificial Sequence
  Description of Artificial Sequence: Synthetic peptide
  Seed: KNYKRCFPV (MAGA4_HUMAN)
KQYKRCFPK

SEQ ID NO: 63293 - protein, 10 aa, Artificial Sequence
  Description of Artificial Sequence: Synthetic peptide
  Seed: FGKASESLKM (MAGA4_HUMAN)
FLKASESLKF

SEQ ID NO: 63294 - protein, 9 aa, Artificial Sequence
  Description of Artificial Sequence: Synthetic peptide
  Seed: KVLEHVVRV (MAGA4_HUMAN)
KLLEHVVRA

SEQ ID NO: 63295 - protein, 9 aa, Artificial Sequence
  Description of Artificial Sequence: Synthetic peptide
  Seed: YPSLREAAL (MAGA4_HUMAN)
YLSLREAAY

SEQ ID NO: 63296 - protein, 9 aa, Artificial Sequence
  Description of Artificial Sequence: Synthetic peptide
  Seed: IIVLGTIAM (MAGA4_HUMAN)
IHVLGTIAY

SEQ ID NO: 63297 - protein, 9 aa, Artificial Sequence
  Description of Artificial Sequence: Synthetic peptide
  Seed: RQVPGSNPA (MAGA4_HUMAN)
RMVPGSNPA

SEQ ID NO: 63298 - protein, 10 aa, Artificial Sequence
  Description of Artificial Sequence: Synthetic peptide
  Seed: YRQVPGSNPA (MAGA4_HUMAN)
YIQVPGSNPV

SEQ ID NO: 63299 - protein, 9 aa, Artificial Sequence
  Description of Artificial Sequence: Synthetic peptide
  Seed: STSPDAESL (MAGA4_HUMAN)
SESPDAESF

SEQ ID NO: 63300 - protein, 10 aa, Artificial Sequence
  Description of Artificial Sequence: Synthetic peptide
  Seed: KVDELAHFLL (MAGA4_HUMAN)
KLDELAHFLD

SEQ ID NO: 63301 - protein, 9 aa, Artificial Sequence
  Description of Artificial Sequence: Synthetic peptide
  Seed: ALSNKVDEL (MAGA4_HUMAN)
AFSNKVDEM

SEQ ID NO: 63302 - protein, 10 aa, Artificial Sequence
  Description of Artificial Sequence: Synthetic peptide
  Seed: QIFPKTGLLI (MAGA4_HUMAN)
QNFPKTGLLF

SEQ ID NO: 63303 - protein, 9 aa, Artificial Sequence
  Description of Artificial Sequence: Synthetic peptide
  Seed: SEEEIWEEL (MAGA4_HUMAN)
STEEIWEEI

SEQ ID NO: 63304 - protein, 11 aa, Artificial Sequence
  Description of Artificial Sequence: Synthetic peptide
  Seed: MEGDSASEEEI (MAGA4_HUMAN)
MEGDSASEEEL

SEQ ID NO: 63305 - protein, 10 aa, Artificial Sequence
  Description of Artificial Sequence: Synthetic peptide
  Seed: YRQVPGSNPA (MAGA4_HUMAN)
YRQVPGSNPL

SEQ ID NO: 63306 - protein, 10 aa, Artificial Sequence
  Description of Artificial Sequence: Synthetic peptide
  Seed: YRQVPGSNPA (MAGA4_HUMAN)
YCQVPGSNPV

SEQ ID NO: 63307 - protein, 9 aa, Artificial Sequence
  Description of Artificial Sequence: Synthetic peptide
  Seed: VYDGREHTV (MAGA4_HUMAN)
VTDGREHTA

SEQ ID NO: 63308 - protein, 11 aa, Artificial Sequence
  Description of Artificial Sequence: Synthetic peptide
  Seed: LSNKVDELAHF (MAGA4_HUMAN)
LVNKVDELAHW

SEQ ID NO: 63309 - protein, 9 aa, Artificial Sequence
  Description of Artificial Sequence: Synthetic peptide
  Seed: KVLEHVVRV (MAGA4_HUMAN)
KGLEHVVRR

SEQ ID NO: 63310 - protein, 10 aa, Artificial Sequence
  Description of Artificial Sequence: Synthetic peptide
  Seed: TTISFTCWRQ (MAGA4_HUMAN)
TTISFTCWRN

SEQ ID NO: 63311 - protein, 9 aa, Artificial Sequence
  Description of Artificial Sequence: Synthetic peptide
  Seed: IAMEGDSAS (MAGA4_HUMAN)
IAMEGDSAY

SEQ ID NO: 63312 - protein, 9 aa, Artificial Sequence
  Description of Artificial Sequence: Synthetic peptide
  Seed: GASALPTTI (MAGA4_HUMAN)
GASALPTTV

SEQ ID NO: 63313 - protein, 9 aa, Artificial Sequence
  Description of Artificial Sequence: Synthetic peptide
  Seed: EELGVMGVY (MAGA4_HUMAN)
EELGVMGVW

SEQ ID NO: 63314 - protein, 9 aa, Artificial Sequence
  Description of Artificial Sequence: Synthetic peptide
  Seed: LAHFLLRKY (MAGA4_HUMAN)
LTHFLLRKY

SEQ ID NO: 63315 - protein, 9 aa, Artificial Sequence
  Description of Artificial Sequence: Synthetic peptide
  Seed: SSSPLVPGT (MAGA4_HUMAN)
SSSPLVPGV

SEQ ID NO: 63316 - protein, 9 aa, Artificial Sequence
  Description of Artificial Sequence: Synthetic peptide
  Seed: SSSPLVPGT (MAGA4_HUMAN)
SISPLVPGT

SEQ ID NO: 63317 - protein, 10 aa, Artificial Sequence
  Description of Artificial Sequence: Synthetic peptide
  Seed: YPSLREAALL (MAGA4_HUMAN)
YESLREAALW

SEQ ID NO: 63318 - protein, 9 aa, Artificial Sequence
  Description of Artificial Sequence: Synthetic peptide
  Seed: ARVRIAYPS (MAGA4_HUMAN)
ARVRIAYPK

SEQ ID NO: 63319 - protein, 11 aa, Artificial Sequence
  Description of Artificial Sequence: Synthetic peptide
  Seed: RVRIAYPSLRE (MAGA4_HUMAN)
RTRIAYPSLRS

SEQ ID NO: 63320 - protein, 10 aa, Artificial Sequence
  Description of Artificial Sequence: Synthetic peptide
  Seed: QIFPKTGLLI (MAGA4_HUMAN)
QAFPKTGLLF

SEQ ID NO: 63321 - protein, 11 aa, Artificial Sequence
  Description of Artificial Sequence: Synthetic peptide
  Seed: ELGVMGVYDGR (MAGA4_HUMAN)
EGGVMGVYDGR

SEQ ID NO: 63322 - protein, 9 aa, Artificial Sequence
  Description of Artificial Sequence: Synthetic peptide
  Seed: KVLEHVVRV (MAGA4_HUMAN)
KILEHVVRR

SEQ ID NO: 63323 - protein, 9 aa, Artificial Sequence
  Description of Artificial Sequence: Synthetic peptide
  Seed: EEQEAAVSS (MAGA4_HUMAN)
EEQEAAVSL

SEQ ID NO: 63324 - protein, 9 aa, Artificial Sequence
  Description of Artificial Sequence: Synthetic peptide
  Seed: QIFPKTGLL (MAGA4_HUMAN)
QMFPKTGLL

SEQ ID NO: 63325 - protein, 11 aa, Artificial Sequence
  Description of Artificial Sequence: Synthetic peptide
  Seed: RVNARVRIAYP (MAGA4_HUMAN)
RSNARVRIAYA

SEQ ID NO: 63326 - protein, 9 aa, Artificial Sequence
  Description of Artificial Sequence: Synthetic peptide
  Seed: RVRIAYPSL (MAGA4_HUMAN)
RSRIAYPSK

SEQ ID NO: 63327 - protein, 9 aa, Artificial Sequence
  Description of Artificial Sequence: Synthetic peptide
  Seed: SALPTTISF (MAGA4_HUMAN)
SALPTTISV

SEQ ID NO: 63328 - protein, 10 aa, Artificial Sequence
  Description of Artificial Sequence: Synthetic peptide
  Seed: VYDGREHTVY (MAGA4_HUMAN)
VTDGREHTVW

SEQ ID NO: 63329 - protein, 9 aa, Artificial Sequence
  Description of Artificial Sequence: Synthetic peptide
  Seed: IDVKEVDPA (MAGA4_HUMAN)
IEVKEVDPV

SEQ ID NO: 63330 - protein, 11 aa, Artificial Sequence
  Description of Artificial Sequence: Synthetic peptide
  Seed: RQVPGSNPARY (MAGA4_HUMAN)
RSVPGSNPARR

SEQ ID NO: 63331 - protein, 10 aa, Artificial Sequence
  Description of Artificial Sequence: Synthetic peptide
  Seed: ASALPTTISF (MAGA4_HUMAN)
AQALPTTISW

SEQ ID NO: 63332 - protein, 9 aa, Artificial Sequence
  Description of Artificial Sequence: Synthetic peptide
  Seed: VYDGREHTV (MAGA4_HUMAN)
VIDGREHTM

SEQ ID NO: 63333 - protein, 10 aa, Artificial Sequence
  Description of Artificial Sequence: Synthetic peptide
  Seed: QIFPKTGLLI (MAGA4_HUMAN)
QTFPKTGLLF

SEQ ID NO: 63334 - protein, 9 aa, Artificial Sequence
  Description of Artificial Sequence: Synthetic peptide
  Seed: SALPTTISF (MAGA4_HUMAN)
SMLPTTISI

SEQ ID NO: 63335 - protein, 10 aa, Artificial Sequence
  Description of Artificial Sequence: Synthetic peptide
  Seed: EHVVRVNARV (MAGA4_HUMAN)
ERVVRVNARV

SEQ ID NO: 63336 - protein, 9 aa, Artificial Sequence
  Description of Artificial Sequence: Synthetic peptide
  Seed: KELVTKAEM (MAGA4_HUMAN)
KELVTKAEP

SEQ ID NO: 63337 - protein, 9 aa, Artificial Sequence
  Description of Artificial Sequence: Synthetic peptide
  Seed: KASESLKMI (MAGA4_HUMAN)
KISESLKML

SEQ ID NO: 63338 - protein, 10 aa, Artificial Sequence
  Description of Artificial Sequence: Synthetic peptide
  Seed: YRQVPGSNPA (MAGA4_HUMAN)
YGQVPGSNPM

SEQ ID NO: 63339 - protein, 9 aa, Artificial Sequence
  Description of Artificial Sequence: Synthetic peptide
  Seed: KYRAKELVT (MAGA4_HUMAN)
KTRAKELVA

SEQ ID NO: 63340 - protein, 11 aa, Artificial Sequence
  Description of Artificial Sequence: Synthetic peptide
  Seed: SSSSPLVPGTL (MAGA4_HUMAN)
SVSSPLVPGTW

SEQ ID NO: 63341 - protein, 9 aa, Artificial Sequence
  Description of Artificial Sequence: Synthetic peptide
  Seed: TVYGEPRKL (MAGA4_HUMAN)
TMYGEPRKV

SEQ ID NO: 63342 - protein, 9 aa, Artificial Sequence
  Description of Artificial Sequence: Synthetic peptide
  Seed: ALPTTISFT (MAGA4_HUMAN)
AVPTTISFV

SEQ ID NO: 63343 - protein, 9 aa, Artificial Sequence
  Description of Artificial Sequence: Synthetic peptide
  Seed: WEELGVMGV (MAGA4_HUMAN)
WEELGVMGA

SEQ ID NO: 63344 - protein, 9 aa, Artificial Sequence
  Description of Artificial Sequence: Synthetic peptide
  Seed: VYGEPRKLL (MAGA4_HUMAN)
VTGEPRKLF

SEQ ID NO: 63345 - protein, 9 aa, Artificial Sequence
  Description of Artificial Sequence: Synthetic peptide
  Seed: IAYPSLREA (MAGA4_HUMAN)
ILYPSLREV

SEQ ID NO: 63346 - protein, 9 aa, Artificial Sequence
  Description of Artificial Sequence: Synthetic peptide
  Seed: FPKTGLLII (MAGA4_HUMAN)
FPKTGLLIP

SEQ ID NO: 63347 - protein, 9 aa, Artificial Sequence
  Description of Artificial Sequence: Synthetic peptide
  Seed: AHFLLRKYR (MAGA4_HUMAN)
ALFLLRKYR

SEQ ID NO: 63348 - protein, 9 aa, Artificial Sequence
  Description of Artificial Sequence: Synthetic peptide
  Seed: KVDELAHFL (MAGA4_HUMAN)
KCDELAHFF

SEQ ID NO: 63349 - protein, 9 aa, Artificial Sequence
  Description of Artificial Sequence: Synthetic peptide
  Seed: SSPLVPGTL (MAGA4_HUMAN)
SGPLVPGTI

SEQ ID NO: 63350 - protein, 9 aa, Artificial Sequence
  Description of Artificial Sequence: Synthetic peptide
  Seed: SALPTTISF (MAGA4_HUMAN)
SLLPTTISY

SEQ ID NO: 63351 - protein, 10 aa, Artificial Sequence
  Description of Artificial Sequence: Synthetic peptide
  Seed: YRQVPGSNPA (MAGA4_HUMAN)
YQQVPGSNPM

SEQ ID NO: 63352 - protein, 10 aa, Artificial Sequence
  Description of Artificial Sequence: Synthetic peptide
  Seed: KVLEHVVRVN (MAGA4_HUMAN)
KLLEHVVRVK

SEQ ID NO: 63353 - protein, 11 aa, Artificial Sequence
  Description of Artificial Sequence: Synthetic peptide
  Seed: LPTTISFTCWR (MAGA4_HUMAN)
LPTTISFTCWF

SEQ ID NO: 63354 - protein, 9 aa, Artificial Sequence
  Description of Artificial Sequence: Synthetic peptide
  Seed: STSPDAESL (MAGA4_HUMAN)
SRSPDAESL

SEQ ID NO: 63355 - protein, 9 aa, Artificial Sequence
  Description of Artificial Sequence: Synthetic peptide
  Seed: TVYGEPRKL (MAGA4_HUMAN)
TYYGEPRKV

SEQ ID NO: 63356 - protein, 10 aa, Artificial Sequence
  Description of Artificial Sequence: Synthetic peptide
  Seed: VDPASNTYTL (MAGA4_HUMAN)
VSPASNTYTM

SEQ ID NO: 63357 - protein, 9 aa, Artificial Sequence
  Description of Artificial Sequence: Synthetic peptide
  Seed: ERVIKNYKR (MAGA4_HUMAN)
ENVIKNYKR

SEQ ID NO: 63358 - protein, 9 aa, Artificial Sequence
  Description of Artificial Sequence: Synthetic peptide
  Seed: KVLEHVVRV (MAGA4_HUMAN)
KQLEHVVRY

SEQ ID NO: 63359 - protein, 9 aa, Artificial Sequence
  Description of Artificial Sequence: Synthetic peptide
  Seed: SAGPPQSPQ (MAGA4_HUMAN)
SVGPPQSPK

SEQ ID NO: 63360 - protein, 9 aa, Artificial Sequence
  Description of Artificial Sequence: Synthetic peptide
  Seed: IIVLGTIAM (MAGA4_HUMAN)
IQVLGTIAM

SEQ ID NO: 63361 - protein, 9 aa, Artificial Sequence
  Description of Artificial Sequence: Synthetic peptide
  Seed: LGNNQIFPK (MAGA4_HUMAN)
LWNNQIFPR

SEQ ID NO: 63362 - protein, 10 aa, Artificial Sequence
  Description of Artificial Sequence: Synthetic peptide
  Seed: KNYKRCFPVI (MAGA4_HUMAN)
KAYKRCFPVK

SEQ ID NO: 63363 - protein, 9 aa, Artificial Sequence
  Description of Artificial Sequence: Synthetic peptide
  Seed: EVDPASNTY (MAGA4_HUMAN)
EMDPASNTM

SEQ ID NO: 63364 - protein, 11 aa, Artificial Sequence
  Description of Artificial Sequence: Synthetic peptide
  Seed: REALSNKVDEL (MAGA4_HUMAN)
REALSNKVDEM

SEQ ID NO: 63365 - protein, 9 aa, Artificial Sequence
  Description of Artificial Sequence: Synthetic peptide
  Seed: RVRIAYPSL (MAGA4_HUMAN)
RVRIAYPSV

SEQ ID NO: 63366 - protein, 9 aa, Artificial Sequence
  Description of Artificial Sequence: Synthetic peptide
  Seed: VYDGREHTV (MAGA4_HUMAN)
VFDGREHTF

SEQ ID NO: 63367 - protein, 9 aa, Artificial Sequence
  Description of Artificial Sequence: Synthetic peptide
  Seed: LVPGTLEEV (MAGA4_HUMAN)
LAPGTLEEM

SEQ ID NO: 63368 - protein, 10 aa, Artificial Sequence
  Description of Artificial Sequence: Synthetic peptide
  Seed: YRQVPGSNPA (MAGA4_HUMAN)
YWQVPGSNPF

SEQ ID NO: 63369 - protein, 10 aa, Artificial Sequence
  Description of Artificial Sequence: Synthetic peptide
  Seed: SLFREALSNK (MAGA4_HUMAN)
SFFREALSNR

SEQ ID NO: 63370 - protein, 9 aa, Artificial Sequence
  Description of Artificial Sequence: Synthetic peptide
  Seed: SALPTTISF (MAGA4_HUMAN)
SMLPTTISH

SEQ ID NO: 63371 - protein, 10 aa, Artificial Sequence
  Description of Artificial Sequence: Synthetic peptide
  Seed: RVRIAYPSLR (MAGA4_HUMAN)
RSRIAYPSLT

SEQ ID NO: 63372 - protein, 9 aa, Artificial Sequence
  Description of Artificial Sequence: Synthetic peptide
  Seed: GTLEEVPAA (MAGA4_HUMAN)
GLLEEVPAA

SEQ ID NO: 63373 - protein, 10 aa, Artificial Sequence
  Description of Artificial Sequence: Synthetic peptide
  Seed: VDPASNTYTL (MAGA4_HUMAN)
VVPASNTYTF

SEQ ID NO: 63374 - protein, 8 aa, Artificial Sequence
  Description of Artificial Sequence: Synthetic peptide
  Seed: VYGEPRKL (MAGA4_HUMAN)
VAGEPRKM

SEQ ID NO: 63375 - protein, 11 aa, Artificial Sequence
  Description of Artificial Sequence: Synthetic peptide
  Seed: RVRIAYPSLRE (MAGA4_HUMAN)
RIRIAYPSLRV

SEQ ID NO: 63376 - protein, 10 aa, Artificial Sequence
  Description of Artificial Sequence: Synthetic peptide
  Seed: STSPDAESLF (MAGA4_HUMAN)
SSSPDAESLY

SEQ ID NO: 63377 - protein, 9 aa, Artificial Sequence
  Description of Artificial Sequence: Synthetic peptide
  Seed: RCFPVIFGK (MAGA4_HUMAN)
RVFPVIFGK

SEQ ID NO: 63378 - protein, 9 aa, Artificial Sequence
  Description of Artificial Sequence: Synthetic peptide
  Seed: RQVPGSNPA (MAGA4_HUMAN)
RYVPGSNPF

SEQ ID NO: 63379 - protein, 9 aa, Artificial Sequence
  Description of Artificial Sequence: Synthetic peptide
  Seed: YKRCFPVIF (MAGA4_HUMAN)
YKRCFPVIM

SEQ ID NO: 63380 - protein, 10 aa, Artificial Sequence
  Description of Artificial Sequence: Synthetic peptide
  Seed: LIIVLGTIAM (MAGA4_HUMAN)
LMIVLGTIAM

SEQ ID NO: 63381 - protein, 10 aa, Artificial Sequence
  Description of Artificial Sequence: Synthetic peptide
  Seed: STSPDAESLF (MAGA4_HUMAN)
SQSPDAESLM

SEQ ID NO: 63382 - protein, 10 aa, Artificial Sequence
  Description of Artificial Sequence: Synthetic peptide
  Seed: QIFPKTGLLI (MAGA4_HUMAN)
QMFPKTGLLF

SEQ ID NO: 63383 - protein, 9 aa, Artificial Sequence
  Description of Artificial Sequence: Synthetic peptide
  Seed: KVLEHVVRV (MAGA4_HUMAN)
KALEHVVRH

SEQ ID NO: 63384 - protein, 9 aa, Artificial Sequence
  Description of Artificial Sequence: Synthetic peptide
  Seed: ESLKMIFGI (MAGA4_HUMAN)
ETLKMIFGM

SEQ ID NO: 63385 - protein, 10 aa, Artificial Sequence
  Description of Artificial Sequence: Synthetic peptide
  Seed: KNYKRCFPVI (MAGA4_HUMAN)
KSYKRCFPVS

SEQ ID NO: 63386 - protein, 9 aa, Artificial Sequence
  Description of Artificial Sequence: Synthetic peptide
  Seed: GSNPARYEF (MAGA4_HUMAN)
GTNPARYEY

SEQ ID NO: 63387 - protein, 9 aa, Artificial Sequence
  Description of Artificial Sequence: Synthetic peptide
  Seed: SSSPLVPGT (MAGA4_HUMAN)
SISPLVPGI

SEQ ID NO: 63388 - protein, 9 aa, Artificial Sequence
  Description of Artificial Sequence: Synthetic peptide
  Seed: DELAHFLLR (MAGA4_HUMAN)
DELAHFLLM

SEQ ID NO: 63389 - protein, 9 aa, Artificial Sequence
  Description of Artificial Sequence: Synthetic peptide
  Seed: KYRAKELVT (MAGA4_HUMAN)
KYRAKELVA

SEQ ID NO: 63390 - protein, 10 aa, Artificial Sequence
  Description of Artificial Sequence: Synthetic peptide
  Seed: KVDELAHFLL (MAGA4_HUMAN)
KTDELAHFLV

SEQ ID NO: 63391 - protein, 9 aa, Artificial Sequence
  Description of Artificial Sequence: Synthetic peptide
  Seed: EVDPASNTY (MAGA4_HUMAN)
EIDPASNTL

SEQ ID NO: 63392 - protein, 9 aa, Artificial Sequence
  Description of Artificial Sequence: Synthetic peptide
  Seed: VYDGREHTV (MAGA4_HUMAN)
VIDGREHTF

SEQ ID NO: 63393 - protein, 10 aa, Artificial Sequence
  Description of Artificial Sequence: Synthetic peptide
  Seed: IAYPSLREAA (MAGA4_HUMAN)
IPYPSLREAI

SEQ ID NO: 63394 - protein, 9 aa, Artificial Sequence
  Description of Artificial Sequence: Synthetic peptide
  Seed: RVRIAYPSL (MAGA4_HUMAN)
RYRIAYPST

SEQ ID NO: 63395 - protein, 9 aa, Artificial Sequence
  Description of Artificial Sequence: Synthetic peptide
  Seed: EEIWEELGV (MAGA4_HUMAN)
EEIWEELGW

SEQ ID NO: 63396 - protein, 9 aa, Artificial Sequence
  Description of Artificial Sequence: Synthetic peptide
  Seed: GASALPTTI (MAGA4_HUMAN)
GTSALPTTW

SEQ ID NO: 63397 - protein, 9 aa, Artificial Sequence
  Description of Artificial Sequence: Synthetic peptide
  Seed: KELVTKAEM (MAGA4_HUMAN)
KKLVTKAEY

SEQ ID NO: 63398 - protein, 9 aa, Artificial Sequence
  Description of Artificial Sequence: Synthetic peptide
  Seed: SSSPLVPGT (MAGA4_HUMAN)
SMSPLVPGC

SEQ ID NO: 63399 - protein, 9 aa, Artificial Sequence
  Description of Artificial Sequence: Synthetic peptide
  Seed: SEEEIWEEL (MAGA4_HUMAN)
SEEEIWEEW

SEQ ID NO: 63400 - protein, 9 aa, Artificial Sequence
  Description of Artificial Sequence: Synthetic peptide
  Seed: SALPTTISF (MAGA4_HUMAN)
SHLPTTISL

SEQ ID NO: 63401 - protein, 9 aa, Artificial Sequence
  Description of Artificial Sequence: Synthetic peptide
  Seed: ALSNKVDEL (MAGA4_HUMAN)
AMSNKVDEA

SEQ ID NO: 63402 - protein, 10 aa, Artificial Sequence
  Description of Artificial Sequence: Synthetic peptide
  Seed: TSPDAESLFR (MAGA4_HUMAN)
TTPDAESLFY

SEQ ID NO: 63403 - protein, 10 aa, Artificial Sequence
  Description of Artificial Sequence: Synthetic peptide
  Seed: SSSPLVPGTL (MAGA4_HUMAN)
SMSPLVPGTA

SEQ ID NO: 63404 - protein, 10 aa, Artificial Sequence
  Description of Artificial Sequence: Synthetic peptide
  Seed: QIFPKTGLLI (MAGA4_HUMAN)
QWFPKTGLLI

SEQ ID NO: 63405 - protein, 9 aa, Artificial Sequence
  Description of Artificial Sequence: Synthetic peptide
  Seed: KVLEHVVRV (MAGA4_HUMAN)
KYLEHVVRM

SEQ ID NO: 63406 - protein, 10 aa, Artificial Sequence
  Description of Artificial Sequence: Synthetic peptide
  Seed: LAHFLLRKYR (MAGA4_HUMAN)
LMHFLLRKYR

SEQ ID NO: 63407 - protein, 10 aa, Artificial Sequence
  Description of Artificial Sequence: Synthetic peptide
  Seed: KNYKRCFPVI (MAGA4_HUMAN)
KYYKRCFPVW

SEQ ID NO: 63408 - protein, 10 aa, Artificial Sequence
  Description of Artificial Sequence: Synthetic peptide
  Seed: YPSLREAALL (MAGA4_HUMAN)
YISLREAALY

SEQ ID NO: 63409 - protein, 9 aa, Artificial Sequence
  Description of Artificial Sequence: Synthetic peptide
  Seed: RVRIAYPSL (MAGA4_HUMAN)
RMRIAYPSP

SEQ ID NO: 63410 - protein, 10 aa, Artificial Sequence
  Description of Artificial Sequence: Synthetic peptide
  Seed: LIIVLGTIAM (MAGA4_HUMAN)
LAIVLGTIAY

SEQ ID NO: 63411 - protein, 9 aa, Artificial Sequence
  Description of Artificial Sequence: Synthetic peptide
  Seed: GASALPTTI (MAGA4_HUMAN)
GQSALPTTI

SEQ ID NO: 63412 - protein, 9 aa, Artificial Sequence
  Description of Artificial Sequence: Synthetic peptide
  Seed: KVDELAHFL (MAGA4_HUMAN)
KIDELAHFY

SEQ ID NO: 63413 - protein, 9 aa, Artificial Sequence
  Description of Artificial Sequence: Synthetic peptide
  Seed: IIVLGTIAM (MAGA4_HUMAN)
IKVLGTIAF

SEQ ID NO: 63414 - protein, 9 aa, Artificial Sequence
  Description of Artificial Sequence: Synthetic peptide
  Seed: RVRIAYPSL (MAGA4_HUMAN)
RTRIAYPSC

SEQ ID NO: 63415 - protein, 11 aa, Artificial Sequence
  Description of Artificial Sequence: Synthetic peptide
  Seed: RVNARVRIAYP (MAGA4_HUMAN)
RTNARVRIAYI

SEQ ID NO: 63416 - protein, 9 aa, Artificial Sequence
  Description of Artificial Sequence: Synthetic peptide
  Seed: KVDELAHFL (MAGA4_HUMAN)
KFDELAHFL

SEQ ID NO: 63417 - protein, 10 aa, Artificial Sequence
  Description of Artificial Sequence: Synthetic peptide
  Seed: MLERVIKNYK (MAGA4_HUMAN)
MGERVIKNYR

SEQ ID NO: 63418 - protein, 10 aa, Artificial Sequence
  Description of Artificial Sequence: Synthetic peptide
  Seed: LGVMGVYDGR (MAGA4_HUMAN)
LFVMGVYDGR

SEQ ID NO: 63419 - protein, 9 aa, Artificial Sequence
  Description of Artificial Sequence: Synthetic peptide
  Seed: EVDPASNTY (MAGA4_HUMAN)
ETDPASNTF

SEQ ID NO: 63420 - protein, 11 aa, Artificial Sequence
  Description of Artificial Sequence: Synthetic peptide
  Seed: SSSSPLVPGTL (MAGA4_HUMAN)
STSSPLVPGTF

SEQ ID NO: 63421 - protein, 10 aa, Artificial Sequence
  Description of Artificial Sequence: Synthetic peptide
  Seed: GVYDGREHTV (MAGA4_HUMAN)
GQYDGREHTM

SEQ ID NO: 63422 - protein, 9 aa, Artificial Sequence
  Description of Artificial Sequence: Synthetic peptide
  Seed: AAVSSSSPL (MAGA4_HUMAN)
ALVSSSSPM

SEQ ID NO: 63423 - protein, 8 aa, Artificial Sequence
  Description of Artificial Sequence: Synthetic peptide
  Seed: RVRIAYPS (MAGA4_HUMAN)
RLRIAYPK

SEQ ID NO: 63424 - protein, 9 aa, Artificial Sequence
  Description of Artificial Sequence: Synthetic peptide
  Seed: RKYRAKELV (MAGA4_HUMAN)
RQYRAKELL

SEQ ID NO: 63425 - protein, 10 aa, Artificial Sequence
  Description of Artificial Sequence: Synthetic peptide
  Seed: KVLEHVVRVN (MAGA4_HUMAN)
KQLEHVVRVV

SEQ ID NO: 63426 - protein, 9 aa, Artificial Sequence
  Description of Artificial Sequence: Synthetic peptide
  Seed: QIFPKTGLL (MAGA4_HUMAN)
QTFPKTGLW

SEQ ID NO: 63427 - protein, 10 aa, Artificial Sequence
  Description of Artificial Sequence: Synthetic peptide
  Seed: NKVDELAHFL (MAGA4_HUMAN)
NLVDELAHFI

SEQ ID NO: 63428 - protein, 10 aa, Artificial Sequence
  Description of Artificial Sequence: Synthetic peptide
  Seed: KNYKRCFPVI (MAGA4_HUMAN)
KTYKRCFPVI

SEQ ID NO: 63429 - protein, 9 aa, Artificial Sequence
  Description of Artificial Sequence: Synthetic peptide
  Seed: YPSLREAAL (MAGA4_HUMAN)
YPSLREAAA

SEQ ID NO: 63430 - protein, 10 aa, Artificial Sequence
  Description of Artificial Sequence: Synthetic peptide
  Seed: KEVDPASNTY (MAGA4_HUMAN)
KWVDPASNTY

SEQ ID NO: 63431 - protein, 10 aa, Artificial Sequence
  Description of Artificial Sequence: Synthetic peptide
  Seed: EHVVRVNARV (MAGA4_HUMAN)
EFVVRVNARV

SEQ ID NO: 63432 - protein, 9 aa, Artificial Sequence
  Description of Artificial Sequence: Synthetic peptide
  Seed: IIVLGTIAM (MAGA4_HUMAN)
ITVLGTIAM

SEQ ID NO: 63433 - protein, 10 aa, Artificial Sequence
  Description of Artificial Sequence: Synthetic peptide
  Seed: EAAVSSSSPL (MAGA4_HUMAN)
EWAVSSSSPV

SEQ ID NO: 63434 - protein, 9 aa, Artificial Sequence
  Description of Artificial Sequence: Synthetic peptide
  Seed: ELAHFLLRK (MAGA4_HUMAN)
EWAHFLLRR

SEQ ID NO: 63435 - protein, 9 aa, Artificial Sequence
  Description of Artificial Sequence: Synthetic peptide
  Seed: IIVLGTIAM (MAGA4_HUMAN)
IQVLGTIAL

SEQ ID NO: 63436 - protein, 10 aa, Artificial Sequence
  Description of Artificial Sequence: Synthetic peptide
  Seed: KNYKRCFPVI (MAGA4_HUMAN)
KYYKRCFPVI

SEQ ID NO: 63437 - protein, 9 aa, Artificial Sequence
  Description of Artificial Sequence: Synthetic peptide
  Seed: LAHFLLRKY (MAGA4_HUMAN)
LAHFLLRKM

SEQ ID NO: 63438 - protein, 9 aa, Artificial Sequence
  Description of Artificial Sequence: Synthetic peptide
  Seed: KELVTKAEM (MAGA4_HUMAN)
KELVTKAEA

SEQ ID NO: 63439 - protein, 9 aa, Artificial Sequence
  Description of Artificial Sequence: Synthetic peptide
  Seed: SALPTTISF (MAGA4_HUMAN)
SCLPTTISW

SEQ ID NO: 63440 - protein, 10 aa, Artificial Sequence
  Description of Artificial Sequence: Synthetic peptide
  Seed: LLGNNQIFPK (MAGA4_HUMAN)
LYGNNQIFPK

SEQ ID NO: 63441 - protein, 10 aa, Artificial Sequence
  Description of Artificial Sequence: Synthetic peptide
  Seed: QEEEGPSTSP (MAGA4_HUMAN)
QEEEGPSTSL

SEQ ID NO: 63442 - protein, 10 aa, Artificial Sequence
  Description of Artificial Sequence: Synthetic peptide
  Seed: REAALLEEEE (MAGA4_HUMAN)
REAALLEEET

SEQ ID NO: 63443 - protein, 10 aa, Artificial Sequence
  Description of Artificial Sequence: Synthetic peptide
  Seed: AYPSLREAAL (MAGA4_HUMAN)
AGPSLREAAM

SEQ ID NO: 63444 - protein, 9 aa, Artificial Sequence
  Description of Artificial Sequence: Synthetic peptide
  Seed: KVLEHVVRV (MAGA4_HUMAN)
KLLEHVVRV

SEQ ID NO: 63445 - protein, 9 aa, Artificial Sequence
  Description of Artificial Sequence: Synthetic peptide
  Seed: STSPDAESL (MAGA4_HUMAN)
SISPDAESV

SEQ ID NO: 63446 - protein, 9 aa, Artificial Sequence
  Description of Artificial Sequence: Synthetic peptide
  Seed: FPKTGLLII (MAGA4_HUMAN)
FPKTGLLIV

SEQ ID NO: 63447 - protein, 11 aa, Artificial Sequence
  Description of Artificial Sequence: Synthetic peptide
  Seed: RQVPGSNPARY (MAGA4_HUMAN)
RMVPGSNPARF

SEQ ID NO: 63448 - protein, 9 aa, Artificial Sequence
  Description of Artificial Sequence: Synthetic peptide
  Seed: TSPDAESLF (MAGA4_HUMAN)
TLPDAESLL

SEQ ID NO: 63449 - protein, 9 aa, Artificial Sequence
  Description of Artificial Sequence: Synthetic peptide
  Seed: AESLFREAL (MAGA4_HUMAN)
AHSLFREAF

SEQ ID NO: 63450 - protein, 11 aa, Artificial Sequence
  Description of Artificial Sequence: Synthetic peptide
  Seed: REALSNKVDEL (MAGA4_HUMAN)
RMALSNKVDEL

SEQ ID NO: 63451 - protein, 9 aa, Artificial Sequence
  Description of Artificial Sequence: Synthetic peptide
  Seed: STSPDAESL (MAGA4_HUMAN)
SRSPDAESF

SEQ ID NO: 63452 - protein, 10 aa, Artificial Sequence
  Description of Artificial Sequence: Synthetic peptide
  Seed: ESAGPPQSPQ (MAGA4_HUMAN)
ESAGPPQSPR

SEQ ID NO: 63453 - protein, 10 aa, Artificial Sequence
  Description of Artificial Sequence: Synthetic peptide
  Seed: FGKASESLKM (MAGA4_HUMAN)
FSKASESLKF

SEQ ID NO: 63454 - protein, 10 aa, Artificial Sequence
  Description of Artificial Sequence: Synthetic peptide
  Seed: RVRIAYPSLR (MAGA4_HUMAN)
RLRIAYPSLF

SEQ ID NO: 63455 - protein, 9 aa, Artificial Sequence
  Description of Artificial Sequence: Synthetic peptide
  Seed: GASALPTTI (MAGA4_HUMAN)
GGSALPTTY

SEQ ID NO: 63456 - protein, 9 aa, Artificial Sequence
  Description of Artificial Sequence: Synthetic peptide
  Seed: VTKAEMLER (MAGA4_HUMAN)
VIKAEMLEK

SEQ ID NO: 63457 - protein, 11 aa, Artificial Sequence
  Description of Artificial Sequence: Synthetic peptide
  Seed: RKYRAKELVTK (MAGA4_HUMAN)
RRYRAKELVTR

SEQ ID NO: 63458 - protein, 10 aa, Artificial Sequence
  Description of Artificial Sequence: Synthetic peptide
  Seed: RVRIAYPSLR (MAGA4_HUMAN)
RGRIAYPSLM

SEQ ID NO: 63459 - protein, 9 aa, Artificial Sequence
  Description of Artificial Sequence: Synthetic peptide
  Seed: SSPLVPGTL (MAGA4_HUMAN)
SWPLVPGTF

SEQ ID NO: 63460 - protein, 9 aa, Artificial Sequence
  Description of Artificial Sequence: Synthetic peptide
  Seed: RVRIAYPSL (MAGA4_HUMAN)
RYRIAYPSA

SEQ ID NO: 63461 - protein, 9 aa, Artificial Sequence
  Description of Artificial Sequence: Synthetic peptide
  Seed: SEEEIWEEL (MAGA4_HUMAN)
SAEEIWEEM

SEQ ID NO: 63462 - protein, 9 aa, Artificial Sequence
  Description of Artificial Sequence: Synthetic peptide
  Seed: VYGEPRKLL (MAGA4_HUMAN)
VYGEPRKLW

SEQ ID NO: 63463 - protein, 9 aa, Artificial Sequence
  Description of Artificial Sequence: Synthetic peptide
  Seed: WVQENYLEY (MAGA4_HUMAN)
WMQENYLEL

SEQ ID NO: 63464 - protein, 9 aa, Artificial Sequence
  Description of Artificial Sequence: Synthetic peptide
  Seed: GVYDGREHT (MAGA4_HUMAN)
GMYDGREHI

SEQ ID NO: 63465 - protein, 9 aa, Artificial Sequence
  Description of Artificial Sequence: Synthetic peptide
  Seed: IAYPSLREA (MAGA4_HUMAN)
IQYPSLREY

SEQ ID NO: 63466 - protein, 9 aa, Artificial Sequence
  Description of Artificial Sequence: Synthetic peptide
  Seed: GVYDGREHT (MAGA4_HUMAN)
GMYDGREHV

SEQ ID NO: 63467 - protein, 9 aa, Artificial Sequence
  Description of Artificial Sequence: Synthetic peptide
  Seed: AEMLERVIK (MAGA4_HUMAN)
AEMLERVIY

SEQ ID NO: 63468 - protein, 10 aa, Artificial Sequence
  Description of Artificial Sequence: Synthetic peptide
  Seed: SSSPLVPGTL (MAGA4_HUMAN)
SISPLVPGTW

SEQ ID NO: 63469 - protein, 9 aa, Artificial Sequence
  Description of Artificial Sequence: Synthetic peptide
  Seed: YRAKELVTK (MAGA4_HUMAN)
YYAKELVTM

SEQ ID NO: 63470 - protein, 10 aa, Artificial Sequence
  Description of Artificial Sequence: Synthetic peptide
  Seed: YPSLREAALL (MAGA4_HUMAN)
YKSLREAALF

SEQ ID NO: 63471 - protein, 10 aa, Artificial Sequence
  Description of Artificial Sequence: Synthetic peptide
  Seed: RVNARVRIAY (MAGA4_HUMAN)
RHNARVRIAY

SEQ ID NO: 63472 - protein, 11 aa, Artificial Sequence
  Description of Artificial Sequence: Synthetic peptide
  Seed: AQAPTTEEQEA (MAGA4_HUMAN)
AEAPTTEEQEL

SEQ ID NO: 63473 - protein, 9 aa, Artificial Sequence
  Description of Artificial Sequence: Synthetic peptide
  Seed: KELVTKAEM (MAGA4_HUMAN)
KDLVTKAEL

SEQ ID NO: 63474 - protein, 8 aa, Artificial Sequence
  Description of Artificial Sequence: Synthetic peptide
  Seed: RVRIAYPS (MAGA4_HUMAN)
RARIAYPK

SEQ ID NO: 63475 - protein, 9 aa, Artificial Sequence
  Description of Artificial Sequence: Synthetic peptide
  Seed: RKYRAKELV (MAGA4_HUMAN)
RAYRAKELF

SEQ ID NO: 63476 - protein, 9 aa, Artificial Sequence
  Description of Artificial Sequence: Synthetic peptide
  Seed: RAKELVTKA (MAGA4_HUMAN)
RPKELVTKI

SEQ ID NO: 63477 - protein, 9 aa, Artificial Sequence
  Description of Artificial Sequence: Synthetic peptide
  Seed: RQVPGSNPA (MAGA4_HUMAN)
RLVPGSNPF

SEQ ID NO: 63478 - protein, 10 aa, Artificial Sequence
  Description of Artificial Sequence: Synthetic peptide
  Seed: KNYKRCFPVI (MAGA4_HUMAN)
KIYKRCFPVA

SEQ ID NO: 63479 - protein, 9 aa, Artificial Sequence
  Description of Artificial Sequence: Synthetic peptide
  Seed: MGVYDGREH (MAGA4_HUMAN)
MAVYDGREY

SEQ ID NO: 63480 - protein, 9 aa, Artificial Sequence
  Description of Artificial Sequence: Synthetic peptide
  Seed: YDGREHTVY (MAGA4_HUMAN)
YMGREHTVF

SEQ ID NO: 63481 - protein, 9 aa, Artificial Sequence
  Description of Artificial Sequence: Synthetic peptide
  Seed: GASALPTTI (MAGA4_HUMAN)
GQSALPTTL

SEQ ID NO: 63482 - protein, 9 aa, Artificial Sequence
  Description of Artificial Sequence: Synthetic peptide
  Seed: KVLEHVVRV (MAGA4_HUMAN)
KLLEHVVRY

SEQ ID NO: 63483 - protein, 11 aa, Artificial Sequence
  Description of Artificial Sequence: Synthetic peptide
  Seed: RVRIAYPSLRE (MAGA4_HUMAN)
RFRIAYPSLRK

SEQ ID NO: 63484 - protein, 9 aa, Artificial Sequence
  Description of Artificial Sequence: Synthetic peptide
  Seed: SYVKVLEHV (MAGA4_HUMAN)
SSVKVLEHY

SEQ ID NO: 63485 - protein, 9 aa, Artificial Sequence
  Description of Artificial Sequence: Synthetic peptide
  Seed: FPVIFGKAS (MAGA4_HUMAN)
FPVIFGKAF

SEQ ID NO: 63486 - protein, 10 aa, Artificial Sequence
  Description of Artificial Sequence: Synthetic peptide
  Seed: QVPGSNPARY (MAGA4_HUMAN)
QVPGSNPARK

SEQ ID NO: 63487 - protein, 9 aa, Artificial Sequence
  Description of Artificial Sequence: Synthetic peptide
  Seed: SSSPLVPGT (MAGA4_HUMAN)
SASPLVPGV

SEQ ID NO: 63488 - protein, 9 aa, Artificial Sequence
  Description of Artificial Sequence: Synthetic peptide
  Seed: VVRVNARVR (MAGA4_HUMAN)
VIRVNARVK

SEQ ID NO: 63489 - protein, 9 aa, Artificial Sequence
  Description of Artificial Sequence: Synthetic peptide
  Seed: IFPKTGLLI (MAGA4_HUMAN)
ISPKTGLLM

SEQ ID NO: 63490 - protein, 11 aa, Artificial Sequence
  Description of Artificial Sequence: Synthetic peptide
  Seed: KVDELAHFLLR (MAGA4_HUMAN)
KMDELAHFLLR

SEQ ID NO: 63491 - protein, 9 aa, Artificial Sequence
  Description of Artificial Sequence: Synthetic peptide
  Seed: FPKTGLLII (MAGA4_HUMAN)
FAKTGLLIY

SEQ ID NO: 63492 - protein, 10 aa, Artificial Sequence
  Description of Artificial Sequence: Synthetic peptide
  Seed: KNYKRCFPVI (MAGA4_HUMAN)
KHYKRCFPVK

SEQ ID NO: 63493 - protein, 10 aa, Artificial Sequence
  Description of Artificial Sequence: Synthetic peptide
  Seed: VIFGKASESL (MAGA4_HUMAN)
VQFGKASESI

SEQ ID NO: 63494 - protein, 9 aa, Artificial Sequence
  Description of Artificial Sequence: Synthetic peptide
  Seed: KVDELAHFL (MAGA4_HUMAN)
KVDELAHFY

SEQ ID NO: 63495 - protein, 9 aa, Artificial Sequence
  Description of Artificial Sequence: Synthetic peptide
  Seed: TVYGEPRKL (MAGA4_HUMAN)
TGYGEPRKW

SEQ ID NO: 63496 - protein, 10 aa, Artificial Sequence
  Description of Artificial Sequence: Synthetic peptide
  Seed: VYDGREHTVY (MAGA4_HUMAN)
VSDGREHTVW

SEQ ID NO: 63497 - protein, 9 aa, Artificial Sequence
  Description of Artificial Sequence: Synthetic peptide
  Seed: SAGPPQSPQ (MAGA4_HUMAN)
SAGPPQSPM

SEQ ID NO: 63498 - protein, 10 aa, Artificial Sequence
  Description of Artificial Sequence: Synthetic peptide
  Seed: KVLEHVVRVN (MAGA4_HUMAN)
KLLEHVVRVG

SEQ ID NO: 63499 - protein, 9 aa, Artificial Sequence
  Description of Artificial Sequence: Synthetic peptide
  Seed: YPSLREAAL (MAGA4_HUMAN)
YSSLREAAI

SEQ ID NO: 63500 - protein, 9 aa, Artificial Sequence
  Description of Artificial Sequence: Synthetic peptide
  Seed: REHTVYGEP (MAGA4_HUMAN)
REHTVYGEI

SEQ ID NO: 63501 - protein, 9 aa, Artificial Sequence
  Description of Artificial Sequence: Synthetic peptide
  Seed: RVRIAYPSL (MAGA4_HUMAN)
RGRIAYPSL

SEQ ID NO: 63502 - protein, 10 aa, Artificial Sequence
  Description of Artificial Sequence: Synthetic peptide
  Seed: KVLEHVVRVN (MAGA4_HUMAN)
KLLEHVVRVS

SEQ ID NO: 63503 - protein, 10 aa, Artificial Sequence
  Description of Artificial Sequence: Synthetic peptide
  Seed: KVDELAHFLL (MAGA4_HUMAN)
KIDELAHFLV

SEQ ID NO: 63504 - protein, 10 aa, Artificial Sequence
  Description of Artificial Sequence: Synthetic peptide
  Seed: DPASNTYTLV (MAGA4_HUMAN)
DTASNTYTLI

SEQ ID NO: 63505 - protein, 9 aa, Artificial Sequence
  Description of Artificial Sequence: Synthetic peptide
  Seed: RVRIAYPSL (MAGA4_HUMAN)
RARIAYPSH

SEQ ID NO: 63506 - protein, 9 aa, Artificial Sequence
  Description of Artificial Sequence: Synthetic peptide
  Seed: RCFPVIFGK (MAGA4_HUMAN)
RVFPVIFGM

SEQ ID NO: 63507 - protein, 9 aa, Artificial Sequence
  Description of Artificial Sequence: Synthetic peptide
  Seed: TVYGEPRKL (MAGA4_HUMAN)
THYGEPRKF

SEQ ID NO: 63508 - protein, 9 aa, Artificial Sequence
  Description of Artificial Sequence: Synthetic peptide
  Seed: TQDWVQENY (MAGA4_HUMAN)
TNDWVQENL

SEQ ID NO: 63509 - protein, 9 aa, Artificial Sequence
  Description of Artificial Sequence: Synthetic peptide
  Seed: ALLEEEEGV (MAGA4_HUMAN)
AILEEEEGF

SEQ ID NO: 63510 - protein, 9 aa, Artificial Sequence
  Description of Artificial Sequence: Synthetic peptide
  Seed: YKRCFPVIF (MAGA4_HUMAN)
YARCFPVIY

SEQ ID NO: 63511 - protein, 10 aa, Artificial Sequence
  Description of Artificial Sequence: Synthetic peptide
  Seed: EMLERVIKNY (MAGA4_HUMAN)
EILERVIKNR

SEQ ID NO: 63512 - protein, 9 aa, Artificial Sequence
  Description of Artificial Sequence: Synthetic peptide
  Seed: KVLEHVVRV (MAGA4_HUMAN)
KILEHVVRI

SEQ ID NO: 63513 - protein, 10 aa, Artificial Sequence
  Description of Artificial Sequence: Synthetic peptide
  Seed: GLLIIVLGTI (MAGA4_HUMAN)
GHLIIVLGTV

SEQ ID NO: 63514 - protein, 10 aa, Artificial Sequence
  Description of Artificial Sequence: Synthetic peptide
  Seed: VDPASNTYTL (MAGA4_HUMAN)
VAPASNTYTL

SEQ ID NO: 63515 - protein, 10 aa, Artificial Sequence
  Description of Artificial Sequence: Synthetic peptide
  Seed: LGVMGVYDGR (MAGA4_HUMAN)
LYVMGVYDGR

SEQ ID NO: 63516 - protein, 9 aa, Artificial Sequence
  Description of Artificial Sequence: Synthetic peptide
  Seed: KVDELAHFL (MAGA4_HUMAN)
KIDELAHFW

SEQ ID NO: 63517 - protein, 9 aa, Artificial Sequence
  Description of Artificial Sequence: Synthetic peptide
  Seed: EIWEELGVM (MAGA4_HUMAN)
ELWEELGVR

SEQ ID NO: 63518 - protein, 9 aa, Artificial Sequence
  Description of Artificial Sequence: Synthetic peptide
  Seed: KYRAKELVT (MAGA4_HUMAN)
KSRAKELVS

SEQ ID NO: 63519 - protein, 10 aa, Artificial Sequence
  Description of Artificial Sequence: Synthetic peptide
  Seed: DELAHFLLRK (MAGA4_HUMAN)
DTLAHFLLRK

SEQ ID NO: 63520 - protein, 9 aa, Artificial Sequence
  Description of Artificial Sequence: Synthetic peptide
  Seed: VYDGREHTV (MAGA4_HUMAN)
VTDGREHTV

SEQ ID NO: 63521 - protein, 11 aa, Artificial Sequence
  Description of Artificial Sequence: Synthetic peptide
  Seed: ELGVMGVYDGR (MAGA4_HUMAN)
EYGVMGVYDGR

SEQ ID NO: 63522 - protein, 10 aa, Artificial Sequence
  Description of Artificial Sequence: Synthetic peptide
  Seed: LAHFLLRKYR (MAGA4_HUMAN)
LFHFLLRKYR

SEQ ID NO: 63523 - protein, 8 aa, Artificial Sequence
  Description of Artificial Sequence: Synthetic peptide
  Seed: VYGEPRKL (MAGA4_HUMAN)
VYGEPRKF

SEQ ID NO: 63524 - protein, 10 aa, Artificial Sequence
  Description of Artificial Sequence: Synthetic peptide
  Seed: GDSASEEEIW (MAGA4_HUMAN)
GESASEEEIY

SEQ ID NO: 63525 - protein, 11 aa, Artificial Sequence
  Description of Artificial Sequence: Synthetic peptide
  Seed: GVYDGREHTVY (MAGA4_HUMAN)
GMYDGREHTVF

SEQ ID NO: 63526 - protein, 9 aa, Artificial Sequence
  Description of Artificial Sequence: Synthetic peptide
  Seed: VNARVRIAY (MAGA4_HUMAN)
VRARVRIAF

SEQ ID NO: 63527 - protein, 10 aa, Artificial Sequence
  Description of Artificial Sequence: Synthetic peptide
  Seed: GSNPARYEFL (MAGA4_HUMAN)
GTNPARYEFW

SEQ ID NO: 63528 - protein, 10 aa, Artificial Sequence
  Description of Artificial Sequence: Synthetic peptide
  Seed: EHTVYGEPRK (MAGA4_HUMAN)
EHTVYGEPRR

SEQ ID NO: 63529 - protein, 9 aa, Artificial Sequence
  Description of Artificial Sequence: Synthetic peptide
  Seed: IAYPSLREA (MAGA4_HUMAN)
ILYPSLREL

SEQ ID NO: 63530 - protein, 8 aa, Artificial Sequence
  Description of Artificial Sequence: Synthetic peptide
  Seed: RVRIAYPS (MAGA4_HUMAN)
RVRIAYPF

SEQ ID NO: 63531 - protein, 9 aa, Artificial Sequence
  Description of Artificial Sequence: Synthetic peptide
  Seed: LRKYRAKEL (MAGA4_HUMAN)
LMKYRAKEF

SEQ ID NO: 63532 - protein, 9 aa, Artificial Sequence
  Description of Artificial Sequence: Synthetic peptide
  Seed: NPARYEFLW (MAGA4_HUMAN)
NAARYEFLF

SEQ ID NO: 63533 - protein, 9 aa, Artificial Sequence
  Description of Artificial Sequence: Synthetic peptide
  Seed: TVYGEPRKL (MAGA4_HUMAN)
TPYGEPRKV

SEQ ID NO: 63534 - protein, 9 aa, Artificial Sequence
  Description of Artificial Sequence: Synthetic peptide
  Seed: STSPDAESL (MAGA4_HUMAN)
SLSPDAESA

SEQ ID NO: 63535 - protein, 9 aa, Artificial Sequence
  Description of Artificial Sequence: Synthetic peptide
  Seed: ALPTTISFT (MAGA4_HUMAN)
AMPTTISFA

SEQ ID NO: 63536 - protein, 9 aa, Artificial Sequence
  Description of Artificial Sequence: Synthetic peptide
  Seed: TSPDAESLF (MAGA4_HUMAN)
TMPDAESLM

SEQ ID NO: 63537 - protein, 9 aa, Artificial Sequence
  Description of Artificial Sequence: Synthetic peptide
  Seed: WVQENYLEY (MAGA4_HUMAN)
WAQENYLEL

SEQ ID NO: 63538 - protein, 9 aa, Artificial Sequence
  Description of Artificial Sequence: Synthetic peptide
  Seed: SALPTTISF (MAGA4_HUMAN)
STLPTTISR

SEQ ID NO: 63539 - protein, 9 aa, Artificial Sequence
  Description of Artificial Sequence: Synthetic peptide
  Seed: TSPDAESLF (MAGA4_HUMAN)
TQPDAESLY

SEQ ID NO: 63540 - protein, 10 aa, Artificial Sequence
  Description of Artificial Sequence: Synthetic peptide
  Seed: AYPSLREAAL (MAGA4_HUMAN)
ATPSLREAAM

SEQ ID NO: 63541 - protein, 9 aa, Artificial Sequence
  Description of Artificial Sequence: Synthetic peptide
  Seed: TSPDAESLF (MAGA4_HUMAN)
TSPDAESLL

SEQ ID NO: 63542 - protein, 9 aa, Artificial Sequence
  Description of Artificial Sequence: Synthetic peptide
  Seed: ALSNKVDEL (MAGA4_HUMAN)
AISNKVDEV

SEQ ID NO: 63543 - protein, 10 aa, Artificial Sequence
  Description of Artificial Sequence: Synthetic peptide
  Seed: KEVDPASNTY (MAGA4_HUMAN)
KTVDPASNTM

SEQ ID NO: 63544 - protein, 9 aa, Artificial Sequence
  Description of Artificial Sequence: Synthetic peptide
  Seed: KVDELAHFL (MAGA4_HUMAN)
KFDELAHFF

SEQ ID NO: 63545 - protein, 9 aa, Artificial Sequence
  Description of Artificial Sequence: Synthetic peptide
  Seed: TTEEQEAAV (MAGA4_HUMAN)
TTEEQEAAL

SEQ ID NO: 63546 - protein, 9 aa, Artificial Sequence
  Description of Artificial Sequence: Synthetic peptide
  Seed: KNYKRCFPV (MAGA4_HUMAN)
KIYKRCFPA

SEQ ID NO: 63547 - protein, 9 aa, Artificial Sequence
  Description of Artificial Sequence: Synthetic peptide
  Seed: RVNARVRIA (MAGA4_HUMAN)
RFNARVRIK

SEQ ID NO: 63548 - protein, 10 aa, Artificial Sequence
  Description of Artificial Sequence: Synthetic peptide
  Seed: RVRIAYPSLR (MAGA4_HUMAN)
RQRIAYPSLL

SEQ ID NO: 63549 - protein, 10 aa, Artificial Sequence
  Description of Artificial Sequence: Synthetic peptide
  Seed: KNYKRCFPVI (MAGA4_HUMAN)
KKYKRCFPVK

SEQ ID NO: 63550 - protein, 9 aa, Artificial Sequence
  Description of Artificial Sequence: Synthetic peptide
  Seed: GTLEEVPAA (MAGA4_HUMAN)
GTLEEVPAL

SEQ ID NO: 63551 - protein, 9 aa, Artificial Sequence
  Description of Artificial Sequence: Synthetic peptide
  Seed: RVRIAYPSL (MAGA4_HUMAN)
RFRIAYPSV

SEQ ID NO: 63552 - protein, 9 aa, Artificial Sequence
  Description of Artificial Sequence: Synthetic peptide
  Seed: VNARVRIAY (MAGA4_HUMAN)
VKARVRIAM

SEQ ID NO: 63553 - protein, 10 aa, Artificial Sequence
  Description of Artificial Sequence: Synthetic peptide
  Seed: QIFPKTGLLI (MAGA4_HUMAN)
QCFPKTGLLF

SEQ ID NO: 63554 - protein, 10 aa, Artificial Sequence
  Description of Artificial Sequence: Synthetic peptide
  Seed: GLLIIVLGTI (MAGA4_HUMAN)
GMLIIVLGTV

SEQ ID NO: 63555 - protein, 9 aa, Artificial Sequence
  Description of Artificial Sequence: Synthetic peptide
  Seed: RQVPGSNPA (MAGA4_HUMAN)
RLVPGSNPI

SEQ ID NO: 63556 - protein, 10 aa, Artificial Sequence
  Description of Artificial Sequence: Synthetic peptide
  Seed: TSYVKVLEHV (MAGA4_HUMAN)
TKYVKVLEHF

SEQ ID NO: 63557 - protein, 9 aa, Artificial Sequence
  Description of Artificial Sequence: Synthetic peptide
  Seed: EVDPASNTY (MAGA4_HUMAN)
EWDPASNTM

SEQ ID NO: 63558 - protein, 9 aa, Artificial Sequence
  Description of Artificial Sequence: Synthetic peptide
  Seed: SALPTTISF (MAGA4_HUMAN)
SHLPTTISM

SEQ ID NO: 63559 - protein, 10 aa, Artificial Sequence
  Description of Artificial Sequence: Synthetic peptide
  Seed: TLVTCLGLSY (MAGA4_HUMAN)
TWVTCLGLSY

SEQ ID NO: 63560 - protein, 8 aa, Artificial Sequence
  Description of Artificial Sequence: Synthetic peptide
  Seed: KASESLKM (MAGA4_HUMAN)
KTSESLKW

SEQ ID NO: 63561 - protein, 9 aa, Artificial Sequence
  Description of Artificial Sequence: Synthetic peptide
  Seed: KVDELAHFL (MAGA4_HUMAN)
KMDELAHFC

SEQ ID NO: 63562 - protein, 9 aa, Artificial Sequence
  Description of Artificial Sequence: Synthetic peptide
  Seed: QVPGSNPAR (MAGA4_HUMAN)
QSPGSNPAL

SEQ ID NO: 63563 - protein, 9 aa, Artificial Sequence
  Description of Artificial Sequence: Synthetic peptide
  Seed: QIFPKTGLL (MAGA4_HUMAN)
QVFPKTGLL

SEQ ID NO: 63564 - protein, 10 aa, Artificial Sequence
  Description of Artificial Sequence: Synthetic peptide
  Seed: VDPASNTYTL (MAGA4_HUMAN)
VGPASNTYTL

SEQ ID NO: 63565 - protein, 9 aa, Artificial Sequence
  Description of Artificial Sequence: Synthetic peptide
  Seed: SSPLVPGTL (MAGA4_HUMAN)
SVPLVPGTF

SEQ ID NO: 63566 - protein, 10 aa, Artificial Sequence
  Description of Artificial Sequence: Synthetic peptide
  Seed: RVRIAYPSLR (MAGA4_HUMAN)
RTRIAYPSLT

SEQ ID NO: 63567 - protein, 10 aa, Artificial Sequence
  Description of Artificial Sequence: Synthetic peptide
  Seed: TTISFTCWRQ (MAGA4_HUMAN)
TTISFTCWRV

SEQ ID NO: 63568 - protein, 10 aa, Artificial Sequence
  Description of Artificial Sequence: Synthetic peptide
  Seed: KYRAKELVTK (MAGA4_HUMAN)
KIRAKELVTK

SEQ ID NO: 63569 - protein, 10 aa, Artificial Sequence
  Description of Artificial Sequence: Synthetic peptide
  Seed: ARVRIAYPSL (MAGA4_HUMAN)
ADVRIAYPSV

SEQ ID NO: 63570 - protein, 9 aa, Artificial Sequence
  Description of Artificial Sequence: Synthetic peptide
  Seed: RVRIAYPSL (MAGA4_HUMAN)
RYRIAYPSM

SEQ ID NO: 63571 - protein, 8 aa, Artificial Sequence
  Description of Artificial Sequence: Synthetic peptide
  Seed: ASALPTTI (MAGA4_HUMAN)
AAALPTTY

SEQ ID NO: 63572 - protein, 9 aa, Artificial Sequence
  Description of Artificial Sequence: Synthetic peptide
  Seed: TVYGEPRKL (MAGA4_HUMAN)
TVYGEPRKY

SEQ ID NO: 63573 - protein, 9 aa, Artificial Sequence
  Description of Artificial Sequence: Synthetic peptide
  Seed: VNARVRIAY (MAGA4_HUMAN)
VQARVRIAM

SEQ ID NO: 63574 - protein, 9 aa, Artificial Sequence
  Description of Artificial Sequence: Synthetic peptide
  Seed: GASALPTTI (MAGA4_HUMAN)
GLSALPTTA

SEQ ID NO: 63575 - protein, 10 aa, Artificial Sequence
  Description of Artificial Sequence: Synthetic peptide
  Seed: RVIKNYKRCF (MAGA4_HUMAN)
RAIKNYKRCW

SEQ ID NO: 63576 - protein, 10 aa, Artificial Sequence
  Description of Artificial Sequence: Synthetic peptide
  Seed: KEVDPASNTY (MAGA4_HUMAN)
KKVDPASNTY

SEQ ID NO: 63577 - protein, 11 aa, Artificial Sequence
  Description of Artificial Sequence: Synthetic peptide
  Seed: SAGPPQSPQGA (MAGA4_HUMAN)
SAGPPQSPQGF

SEQ ID NO: 63578 - protein, 9 aa, Artificial Sequence
  Description of Artificial Sequence: Synthetic peptide
  Seed: KELVTKAEM (MAGA4_HUMAN)
KQLVTKAEY

SEQ ID NO: 63579 - protein, 10 aa, Artificial Sequence
  Description of Artificial Sequence: Synthetic peptide
  Seed: LTQDWVQENY (MAGA4_HUMAN)
LAQDWVQENY

SEQ ID NO: 63580 - protein, 10 aa, Artificial Sequence
  Description of Artificial Sequence: Synthetic peptide
  Seed: RVRIAYPSLR (MAGA4_HUMAN)
RPRIAYPSLK

SEQ ID NO: 63581 - protein, 9 aa, Artificial Sequence
  Description of Artificial Sequence: Synthetic peptide
  Seed: SEEEIWEEL (MAGA4_HUMAN)
SQEEIWEEY

SEQ ID NO: 63582 - protein, 9 aa, Artificial Sequence
  Description of Artificial Sequence: Synthetic peptide
  Seed: SALPTTISF (MAGA4_HUMAN)
SQLPTTISR

SEQ ID NO: 63583 - protein, 9 aa, Artificial Sequence
  Description of Artificial Sequence: Synthetic peptide
  Seed: RQVPGSNPA (MAGA4_HUMAN)
RIVPGSNPL

SEQ ID NO: 63584 - protein, 10 aa, Artificial Sequence
  Description of Artificial Sequence: Synthetic peptide
  Seed: YRQVPGSNPA (MAGA4_HUMAN)
YPQVPGSNPV

SEQ ID NO: 63585 - protein, 10 aa, Artificial Sequence
  Description of Artificial Sequence: Synthetic peptide
  Seed: KEVDPASNTY (MAGA4_HUMAN)
KQVDPASNTY

SEQ ID NO: 63586 - protein, 10 aa, Artificial Sequence
  Description of Artificial Sequence: Synthetic peptide
  Seed: LGVMGVYDGR (MAGA4_HUMAN)
LMVMGVYDGK

SEQ ID NO: 63587 - protein, 10 aa, Artificial Sequence
  Description of Artificial Sequence: Synthetic peptide
  Seed: RVNARVRIAY (MAGA4_HUMAN)
RQNARVRIAL

SEQ ID NO: 63588 - protein, 10 aa, Artificial Sequence
  Description of Artificial Sequence: Synthetic peptide
  Seed: GLLIIVLGTI (MAGA4_HUMAN)
GLLIIVLGTV

SEQ ID NO: 63589 - protein, 9 aa, Artificial Sequence
  Description of Artificial Sequence: Synthetic peptide
  Seed: SSSPLVPGT (MAGA4_HUMAN)
SLSPLVPGV

SEQ ID NO: 63590 - protein, 10 aa, Artificial Sequence
  Description of Artificial Sequence: Synthetic peptide
  Seed: KRCFPVIFGK (MAGA4_HUMAN)
KACFPVIFGR

SEQ ID NO: 63591 - protein, 9 aa, Artificial Sequence
  Description of Artificial Sequence: Synthetic peptide
  Seed: FGKASESLK (MAGA4_HUMAN)
FMKASESLR

SEQ ID NO: 63592 - protein, 9 aa, Artificial Sequence
  Description of Artificial Sequence: Synthetic peptide
  Seed: SEEEIWEEL (MAGA4_HUMAN)
SREEIWEEL

SEQ ID NO: 63593 - protein, 10 aa, Artificial Sequence
  Description of Artificial Sequence: Synthetic peptide
  Seed: QIFPKTGLLI (MAGA4_HUMAN)
QQFPKTGLLL

SEQ ID NO: 63594 - protein, 10 aa, Artificial Sequence
  Description of Artificial Sequence: Synthetic peptide
  Seed: KASESLKMIF (MAGA4_HUMAN)
KMSESLKMIF

SEQ ID NO: 63595 - protein, 10 aa, Artificial Sequence
  Description of Artificial Sequence: Synthetic peptide
  Seed: YRQVPGSNPA (MAGA4_HUMAN)
YNQVPGSNPY

SEQ ID NO: 63596 - protein, 10 aa, Artificial Sequence
  Description of Artificial Sequence: Synthetic peptide
  Seed: DPASNTYTLV (MAGA4_HUMAN)
DVASNTYTLV

SEQ ID NO: 63597 - protein, 9 aa, Artificial Sequence
  Description of Artificial Sequence: Synthetic peptide
  Seed: SSPLVPGTL (MAGA4_HUMAN)
SYPLVPGTW

SEQ ID NO: 63598 - protein, 9 aa, Artificial Sequence
  Description of Artificial Sequence: Synthetic peptide
  Seed: EIWEELGVM (MAGA4_HUMAN)
EPWEELGVF

SEQ ID NO: 63599 - protein, 9 aa, Artificial Sequence
  Description of Artificial Sequence: Synthetic peptide
  Seed: LRKYRAKEL (MAGA4_HUMAN)
LIKYRAKEL

SEQ ID NO: 63600 - protein, 9 aa, Artificial Sequence
  Description of Artificial Sequence: Synthetic peptide
  Seed: IAYPSLREA (MAGA4_HUMAN)
IRYPSLREF

SEQ ID NO: 63601 - protein, 10 aa, Artificial Sequence
  Description of Artificial Sequence: Synthetic peptide
  Seed: LPTTISFTCW (MAGA4_HUMAN)
LPTTISFTCM

SEQ ID NO: 63602 - protein, 9 aa, Artificial Sequence
  Description of Artificial Sequence: Synthetic peptide
  Seed: GASALPTTI (MAGA4_HUMAN)
GVSALPTTI

SEQ ID NO: 63603 - protein, 10 aa, Artificial Sequence
  Description of Artificial Sequence: Synthetic peptide
  Seed: KVLEHVVRVN (MAGA4_HUMAN)
KLLEHVVRVC

SEQ ID NO: 63604 - protein, 10 aa, Artificial Sequence
  Description of Artificial Sequence: Synthetic peptide
  Seed: GLLIIVLGTI (MAGA4_HUMAN)
GALIIVLGTV

SEQ ID NO: 63605 - protein, 9 aa, Artificial Sequence
  Description of Artificial Sequence: Synthetic peptide
  Seed: RQVPGSNPA (MAGA4_HUMAN)
RVVPGSNPL

SEQ ID NO: 63606 - protein, 9 aa, Artificial Sequence
  Description of Artificial Sequence: Synthetic peptide
  Seed: STSPDAESL (MAGA4_HUMAN)
SQSPDAESF

SEQ ID NO: 63607 - protein, 10 aa, Artificial Sequence
  Description of Artificial Sequence: Synthetic peptide
  Seed: SESLKMIFGI (MAGA4_HUMAN)
SWSLKMIFGW

SEQ ID NO: 63608 - protein, 9 aa, Artificial Sequence
  Description of Artificial Sequence: Synthetic peptide
  Seed: RVRIAYPSL (MAGA4_HUMAN)
RTRIAYPSP

SEQ ID NO: 63609 - protein, 10 aa, Artificial Sequence
  Description of Artificial Sequence: Synthetic peptide
  Seed: RVRIAYPSLR (MAGA4_HUMAN)
RTRIAYPSLL

SEQ ID NO: 63610 - protein, 10 aa, Artificial Sequence
  Description of Artificial Sequence: Synthetic peptide
  Seed: ALSNKVDELA (MAGA4_HUMAN)
AMSNKVDELI

SEQ ID NO: 63611 - protein, 10 aa, Artificial Sequence
  Description of Artificial Sequence: Synthetic peptide
  Seed: IAYPSLREAA (MAGA4_HUMAN)
IPYPSLREAP

SEQ ID NO: 63612 - protein, 10 aa, Artificial Sequence
  Description of Artificial Sequence: Synthetic peptide
  Seed: QIFPKTGLLI (MAGA4_HUMAN)
QQFPKTGLLI

SEQ ID NO: 63613 - protein, 9 aa, Artificial Sequence
  Description of Artificial Sequence: Synthetic peptide
  Seed: TSPDAESLF (MAGA4_HUMAN)
TYPDAESLW

SEQ ID NO: 63614 - protein, 10 aa, Artificial Sequence
  Description of Artificial Sequence: Synthetic peptide
  Seed: KEVDPASNTY (MAGA4_HUMAN)
KAVDPASNTF

SEQ ID NO: 63615 - protein, 9 aa, Artificial Sequence
  Description of Artificial Sequence: Synthetic peptide
  Seed: SSSPLVPGT (MAGA4_HUMAN)
STSPLVPGM

SEQ ID NO: 63616 - protein, 9 aa, Artificial Sequence
  Description of Artificial Sequence: Synthetic peptide
  Seed: QIFPKTGLL (MAGA4_HUMAN)
QYFPKTGLY

SEQ ID NO: 63617 - protein, 9 aa, Artificial Sequence
  Description of Artificial Sequence: Synthetic peptide
  Seed: EEQEAAVSS (MAGA4_HUMAN)
EEQEAAVSF

SEQ ID NO: 63618 - protein, 9 aa, Artificial Sequence
  Description of Artificial Sequence: Synthetic peptide
  Seed: KVLEHVVRV (MAGA4_HUMAN)
KRLEHVVRM

SEQ ID NO: 63619 - protein, 10 aa, Artificial Sequence
  Description of Artificial Sequence: Synthetic peptide
  Seed: ASALPTTISF (MAGA4_HUMAN)
ASALPTTISM

SEQ ID NO: 63620 - protein, 9 aa, Artificial Sequence
  Description of Artificial Sequence: Synthetic peptide
  Seed: RVNARVRIA (MAGA4_HUMAN)
RTNARVRIG

SEQ ID NO: 63621 - protein, 11 aa, Artificial Sequence
  Description of Artificial Sequence: Synthetic peptide
  Seed: RVRIAYPSLRE (MAGA4_HUMAN)
RSRIAYPSLRV

SEQ ID NO: 63622 - protein, 10 aa, Artificial Sequence
  Description of Artificial Sequence: Synthetic peptide
  Seed: EAAVSSSSPL (MAGA4_HUMAN)
ETAVSSSSPI

SEQ ID NO: 63623 - protein, 9 aa, Artificial Sequence
  Description of Artificial Sequence: Synthetic peptide
  Seed: VYDGREHTV (MAGA4_HUMAN)
VQDGREHTL

SEQ ID NO: 63624 - protein, 9 aa, Artificial Sequence
  Description of Artificial Sequence: Synthetic peptide
  Seed: SALPTTISF (MAGA4_HUMAN)
SILPTTISK

SEQ ID NO: 63625 - protein, 9 aa, Artificial Sequence
  Description of Artificial Sequence: Synthetic peptide
  Seed: RVNARVRIA (MAGA4_HUMAN)
RANARVRIA

SEQ ID NO: 63626 - protein, 10 aa, Artificial Sequence
  Description of Artificial Sequence: Synthetic peptide
  Seed: SLFREALSNK (MAGA4_HUMAN)
SDFREALSNR

SEQ ID NO: 63627 - protein, 11 aa, Artificial Sequence
  Description of Artificial Sequence: Synthetic peptide
  Seed: SPQGASALPTT (MAGA4_HUMAN)
SPQGASALPTI

SEQ ID NO: 63628 - protein, 9 aa, Artificial Sequence
  Description of Artificial Sequence: Synthetic peptide
  Seed: KNYKRCFPV (MAGA4_HUMAN)
KAYKRCFPA

SEQ ID NO: 63629 - protein, 9 aa, Artificial Sequence
  Description of Artificial Sequence: Synthetic peptide
  Seed: RCFPVIFGK (MAGA4_HUMAN)
RTFPVIFGY

SEQ ID NO: 63630 - protein, 9 aa, Artificial Sequence
  Description of Artificial Sequence: Synthetic peptide
  Seed: VNARVRIAY (MAGA4_HUMAN)
VQARVRIAF

SEQ ID NO: 63631 - protein, 9 aa, Artificial Sequence
  Description of Artificial Sequence: Synthetic peptide
  Seed: SEEEIWEEL (MAGA4_HUMAN)
SAEEIWEEL

SEQ ID NO: 63632 - protein, 10 aa, Artificial Sequence
  Description of Artificial Sequence: Synthetic peptide
  Seed: PTTISFTCWR (MAGA4_HUMAN)
PWTISFTCWR

SEQ ID NO: 63633 - protein, 9 aa, Artificial Sequence
  Description of Artificial Sequence: Synthetic peptide
  Seed: RVRIAYPSL (MAGA4_HUMAN)
RTRIAYPSV

SEQ ID NO: 63634 - protein, 9 aa, Artificial Sequence
  Description of Artificial Sequence: Synthetic peptide
  Seed: VYDGREHTV (MAGA4_HUMAN)
VSDGREHTL

SEQ ID NO: 63635 - protein, 10 aa, Artificial Sequence
  Description of Artificial Sequence: Synthetic peptide
  Seed: AYPSLREAAL (MAGA4_HUMAN)
AVPSLREAAM

SEQ ID NO: 63636 - protein, 10 aa, Artificial Sequence
  Description of Artificial Sequence: Synthetic peptide
  Seed: KASESLKMIF (MAGA4_HUMAN)
KVSESLKMIW

SEQ ID NO: 63637 - protein, 11 aa, Artificial Sequence
  Description of Artificial Sequence: Synthetic peptide
  Seed: RQVPGSNPARY (MAGA4_HUMAN)
RLVPGSNPARW

SEQ ID NO: 63638 - protein, 10 aa, Artificial Sequence
  Description of Artificial Sequence: Synthetic peptide
  Seed: KNYKRCFPVI (MAGA4_HUMAN)
KWYKRCFPVW

SEQ ID NO: 63639 - protein, 10 aa, Artificial Sequence
  Description of Artificial Sequence: Synthetic peptide
  Seed: SSSPLVPGTL (MAGA4_HUMAN)
SLSPLVPGTA

SEQ ID NO: 63640 - protein, 8 aa, Artificial Sequence
  Description of Artificial Sequence: Synthetic peptide
  Seed: RVRIAYPS (MAGA4_HUMAN)
RTRIAYPI

SEQ ID NO: 63641 - protein, 10 aa, Artificial Sequence
  Description of Artificial Sequence: Synthetic peptide
  Seed: KASESLKMIF (MAGA4_HUMAN)
KHSESLKMIW

SEQ ID NO: 63642 - protein, 9 aa, Artificial Sequence
  Description of Artificial Sequence: Synthetic peptide
  Seed: MLERVIKNY (MAGA4_HUMAN)
MTERVIKNY

SEQ ID NO: 63643 - protein, 9 aa, Artificial Sequence
  Description of Artificial Sequence: Synthetic peptide
  Seed: SALPTTISF (MAGA4_HUMAN)
SVLPTTISL

SEQ ID NO: 63644 - protein, 10 aa, Artificial Sequence
  Description of Artificial Sequence: Synthetic peptide
  Seed: MIFGIDVKEV (MAGA4_HUMAN)
MTFGIDVKEA

SEQ ID NO: 63645 - protein, 9 aa, Artificial Sequence
  Description of Artificial Sequence: Synthetic peptide
  Seed: YPSLREAAL (MAGA4_HUMAN)
YMSLREAAF

SEQ ID NO: 63646 - protein, 9 aa, Artificial Sequence
  Description of Artificial Sequence: Synthetic peptide
  Seed: TTEEQEAAV (MAGA4_HUMAN)
TSEEQEAAM

SEQ ID NO: 63647 - protein, 9 aa, Artificial Sequence
  Description of Artificial Sequence: Synthetic peptide
  Seed: STSPDAESL (MAGA4_HUMAN)
SASPDAESY

SEQ ID NO: 63648 - protein, 9 aa, Artificial Sequence
  Description of Artificial Sequence: Synthetic peptide
  Seed: TSPDAESLF (MAGA4_HUMAN)
TTPDAESLY

SEQ ID NO: 63649 - protein, 10 aa, Artificial Sequence
  Description of Artificial Sequence: Synthetic peptide
  Seed: RVRIAYPSLR (MAGA4_HUMAN)
RIRIAYPSLR

SEQ ID NO: 63650 - protein, 10 aa, Artificial Sequence
  Description of Artificial Sequence: Synthetic peptide
  Seed: SSSPLVPGTL (MAGA4_HUMAN)
SSSPLVPGTV

SEQ ID NO: 63651 - protein, 9 aa, Artificial Sequence
  Description of Artificial Sequence: Synthetic peptide
  Seed: RCFPVIFGK (MAGA4_HUMAN)
RFFPVIFGR

SEQ ID NO: 63652 - protein, 9 aa, Artificial Sequence
  Description of Artificial Sequence: Synthetic peptide
  Seed: HVVRVNARV (MAGA4_HUMAN)
HTVRVNARR

SEQ ID NO: 63653 - protein, 9 aa, Artificial Sequence
  Description of Artificial Sequence: Synthetic peptide
  Seed: SYVKVLEHV (MAGA4_HUMAN)
SRVKVLEHL

SEQ ID NO: 63654 - protein, 9 aa, Artificial Sequence
  Description of Artificial Sequence: Synthetic peptide
  Seed: WVQENYLEY (MAGA4_HUMAN)
WSQENYLEM

SEQ ID NO: 63655 - protein, 10 aa, Artificial Sequence
  Description of Artificial Sequence: Synthetic peptide
  Seed: YRQVPGSNPA (MAGA4_HUMAN)
YFQVPGSNPY

SEQ ID NO: 63656 - protein, 10 aa, Artificial Sequence
  Description of Artificial Sequence: Synthetic peptide
  Seed: EHVVRVNARV (MAGA4_HUMAN)
EYVVRVNARV

SEQ ID NO: 63657 - protein, 10 aa, Artificial Sequence
  Description of Artificial Sequence: Synthetic peptide
  Seed: KEVDPASNTY (MAGA4_HUMAN)
KGVDPASNTY

SEQ ID NO: 63658 - protein, 9 aa, Artificial Sequence
  Description of Artificial Sequence: Synthetic peptide
  Seed: IFPKTGLLI (MAGA4_HUMAN)
IMPKTGLLW

SEQ ID NO: 63659 - protein, 9 aa, Artificial Sequence
  Description of Artificial Sequence: Synthetic peptide
  Seed: RVRIAYPSL (MAGA4_HUMAN)
RLRIAYPSR

SEQ ID NO: 63660 - protein, 11 aa, Artificial Sequence
  Description of Artificial Sequence: Synthetic peptide
  Seed: ELGVMGVYDGR (MAGA4_HUMAN)
ENGVMGVYDGR

SEQ ID NO: 63661 - protein, 9 aa, Artificial Sequence
  Description of Artificial Sequence: Synthetic peptide
  Seed: RAKELVTKA (MAGA4_HUMAN)
RSKELVTKM

SEQ ID NO: 63662 - protein, 9 aa, Artificial Sequence
  Description of Artificial Sequence: Synthetic peptide
  Seed: AAVSSSSPL (MAGA4_HUMAN)
AGVSSSSPY

SEQ ID NO: 63663 - protein, 10 aa, Artificial Sequence
  Description of Artificial Sequence: Synthetic peptide
  Seed: YRQVPGSNPA (MAGA4_HUMAN)
YKQVPGSNPW

SEQ ID NO: 63664 - protein, 10 aa, Artificial Sequence
  Description of Artificial Sequence: Synthetic peptide
  Seed: TSYVKVLEHV (MAGA4_HUMAN)
TWYVKVLEHF

SEQ ID NO: 63665 - protein, 10 aa, Artificial Sequence
  Description of Artificial Sequence: Synthetic peptide
  Seed: VIFGKASESL (MAGA4_HUMAN)
VLFGKASESV

SEQ ID NO: 63666 - protein, 9 aa, Artificial Sequence
  Description of Artificial Sequence: Synthetic peptide
  Seed: GASALPTTI (MAGA4_HUMAN)
GTSALPTTY

SEQ ID NO: 63667 - protein, 9 aa, Artificial Sequence
  Description of Artificial Sequence: Synthetic peptide
  Seed: ALPTTISFT (MAGA4_HUMAN)
AMPTTISFV

SEQ ID NO: 63668 - protein, 10 aa, Artificial Sequence
  Description of Artificial Sequence: Synthetic peptide
  Seed: KNYKRCFPVI (MAGA4_HUMAN)
KWYKRCFPVL

SEQ ID NO: 63669 - protein, 8 aa, Artificial Sequence
  Description of Artificial Sequence: Synthetic peptide
  Seed: AEMLERVI (MAGA4_HUMAN)
AEMLERVL

SEQ ID NO: 63670 - protein, 9 aa, Artificial Sequence
  Description of Artificial Sequence: Synthetic peptide
  Seed: QIFPKTGLL (MAGA4_HUMAN)
QPFPKTGLL

SEQ ID NO: 63671 - protein, 9 aa, Artificial Sequence
  Description of Artificial Sequence: Synthetic peptide
  Seed: VYDGREHTV (MAGA4_HUMAN)
VIDGREHTY

SEQ ID NO: 63672 - protein, 11 aa, Artificial Sequence
  Description of Artificial Sequence: Synthetic peptide
  Seed: AQAPTTEEQEA (MAGA4_HUMAN)
AQAPTTEEQEF

SEQ ID NO: 63673 - protein, 9 aa, Artificial Sequence
  Description of Artificial Sequence: Synthetic peptide
  Seed: ERVIKNYKR (MAGA4_HUMAN)
EVVIKNYKR

SEQ ID NO: 63674 - protein, 9 aa, Artificial Sequence
  Description of Artificial Sequence: Synthetic peptide
  Seed: EVDPASNTY (MAGA4_HUMAN)
ETDPASNTW

SEQ ID NO: 63675 - protein, 11 aa, Artificial Sequence
  Description of Artificial Sequence: Synthetic peptide
  Seed: VIFGKASESLK (MAGA4_HUMAN)
VVFGKASESLK

SEQ ID NO: 63676 - protein, 9 aa, Artificial Sequence
  Description of Artificial Sequence: Synthetic peptide
  Seed: KVDELAHFL (MAGA4_HUMAN)
KWDELAHFV

SEQ ID NO: 63677 - protein, 10 aa, Artificial Sequence
  Description of Artificial Sequence: Synthetic peptide
  Seed: EAAVSSSSPL (MAGA4_HUMAN)
EFAVSSSSPV

SEQ ID NO: 63678 - protein, 9 aa, Artificial Sequence
  Description of Artificial Sequence: Synthetic peptide
  Seed: IIVLGTIAM (MAGA4_HUMAN)
IGVLGTIAF

SEQ ID NO: 63679 - protein, 9 aa, Artificial Sequence
  Description of Artificial Sequence: Synthetic peptide
  Seed: TQDWVQENY (MAGA4_HUMAN)
TTDWVQENI

SEQ ID NO: 63680 - protein, 10 aa, Artificial Sequence
  Description of Artificial Sequence: Synthetic peptide
  Seed: RVRIAYPSLR (MAGA4_HUMAN)
RPRIAYPSLV

SEQ ID NO: 63681 - protein, 11 aa, Artificial Sequence
  Description of Artificial Sequence: Synthetic peptide
  Seed: AYPSLREAALL (MAGA4_HUMAN)
AFPSLREAALF

SEQ ID NO: 63682 - protein, 10 aa, Artificial Sequence
  Description of Artificial Sequence: Synthetic peptide
  Seed: YRQVPGSNPA (MAGA4_HUMAN)
YFQVPGSNPM

SEQ ID NO: 63683 - protein, 10 aa, Artificial Sequence
  Description of Artificial Sequence: Synthetic peptide
  Seed: RIAYPSLREA (MAGA4_HUMAN)
RIAYPSLREV

SEQ ID NO: 63684 - protein, 9 aa, Artificial Sequence
  Description of Artificial Sequence: Synthetic peptide
  Seed: TVYGEPRKL (MAGA4_HUMAN)
THYGEPRKY

SEQ ID NO: 63685 - protein, 10 aa, Artificial Sequence
  Description of Artificial Sequence: Synthetic peptide
  Seed: LPTTISFTCW (MAGA4_HUMAN)
LVTTISFTCW

SEQ ID NO: 63686 - protein, 11 aa, Artificial Sequence
  Description of Artificial Sequence: Synthetic peptide
  Seed: RVRIAYPSLRE (MAGA4_HUMAN)
RSRIAYPSLRR

SEQ ID NO: 63687 - protein, 9 aa, Artificial Sequence
  Description of Artificial Sequence: Synthetic peptide
  Seed: SSPLVPGTL (MAGA4_HUMAN)
SIPLVPGTL

SEQ ID NO: 63688 - protein, 10 aa, Artificial Sequence
  Description of Artificial Sequence: Synthetic peptide
  Seed: RIAYPSLREA (MAGA4_HUMAN)
RLAYPSLREK

SEQ ID NO: 63689 - protein, 9 aa, Artificial Sequence
  Description of Artificial Sequence: Synthetic peptide
  Seed: ELAHFLLRK (MAGA4_HUMAN)
EIAHFLLRR

SEQ ID NO: 63690 - protein, 9 aa, Artificial Sequence
  Description of Artificial Sequence: Synthetic peptide
  Seed: NTYTLVTCL (MAGA4_HUMAN)
NLYTLVTCA

SEQ ID NO: 63691 - protein, 10 aa, Artificial Sequence
  Description of Artificial Sequence: Synthetic peptide
  Seed: SESLKMIFGI (MAGA4_HUMAN)
SPSLKMIFGW

SEQ ID NO: 63692 - protein, 11 aa, Artificial Sequence
  Description of Artificial Sequence: Synthetic peptide
  Seed: REALSNKVDEL (MAGA4_HUMAN)
REALSNKVDEC

SEQ ID NO: 63693 - protein, 9 aa, Artificial Sequence
  Description of Artificial Sequence: Synthetic peptide
  Seed: FGKASESLK (MAGA4_HUMAN)
FAKASESLM

SEQ ID NO: 63694 - protein, 9 aa, Artificial Sequence
  Description of Artificial Sequence: Synthetic peptide
  Seed: EEVPAAESA (MAGA4_HUMAN)
EHVPAAESA

SEQ ID NO: 63695 - protein, 9 aa, Artificial Sequence
  Description of Artificial Sequence: Synthetic peptide
  Seed: AHFLLRKYR (MAGA4_HUMAN)
AWFLLRKYK

SEQ ID NO: 63696 - protein, 10 aa, Artificial Sequence
  Description of Artificial Sequence: Synthetic peptide
  Seed: ARVRIAYPSL (MAGA4_HUMAN)
ATVRIAYPSI

SEQ ID NO: 63697 - protein, 9 aa, Artificial Sequence
  Description of Artificial Sequence: Synthetic peptide
  Seed: GTLEEVPAA (MAGA4_HUMAN)
GQLEEVPAI

SEQ ID NO: 63698 - protein, 9 aa, Artificial Sequence
  Description of Artificial Sequence: Synthetic peptide
  Seed: TTISFTCWR (MAGA4_HUMAN)
TWISFTCWK

SEQ ID NO: 63699 - protein, 9 aa, Artificial Sequence
  Description of Artificial Sequence: Synthetic peptide
  Seed: TVYGEPRKL (MAGA4_HUMAN)
TAYGEPRKY

SEQ ID NO: 63700 - protein, 9 aa, Artificial Sequence
  Description of Artificial Sequence: Synthetic peptide
  Seed: AAVSSSSPL (MAGA4_HUMAN)
APVSSSSPF

SEQ ID NO: 63701 - protein, 9 aa, Artificial Sequence
  Description of Artificial Sequence: Synthetic peptide
  Seed: RAKELVTKA (MAGA4_HUMAN)
RLKELVTKL

SEQ ID NO: 63702 - protein, 10 aa, Artificial Sequence
  Description of Artificial Sequence: Synthetic peptide
  Seed: KVLEHVVRVN (MAGA4_HUMAN)
KMLEHVVRVL

SEQ ID NO: 63703 - protein, 8 aa, Artificial Sequence
  Description of Artificial Sequence: Synthetic peptide
  Seed: KVDELAHF (MAGA4_HUMAN)
KVDELAHI

SEQ ID NO: 63704 - protein, 9 aa, Artificial Sequence
  Description of Artificial Sequence: Synthetic peptide
  Seed: SSPLVPGTL (MAGA4_HUMAN)
SMPLVPGTF

SEQ ID NO: 63705 - protein, 10 aa, Artificial Sequence
  Description of Artificial Sequence: Synthetic peptide
  Seed: KYRAKELVTK (MAGA4_HUMAN)
KQRAKELVTK

SEQ ID NO: 63706 - protein, 9 aa, Artificial Sequence
  Description of Artificial Sequence: Synthetic peptide
  Seed: GSNPARYEF (MAGA4_HUMAN)
GQNPARYEF

SEQ ID NO: 63707 - protein, 10 aa, Artificial Sequence
  Description of Artificial Sequence: Synthetic peptide
  Seed: LTQDWVQENY (MAGA4_HUMAN)
LSQDWVQENY

SEQ ID NO: 63708 - protein, 10 aa, Artificial Sequence
  Description of Artificial Sequence: Synthetic peptide
  Seed: SSSPLVPGTL (MAGA4_HUMAN)
SISPLVPGTL

SEQ ID NO: 63709 - protein, 9 aa, Artificial Sequence
  Description of Artificial Sequence: Synthetic peptide
  Seed: LGNNQIFPK (MAGA4_HUMAN)
LSNNQIFPK

SEQ ID NO: 63710 - protein, 9 aa, Artificial Sequence
  Description of Artificial Sequence: Synthetic peptide
  Seed: SALPTTISF (MAGA4_HUMAN)
STLPTTISK

SEQ ID NO: 63711 - protein, 11 aa, Artificial Sequence
  Description of Artificial Sequence: Synthetic peptide
  Seed: ELAHFLLRKYR (MAGA4_HUMAN)
EVAHFLLRKYR

SEQ ID NO: 63712 - protein, 9 aa, Artificial Sequence
  Description of Artificial Sequence: Synthetic peptide
  Seed: WVQENYLEY (MAGA4_HUMAN)
WQQENYLEW

SEQ ID NO: 63713 - protein, 9 aa, Artificial Sequence
  Description of Artificial Sequence: Synthetic peptide
  Seed: RCFPVIFGK (MAGA4_HUMAN)
RLFPVIFGI

SEQ ID NO: 63714 - protein, 10 aa, Artificial Sequence
  Description of Artificial Sequence: Synthetic peptide
  Seed: EAAVSSSSPL (MAGA4_HUMAN)
EVAVSSSSPV

SEQ ID NO: 63715 - protein, 10 aa, Artificial Sequence
  Description of Artificial Sequence: Synthetic peptide
  Seed: LEEVPAAESA (MAGA4_HUMAN)
LEEVPAAESL

SEQ ID NO: 63716 - protein, 9 aa, Artificial Sequence
  Description of Artificial Sequence: Synthetic peptide
  Seed: RCFPVIFGK (MAGA4_HUMAN)
RTFPVIFGH

SEQ ID NO: 63717 - protein, 9 aa, Artificial Sequence
  Description of Artificial Sequence: Synthetic peptide
  Seed: DELAHFLLR (MAGA4_HUMAN)
DFLAHFLLK

SEQ ID NO: 63718 - protein, 10 aa, Artificial Sequence
  Description of Artificial Sequence: Synthetic peptide
  Seed: RQVPGSNPAR (MAGA4_HUMAN)
RIVPGSNPAF

SEQ ID NO: 63719 - protein, 9 aa, Artificial Sequence
  Description of Artificial Sequence: Synthetic peptide
  Seed: KNYKRCFPV (MAGA4_HUMAN)
KTYKRCFPK

SEQ ID NO: 63720 - protein, 9 aa, Artificial Sequence
  Description of Artificial Sequence: Synthetic peptide
  Seed: RAKELVTKA (MAGA4_HUMAN)
RAKELVTKI

SEQ ID NO: 63721 - protein, 10 aa, Artificial Sequence
  Description of Artificial Sequence: Synthetic peptide
  Seed: ELAHFLLRKY (MAGA4_HUMAN)
ETAHFLLRKY

SEQ ID NO: 63722 - protein, 9 aa, Artificial Sequence
  Description of Artificial Sequence: Synthetic peptide
  Seed: QIFPKTGLL (MAGA4_HUMAN)
QTFPKTGLR

SEQ ID NO: 63723 - protein, 9 aa, Artificial Sequence
  Description of Artificial Sequence: Synthetic peptide
  Seed: KVLEHVVRV (MAGA4_HUMAN)
KLLEHVVRT

SEQ ID NO: 63724 - protein, 9 aa, Artificial Sequence
  Description of Artificial Sequence: Synthetic peptide
  Seed: KVLEHVVRV (MAGA4_HUMAN)
KMLEHVVRK

SEQ ID NO: 63725 - protein, 11 aa, Artificial Sequence
  Description of Artificial Sequence: Synthetic peptide
  Seed: RQVPGSNPARY (MAGA4_HUMAN)
RWVPGSNPARY

SEQ ID NO: 63726 - protein, 10 aa, Artificial Sequence
  Description of Artificial Sequence: Synthetic peptide
  Seed: KVDELAHFLL (MAGA4_HUMAN)
KSDELAHFLY

SEQ ID NO: 63727 - protein, 9 aa, Artificial Sequence
  Description of Artificial Sequence: Synthetic peptide
  Seed: SEEEIWEEL (MAGA4_HUMAN)
SHEEIWEEI

SEQ ID NO: 63728 - protein, 10 aa, Artificial Sequence
  Description of Artificial Sequence: Synthetic peptide
  Seed: YRQVPGSNPA (MAGA4_HUMAN)
YIQVPGSNPY

SEQ ID NO: 63729 - protein, 10 aa, Artificial Sequence
  Description of Artificial Sequence: Synthetic peptide
  Seed: RVNARVRIAY (MAGA4_HUMAN)
RTNARVRIAK

SEQ ID NO: 63730 - protein, 9 aa, Artificial Sequence
  Description of Artificial Sequence: Synthetic peptide
  Seed: LKMIFGIDV (MAGA4_HUMAN)
LQMIFGIDM

SEQ ID NO: 63731 - protein, 10 aa, Artificial Sequence
  Description of Artificial Sequence: Synthetic peptide
  Seed: ASALPTTISF (MAGA4_HUMAN)
ALALPTTISW

SEQ ID NO: 63732 - protein, 9 aa, Artificial Sequence
  Description of Artificial Sequence: Synthetic peptide
  Seed: HVVRVNARV (MAGA4_HUMAN)
HIVRVNARV

SEQ ID NO: 63733 - protein, 9 aa, Artificial Sequence
  Description of Artificial Sequence: Synthetic peptide
  Seed: IFPKTGLLI (MAGA4_HUMAN)
ITPKTGLLM

SEQ ID NO: 63734 - protein, 9 aa, Artificial Sequence
  Description of Artificial Sequence: Synthetic peptide
  Seed: KVDELAHFL (MAGA4_HUMAN)
KGDELAHFY

SEQ ID NO: 63735 - protein, 10 aa, Artificial Sequence
  Description of Artificial Sequence: Synthetic peptide
  Seed: ASALPTTISF (MAGA4_HUMAN)
AMALPTTISM

SEQ ID NO: 63736 - protein, 9 aa, Artificial Sequence
  Description of Artificial Sequence: Synthetic peptide
  Seed: VYDGREHTV (MAGA4_HUMAN)
VQDGREHTY

SEQ ID NO: 63737 - protein, 9 aa, Artificial Sequence
  Description of Artificial Sequence: Synthetic peptide
  Seed: IIVLGTIAM (MAGA4_HUMAN)
IYVLGTIAY

SEQ ID NO: 63738 - protein, 9 aa, Artificial Sequence
  Description of Artificial Sequence: Synthetic peptide
  Seed: KVLEHVVRV (MAGA4_HUMAN)
KCLEHVVRW

SEQ ID NO: 63739 - protein, 9 aa, Artificial Sequence
  Description of Artificial Sequence: Synthetic peptide
  Seed: SPLVPGTLE (MAGA4_HUMAN)
SPLVPGTLV

SEQ ID NO: 63740 - protein, 11 aa, Artificial Sequence
  Description of Artificial Sequence: Synthetic peptide
  Seed: REALSNKVDEL (MAGA4_HUMAN)
REALSNKVDEW

SEQ ID NO: 63741 - protein, 11 aa, Artificial Sequence
  Description of Artificial Sequence: Synthetic peptide
  Seed: GASALPTTISF (MAGA4_HUMAN)
GSSALPTTISF

SEQ ID NO: 63742 - protein, 9 aa, Artificial Sequence
  Description of Artificial Sequence: Synthetic peptide
  Seed: LFREALSNK (MAGA4_HUMAN)
LIREALSNR

SEQ ID NO: 63743 - protein, 9 aa, Artificial Sequence
  Description of Artificial Sequence: Synthetic peptide
  Seed: RVRIAYPSL (MAGA4_HUMAN)
RYRIAYPSF

SEQ ID NO: 63744 - protein, 11 aa, Artificial Sequence
  Description of Artificial Sequence: Synthetic peptide
  Seed: KVDELAHFLLR (MAGA4_HUMAN)
KTDELAHFLLY

SEQ ID NO: 63745 - protein, 10 aa, Artificial Sequence
  Description of Artificial Sequence: Synthetic peptide
  Seed: LTQDWVQENY (MAGA4_HUMAN)
LQQDWVQENY

SEQ ID NO: 63746 - protein, 11 aa, Artificial Sequence
  Description of Artificial Sequence: Synthetic peptide
  Seed: ELAHFLLRKYR (MAGA4_HUMAN)
EAAHFLLRKYR

SEQ ID NO: 63747 - protein, 10 aa, Artificial Sequence
  Description of Artificial Sequence: Synthetic peptide
  Seed: GVYDGREHTV (MAGA4_HUMAN)
GMYDGREHTA

SEQ ID NO: 63748 - protein, 10 aa, Artificial Sequence
  Description of Artificial Sequence: Synthetic peptide
  Seed: VYDGREHTVY (MAGA4_HUMAN)
VWDGREHTVM

SEQ ID NO: 63749 - protein, 9 aa, Artificial Sequence
  Description of Artificial Sequence: Synthetic peptide
  Seed: SSPLVPGTL (MAGA4_HUMAN)
SPPLVPGTI

SEQ ID NO: 63750 - protein, 9 aa, Artificial Sequence
  Description of Artificial Sequence: Synthetic peptide
  Seed: NQIFPKTGL (MAGA4_HUMAN)
NHIFPKTGV

SEQ ID NO: 63751 - protein, 10 aa, Artificial Sequence
  Description of Artificial Sequence: Synthetic peptide
  Seed: RVRIAYPSLR (MAGA4_HUMAN)
RERIAYPSLF

SEQ ID NO: 63752 - protein, 9 aa, Artificial Sequence
  Description of Artificial Sequence: Synthetic peptide
  Seed: AAVSSSSPL (MAGA4_HUMAN)
AFVSSSSPL

SEQ ID NO: 63753 - protein, 9 aa, Artificial Sequence
  Description of Artificial Sequence: Synthetic peptide
  Seed: SYVKVLEHV (MAGA4_HUMAN)
SMVKVLEHL

SEQ ID NO: 63754 - protein, 9 aa, Artificial Sequence
  Description of Artificial Sequence: Synthetic peptide
  Seed: IAYPSLREA (MAGA4_HUMAN)
IQYPSLREL

SEQ ID NO: 63755 - protein, 9 aa, Artificial Sequence
  Description of Artificial Sequence: Synthetic peptide
  Seed: GVYDGREHT (MAGA4_HUMAN)
GLYDGREHL

SEQ ID NO: 63756 - protein, 9 aa, Artificial Sequence
  Description of Artificial Sequence: Synthetic peptide
  Seed: EVDPASNTY (MAGA4_HUMAN)
EADPASNTW

SEQ ID NO: 63757 - protein, 10 aa, Artificial Sequence
  Description of Artificial Sequence: Synthetic peptide
  Seed: PTTISFTCWR (MAGA4_HUMAN)
PATISFTCWR

SEQ ID NO: 63758 - protein, 11 aa, Artificial Sequence
  Description of Artificial Sequence: Synthetic peptide
  Seed: RKYRAKELVTK (MAGA4_HUMAN)
RRYRAKELVTK

SEQ ID NO: 63759 - protein, 10 aa, Artificial Sequence
  Description of Artificial Sequence: Synthetic peptide
  Seed: YPSLREAALL (MAGA4_HUMAN)
YKSLREAALW

SEQ ID NO: 63760 - protein, 9 aa, Artificial Sequence
  Description of Artificial Sequence: Synthetic peptide
  Seed: NKVDELAHF (MAGA4_HUMAN)
NLVDELAHY

SEQ ID NO: 63761 - protein, 11 aa, Artificial Sequence
  Description of Artificial Sequence: Synthetic peptide
  Seed: IAYPSLREAAL (MAGA4_HUMAN)
IVYPSLREAAW

SEQ ID NO: 63762 - protein, 10 aa, Artificial Sequence
  Description of Artificial Sequence: Synthetic peptide
  Seed: WVQENYLEYR (MAGA4_HUMAN)
WYQENYLEYR

SEQ ID NO: 63763 - protein, 9 aa, Artificial Sequence
  Description of Artificial Sequence: Synthetic peptide
  Seed: SSSPLVPGT (MAGA4_HUMAN)
SMSPLVPGL

SEQ ID NO: 63764 - protein, 10 aa, Artificial Sequence
  Description of Artificial Sequence: Synthetic peptide
  Seed: LTQDWVQENY (MAGA4_HUMAN)
LSQDWVQENF

SEQ ID NO: 63765 - protein, 10 aa, Artificial Sequence
  Description of Artificial Sequence: Synthetic peptide
  Seed: SSSPLVPGTL (MAGA4_HUMAN)
SMSPLVPGTL

SEQ ID NO: 63766 - protein, 9 aa, Artificial Sequence
  Description of Artificial Sequence: Synthetic peptide
  Seed: RQVPGSNPA (MAGA4_HUMAN)
RKVPGSNPI

SEQ ID NO: 63767 - protein, 9 aa, Artificial Sequence
  Description of Artificial Sequence: Synthetic peptide
  Seed: KNYKRCFPV (MAGA4_HUMAN)
KSYKRCFPS

SEQ ID NO: 63768 - protein, 10 aa, Artificial Sequence
  Description of Artificial Sequence: Synthetic peptide
  Seed: GVYDGREHTV (MAGA4_HUMAN)
GTYDGREHTK

SEQ ID NO: 63769 - protein, 9 aa, Artificial Sequence
  Description of Artificial Sequence: Synthetic peptide
  Seed: SALPTTISF (MAGA4_HUMAN)
SWLPTTISI

SEQ ID NO: 63770 - protein, 9 aa, Artificial Sequence
  Description of Artificial Sequence: Synthetic peptide
  Seed: LAHFLLRKY (MAGA4_HUMAN)
LTHFLLRKW

SEQ ID NO: 63771 - protein, 9 aa, Artificial Sequence
  Description of Artificial Sequence: Synthetic peptide
  Seed: GSNPARYEF (MAGA4_HUMAN)
GRNPARYEY

SEQ ID NO: 63772 - protein, 9 aa, Artificial Sequence
  Description of Artificial Sequence: Synthetic peptide
  Seed: YVKVLEHVV (MAGA4_HUMAN)
YTKVLEHVL

SEQ ID NO: 63773 - protein, 9 aa, Artificial Sequence
  Description of Artificial Sequence: Synthetic peptide
  Seed: TQDWVQENY (MAGA4_HUMAN)
TMDWVQENF

SEQ ID NO: 63774 - protein, 9 aa, Artificial Sequence
  Description of Artificial Sequence: Synthetic peptide
  Seed: KVLEHVVRV (MAGA4_HUMAN)
KFLEHVVRY

SEQ ID NO: 63775 - protein, 9 aa, Artificial Sequence
  Description of Artificial Sequence: Synthetic peptide
  Seed: STSPDAESL (MAGA4_HUMAN)
SYSPDAESM

SEQ ID NO: 63776 - protein, 11 aa, Artificial Sequence
  Description of Artificial Sequence: Synthetic peptide
  Seed: ELGVMGVYDGR (MAGA4_HUMAN)
ETGVMGVYDGR

SEQ ID NO: 63777 - protein, 9 aa, Artificial Sequence
  Description of Artificial Sequence: Synthetic peptide
  Seed: RAKELVTKA (MAGA4_HUMAN)
RLKELVTKI

SEQ ID NO: 63778 - protein, 10 aa, Artificial Sequence
  Description of Artificial Sequence: Synthetic peptide
  Seed: LGVMGVYDGR (MAGA4_HUMAN)
LKVMGVYDGR

SEQ ID NO: 63779 - protein, 11 aa, Artificial Sequence
  Description of Artificial Sequence: Synthetic peptide
  Seed: RQVPGSNPARY (MAGA4_HUMAN)
RIVPGSNPARF

SEQ ID NO: 63780 - protein, 9 aa, Artificial Sequence
  Description of Artificial Sequence: Synthetic peptide
  Seed: GASALPTTI (MAGA4_HUMAN)
GISALPTTI

SEQ ID NO: 63781 - protein, 9 aa, Artificial Sequence
  Description of Artificial Sequence: Synthetic peptide
  Seed: SALPTTISF (MAGA4_HUMAN)
SNLPTTISL

SEQ ID NO: 63782 - protein, 10 aa, Artificial Sequence
  Description of Artificial Sequence: Synthetic peptide
  Seed: ARVRIAYPSL (MAGA4_HUMAN)
AIVRIAYPSV

SEQ ID NO: 63783 - protein, 9 aa, Artificial Sequence
  Description of Artificial Sequence: Synthetic peptide
  Seed: RAKELVTKA (MAGA4_HUMAN)
RAKELVTKR

SEQ ID NO: 63784 - protein, 10 aa, Artificial Sequence
  Description of Artificial Sequence: Synthetic peptide
  Seed: KEVDPASNTY (MAGA4_HUMAN)
KEVDPASNTC

SEQ ID NO: 63785 - protein, 10 aa, Artificial Sequence
  Description of Artificial Sequence: Synthetic peptide
  Seed: AYPSLREAAL (MAGA4_HUMAN)
AYPSLREAAM

SEQ ID NO: 63786 - protein, 11 aa, Artificial Sequence
  Description of Artificial Sequence: Synthetic peptide
  Seed: AQAPTTEEQEA (MAGA4_HUMAN)
ALAPTTEEQEF

SEQ ID NO: 63787 - protein, 10 aa, Artificial Sequence
  Description of Artificial Sequence: Synthetic peptide
  Seed: QIFPKTGLLI (MAGA4_HUMAN)
QYFPKTGLLL

SEQ ID NO: 63788 - protein, 10 aa, Artificial Sequence
  Description of Artificial Sequence: Synthetic peptide
  Seed: VDPASNTYTL (MAGA4_HUMAN)
VRPASNTYTY

SEQ ID NO: 63789 - protein, 10 aa, Artificial Sequence
  Description of Artificial Sequence: Synthetic peptide
  Seed: YPSLREAALL (MAGA4_HUMAN)
YHSLREAALF

SEQ ID NO: 63790 - protein, 9 aa, Artificial Sequence
  Description of Artificial Sequence: Synthetic peptide
  Seed: RQVPGSNPA (MAGA4_HUMAN)
RGVPGSNPY

SEQ ID NO: 63791 - protein, 9 aa, Artificial Sequence
  Description of Artificial Sequence: Synthetic peptide
  Seed: KVLEHVVRV (MAGA4_HUMAN)
KHLEHVVRF

SEQ ID NO: 63792 - protein, 10 aa, Artificial Sequence
  Description of Artificial Sequence: Synthetic peptide
  Seed: EHVVRVNARV (MAGA4_HUMAN)
ETVVRVNARI

SEQ ID NO: 63793 - protein, 9 aa, Artificial Sequence
  Description of Artificial Sequence: Synthetic peptide
  Seed: ALSNKVDEL (MAGA4_HUMAN)
AASNKVDEI

SEQ ID NO: 63794 - protein, 11 aa, Artificial Sequence
  Description of Artificial Sequence: Synthetic peptide
  Seed: KVDELAHFLLR (MAGA4_HUMAN)
KLDELAHFLLR

SEQ ID NO: 63795 - protein, 10 aa, Artificial Sequence
  Description of Artificial Sequence: Synthetic peptide
  Seed: SNKVDELAHF (MAGA4_HUMAN)
SQKVDELAHY

SEQ ID NO: 63796 - protein, 10 aa, Artificial Sequence
  Description of Artificial Sequence: Synthetic peptide
  Seed: KRCFPVIFGK (MAGA4_HUMAN)
KRCFPVIFGL

SEQ ID NO: 63797 - protein, 9 aa, Artificial Sequence
  Description of Artificial Sequence: Synthetic peptide
  Seed: EIWEELGVM (MAGA4_HUMAN)
EIWEELGVF

SEQ ID NO: 63798 - protein, 9 aa, Artificial Sequence
  Description of Artificial Sequence: Synthetic peptide
  Seed: SALPTTISF (MAGA4_HUMAN)
SALPTTISA

SEQ ID NO: 63799 - protein, 10 aa, Artificial Sequence
  Description of Artificial Sequence: Synthetic peptide
  Seed: ARVRIAYPSL (MAGA4_HUMAN)
ARVRIAYPSR

SEQ ID NO: 63800 - protein, 10 aa, Artificial Sequence
  Description of Artificial Sequence: Synthetic peptide
  Seed: YRQVPGSNPA (MAGA4_HUMAN)
YFQVPGSNPF

SEQ ID NO: 63801 - protein, 10 aa, Artificial Sequence
  Description of Artificial Sequence: Synthetic peptide
  Seed: SSSPLVPGTL (MAGA4_HUMAN)
SASPLVPGTY

SEQ ID NO: 63802 - protein, 10 aa, Artificial Sequence
  Description of Artificial Sequence: Synthetic peptide
  Seed: HFLLRKYRAK (MAGA4_HUMAN)
HYLLRKYRAR

SEQ ID NO: 63803 - protein, 10 aa, Artificial Sequence
  Description of Artificial Sequence: Synthetic peptide
  Seed: VDPASNTYTL (MAGA4_HUMAN)
VLPASNTYTY

SEQ ID NO: 63804 - protein, 8 aa, Artificial Sequence
  Description of Artificial Sequence: Synthetic peptide
  Seed: KVDELAHF (MAGA4_HUMAN)
KIDELAHM

SEQ ID NO: 63805 - protein, 9 aa, Artificial Sequence
  Description of Artificial Sequence: Synthetic peptide
  Seed: LVPGTLEEV (MAGA4_HUMAN)
LYPGTLEEL

SEQ ID NO: 63806 - protein, 9 aa, Artificial Sequence
  Description of Artificial Sequence: Synthetic peptide
  Seed: AAVSSSSPL (MAGA4_HUMAN)
AWVSSSSPM

SEQ ID NO: 63807 - protein, 9 aa, Artificial Sequence
  Description of Artificial Sequence: Synthetic peptide
  Seed: GKASESLKM (MAGA4_HUMAN)
GMASESLKY

SEQ ID NO: 63808 - protein, 9 aa, Artificial Sequence
  Description of Artificial Sequence: Synthetic peptide
  Seed: GASALPTTI (MAGA4_HUMAN)
GSSALPTTW

SEQ ID NO: 63809 - protein, 9 aa, Artificial Sequence
  Description of Artificial Sequence: Synthetic peptide
  Seed: VRIAYPSLR (MAGA4_HUMAN)
VRIAYPSLF

SEQ ID NO: 63810 - protein, 10 aa, Artificial Sequence
  Description of Artificial Sequence: Synthetic peptide
  Seed: GVYDGREHTV (MAGA4_HUMAN)
GIYDGREHTW

SEQ ID NO: 63811 - protein, 9 aa, Artificial Sequence
  Description of Artificial Sequence: Synthetic peptide
  Seed: RVRIAYPSL (MAGA4_HUMAN)
RHRIAYPSM

SEQ ID NO: 63812 - protein, 10 aa, Artificial Sequence
  Description of Artificial Sequence: Synthetic peptide
  Seed: GVYDGREHTV (MAGA4_HUMAN)
GQYDGREHTL

SEQ ID NO: 63813 - protein, 10 aa, Artificial Sequence
  Description of Artificial Sequence: Synthetic peptide
  Seed: EHVVRVNARV (MAGA4_HUMAN)
EKVVRVNARV

SEQ ID NO: 63814 - protein, 10 aa, Artificial Sequence
  Description of Artificial Sequence: Synthetic peptide
  Seed: TTISFTCWRQ (MAGA4_HUMAN)
TEISFTCWRR

SEQ ID NO: 63815 - protein, 9 aa, Artificial Sequence
  Description of Artificial Sequence: Synthetic peptide
  Seed: ALSNKVDEL (MAGA4_HUMAN)
AQSNKVDEI

SEQ ID NO: 63816 - protein, 10 aa, Artificial Sequence
  Description of Artificial Sequence: Synthetic peptide
  Seed: ARVRIAYPSL (MAGA4_HUMAN)
ASVRIAYPSV

SEQ ID NO: 63817 - protein, 9 aa, Artificial Sequence
  Description of Artificial Sequence: Synthetic peptide
  Seed: RCFPVIFGK (MAGA4_HUMAN)
RSFPVIFGR

SEQ ID NO: 63818 - protein, 9 aa, Artificial Sequence
  Description of Artificial Sequence: Synthetic peptide
  Seed: RVRIAYPSL (MAGA4_HUMAN)
RWRIAYPSL

SEQ ID NO: 63819 - protein, 10 aa, Artificial Sequence
  Description of Artificial Sequence: Synthetic peptide
  Seed: VIFGKASESL (MAGA4_HUMAN)
VTFGKASESV

SEQ ID NO: 63820 - protein, 9 aa, Artificial Sequence
  Description of Artificial Sequence: Synthetic peptide
  Seed: KVLEHVVRV (MAGA4_HUMAN)
KILEHVVRF

SEQ ID NO: 63821 - protein, 10 aa, Artificial Sequence
  Description of Artificial Sequence: Synthetic peptide
  Seed: TTISFTCWRQ (MAGA4_HUMAN)
TTISFTCWRF

SEQ ID NO: 63822 - protein, 10 aa, Artificial Sequence
  Description of Artificial Sequence: Synthetic peptide
  Seed: AQEEALGLVG (MAGA4_HUMAN)
AEEEALGLVM

SEQ ID NO: 63823 - protein, 10 aa, Artificial Sequence
  Description of Artificial Sequence: Synthetic peptide
  Seed: KVLEHVVRVN (MAGA4_HUMAN)
KMLEHVVRVI

SEQ ID NO: 63824 - protein, 10 aa, Artificial Sequence
  Description of Artificial Sequence: Synthetic peptide
  Seed: KNYKRCFPVI (MAGA4_HUMAN)
KTYKRCFPVA

SEQ ID NO: 63825 - protein, 9 aa, Artificial Sequence
  Description of Artificial Sequence: Synthetic peptide
  Seed: RVRIAYPSL (MAGA4_HUMAN)
RVRIAYPSW

SEQ ID NO: 63826 - protein, 9 aa, Artificial Sequence
  Description of Artificial Sequence: Synthetic peptide
  Seed: GVYDGREHT (MAGA4_HUMAN)
GVYDGREHA

SEQ ID NO: 63827 - protein, 11 aa, Artificial Sequence
  Description of Artificial Sequence: Synthetic peptide
  Seed: QEAAVSSSSPL (MAGA4_HUMAN)
QEAAVSSSSPW

SEQ ID NO: 63828 - protein, 10 aa, Artificial Sequence
  Description of Artificial Sequence: Synthetic peptide
  Seed: KVDELAHFLL (MAGA4_HUMAN)
KLDELAHFLI

SEQ ID NO: 63829 - protein, 9 aa, Artificial Sequence
  Description of Artificial Sequence: Synthetic peptide
  Seed: IIVLGTIAM (MAGA4_HUMAN)
IFVLGTIAF

SEQ ID NO: 63830 - protein, 9 aa, Artificial Sequence
  Description of Artificial Sequence: Synthetic peptide
  Seed: SALPTTISF (MAGA4_HUMAN)
SDLPTTISL

SEQ ID NO: 63831 - protein, 10 aa, Artificial Sequence
  Description of Artificial Sequence: Synthetic peptide
  Seed: ARVRIAYPSL (MAGA4_HUMAN)
APVRIAYPSA

SEQ ID NO: 63832 - protein, 9 aa, Artificial Sequence
  Description of Artificial Sequence: Synthetic peptide
  Seed: LLIIVLGTI (MAGA4_HUMAN)
LLIIVLGTV

SEQ ID NO: 63833 - protein, 9 aa, Artificial Sequence
  Description of Artificial Sequence: Synthetic peptide
  Seed: KVLEHVVRV (MAGA4_HUMAN)
KSLEHVVRF

SEQ ID NO: 63834 - protein, 9 aa, Artificial Sequence
  Description of Artificial Sequence: Synthetic peptide
  Seed: FPVIFGKAS (MAGA4_HUMAN)
FPVIFGKAP

SEQ ID NO: 63835 - protein, 10 aa, Artificial Sequence
  Description of Artificial Sequence: Synthetic peptide
  Seed: KRCFPVIFGK (MAGA4_HUMAN)
KFCFPVIFGK

SEQ ID NO: 63836 - protein, 9 aa, Artificial Sequence
  Description of Artificial Sequence: Synthetic peptide
  Seed: QIFPKTGLL (MAGA4_HUMAN)
QTFPKTGLL

SEQ ID NO: 63837 - protein, 10 aa, Artificial Sequence
  Description of Artificial Sequence: Synthetic peptide
  Seed: VIFGKASESL (MAGA4_HUMAN)
VIFGKASESV

SEQ ID NO: 63838 - protein, 9 aa, Artificial Sequence
  Description of Artificial Sequence: Synthetic peptide
  Seed: KVDELAHFL (MAGA4_HUMAN)
KIDELAHFF

SEQ ID NO: 63839 - protein, 9 aa, Artificial Sequence
  Description of Artificial Sequence: Synthetic peptide
  Seed: DPASNTYTL (MAGA4_HUMAN)
DVASNTYTF

SEQ ID NO: 63840 - protein, 9 aa, Artificial Sequence
  Description of Artificial Sequence: Synthetic peptide
  Seed: ELAHFLLRK (MAGA4_HUMAN)
EQAHFLLRR

SEQ ID NO: 63841 - protein, 10 aa, Artificial Sequence
  Description of Artificial Sequence: Synthetic peptide
  Seed: EHVVRVNARV (MAGA4_HUMAN)
EAVVRVNARV

SEQ ID NO: 63842 - protein, 9 aa, Artificial Sequence
  Description of Artificial Sequence: Synthetic peptide
  Seed: DPASNTYTL (MAGA4_HUMAN)
DIASNTYTF

SEQ ID NO: 63843 - protein, 10 aa, Artificial Sequence
  Description of Artificial Sequence: Synthetic peptide
  Seed: EHVVRVNARV (MAGA4_HUMAN)
EWVVRVNARV

SEQ ID NO: 63844 - protein, 10 aa, Artificial Sequence
  Description of Artificial Sequence: Synthetic peptide
  Seed: KVDELAHFLL (MAGA4_HUMAN)
KVDELAHFLV

SEQ ID NO: 63845 - protein, 10 aa, Artificial Sequence
  Description of Artificial Sequence: Synthetic peptide
  Seed: KNYKRCFPVI (MAGA4_HUMAN)
KWYKRCFPVF

SEQ ID NO: 63846 - protein, 9 aa, Artificial Sequence
  Description of Artificial Sequence: Synthetic peptide
  Seed: KVLEHVVRV (MAGA4_HUMAN)
KILEHVVRW

SEQ ID NO: 63847 - protein, 9 aa, Artificial Sequence
  Description of Artificial Sequence: Synthetic peptide
  Seed: IAYPSLREA (MAGA4_HUMAN)
ISYPSLREI

SEQ ID NO: 63848 - protein, 10 aa, Artificial Sequence
  Description of Artificial Sequence: Synthetic peptide
  Seed: GVYDGREHTV (MAGA4_HUMAN)
GLYDGREHTY

SEQ ID NO: 63849 - protein, 9 aa, Artificial Sequence
  Description of Artificial Sequence: Synthetic peptide
  Seed: SYVKVLEHV (MAGA4_HUMAN)
SFVKVLEHW

SEQ ID NO: 63850 - protein, 8 aa, Artificial Sequence
  Description of Artificial Sequence: Synthetic peptide
  Seed: FGIDVKEV (MAGA4_HUMAN)
FSIDVKEL

SEQ ID NO: 63851 - protein, 9 aa, Artificial Sequence
  Description of Artificial Sequence: Synthetic peptide
  Seed: SALPTTISF (MAGA4_HUMAN)
SWLPTTISY

SEQ ID NO: 63852 - protein, 11 aa, Artificial Sequence
  Description of Artificial Sequence: Synthetic peptide
  Seed: YVKVLEHVVRV (MAGA4_HUMAN)
YRKVLEHVVRV

SEQ ID NO: 63853 - protein, 9 aa, Artificial Sequence
  Description of Artificial Sequence: Synthetic peptide
  Seed: RAKELVTKA (MAGA4_HUMAN)
RVKELVTKK

SEQ ID NO: 63854 - protein, 9 aa, Artificial Sequence
  Description of Artificial Sequence: Synthetic peptide
  Seed: RVRIAYPSL (MAGA4_HUMAN)
RFRIAYPSY

SEQ ID NO: 63855 - protein, 9 aa, Artificial Sequence
  Description of Artificial Sequence: Synthetic peptide
  Seed: TVYGEPRKL (MAGA4_HUMAN)
TQYGEPRKI

SEQ ID NO: 63856 - protein, 9 aa, Artificial Sequence
  Description of Artificial Sequence: Synthetic peptide
  Seed: SALPTTISF (MAGA4_HUMAN)
SPLPTTISH

SEQ ID NO: 63857 - protein, 10 aa, Artificial Sequence
  Description of Artificial Sequence: Synthetic peptide
  Seed: TTISFTCWRQ (MAGA4_HUMAN)
TTISFTCWRR

SEQ ID NO: 63858 - protein, 9 aa, Artificial Sequence
  Description of Artificial Sequence: Synthetic peptide
  Seed: KVDELAHFL (MAGA4_HUMAN)
KRDELAHFF

SEQ ID NO: 63859 - protein, 10 aa, Artificial Sequence
  Description of Artificial Sequence: Synthetic peptide
  Seed: AYPSLREAAL (MAGA4_HUMAN)
ASPSLREAAL

SEQ ID NO: 63860 - protein, 10 aa, Artificial Sequence
  Description of Artificial Sequence: Synthetic peptide
  Seed: TSPDAESLFR (MAGA4_HUMAN)
TYPDAESLFR

SEQ ID NO: 63861 - protein, 9 aa, Artificial Sequence
  Description of Artificial Sequence: Synthetic peptide
  Seed: EIWEELGVM (MAGA4_HUMAN)
EQWEELGVY

SEQ ID NO: 63862 - protein, 10 aa, Artificial Sequence
  Description of Artificial Sequence: Synthetic peptide
  Seed: AYPSLREAAL (MAGA4_HUMAN)
ALPSLREAAL

SEQ ID NO: 63863 - protein, 9 aa, Artificial Sequence
  Description of Artificial Sequence: Synthetic peptide
  Seed: SSSPLVPGT (MAGA4_HUMAN)
SSSPLVPGA

SEQ ID NO: 63864 - protein, 11 aa, Artificial Sequence
  Description of Artificial Sequence: Synthetic peptide
  Seed: LTQDWVQENYL (MAGA4_HUMAN)
LTQDWVQENYW

SEQ ID NO: 63865 - protein, 9 aa, Artificial Sequence
  Description of Artificial Sequence: Synthetic peptide
  Seed: GLLGNNQIF (MAGA4_HUMAN)
GLLGNNQIY

SEQ ID NO: 63866 - protein, 9 aa, Artificial Sequence
  Description of Artificial Sequence: Synthetic peptide
  Seed: RAKELVTKA (MAGA4_HUMAN)
RVKELVTKY

SEQ ID NO: 63867 - protein, 10 aa, Artificial Sequence
  Description of Artificial Sequence: Synthetic peptide
  Seed: LIIVLGTIAM (MAGA4_HUMAN)
LQIVLGTIAF

SEQ ID NO: 63868 - protein, 10 aa, Artificial Sequence
  Description of Artificial Sequence: Synthetic peptide
  Seed: YRQVPGSNPA (MAGA4_HUMAN)
YSQVPGSNPM

SEQ ID NO: 63869 - protein, 9 aa, Artificial Sequence
  Description of Artificial Sequence: Synthetic peptide
  Seed: TQDWVQENY (MAGA4_HUMAN)
TLDWVQENY

SEQ ID NO: 63870 - protein, 9 aa, Artificial Sequence
  Description of Artificial Sequence: Synthetic peptide
  Seed: STSPDAESL (MAGA4_HUMAN)
STSPDAESY

SEQ ID NO: 63871 - protein, 10 aa, Artificial Sequence
  Description of Artificial Sequence: Synthetic peptide
  Seed: RQVPGSNPAR (MAGA4_HUMAN)
RQVPGSNPAM

SEQ ID NO: 63872 - protein, 10 aa, Artificial Sequence
  Description of Artificial Sequence: Synthetic peptide
  Seed: KASESLKMIF (MAGA4_HUMAN)
KLSESLKMIY

SEQ ID NO: 63873 - protein, 9 aa, Artificial Sequence
  Description of Artificial Sequence: Synthetic peptide
  Seed: KVLEHVVRV (MAGA4_HUMAN)
KNLEHVVRY

SEQ ID NO: 63874 - protein, 9 aa, Artificial Sequence
  Description of Artificial Sequence: Synthetic peptide
  Seed: QIFPKTGLL (MAGA4_HUMAN)
QMFPKTGLR

SEQ ID NO: 63875 - protein, 9 aa, Artificial Sequence
  Description of Artificial Sequence: Synthetic peptide
  Seed: STSPDAESL (MAGA4_HUMAN)
SLSPDAESY

SEQ ID NO: 63876 - protein, 10 aa, Artificial Sequence
  Description of Artificial Sequence: Synthetic peptide
  Seed: RVRIAYPSLR (MAGA4_HUMAN)
RKRIAYPSLM

SEQ ID NO: 63877 - protein, 9 aa, Artificial Sequence
  Description of Artificial Sequence: Synthetic peptide
  Seed: LGNNQIFPK (MAGA4_HUMAN)
LMNNQIFPR

SEQ ID NO: 63878 - protein, 9 aa, Artificial Sequence
  Description of Artificial Sequence: Synthetic peptide
  Seed: KVDELAHFL (MAGA4_HUMAN)
KVDELAHFW

SEQ ID NO: 63879 - protein, 9 aa, Artificial Sequence
  Description of Artificial Sequence: Synthetic peptide
  Seed: AHFLLRKYR (MAGA4_HUMAN)
AYFLLRKYK

SEQ ID NO: 63880 - protein, 10 aa, Artificial Sequence
  Description of Artificial Sequence: Synthetic peptide
  Seed: RVRIAYPSLR (MAGA4_HUMAN)
RVRIAYPSLN

SEQ ID NO: 63881 - protein, 10 aa, Artificial Sequence
  Description of Artificial Sequence: Synthetic peptide
  Seed: KNYKRCFPVI (MAGA4_HUMAN)
KSYKRCFPVM

SEQ ID NO: 63882 - protein, 11 aa, Artificial Sequence
  Description of Artificial Sequence: Synthetic peptide
  Seed: RVNARVRIAYP (MAGA4_HUMAN)
RTNARVRIAYV

SEQ ID NO: 63883 - protein, 9 aa, Artificial Sequence
  Description of Artificial Sequence: Synthetic peptide
  Seed: RVRIAYPSL (MAGA4_HUMAN)
RIRIAYPST

SEQ ID NO: 63884 - protein, 9 aa, Artificial Sequence
  Description of Artificial Sequence: Synthetic peptide
  Seed: DELAHFLLR (MAGA4_HUMAN)
DMLAHFLLK

SEQ ID NO: 63885 - protein, 11 aa, Artificial Sequence
  Description of Artificial Sequence: Synthetic peptide
  Seed: KVDELAHFLLR (MAGA4_HUMAN)
KTDELAHFLLR

SEQ ID NO: 63886 - protein, 11 aa, Artificial Sequence
  Description of Artificial Sequence: Synthetic peptide
  Seed: ELGVMGVYDGR (MAGA4_HUMAN)
ECGVMGVYDGR

SEQ ID NO: 63887 - protein, 9 aa, Artificial Sequence
  Description of Artificial Sequence: Synthetic peptide
  Seed: YKRCFPVIF (MAGA4_HUMAN)
YQRCFPVIH

SEQ ID NO: 63888 - protein, 9 aa, Artificial Sequence
  Description of Artificial Sequence: Synthetic peptide
  Seed: VYDGREHTV (MAGA4_HUMAN)
VLDGREHTV

SEQ ID NO: 63889 - protein, 10 aa, Artificial Sequence
  Description of Artificial Sequence: Synthetic peptide
  Seed: TSPDAESLFR (MAGA4_HUMAN)
TVPDAESLFY

SEQ ID NO: 63890 - protein, 10 aa, Artificial Sequence
  Description of Artificial Sequence: Synthetic peptide
  Seed: YRQVPGSNPA (MAGA4_HUMAN)
YRQVPGSNPW

SEQ ID NO: 63891 - protein, 10 aa, Artificial Sequence
  Description of Artificial Sequence: Synthetic peptide
  Seed: KEVDPASNTY (MAGA4_HUMAN)
KLVDPASNTM

SEQ ID NO: 63892 - protein, 8 aa, Artificial Sequence
  Description of Artificial Sequence: Synthetic peptide
  Seed: VYGEPRKL (MAGA4_HUMAN)
VAGEPRKF

SEQ ID NO: 63893 - protein, 10 aa, Artificial Sequence
  Description of Artificial Sequence: Synthetic peptide
  Seed: TSYVKVLEHV (MAGA4_HUMAN)
TYYVKVLEHM

SEQ ID NO: 63894 - protein, 9 aa, Artificial Sequence
  Description of Artificial Sequence: Synthetic peptide
  Seed: FPKTGLLII (MAGA4_HUMAN)
FPKTGLLIL

SEQ ID NO: 63895 - protein, 9 aa, Artificial Sequence
  Description of Artificial Sequence: Synthetic peptide
  Seed: EEVPAAESA (MAGA4_HUMAN)
EQVPAAESW

SEQ ID NO: 63896 - protein, 9 aa, Artificial Sequence
  Description of Artificial Sequence: Synthetic peptide
  Seed: TQDWVQENY (MAGA4_HUMAN)
TMDWVQENL

SEQ ID NO: 63897 - protein, 10 aa, Artificial Sequence
  Description of Artificial Sequence: Synthetic peptide
  Seed: LLGNNQIFPK (MAGA4_HUMAN)
LSGNNQIFPR

SEQ ID NO: 63898 - protein, 9 aa, Artificial Sequence
  Description of Artificial Sequence: Synthetic peptide
  Seed: YDGREHTVY (MAGA4_HUMAN)
YQGREHTVY

SEQ ID NO: 63899 - protein, 9 aa, Artificial Sequence
  Description of Artificial Sequence: Synthetic peptide
  Seed: GSNPARYEF (MAGA4_HUMAN)
GQNPARYEW

SEQ ID NO: 63900 - protein, 9 aa, Artificial Sequence
  Description of Artificial Sequence: Synthetic peptide
  Seed: DPASNTYTL (MAGA4_HUMAN)
DTASNTYTY

SEQ ID NO: 63901 - protein, 9 aa, Artificial Sequence
  Description of Artificial Sequence: Synthetic peptide
  Seed: VRIAYPSLR (MAGA4_HUMAN)
VTIAYPSLR

SEQ ID NO: 63902 - protein, 9 aa, Artificial Sequence
  Description of Artificial Sequence: Synthetic peptide
  Seed: LVPGTLEEV (MAGA4_HUMAN)
LMPGTLEEA

SEQ ID NO: 63903 - protein, 9 aa, Artificial Sequence
  Description of Artificial Sequence: Synthetic peptide
  Seed: EVDPASNTY (MAGA4_HUMAN)
EVDPASNTI

SEQ ID NO: 63904 - protein, 9 aa, Artificial Sequence
  Description of Artificial Sequence: Synthetic peptide
  Seed: KVDELAHFL (MAGA4_HUMAN)
KLDELAHFW

SEQ ID NO: 63905 - protein, 9 aa, Artificial Sequence
  Description of Artificial Sequence: Synthetic peptide
  Seed: RAKELVTKA (MAGA4_HUMAN)
RTKELVTKY

SEQ ID NO: 63906 - protein, 9 aa, Artificial Sequence
  Description of Artificial Sequence: Synthetic peptide
  Seed: LVPGTLEEV (MAGA4_HUMAN)
LWPGTLEEL

SEQ ID NO: 63907 - protein, 9 aa, Artificial Sequence
  Description of Artificial Sequence: Synthetic peptide
  Seed: KELVTKAEM (MAGA4_HUMAN)
KVLVTKAEY

SEQ ID NO: 63908 - protein, 9 aa, Artificial Sequence
  Description of Artificial Sequence: Synthetic peptide
  Seed: KNYKRCFPV (MAGA4_HUMAN)
KTYKRCFPI

SEQ ID NO: 63909 - protein, 9 aa, Artificial Sequence
  Description of Artificial Sequence: Synthetic peptide
  Seed: HVVRVNARV (MAGA4_HUMAN)
HMVRVNARL

SEQ ID NO: 63910 - protein, 10 aa, Artificial Sequence
  Description of Artificial Sequence: Synthetic peptide
  Seed: YRQVPGSNPA (MAGA4_HUMAN)
YIQVPGSNPF

SEQ ID NO: 63911 - protein, 10 aa, Artificial Sequence
  Description of Artificial Sequence: Synthetic peptide
  Seed: GLLIIVLGTI (MAGA4_HUMAN)
GGLIIVLGTV

SEQ ID NO: 63912 - protein, 9 aa, Artificial Sequence
  Description of Artificial Sequence: Synthetic peptide
  Seed: RVRIAYPSL (MAGA4_HUMAN)
RSRIAYPST

SEQ ID NO: 63913 - protein, 9 aa, Artificial Sequence
  Description of Artificial Sequence: Synthetic peptide
  Seed: KVDELAHFL (MAGA4_HUMAN)
KNDELAHFY

SEQ ID NO: 63914 - protein, 9 aa, Artificial Sequence
  Description of Artificial Sequence: Synthetic peptide
  Seed: KVLEHVVRV (MAGA4_HUMAN)
KLLEHVVRW

SEQ ID NO: 63915 - protein, 10 aa, Artificial Sequence
  Description of Artificial Sequence: Synthetic peptide
  Seed: YPSLREAALL (MAGA4_HUMAN)
YDSLREAALW

SEQ ID NO: 63916 - protein, 10 aa, Artificial Sequence
  Description of Artificial Sequence: Synthetic peptide
  Seed: KVLEHVVRVN (MAGA4_HUMAN)
KLLEHVVRVN

SEQ ID NO: 63917 - protein, 10 aa, Artificial Sequence
  Description of Artificial Sequence: Synthetic peptide
  Seed: KEVDPASNTY (MAGA4_HUMAN)
KFVDPASNTF

SEQ ID NO: 63918 - protein, 9 aa, Artificial Sequence
  Description of Artificial Sequence: Synthetic peptide
  Seed: RVNARVRIA (MAGA4_HUMAN)
RVNARVRIS

SEQ ID NO: 63919 - protein, 9 aa, Artificial Sequence
  Description of Artificial Sequence: Synthetic peptide
  Seed: KYRAKELVT (MAGA4_HUMAN)
KYRAKELVV

SEQ ID NO: 63920 - protein, 11 aa, Artificial Sequence
  Description of Artificial Sequence: Synthetic peptide
  Seed: SPQGASALPTT (MAGA4_HUMAN)
SPQGASALPTF

SEQ ID NO: 63921 - protein, 9 aa, Artificial Sequence
  Description of Artificial Sequence: Synthetic peptide
  Seed: EVDPASNTY (MAGA4_HUMAN)
ELDPASNTI

SEQ ID NO: 63922 - protein, 9 aa, Artificial Sequence
  Description of Artificial Sequence: Synthetic peptide
  Seed: STSPDAESL (MAGA4_HUMAN)
SFSPDAESF

SEQ ID NO: 63923 - protein, 10 aa, Artificial Sequence
  Description of Artificial Sequence: Synthetic peptide
  Seed: TLVTCLGLSY (MAGA4_HUMAN)
TQVTCLGLSY

SEQ ID NO: 63924 - protein, 9 aa, Artificial Sequence
  Description of Artificial Sequence: Synthetic peptide
  Seed: KASESLKMI (MAGA4_HUMAN)
KCSESLKMW

SEQ ID NO: 63925 - protein, 9 aa, Artificial Sequence
  Description of Artificial Sequence: Synthetic peptide
  Seed: AAVSSSSPL (MAGA4_HUMAN)
APVSSSSPA

SEQ ID NO: 63926 - protein, 9 aa, Artificial Sequence
  Description of Artificial Sequence: Synthetic peptide
  Seed: KVDELAHFL (MAGA4_HUMAN)
KGDELAHFF

SEQ ID NO: 63927 - protein, 9 aa, Artificial Sequence
  Description of Artificial Sequence: Synthetic peptide
  Seed: AESAGPPQS (MAGA4_HUMAN)
AESAGPPQP

SEQ ID NO: 63928 - protein, 9 aa, Artificial Sequence
  Description of Artificial Sequence: Synthetic peptide
  Seed: QVPGSNPAR (MAGA4_HUMAN)
QAPGSNPAM

SEQ ID NO: 63929 - protein, 11 aa, Artificial Sequence
  Description of Artificial Sequence: Synthetic peptide
  Seed: REALSNKVDEL (MAGA4_HUMAN)
RQALSNKVDEI

SEQ ID NO: 63930 - protein, 10 aa, Artificial Sequence
  Description of Artificial Sequence: Synthetic peptide
  Seed: FGKASESLKM (MAGA4_HUMAN)
FQKASESLKY

SEQ ID NO: 63931 - protein, 10 aa, Artificial Sequence
  Description of Artificial Sequence: Synthetic peptide
  Seed: TYTLVTCLGL (MAGA4_HUMAN)
TWTLVTCLGF

SEQ ID NO: 63932 - protein, 9 aa, Artificial Sequence
  Description of Artificial Sequence: Synthetic peptide
  Seed: RVRIAYPSL (MAGA4_HUMAN)
RMRIAYPSY

SEQ ID NO: 63933 - protein, 11 aa, Artificial Sequence
  Description of Artificial Sequence: Synthetic peptide
  Seed: EVDPASNTYTL (MAGA4_HUMAN)
EVDPASNTYTV

SEQ ID NO: 63934 - protein, 10 aa, Artificial Sequence
  Description of Artificial Sequence: Synthetic peptide
  Seed: ASALPTTISF (MAGA4_HUMAN)
AKALPTTISY

SEQ ID NO: 63935 - protein, 9 aa, Artificial Sequence
  Description of Artificial Sequence: Synthetic peptide
  Seed: IFPKTGLLI (MAGA4_HUMAN)
IIPKTGLLI

SEQ ID NO: 63936 - protein, 10 aa, Artificial Sequence
  Description of Artificial Sequence: Synthetic peptide
  Seed: KVDELAHFLL (MAGA4_HUMAN)
KQDELAHFLY

SEQ ID NO: 63937 - protein, 10 aa, Artificial Sequence
  Description of Artificial Sequence: Synthetic peptide
  Seed: TTISFTCWRQ (MAGA4_HUMAN)
TTISFTCWRI

SEQ ID NO: 63938 - protein, 9 aa, Artificial Sequence
  Description of Artificial Sequence: Synthetic peptide
  Seed: ARVRIAYPS (MAGA4_HUMAN)
ARVRIAYPY

SEQ ID NO: 63939 - protein, 9 aa, Artificial Sequence
  Description of Artificial Sequence: Synthetic peptide
  Seed: EVDPASNTY (MAGA4_HUMAN)
EGDPASNTM

SEQ ID NO: 63940 - protein, 9 aa, Artificial Sequence
  Description of Artificial Sequence: Synthetic peptide
  Seed: KVDELAHFL (MAGA4_HUMAN)
KMDELAHFF

SEQ ID NO: 63941 - protein, 10 aa, Artificial Sequence
  Description of Artificial Sequence: Synthetic peptide
  Seed: YPSLREAALL (MAGA4_HUMAN)
YMSLREAALW

SEQ ID NO: 63942 - protein, 9 aa, Artificial Sequence
  Description of Artificial Sequence: Synthetic peptide
  Seed: LVPGTLEEV (MAGA4_HUMAN)
LVPGTLEEI

SEQ ID NO: 63943 - protein, 9 aa, Artificial Sequence
  Description of Artificial Sequence: Synthetic peptide
  Seed: GASALPTTI (MAGA4_HUMAN)
GASALPTTW

SEQ ID NO: 63944 - protein, 9 aa, Artificial Sequence
  Description of Artificial Sequence: Synthetic peptide
  Seed: IAYPSLREA (MAGA4_HUMAN)
ITYPSLREA

SEQ ID NO: 63945 - protein, 9 aa, Artificial Sequence
  Description of Artificial Sequence: Synthetic peptide
  Seed: RAKELVTKA (MAGA4_HUMAN)
RQKELVTKY

SEQ ID NO: 63946 - protein, 9 aa, Artificial Sequence
  Description of Artificial Sequence: Synthetic peptide
  Seed: SALPTTISF (MAGA4_HUMAN)
SMLPTTISK

SEQ ID NO: 63947 - protein, 11 aa, Artificial Sequence
  Description of Artificial Sequence: Synthetic peptide
  Seed: REALSNKVDEL (MAGA4_HUMAN)
RLALSNKVDEF

SEQ ID NO: 63948 - protein, 10 aa, Artificial Sequence
  Description of Artificial Sequence: Synthetic peptide
  Seed: QIFPKTGLLI (MAGA4_HUMAN)
QQFPKTGLLV

SEQ ID NO: 63949 - protein, 9 aa, Artificial Sequence
  Description of Artificial Sequence: Synthetic peptide
  Seed: FPKTGLLII (MAGA4_HUMAN)
FHKTGLLIA

SEQ ID NO: 63950 - protein, 9 aa, Artificial Sequence
  Description of Artificial Sequence: Synthetic peptide
  Seed: YDGREHTVY (MAGA4_HUMAN)
YIGREHTVF

SEQ ID NO: 63951 - protein, 9 aa, Artificial Sequence
  Description of Artificial Sequence: Synthetic peptide
  Seed: NKVDELAHF (MAGA4_HUMAN)
NQVDELAHL

SEQ ID NO: 63952 - protein, 10 aa, Artificial Sequence
  Description of Artificial Sequence: Synthetic peptide
  Seed: RVIKNYKRCF (MAGA4_HUMAN)
RMIKNYKRCY

SEQ ID NO: 63953 - protein, 9 aa, Artificial Sequence
  Description of Artificial Sequence: Synthetic peptide
  Seed: EEQEAAVSS (MAGA4_HUMAN)
EEQEAAVSP

SEQ ID NO: 63954 - protein, 10 aa, Artificial Sequence
  Description of Artificial Sequence: Synthetic peptide
  Seed: KRCFPVIFGK (MAGA4_HUMAN)
KWCFPVIFGK

SEQ ID NO: 63955 - protein, 10 aa, Artificial Sequence
  Description of Artificial Sequence: Synthetic peptide
  Seed: EAAVSSSSPL (MAGA4_HUMAN)
EGAVSSSSPV

SEQ ID NO: 63956 - protein, 9 aa, Artificial Sequence
  Description of Artificial Sequence: Synthetic peptide
  Seed: WVQENYLEY (MAGA4_HUMAN)
WVQENYLEM

SEQ ID NO: 63957 - protein, 9 aa, Artificial Sequence
  Description of Artificial Sequence: Synthetic peptide
  Seed: NPARYEFLW (MAGA4_HUMAN)
NVARYEFLW

SEQ ID NO: 63958 - protein, 10 aa, Artificial Sequence
  Description of Artificial Sequence: Synthetic peptide
  Seed: LIIVLGTIAM (MAGA4_HUMAN)
LIIVLGTIAY

SEQ ID NO: 63959 - protein, 9 aa, Artificial Sequence
  Description of Artificial Sequence: Synthetic peptide
  Seed: SYVKVLEHV (MAGA4_HUMAN)
SIVKVLEHY

SEQ ID NO: 63960 - protein, 9 aa, Artificial Sequence
  Description of Artificial Sequence: Synthetic peptide
  Seed: EEIWEELGV (MAGA4_HUMAN)
EEIWEELGL

SEQ ID NO: 63961 - protein, 10 aa, Artificial Sequence
  Description of Artificial Sequence: Synthetic peptide
  Seed: GVYDGREHTV (MAGA4_HUMAN)
GIYDGREHTR

SEQ ID NO: 63962 - protein, 11 aa, Artificial Sequence
  Description of Artificial Sequence: Synthetic peptide
  Seed: YVKVLEHVVRV (MAGA4_HUMAN)
YTKVLEHVVRV

SEQ ID NO: 63963 - protein, 9 aa, Artificial Sequence
  Description of Artificial Sequence: Synthetic peptide
  Seed: SALPTTISF (MAGA4_HUMAN)
STLPTTISW

SEQ ID NO: 63964 - protein, 10 aa, Artificial Sequence
  Description of Artificial Sequence: Synthetic peptide
  Seed: RVRIAYPSLR (MAGA4_HUMAN)
RFRIAYPSLG

SEQ ID NO: 63965 - protein, 10 aa, Artificial Sequence
  Description of Artificial Sequence: Synthetic peptide
  Seed: HFLLRKYRAK (MAGA4_HUMAN)
HFLLRKYRAR

SEQ ID NO: 63966 - protein, 10 aa, Artificial Sequence
  Description of Artificial Sequence: Synthetic peptide
  Seed: TSYVKVLEHV (MAGA4_HUMAN)
TDYVKVLEHL

SEQ ID NO: 63967 - protein, 9 aa, Artificial Sequence
  Description of Artificial Sequence: Synthetic peptide
  Seed: SYVKVLEHV (MAGA4_HUMAN)
SIVKVLEHV

SEQ ID NO: 63968 - protein, 9 aa, Artificial Sequence
  Description of Artificial Sequence: Synthetic peptide
  Seed: EHVVRVNAR (MAGA4_HUMAN)
EWVVRVNAR

SEQ ID NO: 63969 - protein, 9 aa, Artificial Sequence
  Description of Artificial Sequence: Synthetic peptide
  Seed: LVPGTLEEV (MAGA4_HUMAN)
LVPGTLEEM

SEQ ID NO: 63970 - protein, 9 aa, Artificial Sequence
  Description of Artificial Sequence: Synthetic peptide
  Seed: RKYRAKELV (MAGA4_HUMAN)
RNYRAKELY

SEQ ID NO: 63971 - protein, 9 aa, Artificial Sequence
  Description of Artificial Sequence: Synthetic peptide
  Seed: TVYGEPRKL (MAGA4_HUMAN)
TTYGEPRKW

SEQ ID NO: 63972 - protein, 9 aa, Artificial Sequence
  Description of Artificial Sequence: Synthetic peptide
  Seed: ALSNKVDEL (MAGA4_HUMAN)
ATSNKVDEV

SEQ ID NO: 63973 - protein, 10 aa, Artificial Sequence
  Description of Artificial Sequence: Synthetic peptide
  Seed: EMLERVIKNY (MAGA4_HUMAN)
ETLERVIKNK

SEQ ID NO: 63974 - protein, 9 aa, Artificial Sequence
  Description of Artificial Sequence: Synthetic peptide
  Seed: SSPLVPGTL (MAGA4_HUMAN)
SGPLVPGTM

SEQ ID NO: 63975 - protein, 9 aa, Artificial Sequence
  Description of Artificial Sequence: Synthetic peptide
  Seed: RVRIAYPSL (MAGA4_HUMAN)
RLRIAYPSL

SEQ ID NO: 63976 - protein, 9 aa, Artificial Sequence
  Description of Artificial Sequence: Synthetic peptide
  Seed: ALLEEEEGV (MAGA4_HUMAN)
AMLEEEEGV

SEQ ID NO: 63977 - protein, 9 aa, Artificial Sequence
  Description of Artificial Sequence: Synthetic peptide
  Seed: HVVRVNARV (MAGA4_HUMAN)
HQVRVNARL

SEQ ID NO: 63978 - protein, 10 aa, Artificial Sequence
  Description of Artificial Sequence: Synthetic peptide
  Seed: KNYKRCFPVI (MAGA4_HUMAN)
KRYKRCFPVF

SEQ ID NO: 63979 - protein, 9 aa, Artificial Sequence
  Description of Artificial Sequence: Synthetic peptide
  Seed: LFREALSNK (MAGA4_HUMAN)
LFREALSNR

SEQ ID NO: 63980 - protein, 9 aa, Artificial Sequence
  Description of Artificial Sequence: Synthetic peptide
  Seed: MSSEQKSQH (MAGA4_HUMAN)
MVSEQKSQM

SEQ ID NO: 63981 - protein, 9 aa, Artificial Sequence
  Description of Artificial Sequence: Synthetic peptide
  Seed: KVDELAHFL (MAGA4_HUMAN)
KYDELAHFI

SEQ ID NO: 63982 - protein, 9 aa, Artificial Sequence
  Description of Artificial Sequence: Synthetic peptide
  Seed: TVYGEPRKL (MAGA4_HUMAN)
TFYGEPRKV

SEQ ID NO: 63983 - protein, 10 aa, Artificial Sequence
  Description of Artificial Sequence: Synthetic peptide
  Seed: SLFREALSNK (MAGA4_HUMAN)
SPFREALSNR

SEQ ID NO: 63984 - protein, 9 aa, Artificial Sequence
  Description of Artificial Sequence: Synthetic peptide
  Seed: KVLEHVVRV (MAGA4_HUMAN)
KILEHVVRV

SEQ ID NO: 63985 - protein, 9 aa, Artificial Sequence
  Description of Artificial Sequence: Synthetic peptide
  Seed: KEVDPASNT (MAGA4_HUMAN)
KEVDPASNP

SEQ ID NO: 63986 - protein, 9 aa, Artificial Sequence
  Description of Artificial Sequence: Synthetic peptide
  Seed: KASESLKMI (MAGA4_HUMAN)
KASESLKMY

SEQ ID NO: 63987 - protein, 10 aa, Artificial Sequence
  Description of Artificial Sequence: Synthetic peptide
  Seed: LLGNNQIFPK (MAGA4_HUMAN)
LIGNNQIFPK

SEQ ID NO: 63988 - protein, 9 aa, Artificial Sequence
  Description of Artificial Sequence: Synthetic peptide
  Seed: EVDPASNTY (MAGA4_HUMAN)
ETDPASNTV

SEQ ID NO: 63989 - protein, 8 aa, Artificial Sequence
  Description of Artificial Sequence: Synthetic peptide
  Seed: SAGPPQSP (MAGA4_HUMAN)
SAGPPQSY

SEQ ID NO: 63990 - protein, 10 aa, Artificial Sequence
  Description of Artificial Sequence: Synthetic peptide
  Seed: ASALPTTISF (MAGA4_HUMAN)
AHALPTTISF

SEQ ID NO: 63991 - protein, 10 aa, Artificial Sequence
  Description of Artificial Sequence: Synthetic peptide
  Seed: KASESLKMIF (MAGA4_HUMAN)
KASESLKMIW

SEQ ID NO: 63992 - protein, 9 aa, Artificial Sequence
  Description of Artificial Sequence: Synthetic peptide
  Seed: LFREALSNK (MAGA4_HUMAN)
LSREALSNR

SEQ ID NO: 63993 - protein, 9 aa, Artificial Sequence
  Description of Artificial Sequence: Synthetic peptide
  Seed: KVLEHVVRV (MAGA4_HUMAN)
KTLEHVVRK

SEQ ID NO: 63994 - protein, 10 aa, Artificial Sequence
  Description of Artificial Sequence: Synthetic peptide
  Seed: RVRIAYPSLR (MAGA4_HUMAN)
RERIAYPSLY

SEQ ID NO: 63995 - protein, 10 aa, Artificial Sequence
  Description of Artificial Sequence: Synthetic peptide
  Seed: KYRAKELVTK (MAGA4_HUMAN)
KTRAKELVTM

SEQ ID NO: 63996 - protein, 8 aa, Artificial Sequence
  Description of Artificial Sequence: Synthetic peptide
  Seed: REALSNKV (MAGA4_HUMAN)
REALSNKI

SEQ ID NO: 63997 - protein, 10 aa, Artificial Sequence
  Description of Artificial Sequence: Synthetic peptide
  Seed: RVRIAYPSLR (MAGA4_HUMAN)
RWRIAYPSLR

SEQ ID NO: 63998 - protein, 10 aa, Artificial Sequence
  Description of Artificial Sequence: Synthetic peptide
  Seed: FGKASESLKM (MAGA4_HUMAN)
FEKASESLKF

SEQ ID NO: 63999 - protein, 9 aa, Artificial Sequence
  Description of Artificial Sequence: Synthetic peptide
  Seed: RAKELVTKA (MAGA4_HUMAN)
RAKELVTKY

SEQ ID NO: 64000 - protein, 10 aa, Artificial Sequence
  Description of Artificial Sequence: Synthetic peptide
  Seed: RIAYPSLREA (MAGA4_HUMAN)
RLAYPSLREA

SEQ ID NO: 64001 - protein, 9 aa, Artificial Sequence
  Description of Artificial Sequence: Synthetic peptide
  Seed: SALPTTISF (MAGA4_HUMAN)
SYLPTTISW

SEQ ID NO: 64002 - protein, 9 aa, Artificial Sequence
  Description of Artificial Sequence: Synthetic peptide
  Seed: SSPLVPGTL (MAGA4_HUMAN)
SAPLVPGTI

SEQ ID NO: 64003 - protein, 11 aa, Artificial Sequence
  Description of Artificial Sequence: Synthetic peptide
  Seed: IAMEGDSASEE (MAGA4_HUMAN)
IAMEGDSASEL

SEQ ID NO: 64004 - protein, 9 aa, Artificial Sequence
  Description of Artificial Sequence: Synthetic peptide
  Seed: TQDWVQENY (MAGA4_HUMAN)
TEDWVQENW

SEQ ID NO: 64005 - protein, 9 aa, Artificial Sequence
  Description of Artificial Sequence: Synthetic peptide
  Seed: GTLEEVPAA (MAGA4_HUMAN)
GQLEEVPAL

SEQ ID NO: 64006 - protein, 9 aa, Artificial Sequence
  Description of Artificial Sequence: Synthetic peptide
  Seed: AAVSSSSPL (MAGA4_HUMAN)
AFVSSSSPI

SEQ ID NO: 64007 - protein, 9 aa, Artificial Sequence
  Description of Artificial Sequence: Synthetic peptide
  Seed: YKRCFPVIF (MAGA4_HUMAN)
YSRCFPVIY

SEQ ID NO: 64008 - protein, 10 aa, Artificial Sequence
  Description of Artificial Sequence: Synthetic peptide
  Seed: KNYKRCFPVI (MAGA4_HUMAN)
KVYKRCFPVM

SEQ ID NO: 64009 - protein, 10 aa, Artificial Sequence
  Description of Artificial Sequence: Synthetic peptide
  Seed: ARVRIAYPSL (MAGA4_HUMAN)
APVRIAYPSK

SEQ ID NO: 64010 - protein, 9 aa, Artificial Sequence
  Description of Artificial Sequence: Synthetic peptide
  Seed: VYDGREHTV (MAGA4_HUMAN)
VRDGREHTY

SEQ ID NO: 64011 - protein, 9 aa, Artificial Sequence
  Description of Artificial Sequence: Synthetic peptide
  Seed: GSNPARYEF (MAGA4_HUMAN)
GSNPARYEY

SEQ ID NO: 64012 - protein, 10 aa, Artificial Sequence
  Description of Artificial Sequence: Synthetic peptide
  Seed: TSYVKVLEHV (MAGA4_HUMAN)
TAYVKVLEHL

SEQ ID NO: 64013 - protein, 10 aa, Artificial Sequence
  Description of Artificial Sequence: Synthetic peptide
  Seed: VDPASNTYTL (MAGA4_HUMAN)
VDPASNTYTY

SEQ ID NO: 64014 - protein, 9 aa, Artificial Sequence
  Description of Artificial Sequence: Synthetic peptide
  Seed: NTYTLVTCL (MAGA4_HUMAN)
NQYTLVTCM

SEQ ID NO: 64015 - protein, 9 aa, Artificial Sequence
  Description of Artificial Sequence: Synthetic peptide
  Seed: GTLEEVPAA (MAGA4_HUMAN)
GSLEEVPAL

SEQ ID NO: 64016 - protein, 10 aa, Artificial Sequence
  Description of Artificial Sequence: Synthetic peptide
  Seed: KEVDPASNTY (MAGA4_HUMAN)
KIVDPASNTF

SEQ ID NO: 64017 - protein, 9 aa, Artificial Sequence
  Description of Artificial Sequence: Synthetic peptide
  Seed: SEEEIWEEL (MAGA4_HUMAN)
SMEEIWEEF

SEQ ID NO: 64018 - protein, 9 aa, Artificial Sequence
  Description of Artificial Sequence: Synthetic peptide
  Seed: EAQEEALGL (MAGA4_HUMAN)
ESQEEALGR

SEQ ID NO: 64019 - protein, 9 aa, Artificial Sequence
  Description of Artificial Sequence: Synthetic peptide
  Seed: ALSNKVDEL (MAGA4_HUMAN)
ALSNKVDEI

SEQ ID NO: 64020 - protein, 9 aa, Artificial Sequence
  Description of Artificial Sequence: Synthetic peptide
  Seed: KYRAKELVT (MAGA4_HUMAN)
KIRAKELVK

SEQ ID NO: 64021 - protein, 8 aa, Artificial Sequence
  Description of Artificial Sequence: Synthetic peptide
  Seed: RIAYPSLR (MAGA4_HUMAN)
RMAYPSLR

SEQ ID NO: 64022 - protein, 9 aa, Artificial Sequence
  Description of Artificial Sequence: Synthetic peptide
  Seed: VYGEPRKLL (MAGA4_HUMAN)
VFGEPRKLM

SEQ ID NO: 64023 - protein, 10 aa, Artificial Sequence
  Description of Artificial Sequence: Synthetic peptide
  Seed: QIFPKTGLLI (MAGA4_HUMAN)
QSFPKTGLLF

SEQ ID NO: 64024 - protein, 10 aa, Artificial Sequence
  Description of Artificial Sequence: Synthetic peptide
  Seed: RVRIAYPSLR (MAGA4_HUMAN)
RQRIAYPSLR

SEQ ID NO: 64025 - protein, 10 aa, Artificial Sequence
  Description of Artificial Sequence: Synthetic peptide
  Seed: ARVRIAYPSL (MAGA4_HUMAN)
AQVRIAYPSV

SEQ ID NO: 64026 - protein, 9 aa, Artificial Sequence
  Description of Artificial Sequence: Synthetic peptide
  Seed: TVYGEPRKL (MAGA4_HUMAN)
TSYGEPRKW

SEQ ID NO: 64027 - protein, 9 aa, Artificial Sequence
  Description of Artificial Sequence: Synthetic peptide
  Seed: SALPTTISF (MAGA4_HUMAN)
SGLPTTISF

SEQ ID NO: 64028 - protein, 9 aa, Artificial Sequence
  Description of Artificial Sequence: Synthetic peptide
  Seed: VTKAEMLER (MAGA4_HUMAN)
VVKAEMLEK

SEQ ID NO: 64029 - protein, 9 aa, Artificial Sequence
  Description of Artificial Sequence: Synthetic peptide
  Seed: IIVLGTIAM (MAGA4_HUMAN)
IMVLGTIAI

SEQ ID NO: 64030 - protein, 10 aa, Artificial Sequence
  Description of Artificial Sequence: Synthetic peptide
  Seed: AYPSLREAAL (MAGA4_HUMAN)
AYPSLREAAY

SEQ ID NO: 64031 - protein, 9 aa, Artificial Sequence
  Description of Artificial Sequence: Synthetic peptide
  Seed: RVRIAYPSL (MAGA4_HUMAN)
RFRIAYPSG

SEQ ID NO: 64032 - protein, 10 aa, Artificial Sequence
  Description of Artificial Sequence: Synthetic peptide
  Seed: ASALPTTISF (MAGA4_HUMAN)
AAALPTTISW

SEQ ID NO: 64033 - protein, 9 aa, Artificial Sequence
  Description of Artificial Sequence: Synthetic peptide
  Seed: YVKVLEHVV (MAGA4_HUMAN)
YQKVLEHVI

SEQ ID NO: 64034 - protein, 9 aa, Artificial Sequence
  Description of Artificial Sequence: Synthetic peptide
  Seed: AAVSSSSPL (MAGA4_HUMAN)
AKVSSSSPI

SEQ ID NO: 64035 - protein, 10 aa, Artificial Sequence
  Description of Artificial Sequence: Synthetic peptide
  Seed: ASALPTTISF (MAGA4_HUMAN)
AMALPTTISF

SEQ ID NO: 64036 - protein, 9 aa, Artificial Sequence
  Description of Artificial Sequence: Synthetic peptide
  Seed: VNARVRIAY (MAGA4_HUMAN)
VMARVRIAL

SEQ ID NO: 64037 - protein, 10 aa, Artificial Sequence
  Description of Artificial Sequence: Synthetic peptide
  Seed: ARVRIAYPSL (MAGA4_HUMAN)
AIVRIAYPSA

SEQ ID NO: 64038 - protein, 10 aa, Artificial Sequence
  Description of Artificial Sequence: Synthetic peptide
  Seed: LTQDWVQENY (MAGA4_HUMAN)
LMQDWVQENY

SEQ ID NO: 64039 - protein, 9 aa, Artificial Sequence
  Description of Artificial Sequence: Synthetic peptide
  Seed: VYDGREHTV (MAGA4_HUMAN)
VRDGREHTL

SEQ ID NO: 64040 - protein, 9 aa, Artificial Sequence
  Description of Artificial Sequence: Synthetic peptide
  Seed: VYDGREHTV (MAGA4_HUMAN)
VSDGREHTW

SEQ ID NO: 64041 - protein, 9 aa, Artificial Sequence
  Description of Artificial Sequence: Synthetic peptide
  Seed: IAYPSLREA (MAGA4_HUMAN)
ISYPSLREF

SEQ ID NO: 64042 - protein, 9 aa, Artificial Sequence
  Description of Artificial Sequence: Synthetic peptide
  Seed: SALPTTISF (MAGA4_HUMAN)
SLLPTTISL

SEQ ID NO: 64043 - protein, 11 aa, Artificial Sequence
  Description of Artificial Sequence: Synthetic peptide
  Seed: AQAPTTEEQEA (MAGA4_HUMAN)
AMAPTTEEQEW

SEQ ID NO: 64044 - protein, 10 aa, Artificial Sequence
  Description of Artificial Sequence: Synthetic peptide
  Seed: ELAHFLLRKY (MAGA4_HUMAN)
EMAHFLLRKK

SEQ ID NO: 64045 - protein, 9 aa, Artificial Sequence
  Description of Artificial Sequence: Synthetic peptide
  Seed: MSSEQKSQH (MAGA4_HUMAN)
MISEQKSQY

SEQ ID NO: 64046 - protein, 9 aa, Artificial Sequence
  Description of Artificial Sequence: Synthetic peptide
  Seed: GLLIIVLGT (MAGA4_HUMAN)
GMLIIVLGA

SEQ ID NO: 64047 - protein, 10 aa, Artificial Sequence
  Description of Artificial Sequence: Synthetic peptide
  Seed: KEVDPASNTY (MAGA4_HUMAN)
KRVDPASNTM

SEQ ID NO: 64048 - protein, 10 aa, Artificial Sequence
  Description of Artificial Sequence: Synthetic peptide
  Seed: KRCFPVIFGK (MAGA4_HUMAN)
KICFPVIFGR

SEQ ID NO: 64049 - protein, 9 aa, Artificial Sequence
  Description of Artificial Sequence: Synthetic peptide
  Seed: YKRCFPVIF (MAGA4_HUMAN)
YHRCFPVIY

SEQ ID NO: 64050 - protein, 9 aa, Artificial Sequence
  Description of Artificial Sequence: Synthetic peptide
  Seed: KNYKRCFPV (MAGA4_HUMAN)
KTYKRCFPV

SEQ ID NO: 64051 - protein, 9 aa, Artificial Sequence
  Description of Artificial Sequence: Synthetic peptide
  Seed: IAYPSLREA (MAGA4_HUMAN)
IMYPSLREI

SEQ ID NO: 64052 - protein, 9 aa, Artificial Sequence
  Description of Artificial Sequence: Synthetic peptide
  Seed: KNYKRCFPV (MAGA4_HUMAN)
KSYKRCFPG

SEQ ID NO: 64053 - protein, 10 aa, Artificial Sequence
  Description of Artificial Sequence: Synthetic peptide
  Seed: GVYDGREHTV (MAGA4_HUMAN)
GGYDGREHTY

SEQ ID NO: 64054 - protein, 9 aa, Artificial Sequence
  Description of Artificial Sequence: Synthetic peptide
  Seed: RQVPGSNPA (MAGA4_HUMAN)
RYVPGSNPY

SEQ ID NO: 64055 - protein, 9 aa, Artificial Sequence
  Description of Artificial Sequence: Synthetic peptide
  Seed: ESLKMIFGI (MAGA4_HUMAN)
ESLKMIFGV

SEQ ID NO: 64056 - protein, 8 aa, Artificial Sequence
  Description of Artificial Sequence: Synthetic peptide
  Seed: REALSNKV (MAGA4_HUMAN)
REALSNKM

SEQ ID NO: 64057 - protein, 9 aa, Artificial Sequence
  Description of Artificial Sequence: Synthetic peptide
  Seed: KNYKRCFPV (MAGA4_HUMAN)
KSYKRCFPI

SEQ ID NO: 64058 - protein, 9 aa, Artificial Sequence
  Description of Artificial Sequence: Synthetic peptide
  Seed: EVDPASNTY (MAGA4_HUMAN)
EMDPASNTF

SEQ ID NO: 64059 - protein, 9 aa, Artificial Sequence
  Description of Artificial Sequence: Synthetic peptide
  Seed: FGKASESLK (MAGA4_HUMAN)
FTKASESLR

SEQ ID NO: 64060 - protein, 10 aa, Artificial Sequence
  Description of Artificial Sequence: Synthetic peptide
  Seed: LLGNNQIFPK (MAGA4_HUMAN)
LMGNNQIFPR

SEQ ID NO: 64061 - protein, 9 aa, Artificial Sequence
  Description of Artificial Sequence: Synthetic peptide
  Seed: GASALPTTI (MAGA4_HUMAN)
GISALPTTY

SEQ ID NO: 64062 - protein, 9 aa, Artificial Sequence
  Description of Artificial Sequence: Synthetic peptide
  Seed: FPKTGLLII (MAGA4_HUMAN)
FAKTGLLIF

SEQ ID NO: 64063 - protein, 9 aa, Artificial Sequence
  Description of Artificial Sequence: Synthetic peptide
  Seed: SALPTTISF (MAGA4_HUMAN)
SILPTTISV

SEQ ID NO: 64064 - protein, 9 aa, Artificial Sequence
  Description of Artificial Sequence: Synthetic peptide
  Seed: KEVDPASNT (MAGA4_HUMAN)
KEVDPASNM

SEQ ID NO: 64065 - protein, 9 aa, Artificial Sequence
  Description of Artificial Sequence: Synthetic peptide
  Seed: NTYTLVTCL (MAGA4_HUMAN)
NVYTLVTCY

SEQ ID NO: 64066 - protein, 9 aa, Artificial Sequence
  Description of Artificial Sequence: Synthetic peptide
  Seed: IAMEGDSAS (MAGA4_HUMAN)
ITMEGDSAF

SEQ ID NO: 64067 - protein, 9 aa, Artificial Sequence
  Description of Artificial Sequence: Synthetic peptide
  Seed: IAYPSLREA (MAGA4_HUMAN)
ITYPSLREY

SEQ ID NO: 64068 - protein, 9 aa, Artificial Sequence
  Description of Artificial Sequence: Synthetic peptide
  Seed: RVRIAYPSL (MAGA4_HUMAN)
RWRIAYPSK

SEQ ID NO: 64069 - protein, 9 aa, Artificial Sequence
  Description of Artificial Sequence: Synthetic peptide
  Seed: RVRIAYPSL (MAGA4_HUMAN)
RYRIAYPSN

SEQ ID NO: 64070 - protein, 8 aa, Artificial Sequence
  Description of Artificial Sequence: Synthetic peptide
  Seed: KVDELAHF (MAGA4_HUMAN)
KGDELAHL

SEQ ID NO: 64071 - protein, 10 aa, Artificial Sequence
  Description of Artificial Sequence: Synthetic peptide
  Seed: RVRIAYPSLR (MAGA4_HUMAN)
RSRIAYPSLL

SEQ ID NO: 64072 - protein, 9 aa, Artificial Sequence
  Description of Artificial Sequence: Synthetic peptide
  Seed: ELAHFLLRK (MAGA4_HUMAN)
EAAHFLLRY

SEQ ID NO: 64073 - protein, 11 aa, Artificial Sequence
  Description of Artificial Sequence: Synthetic peptide
  Seed: YVKVLEHVVRV (MAGA4_HUMAN)
YQKVLEHVVRL

SEQ ID NO: 64074 - protein, 9 aa, Artificial Sequence
  Description of Artificial Sequence: Synthetic peptide
  Seed: KASESLKMI (MAGA4_HUMAN)
KSSESLKMW

SEQ ID NO: 64075 - protein, 9 aa, Artificial Sequence
  Description of Artificial Sequence: Synthetic peptide
  Seed: EIWEELGVM (MAGA4_HUMAN)
EAWEELGVF

SEQ ID NO: 64076 - protein, 9 aa, Artificial Sequence
  Description of Artificial Sequence: Synthetic peptide
  Seed: VTKAEMLER (MAGA4_HUMAN)
VAKAEMLEK

SEQ ID NO: 64077 - protein, 9 aa, Artificial Sequence
  Description of Artificial Sequence: Synthetic peptide
  Seed: KNYKRCFPV (MAGA4_HUMAN)
KIYKRCFPR

SEQ ID NO: 64078 - protein, 10 aa, Artificial Sequence
  Description of Artificial Sequence: Synthetic peptide
  Seed: KEVDPASNTY (MAGA4_HUMAN)
KIVDPASNTL

SEQ ID NO: 64079 - protein, 11 aa, Artificial Sequence
  Description of Artificial Sequence: Synthetic peptide
  Seed: RQVPGSNPARY (MAGA4_HUMAN)
RTVPGSNPARR

SEQ ID NO: 64080 - protein, 9 aa, Artificial Sequence
  Description of Artificial Sequence: Synthetic peptide
  Seed: TQDWVQENY (MAGA4_HUMAN)
TLDWVQENM

SEQ ID NO: 64081 - protein, 9 aa, Artificial Sequence
  Description of Artificial Sequence: Synthetic peptide
  Seed: KVLEHVVRV (MAGA4_HUMAN)
KNLEHVVRW

SEQ ID NO: 64082 - protein, 11 aa, Artificial Sequence
  Description of Artificial Sequence: Synthetic peptide
  Seed: ELAHFLLRKYR (MAGA4_HUMAN)
ESAHFLLRKYR

SEQ ID NO: 64083 - protein, 10 aa, Artificial Sequence
  Description of Artificial Sequence: Synthetic peptide
  Seed: RVNARVRIAY (MAGA4_HUMAN)
RSNARVRIAW

SEQ ID NO: 64084 - protein, 10 aa, Artificial Sequence
  Description of Artificial Sequence: Synthetic peptide
  Seed: KYRAKELVTK (MAGA4_HUMAN)
KIRAKELVTV

SEQ ID NO: 64085 - protein, 10 aa, Artificial Sequence
  Description of Artificial Sequence: Synthetic peptide
  Seed: AAVSSSSPLV (MAGA4_HUMAN)
AMVSSSSPLA

SEQ ID NO: 64086 - protein, 10 aa, Artificial Sequence
  Description of Artificial Sequence: Synthetic peptide
  Seed: VDPASNTYTL (MAGA4_HUMAN)
VIPASNTYTY

SEQ ID NO: 64087 - protein, 10 aa, Artificial Sequence
  Description of Artificial Sequence: Synthetic peptide
  Seed: RQVPGSNPAR (MAGA4_HUMAN)
RTVPGSNPAK

SEQ ID NO: 64088 - protein, 10 aa, Artificial Sequence
  Description of Artificial Sequence: Synthetic peptide
  Seed: FGKASESLKM (MAGA4_HUMAN)
FWKASESLKF

SEQ ID NO: 64089 - protein, 9 aa, Artificial Sequence
  Description of Artificial Sequence: Synthetic peptide
  Seed: EIWEELGVM (MAGA4_HUMAN)
ETWEELGVW

SEQ ID NO: 64090 - protein, 11 aa, Artificial Sequence
  Description of Artificial Sequence: Synthetic peptide
  Seed: ESLFREALSNK (MAGA4_HUMAN)
EALFREALSNR

SEQ ID NO: 64091 - protein, 9 aa, Artificial Sequence
  Description of Artificial Sequence: Synthetic peptide
  Seed: AEMLERVIK (MAGA4_HUMAN)
AEMLERVIA

SEQ ID NO: 64092 - protein, 9 aa, Artificial Sequence
  Description of Artificial Sequence: Synthetic peptide
  Seed: FPKTGLLII (MAGA4_HUMAN)
FPKTGLLIY

SEQ ID NO: 64093 - protein, 11 aa, Artificial Sequence
  Description of Artificial Sequence: Synthetic peptide
  Seed: SQEEEGPSTSP (MAGA4_HUMAN)
SEEEEGPSTSC

SEQ ID NO: 64094 - protein, 9 aa, Artificial Sequence
  Description of Artificial Sequence: Synthetic peptide
  Seed: SSPLVPGTL (MAGA4_HUMAN)
SLPLVPGTF

SEQ ID NO: 64095 - protein, 9 aa, Artificial Sequence
  Description of Artificial Sequence: Synthetic peptide
  Seed: IFPKTGLLI (MAGA4_HUMAN)
IGPKTGLLL

SEQ ID NO: 64096 - protein, 10 aa, Artificial Sequence
  Description of Artificial Sequence: Synthetic peptide
  Seed: TTISFTCWRQ (MAGA4_HUMAN)
TDISFTCWRR

SEQ ID NO: 64097 - protein, 9 aa, Artificial Sequence
  Description of Artificial Sequence: Synthetic peptide
  Seed: EELGVMGVY (MAGA4_HUMAN)
EMLGVMGVY

SEQ ID NO: 64098 - protein, 11 aa, Artificial Sequence
  Description of Artificial Sequence: Synthetic peptide
  Seed: YVKVLEHVVRV (MAGA4_HUMAN)
YMKVLEHVVRL

SEQ ID NO: 64099 - protein, 11 aa, Artificial Sequence
  Description of Artificial Sequence: Synthetic peptide
  Seed: RQVPGSNPARY (MAGA4_HUMAN)
RKVPGSNPARY

SEQ ID NO: 64100 - protein, 9 aa, Artificial Sequence
  Description of Artificial Sequence: Synthetic peptide
  Seed: KELVTKAEM (MAGA4_HUMAN)
KLLVTKAEY

SEQ ID NO: 64101 - protein, 9 aa, Artificial Sequence
  Description of Artificial Sequence: Synthetic peptide
  Seed: AESAGPPQS (MAGA4_HUMAN)
AESAGPPQT

SEQ ID NO: 64102 - protein, 9 aa, Artificial Sequence
  Description of Artificial Sequence: Synthetic peptide
  Seed: SSPLVPGTL (MAGA4_HUMAN)
SCPLVPGTL

SEQ ID NO: 64103 - protein, 9 aa, Artificial Sequence
  Description of Artificial Sequence: Synthetic peptide
  Seed: KNYKRCFPV (MAGA4_HUMAN)
KLYKRCFPR

SEQ ID NO: 64104 - protein, 11 aa, Artificial Sequence
  Description of Artificial Sequence: Synthetic peptide
  Seed: ELAHFLLRKYR (MAGA4_HUMAN)
EMAHFLLRKYR

SEQ ID NO: 64105 - protein, 9 aa, Artificial Sequence
  Description of Artificial Sequence: Synthetic peptide
  Seed: SEEEIWEEL (MAGA4_HUMAN)
SAEEIWEEF

SEQ ID NO: 64106 - protein, 9 aa, Artificial Sequence
  Description of Artificial Sequence: Synthetic peptide
  Seed: SSSPLVPGT (MAGA4_HUMAN)
SLSPLVPGT

SEQ ID NO: 64107 - protein, 11 aa, Artificial Sequence
  Description of Artificial Sequence: Synthetic peptide
  Seed: IAYPSLREAAL (MAGA4_HUMAN)
ITYPSLREAAF

SEQ ID NO: 64108 - protein, 9 aa, Artificial Sequence
  Description of Artificial Sequence: Synthetic peptide
  Seed: KNYKRCFPV (MAGA4_HUMAN)
KSYKRCFPM

SEQ ID NO: 64109 - protein, 9 aa, Artificial Sequence
  Description of Artificial Sequence: Synthetic peptide
  Seed: VYDGREHTV (MAGA4_HUMAN)
VHDGREHTL

SEQ ID NO: 64110 - protein, 8 aa, Artificial Sequence
  Description of Artificial Sequence: Synthetic peptide
  Seed: KVDELAHF (MAGA4_HUMAN)
KYDELAHL

SEQ ID NO: 64111 - protein, 9 aa, Artificial Sequence
  Description of Artificial Sequence: Synthetic peptide
  Seed: SAGPPQSPQ (MAGA4_HUMAN)
SIGPPQSPR

SEQ ID NO: 64112 - protein, 11 aa, Artificial Sequence
  Description of Artificial Sequence: Synthetic peptide
  Seed: SYDGLLGNNQI (MAGA4_HUMAN)
SSDGLLGNNQL

SEQ ID NO: 64113 - protein, 9 aa, Artificial Sequence
  Description of Artificial Sequence: Synthetic peptide
  Seed: EHTVYGEPR (MAGA4_HUMAN)
ELTVYGEPR

SEQ ID NO: 64114 - protein, 8 aa, Artificial Sequence
  Description of Artificial Sequence: Synthetic peptide
  Seed: ASALPTTI (MAGA4_HUMAN)
ATALPTTW

SEQ ID NO: 64115 - protein, 10 aa, Artificial Sequence
  Description of Artificial Sequence: Synthetic peptide
  Seed: RQVPGSNPAR (MAGA4_HUMAN)
RMVPGSNPAY

SEQ ID NO: 64116 - protein, 9 aa, Artificial Sequence
  Description of Artificial Sequence: Synthetic peptide
  Seed: LVPGTLEEV (MAGA4_HUMAN)
LSPGTLEEV

SEQ ID NO: 64117 - protein, 9 aa, Artificial Sequence
  Description of Artificial Sequence: Synthetic peptide
  Seed: KASESLKMI (MAGA4_HUMAN)
KSSESLKML

SEQ ID NO: 64118 - protein, 9 aa, Artificial Sequence
  Description of Artificial Sequence: Synthetic peptide
  Seed: QVPGSNPAR (MAGA4_HUMAN)
QTPGSNPAK

SEQ ID NO: 64119 - protein, 11 aa, Artificial Sequence
  Description of Artificial Sequence: Synthetic peptide
  Seed: ALPTTISFTCW (MAGA4_HUMAN)
AMPTTISFTCW

SEQ ID NO: 64120 - protein, 9 aa, Artificial Sequence
  Description of Artificial Sequence: Synthetic peptide
  Seed: SAGPPQSPQ (MAGA4_HUMAN)
STGPPQSPK

SEQ ID NO: 64121 - protein, 10 aa, Artificial Sequence
  Description of Artificial Sequence: Synthetic peptide
  Seed: KVLEHVVRVN (MAGA4_HUMAN)
KLLEHVVRVR

SEQ ID NO: 64122 - protein, 9 aa, Artificial Sequence
  Description of Artificial Sequence: Synthetic peptide
  Seed: RVRIAYPSL (MAGA4_HUMAN)
RQRIAYPSN

SEQ ID NO: 64123 - protein, 9 aa, Artificial Sequence
  Description of Artificial Sequence: Synthetic peptide
  Seed: KVDELAHFL (MAGA4_HUMAN)
KTDELAHFV

SEQ ID NO: 64124 - protein, 10 aa, Artificial Sequence
  Description of Artificial Sequence: Synthetic peptide
  Seed: KYRAKELVTK (MAGA4_HUMAN)
KSRAKELVTI

SEQ ID NO: 64125 - protein, 10 aa, Artificial Sequence
  Description of Artificial Sequence: Synthetic peptide
  Seed: VKVLEHVVRV (MAGA4_HUMAN)
VIVLEHVVRV

SEQ ID NO: 64126 - protein, 9 aa, Artificial Sequence
  Description of Artificial Sequence: Synthetic peptide
  Seed: IIVLGTIAM (MAGA4_HUMAN)
IVVLGTIAF

SEQ ID NO: 64127 - protein, 10 aa, Artificial Sequence
  Description of Artificial Sequence: Synthetic peptide
  Seed: RVRIAYPSLR (MAGA4_HUMAN)
RARIAYPSLS

SEQ ID NO: 64128 - protein, 11 aa, Artificial Sequence
  Description of Artificial Sequence: Synthetic peptide
  Seed: RQVPGSNPARY (MAGA4_HUMAN)
RSVPGSNPARW

SEQ ID NO: 64129 - protein, 10 aa, Artificial Sequence
  Description of Artificial Sequence: Synthetic peptide
  Seed: AAVSSSSPLV (MAGA4_HUMAN)
ALVSSSSPLL

SEQ ID NO: 64130 - protein, 9 aa, Artificial Sequence
  Description of Artificial Sequence: Synthetic peptide
  Seed: TVYGEPRKL (MAGA4_HUMAN)
TIYGEPRKY

SEQ ID NO: 64131 - protein, 10 aa, Artificial Sequence
  Description of Artificial Sequence: Synthetic peptide
  Seed: RVRIAYPSLR (MAGA4_HUMAN)
RFRIAYPSLI

SEQ ID NO: 64132 - protein, 9 aa, Artificial Sequence
  Description of Artificial Sequence: Synthetic peptide
  Seed: RVRIAYPSL (MAGA4_HUMAN)
RFRIAYPST

SEQ ID NO: 64133 - protein, 10 aa, Artificial Sequence
  Description of Artificial Sequence: Synthetic peptide
  Seed: RVRIAYPSLR (MAGA4_HUMAN)
RSRIAYPSLH

SEQ ID NO: 64134 - protein, 10 aa, Artificial Sequence
  Description of Artificial Sequence: Synthetic peptide
  Seed: GVYDGREHTV (MAGA4_HUMAN)
GLYDGREHTW

SEQ ID NO: 64135 - protein, 9 aa, Artificial Sequence
  Description of Artificial Sequence: Synthetic peptide
  Seed: LPTTISFTC (MAGA4_HUMAN)
LMTTISFTF

SEQ ID NO: 64136 - protein, 9 aa, Artificial Sequence
  Description of Artificial Sequence: Synthetic peptide
  Seed: ARVRIAYPS (MAGA4_HUMAN)
ARVRIAYPL

SEQ ID NO: 64137 - protein, 9 aa, Artificial Sequence
  Description of Artificial Sequence: Synthetic peptide
  Seed: MSSEQKSQH (MAGA4_HUMAN)
MASEQKSQM

SEQ ID NO: 64138 - protein, 11 aa, Artificial Sequence
  Description of Artificial Sequence: Synthetic peptide
  Seed: ESLFREALSNK (MAGA4_HUMAN)
EYLFREALSNR

SEQ ID NO: 64139 - protein, 9 aa, Artificial Sequence
  Description of Artificial Sequence: Synthetic peptide
  Seed: SEEEIWEEL (MAGA4_HUMAN)
SYEEIWEEL

SEQ ID NO: 64140 - protein, 9 aa, Artificial Sequence
  Description of Artificial Sequence: Synthetic peptide
  Seed: DPASNTYTL (MAGA4_HUMAN)
DRASNTYTL

SEQ ID NO: 64141 - protein, 9 aa, Artificial Sequence
  Description of Artificial Sequence: Synthetic peptide
  Seed: VTKAEMLER (MAGA4_HUMAN)
VMKAEMLER

SEQ ID NO: 64142 - protein, 9 aa, Artificial Sequence
  Description of Artificial Sequence: Synthetic peptide
  Seed: RVRIAYPSL (MAGA4_HUMAN)
RMRIAYPSR

SEQ ID NO: 64143 - protein, 9 aa, Artificial Sequence
  Description of Artificial Sequence: Synthetic peptide
  Seed: SSPLVPGTL (MAGA4_HUMAN)
SMPLVPGTM

SEQ ID NO: 64144 - protein, 10 aa, Artificial Sequence
  Description of Artificial Sequence: Synthetic peptide
  Seed: TYTLVTCLGL (MAGA4_HUMAN)
TYTLVTCLGF

SEQ ID NO: 64145 - protein, 9 aa, Artificial Sequence
  Description of Artificial Sequence: Synthetic peptide
  Seed: GVYDGREHT (MAGA4_HUMAN)
GLYDGREHV

SEQ ID NO: 64146 - protein, 10 aa, Artificial Sequence
  Description of Artificial Sequence: Synthetic peptide
  Seed: TTISFTCWRQ (MAGA4_HUMAN)
TTISFTCWRG

SEQ ID NO: 64147 - protein, 9 aa, Artificial Sequence
  Description of Artificial Sequence: Synthetic peptide
  Seed: SSSPLVPGT (MAGA4_HUMAN)
SASPLVPGL

SEQ ID NO: 64148 - protein, 9 aa, Artificial Sequence
  Description of Artificial Sequence: Synthetic peptide
  Seed: STSPDAESL (MAGA4_HUMAN)
SPSPDAESY

SEQ ID NO: 64149 - protein, 10 aa, Artificial Sequence
  Description of Artificial Sequence: Synthetic peptide
  Seed: YRQVPGSNPA (MAGA4_HUMAN)
YAQVPGSNPW

SEQ ID NO: 64150 - protein, 9 aa, Artificial Sequence
  Description of Artificial Sequence: Synthetic peptide
  Seed: SAGPPQSPQ (MAGA4_HUMAN)
STGPPQSPR

SEQ ID NO: 64151 - protein, 10 aa, Artificial Sequence
  Description of Artificial Sequence: Synthetic peptide
  Seed: GVYDGREHTV (MAGA4_HUMAN)
GTYDGREHTY

SEQ ID NO: 64152 - protein, 9 aa, Artificial Sequence
  Description of Artificial Sequence: Synthetic peptide
  Seed: TTISFTCWR (MAGA4_HUMAN)
TIISFTCWK

SEQ ID NO: 64153 - protein, 9 aa, Artificial Sequence
  Description of Artificial Sequence: Synthetic peptide
  Seed: ALSNKVDEL (MAGA4_HUMAN)
AMSNKVDEF

SEQ ID NO: 64154 - protein, 10 aa, Artificial Sequence
  Description of Artificial Sequence: Synthetic peptide
  Seed: SSSPLVPGTL (MAGA4_HUMAN)
SASPLVPGTV

SEQ ID NO: 64155 - protein, 9 aa, Artificial Sequence
  Description of Artificial Sequence: Synthetic peptide
  Seed: ALSNKVDEL (MAGA4_HUMAN)
AQSNKVDEV

SEQ ID NO: 64156 - protein, 9 aa, Artificial Sequence
  Description of Artificial Sequence: Synthetic peptide
  Seed: TTEEQEAAV (MAGA4_HUMAN)
TLEEQEAAL

SEQ ID NO: 64157 - protein, 10 aa, Artificial Sequence
  Description of Artificial Sequence: Synthetic peptide
  Seed: GVYDGREHTV (MAGA4_HUMAN)
GLYDGREHTV

SEQ ID NO: 64158 - protein, 9 aa, Artificial Sequence
  Description of Artificial Sequence: Synthetic peptide
  Seed: KVLEHVVRV (MAGA4_HUMAN)
KELEHVVRY

SEQ ID NO: 64159 - protein, 9 aa, Artificial Sequence
  Description of Artificial Sequence: Synthetic peptide
  Seed: SNPARYEFL (MAGA4_HUMAN)
SAPARYEFM

SEQ ID NO: 64160 - protein, 9 aa, Artificial Sequence
  Description of Artificial Sequence: Synthetic peptide
  Seed: YPSLREAAL (MAGA4_HUMAN)
YMSLREAAV

SEQ ID NO: 64161 - protein, 11 aa, Artificial Sequence
  Description of Artificial Sequence: Synthetic peptide
  Seed: SASEEEIWEEL (MAGA4_HUMAN)
SQSEEEIWEEW

SEQ ID NO: 64162 - protein, 9 aa, Artificial Sequence
  Description of Artificial Sequence: Synthetic peptide
  Seed: KVLEHVVRV (MAGA4_HUMAN)
KILEHVVRK

SEQ ID NO: 64163 - protein, 9 aa, Artificial Sequence
  Description of Artificial Sequence: Synthetic peptide
  Seed: KVDELAHFL (MAGA4_HUMAN)
KNDELAHFW

SEQ ID NO: 64164 - protein, 9 aa, Artificial Sequence
  Description of Artificial Sequence: Synthetic peptide
  Seed: TSPDAESLF (MAGA4_HUMAN)
TSPDAESLM

SEQ ID NO: 64165 - protein, 10 aa, Artificial Sequence
  Description of Artificial Sequence: Synthetic peptide
  Seed: KEVDPASNTY (MAGA4_HUMAN)
KIVDPASNTW

SEQ ID NO: 64166 - protein, 10 aa, Artificial Sequence
  Description of Artificial Sequence: Synthetic peptide
  Seed: KRCFPVIFGK (MAGA4_HUMAN)
KRCFPVIFGI

SEQ ID NO: 64167 - protein, 10 aa, Artificial Sequence
  Description of Artificial Sequence: Synthetic peptide
  Seed: IAYPSLREAA (MAGA4_HUMAN)
IPYPSLREAA

SEQ ID NO: 64168 - protein, 9 aa, Artificial Sequence
  Description of Artificial Sequence: Synthetic peptide
  Seed: RVRIAYPSL (MAGA4_HUMAN)
RTRIAYPSK

SEQ ID NO: 64169 - protein, 9 aa, Artificial Sequence
  Description of Artificial Sequence: Synthetic peptide
  Seed: NQIFPKTGL (MAGA4_HUMAN)
NHIFPKTGL

SEQ ID NO: 64170 - protein, 9 aa, Artificial Sequence
  Description of Artificial Sequence: Synthetic peptide
  Seed: IAYPSLREA (MAGA4_HUMAN)
IPYPSLREP

SEQ ID NO: 64171 - protein, 9 aa, Artificial Sequence
  Description of Artificial Sequence: Synthetic peptide
  Seed: RAKELVTKA (MAGA4_HUMAN)
RMKELVTKF

SEQ ID NO: 64172 - protein, 9 aa, Artificial Sequence
  Description of Artificial Sequence: Synthetic peptide
  Seed: LFREALSNK (MAGA4_HUMAN)
LTREALSNK

SEQ ID NO: 64173 - protein, 10 aa, Artificial Sequence
  Description of Artificial Sequence: Synthetic peptide
  Seed: AYPSLREAAL (MAGA4_HUMAN)
ACPSLREAAL

SEQ ID NO: 64174 - protein, 9 aa, Artificial Sequence
  Description of Artificial Sequence: Synthetic peptide
  Seed: RVRIAYPSL (MAGA4_HUMAN)
RTRIAYPSQ

SEQ ID NO: 64175 - protein, 10 aa, Artificial Sequence
  Description of Artificial Sequence: Synthetic peptide
  Seed: KYRAKELVTK (MAGA4_HUMAN)
KTRAKELVTY

SEQ ID NO: 64176 - protein, 8 aa, Artificial Sequence
  Description of Artificial Sequence: Synthetic peptide
  Seed: AEMLERVI (MAGA4_HUMAN)
AEMLERVM

SEQ ID NO: 64177 - protein, 9 aa, Artificial Sequence
  Description of Artificial Sequence: Synthetic peptide
  Seed: TVYGEPRKL (MAGA4_HUMAN)
TLYGEPRKW

SEQ ID NO: 64178 - protein, 10 aa, Artificial Sequence
  Description of Artificial Sequence: Synthetic peptide
  Seed: ARVRIAYPSL (MAGA4_HUMAN)
AKVRIAYPSK

SEQ ID NO: 64179 - protein, 10 aa, Artificial Sequence
  Description of Artificial Sequence: Synthetic peptide
  Seed: ELAHFLLRKY (MAGA4_HUMAN)
ETAHFLLRKR

SEQ ID NO: 64180 - protein, 9 aa, Artificial Sequence
  Description of Artificial Sequence: Synthetic peptide
  Seed: KVLEHVVRV (MAGA4_HUMAN)
KTLEHVVRV

SEQ ID NO: 64181 - protein, 8 aa, Artificial Sequence
  Description of Artificial Sequence: Synthetic peptide
  Seed: YPSLREAA (MAGA4_HUMAN)
YPSLREAM

SEQ ID NO: 64182 - protein, 9 aa, Artificial Sequence
  Description of Artificial Sequence: Synthetic peptide
  Seed: KVLEHVVRV (MAGA4_HUMAN)
KWLEHVVRY

SEQ ID NO: 64183 - protein, 9 aa, Artificial Sequence
  Description of Artificial Sequence: Synthetic peptide
  Seed: AHFLLRKYR (MAGA4_HUMAN)
AIFLLRKYK

SEQ ID NO: 64184 - protein, 9 aa, Artificial Sequence
  Description of Artificial Sequence: Synthetic peptide
  Seed: IAYPSLREA (MAGA4_HUMAN)
IGYPSLREF

SEQ ID NO: 64185 - protein, 9 aa, Artificial Sequence
  Description of Artificial Sequence: Synthetic peptide
  Seed: LGNNQIFPK (MAGA4_HUMAN)
LYNNQIFPR

SEQ ID NO: 64186 - protein, 10 aa, Artificial Sequence
  Description of Artificial Sequence: Synthetic peptide
  Seed: QIFPKTGLLI (MAGA4_HUMAN)
QMFPKTGLLA

SEQ ID NO: 64187 - protein, 10 aa, Artificial Sequence
  Description of Artificial Sequence: Synthetic peptide
  Seed: VDPASNTYTL (MAGA4_HUMAN)
VMPASNTYTF

SEQ ID NO: 64188 - protein, 10 aa, Artificial Sequence
  Description of Artificial Sequence: Synthetic peptide
  Seed: KEVDPASNTY (MAGA4_HUMAN)
KIVDPASNTY

SEQ ID NO: 64189 - protein, 9 aa, Artificial Sequence
  Description of Artificial Sequence: Synthetic peptide
  Seed: YDGREHTVY (MAGA4_HUMAN)
YMGREHTVY

SEQ ID NO: 64190 - protein, 9 aa, Artificial Sequence
  Description of Artificial Sequence: Synthetic peptide
  Seed: ELAHFLLRK (MAGA4_HUMAN)
EVAHFLLRK

SEQ ID NO: 64191 - protein, 11 aa, Artificial Sequence
  Description of Artificial Sequence: Synthetic peptide
  Seed: KEVDPASNTYT (MAGA4_HUMAN)
KEVDPASNTYA

SEQ ID NO: 64192 - protein, 9 aa, Artificial Sequence
  Description of Artificial Sequence: Synthetic peptide
  Seed: KELVTKAEM (MAGA4_HUMAN)
KMLVTKAEY

SEQ ID NO: 64193 - protein, 11 aa, Artificial Sequence
  Description of Artificial Sequence: Synthetic peptide
  Seed: RQVPGSNPARY (MAGA4_HUMAN)
RIVPGSNPARK

SEQ ID NO: 64194 - protein, 10 aa, Artificial Sequence
  Description of Artificial Sequence: Synthetic peptide
  Seed: VYDGREHTVY (MAGA4_HUMAN)
VYDGREHTVF

SEQ ID NO: 64195 - protein, 10 aa, Artificial Sequence
  Description of Artificial Sequence: Synthetic peptide
  Seed: KRCFPVIFGK (MAGA4_HUMAN)
KYCFPVIFGR

SEQ ID NO: 64196 - protein, 9 aa, Artificial Sequence
  Description of Artificial Sequence: Synthetic peptide
  Seed: QIFPKTGLL (MAGA4_HUMAN)
QAFPKTGLF

SEQ ID NO: 64197 - protein, 10 aa, Artificial Sequence
  Description of Artificial Sequence: Synthetic peptide
  Seed: KEVDPASNTY (MAGA4_HUMAN)
KMVDPASNTW

SEQ ID NO: 64198 - protein, 9 aa, Artificial Sequence
  Description of Artificial Sequence: Synthetic peptide
  Seed: SALPTTISF (MAGA4_HUMAN)
STLPTTISF

SEQ ID NO: 64199 - protein, 9 aa, Artificial Sequence
  Description of Artificial Sequence: Synthetic peptide
  Seed: SAGPPQSPQ (MAGA4_HUMAN)
SSGPPQSPY

SEQ ID NO: 64200 - protein, 11 aa, Artificial Sequence
  Description of Artificial Sequence: Synthetic peptide
  Seed: ELVTKAEMLER (MAGA4_HUMAN)
EIVTKAEMLEK

SEQ ID NO: 64201 - protein, 9 aa, Artificial Sequence
  Description of Artificial Sequence: Synthetic peptide
  Seed: VYDGREHTV (MAGA4_HUMAN)
VVDGREHTV

SEQ ID NO: 64202 - protein, 9 aa, Artificial Sequence
  Description of Artificial Sequence: Synthetic peptide
  Seed: VYDGREHTV (MAGA4_HUMAN)
VYDGREHTA

SEQ ID NO: 64203 - protein, 10 aa, Artificial Sequence
  Description of Artificial Sequence: Synthetic peptide
  Seed: RIAYPSLREA (MAGA4_HUMAN)
RIAYPSLREK

SEQ ID NO: 64204 - protein, 9 aa, Artificial Sequence
  Description of Artificial Sequence: Synthetic peptide
  Seed: SALPTTISF (MAGA4_HUMAN)
SMLPTTISL

SEQ ID NO: 64205 - protein, 10 aa, Artificial Sequence
  Description of Artificial Sequence: Synthetic peptide
  Seed: RQVPGSNPAR (MAGA4_HUMAN)
RVVPGSNPAY

SEQ ID NO: 64206 - protein, 9 aa, Artificial Sequence
  Description of Artificial Sequence: Synthetic peptide
  Seed: LVPGTLEEV (MAGA4_HUMAN)
LAPGTLEEL

SEQ ID NO: 64207 - protein, 9 aa, Artificial Sequence
  Description of Artificial Sequence: Synthetic peptide
  Seed: ALPTTISFT (MAGA4_HUMAN)
ALPTTISFM

SEQ ID NO: 64208 - protein, 10 aa, Artificial Sequence
  Description of Artificial Sequence: Synthetic peptide
  Seed: KVDELAHFLL (MAGA4_HUMAN)
KVDELAHFLW

SEQ ID NO: 64209 - protein, 10 aa, Artificial Sequence
  Description of Artificial Sequence: Synthetic peptide
  Seed: YRQVPGSNPA (MAGA4_HUMAN)
YLQVPGSNPW

SEQ ID NO: 64210 - protein, 10 aa, Artificial Sequence
  Description of Artificial Sequence: Synthetic peptide
  Seed: TSYVKVLEHV (MAGA4_HUMAN)
TRYVKVLEHF

SEQ ID NO: 64211 - protein, 9 aa, Artificial Sequence
  Description of Artificial Sequence: Synthetic peptide
  Seed: KASESLKMI (MAGA4_HUMAN)
KMSESLKMF

SEQ ID NO: 64212 - protein, 10 aa, Artificial Sequence
  Description of Artificial Sequence: Synthetic peptide
  Seed: ASALPTTISF (MAGA4_HUMAN)
AHALPTTISY

SEQ ID NO: 64213 - protein, 9 aa, Artificial Sequence
  Description of Artificial Sequence: Synthetic peptide
  Seed: VRIAYPSLR (MAGA4_HUMAN)
VRIAYPSLL

SEQ ID NO: 64214 - protein, 9 aa, Artificial Sequence
  Description of Artificial Sequence: Synthetic peptide
  Seed: LPTTISFTC (MAGA4_HUMAN)
LVTTISFTY

SEQ ID NO: 64215 - protein, 9 aa, Artificial Sequence
  Description of Artificial Sequence: Synthetic peptide
  Seed: KVLEHVVRV (MAGA4_HUMAN)
KVLEHVVRW

SEQ ID NO: 64216 - protein, 10 aa, Artificial Sequence
  Description of Artificial Sequence: Synthetic peptide
  Seed: LLGNNQIFPK (MAGA4_HUMAN)
LTGNNQIFPR

SEQ ID NO: 64217 - protein, 9 aa, Artificial Sequence
  Description of Artificial Sequence: Synthetic peptide
  Seed: RVRIAYPSL (MAGA4_HUMAN)
RGRIAYPSA

SEQ ID NO: 64218 - protein, 9 aa, Artificial Sequence
  Description of Artificial Sequence: Synthetic peptide
  Seed: RVRIAYPSL (MAGA4_HUMAN)
RGRIAYPSM

SEQ ID NO: 64219 - protein, 10 aa, Artificial Sequence
  Description of Artificial Sequence: Synthetic peptide
  Seed: YRQVPGSNPA (MAGA4_HUMAN)
YLQVPGSNPM

SEQ ID NO: 64220 - protein, 9 aa, Artificial Sequence
  Description of Artificial Sequence: Synthetic peptide
  Seed: RCFPVIFGK (MAGA4_HUMAN)
RMFPVIFGF

SEQ ID NO: 64221 - protein, 8 aa, Artificial Sequence
  Description of Artificial Sequence: Synthetic peptide
  Seed: KVDELAHF (MAGA4_HUMAN)
KFDELAHI

SEQ ID NO: 64222 - protein, 9 aa, Artificial Sequence
  Description of Artificial Sequence: Synthetic peptide
  Seed: KVLEHVVRV (MAGA4_HUMAN)
KLLEHVVRF

SEQ ID NO: 64223 - protein, 9 aa, Artificial Sequence
  Description of Artificial Sequence: Synthetic peptide
  Seed: GASALPTTI (MAGA4_HUMAN)
GASALPTTF

SEQ ID NO: 64224 - protein, 9 aa, Artificial Sequence
  Description of Artificial Sequence: Synthetic peptide
  Seed: QIFPKTGLL (MAGA4_HUMAN)
QGFPKTGLY

SEQ ID NO: 64225 - protein, 10 aa, Artificial Sequence
  Description of Artificial Sequence: Synthetic peptide
  Seed: KVDELAHFLL (MAGA4_HUMAN)
KMDELAHFLP

SEQ ID NO: 64226 - protein, 9 aa, Artificial Sequence
  Description of Artificial Sequence: Synthetic peptide
  Seed: KASESLKMI (MAGA4_HUMAN)
KMSESLKML

SEQ ID NO: 64227 - protein, 10 aa, Artificial Sequence
  Description of Artificial Sequence: Synthetic peptide
  Seed: MIFGIDVKEV (MAGA4_HUMAN)
MQFGIDVKEI

SEQ ID NO: 64228 - protein, 10 aa, Artificial Sequence
  Description of Artificial Sequence: Synthetic peptide
  Seed: RVRIAYPSLR (MAGA4_HUMAN)
RFRIAYPSLS

SEQ ID NO: 64229 - protein, 9 aa, Artificial Sequence
  Description of Artificial Sequence: Synthetic peptide
  Seed: EEVPAAESA (MAGA4_HUMAN)
EEVPAAESY

SEQ ID NO: 64230 - protein, 10 aa, Artificial Sequence
  Description of Artificial Sequence: Synthetic peptide
  Seed: RVRIAYPSLR (MAGA4_HUMAN)
RERIAYPSLM

SEQ ID NO: 64231 - protein, 8 aa, Artificial Sequence
  Description of Artificial Sequence: Synthetic peptide
  Seed: RKYRAKEL (MAGA4_HUMAN)
REYRAKEY

SEQ ID NO: 64232 - protein, 9 aa, Artificial Sequence
  Description of Artificial Sequence: Synthetic peptide
  Seed: RVRIAYPSL (MAGA4_HUMAN)
RQRIAYPSL

SEQ ID NO: 64233 - protein, 10 aa, Artificial Sequence
  Description of Artificial Sequence: Synthetic peptide
  Seed: SEQKSQHCKP (MAGA4_HUMAN)
SEQKSQHCKA

SEQ ID NO: 64234 - protein, 11 aa, Artificial Sequence
  Description of Artificial Sequence: Synthetic peptide
  Seed: AQAPTTEEQEA (MAGA4_HUMAN)
AQAPTTEEQEW

SEQ ID NO: 64235 - protein, 9 aa, Artificial Sequence
  Description of Artificial Sequence: Synthetic peptide
  Seed: RKYRAKELV (MAGA4_HUMAN)
RLYRAKELF

SEQ ID NO: 64236 - protein, 9 aa, Artificial Sequence
  Description of Artificial Sequence: Synthetic peptide
  Seed: IIVLGTIAM (MAGA4_HUMAN)
ITVLGTIAY

SEQ ID NO: 64237 - protein, 10 aa, Artificial Sequence
  Description of Artificial Sequence: Synthetic peptide
  Seed: SEEEIWEELG (MAGA4_HUMAN)
SEEEIWEELA

SEQ ID NO: 64238 - protein, 9 aa, Artificial Sequence
  Description of Artificial Sequence: Synthetic peptide
  Seed: LVPGTLEEV (MAGA4_HUMAN)
LAPGTLEEY

SEQ ID NO: 64239 - protein, 10 aa, Artificial Sequence
  Description of Artificial Sequence: Synthetic peptide
  Seed: VDPASNTYTL (MAGA4_HUMAN)
VGPASNTYTY

SEQ ID NO: 64240 - protein, 10 aa, Artificial Sequence
  Description of Artificial Sequence: Synthetic peptide
  Seed: YPSLREAALL (MAGA4_HUMAN)
YRSLREAALW

SEQ ID NO: 64241 - protein, 9 aa, Artificial Sequence
  Description of Artificial Sequence: Synthetic peptide
  Seed: SEQKSQHCK (MAGA4_HUMAN)
SEQKSQHCI

SEQ ID NO: 64242 - protein, 11 aa, Artificial Sequence
  Description of Artificial Sequence: Synthetic peptide
  Seed: KVDELAHFLLR (MAGA4_HUMAN)
KIDELAHFLLK

SEQ ID NO: 64243 - protein, 10 aa, Artificial Sequence
  Description of Artificial Sequence: Synthetic peptide
  Seed: SLFREALSNK (MAGA4_HUMAN)
SQFREALSNR

SEQ ID NO: 64244 - protein, 9 aa, Artificial Sequence
  Description of Artificial Sequence: Synthetic peptide
  Seed: LPTTISFTC (MAGA4_HUMAN)
LATTISFTW

SEQ ID NO: 64245 - protein, 9 aa, Artificial Sequence
  Description of Artificial Sequence: Synthetic peptide
  Seed: LGNNQIFPK (MAGA4_HUMAN)
LFNNQIFPK

SEQ ID NO: 64246 - protein, 9 aa, Artificial Sequence
  Description of Artificial Sequence: Synthetic peptide
  Seed: SALPTTISF (MAGA4_HUMAN)
SYLPTTISV

SEQ ID NO: 64247 - protein, 9 aa, Artificial Sequence
  Description of Artificial Sequence: Synthetic peptide
  Seed: YKRCFPVIF (MAGA4_HUMAN)
YQRCFPVIF

SEQ ID NO: 64248 - protein, 9 aa, Artificial Sequence
  Description of Artificial Sequence: Synthetic peptide
  Seed: RQVPGSNPA (MAGA4_HUMAN)
RQVPGSNPH

SEQ ID NO: 64249 - protein, 10 aa, Artificial Sequence
  Description of Artificial Sequence: Synthetic peptide
  Seed: TSYVKVLEHV (MAGA4_HUMAN)
TLYVKVLEHF

SEQ ID NO: 64250 - protein, 9 aa, Artificial Sequence
  Description of Artificial Sequence: Synthetic peptide
  Seed: SPQGASALP (MAGA4_HUMAN)
SPQGASALI

SEQ ID NO: 64251 - protein, 9 aa, Artificial Sequence
  Description of Artificial Sequence: Synthetic peptide
  Seed: KASESLKMI (MAGA4_HUMAN)
KVSESLKMW

SEQ ID NO: 64252 - protein, 10 aa, Artificial Sequence
  Description of Artificial Sequence: Synthetic peptide
  Seed: QVPGSNPARY (MAGA4_HUMAN)
QAPGSNPARR

SEQ ID NO: 64253 - protein, 10 aa, Artificial Sequence
  Description of Artificial Sequence: Synthetic peptide
  Seed: MLERVIKNYK (MAGA4_HUMAN)
MAERVIKNYR

SEQ ID NO: 64254 - protein, 9 aa, Artificial Sequence
  Description of Artificial Sequence: Synthetic peptide
  Seed: ALSNKVDEL (MAGA4_HUMAN)
AASNKVDEM

SEQ ID NO: 64255 - protein, 9 aa, Artificial Sequence
  Description of Artificial Sequence: Synthetic peptide
  Seed: AYPSLREAA (MAGA4_HUMAN)
AYPSLREAI

SEQ ID NO: 64256 - protein, 9 aa, Artificial Sequence
  Description of Artificial Sequence: Synthetic peptide
  Seed: SEEEIWEEL (MAGA4_HUMAN)
SSEEIWEEM

SEQ ID NO: 64257 - protein, 9 aa, Artificial Sequence
  Description of Artificial Sequence: Synthetic peptide
  Seed: YKRCFPVIF (MAGA4_HUMAN)
YGRCFPVIF

SEQ ID NO: 64258 - protein, 9 aa, Artificial Sequence
  Description of Artificial Sequence: Synthetic peptide
  Seed: TVYGEPRKL (MAGA4_HUMAN)
TWYGEPRKM

SEQ ID NO: 64259 - protein, 9 aa, Artificial Sequence
  Description of Artificial Sequence: Synthetic peptide
  Seed: GASALPTTI (MAGA4_HUMAN)
GQSALPTTY

SEQ ID NO: 64260 - protein, 9 aa, Artificial Sequence
  Description of Artificial Sequence: Synthetic peptide
  Seed: KVLEHVVRV (MAGA4_HUMAN)
KMLEHVVRT

SEQ ID NO: 64261 - protein, 9 aa, Artificial Sequence
  Description of Artificial Sequence: Synthetic peptide
  Seed: TQDWVQENY (MAGA4_HUMAN)
TLDWVQENV

SEQ ID NO: 64262 - protein, 10 aa, Artificial Sequence
  Description of Artificial Sequence: Synthetic peptide
  Seed: LIIVLGTIAM (MAGA4_HUMAN)
LTIVLGTIAF

SEQ ID NO: 64263 - protein, 9 aa, Artificial Sequence
  Description of Artificial Sequence: Synthetic peptide
  Seed: AAVSSSSPL (MAGA4_HUMAN)
ATVSSSSPV

SEQ ID NO: 64264 - protein, 9 aa, Artificial Sequence
  Description of Artificial Sequence: Synthetic peptide
  Seed: TVYGEPRKL (MAGA4_HUMAN)
TLYGEPRKY

SEQ ID NO: 64265 - protein, 10 aa, Artificial Sequence
  Description of Artificial Sequence: Synthetic peptide
  Seed: KVDELAHFLL (MAGA4_HUMAN)
KMDELAHFLI

SEQ ID NO: 64266 - protein, 9 aa, Artificial Sequence
  Description of Artificial Sequence: Synthetic peptide
  Seed: RVRIAYPSL (MAGA4_HUMAN)
RERIAYPSY

SEQ ID NO: 64267 - protein, 9 aa, Artificial Sequence
  Description of Artificial Sequence: Synthetic peptide
  Seed: RAKELVTKA (MAGA4_HUMAN)
RMKELVTKK

SEQ ID NO: 64268 - protein, 9 aa, Artificial Sequence
  Description of Artificial Sequence: Synthetic peptide
  Seed: EEQEAAVSS (MAGA4_HUMAN)
EEQEAAVSV

SEQ ID NO: 64269 - protein, 9 aa, Artificial Sequence
  Description of Artificial Sequence: Synthetic peptide
  Seed: VYDGREHTV (MAGA4_HUMAN)
VVDGREHTC

SEQ ID NO: 64270 - protein, 9 aa, Artificial Sequence
  Description of Artificial Sequence: Synthetic peptide
  Seed: ASESLKMIF (MAGA4_HUMAN)
ASESLKMIW

SEQ ID NO: 64271 - protein, 9 aa, Artificial Sequence
  Description of Artificial Sequence: Synthetic peptide
  Seed: EVDPASNTY (MAGA4_HUMAN)
EYDPASNTL

SEQ ID NO: 64272 - protein, 9 aa, Artificial Sequence
  Description of Artificial Sequence: Synthetic peptide
  Seed: QEAAVSSSS (MAGA4_HUMAN)
QEAAVSSSM

SEQ ID NO: 64273 - protein, 9 aa, Artificial Sequence
  Description of Artificial Sequence: Synthetic peptide
  Seed: AAVSSSSPL (MAGA4_HUMAN)
AYVSSSSPV

SEQ ID NO: 64274 - protein, 9 aa, Artificial Sequence
  Description of Artificial Sequence: Synthetic peptide
  Seed: SYVKVLEHV (MAGA4_HUMAN)
SVVKVLEHL

SEQ ID NO: 64275 - protein, 9 aa, Artificial Sequence
  Description of Artificial Sequence: Synthetic peptide
  Seed: RAKELVTKA (MAGA4_HUMAN)
RIKELVTKI

SEQ ID NO: 64276 - protein, 9 aa, Artificial Sequence
  Description of Artificial Sequence: Synthetic peptide
  Seed: RVRIAYPSL (MAGA4_HUMAN)
RIRIAYPSE

SEQ ID NO: 64277 - protein, 9 aa, Artificial Sequence
  Description of Artificial Sequence: Synthetic peptide
  Seed: LKMIFGIDV (MAGA4_HUMAN)
LQMIFGIDL

SEQ ID NO: 64278 - protein, 9 aa, Artificial Sequence
  Description of Artificial Sequence: Synthetic peptide
  Seed: EVDPASNTY (MAGA4_HUMAN)
EADPASNTL

SEQ ID NO: 64279 - protein, 9 aa, Artificial Sequence
  Description of Artificial Sequence: Synthetic peptide
  Seed: QIFPKTGLL (MAGA4_HUMAN)
QLFPKTGLW

SEQ ID NO: 64280 - protein, 10 aa, Artificial Sequence
  Description of Artificial Sequence: Synthetic peptide
  Seed: RVRIAYPSLR (MAGA4_HUMAN)
RMRIAYPSLG

SEQ ID NO: 64281 - protein, 10 aa, Artificial Sequence
  Description of Artificial Sequence: Synthetic peptide
  Seed: KEVDPASNTY (MAGA4_HUMAN)
KEVDPASNTT

SEQ ID NO: 64282 - protein, 9 aa, Artificial Sequence
  Description of Artificial Sequence: Synthetic peptide
  Seed: RAKELVTKA (MAGA4_HUMAN)
RIKELVTKK

SEQ ID NO: 64283 - protein, 11 aa, Artificial Sequence
  Description of Artificial Sequence: Synthetic peptide
  Seed: GVYDGREHTVY (MAGA4_HUMAN)
GAYDGREHTVH

SEQ ID NO: 64284 - protein, 9 aa, Artificial Sequence
  Description of Artificial Sequence: Synthetic peptide
  Seed: VNARVRIAY (MAGA4_HUMAN)
VHARVRIAF

SEQ ID NO: 64285 - protein, 10 aa, Artificial Sequence
  Description of Artificial Sequence: Synthetic peptide
  Seed: KNYKRCFPVI (MAGA4_HUMAN)
KAYKRCFPVA

SEQ ID NO: 64286 - protein, 9 aa, Artificial Sequence
  Description of Artificial Sequence: Synthetic peptide
  Seed: FLLRKYRAK (MAGA4_HUMAN)
FMLRKYRAR

SEQ ID NO: 64287 - protein, 11 aa, Artificial Sequence
  Description of Artificial Sequence: Synthetic peptide
  Seed: RVRIAYPSLRE (MAGA4_HUMAN)
RQRIAYPSLRK

SEQ ID NO: 64288 - protein, 9 aa, Artificial Sequence
  Description of Artificial Sequence: Synthetic peptide
  Seed: QIFPKTGLL (MAGA4_HUMAN)
QAFPKTGLM

SEQ ID NO: 64289 - protein, 9 aa, Artificial Sequence
  Description of Artificial Sequence: Synthetic peptide
  Seed: SALPTTISF (MAGA4_HUMAN)
SALPTTISL

SEQ ID NO: 64290 - protein, 10 aa, Artificial Sequence
  Description of Artificial Sequence: Synthetic peptide
  Seed: GVYDGREHTV (MAGA4_HUMAN)
GLYDGREHTT

SEQ ID NO: 64291 - protein, 9 aa, Artificial Sequence
  Description of Artificial Sequence: Synthetic peptide
  Seed: IFGIDVKEV (MAGA4_HUMAN)
IYGIDVKEM

SEQ ID NO: 64292 - protein, 9 aa, Artificial Sequence
  Description of Artificial Sequence: Synthetic peptide
  Seed: VYDGREHTV (MAGA4_HUMAN)
VGDGREHTV

SEQ ID NO: 64293 - protein, 9 aa, Artificial Sequence
  Description of Artificial Sequence: Synthetic peptide
  Seed: IIVLGTIAM (MAGA4_HUMAN)
IMVLGTIAV

SEQ ID NO: 64294 - protein, 10 aa, Artificial Sequence
  Description of Artificial Sequence: Synthetic peptide
  Seed: KASESLKMIF (MAGA4_HUMAN)
KVSESLKMIF

SEQ ID NO: 64295 - protein, 9 aa, Artificial Sequence
  Description of Artificial Sequence: Synthetic peptide
  Seed: LPTTISFTC (MAGA4_HUMAN)
LTTTISFTY

SEQ ID NO: 64296 - protein, 9 aa, Artificial Sequence
  Description of Artificial Sequence: Synthetic peptide
  Seed: STSPDAESL (MAGA4_HUMAN)
SISPDAESY

SEQ ID NO: 64297 - protein, 10 aa, Artificial Sequence
  Description of Artificial Sequence: Synthetic peptide
  Seed: MLERVIKNYK (MAGA4_HUMAN)
MLERVIKNYR

SEQ ID NO: 64298 - protein, 9 aa, Artificial Sequence
  Description of Artificial Sequence: Synthetic peptide
  Seed: RVRIAYPSL (MAGA4_HUMAN)
RIRIAYPSN

SEQ ID NO: 64299 - protein, 10 aa, Artificial Sequence
  Description of Artificial Sequence: Synthetic peptide
  Seed: KASESLKMIF (MAGA4_HUMAN)
KASESLKMIY

SEQ ID NO: 64300 - protein, 10 aa, Artificial Sequence
  Description of Artificial Sequence: Synthetic peptide
  Seed: YPSLREAALL (MAGA4_HUMAN)
YTSLREAALF

SEQ ID NO: 64301 - protein, 10 aa, Artificial Sequence
  Description of Artificial Sequence: Synthetic peptide
  Seed: ARVRIAYPSL (MAGA4_HUMAN)
ADVRIAYPSK

SEQ ID NO: 64302 - protein, 9 aa, Artificial Sequence
  Description of Artificial Sequence: Synthetic peptide
  Seed: GASALPTTI (MAGA4_HUMAN)
GRSALPTTM

SEQ ID NO: 64303 - protein, 9 aa, Artificial Sequence
  Description of Artificial Sequence: Synthetic peptide
  Seed: SALPTTISF (MAGA4_HUMAN)
SELPTTISM

SEQ ID NO: 64304 - protein, 9 aa, Artificial Sequence
  Description of Artificial Sequence: Synthetic peptide
  Seed: RCFPVIFGK (MAGA4_HUMAN)
RMFPVIFGM

SEQ ID NO: 64305 - protein, 9 aa, Artificial Sequence
  Description of Artificial Sequence: Synthetic peptide
  Seed: SYVKVLEHV (MAGA4_HUMAN)
SSVKVLEHL

SEQ ID NO: 64306 - protein, 9 aa, Artificial Sequence
  Description of Artificial Sequence: Synthetic peptide
  Seed: ALSNKVDEL (MAGA4_HUMAN)
AFSNKVDEY

SEQ ID NO: 64307 - protein, 10 aa, Artificial Sequence
  Description of Artificial Sequence: Synthetic peptide
  Seed: KNYKRCFPVI (MAGA4_HUMAN)
KSYKRCFPVK

SEQ ID NO: 64308 - protein, 11 aa, Artificial Sequence
  Description of Artificial Sequence: Synthetic peptide
  Seed: ELVTKAEMLER (MAGA4_HUMAN)
EFVTKAEMLER

SEQ ID NO: 64309 - protein, 9 aa, Artificial Sequence
  Description of Artificial Sequence: Synthetic peptide
  Seed: RCFPVIFGK (MAGA4_HUMAN)
RNFPVIFGR

SEQ ID NO: 64310 - protein, 11 aa, Artificial Sequence
  Description of Artificial Sequence: Synthetic peptide
  Seed: YVKVLEHVVRV (MAGA4_HUMAN)
YFKVLEHVVRV

SEQ ID NO: 64311 - protein, 11 aa, Artificial Sequence
  Description of Artificial Sequence: Synthetic peptide
  Seed: RQVPGSNPARY (MAGA4_HUMAN)
RLVPGSNPARL

SEQ ID NO: 64312 - protein, 10 aa, Artificial Sequence
  Description of Artificial Sequence: Synthetic peptide
  Seed: AYPSLREAAL (MAGA4_HUMAN)
AFPSLREAAL

SEQ ID NO: 64313 - protein, 9 aa, Artificial Sequence
  Description of Artificial Sequence: Synthetic peptide
  Seed: GTLEEVPAA (MAGA4_HUMAN)
GLLEEVPAL

SEQ ID NO: 64314 - protein, 9 aa, Artificial Sequence
  Description of Artificial Sequence: Synthetic peptide
  Seed: DELAHFLLR (MAGA4_HUMAN)
DSLAHFLLK

SEQ ID NO: 64315 - protein, 9 aa, Artificial Sequence
  Description of Artificial Sequence: Synthetic peptide
  Seed: ESLKMIFGI (MAGA4_HUMAN)
ESLKMIFGA

SEQ ID NO: 64316 - protein, 9 aa, Artificial Sequence
  Description of Artificial Sequence: Synthetic peptide
  Seed: LAHFLLRKY (MAGA4_HUMAN)
LSHFLLRKM

SEQ ID NO: 64317 - protein, 9 aa, Artificial Sequence
  Description of Artificial Sequence: Synthetic peptide
  Seed: KVDELAHFL (MAGA4_HUMAN)
KDDELAHFL

SEQ ID NO: 64318 - protein, 9 aa, Artificial Sequence
  Description of Artificial Sequence: Synthetic peptide
  Seed: SALPTTISF (MAGA4_HUMAN)
SKLPTTISY

SEQ ID NO: 64319 - protein, 9 aa, Artificial Sequence
  Description of Artificial Sequence: Synthetic peptide
  Seed: QIFPKTGLL (MAGA4_HUMAN)
QRFPKTGLY

SEQ ID NO: 64320 - protein, 9 aa, Artificial Sequence
  Description of Artificial Sequence: Synthetic peptide
  Seed: ESLKMIFGI (MAGA4_HUMAN)
ETLKMIFGI

SEQ ID NO: 64321 - protein, 9 aa, Artificial Sequence
  Description of Artificial Sequence: Synthetic peptide
  Seed: SEEEIWEEL (MAGA4_HUMAN)
SIEEIWEEL

SEQ ID NO: 64322 - protein, 9 aa, Artificial Sequence
  Description of Artificial Sequence: Synthetic peptide
  Seed: YVKVLEHVV (MAGA4_HUMAN)
YPKVLEHVL

SEQ ID NO: 64323 - protein, 9 aa, Artificial Sequence
  Description of Artificial Sequence: Synthetic peptide
  Seed: KVLEHVVRV (MAGA4_HUMAN)
KQLEHVVRA

SEQ ID NO: 64324 - protein, 9 aa, Artificial Sequence
  Description of Artificial Sequence: Synthetic peptide
  Seed: IIVLGTIAM (MAGA4_HUMAN)
IKVLGTIAL

SEQ ID NO: 64325 - protein, 10 aa, Artificial Sequence
  Description of Artificial Sequence: Synthetic peptide
  Seed: KVDELAHFLL (MAGA4_HUMAN)
KVDELAHFLY

SEQ ID NO: 64326 - protein, 10 aa, Artificial Sequence
  Description of Artificial Sequence: Synthetic peptide
  Seed: RIAYPSLREA (MAGA4_HUMAN)
RAAYPSLREK

SEQ ID NO: 64327 - protein, 11 aa, Artificial Sequence
  Description of Artificial Sequence: Synthetic peptide
  Seed: GVYDGREHTVY (MAGA4_HUMAN)
GMYDGREHTVW

SEQ ID NO: 64328 - protein, 10 aa, Artificial Sequence
  Description of Artificial Sequence: Synthetic peptide
  Seed: QVPGSNPARY (MAGA4_HUMAN)
QTPGSNPARK

SEQ ID NO: 64329 - protein, 9 aa, Artificial Sequence
  Description of Artificial Sequence: Synthetic peptide
  Seed: AESLFREAL (MAGA4_HUMAN)
AESLFREAS

SEQ ID NO: 64330 - protein, 9 aa, Artificial Sequence
  Description of Artificial Sequence: Synthetic peptide
  Seed: DPASNTYTL (MAGA4_HUMAN)
DVASNTYTY

SEQ ID NO: 64331 - protein, 9 aa, Artificial Sequence
  Description of Artificial Sequence: Synthetic peptide
  Seed: TSPDAESLF (MAGA4_HUMAN)
TYPDAESLM

SEQ ID NO: 64332 - protein, 9 aa, Artificial Sequence
  Description of Artificial Sequence: Synthetic peptide
  Seed: RVNARVRIA (MAGA4_HUMAN)
RINARVRIK

SEQ ID NO: 64333 - protein, 10 aa, Artificial Sequence
  Description of Artificial Sequence: Synthetic peptide
  Seed: GLLIIVLGTI (MAGA4_HUMAN)
GFLIIVLGTV

SEQ ID NO: 64334 - protein, 10 aa, Artificial Sequence
  Description of Artificial Sequence: Synthetic peptide
  Seed: TSYVKVLEHV (MAGA4_HUMAN)
TCYVKVLEHF

SEQ ID NO: 64335 - protein, 10 aa, Artificial Sequence
  Description of Artificial Sequence: Synthetic peptide
  Seed: RQVPGSNPAR (MAGA4_HUMAN)
RVVPGSNPAF

SEQ ID NO: 64336 - protein, 9 aa, Artificial Sequence
  Description of Artificial Sequence: Synthetic peptide
  Seed: NTYTLVTCL (MAGA4_HUMAN)
NAYTLVTCM

SEQ ID NO: 64337 - protein, 9 aa, Artificial Sequence
  Description of Artificial Sequence: Synthetic peptide
  Seed: RVRIAYPSL (MAGA4_HUMAN)
RLRIAYPSS

SEQ ID NO: 64338 - protein, 9 aa, Artificial Sequence
  Description of Artificial Sequence: Synthetic peptide
  Seed: RVRIAYPSL (MAGA4_HUMAN)
RNRIAYPST

SEQ ID NO: 64339 - protein, 10 aa, Artificial Sequence
  Description of Artificial Sequence: Synthetic peptide
  Seed: KASESLKMIF (MAGA4_HUMAN)
KTSESLKMIY

SEQ ID NO: 64340 - protein, 9 aa, Artificial Sequence
  Description of Artificial Sequence: Synthetic peptide
  Seed: AAVSSSSPL (MAGA4_HUMAN)
AKVSSSSPW

SEQ ID NO: 64341 - protein, 8 aa, Artificial Sequence
  Description of Artificial Sequence: Synthetic peptide
  Seed: AEMLERVI (MAGA4_HUMAN)
AQMLERVV

SEQ ID NO: 64342 - protein, 9 aa, Artificial Sequence
  Description of Artificial Sequence: Synthetic peptide
  Seed: STSPDAESL (MAGA4_HUMAN)
SQSPDAESY

SEQ ID NO: 64343 - protein, 10 aa, Artificial Sequence
  Description of Artificial Sequence: Synthetic peptide
  Seed: KNYKRCFPVI (MAGA4_HUMAN)
KEYKRCFPVF

SEQ ID NO: 64344 - protein, 10 aa, Artificial Sequence
  Description of Artificial Sequence: Synthetic peptide
  Seed: TSYVKVLEHV (MAGA4_HUMAN)
TYYVKVLEHF

SEQ ID NO: 64345 - protein, 11 aa, Artificial Sequence
  Description of Artificial Sequence: Synthetic peptide
  Seed: ELGVMGVYDGR (MAGA4_HUMAN)
EFGVMGVYDGR

SEQ ID NO: 64346 - protein, 9 aa, Artificial Sequence
  Description of Artificial Sequence: Synthetic peptide
  Seed: SSPLVPGTL (MAGA4_HUMAN)
SEPLVPGTV

SEQ ID NO: 64347 - protein, 10 aa, Artificial Sequence
  Description of Artificial Sequence: Synthetic peptide
  Seed: HVVRVNARVR (MAGA4_HUMAN)
HTVRVNARVK

SEQ ID NO: 64348 - protein, 9 aa, Artificial Sequence
  Description of Artificial Sequence: Synthetic peptide
  Seed: SSSPLVPGT (MAGA4_HUMAN)
SISPLVPGL

SEQ ID NO: 64349 - protein, 9 aa, Artificial Sequence
  Description of Artificial Sequence: Synthetic peptide
  Seed: SPQGASALP (MAGA4_HUMAN)
SPQGASALM

SEQ ID NO: 64350 - protein, 10 aa, Artificial Sequence
  Description of Artificial Sequence: Synthetic peptide
  Seed: RVRIAYPSLR (MAGA4_HUMAN)
RVRIAYPSLL

SEQ ID NO: 64351 - protein, 9 aa, Artificial Sequence
  Description of Artificial Sequence: Synthetic peptide
  Seed: TTEEQEAAV (MAGA4_HUMAN)
TMEEQEAAL

SEQ ID NO: 64352 - protein, 10 aa, Artificial Sequence
  Description of Artificial Sequence: Synthetic peptide
  Seed: YRQVPGSNPA (MAGA4_HUMAN)
YHQVPGSNPF

SEQ ID NO: 64353 - protein, 10 aa, Artificial Sequence
  Description of Artificial Sequence: Synthetic peptide
  Seed: SSSPLVPGTL (MAGA4_HUMAN)
SMSPLVPGTM

SEQ ID NO: 64354 - protein, 10 aa, Artificial Sequence
  Description of Artificial Sequence: Synthetic peptide
  Seed: KVLEHVVRVN (MAGA4_HUMAN)
KLLEHVVRVD

SEQ ID NO: 64355 - protein, 9 aa, Artificial Sequence
  Description of Artificial Sequence: Synthetic peptide
  Seed: KNYKRCFPV (MAGA4_HUMAN)
KTYKRCFPY

SEQ ID NO: 64356 - protein, 9 aa, Artificial Sequence
  Description of Artificial Sequence: Synthetic peptide
  Seed: KELVTKAEM (MAGA4_HUMAN)
KDLVTKAEM

SEQ ID NO: 64357 - protein, 9 aa, Artificial Sequence
  Description of Artificial Sequence: Synthetic peptide
  Seed: AQEEALGLV (MAGA4_HUMAN)
AQEEALGLW

SEQ ID NO: 64358 - protein, 9 aa, Artificial Sequence
  Description of Artificial Sequence: Synthetic peptide
  Seed: TVYGEPRKL (MAGA4_HUMAN)
TQYGEPRKY

SEQ ID NO: 64359 - protein, 10 aa, Artificial Sequence
  Description of Artificial Sequence: Synthetic peptide
  Seed: LGVMGVYDGR (MAGA4_HUMAN)
LCVMGVYDGR

SEQ ID NO: 64360 - protein, 9 aa, Artificial Sequence
  Description of Artificial Sequence: Synthetic peptide
  Seed: YVKVLEHVV (MAGA4_HUMAN)
YTKVLEHVF

SEQ ID NO: 64361 - protein, 9 aa, Artificial Sequence
  Description of Artificial Sequence: Synthetic peptide
  Seed: LGNNQIFPK (MAGA4_HUMAN)
LQNNQIFPR

SEQ ID NO: 64362 - protein, 9 aa, Artificial Sequence
  Description of Artificial Sequence: Synthetic peptide
  Seed: ALSNKVDEL (MAGA4_HUMAN)
AYSNKVDEY

SEQ ID NO: 64363 - protein, 9 aa, Artificial Sequence
  Description of Artificial Sequence: Synthetic peptide
  Seed: AAVSSSSPL (MAGA4_HUMAN)
AIVSSSSPW

SEQ ID NO: 64364 - protein, 9 aa, Artificial Sequence
  Description of Artificial Sequence: Synthetic peptide
  Seed: YPSLREAAL (MAGA4_HUMAN)
YVSLREAAF

SEQ ID NO: 64365 - protein, 9 aa, Artificial Sequence
  Description of Artificial Sequence: Synthetic peptide
  Seed: AHFLLRKYR (MAGA4_HUMAN)
ATFLLRKYR

SEQ ID NO: 64366 - protein, 11 aa, Artificial Sequence
  Description of Artificial Sequence: Synthetic peptide
  Seed: ELGVMGVYDGR (MAGA4_HUMAN)
ESGVMGVYDGR

SEQ ID NO: 64367 - protein, 9 aa, Artificial Sequence
  Description of Artificial Sequence: Synthetic peptide
  Seed: QVPGSNPAR (MAGA4_HUMAN)
QSPGSNPAM

SEQ ID NO: 64368 - protein, 9 aa, Artificial Sequence
  Description of Artificial Sequence: Synthetic peptide
  Seed: LFREALSNK (MAGA4_HUMAN)
LAREALSNR

SEQ ID NO: 64369 - protein, 9 aa, Artificial Sequence
  Description of Artificial Sequence: Synthetic peptide
  Seed: SALPTTISF (MAGA4_HUMAN)
SGLPTTISY

SEQ ID NO: 64370 - protein, 10 aa, Artificial Sequence
  Description of Artificial Sequence: Synthetic peptide
  Seed: SSSPLVPGTL (MAGA4_HUMAN)
SVSPLVPGTV

SEQ ID NO: 64371 - protein, 9 aa, Artificial Sequence
  Description of Artificial Sequence: Synthetic peptide
  Seed: ALSNKVDEL (MAGA4_HUMAN)
AASNKVDEV

SEQ ID NO: 64372 - protein, 8 aa, Artificial Sequence
  Description of Artificial Sequence: Synthetic peptide
  Seed: RKYRAKEL (MAGA4_HUMAN)
RQYRAKEY

SEQ ID NO: 64373 - protein, 9 aa, Artificial Sequence
  Description of Artificial Sequence: Synthetic peptide
  Seed: SALPTTISF (MAGA4_HUMAN)
SCLPTTISL

SEQ ID NO: 64374 - protein, 9 aa, Artificial Sequence
  Description of Artificial Sequence: Synthetic peptide
  Seed: SYVKVLEHV (MAGA4_HUMAN)
SAVKVLEHA

SEQ ID NO: 64375 - protein, 9 aa, Artificial Sequence
  Description of Artificial Sequence: Synthetic peptide
  Seed: RQVPGSNPA (MAGA4_HUMAN)
RMVPGSNPV

SEQ ID NO: 64376 - protein, 9 aa, Artificial Sequence
  Description of Artificial Sequence: Synthetic peptide
  Seed: TTISFTCWR (MAGA4_HUMAN)
TFISFTCWK

SEQ ID NO: 64377 - protein, 10 aa, Artificial Sequence
  Description of Artificial Sequence: Synthetic peptide
  Seed: SYVKVLEHVV (MAGA4_HUMAN)
SWVKVLEHVF

SEQ ID NO: 64378 - protein, 9 aa, Artificial Sequence
  Description of Artificial Sequence: Synthetic peptide
  Seed: STSPDAESL (MAGA4_HUMAN)
SMSPDAESL

SEQ ID NO: 64379 - protein, 9 aa, Artificial Sequence
  Description of Artificial Sequence: Synthetic peptide
  Seed: IIVLGTIAM (MAGA4_HUMAN)
IAVLGTIAV

SEQ ID NO: 64380 - protein, 9 aa, Artificial Sequence
  Description of Artificial Sequence: Synthetic peptide
  Seed: VYDGREHTV (MAGA4_HUMAN)
VVDGREHTW

SEQ ID NO: 64381 - protein, 10 aa, Artificial Sequence
  Description of Artificial Sequence: Synthetic peptide
  Seed: RQVPGSNPAR (MAGA4_HUMAN)
RQVPGSNPAY

SEQ ID NO: 64382 - protein, 10 aa, Artificial Sequence
  Description of Artificial Sequence: Synthetic peptide
  Seed: YPSLREAALL (MAGA4_HUMAN)
YNSLREAALW

SEQ ID NO: 64383 - protein, 10 aa, Artificial Sequence
  Description of Artificial Sequence: Synthetic peptide
  Seed: YRQVPGSNPA (MAGA4_HUMAN)
YFQVPGSNPW

SEQ ID NO: 64384 - protein, 9 aa, Artificial Sequence
  Description of Artificial Sequence: Synthetic peptide
  Seed: VYDGREHTV (MAGA4_HUMAN)
VCDGREHTI

SEQ ID NO: 64385 - protein, 9 aa, Artificial Sequence
  Description of Artificial Sequence: Synthetic peptide
  Seed: VYDGREHTV (MAGA4_HUMAN)
VHDGREHTM

SEQ ID NO: 64386 - protein, 9 aa, Artificial Sequence
  Description of Artificial Sequence: Synthetic peptide
  Seed: GLLIIVLGT (MAGA4_HUMAN)
GQLIIVLGV

SEQ ID NO: 64387 - protein, 11 aa, Artificial Sequence
  Description of Artificial Sequence: Synthetic peptide
  Seed: QHCKPEEGVEA (MAGA4_HUMAN)
QHCKPEEGVEV

SEQ ID NO: 64388 - protein, 9 aa, Artificial Sequence
  Description of Artificial Sequence: Synthetic peptide
  Seed: SYVKVLEHV (MAGA4_HUMAN)
SVVKVLEHI

SEQ ID NO: 64389 - protein, 9 aa, Artificial Sequence
  Description of Artificial Sequence: Synthetic peptide
  Seed: KNYKRCFPV (MAGA4_HUMAN)
KWYKRCFPK

SEQ ID NO: 64390 - protein, 8 aa, Artificial Sequence
  Description of Artificial Sequence: Synthetic peptide
  Seed: AEMLERVI (MAGA4_HUMAN)
AEMLERVA

SEQ ID NO: 64391 - protein, 10 aa, Artificial Sequence
  Description of Artificial Sequence: Synthetic peptide
  Seed: KRCFPVIFGK (MAGA4_HUMAN)
KMCFPVIFGK

SEQ ID NO: 64392 - protein, 9 aa, Artificial Sequence
  Description of Artificial Sequence: Synthetic peptide
  Seed: KYRAKELVT (MAGA4_HUMAN)
KTRAKELVG

SEQ ID NO: 64393 - protein, 9 aa, Artificial Sequence
  Description of Artificial Sequence: Synthetic peptide
  Seed: KASESLKMI (MAGA4_HUMAN)
KASESLKMM

SEQ ID NO: 64394 - protein, 10 aa, Artificial Sequence
  Description of Artificial Sequence: Synthetic peptide
  Seed: YRQVPGSNPA (MAGA4_HUMAN)
YVQVPGSNPL

SEQ ID NO: 64395 - protein, 11 aa, Artificial Sequence
  Description of Artificial Sequence: Synthetic peptide
  Seed: ELVTKAEMLER (MAGA4_HUMAN)
EMVTKAEMLER

SEQ ID NO: 64396 - protein, 11 aa, Artificial Sequence
  Description of Artificial Sequence: Synthetic peptide
  Seed: SYDGLLGNNQI (MAGA4_HUMAN)
STDGLLGNNQL

SEQ ID NO: 64397 - protein, 9 aa, Artificial Sequence
  Description of Artificial Sequence: Synthetic peptide
  Seed: ALSNKVDEL (MAGA4_HUMAN)
AMSNKVDEI

SEQ ID NO: 64398 - protein, 10 aa, Artificial Sequence
  Description of Artificial Sequence: Synthetic peptide
  Seed: KASESLKMIF (MAGA4_HUMAN)
KKSESLKMIW

SEQ ID NO: 64399 - protein, 10 aa, Artificial Sequence
  Description of Artificial Sequence: Synthetic peptide
  Seed: AYPSLREAAL (MAGA4_HUMAN)
AYPSLREAAW

SEQ ID NO: 64400 - protein, 11 aa, Artificial Sequence
  Description of Artificial Sequence: Synthetic peptide
  Seed: ELAHFLLRKYR (MAGA4_HUMAN)
EVAHFLLRKYK

SEQ ID NO: 64401 - protein, 10 aa, Artificial Sequence
  Description of Artificial Sequence: Synthetic peptide
  Seed: MLERVIKNYK (MAGA4_HUMAN)
MYERVIKNYR

SEQ ID NO: 64402 - protein, 10 aa, Artificial Sequence
  Description of Artificial Sequence: Synthetic peptide
  Seed: EAAVSSSSPL (MAGA4_HUMAN)
EVAVSSSSPI

SEQ ID NO: 64403 - protein, 11 aa, Artificial Sequence
  Description of Artificial Sequence: Synthetic peptide
  Seed: RQVPGSNPARY (MAGA4_HUMAN)
RQVPGSNPARW

SEQ ID NO: 64404 - protein, 10 aa, Artificial Sequence
  Description of Artificial Sequence: Synthetic peptide
  Seed: KRCFPVIFGK (MAGA4_HUMAN)
KGCFPVIFGR

SEQ ID NO: 64405 - protein, 10 aa, Artificial Sequence
  Description of Artificial Sequence: Synthetic peptide
  Seed: KNYKRCFPVI (MAGA4_HUMAN)
KNYKRCFPVF

SEQ ID NO: 64406 - protein, 9 aa, Artificial Sequence
  Description of Artificial Sequence: Synthetic peptide
  Seed: KASESLKMI (MAGA4_HUMAN)
KMSESLKMV

SEQ ID NO: 64407 - protein, 11 aa, Artificial Sequence
  Description of Artificial Sequence: Synthetic peptide
  Seed: SYDGLLGNNQI (MAGA4_HUMAN)
SFDGLLGNNQL

SEQ ID NO: 64408 - protein, 9 aa, Artificial Sequence
  Description of Artificial Sequence: Synthetic peptide
  Seed: ALSNKVDEL (MAGA4_HUMAN)
ARSNKVDEY

SEQ ID NO: 64409 - protein, 9 aa, Artificial Sequence
  Description of Artificial Sequence: Synthetic peptide
  Seed: SNPARYEFL (MAGA4_HUMAN)
SAPARYEFF

SEQ ID NO: 64410 - protein, 9 aa, Artificial Sequence
  Description of Artificial Sequence: Synthetic peptide
  Seed: QEAAVSSSS (MAGA4_HUMAN)
QEAAVSSST

SEQ ID NO: 64411 - protein, 10 aa, Artificial Sequence
  Description of Artificial Sequence: Synthetic peptide
  Seed: TTISFTCWRQ (MAGA4_HUMAN)
TLISFTCWRK

SEQ ID NO: 64412 - protein, 9 aa, Artificial Sequence
  Description of Artificial Sequence: Synthetic peptide
  Seed: NTYTLVTCL (MAGA4_HUMAN)
NIYTLVTCY

SEQ ID NO: 64413 - protein, 11 aa, Artificial Sequence
  Description of Artificial Sequence: Synthetic peptide
  Seed: AQAPTTEEQEA (MAGA4_HUMAN)
ALAPTTEEQEW

SEQ ID NO: 64414 - protein, 9 aa, Artificial Sequence
  Description of Artificial Sequence: Synthetic peptide
  Seed: KVDELAHFL (MAGA4_HUMAN)
KQDELAHFF

SEQ ID NO: 64415 - protein, 9 aa, Artificial Sequence
  Description of Artificial Sequence: Synthetic peptide
  Seed: SNPARYEFL (MAGA4_HUMAN)
SLPARYEFL

SEQ ID NO: 64416 - protein, 9 aa, Artificial Sequence
  Description of Artificial Sequence: Synthetic peptide
  Seed: YPSLREAAL (MAGA4_HUMAN)
YISLREAAY

SEQ ID NO: 64417 - protein, 9 aa, Artificial Sequence
  Description of Artificial Sequence: Synthetic peptide
  Seed: QIFPKTGLL (MAGA4_HUMAN)
QVFPKTGLK

SEQ ID NO: 64418 - protein, 9 aa, Artificial Sequence
  Description of Artificial Sequence: Synthetic peptide
  Seed: QEAAVSSSS (MAGA4_HUMAN)
QEAAVSSSI

SEQ ID NO: 64419 - protein, 10 aa, Artificial Sequence
  Description of Artificial Sequence: Synthetic peptide
  Seed: GLLIIVLGTI (MAGA4_HUMAN)
GTLIIVLGTV

SEQ ID NO: 64420 - protein, 9 aa, Artificial Sequence
  Description of Artificial Sequence: Synthetic peptide
  Seed: AYPSLREAA (MAGA4_HUMAN)
AFPSLREAI

SEQ ID NO: 64421 - protein, 10 aa, Artificial Sequence
  Description of Artificial Sequence: Synthetic peptide
  Seed: ASALPTTISF (MAGA4_HUMAN)
AVALPTTISW

SEQ ID NO: 64422 - protein, 9 aa, Artificial Sequence
  Description of Artificial Sequence: Synthetic peptide
  Seed: IAYPSLREA (MAGA4_HUMAN)
IAYPSLRET

SEQ ID NO: 64423 - protein, 10 aa, Artificial Sequence
  Description of Artificial Sequence: Synthetic peptide
  Seed: RVRIAYPSLR (MAGA4_HUMAN)
RARIAYPSLA

SEQ ID NO: 64424 - protein, 10 aa, Artificial Sequence
  Description of Artificial Sequence: Synthetic peptide
  Seed: IAYPSLREAA (MAGA4_HUMAN)
IPYPSLREAV

SEQ ID NO: 64425 - protein, 9 aa, Artificial Sequence
  Description of Artificial Sequence: Synthetic peptide
  Seed: SALPTTISF (MAGA4_HUMAN)
SSLPTTISW

SEQ ID NO: 64426 - protein, 9 aa, Artificial Sequence
  Description of Artificial Sequence: Synthetic peptide
  Seed: IAYPSLREA (MAGA4_HUMAN)
IGYPSLREL

SEQ ID NO: 64427 - protein, 9 aa, Artificial Sequence
  Description of Artificial Sequence: Synthetic peptide
  Seed: IAYPSLREA (MAGA4_HUMAN)
ILYPSLREY

SEQ ID NO: 64428 - protein, 10 aa, Artificial Sequence
  Description of Artificial Sequence: Synthetic peptide
  Seed: VDPASNTYTL (MAGA4_HUMAN)
VWPASNTYTM

SEQ ID NO: 64429 - protein, 9 aa, Artificial Sequence
  Description of Artificial Sequence: Synthetic peptide
  Seed: SSPLVPGTL (MAGA4_HUMAN)
SSPLVPGTY

SEQ ID NO: 64430 - protein, 9 aa, Artificial Sequence
  Description of Artificial Sequence: Synthetic peptide
  Seed: TQDWVQENY (MAGA4_HUMAN)
TSDWVQENF

SEQ ID NO: 64431 - protein, 11 aa, Artificial Sequence
  Description of Artificial Sequence: Synthetic peptide
  Seed: AQAPTTEEQEA (MAGA4_HUMAN)
ALAPTTEEQEI

SEQ ID NO: 64432 - protein, 9 aa, Artificial Sequence
  Description of Artificial Sequence: Synthetic peptide
  Seed: YPSLREAAL (MAGA4_HUMAN)
YPSLREAAP

SEQ ID NO: 64433 - protein, 9 aa, Artificial Sequence
  Description of Artificial Sequence: Synthetic peptide
  Seed: LLIIVLGTI (MAGA4_HUMAN)
LIIIVLGTV

SEQ ID NO: 64434 - protein, 10 aa, Artificial Sequence
  Description of Artificial Sequence: Synthetic peptide
  Seed: IFPKTGLLII (MAGA4_HUMAN)
IWPKTGLLIW

SEQ ID NO: 64435 - protein, 9 aa, Artificial Sequence
  Description of Artificial Sequence: Synthetic peptide
  Seed: TQDWVQENY (MAGA4_HUMAN)
TMDWVQENM

SEQ ID NO: 64436 - protein, 9 aa, Artificial Sequence
  Description of Artificial Sequence: Synthetic peptide
  Seed: YVKVLEHVV (MAGA4_HUMAN)
YQKVLEHVV

SEQ ID NO: 64437 - protein, 10 aa, Artificial Sequence
  Description of Artificial Sequence: Synthetic peptide
  Seed: YRQVPGSNPA (MAGA4_HUMAN)
YYQVPGSNPY

SEQ ID NO: 64438 - protein, 9 aa, Artificial Sequence
  Description of Artificial Sequence: Synthetic peptide
  Seed: KVDELAHFL (MAGA4_HUMAN)
KWDELAHFI

SEQ ID NO: 64439 - protein, 10 aa, Artificial Sequence
  Description of Artificial Sequence: Synthetic peptide
  Seed: VYDGREHTVY (MAGA4_HUMAN)
VFDGREHTVM

SEQ ID NO: 64440 - protein, 9 aa, Artificial Sequence
  Description of Artificial Sequence: Synthetic peptide
  Seed: SALPTTISF (MAGA4_HUMAN)
SELPTTISV

SEQ ID NO: 64441 - protein, 9 aa, Artificial Sequence
  Description of Artificial Sequence: Synthetic peptide
  Seed: RVRIAYPSL (MAGA4_HUMAN)
RTRIAYPSF

SEQ ID NO: 64442 - protein, 9 aa, Artificial Sequence
  Description of Artificial Sequence: Synthetic peptide
  Seed: SSPLVPGTL (MAGA4_HUMAN)
SPPLVPGTM

SEQ ID NO: 64443 - protein, 8 aa, Artificial Sequence
  Description of Artificial Sequence: Synthetic peptide
  Seed: KVDELAHF (MAGA4_HUMAN)
KCDELAHL

SEQ ID NO: 64444 - protein, 10 aa, Artificial Sequence
  Description of Artificial Sequence: Synthetic peptide
  Seed: AESLFREALS (MAGA4_HUMAN)
AESLFREALL

SEQ ID NO: 64445 - protein, 10 aa, Artificial Sequence
  Description of Artificial Sequence: Synthetic peptide
  Seed: GVYDGREHTV (MAGA4_HUMAN)
GMYDGREHTL

SEQ ID NO: 64446 - protein, 9 aa, Artificial Sequence
  Description of Artificial Sequence: Synthetic peptide
  Seed: NTYTLVTCL (MAGA4_HUMAN)
NMYTLVTCF

SEQ ID NO: 64447 - protein, 9 aa, Artificial Sequence
  Description of Artificial Sequence: Synthetic peptide
  Seed: SALPTTISF (MAGA4_HUMAN)
SGLPTTISW

SEQ ID NO: 64448 - protein, 9 aa, Artificial Sequence
  Description of Artificial Sequence: Synthetic peptide
  Seed: SALPTTISF (MAGA4_HUMAN)
SMLPTTISM

SEQ ID NO: 64449 - protein, 11 aa, Artificial Sequence
  Description of Artificial Sequence: Synthetic peptide
  Seed: GASALPTTISF (MAGA4_HUMAN)
GTSALPTTISW

SEQ ID NO: 64450 - protein, 10 aa, Artificial Sequence
  Description of Artificial Sequence: Synthetic peptide
  Seed: AAVSSSSPLV (MAGA4_HUMAN)
AMVSSSSPLV

SEQ ID NO: 64451 - protein, 9 aa, Artificial Sequence
  Description of Artificial Sequence: Synthetic peptide
  Seed: GKASESLKM (MAGA4_HUMAN)
GKASESLKF

SEQ ID NO: 64452 - protein, 9 aa, Artificial Sequence
  Description of Artificial Sequence: Synthetic peptide
  Seed: EHVVRVNAR (MAGA4_HUMAN)
EFVVRVNAR

SEQ ID NO: 64453 - protein, 10 aa, Artificial Sequence
  Description of Artificial Sequence: Synthetic peptide
  Seed: KNYKRCFPVI (MAGA4_HUMAN)
KGYKRCFPVK

SEQ ID NO: 64454 - protein, 10 aa, Artificial Sequence
  Description of Artificial Sequence: Synthetic peptide
  Seed: VIFGKASESL (MAGA4_HUMAN)
VMFGKASESA

SEQ ID NO: 64455 - protein, 9 aa, Artificial Sequence
  Description of Artificial Sequence: Synthetic peptide
  Seed: ALPTTISFT (MAGA4_HUMAN)
AIPTTISFI

SEQ ID NO: 64456 - protein, 9 aa, Artificial Sequence
  Description of Artificial Sequence: Synthetic peptide
  Seed: TTEEQEAAV (MAGA4_HUMAN)
TAEEQEAAM

SEQ ID NO: 64457 - protein, 10 aa, Artificial Sequence
  Description of Artificial Sequence: Synthetic peptide
  Seed: FGKASESLKM (MAGA4_HUMAN)
FVKASESLKF

SEQ ID NO: 64458 - protein, 9 aa, Artificial Sequence
  Description of Artificial Sequence: Synthetic peptide
  Seed: NPARYEFLW (MAGA4_HUMAN)
NPARYEFLF

SEQ ID NO: 64459 - protein, 9 aa, Artificial Sequence
  Description of Artificial Sequence: Synthetic peptide
  Seed: GVYDGREHT (MAGA4_HUMAN)
GIYDGREHA

SEQ ID NO: 64460 - protein, 10 aa, Artificial Sequence
  Description of Artificial Sequence: Synthetic peptide
  Seed: AESAGPPQSP (MAGA4_HUMAN)
AESAGPPQSF

SEQ ID NO: 64461 - protein, 9 aa, Artificial Sequence
  Description of Artificial Sequence: Synthetic peptide
  Seed: EVDPASNTY (MAGA4_HUMAN)
ESDPASNTF

SEQ ID NO: 64462 - protein, 11 aa, Artificial Sequence
  Description of Artificial Sequence: Synthetic peptide
  Seed: VRVNARVRIAY (MAGA4_HUMAN)
VQVNARVRIAY

SEQ ID NO: 64463 - protein, 9 aa, Artificial Sequence
  Description of Artificial Sequence: Synthetic peptide
  Seed: SSSPLVPGT (MAGA4_HUMAN)
SLSPLVPGL

SEQ ID NO: 64464 - protein, 9 aa, Artificial Sequence
  Description of Artificial Sequence: Synthetic peptide
  Seed: AHFLLRKYR (MAGA4_HUMAN)
AAFLLRKYR

SEQ ID NO: 64465 - protein, 9 aa, Artificial Sequence
  Description of Artificial Sequence: Synthetic peptide
  Seed: NPARYEFLW (MAGA4_HUMAN)
NSARYEFLW

SEQ ID NO: 64466 - protein, 11 aa, Artificial Sequence
  Description of Artificial Sequence: Synthetic peptide
  Seed: ELGVMGVYDGR (MAGA4_HUMAN)
EAGVMGVYDGR

SEQ ID NO: 64467 - protein, 9 aa, Artificial Sequence
  Description of Artificial Sequence: Synthetic peptide
  Seed: LAHFLLRKY (MAGA4_HUMAN)
LQHFLLRKY

SEQ ID NO: 64468 - protein, 9 aa, Artificial Sequence
  Description of Artificial Sequence: Synthetic peptide
  Seed: VNARVRIAY (MAGA4_HUMAN)
VIARVRIAY

SEQ ID NO: 64469 - protein, 9 aa, Artificial Sequence
  Description of Artificial Sequence: Synthetic peptide
  Seed: GASALPTTI (MAGA4_HUMAN)
GMSALPTTI

SEQ ID NO: 64470 - protein, 9 aa, Artificial Sequence
  Description of Artificial Sequence: Synthetic peptide
  Seed: SNPARYEFL (MAGA4_HUMAN)
SSPARYEFM

SEQ ID NO: 64471 - protein, 9 aa, Artificial Sequence
  Description of Artificial Sequence: Synthetic peptide
  Seed: LGNNQIFPK (MAGA4_HUMAN)
LANNQIFPR

SEQ ID NO: 64472 - protein, 9 aa, Artificial Sequence
  Description of Artificial Sequence: Synthetic peptide
  Seed: NTYTLVTCL (MAGA4_HUMAN)
NVYTLVTCV

SEQ ID NO: 64473 - protein, 9 aa, Artificial Sequence
  Description of Artificial Sequence: Synthetic peptide
  Seed: SSPLVPGTL (MAGA4_HUMAN)
STPLVPGTR

SEQ ID NO: 64474 - protein, 10 aa, Artificial Sequence
  Description of Artificial Sequence: Synthetic peptide
  Seed: YRQVPGSNPA (MAGA4_HUMAN)
YYQVPGSNPL

SEQ ID NO: 64475 - protein, 9 aa, Artificial Sequence
  Description of Artificial Sequence: Synthetic peptide
  Seed: AESLFREAL (MAGA4_HUMAN)
AESLFREAM

SEQ ID NO: 64476 - protein, 9 aa, Artificial Sequence
  Description of Artificial Sequence: Synthetic peptide
  Seed: WVQENYLEY (MAGA4_HUMAN)
WQQENYLEL

SEQ ID NO: 64477 - protein, 9 aa, Artificial Sequence
  Description of Artificial Sequence: Synthetic peptide
  Seed: YVKVLEHVV (MAGA4_HUMAN)
YAKVLEHVV

SEQ ID NO: 64478 - protein, 9 aa, Artificial Sequence
  Description of Artificial Sequence: Synthetic peptide
  Seed: GSNPARYEF (MAGA4_HUMAN)
GVNPARYEY

SEQ ID NO: 64479 - protein, 9 aa, Artificial Sequence
  Description of Artificial Sequence: Synthetic peptide
  Seed: SALPTTISF (MAGA4_HUMAN)
SPLPTTISW

SEQ ID NO: 64480 - protein, 9 aa, Artificial Sequence
  Description of Artificial Sequence: Synthetic peptide
  Seed: EIWEELGVM (MAGA4_HUMAN)
ETWEELGVK

SEQ ID NO: 64481 - protein, 9 aa, Artificial Sequence
  Description of Artificial Sequence: Synthetic peptide
  Seed: IAYPSLREA (MAGA4_HUMAN)
ILYPSLREA

SEQ ID NO: 64482 - protein, 10 aa, Artificial Sequence
  Description of Artificial Sequence: Synthetic peptide
  Seed: RVRIAYPSLR (MAGA4_HUMAN)
RCRIAYPSLF

SEQ ID NO: 64483 - protein, 9 aa, Artificial Sequence
  Description of Artificial Sequence: Synthetic peptide
  Seed: NYKRCFPVI (MAGA4_HUMAN)
NYKRCFPVL

SEQ ID NO: 64484 - protein, 10 aa, Artificial Sequence
  Description of Artificial Sequence: Synthetic peptide
  Seed: GDSASEEEIW (MAGA4_HUMAN)
GYSASEEEIW

SEQ ID NO: 64485 - protein, 10 aa, Artificial Sequence
  Description of Artificial Sequence: Synthetic peptide
  Seed: RVRIAYPSLR (MAGA4_HUMAN)
RDRIAYPSLF

SEQ ID NO: 64486 - protein, 9 aa, Artificial Sequence
  Description of Artificial Sequence: Synthetic peptide
  Seed: YPSLREAAL (MAGA4_HUMAN)
YVSLREAAY

SEQ ID NO: 64487 - protein, 9 aa, Artificial Sequence
  Description of Artificial Sequence: Synthetic peptide
  Seed: KNYKRCFPV (MAGA4_HUMAN)
KVYKRCFPI

SEQ ID NO: 64488 - protein, 10 aa, Artificial Sequence
  Description of Artificial Sequence: Synthetic peptide
  Seed: YRQVPGSNPA (MAGA4_HUMAN)
YWQVPGSNPV

SEQ ID NO: 64489 - protein, 9 aa, Artificial Sequence
  Description of Artificial Sequence: Synthetic peptide
  Seed: QIFPKTGLL (MAGA4_HUMAN)
QRFPKTGLL

SEQ ID NO: 64490 - protein, 8 aa, Artificial Sequence
  Description of Artificial Sequence: Synthetic peptide
  Seed: VYGEPRKL (MAGA4_HUMAN)
VVGEPRKL

SEQ ID NO: 64491 - protein, 9 aa, Artificial Sequence
  Description of Artificial Sequence: Synthetic peptide
  Seed: NQIFPKTGL (MAGA4_HUMAN)
NAIFPKTGF

SEQ ID NO: 64492 - protein, 9 aa, Artificial Sequence
  Description of Artificial Sequence: Synthetic peptide
  Seed: RVRIAYPSL (MAGA4_HUMAN)
RTRIAYPSY

SEQ ID NO: 64493 - protein, 9 aa, Artificial Sequence
  Description of Artificial Sequence: Synthetic peptide
  Seed: GVMGVYDGR (MAGA4_HUMAN)
GYMGVYDGR

SEQ ID NO: 64494 - protein, 9 aa, Artificial Sequence
  Description of Artificial Sequence: Synthetic peptide
  Seed: ELAHFLLRK (MAGA4_HUMAN)
EMAHFLLRK

SEQ ID NO: 64495 - protein, 10 aa, Artificial Sequence
  Description of Artificial Sequence: Synthetic peptide
  Seed: YRQVPGSNPA (MAGA4_HUMAN)
YKQVPGSNPL

SEQ ID NO: 64496 - protein, 10 aa, Artificial Sequence
  Description of Artificial Sequence: Synthetic peptide
  Seed: QIFPKTGLLI (MAGA4_HUMAN)
QQFPKTGLLW

SEQ ID NO: 64497 - protein, 11 aa, Artificial Sequence
  Description of Artificial Sequence: Synthetic peptide
  Seed: RQVPGSNPARY (MAGA4_HUMAN)
RQVPGSNPARM

SEQ ID NO: 64498 - protein, 9 aa, Artificial Sequence
  Description of Artificial Sequence: Synthetic peptide
  Seed: YDGREHTVY (MAGA4_HUMAN)
YVGREHTVY

SEQ ID NO: 64499 - protein, 11 aa, Artificial Sequence
  Description of Artificial Sequence: Synthetic peptide
  Seed: EMLERVIKNYK (MAGA4_HUMAN)
EVLERVIKNYR

SEQ ID NO: 64500 - protein, 10 aa, Artificial Sequence
  Description of Artificial Sequence: Synthetic peptide
  Seed: EEVPAAESAG (MAGA4_HUMAN)
EEVPAAESAV

SEQ ID NO: 64501 - protein, 9 aa, Artificial Sequence
  Description of Artificial Sequence: Synthetic peptide
  Seed: EIWEELGVM (MAGA4_HUMAN)
ESWEELGVR

SEQ ID NO: 64502 - protein, 11 aa, Artificial Sequence
  Description of Artificial Sequence: Synthetic peptide
  Seed: ELGVMGVYDGR (MAGA4_HUMAN)
EIGVMGVYDGR

SEQ ID NO: 64503 - protein, 10 aa, Artificial Sequence
  Description of Artificial Sequence: Synthetic peptide
  Seed: TSYVKVLEHV (MAGA4_HUMAN)
TAYVKVLEHF

SEQ ID NO: 64504 - protein, 9 aa, Artificial Sequence
  Description of Artificial Sequence: Synthetic peptide
  Seed: IFPKTGLLI (MAGA4_HUMAN)
IVPKTGLLL

SEQ ID NO: 64505 - protein, 9 aa, Artificial Sequence
  Description of Artificial Sequence: Synthetic peptide
  Seed: KVLEHVVRV (MAGA4_HUMAN)
KALEHVVRA

SEQ ID NO: 64506 - protein, 10 aa, Artificial Sequence
  Description of Artificial Sequence: Synthetic peptide
  Seed: KYRAKELVTK (MAGA4_HUMAN)
KQRAKELVTR

SEQ ID NO: 64507 - protein, 11 aa, Artificial Sequence
  Description of Artificial Sequence: Synthetic peptide
  Seed: KEVDPASNTYT (MAGA4_HUMAN)
KEVDPASNTYM

SEQ ID NO: 64508 - protein, 9 aa, Artificial Sequence
  Description of Artificial Sequence: Synthetic peptide
  Seed: TTISFTCWR (MAGA4_HUMAN)
TTISFTCWK

SEQ ID NO: 64509 - protein, 10 aa, Artificial Sequence
  Description of Artificial Sequence: Synthetic peptide
  Seed: TSPDAESLFR (MAGA4_HUMAN)
TIPDAESLFR

SEQ ID NO: 64510 - protein, 9 aa, Artificial Sequence
  Description of Artificial Sequence: Synthetic peptide
  Seed: LRKYRAKEL (MAGA4_HUMAN)
LLKYRAKEL

SEQ ID NO: 64511 - protein, 9 aa, Artificial Sequence
  Description of Artificial Sequence: Synthetic peptide
  Seed: VNARVRIAY (MAGA4_HUMAN)
VIARVRIAF

SEQ ID NO: 64512 - protein, 11 aa, Artificial Sequence
  Description of Artificial Sequence: Synthetic peptide
  Seed: STSPDAESLFR (MAGA4_HUMAN)
SSSPDAESLFY

SEQ ID NO: 64513 - protein, 9 aa, Artificial Sequence
  Description of Artificial Sequence: Synthetic peptide
  Seed: VTKAEMLER (MAGA4_HUMAN)
VMKAEMLEK

SEQ ID NO: 64514 - protein, 9 aa, Artificial Sequence
  Description of Artificial Sequence: Synthetic peptide
  Seed: SYVKVLEHV (MAGA4_HUMAN)
SMVKVLEHV

SEQ ID NO: 64515 - protein, 10 aa, Artificial Sequence
  Description of Artificial Sequence: Synthetic peptide
  Seed: RVNARVRIAY (MAGA4_HUMAN)
RQNARVRIAY

SEQ ID NO: 64516 - protein, 9 aa, Artificial Sequence
  Description of Artificial Sequence: Synthetic peptide
  Seed: EHTVYGEPR (MAGA4_HUMAN)
EITVYGEPR

SEQ ID NO: 64517 - protein, 9 aa, Artificial Sequence
  Description of Artificial Sequence: Synthetic peptide
  Seed: QIFPKTGLL (MAGA4_HUMAN)
QLFPKTGLV

SEQ ID NO: 64518 - protein, 9 aa, Artificial Sequence
  Description of Artificial Sequence: Synthetic peptide
  Seed: SYVKVLEHV (MAGA4_HUMAN)
SIVKVLEHL

SEQ ID NO: 64519 - protein, 9 aa, Artificial Sequence
  Description of Artificial Sequence: Synthetic peptide
  Seed: VYDGREHTV (MAGA4_HUMAN)
VYDGREHTY

SEQ ID NO: 64520 - protein, 10 aa, Artificial Sequence
  Description of Artificial Sequence: Synthetic peptide
  Seed: VDPASNTYTL (MAGA4_HUMAN)
VQPASNTYTF

SEQ ID NO: 64521 - protein, 9 aa, Artificial Sequence
  Description of Artificial Sequence: Synthetic peptide
  Seed: VYDGREHTV (MAGA4_HUMAN)
VIDGREHTW

SEQ ID NO: 64522 - protein, 9 aa, Artificial Sequence
  Description of Artificial Sequence: Synthetic peptide
  Seed: ELAHFLLRK (MAGA4_HUMAN)
ETAHFLLRH

SEQ ID NO: 64523 - protein, 10 aa, Artificial Sequence
  Description of Artificial Sequence: Synthetic peptide
  Seed: RQVPGSNPAR (MAGA4_HUMAN)
RLVPGSNPAK

SEQ ID NO: 64524 - protein, 9 aa, Artificial Sequence
  Description of Artificial Sequence: Synthetic peptide
  Seed: YKRCFPVIF (MAGA4_HUMAN)
YRRCFPVIY

SEQ ID NO: 64525 - protein, 10 aa, Artificial Sequence
  Description of Artificial Sequence: Synthetic peptide
  Seed: RVRIAYPSLR (MAGA4_HUMAN)
RARIAYPSLL

SEQ ID NO: 64526 - protein, 10 aa, Artificial Sequence
  Description of Artificial Sequence: Synthetic peptide
  Seed: KEVDPASNTY (MAGA4_HUMAN)
KRVDPASNTL

SEQ ID NO: 64527 - protein, 9 aa, Artificial Sequence
  Description of Artificial Sequence: Synthetic peptide
  Seed: NTYTLVTCL (MAGA4_HUMAN)
NAYTLVTCL

SEQ ID NO: 64528 - protein, 9 aa, Artificial Sequence
  Description of Artificial Sequence: Synthetic peptide
  Seed: LFREALSNK (MAGA4_HUMAN)
LQREALSNR

SEQ ID NO: 64529 - protein, 10 aa, Artificial Sequence
  Description of Artificial Sequence: Synthetic peptide
  Seed: TSYVKVLEHV (MAGA4_HUMAN)
TLYVKVLEHL

SEQ ID NO: 64530 - protein, 10 aa, Artificial Sequence
  Description of Artificial Sequence: Synthetic peptide
  Seed: STSPDAESLF (MAGA4_HUMAN)
SMSPDAESLL

SEQ ID NO: 64531 - protein, 10 aa, Artificial Sequence
  Description of Artificial Sequence: Synthetic peptide
  Seed: FGKASESLKM (MAGA4_HUMAN)
FFKASESLKF

SEQ ID NO: 64532 - protein, 10 aa, Artificial Sequence
  Description of Artificial Sequence: Synthetic peptide
  Seed: VDPASNTYTL (MAGA4_HUMAN)
VKPASNTYTL

SEQ ID NO: 64533 - protein, 9 aa, Artificial Sequence
  Description of Artificial Sequence: Synthetic peptide
  Seed: NKVDELAHF (MAGA4_HUMAN)
NIVDELAHF

SEQ ID NO: 64534 - protein, 10 aa, Artificial Sequence
  Description of Artificial Sequence: Synthetic peptide
  Seed: GLVGAQAPTT (MAGA4_HUMAN)
GLVGAQAPTI

SEQ ID NO: 64535 - protein, 9 aa, Artificial Sequence
  Description of Artificial Sequence: Synthetic peptide
  Seed: KASESLKMI (MAGA4_HUMAN)
KASESLKMV

SEQ ID NO: 64536 - protein, 9 aa, Artificial Sequence
  Description of Artificial Sequence: Synthetic peptide
  Seed: EVDPASNTY (MAGA4_HUMAN)
EFDPASNTL

SEQ ID NO: 64537 - protein, 10 aa, Artificial Sequence
  Description of Artificial Sequence: Synthetic peptide
  Seed: DELAHFLLRK (MAGA4_HUMAN)
DILAHFLLRR

SEQ ID NO: 64538 - protein, 11 aa, Artificial Sequence
  Description of Artificial Sequence: Synthetic peptide
  Seed: ARVRIAYPSLR (MAGA4_HUMAN)
AMVRIAYPSLR

SEQ ID NO: 64539 - protein, 9 aa, Artificial Sequence
  Description of Artificial Sequence: Synthetic peptide
  Seed: TVYGEPRKL (MAGA4_HUMAN)
TAYGEPRKV

SEQ ID NO: 64540 - protein, 9 aa, Artificial Sequence
  Description of Artificial Sequence: Synthetic peptide
  Seed: KASESLKMI (MAGA4_HUMAN)
KRSESLKML

SEQ ID NO: 64541 - protein, 10 aa, Artificial Sequence
  Description of Artificial Sequence: Synthetic peptide
  Seed: KVLEHVVRVN (MAGA4_HUMAN)
KMLEHVVRVD

SEQ ID NO: 64542 - protein, 11 aa, Artificial Sequence
  Description of Artificial Sequence: Synthetic peptide
  Seed: AYPSLREAALL (MAGA4_HUMAN)
AYPSLREAALI

SEQ ID NO: 64543 - protein, 9 aa, Artificial Sequence
  Description of Artificial Sequence: Synthetic peptide
  Seed: RVRIAYPSL (MAGA4_HUMAN)
RYRIAYPSL

SEQ ID NO: 64544 - protein, 10 aa, Artificial Sequence
  Description of Artificial Sequence: Synthetic peptide
  Seed: MIFGIDVKEV (MAGA4_HUMAN)
MTFGIDVKEI

SEQ ID NO: 64545 - protein, 10 aa, Artificial Sequence
  Description of Artificial Sequence: Synthetic peptide
  Seed: KVDELAHFLL (MAGA4_HUMAN)
KIDELAHFLY

SEQ ID NO: 64546 - protein, 9 aa, Artificial Sequence
  Description of Artificial Sequence: Synthetic peptide
  Seed: AESLFREAL (MAGA4_HUMAN)
AESLFREAW

SEQ ID NO: 64547 - protein, 9 aa, Artificial Sequence
  Description of Artificial Sequence: Synthetic peptide
  Seed: LAHFLLRKY (MAGA4_HUMAN)
LSHFLLRKY

SEQ ID NO: 64548 - protein, 10 aa, Artificial Sequence
  Description of Artificial Sequence: Synthetic peptide
  Seed: LIIVLGTIAM (MAGA4_HUMAN)
LSIVLGTIAY

SEQ ID NO: 64549 - protein, 11 aa, Artificial Sequence
  Description of Artificial Sequence: Synthetic peptide
  Seed: RQVPGSNPARY (MAGA4_HUMAN)
RLVPGSNPARR

SEQ ID NO: 64550 - protein, 10 aa, Artificial Sequence
  Description of Artificial Sequence: Synthetic peptide
  Seed: TTISFTCWRQ (MAGA4_HUMAN)
TAISFTCWRK

SEQ ID NO: 64551 - protein, 10 aa, Artificial Sequence
  Description of Artificial Sequence: Synthetic peptide
  Seed: KNYKRCFPVI (MAGA4_HUMAN)
KTYKRCFPVM

SEQ ID NO: 64552 - protein, 9 aa, Artificial Sequence
  Description of Artificial Sequence: Synthetic peptide
  Seed: VYGEPRKLL (MAGA4_HUMAN)
VWGEPRKLF

SEQ ID NO: 64553 - protein, 10 aa, Artificial Sequence
  Description of Artificial Sequence: Synthetic peptide
  Seed: EHTVYGEPRK (MAGA4_HUMAN)
ELTVYGEPRR

SEQ ID NO: 64554 - protein, 10 aa, Artificial Sequence
  Description of Artificial Sequence: Synthetic peptide
  Seed: RQVPGSNPAR (MAGA4_HUMAN)
RSVPGSNPAR

SEQ ID NO: 64555 - protein, 10 aa, Artificial Sequence
  Description of Artificial Sequence: Synthetic peptide
  Seed: LGVMGVYDGR (MAGA4_HUMAN)
LSVMGVYDGR

SEQ ID NO: 64556 - protein, 10 aa, Artificial Sequence
  Description of Artificial Sequence: Synthetic peptide
  Seed: TTISFTCWRQ (MAGA4_HUMAN)
TVISFTCWRE

SEQ ID NO: 64557 - protein, 8 aa, Artificial Sequence
  Description of Artificial Sequence: Synthetic peptide
  Seed: RVRIAYPS (MAGA4_HUMAN)
RVRIAYPV

SEQ ID NO: 64558 - protein, 9 aa, Artificial Sequence
  Description of Artificial Sequence: Synthetic peptide
  Seed: SALPTTISF (MAGA4_HUMAN)
SKLPTTISI

SEQ ID NO: 64559 - protein, 8 aa, Artificial Sequence
  Description of Artificial Sequence: Synthetic peptide
  Seed: RVRIAYPS (MAGA4_HUMAN)
RQRIAYPK

SEQ ID NO: 64560 - protein, 9 aa, Artificial Sequence
  Description of Artificial Sequence: Synthetic peptide
  Seed: GVYDGREHT (MAGA4_HUMAN)
GMYDGREHA

SEQ ID NO: 64561 - protein, 8 aa, Artificial Sequence
  Description of Artificial Sequence: Synthetic peptide
  Seed: SAGPPQSP (MAGA4_HUMAN)
SSGPPQSY

SEQ ID NO: 64562 - protein, 9 aa, Artificial Sequence
  Description of Artificial Sequence: Synthetic peptide
  Seed: RQVPGSNPA (MAGA4_HUMAN)
RTVPGSNPM

SEQ ID NO: 64563 - protein, 9 aa, Artificial Sequence
  Description of Artificial Sequence: Synthetic peptide
  Seed: RAKELVTKA (MAGA4_HUMAN)
RIKELVTKR

SEQ ID NO: 64564 - protein, 10 aa, Artificial Sequence
  Description of Artificial Sequence: Synthetic peptide
  Seed: IFPKTGLLII (MAGA4_HUMAN)
IYPKTGLLIF

SEQ ID NO: 64565 - protein, 9 aa, Artificial Sequence
  Description of Artificial Sequence: Synthetic peptide
  Seed: TVYGEPRKL (MAGA4_HUMAN)
TVYGEPRKF

SEQ ID NO: 64566 - protein, 10 aa, Artificial Sequence
  Description of Artificial Sequence: Synthetic peptide
  Seed: KNYKRCFPVI (MAGA4_HUMAN)
KCYKRCFPVK

SEQ ID NO: 64567 - protein, 9 aa, Artificial Sequence
  Description of Artificial Sequence: Synthetic peptide
  Seed: EIWEELGVM (MAGA4_HUMAN)
ETWEELGVR

SEQ ID NO: 64568 - protein, 9 aa, Artificial Sequence
  Description of Artificial Sequence: Synthetic peptide
  Seed: KVLEHVVRV (MAGA4_HUMAN)
KALEHVVRF

SEQ ID NO: 64569 - protein, 10 aa, Artificial Sequence
  Description of Artificial Sequence: Synthetic peptide
  Seed: KYRAKELVTK (MAGA4_HUMAN)
KARAKELVTV

SEQ ID NO: 64570 - protein, 9 aa, Artificial Sequence
  Description of Artificial Sequence: Synthetic peptide
  Seed: SALPTTISF (MAGA4_HUMAN)
SRLPTTISY

SEQ ID NO: 64571 - protein, 9 aa, Artificial Sequence
  Description of Artificial Sequence: Synthetic peptide
  Seed: STSPDAESL (MAGA4_HUMAN)
SESPDAESM

SEQ ID NO: 64572 - protein, 9 aa, Artificial Sequence
  Description of Artificial Sequence: Synthetic peptide
  Seed: GASALPTTI (MAGA4_HUMAN)
GLSALPTTY

SEQ ID NO: 64573 - protein, 11 aa, Artificial Sequence
  Description of Artificial Sequence: Synthetic peptide
  Seed: RVRIAYPSLRE (MAGA4_HUMAN)
RLRIAYPSLRK

SEQ ID NO: 64574 - protein, 9 aa, Artificial Sequence
  Description of Artificial Sequence: Synthetic peptide
  Seed: GLLIIVLGT (MAGA4_HUMAN)
GMLIIVLGL

SEQ ID NO: 64575 - protein, 10 aa, Artificial Sequence
  Description of Artificial Sequence: Synthetic peptide
  Seed: KEVDPASNTY (MAGA4_HUMAN)
KQVDPASNTL

SEQ ID NO: 64576 - protein, 9 aa, Artificial Sequence
  Description of Artificial Sequence: Synthetic peptide
  Seed: NTYTLVTCL (MAGA4_HUMAN)
NQYTLVTCF

SEQ ID NO: 64577 - protein, 10 aa, Artificial Sequence
  Description of Artificial Sequence: Synthetic peptide
  Seed: ASALPTTISF (MAGA4_HUMAN)
AQALPTTISF

SEQ ID NO: 64578 - protein, 9 aa, Artificial Sequence
  Description of Artificial Sequence: Synthetic peptide
  Seed: RVNARVRIA (MAGA4_HUMAN)
RINARVRIV

SEQ ID NO: 64579 - protein, 11 aa, Artificial Sequence
  Description of Artificial Sequence: Synthetic peptide
  Seed: YVKVLEHVVRV (MAGA4_HUMAN)
YQKVLEHVVRI

SEQ ID NO: 64580 - protein, 10 aa, Artificial Sequence
  Description of Artificial Sequence: Synthetic peptide
  Seed: ASALPTTISF (MAGA4_HUMAN)
AFALPTTISW

SEQ ID NO: 64581 - protein, 9 aa, Artificial Sequence
  Description of Artificial Sequence: Synthetic peptide
  Seed: SYVKVLEHV (MAGA4_HUMAN)
STVKVLEHL

SEQ ID NO: 64582 - protein, 9 aa, Artificial Sequence
  Description of Artificial Sequence: Synthetic peptide
  Seed: LAHFLLRKY (MAGA4_HUMAN)
LQHFLLRKF

SEQ ID NO: 64583 - protein, 9 aa, Artificial Sequence
  Description of Artificial Sequence: Synthetic peptide
  Seed: LLIIVLGTI (MAGA4_HUMAN)
LLIIVLGTA

SEQ ID NO: 64584 - protein, 9 aa, Artificial Sequence
  Description of Artificial Sequence: Synthetic peptide
  Seed: RVRIAYPSL (MAGA4_HUMAN)
RFRIAYPSS

SEQ ID NO: 64585 - protein, 10 aa, Artificial Sequence
  Description of Artificial Sequence: Synthetic peptide
  Seed: YRQVPGSNPA (MAGA4_HUMAN)
YDQVPGSNPV

SEQ ID NO: 64586 - protein, 9 aa, Artificial Sequence
  Description of Artificial Sequence: Synthetic peptide
  Seed: KVDELAHFL (MAGA4_HUMAN)
KTDELAHFL

SEQ ID NO: 64587 - protein, 10 aa, Artificial Sequence
  Description of Artificial Sequence: Synthetic peptide
  Seed: KYRAKELVTK (MAGA4_HUMAN)
KTRAKELVTI

SEQ ID NO: 64588 - protein, 10 aa, Artificial Sequence
  Description of Artificial Sequence: Synthetic peptide
  Seed: KVDELAHFLL (MAGA4_HUMAN)
KMDELAHFLT

SEQ ID NO: 64589 - protein, 9 aa, Artificial Sequence
  Description of Artificial Sequence: Synthetic peptide
  Seed: SYVKVLEHV (MAGA4_HUMAN)
SYVKVLEHM

SEQ ID NO: 64590 - protein, 9 aa, Artificial Sequence
  Description of Artificial Sequence: Synthetic peptide
  Seed: TVYGEPRKL (MAGA4_HUMAN)
TFYGEPRKF

SEQ ID NO: 64591 - protein, 9 aa, Artificial Sequence
  Description of Artificial Sequence: Synthetic peptide
  Seed: SEEEIWEEL (MAGA4_HUMAN)
SQEEIWEEM

SEQ ID NO: 64592 - protein, 9 aa, Artificial Sequence
  Description of Artificial Sequence: Synthetic peptide
  Seed: VVRVNARVR (MAGA4_HUMAN)
VMRVNARVK

SEQ ID NO: 64593 - protein, 10 aa, Artificial Sequence
  Description of Artificial Sequence: Synthetic peptide
  Seed: KVDELAHFLL (MAGA4_HUMAN)
KLDELAHFLH

SEQ ID NO: 64594 - protein, 9 aa, Artificial Sequence
  Description of Artificial Sequence: Synthetic peptide
  Seed: ALPTTISFT (MAGA4_HUMAN)
AAPTTISFV

SEQ ID NO: 64595 - protein, 10 aa, Artificial Sequence
  Description of Artificial Sequence: Synthetic peptide
  Seed: MLERVIKNYK (MAGA4_HUMAN)
MSERVIKNYR

SEQ ID NO: 64596 - protein, 9 aa, Artificial Sequence
  Description of Artificial Sequence: Synthetic peptide
  Seed: STSPDAESL (MAGA4_HUMAN)
SSSPDAESM

SEQ ID NO: 64597 - protein, 10 aa, Artificial Sequence
  Description of Artificial Sequence: Synthetic peptide
  Seed: HTVYGEPRKL (MAGA4_HUMAN)
HTVYGEPRKR

SEQ ID NO: 64598 - protein, 9 aa, Artificial Sequence
  Description of Artificial Sequence: Synthetic peptide
  Seed: REAALLEEE (MAGA4_HUMAN)
REAALLEEV

SEQ ID NO: 64599 - protein, 9 aa, Artificial Sequence
  Description of Artificial Sequence: Synthetic peptide
  Seed: SEQKSQHCK (MAGA4_HUMAN)
SEQKSQHCF

SEQ ID NO: 64600 - protein, 9 aa, Artificial Sequence
  Description of Artificial Sequence: Synthetic peptide
  Seed: KVDELAHFL (MAGA4_HUMAN)
KEDELAHFL

SEQ ID NO: 64601 - protein, 9 aa, Artificial Sequence
  Description of Artificial Sequence: Synthetic peptide
  Seed: RVRIAYPSL (MAGA4_HUMAN)
RIRIAYPSC

SEQ ID NO: 64602 - protein, 9 aa, Artificial Sequence
  Description of Artificial Sequence: Synthetic peptide
  Seed: IFPKTGLLI (MAGA4_HUMAN)
IAPKTGLLM

SEQ ID NO: 64603 - protein, 10 aa, Artificial Sequence
  Description of Artificial Sequence: Synthetic peptide
  Seed: KNYKRCFPVI (MAGA4_HUMAN)
KTYKRCFPVF

SEQ ID NO: 64604 - protein, 10 aa, Artificial Sequence
  Description of Artificial Sequence: Synthetic peptide
  Seed: KVDELAHFLL (MAGA4_HUMAN)
KMDELAHFLE

SEQ ID NO: 64605 - protein, 9 aa, Artificial Sequence
  Description of Artificial Sequence: Synthetic peptide
  Seed: FPVIFGKAS (MAGA4_HUMAN)
FPVIFGKAV

SEQ ID NO: 64606 - protein, 9 aa, Artificial Sequence
  Description of Artificial Sequence: Synthetic peptide
  Seed: IIVLGTIAM (MAGA4_HUMAN)
IAVLGTIAH

SEQ ID NO: 64607 - protein, 9 aa, Artificial Sequence
  Description of Artificial Sequence: Synthetic peptide
  Seed: KELVTKAEM (MAGA4_HUMAN)
KALVTKAEF

SEQ ID NO: 64608 - protein, 9 aa, Artificial Sequence
  Description of Artificial Sequence: Synthetic peptide
  Seed: RVRIAYPSL (MAGA4_HUMAN)
RYRIAYPSC

SEQ ID NO: 64609 - protein, 9 aa, Artificial Sequence
  Description of Artificial Sequence: Synthetic peptide
  Seed: KVDELAHFL (MAGA4_HUMAN)
KRDELAHFM

SEQ ID NO: 64610 - protein, 9 aa, Artificial Sequence
  Description of Artificial Sequence: Synthetic peptide
  Seed: SSSPLVPGT (MAGA4_HUMAN)
SVSPLVPGL

SEQ ID NO: 64611 - protein, 10 aa, Artificial Sequence
  Description of Artificial Sequence: Synthetic peptide
  Seed: EHVVRVNARV (MAGA4_HUMAN)
EQVVRVNARV

SEQ ID NO: 64612 - protein, 10 aa, Artificial Sequence
  Description of Artificial Sequence: Synthetic peptide
  Seed: YPSLREAALL (MAGA4_HUMAN)
YPSLREAALY

SEQ ID NO: 64613 - protein, 10 aa, Artificial Sequence
  Description of Artificial Sequence: Synthetic peptide
  Seed: ELAHFLLRKY (MAGA4_HUMAN)
EVAHFLLRKK

SEQ ID NO: 64614 - protein, 9 aa, Artificial Sequence
  Description of Artificial Sequence: Synthetic peptide
  Seed: RVRIAYPSL (MAGA4_HUMAN)
RGRIAYPSS

SEQ ID NO: 64615 - protein, 10 aa, Artificial Sequence
  Description of Artificial Sequence: Synthetic peptide
  Seed: RQVPGSNPAR (MAGA4_HUMAN)
RSVPGSNPAY

SEQ ID NO: 64616 - protein, 9 aa, Artificial Sequence
  Description of Artificial Sequence: Synthetic peptide
  Seed: LKMIFGIDV (MAGA4_HUMAN)
LQMIFGIDY

SEQ ID NO: 64617 - protein, 9 aa, Artificial Sequence
  Description of Artificial Sequence: Synthetic peptide
  Seed: RVNARVRIA (MAGA4_HUMAN)
RYNARVRIK

SEQ ID NO: 64618 - protein, 9 aa, Artificial Sequence
  Description of Artificial Sequence: Synthetic peptide
  Seed: ERVIKNYKR (MAGA4_HUMAN)
ESVIKNYKR

SEQ ID NO: 64619 - protein, 9 aa, Artificial Sequence
  Description of Artificial Sequence: Synthetic peptide
  Seed: WVQENYLEY (MAGA4_HUMAN)
WAQENYLEI

SEQ ID NO: 64620 - protein, 9 aa, Artificial Sequence
  Description of Artificial Sequence: Synthetic peptide
  Seed: STSPDAESL (MAGA4_HUMAN)
SVSPDAESL

SEQ ID NO: 64621 - protein, 9 aa, Artificial Sequence
  Description of Artificial Sequence: Synthetic peptide
  Seed: VTKAEMLER (MAGA4_HUMAN)
VIKAEMLER

SEQ ID NO: 64622 - protein, 9 aa, Artificial Sequence
  Description of Artificial Sequence: Synthetic peptide
  Seed: KVLEHVVRV (MAGA4_HUMAN)
KMLEHVVRF

SEQ ID NO: 64623 - protein, 11 aa, Artificial Sequence
  Description of Artificial Sequence: Synthetic peptide
  Seed: AYPSLREAALL (MAGA4_HUMAN)
AYPSLREAALF

SEQ ID NO: 64624 - protein, 9 aa, Artificial Sequence
  Description of Artificial Sequence: Synthetic peptide
  Seed: AQEEALGLV (MAGA4_HUMAN)
AEEEALGLA

SEQ ID NO: 64625 - protein, 10 aa, Artificial Sequence
  Description of Artificial Sequence: Synthetic peptide
  Seed: KVDELAHFLL (MAGA4_HUMAN)
KMDELAHFLW

SEQ ID NO: 64626 - protein, 9 aa, Artificial Sequence
  Description of Artificial Sequence: Synthetic peptide
  Seed: SSPLVPGTL (MAGA4_HUMAN)
SSPLVPGTM

SEQ ID NO: 64627 - protein, 11 aa, Artificial Sequence
  Description of Artificial Sequence: Synthetic peptide
  Seed: RQVPGSNPARY (MAGA4_HUMAN)
RGVPGSNPARY

SEQ ID NO: 64628 - protein, 10 aa, Artificial Sequence
  Description of Artificial Sequence: Synthetic peptide
  Seed: EAAVSSSSPL (MAGA4_HUMAN)
EDAVSSSSPV

SEQ ID NO: 64629 - protein, 9 aa, Artificial Sequence
  Description of Artificial Sequence: Synthetic peptide
  Seed: GKASESLKM (MAGA4_HUMAN)
GQASESLKY

SEQ ID NO: 64630 - protein, 9 aa, Artificial Sequence
  Description of Artificial Sequence: Synthetic peptide
  Seed: IFGIDVKEV (MAGA4_HUMAN)
IFGIDVKEM

SEQ ID NO: 64631 - protein, 10 aa, Artificial Sequence
  Description of Artificial Sequence: Synthetic peptide
  Seed: RVRIAYPSLR (MAGA4_HUMAN)
RPRIAYPSLL

SEQ ID NO: 64632 - protein, 10 aa, Artificial Sequence
  Description of Artificial Sequence: Synthetic peptide
  Seed: KEVDPASNTY (MAGA4_HUMAN)
KIVDPASNTM

SEQ ID NO: 64633 - protein, 10 aa, Artificial Sequence
  Description of Artificial Sequence: Synthetic peptide
  Seed: RVRIAYPSLR (MAGA4_HUMAN)
RIRIAYPSLI

SEQ ID NO: 64634 - protein, 10 aa, Artificial Sequence
  Description of Artificial Sequence: Synthetic peptide
  Seed: ASALPTTISF (MAGA4_HUMAN)
AHALPTTISW

SEQ ID NO: 64635 - protein, 10 aa, Artificial Sequence
  Description of Artificial Sequence: Synthetic peptide
  Seed: RIAYPSLREA (MAGA4_HUMAN)
RLAYPSLREV

SEQ ID NO: 64636 - protein, 9 aa, Artificial Sequence
  Description of Artificial Sequence: Synthetic peptide
  Seed: RQVPGSNPA (MAGA4_HUMAN)
RLVPGSNPW

SEQ ID NO: 64637 - protein, 10 aa, Artificial Sequence
  Description of Artificial Sequence: Synthetic peptide
  Seed: EMLERVIKNY (MAGA4_HUMAN)
EALERVIKNR

SEQ ID NO: 64638 - protein, 11 aa, Artificial Sequence
  Description of Artificial Sequence: Synthetic peptide
  Seed: GVYDGREHTVY (MAGA4_HUMAN)
GAYDGREHTVY

SEQ ID NO: 64639 - protein, 9 aa, Artificial Sequence
  Description of Artificial Sequence: Synthetic peptide
  Seed: SNKVDELAH (MAGA4_HUMAN)
SIKVDELAY

SEQ ID NO: 64640 - protein, 10 aa, Artificial Sequence
  Description of Artificial Sequence: Synthetic peptide
  Seed: RVRIAYPSLR (MAGA4_HUMAN)
RGRIAYPSLV

SEQ ID NO: 64641 - protein, 9 aa, Artificial Sequence
  Description of Artificial Sequence: Synthetic peptide
  Seed: SYVKVLEHV (MAGA4_HUMAN)
SMVKVLEHM

SEQ ID NO: 64642 - protein, 9 aa, Artificial Sequence
  Description of Artificial Sequence: Synthetic peptide
  Seed: YPSLREAAL (MAGA4_HUMAN)
YASLREAAM

SEQ ID NO: 64643 - protein, 10 aa, Artificial Sequence
  Description of Artificial Sequence: Synthetic peptide
  Seed: QIFPKTGLLI (MAGA4_HUMAN)
QYFPKTGLLM

SEQ ID NO: 64644 - protein, 10 aa, Artificial Sequence
  Description of Artificial Sequence: Synthetic peptide
  Seed: TQDWVQENYL (MAGA4_HUMAN)
TADWVQENYM

SEQ ID NO: 64645 - protein, 9 aa, Artificial Sequence
  Description of Artificial Sequence: Synthetic peptide
  Seed: FREALSNKV (MAGA4_HUMAN)
FHEALSNKM

SEQ ID NO: 64646 - protein, 9 aa, Artificial Sequence
  Description of Artificial Sequence: Synthetic peptide
  Seed: SSPLVPGTL (MAGA4_HUMAN)
SFPLVPGTY

SEQ ID NO: 64647 - protein, 10 aa, Artificial Sequence
  Description of Artificial Sequence: Synthetic peptide
  Seed: VYDGREHTVY (MAGA4_HUMAN)
VMDGREHTVY

SEQ ID NO: 64648 - protein, 10 aa, Artificial Sequence
  Description of Artificial Sequence: Synthetic peptide
  Seed: RVRIAYPSLR (MAGA4_HUMAN)
RDRIAYPSLY

SEQ ID NO: 64649 - protein, 11 aa, Artificial Sequence
  Description of Artificial Sequence: Synthetic peptide
  Seed: SSSSPLVPGTL (MAGA4_HUMAN)
SGSSPLVPGTW

SEQ ID NO: 64650 - protein, 9 aa, Artificial Sequence
  Description of Artificial Sequence: Synthetic peptide
  Seed: TVYGEPRKL (MAGA4_HUMAN)
TMYGEPRKR

SEQ ID NO: 64651 - protein, 9 aa, Artificial Sequence
  Description of Artificial Sequence: Synthetic peptide
  Seed: KVDELAHFL (MAGA4_HUMAN)
KADELAHFW

SEQ ID NO: 64652 - protein, 9 aa, Artificial Sequence
  Description of Artificial Sequence: Synthetic peptide
  Seed: KASESLKMI (MAGA4_HUMAN)
KSSESLKMI

SEQ ID NO: 64653 - protein, 10 aa, Artificial Sequence
  Description of Artificial Sequence: Synthetic peptide
  Seed: LLGNNQIFPK (MAGA4_HUMAN)
LLGNNQIFPR

SEQ ID NO: 64654 - protein, 9 aa, Artificial Sequence
  Description of Artificial Sequence: Synthetic peptide
  Seed: ALSNKVDEL (MAGA4_HUMAN)
AMSNKVDEV

SEQ ID NO: 64655 - protein, 9 aa, Artificial Sequence
  Description of Artificial Sequence: Synthetic peptide
  Seed: TSPDAESLF (MAGA4_HUMAN)
TWPDAESLM

SEQ ID NO: 64656 - protein, 11 aa, Artificial Sequence
  Description of Artificial Sequence: Synthetic peptide
  Seed: RQVPGSNPARY (MAGA4_HUMAN)
RIVPGSNPARR

SEQ ID NO: 64657 - protein, 8 aa, Artificial Sequence
  Description of Artificial Sequence: Synthetic peptide
  Seed: RVRIAYPS (MAGA4_HUMAN)
RTRIAYPM

SEQ ID NO: 64658 - protein, 9 aa, Artificial Sequence
  Description of Artificial Sequence: Synthetic peptide
  Seed: GTLEEVPAA (MAGA4_HUMAN)
GLLEEVPAI

SEQ ID NO: 64659 - protein, 9 aa, Artificial Sequence
  Description of Artificial Sequence: Synthetic peptide
  Seed: WVQENYLEY (MAGA4_HUMAN)
WTQENYLEK

SEQ ID NO: 64660 - protein, 9 aa, Artificial Sequence
  Description of Artificial Sequence: Synthetic peptide
  Seed: IIVLGTIAM (MAGA4_HUMAN)
IKVLGTIAY

SEQ ID NO: 64661 - protein, 9 aa, Artificial Sequence
  Description of Artificial Sequence: Synthetic peptide
  Seed: SALPTTISF (MAGA4_HUMAN)
SDLPTTISV

SEQ ID NO: 64662 - protein, 10 aa, Artificial Sequence
  Description of Artificial Sequence: Synthetic peptide
  Seed: NYKRCFPVIF (MAGA4_HUMAN)
NQKRCFPVIF

SEQ ID NO: 64663 - protein, 10 aa, Artificial Sequence
  Description of Artificial Sequence: Synthetic peptide
  Seed: GVYDGREHTV (MAGA4_HUMAN)
GTYDGREHTF

SEQ ID NO: 64664 - protein, 9 aa, Artificial Sequence
  Description of Artificial Sequence: Synthetic peptide
  Seed: SYVKVLEHV (MAGA4_HUMAN)
SWVKVLEHF

SEQ ID NO: 64665 - protein, 9 aa, Artificial Sequence
  Description of Artificial Sequence: Synthetic peptide
  Seed: SYVKVLEHV (MAGA4_HUMAN)
SLVKVLEHY

SEQ ID NO: 64666 - protein, 9 aa, Artificial Sequence
  Description of Artificial Sequence: Synthetic peptide
  Seed: KYRAKELVT (MAGA4_HUMAN)
KVRAKELVI

SEQ ID NO: 64667 - protein, 9 aa, Artificial Sequence
  Description of Artificial Sequence: Synthetic peptide
  Seed: YVKVLEHVV (MAGA4_HUMAN)
YQKVLEHVL

SEQ ID NO: 64668 - protein, 9 aa, Artificial Sequence
  Description of Artificial Sequence: Synthetic peptide
  Seed: SSSPLVPGT (MAGA4_HUMAN)
SQSPLVPGM

SEQ ID NO: 64669 - protein, 9 aa, Artificial Sequence
  Description of Artificial Sequence: Synthetic peptide
  Seed: YRAKELVTK (MAGA4_HUMAN)
YRAKELVTF

SEQ ID NO: 64670 - protein, 11 aa, Artificial Sequence
  Description of Artificial Sequence: Synthetic peptide
  Seed: RVNARVRIAYP (MAGA4_HUMAN)
RSNARVRIAYK

SEQ ID NO: 64671 - protein, 9 aa, Artificial Sequence
  Description of Artificial Sequence: Synthetic peptide
  Seed: NYKRCFPVI (MAGA4_HUMAN)
NYKRCFPVW

SEQ ID NO: 64672 - protein, 10 aa, Artificial Sequence
  Description of Artificial Sequence: Synthetic peptide
  Seed: PTTISFTCWR (MAGA4_HUMAN)
PRTISFTCWR

SEQ ID NO: 64673 - protein, 10 aa, Artificial Sequence
  Description of Artificial Sequence: Synthetic peptide
  Seed: TLVTCLGLSY (MAGA4_HUMAN)
TVVTCLGLSK

SEQ ID NO: 64674 - protein, 9 aa, Artificial Sequence
  Description of Artificial Sequence: Synthetic peptide
  Seed: SNKVDELAH (MAGA4_HUMAN)
SAKVDELAY

SEQ ID NO: 64675 - protein, 10 aa, Artificial Sequence
  Description of Artificial Sequence: Synthetic peptide
  Seed: SLFREALSNK (MAGA4_HUMAN)
SVFREALSNR

SEQ ID NO: 64676 - protein, 10 aa, Artificial Sequence
  Description of Artificial Sequence: Synthetic peptide
  Seed: YRQVPGSNPA (MAGA4_HUMAN)
YWQVPGSNPM

SEQ ID NO: 64677 - protein, 10 aa, Artificial Sequence
  Description of Artificial Sequence: Synthetic peptide
  Seed: TTISFTCWRQ (MAGA4_HUMAN)
TWISFTCWRK

SEQ ID NO: 64678 - protein, 9 aa, Artificial Sequence
  Description of Artificial Sequence: Synthetic peptide
  Seed: YKRCFPVIF (MAGA4_HUMAN)
YGRCFPVIY

SEQ ID NO: 64679 - protein, 9 aa, Artificial Sequence
  Description of Artificial Sequence: Synthetic peptide
  Seed: RVRIAYPSL (MAGA4_HUMAN)
RPRIAYPSY

SEQ ID NO: 64680 - protein, 10 aa, Artificial Sequence
  Description of Artificial Sequence: Synthetic peptide
  Seed: LIIVLGTIAM (MAGA4_HUMAN)
LMIVLGTIAF

SEQ ID NO: 64681 - protein, 9 aa, Artificial Sequence
  Description of Artificial Sequence: Synthetic peptide
  Seed: LAHFLLRKY (MAGA4_HUMAN)
LTHFLLRKF

SEQ ID NO: 64682 - protein, 10 aa, Artificial Sequence
  Description of Artificial Sequence: Synthetic peptide
  Seed: YPSLREAALL (MAGA4_HUMAN)
YWSLREAALW

SEQ ID NO: 64683 - protein, 9 aa, Artificial Sequence
  Description of Artificial Sequence: Synthetic peptide
  Seed: AESAGPPQS (MAGA4_HUMAN)
AESAGPPQV

SEQ ID NO: 64684 - protein, 9 aa, Artificial Sequence
  Description of Artificial Sequence: Synthetic peptide
  Seed: KVLEHVVRV (MAGA4_HUMAN)
KVLEHVVRA

SEQ ID NO: 64685 - protein, 10 aa, Artificial Sequence
  Description of Artificial Sequence: Synthetic peptide
  Seed: KNYKRCFPVI (MAGA4_HUMAN)
KPYKRCFPVK

SEQ ID NO: 64686 - protein, 10 aa, Artificial Sequence
  Description of Artificial Sequence: Synthetic peptide
  Seed: GVYDGREHTV (MAGA4_HUMAN)
GTYDGREHTI

SEQ ID NO: 64687 - protein, 9 aa, Artificial Sequence
  Description of Artificial Sequence: Synthetic peptide
  Seed: KVDELAHFL (MAGA4_HUMAN)
KVDELAHFI

SEQ ID NO: 64688 - protein, 9 aa, Artificial Sequence
  Description of Artificial Sequence: Synthetic peptide
  Seed: RVRIAYPSL (MAGA4_HUMAN)
RVRIAYPSP

SEQ ID NO: 64689 - protein, 9 aa, Artificial Sequence
  Description of Artificial Sequence: Synthetic peptide
  Seed: SSPLVPGTL (MAGA4_HUMAN)
SLPLVPGTL

SEQ ID NO: 64690 - protein, 10 aa, Artificial Sequence
  Description of Artificial Sequence: Synthetic peptide
  Seed: KRCFPVIFGK (MAGA4_HUMAN)
KSCFPVIFGR

SEQ ID NO: 64691 - protein, 9 aa, Artificial Sequence
  Description of Artificial Sequence: Synthetic peptide
  Seed: GASALPTTI (MAGA4_HUMAN)
GMSALPTTL

SEQ ID NO: 64692 - protein, 9 aa, Artificial Sequence
  Description of Artificial Sequence: Synthetic peptide
  Seed: RVRIAYPSL (MAGA4_HUMAN)
RLRIAYPSM

SEQ ID NO: 64693 - protein, 10 aa, Artificial Sequence
  Description of Artificial Sequence: Synthetic peptide
  Seed: RVRIAYPSLR (MAGA4_HUMAN)
RVRIAYPSLA

SEQ ID NO: 64694 - protein, 11 aa, Artificial Sequence
  Description of Artificial Sequence: Synthetic peptide
  Seed: ESLFREALSNK (MAGA4_HUMAN)
EVLFREALSNR

SEQ ID NO: 64695 - protein, 10 aa, Artificial Sequence
  Description of Artificial Sequence: Synthetic peptide
  Seed: FGKASESLKM (MAGA4_HUMAN)
FNKASESLKF

SEQ ID NO: 64696 - protein, 9 aa, Artificial Sequence
  Description of Artificial Sequence: Synthetic peptide
  Seed: QSPQGASAL (MAGA4_HUMAN)
QVPQGASAK

SEQ ID NO: 64697 - protein, 9 aa, Artificial Sequence
  Description of Artificial Sequence: Synthetic peptide
  Seed: SSSPLVPGT (MAGA4_HUMAN)
SVSPLVPGV

SEQ ID NO: 64698 - protein, 9 aa, Artificial Sequence
  Description of Artificial Sequence: Synthetic peptide
  Seed: HVVRVNARV (MAGA4_HUMAN)
HSVRVNARV

SEQ ID NO: 64699 - protein, 10 aa, Artificial Sequence
  Description of Artificial Sequence: Synthetic peptide
  Seed: AYPSLREAAL (MAGA4_HUMAN)
AIPSLREAAL

SEQ ID NO: 64700 - protein, 9 aa, Artificial Sequence
  Description of Artificial Sequence: Synthetic peptide
  Seed: GSNPARYEF (MAGA4_HUMAN)
GMNPARYEW

SEQ ID NO: 64701 - protein, 9 aa, Artificial Sequence
  Description of Artificial Sequence: Synthetic peptide
  Seed: KVDELAHFL (MAGA4_HUMAN)
KSDELAHFW

SEQ ID NO: 64702 - protein, 11 aa, Artificial Sequence
  Description of Artificial Sequence: Synthetic peptide
  Seed: ELVTKAEMLER (MAGA4_HUMAN)
EVVTKAEMLER

SEQ ID NO: 64703 - protein, 9 aa, Artificial Sequence
  Description of Artificial Sequence: Synthetic peptide
  Seed: IAYPSLREA (MAGA4_HUMAN)
IGYPSLREY

SEQ ID NO: 64704 - protein, 9 aa, Artificial Sequence
  Description of Artificial Sequence: Synthetic peptide
  Seed: RVRIAYPSL (MAGA4_HUMAN)
RVRIAYPSQ

SEQ ID NO: 64705 - protein, 9 aa, Artificial Sequence
  Description of Artificial Sequence: Synthetic peptide
  Seed: VEAQEEALG (MAGA4_HUMAN)
VEAQEEALV

SEQ ID NO: 64706 - protein, 11 aa, Artificial Sequence
  Description of Artificial Sequence: Synthetic peptide
  Seed: AQEEALGLVGA (MAGA4_HUMAN)
AEEEALGLVGA

SEQ ID NO: 64707 - protein, 10 aa, Artificial Sequence
  Description of Artificial Sequence: Synthetic peptide
  Seed: ELAHFLLRKY (MAGA4_HUMAN)
ETAHFLLRKK

SEQ ID NO: 64708 - protein, 9 aa, Artificial Sequence
  Description of Artificial Sequence: Synthetic peptide
  Seed: YKRCFPVIF (MAGA4_HUMAN)
YHRCFPVIF

SEQ ID NO: 64709 - protein, 11 aa, Artificial Sequence
  Description of Artificial Sequence: Synthetic peptide
  Seed: VIFGKASESLK (MAGA4_HUMAN)
VTFGKASESLR

SEQ ID NO: 64710 - protein, 10 aa, Artificial Sequence
  Description of Artificial Sequence: Synthetic peptide
  Seed: EAAVSSSSPL (MAGA4_HUMAN)
EAAVSSSSPV

SEQ ID NO: 64711 - protein, 9 aa, Artificial Sequence
  Description of Artificial Sequence: Synthetic peptide
  Seed: SSSPLVPGT (MAGA4_HUMAN)
SQSPLVPGV

SEQ ID NO: 64712 - protein, 9 aa, Artificial Sequence
  Description of Artificial Sequence: Synthetic peptide
  Seed: AHFLLRKYR (MAGA4_HUMAN)
AYFLLRKYR

SEQ ID NO: 64713 - protein, 9 aa, Artificial Sequence
  Description of Artificial Sequence: Synthetic peptide
  Seed: KEVDPASNT (MAGA4_HUMAN)
KEVDPASNC

SEQ ID NO: 64714 - protein, 9 aa, Artificial Sequence
  Description of Artificial Sequence: Synthetic peptide
  Seed: GVMGVYDGR (MAGA4_HUMAN)
GIMGVYDGR

SEQ ID NO: 64715 - protein, 9 aa, Artificial Sequence
  Description of Artificial Sequence: Synthetic peptide
  Seed: KVDELAHFL (MAGA4_HUMAN)
KQDELAHFL

SEQ ID NO: 64716 - protein, 11 aa, Artificial Sequence
  Description of Artificial Sequence: Synthetic peptide
  Seed: REALSNKVDEL (MAGA4_HUMAN)
RQALSNKVDEM

SEQ ID NO: 64717 - protein, 10 aa, Artificial Sequence
  Description of Artificial Sequence: Synthetic peptide
  Seed: KASESLKMIF (MAGA4_HUMAN)
KSSESLKMIY

SEQ ID NO: 64718 - protein, 10 aa, Artificial Sequence
  Description of Artificial Sequence: Synthetic peptide
  Seed: RQVPGSNPAR (MAGA4_HUMAN)
RHVPGSNPAY

SEQ ID NO: 64719 - protein, 9 aa, Artificial Sequence
  Description of Artificial Sequence: Synthetic peptide
  Seed: RCFPVIFGK (MAGA4_HUMAN)
RLFPVIFGL

SEQ ID NO: 64720 - protein, 10 aa, Artificial Sequence
  Description of Artificial Sequence: Synthetic peptide
  Seed: KVDELAHFLL (MAGA4_HUMAN)
KQDELAHFLF

SEQ ID NO: 64721 - protein, 10 aa, Artificial Sequence
  Description of Artificial Sequence: Synthetic peptide
  Seed: TTISFTCWRQ (MAGA4_HUMAN)
TTISFTCWRA

SEQ ID NO: 64722 - protein, 9 aa, Artificial Sequence
  Description of Artificial Sequence: Synthetic peptide
  Seed: RQVPGSNPA (MAGA4_HUMAN)
RPVPGSNPY

SEQ ID NO: 64723 - protein, 9 aa, Artificial Sequence
  Description of Artificial Sequence: Synthetic peptide
  Seed: AAVSSSSPL (MAGA4_HUMAN)
APVSSSSPT

SEQ ID NO: 64724 - protein, 9 aa, Artificial Sequence
  Description of Artificial Sequence: Synthetic peptide
  Seed: SSPLVPGTL (MAGA4_HUMAN)
SYPLVPGTI

SEQ ID NO: 64725 - protein, 10 aa, Artificial Sequence
  Description of Artificial Sequence: Synthetic peptide
  Seed: YRQVPGSNPA (MAGA4_HUMAN)
YRQVPGSNPV

SEQ ID NO: 64726 - protein, 11 aa, Artificial Sequence
  Description of Artificial Sequence: Synthetic peptide
  Seed: KVDELAHFLLR (MAGA4_HUMAN)
KFDELAHFLLR

SEQ ID NO: 64727 - protein, 10 aa, Artificial Sequence
  Description of Artificial Sequence: Synthetic peptide
  Seed: VDPASNTYTL (MAGA4_HUMAN)
VHPASNTYTM

SEQ ID NO: 64728 - protein, 9 aa, Artificial Sequence
  Description of Artificial Sequence: Synthetic peptide
  Seed: SEEEIWEEL (MAGA4_HUMAN)
SVEEIWEEM

SEQ ID NO: 64729 - protein, 11 aa, Artificial Sequence
  Description of Artificial Sequence: Synthetic peptide
  Seed: VIFGKASESLK (MAGA4_HUMAN)
VAFGKASESLY

SEQ ID NO: 64730 - protein, 9 aa, Artificial Sequence
  Description of Artificial Sequence: Synthetic peptide
  Seed: WVQENYLEY (MAGA4_HUMAN)
WKQENYLEM

SEQ ID NO: 64731 - protein, 9 aa, Artificial Sequence
  Description of Artificial Sequence: Synthetic peptide
  Seed: IAYPSLREA (MAGA4_HUMAN)
IMYPSLREF

SEQ ID NO: 64732 - protein, 9 aa, Artificial Sequence
  Description of Artificial Sequence: Synthetic peptide
  Seed: VYDGREHTV (MAGA4_HUMAN)
VMDGREHTI

SEQ ID NO: 64733 - protein, 9 aa, Artificial Sequence
  Description of Artificial Sequence: Synthetic peptide
  Seed: FREALSNKV (MAGA4_HUMAN)
FHEALSNKV

SEQ ID NO: 64734 - protein, 10 aa, Artificial Sequence
  Description of Artificial Sequence: Synthetic peptide
  Seed: SLFREALSNK (MAGA4_HUMAN)
SRFREALSNR

SEQ ID NO: 64735 - protein, 9 aa, Artificial Sequence
  Description of Artificial Sequence: Synthetic peptide
  Seed: SSPLVPGTL (MAGA4_HUMAN)
SQPLVPGTL

SEQ ID NO: 64736 - protein, 9 aa, Artificial Sequence
  Description of Artificial Sequence: Synthetic peptide
  Seed: KVLEHVVRV (MAGA4_HUMAN)
KGLEHVVRI

SEQ ID NO: 64737 - protein, 10 aa, Artificial Sequence
  Description of Artificial Sequence: Synthetic peptide
  Seed: IAYPSLREAA (MAGA4_HUMAN)
ISYPSLREAY

SEQ ID NO: 64738 - protein, 9 aa, Artificial Sequence
  Description of Artificial Sequence: Synthetic peptide
  Seed: IAYPSLREA (MAGA4_HUMAN)
IRYPSLREV

SEQ ID NO: 64739 - protein, 10 aa, Artificial Sequence
  Description of Artificial Sequence: Synthetic peptide
  Seed: SSSPLVPGTL (MAGA4_HUMAN)
SSSPLVPGTF

SEQ ID NO: 64740 - protein, 9 aa, Artificial Sequence
  Description of Artificial Sequence: Synthetic peptide
  Seed: KVLEHVVRV (MAGA4_HUMAN)
KGLEHVVRK

SEQ ID NO: 64741 - protein, 8 aa, Artificial Sequence
  Description of Artificial Sequence: Synthetic peptide
  Seed: VYGEPRKL (MAGA4_HUMAN)
VFGEPRKF

SEQ ID NO: 64742 - protein, 10 aa, Artificial Sequence
  Description of Artificial Sequence: Synthetic peptide
  Seed: SESLKMIFGI (MAGA4_HUMAN)
SRSLKMIFGW

SEQ ID NO: 64743 - protein, 9 aa, Artificial Sequence
  Description of Artificial Sequence: Synthetic peptide
  Seed: TVYGEPRKL (MAGA4_HUMAN)
TVYGEPRKW

SEQ ID NO: 64744 - protein, 9 aa, Artificial Sequence
  Description of Artificial Sequence: Synthetic peptide
  Seed: SPDAESLFR (MAGA4_HUMAN)
SIDAESLFY

SEQ ID NO: 64745 - protein, 9 aa, Artificial Sequence
  Description of Artificial Sequence: Synthetic peptide
  Seed: RVRIAYPSL (MAGA4_HUMAN)
RIRIAYPSF

SEQ ID NO: 64746 - protein, 9 aa, Artificial Sequence
  Description of Artificial Sequence: Synthetic peptide
  Seed: KASESLKMI (MAGA4_HUMAN)
KMSESLKMI

SEQ ID NO: 64747 - protein, 10 aa, Artificial Sequence
  Description of Artificial Sequence: Synthetic peptide
  Seed: FGKASESLKM (MAGA4_HUMAN)
FAKASESLKY

SEQ ID NO: 64748 - protein, 9 aa, Artificial Sequence
  Description of Artificial Sequence: Synthetic peptide
  Seed: ALPTTISFT (MAGA4_HUMAN)
ATPTTISFV

SEQ ID NO: 64749 - protein, 10 aa, Artificial Sequence
  Description of Artificial Sequence: Synthetic peptide
  Seed: KNYKRCFPVI (MAGA4_HUMAN)
KQYKRCFPVA

SEQ ID NO: 64750 - protein, 9 aa, Artificial Sequence
  Description of Artificial Sequence: Synthetic peptide
  Seed: RCFPVIFGK (MAGA4_HUMAN)
RLFPVIFGF

SEQ ID NO: 64751 - protein, 10 aa, Artificial Sequence
  Description of Artificial Sequence: Synthetic peptide
  Seed: AYPSLREAAL (MAGA4_HUMAN)
AMPSLREAAL

SEQ ID NO: 64752 - protein, 9 aa, Artificial Sequence
  Description of Artificial Sequence: Synthetic peptide
  Seed: TSPDAESLF (MAGA4_HUMAN)
TAPDAESLI

SEQ ID NO: 64753 - protein, 10 aa, Artificial Sequence
  Description of Artificial Sequence: Synthetic peptide
  Seed: ARVRIAYPSL (MAGA4_HUMAN)
AFVRIAYPSV

SEQ ID NO: 64754 - protein, 9 aa, Artificial Sequence
  Description of Artificial Sequence: Synthetic peptide
  Seed: TSPDAESLF (MAGA4_HUMAN)
TVPDAESLM

SEQ ID NO: 64755 - protein, 9 aa, Artificial Sequence
  Description of Artificial Sequence: Synthetic peptide
  Seed: ELAHFLLRK (MAGA4_HUMAN)
ENAHFLLRR

SEQ ID NO: 64756 - protein, 9 aa, Artificial Sequence
  Description of Artificial Sequence: Synthetic peptide
  Seed: RVRIAYPSL (MAGA4_HUMAN)
RARIAYPSV

SEQ ID NO: 64757 - protein, 10 aa, Artificial Sequence
  Description of Artificial Sequence: Synthetic peptide
  Seed: LTQDWVQENY (MAGA4_HUMAN)
LSQDWVQENW

SEQ ID NO: 64758 - protein, 9 aa, Artificial Sequence
  Description of Artificial Sequence: Synthetic peptide
  Seed: SALPTTISF (MAGA4_HUMAN)
SSLPTTISV

SEQ ID NO: 64759 - protein, 9 aa, Artificial Sequence
  Description of Artificial Sequence: Synthetic peptide
  Seed: IFPKTGLLI (MAGA4_HUMAN)
ILPKTGLLM

SEQ ID NO: 64760 - protein, 9 aa, Artificial Sequence
  Description of Artificial Sequence: Synthetic peptide
  Seed: AAVSSSSPL (MAGA4_HUMAN)
ARVSSSSPF

SEQ ID NO: 64761 - protein, 10 aa, Artificial Sequence
  Description of Artificial Sequence: Synthetic peptide
  Seed: STSPDAESLF (MAGA4_HUMAN)
SISPDAESLW

SEQ ID NO: 64762 - protein, 9 aa, Artificial Sequence
  Description of Artificial Sequence: Synthetic peptide
  Seed: KVLEHVVRV (MAGA4_HUMAN)
KSLEHVVRM

SEQ ID NO: 64763 - protein, 10 aa, Artificial Sequence
  Description of Artificial Sequence: Synthetic peptide
  Seed: SLFREALSNK (MAGA4_HUMAN)
SGFREALSNR

SEQ ID NO: 64764 - protein, 10 aa, Artificial Sequence
  Description of Artificial Sequence: Synthetic peptide
  Seed: EHVVRVNARV (MAGA4_HUMAN)
EEVVRVNARV

SEQ ID NO: 64765 - protein, 10 aa, Artificial Sequence
  Description of Artificial Sequence: Synthetic peptide
  Seed: LPTTISFTCW (MAGA4_HUMAN)
LWTTISFTCW

SEQ ID NO: 64766 - protein, 9 aa, Artificial Sequence
  Description of Artificial Sequence: Synthetic peptide
  Seed: EEVPAAESA (MAGA4_HUMAN)
ERVPAAESA

SEQ ID NO: 64767 - protein, 9 aa, Artificial Sequence
  Description of Artificial Sequence: Synthetic peptide
  Seed: VYGEPRKLL (MAGA4_HUMAN)
VAGEPRKLL

SEQ ID NO: 64768 - protein, 10 aa, Artificial Sequence
  Description of Artificial Sequence: Synthetic peptide
  Seed: RVRIAYPSLR (MAGA4_HUMAN)
RYRIAYPSLF

SEQ ID NO: 64769 - protein, 10 aa, Artificial Sequence
  Description of Artificial Sequence: Synthetic peptide
  Seed: RVRIAYPSLR (MAGA4_HUMAN)
RWRIAYPSLA

SEQ ID NO: 64770 - protein, 9 aa, Artificial Sequence
  Description of Artificial Sequence: Synthetic peptide
  Seed: WVQENYLEY (MAGA4_HUMAN)
WLQENYLEF

SEQ ID NO: 64771 - protein, 10 aa, Artificial Sequence
  Description of Artificial Sequence: Synthetic peptide
  Seed: ASALPTTISF (MAGA4_HUMAN)
AYALPTTISM

SEQ ID NO: 64772 - protein, 9 aa, Artificial Sequence
  Description of Artificial Sequence: Synthetic peptide
  Seed: SEQKSQHCK (MAGA4_HUMAN)
SEQKSQHCM

SEQ ID NO: 64773 - protein, 9 aa, Artificial Sequence
  Description of Artificial Sequence: Synthetic peptide
  Seed: LAHFLLRKY (MAGA4_HUMAN)
LSHFLLRKF

SEQ ID NO: 64774 - protein, 9 aa, Artificial Sequence
  Description of Artificial Sequence: Synthetic peptide
  Seed: ALSNKVDEL (MAGA4_HUMAN)
AISNKVDEI

SEQ ID NO: 64775 - protein, 10 aa, Artificial Sequence
  Description of Artificial Sequence: Synthetic peptide
  Seed: QEEEGPSTSP (MAGA4_HUMAN)
QEEEGPSTSM

SEQ ID NO: 64776 - protein, 10 aa, Artificial Sequence
  Description of Artificial Sequence: Synthetic peptide
  Seed: ARVRIAYPSL (MAGA4_HUMAN)
ALVRIAYPSA

SEQ ID NO: 64777 - protein, 9 aa, Artificial Sequence
  Description of Artificial Sequence: Synthetic peptide
  Seed: AAVSSSSPL (MAGA4_HUMAN)
AQVSSSSPA

SEQ ID NO: 64778 - protein, 10 aa, Artificial Sequence
  Description of Artificial Sequence: Synthetic peptide
  Seed: HVVRVNARVR (MAGA4_HUMAN)
HAVRVNARVR

SEQ ID NO: 64779 - protein, 10 aa, Artificial Sequence
  Description of Artificial Sequence: Synthetic peptide
  Seed: EHVVRVNARV (MAGA4_HUMAN)
ECVVRVNARV

SEQ ID NO: 64780 - protein, 10 aa, Artificial Sequence
  Description of Artificial Sequence: Synthetic peptide
  Seed: SEEEIWEELG (MAGA4_HUMAN)
SEEEIWEELL

SEQ ID NO: 64781 - protein, 9 aa, Artificial Sequence
  Description of Artificial Sequence: Synthetic peptide
  Seed: LGNNQIFPK (MAGA4_HUMAN)
LNNNQIFPR

SEQ ID NO: 64782 - protein, 9 aa, Artificial Sequence
  Description of Artificial Sequence: Synthetic peptide
  Seed: RVRIAYPSL (MAGA4_HUMAN)
RWRIAYPSA

SEQ ID NO: 64783 - protein, 9 aa, Artificial Sequence
  Description of Artificial Sequence: Synthetic peptide
  Seed: SEEEIWEEL (MAGA4_HUMAN)
SHEEIWEEV

SEQ ID NO: 64784 - protein, 8 aa, Artificial Sequence
  Description of Artificial Sequence: Synthetic peptide
  Seed: REALSNKV (MAGA4_HUMAN)
RDALSNKL

SEQ ID NO: 64785 - protein, 10 aa, Artificial Sequence
  Description of Artificial Sequence: Synthetic peptide
  Seed: GVYDGREHTV (MAGA4_HUMAN)
GSYDGREHTY

SEQ ID NO: 64786 - protein, 10 aa, Artificial Sequence
  Description of Artificial Sequence: Synthetic peptide
  Seed: AYPSLREAAL (MAGA4_HUMAN)
AAPSLREAAL

SEQ ID NO: 64787 - protein, 9 aa, Artificial Sequence
  Description of Artificial Sequence: Synthetic peptide
  Seed: REAALLEEE (MAGA4_HUMAN)
REAALLEES

SEQ ID NO: 64788 - protein, 10 aa, Artificial Sequence
  Description of Artificial Sequence: Synthetic peptide
  Seed: QEAAVSSSSP (MAGA4_HUMAN)
QEAAVSSSSV

SEQ ID NO: 64789 - protein, 9 aa, Artificial Sequence
  Description of Artificial Sequence: Synthetic peptide
  Seed: VNARVRIAY (MAGA4_HUMAN)
VTARVRIAL

SEQ ID NO: 64790 - protein, 9 aa, Artificial Sequence
  Description of Artificial Sequence: Synthetic peptide
  Seed: KVDELAHFL (MAGA4_HUMAN)
KSDELAHFV

SEQ ID NO: 64791 - protein, 10 aa, Artificial Sequence
  Description of Artificial Sequence: Synthetic peptide
  Seed: RVRIAYPSLR (MAGA4_HUMAN)
RMRIAYPSLT

SEQ ID NO: 64792 - protein, 9 aa, Artificial Sequence
  Description of Artificial Sequence: Synthetic peptide
  Seed: ELAHFLLRK (MAGA4_HUMAN)
EFAHFLLRR

SEQ ID NO: 64793 - protein, 8 aa, Artificial Sequence
  Description of Artificial Sequence: Synthetic peptide
  Seed: FLLRKYRA (MAGA4_HUMAN)
FILRKYRL

SEQ ID NO: 64794 - protein, 10 aa, Artificial Sequence
  Description of Artificial Sequence: Synthetic peptide
  Seed: YRQVPGSNPA (MAGA4_HUMAN)
YAQVPGSNPM

SEQ ID NO: 64795 - protein, 9 aa, Artificial Sequence
  Description of Artificial Sequence: Synthetic peptide
  Seed: RCFPVIFGK (MAGA4_HUMAN)
RTFPVIFGF

SEQ ID NO: 64796 - protein, 9 aa, Artificial Sequence
  Description of Artificial Sequence: Synthetic peptide
  Seed: NQIFPKTGL (MAGA4_HUMAN)
NEIFPKTGM

SEQ ID NO: 64797 - protein, 9 aa, Artificial Sequence
  Description of Artificial Sequence: Synthetic peptide
  Seed: NPARYEFLW (MAGA4_HUMAN)
NGARYEFLW

SEQ ID NO: 64798 - protein, 9 aa, Artificial Sequence
  Description of Artificial Sequence: Synthetic peptide
  Seed: GSNPARYEF (MAGA4_HUMAN)
GFNPARYEY

SEQ ID NO: 64799 - protein, 9 aa, Artificial Sequence
  Description of Artificial Sequence: Synthetic peptide
  Seed: NQIFPKTGL (MAGA4_HUMAN)
NHIFPKTGY

SEQ ID NO: 64800 - protein, 9 aa, Artificial Sequence
  Description of Artificial Sequence: Synthetic peptide
  Seed: IAYPSLREA (MAGA4_HUMAN)
IYYPSLREL

SEQ ID NO: 64801 - protein, 9 aa, Artificial Sequence
  Description of Artificial Sequence: Synthetic peptide
  Seed: KYRAKELVT (MAGA4_HUMAN)
KFRAKELVA

SEQ ID NO: 64802 - protein, 10 aa, Artificial Sequence
  Description of Artificial Sequence: Synthetic peptide
  Seed: YRQVPGSNPA (MAGA4_HUMAN)
YTQVPGSNPI

SEQ ID NO: 64803 - protein, 9 aa, Artificial Sequence
  Description of Artificial Sequence: Synthetic peptide
  Seed: YPSLREAAL (MAGA4_HUMAN)
YPSLREAAM

SEQ ID NO: 64804 - protein, 9 aa, Artificial Sequence
  Description of Artificial Sequence: Synthetic peptide
  Seed: GSNPARYEF (MAGA4_HUMAN)
GYNPARYEY

SEQ ID NO: 64805 - protein, 10 aa, Artificial Sequence
  Description of Artificial Sequence: Synthetic peptide
  Seed: KNYKRCFPVI (MAGA4_HUMAN)
KSYKRCFPVF

SEQ ID NO: 64806 - protein, 9 aa, Artificial Sequence
  Description of Artificial Sequence: Synthetic peptide
  Seed: EVDPASNTY (MAGA4_HUMAN)
EIDPASNTM

SEQ ID NO: 64807 - protein, 10 aa, Artificial Sequence
  Description of Artificial Sequence: Synthetic peptide
  Seed: RVRIAYPSLR (MAGA4_HUMAN)
RTRIAYPSLS

SEQ ID NO: 64808 - protein, 11 aa, Artificial Sequence
  Description of Artificial Sequence: Synthetic peptide
  Seed: SSSSPLVPGTL (MAGA4_HUMAN)
SASSPLVPGTM

SEQ ID NO: 64809 - protein, 9 aa, Artificial Sequence
  Description of Artificial Sequence: Synthetic peptide
  Seed: SYVKVLEHV (MAGA4_HUMAN)
SLVKVLEHV

SEQ ID NO: 64810 - protein, 9 aa, Artificial Sequence
  Description of Artificial Sequence: Synthetic peptide
  Seed: YDGREHTVY (MAGA4_HUMAN)
YAGREHTVY

SEQ ID NO: 64811 - protein, 9 aa, Artificial Sequence
  Description of Artificial Sequence: Synthetic peptide
  Seed: TSPDAESLF (MAGA4_HUMAN)
TGPDAESLM

SEQ ID NO: 64812 - protein, 10 aa, Artificial Sequence
  Description of Artificial Sequence: Synthetic peptide
  Seed: MLERVIKNYK (MAGA4_HUMAN)
MTERVIKNYR

SEQ ID NO: 64813 - protein, 10 aa, Artificial Sequence
  Description of Artificial Sequence: Synthetic peptide
  Seed: SLFREALSNK (MAGA4_HUMAN)
SYFREALSNK

SEQ ID NO: 64814 - protein, 10 aa, Artificial Sequence
  Description of Artificial Sequence: Synthetic peptide
  Seed: KVLEHVVRVN (MAGA4_HUMAN)
KMLEHVVRVH

SEQ ID NO: 64815 - protein, 11 aa, Artificial Sequence
  Description of Artificial Sequence: Synthetic peptide
  Seed: SASEEEIWEEL (MAGA4_HUMAN)
SMSEEEIWEEL

SEQ ID NO: 64816 - protein, 9 aa, Artificial Sequence
  Description of Artificial Sequence: Synthetic peptide
  Seed: RVRIAYPSL (MAGA4_HUMAN)
RVRIAYPSE

SEQ ID NO: 64817 - protein, 9 aa, Artificial Sequence
  Description of Artificial Sequence: Synthetic peptide
  Seed: RCFPVIFGK (MAGA4_HUMAN)
RTFPVIFGR

SEQ ID NO: 64818 - protein, 9 aa, Artificial Sequence
  Description of Artificial Sequence: Synthetic peptide
  Seed: AESLFREAL (MAGA4_HUMAN)
AKSLFREAY

SEQ ID NO: 64819 - protein, 10 aa, Artificial Sequence
  Description of Artificial Sequence: Synthetic peptide
  Seed: IFPKTGLLII (MAGA4_HUMAN)
IYPKTGLLIW

SEQ ID NO: 64820 - protein, 9 aa, Artificial Sequence
  Description of Artificial Sequence: Synthetic peptide
  Seed: LRKYRAKEL (MAGA4_HUMAN)
LMKYRAKEL

SEQ ID NO: 64821 - protein, 9 aa, Artificial Sequence
  Description of Artificial Sequence: Synthetic peptide
  Seed: YPSLREAAL (MAGA4_HUMAN)
YRSLREAAM

SEQ ID NO: 64822 - protein, 11 aa, Artificial Sequence
  Description of Artificial Sequence: Synthetic peptide
  Seed: SSSSPLVPGTL (MAGA4_HUMAN)
SSSSPLVPGTY

SEQ ID NO: 64823 - protein, 9 aa, Artificial Sequence
  Description of Artificial Sequence: Synthetic peptide
  Seed: DPASNTYTL (MAGA4_HUMAN)
DPASNTYTM

SEQ ID NO: 64824 - protein, 9 aa, Artificial Sequence
  Description of Artificial Sequence: Synthetic peptide
  Seed: VYDGREHTV (MAGA4_HUMAN)
VADGREHTA

SEQ ID NO: 64825 - protein, 9 aa, Artificial Sequence
  Description of Artificial Sequence: Synthetic peptide
  Seed: DPASNTYTL (MAGA4_HUMAN)
DSASNTYTY

SEQ ID NO: 64826 - protein, 9 aa, Artificial Sequence
  Description of Artificial Sequence: Synthetic peptide
  Seed: SAGPPQSPQ (MAGA4_HUMAN)
SAGPPQSPL

SEQ ID NO: 64827 - protein, 8 aa, Artificial Sequence
  Description of Artificial Sequence: Synthetic peptide
  Seed: KVDELAHF (MAGA4_HUMAN)
KFDELAHL

SEQ ID NO: 64828 - protein, 9 aa, Artificial Sequence
  Description of Artificial Sequence: Synthetic peptide
  Seed: IAYPSLREA (MAGA4_HUMAN)
IAYPSLREF

SEQ ID NO: 64829 - protein, 10 aa, Artificial Sequence
  Description of Artificial Sequence: Synthetic peptide
  Seed: MLERVIKNYK (MAGA4_HUMAN)
MFERVIKNYR

SEQ ID NO: 64830 - protein, 9 aa, Artificial Sequence
  Description of Artificial Sequence: Synthetic peptide
  Seed: EELGVMGVY (MAGA4_HUMAN)
EELGVMGVF

SEQ ID NO: 64831 - protein, 11 aa, Artificial Sequence
  Description of Artificial Sequence: Synthetic peptide
  Seed: LSNKVDELAHF (MAGA4_HUMAN)
LSNKVDELAHW

SEQ ID NO: 64832 - protein, 10 aa, Artificial Sequence
  Description of Artificial Sequence: Synthetic peptide
  Seed: NKVDELAHFL (MAGA4_HUMAN)
NHVDELAHFL

SEQ ID NO: 64833 - protein, 10 aa, Artificial Sequence
  Description of Artificial Sequence: Synthetic peptide
  Seed: ARVRIAYPSL (MAGA4_HUMAN)
AMVRIAYPSA

SEQ ID NO: 64834 - protein, 10 aa, Artificial Sequence
  Description of Artificial Sequence: Synthetic peptide
  Seed: RVRIAYPSLR (MAGA4_HUMAN)
RVRIAYPSLV

SEQ ID NO: 64835 - protein, 9 aa, Artificial Sequence
  Description of Artificial Sequence: Synthetic peptide
  Seed: KVLEHVVRV (MAGA4_HUMAN)
KVLEHVVRL

SEQ ID NO: 64836 - protein, 9 aa, Artificial Sequence
  Description of Artificial Sequence: Synthetic peptide
  Seed: NKVDELAHF (MAGA4_HUMAN)
NHVDELAHI

SEQ ID NO: 64837 - protein, 11 aa, Artificial Sequence
  Description of Artificial Sequence: Synthetic peptide
  Seed: SYDGLLGNNQI (MAGA4_HUMAN)
SYDGLLGNNQL

SEQ ID NO: 64838 - protein, 10 aa, Artificial Sequence
  Description of Artificial Sequence: Synthetic peptide
  Seed: RVRIAYPSLR (MAGA4_HUMAN)
RCRIAYPSLV

SEQ ID NO: 64839 - protein, 10 aa, Artificial Sequence
  Description of Artificial Sequence: Synthetic peptide
  Seed: EHTVYGEPRK (MAGA4_HUMAN)
EGTVYGEPRR

SEQ ID NO: 64840 - protein, 10 aa, Artificial Sequence
  Description of Artificial Sequence: Synthetic peptide
  Seed: RVRIAYPSLR (MAGA4_HUMAN)
RHRIAYPSLI

SEQ ID NO: 64841 - protein, 9 aa, Artificial Sequence
  Description of Artificial Sequence: Synthetic peptide
  Seed: FPKTGLLII (MAGA4_HUMAN)
FPKTGLLIM

SEQ ID NO: 64842 - protein, 9 aa, Artificial Sequence
  Description of Artificial Sequence: Synthetic peptide
  Seed: VYDGREHTV (MAGA4_HUMAN)
VQDGREHTI

SEQ ID NO: 64843 - protein, 10 aa, Artificial Sequence
  Description of Artificial Sequence: Synthetic peptide
  Seed: ELAHFLLRKY (MAGA4_HUMAN)
EVAHFLLRKR

SEQ ID NO: 64844 - protein, 9 aa, Artificial Sequence
  Description of Artificial Sequence: Synthetic peptide
  Seed: TQDWVQENY (MAGA4_HUMAN)
TQDWVQENF

SEQ ID NO: 64845 - protein, 9 aa, Artificial Sequence
  Description of Artificial Sequence: Synthetic peptide
  Seed: KVLEHVVRV (MAGA4_HUMAN)
KALEHVVRK

SEQ ID NO: 64846 - protein, 8 aa, Artificial Sequence
  Description of Artificial Sequence: Synthetic peptide
  Seed: RVRIAYPS (MAGA4_HUMAN)
RVRIAYPL

SEQ ID NO: 64847 - protein, 9 aa, Artificial Sequence
  Description of Artificial Sequence: Synthetic peptide
  Seed: IAYPSLREA (MAGA4_HUMAN)
ITYPSLREI

SEQ ID NO: 64848 - protein, 10 aa, Artificial Sequence
  Description of Artificial Sequence: Synthetic peptide
  Seed: GDSASEEEIW (MAGA4_HUMAN)
GASASEEEIW

SEQ ID NO: 64849 - protein, 10 aa, Artificial Sequence
  Description of Artificial Sequence: Synthetic peptide
  Seed: KVDELAHFLL (MAGA4_HUMAN)
KLDELAHFLC

SEQ ID NO: 64850 - protein, 9 aa, Artificial Sequence
  Description of Artificial Sequence: Synthetic peptide
  Seed: RVRIAYPSL (MAGA4_HUMAN)
RARIAYPSM

SEQ ID NO: 64851 - protein, 9 aa, Artificial Sequence
  Description of Artificial Sequence: Synthetic peptide
  Seed: RCFPVIFGK (MAGA4_HUMAN)
RIFPVIFGK

SEQ ID NO: 64852 - protein, 9 aa, Artificial Sequence
  Description of Artificial Sequence: Synthetic peptide
  Seed: KVLEHVVRV (MAGA4_HUMAN)
KNLEHVVRI

SEQ ID NO: 64853 - protein, 9 aa, Artificial Sequence
  Description of Artificial Sequence: Synthetic peptide
  Seed: YRAKELVTK (MAGA4_HUMAN)
YQAKELVTF

SEQ ID NO: 64854 - protein, 10 aa, Artificial Sequence
  Description of Artificial Sequence: Synthetic peptide
  Seed: MLERVIKNYK (MAGA4_HUMAN)
MMERVIKNYK

SEQ ID NO: 64855 - protein, 9 aa, Artificial Sequence
  Description of Artificial Sequence: Synthetic peptide
  Seed: RVRIAYPSL (MAGA4_HUMAN)
RNRIAYPSS

SEQ ID NO: 64856 - protein, 8 aa, Artificial Sequence
  Description of Artificial Sequence: Synthetic peptide
  Seed: AESLFREA (MAGA4_HUMAN)
ADSLFREL

SEQ ID NO: 64857 - protein, 10 aa, Artificial Sequence
  Description of Artificial Sequence: Synthetic peptide
  Seed: GVYDGREHTV (MAGA4_HUMAN)
GLYDGREHTA

SEQ ID NO: 64858 - protein, 8 aa, Artificial Sequence
  Description of Artificial Sequence: Synthetic peptide
  Seed: SAGPPQSP (MAGA4_HUMAN)
SAGPPQSL

SEQ ID NO: 64859 - protein, 10 aa, Artificial Sequence
  Description of Artificial Sequence: Synthetic peptide
  Seed: VDPASNTYTL (MAGA4_HUMAN)
VTPASNTYTY

SEQ ID NO: 64860 - protein, 11 aa, Artificial Sequence
  Description of Artificial Sequence: Synthetic peptide
  Seed: AQAPTTEEQEA (MAGA4_HUMAN)
AMAPTTEEQEF

SEQ ID NO: 64861 - protein, 9 aa, Artificial Sequence
  Description of Artificial Sequence: Synthetic peptide
  Seed: VYDGREHTV (MAGA4_HUMAN)
VMDGREHTV

SEQ ID NO: 64862 - protein, 10 aa, Artificial Sequence
  Description of Artificial Sequence: Synthetic peptide
  Seed: RVRIAYPSLR (MAGA4_HUMAN)
RYRIAYPSLI

SEQ ID NO: 64863 - protein, 9 aa, Artificial Sequence
  Description of Artificial Sequence: Synthetic peptide
  Seed: VYDGREHTV (MAGA4_HUMAN)
VFDGREHTI

SEQ ID NO: 64864 - protein, 10 aa, Artificial Sequence
  Description of Artificial Sequence: Synthetic peptide
  Seed: EHVVRVNARV (MAGA4_HUMAN)
ETVVRVNARL

SEQ ID NO: 64865 - protein, 10 aa, Artificial Sequence
  Description of Artificial Sequence: Synthetic peptide
  Seed: TSYVKVLEHV (MAGA4_HUMAN)
TYYVKVLEHL

SEQ ID NO: 64866 - protein, 9 aa, Artificial Sequence
  Description of Artificial Sequence: Synthetic peptide
  Seed: AAVSSSSPL (MAGA4_HUMAN)
AEVSSSSPL

SEQ ID NO: 64867 - protein, 9 aa, Artificial Sequence
  Description of Artificial Sequence: Synthetic peptide
  Seed: LKMIFGIDV (MAGA4_HUMAN)
LMMIFGIDY

SEQ ID NO: 64868 - protein, 9 aa, Artificial Sequence
  Description of Artificial Sequence: Synthetic peptide
  Seed: AAVSSSSPL (MAGA4_HUMAN)
AHVSSSSPM

SEQ ID NO: 64869 - protein, 9 aa, Artificial Sequence
  Description of Artificial Sequence: Synthetic peptide
  Seed: RVRIAYPSL (MAGA4_HUMAN)
RKRIAYPSY

SEQ ID NO: 64870 - protein, 9 aa, Artificial Sequence
  Description of Artificial Sequence: Synthetic peptide
  Seed: YKRCFPVIF (MAGA4_HUMAN)
YQRCFPVIA

SEQ ID NO: 64871 - protein, 9 aa, Artificial Sequence
  Description of Artificial Sequence: Synthetic peptide
  Seed: AAVSSSSPL (MAGA4_HUMAN)
AVVSSSSPV

SEQ ID NO: 64872 - protein, 9 aa, Artificial Sequence
  Description of Artificial Sequence: Synthetic peptide
  Seed: LVPGTLEEV (MAGA4_HUMAN)
LRPGTLEEM

SEQ ID NO: 64873 - protein, 9 aa, Artificial Sequence
  Description of Artificial Sequence: Synthetic peptide
  Seed: AAVSSSSPL (MAGA4_HUMAN)
AAVSSSSPV

SEQ ID NO: 64874 - protein, 10 aa, Artificial Sequence
  Description of Artificial Sequence: Synthetic peptide
  Seed: KNYKRCFPVI (MAGA4_HUMAN)
KYYKRCFPVM

SEQ ID NO: 64875 - protein, 9 aa, Artificial Sequence
  Description of Artificial Sequence: Synthetic peptide
  Seed: RCFPVIFGK (MAGA4_HUMAN)
RTFPVIFGA

SEQ ID NO: 64876 - protein, 10 aa, Artificial Sequence
  Description of Artificial Sequence: Synthetic peptide
  Seed: RIAYPSLREA (MAGA4_HUMAN)
RTAYPSLREK

SEQ ID NO: 64877 - protein, 10 aa, Artificial Sequence
  Description of Artificial Sequence: Synthetic peptide
  Seed: PTTISFTCWR (MAGA4_HUMAN)
PHTISFTCWK

SEQ ID NO: 64878 - protein, 9 aa, Artificial Sequence
  Description of Artificial Sequence: Synthetic peptide
  Seed: VYDGREHTV (MAGA4_HUMAN)
VMDGREHTL

SEQ ID NO: 64879 - protein, 9 aa, Artificial Sequence
  Description of Artificial Sequence: Synthetic peptide
  Seed: GLLIIVLGT (MAGA4_HUMAN)
GVLIIVLGV

SEQ ID NO: 64880 - protein, 9 aa, Artificial Sequence
  Description of Artificial Sequence: Synthetic peptide
  Seed: YKRCFPVIF (MAGA4_HUMAN)
YHRCFPVIM

SEQ ID NO: 64881 - protein, 9 aa, Artificial Sequence
  Description of Artificial Sequence: Synthetic peptide
  Seed: ASESLKMIF (MAGA4_HUMAN)
AQESLKMIY

SEQ ID NO: 64882 - protein, 10 aa, Artificial Sequence
  Description of Artificial Sequence: Synthetic peptide
  Seed: YRQVPGSNPA (MAGA4_HUMAN)
YWQVPGSNPL

SEQ ID NO: 64883 - protein, 10 aa, Artificial Sequence
  Description of Artificial Sequence: Synthetic peptide
  Seed: RVRIAYPSLR (MAGA4_HUMAN)
RSRIAYPSLS

SEQ ID NO: 64884 - protein, 9 aa, Artificial Sequence
  Description of Artificial Sequence: Synthetic peptide
  Seed: ALSNKVDEL (MAGA4_HUMAN)
AMSNKVDEM

SEQ ID NO: 64885 - protein, 10 aa, Artificial Sequence
  Description of Artificial Sequence: Synthetic peptide
  Seed: EHTVYGEPRK (MAGA4_HUMAN)
ESTVYGEPRR

SEQ ID NO: 64886 - protein, 10 aa, Artificial Sequence
  Description of Artificial Sequence: Synthetic peptide
  Seed: VDPASNTYTL (MAGA4_HUMAN)
VFPASNTYTF

SEQ ID NO: 64887 - protein, 9 aa, Artificial Sequence
  Description of Artificial Sequence: Synthetic peptide
  Seed: LVPGTLEEV (MAGA4_HUMAN)
LIPGTLEEA

SEQ ID NO: 64888 - protein, 10 aa, Artificial Sequence
  Description of Artificial Sequence: Synthetic peptide
  Seed: VKVLEHVVRV (MAGA4_HUMAN)
VMVLEHVVRV

SEQ ID NO: 64889 - protein, 9 aa, Artificial Sequence
  Description of Artificial Sequence: Synthetic peptide
  Seed: RVRIAYPSL (MAGA4_HUMAN)
RERIAYPSF

SEQ ID NO: 64890 - protein, 9 aa, Artificial Sequence
  Description of Artificial Sequence: Synthetic peptide
  Seed: GLLGNNQIF (MAGA4_HUMAN)
GALGNNQIY

SEQ ID NO: 64891 - protein, 9 aa, Artificial Sequence
  Description of Artificial Sequence: Synthetic peptide
  Seed: RAKELVTKA (MAGA4_HUMAN)
RAKELVTKV

SEQ ID NO: 64892 - protein, 9 aa, Artificial Sequence
  Description of Artificial Sequence: Synthetic peptide
  Seed: WVQENYLEY (MAGA4_HUMAN)
WSQENYLEW

SEQ ID NO: 64893 - protein, 9 aa, Artificial Sequence
  Description of Artificial Sequence: Synthetic peptide
  Seed: KVLEHVVRV (MAGA4_HUMAN)
KSLEHVVRR

SEQ ID NO: 64894 - protein, 9 aa, Artificial Sequence
  Description of Artificial Sequence: Synthetic peptide
  Seed: KVLEHVVRV (MAGA4_HUMAN)
KSLEHVVRK

SEQ ID NO: 64895 - protein, 10 aa, Artificial Sequence
  Description of Artificial Sequence: Synthetic peptide
  Seed: AYPSLREAAL (MAGA4_HUMAN)
AFPSLREAAM

SEQ ID NO: 64896 - protein, 10 aa, Artificial Sequence
  Description of Artificial Sequence: Synthetic peptide
  Seed: YPSLREAALL (MAGA4_HUMAN)
YRSLREAALF

SEQ ID NO: 64897 - protein, 9 aa, Artificial Sequence
  Description of Artificial Sequence: Synthetic peptide
  Seed: TQDWVQENY (MAGA4_HUMAN)
TMDWVQENV

SEQ ID NO: 64898 - protein, 9 aa, Artificial Sequence
  Description of Artificial Sequence: Synthetic peptide
  Seed: YPSLREAAL (MAGA4_HUMAN)
YTSLREAAL

SEQ ID NO: 64899 - protein, 9 aa, Artificial Sequence
  Description of Artificial Sequence: Synthetic peptide
  Seed: RQVPGSNPA (MAGA4_HUMAN)
RAVPGSNPM

SEQ ID NO: 64900 - protein, 10 aa, Artificial Sequence
  Description of Artificial Sequence: Synthetic peptide
  Seed: KASESLKMIF (MAGA4_HUMAN)
KTSESLKMIF

SEQ ID NO: 64901 - protein, 10 aa, Artificial Sequence
  Description of Artificial Sequence: Synthetic peptide
  Seed: YPSLREAALL (MAGA4_HUMAN)
YVSLREAALW

SEQ ID NO: 64902 - protein, 11 aa, Artificial Sequence
  Description of Artificial Sequence: Synthetic peptide
  Seed: RQVPGSNPARY (MAGA4_HUMAN)
RMVPGSNPARK

SEQ ID NO: 64903 - protein, 9 aa, Artificial Sequence
  Description of Artificial Sequence: Synthetic peptide
  Seed: SALPTTISF (MAGA4_HUMAN)
SGLPTTISM

SEQ ID NO: 64904 - protein, 9 aa, Artificial Sequence
  Description of Artificial Sequence: Synthetic peptide
  Seed: IFPKTGLLI (MAGA4_HUMAN)
IYPKTGLLV

SEQ ID NO: 64905 - protein, 9 aa, Artificial Sequence
  Description of Artificial Sequence: Synthetic peptide
  Seed: KASESLKMI (MAGA4_HUMAN)
KQSESLKMM

SEQ ID NO: 64906 - protein, 11 aa, Artificial Sequence
  Description of Artificial Sequence: Synthetic peptide
  Seed: LPTTISFTCWR (MAGA4_HUMAN)
LATTISFTCWR

SEQ ID NO: 64907 - protein, 8 aa, Artificial Sequence
  Description of Artificial Sequence: Synthetic peptide
  Seed: SEQKSQHC (MAGA4_HUMAN)
SDQKSQHL

SEQ ID NO: 64908 - protein, 9 aa, Artificial Sequence
  Description of Artificial Sequence: Synthetic peptide
  Seed: RVRIAYPSL (MAGA4_HUMAN)
RLRIAYPSN

SEQ ID NO: 64909 - protein, 9 aa, Artificial Sequence
  Description of Artificial Sequence: Synthetic peptide
  Seed: SEEEIWEEL (MAGA4_HUMAN)
SEEEIWEET

SEQ ID NO: 64910 - protein, 10 aa, Artificial Sequence
  Description of Artificial Sequence: Synthetic peptide
  Seed: DELAHFLLRK (MAGA4_HUMAN)
DALAHFLLRR

SEQ ID NO: 64911 - protein, 10 aa, Artificial Sequence
  Description of Artificial Sequence: Synthetic peptide
  Seed: EAAVSSSSPL (MAGA4_HUMAN)
EHAVSSSSPV

SEQ ID NO: 64912 - protein, 9 aa, Artificial Sequence
  Description of Artificial Sequence: Synthetic peptide
  Seed: SSPLVPGTL (MAGA4_HUMAN)
SAPLVPGTF

SEQ ID NO: 64913 - protein, 9 aa, Artificial Sequence
  Description of Artificial Sequence: Synthetic peptide
  Seed: RAKELVTKA (MAGA4_HUMAN)
RTKELVTKI

SEQ ID NO: 64914 - protein, 10 aa, Artificial Sequence
  Description of Artificial Sequence: Synthetic peptide
  Seed: VDPASNTYTL (MAGA4_HUMAN)
VEPASNTYTM

SEQ ID NO: 64915 - protein, 9 aa, Artificial Sequence
  Description of Artificial Sequence: Synthetic peptide
  Seed: VYGEPRKLL (MAGA4_HUMAN)
VSGEPRKLL

SEQ ID NO: 64916 - protein, 9 aa, Artificial Sequence
  Description of Artificial Sequence: Synthetic peptide
  Seed: STSPDAESL (MAGA4_HUMAN)
SLSPDAESV

SEQ ID NO: 64917 - protein, 10 aa, Artificial Sequence
  Description of Artificial Sequence: Synthetic peptide
  Seed: KASESLKMIF (MAGA4_HUMAN)
KGSESLKMIW

SEQ ID NO: 64918 - protein, 9 aa, Artificial Sequence
  Description of Artificial Sequence: Synthetic peptide
  Seed: KASESLKMI (MAGA4_HUMAN)
KISESLKMI

SEQ ID NO: 64919 - protein, 10 aa, Artificial Sequence
  Description of Artificial Sequence: Synthetic peptide
  Seed: VIFGKASESL (MAGA4_HUMAN)
VAFGKASESM

SEQ ID NO: 64920 - protein, 9 aa, Artificial Sequence
  Description of Artificial Sequence: Synthetic peptide
  Seed: ALLEEEEGV (MAGA4_HUMAN)
AILEEEEGV

SEQ ID NO: 64921 - protein, 9 aa, Artificial Sequence
  Description of Artificial Sequence: Synthetic peptide
  Seed: AESLFREAL (MAGA4_HUMAN)
AQSLFREAW

SEQ ID NO: 64922 - protein, 10 aa, Artificial Sequence
  Description of Artificial Sequence: Synthetic peptide
  Seed: QEEEGPSTSP (MAGA4_HUMAN)
QEEEGPSTST

SEQ ID NO: 64923 - protein, 8 aa, Artificial Sequence
  Description of Artificial Sequence: Synthetic peptide
  Seed: KVDELAHF (MAGA4_HUMAN)
KSDELAHF

SEQ ID NO: 64924 - protein, 9 aa, Artificial Sequence
  Description of Artificial Sequence: Synthetic peptide
  Seed: DELAHFLLR (MAGA4_HUMAN)
DTLAHFLLK

SEQ ID NO: 64925 - protein, 10 aa, Artificial Sequence
  Description of Artificial Sequence: Synthetic peptide
  Seed: TTISFTCWRQ (MAGA4_HUMAN)
TTISFTCWRP

SEQ ID NO: 64926 - protein, 9 aa, Artificial Sequence
  Description of Artificial Sequence: Synthetic peptide
  Seed: RVRIAYPSL (MAGA4_HUMAN)
RQRIAYPSG

SEQ ID NO: 64927 - protein, 9 aa, Artificial Sequence
  Description of Artificial Sequence: Synthetic peptide
  Seed: LVPGTLEEV (MAGA4_HUMAN)
LRPGTLEEL

SEQ ID NO: 64928 - protein, 9 aa, Artificial Sequence
  Description of Artificial Sequence: Synthetic peptide
  Seed: NKVDELAHF (MAGA4_HUMAN)
NHVDELAHY

SEQ ID NO: 64929 - protein, 10 aa, Artificial Sequence
  Description of Artificial Sequence: Synthetic peptide
  Seed: YRAKELVTKA (MAGA4_HUMAN)
YRAKELVTKL

SEQ ID NO: 64930 - protein, 8 aa, Artificial Sequence
  Description of Artificial Sequence: Synthetic peptide
  Seed: KVDELAHF (MAGA4_HUMAN)
KSDELAHL

SEQ ID NO: 64931 - protein, 8 aa, Artificial Sequence
  Description of Artificial Sequence: Synthetic peptide
  Seed: KVDELAHF (MAGA4_HUMAN)
KTDELAHM

SEQ ID NO: 64932 - protein, 10 aa, Artificial Sequence
  Description of Artificial Sequence: Synthetic peptide
  Seed: SSSPLVPGTL (MAGA4_HUMAN)
SLSPLVPGTI

SEQ ID NO: 64933 - protein, 9 aa, Artificial Sequence
  Description of Artificial Sequence: Synthetic peptide
  Seed: VYDGREHTV (MAGA4_HUMAN)
VMDGREHTY

SEQ ID NO: 64934 - protein, 9 aa, Artificial Sequence
  Description of Artificial Sequence: Synthetic peptide
  Seed: RVRIAYPSL (MAGA4_HUMAN)
RFRIAYPSL

SEQ ID NO: 64935 - protein, 8 aa, Artificial Sequence
  Description of Artificial Sequence: Synthetic peptide
  Seed: GVYDGREH (MAGA4_HUMAN)
GAYDGREY

SEQ ID NO: 64936 - protein, 10 aa, Artificial Sequence
  Description of Artificial Sequence: Synthetic peptide
  Seed: AAVSSSSPLV (MAGA4_HUMAN)
ALVSSSSPLI

SEQ ID NO: 64937 - protein, 9 aa, Artificial Sequence
  Description of Artificial Sequence: Synthetic peptide
  Seed: RVRIAYPSL (MAGA4_HUMAN)
RWRIAYPST

SEQ ID NO: 64938 - protein, 10 aa, Artificial Sequence
  Description of Artificial Sequence: Synthetic peptide
  Seed: SSSPLVPGTL (MAGA4_HUMAN)
SMSPLVPGTW

SEQ ID NO: 64939 - protein, 10 aa, Artificial Sequence
  Description of Artificial Sequence: Synthetic peptide
  Seed: KEVDPASNTY (MAGA4_HUMAN)
KVVDPASNTF

SEQ ID NO: 64940 - protein, 9 aa, Artificial Sequence
  Description of Artificial Sequence: Synthetic peptide
  Seed: ALSNKVDEL (MAGA4_HUMAN)
AQSNKVDEY

SEQ ID NO: 64941 - protein, 11 aa, Artificial Sequence
  Description of Artificial Sequence: Synthetic peptide
  Seed: KEVDPASNTYT (MAGA4_HUMAN)
KEVDPASNTYI

SEQ ID NO: 64942 - protein, 9 aa, Artificial Sequence
  Description of Artificial Sequence: Synthetic peptide
  Seed: AAVSSSSPL (MAGA4_HUMAN)
AYVSSSSPI

SEQ ID NO: 64943 - protein, 9 aa, Artificial Sequence
  Description of Artificial Sequence: Synthetic peptide
  Seed: KVDELAHFL (MAGA4_HUMAN)
KADELAHFM

SEQ ID NO: 64944 - protein, 10 aa, Artificial Sequence
  Description of Artificial Sequence: Synthetic peptide
  Seed: VDPASNTYTL (MAGA4_HUMAN)
VPPASNTYTY

SEQ ID NO: 64945 - protein, 9 aa, Artificial Sequence
  Description of Artificial Sequence: Synthetic peptide
  Seed: REALSNKVD (MAGA4_HUMAN)
REALSNKVP

SEQ ID NO: 64946 - protein, 10 aa, Artificial Sequence
  Description of Artificial Sequence: Synthetic peptide
  Seed: YRQVPGSNPA (MAGA4_HUMAN)
YHQVPGSNPW

SEQ ID NO: 64947 - protein, 10 aa, Artificial Sequence
  Description of Artificial Sequence: Synthetic peptide
  Seed: KRCFPVIFGK (MAGA4_HUMAN)
KYCFPVIFGK

SEQ ID NO: 64948 - protein, 9 aa, Artificial Sequence
  Description of Artificial Sequence: Synthetic peptide
  Seed: RAKELVTKA (MAGA4_HUMAN)
RSKELVTKL

SEQ ID NO: 64949 - protein, 9 aa, Artificial Sequence
  Description of Artificial Sequence: Synthetic peptide
  Seed: KASESLKMI (MAGA4_HUMAN)
KMSESLKMA

SEQ ID NO: 64950 - protein, 10 aa, Artificial Sequence
  Description of Artificial Sequence: Synthetic peptide
  Seed: AYPSLREAAL (MAGA4_HUMAN)
AQPSLREAAM

SEQ ID NO: 64951 - protein, 10 aa, Artificial Sequence
  Description of Artificial Sequence: Synthetic peptide
  Seed: SESLKMIFGI (MAGA4_HUMAN)
SASLKMIFGW

SEQ ID NO: 64952 - protein, 10 aa, Artificial Sequence
  Description of Artificial Sequence: Synthetic peptide
  Seed: LIIVLGTIAM (MAGA4_HUMAN)
LMIVLGTIAY

SEQ ID NO: 64953 - protein, 9 aa, Artificial Sequence
  Description of Artificial Sequence: Synthetic peptide
  Seed: SSSPLVPGT (MAGA4_HUMAN)
SASPLVPGM

SEQ ID NO: 64954 - protein, 9 aa, Artificial Sequence
  Description of Artificial Sequence: Synthetic peptide
  Seed: VNARVRIAY (MAGA4_HUMAN)
VKARVRIAF

SEQ ID NO: 64955 - protein, 10 aa, Artificial Sequence
  Description of Artificial Sequence: Synthetic peptide
  Seed: LIIVLGTIAM (MAGA4_HUMAN)
LQIVLGTIAM

SEQ ID NO: 64956 - protein, 8 aa, Artificial Sequence
  Description of Artificial Sequence: Synthetic peptide
  Seed: FLLRKYRA (MAGA4_HUMAN)
FMLRKYRL

SEQ ID NO: 64957 - protein, 10 aa, Artificial Sequence
  Description of Artificial Sequence: Synthetic peptide
  Seed: FGKASESLKM (MAGA4_HUMAN)
FQKASESLKF

SEQ ID NO: 64958 - protein, 9 aa, Artificial Sequence
  Description of Artificial Sequence: Synthetic peptide
  Seed: STSPDAESL (MAGA4_HUMAN)
SLSPDAESL

SEQ ID NO: 64959 - protein, 9 aa, Artificial Sequence
  Description of Artificial Sequence: Synthetic peptide
  Seed: KASESLKMI (MAGA4_HUMAN)
KQSESLKML

SEQ ID NO: 64960 - protein, 10 aa, Artificial Sequence
  Description of Artificial Sequence: Synthetic peptide
  Seed: KRCFPVIFGK (MAGA4_HUMAN)
KRCFPVIFGR

SEQ ID NO: 64961 - protein, 10 aa, Artificial Sequence
  Description of Artificial Sequence: Synthetic peptide
  Seed: KEVDPASNTY (MAGA4_HUMAN)
KTVDPASNTW

SEQ ID NO: 64962 - protein, 10 aa, Artificial Sequence
  Description of Artificial Sequence: Synthetic peptide
  Seed: STSPDAESLF (MAGA4_HUMAN)
SMSPDAESLF

SEQ ID NO: 64963 - protein, 10 aa, Artificial Sequence
  Description of Artificial Sequence: Synthetic peptide
  Seed: GLLIIVLGTI (MAGA4_HUMAN)
GKLIIVLGTV

SEQ ID NO: 64964 - protein, 9 aa, Artificial Sequence
  Description of Artificial Sequence: Synthetic peptide
  Seed: SPDAESLFR (MAGA4_HUMAN)
SSDAESLFY

SEQ ID NO: 64965 - protein, 9 aa, Artificial Sequence
  Description of Artificial Sequence: Synthetic peptide
  Seed: EAQEEALGL (MAGA4_HUMAN)
EVQEEALGW

SEQ ID NO: 64966 - protein, 9 aa, Artificial Sequence
  Description of Artificial Sequence: Synthetic peptide
  Seed: NYKRCFPVI (MAGA4_HUMAN)
NFKRCFPVM

SEQ ID NO: 64967 - protein, 8 aa, Artificial Sequence
  Description of Artificial Sequence: Synthetic peptide
  Seed: FGIDVKEV (MAGA4_HUMAN)
FQIDVKEL

SEQ ID NO: 64968 - protein, 8 aa, Artificial Sequence
  Description of Artificial Sequence: Synthetic peptide
  Seed: RVRIAYPS (MAGA4_HUMAN)
RVRIAYPI

SEQ ID NO: 64969 - protein, 9 aa, Artificial Sequence
  Description of Artificial Sequence: Synthetic peptide
  Seed: EEVPAAESA (MAGA4_HUMAN)
EHVPAAESL

SEQ ID NO: 64970 - protein, 10 aa, Artificial Sequence
  Description of Artificial Sequence: Synthetic peptide
  Seed: KVDELAHFLL (MAGA4_HUMAN)
KSDELAHFLL

SEQ ID NO: 64971 - protein, 9 aa, Artificial Sequence
  Description of Artificial Sequence: Synthetic peptide
  Seed: KVDELAHFL (MAGA4_HUMAN)
KTDELAHFY

SEQ ID NO: 64972 - protein, 9 aa, Artificial Sequence
  Description of Artificial Sequence: Synthetic peptide
  Seed: NKVDELAHF (MAGA4_HUMAN)
NVVDELAHY

SEQ ID NO: 64973 - protein, 9 aa, Artificial Sequence
  Description of Artificial Sequence: Synthetic peptide
  Seed: KASESLKMI (MAGA4_HUMAN)
KISESLKMV

SEQ ID NO: 64974 - protein, 9 aa, Artificial Sequence
  Description of Artificial Sequence: Synthetic peptide
  Seed: KASESLKMI (MAGA4_HUMAN)
KVSESLKMV

SEQ ID NO: 64975 - protein, 9 aa, Artificial Sequence
  Description of Artificial Sequence: Synthetic peptide
  Seed: SALPTTISF (MAGA4_HUMAN)
SPLPTTISP

SEQ ID NO: 64976 - protein, 9 aa, Artificial Sequence
  Description of Artificial Sequence: Synthetic peptide
  Seed: EVDPASNTY (MAGA4_HUMAN)
EVDPASNTF

SEQ ID NO: 64977 - protein, 9 aa, Artificial Sequence
  Description of Artificial Sequence: Synthetic peptide
  Seed: LKMIFGIDV (MAGA4_HUMAN)
LKMIFGIDL

SEQ ID NO: 64978 - protein, 11 aa, Artificial Sequence
  Description of Artificial Sequence: Synthetic peptide
  Seed: RVNARVRIAYP (MAGA4_HUMAN)
RFNARVRIAYK

SEQ ID NO: 64979 - protein, 9 aa, Artificial Sequence
  Description of Artificial Sequence: Synthetic peptide
  Seed: ALLEEEEGV (MAGA4_HUMAN)
ALLEEEEGW

SEQ ID NO: 64980 - protein, 11 aa, Artificial Sequence
  Description of Artificial Sequence: Synthetic peptide
  Seed: REALSNKVDEL (MAGA4_HUMAN)
REALSNKVDEF

SEQ ID NO: 64981 - protein, 10 aa, Artificial Sequence
  Description of Artificial Sequence: Synthetic peptide
  Seed: KVDELAHFLL (MAGA4_HUMAN)
KTDELAHFLF

SEQ ID NO: 64982 - protein, 9 aa, Artificial Sequence
  Description of Artificial Sequence: Synthetic peptide
  Seed: RCFPVIFGK (MAGA4_HUMAN)
RIFPVIFGL

SEQ ID NO: 64983 - protein, 10 aa, Artificial Sequence
  Description of Artificial Sequence: Synthetic peptide
  Seed: LGVMGVYDGR (MAGA4_HUMAN)
LIVMGVYDGR

SEQ ID NO: 64984 - protein, 8 aa, Artificial Sequence
  Description of Artificial Sequence: Synthetic peptide
  Seed: VYGEPRKL (MAGA4_HUMAN)
VAGEPRKI

SEQ ID NO: 64985 - protein, 10 aa, Artificial Sequence
  Description of Artificial Sequence: Synthetic peptide
  Seed: ARVRIAYPSL (MAGA4_HUMAN)
APVRIAYPSV

SEQ ID NO: 64986 - protein, 11 aa, Artificial Sequence
  Description of Artificial Sequence: Synthetic peptide
  Seed: KVDELAHFLLR (MAGA4_HUMAN)
KQDELAHFLLR

SEQ ID NO: 64987 - protein, 9 aa, Artificial Sequence
  Description of Artificial Sequence: Synthetic peptide
  Seed: DELAHFLLR (MAGA4_HUMAN)
DNLAHFLLR

SEQ ID NO: 64988 - protein, 10 aa, Artificial Sequence
  Description of Artificial Sequence: Synthetic peptide
  Seed: MIFGIDVKEV (MAGA4_HUMAN)
MLFGIDVKEV

SEQ ID NO: 64989 - protein, 9 aa, Artificial Sequence
  Description of Artificial Sequence: Synthetic peptide
  Seed: GTLEEVPAA (MAGA4_HUMAN)
GSLEEVPAV

SEQ ID NO: 64990 - protein, 9 aa, Artificial Sequence
  Description of Artificial Sequence: Synthetic peptide
  Seed: RVRIAYPSL (MAGA4_HUMAN)
RARIAYPSA

SEQ ID NO: 64991 - protein, 10 aa, Artificial Sequence
  Description of Artificial Sequence: Synthetic peptide
  Seed: KASESLKMIF (MAGA4_HUMAN)
KQSESLKMIM

SEQ ID NO: 64992 - protein, 10 aa, Artificial Sequence
  Description of Artificial Sequence: Synthetic peptide
  Seed: KYRAKELVTK (MAGA4_HUMAN)
KVRAKELVTA

SEQ ID NO: 64993 - protein, 11 aa, Artificial Sequence
  Description of Artificial Sequence: Synthetic peptide
  Seed: RVNARVRIAYP (MAGA4_HUMAN)
RVNARVRIAYA

SEQ ID NO: 64994 - protein, 9 aa, Artificial Sequence
  Description of Artificial Sequence: Synthetic peptide
  Seed: KASESLKMI (MAGA4_HUMAN)
KMSESLKMY

SEQ ID NO: 64995 - protein, 10 aa, Artificial Sequence
  Description of Artificial Sequence: Synthetic peptide
  Seed: YRQVPGSNPA (MAGA4_HUMAN)
YCQVPGSNPM

SEQ ID NO: 64996 - protein, 11 aa, Artificial Sequence
  Description of Artificial Sequence: Synthetic peptide
  Seed: RQVPGSNPARY (MAGA4_HUMAN)
RQVPGSNPARR

SEQ ID NO: 64997 - protein, 10 aa, Artificial Sequence
  Description of Artificial Sequence: Synthetic peptide
  Seed: AESLFREALS (MAGA4_HUMAN)
AESLFREALI

SEQ ID NO: 64998 - protein, 9 aa, Artificial Sequence
  Description of Artificial Sequence: Synthetic peptide
  Seed: RVRIAYPSL (MAGA4_HUMAN)
RSRIAYPSA

SEQ ID NO: 64999 - protein, 9 aa, Artificial Sequence
  Description of Artificial Sequence: Synthetic peptide
  Seed: RVRIAYPSL (MAGA4_HUMAN)
RIRIAYPSI

SEQ ID NO: 65000 - protein, 9 aa, Artificial Sequence
  Description of Artificial Sequence: Synthetic peptide
  Seed: TSPDAESLF (MAGA4_HUMAN)
TRPDAESLY

SEQ ID NO: 65001 - protein, 9 aa, Artificial Sequence
  Description of Artificial Sequence: Synthetic peptide
  Seed: KYRAKELVT (MAGA4_HUMAN)
KSRAKELVA

SEQ ID NO: 65002 - protein, 10 aa, Artificial Sequence
  Description of Artificial Sequence: Synthetic peptide
  Seed: RVRIAYPSLR (MAGA4_HUMAN)
RSRIAYPSLR

SEQ ID NO: 65003 - protein, 9 aa, Artificial Sequence
  Description of Artificial Sequence: Synthetic peptide
  Seed: AHFLLRKYR (MAGA4_HUMAN)
AIFLLRKYR

SEQ ID NO: 65004 - protein, 10 aa, Artificial Sequence
  Description of Artificial Sequence: Synthetic peptide
  Seed: VDPASNTYTL (MAGA4_HUMAN)
VNPASNTYTL

SEQ ID NO: 65005 - protein, 11 aa, Artificial Sequence
  Description of Artificial Sequence: Synthetic peptide
  Seed: KVDELAHFLLR (MAGA4_HUMAN)
KVDELAHFLLY

SEQ ID NO: 65006 - protein, 9 aa, Artificial Sequence
  Description of Artificial Sequence: Synthetic peptide
  Seed: NPARYEFLW (MAGA4_HUMAN)
NMARYEFLW

SEQ ID NO: 65007 - protein, 9 aa, Artificial Sequence
  Description of Artificial Sequence: Synthetic peptide
  Seed: VYDGREHTV (MAGA4_HUMAN)
VNDGREHTM

SEQ ID NO: 65008 - protein, 9 aa, Artificial Sequence
  Description of Artificial Sequence: Synthetic peptide
  Seed: ALPTTISFT (MAGA4_HUMAN)
AQPTTISFL

SEQ ID NO: 65009 - protein, 9 aa, Artificial Sequence
  Description of Artificial Sequence: Synthetic peptide
  Seed: WVQENYLEY (MAGA4_HUMAN)
WYQENYLEY

SEQ ID NO: 65010 - protein, 9 aa, Artificial Sequence
  Description of Artificial Sequence: Synthetic peptide
  Seed: SSPLVPGTL (MAGA4_HUMAN)
SVPLVPGTL

SEQ ID NO: 65011 - protein, 9 aa, Artificial Sequence
  Description of Artificial Sequence: Synthetic peptide
  Seed: VYDGREHTV (MAGA4_HUMAN)
VADGREHTV

SEQ ID NO: 65012 - protein, 9 aa, Artificial Sequence
  Description of Artificial Sequence: Synthetic peptide
  Seed: RVRIAYPSL (MAGA4_HUMAN)
RNRIAYPSK

SEQ ID NO: 65013 - protein, 9 aa, Artificial Sequence
  Description of Artificial Sequence: Synthetic peptide
  Seed: IAYPSLREA (MAGA4_HUMAN)
IMYPSLREM

SEQ ID NO: 65014 - protein, 10 aa, Artificial Sequence
  Description of Artificial Sequence: Synthetic peptide
  Seed: RVRIAYPSLR (MAGA4_HUMAN)
RYRIAYPSLK

SEQ ID NO: 65015 - protein, 9 aa, Artificial Sequence
  Description of Artificial Sequence: Synthetic peptide
  Seed: KNYKRCFPV (MAGA4_HUMAN)
KVYKRCFPS

SEQ ID NO: 65016 - protein, 8 aa, Artificial Sequence
  Description of Artificial Sequence: Synthetic peptide
  Seed: KVDELAHF (MAGA4_HUMAN)
KADELAHL

SEQ ID NO: 65017 - protein, 9 aa, Artificial Sequence
  Description of Artificial Sequence: Synthetic peptide
  Seed: RVRIAYPSL (MAGA4_HUMAN)
RIRIAYPSY

SEQ ID NO: 65018 - protein, 9 aa, Artificial Sequence
  Description of Artificial Sequence: Synthetic peptide
  Seed: NKVDELAHF (MAGA4_HUMAN)
NHVDELAHF

SEQ ID NO: 65019 - protein, 10 aa, Artificial Sequence
  Description of Artificial Sequence: Synthetic peptide
  Seed: VIFGKASESL (MAGA4_HUMAN)
VQFGKASESF

SEQ ID NO: 65020 - protein, 10 aa, Artificial Sequence
  Description of Artificial Sequence: Synthetic peptide
  Seed: RVRIAYPSLR (MAGA4_HUMAN)
RSRIAYPSLI

SEQ ID NO: 65021 - protein, 11 aa, Artificial Sequence
  Description of Artificial Sequence: Synthetic peptide
  Seed: GVYDGREHTVY (MAGA4_HUMAN)
GQYDGREHTVF

SEQ ID NO: 65022 - protein, 9 aa, Artificial Sequence
  Description of Artificial Sequence: Synthetic peptide
  Seed: KVLEHVVRV (MAGA4_HUMAN)
KQLEHVVRL

SEQ ID NO: 65023 - protein, 11 aa, Artificial Sequence
  Description of Artificial Sequence: Synthetic peptide
  Seed: RQVPGSNPARY (MAGA4_HUMAN)
RLVPGSNPARF

SEQ ID NO: 65024 - protein, 9 aa, Artificial Sequence
  Description of Artificial Sequence: Synthetic peptide
  Seed: SSPLVPGTL (MAGA4_HUMAN)
SRPLVPGTL

SEQ ID NO: 65025 - protein, 9 aa, Artificial Sequence
  Description of Artificial Sequence: Synthetic peptide
  Seed: FPKTGLLII (MAGA4_HUMAN)
FPKTGLLIF

SEQ ID NO: 65026 - protein, 11 aa, Artificial Sequence
  Description of Artificial Sequence: Synthetic peptide
  Seed: AQEEALGLVGA (MAGA4_HUMAN)
AEEEALGLVGL

SEQ ID NO: 65027 - protein, 10 aa, Artificial Sequence
  Description of Artificial Sequence: Synthetic peptide
  Seed: YRAKELVTKA (MAGA4_HUMAN)
YRAKELVTKM

SEQ ID NO: 65028 - protein, 9 aa, Artificial Sequence
  Description of Artificial Sequence: Synthetic peptide
  Seed: GASALPTTI (MAGA4_HUMAN)
GMSALPTTV

SEQ ID NO: 65029 - protein, 9 aa, Artificial Sequence
  Description of Artificial Sequence: Synthetic peptide
  Seed: TQDWVQENY (MAGA4_HUMAN)
TADWVQENM

SEQ ID NO: 65030 - protein, 9 aa, Artificial Sequence
  Description of Artificial Sequence: Synthetic peptide
  Seed: TVYGEPRKL (MAGA4_HUMAN)
TSYGEPRKI

SEQ ID NO: 65031 - protein, 9 aa, Artificial Sequence
  Description of Artificial Sequence: Synthetic peptide
  Seed: VYDGREHTV (MAGA4_HUMAN)
VTDGREHTI

SEQ ID NO: 65032 - protein, 10 aa, Artificial Sequence
  Description of Artificial Sequence: Synthetic peptide
  Seed: QIFPKTGLLI (MAGA4_HUMAN)
QWFPKTGLLL

SEQ ID NO: 65033 - protein, 11 aa, Artificial Sequence
  Description of Artificial Sequence: Synthetic peptide
  Seed: RVNARVRIAYP (MAGA4_HUMAN)
RVNARVRIAYV

SEQ ID NO: 65034 - protein, 11 aa, Artificial Sequence
  Description of Artificial Sequence: Synthetic peptide
  Seed: SQEEEGPSTSP (MAGA4_HUMAN)
SEEEEGPSTSL

SEQ ID NO: 65035 - protein, 9 aa, Artificial Sequence
  Description of Artificial Sequence: Synthetic peptide
  Seed: LVPGTLEEV (MAGA4_HUMAN)
LYPGTLEEY

SEQ ID NO: 65036 - protein, 9 aa, Artificial Sequence
  Description of Artificial Sequence: Synthetic peptide
  Seed: STSPDAESL (MAGA4_HUMAN)
SASPDAESL

SEQ ID NO: 65037 - protein, 9 aa, Artificial Sequence
  Description of Artificial Sequence: Synthetic peptide
  Seed: FPVIFGKAS (MAGA4_HUMAN)
FPVIFGKAM

SEQ ID NO: 65038 - protein, 9 aa, Artificial Sequence
  Description of Artificial Sequence: Synthetic peptide
  Seed: KVDELAHFL (MAGA4_HUMAN)
KTDELAHFW

SEQ ID NO: 65039 - protein, 9 aa, Artificial Sequence
  Description of Artificial Sequence: Synthetic peptide
  Seed: VYDGREHTV (MAGA4_HUMAN)
VSDGREHTV

SEQ ID NO: 65040 - protein, 10 aa, Artificial Sequence
  Description of Artificial Sequence: Synthetic peptide
  Seed: TTISFTCWRQ (MAGA4_HUMAN)
TMISFTCWRR

SEQ ID NO: 65041 - protein, 9 aa, Artificial Sequence
  Description of Artificial Sequence: Synthetic peptide
  Seed: GSNPARYEF (MAGA4_HUMAN)
GSNPARYEM

SEQ ID NO: 65042 - protein, 9 aa, Artificial Sequence
  Description of Artificial Sequence: Synthetic peptide
  Seed: TSPDAESLF (MAGA4_HUMAN)
TWPDAESLL

SEQ ID NO: 65043 - protein, 9 aa, Artificial Sequence
  Description of Artificial Sequence: Synthetic peptide
  Seed: GVYDGREHT (MAGA4_HUMAN)
GVYDGREHV

SEQ ID NO: 65044 - protein, 9 aa, Artificial Sequence
  Description of Artificial Sequence: Synthetic peptide
  Seed: ALPTTISFT (MAGA4_HUMAN)
ALPTTISFL

SEQ ID NO: 65045 - protein, 9 aa, Artificial Sequence
  Description of Artificial Sequence: Synthetic peptide
  Seed: YVKVLEHVV (MAGA4_HUMAN)
YLKVLEHVV

SEQ ID NO: 65046 - protein, 9 aa, Artificial Sequence
  Description of Artificial Sequence: Synthetic peptide
  Seed: REAALLEEE (MAGA4_HUMAN)
REAALLEEI

SEQ ID NO: 65047 - protein, 10 aa, Artificial Sequence
  Description of Artificial Sequence: Synthetic peptide
  Seed: LTQDWVQENY (MAGA4_HUMAN)
LTQDWVQENW

SEQ ID NO: 65048 - protein, 10 aa, Artificial Sequence
  Description of Artificial Sequence: Synthetic peptide
  Seed: VDPASNTYTL (MAGA4_HUMAN)
VRPASNTYTF

SEQ ID NO: 65049 - protein, 9 aa, Artificial Sequence
  Description of Artificial Sequence: Synthetic peptide
  Seed: KASESLKMI (MAGA4_HUMAN)
KQSESLKMF

SEQ ID NO: 65050 - protein, 9 aa, Artificial Sequence
  Description of Artificial Sequence: Synthetic peptide
  Seed: SALPTTISF (MAGA4_HUMAN)
SQLPTTISW

SEQ ID NO: 65051 - protein, 9 aa, Artificial Sequence
  Description of Artificial Sequence: Synthetic peptide
  Seed: SALPTTISF (MAGA4_HUMAN)
SNLPTTISY

SEQ ID NO: 65052 - protein, 10 aa, Artificial Sequence
  Description of Artificial Sequence: Synthetic peptide
  Seed: KEVDPASNTY (MAGA4_HUMAN)
KIVDPASNTV

SEQ ID NO: 65053 - protein, 10 aa, Artificial Sequence
  Description of Artificial Sequence: Synthetic peptide
  Seed: STSPDAESLF (MAGA4_HUMAN)
SLSPDAESLY

SEQ ID NO: 65054 - protein, 9 aa, Artificial Sequence
  Description of Artificial Sequence: Synthetic peptide
  Seed: RVRIAYPSL (MAGA4_HUMAN)
RYRIAYPSI

SEQ ID NO: 65055 - protein, 10 aa, Artificial Sequence
  Description of Artificial Sequence: Synthetic peptide
  Seed: ARVRIAYPSL (MAGA4_HUMAN)
ANVRIAYPSA

SEQ ID NO: 65056 - protein, 10 aa, Artificial Sequence
  Description of Artificial Sequence: Synthetic peptide
  Seed: RVRIAYPSLR (MAGA4_HUMAN)
RQRIAYPSLI

SEQ ID NO: 65057 - protein, 9 aa, Artificial Sequence
  Description of Artificial Sequence: Synthetic peptide
  Seed: WVQENYLEY (MAGA4_HUMAN)
WFQENYLEF

SEQ ID NO: 65058 - protein, 9 aa, Artificial Sequence
  Description of Artificial Sequence: Synthetic peptide
  Seed: RQVPGSNPA (MAGA4_HUMAN)
RRVPGSNPF

SEQ ID NO: 65059 - protein, 10 aa, Artificial Sequence
  Description of Artificial Sequence: Synthetic peptide
  Seed: ARVRIAYPSL (MAGA4_HUMAN)
AYVRIAYPSV

SEQ ID NO: 65060 - protein, 9 aa, Artificial Sequence
  Description of Artificial Sequence: Synthetic peptide
  Seed: KASESLKMI (MAGA4_HUMAN)
KLSESLKMM

SEQ ID NO: 65061 - protein, 9 aa, Artificial Sequence
  Description of Artificial Sequence: Synthetic peptide
  Seed: KASESLKMI (MAGA4_HUMAN)
KASESLKML

SEQ ID NO: 65062 - protein, 9 aa, Artificial Sequence
  Description of Artificial Sequence: Synthetic peptide
  Seed: EVDPASNTY (MAGA4_HUMAN)
EQDPASNTM

SEQ ID NO: 65063 - protein, 10 aa, Artificial Sequence
  Description of Artificial Sequence: Synthetic peptide
  Seed: MIFGIDVKEV (MAGA4_HUMAN)
MSFGIDVKEV

SEQ ID NO: 65064 - protein, 8 aa, Artificial Sequence
  Description of Artificial Sequence: Synthetic peptide
  Seed: REALSNKV (MAGA4_HUMAN)
REALSNKF

SEQ ID NO: 65065 - protein, 9 aa, Artificial Sequence
  Description of Artificial Sequence: Synthetic peptide
  Seed: RCFPVIFGK (MAGA4_HUMAN)
RMFPVIFGV

SEQ ID NO: 65066 - protein, 10 aa, Artificial Sequence
  Description of Artificial Sequence: Synthetic peptide
  Seed: VIFGKASESL (MAGA4_HUMAN)
VMFGKASESL

SEQ ID NO: 65067 - protein, 11 aa, Artificial Sequence
  Description of Artificial Sequence: Synthetic peptide
  Seed: SASEEEIWEEL (MAGA4_HUMAN)
SQSEEEIWEEL

SEQ ID NO: 65068 - protein, 10 aa, Artificial Sequence
  Description of Artificial Sequence: Synthetic peptide
  Seed: RVRIAYPSLR (MAGA4_HUMAN)
RVRIAYPSLQ

SEQ ID NO: 65069 - protein, 9 aa, Artificial Sequence
  Description of Artificial Sequence: Synthetic peptide
  Seed: AESLFREAL (MAGA4_HUMAN)
AESLFREAV

SEQ ID NO: 65070 - protein, 9 aa, Artificial Sequence
  Description of Artificial Sequence: Synthetic peptide
  Seed: IAYPSLREA (MAGA4_HUMAN)
IPYPSLREM

SEQ ID NO: 65071 - protein, 10 aa, Artificial Sequence
  Description of Artificial Sequence: Synthetic peptide
  Seed: KRCFPVIFGK (MAGA4_HUMAN)
KNCFPVIFGR

SEQ ID NO: 65072 - protein, 9 aa, Artificial Sequence
  Description of Artificial Sequence: Synthetic peptide
  Seed: TQDWVQENY (MAGA4_HUMAN)
TMDWVQENI

SEQ ID NO: 65073 - protein, 10 aa, Artificial Sequence
  Description of Artificial Sequence: Synthetic peptide
  Seed: ARVRIAYPSL (MAGA4_HUMAN)
AKVRIAYPSA

SEQ ID NO: 65074 - protein, 9 aa, Artificial Sequence
  Description of Artificial Sequence: Synthetic peptide
  Seed: SAGPPQSPQ (MAGA4_HUMAN)
SMGPPQSPY

SEQ ID NO: 65075 - protein, 11 aa, Artificial Sequence
  Description of Artificial Sequence: Synthetic peptide
  Seed: SSSSPLVPGTL (MAGA4_HUMAN)
SSSSPLVPGTF

SEQ ID NO: 65076 - protein, 9 aa, Artificial Sequence
  Description of Artificial Sequence: Synthetic peptide
  Seed: LGNNQIFPK (MAGA4_HUMAN)
LMNNQIFPK

SEQ ID NO: 65077 - protein, 9 aa, Artificial Sequence
  Description of Artificial Sequence: Synthetic peptide
  Seed: SPQGASALP (MAGA4_HUMAN)
SPQGASALA

SEQ ID NO: 65078 - protein, 9 aa, Artificial Sequence
  Description of Artificial Sequence: Synthetic peptide
  Seed: YPSLREAAL (MAGA4_HUMAN)
YHSLREAAI

SEQ ID NO: 65079 - protein, 9 aa, Artificial Sequence
  Description of Artificial Sequence: Synthetic peptide
  Seed: VYGEPRKLL (MAGA4_HUMAN)
VIGEPRKLL

SEQ ID NO: 65080 - protein, 9 aa, Artificial Sequence
  Description of Artificial Sequence: Synthetic peptide
  Seed: DELAHFLLR (MAGA4_HUMAN)
DILAHFLLR

SEQ ID NO: 65081 - protein, 9 aa, Artificial Sequence
  Description of Artificial Sequence: Synthetic peptide
  Seed: TSPDAESLF (MAGA4_HUMAN)
TTPDAESLL

SEQ ID NO: 65082 - protein, 10 aa, Artificial Sequence
  Description of Artificial Sequence: Synthetic peptide
  Seed: YPSLREAALL (MAGA4_HUMAN)
YGSLREAALY

SEQ ID NO: 65083 - protein, 9 aa, Artificial Sequence
  Description of Artificial Sequence: Synthetic peptide
  Seed: SALPTTISF (MAGA4_HUMAN)
SSLPTTISR

SEQ ID NO: 65084 - protein, 9 aa, Artificial Sequence
  Description of Artificial Sequence: Synthetic peptide
  Seed: AVSSSSPLV (MAGA4_HUMAN)
AQSSSSPLF

SEQ ID NO: 65085 - protein, 9 aa, Artificial Sequence
  Description of Artificial Sequence: Synthetic peptide
  Seed: AQEEALGLV (MAGA4_HUMAN)
ALEEALGLV

SEQ ID NO: 65086 - protein, 9 aa, Artificial Sequence
  Description of Artificial Sequence: Synthetic peptide
  Seed: LPTTISFTC (MAGA4_HUMAN)
LATTISFTM

SEQ ID NO: 65087 - protein, 10 aa, Artificial Sequence
  Description of Artificial Sequence: Synthetic peptide
  Seed: PTTISFTCWR (MAGA4_HUMAN)
PNTISFTCWK

SEQ ID NO: 65088 - protein, 10 aa, Artificial Sequence
  Description of Artificial Sequence: Synthetic peptide
  Seed: WVQENYLEYR (MAGA4_HUMAN)
WTQENYLEYR

SEQ ID NO: 65089 - protein, 11 aa, Artificial Sequence
  Description of Artificial Sequence: Synthetic peptide
  Seed: RVRIAYPSLRE (MAGA4_HUMAN)
RTRIAYPSLRK

SEQ ID NO: 65090 - protein, 11 aa, Artificial Sequence
  Description of Artificial Sequence: Synthetic peptide
  Seed: STSPDAESLFR (MAGA4_HUMAN)
SISPDAESLFY

SEQ ID NO: 65091 - protein, 9 aa, Artificial Sequence
  Description of Artificial Sequence: Synthetic peptide
  Seed: RVRIAYPSL (MAGA4_HUMAN)
RNRIAYPSY

SEQ ID NO: 65092 - protein, 9 aa, Artificial Sequence
  Description of Artificial Sequence: Synthetic peptide
  Seed: GASALPTTI (MAGA4_HUMAN)
GQSALPTTW

SEQ ID NO: 65093 - protein, 10 aa, Artificial Sequence
  Description of Artificial Sequence: Synthetic peptide
  Seed: SLFREALSNK (MAGA4_HUMAN)
STFREALSNK

SEQ ID NO: 65094 - protein, 10 aa, Artificial Sequence
  Description of Artificial Sequence: Synthetic peptide
  Seed: ARVRIAYPSL (MAGA4_HUMAN)
AWVRIAYPSA

SEQ ID NO: 65095 - protein, 9 aa, Artificial Sequence
  Description of Artificial Sequence: Synthetic peptide
  Seed: ALLEEEEGV (MAGA4_HUMAN)
ATLEEEEGV

SEQ ID NO: 65096 - protein, 9 aa, Artificial Sequence
  Description of Artificial Sequence: Synthetic peptide
  Seed: LFREALSNK (MAGA4_HUMAN)
LYREALSNK

SEQ ID NO: 65097 - protein, 9 aa, Artificial Sequence
  Description of Artificial Sequence: Synthetic peptide
  Seed: RVRIAYPSL (MAGA4_HUMAN)
RQRIAYPSA

SEQ ID NO: 65098 - protein, 9 aa, Artificial Sequence
  Description of Artificial Sequence: Synthetic peptide
  Seed: SNPARYEFL (MAGA4_HUMAN)
SMPARYEFL

SEQ ID NO: 65099 - protein, 9 aa, Artificial Sequence
  Description of Artificial Sequence: Synthetic peptide
  Seed: RQVPGSNPA (MAGA4_HUMAN)
RFVPGSNPY

SEQ ID NO: 65100 - protein, 9 aa, Artificial Sequence
  Description of Artificial Sequence: Synthetic peptide
  Seed: IIVLGTIAM (MAGA4_HUMAN)
IYVLGTIAM

SEQ ID NO: 65101 - protein, 10 aa, Artificial Sequence
  Description of Artificial Sequence: Synthetic peptide
  Seed: GVYDGREHTV (MAGA4_HUMAN)
GVYDGREHTR

SEQ ID NO: 65102 - protein, 8 aa, Artificial Sequence
  Description of Artificial Sequence: Synthetic peptide
  Seed: KVDELAHF (MAGA4_HUMAN)
KADELAHM

SEQ ID NO: 65103 - protein, 9 aa, Artificial Sequence
  Description of Artificial Sequence: Synthetic peptide
  Seed: KVDELAHFL (MAGA4_HUMAN)
KIDELAHFI

SEQ ID NO: 65104 - protein, 9 aa, Artificial Sequence
  Description of Artificial Sequence: Synthetic peptide
  Seed: YKRCFPVIF (MAGA4_HUMAN)
YKRCFPVIL

SEQ ID NO: 65105 - protein, 8 aa, Artificial Sequence
  Description of Artificial Sequence: Synthetic peptide
  Seed: FGIDVKEV (MAGA4_HUMAN)
FAIDVKEL

SEQ ID NO: 65106 - protein, 9 aa, Artificial Sequence
  Description of Artificial Sequence: Synthetic peptide
  Seed: IAYPSLREA (MAGA4_HUMAN)
IVYPSLREY

SEQ ID NO: 65107 - protein, 9 aa, Artificial Sequence
  Description of Artificial Sequence: Synthetic peptide
  Seed: EEVPAAESA (MAGA4_HUMAN)
EHVPAAESI

SEQ ID NO: 65108 - protein, 9 aa, Artificial Sequence
  Description of Artificial Sequence: Synthetic peptide
  Seed: DELAHFLLR (MAGA4_HUMAN)
DVLAHFLLK

SEQ ID NO: 65109 - protein, 9 aa, Artificial Sequence
  Description of Artificial Sequence: Synthetic peptide
  Seed: YVKVLEHVV (MAGA4_HUMAN)
YTKVLEHVM

SEQ ID NO: 65110 - protein, 9 aa, Artificial Sequence
  Description of Artificial Sequence: Synthetic peptide
  Seed: GASALPTTI (MAGA4_HUMAN)
GPSALPTTV

SEQ ID NO: 65111 - protein, 9 aa, Artificial Sequence
  Description of Artificial Sequence: Synthetic peptide
  Seed: YKRCFPVIF (MAGA4_HUMAN)
YERCFPVIF

SEQ ID NO: 65112 - protein, 9 aa, Artificial Sequence
  Description of Artificial Sequence: Synthetic peptide
  Seed: KVLEHVVRV (MAGA4_HUMAN)
KVLEHVVRI

SEQ ID NO: 65113 - protein, 9 aa, Artificial Sequence
  Description of Artificial Sequence: Synthetic peptide
  Seed: GTLEEVPAA (MAGA4_HUMAN)
GLLEEVPAV

SEQ ID NO: 65114 - protein, 9 aa, Artificial Sequence
  Description of Artificial Sequence: Synthetic peptide
  Seed: GVMGVYDGR (MAGA4_HUMAN)
GAMGVYDGK

SEQ ID NO: 65115 - protein, 9 aa, Artificial Sequence
  Description of Artificial Sequence: Synthetic peptide
  Seed: RKYRAKELV (MAGA4_HUMAN)
RRYRAKELM

SEQ ID NO: 65116 - protein, 9 aa, Artificial Sequence
  Description of Artificial Sequence: Synthetic peptide
  Seed: TVYGEPRKL (MAGA4_HUMAN)
TMYGEPRKM

SEQ ID NO: 65117 - protein, 9 aa, Artificial Sequence
  Description of Artificial Sequence: Synthetic peptide
  Seed: ALLEEEEGV (MAGA4_HUMAN)
AQLEEEEGV

SEQ ID NO: 65118 - protein, 11 aa, Artificial Sequence
  Description of Artificial Sequence: Synthetic peptide
  Seed: STSPDAESLFR (MAGA4_HUMAN)
SMSPDAESLFY

SEQ ID NO: 65119 - protein, 11 aa, Artificial Sequence
  Description of Artificial Sequence: Synthetic peptide
  Seed: GLLGNNQIFPK (MAGA4_HUMAN)
GTLGNNQIFPK

SEQ ID NO: 65120 - protein, 9 aa, Artificial Sequence
  Description of Artificial Sequence: Synthetic peptide
  Seed: RVRIAYPSL (MAGA4_HUMAN)
RPRIAYPSF

SEQ ID NO: 65121 - protein, 9 aa, Artificial Sequence
  Description of Artificial Sequence: Synthetic peptide
  Seed: WVQENYLEY (MAGA4_HUMAN)
WTQENYLEF

SEQ ID NO: 65122 - protein, 9 aa, Artificial Sequence
  Description of Artificial Sequence: Synthetic peptide
  Seed: LVPGTLEEV (MAGA4_HUMAN)
LQPGTLEEL

SEQ ID NO: 65123 - protein, 9 aa, Artificial Sequence
  Description of Artificial Sequence: Synthetic peptide
  Seed: RAKELVTKA (MAGA4_HUMAN)
RAKELVTKH

SEQ ID NO: 65124 - protein, 9 aa, Artificial Sequence
  Description of Artificial Sequence: Synthetic peptide
  Seed: RCFPVIFGK (MAGA4_HUMAN)
RLFPVIFGR

SEQ ID NO: 65125 - protein, 10 aa, Artificial Sequence
  Description of Artificial Sequence: Synthetic peptide
  Seed: MLERVIKNYK (MAGA4_HUMAN)
MTERVIKNYK

SEQ ID NO: 65126 - protein, 9 aa, Artificial Sequence
  Description of Artificial Sequence: Synthetic peptide
  Seed: VNARVRIAY (MAGA4_HUMAN)
VWARVRIAY

SEQ ID NO: 65127 - protein, 9 aa, Artificial Sequence
  Description of Artificial Sequence: Synthetic peptide
  Seed: KVDELAHFL (MAGA4_HUMAN)
KMDELAHFW

SEQ ID NO: 65128 - protein, 9 aa, Artificial Sequence
  Description of Artificial Sequence: Synthetic peptide
  Seed: SEQKSQHCK (MAGA4_HUMAN)
STQKSQHCY

SEQ ID NO: 65129 - protein, 9 aa, Artificial Sequence
  Description of Artificial Sequence: Synthetic peptide
  Seed: ALPTTISFT (MAGA4_HUMAN)
ALPTTISFA

SEQ ID NO: 65130 - protein, 9 aa, Artificial Sequence
  Description of Artificial Sequence: Synthetic peptide
  Seed: RVRIAYPSL (MAGA4_HUMAN)
RYRIAYPSS

SEQ ID NO: 65131 - protein, 9 aa, Artificial Sequence
  Description of Artificial Sequence: Synthetic peptide
  Seed: VYDGREHTV (MAGA4_HUMAN)
VTDGREHTC

SEQ ID NO: 65132 - protein, 9 aa, Artificial Sequence
  Description of Artificial Sequence: Synthetic peptide
  Seed: IAYPSLREA (MAGA4_HUMAN)
IRYPSLREY

SEQ ID NO: 65133 - protein, 9 aa, Artificial Sequence
  Description of Artificial Sequence: Synthetic peptide
  Seed: IAYPSLREA (MAGA4_HUMAN)
IRYPSLREI

SEQ ID NO: 65134 - protein, 10 aa, Artificial Sequence
  Description of Artificial Sequence: Synthetic peptide
  Seed: KEVDPASNTY (MAGA4_HUMAN)
KLVDPASNTW

SEQ ID NO: 65135 - protein, 9 aa, Artificial Sequence
  Description of Artificial Sequence: Synthetic peptide
  Seed: RVRIAYPSL (MAGA4_HUMAN)
RFRIAYPSH

SEQ ID NO: 65136 - protein, 9 aa, Artificial Sequence
  Description of Artificial Sequence: Synthetic peptide
  Seed: RCFPVIFGK (MAGA4_HUMAN)
RPFPVIFGR

SEQ ID NO: 65137 - protein, 10 aa, Artificial Sequence
  Description of Artificial Sequence: Synthetic peptide
  Seed: STSPDAESLF (MAGA4_HUMAN)
SMSPDAESLY

SEQ ID NO: 65138 - protein, 9 aa, Artificial Sequence
  Description of Artificial Sequence: Synthetic peptide
  Seed: LLIIVLGTI (MAGA4_HUMAN)
LMIIVLGTI

SEQ ID NO: 65139 - protein, 9 aa, Artificial Sequence
  Description of Artificial Sequence: Synthetic peptide
  Seed: QIFPKTGLL (MAGA4_HUMAN)
QVFPKTGLY

SEQ ID NO: 65140 - protein, 9 aa, Artificial Sequence
  Description of Artificial Sequence: Synthetic peptide
  Seed: IAYPSLREA (MAGA4_HUMAN)
IAYPSLREV

SEQ ID NO: 65141 - protein, 9 aa, Artificial Sequence
  Description of Artificial Sequence: Synthetic peptide
  Seed: QIFPKTGLL (MAGA4_HUMAN)
QMFPKTGLY

SEQ ID NO: 65142 - protein, 9 aa, Artificial Sequence
  Description of Artificial Sequence: Synthetic peptide
  Seed: SAGPPQSPQ (MAGA4_HUMAN)
STGPPQSPY

SEQ ID NO: 65143 - protein, 11 aa, Artificial Sequence
  Description of Artificial Sequence: Synthetic peptide
  Seed: SQEEEGPSTSP (MAGA4_HUMAN)
SEEEEGPSTSM

SEQ ID NO: 65144 - protein, 9 aa, Artificial Sequence
  Description of Artificial Sequence: Synthetic peptide
  Seed: SEEEIWEEL (MAGA4_HUMAN)
SEEEIWEEC

SEQ ID NO: 65145 - protein, 9 aa, Artificial Sequence
  Description of Artificial Sequence: Synthetic peptide
  Seed: QIFPKTGLL (MAGA4_HUMAN)
QSFPKTGLR

SEQ ID NO: 65146 - protein, 9 aa, Artificial Sequence
  Description of Artificial Sequence: Synthetic peptide
  Seed: GSNPARYEF (MAGA4_HUMAN)
GANPARYEM

SEQ ID NO: 65147 - protein, 11 aa, Artificial Sequence
  Description of Artificial Sequence: Synthetic peptide
  Seed: GLLGNNQIFPK (MAGA4_HUMAN)
GVLGNNQIFPK

SEQ ID NO: 65148 - protein, 10 aa, Artificial Sequence
  Description of Artificial Sequence: Synthetic peptide
  Seed: RVRIAYPSLR (MAGA4_HUMAN)
RTRIAYPSLC

SEQ ID NO: 65149 - protein, 10 aa, Artificial Sequence
  Description of Artificial Sequence: Synthetic peptide
  Seed: RVRIAYPSLR (MAGA4_HUMAN)
RWRIAYPSLM

SEQ ID NO: 65150 - protein, 10 aa, Artificial Sequence
  Description of Artificial Sequence: Synthetic peptide
  Seed: LAHFLLRKYR (MAGA4_HUMAN)
LQHFLLRKYR

SEQ ID NO: 65151 - protein, 9 aa, Artificial Sequence
  Description of Artificial Sequence: Synthetic peptide
  Seed: AHFLLRKYR (MAGA4_HUMAN)
AFFLLRKYR

SEQ ID NO: 65152 - protein, 11 aa, Artificial Sequence
  Description of Artificial Sequence: Synthetic peptide
  Seed: EMLERVIKNYK (MAGA4_HUMAN)
EMLERVIKNYR

SEQ ID NO: 65153 - protein, 9 aa, Artificial Sequence
  Description of Artificial Sequence: Synthetic peptide
  Seed: RVRIAYPSL (MAGA4_HUMAN)
RSRIAYPSC

SEQ ID NO: 65154 - protein, 9 aa, Artificial Sequence
  Description of Artificial Sequence: Synthetic peptide
  Seed: TSPDAESLF (MAGA4_HUMAN)
TAPDAESLY

SEQ ID NO: 65155 - protein, 8 aa, Artificial Sequence
  Description of Artificial Sequence: Synthetic peptide
  Seed: KVDELAHF (MAGA4_HUMAN)
KMDELAHL

SEQ ID NO: 65156 - protein, 9 aa, Artificial Sequence
  Description of Artificial Sequence: Synthetic peptide
  Seed: AESLFREAL (MAGA4_HUMAN)
AESLFREAY

SEQ ID NO: 65157 - protein, 9 aa, Artificial Sequence
  Description of Artificial Sequence: Synthetic peptide
  Seed: KYRAKELVT (MAGA4_HUMAN)
KARAKELVV

SEQ ID NO: 65158 - protein, 10 aa, Artificial Sequence
  Description of Artificial Sequence: Synthetic peptide
  Seed: ESAGPPQSPQ (MAGA4_HUMAN)
ELAGPPQSPR

SEQ ID NO: 65159 - protein, 9 aa, Artificial Sequence
  Description of Artificial Sequence: Synthetic peptide
  Seed: GTLEEVPAA (MAGA4_HUMAN)
GALEEVPAL

SEQ ID NO: 65160 - protein, 9 aa, Artificial Sequence
  Description of Artificial Sequence: Synthetic peptide
  Seed: RVRIAYPSL (MAGA4_HUMAN)
RSRIAYPSI

SEQ ID NO: 65161 - protein, 9 aa, Artificial Sequence
  Description of Artificial Sequence: Synthetic peptide
  Seed: YKRCFPVIF (MAGA4_HUMAN)
YNRCFPVIF

SEQ ID NO: 65162 - protein, 10 aa, Artificial Sequence
  Description of Artificial Sequence: Synthetic peptide
  Seed: ASALPTTISF (MAGA4_HUMAN)
AAALPTTISY

SEQ ID NO: 65163 - protein, 9 aa, Artificial Sequence
  Description of Artificial Sequence: Synthetic peptide
  Seed: YPSLREAAL (MAGA4_HUMAN)
YASLREAAV

SEQ ID NO: 65164 - protein, 9 aa, Artificial Sequence
  Description of Artificial Sequence: Synthetic peptide
  Seed: DPASNTYTL (MAGA4_HUMAN)
DAASNTYTF

SEQ ID NO: 65165 - protein, 10 aa, Artificial Sequence
  Description of Artificial Sequence: Synthetic peptide
  Seed: RVRIAYPSLR (MAGA4_HUMAN)
RARIAYPSLI

SEQ ID NO: 65166 - protein, 9 aa, Artificial Sequence
  Description of Artificial Sequence: Synthetic peptide
  Seed: SSPLVPGTL (MAGA4_HUMAN)
SSPLVPGTW

SEQ ID NO: 65167 - protein, 10 aa, Artificial Sequence
  Description of Artificial Sequence: Synthetic peptide
  Seed: KASESLKMIF (MAGA4_HUMAN)
KQSESLKMIL

SEQ ID NO: 65168 - protein, 9 aa, Artificial Sequence
  Description of Artificial Sequence: Synthetic peptide
  Seed: AVSSSSPLV (MAGA4_HUMAN)
ALSSSSPLW

SEQ ID NO: 65169 - protein, 8 aa, Artificial Sequence
  Description of Artificial Sequence: Synthetic peptide
  Seed: KVDELAHF (MAGA4_HUMAN)
KFDELAHM

SEQ ID NO: 65170 - protein, 9 aa, Artificial Sequence
  Description of Artificial Sequence: Synthetic peptide
  Seed: KASESLKMI (MAGA4_HUMAN)
KVSESLKMI

SEQ ID NO: 65171 - protein, 9 aa, Artificial Sequence
  Description of Artificial Sequence: Synthetic peptide
  Seed: KTGLLIIVL (MAGA4_HUMAN)
KLGLLIIVV

SEQ ID NO: 65172 - protein, 9 aa, Artificial Sequence
  Description of Artificial Sequence: Synthetic peptide
  Seed: VNARVRIAY (MAGA4_HUMAN)
VTARVRIAY

SEQ ID NO: 65173 - protein, 9 aa, Artificial Sequence
  Description of Artificial Sequence: Synthetic peptide
  Seed: GVYDGREHT (MAGA4_HUMAN)
GTYDGREHI

SEQ ID NO: 65174 - protein, 11 aa, Artificial Sequence
  Description of Artificial Sequence: Synthetic peptide
  Seed: QHCKPEEGVEA (MAGA4_HUMAN)
QHCKPEEGVEM

SEQ ID NO: 65175 - protein, 8 aa, Artificial Sequence
  Description of Artificial Sequence: Synthetic peptide
  Seed: YPSLREAA (MAGA4_HUMAN)
YPSLREAL

SEQ ID NO: 65176 - protein, 10 aa, Artificial Sequence
  Description of Artificial Sequence: Synthetic peptide
  Seed: KVDELAHFLL (MAGA4_HUMAN)
KLDELAHFLF

SEQ ID NO: 65177 - protein, 10 aa, Artificial Sequence
  Description of Artificial Sequence: Synthetic peptide
  Seed: RVNARVRIAY (MAGA4_HUMAN)
RTNARVRIAL

SEQ ID NO: 65178 - protein, 10 aa, Artificial Sequence
  Description of Artificial Sequence: Synthetic peptide
  Seed: KVLEHVVRVN (MAGA4_HUMAN)
KLLEHVVRVY

SEQ ID NO: 65179 - protein, 9 aa, Artificial Sequence
  Description of Artificial Sequence: Synthetic peptide
  Seed: SSPLVPGTL (MAGA4_HUMAN)
SAPLVPGTV

SEQ ID NO: 65180 - protein, 9 aa, Artificial Sequence
  Description of Artificial Sequence: Synthetic peptide
  Seed: RAKELVTKA (MAGA4_HUMAN)
RGKELVTKY

SEQ ID NO: 65181 - protein, 9 aa, Artificial Sequence
  Description of Artificial Sequence: Synthetic peptide
  Seed: IIVLGTIAM (MAGA4_HUMAN)
IMVLGTIAM

SEQ ID NO: 65182 - protein, 10 aa, Artificial Sequence
  Description of Artificial Sequence: Synthetic peptide
  Seed: YRQVPGSNPA (MAGA4_HUMAN)
YMQVPGSNPL

SEQ ID NO: 65183 - protein, 9 aa, Artificial Sequence
  Description of Artificial Sequence: Synthetic peptide
  Seed: SALPTTISF (MAGA4_HUMAN)
SWLPTTISW

SEQ ID NO: 65184 - protein, 10 aa, Artificial Sequence
  Description of Artificial Sequence: Synthetic peptide
  Seed: RVRIAYPSLR (MAGA4_HUMAN)
RVRIAYPSLI

SEQ ID NO: 65185 - protein, 9 aa, Artificial Sequence
  Description of Artificial Sequence: Synthetic peptide
  Seed: KMIFGIDVK (MAGA4_HUMAN)
KSIFGIDVK

SEQ ID NO: 65186 - protein, 9 aa, Artificial Sequence
  Description of Artificial Sequence: Synthetic peptide
  Seed: RCFPVIFGK (MAGA4_HUMAN)
RMFPVIFGI

SEQ ID NO: 65187 - protein, 9 aa, Artificial Sequence
  Description of Artificial Sequence: Synthetic peptide
  Seed: EEVPAAESA (MAGA4_HUMAN)
EHVPAAESV

SEQ ID NO: 65188 - protein, 9 aa, Artificial Sequence
  Description of Artificial Sequence: Synthetic peptide
  Seed: ERVIKNYKR (MAGA4_HUMAN)
EMVIKNYKR

SEQ ID NO: 65189 - protein, 9 aa, Artificial Sequence
  Description of Artificial Sequence: Synthetic peptide
  Seed: GASALPTTI (MAGA4_HUMAN)
GTSALPTTL

SEQ ID NO: 65190 - protein, 10 aa, Artificial Sequence
  Description of Artificial Sequence: Synthetic peptide
  Seed: RQVPGSNPAR (MAGA4_HUMAN)
RLVPGSNPAR

SEQ ID NO: 65191 - protein, 9 aa, Artificial Sequence
  Description of Artificial Sequence: Synthetic peptide
  Seed: ESLKMIFGI (MAGA4_HUMAN)
EILKMIFGV

SEQ ID NO: 65192 - protein, 10 aa, Artificial Sequence
  Description of Artificial Sequence: Synthetic peptide
  Seed: RVRIAYPSLR (MAGA4_HUMAN)
RNRIAYPSLA

SEQ ID NO: 65193 - protein, 9 aa, Artificial Sequence
  Description of Artificial Sequence: Synthetic peptide
  Seed: RKYRAKELV (MAGA4_HUMAN)
RQYRAKELM

SEQ ID NO: 65194 - protein, 9 aa, Artificial Sequence
  Description of Artificial Sequence: Synthetic peptide
  Seed: IAYPSLREA (MAGA4_HUMAN)
IAYPSLREW

SEQ ID NO: 65195 - protein, 10 aa, Artificial Sequence
  Description of Artificial Sequence: Synthetic peptide
  Seed: RQVPGSNPAR (MAGA4_HUMAN)
RMVPGSNPAR

SEQ ID NO: 65196 - protein, 10 aa, Artificial Sequence
  Description of Artificial Sequence: Synthetic peptide
  Seed: RVRIAYPSLR (MAGA4_HUMAN)
RQRIAYPSLF

SEQ ID NO: 65197 - protein, 9 aa, Artificial Sequence
  Description of Artificial Sequence: Synthetic peptide
  Seed: SSSPLVPGT (MAGA4_HUMAN)
SISPLVPGA

SEQ ID NO: 65198 - protein, 10 aa, Artificial Sequence
  Description of Artificial Sequence: Synthetic peptide
  Seed: WVQENYLEYR (MAGA4_HUMAN)
WMQENYLEYR

SEQ ID NO: 65199 - protein, 9 aa, Artificial Sequence
  Description of Artificial Sequence: Synthetic peptide
  Seed: NKVDELAHF (MAGA4_HUMAN)
NAVDELAHF

SEQ ID NO: 65200 - protein, 10 aa, Artificial Sequence
  Description of Artificial Sequence: Synthetic peptide
  Seed: YRQVPGSNPA (MAGA4_HUMAN)
YKQVPGSNPM

SEQ ID NO: 65201 - protein, 10 aa, Artificial Sequence
  Description of Artificial Sequence: Synthetic peptide
  Seed: VDPASNTYTL (MAGA4_HUMAN)
VVPASNTYTY

SEQ ID NO: 65202 - protein, 9 aa, Artificial Sequence
  Description of Artificial Sequence: Synthetic peptide
  Seed: EELGVMGVY (MAGA4_HUMAN)
EELGVMGVA

SEQ ID NO: 65203 - protein, 10 aa, Artificial Sequence
  Description of Artificial Sequence: Synthetic peptide
  Seed: EAAVSSSSPL (MAGA4_HUMAN)
EEAVSSSSPV

SEQ ID NO: 65204 - protein, 9 aa, Artificial Sequence
  Description of Artificial Sequence: Synthetic peptide
  Seed: IAYPSLREA (MAGA4_HUMAN)
IQYPSLREV

SEQ ID NO: 65205 - protein, 9 aa, Artificial Sequence
  Description of Artificial Sequence: Synthetic peptide
  Seed: SYVKVLEHV (MAGA4_HUMAN)
SVVKVLEHY

SEQ ID NO: 65206 - protein, 10 aa, Artificial Sequence
  Description of Artificial Sequence: Synthetic peptide
  Seed: RVNARVRIAY (MAGA4_HUMAN)
RVNARVRIAA

SEQ ID NO: 65207 - protein, 9 aa, Artificial Sequence
  Description of Artificial Sequence: Synthetic peptide
  Seed: MLERVIKNY (MAGA4_HUMAN)
MQERVIKNY

SEQ ID NO: 65208 - protein, 9 aa, Artificial Sequence
  Description of Artificial Sequence: Synthetic peptide
  Seed: SSPLVPGTL (MAGA4_HUMAN)
SIPLVPGTV

SEQ ID NO: 65209 - protein, 11 aa, Artificial Sequence
  Description of Artificial Sequence: Synthetic peptide
  Seed: RVRIAYPSLRE (MAGA4_HUMAN)
RVRIAYPSLRV

SEQ ID NO: 65210 - protein, 10 aa, Artificial Sequence
  Description of Artificial Sequence: Synthetic peptide
  Seed: RVRIAYPSLR (MAGA4_HUMAN)
RHRIAYPSLY

SEQ ID NO: 65211 - protein, 9 aa, Artificial Sequence
  Description of Artificial Sequence: Synthetic peptide
  Seed: KYRAKELVT (MAGA4_HUMAN)
KTRAKELVR

SEQ ID NO: 65212 - protein, 10 aa, Artificial Sequence
  Description of Artificial Sequence: Synthetic peptide
  Seed: ASALPTTISF (MAGA4_HUMAN)
AFALPTTISM

SEQ ID NO: 65213 - protein, 9 aa, Artificial Sequence
  Description of Artificial Sequence: Synthetic peptide
  Seed: EIWEELGVM (MAGA4_HUMAN)
ETWEELGVM

SEQ ID NO: 65214 - protein, 11 aa, Artificial Sequence
  Description of Artificial Sequence: Synthetic peptide
  Seed: IAYPSLREAAL (MAGA4_HUMAN)
ITYPSLREAAM

SEQ ID NO: 65215 - protein, 10 aa, Artificial Sequence
  Description of Artificial Sequence: Synthetic peptide
  Seed: ASALPTTISF (MAGA4_HUMAN)
AAALPTTISM

SEQ ID NO: 65216 - protein, 9 aa, Artificial Sequence
  Description of Artificial Sequence: Synthetic peptide
  Seed: NKVDELAHF (MAGA4_HUMAN)
NQVDELAHF

SEQ ID NO: 65217 - protein, 9 aa, Artificial Sequence
  Description of Artificial Sequence: Synthetic peptide
  Seed: STSPDAESL (MAGA4_HUMAN)
SRSPDAESM

SEQ ID NO: 65218 - protein, 9 aa, Artificial Sequence
  Description of Artificial Sequence: Synthetic peptide
  Seed: SNPARYEFL (MAGA4_HUMAN)
SIPARYEFL

SEQ ID NO: 65219 - protein, 10 aa, Artificial Sequence
  Description of Artificial Sequence: Synthetic peptide
  Seed: RVRIAYPSLR (MAGA4_HUMAN)
RVRIAYPSLC

SEQ ID NO: 65220 - protein, 9 aa, Artificial Sequence
  Description of Artificial Sequence: Synthetic peptide
  Seed: RVRIAYPSL (MAGA4_HUMAN)
RWRIAYPSV

SEQ ID NO: 65221 - protein, 8 aa, Artificial Sequence
  Description of Artificial Sequence: Synthetic peptide
  Seed: AESLFREA (MAGA4_HUMAN)
AESLFREI

SEQ ID NO: 65222 - protein, 9 aa, Artificial Sequence
  Description of Artificial Sequence: Synthetic peptide
  Seed: EVDPASNTY (MAGA4_HUMAN)
EIDPASNTV

SEQ ID NO: 65223 - protein, 9 aa, Artificial Sequence
  Description of Artificial Sequence: Synthetic peptide
  Seed: YPSLREAAL (MAGA4_HUMAN)
YHSLREAAM

SEQ ID NO: 65224 - protein, 9 aa, Artificial Sequence
  Description of Artificial Sequence: Synthetic peptide
  Seed: TSPDAESLF (MAGA4_HUMAN)
TRPDAESLL

SEQ ID NO: 65225 - protein, 10 aa, Artificial Sequence
  Description of Artificial Sequence: Synthetic peptide
  Seed: ARVRIAYPSL (MAGA4_HUMAN)
AMVRIAYPSV

SEQ ID NO: 65226 - protein, 11 aa, Artificial Sequence
  Description of Artificial Sequence: Synthetic peptide
  Seed: YVKVLEHVVRV (MAGA4_HUMAN)
YKKVLEHVVRV

SEQ ID NO: 65227 - protein, 9 aa, Artificial Sequence
  Description of Artificial Sequence: Synthetic peptide
  Seed: VYGEPRKLL (MAGA4_HUMAN)
VRGEPRKLM

SEQ ID NO: 65228 - protein, 10 aa, Artificial Sequence
  Description of Artificial Sequence: Synthetic peptide
  Seed: GVYDGREHTV (MAGA4_HUMAN)
GLYDGREHTI

SEQ ID NO: 65229 - protein, 9 aa, Artificial Sequence
  Description of Artificial Sequence: Synthetic peptide
  Seed: MSSEQKSQH (MAGA4_HUMAN)
MTSEQKSQY

SEQ ID NO: 65230 - protein, 11 aa, Artificial Sequence
  Description of Artificial Sequence: Synthetic peptide
  Seed: EMLERVIKNYK (MAGA4_HUMAN)
EFLERVIKNYR

SEQ ID NO: 65231 - protein, 9 aa, Artificial Sequence
  Description of Artificial Sequence: Synthetic peptide
  Seed: ELAHFLLRK (MAGA4_HUMAN)
ETAHFLLRR

SEQ ID NO: 65232 - protein, 9 aa, Artificial Sequence
  Description of Artificial Sequence: Synthetic peptide
  Seed: RVRIAYPSL (MAGA4_HUMAN)
RLRIAYPSP

SEQ ID NO: 65233 - protein, 9 aa, Artificial Sequence
  Description of Artificial Sequence: Synthetic peptide
  Seed: RVRIAYPSL (MAGA4_HUMAN)
RNRIAYPSV

SEQ ID NO: 65234 - protein, 10 aa, Artificial Sequence
  Description of Artificial Sequence: Synthetic peptide
  Seed: NQIFPKTGLL (MAGA4_HUMAN)
NHIFPKTGLF

SEQ ID NO: 65235 - protein, 9 aa, Artificial Sequence
  Description of Artificial Sequence: Synthetic peptide
  Seed: MLERVIKNY (MAGA4_HUMAN)
MSERVIKNY

SEQ ID NO: 65236 - protein, 10 aa, Artificial Sequence
  Description of Artificial Sequence: Synthetic peptide
  Seed: GSNPARYEFL (MAGA4_HUMAN)
GSNPARYEFW

SEQ ID NO: 65237 - protein, 10 aa, Artificial Sequence
  Description of Artificial Sequence: Synthetic peptide
  Seed: RVRIAYPSLR (MAGA4_HUMAN)
RHRIAYPSLF

SEQ ID NO: 65238 - protein, 10 aa, Artificial Sequence
  Description of Artificial Sequence: Synthetic peptide
  Seed: KELVTKAEML (MAGA4_HUMAN)
KELVTKAEMY

SEQ ID NO: 65239 - protein, 10 aa, Artificial Sequence
  Description of Artificial Sequence: Synthetic peptide
  Seed: VDPASNTYTL (MAGA4_HUMAN)
VIPASNTYTF

SEQ ID NO: 65240 - protein, 9 aa, Artificial Sequence
  Description of Artificial Sequence: Synthetic peptide
  Seed: GTLEEVPAA (MAGA4_HUMAN)
GILEEVPAI

SEQ ID NO: 65241 - protein, 9 aa, Artificial Sequence
  Description of Artificial Sequence: Synthetic peptide
  Seed: KMIFGIDVK (MAGA4_HUMAN)
KVIFGIDVK

SEQ ID NO: 65242 - protein, 9 aa, Artificial Sequence
  Description of Artificial Sequence: Synthetic peptide
  Seed: AAVSSSSPL (MAGA4_HUMAN)
AYVSSSSPW

SEQ ID NO: 65243 - protein, 11 aa, Artificial Sequence
  Description of Artificial Sequence: Synthetic peptide
  Seed: SAGPPQSPQGA (MAGA4_HUMAN)
SAGPPQSPQGL

SEQ ID NO: 65244 - protein, 9 aa, Artificial Sequence
  Description of Artificial Sequence: Synthetic peptide
  Seed: LVPGTLEEV (MAGA4_HUMAN)
LQPGTLEEV

SEQ ID NO: 65245 - protein, 9 aa, Artificial Sequence
  Description of Artificial Sequence: Synthetic peptide
  Seed: RCFPVIFGK (MAGA4_HUMAN)
RKFPVIFGR

SEQ ID NO: 65246 - protein, 9 aa, Artificial Sequence
  Description of Artificial Sequence: Synthetic peptide
  Seed: SSSPLVPGT (MAGA4_HUMAN)
SSSPLVPGL

SEQ ID NO: 65247 - protein, 9 aa, Artificial Sequence
  Description of Artificial Sequence: Synthetic peptide
  Seed: STSPDAESL (MAGA4_HUMAN)
SASPDAESF

SEQ ID NO: 65248 - protein, 9 aa, Artificial Sequence
  Description of Artificial Sequence: Synthetic peptide
  Seed: TVYGEPRKL (MAGA4_HUMAN)
TVYGEPRKR

SEQ ID NO: 65249 - protein, 11 aa, Artificial Sequence
  Description of Artificial Sequence: Synthetic peptide
  Seed: KVDELAHFLLR (MAGA4_HUMAN)
KTDELAHFLLK

SEQ ID NO: 65250 - protein, 9 aa, Artificial Sequence
  Description of Artificial Sequence: Synthetic peptide
  Seed: YKRCFPVIF (MAGA4_HUMAN)
YIRCFPVIY

SEQ ID NO: 65251 - protein, 9 aa, Artificial Sequence
  Description of Artificial Sequence: Synthetic peptide
  Seed: TVYGEPRKL (MAGA4_HUMAN)
TAYGEPRKI

SEQ ID NO: 65252 - protein, 10 aa, Artificial Sequence
  Description of Artificial Sequence: Synthetic peptide
  Seed: SNKVDELAHF (MAGA4_HUMAN)
SMKVDELAHF

SEQ ID NO: 65253 - protein, 9 aa, Artificial Sequence
  Description of Artificial Sequence: Synthetic peptide
  Seed: GLLGNNQIF (MAGA4_HUMAN)
GKLGNNQIY

SEQ ID NO: 65254 - protein, 11 aa, Artificial Sequence
  Description of Artificial Sequence: Synthetic peptide
  Seed: IAYPSLREAAL (MAGA4_HUMAN)
IAYPSLREAAF

SEQ ID NO: 65255 - protein, 9 aa, Artificial Sequence
  Description of Artificial Sequence: Synthetic peptide
  Seed: KVLEHVVRV (MAGA4_HUMAN)
KYLEHVVRF

SEQ ID NO: 65256 - protein, 10 aa, Artificial Sequence
  Description of Artificial Sequence: Synthetic peptide
  Seed: LPTTISFTCW (MAGA4_HUMAN)
LFTTISFTCW

SEQ ID NO: 65257 - protein, 9 aa, Artificial Sequence
  Description of Artificial Sequence: Synthetic peptide
  Seed: TQDWVQENY (MAGA4_HUMAN)
TIDWVQENV

SEQ ID NO: 65258 - protein, 9 aa, Artificial Sequence
  Description of Artificial Sequence: Synthetic peptide
  Seed: NTYTLVTCL (MAGA4_HUMAN)
NVYTLVTCR

SEQ ID NO: 65259 - protein, 9 aa, Artificial Sequence
  Description of Artificial Sequence: Synthetic peptide
  Seed: KVLEHVVRV (MAGA4_HUMAN)
KLLEHVVRI

SEQ ID NO: 65260 - protein, 9 aa, Artificial Sequence
  Description of Artificial Sequence: Synthetic peptide
  Seed: NQIFPKTGL (MAGA4_HUMAN)
NHIFPKTGF

SEQ ID NO: 65261 - protein, 9 aa, Artificial Sequence
  Description of Artificial Sequence: Synthetic peptide
  Seed: AAVSSSSPL (MAGA4_HUMAN)
AVVSSSSPM

SEQ ID NO: 65262 - protein, 9 aa, Artificial Sequence
  Description of Artificial Sequence: Synthetic peptide
  Seed: KVLEHVVRV (MAGA4_HUMAN)
KRLEHVVRV

SEQ ID NO: 65263 - protein, 10 aa, Artificial Sequence
  Description of Artificial Sequence: Synthetic peptide
  Seed: KVLEHVVRVN (MAGA4_HUMAN)
KLLEHVVRVQ

SEQ ID NO: 65264 - protein, 9 aa, Artificial Sequence
  Description of Artificial Sequence: Synthetic peptide
  Seed: RVNARVRIA (MAGA4_HUMAN)
RTNARVRIA

SEQ ID NO: 65265 - protein, 9 aa, Artificial Sequence
  Description of Artificial Sequence: Synthetic peptide
  Seed: AAVSSSSPL (MAGA4_HUMAN)
ALVSSSSPI

SEQ ID NO: 65266 - protein, 9 aa, Artificial Sequence
  Description of Artificial Sequence: Synthetic peptide
  Seed: HVVRVNARV (MAGA4_HUMAN)
HLVRVNARL

SEQ ID NO: 65267 - protein, 11 aa, Artificial Sequence
  Description of Artificial Sequence: Synthetic peptide
  Seed: RVNARVRIAYP (MAGA4_HUMAN)
RHNARVRIAYK

SEQ ID NO: 65268 - protein, 9 aa, Artificial Sequence
  Description of Artificial Sequence: Synthetic peptide
  Seed: ESLKMIFGI (MAGA4_HUMAN)
EILKMIFGI

SEQ ID NO: 65269 - protein, 10 aa, Artificial Sequence
  Description of Artificial Sequence: Synthetic peptide
  Seed: KNYKRCFPVI (MAGA4_HUMAN)
KVYKRCFPVK

SEQ ID NO: 65270 - protein, 9 aa, Artificial Sequence
  Description of Artificial Sequence: Synthetic peptide
  Seed: SALPTTISF (MAGA4_HUMAN)
SSLPTTISL

SEQ ID NO: 65271 - protein, 9 aa, Artificial Sequence
  Description of Artificial Sequence: Synthetic peptide
  Seed: WVQENYLEY (MAGA4_HUMAN)
WPQENYLEL

SEQ ID NO: 65272 - protein, 11 aa, Artificial Sequence
  Description of Artificial Sequence: Synthetic peptide
  Seed: REAALLEEEEG (MAGA4_HUMAN)
REAALLEEEEV

SEQ ID NO: 65273 - protein, 9 aa, Artificial Sequence
  Description of Artificial Sequence: Synthetic peptide
  Seed: HVVRVNARV (MAGA4_HUMAN)
HTVRVNARK

SEQ ID NO: 65274 - protein, 10 aa, Artificial Sequence
  Description of Artificial Sequence: Synthetic peptide
  Seed: YPSLREAALL (MAGA4_HUMAN)
YTSLREAALW

SEQ ID NO: 65275 - protein, 9 aa, Artificial Sequence
  Description of Artificial Sequence: Synthetic peptide
  Seed: RCFPVIFGK (MAGA4_HUMAN)
RAFPVIFGK

SEQ ID NO: 65276 - protein, 9 aa, Artificial Sequence
  Description of Artificial Sequence: Synthetic peptide
  Seed: RVRIAYPSL (MAGA4_HUMAN)
RSRIAYPSE

SEQ ID NO: 65277 - protein, 9 aa, Artificial Sequence
  Description of Artificial Sequence: Synthetic peptide
  Seed: IFPKTGLLI (MAGA4_HUMAN)
ILPKTGLLL

SEQ ID NO: 65278 - protein, 9 aa, Artificial Sequence
  Description of Artificial Sequence: Synthetic peptide
  Seed: SAGPPQSPQ (MAGA4_HUMAN)
SLGPPQSPY

SEQ ID NO: 65279 - protein, 9 aa, Artificial Sequence
  Description of Artificial Sequence: Synthetic peptide
  Seed: VYDGREHTV (MAGA4_HUMAN)
VSDGREHTF

SEQ ID NO: 65280 - protein, 9 aa, Artificial Sequence
  Description of Artificial Sequence: Synthetic peptide
  Seed: RVRIAYPSL (MAGA4_HUMAN)
RIRIAYPSA

SEQ ID NO: 65281 - protein, 9 aa, Artificial Sequence
  Description of Artificial Sequence: Synthetic peptide
  Seed: RQVPGSNPA (MAGA4_HUMAN)
REVPGSNPA

SEQ ID NO: 65282 - protein, 9 aa, Artificial Sequence
  Description of Artificial Sequence: Synthetic peptide
  Seed: ESLKMIFGI (MAGA4_HUMAN)
ESLKMIFGL

SEQ ID NO: 65283 - protein, 9 aa, Artificial Sequence
  Description of Artificial Sequence: Synthetic peptide
  Seed: KVDELAHFL (MAGA4_HUMAN)
KLDELAHFI

SEQ ID NO: 65284 - protein, 9 aa, Artificial Sequence
  Description of Artificial Sequence: Synthetic peptide
  Seed: RQVPGSNPA (MAGA4_HUMAN)
REVPGSNPV

SEQ ID NO: 65285 - protein, 9 aa, Artificial Sequence
  Description of Artificial Sequence: Synthetic peptide
  Seed: VYDGREHTV (MAGA4_HUMAN)
VFDGREHTA

SEQ ID NO: 65286 - protein, 10 aa, Artificial Sequence
  Description of Artificial Sequence: Synthetic peptide
  Seed: QIFPKTGLLI (MAGA4_HUMAN)
QYFPKTGLLF

SEQ ID NO: 65287 - protein, 9 aa, Artificial Sequence
  Description of Artificial Sequence: Synthetic peptide
  Seed: LEHVVRVNA (MAGA4_HUMAN)
LEHVVRVNY

SEQ ID NO: 65288 - protein, 10 aa, Artificial Sequence
  Description of Artificial Sequence: Synthetic peptide
  Seed: LGVMGVYDGR (MAGA4_HUMAN)
LRVMGVYDGR

SEQ ID NO: 65289 - protein, 9 aa, Artificial Sequence
  Description of Artificial Sequence: Synthetic peptide
  Seed: EIWEELGVM (MAGA4_HUMAN)
EAWEELGVR

SEQ ID NO: 65290 - protein, 10 aa, Artificial Sequence
  Description of Artificial Sequence: Synthetic peptide
  Seed: STSPDAESLF (MAGA4_HUMAN)
SQSPDAESLY

SEQ ID NO: 65291 - protein, 9 aa, Artificial Sequence
  Description of Artificial Sequence: Synthetic peptide
  Seed: RQVPGSNPA (MAGA4_HUMAN)
RRVPGSNPI

SEQ ID NO: 65292 - protein, 8 aa, Artificial Sequence
  Description of Artificial Sequence: Synthetic peptide
  Seed: RVRIAYPS (MAGA4_HUMAN)
RSRIAYPV

SEQ ID NO: 65293 - protein, 9 aa, Artificial Sequence
  Description of Artificial Sequence: Synthetic peptide
  Seed: ERVIKNYKR (MAGA4_HUMAN)
EGVIKNYKR

SEQ ID NO: 65294 - protein, 8 aa, Artificial Sequence
  Description of Artificial Sequence: Synthetic peptide
  Seed: ASALPTTI (MAGA4_HUMAN)
ASALPTTW

SEQ ID NO: 65295 - protein, 9 aa, Artificial Sequence
  Description of Artificial Sequence: Synthetic peptide
  Seed: IAYPSLREA (MAGA4_HUMAN)
ITYPSLREL

SEQ ID NO: 65296 - protein, 9 aa, Artificial Sequence
  Description of Artificial Sequence: Synthetic peptide
  Seed: TVYGEPRKL (MAGA4_HUMAN)
TMYGEPRKL

SEQ ID NO: 65297 - protein, 9 aa, Artificial Sequence
  Description of Artificial Sequence: Synthetic peptide
  Seed: RAKELVTKA (MAGA4_HUMAN)
RPKELVTKL

SEQ ID NO: 65298 - protein, 9 aa, Artificial Sequence
  Description of Artificial Sequence: Synthetic peptide
  Seed: TTEEQEAAV (MAGA4_HUMAN)
TTEEQEAAI

SEQ ID NO: 65299 - protein, 10 aa, Artificial Sequence
  Description of Artificial Sequence: Synthetic peptide
  Seed: GLLIIVLGTI (MAGA4_HUMAN)
GRLIIVLGTV

SEQ ID NO: 65300 - protein, 9 aa, Artificial Sequence
  Description of Artificial Sequence: Synthetic peptide
  Seed: AHFLLRKYR (MAGA4_HUMAN)
AVFLLRKYR

SEQ ID NO: 65301 - protein, 9 aa, Artificial Sequence
  Description of Artificial Sequence: Synthetic peptide
  Seed: DPASNTYTL (MAGA4_HUMAN)
DAASNTYTV

SEQ ID NO: 65302 - protein, 9 aa, Artificial Sequence
  Description of Artificial Sequence: Synthetic peptide
  Seed: QIFPKTGLL (MAGA4_HUMAN)
QLFPKTGLA

SEQ ID NO: 65303 - protein, 9 aa, Artificial Sequence
  Description of Artificial Sequence: Synthetic peptide
  Seed: YTLVTCLGL (MAGA4_HUMAN)
YSLVTCLGW

SEQ ID NO: 65304 - protein, 9 aa, Artificial Sequence
  Description of Artificial Sequence: Synthetic peptide
  Seed: TQDWVQENY (MAGA4_HUMAN)
TADWVQENY

SEQ ID NO: 65305 - protein, 9 aa, Artificial Sequence
  Description of Artificial Sequence: Synthetic peptide
  Seed: SSPLVPGTL (MAGA4_HUMAN)
SWPLVPGTM

SEQ ID NO: 65306 - protein, 10 aa, Artificial Sequence
  Description of Artificial Sequence: Synthetic peptide
  Seed: KEVDPASNTY (MAGA4_HUMAN)
KQVDPASNTV

SEQ ID NO: 65307 - protein, 9 aa, Artificial Sequence
  Description of Artificial Sequence: Synthetic peptide
  Seed: EHVVRVNAR (MAGA4_HUMAN)
EYVVRVNAR

SEQ ID NO: 65308 - protein, 10 aa, Artificial Sequence
  Description of Artificial Sequence: Synthetic peptide
  Seed: NKVDELAHFL (MAGA4_HUMAN)
NMVDELAHFV

SEQ ID NO: 65309 - protein, 9 aa, Artificial Sequence
  Description of Artificial Sequence: Synthetic peptide
  Seed: YPSLREAAL (MAGA4_HUMAN)
YGSLREAAY

SEQ ID NO: 65310 - protein, 10 aa, Artificial Sequence
  Description of Artificial Sequence: Synthetic peptide
  Seed: RVRIAYPSLR (MAGA4_HUMAN)
RKRIAYPSLV

SEQ ID NO: 65311 - protein, 8 aa, Artificial Sequence
  Description of Artificial Sequence: Synthetic peptide
  Seed: RVRIAYPS (MAGA4_HUMAN)
RMRIAYPK

SEQ ID NO: 65312 - protein, 10 aa, Artificial Sequence
  Description of Artificial Sequence: Synthetic peptide
  Seed: FGKASESLKM (MAGA4_HUMAN)
FKKASESLKY

SEQ ID NO: 65313 - protein, 9 aa, Artificial Sequence
  Description of Artificial Sequence: Synthetic peptide
  Seed: VYDGREHTV (MAGA4_HUMAN)
VYDGREHTI

SEQ ID NO: 65314 - protein, 10 aa, Artificial Sequence
  Description of Artificial Sequence: Synthetic peptide
  Seed: NKVDELAHFL (MAGA4_HUMAN)
NMVDELAHFL

SEQ ID NO: 65315 - protein, 9 aa, Artificial Sequence
  Description of Artificial Sequence: Synthetic peptide
  Seed: TEEQEAAVS (MAGA4_HUMAN)
TEEQEAAVV

SEQ ID NO: 65316 - protein, 9 aa, Artificial Sequence
  Description of Artificial Sequence: Synthetic peptide
  Seed: VYDGREHTV (MAGA4_HUMAN)
VIDGREHTL

SEQ ID NO: 65317 - protein, 11 aa, Artificial Sequence
  Description of Artificial Sequence: Synthetic peptide
  Seed: RQVPGSNPARY (MAGA4_HUMAN)
REVPGSNPARF

SEQ ID NO: 65318 - protein, 10 aa, Artificial Sequence
  Description of Artificial Sequence: Synthetic peptide
  Seed: RVNARVRIAY (MAGA4_HUMAN)
RTNARVRIAM

SEQ ID NO: 65319 - protein, 9 aa, Artificial Sequence
  Description of Artificial Sequence: Synthetic peptide
  Seed: SALPTTISF (MAGA4_HUMAN)
SVLPTTISI

SEQ ID NO: 65320 - protein, 9 aa, Artificial Sequence
  Description of Artificial Sequence: Synthetic peptide
  Seed: SEEEIWEEL (MAGA4_HUMAN)
SFEEIWEEL

SEQ ID NO: 65321 - protein, 10 aa, Artificial Sequence
  Description of Artificial Sequence: Synthetic peptide
  Seed: KVLEHVVRVN (MAGA4_HUMAN)
KILEHVVRVI

SEQ ID NO: 65322 - protein, 9 aa, Artificial Sequence
  Description of Artificial Sequence: Synthetic peptide
  Seed: NPARYEFLW (MAGA4_HUMAN)
NTARYEFLW

SEQ ID NO: 65323 - protein, 9 aa, Artificial Sequence
  Description of Artificial Sequence: Synthetic peptide
  Seed: KEVDPASNT (MAGA4_HUMAN)
KEVDPASNF

SEQ ID NO: 65324 - protein, 10 aa, Artificial Sequence
  Description of Artificial Sequence: Synthetic peptide
  Seed: VYDGREHTVY (MAGA4_HUMAN)
VADGREHTVY

SEQ ID NO: 65325 - protein, 9 aa, Artificial Sequence
  Description of Artificial Sequence: Synthetic peptide
  Seed: GTLEEVPAA (MAGA4_HUMAN)
GVLEEVPAI

SEQ ID NO: 65326 - protein, 9 aa, Artificial Sequence
  Description of Artificial Sequence: Synthetic peptide
  Seed: LPTTISFTC (MAGA4_HUMAN)
LMTTISFTY

SEQ ID NO: 65327 - protein, 9 aa, Artificial Sequence
  Description of Artificial Sequence: Synthetic peptide
  Seed: IFPKTGLLI (MAGA4_HUMAN)
IYPKTGLLW

SEQ ID NO: 65328 - protein, 10 aa, Artificial Sequence
  Description of Artificial Sequence: Synthetic peptide
  Seed: EAQEEALGLV (MAGA4_HUMAN)
ETQEEALGLV

SEQ ID NO: 65329 - protein, 9 aa, Artificial Sequence
  Description of Artificial Sequence: Synthetic peptide
  Seed: GKASESLKM (MAGA4_HUMAN)
GQASESLKF

SEQ ID NO: 65330 - protein, 9 aa, Artificial Sequence
  Description of Artificial Sequence: Synthetic peptide
  Seed: RAKELVTKA (MAGA4_HUMAN)
RLKELVTKF

SEQ ID NO: 65331 - protein, 9 aa, Artificial Sequence
  Description of Artificial Sequence: Synthetic peptide
  Seed: WVQENYLEY (MAGA4_HUMAN)
WRQENYLEY

SEQ ID NO: 65332 - protein, 10 aa, Artificial Sequence
  Description of Artificial Sequence: Synthetic peptide
  Seed: FGKASESLKM (MAGA4_HUMAN)
FAKASESLKF

SEQ ID NO: 65333 - protein, 9 aa, Artificial Sequence
  Description of Artificial Sequence: Synthetic peptide
  Seed: KNYKRCFPV (MAGA4_HUMAN)
KFYKRCFPK

SEQ ID NO: 65334 - protein, 10 aa, Artificial Sequence
  Description of Artificial Sequence: Synthetic peptide
  Seed: VKVLEHVVRV (MAGA4_HUMAN)
VMVLEHVVRI

SEQ ID NO: 65335 - protein, 9 aa, Artificial Sequence
  Description of Artificial Sequence: Synthetic peptide
  Seed: TSPDAESLF (MAGA4_HUMAN)
TIPDAESLL

SEQ ID NO: 65336 - protein, 10 aa, Artificial Sequence
  Description of Artificial Sequence: Synthetic peptide
  Seed: NQIFPKTGLL (MAGA4_HUMAN)
NHIFPKTGLL

SEQ ID NO: 65337 - protein, 9 aa, Artificial Sequence
  Description of Artificial Sequence: Synthetic peptide
  Seed: RVNARVRIA (MAGA4_HUMAN)
RTNARVRIL

SEQ ID NO: 65338 - protein, 9 aa, Artificial Sequence
  Description of Artificial Sequence: Synthetic peptide
  Seed: WVQENYLEY (MAGA4_HUMAN)
WIQENYLEM

SEQ ID NO: 65339 - protein, 9 aa, Artificial Sequence
  Description of Artificial Sequence: Synthetic peptide
  Seed: EVDPASNTY (MAGA4_HUMAN)
EQDPASNTY

SEQ ID NO: 65340 - protein, 9 aa, Artificial Sequence
  Description of Artificial Sequence: Synthetic peptide
  Seed: TTISFTCWR (MAGA4_HUMAN)
TAISFTCWK

SEQ ID NO: 65341 - protein, 10 aa, Artificial Sequence
  Description of Artificial Sequence: Synthetic peptide
  Seed: YRQVPGSNPA (MAGA4_HUMAN)
YEQVPGSNPF

SEQ ID NO: 65342 - protein, 11 aa, Artificial Sequence
  Description of Artificial Sequence: Synthetic peptide
  Seed: ELGVMGVYDGR (MAGA4_HUMAN)
EWGVMGVYDGR

SEQ ID NO: 65343 - protein, 10 aa, Artificial Sequence
  Description of Artificial Sequence: Synthetic peptide
  Seed: TEEQEAAVSS (MAGA4_HUMAN)
TEEQEAAVSI

SEQ ID NO: 65344 - protein, 10 aa, Artificial Sequence
  Description of Artificial Sequence: Synthetic peptide
  Seed: KYRAKELVTK (MAGA4_HUMAN)
KWRAKELVTR

SEQ ID NO: 65345 - protein, 9 aa, Artificial Sequence
  Description of Artificial Sequence: Synthetic peptide
  Seed: KVLEHVVRV (MAGA4_HUMAN)
KQLEHVVRF

SEQ ID NO: 65346 - protein, 10 aa, Artificial Sequence
  Description of Artificial Sequence: Synthetic peptide
  Seed: HTVYGEPRKL (MAGA4_HUMAN)
HTVYGEPRKW

SEQ ID NO: 65347 - protein, 10 aa, Artificial Sequence
  Description of Artificial Sequence: Synthetic peptide
  Seed: AYPSLREAAL (MAGA4_HUMAN)
APPSLREAAM

SEQ ID NO: 65348 - protein, 9 aa, Artificial Sequence
  Description of Artificial Sequence: Synthetic peptide
  Seed: RVRIAYPSL (MAGA4_HUMAN)
RARIAYPSF

SEQ ID NO: 65349 - protein, 10 aa, Artificial Sequence
  Description of Artificial Sequence: Synthetic peptide
  Seed: TSYVKVLEHV (MAGA4_HUMAN)
TCYVKVLEHL

SEQ ID NO: 65350 - protein, 10 aa, Artificial Sequence
  Description of Artificial Sequence: Synthetic peptide
  Seed: KASESLKMIF (MAGA4_HUMAN)
KISESLKMIW

SEQ ID NO: 65351 - protein, 9 aa, Artificial Sequence
  Description of Artificial Sequence: Synthetic peptide
  Seed: ELAHFLLRK (MAGA4_HUMAN)
EIAHFLLRK

SEQ ID NO: 65352 - protein, 9 aa, Artificial Sequence
  Description of Artificial Sequence: Synthetic peptide
  Seed: SALPTTISF (MAGA4_HUMAN)
SPLPTTISC

SEQ ID NO: 65353 - protein, 10 aa, Artificial Sequence
  Description of Artificial Sequence: Synthetic peptide
  Seed: ASALPTTISF (MAGA4_HUMAN)
ATALPTTISF

SEQ ID NO: 65354 - protein, 10 aa, Artificial Sequence
  Description of Artificial Sequence: Synthetic peptide
  Seed: YRQVPGSNPA (MAGA4_HUMAN)
YVQVPGSNPI

SEQ ID NO: 65355 - protein, 10 aa, Artificial Sequence
  Description of Artificial Sequence: Synthetic peptide
  Seed: GVYDGREHTV (MAGA4_HUMAN)
GNYDGREHTY

SEQ ID NO: 65356 - protein, 9 aa, Artificial Sequence
  Description of Artificial Sequence: Synthetic peptide
  Seed: RCFPVIFGK (MAGA4_HUMAN)
RVFPVIFGR

SEQ ID NO: 65357 - protein, 9 aa, Artificial Sequence
  Description of Artificial Sequence: Synthetic peptide
  Seed: HTVYGEPRK (MAGA4_HUMAN)
HVVYGEPRR

SEQ ID NO: 65358 - protein, 11 aa, Artificial Sequence
  Description of Artificial Sequence: Synthetic peptide
  Seed: ELVTKAEMLER (MAGA4_HUMAN)
EAVTKAEMLER

SEQ ID NO: 65359 - protein, 9 aa, Artificial Sequence
  Description of Artificial Sequence: Synthetic peptide
  Seed: VYDGREHTV (MAGA4_HUMAN)
VADGREHTI

SEQ ID NO: 65360 - protein, 11 aa, Artificial Sequence
  Description of Artificial Sequence: Synthetic peptide
  Seed: RVRIAYPSLRE (MAGA4_HUMAN)
RIRIAYPSLRA

SEQ ID NO: 65361 - protein, 10 aa, Artificial Sequence
  Description of Artificial Sequence: Synthetic peptide
  Seed: AESAGPPQSP (MAGA4_HUMAN)
AESAGPPQSA

SEQ ID NO: 65362 - protein, 10 aa, Artificial Sequence
  Description of Artificial Sequence: Synthetic peptide
  Seed: TTISFTCWRQ (MAGA4_HUMAN)
TPISFTCWRR

SEQ ID NO: 65363 - protein, 10 aa, Artificial Sequence
  Description of Artificial Sequence: Synthetic peptide
  Seed: EHVVRVNARV (MAGA4_HUMAN)
ELVVRVNARV

SEQ ID NO: 65364 - protein, 10 aa, Artificial Sequence
  Description of Artificial Sequence: Synthetic peptide
  Seed: VIFGKASESL (MAGA4_HUMAN)
VAFGKASESL

SEQ ID NO: 65365 - protein, 10 aa, Artificial Sequence
  Description of Artificial Sequence: Synthetic peptide
  Seed: VIFGKASESL (MAGA4_HUMAN)
VVFGKASESV

SEQ ID NO: 65366 - protein, 9 aa, Artificial Sequence
  Description of Artificial Sequence: Synthetic peptide
  Seed: ESLKMIFGI (MAGA4_HUMAN)
EVLKMIFGA

SEQ ID NO: 65367 - protein, 9 aa, Artificial Sequence
  Description of Artificial Sequence: Synthetic peptide
  Seed: KVLEHVVRV (MAGA4_HUMAN)
KALEHVVRI

SEQ ID NO: 65368 - protein, 10 aa, Artificial Sequence
  Description of Artificial Sequence: Synthetic peptide
  Seed: TLVTCLGLSY (MAGA4_HUMAN)
TYVTCLGLSY

SEQ ID NO: 65369 - protein, 9 aa, Artificial Sequence
  Description of Artificial Sequence: Synthetic peptide
  Seed: LGNNQIFPK (MAGA4_HUMAN)
LINNQIFPK

SEQ ID NO: 65370 - protein, 9 aa, Artificial Sequence
  Description of Artificial Sequence: Synthetic peptide
  Seed: RAKELVTKA (MAGA4_HUMAN)
RAKELVTKM

SEQ ID NO: 65371 - protein, 9 aa, Artificial Sequence
  Description of Artificial Sequence: Synthetic peptide
  Seed: IIVLGTIAM (MAGA4_HUMAN)
IYVLGTIAV

SEQ ID NO: 65372 - protein, 10 aa, Artificial Sequence
  Description of Artificial Sequence: Synthetic peptide
  Seed: QIFPKTGLLI (MAGA4_HUMAN)
QFFPKTGLLF

SEQ ID NO: 65373 - protein, 10 aa, Artificial Sequence
  Description of Artificial Sequence: Synthetic peptide
  Seed: ARVRIAYPSL (MAGA4_HUMAN)
AAVRIAYPSK

SEQ ID NO: 65374 - protein, 9 aa, Artificial Sequence
  Description of Artificial Sequence: Synthetic peptide
  Seed: AAVSSSSPL (MAGA4_HUMAN)
ATVSSSSPW

SEQ ID NO: 65375 - protein, 9 aa, Artificial Sequence
  Description of Artificial Sequence: Synthetic peptide
  Seed: LFREALSNK (MAGA4_HUMAN)
LTREALSNI

SEQ ID NO: 65376 - protein, 9 aa, Artificial Sequence
  Description of Artificial Sequence: Synthetic peptide
  Seed: GSNPARYEF (MAGA4_HUMAN)
GANPARYEY

SEQ ID NO: 65377 - protein, 9 aa, Artificial Sequence
  Description of Artificial Sequence: Synthetic peptide
  Seed: AAVSSSSPL (MAGA4_HUMAN)
AHVSSSSPL

SEQ ID NO: 65378 - protein, 9 aa, Artificial Sequence
  Description of Artificial Sequence: Synthetic peptide
  Seed: TEEQEAAVS (MAGA4_HUMAN)
TEEQEAAVM

SEQ ID NO: 65379 - protein, 8 aa, Artificial Sequence
  Description of Artificial Sequence: Synthetic peptide
  Seed: VYGEPRKL (MAGA4_HUMAN)
VFGEPRKL

SEQ ID NO: 65380 - protein, 9 aa, Artificial Sequence
  Description of Artificial Sequence: Synthetic peptide
  Seed: RVRIAYPSL (MAGA4_HUMAN)
RQRIAYPSV

SEQ ID NO: 65381 - protein, 9 aa, Artificial Sequence
  Description of Artificial Sequence: Synthetic peptide
  Seed: SALPTTISF (MAGA4_HUMAN)
SHLPTTISY

SEQ ID NO: 65382 - protein, 10 aa, Artificial Sequence
  Description of Artificial Sequence: Synthetic peptide
  Seed: AYPSLREAAL (MAGA4_HUMAN)
ALPSLREAAM

SEQ ID NO: 65383 - protein, 9 aa, Artificial Sequence
  Description of Artificial Sequence: Synthetic peptide
  Seed: RAKELVTKA (MAGA4_HUMAN)
RSKELVTKY

SEQ ID NO: 65384 - protein, 9 aa, Artificial Sequence
  Description of Artificial Sequence: Synthetic peptide
  Seed: LVPGTLEEV (MAGA4_HUMAN)
LLPGTLEEI

SEQ ID NO: 65385 - protein, 9 aa, Artificial Sequence
  Description of Artificial Sequence: Synthetic peptide
  Seed: SAGPPQSPQ (MAGA4_HUMAN)
SSGPPQSPL

SEQ ID NO: 65386 - protein, 9 aa, Artificial Sequence
  Description of Artificial Sequence: Synthetic peptide
  Seed: ALLEEEEGV (MAGA4_HUMAN)
AMLEEEEGW

SEQ ID NO: 65387 - protein, 9 aa, Artificial Sequence
  Description of Artificial Sequence: Synthetic peptide
  Seed: LPTTISFTC (MAGA4_HUMAN)
LGTTISFTY

SEQ ID NO: 65388 - protein, 9 aa, Artificial Sequence
  Description of Artificial Sequence: Synthetic peptide
  Seed: RAKELVTKA (MAGA4_HUMAN)
RPKELVTKV

SEQ ID NO: 65389 - protein, 9 aa, Artificial Sequence
  Description of Artificial Sequence: Synthetic peptide
  Seed: RVRIAYPSL (MAGA4_HUMAN)
RWRIAYPSY

SEQ ID NO: 65390 - protein, 8 aa, Artificial Sequence
  Description of Artificial Sequence: Synthetic peptide
  Seed: RVRIAYPS (MAGA4_HUMAN)
RTRIAYPP

SEQ ID NO: 65391 - protein, 11 aa, Artificial Sequence
  Description of Artificial Sequence: Synthetic peptide
  Seed: KEVDPASNTYT (MAGA4_HUMAN)
KEVDPASNTYY

SEQ ID NO: 65392 - protein, 9 aa, Artificial Sequence
  Description of Artificial Sequence: Synthetic peptide
  Seed: VTKAEMLER (MAGA4_HUMAN)
VSKAEMLEK

SEQ ID NO: 65393 - protein, 10 aa, Artificial Sequence
  Description of Artificial Sequence: Synthetic peptide
  Seed: YPSLREAALL (MAGA4_HUMAN)
YQSLREAALF

SEQ ID NO: 65394 - protein, 10 aa, Artificial Sequence
  Description of Artificial Sequence: Synthetic peptide
  Seed: TQDWVQENYL (MAGA4_HUMAN)
THDWVQENYF

SEQ ID NO: 65395 - protein, 9 aa, Artificial Sequence
  Description of Artificial Sequence: Synthetic peptide
  Seed: TVYGEPRKL (MAGA4_HUMAN)
TLYGEPRKV

SEQ ID NO: 65396 - protein, 9 aa, Artificial Sequence
  Description of Artificial Sequence: Synthetic peptide
  Seed: RVRIAYPSL (MAGA4_HUMAN)
RQRIAYPSF

SEQ ID NO: 65397 - protein, 9 aa, Artificial Sequence
  Description of Artificial Sequence: Synthetic peptide
  Seed: TVYGEPRKL (MAGA4_HUMAN)
TVYGEPRKV

SEQ ID NO: 65398 - protein, 10 aa, Artificial Sequence
  Description of Artificial Sequence: Synthetic peptide
  Seed: RVRIAYPSLR (MAGA4_HUMAN)
RDRIAYPSLL

SEQ ID NO: 65399 - protein, 10 aa, Artificial Sequence
  Description of Artificial Sequence: Synthetic peptide
  Seed: KVDELAHFLL (MAGA4_HUMAN)
KMDELAHFLC

SEQ ID NO: 65400 - protein, 9 aa, Artificial Sequence
  Description of Artificial Sequence: Synthetic peptide
  Seed: TQDWVQENY (MAGA4_HUMAN)
TTDWVQENV

SEQ ID NO: 65401 - protein, 9 aa, Artificial Sequence
  Description of Artificial Sequence: Synthetic peptide
  Seed: AAVSSSSPL (MAGA4_HUMAN)
ASVSSSSPW

SEQ ID NO: 65402 - protein, 10 aa, Artificial Sequence
  Description of Artificial Sequence: Synthetic peptide
  Seed: RVRIAYPSLR (MAGA4_HUMAN)
RFRIAYPSLL

SEQ ID NO: 65403 - protein, 10 aa, Artificial Sequence
  Description of Artificial Sequence: Synthetic peptide
  Seed: WVQENYLEYR (MAGA4_HUMAN)
WLQENYLEYR

SEQ ID NO: 65404 - protein, 9 aa, Artificial Sequence
  Description of Artificial Sequence: Synthetic peptide
  Seed: TQDWVQENY (MAGA4_HUMAN)
TFDWVQENL

SEQ ID NO: 65405 - protein, 10 aa, Artificial Sequence
  Description of Artificial Sequence: Synthetic peptide
  Seed: TSYVKVLEHV (MAGA4_HUMAN)
TQYVKVLEHF

SEQ ID NO: 65406 - protein, 9 aa, Artificial Sequence
  Description of Artificial Sequence: Synthetic peptide
  Seed: TSPDAESLF (MAGA4_HUMAN)
TFPDAESLM

SEQ ID NO: 65407 - protein, 9 aa, Artificial Sequence
  Description of Artificial Sequence: Synthetic peptide
  Seed: VRIAYPSLR (MAGA4_HUMAN)
VIIAYPSLR

SEQ ID NO: 65408 - protein, 10 aa, Artificial Sequence
  Description of Artificial Sequence: Synthetic peptide
  Seed: YPSLREAALL (MAGA4_HUMAN)
YPSLREAALM

SEQ ID NO: 65409 - protein, 9 aa, Artificial Sequence
  Description of Artificial Sequence: Synthetic peptide
  Seed: KNYKRCFPV (MAGA4_HUMAN)
KTYKRCFPM

SEQ ID NO: 65410 - protein, 10 aa, Artificial Sequence
  Description of Artificial Sequence: Synthetic peptide
  Seed: RVRIAYPSLR (MAGA4_HUMAN)
RIRIAYPSLA

SEQ ID NO: 65411 - protein, 10 aa, Artificial Sequence
  Description of Artificial Sequence: Synthetic peptide
  Seed: RVRIAYPSLR (MAGA4_HUMAN)
RVRIAYPSLE

SEQ ID NO: 65412 - protein, 10 aa, Artificial Sequence
  Description of Artificial Sequence: Synthetic peptide
  Seed: MLERVIKNYK (MAGA4_HUMAN)
MFERVIKNYK

SEQ ID NO: 65413 - protein, 9 aa, Artificial Sequence
  Description of Artificial Sequence: Synthetic peptide
  Seed: KEVDPASNT (MAGA4_HUMAN)
KEVDPASNI

SEQ ID NO: 65414 - protein, 9 aa, Artificial Sequence
  Description of Artificial Sequence: Synthetic peptide
  Seed: LEHVVRVNA (MAGA4_HUMAN)
LEHVVRVNV

SEQ ID NO: 65415 - protein, 11 aa, Artificial Sequence
  Description of Artificial Sequence: Synthetic peptide
  Seed: RVRIAYPSLRE (MAGA4_HUMAN)
RMRIAYPSLRR

SEQ ID NO: 65416 - protein, 9 aa, Artificial Sequence
  Description of Artificial Sequence: Synthetic peptide
  Seed: TTISFTCWR (MAGA4_HUMAN)
TNISFTCWR

SEQ ID NO: 65417 - protein, 9 aa, Artificial Sequence
  Description of Artificial Sequence: Synthetic peptide
  Seed: VYDGREHTV (MAGA4_HUMAN)
VYDGREHTW

SEQ ID NO: 65418 - protein, 9 aa, Artificial Sequence
  Description of Artificial Sequence: Synthetic peptide
  Seed: TSPDAESLF (MAGA4_HUMAN)
TIPDAESLI

SEQ ID NO: 65419 - protein, 10 aa, Artificial Sequence
  Description of Artificial Sequence: Synthetic peptide
  Seed: RVRIAYPSLR (MAGA4_HUMAN)
RMRIAYPSLV

SEQ ID NO: 65420 - protein, 9 aa, Artificial Sequence
  Description of Artificial Sequence: Synthetic peptide
  Seed: QIFPKTGLL (MAGA4_HUMAN)
QRFPKTGLF

SEQ ID NO: 65421 - protein, 9 aa, Artificial Sequence
  Description of Artificial Sequence: Synthetic peptide
  Seed: RQVPGSNPA (MAGA4_HUMAN)
REVPGSNPT

SEQ ID NO: 65422 - protein, 10 aa, Artificial Sequence
  Description of Artificial Sequence: Synthetic peptide
  Seed: SSSPLVPGTL (MAGA4_HUMAN)
SASPLVPGTM

SEQ ID NO: 65423 - protein, 9 aa, Artificial Sequence
  Description of Artificial Sequence: Synthetic peptide
  Seed: EEVPAAESA (MAGA4_HUMAN)
EEVPAAESV

SEQ ID NO: 65424 - protein, 9 aa, Artificial Sequence
  Description of Artificial Sequence: Synthetic peptide
  Seed: ALSNKVDEL (MAGA4_HUMAN)
AFSNKVDEF

SEQ ID NO: 65425 - protein, 9 aa, Artificial Sequence
  Description of Artificial Sequence: Synthetic peptide
  Seed: EEALGLVGA (MAGA4_HUMAN)
EEALGLVGF

SEQ ID NO: 65426 - protein, 9 aa, Artificial Sequence
  Description of Artificial Sequence: Synthetic peptide
  Seed: GVYDGREHT (MAGA4_HUMAN)
GQYDGREHI

SEQ ID NO: 65427 - protein, 10 aa, Artificial Sequence
  Description of Artificial Sequence: Synthetic peptide
  Seed: KASESLKMIF (MAGA4_HUMAN)
KQSESLKMIY

SEQ ID NO: 65428 - protein, 9 aa, Artificial Sequence
  Description of Artificial Sequence: Synthetic peptide
  Seed: QIFPKTGLL (MAGA4_HUMAN)
QMFPKTGLW

SEQ ID NO: 65429 - protein, 9 aa, Artificial Sequence
  Description of Artificial Sequence: Synthetic peptide
  Seed: SYVKVLEHV (MAGA4_HUMAN)
SIVKVLEHI

SEQ ID NO: 65430 - protein, 9 aa, Artificial Sequence
  Description of Artificial Sequence: Synthetic peptide
  Seed: NTYTLVTCL (MAGA4_HUMAN)
NTYTLVTCW

SEQ ID NO: 65431 - protein, 9 aa, Artificial Sequence
  Description of Artificial Sequence: Synthetic peptide
  Seed: EIWEELGVM (MAGA4_HUMAN)
EVWEELGVW

SEQ ID NO: 65432 - protein, 9 aa, Artificial Sequence
  Description of Artificial Sequence: Synthetic peptide
  Seed: KVLEHVVRV (MAGA4_HUMAN)
KGLEHVVRF

SEQ ID NO: 65433 - protein, 10 aa, Artificial Sequence
  Description of Artificial Sequence: Synthetic peptide
  Seed: KVDELAHFLL (MAGA4_HUMAN)
KLDELAHFLL

SEQ ID NO: 65434 - protein, 9 aa, Artificial Sequence
  Description of Artificial Sequence: Synthetic peptide
  Seed: KVDELAHFL (MAGA4_HUMAN)
KFDELAHFV

SEQ ID NO: 65435 - protein, 9 aa, Artificial Sequence
  Description of Artificial Sequence: Synthetic peptide
  Seed: GTLEEVPAA (MAGA4_HUMAN)
GMLEEVPAT

SEQ ID NO: 65436 - protein, 9 aa, Artificial Sequence
  Description of Artificial Sequence: Synthetic peptide
  Seed: TVYGEPRKL (MAGA4_HUMAN)
TLYGEPRKF

SEQ ID NO: 65437 - protein, 10 aa, Artificial Sequence
  Description of Artificial Sequence: Synthetic peptide
  Seed: YRQVPGSNPA (MAGA4_HUMAN)
YNQVPGSNPF

SEQ ID NO: 65438 - protein, 10 aa, Artificial Sequence
  Description of Artificial Sequence: Synthetic peptide
  Seed: NKVDELAHFL (MAGA4_HUMAN)
NFVDELAHFV

SEQ ID NO: 65439 - protein, 9 aa, Artificial Sequence
  Description of Artificial Sequence: Synthetic peptide
  Seed: TSPDAESLF (MAGA4_HUMAN)
TMPDAESLY

SEQ ID NO: 65440 - protein, 10 aa, Artificial Sequence
  Description of Artificial Sequence: Synthetic peptide
  Seed: ASALPTTISF (MAGA4_HUMAN)
ANALPTTISW

SEQ ID NO: 65441 - protein, 9 aa, Artificial Sequence
  Description of Artificial Sequence: Synthetic peptide
  Seed: YRAKELVTK (MAGA4_HUMAN)
YRAKELVTM

SEQ ID NO: 65442 - protein, 9 aa, Artificial Sequence
  Description of Artificial Sequence: Synthetic peptide
  Seed: ELAHFLLRK (MAGA4_HUMAN)
EYAHFLLRR

SEQ ID NO: 65443 - protein, 11 aa, Artificial Sequence
  Description of Artificial Sequence: Synthetic peptide
  Seed: KVDELAHFLLR (MAGA4_HUMAN)
KYDELAHFLLR

SEQ ID NO: 65444 - protein, 10 aa, Artificial Sequence
  Description of Artificial Sequence: Synthetic peptide
  Seed: QIFPKTGLLI (MAGA4_HUMAN)
QHFPKTGLLF

SEQ ID NO: 65445 - protein, 8 aa, Artificial Sequence
  Description of Artificial Sequence: Synthetic peptide
  Seed: KVDELAHF (MAGA4_HUMAN)
KFDELAHF

SEQ ID NO: 65446 - protein, 10 aa, Artificial Sequence
  Description of Artificial Sequence: Synthetic peptide
  Seed: AYPSLREAAL (MAGA4_HUMAN)
ANPSLREAAL

SEQ ID NO: 65447 - protein, 10 aa, Artificial Sequence
  Description of Artificial Sequence: Synthetic peptide
  Seed: KEVDPASNTY (MAGA4_HUMAN)
KAVDPASNTM

SEQ ID NO: 65448 - protein, 9 aa, Artificial Sequence
  Description of Artificial Sequence: Synthetic peptide
  Seed: IFPKTGLLI (MAGA4_HUMAN)
IRPKTGLLM

SEQ ID NO: 65449 - protein, 9 aa, Artificial Sequence
  Description of Artificial Sequence: Synthetic peptide
  Seed: STSPDAESL (MAGA4_HUMAN)
STSPDAESV

SEQ ID NO: 65450 - protein, 10 aa, Artificial Sequence
  Description of Artificial Sequence: Synthetic peptide
  Seed: DPASNTYTLV (MAGA4_HUMAN)
DAASNTYTLV

SEQ ID NO: 65451 - protein, 10 aa, Artificial Sequence
  Description of Artificial Sequence: Synthetic peptide
  Seed: KEVDPASNTY (MAGA4_HUMAN)
KYVDPASNTL

SEQ ID NO: 65452 - protein, 10 aa, Artificial Sequence
  Description of Artificial Sequence: Synthetic peptide
  Seed: AQEEALGLVG (MAGA4_HUMAN)
AEEEALGLVI

SEQ ID NO: 65453 - protein, 9 aa, Artificial Sequence
  Description of Artificial Sequence: Synthetic peptide
  Seed: VYDGREHTV (MAGA4_HUMAN)
VTDGREHTM

SEQ ID NO: 65454 - protein, 10 aa, Artificial Sequence
  Description of Artificial Sequence: Synthetic peptide
  Seed: LLGNNQIFPK (MAGA4_HUMAN)
LWGNNQIFPR

SEQ ID NO: 65455 - protein, 10 aa, Artificial Sequence
  Description of Artificial Sequence: Synthetic peptide
  Seed: AYPSLREAAL (MAGA4_HUMAN)
AEPSLREAAM

SEQ ID NO: 65456 - protein, 10 aa, Artificial Sequence
  Description of Artificial Sequence: Synthetic peptide
  Seed: QIFPKTGLLI (MAGA4_HUMAN)
QYFPKTGLLW

SEQ ID NO: 65457 - protein, 11 aa, Artificial Sequence
  Description of Artificial Sequence: Synthetic peptide
  Seed: RVNARVRIAYP (MAGA4_HUMAN)
RTNARVRIAYK

SEQ ID NO: 65458 - protein, 11 aa, Artificial Sequence
  Description of Artificial Sequence: Synthetic peptide
  Seed: STSPDAESLFR (MAGA4_HUMAN)
SASPDAESLFR

SEQ ID NO: 65459 - protein, 9 aa, Artificial Sequence
  Description of Artificial Sequence: Synthetic peptide
  Seed: IIVLGTIAM (MAGA4_HUMAN)
IAVLGTIAF

SEQ ID NO: 65460 - protein, 9 aa, Artificial Sequence
  Description of Artificial Sequence: Synthetic peptide
  Seed: AAVSSSSPL (MAGA4_HUMAN)
AIVSSSSPF

SEQ ID NO: 65461 - protein, 9 aa, Artificial Sequence
  Description of Artificial Sequence: Synthetic peptide
  Seed: RVRIAYPSL (MAGA4_HUMAN)
RFRIAYPSR

SEQ ID NO: 65462 - protein, 11 aa, Artificial Sequence
  Description of Artificial Sequence: Synthetic peptide
  Seed: TEEQEAAVSSS (MAGA4_HUMAN)
TEEQEAAVSSL

SEQ ID NO: 65463 - protein, 10 aa, Artificial Sequence
  Description of Artificial Sequence: Synthetic peptide
  Seed: AYPSLREAAL (MAGA4_HUMAN)
ACPSLREAAM

SEQ ID NO: 65464 - protein, 10 aa, Artificial Sequence
  Description of Artificial Sequence: Synthetic peptide
  Seed: RVIKNYKRCF (MAGA4_HUMAN)
RTIKNYKRCW

SEQ ID NO: 65465 - protein, 9 aa, Artificial Sequence
  Description of Artificial Sequence: Synthetic peptide
  Seed: RAKELVTKA (MAGA4_HUMAN)
RPKELVTKM

SEQ ID NO: 65466 - protein, 10 aa, Artificial Sequence
  Description of Artificial Sequence: Synthetic peptide
  Seed: RVRIAYPSLR (MAGA4_HUMAN)
RYRIAYPSLL

SEQ ID NO: 65467 - protein, 9 aa, Artificial Sequence
  Description of Artificial Sequence: Synthetic peptide
  Seed: LGNNQIFPK (MAGA4_HUMAN)
LFNNQIFPR

SEQ ID NO: 65468 - protein, 9 aa, Artificial Sequence
  Description of Artificial Sequence: Synthetic peptide
  Seed: IIVLGTIAM (MAGA4_HUMAN)
IIVLGTIAL

SEQ ID NO: 65469 - protein, 9 aa, Artificial Sequence
  Description of Artificial Sequence: Synthetic peptide
  Seed: STSPDAESL (MAGA4_HUMAN)
SESPDAESL

SEQ ID NO: 65470 - protein, 9 aa, Artificial Sequence
  Description of Artificial Sequence: Synthetic peptide
  Seed: EHTVYGEPR (MAGA4_HUMAN)
ETTVYGEPR

SEQ ID NO: 65471 - protein, 9 aa, Artificial Sequence
  Description of Artificial Sequence: Synthetic peptide
  Seed: RAKELVTKA (MAGA4_HUMAN)
RTKELVTKK

SEQ ID NO: 65472 - protein, 8 aa, Artificial Sequence
  Description of Artificial Sequence: Synthetic peptide
  Seed: RVRIAYPS (MAGA4_HUMAN)
RTRIAYPA

SEQ ID NO: 65473 - protein, 8 aa, Artificial Sequence
  Description of Artificial Sequence: Synthetic peptide
  Seed: FLLRKYRA (MAGA4_HUMAN)
FLLRKYRM

SEQ ID NO: 65474 - protein, 11 aa, Artificial Sequence
  Description of Artificial Sequence: Synthetic peptide
  Seed: MEGDSASEEEI (MAGA4_HUMAN)
MMGDSASEEEF

SEQ ID NO: 65475 - protein, 9 aa, Artificial Sequence
  Description of Artificial Sequence: Synthetic peptide
  Seed: WVQENYLEY (MAGA4_HUMAN)
WQQENYLEM

SEQ ID NO: 65476 - protein, 9 aa, Artificial Sequence
  Description of Artificial Sequence: Synthetic peptide
  Seed: VTKAEMLER (MAGA4_HUMAN)
VVKAEMLER

SEQ ID NO: 65477 - protein, 10 aa, Artificial Sequence
  Description of Artificial Sequence: Synthetic peptide
  Seed: RVRIAYPSLR (MAGA4_HUMAN)
RSRIAYPSLY

SEQ ID NO: 65478 - protein, 10 aa, Artificial Sequence
  Description of Artificial Sequence: Synthetic peptide
  Seed: VDPASNTYTL (MAGA4_HUMAN)
VIPASNTYTM

SEQ ID NO: 65479 - protein, 9 aa, Artificial Sequence
  Description of Artificial Sequence: Synthetic peptide
  Seed: RVRIAYPSL (MAGA4_HUMAN)
RNRIAYPSR

SEQ ID NO: 65480 - protein, 9 aa, Artificial Sequence
  Description of Artificial Sequence: Synthetic peptide
  Seed: AAVSSSSPL (MAGA4_HUMAN)
AIVSSSSPY

SEQ ID NO: 65481 - protein, 9 aa, Artificial Sequence
  Description of Artificial Sequence: Synthetic peptide
  Seed: SALPTTISF (MAGA4_HUMAN)
SILPTTISM

SEQ ID NO: 65482 - protein, 10 aa, Artificial Sequence
  Description of Artificial Sequence: Synthetic peptide
  Seed: KVDELAHFLL (MAGA4_HUMAN)
KMDELAHFLV

SEQ ID NO: 65483 - protein, 11 aa, Artificial Sequence
  Description of Artificial Sequence: Synthetic peptide
  Seed: ALPTTISFTCW (MAGA4_HUMAN)
ASPTTISFTCW

SEQ ID NO: 65484 - protein, 9 aa, Artificial Sequence
  Description of Artificial Sequence: Synthetic peptide
  Seed: RVRIAYPSL (MAGA4_HUMAN)
RFRIAYPSN

SEQ ID NO: 65485 - protein, 9 aa, Artificial Sequence
  Description of Artificial Sequence: Synthetic peptide
  Seed: IFPKTGLLI (MAGA4_HUMAN)
IAPKTGLLV

SEQ ID NO: 65486 - protein, 9 aa, Artificial Sequence
  Description of Artificial Sequence: Synthetic peptide
  Seed: SSPLVPGTL (MAGA4_HUMAN)
SAPLVPGTH

SEQ ID NO: 65487 - protein, 10 aa, Artificial Sequence
  Description of Artificial Sequence: Synthetic peptide
  Seed: VDPASNTYTL (MAGA4_HUMAN)
VMPASNTYTL

SEQ ID NO: 65488 - protein, 9 aa, Artificial Sequence
  Description of Artificial Sequence: Synthetic peptide
  Seed: RVRIAYPSL (MAGA4_HUMAN)
RARIAYPSL

SEQ ID NO: 65489 - protein, 11 aa, Artificial Sequence
  Description of Artificial Sequence: Synthetic peptide
  Seed: GVYDGREHTVY (MAGA4_HUMAN)
GVYDGREHTVF

SEQ ID NO: 65490 - protein, 10 aa, Artificial Sequence
  Description of Artificial Sequence: Synthetic peptide
  Seed: AYPSLREAAL (MAGA4_HUMAN)
AHPSLREAAL

SEQ ID NO: 65491 - protein, 9 aa, Artificial Sequence
  Description of Artificial Sequence: Synthetic peptide
  Seed: GTLEEVPAA (MAGA4_HUMAN)
GMLEEVPAV

SEQ ID NO: 65492 - protein, 9 aa, Artificial Sequence
  Description of Artificial Sequence: Synthetic peptide
  Seed: SALPTTISF (MAGA4_HUMAN)
SNLPTTISW

SEQ ID NO: 65493 - protein, 10 aa, Artificial Sequence
  Description of Artificial Sequence: Synthetic peptide
  Seed: KASESLKMIF (MAGA4_HUMAN)
KRSESLKMIW

SEQ ID NO: 65494 - protein, 9 aa, Artificial Sequence
  Description of Artificial Sequence: Synthetic peptide
  Seed: DPASNTYTL (MAGA4_HUMAN)
DPASNTYTW

SEQ ID NO: 65495 - protein, 9 aa, Artificial Sequence
  Description of Artificial Sequence: Synthetic peptide
  Seed: ELAHFLLRK (MAGA4_HUMAN)
EVAHFLLRF

SEQ ID NO: 65496 - protein, 9 aa, Artificial Sequence
  Description of Artificial Sequence: Synthetic peptide
  Seed: IFPKTGLLI (MAGA4_HUMAN)
IFPKTGLLY

SEQ ID NO: 65497 - protein, 9 aa, Artificial Sequence
  Description of Artificial Sequence: Synthetic peptide
  Seed: LLIIVLGTI (MAGA4_HUMAN)
LTIIVLGTV

SEQ ID NO: 65498 - protein, 9 aa, Artificial Sequence
  Description of Artificial Sequence: Synthetic peptide
  Seed: RVRIAYPSL (MAGA4_HUMAN)
RTRIAYPSG

SEQ ID NO: 65499 - protein, 9 aa, Artificial Sequence
  Description of Artificial Sequence: Synthetic peptide
  Seed: GASALPTTI (MAGA4_HUMAN)
GISALPTTV

SEQ ID NO: 65500 - protein, 9 aa, Artificial Sequence
  Description of Artificial Sequence: Synthetic peptide
  Seed: QIFPKTGLL (MAGA4_HUMAN)
QAFPKTGLR

SEQ ID NO: 65501 - protein, 10 aa, Artificial Sequence
  Description of Artificial Sequence: Synthetic peptide
  Seed: GVYDGREHTV (MAGA4_HUMAN)
GIYDGREHTA

SEQ ID NO: 65502 - protein, 9 aa, Artificial Sequence
  Description of Artificial Sequence: Synthetic peptide
  Seed: ERVIKNYKR (MAGA4_HUMAN)
EWVIKNYKR

SEQ ID NO: 65503 - protein, 10 aa, Artificial Sequence
  Description of Artificial Sequence: Synthetic peptide
  Seed: ARVRIAYPSL (MAGA4_HUMAN)
AEVRIAYPSK

SEQ ID NO: 65504 - protein, 9 aa, Artificial Sequence
  Description of Artificial Sequence: Synthetic peptide
  Seed: GLLIIVLGT (MAGA4_HUMAN)
GLLIIVLGL

SEQ ID NO: 65505 - protein, 9 aa, Artificial Sequence
  Description of Artificial Sequence: Synthetic peptide
  Seed: EEVPAAESA (MAGA4_HUMAN)
EEVPAAESW

SEQ ID NO: 65506 - protein, 9 aa, Artificial Sequence
  Description of Artificial Sequence: Synthetic peptide
  Seed: AAVSSSSPL (MAGA4_HUMAN)
AWVSSSSPY

SEQ ID NO: 65507 - protein, 9 aa, Artificial Sequence
  Description of Artificial Sequence: Synthetic peptide
  Seed: REAALLEEE (MAGA4_HUMAN)
REAALLEET

SEQ ID NO: 65508 - protein, 9 aa, Artificial Sequence
  Description of Artificial Sequence: Synthetic peptide
  Seed: KELVTKAEM (MAGA4_HUMAN)
KELVTKAEY

SEQ ID NO: 65509 - protein, 9 aa, Artificial Sequence
  Description of Artificial Sequence: Synthetic peptide
  Seed: TVYGEPRKL (MAGA4_HUMAN)
TLYGEPRKR

SEQ ID NO: 65510 - protein, 10 aa, Artificial Sequence
  Description of Artificial Sequence: Synthetic peptide
  Seed: GVYDGREHTV (MAGA4_HUMAN)
GIYDGREHTV

SEQ ID NO: 65511 - protein, 10 aa, Artificial Sequence
  Description of Artificial Sequence: Synthetic peptide
  Seed: HTVYGEPRKL (MAGA4_HUMAN)
HSVYGEPRKW

SEQ ID NO: 65512 - protein, 10 aa, Artificial Sequence
  Description of Artificial Sequence: Synthetic peptide
  Seed: KVDELAHFLL (MAGA4_HUMAN)
KADELAHFLY

SEQ ID NO: 65513 - protein, 9 aa, Artificial Sequence
  Description of Artificial Sequence: Synthetic peptide
  Seed: RVRIAYPSL (MAGA4_HUMAN)
RRRIAYPSY

SEQ ID NO: 65514 - protein, 9 aa, Artificial Sequence
  Description of Artificial Sequence: Synthetic peptide
  Seed: STSPDAESL (MAGA4_HUMAN)
SLSPDAESF

SEQ ID NO: 65515 - protein, 9 aa, Artificial Sequence
  Description of Artificial Sequence: Synthetic peptide
  Seed: KVLEHVVRV (MAGA4_HUMAN)
KNLEHVVRL

SEQ ID NO: 65516 - protein, 9 aa, Artificial Sequence
  Description of Artificial Sequence: Synthetic peptide
  Seed: KYRAKELVT (MAGA4_HUMAN)
KTRAKELVY

SEQ ID NO: 65517 - protein, 9 aa, Artificial Sequence
  Description of Artificial Sequence: Synthetic peptide
  Seed: IFPKTGLLI (MAGA4_HUMAN)
IWPKTGLLL

SEQ ID NO: 65518 - protein, 9 aa, Artificial Sequence
  Description of Artificial Sequence: Synthetic peptide
  Seed: GVYDGREHT (MAGA4_HUMAN)
GIYDGREHI

SEQ ID NO: 65519 - protein, 9 aa, Artificial Sequence
  Description of Artificial Sequence: Synthetic peptide
  Seed: KASESLKMI (MAGA4_HUMAN)
KTSESLKMI

SEQ ID NO: 65520 - protein, 10 aa, Artificial Sequence
  Description of Artificial Sequence: Synthetic peptide
  Seed: SLFREALSNK (MAGA4_HUMAN)
SIFREALSNK

SEQ ID NO: 65521 - protein, 9 aa, Artificial Sequence
  Description of Artificial Sequence: Synthetic peptide
  Seed: ELAHFLLRK (MAGA4_HUMAN)
EVAHFLLRL

SEQ ID NO: 65522 - protein, 9 aa, Artificial Sequence
  Description of Artificial Sequence: Synthetic peptide
  Seed: KVDELAHFL (MAGA4_HUMAN)
KGDELAHFV

SEQ ID NO: 65523 - protein, 9 aa, Artificial Sequence
  Description of Artificial Sequence: Synthetic peptide
  Seed: SYVKVLEHV (MAGA4_HUMAN)
SFVKVLEHI

SEQ ID NO: 65524 - protein, 9 aa, Artificial Sequence
  Description of Artificial Sequence: Synthetic peptide
  Seed: QIFPKTGLL (MAGA4_HUMAN)
QVFPKTGLF

SEQ ID NO: 65525 - protein, 9 aa, Artificial Sequence
  Description of Artificial Sequence: Synthetic peptide
  Seed: QIFPKTGLL (MAGA4_HUMAN)
QFFPKTGLY

SEQ ID NO: 65526 - protein, 10 aa, Artificial Sequence
  Description of Artificial Sequence: Synthetic peptide
  Seed: RVRIAYPSLR (MAGA4_HUMAN)
RCRIAYPSLK

SEQ ID NO: 65527 - protein, 10 aa, Artificial Sequence
  Description of Artificial Sequence: Synthetic peptide
  Seed: RVRIAYPSLR (MAGA4_HUMAN)
RIRIAYPSLG

SEQ ID NO: 65528 - protein, 9 aa, Artificial Sequence
  Description of Artificial Sequence: Synthetic peptide
  Seed: IIVLGTIAM (MAGA4_HUMAN)
ILVLGTIAL

SEQ ID NO: 65529 - protein, 10 aa, Artificial Sequence
  Description of Artificial Sequence: Synthetic peptide
  Seed: LIIVLGTIAM (MAGA4_HUMAN)
LQIVLGTIAY

SEQ ID NO: 65530 - protein, 9 aa, Artificial Sequence
  Description of Artificial Sequence: Synthetic peptide
  Seed: REHTVYGEP (MAGA4_HUMAN)
REHTVYGEA

SEQ ID NO: 65531 - protein, 9 aa, Artificial Sequence
  Description of Artificial Sequence: Synthetic peptide
  Seed: RCFPVIFGK (MAGA4_HUMAN)
RAFPVIFGY

SEQ ID NO: 65532 - protein, 8 aa, Artificial Sequence
  Description of Artificial Sequence: Synthetic peptide
  Seed: ASALPTTI (MAGA4_HUMAN)
AQALPTTV

SEQ ID NO: 65533 - protein, 11 aa, Artificial Sequence
  Description of Artificial Sequence: Synthetic peptide
  Seed: RQVPGSNPARY (MAGA4_HUMAN)
RTVPGSNPARK

SEQ ID NO: 65534 - protein, 9 aa, Artificial Sequence
  Description of Artificial Sequence: Synthetic peptide
  Seed: NTYTLVTCL (MAGA4_HUMAN)
NLYTLVTCF

SEQ ID NO: 65535 - protein, 10 aa, Artificial Sequence
  Description of Artificial Sequence: Synthetic peptide
  Seed: RVRIAYPSLR (MAGA4_HUMAN)
RFRIAYPSLY

SEQ ID NO: 65536 - protein, 11 aa, Artificial Sequence
  Description of Artificial Sequence: Synthetic peptide
  Seed: VPAAESAGPPQ (MAGA4_HUMAN)
VPAAESAGPPI

SEQ ID NO: 65537 - protein, 9 aa, Artificial Sequence
  Description of Artificial Sequence: Synthetic peptide
  Seed: LVPGTLEEV (MAGA4_HUMAN)
LSPGTLEEI

SEQ ID NO: 65538 - protein, 9 aa, Artificial Sequence
  Description of Artificial Sequence: Synthetic peptide
  Seed: STSPDAESL (MAGA4_HUMAN)
SASPDAESH

SEQ ID NO: 65539 - protein, 9 aa, Artificial Sequence
  Description of Artificial Sequence: Synthetic peptide
  Seed: RQVPGSNPA (MAGA4_HUMAN)
RCVPGSNPF

SEQ ID NO: 65540 - protein, 9 aa, Artificial Sequence
  Description of Artificial Sequence: Synthetic peptide
  Seed: KASESLKMI (MAGA4_HUMAN)
KLSESLKMW

SEQ ID NO: 65541 - protein, 10 aa, Artificial Sequence
  Description of Artificial Sequence: Synthetic peptide
  Seed: KNYKRCFPVI (MAGA4_HUMAN)
KYYKRCFPVL

SEQ ID NO: 65542 - protein, 9 aa, Artificial Sequence
  Description of Artificial Sequence: Synthetic peptide
  Seed: EHTVYGEPR (MAGA4_HUMAN)
EYTVYGEPR

SEQ ID NO: 65543 - protein, 11 aa, Artificial Sequence
  Description of Artificial Sequence: Synthetic peptide
  Seed: GVYDGREHTVY (MAGA4_HUMAN)
GQYDGREHTVW

SEQ ID NO: 65544 - protein, 10 aa, Artificial Sequence
  Description of Artificial Sequence: Synthetic peptide
  Seed: TTISFTCWRQ (MAGA4_HUMAN)
TTISFTCWRT

SEQ ID NO: 65545 - protein, 9 aa, Artificial Sequence
  Description of Artificial Sequence: Synthetic peptide
  Seed: TQDWVQENY (MAGA4_HUMAN)
TTDWVQENY

SEQ ID NO: 65546 - protein, 9 aa, Artificial Sequence
  Description of Artificial Sequence: Synthetic peptide
  Seed: LLIIVLGTI (MAGA4_HUMAN)
LVIIVLGTV

SEQ ID NO: 65547 - protein, 10 aa, Artificial Sequence
  Description of Artificial Sequence: Synthetic peptide
  Seed: RVRIAYPSLR (MAGA4_HUMAN)
RLRIAYPSLA

SEQ ID NO: 65548 - protein, 10 aa, Artificial Sequence
  Description of Artificial Sequence: Synthetic peptide
  Seed: VDPASNTYTL (MAGA4_HUMAN)
VYPASNTYTY

SEQ ID NO: 65549 - protein, 9 aa, Artificial Sequence
  Description of Artificial Sequence: Synthetic peptide
  Seed: RVNARVRIA (MAGA4_HUMAN)
RGNARVRIK

SEQ ID NO: 65550 - protein, 9 aa, Artificial Sequence
  Description of Artificial Sequence: Synthetic peptide
  Seed: EEVPAAESA (MAGA4_HUMAN)
EEVPAAESM

SEQ ID NO: 65551 - protein, 9 aa, Artificial Sequence
  Description of Artificial Sequence: Synthetic peptide
  Seed: KVDELAHFL (MAGA4_HUMAN)
KSDELAHFM

SEQ ID NO: 65552 - protein, 10 aa, Artificial Sequence
  Description of Artificial Sequence: Synthetic peptide
  Seed: GVYDGREHTV (MAGA4_HUMAN)
GSYDGREHTM

SEQ ID NO: 65553 - protein, 8 aa, Artificial Sequence
  Description of Artificial Sequence: Synthetic peptide
  Seed: REALSNKV (MAGA4_HUMAN)
REALSNKA

SEQ ID NO: 65554 - protein, 9 aa, Artificial Sequence
  Description of Artificial Sequence: Synthetic peptide
  Seed: RVRIAYPSL (MAGA4_HUMAN)
RMRIAYPSH

SEQ ID NO: 65555 - protein, 10 aa, Artificial Sequence
  Description of Artificial Sequence: Synthetic peptide
  Seed: RVRIAYPSLR (MAGA4_HUMAN)
RMRIAYPSLP

SEQ ID NO: 65556 - protein, 11 aa, Artificial Sequence
  Description of Artificial Sequence: Synthetic peptide
  Seed: RVRIAYPSLRE (MAGA4_HUMAN)
RTRIAYPSLRV

SEQ ID NO: 65557 - protein, 9 aa, Artificial Sequence
  Description of Artificial Sequence: Synthetic peptide
  Seed: KVDELAHFL (MAGA4_HUMAN)
KFDELAHFI

SEQ ID NO: 65558 - protein, 9 aa, Artificial Sequence
  Description of Artificial Sequence: Synthetic peptide
  Seed: RVRIAYPSL (MAGA4_HUMAN)
RIRIAYPSL

SEQ ID NO: 65559 - protein, 11 aa, Artificial Sequence
  Description of Artificial Sequence: Synthetic peptide
  Seed: YVKVLEHVVRV (MAGA4_HUMAN)
YMKVLEHVVRV

SEQ ID NO: 65560 - protein, 9 aa, Artificial Sequence
  Description of Artificial Sequence: Synthetic peptide
  Seed: KAEMLERVI (MAGA4_HUMAN)
KTEMLERVF

SEQ ID NO: 65561 - protein, 10 aa, Artificial Sequence
  Description of Artificial Sequence: Synthetic peptide
  Seed: RVRIAYPSLR (MAGA4_HUMAN)
RKRIAYPSLL

SEQ ID NO: 65562 - protein, 9 aa, Artificial Sequence
  Description of Artificial Sequence: Synthetic peptide
  Seed: IAYPSLREA (MAGA4_HUMAN)
ISYPSLREL

SEQ ID NO: 65563 - protein, 9 aa, Artificial Sequence
  Description of Artificial Sequence: Synthetic peptide
  Seed: EVDPASNTY (MAGA4_HUMAN)
ETDPASNTL

SEQ ID NO: 65564 - protein, 10 aa, Artificial Sequence
  Description of Artificial Sequence: Synthetic peptide
  Seed: TTISFTCWRQ (MAGA4_HUMAN)
TQISFTCWRR

SEQ ID NO: 65565 - protein, 9 aa, Artificial Sequence
  Description of Artificial Sequence: Synthetic peptide
  Seed: RQVPGSNPA (MAGA4_HUMAN)
RAVPGSNPL

SEQ ID NO: 65566 - protein, 11 aa, Artificial Sequence
  Description of Artificial Sequence: Synthetic peptide
  Seed: GASALPTTISF (MAGA4_HUMAN)
GQSALPTTISY

SEQ ID NO: 65567 - protein, 9 aa, Artificial Sequence
  Description of Artificial Sequence: Synthetic peptide
  Seed: TQDWVQENY (MAGA4_HUMAN)
TTDWVQENL

SEQ ID NO: 65568 - protein, 11 aa, Artificial Sequence
  Description of Artificial Sequence: Synthetic peptide
  Seed: IAMEGDSASEE (MAGA4_HUMAN)
ISMEGDSASEL

SEQ ID NO: 65569 - protein, 9 aa, Artificial Sequence
  Description of Artificial Sequence: Synthetic peptide
  Seed: RQVPGSNPA (MAGA4_HUMAN)
RKVPGSNPV

SEQ ID NO: 65570 - protein, 10 aa, Artificial Sequence
  Description of Artificial Sequence: Synthetic peptide
  Seed: PTTISFTCWR (MAGA4_HUMAN)
PNTISFTCWR

SEQ ID NO: 65571 - protein, 9 aa, Artificial Sequence
  Description of Artificial Sequence: Synthetic peptide
  Seed: AYPSLREAA (MAGA4_HUMAN)
AFPSLREAF

SEQ ID NO: 65572 - protein, 9 aa, Artificial Sequence
  Description of Artificial Sequence: Synthetic peptide
  Seed: SEEEIWEEL (MAGA4_HUMAN)
SEEEIWEEP

SEQ ID NO: 65573 - protein, 9 aa, Artificial Sequence
  Description of Artificial Sequence: Synthetic peptide
  Seed: KYRAKELVT (MAGA4_HUMAN)
KFRAKELVK

SEQ ID NO: 65574 - protein, 9 aa, Artificial Sequence
  Description of Artificial Sequence: Synthetic peptide
  Seed: SESLKMIFG (MAGA4_HUMAN)
SESLKMIFA

SEQ ID NO: 65575 - protein, 10 aa, Artificial Sequence
  Description of Artificial Sequence: Synthetic peptide
  Seed: GVYDGREHTV (MAGA4_HUMAN)
GMYDGREHTM

SEQ ID NO: 65576 - protein, 10 aa, Artificial Sequence
  Description of Artificial Sequence: Synthetic peptide
  Seed: GVYDGREHTV (MAGA4_HUMAN)
GEYDGREHTL

SEQ ID NO: 65577 - protein, 9 aa, Artificial Sequence
  Description of Artificial Sequence: Synthetic peptide
  Seed: KVLEHVVRV (MAGA4_HUMAN)
KALEHVVRR

SEQ ID NO: 65578 - protein, 10 aa, Artificial Sequence
  Description of Artificial Sequence: Synthetic peptide
  Seed: ELAHFLLRKY (MAGA4_HUMAN)
EAAHFLLRKR

SEQ ID NO: 65579 - protein, 9 aa, Artificial Sequence
  Description of Artificial Sequence: Synthetic peptide
  Seed: EVDPASNTY (MAGA4_HUMAN)
ECDPASNTL

SEQ ID NO: 65580 - protein, 9 aa, Artificial Sequence
  Description of Artificial Sequence: Synthetic peptide
  Seed: IAYPSLREA (MAGA4_HUMAN)
IPYPSLREL

SEQ ID NO: 65581 - protein, 10 aa, Artificial Sequence
  Description of Artificial Sequence: Synthetic peptide
  Seed: RVNARVRIAY (MAGA4_HUMAN)
RTNARVRIAI

SEQ ID NO: 65582 - protein, 9 aa, Artificial Sequence
  Description of Artificial Sequence: Synthetic peptide
  Seed: ELAHFLLRK (MAGA4_HUMAN)
EGAHFLLRR

SEQ ID NO: 65583 - protein, 9 aa, Artificial Sequence
  Description of Artificial Sequence: Synthetic peptide
  Seed: QVPGSNPAR (MAGA4_HUMAN)
QVPGSNPAL

SEQ ID NO: 65584 - protein, 9 aa, Artificial Sequence
  Description of Artificial Sequence: Synthetic peptide
  Seed: KELVTKAEM (MAGA4_HUMAN)
KQLVTKAEV

SEQ ID NO: 65585 - protein, 9 aa, Artificial Sequence
  Description of Artificial Sequence: Synthetic peptide
  Seed: TSPDAESLF (MAGA4_HUMAN)
TSPDAESLW

SEQ ID NO: 65586 - protein, 9 aa, Artificial Sequence
  Description of Artificial Sequence: Synthetic peptide
  Seed: RQVPGSNPA (MAGA4_HUMAN)
RSVPGSNPM

SEQ ID NO: 65587 - protein, 9 aa, Artificial Sequence
  Description of Artificial Sequence: Synthetic peptide
  Seed: EEALGLVGA (MAGA4_HUMAN)
EEALGLVGY

SEQ ID NO: 65588 - protein, 9 aa, Artificial Sequence
  Description of Artificial Sequence: Synthetic peptide
  Seed: RCFPVIFGK (MAGA4_HUMAN)
RAFPVIFGR

SEQ ID NO: 65589 - protein, 9 aa, Artificial Sequence
  Description of Artificial Sequence: Synthetic peptide
  Seed: TSPDAESLF (MAGA4_HUMAN)
TFPDAESLY

SEQ ID NO: 65590 - protein, 9 aa, Artificial Sequence
  Description of Artificial Sequence: Synthetic peptide
  Seed: GSNPARYEF (MAGA4_HUMAN)
GTNPARYEW

SEQ ID NO: 65591 - protein, 11 aa, Artificial Sequence
  Description of Artificial Sequence: Synthetic peptide
  Seed: YVKVLEHVVRV (MAGA4_HUMAN)
YLKVLEHVVRV

SEQ ID NO: 65592 - protein, 9 aa, Artificial Sequence
  Description of Artificial Sequence: Synthetic peptide
  Seed: VYDGREHTV (MAGA4_HUMAN)
VIDGREHTA

SEQ ID NO: 65593 - protein, 9 aa, Artificial Sequence
  Description of Artificial Sequence: Synthetic peptide
  Seed: NKVDELAHF (MAGA4_HUMAN)
NYVDELAHL

SEQ ID NO: 65594 - protein, 9 aa, Artificial Sequence
  Description of Artificial Sequence: Synthetic peptide
  Seed: SALPTTISF (MAGA4_HUMAN)
SALPTTISH

SEQ ID NO: 65595 - protein, 9 aa, Artificial Sequence
  Description of Artificial Sequence: Synthetic peptide
  Seed: IAMEGDSAS (MAGA4_HUMAN)
IAMEGDSAL

SEQ ID NO: 65596 - protein, 9 aa, Artificial Sequence
  Description of Artificial Sequence: Synthetic peptide
  Seed: RQVPGSNPA (MAGA4_HUMAN)
RIVPGSNPY

SEQ ID NO: 65597 - protein, 10 aa, Artificial Sequence
  Description of Artificial Sequence: Synthetic peptide
  Seed: TSYVKVLEHV (MAGA4_HUMAN)
TTYVKVLEHL

SEQ ID NO: 65598 - protein, 9 aa, Artificial Sequence
  Description of Artificial Sequence: Synthetic peptide
  Seed: RQVPGSNPA (MAGA4_HUMAN)
RKVPGSNPM

SEQ ID NO: 65599 - protein, 10 aa, Artificial Sequence
  Description of Artificial Sequence: Synthetic peptide
  Seed: ALSNKVDELA (MAGA4_HUMAN)
AMSNKVDELL

SEQ ID NO: 65600 - protein, 10 aa, Artificial Sequence
  Description of Artificial Sequence: Synthetic peptide
  Seed: RVIKNYKRCF (MAGA4_HUMAN)
RTIKNYKRCF

SEQ ID NO: 65601 - protein, 10 aa, Artificial Sequence
  Description of Artificial Sequence: Synthetic peptide
  Seed: KVDELAHFLL (MAGA4_HUMAN)
KADELAHFLW

SEQ ID NO: 65602 - protein, 9 aa, Artificial Sequence
  Description of Artificial Sequence: Synthetic peptide
  Seed: GTLEEVPAA (MAGA4_HUMAN)
GVLEEVPAV

SEQ ID NO: 65603 - protein, 8 aa, Artificial Sequence
  Description of Artificial Sequence: Synthetic peptide
  Seed: VYGEPRKL (MAGA4_HUMAN)
VYGEPRKY

SEQ ID NO: 65604 - protein, 10 aa, Artificial Sequence
  Description of Artificial Sequence: Synthetic peptide
  Seed: GDSASEEEIW (MAGA4_HUMAN)
GRSASEEEIW

SEQ ID NO: 65605 - protein, 10 aa, Artificial Sequence
  Description of Artificial Sequence: Synthetic peptide
  Seed: KEVDPASNTY (MAGA4_HUMAN)
KVVDPASNTV

SEQ ID NO: 65606 - protein, 9 aa, Artificial Sequence
  Description of Artificial Sequence: Synthetic peptide
  Seed: QIFPKTGLL (MAGA4_HUMAN)
QMFPKTGLI

SEQ ID NO: 65607 - protein, 9 aa, Artificial Sequence
  Description of Artificial Sequence: Synthetic peptide
  Seed: QIFPKTGLL (MAGA4_HUMAN)
QQFPKTGLY

SEQ ID NO: 65608 - protein, 10 aa, Artificial Sequence
  Description of Artificial Sequence: Synthetic peptide
  Seed: MIFGIDVKEV (MAGA4_HUMAN)
MMFGIDVKEM

SEQ ID NO: 65609 - protein, 9 aa, Artificial Sequence
  Description of Artificial Sequence: Synthetic peptide
  Seed: AYPSLREAA (MAGA4_HUMAN)
AFPSLREAM

SEQ ID NO: 65610 - protein, 10 aa, Artificial Sequence
  Description of Artificial Sequence: Synthetic peptide
  Seed: SSSPLVPGTL (MAGA4_HUMAN)
SRSPLVPGTY

SEQ ID NO: 65611 - protein, 9 aa, Artificial Sequence
  Description of Artificial Sequence: Synthetic peptide
  Seed: SAGPPQSPQ (MAGA4_HUMAN)
SAGPPQSPF

SEQ ID NO: 65612 - protein, 9 aa, Artificial Sequence
  Description of Artificial Sequence: Synthetic peptide
  Seed: VYDGREHTV (MAGA4_HUMAN)
VDDGREHTM

SEQ ID NO: 65613 - protein, 9 aa, Artificial Sequence
  Description of Artificial Sequence: Synthetic peptide
  Seed: LVPGTLEEV (MAGA4_HUMAN)
LWPGTLEEM

SEQ ID NO: 65614 - protein, 9 aa, Artificial Sequence
  Description of Artificial Sequence: Synthetic peptide
  Seed: ASESLKMIF (MAGA4_HUMAN)
ATESLKMIY

SEQ ID NO: 65615 - protein, 9 aa, Artificial Sequence
  Description of Artificial Sequence: Synthetic peptide
  Seed: VYGEPRKLL (MAGA4_HUMAN)
VAGEPRKLY

SEQ ID NO: 65616 - protein, 9 aa, Artificial Sequence
  Description of Artificial Sequence: Synthetic peptide
  Seed: KELVTKAEM (MAGA4_HUMAN)
KILVTKAEF

SEQ ID NO: 65617 - protein, 9 aa, Artificial Sequence
  Description of Artificial Sequence: Synthetic peptide
  Seed: STSPDAESL (MAGA4_HUMAN)
SVSPDAESF

SEQ ID NO: 65618 - protein, 9 aa, Artificial Sequence
  Description of Artificial Sequence: Synthetic peptide
  Seed: ALLEEEEGV (MAGA4_HUMAN)
AVLEEEEGV

SEQ ID NO: 65619 - protein, 9 aa, Artificial Sequence
  Description of Artificial Sequence: Synthetic peptide
  Seed: SPLVPGTLE (MAGA4_HUMAN)
SPLVPGTLI

SEQ ID NO: 65620 - protein, 9 aa, Artificial Sequence
  Description of Artificial Sequence: Synthetic peptide
  Seed: YPSLREAAL (MAGA4_HUMAN)
YGSLREAAL

SEQ ID NO: 65621 - protein, 9 aa, Artificial Sequence
  Description of Artificial Sequence: Synthetic peptide
  Seed: TTEEQEAAV (MAGA4_HUMAN)
TAEEQEAAV

SEQ ID NO: 65622 - protein, 9 aa, Artificial Sequence
  Description of Artificial Sequence: Synthetic peptide
  Seed: WVQENYLEY (MAGA4_HUMAN)
WFQENYLEL

SEQ ID NO: 65623 - protein, 10 aa, Artificial Sequence
  Description of Artificial Sequence: Synthetic peptide
  Seed: RVRIAYPSLR (MAGA4_HUMAN)
RFRIAYPSLT

SEQ ID NO: 65624 - protein, 10 aa, Artificial Sequence
  Description of Artificial Sequence: Synthetic peptide
  Seed: VYDGREHTVY (MAGA4_HUMAN)
VYDGREHTVM

SEQ ID NO: 65625 - protein, 9 aa, Artificial Sequence
  Description of Artificial Sequence: Synthetic peptide
  Seed: WVQENYLEY (MAGA4_HUMAN)
WCQENYLEY

SEQ ID NO: 65626 - protein, 10 aa, Artificial Sequence
  Description of Artificial Sequence: Synthetic peptide
  Seed: RVRIAYPSLR (MAGA4_HUMAN)
RIRIAYPSLV

SEQ ID NO: 65627 - protein, 9 aa, Artificial Sequence
  Description of Artificial Sequence: Synthetic peptide
  Seed: REALSNKVD (MAGA4_HUMAN)
REALSNKVA

SEQ ID NO: 65628 - protein, 11 aa, Artificial Sequence
  Description of Artificial Sequence: Synthetic peptide
  Seed: KVDELAHFLLR (MAGA4_HUMAN)
KSDELAHFLLY

SEQ ID NO: 65629 - protein, 10 aa, Artificial Sequence
  Description of Artificial Sequence: Synthetic peptide
  Seed: SYVKVLEHVV (MAGA4_HUMAN)
SFVKVLEHVF

SEQ ID NO: 65630 - protein, 9 aa, Artificial Sequence
  Description of Artificial Sequence: Synthetic peptide
  Seed: RVRIAYPSL (MAGA4_HUMAN)
RLRIAYPSV

SEQ ID NO: 65631 - protein, 8 aa, Artificial Sequence
  Description of Artificial Sequence: Synthetic peptide
  Seed: VYGEPRKL (MAGA4_HUMAN)
VTGEPRKM

SEQ ID NO: 65632 - protein, 11 aa, Artificial Sequence
  Description of Artificial Sequence: Synthetic peptide
  Seed: ELAHFLLRKYR (MAGA4_HUMAN)
EYAHFLLRKYR

SEQ ID NO: 65633 - protein, 10 aa, Artificial Sequence
  Description of Artificial Sequence: Synthetic peptide
  Seed: SESLKMIFGI (MAGA4_HUMAN)
SGSLKMIFGW

SEQ ID NO: 65634 - protein, 9 aa, Artificial Sequence
  Description of Artificial Sequence: Synthetic peptide
  Seed: SALPTTISF (MAGA4_HUMAN)
SFLPTTISY

SEQ ID NO: 65635 - protein, 11 aa, Artificial Sequence
  Description of Artificial Sequence: Synthetic peptide
  Seed: ESLFREALSNK (MAGA4_HUMAN)
ETLFREALSNR

SEQ ID NO: 65636 - protein, 9 aa, Artificial Sequence
  Description of Artificial Sequence: Synthetic peptide
  Seed: TQDWVQENY (MAGA4_HUMAN)
TIDWVQENY

SEQ ID NO: 65637 - protein, 10 aa, Artificial Sequence
  Description of Artificial Sequence: Synthetic peptide
  Seed: RQVPGSNPAR (MAGA4_HUMAN)
RKVPGSNPAF

SEQ ID NO: 65638 - protein, 9 aa, Artificial Sequence
  Description of Artificial Sequence: Synthetic peptide
  Seed: VTKAEMLER (MAGA4_HUMAN)
VAKAEMLER

SEQ ID NO: 65639 - protein, 9 aa, Artificial Sequence
  Description of Artificial Sequence: Synthetic peptide
  Seed: KVDELAHFL (MAGA4_HUMAN)
KPDELAHFL

SEQ ID NO: 65640 - protein, 11 aa, Artificial Sequence
  Description of Artificial Sequence: Synthetic peptide
  Seed: EEGVEAQEEAL (MAGA4_HUMAN)
EEGVEAQEEAF

SEQ ID NO: 65641 - protein, 9 aa, Artificial Sequence
  Description of Artificial Sequence: Synthetic peptide
  Seed: DPASNTYTL (MAGA4_HUMAN)
DSASNTYTF

SEQ ID NO: 65642 - protein, 9 aa, Artificial Sequence
  Description of Artificial Sequence: Synthetic peptide
  Seed: KVLEHVVRV (MAGA4_HUMAN)
KILEHVVRM

SEQ ID NO: 65643 - protein, 9 aa, Artificial Sequence
  Description of Artificial Sequence: Synthetic peptide
  Seed: KELVTKAEM (MAGA4_HUMAN)
KELVTKAEL

SEQ ID NO: 65644 - protein, 9 aa, Artificial Sequence
  Description of Artificial Sequence: Synthetic peptide
  Seed: KASESLKMI (MAGA4_HUMAN)
KTSESLKMV

SEQ ID NO: 65645 - protein, 10 aa, Artificial Sequence
  Description of Artificial Sequence: Synthetic peptide
  Seed: IFPKTGLLII (MAGA4_HUMAN)
IMPKTGLLIF

SEQ ID NO: 65646 - protein, 9 aa, Artificial Sequence
  Description of Artificial Sequence: Synthetic peptide
  Seed: TVYGEPRKL (MAGA4_HUMAN)
TYYGEPRKY

SEQ ID NO: 65647 - protein, 10 aa, Artificial Sequence
  Description of Artificial Sequence: Synthetic peptide
  Seed: VYDGREHTVY (MAGA4_HUMAN)
VTDGREHTVY

SEQ ID NO: 65648 - protein, 9 aa, Artificial Sequence
  Description of Artificial Sequence: Synthetic peptide
  Seed: RVRIAYPSL (MAGA4_HUMAN)
RHRIAYPSY

SEQ ID NO: 65649 - protein, 10 aa, Artificial Sequence
  Description of Artificial Sequence: Synthetic peptide
  Seed: FGKASESLKM (MAGA4_HUMAN)
FKKASESLKF

SEQ ID NO: 65650 - protein, 9 aa, Artificial Sequence
  Description of Artificial Sequence: Synthetic peptide
  Seed: RAKELVTKA (MAGA4_HUMAN)
RFKELVTKK

SEQ ID NO: 65651 - protein, 10 aa, Artificial Sequence
  Description of Artificial Sequence: Synthetic peptide
  Seed: RVRIAYPSLR (MAGA4_HUMAN)
RHRIAYPSLM

SEQ ID NO: 65652 - protein, 9 aa, Artificial Sequence
  Description of Artificial Sequence: Synthetic peptide
  Seed: AYPSLREAA (MAGA4_HUMAN)
AFPSLREAL

SEQ ID NO: 65653 - protein, 9 aa, Artificial Sequence
  Description of Artificial Sequence: Synthetic peptide
  Seed: SEEEIWEEL (MAGA4_HUMAN)
SHEEIWEEL

SEQ ID NO: 65654 - protein, 9 aa, Artificial Sequence
  Description of Artificial Sequence: Synthetic peptide
  Seed: RVRIAYPSL (MAGA4_HUMAN)
RTRIAYPSD

SEQ ID NO: 65655 - protein, 10 aa, Artificial Sequence
  Description of Artificial Sequence: Synthetic peptide
  Seed: RVRIAYPSLR (MAGA4_HUMAN)
RIRIAYPSLP

SEQ ID NO: 65656 - protein, 9 aa, Artificial Sequence
  Description of Artificial Sequence: Synthetic peptide
  Seed: SSSPLVPGT (MAGA4_HUMAN)
SQSPLVPGL

SEQ ID NO: 65657 - protein, 10 aa, Artificial Sequence
  Description of Artificial Sequence: Synthetic peptide
  Seed: RVRIAYPSLR (MAGA4_HUMAN)
RQRIAYPSLY

SEQ ID NO: 65658 - protein, 9 aa, Artificial Sequence
  Description of Artificial Sequence: Synthetic peptide
  Seed: IIVLGTIAM (MAGA4_HUMAN)
IPVLGTIAM

SEQ ID NO: 65659 - protein, 9 aa, Artificial Sequence
  Description of Artificial Sequence: Synthetic peptide
  Seed: RVRIAYPSL (MAGA4_HUMAN)
RNRIAYPSF

SEQ ID NO: 65660 - protein, 9 aa, Artificial Sequence
  Description of Artificial Sequence: Synthetic peptide
  Seed: RVRIAYPSL (MAGA4_HUMAN)
RTRIAYPSL

SEQ ID NO: 65661 - protein, 9 aa, Artificial Sequence
  Description of Artificial Sequence: Synthetic peptide
  Seed: SSPLVPGTL (MAGA4_HUMAN)
STPLVPGTV

SEQ ID NO: 65662 - protein, 9 aa, Artificial Sequence
  Description of Artificial Sequence: Synthetic peptide
  Seed: VYDGREHTV (MAGA4_HUMAN)
VFDGREHTV

SEQ ID NO: 65663 - protein, 10 aa, Artificial Sequence
  Description of Artificial Sequence: Synthetic peptide
  Seed: EHTVYGEPRK (MAGA4_HUMAN)
EQTVYGEPRR

SEQ ID NO: 65664 - protein, 10 aa, Artificial Sequence
  Description of Artificial Sequence: Synthetic peptide
  Seed: MIFGIDVKEV (MAGA4_HUMAN)
MMFGIDVKEL

SEQ ID NO: 65665 - protein, 9 aa, Artificial Sequence
  Description of Artificial Sequence: Synthetic peptide
  Seed: IIVLGTIAM (MAGA4_HUMAN)
ILVLGTIAF

SEQ ID NO: 65666 - protein, 10 aa, Artificial Sequence
  Description of Artificial Sequence: Synthetic peptide
  Seed: RVIKNYKRCF (MAGA4_HUMAN)
RMIKNYKRCF

SEQ ID NO: 65667 - protein, 9 aa, Artificial Sequence
  Description of Artificial Sequence: Synthetic peptide
  Seed: AEMLERVIK (MAGA4_HUMAN)
AEMLERVIS

SEQ ID NO: 65668 - protein, 9 aa, Artificial Sequence
  Description of Artificial Sequence: Synthetic peptide
  Seed: DPASNTYTL (MAGA4_HUMAN)
DAASNTYTI

SEQ ID NO: 65669 - protein, 9 aa, Artificial Sequence
  Description of Artificial Sequence: Synthetic peptide
  Seed: EAQEEALGL (MAGA4_HUMAN)
EAQEEALGR

SEQ ID NO: 65670 - protein, 10 aa, Artificial Sequence
  Description of Artificial Sequence: Synthetic peptide
  Seed: AQEEALGLVG (MAGA4_HUMAN)
AEEEALGLVV

SEQ ID NO: 65671 - protein, 11 aa, Artificial Sequence
  Description of Artificial Sequence: Synthetic peptide
  Seed: RQVPGSNPARY (MAGA4_HUMAN)
REVPGSNPARY

SEQ ID NO: 65672 - protein, 10 aa, Artificial Sequence
  Description of Artificial Sequence: Synthetic peptide
  Seed: RVNARVRIAY (MAGA4_HUMAN)
RTNARVRIAA

SEQ ID NO: 65673 - protein, 10 aa, Artificial Sequence
  Description of Artificial Sequence: Synthetic peptide
  Seed: RVRIAYPSLR (MAGA4_HUMAN)
RYRIAYPSLM

SEQ ID NO: 65674 - protein, 10 aa, Artificial Sequence
  Description of Artificial Sequence: Synthetic peptide
  Seed: SLFREALSNK (MAGA4_HUMAN)
SIFREALSNR

SEQ ID NO: 65675 - protein, 9 aa, Artificial Sequence
  Description of Artificial Sequence: Synthetic peptide
  Seed: IAYPSLREA (MAGA4_HUMAN)
ILYPSLREF

SEQ ID NO: 65676 - protein, 9 aa, Artificial Sequence
  Description of Artificial Sequence: Synthetic peptide
  Seed: TTISFTCWR (MAGA4_HUMAN)
TQISFTCWK

SEQ ID NO: 65677 - protein, 9 aa, Artificial Sequence
  Description of Artificial Sequence: Synthetic peptide
  Seed: SEEEIWEEL (MAGA4_HUMAN)
SQEEIWEEF

SEQ ID NO: 65678 - protein, 9 aa, Artificial Sequence
  Description of Artificial Sequence: Synthetic peptide
  Seed: YVKVLEHVV (MAGA4_HUMAN)
YVKVLEHVY

SEQ ID NO: 65679 - protein, 9 aa, Artificial Sequence
  Description of Artificial Sequence: Synthetic peptide
  Seed: SALPTTISF (MAGA4_HUMAN)
SYLPTTISL

SEQ ID NO: 65680 - protein, 9 aa, Artificial Sequence
  Description of Artificial Sequence: Synthetic peptide
  Seed: LVPGTLEEV (MAGA4_HUMAN)
LLPGTLEEV

SEQ ID NO: 65681 - protein, 9 aa, Artificial Sequence
  Description of Artificial Sequence: Synthetic peptide
  Seed: WVQENYLEY (MAGA4_HUMAN)
WIQENYLEY

SEQ ID NO: 65682 - protein, 9 aa, Artificial Sequence
  Description of Artificial Sequence: Synthetic peptide
  Seed: KVDELAHFL (MAGA4_HUMAN)
KLDELAHFM

SEQ ID NO: 65683 - protein, 9 aa, Artificial Sequence
  Description of Artificial Sequence: Synthetic peptide
  Seed: VVRVNARVR (MAGA4_HUMAN)
VVRVNARVK

SEQ ID NO: 65684 - protein, 9 aa, Artificial Sequence
  Description of Artificial Sequence: Synthetic peptide
  Seed: IAYPSLREA (MAGA4_HUMAN)
IPYPSLRET

SEQ ID NO: 65685 - protein, 10 aa, Artificial Sequence
  Description of Artificial Sequence: Synthetic peptide
  Seed: KEVDPASNTY (MAGA4_HUMAN)
KTVDPASNTL

SEQ ID NO: 65686 - protein, 11 aa, Artificial Sequence
  Description of Artificial Sequence: Synthetic peptide
  Seed: QHCKPEEGVEA (MAGA4_HUMAN)
QHCKPEEGVEL

SEQ ID NO: 65687 - protein, 10 aa, Artificial Sequence
  Description of Artificial Sequence: Synthetic peptide
  Seed: AYPSLREAAL (MAGA4_HUMAN)
AKPSLREAAM

SEQ ID NO: 65688 - protein, 9 aa, Artificial Sequence
  Description of Artificial Sequence: Synthetic peptide
  Seed: SSPLVPGTL (MAGA4_HUMAN)
SIPLVPGTI

SEQ ID NO: 65689 - protein, 9 aa, Artificial Sequence
  Description of Artificial Sequence: Synthetic peptide
  Seed: QVPGSNPAR (MAGA4_HUMAN)
QTPGSNPAR

SEQ ID NO: 65690 - protein, 9 aa, Artificial Sequence
  Description of Artificial Sequence: Synthetic peptide
  Seed: LLIIVLGTI (MAGA4_HUMAN)
LMIIVLGTA

SEQ ID NO: 65691 - protein, 9 aa, Artificial Sequence
  Description of Artificial Sequence: Synthetic peptide
  Seed: VEAQEEALG (MAGA4_HUMAN)
VEAQEEALA

SEQ ID NO: 65692 - protein, 9 aa, Artificial Sequence
  Description of Artificial Sequence: Synthetic peptide
  Seed: LFREALSNK (MAGA4_HUMAN)
LSREALSNK

SEQ ID NO: 65693 - protein, 9 aa, Artificial Sequence
  Description of Artificial Sequence: Synthetic peptide
  Seed: SSPLVPGTL (MAGA4_HUMAN)
SQPLVPGTI

SEQ ID NO: 65694 - protein, 10 aa, Artificial Sequence
  Description of Artificial Sequence: Synthetic peptide
  Seed: KASESLKMIF (MAGA4_HUMAN)
KKSESLKMIY

SEQ ID NO: 65695 - protein, 9 aa, Artificial Sequence
  Description of Artificial Sequence: Synthetic peptide
  Seed: SSPLVPGTL (MAGA4_HUMAN)
SVPLVPGTM

SEQ ID NO: 65696 - protein, 9 aa, Artificial Sequence
  Description of Artificial Sequence: Synthetic peptide
  Seed: KASESLKMI (MAGA4_HUMAN)
KTSESLKMW

SEQ ID NO: 65697 - protein, 9 aa, Artificial Sequence
  Description of Artificial Sequence: Synthetic peptide
  Seed: LPTTISFTC (MAGA4_HUMAN)
LPTTISFTV

SEQ ID NO: 65698 - protein, 9 aa, Artificial Sequence
  Description of Artificial Sequence: Synthetic peptide
  Seed: EAQEEALGL (MAGA4_HUMAN)
EMQEEALGR

SEQ ID NO: 65699 - protein, 10 aa, Artificial Sequence
  Description of Artificial Sequence: Synthetic peptide
  Seed: GVYDGREHTV (MAGA4_HUMAN)
GSYDGREHTI

SEQ ID NO: 65700 - protein, 10 aa, Artificial Sequence
  Description of Artificial Sequence: Synthetic peptide
  Seed: QIFPKTGLLI (MAGA4_HUMAN)
QPFPKTGLLF

SEQ ID NO: 65701 - protein, 10 aa, Artificial Sequence
  Description of Artificial Sequence: Synthetic peptide
  Seed: PTTISFTCWR (MAGA4_HUMAN)
PMTISFTCWR

SEQ ID NO: 65702 - protein, 10 aa, Artificial Sequence
  Description of Artificial Sequence: Synthetic peptide
  Seed: YRQVPGSNPA (MAGA4_HUMAN)
YMQVPGSNPW

SEQ ID NO: 65703 - protein, 10 aa, Artificial Sequence
  Description of Artificial Sequence: Synthetic peptide
  Seed: KNYKRCFPVI (MAGA4_HUMAN)
KVYKRCFPVV

SEQ ID NO: 65704 - protein, 9 aa, Artificial Sequence
  Description of Artificial Sequence: Synthetic peptide
  Seed: QIFPKTGLL (MAGA4_HUMAN)
QTFPKTGLF

SEQ ID NO: 65705 - protein, 11 aa, Artificial Sequence
  Description of Artificial Sequence: Synthetic peptide
  Seed: RQVPGSNPARY (MAGA4_HUMAN)
RRVPGSNPARF

SEQ ID NO: 65706 - protein, 9 aa, Artificial Sequence
  Description of Artificial Sequence: Synthetic peptide
  Seed: GDSASEEEI (MAGA4_HUMAN)
GESASEEEM

SEQ ID NO: 65707 - protein, 9 aa, Artificial Sequence
  Description of Artificial Sequence: Synthetic peptide
  Seed: NPARYEFLW (MAGA4_HUMAN)
NPARYEFLY

SEQ ID NO: 65708 - protein, 9 aa, Artificial Sequence
  Description of Artificial Sequence: Synthetic peptide
  Seed: KYRAKELVT (MAGA4_HUMAN)
KVRAKELVG

SEQ ID NO: 65709 - protein, 9 aa, Artificial Sequence
  Description of Artificial Sequence: Synthetic peptide
  Seed: SSPLVPGTL (MAGA4_HUMAN)
SRPLVPGTF

SEQ ID NO: 65710 - protein, 9 aa, Artificial Sequence
  Description of Artificial Sequence: Synthetic peptide
  Seed: RVRIAYPSL (MAGA4_HUMAN)
RARIAYPSR

SEQ ID NO: 65711 - protein, 9 aa, Artificial Sequence
  Description of Artificial Sequence: Synthetic peptide
  Seed: STSPDAESL (MAGA4_HUMAN)
SVSPDAESY

SEQ ID NO: 65712 - protein, 9 aa, Artificial Sequence
  Description of Artificial Sequence: Synthetic peptide
  Seed: RVRIAYPSL (MAGA4_HUMAN)
RSRIAYPSF

SEQ ID NO: 65713 - protein, 9 aa, Artificial Sequence
  Description of Artificial Sequence: Synthetic peptide
  Seed: AAVSSSSPL (MAGA4_HUMAN)
AFVSSSSPM

SEQ ID NO: 65714 - protein, 9 aa, Artificial Sequence
  Description of Artificial Sequence: Synthetic peptide
  Seed: KVDELAHFL (MAGA4_HUMAN)
KTDELAHFR

SEQ ID NO: 65715 - protein, 10 aa, Artificial Sequence
  Description of Artificial Sequence: Synthetic peptide
  Seed: ASALPTTISF (MAGA4_HUMAN)
ALALPTTISY

SEQ ID NO: 65716 - protein, 9 aa, Artificial Sequence
  Description of Artificial Sequence: Synthetic peptide
  Seed: KVLEHVVRV (MAGA4_HUMAN)
KQLEHVVRM

SEQ ID NO: 65717 - protein, 9 aa, Artificial Sequence
  Description of Artificial Sequence: Synthetic peptide
  Seed: RVRIAYPSL (MAGA4_HUMAN)
RKRIAYPSM

SEQ ID NO: 65718 - protein, 10 aa, Artificial Sequence
  Description of Artificial Sequence: Synthetic peptide
  Seed: EMLERVIKNY (MAGA4_HUMAN)
EVLERVIKNK

SEQ ID NO: 65719 - protein, 8 aa, Artificial Sequence
  Description of Artificial Sequence: Synthetic peptide
  Seed: MIFGIDVK (MAGA4_HUMAN)
MVFGIDVR

SEQ ID NO: 65720 - protein, 10 aa, Artificial Sequence
  Description of Artificial Sequence: Synthetic peptide
  Seed: YRQVPGSNPA (MAGA4_HUMAN)
YEQVPGSNPV

SEQ ID NO: 65721 - protein, 10 aa, Artificial Sequence
  Description of Artificial Sequence: Synthetic peptide
  Seed: EHTVYGEPRK (MAGA4_HUMAN)
EFTVYGEPRR

SEQ ID NO: 65722 - protein, 11 aa, Artificial Sequence
  Description of Artificial Sequence: Synthetic peptide
  Seed: ESLFREALSNK (MAGA4_HUMAN)
ERLFREALSNK

SEQ ID NO: 65723 - protein, 10 aa, Artificial Sequence
  Description of Artificial Sequence: Synthetic peptide
  Seed: YPSLREAALL (MAGA4_HUMAN)
YYSLREAALF

SEQ ID NO: 65724 - protein, 10 aa, Artificial Sequence
  Description of Artificial Sequence: Synthetic peptide
  Seed: TTISFTCWRQ (MAGA4_HUMAN)
TVISFTCWRQ

SEQ ID NO: 65725 - protein, 9 aa, Artificial Sequence
  Description of Artificial Sequence: Synthetic peptide
  Seed: VYGEPRKLL (MAGA4_HUMAN)
VYGEPRKLM

SEQ ID NO: 65726 - protein, 9 aa, Artificial Sequence
  Description of Artificial Sequence: Synthetic peptide
  Seed: TSPDAESLF (MAGA4_HUMAN)
TPPDAESLW

SEQ ID NO: 65727 - protein, 9 aa, Artificial Sequence
  Description of Artificial Sequence: Synthetic peptide
  Seed: DELAHFLLR (MAGA4_HUMAN)
DSLAHFLLR

SEQ ID NO: 65728 - protein, 9 aa, Artificial Sequence
  Description of Artificial Sequence: Synthetic peptide
  Seed: YVKVLEHVV (MAGA4_HUMAN)
YMKVLEHVL

SEQ ID NO: 65729 - protein, 9 aa, Artificial Sequence
  Description of Artificial Sequence: Synthetic peptide
  Seed: KELVTKAEM (MAGA4_HUMAN)
KELVTKAET

SEQ ID NO: 65730 - protein, 9 aa, Artificial Sequence
  Description of Artificial Sequence: Synthetic peptide
  Seed: LFREALSNK (MAGA4_HUMAN)
LVREALSNK

SEQ ID NO: 65731 - protein, 9 aa, Artificial Sequence
  Description of Artificial Sequence: Synthetic peptide
  Seed: ESLKMIFGI (MAGA4_HUMAN)
EALKMIFGF

SEQ ID NO: 65732 - protein, 9 aa, Artificial Sequence
  Description of Artificial Sequence: Synthetic peptide
  Seed: AAVSSSSPL (MAGA4_HUMAN)
AWVSSSSPL

SEQ ID NO: 65733 - protein, 10 aa, Artificial Sequence
  Description of Artificial Sequence: Synthetic peptide
  Seed: EHTVYGEPRK (MAGA4_HUMAN)
EITVYGEPRR

SEQ ID NO: 65734 - protein, 10 aa, Artificial Sequence
  Description of Artificial Sequence: Synthetic peptide
  Seed: KVDELAHFLL (MAGA4_HUMAN)
KSDELAHFLW

SEQ ID NO: 65735 - protein, 9 aa, Artificial Sequence
  Description of Artificial Sequence: Synthetic peptide
  Seed: REHTVYGEP (MAGA4_HUMAN)
REHTVYGEC

SEQ ID NO: 65736 - protein, 9 aa, Artificial Sequence
  Description of Artificial Sequence: Synthetic peptide
  Seed: IAYPSLREA (MAGA4_HUMAN)
INYPSLREY

SEQ ID NO: 65737 - protein, 9 aa, Artificial Sequence
  Description of Artificial Sequence: Synthetic peptide
  Seed: IFPKTGLLI (MAGA4_HUMAN)
IFPKTGLLW

SEQ ID NO: 65738 - protein, 10 aa, Artificial Sequence
  Description of Artificial Sequence: Synthetic peptide
  Seed: KRCFPVIFGK (MAGA4_HUMAN)
KTCFPVIFGR

SEQ ID NO: 65739 - protein, 9 aa, Artificial Sequence
  Description of Artificial Sequence: Synthetic peptide
  Seed: RVRIAYPSL (MAGA4_HUMAN)
RNRIAYPSL

SEQ ID NO: 65740 - protein, 9 aa, Artificial Sequence
  Description of Artificial Sequence: Synthetic peptide
  Seed: AAVSSSSPL (MAGA4_HUMAN)
AVVSSSSPL

SEQ ID NO: 65741 - protein, 10 aa, Artificial Sequence
  Description of Artificial Sequence: Synthetic peptide
  Seed: GVYDGREHTV (MAGA4_HUMAN)
GMYDGREHTI

SEQ ID NO: 65742 - protein, 9 aa, Artificial Sequence
  Description of Artificial Sequence: Synthetic peptide
  Seed: STSPDAESL (MAGA4_HUMAN)
SISPDAESF

SEQ ID NO: 65743 - protein, 9 aa, Artificial Sequence
  Description of Artificial Sequence: Synthetic peptide
  Seed: STSPDAESL (MAGA4_HUMAN)
SISPDAESW

SEQ ID NO: 65744 - protein, 10 aa, Artificial Sequence
  Description of Artificial Sequence: Synthetic peptide
  Seed: VIFGKASESL (MAGA4_HUMAN)
VLFGKASESL

SEQ ID NO: 65745 - protein, 10 aa, Artificial Sequence
  Description of Artificial Sequence: Synthetic peptide
  Seed: GVYDGREHTV (MAGA4_HUMAN)
GMYDGREHTW

SEQ ID NO: 65746 - protein, 10 aa, Artificial Sequence
  Description of Artificial Sequence: Synthetic peptide
  Seed: EAAVSSSSPL (MAGA4_HUMAN)
EMAVSSSSPV

SEQ ID NO: 65747 - protein, 10 aa, Artificial Sequence
  Description of Artificial Sequence: Synthetic peptide
  Seed: YRQVPGSNPA (MAGA4_HUMAN)
YSQVPGSNPL

SEQ ID NO: 65748 - protein, 10 aa, Artificial Sequence
  Description of Artificial Sequence: Synthetic peptide
  Seed: EAAVSSSSPL (MAGA4_HUMAN)
ETAVSSSSPL

SEQ ID NO: 65749 - protein, 10 aa, Artificial Sequence
  Description of Artificial Sequence: Synthetic peptide
  Seed: ASALPTTISF (MAGA4_HUMAN)
ACALPTTISW

SEQ ID NO: 65750 - protein, 9 aa, Artificial Sequence
  Description of Artificial Sequence: Synthetic peptide
  Seed: RQVPGSNPA (MAGA4_HUMAN)
RIVPGSNPM

SEQ ID NO: 65751 - protein, 9 aa, Artificial Sequence
  Description of Artificial Sequence: Synthetic peptide
  Seed: TSPDAESLF (MAGA4_HUMAN)
TYPDAESLY

SEQ ID NO: 65752 - protein, 9 aa, Artificial Sequence
  Description of Artificial Sequence: Synthetic peptide
  Seed: ALSNKVDEL (MAGA4_HUMAN)
AYSNKVDEL

SEQ ID NO: 65753 - protein, 10 aa, Artificial Sequence
  Description of Artificial Sequence: Synthetic peptide
  Seed: STSPDAESLF (MAGA4_HUMAN)
SLSPDAESLW

SEQ ID NO: 65754 - protein, 9 aa, Artificial Sequence
  Description of Artificial Sequence: Synthetic peptide
  Seed: NTYTLVTCL (MAGA4_HUMAN)
NMYTLVTCI

SEQ ID NO: 65755 - protein, 9 aa, Artificial Sequence
  Description of Artificial Sequence: Synthetic peptide
  Seed: KVLEHVVRV (MAGA4_HUMAN)
KQLEHVVRT

SEQ ID NO: 65756 - protein, 9 aa, Artificial Sequence
  Description of Artificial Sequence: Synthetic peptide
  Seed: IAMEGDSAS (MAGA4_HUMAN)
IIMEGDSAF

SEQ ID NO: 65757 - protein, 9 aa, Artificial Sequence
  Description of Artificial Sequence: Synthetic peptide
  Seed: SNPARYEFL (MAGA4_HUMAN)
SRPARYEFF

SEQ ID NO: 65758 - protein, 9 aa, Artificial Sequence
  Description of Artificial Sequence: Synthetic peptide
  Seed: VYDGREHTV (MAGA4_HUMAN)
VVDGREHTF

SEQ ID NO: 65759 - protein, 9 aa, Artificial Sequence
  Description of Artificial Sequence: Synthetic peptide
  Seed: SSSPLVPGT (MAGA4_HUMAN)
SMSPLVPGI

SEQ ID NO: 65760 - protein, 10 aa, Artificial Sequence
  Description of Artificial Sequence: Synthetic peptide
  Seed: RVRIAYPSLR (MAGA4_HUMAN)
RVRIAYPSLG

SEQ ID NO: 65761 - protein, 10 aa, Artificial Sequence
  Description of Artificial Sequence: Synthetic peptide
  Seed: GVYDGREHTV (MAGA4_HUMAN)
GLYDGREHTM

SEQ ID NO: 65762 - protein, 10 aa, Artificial Sequence
  Description of Artificial Sequence: Synthetic peptide
  Seed: YRQVPGSNPA (MAGA4_HUMAN)
YFQVPGSNPL

SEQ ID NO: 65763 - protein, 11 aa, Artificial Sequence
  Description of Artificial Sequence: Synthetic peptide
  Seed: STSPDAESLFR (MAGA4_HUMAN)
SSSPDAESLFK

SEQ ID NO: 65764 - protein, 9 aa, Artificial Sequence
  Description of Artificial Sequence: Synthetic peptide
  Seed: TTISFTCWR (MAGA4_HUMAN)
TLISFTCWK

SEQ ID NO: 65765 - protein, 10 aa, Artificial Sequence
  Description of Artificial Sequence: Synthetic peptide
  Seed: TTISFTCWRQ (MAGA4_HUMAN)
TTISFTCWRD

SEQ ID NO: 65766 - protein, 9 aa, Artificial Sequence
  Description of Artificial Sequence: Synthetic peptide
  Seed: GVYDGREHT (MAGA4_HUMAN)
GLYDGREHA

SEQ ID NO: 65767 - protein, 9 aa, Artificial Sequence
  Description of Artificial Sequence: Synthetic peptide
  Seed: KNYKRCFPV (MAGA4_HUMAN)
KTYKRCFPT

SEQ ID NO: 65768 - protein, 9 aa, Artificial Sequence
  Description of Artificial Sequence: Synthetic peptide
  Seed: RVRIAYPSL (MAGA4_HUMAN)
RYRIAYPSE

SEQ ID NO: 65769 - protein, 9 aa, Artificial Sequence
  Description of Artificial Sequence: Synthetic peptide
  Seed: KMIFGIDVK (MAGA4_HUMAN)
KIIFGIDVK

SEQ ID NO: 65770 - protein, 10 aa, Artificial Sequence
  Description of Artificial Sequence: Synthetic peptide
  Seed: SLKMIFGIDV (MAGA4_HUMAN)
SMKMIFGIDV

SEQ ID NO: 65771 - protein, 9 aa, Artificial Sequence
  Description of Artificial Sequence: Synthetic peptide
  Seed: KVLEHVVRV (MAGA4_HUMAN)
KMLEHVVRS

SEQ ID NO: 65772 - protein, 9 aa, Artificial Sequence
  Description of Artificial Sequence: Synthetic peptide
  Seed: HTVYGEPRK (MAGA4_HUMAN)
HVVYGEPRK

SEQ ID NO: 65773 - protein, 9 aa, Artificial Sequence
  Description of Artificial Sequence: Synthetic peptide
  Seed: KELVTKAEM (MAGA4_HUMAN)
KQLVTKAEF

SEQ ID NO: 65774 - protein, 10 aa, Artificial Sequence
  Description of Artificial Sequence: Synthetic peptide
  Seed: ESAGPPQSPQ (MAGA4_HUMAN)
ETAGPPQSPR

SEQ ID NO: 65775 - protein, 10 aa, Artificial Sequence
  Description of Artificial Sequence: Synthetic peptide
  Seed: LIIVLGTIAM (MAGA4_HUMAN)
LSIVLGTIAF

SEQ ID NO: 65776 - protein, 9 aa, Artificial Sequence
  Description of Artificial Sequence: Synthetic peptide
  Seed: ALSNKVDEL (MAGA4_HUMAN)
AMSNKVDEW

SEQ ID NO: 65777 - protein, 10 aa, Artificial Sequence
  Description of Artificial Sequence: Synthetic peptide
  Seed: AQEEALGLVG (MAGA4_HUMAN)
AEEEALGLVA

SEQ ID NO: 65778 - protein, 10 aa, Artificial Sequence
  Description of Artificial Sequence: Synthetic peptide
  Seed: KYRAKELVTK (MAGA4_HUMAN)
KMRAKELVTA

SEQ ID NO: 65779 - protein, 10 aa, Artificial Sequence
  Description of Artificial Sequence: Synthetic peptide
  Seed: ASALPTTISF (MAGA4_HUMAN)
AIALPTTISY

SEQ ID NO: 65780 - protein, 9 aa, Artificial Sequence
  Description of Artificial Sequence: Synthetic peptide
  Seed: EIWEELGVM (MAGA4_HUMAN)
ESWEELGVY

SEQ ID NO: 65781 - protein, 9 aa, Artificial Sequence
  Description of Artificial Sequence: Synthetic peptide
  Seed: EELGVMGVY (MAGA4_HUMAN)
EELGVMGVM

SEQ ID NO: 65782 - protein, 9 aa, Artificial Sequence
  Description of Artificial Sequence: Synthetic peptide
  Seed: KVLEHVVRV (MAGA4_HUMAN)
KQLEHVVRR

SEQ ID NO: 65783 - protein, 9 aa, Artificial Sequence
  Description of Artificial Sequence: Synthetic peptide
  Seed: SYVKVLEHV (MAGA4_HUMAN)
SAVKVLEHY

SEQ ID NO: 65784 - protein, 10 aa, Artificial Sequence
  Description of Artificial Sequence: Synthetic peptide
  Seed: RVRIAYPSLR (MAGA4_HUMAN)
RCRIAYPSLR

SEQ ID NO: 65785 - protein, 11 aa, Artificial Sequence
  Description of Artificial Sequence: Synthetic peptide
  Seed: RVNARVRIAYP (MAGA4_HUMAN)
RNNARVRIAYK

SEQ ID NO: 65786 - protein, 9 aa, Artificial Sequence
  Description of Artificial Sequence: Synthetic peptide
  Seed: ALSNKVDEL (MAGA4_HUMAN)
AQSNKVDEW

SEQ ID NO: 65787 - protein, 9 aa, Artificial Sequence
  Description of Artificial Sequence: Synthetic peptide
  Seed: ARVRIAYPS (MAGA4_HUMAN)
ARVRIAYPA

SEQ ID NO: 65788 - protein, 8 aa, Artificial Sequence
  Description of Artificial Sequence: Synthetic peptide
  Seed: FPKTGLLI (MAGA4_HUMAN)
FPKTGLLA

SEQ ID NO: 65789 - protein, 9 aa, Artificial Sequence
  Description of Artificial Sequence: Synthetic peptide
  Seed: YDGREHTVY (MAGA4_HUMAN)
YTGREHTVY

SEQ ID NO: 65790 - protein, 10 aa, Artificial Sequence
  Description of Artificial Sequence: Synthetic peptide
  Seed: HVVRVNARVR (MAGA4_HUMAN)
HSVRVNARVR

SEQ ID NO: 65791 - protein, 9 aa, Artificial Sequence
  Description of Artificial Sequence: Synthetic peptide
  Seed: SAGPPQSPQ (MAGA4_HUMAN)
STGPPQSPL

SEQ ID NO: 65792 - protein, 10 aa, Artificial Sequence
  Description of Artificial Sequence: Synthetic peptide
  Seed: EAAVSSSSPL (MAGA4_HUMAN)
EIAVSSSSPV

SEQ ID NO: 65793 - protein, 9 aa, Artificial Sequence
  Description of Artificial Sequence: Synthetic peptide
  Seed: IIVLGTIAM (MAGA4_HUMAN)
IPVLGTIAA

SEQ ID NO: 65794 - protein, 10 aa, Artificial Sequence
  Description of Artificial Sequence: Synthetic peptide
  Seed: QIFPKTGLLI (MAGA4_HUMAN)
QGFPKTGLLF

SEQ ID NO: 65795 - protein, 9 aa, Artificial Sequence
  Description of Artificial Sequence: Synthetic peptide
  Seed: NTYTLVTCL (MAGA4_HUMAN)
NMYTLVTCY

SEQ ID NO: 65796 - protein, 9 aa, Artificial Sequence
  Description of Artificial Sequence: Synthetic peptide
  Seed: KYRAKELVT (MAGA4_HUMAN)
KSRAKELVV

SEQ ID NO: 65797 - protein, 11 aa, Artificial Sequence
  Description of Artificial Sequence: Synthetic peptide
  Seed: RVRIAYPSLRE (MAGA4_HUMAN)
RMRIAYPSLRA

SEQ ID NO: 65798 - protein, 9 aa, Artificial Sequence
  Description of Artificial Sequence: Synthetic peptide
  Seed: SALPTTISF (MAGA4_HUMAN)
STLPTTISL

SEQ ID NO: 65799 - protein, 9 aa, Artificial Sequence
  Description of Artificial Sequence: Synthetic peptide
  Seed: LVPGTLEEV (MAGA4_HUMAN)
LTPGTLEEI

SEQ ID NO: 65800 - protein, 10 aa, Artificial Sequence
  Description of Artificial Sequence: Synthetic peptide
  Seed: QIFPKTGLLI (MAGA4_HUMAN)
QLFPKTGLLW

SEQ ID NO: 65801 - protein, 10 aa, Artificial Sequence
  Description of Artificial Sequence: Synthetic peptide
  Seed: TSYVKVLEHV (MAGA4_HUMAN)
TIYVKVLEHF

SEQ ID NO: 65802 - protein, 9 aa, Artificial Sequence
  Description of Artificial Sequence: Synthetic peptide
  Seed: WVQENYLEY (MAGA4_HUMAN)
WHQENYLEY

SEQ ID NO: 65803 - protein, 10 aa, Artificial Sequence
  Description of Artificial Sequence: Synthetic peptide
  Seed: PTTISFTCWR (MAGA4_HUMAN)
PSTISFTCWR

SEQ ID NO: 65804 - protein, 9 aa, Artificial Sequence
  Description of Artificial Sequence: Synthetic peptide
  Seed: AESLFREAL (MAGA4_HUMAN)
ADSLFREAM

SEQ ID NO: 65805 - protein, 9 aa, Artificial Sequence
  Description of Artificial Sequence: Synthetic peptide
  Seed: IDVKEVDPA (MAGA4_HUMAN)
IEVKEVDPA

SEQ ID NO: 65806 - protein, 9 aa, Artificial Sequence
  Description of Artificial Sequence: Synthetic peptide
  Seed: SALPTTISF (MAGA4_HUMAN)
SVLPTTISV

SEQ ID NO: 65807 - protein, 10 aa, Artificial Sequence
  Description of Artificial Sequence: Synthetic peptide
  Seed: LGVMGVYDGR (MAGA4_HUMAN)
LPVMGVYDGR

SEQ ID NO: 65808 - protein, 8 aa, Artificial Sequence
  Description of Artificial Sequence: Synthetic peptide
  Seed: AHFLLRKY (MAGA4_HUMAN)
AQFLLRKY

SEQ ID NO: 65809 - protein, 11 aa, Artificial Sequence
  Description of Artificial Sequence: Synthetic peptide
  Seed: GVYDGREHTVY (MAGA4_HUMAN)
GAYDGREHTVM

SEQ ID NO: 65810 - protein, 11 aa, Artificial Sequence
  Description of Artificial Sequence: Synthetic peptide
  Seed: RQVPGSNPARY (MAGA4_HUMAN)
RRVPGSNPARL

SEQ ID NO: 65811 - protein, 10 aa, Artificial Sequence
  Description of Artificial Sequence: Synthetic peptide
  Seed: ARVRIAYPSL (MAGA4_HUMAN)
AHVRIAYPSA

SEQ ID NO: 65812 - protein, 9 aa, Artificial Sequence
  Description of Artificial Sequence: Synthetic peptide
  Seed: RVRIAYPSL (MAGA4_HUMAN)
RARIAYPSE

SEQ ID NO: 65813 - protein, 9 aa, Artificial Sequence
  Description of Artificial Sequence: Synthetic peptide
  Seed: GSNPARYEF (MAGA4_HUMAN)
GVNPARYEW

SEQ ID NO: 65814 - protein, 9 aa, Artificial Sequence
  Description of Artificial Sequence: Synthetic peptide
  Seed: TQDWVQENY (MAGA4_HUMAN)
TADWVQENL

SEQ ID NO: 65815 - protein, 9 aa, Artificial Sequence
  Description of Artificial Sequence: Synthetic peptide
  Seed: RCFPVIFGK (MAGA4_HUMAN)
RSFPVIFGK

SEQ ID NO: 65816 - protein, 10 aa, Artificial Sequence
  Description of Artificial Sequence: Synthetic peptide
  Seed: RVRIAYPSLR (MAGA4_HUMAN)
RGRIAYPSLI

SEQ ID NO: 65817 - protein, 9 aa, Artificial Sequence
  Description of Artificial Sequence: Synthetic peptide
  Seed: NYKRCFPVI (MAGA4_HUMAN)
NYKRCFPVF

SEQ ID NO: 65818 - protein, 10 aa, Artificial Sequence
  Description of Artificial Sequence: Synthetic peptide
  Seed: VDPASNTYTL (MAGA4_HUMAN)
VQPASNTYTM

SEQ ID NO: 65819 - protein, 9 aa, Artificial Sequence
  Description of Artificial Sequence: Synthetic peptide
  Seed: TVYGEPRKL (MAGA4_HUMAN)
TRYGEPRKL

SEQ ID NO: 65820 - protein, 10 aa, Artificial Sequence
  Description of Artificial Sequence: Synthetic peptide
  Seed: SPQGASALPT (MAGA4_HUMAN)
SPQGASALPV

SEQ ID NO: 65821 - protein, 9 aa, Artificial Sequence
  Description of Artificial Sequence: Synthetic peptide
  Seed: AEMLERVIK (MAGA4_HUMAN)
AEMLERVIT

SEQ ID NO: 65822 - protein, 10 aa, Artificial Sequence
  Description of Artificial Sequence: Synthetic peptide
  Seed: MLERVIKNYK (MAGA4_HUMAN)
MTERVIKNYA

SEQ ID NO: 65823 - protein, 10 aa, Artificial Sequence
  Description of Artificial Sequence: Synthetic peptide
  Seed: TSPDAESLFR (MAGA4_HUMAN)
TMPDAESLFY

SEQ ID NO: 65824 - protein, 9 aa, Artificial Sequence
  Description of Artificial Sequence: Synthetic peptide
  Seed: SAGPPQSPQ (MAGA4_HUMAN)
SGGPPQSPY

SEQ ID NO: 65825 - protein, 9 aa, Artificial Sequence
  Description of Artificial Sequence: Synthetic peptide
  Seed: KVLEHVVRV (MAGA4_HUMAN)
KVLEHVVRM

SEQ ID NO: 65826 - protein, 9 aa, Artificial Sequence
  Description of Artificial Sequence: Synthetic peptide
  Seed: RAKELVTKA (MAGA4_HUMAN)
RTKELVTKM

SEQ ID NO: 65827 - protein, 10 aa, Artificial Sequence
  Description of Artificial Sequence: Synthetic peptide
  Seed: TTISFTCWRQ (MAGA4_HUMAN)
TVISFTCWRD

SEQ ID NO: 65828 - protein, 9 aa, Artificial Sequence
  Description of Artificial Sequence: Synthetic peptide
  Seed: SSPLVPGTL (MAGA4_HUMAN)
SQPLVPGTV

SEQ ID NO: 65829 - protein, 8 aa, Artificial Sequence
  Description of Artificial Sequence: Synthetic peptide
  Seed: RVRIAYPS (MAGA4_HUMAN)
RSRIAYPY

SEQ ID NO: 65830 - protein, 10 aa, Artificial Sequence
  Description of Artificial Sequence: Synthetic peptide
  Seed: YRQVPGSNPA (MAGA4_HUMAN)
YDQVPGSNPM

SEQ ID NO: 65831 - protein, 9 aa, Artificial Sequence
  Description of Artificial Sequence: Synthetic peptide
  Seed: NPARYEFLW (MAGA4_HUMAN)
NPARYEFLM

SEQ ID NO: 65832 - protein, 8 aa, Artificial Sequence
  Description of Artificial Sequence: Synthetic peptide
  Seed: FLLRKYRA (MAGA4_HUMAN)
FMLRKYRM

SEQ ID NO: 65833 - protein, 11 aa, Artificial Sequence
  Description of Artificial Sequence: Synthetic peptide
  Seed: STSPDAESLFR (MAGA4_HUMAN)
SLSPDAESLFY

SEQ ID NO: 65834 - protein, 10 aa, Artificial Sequence
  Description of Artificial Sequence: Synthetic peptide
  Seed: SLFREALSNK (MAGA4_HUMAN)
SLFREALSNR

SEQ ID NO: 65835 - protein, 10 aa, Artificial Sequence
  Description of Artificial Sequence: Synthetic peptide
  Seed: RVRIAYPSLR (MAGA4_HUMAN)
RRRIAYPSLY

SEQ ID NO: 65836 - protein, 10 aa, Artificial Sequence
  Description of Artificial Sequence: Synthetic peptide
  Seed: RVRIAYPSLR (MAGA4_HUMAN)
RMRIAYPSLS

SEQ ID NO: 65837 - protein, 10 aa, Artificial Sequence
  Description of Artificial Sequence: Synthetic peptide
  Seed: AYPSLREAAL (MAGA4_HUMAN)
AAPSLREAAM

SEQ ID NO: 65838 - protein, 9 aa, Artificial Sequence
  Description of Artificial Sequence: Synthetic peptide
  Seed: SEEEIWEEL (MAGA4_HUMAN)
SAEEIWEEI

SEQ ID NO: 65839 - protein, 9 aa, Artificial Sequence
  Description of Artificial Sequence: Synthetic peptide
  Seed: AAVSSSSPL (MAGA4_HUMAN)
AYVSSSSPL

SEQ ID NO: 65840 - protein, 11 aa, Artificial Sequence
  Description of Artificial Sequence: Synthetic peptide
  Seed: REALSNKVDEL (MAGA4_HUMAN)
REALSNKVDEA

SEQ ID NO: 65841 - protein, 9 aa, Artificial Sequence
  Description of Artificial Sequence: Synthetic peptide
  Seed: KASESLKMI (MAGA4_HUMAN)
KVSESLKML

SEQ ID NO: 65842 - protein, 9 aa, Artificial Sequence
  Description of Artificial Sequence: Synthetic peptide
  Seed: TQDWVQENY (MAGA4_HUMAN)
TCDWVQENL

SEQ ID NO: 65843 - protein, 9 aa, Artificial Sequence
  Description of Artificial Sequence: Synthetic peptide
  Seed: SYVKVLEHV (MAGA4_HUMAN)
SRVKVLEHM

SEQ ID NO: 65844 - protein, 10 aa, Artificial Sequence
  Description of Artificial Sequence: Synthetic peptide
  Seed: KEVDPASNTY (MAGA4_HUMAN)
KQVDPASNTF

SEQ ID NO: 65845 - protein, 9 aa, Artificial Sequence
  Description of Artificial Sequence: Synthetic peptide
  Seed: KVLEHVVRV (MAGA4_HUMAN)
KALEHVVRY

SEQ ID NO: 65846 - protein, 9 aa, Artificial Sequence
  Description of Artificial Sequence: Synthetic peptide
  Seed: DPASNTYTL (MAGA4_HUMAN)
DHASNTYTM

SEQ ID NO: 65847 - protein, 10 aa, Artificial Sequence
  Description of Artificial Sequence: Synthetic peptide
  Seed: TTISFTCWRQ (MAGA4_HUMAN)
TMISFTCWRK

SEQ ID NO: 65848 - protein, 9 aa, Artificial Sequence
  Description of Artificial Sequence: Synthetic peptide
  Seed: IAYPSLREA (MAGA4_HUMAN)
IEYPSLREI

SEQ ID NO: 65849 - protein, 9 aa, Artificial Sequence
  Description of Artificial Sequence: Synthetic peptide
  Seed: KVLEHVVRV (MAGA4_HUMAN)
KYLEHVVRK

SEQ ID NO: 65850 - protein, 9 aa, Artificial Sequence
  Description of Artificial Sequence: Synthetic peptide
  Seed: VYGEPRKLL (MAGA4_HUMAN)
VYGEPRKLY

SEQ ID NO: 65851 - protein, 9 aa, Artificial Sequence
  Description of Artificial Sequence: Synthetic peptide
  Seed: LEHVVRVNA (MAGA4_HUMAN)
LEHVVRVNP

SEQ ID NO: 65852 - protein, 11 aa, Artificial Sequence
  Description of Artificial Sequence: Synthetic peptide
  Seed: STSPDAESLFR (MAGA4_HUMAN)
SASPDAESLFY

SEQ ID NO: 65853 - protein, 10 aa, Artificial Sequence
  Description of Artificial Sequence: Synthetic peptide
  Seed: HVVRVNARVR (MAGA4_HUMAN)
HTVRVNARVR

SEQ ID NO: 65854 - protein, 9 aa, Artificial Sequence
  Description of Artificial Sequence: Synthetic peptide
  Seed: LEEVPAAES (MAGA4_HUMAN)
LEEVPAAEI

SEQ ID NO: 65855 - protein, 11 aa, Artificial Sequence
  Description of Artificial Sequence: Synthetic peptide
  Seed: AEMLERVIKNY (MAGA4_HUMAN)
AEMLERVIKNW

SEQ ID NO: 65856 - protein, 10 aa, Artificial Sequence
  Description of Artificial Sequence: Synthetic peptide
  Seed: LPTTISFTCW (MAGA4_HUMAN)
LTTTISFTCY

SEQ ID NO: 65857 - protein, 9 aa, Artificial Sequence
  Description of Artificial Sequence: Synthetic peptide
  Seed: QIFPKTGLL (MAGA4_HUMAN)
QSFPKTGLV

SEQ ID NO: 65858 - protein, 10 aa, Artificial Sequence
  Description of Artificial Sequence: Synthetic peptide
  Seed: GLVGAQAPTT (MAGA4_HUMAN)
GMVGAQAPTI

SEQ ID NO: 65859 - protein, 9 aa, Artificial Sequence
  Description of Artificial Sequence: Synthetic peptide
  Seed: RVRIAYPSL (MAGA4_HUMAN)
RFRIAYPSC

SEQ ID NO: 65860 - protein, 9 aa, Artificial Sequence
  Description of Artificial Sequence: Synthetic peptide
  Seed: YTLVTCLGL (MAGA4_HUMAN)
YALVTCLGW

SEQ ID NO: 65861 - protein, 10 aa, Artificial Sequence
  Description of Artificial Sequence: Synthetic peptide
  Seed: ASALPTTISF (MAGA4_HUMAN)
AVALPTTISF

SEQ ID NO: 65862 - protein, 10 aa, Artificial Sequence
  Description of Artificial Sequence: Synthetic peptide
  Seed: KEVDPASNTY (MAGA4_HUMAN)
KDVDPASNTW

SEQ ID NO: 65863 - protein, 9 aa, Artificial Sequence
  Description of Artificial Sequence: Synthetic peptide
  Seed: RQVPGSNPA (MAGA4_HUMAN)
REVPGSNPI

SEQ ID NO: 65864 - protein, 9 aa, Artificial Sequence
  Description of Artificial Sequence: Synthetic peptide
  Seed: ALLEEEEGV (MAGA4_HUMAN)
AVLEEEEGL

SEQ ID NO: 65865 - protein, 9 aa, Artificial Sequence
  Description of Artificial Sequence: Synthetic peptide
  Seed: LLIIVLGTI (MAGA4_HUMAN)
LQIIVLGTV

SEQ ID NO: 65866 - protein, 9 aa, Artificial Sequence
  Description of Artificial Sequence: Synthetic peptide
  Seed: TSPDAESLF (MAGA4_HUMAN)
TAPDAESLM

SEQ ID NO: 65867 - protein, 10 aa, Artificial Sequence
  Description of Artificial Sequence: Synthetic peptide
  Seed: YRQVPGSNPA (MAGA4_HUMAN)
YLQVPGSNPY

SEQ ID NO: 65868 - protein, 10 aa, Artificial Sequence
  Description of Artificial Sequence: Synthetic peptide
  Seed: ARVRIAYPSL (MAGA4_HUMAN)
ADVRIAYPSA

SEQ ID NO: 65869 - protein, 10 aa, Artificial Sequence
  Description of Artificial Sequence: Synthetic peptide
  Seed: TSYVKVLEHV (MAGA4_HUMAN)
THYVKVLEHL

SEQ ID NO: 65870 - protein, 9 aa, Artificial Sequence
  Description of Artificial Sequence: Synthetic peptide
  Seed: GASALPTTI (MAGA4_HUMAN)
GVSALPTTL

SEQ ID NO: 65871 - protein, 9 aa, Artificial Sequence
  Description of Artificial Sequence: Synthetic peptide
  Seed: VYDGREHTV (MAGA4_HUMAN)
VIDGREHTV

SEQ ID NO: 65872 - protein, 10 aa, Artificial Sequence
  Description of Artificial Sequence: Synthetic peptide
  Seed: FGKASESLKM (MAGA4_HUMAN)
FRKASESLKF

SEQ ID NO: 65873 - protein, 10 aa, Artificial Sequence
  Description of Artificial Sequence: Synthetic peptide
  Seed: YRQVPGSNPA (MAGA4_HUMAN)
YRQVPGSNPF

SEQ ID NO: 65874 - protein, 9 aa, Artificial Sequence
  Description of Artificial Sequence: Synthetic peptide
  Seed: WVQENYLEY (MAGA4_HUMAN)
WIQENYLEF

SEQ ID NO: 65875 - protein, 10 aa, Artificial Sequence
  Description of Artificial Sequence: Synthetic peptide
  Seed: SESLKMIFGI (MAGA4_HUMAN)
SCSLKMIFGW

SEQ ID NO: 65876 - protein, 11 aa, Artificial Sequence
  Description of Artificial Sequence: Synthetic peptide
  Seed: RQVPGSNPARY (MAGA4_HUMAN)
RRVPGSNPARM

SEQ ID NO: 65877 - protein, 10 aa, Artificial Sequence
  Description of Artificial Sequence: Synthetic peptide
  Seed: KNYKRCFPVI (MAGA4_HUMAN)
KYYKRCFPVK

SEQ ID NO: 65878 - protein, 8 aa, Artificial Sequence
  Description of Artificial Sequence: Synthetic peptide
  Seed: YPSLREAA (MAGA4_HUMAN)
YPSLREAI

SEQ ID NO: 65879 - protein, 9 aa, Artificial Sequence
  Description of Artificial Sequence: Synthetic peptide
  Seed: SALPTTISF (MAGA4_HUMAN)
SALPTTISR

SEQ ID NO: 65880 - protein, 10 aa, Artificial Sequence
  Description of Artificial Sequence: Synthetic peptide
  Seed: GVYDGREHTV (MAGA4_HUMAN)
GAYDGREHTY

SEQ ID NO: 65881 - protein, 9 aa, Artificial Sequence
  Description of Artificial Sequence: Synthetic peptide
  Seed: RAKELVTKA (MAGA4_HUMAN)
RLKELVTKM

SEQ ID NO: 65882 - protein, 10 aa, Artificial Sequence
  Description of Artificial Sequence: Synthetic peptide
  Seed: VDPASNTYTL (MAGA4_HUMAN)
VCPASNTYTM

SEQ ID NO: 65883 - protein, 9 aa, Artificial Sequence
  Description of Artificial Sequence: Synthetic peptide
  Seed: VYGEPRKLL (MAGA4_HUMAN)
VFGEPRKLF

SEQ ID NO: 65884 - protein, 8 aa, Artificial Sequence
  Description of Artificial Sequence: Synthetic peptide
  Seed: KVDELAHF (MAGA4_HUMAN)
KSDELAHM

SEQ ID NO: 65885 - protein, 10 aa, Artificial Sequence
  Description of Artificial Sequence: Synthetic peptide
  Seed: RVRIAYPSLR (MAGA4_HUMAN)
RPRIAYPSLR

SEQ ID NO: 65886 - protein, 9 aa, Artificial Sequence
  Description of Artificial Sequence: Synthetic peptide
  Seed: GVYDGREHT (MAGA4_HUMAN)
GVYDGREHI

SEQ ID NO: 65887 - protein, 10 aa, Artificial Sequence
  Description of Artificial Sequence: Synthetic peptide
  Seed: KNYKRCFPVI (MAGA4_HUMAN)
KKYKRCFPVF

SEQ ID NO: 65888 - protein, 10 aa, Artificial Sequence
  Description of Artificial Sequence: Synthetic peptide
  Seed: KVDELAHFLL (MAGA4_HUMAN)
KMDELAHFLF

SEQ ID NO: 65889 - protein, 9 aa, Artificial Sequence
  Description of Artificial Sequence: Synthetic peptide
  Seed: REAALLEEE (MAGA4_HUMAN)
REAALLEEF

SEQ ID NO: 65890 - protein, 11 aa, Artificial Sequence
  Description of Artificial Sequence: Synthetic peptide
  Seed: GLLGNNQIFPK (MAGA4_HUMAN)
GVLGNNQIFPR

SEQ ID NO: 65891 - protein, 9 aa, Artificial Sequence
  Description of Artificial Sequence: Synthetic peptide
  Seed: EVDPASNTY (MAGA4_HUMAN)
EIDPASNTI

SEQ ID NO: 65892 - protein, 10 aa, Artificial Sequence
  Description of Artificial Sequence: Synthetic peptide
  Seed: LTQDWVQENY (MAGA4_HUMAN)
LIQDWVQENY

SEQ ID NO: 65893 - protein, 9 aa, Artificial Sequence
  Description of Artificial Sequence: Synthetic peptide
  Seed: SALPTTISF (MAGA4_HUMAN)
SKLPTTISM

SEQ ID NO: 65894 - protein, 10 aa, Artificial Sequence
  Description of Artificial Sequence: Synthetic peptide
  Seed: IAYPSLREAA (MAGA4_HUMAN)
IAYPSLREAF

SEQ ID NO: 65895 - protein, 10 aa, Artificial Sequence
  Description of Artificial Sequence: Synthetic peptide
  Seed: RQVPGSNPAR (MAGA4_HUMAN)
RNVPGSNPAY

SEQ ID NO: 65896 - protein, 9 aa, Artificial Sequence
  Description of Artificial Sequence: Synthetic peptide
  Seed: LVPGTLEEV (MAGA4_HUMAN)
LRPGTLEEV

SEQ ID NO: 65897 - protein, 9 aa, Artificial Sequence
  Description of Artificial Sequence: Synthetic peptide
  Seed: GDSASEEEI (MAGA4_HUMAN)
GESASEEEL

SEQ ID NO: 65898 - protein, 9 aa, Artificial Sequence
  Description of Artificial Sequence: Synthetic peptide
  Seed: GTLEEVPAA (MAGA4_HUMAN)
GLLEEVPAT

SEQ ID NO: 65899 - protein, 9 aa, Artificial Sequence
  Description of Artificial Sequence: Synthetic peptide
  Seed: RAKELVTKA (MAGA4_HUMAN)
RTKELVTKV

SEQ ID NO: 65900 - protein, 10 aa, Artificial Sequence
  Description of Artificial Sequence: Synthetic peptide
  Seed: SLFREALSNK (MAGA4_HUMAN)
SAFREALSNK

SEQ ID NO: 65901 - protein, 11 aa, Artificial Sequence
  Description of Artificial Sequence: Synthetic peptide
  Seed: VIFGKASESLK (MAGA4_HUMAN)
VMFGKASESLK

SEQ ID NO: 65902 - protein, 9 aa, Artificial Sequence
  Description of Artificial Sequence: Synthetic peptide
  Seed: KNYKRCFPV (MAGA4_HUMAN)
KVYKRCFPA

SEQ ID NO: 65903 - protein, 10 aa, Artificial Sequence
  Description of Artificial Sequence: Synthetic peptide
  Seed: VDPASNTYTL (MAGA4_HUMAN)
VYPASNTYTM

SEQ ID NO: 65904 - protein, 9 aa, Artificial Sequence
  Description of Artificial Sequence: Synthetic peptide
  Seed: GLLGNNQIF (MAGA4_HUMAN)
GMLGNNQIY

SEQ ID NO: 65905 - protein, 10 aa, Artificial Sequence
  Description of Artificial Sequence: Synthetic peptide
  Seed: KASESLKMIF (MAGA4_HUMAN)
KQSESLKMIF

SEQ ID NO: 65906 - protein, 9 aa, Artificial Sequence
  Description of Artificial Sequence: Synthetic peptide
  Seed: SSPLVPGTL (MAGA4_HUMAN)
STPLVPGTI

SEQ ID NO: 65907 - protein, 9 aa, Artificial Sequence
  Description of Artificial Sequence: Synthetic peptide
  Seed: EVDPASNTY (MAGA4_HUMAN)
EFDPASNTV

SEQ ID NO: 65908 - protein, 9 aa, Artificial Sequence
  Description of Artificial Sequence: Synthetic peptide
  Seed: RAKELVTKA (MAGA4_HUMAN)
RAKELVTKL

SEQ ID NO: 65909 - protein, 9 aa, Artificial Sequence
  Description of Artificial Sequence: Synthetic peptide
  Seed: VYGEPRKLL (MAGA4_HUMAN)
VSGEPRKLM

SEQ ID NO: 65910 - protein, 9 aa, Artificial Sequence
  Description of Artificial Sequence: Synthetic peptide
  Seed: DPASNTYTL (MAGA4_HUMAN)
DAASNTYTY

SEQ ID NO: 65911 - protein, 10 aa, Artificial Sequence
  Description of Artificial Sequence: Synthetic peptide
  Seed: KYRAKELVTK (MAGA4_HUMAN)
KIRAKELVTR

SEQ ID NO: 65912 - protein, 9 aa, Artificial Sequence
  Description of Artificial Sequence: Synthetic peptide
  Seed: RVRIAYPSL (MAGA4_HUMAN)
RMRIAYPSI

SEQ ID NO: 65913 - protein, 9 aa, Artificial Sequence
  Description of Artificial Sequence: Synthetic peptide
  Seed: YPSLREAAL (MAGA4_HUMAN)
YASLREAAF

SEQ ID NO: 65914 - protein, 9 aa, Artificial Sequence
  Description of Artificial Sequence: Synthetic peptide
  Seed: KYRAKELVT (MAGA4_HUMAN)
KMRAKELVK

SEQ ID NO: 65915 - protein, 9 aa, Artificial Sequence
  Description of Artificial Sequence: Synthetic peptide
  Seed: RKYRAKELV (MAGA4_HUMAN)
RRYRAKELL

SEQ ID NO: 65916 - protein, 10 aa, Artificial Sequence
  Description of Artificial Sequence: Synthetic peptide
  Seed: RVNARVRIAY (MAGA4_HUMAN)
RSNARVRIAA

SEQ ID NO: 65917 - protein, 9 aa, Artificial Sequence
  Description of Artificial Sequence: Synthetic peptide
  Seed: LRKYRAKEL (MAGA4_HUMAN)
LIKYRAKEM

SEQ ID NO: 65918 - protein, 10 aa, Artificial Sequence
  Description of Artificial Sequence: Synthetic peptide
  Seed: GVYDGREHTV (MAGA4_HUMAN)
GLYDGREHTF

SEQ ID NO: 65919 - protein, 9 aa, Artificial Sequence
  Description of Artificial Sequence: Synthetic peptide
  Seed: TVYGEPRKL (MAGA4_HUMAN)
TIYGEPRKV

SEQ ID NO: 65920 - protein, 9 aa, Artificial Sequence
  Description of Artificial Sequence: Synthetic peptide
  Seed: YKRCFPVIF (MAGA4_HUMAN)
YERCFPVIM

SEQ ID NO: 65921 - protein, 10 aa, Artificial Sequence
  Description of Artificial Sequence: Synthetic peptide
  Seed: TTISFTCWRQ (MAGA4_HUMAN)
TVISFTCWRR

SEQ ID NO: 65922 - protein, 10 aa, Artificial Sequence
  Description of Artificial Sequence: Synthetic peptide
  Seed: VDPASNTYTL (MAGA4_HUMAN)
VPPASNTYTL

SEQ ID NO: 65923 - protein, 11 aa, Artificial Sequence
  Description of Artificial Sequence: Synthetic peptide
  Seed: SASEEEIWEEL (MAGA4_HUMAN)
SQSEEEIWEEF

SEQ ID NO: 65924 - protein, 9 aa, Artificial Sequence
  Description of Artificial Sequence: Synthetic peptide
  Seed: KVLEHVVRV (MAGA4_HUMAN)
KLLEHVVRS

SEQ ID NO: 65925 - protein, 9 aa, Artificial Sequence
  Description of Artificial Sequence: Synthetic peptide
  Seed: KASESLKMI (MAGA4_HUMAN)
KMSESLKMW

SEQ ID NO: 65926 - protein, 11 aa, Artificial Sequence
  Description of Artificial Sequence: Synthetic peptide
  Seed: IAYPSLREAAL (MAGA4_HUMAN)
ISYPSLREAAM

SEQ ID NO: 65927 - protein, 9 aa, Artificial Sequence
  Description of Artificial Sequence: Synthetic peptide
  Seed: VYDGREHTV (MAGA4_HUMAN)
VSDGREHTA

SEQ ID NO: 65928 - protein, 9 aa, Artificial Sequence
  Description of Artificial Sequence: Synthetic peptide
  Seed: SALPTTISF (MAGA4_HUMAN)
SPLPTTISV

SEQ ID NO: 65929 - protein, 9 aa, Artificial Sequence
  Description of Artificial Sequence: Synthetic peptide
  Seed: VYDGREHTV (MAGA4_HUMAN)
VLDGREHTF

SEQ ID NO: 65930 - protein, 8 aa, Artificial Sequence
  Description of Artificial Sequence: Synthetic peptide
  Seed: REALSNKV (MAGA4_HUMAN)
REALSNKL

SEQ ID NO: 65931 - protein, 11 aa, Artificial Sequence
  Description of Artificial Sequence: Synthetic peptide
  Seed: VIFGKASESLK (MAGA4_HUMAN)
VTFGKASESLK

SEQ ID NO: 65932 - protein, 10 aa, Artificial Sequence
  Description of Artificial Sequence: Synthetic peptide
  Seed: YRQVPGSNPA (MAGA4_HUMAN)
YPQVPGSNPL

SEQ ID NO: 65933 - protein, 9 aa, Artificial Sequence
  Description of Artificial Sequence: Synthetic peptide
  Seed: DGLLGNNQI (MAGA4_HUMAN)
DALLGNNQI

SEQ ID NO: 65934 - protein, 10 aa, Artificial Sequence
  Description of Artificial Sequence: Synthetic peptide
  Seed: KYRAKELVTK (MAGA4_HUMAN)
KTRAKELVTL

SEQ ID NO: 65935 - protein, 9 aa, Artificial Sequence
  Description of Artificial Sequence: Synthetic peptide
  Seed: DELAHFLLR (MAGA4_HUMAN)
DCLAHFLLR

SEQ ID NO: 65936 - protein, 9 aa, Artificial Sequence
  Description of Artificial Sequence: Synthetic peptide
  Seed: KVDELAHFL (MAGA4_HUMAN)
KADELAHFY

SEQ ID NO: 65937 - protein, 10 aa, Artificial Sequence
  Description of Artificial Sequence: Synthetic peptide
  Seed: KYRAKELVTK (MAGA4_HUMAN)
KMRAKELVTK

SEQ ID NO: 65938 - protein, 11 aa, Artificial Sequence
  Description of Artificial Sequence: Synthetic peptide
  Seed: RVRIAYPSLRE (MAGA4_HUMAN)
RFRIAYPSLRA

SEQ ID NO: 65939 - protein, 10 aa, Artificial Sequence
  Description of Artificial Sequence: Synthetic peptide
  Seed: RVRIAYPSLR (MAGA4_HUMAN)
RARIAYPSLT

SEQ ID NO: 65940 - protein, 11 aa, Artificial Sequence
  Description of Artificial Sequence: Synthetic peptide
  Seed: RQVPGSNPARY (MAGA4_HUMAN)
RTVPGSNPARF

SEQ ID NO: 65941 - protein, 9 aa, Artificial Sequence
  Description of Artificial Sequence: Synthetic peptide
  Seed: SPLVPGTLE (MAGA4_HUMAN)
SPLVPGTLL

SEQ ID NO: 65942 - protein, 9 aa, Artificial Sequence
  Description of Artificial Sequence: Synthetic peptide
  Seed: IIVLGTIAM (MAGA4_HUMAN)
IQVLGTIAH

SEQ ID NO: 65943 - protein, 9 aa, Artificial Sequence
  Description of Artificial Sequence: Synthetic peptide
  Seed: KNYKRCFPV (MAGA4_HUMAN)
KTYKRCFPL

SEQ ID NO: 65944 - protein, 9 aa, Artificial Sequence
  Description of Artificial Sequence: Synthetic peptide
  Seed: RVRIAYPSL (MAGA4_HUMAN)
RIRIAYPSH

SEQ ID NO: 65945 - protein, 9 aa, Artificial Sequence
  Description of Artificial Sequence: Synthetic peptide
  Seed: VNARVRIAY (MAGA4_HUMAN)
VVARVRIAY

SEQ ID NO: 65946 - protein, 9 aa, Artificial Sequence
  Description of Artificial Sequence: Synthetic peptide
  Seed: RVRIAYPSL (MAGA4_HUMAN)
RMRIAYPSE

SEQ ID NO: 65947 - protein, 9 aa, Artificial Sequence
  Description of Artificial Sequence: Synthetic peptide
  Seed: GASALPTTI (MAGA4_HUMAN)
GMSALPTTA

SEQ ID NO: 65948 - protein, 9 aa, Artificial Sequence
  Description of Artificial Sequence: Synthetic peptide
  Seed: RVRIAYPSL (MAGA4_HUMAN)
RKRIAYPSK

SEQ ID NO: 65949 - protein, 11 aa, Artificial Sequence
  Description of Artificial Sequence: Synthetic peptide
  Seed: MEGDSASEEEI (MAGA4_HUMAN)
MQGDSASEEEW

SEQ ID NO: 65950 - protein, 8 aa, Artificial Sequence
  Description of Artificial Sequence: Synthetic peptide
  Seed: AESLFREA (MAGA4_HUMAN)
AESLFREM

SEQ ID NO: 65951 - protein, 9 aa, Artificial Sequence
  Description of Artificial Sequence: Synthetic peptide
  Seed: RAKELVTKA (MAGA4_HUMAN)
RPKELVTKA

SEQ ID NO: 65952 - protein, 10 aa, Artificial Sequence
  Description of Artificial Sequence: Synthetic peptide
  Seed: IAYPSLREAA (MAGA4_HUMAN)
IAYPSLREAM

SEQ ID NO: 65953 - protein, 10 aa, Artificial Sequence
  Description of Artificial Sequence: Synthetic peptide
  Seed: TSYVKVLEHV (MAGA4_HUMAN)
TYYVKVLEHW

SEQ ID NO: 65954 - protein, 9 aa, Artificial Sequence
  Description of Artificial Sequence: Synthetic peptide
  Seed: SEEEIWEEL (MAGA4_HUMAN)
SQEEIWEEI

SEQ ID NO: 65955 - protein, 9 aa, Artificial Sequence
  Description of Artificial Sequence: Synthetic peptide
  Seed: YKRCFPVIF (MAGA4_HUMAN)
YVRCFPVIF

SEQ ID NO: 65956 - protein, 9 aa, Artificial Sequence
  Description of Artificial Sequence: Synthetic peptide
  Seed: RKYRAKELV (MAGA4_HUMAN)
RAYRAKELY

SEQ ID NO: 65957 - protein, 10 aa, Artificial Sequence
  Description of Artificial Sequence: Synthetic peptide
  Seed: ASALPTTISF (MAGA4_HUMAN)
AIALPTTISW

SEQ ID NO: 65958 - protein, 10 aa, Artificial Sequence
  Description of Artificial Sequence: Synthetic peptide
  Seed: DPASNTYTLV (MAGA4_HUMAN)
DTASNTYTLL

SEQ ID NO: 65959 - protein, 9 aa, Artificial Sequence
  Description of Artificial Sequence: Synthetic peptide
  Seed: NYKRCFPVI (MAGA4_HUMAN)
NWKRCFPVF

SEQ ID NO: 65960 - protein, 10 aa, Artificial Sequence
  Description of Artificial Sequence: Synthetic peptide
  Seed: RVRIAYPSLR (MAGA4_HUMAN)
RNRIAYPSLV

SEQ ID NO: 65961 - protein, 9 aa, Artificial Sequence
  Description of Artificial Sequence: Synthetic peptide
  Seed: STSPDAESL (MAGA4_HUMAN)
SYSPDAESL

SEQ ID NO: 65962 - protein, 9 aa, Artificial Sequence
  Description of Artificial Sequence: Synthetic peptide
  Seed: LAHFLLRKY (MAGA4_HUMAN)
LMHFLLRKF

SEQ ID NO: 65963 - protein, 10 aa, Artificial Sequence
  Description of Artificial Sequence: Synthetic peptide
  Seed: KVLEHVVRVN (MAGA4_HUMAN)
KMLEHVVRVA

SEQ ID NO: 65964 - protein, 10 aa, Artificial Sequence
  Description of Artificial Sequence: Synthetic peptide
  Seed: GPPQSPQGAS (MAGA4_HUMAN)
GPPQSPQGAA

SEQ ID NO: 65965 - protein, 9 aa, Artificial Sequence
  Description of Artificial Sequence: Synthetic peptide
  Seed: QIFPKTGLL (MAGA4_HUMAN)
QMFPKTGLV

SEQ ID NO: 65966 - protein, 10 aa, Artificial Sequence
  Description of Artificial Sequence: Synthetic peptide
  Seed: KASESLKMIF (MAGA4_HUMAN)
KKSESLKMIF

SEQ ID NO: 65967 - protein, 10 aa, Artificial Sequence
  Description of Artificial Sequence: Synthetic peptide
  Seed: ELAHFLLRKY (MAGA4_HUMAN)
EVAHFLLRKY

SEQ ID NO: 65968 - protein, 10 aa, Artificial Sequence
  Description of Artificial Sequence: Synthetic peptide
  Seed: MLERVIKNYK (MAGA4_HUMAN)
MYERVIKNYK

SEQ ID NO: 65969 - protein, 9 aa, Artificial Sequence
  Description of Artificial Sequence: Synthetic peptide
  Seed: SALPTTISF (MAGA4_HUMAN)
SPLPTTISS

SEQ ID NO: 65970 - protein, 10 aa, Artificial Sequence
  Description of Artificial Sequence: Synthetic peptide
  Seed: KYRAKELVTK (MAGA4_HUMAN)
KFRAKELVTK

SEQ ID NO: 65971 - protein, 10 aa, Artificial Sequence
  Description of Artificial Sequence: Synthetic peptide
  Seed: LPTTISFTCW (MAGA4_HUMAN)
LITTISFTCW

SEQ ID NO: 65972 - protein, 9 aa, Artificial Sequence
  Description of Artificial Sequence: Synthetic peptide
  Seed: RAKELVTKA (MAGA4_HUMAN)
RMKELVTKI

SEQ ID NO: 65973 - protein, 9 aa, Artificial Sequence
  Description of Artificial Sequence: Synthetic peptide
  Seed: IAYPSLREA (MAGA4_HUMAN)
IIYPSLREV

SEQ ID NO: 65974 - protein, 10 aa, Artificial Sequence
  Description of Artificial Sequence: Synthetic peptide
  Seed: RQVPGSNPAR (MAGA4_HUMAN)
RAVPGSNPAY

SEQ ID NO: 65975 - protein, 9 aa, Artificial Sequence
  Description of Artificial Sequence: Synthetic peptide
  Seed: WVQENYLEY (MAGA4_HUMAN)
WQQENYLEY

SEQ ID NO: 65976 - protein, 11 aa, Artificial Sequence
  Description of Artificial Sequence: Synthetic peptide
  Seed: GVYDGREHTVY (MAGA4_HUMAN)
GMYDGREHTVY

SEQ ID NO: 65977 - protein, 9 aa, Artificial Sequence
  Description of Artificial Sequence: Synthetic peptide
  Seed: YDGREHTVY (MAGA4_HUMAN)
YLGREHTVY

SEQ ID NO: 65978 - protein, 9 aa, Artificial Sequence
  Description of Artificial Sequence: Synthetic peptide
  Seed: RQVPGSNPA (MAGA4_HUMAN)
RTVPGSNPY

SEQ ID NO: 65979 - protein, 9 aa, Artificial Sequence
  Description of Artificial Sequence: Synthetic peptide
  Seed: LGNNQIFPK (MAGA4_HUMAN)
LQNNQIFPK

SEQ ID NO: 65980 - protein, 10 aa, Artificial Sequence
  Description of Artificial Sequence: Synthetic peptide
  Seed: NKVDELAHFL (MAGA4_HUMAN)
NHVDELAHFI

SEQ ID NO: 65981 - protein, 10 aa, Artificial Sequence
  Description of Artificial Sequence: Synthetic peptide
  Seed: ESAGPPQSPQ (MAGA4_HUMAN)
EGAGPPQSPR

SEQ ID NO: 65982 - protein, 10 aa, Artificial Sequence
  Description of Artificial Sequence: Synthetic peptide
  Seed: RQVPGSNPAR (MAGA4_HUMAN)
RMVPGSNPAM

SEQ ID NO: 65983 - protein, 9 aa, Artificial Sequence
  Description of Artificial Sequence: Synthetic peptide
  Seed: RCFPVIFGK (MAGA4_HUMAN)
RHFPVIFGR

SEQ ID NO: 65984 - protein, 9 aa, Artificial Sequence
  Description of Artificial Sequence: Synthetic peptide
  Seed: IFPKTGLLI (MAGA4_HUMAN)
IAPKTGLLY

SEQ ID NO: 65985 - protein, 9 aa, Artificial Sequence
  Description of Artificial Sequence: Synthetic peptide
  Seed: LVPGTLEEV (MAGA4_HUMAN)
LGPGTLEEM

SEQ ID NO: 65986 - protein, 9 aa, Artificial Sequence
  Description of Artificial Sequence: Synthetic peptide
  Seed: IFPKTGLLI (MAGA4_HUMAN)
IYPKTGLLY

SEQ ID NO: 65987 - protein, 9 aa, Artificial Sequence
  Description of Artificial Sequence: Synthetic peptide
  Seed: KYRAKELVT (MAGA4_HUMAN)
KMRAKELVY

SEQ ID NO: 65988 - protein, 9 aa, Artificial Sequence
  Description of Artificial Sequence: Synthetic peptide
  Seed: RVRIAYPSL (MAGA4_HUMAN)
RSRIAYPSS

SEQ ID NO: 65989 - protein, 9 aa, Artificial Sequence
  Description of Artificial Sequence: Synthetic peptide
  Seed: KVDELAHFL (MAGA4_HUMAN)
KVDELAHFA

SEQ ID NO: 65990 - protein, 9 aa, Artificial Sequence
  Description of Artificial Sequence: Synthetic peptide
  Seed: NTYTLVTCL (MAGA4_HUMAN)
NMYTLVTCV

SEQ ID NO: 65991 - protein, 8 aa, Artificial Sequence
  Description of Artificial Sequence: Synthetic peptide
  Seed: KASESLKM (MAGA4_HUMAN)
KSSESLKW

SEQ ID NO: 65992 - protein, 9 aa, Artificial Sequence
  Description of Artificial Sequence: Synthetic peptide
  Seed: VDELAHFLL (MAGA4_HUMAN)
VEELAHFLL

SEQ ID NO: 65993 - protein, 9 aa, Artificial Sequence
  Description of Artificial Sequence: Synthetic peptide
  Seed: LPTTISFTC (MAGA4_HUMAN)
LPTTISFTA

SEQ ID NO: 65994 - protein, 11 aa, Artificial Sequence
  Description of Artificial Sequence: Synthetic peptide
  Seed: ELGVMGVYDGR (MAGA4_HUMAN)
EQGVMGVYDGR

SEQ ID NO: 65995 - protein, 9 aa, Artificial Sequence
  Description of Artificial Sequence: Synthetic peptide
  Seed: NKVDELAHF (MAGA4_HUMAN)
NRVDELAHM

SEQ ID NO: 65996 - protein, 10 aa, Artificial Sequence
  Description of Artificial Sequence: Synthetic peptide
  Seed: ARVRIAYPSL (MAGA4_HUMAN)
ACVRIAYPSA

SEQ ID NO: 65997 - protein, 9 aa, Artificial Sequence
  Description of Artificial Sequence: Synthetic peptide
  Seed: RVRIAYPSL (MAGA4_HUMAN)
RSRIAYPSH

SEQ ID NO: 65998 - protein, 10 aa, Artificial Sequence
  Description of Artificial Sequence: Synthetic peptide
  Seed: RVRIAYPSLR (MAGA4_HUMAN)
RWRIAYPSLY

SEQ ID NO: 65999 - protein, 9 aa, Artificial Sequence
  Description of Artificial Sequence: Synthetic peptide
  Seed: GSNPARYEF (MAGA4_HUMAN)
GRNPARYEL

SEQ ID NO: 66000 - protein, 9 aa, Artificial Sequence
  Description of Artificial Sequence: Synthetic peptide
  Seed: EEIWEELGV (MAGA4_HUMAN)
EEIWEELGA

SEQ ID NO: 66001 - protein, 9 aa, Artificial Sequence
  Description of Artificial Sequence: Synthetic peptide
  Seed: SEEEIWEEL (MAGA4_HUMAN)
SMEEIWEEY

SEQ ID NO: 66002 - protein, 11 aa, Artificial Sequence
  Description of Artificial Sequence: Synthetic peptide
  Seed: NARVRIAYPSL (MAGA4_HUMAN)
NMRVRIAYPSL

SEQ ID NO: 66003 - protein, 10 aa, Artificial Sequence
  Description of Artificial Sequence: Synthetic peptide
  Seed: YRQVPGSNPA (MAGA4_HUMAN)
YPQVPGSNPF

SEQ ID NO: 66004 - protein, 10 aa, Artificial Sequence
  Description of Artificial Sequence: Synthetic peptide
  Seed: RVNARVRIAY (MAGA4_HUMAN)
RKNARVRIAF

SEQ ID NO: 66005 - protein, 9 aa, Artificial Sequence
  Description of Artificial Sequence: Synthetic peptide
  Seed: ALSNKVDEL (MAGA4_HUMAN)
AMSNKVDEY

SEQ ID NO: 66006 - protein, 9 aa, Artificial Sequence
  Description of Artificial Sequence: Synthetic peptide
  Seed: EVDPASNTY (MAGA4_HUMAN)
EADPASNTF

SEQ ID NO: 66007 - protein, 10 aa, Artificial Sequence
  Description of Artificial Sequence: Synthetic peptide
  Seed: FGKASESLKM (MAGA4_HUMAN)
FHKASESLKY

SEQ ID NO: 66008 - protein, 9 aa, Artificial Sequence
  Description of Artificial Sequence: Synthetic peptide
  Seed: GSNPARYEF (MAGA4_HUMAN)
GLNPARYEY

SEQ ID NO: 66009 - protein, 10 aa, Artificial Sequence
  Description of Artificial Sequence: Synthetic peptide
  Seed: KVDELAHFLL (MAGA4_HUMAN)
KLDELAHFLT

SEQ ID NO: 66010 - protein, 10 aa, Artificial Sequence
  Description of Artificial Sequence: Synthetic peptide
  Seed: EMLERVIKNY (MAGA4_HUMAN)
ETLERVIKNY

SEQ ID NO: 66011 - protein, 11 aa, Artificial Sequence
  Description of Artificial Sequence: Synthetic peptide
  Seed: SPQGASALPTT (MAGA4_HUMAN)
SPQGASALPTA

SEQ ID NO: 66012 - protein, 10 aa, Artificial Sequence
  Description of Artificial Sequence: Synthetic peptide
  Seed: LIIVLGTIAM (MAGA4_HUMAN)
LLIVLGTIAY

SEQ ID NO: 66013 - protein, 9 aa, Artificial Sequence
  Description of Artificial Sequence: Synthetic peptide
  Seed: SQEEEGPST (MAGA4_HUMAN)
SEEEEGPSM

SEQ ID NO: 66014 - protein, 9 aa, Artificial Sequence
  Description of Artificial Sequence: Synthetic peptide
  Seed: KVDELAHFL (MAGA4_HUMAN)
KLDELAHFT

SEQ ID NO: 66015 - protein, 9 aa, Artificial Sequence
  Description of Artificial Sequence: Synthetic peptide
  Seed: ESLKMIFGI (MAGA4_HUMAN)
ELLKMIFGV

SEQ ID NO: 66016 - protein, 9 aa, Artificial Sequence
  Description of Artificial Sequence: Synthetic peptide
  Seed: REAALLEEE (MAGA4_HUMAN)
REAALLEEA

SEQ ID NO: 66017 - protein, 10 aa, Artificial Sequence
  Description of Artificial Sequence: Synthetic peptide
  Seed: KVDELAHFLL (MAGA4_HUMAN)
KIDELAHFLI

SEQ ID NO: 66018 - protein, 9 aa, Artificial Sequence
  Description of Artificial Sequence: Synthetic peptide
  Seed: DPASNTYTL (MAGA4_HUMAN)
DAASNTYTW

SEQ ID NO: 66019 - protein, 10 aa, Artificial Sequence
  Description of Artificial Sequence: Synthetic peptide
  Seed: ARVRIAYPSL (MAGA4_HUMAN)
ASVRIAYPSK

SEQ ID NO: 66020 - protein, 9 aa, Artificial Sequence
  Description of Artificial Sequence: Synthetic peptide
  Seed: VYDGREHTV (MAGA4_HUMAN)
VGDGREHTF

SEQ ID NO: 66021 - protein, 9 aa, Artificial Sequence
  Description of Artificial Sequence: Synthetic peptide
  Seed: TQDWVQENY (MAGA4_HUMAN)
TVDWVQENV

SEQ ID NO: 66022 - protein, 10 aa, Artificial Sequence
  Description of Artificial Sequence: Synthetic peptide
  Seed: REAALLEEEE (MAGA4_HUMAN)
REAALLEEEC

SEQ ID NO: 66023 - protein, 9 aa, Artificial Sequence
  Description of Artificial Sequence: Synthetic peptide
  Seed: IIVLGTIAM (MAGA4_HUMAN)
IQVLGTIAY

SEQ ID NO: 66024 - protein, 10 aa, Artificial Sequence
  Description of Artificial Sequence: Synthetic peptide
  Seed: YPSLREAALL (MAGA4_HUMAN)
YWSLREAALF

SEQ ID NO: 66025 - protein, 11 aa, Artificial Sequence
  Description of Artificial Sequence: Synthetic peptide
  Seed: RQVPGSNPARY (MAGA4_HUMAN)
RMVPGSNPARM

SEQ ID NO: 66026 - protein, 9 aa, Artificial Sequence
  Description of Artificial Sequence: Synthetic peptide
  Seed: SEEEIWEEL (MAGA4_HUMAN)
SYEEIWEEM

SEQ ID NO: 66027 - protein, 10 aa, Artificial Sequence
  Description of Artificial Sequence: Synthetic peptide
  Seed: ARVRIAYPSL (MAGA4_HUMAN)
AVVRIAYPSK

SEQ ID NO: 66028 - protein, 10 aa, Artificial Sequence
  Description of Artificial Sequence: Synthetic peptide
  Seed: AYPSLREAAL (MAGA4_HUMAN)
ADPSLREAAM

SEQ ID NO: 66029 - protein, 11 aa, Artificial Sequence
  Description of Artificial Sequence: Synthetic peptide
  Seed: RVRIAYPSLRE (MAGA4_HUMAN)
RSRIAYPSLRA

SEQ ID NO: 66030 - protein, 9 aa, Artificial Sequence
  Description of Artificial Sequence: Synthetic peptide
  Seed: DELAHFLLR (MAGA4_HUMAN)
DLLAHFLLK

SEQ ID NO: 66031 - protein, 11 aa, Artificial Sequence
  Description of Artificial Sequence: Synthetic peptide
  Seed: LPTTISFTCWR (MAGA4_HUMAN)
LMTTISFTCWR

SEQ ID NO: 66032 - protein, 9 aa, Artificial Sequence
  Description of Artificial Sequence: Synthetic peptide
  Seed: TQDWVQENY (MAGA4_HUMAN)
TEDWVQENF

SEQ ID NO: 66033 - protein, 10 aa, Artificial Sequence
  Description of Artificial Sequence: Synthetic peptide
  Seed: TTISFTCWRQ (MAGA4_HUMAN)
TYISFTCWRK

SEQ ID NO: 66034 - protein, 9 aa, Artificial Sequence
  Description of Artificial Sequence: Synthetic peptide
  Seed: SSPLVPGTL (MAGA4_HUMAN)
SYPLVPGTF

SEQ ID NO: 66035 - protein, 9 aa, Artificial Sequence
  Description of Artificial Sequence: Synthetic peptide
  Seed: KYRAKELVT (MAGA4_HUMAN)
KLRAKELVK

SEQ ID NO: 66036 - protein, 8 aa, Artificial Sequence
  Description of Artificial Sequence: Synthetic peptide
  Seed: KVDELAHF (MAGA4_HUMAN)
KWDELAHL

SEQ ID NO: 66037 - protein, 11 aa, Artificial Sequence
  Description of Artificial Sequence: Synthetic peptide
  Seed: ELAHFLLRKYR (MAGA4_HUMAN)
EIAHFLLRKYR

SEQ ID NO: 66038 - protein, 9 aa, Artificial Sequence
  Description of Artificial Sequence: Synthetic peptide
  Seed: LKMIFGIDV (MAGA4_HUMAN)
LRMIFGIDY

SEQ ID NO: 66039 - protein, 9 aa, Artificial Sequence
  Description of Artificial Sequence: Synthetic peptide
  Seed: EHTVYGEPR (MAGA4_HUMAN)
EMTVYGEPR

SEQ ID NO: 66040 - protein, 9 aa, Artificial Sequence
  Description of Artificial Sequence: Synthetic peptide
  Seed: RQVPGSNPA (MAGA4_HUMAN)
RQVPGSNPV

SEQ ID NO: 66041 - protein, 9 aa, Artificial Sequence
  Description of Artificial Sequence: Synthetic peptide
  Seed: GASALPTTI (MAGA4_HUMAN)
GTSALPTTF

SEQ ID NO: 66042 - protein, 10 aa, Artificial Sequence
  Description of Artificial Sequence: Synthetic peptide
  Seed: KNYKRCFPVI (MAGA4_HUMAN)
KYYKRCFPVA

SEQ ID NO: 66043 - protein, 10 aa, Artificial Sequence
  Description of Artificial Sequence: Synthetic peptide
  Seed: ARVRIAYPSL (MAGA4_HUMAN)
AIVRIAYPSK

SEQ ID NO: 66044 - protein, 9 aa, Artificial Sequence
  Description of Artificial Sequence: Synthetic peptide
  Seed: LFREALSNK (MAGA4_HUMAN)
LMREALSNK

SEQ ID NO: 66045 - protein, 9 aa, Artificial Sequence
  Description of Artificial Sequence: Synthetic peptide
  Seed: VNARVRIAY (MAGA4_HUMAN)
VVARVRIAF

SEQ ID NO: 66046 - protein, 9 aa, Artificial Sequence
  Description of Artificial Sequence: Synthetic peptide
  Seed: SALPTTISF (MAGA4_HUMAN)
SYLPTTISY

SEQ ID NO: 66047 - protein, 10 aa, Artificial Sequence
  Description of Artificial Sequence: Synthetic peptide
  Seed: TSYVKVLEHV (MAGA4_HUMAN)
TIYVKVLEHV

SEQ ID NO: 66048 - protein, 9 aa, Artificial Sequence
  Description of Artificial Sequence: Synthetic peptide
  Seed: EVDPASNTY (MAGA4_HUMAN)
ELDPASNTL

SEQ ID NO: 66049 - protein, 10 aa, Artificial Sequence
  Description of Artificial Sequence: Synthetic peptide
  Seed: REAALLEEEE (MAGA4_HUMAN)
REAALLEEEV

SEQ ID NO: 66050 - protein, 9 aa, Artificial Sequence
  Description of Artificial Sequence: Synthetic peptide
  Seed: TQDWVQENY (MAGA4_HUMAN)
TVDWVQENM

SEQ ID NO: 66051 - protein, 10 aa, Artificial Sequence
  Description of Artificial Sequence: Synthetic peptide
  Seed: KVLEHVVRVN (MAGA4_HUMAN)
KMLEHVVRVS

SEQ ID NO: 66052 - protein, 10 aa, Artificial Sequence
  Description of Artificial Sequence: Synthetic peptide
  Seed: LPTTISFTCW (MAGA4_HUMAN)
LKTTISFTCW

SEQ ID NO: 66053 - protein, 10 aa, Artificial Sequence
  Description of Artificial Sequence: Synthetic peptide
  Seed: VVRVNARVRI (MAGA4_HUMAN)
VSRVNARVRK

SEQ ID NO: 66054 - protein, 10 aa, Artificial Sequence
  Description of Artificial Sequence: Synthetic peptide
  Seed: SSEQKSQHCK (MAGA4_HUMAN)
SVEQKSQHCY

SEQ ID NO: 66055 - protein, 9 aa, Artificial Sequence
  Description of Artificial Sequence: Synthetic peptide
  Seed: VYDGREHTV (MAGA4_HUMAN)
VWDGREHTI

SEQ ID NO: 66056 - protein, 10 aa, Artificial Sequence
  Description of Artificial Sequence: Synthetic peptide
  Seed: VIFGKASESL (MAGA4_HUMAN)
VLFGKASESI

SEQ ID NO: 66057 - protein, 9 aa, Artificial Sequence
  Description of Artificial Sequence: Synthetic peptide
  Seed: TVYGEPRKL (MAGA4_HUMAN)
TQYGEPRKV

SEQ ID NO: 66058 - protein, 9 aa, Artificial Sequence
  Description of Artificial Sequence: Synthetic peptide
  Seed: TVYGEPRKL (MAGA4_HUMAN)
TTYGEPRKI

SEQ ID NO: 66059 - protein, 10 aa, Artificial Sequence
  Description of Artificial Sequence: Synthetic peptide
  Seed: SSSPLVPGTL (MAGA4_HUMAN)
SMSPLVPGTI

SEQ ID NO: 66060 - protein, 10 aa, Artificial Sequence
  Description of Artificial Sequence: Synthetic peptide
  Seed: ARVRIAYPSL (MAGA4_HUMAN)
AGVRIAYPSK

SEQ ID NO: 66061 - protein, 9 aa, Artificial Sequence
  Description of Artificial Sequence: Synthetic peptide
  Seed: RAKELVTKA (MAGA4_HUMAN)
RTKELVTKT

SEQ ID NO: 66062 - protein, 10 aa, Artificial Sequence
  Description of Artificial Sequence: Synthetic peptide
  Seed: EAAVSSSSPL (MAGA4_HUMAN)
ECAVSSSSPV

SEQ ID NO: 66063 - protein, 9 aa, Artificial Sequence
  Description of Artificial Sequence: Synthetic peptide
  Seed: WVQENYLEY (MAGA4_HUMAN)
WYQENYLEM

SEQ ID NO: 66064 - protein, 9 aa, Artificial Sequence
  Description of Artificial Sequence: Synthetic peptide
  Seed: VYGEPRKLL (MAGA4_HUMAN)
VRGEPRKLF

SEQ ID NO: 66065 - protein, 9 aa, Artificial Sequence
  Description of Artificial Sequence: Synthetic peptide
  Seed: GASALPTTI (MAGA4_HUMAN)
GMSALPTTY

SEQ ID NO: 66066 - protein, 10 aa, Artificial Sequence
  Description of Artificial Sequence: Synthetic peptide
  Seed: TSYVKVLEHV (MAGA4_HUMAN)
TEYVKVLEHL

SEQ ID NO: 66067 - protein, 10 aa, Artificial Sequence
  Description of Artificial Sequence: Synthetic peptide
  Seed: GVYDGREHTV (MAGA4_HUMAN)
GRYDGREHTF

SEQ ID NO: 66068 - protein, 10 aa, Artificial Sequence
  Description of Artificial Sequence: Synthetic peptide
  Seed: TSPDAESLFR (MAGA4_HUMAN)
TLPDAESLFY

SEQ ID NO: 66069 - protein, 9 aa, Artificial Sequence
  Description of Artificial Sequence: Synthetic peptide
  Seed: STSPDAESL (MAGA4_HUMAN)
SASPDAESI

SEQ ID NO: 66070 - protein, 9 aa, Artificial Sequence
  Description of Artificial Sequence: Synthetic peptide
  Seed: ALSNKVDEL (MAGA4_HUMAN)
ALSNKVDEM

SEQ ID NO: 66071 - protein, 9 aa, Artificial Sequence
  Description of Artificial Sequence: Synthetic peptide
  Seed: YKRCFPVIF (MAGA4_HUMAN)
YQRCFPVIY

SEQ ID NO: 66072 - protein, 10 aa, Artificial Sequence
  Description of Artificial Sequence: Synthetic peptide
  Seed: QIFPKTGLLI (MAGA4_HUMAN)
QEFPKTGLLF

SEQ ID NO: 66073 - protein, 9 aa, Artificial Sequence
  Description of Artificial Sequence: Synthetic peptide
  Seed: SALPTTISF (MAGA4_HUMAN)
SQLPTTISH

SEQ ID NO: 66074 - protein, 9 aa, Artificial Sequence
  Description of Artificial Sequence: Synthetic peptide
  Seed: IAYPSLREA (MAGA4_HUMAN)
IMYPSLREV

SEQ ID NO: 66075 - protein, 10 aa, Artificial Sequence
  Description of Artificial Sequence: Synthetic peptide
  Seed: VIFGKASESL (MAGA4_HUMAN)
VVFGKASESL

SEQ ID NO: 66076 - protein, 9 aa, Artificial Sequence
  Description of Artificial Sequence: Synthetic peptide
  Seed: RCFPVIFGK (MAGA4_HUMAN)
RFFPVIFGK

SEQ ID NO: 66077 - protein, 10 aa, Artificial Sequence
  Description of Artificial Sequence: Synthetic peptide
  Seed: KYRAKELVTK (MAGA4_HUMAN)
KTRAKELVTV

SEQ ID NO: 66078 - protein, 10 aa, Artificial Sequence
  Description of Artificial Sequence: Synthetic peptide
  Seed: GVYDGREHTV (MAGA4_HUMAN)
GTYDGREHTM

SEQ ID NO: 66079 - protein, 10 aa, Artificial Sequence
  Description of Artificial Sequence: Synthetic peptide
  Seed: RVNARVRIAY (MAGA4_HUMAN)
RLNARVRIAF

SEQ ID NO: 66080 - protein, 9 aa, Artificial Sequence
  Description of Artificial Sequence: Synthetic peptide
  Seed: IAYPSLREA (MAGA4_HUMAN)
IAYPSLREY

SEQ ID NO: 66081 - protein, 9 aa, Artificial Sequence
  Description of Artificial Sequence: Synthetic peptide
  Seed: HTVYGEPRK (MAGA4_HUMAN)
HAVYGEPRR

SEQ ID NO: 66082 - protein, 9 aa, Artificial Sequence
  Description of Artificial Sequence: Synthetic peptide
  Seed: GVMGVYDGR (MAGA4_HUMAN)
GIMGVYDGK

SEQ ID NO: 66083 - protein, 9 aa, Artificial Sequence
  Description of Artificial Sequence: Synthetic peptide
  Seed: IFPKTGLLI (MAGA4_HUMAN)
IFPKTGLLF

SEQ ID NO: 66084 - protein, 9 aa, Artificial Sequence
  Description of Artificial Sequence: Synthetic peptide
  Seed: VVRVNARVR (MAGA4_HUMAN)
VLRVNARVK

SEQ ID NO: 66085 - protein, 9 aa, Artificial Sequence
  Description of Artificial Sequence: Synthetic peptide
  Seed: SSSPLVPGT (MAGA4_HUMAN)
SQSPLVPGI

SEQ ID NO: 66086 - protein, 9 aa, Artificial Sequence
  Description of Artificial Sequence: Synthetic peptide
  Seed: LVPGTLEEV (MAGA4_HUMAN)
LVPGTLEEL

SEQ ID NO: 66087 - protein, 9 aa, Artificial Sequence
  Description of Artificial Sequence: Synthetic peptide
  Seed: YKRCFPVIF (MAGA4_HUMAN)
YMRCFPVIH

SEQ ID NO: 66088 - protein, 10 aa, Artificial Sequence
  Description of Artificial Sequence: Synthetic peptide
  Seed: SSEQKSQHCK (MAGA4_HUMAN)
SIEQKSQHCY

SEQ ID NO: 66089 - protein, 10 aa, Artificial Sequence
  Description of Artificial Sequence: Synthetic peptide
  Seed: LLGNNQIFPK (MAGA4_HUMAN)
LMGNNQIFPK

SEQ ID NO: 66090 - protein, 9 aa, Artificial Sequence
  Description of Artificial Sequence: Synthetic peptide
  Seed: ELAHFLLRK (MAGA4_HUMAN)
ESAHFLLRR

SEQ ID NO: 66091 - protein, 11 aa, Artificial Sequence
  Description of Artificial Sequence: Synthetic peptide
  Seed: EVDPASNTYTL (MAGA4_HUMAN)
ETDPASNTYTV

SEQ ID NO: 66092 - protein, 9 aa, Artificial Sequence
  Description of Artificial Sequence: Synthetic peptide
  Seed: IAYPSLREA (MAGA4_HUMAN)
IAYPSLREH

SEQ ID NO: 66093 - protein, 9 aa, Artificial Sequence
  Description of Artificial Sequence: Synthetic peptide
  Seed: AAVSSSSPL (MAGA4_HUMAN)
ANVSSSSPF

SEQ ID NO: 66094 - protein, 9 aa, Artificial Sequence
  Description of Artificial Sequence: Synthetic peptide
  Seed: LRKYRAKEL (MAGA4_HUMAN)
LMKYRAKEV

SEQ ID NO: 66095 - protein, 9 aa, Artificial Sequence
  Description of Artificial Sequence: Synthetic peptide
  Seed: RVRIAYPSL (MAGA4_HUMAN)
RLRIAYPSF

SEQ ID NO: 66096 - protein, 9 aa, Artificial Sequence
  Description of Artificial Sequence: Synthetic peptide
  Seed: AAVSSSSPL (MAGA4_HUMAN)
AMVSSSSPH

SEQ ID NO: 66097 - protein, 10 aa, Artificial Sequence
  Description of Artificial Sequence: Synthetic peptide
  Seed: RVRIAYPSLR (MAGA4_HUMAN)
RLRIAYPSLV

SEQ ID NO: 66098 - protein, 10 aa, Artificial Sequence
  Description of Artificial Sequence: Synthetic peptide
  Seed: RVRIAYPSLR (MAGA4_HUMAN)
RARIAYPSLV

SEQ ID NO: 66099 - protein, 10 aa, Artificial Sequence
  Description of Artificial Sequence: Synthetic peptide
  Seed: VKVLEHVVRV (MAGA4_HUMAN)
VMVLEHVVRA

SEQ ID NO: 66100 - protein, 9 aa, Artificial Sequence
  Description of Artificial Sequence: Synthetic peptide
  Seed: QIFPKTGLL (MAGA4_HUMAN)
QVFPKTGLR

SEQ ID NO: 66101 - protein, 11 aa, Artificial Sequence
  Description of Artificial Sequence: Synthetic peptide
  Seed: KNYKRCFPVIF (MAGA4_HUMAN)
KMYKRCFPVIY

SEQ ID NO: 66102 - protein, 10 aa, Artificial Sequence
  Description of Artificial Sequence: Synthetic peptide
  Seed: YRQVPGSNPA (MAGA4_HUMAN)
YWQVPGSNPW

SEQ ID NO: 66103 - protein, 11 aa, Artificial Sequence
  Description of Artificial Sequence: Synthetic peptide
  Seed: RVNARVRIAYP (MAGA4_HUMAN)
RTNARVRIAYM

SEQ ID NO: 66104 - protein, 9 aa, Artificial Sequence
  Description of Artificial Sequence: Synthetic peptide
  Seed: SALPTTISF (MAGA4_HUMAN)
SILPTTISR

SEQ ID NO: 66105 - protein, 9 aa, Artificial Sequence
  Description of Artificial Sequence: Synthetic peptide
  Seed: EVDPASNTY (MAGA4_HUMAN)
ELDPASNTV

SEQ ID NO: 66106 - protein, 10 aa, Artificial Sequence
  Description of Artificial Sequence: Synthetic peptide
  Seed: EAAVSSSSPL (MAGA4_HUMAN)
EIAVSSSSPK

SEQ ID NO: 66107 - protein, 9 aa, Artificial Sequence
  Description of Artificial Sequence: Synthetic peptide
  Seed: RVRIAYPSL (MAGA4_HUMAN)
RFRIAYPSI

SEQ ID NO: 66108 - protein, 10 aa, Artificial Sequence
  Description of Artificial Sequence: Synthetic peptide
  Seed: IFPKTGLLII (MAGA4_HUMAN)
IWPKTGLLIF

SEQ ID NO: 66109 - protein, 10 aa, Artificial Sequence
  Description of Artificial Sequence: Synthetic peptide
  Seed: KYRAKELVTK (MAGA4_HUMAN)
KARAKELVTR

SEQ ID NO: 66110 - protein, 10 aa, Artificial Sequence
  Description of Artificial Sequence: Synthetic peptide
  Seed: ASALPTTISF (MAGA4_HUMAN)
AYALPTTISW

SEQ ID NO: 66111 - protein, 11 aa, Artificial Sequence
  Description of Artificial Sequence: Synthetic peptide
  Seed: YTLVTCLGLSY (MAGA4_HUMAN)
YTLVTCLGLSW

SEQ ID NO: 66112 - protein, 9 aa, Artificial Sequence
  Description of Artificial Sequence: Synthetic peptide
  Seed: REAALLEEE (MAGA4_HUMAN)
REAALLEEC

SEQ ID NO: 66113 - protein, 9 aa, Artificial Sequence
  Description of Artificial Sequence: Synthetic peptide
  Seed: GASALPTTI (MAGA4_HUMAN)
GSSALPTTV

SEQ ID NO: 66114 - protein, 10 aa, Artificial Sequence
  Description of Artificial Sequence: Synthetic peptide
  Seed: VDPASNTYTL (MAGA4_HUMAN)
VSPASNTYTL

SEQ ID NO: 66115 - protein, 9 aa, Artificial Sequence
  Description of Artificial Sequence: Synthetic peptide
  Seed: WVQENYLEY (MAGA4_HUMAN)
WMQENYLEM

SEQ ID NO: 66116 - protein, 9 aa, Artificial Sequence
  Description of Artificial Sequence: Synthetic peptide
  Seed: VYDGREHTV (MAGA4_HUMAN)
VNDGREHTL

SEQ ID NO: 66117 - protein, 9 aa, Artificial Sequence
  Description of Artificial Sequence: Synthetic peptide
  Seed: RKYRAKELV (MAGA4_HUMAN)
RQYRAKELF

SEQ ID NO: 66118 - protein, 10 aa, Artificial Sequence
  Description of Artificial Sequence: Synthetic peptide
  Seed: TSYVKVLEHV (MAGA4_HUMAN)
TQYVKVLEHL

SEQ ID NO: 66119 - protein, 10 aa, Artificial Sequence
  Description of Artificial Sequence: Synthetic peptide
  Seed: TTISFTCWRQ (MAGA4_HUMAN)
TIISFTCWRR

SEQ ID NO: 66120 - protein, 9 aa, Artificial Sequence
  Description of Artificial Sequence: Synthetic peptide
  Seed: SPDAESLFR (MAGA4_HUMAN)
SFDAESLFY

SEQ ID NO: 66121 - protein, 9 aa, Artificial Sequence
  Description of Artificial Sequence: Synthetic peptide
  Seed: KVLEHVVRV (MAGA4_HUMAN)
KVLEHVVRY

SEQ ID NO: 66122 - protein, 9 aa, Artificial Sequence
  Description of Artificial Sequence: Synthetic peptide
  Seed: SAGPPQSPQ (MAGA4_HUMAN)
SVGPPQSPF

SEQ ID NO: 66123 - protein, 9 aa, Artificial Sequence
  Description of Artificial Sequence: Synthetic peptide
  Seed: RQVPGSNPA (MAGA4_HUMAN)
RAVPGSNPF

SEQ ID NO: 66124 - protein, 9 aa, Artificial Sequence
  Description of Artificial Sequence: Synthetic peptide
  Seed: VYDGREHTV (MAGA4_HUMAN)
VEDGREHTL

SEQ ID NO: 66125 - protein, 10 aa, Artificial Sequence
  Description of Artificial Sequence: Synthetic peptide
  Seed: SESLKMIFGI (MAGA4_HUMAN)
SISLKMIFGW

SEQ ID NO: 66126 - protein, 9 aa, Artificial Sequence
  Description of Artificial Sequence: Synthetic peptide
  Seed: KELVTKAEM (MAGA4_HUMAN)
KQLVTKAEL

SEQ ID NO: 66127 - protein, 9 aa, Artificial Sequence
  Description of Artificial Sequence: Synthetic peptide
  Seed: RCFPVIFGK (MAGA4_HUMAN)
RIFPVIFGR

SEQ ID NO: 66128 - protein, 9 aa, Artificial Sequence
  Description of Artificial Sequence: Synthetic peptide
  Seed: EVDPASNTY (MAGA4_HUMAN)
EGDPASNTV

SEQ ID NO: 66129 - protein, 10 aa, Artificial Sequence
  Description of Artificial Sequence: Synthetic peptide
  Seed: RVRIAYPSLR (MAGA4_HUMAN)
RDRIAYPSLR

SEQ ID NO: 66130 - protein, 9 aa, Artificial Sequence
  Description of Artificial Sequence: Synthetic peptide
  Seed: SALPTTISF (MAGA4_HUMAN)
SPLPTTISM

SEQ ID NO: 66131 - protein, 10 aa, Artificial Sequence
  Description of Artificial Sequence: Synthetic peptide
  Seed: GVYDGREHTV (MAGA4_HUMAN)
GAYDGREHTH

SEQ ID NO: 66132 - protein, 9 aa, Artificial Sequence
  Description of Artificial Sequence: Synthetic peptide
  Seed: RVRIAYPSL (MAGA4_HUMAN)
RNRIAYPSA

SEQ ID NO: 66133 - protein, 9 aa, Artificial Sequence
  Description of Artificial Sequence: Synthetic peptide
  Seed: ELAHFLLRK (MAGA4_HUMAN)
ETAHFLLRM

SEQ ID NO: 66134 - protein, 9 aa, Artificial Sequence
  Description of Artificial Sequence: Synthetic peptide
  Seed: NKVDELAHF (MAGA4_HUMAN)
NVVDELAHF

SEQ ID NO: 66135 - protein, 10 aa, Artificial Sequence
  Description of Artificial Sequence: Synthetic peptide
  Seed: DELAHFLLRK (MAGA4_HUMAN)
DALAHFLLRK

SEQ ID NO: 66136 - protein, 11 aa, Artificial Sequence
  Description of Artificial Sequence: Synthetic peptide
  Seed: RQVPGSNPARY (MAGA4_HUMAN)
RMVPGSNPARY

SEQ ID NO: 66137 - protein, 9 aa, Artificial Sequence
  Description of Artificial Sequence: Synthetic peptide
  Seed: YRAKELVTK (MAGA4_HUMAN)
YRAKELVTV

SEQ ID NO: 66138 - protein, 9 aa, Artificial Sequence
  Description of Artificial Sequence: Synthetic peptide
  Seed: RVRIAYPSL (MAGA4_HUMAN)
RGRIAYPSV

SEQ ID NO: 66139 - protein, 9 aa, Artificial Sequence
  Description of Artificial Sequence: Synthetic peptide
  Seed: WVQENYLEY (MAGA4_HUMAN)
WAQENYLEM

SEQ ID NO: 66140 - protein, 9 aa, Artificial Sequence
  Description of Artificial Sequence: Synthetic peptide
  Seed: AAVSSSSPL (MAGA4_HUMAN)
ALVSSSSPA

SEQ ID NO: 66141 - protein, 10 aa, Artificial Sequence
  Description of Artificial Sequence: Synthetic peptide
  Seed: KVDELAHFLL (MAGA4_HUMAN)
KLDELAHFLK

SEQ ID NO: 66142 - protein, 9 aa, Artificial Sequence
  Description of Artificial Sequence: Synthetic peptide
  Seed: QIFPKTGLL (MAGA4_HUMAN)
QQFPKTGLV

SEQ ID NO: 66143 - protein, 10 aa, Artificial Sequence
  Description of Artificial Sequence: Synthetic peptide
  Seed: SSSPLVPGTL (MAGA4_HUMAN)
STSPLVPGTW

SEQ ID NO: 66144 - protein, 10 aa, Artificial Sequence
  Description of Artificial Sequence: Synthetic peptide
  Seed: FPKTGLLIIV (MAGA4_HUMAN)
FPKTGLLIIA

SEQ ID NO: 66145 - protein, 9 aa, Artificial Sequence
  Description of Artificial Sequence: Synthetic peptide
  Seed: GSNPARYEF (MAGA4_HUMAN)
GTNPARYEF

SEQ ID NO: 66146 - protein, 10 aa, Artificial Sequence
  Description of Artificial Sequence: Synthetic peptide
  Seed: TTISFTCWRQ (MAGA4_HUMAN)
TNISFTCWRK

SEQ ID NO: 66147 - protein, 10 aa, Artificial Sequence
  Description of Artificial Sequence: Synthetic peptide
  Seed: SSSPLVPGTL (MAGA4_HUMAN)
SMSPLVPGTV

SEQ ID NO: 66148 - protein, 9 aa, Artificial Sequence
  Description of Artificial Sequence: Synthetic peptide
  Seed: IFPKTGLLI (MAGA4_HUMAN)
IMPKTGLLF

SEQ ID NO: 66149 - protein, 9 aa, Artificial Sequence
  Description of Artificial Sequence: Synthetic peptide
  Seed: RVRIAYPSL (MAGA4_HUMAN)
RQRIAYPSY

SEQ ID NO: 66150 - protein, 10 aa, Artificial Sequence
  Description of Artificial Sequence: Synthetic peptide
  Seed: QVPGSNPARY (MAGA4_HUMAN)
QVPGSNPARW

SEQ ID NO: 66151 - protein, 9 aa, Artificial Sequence
  Description of Artificial Sequence: Synthetic peptide
  Seed: KVDELAHFL (MAGA4_HUMAN)
KCDELAHFV

SEQ ID NO: 66152 - protein, 10 aa, Artificial Sequence
  Description of Artificial Sequence: Synthetic peptide
  Seed: STSPDAESLF (MAGA4_HUMAN)
SVSPDAESLW

SEQ ID NO: 66153 - protein, 9 aa, Artificial Sequence
  Description of Artificial Sequence: Synthetic peptide
  Seed: IIVLGTIAM (MAGA4_HUMAN)
IGVLGTIAY

SEQ ID NO: 66154 - protein, 9 aa, Artificial Sequence
  Description of Artificial Sequence: Synthetic peptide
  Seed: RVRIAYPSL (MAGA4_HUMAN)
RARIAYPSY

SEQ ID NO: 66155 - protein, 9 aa, Artificial Sequence
  Description of Artificial Sequence: Synthetic peptide
  Seed: ALPTTISFT (MAGA4_HUMAN)
ALPTTISFI

SEQ ID NO: 66156 - protein, 9 aa, Artificial Sequence
  Description of Artificial Sequence: Synthetic peptide
  Seed: GVMGVYDGR (MAGA4_HUMAN)
GSMGVYDGR

SEQ ID NO: 66157 - protein, 9 aa, Artificial Sequence
  Description of Artificial Sequence: Synthetic peptide
  Seed: ELAHFLLRK (MAGA4_HUMAN)
ENAHFLLRK

SEQ ID NO: 66158 - protein, 11 aa, Artificial Sequence
  Description of Artificial Sequence: Synthetic peptide
  Seed: MEGDSASEEEI (MAGA4_HUMAN)
MLGDSASEEEF

SEQ ID NO: 66159 - protein, 8 aa, Artificial Sequence
  Description of Artificial Sequence: Synthetic peptide
  Seed: KASESLKM (MAGA4_HUMAN)
KASESLKW

SEQ ID NO: 66160 - protein, 9 aa, Artificial Sequence
  Description of Artificial Sequence: Synthetic peptide
  Seed: LVPGTLEEV (MAGA4_HUMAN)
LLPGTLEEA

SEQ ID NO: 66161 - protein, 9 aa, Artificial Sequence
  Description of Artificial Sequence: Synthetic peptide
  Seed: YKRCFPVIF (MAGA4_HUMAN)
YIRCFPVIF

SEQ ID NO: 66162 - protein, 9 aa, Artificial Sequence
  Description of Artificial Sequence: Synthetic peptide
  Seed: RVRIAYPSL (MAGA4_HUMAN)
RYRIAYPSP

SEQ ID NO: 66163 - protein, 9 aa, Artificial Sequence
  Description of Artificial Sequence: Synthetic peptide
  Seed: RVRIAYPSL (MAGA4_HUMAN)
RFRIAYPSA

SEQ ID NO: 66164 - protein, 9 aa, Artificial Sequence
  Description of Artificial Sequence: Synthetic peptide
  Seed: STSPDAESL (MAGA4_HUMAN)
STSPDAESW

SEQ ID NO: 66165 - protein, 9 aa, Artificial Sequence
  Description of Artificial Sequence: Synthetic peptide
  Seed: AQEEALGLV (MAGA4_HUMAN)
AEEEALGLL

SEQ ID NO: 66166 - protein, 9 aa, Artificial Sequence
  Description of Artificial Sequence: Synthetic peptide
  Seed: IIVLGTIAM (MAGA4_HUMAN)
IYVLGTIAL

SEQ ID NO: 66167 - protein, 9 aa, Artificial Sequence
  Description of Artificial Sequence: Synthetic peptide
  Seed: SEEEIWEEL (MAGA4_HUMAN)
SIEEIWEEF

SEQ ID NO: 66168 - protein, 11 aa, Artificial Sequence
  Description of Artificial Sequence: Synthetic peptide
  Seed: AQAPTTEEQEA (MAGA4_HUMAN)
AEAPTTEEQEV

SEQ ID NO: 66169 - protein, 9 aa, Artificial Sequence
  Description of Artificial Sequence: Synthetic peptide
  Seed: FPVIFGKAS (MAGA4_HUMAN)
FPVIFGKAY

SEQ ID NO: 66170 - protein, 10 aa, Artificial Sequence
  Description of Artificial Sequence: Synthetic peptide
  Seed: EMLERVIKNY (MAGA4_HUMAN)
EILERVIKNK

SEQ ID NO: 66171 - protein, 9 aa, Artificial Sequence
  Description of Artificial Sequence: Synthetic peptide
  Seed: STSPDAESL (MAGA4_HUMAN)
SLSPDAESI

SEQ ID NO: 66172 - protein, 9 aa, Artificial Sequence
  Description of Artificial Sequence: Synthetic peptide
  Seed: AVSSSSPLV (MAGA4_HUMAN)
ALSSSSPLF

SEQ ID NO: 66173 - protein, 10 aa, Artificial Sequence
  Description of Artificial Sequence: Synthetic peptide
  Seed: VDPASNTYTL (MAGA4_HUMAN)
VVPASNTYTL

SEQ ID NO: 66174 - protein, 9 aa, Artificial Sequence
  Description of Artificial Sequence: Synthetic peptide
  Seed: RQVPGSNPA (MAGA4_HUMAN)
RQVPGSNPL

SEQ ID NO: 66175 - protein, 8 aa, Artificial Sequence
  Description of Artificial Sequence: Synthetic peptide
  Seed: VYGEPRKL (MAGA4_HUMAN)
VSGEPRKM

SEQ ID NO: 66176 - protein, 9 aa, Artificial Sequence
  Description of Artificial Sequence: Synthetic peptide
  Seed: NTYTLVTCL (MAGA4_HUMAN)
NLYTLVTCI

SEQ ID NO: 66177 - protein, 9 aa, Artificial Sequence
  Description of Artificial Sequence: Synthetic peptide
  Seed: EEQEAAVSS (MAGA4_HUMAN)
EEQEAAVST

SEQ ID NO: 66178 - protein, 9 aa, Artificial Sequence
  Description of Artificial Sequence: Synthetic peptide
  Seed: RQVPGSNPA (MAGA4_HUMAN)
RQVPGSNPY

SEQ ID NO: 66179 - protein, 9 aa, Artificial Sequence
  Description of Artificial Sequence: Synthetic peptide
  Seed: KASESLKMI (MAGA4_HUMAN)
KQSESLKMI

SEQ ID NO: 66180 - protein, 9 aa, Artificial Sequence
  Description of Artificial Sequence: Synthetic peptide
  Seed: AESLFREAL (MAGA4_HUMAN)
AQSLFREAF

SEQ ID NO: 66181 - protein, 10 aa, Artificial Sequence
  Description of Artificial Sequence: Synthetic peptide
  Seed: LIIVLGTIAM (MAGA4_HUMAN)
LQIVLGTIAL

SEQ ID NO: 66182 - protein, 9 aa, Artificial Sequence
  Description of Artificial Sequence: Synthetic peptide
  Seed: SSPLVPGTL (MAGA4_HUMAN)
SQPLVPGTF

SEQ ID NO: 66183 - protein, 9 aa, Artificial Sequence
  Description of Artificial Sequence: Synthetic peptide
  Seed: IFPKTGLLI (MAGA4_HUMAN)
IIPKTGLLM

SEQ ID NO: 66184 - protein, 11 aa, Artificial Sequence
  Description of Artificial Sequence: Synthetic peptide
  Seed: KYRAKELVTKA (MAGA4_HUMAN)
KTRAKELVTKK

SEQ ID NO: 66185 - protein, 10 aa, Artificial Sequence
  Description of Artificial Sequence: Synthetic peptide
  Seed: TTISFTCWRQ (MAGA4_HUMAN)
TTISFTCWRK

SEQ ID NO: 66186 - protein, 10 aa, Artificial Sequence
  Description of Artificial Sequence: Synthetic peptide
  Seed: ARVRIAYPSL (MAGA4_HUMAN)
AFVRIAYPSA

SEQ ID NO: 66187 - protein, 10 aa, Artificial Sequence
  Description of Artificial Sequence: Synthetic peptide
  Seed: GVYDGREHTV (MAGA4_HUMAN)
GGYDGREHTF

SEQ ID NO: 66188 - protein, 11 aa, Artificial Sequence
  Description of Artificial Sequence: Synthetic peptide
  Seed: MEGDSASEEEI (MAGA4_HUMAN)
MEGDSASEEEW

SEQ ID NO: 66189 - protein, 9 aa, Artificial Sequence
  Description of Artificial Sequence: Synthetic peptide
  Seed: YVKVLEHVV (MAGA4_HUMAN)
YMKVLEHVI

SEQ ID NO: 66190 - protein, 10 aa, Artificial Sequence
  Description of Artificial Sequence: Synthetic peptide
  Seed: ARVRIAYPSL (MAGA4_HUMAN)
ANVRIAYPSV

SEQ ID NO: 66191 - protein, 9 aa, Artificial Sequence
  Description of Artificial Sequence: Synthetic peptide
  Seed: YPSLREAAL (MAGA4_HUMAN)
YMSLREAAM

SEQ ID NO: 66192 - protein, 9 aa, Artificial Sequence
  Description of Artificial Sequence: Synthetic peptide
  Seed: RVRIAYPSL (MAGA4_HUMAN)
RMRIAYPSM

SEQ ID NO: 66193 - protein, 9 aa, Artificial Sequence
  Description of Artificial Sequence: Synthetic peptide
  Seed: STSPDAESL (MAGA4_HUMAN)
SISPDAESR

SEQ ID NO: 66194 - protein, 9 aa, Artificial Sequence
  Description of Artificial Sequence: Synthetic peptide
  Seed: RKYRAKELV (MAGA4_HUMAN)
RHYRAKELY

SEQ ID NO: 66195 - protein, 9 aa, Artificial Sequence
  Description of Artificial Sequence: Synthetic peptide
  Seed: NQIFPKTGL (MAGA4_HUMAN)
NRIFPKTGL

SEQ ID NO: 66196 - protein, 10 aa, Artificial Sequence
  Description of Artificial Sequence: Synthetic peptide
  Seed: TSYVKVLEHV (MAGA4_HUMAN)
TEYVKVLEHF

SEQ ID NO: 66197 - protein, 9 aa, Artificial Sequence
  Description of Artificial Sequence: Synthetic peptide
  Seed: KELVTKAEM (MAGA4_HUMAN)
KQLVTKAEM

SEQ ID NO: 66198 - protein, 9 aa, Artificial Sequence
  Description of Artificial Sequence: Synthetic peptide
  Seed: TSPDAESLF (MAGA4_HUMAN)
TIPDAESLM

SEQ ID NO: 66199 - protein, 11 aa, Artificial Sequence
  Description of Artificial Sequence: Synthetic peptide
  Seed: RVRIAYPSLRE (MAGA4_HUMAN)
RFRIAYPSLRR

SEQ ID NO: 66200 - protein, 9 aa, Artificial Sequence
  Description of Artificial Sequence: Synthetic peptide
  Seed: LVPGTLEEV (MAGA4_HUMAN)
LTPGTLEEM

SEQ ID NO: 66201 - protein, 9 aa, Artificial Sequence
  Description of Artificial Sequence: Synthetic peptide
  Seed: RCFPVIFGK (MAGA4_HUMAN)
RVFPVIFGF

SEQ ID NO: 66202 - protein, 10 aa, Artificial Sequence
  Description of Artificial Sequence: Synthetic peptide
  Seed: TTISFTCWRQ (MAGA4_HUMAN)
TTISFTCWRE

SEQ ID NO: 66203 - protein, 9 aa, Artificial Sequence
  Description of Artificial Sequence: Synthetic peptide
  Seed: TSPDAESLF (MAGA4_HUMAN)
TLPDAESLY

SEQ ID NO: 66204 - protein, 10 aa, Artificial Sequence
  Description of Artificial Sequence: Synthetic peptide
  Seed: KRCFPVIFGK (MAGA4_HUMAN)
KQCFPVIFGK

SEQ ID NO: 66205 - protein, 9 aa, Artificial Sequence
  Description of Artificial Sequence: Synthetic peptide
  Seed: FPVIFGKAS (MAGA4_HUMAN)
FPVIFGKAA

SEQ ID NO: 66206 - protein, 9 aa, Artificial Sequence
  Description of Artificial Sequence: Synthetic peptide
  Seed: AHFLLRKYR (MAGA4_HUMAN)
ASFLLRKYR

SEQ ID NO: 66207 - protein, 9 aa, Artificial Sequence
  Description of Artificial Sequence: Synthetic peptide
  Seed: REHTVYGEP (MAGA4_HUMAN)
REHTVYGEL

SEQ ID NO: 66208 - protein, 11 aa, Artificial Sequence
  Description of Artificial Sequence: Synthetic peptide
  Seed: STSPDAESLFR (MAGA4_HUMAN)
SVSPDAESLFR

SEQ ID NO: 66209 - protein, 9 aa, Artificial Sequence
  Description of Artificial Sequence: Synthetic peptide
  Seed: TVYGEPRKL (MAGA4_HUMAN)
TIYGEPRKF

SEQ ID NO: 66210 - protein, 9 aa, Artificial Sequence
  Description of Artificial Sequence: Synthetic peptide
  Seed: YPSLREAAL (MAGA4_HUMAN)
YGSLREAAM

SEQ ID NO: 66211 - protein, 9 aa, Artificial Sequence
  Description of Artificial Sequence: Synthetic peptide
  Seed: AAVSSSSPL (MAGA4_HUMAN)
ASVSSSSPY

SEQ ID NO: 66212 - protein, 10 aa, Artificial Sequence
  Description of Artificial Sequence: Synthetic peptide
  Seed: GVYDGREHTV (MAGA4_HUMAN)
GTYDGREHTL

SEQ ID NO: 66213 - protein, 10 aa, Artificial Sequence
  Description of Artificial Sequence: Synthetic peptide
  Seed: STSPDAESLF (MAGA4_HUMAN)
STSPDAESLY

SEQ ID NO: 66214 - protein, 9 aa, Artificial Sequence
  Description of Artificial Sequence: Synthetic peptide
  Seed: RVNARVRIA (MAGA4_HUMAN)
RYNARVRIA

SEQ ID NO: 66215 - protein, 10 aa, Artificial Sequence
  Description of Artificial Sequence: Synthetic peptide
  Seed: KRCFPVIFGK (MAGA4_HUMAN)
KFCFPVIFGR

SEQ ID NO: 66216 - protein, 10 aa, Artificial Sequence
  Description of Artificial Sequence: Synthetic peptide
  Seed: KVDELAHFLL (MAGA4_HUMAN)
KQDELAHFLW

SEQ ID NO: 66217 - protein, 9 aa, Artificial Sequence
  Description of Artificial Sequence: Synthetic peptide
  Seed: KVLEHVVRV (MAGA4_HUMAN)
KQLEHVVRC

SEQ ID NO: 66218 - protein, 10 aa, Artificial Sequence
  Description of Artificial Sequence: Synthetic peptide
  Seed: GVYDGREHTV (MAGA4_HUMAN)
GAYDGREHTI

SEQ ID NO: 66219 - protein, 9 aa, Artificial Sequence
  Description of Artificial Sequence: Synthetic peptide
  Seed: TQDWVQENY (MAGA4_HUMAN)
TVDWVQENY

SEQ ID NO: 66220 - protein, 10 aa, Artificial Sequence
  Description of Artificial Sequence: Synthetic peptide
  Seed: TLVTCLGLSY (MAGA4_HUMAN)
TVVTCLGLSY

SEQ ID NO: 66221 - protein, 10 aa, Artificial Sequence
  Description of Artificial Sequence: Synthetic peptide
  Seed: VDPASNTYTL (MAGA4_HUMAN)
VMPASNTYTY

SEQ ID NO: 66222 - protein, 10 aa, Artificial Sequence
  Description of Artificial Sequence: Synthetic peptide
  Seed: SESLKMIFGI (MAGA4_HUMAN)
SQSLKMIFGW

SEQ ID NO: 66223 - protein, 9 aa, Artificial Sequence
  Description of Artificial Sequence: Synthetic peptide
  Seed: NQIFPKTGL (MAGA4_HUMAN)
NEIFPKTGI

SEQ ID NO: 66224 - protein, 9 aa, Artificial Sequence
  Description of Artificial Sequence: Synthetic peptide
  Seed: TTISFTCWR (MAGA4_HUMAN)
TIISFTCWR

SEQ ID NO: 66225 - protein, 10 aa, Artificial Sequence
  Description of Artificial Sequence: Synthetic peptide
  Seed: KVDELAHFLL (MAGA4_HUMAN)
KTDELAHFLW

SEQ ID NO: 66226 - protein, 10 aa, Artificial Sequence
  Description of Artificial Sequence: Synthetic peptide
  Seed: LIIVLGTIAM (MAGA4_HUMAN)
LVIVLGTIAY

SEQ ID NO: 66227 - protein, 10 aa, Artificial Sequence
  Description of Artificial Sequence: Synthetic peptide
  Seed: SSSPLVPGTL (MAGA4_HUMAN)
SASPLVPGTL

SEQ ID NO: 66228 - protein, 10 aa, Artificial Sequence
  Description of Artificial Sequence: Synthetic peptide
  Seed: RIAYPSLREA (MAGA4_HUMAN)
RFAYPSLREK

SEQ ID NO: 66229 - protein, 9 aa, Artificial Sequence
  Description of Artificial Sequence: Synthetic peptide
  Seed: AQEEALGLV (MAGA4_HUMAN)
AQEEALGLF

SEQ ID NO: 66230 - protein, 10 aa, Artificial Sequence
  Description of Artificial Sequence: Synthetic peptide
  Seed: KVDELAHFLL (MAGA4_HUMAN)
KMDELAHFLD

SEQ ID NO: 66231 - protein, 10 aa, Artificial Sequence
  Description of Artificial Sequence: Synthetic peptide
  Seed: LPTTISFTCW (MAGA4_HUMAN)
LSTTISFTCY

SEQ ID NO: 66232 - protein, 10 aa, Artificial Sequence
  Description of Artificial Sequence: Synthetic peptide
  Seed: QVPGSNPARY (MAGA4_HUMAN)
QTPGSNPARR

SEQ ID NO: 66233 - protein, 10 aa, Artificial Sequence
  Description of Artificial Sequence: Synthetic peptide
  Seed: KVDELAHFLL (MAGA4_HUMAN)
KLDELAHFLS

SEQ ID NO: 66234 - protein, 10 aa, Artificial Sequence
  Description of Artificial Sequence: Synthetic peptide
  Seed: YPSLREAALL (MAGA4_HUMAN)
YYSLREAALW

SEQ ID NO: 66235 - protein, 9 aa, Artificial Sequence
  Description of Artificial Sequence: Synthetic peptide
  Seed: NTYTLVTCL (MAGA4_HUMAN)
NSYTLVTCW

SEQ ID NO: 66236 - protein, 11 aa, Artificial Sequence
  Description of Artificial Sequence: Synthetic peptide
  Seed: SSSSPLVPGTL (MAGA4_HUMAN)
SASSPLVPGTY

SEQ ID NO: 66237 - protein, 9 aa, Artificial Sequence
  Description of Artificial Sequence: Synthetic peptide
  Seed: KVDELAHFL (MAGA4_HUMAN)
KGDELAHFW

SEQ ID NO: 66238 - protein, 10 aa, Artificial Sequence
  Description of Artificial Sequence: Synthetic peptide
  Seed: STSPDAESLF (MAGA4_HUMAN)
STSPDAESLW

SEQ ID NO: 66239 - protein, 9 aa, Artificial Sequence
  Description of Artificial Sequence: Synthetic peptide
  Seed: VYDGREHTV (MAGA4_HUMAN)
VLDGREHTM

SEQ ID NO: 66240 - protein, 11 aa, Artificial Sequence
  Description of Artificial Sequence: Synthetic peptide
  Seed: RQVPGSNPARY (MAGA4_HUMAN)
RAVPGSNPARF

SEQ ID NO: 66241 - protein, 9 aa, Artificial Sequence
  Description of Artificial Sequence: Synthetic peptide
  Seed: IAMEGDSAS (MAGA4_HUMAN)
ISMEGDSAY

SEQ ID NO: 66242 - protein, 9 aa, Artificial Sequence
  Description of Artificial Sequence: Synthetic peptide
  Seed: STSPDAESL (MAGA4_HUMAN)
SMSPDAESF

SEQ ID NO: 66243 - protein, 9 aa, Artificial Sequence
  Description of Artificial Sequence: Synthetic peptide
  Seed: STSPDAESL (MAGA4_HUMAN)
SVSPDAESW

SEQ ID NO: 66244 - protein, 8 aa, Artificial Sequence
  Description of Artificial Sequence: Synthetic peptide
  Seed: KVDELAHF (MAGA4_HUMAN)
KIDELAHL

SEQ ID NO: 66245 - protein, 9 aa, Artificial Sequence
  Description of Artificial Sequence: Synthetic peptide
  Seed: KNYKRCFPV (MAGA4_HUMAN)
KSYKRCFPA

SEQ ID NO: 66246 - protein, 9 aa, Artificial Sequence
  Description of Artificial Sequence: Synthetic peptide
  Seed: RQVPGSNPA (MAGA4_HUMAN)
RKVPGSNPF

SEQ ID NO: 66247 - protein, 8 aa, Artificial Sequence
  Description of Artificial Sequence: Synthetic peptide
  Seed: TSPDAESL (MAGA4_HUMAN)
TIPDAESL

SEQ ID NO: 66248 - protein, 10 aa, Artificial Sequence
  Description of Artificial Sequence: Synthetic peptide
  Seed: AESAGPPQSP (MAGA4_HUMAN)
AESAGPPQST

SEQ ID NO: 66249 - protein, 9 aa, Artificial Sequence
  Description of Artificial Sequence: Synthetic peptide
  Seed: GASALPTTI (MAGA4_HUMAN)
GASALPTTH

SEQ ID NO: 66250 - protein, 9 aa, Artificial Sequence
  Description of Artificial Sequence: Synthetic peptide
  Seed: ESLKMIFGI (MAGA4_HUMAN)
ETLKMIFGA

SEQ ID NO: 66251 - protein, 10 aa, Artificial Sequence
  Description of Artificial Sequence: Synthetic peptide
  Seed: AALLEEEEGV (MAGA4_HUMAN)
AFLLEEEEGV

SEQ ID NO: 66252 - protein, 11 aa, Artificial Sequence
  Description of Artificial Sequence: Synthetic peptide
  Seed: AQAPTTEEQEA (MAGA4_HUMAN)
AQAPTTEEQEI

SEQ ID NO: 66253 - protein, 9 aa, Artificial Sequence
  Description of Artificial Sequence: Synthetic peptide
  Seed: KELVTKAEM (MAGA4_HUMAN)
KDLVTKAEF

SEQ ID NO: 66254 - protein, 9 aa, Artificial Sequence
  Description of Artificial Sequence: Synthetic peptide
  Seed: ELAHFLLRK (MAGA4_HUMAN)
ETAHFLLRY

SEQ ID NO: 66255 - protein, 10 aa, Artificial Sequence
  Description of Artificial Sequence: Synthetic peptide
  Seed: AAVSSSSPLV (MAGA4_HUMAN)
AMVSSSSPLI

SEQ ID NO: 66256 - protein, 11 aa, Artificial Sequence
  Description of Artificial Sequence: Synthetic peptide
  Seed: AQAPTTEEQEA (MAGA4_HUMAN)
AEAPTTEEQEM

SEQ ID NO: 66257 - protein, 9 aa, Artificial Sequence
  Description of Artificial Sequence: Synthetic peptide
  Seed: MSSEQKSQH (MAGA4_HUMAN)
MASEQKSQL

SEQ ID NO: 66258 - protein, 11 aa, Artificial Sequence
  Description of Artificial Sequence: Synthetic peptide
  Seed: KEVDPASNTYT (MAGA4_HUMAN)
KEVDPASNTYL

SEQ ID NO: 66259 - protein, 10 aa, Artificial Sequence
  Description of Artificial Sequence: Synthetic peptide
  Seed: RVNARVRIAY (MAGA4_HUMAN)
RMNARVRIAF

SEQ ID NO: 66260 - protein, 11 aa, Artificial Sequence
  Description of Artificial Sequence: Synthetic peptide
  Seed: RQVPGSNPARY (MAGA4_HUMAN)
RQVPGSNPARF

SEQ ID NO: 66261 - protein, 8 aa, Artificial Sequence
  Description of Artificial Sequence: Synthetic peptide
  Seed: AESLFREA (MAGA4_HUMAN)
ADSLFREF

SEQ ID NO: 66262 - protein, 9 aa, Artificial Sequence
  Description of Artificial Sequence: Synthetic peptide
  Seed: EVDPASNTY (MAGA4_HUMAN)
EMDPASNTV

SEQ ID NO: 66263 - protein, 9 aa, Artificial Sequence
  Description of Artificial Sequence: Synthetic peptide
  Seed: KNYKRCFPV (MAGA4_HUMAN)
KGYKRCFPK

SEQ ID NO: 66264 - protein, 11 aa, Artificial Sequence
  Description of Artificial Sequence: Synthetic peptide
  Seed: RVNARVRIAYP (MAGA4_HUMAN)
RGNARVRIAYK

SEQ ID NO: 66265 - protein, 9 aa, Artificial Sequence
  Description of Artificial Sequence: Synthetic peptide
  Seed: ESLKMIFGI (MAGA4_HUMAN)
EVLKMIFGW

SEQ ID NO: 66266 - protein, 9 aa, Artificial Sequence
  Description of Artificial Sequence: Synthetic peptide
  Seed: GSNPARYEF (MAGA4_HUMAN)
GANPARYEF

SEQ ID NO: 66267 - protein, 9 aa, Artificial Sequence
  Description of Artificial Sequence: Synthetic peptide
  Seed: RAKELVTKA (MAGA4_HUMAN)
RVKELVTKI

SEQ ID NO: 66268 - protein, 9 aa, Artificial Sequence
  Description of Artificial Sequence: Synthetic peptide
  Seed: SSPLVPGTL (MAGA4_HUMAN)
STPLVPGTL

SEQ ID NO: 66269 - protein, 10 aa, Artificial Sequence
  Description of Artificial Sequence: Synthetic peptide
  Seed: ASALPTTISF (MAGA4_HUMAN)
ARALPTTISW

SEQ ID NO: 66270 - protein, 11 aa, Artificial Sequence
  Description of Artificial Sequence: Synthetic peptide
  Seed: GVYDGREHTVY (MAGA4_HUMAN)
GQYDGREHTVY

SEQ ID NO: 66271 - protein, 9 aa, Artificial Sequence
  Description of Artificial Sequence: Synthetic peptide
  Seed: TVYGEPRKL (MAGA4_HUMAN)
TFYGEPRKY

SEQ ID NO: 66272 - protein, 9 aa, Artificial Sequence
  Description of Artificial Sequence: Synthetic peptide
  Seed: KVLEHVVRV (MAGA4_HUMAN)
KILEHVVRY

SEQ ID NO: 66273 - protein, 10 aa, Artificial Sequence
  Description of Artificial Sequence: Synthetic peptide
  Seed: KEVDPASNTY (MAGA4_HUMAN)
KLVDPASNTL

SEQ ID NO: 66274 - protein, 9 aa, Artificial Sequence
  Description of Artificial Sequence: Synthetic peptide
  Seed: SSPLVPGTL (MAGA4_HUMAN)
SSPLVPGTI

SEQ ID NO: 66275 - protein, 9 aa, Artificial Sequence
  Description of Artificial Sequence: Synthetic peptide
  Seed: RVRIAYPSL (MAGA4_HUMAN)
RARIAYPSS

SEQ ID NO: 66276 - protein, 9 aa, Artificial Sequence
  Description of Artificial Sequence: Synthetic peptide
  Seed: SALPTTISF (MAGA4_HUMAN)
SYLPTTISI

SEQ ID NO: 66277 - protein, 11 aa, Artificial Sequence
  Description of Artificial Sequence: Synthetic peptide
  Seed: RVNARVRIAYP (MAGA4_HUMAN)
RPNARVRIAYK

SEQ ID NO: 66278 - protein, 9 aa, Artificial Sequence
  Description of Artificial Sequence: Synthetic peptide
  Seed: SEEEIWEEL (MAGA4_HUMAN)
SAEEIWEEV

SEQ ID NO: 66279 - protein, 9 aa, Artificial Sequence
  Description of Artificial Sequence: Synthetic peptide
  Seed: SSSPLVPGT (MAGA4_HUMAN)
SASPLVPGA

SEQ ID NO: 66280 - protein, 9 aa, Artificial Sequence
  Description of Artificial Sequence: Synthetic peptide
  Seed: MGVYDGREH (MAGA4_HUMAN)
MSVYDGREY

SEQ ID NO: 66281 - protein, 9 aa, Artificial Sequence
  Description of Artificial Sequence: Synthetic peptide
  Seed: NTYTLVTCL (MAGA4_HUMAN)
NMYTLVTCL

SEQ ID NO: 66282 - protein, 9 aa, Artificial Sequence
  Description of Artificial Sequence: Synthetic peptide
  Seed: SNPARYEFL (MAGA4_HUMAN)
SAPARYEFV

SEQ ID NO: 66283 - protein, 9 aa, Artificial Sequence
  Description of Artificial Sequence: Synthetic peptide
  Seed: EEVPAAESA (MAGA4_HUMAN)
EEVPAAESI

SEQ ID NO: 66284 - protein, 10 aa, Artificial Sequence
  Description of Artificial Sequence: Synthetic peptide
  Seed: GLVGAQAPTT (MAGA4_HUMAN)
GMVGAQAPTL

SEQ ID NO: 66285 - protein, 9 aa, Artificial Sequence
  Description of Artificial Sequence: Synthetic peptide
  Seed: GLLGNNQIF (MAGA4_HUMAN)
GVLGNNQIY

SEQ ID NO: 66286 - protein, 9 aa, Artificial Sequence
  Description of Artificial Sequence: Synthetic peptide
  Seed: VYGEPRKLL (MAGA4_HUMAN)
VRGEPRKLL

SEQ ID NO: 66287 - protein, 9 aa, Artificial Sequence
  Description of Artificial Sequence: Synthetic peptide
  Seed: SALPTTISF (MAGA4_HUMAN)
SQLPTTISY

SEQ ID NO: 66288 - protein, 11 aa, Artificial Sequence
  Description of Artificial Sequence: Synthetic peptide
  Seed: RVRIAYPSLRE (MAGA4_HUMAN)
RSRIAYPSLRI

SEQ ID NO: 66289 - protein, 9 aa, Artificial Sequence
  Description of Artificial Sequence: Synthetic peptide
  Seed: AAVSSSSPL (MAGA4_HUMAN)
AHVSSSSPF

SEQ ID NO: 66290 - protein, 9 aa, Artificial Sequence
  Description of Artificial Sequence: Synthetic peptide
  Seed: SNPARYEFL (MAGA4_HUMAN)
STPARYEFM

SEQ ID NO: 66291 - protein, 9 aa, Artificial Sequence
  Description of Artificial Sequence: Synthetic peptide
  Seed: EIWEELGVM (MAGA4_HUMAN)
EIWEELGVY

SEQ ID NO: 66292 - protein, 11 aa, Artificial Sequence
  Description of Artificial Sequence: Synthetic peptide
  Seed: ELGVMGVYDGR (MAGA4_HUMAN)
EHGVMGVYDGR

SEQ ID NO: 66293 - protein, 10 aa, Artificial Sequence
  Description of Artificial Sequence: Synthetic peptide
  Seed: RVRIAYPSLR (MAGA4_HUMAN)
RRRIAYPSLV

SEQ ID NO: 66294 - protein, 10 aa, Artificial Sequence
  Description of Artificial Sequence: Synthetic peptide
  Seed: QIFPKTGLLI (MAGA4_HUMAN)
QLFPKTGLLF

SEQ ID NO: 66295 - protein, 9 aa, Artificial Sequence
  Description of Artificial Sequence: Synthetic peptide
  Seed: RVRIAYPSL (MAGA4_HUMAN)
RTRIAYPSI

SEQ ID NO: 66296 - protein, 9 aa, Artificial Sequence
  Description of Artificial Sequence: Synthetic peptide
  Seed: RVRIAYPSL (MAGA4_HUMAN)
RIRIAYPSS

SEQ ID NO: 66297 - protein, 10 aa, Artificial Sequence
  Description of Artificial Sequence: Synthetic peptide
  Seed: YPSLREAALL (MAGA4_HUMAN)
YSSLREAALW

SEQ ID NO: 66298 - protein, 8 aa, Artificial Sequence
  Description of Artificial Sequence: Synthetic peptide
  Seed: MIFGIDVK (MAGA4_HUMAN)
MTFGIDVK

SEQ ID NO: 66299 - protein, 10 aa, Artificial Sequence
  Description of Artificial Sequence: Synthetic peptide
  Seed: TEEQEAAVSS (MAGA4_HUMAN)
TEEQEAAVSV

SEQ ID NO: 66300 - protein, 9 aa, Artificial Sequence
  Description of Artificial Sequence: Synthetic peptide
  Seed: EVDPASNTY (MAGA4_HUMAN)
EMDPASNTI

SEQ ID NO: 66301 - protein, 10 aa, Artificial Sequence
  Description of Artificial Sequence: Synthetic peptide
  Seed: KNYKRCFPVI (MAGA4_HUMAN)
KMYKRCFPVF

SEQ ID NO: 66302 - protein, 8 aa, Artificial Sequence
  Description of Artificial Sequence: Synthetic peptide
  Seed: KVDELAHF (MAGA4_HUMAN)
KADELAHV

SEQ ID NO: 66303 - protein, 9 aa, Artificial Sequence
  Description of Artificial Sequence: Synthetic peptide
  Seed: LVPGTLEEV (MAGA4_HUMAN)
LQPGTLEEW

SEQ ID NO: 66304 - protein, 9 aa, Artificial Sequence
  Description of Artificial Sequence: Synthetic peptide
  Seed: SSPLVPGTL (MAGA4_HUMAN)
SYPLVPGTM

SEQ ID NO: 66305 - protein, 9 aa, Artificial Sequence
  Description of Artificial Sequence: Synthetic peptide
  Seed: LPTTISFTC (MAGA4_HUMAN)
LSTTISFTY

SEQ ID NO: 66306 - protein, 10 aa, Artificial Sequence
  Description of Artificial Sequence: Synthetic peptide
  Seed: ASALPTTISF (MAGA4_HUMAN)
AFALPTTISF

SEQ ID NO: 66307 - protein, 11 aa, Artificial Sequence
  Description of Artificial Sequence: Synthetic peptide
  Seed: TEEQEAAVSSS (MAGA4_HUMAN)
TEEQEAAVSSV

SEQ ID NO: 66308 - protein, 10 aa, Artificial Sequence
  Description of Artificial Sequence: Synthetic peptide
  Seed: YPSLREAALL (MAGA4_HUMAN)
YASLREAALF

SEQ ID NO: 66309 - protein, 9 aa, Artificial Sequence
  Description of Artificial Sequence: Synthetic peptide
  Seed: IAMEGDSAS (MAGA4_HUMAN)
IVMEGDSAF

SEQ ID NO: 66310 - protein, 9 aa, Artificial Sequence
  Description of Artificial Sequence: Synthetic peptide
  Seed: SEQKSQHCK (MAGA4_HUMAN)
SEQKSQHCL

SEQ ID NO: 66311 - protein, 9 aa, Artificial Sequence
  Description of Artificial Sequence: Synthetic peptide
  Seed: KNYKRCFPV (MAGA4_HUMAN)
KNYKRCFPK

SEQ ID NO: 66312 - protein, 10 aa, Artificial Sequence
  Description of Artificial Sequence: Synthetic peptide
  Seed: KASESLKMIF (MAGA4_HUMAN)
KDSESLKMIW

SEQ ID NO: 66313 - protein, 10 aa, Artificial Sequence
  Description of Artificial Sequence: Synthetic peptide
  Seed: QIFPKTGLLI (MAGA4_HUMAN)
QQFPKTGLLF

SEQ ID NO: 66314 - protein, 9 aa, Artificial Sequence
  Description of Artificial Sequence: Synthetic peptide
  Seed: KVLEHVVRV (MAGA4_HUMAN)
KGLEHVVRW

SEQ ID NO: 66315 - protein, 10 aa, Artificial Sequence
  Description of Artificial Sequence: Synthetic peptide
  Seed: TSYVKVLEHV (MAGA4_HUMAN)
TFYVKVLEHL

SEQ ID NO: 66316 - protein, 11 aa, Artificial Sequence
  Description of Artificial Sequence: Synthetic peptide
  Seed: MEGDSASEEEI (MAGA4_HUMAN)
MQGDSASEEEL

SEQ ID NO: 66317 - protein, 9 aa, Artificial Sequence
  Description of Artificial Sequence: Synthetic peptide
  Seed: IIVLGTIAM (MAGA4_HUMAN)
INVLGTIAF

SEQ ID NO: 66318 - protein, 10 aa, Artificial Sequence
  Description of Artificial Sequence: Synthetic peptide
  Seed: GVYDGREHTV (MAGA4_HUMAN)
GSYDGREHTF

SEQ ID NO: 66319 - protein, 9 aa, Artificial Sequence
  Description of Artificial Sequence: Synthetic peptide
  Seed: NKVDELAHF (MAGA4_HUMAN)
NIVDELAHY

SEQ ID NO: 66320 - protein, 10 aa, Artificial Sequence
  Description of Artificial Sequence: Synthetic peptide
  Seed: ARVRIAYPSL (MAGA4_HUMAN)
AGVRIAYPSV

SEQ ID NO: 66321 - protein, 9 aa, Artificial Sequence
  Description of Artificial Sequence: Synthetic peptide
  Seed: YKRCFPVIF (MAGA4_HUMAN)
YMRCFPVIM

SEQ ID NO: 66322 - protein, 10 aa, Artificial Sequence
  Description of Artificial Sequence: Synthetic peptide
  Seed: REAALLEEEE (MAGA4_HUMAN)
REAALLEEEA

SEQ ID NO: 66323 - protein, 11 aa, Artificial Sequence
  Description of Artificial Sequence: Synthetic peptide
  Seed: GVYDGREHTVY (MAGA4_HUMAN)
GTYDGREHTVF

SEQ ID NO: 66324 - protein, 9 aa, Artificial Sequence
  Description of Artificial Sequence: Synthetic peptide
  Seed: IFPKTGLLI (MAGA4_HUMAN)
IMPKTGLLM

SEQ ID NO: 66325 - protein, 9 aa, Artificial Sequence
  Description of Artificial Sequence: Synthetic peptide
  Seed: LVPGTLEEV (MAGA4_HUMAN)
LVPGTLEEF

SEQ ID NO: 66326 - protein, 9 aa, Artificial Sequence
  Description of Artificial Sequence: Synthetic peptide
  Seed: LFREALSNK (MAGA4_HUMAN)
LTREALSNR

SEQ ID NO: 66327 - protein, 9 aa, Artificial Sequence
  Description of Artificial Sequence: Synthetic peptide
  Seed: SSPLVPGTL (MAGA4_HUMAN)
SVPLVPGTI

SEQ ID NO: 66328 - protein, 10 aa, Artificial Sequence
  Description of Artificial Sequence: Synthetic peptide
  Seed: ARVRIAYPSL (MAGA4_HUMAN)
AQVRIAYPSA

SEQ ID NO: 66329 - protein, 9 aa, Artificial Sequence
  Description of Artificial Sequence: Synthetic peptide
  Seed: NKVDELAHF (MAGA4_HUMAN)
NHVDELAHW

SEQ ID NO: 66330 - protein, 10 aa, Artificial Sequence
  Description of Artificial Sequence: Synthetic peptide
  Seed: TTISFTCWRQ (MAGA4_HUMAN)
TGISFTCWRR

SEQ ID NO: 66331 - protein, 9 aa, Artificial Sequence
  Description of Artificial Sequence: Synthetic peptide
  Seed: STSPDAESL (MAGA4_HUMAN)
STSPDAESM

SEQ ID NO: 66332 - protein, 9 aa, Artificial Sequence
  Description of Artificial Sequence: Synthetic peptide
  Seed: SSSPLVPGT (MAGA4_HUMAN)
SSSPLVPGI

SEQ ID NO: 66333 - protein, 9 aa, Artificial Sequence
  Description of Artificial Sequence: Synthetic peptide
  Seed: NTYTLVTCL (MAGA4_HUMAN)
NMYTLVTCW

SEQ ID NO: 66334 - protein, 9 aa, Artificial Sequence
  Description of Artificial Sequence: Synthetic peptide
  Seed: AAVSSSSPL (MAGA4_HUMAN)
ALVSSSSPF

SEQ ID NO: 66335 - protein, 9 aa, Artificial Sequence
  Description of Artificial Sequence: Synthetic peptide
  Seed: IFPKTGLLI (MAGA4_HUMAN)
IYPKTGLLL

SEQ ID NO: 66336 - protein, 10 aa, Artificial Sequence
  Description of Artificial Sequence: Synthetic peptide
  Seed: YVKVLEHVVR (MAGA4_HUMAN)
YTKVLEHVVR

SEQ ID NO: 66337 - protein, 9 aa, Artificial Sequence
  Description of Artificial Sequence: Synthetic peptide
  Seed: RQVPGSNPA (MAGA4_HUMAN)
RMVPGSNPF

SEQ ID NO: 66338 - protein, 8 aa, Artificial Sequence
  Description of Artificial Sequence: Synthetic peptide
  Seed: TGLLIIVL (MAGA4_HUMAN)
TQLLIIVV

SEQ ID NO: 66339 - protein, 10 aa, Artificial Sequence
  Description of Artificial Sequence: Synthetic peptide
  Seed: VYDGREHTVY (MAGA4_HUMAN)
VVDGREHTVY

SEQ ID NO: 66340 - protein, 9 aa, Artificial Sequence
  Description of Artificial Sequence: Synthetic peptide
  Seed: IFPKTGLLI (MAGA4_HUMAN)
IIPKTGLLL

SEQ ID NO: 66341 - protein, 9 aa, Artificial Sequence
  Description of Artificial Sequence: Synthetic peptide
  Seed: KEVDPASNT (MAGA4_HUMAN)
KEVDPASNA

SEQ ID NO: 66342 - protein, 10 aa, Artificial Sequence
  Description of Artificial Sequence: Synthetic peptide
  Seed: ASALPTTISF (MAGA4_HUMAN)
ASALPTTISY

SEQ ID NO: 66343 - protein, 10 aa, Artificial Sequence
  Description of Artificial Sequence: Synthetic peptide
  Seed: MIFGIDVKEV (MAGA4_HUMAN)
MVFGIDVKEI

SEQ ID NO: 66344 - protein, 9 aa, Artificial Sequence
  Description of Artificial Sequence: Synthetic peptide
  Seed: KYRAKELVT (MAGA4_HUMAN)
KSRAKELVL

SEQ ID NO: 66345 - protein, 9 aa, Artificial Sequence
  Description of Artificial Sequence: Synthetic peptide
  Seed: RVRIAYPSL (MAGA4_HUMAN)
RMRIAYPSW

SEQ ID NO: 66346 - protein, 9 aa, Artificial Sequence
  Description of Artificial Sequence: Synthetic peptide
  Seed: LVPGTLEEV (MAGA4_HUMAN)
LIPGTLEEM

SEQ ID NO: 66347 - protein, 10 aa, Artificial Sequence
  Description of Artificial Sequence: Synthetic peptide
  Seed: YRQVPGSNPA (MAGA4_HUMAN)
YMQVPGSNPI

SEQ ID NO: 66348 - protein, 10 aa, Artificial Sequence
  Description of Artificial Sequence: Synthetic peptide
  Seed: YRQVPGSNPA (MAGA4_HUMAN)
YTQVPGSNPV

SEQ ID NO: 66349 - protein, 10 aa, Artificial Sequence
  Description of Artificial Sequence: Synthetic peptide
  Seed: LPTTISFTCW (MAGA4_HUMAN)
LATTISFTCY

SEQ ID NO: 66350 - protein, 9 aa, Artificial Sequence
  Description of Artificial Sequence: Synthetic peptide
  Seed: NPARYEFLW (MAGA4_HUMAN)
NIARYEFLW

SEQ ID NO: 66351 - protein, 10 aa, Artificial Sequence
  Description of Artificial Sequence: Synthetic peptide
  Seed: YRQVPGSNPA (MAGA4_HUMAN)
YYQVPGSNPF

SEQ ID NO: 66352 - protein, 9 aa, Artificial Sequence
  Description of Artificial Sequence: Synthetic peptide
  Seed: RAKELVTKA (MAGA4_HUMAN)
RLKELVTKR

SEQ ID NO: 66353 - protein, 10 aa, Artificial Sequence
  Description of Artificial Sequence: Synthetic peptide
  Seed: KVDELAHFLL (MAGA4_HUMAN)
KADELAHFLM

SEQ ID NO: 66354 - protein, 10 aa, Artificial Sequence
  Description of Artificial Sequence: Synthetic peptide
  Seed: ARVRIAYPSL (MAGA4_HUMAN)
ARVRIAYPSK

SEQ ID NO: 66355 - protein, 11 aa, Artificial Sequence
  Description of Artificial Sequence: Synthetic peptide
  Seed: RVNARVRIAYP (MAGA4_HUMAN)
RENARVRIAYK

SEQ ID NO: 66356 - protein, 9 aa, Artificial Sequence
  Description of Artificial Sequence: Synthetic peptide
  Seed: WVQENYLEY (MAGA4_HUMAN)
WFQENYLEY

SEQ ID NO: 66357 - protein, 10 aa, Artificial Sequence
  Description of Artificial Sequence: Synthetic peptide
  Seed: KASESLKMIF (MAGA4_HUMAN)
KPSESLKMIW

SEQ ID NO: 66358 - protein, 9 aa, Artificial Sequence
  Description of Artificial Sequence: Synthetic peptide
  Seed: GSNPARYEF (MAGA4_HUMAN)
GQNPARYEY

SEQ ID NO: 66359 - protein, 9 aa, Artificial Sequence
  Description of Artificial Sequence: Synthetic peptide
  Seed: YRAKELVTK (MAGA4_HUMAN)
YRAKELVTY

SEQ ID NO: 66360 - protein, 9 aa, Artificial Sequence
  Description of Artificial Sequence: Synthetic peptide
  Seed: TVYGEPRKL (MAGA4_HUMAN)
TAYGEPRKF

SEQ ID NO: 66361 - protein, 10 aa, Artificial Sequence
  Description of Artificial Sequence: Synthetic peptide
  Seed: KNYKRCFPVI (MAGA4_HUMAN)
KTYKRCFPVV

SEQ ID NO: 66362 - protein, 11 aa, Artificial Sequence
  Description of Artificial Sequence: Synthetic peptide
  Seed: RVRIAYPSLRE (MAGA4_HUMAN)
RVRIAYPSLRA

SEQ ID NO: 66363 - protein, 9 aa, Artificial Sequence
  Description of Artificial Sequence: Synthetic peptide
  Seed: TVYGEPRKL (MAGA4_HUMAN)
TFYGEPRKL

SEQ ID NO: 66364 - protein, 11 aa, Artificial Sequence
  Description of Artificial Sequence: Synthetic peptide
  Seed: RVRIAYPSLRE (MAGA4_HUMAN)
RYRIAYPSLRK

SEQ ID NO: 66365 - protein, 9 aa, Artificial Sequence
  Description of Artificial Sequence: Synthetic peptide
  Seed: QIFPKTGLL (MAGA4_HUMAN)
QSFPKTGLY

SEQ ID NO: 66366 - protein, 9 aa, Artificial Sequence
  Description of Artificial Sequence: Synthetic peptide
  Seed: AAVSSSSPL (MAGA4_HUMAN)
ASVSSSSPF

SEQ ID NO: 66367 - protein, 9 aa, Artificial Sequence
  Description of Artificial Sequence: Synthetic peptide
  Seed: GSNPARYEF (MAGA4_HUMAN)
GENPARYEY

SEQ ID NO: 66368 - protein, 9 aa, Artificial Sequence
  Description of Artificial Sequence: Synthetic peptide
  Seed: LVPGTLEEV (MAGA4_HUMAN)
LIPGTLEEY

SEQ ID NO: 66369 - protein, 10 aa, Artificial Sequence
  Description of Artificial Sequence: Synthetic peptide
  Seed: VDPASNTYTL (MAGA4_HUMAN)
VWPASNTYTF

SEQ ID NO: 66370 - protein, 10 aa, Artificial Sequence
  Description of Artificial Sequence: Synthetic peptide
  Seed: KVLEHVVRVN (MAGA4_HUMAN)
KMLEHVVRVF

SEQ ID NO: 66371 - protein, 10 aa, Artificial Sequence
  Description of Artificial Sequence: Synthetic peptide
  Seed: TQDWVQENYL (MAGA4_HUMAN)
THDWVQENYI

SEQ ID NO: 66372 - protein, 10 aa, Artificial Sequence
  Description of Artificial Sequence: Synthetic peptide
  Seed: YRQVPGSNPA (MAGA4_HUMAN)
YNQVPGSNPV

SEQ ID NO: 66373 - protein, 9 aa, Artificial Sequence
  Description of Artificial Sequence: Synthetic peptide
  Seed: VNARVRIAY (MAGA4_HUMAN)
VLARVRIAF

SEQ ID NO: 66374 - protein, 9 aa, Artificial Sequence
  Description of Artificial Sequence: Synthetic peptide
  Seed: VPGSNPARY (MAGA4_HUMAN)
VMGSNPARY

SEQ ID NO: 66375 - protein, 9 aa, Artificial Sequence
  Description of Artificial Sequence: Synthetic peptide
  Seed: LVPGTLEEV (MAGA4_HUMAN)
LAPGTLEEF

SEQ ID NO: 66376 - protein, 10 aa, Artificial Sequence
  Description of Artificial Sequence: Synthetic peptide
  Seed: VDPASNTYTL (MAGA4_HUMAN)
VKPASNTYTF

SEQ ID NO: 66377 - protein, 9 aa, Artificial Sequence
  Description of Artificial Sequence: Synthetic peptide
  Seed: YDGREHTVY (MAGA4_HUMAN)
YLGREHTVF

SEQ ID NO: 66378 - protein, 9 aa, Artificial Sequence
  Description of Artificial Sequence: Synthetic peptide
  Seed: QIFPKTGLL (MAGA4_HUMAN)
QSFPKTGLF

SEQ ID NO: 66379 - protein, 10 aa, Artificial Sequence
  Description of Artificial Sequence: Synthetic peptide
  Seed: RVRIAYPSLR (MAGA4_HUMAN)
RMRIAYPSLK

SEQ ID NO: 66380 - protein, 11 aa, Artificial Sequence
  Description of Artificial Sequence: Synthetic peptide
  Seed: AQAPTTEEQEA (MAGA4_HUMAN)
AIAPTTEEQEF

SEQ ID NO: 66381 - protein, 10 aa, Artificial Sequence
  Description of Artificial Sequence: Synthetic peptide
  Seed: WVQENYLEYR (MAGA4_HUMAN)
WFQENYLEYR

SEQ ID NO: 66382 - protein, 11 aa, Artificial Sequence
  Description of Artificial Sequence: Synthetic peptide
  Seed: YVKVLEHVVRV (MAGA4_HUMAN)
YYKVLEHVVRV

SEQ ID NO: 66383 - protein, 9 aa, Artificial Sequence
  Description of Artificial Sequence: Synthetic peptide
  Seed: KVLEHVVRV (MAGA4_HUMAN)
KTLEHVVRW

SEQ ID NO: 66384 - protein, 9 aa, Artificial Sequence
  Description of Artificial Sequence: Synthetic peptide
  Seed: IAYPSLREA (MAGA4_HUMAN)
ITYPSLREF

SEQ ID NO: 66385 - protein, 10 aa, Artificial Sequence
  Description of Artificial Sequence: Synthetic peptide
  Seed: KYRAKELVTK (MAGA4_HUMAN)
KTRAKELVTK

SEQ ID NO: 66386 - protein, 10 aa, Artificial Sequence
  Description of Artificial Sequence: Synthetic peptide
  Seed: RVRIAYPSLR (MAGA4_HUMAN)
RSRIAYPSLP

SEQ ID NO: 66387 - protein, 9 aa, Artificial Sequence
  Description of Artificial Sequence: Synthetic peptide
  Seed: KASESLKMI (MAGA4_HUMAN)
KASESLKMW

SEQ ID NO: 66388 - protein, 10 aa, Artificial Sequence
  Description of Artificial Sequence: Synthetic peptide
  Seed: MLERVIKNYK (MAGA4_HUMAN)
MQERVIKNYK

SEQ ID NO: 66389 - protein, 9 aa, Artificial Sequence
  Description of Artificial Sequence: Synthetic peptide
  Seed: AESLFREAL (MAGA4_HUMAN)
AQSLFREAI

SEQ ID NO: 66390 - protein, 10 aa, Artificial Sequence
  Description of Artificial Sequence: Synthetic peptide
  Seed: KNYKRCFPVI (MAGA4_HUMAN)
KLYKRCFPVF

SEQ ID NO: 66391 - protein, 10 aa, Artificial Sequence
  Description of Artificial Sequence: Synthetic peptide
  Seed: KVLEHVVRVN (MAGA4_HUMAN)
KMLEHVVRVC

SEQ ID NO: 66392 - protein, 11 aa, Artificial Sequence
  Description of Artificial Sequence: Synthetic peptide
  Seed: LSNKVDELAHF (MAGA4_HUMAN)
LINKVDELAHW

SEQ ID NO: 66393 - protein, 10 aa, Artificial Sequence
  Description of Artificial Sequence: Synthetic peptide
  Seed: QIFPKTGLLI (MAGA4_HUMAN)
QWFPKTGLLW

SEQ ID NO: 66394 - protein, 9 aa, Artificial Sequence
  Description of Artificial Sequence: Synthetic peptide
  Seed: AHFLLRKYR (MAGA4_HUMAN)
ANFLLRKYR

SEQ ID NO: 66395 - protein, 10 aa, Artificial Sequence
  Description of Artificial Sequence: Synthetic peptide
  Seed: LPTTISFTCW (MAGA4_HUMAN)
LGTTISFTCW

SEQ ID NO: 66396 - protein, 9 aa, Artificial Sequence
  Description of Artificial Sequence: Synthetic peptide
  Seed: SSPLVPGTL (MAGA4_HUMAN)
SFPLVPGTI

SEQ ID NO: 66397 - protein, 9 aa, Artificial Sequence
  Description of Artificial Sequence: Synthetic peptide
  Seed: KVLEHVVRV (MAGA4_HUMAN)
KGLEHVVRL

SEQ ID NO: 66398 - protein, 9 aa, Artificial Sequence
  Description of Artificial Sequence: Synthetic peptide
  Seed: VYDGREHTV (MAGA4_HUMAN)
VSDGREHTI

SEQ ID NO: 66399 - protein, 10 aa, Artificial Sequence
  Description of Artificial Sequence: Synthetic peptide
  Seed: PTTISFTCWR (MAGA4_HUMAN)
PMTISFTCWK

SEQ ID NO: 66400 - protein, 9 aa, Artificial Sequence
  Description of Artificial Sequence: Synthetic peptide
  Seed: KVLEHVVRV (MAGA4_HUMAN)
KGLEHVVRV

SEQ ID NO: 66401 - protein, 10 aa, Artificial Sequence
  Description of Artificial Sequence: Synthetic peptide
  Seed: SESLKMIFGI (MAGA4_HUMAN)
SESLKMIFGA

SEQ ID NO: 66402 - protein, 9 aa, Artificial Sequence
  Description of Artificial Sequence: Synthetic peptide
  Seed: ALSNKVDEL (MAGA4_HUMAN)
ALSNKVDEF

SEQ ID NO: 66403 - protein, 9 aa, Artificial Sequence
  Description of Artificial Sequence: Synthetic peptide
  Seed: IAYPSLREA (MAGA4_HUMAN)
ISYPSLREV

SEQ ID NO: 66404 - protein, 10 aa, Artificial Sequence
  Description of Artificial Sequence: Synthetic peptide
  Seed: RVRIAYPSLR (MAGA4_HUMAN)
RRRIAYPSLI

SEQ ID NO: 66405 - protein, 10 aa, Artificial Sequence
  Description of Artificial Sequence: Synthetic peptide
  Seed: TQDWVQENYL (MAGA4_HUMAN)
TSDWVQENYL

SEQ ID NO: 66406 - protein, 9 aa, Artificial Sequence
  Description of Artificial Sequence: Synthetic peptide
  Seed: ERVIKNYKR (MAGA4_HUMAN)
EIVIKNYKR

SEQ ID NO: 66407 - protein, 10 aa, Artificial Sequence
  Description of Artificial Sequence: Synthetic peptide
  Seed: VKVLEHVVRV (MAGA4_HUMAN)
VLVLEHVVRV

SEQ ID NO: 66408 - protein, 9 aa, Artificial Sequence
  Description of Artificial Sequence: Synthetic peptide
  Seed: SEEEIWEEL (MAGA4_HUMAN)
SMEEIWEEL

SEQ ID NO: 66409 - protein, 10 aa, Artificial Sequence
  Description of Artificial Sequence: Synthetic peptide
  Seed: TSYVKVLEHV (MAGA4_HUMAN)
TGYVKVLEHF

SEQ ID NO: 66410 - protein, 9 aa, Artificial Sequence
  Description of Artificial Sequence: Synthetic peptide
  Seed: NKVDELAHF (MAGA4_HUMAN)
NAVDELAHY

SEQ ID NO: 66411 - protein, 9 aa, Artificial Sequence
  Description of Artificial Sequence: Synthetic peptide
  Seed: AAVSSSSPL (MAGA4_HUMAN)
AMVSSSSPL

SEQ ID NO: 66412 - protein, 9 aa, Artificial Sequence
  Description of Artificial Sequence: Synthetic peptide
  Seed: STSPDAESL (MAGA4_HUMAN)
SVSPDAESV

SEQ ID NO: 66413 - protein, 9 aa, Artificial Sequence
  Description of Artificial Sequence: Synthetic peptide
  Seed: SSPLVPGTL (MAGA4_HUMAN)
SYPLVPGTV

SEQ ID NO: 66414 - protein, 9 aa, Artificial Sequence
  Description of Artificial Sequence: Synthetic peptide
  Seed: AAVSSSSPL (MAGA4_HUMAN)
AMVSSSSPF

SEQ ID NO: 66415 - protein, 9 aa, Artificial Sequence
  Description of Artificial Sequence: Synthetic peptide
  Seed: SPDAESLFR (MAGA4_HUMAN)
STDAESLFY

SEQ ID NO: 66416 - protein, 9 aa, Artificial Sequence
  Description of Artificial Sequence: Synthetic peptide
  Seed: DELAHFLLR (MAGA4_HUMAN)
DELAHFLLY

SEQ ID NO: 66417 - protein, 11 aa, Artificial Sequence
  Description of Artificial Sequence: Synthetic peptide
  Seed: RVRIAYPSLRE (MAGA4_HUMAN)
RLRIAYPSLRR

SEQ ID NO: 66418 - protein, 9 aa, Artificial Sequence
  Description of Artificial Sequence: Synthetic peptide
  Seed: SALPTTISF (MAGA4_HUMAN)
SWLPTTISL

SEQ ID NO: 66419 - protein, 10 aa, Artificial Sequence
  Description of Artificial Sequence: Synthetic peptide
  Seed: AYPSLREAAL (MAGA4_HUMAN)
AMPSLREAAM

SEQ ID NO: 66420 - protein, 9 aa, Artificial Sequence
  Description of Artificial Sequence: Synthetic peptide
  Seed: IAYPSLREA (MAGA4_HUMAN)
ISYPSLREM

SEQ ID NO: 66421 - protein, 10 aa, Artificial Sequence
  Description of Artificial Sequence: Synthetic peptide
  Seed: ESAGPPQSPQ (MAGA4_HUMAN)
EIAGPPQSPR

SEQ ID NO: 66422 - protein, 8 aa, Artificial Sequence
  Description of Artificial Sequence: Synthetic peptide
  Seed: VYGEPRKL (MAGA4_HUMAN)
VSGEPRKL

SEQ ID NO: 66423 - protein, 9 aa, Artificial Sequence
  Description of Artificial Sequence: Synthetic peptide
  Seed: SSSPLVPGT (MAGA4_HUMAN)
SMSPLVPGV

SEQ ID NO: 66424 - protein, 11 aa, Artificial Sequence
  Description of Artificial Sequence: Synthetic peptide
  Seed: ARVRIAYPSLR (MAGA4_HUMAN)
ARVRIAYPSLM

SEQ ID NO: 66425 - protein, 9 aa, Artificial Sequence
  Description of Artificial Sequence: Synthetic peptide
  Seed: RKYRAKELV (MAGA4_HUMAN)
RSYRAKELY

SEQ ID NO: 66426 - protein, 9 aa, Artificial Sequence
  Description of Artificial Sequence: Synthetic peptide
  Seed: YTLVTCLGL (MAGA4_HUMAN)
YTLVTCLGY

SEQ ID NO: 66427 - protein, 9 aa, Artificial Sequence
  Description of Artificial Sequence: Synthetic peptide
  Seed: IAYPSLREA (MAGA4_HUMAN)
IPYPSLREV

SEQ ID NO: 66428 - protein, 9 aa, Artificial Sequence
  Description of Artificial Sequence: Synthetic peptide
  Seed: SSPLVPGTL (MAGA4_HUMAN)
STPLVPGTW

SEQ ID NO: 66429 - protein, 10 aa, Artificial Sequence
  Description of Artificial Sequence: Synthetic peptide
  Seed: RVRIAYPSLR (MAGA4_HUMAN)
RLRIAYPSLS

SEQ ID NO: 66430 - protein, 10 aa, Artificial Sequence
  Description of Artificial Sequence: Synthetic peptide
  Seed: KNYKRCFPVI (MAGA4_HUMAN)
KSYKRCFPVL

SEQ ID NO: 66431 - protein, 9 aa, Artificial Sequence
  Description of Artificial Sequence: Synthetic peptide
  Seed: KASESLKMI (MAGA4_HUMAN)
KGSESLKMW

SEQ ID NO: 66432 - protein, 9 aa, Artificial Sequence
  Description of Artificial Sequence: Synthetic peptide
  Seed: LFREALSNK (MAGA4_HUMAN)
LTREALSNL

SEQ ID NO: 66433 - protein, 9 aa, Artificial Sequence
  Description of Artificial Sequence: Synthetic peptide
  Seed: ALLEEEEGV (MAGA4_HUMAN)
AQLEEEEGM

SEQ ID NO: 66434 - protein, 10 aa, Artificial Sequence
  Description of Artificial Sequence: Synthetic peptide
  Seed: SYVKVLEHVV (MAGA4_HUMAN)
SYVKVLEHVM

SEQ ID NO: 66435 - protein, 11 aa, Artificial Sequence
  Description of Artificial Sequence: Synthetic peptide
  Seed: IAYPSLREAAL (MAGA4_HUMAN)
IAYPSLREAAW

SEQ ID NO: 66436 - protein, 10 aa, Artificial Sequence
  Description of Artificial Sequence: Synthetic peptide
  Seed: RVRIAYPSLR (MAGA4_HUMAN)
RTRIAYPSLH

SEQ ID NO: 66437 - protein, 10 aa, Artificial Sequence
  Description of Artificial Sequence: Synthetic peptide
  Seed: RVRIAYPSLR (MAGA4_HUMAN)
RNRIAYPSLF

SEQ ID NO: 66438 - protein, 10 aa, Artificial Sequence
  Description of Artificial Sequence: Synthetic peptide
  Seed: MLERVIKNYK (MAGA4_HUMAN)
MAERVIKNYK

SEQ ID NO: 66439 - protein, 10 aa, Artificial Sequence
  Description of Artificial Sequence: Synthetic peptide
  Seed: RVNARVRIAY (MAGA4_HUMAN)
RSNARVRIAV

SEQ ID NO: 66440 - protein, 9 aa, Artificial Sequence
  Description of Artificial Sequence: Synthetic peptide
  Seed: RVRIAYPSL (MAGA4_HUMAN)
RTRIAYPSM

SEQ ID NO: 66441 - protein, 9 aa, Artificial Sequence
  Description of Artificial Sequence: Synthetic peptide
  Seed: LVPGTLEEV (MAGA4_HUMAN)
LCPGTLEEL

SEQ ID NO: 66442 - protein, 9 aa, Artificial Sequence
  Description of Artificial Sequence: Synthetic peptide
  Seed: TQDWVQENY (MAGA4_HUMAN)
TSDWVQENY

SEQ ID NO: 66443 - protein, 11 aa, Artificial Sequence
  Description of Artificial Sequence: Synthetic peptide
  Seed: IAMEGDSASEE (MAGA4_HUMAN)
ITMEGDSASEL

SEQ ID NO: 66444 - protein, 8 aa, Artificial Sequence
  Description of Artificial Sequence: Synthetic peptide
  Seed: KVDELAHF (MAGA4_HUMAN)
KYDELAHF

SEQ ID NO: 66445 - protein, 9 aa, Artificial Sequence
  Description of Artificial Sequence: Synthetic peptide
  Seed: NTYTLVTCL (MAGA4_HUMAN)
NTYTLVTCR

SEQ ID NO: 66446 - protein, 9 aa, Artificial Sequence
  Description of Artificial Sequence: Synthetic peptide
  Seed: YPSLREAAL (MAGA4_HUMAN)
YPSLREAAI

SEQ ID NO: 66447 - protein, 8 aa, Artificial Sequence
  Description of Artificial Sequence: Synthetic peptide
  Seed: RVRIAYPS (MAGA4_HUMAN)
RTRIAYPL

SEQ ID NO: 66448 - protein, 9 aa, Artificial Sequence
  Description of Artificial Sequence: Synthetic peptide
  Seed: SYVKVLEHV (MAGA4_HUMAN)
SAVKVLEHL

SEQ ID NO: 66449 - protein, 9 aa, Artificial Sequence
  Description of Artificial Sequence: Synthetic peptide
  Seed: IIVLGTIAM (MAGA4_HUMAN)
IVVLGTIAY

SEQ ID NO: 66450 - protein, 10 aa, Artificial Sequence
  Description of Artificial Sequence: Synthetic peptide
  Seed: KVLEHVVRVN (MAGA4_HUMAN)
KLLEHVVRVE

SEQ ID NO: 66451 - protein, 10 aa, Artificial Sequence
  Description of Artificial Sequence: Synthetic peptide
  Seed: QIFPKTGLLI (MAGA4_HUMAN)
QMFPKTGLLW

SEQ ID NO: 66452 - protein, 11 aa, Artificial Sequence
  Description of Artificial Sequence: Synthetic peptide
  Seed: YVKVLEHVVRV (MAGA4_HUMAN)
YLKVLEHVVRI

SEQ ID NO: 66453 - protein, 9 aa, Artificial Sequence
  Description of Artificial Sequence: Synthetic peptide
  Seed: AAVSSSSPL (MAGA4_HUMAN)
ALVSSSSPV

SEQ ID NO: 66454 - protein, 10 aa, Artificial Sequence
  Description of Artificial Sequence: Synthetic peptide
  Seed: EHTVYGEPRK (MAGA4_HUMAN)
EWTVYGEPRR

SEQ ID NO: 66455 - protein, 9 aa, Artificial Sequence
  Description of Artificial Sequence: Synthetic peptide
  Seed: QIFPKTGLL (MAGA4_HUMAN)
QTFPKTGLM

SEQ ID NO: 66456 - protein, 9 aa, Artificial Sequence
  Description of Artificial Sequence: Synthetic peptide
  Seed: MSSEQKSQH (MAGA4_HUMAN)
MSSEQKSQF

SEQ ID NO: 66457 - protein, 10 aa, Artificial Sequence
  Description of Artificial Sequence: Synthetic peptide
  Seed: RVRIAYPSLR (MAGA4_HUMAN)
RSRIAYPSLQ

SEQ ID NO: 66458 - protein, 11 aa, Artificial Sequence
  Description of Artificial Sequence: Synthetic peptide
  Seed: QHCKPEEGVEA (MAGA4_HUMAN)
QHCKPEEGVEI

SEQ ID NO: 66459 - protein, 11 aa, Artificial Sequence
  Description of Artificial Sequence: Synthetic peptide
  Seed: AQAPTTEEQEA (MAGA4_HUMAN)
AQAPTTEEQEV

SEQ ID NO: 66460 - protein, 10 aa, Artificial Sequence
  Description of Artificial Sequence: Synthetic peptide
  Seed: YRQVPGSNPA (MAGA4_HUMAN)
YSQVPGSNPW

SEQ ID NO: 66461 - protein, 9 aa, Artificial Sequence
  Description of Artificial Sequence: Synthetic peptide
  Seed: SALPTTISF (MAGA4_HUMAN)
SPLPTTISF

SEQ ID NO: 66462 - protein, 10 aa, Artificial Sequence
  Description of Artificial Sequence: Synthetic peptide
  Seed: MLERVIKNYK (MAGA4_HUMAN)
MSERVIKNYK

SEQ ID NO: 66463 - protein, 8 aa, Artificial Sequence
  Description of Artificial Sequence: Synthetic peptide
  Seed: TSPDAESL (MAGA4_HUMAN)
TAPDAESL

SEQ ID NO: 66464 - protein, 9 aa, Artificial Sequence
  Description of Artificial Sequence: Synthetic peptide
  Seed: SALPTTISF (MAGA4_HUMAN)
SLLPTTISM

SEQ ID NO: 66465 - protein, 10 aa, Artificial Sequence
  Description of Artificial Sequence: Synthetic peptide
  Seed: YPSLREAALL (MAGA4_HUMAN)
YESLREAALY

SEQ ID NO: 66466 - protein, 9 aa, Artificial Sequence
  Description of Artificial Sequence: Synthetic peptide
  Seed: AESAGPPQS (MAGA4_HUMAN)
AESAGPPQC

SEQ ID NO: 66467 - protein, 8 aa, Artificial Sequence
  Description of Artificial Sequence: Synthetic peptide
  Seed: RVRIAYPS (MAGA4_HUMAN)
RSRIAYPK

SEQ ID NO: 66468 - protein, 9 aa, Artificial Sequence
  Description of Artificial Sequence: Synthetic peptide
  Seed: KVLEHVVRV (MAGA4_HUMAN)
KSLEHVVRW

SEQ ID NO: 66469 - protein, 10 aa, Artificial Sequence
  Description of Artificial Sequence: Synthetic peptide
  Seed: GVYDGREHTV (MAGA4_HUMAN)
GQYDGREHTW

SEQ ID NO: 66470 - protein, 10 aa, Artificial Sequence
  Description of Artificial Sequence: Synthetic peptide
  Seed: EHVVRVNARV (MAGA4_HUMAN)
ENVVRVNARV

SEQ ID NO: 66471 - protein, 10 aa, Artificial Sequence
  Description of Artificial Sequence: Synthetic peptide
  Seed: KNYKRCFPVI (MAGA4_HUMAN)
KVYKRCFPVL

SEQ ID NO: 66472 - protein, 10 aa, Artificial Sequence
  Description of Artificial Sequence: Synthetic peptide
  Seed: MLERVIKNYK (MAGA4_HUMAN)
MIERVIKNYR

SEQ ID NO: 66473 - protein, 9 aa, Artificial Sequence
  Description of Artificial Sequence: Synthetic peptide
  Seed: LRKYRAKEL (MAGA4_HUMAN)
LMKYRAKEM

SEQ ID NO: 66474 - protein, 9 aa, Artificial Sequence
  Description of Artificial Sequence: Synthetic peptide
  Seed: TVYGEPRKL (MAGA4_HUMAN)
TYYGEPRKL

SEQ ID NO: 66475 - protein, 9 aa, Artificial Sequence
  Description of Artificial Sequence: Synthetic peptide
  Seed: TTISFTCWR (MAGA4_HUMAN)
TVISFTCWK

SEQ ID NO: 66476 - protein, 9 aa, Artificial Sequence
  Description of Artificial Sequence: Synthetic peptide
  Seed: AAVSSSSPL (MAGA4_HUMAN)
ARVSSSSPY

SEQ ID NO: 66477 - protein, 8 aa, Artificial Sequence
  Description of Artificial Sequence: Synthetic peptide
  Seed: VYGEPRKL (MAGA4_HUMAN)
VAGEPRKY

SEQ ID NO: 66478 - protein, 9 aa, Artificial Sequence
  Description of Artificial Sequence: Synthetic peptide
  Seed: STSPDAESL (MAGA4_HUMAN)
SMSPDAESI

SEQ ID NO: 66479 - protein, 10 aa, Artificial Sequence
  Description of Artificial Sequence: Synthetic peptide
  Seed: HFLLRKYRAK (MAGA4_HUMAN)
HVLLRKYRAR

SEQ ID NO: 66480 - protein, 10 aa, Artificial Sequence
  Description of Artificial Sequence: Synthetic peptide
  Seed: SLFREALSNK (MAGA4_HUMAN)
SSFREALSNR

SEQ ID NO: 66481 - protein, 11 aa, Artificial Sequence
  Description of Artificial Sequence: Synthetic peptide
  Seed: ALPTTISFTCW (MAGA4_HUMAN)
ATPTTISFTCW

SEQ ID NO: 66482 - protein, 10 aa, Artificial Sequence
  Description of Artificial Sequence: Synthetic peptide
  Seed: TQDWVQENYL (MAGA4_HUMAN)
THDWVQENYL

SEQ ID NO: 66483 - protein, 9 aa, Artificial Sequence
  Description of Artificial Sequence: Synthetic peptide
  Seed: ALSNKVDEL (MAGA4_HUMAN)
AVSNKVDEV

SEQ ID NO: 66484 - protein, 10 aa, Artificial Sequence
  Description of Artificial Sequence: Synthetic peptide
  Seed: LTQDWVQENY (MAGA4_HUMAN)
LVQDWVQENY

SEQ ID NO: 66485 - protein, 11 aa, Artificial Sequence
  Description of Artificial Sequence: Synthetic peptide
  Seed: ELAHFLLRKYR (MAGA4_HUMAN)
ETAHFLLRKYK

SEQ ID NO: 66486 - protein, 10 aa, Artificial Sequence
  Description of Artificial Sequence: Synthetic peptide
  Seed: YPSLREAALL (MAGA4_HUMAN)
YLSLREAALW

SEQ ID NO: 66487 - protein, 9 aa, Artificial Sequence
  Description of Artificial Sequence: Synthetic peptide
  Seed: KYRAKELVT (MAGA4_HUMAN)
KSRAKELVM

SEQ ID NO: 66488 - protein, 10 aa, Artificial Sequence
  Description of Artificial Sequence: Synthetic peptide
  Seed: KVDELAHFLL (MAGA4_HUMAN)
KLDELAHFLQ

SEQ ID NO: 66489 - protein, 10 aa, Artificial Sequence
  Description of Artificial Sequence: Synthetic peptide
  Seed: REAALLEEEE (MAGA4_HUMAN)
REAALLEEEM

SEQ ID NO: 66490 - protein, 10 aa, Artificial Sequence
  Description of Artificial Sequence: Synthetic peptide
  Seed: RVRIAYPSLR (MAGA4_HUMAN)
RNRIAYPSLR

SEQ ID NO: 66491 - protein, 9 aa, Artificial Sequence
  Description of Artificial Sequence: Synthetic peptide
  Seed: RQVPGSNPA (MAGA4_HUMAN)
RVVPGSNPM

SEQ ID NO: 66492 - protein, 9 aa, Artificial Sequence
  Description of Artificial Sequence: Synthetic peptide
  Seed: KVDELAHFL (MAGA4_HUMAN)
KQDELAHFI

SEQ ID NO: 66493 - protein, 9 aa, Artificial Sequence
  Description of Artificial Sequence: Synthetic peptide
  Seed: YDGREHTVY (MAGA4_HUMAN)
YAGREHTVM

SEQ ID NO: 66494 - protein, 10 aa, Artificial Sequence
  Description of Artificial Sequence: Synthetic peptide
  Seed: KVDELAHFLL (MAGA4_HUMAN)
KLDELAHFLP

SEQ ID NO: 66495 - protein, 9 aa, Artificial Sequence
  Description of Artificial Sequence: Synthetic peptide
  Seed: RKYRAKELV (MAGA4_HUMAN)
RKYRAKELF

SEQ ID NO: 66496 - protein, 9 aa, Artificial Sequence
  Description of Artificial Sequence: Synthetic peptide
  Seed: VYGEPRKLL (MAGA4_HUMAN)
VAGEPRKLM

SEQ ID NO: 66497 - protein, 9 aa, Artificial Sequence
  Description of Artificial Sequence: Synthetic peptide
  Seed: RVRIAYPSL (MAGA4_HUMAN)
RFRIAYPSQ

SEQ ID NO: 66498 - protein, 9 aa, Artificial Sequence
  Description of Artificial Sequence: Synthetic peptide
  Seed: SYVKVLEHV (MAGA4_HUMAN)
STVKVLEHI

SEQ ID NO: 66499 - protein, 9 aa, Artificial Sequence
  Description of Artificial Sequence: Synthetic peptide
  Seed: VVRVNARVR (MAGA4_HUMAN)
VYRVNARVK

SEQ ID NO: 66500 - protein, 9 aa, Artificial Sequence
  Description of Artificial Sequence: Synthetic peptide
  Seed: SEQKSQHCK (MAGA4_HUMAN)
SEQKSQHCV

SEQ ID NO: 66501 - protein, 10 aa, Artificial Sequence
  Description of Artificial Sequence: Synthetic peptide
  Seed: YRQVPGSNPA (MAGA4_HUMAN)
YVQVPGSNPM

SEQ ID NO: 66502 - protein, 9 aa, Artificial Sequence
  Description of Artificial Sequence: Synthetic peptide
  Seed: VTKAEMLER (MAGA4_HUMAN)
VLKAEMLEK

SEQ ID NO: 66503 - protein, 10 aa, Artificial Sequence
  Description of Artificial Sequence: Synthetic peptide
  Seed: STSPDAESLF (MAGA4_HUMAN)
SISPDAESLY

SEQ ID NO: 66504 - protein, 9 aa, Artificial Sequence
  Description of Artificial Sequence: Synthetic peptide
  Seed: GDSASEEEI (MAGA4_HUMAN)
GESASEEEI

SEQ ID NO: 66505 - protein, 9 aa, Artificial Sequence
  Description of Artificial Sequence: Synthetic peptide
  Seed: KVDELAHFL (MAGA4_HUMAN)
KIDELAHFV

SEQ ID NO: 66506 - protein, 11 aa, Artificial Sequence
  Description of Artificial Sequence: Synthetic peptide
  Seed: YVKVLEHVVRV (MAGA4_HUMAN)
YDKVLEHVVRV

SEQ ID NO: 66507 - protein, 9 aa, Artificial Sequence
  Description of Artificial Sequence: Synthetic peptide
  Seed: IIVLGTIAM (MAGA4_HUMAN)
IRVLGTIAF

SEQ ID NO: 66508 - protein, 10 aa, Artificial Sequence
  Description of Artificial Sequence: Synthetic peptide
  Seed: RVRIAYPSLR (MAGA4_HUMAN)
RIRIAYPSLF

SEQ ID NO: 66509 - protein, 11 aa, Artificial Sequence
  Description of Artificial Sequence: Synthetic peptide
  Seed: ARVRIAYPSLR (MAGA4_HUMAN)
ARVRIAYPSLL

SEQ ID NO: 66510 - protein, 10 aa, Artificial Sequence
  Description of Artificial Sequence: Synthetic peptide
  Seed: KNYKRCFPVI (MAGA4_HUMAN)
KQYKRCFPVF

SEQ ID NO: 66511 - protein, 9 aa, Artificial Sequence
  Description of Artificial Sequence: Synthetic peptide
  Seed: VYDGREHTV (MAGA4_HUMAN)
VADGREHTF

SEQ ID NO: 66512 - protein, 10 aa, Artificial Sequence
  Description of Artificial Sequence: Synthetic peptide
  Seed: RVRIAYPSLR (MAGA4_HUMAN)
RRRIAYPSLL

SEQ ID NO: 66513 - protein, 11 aa, Artificial Sequence
  Description of Artificial Sequence: Synthetic peptide
  Seed: SASEEEIWEEL (MAGA4_HUMAN)
SLSEEEIWEEF

SEQ ID NO: 66514 - protein, 10 aa, Artificial Sequence
  Description of Artificial Sequence: Synthetic peptide
  Seed: TSPDAESLFR (MAGA4_HUMAN)
TAPDAESLFY

SEQ ID NO: 66515 - protein, 9 aa, Artificial Sequence
  Description of Artificial Sequence: Synthetic peptide
  Seed: ALSNKVDEL (MAGA4_HUMAN)
AQSNKVDEL

SEQ ID NO: 66516 - protein, 9 aa, Artificial Sequence
  Description of Artificial Sequence: Synthetic peptide
  Seed: NKVDELAHF (MAGA4_HUMAN)
NRVDELAHF

SEQ ID NO: 66517 - protein, 9 aa, Artificial Sequence
  Description of Artificial Sequence: Synthetic peptide
  Seed: RVRIAYPSL (MAGA4_HUMAN)
RQRIAYPSH

SEQ ID NO: 66518 - protein, 10 aa, Artificial Sequence
  Description of Artificial Sequence: Synthetic peptide
  Seed: ASALPTTISF (MAGA4_HUMAN)
AKALPTTISM

SEQ ID NO: 66519 - protein, 8 aa, Artificial Sequence
  Description of Artificial Sequence: Synthetic peptide
  Seed: KVDELAHF (MAGA4_HUMAN)
KVDELAHL

SEQ ID NO: 66520 - protein, 11 aa, Artificial Sequence
  Description of Artificial Sequence: Synthetic peptide
  Seed: AEMLERVIKNY (MAGA4_HUMAN)
AEMLERVIKNF

SEQ ID NO: 66521 - protein, 9 aa, Artificial Sequence
  Description of Artificial Sequence: Synthetic peptide
  Seed: GTLEEVPAA (MAGA4_HUMAN)
GVLEEVPAA

SEQ ID NO: 66522 - protein, 8 aa, Artificial Sequence
  Description of Artificial Sequence: Synthetic peptide
  Seed: FPKTGLLI (MAGA4_HUMAN)
FPKTGLLL

SEQ ID NO: 66523 - protein, 9 aa, Artificial Sequence
  Description of Artificial Sequence: Synthetic peptide
  Seed: RAKELVTKA (MAGA4_HUMAN)
RYKELVTKK

SEQ ID NO: 66524 - protein, 9 aa, Artificial Sequence
  Description of Artificial Sequence: Synthetic peptide
  Seed: RVRIAYPSL (MAGA4_HUMAN)
RPRIAYPSA

SEQ ID NO: 66525 - protein, 10 aa, Artificial Sequence
  Description of Artificial Sequence: Synthetic peptide
  Seed: VIFGKASESL (MAGA4_HUMAN)
VAFGKASESY

SEQ ID NO: 66526 - protein, 9 aa, Artificial Sequence
  Description of Artificial Sequence: Synthetic peptide
  Seed: KVDELAHFL (MAGA4_HUMAN)
KNDELAHFM

SEQ ID NO: 66527 - protein, 10 aa, Artificial Sequence
  Description of Artificial Sequence: Synthetic peptide
  Seed: TTISFTCWRQ (MAGA4_HUMAN)
TTISFTCWRL

SEQ ID NO: 66528 - protein, 10 aa, Artificial Sequence
  Description of Artificial Sequence: Synthetic peptide
  Seed: DPASNTYTLV (MAGA4_HUMAN)
DIASNTYTLV

SEQ ID NO: 66529 - protein, 11 aa, Artificial Sequence
  Description of Artificial Sequence: Synthetic peptide
  Seed: REALSNKVDEL (MAGA4_HUMAN)
REALSNKVDEY

SEQ ID NO: 66530 - protein, 9 aa, Artificial Sequence
  Description of Artificial Sequence: Synthetic peptide
  Seed: TQDWVQENY (MAGA4_HUMAN)
TIDWVQENI

SEQ ID NO: 66531 - protein, 9 aa, Artificial Sequence
  Description of Artificial Sequence: Synthetic peptide
  Seed: TEEQEAAVS (MAGA4_HUMAN)
TEEQEAAVI

SEQ ID NO: 66532 - protein, 9 aa, Artificial Sequence
  Description of Artificial Sequence: Synthetic peptide
  Seed: VRIAYPSLR (MAGA4_HUMAN)
VSIAYPSLR

SEQ ID NO: 66533 - protein, 9 aa, Artificial Sequence
  Description of Artificial Sequence: Synthetic peptide
  Seed: SEEEIWEEL (MAGA4_HUMAN)
STEEIWEEM

SEQ ID NO: 66534 - protein, 9 aa, Artificial Sequence
  Description of Artificial Sequence: Synthetic peptide
  Seed: LGNNQIFPK (MAGA4_HUMAN)
LTNNQIFPR

SEQ ID NO: 66535 - protein, 9 aa, Artificial Sequence
  Description of Artificial Sequence: Synthetic peptide
  Seed: YKRCFPVIF (MAGA4_HUMAN)
YRRCFPVIF

SEQ ID NO: 66536 - protein, 9 aa, Artificial Sequence
  Description of Artificial Sequence: Synthetic peptide
  Seed: SAGPPQSPQ (MAGA4_HUMAN)
SAGPPQSPA

SEQ ID NO: 66537 - protein, 9 aa, Artificial Sequence
  Description of Artificial Sequence: Synthetic peptide
  Seed: RVRIAYPSL (MAGA4_HUMAN)
RHRIAYPSK

SEQ ID NO: 66538 - protein, 10 aa, Artificial Sequence
  Description of Artificial Sequence: Synthetic peptide
  Seed: RVNARVRIAY (MAGA4_HUMAN)
RLNARVRIAY

SEQ ID NO: 66539 - protein, 10 aa, Artificial Sequence
  Description of Artificial Sequence: Synthetic peptide
  Seed: PTTISFTCWR (MAGA4_HUMAN)
PHTISFTCWR

SEQ ID NO: 66540 - protein, 9 aa, Artificial Sequence
  Description of Artificial Sequence: Synthetic peptide
  Seed: AHFLLRKYR (MAGA4_HUMAN)
AVFLLRKYK

SEQ ID NO: 66541 - protein, 9 aa, Artificial Sequence
  Description of Artificial Sequence: Synthetic peptide
  Seed: RVRIAYPSL (MAGA4_HUMAN)
RCRIAYPSV

SEQ ID NO: 66542 - protein, 10 aa, Artificial Sequence
  Description of Artificial Sequence: Synthetic peptide
  Seed: RVRIAYPSLR (MAGA4_HUMAN)
RSRIAYPSLM

SEQ ID NO: 66543 - protein, 10 aa, Artificial Sequence
  Description of Artificial Sequence: Synthetic peptide
  Seed: VYDGREHTVY (MAGA4_HUMAN)
VLDGREHTVY

SEQ ID NO: 66544 - protein, 10 aa, Artificial Sequence
  Description of Artificial Sequence: Synthetic peptide
  Seed: SESLKMIFGI (MAGA4_HUMAN)
SKSLKMIFGW

SEQ ID NO: 66545 - protein, 9 aa, Artificial Sequence
  Description of Artificial Sequence: Synthetic peptide
  Seed: QIFPKTGLL (MAGA4_HUMAN)
QTFPKTGLA

SEQ ID NO: 66546 - protein, 10 aa, Artificial Sequence
  Description of Artificial Sequence: Synthetic peptide
  Seed: KYRAKELVTK (MAGA4_HUMAN)
KTRAKELVTT

SEQ ID NO: 66547 - protein, 10 aa, Artificial Sequence
  Description of Artificial Sequence: Synthetic peptide
  Seed: KEVDPASNTY (MAGA4_HUMAN)
KEVDPASNTV

SEQ ID NO: 66548 - protein, 10 aa, Artificial Sequence
  Description of Artificial Sequence: Synthetic peptide
  Seed: ARVRIAYPSL (MAGA4_HUMAN)
AHVRIAYPSV

SEQ ID NO: 66549 - protein, 9 aa, Artificial Sequence
  Description of Artificial Sequence: Synthetic peptide
  Seed: RAKELVTKA (MAGA4_HUMAN)
RIKELVTKA

SEQ ID NO: 66550 - protein, 9 aa, Artificial Sequence
  Description of Artificial Sequence: Synthetic peptide
  Seed: SNKVDELAH (MAGA4_HUMAN)
SAKVDELAF

SEQ ID NO: 66551 - protein, 9 aa, Artificial Sequence
  Description of Artificial Sequence: Synthetic peptide
  Seed: TVYGEPRKL (MAGA4_HUMAN)
TPYGEPRKI

SEQ ID NO: 66552 - protein, 10 aa, Artificial Sequence
  Description of Artificial Sequence: Synthetic peptide
  Seed: RQVPGSNPAR (MAGA4_HUMAN)
RSVPGSNPAF

SEQ ID NO: 66553 - protein, 9 aa, Artificial Sequence
  Description of Artificial Sequence: Synthetic peptide
  Seed: GLLGNNQIF (MAGA4_HUMAN)
GKLGNNQIF

SEQ ID NO: 66554 - protein, 10 aa, Artificial Sequence
  Description of Artificial Sequence: Synthetic peptide
  Seed: KRCFPVIFGK (MAGA4_HUMAN)
KICFPVIFGK

SEQ ID NO: 66555 - protein, 9 aa, Artificial Sequence
  Description of Artificial Sequence: Synthetic peptide
  Seed: LVPGTLEEV (MAGA4_HUMAN)
LTPGTLEEL

SEQ ID NO: 66556 - protein, 9 aa, Artificial Sequence
  Description of Artificial Sequence: Synthetic peptide
  Seed: RVRIAYPSL (MAGA4_HUMAN)
RVRIAYPST

SEQ ID NO: 66557 - protein, 9 aa, Artificial Sequence
  Description of Artificial Sequence: Synthetic peptide
  Seed: VNARVRIAY (MAGA4_HUMAN)
VAARVRIAM

SEQ ID NO: 66558 - protein, 11 aa, Artificial Sequence
  Description of Artificial Sequence: Synthetic peptide
  Seed: RQVPGSNPARY (MAGA4_HUMAN)
RMVPGSNPARR

SEQ ID NO: 66559 - protein, 9 aa, Artificial Sequence
  Description of Artificial Sequence: Synthetic peptide
  Seed: VYDGREHTV (MAGA4_HUMAN)
VNDGREHTF

SEQ ID NO: 66560 - protein, 10 aa, Artificial Sequence
  Description of Artificial Sequence: Synthetic peptide
  Seed: LTQDWVQENY (MAGA4_HUMAN)
LIQDWVQENW

SEQ ID NO: 66561 - protein, 9 aa, Artificial Sequence
  Description of Artificial Sequence: Synthetic peptide
  Seed: IFGIDVKEV (MAGA4_HUMAN)
IYGIDVKEL

SEQ ID NO: 66562 - protein, 11 aa, Artificial Sequence
  Description of Artificial Sequence: Synthetic peptide
  Seed: RQVPGSNPARY (MAGA4_HUMAN)
RAVPGSNPARR

SEQ ID NO: 66563 - protein, 10 aa, Artificial Sequence
  Description of Artificial Sequence: Synthetic peptide
  Seed: ARVRIAYPSL (MAGA4_HUMAN)
ANVRIAYPSK

SEQ ID NO: 66564 - protein, 11 aa, Artificial Sequence
  Description of Artificial Sequence: Synthetic peptide
  Seed: TEEQEAAVSSS (MAGA4_HUMAN)
TEEQEAAVSSA

SEQ ID NO: 66565 - protein, 9 aa, Artificial Sequence
  Description of Artificial Sequence: Synthetic peptide
  Seed: AAVSSSSPL (MAGA4_HUMAN)
APVSSSSPV

SEQ ID NO: 66566 - protein, 10 aa, Artificial Sequence
  Description of Artificial Sequence: Synthetic peptide
  Seed: KYRAKELVTK (MAGA4_HUMAN)
KYRAKELVTA

SEQ ID NO: 66567 - protein, 9 aa, Artificial Sequence
  Description of Artificial Sequence: Synthetic peptide
  Seed: YPSLREAAL (MAGA4_HUMAN)
YISLREAAL

SEQ ID NO: 66568 - protein, 9 aa, Artificial Sequence
  Description of Artificial Sequence: Synthetic peptide
  Seed: GVMGVYDGR (MAGA4_HUMAN)
GMMGVYDGK

SEQ ID NO: 66569 - protein, 10 aa, Artificial Sequence
  Description of Artificial Sequence: Synthetic peptide
  Seed: TSYVKVLEHV (MAGA4_HUMAN)
TYYVKVLEHI

SEQ ID NO: 66570 - protein, 9 aa, Artificial Sequence
  Description of Artificial Sequence: Synthetic peptide
  Seed: RVRIAYPSL (MAGA4_HUMAN)
RHRIAYPSF

SEQ ID NO: 66571 - protein, 10 aa, Artificial Sequence
  Description of Artificial Sequence: Synthetic peptide
  Seed: TTISFTCWRQ (MAGA4_HUMAN)
TTISFTCWRY

SEQ ID NO: 66572 - protein, 9 aa, Artificial Sequence
  Description of Artificial Sequence: Synthetic peptide
  Seed: VYDGREHTV (MAGA4_HUMAN)
VVDGREHTL

SEQ ID NO: 66573 - protein, 9 aa, Artificial Sequence
  Description of Artificial Sequence: Synthetic peptide
  Seed: EVDPASNTY (MAGA4_HUMAN)
EADPASNTV

SEQ ID NO: 66574 - protein, 9 aa, Artificial Sequence
  Description of Artificial Sequence: Synthetic peptide
  Seed: RVRIAYPSL (MAGA4_HUMAN)
RMRIAYPSS

SEQ ID NO: 66575 - protein, 11 aa, Artificial Sequence
  Description of Artificial Sequence: Synthetic peptide
  Seed: YVKVLEHVVRV (MAGA4_HUMAN)
YNKVLEHVVRV

SEQ ID NO: 66576 - protein, 9 aa, Artificial Sequence
  Description of Artificial Sequence: Synthetic peptide
  Seed: VYDGREHTV (MAGA4_HUMAN)
VWDGREHTC

SEQ ID NO: 66577 - protein, 10 aa, Artificial Sequence
  Description of Artificial Sequence: Synthetic peptide
  Seed: PTTISFTCWR (MAGA4_HUMAN)
PETISFTCWR

SEQ ID NO: 66578 - protein, 9 aa, Artificial Sequence
  Description of Artificial Sequence: Synthetic peptide
  Seed: KVDELAHFL (MAGA4_HUMAN)
KYDELAHFL

SEQ ID NO: 66579 - protein, 10 aa, Artificial Sequence
  Description of Artificial Sequence: Synthetic peptide
  Seed: RQVPGSNPAR (MAGA4_HUMAN)
RRVPGSNPAY

SEQ ID NO: 66580 - protein, 9 aa, Artificial Sequence
  Description of Artificial Sequence: Synthetic peptide
  Seed: NTYTLVTCL (MAGA4_HUMAN)
NIYTLVTCR

SEQ ID NO: 66581 - protein, 10 aa, Artificial Sequence
  Description of Artificial Sequence: Synthetic peptide
  Seed: QEEEGPSTSP (MAGA4_HUMAN)
QEEEGPSTSA

SEQ ID NO: 66582 - protein, 9 aa, Artificial Sequence
  Description of Artificial Sequence: Synthetic peptide
  Seed: KVLEHVVRV (MAGA4_HUMAN)
KNLEHVVRM

SEQ ID NO: 66583 - protein, 9 aa, Artificial Sequence
  Description of Artificial Sequence: Synthetic peptide
  Seed: SYVKVLEHV (MAGA4_HUMAN)
SMVKVLEHA

SEQ ID NO: 66584 - protein, 9 aa, Artificial Sequence
  Description of Artificial Sequence: Synthetic peptide
  Seed: SQEEEGPST (MAGA4_HUMAN)
SEEEEGPSL

SEQ ID NO: 66585 - protein, 10 aa, Artificial Sequence
  Description of Artificial Sequence: Synthetic peptide
  Seed: SLFREALSNK (MAGA4_HUMAN)
SYFREALSNR

SEQ ID NO: 66586 - protein, 11 aa, Artificial Sequence
  Description of Artificial Sequence: Synthetic peptide
  Seed: RVRIAYPSLRE (MAGA4_HUMAN)
RVRIAYPSLRK

SEQ ID NO: 66587 - protein, 10 aa, Artificial Sequence
  Description of Artificial Sequence: Synthetic peptide
  Seed: RVRIAYPSLR (MAGA4_HUMAN)
RTRIAYPSLR

SEQ ID NO: 66588 - protein, 9 aa, Artificial Sequence
  Description of Artificial Sequence: Synthetic peptide
  Seed: AAVSSSSPL (MAGA4_HUMAN)
AQVSSSSPI

SEQ ID NO: 66589 - protein, 9 aa, Artificial Sequence
  Description of Artificial Sequence: Synthetic peptide
  Seed: IIVLGTIAM (MAGA4_HUMAN)
IAVLGTIAM

SEQ ID NO: 66590 - protein, 9 aa, Artificial Sequence
  Description of Artificial Sequence: Synthetic peptide
  Seed: GVYDGREHT (MAGA4_HUMAN)
GAYDGREHV

SEQ ID NO: 66591 - protein, 9 aa, Artificial Sequence
  Description of Artificial Sequence: Synthetic peptide
  Seed: QSPQGASAL (MAGA4_HUMAN)
QPPQGASAM

SEQ ID NO: 66592 - protein, 10 aa, Artificial Sequence
  Description of Artificial Sequence: Synthetic peptide
  Seed: AYPSLREAAL (MAGA4_HUMAN)
AQPSLREAAL

SEQ ID NO: 66593 - protein, 9 aa, Artificial Sequence
  Description of Artificial Sequence: Synthetic peptide
  Seed: IIVLGTIAM (MAGA4_HUMAN)
IPVLGTIAF

SEQ ID NO: 66594 - protein, 11 aa, Artificial Sequence
  Description of Artificial Sequence: Synthetic peptide
  Seed: IAYPSLREAAL (MAGA4_HUMAN)
IAYPSLREAAY

SEQ ID NO: 66595 - protein, 9 aa, Artificial Sequence
  Description of Artificial Sequence: Synthetic peptide
  Seed: EAQEEALGL (MAGA4_HUMAN)
EEQEEALGM

SEQ ID NO: 66596 - protein, 9 aa, Artificial Sequence
  Description of Artificial Sequence: Synthetic peptide
  Seed: KVDELAHFL (MAGA4_HUMAN)
KMDELAHFI

SEQ ID NO: 66597 - protein, 11 aa, Artificial Sequence
  Description of Artificial Sequence: Synthetic peptide
  Seed: RQVPGSNPARY (MAGA4_HUMAN)
RKVPGSNPARF

SEQ ID NO: 66598 - protein, 9 aa, Artificial Sequence
  Description of Artificial Sequence: Synthetic peptide
  Seed: RKYRAKELV (MAGA4_HUMAN)
RRYRAKELV

SEQ ID NO: 66599 - protein, 10 aa, Artificial Sequence
  Description of Artificial Sequence: Synthetic peptide
  Seed: RQVPGSNPAR (MAGA4_HUMAN)
RSVPGSNPAK

SEQ ID NO: 66600 - protein, 9 aa, Artificial Sequence
  Description of Artificial Sequence: Synthetic peptide
  Seed: ALSNKVDEL (MAGA4_HUMAN)
AYSNKVDEM

SEQ ID NO: 66601 - protein, 9 aa, Artificial Sequence
  Description of Artificial Sequence: Synthetic peptide
  Seed: SYVKVLEHV (MAGA4_HUMAN)
SMVKVLEHY

SEQ ID NO: 66602 - protein, 9 aa, Artificial Sequence
  Description of Artificial Sequence: Synthetic peptide
  Seed: SYVKVLEHV (MAGA4_HUMAN)
SVVKVLEHA

SEQ ID NO: 66603 - protein, 9 aa, Artificial Sequence
  Description of Artificial Sequence: Synthetic peptide
  Seed: VYDGREHTV (MAGA4_HUMAN)
VTDGREHTL

SEQ ID NO: 66604 - protein, 10 aa, Artificial Sequence
  Description of Artificial Sequence: Synthetic peptide
  Seed: GVYDGREHTV (MAGA4_HUMAN)
GVYDGREHTY

SEQ ID NO: 66605 - protein, 10 aa, Artificial Sequence
  Description of Artificial Sequence: Synthetic peptide
  Seed: TTISFTCWRQ (MAGA4_HUMAN)
TKISFTCWRR

SEQ ID NO: 66606 - protein, 10 aa, Artificial Sequence
  Description of Artificial Sequence: Synthetic peptide
  Seed: RVRIAYPSLR (MAGA4_HUMAN)
RRRIAYPSLM

SEQ ID NO: 66607 - protein, 9 aa, Artificial Sequence
  Description of Artificial Sequence: Synthetic peptide
  Seed: SSPLVPGTL (MAGA4_HUMAN)
SYPLVPGTY

SEQ ID NO: 66608 - protein, 10 aa, Artificial Sequence
  Description of Artificial Sequence: Synthetic peptide
  Seed: TLVTCLGLSY (MAGA4_HUMAN)
TFVTCLGLSY

SEQ ID NO: 66609 - protein, 9 aa, Artificial Sequence
  Description of Artificial Sequence: Synthetic peptide
  Seed: NPARYEFLW (MAGA4_HUMAN)
NCARYEFLW

SEQ ID NO: 66610 - protein, 9 aa, Artificial Sequence
  Description of Artificial Sequence: Synthetic peptide
  Seed: TTISFTCWR (MAGA4_HUMAN)
TWISFTCWR

SEQ ID NO: 66611 - protein, 10 aa, Artificial Sequence
  Description of Artificial Sequence: Synthetic peptide
  Seed: LAHFLLRKYR (MAGA4_HUMAN)
LSHFLLRKYR

SEQ ID NO: 66612 - protein, 9 aa, Artificial Sequence
  Description of Artificial Sequence: Synthetic peptide
  Seed: KVDELAHFL (MAGA4_HUMAN)
KEDELAHFI

SEQ ID NO: 66613 - protein, 9 aa, Artificial Sequence
  Description of Artificial Sequence: Synthetic peptide
  Seed: QDWVQENYL (MAGA4_HUMAN)
QEWVQENYV

SEQ ID NO: 66614 - protein, 9 aa, Artificial Sequence
  Description of Artificial Sequence: Synthetic peptide
  Seed: AYPSLREAA (MAGA4_HUMAN)
AFPSLREAY

SEQ ID NO: 66615 - protein, 10 aa, Artificial Sequence
  Description of Artificial Sequence: Synthetic peptide
  Seed: MIFGIDVKEV (MAGA4_HUMAN)
MSFGIDVKEI

SEQ ID NO: 66616 - protein, 10 aa, Artificial Sequence
  Description of Artificial Sequence: Synthetic peptide
  Seed: EMLERVIKNY (MAGA4_HUMAN)
EVLERVIKNY

SEQ ID NO: 66617 - protein, 10 aa, Artificial Sequence
  Description of Artificial Sequence: Synthetic peptide
  Seed: RVNARVRIAY (MAGA4_HUMAN)
RMNARVRIAK

SEQ ID NO: 66618 - protein, 9 aa, Artificial Sequence
  Description of Artificial Sequence: Synthetic peptide
  Seed: SEEEIWEEL (MAGA4_HUMAN)
SIEEIWEEM

SEQ ID NO: 66619 - protein, 10 aa, Artificial Sequence
  Description of Artificial Sequence: Synthetic peptide
  Seed: TTISFTCWRQ (MAGA4_HUMAN)
TFISFTCWRR

SEQ ID NO: 66620 - protein, 9 aa, Artificial Sequence
  Description of Artificial Sequence: Synthetic peptide
  Seed: RKYRAKELV (MAGA4_HUMAN)
RLYRAKELY

SEQ ID NO: 66621 - protein, 9 aa, Artificial Sequence
  Description of Artificial Sequence: Synthetic peptide
  Seed: YRAKELVTK (MAGA4_HUMAN)
YYAKELVTL

SEQ ID NO: 66622 - protein, 9 aa, Artificial Sequence
  Description of Artificial Sequence: Synthetic peptide
  Seed: LRKYRAKEL (MAGA4_HUMAN)
LLKYRAKEV

SEQ ID NO: 66623 - protein, 9 aa, Artificial Sequence
  Description of Artificial Sequence: Synthetic peptide
  Seed: RVRIAYPSL (MAGA4_HUMAN)
RLRIAYPSG

SEQ ID NO: 66624 - protein, 9 aa, Artificial Sequence
  Description of Artificial Sequence: Synthetic peptide
  Seed: EEALGLVGA (MAGA4_HUMAN)
EEALGLVGL

SEQ ID NO: 66625 - protein, 9 aa, Artificial Sequence
  Description of Artificial Sequence: Synthetic peptide
  Seed: REAALLEEE (MAGA4_HUMAN)
REAALLEEM

SEQ ID NO: 66626 - protein, 9 aa, Artificial Sequence
  Description of Artificial Sequence: Synthetic peptide
  Seed: QIFPKTGLL (MAGA4_HUMAN)
QIFPKTGLV

SEQ ID NO: 66627 - protein, 10 aa, Artificial Sequence
  Description of Artificial Sequence: Synthetic peptide
  Seed: YRQVPGSNPA (MAGA4_HUMAN)
YSQVPGSNPV

SEQ ID NO: 66628 - protein, 11 aa, Artificial Sequence
  Description of Artificial Sequence: Synthetic peptide
  Seed: KNYKRCFPVIF (MAGA4_HUMAN)
KMYKRCFPVIF

SEQ ID NO: 66629 - protein, 9 aa, Artificial Sequence
  Description of Artificial Sequence: Synthetic peptide
  Seed: YVKVLEHVV (MAGA4_HUMAN)
YAKVLEHVF

SEQ ID NO: 66630 - protein, 10 aa, Artificial Sequence
  Description of Artificial Sequence: Synthetic peptide
  Seed: YRQVPGSNPA (MAGA4_HUMAN)
YMQVPGSNPF

SEQ ID NO: 66631 - protein, 11 aa, Artificial Sequence
  Description of Artificial Sequence: Synthetic peptide
  Seed: GPPQSPQGASA (MAGA4_HUMAN)
GPPQSPQGASL

SEQ ID NO: 66632 - protein, 10 aa, Artificial Sequence
  Description of Artificial Sequence: Synthetic peptide
  Seed: KNYKRCFPVI (MAGA4_HUMAN)
KDYKRCFPVF

SEQ ID NO: 66633 - protein, 11 aa, Artificial Sequence
  Description of Artificial Sequence: Synthetic peptide
  Seed: SSSSPLVPGTL (MAGA4_HUMAN)
SISSPLVPGTW

SEQ ID NO: 66634 - protein, 10 aa, Artificial Sequence
  Description of Artificial Sequence: Synthetic peptide
  Seed: STSPDAESLF (MAGA4_HUMAN)
SQSPDAESLI

SEQ ID NO: 66635 - protein, 9 aa, Artificial Sequence
  Description of Artificial Sequence: Synthetic peptide
  Seed: IAYPSLREA (MAGA4_HUMAN)
IEYPSLREL

SEQ ID NO: 66636 - protein, 11 aa, Artificial Sequence
  Description of Artificial Sequence: Synthetic peptide
  Seed: RQVPGSNPARY (MAGA4_HUMAN)
RLVPGSNPARI

SEQ ID NO: 66637 - protein, 9 aa, Artificial Sequence
  Description of Artificial Sequence: Synthetic peptide
  Seed: KNYKRCFPV (MAGA4_HUMAN)
KYYKRCFPA

SEQ ID NO: 66638 - protein, 10 aa, Artificial Sequence
  Description of Artificial Sequence: Synthetic peptide
  Seed: SESLKMIFGI (MAGA4_HUMAN)
SYSLKMIFGW

SEQ ID NO: 66639 - protein, 9 aa, Artificial Sequence
  Description of Artificial Sequence: Synthetic peptide
  Seed: KYRAKELVT (MAGA4_HUMAN)
KVRAKELVK

SEQ ID NO: 66640 - protein, 11 aa, Artificial Sequence
  Description of Artificial Sequence: Synthetic peptide
  Seed: VPAAESAGPPQ (MAGA4_HUMAN)
VPAAESAGPPA

SEQ ID NO: 66641 - protein, 10 aa, Artificial Sequence
  Description of Artificial Sequence: Synthetic peptide
  Seed: ASALPTTISF (MAGA4_HUMAN)
AGALPTTISW

SEQ ID NO: 66642 - protein, 9 aa, Artificial Sequence
  Description of Artificial Sequence: Synthetic peptide
  Seed: LGNNQIFPK (MAGA4_HUMAN)
LTNNQIFPK

SEQ ID NO: 66643 - protein, 9 aa, Artificial Sequence
  Description of Artificial Sequence: Synthetic peptide
  Seed: SYVKVLEHV (MAGA4_HUMAN)
SVVKVLEHM

SEQ ID NO: 66644 - protein, 9 aa, Artificial Sequence
  Description of Artificial Sequence: Synthetic peptide
  Seed: AAVSSSSPL (MAGA4_HUMAN)
AQVSSSSPH

SEQ ID NO: 66645 - protein, 9 aa, Artificial Sequence
  Description of Artificial Sequence: Synthetic peptide
  Seed: IIVLGTIAM (MAGA4_HUMAN)
IFVLGTIAM

SEQ ID NO: 66646 - protein, 11 aa, Artificial Sequence
  Description of Artificial Sequence: Synthetic peptide
  Seed: GPPQSPQGASA (MAGA4_HUMAN)
GPPQSPQGASM

SEQ ID NO: 66647 - protein, 9 aa, Artificial Sequence
  Description of Artificial Sequence: Synthetic peptide
  Seed: QIFPKTGLL (MAGA4_HUMAN)
QVFPKTGLI

SEQ ID NO: 66648 - protein, 9 aa, Artificial Sequence
  Description of Artificial Sequence: Synthetic peptide
  Seed: DELAHFLLR (MAGA4_HUMAN)
DFLAHFLLR

SEQ ID NO: 66649 - protein, 9 aa, Artificial Sequence
  Description of Artificial Sequence: Synthetic peptide
  Seed: IIVLGTIAM (MAGA4_HUMAN)
IQVLGTIAF

SEQ ID NO: 66650 - protein, 10 aa, Artificial Sequence
  Description of Artificial Sequence: Synthetic peptide
  Seed: ASALPTTISF (MAGA4_HUMAN)
ASALPTTISW

SEQ ID NO: 66651 - protein, 10 aa, Artificial Sequence
  Description of Artificial Sequence: Synthetic peptide
  Seed: RVRIAYPSLR (MAGA4_HUMAN)
RKRIAYPSLR

SEQ ID NO: 66652 - protein, 9 aa, Artificial Sequence
  Description of Artificial Sequence: Synthetic peptide
  Seed: GLLGNNQIF (MAGA4_HUMAN)
GMLGNNQIF

SEQ ID NO: 66653 - protein, 8 aa, Artificial Sequence
  Description of Artificial Sequence: Synthetic peptide
  Seed: DELAHFLL (MAGA4_HUMAN)
DELAHFLY

SEQ ID NO: 66654 - protein, 9 aa, Artificial Sequence
  Description of Artificial Sequence: Synthetic peptide
  Seed: SEEEIWEEL (MAGA4_HUMAN)
SLEEIWEEM

SEQ ID NO: 66655 - protein, 11 aa, Artificial Sequence
  Description of Artificial Sequence: Synthetic peptide
  Seed: REALSNKVDEL (MAGA4_HUMAN)
RQALSNKVDEF

SEQ ID NO: 66656 - protein, 11 aa, Artificial Sequence
  Description of Artificial Sequence: Synthetic peptide
  Seed: SPQGASALPTT (MAGA4_HUMAN)
SPQGASALPTV

SEQ ID NO: 66657 - protein, 9 aa, Artificial Sequence
  Description of Artificial Sequence: Synthetic peptide
  Seed: AHFLLRKYR (MAGA4_HUMAN)
AWFLLRKYR

SEQ ID NO: 66658 - protein, 10 aa, Artificial Sequence
  Description of Artificial Sequence: Synthetic peptide
  Seed: DELAHFLLRK (MAGA4_HUMAN)
DVLAHFLLRK

SEQ ID NO: 66659 - protein, 9 aa, Artificial Sequence
  Description of Artificial Sequence: Synthetic peptide
  Seed: LVPGTLEEV (MAGA4_HUMAN)
LIPGTLEEL

SEQ ID NO: 66660 - protein, 9 aa, Artificial Sequence
  Description of Artificial Sequence: Synthetic peptide
  Seed: IFGIDVKEV (MAGA4_HUMAN)
IYGIDVKEF

SEQ ID NO: 66661 - protein, 9 aa, Artificial Sequence
  Description of Artificial Sequence: Synthetic peptide
  Seed: SALPTTISF (MAGA4_HUMAN)
SYLPTTISA

SEQ ID NO: 66662 - protein, 9 aa, Artificial Sequence
  Description of Artificial Sequence: Synthetic peptide
  Seed: AAVSSSSPL (MAGA4_HUMAN)
AGVSSSSPF

SEQ ID NO: 66663 - protein, 11 aa, Artificial Sequence
  Description of Artificial Sequence: Synthetic peptide
  Seed: YVKVLEHVVRV (MAGA4_HUMAN)
YHKVLEHVVRV

SEQ ID NO: 66664 - protein, 9 aa, Artificial Sequence
  Description of Artificial Sequence: Synthetic peptide
  Seed: SALPTTISF (MAGA4_HUMAN)
SVLPTTISH

SEQ ID NO: 66665 - protein, 9 aa, Artificial Sequence
  Description of Artificial Sequence: Synthetic peptide
  Seed: VNARVRIAY (MAGA4_HUMAN)
VHARVRIAY

SEQ ID NO: 66666 - protein, 10 aa, Artificial Sequence
  Description of Artificial Sequence: Synthetic peptide
  Seed: AQEEALGLVG (MAGA4_HUMAN)
AEEEALGLVC

SEQ ID NO: 66667 - protein, 9 aa, Artificial Sequence
  Description of Artificial Sequence: Synthetic peptide
  Seed: ELAHFLLRK (MAGA4_HUMAN)
ELAHFLLRR

SEQ ID NO: 66668 - protein, 9 aa, Artificial Sequence
  Description of Artificial Sequence: Synthetic peptide
  Seed: HTVYGEPRK (MAGA4_HUMAN)
HSVYGEPRR

SEQ ID NO: 66669 - protein, 9 aa, Artificial Sequence
  Description of Artificial Sequence: Synthetic peptide
  Seed: IAMEGDSAS (MAGA4_HUMAN)
ISMEGDSAM

SEQ ID NO: 66670 - protein, 10 aa, Artificial Sequence
  Description of Artificial Sequence: Synthetic peptide
  Seed: VKVLEHVVRV (MAGA4_HUMAN)
VLVLEHVVRI

SEQ ID NO: 66671 - protein, 9 aa, Artificial Sequence
  Description of Artificial Sequence: Synthetic peptide
  Seed: RAKELVTKA (MAGA4_HUMAN)
RLKELVTKA

SEQ ID NO: 66672 - protein, 9 aa, Artificial Sequence
  Description of Artificial Sequence: Synthetic peptide
  Seed: EEVPAAESA (MAGA4_HUMAN)
EQVPAAESY

SEQ ID NO: 66673 - protein, 10 aa, Artificial Sequence
  Description of Artificial Sequence: Synthetic peptide
  Seed: KNYKRCFPVI (MAGA4_HUMAN)
KQYKRCFPVK

SEQ ID NO: 66674 - protein, 10 aa, Artificial Sequence
  Description of Artificial Sequence: Synthetic peptide
  Seed: TTISFTCWRQ (MAGA4_HUMAN)
TAISFTCWRR

SEQ ID NO: 66675 - protein, 9 aa, Artificial Sequence
  Description of Artificial Sequence: Synthetic peptide
  Seed: EVDPASNTY (MAGA4_HUMAN)
ESDPASNTM

SEQ ID NO: 66676 - protein, 10 aa, Artificial Sequence
  Description of Artificial Sequence: Synthetic peptide
  Seed: YPSLREAALL (MAGA4_HUMAN)
YRSLREAALY

SEQ ID NO: 66677 - protein, 9 aa, Artificial Sequence
  Description of Artificial Sequence: Synthetic peptide
  Seed: HVVRVNARV (MAGA4_HUMAN)
HMVRVNARV

SEQ ID NO: 66678 - protein, 9 aa, Artificial Sequence
  Description of Artificial Sequence: Synthetic peptide
  Seed: VYDGREHTV (MAGA4_HUMAN)
VWDGREHTF

SEQ ID NO: 66679 - protein, 8 aa, Artificial Sequence
  Description of Artificial Sequence: Synthetic peptide
  Seed: KVDELAHF (MAGA4_HUMAN)
KQDELAHL

SEQ ID NO: 66680 - protein, 10 aa, Artificial Sequence
  Description of Artificial Sequence: Synthetic peptide
  Seed: FGKASESLKM (MAGA4_HUMAN)
FDKASESLKF

SEQ ID NO: 66681 - protein, 9 aa, Artificial Sequence
  Description of Artificial Sequence: Synthetic peptide
  Seed: GVYDGREHT (MAGA4_HUMAN)
GLYDGREHI

SEQ ID NO: 66682 - protein, 9 aa, Artificial Sequence
  Description of Artificial Sequence: Synthetic peptide
  Seed: GTLEEVPAA (MAGA4_HUMAN)
GQLEEVPAV

SEQ ID NO: 66683 - protein, 9 aa, Artificial Sequence
  Description of Artificial Sequence: Synthetic peptide
  Seed: ALLEEEEGV (MAGA4_HUMAN)
ALLEEEEGL

SEQ ID NO: 66684 - protein, 11 aa, Artificial Sequence
  Description of Artificial Sequence: Synthetic peptide
  Seed: EIWEELGVMGV (MAGA4_HUMAN)
EVWEELGVMGV

SEQ ID NO: 66685 - protein, 9 aa, Artificial Sequence
  Description of Artificial Sequence: Synthetic peptide
  Seed: KVLEHVVRV (MAGA4_HUMAN)
KLLEHVVRL

SEQ ID NO: 66686 - protein, 9 aa, Artificial Sequence
  Description of Artificial Sequence: Synthetic peptide
  Seed: RCFPVIFGK (MAGA4_HUMAN)
RTFPVIFGK

SEQ ID NO: 66687 - protein, 10 aa, Artificial Sequence
  Description of Artificial Sequence: Synthetic peptide
  Seed: EMLERVIKNY (MAGA4_HUMAN)
ETLERVIKNF

SEQ ID NO: 66688 - protein, 9 aa, Artificial Sequence
  Description of Artificial Sequence: Synthetic peptide
  Seed: AAVSSSSPL (MAGA4_HUMAN)
AKVSSSSPL

SEQ ID NO: 66689 - protein, 9 aa, Artificial Sequence
  Description of Artificial Sequence: Synthetic peptide
  Seed: QIFPKTGLL (MAGA4_HUMAN)
QIFPKTGLK

SEQ ID NO: 66690 - protein, 10 aa, Artificial Sequence
  Description of Artificial Sequence: Synthetic peptide
  Seed: KASESLKMIF (MAGA4_HUMAN)
KTSESLKMIM

SEQ ID NO: 66691 - protein, 9 aa, Artificial Sequence
  Description of Artificial Sequence: Synthetic peptide
  Seed: IIVLGTIAM (MAGA4_HUMAN)
IQVLGTIAW

SEQ ID NO: 66692 - protein, 9 aa, Artificial Sequence
  Description of Artificial Sequence: Synthetic peptide
  Seed: ESLKMIFGI (MAGA4_HUMAN)
EVLKMIFGF

SEQ ID NO: 66693 - protein, 10 aa, Artificial Sequence
  Description of Artificial Sequence: Synthetic peptide
  Seed: KNYKRCFPVI (MAGA4_HUMAN)
KWYKRCFPVA

SEQ ID NO: 66694 - protein, 9 aa, Artificial Sequence
  Description of Artificial Sequence: Synthetic peptide
  Seed: RVRIAYPSL (MAGA4_HUMAN)
RGRIAYPST

SEQ ID NO: 66695 - protein, 10 aa, Artificial Sequence
  Description of Artificial Sequence: Synthetic peptide
  Seed: RVRIAYPSLR (MAGA4_HUMAN)
RVRIAYPSLP

SEQ ID NO: 66696 - protein, 10 aa, Artificial Sequence
  Description of Artificial Sequence: Synthetic peptide
  Seed: RVRIAYPSLR (MAGA4_HUMAN)
RWRIAYPSLF

SEQ ID NO: 66697 - protein, 10 aa, Artificial Sequence
  Description of Artificial Sequence: Synthetic peptide
  Seed: RVRIAYPSLR (MAGA4_HUMAN)
RCRIAYPSLL

SEQ ID NO: 66698 - protein, 9 aa, Artificial Sequence
  Description of Artificial Sequence: Synthetic peptide
  Seed: YVKVLEHVV (MAGA4_HUMAN)
YLKVLEHVI

SEQ ID NO: 66699 - protein, 9 aa, Artificial Sequence
  Description of Artificial Sequence: Synthetic peptide
  Seed: EVDPASNTY (MAGA4_HUMAN)
EYDPASNTY

SEQ ID NO: 66700 - protein, 8 aa, Artificial Sequence
  Description of Artificial Sequence: Synthetic peptide
  Seed: RVRIAYPS (MAGA4_HUMAN)
RVRIAYPA

SEQ ID NO: 66701 - protein, 10 aa, Artificial Sequence
  Description of Artificial Sequence: Synthetic peptide
  Seed: LAHFLLRKYR (MAGA4_HUMAN)
LLHFLLRKYR

SEQ ID NO: 66702 - protein, 9 aa, Artificial Sequence
  Description of Artificial Sequence: Synthetic peptide
  Seed: RVRIAYPSL (MAGA4_HUMAN)
RPRIAYPSI

SEQ ID NO: 66703 - protein, 10 aa, Artificial Sequence
  Description of Artificial Sequence: Synthetic peptide
  Seed: YRQVPGSNPA (MAGA4_HUMAN)
YQQVPGSNPW

SEQ ID NO: 66704 - protein, 10 aa, Artificial Sequence
  Description of Artificial Sequence: Synthetic peptide
  Seed: SSSPLVPGTL (MAGA4_HUMAN)
STSPLVPGTA

SEQ ID NO: 66705 - protein, 9 aa, Artificial Sequence
  Description of Artificial Sequence: Synthetic peptide
  Seed: IAYPSLREA (MAGA4_HUMAN)
IGYPSLREM

SEQ ID NO: 66706 - protein, 10 aa, Artificial Sequence
  Description of Artificial Sequence: Synthetic peptide
  Seed: SYVKVLEHVV (MAGA4_HUMAN)
SYVKVLEHVL

SEQ ID NO: 66707 - protein, 9 aa, Artificial Sequence
  Description of Artificial Sequence: Synthetic peptide
  Seed: KVLEHVVRV (MAGA4_HUMAN)
KRLEHVVRL

SEQ ID NO: 66708 - protein, 9 aa, Artificial Sequence
  Description of Artificial Sequence: Synthetic peptide
  Seed: RQVPGSNPA (MAGA4_HUMAN)
RHVPGSNPM

SEQ ID NO: 66709 - protein, 9 aa, Artificial Sequence
  Description of Artificial Sequence: Synthetic peptide
  Seed: KVLEHVVRV (MAGA4_HUMAN)
KHLEHVVRL

SEQ ID NO: 66710 - protein, 9 aa, Artificial Sequence
  Description of Artificial Sequence: Synthetic peptide
  Seed: QEAAVSSSS (MAGA4_HUMAN)
QEAAVSSSL

SEQ ID NO: 66711 - protein, 9 aa, Artificial Sequence
  Description of Artificial Sequence: Synthetic peptide
  Seed: LPTTISFTC (MAGA4_HUMAN)
LPTTISFTH

SEQ ID NO: 66712 - protein, 8 aa, Artificial Sequence
  Description of Artificial Sequence: Synthetic peptide
  Seed: FLLRKYRA (MAGA4_HUMAN)
FPLRKYRM

SEQ ID NO: 66713 - protein, 9 aa, Artificial Sequence
  Description of Artificial Sequence: Synthetic peptide
  Seed: IAYPSLREA (MAGA4_HUMAN)
IGYPSLREV

SEQ ID NO: 66714 - protein, 9 aa, Artificial Sequence
  Description of Artificial Sequence: Synthetic peptide
  Seed: LVPGTLEEV (MAGA4_HUMAN)
LIPGTLEEF

SEQ ID NO: 66715 - protein, 11 aa, Artificial Sequence
  Description of Artificial Sequence: Synthetic peptide
  Seed: REALSNKVDEL (MAGA4_HUMAN)
RLALSNKVDEL

SEQ ID NO: 66716 - protein, 9 aa, Artificial Sequence
  Description of Artificial Sequence: Synthetic peptide
  Seed: EVDPASNTY (MAGA4_HUMAN)
ESDPASNTI

SEQ ID NO: 66717 - protein, 9 aa, Artificial Sequence
  Description of Artificial Sequence: Synthetic peptide
  Seed: GLLIIVLGT (MAGA4_HUMAN)
GTLIIVLGV

SEQ ID NO: 66718 - protein, 9 aa, Artificial Sequence
  Description of Artificial Sequence: Synthetic peptide
  Seed: VYDGREHTV (MAGA4_HUMAN)
VMDGREHTM

SEQ ID NO: 66719 - protein, 9 aa, Artificial Sequence
  Description of Artificial Sequence: Synthetic peptide
  Seed: AVSSSSPLV (MAGA4_HUMAN)
AMSSSSPLF

SEQ ID NO: 66720 - protein, 10 aa, Artificial Sequence
  Description of Artificial Sequence: Synthetic peptide
  Seed: LIIVLGTIAM (MAGA4_HUMAN)
LLIVLGTIAF

SEQ ID NO: 66721 - protein, 9 aa, Artificial Sequence
  Description of Artificial Sequence: Synthetic peptide
  Seed: RAKELVTKA (MAGA4_HUMAN)
REKELVTKL

SEQ ID NO: 66722 - protein, 10 aa, Artificial Sequence
  Description of Artificial Sequence: Synthetic peptide
  Seed: VDPASNTYTL (MAGA4_HUMAN)
VNPASNTYTF

SEQ ID NO: 66723 - protein, 9 aa, Artificial Sequence
  Description of Artificial Sequence: Synthetic peptide
  Seed: YTLVTCLGL (MAGA4_HUMAN)
YSLVTCLGL

SEQ ID NO: 66724 - protein, 9 aa, Artificial Sequence
  Description of Artificial Sequence: Synthetic peptide
  Seed: GSNPARYEF (MAGA4_HUMAN)
GRNPARYEV

SEQ ID NO: 66725 - protein, 10 aa, Artificial Sequence
  Description of Artificial Sequence: Synthetic peptide
  Seed: RVRIAYPSLR (MAGA4_HUMAN)
RSRIAYPSLE

SEQ ID NO: 66726 - protein, 9 aa, Artificial Sequence
  Description of Artificial Sequence: Synthetic peptide
  Seed: RVNARVRIA (MAGA4_HUMAN)
RVNARVRIM

SEQ ID NO: 66727 - protein, 9 aa, Artificial Sequence
  Description of Artificial Sequence: Synthetic peptide
  Seed: HTVYGEPRK (MAGA4_HUMAN)
HIVYGEPRR

SEQ ID NO: 66728 - protein, 9 aa, Artificial Sequence
  Description of Artificial Sequence: Synthetic peptide
  Seed: TTISFTCWR (MAGA4_HUMAN)
TFISFTCWR

SEQ ID NO: 66729 - protein, 10 aa, Artificial Sequence
  Description of Artificial Sequence: Synthetic peptide
  Seed: TTISFTCWRQ (MAGA4_HUMAN)
TVISFTCWRY

SEQ ID NO: 66730 - protein, 10 aa, Artificial Sequence
  Description of Artificial Sequence: Synthetic peptide
  Seed: LAHFLLRKYR (MAGA4_HUMAN)
LIHFLLRKYR

SEQ ID NO: 66731 - protein, 9 aa, Artificial Sequence
  Description of Artificial Sequence: Synthetic peptide
  Seed: YPSLREAAL (MAGA4_HUMAN)
YHSLREAAV

SEQ ID NO: 66732 - protein, 9 aa, Artificial Sequence
  Description of Artificial Sequence: Synthetic peptide
  Seed: KVLEHVVRV (MAGA4_HUMAN)
KFLEHVVRL

SEQ ID NO: 66733 - protein, 9 aa, Artificial Sequence
  Description of Artificial Sequence: Synthetic peptide
  Seed: YPSLREAAL (MAGA4_HUMAN)
YSSLREAAY

SEQ ID NO: 66734 - protein, 9 aa, Artificial Sequence
  Description of Artificial Sequence: Synthetic peptide
  Seed: VYDGREHTV (MAGA4_HUMAN)
VDDGREHTL

SEQ ID NO: 66735 - protein, 9 aa, Artificial Sequence
  Description of Artificial Sequence: Synthetic peptide
  Seed: IIVLGTIAM (MAGA4_HUMAN)
ISVLGTIAL

SEQ ID NO: 66736 - protein, 9 aa, Artificial Sequence
  Description of Artificial Sequence: Synthetic peptide
  Seed: TSPDAESLF (MAGA4_HUMAN)
TMPDAESLL

SEQ ID NO: 66737 - protein, 9 aa, Artificial Sequence
  Description of Artificial Sequence: Synthetic peptide
  Seed: AESLFREAL (MAGA4_HUMAN)
AQSLFREAM

SEQ ID NO: 66738 - protein, 9 aa, Artificial Sequence
  Description of Artificial Sequence: Synthetic peptide
  Seed: KVDELAHFL (MAGA4_HUMAN)
KADELAHFI

SEQ ID NO: 66739 - protein, 10 aa, Artificial Sequence
  Description of Artificial Sequence: Synthetic peptide
  Seed: KRCFPVIFGK (MAGA4_HUMAN)
KVCFPVIFGK

SEQ ID NO: 66740 - protein, 9 aa, Artificial Sequence
  Description of Artificial Sequence: Synthetic peptide
  Seed: GSNPARYEF (MAGA4_HUMAN)
GYNPARYEF

SEQ ID NO: 66741 - protein, 10 aa, Artificial Sequence
  Description of Artificial Sequence: Synthetic peptide
  Seed: RVRIAYPSLR (MAGA4_HUMAN)
RERIAYPSLV

SEQ ID NO: 66742 - protein, 9 aa, Artificial Sequence
  Description of Artificial Sequence: Synthetic peptide
  Seed: GTLEEVPAA (MAGA4_HUMAN)
GLLEEVPAC

SEQ ID NO: 66743 - protein, 9 aa, Artificial Sequence
  Description of Artificial Sequence: Synthetic peptide
  Seed: ALSNKVDEL (MAGA4_HUMAN)
ARSNKVDEF

SEQ ID NO: 66744 - protein, 9 aa, Artificial Sequence
  Description of Artificial Sequence: Synthetic peptide
  Seed: SSSPLVPGT (MAGA4_HUMAN)
SLSPLVPGC

SEQ ID NO: 66745 - protein, 9 aa, Artificial Sequence
  Description of Artificial Sequence: Synthetic peptide
  Seed: KVLEHVVRV (MAGA4_HUMAN)
KQLEHVVRI

SEQ ID NO: 66746 - protein, 10 aa, Artificial Sequence
  Description of Artificial Sequence: Synthetic peptide
  Seed: VDPASNTYTL (MAGA4_HUMAN)
VRPASNTYTM

SEQ ID NO: 66747 - protein, 9 aa, Artificial Sequence
  Description of Artificial Sequence: Synthetic peptide
  Seed: VNARVRIAY (MAGA4_HUMAN)
VYARVRIAY

SEQ ID NO: 66748 - protein, 10 aa, Artificial Sequence
  Description of Artificial Sequence: Synthetic peptide
  Seed: LTQDWVQENY (MAGA4_HUMAN)
LAQDWVQENW

SEQ ID NO: 66749 - protein, 10 aa, Artificial Sequence
  Description of Artificial Sequence: Synthetic peptide
  Seed: VDPASNTYTL (MAGA4_HUMAN)
VEPASNTYTY

SEQ ID NO: 66750 - protein, 9 aa, Artificial Sequence
  Description of Artificial Sequence: Synthetic peptide
  Seed: SEEEIWEEL (MAGA4_HUMAN)
SQEEIWEEL

SEQ ID NO: 66751 - protein, 11 aa, Artificial Sequence
  Description of Artificial Sequence: Synthetic peptide
  Seed: ALPTTISFTCW (MAGA4_HUMAN)
AFPTTISFTCW

SEQ ID NO: 66752 - protein, 9 aa, Artificial Sequence
  Description of Artificial Sequence: Synthetic peptide
  Seed: FGKASESLK (MAGA4_HUMAN)
FVKASESLK

SEQ ID NO: 66753 - protein, 9 aa, Artificial Sequence
  Description of Artificial Sequence: Synthetic peptide
  Seed: FGKASESLK (MAGA4_HUMAN)
FIKASESLR

SEQ ID NO: 66754 - protein, 9 aa, Artificial Sequence
  Description of Artificial Sequence: Synthetic peptide
  Seed: RVRIAYPSL (MAGA4_HUMAN)
RFRIAYPSP

SEQ ID NO: 66755 - protein, 9 aa, Artificial Sequence
  Description of Artificial Sequence: Synthetic peptide
  Seed: SEEEIWEEL (MAGA4_HUMAN)
SSEEIWEEI

SEQ ID NO: 66756 - protein, 9 aa, Artificial Sequence
  Description of Artificial Sequence: Synthetic peptide
  Seed: VYDGREHTV (MAGA4_HUMAN)
VQDGREHTM

SEQ ID NO: 66757 - protein, 10 aa, Artificial Sequence
  Description of Artificial Sequence: Synthetic peptide
  Seed: YPSLREAALL (MAGA4_HUMAN)
YGSLREAALF

SEQ ID NO: 66758 - protein, 10 aa, Artificial Sequence
  Description of Artificial Sequence: Synthetic peptide
  Seed: ASALPTTISF (MAGA4_HUMAN)
AAALPTTISF

SEQ ID NO: 66759 - protein, 9 aa, Artificial Sequence
  Description of Artificial Sequence: Synthetic peptide
  Seed: SALPTTISF (MAGA4_HUMAN)
SELPTTISL

SEQ ID NO: 66760 - protein, 10 aa, Artificial Sequence
  Description of Artificial Sequence: Synthetic peptide
  Seed: GDSASEEEIW (MAGA4_HUMAN)
GESASEEEIW

SEQ ID NO: 66761 - protein, 9 aa, Artificial Sequence
  Description of Artificial Sequence: Synthetic peptide
  Seed: LGNNQIFPK (MAGA4_HUMAN)
LANNQIFPK

SEQ ID NO: 66762 - protein, 10 aa, Artificial Sequence
  Description of Artificial Sequence: Synthetic peptide
  Seed: YRQVPGSNPA (MAGA4_HUMAN)
YAQVPGSNPV

SEQ ID NO: 66763 - protein, 9 aa, Artificial Sequence
  Description of Artificial Sequence: Synthetic peptide
  Seed: SALPTTISF (MAGA4_HUMAN)
SPLPTTISG

SEQ ID NO: 66764 - protein, 10 aa, Artificial Sequence
  Description of Artificial Sequence: Synthetic peptide
  Seed: ASALPTTISF (MAGA4_HUMAN)
AWALPTTISW

SEQ ID NO: 66765 - protein, 9 aa, Artificial Sequence
  Description of Artificial Sequence: Synthetic peptide
  Seed: IAYPSLREA (MAGA4_HUMAN)
IEYPSLREV

SEQ ID NO: 66766 - protein, 10 aa, Artificial Sequence
  Description of Artificial Sequence: Synthetic peptide
  Seed: VDPASNTYTL (MAGA4_HUMAN)
VCPASNTYTY

SEQ ID NO: 66767 - protein, 9 aa, Artificial Sequence
  Description of Artificial Sequence: Synthetic peptide
  Seed: YKRCFPVIF (MAGA4_HUMAN)
YLRCFPVIM

SEQ ID NO: 66768 - protein, 9 aa, Artificial Sequence
  Description of Artificial Sequence: Synthetic peptide
  Seed: AAVSSSSPL (MAGA4_HUMAN)
ATVSSSSPF

SEQ ID NO: 66769 - protein, 9 aa, Artificial Sequence
  Description of Artificial Sequence: Synthetic peptide
  Seed: NTYTLVTCL (MAGA4_HUMAN)
NIYTLVTCV

SEQ ID NO: 66770 - protein, 10 aa, Artificial Sequence
  Description of Artificial Sequence: Synthetic peptide
  Seed: SEQKSQHCKP (MAGA4_HUMAN)
SEQKSQHCKL

SEQ ID NO: 66771 - protein, 10 aa, Artificial Sequence
  Description of Artificial Sequence: Synthetic peptide
  Seed: KASESLKMIF (MAGA4_HUMAN)
KSSESLKMIW

SEQ ID NO: 66772 - protein, 9 aa, Artificial Sequence
  Description of Artificial Sequence: Synthetic peptide
  Seed: GTLEEVPAA (MAGA4_HUMAN)
GILEEVPAV

SEQ ID NO: 66773 - protein, 9 aa, Artificial Sequence
  Description of Artificial Sequence: Synthetic peptide
  Seed: SYVKVLEHV (MAGA4_HUMAN)
SLVKVLEHT

SEQ ID NO: 66774 - protein, 9 aa, Artificial Sequence
  Description of Artificial Sequence: Synthetic peptide
  Seed: SSPLVPGTL (MAGA4_HUMAN)
SSPLVPGTF

SEQ ID NO: 66775 - protein, 10 aa, Artificial Sequence
  Description of Artificial Sequence: Synthetic peptide
  Seed: EHVVRVNARV (MAGA4_HUMAN)
EGVVRVNARV

SEQ ID NO: 66776 - protein, 10 aa, Artificial Sequence
  Description of Artificial Sequence: Synthetic peptide
  Seed: KNYKRCFPVI (MAGA4_HUMAN)
KSYKRCFPVV

SEQ ID NO: 66777 - protein, 8 aa, Artificial Sequence
  Description of Artificial Sequence: Synthetic peptide
  Seed: VYGEPRKL (MAGA4_HUMAN)
VAGEPRKL

SEQ ID NO: 66778 - protein, 9 aa, Artificial Sequence
  Description of Artificial Sequence: Synthetic peptide
  Seed: YVKVLEHVV (MAGA4_HUMAN)
YGKVLEHVY

SEQ ID NO: 66779 - protein, 9 aa, Artificial Sequence
  Description of Artificial Sequence: Synthetic peptide
  Seed: YDGREHTVY (MAGA4_HUMAN)
YEGREHTVY

SEQ ID NO: 66780 - protein, 10 aa, Artificial Sequence
  Description of Artificial Sequence: Synthetic peptide
  Seed: TLVTCLGLSY (MAGA4_HUMAN)
TQVTCLGLSM

SEQ ID NO: 66781 - protein, 10 aa, Artificial Sequence
  Description of Artificial Sequence: Synthetic peptide
  Seed: RQVPGSNPAR (MAGA4_HUMAN)
RIVPGSNPAY

SEQ ID NO: 66782 - protein, 9 aa, Artificial Sequence
  Description of Artificial Sequence: Synthetic peptide
  Seed: IAYPSLREA (MAGA4_HUMAN)
ILYPSLREM

SEQ ID NO: 66783 - protein, 10 aa, Artificial Sequence
  Description of Artificial Sequence: Synthetic peptide
  Seed: QEAAVSSSSP (MAGA4_HUMAN)
QEAAVSSSSA

SEQ ID NO: 66784 - protein, 11 aa, Artificial Sequence
  Description of Artificial Sequence: Synthetic peptide
  Seed: EIWEELGVMGV (MAGA4_HUMAN)
ETWEELGVMGV

SEQ ID NO: 66785 - protein, 9 aa, Artificial Sequence
  Description of Artificial Sequence: Synthetic peptide
  Seed: AAVSSSSPL (MAGA4_HUMAN)
AEVSSSSPF

SEQ ID NO: 66786 - protein, 10 aa, Artificial Sequence
  Description of Artificial Sequence: Synthetic peptide
  Seed: YRQVPGSNPA (MAGA4_HUMAN)
YPQVPGSNPM

SEQ ID NO: 66787 - protein, 9 aa, Artificial Sequence
  Description of Artificial Sequence: Synthetic peptide
  Seed: SSPLVPGTL (MAGA4_HUMAN)
SVPLVPGTV

SEQ ID NO: 66788 - protein, 10 aa, Artificial Sequence
  Description of Artificial Sequence: Synthetic peptide
  Seed: TSPDAESLFR (MAGA4_HUMAN)
TVPDAESLFR

SEQ ID NO: 66789 - protein, 9 aa, Artificial Sequence
  Description of Artificial Sequence: Synthetic peptide
  Seed: TTISFTCWR (MAGA4_HUMAN)
TNISFTCWK

SEQ ID NO: 66790 - protein, 9 aa, Artificial Sequence
  Description of Artificial Sequence: Synthetic peptide
  Seed: SEEEIWEEL (MAGA4_HUMAN)
SEEEIWEEI

SEQ ID NO: 66791 - protein, 9 aa, Artificial Sequence
  Description of Artificial Sequence: Synthetic peptide
  Seed: YPSLREAAL (MAGA4_HUMAN)
YSSLREAAM

SEQ ID NO: 66792 - protein, 10 aa, Artificial Sequence
  Description of Artificial Sequence: Synthetic peptide
  Seed: KEVDPASNTY (MAGA4_HUMAN)
KMVDPASNTL

SEQ ID NO: 66793 - protein, 9 aa, Artificial Sequence
  Description of Artificial Sequence: Synthetic peptide
  Seed: KASESLKMI (MAGA4_HUMAN)
KSSESLKMM

SEQ ID NO: 66794 - protein, 9 aa, Artificial Sequence
  Description of Artificial Sequence: Synthetic peptide
  Seed: KVLEHVVRV (MAGA4_HUMAN)
KVLEHVVRF

SEQ ID NO: 66795 - protein, 10 aa, Artificial Sequence
  Description of Artificial Sequence: Synthetic peptide
  Seed: PTTISFTCWR (MAGA4_HUMAN)
PDTISFTCWR

SEQ ID NO: 66796 - protein, 10 aa, Artificial Sequence
  Description of Artificial Sequence: Synthetic peptide
  Seed: RVRIAYPSLR (MAGA4_HUMAN)
RIRIAYPSLK

SEQ ID NO: 66797 - protein, 9 aa, Artificial Sequence
  Description of Artificial Sequence: Synthetic peptide
  Seed: LVPGTLEEV (MAGA4_HUMAN)
LSPGTLEEF

SEQ ID NO: 66798 - protein, 10 aa, Artificial Sequence
  Description of Artificial Sequence: Synthetic peptide
  Seed: EHVVRVNARV (MAGA4_HUMAN)
EIVVRVNARV

SEQ ID NO: 66799 - protein, 9 aa, Artificial Sequence
  Description of Artificial Sequence: Synthetic peptide
  Seed: KYRAKELVT (MAGA4_HUMAN)
KYRAKELVK

SEQ ID NO: 66800 - protein, 9 aa, Artificial Sequence
  Description of Artificial Sequence: Synthetic peptide
  Seed: SALPTTISF (MAGA4_HUMAN)
SYLPTTISM

SEQ ID NO: 66801 - protein, 11 aa, Artificial Sequence
  Description of Artificial Sequence: Synthetic peptide
  Seed: VPAAESAGPPQ (MAGA4_HUMAN)
VPAAESAGPPV

SEQ ID NO: 66802 - protein, 9 aa, Artificial Sequence
  Description of Artificial Sequence: Synthetic peptide
  Seed: REAALLEEE (MAGA4_HUMAN)
REAALLEEL

SEQ ID NO: 66803 - protein, 11 aa, Artificial Sequence
  Description of Artificial Sequence: Synthetic peptide
  Seed: RVRIAYPSLRE (MAGA4_HUMAN)
RWRIAYPSLRR

SEQ ID NO: 66804 - protein, 10 aa, Artificial Sequence
  Description of Artificial Sequence: Synthetic peptide
  Seed: QIFPKTGLLI (MAGA4_HUMAN)
QLFPKTGLLV

SEQ ID NO: 66805 - protein, 9 aa, Artificial Sequence
  Description of Artificial Sequence: Synthetic peptide
  Seed: VYDGREHTV (MAGA4_HUMAN)
VVDGREHTY

SEQ ID NO: 66806 - protein, 9 aa, Artificial Sequence
  Description of Artificial Sequence: Synthetic peptide
  Seed: LGNNQIFPK (MAGA4_HUMAN)
LLNNQIFPK

SEQ ID NO: 66807 - protein, 10 aa, Artificial Sequence
  Description of Artificial Sequence: Synthetic peptide
  Seed: RVRIAYPSLR (MAGA4_HUMAN)
RSRIAYPSLA

SEQ ID NO: 66808 - protein, 9 aa, Artificial Sequence
  Description of Artificial Sequence: Synthetic peptide
  Seed: RVRIAYPSL (MAGA4_HUMAN)
RIRIAYPSQ

SEQ ID NO: 66809 - protein, 9 aa, Artificial Sequence
  Description of Artificial Sequence: Synthetic peptide
  Seed: TQDWVQENY (MAGA4_HUMAN)
TEDWVQENM

SEQ ID NO: 66810 - protein, 9 aa, Artificial Sequence
  Description of Artificial Sequence: Synthetic peptide
  Seed: KVLEHVVRV (MAGA4_HUMAN)
KELEHVVRF

SEQ ID NO: 66811 - protein, 9 aa, Artificial Sequence
  Description of Artificial Sequence: Synthetic peptide
  Seed: IIVLGTIAM (MAGA4_HUMAN)
IIVLGTIAF

SEQ ID NO: 66812 - protein, 9 aa, Artificial Sequence
  Description of Artificial Sequence: Synthetic peptide
  Seed: DELAHFLLR (MAGA4_HUMAN)
DWLAHFLLK

SEQ ID NO: 66813 - protein, 9 aa, Artificial Sequence
  Description of Artificial Sequence: Synthetic peptide
  Seed: EEQEAAVSS (MAGA4_HUMAN)
EEQEAAVSI

SEQ ID NO: 66814 - protein, 11 aa, Artificial Sequence
  Description of Artificial Sequence: Synthetic peptide
  Seed: KVDELAHFLLR (MAGA4_HUMAN)
KLDELAHFLLK

SEQ ID NO: 66815 - protein, 9 aa, Artificial Sequence
  Description of Artificial Sequence: Synthetic peptide
  Seed: SEEEIWEEL (MAGA4_HUMAN)
SEEEIWEEF

SEQ ID NO: 66816 - protein, 11 aa, Artificial Sequence
  Description of Artificial Sequence: Synthetic peptide
  Seed: YVKVLEHVVRV (MAGA4_HUMAN)
YLKVLEHVVRM

SEQ ID NO: 66817 - protein, 9 aa, Artificial Sequence
  Description of Artificial Sequence: Synthetic peptide
  Seed: AAVSSSSPL (MAGA4_HUMAN)
AQVSSSSPY

SEQ ID NO: 66818 - protein, 9 aa, Artificial Sequence
  Description of Artificial Sequence: Synthetic peptide
  Seed: DELAHFLLR (MAGA4_HUMAN)
DALAHFLLR

SEQ ID NO: 66819 - protein, 9 aa, Artificial Sequence
  Description of Artificial Sequence: Synthetic peptide
  Seed: RVRIAYPSL (MAGA4_HUMAN)
RVRIAYPSS

SEQ ID NO: 66820 - protein, 11 aa, Artificial Sequence
  Description of Artificial Sequence: Synthetic peptide
  Seed: GLLGNNQIFPK (MAGA4_HUMAN)
GYLGNNQIFPR

SEQ ID NO: 66821 - protein, 11 aa, Artificial Sequence
  Description of Artificial Sequence: Synthetic peptide
  Seed: AQAPTTEEQEA (MAGA4_HUMAN)
AEAPTTEEQEA

SEQ ID NO: 66822 - protein, 10 aa, Artificial Sequence
  Description of Artificial Sequence: Synthetic peptide
  Seed: GLLIIVLGTI (MAGA4_HUMAN)
GILIIVLGTV

SEQ ID NO: 66823 - protein, 9 aa, Artificial Sequence
  Description of Artificial Sequence: Synthetic peptide
  Seed: VRIAYPSLR (MAGA4_HUMAN)
VRIAYPSLM

SEQ ID NO: 66824 - protein, 9 aa, Artificial Sequence
  Description of Artificial Sequence: Synthetic peptide
  Seed: QIFPKTGLL (MAGA4_HUMAN)
QMFPKTGLA

SEQ ID NO: 66825 - protein, 9 aa, Artificial Sequence
  Description of Artificial Sequence: Synthetic peptide
  Seed: SYVKVLEHV (MAGA4_HUMAN)
STVKVLEHA

SEQ ID NO: 66826 - protein, 10 aa, Artificial Sequence
  Description of Artificial Sequence: Synthetic peptide
  Seed: YPSLREAALL (MAGA4_HUMAN)
YMSLREAALF

SEQ ID NO: 66827 - protein, 10 aa, Artificial Sequence
  Description of Artificial Sequence: Synthetic peptide
  Seed: MIFGIDVKEV (MAGA4_HUMAN)
MLFGIDVKEI

SEQ ID NO: 66828 - protein, 10 aa, Artificial Sequence
  Description of Artificial Sequence: Synthetic peptide
  Seed: YRQVPGSNPA (MAGA4_HUMAN)
YCQVPGSNPY

SEQ ID NO: 66829 - protein, 9 aa, Artificial Sequence
  Description of Artificial Sequence: Synthetic peptide
  Seed: KASESLKMI (MAGA4_HUMAN)
KISESLKMW

SEQ ID NO: 66830 - protein, 9 aa, Artificial Sequence
  Description of Artificial Sequence: Synthetic peptide
  Seed: LGNNQIFPK (MAGA4_HUMAN)
LSNNQIFPR

SEQ ID NO: 66831 - protein, 9 aa, Artificial Sequence
  Description of Artificial Sequence: Synthetic peptide
  Seed: FREALSNKV (MAGA4_HUMAN)
FHEALSNKI

SEQ ID NO: 66832 - protein, 10 aa, Artificial Sequence
  Description of Artificial Sequence: Synthetic peptide
  Seed: YRQVPGSNPA (MAGA4_HUMAN)
YCQVPGSNPF

SEQ ID NO: 66833 - protein, 10 aa, Artificial Sequence
  Description of Artificial Sequence: Synthetic peptide
  Seed: LPTTISFTCW (MAGA4_HUMAN)
LPTTISFTCY

SEQ ID NO: 66834 - protein, 10 aa, Artificial Sequence
  Description of Artificial Sequence: Synthetic peptide
  Seed: ARVRIAYPSL (MAGA4_HUMAN)
AVVRIAYPSA

SEQ ID NO: 66835 - protein, 10 aa, Artificial Sequence
  Description of Artificial Sequence: Synthetic peptide
  Seed: KNYKRCFPVI (MAGA4_HUMAN)
KVYKRCFPVS

SEQ ID NO: 66836 - protein, 9 aa, Artificial Sequence
  Description of Artificial Sequence: Synthetic peptide
  Seed: RQVPGSNPA (MAGA4_HUMAN)
RCVPGSNPY

SEQ ID NO: 66837 - protein, 9 aa, Artificial Sequence
  Description of Artificial Sequence: Synthetic peptide
  Seed: AAVSSSSPL (MAGA4_HUMAN)
AKVSSSSPF

SEQ ID NO: 66838 - protein, 9 aa, Artificial Sequence
  Description of Artificial Sequence: Synthetic peptide
  Seed: RKYRAKELV (MAGA4_HUMAN)
RRYRAKELI

SEQ ID NO: 66839 - protein, 9 aa, Artificial Sequence
  Description of Artificial Sequence: Synthetic peptide
  Seed: TTEEQEAAV (MAGA4_HUMAN)
TVEEQEAAL

SEQ ID NO: 66840 - protein, 9 aa, Artificial Sequence
  Description of Artificial Sequence: Synthetic peptide
  Seed: KVLEHVVRV (MAGA4_HUMAN)
KFLEHVVRK

SEQ ID NO: 66841 - protein, 10 aa, Artificial Sequence
  Description of Artificial Sequence: Synthetic peptide
  Seed: ELAHFLLRKY (MAGA4_HUMAN)
EAAHFLLRKK

SEQ ID NO: 66842 - protein, 9 aa, Artificial Sequence
  Description of Artificial Sequence: Synthetic peptide
  Seed: EIWEELGVM (MAGA4_HUMAN)
EAWEELGVY

SEQ ID NO: 66843 - protein, 9 aa, Artificial Sequence
  Description of Artificial Sequence: Synthetic peptide
  Seed: YKRCFPVIF (MAGA4_HUMAN)
YKRCFPVIY

SEQ ID NO: 66844 - protein, 10 aa, Artificial Sequence
  Description of Artificial Sequence: Synthetic peptide
  Seed: KNYKRCFPVI (MAGA4_HUMAN)
KGYKRCFPVF

SEQ ID NO: 66845 - protein, 10 aa, Artificial Sequence
  Description of Artificial Sequence: Synthetic peptide
  Seed: EHTVYGEPRK (MAGA4_HUMAN)
ETTVYGEPRR

SEQ ID NO: 66846 - protein, 9 aa, Artificial Sequence
  Description of Artificial Sequence: Synthetic peptide
  Seed: NPARYEFLW (MAGA4_HUMAN)
NTARYEFLF

SEQ ID NO: 66847 - protein, 11 aa, Artificial Sequence
  Description of Artificial Sequence: Synthetic peptide
  Seed: RVRIAYPSLRE (MAGA4_HUMAN)
RYRIAYPSLRA

SEQ ID NO: 66848 - protein, 10 aa, Artificial Sequence
  Description of Artificial Sequence: Synthetic peptide
  Seed: LGVMGVYDGR (MAGA4_HUMAN)
LTVMGVYDGK

SEQ ID NO: 66849 - protein, 10 aa, Artificial Sequence
  Description of Artificial Sequence: Synthetic peptide
  Seed: KVLEHVVRVN (MAGA4_HUMAN)
KLLEHVVRVF

SEQ ID NO: 66850 - protein, 10 aa, Artificial Sequence
  Description of Artificial Sequence: Synthetic peptide
  Seed: YPSLREAALL (MAGA4_HUMAN)
YISLREAALF

SEQ ID NO: 66851 - protein, 10 aa, Artificial Sequence
  Description of Artificial Sequence: Synthetic peptide
  Seed: SESLKMIFGI (MAGA4_HUMAN)
SVSLKMIFGW

SEQ ID NO: 66852 - protein, 9 aa, Artificial Sequence
  Description of Artificial Sequence: Synthetic peptide
  Seed: NKVDELAHF (MAGA4_HUMAN)
NLVDELAHF

SEQ ID NO: 66853 - protein, 11 aa, Artificial Sequence
  Description of Artificial Sequence: Synthetic peptide
  Seed: IAMEGDSASEE (MAGA4_HUMAN)
IVMEGDSASEL

SEQ ID NO: 66854 - protein, 11 aa, Artificial Sequence
  Description of Artificial Sequence: Synthetic peptide
  Seed: ELGVMGVYDGR (MAGA4_HUMAN)
EVGVMGVYDGR

SEQ ID NO: 66855 - protein, 9 aa, Artificial Sequence
  Description of Artificial Sequence: Synthetic peptide
  Seed: SALPTTISF (MAGA4_HUMAN)
SVLPTTISF

SEQ ID NO: 66856 - protein, 9 aa, Artificial Sequence
  Description of Artificial Sequence: Synthetic peptide
  Seed: IAYPSLREA (MAGA4_HUMAN)
IIYPSLREA

SEQ ID NO: 66857 - protein, 9 aa, Artificial Sequence
  Description of Artificial Sequence: Synthetic peptide
  Seed: SALPTTISF (MAGA4_HUMAN)
SILPTTISF

SEQ ID NO: 66858 - protein, 11 aa, Artificial Sequence
  Description of Artificial Sequence: Synthetic peptide
  Seed: RQVPGSNPARY (MAGA4_HUMAN)
RVVPGSNPARK

SEQ ID NO: 66859 - protein, 9 aa, Artificial Sequence
  Description of Artificial Sequence: Synthetic peptide
  Seed: QEAAVSSSS (MAGA4_HUMAN)
QEAAVSSSA

SEQ ID NO: 66860 - protein, 11 aa, Artificial Sequence
  Description of Artificial Sequence: Synthetic peptide
  Seed: ELGVMGVYDGR (MAGA4_HUMAN)
EEGVMGVYDGR

SEQ ID NO: 66861 - protein, 9 aa, Artificial Sequence
  Description of Artificial Sequence: Synthetic peptide
  Seed: RCFPVIFGK (MAGA4_HUMAN)
RNFPVIFGK

SEQ ID NO: 66862 - protein, 9 aa, Artificial Sequence
  Description of Artificial Sequence: Synthetic peptide
  Seed: WVQENYLEY (MAGA4_HUMAN)
WTQENYLEW

SEQ ID NO: 66863 - protein, 11 aa, Artificial Sequence
  Description of Artificial Sequence: Synthetic peptide
  Seed: KVDELAHFLLR (MAGA4_HUMAN)
KIDELAHFLLY

SEQ ID NO: 66864 - protein, 9 aa, Artificial Sequence
  Description of Artificial Sequence: Synthetic peptide
  Seed: GTLEEVPAA (MAGA4_HUMAN)
GQLEEVPAM

SEQ ID NO: 66865 - protein, 9 aa, Artificial Sequence
  Description of Artificial Sequence: Synthetic peptide
  Seed: ALSNKVDEL (MAGA4_HUMAN)
ALSNKVDEA

SEQ ID NO: 66866 - protein, 9 aa, Artificial Sequence
  Description of Artificial Sequence: Synthetic peptide
  Seed: STSPDAESL (MAGA4_HUMAN)
STSPDAESR

SEQ ID NO: 66867 - protein, 9 aa, Artificial Sequence
  Description of Artificial Sequence: Synthetic peptide
  Seed: WVQENYLEY (MAGA4_HUMAN)
WPQENYLEH

SEQ ID NO: 66868 - protein, 11 aa, Artificial Sequence
  Description of Artificial Sequence: Synthetic peptide
  Seed: EMLERVIKNYK (MAGA4_HUMAN)
EYLERVIKNYR

SEQ ID NO: 66869 - protein, 11 aa, Artificial Sequence
  Description of Artificial Sequence: Synthetic peptide
  Seed: ELAHFLLRKYR (MAGA4_HUMAN)
EFAHFLLRKYR

SEQ ID NO: 66870 - protein, 10 aa, Artificial Sequence
  Description of Artificial Sequence: Synthetic peptide
  Seed: QIFPKTGLLI (MAGA4_HUMAN)
QIFPKTGLLF

SEQ ID NO: 66871 - protein, 10 aa, Artificial Sequence
  Description of Artificial Sequence: Synthetic peptide
  Seed: YRQVPGSNPA (MAGA4_HUMAN)
YPQVPGSNPY

SEQ ID NO: 66872 - protein, 9 aa, Artificial Sequence
  Description of Artificial Sequence: Synthetic peptide
  Seed: VRIAYPSLR (MAGA4_HUMAN)
VFIAYPSLR

SEQ ID NO: 66873 - protein, 10 aa, Artificial Sequence
  Description of Artificial Sequence: Synthetic peptide
  Seed: YPSLREAALL (MAGA4_HUMAN)
YLSLREAALY

SEQ ID NO: 66874 - protein, 9 aa, Artificial Sequence
  Description of Artificial Sequence: Synthetic peptide
  Seed: SALPTTISF (MAGA4_HUMAN)
SRLPTTISV

SEQ ID NO: 66875 - protein, 10 aa, Artificial Sequence
  Description of Artificial Sequence: Synthetic peptide
  Seed: GVYDGREHTV (MAGA4_HUMAN)
GQYDGREHTY

SEQ ID NO: 66876 - protein, 10 aa, Artificial Sequence
  Description of Artificial Sequence: Synthetic peptide
  Seed: FGKASESLKM (MAGA4_HUMAN)
FHKASESLKF

SEQ ID NO: 66877 - protein, 11 aa, Artificial Sequence
  Description of Artificial Sequence: Synthetic peptide
  Seed: STSPDAESLFR (MAGA4_HUMAN)
STSPDAESLFY

SEQ ID NO: 66878 - protein, 9 aa, Artificial Sequence
  Description of Artificial Sequence: Synthetic peptide
  Seed: SYVKVLEHV (MAGA4_HUMAN)
SWVKVLEHI

SEQ ID NO: 66879 - protein, 9 aa, Artificial Sequence
  Description of Artificial Sequence: Synthetic peptide
  Seed: KVDELAHFL (MAGA4_HUMAN)
KCDELAHFI

SEQ ID NO: 66880 - protein, 9 aa, Artificial Sequence
  Description of Artificial Sequence: Synthetic peptide
  Seed: SYVKVLEHV (MAGA4_HUMAN)
SSVKVLEHV

SEQ ID NO: 66881 - protein, 10 aa, Artificial Sequence
  Description of Artificial Sequence: Synthetic peptide
  Seed: ELAHFLLRKY (MAGA4_HUMAN)
EIAHFLLRKR

SEQ ID NO: 66882 - protein, 9 aa, Artificial Sequence
  Description of Artificial Sequence: Synthetic peptide
  Seed: TQDWVQENY (MAGA4_HUMAN)
TTDWVQENF

SEQ ID NO: 66883 - protein, 9 aa, Artificial Sequence
  Description of Artificial Sequence: Synthetic peptide
  Seed: LAHFLLRKY (MAGA4_HUMAN)
LSHFLLRKW

SEQ ID NO: 66884 - protein, 9 aa, Artificial Sequence
  Description of Artificial Sequence: Synthetic peptide
  Seed: RVRIAYPSL (MAGA4_HUMAN)
RSRIAYPSQ

SEQ ID NO: 66885 - protein, 11 aa, Artificial Sequence
  Description of Artificial Sequence: Synthetic peptide
  Seed: FLLRKYRAKEL (MAGA4_HUMAN)
FMLRKYRAKEL

SEQ ID NO: 66886 - protein, 11 aa, Artificial Sequence
  Description of Artificial Sequence: Synthetic peptide
  Seed: EMLERVIKNYK (MAGA4_HUMAN)
ESLERVIKNYR

SEQ ID NO: 66887 - protein, 9 aa, Artificial Sequence
  Description of Artificial Sequence: Synthetic peptide
  Seed: KVDELAHFL (MAGA4_HUMAN)
KCDELAHFM

SEQ ID NO: 66888 - protein, 10 aa, Artificial Sequence
  Description of Artificial Sequence: Synthetic peptide
  Seed: AYPSLREAAL (MAGA4_HUMAN)
AFPSLREAAF

SEQ ID NO: 66889 - protein, 9 aa, Artificial Sequence
  Description of Artificial Sequence: Synthetic peptide
  Seed: RVRIAYPSL (MAGA4_HUMAN)
RTRIAYPSS

SEQ ID NO: 66890 - protein, 10 aa, Artificial Sequence
  Description of Artificial Sequence: Synthetic peptide
  Seed: YRQVPGSNPA (MAGA4_HUMAN)
YGQVPGSNPF

SEQ ID NO: 66891 - protein, 10 aa, Artificial Sequence
  Description of Artificial Sequence: Synthetic peptide
  Seed: RVRIAYPSLR (MAGA4_HUMAN)
RGRIAYPSLR

SEQ ID NO: 66892 - protein, 9 aa, Artificial Sequence
  Description of Artificial Sequence: Synthetic peptide
  Seed: KVLEHVVRV (MAGA4_HUMAN)
KELEHVVRL

SEQ ID NO: 66893 - protein, 10 aa, Artificial Sequence
  Description of Artificial Sequence: Synthetic peptide
  Seed: SLFREALSNK (MAGA4_HUMAN)
SNFREALSNR

SEQ ID NO: 66894 - protein, 9 aa, Artificial Sequence
  Description of Artificial Sequence: Synthetic peptide
  Seed: LKMIFGIDV (MAGA4_HUMAN)
LHMIFGIDY

SEQ ID NO: 66895 - protein, 10 aa, Artificial Sequence
  Description of Artificial Sequence: Synthetic peptide
  Seed: LLGNNQIFPK (MAGA4_HUMAN)
LAGNNQIFPR

SEQ ID NO: 66896 - protein, 9 aa, Artificial Sequence
  Description of Artificial Sequence: Synthetic peptide
  Seed: SAGPPQSPQ (MAGA4_HUMAN)
SIGPPQSPL

SEQ ID NO: 66897 - protein, 9 aa, Artificial Sequence
  Description of Artificial Sequence: Synthetic peptide
  Seed: NQIFPKTGL (MAGA4_HUMAN)
NMIFPKTGY

SEQ ID NO: 66898 - protein, 11 aa, Artificial Sequence
  Description of Artificial Sequence: Synthetic peptide
  Seed: ELGVMGVYDGR (MAGA4_HUMAN)
EPGVMGVYDGR

SEQ ID NO: 66899 - protein, 9 aa, Artificial Sequence
  Description of Artificial Sequence: Synthetic peptide
  Seed: KYRAKELVT (MAGA4_HUMAN)
KARAKELVA

SEQ ID NO: 66900 - protein, 9 aa, Artificial Sequence
  Description of Artificial Sequence: Synthetic peptide
  Seed: YPSLREAAL (MAGA4_HUMAN)
YSSLREAAF

SEQ ID NO: 66901 - protein, 9 aa, Artificial Sequence
  Description of Artificial Sequence: Synthetic peptide
  Seed: KELVTKAEM (MAGA4_HUMAN)
KELVTKAEV

SEQ ID NO: 66902 - protein, 10 aa, Artificial Sequence
  Description of Artificial Sequence: Synthetic peptide
  Seed: SLFREALSNK (MAGA4_HUMAN)
SHFREALSNR

SEQ ID NO: 66903 - protein, 11 aa, Artificial Sequence
  Description of Artificial Sequence: Synthetic peptide
  Seed: AQAPTTEEQEA (MAGA4_HUMAN)
AQAPTTEEQEM

SEQ ID NO: 66904 - protein, 9 aa, Artificial Sequence
  Description of Artificial Sequence: Synthetic peptide
  Seed: GLLIIVLGT (MAGA4_HUMAN)
GMLIIVLGI

SEQ ID NO: 66905 - protein, 10 aa, Artificial Sequence
  Description of Artificial Sequence: Synthetic peptide
  Seed: TTISFTCWRQ (MAGA4_HUMAN)
TVISFTCWRV

SEQ ID NO: 66906 - protein, 9 aa, Artificial Sequence
  Description of Artificial Sequence: Synthetic peptide
  Seed: EVDPASNTY (MAGA4_HUMAN)
EPDPASNTW

SEQ ID NO: 66907 - protein, 9 aa, Artificial Sequence
  Description of Artificial Sequence: Synthetic peptide
  Seed: TQDWVQENY (MAGA4_HUMAN)
TVDWVQENI

SEQ ID NO: 66908 - protein, 9 aa, Artificial Sequence
  Description of Artificial Sequence: Synthetic peptide
  Seed: VYDGREHTV (MAGA4_HUMAN)
VVDGREHTM

SEQ ID NO: 66909 - protein, 11 aa, Artificial Sequence
  Description of Artificial Sequence: Synthetic peptide
  Seed: ELVTKAEMLER (MAGA4_HUMAN)
ESVTKAEMLER

SEQ ID NO: 66910 - protein, 10 aa, Artificial Sequence
  Description of Artificial Sequence: Synthetic peptide
  Seed: DELAHFLLRK (MAGA4_HUMAN)
DSLAHFLLRK

SEQ ID NO: 66911 - protein, 10 aa, Artificial Sequence
  Description of Artificial Sequence: Synthetic peptide
  Seed: YPSLREAALL (MAGA4_HUMAN)
YVSLREAALY

SEQ ID NO: 66912 - protein, 9 aa, Artificial Sequence
  Description of Artificial Sequence: Synthetic peptide
  Seed: AQEEALGLV (MAGA4_HUMAN)
AEEEALGLP

SEQ ID NO: 66913 - protein, 9 aa, Artificial Sequence
  Description of Artificial Sequence: Synthetic peptide
  Seed: VYGEPRKLL (MAGA4_HUMAN)
VVGEPRKLL

SEQ ID NO: 66914 - protein, 11 aa, Artificial Sequence
  Description of Artificial Sequence: Synthetic peptide
  Seed: LPTTISFTCWR (MAGA4_HUMAN)
LFTTISFTCWR

SEQ ID NO: 66915 - protein, 8 aa, Artificial Sequence
  Description of Artificial Sequence: Synthetic peptide
  Seed: RVRIAYPS (MAGA4_HUMAN)
RTRIAYPT

SEQ ID NO: 66916 - protein, 11 aa, Artificial Sequence
  Description of Artificial Sequence: Synthetic peptide
  Seed: AQAPTTEEQEA (MAGA4_HUMAN)
AMAPTTEEQEM

SEQ ID NO: 66917 - protein, 9 aa, Artificial Sequence
  Description of Artificial Sequence: Synthetic peptide
  Seed: RVRIAYPSL (MAGA4_HUMAN)
RYRIAYPSQ

SEQ ID NO: 66918 - protein, 9 aa, Artificial Sequence
  Description of Artificial Sequence: Synthetic peptide
  Seed: NKVDELAHF (MAGA4_HUMAN)
NYVDELAHF

SEQ ID NO: 66919 - protein, 9 aa, Artificial Sequence
  Description of Artificial Sequence: Synthetic peptide
  Seed: IAMEGDSAS (MAGA4_HUMAN)
ISMEGDSAF

SEQ ID NO: 66920 - protein, 10 aa, Artificial Sequence
  Description of Artificial Sequence: Synthetic peptide
  Seed: KASESLKMIF (MAGA4_HUMAN)
KWSESLKMIW

SEQ ID NO: 66921 - protein, 9 aa, Artificial Sequence
  Description of Artificial Sequence: Synthetic peptide
  Seed: RCFPVIFGK (MAGA4_HUMAN)
RSFPVIFGA

SEQ ID NO: 66922 - protein, 10 aa, Artificial Sequence
  Description of Artificial Sequence: Synthetic peptide
  Seed: TTISFTCWRQ (MAGA4_HUMAN)
TVISFTCWRS

SEQ ID NO: 66923 - protein, 9 aa, Artificial Sequence
  Description of Artificial Sequence: Synthetic peptide
  Seed: RVRIAYPSL (MAGA4_HUMAN)
RMRIAYPSV

SEQ ID NO: 66924 - protein, 9 aa, Artificial Sequence
  Description of Artificial Sequence: Synthetic peptide
  Seed: GLLIIVLGT (MAGA4_HUMAN)
GLLIIVLGI

SEQ ID NO: 66925 - protein, 10 aa, Artificial Sequence
  Description of Artificial Sequence: Synthetic peptide
  Seed: VPAAESAGPP (MAGA4_HUMAN)
VPAAESAGPA

SEQ ID NO: 66926 - protein, 9 aa, Artificial Sequence
  Description of Artificial Sequence: Synthetic peptide
  Seed: WVQENYLEY (MAGA4_HUMAN)
WEQENYLEF

SEQ ID NO: 66927 - protein, 10 aa, Artificial Sequence
  Description of Artificial Sequence: Synthetic peptide
  Seed: ARVRIAYPSL (MAGA4_HUMAN)
ALVRIAYPSK

SEQ ID NO: 66928 - protein, 10 aa, Artificial Sequence
  Description of Artificial Sequence: Synthetic peptide
  Seed: SESLKMIFGI (MAGA4_HUMAN)
STSLKMIFGW

SEQ ID NO: 66929 - protein, 9 aa, Artificial Sequence
  Description of Artificial Sequence: Synthetic peptide
  Seed: EVDPASNTY (MAGA4_HUMAN)
ENDPASNTL

SEQ ID NO: 66930 - protein, 10 aa, Artificial Sequence
  Description of Artificial Sequence: Synthetic peptide
  Seed: KEVDPASNTY (MAGA4_HUMAN)
KVVDPASNTW

SEQ ID NO: 66931 - protein, 10 aa, Artificial Sequence
  Description of Artificial Sequence: Synthetic peptide
  Seed: ARVRIAYPSL (MAGA4_HUMAN)
AVVRIAYPSV

SEQ ID NO: 66932 - protein, 9 aa, Artificial Sequence
  Description of Artificial Sequence: Synthetic peptide
  Seed: SEEEIWEEL (MAGA4_HUMAN)
SHEEIWEEF

SEQ ID NO: 66933 - protein, 10 aa, Artificial Sequence
  Description of Artificial Sequence: Synthetic peptide
  Seed: RQVPGSNPAR (MAGA4_HUMAN)
RQVPGSNPAF

SEQ ID NO: 66934 - protein, 9 aa, Artificial Sequence
  Description of Artificial Sequence: Synthetic peptide
  Seed: RVRIAYPSL (MAGA4_HUMAN)
RARIAYPSG

SEQ ID NO: 66935 - protein, 9 aa, Artificial Sequence
  Description of Artificial Sequence: Synthetic peptide
  Seed: IIVLGTIAM (MAGA4_HUMAN)
IPVLGTIAL

SEQ ID NO: 66936 - protein, 9 aa, Artificial Sequence
  Description of Artificial Sequence: Synthetic peptide
  Seed: AEMLERVIK (MAGA4_HUMAN)
AEMLERVIC

SEQ ID NO: 66937 - protein, 10 aa, Artificial Sequence
  Description of Artificial Sequence: Synthetic peptide
  Seed: SLFREALSNK (MAGA4_HUMAN)
SMFREALSNR

SEQ ID NO: 66938 - protein, 10 aa, Artificial Sequence
  Description of Artificial Sequence: Synthetic peptide
  Seed: KEVDPASNTY (MAGA4_HUMAN)
KPVDPASNTF

SEQ ID NO: 66939 - protein, 10 aa, Artificial Sequence
  Description of Artificial Sequence: Synthetic peptide
  Seed: LPTTISFTCW (MAGA4_HUMAN)
LNTTISFTCW

SEQ ID NO: 66940 - protein, 9 aa, Artificial Sequence
  Description of Artificial Sequence: Synthetic peptide
  Seed: ALLEEEEGV (MAGA4_HUMAN)
AQLEEEEGF

SEQ ID NO: 66941 - protein, 10 aa, Artificial Sequence
  Description of Artificial Sequence: Synthetic peptide
  Seed: VDPASNTYTL (MAGA4_HUMAN)
VDPASNTYTF

SEQ ID NO: 66942 - protein, 10 aa, Artificial Sequence
  Description of Artificial Sequence: Synthetic peptide
  Seed: KYRAKELVTK (MAGA4_HUMAN)
KTRAKELVTR

SEQ ID NO: 66943 - protein, 10 aa, Artificial Sequence
  Description of Artificial Sequence: Synthetic peptide
  Seed: RVRIAYPSLR (MAGA4_HUMAN)
RQRIAYPSLK

SEQ ID NO: 66944 - protein, 10 aa, Artificial Sequence
  Description of Artificial Sequence: Synthetic peptide
  Seed: RVNARVRIAY (MAGA4_HUMAN)
RSNARVRIAK

SEQ ID NO: 66945 - protein, 9 aa, Artificial Sequence
  Description of Artificial Sequence: Synthetic peptide
  Seed: LFREALSNK (MAGA4_HUMAN)
LYREALSNR

SEQ ID NO: 66946 - protein, 9 aa, Artificial Sequence
  Description of Artificial Sequence: Synthetic peptide
  Seed: ALSNKVDEL (MAGA4_HUMAN)
AFSNKVDEL

SEQ ID NO: 66947 - protein, 9 aa, Artificial Sequence
  Description of Artificial Sequence: Synthetic peptide
  Seed: EVDPASNTY (MAGA4_HUMAN)
EPDPASNTF

SEQ ID NO: 66948 - protein, 9 aa, Artificial Sequence
  Description of Artificial Sequence: Synthetic peptide
  Seed: ESLKMIFGI (MAGA4_HUMAN)
EILKMIFGL

SEQ ID NO: 66949 - protein, 10 aa, Artificial Sequence
  Description of Artificial Sequence: Synthetic peptide
  Seed: KASESLKMIF (MAGA4_HUMAN)
KLSESLKMIW

SEQ ID NO: 66950 - protein, 10 aa, Artificial Sequence
  Description of Artificial Sequence: Synthetic peptide
  Seed: RIAYPSLREA (MAGA4_HUMAN)
RWAYPSLREK

SEQ ID NO: 66951 - protein, 9 aa, Artificial Sequence
  Description of Artificial Sequence: Synthetic peptide
  Seed: YPSLREAAL (MAGA4_HUMAN)
YRSLREAAL

SEQ ID NO: 66952 - protein, 9 aa, Artificial Sequence
  Description of Artificial Sequence: Synthetic peptide
  Seed: SALPTTISF (MAGA4_HUMAN)
STLPTTISV

SEQ ID NO: 66953 - protein, 9 aa, Artificial Sequence
  Description of Artificial Sequence: Synthetic peptide
  Seed: LPTTISFTC (MAGA4_HUMAN)
LITTISFTY

SEQ ID NO: 66954 - protein, 9 aa, Artificial Sequence
  Description of Artificial Sequence: Synthetic peptide
  Seed: LPTTISFTC (MAGA4_HUMAN)
LSTTISFTF

SEQ ID NO: 66955 - protein, 9 aa, Artificial Sequence
  Description of Artificial Sequence: Synthetic peptide
  Seed: FGKASESLK (MAGA4_HUMAN)
FAKASESLR

SEQ ID NO: 66956 - protein, 10 aa, Artificial Sequence
  Description of Artificial Sequence: Synthetic peptide
  Seed: EHVVRVNARV (MAGA4_HUMAN)
EDVVRVNARV

SEQ ID NO: 66957 - protein, 9 aa, Artificial Sequence
  Description of Artificial Sequence: Synthetic peptide
  Seed: AAVSSSSPL (MAGA4_HUMAN)
AEVSSSSPM

SEQ ID NO: 66958 - protein, 9 aa, Artificial Sequence
  Description of Artificial Sequence: Synthetic peptide
  Seed: RQVPGSNPA (MAGA4_HUMAN)
RMVPGSNPH

SEQ ID NO: 66959 - protein, 9 aa, Artificial Sequence
  Description of Artificial Sequence: Synthetic peptide
  Seed: EELGVMGVY (MAGA4_HUMAN)
EELGVMGVV

SEQ ID NO: 66960 - protein, 10 aa, Artificial Sequence
  Description of Artificial Sequence: Synthetic peptide
  Seed: VKVLEHVVRV (MAGA4_HUMAN)
VQVLEHVVRV

SEQ ID NO: 66961 - protein, 10 aa, Artificial Sequence
  Description of Artificial Sequence: Synthetic peptide
  Seed: KNYKRCFPVI (MAGA4_HUMAN)
KDYKRCFPVK

SEQ ID NO: 66962 - protein, 9 aa, Artificial Sequence
  Description of Artificial Sequence: Synthetic peptide
  Seed: TVYGEPRKL (MAGA4_HUMAN)
TQYGEPRKM

SEQ ID NO: 66963 - protein, 9 aa, Artificial Sequence
  Description of Artificial Sequence: Synthetic peptide
  Seed: TTISFTCWR (MAGA4_HUMAN)
TLISFTCWR

SEQ ID NO: 66964 - protein, 9 aa, Artificial Sequence
  Description of Artificial Sequence: Synthetic peptide
  Seed: EVDPASNTY (MAGA4_HUMAN)
ETDPASNTR

SEQ ID NO: 66965 - protein, 10 aa, Artificial Sequence
  Description of Artificial Sequence: Synthetic peptide
  Seed: SLFREALSNK (MAGA4_HUMAN)
STFREALSNR

SEQ ID NO: 66966 - protein, 9 aa, Artificial Sequence
  Description of Artificial Sequence: Synthetic peptide
  Seed: VYDGREHTV (MAGA4_HUMAN)
VVDGREHTI

SEQ ID NO: 66967 - protein, 10 aa, Artificial Sequence
  Description of Artificial Sequence: Synthetic peptide
  Seed: KYRAKELVTK (MAGA4_HUMAN)
KGRAKELVTK

SEQ ID NO: 66968 - protein, 10 aa, Artificial Sequence
  Description of Artificial Sequence: Synthetic peptide
  Seed: RVRIAYPSLR (MAGA4_HUMAN)
RTRIAYPSLE

SEQ ID NO: 66969 - protein, 10 aa, Artificial Sequence
  Description of Artificial Sequence: Synthetic peptide
  Seed: TTISFTCWRQ (MAGA4_HUMAN)
TVISFTCWRH

SEQ ID NO: 66970 - protein, 9 aa, Artificial Sequence
  Description of Artificial Sequence: Synthetic peptide
  Seed: AHFLLRKYR (MAGA4_HUMAN)
ASFLLRKYK

SEQ ID NO: 66971 - protein, 10 aa, Artificial Sequence
  Description of Artificial Sequence: Synthetic peptide
  Seed: RIAYPSLREA (MAGA4_HUMAN)
RSAYPSLREK

SEQ ID NO: 66972 - protein, 9 aa, Artificial Sequence
  Description of Artificial Sequence: Synthetic peptide
  Seed: KASESLKMI (MAGA4_HUMAN)
KTSESLKMY

SEQ ID NO: 66973 - protein, 9 aa, Artificial Sequence
  Description of Artificial Sequence: Synthetic peptide
  Seed: ALSNKVDEL (MAGA4_HUMAN)
AYSNKVDEF

SEQ ID NO: 66974 - protein, 9 aa, Artificial Sequence
  Description of Artificial Sequence: Synthetic peptide
  Seed: GVYDGREHT (MAGA4_HUMAN)
GQYDGREHV

SEQ ID NO: 66975 - protein, 9 aa, Artificial Sequence
  Description of Artificial Sequence: Synthetic peptide
  Seed: LRKYRAKEL (MAGA4_HUMAN)
LMKYRAKEI

SEQ ID NO: 66976 - protein, 10 aa, Artificial Sequence
  Description of Artificial Sequence: Synthetic peptide
  Seed: RVRIAYPSLR (MAGA4_HUMAN)
RDRIAYPSLK

SEQ ID NO: 66977 - protein, 9 aa, Artificial Sequence
  Description of Artificial Sequence: Synthetic peptide
  Seed: FGKASESLK (MAGA4_HUMAN)
FAKASESLY

SEQ ID NO: 66978 - protein, 9 aa, Artificial Sequence
  Description of Artificial Sequence: Synthetic peptide
  Seed: TQDWVQENY (MAGA4_HUMAN)
TYDWVQENL

SEQ ID NO: 66979 - protein, 9 aa, Artificial Sequence
  Description of Artificial Sequence: Synthetic peptide
  Seed: VYDGREHTV (MAGA4_HUMAN)
VGDGREHTL

SEQ ID NO: 66980 - protein, 10 aa, Artificial Sequence
  Description of Artificial Sequence: Synthetic peptide
  Seed: VYDGREHTVY (MAGA4_HUMAN)
VFDGREHTVL

SEQ ID NO: 66981 - protein, 11 aa, Artificial Sequence
  Description of Artificial Sequence: Synthetic peptide
  Seed: RVNARVRIAYP (MAGA4_HUMAN)
RTNARVRIAYA

SEQ ID NO: 66982 - protein, 9 aa, Artificial Sequence
  Description of Artificial Sequence: Synthetic peptide
  Seed: TVYGEPRKL (MAGA4_HUMAN)
TSYGEPRKF

SEQ ID NO: 66983 - protein, 9 aa, Artificial Sequence
  Description of Artificial Sequence: Synthetic peptide
  Seed: AAVSSSSPL (MAGA4_HUMAN)
AIVSSSSPI

SEQ ID NO: 66984 - protein, 9 aa, Artificial Sequence
  Description of Artificial Sequence: Synthetic peptide
  Seed: AAVSSSSPL (MAGA4_HUMAN)
AVVSSSSPY

SEQ ID NO: 66985 - protein, 11 aa, Artificial Sequence
  Description of Artificial Sequence: Synthetic peptide
  Seed: RVRIAYPSLRE (MAGA4_HUMAN)
RTRIAYPSLRA

SEQ ID NO: 66986 - protein, 9 aa, Artificial Sequence
  Description of Artificial Sequence: Synthetic peptide
  Seed: SEEEIWEEL (MAGA4_HUMAN)
SLEEIWEEL

SEQ ID NO: 66987 - protein, 9 aa, Artificial Sequence
  Description of Artificial Sequence: Synthetic peptide
  Seed: WVQENYLEY (MAGA4_HUMAN)
WRQENYLEF

SEQ ID NO: 66988 - protein, 9 aa, Artificial Sequence
  Description of Artificial Sequence: Synthetic peptide
  Seed: STSPDAESL (MAGA4_HUMAN)
SASPDAESV

SEQ ID NO: 66989 - protein, 11 aa, Artificial Sequence
  Description of Artificial Sequence: Synthetic peptide
  Seed: LPTTISFTCWR (MAGA4_HUMAN)
LPTTISFTCWW

SEQ ID NO: 66990 - protein, 10 aa, Artificial Sequence
  Description of Artificial Sequence: Synthetic peptide
  Seed: VDPASNTYTL (MAGA4_HUMAN)
VVPASNTYTM

SEQ ID NO: 66991 - protein, 11 aa, Artificial Sequence
  Description of Artificial Sequence: Synthetic peptide
  Seed: RQVPGSNPARY (MAGA4_HUMAN)
RNVPGSNPARY

SEQ ID NO: 66992 - protein, 11 aa, Artificial Sequence
  Description of Artificial Sequence: Synthetic peptide
  Seed: VIKNYKRCFPV (MAGA4_HUMAN)
VLKNYKRCFPV

SEQ ID NO: 66993 - protein, 9 aa, Artificial Sequence
  Description of Artificial Sequence: Synthetic peptide
  Seed: RVRIAYPSL (MAGA4_HUMAN)
RARIAYPSI

SEQ ID NO: 66994 - protein, 10 aa, Artificial Sequence
  Description of Artificial Sequence: Synthetic peptide
  Seed: SSSPLVPGTL (MAGA4_HUMAN)
STSPLVPGTV

SEQ ID NO: 66995 - protein, 9 aa, Artificial Sequence
  Description of Artificial Sequence: Synthetic peptide
  Seed: TVYGEPRKL (MAGA4_HUMAN)
TQYGEPRKL

SEQ ID NO: 66996 - protein, 9 aa, Artificial Sequence
  Description of Artificial Sequence: Synthetic peptide
  Seed: LVPGTLEEV (MAGA4_HUMAN)
LRPGTLEEF

SEQ ID NO: 66997 - protein, 9 aa, Artificial Sequence
  Description of Artificial Sequence: Synthetic peptide
  Seed: AQEEALGLV (MAGA4_HUMAN)
ALEEALGLL

SEQ ID NO: 66998 - protein, 10 aa, Artificial Sequence
  Description of Artificial Sequence: Synthetic peptide
  Seed: VDPASNTYTL (MAGA4_HUMAN)
VFPASNTYTL

SEQ ID NO: 66999 - protein, 10 aa, Artificial Sequence
  Description of Artificial Sequence: Synthetic peptide
  Seed: KVDELAHFLL (MAGA4_HUMAN)
KMDELAHFLH

SEQ ID NO: 67000 - protein, 9 aa, Artificial Sequence
  Description of Artificial Sequence: Synthetic peptide
  Seed: TVYGEPRKL (MAGA4_HUMAN)
TLYGEPRKL

SEQ ID NO: 67001 - protein, 10 aa, Artificial Sequence
  Description of Artificial Sequence: Synthetic peptide
  Seed: AESAGPPQSP (MAGA4_HUMAN)
AESAGPPQSC

SEQ ID NO: 67002 - protein, 9 aa, Artificial Sequence
  Description of Artificial Sequence: Synthetic peptide
  Seed: SYVKVLEHV (MAGA4_HUMAN)
SMVKVLEHF

SEQ ID NO: 67003 - protein, 10 aa, Artificial Sequence
  Description of Artificial Sequence: Synthetic peptide
  Seed: RVRIAYPSLR (MAGA4_HUMAN)
RIRIAYPSLM

SEQ ID NO: 67004 - protein, 9 aa, Artificial Sequence
  Description of Artificial Sequence: Synthetic peptide
  Seed: IAYPSLREA (MAGA4_HUMAN)
ISYPSLREH

SEQ ID NO: 67005 - protein, 9 aa, Artificial Sequence
  Description of Artificial Sequence: Synthetic peptide
  Seed: NTYTLVTCL (MAGA4_HUMAN)
NAYTLVTCF

SEQ ID NO: 67006 - protein, 9 aa, Artificial Sequence
  Description of Artificial Sequence: Synthetic peptide
  Seed: RVRIAYPSL (MAGA4_HUMAN)
RCRIAYPSK

SEQ ID NO: 67007 - protein, 9 aa, Artificial Sequence
  Description of Artificial Sequence: Synthetic peptide
  Seed: SALPTTISF (MAGA4_HUMAN)
SLLPTTISF

SEQ ID NO: 67008 - protein, 9 aa, Artificial Sequence
  Description of Artificial Sequence: Synthetic peptide
  Seed: SSPLVPGTL (MAGA4_HUMAN)
SVPLVPGTR

SEQ ID NO: 67009 - protein, 9 aa, Artificial Sequence
  Description of Artificial Sequence: Synthetic peptide
  Seed: KELVTKAEM (MAGA4_HUMAN)
KMLVTKAEM

SEQ ID NO: 67010 - protein, 9 aa, Artificial Sequence
  Description of Artificial Sequence: Synthetic peptide
  Seed: RQVPGSNPA (MAGA4_HUMAN)
RLVPGSNPM

SEQ ID NO: 67011 - protein, 10 aa, Artificial Sequence
  Description of Artificial Sequence: Synthetic peptide
  Seed: KNYKRCFPVI (MAGA4_HUMAN)
KMYKRCFPVV

SEQ ID NO: 67012 - protein, 9 aa, Artificial Sequence
  Description of Artificial Sequence: Synthetic peptide
  Seed: SYVKVLEHV (MAGA4_HUMAN)
SRVKVLEHY

SEQ ID NO: 67013 - protein, 10 aa, Artificial Sequence
  Description of Artificial Sequence: Synthetic peptide
  Seed: LIIVLGTIAM (MAGA4_HUMAN)
LAIVLGTIAF

SEQ ID NO: 67014 - protein, 9 aa, Artificial Sequence
  Description of Artificial Sequence: Synthetic peptide
  Seed: YDGREHTVY (MAGA4_HUMAN)
YEGREHTVW

SEQ ID NO: 67015 - protein, 9 aa, Artificial Sequence
  Description of Artificial Sequence: Synthetic peptide
  Seed: DPASNTYTL (MAGA4_HUMAN)
DTASNTYTF

SEQ ID NO: 67016 - protein, 10 aa, Artificial Sequence
  Description of Artificial Sequence: Synthetic peptide
  Seed: KVDELAHFLL (MAGA4_HUMAN)
KMDELAHFLA

SEQ ID NO: 67017 - protein, 9 aa, Artificial Sequence
  Description of Artificial Sequence: Synthetic peptide
  Seed: GASALPTTI (MAGA4_HUMAN)
GLSALPTTF

SEQ ID NO: 67018 - protein, 9 aa, Artificial Sequence
  Description of Artificial Sequence: Synthetic peptide
  Seed: WVQENYLEY (MAGA4_HUMAN)
WPQENYLEW

SEQ ID NO: 67019 - protein, 9 aa, Artificial Sequence
  Description of Artificial Sequence: Synthetic peptide
  Seed: GTLEEVPAA (MAGA4_HUMAN)
GMLEEVPAI

SEQ ID NO: 67020 - protein, 9 aa, Artificial Sequence
  Description of Artificial Sequence: Synthetic peptide
  Seed: KNYKRCFPV (MAGA4_HUMAN)
KVYKRCFPR

SEQ ID NO: 67021 - protein, 10 aa, Artificial Sequence
  Description of Artificial Sequence: Synthetic peptide
  Seed: KNYKRCFPVI (MAGA4_HUMAN)
KIYKRCFPVF

SEQ ID NO: 67022 - protein, 9 aa, Artificial Sequence
  Description of Artificial Sequence: Synthetic peptide
  Seed: SALPTTISF (MAGA4_HUMAN)
SMLPTTISY

SEQ ID NO: 67023 - protein, 10 aa, Artificial Sequence
  Description of Artificial Sequence: Synthetic peptide
  Seed: LGVMGVYDGR (MAGA4_HUMAN)
LTVMGVYDGR

SEQ ID NO: 67024 - protein, 11 aa, Artificial Sequence
  Description of Artificial Sequence: Synthetic peptide
  Seed: SAGPPQSPQGA (MAGA4_HUMAN)
SAGPPQSPQGY

SEQ ID NO: 67025 - protein, 9 aa, Artificial Sequence
  Description of Artificial Sequence: Synthetic peptide
  Seed: ESLKMIFGI (MAGA4_HUMAN)
EVLKMIFGV

SEQ ID NO: 67026 - protein, 10 aa, Artificial Sequence
  Description of Artificial Sequence: Synthetic peptide
  Seed: KEVDPASNTY (MAGA4_HUMAN)
KEVDPASNTF

SEQ ID NO: 67027 - protein, 9 aa, Artificial Sequence
  Description of Artificial Sequence: Synthetic peptide
  Seed: NQIFPKTGL (MAGA4_HUMAN)
NEIFPKTGV

SEQ ID NO: 67028 - protein, 9 aa, Artificial Sequence
  Description of Artificial Sequence: Synthetic peptide
  Seed: VYDGREHTV (MAGA4_HUMAN)
VLDGREHTY

SEQ ID NO: 67029 - protein, 9 aa, Artificial Sequence
  Description of Artificial Sequence: Synthetic peptide
  Seed: RAKELVTKA (MAGA4_HUMAN)
RQKELVTKI

SEQ ID NO: 67030 - protein, 10 aa, Artificial Sequence
  Description of Artificial Sequence: Synthetic peptide
  Seed: VDPASNTYTL (MAGA4_HUMAN)
VSPASNTYTF

SEQ ID NO: 67031 - protein, 9 aa, Artificial Sequence
  Description of Artificial Sequence: Synthetic peptide
  Seed: AESLFREAL (MAGA4_HUMAN)
AQSLFREAL

SEQ ID NO: 67032 - protein, 9 aa, Artificial Sequence
  Description of Artificial Sequence: Synthetic peptide
  Seed: SEEEIWEEL (MAGA4_HUMAN)
SREEIWEEI

SEQ ID NO: 67033 - protein, 9 aa, Artificial Sequence
  Description of Artificial Sequence: Synthetic peptide
  Seed: EAQEEALGL (MAGA4_HUMAN)
ETQEEALGR

SEQ ID NO: 67034 - protein, 9 aa, Artificial Sequence
  Description of Artificial Sequence: Synthetic peptide
  Seed: LPTTISFTC (MAGA4_HUMAN)
LATTISFTF

SEQ ID NO: 67035 - protein, 9 aa, Artificial Sequence
  Description of Artificial Sequence: Synthetic peptide
  Seed: LVPGTLEEV (MAGA4_HUMAN)
LMPGTLEEL

SEQ ID NO: 67036 - protein, 9 aa, Artificial Sequence
  Description of Artificial Sequence: Synthetic peptide
  Seed: TSPDAESLF (MAGA4_HUMAN)
TAPDAESLV

SEQ ID NO: 67037 - protein, 9 aa, Artificial Sequence
  Description of Artificial Sequence: Synthetic peptide
  Seed: VNARVRIAY (MAGA4_HUMAN)
VSARVRIAY

SEQ ID NO: 67038 - protein, 9 aa, Artificial Sequence
  Description of Artificial Sequence: Synthetic peptide
  Seed: IIVLGTIAM (MAGA4_HUMAN)
ILVLGTIAM

SEQ ID NO: 67039 - protein, 11 aa, Artificial Sequence
  Description of Artificial Sequence: Synthetic peptide
  Seed: KEVDPASNTYT (MAGA4_HUMAN)
KEVDPASNTYV

SEQ ID NO: 67040 - protein, 9 aa, Artificial Sequence
  Description of Artificial Sequence: Synthetic peptide
  Seed: VTKAEMLER (MAGA4_HUMAN)
VTKAEMLEK

SEQ ID NO: 67041 - protein, 9 aa, Artificial Sequence
  Description of Artificial Sequence: Synthetic peptide
  Seed: HVVRVNARV (MAGA4_HUMAN)
HLVRVNARV

SEQ ID NO: 67042 - protein, 9 aa, Artificial Sequence
  Description of Artificial Sequence: Synthetic peptide
  Seed: KVLEHVVRV (MAGA4_HUMAN)
KMLEHVVRY

SEQ ID NO: 67043 - protein, 9 aa, Artificial Sequence
  Description of Artificial Sequence: Synthetic peptide
  Seed: LGNNQIFPK (MAGA4_HUMAN)
LYNNQIFPK

SEQ ID NO: 67044 - protein, 9 aa, Artificial Sequence
  Description of Artificial Sequence: Synthetic peptide
  Seed: RQVPGSNPA (MAGA4_HUMAN)
RTVPGSNPV

SEQ ID NO: 67045 - protein, 9 aa, Artificial Sequence
  Description of Artificial Sequence: Synthetic peptide
  Seed: MSSEQKSQH (MAGA4_HUMAN)
MTSEQKSQF

SEQ ID NO: 67046 - protein, 10 aa, Artificial Sequence
  Description of Artificial Sequence: Synthetic peptide
  Seed: ARVRIAYPSL (MAGA4_HUMAN)
ARVRIAYPSA

SEQ ID NO: 67047 - protein, 9 aa, Artificial Sequence
  Description of Artificial Sequence: Synthetic peptide
  Seed: EVDPASNTY (MAGA4_HUMAN)
EPDPASNTM

SEQ ID NO: 67048 - protein, 9 aa, Artificial Sequence
  Description of Artificial Sequence: Synthetic peptide
  Seed: NTYTLVTCL (MAGA4_HUMAN)
NRYTLVTCL

SEQ ID NO: 67049 - protein, 10 aa, Artificial Sequence
  Description of Artificial Sequence: Synthetic peptide
  Seed: ASALPTTISF (MAGA4_HUMAN)
AAALPTTISL

SEQ ID NO: 67050 - protein, 9 aa, Artificial Sequence
  Description of Artificial Sequence: Synthetic peptide
  Seed: GASALPTTI (MAGA4_HUMAN)
GVSALPTTW

SEQ ID NO: 67051 - protein, 9 aa, Artificial Sequence
  Description of Artificial Sequence: Synthetic peptide
  Seed: SPLVPGTLE (MAGA4_HUMAN)
SPLVPGTLA

SEQ ID NO: 67052 - protein, 10 aa, Artificial Sequence
  Description of Artificial Sequence: Synthetic peptide
  Seed: LGVMGVYDGR (MAGA4_HUMAN)
LEVMGVYDGK

SEQ ID NO: 67053 - protein, 9 aa, Artificial Sequence
  Description of Artificial Sequence: Synthetic peptide
  Seed: RQVPGSNPA (MAGA4_HUMAN)
RGVPGSNPM

SEQ ID NO: 67054 - protein, 10 aa, Artificial Sequence
  Description of Artificial Sequence: Synthetic peptide
  Seed: KVLEHVVRVN (MAGA4_HUMAN)
KVLEHVVRVV

SEQ ID NO: 67055 - protein, 9 aa, Artificial Sequence
  Description of Artificial Sequence: Synthetic peptide
  Seed: TTEEQEAAV (MAGA4_HUMAN)
TAEEQEAAF

SEQ ID NO: 67056 - protein, 9 aa, Artificial Sequence
  Description of Artificial Sequence: Synthetic peptide
  Seed: TSPDAESLF (MAGA4_HUMAN)
TIPDAESLF

SEQ ID NO: 67057 - protein, 11 aa, Artificial Sequence
  Description of Artificial Sequence: Synthetic peptide
  Seed: EEGVEAQEEAL (MAGA4_HUMAN)
EEGVEAQEEAW

SEQ ID NO: 67058 - protein, 11 aa, Artificial Sequence
  Description of Artificial Sequence: Synthetic peptide
  Seed: RQVPGSNPARY (MAGA4_HUMAN)
RMVPGSNPARL

SEQ ID NO: 67059 - protein, 10 aa, Artificial Sequence
  Description of Artificial Sequence: Synthetic peptide
  Seed: RIAYPSLREA (MAGA4_HUMAN)
RMAYPSLREK

SEQ ID NO: 67060 - protein, 9 aa, Artificial Sequence
  Description of Artificial Sequence: Synthetic peptide
  Seed: YPSLREAAL (MAGA4_HUMAN)
YASLREAAI

SEQ ID NO: 67061 - protein, 9 aa, Artificial Sequence
  Description of Artificial Sequence: Synthetic peptide
  Seed: KVLEHVVRV (MAGA4_HUMAN)
KTLEHVVRY

SEQ ID NO: 67062 - protein, 9 aa, Artificial Sequence
  Description of Artificial Sequence: Synthetic peptide
  Seed: YKRCFPVIF (MAGA4_HUMAN)
YLRCFPVIF

SEQ ID NO: 67063 - protein, 10 aa, Artificial Sequence
  Description of Artificial Sequence: Synthetic peptide
  Seed: KELVTKAEML (MAGA4_HUMAN)
KELVTKAEMW

SEQ ID NO: 67064 - protein, 9 aa, Artificial Sequence
  Description of Artificial Sequence: Synthetic peptide
  Seed: KEVDPASNT (MAGA4_HUMAN)
KEVDPASNV

SEQ ID NO: 67065 - protein, 9 aa, Artificial Sequence
  Description of Artificial Sequence: Synthetic peptide
  Seed: GSNPARYEF (MAGA4_HUMAN)
GRNPARYEI

SEQ ID NO: 67066 - protein, 9 aa, Artificial Sequence
  Description of Artificial Sequence: Synthetic peptide
  Seed: WVQENYLEY (MAGA4_HUMAN)
WFQENYLEV

SEQ ID NO: 67067 - protein, 9 aa, Artificial Sequence
  Description of Artificial Sequence: Synthetic peptide
  Seed: VYDGREHTV (MAGA4_HUMAN)
VPDGREHTL

SEQ ID NO: 67068 - protein, 9 aa, Artificial Sequence
  Description of Artificial Sequence: Synthetic peptide
  Seed: DELAHFLLR (MAGA4_HUMAN)
DTLAHFLLR

SEQ ID NO: 67069 - protein, 9 aa, Artificial Sequence
  Description of Artificial Sequence: Synthetic peptide
  Seed: ARVRIAYPS (MAGA4_HUMAN)
ARVRIAYPI

SEQ ID NO: 67070 - protein, 9 aa, Artificial Sequence
  Description of Artificial Sequence: Synthetic peptide
  Seed: KVLEHVVRV (MAGA4_HUMAN)
KALEHVVRW

SEQ ID NO: 67071 - protein, 9 aa, Artificial Sequence
  Description of Artificial Sequence: Synthetic peptide
  Seed: KVLEHVVRV (MAGA4_HUMAN)
KILEHVVRL

SEQ ID NO: 67072 - protein, 9 aa, Artificial Sequence
  Description of Artificial Sequence: Synthetic peptide
  Seed: AAVSSSSPL (MAGA4_HUMAN)
AKVSSSSPV

SEQ ID NO: 67073 - protein, 10 aa, Artificial Sequence
  Description of Artificial Sequence: Synthetic peptide
  Seed: ELAHFLLRKY (MAGA4_HUMAN)
EIAHFLLRKK

SEQ ID NO: 67074 - protein, 9 aa, Artificial Sequence
  Description of Artificial Sequence: Synthetic peptide
  Seed: RVRIAYPSL (MAGA4_HUMAN)
RQRIAYPSI

SEQ ID NO: 67075 - protein, 9 aa, Artificial Sequence
  Description of Artificial Sequence: Synthetic peptide
  Seed: KYRAKELVT (MAGA4_HUMAN)
KSRAKELVT

SEQ ID NO: 67076 - protein, 9 aa, Artificial Sequence
  Description of Artificial Sequence: Synthetic peptide
  Seed: YTLVTCLGL (MAGA4_HUMAN)
YTLVTCLGW

SEQ ID NO: 67077 - protein, 9 aa, Artificial Sequence
  Description of Artificial Sequence: Synthetic peptide
  Seed: HVVRVNARV (MAGA4_HUMAN)
HTVRVNARA

SEQ ID NO: 67078 - protein, 10 aa, Artificial Sequence
  Description of Artificial Sequence: Synthetic peptide
  Seed: EMLERVIKNY (MAGA4_HUMAN)
ESLERVIKNR

SEQ ID NO: 67079 - protein, 8 aa, Artificial Sequence
  Description of Artificial Sequence: Synthetic peptide
  Seed: SEQKSQHC (MAGA4_HUMAN)
SEQKSQHF

SEQ ID NO: 67080 - protein, 9 aa, Artificial Sequence
  Description of Artificial Sequence: Synthetic peptide
  Seed: RQVPGSNPA (MAGA4_HUMAN)
RMVPGSNPL

SEQ ID NO: 67081 - protein, 11 aa, Artificial Sequence
  Description of Artificial Sequence: Synthetic peptide
  Seed: ELGVMGVYDGR (MAGA4_HUMAN)
EDGVMGVYDGR

SEQ ID NO: 67082 - protein, 9 aa, Artificial Sequence
  Description of Artificial Sequence: Synthetic peptide
  Seed: VNARVRIAY (MAGA4_HUMAN)
VQARVRIAL

SEQ ID NO: 67083 - protein, 10 aa, Artificial Sequence
  Description of Artificial Sequence: Synthetic peptide
  Seed: KVLEHVVRVN (MAGA4_HUMAN)
KLLEHVVRVI

SEQ ID NO: 67084 - protein, 9 aa, Artificial Sequence
  Description of Artificial Sequence: Synthetic peptide
  Seed: RVNARVRIA (MAGA4_HUMAN)
RSNARVRIL

SEQ ID NO: 67085 - protein, 9 aa, Artificial Sequence
  Description of Artificial Sequence: Synthetic peptide
  Seed: ERVIKNYKR (MAGA4_HUMAN)
EYVIKNYKK

SEQ ID NO: 67086 - protein, 9 aa, Artificial Sequence
  Description of Artificial Sequence: Synthetic peptide
  Seed: FPVIFGKAS (MAGA4_HUMAN)
FPVIFGKAW

SEQ ID NO: 67087 - protein, 10 aa, Artificial Sequence
  Description of Artificial Sequence: Synthetic peptide
  Seed: SSSPLVPGTL (MAGA4_HUMAN)
SSSPLVPGTW

SEQ ID NO: 67088 - protein, 9 aa, Artificial Sequence
  Description of Artificial Sequence: Synthetic peptide
  Seed: RVRIAYPSL (MAGA4_HUMAN)
RVRIAYPSA

SEQ ID NO: 67089 - protein, 9 aa, Artificial Sequence
  Description of Artificial Sequence: Synthetic peptide
  Seed: NTYTLVTCL (MAGA4_HUMAN)
NLYTLVTCL

SEQ ID NO: 67090 - protein, 9 aa, Artificial Sequence
  Description of Artificial Sequence: Synthetic peptide
  Seed: TTISFTCWR (MAGA4_HUMAN)
TAISFTCWR

SEQ ID NO: 67091 - protein, 9 aa, Artificial Sequence
  Description of Artificial Sequence: Synthetic peptide
  Seed: SNPARYEFL (MAGA4_HUMAN)
SVPARYEFL

SEQ ID NO: 67092 - protein, 9 aa, Artificial Sequence
  Description of Artificial Sequence: Synthetic peptide
  Seed: ALSNKVDEL (MAGA4_HUMAN)
ARSNKVDEL

SEQ ID NO: 67093 - protein, 10 aa, Artificial Sequence
  Description of Artificial Sequence: Synthetic peptide
  Seed: EHVVRVNARV (MAGA4_HUMAN)
EVVVRVNARV

SEQ ID NO: 67094 - protein, 9 aa, Artificial Sequence
  Description of Artificial Sequence: Synthetic peptide
  Seed: TVYGEPRKL (MAGA4_HUMAN)
TRYGEPRKV

SEQ ID NO: 67095 - protein, 9 aa, Artificial Sequence
  Description of Artificial Sequence: Synthetic peptide
  Seed: KVLEHVVRV (MAGA4_HUMAN)
KELEHVVRV

SEQ ID NO: 67096 - protein, 10 aa, Artificial Sequence
  Description of Artificial Sequence: Synthetic peptide
  Seed: IAYPSLREAA (MAGA4_HUMAN)
ISYPSLREAF

SEQ ID NO: 67097 - protein, 10 aa, Artificial Sequence
  Description of Artificial Sequence: Synthetic peptide
  Seed: TLVTCLGLSY (MAGA4_HUMAN)
TMVTCLGLSF

SEQ ID NO: 67098 - protein, 10 aa, Artificial Sequence
  Description of Artificial Sequence: Synthetic peptide
  Seed: KRCFPVIFGK (MAGA4_HUMAN)
KVCFPVIFGR

SEQ ID NO: 67099 - protein, 9 aa, Artificial Sequence
  Description of Artificial Sequence: Synthetic peptide
  Seed: QIFPKTGLL (MAGA4_HUMAN)
QMFPKTGLK

SEQ ID NO: 67100 - protein, 9 aa, Artificial Sequence
  Description of Artificial Sequence: Synthetic peptide
  Seed: WVQENYLEY (MAGA4_HUMAN)
WPQENYLEY

SEQ ID NO: 67101 - protein, 11 aa, Artificial Sequence
  Description of Artificial Sequence: Synthetic peptide
  Seed: GLLGNNQIFPK (MAGA4_HUMAN)
GFLGNNQIFPR

SEQ ID NO: 67102 - protein, 9 aa, Artificial Sequence
  Description of Artificial Sequence: Synthetic peptide
  Seed: SYVKVLEHV (MAGA4_HUMAN)
SLVKVLEHL

SEQ ID NO: 67103 - protein, 9 aa, Artificial Sequence
  Description of Artificial Sequence: Synthetic peptide
  Seed: MLERVIKNY (MAGA4_HUMAN)
MQERVIKNF

SEQ ID NO: 67104 - protein, 8 aa, Artificial Sequence
  Description of Artificial Sequence: Synthetic peptide
  Seed: SLKMIFGI (MAGA4_HUMAN)
SLKMIFGV

SEQ ID NO: 67105 - protein, 9 aa, Artificial Sequence
  Description of Artificial Sequence: Synthetic peptide
  Seed: SAGPPQSPQ (MAGA4_HUMAN)
STGPPQSPF

SEQ ID NO: 67106 - protein, 9 aa, Artificial Sequence
  Description of Artificial Sequence: Synthetic peptide
  Seed: SEEEIWEEL (MAGA4_HUMAN)
SMEEIWEEM

SEQ ID NO: 67107 - protein, 9 aa, Artificial Sequence
  Description of Artificial Sequence: Synthetic peptide
  Seed: GTLEEVPAA (MAGA4_HUMAN)
GALEEVPAV

SEQ ID NO: 67108 - protein, 11 aa, Artificial Sequence
  Description of Artificial Sequence: Synthetic peptide
  Seed: IAYPSLREAAL (MAGA4_HUMAN)
ISYPSLREAAY

SEQ ID NO: 67109 - protein, 10 aa, Artificial Sequence
  Description of Artificial Sequence: Synthetic peptide
  Seed: VVRVNARVRI (MAGA4_HUMAN)
VVRVNARVRK

SEQ ID NO: 67110 - protein, 9 aa, Artificial Sequence
  Description of Artificial Sequence: Synthetic peptide
  Seed: EIWEELGVM (MAGA4_HUMAN)
EMWEELGVR

SEQ ID NO: 67111 - protein, 11 aa, Artificial Sequence
  Description of Artificial Sequence: Synthetic peptide
  Seed: ALPTTISFTCW (MAGA4_HUMAN)
AYPTTISFTCW

SEQ ID NO: 67112 - protein, 9 aa, Artificial Sequence
  Description of Artificial Sequence: Synthetic peptide
  Seed: AQEEALGLV (MAGA4_HUMAN)
AMEEALGLV

SEQ ID NO: 67113 - protein, 9 aa, Artificial Sequence
  Description of Artificial Sequence: Synthetic peptide
  Seed: STSPDAESL (MAGA4_HUMAN)
SSSPDAESF

SEQ ID NO: 67114 - protein, 10 aa, Artificial Sequence
  Description of Artificial Sequence: Synthetic peptide
  Seed: KVDELAHFLL (MAGA4_HUMAN)
KLDELAHFLV

SEQ ID NO: 67115 - protein, 10 aa, Artificial Sequence
  Description of Artificial Sequence: Synthetic peptide
  Seed: RVRIAYPSLR (MAGA4_HUMAN)
RWRIAYPSLK

SEQ ID NO: 67116 - protein, 9 aa, Artificial Sequence
  Description of Artificial Sequence: Synthetic peptide
  Seed: FREALSNKV (MAGA4_HUMAN)
FHEALSNKL

SEQ ID NO: 67117 - protein, 10 aa, Artificial Sequence
  Description of Artificial Sequence: Synthetic peptide
  Seed: YRQVPGSNPA (MAGA4_HUMAN)
YLQVPGSNPI

SEQ ID NO: 67118 - protein, 9 aa, Artificial Sequence
  Description of Artificial Sequence: Synthetic peptide
  Seed: SSPLVPGTL (MAGA4_HUMAN)
SFPLVPGTF

SEQ ID NO: 67119 - protein, 9 aa, Artificial Sequence
  Description of Artificial Sequence: Synthetic peptide
  Seed: RVRIAYPSL (MAGA4_HUMAN)
RTRIAYPSA

SEQ ID NO: 67120 - protein, 10 aa, Artificial Sequence
  Description of Artificial Sequence: Synthetic peptide
  Seed: SPQGASALPT (MAGA4_HUMAN)
SPQGASALPL

SEQ ID NO: 67121 - protein, 9 aa, Artificial Sequence
  Description of Artificial Sequence: Synthetic peptide
  Seed: TSPDAESLF (MAGA4_HUMAN)
TPPDAESLY

SEQ ID NO: 67122 - protein, 11 aa, Artificial Sequence
  Description of Artificial Sequence: Synthetic peptide
  Seed: GVYDGREHTVY (MAGA4_HUMAN)
GAYDGREHTVL

SEQ ID NO: 67123 - protein, 9 aa, Artificial Sequence
  Description of Artificial Sequence: Synthetic peptide
  Seed: KELVTKAEM (MAGA4_HUMAN)
KILVTKAEY

SEQ ID NO: 67124 - protein, 10 aa, Artificial Sequence
  Description of Artificial Sequence: Synthetic peptide
  Seed: LPTTISFTCW (MAGA4_HUMAN)
LQTTISFTCW

SEQ ID NO: 67125 - protein, 9 aa, Artificial Sequence
  Description of Artificial Sequence: Synthetic peptide
  Seed: GASALPTTI (MAGA4_HUMAN)
GSSALPTTY

SEQ ID NO: 67126 - protein, 10 aa, Artificial Sequence
  Description of Artificial Sequence: Synthetic peptide
  Seed: VDPASNTYTL (MAGA4_HUMAN)
VHPASNTYTL

SEQ ID NO: 67127 - protein, 8 aa, Artificial Sequence
  Description of Artificial Sequence: Synthetic peptide
  Seed: SAGPPQSP (MAGA4_HUMAN)
SAGPPQSF

SEQ ID NO: 67128 - protein, 10 aa, Artificial Sequence
  Description of Artificial Sequence: Synthetic peptide
  Seed: RVRIAYPSLR (MAGA4_HUMAN)
RFRIAYPSLM

SEQ ID NO: 67129 - protein, 9 aa, Artificial Sequence
  Description of Artificial Sequence: Synthetic peptide
  Seed: KVLEHVVRV (MAGA4_HUMAN)
KMLEHVVRA

SEQ ID NO: 67130 - protein, 10 aa, Artificial Sequence
  Description of Artificial Sequence: Synthetic peptide
  Seed: RIAYPSLREA (MAGA4_HUMAN)
RLAYPSLREI

SEQ ID NO: 67131 - protein, 9 aa, Artificial Sequence
  Description of Artificial Sequence: Synthetic peptide
  Seed: NKVDELAHF (MAGA4_HUMAN)
NMVDELAHF

SEQ ID NO: 67132 - protein, 11 aa, Artificial Sequence
  Description of Artificial Sequence: Synthetic peptide
  Seed: KVDELAHFLLR (MAGA4_HUMAN)
KMDELAHFLLK

SEQ ID NO: 67133 - protein, 9 aa, Artificial Sequence
  Description of Artificial Sequence: Synthetic peptide
  Seed: RVRIAYPSL (MAGA4_HUMAN)
RTRIAYPSE

SEQ ID NO: 67134 - protein, 10 aa, Artificial Sequence
  Description of Artificial Sequence: Synthetic peptide
  Seed: FGKASESLKM (MAGA4_HUMAN)
FLKASESLKY

SEQ ID NO: 67135 - protein, 9 aa, Artificial Sequence
  Description of Artificial Sequence: Synthetic peptide
  Seed: SYVKVLEHV (MAGA4_HUMAN)
SMVKVLEHT

SEQ ID NO: 67136 - protein, 10 aa, Artificial Sequence
  Description of Artificial Sequence: Synthetic peptide
  Seed: TLVTCLGLSY (MAGA4_HUMAN)
TQVTCLGLSF

SEQ ID NO: 67137 - protein, 9 aa, Artificial Sequence
  Description of Artificial Sequence: Synthetic peptide
  Seed: QIFPKTGLL (MAGA4_HUMAN)
QLFPKTGLI

SEQ ID NO: 67138 - protein, 10 aa, Artificial Sequence
  Description of Artificial Sequence: Synthetic peptide
  Seed: TSYVKVLEHV (MAGA4_HUMAN)
TVYVKVLEHF

SEQ ID NO: 67139 - protein, 9 aa, Artificial Sequence
  Description of Artificial Sequence: Synthetic peptide
  Seed: WVQENYLEY (MAGA4_HUMAN)
WSQENYLEF

SEQ ID NO: 67140 - protein, 10 aa, Artificial Sequence
  Description of Artificial Sequence: Synthetic peptide
  Seed: YRQVPGSNPA (MAGA4_HUMAN)
YLQVPGSNPL

SEQ ID NO: 67141 - protein, 10 aa, Artificial Sequence
  Description of Artificial Sequence: Synthetic peptide
  Seed: KYRAKELVTK (MAGA4_HUMAN)
KTRAKELVTA

SEQ ID NO: 67142 - protein, 10 aa, Artificial Sequence
  Description of Artificial Sequence: Synthetic peptide
  Seed: EHTVYGEPRK (MAGA4_HUMAN)
EETVYGEPRR

SEQ ID NO: 67143 - protein, 10 aa, Artificial Sequence
  Description of Artificial Sequence: Synthetic peptide
  Seed: KYRAKELVTK (MAGA4_HUMAN)
KSRAKELVTM

SEQ ID NO: 67144 - protein, 10 aa, Artificial Sequence
  Description of Artificial Sequence: Synthetic peptide
  Seed: KVDELAHFLL (MAGA4_HUMAN)
KMDELAHFLG

SEQ ID NO: 67145 - protein, 9 aa, Artificial Sequence
  Description of Artificial Sequence: Synthetic peptide
  Seed: KELVTKAEM (MAGA4_HUMAN)
KVLVTKAEF

SEQ ID NO: 67146 - protein, 11 aa, Artificial Sequence
  Description of Artificial Sequence: Synthetic peptide
  Seed: GVYDGREHTVY (MAGA4_HUMAN)
GLYDGREHTVY

SEQ ID NO: 67147 - protein, 10 aa, Artificial Sequence
  Description of Artificial Sequence: Synthetic peptide
  Seed: RVRIAYPSLR (MAGA4_HUMAN)
RSRIAYPSLV

SEQ ID NO: 67148 - protein, 9 aa, Artificial Sequence
  Description of Artificial Sequence: Synthetic peptide
  Seed: LVPGTLEEV (MAGA4_HUMAN)
LFPGTLEEF

SEQ ID NO: 67149 - protein, 9 aa, Artificial Sequence
  Description of Artificial Sequence: Synthetic peptide
  Seed: FREALSNKV (MAGA4_HUMAN)
FYEALSNKF

SEQ ID NO: 67150 - protein, 9 aa, Artificial Sequence
  Description of Artificial Sequence: Synthetic peptide
  Seed: TVYGEPRKL (MAGA4_HUMAN)
TIYGEPRKL

SEQ ID NO: 67151 - protein, 10 aa, Artificial Sequence
  Description of Artificial Sequence: Synthetic peptide
  Seed: GVYDGREHTV (MAGA4_HUMAN)
GAYDGREHTM

SEQ ID NO: 67152 - protein, 9 aa, Artificial Sequence
  Description of Artificial Sequence: Synthetic peptide
  Seed: HVVRVNARV (MAGA4_HUMAN)
HTVRVNARL

SEQ ID NO: 67153 - protein, 9 aa, Artificial Sequence
  Description of Artificial Sequence: Synthetic peptide
  Seed: YPSLREAAL (MAGA4_HUMAN)
YMSLREAAL

SEQ ID NO: 67154 - protein, 10 aa, Artificial Sequence
  Description of Artificial Sequence: Synthetic peptide
  Seed: RVRIAYPSLR (MAGA4_HUMAN)
RGRIAYPSLL

SEQ ID NO: 67155 - protein, 10 aa, Artificial Sequence
  Description of Artificial Sequence: Synthetic peptide
  Seed: KVDELAHFLL (MAGA4_HUMAN)
KLDELAHFLR

SEQ ID NO: 67156 - protein, 9 aa, Artificial Sequence
  Description of Artificial Sequence: Synthetic peptide
  Seed: KVDELAHFL (MAGA4_HUMAN)
KVDELAHFR

SEQ ID NO: 67157 - protein, 9 aa, Artificial Sequence
  Description of Artificial Sequence: Synthetic peptide
  Seed: SYVKVLEHV (MAGA4_HUMAN)
STVKVLEHY

SEQ ID NO: 67158 - protein, 9 aa, Artificial Sequence
  Description of Artificial Sequence: Synthetic peptide
  Seed: DPASNTYTL (MAGA4_HUMAN)
DMASNTYTF

SEQ ID NO: 67159 - protein, 9 aa, Artificial Sequence
  Description of Artificial Sequence: Synthetic peptide
  Seed: ALSNKVDEL (MAGA4_HUMAN)
AASNKVDEY

SEQ ID NO: 67160 - protein, 10 aa, Artificial Sequence
  Description of Artificial Sequence: Synthetic peptide
  Seed: DELAHFLLRK (MAGA4_HUMAN)
DILAHFLLRK

SEQ ID NO: 67161 - protein, 9 aa, Artificial Sequence
  Description of Artificial Sequence: Synthetic peptide
  Seed: KVLEHVVRV (MAGA4_HUMAN)
KALEHVVRM

SEQ ID NO: 67162 - protein, 9 aa, Artificial Sequence
  Description of Artificial Sequence: Synthetic peptide
  Seed: WVQENYLEY (MAGA4_HUMAN)
WFQENYLEM

SEQ ID NO: 67163 - protein, 9 aa, Artificial Sequence
  Description of Artificial Sequence: Synthetic peptide
  Seed: YVKVLEHVV (MAGA4_HUMAN)
YAKVLEHVM

SEQ ID NO: 67164 - protein, 10 aa, Artificial Sequence
  Description of Artificial Sequence: Synthetic peptide
  Seed: KVLEHVVRVN (MAGA4_HUMAN)
KMLEHVVRVQ

SEQ ID NO: 67165 - protein, 9 aa, Artificial Sequence
  Description of Artificial Sequence: Synthetic peptide
  Seed: RQVPGSNPA (MAGA4_HUMAN)
RLVPGSNPY

SEQ ID NO: 67166 - protein, 9 aa, Artificial Sequence
  Description of Artificial Sequence: Synthetic peptide
  Seed: LVPGTLEEV (MAGA4_HUMAN)
LVPGTLEEA

SEQ ID NO: 67167 - protein, 9 aa, Artificial Sequence
  Description of Artificial Sequence: Synthetic peptide
  Seed: RVRIAYPSL (MAGA4_HUMAN)
RSRIAYPSW

SEQ ID NO: 67168 - protein, 9 aa, Artificial Sequence
  Description of Artificial Sequence: Synthetic peptide
  Seed: RVNARVRIA (MAGA4_HUMAN)
RTNARVRIS

SEQ ID NO: 67169 - protein, 9 aa, Artificial Sequence
  Description of Artificial Sequence: Synthetic peptide
  Seed: EEQEAAVSS (MAGA4_HUMAN)
EEQEAAVSA

SEQ ID NO: 67170 - protein, 9 aa, Artificial Sequence
  Description of Artificial Sequence: Synthetic peptide
  Seed: WVQENYLEY (MAGA4_HUMAN)
WSQENYLEL

SEQ ID NO: 67171 - protein, 11 aa, Artificial Sequence
  Description of Artificial Sequence: Synthetic peptide
  Seed: STSPDAESLFR (MAGA4_HUMAN)
SISPDAESLFR

SEQ ID NO: 67172 - protein, 9 aa, Artificial Sequence
  Description of Artificial Sequence: Synthetic peptide
  Seed: GSNPARYEF (MAGA4_HUMAN)
GANPARYEW

SEQ ID NO: 67173 - protein, 9 aa, Artificial Sequence
  Description of Artificial Sequence: Synthetic peptide
  Seed: RAKELVTKA (MAGA4_HUMAN)
RMKELVTKR

SEQ ID NO: 67174 - protein, 9 aa, Artificial Sequence
  Description of Artificial Sequence: Synthetic peptide
  Seed: GLLGNNQIF (MAGA4_HUMAN)
GQLGNNQIL

SEQ ID NO: 67175 - protein, 10 aa, Artificial Sequence
  Description of Artificial Sequence: Synthetic peptide
  Seed: KVDELAHFLL (MAGA4_HUMAN)
KQDELAHFLL

SEQ ID NO: 67176 - protein, 10 aa, Artificial Sequence
  Description of Artificial Sequence: Synthetic peptide
  Seed: ARVRIAYPSL (MAGA4_HUMAN)
ARVRIAYPSV

SEQ ID NO: 67177 - protein, 10 aa, Artificial Sequence
  Description of Artificial Sequence: Synthetic peptide
  Seed: KYRAKELVTK (MAGA4_HUMAN)
KSRAKELVTA

SEQ ID NO: 67178 - protein, 10 aa, Artificial Sequence
  Description of Artificial Sequence: Synthetic peptide
  Seed: MLERVIKNYK (MAGA4_HUMAN)
MMERVIKNYR

SEQ ID NO: 67179 - protein, 9 aa, Artificial Sequence
  Description of Artificial Sequence: Synthetic peptide
  Seed: RVRIAYPSL (MAGA4_HUMAN)
RLRIAYPSQ

SEQ ID NO: 67180 - protein, 10 aa, Artificial Sequence
  Description of Artificial Sequence: Synthetic peptide
  Seed: KNYKRCFPVI (MAGA4_HUMAN)
KWYKRCFPVK

SEQ ID NO: 67181 - protein, 9 aa, Artificial Sequence
  Description of Artificial Sequence: Synthetic peptide
  Seed: DPASNTYTL (MAGA4_HUMAN)
DSASNTYTM

SEQ ID NO: 67182 - protein, 9 aa, Artificial Sequence
  Description of Artificial Sequence: Synthetic peptide
  Seed: IFPKTGLLI (MAGA4_HUMAN)
IYPKTGLLI

SEQ ID NO: 67183 - protein, 9 aa, Artificial Sequence
  Description of Artificial Sequence: Synthetic peptide
  Seed: GASALPTTI (MAGA4_HUMAN)
GASALPTTY

SEQ ID NO: 67184 - protein, 9 aa, Artificial Sequence
  Description of Artificial Sequence: Synthetic peptide
  Seed: SEEEIWEEL (MAGA4_HUMAN)
SGEEIWEEL

SEQ ID NO: 67185 - protein, 9 aa, Artificial Sequence
  Description of Artificial Sequence: Synthetic peptide
  Seed: RQVPGSNPA (MAGA4_HUMAN)
RSVPGSNPL

SEQ ID NO: 67186 - protein, 10 aa, Artificial Sequence
  Description of Artificial Sequence: Synthetic peptide
  Seed: ARVRIAYPSL (MAGA4_HUMAN)
AYVRIAYPSK

SEQ ID NO: 67187 - protein, 9 aa, Artificial Sequence
  Description of Artificial Sequence: Synthetic peptide
  Seed: ELAHFLLRK (MAGA4_HUMAN)
ETAHFLLRK

SEQ ID NO: 67188 - protein, 10 aa, Artificial Sequence
  Description of Artificial Sequence: Synthetic peptide
  Seed: RVRIAYPSLR (MAGA4_HUMAN)
RNRIAYPSLL

SEQ ID NO: 67189 - protein, 9 aa, Artificial Sequence
  Description of Artificial Sequence: Synthetic peptide
  Seed: YKRCFPVIF (MAGA4_HUMAN)
YTRCFPVIF

SEQ ID NO: 67190 - protein, 10 aa, Artificial Sequence
  Description of Artificial Sequence: Synthetic peptide
  Seed: AYPSLREAAL (MAGA4_HUMAN)
AWPSLREAAM

SEQ ID NO: 67191 - protein, 10 aa, Artificial Sequence
  Description of Artificial Sequence: Synthetic peptide
  Seed: KNYKRCFPVI (MAGA4_HUMAN)
KEYKRCFPVK

SEQ ID NO: 67192 - protein, 10 aa, Artificial Sequence
  Description of Artificial Sequence: Synthetic peptide
  Seed: RVNARVRIAY (MAGA4_HUMAN)
RTNARVRIAY

SEQ ID NO: 67193 - protein, 11 aa, Artificial Sequence
  Description of Artificial Sequence: Synthetic peptide
  Seed: RVNARVRIAYP (MAGA4_HUMAN)
RVNARVRIAYK

SEQ ID NO: 67194 - protein, 9 aa, Artificial Sequence
  Description of Artificial Sequence: Synthetic peptide
  Seed: YVKVLEHVV (MAGA4_HUMAN)
YAKVLEHVI

SEQ ID NO: 67195 - protein, 10 aa, Artificial Sequence
  Description of Artificial Sequence: Synthetic peptide
  Seed: AYPSLREAAL (MAGA4_HUMAN)
AKPSLREAAL

SEQ ID NO: 67196 - protein, 10 aa, Artificial Sequence
  Description of Artificial Sequence: Synthetic peptide
  Seed: KVLEHVVRVN (MAGA4_HUMAN)
KILEHVVRVV

SEQ ID NO: 67197 - protein, 9 aa, Artificial Sequence
  Description of Artificial Sequence: Synthetic peptide
  Seed: AAVSSSSPL (MAGA4_HUMAN)
AVVSSSSPW

SEQ ID NO: 67198 - protein, 10 aa, Artificial Sequence
  Description of Artificial Sequence: Synthetic peptide
  Seed: SESLKMIFGI (MAGA4_HUMAN)
SNSLKMIFGW

SEQ ID NO: 67199 - protein, 11 aa, Artificial Sequence
  Description of Artificial Sequence: Synthetic peptide
  Seed: REALSNKVDEL (MAGA4_HUMAN)
RMALSNKVDEF

SEQ ID NO: 67200 - protein, 10 aa, Artificial Sequence
  Description of Artificial Sequence: Synthetic peptide
  Seed: GLVGAQAPTT (MAGA4_HUMAN)
GMVGAQAPTV

SEQ ID NO: 67201 - protein, 9 aa, Artificial Sequence
  Description of Artificial Sequence: Synthetic peptide
  Seed: SAGPPQSPQ (MAGA4_HUMAN)
SSGPPQSPM

SEQ ID NO: 67202 - protein, 9 aa, Artificial Sequence
  Description of Artificial Sequence: Synthetic peptide
  Seed: TVYGEPRKL (MAGA4_HUMAN)
TMYGEPRKW

SEQ ID NO: 67203 - protein, 10 aa, Artificial Sequence
  Description of Artificial Sequence: Synthetic peptide
  Seed: GVYDGREHTV (MAGA4_HUMAN)
GQYDGREHTF

SEQ ID NO: 67204 - protein, 10 aa, Artificial Sequence
  Description of Artificial Sequence: Synthetic peptide
  Seed: KVDELAHFLL (MAGA4_HUMAN)
KLDELAHFLN

SEQ ID NO: 67205 - protein, 9 aa, Artificial Sequence
  Description of Artificial Sequence: Synthetic peptide
  Seed: GVMGVYDGR (MAGA4_HUMAN)
GTMGVYDGR

SEQ ID NO: 67206 - protein, 9 aa, Artificial Sequence
  Description of Artificial Sequence: Synthetic peptide
  Seed: SAGPPQSPQ (MAGA4_HUMAN)
SAGPPQSPH

SEQ ID NO: 67207 - protein, 10 aa, Artificial Sequence
  Description of Artificial Sequence: Synthetic peptide
  Seed: RQVPGSNPAR (MAGA4_HUMAN)
RIVPGSNPAK

SEQ ID NO: 67208 - protein, 9 aa, Artificial Sequence
  Description of Artificial Sequence: Synthetic peptide
  Seed: ALPTTISFT (MAGA4_HUMAN)
AIPTTISFL

SEQ ID NO: 67209 - protein, 9 aa, Artificial Sequence
  Description of Artificial Sequence: Synthetic peptide
  Seed: RAKELVTKA (MAGA4_HUMAN)
RIKELVTKY

SEQ ID NO: 67210 - protein, 8 aa, Artificial Sequence
  Description of Artificial Sequence: Synthetic peptide
  Seed: RKYRAKEL (MAGA4_HUMAN)
RQYRAKEF

SEQ ID NO: 67211 - protein, 9 aa, Artificial Sequence
  Description of Artificial Sequence: Synthetic peptide
  Seed: RVNARVRIA (MAGA4_HUMAN)
RANARVRIK

SEQ ID NO: 67212 - protein, 9 aa, Artificial Sequence
  Description of Artificial Sequence: Synthetic peptide
  Seed: SALPTTISF (MAGA4_HUMAN)
SPLPTTISL

SEQ ID NO: 67213 - protein, 10 aa, Artificial Sequence
  Description of Artificial Sequence: Synthetic peptide
  Seed: RVRIAYPSLR (MAGA4_HUMAN)
RTRIAYPSLM

SEQ ID NO: 67214 - protein, 10 aa, Artificial Sequence
  Description of Artificial Sequence: Synthetic peptide
  Seed: SLFREALSNK (MAGA4_HUMAN)
SAFREALSNR

SEQ ID NO: 67215 - protein, 10 aa, Artificial Sequence
  Description of Artificial Sequence: Synthetic peptide
  Seed: EAAVSSSSPL (MAGA4_HUMAN)
ETAVSSSSPR

SEQ ID NO: 67216 - protein, 9 aa, Artificial Sequence
  Description of Artificial Sequence: Synthetic peptide
  Seed: VNARVRIAY (MAGA4_HUMAN)
VSARVRIAF

SEQ ID NO: 67217 - protein, 9 aa, Artificial Sequence
  Description of Artificial Sequence: Synthetic peptide
  Seed: RVRIAYPSL (MAGA4_HUMAN)
RPRIAYPSM

SEQ ID NO: 67218 - protein, 9 aa, Artificial Sequence
  Description of Artificial Sequence: Synthetic peptide
  Seed: RVRIAYPSL (MAGA4_HUMAN)
RQRIAYPSM

SEQ ID NO: 67219 - protein, 11 aa, Artificial Sequence
  Description of Artificial Sequence: Synthetic peptide
  Seed: ELVTKAEMLER (MAGA4_HUMAN)
ETVTKAEMLER

SEQ ID NO: 67220 - protein, 9 aa, Artificial Sequence
  Description of Artificial Sequence: Synthetic peptide
  Seed: RVNARVRIA (MAGA4_HUMAN)
RTNARVRIT

SEQ ID NO: 67221 - protein, 10 aa, Artificial Sequence
  Description of Artificial Sequence: Synthetic peptide
  Seed: RQVPGSNPAR (MAGA4_HUMAN)
RTVPGSNPAF

SEQ ID NO: 67222 - protein, 9 aa, Artificial Sequence
  Description of Artificial Sequence: Synthetic peptide
  Seed: STSPDAESL (MAGA4_HUMAN)
SYSPDAESY

SEQ ID NO: 67223 - protein, 11 aa, Artificial Sequence
  Description of Artificial Sequence: Synthetic peptide
  Seed: GPSTSPDAESL (MAGA4_HUMAN)
GPSTSPDAESY

SEQ ID NO: 67224 - protein, 9 aa, Artificial Sequence
  Description of Artificial Sequence: Synthetic peptide
  Seed: HVVRVNARV (MAGA4_HUMAN)
HQVRVNARI

SEQ ID NO: 67225 - protein, 10 aa, Artificial Sequence
  Description of Artificial Sequence: Synthetic peptide
  Seed: EMLERVIKNY (MAGA4_HUMAN)
ETLERVIKNR

SEQ ID NO: 67226 - protein, 9 aa, Artificial Sequence
  Description of Artificial Sequence: Synthetic peptide
  Seed: EVDPASNTY (MAGA4_HUMAN)
EPDPASNTY

SEQ ID NO: 67227 - protein, 10 aa, Artificial Sequence
  Description of Artificial Sequence: Synthetic peptide
  Seed: ARVRIAYPSL (MAGA4_HUMAN)
ACVRIAYPSV

SEQ ID NO: 67228 - protein, 9 aa, Artificial Sequence
  Description of Artificial Sequence: Synthetic peptide
  Seed: AHFLLRKYR (MAGA4_HUMAN)
AGFLLRKYR

SEQ ID NO: 67229 - protein, 9 aa, Artificial Sequence
  Description of Artificial Sequence: Synthetic peptide
  Seed: AAVSSSSPL (MAGA4_HUMAN)
ANVSSSSPY

SEQ ID NO: 67230 - protein, 9 aa, Artificial Sequence
  Description of Artificial Sequence: Synthetic peptide
  Seed: AESLFREAL (MAGA4_HUMAN)
AQSLFREAY

SEQ ID NO: 67231 - protein, 9 aa, Artificial Sequence
  Description of Artificial Sequence: Synthetic peptide
  Seed: QIFPKTGLL (MAGA4_HUMAN)
QQFPKTGLM

SEQ ID NO: 67232 - protein, 9 aa, Artificial Sequence
  Description of Artificial Sequence: Synthetic peptide
  Seed: KNYKRCFPV (MAGA4_HUMAN)
KAYKRCFPR

SEQ ID NO: 67233 - protein, 9 aa, Artificial Sequence
  Description of Artificial Sequence: Synthetic peptide
  Seed: AYPSLREAA (MAGA4_HUMAN)
AYPSLREAY

SEQ ID NO: 67234 - protein, 9 aa, Artificial Sequence
  Description of Artificial Sequence: Synthetic peptide
  Seed: GASALPTTI (MAGA4_HUMAN)
GISALPTTL

SEQ ID NO: 67235 - protein, 11 aa, Artificial Sequence
  Description of Artificial Sequence: Synthetic peptide
  Seed: RVRIAYPSLRE (MAGA4_HUMAN)
RTRIAYPSLRT

SEQ ID NO: 67236 - protein, 10 aa, Artificial Sequence
  Description of Artificial Sequence: Synthetic peptide
  Seed: EAAVSSSSPL (MAGA4_HUMAN)
EPAVSSSSPV

SEQ ID NO: 67237 - protein, 11 aa, Artificial Sequence
  Description of Artificial Sequence: Synthetic peptide
  Seed: ELVTKAEMLER (MAGA4_HUMAN)
EYVTKAEMLER

SEQ ID NO: 67238 - protein, 9 aa, Artificial Sequence
  Description of Artificial Sequence: Synthetic peptide
  Seed: IAYPSLREA (MAGA4_HUMAN)
ILYPSLREI

SEQ ID NO: 67239 - protein, 9 aa, Artificial Sequence
  Description of Artificial Sequence: Synthetic peptide
  Seed: IAYPSLREA (MAGA4_HUMAN)
IAYPSLREL

SEQ ID NO: 67240 - protein, 9 aa, Artificial Sequence
  Description of Artificial Sequence: Synthetic peptide
  Seed: RVRIAYPSL (MAGA4_HUMAN)
RLRIAYPSY

SEQ ID NO: 67241 - protein, 9 aa, Artificial Sequence
  Description of Artificial Sequence: Synthetic peptide
  Seed: IIVLGTIAM (MAGA4_HUMAN)
IEVLGTIAY

SEQ ID NO: 67242 - protein, 10 aa, Artificial Sequence
  Description of Artificial Sequence: Synthetic peptide
  Seed: SESLKMIFGI (MAGA4_HUMAN)
SSSLKMIFGW

SEQ ID NO: 67243 - protein, 9 aa, Artificial Sequence
  Description of Artificial Sequence: Synthetic peptide
  Seed: NTYTLVTCL (MAGA4_HUMAN)
NAYTLVTCI

SEQ ID NO: 67244 - protein, 9 aa, Artificial Sequence
  Description of Artificial Sequence: Synthetic peptide
  Seed: IIVLGTIAM (MAGA4_HUMAN)
IPVLGTIAH

SEQ ID NO: 67245 - protein, 10 aa, Artificial Sequence
  Description of Artificial Sequence: Synthetic peptide
  Seed: GVYDGREHTV (MAGA4_HUMAN)
GMYDGREHTV

SEQ ID NO: 67246 - protein, 9 aa, Artificial Sequence
  Description of Artificial Sequence: Synthetic peptide
  Seed: SSPLVPGTL (MAGA4_HUMAN)
SWPLVPGTL

SEQ ID NO: 67247 - protein, 10 aa, Artificial Sequence
  Description of Artificial Sequence: Synthetic peptide
  Seed: MIFGIDVKEV (MAGA4_HUMAN)
MQFGIDVKEV

SEQ ID NO: 67248 - protein, 11 aa, Artificial Sequence
  Description of Artificial Sequence: Synthetic peptide
  Seed: GVYDGREHTVY (MAGA4_HUMAN)
GTYDGREHTVW

SEQ ID NO: 67249 - protein, 9 aa, Artificial Sequence
  Description of Artificial Sequence: Synthetic peptide
  Seed: KVDELAHFL (MAGA4_HUMAN)
KGDELAHFM

SEQ ID NO: 67250 - protein, 10 aa, Artificial Sequence
  Description of Artificial Sequence: Synthetic peptide
  Seed: YRQVPGSNPA (MAGA4_HUMAN)
YEQVPGSNPY

SEQ ID NO: 67251 - protein, 9 aa, Artificial Sequence
  Description of Artificial Sequence: Synthetic peptide
  Seed: TVYGEPRKL (MAGA4_HUMAN)
TIYGEPRKR

SEQ ID NO: 67252 - protein, 10 aa, Artificial Sequence
  Description of Artificial Sequence: Synthetic peptide
  Seed: GVYDGREHTV (MAGA4_HUMAN)
GRYDGREHTL

SEQ ID NO: 67253 - protein, 10 aa, Artificial Sequence
  Description of Artificial Sequence: Synthetic peptide
  Seed: GVYDGREHTV (MAGA4_HUMAN)
GAYDGREHTL

SEQ ID NO: 67254 - protein, 10 aa, Artificial Sequence
  Description of Artificial Sequence: Synthetic peptide
  Seed: KYRAKELVTK (MAGA4_HUMAN)
KSRAKELVTS

SEQ ID NO: 67255 - protein, 11 aa, Artificial Sequence
  Description of Artificial Sequence: Synthetic peptide
  Seed: SASEEEIWEEL (MAGA4_HUMAN)
SMSEEEIWEEW

SEQ ID NO: 67256 - protein, 9 aa, Artificial Sequence
  Description of Artificial Sequence: Synthetic peptide
  Seed: STSPDAESL (MAGA4_HUMAN)
SVSPDAESI

SEQ ID NO: 67257 - protein, 11 aa, Artificial Sequence
  Description of Artificial Sequence: Synthetic peptide
  Seed: STSPDAESLFR (MAGA4_HUMAN)
SVSPDAESLFK

SEQ ID NO: 67258 - protein, 11 aa, Artificial Sequence
  Description of Artificial Sequence: Synthetic peptide
  Seed: GVYDGREHTVY (MAGA4_HUMAN)
GTYDGREHTVY

SEQ ID NO: 67259 - protein, 10 aa, Artificial Sequence
  Description of Artificial Sequence: Synthetic peptide
  Seed: KNYKRCFPVI (MAGA4_HUMAN)
KTYKRCFPVY

SEQ ID NO: 67260 - protein, 9 aa, Artificial Sequence
  Description of Artificial Sequence: Synthetic peptide
  Seed: KVDELAHFL (MAGA4_HUMAN)
KMDELAHFS

SEQ ID NO: 67261 - protein, 9 aa, Artificial Sequence
  Description of Artificial Sequence: Synthetic peptide
  Seed: RQVPGSNPA (MAGA4_HUMAN)
RSVPGSNPY

SEQ ID NO: 67262 - protein, 10 aa, Artificial Sequence
  Description of Artificial Sequence: Synthetic peptide
  Seed: RQVPGSNPAR (MAGA4_HUMAN)
RIVPGSNPAR

SEQ ID NO: 67263 - protein, 9 aa, Artificial Sequence
  Description of Artificial Sequence: Synthetic peptide
  Seed: SALPTTISF (MAGA4_HUMAN)
SFLPTTISF

SEQ ID NO: 67264 - protein, 9 aa, Artificial Sequence
  Description of Artificial Sequence: Synthetic peptide
  Seed: SSPLVPGTL (MAGA4_HUMAN)
STPLVPGTM

SEQ ID NO: 67265 - protein, 9 aa, Artificial Sequence
  Description of Artificial Sequence: Synthetic peptide
  Seed: KELVTKAEM (MAGA4_HUMAN)
KELVTKAEW

SEQ ID NO: 67266 - protein, 10 aa, Artificial Sequence
  Description of Artificial Sequence: Synthetic peptide
  Seed: AESLFREALS (MAGA4_HUMAN)
AESLFREALA

SEQ ID NO: 67267 - protein, 9 aa, Artificial Sequence
  Description of Artificial Sequence: Synthetic peptide
  Seed: RQVPGSNPA (MAGA4_HUMAN)
RMVPGSNPM

SEQ ID NO: 67268 - protein, 10 aa, Artificial Sequence
  Description of Artificial Sequence: Synthetic peptide
  Seed: LPTTISFTCW (MAGA4_HUMAN)
LYTTISFTCW

SEQ ID NO: 67269 - protein, 9 aa, Artificial Sequence
  Description of Artificial Sequence: Synthetic peptide
  Seed: GSNPARYEF (MAGA4_HUMAN)
GQNPARYEM

SEQ ID NO: 67270 - protein, 9 aa, Artificial Sequence
  Description of Artificial Sequence: Synthetic peptide
  Seed: FLLRKYRAK (MAGA4_HUMAN)
FTLRKYRAR

SEQ ID NO: 67271 - protein, 11 aa, Artificial Sequence
  Description of Artificial Sequence: Synthetic peptide
  Seed: SPLVPGTLEEV (MAGA4_HUMAN)
SPLVPGTLEEA

SEQ ID NO: 67272 - protein, 10 aa, Artificial Sequence
  Description of Artificial Sequence: Synthetic peptide
  Seed: KASESLKMIF (MAGA4_HUMAN)
KNSESLKMIW

SEQ ID NO: 67273 - protein, 9 aa, Artificial Sequence
  Description of Artificial Sequence: Synthetic peptide
  Seed: TVYGEPRKL (MAGA4_HUMAN)
TWYGEPRKL

SEQ ID NO: 67274 - protein, 9 aa, Artificial Sequence
  Description of Artificial Sequence: Synthetic peptide
  Seed: GVYDGREHT (MAGA4_HUMAN)
GSYDGREHV

SEQ ID NO: 67275 - protein, 9 aa, Artificial Sequence
  Description of Artificial Sequence: Synthetic peptide
  Seed: RAKELVTKA (MAGA4_HUMAN)
RTKELVTKA

SEQ ID NO: 67276 - protein, 9 aa, Artificial Sequence
  Description of Artificial Sequence: Synthetic peptide
  Seed: SALPTTISF (MAGA4_HUMAN)
SMLPTTISF

SEQ ID NO: 67277 - protein, 9 aa, Artificial Sequence
  Description of Artificial Sequence: Synthetic peptide
  Seed: RQVPGSNPA (MAGA4_HUMAN)
REVPGSNPP

SEQ ID NO: 67278 - protein, 9 aa, Artificial Sequence
  Description of Artificial Sequence: Synthetic peptide
  Seed: SALPTTISF (MAGA4_HUMAN)
SILPTTISI

SEQ ID NO: 67279 - protein, 11 aa, Artificial Sequence
  Description of Artificial Sequence: Synthetic peptide
  Seed: AYPSLREAALL (MAGA4_HUMAN)
AWPSLREAALF

SEQ ID NO: 67280 - protein, 11 aa, Artificial Sequence
  Description of Artificial Sequence: Synthetic peptide
  Seed: QHCKPEEGVEA (MAGA4_HUMAN)
QHCKPEEGVEF

SEQ ID NO: 67281 - protein, 9 aa, Artificial Sequence
  Description of Artificial Sequence: Synthetic peptide
  Seed: RVNARVRIA (MAGA4_HUMAN)
RLNARVRIK

SEQ ID NO: 67282 - protein, 10 aa, Artificial Sequence
  Description of Artificial Sequence: Synthetic peptide
  Seed: KVLEHVVRVN (MAGA4_HUMAN)
KMLEHVVRVG

SEQ ID NO: 67283 - protein, 9 aa, Artificial Sequence
  Description of Artificial Sequence: Synthetic peptide
  Seed: QIFPKTGLL (MAGA4_HUMAN)
QVFPKTGLV

SEQ ID NO: 67284 - protein, 10 aa, Artificial Sequence
  Description of Artificial Sequence: Synthetic peptide
  Seed: RVRIAYPSLR (MAGA4_HUMAN)
RQRIAYPSLM

SEQ ID NO: 67285 - protein, 10 aa, Artificial Sequence
  Description of Artificial Sequence: Synthetic peptide
  Seed: KYRAKELVTK (MAGA4_HUMAN)
KVRAKELVTL

SEQ ID NO: 67286 - protein, 9 aa, Artificial Sequence
  Description of Artificial Sequence: Synthetic peptide
  Seed: KVLEHVVRV (MAGA4_HUMAN)
KSLEHVVRL

SEQ ID NO: 67287 - protein, 9 aa, Artificial Sequence
  Description of Artificial Sequence: Synthetic peptide
  Seed: SALPTTISF (MAGA4_HUMAN)
SLLPTTISR

SEQ ID NO: 67288 - protein, 9 aa, Artificial Sequence
  Description of Artificial Sequence: Synthetic peptide
  Seed: SSSPLVPGT (MAGA4_HUMAN)
SLSPLVPGM

SEQ ID NO: 67289 - protein, 11 aa, Artificial Sequence
  Description of Artificial Sequence: Synthetic peptide
  Seed: SQEEEGPSTSP (MAGA4_HUMAN)
SEEEEGPSTSV

SEQ ID NO: 67290 - protein, 9 aa, Artificial Sequence
  Description of Artificial Sequence: Synthetic peptide
  Seed: KVLEHVVRV (MAGA4_HUMAN)
KRLEHVVRI

SEQ ID NO: 67291 - protein, 10 aa, Artificial Sequence
  Description of Artificial Sequence: Synthetic peptide
  Seed: KYRAKELVTK (MAGA4_HUMAN)
KYRAKELVTR

SEQ ID NO: 67292 - protein, 9 aa, Artificial Sequence
  Description of Artificial Sequence: Synthetic peptide
  Seed: SYVKVLEHV (MAGA4_HUMAN)
SQVKVLEHA

SEQ ID NO: 67293 - protein, 9 aa, Artificial Sequence
  Description of Artificial Sequence: Synthetic peptide
  Seed: RCFPVIFGK (MAGA4_HUMAN)
RVFPVIFGH

SEQ ID NO: 67294 - protein, 11 aa, Artificial Sequence
  Description of Artificial Sequence: Synthetic peptide
  Seed: AQAPTTEEQEA (MAGA4_HUMAN)
AMAPTTEEQEI

SEQ ID NO: 67295 - protein, 9 aa, Artificial Sequence
  Description of Artificial Sequence: Synthetic peptide
  Seed: ERVIKNYKR (MAGA4_HUMAN)
ELVIKNYKR

SEQ ID NO: 67296 - protein, 10 aa, Artificial Sequence
  Description of Artificial Sequence: Synthetic peptide
  Seed: EAAVSSSSPL (MAGA4_HUMAN)
EYAVSSSSPV

SEQ ID NO: 67297 - protein, 9 aa, Artificial Sequence
  Description of Artificial Sequence: Synthetic peptide
  Seed: SALPTTISF (MAGA4_HUMAN)
SSLPTTISI

SEQ ID NO: 67298 - protein, 9 aa, Artificial Sequence
  Description of Artificial Sequence: Synthetic peptide
  Seed: LVPGTLEEV (MAGA4_HUMAN)
LVPGTLEEY

SEQ ID NO: 67299 - protein, 9 aa, Artificial Sequence
  Description of Artificial Sequence: Synthetic peptide
  Seed: RAKELVTKA (MAGA4_HUMAN)
RQKELVTKF

SEQ ID NO: 67300 - protein, 9 aa, Artificial Sequence
  Description of Artificial Sequence: Synthetic peptide
  Seed: RKYRAKELV (MAGA4_HUMAN)
RKYRAKELY

SEQ ID NO: 67301 - protein, 10 aa, Artificial Sequence
  Description of Artificial Sequence: Synthetic peptide
  Seed: KYRAKELVTK (MAGA4_HUMAN)
KVRAKELVTM

SEQ ID NO: 67302 - protein, 9 aa, Artificial Sequence
  Description of Artificial Sequence: Synthetic peptide
  Seed: EVDPASNTY (MAGA4_HUMAN)
EMDPASNTL

SEQ ID NO: 67303 - protein, 9 aa, Artificial Sequence
  Description of Artificial Sequence: Synthetic peptide
  Seed: KVDELAHFL (MAGA4_HUMAN)
KMDELAHFV

SEQ ID NO: 67304 - protein, 10 aa, Artificial Sequence
  Description of Artificial Sequence: Synthetic peptide
  Seed: LPTTISFTCW (MAGA4_HUMAN)
LSTTISFTCM

SEQ ID NO: 67305 - protein, 11 aa, Artificial Sequence
  Description of Artificial Sequence: Synthetic peptide
  Seed: ELVTKAEMLER (MAGA4_HUMAN)
EIVTKAEMLER

SEQ ID NO: 67306 - protein, 9 aa, Artificial Sequence
  Description of Artificial Sequence: Synthetic peptide
  Seed: EVDPASNTY (MAGA4_HUMAN)
EFDPASNTF

SEQ ID NO: 67307 - protein, 9 aa, Artificial Sequence
  Description of Artificial Sequence: Synthetic peptide
  Seed: RVNARVRIA (MAGA4_HUMAN)
RTNARVRIV

SEQ ID NO: 67308 - protein, 10 aa, Artificial Sequence
  Description of Artificial Sequence: Synthetic peptide
  Seed: NKVDELAHFL (MAGA4_HUMAN)
NHVDELAHFF

SEQ ID NO: 67309 - protein, 10 aa, Artificial Sequence
  Description of Artificial Sequence: Synthetic peptide
  Seed: RVRIAYPSLR (MAGA4_HUMAN)
RYRIAYPSLA

SEQ ID NO: 67310 - protein, 8 aa, Artificial Sequence
  Description of Artificial Sequence: Synthetic peptide
  Seed: KVDELAHF (MAGA4_HUMAN)
KADELAHI

SEQ ID NO: 67311 - protein, 11 aa, Artificial Sequence
  Description of Artificial Sequence: Synthetic peptide
  Seed: RKYRAKELVTK (MAGA4_HUMAN)
RRYRAKELVTY

SEQ ID NO: 67312 - protein, 9 aa, Artificial Sequence
  Description of Artificial Sequence: Synthetic peptide
  Seed: TTISFTCWR (MAGA4_HUMAN)
TYISFTCWK

SEQ ID NO: 67313 - protein, 10 aa, Artificial Sequence
  Description of Artificial Sequence: Synthetic peptide
  Seed: LEEVPAAESA (MAGA4_HUMAN)
LEEVPAAESV

SEQ ID NO: 67314 - protein, 9 aa, Artificial Sequence
  Description of Artificial Sequence: Synthetic peptide
  Seed: WVQENYLEY (MAGA4_HUMAN)
WFQENYLEI

SEQ ID NO: 67315 - protein, 10 aa, Artificial Sequence
  Description of Artificial Sequence: Synthetic peptide
  Seed: IAYPSLREAA (MAGA4_HUMAN)
IAYPSLREAV

SEQ ID NO: 67316 - protein, 10 aa, Artificial Sequence
  Description of Artificial Sequence: Synthetic peptide
  Seed: TSPDAESLFR (MAGA4_HUMAN)
TAPDAESLFR

SEQ ID NO: 67317 - protein, 9 aa, Artificial Sequence
  Description of Artificial Sequence: Synthetic peptide
  Seed: AAVSSSSPL (MAGA4_HUMAN)
ASVSSSSPL

SEQ ID NO: 67318 - protein, 9 aa, Artificial Sequence
  Description of Artificial Sequence: Synthetic peptide
  Seed: KVLEHVVRV (MAGA4_HUMAN)
KELEHVVRI

SEQ ID NO: 67319 - protein, 8 aa, Artificial Sequence
  Description of Artificial Sequence: Synthetic peptide
  Seed: RVRIAYPS (MAGA4_HUMAN)
RVRIAYPK

SEQ ID NO: 67320 - protein, 10 aa, Artificial Sequence
  Description of Artificial Sequence: Synthetic peptide
  Seed: KEVDPASNTY (MAGA4_HUMAN)
KMVDPASNTV

SEQ ID NO: 67321 - protein, 10 aa, Artificial Sequence
  Description of Artificial Sequence: Synthetic peptide
  Seed: AAVSSSSPLV (MAGA4_HUMAN)
ALVSSSSPLV

SEQ ID NO: 67322 - protein, 11 aa, Artificial Sequence
  Description of Artificial Sequence: Synthetic peptide
  Seed: SQEEEGPSTSP (MAGA4_HUMAN)
SEEEEGPSTSA

SEQ ID NO: 67323 - protein, 9 aa, Artificial Sequence
  Description of Artificial Sequence: Synthetic peptide
  Seed: LVPGTLEEV (MAGA4_HUMAN)
LNPGTLEEL

SEQ ID NO: 67324 - protein, 9 aa, Artificial Sequence
  Description of Artificial Sequence: Synthetic peptide
  Seed: SEEEIWEEL (MAGA4_HUMAN)
SIEEIWEEI

SEQ ID NO: 67325 - protein, 10 aa, Artificial Sequence
  Description of Artificial Sequence: Synthetic peptide
  Seed: AYPSLREAAL (MAGA4_HUMAN)
APPSLREAAL

SEQ ID NO: 67326 - protein, 9 aa, Artificial Sequence
  Description of Artificial Sequence: Synthetic peptide
  Seed: LEEVPAAES (MAGA4_HUMAN)
LEEVPAAEM

SEQ ID NO: 67327 - protein, 10 aa, Artificial Sequence
  Description of Artificial Sequence: Synthetic peptide
  Seed: KYRAKELVTK (MAGA4_HUMAN)
KTRAKELVTS

SEQ ID NO: 67328 - protein, 9 aa, Artificial Sequence
  Description of Artificial Sequence: Synthetic peptide
  Seed: WVQENYLEY (MAGA4_HUMAN)
WAQENYLEF

SEQ ID NO: 67329 - protein, 9 aa, Artificial Sequence
  Description of Artificial Sequence: Synthetic peptide
  Seed: KMIFGIDVK (MAGA4_HUMAN)
KTIFGIDVR

SEQ ID NO: 67330 - protein, 10 aa, Artificial Sequence
  Description of Artificial Sequence: Synthetic peptide
  Seed: RVRIAYPSLR (MAGA4_HUMAN)
RHRIAYPSLV

SEQ ID NO: 67331 - protein, 10 aa, Artificial Sequence
  Description of Artificial Sequence: Synthetic peptide
  Seed: RVRIAYPSLR (MAGA4_HUMAN)
RGRIAYPSLA

SEQ ID NO: 67332 - protein, 10 aa, Artificial Sequence
  Description of Artificial Sequence: Synthetic peptide
  Seed: ARVRIAYPSL (MAGA4_HUMAN)
ATVRIAYPSV

SEQ ID NO: 67333 - protein, 9 aa, Artificial Sequence
  Description of Artificial Sequence: Synthetic peptide
  Seed: IAYPSLREA (MAGA4_HUMAN)
IAYPSLREM

SEQ ID NO: 67334 - protein, 9 aa, Artificial Sequence
  Description of Artificial Sequence: Synthetic peptide
  Seed: FGKASESLK (MAGA4_HUMAN)
FVKASESLR

SEQ ID NO: 67335 - protein, 9 aa, Artificial Sequence
  Description of Artificial Sequence: Synthetic peptide
  Seed: RVRIAYPSL (MAGA4_HUMAN)
RMRIAYPSN

SEQ ID NO: 67336 - protein, 11 aa, Artificial Sequence
  Description of Artificial Sequence: Synthetic peptide
  Seed: RQVPGSNPARY (MAGA4_HUMAN)
RTVPGSNPARY

SEQ ID NO: 67337 - protein, 10 aa, Artificial Sequence
  Description of Artificial Sequence: Synthetic peptide
  Seed: VDPASNTYTL (MAGA4_HUMAN)
VMPASNTYTM

SEQ ID NO: 67338 - protein, 11 aa, Artificial Sequence
  Description of Artificial Sequence: Synthetic peptide
  Seed: RVRIAYPSLRE (MAGA4_HUMAN)
RVRIAYPSLRI

SEQ ID NO: 67339 - protein, 9 aa, Artificial Sequence
  Description of Artificial Sequence: Synthetic peptide
  Seed: EVDPASNTY (MAGA4_HUMAN)
EADPASNTY

SEQ ID NO: 67340 - protein, 9 aa, Artificial Sequence
  Description of Artificial Sequence: Synthetic peptide
  Seed: EVDPASNTY (MAGA4_HUMAN)
ENDPASNTM

SEQ ID NO: 67341 - protein, 10 aa, Artificial Sequence
  Description of Artificial Sequence: Synthetic peptide
  Seed: ARVRIAYPSL (MAGA4_HUMAN)
AYVRIAYPSA

SEQ ID NO: 67342 - protein, 9 aa, Artificial Sequence
  Description of Artificial Sequence: Synthetic peptide
  Seed: RAKELVTKA (MAGA4_HUMAN)
RSKELVTKF

SEQ ID NO: 67343 - protein, 9 aa, Artificial Sequence
  Description of Artificial Sequence: Synthetic peptide
  Seed: ESLKMIFGI (MAGA4_HUMAN)
EVLKMIFGY

SEQ ID NO: 67344 - protein, 9 aa, Artificial Sequence
  Description of Artificial Sequence: Synthetic peptide
  Seed: SSSPLVPGT (MAGA4_HUMAN)
STSPLVPGL

SEQ ID NO: 67345 - protein, 10 aa, Artificial Sequence
  Description of Artificial Sequence: Synthetic peptide
  Seed: KASESLKMIF (MAGA4_HUMAN)
KFSESLKMIW

SEQ ID NO: 67346 - protein, 10 aa, Artificial Sequence
  Description of Artificial Sequence: Synthetic peptide
  Seed: KEVDPASNTY (MAGA4_HUMAN)
KAVDPASNTH

SEQ ID NO: 67347 - protein, 10 aa, Artificial Sequence
  Description of Artificial Sequence: Synthetic peptide
  Seed: EAAVSSSSPL (MAGA4_HUMAN)
EKAVSSSSPV

SEQ ID NO: 67348 - protein, 10 aa, Artificial Sequence
  Description of Artificial Sequence: Synthetic peptide
  Seed: KEVDPASNTY (MAGA4_HUMAN)
KKVDPASNTM

SEQ ID NO: 67349 - protein, 9 aa, Artificial Sequence
  Description of Artificial Sequence: Synthetic peptide
  Seed: SAGPPQSPQ (MAGA4_HUMAN)
SAGPPQSPI

SEQ ID NO: 67350 - protein, 10 aa, Artificial Sequence
  Description of Artificial Sequence: Synthetic peptide
  Seed: ARVRIAYPSL (MAGA4_HUMAN)
AAVRIAYPSA

SEQ ID NO: 67351 - protein, 9 aa, Artificial Sequence
  Description of Artificial Sequence: Synthetic peptide
  Seed: SSSPLVPGT (MAGA4_HUMAN)
STSPLVPGA

SEQ ID NO: 67352 - protein, 9 aa, Artificial Sequence
  Description of Artificial Sequence: Synthetic peptide
  Seed: RQVPGSNPA (MAGA4_HUMAN)
RMVPGSNPY

SEQ ID NO: 67353 - protein, 10 aa, Artificial Sequence
  Description of Artificial Sequence: Synthetic peptide
  Seed: GVYDGREHTV (MAGA4_HUMAN)
GIYDGREHTI

SEQ ID NO: 67354 - protein, 9 aa, Artificial Sequence
  Description of Artificial Sequence: Synthetic peptide
  Seed: IIVLGTIAM (MAGA4_HUMAN)
IPVLGTIAY

SEQ ID NO: 67355 - protein, 9 aa, Artificial Sequence
  Description of Artificial Sequence: Synthetic peptide
  Seed: GVYDGREHT (MAGA4_HUMAN)
GIYDGREHV

SEQ ID NO: 67356 - protein, 9 aa, Artificial Sequence
  Description of Artificial Sequence: Synthetic peptide
  Seed: AYPSLREAA (MAGA4_HUMAN)
AWPSLREAF

SEQ ID NO: 67357 - protein, 11 aa, Artificial Sequence
  Description of Artificial Sequence: Synthetic peptide
  Seed: RQVPGSNPARY (MAGA4_HUMAN)
RLVPGSNPARK

SEQ ID NO: 67358 - protein, 10 aa, Artificial Sequence
  Description of Artificial Sequence: Synthetic peptide
  Seed: EAAVSSSSPL (MAGA4_HUMAN)
ETAVSSSSPA

SEQ ID NO: 67359 - protein, 9 aa, Artificial Sequence
  Description of Artificial Sequence: Synthetic peptide
  Seed: SALPTTISF (MAGA4_HUMAN)
SQLPTTISI

SEQ ID NO: 67360 - protein, 9 aa, Artificial Sequence
  Description of Artificial Sequence: Synthetic peptide
  Seed: RVRIAYPSL (MAGA4_HUMAN)
RSRIAYPSP

SEQ ID NO: 67361 - protein, 9 aa, Artificial Sequence
  Description of Artificial Sequence: Synthetic peptide
  Seed: YTLVTCLGL (MAGA4_HUMAN)
YTLVTCLGF

SEQ ID NO: 67362 - protein, 9 aa, Artificial Sequence
  Description of Artificial Sequence: Synthetic peptide
  Seed: SQEEEGPST (MAGA4_HUMAN)
SEEEEGPST

SEQ ID NO: 67363 - protein, 9 aa, Artificial Sequence
  Description of Artificial Sequence: Synthetic peptide
  Seed: KNYKRCFPV (MAGA4_HUMAN)
KTYKRCFPS

SEQ ID NO: 67364 - protein, 9 aa, Artificial Sequence
  Description of Artificial Sequence: Synthetic peptide
  Seed: EVDPASNTY (MAGA4_HUMAN)
ESDPASNTL

SEQ ID NO: 67365 - protein, 9 aa, Artificial Sequence
  Description of Artificial Sequence: Synthetic peptide
  Seed: SAGPPQSPQ (MAGA4_HUMAN)
SIGPPQSPM

SEQ ID NO: 67366 - protein, 9 aa, Artificial Sequence
  Description of Artificial Sequence: Synthetic peptide
  Seed: SALPTTISF (MAGA4_HUMAN)
SYLPTTISF

SEQ ID NO: 67367 - protein, 9 aa, Artificial Sequence
  Description of Artificial Sequence: Synthetic peptide
  Seed: RVRIAYPSL (MAGA4_HUMAN)
RLRIAYPST

SEQ ID NO: 67368 - protein, 9 aa, Artificial Sequence
  Description of Artificial Sequence: Synthetic peptide
  Seed: TQDWVQENY (MAGA4_HUMAN)
TEDWVQENL

SEQ ID NO: 67369 - protein, 8 aa, Artificial Sequence
  Description of Artificial Sequence: Synthetic peptide
  Seed: ASALPTTI (MAGA4_HUMAN)
AAALPTTF

SEQ ID NO: 67370 - protein, 10 aa, Artificial Sequence
  Description of Artificial Sequence: Synthetic peptide
  Seed: REAALLEEEE (MAGA4_HUMAN)
REAALLEEEL

SEQ ID NO: 67371 - protein, 9 aa, Artificial Sequence
  Description of Artificial Sequence: Synthetic peptide
  Seed: IFPKTGLLI (MAGA4_HUMAN)
IWPKTGLLM

SEQ ID NO: 67372 - protein, 10 aa, Artificial Sequence
  Description of Artificial Sequence: Synthetic peptide
  Seed: DELAHFLLRK (MAGA4_HUMAN)
DMLAHFLLRK

SEQ ID NO: 67373 - protein, 9 aa, Artificial Sequence
  Description of Artificial Sequence: Synthetic peptide
  Seed: TTISFTCWR (MAGA4_HUMAN)
TSISFTCWK

SEQ ID NO: 67374 - protein, 10 aa, Artificial Sequence
  Description of Artificial Sequence: Synthetic peptide
  Seed: AAVSSSSPLV (MAGA4_HUMAN)
AMVSSSSPLL

SEQ ID NO: 67375 - protein, 10 aa, Artificial Sequence
  Description of Artificial Sequence: Synthetic peptide
  Seed: NKVDELAHFL (MAGA4_HUMAN)
NMVDELAHFI

SEQ ID NO: 67376 - protein, 9 aa, Artificial Sequence
  Description of Artificial Sequence: Synthetic peptide
  Seed: KVLEHVVRV (MAGA4_HUMAN)
KFLEHVVRV

SEQ ID NO: 67377 - protein, 9 aa, Artificial Sequence
  Description of Artificial Sequence: Synthetic peptide
  Seed: IFPKTGLLI (MAGA4_HUMAN)
IYPKTGLLM

SEQ ID NO: 67378 - protein, 10 aa, Artificial Sequence
  Description of Artificial Sequence: Synthetic peptide
  Seed: MIFGIDVKEV (MAGA4_HUMAN)
MMFGIDVKEA

SEQ ID NO: 67379 - protein, 9 aa, Artificial Sequence
  Description of Artificial Sequence: Synthetic peptide
  Seed: GLLIIVLGT (MAGA4_HUMAN)
GILIIVLGV

SEQ ID NO: 67380 - protein, 9 aa, Artificial Sequence
  Description of Artificial Sequence: Synthetic peptide
  Seed: KYRAKELVT (MAGA4_HUMAN)
KTRAKELVK

SEQ ID NO: 67381 - protein, 9 aa, Artificial Sequence
  Description of Artificial Sequence: Synthetic peptide
  Seed: SALPTTISF (MAGA4_HUMAN)
SVLPTTISK

SEQ ID NO: 67382 - protein, 9 aa, Artificial Sequence
  Description of Artificial Sequence: Synthetic peptide
  Seed: ARVRIAYPS (MAGA4_HUMAN)
ARVRIAYPR

SEQ ID NO: 67383 - protein, 9 aa, Artificial Sequence
  Description of Artificial Sequence: Synthetic peptide
  Seed: ELAHFLLRK (MAGA4_HUMAN)
EVAHFLLRR

SEQ ID NO: 67384 - protein, 10 aa, Artificial Sequence
  Description of Artificial Sequence: Synthetic peptide
  Seed: KVLEHVVRVN (MAGA4_HUMAN)
KLLEHVVRVW

SEQ ID NO: 67385 - protein, 10 aa, Artificial Sequence
  Description of Artificial Sequence: Synthetic peptide
  Seed: YRQVPGSNPA (MAGA4_HUMAN)
YGQVPGSNPL

SEQ ID NO: 67386 - protein, 9 aa, Artificial Sequence
  Description of Artificial Sequence: Synthetic peptide
  Seed: DPASNTYTL (MAGA4_HUMAN)
DIASNTYTY

SEQ ID NO: 67387 - protein, 10 aa, Artificial Sequence
  Description of Artificial Sequence: Synthetic peptide
  Seed: RVNARVRIAY (MAGA4_HUMAN)
RENARVRIAF

SEQ ID NO: 67388 - protein, 8 aa, Artificial Sequence
  Description of Artificial Sequence: Synthetic peptide
  Seed: SEQKSQHC (MAGA4_HUMAN)
SEQKSQHV

SEQ ID NO: 67389 - protein, 9 aa, Artificial Sequence
  Description of Artificial Sequence: Synthetic peptide
  Seed: YVKVLEHVV (MAGA4_HUMAN)
YVKVLEHVF

SEQ ID NO: 67390 - protein, 11 aa, Artificial Sequence
  Description of Artificial Sequence: Synthetic peptide
  Seed: SYDGLLGNNQI (MAGA4_HUMAN)
SVDGLLGNNQL

SEQ ID NO: 67391 - protein, 9 aa, Artificial Sequence
  Description of Artificial Sequence: Synthetic peptide
  Seed: EIWEELGVM (MAGA4_HUMAN)
EMWEELGVY

SEQ ID NO: 67392 - protein, 9 aa, Artificial Sequence
  Description of Artificial Sequence: Synthetic peptide
  Seed: FPKTGLLII (MAGA4_HUMAN)
FPKTGLLIW

SEQ ID NO: 67393 - protein, 11 aa, Homo sapiens
  Native (MAGA4_HUMAN)
SPLVPGTLEEV

SEQ ID NO: 67394 - protein, 10 aa, Homo sapiens
  Native (MAGA4_HUMAN)
TSYVKVLEHV

SEQ ID NO: 67395 - protein, 10 aa, Homo sapiens
  Native (MAGA4_HUMAN)
EEIWEELGVM

SEQ ID NO: 67396 - protein, 11 aa, Homo sapiens
  Native (MAGA4_HUMAN)
EEQEAAVSSSS

SEQ ID NO: 67397 - protein, 11 aa, Homo sapiens
  Native (MAGA4_HUMAN)
VEAQEEALGLV

SEQ ID NO: 67398 - protein, 11 aa, Homo sapiens
  Native (MAGA4_HUMAN)
AETSYVKVLEH

SEQ ID NO: 67399 - protein, 10 aa, Homo sapiens
  Native (MAGA4_HUMAN)
GPPQSPQGAS

SEQ ID NO: 67400 - protein, 9 aa, Homo sapiens
  Native (MAGA4_HUMAN)
MLERVIKNY

SEQ ID NO: 67401 - protein, 8 aa, Homo sapiens
  Native (MAGA4_HUMAN)
NPARYEFL

SEQ ID NO: 67402 - protein, 11 aa, Homo sapiens
  Native (MAGA4_HUMAN)
EAAVSSSSPLV

SEQ ID NO: 67403 - protein, 11 aa, Homo sapiens
  Native (MAGA4_HUMAN)
AGPPQSPQGAS

SEQ ID NO: 67404 - protein, 8 aa, Homo sapiens
  Native (MAGA4_HUMAN)
TSPDAESL

SEQ ID NO: 67405 - protein, 8 aa, Homo sapiens
  Native (MAGA4_HUMAN)
ASNTYTLV

SEQ ID NO: 67406 - protein, 9 aa, Homo sapiens
  Native (MAGA4_HUMAN)
EEQEAAVSS

SEQ ID NO: 67407 - protein, 8 aa, Homo sapiens
  Native (MAGA4_HUMAN)
IWEELGVM

SEQ ID NO: 67408 - protein, 8 aa, Homo sapiens
  Native (MAGA4_HUMAN)
QEAAVSSS

SEQ ID NO: 67409 - protein, 10 aa, Homo sapiens
  Native (MAGA4_HUMAN)
EHTVYGEPRK

SEQ ID NO: 67410 - protein, 11 aa, Homo sapiens
  Native (MAGA4_HUMAN)
LEEVPAAESAG

SEQ ID NO: 67411 - protein, 8 aa, Homo sapiens
  Native (MAGA4_HUMAN)
SPLVPGTL

SEQ ID NO: 67412 - protein, 9 aa, Homo sapiens
  Native (MAGA4_HUMAN)
EVDPASNTY

SEQ ID NO: 67413 - protein, 11 aa, Homo sapiens
  Native (MAGA4_HUMAN)
PSTSPDAESLF

SEQ ID NO: 67414 - protein, 11 aa, Homo sapiens
  Native (MAGA4_HUMAN)
SPQGASALPTT

SEQ ID NO: 67415 - protein, 10 aa, Homo sapiens
  Native (MAGA4_HUMAN)
RVIKNYKRCF

SEQ ID NO: 67416 - protein, 11 aa, Homo sapiens
  Native (MAGA4_HUMAN)
SASEEEIWEEL

SEQ ID NO: 67417 - protein, 8 aa, Homo sapiens
  Native (MAGA4_HUMAN)
ELAHFLLR

SEQ ID NO: 67418 - protein, 10 aa, Homo sapiens
  Native (MAGA4_HUMAN)
KAEMLERVIK

SEQ ID NO: 67419 - protein, 11 aa, Homo sapiens
  Native (MAGA4_HUMAN)
LVTKAEMLERV

SEQ ID NO: 67420 - protein, 10 aa, Homo sapiens
  Native (MAGA4_HUMAN)
TTISFTCWRQ

SEQ ID NO: 67421 - protein, 11 aa, Homo sapiens
  Native (MAGA4_HUMAN)
GPSTSPDAESL

SEQ ID NO: 67422 - protein, 9 aa, Homo sapiens
  Native (MAGA4_HUMAN)
SSSPLVPGT

SEQ ID NO: 67423 - protein, 9 aa, Homo sapiens
  Native (MAGA4_HUMAN)
KASESLKMI

SEQ ID NO: 67424 - protein, 11 aa, Homo sapiens
  Native (MAGA4_HUMAN)
SQEEEGPSTSP

SEQ ID NO: 67425 - protein, 11 aa, Homo sapiens
  Native (MAGA4_HUMAN)
EIWEELGVMGV

SEQ ID NO: 67426 - protein, 9 aa, Homo sapiens
  Native (MAGA4_HUMAN)
DGLLGNNQI

SEQ ID NO: 67427 - protein, 10 aa, Homo sapiens
  Native (MAGA4_HUMAN)
AQEEALGLVG

SEQ ID NO: 67428 - protein, 9 aa, Homo sapiens
  Native (MAGA4_HUMAN)
ESLKMIFGI

SEQ ID NO: 67429 - protein, 11 aa, Homo sapiens
  Native (MAGA4_HUMAN)
VDELAHFLLRK

SEQ ID NO: 67430 - protein, 11 aa, Homo sapiens
  Native (MAGA4_HUMAN)
EMLERVIKNYK

SEQ ID NO: 67431 - protein, 9 aa, Homo sapiens
  Native (MAGA4_HUMAN)
REAALLEEE

SEQ ID NO: 67432 - protein, 8 aa, Homo sapiens
  Native (MAGA4_HUMAN)
SYVKVLEH

SEQ ID NO: 67433 - protein, 8 aa, Homo sapiens
  Native (MAGA4_HUMAN)
TEEQEAAV

SEQ ID NO: 67434 - protein, 9 aa, Homo sapiens
  Native (MAGA4_HUMAN)
FPVIFGKAS

SEQ ID NO: 67435 - protein, 10 aa, Homo sapiens
  Native (MAGA4_HUMAN)
VKVLEHVVRV

SEQ ID NO: 67436 - protein, 11 aa, Homo sapiens
  Native (MAGA4_HUMAN)
ELVTKAEMLER

SEQ ID NO: 67437 - protein, 9 aa, Homo sapiens
  Native (MAGA4_HUMAN)
RCFPVIFGK

SEQ ID NO: 67438 - protein, 8 aa, Homo sapiens
  Native (MAGA4_HUMAN)
EHVVRVNA

SEQ ID NO: 67439 - protein, 10 aa, Homo sapiens
  Native (MAGA4_HUMAN)
KELVTKAEML

SEQ ID NO: 67440 - protein, 8 aa, Homo sapiens
  Native (MAGA4_HUMAN)
QIFPKTGL

SEQ ID NO: 67441 - protein, 8 aa, Homo sapiens
  Native (MAGA4_HUMAN)
VRIAYPSL

SEQ ID NO: 67442 - protein, 8 aa, Homo sapiens
  Native (MAGA4_HUMAN)
EEQEAAVS

SEQ ID NO: 67443 - protein, 10 aa, Homo sapiens
  Native (MAGA4_HUMAN)
VYDGREHTVY

SEQ ID NO: 67444 - protein, 11 aa, Homo sapiens
  Native (MAGA4_HUMAN)
KMIFGIDVKEV

SEQ ID NO: 67445 - protein, 8 aa, Homo sapiens
  Native (MAGA4_HUMAN)
REALSNKV

SEQ ID NO: 67446 - protein, 10 aa, Homo sapiens
  Native (MAGA4_HUMAN)
QVPGSNPARY

SEQ ID NO: 67447 - protein, 9 aa, Homo sapiens
  Native (MAGA4_HUMAN)
LEEVPAAES

SEQ ID NO: 67448 - protein, 8 aa, Homo sapiens
  Native (MAGA4_HUMAN)
RVIKNYKR

SEQ ID NO: 67449 - protein, 9 aa, Homo sapiens
  Native (MAGA4_HUMAN)
FLLRKYRAK

SEQ ID NO: 67450 - protein, 8 aa, Homo sapiens
  Native (MAGA4_HUMAN)
VLEHVVRV

SEQ ID NO: 67451 - protein, 9 aa, Homo sapiens
  Native (MAGA4_HUMAN)
GKASESLKM

SEQ ID NO: 67452 - protein, 10 aa, Homo sapiens
  Native (MAGA4_HUMAN)
NKVDELAHFL

SEQ ID NO: 67453 - protein, 10 aa, Homo sapiens
  Native (MAGA4_HUMAN)
LGVMGVYDGR

SEQ ID NO: 67454 - protein, 9 aa, Homo sapiens
  Native (MAGA4_HUMAN)
ELVTKAEML

SEQ ID NO: 67455 - protein, 9 aa, Homo sapiens
  Native (MAGA4_HUMAN)
YRQVPGSNP

SEQ ID NO: 67456 - protein, 8 aa, Homo sapiens
  Native (MAGA4_HUMAN)
RKYRAKEL

SEQ ID NO: 67457 - protein, 9 aa, Homo sapiens
  Native (MAGA4_HUMAN)
AEMLERVIK

SEQ ID NO: 67458 - protein, 9 aa, Homo sapiens
  Native (MAGA4_HUMAN)
QDWVQENYL

SEQ ID NO: 67459 - protein, 11 aa, Homo sapiens
  Native (MAGA4_HUMAN)
APTTEEQEAAV

SEQ ID NO: 67460 - protein, 10 aa, Homo sapiens
  Native (MAGA4_HUMAN)
FPKTGLLIIV

SEQ ID NO: 67461 - protein, 10 aa, Homo sapiens
  Native (MAGA4_HUMAN)
VIFGKASESL

SEQ ID NO: 67462 - protein, 10 aa, Homo sapiens
  Native (MAGA4_HUMAN)
YPSLREAALL

SEQ ID NO: 67463 - protein, 10 aa, Homo sapiens
  Native (MAGA4_HUMAN)
YRAKELVTKA

SEQ ID NO: 67464 - protein, 10 aa, Homo sapiens
  Native (MAGA4_HUMAN)
YRQVPGSNPA

SEQ ID NO: 67465 - protein, 11 aa, Homo sapiens
  Native (MAGA4_HUMAN)
VRVNARVRIAY

SEQ ID NO: 67466 - protein, 11 aa, Homo sapiens
  Native (MAGA4_HUMAN)
ALPTTISFTCW

SEQ ID NO: 67467 - protein, 10 aa, Homo sapiens
  Native (MAGA4_HUMAN)
RQVPGSNPAR

SEQ ID NO: 67468 - protein, 9 aa, Homo sapiens
  Native (MAGA4_HUMAN)
PASNTYTLV

SEQ ID NO: 67469 - protein, 9 aa, Homo sapiens
  Native (MAGA4_HUMAN)
FGKASESLK

SEQ ID NO: 67470 - protein, 9 aa, Homo sapiens
  Native (MAGA4_HUMAN)
EEALGLVGA

SEQ ID NO: 67471 - protein, 11 aa, Homo sapiens
  Native (MAGA4_HUMAN)
IAMEGDSASEE

SEQ ID NO: 67472 - protein, 8 aa, Homo sapiens
  Native (MAGA4_HUMAN)
EEVPAAES

SEQ ID NO: 67473 - protein, 10 aa, Homo sapiens
  Native (MAGA4_HUMAN)
SSSPLVPGTL

SEQ ID NO: 67474 - protein, 11 aa, Homo sapiens
  Native (MAGA4_HUMAN)
EEVPAAESAGP

SEQ ID NO: 67475 - protein, 9 aa, Homo sapiens
  Native (MAGA4_HUMAN)
GLLIIVLGT

SEQ ID NO: 67476 - protein, 9 aa, Homo sapiens
  Native (MAGA4_HUMAN)
DAESLFREA

SEQ ID NO: 67477 - protein, 10 aa, Homo sapiens
  Native (MAGA4_HUMAN)
GDSASEEEIW

SEQ ID NO: 67478 - protein, 11 aa, Homo sapiens
  Native (MAGA4_HUMAN)
GASALPTTISF

SEQ ID NO: 67479 - protein, 10 aa, Homo sapiens
  Native (MAGA4_HUMAN)
NYKRCFPVIF

SEQ ID NO: 67480 - protein, 11 aa, Homo sapiens
  Native (MAGA4_HUMAN)
KVLEHVVRVNA

SEQ ID NO: 67481 - protein, 9 aa, Homo sapiens
  Native (MAGA4_HUMAN)
VIKNYKRCF

SEQ ID NO: 67482 - protein, 9 aa, Homo sapiens
  Native (MAGA4_HUMAN)
LPTTISFTC

SEQ ID NO: 67483 - protein, 10 aa, Homo sapiens
  Native (MAGA4_HUMAN)
LVTKAEMLER

SEQ ID NO: 67484 - protein, 10 aa, Homo sapiens
  Native (MAGA4_HUMAN)
VVRVNARVRI

SEQ ID NO: 67485 - protein, 11 aa, Homo sapiens
  Native (MAGA4_HUMAN)
EEALGLVGAQA

SEQ ID NO: 67486 - protein, 11 aa, Homo sapiens
  Native (MAGA4_HUMAN)
LTQDWVQENYL

SEQ ID NO: 67487 - protein, 10 aa, Homo sapiens
  Native (MAGA4_HUMAN)
ASALPTTISF

SEQ ID NO: 67488 - protein, 10 aa, Homo sapiens
  Native (MAGA4_HUMAN)
QEEEGPSTSP

SEQ ID NO: 67489 - protein, 9 aa, Homo sapiens
  Native (MAGA4_HUMAN)
EHVVRVNAR

SEQ ID NO: 67490 - protein, 9 aa, Homo sapiens
  Native (MAGA4_HUMAN)
AQEEALGLV

SEQ ID NO: 67491 - protein, 11 aa, Homo sapiens
  Native (MAGA4_HUMAN)
ESLFREALSNK

SEQ ID NO: 67492 - protein, 10 aa, Homo sapiens
  Native (MAGA4_HUMAN)
YVKVLEHVVR

SEQ ID NO: 67493 - protein, 8 aa, Homo sapiens
  Native (MAGA4_HUMAN)
HTVYGEPR

SEQ ID NO: 67494 - protein, 9 aa, Homo sapiens
  Native (MAGA4_HUMAN)
LKMIFGIDV

SEQ ID NO: 67495 - protein, 11 aa, Homo sapiens
  Native (MAGA4_HUMAN)
SAGPPQSPQGA

SEQ ID NO: 67496 - protein, 10 aa, Homo sapiens
  Native (MAGA4_HUMAN)
SNKVDELAHF

SEQ ID NO: 67497 - protein, 8 aa, Homo sapiens
  Native (MAGA4_HUMAN)
KTGLLIIV

SEQ ID NO: 67498 - protein, 8 aa, Homo sapiens
  Native (MAGA4_HUMAN)
VEAQEEAL

SEQ ID NO: 67499 - protein, 10 aa, Homo sapiens
  Native (MAGA4_HUMAN)
LAHFLLRKYR

SEQ ID NO: 67500 - protein, 8 aa, Homo sapiens
  Native (MAGA4_HUMAN)
RVRIAYPS

SEQ ID NO: 67501 - protein, 10 aa, Homo sapiens
  Native (MAGA4_HUMAN)
GLVGAQAPTT

SEQ ID NO: 67502 - protein, 8 aa, Homo sapiens
  Native (MAGA4_HUMAN)
FLLRKYRA

SEQ ID NO: 67503 - protein, 9 aa, Homo sapiens
  Native (MAGA4_HUMAN)
AESAGPPQS

SEQ ID NO: 67504 - protein, 11 aa, Homo sapiens
  Native (MAGA4_HUMAN)
AYPSLREAALL

SEQ ID NO: 67505 - protein, 9 aa, Homo sapiens
  Native (MAGA4_HUMAN)
LGNNQIFPK

SEQ ID NO: 67506 - protein, 11 aa, Homo sapiens
  Native (MAGA4_HUMAN)
IAYPSLREAAL

SEQ ID NO: 67507 - protein, 10 aa, Homo sapiens
  Native (MAGA4_HUMAN)
QEEALGLVGA

SEQ ID NO: 67508 - protein, 10 aa, Homo sapiens
  Native (MAGA4_HUMAN)
LGLVGAQAPT

SEQ ID NO: 67509 - protein, 8 aa, Homo sapiens
  Native (MAGA4_HUMAN)
SEQKSQHC

SEQ ID NO: 67510 - protein, 9 aa, Homo sapiens
  Native (MAGA4_HUMAN)
RKYRAKELV

SEQ ID NO: 67511 - protein, 9 aa, Homo sapiens
  Native (MAGA4_HUMAN)
TQDWVQENY

SEQ ID NO: 67512 - protein, 9 aa, Homo sapiens
  Native (MAGA4_HUMAN)
VRVNARVRI

SEQ ID NO: 67513 - protein, 10 aa, Homo sapiens
  Native (MAGA4_HUMAN)
TYTLVTCLGL

SEQ ID NO: 67514 - protein, 9 aa, Homo sapiens
  Native (MAGA4_HUMAN)
AHFLLRKYR

SEQ ID NO: 67515 - protein, 9 aa, Homo sapiens
  Native (MAGA4_HUMAN)
RVNARVRIA

SEQ ID NO: 67516 - protein, 8 aa, Homo sapiens
  Native (MAGA4_HUMAN)
AHFLLRKY

SEQ ID NO: 67517 - protein, 9 aa, Homo sapiens
  Native (MAGA4_HUMAN)
TSYVKVLEH

SEQ ID NO: 67518 - protein, 10 aa, Homo sapiens
  Native (MAGA4_HUMAN)
SPQGASALPT

SEQ ID NO: 67519 - protein, 11 aa, Homo sapiens
  Native (MAGA4_HUMAN)
VPGTLEEVPAA

SEQ ID NO: 67520 - protein, 10 aa, Homo sapiens
  Native (MAGA4_HUMAN)
EEQEAAVSSS

SEQ ID NO: 67521 - protein, 11 aa, Homo sapiens
  Native (MAGA4_HUMAN)
GSNPARYEFLW

SEQ ID NO: 67522 - protein, 9 aa, Homo sapiens
  Native (MAGA4_HUMAN)
QEAAVSSSS

SEQ ID NO: 67523 - protein, 10 aa, Homo sapiens
  Native (MAGA4_HUMAN)
EEVPAAESAG

SEQ ID NO: 67524 - protein, 9 aa, Homo sapiens
  Native (MAGA4_HUMAN)
LFREALSNK

SEQ ID NO: 67525 - protein, 11 aa, Homo sapiens
  Native (MAGA4_HUMAN)
SPDAESLFREA

SEQ ID NO: 67526 - protein, 11 aa, Homo sapiens
  Native (MAGA4_HUMAN)
EHTVYGEPRKL

SEQ ID NO: 67527 - protein, 10 aa, Homo sapiens
  Native (MAGA4_HUMAN)
GVYDGREHTV

SEQ ID NO: 67528 - protein, 11 aa, Homo sapiens
  Native (MAGA4_HUMAN)
RAKELVTKAEM

SEQ ID NO: 67529 - protein, 9 aa, Homo sapiens
  Native (MAGA4_HUMAN)
DELAHFLLR

SEQ ID NO: 67530 - protein, 9 aa, Homo sapiens
  Native (MAGA4_HUMAN)
GDSASEEEI

SEQ ID NO: 67531 - protein, 11 aa, Homo sapiens
  Native (MAGA4_HUMAN)
RVNARVRIAYP

SEQ ID NO: 67532 - protein, 10 aa, Homo sapiens
  Native (MAGA4_HUMAN)
EAAVSSSSPL

SEQ ID NO: 67533 - protein, 10 aa, Homo sapiens
  Native (MAGA4_HUMAN)
TEEQEAAVSS

SEQ ID NO: 67534 - protein, 11 aa, Homo sapiens
  Native (MAGA4_HUMAN)
KEVDPASNTYT

SEQ ID NO: 67535 - protein, 8 aa, Homo sapiens
  Native (MAGA4_HUMAN)
KPEEGVEA

SEQ ID NO: 67536 - protein, 10 aa, Homo sapiens
  Native (MAGA4_HUMAN)
REAALLEEEE

SEQ ID NO: 67537 - protein, 9 aa, Homo sapiens
  Native (MAGA4_HUMAN)
ALPTTISFT

SEQ ID NO: 67538 - protein, 8 aa, Homo sapiens
  Native (MAGA4_HUMAN)
NARVRIAY

SEQ ID NO: 67539 - protein, 11 aa, Homo sapiens
  Native (MAGA4_HUMAN)
NQIFPKTGLLI

SEQ ID NO: 67540 - protein, 10 aa, Homo sapiens
  Native (MAGA4_HUMAN)
AAVSSSSPLV

SEQ ID NO: 67541 - protein, 10 aa, Homo sapiens
  Native (MAGA4_HUMAN)
VRVNARVRIA

SEQ ID NO: 67542 - protein, 10 aa, Homo sapiens
  Native (MAGA4_HUMAN)
HFLLRKYRAK

SEQ ID NO: 67543 - protein, 9 aa, Homo sapiens
  Native (MAGA4_HUMAN)
IIVLGTIAM

SEQ ID NO: 67544 - protein, 10 aa, Homo sapiens
  Native (MAGA4_HUMAN)
EEGVEAQEEA

SEQ ID NO: 67545 - protein, 11 aa, Homo sapiens
  Native (MAGA4_HUMAN)
TEEQEAAVSSS

SEQ ID NO: 67546 - protein, 11 aa, Homo sapiens
  Native (MAGA4_HUMAN)
VPGSNPARYEF

SEQ ID NO: 67547 - protein, 8 aa, Homo sapiens
  Native (MAGA4_HUMAN)
DELAHFLL

SEQ ID NO: 67548 - protein, 8 aa, Homo sapiens
  Native (MAGA4_HUMAN)
ASALPTTI

SEQ ID NO: 67549 - protein, 9 aa, Homo sapiens
  Native (MAGA4_HUMAN)
DSASEEEIW

SEQ ID NO: 67550 - protein, 8 aa, Homo sapiens
  Native (MAGA4_HUMAN)
KMIFGIDV

SEQ ID NO: 67551 - protein, 9 aa, Homo sapiens
  Native (MAGA4_HUMAN)
AYPSLREAA

SEQ ID NO: 67552 - protein, 9 aa, Homo sapiens
  Native (MAGA4_HUMAN)
SQEEEGPST

SEQ ID NO: 67553 - protein, 10 aa, Homo sapiens
  Native (MAGA4_HUMAN)
ETSYVKVLEH

SEQ ID NO: 67554 - protein, 10 aa, Homo sapiens
  Native (MAGA4_HUMAN)
AALLEEEEGV

SEQ ID NO: 67555 - protein, 10 aa, Homo sapiens
  Native (MAGA4_HUMAN)
LLIIVLGTIA

SEQ ID NO: 67556 - protein, 11 aa, Homo sapiens
  Native (MAGA4_HUMAN)
PEEGVEAQEEA

SEQ ID NO: 67557 - protein, 8 aa, Homo sapiens
  Native (MAGA4_HUMAN)
YDGREHTV

SEQ ID NO: 67558 - protein, 8 aa, Homo sapiens
  Native (MAGA4_HUMAN)
SPDAESLF

SEQ ID NO: 67559 - protein, 9 aa, Homo sapiens
  Native (MAGA4_HUMAN)
GLLGNNQIF

SEQ ID NO: 67560 - protein, 9 aa, Homo sapiens
  Native (MAGA4_HUMAN)
NKVDELAHF

SEQ ID NO: 67561 - protein, 8 aa, Homo sapiens
  Native (MAGA4_HUMAN)
TYTLVTCL

SEQ ID NO: 67562 - protein, 9 aa, Homo sapiens
  Native (MAGA4_HUMAN)
EHTVYGEPR

SEQ ID NO: 67563 - protein, 10 aa, Homo sapiens
  Native (MAGA4_HUMAN)
APTTEEQEAA

SEQ ID NO: 67564 - protein, 11 aa, Homo sapiens
  Native (MAGA4_HUMAN)
ELGVMGVYDGR

SEQ ID NO: 67565 - protein, 10 aa, Homo sapiens
  Native (MAGA4_HUMAN)
FGKASESLKM

SEQ ID NO: 67566 - protein, 9 aa, Homo sapiens
  Native (MAGA4_HUMAN)
VDELAHFLL

SEQ ID NO: 67567 - protein, 11 aa, Homo sapiens
  Native (MAGA4_HUMAN)
DWVQENYLEYR

SEQ ID NO: 67568 - protein, 9 aa, Homo sapiens
  Native (MAGA4_HUMAN)
ASESLKMIF

SEQ ID NO: 67569 - protein, 10 aa, Homo sapiens
  Native (MAGA4_HUMAN)
SSEQKSQHCK

SEQ ID NO: 67570 - protein, 9 aa, Homo sapiens
  Native (MAGA4_HUMAN)
YKRCFPVIF

SEQ ID NO: 67571 - protein, 10 aa, Homo sapiens
  Native (MAGA4_HUMAN)
LKMIFGIDVK

SEQ ID NO: 67572 - protein, 10 aa, Homo sapiens
  Native (MAGA4_HUMAN)
ASEEEIWEEL

SEQ ID NO: 67573 - protein, 8 aa, Homo sapiens
  Native (MAGA4_HUMAN)
KVDELAHF

SEQ ID NO: 67574 - protein, 10 aa, Homo sapiens
  Native (MAGA4_HUMAN)
SLKMIFGIDV

SEQ ID NO: 67575 - protein, 10 aa, Homo sapiens
  Native (MAGA4_HUMAN)
LEEVPAAESA

SEQ ID NO: 67576 - protein, 8 aa, Homo sapiens
  Native (MAGA4_HUMAN)
SASEEEIW

SEQ ID NO: 67577 - protein, 9 aa, Homo sapiens
  Native (MAGA4_HUMAN)
VPAAESAGP

SEQ ID NO: 67578 - protein, 10 aa, Homo sapiens
  Native (MAGA4_HUMAN)
AESLFREALS

SEQ ID NO: 67579 - protein, 9 aa, Homo sapiens
  Native (MAGA4_HUMAN)
LAHFLLRKY

SEQ ID NO: 67580 - protein, 9 aa, Homo sapiens
  Native (MAGA4_HUMAN)
NQIFPKTGL

SEQ ID NO: 67581 - protein, 10 aa, Homo sapiens
  Native (MAGA4_HUMAN)
QIFPKTGLLI

SEQ ID NO: 67582 - protein, 11 aa, Homo sapiens
  Native (MAGA4_HUMAN)
AQAPTTEEQEA

SEQ ID NO: 67583 - protein, 11 aa, Homo sapiens
  Native (MAGA4_HUMAN)
EEEIWEELGVM

SEQ ID NO: 67584 - protein, 10 aa, Homo sapiens
  Native (MAGA4_HUMAN)
SEEEIWEELG

SEQ ID NO: 67585 - protein, 9 aa, Homo sapiens
  Native (MAGA4_HUMAN)
RQVPGSNPA

SEQ ID NO: 67586 - protein, 10 aa, Homo sapiens
  Native (MAGA4_HUMAN)
EAQEEALGLV

SEQ ID NO: 67587 - protein, 11 aa, Homo sapiens
  Native (MAGA4_HUMAN)
EGDSASEEEIW

SEQ ID NO: 67588 - protein, 9 aa, Homo sapiens
  Native (MAGA4_HUMAN)
IDVKEVDPA

SEQ ID NO: 67589 - protein, 9 aa, Homo sapiens
  Native (MAGA4_HUMAN)
WEELGVMGV

SEQ ID NO: 67590 - protein, 11 aa, Homo sapiens
  Native (MAGA4_HUMAN)
VPAAESAGPPQ

SEQ ID NO: 67591 - protein, 8 aa, Homo sapiens
  Native (MAGA4_HUMAN)
FPKTGLLI

SEQ ID NO: 67592 - protein, 11 aa, Homo sapiens
  Native (MAGA4_HUMAN)
QEAAVSSSSPL

SEQ ID NO: 67593 - protein, 11 aa, Homo sapiens
  Native (MAGA4_HUMAN)
LPTTISFTCWR

SEQ ID NO: 67594 - protein, 10 aa, Homo sapiens
  Native (MAGA4_HUMAN)
DPASNTYTLV

SEQ ID NO: 67595 - protein, 9 aa, Homo sapiens
  Native (MAGA4_HUMAN)
KEVDPASNT

SEQ ID NO: 67596 - protein, 9 aa, Homo sapiens
  Native (MAGA4_HUMAN)
TEEQEAAVS

SEQ ID NO: 67597 - protein, 11 aa, Homo sapiens
  Native (MAGA4_HUMAN)
KRCFPVIFGKA

SEQ ID NO: 67598 - protein, 8 aa, Homo sapiens
  Native (MAGA4_HUMAN)
MIFGIDVK

SEQ ID NO: 67599 - protein, 8 aa, Homo sapiens
  Native (MAGA4_HUMAN)
GVYDGREH

SEQ ID NO: 67600 - protein, 9 aa, Homo sapiens
  Native (MAGA4_HUMAN)
KAEMLERVI

SEQ ID NO: 67601 - protein, 11 aa, Homo sapiens
  Native (MAGA4_HUMAN)
SYDGLLGNNQI

SEQ ID NO: 67602 - protein, 9 aa, Homo sapiens
  Native (MAGA4_HUMAN)
VRIAYPSLR

SEQ ID NO: 67603 - protein, 11 aa, Homo sapiens
  Native (MAGA4_HUMAN)
ELAHFLLRKYR

SEQ ID NO: 67604 - protein, 10 aa, Homo sapiens
  Native (MAGA4_HUMAN)
VDPASNTYTL

SEQ ID NO: 67605 - protein, 9 aa, Homo sapiens
  Native (MAGA4_HUMAN)
HTVYGEPRK

SEQ ID NO: 67606 - protein, 9 aa, Homo sapiens
  Native (MAGA4_HUMAN)
QEEEGPSTS

SEQ ID NO: 67607 - protein, 11 aa, Homo sapiens
  Native (MAGA4_HUMAN)
GKASESLKMIF

SEQ ID NO: 67608 - protein, 8 aa, Homo sapiens
  Native (MAGA4_HUMAN)
VSSSSPLV

SEQ ID NO: 67609 - protein, 11 aa, Homo sapiens
  Native (MAGA4_HUMAN)
EEGVEAQEEAL

SEQ ID NO: 67610 - protein, 11 aa, Homo sapiens
  Native (MAGA4_HUMAN)
REAALLEEEEG

SEQ ID NO: 67611 - protein, 8 aa, Homo sapiens
  Native (MAGA4_HUMAN)
SAGPPQSP

SEQ ID NO: 67612 - protein, 9 aa, Homo sapiens
  Native (MAGA4_HUMAN)
GLVGAQAPT

SEQ ID NO: 67613 - protein, 9 aa, Homo sapiens
  Native (MAGA4_HUMAN)
SEQKSQHCK

SEQ ID NO: 67614 - protein, 11 aa, Homo sapiens
  Native (MAGA4_HUMAN)
LEYRQVPGSNP

SEQ ID NO: 67615 - protein, 11 aa, Homo sapiens
  Native (MAGA4_HUMAN)
LSNKVDELAHF

SEQ ID NO: 67616 - protein, 9 aa, Homo sapiens
  Native (MAGA4_HUMAN)
REHTVYGEP

SEQ ID NO: 67617 - protein, 9 aa, Homo sapiens
  Native (MAGA4_HUMAN)
SNPARYEFL

SEQ ID NO: 67618 - protein, 10 aa, Homo sapiens
  Native (MAGA4_HUMAN)
TVYGEPRKLL

SEQ ID NO: 67619 - protein, 10 aa, Homo sapiens
  Native (MAGA4_HUMAN)
PLVPGTLEEV

SEQ ID NO: 67620 - protein, 11 aa, Homo sapiens
  Native (MAGA4_HUMAN)
LLTQDWVQENY

SEQ ID NO: 67621 - protein, 9 aa, Homo sapiens
  Native (MAGA4_HUMAN)
ERVIKNYKR

SEQ ID NO: 67622 - protein, 10 aa, Homo sapiens
  Native (MAGA4_HUMAN)
EGDSASEEEI

SEQ ID NO: 67623 - protein, 9 aa, Homo sapiens
  Native (MAGA4_HUMAN)
EEIWEELGV

SEQ ID NO: 67624 - protein, 8 aa, Homo sapiens
  Native (MAGA4_HUMAN)
KVLEHVVR

SEQ ID NO: 67625 - protein, 11 aa, Homo sapiens
  Native (MAGA4_HUMAN)
REALSNKVDEL

SEQ ID NO: 67626 - protein, 10 aa, Homo sapiens
  Native (MAGA4_HUMAN)
EMLERVIKNY

SEQ ID NO: 67627 - protein, 8 aa, Homo sapiens
  Native (MAGA4_HUMAN)
EEALGLVG

SEQ ID NO: 67628 - protein, 10 aa, Homo sapiens
  Native (MAGA4_HUMAN)
DAESLFREAL

SEQ ID NO: 67629 - protein, 10 aa, Homo sapiens
  Native (MAGA4_HUMAN)
SYVKVLEHVV

SEQ ID NO: 67630 - protein, 9 aa, Homo sapiens
  Native (MAGA4_HUMAN)
ALLEEEEGV

SEQ ID NO: 67631 - protein, 10 aa, Homo sapiens
  Native (MAGA4_HUMAN)
DWVQENYLEY

SEQ ID NO: 67632 - protein, 9 aa, Homo sapiens
  Native (MAGA4_HUMAN)
NYKRCFPVI

SEQ ID NO: 67633 - protein, 9 aa, Homo sapiens
  Native (MAGA4_HUMAN)
EIWEELGVM

SEQ ID NO: 67634 - protein, 9 aa, Homo sapiens
  Native (MAGA4_HUMAN)
APTTEEQEA

SEQ ID NO: 67635 - protein, 10 aa, Homo sapiens
  Native (MAGA4_HUMAN)
AESAGPPQSP

SEQ ID NO: 67636 - protein, 10 aa, Homo sapiens
  Native (MAGA4_HUMAN)
PTTISFTCWR

SEQ ID NO: 67637 - protein, 9 aa, Homo sapiens
  Native (MAGA4_HUMAN)
IAMEGDSAS

SEQ ID NO: 67638 - protein, 11 aa, Homo sapiens
  Native (MAGA4_HUMAN)
GVYDGREHTVY

SEQ ID NO: 67639 - protein, 10 aa, Homo sapiens
  Native (MAGA4_HUMAN)
EEGPSTSPDA

SEQ ID NO: 67640 - protein, 10 aa, Homo sapiens
  Native (MAGA4_HUMAN)
NQIFPKTGLL

SEQ ID NO: 67641 - protein, 10 aa, Homo sapiens
  Native (MAGA4_HUMAN)
LPTTISFTCW

SEQ ID NO: 67642 - protein, 8 aa, Homo sapiens
  Native (MAGA4_HUMAN)
LSNKVDEL

SEQ ID NO: 67643 - protein, 11 aa, Homo sapiens
  Native (MAGA4_HUMAN)
YVKVLEHVVRV

SEQ ID NO: 67644 - protein, 9 aa, Homo sapiens
  Native (MAGA4_HUMAN)
TTEEQEAAV

SEQ ID NO: 67645 - protein, 11 aa, Homo sapiens
  Native (MAGA4_HUMAN)
MSSEQKSQHCK

SEQ ID NO: 67646 - protein, 11 aa, Homo sapiens
  Native (MAGA4_HUMAN)
FPVIFGKASES

SEQ ID NO: 67647 - protein, 9 aa, Homo sapiens
  Native (MAGA4_HUMAN)
RAKELVTKA

SEQ ID NO: 67648 - protein, 10 aa, Homo sapiens
  Native (MAGA4_HUMAN)
AKELVTKAEM

SEQ ID NO: 67649 - protein, 8 aa, Homo sapiens
  Native (MAGA4_HUMAN)
AESLFREA

SEQ ID NO: 67650 - protein, 8 aa, Homo sapiens
  Native (MAGA4_HUMAN)
FPVIFGKA

SEQ ID NO: 67651 - protein, 8 aa, Homo sapiens
  Native (MAGA4_HUMAN)
LERVIKNY

SEQ ID NO: 67652 - protein, 8 aa, Homo sapiens
  Native (MAGA4_HUMAN)
SESLKMIF

SEQ ID NO: 67653 - protein, 11 aa, Homo sapiens
  Native (MAGA4_HUMAN)
KYRAKELVTKA

SEQ ID NO: 67654 - protein, 8 aa, Homo sapiens
  Native (MAGA4_HUMAN)
KLLTQDWV

SEQ ID NO: 67655 - protein, 8 aa, Homo sapiens
  Native (MAGA4_HUMAN)
RIAYPSLR

SEQ ID NO: 67656 - protein, 8 aa, Homo sapiens
  Native (MAGA4_HUMAN)
TGLLIIVL

SEQ ID NO: 67657 - protein, 10 aa, Homo sapiens
  Native (MAGA4_HUMAN)
ESAGPPQSPQ

SEQ ID NO: 67658 - protein, 8 aa, Homo sapiens
  Native (MAGA4_HUMAN)
KRCFPVIF

SEQ ID NO: 67659 - protein, 9 aa, Homo sapiens
  Native (MAGA4_HUMAN)
NTYTLVTCL

SEQ ID NO: 67660 - protein, 11 aa, Homo sapiens
  Native (MAGA4_HUMAN)
SSSSPLVPGTL

SEQ ID NO: 67661 - protein, 11 aa, Homo sapiens
  Native (MAGA4_HUMAN)
EEEGPSTSPDA

SEQ ID NO: 67662 - protein, 8 aa, Homo sapiens
  Native (MAGA4_HUMAN)
TVYGEPRK

SEQ ID NO: 67663 - protein, 10 aa, Homo sapiens
  Native (MAGA4_HUMAN)
VEAQEEALGL

SEQ ID NO: 67664 - protein, 9 aa, Homo sapiens
  Native (MAGA4_HUMAN)
KMIFGIDVK

SEQ ID NO: 67665 - protein, 10 aa, Homo sapiens
  Native (MAGA4_HUMAN)
SNPARYEFLW

SEQ ID NO: 67666 - protein, 8 aa, Homo sapiens
  Native (MAGA4_HUMAN)
KASESLKM

SEQ ID NO: 67667 - protein, 11 aa, Homo sapiens
  Native (MAGA4_HUMAN)
PPQSPQGASAL

SEQ ID NO: 67668 - protein, 9 aa, Homo sapiens
  Native (MAGA4_HUMAN)
REALSNKVD

SEQ ID NO: 67669 - protein, 10 aa, Homo sapiens
  Native (MAGA4_HUMAN)
TQDWVQENYL

SEQ ID NO: 67670 - protein, 9 aa, Homo sapiens
  Native (MAGA4_HUMAN)
QIFPKTGLL

SEQ ID NO: 67671 - protein, 8 aa, Homo sapiens
  Native (MAGA4_HUMAN)
DGREHTVY

SEQ ID NO: 67672 - protein, 9 aa, Homo sapiens
  Native (MAGA4_HUMAN)
QEEALGLVG

SEQ ID NO: 67673 - protein, 10 aa, Homo sapiens
  Native (MAGA4_HUMAN)
STSPDAESLF

SEQ ID NO: 67674 - protein, 11 aa, Homo sapiens
  Native (MAGA4_HUMAN)
YRQVPGSNPAR

SEQ ID NO: 67675 - protein, 9 aa, Homo sapiens
  Native (MAGA4_HUMAN)
SPDAESLFR

SEQ ID NO: 67676 - protein, 9 aa, Homo sapiens
  Native (MAGA4_HUMAN)
KNYKRCFPV

SEQ ID NO: 67677 - protein, 8 aa, Homo sapiens
  Native (MAGA4_HUMAN)
HFLLRKYR

SEQ ID NO: 67678 - protein, 9 aa, Homo sapiens
  Native (MAGA4_HUMAN)
GVEAQEEAL

SEQ ID NO: 67679 - protein, 11 aa, Homo sapiens
  Native (MAGA4_HUMAN)
GLLGNNQIFPK

SEQ ID NO: 67680 - protein, 8 aa, Homo sapiens
  Native (MAGA4_HUMAN)
HVVRVNAR

SEQ ID NO: 67681 - protein, 11 aa, Homo sapiens
  Native (MAGA4_HUMAN)
RKYRAKELVTK

SEQ ID NO: 67682 - protein, 10 aa, Homo sapiens
  Native (MAGA4_HUMAN)
HVVRVNARVR

SEQ ID NO: 67683 - protein, 11 aa, Homo sapiens
  Native (MAGA4_HUMAN)
KNYKRCFPVIF

SEQ ID NO: 67684 - protein, 11 aa, Homo sapiens
  Native (MAGA4_HUMAN)
GEPRKLLTQDW

SEQ ID NO: 67685 - protein, 11 aa, Homo sapiens
  Native (MAGA4_HUMAN)
VKEVDPASNTY

SEQ ID NO: 67686 - protein, 9 aa, Homo sapiens
  Native (MAGA4_HUMAN)
VEAQEEALG

SEQ ID NO: 67687 - protein, 8 aa, Homo sapiens
  Native (MAGA4_HUMAN)
RAKELVTK

SEQ ID NO: 67688 - protein, 9 aa, Homo sapiens
  Native (MAGA4_HUMAN)
SESLKMIFG

SEQ ID NO: 67689 - protein, 11 aa, Homo sapiens
  Native (MAGA4_HUMAN)
QHCKPEEGVEA

SEQ ID NO: 67690 - protein, 8 aa, Homo sapiens
  Native (MAGA4_HUMAN)
ESLFREAL

SEQ ID NO: 67691 - protein, 11 aa, Homo sapiens
  Native (MAGA4_HUMAN)
VIKNYKRCFPV

SEQ ID NO: 67692 - protein, 10 aa, Homo sapiens
  Native (MAGA4_HUMAN)
ELAHFLLRKY

SEQ ID NO: 67693 - protein, 9 aa, Homo sapiens
  Native (MAGA4_HUMAN)
DPASNTYTL

SEQ ID NO: 67694 - protein, 11 aa, Homo sapiens
  Native (MAGA4_HUMAN)
DELAHFLLRKY

SEQ ID NO: 67695 - protein, 10 aa, Homo sapiens
  Native (MAGA4_HUMAN)
IFPKTGLLII

SEQ ID NO: 67696 - protein, 11 aa, Homo sapiens
  Native (MAGA4_HUMAN)
SYVKVLEHVVR

SEQ ID NO: 67697 - protein, 9 aa, Homo sapiens
  Native (MAGA4_HUMAN)
VPGSNPARY

SEQ ID NO: 67698 - protein, 10 aa, Homo sapiens
  Native (MAGA4_HUMAN)
TSPDAESLFR

SEQ ID NO: 67699 - protein, 9 aa, Homo sapiens
  Native (MAGA4_HUMAN)
MSSEQKSQH

SEQ ID NO: 67700 - protein, 9 aa, Homo sapiens
  Native (MAGA4_HUMAN)
VNARVRIAY

SEQ ID NO: 67701 - protein, 9 aa, Homo sapiens
  Native (MAGA4_HUMAN)
SNKVDELAH

SEQ ID NO: 67702 - protein, 10 aa, Homo sapiens
  Native (MAGA4_HUMAN)
KRCFPVIFGK

SEQ ID NO: 67703 - protein, 11 aa, Homo sapiens
  Native (MAGA4_HUMAN)
NARVRIAYPSL

SEQ ID NO: 67704 - protein, 9 aa, Homo sapiens
  Native (MAGA4_HUMAN)
SPLVPGTLE

SEQ ID NO: 67705 - protein, 10 aa, Homo sapiens
  Native (MAGA4_HUMAN)
GLLIIVLGTI

SEQ ID NO: 67706 - protein, 9 aa, Homo sapiens
  Native (MAGA4_HUMAN)
TVYGEPRKL

SEQ ID NO: 67707 - protein, 9 aa, Homo sapiens
  Native (MAGA4_HUMAN)
GPPQSPQGA

SEQ ID NO: 67708 - protein, 11 aa, Homo sapiens
  Native (MAGA4_HUMAN)
RVRIAYPSLRE

SEQ ID NO: 67709 - protein, 9 aa, Homo sapiens
  Native (MAGA4_HUMAN)
VPGTLEEVP

SEQ ID NO: 67710 - protein, 11 aa, Homo sapiens
  Native (MAGA4_HUMAN)
MEGDSASEEEI

SEQ ID NO: 67711 - protein, 11 aa, Homo sapiens
  Native (MAGA4_HUMAN)
STSPDAESLFR

SEQ ID NO: 67712 - protein, 10 aa, Homo sapiens
  Native (MAGA4_HUMAN)
GSNPARYEFL

SEQ ID NO: 67713 - protein, 10 aa, Homo sapiens
  Native (MAGA4_HUMAN)
LRKYRAKELV

SEQ ID NO: 67714 - protein, 10 aa, Homo sapiens
  Native (MAGA4_HUMAN)
VPGTLEEVPA

SEQ ID NO: 67715 - protein, 8 aa, Homo sapiens
  Native (MAGA4_HUMAN)
QEEALGLV

SEQ ID NO: 67716 - protein, 11 aa, Homo sapiens
  Native (MAGA4_HUMAN)
MLERVIKNYKR

SEQ ID NO: 67717 - protein, 9 aa, Homo sapiens
  Native (MAGA4_HUMAN)
SPQGASALP

SEQ ID NO: 67718 - protein, 8 aa, Homo sapiens
  Native (MAGA4_HUMAN)
EELGVMGV

SEQ ID NO: 67719 - protein, 10 aa, Homo sapiens
  Native (MAGA4_HUMAN)
ARVRIAYPSL

SEQ ID NO: 67720 - protein, 11 aa, Homo sapiens
  Native (MAGA4_HUMAN)
IWEELGVMGVY

SEQ ID NO: 67721 - protein, 10 aa, Homo sapiens
  Native (MAGA4_HUMAN)
SESLKMIFGI

SEQ ID NO: 67722 - protein, 11 aa, Homo sapiens
  Native (MAGA4_HUMAN)
YTLVTCLGLSY

SEQ ID NO: 67723 - protein, 9 aa, Homo sapiens
  Native (MAGA4_HUMAN)
EEEIWEELG

SEQ ID NO: 67724 - protein, 9 aa, Homo sapiens
  Native (MAGA4_HUMAN)
GASALPTTI

SEQ ID NO: 67725 - protein, 9 aa, Homo sapiens
  Native (MAGA4_HUMAN)
QVPGSNPAR

SEQ ID NO: 67726 - protein, 11 aa, Homo sapiens
  Native (MAGA4_HUMAN)
ASNTYTLVTCL

SEQ ID NO: 67727 - protein, 10 aa, Homo sapiens
  Native (MAGA4_HUMAN)
EALSNKVDEL

SEQ ID NO: 67728 - protein, 10 aa, Homo sapiens
  Native (MAGA4_HUMAN)
RIAYPSLREA

SEQ ID NO: 67729 - protein, 11 aa, Homo sapiens
  Native (MAGA4_HUMAN)
SLFREALSNKV

SEQ ID NO: 67730 - protein, 10 aa, Homo sapiens
  Native (MAGA4_HUMAN)
LIIVLGTIAM

SEQ ID NO: 67731 - protein, 9 aa, Homo sapiens
  Native (MAGA4_HUMAN)
ALSNKVDEL

SEQ ID NO: 67732 - protein, 11 aa, Homo sapiens
  Native (MAGA4_HUMAN)
FPKTGLLIIVL

SEQ ID NO: 67733 - protein, 10 aa, Homo sapiens
  Native (MAGA4_HUMAN)
ALSNKVDELA

SEQ ID NO: 67734 - protein, 9 aa, Homo sapiens
  Native (MAGA4_HUMAN)
YVKVLEHVV

SEQ ID NO: 67735 - protein, 11 aa, Homo sapiens
  Native (MAGA4_HUMAN)
SEEEIWEELGV

SEQ ID NO: 67736 - protein, 10 aa, Homo sapiens
  Native (MAGA4_HUMAN)
IAYPSLREAA

SEQ ID NO: 67737 - protein, 9 aa, Homo sapiens
  Native (MAGA4_HUMAN)
YRAKELVTK

SEQ ID NO: 67738 - protein, 10 aa, Homo sapiens
  Native (MAGA4_HUMAN)
KVLEHVVRVN

SEQ ID NO: 67739 - protein, 9 aa, Homo sapiens
  Native (MAGA4_HUMAN)
LLIIVLGTI

SEQ ID NO: 67740 - protein, 9 aa, Homo sapiens
  Native (MAGA4_HUMAN)
SAGPPQSPQ

SEQ ID NO: 67741 - protein, 9 aa, Homo sapiens
  Native (MAGA4_HUMAN)
FREALSNKV

SEQ ID NO: 67742 - protein, 10 aa, Homo sapiens
  Native (MAGA4_HUMAN)
DELAHFLLRK

SEQ ID NO: 67743 - protein, 9 aa, Homo sapiens
  Native (MAGA4_HUMAN)
KELVTKAEM

SEQ ID NO: 67744 - protein, 10 aa, Homo sapiens
  Native (MAGA4_HUMAN)
KVDELAHFLL

SEQ ID NO: 67745 - protein, 9 aa, Homo sapiens
  Native (MAGA4_HUMAN)
TSPDAESLF

SEQ ID NO: 67746 - protein, 11 aa, Homo sapiens
  Native (MAGA4_HUMAN)
KVDELAHFLLR

SEQ ID NO: 67747 - protein, 8 aa, Homo sapiens
  Native (MAGA4_HUMAN)
VDELAHFL

SEQ ID NO: 67748 - protein, 11 aa, Homo sapiens
  Native (MAGA4_HUMAN)
ETSYVKVLEHV

SEQ ID NO: 67749 - protein, 9 aa, Homo sapiens
  Native (MAGA4_HUMAN)
MGVYDGREH

SEQ ID NO: 67750 - protein, 8 aa, Homo sapiens
  Native (MAGA4_HUMAN)
AEMLERVI

SEQ ID NO: 67751 - protein, 9 aa, Homo sapiens
  Native (MAGA4_HUMAN)
ARVRIAYPS

SEQ ID NO: 67752 - protein, 10 aa, Homo sapiens
  Native (MAGA4_HUMAN)
AYPSLREAAL

SEQ ID NO: 67753 - protein, 10 aa, Homo sapiens
  Native (MAGA4_HUMAN)
IFGKASESLK

SEQ ID NO: 67754 - protein, 10 aa, Homo sapiens
  Native (MAGA4_HUMAN)
LLRKYRAKEL

SEQ ID NO: 67755 - protein, 11 aa, Homo sapiens
  Native (MAGA4_HUMAN)
GPPQSPQGASA

SEQ ID NO: 67756 - protein, 9 aa, Homo sapiens
  Native (MAGA4_HUMAN)
GTLEEVPAA

SEQ ID NO: 67757 - protein, 9 aa, Homo sapiens
  Native (MAGA4_HUMAN)
LRKYRAKEL

SEQ ID NO: 67758 - protein, 10 aa, Homo sapiens
  Native (MAGA4_HUMAN)
VTKAEMLERV

SEQ ID NO: 67759 - protein, 10 aa, Homo sapiens
  Native (MAGA4_HUMAN)
VPAAESAGPP

SEQ ID NO: 67760 - protein, 8 aa, Homo sapiens
  Native (MAGA4_HUMAN)
EEGPSTSP

SEQ ID NO: 67761 - protein, 8 aa, Homo sapiens
  Native (MAGA4_HUMAN)
TTISFTCW

SEQ ID NO: 67762 - protein, 9 aa, Homo sapiens
  Native (MAGA4_HUMAN)
GVYDGREHT

SEQ ID NO: 67763 - protein, 8 aa, Homo sapiens
  Native (MAGA4_HUMAN)
FGIDVKEV

SEQ ID NO: 67764 - protein, 9 aa, Homo sapiens
  Native (MAGA4_HUMAN)
EEEGPSTSP

SEQ ID NO: 67765 - protein, 11 aa, Homo sapiens
  Native (MAGA4_HUMAN)
ARVRIAYPSLR

SEQ ID NO: 67766 - protein, 10 aa, Homo sapiens
  Native (MAGA4_HUMAN)
MLERVIKNYK

SEQ ID NO: 67767 - protein, 8 aa, Homo sapiens
  Native (MAGA4_HUMAN)
TISFTCWR

SEQ ID NO: 67768 - protein, 9 aa, Homo sapiens
  Native (MAGA4_HUMAN)
KYRAKELVT

SEQ ID NO: 67769 - protein, 9 aa, Homo sapiens
  Native (MAGA4_HUMAN)
IFGIDVKEV

SEQ ID NO: 67770 - protein, 8 aa, Homo sapiens
  Native (MAGA4_HUMAN)
VPGTLEEV

SEQ ID NO: 67771 - protein, 10 aa, Homo sapiens
  Native (MAGA4_HUMAN)
EHVVRVNARV

SEQ ID NO: 67772 - protein, 10 aa, Homo sapiens
  Native (MAGA4_HUMAN)
SQHCKPEEGV

SEQ ID NO: 67773 - protein, 10 aa, Homo sapiens
  Native (MAGA4_HUMAN)
HTVYGEPRKL

SEQ ID NO: 67774 - protein, 10 aa, Homo sapiens
  Native (MAGA4_HUMAN)
KNYKRCFPVI

SEQ ID NO: 67775 - protein, 10 aa, Homo sapiens
  Native (MAGA4_HUMAN)
EEEIWEELGV

SEQ ID NO: 67776 - protein, 11 aa, Homo sapiens
  Native (MAGA4_HUMAN)
GREHTVYGEPR

SEQ ID NO: 67777 - protein, 11 aa, Homo sapiens
  Native (MAGA4_HUMAN)
AQEEALGLVGA

SEQ ID NO: 67778 - protein, 9 aa, Homo sapiens
  Native (MAGA4_HUMAN)
PTTISFTCW

SEQ ID NO: 67779 - protein, 8 aa, Homo sapiens
  Native (MAGA4_HUMAN)
QDWVQENY

SEQ ID NO: 67780 - protein, 10 aa, Homo sapiens
  Native (MAGA4_HUMAN)
SEQKSQHCKP

SEQ ID NO: 67781 - protein, 8 aa, Homo sapiens
  Native (MAGA4_HUMAN)
SLKMIFGI

SEQ ID NO: 67782 - protein, 9 aa, Homo sapiens
  Native (MAGA4_HUMAN)
GVMGVYDGR

SEQ ID NO: 67783 - protein, 9 aa, Homo sapiens
  Native (MAGA4_HUMAN)
YDGREHTVY

SEQ ID NO: 67784 - protein, 8 aa, Homo sapiens
  Native (MAGA4_HUMAN)
PASNTYTL

SEQ ID NO: 67785 - protein, 10 aa, Homo sapiens
  Native (MAGA4_HUMAN)
WEELGVMGVY

SEQ ID NO: 67786 - protein, 10 aa, Homo sapiens
  Native (MAGA4_HUMAN)
WVQENYLEYR

SEQ ID NO: 67787 - protein, 9 aa, Homo sapiens
  Native (MAGA4_HUMAN)
LEHVVRVNA

SEQ ID NO: 67788 - protein, 8 aa, Homo sapiens
  Native (MAGA4_HUMAN)
YPSLREAA

SEQ ID NO: 67789 - protein, 8 aa, Homo sapiens
  Native (MAGA4_HUMAN)
IFPKTGLL

SEQ ID NO: 67790 - protein, 11 aa, Homo sapiens
  Native (MAGA4_HUMAN)
EVDPASNTYTL

SEQ ID NO: 67791 - protein, 10 aa, Homo sapiens
  Native (MAGA4_HUMAN)
QEAAVSSSSP

SEQ ID NO: 67792 - protein, 9 aa, Homo sapiens
  Native (MAGA4_HUMAN)
VVRVNARVR

SEQ ID NO: 67793 - protein, 11 aa, Homo sapiens
  Native (MAGA4_HUMAN)
VIFGKASESLK

SEQ ID NO: 67794 - protein, 9 aa, Homo sapiens
  Native (MAGA4_HUMAN)
EAQEEALGL

SEQ ID NO: 67795 - protein, 10 aa, Artificial Sequence
  Description of Artificial Sequence: Synthetic peptide
  Seed: AALLEEEEGV (MAGA4_HUMAN)
  misc_feature (2)..(2): Xaa can be Phe, Gln, Leu, Val, Ser, Lys, Thr, Cys, Pro, Ala, Tyr, Ile, Asp, Asn, Arg, Met, Glu, Gly, Trp, or His
  misc_feature (10)..(10): Xaa can be Leu, Val, Ile, or Met
AXLLEEEEGX

SEQ ID NO: 67796 - protein, 9 aa, Artificial Sequence
  Description of Artificial Sequence: Synthetic peptide
  Seed: AAVSSSSPL (MAGA4_HUMAN)
  misc_feature (2)..(2): Xaa can be Gln, Pro, Ala, Met, Leu, Ser, Phe, Ile, Val, Thr, Tyr, Glu, Arg, Lys, Gly, His, Cys, Trp, Asn, or Asp
  misc_feature (9)..(9): Xaa can be Phe, Tyr, Leu, Met, Trp, Ile, His, Arg, Val, Lys, Ala, Thr, Cys, Gln, Gly, Pro, Ser, Glu, or Asn
AXVSSSSPX

SEQ ID NO: 67797 - protein, 10 aa, Artificial Sequence
  Description of Artificial Sequence: Synthetic peptide
  Seed: AAVSSSSPLV (MAGA4_HUMAN)
  misc_feature (2)..(2): Xaa can be Met, Leu, Val, Thr, Ser, Ile, Ala, Gln, Tyr, or Phe
  misc_feature (10)..(10): Xaa can be Val, Ile, Leu, Met, Ala, Phe, Cys, Asp, Arg, Asn, Gln, Thr, Tyr, Pro, His, Ser, Trp, Glu, Lys, or Gly
AXVSSSSPLX

SEQ ID NO: 67798 - protein, 8 aa, Artificial Sequence
  Description of Artificial Sequence: Synthetic peptide
  Seed: AEMLERVI (MAGA4_HUMAN)
  misc_feature (2)..(2): Xaa can be Glu, Asp, Gln, Ala, Ser, Gly, Met, or Asn
  misc_feature (8)..(8): Xaa can be Val, Ile, Leu, Phe, Trp, Tyr, Met, Ala, His, Ser, Pro, Thr, Cys, or Gly
AXMLERVX

SEQ ID NO: 67799 - protein, 9 aa, Artificial Sequence
  Description of Artificial Sequence: Synthetic peptide
  Seed: AEMLERVIK (MAGA4_HUMAN)
  misc_feature (2)..(2): Xaa can be Glu, Arg, Asp, Gln, Asn, Lys, Gly, Ile, Ser, Ala, Met, Leu, Thr, or Val
  misc_feature (9)..(9): Xaa can be Leu, Lys, Phe, Val, Trp, Tyr, Ala, Ile, Cys, Met, Pro, Arg, Thr, Asn, Ser, His, Gln, Glu, Asp, or Gly
AXMLERVIX

SEQ ID NO: 67800 - protein, 11 aa, Artificial Sequence
  Description of Artificial Sequence: Synthetic peptide
  Seed: AEMLERVIKNY (MAGA4_HUMAN)
  misc_feature (2)..(2): Xaa can be Glu, Gln, Asp, Met, Leu, Ala, Val, or Lys
  misc_feature (11)..(11): Xaa can be Tyr, Phe, Trp, Cys, Val, Met, Ile, Leu, or His
AXMLERVIKNX

SEQ ID NO: 67801 - protein, 9 aa, Artificial Sequence
  Description of Artificial Sequence: Synthetic peptide
  Seed: AESAGPPQS (MAGA4_HUMAN)
  misc_feature (2)..(2): Xaa can be Glu, Asp, Gln, or Ala
  misc_feature (9)..(9): Xaa can be Leu, Met, Val, Cys, Pro, Ile, Phe, Ala, Gly, Thr, Ser, Asn, Lys, Trp, Tyr, Asp, Gln, Glu, or Arg
AXSAGPPQX

SEQ ID NO: 67802 - protein, 10 aa, Artificial Sequence
  Description of Artificial Sequence: Synthetic peptide
  Seed: AESAGPPQSP (MAGA4_HUMAN)
  misc_feature (2)..(2): Xaa can be Glu, Asp, Gln, or Ala
  misc_feature (10)..(10): Xaa can be Phe, Ala, Leu, Met, Cys, Val, Trp, Ile, Pro, Arg, Tyr, Thr, Lys, Glu, Gly, Ser, Asn, His, Gln, or Asp
AXSAGPPQSX

SEQ ID NO: 67803 - protein, 8 aa, Artificial Sequence
  Description of Artificial Sequence: Synthetic peptide
  Seed: AESLFREA (MAGA4_HUMAN)
  misc_feature (2)..(2): Xaa can be Glu, Asp, or Gln
  misc_feature (8)..(8): Xaa can be Val, Phe, Leu, Met, Ile, Ala, Tyr, Cys, Trp, Pro, Ser, Thr, or Gly
AXSLFREX

SEQ ID NO: 67804 - protein, 9 aa, Artificial Sequence
  Description of Artificial Sequence: Synthetic peptide
  Seed: AESLFREAL (MAGA4_HUMAN)
  misc_feature (2)..(2): Xaa can be Glu, Gln, Asp, His, Arg, Ala, Met, Leu, Val, Gly, Thr, Asn, Ser, Ile, Tyr, Lys, Phe, Pro, or Trp
  misc_feature (9)..(9): Xaa can be Leu, Tyr, Met, Phe, Trp, Val, Ile, Cys, Ala, Pro, Thr, Arg, Lys, His, Ser, Gln, Gly, Asn, Glu, or Asp
AXSLFREAX

SEQ ID NO: 67805 - protein, 10 aa, Artificial Sequence
  Description of Artificial Sequence: Synthetic peptide
  Seed: AESLFREALS (MAGA4_HUMAN)
  misc_feature (2)..(2): Xaa can be Glu, Asp, or Gln
  misc_feature (10)..(10): Xaa can be Leu, Met, Val, Ala, Glu, Arg, Asp, Trp, Tyr, Ile, Gln, Thr, His, Pro, Phe, Cys, Asn, Ser, Gly, or Lys
AXSLFREALX

SEQ ID NO: 67806 - protein, 11 aa, Artificial Sequence
  Description of Artificial Sequence: Synthetic peptide
  Seed: AETSYVKVLEH (MAGA4_HUMAN)
  misc_feature (2)..(2): Xaa can be Glu, Gln, or Asp
  misc_feature (11)..(11): Xaa can be Trp, Ile, Leu, Phe, His, Tyr, or Met
AXTSYVKVLEX

SEQ ID NO: 67807 - protein, 11 aa, Artificial Sequence
  Description of Artificial Sequence: Synthetic peptide
  Seed: AGPPQSPQGAS (MAGA4_HUMAN)
  misc_feature (2)..(2): Xaa can be Arg, Gly, Ala, Pro, Gln, Asn, Ser, Val, Ile, Glu, Asp, Leu, Lys, Met, His, Thr, or Cys
  misc_feature (11)..(11): Xaa can be Lys, Arg, Phe, Asn, Tyr, His, Glu, Gln, Leu, Met, Ile, Ser, Gly, Trp, Val, or Asp
AXPPQSPQGAX

SEQ ID NO: 67808 - protein, 8 aa, Artificial Sequence
  Description of Artificial Sequence: Synthetic peptide
  Seed: AHFLLRKY (MAGA4_HUMAN)
  misc_feature (2)..(2): Xaa can be Gln, Arg, Tyr, His, Glu, Ala, Lys, Leu, Ser, Met, Ile, Gly, Asn, Pro, Phe, Val, Thr, or As p
  misc_feature (8)..(8): Xaa can be Tyr, Phe, Leu, Met, Val, Ile, Trp, or His
AXFLLRKX

SEQ ID NO: 67809 - protein, 9 aa, Artificial Sequence
  Description of Artificial Sequence: Synthetic peptide
  Seed: AHFLLRKYR (MAGA4_HUMAN)
  misc_feature (2)..(2): Xaa can be Met, Thr, Leu, Tyr, Trp, Ser, Ile, His, Ala, Gly, Phe, Val, Asn, Cys, Gln, Asp, Pro, Lys, Arg, or Glu
  misc_feature (9)..(9): Xaa can be Arg, Lys, His, or Tyr
AXFLLRKYX

SEQ ID NO: 67810 - protein, 10 aa, Artificial Sequence
  Description of Artificial Sequence: Synthetic peptide
  Seed: AKELVTKAEM (MAGA4_HUMAN)
  misc_feature (2)..(2): Xaa can be Glu, Met, Val, Thr, Phe, Tyr, Gln, Pro, Ser, Ala, Trp, Asn, Arg, Lys, His, Gly, Leu, Ile, Cys, or Asp
  misc_feature (10)..(10): Xaa can be Ile, Met, Leu, Phe, or Val
AXELVTKAEX

SEQ ID NO: 67811 - protein, 9 aa, Artificial Sequence
  Description of Artificial Sequence: Synthetic peptide
  Seed: ALLEEEEGV (MAGA4_HUMAN)
  misc_feature (2)..(2): Xaa can be Gln, Met, Leu, Val, Thr, Ile, Ala, Ser, Asn, Glu, His, Phe, Gly, Lys, Tyr, or Arg
  misc_feature (9)..(9): Xaa can be Trp, Phe, Arg, Leu, Lys, Val, Ile, Met, Ala, Tyr, Thr, or Cys
AXLEEEEGX

SEQ ID NO: 67812 - protein, 9 aa, Artificial Sequence
  Description of Artificial Sequence: Synthetic peptide
  Seed: ALPTTISFT (MAGA4_HUMAN)
  misc_feature (2)..(2): Xaa can be Leu, Met, Ile, Thr, Val, Gln, Ala, Ser, Cys, Asn, Gly, or Phe
  misc_feature (9)..(9): Xaa can be Val, Leu, Met, Ile, Ala, Phe, Ser, Thr, or Cys
AXPTTISFX

SEQ ID NO: 67813 - protein, 11 aa, Artificial Sequence
  Description of Artificial Sequence: Synthetic peptide
  Seed: ALPTTISFTCW (MAGA4_HUMAN)
  misc_feature (2)..(2): Xaa can be Thr, Met, Phe, Ser, Ala, Val, Tyr, Trp, His, Pro, Arg, Lys, Gln, Asn, Asp, Cys, Ile, Glu, Leu, or Gly
  misc_feature (11)..(11): Xaa can be Trp, Phe, Tyr, or Leu
AXPTTISFTCX

SEQ ID NO: 67814 - protein, 9 aa, Artificial Sequence
  Description of Artificial Sequence: Synthetic peptide
  Seed: ALSNKVDEL (MAGA4_HUMAN)
  misc_feature (2)..(2): Xaa can be Met, Arg, Leu, Gln, Thr, Val, Ile, Ala, Ser, Tyr, Glu, Asn, Phe, Gly, Asp, His, Lys, Pro, Trp, or Cys
  misc_feature (9)..(9): Xaa can be Met, Tyr, Phe, Leu, Ile, Val, Lys, Trp, Arg, His, Ala, Cys, or Thr
AXSNKVDEX

SEQ ID NO: 67815 - protein, 10 aa, Artificial Sequence
  Description of Artificial Sequence: Synthetic peptide
  Seed: ALSNKVDELA (MAGA4_HUMAN)
  misc_feature (2)..(2): Xaa can be Met, Leu, Val, Ile, Gln, Thr, or Ala
  misc_feature (10)..(10): Xaa can be Val, Leu, Ile, Ala, Met, or Phe
AXSNKVDELX

SEQ ID NO: 67816 - protein, 9 aa, Artificial Sequence
  Description of Artificial Sequence: Synthetic peptide
  Seed: APTTEEQEA (MAGA4_HUMAN)
  misc_feature (2)..(2): Xaa can be , or Pro
  misc_feature (9)..(9): Xaa can be Val, Ala, Met, Tyr, Thr, Leu, Ile, Phe, or Pro
AXTTEEQEX

SEQ ID NO: 67817 - protein, 10 aa, Artificial Sequence
  Description of Artificial Sequence: Synthetic peptide
  Seed: APTTEEQEAA (MAGA4_HUMAN)
  misc_feature (2)..(2): Xaa can be , or Pro
  misc_feature (10)..(10): Xaa can be Phe, Ala, Met, Ile, Val, or Leu
AXTTEEQEAX

SEQ ID NO: 67818 - protein, 11 aa, Artificial Sequence
  Description of Artificial Sequence: Synthetic peptide
  Seed: APTTEEQEAAV (MAGA4_HUMAN)
  misc_feature (2)..(2): Xaa can be , or Pro
  misc_feature (11)..(11): Xaa can be Ser, Pro, Val, Phe, Ile, Thr, Leu, Tyr, Met, Ala, or Cys
AXTTEEQEAAX

SEQ ID NO: 67819 - protein, 11 aa, Artificial Sequence
  Description of Artificial Sequence: Synthetic peptide
  Seed: AQAPTTEEQEA (MAGA4_HUMAN)
  misc_feature (2)..(2): Xaa can be Glu, Gln, Met, Asp, Leu, Ile, Val, Ser, Thr, Ala, Asn, His, Lys, Gly, Arg, Cys, Phe, or Ty r
  misc_feature (11)..(11): Xaa can be Trp, Phe, Leu, Met, Ile, Val, Tyr, Cys, Ala, Thr, Pro, Lys, His, Glu, Arg, Asn, Ser, Asp, Gly, or Gln
AXAPTTEEQEX

SEQ ID NO: 67820 - protein, 9 aa, Artificial Sequence
  Description of Artificial Sequence: Synthetic peptide
  Seed: AQEEALGLV (MAGA4_HUMAN)
  misc_feature (2)..(2): Xaa can be Glu, Asp, Gln, Leu, Met, Val, Ile, Ala, Thr, or Ser
  misc_feature (9)..(9): Xaa can be Trp, Leu, Val, Phe, Ile, Met, Ala, Cys, Pro, Tyr, Asp, Arg, Gly, Lys, Glu, Thr, or Ser
AXEEALGLX

SEQ ID NO: 67821 - protein, 10 aa, Artificial Sequence
  Description of Artificial Sequence: Synthetic peptide
  Seed: AQEEALGLVG (MAGA4_HUMAN)
  misc_feature (2)..(2): Xaa can be Glu, Gln, or Asp
  misc_feature (10)..(10): Xaa can be Phe, Val, Thr, Leu, Met, Ser, Cys, Ile, Ala, Pro, Gly, Trp, Asn, Gln, His, Lys, Glu, Arg, Tyr, or Asp
AXEEALGLVX

SEQ ID NO: 67822 - protein, 11 aa, Artificial Sequence
  Description of Artificial Sequence: Synthetic peptide
  Seed: AQEEALGLVGA (MAGA4_HUMAN)
  misc_feature (2)..(2): Xaa can be Glu, Asp, Gln, Phe, Met, Ala, His, Arg, Thr, Ile, Val, Lys, Leu, Trp, Cys, Ser, Tyr, Gly, Pro, or Asn
  misc_feature (11)..(11): Xaa can be Ala, Cys, Val, Ile, Leu, Met, Phe, Pro, Tyr, Gly, Gln, Trp, Ser, Asp, or Thr
AXEEALGLVGX

SEQ ID NO: 67823 - protein, 9 aa, Artificial Sequence
  Description of Artificial Sequence: Synthetic peptide
  Seed: ARVRIAYPS (MAGA4_HUMAN)
  misc_feature (2)..(2): Xaa can be Arg, Gln, Lys, Met, or His
  misc_feature (9)..(9): Xaa can be Leu, Val, Ile, Phe, Met, Ala, Pro, Thr, Trp, Lys, Gly, Ser, Cys, Gln, Tyr, His, or Arg
AXVRIAYPX

SEQ ID NO: 67824 - protein, 10 aa, Artificial Sequence
  Description of Artificial Sequence: Synthetic peptide
  Seed: ARVRIAYPSL (MAGA4_HUMAN)
  misc_feature (2)..(2): Xaa can be Arg, Ser, Thr, Tyr, Asp, Val, His, Lys, Gly, Met, Asn, Gln, Glu, Trp, Pro, Leu, Ala, Ile, Phe, or Cys
  misc_feature (10)..(10): Xaa can be Thr, Met, Lys, Val, Arg, Tyr, Ile, Phe, Ser, Pro, Gly, Ala, Leu, Asn, Gln, His, Cys, or Tr p
AXVRIAYPSX

SEQ ID NO: 67825 - protein, 11 aa, Artificial Sequence
  Description of Artificial Sequence: Synthetic peptide
  Seed: ARVRIAYPSLR (MAGA4_HUMAN)
  misc_feature (2)..(2): Xaa can be Arg, Pro, Glu, Trp, Gly, Val, Gln, Ile, Asp, Ala, Phe, Tyr, Asn, His, Lys, Ser, Thr, Met, Leu, or Cys
  misc_feature (11)..(11): Xaa can be Lys, Phe, Arg, Leu, Met, Val, Tyr, Ile, Trp, Ser, His, Gln, Thr, Asp, Cys, Asn, Glu, Pro, Ala, or Gly
AXVRIAYPSLX

SEQ ID NO: 67826 - protein, 8 aa, Artificial Sequence
  Description of Artificial Sequence: Synthetic peptide
  Seed: ASALPTTI (MAGA4_HUMAN)
  misc_feature (2)..(2): Xaa can be Ala, Ile, Val, Ser, Gln, Gly, Thr, Asn, Leu, Met, Glu, Pro, His, Cys, Arg, Phe, Asp, Tyr, or Lys
  misc_feature (8)..(8): Xaa can be Leu, Met, Ile, Tyr, Phe, Val, Trp, His, Lys, Arg, Ala, Cys, Thr, or Gln
AXALPTTX

SEQ ID NO: 67827 - protein, 10 aa, Artificial Sequence
  Description of Artificial Sequence: Synthetic peptide
  Seed: ASALPTTISF (MAGA4_HUMAN)
  misc_feature (2)..(2): Xaa can be Ala, Ser, Val, Thr, Gly, Gln, Met, Ile, Leu, Asn, Glu, Asp, Pro, Tyr, Cys, Phe, Trp, Arg, Lys, or His
  misc_feature (10)..(10): Xaa can be Tyr, Phe, Trp, Met, Leu, Arg, Lys, His, Ile, Val, Ala, or Cys
AXALPTTISX

SEQ ID NO: 67828 - protein, 10 aa, Artificial Sequence
  Description of Artificial Sequence: Synthetic peptide
  Seed: ASEEEIWEEL (MAGA4_HUMAN)
  misc_feature (2)..(2): Xaa can be Ala, Ser, Thr, Glu, Met, Val, Ile, Leu, Phe, Trp, Tyr, Cys, Asn, His, Gln, Gly, Asp, Lys, Pro, or Arg
  misc_feature (10)..(10): Xaa can be Leu, Met, Phe, Ile, Val, or Tyr
AXEEEIWEEX

SEQ ID NO: 67829 - protein, 9 aa, Artificial Sequence
  Description of Artificial Sequence: Synthetic peptide
  Seed: ASESLKMIF (MAGA4_HUMAN)
  misc_feature (2)..(2): Xaa can be Ser, Thr, Val, Ile, Ala, Met, Leu, Gln, Gly, Phe, Cys, Asp, Asn, Glu, Pro, Trp, Tyr, Arg, or Lys
  misc_feature (9)..(9): Xaa can be Tyr, Trp, Phe, Leu, Met, Lys, Val, Ile, Arg, or His
AXESLKMIX

SEQ ID NO: 67830 - protein, 8 aa, Artificial Sequence
  Description of Artificial Sequence: Synthetic peptide
  Seed: ASNTYTLV (MAGA4_HUMAN)
  misc_feature (2)..(2): Xaa can be Ala, Ser, Thr, Val, Gly, or Ile
  misc_feature (8)..(8): Xaa can be Leu, Tyr, Phe, Ile, Val, Met, or Trp
AXNTYTLX

SEQ ID NO: 67831 - protein, 11 aa, Artificial Sequence
  Description of Artificial Sequence: Synthetic peptide
  Seed: ASNTYTLVTCL (MAGA4_HUMAN)
  misc_feature (2)..(2): Xaa can be Ala, Ser, or Thr
  misc_feature (11)..(11): Xaa can be Phe, Tyr, Met, Leu, or Trp
AXNTYTLVTCX

SEQ ID NO: 67832 - protein, 9 aa, Artificial Sequence
  Description of Artificial Sequence: Synthetic peptide
  Seed: AVSSSSPLV (MAGA4_HUMAN)
  misc_feature (2)..(2): Xaa can be Ala, Met, Leu, Gln, Ser, Thr, Val, Ile, Gly, Asn, Glu, Phe, Cys, Pro, Trp, or Tyr
  misc_feature (9)..(9): Xaa can be Leu, Met, Lys, Phe, Trp, Tyr, Val, Ile, Ala, Thr, Arg, Cys, or His
AXSSSSPLX

SEQ ID NO: 67833 - protein, 9 aa, Artificial Sequence
  Description of Artificial Sequence: Synthetic peptide
  Seed: AYPSLREAA (MAGA4_HUMAN)
  misc_feature (2)..(2): Xaa can be Tyr, Phe, Trp, Ala, Leu, Met, Val, Ile, Thr, Gly, Ser, Gln, His, Arg, Cys, Pro, or Asn
  misc_feature (9)..(9): Xaa can be Phe, Met, Leu, Tyr, Ile, Val, Trp, Cys, Ala, His, or Thr
AXPSLREAX

SEQ ID NO: 67834 - protein, 10 aa, Artificial Sequence
  Description of Artificial Sequence: Synthetic peptide
  Seed: AYPSLREAAL (MAGA4_HUMAN)
  misc_feature (2)..(2): Xaa can be Arg, Tyr, Trp, Phe, His, Gln, Lys, Met, Ala, Leu, Asn, Pro, Asp, Ile, Glu, Gly, Val, Ser, Cys, or Thr
  misc_feature (10)..(10): Xaa can be Ala, Met, Val, Leu, Phe, Ile, Tyr, Trp, His, or Cys
AXPSLREAAX

SEQ ID NO: 67835 - protein, 11 aa, Artificial Sequence
  Description of Artificial Sequence: Synthetic peptide
  Seed: AYPSLREAALL (MAGA4_HUMAN)
  misc_feature (2)..(2): Xaa can be Tyr, Trp, Phe, or Met
  misc_feature (11)..(11): Xaa can be Phe, Met, Leu, Trp, Ile, Val, or Tyr
AXPSLREAALX

SEQ ID NO: 67836 - protein, 9 aa, Artificial Sequence
  Description of Artificial Sequence: Synthetic peptide
  Seed: DAESLFREA (MAGA4_HUMAN)
  misc_feature (2)..(2): Xaa can be Ala, Pro, Gly, Ser, Val, Ile, Thr, Leu, or Met
  misc_feature (9)..(9): Xaa can be Ile, Val, Leu, Met, Cys, Phe, or Ala
DXESLFREX

SEQ ID NO: 67837 - protein, 10 aa, Artificial Sequence
  Description of Artificial Sequence: Synthetic peptide
  Seed: DAESLFREAL (MAGA4_HUMAN)
  misc_feature (2)..(2): Xaa can be Arg, Met, Tyr, Glu, Lys, Gly, Ser, Ala, Trp, Leu, Pro, Asn, Cys, Phe, His, Gln, Val, Asp, Thr, or Ile
  misc_feature (10)..(10): Xaa can be Tyr, Phe, Met, Leu, Ile, Val, or Trp
DXESLFREAX

SEQ ID NO: 67838 - protein, 8 aa, Artificial Sequence
  Description of Artificial Sequence: Synthetic peptide
  Seed: DELAHFLL (MAGA4_HUMAN)
  misc_feature (2)..(2): Xaa can be Glu, Arg, Gln, His, Asp, Ser, Gly, Ala, Asn, or Lys
  misc_feature (8)..(8): Xaa can be Leu, Val, Ile, Met, Phe, Tyr, Ala, Thr, Ser, Pro, Trp, His, or Cys
DXLAHFLX

SEQ ID NO: 67839 - protein, 9 aa, Artificial Sequence
  Description of Artificial Sequence: Synthetic peptide
  Seed: DELAHFLLR (MAGA4_HUMAN)
  misc_feature (2)..(2): Xaa can be Glu, Thr, Val, Ala, Ile, Ser, Gln, Asp, Met, Leu, Phe, Tyr, Gly, Trp, Asn, Lys, Pro, Cys, His, or Arg
  misc_feature (9)..(9): Xaa can be Arg, Lys, His, Tyr, Met, Phe, Leu, Val, Gln, Ile, Ala, Ser, Thr, Pro, Cys, or Trp
DXLAHFLLX

SEQ ID NO: 67840 - protein, 10 aa, Artificial Sequence
  Description of Artificial Sequence: Synthetic peptide
  Seed: DELAHFLLRK (MAGA4_HUMAN)
  misc_feature (2)..(2): Xaa can be Thr, Val, Leu, Ser, Ala, Ile, Met, Glu, Cys, Gly, Phe, Asn, Asp, Gln, Lys, Tyr, Arg, His, Pro, or Trp
  misc_feature (10)..(10): Xaa can be Lys, Arg, Tyr, His, Leu, Met, or Phe
DXLAHFLLRX

SEQ ID NO: 67841 - protein, 11 aa, Artificial Sequence
  Description of Artificial Sequence: Synthetic peptide
  Seed: DELAHFLLRKY (MAGA4_HUMAN)
  misc_feature (2)..(2): Xaa can be , or Glu
  misc_feature (11)..(11): Xaa can be Met, Trp, Tyr, or Phe
DXLAHFLLRKX

SEQ ID NO: 67842 - protein, 9 aa, Artificial Sequence
  Description of Artificial Sequence: Synthetic peptide
  Seed: DGLLGNNQI (MAGA4_HUMAN)
  misc_feature (2)..(2): Xaa can be Ala, Gln, Pro, Ser, Thr, Gly, Val, Met, Glu, Ile, Asn, or Leu
  misc_feature (9)..(9): Xaa can be Ile, Val, Leu, Met, Ala, Phe, or Cys
DXLLGNNQX

SEQ ID NO: 67843 - protein, 8 aa, Artificial Sequence
  Description of Artificial Sequence: Synthetic peptide
  Seed: DGREHTVY (MAGA4_HUMAN)
  misc_feature (2)..(2): Xaa can be Gln, Met, Ala, Ile, Ser, Leu, Val, Gly, Phe, Glu, Thr, Asn, Tyr, Trp, His, Pro, or Asp
  misc_feature (8)..(8): Xaa can be Tyr, Phe, Met, Trp, or Leu
DXREHTVX

SEQ ID NO: 67844 - protein, 9 aa, Artificial Sequence
  Description of Artificial Sequence: Synthetic peptide
  Seed: DPASNTYTL (MAGA4_HUMAN)
  misc_feature (2)..(2): Xaa can be Pro, Ala, Arg, His, Val, Leu, Met, Ile, Cys, Gln, Ser, Gly, Thr, Phe, Asn, Glu, Lys, Tyr, or Asp
  misc_feature (9)..(9): Xaa can be Leu, Met, Trp, Tyr, Ile, Phe, Val, Ala, Thr, Cys, His, or Pro
DXASNTYTX

SEQ ID NO: 67845 - protein, 10 aa, Artificial Sequence
  Description of Artificial Sequence: Synthetic peptide
  Seed: DPASNTYTLV (MAGA4_HUMAN)
  misc_feature (2)..(2): Xaa can be Thr, Val, Ser, Ile, Ala, Met, Leu, Pro, Arg, Phe, Cys, Trp, Lys, Asp, Glu, His, Tyr, Gln, Asn, or Gly
  misc_feature (10)..(10): Xaa can be Val, Ile, Leu, Ala, Met, or Thr
DXASNTYTLX

SEQ ID NO: 67846 - protein, 9 aa, Artificial Sequence
  Description of Artificial Sequence: Synthetic peptide
  Seed: DSASEEEIW (MAGA4_HUMAN)
  misc_feature (2)..(2): Xaa can be Pro, Ala, Thr, Val, Ile, Ser, Leu, Met, or Gly
  misc_feature (9)..(9): Xaa can be Trp, Phe, or Tyr
DXASEEEIX

SEQ ID NO: 67847 - protein, 10 aa, Artificial Sequence
  Description of Artificial Sequence: Synthetic peptide
  Seed: DWVQENYLEY (MAGA4_HUMAN)
  misc_feature (2)..(2): Xaa can be Tyr, Ala, Met, Leu, Ser, Val, Thr, Phe, Trp, Asn, Gln, Glu, or Ile
  misc_feature (10)..(10): Xaa can be , or Tyr
DXVQENYLEX

SEQ ID NO: 67848 - protein, 11 aa, Artificial Sequence
  Description of Artificial Sequence: Synthetic peptide
  Seed: DWVQENYLEYR (MAGA4_HUMAN)
  misc_feature (2)..(2): Xaa can be Ala, Met, Val, Tyr, Ile, Trp, Thr, Phe, Ser, Cys, Gly, Leu, Gln, or Asn
  misc_feature (11)..(11): Xaa can be Arg, or Lys
DXVQENYLEYX

SEQ ID NO: 67849 - protein, 10 aa, Artificial Sequence
  Description of Artificial Sequence: Synthetic peptide
  Seed: EAAVSSSSPL (MAGA4_HUMAN)
  misc_feature (2)..(2): Xaa can be Thr, Val, Ile, Ala, Ser, Met, Leu, Gln, Glu, Asn, Phe, Gly, Cys, Pro, Tyr, Trp, Asp, His, Arg, or Lys
  misc_feature (10)..(10): Xaa can be Leu, Val, Ile, Arg, Lys, Ala, Met, Tyr, His, Phe, Gln, or Thr
EXAVSSSSPX

SEQ ID NO: 67850 - protein, 11 aa, Artificial Sequence
  Description of Artificial Sequence: Synthetic peptide
  Seed: EAAVSSSSPLV (MAGA4_HUMAN)
  misc_feature (2)..(2): Xaa can be Thr, Val, Glu, Leu, Ser, Phe, Ile, Ala, or Met
  misc_feature (11)..(11): Xaa can be Val, Ile, or Leu
EXAVSSSSPLX

SEQ ID NO: 67851 - protein, 10 aa, Artificial Sequence
  Description of Artificial Sequence: Synthetic peptide
  Seed: EALSNKVDEL (MAGA4_HUMAN)
  misc_feature (2)..(2): Xaa can be Ala, or Pro
  misc_feature (10)..(10): Xaa can be Val, Ile, or Leu
EXLSNKVDEX

SEQ ID NO: 67852 - protein, 9 aa, Artificial Sequence
  Description of Artificial Sequence: Synthetic peptide
  Seed: EAQEEALGL (MAGA4_HUMAN)
  misc_feature (2)..(2): Xaa can be Glu, Gln, Val, Thr, Ile, Ala, Ser, Asp, Pro, Leu, Met, Arg, Tyr, Gly, Phe, Asn, His, Cys, or Trp
  misc_feature (9)..(9): Xaa can be Lys, Arg, Leu, Met, Phe, Ile, Tyr, Val, Trp, His, Ala, Cys, Ser, Gln, Thr, or Pro
EXQEEALGX

SEQ ID NO: 67853 - protein, 10 aa, Artificial Sequence
  Description of Artificial Sequence: Synthetic peptide
  Seed: EAQEEALGLV (MAGA4_HUMAN)
  misc_feature (2)..(2): Xaa can be Thr, Val, Ala, Ile, or Ser
  misc_feature (10)..(10): Xaa can be Val, Ile, Leu, or Ala
EXQEEALGLX

SEQ ID NO: 67854 - protein, 8 aa, Artificial Sequence
  Description of Artificial Sequence: Synthetic peptide
  Seed: EEALGLVG (MAGA4_HUMAN)
  misc_feature (2)..(2): Xaa can be Glu, Asp, or Gln
  misc_feature (8)..(8): Xaa can be Val, Ala, Leu, Ile, Cys, Phe, Thr, Ser, Gly, Pro, or Met
EXALGLVX

SEQ ID NO: 67855 - protein, 9 aa, Artificial Sequence
  Description of Artificial Sequence: Synthetic peptide
  Seed: EEALGLVGA (MAGA4_HUMAN)
  misc_feature (2)..(2): Xaa can be Glu, Asp, Gln, Ser, or Ala
  misc_feature (9)..(9): Xaa can be Leu, Tyr, Ala, Met, Ile, Val, Pro, Phe, Cys, His, Gly, Trp, Ser, or Thr
EXALGLVGX

SEQ ID NO: 67856 - protein, 11 aa, Artificial Sequence
  Description of Artificial Sequence: Synthetic peptide
  Seed: EEALGLVGAQA (MAGA4_HUMAN)
  misc_feature (2)..(2): Xaa can be , or Glu
  misc_feature (11)..(11): Xaa can be Leu, Cys, Ile, Val, Thr, Phe, Ala, Met, or Pro
EXALGLVGAQX

SEQ ID NO: 67857 - protein, 9 aa, Artificial Sequence
  Description of Artificial Sequence: Synthetic peptide
  Seed: EEEGPSTSP (MAGA4_HUMAN)
  misc_feature (2)..(2): Xaa can be Glu, Asp, Gln, Val, Ala, or Ile
  misc_feature (9)..(9): Xaa can be Leu, Phe, Ala, Pro, Cys, Met, Ile, Thr, Val, Gly, Tyr, Trp, Asp, Ser, or Glu
EXEGPSTSX

SEQ ID NO: 67858 - protein, 11 aa, Artificial Sequence
  Description of Artificial Sequence: Synthetic peptide
  Seed: EEEGPSTSPDA (MAGA4_HUMAN)
  misc_feature (2)..(2): Xaa can be Glu, or Gln
  misc_feature (11)..(11): Xaa can be Cys, Ser, Val, Pro, Phe, Ile, Trp, Met, Thr, Leu, or Ala
EXEGPSTSPDX

SEQ ID NO: 67859 - protein, 10 aa, Artificial Sequence
  Description of Artificial Sequence: Synthetic peptide
  Seed: EEEIWEELGV (MAGA4_HUMAN)
  misc_feature (2)..(2): Xaa can be , or Glu
  misc_feature (10)..(10): Xaa can be Leu, Val, Ile, Cys, Met, or Ala
EXEIWEELGX

SEQ ID NO: 67860 - protein, 11 aa, Artificial Sequence
  Description of Artificial Sequence: Synthetic peptide
  Seed: EEEIWEELGVM (MAGA4_HUMAN)
  misc_feature (2)..(2): Xaa can be , or Glu
  misc_feature (11)..(11): Xaa can be Leu, Ile, Val, Ala, or Met
EXEIWEELGVX

SEQ ID NO: 67861 - protein, 10 aa, Artificial Sequence
  Description of Artificial Sequence: Synthetic peptide
  Seed: EEGPSTSPDA (MAGA4_HUMAN)
  misc_feature (2)..(2): Xaa can be , or Glu
  misc_feature (10)..(10): Xaa can be Ala, Pro, Thr, Cys, Ile, Phe, Leu, Met, or Val
EXGPSTSPDX

SEQ ID NO: 67862 - protein, 10 aa, Artificial Sequence
  Description of Artificial Sequence: Synthetic peptide
  Seed: EEGVEAQEEA (MAGA4_HUMAN)
  misc_feature (2)..(2): Xaa can be , or Glu
  misc_feature (10)..(10): Xaa can be Ile, Met, Leu, Thr, Pro, Val, Ala, Phe, or Cys
EXGVEAQEEX

SEQ ID NO: 67863 - protein, 11 aa, Artificial Sequence
  Description of Artificial Sequence: Synthetic peptide
  Seed: EEGVEAQEEAL (MAGA4_HUMAN)
  misc_feature (2)..(2): Xaa can be Glu, Gln, Ala, Arg, Asp, or Lys
  misc_feature (11)..(11): Xaa can be Trp, Ala, Phe, Tyr, Leu, Val, Met, Ile, Pro, Thr, or Cys
EXGVEAQEEAX

SEQ ID NO: 67864 - protein, 9 aa, Artificial Sequence
  Description of Artificial Sequence: Synthetic peptide
  Seed: EEIWEELGV (MAGA4_HUMAN)
  misc_feature (2)..(2): Xaa can be Glu, Gln, Asp, Lys, or Arg
  misc_feature (9)..(9): Xaa can be Trp, Phe, Met, Ala, Ile, Leu, Val, Tyr, Cys, Ser, Thr, Gly, Pro, or His
EXIWEELGX

SEQ ID NO: 67865 - protein, 10 aa, Artificial Sequence
  Description of Artificial Sequence: Synthetic peptide
  Seed: EEIWEELGVM (MAGA4_HUMAN)
  misc_feature (2)..(2): Xaa can be Glu, Gln, Asp, Lys, or Arg
  misc_feature (10)..(10): Xaa can be Trp, Phe, Tyr, Leu, Gly, Cys, Ile, Ser, Ala, Thr, Met, Pro, or Val
EXIWEELGVX

SEQ ID NO: 67866 - protein, 8 aa, Artificial Sequence
  Description of Artificial Sequence: Synthetic peptide
  Seed: EELGVMGV (MAGA4_HUMAN)
  misc_feature (2)..(2): Xaa can be Glu, Asp, or Gln
  misc_feature (8)..(8): Xaa can be Leu, Tyr, Val, Met, Ile, Pro, Cys, Phe, Trp, Ala, Thr, or His
EXLGVMGX

SEQ ID NO: 67867 - protein, 9 aa, Artificial Sequence
  Description of Artificial Sequence: Synthetic peptide
  Seed: EELGVMGVY (MAGA4_HUMAN)
  misc_feature (2)..(2): Xaa can be Glu, Gln, Asp, His, Ala, Ser, Arg, Met, Lys, Leu, Ile, Val, Phe, Gly, Pro, Asn, Thr, Tyr, Cys, or Trp
  misc_feature (9)..(9): Xaa can be Tyr, Phe, Met, Trp, Leu, Ile, Ala, Val, Cys, Pro, His, Thr, Gly, Ser, or Lys
EXLGVMGVX

SEQ ID NO: 67868 - protein, 8 aa, Artificial Sequence
  Description of Artificial Sequence: Synthetic peptide
  Seed: EEQEAAVS (MAGA4_HUMAN)
  misc_feature (2)..(2): Xaa can be Glu, Asp, or Gln
  misc_feature (8)..(8): Xaa can be Val, Ala, Ile, Leu, Cys, Pro, Ser, Met, Phe, or Thr
EXQEAAVX

SEQ ID NO: 67869 - protein, 9 aa, Artificial Sequence
  Description of Artificial Sequence: Synthetic peptide
  Seed: EEQEAAVSS (MAGA4_HUMAN)
  misc_feature (2)..(2): Xaa can be Glu, Gln, Asp, Ala, Ser, Val, Ile, Met, Leu, Asn, His, Gly, Lys, Thr, or Arg
  misc_feature (9)..(9): Xaa can be Leu, Met, Ile, Val, Tyr, Ala, Phe, Pro, Cys, Ser, Thr, Trp, Lys, Arg, Gln, Glu, Asp, His, Asn, or Gly
EXQEAAVSX

SEQ ID NO: 67870 - protein, 10 aa, Artificial Sequence
  Description of Artificial Sequence: Synthetic peptide
  Seed: EEQEAAVSSS (MAGA4_HUMAN)
  misc_feature (2)..(2): Xaa can be Glu, Gln, or Asp
  misc_feature (10)..(10): Xaa can be Leu, Ile, Ala, Val, Cys, Gly, Met, Thr, Phe, Ser, Tyr, or Pro
EXQEAAVSSX

SEQ ID NO: 67871 - protein, 11 aa, Artificial Sequence
  Description of Artificial Sequence: Synthetic peptide
  Seed: EEQEAAVSSSS (MAGA4_HUMAN)
  misc_feature (2)..(2): Xaa can be Glu, Gln, or Asp
  misc_feature (11)..(11): Xaa can be Ala, Cys, Leu, Pro, Tyr, Trp, Gly, Ile, Ser, Thr, Met, Val, or Phe
EXQEAAVSSSX

SEQ ID NO: 67872 - protein, 8 aa, Artificial Sequence
  Description of Artificial Sequence: Synthetic peptide
  Seed: EEVPAAES (MAGA4_HUMAN)
  misc_feature (2)..(2): Xaa can be Glu, Asp, or Gln
  misc_feature (8)..(8): Xaa can be Val, Ala, Leu, Met, Ile, Phe, Pro, Gly, Ser, Thr, or Cys
EXVPAAEX

SEQ ID NO: 67873 - protein, 9 aa, Artificial Sequence
  Description of Artificial Sequence: Synthetic peptide
  Seed: EEVPAAESA (MAGA4_HUMAN)
  misc_feature (2)..(2): Xaa can be Glu, Gln, His, Asp, Arg, Ala, Lys, Ser, Asn, Pro, Gly, Val, Ile, Thr, Met, or Leu
  misc_feature (9)..(9): Xaa can be Leu, Trp, Phe, Tyr, Met, Ala, Ile, Val, Pro, Thr, Cys, Ser, Gly, Lys, His, Glu, Arg, Asn, Gln, or Asp
EXVPAAESX

SEQ ID NO: 67874 - protein, 10 aa, Artificial Sequence
  Description of Artificial Sequence: Synthetic peptide
  Seed: EEVPAAESAG (MAGA4_HUMAN)
  misc_feature (2)..(2): Xaa can be Glu, Gln, or Asp
  misc_feature (10)..(10): Xaa can be Leu, Ala, Val, Ile, Cys, Thr, Tyr, Ser, Gly, Phe, Met, or Pro
EXVPAAESAX

SEQ ID NO: 67875 - protein, 11 aa, Artificial Sequence
  Description of Artificial Sequence: Synthetic peptide
  Seed: EEVPAAESAGP (MAGA4_HUMAN)
  misc_feature (2)..(2): Xaa can be Glu, or Gln
  misc_feature (11)..(11): Xaa can be Ala, Cys, Leu, Ser, Thr, Pro, Val, Ile, Tyr, Met, Phe, or Gly
EXVPAAESAGX

SEQ ID NO: 67876 - protein, 10 aa, Artificial Sequence
  Description of Artificial Sequence: Synthetic peptide
  Seed: EGDSASEEEI (MAGA4_HUMAN)
  misc_feature (2)..(2): Xaa can be Ala, Leu, Ile, Met, Val, Ser, Phe, Thr, Gly, Gln, Trp, Asn, Cys, Pro, or Tyr
  misc_feature (10)..(10): Xaa can be Phe, Leu, Met, Ile, Val, Tyr, Lys, or Trp
EXDSASEEEX

SEQ ID NO: 67877 - protein, 11 aa, Artificial Sequence
  Description of Artificial Sequence: Synthetic peptide
  Seed: EGDSASEEEIW (MAGA4_HUMAN)
  misc_feature (2)..(2): Xaa can be Thr, Ile, Val, Met, Tyr, Ser, Phe, Trp, Ala, Gly, Cys, Leu, Pro, Asn, Gln, or Glu
  misc_feature (11)..(11): Xaa can be Trp, Phe, or Tyr
EXDSASEEEIX

SEQ ID NO: 67878 - protein, 9 aa, Artificial Sequence
  Description of Artificial Sequence: Synthetic peptide
  Seed: EHTVYGEPR (MAGA4_HUMAN)
  misc_feature (2)..(2): Xaa can be Thr, Val, Phe, Ile, Trp, Ala, Tyr, Asn, Met, His, Pro, Glu, Gln, Gly, Asp, Leu, Ser, or Cy s
  misc_feature (9)..(9): Xaa can be Arg, or Lys
EXTVYGEPX

SEQ ID NO: 67879 - protein, 10 aa, Artificial Sequence
  Description of Artificial Sequence: Synthetic peptide
  Seed: EHTVYGEPRK (MAGA4_HUMAN)
  misc_feature (2)..(2): Xaa can be Thr, Lys, Asp, Asn, Gly, Met, Phe, His, Leu, Trp, Glu, Pro, Ile, Cys, Arg, Tyr, Ala, Ser, Gln, or Val
  misc_feature (10)..(10): Xaa can be Lys, Arg, or Tyr
EXTVYGEPRX

SEQ ID NO: 67880 - protein, 11 aa, Artificial Sequence
  Description of Artificial Sequence: Synthetic peptide
  Seed: EHTVYGEPRKL (MAGA4_HUMAN)
  misc_feature (2)..(2): Xaa can be , or His
  misc_feature (11)..(11): Xaa can be Ile, Phe, or Leu
EXTVYGEPRKX

SEQ ID NO: 67881 - protein, 8 aa, Artificial Sequence
  Description of Artificial Sequence: Synthetic peptide
  Seed: EHVVRVNA (MAGA4_HUMAN)
  misc_feature (2)..(2): Xaa can be His, Gln, or Arg
  misc_feature (8)..(8): Xaa can be Ala, Leu, Ile, Thr, Val, or Met
EXVVRVNX

SEQ ID NO: 67882 - protein, 9 aa, Artificial Sequence
  Description of Artificial Sequence: Synthetic peptide
  Seed: EHVVRVNAR (MAGA4_HUMAN)
  misc_feature (2)..(2): Xaa can be Trp, Ser, Val, Asn, Leu, Tyr, Gly, Ile, Thr, Ala, Met, Phe, Gln, His, Pro, Glu, Cys, Lys, or Asp
  misc_feature (9)..(9): Xaa can be Arg, or Lys
EXVVRVNAX

SEQ ID NO: 67883 - protein, 10 aa, Artificial Sequence
  Description of Artificial Sequence: Synthetic peptide
  Seed: EHVVRVNARV (MAGA4_HUMAN)
  misc_feature (2)..(2): Xaa can be Thr, Trp, Met, Leu, Tyr, Ser, Glu, Gln, Ile, Asn, His, Lys, Gly, Asp, Arg, Cys, Pro, Ala, Val, or Phe
  misc_feature (10)..(10): Xaa can be Leu, Ala, Ile, Val, Thr, or Met
EXVVRVNARX

SEQ ID NO: 67884 - protein, 9 aa, Artificial Sequence
  Description of Artificial Sequence: Synthetic peptide
  Seed: EIWEELGVM (MAGA4_HUMAN)
  misc_feature (2)..(2): Xaa can be Val, Thr, Ala, Ile, Gln, Ser, Met, Pro, Leu, Glu, Asn, Gly, Phe, Asp, Cys, Tyr, Trp, His, Lys, or Arg
  misc_feature (9)..(9): Xaa can be Tyr, Arg, Phe, Lys, Trp, Met, Leu, His, Ile, Val, or Gln
EXWEELGVX

SEQ ID NO: 67885 - protein, 11 aa, Artificial Sequence
  Description of Artificial Sequence: Synthetic peptide
  Seed: EIWEELGVMGV (MAGA4_HUMAN)
  misc_feature (2)..(2): Xaa can be Met, Leu, Val, Thr, Ile, Ser, Ala, or Gln
  misc_feature (11)..(11): Xaa can be Val, Ile, Leu, Ala, or Met
EXWEELGVMGX

SEQ ID NO: 67886 - protein, 8 aa, Artificial Sequence
  Description of Artificial Sequence: Synthetic peptide
  Seed: ELAHFLLR (MAGA4_HUMAN)
  misc_feature (2)..(2): Xaa can be Gly, Ile, Val, Ser, Thr, Met, Ala, Leu, Tyr, Gln, Trp, Asn, or Phe
  misc_feature (8)..(8): Xaa can be Arg, or Lys
EXAHFLLX

SEQ ID NO: 67887 - protein, 9 aa, Artificial Sequence
  Description of Artificial Sequence: Synthetic peptide
  Seed: ELAHFLLRK (MAGA4_HUMAN)
  misc_feature (2)..(2): Xaa can be Val, Thr, Ile, Ala, Met, Leu, Ser, Gln, Gly, Asn, Cys, Tyr, Phe, His, Trp, Lys, Asp, Glu, Pro, or Arg
  misc_feature (9)..(9): Xaa can be Arg, Lys, His, Tyr, Leu, Phe, Ile, Met, Val, Ala, Gln, Trp, or Asn
EXAHFLLRX

SEQ ID NO: 67888 - protein, 10 aa, Artificial Sequence
  Description of Artificial Sequence: Synthetic peptide
  Seed: ELAHFLLRKY (MAGA4_HUMAN)
  misc_feature (2)..(2): Xaa can be Val, Thr, Ile, Ser, Ala, Met, Gln, Leu, Phe, Trp, Asn, Asp, Cys, Glu, Gly, Tyr, or Pro
  misc_feature (10)..(10): Xaa can be Lys, Arg, Tyr, Phe, Leu, Met, His, Val, Ala, Ile, or Gln
EXAHFLLRKX

SEQ ID NO: 67889 - protein, 11 aa, Artificial Sequence
  Description of Artificial Sequence: Synthetic peptide
  Seed: ELAHFLLRKYR (MAGA4_HUMAN)
  misc_feature (2)..(2): Xaa can be Leu, Met, Ser, Phe, Ala, Tyr, Thr, Val, Ile, Trp, Cys, Gly, Gln, His, Asn, Arg, or Lys
  misc_feature (11)..(11): Xaa can be Arg, or Lys
EXAHFLLRKYX

SEQ ID NO: 67890 - protein, 11 aa, Artificial Sequence
  Description of Artificial Sequence: Synthetic peptide
  Seed: ELGVMGVYDGR (MAGA4_HUMAN)
  misc_feature (2)..(2): Xaa can be Thr, Cys, Tyr, Asn, Met, His, Asp, Ser, Ala, Gly, Arg, Trp, Pro, Leu, Ile, Gln, Val, Glu, Phe, or Lys
  misc_feature (11)..(11): Xaa can be Lys, Arg, or Tyr
EXGVMGVYDGX

SEQ ID NO: 67891 - protein, 9 aa, Artificial Sequence
  Description of Artificial Sequence: Synthetic peptide
  Seed: ELVTKAEML (MAGA4_HUMAN)
  misc_feature (2)..(2): Xaa can be Gln, Met, Leu, Pro, Ala, Ile, or Val
  misc_feature (9)..(9): Xaa can be Leu, Met, Trp, Ile, Phe, or Val
EXVTKAEMX

SEQ ID NO: 67892 - protein, 11 aa, Artificial Sequence
  Description of Artificial Sequence: Synthetic peptide
  Seed: ELVTKAEMLER (MAGA4_HUMAN)
  misc_feature (2)..(2): Xaa can be Thr, Gly, Met, Val, Leu, Phe, Asn, Gln, Tyr, Ile, Ser, Cys, Trp, Ala, Lys, Glu, His, Arg, Asp, or Pro
  misc_feature (11)..(11): Xaa can be Arg, Lys, or His
EXVTKAEMLEX

SEQ ID NO: 67893 - protein, 10 aa, Artificial Sequence
  Description of Artificial Sequence: Synthetic peptide
  Seed: EMLERVIKNY (MAGA4_HUMAN)
  misc_feature (2)..(2): Xaa can be Thr, Val, Ile, Ala, Ser, Met, Leu, Gln, Glu, Phe, Tyr, Asn, Asp, Cys, Gly, Pro, or Trp
  misc_feature (10)..(10): Xaa can be Lys, Arg, Tyr, Phe, Trp, Met, Leu, Ile, His, Gln, or Val
EXLERVIKNX

SEQ ID NO: 67894 - protein, 11 aa, Artificial Sequence
  Description of Artificial Sequence: Synthetic peptide
  Seed: EMLERVIKNYK (MAGA4_HUMAN)
  misc_feature (2)..(2): Xaa can be Thr, Met, Tyr, Gln, Leu, Asn, Ile, Ala, Phe, Trp, Gly, Val, Ser, Glu, His, Asp, or Cys
  misc_feature (11)..(11): Xaa can be Arg, Lys, or Tyr
EXLERVIKNYX

SEQ ID NO: 67895 - protein, 9 aa, Artificial Sequence
  Description of Artificial Sequence: Synthetic peptide
  Seed: ERVIKNYKR (MAGA4_HUMAN)
  misc_feature (2)..(2): Xaa can be Arg, Leu, Trp, Asn, Val, Gly, Ile, Ala, Tyr, Ser, Met, His, Gln, Thr, Phe, Pro, Lys, Glu, Cys, or Asp
  misc_feature (9)..(9): Xaa can be Arg, Lys, Met, Trp, Tyr, Val, Leu, His, Phe, or Ile
EXVIKNYKX

SEQ ID NO: 67896 - protein, 10 aa, Artificial Sequence
  Description of Artificial Sequence: Synthetic peptide
  Seed: ESAGPPQSPQ (MAGA4_HUMAN)
  misc_feature (2)..(2): Xaa can be Val, Thr, Ile, Ala, Met, Leu, Ser, Gln, Pro, Asp, Glu, Tyr, His, Phe, Trp, Gly, Asn, Cys, or Lys
  misc_feature (10)..(10): Xaa can be Arg, Lys, Tyr, Phe, His, Leu, Gln, Met, Ile, Val, Glu, Asn, Trp, Ala, Thr, Cys, or Gly
EXAGPPQSPX

SEQ ID NO: 67897 - protein, 8 aa, Artificial Sequence
  Description of Artificial Sequence: Synthetic peptide
  Seed: ESLFREAL (MAGA4_HUMAN)
  misc_feature (2)..(2): Xaa can be Pro, Leu, Met, Ala, Ile, Asn, Val, Phe, Thr, Gln, Gly, or Ser
  misc_feature (8)..(8): Xaa can be Leu, Met, Ile, or Phe
EXLFREAX

SEQ ID NO: 67898 - protein, 11 aa, Artificial Sequence
  Description of Artificial Sequence: Synthetic peptide
  Seed: ESLFREALSNK (MAGA4_HUMAN)
  misc_feature (2)..(2): Xaa can be Thr, Gln, Ala, Tyr, Phe, Val, Leu, Met, Gly, Trp, His, Ile, Ser, Cys, Glu, Asp, Asn, Lys, or Arg
  misc_feature (11)..(11): Xaa can be Arg, Lys, or Tyr
EXLFREALSNX

SEQ ID NO: 67899 - protein, 9 aa, Artificial Sequence
  Description of Artificial Sequence: Synthetic peptide
  Seed: ESLKMIFGI (MAGA4_HUMAN)
  misc_feature (2)..(2): Xaa can be Thr, Val, Ala, Ser, Ile, Leu, Met, Gly, Asn, Gln, Cys, or Pro
  misc_feature (9)..(9): Xaa can be Val, Trp, Leu, Ile, Phe, Ala, Met, Thr, Tyr, Cys, or Ser
EXLKMIFGX

SEQ ID NO: 67900 - protein, 10 aa, Artificial Sequence
  Description of Artificial Sequence: Synthetic peptide
  Seed: ETSYVKVLEH (MAGA4_HUMAN)
  misc_feature (2)..(2): Xaa can be Val, Thr, Ile, Ser, Ala, Met, Cys, Glu, Gly, Phe, Lys, Asn, Asp, Leu, His, Pro, Arg, Gln, Tyr, or Trp
  misc_feature (10)..(10): Xaa can be Lys, Arg, Tyr, or His
EXSYVKVLEX

SEQ ID NO: 67901 - protein, 11 aa, Artificial Sequence
  Description of Artificial Sequence: Synthetic peptide
  Seed: ETSYVKVLEHV (MAGA4_HUMAN)
  misc_feature (2)..(2): Xaa can be Thr, Val, Ala, Ile, or Ser
  misc_feature (11)..(11): Xaa can be Val, Leu, Ile, or Ala
EXSYVKVLEHX

SEQ ID NO: 67902 - protein, 9 aa, Artificial Sequence
  Description of Artificial Sequence: Synthetic peptide
  Seed: EVDPASNTY (MAGA4_HUMAN)
  misc_feature (2)..(2): Xaa can be Thr, Val, Ser, Leu, Phe, Ile, Ala, Met, Pro, Tyr, Cys, Gly, Gln, Trp, His, Asp, Asn, Glu, Lys, or Arg
  misc_feature (9)..(9): Xaa can be Val, Phe, Met, Tyr, Trp, Ile, Leu, Lys, Arg, Cys, Ala, His, Thr, or Gln
EXDPASNTX

SEQ ID NO: 67903 - protein, 11 aa, Artificial Sequence
  Description of Artificial Sequence: Synthetic peptide
  Seed: EVDPASNTYTL (MAGA4_HUMAN)
  misc_feature (2)..(2): Xaa can be Ala, Thr, Tyr, Phe, Ser, Ile, Met, Leu, Trp, Val, Gly, Cys, Gln, Arg, Asn, His, Pro, Glu, Asp, or Lys
  misc_feature (11)..(11): Xaa can be Trp, Leu, Phe, Met, Lys, Ile, Val, Tyr, Arg, Cys, Ala, or His
EXDPASNTYTX

SEQ ID NO: 67904 - protein, 8 aa, Artificial Sequence
  Description of Artificial Sequence: Synthetic peptide
  Seed: FGIDVKEV (MAGA4_HUMAN)
  misc_feature (2)..(2): Xaa can be Ala, Thr, Ser, Gln, Gly, Ile, Asn, Val, Leu, Met, Phe, Pro, Tyr, Glu, Cys, Asp, His, Trp, or Lys
  misc_feature (8)..(8): Xaa can be Leu, Val, Met, Ile, Phe, Tyr, Lys, Arg, Trp, His, Cys, or Ala
FXIDVKEX

SEQ ID NO: 67905 - protein, 9 aa, Artificial Sequence
  Description of Artificial Sequence: Synthetic peptide
  Seed: FGKASESLK (MAGA4_HUMAN)
  misc_feature (2)..(2): Xaa can be Thr, Ser, Ala, Val, Leu, Phe, Gly, Met, Ile, Cys, Tyr, Gln, Glu, Asp, Asn, or Pro
  misc_feature (9)..(9): Xaa can be Arg, Lys, Tyr, Phe, Met, Leu, Ile, Val, Trp, Ala, or His
FXKASESLX

SEQ ID NO: 67906 - protein, 10 aa, Artificial Sequence
  Description of Artificial Sequence: Synthetic peptide
  Seed: FGKASESLKM (MAGA4_HUMAN)
  misc_feature (2)..(2): Xaa can be Met, Gln, Thr, Cys, Ile, Asp, Arg, Trp, Lys, Asn, Gly, His, Val, Leu, Tyr, Ala, Pro, Ser, Phe, or Glu
  misc_feature (10)..(10): Xaa can be Met, Phe, Tyr, Trp, or Leu
FXKASESLKX

SEQ ID NO: 67907 - protein, 8 aa, Artificial Sequence
  Description of Artificial Sequence: Synthetic peptide
  Seed: FLLRKYRA (MAGA4_HUMAN)
  misc_feature (2)..(2): Xaa can be Met, Pro, Leu, Ile, Ala, Val, Asn, Gly, Ser, Gln, Lys, Arg, Phe, Thr, Trp, His, or Tyr
  misc_feature (8)..(8): Xaa can be Leu, Met, Ile, Phe, Val, or Ala
FXLRKYRX

SEQ ID NO: 67908 - protein, 9 aa, Artificial Sequence
  Description of Artificial Sequence: Synthetic peptide
  Seed: FLLRKYRAK (MAGA4_HUMAN)
  misc_feature (2)..(2): Xaa can be Met, Leu, Thr, Ile, Val, Ser, Phe, Gln, Tyr, Ala, Trp, Asn, or Gly
  misc_feature (9)..(9): Xaa can be Arg, Lys, Tyr, Leu, Val, Met, or His
FXLRKYRAX

SEQ ID NO: 67909 - protein, 11 aa, Artificial Sequence
  Description of Artificial Sequence: Synthetic peptide
  Seed: FLLRKYRAKEL (MAGA4_HUMAN)
  misc_feature (2)..(2): Xaa can be Pro, Met, Leu, Val, Ile, Phe, Ala, Asn, Trp, Tyr, Gln, Thr, Ser, or Gly
  misc_feature (11)..(11): Xaa can be Leu, Met, Ile, Val, Phe, or Ala
FXLRKYRAKEX

SEQ ID NO: 67910 - protein, 8 aa, Artificial Sequence
  Description of Artificial Sequence: Synthetic peptide
  Seed: FPKTGLLI (MAGA4_HUMAN)
  misc_feature (2)..(2): Xaa can be Pro, Ala, Glu, Gln, Asp, Val, Met, Ile, Leu, or Phe
  misc_feature (8)..(8): Xaa can be Leu, Ile, Val, Tyr, Thr, Phe, Cys, Pro, Gly, Trp, Met, Ser, or Ala
FXKTGLLX

SEQ ID NO: 67911 - protein, 9 aa, Artificial Sequence
  Description of Artificial Sequence: Synthetic peptide
  Seed: FPKTGLLII (MAGA4_HUMAN)
  misc_feature (2)..(2): Xaa can be Pro, His, Arg, Ala, Met, Ser, Gly, Gln, Thr, Ile, Val, Leu, Glu, Asn, Asp, Phe, Lys, Cys, Trp, or Tyr
  misc_feature (9)..(9): Xaa can be Leu, Ile, Met, Val, Ala, Phe, Tyr, Trp, Cys, Thr, Pro, Gly, Ser, Gln, Arg, Lys, Glu, His, Asp, or Asn
FXKTGLLIX

SEQ ID NO: 67912 - protein, 10 aa, Artificial Sequence
  Description of Artificial Sequence: Synthetic peptide
  Seed: FPKTGLLIIV (MAGA4_HUMAN)
  misc_feature (2)..(2): Xaa can be , or Pro
  misc_feature (10)..(10): Xaa can be Met, Ile, Lys, Cys, Ser, Tyr, Thr, Val, Pro, Leu, Phe, Arg, Ala, or Gly
FXKTGLLIIX

SEQ ID NO: 67913 - protein, 11 aa, Artificial Sequence
  Description of Artificial Sequence: Synthetic peptide
  Seed: FPKTGLLIIVL (MAGA4_HUMAN)
  misc_feature (2)..(2): Xaa can be , or Pro
  misc_feature (11)..(11): Xaa can be Cys, Gly, Ser, Ile, Met, Val, Thr, Phe, Ala, Leu, or Pro
FXKTGLLIIVX

SEQ ID NO: 67914 - protein, 8 aa, Artificial Sequence
  Description of Artificial Sequence: Synthetic peptide
  Seed: FPVIFGKA (MAGA4_HUMAN)
  misc_feature (2)..(2): Xaa can be , or Pro
  misc_feature (8)..(8): Xaa can be Thr, Met, Ala, Leu, Val, or Ile
FXVIFGKX

SEQ ID NO: 67915 - protein, 9 aa, Artificial Sequence
  Description of Artificial Sequence: Synthetic peptide
  Seed: FPVIFGKAS (MAGA4_HUMAN)
  misc_feature (2)..(2): Xaa can be Pro, Ala, Val, Ser, Ile, Thr, Met, Gly, Cys, Leu, Gln, Asn, Phe, Glu, or Asp
  misc_feature (9)..(9): Xaa can be Tyr, Phe, Met, Ala, Leu, His, Ile, Trp, Cys, Val, Asn, Glu, Arg, Ser, Thr, Gln, Pro, Lys, or Gly
FXVIFGKAX

SEQ ID NO: 67916 - protein, 11 aa, Artificial Sequence
  Description of Artificial Sequence: Synthetic peptide
  Seed: FPVIFGKASES (MAGA4_HUMAN)
  misc_feature (2)..(2): Xaa can be , or Pro
  misc_feature (11)..(11): Xaa can be Ile, Met, Ala, Pro, Phe, Val, Ser, Thr, Tyr, Gly, Leu, or Cys
FXVIFGKASEX

SEQ ID NO: 67917 - protein, 9 aa, Artificial Sequence
  Description of Artificial Sequence: Synthetic peptide
  Seed: FREALSNKV (MAGA4_HUMAN)
  misc_feature (2)..(2): Xaa can be Arg, His, Gln, Tyr, Phe, Ala, Trp, Ser, Met, Gly, Lys, Glu, Val, Ile, Leu, Asn, Asp, Thr, Cys, or Pro
  misc_feature (9)..(9): Xaa can be Leu, Met, Phe, Ile, Tyr, Val, Trp, Ala, Cys, Pro, Thr, Lys, Arg, or His
FXEALSNKX

SEQ ID NO: 67918 - protein, 9 aa, Artificial Sequence
  Description of Artificial Sequence: Synthetic peptide
  Seed: GASALPTTI (MAGA4_HUMAN)
  misc_feature (2)..(2): Xaa can be Arg, Ala, Pro, Gln, Leu, Thr, Val, Ser, Ile, Met, Gly, Asn, Asp, Lys, Phe, Tyr, Glu, Cys, His, or Trp
  misc_feature (9)..(9): Xaa can be Met, Leu, Phe, Tyr, Val, Trp, Ile, Arg, Lys, His, Ala, Thr, Cys, Ser, Pro, Gln, Gly, Glu, or Asn
GXSALPTTX

SEQ ID NO: 67919 - protein, 11 aa, Artificial Sequence
  Description of Artificial Sequence: Synthetic peptide
  Seed: GASALPTTISF (MAGA4_HUMAN)
  misc_feature (2)..(2): Xaa can be Ala, Ser, Thr, Val, Gln, Gly, Ile, Leu, Met, Glu, Pro, Asn, Tyr, Arg, Cys, Phe, Lys, Trp, Asp, or His
  misc_feature (11)..(11): Xaa can be Trp, Phe, Tyr, Lys, Arg, Leu, Met, His, Val, or Ile
GXSALPTTISX

SEQ ID NO: 67920 - protein, 9 aa, Artificial Sequence
  Description of Artificial Sequence: Synthetic peptide
  Seed: GDSASEEEI (MAGA4_HUMAN)
  misc_feature (2)..(2): Xaa can be Glu, Asp, or Gln
  misc_feature (9)..(9): Xaa can be Leu, Met, Phe, Val, Ala, Ile, Cys, Pro, Lys, Ser, Gly, Tyr, Trp, or Thr
GXSASEEEX

SEQ ID NO: 67921 - protein, 10 aa, Artificial Sequence
  Description of Artificial Sequence: Synthetic peptide
  Seed: GDSASEEEIW (MAGA4_HUMAN)
  misc_feature (2)..(2): Xaa can be Glu, Gln, Asp, Trp, Cys, Lys, Val, Ala, Gly, Phe, Arg, Thr, Asn, Ile, His, Met, Ser, Tyr, Pro, or Leu
  misc_feature (10)..(10): Xaa can be Trp, Tyr, Phe, Leu, Met, Ile, or Val
GXSASEEEIX

SEQ ID NO: 67922 - protein, 11 aa, Artificial Sequence
  Description of Artificial Sequence: Synthetic peptide
  Seed: GEPRKLLTQDW (MAGA4_HUMAN)
  misc_feature (2)..(2): Xaa can be , or Glu
  misc_feature (11)..(11): Xaa can be Tyr, or Trp
GXPRKLLTQDX

SEQ ID NO: 67923 - protein, 9 aa, Artificial Sequence
  Description of Artificial Sequence: Synthetic peptide
  Seed: GKASESLKM (MAGA4_HUMAN)
  misc_feature (2)..(2): Xaa can be Gln, Lys, Glu, Met, Arg, Leu, His, Ser, Ala, Ile, Thr, Asn, Val, or Gly
  misc_feature (9)..(9): Xaa can be Tyr, Phe, Met, Leu, Trp, Ile, His, or Val
GXASESLKX

SEQ ID NO: 67924 - protein, 11 aa, Artificial Sequence
  Description of Artificial Sequence: Synthetic peptide
  Seed: GKASESLKMIF (MAGA4_HUMAN)
  misc_feature (2)..(2): Xaa can be Gln, Lys, Met, Glu, or Arg
  misc_feature (11)..(11): Xaa can be Tyr, Phe, Met, or Trp
GXASESLKMIX

SEQ ID NO: 67925 - protein, 9 aa, Artificial Sequence
  Description of Artificial Sequence: Synthetic peptide
  Seed: GLLGNNQIF (MAGA4_HUMAN)
  misc_feature (2)..(2): Xaa can be Ala, Met, Gln, Leu, Thr, Val, Ser, Glu, Ile, Lys, Arg, Gly, Asn, His, Phe, Pro, Asp, Tyr, Cys, or Trp
  misc_feature (9)..(9): Xaa can be Tyr, Phe, Met, Trp, Leu, Ile, His, Val, or Ala
GXLGNNQIX

SEQ ID NO: 67926 - protein, 11 aa, Artificial Sequence
  Description of Artificial Sequence: Synthetic peptide
  Seed: GLLGNNQIFPK (MAGA4_HUMAN)
  misc_feature (2)..(2): Xaa can be Thr, Ile, Met, Arg, Trp, Ser, Leu, Gln, Lys, Val, Ala, Phe, Gly, Tyr, Asn, Cys, Glu, Asp, Pro, or His
  misc_feature (11)..(11): Xaa can be Arg, Lys, or Tyr
GXLGNNQIFPX

SEQ ID NO: 67927 - protein, 9 aa, Artificial Sequence
  Description of Artificial Sequence: Synthetic peptide
  Seed: GLLIIVLGT (MAGA4_HUMAN)
  misc_feature (2)..(2): Xaa can be Met, Leu, Val, Gln, Thr, Ile, Ala, Ser, Gly, or Asn
  misc_feature (9)..(9): Xaa can be Val, Ile, Leu, Ala, Met, Thr, Cys, or Phe
GXLIIVLGX

SEQ ID NO: 67928 - protein, 10 aa, Artificial Sequence
  Description of Artificial Sequence: Synthetic peptide
  Seed: GLLIIVLGTI (MAGA4_HUMAN)
  misc_feature (2)..(2): Xaa can be Met, Leu, Ser, Tyr, Phe, Trp, His, Gly, Arg, Val, Cys, Pro, Ala, Lys, Glu, Ile, Asp, Asn, Thr, or Gln
  misc_feature (10)..(10): Xaa can be Leu, Ala, Ile, Val, Thr, or Met
GXLIIVLGTX

SEQ ID NO: 67929 - protein, 9 aa, Artificial Sequence
  Description of Artificial Sequence: Synthetic peptide
  Seed: GLVGAQAPT (MAGA4_HUMAN)
  misc_feature (2)..(2): Xaa can be Met, Leu, Gln, Ile, Val, Thr, Ala, or Ser
  misc_feature (9)..(9): Xaa can be Ile, Val, Leu, Ala, Met, Phe, Thr, Ser, or Cys
GXVGAQAPX

SEQ ID NO: 67930 - protein, 10 aa, Artificial Sequence
  Description of Artificial Sequence: Synthetic peptide
  Seed: GLVGAQAPTT (MAGA4_HUMAN)
  misc_feature (2)..(2): Xaa can be Leu, Met, Ile, Val, Gln, or Thr
  misc_feature (10)..(10): Xaa can be Val, Leu, Ile, Thr, Met, or Ala
GXVGAQAPTX

SEQ ID NO: 67931 - protein, 9 aa, Artificial Sequence
  Description of Artificial Sequence: Synthetic peptide
  Seed: GPPQSPQGA (MAGA4_HUMAN)
  misc_feature (2)..(2): Xaa can be Pro, or Ala
  misc_feature (9)..(9): Xaa can be Leu, Ala, Thr, Tyr, Pro, Ser, Met, Ile, Phe, Val, or Cys
GXPQSPQGX

SEQ ID NO: 67932 - protein, 10 aa, Artificial Sequence
  Description of Artificial Sequence: Synthetic peptide
  Seed: GPPQSPQGAS (MAGA4_HUMAN)
  misc_feature (2)..(2): Xaa can be Pro, or Ala
  misc_feature (10)..(10): Xaa can be Ala, Cys, Met, Phe, Gly, Ile, Leu, Val, Pro, Thr, Tyr, or Ser
GXPQSPQGAX

SEQ ID NO: 67933 - protein, 11 aa, Artificial Sequence
  Description of Artificial Sequence: Synthetic peptide
  Seed: GPPQSPQGASA (MAGA4_HUMAN)
  misc_feature (2)..(2): Xaa can be Pro, or Ala
  misc_feature (11)..(11): Xaa can be Ala, Leu, Met, Trp, Val, Ile, Tyr, Phe, Cys, Arg, Pro, Gly, Lys, Thr, or Ser
GXPQSPQGASX

SEQ ID NO: 67934 - protein, 11 aa, Artificial Sequence
  Description of Artificial Sequence: Synthetic peptide
  Seed: GPSTSPDAESL (MAGA4_HUMAN)
  misc_feature (2)..(2): Xaa can be Pro, Ala, Ser, Val, Thr, or Gly
  misc_feature (11)..(11): Xaa can be Trp, Leu, Met, Tyr, Phe, Ile, Val, Ala, Pro, Cys, Thr, Gly, or Ser
GXSTSPDAESX

SEQ ID NO: 67935 - protein, 11 aa, Artificial Sequence
  Description of Artificial Sequence: Synthetic peptide
  Seed: GREHTVYGEPR (MAGA4_HUMAN)
  misc_feature (2)..(2): Xaa can be , or Arg
  misc_feature (11)..(11): Xaa can be Arg, Lys, Phe, or Tyr
GXEHTVYGEPX

SEQ ID NO: 67936 - protein, 9 aa, Artificial Sequence
  Description of Artificial Sequence: Synthetic peptide
  Seed: GSNPARYEF (MAGA4_HUMAN)
  misc_feature (2)..(2): Xaa can be Arg, Gln, Ala, Val, Ile, Ser, Met, Thr, Tyr, Asn, Gly, Lys, Leu, Glu, Asp, Phe, His, Trp, Pro, or Cys
  misc_feature (9)..(9): Xaa can be Tyr, Met, Phe, Leu, Trp, Val, Ile, His, Cys, Ala, Thr, Arg, or Lys
GXNPARYEX

SEQ ID NO: 67937 - protein, 10 aa, Artificial Sequence
  Description of Artificial Sequence: Synthetic peptide
  Seed: GSNPARYEFL (MAGA4_HUMAN)
  misc_feature (2)..(2): Xaa can be Ala, Ser, Thr, Val, Ile, Gly, Gln, Asn, Leu, Met, Pro, or Cys
  misc_feature (10)..(10): Xaa can be Trp, Tyr, Leu, Phe, Met, Ile, or Val
GXNPARYEFX

SEQ ID NO: 67938 - protein, 11 aa, Artificial Sequence
  Description of Artificial Sequence: Synthetic peptide
  Seed: GSNPARYEFLW (MAGA4_HUMAN)
  misc_feature (2)..(2): Xaa can be Ser, Thr, Val, Ala, Cys, Met, Asp, Gly, Ile, Asn, Leu, Gln, Pro, or Phe
  misc_feature (11)..(11): Xaa can be Trp, Phe, or Tyr
GXNPARYEFLX

SEQ ID NO: 67939 - protein, 9 aa, Artificial Sequence
  Description of Artificial Sequence: Synthetic peptide
  Seed: GTLEEVPAA (MAGA4_HUMAN)
  misc_feature (2)..(2): Xaa can be Leu, Met, Gln, Thr, Ile, Val, Ala, Ser, Cys, Phe, Gly, Asn, Glu, Tyr, or Trp
  misc_feature (9)..(9): Xaa can be Val, Leu, Ile, Ala, Met, Thr, Phe, Cys, Ser, Lys, Arg, Tyr, Pro, Gly, Gln, or Glu
GXLEEVPAX

SEQ ID NO: 67940 - protein, 9 aa, Artificial Sequence
  Description of Artificial Sequence: Synthetic peptide
  Seed: GVEAQEEAL (MAGA4_HUMAN)
  misc_feature (2)..(2): Xaa can be Gln, Ser, Ala, Ile, Met, Leu, Thr, Val, Phe, or Gly
  misc_feature (9)..(9): Xaa can be Leu, Met, Phe, Trp, Ile, Val, or Tyr
GXEAQEEAX

SEQ ID NO: 67941 - protein, 9 aa, Artificial Sequence
  Description of Artificial Sequence: Synthetic peptide
  Seed: GVMGVYDGR (MAGA4_HUMAN)
  misc_feature (2)..(2): Xaa can be Met, Leu, Ala, Val, Ile, Thr, Ser, Phe, Asn, Asp, Gln, Gly, Trp, Tyr, Pro, Cys, or His
  misc_feature (9)..(9): Xaa can be Arg, Lys, Tyr, Leu, Met, Val, His, or Ile
GXMGVYDGX

SEQ ID NO: 67942 - protein, 8 aa, Artificial Sequence
  Description of Artificial Sequence: Synthetic peptide
  Seed: GVYDGREH (MAGA4_HUMAN)
  misc_feature (2)..(2): Xaa can be Ala, Ser, Thr, Val, Gly, Ile, Met, Gln, Leu, Asn, Glu, Pro, Cys, Asp, or Phe
  misc_feature (8)..(8): Xaa can be Tyr, Phe, Leu, Met, His, Ile, Val, Trp, Lys, Arg, or Ala
GXYDGREX

SEQ ID NO: 67943 - protein, 9 aa, Artificial Sequence
  Description of Artificial Sequence: Synthetic peptide
  Seed: GVYDGREHT (MAGA4_HUMAN)
  misc_feature (2)..(2): Xaa can be Leu, Met, Ile, Gln, Val, Thr, Ala, Ser, Glu, Asn, Gly, or Cys
  misc_feature (9)..(9): Xaa can be Val, Leu, Ile, Ala, Met, Thr, Phe, or Cys
GXYDGREHX

SEQ ID NO: 67944 - protein, 10 aa, Artificial Sequence
  Description of Artificial Sequence: Synthetic peptide
  Seed: GVYDGREHTV (MAGA4_HUMAN)
  misc_feature (2)..(2): Xaa can be Ala, Arg, Leu, Gln, Met, Ser, Thr, Val, Glu, Ile, Gly, Tyr, Asn, Cys, Phe, Pro, His, Trp, Asp, or Lys
  misc_feature (10)..(10): Xaa can be Phe, Tyr, Trp, Leu, Val, Met, Ile, Lys, Arg, Cys, Ala, His, Thr, Gln, Ser, Gly, Pro, Glu, or Asn
GXYDGREHTX

SEQ ID NO: 67945 - protein, 11 aa, Artificial Sequence
  Description of Artificial Sequence: Synthetic peptide
  Seed: GVYDGREHTVY (MAGA4_HUMAN)
  misc_feature (2)..(2): Xaa can be Ala, Ser, Val, Thr, Gln, Ile, Met, Glu, Gly, Leu, Tyr, Cys, Lys, Asn, Arg, Phe, Trp, Asp, Pro, or His
  misc_feature (11)..(11): Xaa can be Tyr, Phe, Lys, Met, Trp, Arg, Leu, His, Ile, Val, Cys, Ala, Gln, Thr, or Ser
GXYDGREHTVX

SEQ ID NO: 67946 - protein, 8 aa, Artificial Sequence
  Description of Artificial Sequence: Synthetic peptide
  Seed: HFLLRKYR (MAGA4_HUMAN)
  misc_feature (2)..(2): Xaa can be Met, Phe, Ile, Leu, Ser, Val, Trp, Thr, or Tyr
  misc_feature (8)..(8): Xaa can be Arg, or Lys
HXLLRKYX

SEQ ID NO: 67947 - protein, 10 aa, Artificial Sequence
  Description of Artificial Sequence: Synthetic peptide
  Seed: HFLLRKYRAK (MAGA4_HUMAN)
  misc_feature (2)..(2): Xaa can be Gln, Lys, Ala, Cys, Glu, His, Arg, Asn, Leu, Ile, Pro, Gly, Ser, Thr, Tyr, Met, Asp, Val, Phe, or Trp
  misc_feature (10)..(10): Xaa can be Lys, or Arg
HXLLRKYRAX

SEQ ID NO: 67948 - protein, 8 aa, Artificial Sequence
  Description of Artificial Sequence: Synthetic peptide
  Seed: HTVYGEPR (MAGA4_HUMAN)
  misc_feature (2)..(2): Xaa can be Val, Ser, Thr, Ile, or Ala
  misc_feature (8)..(8): Xaa can be , or Arg
HXVYGEPX

SEQ ID NO: 67949 - protein, 9 aa, Artificial Sequence
  Description of Artificial Sequence: Synthetic peptide
  Seed: HTVYGEPRK (MAGA4_HUMAN)
  misc_feature (2)..(2): Xaa can be Val, Thr, Pro, Gln, Asn, Ser, Ile, Ala, Gly, Leu, Met, or Asp
  misc_feature (9)..(9): Xaa can be Arg, Lys, Leu, Met, His, or Tyr
HXVYGEPRX

SEQ ID NO: 67950 - protein, 10 aa, Artificial Sequence
  Description of Artificial Sequence: Synthetic peptide
  Seed: HTVYGEPRKL (MAGA4_HUMAN)
  misc_feature (2)..(2): Xaa can be Ala, Thr, Ser, Val, Ile, Gln, Met, Leu, Gly, Glu, Cys, Asn, Asp, Pro, or Phe
  misc_feature (10)..(10): Xaa can be Trp, Phe, Tyr, Arg, Leu, Lys, Met, Ile, Val, or His
HXVYGEPRKX

SEQ ID NO: 67951 - protein, 8 aa, Artificial Sequence
  Description of Artificial Sequence: Synthetic peptide
  Seed: HVVRVNAR (MAGA4_HUMAN)
  misc_feature (2)..(2): Xaa can be Val, Thr, Ile, Tyr, Ala, Met, Phe, or Ser
  misc_feature (8)..(8): Xaa can be Arg, or Lys
HXVRVNAX

SEQ ID NO: 67952 - protein, 9 aa, Artificial Sequence
  Description of Artificial Sequence: Synthetic peptide
  Seed: HVVRVNARV (MAGA4_HUMAN)
  misc_feature (2)..(2): Xaa can be Thr, Val, Ile, Ala, Ser, Gln, Leu, Met, Glu, Asn, Gly, Pro, Asp, Phe, or Cys
  misc_feature (9)..(9): Xaa can be Arg, Lys, Val, Leu, Ile, Ala, Met, Tyr, Phe, His, Cys, Thr, or Trp
HXVRVNARX

SEQ ID NO: 67953 - protein, 10 aa, Artificial Sequence
  Description of Artificial Sequence: Synthetic peptide
  Seed: HVVRVNARVR (MAGA4_HUMAN)
  misc_feature (2)..(2): Xaa can be Thr, Val, Tyr, Ser, Phe, Ala, Met, Leu, Ile, Pro, Gly, Trp, Asn, or Gln
  misc_feature (10)..(10): Xaa can be Arg, Lys, or Tyr
HXVRVNARVX

SEQ ID NO: 67954 - protein, 9 aa, Artificial Sequence
  Description of Artificial Sequence: Synthetic peptide
  Seed: IAMEGDSAS (MAGA4_HUMAN)
  misc_feature (2)..(2): Xaa can be Ala, Ile, Ser, Thr, Val, Gly, Met, Gln, Leu, Asn, Phe, Asp, Cys, Glu, Tyr, Pro, Arg, Lys, or Trp
  misc_feature (9)..(9): Xaa can be Tyr, Phe, Met, Lys, Leu, Arg, His, Ile, Val, Trp, Ala, Cys, Thr, Ser, Gln, or Pro
IXMEGDSAX

SEQ ID NO: 67955 - protein, 11 aa, Artificial Sequence
  Description of Artificial Sequence: Synthetic peptide
  Seed: IAMEGDSASEE (MAGA4_HUMAN)
  misc_feature (2)..(2): Xaa can be Ala, Val, Ile, Ser, Thr, Gly, Cys, Gln, Met, Leu, Pro, Asn, Trp, His, Tyr, Asp, Lys, Phe, Glu, or Arg
  misc_feature (11)..(11): Xaa can be Lys, Arg, Leu, Met, Phe, Gln, Tyr, Ile, Val, Glu, Asn, His, Trp, Cys, or Ala
IXMEGDSASEX

SEQ ID NO: 67956 - protein, 9 aa, Artificial Sequence
  Description of Artificial Sequence: Synthetic peptide
  Seed: IAYPSLREA (MAGA4_HUMAN)
  misc_feature (2)..(2): Xaa can be Pro, Ala, Ser, Gln, Thr, Arg, Gly, Val, Ile, Glu, Leu, Met, Asn, Asp, Tyr, Cys, Phe, His, Lys, or Trp
  misc_feature (9)..(9): Xaa can be Tyr, Ile, Leu, Val, Met, Phe, Ala, Trp, His, Cys, Thr, Lys, Arg, Gln, Ser, Pro, Gly, Glu, Asn, or Asp
IXYPSLREX

SEQ ID NO: 67957 - protein, 10 aa, Artificial Sequence
  Description of Artificial Sequence: Synthetic peptide
  Seed: IAYPSLREAA (MAGA4_HUMAN)
  misc_feature (2)..(2): Xaa can be Pro, Ala, Ser, Val, Thr, Ile, Gly, Gln, Met, Cys, Leu, Asn, Phe, Tyr, Glu, Lys, or Asp
  misc_feature (10)..(10): Xaa can be Tyr, Phe, Met, Leu, His, Trp, Ile, Val, Ala, Cys, Glu, Ser, Lys, Thr, Pro, Asn, Gly, Gln, or Arg
IXYPSLREAX

SEQ ID NO: 67958 - protein, 11 aa, Artificial Sequence
  Description of Artificial Sequence: Synthetic peptide
  Seed: IAYPSLREAAL (MAGA4_HUMAN)
  misc_feature (2)..(2): Xaa can be Ala, Ser, Thr, Val, Gly, Pro, Ile, Met, Gln, Leu, Cys, Arg, Asn, Glu, Trp, Phe, His, Lys, Asp, or Tyr
  misc_feature (11)..(11): Xaa can be Leu, Met, Tyr, Phe, Trp, His, Ile, Val, Lys, or Ala
IXYPSLREAAX

SEQ ID NO: 67959 - protein, 9 aa, Artificial Sequence
  Description of Artificial Sequence: Synthetic peptide
  Seed: IDVKEVDPA (MAGA4_HUMAN)
  misc_feature (2)..(2): Xaa can be Glu, or Asp
  misc_feature (9)..(9): Xaa can be Leu, Cys, Pro, Ile, Val, Ala, Met, Gly, Ser, Phe, Thr, or Tyr
IXVKEVDPX

SEQ ID NO: 67960 - protein, 9 aa, Artificial Sequence
  Description of Artificial Sequence: Synthetic peptide
  Seed: IFGIDVKEV (MAGA4_HUMAN)
  misc_feature (2)..(2): Xaa can be Tyr, Phe, Ser, Arg, Ala, Trp, Gln, Met, Ile, Glu, Leu, Val, Gly, His, Asn, Thr, Asp, or Cy s
  misc_feature (9)..(9): Xaa can be Leu, Met, Phe, Ile, Val, Tyr, Trp, or His
IXGIDVKEX

SEQ ID NO: 67961 - protein, 10 aa, Artificial Sequence
  Description of Artificial Sequence: Synthetic peptide
  Seed: IFGKASESLK (MAGA4_HUMAN)
  misc_feature (2)..(2): Xaa can be Phe, Met, Tyr, Trp, Gln, Ile, Leu, Ser, Val, Thr, or Ala
  misc_feature (10)..(10): Xaa can be Arg, or Lys
IXGKASESLX

SEQ ID NO: 67962 - protein, 8 aa, Artificial Sequence
  Description of Artificial Sequence: Synthetic peptide
  Seed: IFPKTGLL (MAGA4_HUMAN)
  misc_feature (2)..(2): Xaa can be Ala, Ser, Phe, Tyr, Thr, Arg, Trp, Ile, His, Gly, Val, Leu, Pro, Met, Asn, Gln, or Cys
  misc_feature (8)..(8): Xaa can be Leu, Met, Ile, Tyr, Phe, or Val
IXPKTGLX

SEQ ID NO: 67963 - protein, 9 aa, Artificial Sequence
  Description of Artificial Sequence: Synthetic peptide
  Seed: IFPKTGLLI (MAGA4_HUMAN)
  misc_feature (2)..(2): Xaa can be Ala, Tyr, Arg, Phe, Ser, Thr, Val, Gln, Ile, Gly, Trp, Leu, Met, Glu, His, Asn, Asp, Pro, Lys, or Cys
  misc_feature (9)..(9): Xaa can be Phe, Leu, Ile, Val, Met, Tyr, Trp, Lys, Cys, Ala, Arg, His, Thr, Gly, or Ser
IXPKTGLLX

SEQ ID NO: 67964 - protein, 10 aa, Artificial Sequence
  Description of Artificial Sequence: Synthetic peptide
  Seed: IFPKTGLLII (MAGA4_HUMAN)
  misc_feature (2)..(2): Xaa can be Tyr, Trp, Phe, Met, Pro, Arg, Ile, His, Val, Leu, Gln, Ser, Ala, Gly, Asp, Thr, Glu, Cys, Asn, or Lys
  misc_feature (10)..(10): Xaa can be Leu, Met, Phe, Ile, Trp, Tyr, Val, Gly, Lys, Gln, Glu, His, Ala, Arg, Asp, Thr, Ser, Cys, Asn, or Pro
IXPKTGLLIX

SEQ ID NO: 67965 - protein, 9 aa, Artificial Sequence
  Description of Artificial Sequence: Synthetic peptide
  Seed: IIVLGTIAM (MAGA4_HUMAN)
  misc_feature (2)..(2): Xaa can be Pro, Ala, Gln, Met, Tyr, Ser, Arg, Leu, Val, Gly, Phe, Thr, Ile, Glu, Lys, Asn, His, Trp, Cys, or Asp
  misc_feature (9)..(9): Xaa can be Met, Leu, Tyr, Phe, Val, Ile, His, Lys, Trp, Arg, Ala, Cys, Thr, Ser, Gly, Pro, Gln, Asn, or Glu
IXVLGTIAX

SEQ ID NO: 67966 - protein, 8 aa, Artificial Sequence
  Description of Artificial Sequence: Synthetic peptide
  Seed: IWEELGVM (MAGA4_HUMAN)
  misc_feature (2)..(2): Xaa can be Tyr, Phe, Trp, or Ala
  misc_feature (8)..(8): Xaa can be Leu, Met, Ile, Phe, or Val
IXEELGVX

SEQ ID NO: 67967 - protein, 11 aa, Artificial Sequence
  Description of Artificial Sequence: Synthetic peptide
  Seed: IWEELGVMGVY (MAGA4_HUMAN)
  misc_feature (2)..(2): Xaa can be Ser, Trp, Asp, Phe, Thr, Cys, Ile, Gly, Leu, Asn, Val, Met, Ala, Gln, or Tyr
  misc_feature (11)..(11): Xaa can be , or Tyr
IXEELGVMGVX

SEQ ID NO: 67968 - protein, 9 aa, Artificial Sequence
  Description of Artificial Sequence: Synthetic peptide
  Seed: KAEMLERVI (MAGA4_HUMAN)
  misc_feature (2)..(2): Xaa can be Ala, Thr, Val, Ser, Ile, Met, Gln, Glu, Arg, Tyr, Gly, Phe, Asn, Leu, Asp, His, Cys, Trp, Pro, or Lys
  misc_feature (9)..(9): Xaa can be Leu, Trp, Phe, Met, Ile, Val, or Tyr
KXEMLERVX

SEQ ID NO: 67969 - protein, 10 aa, Artificial Sequence
  Description of Artificial Sequence: Synthetic peptide
  Seed: KAEMLERVIK (MAGA4_HUMAN)
  misc_feature (2)..(2): Xaa can be Thr, Ser, Val, Ala, Met, Tyr, Gln, Ile, or Phe
  misc_feature (10)..(10): Xaa can be Lys, Ala, Val, or Ile
KXEMLERVIX

SEQ ID NO: 67970 - protein, 8 aa, Artificial Sequence
  Description of Artificial Sequence: Synthetic peptide
  Seed: KASESLKM (MAGA4_HUMAN)
  misc_feature (2)..(2): Xaa can be Val, Ile, Ala, Ser, Thr, Gln, Asn, Leu, Gly, Met, Phe, Cys, or Pro
  misc_feature (8)..(8): Xaa can be Trp, Leu, Tyr, Met, Val, Phe, Ile, Lys, Arg, or His
KXSESLKX

SEQ ID NO: 67971 - protein, 9 aa, Artificial Sequence
  Description of Artificial Sequence: Synthetic peptide
  Seed: KASESLKMI (MAGA4_HUMAN)
  misc_feature (2)..(2): Xaa can be Gln, Leu, Ser, Ala, Met, Thr, Ile, Val, Arg, Tyr, Phe, Asn, Glu, Cys, Gly, Pro, His, Asp, Trp, or Lys
  misc_feature (9)..(9): Xaa can be Leu, Trp, Phe, Tyr, Val, Ile, Met, Ala, Cys, His, or Thr
KXSESLKMX

SEQ ID NO: 67972 - protein, 10 aa, Artificial Sequence
  Description of Artificial Sequence: Synthetic peptide
  Seed: KASESLKMIF (MAGA4_HUMAN)
  misc_feature (2)..(2): Xaa can be Gln, Ala, Thr, Ser, Met, Val, Ile, Leu, Glu, Cys, Gly, Asn, Lys, His, Arg, Phe, Tyr, Pro, Trp, or Asp
  misc_feature (10)..(10): Xaa can be Trp, Phe, Tyr, Met, Leu, Ile, Val, Cys, or His
KXSESLKMIX

SEQ ID NO: 67973 - protein, 9 aa, Artificial Sequence
  Description of Artificial Sequence: Synthetic peptide
  Seed: KELVTKAEM (MAGA4_HUMAN)
  misc_feature (2)..(2): Xaa can be Glu, Gln, Asp, Met, Val, Leu, Ser, Thr, Ala, Ile, Asn, Gly, Arg, Lys, His, Tyr, Phe, Pro, Cys, or Trp
  misc_feature (9)..(9): Xaa can be Tyr, Phe, Leu, Met, Val, Ile, Trp, His, Ala, Cys, Pro, Gly, Arg, Lys, Ser, Thr, Asp, or Gl u
KXLVTKAEX

SEQ ID NO: 67974 - protein, 10 aa, Artificial Sequence
  Description of Artificial Sequence: Synthetic peptide
  Seed: KELVTKAEML (MAGA4_HUMAN)
  misc_feature (2)..(2): Xaa can be Glu, Gln, Asp, Leu, Met, or Ile
  misc_feature (10)..(10): Xaa can be Leu, Phe, Trp, Ile, Tyr, Met, Val, Cys, Pro, Ala, His, Ser, Thr, or Gly
KXLVTKAEMX

SEQ ID NO: 67975 - protein, 9 aa, Artificial Sequence
  Description of Artificial Sequence: Synthetic peptide
  Seed: KEVDPASNT (MAGA4_HUMAN)
  misc_feature (2)..(2): Xaa can be Glu, Asp, or Gln
  misc_feature (9)..(9): Xaa can be Met, Ala, Ile, Val, Phe, Leu, Cys, Tyr, Thr, Pro, Trp, Glu, Asp, Gln, Ser, Arg, or Gly
KXVDPASNX

SEQ ID NO: 67976 - protein, 10 aa, Artificial Sequence
  Description of Artificial Sequence: Synthetic peptide
  Seed: KEVDPASNTY (MAGA4_HUMAN)
  misc_feature (2)..(2): Xaa can be Glu, Ala, Arg, Gln, Asp, Val, Met, Ser, Ile, Leu, Thr, Tyr, Gly, Phe, Asn, Pro, Lys, His, Cys, or Trp
  misc_feature (10)..(10): Xaa can be Ile, Tyr, Phe, Met, Trp, Leu, Val, His, Lys, Arg, Ala, Cys, Gln, Thr, Ser, Gly, Pro, Asn, Glu, or Asp
KXVDPASNTX

SEQ ID NO: 67977 - protein, 11 aa, Artificial Sequence
  Description of Artificial Sequence: Synthetic peptide
  Seed: KEVDPASNTYT (MAGA4_HUMAN)
  misc_feature (2)..(2): Xaa can be Glu, Asp, Gln, Arg, Lys, His, Thr, Val, Ser, Ala, or Asn
  misc_feature (11)..(11): Xaa can be Trp, Tyr, Ile, Cys, Phe, Leu, Val, Met, Ala, Ser, Lys, Thr, Gln, Arg, His, Pro, or Gly
KXVDPASNTYX

SEQ ID NO: 67978 - protein, 8 aa, Artificial Sequence
  Description of Artificial Sequence: Synthetic peptide
  Seed: KLLTQDWV (MAGA4_HUMAN)
  misc_feature (2)..(2): Xaa can be Met, or Leu
  misc_feature (8)..(8): Xaa can be , or Val
KXLTQDWX

SEQ ID NO: 67979 - protein, 8 aa, Artificial Sequence
  Description of Artificial Sequence: Synthetic peptide
  Seed: KMIFGIDV (MAGA4_HUMAN)
  misc_feature (2)..(2): Xaa can be Met, or Leu
  misc_feature (8)..(8): Xaa can be , or Val
KXIFGIDX

SEQ ID NO: 67980 - protein, 9 aa, Artificial Sequence
  Description of Artificial Sequence: Synthetic peptide
  Seed: KMIFGIDVK (MAGA4_HUMAN)
  misc_feature (2)..(2): Xaa can be Met, Leu, Thr, Val, Ile, Gln, Phe, Gly, Ala, Trp, Tyr, Asn, or Ser
  misc_feature (9)..(9): Xaa can be Arg, Lys, Tyr, Val, Leu, His, Met, or Ala
KXIFGIDVX

SEQ ID NO: 67981 - protein, 11 aa, Artificial Sequence
  Description of Artificial Sequence: Synthetic peptide
  Seed: KMIFGIDVKEV (MAGA4_HUMAN)
  misc_feature (2)..(2): Xaa can be Gln, Leu, Met, Phe, Tyr, Val, or Ile
  misc_feature (11)..(11): Xaa can be Val, Leu, Ile, Ala, Phe, Cys, or Met
KXIFGIDVKEX

SEQ ID NO: 67982 - protein, 9 aa, Artificial Sequence
  Description of Artificial Sequence: Synthetic peptide
  Seed: KNYKRCFPV (MAGA4_HUMAN)
  misc_feature (2)..(2): Xaa can be Thr, Tyr, Ser, Val, Ala, Met, Ile, Gln, Leu, Phe, Gly, Trp, Asn, Glu, Asp, Arg, His, Cys, Lys, or Pro
  misc_feature (9)..(9): Xaa can be Lys, Leu, Met, Ile, Val, Ala, Arg, Ser, Tyr, Gly, Phe, Thr, His, Asn, Pro, Gln, Cys, Glu, Asp, or Trp
KXYKRCFPX

SEQ ID NO: 67983 - protein, 10 aa, Artificial Sequence
  Description of Artificial Sequence: Synthetic peptide
  Seed: KNYKRCFPVI (MAGA4_HUMAN)
  misc_feature (2)..(2): Xaa can be Thr, Met, Ser, Ile, Val, Ala, Tyr, Phe, Gln, Leu, Trp, Gly, Asn, Cys, His, Pro, Arg, Glu, Asp, or Lys
  misc_feature (10)..(10): Xaa can be Phe, Lys, Ile, Met, Trp, Leu, Tyr, Ala, Arg, Ser, Val, Thr, Gly, Gln, Pro, His, Cys, Glu, Asn, or Asp
KXYKRCFPVX

SEQ ID NO: 67984 - protein, 11 aa, Artificial Sequence
  Description of Artificial Sequence: Synthetic peptide
  Seed: KNYKRCFPVIF (MAGA4_HUMAN)
  misc_feature (2)..(2): Xaa can be Gln, Met, His, Ala, Glu, Lys, Ile, Gly, Phe, Val, Ser, Arg, Asn, Thr, Leu, Tyr, Asp, Cys, Trp, or Pro
  misc_feature (11)..(11): Xaa can be Tyr, Phe, Met, Leu, Trp, Ile, or His
KXYKRCFPVIX

SEQ ID NO: 67985 - protein, 8 aa, Artificial Sequence
  Description of Artificial Sequence: Synthetic peptide
  Seed: KPEEGVEA (MAGA4_HUMAN)
  misc_feature (2)..(2): Xaa can be , or Pro
  misc_feature (8)..(8): Xaa can be Leu, Val, Ala, or Ile
KXEEGVEX

SEQ ID NO: 67986 - protein, 8 aa, Artificial Sequence
  Description of Artificial Sequence: Synthetic peptide
  Seed: KRCFPVIF (MAGA4_HUMAN)
  misc_feature (2)..(2): Xaa can be Arg, or Tyr
  misc_feature (8)..(8): Xaa can be Phe, Leu, Ile, Tyr, or Met
KXCFPVIX

SEQ ID NO: 67987 - protein, 10 aa, Artificial Sequence
  Description of Artificial Sequence: Synthetic peptide
  Seed: KRCFPVIFGK (MAGA4_HUMAN)
  misc_feature (2)..(2): Xaa can be Arg, Met, Trp, Ile, Val, Phe, Thr, Leu, Ser, Gln, Tyr, Ala, Asn, Glu, His, Gly, Lys, Cys, Pro, or Asp
  misc_feature (10)..(10): Xaa can be Arg, Lys, His, Tyr, Met, Asn, Ser, Thr, Phe, Gly, Ile, Trp, Cys, Gln, Ala, Leu, or Val
KXCFPVIFGX

SEQ ID NO: 67988 - protein, 11 aa, Artificial Sequence
  Description of Artificial Sequence: Synthetic peptide
  Seed: KRCFPVIFGKA (MAGA4_HUMAN)
  misc_feature (2)..(2): Xaa can be , or Arg
  misc_feature (11)..(11): Xaa can be Met, Val, Ala, Ile, Lys, Trp, Leu, Tyr, His, Phe, or Arg
KXCFPVIFGKX

SEQ ID NO: 67989 - protein, 8 aa, Artificial Sequence
  Description of Artificial Sequence: Synthetic peptide
  Seed: KTGLLIIV (MAGA4_HUMAN)
  misc_feature (2)..(2): Xaa can be Ala, Thr, Ser, Ile, or Val
  misc_feature (8)..(8): Xaa can be Leu, Met, Ile, or Val
KXGLLIIX

SEQ ID NO: 67990 - protein, 9 aa, Artificial Sequence
  Description of Artificial Sequence: Synthetic peptide
  Seed: KTGLLIIVL (MAGA4_HUMAN)
  misc_feature (2)..(2): Xaa can be Arg, Leu, Gln, Ala, Ser, Met, Ile, Val, Thr, Gly, Asn, Glu, Cys, His, Lys, Asp, Phe, Tyr, Trp, or Pro
  misc_feature (9)..(9): Xaa can be Trp, Leu, Met, Phe, Ile, Tyr, Val, Ala, His, Cys, Lys, Arg, Thr, or Gln
KXGLLIIVX

SEQ ID NO: 67991 - protein, 8 aa, Artificial Sequence
  Description of Artificial Sequence: Synthetic peptide
  Seed: KVDELAHF (MAGA4_HUMAN)
  misc_feature (2)..(2): Xaa can be Ala, Val, Ser, Thr, Ile, Met, Leu, Tyr, Gly, Gln, Phe, Asn, Asp, Cys, Trp, Pro, His, Arg, Glu, or Lys
  misc_feature (8)..(8): Xaa can be Leu, Met, Phe, Val, Ile, Trp, Tyr, Lys, Arg, His, Cys, or Ala
KXDELAHX

SEQ ID NO: 67992 - protein, 9 aa, Artificial Sequence
  Description of Artificial Sequence: Synthetic peptide
  Seed: KVDELAHFL (MAGA4_HUMAN)
  misc_feature (2)..(2): Xaa can be Thr, Leu, Met, Ile, Ser, Val, Ala, Tyr, Phe, Trp, Gln, Glu, Gly, Cys, Arg, Pro, Asp, Asn, His, or Lys
  misc_feature (9)..(9): Xaa can be Leu, Val, Met, Phe, Tyr, Trp, Arg, Ile, Cys, Lys, His, Ala, Thr, Ser, Gln, Glu, Asn, Pro, or Gly
KXDELAHFX

SEQ ID NO: 67993 - protein, 10 aa, Artificial Sequence
  Description of Artificial Sequence: Synthetic peptide
  Seed: KVDELAHFLL (MAGA4_HUMAN)
  misc_feature (2)..(2): Xaa can be Leu, Met, Ile, Thr, Gln, Ala, Val, Ser, Phe, Cys, Gly, Tyr, Trp, Asn, Glu, Arg, Pro, Asp, His, or Lys
  misc_feature (10)..(10): Xaa can be Leu, Tyr, Trp, Met, Phe, Lys, Val, Ile, Arg, His, Cys, Gln, Ala, Thr, Asn, Glu, Gly, Ser, Pro, or Asp
KXDELAHFLX

SEQ ID NO: 67994 - protein, 11 aa, Artificial Sequence
  Description of Artificial Sequence: Synthetic peptide
  Seed: KVDELAHFLLR (MAGA4_HUMAN)
  misc_feature (2)..(2): Xaa can be Thr, Ser, Ala, Val, Met, Ile, Leu, Gln, Gly, Asn, Phe, Cys, Tyr, Trp, Asp, Glu, His, Pro, or Arg
  misc_feature (11)..(11): Xaa can be Tyr, Arg, Lys, His, Phe, Trp, Met, Gln, or Leu
KXDELAHFLLX

SEQ ID NO: 67995 - protein, 8 aa, Artificial Sequence
  Description of Artificial Sequence: Synthetic peptide
  Seed: KVLEHVVR (MAGA4_HUMAN)
  misc_feature (2)..(2): Xaa can be Met, Trp, Ser, Gln, Phe, Tyr, Thr, Leu, Val, or Ile
  misc_feature (8)..(8): Xaa can be , or Arg
KXLEHVVX

SEQ ID NO: 67996 - protein, 9 aa, Artificial Sequence
  Description of Artificial Sequence: Synthetic peptide
  Seed: KVLEHVVRV (MAGA4_HUMAN)
  misc_feature (2)..(2): Xaa can be Met, Arg, Leu, Gln, Thr, Ile, Ser, Ala, Val, Glu, Gly, Tyr, His, Asn, Phe, Lys, Trp, Pro, Cys, or Asp
  misc_feature (9)..(9): Xaa can be Met, Phe, Trp, Tyr, Ile, Arg, Lys, Leu, Val, His, Cys, Ala, Thr, Gln, Ser, Gly, Pro, Glu, or Asn
KXLEHVVRX

SEQ ID NO: 67997 - protein, 10 aa, Artificial Sequence
  Description of Artificial Sequence: Synthetic peptide
  Seed: KVLEHVVRVN (MAGA4_HUMAN)
  misc_feature (2)..(2): Xaa can be Gln, Ile, Val, Leu, Met, Thr, Phe, Trp, Ala, Ser, or Tyr
  misc_feature (10)..(10): Xaa can be Val, Ile, Leu, Phe, Glu, Gly, Thr, Ser, Gln, Cys, Asn, Asp, Arg, His, Ala, Tyr, Pro, Trp, Met, or Lys
KXLEHVVRVX

SEQ ID NO: 67998 - protein, 11 aa, Artificial Sequence
  Description of Artificial Sequence: Synthetic peptide
  Seed: KVLEHVVRVNA (MAGA4_HUMAN)
  misc_feature (2)..(2): Xaa can be Thr, Val, Ser, Ile, Ala, Met, Tyr, Phe, Gln, or Leu
  misc_feature (11)..(11): Xaa can be Lys, Ala, Ile, or Val
KXLEHVVRVNX

SEQ ID NO: 67999 - protein, 9 aa, Artificial Sequence
  Description of Artificial Sequence: Synthetic peptide
  Seed: KYRAKELVT (MAGA4_HUMAN)
  misc_feature (2)..(2): Xaa can be Thr, Tyr, Met, Val, Phe, Ser, Ile, Ala, Leu, Trp, Gly, Gln, Asn, Cys, Lys, or His
  misc_feature (9)..(9): Xaa can be Lys, Met, Tyr, Val, Ile, Ser, Leu, Ala, Arg, Gly, Thr, Asn, Phe, Gln, His, Cys, Pro, Glu, Trp, or Asp
KXRAKELVX

SEQ ID NO: 68000 - protein, 10 aa, Artificial Sequence
  Description of Artificial Sequence: Synthetic peptide
  Seed: KYRAKELVTK (MAGA4_HUMAN)
  misc_feature (2)..(2): Xaa can be Thr, Ser, Tyr, Val, Met, Phe, Ala, Ile, Leu, Trp, Gly, Gln, Asn, Cys, Lys, or His
  misc_feature (10)..(10): Xaa can be Lys, Arg, Ala, Val, Met, Ile, Leu, Ser, Tyr, Gly, Phe, Thr, Cys, Gln, Pro, Asn, His, or Gl u
KXRAKELVTX

SEQ ID NO: 68001 - protein, 11 aa, Artificial Sequence
  Description of Artificial Sequence: Synthetic peptide
  Seed: KYRAKELVTKA (MAGA4_HUMAN)
  misc_feature (2)..(2): Xaa can be Ser, Val, Thr, Tyr, Met, Ala, Phe, Ile, Trp, Asn, Gln, Leu, or Gly
  misc_feature (11)..(11): Xaa can be Lys, Ala, Val, Ile, Leu, Met, Tyr, Arg, Phe, Ser, Pro, Gly, His, Cys, Thr, Glu, Gln, Asp, Asn, or Trp
KXRAKELVTKX

SEQ ID NO: 68002 - protein, 9 aa, Artificial Sequence
  Description of Artificial Sequence: Synthetic peptide
  Seed: LAHFLLRKY (MAGA4_HUMAN)
  misc_feature (2)..(2): Xaa can be Ala, Ser, Pro, Thr, Val, Gln, Gly, Met, Leu, Ile, Lys, His, Glu, Phe, Tyr, Asn, Arg, Asp, Trp, or Cys
  misc_feature (9)..(9): Xaa can be Trp, Tyr, Phe, Met, Leu, Ile, Val, His, Ala, or Cys
LXHFLLRKX

SEQ ID NO: 68003 - protein, 10 aa, Artificial Sequence
  Description of Artificial Sequence: Synthetic peptide
  Seed: LAHFLLRKYR (MAGA4_HUMAN)
  misc_feature (2)..(2): Xaa can be Thr, Gly, Leu, Met, Phe, Trp, Val, Ile, Asn, Gln, Ser, Ala, Tyr, Asp, His, Glu, Cys, Arg, Pro, or Lys
  misc_feature (10)..(10): Xaa can be Arg, or Lys
LXHFLLRKYX

SEQ ID NO: 68004 - protein, 9 aa, Artificial Sequence
  Description of Artificial Sequence: Synthetic peptide
  Seed: LEEVPAAES (MAGA4_HUMAN)
  misc_feature (2)..(2): Xaa can be Glu, Asp, or Gln
  misc_feature (9)..(9): Xaa can be Ala, Cys, Ile, Leu, Met, Val, Pro, Phe, Tyr, Glu, Gly, Trp, Asp, Thr, or Ser
LXEVPAAEX

SEQ ID NO: 68005 - protein, 10 aa, Artificial Sequence
  Description of Artificial Sequence: Synthetic peptide
  Seed: LEEVPAAESA (MAGA4_HUMAN)
  misc_feature (2)..(2): Xaa can be Glu, Asp, Gln, Leu, Val, Lys, Asn, Met, Phe, Gly, Arg, Cys, Trp, Ala, His, Ile, Pro, Ser, Tyr, or Thr
  misc_feature (10)..(10): Xaa can be Ala, Leu, Met, Val, Tyr, Ser, Trp, Gly, Thr, Cys, Phe, Ile, or Pro
LXEVPAAESX

SEQ ID NO: 68006 - protein, 11 aa, Artificial Sequence
  Description of Artificial Sequence: Synthetic peptide
  Seed: LEEVPAAESAG (MAGA4_HUMAN)
  misc_feature (2)..(2): Xaa can be , or Glu
  misc_feature (11)..(11): Xaa can be Ser, Pro, Met, Ile, Cys, Trp, Val, Thr, Tyr, Leu, Ala, Phe, or Gly
LXEVPAAESAX

SEQ ID NO: 68007 - protein, 9 aa, Artificial Sequence
  Description of Artificial Sequence: Synthetic peptide
  Seed: LEHVVRVNA (MAGA4_HUMAN)
  misc_feature (2)..(2): Xaa can be Glu, His, Asp, Gln, Arg, or Pro
  misc_feature (9)..(9): Xaa can be Val, Ala, Leu, Ile, Cys, Met, Phe, Tyr, Pro, Thr, Trp, Gly, Ser, or His
LXHVVRVNX

SEQ ID NO: 68008 - protein, 8 aa, Artificial Sequence
  Description of Artificial Sequence: Synthetic peptide
  Seed: LERVIKNY (MAGA4_HUMAN)
  misc_feature (2)..(2): Xaa can be Glu, Gln, Met, Arg, Lys, Val, Asp, Ala, Leu, Ile, Ser, or Pro
  misc_feature (8)..(8): Xaa can be Tyr, Phe, Met, Trp, Leu, Val, or Ile
LXRVIKNX

SEQ ID NO: 68009 - protein, 11 aa, Artificial Sequence
  Description of Artificial Sequence: Synthetic peptide
  Seed: LEYRQVPGSNP (MAGA4_HUMAN)
  misc_feature (2)..(2): Xaa can be , or Glu
  misc_feature (11)..(11): Xaa can be Thr, Cys, Pro, Phe, Leu, Ala, Val, Met, or Ile
LXYRQVPGSNX

SEQ ID NO: 68010 - protein, 9 aa, Artificial Sequence
  Description of Artificial Sequence: Synthetic peptide
  Seed: LFREALSNK (MAGA4_HUMAN)
  misc_feature (2)..(2): Xaa can be Thr, Met, Val, Ser, Tyr, Leu, Ala, Ile, Phe, Trp, Gln, Gly, Asn, Pro, Cys, Glu, Asp, His, or Arg
  misc_feature (9)..(9): Xaa can be Lys, Arg, Ala, Val, Ile, Leu, Met, Tyr, Gly, Ser, Phe, His, Thr, Cys, or Pro
LXREALSNX

SEQ ID NO: 68011 - protein, 9 aa, Artificial Sequence
  Description of Artificial Sequence: Synthetic peptide
  Seed: LGNNQIFPK (MAGA4_HUMAN)
  misc_feature (2)..(2): Xaa can be Ser, Thr, Met, Leu, Ala, Val, Ile, Tyr, Phe, Cys, Gly, Trp, Gln, Asn, Glu, Asp, Pro, His, Arg, or Lys
  misc_feature (9)..(9): Xaa can be Arg, Lys, Tyr, Met, Phe, Leu, His, Val, Ile, Ala, or Trp
LXNNQIFPX

SEQ ID NO: 68012 - protein, 10 aa, Artificial Sequence
  Description of Artificial Sequence: Synthetic peptide
  Seed: LGVMGVYDGR (MAGA4_HUMAN)
  misc_feature (2)..(2): Xaa can be Ser, Ala, Phe, Tyr, Glu, Thr, Met, Asn, Arg, Asp, Ile, Lys, Pro, Trp, Gln, Cys, Leu, Gly, Val, or His
  misc_feature (10)..(10): Xaa can be Lys, Arg, or Tyr
LXVMGVYDGX

SEQ ID NO: 68013 - protein, 10 aa, Artificial Sequence
  Description of Artificial Sequence: Synthetic peptide
  Seed: LIIVLGTIAM (MAGA4_HUMAN)
  misc_feature (2)..(2): Xaa can be Gln, Met, Leu, Lys, Ile, Pro, Asn, Val, Phe, Tyr, Gly, Trp, Ala, Thr, His, Ser, Arg, Glu, Cys, or Asp
  misc_feature (10)..(10): Xaa can be Tyr, Phe, Met, Leu, Ile, Trp, His, or Val
LXIVLGTIAX

SEQ ID NO: 68014 - protein, 9 aa, Artificial Sequence
  Description of Artificial Sequence: Synthetic peptide
  Seed: LKMIFGIDV (MAGA4_HUMAN)
  misc_feature (2)..(2): Xaa can be Gln, Lys, Met, Ala, Arg, His, Glu, Ser, Leu, Val, Asn, Thr, Ile, or Gly
  misc_feature (9)..(9): Xaa can be Tyr, Phe, Met, Leu, Ile, Val, Trp, His, or Ala
LXMIFGIDX

SEQ ID NO: 68015 - protein, 10 aa, Artificial Sequence
  Description of Artificial Sequence: Synthetic peptide
  Seed: LKMIFGIDVK (MAGA4_HUMAN)
  misc_feature (2)..(2): Xaa can be Tyr, Gly, Asn, Ile, Phe, His, Arg, Leu, Pro, Ala, Thr, Met, Cys, Trp, Asp, Lys, Val, Gln, or Ser
  misc_feature (10)..(10): Xaa can be , or Lys
LXMIFGIDVX

SEQ ID NO: 68016 - protein, 10 aa, Artificial Sequence
  Description of Artificial Sequence: Synthetic peptide
  Seed: LLGNNQIFPK (MAGA4_HUMAN)
  misc_feature (2)..(2): Xaa can be Met, Thr, Asn, Glu, Pro, Asp, Gly, Cys, Arg, Leu, Trp, His, Lys, Tyr, Phe, Val, Gln, Ile, Ala, or Ser
  misc_feature (10)..(10): Xaa can be Arg, Lys, or Tyr
LXGNNQIFPX

SEQ ID NO: 68017 - protein, 9 aa, Artificial Sequence
  Description of Artificial Sequence: Synthetic peptide
  Seed: LLIIVLGTI (MAGA4_HUMAN)
  misc_feature (2)..(2): Xaa can be Leu, Met, Gln, Glu, Ile, Thr, Ala, Val, Asp, Gly, Ser, Asn, His, or Pro
  misc_feature (9)..(9): Xaa can be Val, Leu, Ile, Met, Ala, Phe, Trp, Thr, Ser, Tyr, or Cys
LXIIVLGTX

SEQ ID NO: 68018 - protein, 10 aa, Artificial Sequence
  Description of Artificial Sequence: Synthetic peptide
  Seed: LLIIVLGTIA (MAGA4_HUMAN)
  misc_feature (2)..(2): Xaa can be Leu, Met, Val, Ile, Thr, or Gln
  misc_feature (10)..(10): Xaa can be Val, Ala, Thr, Ile, or Leu
LXIIVLGTIX

SEQ ID NO: 68019 - protein, 10 aa, Artificial Sequence
  Description of Artificial Sequence: Synthetic peptide
  Seed: LLRKYRAKEL (MAGA4_HUMAN)
  misc_feature (2)..(2): Xaa can be Met, Leu, Pro, Ile, Ala, Phe, Gln, or Val
  misc_feature (10)..(10): Xaa can be Leu, Met, Phe, Ile, or Val
LXRKYRAKEX

SEQ ID NO: 68020 - protein, 11 aa, Artificial Sequence
  Description of Artificial Sequence: Synthetic peptide
  Seed: LLTQDWVQENY (MAGA4_HUMAN)
  misc_feature (2)..(2): Xaa can be Thr, Ile, Ala, Ser, Val, Leu, or Met
  misc_feature (11)..(11): Xaa can be Tyr, or Lys
LXTQDWVQENX

SEQ ID NO: 68021 - protein, 9 aa, Artificial Sequence
  Description of Artificial Sequence: Synthetic peptide
  Seed: LPTTISFTC (MAGA4_HUMAN)
  misc_feature (2)..(2): Xaa can be Pro, Ala, Val, Met, Ile, Gln, Gly, Leu, Thr, Ser, Cys, Phe, Asn, Tyr, or His
  misc_feature (9)..(9): Xaa can be Tyr, Phe, Met, Trp, Leu, Ala, Ile, Val, His, Cys, Asp, Thr, Pro, Ser, Gln, Glu, Asn, Arg, or Gly
LXTTISFTX

SEQ ID NO: 68022 - protein, 10 aa, Artificial Sequence
  Description of Artificial Sequence: Synthetic peptide
  Seed: LPTTISFTCW (MAGA4_HUMAN)
  misc_feature (2)..(2): Xaa can be Pro, Ser, Ala, Thr, Ile, Glu, Leu, Arg, Lys, Tyr, Phe, Asp, Cys, Gly, Gln, Asn, Met, Val, Trp, or His
  misc_feature (10)..(10): Xaa can be Tyr, Trp, Phe, Leu, Ile, Met, Val, His, or Gly
LXTTISFTCX

SEQ ID NO: 68023 - protein, 11 aa, Artificial Sequence
  Description of Artificial Sequence: Synthetic peptide
  Seed: LPTTISFTCWR (MAGA4_HUMAN)
  misc_feature (2)..(2): Xaa can be Pro, Ala, Ser, Asn, Asp, Tyr, His, Gln, Glu, Cys, Arg, Ile, Phe, Thr, Val, Leu, Met, Trp, Lys, or Gly
  misc_feature (11)..(11): Xaa can be Lys, Arg, Trp, Leu, Asn, Ala, Val, Gln, Glu, Phe, Gly, Met, Ile, His, Tyr, Pro, Ser, Thr, Asp, or Cys
LXTTISFTCWX

SEQ ID NO: 68024 - protein, 9 aa, Artificial Sequence
  Description of Artificial Sequence: Synthetic peptide
  Seed: LRKYRAKEL (MAGA4_HUMAN)
  misc_feature (2)..(2): Xaa can be Arg, Met, Leu, Pro, Ile, Ala, Gln, His, Val, Phe, Gly, Asn, Tyr, Ser, Glu, Thr, Asp, Cys, Lys, or Trp
  misc_feature (9)..(9): Xaa can be Leu, Met, Ile, Val, Phe, Ala, Tyr, Cys, Thr, Lys, or Arg
LXKYRAKEX

SEQ ID NO: 68025 - protein, 10 aa, Artificial Sequence
  Description of Artificial Sequence: Synthetic peptide
  Seed: LRKYRAKELV (MAGA4_HUMAN)
  misc_feature (2)..(2): Xaa can be , or Arg
  misc_feature (10)..(10): Xaa can be Met, Leu, Val, Phe, or Ile
LXKYRAKELX

SEQ ID NO: 68026 - protein, 8 aa, Artificial Sequence
  Description of Artificial Sequence: Synthetic peptide
  Seed: LSNKVDEL (MAGA4_HUMAN)
  misc_feature (2)..(2): Xaa can be Ala, Ser, Thr, Val, Ile, Gly, Phe, Gln, Leu, Met, Tyr, Asn, Arg, His, Asp, Trp, Glu, or Cy s
  misc_feature (8)..(8): Xaa can be Leu, Trp, Lys, Met, Tyr, Arg, Phe, Val, Ile, or His
LXNKVDEX

SEQ ID NO: 68027 - protein, 11 aa, Artificial Sequence
  Description of Artificial Sequence: Synthetic peptide
  Seed: LSNKVDELAHF (MAGA4_HUMAN)
  misc_feature (2)..(2): Xaa can be Ala, Ser, Thr, Gly, Val, Ile, Cys, Gln, Met, Phe, Glu, Asn, Trp, Lys, Leu, Asp, Tyr, or Pr o
  misc_feature (11)..(11): Xaa can be Trp, Tyr, Phe, Lys, Met, Leu, Ile, Arg, or His
LXNKVDELAHX

SEQ ID NO: 68028 - protein, 10 aa, Artificial Sequence
  Description of Artificial Sequence: Synthetic peptide
  Seed: LTQDWVQENY (MAGA4_HUMAN)
  misc_feature (2)..(2): Xaa can be Ser, Thr, Ala, Val, Leu, Met, Gln, Phe, Gly, Asn, Ile, Tyr, Trp, Cys, Glu, Pro, Asp, Lys, Arg, or His
  misc_feature (10)..(10): Xaa can be Tyr, Trp, Phe, Lys, Arg, Met, Leu, His, or Ile
LXQDWVQENX

SEQ ID NO: 68029 - protein, 11 aa, Artificial Sequence
  Description of Artificial Sequence: Synthetic peptide
  Seed: LTQDWVQENYL (MAGA4_HUMAN)
  misc_feature (2)..(2): Xaa can be Thr, Ala, Ser, Gly, Cys, Val, Asp, Phe, Met, Trp, Pro, Leu, Asn, Ile, or Gln
  misc_feature (11)..(11): Xaa can be Trp, Phe, Met, Leu, Tyr, or Ile
LXQDWVQENYX

SEQ ID NO: 68030 - protein, 9 aa, Artificial Sequence
  Description of Artificial Sequence: Synthetic peptide
  Seed: LVPGTLEEV (MAGA4_HUMAN)
  misc_feature (2)..(2): Xaa can be Ala, Leu, Ile, Tyr, Met, Val, Gly, Pro, Phe, Arg, Ser, Thr, Gln, Asn, Glu, Trp, Asp, Cys, His, or Lys
  misc_feature (9)..(9): Xaa can be Leu, Ile, Val, Phe, Tyr, Met, Arg, Lys, Trp, His, Ala, Cys, Thr, Ser, Gln, or Pro
LXPGTLEEX

SEQ ID NO: 68031 - protein, 10 aa, Artificial Sequence
  Description of Artificial Sequence: Synthetic peptide
  Seed: LVTKAEMLER (MAGA4_HUMAN)
  misc_feature (2)..(2): Xaa can be Ile, Phe, Tyr, Thr, Val, Ser, Leu, Ala, Met, Gly, Cys, Arg, Asn, Asp, Pro, His, Lys, Glu, Gln, or Trp
  misc_feature (10)..(10): Xaa can be Arg, or Lys
LXTKAEMLEX

SEQ ID NO: 68032 - protein, 11 aa, Artificial Sequence
  Description of Artificial Sequence: Synthetic peptide
  Seed: LVTKAEMLERV (MAGA4_HUMAN)
  misc_feature (2)..(2): Xaa can be Gln, Leu, Met, or Val
  misc_feature (11)..(11): Xaa can be Val, or Leu
LXTKAEMLERX

SEQ ID NO: 68033 - protein, 11 aa, Artificial Sequence
  Description of Artificial Sequence: Synthetic peptide
  Seed: MEGDSASEEEI (MAGA4_HUMAN)
  misc_feature (2)..(2): Xaa can be Glu, Gln, Leu, Met, Ile, Val, Asp, Ala, Thr, Ser, Arg, His, Asn, Gly, or Lys
  misc_feature (11)..(11): Xaa can be Trp, Phe, Leu, Ile, Met, Val, Tyr, Cys, Gly, Pro, Thr, Ala, Lys, or Ser
MXGDSASEEEX

SEQ ID NO: 68034 - protein, 9 aa, Artificial Sequence
  Description of Artificial Sequence: Synthetic peptide
  Seed: MGVYDGREH (MAGA4_HUMAN)
  misc_feature (2)..(2): Xaa can be Ala, Ser, Val, Thr, Gln, Gly, Ile, Met, Leu, Cys, Asn, Glu, Asp, Pro, or Phe
  misc_feature (9)..(9): Xaa can be Tyr, Phe, Met, Leu, His, Val, Ile, Ala, Thr, Trp, Cys, Arg, or Lys
MXVYDGREX

SEQ ID NO: 68035 - protein, 8 aa, Artificial Sequence
  Description of Artificial Sequence: Synthetic peptide
  Seed: MIFGIDVK (MAGA4_HUMAN)
  misc_feature (2)..(2): Xaa can be Ala, Ser, Ile, Val, Thr, Leu, Met, or Gly
  misc_feature (8)..(8): Xaa can be Arg, Lys, Leu, or Met
MXFGIDVX

SEQ ID NO: 68036 - protein, 10 aa, Artificial Sequence
  Description of Artificial Sequence: Synthetic peptide
  Seed: MIFGIDVKEV (MAGA4_HUMAN)
  misc_feature (2)..(2): Xaa can be Met, Leu, Gln, Thr, Val, Ala, Ser, Ile, Glu, Phe, Gly, Pro, or Asn
  misc_feature (10)..(10): Xaa can be Val, Leu, Ile, Met, Ala, Thr, Phe, Ser, Cys, Gly, Trp, Tyr, or Pro
MXFGIDVKEX

SEQ ID NO: 68037 - protein, 9 aa, Artificial Sequence
  Description of Artificial Sequence: Synthetic peptide
  Seed: MLERVIKNY (MAGA4_HUMAN)
  misc_feature (2)..(2): Xaa can be Ser, Thr, Ala, Val, Gln, Met, Ile, Leu, Phe, Gly, Tyr, Asp, Glu, Lys, Pro, Arg, Trp, Asn, His, or Cys
  misc_feature (9)..(9): Xaa can be Tyr, Phe, Met, Lys, Leu, Arg, Ile, Trp, Val, or His
MXERVIKNX

SEQ ID NO: 68038 - protein, 10 aa, Artificial Sequence
  Description of Artificial Sequence: Synthetic peptide
  Seed: MLERVIKNYK (MAGA4_HUMAN)
  misc_feature (2)..(2): Xaa can be Thr, Ser, Val, Met, Ile, Tyr, Ala, Phe, Gln, Trp, Gly, Asn, Leu, His, Cys, Arg, or Pro
  misc_feature (10)..(10): Xaa can be Arg, Lys, Ala, Val, Ile, Met, Leu, Tyr, Ser, Thr, Gly, or Phe
MXERVIKNYX

SEQ ID NO: 68039 - protein, 11 aa, Artificial Sequence
  Description of Artificial Sequence: Synthetic peptide
  Seed: MLERVIKNYKR (MAGA4_HUMAN)
  misc_feature (2)..(2): Xaa can be Tyr, Phe, Leu, Ile, Trp, Gln, Thr, Ser, Met, or Val
  misc_feature (11)..(11): Xaa can be Arg, or Lys
MXERVIKNYKX

SEQ ID NO: 68040 - protein, 9 aa, Artificial Sequence
  Description of Artificial Sequence: Synthetic peptide
  Seed: MSSEQKSQH (MAGA4_HUMAN)
  misc_feature (2)..(2): Xaa can be Ala, Val, Ile, Ser, Thr, Gln, Leu, Met, Gly, Asn, Cys, Glu, Phe, Pro, Asp, Tyr, Trp, or Ly s
  misc_feature (9)..(9): Xaa can be Tyr, Phe, Met, Leu, Lys, His, Ile, Arg, Trp, Val, Ala, or Cys
MXSEQKSQX

SEQ ID NO: 68041 - protein, 11 aa, Artificial Sequence
  Description of Artificial Sequence: Synthetic peptide
  Seed: MSSEQKSQHCK (MAGA4_HUMAN)
  misc_feature (2)..(2): Xaa can be Ala, Thr, Ser, Val, Ile, Gly, Met, Leu, Gln, Asn, Asp, Phe, Cys, or Glu
  misc_feature (11)..(11): Xaa can be Tyr, Lys, Arg, Phe, Leu, Met, His, Ile, or Trp
MXSEQKSQHCX

SEQ ID NO: 68042 - protein, 8 aa, Artificial Sequence
  Description of Artificial Sequence: Synthetic peptide
  Seed: NARVRIAY (MAGA4_HUMAN)
  misc_feature (2)..(2): Xaa can be Ala, Ser, Thr, Gln, Met, Leu, or Glu
  misc_feature (8)..(8): Xaa can be Tyr, Phe, Met, Leu, Ile, or Val
NXRVRIAX

SEQ ID NO: 68043 - protein, 11 aa, Artificial Sequence
  Description of Artificial Sequence: Synthetic peptide
  Seed: NARVRIAYPSL (MAGA4_HUMAN)
  misc_feature (2)..(2): Xaa can be Met, Pro, Arg, Leu, Ile, Gln, Ala, Val, Tyr, Asn, Ser, Gly, Phe, Trp, Lys, or His
  misc_feature (11)..(11): Xaa can be Leu, Met, Ile, Phe, Val, or Ala
NXRVRIAYPSX

SEQ ID NO: 68044 - protein, 9 aa, Artificial Sequence
  Description of Artificial Sequence: Synthetic peptide
  Seed: NKVDELAHF (MAGA4_HUMAN)
  misc_feature (2)..(2): Xaa can be Arg, His, Gln, Tyr, Met, Ala, Glu, Phe, Val, Leu, Lys, Ile, Trp, Gly, Thr, Pro, Asn, Ser, Asp, or Cys
  misc_feature (9)..(9): Xaa can be Phe, Tyr, Met, Leu, Ile, Trp, Val, His, Lys, Ala, Cys, Arg, or Thr
NXVDELAHX

SEQ ID NO: 68045 - protein, 10 aa, Artificial Sequence
  Description of Artificial Sequence: Synthetic peptide
  Seed: NKVDELAHFL (MAGA4_HUMAN)
  misc_feature (2)..(2): Xaa can be His, Arg, Gln, Leu, Met, Lys, Phe, Tyr, Trp, Ile, Val, Glu, Thr, Ala, Asn, Pro, Ser, Gly, Asp, or Cys
  misc_feature (10)..(10): Xaa can be Val, Leu, Ile, Met, Phe, Ala, Trp, Cys, Thr, or Tyr
NXVDELAHFX

SEQ ID NO: 68046 - protein, 8 aa, Artificial Sequence
  Description of Artificial Sequence: Synthetic peptide
  Seed: NPARYEFL (MAGA4_HUMAN)
  misc_feature (2)..(2): Xaa can be , or Pro
  misc_feature (8)..(8): Xaa can be Val, Leu, or Ile
NXARYEFX

SEQ ID NO: 68047 - protein, 9 aa, Artificial Sequence
  Description of Artificial Sequence: Synthetic peptide
  Seed: NPARYEFLW (MAGA4_HUMAN)
  misc_feature (2)..(2): Xaa can be Pro, Thr, Ala, Ser, Ile, Val, Leu, Met, Gly, Cys, Gln, Tyr, Asp, Glu, Trp, Phe, or Asn
  misc_feature (9)..(9): Xaa can be Trp, Phe, Tyr, Leu, Met, Ile, or His
NXARYEFLX

SEQ ID NO: 68048 - protein, 9 aa, Artificial Sequence
  Description of Artificial Sequence: Synthetic peptide
  Seed: NQIFPKTGL (MAGA4_HUMAN)
  misc_feature (2)..(2): Xaa can be Arg, His, Gln, Glu, Met, Asp, Leu, Pro, Ser, Ala, Lys, Tyr, Phe, Ile, Val, Asn, Gly, Thr, Trp, or Cys
  misc_feature (9)..(9): Xaa can be Tyr, Phe, Met, Leu, Val, Ile, Ala, Trp, Thr, Cys, Pro, Ser, His, Gly, Lys, or Arg
NXIFPKTGX

SEQ ID NO: 68049 - protein, 10 aa, Artificial Sequence
  Description of Artificial Sequence: Synthetic peptide
  Seed: NQIFPKTGLL (MAGA4_HUMAN)
  misc_feature (2)..(2): Xaa can be His, Gln, or Met
  misc_feature (10)..(10): Xaa can be Trp, Leu, Val, Phe, Ile, Met, Cys, or Tyr
NXIFPKTGLX

SEQ ID NO: 68050 - protein, 11 aa, Artificial Sequence
  Description of Artificial Sequence: Synthetic peptide
  Seed: NQIFPKTGLLI (MAGA4_HUMAN)
  misc_feature (2)..(2): Xaa can be Gln, Leu, or Met
  misc_feature (11)..(11): Xaa can be Trp, Phe, Leu, Met, Val, or Ile
NXIFPKTGLLX

SEQ ID NO: 68051 - protein, 9 aa, Artificial Sequence
  Description of Artificial Sequence: Synthetic peptide
  Seed: NTYTLVTCL (MAGA4_HUMAN)
  misc_feature (2)..(2): Xaa can be Met, Gln, Leu, Thr, Ala, Val, Ser, Ile, Gly, Pro, Asp, Asn, Phe, Glu, Arg, His, Tyr, Cys, Lys, or Trp
  misc_feature (9)..(9): Xaa can be Tyr, Phe, Val, Met, Leu, Ile, Trp, Arg, Lys, His, Ala, Thr, or Cys
NXYTLVTCX

SEQ ID NO: 68052 - protein, 9 aa, Artificial Sequence
  Description of Artificial Sequence: Synthetic peptide
  Seed: NYKRCFPVI (MAGA4_HUMAN)
  misc_feature (2)..(2): Xaa can be Tyr, Phe, Trp, Met, Leu, or Ala
  misc_feature (9)..(9): Xaa can be Met, Phe, Leu, Tyr, Ile, Trp, or Val
NXKRCFPVX

SEQ ID NO: 68053 - protein, 10 aa, Artificial Sequence
  Description of Artificial Sequence: Synthetic peptide
  Seed: NYKRCFPVIF (MAGA4_HUMAN)
  misc_feature (2)..(2): Xaa can be Tyr, Gln, Met, Trp, Phe, Ile, Glu, Lys, Arg, Val, Ser, Ala, His, Leu, Thr, Pro, Cys, Asn, Gly, or Asp
  misc_feature (10)..(10): Xaa can be Tyr, Phe, Met, Leu, Trp, or Ile
NXKRCFPVIX

SEQ ID NO: 68054 - protein, 8 aa, Artificial Sequence
  Description of Artificial Sequence: Synthetic peptide
  Seed: PASNTYTL (MAGA4_HUMAN)
  misc_feature (2)..(2): Xaa can be Met, Ala, Trp, Tyr, Ile, or Phe
  misc_feature (8)..(8): Xaa can be Leu, or Met
PXSNTYTX

SEQ ID NO: 68055 - protein, 9 aa, Artificial Sequence
  Description of Artificial Sequence: Synthetic peptide
  Seed: PASNTYTLV (MAGA4_HUMAN)
  misc_feature (2)..(2): Xaa can be , or Ala
  misc_feature (9)..(9): Xaa can be Ile, or Val
PXSNTYTLX

SEQ ID NO: 68056 - protein, 11 aa, Artificial Sequence
  Description of Artificial Sequence: Synthetic peptide
  Seed: PEEGVEAQEEA (MAGA4_HUMAN)
  misc_feature (2)..(2): Xaa can be , or Glu
  misc_feature (11)..(11): Xaa can be Leu, Met, Ala, Val, or Ile
PXEGVEAQEEX

SEQ ID NO: 68057 - protein, 10 aa, Artificial Sequence
  Description of Artificial Sequence: Synthetic peptide
  Seed: PLVPGTLEEV (MAGA4_HUMAN)
  misc_feature (2)..(2): Xaa can be Met, Leu, Val, Phe, or Ile
  misc_feature (10)..(10): Xaa can be Val, Ile, or Leu
PXVPGTLEEX

SEQ ID NO: 68058 - protein, 11 aa, Artificial Sequence
  Description of Artificial Sequence: Synthetic peptide
  Seed: PPQSPQGASAL (MAGA4_HUMAN)
  misc_feature (2)..(2): Xaa can be Pro, Ala, or Val
  misc_feature (11)..(11): Xaa can be Leu, Met, Ala, Thr, Val, Phe, Ile, Pro, or Cys
PXQSPQGASAX

SEQ ID NO: 68059 - protein, 11 aa, Artificial Sequence
  Description of Artificial Sequence: Synthetic peptide
  Seed: PSTSPDAESLF (MAGA4_HUMAN)
  misc_feature (2)..(2): Xaa can be Ser, Thr, Met, Gly, Cys, Ala, Ile, Leu, or Val
  misc_feature (11)..(11): Xaa can be Trp, or Phe
PXTSPDAESLX

SEQ ID NO: 68060 - protein, 9 aa, Artificial Sequence
  Description of Artificial Sequence: Synthetic peptide
  Seed: PTTISFTCW (MAGA4_HUMAN)
  misc_feature (2)..(2): Xaa can be Ser, Thr, Asn, Val, Met, Gly, Ile, Ala, or Cys
  misc_feature (9)..(9): Xaa can be Trp, or Phe
PXTISFTCX

SEQ ID NO: 68061 - protein, 10 aa, Artificial Sequence
  Description of Artificial Sequence: Synthetic peptide
  Seed: PTTISFTCWR (MAGA4_HUMAN)
  misc_feature (2)..(2): Xaa can be Met, Pro, Ser, Tyr, Thr, Lys, Phe, Cys, Leu, Glu, Trp, Gly, Gln, Ala, Val, Arg, Asn, Ile, Asp, or His
  misc_feature (10)..(10): Xaa can be Arg, Lys, or Tyr
PXTISFTCWX

SEQ ID NO: 68062 - protein, 8 aa, Artificial Sequence
  Description of Artificial Sequence: Synthetic peptide
  Seed: QDWVQENY (MAGA4_HUMAN)
  misc_feature (2)..(2): Xaa can be Glu, or Asp
  misc_feature (8)..(8): Xaa can be Tyr, Phe, Met, or Leu
QXWVQENX

SEQ ID NO: 68063 - protein, 9 aa, Artificial Sequence
  Description of Artificial Sequence: Synthetic peptide
  Seed: QDWVQENYL (MAGA4_HUMAN)
  misc_feature (2)..(2): Xaa can be Glu, Asp, or Gln
  misc_feature (9)..(9): Xaa can be Leu, Met, Ile, Val, Phe, Ala, Tyr, Cys, Pro, Thr, Gly, Trp, or Ser
QXWVQENYX

SEQ ID NO: 68064 - protein, 8 aa, Artificial Sequence
  Description of Artificial Sequence: Synthetic peptide
  Seed: QEAAVSSS (MAGA4_HUMAN)
  misc_feature (2)..(2): Xaa can be Glu, or Asp
  misc_feature (8)..(8): Xaa can be Ile, Val, Leu, Ala, Pro, Met, Thr, Cys, Phe, or Ser
QXAAVSSX

SEQ ID NO: 68065 - protein, 9 aa, Artificial Sequence
  Description of Artificial Sequence: Synthetic peptide
  Seed: QEAAVSSSS (MAGA4_HUMAN)
  misc_feature (2)..(2): Xaa can be Glu, Asp, or Gln
  misc_feature (9)..(9): Xaa can be Val, Met, Ala, Ile, Phe, Cys, Leu, Pro, Thr, Gln, Tyr, Asp, Ser, Gly, Glu, or Trp
QXAAVSSSX

SEQ ID NO: 68066 - protein, 10 aa, Artificial Sequence
  Description of Artificial Sequence: Synthetic peptide
  Seed: QEAAVSSSSP (MAGA4_HUMAN)
  misc_feature (2)..(2): Xaa can be Glu, Gln, or Asp
  misc_feature (10)..(10): Xaa can be Ala, Leu, Cys, Ile, Val, Met, Phe, Ser, Thr, Gly, Trp, Tyr, or Pro
QXAAVSSSSX

SEQ ID NO: 68067 - protein, 11 aa, Artificial Sequence
  Description of Artificial Sequence: Synthetic peptide
  Seed: QEAAVSSSSPL (MAGA4_HUMAN)
  misc_feature (2)..(2): Xaa can be Glu, Gln, or Asp
  misc_feature (11)..(11): Xaa can be Trp, Tyr, Val, Met, Cys, Leu, Gly, Phe, Ile, Pro, Ser, Thr, or Ala
QXAAVSSSSPX

SEQ ID NO: 68068 - protein, 8 aa, Artificial Sequence
  Description of Artificial Sequence: Synthetic peptide
  Seed: QEEALGLV (MAGA4_HUMAN)
  misc_feature (2)..(2): Xaa can be , or Glu
  misc_feature (8)..(8): Xaa can be Leu, Phe, Ile, Cys, Ala, Val, or Met
QXEALGLX

SEQ ID NO: 68069 - protein, 10 aa, Artificial Sequence
  Description of Artificial Sequence: Synthetic peptide
  Seed: QEEALGLVGA (MAGA4_HUMAN)
  misc_feature (2)..(2): Xaa can be Glu, Gln, Lys, His, Phe, Trp, Gly, Ala, Thr, Cys, Asp, Ser, Leu, Tyr, Ile, Pro, Met, Arg, Val, or Asn
  misc_feature (10)..(10): Xaa can be Ala, Leu, Met, Val, Cys, Phe, Ser, Trp, Pro, Gly, Ile, Tyr, or Thr
QXEALGLVGX

SEQ ID NO: 68070 - protein, 9 aa, Artificial Sequence
  Description of Artificial Sequence: Synthetic peptide
  Seed: QEEEGPSTS (MAGA4_HUMAN)
  misc_feature (2)..(2): Xaa can be Glu, Asp, Gln, Ile, Ser, Val, or Ala
  misc_feature (9)..(9): Xaa can be Leu, Val, Phe, Pro, Met, Cys, Ile, Ala, Thr, Gln, Arg, Gly, Ser, Asn, Tyr, Asp, Glu, Trp, or Lys
QXEEGPSTX

SEQ ID NO: 68071 - protein, 10 aa, Artificial Sequence
  Description of Artificial Sequence: Synthetic peptide
  Seed: QEEEGPSTSP (MAGA4_HUMAN)
  misc_feature (2)..(2): Xaa can be Glu, Gln, Asp, or Lys
  misc_feature (10)..(10): Xaa can be Leu, Ala, Cys, Thr, Val, Ile, Phe, Met, Pro, Arg, Gly, Ser, Gln, Trp, Lys, Glu, Asp, Tyr, or Asn
QXEEGPSTSX

SEQ ID NO: 68072 - protein, 9 aa, Artificial Sequence
  Description of Artificial Sequence: Synthetic peptide
  Seed: QHCKPEEGV (MAGA4_HUMAN)
  misc_feature (2)..(2): Xaa can be His, Arg, Gln, or Glu
  misc_feature (9)..(9): Xaa can be Leu, Ala, Met, Ile, Val, Phe, Pro, Trp, Cys, Thr, or Tyr
QXCKPEEGX

SEQ ID NO: 68073 - protein, 11 aa, Artificial Sequence
  Description of Artificial Sequence: Synthetic peptide
  Seed: QHCKPEEGVEA (MAGA4_HUMAN)
  misc_feature (2)..(2): Xaa can be His, Arg, Gln, Lys, Glu, Tyr, or Asn
  misc_feature (11)..(11): Xaa can be Leu, Phe, Ala, Met, Ile, Val, Trp, Cys, Tyr, Pro, Ser, or Thr
QXCKPEEGVEX

SEQ ID NO: 68074 - protein, 8 aa, Artificial Sequence
  Description of Artificial Sequence: Synthetic peptide
  Seed: QIFPKTGL (MAGA4_HUMAN)
  misc_feature (2)..(2): Xaa can be Pro, Met, Ala, Leu, or Ile
  misc_feature (8)..(8): Xaa can be Leu, Ile, Phe, Met, or Val
QXFPKTGX

SEQ ID NO: 68075 - protein, 9 aa, Artificial Sequence
  Description of Artificial Sequence: Synthetic peptide
  Seed: QIFPKTGLL (MAGA4_HUMAN)
  misc_feature (2)..(2): Xaa can be Leu, Pro, Gln, Met, Thr, Ala, Val, Arg, Ile, Ser, Gly, Tyr, Asn, Glu, Cys, Asp, Phe, Trp, His, or Lys
  misc_feature (9)..(9): Xaa can be Met, Phe, Tyr, Leu, Ile, Arg, Trp, Lys, Val, His, Ala, Thr, Cys, Gln, Ser, or Pro
QXFPKTGLX

SEQ ID NO: 68076 - protein, 10 aa, Artificial Sequence
  Description of Artificial Sequence: Synthetic peptide
  Seed: QIFPKTGLLI (MAGA4_HUMAN)
  misc_feature (2)..(2): Xaa can be Met, Gln, Leu, Val, Ile, Ser, Glu, Tyr, Trp, Ala, Thr, Phe, Asn, Arg, Gly, Lys, Pro, His, Asp, or Cys
  misc_feature (10)..(10): Xaa can be Trp, Leu, Phe, Tyr, Ile, Met, Val, Ala, Thr, Ser, or Cys
QXFPKTGLLX

SEQ ID NO: 68077 - protein, 9 aa, Artificial Sequence
  Description of Artificial Sequence: Synthetic peptide
  Seed: QSPQGASAL (MAGA4_HUMAN)
  misc_feature (2)..(2): Xaa can be Pro, Ala, Ile, Met, Leu, Val, Phe, Ser, Thr, Tyr, Arg, Glu, Gln, Gly, Asn, Cys, Asp, His, Trp, or Lys
  misc_feature (9)..(9): Xaa can be Phe, Tyr, Leu, Met, Ile, Val, Trp, Lys, Arg, Ala, Cys, His, Thr, Pro, Ser, Gln, or Gly
QXPQGASAX

SEQ ID NO: 68078 - protein, 9 aa, Artificial Sequence
  Description of Artificial Sequence: Synthetic peptide
  Seed: QVPGSNPAR (MAGA4_HUMAN)
  misc_feature (2)..(2): Xaa can be Ala, Thr, Ile, Ser, Val, Phe, Leu, Gly, Met, Tyr, Cys, Gln, Asn, Trp, Pro, Asp, Glu, or Ar g
  misc_feature (9)..(9): Xaa can be Arg, Leu, Met, Lys, Phe, Tyr, Val, Ile, His, Trp, Cys, or Ala
QXPGSNPAX

SEQ ID NO: 68079 - protein, 10 aa, Artificial Sequence
  Description of Artificial Sequence: Synthetic peptide
  Seed: QVPGSNPARY (MAGA4_HUMAN)
  misc_feature (2)..(2): Xaa can be Val, Thr, Ala, Met, Ile, Ser, Gln, Leu, Pro, Phe, Tyr, Glu, Asn, Cys, Gly, Asp, Trp, Lys, Arg, or His
  misc_feature (10)..(10): Xaa can be Tyr, Lys, Arg, Phe, Met, Trp, Leu, Ile, His, Val, or Gln
QXPGSNPARX

SEQ ID NO: 68080 - protein, 8 aa, Artificial Sequence
  Description of Artificial Sequence: Synthetic peptide
  Seed: RAKELVTK (MAGA4_HUMAN)
  misc_feature (2)..(2): Xaa can be Thr, Ser, Val, Ala, Ile, Arg, Met, Leu, Phe, or Tyr
  misc_feature (8)..(8): Xaa can be Lys, Ala, Val, or Tyr
RXKELVTX

SEQ ID NO: 68081 - protein, 9 aa, Artificial Sequence
  Description of Artificial Sequence: Synthetic peptide
  Seed: RAKELVTKA (MAGA4_HUMAN)
  misc_feature (2)..(2): Xaa can be Pro, Thr, Ser, Met, Val, Ala, Ile, Leu, Gln, Tyr, Phe, Asn, Gly, Glu, Trp, His, Arg, Cys, Lys, or Asp
  misc_feature (9)..(9): Xaa can be Tyr, Leu, Phe, Lys, Met, Ile, Val, Ala, His, Arg, Cys, Trp, Gly, Thr, Ser, Gln, Pro, Asn, Glu, or Asp
RXKELVTKX

SEQ ID NO: 68082 - protein, 11 aa, Artificial Sequence
  Description of Artificial Sequence: Synthetic peptide
  Seed: RAKELVTKAEM (MAGA4_HUMAN)
  misc_feature (2)..(2): Xaa can be Ala, Val, Ser, Thr, or Ile
  misc_feature (11)..(11): Xaa can be Tyr, Phe, Met, or Leu
RXKELVTKAEX

SEQ ID NO: 68083 - protein, 9 aa, Artificial Sequence
  Description of Artificial Sequence: Synthetic peptide
  Seed: RCFPVIFGK (MAGA4_HUMAN)
  misc_feature (2)..(2): Xaa can be Met, Thr, Leu, Ile, Val, Ser, Tyr, Trp, Ala, Phe, Gln, Gly, Asn, Cys, Glu, Asp, His, Pro, Lys, or Arg
  misc_feature (9)..(9): Xaa can be Arg, Lys, Tyr, Leu, His, Val, Ala, Ile, Phe, Gln, Met, Gly, Ser, Thr, Trp, Glu, Asn, Cys, or Pro
RXFPVIFGX

SEQ ID NO: 68084 - protein, 9 aa, Artificial Sequence
  Description of Artificial Sequence: Synthetic peptide
  Seed: REAALLEEE (MAGA4_HUMAN)
  misc_feature (2)..(2): Xaa can be Glu, Asp, Gln, or Ala
  misc_feature (9)..(9): Xaa can be Leu, Met, Cys, Ala, Pro, Ile, Val, Phe, Gly, Ser, Tyr, Thr, Trp, Lys, Glu, Gln, Asn, Arg, His, or Asp
RXAALLEEX

SEQ ID NO: 68085 - protein, 10 aa, Artificial Sequence
  Description of Artificial Sequence: Synthetic peptide
  Seed: REAALLEEEE (MAGA4_HUMAN)
  misc_feature (2)..(2): Xaa can be Glu, Asp, or Gln
  misc_feature (10)..(10): Xaa can be Leu, Ile, Cys, Val, Ala, Met, Glu, Gly, Trp, Tyr, Arg, Gln, Asp, Asn, Thr, Pro, Phe, or Se r
RXAALLEEEX

SEQ ID NO: 68086 - protein, 11 aa, Artificial Sequence
  Description of Artificial Sequence: Synthetic peptide
  Seed: REAALLEEEEG (MAGA4_HUMAN)
  misc_feature (2)..(2): Xaa can be Glu, Asp, or Gln
  misc_feature (11)..(11): Xaa can be Cys, Leu, Val, Ile, Ala, Tyr, Thr, Ser, Met, Pro, Phe, Trp, or Gly
RXAALLEEEEX

SEQ ID NO: 68087 - protein, 8 aa, Artificial Sequence
  Description of Artificial Sequence: Synthetic peptide
  Seed: REALSNKV (MAGA4_HUMAN)
  misc_feature (2)..(2): Xaa can be Glu, Asp, Gln, Ala, Ser, Met, or Val
  misc_feature (8)..(8): Xaa can be Ile, Val, Leu, Tyr, Trp, Met, Phe, Ala, His, Pro, Thr, Cys, or Ser
RXALSNKX

SEQ ID NO: 68088 - protein, 9 aa, Artificial Sequence
  Description of Artificial Sequence: Synthetic peptide
  Seed: REALSNKVD (MAGA4_HUMAN)
  misc_feature (2)..(2): Xaa can be Glu, Asp, or Gln
  misc_feature (9)..(9): Xaa can be Val, Ala, Leu, Cys, Ile, Met, Pro, Thr, Gly, Ser, Tyr, Gln, Asp, Glu, or Phe
RXALSNKVX

SEQ ID NO: 68089 - protein, 11 aa, Artificial Sequence
  Description of Artificial Sequence: Synthetic peptide
  Seed: REALSNKVDEL (MAGA4_HUMAN)
  misc_feature (2)..(2): Xaa can be Glu, Gln, Asp, Leu, Met, Val, Ile, Ala, Thr, Ser, Asn, Lys, or His
  misc_feature (11)..(11): Xaa can be Trp, Phe, Leu, Ile, Met, Val, Tyr, Cys, Ala, Thr, Ser, Gly, Pro, or His
RXALSNKVDEX

SEQ ID NO: 68090 - protein, 9 aa, Artificial Sequence
  Description of Artificial Sequence: Synthetic peptide
  Seed: REHTVYGEP (MAGA4_HUMAN)
  misc_feature (2)..(2): Xaa can be Glu, Asp, or Gln
  misc_feature (9)..(9): Xaa can be Ile, Ala, Leu, Met, Val, Cys, Phe, Pro, Thr, Trp, Tyr, Glu, Gln, Ser, Asp, or Gly
RXHTVYGEX

SEQ ID NO: 68091 - protein, 8 aa, Artificial Sequence
  Description of Artificial Sequence: Synthetic peptide
  Seed: RIAYPSLR (MAGA4_HUMAN)
  misc_feature (2)..(2): Xaa can be Phe, Met, Val, Tyr, Trp, Gly, Ser, Thr, Asn, Ile, Gln, Leu, or Ala
  misc_feature (8)..(8): Xaa can be Arg, or Lys
RXAYPSLX

SEQ ID NO: 68092 - protein, 10 aa, Artificial Sequence
  Description of Artificial Sequence: Synthetic peptide
  Seed: RIAYPSLREA (MAGA4_HUMAN)
  misc_feature (2)..(2): Xaa can be Thr, Ser, Val, Tyr, Met, Leu, Phe, Ile, Trp, Gly, Ala, Cys, Asn, Gln, Glu, Pro, Arg, Lys, Asp, or His
  misc_feature (10)..(10): Xaa can be Ala, Lys, Val, Ile, Leu, Met, Ser, Arg, Thr, Tyr, or Gly
RXAYPSLREX

SEQ ID NO: 68093 - protein, 8 aa, Artificial Sequence
  Description of Artificial Sequence: Synthetic peptide
  Seed: RKYRAKEL (MAGA4_HUMAN)
  misc_feature (2)..(2): Xaa can be Gln, Arg, Lys, Glu, Ala, His, Tyr, Ser, Phe, Asn, Asp, Met, Gly, Leu, Ile, or Val
  misc_feature (8)..(8): Xaa can be Tyr, Phe, Leu, Met, Trp, Ile, Val, or His
RXYRAKEX

SEQ ID NO: 68094 - protein, 9 aa, Artificial Sequence
  Description of Artificial Sequence: Synthetic peptide
  Seed: RKYRAKELV (MAGA4_HUMAN)
  misc_feature (2)..(2): Xaa can be Arg, Gln, Glu, Lys, His, Met, Gly, Leu, Asn, Ala, Ser, Thr, Ile, Val, Asp, Pro, Phe, Tyr, or Cys
  misc_feature (9)..(9): Xaa can be Tyr, Phe, Leu, Ile, Met, Lys, Arg, Val, Trp, His, Cys, Ala, Asn, Gln, Gly, Pro, Ser, Glu, or Thr
RXYRAKELX

SEQ ID NO: 68095 - protein, 11 aa, Artificial Sequence
  Description of Artificial Sequence: Synthetic peptide
  Seed: RKYRAKELVTK (MAGA4_HUMAN)
  misc_feature (2)..(2): Xaa can be Arg, Gln, Lys, His, Glu, Thr, Ser, Asn, Val, Phe, Leu, Met, Gly, Pro, Cys, Trp, Tyr, Ile, Ala, or Asp
  misc_feature (11)..(11): Xaa can be Lys, Phe, Arg, Ala, Tyr, Leu, Met, Ile, Trp, Val, His, Cys, Thr, Pro, Gly, Asn, Gln, Ser, Glu, or Asp
RXYRAKELVTX

SEQ ID NO: 68096 - protein, 9 aa, Artificial Sequence
  Description of Artificial Sequence: Synthetic peptide
  Seed: RQVPGSNPA (MAGA4_HUMAN)
  misc_feature (2)..(2): Xaa can be Glu, Gln, Arg, Met, His, Asp, Lys, Leu, Ala, Val, Ile, Ser, Asn, Pro, Thr, Gly, Tyr, Phe, Cys, or Trp
  misc_feature (9)..(9): Xaa can be Phe, Tyr, Leu, Met, Val, Ile, Trp, His, Ala, Cys, Thr, Gly, Ser, Pro, Gln, Asn, Lys, Arg, Glu, or Asp
RXVPGSNPX

SEQ ID NO: 68097 - protein, 10 aa, Artificial Sequence
  Description of Artificial Sequence: Synthetic peptide
  Seed: RQVPGSNPAR (MAGA4_HUMAN)
  misc_feature (2)..(2): Xaa can be Arg, Gln, Met, Leu, Thr, Val, Lys, Ala, Glu, Ser, Ile, Gly, Phe, His, Tyr, Pro, Asp, Asn, Trp, or Cys
  misc_feature (10)..(10): Xaa can be Lys, Tyr, Arg, Met, Phe, Leu, Trp, Ile, Val, His, Ala, Cys, Thr, Gln, Ser, Gly, Pro, Glu, or Asn
RXVPGSNPAX

SEQ ID NO: 68098 - protein, 11 aa, Artificial Sequence
  Description of Artificial Sequence: Synthetic peptide
  Seed: RQVPGSNPARY (MAGA4_HUMAN)
  misc_feature (2)..(2): Xaa can be Arg, Glu, Gln, Leu, Met, Val, Ile, Ala, Thr, Ser, Gly, Tyr, His, Lys, Asn, Cys, Phe, Trp, Asp, or Pro
  misc_feature (11)..(11): Xaa can be Trp, Phe, Tyr, Arg, Lys, Leu, Met, Ile, His, Val, Cys, Gln, Ala, Thr, Gly, Pro, Ser, Asn, Asp, or Glu
RXVPGSNPARX

SEQ ID NO: 68099 - protein, 8 aa, Artificial Sequence
  Description of Artificial Sequence: Synthetic peptide
  Seed: RVIKNYKR (MAGA4_HUMAN)
  misc_feature (2)..(2): Xaa can be Met, Phe, Ala, Leu, Val, Trp, Thr, Ser, Gln, Ile, or Tyr
  misc_feature (8)..(8): Xaa can be Arg, or Lys
RXIKNYKX

SEQ ID NO: 68100 - protein, 10 aa, Artificial Sequence
  Description of Artificial Sequence: Synthetic peptide
  Seed: RVIKNYKRCF (MAGA4_HUMAN)
  misc_feature (2)..(2): Xaa can be Ser, Thr, Met, Gln, Ile, Ala, Leu, Val, Glu, Asn, Pro, Cys, Gly, Asp, or Phe
  misc_feature (10)..(10): Xaa can be Trp, Tyr, Phe, Met, Ile, or Leu
RXIKNYKRCX

SEQ ID NO: 68101 - protein, 9 aa, Artificial Sequence
  Description of Artificial Sequence: Synthetic peptide
  Seed: RVNARVRIA (MAGA4_HUMAN)
  misc_feature (2)..(2): Xaa can be Ser, Met, Val, Thr, Ile, Tyr, Ala, Phe, Pro, Leu, Gln, Gly, Trp, Asn, His, Lys, or Cys
  misc_feature (9)..(9): Xaa can be Lys, Leu, Ala, Met, Ile, Val, Ser, Tyr, Gly, Thr, Arg, Phe, Cys, Gln, Pro, Asn, Glu, or Hi s
RXNARVRIX

SEQ ID NO: 68102 - protein, 10 aa, Artificial Sequence
  Description of Artificial Sequence: Synthetic peptide
  Seed: RVNARVRIAY (MAGA4_HUMAN)
  misc_feature (2)..(2): Xaa can be Ser, Thr, Val, Met, Ala, Tyr, Ile, Gln, Leu, Phe, Trp, Lys, Asn, Glu, Gly, His, Arg, Pro, Cys, or Asp
  misc_feature (10)..(10): Xaa can be Lys, Tyr, Phe, Met, Val, Ala, Leu, Ile, Arg, Ser, Gly, Trp, His, Thr, Pro, Asn, Cys, Gln, or Glu
RXNARVRIAX

SEQ ID NO: 68103 - protein, 11 aa, Artificial Sequence
  Description of Artificial Sequence: Synthetic peptide
  Seed: RVNARVRIAYP (MAGA4_HUMAN)
  misc_feature (2)..(2): Xaa can be Thr, Ser, Tyr, Val, Ile, Met, Phe, Trp, Leu, Gln, Arg, Pro, Gly, His, Cys, Lys, Asn, Asp, Ala, or Glu
  misc_feature (11)..(11): Xaa can be Met, Tyr, Ser, Ala, Leu, Lys, Ile, Val, Arg, Thr, Gly, Phe, Pro, Gln, Cys, Glu, His, or As n
RXNARVRIAYX

SEQ ID NO: 68104 - protein, 8 aa, Artificial Sequence
  Description of Artificial Sequence: Synthetic peptide
  Seed: RVRIAYPS (MAGA4_HUMAN)
  misc_feature (2)..(2): Xaa can be Thr, Ile, Met, Ser, Val, Phe, Tyr, Leu, Ala, Trp, Gln, Gly, Asn, Arg, Cys, His, or Lys
  misc_feature (8)..(8): Xaa can be Lys, Ala, Val, Tyr, Leu, Met, Phe, Ile, Ser, Arg, Gly, Pro, Thr, Asn, Gln, Glu, His, Cys, Trp, or Asp
RXRIAYPX

SEQ ID NO: 68105 - protein, 9 aa, Artificial Sequence
  Description of Artificial Sequence: Synthetic peptide
  Seed: RVRIAYPSL (MAGA4_HUMAN)
  misc_feature (2)..(2): Xaa can be Thr, Ala, Val, Tyr, Ser, Met, Pro, Trp, Ile, Gln, Phe, Leu, Asn, Gly, Arg, Cys, His, Lys, Glu, or Asp
  misc_feature (9)..(9): Xaa can be Trp, Tyr, Met, Leu, Ala, Ile, Lys, Val, Phe, His, Thr, Arg, Ser, Gln, Gly, Asn, Glu, Pro, Cys, or Asp
RXRIAYPSX

SEQ ID NO: 68106 - protein, 10 aa, Artificial Sequence
  Description of Artificial Sequence: Synthetic peptide
  Seed: RVRIAYPSLR (MAGA4_HUMAN)
  misc_feature (2)..(2): Xaa can be Val, Leu, Trp, Phe, Ile, Ala, Tyr, Ser, Thr, Met, Arg, Gln, Asn, Gly, Lys, Cys, His, Asp, Glu, or Pro
  misc_feature (10)..(10): Xaa can be Phe, Thr, Tyr, Gln, Lys, His, Arg, Trp, Ile, Glu, Val, Ser, Met, Leu, Cys, Asn, Ala, Gly, Pro, or Asp
RXRIAYPSLX

SEQ ID NO: 68107 - protein, 11 aa, Artificial Sequence
  Description of Artificial Sequence: Synthetic peptide
  Seed: RVRIAYPSLRE (MAGA4_HUMAN)
  misc_feature (2)..(2): Xaa can be Thr, Trp, Asp, Gly, Asn, Tyr, Phe, Ser, Lys, Arg, Met, Ala, Val, His, Pro, Ile, Gln, Leu, Cys, or Glu
  misc_feature (11)..(11): Xaa can be Gly, Phe, Ser, His, Pro, Asn, Lys, Leu, Ile, Met, Trp, Glu, Cys, Asp, Arg, Gln, Ala, Tyr, Val, or Thr
RXRIAYPSLRX

SEQ ID NO: 68108 - protein, 8 aa, Artificial Sequence
  Description of Artificial Sequence: Synthetic peptide
  Seed: SAGPPQSP (MAGA4_HUMAN)
  misc_feature (2)..(2): Xaa can be Ala, Ser, Val, Ile, Gln, Gly, Thr, Leu, Met, Glu, Asn, Cys, Pro, Phe, Tyr, Asp, or Lys
  misc_feature (8)..(8): Xaa can be Tyr, Phe, Leu, Met, His, Ile, Lys, Arg, Val, Ala, Trp, Cys, Gln, Ser, Thr, or Pro
SXGPPQSX

SEQ ID NO: 68109 - protein, 9 aa, Artificial Sequence
  Description of Artificial Sequence: Synthetic peptide
  Seed: SAGPPQSPQ (MAGA4_HUMAN)
  misc_feature (2)..(2): Xaa can be Ala, Ser, Val, Gly, Ile, Thr, Arg, Gln, Met, Leu, Cys, Pro, Phe, Glu, Asn, Asp, Tyr, Trp, Lys, or His
  misc_feature (9)..(9): Xaa can be Lys, Tyr, Arg, Phe, Leu, Met, His, Val, Ile, Ala, Trp, Gln, Cys, Thr, Ser, Asn, Glu, Pro, or Gly
SXGPPQSPX

SEQ ID NO: 68110 - protein, 11 aa, Artificial Sequence
  Description of Artificial Sequence: Synthetic peptide
  Seed: SAGPPQSPQGA (MAGA4_HUMAN)
  misc_feature (2)..(2): Xaa can be Pro, Ala, Thr, Val, Ser, Ile, Leu, Gln, Met, Gly, Glu, Cys, Asn, Phe, Asp, Trp, His, Lys, or Tyr
  misc_feature (11)..(11): Xaa can be Lys, Tyr, Arg, Phe, Leu, Met, Trp, His, Ile, Val, Ala, Gln, Cys, Pro, Thr, Ser, or Gly
SXGPPQSPQGX

SEQ ID NO: 68111 - protein, 9 aa, Artificial Sequence
  Description of Artificial Sequence: Synthetic peptide
  Seed: SALPTTISF (MAGA4_HUMAN)
  misc_feature (2)..(2): Xaa can be Pro, Arg, Ala, Glu, Gln, Tyr, Met, Ser, Asp, Phe, Thr, His, Val, Gly, Trp, Leu, Ile, Asn, Cys, or Lys
  misc_feature (9)..(9): Xaa can be Leu, Met, Ala, Arg, Tyr, Trp, Phe, Lys, His, Ile, Val, Cys, Thr, Gln, Ser, Gly, Pro, Glu, Asn, or Asp
SXLPTTISX

SEQ ID NO: 68112 - protein, 8 aa, Artificial Sequence
  Description of Artificial Sequence: Synthetic peptide
  Seed: SASEEEIW (MAGA4_HUMAN)
  misc_feature (2)..(2): Xaa can be Ala, Ile, Thr, Ser, or Val
  misc_feature (8)..(8): Xaa can be , or Trp
SXSEEEIX

SEQ ID NO: 68113 - protein, 11 aa, Artificial Sequence
  Description of Artificial Sequence: Synthetic peptide
  Seed: SASEEEIWEEL (MAGA4_HUMAN)
  misc_feature (2)..(2): Xaa can be Ala, Val, Met, Gln, Thr, Leu, Ile, Ser, Arg, Glu, Tyr, Gly, Asn, Phe, Cys, Asp, His, Trp, Pro, or Lys
  misc_feature (11)..(11): Xaa can be Lys, Arg, Leu, Trp, Met, Phe, Tyr, Ile, Val, or His
SXSEEEIWEEX

SEQ ID NO: 68114 - protein, 9 aa, Artificial Sequence
  Description of Artificial Sequence: Synthetic peptide
  Seed: SEEEIWEEL (MAGA4_HUMAN)
  misc_feature (2)..(2): Xaa can be Glu, Asp, Gln, His, Arg, Ala, Tyr, Thr, Phe, Ile, Val, Leu, Lys, Gly, Asn, Met, Ser, Pro, Trp, or Cys
  misc_feature (9)..(9): Xaa can be Leu, Phe, Val, Met, Ile, Tyr, Trp, Cys, Ala, Lys, Thr, Pro, Arg, His, Asp, Ser, Gln, Glu, Gly, or Asn
SXEEIWEEX

SEQ ID NO: 68115 - protein, 10 aa, Artificial Sequence
  Description of Artificial Sequence: Synthetic peptide
  Seed: SEEEIWEELG (MAGA4_HUMAN)
  misc_feature (2)..(2): Xaa can be Glu, Gln, or Asp
  misc_feature (10)..(10): Xaa can be Ala, Leu, Val, Cys, Ile, Met, Gly, Ser, Gln, Phe, Pro, Trp, Thr, Lys, Glu, Arg, or Tyr
SXEEIWEELX

SEQ ID NO: 68116 - protein, 11 aa, Artificial Sequence
  Description of Artificial Sequence: Synthetic peptide
  Seed: SEEEIWEELGV (MAGA4_HUMAN)
  misc_feature (2)..(2): Xaa can be , or Glu
  misc_feature (11)..(11): Xaa can be Met, Thr, Ala, Val, Gly, Cys, Ser, Leu, Phe, Tyr, Ile, Pro, or Trp
SXEEIWEELGX

SEQ ID NO: 68117 - protein, 8 aa, Artificial Sequence
  Description of Artificial Sequence: Synthetic peptide
  Seed: SEQKSQHC (MAGA4_HUMAN)
  misc_feature (2)..(2): Xaa can be Glu, Asp, or Gln
  misc_feature (8)..(8): Xaa can be Leu, Phe, Ile, Tyr, Ala, Val, Met, Ser, Thr, Pro, Trp, or Cys
SXQKSQHX

SEQ ID NO: 68118 - protein, 9 aa, Artificial Sequence
  Description of Artificial Sequence: Synthetic peptide
  Seed: SEQKSQHCK (MAGA4_HUMAN)
  misc_feature (2)..(2): Xaa can be Glu, Asp, Gln, Ser, Thr, Val, Ile, Gly, Met, Leu, Ala, Phe, Asn, Cys, Lys, or Trp
  misc_feature (9)..(9): Xaa can be Tyr, Lys, Arg, Phe, Trp, Val, Leu, Ile, Met, Ala, Thr, His, or Cys
SXQKSQHCX

SEQ ID NO: 68119 - protein, 10 aa, Artificial Sequence
  Description of Artificial Sequence: Synthetic peptide
  Seed: SEQKSQHCKP (MAGA4_HUMAN)
  misc_feature (2)..(2): Xaa can be Glu, or Asp
  misc_feature (10)..(10): Xaa can be Ala, Leu, Cys, Ile, Phe, Pro, Val, Met, Gly, Trp, Thr, or Ser
SXQKSQHCKX

SEQ ID NO: 68120 - protein, 8 aa, Artificial Sequence
  Description of Artificial Sequence: Synthetic peptide
  Seed: SESLKMIF (MAGA4_HUMAN)
  misc_feature (2)..(2): Xaa can be Glu, or Asp
  misc_feature (8)..(8): Xaa can be Met, Phe, Leu, Val, Trp, Tyr, Ile, Pro, Thr, Ala, or Cys
SXSLKMIX

SEQ ID NO: 68121 - protein, 9 aa, Artificial Sequence
  Description of Artificial Sequence: Synthetic peptide
  Seed: SESLKMIFG (MAGA4_HUMAN)
  misc_feature (2)..(2): Xaa can be Glu, or Asp
  misc_feature (9)..(9): Xaa can be Ile, Leu, Cys, Ala, Val, Ser, Thr, Tyr, Gly, Phe, Pro, or Met
SXSLKMIFX

SEQ ID NO: 68122 - protein, 10 aa, Artificial Sequence
  Description of Artificial Sequence: Synthetic peptide
  Seed: SESLKMIFGI (MAGA4_HUMAN)
  misc_feature (2)..(2): Xaa can be Glu, Gln, Ser, Asn, Cys, Ala, His, Met, Pro, Gly, Trp, Lys, Val, Phe, Asp, Arg, Thr, Leu, Ile, or Tyr
  misc_feature (10)..(10): Xaa can be Ile, Met, Phe, Trp, Tyr, Leu, Val, Pro, Cys, Ala, or Thr
SXSLKMIFGX

SEQ ID NO: 68123 - protein, 10 aa, Artificial Sequence
  Description of Artificial Sequence: Synthetic peptide
  Seed: SLFREALSNK (MAGA4_HUMAN)
  misc_feature (2)..(2): Xaa can be Thr, Val, Ser, Met, Leu, Arg, Ile, Gln, Ala, Tyr, Lys, Trp, Asn, Gly, Cys, Asp, Glu, His, Pro, or Phe
  misc_feature (10)..(10): Xaa can be Lys, Ala, Arg, Val, Ile, Tyr, Met, Leu, Phe, Ser, Gly, His, or Thr
SXFREALSNX

SEQ ID NO: 68124 - protein, 11 aa, Artificial Sequence
  Description of Artificial Sequence: Synthetic peptide
  Seed: SLFREALSNKV (MAGA4_HUMAN)
  misc_feature (2)..(2): Xaa can be Leu, Met, Gln, Glu, Val, Ile, Thr, or Ser
  misc_feature (11)..(11): Xaa can be Lys, Ile, Leu, Val, Phe, Trp, Cys, Met, Tyr, His, Asp, Glu, Arg, Gly, Asn, Thr, Ala, Gln, Ser, or Pro
SXFREALSNKX

SEQ ID NO: 68125 - protein, 8 aa, Artificial Sequence
  Description of Artificial Sequence: Synthetic peptide
  Seed: SLKMIFGI (MAGA4_HUMAN)
  misc_feature (2)..(2): Xaa can be Met, Leu, or Ile
  misc_feature (8)..(8): Xaa can be Val, Ala, Leu, or Ile
SXKMIFGX

SEQ ID NO: 68126 - protein, 10 aa, Artificial Sequence
  Description of Artificial Sequence: Synthetic peptide
  Seed: SLKMIFGIDV (MAGA4_HUMAN)
  misc_feature (2)..(2): Xaa can be Met, Leu, or Ile
  misc_feature (10)..(10): Xaa can be Val, Ile, Leu, or Ala
SXKMIFGIDX

SEQ ID NO: 68127 - protein, 9 aa, Artificial Sequence
  Description of Artificial Sequence: Synthetic peptide
  Seed: SNKVDELAH (MAGA4_HUMAN)
  misc_feature (2)..(2): Xaa can be Ala, Val, Ser, Ile, Thr, Gln, Gly, Leu, Asn, Met, Glu, Cys, Phe, Asp, Tyr, Lys, or Pro
  misc_feature (9)..(9): Xaa can be Tyr, Phe, Met, Lys, His, Leu, Arg, Ile, Val, Ala, Trp, Gln, Cys, or Thr
SXKVDELAX

SEQ ID NO: 68128 - protein, 10 aa, Artificial Sequence
  Description of Artificial Sequence: Synthetic peptide
  Seed: SNKVDELAHF (MAGA4_HUMAN)
  misc_feature (2)..(2): Xaa can be Gln, Met, Lys, Trp, Asp, Gly, Arg, Val, Glu, Cys, Thr, Ile, Ala, Phe, His, Asn, Tyr, Ser, Leu, or Pro
  misc_feature (10)..(10): Xaa can be Tyr, Phe, Met, or Leu
SXKVDELAHX

SEQ ID NO: 68129 - protein, 9 aa, Artificial Sequence
  Description of Artificial Sequence: Synthetic peptide
  Seed: SNPARYEFL (MAGA4_HUMAN)
  misc_feature (2)..(2): Xaa can be Ala, Arg, Ser, Val, Tyr, Thr, Gly, His, Met, Phe, Asn, Gln, Cys, Leu, Ile, Lys, Glu, Pro, Asp, or Trp
  misc_feature (9)..(9): Xaa can be Met, Phe, Leu, Ile, Tyr, Val, Trp, Cys, Ala, or His
SXPARYEFX

SEQ ID NO: 68130 - protein, 8 aa, Artificial Sequence
  Description of Artificial Sequence: Synthetic peptide
  Seed: SPDAESLF (MAGA4_HUMAN)
  misc_feature (2)..(2): Xaa can be , or Pro
  misc_feature (8)..(8): Xaa can be Tyr, or Phe
SXDAESLX

SEQ ID NO: 68131 - protein, 9 aa, Artificial Sequence
  Description of Artificial Sequence: Synthetic peptide
  Seed: SPDAESLFR (MAGA4_HUMAN)
  misc_feature (2)..(2): Xaa can be Thr, Ser, Val, Ile, Met, Ala, Leu, Phe, Tyr, Gln, Asn, Gly, Cys, Trp, Pro, Asp, Glu, Lys, His, or Arg
  misc_feature (9)..(9): Xaa can be Tyr, Lys, Arg, Leu, Phe, Met, His, Trp, Val, Ile, Gln, Ala, Glu, Thr, Ser, Cys, or Asn
SXDAESLFX

SEQ ID NO: 68132 - protein, 11 aa, Artificial Sequence
  Description of Artificial Sequence: Synthetic peptide
  Seed: SPDAESLFREA (MAGA4_HUMAN)
  misc_feature (2)..(2): Xaa can be , or Pro
  misc_feature (11)..(11): Xaa can be Tyr, Val, Cys, Met, Leu, Phe, Ala, or Ile
SXDAESLFREX

SEQ ID NO: 68133 - protein, 8 aa, Artificial Sequence
  Description of Artificial Sequence: Synthetic peptide
  Seed: SPLVPGTL (MAGA4_HUMAN)
  misc_feature (2)..(2): Xaa can be Pro, His, Arg, Ala, or Gln
  misc_feature (8)..(8): Xaa can be Leu, Val, Ile, Met, Phe, Tyr, Ser, Pro, Cys, Ala, or Thr
SXLVPGTX

SEQ ID NO: 68134 - protein, 9 aa, Artificial Sequence
  Description of Artificial Sequence: Synthetic peptide
  Seed: SPLVPGTLE (MAGA4_HUMAN)
  misc_feature (2)..(2): Xaa can be Pro, Ala, Val, Ile, or Gly
  misc_feature (9)..(9): Xaa can be Ala, Leu, Pro, Met, Cys, Ile, Val, Phe, Gln, Ser, Lys, His, Tyr, Arg, Asn, Glu, Thr, Trp, Gly, or Asp
SXLVPGTLX

SEQ ID NO: 68135 - protein, 11 aa, Artificial Sequence
  Description of Artificial Sequence: Synthetic peptide
  Seed: SPLVPGTLEEV (MAGA4_HUMAN)
  misc_feature (2)..(2): Xaa can be Pro, or Ala
  misc_feature (11)..(11): Xaa can be Ile, Leu, Ala, Cys, Lys, Arg, Val, Pro, Phe, Thr, Ser, Gly, Met, Trp, or Tyr
SXLVPGTLEEX

SEQ ID NO: 68136 - protein, 8 aa, Artificial Sequence
  Description of Artificial Sequence: Synthetic peptide
  Seed: SPQGASAL (MAGA4_HUMAN)
  misc_feature (2)..(2): Xaa can be , or Pro
  misc_feature (8)..(8): Xaa can be Leu, Ala, Val, Met, Phe, or Ile
SXQGASAX

SEQ ID NO: 68137 - protein, 9 aa, Artificial Sequence
  Description of Artificial Sequence: Synthetic peptide
  Seed: SPQGASALP (MAGA4_HUMAN)
  misc_feature (2)..(2): Xaa can be Pro, Ala, or Val
  misc_feature (9)..(9): Xaa can be Leu, Ala, Met, His, Tyr, Arg, Thr, Ile, Lys, Trp, Ser, Gly, Val, Phe, Cys, or Pro
SXQGASALX

SEQ ID NO: 68138 - protein, 10 aa, Artificial Sequence
  Description of Artificial Sequence: Synthetic peptide
  Seed: SPQGASALPT (MAGA4_HUMAN)
  misc_feature (2)..(2): Xaa can be Pro, or Ala
  misc_feature (10)..(10): Xaa can be Ala, Leu, Arg, Gly, Lys, Gln, Thr, Met, Tyr, Glu, Cys, Pro, Phe, Ile, His, Ser, Val, or Tr p
SXQGASALPX

SEQ ID NO: 68139 - protein, 11 aa, Artificial Sequence
  Description of Artificial Sequence: Synthetic peptide
  Seed: SPQGASALPTT (MAGA4_HUMAN)
  misc_feature (2)..(2): Xaa can be Pro, Ala, or Val
  misc_feature (11)..(11): Xaa can be Leu, Ala, Cys, Met, Gly, Thr, Lys, Val, Asn, Tyr, Trp, His, Ser, Gln, Ile, Arg, Phe, Glu, or Pro
SXQGASALPTX

SEQ ID NO: 68140 - protein, 9 aa, Artificial Sequence
  Description of Artificial Sequence: Synthetic peptide
  Seed: SQEEEGPST (MAGA4_HUMAN)
  misc_feature (2)..(2): Xaa can be Glu, Asp, or Gln
  misc_feature (9)..(9): Xaa can be Val, Ala, Thr, Leu, Phe, Ile, Met, Pro, Cys, Asn, Arg, Lys, Glu, Trp, Asp, Gly, His, Gln, Ser, or Tyr
SXEEEGPSX

SEQ ID NO: 68141 - protein, 11 aa, Artificial Sequence
  Description of Artificial Sequence: Synthetic peptide
  Seed: SQEEEGPSTSP (MAGA4_HUMAN)
  misc_feature (2)..(2): Xaa can be Glu, Gln, Asp, or Lys
  misc_feature (11)..(11): Xaa can be Cys, Ala, Pro, Ile, Met, Thr, Leu, Phe, Val, Gly, Trp, Ser, Asp, Lys, Gln, Arg, Asn, Glu, Tyr, or His
SXEEEGPSTSX

SEQ ID NO: 68142 - protein, 10 aa, Artificial Sequence
  Description of Artificial Sequence: Synthetic peptide
  Seed: SQHCKPEEGV (MAGA4_HUMAN)
  misc_feature (2)..(2): Xaa can be , or Gln
  misc_feature (10)..(10): Xaa can be Leu, Val, or Ile
SXHCKPEEGX

SEQ ID NO: 68143 - protein, 10 aa, Artificial Sequence
  Description of Artificial Sequence: Synthetic peptide
  Seed: SSEQKSQHCK (MAGA4_HUMAN)
  misc_feature (2)..(2): Xaa can be Thr, Met, Ile, Val, Ser, Leu, Ala, Gly, Asn, Phe, Gln, Trp, Tyr, Glu, Cys, or Asp
  misc_feature (10)..(10): Xaa can be Tyr, Lys, Arg, Phe, His, or Trp
SXEQKSQHCX

SEQ ID NO: 68144 - protein, 9 aa, Artificial Sequence
  Description of Artificial Sequence: Synthetic peptide
  Seed: SSPLVPGTL (MAGA4_HUMAN)
  misc_feature (2)..(2): Xaa can be Pro, Ala, Tyr, Glu, Leu, Gln, Ile, Arg, Val, Ser, Phe, Thr, Met, Gly, Asp, Trp, Cys, His, Asn, or Lys
  misc_feature (9)..(9): Xaa can be Val, Phe, Leu, Met, Tyr, Trp, Ile, Lys, Ala, Arg, His, Cys, Thr, Ser, Pro, Gln, or Gly
SXPLVPGTX

SEQ ID NO: 68145 - protein, 9 aa, Artificial Sequence
  Description of Artificial Sequence: Synthetic peptide
  Seed: SSSPLVPGT (MAGA4_HUMAN)
  misc_feature (2)..(2): Xaa can be Leu, Met, Ile, Val, Gln, Thr, Ala, Ser, Gly, Asn, Cys, Phe, Glu, Pro, Tyr, Trp, or Asp
  misc_feature (9)..(9): Xaa can be Val, Leu, Ile, Ala, Met, Thr, Cys, Phe, Ser, Gly, or Pro
SXSPLVPGX

SEQ ID NO: 68146 - protein, 10 aa, Artificial Sequence
  Description of Artificial Sequence: Synthetic peptide
  Seed: SSSPLVPGTL (MAGA4_HUMAN)
  misc_feature (2)..(2): Xaa can be Ala, Leu, Thr, Met, Val, Ile, Gln, Arg, Ser, Gly, Glu, Pro, Tyr, His, Cys, Phe, Asn, Asp, Trp, or Lys
  misc_feature (10)..(10): Xaa can be Leu, Phe, Tyr, Trp, Lys, Met, Arg, Ile, Val, His, Ala, Cys, Thr, Gln, or Ser
SXSPLVPGTX

SEQ ID NO: 68147 - protein, 11 aa, Artificial Sequence
  Description of Artificial Sequence: Synthetic peptide
  Seed: SSSSPLVPGTL (MAGA4_HUMAN)
  misc_feature (2)..(2): Xaa can be Ala, Ser, Thr, Val, Gly, Ile, Gln, Pro, Leu, Met, Cys, Arg, Glu, Asn, Phe, Tyr, His, Asp, Trp, or Lys
  misc_feature (11)..(11): Xaa can be Trp, Leu, Lys, Phe, Met, Tyr, Arg, His, Ile, Val, Cys, or Ala
SXSSPLVPGTX

SEQ ID NO: 68148 - protein, 9 aa, Artificial Sequence
  Description of Artificial Sequence: Synthetic peptide
  Seed: STSPDAESL (MAGA4_HUMAN)
  misc_feature (2)..(2): Xaa can be Ala, Glu, Gln, Met, Ser, Arg, Val, Leu, Ile, Pro, Thr, Tyr, Gly, Asp, Phe, Asn, Cys, Trp, His, or Lys
  misc_feature (9)..(9): Xaa can be Trp, Phe, Val, Tyr, Leu, Lys, Ile, Met, Arg, His, Ala, Cys, Thr, Gln, Pro, or Ser
SXSPDAESX

SEQ ID NO: 68149 - protein, 10 aa, Artificial Sequence
  Description of Artificial Sequence: Synthetic peptide
  Seed: STSPDAESLF (MAGA4_HUMAN)
  misc_feature (2)..(2): Xaa can be Ser, Thr, Ala, Leu, Met, Gln, Ile, Val, Gly, Glu, Phe, Tyr, Cys, Asn, Pro, Trp, Asp, Arg, Lys, or His
  misc_feature (10)..(10): Xaa can be Trp, Tyr, Phe, Lys, Arg, Leu, Met, Ile, Val, or His
SXSPDAESLX

SEQ ID NO: 68150 - protein, 11 aa, Artificial Sequence
  Description of Artificial Sequence: Synthetic peptide
  Seed: STSPDAESLFR (MAGA4_HUMAN)
  misc_feature (2)..(2): Xaa can be Ser, Ala, Thr, Leu, Ile, Val, Met, Gly, Gln, Tyr, Arg, Cys, Phe, Asn, Trp, Glu, Asp, Pro, Lys, or His
  misc_feature (11)..(11): Xaa can be Lys, Tyr, Arg, Phe, His, Leu, Trp, Met, Gln, Ile, or Val
SXSPDAESLFX

SEQ ID NO: 68151 - protein, 11 aa, Artificial Sequence
  Description of Artificial Sequence: Synthetic peptide
  Seed: SYDGLLGNNQI (MAGA4_HUMAN)
  misc_feature (2)..(2): Xaa can be Ala, Arg, Tyr, Thr, Val, Ile, Ser, Gly, Phe, Trp, Gln, His, Met, Leu, Cys, Pro, Asn, Glu, Asp, or Lys
  misc_feature (11)..(11): Xaa can be Leu, Met, Phe, Ile, Val, Tyr, Trp, Cys, Lys, Ala, or Arg
SXDGLLGNNQX

SEQ ID NO: 68152 - protein, 8 aa, Artificial Sequence
  Description of Artificial Sequence: Synthetic peptide
  Seed: SYVKVLEH (MAGA4_HUMAN)
  misc_feature (2)..(2): Xaa can be Tyr, Phe, or Trp
  misc_feature (8)..(8): Xaa can be Met, Tyr, Phe, Leu, Val, Ile, or His
SXVKVLEX

SEQ ID NO: 68153 - protein, 9 aa, Artificial Sequence
  Description of Artificial Sequence: Synthetic peptide
  Seed: SYVKVLEHV (MAGA4_HUMAN)
  misc_feature (2)..(2): Xaa can be Leu, Met, Arg, Gln, Tyr, Thr, Ile, Val, Ala, Asn, Trp, Ser, His, Phe, Gly, Lys, Asp, Glu, Cys, or Pro
  misc_feature (9)..(9): Xaa can be Tyr, Leu, Ile, Met, Val, Phe, Ala, Trp, Cys, Thr, Lys, Arg, Ser, His, or Gly
SXVKVLEHX

SEQ ID NO: 68154 - protein, 10 aa, Artificial Sequence
  Description of Artificial Sequence: Synthetic peptide
  Seed: SYVKVLEHVV (MAGA4_HUMAN)
  misc_feature (2)..(2): Xaa can be Tyr, Trp, or Phe
  misc_feature (10)..(10): Xaa can be Trp, Leu, Phe, Ile, Met, Val, or Tyr
SXVKVLEHVX

SEQ ID NO: 68155 - protein, 11 aa, Artificial Sequence
  Description of Artificial Sequence: Synthetic peptide
  Seed: SYVKVLEHVVR (MAGA4_HUMAN)
  misc_feature (2)..(2): Xaa can be Ser, Leu, Val, Thr, Met, Phe, Trp, Ile, Ala, Arg, or Tyr
  misc_feature (11)..(11): Xaa can be , or Arg
SXVKVLEHVVX

SEQ ID NO: 68156 - protein, 8 aa, Artificial Sequence
  Description of Artificial Sequence: Synthetic peptide
  Seed: TEEQEAAV (MAGA4_HUMAN)
  misc_feature (2)..(2): Xaa can be Glu, or Asp
  misc_feature (8)..(8): Xaa can be Leu, Phe, Thr, Met, Ile, Ala, Val, or Cys
TXEQEAAX

SEQ ID NO: 68157 - protein, 9 aa, Artificial Sequence
  Description of Artificial Sequence: Synthetic peptide
  Seed: TEEQEAAVS (MAGA4_HUMAN)
  misc_feature (2)..(2): Xaa can be Glu, Asp, Gln, or Ala
  misc_feature (9)..(9): Xaa can be Leu, Val, Met, Ala, Pro, Phe, Cys, Ile, Thr, Gln, Gly, Lys, Arg, Glu, Ser, Trp, or Tyr
TXEQEAAVX

SEQ ID NO: 68158 - protein, 10 aa, Artificial Sequence
  Description of Artificial Sequence: Synthetic peptide
  Seed: TEEQEAAVSS (MAGA4_HUMAN)
  misc_feature (2)..(2): Xaa can be Glu, Gln, or Asp
  misc_feature (10)..(10): Xaa can be Ala, Val, Leu, Ile, Cys, Met, Gln, Trp, Arg, Phe, Gly, Ser, Lys, Glu, Thr, Pro, or Tyr
TXEQEAAVSX

SEQ ID NO: 68159 - protein, 11 aa, Artificial Sequence
  Description of Artificial Sequence: Synthetic peptide
  Seed: TEEQEAAVSSS (MAGA4_HUMAN)
  misc_feature (2)..(2): Xaa can be Glu, Asp, or Gln
  misc_feature (11)..(11): Xaa can be Ile, Ala, Leu, Val, Cys, Met, Gly, Trp, Ser, Thr, Tyr, Phe, or Pro
TXEQEAAVSSX

SEQ ID NO: 68160 - protein, 8 aa, Artificial Sequence
  Description of Artificial Sequence: Synthetic peptide
  Seed: TGLLIIVL (MAGA4_HUMAN)
  misc_feature (2)..(2): Xaa can be Gln, Gly, Asn, Pro, Ser, Met, Asp, His, Glu, Ala, Ile, Thr, Val, Leu, or Lys
  misc_feature (8)..(8): Xaa can be Val, Ile, Leu, Met, Phe, Cys, or Ala
TXLLIIVX

SEQ ID NO: 68161 - protein, 8 aa, Artificial Sequence
  Description of Artificial Sequence: Synthetic peptide
  Seed: TISFTCWR (MAGA4_HUMAN)
  misc_feature (2)..(2): Xaa can be Phe, Thr, Met, Val, Tyr, Leu, Gln, Asn, Ser, Ile, Trp, or Ala
  misc_feature (8)..(8): Xaa can be Arg, or Lys
TXSFTCWX

SEQ ID NO: 68162 - protein, 10 aa, Artificial Sequence
  Description of Artificial Sequence: Synthetic peptide
  Seed: TLVTCLGLSY (MAGA4_HUMAN)
  misc_feature (2)..(2): Xaa can be Gln, Met, Ala, Lys, Leu, Ile, Val, Ser, Glu, His, Arg, Cys, Thr, Asp, Phe, Trp, Asn, Tyr, Pro, or Gly
  misc_feature (10)..(10): Xaa can be Tyr, Phe, Lys, Arg, Met, Leu, His, Trp, Ile, or Val
TXVTCLGLSX

SEQ ID NO: 68163 - protein, 9 aa, Artificial Sequence
  Description of Artificial Sequence: Synthetic peptide
  Seed: TQDWVQENY (MAGA4_HUMAN)
  misc_feature (2)..(2): Xaa can be Ala, Thr, Ser, Glu, Leu, Ile, Val, Met, Tyr, Phe, Gln, Asp, Trp, Asn, Gly, Cys, Pro, His, Arg, or Lys
  misc_feature (9)..(9): Xaa can be Met, Leu, Phe, Tyr, Lys, Val, Arg, Ile, Trp, Cys, His, Ala, Gln, or Thr
TXDWVQENX

SEQ ID NO: 68164 - protein, 10 aa, Artificial Sequence
  Description of Artificial Sequence: Synthetic peptide
  Seed: TQDWVQENYL (MAGA4_HUMAN)
  misc_feature (2)..(2): Xaa can be His, Glu, Ala, Gln, Met, Leu, Cys, Ser, Phe, Val, Ile, Gly, Thr, Arg, Tyr, Asn, Pro, or Tr p
  misc_feature (10)..(10): Xaa can be Met, Leu, Phe, Ile, Val, Trp, Tyr, Cys, or Ala
TXDWVQENYX

SEQ ID NO: 68165 - protein, 8 aa, Artificial Sequence
  Description of Artificial Sequence: Synthetic peptide
  Seed: TSPDAESL (MAGA4_HUMAN)
  misc_feature (2)..(2): Xaa can be Ile, Val, Leu, Ala, Met, Ser, Thr, Gly, Gln, Arg, Tyr, Phe, His, Cys, Asn, Asp, Trp, Glu, or Pro
  misc_feature (8)..(8): Xaa can be Leu, Met, Ile, Phe, Tyr, Lys, Val, or Arg
TXPDAESX

SEQ ID NO: 68166 - protein, 9 aa, Artificial Sequence
  Description of Artificial Sequence: Synthetic peptide
  Seed: TSPDAESLF (MAGA4_HUMAN)
  misc_feature (2)..(2): Xaa can be Ala, Tyr, Phe, Ser, Ile, Arg, Val, Met, Leu, Thr, Gly, Gln, Pro, Trp, Asn, Cys, Asp, Glu, His, or Lys
  misc_feature (9)..(9): Xaa can be Ile, Leu, Lys, Met, Phe, Tyr, Arg, Val, Trp, His, Cys, Ala, or Thr
TXPDAESLX

SEQ ID NO: 68167 - protein, 10 aa, Artificial Sequence
  Description of Artificial Sequence: Synthetic peptide
  Seed: TSPDAESLFR (MAGA4_HUMAN)
  misc_feature (2)..(2): Xaa can be Thr, Ser, Ala, Met, Val, Ile, Leu, Tyr, Phe, Gly, Gln, Cys, Trp, Asn, Asp, Pro, Glu, His, Lys, or Arg
  misc_feature (10)..(10): Xaa can be Lys, Tyr, Arg, Phe, Leu, Met, Trp, His, Ile, Val, or Gln
TXPDAESLFX

SEQ ID NO: 68168 - protein, 9 aa, Artificial Sequence
  Description of Artificial Sequence: Synthetic peptide
  Seed: TSYVKVLEH (MAGA4_HUMAN)
  misc_feature (2)..(2): Xaa can be Ala, Ser, Thr, Val, Gly, Met, Leu, Ile, Gln, Cys, Phe, Asn, Pro, Tyr, Glu, Trp, Asp, His, Arg, or Lys
  misc_feature (9)..(9): Xaa can be Tyr, Met, Phe, Leu, Lys, Arg, Ile, Val, His, Trp, Ala, Cys, Gln, Thr, or Ser
TXYVKVLEX

SEQ ID NO: 68169 - protein, 10 aa, Artificial Sequence
  Description of Artificial Sequence: Synthetic peptide
  Seed: TSYVKVLEHV (MAGA4_HUMAN)
  misc_feature (2)..(2): Xaa can be Gln, Thr, Ile, Met, Leu, Tyr, Val, Ala, Pro, Glu, Ser, Cys, Gly, Asn, Arg, Trp, His, Phe, Lys, or Asp
  misc_feature (10)..(10): Xaa can be Met, Trp, Val, Ile, Phe, Leu, Ala, or Tyr
TXYVKVLEHX

SEQ ID NO: 68170 - protein, 9 aa, Artificial Sequence
  Description of Artificial Sequence: Synthetic peptide
  Seed: TTEEQEAAV (MAGA4_HUMAN)
  misc_feature (2)..(2): Xaa can be Ala, Thr, Leu, Phe, Trp, Ile, Val, Gly, Met, Ser, Tyr, Gln, Asn, Cys, Asp, Pro, Glu, or Hi s
  misc_feature (9)..(9): Xaa can be Lys, Met, Leu, Arg, Ile, Phe, Val, Tyr, Trp, Ala, or Cys
TXEEQEAAX

SEQ ID NO: 68171 - protein, 8 aa, Artificial Sequence
  Description of Artificial Sequence: Synthetic peptide
  Seed: TTISFTCW (MAGA4_HUMAN)
  misc_feature (2)..(2): Xaa can be Thr, Ser, Cys, Ala, or Met
  misc_feature (8)..(8): Xaa can be Trp, or Phe
TXISFTCX

SEQ ID NO: 68172 - protein, 9 aa, Artificial Sequence
  Description of Artificial Sequence: Synthetic peptide
  Seed: TTISFTCWR (MAGA4_HUMAN)
  misc_feature (2)..(2): Xaa can be Thr, Val, Met, Leu, Ile, Ala, Ser, Gln, Trp, Cys, Asn, Phe, Glu, Asp, Gly, Tyr, His, Pro, Arg, or Lys
  misc_feature (9)..(9): Xaa can be Arg, Lys, Tyr, His, Met, Val, Leu, Ile, Ala, Phe, Gln, or Glu
TXISFTCWX

SEQ ID NO: 68173 - protein, 10 aa, Artificial Sequence
  Description of Artificial Sequence: Synthetic peptide
  Seed: TTISFTCWRQ (MAGA4_HUMAN)
  misc_feature (2)..(2): Xaa can be Thr, Tyr, Ile, Ala, Ser, Met, Val, Leu, Phe, Trp, Gln, His, Arg, Cys, Pro, Asn, Glu, Asp, Lys, or Gly
  misc_feature (10)..(10): Xaa can be Arg, Lys, Tyr, His, Val, Trp, Met, Gly, Ala, Gln, Leu, Ile, Ser, Cys, Thr, Phe, Asn, Pro, Asp, or Glu
TXISFTCWRX

SEQ ID NO: 68174 - protein, 8 aa, Artificial Sequence
  Description of Artificial Sequence: Synthetic peptide
  Seed: TVYGEPRK (MAGA4_HUMAN)
  misc_feature (2)..(2): Xaa can be Val, Thr, Ser, Ile, or Ala
  misc_feature (8)..(8): Xaa can be Lys, or Arg
TXYGEPRX

SEQ ID NO: 68175 - protein, 9 aa, Artificial Sequence
  Description of Artificial Sequence: Synthetic peptide
  Seed: TVYGEPRKL (MAGA4_HUMAN)
  misc_feature (2)..(2): Xaa can be Ala, Pro, Gln, Arg, Tyr, Met, Leu, Thr, Phe, Val, Ser, Glu, Ile, Gly, Trp, Asn, Asp, His, Cys, or Lys
  misc_feature (9)..(9): Xaa can be Phe, Met, Trp, Tyr, Val, Ile, Leu, Arg, Lys, His, Ala, Cys, Thr, Pro, Ser, Gln, or Gly
TXYGEPRKX

SEQ ID NO: 68176 - protein, 10 aa, Artificial Sequence
  Description of Artificial Sequence: Synthetic peptide
  Seed: TVYGEPRKLL (MAGA4_HUMAN)
  misc_feature (2)..(2): Xaa can be Ala, Thr, Ser, Val, Gly, Ile, Leu, Gln, Met, Glu, Asn, or Cys
  misc_feature (10)..(10): Xaa can be Tyr, Phe, Leu, Met, Trp, His, Ile, or Val
TXYGEPRKLX

SEQ ID NO: 68177 - protein, 8 aa, Artificial Sequence
  Description of Artificial Sequence: Synthetic peptide
  Seed: TYTLVTCL (MAGA4_HUMAN)
  misc_feature (2)..(2): Xaa can be Tyr, or Phe
  misc_feature (8)..(8): Xaa can be Tyr, Met, Leu, or Phe
TXTLVTCX

SEQ ID NO: 68178 - protein, 10 aa, Artificial Sequence
  Description of Artificial Sequence: Synthetic peptide
  Seed: TYTLVTCLGL (MAGA4_HUMAN)
  misc_feature (2)..(2): Xaa can be Tyr, Trp, or Phe
  misc_feature (10)..(10): Xaa can be Trp, Phe, Leu, Ile, Met, or Tyr
TXTLVTCLGX

SEQ ID NO: 68179 - protein, 8 aa, Artificial Sequence
  Description of Artificial Sequence: Synthetic peptide
  Seed: VDELAHFL (MAGA4_HUMAN)
  misc_feature (2)..(2): Xaa can be Glu, Ser, Ala, Asp, Thr, Ile, Gly, Tyr, Val, Asn, Met, Arg, Cys, Leu, His, Gln, or Phe
  misc_feature (8)..(8): Xaa can be Leu, Met, Ile, Val, Phe, Ala, Pro, Thr, or Cys
VXELAHFX

SEQ ID NO: 68180 - protein, 9 aa, Artificial Sequence
  Description of Artificial Sequence: Synthetic peptide
  Seed: VDELAHFLL (MAGA4_HUMAN)
  misc_feature (2)..(2): Xaa can be Glu, Asp, or Gln
  misc_feature (9)..(9): Xaa can be Phe, Leu, Met, Ile, Val, Tyr, Ala, Thr, Trp, or Cys
VXELAHFLX

SEQ ID NO: 68181 - protein, 11 aa, Artificial Sequence
  Description of Artificial Sequence: Synthetic peptide
  Seed: VDELAHFLLRK (MAGA4_HUMAN)
  misc_feature (2)..(2): Xaa can be Val, Asn, Ala, Cys, Glu, Tyr, Gln, Phe, Ser, Asp, Thr, Trp, Lys, Pro, Ile, Met, His, Leu, Gly, or Arg
  misc_feature (11)..(11): Xaa can be , or Lys
VXELAHFLLRX

SEQ ID NO: 68182 - protein, 10 aa, Artificial Sequence
  Description of Artificial Sequence: Synthetic peptide
  Seed: VDPASNTYTL (MAGA4_HUMAN)
  misc_feature (2)..(2): Xaa can be Tyr, Phe, Met, Trp, Lys, Ile, Asp, Cys, Ala, His, Asn, Gln, Ser, Val, Pro, Arg, Gly, Thr, Leu, or Glu
  misc_feature (10)..(10): Xaa can be Tyr, Leu, Phe, Ala, Ile, Met, Val, Trp, or His
VXPASNTYTX

SEQ ID NO: 68183 - protein, 8 aa, Artificial Sequence
  Description of Artificial Sequence: Synthetic peptide
  Seed: VEAQEEAL (MAGA4_HUMAN)
  misc_feature (2)..(2): Xaa can be Glu, or Asp
  misc_feature (8)..(8): Xaa can be Ile, Val, Met, Leu, Phe, Thr, Cys, Pro, Tyr, or Ala
VXAQEEAX

SEQ ID NO: 68184 - protein, 9 aa, Artificial Sequence
  Description of Artificial Sequence: Synthetic peptide
  Seed: VEAQEEALG (MAGA4_HUMAN)
  misc_feature (2)..(2): Xaa can be Glu, or Asp
  misc_feature (9)..(9): Xaa can be Ile, Leu, Val, Ala, Met, Tyr, Ser, Pro, Cys, Thr, Phe, or Gly
VXAQEEALX

SEQ ID NO: 68185 - protein, 10 aa, Artificial Sequence
  Description of Artificial Sequence: Synthetic peptide
  Seed: VEAQEEALGL (MAGA4_HUMAN)
  misc_feature (2)..(2): Xaa can be Glu, Gln, or Asp
  misc_feature (10)..(10): Xaa can be Phe, Leu, Trp, Lys, Tyr, Val, Ala, Ile, Gly, Thr, Ser, Met, Pro, Cys, or Arg
VXAQEEALGX

SEQ ID NO: 68186 - protein, 11 aa, Artificial Sequence
  Description of Artificial Sequence: Synthetic peptide
  Seed: VEAQEEALGLV (MAGA4_HUMAN)
  misc_feature (2)..(2): Xaa can be , or Glu
  misc_feature (11)..(11): Xaa can be Val, Ile, Pro, Thr, Ala, Ser, Met, Lys, Trp, Cys, Leu, or Phe
VXAQEEALGLX

SEQ ID NO: 68187 - protein, 10 aa, Artificial Sequence
  Description of Artificial Sequence: Synthetic peptide
  Seed: VIFGKASESL (MAGA4_HUMAN)
  misc_feature (2)..(2): Xaa can be Gln, Thr, Val, Ile, Ala, Ser, Leu, Met, Glu, Gly, Phe, Asn, Cys, Asp, Pro, or Tyr
  misc_feature (10)..(10): Xaa can be Tyr, Leu, Phe, Lys, Met, Arg, Val, Ile, Trp, Ala, His, Thr, or Cys
VXFGKASESX

SEQ ID NO: 68188 - protein, 11 aa, Artificial Sequence
  Description of Artificial Sequence: Synthetic peptide
  Seed: VIFGKASESLK (MAGA4_HUMAN)
  misc_feature (2)..(2): Xaa can be Ala, Thr, Val, Ser, Gln, Ile, Met, Gly, Asn, Leu, Asp, Glu, Cys, Tyr, Phe, Pro, or Trp
  misc_feature (11)..(11): Xaa can be Lys, Arg, Tyr, Phe, Leu, His, Met, or Trp
VXFGKASESLX

SEQ ID NO: 68189 - protein, 9 aa, Artificial Sequence
  Description of Artificial Sequence: Synthetic peptide
  Seed: VIKNYKRCF (MAGA4_HUMAN)
  misc_feature (2)..(2): Xaa can be Ala, Thr, Ser, Gln, Val, Met, Ile, Leu, Glu, Gly, Pro, Phe, or Asn
  misc_feature (9)..(9): Xaa can be Tyr, Phe, Met, Leu, Val, Ile, Trp, or His
VXKNYKRCX

SEQ ID NO: 68190 - protein, 11 aa, Artificial Sequence
  Description of Artificial Sequence: Synthetic peptide
  Seed: VIKNYKRCFPV (MAGA4_HUMAN)
  misc_feature (2)..(2): Xaa can be Met, Leu, or Ile
  misc_feature (11)..(11): Xaa can be Val, Ala, Ile, or Leu
VXKNYKRCFPX

SEQ ID NO: 68191 - protein, 11 aa, Artificial Sequence
  Description of Artificial Sequence: Synthetic peptide
  Seed: VKEVDPASNTY (MAGA4_HUMAN)
  misc_feature (2)..(2): Xaa can be Arg, Met, Gln, or Lys
  misc_feature (11)..(11): Xaa can be Tyr, or Phe
VXEVDPASNTX

SEQ ID NO: 68192 - protein, 10 aa, Artificial Sequence
  Description of Artificial Sequence: Synthetic peptide
  Seed: VKVLEHVVRV (MAGA4_HUMAN)
  misc_feature (2)..(2): Xaa can be Met, Leu, Tyr, Phe, Lys, Ser, Glu, Pro, Thr, Asp, Gly, Gln, Val, Trp, Ala, Arg, Ile, His, Asn, or Cys
  misc_feature (10)..(10): Xaa can be Ile, Val, Leu, Thr, Met, Ala, or Cys
VXVLEHVVRX

SEQ ID NO: 68193 - protein, 8 aa, Artificial Sequence
  Description of Artificial Sequence: Synthetic peptide
  Seed: VLEHVVRV (MAGA4_HUMAN)
  misc_feature (2)..(2): Xaa can be Met, or Leu
  misc_feature (8)..(8): Xaa can be Leu, or Val
VXEHVVRX

SEQ ID NO: 68194 - protein, 9 aa, Artificial Sequence
  Description of Artificial Sequence: Synthetic peptide
  Seed: VNARVRIAY (MAGA4_HUMAN)
  misc_feature (2)..(2): Xaa can be Ala, Gln, Ser, Met, Thr, His, Lys, Leu, Ile, Val, Gly, Arg, Glu, Pro, Asn, Cys, Phe, Tyr, Asp, or Trp
  misc_feature (9)..(9): Xaa can be Phe, Tyr, Met, Leu, Ile, Val, Trp, His, Ala, Gly, or Cys
VXARVRIAX

SEQ ID NO: 68195 - protein, 9 aa, Artificial Sequence
  Description of Artificial Sequence: Synthetic peptide
  Seed: VPAAESAGP (MAGA4_HUMAN)
  misc_feature (2)..(2): Xaa can be Pro, or Ala
  misc_feature (9)..(9): Xaa can be Ala, Leu, Tyr, Phe, Thr, Gly, Met, Pro, Val, Ser, Cys, or Ile
VXAAESAGX

SEQ ID NO: 68196 - protein, 10 aa, Artificial Sequence
  Description of Artificial Sequence: Synthetic peptide
  Seed: VPAAESAGPP (MAGA4_HUMAN)
  misc_feature (2)..(2): Xaa can be , or Pro
  misc_feature (10)..(10): Xaa can be Phe, Gly, Pro, Met, Tyr, Leu, Thr, Cys, Ala, Ser, Val, or Ile
VXAAESAGPX

SEQ ID NO: 68197 - protein, 11 aa, Artificial Sequence
  Description of Artificial Sequence: Synthetic peptide
  Seed: VPAAESAGPPQ (MAGA4_HUMAN)
  misc_feature (2)..(2): Xaa can be Pro, or Ala
  misc_feature (11)..(11): Xaa can be Leu, Cys, Met, Ala, Gln, His, Tyr, Ile, Arg, Val, Asn, Lys, Glu, Gly, Phe, Ser, Thr, Pro, or Trp
VXAAESAGPPX

SEQ ID NO: 68198 - protein, 9 aa, Artificial Sequence
  Description of Artificial Sequence: Synthetic peptide
  Seed: VPGSNPARY (MAGA4_HUMAN)
  misc_feature (2)..(2): Xaa can be Pro, Gln, His, Met, Ala, Ile, Leu, Val, Glu, Ser, Phe, Arg, Thr, Gly, Trp, Tyr, Asp, or As n
  misc_feature (9)..(9): Xaa can be Tyr, Phe, Met, Leu, or Trp
VXGSNPARX

SEQ ID NO: 68199 - protein, 11 aa, Artificial Sequence
  Description of Artificial Sequence: Synthetic peptide
  Seed: VPGSNPARYEF (MAGA4_HUMAN)
  misc_feature (2)..(2): Xaa can be Pro, Gly, Ile, Asn, Phe, Asp, Tyr, Gln, Glu, Met, Lys, Val, Ala, Thr, Leu, Arg, His, Trp, Cys, or Ser
  misc_feature (11)..(11): Xaa can be Phe, Trp, Val, Thr, Ala, Ile, Tyr, Leu, Pro, Cys, or Met
VXGSNPARYEX

SEQ ID NO: 68200 - protein, 8 aa, Artificial Sequence
  Description of Artificial Sequence: Synthetic peptide
  Seed: VPGTLEEV (MAGA4_HUMAN)
  misc_feature (2)..(2): Xaa can be Pro, Gln, or Ala
  misc_feature (8)..(8): Xaa can be Val, Leu, Ile, Phe, Met, or Ala
VXGTLEEX

SEQ ID NO: 68201 - protein, 9 aa, Artificial Sequence
  Description of Artificial Sequence: Synthetic peptide
  Seed: VPGTLEEVP (MAGA4_HUMAN)
  misc_feature (2)..(2): Xaa can be , or Pro
  misc_feature (9)..(9): Xaa can be Val, Met, Pro, Leu, Ala, Thr, Cys, or Ile
VXGTLEEVX

SEQ ID NO: 68202 - protein, 10 aa, Artificial Sequence
  Description of Artificial Sequence: Synthetic peptide
  Seed: VPGTLEEVPA (MAGA4_HUMAN)
  misc_feature (2)..(2): Xaa can be , or Pro
  misc_feature (10)..(10): Xaa can be Thr, Phe, Val, Ala, Ile, Leu, or Met
VXGTLEEVPX

SEQ ID NO: 68203 - protein, 11 aa, Artificial Sequence
  Description of Artificial Sequence: Synthetic peptide
  Seed: VPGTLEEVPAA (MAGA4_HUMAN)
  misc_feature (2)..(2): Xaa can be , or Pro
  misc_feature (11)..(11): Xaa can be Thr, Ala, Ile, Cys, Pro, Leu, Tyr, Gly, Met, Phe, Val, or Ser
VXGTLEEVPAX

SEQ ID NO: 68204 - protein, 8 aa, Artificial Sequence
  Description of Artificial Sequence: Synthetic peptide
  Seed: VRIAYPSL (MAGA4_HUMAN)
  misc_feature (2)..(2): Xaa can be His, Arg, Tyr, Phe, Ala, Gln, Pro, or Ser
  misc_feature (8)..(8): Xaa can be Leu, Phe, Met, Tyr, Ile, or Val
VXIAYPSX

SEQ ID NO: 68205 - protein, 9 aa, Artificial Sequence
  Description of Artificial Sequence: Synthetic peptide
  Seed: VRIAYPSLR (MAGA4_HUMAN)
  misc_feature (2)..(2): Xaa can be Arg, Tyr, Phe, Gln, Trp, Thr, Ser, Ala, Met, His, Gly, Lys, Asn, Leu, Ile, Val, Glu, Asp, Pro, or Cys
  misc_feature (9)..(9): Xaa can be Arg, Phe, Leu, Tyr, Met, Lys, Ile, Trp, Val, Ala, or His
VXIAYPSLX

SEQ ID NO: 68206 - protein, 9 aa, Artificial Sequence
  Description of Artificial Sequence: Synthetic peptide
  Seed: VRVNARVRI (MAGA4_HUMAN)
  misc_feature (2)..(2): Xaa can be Arg, His, Gln, Tyr, Ala, Phe, Trp, Glu, Lys, Asn, Gly, Asp, or Ser
  misc_feature (9)..(9): Xaa can be Leu, Phe, Met, Tyr, Ile, Val, Ala, Cys, Trp, His, Lys, or Arg
VXVNARVRX

SEQ ID NO: 68207 - protein, 10 aa, Artificial Sequence
  Description of Artificial Sequence: Synthetic peptide
  Seed: VRVNARVRIA (MAGA4_HUMAN)
  misc_feature (2)..(2): Xaa can be , or Arg
  misc_feature (10)..(10): Xaa can be , or Ala
VXVNARVRIX

SEQ ID NO: 68208 - protein, 11 aa, Artificial Sequence
  Description of Artificial Sequence: Synthetic peptide
  Seed: VRVNARVRIAY (MAGA4_HUMAN)
  misc_feature (2)..(2): Xaa can be Arg, Gln, Met, His, or Lys
  misc_feature (11)..(11): Xaa can be Tyr, Phe, Met, Leu, Arg, Lys, or Trp
VXVNARVRIAX

SEQ ID NO: 68209 - protein, 8 aa, Artificial Sequence
  Description of Artificial Sequence: Synthetic peptide
  Seed: VSSSSPLV (MAGA4_HUMAN)
  misc_feature (2)..(2): Xaa can be Thr, Ala, Ser, Gln, Met, Glu, Val, Gly, Leu, or Ile
  misc_feature (8)..(8): Xaa can be Leu, Ile, Val, or Met
VXSSSPLX

SEQ ID NO: 68210 - protein, 9 aa, Artificial Sequence
  Description of Artificial Sequence: Synthetic peptide
  Seed: VTKAEMLER (MAGA4_HUMAN)
  misc_feature (2)..(2): Xaa can be Thr, Leu, Met, Val, Ser, Gly, Asp, Asn, Glu, Ile, Phe, Ala, Gln, Tyr, Pro, Trp, His, or Cy s
  misc_feature (9)..(9): Xaa can be Arg, Lys, Tyr, Leu, His, Val, Phe, Met, or Ile
VXKAEMLEX

SEQ ID NO: 68211 - protein, 10 aa, Artificial Sequence
  Description of Artificial Sequence: Synthetic peptide
  Seed: VTKAEMLERV (MAGA4_HUMAN)
  misc_feature (2)..(2): Xaa can be Leu, Met, Ile, Val, Gln, or Thr
  misc_feature (10)..(10): Xaa can be Val, Ile, Leu, Ala, or Met
VXKAEMLERX

SEQ ID NO: 68212 - protein, 9 aa, Artificial Sequence
  Description of Artificial Sequence: Synthetic peptide
  Seed: VVRVNARVR (MAGA4_HUMAN)
  misc_feature (2)..(2): Xaa can be Thr, Val, Ser, Met, Ile, Phe, Tyr, Ala, Gln, Trp, Leu, Asn, His, Gly, or Cys
  misc_feature (9)..(9): Xaa can be Lys, Arg, Ala, Val, Leu, Tyr, Ile, Met, Ser, Gly, Thr, Phe, or Gln
VXRVNARVX

SEQ ID NO: 68213 - protein, 10 aa, Artificial Sequence
  Description of Artificial Sequence: Synthetic peptide
  Seed: VVRVNARVRI (MAGA4_HUMAN)
  misc_feature (2)..(2): Xaa can be Thr, Ser, Val, Met, Ile, Ala, Phe, Tyr, Gly, Asn, Leu, Gln, or Trp
  misc_feature (10)..(10): Xaa can be Lys, Ala, Val, Ile, Ser, Tyr, Leu, or Met
VXRVNARVRX

SEQ ID NO: 68214 - protein, 9 aa, Artificial Sequence
  Description of Artificial Sequence: Synthetic peptide
  Seed: VYDGREHTV (MAGA4_HUMAN)
  misc_feature (2)..(2): Xaa can be Tyr, Phe, Ala, Thr, Ser, Trp, Ile, Val, Met, Leu, Arg, Pro, Gly, Gln, Asn, Glu, His, Cys, Lys, or Asp
  misc_feature (9)..(9): Xaa can be Trp, Phe, Leu, Lys, Met, Val, Ile, Tyr, Cys, Ala, Thr, Arg, Ser, Gln, Pro, His, Gly, or Gl u
VXDGREHTX

SEQ ID NO: 68215 - protein, 10 aa, Artificial Sequence
  Description of Artificial Sequence: Synthetic peptide
  Seed: VYDGREHTVY (MAGA4_HUMAN)
  misc_feature (2)..(2): Xaa can be Tyr, Thr, Phe, Met, Ser, Ala, Leu, Val, Trp, Gly, Ile, Gln, Arg, Asn, Pro, Glu, Cys, His, Lys, or Asp
  misc_feature (10)..(10): Xaa can be Tyr, Phe, Met, Leu, Trp, Lys, Ile, Arg, Val, His, Cys, Ala, or Gln
VXDGREHTVX

SEQ ID NO: 68216 - protein, 8 aa, Artificial Sequence
  Description of Artificial Sequence: Synthetic peptide
  Seed: VYGEPRKL (MAGA4_HUMAN)
  misc_feature (2)..(2): Xaa can be Ala, Tyr, Thr, Val, Ile, Ser, Leu, Phe, Gly, Asn, Gln, Met, Arg, Trp, Cys, His, Glu, Asp, Lys, or Pro
  misc_feature (8)..(8): Xaa can be Met, Leu, Phe, Ile, Tyr, Val, Lys, Arg, Trp, His, Cys, or Ala
VXGEPRKX

SEQ ID NO: 68217 - protein, 9 aa, Artificial Sequence
  Description of Artificial Sequence: Synthetic peptide
  Seed: VYGEPRKLL (MAGA4_HUMAN)
  misc_feature (2)..(2): Xaa can be Arg, Ala, Ser, Tyr, Thr, Gly, Phe, Ile, Val, Trp, Gln, Glu, His, Asn, Met, Leu, Cys, Pro, Lys, or Asp
  misc_feature (9)..(9): Xaa can be Leu, Met, Phe, Tyr, Ile, Val, Lys, Trp, Arg, Ala, His, or Cys
VXGEPRKLX

SEQ ID NO: 68218 - protein, 9 aa, Artificial Sequence
  Description of Artificial Sequence: Synthetic peptide
  Seed: WEELGVMGV (MAGA4_HUMAN)
  misc_feature (2)..(2): Xaa can be Glu, Asp, or Gln
  misc_feature (9)..(9): Xaa can be Leu, Phe, Met, Val, Pro, Cys, Thr, Ser, Ile, Trp, Tyr, Gly, or Ala
WXELGVMGX

SEQ ID NO: 68219 - protein, 10 aa, Artificial Sequence
  Description of Artificial Sequence: Synthetic peptide
  Seed: WEELGVMGVY (MAGA4_HUMAN)
  misc_feature (2)..(2): Xaa can be Gln, Met, Asp, Gly, Tyr, Phe, Ala, Ile, Lys, His, Cys, Pro, Glu, Thr, Leu, Trp, Arg, Val, Asn, or Ser
  misc_feature (10)..(10): Xaa can be Tyr, Met, Trp, Phe, or Leu
WXELGVMGVX

SEQ ID NO: 68220 - protein, 9 aa, Artificial Sequence
  Description of Artificial Sequence: Synthetic peptide
  Seed: WVQENYLEY (MAGA4_HUMAN)
  misc_feature (2)..(2): Xaa can be Pro, Tyr, Gln, Ala, Arg, Phe, Met, Leu, Gly, Thr, Ile, Val, Ser, Lys, Trp, Glu, Asn, Asp, Cys, or His
  misc_feature (9)..(9): Xaa can be Phe, Met, Tyr, Leu, Trp, Val, Arg, Lys, Ile, His, Ala, Thr, Cys, Gly, Gln, Glu, Ser, or As n
WXQENYLEX

SEQ ID NO: 68221 - protein, 10 aa, Artificial Sequence
  Description of Artificial Sequence: Synthetic peptide
  Seed: WVQENYLEYR (MAGA4_HUMAN)
  misc_feature (2)..(2): Xaa can be Met, Ser, Ile, Tyr, Trp, Val, Gln, Ala, Phe, Thr, Leu, His, Cys, Arg, Gly, Lys, or Asn
  misc_feature (10)..(10): Xaa can be Arg, Lys, or Tyr
WXQENYLEYX

SEQ ID NO: 68222 - protein, 8 aa, Artificial Sequence
  Description of Artificial Sequence: Synthetic peptide
  Seed: YDGREHTV (MAGA4_HUMAN)
  misc_feature (2)..(2): Xaa can be Glu, Asp, or Gln
  misc_feature (8)..(8): Xaa can be Leu, Tyr, Met, Ala, Phe, Ile, Val, Pro, Trp, Cys, Ser, or Thr
YXGREHTX

SEQ ID NO: 68223 - protein, 9 aa, Artificial Sequence
  Description of Artificial Sequence: Synthetic peptide
  Seed: YDGREHTVY (MAGA4_HUMAN)
  misc_feature (2)..(2): Xaa can be Ala, Glu, Asp, Val, Ser, Gln, Thr, Met, Ile, Gly, Lys, Pro, Leu, Cys, Arg, Phe, Tyr, His, Asn, or Trp
  misc_feature (9)..(9): Xaa can be Tyr, Phe, Met, Leu, His, Ile, Val, Lys, Trp, Ala, or Cys
YXGREHTVX

SEQ ID NO: 68224 - protein, 9 aa, Artificial Sequence
  Description of Artificial Sequence: Synthetic peptide
  Seed: YKRCFPVIF (MAGA4_HUMAN)
  misc_feature (2)..(2): Xaa can be Gln, Arg, Met, Lys, Ala, His, Glu, Ser, Leu, Phe, Tyr, Ile, Gly, Pro, Val, Trp, Thr, Asn, Asp, or Cys
  misc_feature (9)..(9): Xaa can be Tyr, Phe, Met, Leu, Ile, Trp, His, Val, Ala, Cys, Gly, Arg, Lys, Thr, Ser, Pro, Asn, or Gl n
YXRCFPVIX

SEQ ID NO: 68225 - protein, 8 aa, Artificial Sequence
  Description of Artificial Sequence: Synthetic peptide
  Seed: YPSLREAA (MAGA4_HUMAN)
  misc_feature (2)..(2): Xaa can be Pro, or Ala
  misc_feature (8)..(8): Xaa can be Leu, Met, Tyr, Ile, Cys, Ala, Pro, Val, Phe, Thr, or Ser
YXSLREAX

SEQ ID NO: 68226 - protein, 9 aa, Artificial Sequence
  Description of Artificial Sequence: Synthetic peptide
  Seed: YPSLREAAL (MAGA4_HUMAN)
  misc_feature (2)..(2): Xaa can be Pro, His, Gln, Ala, Ser, Arg, Met, Ile, Leu, Glu, Gly, Val, Phe, Lys, Thr, Tyr, Asn, Cys, Asp, or Trp
  misc_feature (9)..(9): Xaa can be Tyr, Met, Phe, Leu, Ile, Val, Trp, Ala, Cys, Thr, His, Pro, Ser, Gly, Lys, Glu, Arg, or Gl n
YXSLREAAX

SEQ ID NO: 68227 - protein, 10 aa, Artificial Sequence
  Description of Artificial Sequence: Synthetic peptide
  Seed: YPSLREAALL (MAGA4_HUMAN)
  misc_feature (2)..(2): Xaa can be Pro, Met, Asp, Phe, His, Cys, Gln, Tyr, Ala, Ile, Lys, Thr, Gly, Trp, Leu, Val, Arg, Asn, Glu, or Ser
  misc_feature (10)..(10): Xaa can be Tyr, Leu, Ile, Trp, Met, Phe, Ala, Val, Cys, Pro, Gly, Gln, Ser, Arg, Glu, Lys, Asn, Thr, His, or Asp
YXSLREAALX

SEQ ID NO: 68228 - protein, 9 aa, Artificial Sequence
  Description of Artificial Sequence: Synthetic peptide
  Seed: YRAKELVTK (MAGA4_HUMAN)
  misc_feature (2)..(2): Xaa can be Arg, Asn, Lys, Tyr, Gln, Gly, His, Trp, Thr, Leu, Ala, Phe, Ser, Ile, Met, Val, Glu, Pro, Cys, or Asp
  misc_feature (9)..(9): Xaa can be Leu, Met, Phe, Tyr, Ile, Val, Lys, Arg, Trp, Cys, Asn, Ala, Pro, Glu, Gly, His, Thr, Gln, or Ser
YXAKELVTX

SEQ ID NO: 68229 - protein, 10 aa, Artificial Sequence
  Description of Artificial Sequence: Synthetic peptide
  Seed: YRAKELVTKA (MAGA4_HUMAN)
  misc_feature (2)..(2): Xaa can be Arg, Tyr, Gln, His, Lys, Ala, or Phe
  misc_feature (10)..(10): Xaa can be Phe, Tyr, Leu, Met, Ala, Ile, Arg, Gln, Lys, Trp, Val, Cys, or His
YXAKELVTKX

SEQ ID NO: 68230 - protein, 9 aa, Artificial Sequence
  Description of Artificial Sequence: Synthetic peptide
  Seed: YRQVPGSNP (MAGA4_HUMAN)
  misc_feature (2)..(2): Xaa can be Arg, His, or Gln
  misc_feature (9)..(9): Xaa can be Ala, Leu, Val, Thr, Gly, Ile, Pro, Met, or Cys
YXQVPGSNX

SEQ ID NO: 68231 - protein, 10 aa, Artificial Sequence
  Description of Artificial Sequence: Synthetic peptide
  Seed: YRQVPGSNPA (MAGA4_HUMAN)
  misc_feature (2)..(2): Xaa can be His, Arg, Met, Leu, Val, Asp, Thr, Gly, Trp, Ala, Gln, Phe, Lys, Tyr, Ile, Asn, Cys, Glu, Ser, or Pro
  misc_feature (10)..(10): Xaa can be Phe, Ile, His, Ala, Leu, Val, Tyr, Met, Trp, Thr, Pro, or Cys
YXQVPGSNPX

SEQ ID NO: 68232 - protein, 11 aa, Artificial Sequence
  Description of Artificial Sequence: Synthetic peptide
  Seed: YRQVPGSNPAR (MAGA4_HUMAN)
  misc_feature (2)..(2): Xaa can be Arg, Tyr, Trp, His, Phe, Ala, Gly, Gln, Lys, Asn, Ser, Thr, or Met
  misc_feature (11)..(11): Xaa can be Phe, Tyr, Met, Leu, Trp, Ile, His, Val, Arg, or Lys
YXQVPGSNPAX

SEQ ID NO: 68233 - protein, 9 aa, Artificial Sequence
  Description of Artificial Sequence: Synthetic peptide
  Seed: YTLVTCLGL (MAGA4_HUMAN)
  misc_feature (2)..(2): Xaa can be Met, Ala, Leu, Gln, Val, Thr, Ile, Gly, Ser, Asn, Cys, Phe, Pro, Arg, Glu, Asp, Tyr, Lys, His, or Trp
  misc_feature (9)..(9): Xaa can be Tyr, Phe, Trp, Val, Leu, Met, Ile, Ala, Thr, Ser, His, Lys, Cys, or Arg
YXLVTCLGX

SEQ ID NO: 68234 - protein, 11 aa, Artificial Sequence
  Description of Artificial Sequence: Synthetic peptide
  Seed: YTLVTCLGLSY (MAGA4_HUMAN)
  misc_feature (2)..(2): Xaa can be Ser, Thr, Met, Gln, Leu, Ala, Ile, Gly, Cys, Val, Asn, Trp, Phe, Glu, Pro, Asp, Lys, Tyr, Arg, or His
  misc_feature (11)..(11): Xaa can be Tyr, Trp, Phe, Met, Leu, or Ile
YXLVTCLGLSX

SEQ ID NO: 68235 - protein, 9 aa, Artificial Sequence
  Description of Artificial Sequence: Synthetic peptide
  Seed: YVKVLEHVV (MAGA4_HUMAN)
  misc_feature (2)..(2): Xaa can be Ala, Gln, Ser, Pro, Thr, Val, Gly, Ile, Met, Asn, Leu, Arg, Asp, Tyr, Glu, Phe, Lys, Cys, His, or Trp
  misc_feature (9)..(9): Xaa can be Leu, Met, Val, Phe, Tyr, Ile, His, Ala, Trp, Lys, Cys, Thr, Arg, Ser, or Gln
YXKVLEHVX

SEQ ID NO: 68236 - protein, 10 aa, Artificial Sequence
  Description of Artificial Sequence: Synthetic peptide
  Seed: YVKVLEHVVR (MAGA4_HUMAN)
  misc_feature (2)..(2): Xaa can be Met, Ile, Val, Tyr, Leu, Phe, Thr, Ala, Ser, Trp, or Gln
  misc_feature (10)..(10): Xaa can be Arg, or Lys
YXKVLEHVVX

SEQ ID NO: 68237 - protein, 11 aa, Artificial Sequence
  Description of Artificial Sequence: Synthetic peptide
  Seed: YVKVLEHVVRV (MAGA4_HUMAN)
  misc_feature (2)..(2): Xaa can be Met, Leu, Ile, Gln, Phe, Lys, Pro, Cys, Glu, Thr, Ser, Asn, Arg, Tyr, Asp, Val, Ala, His, Trp, or Gly
  misc_feature (11)..(11): Xaa can be Ile, Leu, Ala, Val, Met, Ser, Cys, Thr, or Phe
YXKVLEHVVRX

SEQ ID NO: 68238 - protein, 10 aa, Artificial Sequence
  Description of Artificial Sequence: Synthetic peptide
  Seed: EVIWDVLSGI (MAGC1_HUMAN)
ETIWDVLSGM

SEQ ID NO: 68239 - protein, 9 aa, Artificial Sequence
  Description of Artificial Sequence: Synthetic peptide
  Seed: FSEESSSPV (MAGC1_HUMAN)
FAEESSSPL

SEQ ID NO: 68240 - protein, 9 aa, Artificial Sequence
  Description of Artificial Sequence: Synthetic peptide
  Seed: FSEESSSPV (MAGC1_HUMAN)
FAEESSSPM

SEQ ID NO: 68241 - protein, 9 aa, Artificial Sequence
  Description of Artificial Sequence: Synthetic peptide
  Seed: FAFGEPREL (MAGC1_HUMAN)
FAFGEPREF

SEQ ID NO: 68242 - protein, 9 aa, Artificial Sequence
  Description of Artificial Sequence: Synthetic peptide
  Seed: FPSSTSSSL (MAGC1_HUMAN)
FPSSTSSSM

SEQ ID NO: 68243 - protein, 9 aa, Artificial Sequence
  Description of Artificial Sequence: Synthetic peptide
  Seed: FAFGEPREL (MAGC1_HUMAN)
FQFGEPREL

SEQ ID NO: 68244 - protein, 9 aa, Artificial Sequence
  Description of Artificial Sequence: Synthetic peptide
  Seed: FAFGEPREL (MAGC1_HUMAN)
FQFGEPREM

SEQ ID NO: 68245 - protein, 9 aa, Artificial Sequence
  Description of Artificial Sequence: Synthetic peptide
  Seed: FAFGEPREL (MAGC1_HUMAN)
FRFGEPREF

SEQ ID NO: 68246 - protein, 9 aa, Artificial Sequence
  Description of Artificial Sequence: Synthetic peptide
  Seed: FAFGEPREL (MAGC1_HUMAN)
FRFGEPREI

SEQ ID NO: 68247 - protein, 9 aa, Artificial Sequence
  Description of Artificial Sequence: Synthetic peptide
  Seed: FAFGEPREL (MAGC1_HUMAN)
FRFGEPREM

SEQ ID NO: 68248 - protein, 9 aa, Artificial Sequence
  Description of Artificial Sequence: Synthetic peptide
  Seed: FAFGEPREL (MAGC1_HUMAN)
FYFGEPREM

SEQ ID NO: 68249 - protein, 9 aa, Artificial Sequence
  Description of Artificial Sequence: Synthetic peptide
  Seed: KVVEFLAML (MAGC1_HUMAN)
KAVEFLAMV

SEQ ID NO: 68250 - protein, 9 aa, Artificial Sequence
  Description of Artificial Sequence: Synthetic peptide
  Seed: KVVEFLAML (MAGC1_HUMAN)
KTVEFLAMV

SEQ ID NO: 68251 - protein, 9 aa, Artificial Sequence
  Description of Artificial Sequence: Synthetic peptide
  Seed: LQIPGSPSF (MAGC1_HUMAN)
LAIPGSPSF

SEQ ID NO: 68252 - protein, 10 aa, Artificial Sequence
  Description of Artificial Sequence: Synthetic peptide
  Seed: LAMLKNTVPI (MAGC1_HUMAN)
LMMLKNTVPV

SEQ ID NO: 68253 - protein, 9 aa, Artificial Sequence
  Description of Artificial Sequence: Synthetic peptide
  Seed: LQRPVSSFF (MAGC1_HUMAN)
LMRPVSSFY

SEQ ID NO: 68254 - protein, 10 aa, Artificial Sequence
  Description of Artificial Sequence: Synthetic peptide
  Seed: LIESEPLFTY (MAGC1_HUMAN)
LTESEPLFTY

SEQ ID NO: 68255 - protein, 9 aa, Artificial Sequence
  Description of Artificial Sequence: Synthetic peptide
  Seed: MTSSFSSTL (MAGC1_HUMAN)
MASSFSSTL

SEQ ID NO: 68256 - protein, 9 aa, Artificial Sequence
  Description of Artificial Sequence: Synthetic peptide
  Seed: MTSSFSSTL (MAGC1_HUMAN)
MTSSFSSTF

SEQ ID NO: 68257 - protein, 10 aa, Artificial Sequence
  Description of Artificial Sequence: Synthetic peptide
  Seed: REFIEILFGI (MAGC1_HUMAN)
REFIEILFGF

SEQ ID NO: 68258 - protein, 10 aa, Artificial Sequence
  Description of Artificial Sequence: Synthetic peptide
  Seed: SFPSSTSSSL (MAGC1_HUMAN)
SMPSSTSSSL

SEQ ID NO: 68259 - protein, 10 aa, Artificial Sequence
  Description of Artificial Sequence: Synthetic peptide
  Seed: SRYTGYFPVI (MAGC1_HUMAN)
SRYTGYFPVF

SEQ ID NO: 68260 - protein, 9 aa, Artificial Sequence
  Description of Artificial Sequence: Synthetic peptide
  Seed: SLFQSFSER (MAGC1_HUMAN)
STFQSFSER

SEQ ID NO: 68261 - protein, 10 aa, Artificial Sequence
  Description of Artificial Sequence: Synthetic peptide
  Seed: SFSYTLLSLF (MAGC1_HUMAN)
SYSYTLLSLW

SEQ ID NO: 68262 - protein, 9 aa, Artificial Sequence
  Description of Artificial Sequence: Synthetic peptide
  Seed: TLDEKVDEL (MAGC1_HUMAN)
TFDEKVDEM

SEQ ID NO: 68263 - protein, 9 aa, Artificial Sequence
  Description of Artificial Sequence: Synthetic peptide
  Seed: TLDEKVDEL (MAGC1_HUMAN)
TYDEKVDEL

SEQ ID NO: 68264 - protein, 9 aa, Artificial Sequence
  Description of Artificial Sequence: Synthetic peptide
  Seed: TLDEKVDEL (MAGC1_HUMAN)
TYDEKVDEM

SEQ ID NO: 68265 - protein, 9 aa, Artificial Sequence
  Description of Artificial Sequence: Synthetic peptide
  Seed: TFEGFPQSL (MAGC1_HUMAN)
TYEGFPQSF

SEQ ID NO: 68266 - protein, 9 aa, Artificial Sequence
  Description of Artificial Sequence: Synthetic peptide
  Seed: VSPSFSSTL (MAGC1_HUMAN)
VAPSFSSTL

SEQ ID NO: 68267 - protein, 10 aa, Artificial Sequence
  Description of Artificial Sequence: Synthetic peptide
  Seed: VPITFPSSYK (MAGC1_HUMAN)
VIITFPSSYK

SEQ ID NO: 68268 - protein, 10 aa, Artificial Sequence
  Description of Artificial Sequence: Synthetic peptide
  Seed: VPITFPSSYK (MAGC1_HUMAN)
VMITFPSSYK

SEQ ID NO: 68269 - protein, 9 aa, Artificial Sequence
  Description of Artificial Sequence: Synthetic peptide
  Seed: VSPSSSSTL (MAGC1_HUMAN)
VMPSSSSTL

SEQ ID NO: 68270 - protein, 9 aa, Artificial Sequence
  Description of Artificial Sequence: Synthetic peptide
  Seed: VSPSSSSTL (MAGC1_HUMAN)
VMPSSSSTM

SEQ ID NO: 68271 - protein, 9 aa, Artificial Sequence
  Description of Artificial Sequence: Synthetic peptide
  Seed: WVQEHYLEY (MAGC1_HUMAN)
WMQEHYLEY

SEQ ID NO: 68272 - protein, 9 aa, Artificial Sequence
  Description of Artificial Sequence: Synthetic peptide
  Seed: WVQEHYLEY (MAGC1_HUMAN)
WTQEHYLEY

SEQ ID NO: 68273 - protein, 9 aa, Homo sapiens
  Native (MAGC1_HUMAN)
AMLKNTVPI

SEQ ID NO: 68274 - protein, 9 aa, Homo sapiens
  Native (MAGC1_HUMAN)
AQSPLQIPV

SEQ ID NO: 68275 - protein, 9 aa, Homo sapiens
  Native (MAGC1_HUMAN)
AQSSLQIPV

SEQ ID NO: 68276 - protein, 9 aa, Homo sapiens
  Native (MAGC1_HUMAN)
ELARFLLLK

SEQ ID NO: 68277 - protein, 9 aa, Homo sapiens
  Native (MAGC1_HUMAN)
FAFGEPREL

SEQ ID NO: 68278 - protein, 9 aa, Homo sapiens
  Native (MAGC1_HUMAN)
FLAMLKNTV

SEQ ID NO: 68279 - protein, 10 aa, Homo sapiens
  Native (MAGC1_HUMAN)
FPQSPLQIPM

SEQ ID NO: 68280 - protein, 9 aa, Homo sapiens
  Native (MAGC1_HUMAN)
FPSSTSSSL

SEQ ID NO: 68281 - protein, 9 aa, Homo sapiens
  Native (MAGC1_HUMAN)
FQSSLQSPV

SEQ ID NO: 68282 - protein, 9 aa, Homo sapiens
  Native (MAGC1_HUMAN)
FSEESSSPV

SEQ ID NO: 68283 - protein, 9 aa, Homo sapiens
  Native (MAGC1_HUMAN)
FSSALLSIF

SEQ ID NO: 68284 - protein, 9 aa, Homo sapiens
  Native (MAGC1_HUMAN)
FSSTLVSLF

SEQ ID NO: 68285 - protein, 9 aa, Homo sapiens
  Native (MAGC1_HUMAN)
FTYTLDEKV

SEQ ID NO: 68286 - protein, 9 aa, Homo sapiens
  Native (MAGC1_HUMAN)
GSPSFSSTL

SEQ ID NO: 68287 - protein, 10 aa, Homo sapiens
  Native (MAGC1_HUMAN)
GTYASEEVIW

SEQ ID NO: 68288 - protein, 9 aa, Homo sapiens
  Native (MAGC1_HUMAN)
IEILFGISL

SEQ ID NO: 68289 - protein, 9 aa, Homo sapiens
  Native (MAGC1_HUMAN)
IESEPLFTY

SEQ ID NO: 68290 - protein, 9 aa, Homo sapiens
  Native (MAGC1_HUMAN)
KAREFIEIL

SEQ ID NO: 68291 - protein, 10 aa, Homo sapiens
  Native (MAGC1_HUMAN)
KVVEFLAMLK

SEQ ID NO: 68292 - protein, 9 aa, Homo sapiens
  Native (MAGC1_HUMAN)
LQIPVSRSF

SEQ ID NO: 68293 - protein, 9 aa, Homo sapiens
  Native (MAGC1_HUMAN)
MLTNVISRY

SEQ ID NO: 68294 - protein, 9 aa, Homo sapiens
  Native (MAGC1_HUMAN)
MPTAGMPSL

SEQ ID NO: 68295 - protein, 9 aa, Homo sapiens
  Native (MAGC1_HUMAN)
MTSSFSSTL

SEQ ID NO: 68296 - protein, 11 aa, Homo sapiens
  Native (MAGC1_HUMAN)
NSSPPRYEFLW

SEQ ID NO: 68297 - protein, 9 aa, Homo sapiens
  Native (MAGC1_HUMAN)
NVISRYTGY

SEQ ID NO: 68298 - protein, 9 aa, Homo sapiens
  Native (MAGC1_HUMAN)
QIVPSLPEW

SEQ ID NO: 68299 - protein, 11 aa, Homo sapiens
  Native (MAGC1_HUMAN)
QSSPESDDTLY

SEQ ID NO: 68300 - protein, 11 aa, Homo sapiens
  Native (MAGC1_HUMAN)
RSFSSTLLSIF

SEQ ID NO: 68301 - protein, 9 aa, Homo sapiens
  Native (MAGC1_HUMAN)
RTHSTFEGF

SEQ ID NO: 68302 - protein, 10 aa, Homo sapiens
  Native (MAGC1_HUMAN)
RTQSTFEGFA

SEQ ID NO: 68303 - protein, 9 aa, Homo sapiens
  Native (MAGC1_HUMAN)
RYTGYFPVI

SEQ ID NO: 68304 - protein, 9 aa, Homo sapiens
  Native (MAGC1_HUMAN)
SAPEGEDSL

SEQ ID NO: 68305 - protein, 9 aa, Homo sapiens
  Native (MAGC1_HUMAN)
SEPLFTYTL

SEQ ID NO: 68306 - protein, 9 aa, Homo sapiens
  Native (MAGC1_HUMAN)
SFSSTLLSL

SEQ ID NO: 68307 - protein, 10 aa, Homo sapiens
  Native (MAGC1_HUMAN)
SFSSTLLSLF

SEQ ID NO: 68308 - protein, 10 aa, Homo sapiens
  Native (MAGC1_HUMAN)
SFSYTLLSLF

SEQ ID NO: 68309 - protein, 9 aa, Homo sapiens
  Native (MAGC1_HUMAN)
SIFQSSPER

SEQ ID NO: 68310 - protein, 9 aa, Homo sapiens
  Native (MAGC1_HUMAN)
SLFQSFSER

SEQ ID NO: 68311 - protein, 9 aa, Homo sapiens
  Native (MAGC1_HUMAN)
SPLQIVPSL

SEQ ID NO: 68312 - protein, 9 aa, Homo sapiens
  Native (MAGC1_HUMAN)
SRSFSSTLL

SEQ ID NO: 68313 - protein, 9 aa, Homo sapiens
  Native (MAGC1_HUMAN)
SSSSTLLSL

SEQ ID NO: 68314 - protein, 9 aa, Homo sapiens
  Native (MAGC1_HUMAN)
TFEGFPQSL

SEQ ID NO: 68315 - protein, 9 aa, Homo sapiens
  Native (MAGC1_HUMAN)
TGYFPVIFR

SEQ ID NO: 68316 - protein, 9 aa, Homo sapiens
  Native (MAGC1_HUMAN)
TLDEKVDEL

SEQ ID NO: 68317 - protein, 9 aa, Homo sapiens
  Native (MAGC1_HUMAN)
TPSSLPQSF

SEQ ID NO: 68318 - protein, 10 aa, Homo sapiens
  Native (MAGC1_HUMAN)
VPITFPSSYK

SEQ ID NO: 68319 - protein, 9 aa, Homo sapiens
  Native (MAGC1_HUMAN)
VSPSFSSTL

SEQ ID NO: 68320 - protein, 9 aa, Homo sapiens
  Native (MAGC1_HUMAN)
VSPSSSSTL

SEQ ID NO: 68321 - protein, 9 aa, Homo sapiens
  Native (MAGC1_HUMAN)
WVQEHYLEY

SEQ ID NO: 68322 - protein, 9 aa, Artificial Sequence
  Description of Artificial Sequence: Synthetic peptide
  Seed: SSFFSYTLA (MAGC1_HUMAN)
STFFSYTLL

SEQ ID NO: 68323 - protein, 10 aa, Artificial Sequence
  Description of Artificial Sequence: Synthetic peptide
  Seed: SFSSTLLSIF (MAGC1_HUMAN)
SPSSTLLSIF

SEQ ID NO: 68324 - protein, 9 aa, Artificial Sequence
  Description of Artificial Sequence: Synthetic peptide
  Seed: TLLSILQSS (MAGC1_HUMAN)
TVLSILQSM

SEQ ID NO: 68325 - protein, 9 aa, Artificial Sequence
  Description of Artificial Sequence: Synthetic peptide
  Seed: KVWVQEHYL (MAGC1_HUMAN)
KMWVQEHYA

SEQ ID NO: 68326 - protein, 9 aa, Artificial Sequence
  Description of Artificial Sequence: Synthetic peptide
  Seed: LSPLHFPQF (MAGC1_HUMAN)
LAPLHFPQW

SEQ ID NO: 68327 - protein, 10 aa, Artificial Sequence
  Description of Artificial Sequence: Synthetic peptide
  Seed: VSSSSSSTLL (MAGC1_HUMAN)
VRSSSSSTLW

SEQ ID NO: 68328 - protein, 10 aa, Artificial Sequence
  Description of Artificial Sequence: Synthetic peptide
  Seed: ICSSSTSLSL (MAGC1_HUMAN)
IFSSSTSLSW

SEQ ID NO: 68329 - protein, 10 aa, Artificial Sequence
  Description of Artificial Sequence: Synthetic peptide
  Seed: FSSSTSLSPF (MAGC1_HUMAN)
FCSSTSLSPW

SEQ ID NO: 68330 - protein, 9 aa, Artificial Sequence
  Description of Artificial Sequence: Synthetic peptide
  Seed: SLFQSFSER (MAGC1_HUMAN)
SSFQSFSEH

SEQ ID NO: 68331 - protein, 10 aa, Artificial Sequence
  Description of Artificial Sequence: Synthetic peptide
  Seed: VSAASSSTLV (MAGC1_HUMAN)
VLAASSSTLV

SEQ ID NO: 68332 - protein, 9 aa, Artificial Sequence
  Description of Artificial Sequence: Synthetic peptide
  Seed: AGREHFAFG (MAGC1_HUMAN)
AVREHFAFY

SEQ ID NO: 68333 - protein, 9 aa, Artificial Sequence
  Description of Artificial Sequence: Synthetic peptide
  Seed: RSFSSTLLS (MAGC1_HUMAN)
RAFSSTLLL

SEQ ID NO: 68334 - protein, 9 aa, Artificial Sequence
  Description of Artificial Sequence: Synthetic peptide
  Seed: SSPESTQSP (MAGC1_HUMAN)
SLPESTQSI

SEQ ID NO: 68335 - protein, 10 aa, Artificial Sequence
  Description of Artificial Sequence: Synthetic peptide
  Seed: LSQSSPVSSF (MAGC1_HUMAN)
LQQSSPVSSY

SEQ ID NO: 68336 - protein, 9 aa, Artificial Sequence
  Description of Artificial Sequence: Synthetic peptide
  Seed: SQSSPVSSF (MAGC1_HUMAN)
SKSSPVSSF

SEQ ID NO: 68337 - protein, 9 aa, Artificial Sequence
  Description of Artificial Sequence: Synthetic peptide
  Seed: KQPITKAEM (MAGC1_HUMAN)
KQPITKAEF

SEQ ID NO: 68338 - protein, 9 aa, Artificial Sequence
  Description of Artificial Sequence: Synthetic peptide
  Seed: FSSALLSIF (MAGC1_HUMAN)
FPSALLSIW

SEQ ID NO: 68339 - protein, 10 aa, Artificial Sequence
  Description of Artificial Sequence: Synthetic peptide
  Seed: RSFSSTLLSI (MAGC1_HUMAN)
RIFSSTLLSK

SEQ ID NO: 68340 - protein, 9 aa, Artificial Sequence
  Description of Artificial Sequence: Synthetic peptide
  Seed: YTLLSLFQS (MAGC1_HUMAN)
YTLLSLFQV

SEQ ID NO: 68341 - protein, 9 aa, Artificial Sequence
  Description of Artificial Sequence: Synthetic peptide
  Seed: YTGYFPVIF (MAGC1_HUMAN)
YYGYFPVIY

SEQ ID NO: 68342 - protein, 10 aa, Artificial Sequence
  Description of Artificial Sequence: Synthetic peptide
  Seed: SQNRLLILIL (MAGC1_HUMAN)
SRNRLLILIM

SEQ ID NO: 68343 - protein, 8 aa, Artificial Sequence
  Description of Artificial Sequence: Synthetic peptide
  Seed: QIPGSPSF (MAGC1_HUMAN)
QFPGSPSF

SEQ ID NO: 68344 - protein, 9 aa, Artificial Sequence
  Description of Artificial Sequence: Synthetic peptide
  Seed: FSERTQSTF (MAGC1_HUMAN)
FKERTQSTY

SEQ ID NO: 68345 - protein, 9 aa, Artificial Sequence
  Description of Artificial Sequence: Synthetic peptide
  Seed: MTSSFSSTL (MAGC1_HUMAN)
MMSSFSSTW

SEQ ID NO: 68346 - protein, 11 aa, Artificial Sequence
  Description of Artificial Sequence: Synthetic peptide
  Seed: KDMPTAGMPSL (MAGC1_HUMAN)
KQMPTAGMPSL

SEQ ID NO: 68347 - protein, 10 aa, Artificial Sequence
  Description of Artificial Sequence: Synthetic peptide
  Seed: WGPRAHSEVI (MAGC1_HUMAN)
WLPRAHSEVF

SEQ ID NO: 68348 - protein, 10 aa, Artificial Sequence
  Description of Artificial Sequence: Synthetic peptide
  Seed: YTLASLLQSS (MAGC1_HUMAN)
YLLASLLQSM

SEQ ID NO: 68349 - protein, 9 aa, Artificial Sequence
  Description of Artificial Sequence: Synthetic peptide
  Seed: FSSALLSIF (MAGC1_HUMAN)
FYSALLSIV

SEQ ID NO: 68350 - protein, 9 aa, Artificial Sequence
  Description of Artificial Sequence: Synthetic peptide
  Seed: STFEGFAQS (MAGC1_HUMAN)
SVFEGFAQM

SEQ ID NO: 68351 - protein, 11 aa, Artificial Sequence
  Description of Artificial Sequence: Synthetic peptide
  Seed: RPVSSFFSYTL (MAGC1_HUMAN)
RYVSSFFSYTY

SEQ ID NO: 68352 - protein, 8 aa, Artificial Sequence
  Description of Artificial Sequence: Synthetic peptide
  Seed: RYTGYFPV (MAGC1_HUMAN)
RYTGYFPL

SEQ ID NO: 68353 - protein, 9 aa, Artificial Sequence
  Description of Artificial Sequence: Synthetic peptide
  Seed: MTSSFSSTL (MAGC1_HUMAN)
MISSFSSTR

SEQ ID NO: 68354 - protein, 9 aa, Artificial Sequence
  Description of Artificial Sequence: Synthetic peptide
  Seed: SLSPHYFPQ (MAGC1_HUMAN)
STSPHYFPK

SEQ ID NO: 68355 - protein, 9 aa, Artificial Sequence
  Description of Artificial Sequence: Synthetic peptide
  Seed: GYFPVIFRK (MAGC1_HUMAN)
GFFPVIFRR

SEQ ID NO: 68356 - protein, 10 aa, Artificial Sequence
  Description of Artificial Sequence: Synthetic peptide
  Seed: FFSSALLSIF (MAGC1_HUMAN)
FYSSALLSIM

SEQ ID NO: 68357 - protein, 10 aa, Artificial Sequence
  Description of Artificial Sequence: Synthetic peptide
  Seed: STFEGFPQSL (MAGC1_HUMAN)
SVFEGFPQSW

SEQ ID NO: 68358 - protein, 9 aa, Artificial Sequence
  Description of Artificial Sequence: Synthetic peptide
  Seed: TLLSLFQSF (MAGC1_HUMAN)
TYLSLFQSY

SEQ ID NO: 68359 - protein, 10 aa, Artificial Sequence
  Description of Artificial Sequence: Synthetic peptide
  Seed: YTGYFPVIFR (MAGC1_HUMAN)
YFGYFPVIFK

SEQ ID NO: 68360 - protein, 11 aa, Artificial Sequence
  Description of Artificial Sequence: Synthetic peptide
  Seed: SPLQIPVSRSF (MAGC1_HUMAN)
SKLQIPVSRSF

SEQ ID NO: 68361 - protein, 10 aa, Artificial Sequence
  Description of Artificial Sequence: Synthetic peptide
  Seed: RSFSSTLLSI (MAGC1_HUMAN)
RQFSSTLLSW

SEQ ID NO: 68362 - protein, 10 aa, Artificial Sequence
  Description of Artificial Sequence: Synthetic peptide
  Seed: SFSYTLLSLF (MAGC1_HUMAN)
SNSYTLLSLY

SEQ ID NO: 68363 - protein, 9 aa, Artificial Sequence
  Description of Artificial Sequence: Synthetic peptide
  Seed: FEGFAQSSL (MAGC1_HUMAN)
FAGFAQSSY

SEQ ID NO: 68364 - protein, 10 aa, Artificial Sequence
  Description of Artificial Sequence: Synthetic peptide
  Seed: RSFSSTLLSI (MAGC1_HUMAN)
RAFSSTLLSK

SEQ ID NO: 68365 - protein, 9 aa, Artificial Sequence
  Description of Artificial Sequence: Synthetic peptide
  Seed: RTHSTFEGF (MAGC1_HUMAN)
RHHSTFEGY

SEQ ID NO: 68366 - protein, 10 aa, Artificial Sequence
  Description of Artificial Sequence: Synthetic peptide
  Seed: TTDDSTATES (MAGC1_HUMAN)
TTDDSTATEI

SEQ ID NO: 68367 - protein, 9 aa, Artificial Sequence
  Description of Artificial Sequence: Synthetic peptide
  Seed: FSERTQSTF (MAGC1_HUMAN)
FTERTQSTY

SEQ ID NO: 68368 - protein, 11 aa, Artificial Sequence
  Description of Artificial Sequence: Synthetic peptide
  Seed: IPMTSSFSSTL (MAGC1_HUMAN)
IKMTSSFSSTW

SEQ ID NO: 68369 - protein, 9 aa, Artificial Sequence
  Description of Artificial Sequence: Synthetic peptide
  Seed: LSDEQGMSQ (MAGC1_HUMAN)
LADEQGMSF

SEQ ID NO: 68370 - protein, 9 aa, Artificial Sequence
  Description of Artificial Sequence: Synthetic peptide
  Seed: GFPQSLLQI (MAGC1_HUMAN)
GAPQSLLQL

SEQ ID NO: 68371 - protein, 9 aa, Artificial Sequence
  Description of Artificial Sequence: Synthetic peptide
  Seed: LQIPGSPSF (MAGC1_HUMAN)
LEIPGSPSM

SEQ ID NO: 68372 - protein, 10 aa, Artificial Sequence
  Description of Artificial Sequence: Synthetic peptide
  Seed: WGPRAHSEVI (MAGC1_HUMAN)
WDPRAHSEVM

SEQ ID NO: 68373 - protein, 9 aa, Artificial Sequence
  Description of Artificial Sequence: Synthetic peptide
  Seed: SSSSSSSTL (MAGC1_HUMAN)
SASSSSSTY

SEQ ID NO: 68374 - protein, 9 aa, Artificial Sequence
  Description of Artificial Sequence: Synthetic peptide
  Seed: MPSLLQSSS (MAGC1_HUMAN)
MASLLQSSM

SEQ ID NO: 68375 - protein, 10 aa, Artificial Sequence
  Description of Artificial Sequence: Synthetic peptide
  Seed: RSFSSTLLSI (MAGC1_HUMAN)
RKFSSTLLSM

SEQ ID NO: 68376 - protein, 10 aa, Artificial Sequence
  Description of Artificial Sequence: Synthetic peptide
  Seed: HSPQSPPEGM (MAGC1_HUMAN)
HAPQSPPEGM

SEQ ID NO: 68377 - protein, 9 aa, Artificial Sequence
  Description of Artificial Sequence: Synthetic peptide
  Seed: LQIPGSPSF (MAGC1_HUMAN)
LEIPGSPSW

SEQ ID NO: 68378 - protein, 9 aa, Artificial Sequence
  Description of Artificial Sequence: Synthetic peptide
  Seed: RSFSSTLLS (MAGC1_HUMAN)
RNFSSTLLF

SEQ ID NO: 68379 - protein, 9 aa, Artificial Sequence
  Description of Artificial Sequence: Synthetic peptide
  Seed: VSSFFSYTL (MAGC1_HUMAN)
VASFFSYTY

SEQ ID NO: 68380 - protein, 11 aa, Artificial Sequence
  Description of Artificial Sequence: Synthetic peptide
  Seed: SFFSSALLSIF (MAGC1_HUMAN)
SSFSSALLSIM

SEQ ID NO: 68381 - protein, 9 aa, Artificial Sequence
  Description of Artificial Sequence: Synthetic peptide
  Seed: FSYTLASLL (MAGC1_HUMAN)
FPYTLASLF

SEQ ID NO: 68382 - protein, 11 aa, Artificial Sequence
  Description of Artificial Sequence: Synthetic peptide
  Seed: SSFSYTLLSLF (MAGC1_HUMAN)
STFSYTLLSLW

SEQ ID NO: 68383 - protein, 9 aa, Artificial Sequence
  Description of Artificial Sequence: Synthetic peptide
  Seed: MPTAGMPSL (MAGC1_HUMAN)
MSTAGMPSF

SEQ ID NO: 68384 - protein, 10 aa, Artificial Sequence
  Description of Artificial Sequence: Synthetic peptide
  Seed: STFEGFPQSL (MAGC1_HUMAN)
STFEGFPQSI

SEQ ID NO: 68385 - protein, 9 aa, Artificial Sequence
  Description of Artificial Sequence: Synthetic peptide
  Seed: SSTSSSLSK (MAGC1_HUMAN)
STTSSSLSL

SEQ ID NO: 68386 - protein, 9 aa, Artificial Sequence
  Description of Artificial Sequence: Synthetic peptide
  Seed: FQSSLQSPV (MAGC1_HUMAN)
FCSSLQSPF

SEQ ID NO: 68387 - protein, 10 aa, Artificial Sequence
  Description of Artificial Sequence: Synthetic peptide
  Seed: ELARFLLLKY (MAGC1_HUMAN)
ETARFLLLKK

SEQ ID NO: 68388 - protein, 10 aa, Artificial Sequence
  Description of Artificial Sequence: Synthetic peptide
  Seed: SSFSYTLLSL (MAGC1_HUMAN)
SLFSYTLLSY

SEQ ID NO: 68389 - protein, 9 aa, Artificial Sequence
  Description of Artificial Sequence: Synthetic peptide
  Seed: YVFVNTLDL (MAGC1_HUMAN)
YAFVNTLDY

SEQ ID NO: 68390 - protein, 10 aa, Artificial Sequence
  Description of Artificial Sequence: Synthetic peptide
  Seed: SPPEGPVQSP (MAGC1_HUMAN)
SPPEGPVQSV

SEQ ID NO: 68391 - protein, 10 aa, Artificial Sequence
  Description of Artificial Sequence: Synthetic peptide
  Seed: YTLDEKVDEL (MAGC1_HUMAN)
YWLDEKVDEL

SEQ ID NO: 68392 - protein, 9 aa, Artificial Sequence
  Description of Artificial Sequence: Synthetic peptide
  Seed: SAQSTFEGF (MAGC1_HUMAN)
SPQSTFEGY

SEQ ID NO: 68393 - protein, 10 aa, Artificial Sequence
  Description of Artificial Sequence: Synthetic peptide
  Seed: RYTGYFPVIF (MAGC1_HUMAN)
RYTGYFPVIW

SEQ ID NO: 68394 - protein, 8 aa, Artificial Sequence
  Description of Artificial Sequence: Synthetic peptide
  Seed: SEVIKRKV (MAGC1_HUMAN)
SEVIKRKW

SEQ ID NO: 68395 - protein, 10 aa, Artificial Sequence
  Description of Artificial Sequence: Synthetic peptide
  Seed: AASSSTLVSI (MAGC1_HUMAN)
AVSSSTLVSV

SEQ ID NO: 68396 - protein, 9 aa, Artificial Sequence
  Description of Artificial Sequence: Synthetic peptide
  Seed: AQSPLQIPV (MAGC1_HUMAN)
AYSPLQIPM

SEQ ID NO: 68397 - protein, 11 aa, Artificial Sequence
  Description of Artificial Sequence: Synthetic peptide
  Seed: IPVSPSFSSTL (MAGC1_HUMAN)
IPVSPSFSSTV

SEQ ID NO: 68398 - protein, 9 aa, Artificial Sequence
  Description of Artificial Sequence: Synthetic peptide
  Seed: SSTSSSLSK (MAGC1_HUMAN)
SVTSSSLSL

SEQ ID NO: 68399 - protein, 10 aa, Artificial Sequence
  Description of Artificial Sequence: Synthetic peptide
  Seed: QRPVSSFFSY (MAGC1_HUMAN)
QHPVSSFFSF

SEQ ID NO: 68400 - protein, 10 aa, Artificial Sequence
  Description of Artificial Sequence: Synthetic peptide
  Seed: MTSSFSSTLL (MAGC1_HUMAN)
MQSSFSSTLY

SEQ ID NO: 68401 - protein, 9 aa, Artificial Sequence
  Description of Artificial Sequence: Synthetic peptide
  Seed: VPNSSPPRY (MAGC1_HUMAN)
VFNSSPPRY

SEQ ID NO: 68402 - protein, 9 aa, Artificial Sequence
  Description of Artificial Sequence: Synthetic peptide
  Seed: FSSTLLSLF (MAGC1_HUMAN)
FTSTLLSLY

SEQ ID NO: 68403 - protein, 9 aa, Artificial Sequence
  Description of Artificial Sequence: Synthetic peptide
  Seed: LQSPVISFS (MAGC1_HUMAN)
LLSPVISFV

SEQ ID NO: 68404 - protein, 10 aa, Artificial Sequence
  Description of Artificial Sequence: Synthetic peptide
  Seed: FFSYTLASLL (MAGC1_HUMAN)
FVSYTLASLA

SEQ ID NO: 68405 - protein, 9 aa, Artificial Sequence
  Description of Artificial Sequence: Synthetic peptide
  Seed: SSPESTQSP (MAGC1_HUMAN)
SCPESTQSF

SEQ ID NO: 68406 - protein, 10 aa, Artificial Sequence
  Description of Artificial Sequence: Synthetic peptide
  Seed: RKVVEFLAML (MAGC1_HUMAN)
RYVVEFLAMA

SEQ ID NO: 68407 - protein, 9 aa, Artificial Sequence
  Description of Artificial Sequence: Synthetic peptide
  Seed: SFSYTLLSL (MAGC1_HUMAN)
SWSYTLLSW

SEQ ID NO: 68408 - protein, 10 aa, Artificial Sequence
  Description of Artificial Sequence: Synthetic peptide
  Seed: RKVVEFLAML (MAGC1_HUMAN)
RPVVEFLAMI

SEQ ID NO: 68409 - protein, 9 aa, Artificial Sequence
  Description of Artificial Sequence: Synthetic peptide
  Seed: VIFRKAREF (MAGC1_HUMAN)
VFFRKAREL

SEQ ID NO: 68410 - protein, 10 aa, Artificial Sequence
  Description of Artificial Sequence: Synthetic peptide
  Seed: EVIWDVLSGI (MAGC1_HUMAN)
EHIWDVLSGV

SEQ ID NO: 68411 - protein, 10 aa, Artificial Sequence
  Description of Artificial Sequence: Synthetic peptide
  Seed: FAFGEPRELL (MAGC1_HUMAN)
FSFGEPRELY

SEQ ID NO: 68412 - protein, 9 aa, Artificial Sequence
  Description of Artificial Sequence: Synthetic peptide
  Seed: VIKRKVVEF (MAGC1_HUMAN)
VQKRKVVEY

SEQ ID NO: 68413 - protein, 9 aa, Artificial Sequence
  Description of Artificial Sequence: Synthetic peptide
  Seed: SICSSSTSL (MAGC1_HUMAN)
SICSSSTSV

SEQ ID NO: 68414 - protein, 9 aa, Artificial Sequence
  Description of Artificial Sequence: Synthetic peptide
  Seed: MLTNVISRY (MAGC1_HUMAN)
MATNVISRL

SEQ ID NO: 68415 - protein, 11 aa, Artificial Sequence
  Description of Artificial Sequence: Synthetic peptide
  Seed: NPASSFFSSAL (MAGC1_HUMAN)
NPASSFFSSAA

SEQ ID NO: 68416 - protein, 9 aa, Artificial Sequence
  Description of Artificial Sequence: Synthetic peptide
  Seed: YTSSSDTLL (MAGC1_HUMAN)
YTSSSDTLM

SEQ ID NO: 68417 - protein, 9 aa, Artificial Sequence
  Description of Artificial Sequence: Synthetic peptide
  Seed: VSAASSSTL (MAGC1_HUMAN)
VIAASSSTI

SEQ ID NO: 68418 - protein, 10 aa, Artificial Sequence
  Description of Artificial Sequence: Synthetic peptide
  Seed: SSSSTLLSLF (MAGC1_HUMAN)
SYSSTLLSLM

SEQ ID NO: 68419 - protein, 9 aa, Artificial Sequence
  Description of Artificial Sequence: Synthetic peptide
  Seed: RLLILILSI (MAGC1_HUMAN)
RILILILSW

SEQ ID NO: 68420 - protein, 11 aa, Artificial Sequence
  Description of Artificial Sequence: Synthetic peptide
  Seed: TTDDSTATESA (MAGC1_HUMAN)
TFDDSTATESI

SEQ ID NO: 68421 - protein, 10 aa, Artificial Sequence
  Description of Artificial Sequence: Synthetic peptide
  Seed: SSPESAQSAF (MAGC1_HUMAN)
SQPESAQSAL

SEQ ID NO: 68422 - protein, 9 aa, Artificial Sequence
  Description of Artificial Sequence: Synthetic peptide
  Seed: TLLSLFQSF (MAGC1_HUMAN)
TTLSLFQSV

SEQ ID NO: 68423 - protein, 10 aa, Artificial Sequence
  Description of Artificial Sequence: Synthetic peptide
  Seed: MPTAGMPSLL (MAGC1_HUMAN)
MMTAGMPSLV

SEQ ID NO: 68424 - protein, 9 aa, Artificial Sequence
  Description of Artificial Sequence: Synthetic peptide
  Seed: LQIVPSLPE (MAGC1_HUMAN)
LYIVPSLPY

SEQ ID NO: 68425 - protein, 9 aa, Artificial Sequence
  Description of Artificial Sequence: Synthetic peptide
  Seed: EHFAFGEPR (MAGC1_HUMAN)
EIFAFGEPK

SEQ ID NO: 68426 - protein, 9 aa, Artificial Sequence
  Description of Artificial Sequence: Synthetic peptide
  Seed: LQNPASSFF (MAGC1_HUMAN)
LENPASSFF

SEQ ID NO: 68427 - protein, 9 aa, Artificial Sequence
  Description of Artificial Sequence: Synthetic peptide
  Seed: SQSSPVSSF (MAGC1_HUMAN)
SMSSPVSSF

SEQ ID NO: 68428 - protein, 9 aa, Artificial Sequence
  Description of Artificial Sequence: Synthetic peptide
  Seed: ISFSSSTSL (MAGC1_HUMAN)
IEFSSSTSL

SEQ ID NO: 68429 - protein, 10 aa, Artificial Sequence
  Description of Artificial Sequence: Synthetic peptide
  Seed: LQIPMTSSFS (MAGC1_HUMAN)
LQIPMTSSFI

SEQ ID NO: 68430 - protein, 9 aa, Artificial Sequence
  Description of Artificial Sequence: Synthetic peptide
  Seed: SSPEGKDSL (MAGC1_HUMAN)
SFPEGKDSM

SEQ ID NO: 68431 - protein, 9 aa, Artificial Sequence
  Description of Artificial Sequence: Synthetic peptide
  Seed: RPVSSFFSY (MAGC1_HUMAN)
RKVSSFFSM

SEQ ID NO: 68432 - protein, 9 aa, Artificial Sequence
  Description of Artificial Sequence: Synthetic peptide
  Seed: IPVSSSFSY (MAGC1_HUMAN)
INVSSSFSY

SEQ ID NO: 68433 - protein, 9 aa, Artificial Sequence
  Description of Artificial Sequence: Synthetic peptide
  Seed: DSYVFVNTL (MAGC1_HUMAN)
DPYVFVNTI

SEQ ID NO: 68434 - protein, 9 aa, Artificial Sequence
  Description of Artificial Sequence: Synthetic peptide
  Seed: VIFRKAREF (MAGC1_HUMAN)
VSFRKAREY

SEQ ID NO: 68435 - protein, 10 aa, Artificial Sequence
  Description of Artificial Sequence: Synthetic peptide
  Seed: VISFSSSTSL (MAGC1_HUMAN)
VTSFSSSTSL

SEQ ID NO: 68436 - protein, 9 aa, Artificial Sequence
  Description of Artificial Sequence: Synthetic peptide
  Seed: VSPSFSSTL (MAGC1_HUMAN)
VRPSFSSTV

SEQ ID NO: 68437 - protein, 10 aa, Artificial Sequence
  Description of Artificial Sequence: Synthetic peptide
  Seed: VSICSSSTSL (MAGC1_HUMAN)
VQICSSSTSF

SEQ ID NO: 68438 - protein, 10 aa, Artificial Sequence
  Description of Artificial Sequence: Synthetic peptide
  Seed: LSLFQSSPER (MAGC1_HUMAN)
LVLFQSSPER

SEQ ID NO: 68439 - protein, 9 aa, Artificial Sequence
  Description of Artificial Sequence: Synthetic peptide
  Seed: RYTGYFPVI (MAGC1_HUMAN)
RWTGYFPVV

SEQ ID NO: 68440 - protein, 10 aa, Artificial Sequence
  Description of Artificial Sequence: Synthetic peptide
  Seed: ERTQSTFEGF (MAGC1_HUMAN)
EHTQSTFEGF

SEQ ID NO: 68441 - protein, 9 aa, Artificial Sequence
  Description of Artificial Sequence: Synthetic peptide
  Seed: SFSYTLLSL (MAGC1_HUMAN)
SRSYTLLSM

SEQ ID NO: 68442 - protein, 10 aa, Artificial Sequence
  Description of Artificial Sequence: Synthetic peptide
  Seed: SSSSTLLSLF (MAGC1_HUMAN)
SPSSTLLSLF

SEQ ID NO: 68443 - protein, 9 aa, Artificial Sequence
  Description of Artificial Sequence: Synthetic peptide
  Seed: SQSPPEGPV (MAGC1_HUMAN)
SLSPPEGPF

SEQ ID NO: 68444 - protein, 10 aa, Artificial Sequence
  Description of Artificial Sequence: Synthetic peptide
  Seed: NPASSFFSSA (MAGC1_HUMAN)
NDASSFFSSV

SEQ ID NO: 68445 - protein, 9 aa, Artificial Sequence
  Description of Artificial Sequence: Synthetic peptide
  Seed: SSSTLLSLF (MAGC1_HUMAN)
SQSTLLSLW

SEQ ID NO: 68446 - protein, 10 aa, Artificial Sequence
  Description of Artificial Sequence: Synthetic peptide
  Seed: MPTAGMPSLL (MAGC1_HUMAN)
MCTAGMPSLW

SEQ ID NO: 68447 - protein, 9 aa, Artificial Sequence
  Description of Artificial Sequence: Synthetic peptide
  Seed: GYFPVIFRK (MAGC1_HUMAN)
GLFPVIFRR

SEQ ID NO: 68448 - protein, 9 aa, Artificial Sequence
  Description of Artificial Sequence: Synthetic peptide
  Seed: STFEGFPQS (MAGC1_HUMAN)
SPFEGFPQL

SEQ ID NO: 68449 - protein, 10 aa, Artificial Sequence
  Description of Artificial Sequence: Synthetic peptide
  Seed: QRPVSSFFSY (MAGC1_HUMAN)
QSPVSSFFSF

SEQ ID NO: 68450 - protein, 9 aa, Artificial Sequence
  Description of Artificial Sequence: Synthetic peptide
  Seed: SSFFSSALL (MAGC1_HUMAN)
SAFFSSALK

SEQ ID NO: 68451 - protein, 10 aa, Artificial Sequence
  Description of Artificial Sequence: Synthetic peptide
  Seed: SLFQSSPERT (MAGC1_HUMAN)
SLFQSSPERI

SEQ ID NO: 68452 - protein, 9 aa, Artificial Sequence
  Description of Artificial Sequence: Synthetic peptide
  Seed: LQNPASSFF (MAGC1_HUMAN)
LENPASSFM

SEQ ID NO: 68453 - protein, 11 aa, Artificial Sequence
  Description of Artificial Sequence: Synthetic peptide
  Seed: TLYPLQSPQSR (MAGC1_HUMAN)
TAYPLQSPQSR

SEQ ID NO: 68454 - protein, 11 aa, Artificial Sequence
  Description of Artificial Sequence: Synthetic peptide
  Seed: IPVSSSFSYTL (MAGC1_HUMAN)
ITVSSSFSYTW

SEQ ID NO: 68455 - protein, 10 aa, Artificial Sequence
  Description of Artificial Sequence: Synthetic peptide
  Seed: MTSSFSSTLL (MAGC1_HUMAN)
MLSSFSSTLL

SEQ ID NO: 68456 - protein, 10 aa, Artificial Sequence
  Description of Artificial Sequence: Synthetic peptide
  Seed: ASSSTLVSIF (MAGC1_HUMAN)
ATSSTLVSIY

SEQ ID NO: 68457 - protein, 10 aa, Artificial Sequence
  Description of Artificial Sequence: Synthetic peptide
  Seed: RAGREHFAFG (MAGC1_HUMAN)
RYGREHFAFA

SEQ ID NO: 68458 - protein, 11 aa, Artificial Sequence
  Description of Artificial Sequence: Synthetic peptide
  Seed: LQIPVSSSFSY (MAGC1_HUMAN)
LGIPVSSSFSY

SEQ ID NO: 68459 - protein, 9 aa, Artificial Sequence
  Description of Artificial Sequence: Synthetic peptide
  Seed: SPLQSPESA (MAGC1_HUMAN)
SPLQSPESM

SEQ ID NO: 68460 - protein, 11 aa, Artificial Sequence
  Description of Artificial Sequence: Synthetic peptide
  Seed: SFFSYTLASLL (MAGC1_HUMAN)
SSFSYTLASLY

SEQ ID NO: 68461 - protein, 9 aa, Artificial Sequence
  Description of Artificial Sequence: Synthetic peptide
  Seed: KVVEFLAML (MAGC1_HUMAN)
KSVEFLAMR

SEQ ID NO: 68462 - protein, 9 aa, Artificial Sequence
  Description of Artificial Sequence: Synthetic peptide
  Seed: TSLSLPQSF (MAGC1_HUMAN)
TRLSLPQSF

SEQ ID NO: 68463 - protein, 9 aa, Artificial Sequence
  Description of Artificial Sequence: Synthetic peptide
  Seed: YTLLSLFQS (MAGC1_HUMAN)
YILLSLFQM

SEQ ID NO: 68464 - protein, 9 aa, Artificial Sequence
  Description of Artificial Sequence: Synthetic peptide
  Seed: LQIPMTSSF (MAGC1_HUMAN)
LYIPMTSSY

SEQ ID NO: 68465 - protein, 9 aa, Artificial Sequence
  Description of Artificial Sequence: Synthetic peptide
  Seed: FQSSLQSPV (MAGC1_HUMAN)
FVSSLQSPY

SEQ ID NO: 68466 - protein, 9 aa, Artificial Sequence
  Description of Artificial Sequence: Synthetic peptide
  Seed: FAFGEPREL (MAGC1_HUMAN)
FMFGEPRER

SEQ ID NO: 68467 - protein, 9 aa, Artificial Sequence
  Description of Artificial Sequence: Synthetic peptide
  Seed: FSSTLLSLF (MAGC1_HUMAN)
FVSTLLSLF

SEQ ID NO: 68468 - protein, 11 aa, Artificial Sequence
  Description of Artificial Sequence: Synthetic peptide
  Seed: IPMTSSFSSTL (MAGC1_HUMAN)
ITMTSSFSSTF

SEQ ID NO: 68469 - protein, 11 aa, Artificial Sequence
  Description of Artificial Sequence: Synthetic peptide
  Seed: TVPITFPSSYK (MAGC1_HUMAN)
TEPITFPSSYR

SEQ ID NO: 68470 - protein, 9 aa, Artificial Sequence
  Description of Artificial Sequence: Synthetic peptide
  Seed: KAREFIEIL (MAGC1_HUMAN)
KSREFIEIL

SEQ ID NO: 68471 - protein, 9 aa, Artificial Sequence
  Description of Artificial Sequence: Synthetic peptide
  Seed: AMLKNTVPI (MAGC1_HUMAN)
ATLKNTVPW

SEQ ID NO: 68472 - protein, 10 aa, Artificial Sequence
  Description of Artificial Sequence: Synthetic peptide
  Seed: ESAQSTFEGF (MAGC1_HUMAN)
ETAQSTFEGF

SEQ ID NO: 68473 - protein, 9 aa, Artificial Sequence
  Description of Artificial Sequence: Synthetic peptide
  Seed: TTDDSTATE (MAGC1_HUMAN)
TNDDSTATM

SEQ ID NO: 68474 - protein, 10 aa, Artificial Sequence
  Description of Artificial Sequence: Synthetic peptide
  Seed: FFSYTLASLL (MAGC1_HUMAN)
FLSYTLASLG

SEQ ID NO: 68475 - protein, 9 aa, Artificial Sequence
  Description of Artificial Sequence: Synthetic peptide
  Seed: GYFPVIFRK (MAGC1_HUMAN)
GQFPVIFRY

SEQ ID NO: 68476 - protein, 10 aa, Artificial Sequence
  Description of Artificial Sequence: Synthetic peptide
  Seed: SFSSTLVSLF (MAGC1_HUMAN)
SYSSTLVSLI

SEQ ID NO: 68477 - protein, 9 aa, Artificial Sequence
  Description of Artificial Sequence: Synthetic peptide
  Seed: VSAASSSTL (MAGC1_HUMAN)
VEAASSSTY

SEQ ID NO: 68478 - protein, 9 aa, Artificial Sequence
  Description of Artificial Sequence: Synthetic peptide
  Seed: WVQEHYLEY (MAGC1_HUMAN)
WFQEHYLEF

SEQ ID NO: 68479 - protein, 9 aa, Artificial Sequence
  Description of Artificial Sequence: Synthetic peptide
  Seed: VPITFPSSY (MAGC1_HUMAN)
VQITFPSSY

SEQ ID NO: 68480 - protein, 10 aa, Artificial Sequence
  Description of Artificial Sequence: Synthetic peptide
  Seed: YTLLSLFQSS (MAGC1_HUMAN)
YSLLSLFQSL

SEQ ID NO: 68481 - protein, 11 aa, Artificial Sequence
  Description of Artificial Sequence: Synthetic peptide
  Seed: RPVSSFFSYTL (MAGC1_HUMAN)
RCVSSFFSYTY

SEQ ID NO: 68482 - protein, 10 aa, Artificial Sequence
  Description of Artificial Sequence: Synthetic peptide
  Seed: EVIKRKVVEF (MAGC1_HUMAN)
EIIKRKVVER

SEQ ID NO: 68483 - protein, 9 aa, Artificial Sequence
  Description of Artificial Sequence: Synthetic peptide
  Seed: FSSALLSIF (MAGC1_HUMAN)
FHSALLSIY

SEQ ID NO: 68484 - protein, 10 aa, Artificial Sequence
  Description of Artificial Sequence: Synthetic peptide
  Seed: LSIFQSSPER (MAGC1_HUMAN)
LVIFQSSPEK

SEQ ID NO: 68485 - protein, 9 aa, Artificial Sequence
  Description of Artificial Sequence: Synthetic peptide
  Seed: SRYTGYFPV (MAGC1_HUMAN)
SEYTGYFPL

SEQ ID NO: 68486 - protein, 10 aa, Artificial Sequence
  Description of Artificial Sequence: Synthetic peptide
  Seed: SQSPPEGEDV (MAGC1_HUMAN)
SHSPPEGEDM

SEQ ID NO: 68487 - protein, 11 aa, Artificial Sequence
  Description of Artificial Sequence: Synthetic peptide
  Seed: SPLQIPVSPSS (MAGC1_HUMAN)
SALQIPVSPSW

SEQ ID NO: 68488 - protein, 9 aa, Artificial Sequence
  Description of Artificial Sequence: Synthetic peptide
  Seed: SMSPLYFPQ (MAGC1_HUMAN)
SMSPLYFPK

SEQ ID NO: 68489 - protein, 9 aa, Artificial Sequence
  Description of Artificial Sequence: Synthetic peptide
  Seed: SPLQIVPSL (MAGC1_HUMAN)
SQLQIVPSY

SEQ ID NO: 68490 - protein, 11 aa, Artificial Sequence
  Description of Artificial Sequence: Synthetic peptide
  Seed: IPVSSSFSYTL (MAGC1_HUMAN)
IVVSSSFSYTF

SEQ ID NO: 68491 - protein, 10 aa, Artificial Sequence
  Description of Artificial Sequence: Synthetic peptide
  Seed: LAMLKNTVPI (MAGC1_HUMAN)
LGMLKNTVPV

SEQ ID NO: 68492 - protein, 10 aa, Artificial Sequence
  Description of Artificial Sequence: Synthetic peptide
  Seed: LQIVPSLPEW (MAGC1_HUMAN)
LIIVPSLPEF

SEQ ID NO: 68493 - protein, 9 aa, Artificial Sequence
  Description of Artificial Sequence: Synthetic peptide
  Seed: AQSSLQIPV (MAGC1_HUMAN)
AQSSLQIPM

SEQ ID NO: 68494 - protein, 9 aa, Artificial Sequence
  Description of Artificial Sequence: Synthetic peptide
  Seed: TSLSLPQSF (MAGC1_HUMAN)
TALSLPQSV

SEQ ID NO: 68495 - protein, 10 aa, Artificial Sequence
  Description of Artificial Sequence: Synthetic peptide
  Seed: SSFSYTLLSL (MAGC1_HUMAN)
SVFSYTLLSF

SEQ ID NO: 68496 - protein, 10 aa, Artificial Sequence
  Description of Artificial Sequence: Synthetic peptide
  Seed: SPLYFPQSPL (MAGC1_HUMAN)
SPLYFPQSPI

SEQ ID NO: 68497 - protein, 11 aa, Artificial Sequence
  Description of Artificial Sequence: Synthetic peptide
  Seed: SPLQIPVSSSS (MAGC1_HUMAN)
SRLQIPVSSSF

SEQ ID NO: 68498 - protein, 9 aa, Artificial Sequence
  Description of Artificial Sequence: Synthetic peptide
  Seed: KVWVQEHYL (MAGC1_HUMAN)
KSWVQEHYY

SEQ ID NO: 68499 - protein, 9 aa, Artificial Sequence
  Description of Artificial Sequence: Synthetic peptide
  Seed: YTLLSLFQS (MAGC1_HUMAN)
YQLLSLFQT

SEQ ID NO: 68500 - protein, 10 aa, Artificial Sequence
  Description of Artificial Sequence: Synthetic peptide
  Seed: SFPSSTSSSL (MAGC1_HUMAN)
SGPSSTSSSV

SEQ ID NO: 68501 - protein, 10 aa, Artificial Sequence
  Description of Artificial Sequence: Synthetic peptide
  Seed: PLQIPVSSSF (MAGC1_HUMAN)
PYQIPVSSSF

SEQ ID NO: 68502 - protein, 9 aa, Artificial Sequence
  Description of Artificial Sequence: Synthetic peptide
  Seed: SSFFSSALL (MAGC1_HUMAN)
SIFFSSALI

SEQ ID NO: 68503 - protein, 10 aa, Artificial Sequence
  Description of Artificial Sequence: Synthetic peptide
  Seed: SFPSSTSSSL (MAGC1_HUMAN)
SWPSSTSSSL

SEQ ID NO: 68504 - protein, 10 aa, Artificial Sequence
  Description of Artificial Sequence: Synthetic peptide
  Seed: YTLASLLQSS (MAGC1_HUMAN)
YSLASLLQSL

SEQ ID NO: 68505 - protein, 9 aa, Artificial Sequence
  Description of Artificial Sequence: Synthetic peptide
  Seed: SSSTLVSIF (MAGC1_HUMAN)
SPSTLVSIM

SEQ ID NO: 68506 - protein, 9 aa, Artificial Sequence
  Description of Artificial Sequence: Synthetic peptide
  Seed: VSPSFSSTL (MAGC1_HUMAN)
VTPSFSSTL

SEQ ID NO: 68507 - protein, 9 aa, Artificial Sequence
  Description of Artificial Sequence: Synthetic peptide
  Seed: DSYVFVNTL (MAGC1_HUMAN)
DTYVFVNTV

SEQ ID NO: 68508 - protein, 9 aa, Artificial Sequence
  Description of Artificial Sequence: Synthetic peptide
  Seed: SAPEGEDSL (MAGC1_HUMAN)
SHPEGEDSL

SEQ ID NO: 68509 - protein, 9 aa, Artificial Sequence
  Description of Artificial Sequence: Synthetic peptide
  Seed: VSSFFSYTL (MAGC1_HUMAN)
VSSFFSYTF

SEQ ID NO: 68510 - protein, 9 aa, Artificial Sequence
  Description of Artificial Sequence: Synthetic peptide
  Seed: YVFVNTLDL (MAGC1_HUMAN)
YMFVNTLDV

SEQ ID NO: 68511 - protein, 9 aa, Artificial Sequence
  Description of Artificial Sequence: Synthetic peptide
  Seed: NVISRYTGY (MAGC1_HUMAN)
NAISRYTGL

SEQ ID NO: 68512 - protein, 11 aa, Artificial Sequence
  Description of Artificial Sequence: Synthetic peptide
  Seed: SPLQIPVSPSS (MAGC1_HUMAN)
SKLQIPVSPSY

SEQ ID NO: 68513 - protein, 9 aa, Artificial Sequence
  Description of Artificial Sequence: Synthetic peptide
  Seed: LQIPMTSSF (MAGC1_HUMAN)
LIIPMTSSM

SEQ ID NO: 68514 - protein, 9 aa, Artificial Sequence
  Description of Artificial Sequence: Synthetic peptide
  Seed: STFEGFAQS (MAGC1_HUMAN)
SSFEGFAQI

SEQ ID NO: 68515 - protein, 10 aa, Artificial Sequence
  Description of Artificial Sequence: Synthetic peptide
  Seed: FAQSSLQIPV (MAGC1_HUMAN)
FAQSSLQIPF

SEQ ID NO: 68516 - protein, 11 aa, Artificial Sequence
  Description of Artificial Sequence: Synthetic peptide
  Seed: SSFPSSTSSSL (MAGC1_HUMAN)
SHFPSSTSSSF

SEQ ID NO: 68517 - protein, 9 aa, Artificial Sequence
  Description of Artificial Sequence: Synthetic peptide
  Seed: SSSTSLSPF (MAGC1_HUMAN)
SVSTSLSPW

SEQ ID NO: 68518 - protein, 10 aa, Artificial Sequence
  Description of Artificial Sequence: Synthetic peptide
  Seed: VWVQEHYLEY (MAGC1_HUMAN)
VYVQEHYLEM

SEQ ID NO: 68519 - protein, 9 aa, Artificial Sequence
  Description of Artificial Sequence: Synthetic peptide
  Seed: EFIEILFGI (MAGC1_HUMAN)
EVIEILFGL

SEQ ID NO: 68520 - protein, 10 aa, Artificial Sequence
  Description of Artificial Sequence: Synthetic peptide
  Seed: SLFQSFSERT (MAGC1_HUMAN)
STFQSFSERR

SEQ ID NO: 68521 - protein, 11 aa, Artificial Sequence
  Description of Artificial Sequence: Synthetic peptide
  Seed: FLAMLKNTVPI (MAGC1_HUMAN)
FQAMLKNTVPL

SEQ ID NO: 68522 - protein, 10 aa, Artificial Sequence
  Description of Artificial Sequence: Synthetic peptide
  Seed: FPQSPLQIPV (MAGC1_HUMAN)
FGQSPLQIPI

SEQ ID NO: 68523 - protein, 10 aa, Artificial Sequence
  Description of Artificial Sequence: Synthetic peptide
  Seed: SSPESTQSPF (MAGC1_HUMAN)
SYPESTQSPM

SEQ ID NO: 68524 - protein, 9 aa, Artificial Sequence
  Description of Artificial Sequence: Synthetic peptide
  Seed: FAFGEPREL (MAGC1_HUMAN)
FCFGEPREL

SEQ ID NO: 68525 - protein, 10 aa, Artificial Sequence
  Description of Artificial Sequence: Synthetic peptide
  Seed: RAGREHFAFG (MAGC1_HUMAN)
RFGREHFAFS

SEQ ID NO: 68526 - protein, 10 aa, Artificial Sequence
  Description of Artificial Sequence: Synthetic peptide
  Seed: SIFQSSPESA (MAGC1_HUMAN)
SMFQSSPESA

SEQ ID NO: 68527 - protein, 10 aa, Artificial Sequence
  Description of Artificial Sequence: Synthetic peptide
  Seed: LSLFQSFSER (MAGC1_HUMAN)
LTLFQSFSEK

SEQ ID NO: 68528 - protein, 9 aa, Artificial Sequence
  Description of Artificial Sequence: Synthetic peptide
  Seed: SPLEGEDSL (MAGC1_HUMAN)
SSLEGEDSY

SEQ ID NO: 68529 - protein, 10 aa, Artificial Sequence
  Description of Artificial Sequence: Synthetic peptide
  Seed: RKVVEFLAML (MAGC1_HUMAN)
RLVVEFLAMM

SEQ ID NO: 68530 - protein, 9 aa, Artificial Sequence
  Description of Artificial Sequence: Synthetic peptide
  Seed: VIWDVLSGI (MAGC1_HUMAN)
VTWDVLSGA

SEQ ID NO: 68531 - protein, 9 aa, Artificial Sequence
  Description of Artificial Sequence: Synthetic peptide
  Seed: AQSPLQSPV (MAGC1_HUMAN)
AESPLQSPF

SEQ ID NO: 68532 - protein, 10 aa, Artificial Sequence
  Description of Artificial Sequence: Synthetic peptide
  Seed: RAHSEVIKRK (MAGC1_HUMAN)
RIHSEVIKRR

SEQ ID NO: 68533 - protein, 9 aa, Artificial Sequence
  Description of Artificial Sequence: Synthetic peptide
  Seed: ESDDTLYPL (MAGC1_HUMAN)
ETDDTLYPV

SEQ ID NO: 68534 - protein, 10 aa, Artificial Sequence
  Description of Artificial Sequence: Synthetic peptide
  Seed: QRPVSSFFSY (MAGC1_HUMAN)
QHPVSSFFSM

SEQ ID NO: 68535 - protein, 10 aa, Artificial Sequence
  Description of Artificial Sequence: Synthetic peptide
  Seed: FPQSVLQIPV (MAGC1_HUMAN)
FQQSVLQIPM

SEQ ID NO: 68536 - protein, 10 aa, Artificial Sequence
  Description of Artificial Sequence: Synthetic peptide
  Seed: LLQIPMTSSF (MAGC1_HUMAN)
LDQIPMTSSL

SEQ ID NO: 68537 - protein, 9 aa, Artificial Sequence
  Description of Artificial Sequence: Synthetic peptide
  Seed: YTGYFPVIF (MAGC1_HUMAN)
YAGYFPVIF

SEQ ID NO: 68538 - protein, 10 aa, Artificial Sequence
  Description of Artificial Sequence: Synthetic peptide
  Seed: SFSYTLLSLF (MAGC1_HUMAN)
STSYTLLSLY

SEQ ID NO: 68539 - protein, 9 aa, Artificial Sequence
  Description of Artificial Sequence: Synthetic peptide
  Seed: SPLQIVPSL (MAGC1_HUMAN)
SALQIVPSW

SEQ ID NO: 68540 - protein, 10 aa, Artificial Sequence
  Description of Artificial Sequence: Synthetic peptide
  Seed: SSPERTQSTF (MAGC1_HUMAN)
SMPERTQSTF

SEQ ID NO: 68541 - protein, 11 aa, Artificial Sequence
  Description of Artificial Sequence: Synthetic peptide
  Seed: SSSSSTLLSLF (MAGC1_HUMAN)
SVSSSTLLSLW

SEQ ID NO: 68542 - protein, 9 aa, Artificial Sequence
  Description of Artificial Sequence: Synthetic peptide
  Seed: FAFGEPREL (MAGC1_HUMAN)
FQFGEPREY

SEQ ID NO: 68543 - protein, 9 aa, Artificial Sequence
  Description of Artificial Sequence: Synthetic peptide
  Seed: YTLLSLFQS (MAGC1_HUMAN)
YLLLSLFQA

SEQ ID NO: 68544 - protein, 9 aa, Artificial Sequence
  Description of Artificial Sequence: Synthetic peptide
  Seed: SPPEGPVQS (MAGC1_HUMAN)
SAPEGPVQM

SEQ ID NO: 68545 - protein, 11 aa, Artificial Sequence
  Description of Artificial Sequence: Synthetic peptide
  Seed: SPPEGPAQSPL (MAGC1_HUMAN)
SLPEGPAQSPL

SEQ ID NO: 68546 - protein, 9 aa, Artificial Sequence
  Description of Artificial Sequence: Synthetic peptide
  Seed: SAQSTFEGF (MAGC1_HUMAN)
SQQSTFEGF

SEQ ID NO: 68547 - protein, 11 aa, Artificial Sequence
  Description of Artificial Sequence: Synthetic peptide
  Seed: NTVPITFPSSY (MAGC1_HUMAN)
NTVPITFPSSF

SEQ ID NO: 68548 - protein, 9 aa, Artificial Sequence
  Description of Artificial Sequence: Synthetic peptide
  Seed: STFEGFAQS (MAGC1_HUMAN)
STFEGFAQT

SEQ ID NO: 68549 - protein, 9 aa, Artificial Sequence
  Description of Artificial Sequence: Synthetic peptide
  Seed: FFSSALLSI (MAGC1_HUMAN)
FNSSALLSL

SEQ ID NO: 68550 - protein, 9 aa, Artificial Sequence
  Description of Artificial Sequence: Synthetic peptide
  Seed: MLTNVISRY (MAGC1_HUMAN)
MVTNVISRY

SEQ ID NO: 68551 - protein, 10 aa, Artificial Sequence
  Description of Artificial Sequence: Synthetic peptide
  Seed: MPTAGMPSLL (MAGC1_HUMAN)
MQTAGMPSLV

SEQ ID NO: 68552 - protein, 10 aa, Artificial Sequence
  Description of Artificial Sequence: Synthetic peptide
  Seed: FLAMLKNTVP (MAGC1_HUMAN)
FLAMLKNTVG

SEQ ID NO: 68553 - protein, 11 aa, Artificial Sequence
  Description of Artificial Sequence: Synthetic peptide
  Seed: TTDDSTATESA (MAGC1_HUMAN)
TVDDSTATESV

SEQ ID NO: 68554 - protein, 9 aa, Artificial Sequence
  Description of Artificial Sequence: Synthetic peptide
  Seed: YPLQSPQSR (MAGC1_HUMAN)
YPLQSPQST

SEQ ID NO: 68555 - protein, 9 aa, Artificial Sequence
  Description of Artificial Sequence: Synthetic peptide
  Seed: SPLEISQSP (MAGC1_HUMAN)
SPLEISQSL

SEQ ID NO: 68556 - protein, 10 aa, Artificial Sequence
  Description of Artificial Sequence: Synthetic peptide
  Seed: RFLLLKYQVK (MAGC1_HUMAN)
RQLLLKYQVR

SEQ ID NO: 68557 - protein, 9 aa, Artificial Sequence
  Description of Artificial Sequence: Synthetic peptide
  Seed: FSSTLVSLF (MAGC1_HUMAN)
FSSTLVSLI

SEQ ID NO: 68558 - protein, 9 aa, Artificial Sequence
  Description of Artificial Sequence: Synthetic peptide
  Seed: GENTHSPLQ (MAGC1_HUMAN)
GENTHSPLV

SEQ ID NO: 68559 - protein, 9 aa, Artificial Sequence
  Description of Artificial Sequence: Synthetic peptide
  Seed: VSSSFSYTL (MAGC1_HUMAN)
VNSSFSYTF

SEQ ID NO: 68560 - protein, 9 aa, Artificial Sequence
  Description of Artificial Sequence: Synthetic peptide
  Seed: FPVIFRKAR (MAGC1_HUMAN)
FIVIFRKAR

SEQ ID NO: 68561 - protein, 9 aa, Artificial Sequence
  Description of Artificial Sequence: Synthetic peptide
  Seed: REHFAFGEP (MAGC1_HUMAN)
REHFAFGET

SEQ ID NO: 68562 - protein, 11 aa, Artificial Sequence
  Description of Artificial Sequence: Synthetic peptide
  Seed: AIIDTTDDSTA (MAGC1_HUMAN)
AVIDTTDDSTL

SEQ ID NO: 68563 - protein, 9 aa, Artificial Sequence
  Description of Artificial Sequence: Synthetic peptide
  Seed: YQVKQPITK (MAGC1_HUMAN)
YIVKQPITR

SEQ ID NO: 68564 - protein, 10 aa, Artificial Sequence
  Description of Artificial Sequence: Synthetic peptide
  Seed: ICSSSTPSSL (MAGC1_HUMAN)
IASSSTPSSY

SEQ ID NO: 68565 - protein, 9 aa, Artificial Sequence
  Description of Artificial Sequence: Synthetic peptide
  Seed: KVVEFLAML (MAGC1_HUMAN)
KRVEFLAMI

SEQ ID NO: 68566 - protein, 9 aa, Artificial Sequence
  Description of Artificial Sequence: Synthetic peptide
  Seed: MSQNRLLIL (MAGC1_HUMAN)
MEQNRLLIY

SEQ ID NO: 68567 - protein, 9 aa, Artificial Sequence
  Description of Artificial Sequence: Synthetic peptide
  Seed: FPSSTSSSL (MAGC1_HUMAN)
FPSSTSSSA

SEQ ID NO: 68568 - protein, 10 aa, Artificial Sequence
  Description of Artificial Sequence: Synthetic peptide
  Seed: VSSSSSSSTL (MAGC1_HUMAN)
VESSSSSSTW

SEQ ID NO: 68569 - protein, 9 aa, Artificial Sequence
  Description of Artificial Sequence: Synthetic peptide
  Seed: SIIFIKGTY (MAGC1_HUMAN)
SIIFIKGTK

SEQ ID NO: 68570 - protein, 9 aa, Artificial Sequence
  Description of Artificial Sequence: Synthetic peptide
  Seed: SSSTSLSPF (MAGC1_HUMAN)
SPSTSLSPY

SEQ ID NO: 68571 - protein, 9 aa, Artificial Sequence
  Description of Artificial Sequence: Synthetic peptide
  Seed: SQSPPEGPV (MAGC1_HUMAN)
SMSPPEGPM

SEQ ID NO: 68572 - protein, 10 aa, Artificial Sequence
  Description of Artificial Sequence: Synthetic peptide
  Seed: QSPLQIPVSR (MAGC1_HUMAN)
QVPLQIPVSR

SEQ ID NO: 68573 - protein, 11 aa, Artificial Sequence
  Description of Artificial Sequence: Synthetic peptide
  Seed: SPLQIPGSPSF (MAGC1_HUMAN)
SCLQIPGSPSM

SEQ ID NO: 68574 - protein, 9 aa, Artificial Sequence
  Description of Artificial Sequence: Synthetic peptide
  Seed: LQIVPSLPE (MAGC1_HUMAN)
LMIVPSLPV

SEQ ID NO: 68575 - protein, 9 aa, Artificial Sequence
  Description of Artificial Sequence: Synthetic peptide
  Seed: LQIPGSPSF (MAGC1_HUMAN)
LTIPGSPSM

SEQ ID NO: 68576 - protein, 9 aa, Artificial Sequence
  Description of Artificial Sequence: Synthetic peptide
  Seed: AFGEPRELL (MAGC1_HUMAN)
AAGEPRELL

SEQ ID NO: 68577 - protein, 8 aa, Artificial Sequence
  Description of Artificial Sequence: Synthetic peptide
  Seed: YPLQSPQS (MAGC1_HUMAN)
YPLQSPQA

SEQ ID NO: 68578 - protein, 9 aa, Artificial Sequence
  Description of Artificial Sequence: Synthetic peptide
  Seed: VQSPLQNPA (MAGC1_HUMAN)
VESPLQNPP

SEQ ID NO: 68579 - protein, 9 aa, Artificial Sequence
  Description of Artificial Sequence: Synthetic peptide
  Seed: KQPITKAEM (MAGC1_HUMAN)
KFPITKAEY

SEQ ID NO: 68580 - protein, 9 aa, Artificial Sequence
  Description of Artificial Sequence: Synthetic peptide
  Seed: THSPLQIVP (MAGC1_HUMAN)
THSPLQIVT

SEQ ID NO: 68581 - protein, 9 aa, Artificial Sequence
  Description of Artificial Sequence: Synthetic peptide
  Seed: SASSSVMSP (MAGC1_HUMAN)
SSSSSVMSM

SEQ ID NO: 68582 - protein, 9 aa, Artificial Sequence
  Description of Artificial Sequence: Synthetic peptide
  Seed: GFPQSVLQI (MAGC1_HUMAN)
GYPQSVLQF

SEQ ID NO: 68583 - protein, 10 aa, Artificial Sequence
  Description of Artificial Sequence: Synthetic peptide
  Seed: EVIWDVLSGI (MAGC1_HUMAN)
EDIWDVLSGV

SEQ ID NO: 68584 - protein, 9 aa, Artificial Sequence
  Description of Artificial Sequence: Synthetic peptide
  Seed: SSSTLLSLF (MAGC1_HUMAN)
SKSTLLSLY

SEQ ID NO: 68585 - protein, 10 aa, Artificial Sequence
  Description of Artificial Sequence: Synthetic peptide
  Seed: ATESASSSVM (MAGC1_HUMAN)
ANESASSSVW

SEQ ID NO: 68586 - protein, 9 aa, Artificial Sequence
  Description of Artificial Sequence: Synthetic peptide
  Seed: MPTAGMPSL (MAGC1_HUMAN)
MITAGMPSY

SEQ ID NO: 68587 - protein, 10 aa, Artificial Sequence
  Description of Artificial Sequence: Synthetic peptide
  Seed: RSFSSTLLSI (MAGC1_HUMAN)
RKFSSTLLSI

SEQ ID NO: 68588 - protein, 11 aa, Artificial Sequence
  Description of Artificial Sequence: Synthetic peptide
  Seed: IIDTTDDSTAT (MAGC1_HUMAN)
IADTTDDSTAV

SEQ ID NO: 68589 - protein, 9 aa, Artificial Sequence
  Description of Artificial Sequence: Synthetic peptide
  Seed: FPSSTSSSL (MAGC1_HUMAN)
FPSSTSSSS

SEQ ID NO: 68590 - protein, 9 aa, Artificial Sequence
  Description of Artificial Sequence: Synthetic peptide
  Seed: GFPQSLLQI (MAGC1_HUMAN)
GYPQSLLQW

SEQ ID NO: 68591 - protein, 9 aa, Artificial Sequence
  Description of Artificial Sequence: Synthetic peptide
  Seed: LQRPVSSFF (MAGC1_HUMAN)
LNRPVSSFF

SEQ ID NO: 68592 - protein, 9 aa, Artificial Sequence
  Description of Artificial Sequence: Synthetic peptide
  Seed: RLLILILSI (MAGC1_HUMAN)
RSLILILSY

SEQ ID NO: 68593 - protein, 9 aa, Artificial Sequence
  Description of Artificial Sequence: Synthetic peptide
  Seed: FQSSLQSPV (MAGC1_HUMAN)
FLSSLQSPG

SEQ ID NO: 68594 - protein, 11 aa, Artificial Sequence
  Description of Artificial Sequence: Synthetic peptide
  Seed: RSFSSTLLSIF (MAGC1_HUMAN)
RVFSSTLLSIM

SEQ ID NO: 68595 - protein, 9 aa, Artificial Sequence
  Description of Artificial Sequence: Synthetic peptide
  Seed: LQIPGSPSF (MAGC1_HUMAN)
LFIPGSPSW

SEQ ID NO: 68596 - protein, 9 aa, Artificial Sequence
  Description of Artificial Sequence: Synthetic peptide
  Seed: EVDPDDSYV (MAGC1_HUMAN)
ELDPDDSYM

SEQ ID NO: 68597 - protein, 10 aa, Artificial Sequence
  Description of Artificial Sequence: Synthetic peptide
  Seed: MSPLYFPQSP (MAGC1_HUMAN)
MHPLYFPQSV

SEQ ID NO: 68598 - protein, 10 aa, Artificial Sequence
  Description of Artificial Sequence: Synthetic peptide
  Seed: SFPSSTSSSL (MAGC1_HUMAN)
SWPSSTSSSY

SEQ ID NO: 68599 - protein, 9 aa, Artificial Sequence
  Description of Artificial Sequence: Synthetic peptide
  Seed: FPSSYKDAL (MAGC1_HUMAN)
FHSSYKDAM

SEQ ID NO: 68600 - protein, 9 aa, Artificial Sequence
  Description of Artificial Sequence: Synthetic peptide
  Seed: SSSSSSSTL (MAGC1_HUMAN)
SRSSSSSTY

SEQ ID NO: 68601 - protein, 11 aa, Artificial Sequence
  Description of Artificial Sequence: Synthetic peptide
  Seed: SSFPSSTSSSL (MAGC1_HUMAN)
SFFPSSTSSSF

SEQ ID NO: 68602 - protein, 10 aa, Artificial Sequence
  Description of Artificial Sequence: Synthetic peptide
  Seed: YTLASLLQSS (MAGC1_HUMAN)
YKLASLLQSV

SEQ ID NO: 68603 - protein, 9 aa, Artificial Sequence
  Description of Artificial Sequence: Synthetic peptide
  Seed: EFIEILFGI (MAGC1_HUMAN)
EFIEILFGV

SEQ ID NO: 68604 - protein, 10 aa, Artificial Sequence
  Description of Artificial Sequence: Synthetic peptide
  Seed: FQSSLQSPVS (MAGC1_HUMAN)
FVSSLQSPVV

SEQ ID NO: 68605 - protein, 11 aa, Artificial Sequence
  Description of Artificial Sequence: Synthetic peptide
  Seed: QSSPESDDTLY (MAGC1_HUMAN)
QSSPESDDTLW

SEQ ID NO: 68606 - protein, 9 aa, Artificial Sequence
  Description of Artificial Sequence: Synthetic peptide
  Seed: FSSTLVSLF (MAGC1_HUMAN)
FGSTLVSLL

SEQ ID NO: 68607 - protein, 10 aa, Artificial Sequence
  Description of Artificial Sequence: Synthetic peptide
  Seed: FPQSLLQIPM (MAGC1_HUMAN)
FGQSLLQIPY

SEQ ID NO: 68608 - protein, 9 aa, Artificial Sequence
  Description of Artificial Sequence: Synthetic peptide
  Seed: FQSSPERTH (MAGC1_HUMAN)
FTSSPERTL

SEQ ID NO: 68609 - protein, 9 aa, Artificial Sequence
  Description of Artificial Sequence: Synthetic peptide
  Seed: SAQSTFEGF (MAGC1_HUMAN)
SAQSTFEGW

SEQ ID NO: 68610 - protein, 10 aa, Artificial Sequence
  Description of Artificial Sequence: Synthetic peptide
  Seed: SPLYFPQSPL (MAGC1_HUMAN)
SVLYFPQSPI

SEQ ID NO: 68611 - protein, 11 aa, Artificial Sequence
  Description of Artificial Sequence: Synthetic peptide
  Seed: IPVSSSSSSTL (MAGC1_HUMAN)
IAVSSSSSSTF

SEQ ID NO: 68612 - protein, 9 aa, Artificial Sequence
  Description of Artificial Sequence: Synthetic peptide
  Seed: YTLASLLQS (MAGC1_HUMAN)
YTLASLLQA

SEQ ID NO: 68613 - protein, 9 aa, Artificial Sequence
  Description of Artificial Sequence: Synthetic peptide
  Seed: RPVSSFFSY (MAGC1_HUMAN)
RKVSSFFSF

SEQ ID NO: 68614 - protein, 9 aa, Artificial Sequence
  Description of Artificial Sequence: Synthetic peptide
  Seed: SQNRLLILI (MAGC1_HUMAN)
SDNRLLILL

SEQ ID NO: 68615 - protein, 11 aa, Artificial Sequence
  Description of Artificial Sequence: Synthetic peptide
  Seed: SPLQIPVSRSF (MAGC1_HUMAN)
SSLQIPVSRSF

SEQ ID NO: 68616 - protein, 10 aa, Artificial Sequence
  Description of Artificial Sequence: Synthetic peptide
  Seed: VSSSSSSSTL (MAGC1_HUMAN)
VHSSSSSSTF

SEQ ID NO: 68617 - protein, 9 aa, Artificial Sequence
  Description of Artificial Sequence: Synthetic peptide
  Seed: SAQSTFEGF (MAGC1_HUMAN)
SQQSTFEGY

SEQ ID NO: 68618 - protein, 9 aa, Artificial Sequence
  Description of Artificial Sequence: Synthetic peptide
  Seed: IESEPLFTY (MAGC1_HUMAN)
IESEPLFTT

SEQ ID NO: 68619 - protein, 11 aa, Artificial Sequence
  Description of Artificial Sequence: Synthetic peptide
  Seed: SSTSLSLPQSF (MAGC1_HUMAN)
SCTSLSLPQSW

SEQ ID NO: 68620 - protein, 9 aa, Artificial Sequence
  Description of Artificial Sequence: Synthetic peptide
  Seed: MLTNVISRY (MAGC1_HUMAN)
MTTNVISRF

SEQ ID NO: 68621 - protein, 9 aa, Artificial Sequence
  Description of Artificial Sequence: Synthetic peptide
  Seed: SSSFSYTLL (MAGC1_HUMAN)
STSFSYTLA

SEQ ID NO: 68622 - protein, 9 aa, Artificial Sequence
  Description of Artificial Sequence: Synthetic peptide
  Seed: RSFSSTLLS (MAGC1_HUMAN)
RSFSSTLLF

SEQ ID NO: 68623 - protein, 11 aa, Artificial Sequence
  Description of Artificial Sequence: Synthetic peptide
  Seed: SICSSSTPSSL (MAGC1_HUMAN)
SMCSSSTPSSY

SEQ ID NO: 68624 - protein, 9 aa, Artificial Sequence
  Description of Artificial Sequence: Synthetic peptide
  Seed: LSPLHFPQF (MAGC1_HUMAN)
LIPLHFPQM

SEQ ID NO: 68625 - protein, 11 aa, Artificial Sequence
  Description of Artificial Sequence: Synthetic peptide
  Seed: TTDDSTATESA (MAGC1_HUMAN)
TCDDSTATESF

SEQ ID NO: 68626 - protein, 10 aa, Artificial Sequence
  Description of Artificial Sequence: Synthetic peptide
  Seed: ISRYTGYFPV (MAGC1_HUMAN)
IQRYTGYFPL

SEQ ID NO: 68627 - protein, 11 aa, Artificial Sequence
  Description of Artificial Sequence: Synthetic peptide
  Seed: SLIESEPLFTY (MAGC1_HUMAN)
SMIESEPLFTM

SEQ ID NO: 68628 - protein, 9 aa, Artificial Sequence
  Description of Artificial Sequence: Synthetic peptide
  Seed: TLVSIFQSS (MAGC1_HUMAN)
TTVSIFQSV

SEQ ID NO: 68629 - protein, 9 aa, Artificial Sequence
  Description of Artificial Sequence: Synthetic peptide
  Seed: SSPERTHST (MAGC1_HUMAN)
SMPERTHSV

SEQ ID NO: 68630 - protein, 11 aa, Artificial Sequence
  Description of Artificial Sequence: Synthetic peptide
  Seed: REVDPDDSYVF (MAGC1_HUMAN)
REVDPDDSYVC

SEQ ID NO: 68631 - protein, 10 aa, Artificial Sequence
  Description of Artificial Sequence: Synthetic peptide
  Seed: KVVEFLAMLK (MAGC1_HUMAN)
KEVEFLAMLR

SEQ ID NO: 68632 - protein, 10 aa, Artificial Sequence
  Description of Artificial Sequence: Synthetic peptide
  Seed: RAGREHFAFG (MAGC1_HUMAN)
RVGREHFAFY

SEQ ID NO: 68633 - protein, 9 aa, Artificial Sequence
  Description of Artificial Sequence: Synthetic peptide
  Seed: WVQEHYLEY (MAGC1_HUMAN)
WWQEHYLEY

SEQ ID NO: 68634 - protein, 9 aa, Artificial Sequence
  Description of Artificial Sequence: Synthetic peptide
  Seed: SLIESEPLF (MAGC1_HUMAN)
SLIESEPLW

SEQ ID NO: 68635 - protein, 9 aa, Artificial Sequence
  Description of Artificial Sequence: Synthetic peptide
  Seed: AQSPLQRPV (MAGC1_HUMAN)
AQSPLQRPI

SEQ ID NO: 68636 - protein, 9 aa, Artificial Sequence
  Description of Artificial Sequence: Synthetic peptide
  Seed: LQNPASSFF (MAGC1_HUMAN)
LMNPASSFI

SEQ ID NO: 68637 - protein, 9 aa, Artificial Sequence
  Description of Artificial Sequence: Synthetic peptide
  Seed: SFSSTLVSL (MAGC1_HUMAN)
SVSSTLVSF

SEQ ID NO: 68638 - protein, 9 aa, Artificial Sequence
  Description of Artificial Sequence: Synthetic peptide
  Seed: VSPSFSSTL (MAGC1_HUMAN)
VLPSFSSTL

SEQ ID NO: 68639 - protein, 11 aa, Artificial Sequence
  Description of Artificial Sequence: Synthetic peptide
  Seed: SSSFSYTLLSL (MAGC1_HUMAN)
SKSFSYTLLSF

SEQ ID NO: 68640 - protein, 10 aa, Artificial Sequence
  Description of Artificial Sequence: Synthetic peptide
  Seed: VSSSFSYTLL (MAGC1_HUMAN)
VQSSFSYTLF

SEQ ID NO: 68641 - protein, 9 aa, Artificial Sequence
  Description of Artificial Sequence: Synthetic peptide
  Seed: SQSPPEGPV (MAGC1_HUMAN)
SMSPPEGPI

SEQ ID NO: 68642 - protein, 9 aa, Artificial Sequence
  Description of Artificial Sequence: Synthetic peptide
  Seed: EYTSSSDTL (MAGC1_HUMAN)
EHTSSSDTV

SEQ ID NO: 68643 - protein, 9 aa, Artificial Sequence
  Description of Artificial Sequence: Synthetic peptide
  Seed: GFPQSLLQI (MAGC1_HUMAN)
GIPQSLLQL

SEQ ID NO: 68644 - protein, 9 aa, Artificial Sequence
  Description of Artificial Sequence: Synthetic peptide
  Seed: SRSFSSTLL (MAGC1_HUMAN)
SHSFSSTLI

SEQ ID NO: 68645 - protein, 9 aa, Artificial Sequence
  Description of Artificial Sequence: Synthetic peptide
  Seed: VSSSFSYTL (MAGC1_HUMAN)
VSSSFSYTI

SEQ ID NO: 68646 - protein, 9 aa, Artificial Sequence
  Description of Artificial Sequence: Synthetic peptide
  Seed: AQSPLQRPV (MAGC1_HUMAN)
AESPLQRPI

SEQ ID NO: 68647 - protein, 11 aa, Artificial Sequence
  Description of Artificial Sequence: Synthetic peptide
  Seed: SLFQSSPERTH (MAGC1_HUMAN)
SMFQSSPERTF

SEQ ID NO: 68648 - protein, 10 aa, Artificial Sequence
  Description of Artificial Sequence: Synthetic peptide
  Seed: LSQSSPVSSF (MAGC1_HUMAN)
LIQSSPVSSY

SEQ ID NO: 68649 - protein, 10 aa, Artificial Sequence
  Description of Artificial Sequence: Synthetic peptide
  Seed: MPTAGMPSLL (MAGC1_HUMAN)
MSTAGMPSLL

SEQ ID NO: 68650 - protein, 10 aa, Artificial Sequence
  Description of Artificial Sequence: Synthetic peptide
  Seed: TTDDSTATES (MAGC1_HUMAN)
TMDDSTATEM

SEQ ID NO: 68651 - protein, 9 aa, Artificial Sequence
  Description of Artificial Sequence: Synthetic peptide
  Seed: SSSVMSPSF (MAGC1_HUMAN)
SISVMSPSW

SEQ ID NO: 68652 - protein, 9 aa, Artificial Sequence
  Description of Artificial Sequence: Synthetic peptide
  Seed: TTDDSTATE (MAGC1_HUMAN)
TMDDSTATC

SEQ ID NO: 68653 - protein, 9 aa, Artificial Sequence
  Description of Artificial Sequence: Synthetic peptide
  Seed: CSSSTPSSL (MAGC1_HUMAN)
CRSSTPSSY

SEQ ID NO: 68654 - protein, 9 aa, Artificial Sequence
  Description of Artificial Sequence: Synthetic peptide
  Seed: LKYQVKQPI (MAGC1_HUMAN)
LEYQVKQPF

SEQ ID NO: 68655 - protein, 9 aa, Artificial Sequence
  Description of Artificial Sequence: Synthetic peptide
  Seed: VSSFFSYTL (MAGC1_HUMAN)
VMSFFSYTV

SEQ ID NO: 68656 - protein, 10 aa, Artificial Sequence
  Description of Artificial Sequence: Synthetic peptide
  Seed: QGEDSMSPLY (MAGC1_HUMAN)
QEEDSMSPLW

SEQ ID NO: 68657 - protein, 11 aa, Artificial Sequence
  Description of Artificial Sequence: Synthetic peptide
  Seed: SSFPSSTSSSL (MAGC1_HUMAN)
SKFPSSTSSSM

SEQ ID NO: 68658 - protein, 8 aa, Artificial Sequence
  Description of Artificial Sequence: Synthetic peptide
  Seed: SSFSSTLL (MAGC1_HUMAN)
SQFSSTLL

SEQ ID NO: 68659 - protein, 9 aa, Artificial Sequence
  Description of Artificial Sequence: Synthetic peptide
  Seed: LKYQVKQPI (MAGC1_HUMAN)
LQYQVKQPF

SEQ ID NO: 68660 - protein, 10 aa, Artificial Sequence
  Description of Artificial Sequence: Synthetic peptide
  Seed: SVLQIPVSAA (MAGC1_HUMAN)
SLLQIPVSAL

SEQ ID NO: 68661 - protein, 9 aa, Artificial Sequence
  Description of Artificial Sequence: Synthetic peptide
  Seed: VQSPLQNPA (MAGC1_HUMAN)
VTSPLQNPV

SEQ ID NO: 68662 - protein, 10 aa, Artificial Sequence
  Description of Artificial Sequence: Synthetic peptide
  Seed: QSPLQIPVSR (MAGC1_HUMAN)
QTPLQIPVSR

SEQ ID NO: 68663 - protein, 9 aa, Artificial Sequence
  Description of Artificial Sequence: Synthetic peptide
  Seed: LQSPVISFS (MAGC1_HUMAN)
LLSPVISFL

SEQ ID NO: 68664 - protein, 9 aa, Artificial Sequence
  Description of Artificial Sequence: Synthetic peptide
  Seed: RYTGYFPVI (MAGC1_HUMAN)
RRTGYFPVL

SEQ ID NO: 68665 - protein, 9 aa, Artificial Sequence
  Description of Artificial Sequence: Synthetic peptide
  Seed: SQNRLLILI (MAGC1_HUMAN)
SMNRLLILM

SEQ ID NO: 68666 - protein, 9 aa, Artificial Sequence
  Description of Artificial Sequence: Synthetic peptide
  Seed: IESEPLFTY (MAGC1_HUMAN)
ISSEPLFTY

SEQ ID NO: 68667 - protein, 8 aa, Artificial Sequence
  Description of Artificial Sequence: Synthetic peptide
  Seed: SSFFSSAL (MAGC1_HUMAN)
SMFFSSAL

SEQ ID NO: 68668 - protein, 9 aa, Artificial Sequence
  Description of Artificial Sequence: Synthetic peptide
  Seed: SQNRLLILI (MAGC1_HUMAN)
SLNRLLILL

SEQ ID NO: 68669 - protein, 9 aa, Artificial Sequence
  Description of Artificial Sequence: Synthetic peptide
  Seed: MPTAGMPSL (MAGC1_HUMAN)
MQTAGMPSM

SEQ ID NO: 68670 - protein, 11 aa, Artificial Sequence
  Description of Artificial Sequence: Synthetic peptide
  Seed: IPGSPSFSSTL (MAGC1_HUMAN)
IPGSPSFSSTW

SEQ ID NO: 68671 - protein, 10 aa, Artificial Sequence
  Description of Artificial Sequence: Synthetic peptide
  Seed: YTLLSLFQSS (MAGC1_HUMAN)
YGLLSLFQSV

SEQ ID NO: 68672 - protein, 9 aa, Artificial Sequence
  Description of Artificial Sequence: Synthetic peptide
  Seed: DPDDSYVFV (MAGC1_HUMAN)
DSDDSYVFL

SEQ ID NO: 68673 - protein, 9 aa, Artificial Sequence
  Description of Artificial Sequence: Synthetic peptide
  Seed: AMLKNTVPI (MAGC1_HUMAN)
AMLKNTVPW

SEQ ID NO: 68674 - protein, 9 aa, Artificial Sequence
  Description of Artificial Sequence: Synthetic peptide
  Seed: AGREHFAFG (MAGC1_HUMAN)
ASREHFAFR

SEQ ID NO: 68675 - protein, 10 aa, Artificial Sequence
  Description of Artificial Sequence: Synthetic peptide
  Seed: FAQSSLQIPV (MAGC1_HUMAN)
FVQSSLQIPI

SEQ ID NO: 68676 - protein, 9 aa, Artificial Sequence
  Description of Artificial Sequence: Synthetic peptide
  Seed: YQVKQPITK (MAGC1_HUMAN)
YRVKQPITF

SEQ ID NO: 68677 - protein, 9 aa, Artificial Sequence
  Description of Artificial Sequence: Synthetic peptide
  Seed: KQPITKAEM (MAGC1_HUMAN)
KEPITKAEL

SEQ ID NO: 68678 - protein, 10 aa, Artificial Sequence
  Description of Artificial Sequence: Synthetic peptide
  Seed: SLFQSSPECT (MAGC1_HUMAN)
SLFQSSPECI

SEQ ID NO: 68679 - protein, 10 aa, Artificial Sequence
  Description of Artificial Sequence: Synthetic peptide
  Seed: SIFQSSPESA (MAGC1_HUMAN)
STFQSSPESL

SEQ ID NO: 68680 - protein, 9 aa, Artificial Sequence
  Description of Artificial Sequence: Synthetic peptide
  Seed: MTSSFSSTL (MAGC1_HUMAN)
MTSSFSSTA

SEQ ID NO: 68681 - protein, 9 aa, Artificial Sequence
  Description of Artificial Sequence: Synthetic peptide
  Seed: VQSPLHSPQ (MAGC1_HUMAN)
VQSPLHSPY

SEQ ID NO: 68682 - protein, 9 aa, Artificial Sequence
  Description of Artificial Sequence: Synthetic peptide
  Seed: FSERTQSTF (MAGC1_HUMAN)
FTERTQSTF

SEQ ID NO: 68683 - protein, 9 aa, Artificial Sequence
  Description of Artificial Sequence: Synthetic peptide
  Seed: SAPEGEDSL (MAGC1_HUMAN)
SGPEGEDSM

SEQ ID NO: 68684 - protein, 9 aa, Artificial Sequence
  Description of Artificial Sequence: Synthetic peptide
  Seed: RLLILILSI (MAGC1_HUMAN)
RILILILSL

SEQ ID NO: 68685 - protein, 9 aa, Artificial Sequence
  Description of Artificial Sequence: Synthetic peptide
  Seed: LQIPVSRSF (MAGC1_HUMAN)
LRIPVSRSL

SEQ ID NO: 68686 - protein, 9 aa, Artificial Sequence
  Description of Artificial Sequence: Synthetic peptide
  Seed: SPLEISQSP (MAGC1_HUMAN)
SPLEISQSV

SEQ ID NO: 68687 - protein, 10 aa, Artificial Sequence
  Description of Artificial Sequence: Synthetic peptide
  Seed: NPASSFFSSA (MAGC1_HUMAN)
NAASSFFSSV

SEQ ID NO: 68688 - protein, 9 aa, Artificial Sequence
  Description of Artificial Sequence: Synthetic peptide
  Seed: MSQNRLLIL (MAGC1_HUMAN)
MSQNRLLIF

SEQ ID NO: 68689 - protein, 10 aa, Artificial Sequence
  Description of Artificial Sequence: Synthetic peptide
  Seed: RYTGYFPVIF (MAGC1_HUMAN)
RGTGYFPVIW

SEQ ID NO: 68690 - protein, 9 aa, Artificial Sequence
  Description of Artificial Sequence: Synthetic peptide
  Seed: IESEPLFTY (MAGC1_HUMAN)
IVSEPLFTF

SEQ ID NO: 68691 - protein, 10 aa, Artificial Sequence
  Description of Artificial Sequence: Synthetic peptide
  Seed: QGEDSMSPLY (MAGC1_HUMAN)
QQEDSMSPLW

SEQ ID NO: 68692 - protein, 10 aa, Artificial Sequence
  Description of Artificial Sequence: Synthetic peptide
  Seed: SFSSTLVSLF (MAGC1_HUMAN)
SQSSTLVSLM

SEQ ID NO: 68693 - protein, 9 aa, Artificial Sequence
  Description of Artificial Sequence: Synthetic peptide
  Seed: LKNTVPITF (MAGC1_HUMAN)
LYNTVPITF

SEQ ID NO: 68694 - protein, 9 aa, Artificial Sequence
  Description of Artificial Sequence: Synthetic peptide
  Seed: FSSTLLSLF (MAGC1_HUMAN)
FFSTLLSLF

SEQ ID NO: 68695 - protein, 11 aa, Artificial Sequence
  Description of Artificial Sequence: Synthetic peptide
  Seed: SPLQRPVSSFF (MAGC1_HUMAN)
SMLQRPVSSFY

SEQ ID NO: 68696 - protein, 9 aa, Artificial Sequence
  Description of Artificial Sequence: Synthetic peptide
  Seed: LKNTVPITF (MAGC1_HUMAN)
LFNTVPITM

SEQ ID NO: 68697 - protein, 10 aa, Artificial Sequence
  Description of Artificial Sequence: Synthetic peptide
  Seed: SLQIPVSPSF (MAGC1_HUMAN)
SHQIPVSPSM

SEQ ID NO: 68698 - protein, 9 aa, Artificial Sequence
  Description of Artificial Sequence: Synthetic peptide
  Seed: SSSFSYTLL (MAGC1_HUMAN)
SMSFSYTLK

SEQ ID NO: 68699 - protein, 9 aa, Artificial Sequence
  Description of Artificial Sequence: Synthetic peptide
  Seed: RAGREHFAF (MAGC1_HUMAN)
RKGREHFAM

SEQ ID NO: 68700 - protein, 10 aa, Artificial Sequence
  Description of Artificial Sequence: Synthetic peptide
  Seed: TGYFPVIFRK (MAGC1_HUMAN)
TVYFPVIFRQ

SEQ ID NO: 68701 - protein, 9 aa, Artificial Sequence
  Description of Artificial Sequence: Synthetic peptide
  Seed: SLPEWEDSL (MAGC1_HUMAN)
SRPEWEDSY

SEQ ID NO: 68702 - protein, 10 aa, Artificial Sequence
  Description of Artificial Sequence: Synthetic peptide
  Seed: STFEGFPQSL (MAGC1_HUMAN)
SHFEGFPQSI

SEQ ID NO: 68703 - protein, 9 aa, Artificial Sequence
  Description of Artificial Sequence: Synthetic peptide
  Seed: AQSPLQSPV (MAGC1_HUMAN)
AQSPLQSPM

SEQ ID NO: 68704 - protein, 9 aa, Artificial Sequence
  Description of Artificial Sequence: Synthetic peptide
  Seed: TSLSLPQSF (MAGC1_HUMAN)
TWLSLPQSL

SEQ ID NO: 68705 - protein, 9 aa, Artificial Sequence
  Description of Artificial Sequence: Synthetic peptide
  Seed: FSSALLSIF (MAGC1_HUMAN)
FYSALLSIF

SEQ ID NO: 68706 - protein, 10 aa, Artificial Sequence
  Description of Artificial Sequence: Synthetic peptide
  Seed: SSFSSTLLSI (MAGC1_HUMAN)
SLFSSTLLSA

SEQ ID NO: 68707 - protein, 8 aa, Artificial Sequence
  Description of Artificial Sequence: Synthetic peptide
  Seed: MSQNRLLI (MAGC1_HUMAN)
MSQNRLLM

SEQ ID NO: 68708 - protein, 11 aa, Artificial Sequence
  Description of Artificial Sequence: Synthetic peptide
  Seed: SPLQIPVSPSS (MAGC1_HUMAN)
SRLQIPVSPSF

SEQ ID NO: 68709 - protein, 11 aa, Artificial Sequence
  Description of Artificial Sequence: Synthetic peptide
  Seed: SPLQIPVSPSS (MAGC1_HUMAN)
SMLQIPVSPSY

SEQ ID NO: 68710 - protein, 9 aa, Artificial Sequence
  Description of Artificial Sequence: Synthetic peptide
  Seed: SICSSSTSL (MAGC1_HUMAN)
SQCSSSTSY

SEQ ID NO: 68711 - protein, 10 aa, Artificial Sequence
  Description of Artificial Sequence: Synthetic peptide
  Seed: MTSSFSSTLL (MAGC1_HUMAN)
MWSSFSSTLW

SEQ ID NO: 68712 - protein, 9 aa, Artificial Sequence
  Description of Artificial Sequence: Synthetic peptide
  Seed: VPITFPSSY (MAGC1_HUMAN)
VSITFPSSM

SEQ ID NO: 68713 - protein, 9 aa, Artificial Sequence
  Description of Artificial Sequence: Synthetic peptide
  Seed: LSPLHFPQF (MAGC1_HUMAN)
LSPLHFPQY

SEQ ID NO: 68714 - protein, 9 aa, Artificial Sequence
  Description of Artificial Sequence: Synthetic peptide
  Seed: SPVSSFPSS (MAGC1_HUMAN)
SAVSSFPSA

SEQ ID NO: 68715 - protein, 10 aa, Artificial Sequence
  Description of Artificial Sequence: Synthetic peptide
  Seed: WGPRAHSEVI (MAGC1_HUMAN)
WIPRAHSEVM

SEQ ID NO: 68716 - protein, 11 aa, Artificial Sequence
  Description of Artificial Sequence: Synthetic peptide
  Seed: STFEGFAQSSL (MAGC1_HUMAN)
SMFEGFAQSSM

SEQ ID NO: 68717 - protein, 10 aa, Artificial Sequence
  Description of Artificial Sequence: Synthetic peptide
  Seed: SSFSYTLLSL (MAGC1_HUMAN)
SIFSYTLLSY

SEQ ID NO: 68718 - protein, 9 aa, Artificial Sequence
  Description of Artificial Sequence: Synthetic peptide
  Seed: SSSTSLSPF (MAGC1_HUMAN)
SFSTSLSPV

SEQ ID NO: 68719 - protein, 9 aa, Artificial Sequence
  Description of Artificial Sequence: Synthetic peptide
  Seed: QVKQPITKA (MAGC1_HUMAN)
QTKQPITKR

SEQ ID NO: 68720 - protein, 10 aa, Artificial Sequence
  Description of Artificial Sequence: Synthetic peptide
  Seed: SYVFVNTLDL (MAGC1_HUMAN)
SWVFVNTLDW

SEQ ID NO: 68721 - protein, 9 aa, Artificial Sequence
  Description of Artificial Sequence: Synthetic peptide
  Seed: VSPSSSSTL (MAGC1_HUMAN)
VMPSSSSTV

SEQ ID NO: 68722 - protein, 10 aa, Artificial Sequence
  Description of Artificial Sequence: Synthetic peptide
  Seed: EVIWDVLSGI (MAGC1_HUMAN)
EIIWDVLSGA

SEQ ID NO: 68723 - protein, 9 aa, Artificial Sequence
  Description of Artificial Sequence: Synthetic peptide
  Seed: FSSALLSIF (MAGC1_HUMAN)
FPSALLSIF

SEQ ID NO: 68724 - protein, 10 aa, Artificial Sequence
  Description of Artificial Sequence: Synthetic peptide
  Seed: FPQSVLQIPV (MAGC1_HUMAN)
FIQSVLQIPI

SEQ ID NO: 68725 - protein, 9 aa, Artificial Sequence
  Description of Artificial Sequence: Synthetic peptide
  Seed: LQIPVSPSF (MAGC1_HUMAN)
LNIPVSPSW

SEQ ID NO: 68726 - protein, 9 aa, Artificial Sequence
  Description of Artificial Sequence: Synthetic peptide
  Seed: CSSSTPSSL (MAGC1_HUMAN)
CISSTPSSY

SEQ ID NO: 68727 - protein, 9 aa, Artificial Sequence
  Description of Artificial Sequence: Synthetic peptide
  Seed: SSSFSYTLL (MAGC1_HUMAN)
STSFSYTLK

SEQ ID NO: 68728 - protein, 11 aa, Artificial Sequence
  Description of Artificial Sequence: Synthetic peptide
  Seed: IIDTTDDSTAT (MAGC1_HUMAN)
IMDTTDDSTAV

SEQ ID NO: 68729 - protein, 9 aa, Artificial Sequence
  Description of Artificial Sequence: Synthetic peptide
  Seed: VPNSSPPRY (MAGC1_HUMAN)
VPNSSPPRM

SEQ ID NO: 68730 - protein, 9 aa, Artificial Sequence
  Description of Artificial Sequence: Synthetic peptide
  Seed: RTHSTFEGF (MAGC1_HUMAN)
RIHSTFEGY

SEQ ID NO: 68731 - protein, 9 aa, Artificial Sequence
  Description of Artificial Sequence: Synthetic peptide
  Seed: SSPESAQSA (MAGC1_HUMAN)
SLPESAQSL

SEQ ID NO: 68732 - protein, 10 aa, Artificial Sequence
  Description of Artificial Sequence: Synthetic peptide
  Seed: EILFGISLRE (MAGC1_HUMAN)
ETLFGISLRY

SEQ ID NO: 68733 - protein, 9 aa, Artificial Sequence
  Description of Artificial Sequence: Synthetic peptide
  Seed: MLTNVISRY (MAGC1_HUMAN)
MMTNVISRK

SEQ ID NO: 68734 - protein, 10 aa, Artificial Sequence
  Description of Artificial Sequence: Synthetic peptide
  Seed: YASEEVIWDV (MAGC1_HUMAN)
YLSEEVIWDT

SEQ ID NO: 68735 - protein, 10 aa, Artificial Sequence
  Description of Artificial Sequence: Synthetic peptide
  Seed: SSPESAQSTF (MAGC1_HUMAN)
SMPESAQSTI

SEQ ID NO: 68736 - protein, 11 aa, Artificial Sequence
  Description of Artificial Sequence: Synthetic peptide
  Seed: IPVSAASSSTL (MAGC1_HUMAN)
ILVSAASSSTW

SEQ ID NO: 68737 - protein, 9 aa, Artificial Sequence
  Description of Artificial Sequence: Synthetic peptide
  Seed: SFFSYTLAS (MAGC1_HUMAN)
SWFSYTLAV

SEQ ID NO: 68738 - protein, 9 aa, Artificial Sequence
  Description of Artificial Sequence: Synthetic peptide
  Seed: SMSPLYFPQ (MAGC1_HUMAN)
SSSPLYFPK

SEQ ID NO: 68739 - protein, 11 aa, Artificial Sequence
  Description of Artificial Sequence: Synthetic peptide
  Seed: IPVSSSSSSTL (MAGC1_HUMAN)
IWVSSSSSSTW

SEQ ID NO: 68740 - protein, 9 aa, Artificial Sequence
  Description of Artificial Sequence: Synthetic peptide
  Seed: LSPLHFPQF (MAGC1_HUMAN)
LFPLHFPQY

SEQ ID NO: 68741 - protein, 9 aa, Artificial Sequence
  Description of Artificial Sequence: Synthetic peptide
  Seed: KDSQSPLQI (MAGC1_HUMAN)
KVSQSPLQI

SEQ ID NO: 68742 - protein, 9 aa, Artificial Sequence
  Description of Artificial Sequence: Synthetic peptide
  Seed: SSSFSYTLL (MAGC1_HUMAN)
SSSFSYTLM

SEQ ID NO: 68743 - protein, 9 aa, Artificial Sequence
  Description of Artificial Sequence: Synthetic peptide
  Seed: EHYLEYREV (MAGC1_HUMAN)
EQYLEYREV

SEQ ID NO: 68744 - protein, 9 aa, Artificial Sequence
  Description of Artificial Sequence: Synthetic peptide
  Seed: MPSLLQSSS (MAGC1_HUMAN)
MGSLLQSSY

SEQ ID NO: 68745 - protein, 9 aa, Artificial Sequence
  Description of Artificial Sequence: Synthetic peptide
  Seed: VIKRKVVEF (MAGC1_HUMAN)
VMKRKVVEW

SEQ ID NO: 68746 - protein, 11 aa, Artificial Sequence
  Description of Artificial Sequence: Synthetic peptide
  Seed: SRSFSSTLLSI (MAGC1_HUMAN)
SRSFSSTLLSF

SEQ ID NO: 68747 - protein, 8 aa, Artificial Sequence
  Description of Artificial Sequence: Synthetic peptide
  Seed: FIEILFGI (MAGC1_HUMAN)
FMEILFGV

SEQ ID NO: 68748 - protein, 10 aa, Artificial Sequence
  Description of Artificial Sequence: Synthetic peptide
  Seed: MPTAGMPSLL (MAGC1_HUMAN)
MFTAGMPSLF

SEQ ID NO: 68749 - protein, 9 aa, Artificial Sequence
  Description of Artificial Sequence: Synthetic peptide
  Seed: EMLTNVISR (MAGC1_HUMAN)
EYLTNVISK

SEQ ID NO: 68750 - protein, 9 aa, Artificial Sequence
  Description of Artificial Sequence: Synthetic peptide
  Seed: RTHSTFEGF (MAGC1_HUMAN)
RRHSTFEGY

SEQ ID NO: 68751 - protein, 10 aa, Artificial Sequence
  Description of Artificial Sequence: Synthetic peptide
  Seed: KVVEFLAMLK (MAGC1_HUMAN)
KTVEFLAMLL

SEQ ID NO: 68752 - protein, 9 aa, Artificial Sequence
  Description of Artificial Sequence: Synthetic peptide
  Seed: VSPSSSSTL (MAGC1_HUMAN)
VLPSSSSTI

SEQ ID NO: 68753 - protein, 10 aa, Artificial Sequence
  Description of Artificial Sequence: Synthetic peptide
  Seed: ASSSVMSPSF (MAGC1_HUMAN)
AYSSVMSPSW

SEQ ID NO: 68754 - protein, 9 aa, Artificial Sequence
  Description of Artificial Sequence: Synthetic peptide
  Seed: FSSTLLSIL (MAGC1_HUMAN)
FSSTLLSIY

SEQ ID NO: 68755 - protein, 10 aa, Artificial Sequence
  Description of Artificial Sequence: Synthetic peptide
  Seed: FPQSPLQIPV (MAGC1_HUMAN)
FPQSPLQIPT

SEQ ID NO: 68756 - protein, 10 aa, Artificial Sequence
  Description of Artificial Sequence: Synthetic peptide
  Seed: AEMLTNVISR (MAGC1_HUMAN)
AVMLTNVISK

SEQ ID NO: 68757 - protein, 10 aa, Artificial Sequence
  Description of Artificial Sequence: Synthetic peptide
  Seed: FQSSLQSPVS (MAGC1_HUMAN)
FLSSLQSPVP

SEQ ID NO: 68758 - protein, 10 aa, Artificial Sequence
  Description of Artificial Sequence: Synthetic peptide
  Seed: SFSYTLLSLF (MAGC1_HUMAN)
SDSYTLLSLW

SEQ ID NO: 68759 - protein, 9 aa, Artificial Sequence
  Description of Artificial Sequence: Synthetic peptide
  Seed: SLTDSESLI (MAGC1_HUMAN)
SLTDSESLV

SEQ ID NO: 68760 - protein, 10 aa, Artificial Sequence
  Description of Artificial Sequence: Synthetic peptide
  Seed: REFIEILFGI (MAGC1_HUMAN)
RSFIEILFGF

SEQ ID NO: 68761 - protein, 9 aa, Artificial Sequence
  Description of Artificial Sequence: Synthetic peptide
  Seed: SPLQIPMTS (MAGC1_HUMAN)
SVLQIPMTV

SEQ ID NO: 68762 - protein, 9 aa, Artificial Sequence
  Description of Artificial Sequence: Synthetic peptide
  Seed: TLLSIFQSS (MAGC1_HUMAN)
TMLSIFQSI

SEQ ID NO: 68763 - protein, 10 aa, Artificial Sequence
  Description of Artificial Sequence: Synthetic peptide
  Seed: VSSSSSSTLL (MAGC1_HUMAN)
VVSSSSSTLW

SEQ ID NO: 68764 - protein, 11 aa, Artificial Sequence
  Description of Artificial Sequence: Synthetic peptide
  Seed: REVDPDDSYVF (MAGC1_HUMAN)
RQVDPDDSYVM

SEQ ID NO: 68765 - protein, 9 aa, Artificial Sequence
  Description of Artificial Sequence: Synthetic peptide
  Seed: MLTNVISRY (MAGC1_HUMAN)
MTTNVISRK

SEQ ID NO: 68766 - protein, 9 aa, Artificial Sequence
  Description of Artificial Sequence: Synthetic peptide
  Seed: IESEPLFTY (MAGC1_HUMAN)
ITSEPLFTI

SEQ ID NO: 68767 - protein, 11 aa, Artificial Sequence
  Description of Artificial Sequence: Synthetic peptide
  Seed: IPVSSSSSSTL (MAGC1_HUMAN)
IIVSSSSSSTF

SEQ ID NO: 68768 - protein, 9 aa, Artificial Sequence
  Description of Artificial Sequence: Synthetic peptide
  Seed: RTQSTFEGF (MAGC1_HUMAN)
RQQSTFEGF

SEQ ID NO: 68769 - protein, 10 aa, Artificial Sequence
  Description of Artificial Sequence: Synthetic peptide
  Seed: FAQSSLQIPV (MAGC1_HUMAN)
FMQSSLQIPL

SEQ ID NO: 68770 - protein, 10 aa, Artificial Sequence
  Description of Artificial Sequence: Synthetic peptide
  Seed: RPVSSFFSYT (MAGC1_HUMAN)
RTVSSFFSYI

SEQ ID NO: 68771 - protein, 11 aa, Artificial Sequence
  Description of Artificial Sequence: Synthetic peptide
  Seed: YTGYFPVIFRK (MAGC1_HUMAN)
YAGYFPVIFRR

SEQ ID NO: 68772 - protein, 10 aa, Artificial Sequence
  Description of Artificial Sequence: Synthetic peptide
  Seed: FSSSTSLSPF (MAGC1_HUMAN)
FGSSTSLSPF

SEQ ID NO: 68773 - protein, 9 aa, Artificial Sequence
  Description of Artificial Sequence: Synthetic peptide
  Seed: FPSSTSSSL (MAGC1_HUMAN)
FMSSTSSSY

SEQ ID NO: 68774 - protein, 9 aa, Artificial Sequence
  Description of Artificial Sequence: Synthetic peptide
  Seed: GSPSFSSTL (MAGC1_HUMAN)
GYPSFSSTL

SEQ ID NO: 68775 - protein, 9 aa, Artificial Sequence
  Description of Artificial Sequence: Synthetic peptide
  Seed: SSPESPLQS (MAGC1_HUMAN)
SSPESPLQF

SEQ ID NO: 68776 - protein, 9 aa, Artificial Sequence
  Description of Artificial Sequence: Synthetic peptide
  Seed: SEESSSPVD (MAGC1_HUMAN)
SEESSSPVC

SEQ ID NO: 68777 - protein, 9 aa, Artificial Sequence
  Description of Artificial Sequence: Synthetic peptide
  Seed: SSPESPLQS (MAGC1_HUMAN)
SMPESPLQI

SEQ ID NO: 68778 - protein, 9 aa, Artificial Sequence
  Description of Artificial Sequence: Synthetic peptide
  Seed: RKAREFIEI (MAGC1_HUMAN)
RRAREFIEM

SEQ ID NO: 68779 - protein, 9 aa, Artificial Sequence
  Description of Artificial Sequence: Synthetic peptide
  Seed: WEDSLSPHY (MAGC1_HUMAN)
WVDSLSPHY

SEQ ID NO: 68780 - protein, 10 aa, Artificial Sequence
  Description of Artificial Sequence: Synthetic peptide
  Seed: SRYTGYFPVI (MAGC1_HUMAN)
SEYTGYFPVM

SEQ ID NO: 68781 - protein, 9 aa, Artificial Sequence
  Description of Artificial Sequence: Synthetic peptide
  Seed: SSLSQSSPV (MAGC1_HUMAN)
STLSQSSPF

SEQ ID NO: 68782 - protein, 11 aa, Artificial Sequence
  Description of Artificial Sequence: Synthetic peptide
  Seed: LWGPRAHSEVI (MAGC1_HUMAN)
LCGPRAHSEVL

SEQ ID NO: 68783 - protein, 9 aa, Artificial Sequence
  Description of Artificial Sequence: Synthetic peptide
  Seed: TSLSLPQSF (MAGC1_HUMAN)
TILSLPQSY

SEQ ID NO: 68784 - protein, 10 aa, Artificial Sequence
  Description of Artificial Sequence: Synthetic peptide
  Seed: ITKAEMLTNV (MAGC1_HUMAN)
IIKAEMLTNI

SEQ ID NO: 68785 - protein, 9 aa, Artificial Sequence
  Description of Artificial Sequence: Synthetic peptide
  Seed: SSPESPLQS (MAGC1_HUMAN)
SGPESPLQF

SEQ ID NO: 68786 - protein, 9 aa, Artificial Sequence
  Description of Artificial Sequence: Synthetic peptide
  Seed: KAREFIEIL (MAGC1_HUMAN)
KAREFIEIK

SEQ ID NO: 68787 - protein, 9 aa, Artificial Sequence
  Description of Artificial Sequence: Synthetic peptide
  Seed: GVRAGREHF (MAGC1_HUMAN)
GQRAGREHY

SEQ ID NO: 68788 - protein, 10 aa, Artificial Sequence
  Description of Artificial Sequence: Synthetic peptide
  Seed: TGYFPVIFRK (MAGC1_HUMAN)
THYFPVIFRR

SEQ ID NO: 68789 - protein, 9 aa, Artificial Sequence
  Description of Artificial Sequence: Synthetic peptide
  Seed: FFSYTLASL (MAGC1_HUMAN)
FYSYTLASF

SEQ ID NO: 68790 - protein, 11 aa, Artificial Sequence
  Description of Artificial Sequence: Synthetic peptide
  Seed: NPASSFFSSAL (MAGC1_HUMAN)
NAASSFFSSAY

SEQ ID NO: 68791 - protein, 8 aa, Artificial Sequence
  Description of Artificial Sequence: Synthetic peptide
  Seed: QIPVSSSF (MAGC1_HUMAN)
QFPVSSSY

SEQ ID NO: 68792 - protein, 9 aa, Artificial Sequence
  Description of Artificial Sequence: Synthetic peptide
  Seed: AGREHFAFG (MAGC1_HUMAN)
ATREHFAFI

SEQ ID NO: 68793 - protein, 10 aa, Artificial Sequence
  Description of Artificial Sequence: Synthetic peptide
  Seed: KAEMLTNVIS (MAGC1_HUMAN)
KKEMLTNVIA

SEQ ID NO: 68794 - protein, 9 aa, Artificial Sequence
  Description of Artificial Sequence: Synthetic peptide
  Seed: SLLQSSHES (MAGC1_HUMAN)
SMLQSSHEV

SEQ ID NO: 68795 - protein, 9 aa, Artificial Sequence
  Description of Artificial Sequence: Synthetic peptide
  Seed: TLLSLFQSF (MAGC1_HUMAN)
TILSLFQSL

SEQ ID NO: 68796 - protein, 11 aa, Artificial Sequence
  Description of Artificial Sequence: Synthetic peptide
  Seed: IPVSSSFSYTL (MAGC1_HUMAN)
IEVSSSFSYTW

SEQ ID NO: 68797 - protein, 11 aa, Artificial Sequence
  Description of Artificial Sequence: Synthetic peptide
  Seed: KRKVVEFLAML (MAGC1_HUMAN)
KPKVVEFLAMV

SEQ ID NO: 68798 - protein, 9 aa, Artificial Sequence
  Description of Artificial Sequence: Synthetic peptide
  Seed: KVDELARFL (MAGC1_HUMAN)
KEDELARFL

SEQ ID NO: 68799 - protein, 9 aa, Artificial Sequence
  Description of Artificial Sequence: Synthetic peptide
  Seed: SQNRLLILI (MAGC1_HUMAN)
SRNRLLILY

SEQ ID NO: 68800 - protein, 9 aa, Artificial Sequence
  Description of Artificial Sequence: Synthetic peptide
  Seed: MSQNRLLIL (MAGC1_HUMAN)
MKQNRLLIM

SEQ ID NO: 68801 - protein, 10 aa, Artificial Sequence
  Description of Artificial Sequence: Synthetic peptide
  Seed: VPITFPSSYK (MAGC1_HUMAN)
VTITFPSSYK

SEQ ID NO: 68802 - protein, 9 aa, Artificial Sequence
  Description of Artificial Sequence: Synthetic peptide
  Seed: LSDEQGMSQ (MAGC1_HUMAN)
LWDEQGMSL

SEQ ID NO: 68803 - protein, 9 aa, Artificial Sequence
  Description of Artificial Sequence: Synthetic peptide
  Seed: DSYVFVNTL (MAGC1_HUMAN)
DLYVFVNTF

SEQ ID NO: 68804 - protein, 11 aa, Artificial Sequence
  Description of Artificial Sequence: Synthetic peptide
  Seed: SSFSYTLLSLF (MAGC1_HUMAN)
SMFSYTLLSLW

SEQ ID NO: 68805 - protein, 9 aa, Artificial Sequence
  Description of Artificial Sequence: Synthetic peptide
  Seed: GENTHSPLQ (MAGC1_HUMAN)
GENTHSPLP

SEQ ID NO: 68806 - protein, 10 aa, Artificial Sequence
  Description of Artificial Sequence: Synthetic peptide
  Seed: NPASSFFSSA (MAGC1_HUMAN)
NVASSFFSSV

SEQ ID NO: 68807 - protein, 10 aa, Artificial Sequence
  Description of Artificial Sequence: Synthetic peptide
  Seed: QGEDSLSPHY (MAGC1_HUMAN)
QIEDSLSPHY

SEQ ID NO: 68808 - protein, 9 aa, Artificial Sequence
  Description of Artificial Sequence: Synthetic peptide
  Seed: LQIPVSSSS (MAGC1_HUMAN)
LDIPVSSSF

SEQ ID NO: 68809 - protein, 9 aa, Artificial Sequence
  Description of Artificial Sequence: Synthetic peptide
  Seed: FSSALLSIF (MAGC1_HUMAN)
FQSALLSIF

SEQ ID NO: 68810 - protein, 9 aa, Artificial Sequence
  Description of Artificial Sequence: Synthetic peptide
  Seed: TLVSIFQSS (MAGC1_HUMAN)
TLVSIFQSI

SEQ ID NO: 68811 - protein, 10 aa, Artificial Sequence
  Description of Artificial Sequence: Synthetic peptide
  Seed: HSPQSPPEGM (MAGC1_HUMAN)
HRPQSPPEGY

SEQ ID NO: 68812 - protein, 9 aa, Artificial Sequence
  Description of Artificial Sequence: Synthetic peptide
  Seed: SSHESPQSP (MAGC1_HUMAN)
SLHESPQSF

SEQ ID NO: 68813 - protein, 9 aa, Artificial Sequence
  Description of Artificial Sequence: Synthetic peptide
  Seed: TLLSLFQSF (MAGC1_HUMAN)
TLLSLFQSI

SEQ ID NO: 68814 - protein, 9 aa, Artificial Sequence
  Description of Artificial Sequence: Synthetic peptide
  Seed: NTVPITFPS (MAGC1_HUMAN)
NQVPITFPM

SEQ ID NO: 68815 - protein, 9 aa, Artificial Sequence
  Description of Artificial Sequence: Synthetic peptide
  Seed: SGIGVRAGR (MAGC1_HUMAN)
SAIGVRAGY

SEQ ID NO: 68816 - protein, 10 aa, Artificial Sequence
  Description of Artificial Sequence: Synthetic peptide
  Seed: FAFGEPRELL (MAGC1_HUMAN)
FRFGEPRELM

SEQ ID NO: 68817 - protein, 9 aa, Artificial Sequence
  Description of Artificial Sequence: Synthetic peptide
  Seed: SSSDTLLES (MAGC1_HUMAN)
SISDTLLEF

SEQ ID NO: 68818 - protein, 11 aa, Artificial Sequence
  Description of Artificial Sequence: Synthetic peptide
  Seed: FLAMLKNTVPI (MAGC1_HUMAN)
FRAMLKNTVPI

SEQ ID NO: 68819 - protein, 9 aa, Artificial Sequence
  Description of Artificial Sequence: Synthetic peptide
  Seed: LQIPVSSSS (MAGC1_HUMAN)
LSIPVSSSI

SEQ ID NO: 68820 - protein, 9 aa, Artificial Sequence
  Description of Artificial Sequence: Synthetic peptide
  Seed: MTSSFSSTL (MAGC1_HUMAN)
MFSSFSSTV

SEQ ID NO: 68821 - protein, 11 aa, Artificial Sequence
  Description of Artificial Sequence: Synthetic peptide
  Seed: VDEYTSSSDTL (MAGC1_HUMAN)
VLEYTSSSDTF

SEQ ID NO: 68822 - protein, 9 aa, Artificial Sequence
  Description of Artificial Sequence: Synthetic peptide
  Seed: GFPQSVLQI (MAGC1_HUMAN)
GAPQSVLQY

SEQ ID NO: 68823 - protein, 10 aa, Artificial Sequence
  Description of Artificial Sequence: Synthetic peptide
  Seed: SSSLSQSSPV (MAGC1_HUMAN)
STSLSQSSPV

SEQ ID NO: 68824 - protein, 10 aa, Artificial Sequence
  Description of Artificial Sequence: Synthetic peptide
  Seed: SFFSSALLSI (MAGC1_HUMAN)
SWFSSALLSL

SEQ ID NO: 68825 - protein, 10 aa, Artificial Sequence
  Description of Artificial Sequence: Synthetic peptide
  Seed: SPFSEESSSP (MAGC1_HUMAN)
SPFSEESSSV

SEQ ID NO: 68826 - protein, 9 aa, Artificial Sequence
  Description of Artificial Sequence: Synthetic peptide
  Seed: GEDSLSPLQ (MAGC1_HUMAN)
GEDSLSPLV

SEQ ID NO: 68827 - protein, 10 aa, Artificial Sequence
  Description of Artificial Sequence: Synthetic peptide
  Seed: YASEEVIWDV (MAGC1_HUMAN)
YISEEVIWDL

SEQ ID NO: 68828 - protein, 10 aa, Artificial Sequence
  Description of Artificial Sequence: Synthetic peptide
  Seed: SSPESAQSTF (MAGC1_HUMAN)
STPESAQSTL

SEQ ID NO: 68829 - protein, 9 aa, Artificial Sequence
  Description of Artificial Sequence: Synthetic peptide
  Seed: ISFSSSTSL (MAGC1_HUMAN)
ILFSSSTSF

SEQ ID NO: 68830 - protein, 11 aa, Artificial Sequence
  Description of Artificial Sequence: Synthetic peptide
  Seed: SFSSSTSLSPF (MAGC1_HUMAN)
SYSSSTSLSPW

SEQ ID NO: 68831 - protein, 9 aa, Artificial Sequence
  Description of Artificial Sequence: Synthetic peptide
  Seed: SSLSQSSPV (MAGC1_HUMAN)
STLSQSSPV

SEQ ID NO: 68832 - protein, 11 aa, Artificial Sequence
  Description of Artificial Sequence: Synthetic peptide
  Seed: SPLQIPMTSSF (MAGC1_HUMAN)
SILQIPMTSSY

SEQ ID NO: 68833 - protein, 9 aa, Artificial Sequence
  Description of Artificial Sequence: Synthetic peptide
  Seed: LQSPVISFS (MAGC1_HUMAN)
LISPVISFV

SEQ ID NO: 68834 - protein, 9 aa, Artificial Sequence
  Description of Artificial Sequence: Synthetic peptide
  Seed: KVVEFLAML (MAGC1_HUMAN)
KSVEFLAMK

SEQ ID NO: 68835 - protein, 9 aa, Artificial Sequence
  Description of Artificial Sequence: Synthetic peptide
  Seed: TSLSLPQSF (MAGC1_HUMAN)
TRLSLPQSL

SEQ ID NO: 68836 - protein, 9 aa, Artificial Sequence
  Description of Artificial Sequence: Synthetic peptide
  Seed: SEVIKRKVV (MAGC1_HUMAN)
SQVIKRKVL

SEQ ID NO: 68837 - protein, 10 aa, Artificial Sequence
  Description of Artificial Sequence: Synthetic peptide
  Seed: FPQSVLQIPV (MAGC1_HUMAN)
FQQSVLQIPI

SEQ ID NO: 68838 - protein, 10 aa, Artificial Sequence
  Description of Artificial Sequence: Synthetic peptide
  Seed: ICSSSTSLSL (MAGC1_HUMAN)
IVSSSTSLSF

SEQ ID NO: 68839 - protein, 11 aa, Artificial Sequence
  Description of Artificial Sequence: Synthetic peptide
  Seed: SPLQNPASSFF (MAGC1_HUMAN)
SRLQNPASSFY

SEQ ID NO: 68840 - protein, 9 aa, Artificial Sequence
  Description of Artificial Sequence: Synthetic peptide
  Seed: SPLQSPVIS (MAGC1_HUMAN)
SPLQSPVIV

SEQ ID NO: 68841 - protein, 9 aa, Artificial Sequence
  Description of Artificial Sequence: Synthetic peptide
  Seed: ISRYTGYFP (MAGC1_HUMAN)
IVRYTGYFL

SEQ ID NO: 68842 - protein, 10 aa, Artificial Sequence
  Description of Artificial Sequence: Synthetic peptide
  Seed: VISFSSSTSL (MAGC1_HUMAN)
VYSFSSSTSY

SEQ ID NO: 68843 - protein, 9 aa, Artificial Sequence
  Description of Artificial Sequence: Synthetic peptide
  Seed: LQIPVSRSF (MAGC1_HUMAN)
LAIPVSRSM

SEQ ID NO: 68844 - protein, 9 aa, Artificial Sequence
  Description of Artificial Sequence: Synthetic peptide
  Seed: RTQSTFEGF (MAGC1_HUMAN)
RAQSTFEGF

SEQ ID NO: 68845 - protein, 9 aa, Artificial Sequence
  Description of Artificial Sequence: Synthetic peptide
  Seed: YPLQSPQSR (MAGC1_HUMAN)
YSLQSPQSF

SEQ ID NO: 68846 - protein, 11 aa, Artificial Sequence
  Description of Artificial Sequence: Synthetic peptide
  Seed: LQIPVSSSFSY (MAGC1_HUMAN)
LVIPVSSSFSM

SEQ ID NO: 68847 - protein, 10 aa, Artificial Sequence
  Description of Artificial Sequence: Synthetic peptide
  Seed: SSPESAQSTF (MAGC1_HUMAN)
SVPESAQSTM

SEQ ID NO: 68848 - protein, 10 aa, Artificial Sequence
  Description of Artificial Sequence: Synthetic peptide
  Seed: VSPSSSSTLL (MAGC1_HUMAN)
VLPSSSSTLL

SEQ ID NO: 68849 - protein, 10 aa, Artificial Sequence
  Description of Artificial Sequence: Synthetic peptide
  Seed: FQSSLQSPVS (MAGC1_HUMAN)
FQSSLQSPVV

SEQ ID NO: 68850 - protein, 9 aa, Artificial Sequence
  Description of Artificial Sequence: Synthetic peptide
  Seed: STQSPFEGF (MAGC1_HUMAN)
SAQSPFEGR

SEQ ID NO: 68851 - protein, 9 aa, Artificial Sequence
  Description of Artificial Sequence: Synthetic peptide
  Seed: TLDLTSEGC (MAGC1_HUMAN)
TFDLTSEGL

SEQ ID NO: 68852 - protein, 11 aa, Artificial Sequence
  Description of Artificial Sequence: Synthetic peptide
  Seed: TTDDSTATESA (MAGC1_HUMAN)
TFDDSTATESF

SEQ ID NO: 68853 - protein, 11 aa, Artificial Sequence
  Description of Artificial Sequence: Synthetic peptide
  Seed: IKRKVVEFLAM (MAGC1_HUMAN)
IMRKVVEFLAF

SEQ ID NO: 68854 - protein, 10 aa, Artificial Sequence
  Description of Artificial Sequence: Synthetic peptide
  Seed: NTVPITFPSS (MAGC1_HUMAN)
NVVPITFPSA

SEQ ID NO: 68855 - protein, 9 aa, Artificial Sequence
  Description of Artificial Sequence: Synthetic peptide
  Seed: RLLILILSI (MAGC1_HUMAN)
RTLILILSL

SEQ ID NO: 68856 - protein, 10 aa, Artificial Sequence
  Description of Artificial Sequence: Synthetic peptide
  Seed: ICSSSTPSSL (MAGC1_HUMAN)
IISSSTPSSF

SEQ ID NO: 68857 - protein, 9 aa, Artificial Sequence
  Description of Artificial Sequence: Synthetic peptide
  Seed: EHYLEYREV (MAGC1_HUMAN)
ERYLEYREL

SEQ ID NO: 68858 - protein, 10 aa, Artificial Sequence
  Description of Artificial Sequence: Synthetic peptide
  Seed: VPITFPSSYK (MAGC1_HUMAN)
VDITFPSSYK

SEQ ID NO: 68859 - protein, 10 aa, Artificial Sequence
  Description of Artificial Sequence: Synthetic peptide
  Seed: EILFGISLRE (MAGC1_HUMAN)
ECLFGISLRR

SEQ ID NO: 68860 - protein, 11 aa, Artificial Sequence
  Description of Artificial Sequence: Synthetic peptide
  Seed: SPLQIPVSSSS (MAGC1_HUMAN)
SILQIPVSSSM

SEQ ID NO: 68861 - protein, 9 aa, Artificial Sequence
  Description of Artificial Sequence: Synthetic peptide
  Seed: MPTAGMPSL (MAGC1_HUMAN)
MVTAGMPSL

SEQ ID NO: 68862 - protein, 10 aa, Artificial Sequence
  Description of Artificial Sequence: Synthetic peptide
  Seed: KRKVVEFLAM (MAGC1_HUMAN)
KSKVVEFLAM

SEQ ID NO: 68863 - protein, 9 aa, Artificial Sequence
  Description of Artificial Sequence: Synthetic peptide
  Seed: SLPEWEDSL (MAGC1_HUMAN)
SAPEWEDSL

SEQ ID NO: 68864 - protein, 10 aa, Artificial Sequence
  Description of Artificial Sequence: Synthetic peptide
  Seed: LSQSSPVSSF (MAGC1_HUMAN)
LNQSSPVSSY

SEQ ID NO: 68865 - protein, 11 aa, Artificial Sequence
  Description of Artificial Sequence: Synthetic peptide
  Seed: RSFSSTLLSIF (MAGC1_HUMAN)
RTFSSTLLSIW

SEQ ID NO: 68866 - protein, 9 aa, Artificial Sequence
  Description of Artificial Sequence: Synthetic peptide
  Seed: IPVSPSSSS (MAGC1_HUMAN)
IPVSPSSSM

SEQ ID NO: 68867 - protein, 9 aa, Artificial Sequence
  Description of Artificial Sequence: Synthetic peptide
  Seed: AQSPLQSPV (MAGC1_HUMAN)
ALSPLQSPA

SEQ ID NO: 68868 - protein, 9 aa, Artificial Sequence
  Description of Artificial Sequence: Synthetic peptide
  Seed: STFEGFPQS (MAGC1_HUMAN)
SIFEGFPQY

SEQ ID NO: 68869 - protein, 9 aa, Artificial Sequence
  Description of Artificial Sequence: Synthetic peptide
  Seed: GFPQSLLQI (MAGC1_HUMAN)
GGPQSLLQL

SEQ ID NO: 68870 - protein, 10 aa, Artificial Sequence
  Description of Artificial Sequence: Synthetic peptide
  Seed: TGYFPVIFRK (MAGC1_HUMAN)
TAYFPVIFRV

SEQ ID NO: 68871 - protein, 10 aa, Artificial Sequence
  Description of Artificial Sequence: Synthetic peptide
  Seed: PLQIPVSSSF (MAGC1_HUMAN)
PFQIPVSSSF

SEQ ID NO: 68872 - protein, 11 aa, Artificial Sequence
  Description of Artificial Sequence: Synthetic peptide
  Seed: LQRPVSSFFSY (MAGC1_HUMAN)
LFRPVSSFFSF

SEQ ID NO: 68873 - protein, 10 aa, Artificial Sequence
  Description of Artificial Sequence: Synthetic peptide
  Seed: REVDPDDSYV (MAGC1_HUMAN)
RMVDPDDSYV

SEQ ID NO: 68874 - protein, 10 aa, Artificial Sequence
  Description of Artificial Sequence: Synthetic peptide
  Seed: RSFSSTLLSI (MAGC1_HUMAN)
RNFSSTLLSF

SEQ ID NO: 68875 - protein, 10 aa, Artificial Sequence
  Description of Artificial Sequence: Synthetic peptide
  Seed: LQIPVSRSFS (MAGC1_HUMAN)
LQIPVSRSFN

SEQ ID NO: 68876 - protein, 9 aa, Artificial Sequence
  Description of Artificial Sequence: Synthetic peptide
  Seed: VIKRKVVEF (MAGC1_HUMAN)
VPKRKVVEF

SEQ ID NO: 68877 - protein, 11 aa, Artificial Sequence
  Description of Artificial Sequence: Synthetic peptide
  Seed: RYTGYFPVIFR (MAGC1_HUMAN)
RYTGYFPVIFI

SEQ ID NO: 68878 - protein, 10 aa, Artificial Sequence
  Description of Artificial Sequence: Synthetic peptide
  Seed: FPQSPLQIPV (MAGC1_HUMAN)
FDQSPLQIPI

SEQ ID NO: 68879 - protein, 10 aa, Artificial Sequence
  Description of Artificial Sequence: Synthetic peptide
  Seed: QRPVSSFFSY (MAGC1_HUMAN)
QQPVSSFFSF

SEQ ID NO: 68880 - protein, 10 aa, Artificial Sequence
  Description of Artificial Sequence: Synthetic peptide
  Seed: FFSYTLASLL (MAGC1_HUMAN)
FLSYTLASLM

SEQ ID NO: 68881 - protein, 10 aa, Artificial Sequence
  Description of Artificial Sequence: Synthetic peptide
  Seed: VPITFPSSYK (MAGC1_HUMAN)
VQITFPSSYR

SEQ ID NO: 68882 - protein, 9 aa, Artificial Sequence
  Description of Artificial Sequence: Synthetic peptide
  Seed: TLLESDSLT (MAGC1_HUMAN)
TLLESDSLL

SEQ ID NO: 68883 - protein, 10 aa, Artificial Sequence
  Description of Artificial Sequence: Synthetic peptide
  Seed: ITKAEMLTNV (MAGC1_HUMAN)
IIKAEMLTNV

SEQ ID NO: 68884 - protein, 11 aa, Artificial Sequence
  Description of Artificial Sequence: Synthetic peptide
  Seed: VSSSSSSSTLL (MAGC1_HUMAN)
VISSSSSSTLF

SEQ ID NO: 68885 - protein, 10 aa, Artificial Sequence
  Description of Artificial Sequence: Synthetic peptide
  Seed: SSPECTQSTF (MAGC1_HUMAN)
SQPECTQSTF

SEQ ID NO: 68886 - protein, 9 aa, Artificial Sequence
  Description of Artificial Sequence: Synthetic peptide
  Seed: ASSFFSSAL (MAGC1_HUMAN)
AKSFFSSAY

SEQ ID NO: 68887 - protein, 11 aa, Artificial Sequence
  Description of Artificial Sequence: Synthetic peptide
  Seed: KVWVQEHYLEY (MAGC1_HUMAN)
KMWVQEHYLEY

SEQ ID NO: 68888 - protein, 9 aa, Artificial Sequence
  Description of Artificial Sequence: Synthetic peptide
  Seed: ALLSIFQSS (MAGC1_HUMAN)
AMLSIFQSL

SEQ ID NO: 68889 - protein, 9 aa, Artificial Sequence
  Description of Artificial Sequence: Synthetic peptide
  Seed: VPNSSPPRY (MAGC1_HUMAN)
VVNSSPPRF

SEQ ID NO: 68890 - protein, 9 aa, Artificial Sequence
  Description of Artificial Sequence: Synthetic peptide
  Seed: IESEPLFTY (MAGC1_HUMAN)
IISEPLFTF

SEQ ID NO: 68891 - protein, 8 aa, Artificial Sequence
  Description of Artificial Sequence: Synthetic peptide
  Seed: LQRPVSSF (MAGC1_HUMAN)
LQRPVSSI

SEQ ID NO: 68892 - protein, 11 aa, Artificial Sequence
  Description of Artificial Sequence: Synthetic peptide
  Seed: IPVSAASSSTL (MAGC1_HUMAN)
IKVSAASSSTW

SEQ ID NO: 68893 - protein, 9 aa, Artificial Sequence
  Description of Artificial Sequence: Synthetic peptide
  Seed: VSRSFSSTL (MAGC1_HUMAN)
VQRSFSSTI

SEQ ID NO: 68894 - protein, 9 aa, Artificial Sequence
  Description of Artificial Sequence: Synthetic peptide
  Seed: SPERTQSTF (MAGC1_HUMAN)
SPERTQSTI

SEQ ID NO: 68895 - protein, 10 aa, Artificial Sequence
  Description of Artificial Sequence: Synthetic peptide
  Seed: STPSSLPQSF (MAGC1_HUMAN)
STPSSLPQSL

SEQ ID NO: 68896 - protein, 9 aa, Artificial Sequence
  Description of Artificial Sequence: Synthetic peptide
  Seed: NTVPITFPS (MAGC1_HUMAN)
NVVPITFPY

SEQ ID NO: 68897 - protein, 11 aa, Artificial Sequence
  Description of Artificial Sequence: Synthetic peptide
  Seed: TTDDSTATESA (MAGC1_HUMAN)
TFDDSTATESL

SEQ ID NO: 68898 - protein, 10 aa, Artificial Sequence
  Description of Artificial Sequence: Synthetic peptide
  Seed: KAREFIEILF (MAGC1_HUMAN)
KSREFIEILL

SEQ ID NO: 68899 - protein, 9 aa, Artificial Sequence
  Description of Artificial Sequence: Synthetic peptide
  Seed: VSPSFSSTL (MAGC1_HUMAN)
VGPSFSSTM

SEQ ID NO: 68900 - protein, 9 aa, Artificial Sequence
  Description of Artificial Sequence: Synthetic peptide
  Seed: KAREFIEIL (MAGC1_HUMAN)
KSREFIEIF

SEQ ID NO: 68901 - protein, 9 aa, Artificial Sequence
  Description of Artificial Sequence: Synthetic peptide
  Seed: HFPQSPPEW (MAGC1_HUMAN)
HVPQSPPEF

SEQ ID NO: 68902 - protein, 9 aa, Artificial Sequence
  Description of Artificial Sequence: Synthetic peptide
  Seed: MTSSFSSTL (MAGC1_HUMAN)
MCSSFSSTM

SEQ ID NO: 68903 - protein, 9 aa, Artificial Sequence
  Description of Artificial Sequence: Synthetic peptide
  Seed: SSPESPLQS (MAGC1_HUMAN)
SFPESPLQI

SEQ ID NO: 68904 - protein, 9 aa, Artificial Sequence
  Description of Artificial Sequence: Synthetic peptide
  Seed: KVVEFLAML (MAGC1_HUMAN)
KMVEFLAMT

SEQ ID NO: 68905 - protein, 9 aa, Artificial Sequence
  Description of Artificial Sequence: Synthetic peptide
  Seed: SLTDSESLI (MAGC1_HUMAN)
SMTDSESLL

SEQ ID NO: 68906 - protein, 10 aa, Artificial Sequence
  Description of Artificial Sequence: Synthetic peptide
  Seed: YASEEVIWDV (MAGC1_HUMAN)
YLSEEVIWDM

SEQ ID NO: 68907 - protein, 9 aa, Artificial Sequence
  Description of Artificial Sequence: Synthetic peptide
  Seed: KVVEFLAML (MAGC1_HUMAN)
KMVEFLAMY

SEQ ID NO: 68908 - protein, 10 aa, Artificial Sequence
  Description of Artificial Sequence: Synthetic peptide
  Seed: SRYTGYFPVI (MAGC1_HUMAN)
SRYTGYFPVW

SEQ ID NO: 68909 - protein, 10 aa, Artificial Sequence
  Description of Artificial Sequence: Synthetic peptide
  Seed: SPESPLQSPV (MAGC1_HUMAN)
SEESPLQSPL

SEQ ID NO: 68910 - protein, 10 aa, Artificial Sequence
  Description of Artificial Sequence: Synthetic peptide
  Seed: FFSSALLSIF (MAGC1_HUMAN)
FHSSALLSIF

SEQ ID NO: 68911 - protein, 9 aa, Artificial Sequence
  Description of Artificial Sequence: Synthetic peptide
  Seed: LQNPASSFF (MAGC1_HUMAN)
LANPASSFY

SEQ ID NO: 68912 - protein, 11 aa, Artificial Sequence
  Description of Artificial Sequence: Synthetic peptide
  Seed: SAASSSTLVSI (MAGC1_HUMAN)
SSASSSTLVSY

SEQ ID NO: 68913 - protein, 9 aa, Artificial Sequence
  Description of Artificial Sequence: Synthetic peptide
  Seed: RTQSTFEGF (MAGC1_HUMAN)
RSQSTFEGK

SEQ ID NO: 68914 - protein, 10 aa, Artificial Sequence
  Description of Artificial Sequence: Synthetic peptide
  Seed: SPLYFPQSPL (MAGC1_HUMAN)
SWLYFPQSPV

SEQ ID NO: 68915 - protein, 10 aa, Artificial Sequence
  Description of Artificial Sequence: Synthetic peptide
  Seed: TGYFPVIFRK (MAGC1_HUMAN)
TAYFPVIFRA

SEQ ID NO: 68916 - protein, 9 aa, Artificial Sequence
  Description of Artificial Sequence: Synthetic peptide
  Seed: FSSTLLSIL (MAGC1_HUMAN)
FVSTLLSIT

SEQ ID NO: 68917 - protein, 9 aa, Artificial Sequence
  Description of Artificial Sequence: Synthetic peptide
  Seed: VSRSFSSTL (MAGC1_HUMAN)
VWRSFSSTL

SEQ ID NO: 68918 - protein, 9 aa, Artificial Sequence
  Description of Artificial Sequence: Synthetic peptide
  Seed: FPSSTSSSL (MAGC1_HUMAN)
FNSSTSSSF

SEQ ID NO: 68919 - protein, 8 aa, Artificial Sequence
  Description of Artificial Sequence: Synthetic peptide
  Seed: QSSPVSSF (MAGC1_HUMAN)
QQSPVSSY

SEQ ID NO: 68920 - protein, 9 aa, Artificial Sequence
  Description of Artificial Sequence: Synthetic peptide
  Seed: YTGYFPVIF (MAGC1_HUMAN)
YYGYFPVIF

SEQ ID NO: 68921 - protein, 9 aa, Artificial Sequence
  Description of Artificial Sequence: Synthetic peptide
  Seed: SLPEWEDSL (MAGC1_HUMAN)
SHPEWEDSL

SEQ ID NO: 68922 - protein, 10 aa, Artificial Sequence
  Description of Artificial Sequence: Synthetic peptide
  Seed: VSSSSSSSTL (MAGC1_HUMAN)
VNSSSSSSTF

SEQ ID NO: 68923 - protein, 10 aa, Artificial Sequence
  Description of Artificial Sequence: Synthetic peptide
  Seed: SSSSSTLLSL (MAGC1_HUMAN)
SVSSSTLLSY

SEQ ID NO: 68924 - protein, 10 aa, Artificial Sequence
  Description of Artificial Sequence: Synthetic peptide
  Seed: LQIVPSLPEW (MAGC1_HUMAN)
LMIVPSLPEY

SEQ ID NO: 68925 - protein, 9 aa, Artificial Sequence
  Description of Artificial Sequence: Synthetic peptide
  Seed: VSSSFSYTL (MAGC1_HUMAN)
VLSSFSYTM

SEQ ID NO: 68926 - protein, 9 aa, Artificial Sequence
  Description of Artificial Sequence: Synthetic peptide
  Seed: LQIPVSPSF (MAGC1_HUMAN)
LLIPVSPSM

SEQ ID NO: 68927 - protein, 9 aa, Artificial Sequence
  Description of Artificial Sequence: Synthetic peptide
  Seed: SEPLFTYTL (MAGC1_HUMAN)
SRPLFTYTF

SEQ ID NO: 68928 - protein, 9 aa, Artificial Sequence
  Description of Artificial Sequence: Synthetic peptide
  Seed: KVDELARFL (MAGC1_HUMAN)
KSDELARFL

SEQ ID NO: 68929 - protein, 9 aa, Artificial Sequence
  Description of Artificial Sequence: Synthetic peptide
  Seed: KVVEFLAML (MAGC1_HUMAN)
KTVEFLAMI

SEQ ID NO: 68930 - protein, 9 aa, Artificial Sequence
  Description of Artificial Sequence: Synthetic peptide
  Seed: VSAASSSTL (MAGC1_HUMAN)
VQAASSSTL

SEQ ID NO: 68931 - protein, 9 aa, Artificial Sequence
  Description of Artificial Sequence: Synthetic peptide
  Seed: AGREHFAFG (MAGC1_HUMAN)
AVREHFAFT

SEQ ID NO: 68932 - protein, 10 aa, Artificial Sequence
  Description of Artificial Sequence: Synthetic peptide
  Seed: LQIPMTSSFS (MAGC1_HUMAN)
LMIPMTSSFM

SEQ ID NO: 68933 - protein, 9 aa, Artificial Sequence
  Description of Artificial Sequence: Synthetic peptide
  Seed: STFEGFPQS (MAGC1_HUMAN)
SIFEGFPQF

SEQ ID NO: 68934 - protein, 9 aa, Artificial Sequence
  Description of Artificial Sequence: Synthetic peptide
  Seed: SSSVMSPSF (MAGC1_HUMAN)
SSSVMSPSY

SEQ ID NO: 68935 - protein, 8 aa, Artificial Sequence
  Description of Artificial Sequence: Synthetic peptide
  Seed: SSFSSTLL (MAGC1_HUMAN)
SVFSSTLW

SEQ ID NO: 68936 - protein, 9 aa, Artificial Sequence
  Description of Artificial Sequence: Synthetic peptide
  Seed: KQPITKAEM (MAGC1_HUMAN)
KYPITKAEF

SEQ ID NO: 68937 - protein, 10 aa, Artificial Sequence
  Description of Artificial Sequence: Synthetic peptide
  Seed: ILILSIIFIK (MAGC1_HUMAN)
IKILSIIFIR

SEQ ID NO: 68938 - protein, 9 aa, Artificial Sequence
  Description of Artificial Sequence: Synthetic peptide
  Seed: LKNTVPITF (MAGC1_HUMAN)
LRNTVPITM

SEQ ID NO: 68939 - protein, 9 aa, Artificial Sequence
  Description of Artificial Sequence: Synthetic peptide
  Seed: SLFQSFSER (MAGC1_HUMAN)
SLFQSFSEY

SEQ ID NO: 68940 - protein, 11 aa, Artificial Sequence
  Description of Artificial Sequence: Synthetic peptide
  Seed: IPVSRSFSSTL (MAGC1_HUMAN)
IGVSRSFSSTW

SEQ ID NO: 68941 - protein, 11 aa, Artificial Sequence
  Description of Artificial Sequence: Synthetic peptide
  Seed: SSFPSSTSSSL (MAGC1_HUMAN)
SRFPSSTSSSF

SEQ ID NO: 68942 - protein, 10 aa, Artificial Sequence
  Description of Artificial Sequence: Synthetic peptide
  Seed: SSSSTLLSLF (MAGC1_HUMAN)
SASSTLLSLF

SEQ ID NO: 68943 - protein, 10 aa, Artificial Sequence
  Description of Artificial Sequence: Synthetic peptide
  Seed: RAGREHFAFG (MAGC1_HUMAN)
RMGREHFAFS

SEQ ID NO: 68944 - protein, 10 aa, Artificial Sequence
  Description of Artificial Sequence: Synthetic peptide
  Seed: FAFGEPRELL (MAGC1_HUMAN)
FVFGEPRELA

SEQ ID NO: 68945 - protein, 9 aa, Artificial Sequence
  Description of Artificial Sequence: Synthetic peptide
  Seed: SSPERTQST (MAGC1_HUMAN)
SRPERTQSL

SEQ ID NO: 68946 - protein, 10 aa, Artificial Sequence
  Description of Artificial Sequence: Synthetic peptide
  Seed: VSLFQSSPER (MAGC1_HUMAN)
VVLFQSSPEK

SEQ ID NO: 68947 - protein, 10 aa, Artificial Sequence
  Description of Artificial Sequence: Synthetic peptide
  Seed: STLLSLFQSF (MAGC1_HUMAN)
SFLLSLFQSY

SEQ ID NO: 68948 - protein, 10 aa, Artificial Sequence
  Description of Artificial Sequence: Synthetic peptide
  Seed: KVVEFLAMLK (MAGC1_HUMAN)
KLVEFLAMLI

SEQ ID NO: 68949 - protein, 10 aa, Artificial Sequence
  Description of Artificial Sequence: Synthetic peptide
  Seed: MPTAGMPSLL (MAGC1_HUMAN)
MCTAGMPSLL

SEQ ID NO: 68950 - protein, 9 aa, Artificial Sequence
  Description of Artificial Sequence: Synthetic peptide
  Seed: FFSYTLASL (MAGC1_HUMAN)
FLSYTLASP

SEQ ID NO: 68951 - protein, 9 aa, Artificial Sequence
  Description of Artificial Sequence: Synthetic peptide
  Seed: VLQIPVSAA (MAGC1_HUMAN)
VMQIPVSAL

SEQ ID NO: 68952 - protein, 9 aa, Artificial Sequence
  Description of Artificial Sequence: Synthetic peptide
  Seed: FLWGPRAHS (MAGC1_HUMAN)
FLWGPRAHM

SEQ ID NO: 68953 - protein, 10 aa, Artificial Sequence
  Description of Artificial Sequence: Synthetic peptide
  Seed: QGEDSMSPLY (MAGC1_HUMAN)
QNEDSMSPLW

SEQ ID NO: 68954 - protein, 10 aa, Artificial Sequence
  Description of Artificial Sequence: Synthetic peptide
  Seed: SPLQNPASSF (MAGC1_HUMAN)
SPLQNPASSM

SEQ ID NO: 68955 - protein, 9 aa, Artificial Sequence
  Description of Artificial Sequence: Synthetic peptide
  Seed: VIFRKAREF (MAGC1_HUMAN)
VTFRKAREW

SEQ ID NO: 68956 - protein, 9 aa, Artificial Sequence
  Description of Artificial Sequence: Synthetic peptide
  Seed: IPVSAASSS (MAGC1_HUMAN)
IAVSAASSL

SEQ ID NO: 68957 - protein, 9 aa, Artificial Sequence
  Description of Artificial Sequence: Synthetic peptide
  Seed: HYFPQSPPQ (MAGC1_HUMAN)
HFFPQSPPL

SEQ ID NO: 68958 - protein, 9 aa, Artificial Sequence
  Description of Artificial Sequence: Synthetic peptide
  Seed: LSDEQGMSQ (MAGC1_HUMAN)
LPDEQGMSL

SEQ ID NO: 68959 - protein, 9 aa, Artificial Sequence
  Description of Artificial Sequence: Synthetic peptide
  Seed: RYTGYFPVI (MAGC1_HUMAN)
RWTGYFPVM

SEQ ID NO: 68960 - protein, 9 aa, Artificial Sequence
  Description of Artificial Sequence: Synthetic peptide
  Seed: SQSSPVSSF (MAGC1_HUMAN)
SYSSPVSSI

SEQ ID NO: 68961 - protein, 9 aa, Artificial Sequence
  Description of Artificial Sequence: Synthetic peptide
  Seed: AREFIEILF (MAGC1_HUMAN)
AHEFIEILM

SEQ ID NO: 68962 - protein, 9 aa, Artificial Sequence
  Description of Artificial Sequence: Synthetic peptide
  Seed: FSYTLASLL (MAGC1_HUMAN)
FVYTLASLI

SEQ ID NO: 68963 - protein, 9 aa, Artificial Sequence
  Description of Artificial Sequence: Synthetic peptide
  Seed: NTVPITFPS (MAGC1_HUMAN)
NSVPITFPM

SEQ ID NO: 68964 - protein, 11 aa, Artificial Sequence
  Description of Artificial Sequence: Synthetic peptide
  Seed: SPLQNPASSFF (MAGC1_HUMAN)
SGLQNPASSFF

SEQ ID NO: 68965 - protein, 9 aa, Artificial Sequence
  Description of Artificial Sequence: Synthetic peptide
  Seed: SFPSSTSSS (MAGC1_HUMAN)
SWPSSTSSI

SEQ ID NO: 68966 - protein, 9 aa, Artificial Sequence
  Description of Artificial Sequence: Synthetic peptide
  Seed: SLIESEPLF (MAGC1_HUMAN)
SIIESEPLF

SEQ ID NO: 68967 - protein, 10 aa, Artificial Sequence
  Description of Artificial Sequence: Synthetic peptide
  Seed: LLQIPMTSSF (MAGC1_HUMAN)
LDQIPMTSSW

SEQ ID NO: 68968 - protein, 10 aa, Artificial Sequence
  Description of Artificial Sequence: Synthetic peptide
  Seed: SLFQSSPECT (MAGC1_HUMAN)
SIFQSSPECV

SEQ ID NO: 68969 - protein, 9 aa, Artificial Sequence
  Description of Artificial Sequence: Synthetic peptide
  Seed: MTSSFSSTL (MAGC1_HUMAN)
MMSSFSSTA

SEQ ID NO: 68970 - protein, 9 aa, Artificial Sequence
  Description of Artificial Sequence: Synthetic peptide
  Seed: REVDPDDSY (MAGC1_HUMAN)
RRVDPDDSF

SEQ ID NO: 68971 - protein, 9 aa, Artificial Sequence
  Description of Artificial Sequence: Synthetic peptide
  Seed: MLTNVISRY (MAGC1_HUMAN)
MSTNVISRY

SEQ ID NO: 68972 - protein, 9 aa, Artificial Sequence
  Description of Artificial Sequence: Synthetic peptide
  Seed: SICSSSTSL (MAGC1_HUMAN)
SLCSSSTSY

SEQ ID NO: 68973 - protein, 10 aa, Artificial Sequence
  Description of Artificial Sequence: Synthetic peptide
  Seed: KRKVVEFLAM (MAGC1_HUMAN)
KPKVVEFLAF

SEQ ID NO: 68974 - protein, 9 aa, Artificial Sequence
  Description of Artificial Sequence: Synthetic peptide
  Seed: GSPSFSSTL (MAGC1_HUMAN)
GLPSFSSTI

SEQ ID NO: 68975 - protein, 11 aa, Artificial Sequence
  Description of Artificial Sequence: Synthetic peptide
  Seed: SPLQIPVSSSS (MAGC1_HUMAN)
SDLQIPVSSSM

SEQ ID NO: 68976 - protein, 10 aa, Artificial Sequence
  Description of Artificial Sequence: Synthetic peptide
  Seed: RAGREHFAFG (MAGC1_HUMAN)
RSGREHFAFG

SEQ ID NO: 68977 - protein, 11 aa, Artificial Sequence
  Description of Artificial Sequence: Synthetic peptide
  Seed: SFFSYTLASLL (MAGC1_HUMAN)
SGFSYTLASLW

SEQ ID NO: 68978 - protein, 9 aa, Artificial Sequence
  Description of Artificial Sequence: Synthetic peptide
  Seed: LQIVPSLPE (MAGC1_HUMAN)
LVIVPSLPM

SEQ ID NO: 68979 - protein, 9 aa, Artificial Sequence
  Description of Artificial Sequence: Synthetic peptide
  Seed: FEGFAQSSL (MAGC1_HUMAN)
FVGFAQSSF

SEQ ID NO: 68980 - protein, 10 aa, Artificial Sequence
  Description of Artificial Sequence: Synthetic peptide
  Seed: MTSSFSSTLL (MAGC1_HUMAN)
MRSSFSSTLL

SEQ ID NO: 68981 - protein, 9 aa, Artificial Sequence
  Description of Artificial Sequence: Synthetic peptide
  Seed: STFEGFAQS (MAGC1_HUMAN)
SMFEGFAQV

SEQ ID NO: 68982 - protein, 10 aa, Artificial Sequence
  Description of Artificial Sequence: Synthetic peptide
  Seed: SSSSSTLLSL (MAGC1_HUMAN)
STSSSTLLSF

SEQ ID NO: 68983 - protein, 10 aa, Artificial Sequence
  Description of Artificial Sequence: Synthetic peptide
  Seed: DVLSGIGVRA (MAGC1_HUMAN)
DVLSGIGVRF

SEQ ID NO: 68984 - protein, 9 aa, Artificial Sequence
  Description of Artificial Sequence: Synthetic peptide
  Seed: LQIPGSPSF (MAGC1_HUMAN)
LSIPGSPSL

SEQ ID NO: 68985 - protein, 10 aa, Artificial Sequence
  Description of Artificial Sequence: Synthetic peptide
  Seed: ASSFFSSALL (MAGC1_HUMAN)
AFSFFSSALV

SEQ ID NO: 68986 - protein, 10 aa, Artificial Sequence
  Description of Artificial Sequence: Synthetic peptide
  Seed: YTLASLLQSS (MAGC1_HUMAN)
YFLASLLQSV

SEQ ID NO: 68987 - protein, 10 aa, Artificial Sequence
  Description of Artificial Sequence: Synthetic peptide
  Seed: SPLQSPVSSF (MAGC1_HUMAN)
SPLQSPVSSI

SEQ ID NO: 68988 - protein, 9 aa, Artificial Sequence
  Description of Artificial Sequence: Synthetic peptide
  Seed: KVDELARFL (MAGC1_HUMAN)
KQDELARFY

SEQ ID NO: 68989 - protein, 11 aa, Artificial Sequence
  Description of Artificial Sequence: Synthetic peptide
  Seed: AMLKNTVPITF (MAGC1_HUMAN)
AQLKNTVPITY

SEQ ID NO: 68990 - protein, 11 aa, Artificial Sequence
  Description of Artificial Sequence: Synthetic peptide
  Seed: SSFSSTLLSIL (MAGC1_HUMAN)
SAFSSTLLSIF

SEQ ID NO: 68991 - protein, 8 aa, Artificial Sequence
  Description of Artificial Sequence: Synthetic peptide
  Seed: SSFFSSAL (MAGC1_HUMAN)
SQFFSSAV

SEQ ID NO: 68992 - protein, 10 aa, Artificial Sequence
  Description of Artificial Sequence: Synthetic peptide
  Seed: LAMLKNTVPI (MAGC1_HUMAN)
LEMLKNTVPI

SEQ ID NO: 68993 - protein, 10 aa, Artificial Sequence
  Description of Artificial Sequence: Synthetic peptide
  Seed: QIPVSSSFSY (MAGC1_HUMAN)
QQPVSSSFSY

SEQ ID NO: 68994 - protein, 10 aa, Artificial Sequence
  Description of Artificial Sequence: Synthetic peptide
  Seed: MPTAGMPSLL (MAGC1_HUMAN)
MYTAGMPSLV

SEQ ID NO: 68995 - protein, 9 aa, Artificial Sequence
  Description of Artificial Sequence: Synthetic peptide
  Seed: KQPITKAEM (MAGC1_HUMAN)
KFPITKAEL

SEQ ID NO: 68996 - protein, 9 aa, Artificial Sequence
  Description of Artificial Sequence: Synthetic peptide
  Seed: AQSPLQIPV (MAGC1_HUMAN)
AASPLQIPV

SEQ ID NO: 68997 - protein, 9 aa, Artificial Sequence
  Description of Artificial Sequence: Synthetic peptide
  Seed: AMLKNTVPI (MAGC1_HUMAN)
AGLKNTVPY

SEQ ID NO: 68998 - protein, 9 aa, Artificial Sequence
  Description of Artificial Sequence: Synthetic peptide
  Seed: LARFLLLKY (MAGC1_HUMAN)
LARFLLLKF

SEQ ID NO: 68999 - protein, 9 aa, Artificial Sequence
  Description of Artificial Sequence: Synthetic peptide
  Seed: AQSSLQIPV (MAGC1_HUMAN)
AKSSLQIPM

SEQ ID NO: 69000 - protein, 9 aa, Artificial Sequence
  Description of Artificial Sequence: Synthetic peptide
  Seed: MGDKDMPTA (MAGC1_HUMAN)
MLDKDMPTM

SEQ ID NO: 69001 - protein, 9 aa, Artificial Sequence
  Description of Artificial Sequence: Synthetic peptide
  Seed: SSPESPLQS (MAGC1_HUMAN)
SGPESPLQM

SEQ ID NO: 69002 - protein, 9 aa, Artificial Sequence
  Description of Artificial Sequence: Synthetic peptide
  Seed: RSFSSTLLS (MAGC1_HUMAN)
RVFSSTLLV

SEQ ID NO: 69003 - protein, 10 aa, Artificial Sequence
  Description of Artificial Sequence: Synthetic peptide
  Seed: MTSSFSSTLL (MAGC1_HUMAN)
MTSSFSSTLA

SEQ ID NO: 69004 - protein, 10 aa, Artificial Sequence
  Description of Artificial Sequence: Synthetic peptide
  Seed: YLEYREVPNS (MAGC1_HUMAN)
YMEYREVPNL

SEQ ID NO: 69005 - protein, 10 aa, Artificial Sequence
  Description of Artificial Sequence: Synthetic peptide
  Seed: EILFGISLRE (MAGC1_HUMAN)
ETLFGISLRR

SEQ ID NO: 69006 - protein, 9 aa, Artificial Sequence
  Description of Artificial Sequence: Synthetic peptide
  Seed: KDSLSPLEI (MAGC1_HUMAN)
KVSLSPLEI

SEQ ID NO: 69007 - protein, 10 aa, Artificial Sequence
  Description of Artificial Sequence: Synthetic peptide
  Seed: SPLQIPGSPS (MAGC1_HUMAN)
SPLQIPGSPA

SEQ ID NO: 69008 - protein, 10 aa, Artificial Sequence
  Description of Artificial Sequence: Synthetic peptide
  Seed: SFSSTLVSLF (MAGC1_HUMAN)
SYSSTLVSLW

SEQ ID NO: 69009 - protein, 10 aa, Artificial Sequence
  Description of Artificial Sequence: Synthetic peptide
  Seed: SFSSTLVSLF (MAGC1_HUMAN)
STSSTLVSLF

SEQ ID NO: 69010 - protein, 11 aa, Artificial Sequence
  Description of Artificial Sequence: Synthetic peptide
  Seed: STFEGFPQSLL (MAGC1_HUMAN)
SQFEGFPQSLI

SEQ ID NO: 69011 - protein, 9 aa, Artificial Sequence
  Description of Artificial Sequence: Synthetic peptide
  Seed: VIKRKVVEF (MAGC1_HUMAN)
VGKRKVVEL

SEQ ID NO: 69012 - protein, 11 aa, Artificial Sequence
  Description of Artificial Sequence: Synthetic peptide
  Seed: SFSSSTSLSPF (MAGC1_HUMAN)
SQSSSTSLSPF

SEQ ID NO: 69013 - protein, 10 aa, Artificial Sequence
  Description of Artificial Sequence: Synthetic peptide
  Seed: FPQSLLQIPM (MAGC1_HUMAN)
FEQSLLQIPY

SEQ ID NO: 69014 - protein, 9 aa, Artificial Sequence
  Description of Artificial Sequence: Synthetic peptide
  Seed: FPSSYKDAL (MAGC1_HUMAN)
FASSYKDAL

SEQ ID NO: 69015 - protein, 9 aa, Artificial Sequence
  Description of Artificial Sequence: Synthetic peptide
  Seed: SPESTQSPF (MAGC1_HUMAN)
SPESTQSPV

SEQ ID NO: 69016 - protein, 9 aa, Artificial Sequence
  Description of Artificial Sequence: Synthetic peptide
  Seed: MLTNVISRY (MAGC1_HUMAN)
MYTNVISRY

SEQ ID NO: 69017 - protein, 9 aa, Artificial Sequence
  Description of Artificial Sequence: Synthetic peptide
  Seed: SESLIESEP (MAGC1_HUMAN)
SESLIESET

SEQ ID NO: 69018 - protein, 11 aa, Artificial Sequence
  Description of Artificial Sequence: Synthetic peptide
  Seed: IPVSRSFSSTL (MAGC1_HUMAN)
ICVSRSFSSTF

SEQ ID NO: 69019 - protein, 10 aa, Artificial Sequence
  Description of Artificial Sequence: Synthetic peptide
  Seed: LAMLKNTVPI (MAGC1_HUMAN)
LLMLKNTVPV

SEQ ID NO: 69020 - protein, 9 aa, Artificial Sequence
  Description of Artificial Sequence: Synthetic peptide
  Seed: VSSSSSSTL (MAGC1_HUMAN)
VESSSSSTY

SEQ ID NO: 69021 - protein, 11 aa, Artificial Sequence
  Description of Artificial Sequence: Synthetic peptide
  Seed: SLIESEPLFTY (MAGC1_HUMAN)
SMIESEPLFTY

SEQ ID NO: 69022 - protein, 10 aa, Artificial Sequence
  Description of Artificial Sequence: Synthetic peptide
  Seed: RAGREHFAFG (MAGC1_HUMAN)
RLGREHFAFK

SEQ ID NO: 69023 - protein, 9 aa, Artificial Sequence
  Description of Artificial Sequence: Synthetic peptide
  Seed: ISRYTGYFP (MAGC1_HUMAN)
IIRYTGYFK

SEQ ID NO: 69024 - protein, 9 aa, Artificial Sequence
  Description of Artificial Sequence: Synthetic peptide
  Seed: FPQSVLQIP (MAGC1_HUMAN)
FPQSVLQII

SEQ ID NO: 69025 - protein, 9 aa, Artificial Sequence
  Description of Artificial Sequence: Synthetic peptide
  Seed: FSYTLASLL (MAGC1_HUMAN)
FQYTLASLV

SEQ ID NO: 69026 - protein, 10 aa, Artificial Sequence
  Description of Artificial Sequence: Synthetic peptide
  Seed: REFIEILFGI (MAGC1_HUMAN)
RMFIEILFGA

SEQ ID NO: 69027 - protein, 9 aa, Artificial Sequence
  Description of Artificial Sequence: Synthetic peptide
  Seed: TLDLTSEGC (MAGC1_HUMAN)
TFDLTSEGV

SEQ ID NO: 69028 - protein, 11 aa, Artificial Sequence
  Description of Artificial Sequence: Synthetic peptide
  Seed: SAASSSTLVSI (MAGC1_HUMAN)
SAASSSTLVSM

SEQ ID NO: 69029 - protein, 9 aa, Artificial Sequence
  Description of Artificial Sequence: Synthetic peptide
  Seed: SLFQSFSER (MAGC1_HUMAN)
SGFQSFSEY

SEQ ID NO: 69030 - protein, 9 aa, Artificial Sequence
  Description of Artificial Sequence: Synthetic peptide
  Seed: SSFFSSALL (MAGC1_HUMAN)
STFFSSALT

SEQ ID NO: 69031 - protein, 9 aa, Artificial Sequence
  Description of Artificial Sequence: Synthetic peptide
  Seed: SFSSTLVSL (MAGC1_HUMAN)
SGSSTLVSF

SEQ ID NO: 69032 - protein, 10 aa, Artificial Sequence
  Description of Artificial Sequence: Synthetic peptide
  Seed: SIFQSSPESA (MAGC1_HUMAN)
SLFQSSPESI

SEQ ID NO: 69033 - protein, 10 aa, Artificial Sequence
  Description of Artificial Sequence: Synthetic peptide
  Seed: STSLSLPQSF (MAGC1_HUMAN)
SNSLSLPQSW

SEQ ID NO: 69034 - protein, 9 aa, Artificial Sequence
  Description of Artificial Sequence: Synthetic peptide
  Seed: FSEESSSPV (MAGC1_HUMAN)
FAEESSSPY

SEQ ID NO: 69035 - protein, 10 aa, Artificial Sequence
  Description of Artificial Sequence: Synthetic peptide
  Seed: QGEDSLSPHY (MAGC1_HUMAN)
QVEDSLSPHY

SEQ ID NO: 69036 - protein, 9 aa, Artificial Sequence
  Description of Artificial Sequence: Synthetic peptide
  Seed: SSPEGKDSL (MAGC1_HUMAN)
SIPEGKDSL

SEQ ID NO: 69037 - protein, 10 aa, Artificial Sequence
  Description of Artificial Sequence: Synthetic peptide
  Seed: SFSYTLLSLF (MAGC1_HUMAN)
SQSYTLLSLF

SEQ ID NO: 69038 - protein, 9 aa, Artificial Sequence
  Description of Artificial Sequence: Synthetic peptide
  Seed: FFSYTLASL (MAGC1_HUMAN)
FWSYTLASW

SEQ ID NO: 69039 - protein, 11 aa, Artificial Sequence
  Description of Artificial Sequence: Synthetic peptide
  Seed: FPQSPLQGEEF (MAGC1_HUMAN)
FAQSPLQGEEL

SEQ ID NO: 69040 - protein, 9 aa, Artificial Sequence
  Description of Artificial Sequence: Synthetic peptide
  Seed: SICSSSTSL (MAGC1_HUMAN)
SECSSSTSM

SEQ ID NO: 69041 - protein, 9 aa, Artificial Sequence
  Description of Artificial Sequence: Synthetic peptide
  Seed: YVFVNTLDL (MAGC1_HUMAN)
YIFVNTLDM

SEQ ID NO: 69042 - protein, 11 aa, Artificial Sequence
  Description of Artificial Sequence: Synthetic peptide
  Seed: EEVIWDVLSGI (MAGC1_HUMAN)
ETVIWDVLSGL

SEQ ID NO: 69043 - protein, 9 aa, Artificial Sequence
  Description of Artificial Sequence: Synthetic peptide
  Seed: AFGEPRELL (MAGC1_HUMAN)
AIGEPRELL

SEQ ID NO: 69044 - protein, 9 aa, Artificial Sequence
  Description of Artificial Sequence: Synthetic peptide
  Seed: FSSTLLSIL (MAGC1_HUMAN)
FASTLLSIY

SEQ ID NO: 69045 - protein, 9 aa, Artificial Sequence
  Description of Artificial Sequence: Synthetic peptide
  Seed: MTSSFSSTL (MAGC1_HUMAN)
MRSSFSSTF

SEQ ID NO: 69046 - protein, 9 aa, Artificial Sequence
  Description of Artificial Sequence: Synthetic peptide
  Seed: VLQIPVSAA (MAGC1_HUMAN)
VMQIPVSAV

SEQ ID NO: 69047 - protein, 8 aa, Artificial Sequence
  Description of Artificial Sequence: Synthetic peptide
  Seed: FIEILFGI (MAGC1_HUMAN)
FMEILFGM

SEQ ID NO: 69048 - protein, 9 aa, Artificial Sequence
  Description of Artificial Sequence: Synthetic peptide
  Seed: ESSSPVDEY (MAGC1_HUMAN)
ELSSPVDEY

SEQ ID NO: 69049 - protein, 10 aa, Artificial Sequence
  Description of Artificial Sequence: Synthetic peptide
  Seed: GEDSMSPLYF (MAGC1_HUMAN)
GEDSMSPLYW

SEQ ID NO: 69050 - protein, 9 aa, Artificial Sequence
  Description of Artificial Sequence: Synthetic peptide
  Seed: ISFSSSTSL (MAGC1_HUMAN)
IKFSSSTSW

SEQ ID NO: 69051 - protein, 9 aa, Artificial Sequence
  Description of Artificial Sequence: Synthetic peptide
  Seed: MGDKDMPTA (MAGC1_HUMAN)
MGDKDMPTI

SEQ ID NO: 69052 - protein, 9 aa, Artificial Sequence
  Description of Artificial Sequence: Synthetic peptide
  Seed: TTDDSTATE (MAGC1_HUMAN)
TSDDSTATV

SEQ ID NO: 69053 - protein, 9 aa, Artificial Sequence
  Description of Artificial Sequence: Synthetic peptide
  Seed: LILSIIFIK (MAGC1_HUMAN)
LILSIIFIR

SEQ ID NO: 69054 - protein, 10 aa, Artificial Sequence
  Description of Artificial Sequence: Synthetic peptide
  Seed: PLQIPVSSSF (MAGC1_HUMAN)
PVQIPVSSSF

SEQ ID NO: 69055 - protein, 9 aa, Artificial Sequence
  Description of Artificial Sequence: Synthetic peptide
  Seed: IPMTSSFSS (MAGC1_HUMAN)
IMMTSSFSM

SEQ ID NO: 69056 - protein, 9 aa, Artificial Sequence
  Description of Artificial Sequence: Synthetic peptide
  Seed: KRKVVEFLA (MAGC1_HUMAN)
KRKVVEFLK

SEQ ID NO: 69057 - protein, 10 aa, Artificial Sequence
  Description of Artificial Sequence: Synthetic peptide
  Seed: RKVVEFLAML (MAGC1_HUMAN)
RWVVEFLAMA

SEQ ID NO: 69058 - protein, 10 aa, Artificial Sequence
  Description of Artificial Sequence: Synthetic peptide
  Seed: FQSSLQSPVS (MAGC1_HUMAN)
FMSSLQSPVF

SEQ ID NO: 69059 - protein, 9 aa, Artificial Sequence
  Description of Artificial Sequence: Synthetic peptide
  Seed: FSYTLASLL (MAGC1_HUMAN)
FKYTLASLM

SEQ ID NO: 69060 - protein, 9 aa, Artificial Sequence
  Description of Artificial Sequence: Synthetic peptide
  Seed: SLFQSFSER (MAGC1_HUMAN)
SFFQSFSER

SEQ ID NO: 69061 - protein, 9 aa, Artificial Sequence
  Description of Artificial Sequence: Synthetic peptide
  Seed: HYFPQSPPQ (MAGC1_HUMAN)
HYFPQSPPF

SEQ ID NO: 69062 - protein, 9 aa, Artificial Sequence
  Description of Artificial Sequence: Synthetic peptide
  Seed: LFGISLREV (MAGC1_HUMAN)
LYGISLREM

SEQ ID NO: 69063 - protein, 10 aa, Artificial Sequence
  Description of Artificial Sequence: Synthetic peptide
  Seed: IIDTTDDSTA (MAGC1_HUMAN)
IADTTDDSTI

SEQ ID NO: 69064 - protein, 11 aa, Artificial Sequence
  Description of Artificial Sequence: Synthetic peptide
  Seed: QSSPESAQSAF (MAGC1_HUMAN)
QMSPESAQSAW

SEQ ID NO: 69065 - protein, 9 aa, Artificial Sequence
  Description of Artificial Sequence: Synthetic peptide
  Seed: SSFFSSALL (MAGC1_HUMAN)
SGFFSSALY

SEQ ID NO: 69066 - protein, 11 aa, Artificial Sequence
  Description of Artificial Sequence: Synthetic peptide
  Seed: SSFPSSTSSSL (MAGC1_HUMAN)
SIFPSSTSSSV

SEQ ID NO: 69067 - protein, 10 aa, Artificial Sequence
  Description of Artificial Sequence: Synthetic peptide
  Seed: SLQIPVSPSF (MAGC1_HUMAN)
SDQIPVSPSM

SEQ ID NO: 69068 - protein, 11 aa, Artificial Sequence
  Description of Artificial Sequence: Synthetic peptide
  Seed: RSFSSTLLSIF (MAGC1_HUMAN)
RYFSSTLLSII

SEQ ID NO: 69069 - protein, 9 aa, Artificial Sequence
  Description of Artificial Sequence: Synthetic peptide
  Seed: VSSFFSYTL (MAGC1_HUMAN)
VISFFSYTA

SEQ ID NO: 69070 - protein, 9 aa, Artificial Sequence
  Description of Artificial Sequence: Synthetic peptide
  Seed: WVQEHYLEY (MAGC1_HUMAN)
WKQEHYLEY

SEQ ID NO: 69071 - protein, 9 aa, Artificial Sequence
  Description of Artificial Sequence: Synthetic peptide
  Seed: SFSSTLVSL (MAGC1_HUMAN)
SISSTLVSL

SEQ ID NO: 69072 - protein, 9 aa, Artificial Sequence
  Description of Artificial Sequence: Synthetic peptide
  Seed: RKVVEFLAM (MAGC1_HUMAN)
RLVVEFLAY

SEQ ID NO: 69073 - protein, 10 aa, Artificial Sequence
  Description of Artificial Sequence: Synthetic peptide
  Seed: WGPRAHSEVI (MAGC1_HUMAN)
WPPRAHSEVM

SEQ ID NO: 69074 - protein, 9 aa, Artificial Sequence
  Description of Artificial Sequence: Synthetic peptide
  Seed: KVVEFLAML (MAGC1_HUMAN)
KAVEFLAMR

SEQ ID NO: 69075 - protein, 10 aa, Artificial Sequence
  Description of Artificial Sequence: Synthetic peptide
  Seed: TTDDSTATES (MAGC1_HUMAN)
TSDDSTATEI

SEQ ID NO: 69076 - protein, 9 aa, Artificial Sequence
  Description of Artificial Sequence: Synthetic peptide
  Seed: FSSTLVSLF (MAGC1_HUMAN)
FTSTLVSLF

SEQ ID NO: 69077 - protein, 9 aa, Artificial Sequence
  Description of Artificial Sequence: Synthetic peptide
  Seed: FQSSLQSPV (MAGC1_HUMAN)
FKSSLQSPI

SEQ ID NO: 69078 - protein, 10 aa, Artificial Sequence
  Description of Artificial Sequence: Synthetic peptide
  Seed: EEFQSSLQSP (MAGC1_HUMAN)
EEFQSSLQSA

SEQ ID NO: 69079 - protein, 9 aa, Artificial Sequence
  Description of Artificial Sequence: Synthetic peptide
  Seed: SLPEWEDSL (MAGC1_HUMAN)
SGPEWEDSL

SEQ ID NO: 69080 - protein, 10 aa, Artificial Sequence
  Description of Artificial Sequence: Synthetic peptide
  Seed: SFFSSALLSI (MAGC1_HUMAN)
SLFSSALLSF

SEQ ID NO: 69081 - protein, 9 aa, Artificial Sequence
  Description of Artificial Sequence: Synthetic peptide
  Seed: ILILSIIFI (MAGC1_HUMAN)
ILILSIIFA

SEQ ID NO: 69082 - protein, 8 aa, Artificial Sequence
  Description of Artificial Sequence: Synthetic peptide
  Seed: RSFSSTLL (MAGC1_HUMAN)
RTFSSTLL

SEQ ID NO: 69083 - protein, 9 aa, Artificial Sequence
  Description of Artificial Sequence: Synthetic peptide
  Seed: AASSSTLVS (MAGC1_HUMAN)
ATSSSTLVY

SEQ ID NO: 69084 - protein, 9 aa, Artificial Sequence
  Description of Artificial Sequence: Synthetic peptide
  Seed: SSSVMSPSF (MAGC1_HUMAN)
SMSVMSPSF

SEQ ID NO: 69085 - protein, 11 aa, Artificial Sequence
  Description of Artificial Sequence: Synthetic peptide
  Seed: IPVSAASSSTL (MAGC1_HUMAN)
ITVSAASSSTW

SEQ ID NO: 69086 - protein, 9 aa, Artificial Sequence
  Description of Artificial Sequence: Synthetic peptide
  Seed: RTQSTFEGF (MAGC1_HUMAN)
RQQSTFEGM

SEQ ID NO: 69087 - protein, 9 aa, Artificial Sequence
  Description of Artificial Sequence: Synthetic peptide
  Seed: MTSSFSSTL (MAGC1_HUMAN)
MQSSFSSTW

SEQ ID NO: 69088 - protein, 9 aa, Artificial Sequence
  Description of Artificial Sequence: Synthetic peptide
  Seed: SSPERTQST (MAGC1_HUMAN)
SFPERTQSF

SEQ ID NO: 69089 - protein, 11 aa, Artificial Sequence
  Description of Artificial Sequence: Synthetic peptide
  Seed: RPVSSFFSYTL (MAGC1_HUMAN)
RDVSSFFSYTW

SEQ ID NO: 69090 - protein, 9 aa, Artificial Sequence
  Description of Artificial Sequence: Synthetic peptide
  Seed: SSFFSYTLA (MAGC1_HUMAN)
SSFFSYTLK

SEQ ID NO: 69091 - protein, 10 aa, Artificial Sequence
  Description of Artificial Sequence: Synthetic peptide
  Seed: MTSSFSSTLL (MAGC1_HUMAN)
MLSSFSSTLQ

SEQ ID NO: 69092 - protein, 10 aa, Artificial Sequence
  Description of Artificial Sequence: Synthetic peptide
  Seed: GEDSLSPLQI (MAGC1_HUMAN)
GEDSLSPLQF

SEQ ID NO: 69093 - protein, 9 aa, Artificial Sequence
  Description of Artificial Sequence: Synthetic peptide
  Seed: SPPEGENTH (MAGC1_HUMAN)
STPEGENTL

SEQ ID NO: 69094 - protein, 11 aa, Artificial Sequence
  Description of Artificial Sequence: Synthetic peptide
  Seed: SRYTGYFPVIF (MAGC1_HUMAN)
SYYTGYFPVII

SEQ ID NO: 69095 - protein, 9 aa, Artificial Sequence
  Description of Artificial Sequence: Synthetic peptide
  Seed: EGKDSLSPL (MAGC1_HUMAN)
EAKDSLSPY

SEQ ID NO: 69096 - protein, 9 aa, Artificial Sequence
  Description of Artificial Sequence: Synthetic peptide
  Seed: SLPQSFPES (MAGC1_HUMAN)
SIPQSFPEM

SEQ ID NO: 69097 - protein, 9 aa, Artificial Sequence
  Description of Artificial Sequence: Synthetic peptide
  Seed: LQRPVSSFF (MAGC1_HUMAN)
LVRPVSSFK

SEQ ID NO: 69098 - protein, 11 aa, Artificial Sequence
  Description of Artificial Sequence: Synthetic peptide
  Seed: REVDPDDSYVF (MAGC1_HUMAN)
RRVDPDDSYVM

SEQ ID NO: 69099 - protein, 10 aa, Artificial Sequence
  Description of Artificial Sequence: Synthetic peptide
  Seed: MTSSFSSTLL (MAGC1_HUMAN)
MGSSFSSTLW

SEQ ID NO: 69100 - protein, 9 aa, Artificial Sequence
  Description of Artificial Sequence: Synthetic peptide
  Seed: IIDTTDDST (MAGC1_HUMAN)
IVDTTDDSL

SEQ ID NO: 69101 - protein, 10 aa, Artificial Sequence
  Description of Artificial Sequence: Synthetic peptide
  Seed: LSQSSPVSSF (MAGC1_HUMAN)
LKQSSPVSSM

SEQ ID NO: 69102 - protein, 11 aa, Artificial Sequence
  Description of Artificial Sequence: Synthetic peptide
  Seed: SSFSYTLLSLF (MAGC1_HUMAN)
SVFSYTLLSLY

SEQ ID NO: 69103 - protein, 9 aa, Artificial Sequence
  Description of Artificial Sequence: Synthetic peptide
  Seed: VSSSFSYTL (MAGC1_HUMAN)
VISSFSYTA

SEQ ID NO: 69104 - protein, 9 aa, Artificial Sequence
  Description of Artificial Sequence: Synthetic peptide
  Seed: YQVKQPITK (MAGC1_HUMAN)
YMVKQPITK

SEQ ID NO: 69105 - protein, 9 aa, Artificial Sequence
  Description of Artificial Sequence: Synthetic peptide
  Seed: WVQEHYLEY (MAGC1_HUMAN)
WAQEHYLEL

SEQ ID NO: 69106 - protein, 11 aa, Artificial Sequence
  Description of Artificial Sequence: Synthetic peptide
  Seed: SSSSSSTLLSL (MAGC1_HUMAN)
SISSSSTLLSW

SEQ ID NO: 69107 - protein, 10 aa, Artificial Sequence
  Description of Artificial Sequence: Synthetic peptide
  Seed: SLFQSSPERT (MAGC1_HUMAN)
SLFQSSPERA

SEQ ID NO: 69108 - protein, 10 aa, Artificial Sequence
  Description of Artificial Sequence: Synthetic peptide
  Seed: SSPERTHSTF (MAGC1_HUMAN)
SDPERTHSTM

SEQ ID NO: 69109 - protein, 10 aa, Artificial Sequence
  Description of Artificial Sequence: Synthetic peptide
  Seed: RKVVEFLAML (MAGC1_HUMAN)
RKVVEFLAMF

SEQ ID NO: 69110 - protein, 10 aa, Artificial Sequence
  Description of Artificial Sequence: Synthetic peptide
  Seed: SSPECTQSTF (MAGC1_HUMAN)
SIPECTQSTY

SEQ ID NO: 69111 - protein, 9 aa, Artificial Sequence
  Description of Artificial Sequence: Synthetic peptide
  Seed: ISFSSSTSL (MAGC1_HUMAN)
IIFSSSTSI

SEQ ID NO: 69112 - protein, 9 aa, Artificial Sequence
  Description of Artificial Sequence: Synthetic peptide
  Seed: SSSSTLLSL (MAGC1_HUMAN)
SSSSTLLSM

SEQ ID NO: 69113 - protein, 11 aa, Artificial Sequence
  Description of Artificial Sequence: Synthetic peptide
  Seed: VSSSSSSSTLL (MAGC1_HUMAN)
VHSSSSSSTLW

SEQ ID NO: 69114 - protein, 9 aa, Artificial Sequence
  Description of Artificial Sequence: Synthetic peptide
  Seed: ASEEVIWDV (MAGC1_HUMAN)
AQEEVIWDV

SEQ ID NO: 69115 - protein, 10 aa, Artificial Sequence
  Description of Artificial Sequence: Synthetic peptide
  Seed: FFSYTLASLL (MAGC1_HUMAN)
FQSYTLASLF

SEQ ID NO: 69116 - protein, 9 aa, Artificial Sequence
  Description of Artificial Sequence: Synthetic peptide
  Seed: KVWVQEHYL (MAGC1_HUMAN)
KIWVQEHYW

SEQ ID NO: 69117 - protein, 9 aa, Artificial Sequence
  Description of Artificial Sequence: Synthetic peptide
  Seed: FSSTLLSLF (MAGC1_HUMAN)
FVSTLLSLY

SEQ ID NO: 69118 - protein, 10 aa, Artificial Sequence
  Description of Artificial Sequence: Synthetic peptide
  Seed: ASSFFSSALL (MAGC1_HUMAN)
AYSFFSSALY

SEQ ID NO: 69119 - protein, 9 aa, Artificial Sequence
  Description of Artificial Sequence: Synthetic peptide
  Seed: MLTNVISRY (MAGC1_HUMAN)
MPTNVISRL

SEQ ID NO: 69120 - protein, 9 aa, Artificial Sequence
  Description of Artificial Sequence: Synthetic peptide
  Seed: GSPSFSSTL (MAGC1_HUMAN)
GFPSFSSTL

SEQ ID NO: 69121 - protein, 9 aa, Artificial Sequence
  Description of Artificial Sequence: Synthetic peptide
  Seed: SIFQSSPER (MAGC1_HUMAN)
SMFQSSPEL

SEQ ID NO: 69122 - protein, 10 aa, Artificial Sequence
  Description of Artificial Sequence: Synthetic peptide
  Seed: ESAQSTFEGF (MAGC1_HUMAN)
ETAQSTFEGK

SEQ ID NO: 69123 - protein, 10 aa, Artificial Sequence
  Description of Artificial Sequence: Synthetic peptide
  Seed: KYQVKQPITK (MAGC1_HUMAN)
KMQVKQPITR

SEQ ID NO: 69124 - protein, 9 aa, Artificial Sequence
  Description of Artificial Sequence: Synthetic peptide
  Seed: SSSESPQSC (MAGC1_HUMAN)
SVSESPQSY

SEQ ID NO: 69125 - protein, 10 aa, Artificial Sequence
  Description of Artificial Sequence: Synthetic peptide
  Seed: ISRYTGYFPV (MAGC1_HUMAN)
IARYTGYFPM

SEQ ID NO: 69126 - protein, 10 aa, Artificial Sequence
  Description of Artificial Sequence: Synthetic peptide
  Seed: SSPESAQSAF (MAGC1_HUMAN)
SAPESAQSAM

SEQ ID NO: 69127 - protein, 9 aa, Artificial Sequence
  Description of Artificial Sequence: Synthetic peptide
  Seed: CSSSTSLSL (MAGC1_HUMAN)
CQSSTSLSW

SEQ ID NO: 69128 - protein, 10 aa, Artificial Sequence
  Description of Artificial Sequence: Synthetic peptide
  Seed: MTSSFSSTLL (MAGC1_HUMAN)
MDSSFSSTLM

SEQ ID NO: 69129 - protein, 10 aa, Artificial Sequence
  Description of Artificial Sequence: Synthetic peptide
  Seed: SFSSTLLSIL (MAGC1_HUMAN)
SGSSTLLSIF

SEQ ID NO: 69130 - protein, 9 aa, Artificial Sequence
  Description of Artificial Sequence: Synthetic peptide
  Seed: FSERTQSTF (MAGC1_HUMAN)
FTERTQSTM

SEQ ID NO: 69131 - protein, 9 aa, Artificial Sequence
  Description of Artificial Sequence: Synthetic peptide
  Seed: MPTAGMPSL (MAGC1_HUMAN)
MHTAGMPSA

SEQ ID NO: 69132 - protein, 9 aa, Artificial Sequence
  Description of Artificial Sequence: Synthetic peptide
  Seed: FFSYTLASL (MAGC1_HUMAN)
FYSYTLASY

SEQ ID NO: 69133 - protein, 8 aa, Artificial Sequence
  Description of Artificial Sequence: Synthetic peptide
  Seed: AEMLTNVI (MAGC1_HUMAN)
AEMLTNVV

SEQ ID NO: 69134 - protein, 11 aa, Artificial Sequence
  Description of Artificial Sequence: Synthetic peptide
  Seed: RPVSSFFSYTL (MAGC1_HUMAN)
RIVSSFFSYTY

SEQ ID NO: 69135 - protein, 10 aa, Artificial Sequence
  Description of Artificial Sequence: Synthetic peptide
  Seed: STSLSLPQSF (MAGC1_HUMAN)
SWSLSLPQSW

SEQ ID NO: 69136 - protein, 9 aa, Artificial Sequence
  Description of Artificial Sequence: Synthetic peptide
  Seed: LILILSIIF (MAGC1_HUMAN)
LMLILSIIF

SEQ ID NO: 69137 - protein, 10 aa, Artificial Sequence
  Description of Artificial Sequence: Synthetic peptide
  Seed: PLQIPVSRSF (MAGC1_HUMAN)
PFQIPVSRSY

SEQ ID NO: 69138 - protein, 9 aa, Artificial Sequence
  Description of Artificial Sequence: Synthetic peptide
  Seed: QVKQPITKA (MAGC1_HUMAN)
QAKQPITKF

SEQ ID NO: 69139 - protein, 11 aa, Artificial Sequence
  Description of Artificial Sequence: Synthetic peptide
  Seed: IIDTTDDSTAT (MAGC1_HUMAN)
IGDTTDDSTAI

SEQ ID NO: 69140 - protein, 10 aa, Artificial Sequence
  Description of Artificial Sequence: Synthetic peptide
  Seed: SLQIPVSPSF (MAGC1_HUMAN)
SNQIPVSPSM

SEQ ID NO: 69141 - protein, 9 aa, Artificial Sequence
  Description of Artificial Sequence: Synthetic peptide
  Seed: SFSSTLVSL (MAGC1_HUMAN)
STSSTLVSI

SEQ ID NO: 69142 - protein, 9 aa, Artificial Sequence
  Description of Artificial Sequence: Synthetic peptide
  Seed: HFPQSPPEW (MAGC1_HUMAN)
HVPQSPPEM

SEQ ID NO: 69143 - protein, 9 aa, Artificial Sequence
  Description of Artificial Sequence: Synthetic peptide
  Seed: DALKDVEER (MAGC1_HUMAN)
DVLKDVEEK

SEQ ID NO: 69144 - protein, 10 aa, Artificial Sequence
  Description of Artificial Sequence: Synthetic peptide
  Seed: SSSSTLLSLF (MAGC1_HUMAN)
SWSSTLLSLY

SEQ ID NO: 69145 - protein, 9 aa, Artificial Sequence
  Description of Artificial Sequence: Synthetic peptide
  Seed: SQSPPEGPV (MAGC1_HUMAN)
SMSPPEGPF

SEQ ID NO: 69146 - protein, 10 aa, Artificial Sequence
  Description of Artificial Sequence: Synthetic peptide
  Seed: SIIFIKGTYA (MAGC1_HUMAN)
SMIFIKGTYI

SEQ ID NO: 69147 - protein, 9 aa, Artificial Sequence
  Description of Artificial Sequence: Synthetic peptide
  Seed: IIDTTDDST (MAGC1_HUMAN)
IVDTTDDSI

SEQ ID NO: 69148 - protein, 10 aa, Artificial Sequence
  Description of Artificial Sequence: Synthetic peptide
  Seed: REFIEILFGI (MAGC1_HUMAN)
RVFIEILFGT

SEQ ID NO: 69149 - protein, 9 aa, Artificial Sequence
  Description of Artificial Sequence: Synthetic peptide
  Seed: QFPPQGEDF (MAGC1_HUMAN)
QVPPQGEDL

SEQ ID NO: 69150 - protein, 10 aa, Artificial Sequence
  Description of Artificial Sequence: Synthetic peptide
  Seed: VISFSSSTSL (MAGC1_HUMAN)
VQSFSSSTSL

SEQ ID NO: 69151 - protein, 10 aa, Artificial Sequence
  Description of Artificial Sequence: Synthetic peptide
  Seed: STPSSLPQSF (MAGC1_HUMAN)
SQPSSLPQSL

SEQ ID NO: 69152 - protein, 9 aa, Artificial Sequence
  Description of Artificial Sequence: Synthetic peptide
  Seed: SPPEGPVQS (MAGC1_HUMAN)
SPPEGPVQA

SEQ ID NO: 69153 - protein, 9 aa, Artificial Sequence
  Description of Artificial Sequence: Synthetic peptide
  Seed: QVKQPITKA (MAGC1_HUMAN)
QPKQPITKI

SEQ ID NO: 69154 - protein, 10 aa, Artificial Sequence
  Description of Artificial Sequence: Synthetic peptide
  Seed: MTSSFSSTLL (MAGC1_HUMAN)
MDSSFSSTLY

SEQ ID NO: 69155 - protein, 9 aa, Artificial Sequence
  Description of Artificial Sequence: Synthetic peptide
  Seed: TLVSIFQSS (MAGC1_HUMAN)
TMVSIFQSL

SEQ ID NO: 69156 - protein, 9 aa, Artificial Sequence
  Description of Artificial Sequence: Synthetic peptide
  Seed: YTSSSDTLL (MAGC1_HUMAN)
YLSSSDTLM

SEQ ID NO: 69157 - protein, 10 aa, Artificial Sequence
  Description of Artificial Sequence: Synthetic peptide
  Seed: SSSSSSSTLL (MAGC1_HUMAN)
SNSSSSSTLF

SEQ ID NO: 69158 - protein, 10 aa, Artificial Sequence
  Description of Artificial Sequence: Synthetic peptide
  Seed: YTLASLLQSS (MAGC1_HUMAN)
YLLASLLQST

SEQ ID NO: 69159 - protein, 8 aa, Artificial Sequence
  Description of Artificial Sequence: Synthetic peptide
  Seed: RSFSSTLL (MAGC1_HUMAN)
RSFSSTLF

SEQ ID NO: 69160 - protein, 9 aa, Artificial Sequence
  Description of Artificial Sequence: Synthetic peptide
  Seed: RAGREHFAF (MAGC1_HUMAN)
RYGREHFAV

SEQ ID NO: 69161 - protein, 10 aa, Artificial Sequence
  Description of Artificial Sequence: Synthetic peptide
  Seed: TGYFPVIFRK (MAGC1_HUMAN)
TTYFPVIFRV

SEQ ID NO: 69162 - protein, 11 aa, Artificial Sequence
  Description of Artificial Sequence: Synthetic peptide
  Seed: VDEYTSSSDTL (MAGC1_HUMAN)
VYEYTSSSDTF

SEQ ID NO: 69163 - protein, 9 aa, Artificial Sequence
  Description of Artificial Sequence: Synthetic peptide
  Seed: RFLLLKYQV (MAGC1_HUMAN)
RYLLLKYQF

SEQ ID NO: 69164 - protein, 9 aa, Artificial Sequence
  Description of Artificial Sequence: Synthetic peptide
  Seed: FSSTLVSLF (MAGC1_HUMAN)
FVSTLVSLI

SEQ ID NO: 69165 - protein, 9 aa, Artificial Sequence
  Description of Artificial Sequence: Synthetic peptide
  Seed: IPMTSSFSS (MAGC1_HUMAN)
IVMTSSFSF

SEQ ID NO: 69166 - protein, 9 aa, Artificial Sequence
  Description of Artificial Sequence: Synthetic peptide
  Seed: VSSFFSYTL (MAGC1_HUMAN)
VQSFFSYTY

SEQ ID NO: 69167 - protein, 9 aa, Artificial Sequence
  Description of Artificial Sequence: Synthetic peptide
  Seed: SPHYFPQSP (MAGC1_HUMAN)
SPHYFPQSC

SEQ ID NO: 69168 - protein, 10 aa, Artificial Sequence
  Description of Artificial Sequence: Synthetic peptide
  Seed: LQNPASSFFS (MAGC1_HUMAN)
LLNPASSFFY

SEQ ID NO: 69169 - protein, 9 aa, Artificial Sequence
  Description of Artificial Sequence: Synthetic peptide
  Seed: AQSSLQIPV (MAGC1_HUMAN)
AMSSLQIPM

SEQ ID NO: 69170 - protein, 10 aa, Artificial Sequence
  Description of Artificial Sequence: Synthetic peptide
  Seed: VSAASSSTLV (MAGC1_HUMAN)
VLAASSSTLI

SEQ ID NO: 69171 - protein, 9 aa, Artificial Sequence
  Description of Artificial Sequence: Synthetic peptide
  Seed: SSSTLLSLF (MAGC1_HUMAN)
SASTLLSLL

SEQ ID NO: 69172 - protein, 9 aa, Artificial Sequence
  Description of Artificial Sequence: Synthetic peptide
  Seed: WVQEHYLEY (MAGC1_HUMAN)
WQQEHYLEI

SEQ ID NO: 69173 - protein, 9 aa, Artificial Sequence
  Description of Artificial Sequence: Synthetic peptide
  Seed: FTYTLDEKV (MAGC1_HUMAN)
FLYTLDEKT

SEQ ID NO: 69174 - protein, 10 aa, Artificial Sequence
  Description of Artificial Sequence: Synthetic peptide
  Seed: RFLLLKYQVK (MAGC1_HUMAN)
RWLLLKYQVR

SEQ ID NO: 69175 - protein, 9 aa, Artificial Sequence
  Description of Artificial Sequence: Synthetic peptide
  Seed: SICSSSTSL (MAGC1_HUMAN)
SLCSSSTSW

SEQ ID NO: 69176 - protein, 9 aa, Artificial Sequence
  Description of Artificial Sequence: Synthetic peptide
  Seed: LQIPGSPSF (MAGC1_HUMAN)
LQIPGSPSI

SEQ ID NO: 69177 - protein, 9 aa, Artificial Sequence
  Description of Artificial Sequence: Synthetic peptide
  Seed: RTHSTFEGF (MAGC1_HUMAN)
RQHSTFEGF

SEQ ID NO: 69178 - protein, 9 aa, Artificial Sequence
  Description of Artificial Sequence: Synthetic peptide
  Seed: SQSSPVSSF (MAGC1_HUMAN)
SWSSPVSSM

SEQ ID NO: 69179 - protein, 10 aa, Artificial Sequence
  Description of Artificial Sequence: Synthetic peptide
  Seed: VSPSSSSTLL (MAGC1_HUMAN)
VTPSSSSTLY

SEQ ID NO: 69180 - protein, 10 aa, Artificial Sequence
  Description of Artificial Sequence: Synthetic peptide
  Seed: FIEILFGISL (MAGC1_HUMAN)
FEEILFGISM

SEQ ID NO: 69181 - protein, 9 aa, Artificial Sequence
  Description of Artificial Sequence: Synthetic peptide
  Seed: SIIFIKGTY (MAGC1_HUMAN)
STIFIKGTY

SEQ ID NO: 69182 - protein, 11 aa, Artificial Sequence
  Description of Artificial Sequence: Synthetic peptide
  Seed: SSSSSSTLLSL (MAGC1_HUMAN)
SKSSSSTLLSF

SEQ ID NO: 69183 - protein, 9 aa, Artificial Sequence
  Description of Artificial Sequence: Synthetic peptide
  Seed: EHFAFGEPR (MAGC1_HUMAN)
EVFAFGEPY

SEQ ID NO: 69184 - protein, 9 aa, Artificial Sequence
  Description of Artificial Sequence: Synthetic peptide
  Seed: VSSSFSYTL (MAGC1_HUMAN)
VASSFSYTF

SEQ ID NO: 69185 - protein, 9 aa, Artificial Sequence
  Description of Artificial Sequence: Synthetic peptide
  Seed: SPHYFPQSP (MAGC1_HUMAN)
SPHYFPQSV

SEQ ID NO: 69186 - protein, 9 aa, Artificial Sequence
  Description of Artificial Sequence: Synthetic peptide
  Seed: RYTGYFPVI (MAGC1_HUMAN)
RRTGYFPVF

SEQ ID NO: 69187 - protein, 9 aa, Artificial Sequence
  Description of Artificial Sequence: Synthetic peptide
  Seed: SSSSSSSTL (MAGC1_HUMAN)
SQSSSSSTH

SEQ ID NO: 69188 - protein, 11 aa, Artificial Sequence
  Description of Artificial Sequence: Synthetic peptide
  Seed: SQSSPEGKDSL (MAGC1_HUMAN)
SQSSPEGKDSW

SEQ ID NO: 69189 - protein, 9 aa, Artificial Sequence
  Description of Artificial Sequence: Synthetic peptide
  Seed: SLPEWEDSL (MAGC1_HUMAN)
SSPEWEDSL

SEQ ID NO: 69190 - protein, 9 aa, Artificial Sequence
  Description of Artificial Sequence: Synthetic peptide
  Seed: LQIPVSAAS (MAGC1_HUMAN)
LTIPVSAAY

SEQ ID NO: 69191 - protein, 10 aa, Artificial Sequence
  Description of Artificial Sequence: Synthetic peptide
  Seed: SSPERTHSTF (MAGC1_HUMAN)
SKPERTHSTL

SEQ ID NO: 69192 - protein, 9 aa, Artificial Sequence
  Description of Artificial Sequence: Synthetic peptide
  Seed: AREFIEILF (MAGC1_HUMAN)
AHEFIEILL

SEQ ID NO: 69193 - protein, 9 aa, Artificial Sequence
  Description of Artificial Sequence: Synthetic peptide
  Seed: RTQSTFEGF (MAGC1_HUMAN)
RWQSTFEGM

SEQ ID NO: 69194 - protein, 9 aa, Artificial Sequence
  Description of Artificial Sequence: Synthetic peptide
  Seed: KDSLSPLEI (MAGC1_HUMAN)
KESLSPLEA

SEQ ID NO: 69195 - protein, 9 aa, Artificial Sequence
  Description of Artificial Sequence: Synthetic peptide
  Seed: QSPPEGEDV (MAGC1_HUMAN)
QMPPEGEDL

SEQ ID NO: 69196 - protein, 9 aa, Artificial Sequence
  Description of Artificial Sequence: Synthetic peptide
  Seed: FLWGPRAHS (MAGC1_HUMAN)
FLWGPRAHI

SEQ ID NO: 69197 - protein, 10 aa, Artificial Sequence
  Description of Artificial Sequence: Synthetic peptide
  Seed: LQIPGSPSFS (MAGC1_HUMAN)
LMIPGSPSFF

SEQ ID NO: 69198 - protein, 10 aa, Artificial Sequence
  Description of Artificial Sequence: Synthetic peptide
  Seed: SSFSYTLLSL (MAGC1_HUMAN)
SQFSYTLLSH

SEQ ID NO: 69199 - protein, 9 aa, Artificial Sequence
  Description of Artificial Sequence: Synthetic peptide
  Seed: RSFSSTLLS (MAGC1_HUMAN)
RLFSSTLLM

SEQ ID NO: 69200 - protein, 9 aa, Artificial Sequence
  Description of Artificial Sequence: Synthetic peptide
  Seed: SPESAQSTF (MAGC1_HUMAN)
SHESAQSTY

SEQ ID NO: 69201 - protein, 11 aa, Artificial Sequence
  Description of Artificial Sequence: Synthetic peptide
  Seed: SSSSSSTLLSL (MAGC1_HUMAN)
SKSSSSTLLSW

SEQ ID NO: 69202 - protein, 10 aa, Artificial Sequence
  Description of Artificial Sequence: Synthetic peptide
  Seed: SSPECTQSTF (MAGC1_HUMAN)
SVPECTQSTM

SEQ ID NO: 69203 - protein, 9 aa, Artificial Sequence
  Description of Artificial Sequence: Synthetic peptide
  Seed: LQIPGSPSF (MAGC1_HUMAN)
LIIPGSPSW

SEQ ID NO: 69204 - protein, 10 aa, Artificial Sequence
  Description of Artificial Sequence: Synthetic peptide
  Seed: FAQSSLQIPV (MAGC1_HUMAN)
FWQSSLQIPI

SEQ ID NO: 69205 - protein, 10 aa, Artificial Sequence
  Description of Artificial Sequence: Synthetic peptide
  Seed: MTSSFSSTLL (MAGC1_HUMAN)
MKSSFSSTLL

SEQ ID NO: 69206 - protein, 10 aa, Artificial Sequence
  Description of Artificial Sequence: Synthetic peptide
  Seed: STPSSLPQSF (MAGC1_HUMAN)
SMPSSLPQSY

SEQ ID NO: 69207 - protein, 11 aa, Artificial Sequence
  Description of Artificial Sequence: Synthetic peptide
  Seed: IPMTSSFSSTL (MAGC1_HUMAN)
IQMTSSFSSTW

SEQ ID NO: 69208 - protein, 10 aa, Artificial Sequence
  Description of Artificial Sequence: Synthetic peptide
  Seed: VWVQEHYLEY (MAGC1_HUMAN)
VQVQEHYLEY

SEQ ID NO: 69209 - protein, 9 aa, Artificial Sequence
  Description of Artificial Sequence: Synthetic peptide
  Seed: IIDTTDDST (MAGC1_HUMAN)
IFDTTDDSF

SEQ ID NO: 69210 - protein, 10 aa, Artificial Sequence
  Description of Artificial Sequence: Synthetic peptide
  Seed: SPVISFSSST (MAGC1_HUMAN)
SPVISFSSSV

SEQ ID NO: 69211 - protein, 9 aa, Artificial Sequence
  Description of Artificial Sequence: Synthetic peptide
  Seed: ILILSIIFI (MAGC1_HUMAN)
IMILSIIFM

SEQ ID NO: 69212 - protein, 11 aa, Artificial Sequence
  Description of Artificial Sequence: Synthetic peptide
  Seed: LQRPVSSFFSY (MAGC1_HUMAN)
LARPVSSFFSF

SEQ ID NO: 69213 - protein, 9 aa, Artificial Sequence
  Description of Artificial Sequence: Synthetic peptide
  Seed: VSPSFSSTL (MAGC1_HUMAN)
VTPSFSSTV

SEQ ID NO: 69214 - protein, 9 aa, Artificial Sequence
  Description of Artificial Sequence: Synthetic peptide
  Seed: WVQEHYLEY (MAGC1_HUMAN)
WKQEHYLEF

SEQ ID NO: 69215 - protein, 9 aa, Artificial Sequence
  Description of Artificial Sequence: Synthetic peptide
  Seed: TLDEKVDEL (MAGC1_HUMAN)
TFDEKVDEI

SEQ ID NO: 69216 - protein, 10 aa, Artificial Sequence
  Description of Artificial Sequence: Synthetic peptide
  Seed: LAMLKNTVPI (MAGC1_HUMAN)
LVMLKNTVPM

SEQ ID NO: 69217 - protein, 8 aa, Artificial Sequence
  Description of Artificial Sequence: Synthetic peptide
  Seed: QIPMTSSF (MAGC1_HUMAN)
QYPMTSSF

SEQ ID NO: 69218 - protein, 9 aa, Artificial Sequence
  Description of Artificial Sequence: Synthetic peptide
  Seed: ISFSSSTSL (MAGC1_HUMAN)
ISFSSSTSI

SEQ ID NO: 69219 - protein, 10 aa, Artificial Sequence
  Description of Artificial Sequence: Synthetic peptide
  Seed: STLLSLFQSF (MAGC1_HUMAN)
SWLLSLFQSL

SEQ ID NO: 69220 - protein, 10 aa, Artificial Sequence
  Description of Artificial Sequence: Synthetic peptide
  Seed: VSLFQSSPER (MAGC1_HUMAN)
VTLFQSSPER

SEQ ID NO: 69221 - protein, 11 aa, Artificial Sequence
  Description of Artificial Sequence: Synthetic peptide
  Seed: LQIPVSSSFSY (MAGC1_HUMAN)
LEIPVSSSFSW

SEQ ID NO: 69222 - protein, 9 aa, Artificial Sequence
  Description of Artificial Sequence: Synthetic peptide
  Seed: LQIPVSSSS (MAGC1_HUMAN)
LQIPVSSSY

SEQ ID NO: 69223 - protein, 11 aa, Artificial Sequence
  Description of Artificial Sequence: Synthetic peptide
  Seed: SPLQNPASSFF (MAGC1_HUMAN)
SHLQNPASSFY

SEQ ID NO: 69224 - protein, 9 aa, Artificial Sequence
  Description of Artificial Sequence: Synthetic peptide
  Seed: SPLQIVPSL (MAGC1_HUMAN)
SMLQIVPSA

SEQ ID NO: 69225 - protein, 9 aa, Artificial Sequence
  Description of Artificial Sequence: Synthetic peptide
  Seed: FSSTLLSLF (MAGC1_HUMAN)
FRSTLLSLV

SEQ ID NO: 69226 - protein, 9 aa, Artificial Sequence
  Description of Artificial Sequence: Synthetic peptide
  Seed: LQIPMTSSF (MAGC1_HUMAN)
LPIPMTSSF

SEQ ID NO: 69227 - protein, 10 aa, Artificial Sequence
  Description of Artificial Sequence: Synthetic peptide
  Seed: FIEILFGISL (MAGC1_HUMAN)
FEEILFGISL

SEQ ID NO: 69228 - protein, 10 aa, Artificial Sequence
  Description of Artificial Sequence: Synthetic peptide
  Seed: RYTGYFPVIF (MAGC1_HUMAN)
RSTGYFPVIM

SEQ ID NO: 69229 - protein, 9 aa, Artificial Sequence
  Description of Artificial Sequence: Synthetic peptide
  Seed: ASSFFSSAL (MAGC1_HUMAN)
AVSFFSSAV

SEQ ID NO: 69230 - protein, 9 aa, Artificial Sequence
  Description of Artificial Sequence: Synthetic peptide
  Seed: DSYVFVNTL (MAGC1_HUMAN)
DPYVFVNTL

SEQ ID NO: 69231 - protein, 10 aa, Artificial Sequence
  Description of Artificial Sequence: Synthetic peptide
  Seed: LSQSSPVSSF (MAGC1_HUMAN)
LQQSSPVSSF

SEQ ID NO: 69232 - protein, 9 aa, Artificial Sequence
  Description of Artificial Sequence: Synthetic peptide
  Seed: FSSALLSIF (MAGC1_HUMAN)
FSSALLSIL

SEQ ID NO: 69233 - protein, 9 aa, Artificial Sequence
  Description of Artificial Sequence: Synthetic peptide
  Seed: SSPERTHST (MAGC1_HUMAN)
SHPERTHSM

SEQ ID NO: 69234 - protein, 9 aa, Artificial Sequence
  Description of Artificial Sequence: Synthetic peptide
  Seed: FSSTLLSIL (MAGC1_HUMAN)
FGSTLLSIW

SEQ ID NO: 69235 - protein, 10 aa, Artificial Sequence
  Description of Artificial Sequence: Synthetic peptide
  Seed: ICSSSTSLSL (MAGC1_HUMAN)
IYSSSTSLSF

SEQ ID NO: 69236 - protein, 9 aa, Artificial Sequence
  Description of Artificial Sequence: Synthetic peptide
  Seed: THSPLQIVP (MAGC1_HUMAN)
TRSPLQIVL

SEQ ID NO: 69237 - protein, 9 aa, Artificial Sequence
  Description of Artificial Sequence: Synthetic peptide
  Seed: YTSSSDTLL (MAGC1_HUMAN)
YTSSSDTLI

SEQ ID NO: 69238 - protein, 9 aa, Artificial Sequence
  Description of Artificial Sequence: Synthetic peptide
  Seed: TPSSLPQSF (MAGC1_HUMAN)
TPSSLPQSI

SEQ ID NO: 69239 - protein, 9 aa, Artificial Sequence
  Description of Artificial Sequence: Synthetic peptide
  Seed: TESASSSVM (MAGC1_HUMAN)
TESASSSVI

SEQ ID NO: 69240 - protein, 9 aa, Artificial Sequence
  Description of Artificial Sequence: Synthetic peptide
  Seed: SASSSVMSP (MAGC1_HUMAN)
SASSSVMSH

SEQ ID NO: 69241 - protein, 9 aa, Artificial Sequence
  Description of Artificial Sequence: Synthetic peptide
  Seed: SIIFIKGTY (MAGC1_HUMAN)
SVIFIKGTY

SEQ ID NO: 69242 - protein, 11 aa, Artificial Sequence
  Description of Artificial Sequence: Synthetic peptide
  Seed: TLDEKVDELAR (MAGC1_HUMAN)
TIDEKVDELAY

SEQ ID NO: 69243 - protein, 9 aa, Artificial Sequence
  Description of Artificial Sequence: Synthetic peptide
  Seed: VPITFPSSY (MAGC1_HUMAN)
VKITFPSSL

SEQ ID NO: 69244 - protein, 9 aa, Artificial Sequence
  Description of Artificial Sequence: Synthetic peptide
  Seed: SSSTLVSIF (MAGC1_HUMAN)
SRSTLVSIF

SEQ ID NO: 69245 - protein, 11 aa, Artificial Sequence
  Description of Artificial Sequence: Synthetic peptide
  Seed: SPVSSFPSSTS (MAGC1_HUMAN)
SPVSSFPSSTL

SEQ ID NO: 69246 - protein, 10 aa, Artificial Sequence
  Description of Artificial Sequence: Synthetic peptide
  Seed: TTDDSTATES (MAGC1_HUMAN)
TGDDSTATEV

SEQ ID NO: 69247 - protein, 11 aa, Artificial Sequence
  Description of Artificial Sequence: Synthetic peptide
  Seed: RSFSSTLLSIF (MAGC1_HUMAN)
RTFSSTLLSIL

SEQ ID NO: 69248 - protein, 9 aa, Artificial Sequence
  Description of Artificial Sequence: Synthetic peptide
  Seed: SSPERTQST (MAGC1_HUMAN)
SGPERTQSV

SEQ ID NO: 69249 - protein, 11 aa, Artificial Sequence
  Description of Artificial Sequence: Synthetic peptide
  Seed: KDMPTAGMPSL (MAGC1_HUMAN)
KEMPTAGMPSC

SEQ ID NO: 69250 - protein, 9 aa, Artificial Sequence
  Description of Artificial Sequence: Synthetic peptide
  Seed: AQSSLQIPV (MAGC1_HUMAN)
AESSLQIPC

SEQ ID NO: 69251 - protein, 11 aa, Artificial Sequence
  Description of Artificial Sequence: Synthetic peptide
  Seed: GEDFQSSLQSP (MAGC1_HUMAN)
GEDFQSSLQSA

SEQ ID NO: 69252 - protein, 11 aa, Artificial Sequence
  Description of Artificial Sequence: Synthetic peptide
  Seed: STFEGFPQSLL (MAGC1_HUMAN)
SMFEGFPQSLG

SEQ ID NO: 69253 - protein, 10 aa, Artificial Sequence
  Description of Artificial Sequence: Synthetic peptide
  Seed: ESAQSTFEGF (MAGC1_HUMAN)
EIAQSTFEGF

SEQ ID NO: 69254 - protein, 9 aa, Artificial Sequence
  Description of Artificial Sequence: Synthetic peptide
  Seed: NVISRYTGY (MAGC1_HUMAN)
NQISRYTGY

SEQ ID NO: 69255 - protein, 9 aa, Artificial Sequence
  Description of Artificial Sequence: Synthetic peptide
  Seed: RPVSSFFSY (MAGC1_HUMAN)
RSVSSFFSY

SEQ ID NO: 69256 - protein, 9 aa, Artificial Sequence
  Description of Artificial Sequence: Synthetic peptide
  Seed: KQPITKAEM (MAGC1_HUMAN)
KRPITKAEF

SEQ ID NO: 69257 - protein, 11 aa, Artificial Sequence
  Description of Artificial Sequence: Synthetic peptide
  Seed: YTGYFPVIFRK (MAGC1_HUMAN)
YTGYFPVIFRR

SEQ ID NO: 69258 - protein, 9 aa, Artificial Sequence
  Description of Artificial Sequence: Synthetic peptide
  Seed: CSSSTPSSL (MAGC1_HUMAN)
CMSSTPSSM

SEQ ID NO: 69259 - protein, 10 aa, Artificial Sequence
  Description of Artificial Sequence: Synthetic peptide
  Seed: SSFSSTLLSI (MAGC1_HUMAN)
SIFSSTLLST

SEQ ID NO: 69260 - protein, 10 aa, Artificial Sequence
  Description of Artificial Sequence: Synthetic peptide
  Seed: EGPAQSPLQR (MAGC1_HUMAN)
ETPAQSPLQK

SEQ ID NO: 69261 - protein, 9 aa, Artificial Sequence
  Description of Artificial Sequence: Synthetic peptide
  Seed: EGDDTQSPL (MAGC1_HUMAN)
EFDDTQSPF

SEQ ID NO: 69262 - protein, 10 aa, Artificial Sequence
  Description of Artificial Sequence: Synthetic peptide
  Seed: TTDDSTATES (MAGC1_HUMAN)
TWDDSTATEL

SEQ ID NO: 69263 - protein, 11 aa, Artificial Sequence
  Description of Artificial Sequence: Synthetic peptide
  Seed: SPLQIPGSPSF (MAGC1_HUMAN)
SMLQIPGSPSM

SEQ ID NO: 69264 - protein, 11 aa, Artificial Sequence
  Description of Artificial Sequence: Synthetic peptide
  Seed: EEVIWDVLSGI (MAGC1_HUMAN)
EVVIWDVLSGV

SEQ ID NO: 69265 - protein, 9 aa, Artificial Sequence
  Description of Artificial Sequence: Synthetic peptide
  Seed: VIKRKVVEF (MAGC1_HUMAN)
VIKRKVVEM

SEQ ID NO: 69266 - protein, 9 aa, Artificial Sequence
  Description of Artificial Sequence: Synthetic peptide
  Seed: SPESAQSTF (MAGC1_HUMAN)
SPESAQSTA

SEQ ID NO: 69267 - protein, 9 aa, Artificial Sequence
  Description of Artificial Sequence: Synthetic peptide
  Seed: SSFFSSALL (MAGC1_HUMAN)
SPFFSSALF

SEQ ID NO: 69268 - protein, 10 aa, Artificial Sequence
  Description of Artificial Sequence: Synthetic peptide
  Seed: MLKNTVPITF (MAGC1_HUMAN)
MVKNTVPITY

SEQ ID NO: 69269 - protein, 9 aa, Artificial Sequence
  Description of Artificial Sequence: Synthetic peptide
  Seed: YQVKQPITK (MAGC1_HUMAN)
YVVKQPITR

SEQ ID NO: 69270 - protein, 9 aa, Artificial Sequence
  Description of Artificial Sequence: Synthetic peptide
  Seed: TLLSLFQSF (MAGC1_HUMAN)
TMLSLFQSW

SEQ ID NO: 69271 - protein, 9 aa, Artificial Sequence
  Description of Artificial Sequence: Synthetic peptide
  Seed: VSSSFSYTL (MAGC1_HUMAN)
VMSSFSYTM

SEQ ID NO: 69272 - protein, 9 aa, Artificial Sequence
  Description of Artificial Sequence: Synthetic peptide
  Seed: SFSYTLLSL (MAGC1_HUMAN)
SFSYTLLSI

SEQ ID NO: 69273 - protein, 9 aa, Artificial Sequence
  Description of Artificial Sequence: Synthetic peptide
  Seed: AQSPLQIPV (MAGC1_HUMAN)
AESPLQIPY

SEQ ID NO: 69274 - protein, 9 aa, Artificial Sequence
  Description of Artificial Sequence: Synthetic peptide
  Seed: WGPRAHSEV (MAGC1_HUMAN)
WVPRAHSEL

SEQ ID NO: 69275 - protein, 9 aa, Artificial Sequence
  Description of Artificial Sequence: Synthetic peptide
  Seed: FFSYTLASL (MAGC1_HUMAN)
FISYTLASA

SEQ ID NO: 69276 - protein, 9 aa, Artificial Sequence
  Description of Artificial Sequence: Synthetic peptide
  Seed: SLSPHYFPQ (MAGC1_HUMAN)
SVSPHYFPR

SEQ ID NO: 69277 - protein, 10 aa, Artificial Sequence
  Description of Artificial Sequence: Synthetic peptide
  Seed: YTLDEKVDEL (MAGC1_HUMAN)
YHLDEKVDEI

SEQ ID NO: 69278 - protein, 9 aa, Artificial Sequence
  Description of Artificial Sequence: Synthetic peptide
  Seed: VSSSSSSTL (MAGC1_HUMAN)
VHSSSSSTY

SEQ ID NO: 69279 - protein, 9 aa, Artificial Sequence
  Description of Artificial Sequence: Synthetic peptide
  Seed: KVWVQEHYL (MAGC1_HUMAN)
KWWVQEHYY

SEQ ID NO: 69280 - protein, 10 aa, Artificial Sequence
  Description of Artificial Sequence: Synthetic peptide
  Seed: SPPEGPAQSP (MAGC1_HUMAN)
SPPEGPAQSF

SEQ ID NO: 69281 - protein, 11 aa, Artificial Sequence
  Description of Artificial Sequence: Synthetic peptide
  Seed: LQIPVSSSFSY (MAGC1_HUMAN)
LCIPVSSSFSW

SEQ ID NO: 69282 - protein, 9 aa, Artificial Sequence
  Description of Artificial Sequence: Synthetic peptide
  Seed: KVDELARFL (MAGC1_HUMAN)
KQDELARFL

SEQ ID NO: 69283 - protein, 9 aa, Artificial Sequence
  Description of Artificial Sequence: Synthetic peptide
  Seed: SLSPFSEES (MAGC1_HUMAN)
SQSPFSEEL

SEQ ID NO: 69284 - protein, 10 aa, Artificial Sequence
  Description of Artificial Sequence: Synthetic peptide
  Seed: ICSSSTPSSL (MAGC1_HUMAN)
IMSSSTPSSW

SEQ ID NO: 69285 - protein, 11 aa, Artificial Sequence
  Description of Artificial Sequence: Synthetic peptide
  Seed: SQSSPEGKDSL (MAGC1_HUMAN)
SLSSPEGKDSL

SEQ ID NO: 69286 - protein, 9 aa, Artificial Sequence
  Description of Artificial Sequence: Synthetic peptide
  Seed: SQSSPVSSF (MAGC1_HUMAN)
SESSPVSSW

SEQ ID NO: 69287 - protein, 10 aa, Artificial Sequence
  Description of Artificial Sequence: Synthetic peptide
  Seed: SFPSSTSSSL (MAGC1_HUMAN)
SEPSSTSSSF

SEQ ID NO: 69288 - protein, 9 aa, Artificial Sequence
  Description of Artificial Sequence: Synthetic peptide
  Seed: AGREHFAFG (MAGC1_HUMAN)
ATREHFAFV

SEQ ID NO: 69289 - protein, 10 aa, Artificial Sequence
  Description of Artificial Sequence: Synthetic peptide
  Seed: ATESASSSVM (MAGC1_HUMAN)
APESASSSVL

SEQ ID NO: 69290 - protein, 10 aa, Artificial Sequence
  Description of Artificial Sequence: Synthetic peptide
  Seed: FLAMLKNTVP (MAGC1_HUMAN)
FLAMLKNTVM

SEQ ID NO: 69291 - protein, 10 aa, Artificial Sequence
  Description of Artificial Sequence: Synthetic peptide
  Seed: VISFSSSTSL (MAGC1_HUMAN)
VESFSSSTSY

SEQ ID NO: 69292 - protein, 8 aa, Artificial Sequence
  Description of Artificial Sequence: Synthetic peptide
  Seed: AEMLTNVI (MAGC1_HUMAN)
AEMLTNVY

SEQ ID NO: 69293 - protein, 9 aa, Artificial Sequence
  Description of Artificial Sequence: Synthetic peptide
  Seed: SSSTLLSLF (MAGC1_HUMAN)
SYSTLLSLV

SEQ ID NO: 69294 - protein, 9 aa, Artificial Sequence
  Description of Artificial Sequence: Synthetic peptide
  Seed: CTQSTFEGF (MAGC1_HUMAN)
CSQSTFEGW

SEQ ID NO: 69295 - protein, 9 aa, Artificial Sequence
  Description of Artificial Sequence: Synthetic peptide
  Seed: KVDELARFL (MAGC1_HUMAN)
KIDELARFL

SEQ ID NO: 69296 - protein, 9 aa, Artificial Sequence
  Description of Artificial Sequence: Synthetic peptide
  Seed: FSYTLASLL (MAGC1_HUMAN)
FRYTLASLV

SEQ ID NO: 69297 - protein, 9 aa, Artificial Sequence
  Description of Artificial Sequence: Synthetic peptide
  Seed: SLSPFSEES (MAGC1_HUMAN)
SISPFSEEL

SEQ ID NO: 69298 - protein, 10 aa, Artificial Sequence
  Description of Artificial Sequence: Synthetic peptide
  Seed: TTDDSTATES (MAGC1_HUMAN)
TFDDSTATEL

SEQ ID NO: 69299 - protein, 10 aa, Artificial Sequence
  Description of Artificial Sequence: Synthetic peptide
  Seed: SSFPSSTSSS (MAGC1_HUMAN)
SNFPSSTSSY

SEQ ID NO: 69300 - protein, 9 aa, Artificial Sequence
  Description of Artificial Sequence: Synthetic peptide
  Seed: LILSIIFIK (MAGC1_HUMAN)
LVLSIIFIR

SEQ ID NO: 69301 - protein, 11 aa, Artificial Sequence
  Description of Artificial Sequence: Synthetic peptide
  Seed: MPSLLQSSSES (MAGC1_HUMAN)
MPSLLQSSSEA

SEQ ID NO: 69302 - protein, 11 aa, Artificial Sequence
  Description of Artificial Sequence: Synthetic peptide
  Seed: IPVSSSFSYTL (MAGC1_HUMAN)
ITVSSSFSYTF

SEQ ID NO: 69303 - protein, 11 aa, Artificial Sequence
  Description of Artificial Sequence: Synthetic peptide
  Seed: SSFPSSTSSSL (MAGC1_HUMAN)
SPFPSSTSSSV

SEQ ID NO: 69304 - protein, 9 aa, Artificial Sequence
  Description of Artificial Sequence: Synthetic peptide
  Seed: ASEEVIWDV (MAGC1_HUMAN)
ALEEVIWDT

SEQ ID NO: 69305 - protein, 10 aa, Artificial Sequence
  Description of Artificial Sequence: Synthetic peptide
  Seed: KVDELARFLL (MAGC1_HUMAN)
KQDELARFLF

SEQ ID NO: 69306 - protein, 9 aa, Artificial Sequence
  Description of Artificial Sequence: Synthetic peptide
  Seed: RAHSEVIKR (MAGC1_HUMAN)
RSHSEVIKV

SEQ ID NO: 69307 - protein, 9 aa, Artificial Sequence
  Description of Artificial Sequence: Synthetic peptide
  Seed: TSLSLPQSF (MAGC1_HUMAN)
TLLSLPQSF

SEQ ID NO: 69308 - protein, 10 aa, Artificial Sequence
  Description of Artificial Sequence: Synthetic peptide
  Seed: SSSSTLLSLF (MAGC1_HUMAN)
SISSTLLSLF

SEQ ID NO: 69309 - protein, 10 aa, Artificial Sequence
  Description of Artificial Sequence: Synthetic peptide
  Seed: MTSSFSSTLL (MAGC1_HUMAN)
MLSSFSSTLI

SEQ ID NO: 69310 - protein, 9 aa, Artificial Sequence
  Description of Artificial Sequence: Synthetic peptide
  Seed: SSPESAQSA (MAGC1_HUMAN)
SNPESAQSL

SEQ ID NO: 69311 - protein, 10 aa, Artificial Sequence
  Description of Artificial Sequence: Synthetic peptide
  Seed: REFIEILFGI (MAGC1_HUMAN)
RQFIEILFGL

SEQ ID NO: 69312 - protein, 9 aa, Artificial Sequence
  Description of Artificial Sequence: Synthetic peptide
  Seed: SICSSSTSL (MAGC1_HUMAN)
SRCSSSTSF

SEQ ID NO: 69313 - protein, 9 aa, Artificial Sequence
  Description of Artificial Sequence: Synthetic peptide
  Seed: FAFGEPREL (MAGC1_HUMAN)
FAFGEPREH

SEQ ID NO: 69314 - protein, 9 aa, Artificial Sequence
  Description of Artificial Sequence: Synthetic peptide
  Seed: FPSSTSSSL (MAGC1_HUMAN)
FWSSTSSSL

SEQ ID NO: 69315 - protein, 9 aa, Artificial Sequence
  Description of Artificial Sequence: Synthetic peptide
  Seed: TSLSLPQSF (MAGC1_HUMAN)
TLLSLPQSM

SEQ ID NO: 69316 - protein, 9 aa, Artificial Sequence
  Description of Artificial Sequence: Synthetic peptide
  Seed: SSSTSLSPF (MAGC1_HUMAN)
SWSTSLSPM

SEQ ID NO: 69317 - protein, 11 aa, Artificial Sequence
  Description of Artificial Sequence: Synthetic peptide
  Seed: LQIPVSSSFSY (MAGC1_HUMAN)
LEIPVSSSFSM

SEQ ID NO: 69318 - protein, 10 aa, Artificial Sequence
  Description of Artificial Sequence: Synthetic peptide
  Seed: SPLQSPESAP (MAGC1_HUMAN)
SPLQSPESAM

SEQ ID NO: 69319 - protein, 10 aa, Artificial Sequence
  Description of Artificial Sequence: Synthetic peptide
  Seed: VSICSSSTSL (MAGC1_HUMAN)
VAICSSSTSF

SEQ ID NO: 69320 - protein, 9 aa, Artificial Sequence
  Description of Artificial Sequence: Synthetic peptide
  Seed: IIFIKGTYA (MAGC1_HUMAN)
ILFIKGTYV

SEQ ID NO: 69321 - protein, 9 aa, Artificial Sequence
  Description of Artificial Sequence: Synthetic peptide
  Seed: IPGSPSFSS (MAGC1_HUMAN)
IPGSPSFSM

SEQ ID NO: 69322 - protein, 10 aa, Artificial Sequence
  Description of Artificial Sequence: Synthetic peptide
  Seed: RKVVEFLAML (MAGC1_HUMAN)
RVVVEFLAMI

SEQ ID NO: 69323 - protein, 8 aa, Artificial Sequence
  Description of Artificial Sequence: Synthetic peptide
  Seed: SSSTLLSL (MAGC1_HUMAN)
SASTLLSL

SEQ ID NO: 69324 - protein, 9 aa, Artificial Sequence
  Description of Artificial Sequence: Synthetic peptide
  Seed: SSSTSLSPF (MAGC1_HUMAN)
STSTSLSPW

SEQ ID NO: 69325 - protein, 10 aa, Artificial Sequence
  Description of Artificial Sequence: Synthetic peptide
  Seed: REVDPDDSYV (MAGC1_HUMAN)
RLVDPDDSYL

SEQ ID NO: 69326 - protein, 9 aa, Artificial Sequence
  Description of Artificial Sequence: Synthetic peptide
  Seed: SPLHSPQSP (MAGC1_HUMAN)
SPLHSPQST

SEQ ID NO: 69327 - protein, 11 aa, Artificial Sequence
  Description of Artificial Sequence: Synthetic peptide
  Seed: FPQSPQGEDSL (MAGC1_HUMAN)
FPQSPQGEDSY

SEQ ID NO: 69328 - protein, 11 aa, Artificial Sequence
  Description of Artificial Sequence: Synthetic peptide
  Seed: STFEGFPQSLL (MAGC1_HUMAN)
SMFEGFPQSLF

SEQ ID NO: 69329 - protein, 11 aa, Artificial Sequence
  Description of Artificial Sequence: Synthetic peptide
  Seed: TLYPLQSPQSR (MAGC1_HUMAN)
TSYPLQSPQSR

SEQ ID NO: 69330 - protein, 9 aa, Artificial Sequence
  Description of Artificial Sequence: Synthetic peptide
  Seed: YVFVNTLDL (MAGC1_HUMAN)
YMFVNTLDI

SEQ ID NO: 69331 - protein, 10 aa, Artificial Sequence
  Description of Artificial Sequence: Synthetic peptide
  Seed: FAQSSLQIPV (MAGC1_HUMAN)
FHQSSLQIPL

SEQ ID NO: 69332 - protein, 9 aa, Artificial Sequence
  Description of Artificial Sequence: Synthetic peptide
  Seed: STQSPFEGF (MAGC1_HUMAN)
SVQSPFEGW

SEQ ID NO: 69333 - protein, 9 aa, Artificial Sequence
  Description of Artificial Sequence: Synthetic peptide
  Seed: YVFVNTLDL (MAGC1_HUMAN)
YYFVNTLDM

SEQ ID NO: 69334 - protein, 9 aa, Artificial Sequence
  Description of Artificial Sequence: Synthetic peptide
  Seed: VSSSSSSTL (MAGC1_HUMAN)
VISSSSSTY

SEQ ID NO: 69335 - protein, 8 aa, Artificial Sequence
  Description of Artificial Sequence: Synthetic peptide
  Seed: LQSPVSSF (MAGC1_HUMAN)
LQSPVSSM

SEQ ID NO: 69336 - protein, 9 aa, Artificial Sequence
  Description of Artificial Sequence: Synthetic peptide
  Seed: CTQSTFEGF (MAGC1_HUMAN)
CWQSTFEGW

SEQ ID NO: 69337 - protein, 10 aa, Artificial Sequence
  Description of Artificial Sequence: Synthetic peptide
  Seed: LAMLKNTVPI (MAGC1_HUMAN)
LWMLKNTVPV

SEQ ID NO: 69338 - protein, 9 aa, Artificial Sequence
  Description of Artificial Sequence: Synthetic peptide
  Seed: SSPPRYEFL (MAGC1_HUMAN)
SGPPRYEFM

SEQ ID NO: 69339 - protein, 11 aa, Artificial Sequence
  Description of Artificial Sequence: Synthetic peptide
  Seed: FLWGPRAHSEV (MAGC1_HUMAN)
FQWGPRAHSEV

SEQ ID NO: 69340 - protein, 8 aa, Artificial Sequence
  Description of Artificial Sequence: Synthetic peptide
  Seed: VPITFPSS (MAGC1_HUMAN)
VPITFPSA

SEQ ID NO: 69341 - protein, 10 aa, Artificial Sequence
  Description of Artificial Sequence: Synthetic peptide
  Seed: LQIPMTSSFS (MAGC1_HUMAN)
LMIPMTSSFD

SEQ ID NO: 69342 - protein, 9 aa, Artificial Sequence
  Description of Artificial Sequence: Synthetic peptide
  Seed: CSSSTSLSL (MAGC1_HUMAN)
CKSSTSLSM

SEQ ID NO: 69343 - protein, 10 aa, Artificial Sequence
  Description of Artificial Sequence: Synthetic peptide
  Seed: SRYTGYFPVI (MAGC1_HUMAN)
SQYTGYFPVI

SEQ ID NO: 69344 - protein, 9 aa, Artificial Sequence
  Description of Artificial Sequence: Synthetic peptide
  Seed: TLDEKVDEL (MAGC1_HUMAN)
TTDEKVDEM

SEQ ID NO: 69345 - protein, 11 aa, Artificial Sequence
  Description of Artificial Sequence: Synthetic peptide
  Seed: SSTLLSLFQSF (MAGC1_HUMAN)
STTLLSLFQSW

SEQ ID NO: 69346 - protein, 9 aa, Artificial Sequence
  Description of Artificial Sequence: Synthetic peptide
  Seed: RLLILILSI (MAGC1_HUMAN)
RMLILILSW

SEQ ID NO: 69347 - protein, 8 aa, Artificial Sequence
  Description of Artificial Sequence: Synthetic peptide
  Seed: LAMLKNTV (MAGC1_HUMAN)
LMMLKNTL

SEQ ID NO: 69348 - protein, 9 aa, Artificial Sequence
  Description of Artificial Sequence: Synthetic peptide
  Seed: FQSSLQSPV (MAGC1_HUMAN)
FTSSLQSPT

SEQ ID NO: 69349 - protein, 11 aa, Artificial Sequence
  Description of Artificial Sequence: Synthetic peptide
  Seed: RSFSSTLLSIF (MAGC1_HUMAN)
REFSSTLLSIY

SEQ ID NO: 69350 - protein, 10 aa, Artificial Sequence
  Description of Artificial Sequence: Synthetic peptide
  Seed: PLQIPGSPSF (MAGC1_HUMAN)
PMQIPGSPSY

SEQ ID NO: 69351 - protein, 9 aa, Artificial Sequence
  Description of Artificial Sequence: Synthetic peptide
  Seed: FPQSPLQGE (MAGC1_HUMAN)
FPQSPLQGM

SEQ ID NO: 69352 - protein, 10 aa, Artificial Sequence
  Description of Artificial Sequence: Synthetic peptide
  Seed: MPTAGMPSLL (MAGC1_HUMAN)
METAGMPSLF

SEQ ID NO: 69353 - protein, 10 aa, Artificial Sequence
  Description of Artificial Sequence: Synthetic peptide
  Seed: AASSSTLVSI (MAGC1_HUMAN)
AVSSSTLVSW

SEQ ID NO: 69354 - protein, 9 aa, Artificial Sequence
  Description of Artificial Sequence: Synthetic peptide
  Seed: FFSSALLSI (MAGC1_HUMAN)
FMSSALLSS

SEQ ID NO: 69355 - protein, 10 aa, Artificial Sequence
  Description of Artificial Sequence: Synthetic peptide
  Seed: SSPESAQSTF (MAGC1_HUMAN)
SPPESAQSTW

SEQ ID NO: 69356 - protein, 9 aa, Artificial Sequence
  Description of Artificial Sequence: Synthetic peptide
  Seed: FTYTLDEKV (MAGC1_HUMAN)
FSYTLDEKV

SEQ ID NO: 69357 - protein, 10 aa, Artificial Sequence
  Description of Artificial Sequence: Synthetic peptide
  Seed: ASSFFSSALL (MAGC1_HUMAN)
AGSFFSSALF

SEQ ID NO: 69358 - protein, 9 aa, Artificial Sequence
  Description of Artificial Sequence: Synthetic peptide
  Seed: LSPLHFPQF (MAGC1_HUMAN)
LFPLHFPQW

SEQ ID NO: 69359 - protein, 9 aa, Artificial Sequence
  Description of Artificial Sequence: Synthetic peptide
  Seed: RSFSSTLLS (MAGC1_HUMAN)
RAFSSTLLK

SEQ ID NO: 69360 - protein, 9 aa, Artificial Sequence
  Description of Artificial Sequence: Synthetic peptide
  Seed: SSPESDDTL (MAGC1_HUMAN)
SFPESDDTY

SEQ ID NO: 69361 - protein, 10 aa, Artificial Sequence
  Description of Artificial Sequence: Synthetic peptide
  Seed: KGTYASEEVI (MAGC1_HUMAN)
KWTYASEEVF

SEQ ID NO: 69362 - protein, 10 aa, Artificial Sequence
  Description of Artificial Sequence: Synthetic peptide
  Seed: VPITFPSSYK (MAGC1_HUMAN)
VAITFPSSYK

SEQ ID NO: 69363 - protein, 9 aa, Artificial Sequence
  Description of Artificial Sequence: Synthetic peptide
  Seed: SPVDEYTSS (MAGC1_HUMAN)
SPVDEYTSV

SEQ ID NO: 69364 - protein, 9 aa, Artificial Sequence
  Description of Artificial Sequence: Synthetic peptide
  Seed: ISRYTGYFP (MAGC1_HUMAN)
ITRYTGYFK

SEQ ID NO: 69365 - protein, 10 aa, Artificial Sequence
  Description of Artificial Sequence: Synthetic peptide
  Seed: VISFSSSTSL (MAGC1_HUMAN)
VMSFSSSTSV

SEQ ID NO: 69366 - protein, 9 aa, Artificial Sequence
  Description of Artificial Sequence: Synthetic peptide
  Seed: STQSPFEGF (MAGC1_HUMAN)
SWQSPFEGW

SEQ ID NO: 69367 - protein, 9 aa, Artificial Sequence
  Description of Artificial Sequence: Synthetic peptide
  Seed: KVVEFLAML (MAGC1_HUMAN)
KMVEFLAMM

SEQ ID NO: 69368 - protein, 9 aa, Artificial Sequence
  Description of Artificial Sequence: Synthetic peptide
  Seed: YTLASLLQS (MAGC1_HUMAN)
YQLASLLQF

SEQ ID NO: 69369 - protein, 10 aa, Artificial Sequence
  Description of Artificial Sequence: Synthetic peptide
  Seed: EMLTNVISRY (MAGC1_HUMAN)
EALTNVISRY

SEQ ID NO: 69370 - protein, 10 aa, Artificial Sequence
  Description of Artificial Sequence: Synthetic peptide
  Seed: IIDTTDDSTA (MAGC1_HUMAN)
ISDTTDDSTF

SEQ ID NO: 69371 - protein, 10 aa, Artificial Sequence
  Description of Artificial Sequence: Synthetic peptide
  Seed: VSSSSSSSTL (MAGC1_HUMAN)
VISSSSSSTY

SEQ ID NO: 69372 - protein, 10 aa, Artificial Sequence
  Description of Artificial Sequence: Synthetic peptide
  Seed: VSSSSSSTLL (MAGC1_HUMAN)
VMSSSSSTLW

SEQ ID NO: 69373 - protein, 9 aa, Artificial Sequence
  Description of Artificial Sequence: Synthetic peptide
  Seed: KVDELARFL (MAGC1_HUMAN)
KGDELARFF

SEQ ID NO: 69374 - protein, 10 aa, Artificial Sequence
  Description of Artificial Sequence: Synthetic peptide
  Seed: VISFSSSTSL (MAGC1_HUMAN)
VHSFSSSTSM

SEQ ID NO: 69375 - protein, 9 aa, Artificial Sequence
  Description of Artificial Sequence: Synthetic peptide
  Seed: TLVSIFQSS (MAGC1_HUMAN)
TIVSIFQSV

SEQ ID NO: 69376 - protein, 9 aa, Artificial Sequence
  Description of Artificial Sequence: Synthetic peptide
  Seed: SSPERTHST (MAGC1_HUMAN)
SIPERTHSM

SEQ ID NO: 69377 - protein, 9 aa, Artificial Sequence
  Description of Artificial Sequence: Synthetic peptide
  Seed: SQSPPEGPV (MAGC1_HUMAN)
SLSPPEGPV

SEQ ID NO: 69378 - protein, 9 aa, Artificial Sequence
  Description of Artificial Sequence: Synthetic peptide
  Seed: SAQSTFEGF (MAGC1_HUMAN)
SPQSTFEGF

SEQ ID NO: 69379 - protein, 9 aa, Artificial Sequence
  Description of Artificial Sequence: Synthetic peptide
  Seed: SSSTLVSIF (MAGC1_HUMAN)
SISTLVSIW

SEQ ID NO: 69380 - protein, 11 aa, Artificial Sequence
  Description of Artificial Sequence: Synthetic peptide
  Seed: SSFPSSTSSSL (MAGC1_HUMAN)
SVFPSSTSSSV

SEQ ID NO: 69381 - protein, 9 aa, Artificial Sequence
  Description of Artificial Sequence: Synthetic peptide
  Seed: MSQNRLLIL (MAGC1_HUMAN)
MQQNRLLII

SEQ ID NO: 69382 - protein, 10 aa, Artificial Sequence
  Description of Artificial Sequence: Synthetic peptide
  Seed: SLFQSSPERT (MAGC1_HUMAN)
SIFQSSPERI

SEQ ID NO: 69383 - protein, 9 aa, Artificial Sequence
  Description of Artificial Sequence: Synthetic peptide
  Seed: SSPERTQST (MAGC1_HUMAN)
SAPERTQSC

SEQ ID NO: 69384 - protein, 10 aa, Artificial Sequence
  Description of Artificial Sequence: Synthetic peptide
  Seed: QRPVSSFFSY (MAGC1_HUMAN)
QTPVSSFFSF

SEQ ID NO: 69385 - protein, 9 aa, Artificial Sequence
  Description of Artificial Sequence: Synthetic peptide
  Seed: SSSVMSPSF (MAGC1_HUMAN)
SQSVMSPSM

SEQ ID NO: 69386 - protein, 10 aa, Artificial Sequence
  Description of Artificial Sequence: Synthetic peptide
  Seed: ASSFFSSALL (MAGC1_HUMAN)
ADSFFSSALW

SEQ ID NO: 69387 - protein, 9 aa, Artificial Sequence
  Description of Artificial Sequence: Synthetic peptide
  Seed: SSSSTLLSL (MAGC1_HUMAN)
SSSSTLLSV

SEQ ID NO: 69388 - protein, 10 aa, Artificial Sequence
  Description of Artificial Sequence: Synthetic peptide
  Seed: VSICSSSTSL (MAGC1_HUMAN)
VSICSSSTSF

SEQ ID NO: 69389 - protein, 10 aa, Artificial Sequence
  Description of Artificial Sequence: Synthetic peptide
  Seed: FPQSVLQIPV (MAGC1_HUMAN)
FQQSVLQIPL

SEQ ID NO: 69390 - protein, 10 aa, Artificial Sequence
  Description of Artificial Sequence: Synthetic peptide
  Seed: TLDEKVDELA (MAGC1_HUMAN)
TVDEKVDELL

SEQ ID NO: 69391 - protein, 9 aa, Artificial Sequence
  Description of Artificial Sequence: Synthetic peptide
  Seed: SSFPSSTSS (MAGC1_HUMAN)
SIFPSSTSH

SEQ ID NO: 69392 - protein, 9 aa, Artificial Sequence
  Description of Artificial Sequence: Synthetic peptide
  Seed: VPNSSPPRY (MAGC1_HUMAN)
VQNSSPPRY

SEQ ID NO: 69393 - protein, 9 aa, Artificial Sequence
  Description of Artificial Sequence: Synthetic peptide
  Seed: EFIEILFGI (MAGC1_HUMAN)
EVIEILFGV

SEQ ID NO: 69394 - protein, 9 aa, Artificial Sequence
  Description of Artificial Sequence: Synthetic peptide
  Seed: SSPERTQST (MAGC1_HUMAN)
SAPERTQSF

SEQ ID NO: 69395 - protein, 9 aa, Artificial Sequence
  Description of Artificial Sequence: Synthetic peptide
  Seed: MPTAGMPSL (MAGC1_HUMAN)
MATAGMPSY

SEQ ID NO: 69396 - protein, 10 aa, Artificial Sequence
  Description of Artificial Sequence: Synthetic peptide
  Seed: FAQSSLQIPV (MAGC1_HUMAN)
FTQSSLQIPI

SEQ ID NO: 69397 - protein, 9 aa, Artificial Sequence
  Description of Artificial Sequence: Synthetic peptide
  Seed: VSPSSSSTL (MAGC1_HUMAN)
VIPSSSSTI

SEQ ID NO: 69398 - protein, 9 aa, Artificial Sequence
  Description of Artificial Sequence: Synthetic peptide
  Seed: FFSYTLASL (MAGC1_HUMAN)
FISYTLASM

SEQ ID NO: 69399 - protein, 11 aa, Artificial Sequence
  Description of Artificial Sequence: Synthetic peptide
  Seed: IPVSRSFSSTL (MAGC1_HUMAN)
IWVSRSFSSTF

SEQ ID NO: 69400 - protein, 9 aa, Artificial Sequence
  Description of Artificial Sequence: Synthetic peptide
  Seed: VSSSFSYTL (MAGC1_HUMAN)
VHSSFSYTF

SEQ ID NO: 69401 - protein, 9 aa, Artificial Sequence
  Description of Artificial Sequence: Synthetic peptide
  Seed: SSPPRYEFL (MAGC1_HUMAN)
SSPPRYEFV

SEQ ID NO: 69402 - protein, 10 aa, Artificial Sequence
  Description of Artificial Sequence: Synthetic peptide
  Seed: SPLQNPASSF (MAGC1_HUMAN)
SHLQNPASSY

SEQ ID NO: 69403 - protein, 10 aa, Artificial Sequence
  Description of Artificial Sequence: Synthetic peptide
  Seed: SSPPRYEFLW (MAGC1_HUMAN)
SWPPRYEFLL

SEQ ID NO: 69404 - protein, 10 aa, Artificial Sequence
  Description of Artificial Sequence: Synthetic peptide
  Seed: SSPECTQSTF (MAGC1_HUMAN)
SRPECTQSTY

SEQ ID NO: 69405 - protein, 9 aa, Artificial Sequence
  Description of Artificial Sequence: Synthetic peptide
  Seed: MLKNTVPIT (MAGC1_HUMAN)
MLKNTVPII

SEQ ID NO: 69406 - protein, 9 aa, Artificial Sequence
  Description of Artificial Sequence: Synthetic peptide
  Seed: MSQNRLLIL (MAGC1_HUMAN)
MHQNRLLIM

SEQ ID NO: 69407 - protein, 10 aa, Artificial Sequence
  Description of Artificial Sequence: Synthetic peptide
  Seed: YTLASLLQSS (MAGC1_HUMAN)
YLLASLLQSL

SEQ ID NO: 69408 - protein, 9 aa, Artificial Sequence
  Description of Artificial Sequence: Synthetic peptide
  Seed: RAGREHFAF (MAGC1_HUMAN)
RRGREHFAL

SEQ ID NO: 69409 - protein, 9 aa, Artificial Sequence
  Description of Artificial Sequence: Synthetic peptide
  Seed: FSERTQSTF (MAGC1_HUMAN)
FSERTQSTW

SEQ ID NO: 69410 - protein, 9 aa, Artificial Sequence
  Description of Artificial Sequence: Synthetic peptide
  Seed: FSSTLLSIL (MAGC1_HUMAN)
FQSTLLSII

SEQ ID NO: 69411 - protein, 9 aa, Artificial Sequence
  Description of Artificial Sequence: Synthetic peptide
  Seed: NTVPITFPS (MAGC1_HUMAN)
NQVPITFPI

SEQ ID NO: 69412 - protein, 10 aa, Artificial Sequence
  Description of Artificial Sequence: Synthetic peptide
  Seed: FPSSYKDALK (MAGC1_HUMAN)
FSSSYKDALR

SEQ ID NO: 69413 - protein, 10 aa, Artificial Sequence
  Description of Artificial Sequence: Synthetic peptide
  Seed: ESAQSTFEGF (MAGC1_HUMAN)
ESAQSTFEGR

SEQ ID NO: 69414 - protein, 9 aa, Artificial Sequence
  Description of Artificial Sequence: Synthetic peptide
  Seed: SASSSVMSP (MAGC1_HUMAN)
STSSSVMSF

SEQ ID NO: 69415 - protein, 9 aa, Artificial Sequence
  Description of Artificial Sequence: Synthetic peptide
  Seed: NSSPPRYEF (MAGC1_HUMAN)
NQSPPRYEY

SEQ ID NO: 69416 - protein, 10 aa, Artificial Sequence
  Description of Artificial Sequence: Synthetic peptide
  Seed: RTHSTFEGFP (MAGC1_HUMAN)
RTHSTFEGFA

SEQ ID NO: 69417 - protein, 9 aa, Artificial Sequence
  Description of Artificial Sequence: Synthetic peptide
  Seed: STFEGFAQS (MAGC1_HUMAN)
SVFEGFAQV

SEQ ID NO: 69418 - protein, 9 aa, Artificial Sequence
  Description of Artificial Sequence: Synthetic peptide
  Seed: RSFSSTLLS (MAGC1_HUMAN)
RCFSSTLLW

SEQ ID NO: 69419 - protein, 10 aa, Artificial Sequence
  Description of Artificial Sequence: Synthetic peptide
  Seed: SSFSYTLLSL (MAGC1_HUMAN)
SEFSYTLLSM

SEQ ID NO: 69420 - protein, 9 aa, Artificial Sequence
  Description of Artificial Sequence: Synthetic peptide
  Seed: SLSPHYFPQ (MAGC1_HUMAN)
SMSPHYFPR

SEQ ID NO: 69421 - protein, 9 aa, Artificial Sequence
  Description of Artificial Sequence: Synthetic peptide
  Seed: IEILFGISL (MAGC1_HUMAN)
IEILFGISI

SEQ ID NO: 69422 - protein, 9 aa, Artificial Sequence
  Description of Artificial Sequence: Synthetic peptide
  Seed: SPLQIVPSL (MAGC1_HUMAN)
SPLQIVPSA

SEQ ID NO: 69423 - protein, 9 aa, Artificial Sequence
  Description of Artificial Sequence: Synthetic peptide
  Seed: LSPLHFPQF (MAGC1_HUMAN)
LSPLHFPQW

SEQ ID NO: 69424 - protein, 9 aa, Artificial Sequence
  Description of Artificial Sequence: Synthetic peptide
  Seed: LQIPVSRSF (MAGC1_HUMAN)
LNIPVSRSW

SEQ ID NO: 69425 - protein, 10 aa, Artificial Sequence
  Description of Artificial Sequence: Synthetic peptide
  Seed: WGPRAHSEVI (MAGC1_HUMAN)
WWPRAHSEVF

SEQ ID NO: 69426 - protein, 9 aa, Artificial Sequence
  Description of Artificial Sequence: Synthetic peptide
  Seed: QVKQPITKA (MAGC1_HUMAN)
QVKQPITKR

SEQ ID NO: 69427 - protein, 9 aa, Artificial Sequence
  Description of Artificial Sequence: Synthetic peptide
  Seed: LQIPVSPSF (MAGC1_HUMAN)
LPIPVSPSM

SEQ ID NO: 69428 - protein, 10 aa, Artificial Sequence
  Description of Artificial Sequence: Synthetic peptide
  Seed: KVVEFLAMLK (MAGC1_HUMAN)
KKVEFLAMLK

SEQ ID NO: 69429 - protein, 9 aa, Artificial Sequence
  Description of Artificial Sequence: Synthetic peptide
  Seed: SSPECTQST (MAGC1_HUMAN)
SIPECTQSM

SEQ ID NO: 69430 - protein, 10 aa, Artificial Sequence
  Description of Artificial Sequence: Synthetic peptide
  Seed: VSSSSSSTLL (MAGC1_HUMAN)
VPSSSSSTLY

SEQ ID NO: 69431 - protein, 11 aa, Artificial Sequence
  Description of Artificial Sequence: Synthetic peptide
  Seed: LQIPVSSSFSY (MAGC1_HUMAN)
LAIPVSSSFSM

SEQ ID NO: 69432 - protein, 9 aa, Artificial Sequence
  Description of Artificial Sequence: Synthetic peptide
  Seed: SSPERTHST (MAGC1_HUMAN)
SMPERTHSL

SEQ ID NO: 69433 - protein, 9 aa, Artificial Sequence
  Description of Artificial Sequence: Synthetic peptide
  Seed: SLFQSFSER (MAGC1_HUMAN)
SIFQSFSEM

SEQ ID NO: 69434 - protein, 9 aa, Artificial Sequence
  Description of Artificial Sequence: Synthetic peptide
  Seed: VPNSSPPRY (MAGC1_HUMAN)
VANSSPPRM

SEQ ID NO: 69435 - protein, 9 aa, Artificial Sequence
  Description of Artificial Sequence: Synthetic peptide
  Seed: LQIPGSPSF (MAGC1_HUMAN)
LMIPGSPSI

SEQ ID NO: 69436 - protein, 9 aa, Artificial Sequence
  Description of Artificial Sequence: Synthetic peptide
  Seed: LQSPVISFS (MAGC1_HUMAN)
LISPVISFM

SEQ ID NO: 69437 - protein, 10 aa, Artificial Sequence
  Description of Artificial Sequence: Synthetic peptide
  Seed: REFIEILFGI (MAGC1_HUMAN)
RIFIEILFGI

SEQ ID NO: 69438 - protein, 9 aa, Artificial Sequence
  Description of Artificial Sequence: Synthetic peptide
  Seed: KVDELARFL (MAGC1_HUMAN)
KYDELARFV

SEQ ID NO: 69439 - protein, 11 aa, Artificial Sequence
  Description of Artificial Sequence: Synthetic peptide
  Seed: IIDTTDDSTAT (MAGC1_HUMAN)
IIDTTDDSTAI

SEQ ID NO: 69440 - protein, 8 aa, Artificial Sequence
  Description of Artificial Sequence: Synthetic peptide
  Seed: KVDELARF (MAGC1_HUMAN)
KADELARI

SEQ ID NO: 69441 - protein, 9 aa, Artificial Sequence
  Description of Artificial Sequence: Synthetic peptide
  Seed: FSEESSSPV (MAGC1_HUMAN)
FSEESSSPI

SEQ ID NO: 69442 - protein, 10 aa, Artificial Sequence
  Description of Artificial Sequence: Synthetic peptide
  Seed: SPLQSPVSSF (MAGC1_HUMAN)
SSLQSPVSSY

SEQ ID NO: 69443 - protein, 9 aa, Artificial Sequence
  Description of Artificial Sequence: Synthetic peptide
  Seed: WEDSLSPHY (MAGC1_HUMAN)
WADSLSPHY

SEQ ID NO: 69444 - protein, 10 aa, Artificial Sequence
  Description of Artificial Sequence: Synthetic peptide
  Seed: AASSSTLVSI (MAGC1_HUMAN)
ALSSSTLVSF

SEQ ID NO: 69445 - protein, 9 aa, Artificial Sequence
  Description of Artificial Sequence: Synthetic peptide
  Seed: VSPSSSSTL (MAGC1_HUMAN)
VMPSSSSTF

SEQ ID NO: 69446 - protein, 10 aa, Artificial Sequence
  Description of Artificial Sequence: Synthetic peptide
  Seed: ICSSSTPSSL (MAGC1_HUMAN)
IWSSSTPSSW

SEQ ID NO: 69447 - protein, 10 aa, Artificial Sequence
  Description of Artificial Sequence: Synthetic peptide
  Seed: IEILFGISLR (MAGC1_HUMAN)
IQILFGISLR

SEQ ID NO: 69448 - protein, 9 aa, Artificial Sequence
  Description of Artificial Sequence: Synthetic peptide
  Seed: SQSPPEGPV (MAGC1_HUMAN)
SMSPPEGPY

SEQ ID NO: 69449 - protein, 10 aa, Artificial Sequence
  Description of Artificial Sequence: Synthetic peptide
  Seed: ICSSSTSLSL (MAGC1_HUMAN)
ISSSSTSLSL

SEQ ID NO: 69450 - protein, 9 aa, Artificial Sequence
  Description of Artificial Sequence: Synthetic peptide
  Seed: TLDEKVDEL (MAGC1_HUMAN)
TTDEKVDEW

SEQ ID NO: 69451 - protein, 9 aa, Artificial Sequence
  Description of Artificial Sequence: Synthetic peptide
  Seed: RLLILILSI (MAGC1_HUMAN)
RNLILILSY

SEQ ID NO: 69452 - protein, 11 aa, Artificial Sequence
  Description of Artificial Sequence: Synthetic peptide
  Seed: SICSSSTSLSL (MAGC1_HUMAN)
SVCSSSTSLSY

SEQ ID NO: 69453 - protein, 9 aa, Artificial Sequence
  Description of Artificial Sequence: Synthetic peptide
  Seed: FQSSLQSPV (MAGC1_HUMAN)
FPSSLQSPL

SEQ ID NO: 69454 - protein, 9 aa, Artificial Sequence
  Description of Artificial Sequence: Synthetic peptide
  Seed: VSSSFSYTL (MAGC1_HUMAN)
VYSSFSYTF

SEQ ID NO: 69455 - protein, 9 aa, Artificial Sequence
  Description of Artificial Sequence: Synthetic peptide
  Seed: ISFSSSTSL (MAGC1_HUMAN)
IVFSSSTSL

SEQ ID NO: 69456 - protein, 10 aa, Artificial Sequence
  Description of Artificial Sequence: Synthetic peptide
  Seed: SFSERTQSTF (MAGC1_HUMAN)
SYSERTQSTF

SEQ ID NO: 69457 - protein, 10 aa, Artificial Sequence
  Description of Artificial Sequence: Synthetic peptide
  Seed: YQVKQPITKA (MAGC1_HUMAN)
YVVKQPITKV

SEQ ID NO: 69458 - protein, 10 aa, Artificial Sequence
  Description of Artificial Sequence: Synthetic peptide
  Seed: ASSSVMSPSF (MAGC1_HUMAN)
ALSSVMSPSY

SEQ ID NO: 69459 - protein, 10 aa, Artificial Sequence
  Description of Artificial Sequence: Synthetic peptide
  Seed: TGYFPVIFRK (MAGC1_HUMAN)
TAYFPVIFRI

SEQ ID NO: 69460 - protein, 9 aa, Artificial Sequence
  Description of Artificial Sequence: Synthetic peptide
  Seed: VSPSSSSTL (MAGC1_HUMAN)
VLPSSSSTF

SEQ ID NO: 69461 - protein, 9 aa, Artificial Sequence
  Description of Artificial Sequence: Synthetic peptide
  Seed: FSSTLLSLF (MAGC1_HUMAN)
FKSTLLSLM

SEQ ID NO: 69462 - protein, 9 aa, Artificial Sequence
  Description of Artificial Sequence: Synthetic peptide
  Seed: SSSSTLLSL (MAGC1_HUMAN)
SQSSTLLSM

SEQ ID NO: 69463 - protein, 10 aa, Artificial Sequence
  Description of Artificial Sequence: Synthetic peptide
  Seed: RSFSSTLLSI (MAGC1_HUMAN)
RYFSSTLLSL

SEQ ID NO: 69464 - protein, 9 aa, Artificial Sequence
  Description of Artificial Sequence: Synthetic peptide
  Seed: LQNPASSFF (MAGC1_HUMAN)
LHNPASSFM

SEQ ID NO: 69465 - protein, 9 aa, Artificial Sequence
  Description of Artificial Sequence: Synthetic peptide
  Seed: SSPECTQST (MAGC1_HUMAN)
SMPECTQSV

SEQ ID NO: 69466 - protein, 9 aa, Artificial Sequence
  Description of Artificial Sequence: Synthetic peptide
  Seed: VSPSSSSTL (MAGC1_HUMAN)
VFPSSSSTI

SEQ ID NO: 69467 - protein, 9 aa, Artificial Sequence
  Description of Artificial Sequence: Synthetic peptide
  Seed: FSYTLASLL (MAGC1_HUMAN)
FAYTLASLW

SEQ ID NO: 69468 - protein, 10 aa, Artificial Sequence
  Description of Artificial Sequence: Synthetic peptide
  Seed: RTHSTFEGFP (MAGC1_HUMAN)
RSHSTFEGFA

SEQ ID NO: 69469 - protein, 11 aa, Artificial Sequence
  Description of Artificial Sequence: Synthetic peptide
  Seed: STFEGFPQSLL (MAGC1_HUMAN)
SLFEGFPQSLN

SEQ ID NO: 69470 - protein, 9 aa, Artificial Sequence
  Description of Artificial Sequence: Synthetic peptide
  Seed: VSPSFSSTL (MAGC1_HUMAN)
VCPSFSSTM

SEQ ID NO: 69471 - protein, 9 aa, Artificial Sequence
  Description of Artificial Sequence: Synthetic peptide
  Seed: SSSTSLSPF (MAGC1_HUMAN)
SESTSLSPF

SEQ ID NO: 69472 - protein, 10 aa, Artificial Sequence
  Description of Artificial Sequence: Synthetic peptide
  Seed: ATESASSSVM (MAGC1_HUMAN)
AEESASSSVF

SEQ ID NO: 69473 - protein, 9 aa, Artificial Sequence
  Description of Artificial Sequence: Synthetic peptide
  Seed: GEDSLSPHY (MAGC1_HUMAN)
GEDSLSPHI

SEQ ID NO: 69474 - protein, 9 aa, Artificial Sequence
  Description of Artificial Sequence: Synthetic peptide
  Seed: VQSPLQNPA (MAGC1_HUMAN)
VASPLQNPY

SEQ ID NO: 69475 - protein, 9 aa, Artificial Sequence
  Description of Artificial Sequence: Synthetic peptide
  Seed: WGPRAHSEV (MAGC1_HUMAN)
WAPRAHSEM

SEQ ID NO: 69476 - protein, 9 aa, Artificial Sequence
  Description of Artificial Sequence: Synthetic peptide
  Seed: MTSSFSSTL (MAGC1_HUMAN)
MVSSFSSTY

SEQ ID NO: 69477 - protein, 9 aa, Artificial Sequence
  Description of Artificial Sequence: Synthetic peptide
  Seed: RTQSTFEGF (MAGC1_HUMAN)
RAQSTFEGK

SEQ ID NO: 69478 - protein, 10 aa, Artificial Sequence
  Description of Artificial Sequence: Synthetic peptide
  Seed: SPQSPPEGPA (MAGC1_HUMAN)
SPQSPPEGPI

SEQ ID NO: 69479 - protein, 9 aa, Artificial Sequence
  Description of Artificial Sequence: Synthetic peptide
  Seed: SSPESTQSP (MAGC1_HUMAN)
SGPESTQSM

SEQ ID NO: 69480 - protein, 10 aa, Artificial Sequence
  Description of Artificial Sequence: Synthetic peptide
  Seed: YTLLSLFQSS (MAGC1_HUMAN)
YNLLSLFQSL

SEQ ID NO: 69481 - protein, 9 aa, Artificial Sequence
  Description of Artificial Sequence: Synthetic peptide
  Seed: FQSSPERTH (MAGC1_HUMAN)
FLSSPERTF

SEQ ID NO: 69482 - protein, 11 aa, Artificial Sequence
  Description of Artificial Sequence: Synthetic peptide
  Seed: LQIPGSPSFSS (MAGC1_HUMAN)
LKIPGSPSFSY

SEQ ID NO: 69483 - protein, 10 aa, Artificial Sequence
  Description of Artificial Sequence: Synthetic peptide
  Seed: SSPESAQSAF (MAGC1_HUMAN)
SMPESAQSAY

SEQ ID NO: 69484 - protein, 10 aa, Artificial Sequence
  Description of Artificial Sequence: Synthetic peptide
  Seed: SFFSYTLASL (MAGC1_HUMAN)
SYFSYTLASI

SEQ ID NO: 69485 - protein, 10 aa, Artificial Sequence
  Description of Artificial Sequence: Synthetic peptide
  Seed: YASEEVIWDV (MAGC1_HUMAN)
YMSEEVIWDL

SEQ ID NO: 69486 - protein, 9 aa, Artificial Sequence
  Description of Artificial Sequence: Synthetic peptide
  Seed: RAHSEVIKR (MAGC1_HUMAN)
RLHSEVIKF

SEQ ID NO: 69487 - protein, 9 aa, Artificial Sequence
  Description of Artificial Sequence: Synthetic peptide
  Seed: TLDEKVDEL (MAGC1_HUMAN)
TADEKVDEC

SEQ ID NO: 69488 - protein, 9 aa, Artificial Sequence
  Description of Artificial Sequence: Synthetic peptide
  Seed: WVQEHYLEY (MAGC1_HUMAN)
WAQEHYLEF

SEQ ID NO: 69489 - protein, 9 aa, Artificial Sequence
  Description of Artificial Sequence: Synthetic peptide
  Seed: FSEESSSPV (MAGC1_HUMAN)
FIEESSSPM

SEQ ID NO: 69490 - protein, 9 aa, Artificial Sequence
  Description of Artificial Sequence: Synthetic peptide
  Seed: YTLASLLQS (MAGC1_HUMAN)
YVLASLLQM

SEQ ID NO: 69491 - protein, 9 aa, Artificial Sequence
  Description of Artificial Sequence: Synthetic peptide
  Seed: SSSVMSPSF (MAGC1_HUMAN)
SISVMSPSY

SEQ ID NO: 69492 - protein, 9 aa, Artificial Sequence
  Description of Artificial Sequence: Synthetic peptide
  Seed: FFSSALLSI (MAGC1_HUMAN)
FSSSALLSI

SEQ ID NO: 69493 - protein, 9 aa, Artificial Sequence
  Description of Artificial Sequence: Synthetic peptide
  Seed: FSYTLASLL (MAGC1_HUMAN)
FYYTLASLV

SEQ ID NO: 69494 - protein, 9 aa, Artificial Sequence
  Description of Artificial Sequence: Synthetic peptide
  Seed: VSAASSSTL (MAGC1_HUMAN)
VYAASSSTM

SEQ ID NO: 69495 - protein, 10 aa, Artificial Sequence
  Description of Artificial Sequence: Synthetic peptide
  Seed: KVVEFLAMLK (MAGC1_HUMAN)
KSVEFLAMLR

SEQ ID NO: 69496 - protein, 11 aa, Artificial Sequence
  Description of Artificial Sequence: Synthetic peptide
  Seed: SSFSSTLLSIF (MAGC1_HUMAN)
STFSSTLLSIY

SEQ ID NO: 69497 - protein, 10 aa, Artificial Sequence
  Description of Artificial Sequence: Synthetic peptide
  Seed: MTSSFSSTLL (MAGC1_HUMAN)
MSSSFSSTLY

SEQ ID NO: 69498 - protein, 9 aa, Artificial Sequence
  Description of Artificial Sequence: Synthetic peptide
  Seed: CSSSTSLSL (MAGC1_HUMAN)
CLSSTSLSY

SEQ ID NO: 69499 - protein, 11 aa, Artificial Sequence
  Description of Artificial Sequence: Synthetic peptide
  Seed: LQIPVSSSFSY (MAGC1_HUMAN)
LGIPVSSSFSM

SEQ ID NO: 69500 - protein, 10 aa, Artificial Sequence
  Description of Artificial Sequence: Synthetic peptide
  Seed: KAREFIEILF (MAGC1_HUMAN)
KVREFIEILM

SEQ ID NO: 69501 - protein, 10 aa, Artificial Sequence
  Description of Artificial Sequence: Synthetic peptide
  Seed: SFSYTLLSLF (MAGC1_HUMAN)
SCSYTLLSLY

SEQ ID NO: 69502 - protein, 9 aa, Artificial Sequence
  Description of Artificial Sequence: Synthetic peptide
  Seed: SSSTSLSPF (MAGC1_HUMAN)
SHSTSLSPM

SEQ ID NO: 69503 - protein, 10 aa, Artificial Sequence
  Description of Artificial Sequence: Synthetic peptide
  Seed: WGPRAHSEVI (MAGC1_HUMAN)
WLPRAHSEVI

SEQ ID NO: 69504 - protein, 11 aa, Artificial Sequence
  Description of Artificial Sequence: Synthetic peptide
  Seed: RYTGYFPVIFR (MAGC1_HUMAN)
RNTGYFPVIFR

SEQ ID NO: 69505 - protein, 9 aa, Artificial Sequence
  Description of Artificial Sequence: Synthetic peptide
  Seed: FTYTLDEKV (MAGC1_HUMAN)
FVYTLDEKM

SEQ ID NO: 69506 - protein, 9 aa, Artificial Sequence
  Description of Artificial Sequence: Synthetic peptide
  Seed: SSSTLVSIF (MAGC1_HUMAN)
SKSTLVSIL

SEQ ID NO: 69507 - protein, 10 aa, Artificial Sequence
  Description of Artificial Sequence: Synthetic peptide
  Seed: SPLYFPQSPL (MAGC1_HUMAN)
SYLYFPQSPL

SEQ ID NO: 69508 - protein, 9 aa, Artificial Sequence
  Description of Artificial Sequence: Synthetic peptide
  Seed: SLSPFSEES (MAGC1_HUMAN)
SQSPFSEEA

SEQ ID NO: 69509 - protein, 9 aa, Artificial Sequence
  Description of Artificial Sequence: Synthetic peptide
  Seed: SEESSSPVD (MAGC1_HUMAN)
SEESSSPVI

SEQ ID NO: 69510 - protein, 10 aa, Artificial Sequence
  Description of Artificial Sequence: Synthetic peptide
  Seed: SSPPRYEFLW (MAGC1_HUMAN)
SYPPRYEFLY

SEQ ID NO: 69511 - protein, 9 aa, Artificial Sequence
  Description of Artificial Sequence: Synthetic peptide
  Seed: SAASSSTLV (MAGC1_HUMAN)
SMASSSTLY

SEQ ID NO: 69512 - protein, 10 aa, Artificial Sequence
  Description of Artificial Sequence: Synthetic peptide
  Seed: TGYFPVIFRK (MAGC1_HUMAN)
TTYFPVIFRE

SEQ ID NO: 69513 - protein, 10 aa, Artificial Sequence
  Description of Artificial Sequence: Synthetic peptide
  Seed: SPLYFPQSPL (MAGC1_HUMAN)
SKLYFPQSPV

SEQ ID NO: 69514 - protein, 10 aa, Artificial Sequence
  Description of Artificial Sequence: Synthetic peptide
  Seed: WVQEHYLEYR (MAGC1_HUMAN)
WLQEHYLEYR

SEQ ID NO: 69515 - protein, 9 aa, Artificial Sequence
  Description of Artificial Sequence: Synthetic peptide
  Seed: KVVEFLAML (MAGC1_HUMAN)
KTVEFLAMR

SEQ ID NO: 69516 - protein, 10 aa, Artificial Sequence
  Description of Artificial Sequence: Synthetic peptide
  Seed: RYTGYFPVIF (MAGC1_HUMAN)
RQTGYFPVIM

SEQ ID NO: 69517 - protein, 9 aa, Artificial Sequence
  Description of Artificial Sequence: Synthetic peptide
  Seed: SEPLFTYTL (MAGC1_HUMAN)
SEPLFTYTA

SEQ ID NO: 69518 - protein, 9 aa, Artificial Sequence
  Description of Artificial Sequence: Synthetic peptide
  Seed: TLLSIFQSS (MAGC1_HUMAN)
TILSIFQSA

SEQ ID NO: 69519 - protein, 9 aa, Artificial Sequence
  Description of Artificial Sequence: Synthetic peptide
  Seed: SAPEGEDSL (MAGC1_HUMAN)
SHPEGEDSI

SEQ ID NO: 69520 - protein, 9 aa, Artificial Sequence
  Description of Artificial Sequence: Synthetic peptide
  Seed: SSSSSSSTL (MAGC1_HUMAN)
SVSSSSSTF

SEQ ID NO: 69521 - protein, 10 aa, Artificial Sequence
  Description of Artificial Sequence: Synthetic peptide
  Seed: LTKVWVQEHY (MAGC1_HUMAN)
LMKVWVQEHW

SEQ ID NO: 69522 - protein, 11 aa, Artificial Sequence
  Description of Artificial Sequence: Synthetic peptide
  Seed: IPVSPSSSSTL (MAGC1_HUMAN)
IAVSPSSSSTM

SEQ ID NO: 69523 - protein, 9 aa, Artificial Sequence
  Description of Artificial Sequence: Synthetic peptide
  Seed: SSFSYTLLS (MAGC1_HUMAN)
SQFSYTLLK

SEQ ID NO: 69524 - protein, 10 aa, Artificial Sequence
  Description of Artificial Sequence: Synthetic peptide
  Seed: SSFPSSTSSS (MAGC1_HUMAN)
SQFPSSTSSF

SEQ ID NO: 69525 - protein, 9 aa, Artificial Sequence
  Description of Artificial Sequence: Synthetic peptide
  Seed: SGIGVRAGR (MAGC1_HUMAN)
SFIGVRAGK

SEQ ID NO: 69526 - protein, 11 aa, Artificial Sequence
  Description of Artificial Sequence: Synthetic peptide
  Seed: LPQSFPESPQS (MAGC1_HUMAN)
LPQSFPESPQA

SEQ ID NO: 69527 - protein, 9 aa, Artificial Sequence
  Description of Artificial Sequence: Synthetic peptide
  Seed: FSYTLASLL (MAGC1_HUMAN)
FQYTLASLW

SEQ ID NO: 69528 - protein, 10 aa, Artificial Sequence
  Description of Artificial Sequence: Synthetic peptide
  Seed: FPQSPLQIPV (MAGC1_HUMAN)
FYQSPLQIPL

SEQ ID NO: 69529 - protein, 11 aa, Artificial Sequence
  Description of Artificial Sequence: Synthetic peptide
  Seed: IPVSSSFSYTL (MAGC1_HUMAN)
INVSSSFSYTW

SEQ ID NO: 69530 - protein, 10 aa, Artificial Sequence
  Description of Artificial Sequence: Synthetic peptide
  Seed: RAGREHFAFG (MAGC1_HUMAN)
RCGREHFAFV

SEQ ID NO: 69531 - protein, 10 aa, Artificial Sequence
  Description of Artificial Sequence: Synthetic peptide
  Seed: STPSSLPQSF (MAGC1_HUMAN)
SFPSSLPQSF

SEQ ID NO: 69532 - protein, 9 aa, Artificial Sequence
  Description of Artificial Sequence: Synthetic peptide
  Seed: KAEMLTNVI (MAGC1_HUMAN)
KSEMLTNVF

SEQ ID NO: 69533 - protein, 9 aa, Artificial Sequence
  Description of Artificial Sequence: Synthetic peptide
  Seed: LQNPASSFF (MAGC1_HUMAN)
LTNPASSFL

SEQ ID NO: 69534 - protein, 9 aa, Artificial Sequence
  Description of Artificial Sequence: Synthetic peptide
  Seed: SSSTSLSPF (MAGC1_HUMAN)
SLSTSLSPY

SEQ ID NO: 69535 - protein, 10 aa, Artificial Sequence
  Description of Artificial Sequence: Synthetic peptide
  Seed: LQIPMTSSFS (MAGC1_HUMAN)
LMIPMTSSFA

SEQ ID NO: 69536 - protein, 9 aa, Artificial Sequence
  Description of Artificial Sequence: Synthetic peptide
  Seed: FSSTLLSLF (MAGC1_HUMAN)
FMSTLLSLL

SEQ ID NO: 69537 - protein, 9 aa, Artificial Sequence
  Description of Artificial Sequence: Synthetic peptide
  Seed: AGREHFAFG (MAGC1_HUMAN)
AAREHFAFR

SEQ ID NO: 69538 - protein, 9 aa, Artificial Sequence
  Description of Artificial Sequence: Synthetic peptide
  Seed: SLPEWEDSL (MAGC1_HUMAN)
SVPEWEDSV

SEQ ID NO: 69539 - protein, 9 aa, Artificial Sequence
  Description of Artificial Sequence: Synthetic peptide
  Seed: WVQEHYLEY (MAGC1_HUMAN)
WSQEHYLEL

SEQ ID NO: 69540 - protein, 9 aa, Artificial Sequence
  Description of Artificial Sequence: Synthetic peptide
  Seed: RKAREFIEI (MAGC1_HUMAN)
RRAREFIEY

SEQ ID NO: 69541 - protein, 11 aa, Artificial Sequence
  Description of Artificial Sequence: Synthetic peptide
  Seed: SICSSSTSLSL (MAGC1_HUMAN)
SICSSSTSLSW

SEQ ID NO: 69542 - protein, 10 aa, Artificial Sequence
  Description of Artificial Sequence: Synthetic peptide
  Seed: SYVFVNTLDL (MAGC1_HUMAN)
SYVFVNTLDF

SEQ ID NO: 69543 - protein, 11 aa, Artificial Sequence
  Description of Artificial Sequence: Synthetic peptide
  Seed: VSSSSSSSTLL (MAGC1_HUMAN)
VSSSSSSSTLF

SEQ ID NO: 69544 - protein, 10 aa, Artificial Sequence
  Description of Artificial Sequence: Synthetic peptide
  Seed: EVIWDVLSGI (MAGC1_HUMAN)
ESIWDVLSGR

SEQ ID NO: 69545 - protein, 10 aa, Artificial Sequence
  Description of Artificial Sequence: Synthetic peptide
  Seed: NTVPITFPSS (MAGC1_HUMAN)
NAVPITFPSL

SEQ ID NO: 69546 - protein, 10 aa, Artificial Sequence
  Description of Artificial Sequence: Synthetic peptide
  Seed: LQIPVSSSFS (MAGC1_HUMAN)
LMIPVSSSFL

SEQ ID NO: 69547 - protein, 9 aa, Artificial Sequence
  Description of Artificial Sequence: Synthetic peptide
  Seed: LQIPVSAAS (MAGC1_HUMAN)
LAIPVSAAV

SEQ ID NO: 69548 - protein, 10 aa, Artificial Sequence
  Description of Artificial Sequence: Synthetic peptide
  Seed: RSFSSTLLSI (MAGC1_HUMAN)
RTFSSTLLSV

SEQ ID NO: 69549 - protein, 9 aa, Artificial Sequence
  Description of Artificial Sequence: Synthetic peptide
  Seed: KVVEFLAML (MAGC1_HUMAN)
KGVEFLAMY

SEQ ID NO: 69550 - protein, 10 aa, Artificial Sequence
  Description of Artificial Sequence: Synthetic peptide
  Seed: PLQIPVSRSF (MAGC1_HUMAN)
PFQIPVSRSF

SEQ ID NO: 69551 - protein, 9 aa, Artificial Sequence
  Description of Artificial Sequence: Synthetic peptide
  Seed: VSSFFSYTL (MAGC1_HUMAN)
VQSFFSYTW

SEQ ID NO: 69552 - protein, 9 aa, Artificial Sequence
  Description of Artificial Sequence: Synthetic peptide
  Seed: FFSSALLSI (MAGC1_HUMAN)
FGSSALLSI

SEQ ID NO: 69553 - protein, 10 aa, Artificial Sequence
  Description of Artificial Sequence: Synthetic peptide
  Seed: MSPLYFPQSP (MAGC1_HUMAN)
MEPLYFPQSV

SEQ ID NO: 69554 - protein, 11 aa, Artificial Sequence
  Description of Artificial Sequence: Synthetic peptide
  Seed: SSSSSTLLSLF (MAGC1_HUMAN)
STSSSTLLSLW

SEQ ID NO: 69555 - protein, 9 aa, Artificial Sequence
  Description of Artificial Sequence: Synthetic peptide
  Seed: VSAASSSTL (MAGC1_HUMAN)
VYAASSSTV

SEQ ID NO: 69556 - protein, 10 aa, Artificial Sequence
  Description of Artificial Sequence: Synthetic peptide
  Seed: VSSSFSYTLL (MAGC1_HUMAN)
VPSSFSYTLY

SEQ ID NO: 69557 - protein, 9 aa, Artificial Sequence
  Description of Artificial Sequence: Synthetic peptide
  Seed: VIFRKAREF (MAGC1_HUMAN)
VEFRKAREY

SEQ ID NO: 69558 - protein, 9 aa, Artificial Sequence
  Description of Artificial Sequence: Synthetic peptide
  Seed: EDSSDPLQR (MAGC1_HUMAN)
EFSSDPLQR

SEQ ID NO: 69559 - protein, 9 aa, Artificial Sequence
  Description of Artificial Sequence: Synthetic peptide
  Seed: RKAREFIEI (MAGC1_HUMAN)
RIAREFIEF

SEQ ID NO: 69560 - protein, 9 aa, Artificial Sequence
  Description of Artificial Sequence: Synthetic peptide
  Seed: SRYTGYFPV (MAGC1_HUMAN)
SMYTGYFPH

SEQ ID NO: 69561 - protein, 10 aa, Artificial Sequence
  Description of Artificial Sequence: Synthetic peptide
  Seed: SFFSSALLSI (MAGC1_HUMAN)
SYFSSALLSF

SEQ ID NO: 69562 - protein, 10 aa, Artificial Sequence
  Description of Artificial Sequence: Synthetic peptide
  Seed: SSPESTQSPF (MAGC1_HUMAN)
SCPESTQSPL

SEQ ID NO: 69563 - protein, 9 aa, Artificial Sequence
  Description of Artificial Sequence: Synthetic peptide
  Seed: VSAASSSTL (MAGC1_HUMAN)
VLAASSSTI

SEQ ID NO: 69564 - protein, 9 aa, Artificial Sequence
  Description of Artificial Sequence: Synthetic peptide
  Seed: LKYQVKQPI (MAGC1_HUMAN)
LQYQVKQPM

SEQ ID NO: 69565 - protein, 9 aa, Artificial Sequence
  Description of Artificial Sequence: Synthetic peptide
  Seed: TFEGFPQSL (MAGC1_HUMAN)
TLEGFPQSF

SEQ ID NO: 69566 - protein, 9 aa, Artificial Sequence
  Description of Artificial Sequence: Synthetic peptide
  Seed: SAQSAFEGF (MAGC1_HUMAN)
SPQSAFEGW

SEQ ID NO: 69567 - protein, 9 aa, Artificial Sequence
  Description of Artificial Sequence: Synthetic peptide
  Seed: SSPERTQST (MAGC1_HUMAN)
SCPERTQSM

SEQ ID NO: 69568 - protein, 11 aa, Artificial Sequence
  Description of Artificial Sequence: Synthetic peptide
  Seed: STFEGFAQSSL (MAGC1_HUMAN)
STFEGFAQSSM

SEQ ID NO: 69569 - protein, 9 aa, Artificial Sequence
  Description of Artificial Sequence: Synthetic peptide
  Seed: LQSPVISFS (MAGC1_HUMAN)
LASPVISFM

SEQ ID NO: 69570 - protein, 10 aa, Artificial Sequence
  Description of Artificial Sequence: Synthetic peptide
  Seed: SSFSSTLLSI (MAGC1_HUMAN)
SVFSSTLLSM

SEQ ID NO: 69571 - protein, 9 aa, Artificial Sequence
  Description of Artificial Sequence: Synthetic peptide
  Seed: YVFVNTLDL (MAGC1_HUMAN)
YTFVNTLDF

SEQ ID NO: 69572 - protein, 10 aa, Artificial Sequence
  Description of Artificial Sequence: Synthetic peptide
  Seed: SFPSSTSSSL (MAGC1_HUMAN)
SRPSSTSSSI

SEQ ID NO: 69573 - protein, 9 aa, Artificial Sequence
  Description of Artificial Sequence: Synthetic peptide
  Seed: TLLSILQSS (MAGC1_HUMAN)
TSLSILQSL

SEQ ID NO: 69574 - protein, 11 aa, Artificial Sequence
  Description of Artificial Sequence: Synthetic peptide
  Seed: IPVSSSSSSTL (MAGC1_HUMAN)
IAVSSSSSSTL

SEQ ID NO: 69575 - protein, 9 aa, Artificial Sequence
  Description of Artificial Sequence: Synthetic peptide
  Seed: FSYTLLSLF (MAGC1_HUMAN)
FQYTLLSLH

SEQ ID NO: 69576 - protein, 11 aa, Artificial Sequence
  Description of Artificial Sequence: Synthetic peptide
  Seed: IPVSRSFSSTL (MAGC1_HUMAN)
IHVSRSFSSTY

SEQ ID NO: 69577 - protein, 8 aa, Artificial Sequence
  Description of Artificial Sequence: Synthetic peptide
  Seed: QIPMTSSF (MAGC1_HUMAN)
QMPMTSSF

SEQ ID NO: 69578 - protein, 8 aa, Artificial Sequence
  Description of Artificial Sequence: Synthetic peptide
  Seed: SSSTSLSL (MAGC1_HUMAN)
SASTSLSM

SEQ ID NO: 69579 - protein, 9 aa, Artificial Sequence
  Description of Artificial Sequence: Synthetic peptide
  Seed: LQIPVSSSS (MAGC1_HUMAN)
LSIPVSSSL

SEQ ID NO: 69580 - protein, 9 aa, Artificial Sequence
  Description of Artificial Sequence: Synthetic peptide
  Seed: VSPSSSSTL (MAGC1_HUMAN)
VYPSSSSTW

SEQ ID NO: 69581 - protein, 9 aa, Artificial Sequence
  Description of Artificial Sequence: Synthetic peptide
  Seed: TTDDSTATE (MAGC1_HUMAN)
TYDDSTATF

SEQ ID NO: 69582 - protein, 10 aa, Artificial Sequence
  Description of Artificial Sequence: Synthetic peptide
  Seed: FAFGEPRELL (MAGC1_HUMAN)
FSFGEPRELV

SEQ ID NO: 69583 - protein, 10 aa, Artificial Sequence
  Description of Artificial Sequence: Synthetic peptide
  Seed: MPTAGMPSLL (MAGC1_HUMAN)
MWTAGMPSLA

SEQ ID NO: 69584 - protein, 9 aa, Artificial Sequence
  Description of Artificial Sequence: Synthetic peptide
  Seed: SPLQSPVIS (MAGC1_HUMAN)
SPLQSPVIT

SEQ ID NO: 69585 - protein, 9 aa, Artificial Sequence
  Description of Artificial Sequence: Synthetic peptide
  Seed: IESEPLFTY (MAGC1_HUMAN)
IGSEPLFTL

SEQ ID NO: 69586 - protein, 9 aa, Artificial Sequence
  Description of Artificial Sequence: Synthetic peptide
  Seed: EFIEILFGI (MAGC1_HUMAN)
EVIEILFGS

SEQ ID NO: 69587 - protein, 11 aa, Artificial Sequence
  Description of Artificial Sequence: Synthetic peptide
  Seed: LQIPVSSSFSY (MAGC1_HUMAN)
LCIPVSSSFSF

SEQ ID NO: 69588 - protein, 9 aa, Artificial Sequence
  Description of Artificial Sequence: Synthetic peptide
  Seed: VSSFFSYTL (MAGC1_HUMAN)
VLSFFSYTF

SEQ ID NO: 69589 - protein, 9 aa, Artificial Sequence
  Description of Artificial Sequence: Synthetic peptide
  Seed: IEILFGISL (MAGC1_HUMAN)
IHILFGISY

SEQ ID NO: 69590 - protein, 10 aa, Artificial Sequence
  Description of Artificial Sequence: Synthetic peptide
  Seed: SSPESAQSTF (MAGC1_HUMAN)
SWPESAQSTF

SEQ ID NO: 69591 - protein, 10 aa, Artificial Sequence
  Description of Artificial Sequence: Synthetic peptide
  Seed: YVFVNTLDLT (MAGC1_HUMAN)
YSFVNTLDLV

SEQ ID NO: 69592 - protein, 9 aa, Artificial Sequence
  Description of Artificial Sequence: Synthetic peptide
  Seed: SSPERTQST (MAGC1_HUMAN)
SFPERTQSM

SEQ ID NO: 69593 - protein, 9 aa, Artificial Sequence
  Description of Artificial Sequence: Synthetic peptide
  Seed: SPLEGEDSL (MAGC1_HUMAN)
SLLEGEDSF

SEQ ID NO: 69594 - protein, 9 aa, Artificial Sequence
  Description of Artificial Sequence: Synthetic peptide
  Seed: TFEGFPQSL (MAGC1_HUMAN)
TIEGFPQSL

SEQ ID NO: 69595 - protein, 9 aa, Artificial Sequence
  Description of Artificial Sequence: Synthetic peptide
  Seed: AGREHFAFG (MAGC1_HUMAN)
ALREHFAFA

SEQ ID NO: 69596 - protein, 9 aa, Artificial Sequence
  Description of Artificial Sequence: Synthetic peptide
  Seed: GFPQSPLQI (MAGC1_HUMAN)
GAPQSPLQY

SEQ ID NO: 69597 - protein, 11 aa, Artificial Sequence
  Description of Artificial Sequence: Synthetic peptide
  Seed: STFEGFPQSLL (MAGC1_HUMAN)
STFEGFPQSLW

SEQ ID NO: 69598 - protein, 9 aa, Artificial Sequence
  Description of Artificial Sequence: Synthetic peptide
  Seed: SQSSPVSSF (MAGC1_HUMAN)
SYSSPVSSY

SEQ ID NO: 69599 - protein, 9 aa, Artificial Sequence
  Description of Artificial Sequence: Synthetic peptide
  Seed: REVDPDDSY (MAGC1_HUMAN)
RKVDPDDSF

SEQ ID NO: 69600 - protein, 9 aa, Artificial Sequence
  Description of Artificial Sequence: Synthetic peptide
  Seed: SQNRLLILI (MAGC1_HUMAN)
SINRLLILL

SEQ ID NO: 69601 - protein, 9 aa, Artificial Sequence
  Description of Artificial Sequence: Synthetic peptide
  Seed: YQVKQPITK (MAGC1_HUMAN)
YIVKQPITL

SEQ ID NO: 69602 - protein, 9 aa, Artificial Sequence
  Description of Artificial Sequence: Synthetic peptide
  Seed: LQIPVSAAS (MAGC1_HUMAN)
LMIPVSAAM

SEQ ID NO: 69603 - protein, 9 aa, Artificial Sequence
  Description of Artificial Sequence: Synthetic peptide
  Seed: VSSSFSYTL (MAGC1_HUMAN)
VQSSFSYTV

SEQ ID NO: 69604 - protein, 9 aa, Artificial Sequence
  Description of Artificial Sequence: Synthetic peptide
  Seed: NVISRYTGY (MAGC1_HUMAN)
NAISRYTGM

SEQ ID NO: 69605 - protein, 10 aa, Artificial Sequence
  Description of Artificial Sequence: Synthetic peptide
  Seed: SPLYFPQSPL (MAGC1_HUMAN)
SFLYFPQSPI

SEQ ID NO: 69606 - protein, 9 aa, Artificial Sequence
  Description of Artificial Sequence: Synthetic peptide
  Seed: FPSSTSSSL (MAGC1_HUMAN)
FPSSTSSSY

SEQ ID NO: 69607 - protein, 11 aa, Artificial Sequence
  Description of Artificial Sequence: Synthetic peptide
  Seed: SPLQIPVSPSS (MAGC1_HUMAN)
SCLQIPVSPSY

SEQ ID NO: 69608 - protein, 9 aa, Artificial Sequence
  Description of Artificial Sequence: Synthetic peptide
  Seed: SSSSTLLSL (MAGC1_HUMAN)
SMSSTLLSM

SEQ ID NO: 69609 - protein, 9 aa, Artificial Sequence
  Description of Artificial Sequence: Synthetic peptide
  Seed: FQSSLQSPV (MAGC1_HUMAN)
FLSSLQSPA

SEQ ID NO: 69610 - protein, 11 aa, Artificial Sequence
  Description of Artificial Sequence: Synthetic peptide
  Seed: IPVSAASSSTL (MAGC1_HUMAN)
IPVSAASSSTW

SEQ ID NO: 69611 - protein, 9 aa, Artificial Sequence
  Description of Artificial Sequence: Synthetic peptide
  Seed: KDMPTAGMP (MAGC1_HUMAN)
KEMPTAGMA

SEQ ID NO: 69612 - protein, 9 aa, Artificial Sequence
  Description of Artificial Sequence: Synthetic peptide
  Seed: SFSSTLVSL (MAGC1_HUMAN)
SWSSTLVSF

SEQ ID NO: 69613 - protein, 9 aa, Artificial Sequence
  Description of Artificial Sequence: Synthetic peptide
  Seed: LQIPVSAAS (MAGC1_HUMAN)
LLIPVSAAA

SEQ ID NO: 69614 - protein, 11 aa, Artificial Sequence
  Description of Artificial Sequence: Synthetic peptide
  Seed: STFEGFAQSPL (MAGC1_HUMAN)
SLFEGFAQSPA

SEQ ID NO: 69615 - protein, 9 aa, Artificial Sequence
  Description of Artificial Sequence: Synthetic peptide
  Seed: SLPEWEDSL (MAGC1_HUMAN)
SLPEWEDSV

SEQ ID NO: 69616 - protein, 11 aa, Artificial Sequence
  Description of Artificial Sequence: Synthetic peptide
  Seed: STFEGFAQSPL (MAGC1_HUMAN)
SAFEGFAQSPY

SEQ ID NO: 69617 - protein, 10 aa, Artificial Sequence
  Description of Artificial Sequence: Synthetic peptide
  Seed: ICSSSTSLSL (MAGC1_HUMAN)
INSSSTSLSF

SEQ ID NO: 69618 - protein, 9 aa, Artificial Sequence
  Description of Artificial Sequence: Synthetic peptide
  Seed: SVLQIPVSA (MAGC1_HUMAN)
SPLQIPVSF

SEQ ID NO: 69619 - protein, 9 aa, Artificial Sequence
  Description of Artificial Sequence: Synthetic peptide
  Seed: FTYTLDEKV (MAGC1_HUMAN)
FTYTLDEKY

SEQ ID NO: 69620 - protein, 10 aa, Artificial Sequence
  Description of Artificial Sequence: Synthetic peptide
  Seed: VISFSSSTSL (MAGC1_HUMAN)
VQSFSSSTSF

SEQ ID NO: 69621 - protein, 11 aa, Artificial Sequence
  Description of Artificial Sequence: Synthetic peptide
  Seed: SLFQSSPERTH (MAGC1_HUMAN)
SMFQSSPERTY

SEQ ID NO: 69622 - protein, 9 aa, Artificial Sequence
  Description of Artificial Sequence: Synthetic peptide
  Seed: SSSDTLLES (MAGC1_HUMAN)
SASDTLLEM

SEQ ID NO: 69623 - protein, 10 aa, Artificial Sequence
  Description of Artificial Sequence: Synthetic peptide
  Seed: KRKVVEFLAM (MAGC1_HUMAN)
KRKVVEFLAL

SEQ ID NO: 69624 - protein, 9 aa, Artificial Sequence
  Description of Artificial Sequence: Synthetic peptide
  Seed: TGYFPVIFR (MAGC1_HUMAN)
TIYFPVIFK

SEQ ID NO: 69625 - protein, 9 aa, Artificial Sequence
  Description of Artificial Sequence: Synthetic peptide
  Seed: SSSFSYTLL (MAGC1_HUMAN)
SSSFSYTLI

SEQ ID NO: 69626 - protein, 11 aa, Artificial Sequence
  Description of Artificial Sequence: Synthetic peptide
  Seed: SSFPSSTSSSL (MAGC1_HUMAN)
SIFPSSTSSSL

SEQ ID NO: 69627 - protein, 10 aa, Artificial Sequence
  Description of Artificial Sequence: Synthetic peptide
  Seed: TTDDSTATES (MAGC1_HUMAN)
TVDDSTATEF

SEQ ID NO: 69628 - protein, 9 aa, Artificial Sequence
  Description of Artificial Sequence: Synthetic peptide
  Seed: IPVSSSFSY (MAGC1_HUMAN)
IHVSSSFSF

SEQ ID NO: 69629 - protein, 10 aa, Artificial Sequence
  Description of Artificial Sequence: Synthetic peptide
  Seed: SLFQSSPECT (MAGC1_HUMAN)
SVFQSSPECL

SEQ ID NO: 69630 - protein, 9 aa, Artificial Sequence
  Description of Artificial Sequence: Synthetic peptide
  Seed: FSSALLSIF (MAGC1_HUMAN)
FISALLSIF

SEQ ID NO: 69631 - protein, 9 aa, Artificial Sequence
  Description of Artificial Sequence: Synthetic peptide
  Seed: RLLILILSI (MAGC1_HUMAN)
RGLILILSY

SEQ ID NO: 69632 - protein, 9 aa, Artificial Sequence
  Description of Artificial Sequence: Synthetic peptide
  Seed: QVKQPITKA (MAGC1_HUMAN)
QMKQPITKK

SEQ ID NO: 69633 - protein, 8 aa, Artificial Sequence
  Description of Artificial Sequence: Synthetic peptide
  Seed: FIEILFGI (MAGC1_HUMAN)
FQEILFGI

SEQ ID NO: 69634 - protein, 11 aa, Artificial Sequence
  Description of Artificial Sequence: Synthetic peptide
  Seed: SLREVDPDDSY (MAGC1_HUMAN)
SLREVDPDDSW

SEQ ID NO: 69635 - protein, 10 aa, Artificial Sequence
  Description of Artificial Sequence: Synthetic peptide
  Seed: ATESASSSVM (MAGC1_HUMAN)
APESASSSVF

SEQ ID NO: 69636 - protein, 10 aa, Artificial Sequence
  Description of Artificial Sequence: Synthetic peptide
  Seed: SLSPLHFPQF (MAGC1_HUMAN)
SKSPLHFPQF

SEQ ID NO: 69637 - protein, 10 aa, Artificial Sequence
  Description of Artificial Sequence: Synthetic peptide
  Seed: SSPESAQSAF (MAGC1_HUMAN)
SRPESAQSAL

SEQ ID NO: 69638 - protein, 10 aa, Artificial Sequence
  Description of Artificial Sequence: Synthetic peptide
  Seed: SLQIPVSPSF (MAGC1_HUMAN)
SYQIPVSPSF

SEQ ID NO: 69639 - protein, 9 aa, Artificial Sequence
  Description of Artificial Sequence: Synthetic peptide
  Seed: SIIFIKGTY (MAGC1_HUMAN)
SSIFIKGTF

SEQ ID NO: 69640 - protein, 9 aa, Artificial Sequence
  Description of Artificial Sequence: Synthetic peptide
  Seed: LSPLHFPQF (MAGC1_HUMAN)
LVPLHFPQM

SEQ ID NO: 69641 - protein, 10 aa, Artificial Sequence
  Description of Artificial Sequence: Synthetic peptide
  Seed: FSSSTSLSPF (MAGC1_HUMAN)
FHSSTSLSPW

SEQ ID NO: 69642 - protein, 9 aa, Artificial Sequence
  Description of Artificial Sequence: Synthetic peptide
  Seed: SQSPPEGPV (MAGC1_HUMAN)
SHSPPEGPL

SEQ ID NO: 69643 - protein, 9 aa, Artificial Sequence
  Description of Artificial Sequence: Synthetic peptide
  Seed: FSSTLVSLF (MAGC1_HUMAN)
FQSTLVSLF

SEQ ID NO: 69644 - protein, 9 aa, Artificial Sequence
  Description of Artificial Sequence: Synthetic peptide
  Seed: IFRKAREFI (MAGC1_HUMAN)
IVRKAREFA

SEQ ID NO: 69645 - protein, 9 aa, Artificial Sequence
  Description of Artificial Sequence: Synthetic peptide
  Seed: LQIPVSSSS (MAGC1_HUMAN)
LPIPVSSSV

SEQ ID NO: 69646 - protein, 10 aa, Artificial Sequence
  Description of Artificial Sequence: Synthetic peptide
  Seed: KRKVVEFLAM (MAGC1_HUMAN)
KMKVVEFLAF

SEQ ID NO: 69647 - protein, 9 aa, Artificial Sequence
  Description of Artificial Sequence: Synthetic peptide
  Seed: NPASSFFSS (MAGC1_HUMAN)
NVASSFFSF

SEQ ID NO: 69648 - protein, 9 aa, Artificial Sequence
  Description of Artificial Sequence: Synthetic peptide
  Seed: RTHSTFEGF (MAGC1_HUMAN)
RRHSTFEGL

SEQ ID NO: 69649 - protein, 9 aa, Artificial Sequence
  Description of Artificial Sequence: Synthetic peptide
  Seed: YVFVNTLDL (MAGC1_HUMAN)
YIFVNTLDY

SEQ ID NO: 69650 - protein, 10 aa, Artificial Sequence
  Description of Artificial Sequence: Synthetic peptide
  Seed: MPTAGMPSLL (MAGC1_HUMAN)
MYTAGMPSLF

SEQ ID NO: 69651 - protein, 9 aa, Artificial Sequence
  Description of Artificial Sequence: Synthetic peptide
  Seed: NTVPITFPS (MAGC1_HUMAN)
NIVPITFPK

SEQ ID NO: 69652 - protein, 10 aa, Artificial Sequence
  Description of Artificial Sequence: Synthetic peptide
  Seed: ELARFLLLKY (MAGC1_HUMAN)
EVARFLLLKK

SEQ ID NO: 69653 - protein, 9 aa, Artificial Sequence
  Description of Artificial Sequence: Synthetic peptide
  Seed: SPVSSFPSS (MAGC1_HUMAN)
SPVSSFPSP

SEQ ID NO: 69654 - protein, 11 aa, Artificial Sequence
  Description of Artificial Sequence: Synthetic peptide
  Seed: IPMTSSFSSTL (MAGC1_HUMAN)
IPMTSSFSSTF

SEQ ID NO: 69655 - protein, 9 aa, Artificial Sequence
  Description of Artificial Sequence: Synthetic peptide
  Seed: YQVKQPITK (MAGC1_HUMAN)
YLVKQPITM

SEQ ID NO: 69656 - protein, 9 aa, Artificial Sequence
  Description of Artificial Sequence: Synthetic peptide
  Seed: LQIPVSAAS (MAGC1_HUMAN)
LAIPVSAAL

SEQ ID NO: 69657 - protein, 9 aa, Artificial Sequence
  Description of Artificial Sequence: Synthetic peptide
  Seed: REVDPDDSY (MAGC1_HUMAN)
RLVDPDDSW

SEQ ID NO: 69658 - protein, 9 aa, Artificial Sequence
  Description of Artificial Sequence: Synthetic peptide
  Seed: VLSGIGVRA (MAGC1_HUMAN)
VLSGIGVRM

SEQ ID NO: 69659 - protein, 9 aa, Artificial Sequence
  Description of Artificial Sequence: Synthetic peptide
  Seed: LQNPASSFF (MAGC1_HUMAN)
LMNPASSFV

SEQ ID NO: 69660 - protein, 9 aa, Artificial Sequence
  Description of Artificial Sequence: Synthetic peptide
  Seed: IPVSRSFSS (MAGC1_HUMAN)
IPVSRSFSV

SEQ ID NO: 69661 - protein, 9 aa, Artificial Sequence
  Description of Artificial Sequence: Synthetic peptide
  Seed: SSLSQSSPV (MAGC1_HUMAN)
SALSQSSPM

SEQ ID NO: 69662 - protein, 9 aa, Artificial Sequence
  Description of Artificial Sequence: Synthetic peptide
  Seed: SSSTLLSLF (MAGC1_HUMAN)
SSSTLLSLV

SEQ ID NO: 69663 - protein, 9 aa, Artificial Sequence
  Description of Artificial Sequence: Synthetic peptide
  Seed: SSTSSSLSK (MAGC1_HUMAN)
SATSSSLSK

SEQ ID NO: 69664 - protein, 9 aa, Artificial Sequence
  Description of Artificial Sequence: Synthetic peptide
  Seed: SSTSSSLSK (MAGC1_HUMAN)
SATSSSLSR

SEQ ID NO: 69665 - protein, 10 aa, Artificial Sequence
  Description of Artificial Sequence: Synthetic peptide
  Seed: SPLQSPVSSF (MAGC1_HUMAN)
SILQSPVSSY

SEQ ID NO: 69666 - protein, 9 aa, Artificial Sequence
  Description of Artificial Sequence: Synthetic peptide
  Seed: YQVKQPITK (MAGC1_HUMAN)
YMVKQPITF

SEQ ID NO: 69667 - protein, 11 aa, Artificial Sequence
  Description of Artificial Sequence: Synthetic peptide
  Seed: FLAMLKNTVPI (MAGC1_HUMAN)
FYAMLKNTVPL

SEQ ID NO: 69668 - protein, 9 aa, Artificial Sequence
  Description of Artificial Sequence: Synthetic peptide
  Seed: GYFPVIFRK (MAGC1_HUMAN)
GMFPVIFRV

SEQ ID NO: 69669 - protein, 10 aa, Artificial Sequence
  Description of Artificial Sequence: Synthetic peptide
  Seed: SSSSSTLLSL (MAGC1_HUMAN)
SMSSSTLLSV

SEQ ID NO: 69670 - protein, 10 aa, Artificial Sequence
  Description of Artificial Sequence: Synthetic peptide
  Seed: YTLDEKVDEL (MAGC1_HUMAN)
YTLDEKVDEI

SEQ ID NO: 69671 - protein, 9 aa, Artificial Sequence
  Description of Artificial Sequence: Synthetic peptide
  Seed: SSHESPQSP (MAGC1_HUMAN)
SLHESPQSM

SEQ ID NO: 69672 - protein, 11 aa, Artificial Sequence
  Description of Artificial Sequence: Synthetic peptide
  Seed: EILFGISLREV (MAGC1_HUMAN)
EALFGISLREV

SEQ ID NO: 69673 - protein, 9 aa, Artificial Sequence
  Description of Artificial Sequence: Synthetic peptide
  Seed: QIVPSLPEW (MAGC1_HUMAN)
QIVPSLPEY

SEQ ID NO: 69674 - protein, 9 aa, Artificial Sequence
  Description of Artificial Sequence: Synthetic peptide
  Seed: LQSPVISFS (MAGC1_HUMAN)
LQSPVISFI

SEQ ID NO: 69675 - protein, 9 aa, Artificial Sequence
  Description of Artificial Sequence: Synthetic peptide
  Seed: TLLSLFQSF (MAGC1_HUMAN)
TALSLFQSM

SEQ ID NO: 69676 - protein, 10 aa, Artificial Sequence
  Description of Artificial Sequence: Synthetic peptide
  Seed: SSPESTQSPF (MAGC1_HUMAN)
SFPESTQSPL

SEQ ID NO: 69677 - protein, 9 aa, Artificial Sequence
  Description of Artificial Sequence: Synthetic peptide
  Seed: SLSPHYFPQ (MAGC1_HUMAN)
SISPHYFPR

SEQ ID NO: 69678 - protein, 8 aa, Artificial Sequence
  Description of Artificial Sequence: Synthetic peptide
  Seed: LQIPVSAA (MAGC1_HUMAN)
LQIPVSAI

SEQ ID NO: 69679 - protein, 10 aa, Artificial Sequence
  Description of Artificial Sequence: Synthetic peptide
  Seed: LAMLKNTVPI (MAGC1_HUMAN)
LCMLKNTVPY

SEQ ID NO: 69680 - protein, 11 aa, Artificial Sequence
  Description of Artificial Sequence: Synthetic peptide
  Seed: REVDPDDSYVF (MAGC1_HUMAN)
RRVDPDDSYVF

SEQ ID NO: 69681 - protein, 10 aa, Artificial Sequence
  Description of Artificial Sequence: Synthetic peptide
  Seed: RAGREHFAFG (MAGC1_HUMAN)
RMGREHFAFG

SEQ ID NO: 69682 - protein, 10 aa, Artificial Sequence
  Description of Artificial Sequence: Synthetic peptide
  Seed: EVIWDVLSGI (MAGC1_HUMAN)
EAIWDVLSGF

SEQ ID NO: 69683 - protein, 9 aa, Artificial Sequence
  Description of Artificial Sequence: Synthetic peptide
  Seed: LSDEQGMSQ (MAGC1_HUMAN)
LVDEQGMSV

SEQ ID NO: 69684 - protein, 10 aa, Artificial Sequence
  Description of Artificial Sequence: Synthetic peptide
  Seed: KGTYASEEVI (MAGC1_HUMAN)
KQTYASEEVF

SEQ ID NO: 69685 - protein, 10 aa, Artificial Sequence
  Description of Artificial Sequence: Synthetic peptide
  Seed: AMLKNTVPIT (MAGC1_HUMAN)
ALLKNTVPIV

SEQ ID NO: 69686 - protein, 9 aa, Artificial Sequence
  Description of Artificial Sequence: Synthetic peptide
  Seed: SQNRLLILI (MAGC1_HUMAN)
SQNRLLILM

SEQ ID NO: 69687 - protein, 10 aa, Artificial Sequence
  Description of Artificial Sequence: Synthetic peptide
  Seed: FFSYTLASLL (MAGC1_HUMAN)
FMSYTLASLH

SEQ ID NO: 69688 - protein, 9 aa, Artificial Sequence
  Description of Artificial Sequence: Synthetic peptide
  Seed: SASSSVMSP (MAGC1_HUMAN)
SASSSVMSL

SEQ ID NO: 69689 - protein, 9 aa, Artificial Sequence
  Description of Artificial Sequence: Synthetic peptide
  Seed: TLLSLFQSF (MAGC1_HUMAN)
TMLSLFQSF

SEQ ID NO: 69690 - protein, 9 aa, Artificial Sequence
  Description of Artificial Sequence: Synthetic peptide
  Seed: LKYQVKQPI (MAGC1_HUMAN)
LEYQVKQPM

SEQ ID NO: 69691 - protein, 9 aa, Artificial Sequence
  Description of Artificial Sequence: Synthetic peptide
  Seed: FLAMLKNTV (MAGC1_HUMAN)
FSAMLKNTM

SEQ ID NO: 69692 - protein, 10 aa, Artificial Sequence
  Description of Artificial Sequence: Synthetic peptide
  Seed: PLQIPVSRSF (MAGC1_HUMAN)
PAQIPVSRSF

SEQ ID NO: 69693 - protein, 10 aa, Artificial Sequence
  Description of Artificial Sequence: Synthetic peptide
  Seed: TTDDSTATES (MAGC1_HUMAN)
TVDDSTATEY

SEQ ID NO: 69694 - protein, 9 aa, Artificial Sequence
  Description of Artificial Sequence: Synthetic peptide
  Seed: LQSPVISFS (MAGC1_HUMAN)
LTSPVISFA

SEQ ID NO: 69695 - protein, 9 aa, Artificial Sequence
  Description of Artificial Sequence: Synthetic peptide
  Seed: WEDSLSPHY (MAGC1_HUMAN)
WSDSLSPHY

SEQ ID NO: 69696 - protein, 10 aa, Artificial Sequence
  Description of Artificial Sequence: Synthetic peptide
  Seed: SPLQNPASSF (MAGC1_HUMAN)
SLLQNPASSY

SEQ ID NO: 69697 - protein, 10 aa, Artificial Sequence
  Description of Artificial Sequence: Synthetic peptide
  Seed: SRYTGYFPVI (MAGC1_HUMAN)
SIYTGYFPVF

SEQ ID NO: 69698 - protein, 11 aa, Artificial Sequence
  Description of Artificial Sequence: Synthetic peptide
  Seed: ILFGISLREVD (MAGC1_HUMAN)
IMFGISLREVL

SEQ ID NO: 69699 - protein, 9 aa, Artificial Sequence
  Description of Artificial Sequence: Synthetic peptide
  Seed: VSSFFSYTL (MAGC1_HUMAN)
VMSFFSYTL

SEQ ID NO: 69700 - protein, 9 aa, Artificial Sequence
  Description of Artificial Sequence: Synthetic peptide
  Seed: SPLQIVPSL (MAGC1_HUMAN)
SMLQIVPSL

SEQ ID NO: 69701 - protein, 9 aa, Artificial Sequence
  Description of Artificial Sequence: Synthetic peptide
  Seed: RPVSSFFSY (MAGC1_HUMAN)
RPVSSFFSV

SEQ ID NO: 69702 - protein, 11 aa, Artificial Sequence
  Description of Artificial Sequence: Synthetic peptide
  Seed: FLWGPRAHSEV (MAGC1_HUMAN)
FMWGPRAHSEM

SEQ ID NO: 69703 - protein, 9 aa, Artificial Sequence
  Description of Artificial Sequence: Synthetic peptide
  Seed: VSAASSSTL (MAGC1_HUMAN)
VMAASSSTL

SEQ ID NO: 69704 - protein, 8 aa, Artificial Sequence
  Description of Artificial Sequence: Synthetic peptide
  Seed: LQRPVSSF (MAGC1_HUMAN)
LQRPVSSY

SEQ ID NO: 69705 - protein, 10 aa, Artificial Sequence
  Description of Artificial Sequence: Synthetic peptide
  Seed: SSSSSTLLSL (MAGC1_HUMAN)
SCSSSTLLSW

SEQ ID NO: 69706 - protein, 11 aa, Artificial Sequence
  Description of Artificial Sequence: Synthetic peptide
  Seed: IPMTSSFSSTL (MAGC1_HUMAN)
IDMTSSFSSTY

SEQ ID NO: 69707 - protein, 10 aa, Artificial Sequence
  Description of Artificial Sequence: Synthetic peptide
  Seed: SIIFIKGTYA (MAGC1_HUMAN)
SMIFIKGTYV

SEQ ID NO: 69708 - protein, 10 aa, Artificial Sequence
  Description of Artificial Sequence: Synthetic peptide
  Seed: FSYTLLSLFQ (MAGC1_HUMAN)
FTYTLLSLFF

SEQ ID NO: 69709 - protein, 10 aa, Artificial Sequence
  Description of Artificial Sequence: Synthetic peptide
  Seed: STSLSLPQSF (MAGC1_HUMAN)
SGSLSLPQSW

SEQ ID NO: 69710 - protein, 9 aa, Artificial Sequence
  Description of Artificial Sequence: Synthetic peptide
  Seed: AGREHFAFG (MAGC1_HUMAN)
AMREHFAFI

SEQ ID NO: 69711 - protein, 9 aa, Artificial Sequence
  Description of Artificial Sequence: Synthetic peptide
  Seed: FPQFPPQGE (MAGC1_HUMAN)
FPQFPPQGL

SEQ ID NO: 69712 - protein, 11 aa, Artificial Sequence
  Description of Artificial Sequence: Synthetic peptide
  Seed: STFEGFAQSPL (MAGC1_HUMAN)
SLFEGFAQSPC

SEQ ID NO: 69713 - protein, 10 aa, Artificial Sequence
  Description of Artificial Sequence: Synthetic peptide
  Seed: STPSSLPQSF (MAGC1_HUMAN)
STPSSLPQSR

SEQ ID NO: 69714 - protein, 11 aa, Artificial Sequence
  Description of Artificial Sequence: Synthetic peptide
  Seed: SPLQIPVSRSF (MAGC1_HUMAN)
SYLQIPVSRSY

SEQ ID NO: 69715 - protein, 9 aa, Artificial Sequence
  Description of Artificial Sequence: Synthetic peptide
  Seed: ASSSTLVSI (MAGC1_HUMAN)
AQSSTLVSI

SEQ ID NO: 69716 - protein, 11 aa, Artificial Sequence
  Description of Artificial Sequence: Synthetic peptide
  Seed: ISRYTGYFPVI (MAGC1_HUMAN)
IIRYTGYFPVF

SEQ ID NO: 69717 - protein, 9 aa, Artificial Sequence
  Description of Artificial Sequence: Synthetic peptide
  Seed: SAQSAFEGF (MAGC1_HUMAN)
SQQSAFEGL

SEQ ID NO: 69718 - protein, 9 aa, Artificial Sequence
  Description of Artificial Sequence: Synthetic peptide
  Seed: DSYVFVNTL (MAGC1_HUMAN)
DPYVFVNTV

SEQ ID NO: 69719 - protein, 11 aa, Artificial Sequence
  Description of Artificial Sequence: Synthetic peptide
  Seed: STFEGFAQSSL (MAGC1_HUMAN)
SGFEGFAQSSW

SEQ ID NO: 69720 - protein, 9 aa, Artificial Sequence
  Description of Artificial Sequence: Synthetic peptide
  Seed: RSFSSTLLS (MAGC1_HUMAN)
RCFSSTLLF

SEQ ID NO: 69721 - protein, 9 aa, Artificial Sequence
  Description of Artificial Sequence: Synthetic peptide
  Seed: RSFSSTLLS (MAGC1_HUMAN)
RIFSSTLLW

SEQ ID NO: 69722 - protein, 9 aa, Artificial Sequence
  Description of Artificial Sequence: Synthetic peptide
  Seed: SSSSSSSTL (MAGC1_HUMAN)
SISSSSSTF

SEQ ID NO: 69723 - protein, 10 aa, Artificial Sequence
  Description of Artificial Sequence: Synthetic peptide
  Seed: LLQIPMTSSF (MAGC1_HUMAN)
LWQIPMTSSW

SEQ ID NO: 69724 - protein, 9 aa, Artificial Sequence
  Description of Artificial Sequence: Synthetic peptide
  Seed: FSSTLLSIL (MAGC1_HUMAN)
FKSTLLSIY

SEQ ID NO: 69725 - protein, 9 aa, Artificial Sequence
  Description of Artificial Sequence: Synthetic peptide
  Seed: SSSTSLSPF (MAGC1_HUMAN)
SWSTSLSPY

SEQ ID NO: 69726 - protein, 9 aa, Artificial Sequence
  Description of Artificial Sequence: Synthetic peptide
  Seed: FPSSYKDAL (MAGC1_HUMAN)
FMSSYKDAF

SEQ ID NO: 69727 - protein, 9 aa, Artificial Sequence
  Description of Artificial Sequence: Synthetic peptide
  Seed: RTHSTFEGF (MAGC1_HUMAN)
RSHSTFEGK

SEQ ID NO: 69728 - protein, 9 aa, Artificial Sequence
  Description of Artificial Sequence: Synthetic peptide
  Seed: SFPSSTSSS (MAGC1_HUMAN)
SYPSSTSSF

SEQ ID NO: 69729 - protein, 9 aa, Artificial Sequence
  Description of Artificial Sequence: Synthetic peptide
  Seed: FAQSPLQIP (MAGC1_HUMAN)
FAQSPLQIF

SEQ ID NO: 69730 - protein, 9 aa, Artificial Sequence
  Description of Artificial Sequence: Synthetic peptide
  Seed: LQIVPSLPE (MAGC1_HUMAN)
LLIVPSLPF

SEQ ID NO: 69731 - protein, 10 aa, Artificial Sequence
  Description of Artificial Sequence: Synthetic peptide
  Seed: SFSYTLLSLF (MAGC1_HUMAN)
SESYTLLSLW

SEQ ID NO: 69732 - protein, 10 aa, Artificial Sequence
  Description of Artificial Sequence: Synthetic peptide
  Seed: ISRYTGYFPV (MAGC1_HUMAN)
IVRYTGYFPV

SEQ ID NO: 69733 - protein, 10 aa, Artificial Sequence
  Description of Artificial Sequence: Synthetic peptide
  Seed: LLQIPMTSSF (MAGC1_HUMAN)
LFQIPMTSSY

SEQ ID NO: 69734 - protein, 9 aa, Artificial Sequence
  Description of Artificial Sequence: Synthetic peptide
  Seed: RTHSTFEGF (MAGC1_HUMAN)
RSHSTFEGL

SEQ ID NO: 69735 - protein, 10 aa, Artificial Sequence
  Description of Artificial Sequence: Synthetic peptide
  Seed: GEDSMSPLYF (MAGC1_HUMAN)
GEDSMSPLYA

SEQ ID NO: 69736 - protein, 9 aa, Artificial Sequence
  Description of Artificial Sequence: Synthetic peptide
  Seed: SLFQSFSER (MAGC1_HUMAN)
SAFQSFSEY

SEQ ID NO: 69737 - protein, 10 aa, Artificial Sequence
  Description of Artificial Sequence: Synthetic peptide
  Seed: FPQSLLQIPM (MAGC1_HUMAN)
FTQSLLQIPL

SEQ ID NO: 69738 - protein, 9 aa, Artificial Sequence
  Description of Artificial Sequence: Synthetic peptide
  Seed: ASSFFSSAL (MAGC1_HUMAN)
ASSFFSSAY

SEQ ID NO: 69739 - protein, 9 aa, Artificial Sequence
  Description of Artificial Sequence: Synthetic peptide
  Seed: FSSTLLSIL (MAGC1_HUMAN)
FPSTLLSIF

SEQ ID NO: 69740 - protein, 9 aa, Artificial Sequence
  Description of Artificial Sequence: Synthetic peptide
  Seed: TSLSLPQSF (MAGC1_HUMAN)
TLLSLPQSY

SEQ ID NO: 69741 - protein, 9 aa, Artificial Sequence
  Description of Artificial Sequence: Synthetic peptide
  Seed: SSSVMSPSF (MAGC1_HUMAN)
SVSVMSPSY

SEQ ID NO: 69742 - protein, 10 aa, Artificial Sequence
  Description of Artificial Sequence: Synthetic peptide
  Seed: SSPESAQSTF (MAGC1_HUMAN)
SSPESAQSTY

SEQ ID NO: 69743 - protein, 9 aa, Artificial Sequence
  Description of Artificial Sequence: Synthetic peptide
  Seed: LKYQVKQPI (MAGC1_HUMAN)
LLYQVKQPF

SEQ ID NO: 69744 - protein, 9 aa, Artificial Sequence
  Description of Artificial Sequence: Synthetic peptide
  Seed: ASSSTLVSI (MAGC1_HUMAN)
ASSSTLVSL

SEQ ID NO: 69745 - protein, 10 aa, Artificial Sequence
  Description of Artificial Sequence: Synthetic peptide
  Seed: SFPSSTSSSL (MAGC1_HUMAN)
SNPSSTSSSF

SEQ ID NO: 69746 - protein, 9 aa, Artificial Sequence
  Description of Artificial Sequence: Synthetic peptide
  Seed: AQSPLQIPV (MAGC1_HUMAN)
AMSPLQIPV

SEQ ID NO: 69747 - protein, 9 aa, Artificial Sequence
  Description of Artificial Sequence: Synthetic peptide
  Seed: IEILFGISL (MAGC1_HUMAN)
IEILFGISM

SEQ ID NO: 69748 - protein, 10 aa, Artificial Sequence
  Description of Artificial Sequence: Synthetic peptide
  Seed: LSLFQSFSER (MAGC1_HUMAN)
LQLFQSFSER

SEQ ID NO: 69749 - protein, 9 aa, Artificial Sequence
  Description of Artificial Sequence: Synthetic peptide
  Seed: ASSFFSSAL (MAGC1_HUMAN)
AWSFFSSAY

SEQ ID NO: 69750 - protein, 8 aa, Artificial Sequence
  Description of Artificial Sequence: Synthetic peptide
  Seed: LQSPVSSF (MAGC1_HUMAN)
LQSPVSSV

SEQ ID NO: 69751 - protein, 9 aa, Artificial Sequence
  Description of Artificial Sequence: Synthetic peptide
  Seed: SSPESTQSP (MAGC1_HUMAN)
SGPESTQSI

SEQ ID NO: 69752 - protein, 9 aa, Artificial Sequence
  Description of Artificial Sequence: Synthetic peptide
  Seed: AQSPLQIPV (MAGC1_HUMAN)
AHSPLQIPF

SEQ ID NO: 69753 - protein, 10 aa, Artificial Sequence
  Description of Artificial Sequence: Synthetic peptide
  Seed: WGPRAHSEVI (MAGC1_HUMAN)
WDPRAHSEVF

SEQ ID NO: 69754 - protein, 11 aa, Artificial Sequence
  Description of Artificial Sequence: Synthetic peptide
  Seed: FIKGTYASEEV (MAGC1_HUMAN)
FLKGTYASEEA

SEQ ID NO: 69755 - protein, 10 aa, Artificial Sequence
  Description of Artificial Sequence: Synthetic peptide
  Seed: SFPSSTSSSL (MAGC1_HUMAN)
STPSSTSSSI

SEQ ID NO: 69756 - protein, 11 aa, Artificial Sequence
  Description of Artificial Sequence: Synthetic peptide
  Seed: IPVSSSSSSTL (MAGC1_HUMAN)
IPVSSSSSSTA

SEQ ID NO: 69757 - protein, 9 aa, Artificial Sequence
  Description of Artificial Sequence: Synthetic peptide
  Seed: QSPLQGEEF (MAGC1_HUMAN)
QPPLQGEEY

SEQ ID NO: 69758 - protein, 9 aa, Artificial Sequence
  Description of Artificial Sequence: Synthetic peptide
  Seed: LKYQVKQPI (MAGC1_HUMAN)
LEYQVKQPY

SEQ ID NO: 69759 - protein, 9 aa, Artificial Sequence
  Description of Artificial Sequence: Synthetic peptide
  Seed: LQIPVSAAS (MAGC1_HUMAN)
LAIPVSAAY

SEQ ID NO: 69760 - protein, 9 aa, Artificial Sequence
  Description of Artificial Sequence: Synthetic peptide
  Seed: VSAASSSTL (MAGC1_HUMAN)
VSAASSSTM

SEQ ID NO: 69761 - protein, 9 aa, Artificial Sequence
  Description of Artificial Sequence: Synthetic peptide
  Seed: VSAASSSTL (MAGC1_HUMAN)
VTAASSSTW

SEQ ID NO: 69762 - protein, 10 aa, Artificial Sequence
  Description of Artificial Sequence: Synthetic peptide
  Seed: SSFSSTLLSI (MAGC1_HUMAN)
SIFSSTLLSL

SEQ ID NO: 69763 - protein, 9 aa, Artificial Sequence
  Description of Artificial Sequence: Synthetic peptide
  Seed: VSSSSSSTL (MAGC1_HUMAN)
VQSSSSSTW

SEQ ID NO: 69764 - protein, 9 aa, Artificial Sequence
  Description of Artificial Sequence: Synthetic peptide
  Seed: KAREFIEIL (MAGC1_HUMAN)
KQREFIEIV

SEQ ID NO: 69765 - protein, 10 aa, Artificial Sequence
  Description of Artificial Sequence: Synthetic peptide
  Seed: STPSSLPQSF (MAGC1_HUMAN)
SVPSSLPQSF

SEQ ID NO: 69766 - protein, 9 aa, Artificial Sequence
  Description of Artificial Sequence: Synthetic peptide
  Seed: FPSSTSSSL (MAGC1_HUMAN)
FCSSTSSSM

SEQ ID NO: 69767 - protein, 10 aa, Artificial Sequence
  Description of Artificial Sequence: Synthetic peptide
  Seed: KAREFIEILF (MAGC1_HUMAN)
KVREFIEILL

SEQ ID NO: 69768 - protein, 9 aa, Artificial Sequence
  Description of Artificial Sequence: Synthetic peptide
  Seed: SSFFSSALL (MAGC1_HUMAN)
SYFFSSALM

SEQ ID NO: 69769 - protein, 9 aa, Artificial Sequence
  Description of Artificial Sequence: Synthetic peptide
  Seed: TFEGFPQSL (MAGC1_HUMAN)
TSEGFPQSL

SEQ ID NO: 69770 - protein, 9 aa, Artificial Sequence
  Description of Artificial Sequence: Synthetic peptide
  Seed: SSPPRYEFL (MAGC1_HUMAN)
SIPPRYEFF

SEQ ID NO: 69771 - protein, 9 aa, Artificial Sequence
  Description of Artificial Sequence: Synthetic peptide
  Seed: MLTNVISRY (MAGC1_HUMAN)
MTTNVISRY

SEQ ID NO: 69772 - protein, 9 aa, Artificial Sequence
  Description of Artificial Sequence: Synthetic peptide
  Seed: TLASLLQSS (MAGC1_HUMAN)
TSASLLQSL

SEQ ID NO: 69773 - protein, 10 aa, Artificial Sequence
  Description of Artificial Sequence: Synthetic peptide
  Seed: RSFSSTLLSI (MAGC1_HUMAN)
RMFSSTLLSK

SEQ ID NO: 69774 - protein, 11 aa, Artificial Sequence
  Description of Artificial Sequence: Synthetic peptide
  Seed: SASSSVMSPSF (MAGC1_HUMAN)
SSSSSVMSPSF

SEQ ID NO: 69775 - protein, 9 aa, Artificial Sequence
  Description of Artificial Sequence: Synthetic peptide
  Seed: SLFQSFSER (MAGC1_HUMAN)
SAFQSFSEL

SEQ ID NO: 69776 - protein, 9 aa, Artificial Sequence
  Description of Artificial Sequence: Synthetic peptide
  Seed: RPVSSFFSY (MAGC1_HUMAN)
RKVSSFFSI

SEQ ID NO: 69777 - protein, 9 aa, Artificial Sequence
  Description of Artificial Sequence: Synthetic peptide
  Seed: LQIPVSPSF (MAGC1_HUMAN)
LSIPVSPSW

SEQ ID NO: 69778 - protein, 8 aa, Artificial Sequence
  Description of Artificial Sequence: Synthetic peptide
  Seed: FSYTLLSL (MAGC1_HUMAN)
FAYTLLSL

SEQ ID NO: 69779 - protein, 9 aa, Artificial Sequence
  Description of Artificial Sequence: Synthetic peptide
  Seed: SSPESPLQS (MAGC1_HUMAN)
SQPESPLQM

SEQ ID NO: 69780 - protein, 11 aa, Artificial Sequence
  Description of Artificial Sequence: Synthetic peptide
  Seed: SPLQNPASSFF (MAGC1_HUMAN)
SLLQNPASSFF

SEQ ID NO: 69781 - protein, 10 aa, Artificial Sequence
  Description of Artificial Sequence: Synthetic peptide
  Seed: SSPERTQSTF (MAGC1_HUMAN)
SQPERTQSTY

SEQ ID NO: 69782 - protein, 9 aa, Artificial Sequence
  Description of Artificial Sequence: Synthetic peptide
  Seed: LQRPVSSFF (MAGC1_HUMAN)
LSRPVSSFI

SEQ ID NO: 69783 - protein, 10 aa, Artificial Sequence
  Description of Artificial Sequence: Synthetic peptide
  Seed: ASSSVMSPSF (MAGC1_HUMAN)
AKSSVMSPSW

SEQ ID NO: 69784 - protein, 10 aa, Artificial Sequence
  Description of Artificial Sequence: Synthetic peptide
  Seed: FFSSALLSIF (MAGC1_HUMAN)
FKSSALLSIF

SEQ ID NO: 69785 - protein, 10 aa, Artificial Sequence
  Description of Artificial Sequence: Synthetic peptide
  Seed: STSLSLPQSF (MAGC1_HUMAN)
SFSLSLPQSW

SEQ ID NO: 69786 - protein, 10 aa, Artificial Sequence
  Description of Artificial Sequence: Synthetic peptide
  Seed: SPLQIPMTSS (MAGC1_HUMAN)
SPLQIPMTSF

SEQ ID NO: 69787 - protein, 10 aa, Artificial Sequence
  Description of Artificial Sequence: Synthetic peptide
  Seed: RKVVEFLAML (MAGC1_HUMAN)
RKVVEFLAMM

SEQ ID NO: 69788 - protein, 9 aa, Artificial Sequence
  Description of Artificial Sequence: Synthetic peptide
  Seed: SQSSPVSSF (MAGC1_HUMAN)
SFSSPVSSY

SEQ ID NO: 69789 - protein, 10 aa, Artificial Sequence
  Description of Artificial Sequence: Synthetic peptide
  Seed: MTSSFSSTLL (MAGC1_HUMAN)
MQSSFSSTLM

SEQ ID NO: 69790 - protein, 10 aa, Artificial Sequence
  Description of Artificial Sequence: Synthetic peptide
  Seed: KAREFIEILF (MAGC1_HUMAN)
KVREFIEILI

SEQ ID NO: 69791 - protein, 9 aa, Artificial Sequence
  Description of Artificial Sequence: Synthetic peptide
  Seed: RPVSSFFSY (MAGC1_HUMAN)
RNVSSFFSY

SEQ ID NO: 69792 - protein, 10 aa, Artificial Sequence
  Description of Artificial Sequence: Synthetic peptide
  Seed: ATESASSSVM (MAGC1_HUMAN)
ARESASSSVW

SEQ ID NO: 69793 - protein, 9 aa, Artificial Sequence
  Description of Artificial Sequence: Synthetic peptide
  Seed: SSSSSSSTL (MAGC1_HUMAN)
SSSSSSSTF

SEQ ID NO: 69794 - protein, 9 aa, Artificial Sequence
  Description of Artificial Sequence: Synthetic peptide
  Seed: ISFSSSTSL (MAGC1_HUMAN)
IMFSSSTSK

SEQ ID NO: 69795 - protein, 9 aa, Artificial Sequence
  Description of Artificial Sequence: Synthetic peptide
  Seed: FQSSLQSPV (MAGC1_HUMAN)
FRSSLQSPF

SEQ ID NO: 69796 - protein, 9 aa, Artificial Sequence
  Description of Artificial Sequence: Synthetic peptide
  Seed: AQSPLQIPV (MAGC1_HUMAN)
AMSPLQIPY

SEQ ID NO: 69797 - protein, 9 aa, Artificial Sequence
  Description of Artificial Sequence: Synthetic peptide
  Seed: VSSSSSSTL (MAGC1_HUMAN)
VTSSSSSTY

SEQ ID NO: 69798 - protein, 9 aa, Artificial Sequence
  Description of Artificial Sequence: Synthetic peptide
  Seed: SPLQSPESA (MAGC1_HUMAN)
SPLQSPESL

SEQ ID NO: 69799 - protein, 9 aa, Artificial Sequence
  Description of Artificial Sequence: Synthetic peptide
  Seed: FPSSTSSSL (MAGC1_HUMAN)
FFSSTSSSV

SEQ ID NO: 69800 - protein, 9 aa, Artificial Sequence
  Description of Artificial Sequence: Synthetic peptide
  Seed: SSSTLLSLF (MAGC1_HUMAN)
SWSTLLSLW

SEQ ID NO: 69801 - protein, 10 aa, Artificial Sequence
  Description of Artificial Sequence: Synthetic peptide
  Seed: MTSSFSSTLL (MAGC1_HUMAN)
MISSFSSTLW

SEQ ID NO: 69802 - protein, 9 aa, Artificial Sequence
  Description of Artificial Sequence: Synthetic peptide
  Seed: SSLSQSSPV (MAGC1_HUMAN)
SMLSQSSPM

SEQ ID NO: 69803 - protein, 9 aa, Artificial Sequence
  Description of Artificial Sequence: Synthetic peptide
  Seed: IPVSSSFSY (MAGC1_HUMAN)
INVSSSFSF

SEQ ID NO: 69804 - protein, 9 aa, Artificial Sequence
  Description of Artificial Sequence: Synthetic peptide
  Seed: KQPITKAEM (MAGC1_HUMAN)
KYPITKAEM

SEQ ID NO: 69805 - protein, 9 aa, Artificial Sequence
  Description of Artificial Sequence: Synthetic peptide
  Seed: LQNPASSFF (MAGC1_HUMAN)
LHNPASSFY

SEQ ID NO: 69806 - protein, 9 aa, Artificial Sequence
  Description of Artificial Sequence: Synthetic peptide
  Seed: VIKRKVVEF (MAGC1_HUMAN)
VTKRKVVEL

SEQ ID NO: 69807 - protein, 9 aa, Artificial Sequence
  Description of Artificial Sequence: Synthetic peptide
  Seed: VSPSFSSTL (MAGC1_HUMAN)
VIPSFSSTL

SEQ ID NO: 69808 - protein, 10 aa, Artificial Sequence
  Description of Artificial Sequence: Synthetic peptide
  Seed: RAGREHFAFG (MAGC1_HUMAN)
RGGREHFAFK

SEQ ID NO: 69809 - protein, 9 aa, Artificial Sequence
  Description of Artificial Sequence: Synthetic peptide
  Seed: LQIVPSLPE (MAGC1_HUMAN)
LHIVPSLPL

SEQ ID NO: 69810 - protein, 9 aa, Artificial Sequence
  Description of Artificial Sequence: Synthetic peptide
  Seed: YTSSSDTLL (MAGC1_HUMAN)
YLSSSDTLF

SEQ ID NO: 69811 - protein, 9 aa, Artificial Sequence
  Description of Artificial Sequence: Synthetic peptide
  Seed: SIFQSSPER (MAGC1_HUMAN)
SVFQSSPEM

SEQ ID NO: 69812 - protein, 10 aa, Artificial Sequence
  Description of Artificial Sequence: Synthetic peptide
  Seed: IPMTSSFSST (MAGC1_HUMAN)
IPMTSSFSSI

SEQ ID NO: 69813 - protein, 9 aa, Artificial Sequence
  Description of Artificial Sequence: Synthetic peptide
  Seed: FQSSLQSPV (MAGC1_HUMAN)
FMSSLQSPY

SEQ ID NO: 69814 - protein, 10 aa, Artificial Sequence
  Description of Artificial Sequence: Synthetic peptide
  Seed: ASSSVMSPSF (MAGC1_HUMAN)
AQSSVMSPSY

SEQ ID NO: 69815 - protein, 9 aa, Artificial Sequence
  Description of Artificial Sequence: Synthetic peptide
  Seed: LQRPVSSFF (MAGC1_HUMAN)
LIRPVSSFI

SEQ ID NO: 69816 - protein, 10 aa, Artificial Sequence
  Description of Artificial Sequence: Synthetic peptide
  Seed: ELARFLLLKY (MAGC1_HUMAN)
ESARFLLLKK

SEQ ID NO: 69817 - protein, 9 aa, Artificial Sequence
  Description of Artificial Sequence: Synthetic peptide
  Seed: SPLQIVPSL (MAGC1_HUMAN)
SILQIVPSM

SEQ ID NO: 69818 - protein, 9 aa, Artificial Sequence
  Description of Artificial Sequence: Synthetic peptide
  Seed: LQIPGSPSF (MAGC1_HUMAN)
LDIPGSPSM

SEQ ID NO: 69819 - protein, 10 aa, Artificial Sequence
  Description of Artificial Sequence: Synthetic peptide
  Seed: SRYTGYFPVI (MAGC1_HUMAN)
SYYTGYFPVV

SEQ ID NO: 69820 - protein, 9 aa, Artificial Sequence
  Description of Artificial Sequence: Synthetic peptide
  Seed: FAFGEPREL (MAGC1_HUMAN)
FRFGEPREY

SEQ ID NO: 69821 - protein, 9 aa, Artificial Sequence
  Description of Artificial Sequence: Synthetic peptide
  Seed: RPVSSFFSY (MAGC1_HUMAN)
RQVSSFFSL

SEQ ID NO: 69822 - protein, 9 aa, Artificial Sequence
  Description of Artificial Sequence: Synthetic peptide
  Seed: SQSPPEGPV (MAGC1_HUMAN)
SKSPPEGPY

SEQ ID NO: 69823 - protein, 11 aa, Artificial Sequence
  Description of Artificial Sequence: Synthetic peptide
  Seed: FLAMLKNTVPI (MAGC1_HUMAN)
FWAMLKNTVPL

SEQ ID NO: 69824 - protein, 10 aa, Artificial Sequence
  Description of Artificial Sequence: Synthetic peptide
  Seed: LQIPMTSSFS (MAGC1_HUMAN)
LQIPMTSSFG

SEQ ID NO: 69825 - protein, 9 aa, Artificial Sequence
  Description of Artificial Sequence: Synthetic peptide
  Seed: FPSSTSSSL (MAGC1_HUMAN)
FSSSTSSSY

SEQ ID NO: 69826 - protein, 9 aa, Artificial Sequence
  Description of Artificial Sequence: Synthetic peptide
  Seed: TTDDSTATE (MAGC1_HUMAN)
TQDDSTATM

SEQ ID NO: 69827 - protein, 10 aa, Artificial Sequence
  Description of Artificial Sequence: Synthetic peptide
  Seed: FAFGEPRELL (MAGC1_HUMAN)
FAFGEPRELI

SEQ ID NO: 69828 - protein, 9 aa, Artificial Sequence
  Description of Artificial Sequence: Synthetic peptide
  Seed: TPSSLPQSF (MAGC1_HUMAN)
TISSLPQSF

SEQ ID NO: 69829 - protein, 10 aa, Artificial Sequence
  Description of Artificial Sequence: Synthetic peptide
  Seed: FPSSYKDALK (MAGC1_HUMAN)
FTSSYKDALK

SEQ ID NO: 69830 - protein, 10 aa, Artificial Sequence
  Description of Artificial Sequence: Synthetic peptide
  Seed: RKVVEFLAML (MAGC1_HUMAN)
RRVVEFLAMV

SEQ ID NO: 69831 - protein, 11 aa, Artificial Sequence
  Description of Artificial Sequence: Synthetic peptide
  Seed: FQSSLQSPVSI (MAGC1_HUMAN)
FLSSLQSPVSV

SEQ ID NO: 69832 - protein, 9 aa, Artificial Sequence
  Description of Artificial Sequence: Synthetic peptide
  Seed: MSQNRLLIL (MAGC1_HUMAN)
MMQNRLLIM

SEQ ID NO: 69833 - protein, 10 aa, Artificial Sequence
  Description of Artificial Sequence: Synthetic peptide
  Seed: SFSYTLLSLF (MAGC1_HUMAN)
SYSYTLLSLL

SEQ ID NO: 69834 - protein, 10 aa, Artificial Sequence
  Description of Artificial Sequence: Synthetic peptide
  Seed: VSSSFSYTLL (MAGC1_HUMAN)
VNSSFSYTLW

SEQ ID NO: 69835 - protein, 9 aa, Artificial Sequence
  Description of Artificial Sequence: Synthetic peptide
  Seed: FPQSPPQGE (MAGC1_HUMAN)
FPQSPPQGT

SEQ ID NO: 69836 - protein, 9 aa, Artificial Sequence
  Description of Artificial Sequence: Synthetic peptide
  Seed: EFIEILFGI (MAGC1_HUMAN)
ELIEILFGI

SEQ ID NO: 69837 - protein, 9 aa, Artificial Sequence
  Description of Artificial Sequence: Synthetic peptide
  Seed: THSPLQIVP (MAGC1_HUMAN)
TQSPLQIVA

SEQ ID NO: 69838 - protein, 9 aa, Artificial Sequence
  Description of Artificial Sequence: Synthetic peptide
  Seed: RAHSEVIKR (MAGC1_HUMAN)
RVHSEVIKY

SEQ ID NO: 69839 - protein, 10 aa, Artificial Sequence
  Description of Artificial Sequence: Synthetic peptide
  Seed: SLQIPVSPSF (MAGC1_HUMAN)
SHQIPVSPSY

SEQ ID NO: 69840 - protein, 9 aa, Artificial Sequence
  Description of Artificial Sequence: Synthetic peptide
  Seed: SSSTSLSPF (MAGC1_HUMAN)
SRSTSLSPF

SEQ ID NO: 69841 - protein, 9 aa, Artificial Sequence
  Description of Artificial Sequence: Synthetic peptide
  Seed: SSPEGKDSL (MAGC1_HUMAN)
SCPEGKDSL

SEQ ID NO: 69842 - protein, 10 aa, Artificial Sequence
  Description of Artificial Sequence: Synthetic peptide
  Seed: SSSSSTLLSL (MAGC1_HUMAN)
SDSSSTLLSY

SEQ ID NO: 69843 - protein, 10 aa, Artificial Sequence
  Description of Artificial Sequence: Synthetic peptide
  Seed: SFSSTLLSIF (MAGC1_HUMAN)
STSSTLLSIW

SEQ ID NO: 69844 - protein, 9 aa, Artificial Sequence
  Description of Artificial Sequence: Synthetic peptide
  Seed: QGEDFQSSL (MAGC1_HUMAN)
QAEDFQSSL

SEQ ID NO: 69845 - protein, 10 aa, Artificial Sequence
  Description of Artificial Sequence: Synthetic peptide
  Seed: MLKNTVPITF (MAGC1_HUMAN)
MVKNTVPITF

SEQ ID NO: 69846 - protein, 9 aa, Artificial Sequence
  Description of Artificial Sequence: Synthetic peptide
  Seed: FEGFPQSVL (MAGC1_HUMAN)
FMGFPQSVF

SEQ ID NO: 69847 - protein, 10 aa, Artificial Sequence
  Description of Artificial Sequence: Synthetic peptide
  Seed: SPLQIPVSPS (MAGC1_HUMAN)
SPLQIPVSPV

SEQ ID NO: 69848 - protein, 9 aa, Artificial Sequence
  Description of Artificial Sequence: Synthetic peptide
  Seed: WVQEHYLEY (MAGC1_HUMAN)
WSQEHYLEM

SEQ ID NO: 69849 - protein, 9 aa, Artificial Sequence
  Description of Artificial Sequence: Synthetic peptide
  Seed: SICSSSTSL (MAGC1_HUMAN)
SACSSSTSI

SEQ ID NO: 69850 - protein, 9 aa, Artificial Sequence
  Description of Artificial Sequence: Synthetic peptide
  Seed: VSRSFSSTL (MAGC1_HUMAN)
VMRSFSSTK

SEQ ID NO: 69851 - protein, 9 aa, Artificial Sequence
  Description of Artificial Sequence: Synthetic peptide
  Seed: SLFQSFSER (MAGC1_HUMAN)
SGFQSFSEK

SEQ ID NO: 69852 - protein, 11 aa, Artificial Sequence
  Description of Artificial Sequence: Synthetic peptide
  Seed: SSSSSSTLLSL (MAGC1_HUMAN)
SVSSSSTLLSW

SEQ ID NO: 69853 - protein, 10 aa, Artificial Sequence
  Description of Artificial Sequence: Synthetic peptide
  Seed: SSFSSTLLSI (MAGC1_HUMAN)
SLFSSTLLSV

SEQ ID NO: 69854 - protein, 9 aa, Artificial Sequence
  Description of Artificial Sequence: Synthetic peptide
  Seed: TSLSLPQSF (MAGC1_HUMAN)
TTLSLPQSW

SEQ ID NO: 69855 - protein, 9 aa, Artificial Sequence
  Description of Artificial Sequence: Synthetic peptide
  Seed: TSSFSSTLL (MAGC1_HUMAN)
TTSFSSTLM

SEQ ID NO: 69856 - protein, 8 aa, Artificial Sequence
  Description of Artificial Sequence: Synthetic peptide
  Seed: FSYTLASL (MAGC1_HUMAN)
FAYTLASI

SEQ ID NO: 69857 - protein, 11 aa, Artificial Sequence
  Description of Artificial Sequence: Synthetic peptide
  Seed: STFEGFPQSLL (MAGC1_HUMAN)
SQFEGFPQSLL

SEQ ID NO: 69858 - protein, 10 aa, Artificial Sequence
  Description of Artificial Sequence: Synthetic peptide
  Seed: TGYFPVIFRK (MAGC1_HUMAN)
TMYFPVIFRR

SEQ ID NO: 69859 - protein, 9 aa, Artificial Sequence
  Description of Artificial Sequence: Synthetic peptide
  Seed: YTSSSDTLL (MAGC1_HUMAN)
YSSSSDTLI

SEQ ID NO: 69860 - protein, 10 aa, Artificial Sequence
  Description of Artificial Sequence: Synthetic peptide
  Seed: ISRYTGYFPV (MAGC1_HUMAN)
ISRYTGYFPI

SEQ ID NO: 69861 - protein, 11 aa, Artificial Sequence
  Description of Artificial Sequence: Synthetic peptide
  Seed: IPVSPSSSSTL (MAGC1_HUMAN)
ITVSPSSSSTF

SEQ ID NO: 69862 - protein, 9 aa, Artificial Sequence
  Description of Artificial Sequence: Synthetic peptide
  Seed: VSSSSSSTL (MAGC1_HUMAN)
VASSSSSTM

SEQ ID NO: 69863 - protein, 9 aa, Artificial Sequence
  Description of Artificial Sequence: Synthetic peptide
  Seed: VIKRKVVEF (MAGC1_HUMAN)
VLKRKVVEI

SEQ ID NO: 69864 - protein, 9 aa, Artificial Sequence
  Description of Artificial Sequence: Synthetic peptide
  Seed: LKNTVPITF (MAGC1_HUMAN)
LRNTVPITV

SEQ ID NO: 69865 - protein, 10 aa, Artificial Sequence
  Description of Artificial Sequence: Synthetic peptide
  Seed: FFSYTLASLL (MAGC1_HUMAN)
FHSYTLASLM

SEQ ID NO: 69866 - protein, 9 aa, Artificial Sequence
  Description of Artificial Sequence: Synthetic peptide
  Seed: SAASSSTLV (MAGC1_HUMAN)
SQASSSTLL

SEQ ID NO: 69867 - protein, 10 aa, Artificial Sequence
  Description of Artificial Sequence: Synthetic peptide
  Seed: ASSFFSSALL (MAGC1_HUMAN)
ADSFFSSALF

SEQ ID NO: 69868 - protein, 9 aa, Artificial Sequence
  Description of Artificial Sequence: Synthetic peptide
  Seed: SSPESPLQS (MAGC1_HUMAN)
SSPESPLQV

SEQ ID NO: 69869 - protein, 10 aa, Artificial Sequence
  Description of Artificial Sequence: Synthetic peptide
  Seed: LQIPMTSSFS (MAGC1_HUMAN)
LMIPMTSSFQ

SEQ ID NO: 69870 - protein, 9 aa, Artificial Sequence
  Description of Artificial Sequence: Synthetic peptide
  Seed: YPLQSPQSR (MAGC1_HUMAN)
YPLQSPQSA

SEQ ID NO: 69871 - protein, 9 aa, Artificial Sequence
  Description of Artificial Sequence: Synthetic peptide
  Seed: FSEESSSPV (MAGC1_HUMAN)
FLEESSSPM

SEQ ID NO: 69872 - protein, 11 aa, Artificial Sequence
  Description of Artificial Sequence: Synthetic peptide
  Seed: RPVSSFFSYTL (MAGC1_HUMAN)
RRVSSFFSYTW

SEQ ID NO: 69873 - protein, 11 aa, Artificial Sequence
  Description of Artificial Sequence: Synthetic peptide
  Seed: REVPNSSPPRY (MAGC1_HUMAN)
RQVPNSSPPRY

SEQ ID NO: 69874 - protein, 10 aa, Artificial Sequence
  Description of Artificial Sequence: Synthetic peptide
  Seed: ASSFFSSALL (MAGC1_HUMAN)
AKSFFSSALF

SEQ ID NO: 69875 - protein, 11 aa, Artificial Sequence
  Description of Artificial Sequence: Synthetic peptide
  Seed: LWGPRAHSEVI (MAGC1_HUMAN)
LIGPRAHSEVL

SEQ ID NO: 69876 - protein, 9 aa, Artificial Sequence
  Description of Artificial Sequence: Synthetic peptide
  Seed: VQSPLQNPA (MAGC1_HUMAN)
VLSPLQNPI

SEQ ID NO: 69877 - protein, 10 aa, Artificial Sequence
  Description of Artificial Sequence: Synthetic peptide
  Seed: SQSSPVSSFP (MAGC1_HUMAN)
SKSSPVSSFF

SEQ ID NO: 69878 - protein, 11 aa, Artificial Sequence
  Description of Artificial Sequence: Synthetic peptide
  Seed: EILFGISLREV (MAGC1_HUMAN)
EFLFGISLREV

SEQ ID NO: 69879 - protein, 9 aa, Artificial Sequence
  Description of Artificial Sequence: Synthetic peptide
  Seed: KVVEFLAML (MAGC1_HUMAN)
KIVEFLAMT

SEQ ID NO: 69880 - protein, 9 aa, Artificial Sequence
  Description of Artificial Sequence: Synthetic peptide
  Seed: MSQNRLLIL (MAGC1_HUMAN)
MHQNRLLIF

SEQ ID NO: 69881 - protein, 11 aa, Artificial Sequence
  Description of Artificial Sequence: Synthetic peptide
  Seed: TTDDSTATESA (MAGC1_HUMAN)
TCDDSTATESM

SEQ ID NO: 69882 - protein, 9 aa, Artificial Sequence
  Description of Artificial Sequence: Synthetic peptide
  Seed: YVFVNTLDL (MAGC1_HUMAN)
YAFVNTLDV

SEQ ID NO: 69883 - protein, 10 aa, Artificial Sequence
  Description of Artificial Sequence: Synthetic peptide
  Seed: LILILSIIFI (MAGC1_HUMAN)
LTLILSIIFV

SEQ ID NO: 69884 - protein, 9 aa, Artificial Sequence
  Description of Artificial Sequence: Synthetic peptide
  Seed: LQRPVSSFF (MAGC1_HUMAN)
LIRPVSSFW

SEQ ID NO: 69885 - protein, 9 aa, Artificial Sequence
  Description of Artificial Sequence: Synthetic peptide
  Seed: QIVPSLPEW (MAGC1_HUMAN)
QEVPSLPEY

SEQ ID NO: 69886 - protein, 10 aa, Artificial Sequence
  Description of Artificial Sequence: Synthetic peptide
  Seed: MPTAGMPSLL (MAGC1_HUMAN)
MDTAGMPSLV

SEQ ID NO: 69887 - protein, 9 aa, Artificial Sequence
  Description of Artificial Sequence: Synthetic peptide
  Seed: SSPPRYEFL (MAGC1_HUMAN)
SQPPRYEFM

SEQ ID NO: 69888 - protein, 10 aa, Artificial Sequence
  Description of Artificial Sequence: Synthetic peptide
  Seed: NPASSFFSSA (MAGC1_HUMAN)
NTASSFFSSL

SEQ ID NO: 69889 - protein, 9 aa, Artificial Sequence
  Description of Artificial Sequence: Synthetic peptide
  Seed: SFPSSTSSS (MAGC1_HUMAN)
SAPSSTSSM

SEQ ID NO: 69890 - protein, 11 aa, Artificial Sequence
  Description of Artificial Sequence: Synthetic peptide
  Seed: IPVSSSFSYTL (MAGC1_HUMAN)
IHVSSSFSYTF

SEQ ID NO: 69891 - protein, 9 aa, Artificial Sequence
  Description of Artificial Sequence: Synthetic peptide
  Seed: ASSSTLVSI (MAGC1_HUMAN)
ARSSTLVSL

SEQ ID NO: 69892 - protein, 10 aa, Artificial Sequence
  Description of Artificial Sequence: Synthetic peptide
  Seed: RKVVEFLAML (MAGC1_HUMAN)
RMVVEFLAMA

SEQ ID NO: 69893 - protein, 9 aa, Artificial Sequence
  Description of Artificial Sequence: Synthetic peptide
  Seed: FSSTLLSLF (MAGC1_HUMAN)
FASTLLSLW

SEQ ID NO: 69894 - protein, 8 aa, Artificial Sequence
  Description of Artificial Sequence: Synthetic peptide
  Seed: LQSPVSSF (MAGC1_HUMAN)
LASPVSSY

SEQ ID NO: 69895 - protein, 9 aa, Artificial Sequence
  Description of Artificial Sequence: Synthetic peptide
  Seed: ISRYTGYFP (MAGC1_HUMAN)
IGRYTGYFK

SEQ ID NO: 69896 - protein, 9 aa, Artificial Sequence
  Description of Artificial Sequence: Synthetic peptide
  Seed: ISFSSSTSL (MAGC1_HUMAN)
IIFSSSTSK

SEQ ID NO: 69897 - protein, 10 aa, Artificial Sequence
  Description of Artificial Sequence: Synthetic peptide
  Seed: TTDDSTATES (MAGC1_HUMAN)
TTDDSTATEV

SEQ ID NO: 69898 - protein, 10 aa, Artificial Sequence
  Description of Artificial Sequence: Synthetic peptide
  Seed: ICSSSTSLSL (MAGC1_HUMAN)
ITSSSTSLSM

SEQ ID NO: 69899 - protein, 9 aa, Artificial Sequence
  Description of Artificial Sequence: Synthetic peptide
  Seed: RPVSSFFSY (MAGC1_HUMAN)
RIVSSFFSY

SEQ ID NO: 69900 - protein, 9 aa, Artificial Sequence
  Description of Artificial Sequence: Synthetic peptide
  Seed: RTQSTFEGF (MAGC1_HUMAN)
RFQSTFEGY

SEQ ID NO: 69901 - protein, 9 aa, Artificial Sequence
  Description of Artificial Sequence: Synthetic peptide
  Seed: IPVSRSFSS (MAGC1_HUMAN)
IPVSRSFSL

SEQ ID NO: 69902 - protein, 9 aa, Artificial Sequence
  Description of Artificial Sequence: Synthetic peptide
  Seed: NTVPITFPS (MAGC1_HUMAN)
NGVPITFPK

SEQ ID NO: 69903 - protein, 9 aa, Artificial Sequence
  Description of Artificial Sequence: Synthetic peptide
  Seed: SPLQRPVSS (MAGC1_HUMAN)
SPLQRPVSI

SEQ ID NO: 69904 - protein, 10 aa, Artificial Sequence
  Description of Artificial Sequence: Synthetic peptide
  Seed: TLDEKVDELA (MAGC1_HUMAN)
TSDEKVDELM

SEQ ID NO: 69905 - protein, 9 aa, Artificial Sequence
  Description of Artificial Sequence: Synthetic peptide
  Seed: FPQSVLQIP (MAGC1_HUMAN)
FPQSVLQIA

SEQ ID NO: 69906 - protein, 10 aa, Artificial Sequence
  Description of Artificial Sequence: Synthetic peptide
  Seed: GPVQSPLHSP (MAGC1_HUMAN)
GPVQSPLHSA

SEQ ID NO: 69907 - protein, 9 aa, Artificial Sequence
  Description of Artificial Sequence: Synthetic peptide
  Seed: LQIPMTSSF (MAGC1_HUMAN)
LLIPMTSSY

SEQ ID NO: 69908 - protein, 9 aa, Artificial Sequence
  Description of Artificial Sequence: Synthetic peptide
  Seed: FSYTLLSLF (MAGC1_HUMAN)
FVYTLLSLF

SEQ ID NO: 69909 - protein, 10 aa, Artificial Sequence
  Description of Artificial Sequence: Synthetic peptide
  Seed: PLQRPVSSFF (MAGC1_HUMAN)
PYQRPVSSFY

SEQ ID NO: 69910 - protein, 9 aa, Artificial Sequence
  Description of Artificial Sequence: Synthetic peptide
  Seed: SSPERTQST (MAGC1_HUMAN)
SQPERTQSV

SEQ ID NO: 69911 - protein, 9 aa, Artificial Sequence
  Description of Artificial Sequence: Synthetic peptide
  Seed: SPPEGENTH (MAGC1_HUMAN)
SAPEGENTM

SEQ ID NO: 69912 - protein, 10 aa, Artificial Sequence
  Description of Artificial Sequence: Synthetic peptide
  Seed: SSPESTQSPF (MAGC1_HUMAN)
SDPESTQSPM

SEQ ID NO: 69913 - protein, 11 aa, Artificial Sequence
  Description of Artificial Sequence: Synthetic peptide
  Seed: IKRKVVEFLAM (MAGC1_HUMAN)
IMRKVVEFLAY

SEQ ID NO: 69914 - protein, 10 aa, Artificial Sequence
  Description of Artificial Sequence: Synthetic peptide
  Seed: FPQSLLQIPM (MAGC1_HUMAN)
FAQSLLQIPF

SEQ ID NO: 69915 - protein, 10 aa, Artificial Sequence
  Description of Artificial Sequence: Synthetic peptide
  Seed: LLQIPMTSSF (MAGC1_HUMAN)
LEQIPMTSSF

SEQ ID NO: 69916 - protein, 10 aa, Artificial Sequence
  Description of Artificial Sequence: Synthetic peptide
  Seed: FFSYTLASLL (MAGC1_HUMAN)
FVSYTLASLF

SEQ ID NO: 69917 - protein, 11 aa, Artificial Sequence
  Description of Artificial Sequence: Synthetic peptide
  Seed: SPLQIPMTSSF (MAGC1_HUMAN)
SRLQIPMTSSM

SEQ ID NO: 69918 - protein, 9 aa, Artificial Sequence
  Description of Artificial Sequence: Synthetic peptide
  Seed: SSSSSSSTL (MAGC1_HUMAN)
STSSSSSTY

SEQ ID NO: 69919 - protein, 10 aa, Artificial Sequence
  Description of Artificial Sequence: Synthetic peptide
  Seed: FQSSLQSPVS (MAGC1_HUMAN)
FVSSLQSPVI

SEQ ID NO: 69920 - protein, 11 aa, Artificial Sequence
  Description of Artificial Sequence: Synthetic peptide
  Seed: SLREVDPDDSY (MAGC1_HUMAN)
SQREVDPDDSW

SEQ ID NO: 69921 - protein, 9 aa, Artificial Sequence
  Description of Artificial Sequence: Synthetic peptide
  Seed: VSSSFSYTL (MAGC1_HUMAN)
VLSSFSYTC

SEQ ID NO: 69922 - protein, 9 aa, Artificial Sequence
  Description of Artificial Sequence: Synthetic peptide
  Seed: LQIPMTSSF (MAGC1_HUMAN)
LAIPMTSSY

SEQ ID NO: 69923 - protein, 10 aa, Artificial Sequence
  Description of Artificial Sequence: Synthetic peptide
  Seed: SSPESTQSPF (MAGC1_HUMAN)
SYPESTQSPL

SEQ ID NO: 69924 - protein, 10 aa, Artificial Sequence
  Description of Artificial Sequence: Synthetic peptide
  Seed: MTSSFSSTLL (MAGC1_HUMAN)
MQSSFSSTLF

SEQ ID NO: 69925 - protein, 10 aa, Artificial Sequence
  Description of Artificial Sequence: Synthetic peptide
  Seed: KVVEFLAMLK (MAGC1_HUMAN)
KHVEFLAMLR

SEQ ID NO: 69926 - protein, 10 aa, Artificial Sequence
  Description of Artificial Sequence: Synthetic peptide
  Seed: SSPPRYEFLW (MAGC1_HUMAN)
SVPPRYEFLF

SEQ ID NO: 69927 - protein, 9 aa, Artificial Sequence
  Description of Artificial Sequence: Synthetic peptide
  Seed: SFSYTLLSL (MAGC1_HUMAN)
SYSYTLLSW

SEQ ID NO: 69928 - protein, 9 aa, Artificial Sequence
  Description of Artificial Sequence: Synthetic peptide
  Seed: SSSSTLLSL (MAGC1_HUMAN)
STSSTLLSL

SEQ ID NO: 69929 - protein, 9 aa, Artificial Sequence
  Description of Artificial Sequence: Synthetic peptide
  Seed: ISRYTGYFP (MAGC1_HUMAN)
IYRYTGYFA

SEQ ID NO: 69930 - protein, 9 aa, Artificial Sequence
  Description of Artificial Sequence: Synthetic peptide
  Seed: SSSTSLSPF (MAGC1_HUMAN)
SQSTSLSPY

SEQ ID NO: 69931 - protein, 9 aa, Artificial Sequence
  Description of Artificial Sequence: Synthetic peptide
  Seed: ESSSPVDEY (MAGC1_HUMAN)
ETSSPVDEK

SEQ ID NO: 69932 - protein, 10 aa, Artificial Sequence
  Description of Artificial Sequence: Synthetic peptide
  Seed: TGYFPVIFRK (MAGC1_HUMAN)
TFYFPVIFRR

SEQ ID NO: 69933 - protein, 9 aa, Artificial Sequence
  Description of Artificial Sequence: Synthetic peptide
  Seed: LQIPVSPSF (MAGC1_HUMAN)
LRIPVSPSI

SEQ ID NO: 69934 - protein, 10 aa, Artificial Sequence
  Description of Artificial Sequence: Synthetic peptide
  Seed: FFSSALLSIF (MAGC1_HUMAN)
FNSSALLSIF

SEQ ID NO: 69935 - protein, 9 aa, Artificial Sequence
  Description of Artificial Sequence: Synthetic peptide
  Seed: DSYVFVNTL (MAGC1_HUMAN)
DAYVFVNTF

SEQ ID NO: 69936 - protein, 10 aa, Artificial Sequence
  Description of Artificial Sequence: Synthetic peptide
  Seed: RPVSSFFSYT (MAGC1_HUMAN)
REVSSFFSYK

SEQ ID NO: 69937 - protein, 9 aa, Artificial Sequence
  Description of Artificial Sequence: Synthetic peptide
  Seed: LSDEQGMSQ (MAGC1_HUMAN)
LLDEQGMSF

SEQ ID NO: 69938 - protein, 10 aa, Artificial Sequence
  Description of Artificial Sequence: Synthetic peptide
  Seed: FSSSTSLSPF (MAGC1_HUMAN)
FVSSTSLSPY

SEQ ID NO: 69939 - protein, 9 aa, Artificial Sequence
  Description of Artificial Sequence: Synthetic peptide
  Seed: SKSSPESPL (MAGC1_HUMAN)
SRSSPESPY

SEQ ID NO: 69940 - protein, 10 aa, Artificial Sequence
  Description of Artificial Sequence: Synthetic peptide
  Seed: ESTQSPFEGF (MAGC1_HUMAN)
EVTQSPFEGW

SEQ ID NO: 69941 - protein, 10 aa, Artificial Sequence
  Description of Artificial Sequence: Synthetic peptide
  Seed: RSFSSTLLSI (MAGC1_HUMAN)
RVFSSTLLSY

SEQ ID NO: 69942 - protein, 9 aa, Artificial Sequence
  Description of Artificial Sequence: Synthetic peptide
  Seed: SSHESPQSP (MAGC1_HUMAN)
SSHESPQSI

SEQ ID NO: 69943 - protein, 9 aa, Artificial Sequence
  Description of Artificial Sequence: Synthetic peptide
  Seed: YTSSSDTLL (MAGC1_HUMAN)
YVSSSDTLA

SEQ ID NO: 69944 - protein, 10 aa, Artificial Sequence
  Description of Artificial Sequence: Synthetic peptide
  Seed: IIDTTDDSTA (MAGC1_HUMAN)
ILDTTDDSTF

SEQ ID NO: 69945 - protein, 9 aa, Artificial Sequence
  Description of Artificial Sequence: Synthetic peptide
  Seed: VSPSSSSTL (MAGC1_HUMAN)
VFPSSSSTL

SEQ ID NO: 69946 - protein, 9 aa, Artificial Sequence
  Description of Artificial Sequence: Synthetic peptide
  Seed: KQPITKAEM (MAGC1_HUMAN)
KAPITKAEV

SEQ ID NO: 69947 - protein, 11 aa, Artificial Sequence
  Description of Artificial Sequence: Synthetic peptide
  Seed: SAASSSTLVSI (MAGC1_HUMAN)
STASSSTLVSW

SEQ ID NO: 69948 - protein, 9 aa, Artificial Sequence
  Description of Artificial Sequence: Synthetic peptide
  Seed: STFEGFAQS (MAGC1_HUMAN)
SLFEGFAQC

SEQ ID NO: 69949 - protein, 10 aa, Artificial Sequence
  Description of Artificial Sequence: Synthetic peptide
  Seed: SSFSYTLLSL (MAGC1_HUMAN)
SHFSYTLLSM

SEQ ID NO: 69950 - protein, 10 aa, Artificial Sequence
  Description of Artificial Sequence: Synthetic peptide
  Seed: VRAGREHFAF (MAGC1_HUMAN)
VMAGREHFAY

SEQ ID NO: 69951 - protein, 11 aa, Artificial Sequence
  Description of Artificial Sequence: Synthetic peptide
  Seed: SSFPSSTSSSL (MAGC1_HUMAN)
SIFPSSTSSSM

SEQ ID NO: 69952 - protein, 11 aa, Artificial Sequence
  Description of Artificial Sequence: Synthetic peptide
  Seed: SSTPSSLPQSF (MAGC1_HUMAN)
SMTPSSLPQSF

SEQ ID NO: 69953 - protein, 9 aa, Artificial Sequence
  Description of Artificial Sequence: Synthetic peptide
  Seed: VSRSFSSTL (MAGC1_HUMAN)
VSRSFSSTM

SEQ ID NO: 69954 - protein, 10 aa, Artificial Sequence
  Description of Artificial Sequence: Synthetic peptide
  Seed: ICSSSTPSSL (MAGC1_HUMAN)
IFSSSTPSSF

SEQ ID NO: 69955 - protein, 11 aa, Artificial Sequence
  Description of Artificial Sequence: Synthetic peptide
  Seed: SPLQIPGSPSF (MAGC1_HUMAN)
SELQIPGSPSM

SEQ ID NO: 69956 - protein, 10 aa, Artificial Sequence
  Description of Artificial Sequence: Synthetic peptide
  Seed: PLQIPVSSSF (MAGC1_HUMAN)
PFQIPVSSSY

SEQ ID NO: 69957 - protein, 9 aa, Artificial Sequence
  Description of Artificial Sequence: Synthetic peptide
  Seed: SQSSPVSSF (MAGC1_HUMAN)
SVSSPVSSI

SEQ ID NO: 69958 - protein, 11 aa, Artificial Sequence
  Description of Artificial Sequence: Synthetic peptide
  Seed: GPAQSPLQSPV (MAGC1_HUMAN)
GPAQSPLQSPL

SEQ ID NO: 69959 - protein, 9 aa, Artificial Sequence
  Description of Artificial Sequence: Synthetic peptide
  Seed: LSDEQGMSQ (MAGC1_HUMAN)
LIDEQGMSC

SEQ ID NO: 69960 - protein, 9 aa, Artificial Sequence
  Description of Artificial Sequence: Synthetic peptide
  Seed: TESASSSVM (MAGC1_HUMAN)
TRSASSSVF

SEQ ID NO: 69961 - protein, 10 aa, Artificial Sequence
  Description of Artificial Sequence: Synthetic peptide
  Seed: SSFPSSTSSS (MAGC1_HUMAN)
SAFPSSTSSH

SEQ ID NO: 69962 - protein, 10 aa, Artificial Sequence
  Description of Artificial Sequence: Synthetic peptide
  Seed: TTDDSTATES (MAGC1_HUMAN)
TIDDSTATEF

SEQ ID NO: 69963 - protein, 9 aa, Artificial Sequence
  Description of Artificial Sequence: Synthetic peptide
  Seed: ESDDTLYPL (MAGC1_HUMAN)
ESDDTLYPV

SEQ ID NO: 69964 - protein, 9 aa, Artificial Sequence
  Description of Artificial Sequence: Synthetic peptide
  Seed: LQNPASSFF (MAGC1_HUMAN)
LHNPASSFI

SEQ ID NO: 69965 - protein, 9 aa, Artificial Sequence
  Description of Artificial Sequence: Synthetic peptide
  Seed: RAHSEVIKR (MAGC1_HUMAN)
RSHSEVIKY

SEQ ID NO: 69966 - protein, 10 aa, Artificial Sequence
  Description of Artificial Sequence: Synthetic peptide
  Seed: YASEEVIWDV (MAGC1_HUMAN)
YVSEEVIWDI

SEQ ID NO: 69967 - protein, 10 aa, Artificial Sequence
  Description of Artificial Sequence: Synthetic peptide
  Seed: VSICSSSTSL (MAGC1_HUMAN)
VQICSSSTSY

SEQ ID NO: 69968 - protein, 10 aa, Artificial Sequence
  Description of Artificial Sequence: Synthetic peptide
  Seed: YTLASLLQSS (MAGC1_HUMAN)
YDLASLLQSA

SEQ ID NO: 69969 - protein, 10 aa, Artificial Sequence
  Description of Artificial Sequence: Synthetic peptide
  Seed: QGEDSMSPLY (MAGC1_HUMAN)
QMEDSMSPLY

SEQ ID NO: 69970 - protein, 9 aa, Artificial Sequence
  Description of Artificial Sequence: Synthetic peptide
  Seed: SSPERTHST (MAGC1_HUMAN)
SRPERTHSM

SEQ ID NO: 69971 - protein, 9 aa, Artificial Sequence
  Description of Artificial Sequence: Synthetic peptide
  Seed: CTQSTFEGF (MAGC1_HUMAN)
CFQSTFEGF

SEQ ID NO: 69972 - protein, 10 aa, Artificial Sequence
  Description of Artificial Sequence: Synthetic peptide
  Seed: FSSSTSLSPF (MAGC1_HUMAN)
FMSSTSLSPF

SEQ ID NO: 69973 - protein, 10 aa, Artificial Sequence
  Description of Artificial Sequence: Synthetic peptide
  Seed: YTLASLLQSS (MAGC1_HUMAN)
YKLASLLQSA

SEQ ID NO: 69974 - protein, 8 aa, Artificial Sequence
  Description of Artificial Sequence: Synthetic peptide
  Seed: FSYTLASL (MAGC1_HUMAN)
FTYTLASW

SEQ ID NO: 69975 - protein, 10 aa, Artificial Sequence
  Description of Artificial Sequence: Synthetic peptide
  Seed: KVVEFLAMLK (MAGC1_HUMAN)
KQVEFLAMLL

SEQ ID NO: 69976 - protein, 11 aa, Artificial Sequence
  Description of Artificial Sequence: Synthetic peptide
  Seed: REVPNSSPPRY (MAGC1_HUMAN)
RKVPNSSPPRF

SEQ ID NO: 69977 - protein, 9 aa, Artificial Sequence
  Description of Artificial Sequence: Synthetic peptide
  Seed: SSPPRYEFL (MAGC1_HUMAN)
SRPPRYEFF

SEQ ID NO: 69978 - protein, 9 aa, Artificial Sequence
  Description of Artificial Sequence: Synthetic peptide
  Seed: ISFSSSTSL (MAGC1_HUMAN)
INFSSSTSM

SEQ ID NO: 69979 - protein, 9 aa, Artificial Sequence
  Description of Artificial Sequence: Synthetic peptide
  Seed: SSSSTLLSL (MAGC1_HUMAN)
SMSSTLLSI

SEQ ID NO: 69980 - protein, 10 aa, Artificial Sequence
  Description of Artificial Sequence: Synthetic peptide
  Seed: SFFSYTLASL (MAGC1_HUMAN)
SYFSYTLASV

SEQ ID NO: 69981 - protein, 9 aa, Artificial Sequence
  Description of Artificial Sequence: Synthetic peptide
  Seed: QSPLQGEEF (MAGC1_HUMAN)
QAPLQGEEL

SEQ ID NO: 69982 - protein, 9 aa, Artificial Sequence
  Description of Artificial Sequence: Synthetic peptide
  Seed: FSSTLVSLF (MAGC1_HUMAN)
FWSTLVSLM

SEQ ID NO: 69983 - protein, 9 aa, Artificial Sequence
  Description of Artificial Sequence: Synthetic peptide
  Seed: SQNRLLILI (MAGC1_HUMAN)
SMNRLLILA

SEQ ID NO: 69984 - protein, 9 aa, Artificial Sequence
  Description of Artificial Sequence: Synthetic peptide
  Seed: TPSSLPQSF (MAGC1_HUMAN)
TASSLPQSW

SEQ ID NO: 69985 - protein, 8 aa, Artificial Sequence
  Description of Artificial Sequence: Synthetic peptide
  Seed: LQSPVISF (MAGC1_HUMAN)
LMSPVISF

SEQ ID NO: 69986 - protein, 10 aa, Artificial Sequence
  Description of Artificial Sequence: Synthetic peptide
  Seed: VSSSFSYTLL (MAGC1_HUMAN)
VQSSFSYTLW

SEQ ID NO: 69987 - protein, 9 aa, Artificial Sequence
  Description of Artificial Sequence: Synthetic peptide
  Seed: FLWGPRAHS (MAGC1_HUMAN)
FAWGPRAHV

SEQ ID NO: 69988 - protein, 10 aa, Artificial Sequence
  Description of Artificial Sequence: Synthetic peptide
  Seed: EVIWDVLSGI (MAGC1_HUMAN)
EEIWDVLSGV

SEQ ID NO: 69989 - protein, 11 aa, Artificial Sequence
  Description of Artificial Sequence: Synthetic peptide
  Seed: IPVSAASSSTL (MAGC1_HUMAN)
IPVSAASSSTA

SEQ ID NO: 69990 - protein, 9 aa, Artificial Sequence
  Description of Artificial Sequence: Synthetic peptide
  Seed: DELARFLLL (MAGC1_HUMAN)
DHLARFLLL

SEQ ID NO: 69991 - protein, 9 aa, Artificial Sequence
  Description of Artificial Sequence: Synthetic peptide
  Seed: LQIPVSRSF (MAGC1_HUMAN)
LPIPVSRSF

SEQ ID NO: 69992 - protein, 10 aa, Artificial Sequence
  Description of Artificial Sequence: Synthetic peptide
  Seed: SFPSSTSSSL (MAGC1_HUMAN)
SGPSSTSSSM

SEQ ID NO: 69993 - protein, 10 aa, Artificial Sequence
  Description of Artificial Sequence: Synthetic peptide
  Seed: FQSSLQSPVS (MAGC1_HUMAN)
FMSSLQSPVH

SEQ ID NO: 69994 - protein, 10 aa, Artificial Sequence
  Description of Artificial Sequence: Synthetic peptide
  Seed: SQSPPEGEDV (MAGC1_HUMAN)
SMSPPEGEDF

SEQ ID NO: 69995 - protein, 10 aa, Artificial Sequence
  Description of Artificial Sequence: Synthetic peptide
  Seed: VISFSSSTSL (MAGC1_HUMAN)
VYSFSSSTSF

SEQ ID NO: 69996 - protein, 9 aa, Artificial Sequence
  Description of Artificial Sequence: Synthetic peptide
  Seed: FQSSPERTH (MAGC1_HUMAN)
FISSPERTF

SEQ ID NO: 69997 - protein, 9 aa, Artificial Sequence
  Description of Artificial Sequence: Synthetic peptide
  Seed: SSSDTLLES (MAGC1_HUMAN)
SSSDTLLEM

SEQ ID NO: 69998 - protein, 9 aa, Artificial Sequence
  Description of Artificial Sequence: Synthetic peptide
  Seed: TTDDSTATE (MAGC1_HUMAN)
TADDSTATV

SEQ ID NO: 69999 - protein, 10 aa, Artificial Sequence
  Description of Artificial Sequence: Synthetic peptide
  Seed: KAREFIEILF (MAGC1_HUMAN)
KIREFIEILK

SEQ ID NO: 70000 - protein, 10 aa, Artificial Sequence
  Description of Artificial Sequence: Synthetic peptide
  Seed: SFSYTLLSLF (MAGC1_HUMAN)
SRSYTLLSLF

SEQ ID NO: 70001 - protein, 10 aa, Artificial Sequence
  Description of Artificial Sequence: Synthetic peptide
  Seed: SSPERTHSTF (MAGC1_HUMAN)
SIPERTHSTI

SEQ ID NO: 70002 - protein, 10 aa, Artificial Sequence
  Description of Artificial Sequence: Synthetic peptide
  Seed: SSFPSSTSSS (MAGC1_HUMAN)
SIFPSSTSSL

SEQ ID NO: 70003 - protein, 10 aa, Artificial Sequence
  Description of Artificial Sequence: Synthetic peptide
  Seed: RAGREHFAFG (MAGC1_HUMAN)
RMGREHFAFV

SEQ ID NO: 70004 - protein, 11 aa, Artificial Sequence
  Description of Artificial Sequence: Synthetic peptide
  Seed: EILFGISLREV (MAGC1_HUMAN)
ELLFGISLREV

SEQ ID NO: 70005 - protein, 11 aa, Artificial Sequence
  Description of Artificial Sequence: Synthetic peptide
  Seed: RPVSSFFSYTL (MAGC1_HUMAN)
RAVSSFFSYTY

SEQ ID NO: 70006 - protein, 9 aa, Artificial Sequence
  Description of Artificial Sequence: Synthetic peptide
  Seed: SSTSSSLSK (MAGC1_HUMAN)
STTSSSLSF

SEQ ID NO: 70007 - protein, 9 aa, Artificial Sequence
  Description of Artificial Sequence: Synthetic peptide
  Seed: NSSPPRYEF (MAGC1_HUMAN)
NWSPPRYEY

SEQ ID NO: 70008 - protein, 11 aa, Artificial Sequence
  Description of Artificial Sequence: Synthetic peptide
  Seed: SPLQRPVSSFF (MAGC1_HUMAN)
SPLQRPVSSFL

SEQ ID NO: 70009 - protein, 9 aa, Artificial Sequence
  Description of Artificial Sequence: Synthetic peptide
  Seed: EMLTNVISR (MAGC1_HUMAN)
EMLTNVISK

SEQ ID NO: 70010 - protein, 11 aa, Artificial Sequence
  Description of Artificial Sequence: Synthetic peptide
  Seed: SSFSYTLLSLF (MAGC1_HUMAN)
SHFSYTLLSLY

SEQ ID NO: 70011 - protein, 9 aa, Artificial Sequence
  Description of Artificial Sequence: Synthetic peptide
  Seed: TLDLTSEGC (MAGC1_HUMAN)
TCDLTSEGL

SEQ ID NO: 70012 - protein, 10 aa, Artificial Sequence
  Description of Artificial Sequence: Synthetic peptide
  Seed: REFIEILFGI (MAGC1_HUMAN)
RLFIEILFGF

SEQ ID NO: 70013 - protein, 10 aa, Artificial Sequence
  Description of Artificial Sequence: Synthetic peptide
  Seed: YTLLSLFQSS (MAGC1_HUMAN)
YALLSLFQSL

SEQ ID NO: 70014 - protein, 9 aa, Artificial Sequence
  Description of Artificial Sequence: Synthetic peptide
  Seed: SLFQSFSER (MAGC1_HUMAN)
STFQSFSEH

SEQ ID NO: 70015 - protein, 9 aa, Artificial Sequence
  Description of Artificial Sequence: Synthetic peptide
  Seed: SSFFSSALL (MAGC1_HUMAN)
STFFSSALV

SEQ ID NO: 70016 - protein, 9 aa, Artificial Sequence
  Description of Artificial Sequence: Synthetic peptide
  Seed: TLLSLFQSF (MAGC1_HUMAN)
THLSLFQSY

SEQ ID NO: 70017 - protein, 9 aa, Artificial Sequence
  Description of Artificial Sequence: Synthetic peptide
  Seed: VSSSFSYTL (MAGC1_HUMAN)
VWSSFSYTL

SEQ ID NO: 70018 - protein, 9 aa, Artificial Sequence
  Description of Artificial Sequence: Synthetic peptide
  Seed: RPVSSFFSY (MAGC1_HUMAN)
RKVSSFFSH

SEQ ID NO: 70019 - protein, 9 aa, Artificial Sequence
  Description of Artificial Sequence: Synthetic peptide
  Seed: LASLLQSSH (MAGC1_HUMAN)
LASLLQSSF

SEQ ID NO: 70020 - protein, 10 aa, Artificial Sequence
  Description of Artificial Sequence: Synthetic peptide
  Seed: LQIVPSLPEW (MAGC1_HUMAN)
LLIVPSLPEM

SEQ ID NO: 70021 - protein, 10 aa, Artificial Sequence
  Description of Artificial Sequence: Synthetic peptide
  Seed: LSLFQSFSER (MAGC1_HUMAN)
LALFQSFSER

SEQ ID NO: 70022 - protein, 10 aa, Artificial Sequence
  Description of Artificial Sequence: Synthetic peptide
  Seed: SSPERTHSTF (MAGC1_HUMAN)
SGPERTHSTM

SEQ ID NO: 70023 - protein, 9 aa, Artificial Sequence
  Description of Artificial Sequence: Synthetic peptide
  Seed: LQIVPSLPE (MAGC1_HUMAN)
LNIVPSLPY

SEQ ID NO: 70024 - protein, 10 aa, Artificial Sequence
  Description of Artificial Sequence: Synthetic peptide
  Seed: YTLLSLFQSS (MAGC1_HUMAN)
YFLLSLFQSI

SEQ ID NO: 70025 - protein, 9 aa, Artificial Sequence
  Description of Artificial Sequence: Synthetic peptide
  Seed: DELARFLLL (MAGC1_HUMAN)
DLLARFLLL

SEQ ID NO: 70026 - protein, 9 aa, Artificial Sequence
  Description of Artificial Sequence: Synthetic peptide
  Seed: WVQEHYLEY (MAGC1_HUMAN)
WAQEHYLEI

SEQ ID NO: 70027 - protein, 10 aa, Artificial Sequence
  Description of Artificial Sequence: Synthetic peptide
  Seed: LQIPVSSSFS (MAGC1_HUMAN)
LQIPVSSSFL

SEQ ID NO: 70028 - protein, 10 aa, Artificial Sequence
  Description of Artificial Sequence: Synthetic peptide
  Seed: EVIWDVLSGI (MAGC1_HUMAN)
ENIWDVLSGI

SEQ ID NO: 70029 - protein, 10 aa, Artificial Sequence
  Description of Artificial Sequence: Synthetic peptide
  Seed: SSPESDDTLY (MAGC1_HUMAN)
STPESDDTLY

SEQ ID NO: 70030 - protein, 9 aa, Artificial Sequence
  Description of Artificial Sequence: Synthetic peptide
  Seed: LKYQVKQPI (MAGC1_HUMAN)
LKYQVKQPY

SEQ ID NO: 70031 - protein, 9 aa, Artificial Sequence
  Description of Artificial Sequence: Synthetic peptide
  Seed: VIFRKAREF (MAGC1_HUMAN)
VSFRKAREF

SEQ ID NO: 70032 - protein, 10 aa, Artificial Sequence
  Description of Artificial Sequence: Synthetic peptide
  Seed: SSFSSTLLSI (MAGC1_HUMAN)
SVFSSTLLSY

SEQ ID NO: 70033 - protein, 9 aa, Artificial Sequence
  Description of Artificial Sequence: Synthetic peptide
  Seed: VSSFFSYTL (MAGC1_HUMAN)
VYSFFSYTY

SEQ ID NO: 70034 - protein, 11 aa, Artificial Sequence
  Description of Artificial Sequence: Synthetic peptide
  Seed: TTDDSTATESA (MAGC1_HUMAN)
TTDDSTATESV

SEQ ID NO: 70035 - protein, 10 aa, Artificial Sequence
  Description of Artificial Sequence: Synthetic peptide
  Seed: KVVEFLAMLK (MAGC1_HUMAN)
KVVEFLAMLR

SEQ ID NO: 70036 - protein, 10 aa, Artificial Sequence
  Description of Artificial Sequence: Synthetic peptide
  Seed: RKAREFIEIL (MAGC1_HUMAN)
RQAREFIEIM

SEQ ID NO: 70037 - protein, 9 aa, Artificial Sequence
  Description of Artificial Sequence: Synthetic peptide
  Seed: SRSFSSTLL (MAGC1_HUMAN)
SMSFSSTLF

SEQ ID NO: 70038 - protein, 9 aa, Artificial Sequence
  Description of Artificial Sequence: Synthetic peptide
  Seed: FFSYTLASL (MAGC1_HUMAN)
FVSYTLASY

SEQ ID NO: 70039 - protein, 9 aa, Artificial Sequence
  Description of Artificial Sequence: Synthetic peptide
  Seed: FSSTLLSLF (MAGC1_HUMAN)
FPSTLLSLV

SEQ ID NO: 70040 - protein, 9 aa, Artificial Sequence
  Description of Artificial Sequence: Synthetic peptide
  Seed: STFEGFAQS (MAGC1_HUMAN)
SLFEGFAQA

SEQ ID NO: 70041 - protein, 11 aa, Artificial Sequence
  Description of Artificial Sequence: Synthetic peptide
  Seed: IPVSSSFSYTL (MAGC1_HUMAN)
IWVSSSFSYTW

SEQ ID NO: 70042 - protein, 9 aa, Artificial Sequence
  Description of Artificial Sequence: Synthetic peptide
  Seed: SSSSSSSTL (MAGC1_HUMAN)
SRSSSSSTM

SEQ ID NO: 70043 - protein, 9 aa, Artificial Sequence
  Description of Artificial Sequence: Synthetic peptide
  Seed: CSSSTSLSL (MAGC1_HUMAN)
CSSSTSLSW

SEQ ID NO: 70044 - protein, 9 aa, Artificial Sequence
  Description of Artificial Sequence: Synthetic peptide
  Seed: SSPESDDTL (MAGC1_HUMAN)
SIPESDDTM

SEQ ID NO: 70045 - protein, 9 aa, Artificial Sequence
  Description of Artificial Sequence: Synthetic peptide
  Seed: SSPESPLQS (MAGC1_HUMAN)
SFPESPLQL

SEQ ID NO: 70046 - protein, 11 aa, Artificial Sequence
  Description of Artificial Sequence: Synthetic peptide
  Seed: STFEGFPQSLL (MAGC1_HUMAN)
SMFEGFPQSLN

SEQ ID NO: 70047 - protein, 10 aa, Artificial Sequence
  Description of Artificial Sequence: Synthetic peptide
  Seed: FFSYTLASLL (MAGC1_HUMAN)
FVSYTLASLL

SEQ ID NO: 70048 - protein, 11 aa, Artificial Sequence
  Description of Artificial Sequence: Synthetic peptide
  Seed: EILFGISLREV (MAGC1_HUMAN)
EFLFGISLREA

SEQ ID NO: 70049 - protein, 9 aa, Artificial Sequence
  Description of Artificial Sequence: Synthetic peptide
  Seed: LQIPVSPSF (MAGC1_HUMAN)
LIIPVSPSV

SEQ ID NO: 70050 - protein, 9 aa, Artificial Sequence
  Description of Artificial Sequence: Synthetic peptide
  Seed: FTYTLDEKV (MAGC1_HUMAN)
FAYTLDEKY

SEQ ID NO: 70051 - protein, 9 aa, Artificial Sequence
  Description of Artificial Sequence: Synthetic peptide
  Seed: ISFSSSTSL (MAGC1_HUMAN)
ITFSSSTSK

SEQ ID NO: 70052 - protein, 10 aa, Artificial Sequence
  Description of Artificial Sequence: Synthetic peptide
  Seed: MSPLYFPQSP (MAGC1_HUMAN)
MVPLYFPQSV

SEQ ID NO: 70053 - protein, 9 aa, Artificial Sequence
  Description of Artificial Sequence: Synthetic peptide
  Seed: VIKRKVVEF (MAGC1_HUMAN)
VMKRKVVEL

SEQ ID NO: 70054 - protein, 11 aa, Artificial Sequence
  Description of Artificial Sequence: Synthetic peptide
  Seed: IPVSSSFSYTL (MAGC1_HUMAN)
IEVSSSFSYTY

SEQ ID NO: 70055 - protein, 10 aa, Artificial Sequence
  Description of Artificial Sequence: Synthetic peptide
  Seed: SMSPLYFPQS (MAGC1_HUMAN)
SMSPLYFPQI

SEQ ID NO: 70056 - protein, 10 aa, Artificial Sequence
  Description of Artificial Sequence: Synthetic peptide
  Seed: SSFSYTLLSL (MAGC1_HUMAN)
SSFSYTLLSF

SEQ ID NO: 70057 - protein, 9 aa, Artificial Sequence
  Description of Artificial Sequence: Synthetic peptide
  Seed: TLLSILQSS (MAGC1_HUMAN)
TLLSILQSL

SEQ ID NO: 70058 - protein, 9 aa, Artificial Sequence
  Description of Artificial Sequence: Synthetic peptide
  Seed: SPPEGENTH (MAGC1_HUMAN)
SAPEGENTL

SEQ ID NO: 70059 - protein, 9 aa, Artificial Sequence
  Description of Artificial Sequence: Synthetic peptide
  Seed: KDSQSPLQI (MAGC1_HUMAN)
KLSQSPLQV

SEQ ID NO: 70060 - protein, 9 aa, Artificial Sequence
  Description of Artificial Sequence: Synthetic peptide
  Seed: SFFSYTLAS (MAGC1_HUMAN)
SYFSYTLAV

SEQ ID NO: 70061 - protein, 9 aa, Artificial Sequence
  Description of Artificial Sequence: Synthetic peptide
  Seed: SIIFIKGTY (MAGC1_HUMAN)
SLIFIKGTY

SEQ ID NO: 70062 - protein, 10 aa, Artificial Sequence
  Description of Artificial Sequence: Synthetic peptide
  Seed: FAFGEPRELL (MAGC1_HUMAN)
FTFGEPRELY

SEQ ID NO: 70063 - protein, 10 aa, Artificial Sequence
  Description of Artificial Sequence: Synthetic peptide
  Seed: MTSSFSSTLL (MAGC1_HUMAN)
MWSSFSSTLM

SEQ ID NO: 70064 - protein, 10 aa, Artificial Sequence
  Description of Artificial Sequence: Synthetic peptide
  Seed: STPSSLPQSF (MAGC1_HUMAN)
SVPSSLPQSI

SEQ ID NO: 70065 - protein, 9 aa, Artificial Sequence
  Description of Artificial Sequence: Synthetic peptide
  Seed: GVRAGREHF (MAGC1_HUMAN)
GTRAGREHY

SEQ ID NO: 70066 - protein, 10 aa, Artificial Sequence
  Description of Artificial Sequence: Synthetic peptide
  Seed: NRLLILILSI (MAGC1_HUMAN)
NRLLILILSV

SEQ ID NO: 70067 - protein, 9 aa, Artificial Sequence
  Description of Artificial Sequence: Synthetic peptide
  Seed: SSPEGKDSL (MAGC1_HUMAN)
SQPEGKDSF

SEQ ID NO: 70068 - protein, 11 aa, Artificial Sequence
  Description of Artificial Sequence: Synthetic peptide
  Seed: IPVSAASSSTL (MAGC1_HUMAN)
ISVSAASSSTM

SEQ ID NO: 70069 - protein, 9 aa, Artificial Sequence
  Description of Artificial Sequence: Synthetic peptide
  Seed: YVFVNTLDL (MAGC1_HUMAN)
YHFVNTLDY

SEQ ID NO: 70070 - protein, 10 aa, Artificial Sequence
  Description of Artificial Sequence: Synthetic peptide
  Seed: SSSSSTLLSL (MAGC1_HUMAN)
SDSSSTLLSF

SEQ ID NO: 70071 - protein, 9 aa, Artificial Sequence
  Description of Artificial Sequence: Synthetic peptide
  Seed: TTDDSTATE (MAGC1_HUMAN)
TTDDSTATC

SEQ ID NO: 70072 - protein, 9 aa, Artificial Sequence
  Description of Artificial Sequence: Synthetic peptide
  Seed: ASSSTLVSI (MAGC1_HUMAN)
AVSSTLVSF

SEQ ID NO: 70073 - protein, 9 aa, Artificial Sequence
  Description of Artificial Sequence: Synthetic peptide
  Seed: CSSSTPSSL (MAGC1_HUMAN)
CTSSTPSSW

SEQ ID NO: 70074 - protein, 9 aa, Artificial Sequence
  Description of Artificial Sequence: Synthetic peptide
  Seed: SSSTLLSLF (MAGC1_HUMAN)
SWSTLLSLF

SEQ ID NO: 70075 - protein, 10 aa, Artificial Sequence
  Description of Artificial Sequence: Synthetic peptide
  Seed: RSFSSTLLSI (MAGC1_HUMAN)
RLFSSTLLSL

SEQ ID NO: 70076 - protein, 10 aa, Artificial Sequence
  Description of Artificial Sequence: Synthetic peptide
  Seed: SPLYFPQSPL (MAGC1_HUMAN)
SYLYFPQSPV

SEQ ID NO: 70077 - protein, 9 aa, Artificial Sequence
  Description of Artificial Sequence: Synthetic peptide
  Seed: EILFGISLR (MAGC1_HUMAN)
ELLFGISLK

SEQ ID NO: 70078 - protein, 10 aa, Artificial Sequence
  Description of Artificial Sequence: Synthetic peptide
  Seed: EGPAQSPLQR (MAGC1_HUMAN)
EMPAQSPLQR

SEQ ID NO: 70079 - protein, 9 aa, Artificial Sequence
  Description of Artificial Sequence: Synthetic peptide
  Seed: SSPPRYEFL (MAGC1_HUMAN)
SVPPRYEFV

SEQ ID NO: 70080 - protein, 9 aa, Artificial Sequence
  Description of Artificial Sequence: Synthetic peptide
  Seed: SPLQIVPSL (MAGC1_HUMAN)
SALQIVPSL

SEQ ID NO: 70081 - protein, 9 aa, Artificial Sequence
  Description of Artificial Sequence: Synthetic peptide
  Seed: FAFGEPREL (MAGC1_HUMAN)
FVFGEPREY

SEQ ID NO: 70082 - protein, 9 aa, Artificial Sequence
  Description of Artificial Sequence: Synthetic peptide
  Seed: NVISRYTGY (MAGC1_HUMAN)
NMISRYTGF

SEQ ID NO: 70083 - protein, 10 aa, Artificial Sequence
  Description of Artificial Sequence: Synthetic peptide
  Seed: RKVVEFLAML (MAGC1_HUMAN)
RQVVEFLAMW

SEQ ID NO: 70084 - protein, 10 aa, Artificial Sequence
  Description of Artificial Sequence: Synthetic peptide
  Seed: STSLSLPQSF (MAGC1_HUMAN)
SSSLSLPQSW

SEQ ID NO: 70085 - protein, 10 aa, Artificial Sequence
  Description of Artificial Sequence: Synthetic peptide
  Seed: IPGSPSFSST (MAGC1_HUMAN)
IPGSPSFSSV

SEQ ID NO: 70086 - protein, 9 aa, Artificial Sequence
  Description of Artificial Sequence: Synthetic peptide
  Seed: LQNPASSFF (MAGC1_HUMAN)
LSNPASSFV

SEQ ID NO: 70087 - protein, 9 aa, Artificial Sequence
  Description of Artificial Sequence: Synthetic peptide
  Seed: QFPPQGEDF (MAGC1_HUMAN)
QFPPQGEDM

SEQ ID NO: 70088 - protein, 11 aa, Artificial Sequence
  Description of Artificial Sequence: Synthetic peptide
  Seed: TLDEKVDELAR (MAGC1_HUMAN)
TVDEKVDELAF

SEQ ID NO: 70089 - protein, 9 aa, Artificial Sequence
  Description of Artificial Sequence: Synthetic peptide
  Seed: VSRSFSSTL (MAGC1_HUMAN)
VIRSFSSTM

SEQ ID NO: 70090 - protein, 9 aa, Artificial Sequence
  Description of Artificial Sequence: Synthetic peptide
  Seed: SLFQSFSER (MAGC1_HUMAN)
SVFQSFSEL

SEQ ID NO: 70091 - protein, 9 aa, Artificial Sequence
  Description of Artificial Sequence: Synthetic peptide
  Seed: LQIPVSRSF (MAGC1_HUMAN)
LTIPVSRSY

SEQ ID NO: 70092 - protein, 10 aa, Artificial Sequence
  Description of Artificial Sequence: Synthetic peptide
  Seed: ATESASSSVM (MAGC1_HUMAN)
AKESASSSVW

SEQ ID NO: 70093 - protein, 8 aa, Artificial Sequence
  Description of Artificial Sequence: Synthetic peptide
  Seed: QIPVSRSF (MAGC1_HUMAN)
QYPVSRSY

SEQ ID NO: 70094 - protein, 9 aa, Artificial Sequence
  Description of Artificial Sequence: Synthetic peptide
  Seed: RSFSSTLLS (MAGC1_HUMAN)
RTFSSTLLW

SEQ ID NO: 70095 - protein, 9 aa, Artificial Sequence
  Description of Artificial Sequence: Synthetic peptide
  Seed: ILILSIIFI (MAGC1_HUMAN)
IMILSIIFV

SEQ ID NO: 70096 - protein, 9 aa, Artificial Sequence
  Description of Artificial Sequence: Synthetic peptide
  Seed: WVQEHYLEY (MAGC1_HUMAN)
WFQEHYLEV

SEQ ID NO: 70097 - protein, 11 aa, Artificial Sequence
  Description of Artificial Sequence: Synthetic peptide
  Seed: ISRYTGYFPVI (MAGC1_HUMAN)
INRYTGYFPVF

SEQ ID NO: 70098 - protein, 11 aa, Artificial Sequence
  Description of Artificial Sequence: Synthetic peptide
  Seed: SPLQRPVSSFF (MAGC1_HUMAN)
SVLQRPVSSFF

SEQ ID NO: 70099 - protein, 9 aa, Artificial Sequence
  Description of Artificial Sequence: Synthetic peptide
  Seed: SICSSSTSL (MAGC1_HUMAN)
SVCSSSTSV

SEQ ID NO: 70100 - protein, 10 aa, Artificial Sequence
  Description of Artificial Sequence: Synthetic peptide
  Seed: SFSYTLLSLF (MAGC1_HUMAN)
SISYTLLSLW

SEQ ID NO: 70101 - protein, 9 aa, Artificial Sequence
  Description of Artificial Sequence: Synthetic peptide
  Seed: FFSSALLSI (MAGC1_HUMAN)
FLSSALLSI

SEQ ID NO: 70102 - protein, 9 aa, Artificial Sequence
  Description of Artificial Sequence: Synthetic peptide
  Seed: LQIPMTSSF (MAGC1_HUMAN)
LMIPMTSSA

SEQ ID NO: 70103 - protein, 9 aa, Artificial Sequence
  Description of Artificial Sequence: Synthetic peptide
  Seed: LILILSIIF (MAGC1_HUMAN)
LSLILSIIF

SEQ ID NO: 70104 - protein, 9 aa, Artificial Sequence
  Description of Artificial Sequence: Synthetic peptide
  Seed: KVDELARFL (MAGC1_HUMAN)
KNDELARFL

SEQ ID NO: 70105 - protein, 10 aa, Artificial Sequence
  Description of Artificial Sequence: Synthetic peptide
  Seed: VISFSSSTSL (MAGC1_HUMAN)
VPSFSSSTSL

SEQ ID NO: 70106 - protein, 10 aa, Artificial Sequence
  Description of Artificial Sequence: Synthetic peptide
  Seed: YTLASLLQSS (MAGC1_HUMAN)
YHLASLLQSI

SEQ ID NO: 70107 - protein, 9 aa, Artificial Sequence
  Description of Artificial Sequence: Synthetic peptide
  Seed: FLAMLKNTV (MAGC1_HUMAN)
FTAMLKNTV

SEQ ID NO: 70108 - protein, 9 aa, Artificial Sequence
  Description of Artificial Sequence: Synthetic peptide
  Seed: NTVPITFPS (MAGC1_HUMAN)
NFVPITFPK

SEQ ID NO: 70109 - protein, 9 aa, Artificial Sequence
  Description of Artificial Sequence: Synthetic peptide
  Seed: KAREFIEIL (MAGC1_HUMAN)
KPREFIEIM

SEQ ID NO: 70110 - protein, 11 aa, Artificial Sequence
  Description of Artificial Sequence: Synthetic peptide
  Seed: REVDPDDSYVF (MAGC1_HUMAN)
RHVDPDDSYVI

SEQ ID NO: 70111 - protein, 10 aa, Artificial Sequence
  Description of Artificial Sequence: Synthetic peptide
  Seed: SSSSTLLSLF (MAGC1_HUMAN)
SHSSTLLSLF

SEQ ID NO: 70112 - protein, 10 aa, Artificial Sequence
  Description of Artificial Sequence: Synthetic peptide
  Seed: VSSSFSYTLL (MAGC1_HUMAN)
VASSFSYTLY

SEQ ID NO: 70113 - protein, 9 aa, Artificial Sequence
  Description of Artificial Sequence: Synthetic peptide
  Seed: LQSPVISFS (MAGC1_HUMAN)
LTSPVISFV

SEQ ID NO: 70114 - protein, 9 aa, Artificial Sequence
  Description of Artificial Sequence: Synthetic peptide
  Seed: RSFSSTLLS (MAGC1_HUMAN)
RGFSSTLLW

SEQ ID NO: 70115 - protein, 9 aa, Artificial Sequence
  Description of Artificial Sequence: Synthetic peptide
  Seed: HYFPQSPPQ (MAGC1_HUMAN)
HWFPQSPPM

SEQ ID NO: 70116 - protein, 10 aa, Artificial Sequence
  Description of Artificial Sequence: Synthetic peptide
  Seed: SSPERTHSTF (MAGC1_HUMAN)
SVPERTHSTY

SEQ ID NO: 70117 - protein, 10 aa, Artificial Sequence
  Description of Artificial Sequence: Synthetic peptide
  Seed: DVLSGIGVRA (MAGC1_HUMAN)
DTLSGIGVRK

SEQ ID NO: 70118 - protein, 9 aa, Artificial Sequence
  Description of Artificial Sequence: Synthetic peptide
  Seed: VSSSSSSTL (MAGC1_HUMAN)
VTSSSSSTW

SEQ ID NO: 70119 - protein, 10 aa, Artificial Sequence
  Description of Artificial Sequence: Synthetic peptide
  Seed: RSFSSTLLSI (MAGC1_HUMAN)
RYFSSTLLSW

SEQ ID NO: 70120 - protein, 10 aa, Artificial Sequence
  Description of Artificial Sequence: Synthetic peptide
  Seed: NPASSFFSSA (MAGC1_HUMAN)
NPASSFFSSV

SEQ ID NO: 70121 - protein, 10 aa, Artificial Sequence
  Description of Artificial Sequence: Synthetic peptide
  Seed: SMSPLYFPQS (MAGC1_HUMAN)
SMSPLYFPQA

SEQ ID NO: 70122 - protein, 9 aa, Artificial Sequence
  Description of Artificial Sequence: Synthetic peptide
  Seed: FPSSTSSSL (MAGC1_HUMAN)
FYSSTSSSW

SEQ ID NO: 70123 - protein, 11 aa, Artificial Sequence
  Description of Artificial Sequence: Synthetic peptide
  Seed: SFFSYTLASLL (MAGC1_HUMAN)
SMFSYTLASLW

SEQ ID NO: 70124 - protein, 9 aa, Artificial Sequence
  Description of Artificial Sequence: Synthetic peptide
  Seed: LQIVPSLPE (MAGC1_HUMAN)
LRIVPSLPY

SEQ ID NO: 70125 - protein, 10 aa, Artificial Sequence
  Description of Artificial Sequence: Synthetic peptide
  Seed: SILQSSPESA (MAGC1_HUMAN)
SMLQSSPESV

SEQ ID NO: 70126 - protein, 9 aa, Artificial Sequence
  Description of Artificial Sequence: Synthetic peptide
  Seed: VSAASSSTL (MAGC1_HUMAN)
VQAASSSTF

SEQ ID NO: 70127 - protein, 9 aa, Artificial Sequence
  Description of Artificial Sequence: Synthetic peptide
  Seed: LQIPVSRSF (MAGC1_HUMAN)
LYIPVSRSW

SEQ ID NO: 70128 - protein, 9 aa, Artificial Sequence
  Description of Artificial Sequence: Synthetic peptide
  Seed: AQSPLQIPV (MAGC1_HUMAN)
ARSPLQIPL

SEQ ID NO: 70129 - protein, 10 aa, Artificial Sequence
  Description of Artificial Sequence: Synthetic peptide
  Seed: EMLTNVISRY (MAGC1_HUMAN)
ESLTNVISRR

SEQ ID NO: 70130 - protein, 9 aa, Artificial Sequence
  Description of Artificial Sequence: Synthetic peptide
  Seed: SQSSPVSSF (MAGC1_HUMAN)
SWSSPVSSI

SEQ ID NO: 70131 - protein, 9 aa, Artificial Sequence
  Description of Artificial Sequence: Synthetic peptide
  Seed: LSDEQGMSQ (MAGC1_HUMAN)
LEDEQGMSL

SEQ ID NO: 70132 - protein, 10 aa, Artificial Sequence
  Description of Artificial Sequence: Synthetic peptide
  Seed: SPLQSPVISF (MAGC1_HUMAN)
SPLQSPVISW

SEQ ID NO: 70133 - protein, 9 aa, Artificial Sequence
  Description of Artificial Sequence: Synthetic peptide
  Seed: LARFLLLKY (MAGC1_HUMAN)
LARFLLLKW

SEQ ID NO: 70134 - protein, 10 aa, Artificial Sequence
  Description of Artificial Sequence: Synthetic peptide
  Seed: FLAMLKNTVP (MAGC1_HUMAN)
FLAMLKNTVC

SEQ ID NO: 70135 - protein, 10 aa, Artificial Sequence
  Description of Artificial Sequence: Synthetic peptide
  Seed: PLQIPMTSSF (MAGC1_HUMAN)
PGQIPMTSSY

SEQ ID NO: 70136 - protein, 10 aa, Artificial Sequence
  Description of Artificial Sequence: Synthetic peptide
  Seed: FAFGEPRELL (MAGC1_HUMAN)
FVFGEPRELV

SEQ ID NO: 70137 - protein, 11 aa, Artificial Sequence
  Description of Artificial Sequence: Synthetic peptide
  Seed: IPVSRSFSSTL (MAGC1_HUMAN)
IGVSRSFSSTF

SEQ ID NO: 70138 - protein, 11 aa, Artificial Sequence
  Description of Artificial Sequence: Synthetic peptide
  Seed: SPLQIPGSPSF (MAGC1_HUMAN)
SGLQIPGSPSM

SEQ ID NO: 70139 - protein, 9 aa, Artificial Sequence
  Description of Artificial Sequence: Synthetic peptide
  Seed: SPLQIVPSL (MAGC1_HUMAN)
SALQIVPSI

SEQ ID NO: 70140 - protein, 9 aa, Artificial Sequence
  Description of Artificial Sequence: Synthetic peptide
  Seed: SSPERTQST (MAGC1_HUMAN)
SSPERTQSL

SEQ ID NO: 70141 - protein, 9 aa, Artificial Sequence
  Description of Artificial Sequence: Synthetic peptide
  Seed: KVVEFLAML (MAGC1_HUMAN)
KIVEFLAMY

SEQ ID NO: 70142 - protein, 10 aa, Artificial Sequence
  Description of Artificial Sequence: Synthetic peptide
  Seed: FFSSALLSIF (MAGC1_HUMAN)
FASSALLSIM

SEQ ID NO: 70143 - protein, 9 aa, Artificial Sequence
  Description of Artificial Sequence: Synthetic peptide
  Seed: KDSQSPLQI (MAGC1_HUMAN)
KISQSPLQF

SEQ ID NO: 70144 - protein, 9 aa, Artificial Sequence
  Description of Artificial Sequence: Synthetic peptide
  Seed: STQSPFEGF (MAGC1_HUMAN)
SMQSPFEGY

SEQ ID NO: 70145 - protein, 9 aa, Artificial Sequence
  Description of Artificial Sequence: Synthetic peptide
  Seed: YTLASLLQS (MAGC1_HUMAN)
YALASLLQA

SEQ ID NO: 70146 - protein, 10 aa, Artificial Sequence
  Description of Artificial Sequence: Synthetic peptide
  Seed: VISFSSSTSL (MAGC1_HUMAN)
VKSFSSSTSY

SEQ ID NO: 70147 - protein, 11 aa, Artificial Sequence
  Description of Artificial Sequence: Synthetic peptide
  Seed: SSFPSSTSSSL (MAGC1_HUMAN)
SFFPSSTSSSM

SEQ ID NO: 70148 - protein, 11 aa, Artificial Sequence
  Description of Artificial Sequence: Synthetic peptide
  Seed: AMLKNTVPITF (MAGC1_HUMAN)
ATLKNTVPITF

SEQ ID NO: 70149 - protein, 10 aa, Artificial Sequence
  Description of Artificial Sequence: Synthetic peptide
  Seed: LQIPVSSSFS (MAGC1_HUMAN)
LMIPVSSSFT

SEQ ID NO: 70150 - protein, 11 aa, Artificial Sequence
  Description of Artificial Sequence: Synthetic peptide
  Seed: STFEGFPQSLL (MAGC1_HUMAN)
SLFEGFPQSLC

SEQ ID NO: 70151 - protein, 9 aa, Artificial Sequence
  Description of Artificial Sequence: Synthetic peptide
  Seed: EHFAFGEPR (MAGC1_HUMAN)
ELFAFGEPK

SEQ ID NO: 70152 - protein, 9 aa, Artificial Sequence
  Description of Artificial Sequence: Synthetic peptide
  Seed: IESEPLFTY (MAGC1_HUMAN)
IQSEPLFTV

SEQ ID NO: 70153 - protein, 11 aa, Artificial Sequence
  Description of Artificial Sequence: Synthetic peptide
  Seed: SPLQIPGSPSF (MAGC1_HUMAN)
SILQIPGSPSM

SEQ ID NO: 70154 - protein, 10 aa, Artificial Sequence
  Description of Artificial Sequence: Synthetic peptide
  Seed: WGPRAHSEVI (MAGC1_HUMAN)
WCPRAHSEVF

SEQ ID NO: 70155 - protein, 10 aa, Artificial Sequence
  Description of Artificial Sequence: Synthetic peptide
  Seed: ESAQSTFEGF (MAGC1_HUMAN)
EIAQSTFEGY

SEQ ID NO: 70156 - protein, 9 aa, Artificial Sequence
  Description of Artificial Sequence: Synthetic peptide
  Seed: SVLQIPVSA (MAGC1_HUMAN)
SNLQIPVSR

SEQ ID NO: 70157 - protein, 11 aa, Artificial Sequence
  Description of Artificial Sequence: Synthetic peptide
  Seed: SSTPSSLPQSF (MAGC1_HUMAN)
SMTPSSLPQSY

SEQ ID NO: 70158 - protein, 9 aa, Artificial Sequence
  Description of Artificial Sequence: Synthetic peptide
  Seed: IESEPLFTY (MAGC1_HUMAN)
IYSEPLFTF

SEQ ID NO: 70159 - protein, 10 aa, Artificial Sequence
  Description of Artificial Sequence: Synthetic peptide
  Seed: ESEPLFTYTL (MAGC1_HUMAN)
ETEPLFTYTA

SEQ ID NO: 70160 - protein, 9 aa, Artificial Sequence
  Description of Artificial Sequence: Synthetic peptide
  Seed: AQSPLQSPV (MAGC1_HUMAN)
AMSPLQSPY

SEQ ID NO: 70161 - protein, 10 aa, Artificial Sequence
  Description of Artificial Sequence: Synthetic peptide
  Seed: KRKVVEFLAM (MAGC1_HUMAN)
KWKVVEFLAF

SEQ ID NO: 70162 - protein, 9 aa, Artificial Sequence
  Description of Artificial Sequence: Synthetic peptide
  Seed: MTSSFSSTL (MAGC1_HUMAN)
MISSFSSTV

SEQ ID NO: 70163 - protein, 11 aa, Artificial Sequence
  Description of Artificial Sequence: Synthetic peptide
  Seed: SSTPSSLPQSF (MAGC1_HUMAN)
STTPSSLPQSW

SEQ ID NO: 70164 - protein, 11 aa, Artificial Sequence
  Description of Artificial Sequence: Synthetic peptide
  Seed: SLIESEPLFTY (MAGC1_HUMAN)
SSIESEPLFTY

SEQ ID NO: 70165 - protein, 10 aa, Artificial Sequence
  Description of Artificial Sequence: Synthetic peptide
  Seed: FIEILFGISL (MAGC1_HUMAN)
FMEILFGISL

SEQ ID NO: 70166 - protein, 9 aa, Artificial Sequence
  Description of Artificial Sequence: Synthetic peptide
  Seed: CTQSTFEGF (MAGC1_HUMAN)
CTQSTFEGW

SEQ ID NO: 70167 - protein, 9 aa, Artificial Sequence
  Description of Artificial Sequence: Synthetic peptide
  Seed: EMLTNVISR (MAGC1_HUMAN)
ETLTNVISH

SEQ ID NO: 70168 - protein, 11 aa, Artificial Sequence
  Description of Artificial Sequence: Synthetic peptide
  Seed: RSFSSTLLSIF (MAGC1_HUMAN)
RWFSSTLLSIF

SEQ ID NO: 70169 - protein, 10 aa, Artificial Sequence
  Description of Artificial Sequence: Synthetic peptide
  Seed: GEDSQSPLQI (MAGC1_HUMAN)
GEDSQSPLQM

SEQ ID NO: 70170 - protein, 9 aa, Artificial Sequence
  Description of Artificial Sequence: Synthetic peptide
  Seed: ASSSTLVSI (MAGC1_HUMAN)
ATSSTLVSI

SEQ ID NO: 70171 - protein, 9 aa, Artificial Sequence
  Description of Artificial Sequence: Synthetic peptide
  Seed: ISFSSSTSL (MAGC1_HUMAN)
IHFSSSTSL

SEQ ID NO: 70172 - protein, 9 aa, Artificial Sequence
  Description of Artificial Sequence: Synthetic peptide
  Seed: SSFFSSALL (MAGC1_HUMAN)
SLFFSSALI

SEQ ID NO: 70173 - protein, 10 aa, Artificial Sequence
  Description of Artificial Sequence: Synthetic peptide
  Seed: VSSSFSYTLL (MAGC1_HUMAN)
VESSFSYTLF

SEQ ID NO: 70174 - protein, 10 aa, Artificial Sequence
  Description of Artificial Sequence: Synthetic peptide
  Seed: REVDPDDSYV (MAGC1_HUMAN)
RIVDPDDSYL

SEQ ID NO: 70175 - protein, 10 aa, Artificial Sequence
  Description of Artificial Sequence: Synthetic peptide
  Seed: REFIEILFGI (MAGC1_HUMAN)
RTFIEILFGV

SEQ ID NO: 70176 - protein, 10 aa, Artificial Sequence
  Description of Artificial Sequence: Synthetic peptide
  Seed: SFSYTLLSLF (MAGC1_HUMAN)
SFSYTLLSLW

SEQ ID NO: 70177 - protein, 9 aa, Artificial Sequence
  Description of Artificial Sequence: Synthetic peptide
  Seed: YVFVNTLDL (MAGC1_HUMAN)
YNFVNTLDF

SEQ ID NO: 70178 - protein, 9 aa, Artificial Sequence
  Description of Artificial Sequence: Synthetic peptide
  Seed: WEDSLSPHY (MAGC1_HUMAN)
WIDSLSPHY

SEQ ID NO: 70179 - protein, 9 aa, Artificial Sequence
  Description of Artificial Sequence: Synthetic peptide
  Seed: REVDPDDSY (MAGC1_HUMAN)
RQVDPDDSM

SEQ ID NO: 70180 - protein, 11 aa, Artificial Sequence
  Description of Artificial Sequence: Synthetic peptide
  Seed: KRKVVEFLAML (MAGC1_HUMAN)
KMKVVEFLAMA

SEQ ID NO: 70181 - protein, 10 aa, Artificial Sequence
  Description of Artificial Sequence: Synthetic peptide
  Seed: VSRSFSSTLL (MAGC1_HUMAN)
VARSFSSTLF

SEQ ID NO: 70182 - protein, 9 aa, Artificial Sequence
  Description of Artificial Sequence: Synthetic peptide
  Seed: IIFIKGTYA (MAGC1_HUMAN)
IQFIKGTYV

SEQ ID NO: 70183 - protein, 10 aa, Artificial Sequence
  Description of Artificial Sequence: Synthetic peptide
  Seed: FPQSPLQIPV (MAGC1_HUMAN)
FPQSPLQIPL

SEQ ID NO: 70184 - protein, 9 aa, Artificial Sequence
  Description of Artificial Sequence: Synthetic peptide
  Seed: GEDSLSPHY (MAGC1_HUMAN)
GEDSLSPHW

SEQ ID NO: 70185 - protein, 10 aa, Artificial Sequence
  Description of Artificial Sequence: Synthetic peptide
  Seed: FSSSTSLSPF (MAGC1_HUMAN)
FDSSTSLSPW

SEQ ID NO: 70186 - protein, 10 aa, Artificial Sequence
  Description of Artificial Sequence: Synthetic peptide
  Seed: FPQSVLQIPV (MAGC1_HUMAN)
FMQSVLQIPV

SEQ ID NO: 70187 - protein, 10 aa, Artificial Sequence
  Description of Artificial Sequence: Synthetic peptide
  Seed: DVLSGIGVRA (MAGC1_HUMAN)
DSLSGIGVRR

SEQ ID NO: 70188 - protein, 9 aa, Artificial Sequence
  Description of Artificial Sequence: Synthetic peptide
  Seed: FTYTLDEKV (MAGC1_HUMAN)
FQYTLDEKL

SEQ ID NO: 70189 - protein, 10 aa, Artificial Sequence
  Description of Artificial Sequence: Synthetic peptide
  Seed: IIDTTDDSTA (MAGC1_HUMAN)
IVDTTDDSTM

SEQ ID NO: 70190 - protein, 9 aa, Artificial Sequence
  Description of Artificial Sequence: Synthetic peptide
  Seed: AQSPLQIPV (MAGC1_HUMAN)
AISPLQIPL

SEQ ID NO: 70191 - protein, 9 aa, Artificial Sequence
  Description of Artificial Sequence: Synthetic peptide
  Seed: SSSSSSSTL (MAGC1_HUMAN)
SQSSSSSTM

SEQ ID NO: 70192 - protein, 10 aa, Artificial Sequence
  Description of Artificial Sequence: Synthetic peptide
  Seed: SPLQSPVISF (MAGC1_HUMAN)
SLLQSPVISY

SEQ ID NO: 70193 - protein, 10 aa, Artificial Sequence
  Description of Artificial Sequence: Synthetic peptide
  Seed: ATESASSSVM (MAGC1_HUMAN)
ANESASSSVL

SEQ ID NO: 70194 - protein, 10 aa, Artificial Sequence
  Description of Artificial Sequence: Synthetic peptide
  Seed: FPQSPLQIPV (MAGC1_HUMAN)
FWQSPLQIPL

SEQ ID NO: 70195 - protein, 11 aa, Artificial Sequence
  Description of Artificial Sequence: Synthetic peptide
  Seed: QSSPERTHSTF (MAGC1_HUMAN)
QVSPERTHSTW

SEQ ID NO: 70196 - protein, 9 aa, Artificial Sequence
  Description of Artificial Sequence: Synthetic peptide
  Seed: DPDDSYVFV (MAGC1_HUMAN)
DLDDSYVFL

SEQ ID NO: 70197 - protein, 9 aa, Artificial Sequence
  Description of Artificial Sequence: Synthetic peptide
  Seed: SIFQSSPER (MAGC1_HUMAN)
SVFQSSPEI

SEQ ID NO: 70198 - protein, 10 aa, Artificial Sequence
  Description of Artificial Sequence: Synthetic peptide
  Seed: LHFPQSPPEW (MAGC1_HUMAN)
LYFPQSPPEW

SEQ ID NO: 70199 - protein, 10 aa, Artificial Sequence
  Description of Artificial Sequence: Synthetic peptide
  Seed: PLQIPGSPSF (MAGC1_HUMAN)
PFQIPGSPSY

SEQ ID NO: 70200 - protein, 10 aa, Artificial Sequence
  Description of Artificial Sequence: Synthetic peptide
  Seed: FFSYTLASLL (MAGC1_HUMAN)
FVSYTLASLM

SEQ ID NO: 70201 - protein, 11 aa, Artificial Sequence
  Description of Artificial Sequence: Synthetic peptide
  Seed: AASSSTLVSIF (MAGC1_HUMAN)
AKSSSTLVSIF

SEQ ID NO: 70202 - protein, 9 aa, Artificial Sequence
  Description of Artificial Sequence: Synthetic peptide
  Seed: SSHESPQSP (MAGC1_HUMAN)
SQHESPQSF

SEQ ID NO: 70203 - protein, 10 aa, Artificial Sequence
  Description of Artificial Sequence: Synthetic peptide
  Seed: RYTGYFPVIF (MAGC1_HUMAN)
RFTGYFPVIF

SEQ ID NO: 70204 - protein, 8 aa, Artificial Sequence
  Description of Artificial Sequence: Synthetic peptide
  Seed: QIPMTSSF (MAGC1_HUMAN)
QFPMTSSY

SEQ ID NO: 70205 - protein, 10 aa, Artificial Sequence
  Description of Artificial Sequence: Synthetic peptide
  Seed: FAFGEPRELL (MAGC1_HUMAN)
FQFGEPRELL

SEQ ID NO: 70206 - protein, 10 aa, Artificial Sequence
  Description of Artificial Sequence: Synthetic peptide
  Seed: QIPVSSSFSY (MAGC1_HUMAN)
QCPVSSSFSF

SEQ ID NO: 70207 - protein, 9 aa, Artificial Sequence
  Description of Artificial Sequence: Synthetic peptide
  Seed: SPLQIPMTS (MAGC1_HUMAN)
SALQIPMTV

SEQ ID NO: 70208 - protein, 10 aa, Artificial Sequence
  Description of Artificial Sequence: Synthetic peptide
  Seed: FSSSTSLSPF (MAGC1_HUMAN)
FSSSTSLSPW

SEQ ID NO: 70209 - protein, 9 aa, Artificial Sequence
  Description of Artificial Sequence: Synthetic peptide
  Seed: IPVSSSFSY (MAGC1_HUMAN)
IQVSSSFSV

SEQ ID NO: 70210 - protein, 10 aa, Artificial Sequence
  Description of Artificial Sequence: Synthetic peptide
  Seed: LQIPVSRSFS (MAGC1_HUMAN)
LQIPVSRSFE

SEQ ID NO: 70211 - protein, 9 aa, Artificial Sequence
  Description of Artificial Sequence: Synthetic peptide
  Seed: FSYTLLSLF (MAGC1_HUMAN)
FYYTLLSLW

SEQ ID NO: 70212 - protein, 9 aa, Artificial Sequence
  Description of Artificial Sequence: Synthetic peptide
  Seed: SPLQIVPSL (MAGC1_HUMAN)
SALQIVPSY

SEQ ID NO: 70213 - protein, 9 aa, Artificial Sequence
  Description of Artificial Sequence: Synthetic peptide
  Seed: SSSTLLSLF (MAGC1_HUMAN)
SASTLLSLF

SEQ ID NO: 70214 - protein, 9 aa, Artificial Sequence
  Description of Artificial Sequence: Synthetic peptide
  Seed: NTVPITFPS (MAGC1_HUMAN)
NSVPITFPR

SEQ ID NO: 70215 - protein, 10 aa, Artificial Sequence
  Description of Artificial Sequence: Synthetic peptide
  Seed: AASSSTLVSI (MAGC1_HUMAN)
AMSSSTLVSI

SEQ ID NO: 70216 - protein, 10 aa, Artificial Sequence
  Description of Artificial Sequence: Synthetic peptide
  Seed: SFSSTLLSIF (MAGC1_HUMAN)
SYSSTLLSIY

SEQ ID NO: 70217 - protein, 10 aa, Artificial Sequence
  Description of Artificial Sequence: Synthetic peptide
  Seed: FFSYTLASLL (MAGC1_HUMAN)
FGSYTLASLW

SEQ ID NO: 70218 - protein, 9 aa, Artificial Sequence
  Description of Artificial Sequence: Synthetic peptide
  Seed: SSPECTQST (MAGC1_HUMAN)
SIPECTQSL

SEQ ID NO: 70219 - protein, 10 aa, Artificial Sequence
  Description of Artificial Sequence: Synthetic peptide
  Seed: SLFQSSPECT (MAGC1_HUMAN)
STFQSSPECV

SEQ ID NO: 70220 - protein, 9 aa, Artificial Sequence
  Description of Artificial Sequence: Synthetic peptide
  Seed: SSPESDDTL (MAGC1_HUMAN)
SVPESDDTM

SEQ ID NO: 70221 - protein, 9 aa, Artificial Sequence
  Description of Artificial Sequence: Synthetic peptide
  Seed: FSSTLLSIL (MAGC1_HUMAN)
FISTLLSIY

SEQ ID NO: 70222 - protein, 11 aa, Artificial Sequence
  Description of Artificial Sequence: Synthetic peptide
  Seed: SFFSSALLSIF (MAGC1_HUMAN)
SKFSSALLSIM

SEQ ID NO: 70223 - protein, 10 aa, Artificial Sequence
  Description of Artificial Sequence: Synthetic peptide
  Seed: LQIPVSRSFS (MAGC1_HUMAN)
LMIPVSRSFL

SEQ ID NO: 70224 - protein, 10 aa, Artificial Sequence
  Description of Artificial Sequence: Synthetic peptide
  Seed: PLQNPASSFF (MAGC1_HUMAN)
PFQNPASSFF

SEQ ID NO: 70225 - protein, 9 aa, Artificial Sequence
  Description of Artificial Sequence: Synthetic peptide
  Seed: SSHESPQSP (MAGC1_HUMAN)
SIHESPQSY

SEQ ID NO: 70226 - protein, 10 aa, Artificial Sequence
  Description of Artificial Sequence: Synthetic peptide
  Seed: MPTAGMPSLL (MAGC1_HUMAN)
MPTAGMPSLM

SEQ ID NO: 70227 - protein, 9 aa, Artificial Sequence
  Description of Artificial Sequence: Synthetic peptide
  Seed: ISFSSSTSL (MAGC1_HUMAN)
INFSSSTSL

SEQ ID NO: 70228 - protein, 9 aa, Artificial Sequence
  Description of Artificial Sequence: Synthetic peptide
  Seed: GYFPVIFRK (MAGC1_HUMAN)
GAFPVIFRY

SEQ ID NO: 70229 - protein, 9 aa, Artificial Sequence
  Description of Artificial Sequence: Synthetic peptide
  Seed: SSSFSYTLL (MAGC1_HUMAN)
STSFSYTLV

SEQ ID NO: 70230 - protein, 10 aa, Artificial Sequence
  Description of Artificial Sequence: Synthetic peptide
  Seed: LQIPMTSSFS (MAGC1_HUMAN)
LQIPMTSSFL

SEQ ID NO: 70231 - protein, 9 aa, Artificial Sequence
  Description of Artificial Sequence: Synthetic peptide
  Seed: TPSSLPQSF (MAGC1_HUMAN)
TSSSLPQSY

SEQ ID NO: 70232 - protein, 9 aa, Artificial Sequence
  Description of Artificial Sequence: Synthetic peptide
  Seed: ISRYTGYFP (MAGC1_HUMAN)
ISRYTGYFA

SEQ ID NO: 70233 - protein, 10 aa, Artificial Sequence
  Description of Artificial Sequence: Synthetic peptide
  Seed: LLQIPMTSSF (MAGC1_HUMAN)
LFQIPMTSSW

SEQ ID NO: 70234 - protein, 9 aa, Artificial Sequence
  Description of Artificial Sequence: Synthetic peptide
  Seed: VSAASSSTL (MAGC1_HUMAN)
VKAASSSTF

SEQ ID NO: 70235 - protein, 9 aa, Artificial Sequence
  Description of Artificial Sequence: Synthetic peptide
  Seed: SFFSYTLAS (MAGC1_HUMAN)
SWFSYTLAF

SEQ ID NO: 70236 - protein, 9 aa, Artificial Sequence
  Description of Artificial Sequence: Synthetic peptide
  Seed: SSSSSSTLL (MAGC1_HUMAN)
SVSSSSTLY

SEQ ID NO: 70237 - protein, 9 aa, Artificial Sequence
  Description of Artificial Sequence: Synthetic peptide
  Seed: LKYQVKQPI (MAGC1_HUMAN)
LQYQVKQPH

SEQ ID NO: 70238 - protein, 9 aa, Artificial Sequence
  Description of Artificial Sequence: Synthetic peptide
  Seed: VQSPLQNPA (MAGC1_HUMAN)
VLSPLQNPY

SEQ ID NO: 70239 - protein, 9 aa, Artificial Sequence
  Description of Artificial Sequence: Synthetic peptide
  Seed: VQSPLQNPA (MAGC1_HUMAN)
VLSPLQNPA

SEQ ID NO: 70240 - protein, 9 aa, Artificial Sequence
  Description of Artificial Sequence: Synthetic peptide
  Seed: SLSPFSEES (MAGC1_HUMAN)
STSPFSEEV

SEQ ID NO: 70241 - protein, 9 aa, Artificial Sequence
  Description of Artificial Sequence: Synthetic peptide
  Seed: SPLEGEDSL (MAGC1_HUMAN)
SPLEGEDSW

SEQ ID NO: 70242 - protein, 10 aa, Artificial Sequence
  Description of Artificial Sequence: Synthetic peptide
  Seed: RKVVEFLAML (MAGC1_HUMAN)
RNVVEFLAMV

SEQ ID NO: 70243 - protein, 9 aa, Artificial Sequence
  Description of Artificial Sequence: Synthetic peptide
  Seed: SQSSPVSSF (MAGC1_HUMAN)
STSSPVSSH

SEQ ID NO: 70244 - protein, 9 aa, Artificial Sequence
  Description of Artificial Sequence: Synthetic peptide
  Seed: AQSPLQRPV (MAGC1_HUMAN)
ASSPLQRPF

SEQ ID NO: 70245 - protein, 10 aa, Artificial Sequence
  Description of Artificial Sequence: Synthetic peptide
  Seed: SLIESEPLFT (MAGC1_HUMAN)
SVIESEPLFI

SEQ ID NO: 70246 - protein, 10 aa, Artificial Sequence
  Description of Artificial Sequence: Synthetic peptide
  Seed: FFSYTLASLL (MAGC1_HUMAN)
FHSYTLASLW

SEQ ID NO: 70247 - protein, 10 aa, Artificial Sequence
  Description of Artificial Sequence: Synthetic peptide
  Seed: KGTYASEEVI (MAGC1_HUMAN)
KRTYASEEVY

SEQ ID NO: 70248 - protein, 10 aa, Artificial Sequence
  Description of Artificial Sequence: Synthetic peptide
  Seed: STFEGFPQSL (MAGC1_HUMAN)
SSFEGFPQSI

SEQ ID NO: 70249 - protein, 10 aa, Artificial Sequence
  Description of Artificial Sequence: Synthetic peptide
  Seed: SFPSSTSSSL (MAGC1_HUMAN)
SVPSSTSSSV

SEQ ID NO: 70250 - protein, 10 aa, Artificial Sequence
  Description of Artificial Sequence: Synthetic peptide
  Seed: SPLQIPQSPP (MAGC1_HUMAN)
SPLQIPQSPM

SEQ ID NO: 70251 - protein, 9 aa, Artificial Sequence
  Description of Artificial Sequence: Synthetic peptide
  Seed: FLWGPRAHS (MAGC1_HUMAN)
FVWGPRAHL

SEQ ID NO: 70252 - protein, 10 aa, Artificial Sequence
  Description of Artificial Sequence: Synthetic peptide
  Seed: SSPERTHSTF (MAGC1_HUMAN)
SDPERTHSTL

SEQ ID NO: 70253 - protein, 9 aa, Artificial Sequence
  Description of Artificial Sequence: Synthetic peptide
  Seed: AQSPLQSPV (MAGC1_HUMAN)
AASPLQSPL

SEQ ID NO: 70254 - protein, 10 aa, Artificial Sequence
  Description of Artificial Sequence: Synthetic peptide
  Seed: MLKNTVPITF (MAGC1_HUMAN)
MWKNTVPITF

SEQ ID NO: 70255 - protein, 9 aa, Artificial Sequence
  Description of Artificial Sequence: Synthetic peptide
  Seed: FSERTQSTF (MAGC1_HUMAN)
FAERTQSTW

SEQ ID NO: 70256 - protein, 8 aa, Artificial Sequence
  Description of Artificial Sequence: Synthetic peptide
  Seed: SSVMSPSF (MAGC1_HUMAN)
SQVMSPSF

SEQ ID NO: 70257 - protein, 11 aa, Artificial Sequence
  Description of Artificial Sequence: Synthetic peptide
  Seed: RPVSSFFSYTL (MAGC1_HUMAN)
RQVSSFFSYTF

SEQ ID NO: 70258 - protein, 11 aa, Artificial Sequence
  Description of Artificial Sequence: Synthetic peptide
  Seed: SPLQIPVSPSS (MAGC1_HUMAN)
SCLQIPVSPSF

SEQ ID NO: 70259 - protein, 9 aa, Artificial Sequence
  Description of Artificial Sequence: Synthetic peptide
  Seed: HFPQSPPEW (MAGC1_HUMAN)
HFPQSPPEF

SEQ ID NO: 70260 - protein, 9 aa, Artificial Sequence
  Description of Artificial Sequence: Synthetic peptide
  Seed: MSQNRLLIL (MAGC1_HUMAN)
MAQNRLLIW

SEQ ID NO: 70261 - protein, 9 aa, Artificial Sequence
  Description of Artificial Sequence: Synthetic peptide
  Seed: LPQSFPESS (MAGC1_HUMAN)
LPQSFPESI

SEQ ID NO: 70262 - protein, 10 aa, Artificial Sequence
  Description of Artificial Sequence: Synthetic peptide
  Seed: FAQSSLQIPV (MAGC1_HUMAN)
FSQSSLQIPI

SEQ ID NO: 70263 - protein, 9 aa, Artificial Sequence
  Description of Artificial Sequence: Synthetic peptide
  Seed: FSYTLASLL (MAGC1_HUMAN)
FIYTLASLA

SEQ ID NO: 70264 - protein, 10 aa, Artificial Sequence
  Description of Artificial Sequence: Synthetic peptide
  Seed: FSYTLLSLFQ (MAGC1_HUMAN)
FSYTLLSLFY

SEQ ID NO: 70265 - protein, 11 aa, Artificial Sequence
  Description of Artificial Sequence: Synthetic peptide
  Seed: IPVSRSFSSTL (MAGC1_HUMAN)
IKVSRSFSSTF

SEQ ID NO: 70266 - protein, 9 aa, Artificial Sequence
  Description of Artificial Sequence: Synthetic peptide
  Seed: SLSPFSEES (MAGC1_HUMAN)
SMSPFSEEA

SEQ ID NO: 70267 - protein, 9 aa, Artificial Sequence
  Description of Artificial Sequence: Synthetic peptide
  Seed: RPVSSFFSY (MAGC1_HUMAN)
RVVSSFFSF

SEQ ID NO: 70268 - protein, 9 aa, Artificial Sequence
  Description of Artificial Sequence: Synthetic peptide
  Seed: ELARFLLLK (MAGC1_HUMAN)
EYARFLLLK

SEQ ID NO: 70269 - protein, 8 aa, Artificial Sequence
  Description of Artificial Sequence: Synthetic peptide
  Seed: QSSPVSSF (MAGC1_HUMAN)
QYSPVSSF

SEQ ID NO: 70270 - protein, 11 aa, Artificial Sequence
  Description of Artificial Sequence: Synthetic peptide
  Seed: FLAMLKNTVPI (MAGC1_HUMAN)
FAAMLKNTVPL

SEQ ID NO: 70271 - protein, 9 aa, Artificial Sequence
  Description of Artificial Sequence: Synthetic peptide
  Seed: SRYTGYFPV (MAGC1_HUMAN)
STYTGYFPY

SEQ ID NO: 70272 - protein, 10 aa, Artificial Sequence
  Description of Artificial Sequence: Synthetic peptide
  Seed: STPSSLPQSF (MAGC1_HUMAN)
STPSSLPQSY

SEQ ID NO: 70273 - protein, 10 aa, Artificial Sequence
  Description of Artificial Sequence: Synthetic peptide
  Seed: RYTGYFPVIF (MAGC1_HUMAN)
RWTGYFPVIF

SEQ ID NO: 70274 - protein, 10 aa, Artificial Sequence
  Description of Artificial Sequence: Synthetic peptide
  Seed: ICSSSTSLSL (MAGC1_HUMAN)
IQSSSTSLSW

SEQ ID NO: 70275 - protein, 11 aa, Artificial Sequence
  Description of Artificial Sequence: Synthetic peptide
  Seed: SSSSSTLLSLF (MAGC1_HUMAN)
SCSSSTLLSLW

SEQ ID NO: 70276 - protein, 9 aa, Artificial Sequence
  Description of Artificial Sequence: Synthetic peptide
  Seed: SSPERTHST (MAGC1_HUMAN)
SEPERTHSL

SEQ ID NO: 70277 - protein, 11 aa, Artificial Sequence
  Description of Artificial Sequence: Synthetic peptide
  Seed: SPLQIPVSPSS (MAGC1_HUMAN)
SNLQIPVSPSY

SEQ ID NO: 70278 - protein, 8 aa, Artificial Sequence
  Description of Artificial Sequence: Synthetic peptide
  Seed: IWDVLSGI (MAGC1_HUMAN)
IMDVLSGL

SEQ ID NO: 70279 - protein, 9 aa, Artificial Sequence
  Description of Artificial Sequence: Synthetic peptide
  Seed: GYFPVIFRK (MAGC1_HUMAN)
GTFPVIFRK

SEQ ID NO: 70280 - protein, 11 aa, Artificial Sequence
  Description of Artificial Sequence: Synthetic peptide
  Seed: QSSPESAQSTF (MAGC1_HUMAN)
QSSPESAQSTY

SEQ ID NO: 70281 - protein, 11 aa, Artificial Sequence
  Description of Artificial Sequence: Synthetic peptide
  Seed: TLDEKVDELAR (MAGC1_HUMAN)
TADEKVDELAF

SEQ ID NO: 70282 - protein, 9 aa, Artificial Sequence
  Description of Artificial Sequence: Synthetic peptide
  Seed: AFGEPRELL (MAGC1_HUMAN)
ARGEPRELM

SEQ ID NO: 70283 - protein, 11 aa, Artificial Sequence
  Description of Artificial Sequence: Synthetic peptide
  Seed: STFEGFAQSSL (MAGC1_HUMAN)
SLFEGFAQSSM

SEQ ID NO: 70284 - protein, 9 aa, Artificial Sequence
  Description of Artificial Sequence: Synthetic peptide
  Seed: FTYTLDEKV (MAGC1_HUMAN)
FVYTLDEKI

SEQ ID NO: 70285 - protein, 10 aa, Artificial Sequence
  Description of Artificial Sequence: Synthetic peptide
  Seed: EILFGISLRE (MAGC1_HUMAN)
ELLFGISLRR

SEQ ID NO: 70286 - protein, 9 aa, Artificial Sequence
  Description of Artificial Sequence: Synthetic peptide
  Seed: SSPESDDTL (MAGC1_HUMAN)
SMPESDDTL

SEQ ID NO: 70287 - protein, 9 aa, Artificial Sequence
  Description of Artificial Sequence: Synthetic peptide
  Seed: FSSTLLSLF (MAGC1_HUMAN)
FYSTLLSLM

SEQ ID NO: 70288 - protein, 11 aa, Artificial Sequence
  Description of Artificial Sequence: Synthetic peptide
  Seed: MSPLYFPQSPL (MAGC1_HUMAN)
MSPLYFPQSPY

SEQ ID NO: 70289 - protein, 10 aa, Artificial Sequence
  Description of Artificial Sequence: Synthetic peptide
  Seed: REHFAFGEPR (MAGC1_HUMAN)
RWHFAFGEPR

SEQ ID NO: 70290 - protein, 9 aa, Artificial Sequence
  Description of Artificial Sequence: Synthetic peptide
  Seed: SIFQSSPER (MAGC1_HUMAN)
SLFQSSPEK

SEQ ID NO: 70291 - protein, 9 aa, Artificial Sequence
  Description of Artificial Sequence: Synthetic peptide
  Seed: SSPERTQST (MAGC1_HUMAN)
SSPERTQSM

SEQ ID NO: 70292 - protein, 11 aa, Artificial Sequence
  Description of Artificial Sequence: Synthetic peptide
  Seed: IIDTTDDSTAT (MAGC1_HUMAN)
ITDTTDDSTAM

SEQ ID NO: 70293 - protein, 9 aa, Artificial Sequence
  Description of Artificial Sequence: Synthetic peptide
  Seed: LQIPVSSSS (MAGC1_HUMAN)
LSIPVSSSW

SEQ ID NO: 70294 - protein, 9 aa, Artificial Sequence
  Description of Artificial Sequence: Synthetic peptide
  Seed: VQSPLHSPQ (MAGC1_HUMAN)
VISPLHSPF

SEQ ID NO: 70295 - protein, 10 aa, Artificial Sequence
  Description of Artificial Sequence: Synthetic peptide
  Seed: SLIESEPLFT (MAGC1_HUMAN)
SIIESEPLFI

SEQ ID NO: 70296 - protein, 9 aa, Artificial Sequence
  Description of Artificial Sequence: Synthetic peptide
  Seed: SQSSPVSSF (MAGC1_HUMAN)
SPSSPVSSL

SEQ ID NO: 70297 - protein, 10 aa, Artificial Sequence
  Description of Artificial Sequence: Synthetic peptide
  Seed: SESPQSCPEG (MAGC1_HUMAN)
SESPQSCPEA

SEQ ID NO: 70298 - protein, 11 aa, Artificial Sequence
  Description of Artificial Sequence: Synthetic peptide
  Seed: SSFPSSTSSSL (MAGC1_HUMAN)
SPFPSSTSSSF

SEQ ID NO: 70299 - protein, 10 aa, Artificial Sequence
  Description of Artificial Sequence: Synthetic peptide
  Seed: FPQSVLQIPV (MAGC1_HUMAN)
FHQSVLQIPV

SEQ ID NO: 70300 - protein, 10 aa, Artificial Sequence
  Description of Artificial Sequence: Synthetic peptide
  Seed: FFSYTLASLL (MAGC1_HUMAN)
FMSYTLASLW

SEQ ID NO: 70301 - protein, 9 aa, Artificial Sequence
  Description of Artificial Sequence: Synthetic peptide
  Seed: SIIFIKGTY (MAGC1_HUMAN)
SAIFIKGTM

SEQ ID NO: 70302 - protein, 9 aa, Artificial Sequence
  Description of Artificial Sequence: Synthetic peptide
  Seed: FSSALLSIF (MAGC1_HUMAN)
FMSALLSIF

SEQ ID NO: 70303 - protein, 9 aa, Artificial Sequence
  Description of Artificial Sequence: Synthetic peptide
  Seed: EHFAFGEPR (MAGC1_HUMAN)
ESFAFGEPR

SEQ ID NO: 70304 - protein, 10 aa, Artificial Sequence
  Description of Artificial Sequence: Synthetic peptide
  Seed: SPLQSPESAP (MAGC1_HUMAN)
SPLQSPESAL

SEQ ID NO: 70305 - protein, 10 aa, Artificial Sequence
  Description of Artificial Sequence: Synthetic peptide
  Seed: RAGREHFAFG (MAGC1_HUMAN)
RSGREHFAFS

SEQ ID NO: 70306 - protein, 9 aa, Artificial Sequence
  Description of Artificial Sequence: Synthetic peptide
  Seed: SKSSPESPL (MAGC1_HUMAN)
SRSSPESPF

SEQ ID NO: 70307 - protein, 9 aa, Artificial Sequence
  Description of Artificial Sequence: Synthetic peptide
  Seed: SIIFIKGTY (MAGC1_HUMAN)
SVIFIKGTW

SEQ ID NO: 70308 - protein, 9 aa, Artificial Sequence
  Description of Artificial Sequence: Synthetic peptide
  Seed: WVQEHYLEY (MAGC1_HUMAN)
WVQEHYLEM

SEQ ID NO: 70309 - protein, 10 aa, Artificial Sequence
  Description of Artificial Sequence: Synthetic peptide
  Seed: SPLQIPVSPS (MAGC1_HUMAN)
SPLQIPVSPA

SEQ ID NO: 70310 - protein, 10 aa, Artificial Sequence
  Description of Artificial Sequence: Synthetic peptide
  Seed: SFSSTLVSLF (MAGC1_HUMAN)
SSSSTLVSLY

SEQ ID NO: 70311 - protein, 10 aa, Artificial Sequence
  Description of Artificial Sequence: Synthetic peptide
  Seed: YTLLSLFQSS (MAGC1_HUMAN)
YWLLSLFQSI

SEQ ID NO: 70312 - protein, 9 aa, Artificial Sequence
  Description of Artificial Sequence: Synthetic peptide
  Seed: FSEESSSPV (MAGC1_HUMAN)
FAEESSSPV

SEQ ID NO: 70313 - protein, 9 aa, Artificial Sequence
  Description of Artificial Sequence: Synthetic peptide
  Seed: SSPESTQSP (MAGC1_HUMAN)
SAPESTQSL

SEQ ID NO: 70314 - protein, 9 aa, Artificial Sequence
  Description of Artificial Sequence: Synthetic peptide
  Seed: SSPERTHST (MAGC1_HUMAN)
SSPERTHSI

SEQ ID NO: 70315 - protein, 9 aa, Artificial Sequence
  Description of Artificial Sequence: Synthetic peptide
  Seed: SSPESPLQS (MAGC1_HUMAN)
SCPESPLQL

SEQ ID NO: 70316 - protein, 9 aa, Artificial Sequence
  Description of Artificial Sequence: Synthetic peptide
  Seed: TFEGFPQSL (MAGC1_HUMAN)
TPEGFPQSM

SEQ ID NO: 70317 - protein, 9 aa, Artificial Sequence
  Description of Artificial Sequence: Synthetic peptide
  Seed: TLDEKVDEL (MAGC1_HUMAN)
TSDEKVDEW

SEQ ID NO: 70318 - protein, 9 aa, Artificial Sequence
  Description of Artificial Sequence: Synthetic peptide
  Seed: YPLQSPQSR (MAGC1_HUMAN)
YSLQSPQSR

SEQ ID NO: 70319 - protein, 9 aa, Artificial Sequence
  Description of Artificial Sequence: Synthetic peptide
  Seed: FSSTLLSIL (MAGC1_HUMAN)
FKSTLLSIL

SEQ ID NO: 70320 - protein, 11 aa, Artificial Sequence
  Description of Artificial Sequence: Synthetic peptide
  Seed: SSFPSSTSSSL (MAGC1_HUMAN)
SLFPSSTSSSM

SEQ ID NO: 70321 - protein, 10 aa, Artificial Sequence
  Description of Artificial Sequence: Synthetic peptide
  Seed: YTLDEKVDEL (MAGC1_HUMAN)
YWLDEKVDEV

SEQ ID NO: 70322 - protein, 9 aa, Artificial Sequence
  Description of Artificial Sequence: Synthetic peptide
  Seed: SQSPPEGPV (MAGC1_HUMAN)
SASPPEGPV

SEQ ID NO: 70323 - protein, 9 aa, Artificial Sequence
  Description of Artificial Sequence: Synthetic peptide
  Seed: MSQNRLLIL (MAGC1_HUMAN)
MPQNRLLIM

SEQ ID NO: 70324 - protein, 9 aa, Artificial Sequence
  Description of Artificial Sequence: Synthetic peptide
  Seed: YQVKQPITK (MAGC1_HUMAN)
YHVKQPITF

SEQ ID NO: 70325 - protein, 9 aa, Artificial Sequence
  Description of Artificial Sequence: Synthetic peptide
  Seed: FEGFAQSSL (MAGC1_HUMAN)
FEGFAQSSW

SEQ ID NO: 70326 - protein, 10 aa, Artificial Sequence
  Description of Artificial Sequence: Synthetic peptide
  Seed: RKAREFIEIL (MAGC1_HUMAN)
RMAREFIEIF

SEQ ID NO: 70327 - protein, 10 aa, Artificial Sequence
  Description of Artificial Sequence: Synthetic peptide
  Seed: STLLSLFQSF (MAGC1_HUMAN)
SLLLSLFQSY

SEQ ID NO: 70328 - protein, 9 aa, Artificial Sequence
  Description of Artificial Sequence: Synthetic peptide
  Seed: SFSSTLVSL (MAGC1_HUMAN)
SVSSTLVSV

SEQ ID NO: 70329 - protein, 9 aa, Artificial Sequence
  Description of Artificial Sequence: Synthetic peptide
  Seed: QIVPSLPEW (MAGC1_HUMAN)
QGVPSLPEW

SEQ ID NO: 70330 - protein, 9 aa, Artificial Sequence
  Description of Artificial Sequence: Synthetic peptide
  Seed: TLLSLFQSF (MAGC1_HUMAN)
TKLSLFQSM

SEQ ID NO: 70331 - protein, 9 aa, Artificial Sequence
  Description of Artificial Sequence: Synthetic peptide
  Seed: LQIPMTSSF (MAGC1_HUMAN)
LMIPMTSSI

SEQ ID NO: 70332 - protein, 9 aa, Artificial Sequence
  Description of Artificial Sequence: Synthetic peptide
  Seed: NVISRYTGY (MAGC1_HUMAN)
NAISRYTGY

SEQ ID NO: 70333 - protein, 9 aa, Artificial Sequence
  Description of Artificial Sequence: Synthetic peptide
  Seed: RTHSTFEGF (MAGC1_HUMAN)
RGHSTFEGY

SEQ ID NO: 70334 - protein, 9 aa, Artificial Sequence
  Description of Artificial Sequence: Synthetic peptide
  Seed: KVVEFLAML (MAGC1_HUMAN)
KYVEFLAMY

SEQ ID NO: 70335 - protein, 11 aa, Artificial Sequence
  Description of Artificial Sequence: Synthetic peptide
  Seed: SPLQIPGSPSF (MAGC1_HUMAN)
SYLQIPGSPSY

SEQ ID NO: 70336 - protein, 10 aa, Artificial Sequence
  Description of Artificial Sequence: Synthetic peptide
  Seed: KVDELARFLL (MAGC1_HUMAN)
KSDELARFLW

SEQ ID NO: 70337 - protein, 10 aa, Artificial Sequence
  Description of Artificial Sequence: Synthetic peptide
  Seed: SPLQIPGSPS (MAGC1_HUMAN)
SPLQIPGSPV

SEQ ID NO: 70338 - protein, 9 aa, Artificial Sequence
  Description of Artificial Sequence: Synthetic peptide
  Seed: SSPESAQSA (MAGC1_HUMAN)
SIPESAQSY

SEQ ID NO: 70339 - protein, 10 aa, Artificial Sequence
  Description of Artificial Sequence: Synthetic peptide
  Seed: FPQSLLQIPM (MAGC1_HUMAN)
FMQSLLQIPV

SEQ ID NO: 70340 - protein, 10 aa, Artificial Sequence
  Description of Artificial Sequence: Synthetic peptide
  Seed: RAGREHFAFG (MAGC1_HUMAN)
RAGREHFAFR

SEQ ID NO: 70341 - protein, 11 aa, Artificial Sequence
  Description of Artificial Sequence: Synthetic peptide
  Seed: SSFSYTLLSLF (MAGC1_HUMAN)
SIFSYTLLSLY

SEQ ID NO: 70342 - protein, 11 aa, Artificial Sequence
  Description of Artificial Sequence: Synthetic peptide
  Seed: LQIPVSSSFSY (MAGC1_HUMAN)
LHIPVSSSFSW

SEQ ID NO: 70343 - protein, 10 aa, Artificial Sequence
  Description of Artificial Sequence: Synthetic peptide
  Seed: SFFSSALLSI (MAGC1_HUMAN)
SKFSSALLSF

SEQ ID NO: 70344 - protein, 8 aa, Artificial Sequence
  Description of Artificial Sequence: Synthetic peptide
  Seed: QNPASSFF (MAGC1_HUMAN)
QYPASSFF

SEQ ID NO: 70345 - protein, 11 aa, Artificial Sequence
  Description of Artificial Sequence: Synthetic peptide
  Seed: SFFSSALLSIF (MAGC1_HUMAN)
SVFSSALLSIY

SEQ ID NO: 70346 - protein, 9 aa, Artificial Sequence
  Description of Artificial Sequence: Synthetic peptide
  Seed: IPVSSSFSY (MAGC1_HUMAN)
ITVSSSFSM

SEQ ID NO: 70347 - protein, 9 aa, Artificial Sequence
  Description of Artificial Sequence: Synthetic peptide
  Seed: YPLQSPQSR (MAGC1_HUMAN)
YPLQSPQSS

SEQ ID NO: 70348 - protein, 9 aa, Artificial Sequence
  Description of Artificial Sequence: Synthetic peptide
  Seed: RSFSSTLLS (MAGC1_HUMAN)
RLFSSTLLY

SEQ ID NO: 70349 - protein, 11 aa, Artificial Sequence
  Description of Artificial Sequence: Synthetic peptide
  Seed: TTDDSTATESA (MAGC1_HUMAN)
TTDDSTATESL

SEQ ID NO: 70350 - protein, 10 aa, Artificial Sequence
  Description of Artificial Sequence: Synthetic peptide
  Seed: SMSPLYFPQS (MAGC1_HUMAN)
SLSPLYFPQM

SEQ ID NO: 70351 - protein, 10 aa, Artificial Sequence
  Description of Artificial Sequence: Synthetic peptide
  Seed: ASSFFSSALL (MAGC1_HUMAN)
AESFFSSALY

SEQ ID NO: 70352 - protein, 9 aa, Artificial Sequence
  Description of Artificial Sequence: Synthetic peptide
  Seed: LILSIIFIK (MAGC1_HUMAN)
LFLSIIFIR

SEQ ID NO: 70353 - protein, 9 aa, Artificial Sequence
  Description of Artificial Sequence: Synthetic peptide
  Seed: TLDEKVDEL (MAGC1_HUMAN)
TIDEKVDEF

SEQ ID NO: 70354 - protein, 10 aa, Artificial Sequence
  Description of Artificial Sequence: Synthetic peptide
  Seed: QIPVSSSFSY (MAGC1_HUMAN)
QNPVSSSFSF

SEQ ID NO: 70355 - protein, 10 aa, Artificial Sequence
  Description of Artificial Sequence: Synthetic peptide
  Seed: YTLLSLFQSS (MAGC1_HUMAN)
YPLLSLFQSL

SEQ ID NO: 70356 - protein, 10 aa, Artificial Sequence
  Description of Artificial Sequence: Synthetic peptide
  Seed: FPSSYKDALK (MAGC1_HUMAN)
FSSSYKDALK

SEQ ID NO: 70357 - protein, 10 aa, Artificial Sequence
  Description of Artificial Sequence: Synthetic peptide
  Seed: TTDDSTATES (MAGC1_HUMAN)
TQDDSTATEM

SEQ ID NO: 70358 - protein, 9 aa, Artificial Sequence
  Description of Artificial Sequence: Synthetic peptide
  Seed: SPLEGEDSL (MAGC1_HUMAN)
SVLEGEDSY

SEQ ID NO: 70359 - protein, 9 aa, Artificial Sequence
  Description of Artificial Sequence: Synthetic peptide
  Seed: EPRELLTKV (MAGC1_HUMAN)
EMRELLTKL

SEQ ID NO: 70360 - protein, 9 aa, Artificial Sequence
  Description of Artificial Sequence: Synthetic peptide
  Seed: NTVPITFPS (MAGC1_HUMAN)
NTVPITFPK

SEQ ID NO: 70361 - protein, 9 aa, Artificial Sequence
  Description of Artificial Sequence: Synthetic peptide
  Seed: IESEPLFTY (MAGC1_HUMAN)
IRSEPLFTL

SEQ ID NO: 70362 - protein, 9 aa, Artificial Sequence
  Description of Artificial Sequence: Synthetic peptide
  Seed: LQIPVSPSF (MAGC1_HUMAN)
LKIPVSPSM

SEQ ID NO: 70363 - protein, 9 aa, Artificial Sequence
  Description of Artificial Sequence: Synthetic peptide
  Seed: SLFQSFSER (MAGC1_HUMAN)
SAFQSFSEV

SEQ ID NO: 70364 - protein, 9 aa, Artificial Sequence
  Description of Artificial Sequence: Synthetic peptide
  Seed: EDSSDPLQR (MAGC1_HUMAN)
EVSSDPLQR

SEQ ID NO: 70365 - protein, 9 aa, Artificial Sequence
  Description of Artificial Sequence: Synthetic peptide
  Seed: MLTNVISRY (MAGC1_HUMAN)
MVTNVISRR

SEQ ID NO: 70366 - protein, 10 aa, Artificial Sequence
  Description of Artificial Sequence: Synthetic peptide
  Seed: SLQIPVSPSF (MAGC1_HUMAN)
SRQIPVSPSF

SEQ ID NO: 70367 - protein, 9 aa, Artificial Sequence
  Description of Artificial Sequence: Synthetic peptide
  Seed: LQIPVSAAS (MAGC1_HUMAN)
LWIPVSAAF

SEQ ID NO: 70368 - protein, 10 aa, Artificial Sequence
  Description of Artificial Sequence: Synthetic peptide
  Seed: QRPVSSFFSY (MAGC1_HUMAN)
QWPVSSFFSF

SEQ ID NO: 70369 - protein, 10 aa, Artificial Sequence
  Description of Artificial Sequence: Synthetic peptide
  Seed: STPSSLPQSF (MAGC1_HUMAN)
SYPSSLPQSM

SEQ ID NO: 70370 - protein, 11 aa, Artificial Sequence
  Description of Artificial Sequence: Synthetic peptide
  Seed: IIDTTDDSTAT (MAGC1_HUMAN)
IGDTTDDSTAM

SEQ ID NO: 70371 - protein, 10 aa, Artificial Sequence
  Description of Artificial Sequence: Synthetic peptide
  Seed: SSPESTQSPF (MAGC1_HUMAN)
SHPESTQSPL

SEQ ID NO: 70372 - protein, 11 aa, Artificial Sequence
  Description of Artificial Sequence: Synthetic peptide
  Seed: SSTPSSLPQSF (MAGC1_HUMAN)
SVTPSSLPQSY

SEQ ID NO: 70373 - protein, 10 aa, Artificial Sequence
  Description of Artificial Sequence: Synthetic peptide
  Seed: MPTAGMPSLL (MAGC1_HUMAN)
MPTAGMPSLW

SEQ ID NO: 70374 - protein, 10 aa, Artificial Sequence
  Description of Artificial Sequence: Synthetic peptide
  Seed: SQSPPEGEDV (MAGC1_HUMAN)
SHSPPEGEDI

SEQ ID NO: 70375 - protein, 9 aa, Artificial Sequence
  Description of Artificial Sequence: Synthetic peptide
  Seed: SFSSTLVSL (MAGC1_HUMAN)
SMSSTLVSI

SEQ ID NO: 70376 - protein, 9 aa, Artificial Sequence
  Description of Artificial Sequence: Synthetic peptide
  Seed: SLSPFSEES (MAGC1_HUMAN)
STSPFSEEL

SEQ ID NO: 70377 - protein, 10 aa, Artificial Sequence
  Description of Artificial Sequence: Synthetic peptide
  Seed: MTSSFSSTLL (MAGC1_HUMAN)
MHSSFSSTLV

SEQ ID NO: 70378 - protein, 9 aa, Artificial Sequence
  Description of Artificial Sequence: Synthetic peptide
  Seed: FSSTLVSLF (MAGC1_HUMAN)
FLSTLVSLY

SEQ ID NO: 70379 - protein, 9 aa, Artificial Sequence
  Description of Artificial Sequence: Synthetic peptide
  Seed: FLAMLKNTV (MAGC1_HUMAN)
FAAMLKNTY

SEQ ID NO: 70380 - protein, 9 aa, Artificial Sequence
  Description of Artificial Sequence: Synthetic peptide
  Seed: FFSSALLSI (MAGC1_HUMAN)
FISSALLSL

SEQ ID NO: 70381 - protein, 11 aa, Artificial Sequence
  Description of Artificial Sequence: Synthetic peptide
  Seed: TLYPLQSPQSR (MAGC1_HUMAN)
TIYPLQSPQSK

SEQ ID NO: 70382 - protein, 10 aa, Artificial Sequence
  Description of Artificial Sequence: Synthetic peptide
  Seed: LQIPGSPSFS (MAGC1_HUMAN)
LMIPGSPSFY

SEQ ID NO: 70383 - protein, 11 aa, Artificial Sequence
  Description of Artificial Sequence: Synthetic peptide
  Seed: SPLQIPGSPSF (MAGC1_HUMAN)
SQLQIPGSPSM

SEQ ID NO: 70384 - protein, 11 aa, Artificial Sequence
  Description of Artificial Sequence: Synthetic peptide
  Seed: REVPNSSPPRY (MAGC1_HUMAN)
RYVPNSSPPRY

SEQ ID NO: 70385 - protein, 10 aa, Artificial Sequence
  Description of Artificial Sequence: Synthetic peptide
  Seed: TTDDSTATES (MAGC1_HUMAN)
TMDDSTATEY

SEQ ID NO: 70386 - protein, 11 aa, Artificial Sequence
  Description of Artificial Sequence: Synthetic peptide
  Seed: SPLQNPASSFF (MAGC1_HUMAN)
SALQNPASSFF

SEQ ID NO: 70387 - protein, 11 aa, Artificial Sequence
  Description of Artificial Sequence: Synthetic peptide
  Seed: REVDPDDSYVF (MAGC1_HUMAN)
RVVDPDDSYVM

SEQ ID NO: 70388 - protein, 11 aa, Artificial Sequence
  Description of Artificial Sequence: Synthetic peptide
  Seed: SPLQIPMTSSF (MAGC1_HUMAN)
SNLQIPMTSSM

SEQ ID NO: 70389 - protein, 9 aa, Artificial Sequence
  Description of Artificial Sequence: Synthetic peptide
  Seed: TTDDSTATE (MAGC1_HUMAN)
TFDDSTATI

SEQ ID NO: 70390 - protein, 9 aa, Artificial Sequence
  Description of Artificial Sequence: Synthetic peptide
  Seed: SQSPPEGPV (MAGC1_HUMAN)
STSPPEGPY

SEQ ID NO: 70391 - protein, 10 aa, Artificial Sequence
  Description of Artificial Sequence: Synthetic peptide
  Seed: LQNPASSFFS (MAGC1_HUMAN)
LMNPASSFFF

SEQ ID NO: 70392 - protein, 9 aa, Artificial Sequence
  Description of Artificial Sequence: Synthetic peptide
  Seed: FQSSLQSPV (MAGC1_HUMAN)
FRSSLQSPI

SEQ ID NO: 70393 - protein, 11 aa, Artificial Sequence
  Description of Artificial Sequence: Synthetic peptide
  Seed: AASSSTLVSIF (MAGC1_HUMAN)
AQSSSTLVSIF

SEQ ID NO: 70394 - protein, 11 aa, Artificial Sequence
  Description of Artificial Sequence: Synthetic peptide
  Seed: LQRPVSSFFSY (MAGC1_HUMAN)
LSRPVSSFFSY

SEQ ID NO: 70395 - protein, 9 aa, Artificial Sequence
  Description of Artificial Sequence: Synthetic peptide
  Seed: RPVSSFFSY (MAGC1_HUMAN)
RQVSSFFSW

SEQ ID NO: 70396 - protein, 8 aa, Artificial Sequence
  Description of Artificial Sequence: Synthetic peptide
  Seed: LQRPVSSF (MAGC1_HUMAN)
LQRPVSSV

SEQ ID NO: 70397 - protein, 9 aa, Artificial Sequence
  Description of Artificial Sequence: Synthetic peptide
  Seed: FQSSLQSPV (MAGC1_HUMAN)
FISSLQSPA

SEQ ID NO: 70398 - protein, 11 aa, Artificial Sequence
  Description of Artificial Sequence: Synthetic peptide
  Seed: QSSPESAQSAF (MAGC1_HUMAN)
QVSPESAQSAY

SEQ ID NO: 70399 - protein, 11 aa, Artificial Sequence
  Description of Artificial Sequence: Synthetic peptide
  Seed: SFFSYTLASLL (MAGC1_HUMAN)
SCFSYTLASLF

SEQ ID NO: 70400 - protein, 9 aa, Artificial Sequence
  Description of Artificial Sequence: Synthetic peptide
  Seed: STFEGFAQS (MAGC1_HUMAN)
SVFEGFAQI

SEQ ID NO: 70401 - protein, 10 aa, Artificial Sequence
  Description of Artificial Sequence: Synthetic peptide
  Seed: QGEDSMSPLY (MAGC1_HUMAN)
QSEDSMSPLW

SEQ ID NO: 70402 - protein, 11 aa, Artificial Sequence
  Description of Artificial Sequence: Synthetic peptide
  Seed: SPLQRPVSSFF (MAGC1_HUMAN)
SELQRPVSSFF

SEQ ID NO: 70403 - protein, 9 aa, Artificial Sequence
  Description of Artificial Sequence: Synthetic peptide
  Seed: SSSTLLSLF (MAGC1_HUMAN)
SQSTLLSLF

SEQ ID NO: 70404 - protein, 10 aa, Artificial Sequence
  Description of Artificial Sequence: Synthetic peptide
  Seed: SLSPLHFPQF (MAGC1_HUMAN)
SASPLHFPQW

SEQ ID NO: 70405 - protein, 10 aa, Artificial Sequence
  Description of Artificial Sequence: Synthetic peptide
  Seed: STFEGFAQSS (MAGC1_HUMAN)
SIFEGFAQSV

SEQ ID NO: 70406 - protein, 9 aa, Artificial Sequence
  Description of Artificial Sequence: Synthetic peptide
  Seed: ISFSSSTSL (MAGC1_HUMAN)
IIFSSSTSL

SEQ ID NO: 70407 - protein, 11 aa, Artificial Sequence
  Description of Artificial Sequence: Synthetic peptide
  Seed: FLAMLKNTVPI (MAGC1_HUMAN)
FIAMLKNTVPI

SEQ ID NO: 70408 - protein, 9 aa, Artificial Sequence
  Description of Artificial Sequence: Synthetic peptide
  Seed: SQNRLLILI (MAGC1_HUMAN)
SRNRLLILV

SEQ ID NO: 70409 - protein, 10 aa, Artificial Sequence
  Description of Artificial Sequence: Synthetic peptide
  Seed: ATESASSSVM (MAGC1_HUMAN)
APESASSSVW

SEQ ID NO: 70410 - protein, 11 aa, Artificial Sequence
  Description of Artificial Sequence: Synthetic peptide
  Seed: SPLQIPGSPSF (MAGC1_HUMAN)
SDLQIPGSPSY

SEQ ID NO: 70411 - protein, 8 aa, Artificial Sequence
  Description of Artificial Sequence: Synthetic peptide
  Seed: AFGEPREL (MAGC1_HUMAN)
ATGEPREL

SEQ ID NO: 70412 - protein, 9 aa, Artificial Sequence
  Description of Artificial Sequence: Synthetic peptide
  Seed: SLIESEPLF (MAGC1_HUMAN)
STIESEPLV

SEQ ID NO: 70413 - protein, 11 aa, Artificial Sequence
  Description of Artificial Sequence: Synthetic peptide
  Seed: FPQFPPQGEDF (MAGC1_HUMAN)
FPQFPPQGEDY

SEQ ID NO: 70414 - protein, 9 aa, Artificial Sequence
  Description of Artificial Sequence: Synthetic peptide
  Seed: MPSLLQSSS (MAGC1_HUMAN)
MTSLLQSSF

SEQ ID NO: 70415 - protein, 10 aa, Artificial Sequence
  Description of Artificial Sequence: Synthetic peptide
  Seed: GEDSLSSLHF (MAGC1_HUMAN)
GEDSLSSLHW

SEQ ID NO: 70416 - protein, 10 aa, Artificial Sequence
  Description of Artificial Sequence: Synthetic peptide
  Seed: GEDSSDPLQR (MAGC1_HUMAN)
GLDSSDPLQY

SEQ ID NO: 70417 - protein, 9 aa, Artificial Sequence
  Description of Artificial Sequence: Synthetic peptide
  Seed: VSAASSSTL (MAGC1_HUMAN)
VWAASSSTL

SEQ ID NO: 70418 - protein, 11 aa, Artificial Sequence
  Description of Artificial Sequence: Synthetic peptide
  Seed: FLAMLKNTVPI (MAGC1_HUMAN)
FSAMLKNTVPA

SEQ ID NO: 70419 - protein, 9 aa, Artificial Sequence
  Description of Artificial Sequence: Synthetic peptide
  Seed: TLLSLFQSF (MAGC1_HUMAN)
TILSLFQSW

SEQ ID NO: 70420 - protein, 9 aa, Artificial Sequence
  Description of Artificial Sequence: Synthetic peptide
  Seed: LQIPVSRSF (MAGC1_HUMAN)
LYIPVSRSY

SEQ ID NO: 70421 - protein, 10 aa, Artificial Sequence
  Description of Artificial Sequence: Synthetic peptide
  Seed: SLFQSFSERT (MAGC1_HUMAN)
SMFQSFSERL

SEQ ID NO: 70422 - protein, 9 aa, Artificial Sequence
  Description of Artificial Sequence: Synthetic peptide
  Seed: LQIPVSSSS (MAGC1_HUMAN)
LFIPVSSSY

SEQ ID NO: 70423 - protein, 11 aa, Artificial Sequence
  Description of Artificial Sequence: Synthetic peptide
  Seed: QSSPESDDTLY (MAGC1_HUMAN)
QPSPESDDTLF

SEQ ID NO: 70424 - protein, 10 aa, Artificial Sequence
  Description of Artificial Sequence: Synthetic peptide
  Seed: RSFSSTLLSI (MAGC1_HUMAN)
RWFSSTLLSM

SEQ ID NO: 70425 - protein, 9 aa, Artificial Sequence
  Description of Artificial Sequence: Synthetic peptide
  Seed: EDSLSPLQI (MAGC1_HUMAN)
EESLSPLQL

SEQ ID NO: 70426 - protein, 10 aa, Artificial Sequence
  Description of Artificial Sequence: Synthetic peptide
  Seed: VRAGREHFAF (MAGC1_HUMAN)
VKAGREHFAF

SEQ ID NO: 70427 - protein, 9 aa, Artificial Sequence
  Description of Artificial Sequence: Synthetic peptide
  Seed: FLWGPRAHS (MAGC1_HUMAN)
FMWGPRAHI

SEQ ID NO: 70428 - protein, 11 aa, Artificial Sequence
  Description of Artificial Sequence: Synthetic peptide
  Seed: RKAREFIEILF (MAGC1_HUMAN)
RQAREFIEILY

SEQ ID NO: 70429 - protein, 9 aa, Artificial Sequence
  Description of Artificial Sequence: Synthetic peptide
  Seed: FSSTLVSLF (MAGC1_HUMAN)
FYSTLVSLF

SEQ ID NO: 70430 - protein, 11 aa, Artificial Sequence
  Description of Artificial Sequence: Synthetic peptide
  Seed: VISRYTGYFPV (MAGC1_HUMAN)
VMSRYTGYFPL

SEQ ID NO: 70431 - protein, 9 aa, Artificial Sequence
  Description of Artificial Sequence: Synthetic peptide
  Seed: FSSTLVSLF (MAGC1_HUMAN)
FASTLVSLH

SEQ ID NO: 70432 - protein, 9 aa, Artificial Sequence
  Description of Artificial Sequence: Synthetic peptide
  Seed: KVDELARFL (MAGC1_HUMAN)
KIDELARFF

SEQ ID NO: 70433 - protein, 9 aa, Artificial Sequence
  Description of Artificial Sequence: Synthetic peptide
  Seed: VSPSFSSTL (MAGC1_HUMAN)
VSPSFSSTI

SEQ ID NO: 70434 - protein, 10 aa, Artificial Sequence
  Description of Artificial Sequence: Synthetic peptide
  Seed: FFSSALLSIF (MAGC1_HUMAN)
FFSSALLSIY

SEQ ID NO: 70435 - protein, 10 aa, Artificial Sequence
  Description of Artificial Sequence: Synthetic peptide
  Seed: SSFSYTLLSL (MAGC1_HUMAN)
SLFSYTLLSI

SEQ ID NO: 70436 - protein, 10 aa, Artificial Sequence
  Description of Artificial Sequence: Synthetic peptide
  Seed: LLQIPMTSSF (MAGC1_HUMAN)
LFQIPMTSSL

SEQ ID NO: 70437 - protein, 10 aa, Artificial Sequence
  Description of Artificial Sequence: Synthetic peptide
  Seed: IIDTTDDSTA (MAGC1_HUMAN)
IVDTTDDSTI

SEQ ID NO: 70438 - protein, 9 aa, Artificial Sequence
  Description of Artificial Sequence: Synthetic peptide
  Seed: HESPQSPPE (MAGC1_HUMAN)
HESPQSPPC

SEQ ID NO: 70439 - protein, 10 aa, Artificial Sequence
  Description of Artificial Sequence: Synthetic peptide
  Seed: FLAMLKNTVP (MAGC1_HUMAN)
FLAMLKNTVK

SEQ ID NO: 70440 - protein, 11 aa, Artificial Sequence
  Description of Artificial Sequence: Synthetic peptide
  Seed: SPLQRPVSSFF (MAGC1_HUMAN)
SPLQRPVSSFM

SEQ ID NO: 70441 - protein, 11 aa, Artificial Sequence
  Description of Artificial Sequence: Synthetic peptide
  Seed: REVDPDDSYVF (MAGC1_HUMAN)
RQVDPDDSYVV

SEQ ID NO: 70442 - protein, 9 aa, Artificial Sequence
  Description of Artificial Sequence: Synthetic peptide
  Seed: SSPESPLQS (MAGC1_HUMAN)
SAPESPLQI

SEQ ID NO: 70443 - protein, 10 aa, Artificial Sequence
  Description of Artificial Sequence: Synthetic peptide
  Seed: SFSERTQSTF (MAGC1_HUMAN)
SQSERTQSTF

SEQ ID NO: 70444 - protein, 11 aa, Artificial Sequence
  Description of Artificial Sequence: Synthetic peptide
  Seed: QSSPESAQSAF (MAGC1_HUMAN)
QGSPESAQSAW

SEQ ID NO: 70445 - protein, 9 aa, Artificial Sequence
  Description of Artificial Sequence: Synthetic peptide
  Seed: FSSTLVSLF (MAGC1_HUMAN)
FTSTLVSLL

SEQ ID NO: 70446 - protein, 11 aa, Artificial Sequence
  Description of Artificial Sequence: Synthetic peptide
  Seed: IIDTTDDSTAT (MAGC1_HUMAN)
ISDTTDDSTAI

SEQ ID NO: 70447 - protein, 9 aa, Artificial Sequence
  Description of Artificial Sequence: Synthetic peptide
  Seed: TLLSILQSS (MAGC1_HUMAN)
TVLSILQSA

SEQ ID NO: 70448 - protein, 11 aa, Artificial Sequence
  Description of Artificial Sequence: Synthetic peptide
  Seed: SSSSSTLLSLF (MAGC1_HUMAN)
SISSSTLLSLW

SEQ ID NO: 70449 - protein, 9 aa, Artificial Sequence
  Description of Artificial Sequence: Synthetic peptide
  Seed: SSSTSLSPF (MAGC1_HUMAN)
SASTSLSPF

SEQ ID NO: 70450 - protein, 9 aa, Artificial Sequence
  Description of Artificial Sequence: Synthetic peptide
  Seed: KVWVQEHYL (MAGC1_HUMAN)
KIWVQEHYR

SEQ ID NO: 70451 - protein, 10 aa, Artificial Sequence
  Description of Artificial Sequence: Synthetic peptide
  Seed: RAGREHFAFG (MAGC1_HUMAN)
RLGREHFAFM

SEQ ID NO: 70452 - protein, 9 aa, Artificial Sequence
  Description of Artificial Sequence: Synthetic peptide
  Seed: FQSSPERTH (MAGC1_HUMAN)
FHSSPERTY

SEQ ID NO: 70453 - protein, 8 aa, Artificial Sequence
  Description of Artificial Sequence: Synthetic peptide
  Seed: SERTQSTF (MAGC1_HUMAN)
SERTQSTL

SEQ ID NO: 70454 - protein, 9 aa, Artificial Sequence
  Description of Artificial Sequence: Synthetic peptide
  Seed: SQSSPVSSF (MAGC1_HUMAN)
SISSPVSSV

SEQ ID NO: 70455 - protein, 10 aa, Artificial Sequence
  Description of Artificial Sequence: Synthetic peptide
  Seed: REFIEILFGI (MAGC1_HUMAN)
RGFIEILFGF

SEQ ID NO: 70456 - protein, 10 aa, Artificial Sequence
  Description of Artificial Sequence: Synthetic peptide
  Seed: VRAGREHFAF (MAGC1_HUMAN)
VQAGREHFAM

SEQ ID NO: 70457 - protein, 11 aa, Artificial Sequence
  Description of Artificial Sequence: Synthetic peptide
  Seed: TLDEKVDELAR (MAGC1_HUMAN)
TMDEKVDELAY

SEQ ID NO: 70458 - protein, 9 aa, Artificial Sequence
  Description of Artificial Sequence: Synthetic peptide
  Seed: FFSYTLASL (MAGC1_HUMAN)
FMSYTLASI

SEQ ID NO: 70459 - protein, 9 aa, Artificial Sequence
  Description of Artificial Sequence: Synthetic peptide
  Seed: LQIPVSSSS (MAGC1_HUMAN)
LKIPVSSSF

SEQ ID NO: 70460 - protein, 11 aa, Artificial Sequence
  Description of Artificial Sequence: Synthetic peptide
  Seed: SPLQIPVSPSS (MAGC1_HUMAN)
SPLQIPVSPSC

SEQ ID NO: 70461 - protein, 10 aa, Artificial Sequence
  Description of Artificial Sequence: Synthetic peptide
  Seed: ILILSIIFIK (MAGC1_HUMAN)
ISILSIIFIR

SEQ ID NO: 70462 - protein, 10 aa, Artificial Sequence
  Description of Artificial Sequence: Synthetic peptide
  Seed: YTLASLLQSS (MAGC1_HUMAN)
YCLASLLQSA

SEQ ID NO: 70463 - protein, 9 aa, Artificial Sequence
  Description of Artificial Sequence: Synthetic peptide
  Seed: SSFFSSALL (MAGC1_HUMAN)
SFFFSSALL

SEQ ID NO: 70464 - protein, 10 aa, Artificial Sequence
  Description of Artificial Sequence: Synthetic peptide
  Seed: QIPVSSSFSY (MAGC1_HUMAN)
QRPVSSSFSY

SEQ ID NO: 70465 - protein, 9 aa, Artificial Sequence
  Description of Artificial Sequence: Synthetic peptide
  Seed: ISFSSSTSL (MAGC1_HUMAN)
IYFSSSTSH

SEQ ID NO: 70466 - protein, 11 aa, Artificial Sequence
  Description of Artificial Sequence: Synthetic peptide
  Seed: VSSSSSSSTLL (MAGC1_HUMAN)
VRSSSSSSTLF

SEQ ID NO: 70467 - protein, 10 aa, Artificial Sequence
  Description of Artificial Sequence: Synthetic peptide
  Seed: FFSYTLASLL (MAGC1_HUMAN)
FISYTLASLV

SEQ ID NO: 70468 - protein, 10 aa, Artificial Sequence
  Description of Artificial Sequence: Synthetic peptide
  Seed: RKVVEFLAML (MAGC1_HUMAN)
RMVVEFLAMV

SEQ ID NO: 70469 - protein, 11 aa, Artificial Sequence
  Description of Artificial Sequence: Synthetic peptide
  Seed: TTDDSTATESA (MAGC1_HUMAN)
TMDDSTATESL

SEQ ID NO: 70470 - protein, 10 aa, Artificial Sequence
  Description of Artificial Sequence: Synthetic peptide
  Seed: SSSSSSSTLL (MAGC1_HUMAN)
SESSSSSTLW

SEQ ID NO: 70471 - protein, 10 aa, Artificial Sequence
  Description of Artificial Sequence: Synthetic peptide
  Seed: FSSSTSLSPF (MAGC1_HUMAN)
FFSSTSLSPW

SEQ ID NO: 70472 - protein, 10 aa, Artificial Sequence
  Description of Artificial Sequence: Synthetic peptide
  Seed: VISFSSSTSL (MAGC1_HUMAN)
VCSFSSSTSY

SEQ ID NO: 70473 - protein, 9 aa, Artificial Sequence
  Description of Artificial Sequence: Synthetic peptide
  Seed: LQNPASSFF (MAGC1_HUMAN)
LTNPASSFF

SEQ ID NO: 70474 - protein, 9 aa, Artificial Sequence
  Description of Artificial Sequence: Synthetic peptide
  Seed: FEGFAQSPL (MAGC1_HUMAN)
FQGFAQSPL

SEQ ID NO: 70475 - protein, 9 aa, Artificial Sequence
  Description of Artificial Sequence: Synthetic peptide
  Seed: SSSFSYTLL (MAGC1_HUMAN)
SVSFSYTLF

SEQ ID NO: 70476 - protein, 10 aa, Artificial Sequence
  Description of Artificial Sequence: Synthetic peptide
  Seed: SSPESAQSTF (MAGC1_HUMAN)
SWPESAQSTY

SEQ ID NO: 70477 - protein, 9 aa, Artificial Sequence
  Description of Artificial Sequence: Synthetic peptide
  Seed: ASSFFSSAL (MAGC1_HUMAN)
AESFFSSAF

SEQ ID NO: 70478 - protein, 9 aa, Artificial Sequence
  Description of Artificial Sequence: Synthetic peptide
  Seed: SSPERTQST (MAGC1_HUMAN)
SFPERTQSY

SEQ ID NO: 70479 - protein, 9 aa, Artificial Sequence
  Description of Artificial Sequence: Synthetic peptide
  Seed: SQSPPEGPV (MAGC1_HUMAN)
SESPPEGPP

SEQ ID NO: 70480 - protein, 9 aa, Artificial Sequence
  Description of Artificial Sequence: Synthetic peptide
  Seed: LQIPMTSSF (MAGC1_HUMAN)
LAIPMTSSL

SEQ ID NO: 70481 - protein, 9 aa, Artificial Sequence
  Description of Artificial Sequence: Synthetic peptide
  Seed: QVKQPITKA (MAGC1_HUMAN)
QSKQPITKY

SEQ ID NO: 70482 - protein, 10 aa, Artificial Sequence
  Description of Artificial Sequence: Synthetic peptide
  Seed: FPQSVLQIPV (MAGC1_HUMAN)
FPQSVLQIPC

SEQ ID NO: 70483 - protein, 10 aa, Artificial Sequence
  Description of Artificial Sequence: Synthetic peptide
  Seed: SSPECTQSTF (MAGC1_HUMAN)
SMPECTQSTY

SEQ ID NO: 70484 - protein, 9 aa, Artificial Sequence
  Description of Artificial Sequence: Synthetic peptide
  Seed: TLLSLFQSF (MAGC1_HUMAN)
TVLSLFQSL

SEQ ID NO: 70485 - protein, 10 aa, Artificial Sequence
  Description of Artificial Sequence: Synthetic peptide
  Seed: FAQSSLQIPV (MAGC1_HUMAN)
FTQSSLQIPV

SEQ ID NO: 70486 - protein, 10 aa, Artificial Sequence
  Description of Artificial Sequence: Synthetic peptide
  Seed: FPQSLLQIPM (MAGC1_HUMAN)
FQQSLLQIPY

SEQ ID NO: 70487 - protein, 10 aa, Artificial Sequence
  Description of Artificial Sequence: Synthetic peptide
  Seed: SSFSYTLLSL (MAGC1_HUMAN)
SRFSYTLLSM

SEQ ID NO: 70488 - protein, 9 aa, Artificial Sequence
  Description of Artificial Sequence: Synthetic peptide
  Seed: AQSPLQIPV (MAGC1_HUMAN)
AQSPLQIPI

SEQ ID NO: 70489 - protein, 11 aa, Artificial Sequence
  Description of Artificial Sequence: Synthetic peptide
  Seed: HESPQSPPEGP (MAGC1_HUMAN)
HESPQSPPEGA

SEQ ID NO: 70490 - protein, 10 aa, Artificial Sequence
  Description of Artificial Sequence: Synthetic peptide
  Seed: SSSSSTLLSL (MAGC1_HUMAN)
SMSSSTLLSW

SEQ ID NO: 70491 - protein, 11 aa, Artificial Sequence
  Description of Artificial Sequence: Synthetic peptide
  Seed: EGEDSSDPLQR (MAGC1_HUMAN)
EMEDSSDPLQY

SEQ ID NO: 70492 - protein, 9 aa, Artificial Sequence
  Description of Artificial Sequence: Synthetic peptide
  Seed: SSSSSSSTL (MAGC1_HUMAN)
SQSSSSSTL

SEQ ID NO: 70493 - protein, 11 aa, Artificial Sequence
  Description of Artificial Sequence: Synthetic peptide
  Seed: SRYTGYFPVIF (MAGC1_HUMAN)
SWYTGYFPVIF

SEQ ID NO: 70494 - protein, 10 aa, Artificial Sequence
  Description of Artificial Sequence: Synthetic peptide
  Seed: TDDSTATESA (MAGC1_HUMAN)
TEDSTATESL

SEQ ID NO: 70495 - protein, 9 aa, Artificial Sequence
  Description of Artificial Sequence: Synthetic peptide
  Seed: KVVEFLAML (MAGC1_HUMAN)
KSVEFLAMY

SEQ ID NO: 70496 - protein, 11 aa, Artificial Sequence
  Description of Artificial Sequence: Synthetic peptide
  Seed: FLAMLKNTVPI (MAGC1_HUMAN)
FSAMLKNTVPL

SEQ ID NO: 70497 - protein, 10 aa, Artificial Sequence
  Description of Artificial Sequence: Synthetic peptide
  Seed: QRPVSSFFSY (MAGC1_HUMAN)
QIPVSSFFSY

SEQ ID NO: 70498 - protein, 9 aa, Artificial Sequence
  Description of Artificial Sequence: Synthetic peptide
  Seed: IIDTTDDST (MAGC1_HUMAN)
ISDTTDDSL

SEQ ID NO: 70499 - protein, 10 aa, Artificial Sequence
  Description of Artificial Sequence: Synthetic peptide
  Seed: ICSSSTSLSL (MAGC1_HUMAN)
IISSSTSLSF

SEQ ID NO: 70500 - protein, 10 aa, Artificial Sequence
  Description of Artificial Sequence: Synthetic peptide
  Seed: FQSSLQSPVS (MAGC1_HUMAN)
FLSSLQSPVM

SEQ ID NO: 70501 - protein, 9 aa, Artificial Sequence
  Description of Artificial Sequence: Synthetic peptide
  Seed: RAHSEVIKR (MAGC1_HUMAN)
RAHSEVIKL

SEQ ID NO: 70502 - protein, 9 aa, Artificial Sequence
  Description of Artificial Sequence: Synthetic peptide
  Seed: YTSSSDTLL (MAGC1_HUMAN)
YQSSSDTLM

SEQ ID NO: 70503 - protein, 9 aa, Artificial Sequence
  Description of Artificial Sequence: Synthetic peptide
  Seed: GFPQSLLQI (MAGC1_HUMAN)
GYPQSLLQL

SEQ ID NO: 70504 - protein, 9 aa, Artificial Sequence
  Description of Artificial Sequence: Synthetic peptide
  Seed: FSEESSSPV (MAGC1_HUMAN)
FIEESSSPY

SEQ ID NO: 70505 - protein, 11 aa, Artificial Sequence
  Description of Artificial Sequence: Synthetic peptide
  Seed: SPLQIPVSRSF (MAGC1_HUMAN)
SELQIPVSRSF

SEQ ID NO: 70506 - protein, 10 aa, Artificial Sequence
  Description of Artificial Sequence: Synthetic peptide
  Seed: RAHSEVIKRK (MAGC1_HUMAN)
RTHSEVIKRR

SEQ ID NO: 70507 - protein, 9 aa, Artificial Sequence
  Description of Artificial Sequence: Synthetic peptide
  Seed: VSSSFSYTL (MAGC1_HUMAN)
VISSFSYTM

SEQ ID NO: 70508 - protein, 10 aa, Artificial Sequence
  Description of Artificial Sequence: Synthetic peptide
  Seed: YTLASLLQSS (MAGC1_HUMAN)
YWLASLLQST

SEQ ID NO: 70509 - protein, 9 aa, Artificial Sequence
  Description of Artificial Sequence: Synthetic peptide
  Seed: FAFGEPREL (MAGC1_HUMAN)
FYFGEPREY

SEQ ID NO: 70510 - protein, 9 aa, Artificial Sequence
  Description of Artificial Sequence: Synthetic peptide
  Seed: FAQSPLQIP (MAGC1_HUMAN)
FVQSPLQIY

SEQ ID NO: 70511 - protein, 10 aa, Artificial Sequence
  Description of Artificial Sequence: Synthetic peptide
  Seed: MTSSFSSTLL (MAGC1_HUMAN)
MMSSFSSTLF

SEQ ID NO: 70512 - protein, 10 aa, Artificial Sequence
  Description of Artificial Sequence: Synthetic peptide
  Seed: VISFSSSTSL (MAGC1_HUMAN)
VQSFSSSTSW

SEQ ID NO: 70513 - protein, 11 aa, Artificial Sequence
  Description of Artificial Sequence: Synthetic peptide
  Seed: SPLQRPVSSFF (MAGC1_HUMAN)
SKLQRPVSSFF

SEQ ID NO: 70514 - protein, 9 aa, Artificial Sequence
  Description of Artificial Sequence: Synthetic peptide
  Seed: DPDDSYVFV (MAGC1_HUMAN)
DLDDSYVFM

SEQ ID NO: 70515 - protein, 9 aa, Artificial Sequence
  Description of Artificial Sequence: Synthetic peptide
  Seed: QSPLQGEEF (MAGC1_HUMAN)
QIPLQGEEL

SEQ ID NO: 70516 - protein, 9 aa, Artificial Sequence
  Description of Artificial Sequence: Synthetic peptide
  Seed: FFSSALLSI (MAGC1_HUMAN)
FLSSALLSM

SEQ ID NO: 70517 - protein, 9 aa, Artificial Sequence
  Description of Artificial Sequence: Synthetic peptide
  Seed: VSSFFSYTL (MAGC1_HUMAN)
VMSFFSYTM

SEQ ID NO: 70518 - protein, 10 aa, Artificial Sequence
  Description of Artificial Sequence: Synthetic peptide
  Seed: VISFSSSTSL (MAGC1_HUMAN)
VNSFSSSTSY

SEQ ID NO: 70519 - protein, 9 aa, Artificial Sequence
  Description of Artificial Sequence: Synthetic peptide
  Seed: THSPLQIVP (MAGC1_HUMAN)
THSPLQIVL

SEQ ID NO: 70520 - protein, 9 aa, Artificial Sequence
  Description of Artificial Sequence: Synthetic peptide
  Seed: AQSPLQSPV (MAGC1_HUMAN)
ALSPLQSPT

SEQ ID NO: 70521 - protein, 9 aa, Artificial Sequence
  Description of Artificial Sequence: Synthetic peptide
  Seed: TFEGFPQSL (MAGC1_HUMAN)
TIEGFPQSM

SEQ ID NO: 70522 - protein, 9 aa, Artificial Sequence
  Description of Artificial Sequence: Synthetic peptide
  Seed: MGDKDMPTA (MAGC1_HUMAN)
MTDKDMPTV

SEQ ID NO: 70523 - protein, 9 aa, Artificial Sequence
  Description of Artificial Sequence: Synthetic peptide
  Seed: AMLKNTVPI (MAGC1_HUMAN)
AHLKNTVPY

SEQ ID NO: 70524 - protein, 9 aa, Artificial Sequence
  Description of Artificial Sequence: Synthetic peptide
  Seed: FPSSTSSSL (MAGC1_HUMAN)
FLSSTSSSL

SEQ ID NO: 70525 - protein, 10 aa, Artificial Sequence
  Description of Artificial Sequence: Synthetic peptide
  Seed: KVVEFLAMLK (MAGC1_HUMAN)
KIVEFLAMLV

SEQ ID NO: 70526 - protein, 9 aa, Artificial Sequence
  Description of Artificial Sequence: Synthetic peptide
  Seed: EGDDTQSPL (MAGC1_HUMAN)
EYDDTQSPM

SEQ ID NO: 70527 - protein, 10 aa, Artificial Sequence
  Description of Artificial Sequence: Synthetic peptide
  Seed: LHFPQSPPEW (MAGC1_HUMAN)
LYFPQSPPEL

SEQ ID NO: 70528 - protein, 10 aa, Artificial Sequence
  Description of Artificial Sequence: Synthetic peptide
  Seed: YTGYFPVIFR (MAGC1_HUMAN)
YQGYFPVIFK

SEQ ID NO: 70529 - protein, 10 aa, Artificial Sequence
  Description of Artificial Sequence: Synthetic peptide
  Seed: SFFSSALLSI (MAGC1_HUMAN)
SRFSSALLSF

SEQ ID NO: 70530 - protein, 9 aa, Artificial Sequence
  Description of Artificial Sequence: Synthetic peptide
  Seed: VSPSSSSTL (MAGC1_HUMAN)
VLPSSSSTV

SEQ ID NO: 70531 - protein, 9 aa, Artificial Sequence
  Description of Artificial Sequence: Synthetic peptide
  Seed: RKVVEFLAM (MAGC1_HUMAN)
REVVEFLAF

SEQ ID NO: 70532 - protein, 9 aa, Artificial Sequence
  Description of Artificial Sequence: Synthetic peptide
  Seed: SFFSYTLAS (MAGC1_HUMAN)
STFSYTLAF

SEQ ID NO: 70533 - protein, 9 aa, Artificial Sequence
  Description of Artificial Sequence: Synthetic peptide
  Seed: SLFQSFSER (MAGC1_HUMAN)
SIFQSFSER

SEQ ID NO: 70534 - protein, 9 aa, Artificial Sequence
  Description of Artificial Sequence: Synthetic peptide
  Seed: NTVPITFPS (MAGC1_HUMAN)
NAVPITFPR

SEQ ID NO: 70535 - protein, 11 aa, Artificial Sequence
  Description of Artificial Sequence: Synthetic peptide
  Seed: IPMTSSFSSTL (MAGC1_HUMAN)
IIMTSSFSSTF

SEQ ID NO: 70536 - protein, 8 aa, Artificial Sequence
  Description of Artificial Sequence: Synthetic peptide
  Seed: SSPPRYEF (MAGC1_HUMAN)
SSPPRYEL

SEQ ID NO: 70537 - protein, 11 aa, Artificial Sequence
  Description of Artificial Sequence: Synthetic peptide
  Seed: RPVSSFFSYTL (MAGC1_HUMAN)
RNVSSFFSYTW

SEQ ID NO: 70538 - protein, 9 aa, Artificial Sequence
  Description of Artificial Sequence: Synthetic peptide
  Seed: LQIPMTSSF (MAGC1_HUMAN)
LNIPMTSSY

SEQ ID NO: 70539 - protein, 10 aa, Artificial Sequence
  Description of Artificial Sequence: Synthetic peptide
  Seed: SFPSSTSSSL (MAGC1_HUMAN)
SAPSSTSSSF

SEQ ID NO: 70540 - protein, 10 aa, Artificial Sequence
  Description of Artificial Sequence: Synthetic peptide
  Seed: YTLASLLQSS (MAGC1_HUMAN)
YMLASLLQSA

SEQ ID NO: 70541 - protein, 10 aa, Artificial Sequence
  Description of Artificial Sequence: Synthetic peptide
  Seed: SRYTGYFPVI (MAGC1_HUMAN)
SAYTGYFPVM

SEQ ID NO: 70542 - protein, 9 aa, Artificial Sequence
  Description of Artificial Sequence: Synthetic peptide
  Seed: WGPRAHSEV (MAGC1_HUMAN)
WSPRAHSEL

SEQ ID NO: 70543 - protein, 11 aa, Artificial Sequence
  Description of Artificial Sequence: Synthetic peptide
  Seed: KDMPTAGMPSL (MAGC1_HUMAN)
KEMPTAGMPSM

SEQ ID NO: 70544 - protein, 10 aa, Artificial Sequence
  Description of Artificial Sequence: Synthetic peptide
  Seed: WGPRAHSEVI (MAGC1_HUMAN)
WPPRAHSEVF

SEQ ID NO: 70545 - protein, 9 aa, Artificial Sequence
  Description of Artificial Sequence: Synthetic peptide
  Seed: SSPERTQST (MAGC1_HUMAN)
SLPERTQSV

SEQ ID NO: 70546 - protein, 9 aa, Artificial Sequence
  Description of Artificial Sequence: Synthetic peptide
  Seed: LSPLHFPQF (MAGC1_HUMAN)
LPPLHFPQY

SEQ ID NO: 70547 - protein, 10 aa, Artificial Sequence
  Description of Artificial Sequence: Synthetic peptide
  Seed: WGPRAHSEVI (MAGC1_HUMAN)
WWPRAHSEVM

SEQ ID NO: 70548 - protein, 10 aa, Artificial Sequence
  Description of Artificial Sequence: Synthetic peptide
  Seed: ASSSTLVSIF (MAGC1_HUMAN)
ATSSTLVSIW

SEQ ID NO: 70549 - protein, 9 aa, Artificial Sequence
  Description of Artificial Sequence: Synthetic peptide
  Seed: MPTAGMPSL (MAGC1_HUMAN)
MTTAGMPSF

SEQ ID NO: 70550 - protein, 9 aa, Artificial Sequence
  Description of Artificial Sequence: Synthetic peptide
  Seed: MPTAGMPSL (MAGC1_HUMAN)
MPTAGMPSV

SEQ ID NO: 70551 - protein, 8 aa, Artificial Sequence
  Description of Artificial Sequence: Synthetic peptide
  Seed: SEVIKRKV (MAGC1_HUMAN)
SEVIKRKY

SEQ ID NO: 70552 - protein, 9 aa, Artificial Sequence
  Description of Artificial Sequence: Synthetic peptide
  Seed: LLILILSII (MAGC1_HUMAN)
LMILILSIL

SEQ ID NO: 70553 - protein, 9 aa, Artificial Sequence
  Description of Artificial Sequence: Synthetic peptide
  Seed: LQIPGSPSF (MAGC1_HUMAN)
LWIPGSPSF

SEQ ID NO: 70554 - protein, 9 aa, Artificial Sequence
  Description of Artificial Sequence: Synthetic peptide
  Seed: SPERTQSTF (MAGC1_HUMAN)
SPERTQSTL

SEQ ID NO: 70555 - protein, 9 aa, Artificial Sequence
  Description of Artificial Sequence: Synthetic peptide
  Seed: SPLQIPGSP (MAGC1_HUMAN)
SPLQIPGST

SEQ ID NO: 70556 - protein, 10 aa, Artificial Sequence
  Description of Artificial Sequence: Synthetic peptide
  Seed: SFSSTLVSLF (MAGC1_HUMAN)
SDSSTLVSLF

SEQ ID NO: 70557 - protein, 9 aa, Artificial Sequence
  Description of Artificial Sequence: Synthetic peptide
  Seed: TLLSLFQSF (MAGC1_HUMAN)
TMLSLFQSR

SEQ ID NO: 70558 - protein, 9 aa, Artificial Sequence
  Description of Artificial Sequence: Synthetic peptide
  Seed: FEGFAQSSL (MAGC1_HUMAN)
FMGFAQSSF

SEQ ID NO: 70559 - protein, 9 aa, Artificial Sequence
  Description of Artificial Sequence: Synthetic peptide
  Seed: VSAASSSTL (MAGC1_HUMAN)
VQAASSSTW

SEQ ID NO: 70560 - protein, 9 aa, Artificial Sequence
  Description of Artificial Sequence: Synthetic peptide
  Seed: SSSSTLLSL (MAGC1_HUMAN)
STSSTLLSY

SEQ ID NO: 70561 - protein, 9 aa, Artificial Sequence
  Description of Artificial Sequence: Synthetic peptide
  Seed: SQSSPVSSF (MAGC1_HUMAN)
STSSPVSSL

SEQ ID NO: 70562 - protein, 9 aa, Artificial Sequence
  Description of Artificial Sequence: Synthetic peptide
  Seed: IIDTTDDST (MAGC1_HUMAN)
IFDTTDDSM

SEQ ID NO: 70563 - protein, 10 aa, Artificial Sequence
  Description of Artificial Sequence: Synthetic peptide
  Seed: MLKNTVPITF (MAGC1_HUMAN)
MEKNTVPITY

SEQ ID NO: 70564 - protein, 10 aa, Artificial Sequence
  Description of Artificial Sequence: Synthetic peptide
  Seed: ICSSSTPSSL (MAGC1_HUMAN)
IPSSSTPSSW

SEQ ID NO: 70565 - protein, 11 aa, Artificial Sequence
  Description of Artificial Sequence: Synthetic peptide
  Seed: SASSSVMSPSF (MAGC1_HUMAN)
SMSSSVMSPSY

SEQ ID NO: 70566 - protein, 10 aa, Artificial Sequence
  Description of Artificial Sequence: Synthetic peptide
  Seed: SSFSSTLLSI (MAGC1_HUMAN)
SVFSSTLLSW

SEQ ID NO: 70567 - protein, 10 aa, Artificial Sequence
  Description of Artificial Sequence: Synthetic peptide
  Seed: FFSYTLASLL (MAGC1_HUMAN)
FMSYTLASLI

SEQ ID NO: 70568 - protein, 10 aa, Artificial Sequence
  Description of Artificial Sequence: Synthetic peptide
  Seed: SSPERTQSTF (MAGC1_HUMAN)
SRPERTQSTY

SEQ ID NO: 70569 - protein, 10 aa, Artificial Sequence
  Description of Artificial Sequence: Synthetic peptide
  Seed: YTLDEKVDEL (MAGC1_HUMAN)
YSLDEKVDEI

SEQ ID NO: 70570 - protein, 9 aa, Artificial Sequence
  Description of Artificial Sequence: Synthetic peptide
  Seed: MSQNRLLIL (MAGC1_HUMAN)
MTQNRLLIF

SEQ ID NO: 70571 - protein, 11 aa, Artificial Sequence
  Description of Artificial Sequence: Synthetic peptide
  Seed: LQRPVSSFFSY (MAGC1_HUMAN)
LWRPVSSFFSY

SEQ ID NO: 70572 - protein, 9 aa, Artificial Sequence
  Description of Artificial Sequence: Synthetic peptide
  Seed: STFEGFPQS (MAGC1_HUMAN)
SPFEGFPQY

SEQ ID NO: 70573 - protein, 9 aa, Artificial Sequence
  Description of Artificial Sequence: Synthetic peptide
  Seed: SPLEISQSP (MAGC1_HUMAN)
SALEISQSM

SEQ ID NO: 70574 - protein, 9 aa, Artificial Sequence
  Description of Artificial Sequence: Synthetic peptide
  Seed: IPVSSSFSY (MAGC1_HUMAN)
IRVSSSFSM

SEQ ID NO: 70575 - protein, 11 aa, Artificial Sequence
  Description of Artificial Sequence: Synthetic peptide
  Seed: SSSFSYTLLSL (MAGC1_HUMAN)
SRSFSYTLLSF

SEQ ID NO: 70576 - protein, 11 aa, Artificial Sequence
  Description of Artificial Sequence: Synthetic peptide
  Seed: SEGCLSDEQGM (MAGC1_HUMAN)
SEGCLSDEQGW

SEQ ID NO: 70577 - protein, 11 aa, Artificial Sequence
  Description of Artificial Sequence: Synthetic peptide
  Seed: SPLQNPASSFF (MAGC1_HUMAN)
SMLQNPASSFF

SEQ ID NO: 70578 - protein, 10 aa, Artificial Sequence
  Description of Artificial Sequence: Synthetic peptide
  Seed: RSFSSTLLSI (MAGC1_HUMAN)
RMFSSTLLST

SEQ ID NO: 70579 - protein, 10 aa, Artificial Sequence
  Description of Artificial Sequence: Synthetic peptide
  Seed: LSQSSPVSSF (MAGC1_HUMAN)
LKQSSPVSSY

SEQ ID NO: 70580 - protein, 10 aa, Artificial Sequence
  Description of Artificial Sequence: Synthetic peptide
  Seed: QIPVSSSFSY (MAGC1_HUMAN)
QLPVSSSFSF

SEQ ID NO: 70581 - protein, 10 aa, Artificial Sequence
  Description of Artificial Sequence: Synthetic peptide
  Seed: WGPRAHSEVI (MAGC1_HUMAN)
WGPRAHSEVM

SEQ ID NO: 70582 - protein, 9 aa, Artificial Sequence
  Description of Artificial Sequence: Synthetic peptide
  Seed: SSPERTHST (MAGC1_HUMAN)
SCPERTHSF

SEQ ID NO: 70583 - protein, 11 aa, Artificial Sequence
  Description of Artificial Sequence: Synthetic peptide
  Seed: SRYTGYFPVIF (MAGC1_HUMAN)
SKYTGYFPVIY

SEQ ID NO: 70584 - protein, 10 aa, Artificial Sequence
  Description of Artificial Sequence: Synthetic peptide
  Seed: LQIPGSPSFS (MAGC1_HUMAN)
LAIPGSPSFF

SEQ ID NO: 70585 - protein, 9 aa, Artificial Sequence
  Description of Artificial Sequence: Synthetic peptide
  Seed: SSSFSYTLL (MAGC1_HUMAN)
STSFSYTLL

SEQ ID NO: 70586 - protein, 9 aa, Artificial Sequence
  Description of Artificial Sequence: Synthetic peptide
  Seed: SPESAQSAF (MAGC1_HUMAN)
SVESAQSAF

SEQ ID NO: 70587 - protein, 9 aa, Artificial Sequence
  Description of Artificial Sequence: Synthetic peptide
  Seed: SPQSPPEGP (MAGC1_HUMAN)
SVQSPPEGF

SEQ ID NO: 70588 - protein, 11 aa, Artificial Sequence
  Description of Artificial Sequence: Synthetic peptide
  Seed: IIDTTDDSTAT (MAGC1_HUMAN)
ITDTTDDSTAV

SEQ ID NO: 70589 - protein, 10 aa, Artificial Sequence
  Description of Artificial Sequence: Synthetic peptide
  Seed: SSSSSSSTLL (MAGC1_HUMAN)
SFSSSSSTLW

SEQ ID NO: 70590 - protein, 10 aa, Artificial Sequence
  Description of Artificial Sequence: Synthetic peptide
  Seed: MPTAGMPSLL (MAGC1_HUMAN)
MTTAGMPSLL

SEQ ID NO: 70591 - protein, 9 aa, Artificial Sequence
  Description of Artificial Sequence: Synthetic peptide
  Seed: LQIPMTSSF (MAGC1_HUMAN)
LFIPMTSSF

SEQ ID NO: 70592 - protein, 11 aa, Artificial Sequence
  Description of Artificial Sequence: Synthetic peptide
  Seed: KVWVQEHYLEY (MAGC1_HUMAN)
KSWVQEHYLEY

SEQ ID NO: 70593 - protein, 10 aa, Artificial Sequence
  Description of Artificial Sequence: Synthetic peptide
  Seed: WEDSLSPHYF (MAGC1_HUMAN)
WVDSLSPHYL

SEQ ID NO: 70594 - protein, 10 aa, Artificial Sequence
  Description of Artificial Sequence: Synthetic peptide
  Seed: RKVVEFLAML (MAGC1_HUMAN)
RGVVEFLAMI

SEQ ID NO: 70595 - protein, 10 aa, Artificial Sequence
  Description of Artificial Sequence: Synthetic peptide
  Seed: SPPEGPAQSP (MAGC1_HUMAN)
SPPEGPAQSA

SEQ ID NO: 70596 - protein, 9 aa, Artificial Sequence
  Description of Artificial Sequence: Synthetic peptide
  Seed: FSSALLSIF (MAGC1_HUMAN)
FESALLSIY

SEQ ID NO: 70597 - protein, 10 aa, Artificial Sequence
  Description of Artificial Sequence: Synthetic peptide
  Seed: LQIPMTSSFS (MAGC1_HUMAN)
LMIPMTSSFS

SEQ ID NO: 70598 - protein, 9 aa, Artificial Sequence
  Description of Artificial Sequence: Synthetic peptide
  Seed: SSSVMSPSF (MAGC1_HUMAN)
SQSVMSPSL

SEQ ID NO: 70599 - protein, 10 aa, Artificial Sequence
  Description of Artificial Sequence: Synthetic peptide
  Seed: SSSSTLLSLF (MAGC1_HUMAN)
SSSSTLLSLM

SEQ ID NO: 70600 - protein, 10 aa, Artificial Sequence
  Description of Artificial Sequence: Synthetic peptide
  Seed: ICSSSTSLSL (MAGC1_HUMAN)
ISSSSTSLSF

SEQ ID NO: 70601 - protein, 10 aa, Artificial Sequence
  Description of Artificial Sequence: Synthetic peptide
  Seed: IPVSRSFSST (MAGC1_HUMAN)
IPVSRSFSSF

SEQ ID NO: 70602 - protein, 10 aa, Artificial Sequence
  Description of Artificial Sequence: Synthetic peptide
  Seed: SFSSTLVSLF (MAGC1_HUMAN)
SMSSTLVSLY

SEQ ID NO: 70603 - protein, 9 aa, Artificial Sequence
  Description of Artificial Sequence: Synthetic peptide
  Seed: SSPECTQST (MAGC1_HUMAN)
SNPECTQSM

SEQ ID NO: 70604 - protein, 9 aa, Artificial Sequence
  Description of Artificial Sequence: Synthetic peptide
  Seed: DEKVDELAR (MAGC1_HUMAN)
DEKVDELAF

SEQ ID NO: 70605 - protein, 9 aa, Artificial Sequence
  Description of Artificial Sequence: Synthetic peptide
  Seed: TLLSIFQSS (MAGC1_HUMAN)
TMLSIFQSA

SEQ ID NO: 70606 - protein, 9 aa, Artificial Sequence
  Description of Artificial Sequence: Synthetic peptide
  Seed: KAREFIEIL (MAGC1_HUMAN)
KLREFIEIM

SEQ ID NO: 70607 - protein, 9 aa, Artificial Sequence
  Description of Artificial Sequence: Synthetic peptide
  Seed: SSPESAQSA (MAGC1_HUMAN)
SFPESAQSM

SEQ ID NO: 70608 - protein, 9 aa, Artificial Sequence
  Description of Artificial Sequence: Synthetic peptide
  Seed: LQNPASSFF (MAGC1_HUMAN)
LINPASSFY

SEQ ID NO: 70609 - protein, 9 aa, Artificial Sequence
  Description of Artificial Sequence: Synthetic peptide
  Seed: SSFFSSALL (MAGC1_HUMAN)
STFFSSALM

SEQ ID NO: 70610 - protein, 10 aa, Artificial Sequence
  Description of Artificial Sequence: Synthetic peptide
  Seed: ICSSSTSLSL (MAGC1_HUMAN)
ICSSSTSLSY

SEQ ID NO: 70611 - protein, 9 aa, Artificial Sequence
  Description of Artificial Sequence: Synthetic peptide
  Seed: SSSSTLLSL (MAGC1_HUMAN)
SWSSTLLSL

SEQ ID NO: 70612 - protein, 9 aa, Artificial Sequence
  Description of Artificial Sequence: Synthetic peptide
  Seed: AMLKNTVPI (MAGC1_HUMAN)
ASLKNTVPY

SEQ ID NO: 70613 - protein, 10 aa, Artificial Sequence
  Description of Artificial Sequence: Synthetic peptide
  Seed: HESPQSPPEG (MAGC1_HUMAN)
HESPQSPPEM

SEQ ID NO: 70614 - protein, 11 aa, Artificial Sequence
  Description of Artificial Sequence: Synthetic peptide
  Seed: SPLQIPVSRSF (MAGC1_HUMAN)
SPLQIPVSRSL

SEQ ID NO: 70615 - protein, 10 aa, Artificial Sequence
  Description of Artificial Sequence: Synthetic peptide
  Seed: LILILSIIFI (MAGC1_HUMAN)
LELILSIIFV

SEQ ID NO: 70616 - protein, 10 aa, Artificial Sequence
  Description of Artificial Sequence: Synthetic peptide
  Seed: STSLSLPQSF (MAGC1_HUMAN)
SVSLSLPQSW

SEQ ID NO: 70617 - protein, 9 aa, Artificial Sequence
  Description of Artificial Sequence: Synthetic peptide
  Seed: SLSPFSEES (MAGC1_HUMAN)
SMSPFSEET

SEQ ID NO: 70618 - protein, 10 aa, Artificial Sequence
  Description of Artificial Sequence: Synthetic peptide
  Seed: SSFSSTLLSI (MAGC1_HUMAN)
STFSSTLLSV

SEQ ID NO: 70619 - protein, 9 aa, Artificial Sequence
  Description of Artificial Sequence: Synthetic peptide
  Seed: EDSSDPLQR (MAGC1_HUMAN)
EASSDPLQR

SEQ ID NO: 70620 - protein, 10 aa, Artificial Sequence
  Description of Artificial Sequence: Synthetic peptide
  Seed: SFSSTLLSIF (MAGC1_HUMAN)
SVSSTLLSIF

SEQ ID NO: 70621 - protein, 9 aa, Artificial Sequence
  Description of Artificial Sequence: Synthetic peptide
  Seed: FPSSTSSSL (MAGC1_HUMAN)
FYSSTSSSV

SEQ ID NO: 70622 - protein, 10 aa, Artificial Sequence
  Description of Artificial Sequence: Synthetic peptide
  Seed: FFSYTLASLL (MAGC1_HUMAN)
FLSYTLASLV

SEQ ID NO: 70623 - protein, 9 aa, Artificial Sequence
  Description of Artificial Sequence: Synthetic peptide
  Seed: FLWGPRAHS (MAGC1_HUMAN)
FLWGPRAHC

SEQ ID NO: 70624 - protein, 10 aa, Artificial Sequence
  Description of Artificial Sequence: Synthetic peptide
  Seed: EVIWDVLSGI (MAGC1_HUMAN)
EIIWDVLSGY

SEQ ID NO: 70625 - protein, 11 aa, Artificial Sequence
  Description of Artificial Sequence: Synthetic peptide
  Seed: IPMTSSFSSTL (MAGC1_HUMAN)
IKMTSSFSSTF

SEQ ID NO: 70626 - protein, 9 aa, Artificial Sequence
  Description of Artificial Sequence: Synthetic peptide
  Seed: KDVEERAQA (MAGC1_HUMAN)
KEVEERAQM

SEQ ID NO: 70627 - protein, 9 aa, Artificial Sequence
  Description of Artificial Sequence: Synthetic peptide
  Seed: AGREHFAFG (MAGC1_HUMAN)
AQREHFAFV

SEQ ID NO: 70628 - protein, 10 aa, Artificial Sequence
  Description of Artificial Sequence: Synthetic peptide
  Seed: SLFQSSPERT (MAGC1_HUMAN)
SLFQSSPERV

SEQ ID NO: 70629 - protein, 9 aa, Artificial Sequence
  Description of Artificial Sequence: Synthetic peptide
  Seed: SPLQIPQSP (MAGC1_HUMAN)
SPLQIPQST

SEQ ID NO: 70630 - protein, 10 aa, Artificial Sequence
  Description of Artificial Sequence: Synthetic peptide
  Seed: LQIVPSLPEW (MAGC1_HUMAN)
LCIVPSLPEW

SEQ ID NO: 70631 - protein, 9 aa, Artificial Sequence
  Description of Artificial Sequence: Synthetic peptide
  Seed: LQIPVSAAS (MAGC1_HUMAN)
LGIPVSAAF

SEQ ID NO: 70632 - protein, 10 aa, Artificial Sequence
  Description of Artificial Sequence: Synthetic peptide
  Seed: PLQIPVSRSF (MAGC1_HUMAN)
PGQIPVSRSY

SEQ ID NO: 70633 - protein, 9 aa, Artificial Sequence
  Description of Artificial Sequence: Synthetic peptide
  Seed: FLAMLKNTV (MAGC1_HUMAN)
FMAMLKNTV

SEQ ID NO: 70634 - protein, 9 aa, Artificial Sequence
  Description of Artificial Sequence: Synthetic peptide
  Seed: MLTNVISRY (MAGC1_HUMAN)
MKTNVISRF

SEQ ID NO: 70635 - protein, 9 aa, Artificial Sequence
  Description of Artificial Sequence: Synthetic peptide
  Seed: YVFVNTLDL (MAGC1_HUMAN)
YLFVNTLDV

SEQ ID NO: 70636 - protein, 9 aa, Artificial Sequence
  Description of Artificial Sequence: Synthetic peptide
  Seed: SSFSYTLLS (MAGC1_HUMAN)
STFSYTLLK

SEQ ID NO: 70637 - protein, 9 aa, Artificial Sequence
  Description of Artificial Sequence: Synthetic peptide
  Seed: VSAASSSTL (MAGC1_HUMAN)
VIAASSSTY

SEQ ID NO: 70638 - protein, 10 aa, Artificial Sequence
  Description of Artificial Sequence: Synthetic peptide
  Seed: MTSSFSSTLL (MAGC1_HUMAN)
MWSSFSSTLL

SEQ ID NO: 70639 - protein, 11 aa, Artificial Sequence
  Description of Artificial Sequence: Synthetic peptide
  Seed: SAASSSTLVSI (MAGC1_HUMAN)
SQASSSTLVSI

SEQ ID NO: 70640 - protein, 9 aa, Artificial Sequence
  Description of Artificial Sequence: Synthetic peptide
  Seed: AMLKNTVPI (MAGC1_HUMAN)
AHLKNTVPF

SEQ ID NO: 70641 - protein, 10 aa, Artificial Sequence
  Description of Artificial Sequence: Synthetic peptide
  Seed: VISFSSSTSL (MAGC1_HUMAN)
VMSFSSSTSY

SEQ ID NO: 70642 - protein, 10 aa, Artificial Sequence
  Description of Artificial Sequence: Synthetic peptide
  Seed: FPQSPLQIPV (MAGC1_HUMAN)
FLQSPLQIPI

SEQ ID NO: 70643 - protein, 11 aa, Artificial Sequence
  Description of Artificial Sequence: Synthetic peptide
  Seed: SFFSSALLSIF (MAGC1_HUMAN)
SKFSSALLSIW

SEQ ID NO: 70644 - protein, 9 aa, Artificial Sequence
  Description of Artificial Sequence: Synthetic peptide
  Seed: SAQSAFEGF (MAGC1_HUMAN)
STQSAFEGY

SEQ ID NO: 70645 - protein, 9 aa, Artificial Sequence
  Description of Artificial Sequence: Synthetic peptide
  Seed: MTSSFSSTL (MAGC1_HUMAN)
MVSSFSSTL

SEQ ID NO: 70646 - protein, 9 aa, Artificial Sequence
  Description of Artificial Sequence: Synthetic peptide
  Seed: IESEPLFTY (MAGC1_HUMAN)
ITSEPLFTF

SEQ ID NO: 70647 - protein, 9 aa, Artificial Sequence
  Description of Artificial Sequence: Synthetic peptide
  Seed: SFSSTLVSL (MAGC1_HUMAN)
SFSSTLVSY

SEQ ID NO: 70648 - protein, 11 aa, Artificial Sequence
  Description of Artificial Sequence: Synthetic peptide
  Seed: VSSSSSSSTLL (MAGC1_HUMAN)
VKSSSSSSTLW

SEQ ID NO: 70649 - protein, 10 aa, Artificial Sequence
  Description of Artificial Sequence: Synthetic peptide
  Seed: RAGREHFAFG (MAGC1_HUMAN)
RTGREHFAFT

SEQ ID NO: 70650 - protein, 9 aa, Artificial Sequence
  Description of Artificial Sequence: Synthetic peptide
  Seed: VSRSFSSTL (MAGC1_HUMAN)
VYRSFSSTY

SEQ ID NO: 70651 - protein, 10 aa, Artificial Sequence
  Description of Artificial Sequence: Synthetic peptide
  Seed: SSPESAQSAF (MAGC1_HUMAN)
SIPESAQSAI

SEQ ID NO: 70652 - protein, 10 aa, Artificial Sequence
  Description of Artificial Sequence: Synthetic peptide
  Seed: ASSFFSSALL (MAGC1_HUMAN)
AYSFFSSALM

SEQ ID NO: 70653 - protein, 10 aa, Artificial Sequence
  Description of Artificial Sequence: Synthetic peptide
  Seed: SSFSYTLLSL (MAGC1_HUMAN)
SIFSYTLLSF

SEQ ID NO: 70654 - protein, 10 aa, Artificial Sequence
  Description of Artificial Sequence: Synthetic peptide
  Seed: PLQIPVSSSF (MAGC1_HUMAN)
PSQIPVSSSY

SEQ ID NO: 70655 - protein, 9 aa, Artificial Sequence
  Description of Artificial Sequence: Synthetic peptide
  Seed: IPMTSSFSS (MAGC1_HUMAN)
IAMTSSFSF

SEQ ID NO: 70656 - protein, 10 aa, Artificial Sequence
  Description of Artificial Sequence: Synthetic peptide
  Seed: STLLSLFQSF (MAGC1_HUMAN)
SSLLSLFQSY

SEQ ID NO: 70657 - protein, 10 aa, Artificial Sequence
  Description of Artificial Sequence: Synthetic peptide
  Seed: YTLASLLQSS (MAGC1_HUMAN)
YQLASLLQSL

SEQ ID NO: 70658 - protein, 9 aa, Artificial Sequence
  Description of Artificial Sequence: Synthetic peptide
  Seed: SSSSSSTLL (MAGC1_HUMAN)
SMSSSSTLY

SEQ ID NO: 70659 - protein, 9 aa, Artificial Sequence
  Description of Artificial Sequence: Synthetic peptide
  Seed: VSAASSSTL (MAGC1_HUMAN)
VKAASSSTW

SEQ ID NO: 70660 - protein, 9 aa, Artificial Sequence
  Description of Artificial Sequence: Synthetic peptide
  Seed: SPLQNPASS (MAGC1_HUMAN)
SPLQNPASA

SEQ ID NO: 70661 - protein, 9 aa, Artificial Sequence
  Description of Artificial Sequence: Synthetic peptide
  Seed: TTDDSTATE (MAGC1_HUMAN)
TMDDSTATL

SEQ ID NO: 70662 - protein, 9 aa, Artificial Sequence
  Description of Artificial Sequence: Synthetic peptide
  Seed: VSSSSSSTL (MAGC1_HUMAN)
VHSSSSSTF

SEQ ID NO: 70663 - protein, 10 aa, Artificial Sequence
  Description of Artificial Sequence: Synthetic peptide
  Seed: SMSPLYFPQS (MAGC1_HUMAN)
SLSPLYFPQA

SEQ ID NO: 70664 - protein, 9 aa, Artificial Sequence
  Description of Artificial Sequence: Synthetic peptide
  Seed: SSFPSSTSS (MAGC1_HUMAN)
SAFPSSTSL

SEQ ID NO: 70665 - protein, 11 aa, Artificial Sequence
  Description of Artificial Sequence: Synthetic peptide
  Seed: IPVSAASSSTL (MAGC1_HUMAN)
IMVSAASSSTY

SEQ ID NO: 70666 - protein, 9 aa, Artificial Sequence
  Description of Artificial Sequence: Synthetic peptide
  Seed: RKVVEFLAM (MAGC1_HUMAN)
RSVVEFLAY

SEQ ID NO: 70667 - protein, 10 aa, Artificial Sequence
  Description of Artificial Sequence: Synthetic peptide
  Seed: KGTYASEEVI (MAGC1_HUMAN)
KATYASEEVW

SEQ ID NO: 70668 - protein, 10 aa, Artificial Sequence
  Description of Artificial Sequence: Synthetic peptide
  Seed: YTLLSLFQSS (MAGC1_HUMAN)
YILLSLFQSV

SEQ ID NO: 70669 - protein, 9 aa, Artificial Sequence
  Description of Artificial Sequence: Synthetic peptide
  Seed: CSSSTPSSL (MAGC1_HUMAN)
CTSSTPSSY

SEQ ID NO: 70670 - protein, 11 aa, Artificial Sequence
  Description of Artificial Sequence: Synthetic peptide
  Seed: RSFSSTLLSIF (MAGC1_HUMAN)
RKFSSTLLSIF

SEQ ID NO: 70671 - protein, 10 aa, Artificial Sequence
  Description of Artificial Sequence: Synthetic peptide
  Seed: SLFQSFSERT (MAGC1_HUMAN)
SVFQSFSERI

SEQ ID NO: 70672 - protein, 9 aa, Artificial Sequence
  Description of Artificial Sequence: Synthetic peptide
  Seed: YTGYFPVIF (MAGC1_HUMAN)
YTGYFPVIM

SEQ ID NO: 70673 - protein, 10 aa, Artificial Sequence
  Description of Artificial Sequence: Synthetic peptide
  Seed: ILILSIIFIK (MAGC1_HUMAN)
IQILSIIFIR

SEQ ID NO: 70674 - protein, 10 aa, Artificial Sequence
  Description of Artificial Sequence: Synthetic peptide
  Seed: FFSSALLSIF (MAGC1_HUMAN)
FYSSALLSII

SEQ ID NO: 70675 - protein, 9 aa, Artificial Sequence
  Description of Artificial Sequence: Synthetic peptide
  Seed: YQVKQPITK (MAGC1_HUMAN)
YAVKQPITF

SEQ ID NO: 70676 - protein, 9 aa, Artificial Sequence
  Description of Artificial Sequence: Synthetic peptide
  Seed: EFIEILFGI (MAGC1_HUMAN)
EVIEILFGT

SEQ ID NO: 70677 - protein, 10 aa, Artificial Sequence
  Description of Artificial Sequence: Synthetic peptide
  Seed: SFFSSALLSI (MAGC1_HUMAN)
SWFSSALLSM

SEQ ID NO: 70678 - protein, 9 aa, Artificial Sequence
  Description of Artificial Sequence: Synthetic peptide
  Seed: VSSSFSYTL (MAGC1_HUMAN)
VASSFSYTL

SEQ ID NO: 70679 - protein, 9 aa, Artificial Sequence
  Description of Artificial Sequence: Synthetic peptide
  Seed: TSSFSSTLL (MAGC1_HUMAN)
TTSFSSTLV

SEQ ID NO: 70680 - protein, 10 aa, Artificial Sequence
  Description of Artificial Sequence: Synthetic peptide
  Seed: SSPERTHSTF (MAGC1_HUMAN)
SAPERTHSTI

SEQ ID NO: 70681 - protein, 10 aa, Artificial Sequence
  Description of Artificial Sequence: Synthetic peptide
  Seed: MPTAGMPSLL (MAGC1_HUMAN)
MVTAGMPSLL

SEQ ID NO: 70682 - protein, 9 aa, Artificial Sequence
  Description of Artificial Sequence: Synthetic peptide
  Seed: IIDTTDDST (MAGC1_HUMAN)
ISDTTDDSV

SEQ ID NO: 70683 - protein, 9 aa, Artificial Sequence
  Description of Artificial Sequence: Synthetic peptide
  Seed: FSYTLLSLF (MAGC1_HUMAN)
FTYTLLSLV

SEQ ID NO: 70684 - protein, 9 aa, Artificial Sequence
  Description of Artificial Sequence: Synthetic peptide
  Seed: KVWVQEHYL (MAGC1_HUMAN)
KVWVQEHYI

SEQ ID NO: 70685 - protein, 10 aa, Artificial Sequence
  Description of Artificial Sequence: Synthetic peptide
  Seed: SFPSSTSSSL (MAGC1_HUMAN)
SQPSSTSSSL

SEQ ID NO: 70686 - protein, 9 aa, Artificial Sequence
  Description of Artificial Sequence: Synthetic peptide
  Seed: LKNTVPITF (MAGC1_HUMAN)
LFNTVPITY

SEQ ID NO: 70687 - protein, 10 aa, Artificial Sequence
  Description of Artificial Sequence: Synthetic peptide
  Seed: RFLLLKYQVK (MAGC1_HUMAN)
RMLLLKYQVK

SEQ ID NO: 70688 - protein, 11 aa, Artificial Sequence
  Description of Artificial Sequence: Synthetic peptide
  Seed: SPQSPPEGPAQ (MAGC1_HUMAN)
SPQSPPEGPAP

SEQ ID NO: 70689 - protein, 9 aa, Artificial Sequence
  Description of Artificial Sequence: Synthetic peptide
  Seed: YTLLSLFQS (MAGC1_HUMAN)
YTLLSLFQA

SEQ ID NO: 70690 - protein, 10 aa, Artificial Sequence
  Description of Artificial Sequence: Synthetic peptide
  Seed: ICSSSTPSSL (MAGC1_HUMAN)
IGSSSTPSSW

SEQ ID NO: 70691 - protein, 11 aa, Artificial Sequence
  Description of Artificial Sequence: Synthetic peptide
  Seed: SPLQIPGSPSF (MAGC1_HUMAN)
SSLQIPGSPSM

SEQ ID NO: 70692 - protein, 9 aa, Artificial Sequence
  Description of Artificial Sequence: Synthetic peptide
  Seed: FTYTLDEKV (MAGC1_HUMAN)
FQYTLDEKM

SEQ ID NO: 70693 - protein, 10 aa, Artificial Sequence
  Description of Artificial Sequence: Synthetic peptide
  Seed: QGEDSMSPLY (MAGC1_HUMAN)
QCEDSMSPLW

SEQ ID NO: 70694 - protein, 9 aa, Artificial Sequence
  Description of Artificial Sequence: Synthetic peptide
  Seed: SSLSQSSPV (MAGC1_HUMAN)
SQLSQSSPI

SEQ ID NO: 70695 - protein, 9 aa, Artificial Sequence
  Description of Artificial Sequence: Synthetic peptide
  Seed: AGREHFAFG (MAGC1_HUMAN)
AVREHFAFN

SEQ ID NO: 70696 - protein, 9 aa, Artificial Sequence
  Description of Artificial Sequence: Synthetic peptide
  Seed: VSRSFSSTL (MAGC1_HUMAN)
VVRSFSSTV

SEQ ID NO: 70697 - protein, 9 aa, Artificial Sequence
  Description of Artificial Sequence: Synthetic peptide
  Seed: LQIPMTSSF (MAGC1_HUMAN)
LAIPMTSSF

SEQ ID NO: 70698 - protein, 11 aa, Artificial Sequence
  Description of Artificial Sequence: Synthetic peptide
  Seed: IPVSRSFSSTL (MAGC1_HUMAN)
IQVSRSFSSTY

SEQ ID NO: 70699 - protein, 10 aa, Artificial Sequence
  Description of Artificial Sequence: Synthetic peptide
  Seed: SSSSSTLLSL (MAGC1_HUMAN)
STSSSTLLSW

SEQ ID NO: 70700 - protein, 11 aa, Artificial Sequence
  Description of Artificial Sequence: Synthetic peptide
  Seed: FLAMLKNTVPI (MAGC1_HUMAN)
FCAMLKNTVPL

SEQ ID NO: 70701 - protein, 11 aa, Artificial Sequence
  Description of Artificial Sequence: Synthetic peptide
  Seed: QSSPERTQSTF (MAGC1_HUMAN)
QTSPERTQSTF

SEQ ID NO: 70702 - protein, 9 aa, Artificial Sequence
  Description of Artificial Sequence: Synthetic peptide
  Seed: RAHSEVIKR (MAGC1_HUMAN)
RIHSEVIKF

SEQ ID NO: 70703 - protein, 9 aa, Artificial Sequence
  Description of Artificial Sequence: Synthetic peptide
  Seed: SPLEGEDSL (MAGC1_HUMAN)
SLLEGEDSY

SEQ ID NO: 70704 - protein, 9 aa, Artificial Sequence
  Description of Artificial Sequence: Synthetic peptide
  Seed: SFSSTLVSL (MAGC1_HUMAN)
SRSSTLVSF

SEQ ID NO: 70705 - protein, 10 aa, Artificial Sequence
  Description of Artificial Sequence: Synthetic peptide
  Seed: SLQIPVSPSF (MAGC1_HUMAN)
SVQIPVSPSF

SEQ ID NO: 70706 - protein, 10 aa, Artificial Sequence
  Description of Artificial Sequence: Synthetic peptide
  Seed: FFSSALLSIF (MAGC1_HUMAN)
FDSSALLSIY

SEQ ID NO: 70707 - protein, 9 aa, Artificial Sequence
  Description of Artificial Sequence: Synthetic peptide
  Seed: LQRPVSSFF (MAGC1_HUMAN)
LARPVSSFV

SEQ ID NO: 70708 - protein, 10 aa, Artificial Sequence
  Description of Artificial Sequence: Synthetic peptide
  Seed: RYTGYFPVIF (MAGC1_HUMAN)
RPTGYFPVIW

SEQ ID NO: 70709 - protein, 9 aa, Artificial Sequence
  Description of Artificial Sequence: Synthetic peptide
  Seed: SSSFSYTLL (MAGC1_HUMAN)
SMSFSYTLI

SEQ ID NO: 70710 - protein, 10 aa, Artificial Sequence
  Description of Artificial Sequence: Synthetic peptide
  Seed: LSQSSPVSSF (MAGC1_HUMAN)
LIQSSPVSSF

SEQ ID NO: 70711 - protein, 9 aa, Artificial Sequence
  Description of Artificial Sequence: Synthetic peptide
  Seed: FEGFAQSPL (MAGC1_HUMAN)
FHGFAQSPY

SEQ ID NO: 70712 - protein, 10 aa, Artificial Sequence
  Description of Artificial Sequence: Synthetic peptide
  Seed: AASSSTLVSI (MAGC1_HUMAN)
AQSSSTLVSM

SEQ ID NO: 70713 - protein, 9 aa, Artificial Sequence
  Description of Artificial Sequence: Synthetic peptide
  Seed: TFEGFPQSL (MAGC1_HUMAN)
TTEGFPQSI

SEQ ID NO: 70714 - protein, 10 aa, Artificial Sequence
  Description of Artificial Sequence: Synthetic peptide
  Seed: SSFSSTLLSI (MAGC1_HUMAN)
SMFSSTLLSY

SEQ ID NO: 70715 - protein, 9 aa, Artificial Sequence
  Description of Artificial Sequence: Synthetic peptide
  Seed: SSFFSSALL (MAGC1_HUMAN)
SMFFSSALH

SEQ ID NO: 70716 - protein, 9 aa, Artificial Sequence
  Description of Artificial Sequence: Synthetic peptide
  Seed: FTYTLDEKV (MAGC1_HUMAN)
FIYTLDEKI

SEQ ID NO: 70717 - protein, 10 aa, Artificial Sequence
  Description of Artificial Sequence: Synthetic peptide
  Seed: PLQIPMTSSF (MAGC1_HUMAN)
PFQIPMTSSM

SEQ ID NO: 70718 - protein, 9 aa, Artificial Sequence
  Description of Artificial Sequence: Synthetic peptide
  Seed: EILFGISLR (MAGC1_HUMAN)
EYLFGISLK

SEQ ID NO: 70719 - protein, 9 aa, Artificial Sequence
  Description of Artificial Sequence: Synthetic peptide
  Seed: TLASLLQSS (MAGC1_HUMAN)
TMASLLQSI

SEQ ID NO: 70720 - protein, 9 aa, Artificial Sequence
  Description of Artificial Sequence: Synthetic peptide
  Seed: FQSSPERTH (MAGC1_HUMAN)
FVSSPERTM

SEQ ID NO: 70721 - protein, 9 aa, Artificial Sequence
  Description of Artificial Sequence: Synthetic peptide
  Seed: MLTNVISRY (MAGC1_HUMAN)
MNTNVISRY

SEQ ID NO: 70722 - protein, 11 aa, Artificial Sequence
  Description of Artificial Sequence: Synthetic peptide
  Seed: QSSPECTQSTF (MAGC1_HUMAN)
QQSPECTQSTL

SEQ ID NO: 70723 - protein, 9 aa, Artificial Sequence
  Description of Artificial Sequence: Synthetic peptide
  Seed: EMLTNVISR (MAGC1_HUMAN)
EVLTNVISY

SEQ ID NO: 70724 - protein, 10 aa, Artificial Sequence
  Description of Artificial Sequence: Synthetic peptide
  Seed: SPLYFPQSPL (MAGC1_HUMAN)
SNLYFPQSPV

SEQ ID NO: 70725 - protein, 11 aa, Artificial Sequence
  Description of Artificial Sequence: Synthetic peptide
  Seed: SPLQIPVSSSS (MAGC1_HUMAN)
SYLQIPVSSSM

SEQ ID NO: 70726 - protein, 9 aa, Artificial Sequence
  Description of Artificial Sequence: Synthetic peptide
  Seed: VISRYTGYF (MAGC1_HUMAN)
VKSRYTGYM

SEQ ID NO: 70727 - protein, 9 aa, Artificial Sequence
  Description of Artificial Sequence: Synthetic peptide
  Seed: DEQGMSQNR (MAGC1_HUMAN)
DVQGMSQNK

SEQ ID NO: 70728 - protein, 8 aa, Artificial Sequence
  Description of Artificial Sequence: Synthetic peptide
  Seed: FIEILFGI (MAGC1_HUMAN)
FLEILFGI

SEQ ID NO: 70729 - protein, 10 aa, Artificial Sequence
  Description of Artificial Sequence: Synthetic peptide
  Seed: YTLDEKVDEL (MAGC1_HUMAN)
YCLDEKVDEI

SEQ ID NO: 70730 - protein, 9 aa, Artificial Sequence
  Description of Artificial Sequence: Synthetic peptide
  Seed: IESEPLFTY (MAGC1_HUMAN)
IYSEPLFTM

SEQ ID NO: 70731 - protein, 9 aa, Artificial Sequence
  Description of Artificial Sequence: Synthetic peptide
  Seed: VSSSFSYTL (MAGC1_HUMAN)
VNSSFSYTW

SEQ ID NO: 70732 - protein, 11 aa, Artificial Sequence
  Description of Artificial Sequence: Synthetic peptide
  Seed: SPLQIPMTSSF (MAGC1_HUMAN)
SDLQIPMTSSM

SEQ ID NO: 70733 - protein, 9 aa, Artificial Sequence
  Description of Artificial Sequence: Synthetic peptide
  Seed: LQIPVSSSS (MAGC1_HUMAN)
LYIPVSSSY

SEQ ID NO: 70734 - protein, 9 aa, Artificial Sequence
  Description of Artificial Sequence: Synthetic peptide
  Seed: IPVSSSFSY (MAGC1_HUMAN)
IAVSSSFSV

SEQ ID NO: 70735 - protein, 9 aa, Artificial Sequence
  Description of Artificial Sequence: Synthetic peptide
  Seed: IEILFGISL (MAGC1_HUMAN)
IHILFGISF

SEQ ID NO: 70736 - protein, 9 aa, Artificial Sequence
  Description of Artificial Sequence: Synthetic peptide
  Seed: RSFSSTLLS (MAGC1_HUMAN)
RSFSSTLLL

SEQ ID NO: 70737 - protein, 10 aa, Artificial Sequence
  Description of Artificial Sequence: Synthetic peptide
  Seed: YTLASLLQSS (MAGC1_HUMAN)
YYLASLLQST

SEQ ID NO: 70738 - protein, 9 aa, Artificial Sequence
  Description of Artificial Sequence: Synthetic peptide
  Seed: ASSSTLVSI (MAGC1_HUMAN)
AVSSTLVSW

SEQ ID NO: 70739 - protein, 10 aa, Artificial Sequence
  Description of Artificial Sequence: Synthetic peptide
  Seed: SILQSSPESA (MAGC1_HUMAN)
SMLQSSPESL

SEQ ID NO: 70740 - protein, 9 aa, Artificial Sequence
  Description of Artificial Sequence: Synthetic peptide
  Seed: TLDEKVDEL (MAGC1_HUMAN)
TADEKVDEY

SEQ ID NO: 70741 - protein, 9 aa, Artificial Sequence
  Description of Artificial Sequence: Synthetic peptide
  Seed: LQNPASSFF (MAGC1_HUMAN)
LINPASSFM

SEQ ID NO: 70742 - protein, 9 aa, Artificial Sequence
  Description of Artificial Sequence: Synthetic peptide
  Seed: SSSSTLLSL (MAGC1_HUMAN)
SYSSTLLSW

SEQ ID NO: 70743 - protein, 11 aa, Artificial Sequence
  Description of Artificial Sequence: Synthetic peptide
  Seed: TLDEKVDELAR (MAGC1_HUMAN)
TSDEKVDELAY

SEQ ID NO: 70744 - protein, 9 aa, Artificial Sequence
  Description of Artificial Sequence: Synthetic peptide
  Seed: GVRAGREHF (MAGC1_HUMAN)
GLRAGREHY

SEQ ID NO: 70745 - protein, 11 aa, Artificial Sequence
  Description of Artificial Sequence: Synthetic peptide
  Seed: VDEYTSSSDTL (MAGC1_HUMAN)
VREYTSSSDTF

SEQ ID NO: 70746 - protein, 11 aa, Artificial Sequence
  Description of Artificial Sequence: Synthetic peptide
  Seed: SSFPSSTSSSL (MAGC1_HUMAN)
STFPSSTSSSM

SEQ ID NO: 70747 - protein, 10 aa, Artificial Sequence
  Description of Artificial Sequence: Synthetic peptide
  Seed: TNVISRYTGY (MAGC1_HUMAN)
TMVISRYTGK

SEQ ID NO: 70748 - protein, 9 aa, Artificial Sequence
  Description of Artificial Sequence: Synthetic peptide
  Seed: GYFPVIFRK (MAGC1_HUMAN)
GNFPVIFRK

SEQ ID NO: 70749 - protein, 9 aa, Artificial Sequence
  Description of Artificial Sequence: Synthetic peptide
  Seed: FAFGEPREL (MAGC1_HUMAN)
FFFGEPREY

SEQ ID NO: 70750 - protein, 9 aa, Artificial Sequence
  Description of Artificial Sequence: Synthetic peptide
  Seed: IEILFGISL (MAGC1_HUMAN)
IKILFGISI

SEQ ID NO: 70751 - protein, 10 aa, Artificial Sequence
  Description of Artificial Sequence: Synthetic peptide
  Seed: LQIPVSSSFS (MAGC1_HUMAN)
LQIPVSSSFH

SEQ ID NO: 70752 - protein, 10 aa, Artificial Sequence
  Description of Artificial Sequence: Synthetic peptide
  Seed: LQIPGSPSFS (MAGC1_HUMAN)
LQIPGSPSFC

SEQ ID NO: 70753 - protein, 9 aa, Artificial Sequence
  Description of Artificial Sequence: Synthetic peptide
  Seed: AEMLTNVIS (MAGC1_HUMAN)
AEMLTNVIM

SEQ ID NO: 70754 - protein, 9 aa, Artificial Sequence
  Description of Artificial Sequence: Synthetic peptide
  Seed: SSPESAQST (MAGC1_HUMAN)
SVPESAQSV

SEQ ID NO: 70755 - protein, 11 aa, Artificial Sequence
  Description of Artificial Sequence: Synthetic peptide
  Seed: SSFPSSTSSSL (MAGC1_HUMAN)
SNFPSSTSSSL

SEQ ID NO: 70756 - protein, 10 aa, Artificial Sequence
  Description of Artificial Sequence: Synthetic peptide
  Seed: RTHSTFEGFP (MAGC1_HUMAN)
RTHSTFEGFI

SEQ ID NO: 70757 - protein, 9 aa, Artificial Sequence
  Description of Artificial Sequence: Synthetic peptide
  Seed: SICSSSTSL (MAGC1_HUMAN)
SFCSSSTSF

SEQ ID NO: 70758 - protein, 9 aa, Artificial Sequence
  Description of Artificial Sequence: Synthetic peptide
  Seed: LQIPVSPSF (MAGC1_HUMAN)
LYIPVSPSI

SEQ ID NO: 70759 - protein, 10 aa, Artificial Sequence
  Description of Artificial Sequence: Synthetic peptide
  Seed: RAGREHFAFG (MAGC1_HUMAN)
RTGREHFAFE

SEQ ID NO: 70760 - protein, 9 aa, Artificial Sequence
  Description of Artificial Sequence: Synthetic peptide
  Seed: AQSPLQSPV (MAGC1_HUMAN)
AASPLQSPF

SEQ ID NO: 70761 - protein, 9 aa, Artificial Sequence
  Description of Artificial Sequence: Synthetic peptide
  Seed: YTSSSDTLL (MAGC1_HUMAN)
YMSSSDTLW

SEQ ID NO: 70762 - protein, 9 aa, Artificial Sequence
  Description of Artificial Sequence: Synthetic peptide
  Seed: RTHSTFEGF (MAGC1_HUMAN)
RLHSTFEGW

SEQ ID NO: 70763 - protein, 11 aa, Artificial Sequence
  Description of Artificial Sequence: Synthetic peptide
  Seed: RSFSSTLLSIF (MAGC1_HUMAN)
RQFSSTLLSIY

SEQ ID NO: 70764 - protein, 9 aa, Artificial Sequence
  Description of Artificial Sequence: Synthetic peptide
  Seed: RLLILILSI (MAGC1_HUMAN)
RVLILILSY

SEQ ID NO: 70765 - protein, 9 aa, Artificial Sequence
  Description of Artificial Sequence: Synthetic peptide
  Seed: IPVSSSFSY (MAGC1_HUMAN)
ISVSSSFSL

SEQ ID NO: 70766 - protein, 9 aa, Artificial Sequence
  Description of Artificial Sequence: Synthetic peptide
  Seed: SSPERTHST (MAGC1_HUMAN)
SFPERTHSV

SEQ ID NO: 70767 - protein, 10 aa, Artificial Sequence
  Description of Artificial Sequence: Synthetic peptide
  Seed: YTLDEKVDEL (MAGC1_HUMAN)
YYLDEKVDEL

SEQ ID NO: 70768 - protein, 9 aa, Artificial Sequence
  Description of Artificial Sequence: Synthetic peptide
  Seed: ESDDTLYPL (MAGC1_HUMAN)
ETDDTLYPL

SEQ ID NO: 70769 - protein, 8 aa, Artificial Sequence
  Description of Artificial Sequence: Synthetic peptide
  Seed: FSSTLVSL (MAGC1_HUMAN)
FSSTLVSF

SEQ ID NO: 70770 - protein, 9 aa, Artificial Sequence
  Description of Artificial Sequence: Synthetic peptide
  Seed: EFIEILFGI (MAGC1_HUMAN)
EAIEILFGI

SEQ ID NO: 70771 - protein, 9 aa, Artificial Sequence
  Description of Artificial Sequence: Synthetic peptide
  Seed: LKNTVPITF (MAGC1_HUMAN)
LANTVPITF

SEQ ID NO: 70772 - protein, 9 aa, Artificial Sequence
  Description of Artificial Sequence: Synthetic peptide
  Seed: IPGSPSFSS (MAGC1_HUMAN)
IPGSPSFSV

SEQ ID NO: 70773 - protein, 9 aa, Artificial Sequence
  Description of Artificial Sequence: Synthetic peptide
  Seed: SAQSTFEGF (MAGC1_HUMAN)
SYQSTFEGY

SEQ ID NO: 70774 - protein, 10 aa, Artificial Sequence
  Description of Artificial Sequence: Synthetic peptide
  Seed: MPTAGMPSLL (MAGC1_HUMAN)
MDTAGMPSLY

SEQ ID NO: 70775 - protein, 10 aa, Artificial Sequence
  Description of Artificial Sequence: Synthetic peptide
  Seed: SSPERTHSTF (MAGC1_HUMAN)
SLPERTHSTM

SEQ ID NO: 70776 - protein, 8 aa, Artificial Sequence
  Description of Artificial Sequence: Synthetic peptide
  Seed: YTGYFPVI (MAGC1_HUMAN)
YAGYFPVL

SEQ ID NO: 70777 - protein, 11 aa, Artificial Sequence
  Description of Artificial Sequence: Synthetic peptide
  Seed: IPVSSSFSYTL (MAGC1_HUMAN)
IYVSSSFSYTF

SEQ ID NO: 70778 - protein, 10 aa, Artificial Sequence
  Description of Artificial Sequence: Synthetic peptide
  Seed: FFSSALLSIF (MAGC1_HUMAN)
FTSSALLSIM

SEQ ID NO: 70779 - protein, 10 aa, Artificial Sequence
  Description of Artificial Sequence: Synthetic peptide
  Seed: NPASSFFSSA (MAGC1_HUMAN)
NMASSFFSSV

SEQ ID NO: 70780 - protein, 10 aa, Artificial Sequence
  Description of Artificial Sequence: Synthetic peptide
  Seed: RSFSSTLLSI (MAGC1_HUMAN)
RKFSSTLLSL

SEQ ID NO: 70781 - protein, 10 aa, Artificial Sequence
  Description of Artificial Sequence: Synthetic peptide
  Seed: FFSYTLASLL (MAGC1_HUMAN)
FMSYTLASLP

SEQ ID NO: 70782 - protein, 9 aa, Artificial Sequence
  Description of Artificial Sequence: Synthetic peptide
  Seed: SFFSYTLAS (MAGC1_HUMAN)
SAFSYTLAM

SEQ ID NO: 70783 - protein, 9 aa, Artificial Sequence
  Description of Artificial Sequence: Synthetic peptide
  Seed: VPITFPSSY (MAGC1_HUMAN)
VMITFPSSL

SEQ ID NO: 70784 - protein, 10 aa, Artificial Sequence
  Description of Artificial Sequence: Synthetic peptide
  Seed: SFFSSALLSI (MAGC1_HUMAN)
SNFSSALLSF

SEQ ID NO: 70785 - protein, 9 aa, Artificial Sequence
  Description of Artificial Sequence: Synthetic peptide
  Seed: FSSTLVSLF (MAGC1_HUMAN)
FISTLVSLI

SEQ ID NO: 70786 - protein, 9 aa, Artificial Sequence
  Description of Artificial Sequence: Synthetic peptide
  Seed: SSHESPQSP (MAGC1_HUMAN)
SGHESPQSL

SEQ ID NO: 70787 - protein, 10 aa, Artificial Sequence
  Description of Artificial Sequence: Synthetic peptide
  Seed: LQIPVSPSFS (MAGC1_HUMAN)
LQIPVSPSFF

SEQ ID NO: 70788 - protein, 9 aa, Artificial Sequence
  Description of Artificial Sequence: Synthetic peptide
  Seed: SSFFSSALL (MAGC1_HUMAN)
SNFFSSALY

SEQ ID NO: 70789 - protein, 9 aa, Artificial Sequence
  Description of Artificial Sequence: Synthetic peptide
  Seed: FPESPQSPP (MAGC1_HUMAN)
FPESPQSPM

SEQ ID NO: 70790 - protein, 10 aa, Artificial Sequence
  Description of Artificial Sequence: Synthetic peptide
  Seed: IPVSAASSST (MAGC1_HUMAN)
IPVSAASSSV

SEQ ID NO: 70791 - protein, 9 aa, Artificial Sequence
  Description of Artificial Sequence: Synthetic peptide
  Seed: FSYTLLSLF (MAGC1_HUMAN)
FYYTLLSLV

SEQ ID NO: 70792 - protein, 11 aa, Artificial Sequence
  Description of Artificial Sequence: Synthetic peptide
  Seed: IIDTTDDSTAT (MAGC1_HUMAN)
IGDTTDDSTAF

SEQ ID NO: 70793 - protein, 10 aa, Artificial Sequence
  Description of Artificial Sequence: Synthetic peptide
  Seed: MPTAGMPSLL (MAGC1_HUMAN)
MMTAGMPSLW

SEQ ID NO: 70794 - protein, 9 aa, Artificial Sequence
  Description of Artificial Sequence: Synthetic peptide
  Seed: DVLSGIGVR (MAGC1_HUMAN)
DILSGIGVK

SEQ ID NO: 70795 - protein, 9 aa, Artificial Sequence
  Description of Artificial Sequence: Synthetic peptide
  Seed: YQVKQPITK (MAGC1_HUMAN)
YQVKQPITF

SEQ ID NO: 70796 - protein, 10 aa, Artificial Sequence
  Description of Artificial Sequence: Synthetic peptide
  Seed: RSFSSTLLSI (MAGC1_HUMAN)
RSFSSTLLSY

SEQ ID NO: 70797 - protein, 11 aa, Artificial Sequence
  Description of Artificial Sequence: Synthetic peptide
  Seed: FLAMLKNTVPI (MAGC1_HUMAN)
FRAMLKNTVPL

SEQ ID NO: 70798 - protein, 11 aa, Artificial Sequence
  Description of Artificial Sequence: Synthetic peptide
  Seed: SSSSSSTLLSL (MAGC1_HUMAN)
SNSSSSTLLSW

SEQ ID NO: 70799 - protein, 10 aa, Artificial Sequence
  Description of Artificial Sequence: Synthetic peptide
  Seed: KVDELARFLL (MAGC1_HUMAN)
KIDELARFLL

SEQ ID NO: 70800 - protein, 10 aa, Artificial Sequence
  Description of Artificial Sequence: Synthetic peptide
  Seed: PLQIPMTSSF (MAGC1_HUMAN)
PQQIPMTSSF

SEQ ID NO: 70801 - protein, 9 aa, Artificial Sequence
  Description of Artificial Sequence: Synthetic peptide
  Seed: TLDEKVDEL (MAGC1_HUMAN)
TQDEKVDEV

SEQ ID NO: 70802 - protein, 9 aa, Artificial Sequence
  Description of Artificial Sequence: Synthetic peptide
  Seed: MGDKDMPTA (MAGC1_HUMAN)
MWDKDMPTM

SEQ ID NO: 70803 - protein, 10 aa, Artificial Sequence
  Description of Artificial Sequence: Synthetic peptide
  Seed: PLQIPGSPSF (MAGC1_HUMAN)
PTQIPGSPSF

SEQ ID NO: 70804 - protein, 11 aa, Artificial Sequence
  Description of Artificial Sequence: Synthetic peptide
  Seed: IPMTSSFSSTL (MAGC1_HUMAN)
IVMTSSFSSTF

SEQ ID NO: 70805 - protein, 9 aa, Artificial Sequence
  Description of Artificial Sequence: Synthetic peptide
  Seed: VSSFFSYTL (MAGC1_HUMAN)
VASFFSYTL

SEQ ID NO: 70806 - protein, 8 aa, Artificial Sequence
  Description of Artificial Sequence: Synthetic peptide
  Seed: FIEILFGI (MAGC1_HUMAN)
FIEILFGL

SEQ ID NO: 70807 - protein, 10 aa, Artificial Sequence
  Description of Artificial Sequence: Synthetic peptide
  Seed: TGYFPVIFRK (MAGC1_HUMAN)
TVYFPVIFRT

SEQ ID NO: 70808 - protein, 11 aa, Artificial Sequence
  Description of Artificial Sequence: Synthetic peptide
  Seed: SSTPSSLPQSF (MAGC1_HUMAN)
SKTPSSLPQSF

SEQ ID NO: 70809 - protein, 9 aa, Artificial Sequence
  Description of Artificial Sequence: Synthetic peptide
  Seed: SAASSSTLV (MAGC1_HUMAN)
SVASSSTLA

SEQ ID NO: 70810 - protein, 9 aa, Artificial Sequence
  Description of Artificial Sequence: Synthetic peptide
  Seed: SSPESPLQS (MAGC1_HUMAN)
SNPESPLQL

SEQ ID NO: 70811 - protein, 10 aa, Artificial Sequence
  Description of Artificial Sequence: Synthetic peptide
  Seed: MLKNTVPITF (MAGC1_HUMAN)
MGKNTVPITY

SEQ ID NO: 70812 - protein, 10 aa, Artificial Sequence
  Description of Artificial Sequence: Synthetic peptide
  Seed: HSPQSPPEGM (MAGC1_HUMAN)
HLPQSPPEGF

SEQ ID NO: 70813 - protein, 10 aa, Artificial Sequence
  Description of Artificial Sequence: Synthetic peptide
  Seed: TTDDSTATES (MAGC1_HUMAN)
TCDDSTATEL

SEQ ID NO: 70814 - protein, 9 aa, Artificial Sequence
  Description of Artificial Sequence: Synthetic peptide
  Seed: DSYVFVNTL (MAGC1_HUMAN)
DTYVFVNTF

SEQ ID NO: 70815 - protein, 9 aa, Artificial Sequence
  Description of Artificial Sequence: Synthetic peptide
  Seed: ELARFLLLK (MAGC1_HUMAN)
EGARFLLLR

SEQ ID NO: 70816 - protein, 10 aa, Artificial Sequence
  Description of Artificial Sequence: Synthetic peptide
  Seed: MTSSFSSTLL (MAGC1_HUMAN)
MRSSFSSTLY

SEQ ID NO: 70817 - protein, 9 aa, Artificial Sequence
  Description of Artificial Sequence: Synthetic peptide
  Seed: IESEPLFTY (MAGC1_HUMAN)
IESEPLFTF

SEQ ID NO: 70818 - protein, 9 aa, Artificial Sequence
  Description of Artificial Sequence: Synthetic peptide
  Seed: SLSPFSEES (MAGC1_HUMAN)
SVSPFSEEM

SEQ ID NO: 70819 - protein, 9 aa, Artificial Sequence
  Description of Artificial Sequence: Synthetic peptide
  Seed: AFGEPRELL (MAGC1_HUMAN)
AAGEPRELY

SEQ ID NO: 70820 - protein, 10 aa, Artificial Sequence
  Description of Artificial Sequence: Synthetic peptide
  Seed: TDDSTATESA (MAGC1_HUMAN)
TEDSTATESI

SEQ ID NO: 70821 - protein, 10 aa, Artificial Sequence
  Description of Artificial Sequence: Synthetic peptide
  Seed: MLKNTVPITF (MAGC1_HUMAN)
MMKNTVPITW

SEQ ID NO: 70822 - protein, 8 aa, Artificial Sequence
  Description of Artificial Sequence: Synthetic peptide
  Seed: SSFSSTLL (MAGC1_HUMAN)
SAFSSTLW

SEQ ID NO: 70823 - protein, 9 aa, Artificial Sequence
  Description of Artificial Sequence: Synthetic peptide
  Seed: YTLLSLFQS (MAGC1_HUMAN)
YQLLSLFQS

SEQ ID NO: 70824 - protein, 10 aa, Artificial Sequence
  Description of Artificial Sequence: Synthetic peptide
  Seed: ICSSSTSLSL (MAGC1_HUMAN)
IMSSSTSLSF

SEQ ID NO: 70825 - protein, 9 aa, Artificial Sequence
  Description of Artificial Sequence: Synthetic peptide
  Seed: SSPPRYEFL (MAGC1_HUMAN)
SSPPRYEFM

SEQ ID NO: 70826 - protein, 9 aa, Artificial Sequence
  Description of Artificial Sequence: Synthetic peptide
  Seed: LSDEQGMSQ (MAGC1_HUMAN)
LVDEQGMSF

SEQ ID NO: 70827 - protein, 11 aa, Artificial Sequence
  Description of Artificial Sequence: Synthetic peptide
  Seed: SPPEGPVQSPL (MAGC1_HUMAN)
SAPEGPVQSPM

SEQ ID NO: 70828 - protein, 11 aa, Artificial Sequence
  Description of Artificial Sequence: Synthetic peptide
  Seed: QSSPECTQSTF (MAGC1_HUMAN)
QLSPECTQSTW

SEQ ID NO: 70829 - protein, 9 aa, Artificial Sequence
  Description of Artificial Sequence: Synthetic peptide
  Seed: FSSTLVSLF (MAGC1_HUMAN)
FASTLVSLI

SEQ ID NO: 70830 - protein, 9 aa, Artificial Sequence
  Description of Artificial Sequence: Synthetic peptide
  Seed: SLSPFSEES (MAGC1_HUMAN)
SISPFSEEA

SEQ ID NO: 70831 - protein, 10 aa, Artificial Sequence
  Description of Artificial Sequence: Synthetic peptide
  Seed: ILILSIIFIK (MAGC1_HUMAN)
IGILSIIFIR

SEQ ID NO: 70832 - protein, 9 aa, Artificial Sequence
  Description of Artificial Sequence: Synthetic peptide
  Seed: FSSTLLSIL (MAGC1_HUMAN)
FRSTLLSIL

SEQ ID NO: 70833 - protein, 10 aa, Artificial Sequence
  Description of Artificial Sequence: Synthetic peptide
  Seed: EVIWDVLSGI (MAGC1_HUMAN)
EMIWDVLSGY

SEQ ID NO: 70834 - protein, 9 aa, Artificial Sequence
  Description of Artificial Sequence: Synthetic peptide
  Seed: VQSPLHSPQ (MAGC1_HUMAN)
VHSPLHSPM

SEQ ID NO: 70835 - protein, 10 aa, Artificial Sequence
  Description of Artificial Sequence: Synthetic peptide
  Seed: SIFQSSPESA (MAGC1_HUMAN)
SVFQSSPESV

SEQ ID NO: 70836 - protein, 9 aa, Artificial Sequence
  Description of Artificial Sequence: Synthetic peptide
  Seed: FSYTLLSLF (MAGC1_HUMAN)
FAYTLLSLM

SEQ ID NO: 70837 - protein, 11 aa, Artificial Sequence
  Description of Artificial Sequence: Synthetic peptide
  Seed: STFEGFAQSSL (MAGC1_HUMAN)
SAFEGFAQSSF

SEQ ID NO: 70838 - protein, 10 aa, Artificial Sequence
  Description of Artificial Sequence: Synthetic peptide
  Seed: EVDPDDSYVF (MAGC1_HUMAN)
EVDPDDSYVY

SEQ ID NO: 70839 - protein, 10 aa, Artificial Sequence
  Description of Artificial Sequence: Synthetic peptide
  Seed: VSSSSSSTLL (MAGC1_HUMAN)
VLSSSSSTLY

SEQ ID NO: 70840 - protein, 9 aa, Artificial Sequence
  Description of Artificial Sequence: Synthetic peptide
  Seed: CSSSTSLSL (MAGC1_HUMAN)
CQSSTSLSH

SEQ ID NO: 70841 - protein, 10 aa, Artificial Sequence
  Description of Artificial Sequence: Synthetic peptide
  Seed: LSKSSPESPL (MAGC1_HUMAN)
LSKSSPESPF

SEQ ID NO: 70842 - protein, 9 aa, Artificial Sequence
  Description of Artificial Sequence: Synthetic peptide
  Seed: RSFSSTLLS (MAGC1_HUMAN)
RAFSSTLLY

SEQ ID NO: 70843 - protein, 10 aa, Artificial Sequence
  Description of Artificial Sequence: Synthetic peptide
  Seed: GEDFQSSLQS (MAGC1_HUMAN)
GEDFQSSLQA

SEQ ID NO: 70844 - protein, 9 aa, Artificial Sequence
  Description of Artificial Sequence: Synthetic peptide
  Seed: SLTDSESLI (MAGC1_HUMAN)
SQTDSESLM

SEQ ID NO: 70845 - protein, 9 aa, Artificial Sequence
  Description of Artificial Sequence: Synthetic peptide
  Seed: MTSSFSSTL (MAGC1_HUMAN)
MYSSFSSTL

SEQ ID NO: 70846 - protein, 9 aa, Artificial Sequence
  Description of Artificial Sequence: Synthetic peptide
  Seed: LQRPVSSFF (MAGC1_HUMAN)
LTRPVSSFA

SEQ ID NO: 70847 - protein, 9 aa, Artificial Sequence
  Description of Artificial Sequence: Synthetic peptide
  Seed: LQIPVSSSS (MAGC1_HUMAN)
LCIPVSSSY

SEQ ID NO: 70848 - protein, 9 aa, Artificial Sequence
  Description of Artificial Sequence: Synthetic peptide
  Seed: KDSQSPLQI (MAGC1_HUMAN)
KLSQSPLQL

SEQ ID NO: 70849 - protein, 9 aa, Artificial Sequence
  Description of Artificial Sequence: Synthetic peptide
  Seed: SSPPRYEFL (MAGC1_HUMAN)
SRPPRYEFM

SEQ ID NO: 70850 - protein, 10 aa, Artificial Sequence
  Description of Artificial Sequence: Synthetic peptide
  Seed: RAGREHFAFG (MAGC1_HUMAN)
RVGREHFAFS

SEQ ID NO: 70851 - protein, 9 aa, Artificial Sequence
  Description of Artificial Sequence: Synthetic peptide
  Seed: VSRSFSSTL (MAGC1_HUMAN)
VWRSFSSTI

SEQ ID NO: 70852 - protein, 9 aa, Artificial Sequence
  Description of Artificial Sequence: Synthetic peptide
  Seed: SSFFSSALL (MAGC1_HUMAN)
SGFFSSALF

SEQ ID NO: 70853 - protein, 10 aa, Artificial Sequence
  Description of Artificial Sequence: Synthetic peptide
  Seed: SSFSYTLLSL (MAGC1_HUMAN)
STFSYTLLSI

SEQ ID NO: 70854 - protein, 10 aa, Artificial Sequence
  Description of Artificial Sequence: Synthetic peptide
  Seed: FAFGEPRELL (MAGC1_HUMAN)
FMFGEPRELL

SEQ ID NO: 70855 - protein, 10 aa, Artificial Sequence
  Description of Artificial Sequence: Synthetic peptide
  Seed: SRYTGYFPVI (MAGC1_HUMAN)
SEYTGYFPVL

SEQ ID NO: 70856 - protein, 9 aa, Artificial Sequence
  Description of Artificial Sequence: Synthetic peptide
  Seed: SIIFIKGTY (MAGC1_HUMAN)
SMIFIKGTY

SEQ ID NO: 70857 - protein, 9 aa, Artificial Sequence
  Description of Artificial Sequence: Synthetic peptide
  Seed: SPLQSPESA (MAGC1_HUMAN)
SSLQSPESL

SEQ ID NO: 70858 - protein, 10 aa, Artificial Sequence
  Description of Artificial Sequence: Synthetic peptide
  Seed: LQIPVSPSFS (MAGC1_HUMAN)
LKIPVSPSFY

SEQ ID NO: 70859 - protein, 11 aa, Artificial Sequence
  Description of Artificial Sequence: Synthetic peptide
  Seed: VSSSSSSSTLL (MAGC1_HUMAN)
VQSSSSSSTLW

SEQ ID NO: 70860 - protein, 11 aa, Artificial Sequence
  Description of Artificial Sequence: Synthetic peptide
  Seed: IPVSAASSSTL (MAGC1_HUMAN)
IVVSAASSSTY

SEQ ID NO: 70861 - protein, 9 aa, Artificial Sequence
  Description of Artificial Sequence: Synthetic peptide
  Seed: SVLQIPVSA (MAGC1_HUMAN)
SVLQIPVSY

SEQ ID NO: 70862 - protein, 9 aa, Artificial Sequence
  Description of Artificial Sequence: Synthetic peptide
  Seed: LQIPVSSSS (MAGC1_HUMAN)
LEIPVSSSW

SEQ ID NO: 70863 - protein, 10 aa, Artificial Sequence
  Description of Artificial Sequence: Synthetic peptide
  Seed: RPVSSFFSYT (MAGC1_HUMAN)
RDVSSFFSYK

SEQ ID NO: 70864 - protein, 10 aa, Artificial Sequence
  Description of Artificial Sequence: Synthetic peptide
  Seed: SIIFIKGTYA (MAGC1_HUMAN)
STIFIKGTYA

SEQ ID NO: 70865 - protein, 9 aa, Artificial Sequence
  Description of Artificial Sequence: Synthetic peptide
  Seed: SAPEGEDSL (MAGC1_HUMAN)
SLPEGEDSY

SEQ ID NO: 70866 - protein, 9 aa, Artificial Sequence
  Description of Artificial Sequence: Synthetic peptide
  Seed: SSSTSLSPF (MAGC1_HUMAN)
STSTSLSPM

SEQ ID NO: 70867 - protein, 10 aa, Artificial Sequence
  Description of Artificial Sequence: Synthetic peptide
  Seed: FFSSALLSIF (MAGC1_HUMAN)
FYSSALLSIF

SEQ ID NO: 70868 - protein, 9 aa, Artificial Sequence
  Description of Artificial Sequence: Synthetic peptide
  Seed: VIWDVLSGI (MAGC1_HUMAN)
VLWDVLSGI

SEQ ID NO: 70869 - protein, 9 aa, Artificial Sequence
  Description of Artificial Sequence: Synthetic peptide
  Seed: ASSFFSSAL (MAGC1_HUMAN)
AESFFSSAM

SEQ ID NO: 70870 - protein, 9 aa, Artificial Sequence
  Description of Artificial Sequence: Synthetic peptide
  Seed: MGDKDMPTA (MAGC1_HUMAN)
MIDKDMPTV

SEQ ID NO: 70871 - protein, 11 aa, Artificial Sequence
  Description of Artificial Sequence: Synthetic peptide
  Seed: EEVIWDVLSGI (MAGC1_HUMAN)
ETVIWDVLSGV

SEQ ID NO: 70872 - protein, 11 aa, Artificial Sequence
  Description of Artificial Sequence: Synthetic peptide
  Seed: SSSSSSTLLSL (MAGC1_HUMAN)
SESSSSTLLSF

SEQ ID NO: 70873 - protein, 9 aa, Artificial Sequence
  Description of Artificial Sequence: Synthetic peptide
  Seed: CSSSTSLSL (MAGC1_HUMAN)
CTSSTSLSW

SEQ ID NO: 70874 - protein, 9 aa, Artificial Sequence
  Description of Artificial Sequence: Synthetic peptide
  Seed: YTLASLLQS (MAGC1_HUMAN)
YTLASLLQV

SEQ ID NO: 70875 - protein, 10 aa, Artificial Sequence
  Description of Artificial Sequence: Synthetic peptide
  Seed: QIPVSSSFSY (MAGC1_HUMAN)
QYPVSSSFSY

SEQ ID NO: 70876 - protein, 11 aa, Artificial Sequence
  Description of Artificial Sequence: Synthetic peptide
  Seed: SSFPSSTSSSL (MAGC1_HUMAN)
SGFPSSTSSSY

SEQ ID NO: 70877 - protein, 9 aa, Artificial Sequence
  Description of Artificial Sequence: Synthetic peptide
  Seed: KVVEFLAML (MAGC1_HUMAN)
KMVEFLAMC

SEQ ID NO: 70878 - protein, 9 aa, Artificial Sequence
  Description of Artificial Sequence: Synthetic peptide
  Seed: QVKQPITKA (MAGC1_HUMAN)
QVKQPITKF

SEQ ID NO: 70879 - protein, 9 aa, Artificial Sequence
  Description of Artificial Sequence: Synthetic peptide
  Seed: LARFLLLKY (MAGC1_HUMAN)
LTRFLLLKF

SEQ ID NO: 70880 - protein, 10 aa, Artificial Sequence
  Description of Artificial Sequence: Synthetic peptide
  Seed: RSFSSTLLSI (MAGC1_HUMAN)
RRFSSTLLSM

SEQ ID NO: 70881 - protein, 9 aa, Artificial Sequence
  Description of Artificial Sequence: Synthetic peptide
  Seed: SSFPSSTSS (MAGC1_HUMAN)
SSFPSSTSF

SEQ ID NO: 70882 - protein, 10 aa, Artificial Sequence
  Description of Artificial Sequence: Synthetic peptide
  Seed: SSPESTQSPF (MAGC1_HUMAN)
SIPESTQSPM

SEQ ID NO: 70883 - protein, 9 aa, Artificial Sequence
  Description of Artificial Sequence: Synthetic peptide
  Seed: SSSTLVSIF (MAGC1_HUMAN)
SASTLVSIL

SEQ ID NO: 70884 - protein, 10 aa, Artificial Sequence
  Description of Artificial Sequence: Synthetic peptide
  Seed: NPASSFFSSA (MAGC1_HUMAN)
NTASSFFSSA

SEQ ID NO: 70885 - protein, 10 aa, Artificial Sequence
  Description of Artificial Sequence: Synthetic peptide
  Seed: LSIFQSSPER (MAGC1_HUMAN)
LMIFQSSPER

SEQ ID NO: 70886 - protein, 9 aa, Artificial Sequence
  Description of Artificial Sequence: Synthetic peptide
  Seed: FSYTLLSLF (MAGC1_HUMAN)
FRYTLLSLV

SEQ ID NO: 70887 - protein, 9 aa, Artificial Sequence
  Description of Artificial Sequence: Synthetic peptide
  Seed: VSSSSSSTL (MAGC1_HUMAN)
VLSSSSSTY

SEQ ID NO: 70888 - protein, 9 aa, Artificial Sequence
  Description of Artificial Sequence: Synthetic peptide
  Seed: LQIVPSLPE (MAGC1_HUMAN)
LMIVPSLPI

SEQ ID NO: 70889 - protein, 11 aa, Artificial Sequence
  Description of Artificial Sequence: Synthetic peptide
  Seed: IPMTSSFSSTL (MAGC1_HUMAN)
IGMTSSFSSTW

SEQ ID NO: 70890 - protein, 9 aa, Artificial Sequence
  Description of Artificial Sequence: Synthetic peptide
  Seed: SQSSPVSSF (MAGC1_HUMAN)
SWSSPVSSY

SEQ ID NO: 70891 - protein, 9 aa, Artificial Sequence
  Description of Artificial Sequence: Synthetic peptide
  Seed: SQSSPVSSF (MAGC1_HUMAN)
SYSSPVSSV

SEQ ID NO: 70892 - protein, 10 aa, Artificial Sequence
  Description of Artificial Sequence: Synthetic peptide
  Seed: HSPQSPPEGM (MAGC1_HUMAN)
HLPQSPPEGL

SEQ ID NO: 70893 - protein, 10 aa, Artificial Sequence
  Description of Artificial Sequence: Synthetic peptide
  Seed: IIDTTDDSTA (MAGC1_HUMAN)
IADTTDDSTM

SEQ ID NO: 70894 - protein, 9 aa, Artificial Sequence
  Description of Artificial Sequence: Synthetic peptide
  Seed: LKNTVPITF (MAGC1_HUMAN)
LHNTVPITL

SEQ ID NO: 70895 - protein, 9 aa, Artificial Sequence
  Description of Artificial Sequence: Synthetic peptide
  Seed: RPVSSFFSY (MAGC1_HUMAN)
RVVSSFFSM

SEQ ID NO: 70896 - protein, 9 aa, Artificial Sequence
  Description of Artificial Sequence: Synthetic peptide
  Seed: FPSSTSSSL (MAGC1_HUMAN)
FTSSTSSSI

SEQ ID NO: 70897 - protein, 10 aa, Artificial Sequence
  Description of Artificial Sequence: Synthetic peptide
  Seed: FFSYTLASLL (MAGC1_HUMAN)
FMSYTLASLF

SEQ ID NO: 70898 - protein, 10 aa, Artificial Sequence
  Description of Artificial Sequence: Synthetic peptide
  Seed: KRKVVEFLAM (MAGC1_HUMAN)
KRKVVEFLAY

SEQ ID NO: 70899 - protein, 9 aa, Artificial Sequence
  Description of Artificial Sequence: Synthetic peptide
  Seed: FLWGPRAHS (MAGC1_HUMAN)
FMWGPRAHC

SEQ ID NO: 70900 - protein, 10 aa, Artificial Sequence
  Description of Artificial Sequence: Synthetic peptide
  Seed: LQIVPSLPEW (MAGC1_HUMAN)
LQIVPSLPEM

SEQ ID NO: 70901 - protein, 10 aa, Artificial Sequence
  Description of Artificial Sequence: Synthetic peptide
  Seed: ICSSSTSLSL (MAGC1_HUMAN)
IGSSSTSLSM

SEQ ID NO: 70902 - protein, 10 aa, Artificial Sequence
  Description of Artificial Sequence: Synthetic peptide
  Seed: RSFSSTLLSI (MAGC1_HUMAN)
RQFSSTLLSF

SEQ ID NO: 70903 - protein, 9 aa, Artificial Sequence
  Description of Artificial Sequence: Synthetic peptide
  Seed: LQIPVSRSF (MAGC1_HUMAN)
LHIPVSRSI

SEQ ID NO: 70904 - protein, 10 aa, Artificial Sequence
  Description of Artificial Sequence: Synthetic peptide
  Seed: SFSSTLLSIL (MAGC1_HUMAN)
SESSTLLSIF

SEQ ID NO: 70905 - protein, 11 aa, Artificial Sequence
  Description of Artificial Sequence: Synthetic peptide
  Seed: SFFSSALLSIF (MAGC1_HUMAN)
SMFSSALLSIM

SEQ ID NO: 70906 - protein, 10 aa, Artificial Sequence
  Description of Artificial Sequence: Synthetic peptide
  Seed: EILFGISLRE (MAGC1_HUMAN)
EELFGISLRK

SEQ ID NO: 70907 - protein, 9 aa, Artificial Sequence
  Description of Artificial Sequence: Synthetic peptide
  Seed: SPLQSPVSS (MAGC1_HUMAN)
SALQSPVSY

SEQ ID NO: 70908 - protein, 10 aa, Artificial Sequence
  Description of Artificial Sequence: Synthetic peptide
  Seed: LHFPQSPPEW (MAGC1_HUMAN)
LHFPQSPPEL

SEQ ID NO: 70909 - protein, 10 aa, Artificial Sequence
  Description of Artificial Sequence: Synthetic peptide
  Seed: LLQIPMTSSF (MAGC1_HUMAN)
LPQIPMTSSW

SEQ ID NO: 70910 - protein, 9 aa, Artificial Sequence
  Description of Artificial Sequence: Synthetic peptide
  Seed: SGIGVRAGR (MAGC1_HUMAN)
SMIGVRAGR

SEQ ID NO: 70911 - protein, 9 aa, Artificial Sequence
  Description of Artificial Sequence: Synthetic peptide
  Seed: TLASLLQSS (MAGC1_HUMAN)
TVASLLQSV

SEQ ID NO: 70912 - protein, 10 aa, Artificial Sequence
  Description of Artificial Sequence: Synthetic peptide
  Seed: ASSFFSSALL (MAGC1_HUMAN)
AASFFSSALV

SEQ ID NO: 70913 - protein, 10 aa, Artificial Sequence
  Description of Artificial Sequence: Synthetic peptide
  Seed: KVVEFLAMLK (MAGC1_HUMAN)
KIVEFLAMLK

SEQ ID NO: 70914 - protein, 9 aa, Artificial Sequence
  Description of Artificial Sequence: Synthetic peptide
  Seed: SSPECTQST (MAGC1_HUMAN)
STPECTQSV

SEQ ID NO: 70915 - protein, 10 aa, Artificial Sequence
  Description of Artificial Sequence: Synthetic peptide
  Seed: STFEGFPQSL (MAGC1_HUMAN)
SVFEGFPQSF

SEQ ID NO: 70916 - protein, 9 aa, Artificial Sequence
  Description of Artificial Sequence: Synthetic peptide
  Seed: SLFQSFSER (MAGC1_HUMAN)
SWFQSFSER

SEQ ID NO: 70917 - protein, 9 aa, Artificial Sequence
  Description of Artificial Sequence: Synthetic peptide
  Seed: FSERTQSTF (MAGC1_HUMAN)
FVERTQSTL

SEQ ID NO: 70918 - protein, 10 aa, Artificial Sequence
  Description of Artificial Sequence: Synthetic peptide
  Seed: VSSSSSSSTL (MAGC1_HUMAN)
VFSSSSSSTF

SEQ ID NO: 70919 - protein, 10 aa, Artificial Sequence
  Description of Artificial Sequence: Synthetic peptide
  Seed: FFSYTLASLL (MAGC1_HUMAN)
FLSYTLASLH

SEQ ID NO: 70920 - protein, 9 aa, Artificial Sequence
  Description of Artificial Sequence: Synthetic peptide
  Seed: MTSSFSSTL (MAGC1_HUMAN)
MFSSFSSTF

SEQ ID NO: 70921 - protein, 11 aa, Artificial Sequence
  Description of Artificial Sequence: Synthetic peptide
  Seed: SFFSSALLSIF (MAGC1_HUMAN)
SWFSSALLSIF

SEQ ID NO: 70922 - protein, 9 aa, Artificial Sequence
  Description of Artificial Sequence: Synthetic peptide
  Seed: TTDDSTATE (MAGC1_HUMAN)
TQDDSTATL

SEQ ID NO: 70923 - protein, 9 aa, Artificial Sequence
  Description of Artificial Sequence: Synthetic peptide
  Seed: VSPSSSSTL (MAGC1_HUMAN)
VYPSSSSTV

SEQ ID NO: 70924 - protein, 9 aa, Artificial Sequence
  Description of Artificial Sequence: Synthetic peptide
  Seed: SSFFSYTLA (MAGC1_HUMAN)
SSFFSYTLV

SEQ ID NO: 70925 - protein, 9 aa, Artificial Sequence
  Description of Artificial Sequence: Synthetic peptide
  Seed: EGDDTQSPL (MAGC1_HUMAN)
EADDTQSPM

SEQ ID NO: 70926 - protein, 9 aa, Artificial Sequence
  Description of Artificial Sequence: Synthetic peptide
  Seed: TESASSSVM (MAGC1_HUMAN)
TLSASSSVF

SEQ ID NO: 70927 - protein, 10 aa, Artificial Sequence
  Description of Artificial Sequence: Synthetic peptide
  Seed: ISRYTGYFPV (MAGC1_HUMAN)
ISRYTGYFPL

SEQ ID NO: 70928 - protein, 11 aa, Artificial Sequence
  Description of Artificial Sequence: Synthetic peptide
  Seed: SICSSSTSLSL (MAGC1_HUMAN)
SVCSSSTSLSW

SEQ ID NO: 70929 - protein, 9 aa, Artificial Sequence
  Description of Artificial Sequence: Synthetic peptide
  Seed: LQIPGSPSF (MAGC1_HUMAN)
LVIPGSPSW

SEQ ID NO: 70930 - protein, 10 aa, Artificial Sequence
  Description of Artificial Sequence: Synthetic peptide
  Seed: LQIVPSLPEW (MAGC1_HUMAN)
LSIVPSLPEY

SEQ ID NO: 70931 - protein, 9 aa, Artificial Sequence
  Description of Artificial Sequence: Synthetic peptide
  Seed: SSSSTLLSL (MAGC1_HUMAN)
SLSSTLLSV

SEQ ID NO: 70932 - protein, 10 aa, Artificial Sequence
  Description of Artificial Sequence: Synthetic peptide
  Seed: LILILSIIFI (MAGC1_HUMAN)
LYLILSIIFV

SEQ ID NO: 70933 - protein, 9 aa, Artificial Sequence
  Description of Artificial Sequence: Synthetic peptide
  Seed: AMLKNTVPI (MAGC1_HUMAN)
ASLKNTVPF

SEQ ID NO: 70934 - protein, 9 aa, Artificial Sequence
  Description of Artificial Sequence: Synthetic peptide
  Seed: MPTAGMPSL (MAGC1_HUMAN)
MITAGMPSL

SEQ ID NO: 70935 - protein, 9 aa, Artificial Sequence
  Description of Artificial Sequence: Synthetic peptide
  Seed: SSPECTQST (MAGC1_HUMAN)
SGPECTQSM

SEQ ID NO: 70936 - protein, 9 aa, Artificial Sequence
  Description of Artificial Sequence: Synthetic peptide
  Seed: AQSPLQIPV (MAGC1_HUMAN)
ASSPLQIPI

SEQ ID NO: 70937 - protein, 10 aa, Artificial Sequence
  Description of Artificial Sequence: Synthetic peptide
  Seed: RSFSSTLLSI (MAGC1_HUMAN)
RLFSSTLLSY

SEQ ID NO: 70938 - protein, 10 aa, Artificial Sequence
  Description of Artificial Sequence: Synthetic peptide
  Seed: IPVSPSSSST (MAGC1_HUMAN)
IPVSPSSSSL

SEQ ID NO: 70939 - protein, 9 aa, Artificial Sequence
  Description of Artificial Sequence: Synthetic peptide
  Seed: LEYREVPNS (MAGC1_HUMAN)
LEYREVPNL

SEQ ID NO: 70940 - protein, 9 aa, Artificial Sequence
  Description of Artificial Sequence: Synthetic peptide
  Seed: YTLLSLFQS (MAGC1_HUMAN)
YTLLSLFQL

SEQ ID NO: 70941 - protein, 9 aa, Artificial Sequence
  Description of Artificial Sequence: Synthetic peptide
  Seed: SPLQIVPSL (MAGC1_HUMAN)
SVLQIVPSF

SEQ ID NO: 70942 - protein, 9 aa, Artificial Sequence
  Description of Artificial Sequence: Synthetic peptide
  Seed: LQRPVSSFF (MAGC1_HUMAN)
LMRPVSSFK

SEQ ID NO: 70943 - protein, 9 aa, Artificial Sequence
  Description of Artificial Sequence: Synthetic peptide
  Seed: SLIESEPLF (MAGC1_HUMAN)
SFIESEPLF

SEQ ID NO: 70944 - protein, 9 aa, Artificial Sequence
  Description of Artificial Sequence: Synthetic peptide
  Seed: VLSGIGVRA (MAGC1_HUMAN)
VMSGIGVRI

SEQ ID NO: 70945 - protein, 9 aa, Artificial Sequence
  Description of Artificial Sequence: Synthetic peptide
  Seed: LQIPVSRSF (MAGC1_HUMAN)
LFIPVSRSW

SEQ ID NO: 70946 - protein, 10 aa, Artificial Sequence
  Description of Artificial Sequence: Synthetic peptide
  Seed: YTLLSLFQSS (MAGC1_HUMAN)
YGLLSLFQSL

SEQ ID NO: 70947 - protein, 9 aa, Artificial Sequence
  Description of Artificial Sequence: Synthetic peptide
  Seed: QSPLQGEEF (MAGC1_HUMAN)
QYPLQGEEL

SEQ ID NO: 70948 - protein, 10 aa, Artificial Sequence
  Description of Artificial Sequence: Synthetic peptide
  Seed: SLFQSSPECT (MAGC1_HUMAN)
SQFQSSPECV

SEQ ID NO: 70949 - protein, 8 aa, Artificial Sequence
  Description of Artificial Sequence: Synthetic peptide
  Seed: SPLQNPAS (MAGC1_HUMAN)
SPLQNPAA

SEQ ID NO: 70950 - protein, 9 aa, Artificial Sequence
  Description of Artificial Sequence: Synthetic peptide
  Seed: YQVKQPITK (MAGC1_HUMAN)
YSVKQPITY

SEQ ID NO: 70951 - protein, 11 aa, Artificial Sequence
  Description of Artificial Sequence: Synthetic peptide
  Seed: SSSSSSTLLSL (MAGC1_HUMAN)
SPSSSSTLLSY

SEQ ID NO: 70952 - protein, 11 aa, Artificial Sequence
  Description of Artificial Sequence: Synthetic peptide
  Seed: STFEGFAQSSL (MAGC1_HUMAN)
SIFEGFAQSSV

SEQ ID NO: 70953 - protein, 10 aa, Artificial Sequence
  Description of Artificial Sequence: Synthetic peptide
  Seed: SQSSPVSSFP (MAGC1_HUMAN)
SKSSPVSSFY

SEQ ID NO: 70954 - protein, 9 aa, Artificial Sequence
  Description of Artificial Sequence: Synthetic peptide
  Seed: IPVSSSFSY (MAGC1_HUMAN)
IMVSSSFSF

SEQ ID NO: 70955 - protein, 9 aa, Artificial Sequence
  Description of Artificial Sequence: Synthetic peptide
  Seed: LQIPVSSSS (MAGC1_HUMAN)
LKIPVSSSM

SEQ ID NO: 70956 - protein, 9 aa, Artificial Sequence
  Description of Artificial Sequence: Synthetic peptide
  Seed: DELARFLLL (MAGC1_HUMAN)
DRLARFLLL

SEQ ID NO: 70957 - protein, 10 aa, Artificial Sequence
  Description of Artificial Sequence: Synthetic peptide
  Seed: ASSSTLVSIF (MAGC1_HUMAN)
ATSSTLVSIF

SEQ ID NO: 70958 - protein, 10 aa, Artificial Sequence
  Description of Artificial Sequence: Synthetic peptide
  Seed: FSSSTSLSPF (MAGC1_HUMAN)
FYSSTSLSPW

SEQ ID NO: 70959 - protein, 10 aa, Artificial Sequence
  Description of Artificial Sequence: Synthetic peptide
  Seed: FAFGEPRELL (MAGC1_HUMAN)
FYFGEPRELF

SEQ ID NO: 70960 - protein, 9 aa, Artificial Sequence
  Description of Artificial Sequence: Synthetic peptide
  Seed: SIFQSSPER (MAGC1_HUMAN)
SSFQSSPEK

SEQ ID NO: 70961 - protein, 9 aa, Artificial Sequence
  Description of Artificial Sequence: Synthetic peptide
  Seed: IPVSSSFSY (MAGC1_HUMAN)
IAVSSSFSM

SEQ ID NO: 70962 - protein, 9 aa, Artificial Sequence
  Description of Artificial Sequence: Synthetic peptide
  Seed: SSSDTLLES (MAGC1_HUMAN)
SISDTLLEL

SEQ ID NO: 70963 - protein, 11 aa, Artificial Sequence
  Description of Artificial Sequence: Synthetic peptide
  Seed: SLFQSSPERTH (MAGC1_HUMAN)
SIFQSSPERTY

SEQ ID NO: 70964 - protein, 9 aa, Artificial Sequence
  Description of Artificial Sequence: Synthetic peptide
  Seed: SSFPSSTSS (MAGC1_HUMAN)
SAFPSSTSF

SEQ ID NO: 70965 - protein, 9 aa, Artificial Sequence
  Description of Artificial Sequence: Synthetic peptide
  Seed: VPITFPSSY (MAGC1_HUMAN)
VQITFPSSI

SEQ ID NO: 70966 - protein, 9 aa, Artificial Sequence
  Description of Artificial Sequence: Synthetic peptide
  Seed: VIWDVLSGI (MAGC1_HUMAN)
VMWDVLSGM

SEQ ID NO: 70967 - protein, 9 aa, Artificial Sequence
  Description of Artificial Sequence: Synthetic peptide
  Seed: SSPPRYEFL (MAGC1_HUMAN)
SMPPRYEFV

SEQ ID NO: 70968 - protein, 9 aa, Artificial Sequence
  Description of Artificial Sequence: Synthetic peptide
  Seed: KAREFIEIL (MAGC1_HUMAN)
KMREFIEIA

SEQ ID NO: 70969 - protein, 9 aa, Artificial Sequence
  Description of Artificial Sequence: Synthetic peptide
  Seed: NTHSPLQIV (MAGC1_HUMAN)
NPHSPLQII

SEQ ID NO: 70970 - protein, 9 aa, Artificial Sequence
  Description of Artificial Sequence: Synthetic peptide
  Seed: VIFRKAREF (MAGC1_HUMAN)
VLFRKAREF

SEQ ID NO: 70971 - protein, 9 aa, Artificial Sequence
  Description of Artificial Sequence: Synthetic peptide
  Seed: SSSSTLLSL (MAGC1_HUMAN)
SASSTLLSL

SEQ ID NO: 70972 - protein, 10 aa, Artificial Sequence
  Description of Artificial Sequence: Synthetic peptide
  Seed: SIFQSSPESA (MAGC1_HUMAN)
SLFQSSPESV

SEQ ID NO: 70973 - protein, 10 aa, Artificial Sequence
  Description of Artificial Sequence: Synthetic peptide
  Seed: ATESASSSVM (MAGC1_HUMAN)
ATESASSSVW

SEQ ID NO: 70974 - protein, 11 aa, Artificial Sequence
  Description of Artificial Sequence: Synthetic peptide
  Seed: FPQFPPQGEDF (MAGC1_HUMAN)
FPQFPPQGEDW

SEQ ID NO: 70975 - protein, 10 aa, Artificial Sequence
  Description of Artificial Sequence: Synthetic peptide
  Seed: REVPNSSPPR (MAGC1_HUMAN)
RFVPNSSPPR

SEQ ID NO: 70976 - protein, 9 aa, Artificial Sequence
  Description of Artificial Sequence: Synthetic peptide
  Seed: VIWDVLSGI (MAGC1_HUMAN)
VVWDVLSGR

SEQ ID NO: 70977 - protein, 10 aa, Artificial Sequence
  Description of Artificial Sequence: Synthetic peptide
  Seed: LLQIPMTSSF (MAGC1_HUMAN)
LCQIPMTSSY

SEQ ID NO: 70978 - protein, 9 aa, Artificial Sequence
  Description of Artificial Sequence: Synthetic peptide
  Seed: SSPERTHST (MAGC1_HUMAN)
SAPERTHSA

SEQ ID NO: 70979 - protein, 11 aa, Artificial Sequence
  Description of Artificial Sequence: Synthetic peptide
  Seed: SEESSSPVDEY (MAGC1_HUMAN)
SSESSSPVDEY

SEQ ID NO: 70980 - protein, 9 aa, Artificial Sequence
  Description of Artificial Sequence: Synthetic peptide
  Seed: VIFRKAREF (MAGC1_HUMAN)
VAFRKAREM

SEQ ID NO: 70981 - protein, 9 aa, Artificial Sequence
  Description of Artificial Sequence: Synthetic peptide
  Seed: SSSSTLLSL (MAGC1_HUMAN)
SMSSTLLSV

SEQ ID NO: 70982 - protein, 10 aa, Artificial Sequence
  Description of Artificial Sequence: Synthetic peptide
  Seed: YTLDEKVDEL (MAGC1_HUMAN)
YLLDEKVDEM

SEQ ID NO: 70983 - protein, 9 aa, Artificial Sequence
  Description of Artificial Sequence: Synthetic peptide
  Seed: SPPQGEDSM (MAGC1_HUMAN)
SSPQGEDSL

SEQ ID NO: 70984 - protein, 10 aa, Artificial Sequence
  Description of Artificial Sequence: Synthetic peptide
  Seed: LQIPMTSSFS (MAGC1_HUMAN)
LQIPMTSSFQ

SEQ ID NO: 70985 - protein, 9 aa, Artificial Sequence
  Description of Artificial Sequence: Synthetic peptide
  Seed: FEGFAQSPL (MAGC1_HUMAN)
FRGFAQSPY

SEQ ID NO: 70986 - protein, 9 aa, Artificial Sequence
  Description of Artificial Sequence: Synthetic peptide
  Seed: GEDSMSPLY (MAGC1_HUMAN)
GEDSMSPLV

SEQ ID NO: 70987 - protein, 10 aa, Artificial Sequence
  Description of Artificial Sequence: Synthetic peptide
  Seed: MTSSFSSTLL (MAGC1_HUMAN)
MPSSFSSTLL

SEQ ID NO: 70988 - protein, 9 aa, Artificial Sequence
  Description of Artificial Sequence: Synthetic peptide
  Seed: SSFFSSALL (MAGC1_HUMAN)
SHFFSSALY

SEQ ID NO: 70989 - protein, 9 aa, Artificial Sequence
  Description of Artificial Sequence: Synthetic peptide
  Seed: SFSSTLVSL (MAGC1_HUMAN)
SYSSTLVSV

SEQ ID NO: 70990 - protein, 10 aa, Artificial Sequence
  Description of Artificial Sequence: Synthetic peptide
  Seed: TGYFPVIFRK (MAGC1_HUMAN)
TAYFPVIFRD

SEQ ID NO: 70991 - protein, 9 aa, Artificial Sequence
  Description of Artificial Sequence: Synthetic peptide
  Seed: MPSLLQSSS (MAGC1_HUMAN)
MTSLLQSSY

SEQ ID NO: 70992 - protein, 8 aa, Artificial Sequence
  Description of Artificial Sequence: Synthetic peptide
  Seed: FSYTLASL (MAGC1_HUMAN)
FAYTLASY

SEQ ID NO: 70993 - protein, 9 aa, Artificial Sequence
  Description of Artificial Sequence: Synthetic peptide
  Seed: QSPLQGEEF (MAGC1_HUMAN)
QFPLQGEEF

SEQ ID NO: 70994 - protein, 9 aa, Artificial Sequence
  Description of Artificial Sequence: Synthetic peptide
  Seed: AQSPLQIPV (MAGC1_HUMAN)
AESPLQIPF

SEQ ID NO: 70995 - protein, 9 aa, Artificial Sequence
  Description of Artificial Sequence: Synthetic peptide
  Seed: IPMTSSFSS (MAGC1_HUMAN)
IPMTSSFSL

SEQ ID NO: 70996 - protein, 9 aa, Artificial Sequence
  Description of Artificial Sequence: Synthetic peptide
  Seed: SSSTLLSLF (MAGC1_HUMAN)
SCSTLLSLW

SEQ ID NO: 70997 - protein, 9 aa, Artificial Sequence
  Description of Artificial Sequence: Synthetic peptide
  Seed: RLLILILSI (MAGC1_HUMAN)
RLLILILSM

SEQ ID NO: 70998 - protein, 9 aa, Artificial Sequence
  Description of Artificial Sequence: Synthetic peptide
  Seed: FSSALLSIF (MAGC1_HUMAN)
FGSALLSIW

SEQ ID NO: 70999 - protein, 9 aa, Artificial Sequence
  Description of Artificial Sequence: Synthetic peptide
  Seed: SSPESPLQS (MAGC1_HUMAN)
SLPESPLQI

SEQ ID NO: 71000 - protein, 10 aa, Artificial Sequence
  Description of Artificial Sequence: Synthetic peptide
  Seed: MPTAGMPSLL (MAGC1_HUMAN)
MATAGMPSLY

SEQ ID NO: 71001 - protein, 10 aa, Artificial Sequence
  Description of Artificial Sequence: Synthetic peptide
  Seed: FPQSVLQIPV (MAGC1_HUMAN)
FAQSVLQIPW

SEQ ID NO: 71002 - protein, 9 aa, Artificial Sequence
  Description of Artificial Sequence: Synthetic peptide
  Seed: SSSDTLLES (MAGC1_HUMAN)
SVSDTLLEF

SEQ ID NO: 71003 - protein, 9 aa, Artificial Sequence
  Description of Artificial Sequence: Synthetic peptide
  Seed: SQSPPEGPV (MAGC1_HUMAN)
SSSPPEGPF

SEQ ID NO: 71004 - protein, 9 aa, Artificial Sequence
  Description of Artificial Sequence: Synthetic peptide
  Seed: SSPESTQSP (MAGC1_HUMAN)
SSPESTQSM

SEQ ID NO: 71005 - protein, 9 aa, Artificial Sequence
  Description of Artificial Sequence: Synthetic peptide
  Seed: GEDSMSPLY (MAGC1_HUMAN)
GVDSMSPLY

SEQ ID NO: 71006 - protein, 9 aa, Artificial Sequence
  Description of Artificial Sequence: Synthetic peptide
  Seed: SPESPLQSP (MAGC1_HUMAN)
SPESPLQSF

SEQ ID NO: 71007 - protein, 10 aa, Artificial Sequence
  Description of Artificial Sequence: Synthetic peptide
  Seed: FFSSALLSIF (MAGC1_HUMAN)
FCSSALLSIW

SEQ ID NO: 71008 - protein, 9 aa, Artificial Sequence
  Description of Artificial Sequence: Synthetic peptide
  Seed: VPITFPSSY (MAGC1_HUMAN)
VPITFPSSM

SEQ ID NO: 71009 - protein, 10 aa, Artificial Sequence
  Description of Artificial Sequence: Synthetic peptide
  Seed: MPTAGMPSLL (MAGC1_HUMAN)
MNTAGMPSLW

SEQ ID NO: 71010 - protein, 10 aa, Artificial Sequence
  Description of Artificial Sequence: Synthetic peptide
  Seed: RTQSTFEGFA (MAGC1_HUMAN)
RMQSTFEGFK

SEQ ID NO: 71011 - protein, 10 aa, Artificial Sequence
  Description of Artificial Sequence: Synthetic peptide
  Seed: SRYTGYFPVI (MAGC1_HUMAN)
SDYTGYFPVL

SEQ ID NO: 71012 - protein, 10 aa, Artificial Sequence
  Description of Artificial Sequence: Synthetic peptide
  Seed: STSLSLPQSF (MAGC1_HUMAN)
SMSLSLPQSF

SEQ ID NO: 71013 - protein, 10 aa, Artificial Sequence
  Description of Artificial Sequence: Synthetic peptide
  Seed: KVDELARFLL (MAGC1_HUMAN)
KMDELARFLL

SEQ ID NO: 71014 - protein, 9 aa, Artificial Sequence
  Description of Artificial Sequence: Synthetic peptide
  Seed: WVQEHYLEY (MAGC1_HUMAN)
WFQEHYLEL

SEQ ID NO: 71015 - protein, 9 aa, Artificial Sequence
  Description of Artificial Sequence: Synthetic peptide
  Seed: LQRPVSSFF (MAGC1_HUMAN)
LERPVSSFY

SEQ ID NO: 71016 - protein, 11 aa, Artificial Sequence
  Description of Artificial Sequence: Synthetic peptide
  Seed: SSFFSSALLSI (MAGC1_HUMAN)
SSFFSSALLSW

SEQ ID NO: 71017 - protein, 10 aa, Artificial Sequence
  Description of Artificial Sequence: Synthetic peptide
  Seed: FAQSSLQIPV (MAGC1_HUMAN)
FCQSSLQIPL

SEQ ID NO: 71018 - protein, 9 aa, Artificial Sequence
  Description of Artificial Sequence: Synthetic peptide
  Seed: QFPPQGEDF (MAGC1_HUMAN)
QYPPQGEDF

SEQ ID NO: 71019 - protein, 9 aa, Artificial Sequence
  Description of Artificial Sequence: Synthetic peptide
  Seed: ESDDTLYPL (MAGC1_HUMAN)
EVDDTLYPV

SEQ ID NO: 71020 - protein, 9 aa, Artificial Sequence
  Description of Artificial Sequence: Synthetic peptide
  Seed: SKSSPESPL (MAGC1_HUMAN)
SESSPESPF

SEQ ID NO: 71021 - protein, 10 aa, Artificial Sequence
  Description of Artificial Sequence: Synthetic peptide
  Seed: ISRYTGYFPV (MAGC1_HUMAN)
ISRYTGYFPM

SEQ ID NO: 71022 - protein, 9 aa, Artificial Sequence
  Description of Artificial Sequence: Synthetic peptide
  Seed: SSPESAQST (MAGC1_HUMAN)
SYPESAQSL

SEQ ID NO: 71023 - protein, 9 aa, Artificial Sequence
  Description of Artificial Sequence: Synthetic peptide
  Seed: TSLSLPQSF (MAGC1_HUMAN)
TKLSLPQSM

SEQ ID NO: 71024 - protein, 10 aa, Artificial Sequence
  Description of Artificial Sequence: Synthetic peptide
  Seed: ASSSVMSPSF (MAGC1_HUMAN)
ALSSVMSPSW

SEQ ID NO: 71025 - protein, 11 aa, Artificial Sequence
  Description of Artificial Sequence: Synthetic peptide
  Seed: SLIESEPLFTY (MAGC1_HUMAN)
SIIESEPLFTV

SEQ ID NO: 71026 - protein, 11 aa, Artificial Sequence
  Description of Artificial Sequence: Synthetic peptide
  Seed: SSFPSSTSSSL (MAGC1_HUMAN)
SDFPSSTSSSL

SEQ ID NO: 71027 - protein, 9 aa, Artificial Sequence
  Description of Artificial Sequence: Synthetic peptide
  Seed: FSSTLLSIL (MAGC1_HUMAN)
FVSTLLSIW

SEQ ID NO: 71028 - protein, 9 aa, Artificial Sequence
  Description of Artificial Sequence: Synthetic peptide
  Seed: FSYTLLSLF (MAGC1_HUMAN)
FFYTLLSLY

SEQ ID NO: 71029 - protein, 10 aa, Artificial Sequence
  Description of Artificial Sequence: Synthetic peptide
  Seed: ESAQSAFEGF (MAGC1_HUMAN)
EIAQSAFEGY

SEQ ID NO: 71030 - protein, 9 aa, Artificial Sequence
  Description of Artificial Sequence: Synthetic peptide
  Seed: FAFGEPREL (MAGC1_HUMAN)
FTFGEPREV

SEQ ID NO: 71031 - protein, 9 aa, Artificial Sequence
  Description of Artificial Sequence: Synthetic peptide
  Seed: ASSFFSSAL (MAGC1_HUMAN)
ARSFFSSAF

SEQ ID NO: 71032 - protein, 11 aa, Artificial Sequence
  Description of Artificial Sequence: Synthetic peptide
  Seed: TTDDSTATESA (MAGC1_HUMAN)
TLDDSTATESV

SEQ ID NO: 71033 - protein, 10 aa, Artificial Sequence
  Description of Artificial Sequence: Synthetic peptide
  Seed: MTSSFSSTLL (MAGC1_HUMAN)
MGSSFSSTLV

SEQ ID NO: 71034 - protein, 9 aa, Artificial Sequence
  Description of Artificial Sequence: Synthetic peptide
  Seed: SLTDSESLI (MAGC1_HUMAN)
SMTDSESLW

SEQ ID NO: 71035 - protein, 9 aa, Artificial Sequence
  Description of Artificial Sequence: Synthetic peptide
  Seed: MTSSFSSTL (MAGC1_HUMAN)
MTSSFSSTW

SEQ ID NO: 71036 - protein, 9 aa, Artificial Sequence
  Description of Artificial Sequence: Synthetic peptide
  Seed: SQNRLLILI (MAGC1_HUMAN)
SLNRLLILI

SEQ ID NO: 71037 - protein, 10 aa, Artificial Sequence
  Description of Artificial Sequence: Synthetic peptide
  Seed: VPITFPSSYK (MAGC1_HUMAN)
VGITFPSSYR

SEQ ID NO: 71038 - protein, 9 aa, Artificial Sequence
  Description of Artificial Sequence: Synthetic peptide
  Seed: FQSSLQSPV (MAGC1_HUMAN)
FSSSLQSPL

SEQ ID NO: 71039 - protein, 9 aa, Artificial Sequence
  Description of Artificial Sequence: Synthetic peptide
  Seed: LTKVWVQEH (MAGC1_HUMAN)
LAKVWVQEL

SEQ ID NO: 71040 - protein, 8 aa, Artificial Sequence
  Description of Artificial Sequence: Synthetic peptide
  Seed: LTDSESLI (MAGC1_HUMAN)
LTDSESLL

SEQ ID NO: 71041 - protein, 10 aa, Artificial Sequence
  Description of Artificial Sequence: Synthetic peptide
  Seed: VSSSSSSTLL (MAGC1_HUMAN)
VCSSSSSTLW

SEQ ID NO: 71042 - protein, 9 aa, Artificial Sequence
  Description of Artificial Sequence: Synthetic peptide
  Seed: AGREHFAFG (MAGC1_HUMAN)
ASREHFAFT

SEQ ID NO: 71043 - protein, 9 aa, Artificial Sequence
  Description of Artificial Sequence: Synthetic peptide
  Seed: AGREHFAFG (MAGC1_HUMAN)
ANREHFAFK

SEQ ID NO: 71044 - protein, 9 aa, Artificial Sequence
  Description of Artificial Sequence: Synthetic peptide
  Seed: QIVPSLPEW (MAGC1_HUMAN)
QQVPSLPEM

SEQ ID NO: 71045 - protein, 11 aa, Artificial Sequence
  Description of Artificial Sequence: Synthetic peptide
  Seed: SPQGEDSLSPH (MAGC1_HUMAN)
SPQGEDSLSPY

SEQ ID NO: 71046 - protein, 9 aa, Artificial Sequence
  Description of Artificial Sequence: Synthetic peptide
  Seed: LQIPVSSSS (MAGC1_HUMAN)
LQIPVSSSW

SEQ ID NO: 71047 - protein, 10 aa, Artificial Sequence
  Description of Artificial Sequence: Synthetic peptide
  Seed: STFEGFAQSS (MAGC1_HUMAN)
SAFEGFAQSV

SEQ ID NO: 71048 - protein, 11 aa, Artificial Sequence
  Description of Artificial Sequence: Synthetic peptide
  Seed: SLSQSSPVSSF (MAGC1_HUMAN)
SVSQSSPVSSW

SEQ ID NO: 71049 - protein, 9 aa, Artificial Sequence
  Description of Artificial Sequence: Synthetic peptide
  Seed: IEILFGISL (MAGC1_HUMAN)
ITILFGISF

SEQ ID NO: 71050 - protein, 9 aa, Artificial Sequence
  Description of Artificial Sequence: Synthetic peptide
  Seed: SFPSSTSSS (MAGC1_HUMAN)
SIPSSTSSF

SEQ ID NO: 71051 - protein, 10 aa, Artificial Sequence
  Description of Artificial Sequence: Synthetic peptide
  Seed: SSFSSTLLSI (MAGC1_HUMAN)
SSFSSTLLSF

SEQ ID NO: 71052 - protein, 10 aa, Artificial Sequence
  Description of Artificial Sequence: Synthetic peptide
  Seed: SFFSYTLASL (MAGC1_HUMAN)
SIFSYTLASV

SEQ ID NO: 71053 - protein, 10 aa, Artificial Sequence
  Description of Artificial Sequence: Synthetic peptide
  Seed: SFPSSTSSSL (MAGC1_HUMAN)
SIPSSTSSSF

SEQ ID NO: 71054 - protein, 9 aa, Artificial Sequence
  Description of Artificial Sequence: Synthetic peptide
  Seed: KVWVQEHYL (MAGC1_HUMAN)
KVWVQEHYK

SEQ ID NO: 71055 - protein, 9 aa, Artificial Sequence
  Description of Artificial Sequence: Synthetic peptide
  Seed: FFSYTLASL (MAGC1_HUMAN)
FGSYTLASY

SEQ ID NO: 71056 - protein, 9 aa, Artificial Sequence
  Description of Artificial Sequence: Synthetic peptide
  Seed: EDSQSPLQI (MAGC1_HUMAN)
EESQSPLQA

SEQ ID NO: 71057 - protein, 9 aa, Artificial Sequence
  Description of Artificial Sequence: Synthetic peptide
  Seed: DSYVFVNTL (MAGC1_HUMAN)
DVYVFVNTW

SEQ ID NO: 71058 - protein, 10 aa, Artificial Sequence
  Description of Artificial Sequence: Synthetic peptide
  Seed: LAMLKNTVPI (MAGC1_HUMAN)
LSMLKNTVPI

SEQ ID NO: 71059 - protein, 10 aa, Artificial Sequence
  Description of Artificial Sequence: Synthetic peptide
  Seed: FFSYTLASLL (MAGC1_HUMAN)
FFSYTLASLY

SEQ ID NO: 71060 - protein, 9 aa, Artificial Sequence
  Description of Artificial Sequence: Synthetic peptide
  Seed: CSSSTSLSL (MAGC1_HUMAN)
CISSTSLSM

SEQ ID NO: 71061 - protein, 9 aa, Artificial Sequence
  Description of Artificial Sequence: Synthetic peptide
  Seed: RTHSTFEGF (MAGC1_HUMAN)
RYHSTFEGK

SEQ ID NO: 71062 - protein, 9 aa, Artificial Sequence
  Description of Artificial Sequence: Synthetic peptide
  Seed: NSSPPRYEF (MAGC1_HUMAN)
NASPPRYEI

SEQ ID NO: 71063 - protein, 10 aa, Artificial Sequence
  Description of Artificial Sequence: Synthetic peptide
  Seed: SVLQIPVSAA (MAGC1_HUMAN)
SMLQIPVSAM

SEQ ID NO: 71064 - protein, 9 aa, Artificial Sequence
  Description of Artificial Sequence: Synthetic peptide
  Seed: AQSPLQIPV (MAGC1_HUMAN)
AVSPLQIPY

SEQ ID NO: 71065 - protein, 9 aa, Artificial Sequence
  Description of Artificial Sequence: Synthetic peptide
  Seed: LQIPVSPSF (MAGC1_HUMAN)
LVIPVSPSF

SEQ ID NO: 71066 - protein, 9 aa, Artificial Sequence
  Description of Artificial Sequence: Synthetic peptide
  Seed: SSFFSYTLA (MAGC1_HUMAN)
STFFSYTLV

SEQ ID NO: 71067 - protein, 9 aa, Artificial Sequence
  Description of Artificial Sequence: Synthetic peptide
  Seed: AQSPLQRPV (MAGC1_HUMAN)
AASPLQRPF

SEQ ID NO: 71068 - protein, 11 aa, Artificial Sequence
  Description of Artificial Sequence: Synthetic peptide
  Seed: SLSQSSPVSSF (MAGC1_HUMAN)
SDSQSSPVSSF

SEQ ID NO: 71069 - protein, 10 aa, Artificial Sequence
  Description of Artificial Sequence: Synthetic peptide
  Seed: FFSSALLSIF (MAGC1_HUMAN)
FISSALLSIY

SEQ ID NO: 71070 - protein, 9 aa, Artificial Sequence
  Description of Artificial Sequence: Synthetic peptide
  Seed: TPSSLPQSF (MAGC1_HUMAN)
TTSSLPQSM

SEQ ID NO: 71071 - protein, 10 aa, Artificial Sequence
  Description of Artificial Sequence: Synthetic peptide
  Seed: VSPSFSSTLV (MAGC1_HUMAN)
VLPSFSSTLL

SEQ ID NO: 71072 - protein, 9 aa, Artificial Sequence
  Description of Artificial Sequence: Synthetic peptide
  Seed: SSLSQSSPV (MAGC1_HUMAN)
STLSQSSPY

SEQ ID NO: 71073 - protein, 11 aa, Artificial Sequence
  Description of Artificial Sequence: Synthetic peptide
  Seed: LQRPVSSFFSY (MAGC1_HUMAN)
LQRPVSSFFSF

SEQ ID NO: 71074 - protein, 9 aa, Artificial Sequence
  Description of Artificial Sequence: Synthetic peptide
  Seed: TLLSLFQSF (MAGC1_HUMAN)
TMLSLFQSI

SEQ ID NO: 71075 - protein, 9 aa, Artificial Sequence
  Description of Artificial Sequence: Synthetic peptide
  Seed: KAREFIEIL (MAGC1_HUMAN)
KAREFIEIY

SEQ ID NO: 71076 - protein, 9 aa, Artificial Sequence
  Description of Artificial Sequence: Synthetic peptide
  Seed: SPQSPPEGP (MAGC1_HUMAN)
SAQSPPEGL

SEQ ID NO: 71077 - protein, 8 aa, Artificial Sequence
  Description of Artificial Sequence: Synthetic peptide
  Seed: SPLQRPVS (MAGC1_HUMAN)
SPLQRPVM

SEQ ID NO: 71078 - protein, 9 aa, Artificial Sequence
  Description of Artificial Sequence: Synthetic peptide
  Seed: LQNPASSFF (MAGC1_HUMAN)
LQNPASSFL

SEQ ID NO: 71079 - protein, 9 aa, Artificial Sequence
  Description of Artificial Sequence: Synthetic peptide
  Seed: TTDDSTATE (MAGC1_HUMAN)
TFDDSTATY

SEQ ID NO: 71080 - protein, 10 aa, Artificial Sequence
  Description of Artificial Sequence: Synthetic peptide
  Seed: PLQIPVSRSF (MAGC1_HUMAN)
PKQIPVSRSF

SEQ ID NO: 71081 - protein, 11 aa, Artificial Sequence
  Description of Artificial Sequence: Synthetic peptide
  Seed: SSSFSYTLLSL (MAGC1_HUMAN)
SMSFSYTLLSW

SEQ ID NO: 71082 - protein, 11 aa, Artificial Sequence
  Description of Artificial Sequence: Synthetic peptide
  Seed: VSSSSSSSTLL (MAGC1_HUMAN)
VVSSSSSSTLF

SEQ ID NO: 71083 - protein, 10 aa, Artificial Sequence
  Description of Artificial Sequence: Synthetic peptide
  Seed: FSSTLVSLFQ (MAGC1_HUMAN)
FASTLVSLFW

SEQ ID NO: 71084 - protein, 11 aa, Artificial Sequence
  Description of Artificial Sequence: Synthetic peptide
  Seed: RSFSSTLLSIF (MAGC1_HUMAN)
RMFSSTLLSIL

SEQ ID NO: 71085 - protein, 9 aa, Artificial Sequence
  Description of Artificial Sequence: Synthetic peptide
  Seed: KVDELARFL (MAGC1_HUMAN)
KADELARFI

SEQ ID NO: 71086 - protein, 10 aa, Artificial Sequence
  Description of Artificial Sequence: Synthetic peptide
  Seed: KVVEFLAMLK (MAGC1_HUMAN)
KTVEFLAMLY

SEQ ID NO: 71087 - protein, 9 aa, Artificial Sequence
  Description of Artificial Sequence: Synthetic peptide
  Seed: SQSSPVSSF (MAGC1_HUMAN)
SGSSPVSSM

SEQ ID NO: 71088 - protein, 9 aa, Artificial Sequence
  Description of Artificial Sequence: Synthetic peptide
  Seed: TTDDSTATE (MAGC1_HUMAN)
TGDDSTATI

SEQ ID NO: 71089 - protein, 9 aa, Artificial Sequence
  Description of Artificial Sequence: Synthetic peptide
  Seed: LQIPVSPSF (MAGC1_HUMAN)
LAIPVSPSH

SEQ ID NO: 71090 - protein, 9 aa, Artificial Sequence
  Description of Artificial Sequence: Synthetic peptide
  Seed: YVFVNTLDL (MAGC1_HUMAN)
YYFVNTLDF

SEQ ID NO: 71091 - protein, 9 aa, Artificial Sequence
  Description of Artificial Sequence: Synthetic peptide
  Seed: SFSYTLLSL (MAGC1_HUMAN)
SASYTLLSM

SEQ ID NO: 71092 - protein, 10 aa, Artificial Sequence
  Description of Artificial Sequence: Synthetic peptide
  Seed: SFSYTLLSLF (MAGC1_HUMAN)
SMSYTLLSLM

SEQ ID NO: 71093 - protein, 9 aa, Artificial Sequence
  Description of Artificial Sequence: Synthetic peptide
  Seed: FSYTLASLL (MAGC1_HUMAN)
FTYTLASLF

SEQ ID NO: 71094 - protein, 10 aa, Artificial Sequence
  Description of Artificial Sequence: Synthetic peptide
  Seed: ASSFFSSALL (MAGC1_HUMAN)
AESFFSSALF

SEQ ID NO: 71095 - protein, 9 aa, Artificial Sequence
  Description of Artificial Sequence: Synthetic peptide
  Seed: LQSPVISFS (MAGC1_HUMAN)
LQSPVISFA

SEQ ID NO: 71096 - protein, 9 aa, Artificial Sequence
  Description of Artificial Sequence: Synthetic peptide
  Seed: RFLLLKYQV (MAGC1_HUMAN)
RYLLLKYQM

SEQ ID NO: 71097 - protein, 10 aa, Artificial Sequence
  Description of Artificial Sequence: Synthetic peptide
  Seed: MPTAGMPSLL (MAGC1_HUMAN)
MLTAGMPSLW

SEQ ID NO: 71098 - protein, 11 aa, Artificial Sequence
  Description of Artificial Sequence: Synthetic peptide
  Seed: STFEGFAQSSL (MAGC1_HUMAN)
SSFEGFAQSSY

SEQ ID NO: 71099 - protein, 9 aa, Artificial Sequence
  Description of Artificial Sequence: Synthetic peptide
  Seed: SFFSYTLAS (MAGC1_HUMAN)
SSFSYTLAY

SEQ ID NO: 71100 - protein, 9 aa, Artificial Sequence
  Description of Artificial Sequence: Synthetic peptide
  Seed: LQIPVSAAS (MAGC1_HUMAN)
LGIPVSAAY

SEQ ID NO: 71101 - protein, 10 aa, Artificial Sequence
  Description of Artificial Sequence: Synthetic peptide
  Seed: SSPERTHSTF (MAGC1_HUMAN)
SFPERTHSTF

SEQ ID NO: 71102 - protein, 10 aa, Artificial Sequence
  Description of Artificial Sequence: Synthetic peptide
  Seed: SPLQIPMTSS (MAGC1_HUMAN)
SPLQIPMTSM

SEQ ID NO: 71103 - protein, 10 aa, Artificial Sequence
  Description of Artificial Sequence: Synthetic peptide
  Seed: RAGREHFAFG (MAGC1_HUMAN)
RTGREHFAFG

SEQ ID NO: 71104 - protein, 8 aa, Artificial Sequence
  Description of Artificial Sequence: Synthetic peptide
  Seed: SSFFSYTL (MAGC1_HUMAN)
SSFFSYTW

SEQ ID NO: 71105 - protein, 11 aa, Artificial Sequence
  Description of Artificial Sequence: Synthetic peptide
  Seed: IPVSSSFSYTL (MAGC1_HUMAN)
IFVSSSFSYTW

SEQ ID NO: 71106 - protein, 11 aa, Artificial Sequence
  Description of Artificial Sequence: Synthetic peptide
  Seed: SSFSSTLLSIF (MAGC1_HUMAN)
SSFSSTLLSIM

SEQ ID NO: 71107 - protein, 9 aa, Artificial Sequence
  Description of Artificial Sequence: Synthetic peptide
  Seed: SSSDTLLES (MAGC1_HUMAN)
SISDTLLEY

SEQ ID NO: 71108 - protein, 9 aa, Artificial Sequence
  Description of Artificial Sequence: Synthetic peptide
  Seed: FPSSTSSSL (MAGC1_HUMAN)
FSSSTSSSM

SEQ ID NO: 71109 - protein, 9 aa, Artificial Sequence
  Description of Artificial Sequence: Synthetic peptide
  Seed: NSSPPRYEF (MAGC1_HUMAN)
NMSPPRYEW

SEQ ID NO: 71110 - protein, 10 aa, Artificial Sequence
  Description of Artificial Sequence: Synthetic peptide
  Seed: RTQSTFEGFA (MAGC1_HUMAN)
RSQSTFEGFK

SEQ ID NO: 71111 - protein, 11 aa, Artificial Sequence
  Description of Artificial Sequence: Synthetic peptide
  Seed: SPLQRPVSSFF (MAGC1_HUMAN)
SFLQRPVSSFF

SEQ ID NO: 71112 - protein, 10 aa, Artificial Sequence
  Description of Artificial Sequence: Synthetic peptide
  Seed: DVLSGIGVRA (MAGC1_HUMAN)
DVLSGIGVRK

SEQ ID NO: 71113 - protein, 9 aa, Artificial Sequence
  Description of Artificial Sequence: Synthetic peptide
  Seed: KDSLSPLEI (MAGC1_HUMAN)
KISLSPLEI

SEQ ID NO: 71114 - protein, 9 aa, Artificial Sequence
  Description of Artificial Sequence: Synthetic peptide
  Seed: ISRYTGYFP (MAGC1_HUMAN)
IFRYTGYFK

SEQ ID NO: 71115 - protein, 10 aa, Artificial Sequence
  Description of Artificial Sequence: Synthetic peptide
  Seed: LSQSSPVSSF (MAGC1_HUMAN)
LTQSSPVSSW

SEQ ID NO: 71116 - protein, 10 aa, Artificial Sequence
  Description of Artificial Sequence: Synthetic peptide
  Seed: FPQSVLQIPV (MAGC1_HUMAN)
FMQSVLQIPM

SEQ ID NO: 71117 - protein, 9 aa, Artificial Sequence
  Description of Artificial Sequence: Synthetic peptide
  Seed: KAREFIEIL (MAGC1_HUMAN)
KMREFIEIF

SEQ ID NO: 71118 - protein, 9 aa, Artificial Sequence
  Description of Artificial Sequence: Synthetic peptide
  Seed: STFEGFAQS (MAGC1_HUMAN)
SLFEGFAQI

SEQ ID NO: 71119 - protein, 9 aa, Artificial Sequence
  Description of Artificial Sequence: Synthetic peptide
  Seed: SLTDSESLI (MAGC1_HUMAN)
SQTDSESLF

SEQ ID NO: 71120 - protein, 9 aa, Artificial Sequence
  Description of Artificial Sequence: Synthetic peptide
  Seed: FAFGEPREL (MAGC1_HUMAN)
FVFGEPREM

SEQ ID NO: 71121 - protein, 9 aa, Artificial Sequence
  Description of Artificial Sequence: Synthetic peptide
  Seed: LQNPASSFF (MAGC1_HUMAN)
LQNPASSFY

SEQ ID NO: 71122 - protein, 10 aa, Artificial Sequence
  Description of Artificial Sequence: Synthetic peptide
  Seed: ISRYTGYFPV (MAGC1_HUMAN)
IGRYTGYFPI

SEQ ID NO: 71123 - protein, 9 aa, Artificial Sequence
  Description of Artificial Sequence: Synthetic peptide
  Seed: SVLQIPVSA (MAGC1_HUMAN)
STLQIPVSM

SEQ ID NO: 71124 - protein, 9 aa, Artificial Sequence
  Description of Artificial Sequence: Synthetic peptide
  Seed: MPTAGMPSL (MAGC1_HUMAN)
MQTAGMPSI

SEQ ID NO: 71125 - protein, 10 aa, Artificial Sequence
  Description of Artificial Sequence: Synthetic peptide
  Seed: LAMLKNTVPI (MAGC1_HUMAN)
LKMLKNTVPF

SEQ ID NO: 71126 - protein, 10 aa, Artificial Sequence
  Description of Artificial Sequence: Synthetic peptide
  Seed: FFSSALLSIF (MAGC1_HUMAN)
FQSSALLSIM

SEQ ID NO: 71127 - protein, 10 aa, Artificial Sequence
  Description of Artificial Sequence: Synthetic peptide
  Seed: SSPPRYEFLW (MAGC1_HUMAN)
SMPPRYEFLW

SEQ ID NO: 71128 - protein, 9 aa, Artificial Sequence
  Description of Artificial Sequence: Synthetic peptide
  Seed: TLLSLFQSF (MAGC1_HUMAN)
TYLSLFQSM

SEQ ID NO: 71129 - protein, 10 aa, Artificial Sequence
  Description of Artificial Sequence: Synthetic peptide
  Seed: RYTGYFPVIF (MAGC1_HUMAN)
RQTGYFPVIW

SEQ ID NO: 71130 - protein, 11 aa, Artificial Sequence
  Description of Artificial Sequence: Synthetic peptide
  Seed: EILFGISLREV (MAGC1_HUMAN)
ERLFGISLREV

SEQ ID NO: 71131 - protein, 9 aa, Artificial Sequence
  Description of Artificial Sequence: Synthetic peptide
  Seed: SPESAQSAF (MAGC1_HUMAN)
SPESAQSAY

SEQ ID NO: 71132 - protein, 9 aa, Artificial Sequence
  Description of Artificial Sequence: Synthetic peptide
  Seed: FSSTLLSLF (MAGC1_HUMAN)
FASTLLSLI

SEQ ID NO: 71133 - protein, 9 aa, Artificial Sequence
  Description of Artificial Sequence: Synthetic peptide
  Seed: VSPSSSSTL (MAGC1_HUMAN)
VAPSSSSTY

SEQ ID NO: 71134 - protein, 11 aa, Artificial Sequence
  Description of Artificial Sequence: Synthetic peptide
  Seed: IPVSSSFSYTL (MAGC1_HUMAN)
IKVSSSFSYTW

SEQ ID NO: 71135 - protein, 9 aa, Artificial Sequence
  Description of Artificial Sequence: Synthetic peptide
  Seed: QVKQPITKA (MAGC1_HUMAN)
QPKQPITKA

SEQ ID NO: 71136 - protein, 9 aa, Artificial Sequence
  Description of Artificial Sequence: Synthetic peptide
  Seed: ASSSTLVSI (MAGC1_HUMAN)
ASSSTLVSW

SEQ ID NO: 71137 - protein, 10 aa, Artificial Sequence
  Description of Artificial Sequence: Synthetic peptide
  Seed: LQIVPSLPEW (MAGC1_HUMAN)
LQIVPSLPEF

SEQ ID NO: 71138 - protein, 9 aa, Artificial Sequence
  Description of Artificial Sequence: Synthetic peptide
  Seed: MLKNTVPIT (MAGC1_HUMAN)
MIKNTVPIV

SEQ ID NO: 71139 - protein, 9 aa, Artificial Sequence
  Description of Artificial Sequence: Synthetic peptide
  Seed: LSDEQGMSQ (MAGC1_HUMAN)
LMDEQGMSM

SEQ ID NO: 71140 - protein, 10 aa, Artificial Sequence
  Description of Artificial Sequence: Synthetic peptide
  Seed: PLQIPMTSSF (MAGC1_HUMAN)
PYQIPMTSSM

SEQ ID NO: 71141 - protein, 10 aa, Artificial Sequence
  Description of Artificial Sequence: Synthetic peptide
  Seed: LLQIPMTSSF (MAGC1_HUMAN)
LLQIPMTSSY

SEQ ID NO: 71142 - protein, 10 aa, Artificial Sequence
  Description of Artificial Sequence: Synthetic peptide
  Seed: LQIPVSRSFS (MAGC1_HUMAN)
LLIPVSRSFF

SEQ ID NO: 71143 - protein, 10 aa, Artificial Sequence
  Description of Artificial Sequence: Synthetic peptide
  Seed: EMLTNVISRY (MAGC1_HUMAN)
EILTNVISRW

SEQ ID NO: 71144 - protein, 9 aa, Artificial Sequence
  Description of Artificial Sequence: Synthetic peptide
  Seed: FPQSPLQGE (MAGC1_HUMAN)
FPQSPLQGP

SEQ ID NO: 71145 - protein, 9 aa, Artificial Sequence
  Description of Artificial Sequence: Synthetic peptide
  Seed: LQIPVSPSF (MAGC1_HUMAN)
LYIPVSPSF

SEQ ID NO: 71146 - protein, 9 aa, Artificial Sequence
  Description of Artificial Sequence: Synthetic peptide
  Seed: TLASLLQSS (MAGC1_HUMAN)
TIASLLQSL

SEQ ID NO: 71147 - protein, 9 aa, Artificial Sequence
  Description of Artificial Sequence: Synthetic peptide
  Seed: NTVPITFPS (MAGC1_HUMAN)
NVVPITFPR

SEQ ID NO: 71148 - protein, 10 aa, Artificial Sequence
  Description of Artificial Sequence: Synthetic peptide
  Seed: EVIWDVLSGI (MAGC1_HUMAN)
EKIWDVLSGV

SEQ ID NO: 71149 - protein, 9 aa, Artificial Sequence
  Description of Artificial Sequence: Synthetic peptide
  Seed: IPMTSSFSS (MAGC1_HUMAN)
IPMTSSFSV

SEQ ID NO: 71150 - protein, 9 aa, Artificial Sequence
  Description of Artificial Sequence: Synthetic peptide
  Seed: AMLKNTVPI (MAGC1_HUMAN)
ARLKNTVPM

SEQ ID NO: 71151 - protein, 9 aa, Artificial Sequence
  Description of Artificial Sequence: Synthetic peptide
  Seed: REFIEILFG (MAGC1_HUMAN)
REFIEILFF

SEQ ID NO: 71152 - protein, 9 aa, Artificial Sequence
  Description of Artificial Sequence: Synthetic peptide
  Seed: LQIPVSRSF (MAGC1_HUMAN)
LSIPVSRSF

SEQ ID NO: 71153 - protein, 9 aa, Artificial Sequence
  Description of Artificial Sequence: Synthetic peptide
  Seed: FFSSALLSI (MAGC1_HUMAN)
FQSSALLSV

SEQ ID NO: 71154 - protein, 10 aa, Artificial Sequence
  Description of Artificial Sequence: Synthetic peptide
  Seed: SQSSPVSSFP (MAGC1_HUMAN)
SLSSPVSSFY

SEQ ID NO: 71155 - protein, 9 aa, Artificial Sequence
  Description of Artificial Sequence: Synthetic peptide
  Seed: VSSFFSYTL (MAGC1_HUMAN)
VTSFFSYTI

SEQ ID NO: 71156 - protein, 9 aa, Artificial Sequence
  Description of Artificial Sequence: Synthetic peptide
  Seed: FFSYTLASL (MAGC1_HUMAN)
FSSYTLASV

SEQ ID NO: 71157 - protein, 9 aa, Artificial Sequence
  Description of Artificial Sequence: Synthetic peptide
  Seed: RAHSEVIKR (MAGC1_HUMAN)
RLHSEVIKH

SEQ ID NO: 71158 - protein, 10 aa, Artificial Sequence
  Description of Artificial Sequence: Synthetic peptide
  Seed: FFSYTLASLL (MAGC1_HUMAN)
FRSYTLASLW

SEQ ID NO: 71159 - protein, 9 aa, Artificial Sequence
  Description of Artificial Sequence: Synthetic peptide
  Seed: SPLQSPVSS (MAGC1_HUMAN)
SPLQSPVSA

SEQ ID NO: 71160 - protein, 10 aa, Artificial Sequence
  Description of Artificial Sequence: Synthetic peptide
  Seed: KGTYASEEVI (MAGC1_HUMAN)
KLTYASEEVY

SEQ ID NO: 71161 - protein, 10 aa, Artificial Sequence
  Description of Artificial Sequence: Synthetic peptide
  Seed: RSFSSTLLSI (MAGC1_HUMAN)
REFSSTLLSL

SEQ ID NO: 71162 - protein, 10 aa, Artificial Sequence
  Description of Artificial Sequence: Synthetic peptide
  Seed: SFSSTLVSLF (MAGC1_HUMAN)
SISSTLVSLW

SEQ ID NO: 71163 - protein, 9 aa, Artificial Sequence
  Description of Artificial Sequence: Synthetic peptide
  Seed: VSSFFSYTL (MAGC1_HUMAN)
VSSFFSYTV

SEQ ID NO: 71164 - protein, 10 aa, Artificial Sequence
  Description of Artificial Sequence: Synthetic peptide
  Seed: FFSYTLASLL (MAGC1_HUMAN)
FKSYTLASLY

SEQ ID NO: 71165 - protein, 10 aa, Artificial Sequence
  Description of Artificial Sequence: Synthetic peptide
  Seed: MTSSFSSTLL (MAGC1_HUMAN)
MRSSFSSTLM

SEQ ID NO: 71166 - protein, 10 aa, Artificial Sequence
  Description of Artificial Sequence: Synthetic peptide
  Seed: SRYTGYFPVI (MAGC1_HUMAN)
SDYTGYFPVW

SEQ ID NO: 71167 - protein, 9 aa, Artificial Sequence
  Description of Artificial Sequence: Synthetic peptide
  Seed: AQSSLQIPV (MAGC1_HUMAN)
AVSSLQIPL

SEQ ID NO: 71168 - protein, 9 aa, Artificial Sequence
  Description of Artificial Sequence: Synthetic peptide
  Seed: VQSPLHSPQ (MAGC1_HUMAN)
VMSPLHSPY

SEQ ID NO: 71169 - protein, 9 aa, Artificial Sequence
  Description of Artificial Sequence: Synthetic peptide
  Seed: MTSSFSSTL (MAGC1_HUMAN)
MKSSFSSTI

SEQ ID NO: 71170 - protein, 9 aa, Artificial Sequence
  Description of Artificial Sequence: Synthetic peptide
  Seed: SLFQSFSER (MAGC1_HUMAN)
SLFQSFSEF

SEQ ID NO: 71171 - protein, 10 aa, Artificial Sequence
  Description of Artificial Sequence: Synthetic peptide
  Seed: YTLASLLQSS (MAGC1_HUMAN)
YGLASLLQSA

SEQ ID NO: 71172 - protein, 9 aa, Artificial Sequence
  Description of Artificial Sequence: Synthetic peptide
  Seed: FLAMLKNTV (MAGC1_HUMAN)
FMAMLKNTL

SEQ ID NO: 71173 - protein, 10 aa, Artificial Sequence
  Description of Artificial Sequence: Synthetic peptide
  Seed: YTGYFPVIFR (MAGC1_HUMAN)
YEGYFPVIFR

SEQ ID NO: 71174 - protein, 9 aa, Artificial Sequence
  Description of Artificial Sequence: Synthetic peptide
  Seed: GSPSFSSTL (MAGC1_HUMAN)
GFPSFSSTM

SEQ ID NO: 71175 - protein, 10 aa, Artificial Sequence
  Description of Artificial Sequence: Synthetic peptide
  Seed: IEILFGISLR (MAGC1_HUMAN)
IMILFGISLR

SEQ ID NO: 71176 - protein, 9 aa, Artificial Sequence
  Description of Artificial Sequence: Synthetic peptide
  Seed: FTYTLDEKV (MAGC1_HUMAN)
FAYTLDEKW

SEQ ID NO: 71177 - protein, 11 aa, Artificial Sequence
  Description of Artificial Sequence: Synthetic peptide
  Seed: MSPLYFPQSPL (MAGC1_HUMAN)
MKPLYFPQSPV

SEQ ID NO: 71178 - protein, 10 aa, Artificial Sequence
  Description of Artificial Sequence: Synthetic peptide
  Seed: VSSSFSYTLL (MAGC1_HUMAN)
VASSFSYTLF

SEQ ID NO: 71179 - protein, 9 aa, Artificial Sequence
  Description of Artificial Sequence: Synthetic peptide
  Seed: LQIPVSSSS (MAGC1_HUMAN)
LEIPVSSSV

SEQ ID NO: 71180 - protein, 9 aa, Artificial Sequence
  Description of Artificial Sequence: Synthetic peptide
  Seed: LQIPGSPSF (MAGC1_HUMAN)
LVIPGSPSI

SEQ ID NO: 71181 - protein, 10 aa, Artificial Sequence
  Description of Artificial Sequence: Synthetic peptide
  Seed: LLQIPMTSSF (MAGC1_HUMAN)
LCQIPMTSSW

SEQ ID NO: 71182 - protein, 9 aa, Artificial Sequence
  Description of Artificial Sequence: Synthetic peptide
  Seed: ESPLQSPVI (MAGC1_HUMAN)
EAPLQSPVL

SEQ ID NO: 71183 - protein, 9 aa, Artificial Sequence
  Description of Artificial Sequence: Synthetic peptide
  Seed: SSSTSLSPF (MAGC1_HUMAN)
SVSTSLSPM

SEQ ID NO: 71184 - protein, 9 aa, Artificial Sequence
  Description of Artificial Sequence: Synthetic peptide
  Seed: FSYTLASLL (MAGC1_HUMAN)
FMYTLASLT

SEQ ID NO: 71185 - protein, 11 aa, Artificial Sequence
  Description of Artificial Sequence: Synthetic peptide
  Seed: FIKGTYASEEV (MAGC1_HUMAN)
FMKGTYASEEL

SEQ ID NO: 71186 - protein, 9 aa, Artificial Sequence
  Description of Artificial Sequence: Synthetic peptide
  Seed: AGREHFAFG (MAGC1_HUMAN)
AYREHFAFK

SEQ ID NO: 71187 - protein, 9 aa, Artificial Sequence
  Description of Artificial Sequence: Synthetic peptide
  Seed: SLIESEPLF (MAGC1_HUMAN)
SKIESEPLM

SEQ ID NO: 71188 - protein, 9 aa, Artificial Sequence
  Description of Artificial Sequence: Synthetic peptide
  Seed: AMLKNTVPI (MAGC1_HUMAN)
AMLKNTVPY

SEQ ID NO: 71189 - protein, 9 aa, Artificial Sequence
  Description of Artificial Sequence: Synthetic peptide
  Seed: VISRYTGYF (MAGC1_HUMAN)
VFSRYTGYY

SEQ ID NO: 71190 - protein, 8 aa, Artificial Sequence
  Description of Artificial Sequence: Synthetic peptide
  Seed: LQSPVISF (MAGC1_HUMAN)
LQSPVISM

SEQ ID NO: 71191 - protein, 9 aa, Artificial Sequence
  Description of Artificial Sequence: Synthetic peptide
  Seed: LQSPVISFS (MAGC1_HUMAN)
LLSPVISFT

SEQ ID NO: 71192 - protein, 9 aa, Artificial Sequence
  Description of Artificial Sequence: Synthetic peptide
  Seed: TLVSIFQSS (MAGC1_HUMAN)
TVVSIFQSV

SEQ ID NO: 71193 - protein, 9 aa, Artificial Sequence
  Description of Artificial Sequence: Synthetic peptide
  Seed: YVFVNTLDL (MAGC1_HUMAN)
YSFVNTLDM

SEQ ID NO: 71194 - protein, 9 aa, Artificial Sequence
  Description of Artificial Sequence: Synthetic peptide
  Seed: YQVKQPITK (MAGC1_HUMAN)
YRVKQPITM

SEQ ID NO: 71195 - protein, 10 aa, Artificial Sequence
  Description of Artificial Sequence: Synthetic peptide
  Seed: YASEEVIWDV (MAGC1_HUMAN)
YMSEEVIWDM

SEQ ID NO: 71196 - protein, 9 aa, Artificial Sequence
  Description of Artificial Sequence: Synthetic peptide
  Seed: EGDDTQSPL (MAGC1_HUMAN)
EWDDTQSPL

SEQ ID NO: 71197 - protein, 10 aa, Artificial Sequence
  Description of Artificial Sequence: Synthetic peptide
  Seed: MPTAGMPSLL (MAGC1_HUMAN)
MFTAGMPSLI

SEQ ID NO: 71198 - protein, 9 aa, Artificial Sequence
  Description of Artificial Sequence: Synthetic peptide
  Seed: LQIVPSLPE (MAGC1_HUMAN)
LKIVPSLPI

SEQ ID NO: 71199 - protein, 11 aa, Artificial Sequence
  Description of Artificial Sequence: Synthetic peptide
  Seed: IIDTTDDSTAT (MAGC1_HUMAN)
ILDTTDDSTAI

SEQ ID NO: 71200 - protein, 9 aa, Artificial Sequence
  Description of Artificial Sequence: Synthetic peptide
  Seed: SSPEGKDSL (MAGC1_HUMAN)
SLPEGKDSI

SEQ ID NO: 71201 - protein, 9 aa, Artificial Sequence
  Description of Artificial Sequence: Synthetic peptide
  Seed: FPQSVLQIP (MAGC1_HUMAN)
FPQSVLQIV

SEQ ID NO: 71202 - protein, 10 aa, Artificial Sequence
  Description of Artificial Sequence: Synthetic peptide
  Seed: EVPNSSPPRY (MAGC1_HUMAN)
ETPNSSPPRK

SEQ ID NO: 71203 - protein, 9 aa, Artificial Sequence
  Description of Artificial Sequence: Synthetic peptide
  Seed: IFRKAREFI (MAGC1_HUMAN)
IIRKAREFK

SEQ ID NO: 71204 - protein, 10 aa, Artificial Sequence
  Description of Artificial Sequence: Synthetic peptide
  Seed: MTSSFSSTLL (MAGC1_HUMAN)
MLSSFSSTLK

SEQ ID NO: 71205 - protein, 9 aa, Artificial Sequence
  Description of Artificial Sequence: Synthetic peptide
  Seed: ASSSTLVSI (MAGC1_HUMAN)
ATSSTLVSW

SEQ ID NO: 71206 - protein, 9 aa, Artificial Sequence
  Description of Artificial Sequence: Synthetic peptide
  Seed: SSHESPQSP (MAGC1_HUMAN)
SNHESPQSY

SEQ ID NO: 71207 - protein, 9 aa, Artificial Sequence
  Description of Artificial Sequence: Synthetic peptide
  Seed: FPSSTSSSL (MAGC1_HUMAN)
FISSTSSSW

SEQ ID NO: 71208 - protein, 10 aa, Artificial Sequence
  Description of Artificial Sequence: Synthetic peptide
  Seed: LQIPMTSSFS (MAGC1_HUMAN)
LMIPMTSSFK

SEQ ID NO: 71209 - protein, 9 aa, Artificial Sequence
  Description of Artificial Sequence: Synthetic peptide
  Seed: SSPESPLQS (MAGC1_HUMAN)
SQPESPLQL

SEQ ID NO: 71210 - protein, 9 aa, Artificial Sequence
  Description of Artificial Sequence: Synthetic peptide
  Seed: MGDKDMPTA (MAGC1_HUMAN)
MTDKDMPTM

SEQ ID NO: 71211 - protein, 9 aa, Artificial Sequence
  Description of Artificial Sequence: Synthetic peptide
  Seed: FAFGEPREL (MAGC1_HUMAN)
FSFGEPREY

SEQ ID NO: 71212 - protein, 9 aa, Artificial Sequence
  Description of Artificial Sequence: Synthetic peptide
  Seed: SLIESEPLF (MAGC1_HUMAN)
SAIESEPLL

SEQ ID NO: 71213 - protein, 10 aa, Artificial Sequence
  Description of Artificial Sequence: Synthetic peptide
  Seed: FFSSALLSIF (MAGC1_HUMAN)
FRSSALLSIF

SEQ ID NO: 71214 - protein, 9 aa, Artificial Sequence
  Description of Artificial Sequence: Synthetic peptide
  Seed: SLTDSESLI (MAGC1_HUMAN)
SVTDSESLL

SEQ ID NO: 71215 - protein, 10 aa, Artificial Sequence
  Description of Artificial Sequence: Synthetic peptide
  Seed: ITKAEMLTNV (MAGC1_HUMAN)
ILKAEMLTNA

SEQ ID NO: 71216 - protein, 10 aa, Artificial Sequence
  Description of Artificial Sequence: Synthetic peptide
  Seed: LSQSSPVSSF (MAGC1_HUMAN)
LVQSSPVSSF

SEQ ID NO: 71217 - protein, 11 aa, Artificial Sequence
  Description of Artificial Sequence: Synthetic peptide
  Seed: SESLIESEPLF (MAGC1_HUMAN)
SESLIESEPLW

SEQ ID NO: 71218 - protein, 9 aa, Artificial Sequence
  Description of Artificial Sequence: Synthetic peptide
  Seed: SSPESPLQS (MAGC1_HUMAN)
SGPESPLQI

SEQ ID NO: 71219 - protein, 10 aa, Artificial Sequence
  Description of Artificial Sequence: Synthetic peptide
  Seed: QRPVSSFFSY (MAGC1_HUMAN)
QFPVSSFFSY

SEQ ID NO: 71220 - protein, 10 aa, Artificial Sequence
  Description of Artificial Sequence: Synthetic peptide
  Seed: SPVSSFPSST (MAGC1_HUMAN)
SPVSSFPSSV

SEQ ID NO: 71221 - protein, 10 aa, Artificial Sequence
  Description of Artificial Sequence: Synthetic peptide
  Seed: VISFSSSTSL (MAGC1_HUMAN)
VQSFSSSTSM

SEQ ID NO: 71222 - protein, 10 aa, Artificial Sequence
  Description of Artificial Sequence: Synthetic peptide
  Seed: YTLASLLQSS (MAGC1_HUMAN)
YCLASLLQSM

SEQ ID NO: 71223 - protein, 9 aa, Artificial Sequence
  Description of Artificial Sequence: Synthetic peptide
  Seed: KDSQSPLQI (MAGC1_HUMAN)
KRSQSPLQL

SEQ ID NO: 71224 - protein, 9 aa, Artificial Sequence
  Description of Artificial Sequence: Synthetic peptide
  Seed: ISFSSSTSL (MAGC1_HUMAN)
IGFSSSTSY

SEQ ID NO: 71225 - protein, 10 aa, Artificial Sequence
  Description of Artificial Sequence: Synthetic peptide
  Seed: FAQSSLQIPV (MAGC1_HUMAN)
FFQSSLQIPI

SEQ ID NO: 71226 - protein, 8 aa, Artificial Sequence
  Description of Artificial Sequence: Synthetic peptide
  Seed: FSSTLLSL (MAGC1_HUMAN)
FTSTLLSL

SEQ ID NO: 71227 - protein, 9 aa, Artificial Sequence
  Description of Artificial Sequence: Synthetic peptide
  Seed: QVKQPITKA (MAGC1_HUMAN)
QPKQPITKF

SEQ ID NO: 71228 - protein, 9 aa, Artificial Sequence
  Description of Artificial Sequence: Synthetic peptide
  Seed: VSSFFSYTL (MAGC1_HUMAN)
VRSFFSYTY

SEQ ID NO: 71229 - protein, 9 aa, Artificial Sequence
  Description of Artificial Sequence: Synthetic peptide
  Seed: GTYASEEVI (MAGC1_HUMAN)
GMYASEEVW

SEQ ID NO: 71230 - protein, 9 aa, Artificial Sequence
  Description of Artificial Sequence: Synthetic peptide
  Seed: LQIPVSAAS (MAGC1_HUMAN)
LYIPVSAAF

SEQ ID NO: 71231 - protein, 9 aa, Artificial Sequence
  Description of Artificial Sequence: Synthetic peptide
  Seed: SSPERTHST (MAGC1_HUMAN)
SYPERTHSV

SEQ ID NO: 71232 - protein, 9 aa, Artificial Sequence
  Description of Artificial Sequence: Synthetic peptide
  Seed: FAFGEPREL (MAGC1_HUMAN)
FIFGEPREV

SEQ ID NO: 71233 - protein, 9 aa, Artificial Sequence
  Description of Artificial Sequence: Synthetic peptide
  Seed: SPLEGEDSL (MAGC1_HUMAN)
SQLEGEDSY

SEQ ID NO: 71234 - protein, 9 aa, Artificial Sequence
  Description of Artificial Sequence: Synthetic peptide
  Seed: AGREHFAFG (MAGC1_HUMAN)
AVREHFAFG

SEQ ID NO: 71235 - protein, 10 aa, Artificial Sequence
  Description of Artificial Sequence: Synthetic peptide
  Seed: FAQSSLQIPV (MAGC1_HUMAN)
FNQSSLQIPV

SEQ ID NO: 71236 - protein, 10 aa, Artificial Sequence
  Description of Artificial Sequence: Synthetic peptide
  Seed: LQRPVSSFFS (MAGC1_HUMAN)
LQRPVSSFFF

SEQ ID NO: 71237 - protein, 10 aa, Artificial Sequence
  Description of Artificial Sequence: Synthetic peptide
  Seed: ICSSSTPSSL (MAGC1_HUMAN)
IASSSTPSSF

SEQ ID NO: 71238 - protein, 9 aa, Artificial Sequence
  Description of Artificial Sequence: Synthetic peptide
  Seed: SSPPRYEFL (MAGC1_HUMAN)
SMPPRYEFW

SEQ ID NO: 71239 - protein, 9 aa, Artificial Sequence
  Description of Artificial Sequence: Synthetic peptide
  Seed: KAREFIEIL (MAGC1_HUMAN)
KTREFIEII

SEQ ID NO: 71240 - protein, 9 aa, Artificial Sequence
  Description of Artificial Sequence: Synthetic peptide
  Seed: VSSSFSYTL (MAGC1_HUMAN)
VMSSFSYTW

SEQ ID NO: 71241 - protein, 10 aa, Artificial Sequence
  Description of Artificial Sequence: Synthetic peptide
  Seed: RAGREHFAFG (MAGC1_HUMAN)
RAGREHFAFL

SEQ ID NO: 71242 - protein, 9 aa, Artificial Sequence
  Description of Artificial Sequence: Synthetic peptide
  Seed: RKVVEFLAM (MAGC1_HUMAN)
RTVVEFLAF

SEQ ID NO: 71243 - protein, 10 aa, Artificial Sequence
  Description of Artificial Sequence: Synthetic peptide
  Seed: FPQSLLQIPM (MAGC1_HUMAN)
FGQSLLQIPF

SEQ ID NO: 71244 - protein, 10 aa, Artificial Sequence
  Description of Artificial Sequence: Synthetic peptide
  Seed: TGYFPVIFRK (MAGC1_HUMAN)
TEYFPVIFRR

SEQ ID NO: 71245 - protein, 9 aa, Artificial Sequence
  Description of Artificial Sequence: Synthetic peptide
  Seed: SLFQSFSER (MAGC1_HUMAN)
SIFQSFSEY

SEQ ID NO: 71246 - protein, 10 aa, Artificial Sequence
  Description of Artificial Sequence: Synthetic peptide
  Seed: MTSSFSSTLL (MAGC1_HUMAN)
MNSSFSSTLV

SEQ ID NO: 71247 - protein, 9 aa, Artificial Sequence
  Description of Artificial Sequence: Synthetic peptide
  Seed: RLLILILSI (MAGC1_HUMAN)
RILILILSF

SEQ ID NO: 71248 - protein, 9 aa, Artificial Sequence
  Description of Artificial Sequence: Synthetic peptide
  Seed: EDSQSPLQI (MAGC1_HUMAN)
EESQSPLQP

SEQ ID NO: 71249 - protein, 9 aa, Artificial Sequence
  Description of Artificial Sequence: Synthetic peptide
  Seed: RLLILILSI (MAGC1_HUMAN)
RLLILILSA

SEQ ID NO: 71250 - protein, 10 aa, Artificial Sequence
  Description of Artificial Sequence: Synthetic peptide
  Seed: FQSSLQSPVS (MAGC1_HUMAN)
FMSSLQSPVP

SEQ ID NO: 71251 - protein, 10 aa, Artificial Sequence
  Description of Artificial Sequence: Synthetic peptide
  Seed: TLDEKVDELA (MAGC1_HUMAN)
TLDEKVDELV

SEQ ID NO: 71252 - protein, 9 aa, Artificial Sequence
  Description of Artificial Sequence: Synthetic peptide
  Seed: ASEEVIWDV (MAGC1_HUMAN)
AMEEVIWDA

SEQ ID NO: 71253 - protein, 11 aa, Artificial Sequence
  Description of Artificial Sequence: Synthetic peptide
  Seed: SQSSPEGKDSL (MAGC1_HUMAN)
SQSSPEGKDSF

SEQ ID NO: 71254 - protein, 9 aa, Artificial Sequence
  Description of Artificial Sequence: Synthetic peptide
  Seed: TLLSIFQSS (MAGC1_HUMAN)
TILSIFQSL

SEQ ID NO: 71255 - protein, 9 aa, Artificial Sequence
  Description of Artificial Sequence: Synthetic peptide
  Seed: ILILSIIFI (MAGC1_HUMAN)
IMILSIIFI

SEQ ID NO: 71256 - protein, 9 aa, Artificial Sequence
  Description of Artificial Sequence: Synthetic peptide
  Seed: LSPLHFPQF (MAGC1_HUMAN)
LQPLHFPQI

SEQ ID NO: 71257 - protein, 9 aa, Artificial Sequence
  Description of Artificial Sequence: Synthetic peptide
  Seed: KVDELARFL (MAGC1_HUMAN)
KLDELARFV

SEQ ID NO: 71258 - protein, 11 aa, Artificial Sequence
  Description of Artificial Sequence: Synthetic peptide
  Seed: FLAMLKNTVPI (MAGC1_HUMAN)
FFAMLKNTVPA

SEQ ID NO: 71259 - protein, 10 aa, Artificial Sequence
  Description of Artificial Sequence: Synthetic peptide
  Seed: VSPSFSSTLV (MAGC1_HUMAN)
VIPSFSSTLV

SEQ ID NO: 71260 - protein, 10 aa, Artificial Sequence
  Description of Artificial Sequence: Synthetic peptide
  Seed: FPQSLLQIPM (MAGC1_HUMAN)
FCQSLLQIPY

SEQ ID NO: 71261 - protein, 9 aa, Artificial Sequence
  Description of Artificial Sequence: Synthetic peptide
  Seed: GEDSLSPHY (MAGC1_HUMAN)
GTDSLSPHY

SEQ ID NO: 71262 - protein, 10 aa, Artificial Sequence
  Description of Artificial Sequence: Synthetic peptide
  Seed: FFSSALLSIF (MAGC1_HUMAN)
FDSSALLSIF

SEQ ID NO: 71263 - protein, 9 aa, Artificial Sequence
  Description of Artificial Sequence: Synthetic peptide
  Seed: ASSFFSSAL (MAGC1_HUMAN)
AQSFFSSAI

SEQ ID NO: 71264 - protein, 11 aa, Artificial Sequence
  Description of Artificial Sequence: Synthetic peptide
  Seed: AMLKNTVPITF (MAGC1_HUMAN)
ASLKNTVPITY

SEQ ID NO: 71265 - protein, 9 aa, Artificial Sequence
  Description of Artificial Sequence: Synthetic peptide
  Seed: RTHSTFEGF (MAGC1_HUMAN)
RMHSTFEGL

SEQ ID NO: 71266 - protein, 9 aa, Artificial Sequence
  Description of Artificial Sequence: Synthetic peptide
  Seed: SKSSPESPL (MAGC1_HUMAN)
SMSSPESPY

SEQ ID NO: 71267 - protein, 9 aa, Artificial Sequence
  Description of Artificial Sequence: Synthetic peptide
  Seed: TGYFPVIFR (MAGC1_HUMAN)
TLYFPVIFK

SEQ ID NO: 71268 - protein, 10 aa, Artificial Sequence
  Description of Artificial Sequence: Synthetic peptide
  Seed: TTDDSTATES (MAGC1_HUMAN)
TGDDSTATEI

SEQ ID NO: 71269 - protein, 9 aa, Artificial Sequence
  Description of Artificial Sequence: Synthetic peptide
  Seed: STQSPFEGF (MAGC1_HUMAN)
SIQSPFEGY

SEQ ID NO: 71270 - protein, 9 aa, Artificial Sequence
  Description of Artificial Sequence: Synthetic peptide
  Seed: VLSGIGVRA (MAGC1_HUMAN)
VLSGIGVRL

SEQ ID NO: 71271 - protein, 9 aa, Artificial Sequence
  Description of Artificial Sequence: Synthetic peptide
  Seed: FLAMLKNTV (MAGC1_HUMAN)
FAAMLKNTF

SEQ ID NO: 71272 - protein, 9 aa, Artificial Sequence
  Description of Artificial Sequence: Synthetic peptide
  Seed: SSFFSSALL (MAGC1_HUMAN)
SRFFSSALF

SEQ ID NO: 71273 - protein, 9 aa, Artificial Sequence
  Description of Artificial Sequence: Synthetic peptide
  Seed: AQSPLQIPV (MAGC1_HUMAN)
AMSPLQIPA

SEQ ID NO: 71274 - protein, 11 aa, Artificial Sequence
  Description of Artificial Sequence: Synthetic peptide
  Seed: SPLQRPVSSFF (MAGC1_HUMAN)
SELQRPVSSFY

SEQ ID NO: 71275 - protein, 9 aa, Artificial Sequence
  Description of Artificial Sequence: Synthetic peptide
  Seed: IEILFGISL (MAGC1_HUMAN)
IQILFGISL

SEQ ID NO: 71276 - protein, 11 aa, Artificial Sequence
  Description of Artificial Sequence: Synthetic peptide
  Seed: TLDEKVDELAR (MAGC1_HUMAN)
TSDEKVDELAL

SEQ ID NO: 71277 - protein, 9 aa, Artificial Sequence
  Description of Artificial Sequence: Synthetic peptide
  Seed: ASSSTLVSI (MAGC1_HUMAN)
AASSTLVSI

SEQ ID NO: 71278 - protein, 9 aa, Artificial Sequence
  Description of Artificial Sequence: Synthetic peptide
  Seed: TKVWVQEHY (MAGC1_HUMAN)
TRVWVQEHF

SEQ ID NO: 71279 - protein, 9 aa, Artificial Sequence
  Description of Artificial Sequence: Synthetic peptide
  Seed: SIFQSSPER (MAGC1_HUMAN)
STFQSSPEK

SEQ ID NO: 71280 - protein, 9 aa, Artificial Sequence
  Description of Artificial Sequence: Synthetic peptide
  Seed: AQSPLQIPV (MAGC1_HUMAN)
ALSPLQIPF

SEQ ID NO: 71281 - protein, 9 aa, Artificial Sequence
  Description of Artificial Sequence: Synthetic peptide
  Seed: TESASSSVM (MAGC1_HUMAN)
TESASSSVF

SEQ ID NO: 71282 - protein, 10 aa, Artificial Sequence
  Description of Artificial Sequence: Synthetic peptide
  Seed: SSSSSTLLSL (MAGC1_HUMAN)
SCSSSTLLSF

SEQ ID NO: 71283 - protein, 10 aa, Artificial Sequence
  Description of Artificial Sequence: Synthetic peptide
  Seed: SSSSSTLLSL (MAGC1_HUMAN)
SLSSSTLLSM

SEQ ID NO: 71284 - protein, 10 aa, Artificial Sequence
  Description of Artificial Sequence: Synthetic peptide
  Seed: RAGREHFAFG (MAGC1_HUMAN)
RIGREHFAFR

SEQ ID NO: 71285 - protein, 9 aa, Artificial Sequence
  Description of Artificial Sequence: Synthetic peptide
  Seed: TPSSLPQSF (MAGC1_HUMAN)
TPSSLPQSV

SEQ ID NO: 71286 - protein, 9 aa, Artificial Sequence
  Description of Artificial Sequence: Synthetic peptide
  Seed: SPLQIPQSS (MAGC1_HUMAN)
SALQIPQSL

SEQ ID NO: 71287 - protein, 9 aa, Artificial Sequence
  Description of Artificial Sequence: Synthetic peptide
  Seed: RKAREFIEI (MAGC1_HUMAN)
REAREFIEY

SEQ ID NO: 71288 - protein, 11 aa, Artificial Sequence
  Description of Artificial Sequence: Synthetic peptide
  Seed: AASSSTLVSIF (MAGC1_HUMAN)
AMSSSTLVSIF

SEQ ID NO: 71289 - protein, 9 aa, Artificial Sequence
  Description of Artificial Sequence: Synthetic peptide
  Seed: HFPQSPPEW (MAGC1_HUMAN)
HIPQSPPEL

SEQ ID NO: 71290 - protein, 10 aa, Artificial Sequence
  Description of Artificial Sequence: Synthetic peptide
  Seed: LQIPGSPSFS (MAGC1_HUMAN)
LIIPGSPSFF

SEQ ID NO: 71291 - protein, 9 aa, Artificial Sequence
  Description of Artificial Sequence: Synthetic peptide
  Seed: LSPLHFPQF (MAGC1_HUMAN)
LFPLHFPQI

SEQ ID NO: 71292 - protein, 9 aa, Artificial Sequence
  Description of Artificial Sequence: Synthetic peptide
  Seed: WVQEHYLEY (MAGC1_HUMAN)
WVQEHYLEL

SEQ ID NO: 71293 - protein, 11 aa, Artificial Sequence
  Description of Artificial Sequence: Synthetic peptide
  Seed: SFFSYTLASLL (MAGC1_HUMAN)
SYFSYTLASLF

SEQ ID NO: 71294 - protein, 10 aa, Artificial Sequence
  Description of Artificial Sequence: Synthetic peptide
  Seed: TGYFPVIFRK (MAGC1_HUMAN)
TLYFPVIFRK

SEQ ID NO: 71295 - protein, 11 aa, Artificial Sequence
  Description of Artificial Sequence: Synthetic peptide
  Seed: FLAMLKNTVPI (MAGC1_HUMAN)
FIAMLKNTVPV

SEQ ID NO: 71296 - protein, 10 aa, Artificial Sequence
  Description of Artificial Sequence: Synthetic peptide
  Seed: LQIPVSPSFS (MAGC1_HUMAN)
LQIPVSPSFI

SEQ ID NO: 71297 - protein, 9 aa, Artificial Sequence
  Description of Artificial Sequence: Synthetic peptide
  Seed: VIKRKVVEF (MAGC1_HUMAN)
VTKRKVVEY

SEQ ID NO: 71298 - protein, 10 aa, Artificial Sequence
  Description of Artificial Sequence: Synthetic peptide
  Seed: YTLASLLQSS (MAGC1_HUMAN)
YDLASLLQSL

SEQ ID NO: 71299 - protein, 10 aa, Artificial Sequence
  Description of Artificial Sequence: Synthetic peptide
  Seed: STPSSLPQSF (MAGC1_HUMAN)
SLPSSLPQSM

SEQ ID NO: 71300 - protein, 9 aa, Artificial Sequence
  Description of Artificial Sequence: Synthetic peptide
  Seed: SSSSSSSTL (MAGC1_HUMAN)
SLSSSSSTV

SEQ ID NO: 71301 - protein, 9 aa, Artificial Sequence
  Description of Artificial Sequence: Synthetic peptide
  Seed: FSSTLLSLF (MAGC1_HUMAN)
FASTLLSLF

SEQ ID NO: 71302 - protein, 11 aa, Artificial Sequence
  Description of Artificial Sequence: Synthetic peptide
  Seed: SPLQIPVSRSF (MAGC1_HUMAN)
SPLQIPVSRSA

SEQ ID NO: 71303 - protein, 9 aa, Artificial Sequence
  Description of Artificial Sequence: Synthetic peptide
  Seed: YTLASLLQS (MAGC1_HUMAN)
YMLASLLQI

SEQ ID NO: 71304 - protein, 10 aa, Artificial Sequence
  Description of Artificial Sequence: Synthetic peptide
  Seed: MTSSFSSTLL (MAGC1_HUMAN)
MVSSFSSTLV

SEQ ID NO: 71305 - protein, 9 aa, Artificial Sequence
  Description of Artificial Sequence: Synthetic peptide
  Seed: SFSSTLVSL (MAGC1_HUMAN)
SVSSTLVSY

SEQ ID NO: 71306 - protein, 10 aa, Artificial Sequence
  Description of Artificial Sequence: Synthetic peptide
  Seed: ATESASSSVM (MAGC1_HUMAN)
AVESASSSVW

SEQ ID NO: 71307 - protein, 9 aa, Artificial Sequence
  Description of Artificial Sequence: Synthetic peptide
  Seed: TPSSLPQSF (MAGC1_HUMAN)
TPSSLPQST

SEQ ID NO: 71308 - protein, 9 aa, Artificial Sequence
  Description of Artificial Sequence: Synthetic peptide
  Seed: FSSALLSIF (MAGC1_HUMAN)
FRSALLSIF

SEQ ID NO: 71309 - protein, 11 aa, Artificial Sequence
  Description of Artificial Sequence: Synthetic peptide
  Seed: IPVSRSFSSTL (MAGC1_HUMAN)
IKVSRSFSSTY

SEQ ID NO: 71310 - protein, 10 aa, Artificial Sequence
  Description of Artificial Sequence: Synthetic peptide
  Seed: PLQIPMTSSF (MAGC1_HUMAN)
PSQIPMTSSF

SEQ ID NO: 71311 - protein, 11 aa, Artificial Sequence
  Description of Artificial Sequence: Synthetic peptide
  Seed: TTDDSTATESA (MAGC1_HUMAN)
TTDDSTATESM

SEQ ID NO: 71312 - protein, 9 aa, Artificial Sequence
  Description of Artificial Sequence: Synthetic peptide
  Seed: TLDEKVDEL (MAGC1_HUMAN)
TRDEKVDEM

SEQ ID NO: 71313 - protein, 9 aa, Artificial Sequence
  Description of Artificial Sequence: Synthetic peptide
  Seed: FLWGPRAHS (MAGC1_HUMAN)
FIWGPRAHA

SEQ ID NO: 71314 - protein, 9 aa, Artificial Sequence
  Description of Artificial Sequence: Synthetic peptide
  Seed: STQSPFEGF (MAGC1_HUMAN)
SFQSPFEGF

SEQ ID NO: 71315 - protein, 9 aa, Artificial Sequence
  Description of Artificial Sequence: Synthetic peptide
  Seed: VPITFPSSY (MAGC1_HUMAN)
VEITFPSSY

SEQ ID NO: 71316 - protein, 9 aa, Artificial Sequence
  Description of Artificial Sequence: Synthetic peptide
  Seed: IPVSPSFSS (MAGC1_HUMAN)
IVVSPSFSM

SEQ ID NO: 71317 - protein, 10 aa, Artificial Sequence
  Description of Artificial Sequence: Synthetic peptide
  Seed: SSPERTQSTF (MAGC1_HUMAN)
SVPERTQSTY

SEQ ID NO: 71318 - protein, 9 aa, Artificial Sequence
  Description of Artificial Sequence: Synthetic peptide
  Seed: RAHSEVIKR (MAGC1_HUMAN)
RFHSEVIKY

SEQ ID NO: 71319 - protein, 9 aa, Artificial Sequence
  Description of Artificial Sequence: Synthetic peptide
  Seed: FSYTLLSLF (MAGC1_HUMAN)
FAYTLLSLA

SEQ ID NO: 71320 - protein, 9 aa, Artificial Sequence
  Description of Artificial Sequence: Synthetic peptide
  Seed: ASSSTLVSI (MAGC1_HUMAN)
AISSTLVSY

SEQ ID NO: 71321 - protein, 11 aa, Artificial Sequence
  Description of Artificial Sequence: Synthetic peptide
  Seed: IPVSSSSSSTL (MAGC1_HUMAN)
IMVSSSSSSTW

SEQ ID NO: 71322 - protein, 10 aa, Artificial Sequence
  Description of Artificial Sequence: Synthetic peptide
  Seed: STFEGFPQSL (MAGC1_HUMAN)
SPFEGFPQSI

SEQ ID NO: 71323 - protein, 9 aa, Artificial Sequence
  Description of Artificial Sequence: Synthetic peptide
  Seed: MTSSFSSTL (MAGC1_HUMAN)
MWSSFSSTL

SEQ ID NO: 71324 - protein, 9 aa, Artificial Sequence
  Description of Artificial Sequence: Synthetic peptide
  Seed: SSPEGKDSL (MAGC1_HUMAN)
SYPEGKDSF

SEQ ID NO: 71325 - protein, 8 aa, Artificial Sequence
  Description of Artificial Sequence: Synthetic peptide
  Seed: SFFSSALL (MAGC1_HUMAN)
SFFSSALF

SEQ ID NO: 71326 - protein, 9 aa, Artificial Sequence
  Description of Artificial Sequence: Synthetic peptide
  Seed: SQSPPEGPV (MAGC1_HUMAN)
SLSPPEGPL

SEQ ID NO: 71327 - protein, 9 aa, Artificial Sequence
  Description of Artificial Sequence: Synthetic peptide
  Seed: FFSYTLASL (MAGC1_HUMAN)
FMSYTLASF

SEQ ID NO: 71328 - protein, 10 aa, Artificial Sequence
  Description of Artificial Sequence: Synthetic peptide
  Seed: REFIEILFGI (MAGC1_HUMAN)
RQFIEILFGF

SEQ ID NO: 71329 - protein, 10 aa, Artificial Sequence
  Description of Artificial Sequence: Synthetic peptide
  Seed: YTLASLLQSS (MAGC1_HUMAN)
YDLASLLQST

SEQ ID NO: 71330 - protein, 9 aa, Artificial Sequence
  Description of Artificial Sequence: Synthetic peptide
  Seed: SSLSQSSPV (MAGC1_HUMAN)
SALSQSSPY

SEQ ID NO: 71331 - protein, 8 aa, Artificial Sequence
  Description of Artificial Sequence: Synthetic peptide
  Seed: AEMLTNVI (MAGC1_HUMAN)
AEMLTNVM

SEQ ID NO: 71332 - protein, 10 aa, Artificial Sequence
  Description of Artificial Sequence: Synthetic peptide
  Seed: RAGREHFAFG (MAGC1_HUMAN)
RYGREHFAFS

SEQ ID NO: 71333 - protein, 10 aa, Artificial Sequence
  Description of Artificial Sequence: Synthetic peptide
  Seed: SFPSSTSSSL (MAGC1_HUMAN)
SKPSSTSSSV

SEQ ID NO: 71334 - protein, 11 aa, Artificial Sequence
  Description of Artificial Sequence: Synthetic peptide
  Seed: IIDTTDDSTAT (MAGC1_HUMAN)
IIDTTDDSTAM

SEQ ID NO: 71335 - protein, 9 aa, Artificial Sequence
  Description of Artificial Sequence: Synthetic peptide
  Seed: FFSYTLASL (MAGC1_HUMAN)
FMSYTLASG

SEQ ID NO: 71336 - protein, 9 aa, Artificial Sequence
  Description of Artificial Sequence: Synthetic peptide
  Seed: GEDVQSPLQ (MAGC1_HUMAN)
GEDVQSPLV

SEQ ID NO: 71337 - protein, 10 aa, Artificial Sequence
  Description of Artificial Sequence: Synthetic peptide
  Seed: ESAQSTFEGF (MAGC1_HUMAN)
ELAQSTFEGR

SEQ ID NO: 71338 - protein, 9 aa, Artificial Sequence
  Description of Artificial Sequence: Synthetic peptide
  Seed: AGREHFAFG (MAGC1_HUMAN)
ATREHFAFL

SEQ ID NO: 71339 - protein, 10 aa, Artificial Sequence
  Description of Artificial Sequence: Synthetic peptide
  Seed: WGPRAHSEVI (MAGC1_HUMAN)
WFPRAHSEVL

SEQ ID NO: 71340 - protein, 9 aa, Artificial Sequence
  Description of Artificial Sequence: Synthetic peptide
  Seed: LQIPVSRSF (MAGC1_HUMAN)
LYIPVSRSM

SEQ ID NO: 71341 - protein, 10 aa, Artificial Sequence
  Description of Artificial Sequence: Synthetic peptide
  Seed: FFSYTLASLL (MAGC1_HUMAN)
FLSYTLASLL

SEQ ID NO: 71342 - protein, 11 aa, Artificial Sequence
  Description of Artificial Sequence: Synthetic peptide
  Seed: KRKVVEFLAML (MAGC1_HUMAN)
KSKVVEFLAMV

SEQ ID NO: 71343 - protein, 11 aa, Artificial Sequence
  Description of Artificial Sequence: Synthetic peptide
  Seed: LQIPMTSSFSS (MAGC1_HUMAN)
LQIPMTSSFSM

SEQ ID NO: 71344 - protein, 9 aa, Artificial Sequence
  Description of Artificial Sequence: Synthetic peptide
  Seed: SLIESEPLF (MAGC1_HUMAN)
SQIESEPLI

SEQ ID NO: 71345 - protein, 8 aa, Artificial Sequence
  Description of Artificial Sequence: Synthetic peptide
  Seed: LQSPVSSF (MAGC1_HUMAN)
LKSPVSSF

SEQ ID NO: 71346 - protein, 11 aa, Artificial Sequence
  Description of Artificial Sequence: Synthetic peptide
  Seed: SPLQIPVSPSS (MAGC1_HUMAN)
STLQIPVSPSF

SEQ ID NO: 71347 - protein, 10 aa, Artificial Sequence
  Description of Artificial Sequence: Synthetic peptide
  Seed: SLFQSSPECT (MAGC1_HUMAN)
SMFQSSPECI

SEQ ID NO: 71348 - protein, 11 aa, Artificial Sequence
  Description of Artificial Sequence: Synthetic peptide
  Seed: SSTPSSLPQSF (MAGC1_HUMAN)
SMTPSSLPQSW

SEQ ID NO: 71349 - protein, 11 aa, Artificial Sequence
  Description of Artificial Sequence: Synthetic peptide
  Seed: IPVSAASSSTL (MAGC1_HUMAN)
IMVSAASSSTW

SEQ ID NO: 71350 - protein, 9 aa, Artificial Sequence
  Description of Artificial Sequence: Synthetic peptide
  Seed: KVDELARFL (MAGC1_HUMAN)
KSDELARFI

SEQ ID NO: 71351 - protein, 9 aa, Artificial Sequence
  Description of Artificial Sequence: Synthetic peptide
  Seed: NSSPPRYEF (MAGC1_HUMAN)
NRSPPRYEM

SEQ ID NO: 71352 - protein, 9 aa, Artificial Sequence
  Description of Artificial Sequence: Synthetic peptide
  Seed: SSSTSLSPF (MAGC1_HUMAN)
SESTSLSPY

SEQ ID NO: 71353 - protein, 10 aa, Artificial Sequence
  Description of Artificial Sequence: Synthetic peptide
  Seed: PLQIPGSPSF (MAGC1_HUMAN)
PAQIPGSPSF

SEQ ID NO: 71354 - protein, 10 aa, Artificial Sequence
  Description of Artificial Sequence: Synthetic peptide
  Seed: SPVISFSSST (MAGC1_HUMAN)
SPVISFSSSM

SEQ ID NO: 71355 - protein, 11 aa, Artificial Sequence
  Description of Artificial Sequence: Synthetic peptide
  Seed: IPVSSSSSSTL (MAGC1_HUMAN)
IQVSSSSSSTF

SEQ ID NO: 71356 - protein, 9 aa, Artificial Sequence
  Description of Artificial Sequence: Synthetic peptide
  Seed: VQSPLQNPA (MAGC1_HUMAN)
VMSPLQNPA

SEQ ID NO: 71357 - protein, 10 aa, Artificial Sequence
  Description of Artificial Sequence: Synthetic peptide
  Seed: SLQIPVSPSF (MAGC1_HUMAN)
SMQIPVSPSY

SEQ ID NO: 71358 - protein, 10 aa, Artificial Sequence
  Description of Artificial Sequence: Synthetic peptide
  Seed: KVVEFLAMLK (MAGC1_HUMAN)
KRVEFLAMLR

SEQ ID NO: 71359 - protein, 8 aa, Artificial Sequence
  Description of Artificial Sequence: Synthetic peptide
  Seed: FIEILFGI (MAGC1_HUMAN)
FVEILFGV

SEQ ID NO: 71360 - protein, 9 aa, Artificial Sequence
  Description of Artificial Sequence: Synthetic peptide
  Seed: IEILFGISL (MAGC1_HUMAN)
IRILFGISF

SEQ ID NO: 71361 - protein, 8 aa, Artificial Sequence
  Description of Artificial Sequence: Synthetic peptide
  Seed: SSSTLLSL (MAGC1_HUMAN)
SQSTLLSI

SEQ ID NO: 71362 - protein, 10 aa, Artificial Sequence
  Description of Artificial Sequence: Synthetic peptide
  Seed: SPHYFPQSPP (MAGC1_HUMAN)
SPHYFPQSPA

SEQ ID NO: 71363 - protein, 11 aa, Artificial Sequence
  Description of Artificial Sequence: Synthetic peptide
  Seed: RYTGYFPVIFR (MAGC1_HUMAN)
RMTGYFPVIFK

SEQ ID NO: 71364 - protein, 9 aa, Artificial Sequence
  Description of Artificial Sequence: Synthetic peptide
  Seed: GENTHSPLQ (MAGC1_HUMAN)
GENTHSPLC

SEQ ID NO: 71365 - protein, 9 aa, Artificial Sequence
  Description of Artificial Sequence: Synthetic peptide
  Seed: SSSFSYTLL (MAGC1_HUMAN)
SGSFSYTLW

SEQ ID NO: 71366 - protein, 10 aa, Artificial Sequence
  Description of Artificial Sequence: Synthetic peptide
  Seed: EMLTNVISRY (MAGC1_HUMAN)
ETLTNVISRK

SEQ ID NO: 71367 - protein, 10 aa, Artificial Sequence
  Description of Artificial Sequence: Synthetic peptide
  Seed: RKAREFIEIL (MAGC1_HUMAN)
RHAREFIEIY

SEQ ID NO: 71368 - protein, 9 aa, Artificial Sequence
  Description of Artificial Sequence: Synthetic peptide
  Seed: YVFVNTLDL (MAGC1_HUMAN)
YYFVNTLDL

SEQ ID NO: 71369 - protein, 9 aa, Artificial Sequence
  Description of Artificial Sequence: Synthetic peptide
  Seed: RTQSTFEGF (MAGC1_HUMAN)
RQQSTFEGV

SEQ ID NO: 71370 - protein, 11 aa, Artificial Sequence
  Description of Artificial Sequence: Synthetic peptide
  Seed: FLAMLKNTVPI (MAGC1_HUMAN)
FSAMLKNTVPV

SEQ ID NO: 71371 - protein, 9 aa, Artificial Sequence
  Description of Artificial Sequence: Synthetic peptide
  Seed: LLSLFQSFS (MAGC1_HUMAN)
LISLFQSFV

SEQ ID NO: 71372 - protein, 9 aa, Artificial Sequence
  Description of Artificial Sequence: Synthetic peptide
  Seed: ASSFFSSAL (MAGC1_HUMAN)
AYSFFSSAY

SEQ ID NO: 71373 - protein, 11 aa, Artificial Sequence
  Description of Artificial Sequence: Synthetic peptide
  Seed: LQIPVSSSFSY (MAGC1_HUMAN)
LMIPVSSSFSF

SEQ ID NO: 71374 - protein, 9 aa, Artificial Sequence
  Description of Artificial Sequence: Synthetic peptide
  Seed: AQSPLQIPV (MAGC1_HUMAN)
ASSPLQIPM

SEQ ID NO: 71375 - protein, 10 aa, Artificial Sequence
  Description of Artificial Sequence: Synthetic peptide
  Seed: SFSYTLLSLF (MAGC1_HUMAN)
SYSYTLLSLF

SEQ ID NO: 71376 - protein, 9 aa, Artificial Sequence
  Description of Artificial Sequence: Synthetic peptide
  Seed: LKNTVPITF (MAGC1_HUMAN)
LQNTVPITL

SEQ ID NO: 71377 - protein, 8 aa, Artificial Sequence
  Description of Artificial Sequence: Synthetic peptide
  Seed: QIPGSPSF (MAGC1_HUMAN)
QMPGSPSY

SEQ ID NO: 71378 - protein, 10 aa, Artificial Sequence
  Description of Artificial Sequence: Synthetic peptide
  Seed: LQIPGSPSFS (MAGC1_HUMAN)
LAIPGSPSFY

SEQ ID NO: 71379 - protein, 9 aa, Artificial Sequence
  Description of Artificial Sequence: Synthetic peptide
  Seed: VPNSSPPRY (MAGC1_HUMAN)
VVNSSPPRY

SEQ ID NO: 71380 - protein, 9 aa, Artificial Sequence
  Description of Artificial Sequence: Synthetic peptide
  Seed: RAHSEVIKR (MAGC1_HUMAN)
RFHSEVIKK

SEQ ID NO: 71381 - protein, 10 aa, Artificial Sequence
  Description of Artificial Sequence: Synthetic peptide
  Seed: RSFSSTLLSI (MAGC1_HUMAN)
RWFSSTLLSW

SEQ ID NO: 71382 - protein, 9 aa, Artificial Sequence
  Description of Artificial Sequence: Synthetic peptide
  Seed: SPQSPPEGP (MAGC1_HUMAN)
SPQSPPEGY

SEQ ID NO: 71383 - protein, 10 aa, Artificial Sequence
  Description of Artificial Sequence: Synthetic peptide
  Seed: FPQSLLQIPM (MAGC1_HUMAN)
FPQSLLQIPA

SEQ ID NO: 71384 - protein, 9 aa, Artificial Sequence
  Description of Artificial Sequence: Synthetic peptide
  Seed: STFEGFPQS (MAGC1_HUMAN)
SVFEGFPQM

SEQ ID NO: 71385 - protein, 9 aa, Artificial Sequence
  Description of Artificial Sequence: Synthetic peptide
  Seed: VSPSFSSTL (MAGC1_HUMAN)
VFPSFSSTF

SEQ ID NO: 71386 - protein, 11 aa, Artificial Sequence
  Description of Artificial Sequence: Synthetic peptide
  Seed: SSFPSSTSSSL (MAGC1_HUMAN)
SAFPSSTSSSW

SEQ ID NO: 71387 - protein, 10 aa, Artificial Sequence
  Description of Artificial Sequence: Synthetic peptide
  Seed: VISFSSSTSL (MAGC1_HUMAN)
VKSFSSSTSM

SEQ ID NO: 71388 - protein, 9 aa, Artificial Sequence
  Description of Artificial Sequence: Synthetic peptide
  Seed: RTHSTFEGF (MAGC1_HUMAN)
RTHSTFEGM

SEQ ID NO: 71389 - protein, 9 aa, Artificial Sequence
  Description of Artificial Sequence: Synthetic peptide
  Seed: SPECTQSTF (MAGC1_HUMAN)
SPECTQSTL

SEQ ID NO: 71390 - protein, 11 aa, Artificial Sequence
  Description of Artificial Sequence: Synthetic peptide
  Seed: SLSQSSPVSSF (MAGC1_HUMAN)
SSSQSSPVSSW

SEQ ID NO: 71391 - protein, 9 aa, Artificial Sequence
  Description of Artificial Sequence: Synthetic peptide
  Seed: KDVEERAQA (MAGC1_HUMAN)
KEVEERAQP

SEQ ID NO: 71392 - protein, 9 aa, Artificial Sequence
  Description of Artificial Sequence: Synthetic peptide
  Seed: MSQNRLLIL (MAGC1_HUMAN)
MGQNRLLIL

SEQ ID NO: 71393 - protein, 11 aa, Artificial Sequence
  Description of Artificial Sequence: Synthetic peptide
  Seed: AMLKNTVPITF (MAGC1_HUMAN)
ATLKNTVPITW

SEQ ID NO: 71394 - protein, 9 aa, Artificial Sequence
  Description of Artificial Sequence: Synthetic peptide
  Seed: LQIPVSAAS (MAGC1_HUMAN)
LQIPVSAAA

SEQ ID NO: 71395 - protein, 9 aa, Artificial Sequence
  Description of Artificial Sequence: Synthetic peptide
  Seed: RKVVEFLAM (MAGC1_HUMAN)
RAVVEFLAY

SEQ ID NO: 71396 - protein, 9 aa, Artificial Sequence
  Description of Artificial Sequence: Synthetic peptide
  Seed: VSPSFSSTL (MAGC1_HUMAN)
VWPSFSSTV

SEQ ID NO: 71397 - protein, 9 aa, Artificial Sequence
  Description of Artificial Sequence: Synthetic peptide
  Seed: SFPSSTSSS (MAGC1_HUMAN)
SYPSSTSSW

SEQ ID NO: 71398 - protein, 11 aa, Artificial Sequence
  Description of Artificial Sequence: Synthetic peptide
  Seed: ILFGISLREVD (MAGC1_HUMAN)
IMFGISLREVA

SEQ ID NO: 71399 - protein, 10 aa, Artificial Sequence
  Description of Artificial Sequence: Synthetic peptide
  Seed: LQIPVSRSFS (MAGC1_HUMAN)
LQIPVSRSFV

SEQ ID NO: 71400 - protein, 9 aa, Artificial Sequence
  Description of Artificial Sequence: Synthetic peptide
  Seed: NSSPPRYEF (MAGC1_HUMAN)
NMSPPRYEY

SEQ ID NO: 71401 - protein, 11 aa, Artificial Sequence
  Description of Artificial Sequence: Synthetic peptide
  Seed: SRYTGYFPVIF (MAGC1_HUMAN)
SFYTGYFPVIF

SEQ ID NO: 71402 - protein, 9 aa, Artificial Sequence
  Description of Artificial Sequence: Synthetic peptide
  Seed: SQNRLLILI (MAGC1_HUMAN)
SHNRLLILM

SEQ ID NO: 71403 - protein, 9 aa, Artificial Sequence
  Description of Artificial Sequence: Synthetic peptide
  Seed: SFSSTLVSL (MAGC1_HUMAN)
SLSSTLVSL

SEQ ID NO: 71404 - protein, 10 aa, Artificial Sequence
  Description of Artificial Sequence: Synthetic peptide
  Seed: RSFSSTLLSI (MAGC1_HUMAN)
RFFSSTLLSK

SEQ ID NO: 71405 - protein, 10 aa, Artificial Sequence
  Description of Artificial Sequence: Synthetic peptide
  Seed: SFSSTLLSIL (MAGC1_HUMAN)
SQSSTLLSIY

SEQ ID NO: 71406 - protein, 9 aa, Artificial Sequence
  Description of Artificial Sequence: Synthetic peptide
  Seed: LQNPASSFF (MAGC1_HUMAN)
LLNPASSFL

SEQ ID NO: 71407 - protein, 9 aa, Artificial Sequence
  Description of Artificial Sequence: Synthetic peptide
  Seed: IPVSSSFSY (MAGC1_HUMAN)
IQVSSSFSI

SEQ ID NO: 71408 - protein, 10 aa, Artificial Sequence
  Description of Artificial Sequence: Synthetic peptide
  Seed: SSPERTHSTF (MAGC1_HUMAN)
SLPERTHSTL

SEQ ID NO: 71409 - protein, 10 aa, Artificial Sequence
  Description of Artificial Sequence: Synthetic peptide
  Seed: ASSFFSSALL (MAGC1_HUMAN)
AWSFFSSALM

SEQ ID NO: 71410 - protein, 10 aa, Artificial Sequence
  Description of Artificial Sequence: Synthetic peptide
  Seed: FFSYTLASLL (MAGC1_HUMAN)
FKSYTLASLF

SEQ ID NO: 71411 - protein, 11 aa, Artificial Sequence
  Description of Artificial Sequence: Synthetic peptide
  Seed: SPLQNPASSFF (MAGC1_HUMAN)
STLQNPASSFF

SEQ ID NO: 71412 - protein, 10 aa, Artificial Sequence
  Description of Artificial Sequence: Synthetic peptide
  Seed: LLQIPMTSSF (MAGC1_HUMAN)
LMQIPMTSSY

SEQ ID NO: 71413 - protein, 11 aa, Artificial Sequence
  Description of Artificial Sequence: Synthetic peptide
  Seed: SPLQIPMTSSF (MAGC1_HUMAN)
SALQIPMTSSF

SEQ ID NO: 71414 - protein, 9 aa, Artificial Sequence
  Description of Artificial Sequence: Synthetic peptide
  Seed: IEILFGISL (MAGC1_HUMAN)
IHILFGISV

SEQ ID NO: 71415 - protein, 9 aa, Artificial Sequence
  Description of Artificial Sequence: Synthetic peptide
  Seed: SPLQSPESA (MAGC1_HUMAN)
SHLQSPESL

SEQ ID NO: 71416 - protein, 10 aa, Artificial Sequence
  Description of Artificial Sequence: Synthetic peptide
  Seed: FFSSALLSIF (MAGC1_HUMAN)
FQSSALLSIW

SEQ ID NO: 71417 - protein, 9 aa, Artificial Sequence
  Description of Artificial Sequence: Synthetic peptide
  Seed: AQSPLQRPV (MAGC1_HUMAN)
AVSPLQRPI

SEQ ID NO: 71418 - protein, 11 aa, Artificial Sequence
  Description of Artificial Sequence: Synthetic peptide
  Seed: IKRKVVEFLAM (MAGC1_HUMAN)
IQRKVVEFLAF

SEQ ID NO: 71419 - protein, 9 aa, Artificial Sequence
  Description of Artificial Sequence: Synthetic peptide
  Seed: FFSSALLSI (MAGC1_HUMAN)
FASSALLSA

SEQ ID NO: 71420 - protein, 10 aa, Artificial Sequence
  Description of Artificial Sequence: Synthetic peptide
  Seed: LQIPGSPSFS (MAGC1_HUMAN)
LRIPGSPSFY

SEQ ID NO: 71421 - protein, 10 aa, Artificial Sequence
  Description of Artificial Sequence: Synthetic peptide
  Seed: TGYFPVIFRK (MAGC1_HUMAN)
TKYFPVIFRR

SEQ ID NO: 71422 - protein, 9 aa, Artificial Sequence
  Description of Artificial Sequence: Synthetic peptide
  Seed: AGREHFAFG (MAGC1_HUMAN)
AFREHFAFI

SEQ ID NO: 71423 - protein, 9 aa, Artificial Sequence
  Description of Artificial Sequence: Synthetic peptide
  Seed: TLLSIFQSS (MAGC1_HUMAN)
TILSIFQSM

SEQ ID NO: 71424 - protein, 11 aa, Artificial Sequence
  Description of Artificial Sequence: Synthetic peptide
  Seed: IPGSPSFSSTL (MAGC1_HUMAN)
IPGSPSFSSTA

SEQ ID NO: 71425 - protein, 9 aa, Artificial Sequence
  Description of Artificial Sequence: Synthetic peptide
  Seed: LQNPASSFF (MAGC1_HUMAN)
LYNPASSFF

SEQ ID NO: 71426 - protein, 11 aa, Artificial Sequence
  Description of Artificial Sequence: Synthetic peptide
  Seed: LQIPVSSSFSY (MAGC1_HUMAN)
LTIPVSSSFSY

SEQ ID NO: 71427 - protein, 9 aa, Artificial Sequence
  Description of Artificial Sequence: Synthetic peptide
  Seed: VSAASSSTL (MAGC1_HUMAN)
VWAASSSTM

SEQ ID NO: 71428 - protein, 9 aa, Artificial Sequence
  Description of Artificial Sequence: Synthetic peptide
  Seed: TLLSLFQSF (MAGC1_HUMAN)
TILSLFQSR

SEQ ID NO: 71429 - protein, 10 aa, Artificial Sequence
  Description of Artificial Sequence: Synthetic peptide
  Seed: REVDPDDSYV (MAGC1_HUMAN)
RQVDPDDSYM

SEQ ID NO: 71430 - protein, 10 aa, Artificial Sequence
  Description of Artificial Sequence: Synthetic peptide
  Seed: SSSSSTLLSL (MAGC1_HUMAN)
SWSSSTLLSW

SEQ ID NO: 71431 - protein, 9 aa, Artificial Sequence
  Description of Artificial Sequence: Synthetic peptide
  Seed: FSSTLLSIL (MAGC1_HUMAN)
FVSTLLSIY

SEQ ID NO: 71432 - protein, 9 aa, Artificial Sequence
  Description of Artificial Sequence: Synthetic peptide
  Seed: KVVEFLAML (MAGC1_HUMAN)
KAVEFLAMK

SEQ ID NO: 71433 - protein, 10 aa, Artificial Sequence
  Description of Artificial Sequence: Synthetic peptide
  Seed: TTDDSTATES (MAGC1_HUMAN)
TIDDSTATEL

SEQ ID NO: 71434 - protein, 9 aa, Artificial Sequence
  Description of Artificial Sequence: Synthetic peptide
  Seed: GYFPVIFRK (MAGC1_HUMAN)
GSFPVIFRF

SEQ ID NO: 71435 - protein, 9 aa, Artificial Sequence
  Description of Artificial Sequence: Synthetic peptide
  Seed: DSYVFVNTL (MAGC1_HUMAN)
DSYVFVNTI

SEQ ID NO: 71436 - protein, 9 aa, Artificial Sequence
  Description of Artificial Sequence: Synthetic peptide
  Seed: FSSTLLSLF (MAGC1_HUMAN)
FASTLLSLH

SEQ ID NO: 71437 - protein, 9 aa, Artificial Sequence
  Description of Artificial Sequence: Synthetic peptide
  Seed: WVQEHYLEY (MAGC1_HUMAN)
WMQEHYLEF

SEQ ID NO: 71438 - protein, 9 aa, Artificial Sequence
  Description of Artificial Sequence: Synthetic peptide
  Seed: MTSSFSSTL (MAGC1_HUMAN)
MMSSFSSTR

SEQ ID NO: 71439 - protein, 10 aa, Artificial Sequence
  Description of Artificial Sequence: Synthetic peptide
  Seed: YTLASLLQSS (MAGC1_HUMAN)
YRLASLLQSL

SEQ ID NO: 71440 - protein, 11 aa, Artificial Sequence
  Description of Artificial Sequence: Synthetic peptide
  Seed: SQSSPEGKDSL (MAGC1_HUMAN)
SHSSPEGKDSF

SEQ ID NO: 71441 - protein, 9 aa, Artificial Sequence
  Description of Artificial Sequence: Synthetic peptide
  Seed: SKSSPESPL (MAGC1_HUMAN)
SSSSPESPY

SEQ ID NO: 71442 - protein, 9 aa, Artificial Sequence
  Description of Artificial Sequence: Synthetic peptide
  Seed: ESDDTLYPL (MAGC1_HUMAN)
EVDDTLYPL

SEQ ID NO: 71443 - protein, 9 aa, Artificial Sequence
  Description of Artificial Sequence: Synthetic peptide
  Seed: WGPRAHSEV (MAGC1_HUMAN)
WSPRAHSEM

SEQ ID NO: 71444 - protein, 10 aa, Artificial Sequence
  Description of Artificial Sequence: Synthetic peptide
  Seed: VISFSSSTSL (MAGC1_HUMAN)
VGSFSSSTSF

SEQ ID NO: 71445 - protein, 9 aa, Artificial Sequence
  Description of Artificial Sequence: Synthetic peptide
  Seed: FSSTLLSLF (MAGC1_HUMAN)
FTSTLLSLW

SEQ ID NO: 71446 - protein, 10 aa, Artificial Sequence
  Description of Artificial Sequence: Synthetic peptide
  Seed: MLTNVISRYT (MAGC1_HUMAN)
MLTNVISRYL

SEQ ID NO: 71447 - protein, 9 aa, Artificial Sequence
  Description of Artificial Sequence: Synthetic peptide
  Seed: STQSPFEGF (MAGC1_HUMAN)
SQQSPFEGI

SEQ ID NO: 71448 - protein, 11 aa, Artificial Sequence
  Description of Artificial Sequence: Synthetic peptide
  Seed: SPFEGFPQSVL (MAGC1_HUMAN)
SAFEGFPQSVY

SEQ ID NO: 71449 - protein, 9 aa, Artificial Sequence
  Description of Artificial Sequence: Synthetic peptide
  Seed: MSQNRLLIL (MAGC1_HUMAN)
MMQNRLLIF

SEQ ID NO: 71450 - protein, 9 aa, Artificial Sequence
  Description of Artificial Sequence: Synthetic peptide
  Seed: SSSTSLSPF (MAGC1_HUMAN)
SASTSLSPL

SEQ ID NO: 71451 - protein, 9 aa, Artificial Sequence
  Description of Artificial Sequence: Synthetic peptide
  Seed: FFSYTLASL (MAGC1_HUMAN)
FISYTLASF

SEQ ID NO: 71452 - protein, 9 aa, Artificial Sequence
  Description of Artificial Sequence: Synthetic peptide
  Seed: TLDEKVDEL (MAGC1_HUMAN)
TVDEKVDEY

SEQ ID NO: 71453 - protein, 9 aa, Artificial Sequence
  Description of Artificial Sequence: Synthetic peptide
  Seed: KVVEFLAML (MAGC1_HUMAN)
KAVEFLAML

SEQ ID NO: 71454 - protein, 9 aa, Artificial Sequence
  Description of Artificial Sequence: Synthetic peptide
  Seed: DSYVFVNTL (MAGC1_HUMAN)
DAYVFVNTI

SEQ ID NO: 71455 - protein, 10 aa, Artificial Sequence
  Description of Artificial Sequence: Synthetic peptide
  Seed: SSPERTHSTF (MAGC1_HUMAN)
SAPERTHSTL

SEQ ID NO: 71456 - protein, 9 aa, Artificial Sequence
  Description of Artificial Sequence: Synthetic peptide
  Seed: SPESDDTLY (MAGC1_HUMAN)
STESDDTLY

SEQ ID NO: 71457 - protein, 9 aa, Artificial Sequence
  Description of Artificial Sequence: Synthetic peptide
  Seed: FSYTLLSLF (MAGC1_HUMAN)
FNYTLLSLF

SEQ ID NO: 71458 - protein, 9 aa, Artificial Sequence
  Description of Artificial Sequence: Synthetic peptide
  Seed: MTSSFSSTL (MAGC1_HUMAN)
MLSSFSSTI

SEQ ID NO: 71459 - protein, 10 aa, Artificial Sequence
  Description of Artificial Sequence: Synthetic peptide
  Seed: NSSPPRYEFL (MAGC1_HUMAN)
NSSPPRYEFV

SEQ ID NO: 71460 - protein, 10 aa, Artificial Sequence
  Description of Artificial Sequence: Synthetic peptide
  Seed: SFSSTLLSIF (MAGC1_HUMAN)
STSSTLLSIF

SEQ ID NO: 71461 - protein, 9 aa, Artificial Sequence
  Description of Artificial Sequence: Synthetic peptide
  Seed: SQNRLLILI (MAGC1_HUMAN)
SKNRLLILF

SEQ ID NO: 71462 - protein, 10 aa, Artificial Sequence
  Description of Artificial Sequence: Synthetic peptide
  Seed: MSQNRLLILI (MAGC1_HUMAN)
MSQNRLLILF

SEQ ID NO: 71463 - protein, 9 aa, Artificial Sequence
  Description of Artificial Sequence: Synthetic peptide
  Seed: TFEGFPQSL (MAGC1_HUMAN)
TGEGFPQSM

SEQ ID NO: 71464 - protein, 9 aa, Artificial Sequence
  Description of Artificial Sequence: Synthetic peptide
  Seed: FPSSTSSSL (MAGC1_HUMAN)
FVSSTSSSY

SEQ ID NO: 71465 - protein, 9 aa, Artificial Sequence
  Description of Artificial Sequence: Synthetic peptide
  Seed: TLLSLFQSF (MAGC1_HUMAN)
TVLSLFQSV

SEQ ID NO: 71466 - protein, 11 aa, Artificial Sequence
  Description of Artificial Sequence: Synthetic peptide
  Seed: IPGSPSFSSTL (MAGC1_HUMAN)
IPGSPSFSSTY

SEQ ID NO: 71467 - protein, 10 aa, Artificial Sequence
  Description of Artificial Sequence: Synthetic peptide
  Seed: FPQSPLQIPV (MAGC1_HUMAN)
FPQSPLQIPS

SEQ ID NO: 71468 - protein, 10 aa, Artificial Sequence
  Description of Artificial Sequence: Synthetic peptide
  Seed: EVIWDVLSGI (MAGC1_HUMAN)
ELIWDVLSGF

SEQ ID NO: 71469 - protein, 10 aa, Artificial Sequence
  Description of Artificial Sequence: Synthetic peptide
  Seed: SSPESAQSAF (MAGC1_HUMAN)
SHPESAQSAM

SEQ ID NO: 71470 - protein, 9 aa, Artificial Sequence
  Description of Artificial Sequence: Synthetic peptide
  Seed: SAPEGEDSL (MAGC1_HUMAN)
SAPEGEDSY

SEQ ID NO: 71471 - protein, 9 aa, Artificial Sequence
  Description of Artificial Sequence: Synthetic peptide
  Seed: FSYTLASLL (MAGC1_HUMAN)
FGYTLASLW

SEQ ID NO: 71472 - protein, 9 aa, Artificial Sequence
  Description of Artificial Sequence: Synthetic peptide
  Seed: SVLQIPVSA (MAGC1_HUMAN)
SPLQIPVSI

SEQ ID NO: 71473 - protein, 9 aa, Artificial Sequence
  Description of Artificial Sequence: Synthetic peptide
  Seed: SSFFSSALL (MAGC1_HUMAN)
SIFFSSALA

SEQ ID NO: 71474 - protein, 9 aa, Artificial Sequence
  Description of Artificial Sequence: Synthetic peptide
  Seed: GDKDMPTAG (MAGC1_HUMAN)
GEKDMPTAP

SEQ ID NO: 71475 - protein, 9 aa, Artificial Sequence
  Description of Artificial Sequence: Synthetic peptide
  Seed: SRYTGYFPV (MAGC1_HUMAN)
SRYTGYFPR

SEQ ID NO: 71476 - protein, 9 aa, Artificial Sequence
  Description of Artificial Sequence: Synthetic peptide
  Seed: KAREFIEIL (MAGC1_HUMAN)
KMREFIEIW

SEQ ID NO: 71477 - protein, 9 aa, Artificial Sequence
  Description of Artificial Sequence: Synthetic peptide
  Seed: FSSTLVSLF (MAGC1_HUMAN)
FYSTLVSLI

SEQ ID NO: 71478 - protein, 9 aa, Artificial Sequence
  Description of Artificial Sequence: Synthetic peptide
  Seed: ELARFLLLK (MAGC1_HUMAN)
EYARFLLLR

SEQ ID NO: 71479 - protein, 9 aa, Artificial Sequence
  Description of Artificial Sequence: Synthetic peptide
  Seed: QIVPSLPEW (MAGC1_HUMAN)
QLVPSLPEI

SEQ ID NO: 71480 - protein, 9 aa, Artificial Sequence
  Description of Artificial Sequence: Synthetic peptide
  Seed: FSERTQSTF (MAGC1_HUMAN)
FLERTQSTY

SEQ ID NO: 71481 - protein, 9 aa, Artificial Sequence
  Description of Artificial Sequence: Synthetic peptide
  Seed: SAQSAFEGF (MAGC1_HUMAN)
SSQSAFEGF

SEQ ID NO: 71482 - protein, 9 aa, Artificial Sequence
  Description of Artificial Sequence: Synthetic peptide
  Seed: IFRKAREFI (MAGC1_HUMAN)
ISRKAREFA

SEQ ID NO: 71483 - protein, 9 aa, Artificial Sequence
  Description of Artificial Sequence: Synthetic peptide
  Seed: YQVKQPITK (MAGC1_HUMAN)
YRVKQPITI

SEQ ID NO: 71484 - protein, 10 aa, Artificial Sequence
  Description of Artificial Sequence: Synthetic peptide
  Seed: LIESEPLFTY (MAGC1_HUMAN)
LFESEPLFTY

SEQ ID NO: 71485 - protein, 9 aa, Artificial Sequence
  Description of Artificial Sequence: Synthetic peptide
  Seed: TFEGFPQSL (MAGC1_HUMAN)
TTEGFPQSM

SEQ ID NO: 71486 - protein, 10 aa, Artificial Sequence
  Description of Artificial Sequence: Synthetic peptide
  Seed: GTYASEEVIW (MAGC1_HUMAN)
GQYASEEVIL

SEQ ID NO: 71487 - protein, 9 aa, Artificial Sequence
  Description of Artificial Sequence: Synthetic peptide
  Seed: STQSPFEGF (MAGC1_HUMAN)
SSQSPFEGF

SEQ ID NO: 71488 - protein, 10 aa, Artificial Sequence
  Description of Artificial Sequence: Synthetic peptide
  Seed: SLSPLHFPQF (MAGC1_HUMAN)
SYSPLHFPQL

SEQ ID NO: 71489 - protein, 9 aa, Artificial Sequence
  Description of Artificial Sequence: Synthetic peptide
  Seed: IESEPLFTY (MAGC1_HUMAN)
IISEPLFTM

SEQ ID NO: 71490 - protein, 9 aa, Artificial Sequence
  Description of Artificial Sequence: Synthetic peptide
  Seed: IPVSPSFSS (MAGC1_HUMAN)
IAVSPSFSF

SEQ ID NO: 71491 - protein, 9 aa, Artificial Sequence
  Description of Artificial Sequence: Synthetic peptide
  Seed: RSFSSTLLS (MAGC1_HUMAN)
RIFSSTLLI

SEQ ID NO: 71492 - protein, 9 aa, Artificial Sequence
  Description of Artificial Sequence: Synthetic peptide
  Seed: TLVSLFQSS (MAGC1_HUMAN)
TMVSLFQSA

SEQ ID NO: 71493 - protein, 10 aa, Artificial Sequence
  Description of Artificial Sequence: Synthetic peptide
  Seed: SLFQSFSERT (MAGC1_HUMAN)
SQFQSFSERV

SEQ ID NO: 71494 - protein, 8 aa, Artificial Sequence
  Description of Artificial Sequence: Synthetic peptide
  Seed: FSSTLVSL (MAGC1_HUMAN)
FASTLVSY

SEQ ID NO: 71495 - protein, 9 aa, Artificial Sequence
  Description of Artificial Sequence: Synthetic peptide
  Seed: ESSSPVDEY (MAGC1_HUMAN)
EVSSPVDER

SEQ ID NO: 71496 - protein, 10 aa, Artificial Sequence
  Description of Artificial Sequence: Synthetic peptide
  Seed: SSFSSTLLSI (MAGC1_HUMAN)
SLFSSTLLSF

SEQ ID NO: 71497 - protein, 9 aa, Artificial Sequence
  Description of Artificial Sequence: Synthetic peptide
  Seed: FQSSPERTH (MAGC1_HUMAN)
FQSSPERTY

SEQ ID NO: 71498 - protein, 10 aa, Artificial Sequence
  Description of Artificial Sequence: Synthetic peptide
  Seed: QIPVSSSFSY (MAGC1_HUMAN)
QCPVSSSFSY

SEQ ID NO: 71499 - protein, 9 aa, Artificial Sequence
  Description of Artificial Sequence: Synthetic peptide
  Seed: VSSSSSSTL (MAGC1_HUMAN)
VASSSSSTY

SEQ ID NO: 71500 - protein, 9 aa, Artificial Sequence
  Description of Artificial Sequence: Synthetic peptide
  Seed: SAPEGEDSL (MAGC1_HUMAN)
SIPEGEDSM

SEQ ID NO: 71501 - protein, 9 aa, Artificial Sequence
  Description of Artificial Sequence: Synthetic peptide
  Seed: ALLSIFQSS (MAGC1_HUMAN)
AILSIFQSV

SEQ ID NO: 71502 - protein, 10 aa, Artificial Sequence
  Description of Artificial Sequence: Synthetic peptide
  Seed: MTSSFSSTLL (MAGC1_HUMAN)
MMSSFSSTLQ

SEQ ID NO: 71503 - protein, 9 aa, Artificial Sequence
  Description of Artificial Sequence: Synthetic peptide
  Seed: EDSLSPHYF (MAGC1_HUMAN)
EESLSPHYW

SEQ ID NO: 71504 - protein, 10 aa, Artificial Sequence
  Description of Artificial Sequence: Synthetic peptide
  Seed: SFPSSTSSSL (MAGC1_HUMAN)
SPPSSTSSSL

SEQ ID NO: 71505 - protein, 9 aa, Artificial Sequence
  Description of Artificial Sequence: Synthetic peptide
  Seed: MPTAGMPSL (MAGC1_HUMAN)
MATAGMPSI

SEQ ID NO: 71506 - protein, 9 aa, Artificial Sequence
  Description of Artificial Sequence: Synthetic peptide
  Seed: ASSSTLVSI (MAGC1_HUMAN)
AISSTLVSA

SEQ ID NO: 71507 - protein, 10 aa, Artificial Sequence
  Description of Artificial Sequence: Synthetic peptide
  Seed: NPASSFFSSA (MAGC1_HUMAN)
NQASSFFSSV

SEQ ID NO: 71508 - protein, 9 aa, Artificial Sequence
  Description of Artificial Sequence: Synthetic peptide
  Seed: SSPEGKDSL (MAGC1_HUMAN)
SQPEGKDSY

SEQ ID NO: 71509 - protein, 9 aa, Artificial Sequence
  Description of Artificial Sequence: Synthetic peptide
  Seed: FSSTLVSLF (MAGC1_HUMAN)
FMSTLVSLV

SEQ ID NO: 71510 - protein, 9 aa, Artificial Sequence
  Description of Artificial Sequence: Synthetic peptide
  Seed: SSPPRYEFL (MAGC1_HUMAN)
SLPPRYEFF

SEQ ID NO: 71511 - protein, 9 aa, Artificial Sequence
  Description of Artificial Sequence: Synthetic peptide
  Seed: KVWVQEHYL (MAGC1_HUMAN)
KSWVQEHYI

SEQ ID NO: 71512 - protein, 10 aa, Artificial Sequence
  Description of Artificial Sequence: Synthetic peptide
  Seed: STPSSLPQSF (MAGC1_HUMAN)
SRPSSLPQSL

SEQ ID NO: 71513 - protein, 9 aa, Artificial Sequence
  Description of Artificial Sequence: Synthetic peptide
  Seed: RKVVEFLAM (MAGC1_HUMAN)
RFVVEFLAF

SEQ ID NO: 71514 - protein, 9 aa, Artificial Sequence
  Description of Artificial Sequence: Synthetic peptide
  Seed: SVLQIPVSA (MAGC1_HUMAN)
SLLQIPVSR

SEQ ID NO: 71515 - protein, 10 aa, Artificial Sequence
  Description of Artificial Sequence: Synthetic peptide
  Seed: MTSSFSSTLL (MAGC1_HUMAN)
MRSSFSSTLF

SEQ ID NO: 71516 - protein, 10 aa, Artificial Sequence
  Description of Artificial Sequence: Synthetic peptide
  Seed: LQRPVSSFFS (MAGC1_HUMAN)
LMRPVSSFFY

SEQ ID NO: 71517 - protein, 9 aa, Artificial Sequence
  Description of Artificial Sequence: Synthetic peptide
  Seed: ISFSSSTSL (MAGC1_HUMAN)
IAFSSSTSW

SEQ ID NO: 71518 - protein, 11 aa, Artificial Sequence
  Description of Artificial Sequence: Synthetic peptide
  Seed: SPLQIPVSSSS (MAGC1_HUMAN)
SSLQIPVSSSY

SEQ ID NO: 71519 - protein, 11 aa, Artificial Sequence
  Description of Artificial Sequence: Synthetic peptide
  Seed: SFFSSALLSIF (MAGC1_HUMAN)
SYFSSALLSIF

SEQ ID NO: 71520 - protein, 9 aa, Artificial Sequence
  Description of Artificial Sequence: Synthetic peptide
  Seed: IPVSPSFSS (MAGC1_HUMAN)
IPVSPSFSV

SEQ ID NO: 71521 - protein, 9 aa, Artificial Sequence
  Description of Artificial Sequence: Synthetic peptide
  Seed: LQIPMTSSF (MAGC1_HUMAN)
LHIPMTSSM

SEQ ID NO: 71522 - protein, 9 aa, Artificial Sequence
  Description of Artificial Sequence: Synthetic peptide
  Seed: DSYVFVNTL (MAGC1_HUMAN)
DTYVFVNTY

SEQ ID NO: 71523 - protein, 10 aa, Artificial Sequence
  Description of Artificial Sequence: Synthetic peptide
  Seed: TNVISRYTGY (MAGC1_HUMAN)
TQVISRYTGY

SEQ ID NO: 71524 - protein, 10 aa, Artificial Sequence
  Description of Artificial Sequence: Synthetic peptide
  Seed: LAMLKNTVPI (MAGC1_HUMAN)
LWMLKNTVPM

SEQ ID NO: 71525 - protein, 9 aa, Artificial Sequence
  Description of Artificial Sequence: Synthetic peptide
  Seed: YQVKQPITK (MAGC1_HUMAN)
YMVKQPITY

SEQ ID NO: 71526 - protein, 9 aa, Artificial Sequence
  Description of Artificial Sequence: Synthetic peptide
  Seed: VIFRKAREF (MAGC1_HUMAN)
VIFRKAREY

SEQ ID NO: 71527 - protein, 9 aa, Artificial Sequence
  Description of Artificial Sequence: Synthetic peptide
  Seed: SQSSPVSSF (MAGC1_HUMAN)
STSSPVSSF

SEQ ID NO: 71528 - protein, 10 aa, Artificial Sequence
  Description of Artificial Sequence: Synthetic peptide
  Seed: LQIVPSLPEW (MAGC1_HUMAN)
LMIVPSLPEL

SEQ ID NO: 71529 - protein, 9 aa, Artificial Sequence
  Description of Artificial Sequence: Synthetic peptide
  Seed: LPQSFPESS (MAGC1_HUMAN)
LPQSFPESM

SEQ ID NO: 71530 - protein, 9 aa, Artificial Sequence
  Description of Artificial Sequence: Synthetic peptide
  Seed: SSPESAQSA (MAGC1_HUMAN)
SAPESAQSV

SEQ ID NO: 71531 - protein, 10 aa, Artificial Sequence
  Description of Artificial Sequence: Synthetic peptide
  Seed: SSPECTQSTF (MAGC1_HUMAN)
SSPECTQSTW

SEQ ID NO: 71532 - protein, 9 aa, Artificial Sequence
  Description of Artificial Sequence: Synthetic peptide
  Seed: MGDKDMPTA (MAGC1_HUMAN)
MCDKDMPTM

SEQ ID NO: 71533 - protein, 9 aa, Artificial Sequence
  Description of Artificial Sequence: Synthetic peptide
  Seed: VPNSSPPRY (MAGC1_HUMAN)
VANSSPPRL

SEQ ID NO: 71534 - protein, 8 aa, Artificial Sequence
  Description of Artificial Sequence: Synthetic peptide
  Seed: SYVFVNTL (MAGC1_HUMAN)
SYVFVNTF

SEQ ID NO: 71535 - protein, 9 aa, Artificial Sequence
  Description of Artificial Sequence: Synthetic peptide
  Seed: SFSSTLVSL (MAGC1_HUMAN)
SMSSTLVSF

SEQ ID NO: 71536 - protein, 9 aa, Artificial Sequence
  Description of Artificial Sequence: Synthetic peptide
  Seed: LSPLHFPQF (MAGC1_HUMAN)
LTPLHFPQL

SEQ ID NO: 71537 - protein, 9 aa, Artificial Sequence
  Description of Artificial Sequence: Synthetic peptide
  Seed: LQIPVSSSS (MAGC1_HUMAN)
LTIPVSSSL

SEQ ID NO: 71538 - protein, 9 aa, Artificial Sequence
  Description of Artificial Sequence: Synthetic peptide
  Seed: AMLKNTVPI (MAGC1_HUMAN)
AKLKNTVPL

SEQ ID NO: 71539 - protein, 9 aa, Artificial Sequence
  Description of Artificial Sequence: Synthetic peptide
  Seed: KVWVQEHYL (MAGC1_HUMAN)
KIWVQEHYK

SEQ ID NO: 71540 - protein, 10 aa, Artificial Sequence
  Description of Artificial Sequence: Synthetic peptide
  Seed: GPVQSPLHSP (MAGC1_HUMAN)
GPVQSPLHSV

SEQ ID NO: 71541 - protein, 10 aa, Artificial Sequence
  Description of Artificial Sequence: Synthetic peptide
  Seed: RSFSSTLLSI (MAGC1_HUMAN)
RPFSSTLLSF

SEQ ID NO: 71542 - protein, 9 aa, Artificial Sequence
  Description of Artificial Sequence: Synthetic peptide
  Seed: KQPITKAEM (MAGC1_HUMAN)
KAPITKAEL

SEQ ID NO: 71543 - protein, 9 aa, Artificial Sequence
  Description of Artificial Sequence: Synthetic peptide
  Seed: YVFVNTLDL (MAGC1_HUMAN)
YFFVNTLDL

SEQ ID NO: 71544 - protein, 9 aa, Artificial Sequence
  Description of Artificial Sequence: Synthetic peptide
  Seed: AMLKNTVPI (MAGC1_HUMAN)
AQLKNTVPY

SEQ ID NO: 71545 - protein, 10 aa, Artificial Sequence
  Description of Artificial Sequence: Synthetic peptide
  Seed: SLFQSSPERT (MAGC1_HUMAN)
SIFQSSPERV

SEQ ID NO: 71546 - protein, 10 aa, Artificial Sequence
  Description of Artificial Sequence: Synthetic peptide
  Seed: SSPECTQSTF (MAGC1_HUMAN)
SPPECTQSTY

SEQ ID NO: 71547 - protein, 9 aa, Artificial Sequence
  Description of Artificial Sequence: Synthetic peptide
  Seed: MSQNRLLIL (MAGC1_HUMAN)
MVQNRLLIL

SEQ ID NO: 71548 - protein, 9 aa, Artificial Sequence
  Description of Artificial Sequence: Synthetic peptide
  Seed: SSPERTHST (MAGC1_HUMAN)
SVPERTHSF

SEQ ID NO: 71549 - protein, 10 aa, Artificial Sequence
  Description of Artificial Sequence: Synthetic peptide
  Seed: FFSYTLASLL (MAGC1_HUMAN)
FDSYTLASLY

SEQ ID NO: 71550 - protein, 10 aa, Artificial Sequence
  Description of Artificial Sequence: Synthetic peptide
  Seed: FPQSVLQIPV (MAGC1_HUMAN)
FVQSVLQIPY

SEQ ID NO: 71551 - protein, 9 aa, Artificial Sequence
  Description of Artificial Sequence: Synthetic peptide
  Seed: VQSPLHSPQ (MAGC1_HUMAN)
VKSPLHSPL

SEQ ID NO: 71552 - protein, 10 aa, Artificial Sequence
  Description of Artificial Sequence: Synthetic peptide
  Seed: WGPRAHSEVI (MAGC1_HUMAN)
WVPRAHSEVI

SEQ ID NO: 71553 - protein, 9 aa, Artificial Sequence
  Description of Artificial Sequence: Synthetic peptide
  Seed: FPSSTSSSL (MAGC1_HUMAN)
FYSSTSSSI

SEQ ID NO: 71554 - protein, 10 aa, Artificial Sequence
  Description of Artificial Sequence: Synthetic peptide
  Seed: VSSSSSSTLL (MAGC1_HUMAN)
VDSSSSSTLW

SEQ ID NO: 71555 - protein, 10 aa, Artificial Sequence
  Description of Artificial Sequence: Synthetic peptide
  Seed: VSSSSSSTLL (MAGC1_HUMAN)
VTSSSSSTLY

SEQ ID NO: 71556 - protein, 9 aa, Artificial Sequence
  Description of Artificial Sequence: Synthetic peptide
  Seed: VSSFFSYTL (MAGC1_HUMAN)
VKSFFSYTY

SEQ ID NO: 71557 - protein, 9 aa, Artificial Sequence
  Description of Artificial Sequence: Synthetic peptide
  Seed: YTLLSLFQS (MAGC1_HUMAN)
YVLLSLFQT

SEQ ID NO: 71558 - protein, 10 aa, Artificial Sequence
  Description of Artificial Sequence: Synthetic peptide
  Seed: ASSSVMSPSF (MAGC1_HUMAN)
AVSSVMSPSW

SEQ ID NO: 71559 - protein, 11 aa, Artificial Sequence
  Description of Artificial Sequence: Synthetic peptide
  Seed: SPLQNPASSFF (MAGC1_HUMAN)
SKLQNPASSFF

SEQ ID NO: 71560 - protein, 9 aa, Artificial Sequence
  Description of Artificial Sequence: Synthetic peptide
  Seed: YVFVNTLDL (MAGC1_HUMAN)
YYFVNTLDI

SEQ ID NO: 71561 - protein, 9 aa, Artificial Sequence
  Description of Artificial Sequence: Synthetic peptide
  Seed: IESEPLFTY (MAGC1_HUMAN)
IYSEPLFTY

SEQ ID NO: 71562 - protein, 10 aa, Artificial Sequence
  Description of Artificial Sequence: Synthetic peptide
  Seed: YTLASLLQSS (MAGC1_HUMAN)
YYLASLLQSA

SEQ ID NO: 71563 - protein, 11 aa, Artificial Sequence
  Description of Artificial Sequence: Synthetic peptide
  Seed: LQRPVSSFFSY (MAGC1_HUMAN)
LVRPVSSFFSY

SEQ ID NO: 71564 - protein, 9 aa, Artificial Sequence
  Description of Artificial Sequence: Synthetic peptide
  Seed: SAQSAFEGF (MAGC1_HUMAN)
SMQSAFEGW

SEQ ID NO: 71565 - protein, 10 aa, Artificial Sequence
  Description of Artificial Sequence: Synthetic peptide
  Seed: ASSSTLVSIF (MAGC1_HUMAN)
AHSSTLVSIW

SEQ ID NO: 71566 - protein, 9 aa, Artificial Sequence
  Description of Artificial Sequence: Synthetic peptide
  Seed: LQIPVSPSF (MAGC1_HUMAN)
LEIPVSPSF

SEQ ID NO: 71567 - protein, 9 aa, Artificial Sequence
  Description of Artificial Sequence: Synthetic peptide
  Seed: SLPEWEDSL (MAGC1_HUMAN)
SLPEWEDSM

SEQ ID NO: 71568 - protein, 9 aa, Artificial Sequence
  Description of Artificial Sequence: Synthetic peptide
  Seed: KVVEFLAML (MAGC1_HUMAN)
KSVEFLAMI

SEQ ID NO: 71569 - protein, 10 aa, Artificial Sequence
  Description of Artificial Sequence: Synthetic peptide
  Seed: RKVVEFLAML (MAGC1_HUMAN)
RPVVEFLAMA

SEQ ID NO: 71570 - protein, 9 aa, Artificial Sequence
  Description of Artificial Sequence: Synthetic peptide
  Seed: FPQSPLQGE (MAGC1_HUMAN)
FPQSPLQGI

SEQ ID NO: 71571 - protein, 9 aa, Artificial Sequence
  Description of Artificial Sequence: Synthetic peptide
  Seed: KVVEFLAML (MAGC1_HUMAN)
KLVEFLAML

SEQ ID NO: 71572 - protein, 9 aa, Artificial Sequence
  Description of Artificial Sequence: Synthetic peptide
  Seed: LQIPVSAAS (MAGC1_HUMAN)
LEIPVSAAM

SEQ ID NO: 71573 - protein, 9 aa, Artificial Sequence
  Description of Artificial Sequence: Synthetic peptide
  Seed: FPSSTSSSL (MAGC1_HUMAN)
FGSSTSSSY

SEQ ID NO: 71574 - protein, 10 aa, Artificial Sequence
  Description of Artificial Sequence: Synthetic peptide
  Seed: SRYTGYFPVI (MAGC1_HUMAN)
SMYTGYFPVL

SEQ ID NO: 71575 - protein, 11 aa, Artificial Sequence
  Description of Artificial Sequence: Synthetic peptide
  Seed: SPQSPPEGMHS (MAGC1_HUMAN)
SPQSPPEGMHL

SEQ ID NO: 71576 - protein, 10 aa, Artificial Sequence
  Description of Artificial Sequence: Synthetic peptide
  Seed: SRYTGYFPVI (MAGC1_HUMAN)
SKYTGYFPVM

SEQ ID NO: 71577 - protein, 9 aa, Artificial Sequence
  Description of Artificial Sequence: Synthetic peptide
  Seed: SAASSSTLV (MAGC1_HUMAN)
SMASSSTLA

SEQ ID NO: 71578 - protein, 9 aa, Artificial Sequence
  Description of Artificial Sequence: Synthetic peptide
  Seed: SQSPPEGPV (MAGC1_HUMAN)
SASPPEGPY

SEQ ID NO: 71579 - protein, 9 aa, Artificial Sequence
  Description of Artificial Sequence: Synthetic peptide
  Seed: VSAASSSTL (MAGC1_HUMAN)
VFAASSSTI

SEQ ID NO: 71580 - protein, 10 aa, Artificial Sequence
  Description of Artificial Sequence: Synthetic peptide
  Seed: SRYTGYFPVI (MAGC1_HUMAN)
SAYTGYFPVW

SEQ ID NO: 71581 - protein, 11 aa, Artificial Sequence
  Description of Artificial Sequence: Synthetic peptide
  Seed: SPLQIPVSSSS (MAGC1_HUMAN)
SKLQIPVSSSF

SEQ ID NO: 71582 - protein, 9 aa, Artificial Sequence
  Description of Artificial Sequence: Synthetic peptide
  Seed: VIWDVLSGI (MAGC1_HUMAN)
VAWDVLSGI

SEQ ID NO: 71583 - protein, 9 aa, Artificial Sequence
  Description of Artificial Sequence: Synthetic peptide
  Seed: SQSSPVSSF (MAGC1_HUMAN)
SYSSPVSSM

SEQ ID NO: 71584 - protein, 10 aa, Artificial Sequence
  Description of Artificial Sequence: Synthetic peptide
  Seed: YTLDEKVDEL (MAGC1_HUMAN)
YFLDEKVDEL

SEQ ID NO: 71585 - protein, 9 aa, Artificial Sequence
  Description of Artificial Sequence: Synthetic peptide
  Seed: KAREFIEIL (MAGC1_HUMAN)
KLREFIEIF

SEQ ID NO: 71586 - protein, 10 aa, Artificial Sequence
  Description of Artificial Sequence: Synthetic peptide
  Seed: LQIPVSPSFS (MAGC1_HUMAN)
LQIPVSPSFQ

SEQ ID NO: 71587 - protein, 10 aa, Artificial Sequence
  Description of Artificial Sequence: Synthetic peptide
  Seed: ASSSVMSPSF (MAGC1_HUMAN)
ASSSVMSPSY

SEQ ID NO: 71588 - protein, 9 aa, Artificial Sequence
  Description of Artificial Sequence: Synthetic peptide
  Seed: SSPESTQSP (MAGC1_HUMAN)
SFPESTQSM

SEQ ID NO: 71589 - protein, 10 aa, Artificial Sequence
  Description of Artificial Sequence: Synthetic peptide
  Seed: IESEPLFTYT (MAGC1_HUMAN)
IESEPLFTYL

SEQ ID NO: 71590 - protein, 9 aa, Artificial Sequence
  Description of Artificial Sequence: Synthetic peptide
  Seed: VSSFFSYTL (MAGC1_HUMAN)
VQSFFSYTI

SEQ ID NO: 71591 - protein, 10 aa, Artificial Sequence
  Description of Artificial Sequence: Synthetic peptide
  Seed: FPSSYKDALK (MAGC1_HUMAN)
FMSSYKDALR

SEQ ID NO: 71592 - protein, 10 aa, Artificial Sequence
  Description of Artificial Sequence: Synthetic peptide
  Seed: FSYTLLSLFQ (MAGC1_HUMAN)
FSYTLLSLFM

SEQ ID NO: 71593 - protein, 10 aa, Artificial Sequence
  Description of Artificial Sequence: Synthetic peptide
  Seed: ICSSSTSLSL (MAGC1_HUMAN)
IESSSTSLSW

SEQ ID NO: 71594 - protein, 9 aa, Artificial Sequence
  Description of Artificial Sequence: Synthetic peptide
  Seed: MTSSFSSTL (MAGC1_HUMAN)
MQSSFSSTA

SEQ ID NO: 71595 - protein, 9 aa, Artificial Sequence
  Description of Artificial Sequence: Synthetic peptide
  Seed: CSSSTSLSL (MAGC1_HUMAN)
CMSSTSLSF

SEQ ID NO: 71596 - protein, 9 aa, Artificial Sequence
  Description of Artificial Sequence: Synthetic peptide
  Seed: FPSSTSSSL (MAGC1_HUMAN)
FMSSTSSSM

SEQ ID NO: 71597 - protein, 10 aa, Artificial Sequence
  Description of Artificial Sequence: Synthetic peptide
  Seed: SQSSPVSSFP (MAGC1_HUMAN)
SQSSPVSSFY

SEQ ID NO: 71598 - protein, 11 aa, Artificial Sequence
  Description of Artificial Sequence: Synthetic peptide
  Seed: FLAMLKNTVPI (MAGC1_HUMAN)
FLAMLKNTVPL

SEQ ID NO: 71599 - protein, 9 aa, Artificial Sequence
  Description of Artificial Sequence: Synthetic peptide
  Seed: FSSTLLSLF (MAGC1_HUMAN)
FPSTLLSLL

SEQ ID NO: 71600 - protein, 11 aa, Artificial Sequence
  Description of Artificial Sequence: Synthetic peptide
  Seed: IPVSPSSSSTL (MAGC1_HUMAN)
ISVSPSSSSTY

SEQ ID NO: 71601 - protein, 9 aa, Artificial Sequence
  Description of Artificial Sequence: Synthetic peptide
  Seed: TLLSLFQSF (MAGC1_HUMAN)
TWLSLFQSM

SEQ ID NO: 71602 - protein, 10 aa, Artificial Sequence
  Description of Artificial Sequence: Synthetic peptide
  Seed: VSICSSSTSL (MAGC1_HUMAN)
VAICSSSTSY

SEQ ID NO: 71603 - protein, 9 aa, Artificial Sequence
  Description of Artificial Sequence: Synthetic peptide
  Seed: FSSTLLSLF (MAGC1_HUMAN)
FGSTLLSLV

SEQ ID NO: 71604 - protein, 9 aa, Artificial Sequence
  Description of Artificial Sequence: Synthetic peptide
  Seed: FQSSLQSPV (MAGC1_HUMAN)
FRSSLQSPM

SEQ ID NO: 71605 - protein, 10 aa, Artificial Sequence
  Description of Artificial Sequence: Synthetic peptide
  Seed: ASSFFSSALL (MAGC1_HUMAN)
ALSFFSSALY

SEQ ID NO: 71606 - protein, 10 aa, Artificial Sequence
  Description of Artificial Sequence: Synthetic peptide
  Seed: TLDEKVDELA (MAGC1_HUMAN)
TLDEKVDELL

SEQ ID NO: 71607 - protein, 10 aa, Artificial Sequence
  Description of Artificial Sequence: Synthetic peptide
  Seed: FFSSALLSIF (MAGC1_HUMAN)
FSSSALLSIY

SEQ ID NO: 71608 - protein, 11 aa, Artificial Sequence
  Description of Artificial Sequence: Synthetic peptide
  Seed: FQSSLQSPVSI (MAGC1_HUMAN)
FLSSLQSPVSA

SEQ ID NO: 71609 - protein, 10 aa, Artificial Sequence
  Description of Artificial Sequence: Synthetic peptide
  Seed: RTQSTFEGFA (MAGC1_HUMAN)
RAQSTFEGFK

SEQ ID NO: 71610 - protein, 9 aa, Artificial Sequence
  Description of Artificial Sequence: Synthetic peptide
  Seed: FSSTLVSLF (MAGC1_HUMAN)
FFSTLVSLW

SEQ ID NO: 71611 - protein, 9 aa, Artificial Sequence
  Description of Artificial Sequence: Synthetic peptide
  Seed: SAPEGEDSL (MAGC1_HUMAN)
SGPEGEDSL

SEQ ID NO: 71612 - protein, 9 aa, Artificial Sequence
  Description of Artificial Sequence: Synthetic peptide
  Seed: YVFVNTLDL (MAGC1_HUMAN)
YSFVNTLDI

SEQ ID NO: 71613 - protein, 9 aa, Artificial Sequence
  Description of Artificial Sequence: Synthetic peptide
  Seed: FPVIFRKAR (MAGC1_HUMAN)
FVVIFRKAR

SEQ ID NO: 71614 - protein, 10 aa, Artificial Sequence
  Description of Artificial Sequence: Synthetic peptide
  Seed: RYTGYFPVIF (MAGC1_HUMAN)
RQTGYFPVIY

SEQ ID NO: 71615 - protein, 9 aa, Artificial Sequence
  Description of Artificial Sequence: Synthetic peptide
  Seed: VSAASSSTL (MAGC1_HUMAN)
VNAASSSTY

SEQ ID NO: 71616 - protein, 9 aa, Artificial Sequence
  Description of Artificial Sequence: Synthetic peptide
  Seed: LSDEQGMSQ (MAGC1_HUMAN)
LLDEQGMSM

SEQ ID NO: 71617 - protein, 10 aa, Artificial Sequence
  Description of Artificial Sequence: Synthetic peptide
  Seed: SPLQSPVSSF (MAGC1_HUMAN)
SPLQSPVSSL

SEQ ID NO: 71618 - protein, 9 aa, Artificial Sequence
  Description of Artificial Sequence: Synthetic peptide
  Seed: HFPQSPPEW (MAGC1_HUMAN)
HGPQSPPEL

SEQ ID NO: 71619 - protein, 10 aa, Artificial Sequence
  Description of Artificial Sequence: Synthetic peptide
  Seed: EVIWDVLSGI (MAGC1_HUMAN)
EIIWDVLSGM

SEQ ID NO: 71620 - protein, 9 aa, Artificial Sequence
  Description of Artificial Sequence: Synthetic peptide
  Seed: KAREFIEIL (MAGC1_HUMAN)
KQREFIEIK

SEQ ID NO: 71621 - protein, 10 aa, Artificial Sequence
  Description of Artificial Sequence: Synthetic peptide
  Seed: SFSYTLLSLF (MAGC1_HUMAN)
SGSYTLLSLF

SEQ ID NO: 71622 - protein, 9 aa, Artificial Sequence
  Description of Artificial Sequence: Synthetic peptide
  Seed: LQRPVSSFF (MAGC1_HUMAN)
LGRPVSSFW

SEQ ID NO: 71623 - protein, 9 aa, Artificial Sequence
  Description of Artificial Sequence: Synthetic peptide
  Seed: AMLKNTVPI (MAGC1_HUMAN)
ALLKNTVPW

SEQ ID NO: 71624 - protein, 9 aa, Artificial Sequence
  Description of Artificial Sequence: Synthetic peptide
  Seed: DSYVFVNTL (MAGC1_HUMAN)
DSYVFVNTV

SEQ ID NO: 71625 - protein, 9 aa, Artificial Sequence
  Description of Artificial Sequence: Synthetic peptide
  Seed: GSPSFSSTL (MAGC1_HUMAN)
GFPSFSSTY

SEQ ID NO: 71626 - protein, 10 aa, Artificial Sequence
  Description of Artificial Sequence: Synthetic peptide
  Seed: FPQSVLQIPV (MAGC1_HUMAN)
FPQSVLQIPP

SEQ ID NO: 71627 - protein, 9 aa, Artificial Sequence
  Description of Artificial Sequence: Synthetic peptide
  Seed: FPSSTSSSL (MAGC1_HUMAN)
FYSSTSSSL

SEQ ID NO: 71628 - protein, 10 aa, Artificial Sequence
  Description of Artificial Sequence: Synthetic peptide
  Seed: FIEILFGISL (MAGC1_HUMAN)
FYEILFGISL

SEQ ID NO: 71629 - protein, 10 aa, Artificial Sequence
  Description of Artificial Sequence: Synthetic peptide
  Seed: AASSSTLVSI (MAGC1_HUMAN)
ASSSSTLVSV

SEQ ID NO: 71630 - protein, 9 aa, Artificial Sequence
  Description of Artificial Sequence: Synthetic peptide
  Seed: FQSSLQSPV (MAGC1_HUMAN)
FKSSLQSPF

SEQ ID NO: 71631 - protein, 10 aa, Artificial Sequence
  Description of Artificial Sequence: Synthetic peptide
  Seed: ICSSSTSLSL (MAGC1_HUMAN)
IDSSSTSLSY

SEQ ID NO: 71632 - protein, 10 aa, Artificial Sequence
  Description of Artificial Sequence: Synthetic peptide
  Seed: LQIPVSSSFS (MAGC1_HUMAN)
LMIPVSSSFK

SEQ ID NO: 71633 - protein, 9 aa, Artificial Sequence
  Description of Artificial Sequence: Synthetic peptide
  Seed: TFEGFPQSL (MAGC1_HUMAN)
TTEGFPQSF

SEQ ID NO: 71634 - protein, 11 aa, Artificial Sequence
  Description of Artificial Sequence: Synthetic peptide
  Seed: AASSSTLVSIF (MAGC1_HUMAN)
ATSSSTLVSIF

SEQ ID NO: 71635 - protein, 9 aa, Artificial Sequence
  Description of Artificial Sequence: Synthetic peptide
  Seed: VIKRKVVEF (MAGC1_HUMAN)
VIKRKVVEY

SEQ ID NO: 71636 - protein, 9 aa, Artificial Sequence
  Description of Artificial Sequence: Synthetic peptide
  Seed: FTYTLDEKV (MAGC1_HUMAN)
FTYTLDEKI

SEQ ID NO: 71637 - protein, 9 aa, Artificial Sequence
  Description of Artificial Sequence: Synthetic peptide
  Seed: SPVSSFPSS (MAGC1_HUMAN)
SPVSSFPSV

SEQ ID NO: 71638 - protein, 9 aa, Artificial Sequence
  Description of Artificial Sequence: Synthetic peptide
  Seed: SLPQSFPES (MAGC1_HUMAN)
STPQSFPEL

SEQ ID NO: 71639 - protein, 9 aa, Artificial Sequence
  Description of Artificial Sequence: Synthetic peptide
  Seed: FSYTLASLL (MAGC1_HUMAN)
FLYTLASLI

SEQ ID NO: 71640 - protein, 9 aa, Artificial Sequence
  Description of Artificial Sequence: Synthetic peptide
  Seed: LESDSLTDS (MAGC1_HUMAN)
LESDSLTDA

SEQ ID NO: 71641 - protein, 10 aa, Artificial Sequence
  Description of Artificial Sequence: Synthetic peptide
  Seed: LQIPVSSSFS (MAGC1_HUMAN)
LAIPVSSSFF

SEQ ID NO: 71642 - protein, 9 aa, Artificial Sequence
  Description of Artificial Sequence: Synthetic peptide
  Seed: LQRPVSSFF (MAGC1_HUMAN)
LCRPVSSFW

SEQ ID NO: 71643 - protein, 10 aa, Artificial Sequence
  Description of Artificial Sequence: Synthetic peptide
  Seed: ICSSSTSLSL (MAGC1_HUMAN)
ICSSSTSLSW

SEQ ID NO: 71644 - protein, 10 aa, Artificial Sequence
  Description of Artificial Sequence: Synthetic peptide
  Seed: YTLASLLQSS (MAGC1_HUMAN)
YVLASLLQSL

SEQ ID NO: 71645 - protein, 9 aa, Artificial Sequence
  Description of Artificial Sequence: Synthetic peptide
  Seed: NTVPITFPS (MAGC1_HUMAN)
NAVPITFPK

SEQ ID NO: 71646 - protein, 10 aa, Artificial Sequence
  Description of Artificial Sequence: Synthetic peptide
  Seed: FFSSALLSIF (MAGC1_HUMAN)
FWSSALLSIY

SEQ ID NO: 71647 - protein, 11 aa, Artificial Sequence
  Description of Artificial Sequence: Synthetic peptide
  Seed: SPLQNPASSFF (MAGC1_HUMAN)
SLLQNPASSFY

SEQ ID NO: 71648 - protein, 9 aa, Artificial Sequence
  Description of Artificial Sequence: Synthetic peptide
  Seed: FSERTQSTF (MAGC1_HUMAN)
FMERTQSTM

SEQ ID NO: 71649 - protein, 9 aa, Artificial Sequence
  Description of Artificial Sequence: Synthetic peptide
  Seed: SQSSPVSSF (MAGC1_HUMAN)
SKSSPVSSL

SEQ ID NO: 71650 - protein, 9 aa, Artificial Sequence
  Description of Artificial Sequence: Synthetic peptide
  Seed: AGREHFAFG (MAGC1_HUMAN)
ATREHFAFE

SEQ ID NO: 71651 - protein, 9 aa, Artificial Sequence
  Description of Artificial Sequence: Synthetic peptide
  Seed: NTVPITFPS (MAGC1_HUMAN)
NQVPITFPA

SEQ ID NO: 71652 - protein, 9 aa, Artificial Sequence
  Description of Artificial Sequence: Synthetic peptide
  Seed: SSSSSSSTL (MAGC1_HUMAN)
SMSSSSSTI

SEQ ID NO: 71653 - protein, 10 aa, Artificial Sequence
  Description of Artificial Sequence: Synthetic peptide
  Seed: EVPNSSPPRY (MAGC1_HUMAN)
EAPNSSPPRR

SEQ ID NO: 71654 - protein, 10 aa, Artificial Sequence
  Description of Artificial Sequence: Synthetic peptide
  Seed: VISFSSSTSL (MAGC1_HUMAN)
VMSFSSSTSL

SEQ ID NO: 71655 - protein, 9 aa, Artificial Sequence
  Description of Artificial Sequence: Synthetic peptide
  Seed: SSPPRYEFL (MAGC1_HUMAN)
SIPPRYEFV

SEQ ID NO: 71656 - protein, 10 aa, Artificial Sequence
  Description of Artificial Sequence: Synthetic peptide
  Seed: YTGYFPVIFR (MAGC1_HUMAN)
YMGYFPVIFR

SEQ ID NO: 71657 - protein, 9 aa, Artificial Sequence
  Description of Artificial Sequence: Synthetic peptide
  Seed: SSPESPLQS (MAGC1_HUMAN)
SIPESPLQL

SEQ ID NO: 71658 - protein, 10 aa, Artificial Sequence
  Description of Artificial Sequence: Synthetic peptide
  Seed: ATESASSSVM (MAGC1_HUMAN)
ASESASSSVL

SEQ ID NO: 71659 - protein, 9 aa, Artificial Sequence
  Description of Artificial Sequence: Synthetic peptide
  Seed: IESEPLFTY (MAGC1_HUMAN)
ISSEPLFTV

SEQ ID NO: 71660 - protein, 9 aa, Artificial Sequence
  Description of Artificial Sequence: Synthetic peptide
  Seed: ALLSIFQSS (MAGC1_HUMAN)
ALLSIFQSL

SEQ ID NO: 71661 - protein, 11 aa, Artificial Sequence
  Description of Artificial Sequence: Synthetic peptide
  Seed: IPVSSSSSSTL (MAGC1_HUMAN)
INVSSSSSSTW

SEQ ID NO: 71662 - protein, 9 aa, Artificial Sequence
  Description of Artificial Sequence: Synthetic peptide
  Seed: LQIPGSPSF (MAGC1_HUMAN)
LVIPGSPSL

SEQ ID NO: 71663 - protein, 9 aa, Artificial Sequence
  Description of Artificial Sequence: Synthetic peptide
  Seed: VSPSFSSTL (MAGC1_HUMAN)
VMPSFSSTV

SEQ ID NO: 71664 - protein, 9 aa, Artificial Sequence
  Description of Artificial Sequence: Synthetic peptide
  Seed: SSPPRYEFL (MAGC1_HUMAN)
SFPPRYEFM

SEQ ID NO: 71665 - protein, 9 aa, Artificial Sequence
  Description of Artificial Sequence: Synthetic peptide
  Seed: VSAASSSTL (MAGC1_HUMAN)
VVAASSSTL

SEQ ID NO: 71666 - protein, 10 aa, Artificial Sequence
  Description of Artificial Sequence: Synthetic peptide
  Seed: SSFSYTLLSL (MAGC1_HUMAN)
SKFSYTLLSL

SEQ ID NO: 71667 - protein, 9 aa, Artificial Sequence
  Description of Artificial Sequence: Synthetic peptide
  Seed: KVVEFLAML (MAGC1_HUMAN)
KQVEFLAML

SEQ ID NO: 71668 - protein, 10 aa, Artificial Sequence
  Description of Artificial Sequence: Synthetic peptide
  Seed: FPSSYKDALK (MAGC1_HUMAN)
FPSSYKDALM

SEQ ID NO: 71669 - protein, 9 aa, Artificial Sequence
  Description of Artificial Sequence: Synthetic peptide
  Seed: FSSTLVSLF (MAGC1_HUMAN)
FTSTLVSLV

SEQ ID NO: 71670 - protein, 10 aa, Artificial Sequence
  Description of Artificial Sequence: Synthetic peptide
  Seed: SLIESEPLFT (MAGC1_HUMAN)
SMIESEPLFV

SEQ ID NO: 71671 - protein, 9 aa, Artificial Sequence
  Description of Artificial Sequence: Synthetic peptide
  Seed: MTSSFSSTL (MAGC1_HUMAN)
MLSSFSSTY

SEQ ID NO: 71672 - protein, 10 aa, Artificial Sequence
  Description of Artificial Sequence: Synthetic peptide
  Seed: SRYTGYFPVI (MAGC1_HUMAN)
SVYTGYFPVL

SEQ ID NO: 71673 - protein, 9 aa, Artificial Sequence
  Description of Artificial Sequence: Synthetic peptide
  Seed: KAREFIEIL (MAGC1_HUMAN)
KTREFIEIV

SEQ ID NO: 71674 - protein, 10 aa, Artificial Sequence
  Description of Artificial Sequence: Synthetic peptide
  Seed: REVPNSSPPR (MAGC1_HUMAN)
RMVPNSSPPR

SEQ ID NO: 71675 - protein, 9 aa, Artificial Sequence
  Description of Artificial Sequence: Synthetic peptide
  Seed: KDSQSPLQI (MAGC1_HUMAN)
KQSQSPLQI

SEQ ID NO: 71676 - protein, 9 aa, Artificial Sequence
  Description of Artificial Sequence: Synthetic peptide
  Seed: VIKRKVVEF (MAGC1_HUMAN)
VMKRKVVEA

SEQ ID NO: 71677 - protein, 9 aa, Artificial Sequence
  Description of Artificial Sequence: Synthetic peptide
  Seed: IPVSSSFSY (MAGC1_HUMAN)
IPVSSSFSV

SEQ ID NO: 71678 - protein, 9 aa, Artificial Sequence
  Description of Artificial Sequence: Synthetic peptide
  Seed: FSSTLLSLF (MAGC1_HUMAN)
FLSTLLSLM

SEQ ID NO: 71679 - protein, 9 aa, Artificial Sequence
  Description of Artificial Sequence: Synthetic peptide
  Seed: ATESASSSV (MAGC1_HUMAN)
AAESASSSM

SEQ ID NO: 71680 - protein, 9 aa, Artificial Sequence
  Description of Artificial Sequence: Synthetic peptide
  Seed: SSPESPLQS (MAGC1_HUMAN)
SLPESPLQV

SEQ ID NO: 71681 - protein, 9 aa, Artificial Sequence
  Description of Artificial Sequence: Synthetic peptide
  Seed: IPVSSSFSY (MAGC1_HUMAN)
IMVSSSFSV

SEQ ID NO: 71682 - protein, 9 aa, Artificial Sequence
  Description of Artificial Sequence: Synthetic peptide
  Seed: VSSSFSYTL (MAGC1_HUMAN)
VESSFSYTY

SEQ ID NO: 71683 - protein, 9 aa, Artificial Sequence
  Description of Artificial Sequence: Synthetic peptide
  Seed: LQRPVSSFF (MAGC1_HUMAN)
LPRPVSSFY

SEQ ID NO: 71684 - protein, 9 aa, Artificial Sequence
  Description of Artificial Sequence: Synthetic peptide
  Seed: VQSPLQNPA (MAGC1_HUMAN)
VISPLQNPI

SEQ ID NO: 71685 - protein, 10 aa, Artificial Sequence
  Description of Artificial Sequence: Synthetic peptide
  Seed: AASSSTLVSI (MAGC1_HUMAN)
ATSSSTLVSF

SEQ ID NO: 71686 - protein, 9 aa, Artificial Sequence
  Description of Artificial Sequence: Synthetic peptide
  Seed: RKVVEFLAM (MAGC1_HUMAN)
RNVVEFLAY

SEQ ID NO: 71687 - protein, 10 aa, Artificial Sequence
  Description of Artificial Sequence: Synthetic peptide
  Seed: SLSPLHFPQF (MAGC1_HUMAN)
SMSPLHFPQY

SEQ ID NO: 71688 - protein, 9 aa, Artificial Sequence
  Description of Artificial Sequence: Synthetic peptide
  Seed: KAREFIEIL (MAGC1_HUMAN)
KMREFIEIK

SEQ ID NO: 71689 - protein, 10 aa, Artificial Sequence
  Description of Artificial Sequence: Synthetic peptide
  Seed: YVFVNTLDLT (MAGC1_HUMAN)
YAFVNTLDLV

SEQ ID NO: 71690 - protein, 9 aa, Artificial Sequence
  Description of Artificial Sequence: Synthetic peptide
  Seed: QGEDFQSSL (MAGC1_HUMAN)
QTEDFQSSL

SEQ ID NO: 71691 - protein, 10 aa, Artificial Sequence
  Description of Artificial Sequence: Synthetic peptide
  Seed: LQIPVSRSFS (MAGC1_HUMAN)
LQIPVSRSFM

SEQ ID NO: 71692 - protein, 10 aa, Artificial Sequence
  Description of Artificial Sequence: Synthetic peptide
  Seed: SPLQNPASSF (MAGC1_HUMAN)
SPLQNPASSL

SEQ ID NO: 71693 - protein, 10 aa, Artificial Sequence
  Description of Artificial Sequence: Synthetic peptide
  Seed: VSSSSSSSTL (MAGC1_HUMAN)
VGSSSSSSTW

SEQ ID NO: 71694 - protein, 9 aa, Artificial Sequence
  Description of Artificial Sequence: Synthetic peptide
  Seed: FLAMLKNTV (MAGC1_HUMAN)
FSAMLKNTF

SEQ ID NO: 71695 - protein, 10 aa, Artificial Sequence
  Description of Artificial Sequence: Synthetic peptide
  Seed: HSPQSPPEGM (MAGC1_HUMAN)
HMPQSPPEGF

SEQ ID NO: 71696 - protein, 10 aa, Artificial Sequence
  Description of Artificial Sequence: Synthetic peptide
  Seed: REFIEILFGI (MAGC1_HUMAN)
RMFIEILFGI

SEQ ID NO: 71697 - protein, 9 aa, Artificial Sequence
  Description of Artificial Sequence: Synthetic peptide
  Seed: SPESAQSAF (MAGC1_HUMAN)
SPESAQSAM

SEQ ID NO: 71698 - protein, 10 aa, Artificial Sequence
  Description of Artificial Sequence: Synthetic peptide
  Seed: MTSSFSSTLL (MAGC1_HUMAN)
MTSSFSSTLM

SEQ ID NO: 71699 - protein, 10 aa, Artificial Sequence
  Description of Artificial Sequence: Synthetic peptide
  Seed: LQIPMTSSFS (MAGC1_HUMAN)
LQIPMTSSFP

SEQ ID NO: 71700 - protein, 9 aa, Artificial Sequence
  Description of Artificial Sequence: Synthetic peptide
  Seed: IEILFGISL (MAGC1_HUMAN)
IPILFGISF

SEQ ID NO: 71701 - protein, 10 aa, Artificial Sequence
  Description of Artificial Sequence: Synthetic peptide
  Seed: SIFQSSPESA (MAGC1_HUMAN)
SVFQSSPESA

SEQ ID NO: 71702 - protein, 9 aa, Artificial Sequence
  Description of Artificial Sequence: Synthetic peptide
  Seed: VIKRKVVEF (MAGC1_HUMAN)
VLKRKVVEV

SEQ ID NO: 71703 - protein, 8 aa, Artificial Sequence
  Description of Artificial Sequence: Synthetic peptide
  Seed: FSYTLLSL (MAGC1_HUMAN)
FTYTLLSY

SEQ ID NO: 71704 - protein, 9 aa, Artificial Sequence
  Description of Artificial Sequence: Synthetic peptide
  Seed: SSSSTLLSL (MAGC1_HUMAN)
SLSSTLLSI

SEQ ID NO: 71705 - protein, 11 aa, Artificial Sequence
  Description of Artificial Sequence: Synthetic peptide
  Seed: FLAMLKNTVPI (MAGC1_HUMAN)
FCAMLKNTVPI

SEQ ID NO: 71706 - protein, 9 aa, Artificial Sequence
  Description of Artificial Sequence: Synthetic peptide
  Seed: SVLQIPVSA (MAGC1_HUMAN)
SILQIPVSK

SEQ ID NO: 71707 - protein, 9 aa, Artificial Sequence
  Description of Artificial Sequence: Synthetic peptide
  Seed: SSSESPQSC (MAGC1_HUMAN)
SGSESPQSY

SEQ ID NO: 71708 - protein, 9 aa, Artificial Sequence
  Description of Artificial Sequence: Synthetic peptide
  Seed: RSFSSTLLS (MAGC1_HUMAN)
RQFSSTLLF

SEQ ID NO: 71709 - protein, 10 aa, Artificial Sequence
  Description of Artificial Sequence: Synthetic peptide
  Seed: GEDSLSPHYF (MAGC1_HUMAN)
GEDSLSPHYL

SEQ ID NO: 71710 - protein, 9 aa, Artificial Sequence
  Description of Artificial Sequence: Synthetic peptide
  Seed: STFEGFPQS (MAGC1_HUMAN)
SCFEGFPQY

SEQ ID NO: 71711 - protein, 9 aa, Artificial Sequence
  Description of Artificial Sequence: Synthetic peptide
  Seed: YPLQSPQSR (MAGC1_HUMAN)
YPLQSPQSW

SEQ ID NO: 71712 - protein, 11 aa, Artificial Sequence
  Description of Artificial Sequence: Synthetic peptide
  Seed: STFEGFPQSLL (MAGC1_HUMAN)
SVFEGFPQSLW

SEQ ID NO: 71713 - protein, 9 aa, Artificial Sequence
  Description of Artificial Sequence: Synthetic peptide
  Seed: SSSTLVSIF (MAGC1_HUMAN)
SSSTLVSIL

SEQ ID NO: 71714 - protein, 9 aa, Artificial Sequence
  Description of Artificial Sequence: Synthetic peptide
  Seed: SPLQIVPSL (MAGC1_HUMAN)
SALQIVPSF

SEQ ID NO: 71715 - protein, 9 aa, Artificial Sequence
  Description of Artificial Sequence: Synthetic peptide
  Seed: SQSSPVSSF (MAGC1_HUMAN)
SISSPVSSY

SEQ ID NO: 71716 - protein, 9 aa, Artificial Sequence
  Description of Artificial Sequence: Synthetic peptide
  Seed: AGREHFAFG (MAGC1_HUMAN)
ATREHFAFQ

SEQ ID NO: 71717 - protein, 11 aa, Artificial Sequence
  Description of Artificial Sequence: Synthetic peptide
  Seed: RPVSSFFSYTL (MAGC1_HUMAN)
REVSSFFSYTW

SEQ ID NO: 71718 - protein, 9 aa, Artificial Sequence
  Description of Artificial Sequence: Synthetic peptide
  Seed: REFIEILFG (MAGC1_HUMAN)
REFIEILFL

SEQ ID NO: 71719 - protein, 11 aa, Artificial Sequence
  Description of Artificial Sequence: Synthetic peptide
  Seed: SICSSSTSLSL (MAGC1_HUMAN)
SQCSSSTSLSI

SEQ ID NO: 71720 - protein, 9 aa, Artificial Sequence
  Description of Artificial Sequence: Synthetic peptide
  Seed: SFSSTLVSL (MAGC1_HUMAN)
SFSSTLVSM

SEQ ID NO: 71721 - protein, 9 aa, Artificial Sequence
  Description of Artificial Sequence: Synthetic peptide
  Seed: FAFGEPREL (MAGC1_HUMAN)
FMFGEPREM

SEQ ID NO: 71722 - protein, 9 aa, Artificial Sequence
  Description of Artificial Sequence: Synthetic peptide
  Seed: SSSFSYTLL (MAGC1_HUMAN)
STSFSYTLI

SEQ ID NO: 71723 - protein, 9 aa, Artificial Sequence
  Description of Artificial Sequence: Synthetic peptide
  Seed: LQRPVSSFF (MAGC1_HUMAN)
LSRPVSSFV

SEQ ID NO: 71724 - protein, 9 aa, Artificial Sequence
  Description of Artificial Sequence: Synthetic peptide
  Seed: FSEESSSPV (MAGC1_HUMAN)
FLEESSSPF

SEQ ID NO: 71725 - protein, 10 aa, Artificial Sequence
  Description of Artificial Sequence: Synthetic peptide
  Seed: MSQNRLLILI (MAGC1_HUMAN)
MMQNRLLILI

SEQ ID NO: 71726 - protein, 9 aa, Artificial Sequence
  Description of Artificial Sequence: Synthetic peptide
  Seed: TFEGFPQSL (MAGC1_HUMAN)
TSEGFPQSM

SEQ ID NO: 71727 - protein, 9 aa, Artificial Sequence
  Description of Artificial Sequence: Synthetic peptide
  Seed: FSSTLLSIL (MAGC1_HUMAN)
FPSTLLSIW

SEQ ID NO: 71728 - protein, 9 aa, Artificial Sequence
  Description of Artificial Sequence: Synthetic peptide
  Seed: TFEGFPQSL (MAGC1_HUMAN)
TVEGFPQSM

SEQ ID NO: 71729 - protein, 10 aa, Artificial Sequence
  Description of Artificial Sequence: Synthetic peptide
  Seed: FPQSLLQIPM (MAGC1_HUMAN)
FTQSLLQIPY

SEQ ID NO: 71730 - protein, 9 aa, Artificial Sequence
  Description of Artificial Sequence: Synthetic peptide
  Seed: TGYFPVIFR (MAGC1_HUMAN)
TNYFPVIFR

SEQ ID NO: 71731 - protein, 9 aa, Artificial Sequence
  Description of Artificial Sequence: Synthetic peptide
  Seed: FAQSPLQIP (MAGC1_HUMAN)
FPQSPLQIT

SEQ ID NO: 71732 - protein, 10 aa, Artificial Sequence
  Description of Artificial Sequence: Synthetic peptide
  Seed: LEYREVPNSS (MAGC1_HUMAN)
LEYREVPNSA

SEQ ID NO: 71733 - protein, 9 aa, Artificial Sequence
  Description of Artificial Sequence: Synthetic peptide
  Seed: SSSSSSSTL (MAGC1_HUMAN)
SMSSSSSTM

SEQ ID NO: 71734 - protein, 10 aa, Artificial Sequence
  Description of Artificial Sequence: Synthetic peptide
  Seed: ICSSSTSLSL (MAGC1_HUMAN)
IGSSSTSLSF

SEQ ID NO: 71735 - protein, 9 aa, Artificial Sequence
  Description of Artificial Sequence: Synthetic peptide
  Seed: FSYTLLSLF (MAGC1_HUMAN)
FIYTLLSLF

SEQ ID NO: 71736 - protein, 9 aa, Artificial Sequence
  Description of Artificial Sequence: Synthetic peptide
  Seed: TLLSLFQSF (MAGC1_HUMAN)
TILSLFQSY

SEQ ID NO: 71737 - protein, 10 aa, Artificial Sequence
  Description of Artificial Sequence: Synthetic peptide
  Seed: MSPLYFPQSP (MAGC1_HUMAN)
MRPLYFPQSV

SEQ ID NO: 71738 - protein, 9 aa, Artificial Sequence
  Description of Artificial Sequence: Synthetic peptide
  Seed: STQSPFEGF (MAGC1_HUMAN)
SSQSPFEGY

SEQ ID NO: 71739 - protein, 9 aa, Artificial Sequence
  Description of Artificial Sequence: Synthetic peptide
  Seed: FSSTLLSIL (MAGC1_HUMAN)
FPSTLLSIV

SEQ ID NO: 71740 - protein, 9 aa, Artificial Sequence
  Description of Artificial Sequence: Synthetic peptide
  Seed: KVVEFLAML (MAGC1_HUMAN)
KRVEFLAMM

SEQ ID NO: 71741 - protein, 11 aa, Artificial Sequence
  Description of Artificial Sequence: Synthetic peptide
  Seed: LQIPVSSSFSY (MAGC1_HUMAN)
LNIPVSSSFSW

SEQ ID NO: 71742 - protein, 9 aa, Artificial Sequence
  Description of Artificial Sequence: Synthetic peptide
  Seed: SFPSSTSSS (MAGC1_HUMAN)
SWPSSTSSF

SEQ ID NO: 71743 - protein, 9 aa, Artificial Sequence
  Description of Artificial Sequence: Synthetic peptide
  Seed: VISRYTGYF (MAGC1_HUMAN)
VVSRYTGYW

SEQ ID NO: 71744 - protein, 9 aa, Artificial Sequence
  Description of Artificial Sequence: Synthetic peptide
  Seed: FQSSPERTH (MAGC1_HUMAN)
FASSPERTI

SEQ ID NO: 71745 - protein, 10 aa, Artificial Sequence
  Description of Artificial Sequence: Synthetic peptide
  Seed: LAMLKNTVPI (MAGC1_HUMAN)
LEMLKNTVPF

SEQ ID NO: 71746 - protein, 9 aa, Artificial Sequence
  Description of Artificial Sequence: Synthetic peptide
  Seed: MTSSFSSTL (MAGC1_HUMAN)
MSSSFSSTR

SEQ ID NO: 71747 - protein, 9 aa, Artificial Sequence
  Description of Artificial Sequence: Synthetic peptide
  Seed: SAQSAFEGF (MAGC1_HUMAN)
SQQSAFEGY

SEQ ID NO: 71748 - protein, 10 aa, Artificial Sequence
  Description of Artificial Sequence: Synthetic peptide
  Seed: LQIPGSPSFS (MAGC1_HUMAN)
LQIPGSPSFY

SEQ ID NO: 71749 - protein, 10 aa, Artificial Sequence
  Description of Artificial Sequence: Synthetic peptide
  Seed: PLQRPVSSFF (MAGC1_HUMAN)
PRQRPVSSFY

SEQ ID NO: 71750 - protein, 11 aa, Artificial Sequence
  Description of Artificial Sequence: Synthetic peptide
  Seed: SASSSVMSPSF (MAGC1_HUMAN)
SASSSVMSPSW

SEQ ID NO: 71751 - protein, 9 aa, Artificial Sequence
  Description of Artificial Sequence: Synthetic peptide
  Seed: YTLASLLQS (MAGC1_HUMAN)
YSLASLLQV

SEQ ID NO: 71752 - protein, 9 aa, Artificial Sequence
  Description of Artificial Sequence: Synthetic peptide
  Seed: FSSTLLSIL (MAGC1_HUMAN)
FCSTLLSIW

SEQ ID NO: 71753 - protein, 10 aa, Artificial Sequence
  Description of Artificial Sequence: Synthetic peptide
  Seed: SLFQSFSERT (MAGC1_HUMAN)
SGFQSFSERR

SEQ ID NO: 71754 - protein, 9 aa, Artificial Sequence
  Description of Artificial Sequence: Synthetic peptide
  Seed: FPSSYKDAL (MAGC1_HUMAN)
FSSSYKDAL

SEQ ID NO: 71755 - protein, 10 aa, Artificial Sequence
  Description of Artificial Sequence: Synthetic peptide
  Seed: REHFAFGEPR (MAGC1_HUMAN)
RIHFAFGEPK

SEQ ID NO: 71756 - protein, 10 aa, Artificial Sequence
  Description of Artificial Sequence: Synthetic peptide
  Seed: DVLSGIGVRA (MAGC1_HUMAN)
DTLSGIGVRL

SEQ ID NO: 71757 - protein, 10 aa, Artificial Sequence
  Description of Artificial Sequence: Synthetic peptide
  Seed: KVVEFLAMLK (MAGC1_HUMAN)
KVVEFLAMLA

SEQ ID NO: 71758 - protein, 9 aa, Artificial Sequence
  Description of Artificial Sequence: Synthetic peptide
  Seed: LQIPGSPSF (MAGC1_HUMAN)
LTIPGSPSW

SEQ ID NO: 71759 - protein, 9 aa, Artificial Sequence
  Description of Artificial Sequence: Synthetic peptide
  Seed: TLVSIFQSS (MAGC1_HUMAN)
TVVSIFQSI

SEQ ID NO: 71760 - protein, 10 aa, Artificial Sequence
  Description of Artificial Sequence: Synthetic peptide
  Seed: SSPESTQSPF (MAGC1_HUMAN)
SIPESTQSPL

SEQ ID NO: 71761 - protein, 9 aa, Artificial Sequence
  Description of Artificial Sequence: Synthetic peptide
  Seed: CSSSTPSSL (MAGC1_HUMAN)
CKSSTPSSY

SEQ ID NO: 71762 - protein, 9 aa, Artificial Sequence
  Description of Artificial Sequence: Synthetic peptide
  Seed: SSFFSSALL (MAGC1_HUMAN)
SSFFSSALA

SEQ ID NO: 71763 - protein, 9 aa, Artificial Sequence
  Description of Artificial Sequence: Synthetic peptide
  Seed: SLIESEPLF (MAGC1_HUMAN)
SYIESEPLL

SEQ ID NO: 71764 - protein, 10 aa, Artificial Sequence
  Description of Artificial Sequence: Synthetic peptide
  Seed: GEDSLSSLHF (MAGC1_HUMAN)
GQDSLSSLHF

SEQ ID NO: 71765 - protein, 10 aa, Artificial Sequence
  Description of Artificial Sequence: Synthetic peptide
  Seed: LSLFQSFSER (MAGC1_HUMAN)
LLLFQSFSER

SEQ ID NO: 71766 - protein, 11 aa, Artificial Sequence
  Description of Artificial Sequence: Synthetic peptide
  Seed: QSSPERTQSTF (MAGC1_HUMAN)
QVSPERTQSTW

SEQ ID NO: 71767 - protein, 9 aa, Artificial Sequence
  Description of Artificial Sequence: Synthetic peptide
  Seed: QSPLQGEEF (MAGC1_HUMAN)
QSPLQGEEL

SEQ ID NO: 71768 - protein, 11 aa, Artificial Sequence
  Description of Artificial Sequence: Synthetic peptide
  Seed: IIDTTDDSTAT (MAGC1_HUMAN)
IMDTTDDSTAF

SEQ ID NO: 71769 - protein, 10 aa, Artificial Sequence
  Description of Artificial Sequence: Synthetic peptide
  Seed: VKQPITKAEM (MAGC1_HUMAN)
VMQPITKAEF

SEQ ID NO: 71770 - protein, 9 aa, Artificial Sequence
  Description of Artificial Sequence: Synthetic peptide
  Seed: LSDEQGMSQ (MAGC1_HUMAN)
LCDEQGMSV

SEQ ID NO: 71771 - protein, 9 aa, Artificial Sequence
  Description of Artificial Sequence: Synthetic peptide
  Seed: GSPSFSSTL (MAGC1_HUMAN)
GYPSFSSTI

SEQ ID NO: 71772 - protein, 9 aa, Artificial Sequence
  Description of Artificial Sequence: Synthetic peptide
  Seed: SPLQIVPSL (MAGC1_HUMAN)
STLQIVPSI

SEQ ID NO: 71773 - protein, 9 aa, Artificial Sequence
  Description of Artificial Sequence: Synthetic peptide
  Seed: SLPEWEDSL (MAGC1_HUMAN)
SYPEWEDSY

SEQ ID NO: 71774 - protein, 9 aa, Artificial Sequence
  Description of Artificial Sequence: Synthetic peptide
  Seed: SLFQSFSER (MAGC1_HUMAN)
SSFQSFSEM

SEQ ID NO: 71775 - protein, 10 aa, Artificial Sequence
  Description of Artificial Sequence: Synthetic peptide
  Seed: FFSYTLASLL (MAGC1_HUMAN)
FSSYTLASLW

SEQ ID NO: 71776 - protein, 10 aa, Artificial Sequence
  Description of Artificial Sequence: Synthetic peptide
  Seed: FAQSSLQIPV (MAGC1_HUMAN)
FYQSSLQIPV

SEQ ID NO: 71777 - protein, 9 aa, Artificial Sequence
  Description of Artificial Sequence: Synthetic peptide
  Seed: MTSSFSSTL (MAGC1_HUMAN)
MPSSFSSTC

SEQ ID NO: 71778 - protein, 10 aa, Artificial Sequence
  Description of Artificial Sequence: Synthetic peptide
  Seed: EVIWDVLSGI (MAGC1_HUMAN)
ETIWDVLSGW

SEQ ID NO: 71779 - protein, 9 aa, Artificial Sequence
  Description of Artificial Sequence: Synthetic peptide
  Seed: MSQNRLLIL (MAGC1_HUMAN)
MVQNRLLIK

SEQ ID NO: 71780 - protein, 9 aa, Artificial Sequence
  Description of Artificial Sequence: Synthetic peptide
  Seed: SQNRLLILI (MAGC1_HUMAN)
SMNRLLILF

SEQ ID NO: 71781 - protein, 9 aa, Artificial Sequence
  Description of Artificial Sequence: Synthetic peptide
  Seed: VSAASSSTL (MAGC1_HUMAN)
VFAASSSTF

SEQ ID NO: 71782 - protein, 9 aa, Artificial Sequence
  Description of Artificial Sequence: Synthetic peptide
  Seed: SKSSPESPL (MAGC1_HUMAN)
SMSSPESPF

SEQ ID NO: 71783 - protein, 10 aa, Artificial Sequence
  Description of Artificial Sequence: Synthetic peptide
  Seed: KAEMLTNVIS (MAGC1_HUMAN)
KIEMLTNVIA

SEQ ID NO: 71784 - protein, 10 aa, Artificial Sequence
  Description of Artificial Sequence: Synthetic peptide
  Seed: MTSSFSSTLL (MAGC1_HUMAN)
MMSSFSSTLN

SEQ ID NO: 71785 - protein, 9 aa, Artificial Sequence
  Description of Artificial Sequence: Synthetic peptide
  Seed: SLIESEPLF (MAGC1_HUMAN)
SMIESEPLR

SEQ ID NO: 71786 - protein, 10 aa, Artificial Sequence
  Description of Artificial Sequence: Synthetic peptide
  Seed: SSSSSTLLSL (MAGC1_HUMAN)
SGSSSTLLSF

SEQ ID NO: 71787 - protein, 9 aa, Artificial Sequence
  Description of Artificial Sequence: Synthetic peptide
  Seed: FFSYTLASL (MAGC1_HUMAN)
FISYTLASL

SEQ ID NO: 71788 - protein, 10 aa, Artificial Sequence
  Description of Artificial Sequence: Synthetic peptide
  Seed: KRKVVEFLAM (MAGC1_HUMAN)
KCKVVEFLAF

SEQ ID NO: 71789 - protein, 9 aa, Artificial Sequence
  Description of Artificial Sequence: Synthetic peptide
  Seed: LQIVPSLPE (MAGC1_HUMAN)
LQIVPSLPY

SEQ ID NO: 71790 - protein, 10 aa, Artificial Sequence
  Description of Artificial Sequence: Synthetic peptide
  Seed: STLLSLFQSF (MAGC1_HUMAN)
SKLLSLFQSY

SEQ ID NO: 71791 - protein, 10 aa, Artificial Sequence
  Description of Artificial Sequence: Synthetic peptide
  Seed: VSSSSSSTLL (MAGC1_HUMAN)
VISSSSSTLY

SEQ ID NO: 71792 - protein, 10 aa, Artificial Sequence
  Description of Artificial Sequence: Synthetic peptide
  Seed: SFPSSTSSSL (MAGC1_HUMAN)
SHPSSTSSSI

SEQ ID NO: 71793 - protein, 10 aa, Artificial Sequence
  Description of Artificial Sequence: Synthetic peptide
  Seed: SPLQSPVSSF (MAGC1_HUMAN)
SPLQSPVSSV

SEQ ID NO: 71794 - protein, 10 aa, Artificial Sequence
  Description of Artificial Sequence: Synthetic peptide
  Seed: FAQSSLQIPV (MAGC1_HUMAN)
FRQSSLQIPL

SEQ ID NO: 71795 - protein, 11 aa, Artificial Sequence
  Description of Artificial Sequence: Synthetic peptide
  Seed: STFEGFAQSPL (MAGC1_HUMAN)
STFEGFAQSPF

SEQ ID NO: 71796 - protein, 9 aa, Artificial Sequence
  Description of Artificial Sequence: Synthetic peptide
  Seed: REVDPDDSY (MAGC1_HUMAN)
RVVDPDDSL

SEQ ID NO: 71797 - protein, 11 aa, Artificial Sequence
  Description of Artificial Sequence: Synthetic peptide
  Seed: RSFSSTLLSIF (MAGC1_HUMAN)
RGFSSTLLSIF

SEQ ID NO: 71798 - protein, 9 aa, Artificial Sequence
  Description of Artificial Sequence: Synthetic peptide
  Seed: SPLQIVPSL (MAGC1_HUMAN)
SSLQIVPSL

SEQ ID NO: 71799 - protein, 9 aa, Artificial Sequence
  Description of Artificial Sequence: Synthetic peptide
  Seed: SQSSPVSSF (MAGC1_HUMAN)
SASSPVSSF

SEQ ID NO: 71800 - protein, 9 aa, Artificial Sequence
  Description of Artificial Sequence: Synthetic peptide
  Seed: LQIPVSRSF (MAGC1_HUMAN)
LIIPVSRSM

SEQ ID NO: 71801 - protein, 9 aa, Artificial Sequence
  Description of Artificial Sequence: Synthetic peptide
  Seed: SFSSTLVSL (MAGC1_HUMAN)
SYSSTLVSI

SEQ ID NO: 71802 - protein, 10 aa, Artificial Sequence
  Description of Artificial Sequence: Synthetic peptide
  Seed: SSPESAQSTF (MAGC1_HUMAN)
SQPESAQSTL

SEQ ID NO: 71803 - protein, 9 aa, Artificial Sequence
  Description of Artificial Sequence: Synthetic peptide
  Seed: RFLLLKYQV (MAGC1_HUMAN)
RYLLLKYQV

SEQ ID NO: 71804 - protein, 9 aa, Artificial Sequence
  Description of Artificial Sequence: Synthetic peptide
  Seed: ALLSIFQSS (MAGC1_HUMAN)
AILSIFQSI

SEQ ID NO: 71805 - protein, 9 aa, Artificial Sequence
  Description of Artificial Sequence: Synthetic peptide
  Seed: TFEGFPQSL (MAGC1_HUMAN)
TYEGFPQSW

SEQ ID NO: 71806 - protein, 9 aa, Artificial Sequence
  Description of Artificial Sequence: Synthetic peptide
  Seed: QVKQPITKA (MAGC1_HUMAN)
QLKQPITKY

SEQ ID NO: 71807 - protein, 9 aa, Artificial Sequence
  Description of Artificial Sequence: Synthetic peptide
  Seed: KAREFIEIL (MAGC1_HUMAN)
KYREFIEIL

SEQ ID NO: 71808 - protein, 9 aa, Artificial Sequence
  Description of Artificial Sequence: Synthetic peptide
  Seed: KVDELARFL (MAGC1_HUMAN)
KGDELARFW

SEQ ID NO: 71809 - protein, 10 aa, Artificial Sequence
  Description of Artificial Sequence: Synthetic peptide
  Seed: YTLDEKVDEL (MAGC1_HUMAN)
YALDEKVDEV

SEQ ID NO: 71810 - protein, 10 aa, Artificial Sequence
  Description of Artificial Sequence: Synthetic peptide
  Seed: MTSSFSSTLL (MAGC1_HUMAN)
MWSSFSSTLV

SEQ ID NO: 71811 - protein, 10 aa, Artificial Sequence
  Description of Artificial Sequence: Synthetic peptide
  Seed: KRKVVEFLAM (MAGC1_HUMAN)
KSKVVEFLAF

SEQ ID NO: 71812 - protein, 10 aa, Artificial Sequence
  Description of Artificial Sequence: Synthetic peptide
  Seed: SSFPSSTSSS (MAGC1_HUMAN)
SAFPSSTSSL

SEQ ID NO: 71813 - protein, 10 aa, Artificial Sequence
  Description of Artificial Sequence: Synthetic peptide
  Seed: ASSFFSSALL (MAGC1_HUMAN)
ANSFFSSALM

SEQ ID NO: 71814 - protein, 10 aa, Artificial Sequence
  Description of Artificial Sequence: Synthetic peptide
  Seed: STFEGFPQSL (MAGC1_HUMAN)
SPFEGFPQSW

SEQ ID NO: 71815 - protein, 10 aa, Artificial Sequence
  Description of Artificial Sequence: Synthetic peptide
  Seed: FFSYTLASLL (MAGC1_HUMAN)
FPSYTLASLW

SEQ ID NO: 71816 - protein, 11 aa, Artificial Sequence
  Description of Artificial Sequence: Synthetic peptide
  Seed: FPQSPLQGEEF (MAGC1_HUMAN)
FPQSPLQGEEM

SEQ ID NO: 71817 - protein, 9 aa, Artificial Sequence
  Description of Artificial Sequence: Synthetic peptide
  Seed: FSSTLVSLF (MAGC1_HUMAN)
FRSTLVSLY

SEQ ID NO: 71818 - protein, 11 aa, Artificial Sequence
  Description of Artificial Sequence: Synthetic peptide
  Seed: IIDTTDDSTAT (MAGC1_HUMAN)
IADTTDDSTAL

SEQ ID NO: 71819 - protein, 9 aa, Artificial Sequence
  Description of Artificial Sequence: Synthetic peptide
  Seed: REVDPDDSY (MAGC1_HUMAN)
RLVDPDDSY

SEQ ID NO: 71820 - protein, 10 aa, Artificial Sequence
  Description of Artificial Sequence: Synthetic peptide
  Seed: FPQSLLQIPM (MAGC1_HUMAN)
FAQSLLQIPW

SEQ ID NO: 71821 - protein, 9 aa, Artificial Sequence
  Description of Artificial Sequence: Synthetic peptide
  Seed: LSDEQGMSQ (MAGC1_HUMAN)
LSDEQGMSY

SEQ ID NO: 71822 - protein, 9 aa, Artificial Sequence
  Description of Artificial Sequence: Synthetic peptide
  Seed: LQIPVSRSF (MAGC1_HUMAN)
LHIPVSRSY

SEQ ID NO: 71823 - protein, 10 aa, Artificial Sequence
  Description of Artificial Sequence: Synthetic peptide
  Seed: VSPSFSSTLV (MAGC1_HUMAN)
VAPSFSSTLM

SEQ ID NO: 71824 - protein, 9 aa, Artificial Sequence
  Description of Artificial Sequence: Synthetic peptide
  Seed: FPVIFRKAR (MAGC1_HUMAN)
FMVIFRKAR

SEQ ID NO: 71825 - protein, 10 aa, Artificial Sequence
  Description of Artificial Sequence: Synthetic peptide
  Seed: FQSSLQSPVS (MAGC1_HUMAN)
FLSSLQSPVT

SEQ ID NO: 71826 - protein, 10 aa, Artificial Sequence
  Description of Artificial Sequence: Synthetic peptide
  Seed: SLIESEPLFT (MAGC1_HUMAN)
SLIESEPLFI

SEQ ID NO: 71827 - protein, 9 aa, Artificial Sequence
  Description of Artificial Sequence: Synthetic peptide
  Seed: LQIPMTSSF (MAGC1_HUMAN)
LTIPMTSSL

SEQ ID NO: 71828 - protein, 11 aa, Artificial Sequence
  Description of Artificial Sequence: Synthetic peptide
  Seed: LQIPVSSSFSY (MAGC1_HUMAN)
LIIPVSSSFSF

SEQ ID NO: 71829 - protein, 9 aa, Artificial Sequence
  Description of Artificial Sequence: Synthetic peptide
  Seed: HFPQSPPEW (MAGC1_HUMAN)
HAPQSPPEL

SEQ ID NO: 71830 - protein, 9 aa, Artificial Sequence
  Description of Artificial Sequence: Synthetic peptide
  Seed: FAFGEPREL (MAGC1_HUMAN)
FQFGEPREW

SEQ ID NO: 71831 - protein, 9 aa, Artificial Sequence
  Description of Artificial Sequence: Synthetic peptide
  Seed: FSSTLLSIL (MAGC1_HUMAN)
FTSTLLSIV

SEQ ID NO: 71832 - protein, 10 aa, Artificial Sequence
  Description of Artificial Sequence: Synthetic peptide
  Seed: WGPRAHSEVI (MAGC1_HUMAN)
WEPRAHSEVF

SEQ ID NO: 71833 - protein, 10 aa, Artificial Sequence
  Description of Artificial Sequence: Synthetic peptide
  Seed: SLQIPVSPSF (MAGC1_HUMAN)
SKQIPVSPSY

SEQ ID NO: 71834 - protein, 10 aa, Artificial Sequence
  Description of Artificial Sequence: Synthetic peptide
  Seed: REVPNSSPPR (MAGC1_HUMAN)
RYVPNSSPPR

SEQ ID NO: 71835 - protein, 9 aa, Artificial Sequence
  Description of Artificial Sequence: Synthetic peptide
  Seed: GFPQSPLQI (MAGC1_HUMAN)
GWPQSPLQF

SEQ ID NO: 71836 - protein, 10 aa, Artificial Sequence
  Description of Artificial Sequence: Synthetic peptide
  Seed: TTDDSTATES (MAGC1_HUMAN)
TLDDSTATEI

SEQ ID NO: 71837 - protein, 9 aa, Artificial Sequence
  Description of Artificial Sequence: Synthetic peptide
  Seed: IESEPLFTY (MAGC1_HUMAN)
IHSEPLFTY

SEQ ID NO: 71838 - protein, 9 aa, Artificial Sequence
  Description of Artificial Sequence: Synthetic peptide
  Seed: SPLQIPGSP (MAGC1_HUMAN)
SALQIPGSA

SEQ ID NO: 71839 - protein, 9 aa, Artificial Sequence
  Description of Artificial Sequence: Synthetic peptide
  Seed: FSYTLASLL (MAGC1_HUMAN)
FSYTLASLI

SEQ ID NO: 71840 - protein, 10 aa, Artificial Sequence
  Description of Artificial Sequence: Synthetic peptide
  Seed: DMPTAGMPSL (MAGC1_HUMAN)
DTPTAGMPSV

SEQ ID NO: 71841 - protein, 10 aa, Artificial Sequence
  Description of Artificial Sequence: Synthetic peptide
  Seed: RAGREHFAFG (MAGC1_HUMAN)
RFGREHFAFK

SEQ ID NO: 71842 - protein, 10 aa, Artificial Sequence
  Description of Artificial Sequence: Synthetic peptide
  Seed: VSSSSSSSTL (MAGC1_HUMAN)
VLSSSSSSTF

SEQ ID NO: 71843 - protein, 11 aa, Artificial Sequence
  Description of Artificial Sequence: Synthetic peptide
  Seed: SICSSSTSLSL (MAGC1_HUMAN)
SACSSSTSLSL

SEQ ID NO: 71844 - protein, 9 aa, Artificial Sequence
  Description of Artificial Sequence: Synthetic peptide
  Seed: YQVKQPITK (MAGC1_HUMAN)
YVVKQPITI

SEQ ID NO: 71845 - protein, 9 aa, Artificial Sequence
  Description of Artificial Sequence: Synthetic peptide
  Seed: IIFIKGTYA (MAGC1_HUMAN)
IVFIKGTYK

SEQ ID NO: 71846 - protein, 11 aa, Artificial Sequence
  Description of Artificial Sequence: Synthetic peptide
  Seed: TTDDSTATESA (MAGC1_HUMAN)
TMDDSTATESV

SEQ ID NO: 71847 - protein, 10 aa, Artificial Sequence
  Description of Artificial Sequence: Synthetic peptide
  Seed: SSSSTLLSLF (MAGC1_HUMAN)
SSSSTLLSLW

SEQ ID NO: 71848 - protein, 10 aa, Artificial Sequence
  Description of Artificial Sequence: Synthetic peptide
  Seed: IPVSRSFSST (MAGC1_HUMAN)
IPVSRSFSSA

SEQ ID NO: 71849 - protein, 9 aa, Artificial Sequence
  Description of Artificial Sequence: Synthetic peptide
  Seed: SSPESPLQS (MAGC1_HUMAN)
SLPESPLQL

SEQ ID NO: 71850 - protein, 9 aa, Artificial Sequence
  Description of Artificial Sequence: Synthetic peptide
  Seed: TLDEKVDEL (MAGC1_HUMAN)
TYDEKVDEI

SEQ ID NO: 71851 - protein, 9 aa, Artificial Sequence
  Description of Artificial Sequence: Synthetic peptide
  Seed: TSLSLPQSF (MAGC1_HUMAN)
TVLSLPQSY

SEQ ID NO: 71852 - protein, 11 aa, Artificial Sequence
  Description of Artificial Sequence: Synthetic peptide
  Seed: IPVSRSFSSTL (MAGC1_HUMAN)
IDVSRSFSSTW

SEQ ID NO: 71853 - protein, 9 aa, Artificial Sequence
  Description of Artificial Sequence: Synthetic peptide
  Seed: IPMTSSFSS (MAGC1_HUMAN)
ITMTSSFSM

SEQ ID NO: 71854 - protein, 11 aa, Artificial Sequence
  Description of Artificial Sequence: Synthetic peptide
  Seed: STFEGFPQSLL (MAGC1_HUMAN)
SQFEGFPQSLA

SEQ ID NO: 71855 - protein, 10 aa, Artificial Sequence
  Description of Artificial Sequence: Synthetic peptide
  Seed: MPTAGMPSLL (MAGC1_HUMAN)
MKTAGMPSLY

SEQ ID NO: 71856 - protein, 9 aa, Artificial Sequence
  Description of Artificial Sequence: Synthetic peptide
  Seed: SFSSTLVSL (MAGC1_HUMAN)
SRSSTLVSY

SEQ ID NO: 71857 - protein, 9 aa, Artificial Sequence
  Description of Artificial Sequence: Synthetic peptide
  Seed: VQEHYLEYR (MAGC1_HUMAN)
VAEHYLEYY

SEQ ID NO: 71858 - protein, 11 aa, Artificial Sequence
  Description of Artificial Sequence: Synthetic peptide
  Seed: SLHFPQSPPEW (MAGC1_HUMAN)
STHFPQSPPEW

SEQ ID NO: 71859 - protein, 11 aa, Artificial Sequence
  Description of Artificial Sequence: Synthetic peptide
  Seed: MSPLYFPQSPL (MAGC1_HUMAN)
MQPLYFPQSPV

SEQ ID NO: 71860 - protein, 9 aa, Artificial Sequence
  Description of Artificial Sequence: Synthetic peptide
  Seed: SLTDSESLI (MAGC1_HUMAN)
SITDSESLV

SEQ ID NO: 71861 - protein, 10 aa, Artificial Sequence
  Description of Artificial Sequence: Synthetic peptide
  Seed: SIFQSSPESA (MAGC1_HUMAN)
SAFQSSPESV

SEQ ID NO: 71862 - protein, 9 aa, Artificial Sequence
  Description of Artificial Sequence: Synthetic peptide
  Seed: SPPEGENTH (MAGC1_HUMAN)
SVPEGENTF

SEQ ID NO: 71863 - protein, 9 aa, Artificial Sequence
  Description of Artificial Sequence: Synthetic peptide
  Seed: SLPEWEDSL (MAGC1_HUMAN)
SMPEWEDSM

SEQ ID NO: 71864 - protein, 10 aa, Artificial Sequence
  Description of Artificial Sequence: Synthetic peptide
  Seed: MTSSFSSTLL (MAGC1_HUMAN)
MFSSFSSTLL

SEQ ID NO: 71865 - protein, 9 aa, Artificial Sequence
  Description of Artificial Sequence: Synthetic peptide
  Seed: VQSPLQNPA (MAGC1_HUMAN)
VLSPLQNPF

SEQ ID NO: 71866 - protein, 9 aa, Artificial Sequence
  Description of Artificial Sequence: Synthetic peptide
  Seed: SLIESEPLF (MAGC1_HUMAN)
SAIESEPLF

SEQ ID NO: 71867 - protein, 10 aa, Artificial Sequence
  Description of Artificial Sequence: Synthetic peptide
  Seed: GEDSSDPLQR (MAGC1_HUMAN)
GEDSSDPLQA

SEQ ID NO: 71868 - protein, 9 aa, Artificial Sequence
  Description of Artificial Sequence: Synthetic peptide
  Seed: SLPEWEDSL (MAGC1_HUMAN)
STPEWEDSL

SEQ ID NO: 71869 - protein, 9 aa, Artificial Sequence
  Description of Artificial Sequence: Synthetic peptide
  Seed: RPVSSFFSY (MAGC1_HUMAN)
RCVSSFFSF

SEQ ID NO: 71870 - protein, 9 aa, Artificial Sequence
  Description of Artificial Sequence: Synthetic peptide
  Seed: GFPQSVLQI (MAGC1_HUMAN)
GWPQSVLQW

SEQ ID NO: 71871 - protein, 10 aa, Artificial Sequence
  Description of Artificial Sequence: Synthetic peptide
  Seed: VSSSFSYTLL (MAGC1_HUMAN)
VESSFSYTLW

SEQ ID NO: 71872 - protein, 10 aa, Artificial Sequence
  Description of Artificial Sequence: Synthetic peptide
  Seed: LQIPVSSSFS (MAGC1_HUMAN)
LMIPVSSSFI

SEQ ID NO: 71873 - protein, 11 aa, Artificial Sequence
  Description of Artificial Sequence: Synthetic peptide
  Seed: QSSPESAQSTF (MAGC1_HUMAN)
QMSPESAQSTF

SEQ ID NO: 71874 - protein, 9 aa, Artificial Sequence
  Description of Artificial Sequence: Synthetic peptide
  Seed: WVQEHYLEY (MAGC1_HUMAN)
WSQEHYLEY

SEQ ID NO: 71875 - protein, 9 aa, Artificial Sequence
  Description of Artificial Sequence: Synthetic peptide
  Seed: FAFGEPREL (MAGC1_HUMAN)
FFFGEPREI

SEQ ID NO: 71876 - protein, 11 aa, Artificial Sequence
  Description of Artificial Sequence: Synthetic peptide
  Seed: LQIPVSSSFSY (MAGC1_HUMAN)
LKIPVSSSFSY

SEQ ID NO: 71877 - protein, 10 aa, Artificial Sequence
  Description of Artificial Sequence: Synthetic peptide
  Seed: SSFSSTLLSI (MAGC1_HUMAN)
SQFSSTLLSI

SEQ ID NO: 71878 - protein, 11 aa, Artificial Sequence
  Description of Artificial Sequence: Synthetic peptide
  Seed: QSSPESAQSTF (MAGC1_HUMAN)
QISPESAQSTY

SEQ ID NO: 71879 - protein, 10 aa, Artificial Sequence
  Description of Artificial Sequence: Synthetic peptide
  Seed: VISFSSSTSL (MAGC1_HUMAN)
VCSFSSSTSL

SEQ ID NO: 71880 - protein, 10 aa, Artificial Sequence
  Description of Artificial Sequence: Synthetic peptide
  Seed: YTLASLLQSS (MAGC1_HUMAN)
YWLASLLQSI

SEQ ID NO: 71881 - protein, 9 aa, Artificial Sequence
  Description of Artificial Sequence: Synthetic peptide
  Seed: YFPVIFRKA (MAGC1_HUMAN)
YYPVIFRKY

SEQ ID NO: 71882 - protein, 9 aa, Artificial Sequence
  Description of Artificial Sequence: Synthetic peptide
  Seed: SSPPRYEFL (MAGC1_HUMAN)
SEPPRYEFL

SEQ ID NO: 71883 - protein, 9 aa, Artificial Sequence
  Description of Artificial Sequence: Synthetic peptide
  Seed: EDSLSPHYF (MAGC1_HUMAN)
EESLSPHYM

SEQ ID NO: 71884 - protein, 11 aa, Artificial Sequence
  Description of Artificial Sequence: Synthetic peptide
  Seed: SFFSSALLSIF (MAGC1_HUMAN)
SFFSSALLSIY

SEQ ID NO: 71885 - protein, 8 aa, Artificial Sequence
  Description of Artificial Sequence: Synthetic peptide
  Seed: SPLQSPES (MAGC1_HUMAN)
SPLQSPEA

SEQ ID NO: 71886 - protein, 10 aa, Artificial Sequence
  Description of Artificial Sequence: Synthetic peptide
  Seed: RTHSTFEGFP (MAGC1_HUMAN)
RSHSTFEGFK

SEQ ID NO: 71887 - protein, 9 aa, Artificial Sequence
  Description of Artificial Sequence: Synthetic peptide
  Seed: FSSTLLSLF (MAGC1_HUMAN)
FRSTLLSLI

SEQ ID NO: 71888 - protein, 9 aa, Artificial Sequence
  Description of Artificial Sequence: Synthetic peptide
  Seed: FSSALLSIF (MAGC1_HUMAN)
FTSALLSIM

SEQ ID NO: 71889 - protein, 11 aa, Artificial Sequence
  Description of Artificial Sequence: Synthetic peptide
  Seed: SSTSLSLPQSF (MAGC1_HUMAN)
SATSLSLPQSW

SEQ ID NO: 71890 - protein, 10 aa, Artificial Sequence
  Description of Artificial Sequence: Synthetic peptide
  Seed: ASSSTLVSIF (MAGC1_HUMAN)
AYSSTLVSIW

SEQ ID NO: 71891 - protein, 9 aa, Artificial Sequence
  Description of Artificial Sequence: Synthetic peptide
  Seed: FEGFPQSVL (MAGC1_HUMAN)
FEGFPQSVA

SEQ ID NO: 71892 - protein, 10 aa, Artificial Sequence
  Description of Artificial Sequence: Synthetic peptide
  Seed: SSSSSTLLSL (MAGC1_HUMAN)
SNSSSTLLSY

SEQ ID NO: 71893 - protein, 9 aa, Artificial Sequence
  Description of Artificial Sequence: Synthetic peptide
  Seed: TLDEKVDEL (MAGC1_HUMAN)
TTDEKVDEI

SEQ ID NO: 71894 - protein, 10 aa, Artificial Sequence
  Description of Artificial Sequence: Synthetic peptide
  Seed: SRYTGYFPVI (MAGC1_HUMAN)
SKYTGYFPVW

SEQ ID NO: 71895 - protein, 9 aa, Artificial Sequence
  Description of Artificial Sequence: Synthetic peptide
  Seed: SESPQSCPE (MAGC1_HUMAN)
SESPQSCPL

SEQ ID NO: 71896 - protein, 9 aa, Artificial Sequence
  Description of Artificial Sequence: Synthetic peptide
  Seed: SICSSSTSL (MAGC1_HUMAN)
SLCSSSTSF

SEQ ID NO: 71897 - protein, 9 aa, Artificial Sequence
  Description of Artificial Sequence: Synthetic peptide
  Seed: SPLQRPVSS (MAGC1_HUMAN)
SSLQRPVSM

SEQ ID NO: 71898 - protein, 9 aa, Artificial Sequence
  Description of Artificial Sequence: Synthetic peptide
  Seed: SMSPLYFPQ (MAGC1_HUMAN)
STSPLYFPR

SEQ ID NO: 71899 - protein, 11 aa, Artificial Sequence
  Description of Artificial Sequence: Synthetic peptide
  Seed: ITFPSSYKDAL (MAGC1_HUMAN)
IGFPSSYKDAW

SEQ ID NO: 71900 - protein, 11 aa, Artificial Sequence
  Description of Artificial Sequence: Synthetic peptide
  Seed: AMLKNTVPITF (MAGC1_HUMAN)
AALKNTVPITW

SEQ ID NO: 71901 - protein, 9 aa, Artificial Sequence
  Description of Artificial Sequence: Synthetic peptide
  Seed: FSSTLVSLF (MAGC1_HUMAN)
FLSTLVSLF

SEQ ID NO: 71902 - protein, 9 aa, Artificial Sequence
  Description of Artificial Sequence: Synthetic peptide
  Seed: VSRSFSSTL (MAGC1_HUMAN)
VVRSFSSTM

SEQ ID NO: 71903 - protein, 9 aa, Artificial Sequence
  Description of Artificial Sequence: Synthetic peptide
  Seed: YTSSSDTLL (MAGC1_HUMAN)
YISSSDTLA

SEQ ID NO: 71904 - protein, 10 aa, Artificial Sequence
  Description of Artificial Sequence: Synthetic peptide
  Seed: SSFSSTLLSI (MAGC1_HUMAN)
STFSSTLLSM

SEQ ID NO: 71905 - protein, 9 aa, Artificial Sequence
  Description of Artificial Sequence: Synthetic peptide
  Seed: STFEGFPQS (MAGC1_HUMAN)
SPFEGFPQC

SEQ ID NO: 71906 - protein, 11 aa, Artificial Sequence
  Description of Artificial Sequence: Synthetic peptide
  Seed: SPLQIPVSPSS (MAGC1_HUMAN)
SDLQIPVSPSY

SEQ ID NO: 71907 - protein, 10 aa, Artificial Sequence
  Description of Artificial Sequence: Synthetic peptide
  Seed: TTDDSTATES (MAGC1_HUMAN)
TADDSTATEF

SEQ ID NO: 71908 - protein, 9 aa, Artificial Sequence
  Description of Artificial Sequence: Synthetic peptide
  Seed: ISRYTGYFP (MAGC1_HUMAN)
ISRYTGYFS

SEQ ID NO: 71909 - protein, 9 aa, Artificial Sequence
  Description of Artificial Sequence: Synthetic peptide
  Seed: TLLSILQSS (MAGC1_HUMAN)
TQLSILQSV

SEQ ID NO: 71910 - protein, 10 aa, Artificial Sequence
  Description of Artificial Sequence: Synthetic peptide
  Seed: SSFPSSTSSS (MAGC1_HUMAN)
SSFPSSTSSH

SEQ ID NO: 71911 - protein, 9 aa, Artificial Sequence
  Description of Artificial Sequence: Synthetic peptide
  Seed: IPVSSSFSY (MAGC1_HUMAN)
IKVSSSFSL

SEQ ID NO: 71912 - protein, 10 aa, Artificial Sequence
  Description of Artificial Sequence: Synthetic peptide
  Seed: NTVPITFPSS (MAGC1_HUMAN)
NAVPITFPSA

SEQ ID NO: 71913 - protein, 11 aa, Artificial Sequence
  Description of Artificial Sequence: Synthetic peptide
  Seed: STFEGFPQSLL (MAGC1_HUMAN)
SAFEGFPQSLF

SEQ ID NO: 71914 - protein, 9 aa, Artificial Sequence
  Description of Artificial Sequence: Synthetic peptide
  Seed: FQSSLQSPV (MAGC1_HUMAN)
FASSLQSPI

SEQ ID NO: 71915 - protein, 9 aa, Artificial Sequence
  Description of Artificial Sequence: Synthetic peptide
  Seed: LSDEQGMSQ (MAGC1_HUMAN)
LIDEQGMSF

SEQ ID NO: 71916 - protein, 9 aa, Artificial Sequence
  Description of Artificial Sequence: Synthetic peptide
  Seed: FPSSTSSSL (MAGC1_HUMAN)
FVSSTSSSF

SEQ ID NO: 71917 - protein, 10 aa, Artificial Sequence
  Description of Artificial Sequence: Synthetic peptide
  Seed: TTDDSTATES (MAGC1_HUMAN)
TADDSTATEI

SEQ ID NO: 71918 - protein, 11 aa, Artificial Sequence
  Description of Artificial Sequence: Synthetic peptide
  Seed: RYTGYFPVIFR (MAGC1_HUMAN)
RYTGYFPVIFM

SEQ ID NO: 71919 - protein, 10 aa, Artificial Sequence
  Description of Artificial Sequence: Synthetic peptide
  Seed: ESEPLFTYTL (MAGC1_HUMAN)
EIEPLFTYTV

SEQ ID NO: 71920 - protein, 9 aa, Artificial Sequence
  Description of Artificial Sequence: Synthetic peptide
  Seed: FSYTLASLL (MAGC1_HUMAN)
FVYTLASLY

SEQ ID NO: 71921 - protein, 9 aa, Artificial Sequence
  Description of Artificial Sequence: Synthetic peptide
  Seed: FPSSTSSSL (MAGC1_HUMAN)
FWSSTSSSI

SEQ ID NO: 71922 - protein, 8 aa, Artificial Sequence
  Description of Artificial Sequence: Synthetic peptide
  Seed: LYFPQSPL (MAGC1_HUMAN)
LYFPQSPY

SEQ ID NO: 71923 - protein, 10 aa, Artificial Sequence
  Description of Artificial Sequence: Synthetic peptide
  Seed: LAMLKNTVPI (MAGC1_HUMAN)
LMMLKNTVPY

SEQ ID NO: 71924 - protein, 9 aa, Artificial Sequence
  Description of Artificial Sequence: Synthetic peptide
  Seed: FAFGEPREL (MAGC1_HUMAN)
FRFGEPREV

SEQ ID NO: 71925 - protein, 10 aa, Artificial Sequence
  Description of Artificial Sequence: Synthetic peptide
  Seed: SPLQSPVISF (MAGC1_HUMAN)
SSLQSPVISY

SEQ ID NO: 71926 - protein, 9 aa, Artificial Sequence
  Description of Artificial Sequence: Synthetic peptide
  Seed: TESASSSVM (MAGC1_HUMAN)
TASASSSVM

SEQ ID NO: 71927 - protein, 10 aa, Artificial Sequence
  Description of Artificial Sequence: Synthetic peptide
  Seed: FSSSTSLSPF (MAGC1_HUMAN)
FESSTSLSPF

SEQ ID NO: 71928 - protein, 10 aa, Artificial Sequence
  Description of Artificial Sequence: Synthetic peptide
  Seed: KVDELARFLL (MAGC1_HUMAN)
KIDELARFLI

SEQ ID NO: 71929 - protein, 10 aa, Artificial Sequence
  Description of Artificial Sequence: Synthetic peptide
  Seed: YTLDEKVDEL (MAGC1_HUMAN)
YHLDEKVDEV

SEQ ID NO: 71930 - protein, 10 aa, Artificial Sequence
  Description of Artificial Sequence: Synthetic peptide
  Seed: SFSSTLLSIF (MAGC1_HUMAN)
SKSSTLLSIM

SEQ ID NO: 71931 - protein, 8 aa, Artificial Sequence
  Description of Artificial Sequence: Synthetic peptide
  Seed: LQSPVISF (MAGC1_HUMAN)
LMSPVISY

SEQ ID NO: 71932 - protein, 9 aa, Artificial Sequence
  Description of Artificial Sequence: Synthetic peptide
  Seed: FSSTLVSLF (MAGC1_HUMAN)
FISTLVSLM

SEQ ID NO: 71933 - protein, 10 aa, Artificial Sequence
  Description of Artificial Sequence: Synthetic peptide
  Seed: LQIPVSRSFS (MAGC1_HUMAN)
LMIPVSRSFF

SEQ ID NO: 71934 - protein, 9 aa, Artificial Sequence
  Description of Artificial Sequence: Synthetic peptide
  Seed: SQSPPEGPV (MAGC1_HUMAN)
SQSPPEGPF

SEQ ID NO: 71935 - protein, 9 aa, Artificial Sequence
  Description of Artificial Sequence: Synthetic peptide
  Seed: MSQNRLLIL (MAGC1_HUMAN)
MTQNRLLIY

SEQ ID NO: 71936 - protein, 9 aa, Artificial Sequence
  Description of Artificial Sequence: Synthetic peptide
  Seed: FSYTLASLL (MAGC1_HUMAN)
FVYTLASLW

SEQ ID NO: 71937 - protein, 10 aa, Artificial Sequence
  Description of Artificial Sequence: Synthetic peptide
  Seed: ICSSSTPSSL (MAGC1_HUMAN)
IQSSSTPSSW

SEQ ID NO: 71938 - protein, 9 aa, Artificial Sequence
  Description of Artificial Sequence: Synthetic peptide
  Seed: SQSPPEGPV (MAGC1_HUMAN)
SESPPEGPT

SEQ ID NO: 71939 - protein, 10 aa, Artificial Sequence
  Description of Artificial Sequence: Synthetic peptide
  Seed: FPQSLLQIPM (MAGC1_HUMAN)
FAQSLLQIPY

SEQ ID NO: 71940 - protein, 9 aa, Artificial Sequence
  Description of Artificial Sequence: Synthetic peptide
  Seed: FQSSPERTH (MAGC1_HUMAN)
FESSPERTY

SEQ ID NO: 71941 - protein, 10 aa, Artificial Sequence
  Description of Artificial Sequence: Synthetic peptide
  Seed: FQSSLQSPVS (MAGC1_HUMAN)
FMSSLQSPVW

SEQ ID NO: 71942 - protein, 9 aa, Artificial Sequence
  Description of Artificial Sequence: Synthetic peptide
  Seed: MPTAGMPSL (MAGC1_HUMAN)
MMTAGMPSM

SEQ ID NO: 71943 - protein, 10 aa, Artificial Sequence
  Description of Artificial Sequence: Synthetic peptide
  Seed: REFIEILFGI (MAGC1_HUMAN)
RVFIEILFGA

SEQ ID NO: 71944 - protein, 10 aa, Artificial Sequence
  Description of Artificial Sequence: Synthetic peptide
  Seed: MLKNTVPITF (MAGC1_HUMAN)
MLKNTVPITY

SEQ ID NO: 71945 - protein, 9 aa, Artificial Sequence
  Description of Artificial Sequence: Synthetic peptide
  Seed: IPMTSSFSS (MAGC1_HUMAN)
IPMTSSFSY

SEQ ID NO: 71946 - protein, 9 aa, Artificial Sequence
  Description of Artificial Sequence: Synthetic peptide
  Seed: IESEPLFTY (MAGC1_HUMAN)
ISSEPLFTF

SEQ ID NO: 71947 - protein, 9 aa, Artificial Sequence
  Description of Artificial Sequence: Synthetic peptide
  Seed: STFEGFAQS (MAGC1_HUMAN)
SMFEGFAQF

SEQ ID NO: 71948 - protein, 10 aa, Artificial Sequence
  Description of Artificial Sequence: Synthetic peptide
  Seed: RKAREFIEIL (MAGC1_HUMAN)
RRAREFIEIF

SEQ ID NO: 71949 - protein, 9 aa, Artificial Sequence
  Description of Artificial Sequence: Synthetic peptide
  Seed: SEESSSPVD (MAGC1_HUMAN)
SEESSSPVP

SEQ ID NO: 71950 - protein, 10 aa, Artificial Sequence
  Description of Artificial Sequence: Synthetic peptide
  Seed: RAGREHFAFG (MAGC1_HUMAN)
RTGREHFAFN

SEQ ID NO: 71951 - protein, 9 aa, Artificial Sequence
  Description of Artificial Sequence: Synthetic peptide
  Seed: YTLASLLQS (MAGC1_HUMAN)
YMLASLLQT

SEQ ID NO: 71952 - protein, 10 aa, Artificial Sequence
  Description of Artificial Sequence: Synthetic peptide
  Seed: IEILFGISLR (MAGC1_HUMAN)
IYILFGISLR

SEQ ID NO: 71953 - protein, 9 aa, Artificial Sequence
  Description of Artificial Sequence: Synthetic peptide
  Seed: ISFSSSTSL (MAGC1_HUMAN)
IHFSSSTSM

SEQ ID NO: 71954 - protein, 9 aa, Artificial Sequence
  Description of Artificial Sequence: Synthetic peptide
  Seed: SQNRLLILI (MAGC1_HUMAN)
SENRLLILL

SEQ ID NO: 71955 - protein, 11 aa, Artificial Sequence
  Description of Artificial Sequence: Synthetic peptide
  Seed: SFFSSALLSIF (MAGC1_HUMAN)
STFSSALLSIY

SEQ ID NO: 71956 - protein, 9 aa, Artificial Sequence
  Description of Artificial Sequence: Synthetic peptide
  Seed: FFSYTLASL (MAGC1_HUMAN)
FSSYTLASY

SEQ ID NO: 71957 - protein, 9 aa, Artificial Sequence
  Description of Artificial Sequence: Synthetic peptide
  Seed: FLAMLKNTV (MAGC1_HUMAN)
FLAMLKNTM

SEQ ID NO: 71958 - protein, 9 aa, Artificial Sequence
  Description of Artificial Sequence: Synthetic peptide
  Seed: ALKDVEERA (MAGC1_HUMAN)
ALKDVEERV

SEQ ID NO: 71959 - protein, 9 aa, Artificial Sequence
  Description of Artificial Sequence: Synthetic peptide
  Seed: VQEHYLEYR (MAGC1_HUMAN)
VVEHYLEYR

SEQ ID NO: 71960 - protein, 11 aa, Artificial Sequence
  Description of Artificial Sequence: Synthetic peptide
  Seed: SSFPSSTSSSL (MAGC1_HUMAN)
SLFPSSTSSSI

SEQ ID NO: 71961 - protein, 9 aa, Artificial Sequence
  Description of Artificial Sequence: Synthetic peptide
  Seed: FPQSPPQGE (MAGC1_HUMAN)
FPQSPPQGI

SEQ ID NO: 71962 - protein, 10 aa, Artificial Sequence
  Description of Artificial Sequence: Synthetic peptide
  Seed: LQIVPSLPEW (MAGC1_HUMAN)
LSIVPSLPEM

SEQ ID NO: 71963 - protein, 11 aa, Artificial Sequence
  Description of Artificial Sequence: Synthetic peptide
  Seed: SSFPSSTSSSL (MAGC1_HUMAN)
SMFPSSTSSSY

SEQ ID NO: 71964 - protein, 9 aa, Artificial Sequence
  Description of Artificial Sequence: Synthetic peptide
  Seed: TLVSIFQSS (MAGC1_HUMAN)
TVVSIFQSL

SEQ ID NO: 71965 - protein, 9 aa, Artificial Sequence
  Description of Artificial Sequence: Synthetic peptide
  Seed: VSSSFSYTL (MAGC1_HUMAN)
VGSSFSYTW

SEQ ID NO: 71966 - protein, 10 aa, Artificial Sequence
  Description of Artificial Sequence: Synthetic peptide
  Seed: FAFGEPRELL (MAGC1_HUMAN)
FLFGEPRELV

SEQ ID NO: 71967 - protein, 10 aa, Artificial Sequence
  Description of Artificial Sequence: Synthetic peptide
  Seed: KVDELARFLL (MAGC1_HUMAN)
KMDELARFLI

SEQ ID NO: 71968 - protein, 8 aa, Artificial Sequence
  Description of Artificial Sequence: Synthetic peptide
  Seed: SYVFVNTL (MAGC1_HUMAN)
SYVFVNTM

SEQ ID NO: 71969 - protein, 9 aa, Artificial Sequence
  Description of Artificial Sequence: Synthetic peptide
  Seed: SSFFSSALL (MAGC1_HUMAN)
STFFSSALW

SEQ ID NO: 71970 - protein, 10 aa, Artificial Sequence
  Description of Artificial Sequence: Synthetic peptide
  Seed: RAGREHFAFG (MAGC1_HUMAN)
RVGREHFAFV

SEQ ID NO: 71971 - protein, 9 aa, Artificial Sequence
  Description of Artificial Sequence: Synthetic peptide
  Seed: FSERTQSTF (MAGC1_HUMAN)
FQERTQSTM

SEQ ID NO: 71972 - protein, 9 aa, Artificial Sequence
  Description of Artificial Sequence: Synthetic peptide
  Seed: SSSSTLLSL (MAGC1_HUMAN)
SFSSTLLSF

SEQ ID NO: 71973 - protein, 10 aa, Artificial Sequence
  Description of Artificial Sequence: Synthetic peptide
  Seed: SFFSSALLSI (MAGC1_HUMAN)
SFFSSALLSF

SEQ ID NO: 71974 - protein, 9 aa, Artificial Sequence
  Description of Artificial Sequence: Synthetic peptide
  Seed: LQSPVISFS (MAGC1_HUMAN)
LLSPVISFI

SEQ ID NO: 71975 - protein, 9 aa, Artificial Sequence
  Description of Artificial Sequence: Synthetic peptide
  Seed: FPVIFRKAR (MAGC1_HUMAN)
FPVIFRKAA

SEQ ID NO: 71976 - protein, 9 aa, Artificial Sequence
  Description of Artificial Sequence: Synthetic peptide
  Seed: SSPEGKDSL (MAGC1_HUMAN)
SSPEGKDSM

SEQ ID NO: 71977 - protein, 11 aa, Artificial Sequence
  Description of Artificial Sequence: Synthetic peptide
  Seed: QSSPESAQSTF (MAGC1_HUMAN)
QQSPESAQSTW

SEQ ID NO: 71978 - protein, 8 aa, Artificial Sequence
  Description of Artificial Sequence: Synthetic peptide
  Seed: SFSSSTSL (MAGC1_HUMAN)
SFSSSTSF

SEQ ID NO: 71979 - protein, 10 aa, Artificial Sequence
  Description of Artificial Sequence: Synthetic peptide
  Seed: FPQSVLQIPV (MAGC1_HUMAN)
FQQSVLQIPV

SEQ ID NO: 71980 - protein, 9 aa, Artificial Sequence
  Description of Artificial Sequence: Synthetic peptide
  Seed: FSSALLSIF (MAGC1_HUMAN)
FTSALLSIY

SEQ ID NO: 71981 - protein, 10 aa, Artificial Sequence
  Description of Artificial Sequence: Synthetic peptide
  Seed: DVLSGIGVRA (MAGC1_HUMAN)
DTLSGIGVRM

SEQ ID NO: 71982 - protein, 9 aa, Artificial Sequence
  Description of Artificial Sequence: Synthetic peptide
  Seed: CSSSTSLSL (MAGC1_HUMAN)
CRSSTSLSF

SEQ ID NO: 71983 - protein, 10 aa, Artificial Sequence
  Description of Artificial Sequence: Synthetic peptide
  Seed: FPQSPLQIPV (MAGC1_HUMAN)
FQQSPLQIPA

SEQ ID NO: 71984 - protein, 9 aa, Artificial Sequence
  Description of Artificial Sequence: Synthetic peptide
  Seed: RAGREHFAF (MAGC1_HUMAN)
RQGREHFAM

SEQ ID NO: 71985 - protein, 10 aa, Artificial Sequence
  Description of Artificial Sequence: Synthetic peptide
  Seed: RAGREHFAFG (MAGC1_HUMAN)
RQGREHFAFV

SEQ ID NO: 71986 - protein, 9 aa, Artificial Sequence
  Description of Artificial Sequence: Synthetic peptide
  Seed: SPVSSFPSS (MAGC1_HUMAN)
SSVSSFPSY

SEQ ID NO: 71987 - protein, 9 aa, Artificial Sequence
  Description of Artificial Sequence: Synthetic peptide
  Seed: EFIEILFGI (MAGC1_HUMAN)
EMIEILFGM

SEQ ID NO: 71988 - protein, 9 aa, Artificial Sequence
  Description of Artificial Sequence: Synthetic peptide
  Seed: MSQNRLLIL (MAGC1_HUMAN)
MTQNRLLIV

SEQ ID NO: 71989 - protein, 9 aa, Artificial Sequence
  Description of Artificial Sequence: Synthetic peptide
  Seed: MLTNVISRY (MAGC1_HUMAN)
MTTNVISRW

SEQ ID NO: 71990 - protein, 10 aa, Artificial Sequence
  Description of Artificial Sequence: Synthetic peptide
  Seed: YTLASLLQSS (MAGC1_HUMAN)
YNLASLLQSI

SEQ ID NO: 71991 - protein, 9 aa, Artificial Sequence
  Description of Artificial Sequence: Synthetic peptide
  Seed: FFSYTLASL (MAGC1_HUMAN)
FGSYTLASM

SEQ ID NO: 71992 - protein, 11 aa, Artificial Sequence
  Description of Artificial Sequence: Synthetic peptide
  Seed: ISRYTGYFPVI (MAGC1_HUMAN)
ITRYTGYFPVF

SEQ ID NO: 71993 - protein, 10 aa, Artificial Sequence
  Description of Artificial Sequence: Synthetic peptide
  Seed: FPQSLLQIPM (MAGC1_HUMAN)
FNQSLLQIPF

SEQ ID NO: 71994 - protein, 9 aa, Artificial Sequence
  Description of Artificial Sequence: Synthetic peptide
  Seed: ALLSIFQSS (MAGC1_HUMAN)
ALLSIFQSV

SEQ ID NO: 71995 - protein, 10 aa, Artificial Sequence
  Description of Artificial Sequence: Synthetic peptide
  Seed: ATESASSSVM (MAGC1_HUMAN)
AEESASSSVL

SEQ ID NO: 71996 - protein, 9 aa, Artificial Sequence
  Description of Artificial Sequence: Synthetic peptide
  Seed: RSFSSTLLS (MAGC1_HUMAN)
RMFSSTLLF

SEQ ID NO: 71997 - protein, 9 aa, Artificial Sequence
  Description of Artificial Sequence: Synthetic peptide
  Seed: SSSTLVSIF (MAGC1_HUMAN)
SVSTLVSIL

SEQ ID NO: 71998 - protein, 9 aa, Artificial Sequence
  Description of Artificial Sequence: Synthetic peptide
  Seed: LILSIIFIK (MAGC1_HUMAN)
LFLSIIFIK

SEQ ID NO: 71999 - protein, 10 aa, Artificial Sequence
  Description of Artificial Sequence: Synthetic peptide
  Seed: SLQIPVSPSF (MAGC1_HUMAN)
SPQIPVSPSM

SEQ ID NO: 72000 - protein, 9 aa, Artificial Sequence
  Description of Artificial Sequence: Synthetic peptide
  Seed: TESASSSVM (MAGC1_HUMAN)
TQSASSSVI

SEQ ID NO: 72001 - protein, 11 aa, Artificial Sequence
  Description of Artificial Sequence: Synthetic peptide
  Seed: MSPLYFPQSPL (MAGC1_HUMAN)
MTPLYFPQSPW

SEQ ID NO: 72002 - protein, 11 aa, Artificial Sequence
  Description of Artificial Sequence: Synthetic peptide
  Seed: SSTSLSLPQSF (MAGC1_HUMAN)
SLTSLSLPQSW

SEQ ID NO: 72003 - protein, 11 aa, Artificial Sequence
  Description of Artificial Sequence: Synthetic peptide
  Seed: IIDTTDDSTAT (MAGC1_HUMAN)
IVDTTDDSTAL

SEQ ID NO: 72004 - protein, 10 aa, Artificial Sequence
  Description of Artificial Sequence: Synthetic peptide
  Seed: IWDVLSGIGV (MAGC1_HUMAN)
IYDVLSGIGL

SEQ ID NO: 72005 - protein, 10 aa, Artificial Sequence
  Description of Artificial Sequence: Synthetic peptide
  Seed: ICSSSTSLSL (MAGC1_HUMAN)
IQSSSTSLSF

SEQ ID NO: 72006 - protein, 9 aa, Artificial Sequence
  Description of Artificial Sequence: Synthetic peptide
  Seed: SPFSEESSS (MAGC1_HUMAN)
SPFSEESSL

SEQ ID NO: 72007 - protein, 9 aa, Artificial Sequence
  Description of Artificial Sequence: Synthetic peptide
  Seed: FPSSTSSSL (MAGC1_HUMAN)
FFSSTSSSI

SEQ ID NO: 72008 - protein, 9 aa, Artificial Sequence
  Description of Artificial Sequence: Synthetic peptide
  Seed: LQIPMTSSF (MAGC1_HUMAN)
LTIPMTSSY

SEQ ID NO: 72009 - protein, 9 aa, Artificial Sequence
  Description of Artificial Sequence: Synthetic peptide
  Seed: SVLQIPVSA (MAGC1_HUMAN)
SMLQIPVSR

SEQ ID NO: 72010 - protein, 10 aa, Artificial Sequence
  Description of Artificial Sequence: Synthetic peptide
  Seed: MSPLYFPQSP (MAGC1_HUMAN)
MVPLYFPQSA

SEQ ID NO: 72011 - protein, 10 aa, Artificial Sequence
  Description of Artificial Sequence: Synthetic peptide
  Seed: SSFSSTLLSI (MAGC1_HUMAN)
SLFSSTLLSM

SEQ ID NO: 72012 - protein, 9 aa, Artificial Sequence
  Description of Artificial Sequence: Synthetic peptide
  Seed: SAQSTFEGF (MAGC1_HUMAN)
SLQSTFEGW

SEQ ID NO: 72013 - protein, 9 aa, Artificial Sequence
  Description of Artificial Sequence: Synthetic peptide
  Seed: HFPQSPPEW (MAGC1_HUMAN)
HYPQSPPEF

SEQ ID NO: 72014 - protein, 11 aa, Artificial Sequence
  Description of Artificial Sequence: Synthetic peptide
  Seed: IPMTSSFSSTL (MAGC1_HUMAN)
IHMTSSFSSTY

SEQ ID NO: 72015 - protein, 10 aa, Artificial Sequence
  Description of Artificial Sequence: Synthetic peptide
  Seed: KVVEFLAMLK (MAGC1_HUMAN)
KGVEFLAMLR

SEQ ID NO: 72016 - protein, 9 aa, Artificial Sequence
  Description of Artificial Sequence: Synthetic peptide
  Seed: RKVVEFLAM (MAGC1_HUMAN)
RGVVEFLAY

SEQ ID NO: 72017 - protein, 11 aa, Artificial Sequence
  Description of Artificial Sequence: Synthetic peptide
  Seed: IPVSRSFSSTL (MAGC1_HUMAN)
ICVSRSFSSTY

SEQ ID NO: 72018 - protein, 11 aa, Artificial Sequence
  Description of Artificial Sequence: Synthetic peptide
  Seed: EILFGISLREV (MAGC1_HUMAN)
EKLFGISLREV

SEQ ID NO: 72019 - protein, 10 aa, Artificial Sequence
  Description of Artificial Sequence: Synthetic peptide
  Seed: PLQIPVSSSF (MAGC1_HUMAN)
PAQIPVSSSY

SEQ ID NO: 72020 - protein, 9 aa, Artificial Sequence
  Description of Artificial Sequence: Synthetic peptide
  Seed: AASSSTLVS (MAGC1_HUMAN)
AASSSTLVF

SEQ ID NO: 72021 - protein, 10 aa, Artificial Sequence
  Description of Artificial Sequence: Synthetic peptide
  Seed: IEILFGISLR (MAGC1_HUMAN)
ITILFGISLK

SEQ ID NO: 72022 - protein, 11 aa, Artificial Sequence
  Description of Artificial Sequence: Synthetic peptide
  Seed: IPMTSSFSSTL (MAGC1_HUMAN)
IYMTSSFSSTW

SEQ ID NO: 72023 - protein, 10 aa, Artificial Sequence
  Description of Artificial Sequence: Synthetic peptide
  Seed: SSFSSTLLSI (MAGC1_HUMAN)
SMFSSTLLST

SEQ ID NO: 72024 - protein, 9 aa, Artificial Sequence
  Description of Artificial Sequence: Synthetic peptide
  Seed: SSPESTQSP (MAGC1_HUMAN)
SVPESTQSL

SEQ ID NO: 72025 - protein, 8 aa, Artificial Sequence
  Description of Artificial Sequence: Synthetic peptide
  Seed: AEMLTNVI (MAGC1_HUMAN)
AQMLTNVI

SEQ ID NO: 72026 - protein, 9 aa, Artificial Sequence
  Description of Artificial Sequence: Synthetic peptide
  Seed: SPESAQSTF (MAGC1_HUMAN)
SMESAQSTF

SEQ ID NO: 72027 - protein, 8 aa, Artificial Sequence
  Description of Artificial Sequence: Synthetic peptide
  Seed: QIPGSPSF (MAGC1_HUMAN)
QYPGSPSF

SEQ ID NO: 72028 - protein, 9 aa, Artificial Sequence
  Description of Artificial Sequence: Synthetic peptide
  Seed: ALKDVEERA (MAGC1_HUMAN)
AMKDVEERV

SEQ ID NO: 72029 - protein, 9 aa, Artificial Sequence
  Description of Artificial Sequence: Synthetic peptide
  Seed: SPERTHSTF (MAGC1_HUMAN)
SPERTHSTY

SEQ ID NO: 72030 - protein, 10 aa, Artificial Sequence
  Description of Artificial Sequence: Synthetic peptide
  Seed: SSSSTLLSLF (MAGC1_HUMAN)
SWSSTLLSLW

SEQ ID NO: 72031 - protein, 10 aa, Artificial Sequence
  Description of Artificial Sequence: Synthetic peptide
  Seed: QRPVSSFFSY (MAGC1_HUMAN)
QIPVSSFFSF

SEQ ID NO: 72032 - protein, 9 aa, Artificial Sequence
  Description of Artificial Sequence: Synthetic peptide
  Seed: MTSSFSSTL (MAGC1_HUMAN)
MYSSFSSTV

SEQ ID NO: 72033 - protein, 9 aa, Artificial Sequence
  Description of Artificial Sequence: Synthetic peptide
  Seed: SSSFSYTLL (MAGC1_HUMAN)
STSFSYTLF

SEQ ID NO: 72034 - protein, 9 aa, Artificial Sequence
  Description of Artificial Sequence: Synthetic peptide
  Seed: SPPQGEDSL (MAGC1_HUMAN)
SAPQGEDSL

SEQ ID NO: 72035 - protein, 10 aa, Artificial Sequence
  Description of Artificial Sequence: Synthetic peptide
  Seed: TGYFPVIFRK (MAGC1_HUMAN)
TAYFPVIFRP

SEQ ID NO: 72036 - protein, 9 aa, Artificial Sequence
  Description of Artificial Sequence: Synthetic peptide
  Seed: AQSPLQSPV (MAGC1_HUMAN)
ALSPLQSPW

SEQ ID NO: 72037 - protein, 9 aa, Artificial Sequence
  Description of Artificial Sequence: Synthetic peptide
  Seed: GEDSMSPLY (MAGC1_HUMAN)
GTDSMSPLY

SEQ ID NO: 72038 - protein, 10 aa, Artificial Sequence
  Description of Artificial Sequence: Synthetic peptide
  Seed: SRYTGYFPVI (MAGC1_HUMAN)
SDYTGYFPVF

SEQ ID NO: 72039 - protein, 9 aa, Artificial Sequence
  Description of Artificial Sequence: Synthetic peptide
  Seed: SSFSYTLLS (MAGC1_HUMAN)
SGFSYTLLK

SEQ ID NO: 72040 - protein, 8 aa, Artificial Sequence
  Description of Artificial Sequence: Synthetic peptide
  Seed: SSVMSPSF (MAGC1_HUMAN)
SKVMSPSF

SEQ ID NO: 72041 - protein, 10 aa, Artificial Sequence
  Description of Artificial Sequence: Synthetic peptide
  Seed: LSQSSPVSSF (MAGC1_HUMAN)
LHQSSPVSSY

SEQ ID NO: 72042 - protein, 9 aa, Artificial Sequence
  Description of Artificial Sequence: Synthetic peptide
  Seed: SSSTSLSPF (MAGC1_HUMAN)
SQSTSLSPH

SEQ ID NO: 72043 - protein, 10 aa, Artificial Sequence
  Description of Artificial Sequence: Synthetic peptide
  Seed: SFSSTLLSIF (MAGC1_HUMAN)
SKSSTLLSIY

SEQ ID NO: 72044 - protein, 9 aa, Artificial Sequence
  Description of Artificial Sequence: Synthetic peptide
  Seed: SLIESEPLF (MAGC1_HUMAN)
SMIESEPLV

SEQ ID NO: 72045 - protein, 9 aa, Artificial Sequence
  Description of Artificial Sequence: Synthetic peptide
  Seed: RLLILILSI (MAGC1_HUMAN)
RSLILILSL

SEQ ID NO: 72046 - protein, 11 aa, Artificial Sequence
  Description of Artificial Sequence: Synthetic peptide
  Seed: SLIESEPLFTY (MAGC1_HUMAN)
SQIESEPLFTI

SEQ ID NO: 72047 - protein, 9 aa, Artificial Sequence
  Description of Artificial Sequence: Synthetic peptide
  Seed: LTKVWVQEH (MAGC1_HUMAN)
LSKVWVQEY

SEQ ID NO: 72048 - protein, 9 aa, Artificial Sequence
  Description of Artificial Sequence: Synthetic peptide
  Seed: SIFQSSPER (MAGC1_HUMAN)
SMFQSSPEM

SEQ ID NO: 72049 - protein, 9 aa, Artificial Sequence
  Description of Artificial Sequence: Synthetic peptide
  Seed: LQIPGSPSF (MAGC1_HUMAN)
LDIPGSPSY

SEQ ID NO: 72050 - protein, 9 aa, Artificial Sequence
  Description of Artificial Sequence: Synthetic peptide
  Seed: TLDLTSEGC (MAGC1_HUMAN)
TGDLTSEGF

SEQ ID NO: 72051 - protein, 9 aa, Artificial Sequence
  Description of Artificial Sequence: Synthetic peptide
  Seed: FFSSALLSI (MAGC1_HUMAN)
FFSSALLSY

SEQ ID NO: 72052 - protein, 9 aa, Artificial Sequence
  Description of Artificial Sequence: Synthetic peptide
  Seed: IFQSSPESA (MAGC1_HUMAN)
ILQSSPESL

SEQ ID NO: 72053 - protein, 9 aa, Artificial Sequence
  Description of Artificial Sequence: Synthetic peptide
  Seed: RAGREHFAF (MAGC1_HUMAN)
RYGREHFAL

SEQ ID NO: 72054 - protein, 8 aa, Artificial Sequence
  Description of Artificial Sequence: Synthetic peptide
  Seed: RYTGYFPV (MAGC1_HUMAN)
RWTGYFPW

SEQ ID NO: 72055 - protein, 9 aa, Artificial Sequence
  Description of Artificial Sequence: Synthetic peptide
  Seed: SEPLFTYTL (MAGC1_HUMAN)
SHPLFTYTM

SEQ ID NO: 72056 - protein, 9 aa, Artificial Sequence
  Description of Artificial Sequence: Synthetic peptide
  Seed: VSPSSSSTL (MAGC1_HUMAN)
VWPSSSSTF

SEQ ID NO: 72057 - protein, 10 aa, Artificial Sequence
  Description of Artificial Sequence: Synthetic peptide
  Seed: ASSSTLVSIF (MAGC1_HUMAN)
AFSSTLVSIW

SEQ ID NO: 72058 - protein, 9 aa, Artificial Sequence
  Description of Artificial Sequence: Synthetic peptide
  Seed: SSSTLVSIF (MAGC1_HUMAN)
SRSTLVSIY

SEQ ID NO: 72059 - protein, 11 aa, Artificial Sequence
  Description of Artificial Sequence: Synthetic peptide
  Seed: KRKVVEFLAML (MAGC1_HUMAN)
KYKVVEFLAMV

SEQ ID NO: 72060 - protein, 11 aa, Artificial Sequence
  Description of Artificial Sequence: Synthetic peptide
  Seed: IPGSPSFSSTL (MAGC1_HUMAN)
IPGSPSFSSTM

SEQ ID NO: 72061 - protein, 9 aa, Artificial Sequence
  Description of Artificial Sequence: Synthetic peptide
  Seed: SLPEWEDSL (MAGC1_HUMAN)
SHPEWEDSF

SEQ ID NO: 72062 - protein, 10 aa, Artificial Sequence
  Description of Artificial Sequence: Synthetic peptide
  Seed: MPTAGMPSLL (MAGC1_HUMAN)
MNTAGMPSLL

SEQ ID NO: 72063 - protein, 10 aa, Artificial Sequence
  Description of Artificial Sequence: Synthetic peptide
  Seed: SSFSYTLLSL (MAGC1_HUMAN)
SVFSYTLLSL

SEQ ID NO: 72064 - protein, 9 aa, Artificial Sequence
  Description of Artificial Sequence: Synthetic peptide
  Seed: YQVKQPITK (MAGC1_HUMAN)
YYVKQPITF

SEQ ID NO: 72065 - protein, 9 aa, Artificial Sequence
  Description of Artificial Sequence: Synthetic peptide
  Seed: AGREHFAFG (MAGC1_HUMAN)
AYREHFAFS

SEQ ID NO: 72066 - protein, 9 aa, Artificial Sequence
  Description of Artificial Sequence: Synthetic peptide
  Seed: RAHSEVIKR (MAGC1_HUMAN)
RAHSEVIKM

SEQ ID NO: 72067 - protein, 9 aa, Artificial Sequence
  Description of Artificial Sequence: Synthetic peptide
  Seed: CSSSTSLSL (MAGC1_HUMAN)
CGSSTSLSF

SEQ ID NO: 72068 - protein, 10 aa, Artificial Sequence
  Description of Artificial Sequence: Synthetic peptide
  Seed: FSSSTSLSPF (MAGC1_HUMAN)
FMSSTSLSPW

SEQ ID NO: 72069 - protein, 9 aa, Artificial Sequence
  Description of Artificial Sequence: Synthetic peptide
  Seed: SFSYTLLSL (MAGC1_HUMAN)
SWSYTLLSF

SEQ ID NO: 72070 - protein, 9 aa, Artificial Sequence
  Description of Artificial Sequence: Synthetic peptide
  Seed: AGREHFAFG (MAGC1_HUMAN)
AYREHFAFI

SEQ ID NO: 72071 - protein, 10 aa, Artificial Sequence
  Description of Artificial Sequence: Synthetic peptide
  Seed: WEDSLSPHYF (MAGC1_HUMAN)
WLDSLSPHYM

SEQ ID NO: 72072 - protein, 10 aa, Artificial Sequence
  Description of Artificial Sequence: Synthetic peptide
  Seed: PLQIPMTSSF (MAGC1_HUMAN)
PAQIPMTSSF

SEQ ID NO: 72073 - protein, 10 aa, Artificial Sequence
  Description of Artificial Sequence: Synthetic peptide
  Seed: NTVPITFPSS (MAGC1_HUMAN)
NTVPITFPSV

SEQ ID NO: 72074 - protein, 11 aa, Artificial Sequence
  Description of Artificial Sequence: Synthetic peptide
  Seed: ILFGISLREVD (MAGC1_HUMAN)
ILFGISLREVV

SEQ ID NO: 72075 - protein, 10 aa, Artificial Sequence
  Description of Artificial Sequence: Synthetic peptide
  Seed: TGYFPVIFRK (MAGC1_HUMAN)
TFYFPVIFRK

SEQ ID NO: 72076 - protein, 9 aa, Artificial Sequence
  Description of Artificial Sequence: Synthetic peptide
  Seed: YVFVNTLDL (MAGC1_HUMAN)
YPFVNTLDI

SEQ ID NO: 72077 - protein, 8 aa, Artificial Sequence
  Description of Artificial Sequence: Synthetic peptide
  Seed: PSSTSSSL (MAGC1_HUMAN)
PRSTSSSL

SEQ ID NO: 72078 - protein, 9 aa, Artificial Sequence
  Description of Artificial Sequence: Synthetic peptide
  Seed: LKNTVPITF (MAGC1_HUMAN)
LANTVPITY

SEQ ID NO: 72079 - protein, 9 aa, Artificial Sequence
  Description of Artificial Sequence: Synthetic peptide
  Seed: FFSYTLASL (MAGC1_HUMAN)
FLSYTLASG

SEQ ID NO: 72080 - protein, 10 aa, Artificial Sequence
  Description of Artificial Sequence: Synthetic peptide
  Seed: MPTAGMPSLL (MAGC1_HUMAN)
MWTAGMPSLF

SEQ ID NO: 72081 - protein, 10 aa, Artificial Sequence
  Description of Artificial Sequence: Synthetic peptide
  Seed: FPQSLLQIPM (MAGC1_HUMAN)
FLQSLLQIPM

SEQ ID NO: 72082 - protein, 11 aa, Artificial Sequence
  Description of Artificial Sequence: Synthetic peptide
  Seed: SSTPSSLPQSF (MAGC1_HUMAN)
SATPSSLPQSF

SEQ ID NO: 72083 - protein, 9 aa, Artificial Sequence
  Description of Artificial Sequence: Synthetic peptide
  Seed: FFSYTLASL (MAGC1_HUMAN)
FQSYTLASV

SEQ ID NO: 72084 - protein, 9 aa, Artificial Sequence
  Description of Artificial Sequence: Synthetic peptide
  Seed: SSSTLLSLF (MAGC1_HUMAN)
STSTLLSLL

SEQ ID NO: 72085 - protein, 9 aa, Artificial Sequence
  Description of Artificial Sequence: Synthetic peptide
  Seed: IEILFGISL (MAGC1_HUMAN)
ISILFGISY

SEQ ID NO: 72086 - protein, 11 aa, Artificial Sequence
  Description of Artificial Sequence: Synthetic peptide
  Seed: LWGPRAHSEVI (MAGC1_HUMAN)
LPGPRAHSEVL

SEQ ID NO: 72087 - protein, 11 aa, Artificial Sequence
  Description of Artificial Sequence: Synthetic peptide
  Seed: ISRYTGYFPVI (MAGC1_HUMAN)
IWRYTGYFPVF

SEQ ID NO: 72088 - protein, 9 aa, Artificial Sequence
  Description of Artificial Sequence: Synthetic peptide
  Seed: SPESTQSPF (MAGC1_HUMAN)
SPESTQSPY

SEQ ID NO: 72089 - protein, 10 aa, Artificial Sequence
  Description of Artificial Sequence: Synthetic peptide
  Seed: LQNPASSFFS (MAGC1_HUMAN)
LINPASSFFY

SEQ ID NO: 72090 - protein, 10 aa, Artificial Sequence
  Description of Artificial Sequence: Synthetic peptide
  Seed: KVVEFLAMLK (MAGC1_HUMAN)
KTVEFLAMLA

SEQ ID NO: 72091 - protein, 9 aa, Artificial Sequence
  Description of Artificial Sequence: Synthetic peptide
  Seed: FSSALLSIF (MAGC1_HUMAN)
FVSALLSIF

SEQ ID NO: 72092 - protein, 9 aa, Artificial Sequence
  Description of Artificial Sequence: Synthetic peptide
  Seed: SSTSSSLSK (MAGC1_HUMAN)
SVTSSSLSR

SEQ ID NO: 72093 - protein, 9 aa, Artificial Sequence
  Description of Artificial Sequence: Synthetic peptide
  Seed: ASEEVIWDV (MAGC1_HUMAN)
AMEEVIWDV

SEQ ID NO: 72094 - protein, 10 aa, Artificial Sequence
  Description of Artificial Sequence: Synthetic peptide
  Seed: ATESASSSVM (MAGC1_HUMAN)
AMESASSSVL

SEQ ID NO: 72095 - protein, 9 aa, Artificial Sequence
  Description of Artificial Sequence: Synthetic peptide
  Seed: LQIPGSPSF (MAGC1_HUMAN)
LQIPGSPSM

SEQ ID NO: 72096 - protein, 10 aa, Artificial Sequence
  Description of Artificial Sequence: Synthetic peptide
  Seed: MLKNTVPITF (MAGC1_HUMAN)
MDKNTVPITY

SEQ ID NO: 72097 - protein, 9 aa, Artificial Sequence
  Description of Artificial Sequence: Synthetic peptide
  Seed: YTGYFPVIF (MAGC1_HUMAN)
YIGYFPVIY

SEQ ID NO: 72098 - protein, 11 aa, Artificial Sequence
  Description of Artificial Sequence: Synthetic peptide
  Seed: SSSSSTLLSLF (MAGC1_HUMAN)
SQSSSTLLSLY

SEQ ID NO: 72099 - protein, 10 aa, Artificial Sequence
  Description of Artificial Sequence: Synthetic peptide
  Seed: LLQIPMTSSF (MAGC1_HUMAN)
LKQIPMTSSF

SEQ ID NO: 72100 - protein, 10 aa, Artificial Sequence
  Description of Artificial Sequence: Synthetic peptide
  Seed: RLLILILSII (MAGC1_HUMAN)
RTLILILSIV

SEQ ID NO: 72101 - protein, 10 aa, Artificial Sequence
  Description of Artificial Sequence: Synthetic peptide
  Seed: SIIFIKGTYA (MAGC1_HUMAN)
SLIFIKGTYL

SEQ ID NO: 72102 - protein, 9 aa, Artificial Sequence
  Description of Artificial Sequence: Synthetic peptide
  Seed: YVFVNTLDL (MAGC1_HUMAN)
YFFVNTLDY

SEQ ID NO: 72103 - protein, 10 aa, Artificial Sequence
  Description of Artificial Sequence: Synthetic peptide
  Seed: STPSSLPQSF (MAGC1_HUMAN)
SRPSSLPQSY

SEQ ID NO: 72104 - protein, 10 aa, Artificial Sequence
  Description of Artificial Sequence: Synthetic peptide
  Seed: VSSSSSSSTL (MAGC1_HUMAN)
VESSSSSSTF

SEQ ID NO: 72105 - protein, 9 aa, Artificial Sequence
  Description of Artificial Sequence: Synthetic peptide
  Seed: TSSFSSTLL (MAGC1_HUMAN)
TTSFSSTLI

SEQ ID NO: 72106 - protein, 10 aa, Artificial Sequence
  Description of Artificial Sequence: Synthetic peptide
  Seed: FAQSSLQIPV (MAGC1_HUMAN)
FFQSSLQIPV

SEQ ID NO: 72107 - protein, 10 aa, Artificial Sequence
  Description of Artificial Sequence: Synthetic peptide
  Seed: SSFSYTLLSL (MAGC1_HUMAN)
SGFSYTLLSY

SEQ ID NO: 72108 - protein, 9 aa, Artificial Sequence
  Description of Artificial Sequence: Synthetic peptide
  Seed: SPQSPPEGP (MAGC1_HUMAN)
SMQSPPEGF

SEQ ID NO: 72109 - protein, 9 aa, Artificial Sequence
  Description of Artificial Sequence: Synthetic peptide
  Seed: VSRSFSSTL (MAGC1_HUMAN)
VFRSFSSTV

SEQ ID NO: 72110 - protein, 9 aa, Artificial Sequence
  Description of Artificial Sequence: Synthetic peptide
  Seed: SPLQIPMTS (MAGC1_HUMAN)
SQLQIPMTV

SEQ ID NO: 72111 - protein, 10 aa, Artificial Sequence
  Description of Artificial Sequence: Synthetic peptide
  Seed: SPLQSPVSSF (MAGC1_HUMAN)
SPLQSPVSSA

SEQ ID NO: 72112 - protein, 10 aa, Artificial Sequence
  Description of Artificial Sequence: Synthetic peptide
  Seed: VSSSSSSTLL (MAGC1_HUMAN)
VWSSSSSTLW

SEQ ID NO: 72113 - protein, 9 aa, Artificial Sequence
  Description of Artificial Sequence: Synthetic peptide
  Seed: EMLTNVISR (MAGC1_HUMAN)
EILTNVISR

SEQ ID NO: 72114 - protein, 10 aa, Artificial Sequence
  Description of Artificial Sequence: Synthetic peptide
  Seed: MPTAGMPSLL (MAGC1_HUMAN)
MCTAGMPSLA

SEQ ID NO: 72115 - protein, 9 aa, Artificial Sequence
  Description of Artificial Sequence: Synthetic peptide
  Seed: TESASSSVM (MAGC1_HUMAN)
TESASSSVT

SEQ ID NO: 72116 - protein, 9 aa, Artificial Sequence
  Description of Artificial Sequence: Synthetic peptide
  Seed: KVWVQEHYL (MAGC1_HUMAN)
KGWVQEHYW

SEQ ID NO: 72117 - protein, 11 aa, Artificial Sequence
  Description of Artificial Sequence: Synthetic peptide
  Seed: IPVSSSFSYTL (MAGC1_HUMAN)
IPVSSSFSYTM

SEQ ID NO: 72118 - protein, 9 aa, Artificial Sequence
  Description of Artificial Sequence: Synthetic peptide
  Seed: FQSSPERTH (MAGC1_HUMAN)
FTSSPERTY

SEQ ID NO: 72119 - protein, 9 aa, Artificial Sequence
  Description of Artificial Sequence: Synthetic peptide
  Seed: MTSSFSSTL (MAGC1_HUMAN)
MQSSFSSTY

SEQ ID NO: 72120 - protein, 9 aa, Artificial Sequence
  Description of Artificial Sequence: Synthetic peptide
  Seed: VSRSFSSTL (MAGC1_HUMAN)
VQRSFSSTV

SEQ ID NO: 72121 - protein, 9 aa, Artificial Sequence
  Description of Artificial Sequence: Synthetic peptide
  Seed: LSPLHFPQF (MAGC1_HUMAN)
LWPLHFPQI

SEQ ID NO: 72122 - protein, 10 aa, Artificial Sequence
  Description of Artificial Sequence: Synthetic peptide
  Seed: LHFPQSPPEW (MAGC1_HUMAN)
LVFPQSPPEW

SEQ ID NO: 72123 - protein, 11 aa, Artificial Sequence
  Description of Artificial Sequence: Synthetic peptide
  Seed: IPVSAASSSTL (MAGC1_HUMAN)
ITVSAASSSTY

SEQ ID NO: 72124 - protein, 9 aa, Artificial Sequence
  Description of Artificial Sequence: Synthetic peptide
  Seed: SFFSYTLAS (MAGC1_HUMAN)
SYFSYTLAH

SEQ ID NO: 72125 - protein, 9 aa, Artificial Sequence
  Description of Artificial Sequence: Synthetic peptide
  Seed: SPQSPPEGP (MAGC1_HUMAN)
SIQSPPEGL

SEQ ID NO: 72126 - protein, 9 aa, Artificial Sequence
  Description of Artificial Sequence: Synthetic peptide
  Seed: CSSSTSLSL (MAGC1_HUMAN)
CSSSTSLSY

SEQ ID NO: 72127 - protein, 11 aa, Artificial Sequence
  Description of Artificial Sequence: Synthetic peptide
  Seed: VSSSSSSSTLL (MAGC1_HUMAN)
VASSSSSSTLW

SEQ ID NO: 72128 - protein, 9 aa, Artificial Sequence
  Description of Artificial Sequence: Synthetic peptide
  Seed: MTSSFSSTL (MAGC1_HUMAN)
MWSSFSSTY

SEQ ID NO: 72129 - protein, 10 aa, Artificial Sequence
  Description of Artificial Sequence: Synthetic peptide
  Seed: LSGIGVRAGR (MAGC1_HUMAN)
LYGIGVRAGR

SEQ ID NO: 72130 - protein, 10 aa, Artificial Sequence
  Description of Artificial Sequence: Synthetic peptide
  Seed: ICSSSTPSSL (MAGC1_HUMAN)
ISSSSTPSSW

SEQ ID NO: 72131 - protein, 9 aa, Artificial Sequence
  Description of Artificial Sequence: Synthetic peptide
  Seed: SSPERTHST (MAGC1_HUMAN)
SRPERTHSL

SEQ ID NO: 72132 - protein, 9 aa, Artificial Sequence
  Description of Artificial Sequence: Synthetic peptide
  Seed: GPAQSPLQR (MAGC1_HUMAN)
GYAQSPLQM

SEQ ID NO: 72133 - protein, 9 aa, Artificial Sequence
  Description of Artificial Sequence: Synthetic peptide
  Seed: FSSTLVSLF (MAGC1_HUMAN)
FISTLVSLA

SEQ ID NO: 72134 - protein, 10 aa, Artificial Sequence
  Description of Artificial Sequence: Synthetic peptide
  Seed: FPQSLLQIPM (MAGC1_HUMAN)
FDQSLLQIPV

SEQ ID NO: 72135 - protein, 10 aa, Artificial Sequence
  Description of Artificial Sequence: Synthetic peptide
  Seed: EILFGISLRE (MAGC1_HUMAN)
EPLFGISLRK

SEQ ID NO: 72136 - protein, 9 aa, Artificial Sequence
  Description of Artificial Sequence: Synthetic peptide
  Seed: FSSTLLSIL (MAGC1_HUMAN)
FVSTLLSIA

SEQ ID NO: 72137 - protein, 9 aa, Artificial Sequence
  Description of Artificial Sequence: Synthetic peptide
  Seed: SSPPRYEFL (MAGC1_HUMAN)
SCPPRYEFL

SEQ ID NO: 72138 - protein, 10 aa, Artificial Sequence
  Description of Artificial Sequence: Synthetic peptide
  Seed: ICSSSTSLSL (MAGC1_HUMAN)
IQSSSTSLSY

SEQ ID NO: 72139 - protein, 11 aa, Artificial Sequence
  Description of Artificial Sequence: Synthetic peptide
  Seed: LQIPVSSSFSY (MAGC1_HUMAN)
LLIPVSSSFSF

SEQ ID NO: 72140 - protein, 9 aa, Artificial Sequence
  Description of Artificial Sequence: Synthetic peptide
  Seed: SPPQGEDSL (MAGC1_HUMAN)
SMPQGEDSL

SEQ ID NO: 72141 - protein, 11 aa, Artificial Sequence
  Description of Artificial Sequence: Synthetic peptide
  Seed: SFFSYTLASLL (MAGC1_HUMAN)
SVFSYTLASLY

SEQ ID NO: 72142 - protein, 9 aa, Artificial Sequence
  Description of Artificial Sequence: Synthetic peptide
  Seed: SPLQSPESA (MAGC1_HUMAN)
SPLQSPESI

SEQ ID NO: 72143 - protein, 9 aa, Artificial Sequence
  Description of Artificial Sequence: Synthetic peptide
  Seed: SAQSAFEGF (MAGC1_HUMAN)
SYQSAFEGF

SEQ ID NO: 72144 - protein, 10 aa, Artificial Sequence
  Description of Artificial Sequence: Synthetic peptide
  Seed: EILFGISLRE (MAGC1_HUMAN)
ENLFGISLRR

SEQ ID NO: 72145 - protein, 9 aa, Artificial Sequence
  Description of Artificial Sequence: Synthetic peptide
  Seed: SSPESDDTL (MAGC1_HUMAN)
SAPESDDTM

SEQ ID NO: 72146 - protein, 9 aa, Artificial Sequence
  Description of Artificial Sequence: Synthetic peptide
  Seed: ISFSSSTSL (MAGC1_HUMAN)
ITFSSSTSL

SEQ ID NO: 72147 - protein, 10 aa, Artificial Sequence
  Description of Artificial Sequence: Synthetic peptide
  Seed: RAGREHFAFG (MAGC1_HUMAN)
RDGREHFAFK

SEQ ID NO: 72148 - protein, 9 aa, Artificial Sequence
  Description of Artificial Sequence: Synthetic peptide
  Seed: FEGFPQSVL (MAGC1_HUMAN)
FEGFPQSVI

SEQ ID NO: 72149 - protein, 9 aa, Artificial Sequence
  Description of Artificial Sequence: Synthetic peptide
  Seed: LQRPVSSFF (MAGC1_HUMAN)
LTRPVSSFL

SEQ ID NO: 72150 - protein, 10 aa, Artificial Sequence
  Description of Artificial Sequence: Synthetic peptide
  Seed: QIPVSSSFSY (MAGC1_HUMAN)
QMPVSSSFSY

SEQ ID NO: 72151 - protein, 10 aa, Artificial Sequence
  Description of Artificial Sequence: Synthetic peptide
  Seed: ATESASSSVM (MAGC1_HUMAN)
AEESASSSVW

SEQ ID NO: 72152 - protein, 10 aa, Artificial Sequence
  Description of Artificial Sequence: Synthetic peptide
  Seed: YTLDEKVDEL (MAGC1_HUMAN)
YALDEKVDEY

SEQ ID NO: 72153 - protein, 11 aa, Artificial Sequence
  Description of Artificial Sequence: Synthetic peptide
  Seed: SPLQIPVSSSS (MAGC1_HUMAN)
SFLQIPVSSSM

SEQ ID NO: 72154 - protein, 10 aa, Artificial Sequence
  Description of Artificial Sequence: Synthetic peptide
  Seed: QRPVSSFFSY (MAGC1_HUMAN)
QRPVSSFFSF

SEQ ID NO: 72155 - protein, 11 aa, Artificial Sequence
  Description of Artificial Sequence: Synthetic peptide
  Seed: IPVSSSSSSTL (MAGC1_HUMAN)
ITVSSSSSSTW

SEQ ID NO: 72156 - protein, 10 aa, Artificial Sequence
  Description of Artificial Sequence: Synthetic peptide
  Seed: LAMLKNTVPI (MAGC1_HUMAN)
LPMLKNTVPL

SEQ ID NO: 72157 - protein, 10 aa, Artificial Sequence
  Description of Artificial Sequence: Synthetic peptide
  Seed: FAQSSLQIPV (MAGC1_HUMAN)
FSQSSLQIPL

SEQ ID NO: 72158 - protein, 9 aa, Artificial Sequence
  Description of Artificial Sequence: Synthetic peptide
  Seed: SVLQIPVSA (MAGC1_HUMAN)
SMLQIPVSK

SEQ ID NO: 72159 - protein, 9 aa, Artificial Sequence
  Description of Artificial Sequence: Synthetic peptide
  Seed: FTYTLDEKV (MAGC1_HUMAN)
FAYTLDEKI

SEQ ID NO: 72160 - protein, 10 aa, Artificial Sequence
  Description of Artificial Sequence: Synthetic peptide
  Seed: SSPERTHSTF (MAGC1_HUMAN)
SAPERTHSTV

SEQ ID NO: 72161 - protein, 9 aa, Artificial Sequence
  Description of Artificial Sequence: Synthetic peptide
  Seed: SGIGVRAGR (MAGC1_HUMAN)
SVIGVRAGR

SEQ ID NO: 72162 - protein, 9 aa, Artificial Sequence
  Description of Artificial Sequence: Synthetic peptide
  Seed: RAHSEVIKR (MAGC1_HUMAN)
RTHSEVIKK

SEQ ID NO: 72163 - protein, 9 aa, Artificial Sequence
  Description of Artificial Sequence: Synthetic peptide
  Seed: FSYTLLSLF (MAGC1_HUMAN)
FMYTLLSLW

SEQ ID NO: 72164 - protein, 11 aa, Artificial Sequence
  Description of Artificial Sequence: Synthetic peptide
  Seed: SPLQIPMTSSF (MAGC1_HUMAN)
STLQIPMTSSY

SEQ ID NO: 72165 - protein, 9 aa, Artificial Sequence
  Description of Artificial Sequence: Synthetic peptide
  Seed: FPSSYKDAL (MAGC1_HUMAN)
FASSYKDAF

SEQ ID NO: 72166 - protein, 9 aa, Artificial Sequence
  Description of Artificial Sequence: Synthetic peptide
  Seed: VSRSFSSTL (MAGC1_HUMAN)
VTRSFSSTY

SEQ ID NO: 72167 - protein, 9 aa, Artificial Sequence
  Description of Artificial Sequence: Synthetic peptide
  Seed: VIWDVLSGI (MAGC1_HUMAN)
VMWDVLSGW

SEQ ID NO: 72168 - protein, 9 aa, Artificial Sequence
  Description of Artificial Sequence: Synthetic peptide
  Seed: GYFPVIFRK (MAGC1_HUMAN)
GMFPVIFRL

SEQ ID NO: 72169 - protein, 10 aa, Artificial Sequence
  Description of Artificial Sequence: Synthetic peptide
  Seed: SSPPRYEFLW (MAGC1_HUMAN)
SYPPRYEFLV

SEQ ID NO: 72170 - protein, 9 aa, Artificial Sequence
  Description of Artificial Sequence: Synthetic peptide
  Seed: FPSSTSSSL (MAGC1_HUMAN)
FHSSTSSSY

SEQ ID NO: 72171 - protein, 9 aa, Artificial Sequence
  Description of Artificial Sequence: Synthetic peptide
  Seed: LILSIIFIK (MAGC1_HUMAN)
LSLSIIFIK

SEQ ID NO: 72172 - protein, 10 aa, Artificial Sequence
  Description of Artificial Sequence: Synthetic peptide
  Seed: PLQIPMTSSF (MAGC1_HUMAN)
PKQIPMTSSY

SEQ ID NO: 72173 - protein, 10 aa, Artificial Sequence
  Description of Artificial Sequence: Synthetic peptide
  Seed: SFPSSTSSSL (MAGC1_HUMAN)
SQPSSTSSSM

SEQ ID NO: 72174 - protein, 9 aa, Artificial Sequence
  Description of Artificial Sequence: Synthetic peptide
  Seed: SFSSTLVSL (MAGC1_HUMAN)
STSSTLVSF

SEQ ID NO: 72175 - protein, 11 aa, Artificial Sequence
  Description of Artificial Sequence: Synthetic peptide
  Seed: SPLQRPVSSFF (MAGC1_HUMAN)
SALQRPVSSFY

SEQ ID NO: 72176 - protein, 10 aa, Artificial Sequence
  Description of Artificial Sequence: Synthetic peptide
  Seed: SLFQSSPECT (MAGC1_HUMAN)
SLFQSSPECL

SEQ ID NO: 72177 - protein, 9 aa, Artificial Sequence
  Description of Artificial Sequence: Synthetic peptide
  Seed: KVVEFLAML (MAGC1_HUMAN)
KTVEFLAMY

SEQ ID NO: 72178 - protein, 9 aa, Artificial Sequence
  Description of Artificial Sequence: Synthetic peptide
  Seed: SFFSYTLAS (MAGC1_HUMAN)
SYFSYTLAF

SEQ ID NO: 72179 - protein, 10 aa, Artificial Sequence
  Description of Artificial Sequence: Synthetic peptide
  Seed: LLQIPMTSSF (MAGC1_HUMAN)
LCQIPMTSSM

SEQ ID NO: 72180 - protein, 9 aa, Artificial Sequence
  Description of Artificial Sequence: Synthetic peptide
  Seed: RAGREHFAF (MAGC1_HUMAN)
RYGREHFAW

SEQ ID NO: 72181 - protein, 9 aa, Artificial Sequence
  Description of Artificial Sequence: Synthetic peptide
  Seed: AQSPLQRPV (MAGC1_HUMAN)
ALSPLQRPA

SEQ ID NO: 72182 - protein, 10 aa, Artificial Sequence
  Description of Artificial Sequence: Synthetic peptide
  Seed: LSIIFIKGTY (MAGC1_HUMAN)
LMIIFIKGTF

SEQ ID NO: 72183 - protein, 10 aa, Artificial Sequence
  Description of Artificial Sequence: Synthetic peptide
  Seed: REFIEILFGI (MAGC1_HUMAN)
RMFIEILFGS

SEQ ID NO: 72184 - protein, 10 aa, Artificial Sequence
  Description of Artificial Sequence: Synthetic peptide
  Seed: KGTYASEEVI (MAGC1_HUMAN)
KPTYASEEVF

SEQ ID NO: 72185 - protein, 9 aa, Artificial Sequence
  Description of Artificial Sequence: Synthetic peptide
  Seed: KVVEFLAML (MAGC1_HUMAN)
KTVEFLAMW

SEQ ID NO: 72186 - protein, 11 aa, Artificial Sequence
  Description of Artificial Sequence: Synthetic peptide
  Seed: VLSGIGVRAGR (MAGC1_HUMAN)
VVSGIGVRAGK

SEQ ID NO: 72187 - protein, 10 aa, Artificial Sequence
  Description of Artificial Sequence: Synthetic peptide
  Seed: SSPECTQSTF (MAGC1_HUMAN)
SFPECTQSTL

SEQ ID NO: 72188 - protein, 9 aa, Artificial Sequence
  Description of Artificial Sequence: Synthetic peptide
  Seed: AQSPLQRPV (MAGC1_HUMAN)
ARSPLQRPF

SEQ ID NO: 72189 - protein, 9 aa, Artificial Sequence
  Description of Artificial Sequence: Synthetic peptide
  Seed: MGDKDMPTA (MAGC1_HUMAN)
MIDKDMPTI

SEQ ID NO: 72190 - protein, 10 aa, Artificial Sequence
  Description of Artificial Sequence: Synthetic peptide
  Seed: NVISRYTGYF (MAGC1_HUMAN)
NVISRYTGYY

SEQ ID NO: 72191 - protein, 9 aa, Artificial Sequence
  Description of Artificial Sequence: Synthetic peptide
  Seed: EILFGISLR (MAGC1_HUMAN)
ESLFGISLR

SEQ ID NO: 72192 - protein, 10 aa, Artificial Sequence
  Description of Artificial Sequence: Synthetic peptide
  Seed: RKVVEFLAML (MAGC1_HUMAN)
RIVVEFLAMV

SEQ ID NO: 72193 - protein, 9 aa, Artificial Sequence
  Description of Artificial Sequence: Synthetic peptide
  Seed: SQSSPVSSF (MAGC1_HUMAN)
STSSPVSSV

SEQ ID NO: 72194 - protein, 9 aa, Artificial Sequence
  Description of Artificial Sequence: Synthetic peptide
  Seed: NSSPPRYEF (MAGC1_HUMAN)
NVSPPRYEL

SEQ ID NO: 72195 - protein, 9 aa, Artificial Sequence
  Description of Artificial Sequence: Synthetic peptide
  Seed: SESLIESEP (MAGC1_HUMAN)
SESLIESEI

SEQ ID NO: 72196 - protein, 9 aa, Artificial Sequence
  Description of Artificial Sequence: Synthetic peptide
  Seed: FSSALLSIF (MAGC1_HUMAN)
FYSALLSIL

SEQ ID NO: 72197 - protein, 10 aa, Artificial Sequence
  Description of Artificial Sequence: Synthetic peptide
  Seed: SSPPRYEFLW (MAGC1_HUMAN)
SYPPRYEFLI

SEQ ID NO: 72198 - protein, 11 aa, Artificial Sequence
  Description of Artificial Sequence: Synthetic peptide
  Seed: IPMTSSFSSTL (MAGC1_HUMAN)
IGMTSSFSSTY

SEQ ID NO: 72199 - protein, 11 aa, Artificial Sequence
  Description of Artificial Sequence: Synthetic peptide
  Seed: REVDPDDSYVF (MAGC1_HUMAN)
RRVDPDDSYVY

SEQ ID NO: 72200 - protein, 11 aa, Artificial Sequence
  Description of Artificial Sequence: Synthetic peptide
  Seed: SPLQIPMTSSF (MAGC1_HUMAN)
SHLQIPMTSSY

SEQ ID NO: 72201 - protein, 10 aa, Artificial Sequence
  Description of Artificial Sequence: Synthetic peptide
  Seed: ATESASSSVM (MAGC1_HUMAN)
AKESASSSVF

SEQ ID NO: 72202 - protein, 9 aa, Artificial Sequence
  Description of Artificial Sequence: Synthetic peptide
  Seed: SSSTSLSPF (MAGC1_HUMAN)
STSTSLSPF

SEQ ID NO: 72203 - protein, 9 aa, Artificial Sequence
  Description of Artificial Sequence: Synthetic peptide
  Seed: TLDLTSEGC (MAGC1_HUMAN)
TTDLTSEGI

SEQ ID NO: 72204 - protein, 9 aa, Artificial Sequence
  Description of Artificial Sequence: Synthetic peptide
  Seed: FSSTLVSLF (MAGC1_HUMAN)
FLSTLVSLL

SEQ ID NO: 72205 - protein, 11 aa, Artificial Sequence
  Description of Artificial Sequence: Synthetic peptide
  Seed: AEMLTNVISRY (MAGC1_HUMAN)
AEMLTNVISRF

SEQ ID NO: 72206 - protein, 9 aa, Artificial Sequence
  Description of Artificial Sequence: Synthetic peptide
  Seed: SLIESEPLF (MAGC1_HUMAN)
SSIESEPLI

SEQ ID NO: 72207 - protein, 10 aa, Artificial Sequence
  Description of Artificial Sequence: Synthetic peptide
  Seed: VWVQEHYLEY (MAGC1_HUMAN)
VTVQEHYLEY

SEQ ID NO: 72208 - protein, 9 aa, Artificial Sequence
  Description of Artificial Sequence: Synthetic peptide
  Seed: LSDEQGMSQ (MAGC1_HUMAN)
LTDEQGMSF

SEQ ID NO: 72209 - protein, 11 aa, Artificial Sequence
  Description of Artificial Sequence: Synthetic peptide
  Seed: SPLQIPVSPSS (MAGC1_HUMAN)
SILQIPVSPSF

SEQ ID NO: 72210 - protein, 11 aa, Artificial Sequence
  Description of Artificial Sequence: Synthetic peptide
  Seed: QSSPERTQSTF (MAGC1_HUMAN)
QLSPERTQSTW

SEQ ID NO: 72211 - protein, 10 aa, Artificial Sequence
  Description of Artificial Sequence: Synthetic peptide
  Seed: ICSSSTSLSL (MAGC1_HUMAN)
IPSSSTSLSM

SEQ ID NO: 72212 - protein, 9 aa, Artificial Sequence
  Description of Artificial Sequence: Synthetic peptide
  Seed: VSPSFSSTL (MAGC1_HUMAN)
VIPSFSSTI

SEQ ID NO: 72213 - protein, 11 aa, Artificial Sequence
  Description of Artificial Sequence: Synthetic peptide
  Seed: SFFSYTLASLL (MAGC1_HUMAN)
SDFSYTLASLW

SEQ ID NO: 72214 - protein, 11 aa, Artificial Sequence
  Description of Artificial Sequence: Synthetic peptide
  Seed: SPLQIPVSRSF (MAGC1_HUMAN)
SRLQIPVSRSF

SEQ ID NO: 72215 - protein, 9 aa, Artificial Sequence
  Description of Artificial Sequence: Synthetic peptide
  Seed: TLLSILQSS (MAGC1_HUMAN)
TSLSILQSI

SEQ ID NO: 72216 - protein, 11 aa, Artificial Sequence
  Description of Artificial Sequence: Synthetic peptide
  Seed: AREFIEILFGI (MAGC1_HUMAN)
AREFIEILFGM

SEQ ID NO: 72217 - protein, 9 aa, Artificial Sequence
  Description of Artificial Sequence: Synthetic peptide
  Seed: FSSALLSIF (MAGC1_HUMAN)
FQSALLSIY

SEQ ID NO: 72218 - protein, 11 aa, Artificial Sequence
  Description of Artificial Sequence: Synthetic peptide
  Seed: STFEGFAQSPL (MAGC1_HUMAN)
SAFEGFAQSPW

SEQ ID NO: 72219 - protein, 9 aa, Artificial Sequence
  Description of Artificial Sequence: Synthetic peptide
  Seed: TESASSSVM (MAGC1_HUMAN)
TMSASSSVM

SEQ ID NO: 72220 - protein, 10 aa, Artificial Sequence
  Description of Artificial Sequence: Synthetic peptide
  Seed: SFSSTLVSLF (MAGC1_HUMAN)
SMSSTLVSLF

SEQ ID NO: 72221 - protein, 10 aa, Artificial Sequence
  Description of Artificial Sequence: Synthetic peptide
  Seed: SFSSTLLSIF (MAGC1_HUMAN)
SYSSTLLSII

SEQ ID NO: 72222 - protein, 11 aa, Artificial Sequence
  Description of Artificial Sequence: Synthetic peptide
  Seed: SSTPSSLPQSF (MAGC1_HUMAN)
SLTPSSLPQSY

SEQ ID NO: 72223 - protein, 10 aa, Artificial Sequence
  Description of Artificial Sequence: Synthetic peptide
  Seed: REHFAFGEPR (MAGC1_HUMAN)
RVHFAFGEPK

SEQ ID NO: 72224 - protein, 10 aa, Artificial Sequence
  Description of Artificial Sequence: Synthetic peptide
  Seed: KGTYASEEVI (MAGC1_HUMAN)
KYTYASEEVY

SEQ ID NO: 72225 - protein, 11 aa, Artificial Sequence
  Description of Artificial Sequence: Synthetic peptide
  Seed: NTVPITFPSSY (MAGC1_HUMAN)
NPVPITFPSSY

SEQ ID NO: 72226 - protein, 9 aa, Artificial Sequence
  Description of Artificial Sequence: Synthetic peptide
  Seed: SLFQSFSER (MAGC1_HUMAN)
SSFQSFSEL

SEQ ID NO: 72227 - protein, 9 aa, Artificial Sequence
  Description of Artificial Sequence: Synthetic peptide
  Seed: VQSPLQNPA (MAGC1_HUMAN)
VLSPLQNPM

SEQ ID NO: 72228 - protein, 9 aa, Artificial Sequence
  Description of Artificial Sequence: Synthetic peptide
  Seed: SFPSSTSSS (MAGC1_HUMAN)
SFPSSTSSF

SEQ ID NO: 72229 - protein, 9 aa, Artificial Sequence
  Description of Artificial Sequence: Synthetic peptide
  Seed: TLASLLQSS (MAGC1_HUMAN)
TTASLLQSA

SEQ ID NO: 72230 - protein, 9 aa, Artificial Sequence
  Description of Artificial Sequence: Synthetic peptide
  Seed: ASEEVIWDV (MAGC1_HUMAN)
ATEEVIWDV

SEQ ID NO: 72231 - protein, 9 aa, Artificial Sequence
  Description of Artificial Sequence: Synthetic peptide
  Seed: QIVPSLPEW (MAGC1_HUMAN)
QSVPSLPEF

SEQ ID NO: 72232 - protein, 9 aa, Artificial Sequence
  Description of Artificial Sequence: Synthetic peptide
  Seed: SSPERTQST (MAGC1_HUMAN)
SLPERTQSF

SEQ ID NO: 72233 - protein, 9 aa, Artificial Sequence
  Description of Artificial Sequence: Synthetic peptide
  Seed: TLDEKVDEL (MAGC1_HUMAN)
TYDEKVDEW

SEQ ID NO: 72234 - protein, 10 aa, Artificial Sequence
  Description of Artificial Sequence: Synthetic peptide
  Seed: YTLLSLFQSS (MAGC1_HUMAN)
YYLLSLFQSI

SEQ ID NO: 72235 - protein, 9 aa, Artificial Sequence
  Description of Artificial Sequence: Synthetic peptide
  Seed: ILILSIIFI (MAGC1_HUMAN)
ILILSIIFM

SEQ ID NO: 72236 - protein, 10 aa, Artificial Sequence
  Description of Artificial Sequence: Synthetic peptide
  Seed: SFSSTLLSIL (MAGC1_HUMAN)
SNSSTLLSIF

SEQ ID NO: 72237 - protein, 9 aa, Artificial Sequence
  Description of Artificial Sequence: Synthetic peptide
  Seed: VIFRKAREF (MAGC1_HUMAN)
VQFRKAREL

SEQ ID NO: 72238 - protein, 9 aa, Artificial Sequence
  Description of Artificial Sequence: Synthetic peptide
  Seed: SPLQRPVSS (MAGC1_HUMAN)
SPLQRPVSC

SEQ ID NO: 72239 - protein, 8 aa, Artificial Sequence
  Description of Artificial Sequence: Synthetic peptide
  Seed: SSSFSYTL (MAGC1_HUMAN)
SASFSYTM

SEQ ID NO: 72240 - protein, 10 aa, Artificial Sequence
  Description of Artificial Sequence: Synthetic peptide
  Seed: FLAMLKNTVP (MAGC1_HUMAN)
FLAMLKNTVS

SEQ ID NO: 72241 - protein, 9 aa, Artificial Sequence
  Description of Artificial Sequence: Synthetic peptide
  Seed: YVFVNTLDL (MAGC1_HUMAN)
YMFVNTLDW

SEQ ID NO: 72242 - protein, 10 aa, Artificial Sequence
  Description of Artificial Sequence: Synthetic peptide
  Seed: YTLASLLQSS (MAGC1_HUMAN)
YELASLLQSM

SEQ ID NO: 72243 - protein, 10 aa, Artificial Sequence
  Description of Artificial Sequence: Synthetic peptide
  Seed: VSLFQSSPER (MAGC1_HUMAN)
VSLFQSSPEK

SEQ ID NO: 72244 - protein, 9 aa, Artificial Sequence
  Description of Artificial Sequence: Synthetic peptide
  Seed: SSSTLVSIF (MAGC1_HUMAN)
SMSTLVSIL

SEQ ID NO: 72245 - protein, 9 aa, Artificial Sequence
  Description of Artificial Sequence: Synthetic peptide
  Seed: SFFSYTLAS (MAGC1_HUMAN)
SWFSYTLAY

SEQ ID NO: 72246 - protein, 9 aa, Artificial Sequence
  Description of Artificial Sequence: Synthetic peptide
  Seed: IPVSSSFSY (MAGC1_HUMAN)
ISVSSSFSF

SEQ ID NO: 72247 - protein, 9 aa, Artificial Sequence
  Description of Artificial Sequence: Synthetic peptide
  Seed: FQSSPERTH (MAGC1_HUMAN)
FGSSPERTM

SEQ ID NO: 72248 - protein, 9 aa, Artificial Sequence
  Description of Artificial Sequence: Synthetic peptide
  Seed: SLSPFSEES (MAGC1_HUMAN)
SSSPFSEEL

SEQ ID NO: 72249 - protein, 9 aa, Artificial Sequence
  Description of Artificial Sequence: Synthetic peptide
  Seed: VSAASSSTL (MAGC1_HUMAN)
VIAASSSTV

SEQ ID NO: 72250 - protein, 9 aa, Artificial Sequence
  Description of Artificial Sequence: Synthetic peptide
  Seed: SSPESPLQS (MAGC1_HUMAN)
SLPESPLQF

SEQ ID NO: 72251 - protein, 9 aa, Artificial Sequence
  Description of Artificial Sequence: Synthetic peptide
  Seed: FSYTLASLL (MAGC1_HUMAN)
FYYTLASLI

SEQ ID NO: 72252 - protein, 9 aa, Artificial Sequence
  Description of Artificial Sequence: Synthetic peptide
  Seed: FFSSALLSI (MAGC1_HUMAN)
FYSSALLSI

SEQ ID NO: 72253 - protein, 10 aa, Artificial Sequence
  Description of Artificial Sequence: Synthetic peptide
  Seed: YTLDEKVDEL (MAGC1_HUMAN)
YGLDEKVDEI

SEQ ID NO: 72254 - protein, 9 aa, Artificial Sequence
  Description of Artificial Sequence: Synthetic peptide
  Seed: ALLSIFQSS (MAGC1_HUMAN)
ASLSIFQSV

SEQ ID NO: 72255 - protein, 9 aa, Artificial Sequence
  Description of Artificial Sequence: Synthetic peptide
  Seed: DSYVFVNTL (MAGC1_HUMAN)
DTYVFVNTK

SEQ ID NO: 72256 - protein, 9 aa, Artificial Sequence
  Description of Artificial Sequence: Synthetic peptide
  Seed: REVDPDDSY (MAGC1_HUMAN)
RMVDPDDSV

SEQ ID NO: 72257 - protein, 10 aa, Artificial Sequence
  Description of Artificial Sequence: Synthetic peptide
  Seed: QEHYLEYREV (MAGC1_HUMAN)
QEHYLEYREY

SEQ ID NO: 72258 - protein, 8 aa, Artificial Sequence
  Description of Artificial Sequence: Synthetic peptide
  Seed: LAMLKNTV (MAGC1_HUMAN)
LMMLKNTM

SEQ ID NO: 72259 - protein, 9 aa, Artificial Sequence
  Description of Artificial Sequence: Synthetic peptide
  Seed: SASSSVMSP (MAGC1_HUMAN)
SSSSSVMSF

SEQ ID NO: 72260 - protein, 9 aa, Artificial Sequence
  Description of Artificial Sequence: Synthetic peptide
  Seed: SSSFSYTLL (MAGC1_HUMAN)
SASFSYTLV

SEQ ID NO: 72261 - protein, 11 aa, Artificial Sequence
  Description of Artificial Sequence: Synthetic peptide
  Seed: REVDPDDSYVF (MAGC1_HUMAN)
RLVDPDDSYVV

SEQ ID NO: 72262 - protein, 9 aa, Artificial Sequence
  Description of Artificial Sequence: Synthetic peptide
  Seed: KQPITKAEM (MAGC1_HUMAN)
KAPITKAEF

SEQ ID NO: 72263 - protein, 9 aa, Artificial Sequence
  Description of Artificial Sequence: Synthetic peptide
  Seed: FSSTLLSLF (MAGC1_HUMAN)
FVSTLLSLL

SEQ ID NO: 72264 - protein, 9 aa, Artificial Sequence
  Description of Artificial Sequence: Synthetic peptide
  Seed: SSSTLVSIF (MAGC1_HUMAN)
STSTLVSIL

SEQ ID NO: 72265 - protein, 9 aa, Artificial Sequence
  Description of Artificial Sequence: Synthetic peptide
  Seed: FAFGEPREL (MAGC1_HUMAN)
FSFGEPREM

SEQ ID NO: 72266 - protein, 10 aa, Artificial Sequence
  Description of Artificial Sequence: Synthetic peptide
  Seed: RAGREHFAFG (MAGC1_HUMAN)
RWGREHFAFK

SEQ ID NO: 72267 - protein, 10 aa, Artificial Sequence
  Description of Artificial Sequence: Synthetic peptide
  Seed: ITKAEMLTNV (MAGC1_HUMAN)
IMKAEMLTNV

SEQ ID NO: 72268 - protein, 9 aa, Artificial Sequence
  Description of Artificial Sequence: Synthetic peptide
  Seed: SPLQIVPSL (MAGC1_HUMAN)
STLQIVPSF

SEQ ID NO: 72269 - protein, 9 aa, Artificial Sequence
  Description of Artificial Sequence: Synthetic peptide
  Seed: VSRSFSSTL (MAGC1_HUMAN)
VYRSFSSTF

SEQ ID NO: 72270 - protein, 9 aa, Artificial Sequence
  Description of Artificial Sequence: Synthetic peptide
  Seed: SSPERTQST (MAGC1_HUMAN)
STPERTQSM

SEQ ID NO: 72271 - protein, 10 aa, Artificial Sequence
  Description of Artificial Sequence: Synthetic peptide
  Seed: SSSSTLLSLF (MAGC1_HUMAN)
SASSTLLSLW

SEQ ID NO: 72272 - protein, 10 aa, Artificial Sequence
  Description of Artificial Sequence: Synthetic peptide
  Seed: AMLKNTVPIT (MAGC1_HUMAN)
AMLKNTVPIV

SEQ ID NO: 72273 - protein, 9 aa, Artificial Sequence
  Description of Artificial Sequence: Synthetic peptide
  Seed: NPASSFFSS (MAGC1_HUMAN)
NMASSFFSY

SEQ ID NO: 72274 - protein, 11 aa, Artificial Sequence
  Description of Artificial Sequence: Synthetic peptide
  Seed: VLSGIGVRAGR (MAGC1_HUMAN)
VVSGIGVRAGR

SEQ ID NO: 72275 - protein, 10 aa, Artificial Sequence
  Description of Artificial Sequence: Synthetic peptide
  Seed: SLFQSSPERT (MAGC1_HUMAN)
SMFQSSPERA

SEQ ID NO: 72276 - protein, 10 aa, Artificial Sequence
  Description of Artificial Sequence: Synthetic peptide
  Seed: LLQIPMTSSF (MAGC1_HUMAN)
LEQIPMTSSW

SEQ ID NO: 72277 - protein, 9 aa, Artificial Sequence
  Description of Artificial Sequence: Synthetic peptide
  Seed: AMLKNTVPI (MAGC1_HUMAN)
AMLKNTVPT

SEQ ID NO: 72278 - protein, 9 aa, Artificial Sequence
  Description of Artificial Sequence: Synthetic peptide
  Seed: YTLASLLQS (MAGC1_HUMAN)
YMLASLLQL

SEQ ID NO: 72279 - protein, 10 aa, Artificial Sequence
  Description of Artificial Sequence: Synthetic peptide
  Seed: SPLQRPVSSF (MAGC1_HUMAN)
SMLQRPVSSY

SEQ ID NO: 72280 - protein, 10 aa, Artificial Sequence
  Description of Artificial Sequence: Synthetic peptide
  Seed: FPQSLLQIPM (MAGC1_HUMAN)
FIQSLLQIPI

SEQ ID NO: 72281 - protein, 9 aa, Artificial Sequence
  Description of Artificial Sequence: Synthetic peptide
  Seed: ASSSTLVSI (MAGC1_HUMAN)
AMSSTLVSV

SEQ ID NO: 72282 - protein, 9 aa, Artificial Sequence
  Description of Artificial Sequence: Synthetic peptide
  Seed: SPLQIVPSL (MAGC1_HUMAN)
STLQIVPSM

SEQ ID NO: 72283 - protein, 11 aa, Artificial Sequence
  Description of Artificial Sequence: Synthetic peptide
  Seed: SFFSSALLSIF (MAGC1_HUMAN)
SHFSSALLSIY

SEQ ID NO: 72284 - protein, 9 aa, Artificial Sequence
  Description of Artificial Sequence: Synthetic peptide
  Seed: SSSFSYTLL (MAGC1_HUMAN)
SVSFSYTLW

SEQ ID NO: 72285 - protein, 9 aa, Artificial Sequence
  Description of Artificial Sequence: Synthetic peptide
  Seed: VPNSSPPRY (MAGC1_HUMAN)
VQNSSPPRF

SEQ ID NO: 72286 - protein, 9 aa, Artificial Sequence
  Description of Artificial Sequence: Synthetic peptide
  Seed: LQIPVSSSS (MAGC1_HUMAN)
LPIPVSSSH

SEQ ID NO: 72287 - protein, 9 aa, Artificial Sequence
  Description of Artificial Sequence: Synthetic peptide
  Seed: SAPEGEDSL (MAGC1_HUMAN)
SVPEGEDSY

SEQ ID NO: 72288 - protein, 10 aa, Artificial Sequence
  Description of Artificial Sequence: Synthetic peptide
  Seed: ASSSVMSPSF (MAGC1_HUMAN)
AASSVMSPSF

SEQ ID NO: 72289 - protein, 11 aa, Artificial Sequence
  Description of Artificial Sequence: Synthetic peptide
  Seed: SQSSPEGKDSL (MAGC1_HUMAN)
SHSSPEGKDSL

SEQ ID NO: 72290 - protein, 9 aa, Artificial Sequence
  Description of Artificial Sequence: Synthetic peptide
  Seed: VQSPLQNPA (MAGC1_HUMAN)
VQSPLQNPY

SEQ ID NO: 72291 - protein, 10 aa, Artificial Sequence
  Description of Artificial Sequence: Synthetic peptide
  Seed: FFSYTLASLL (MAGC1_HUMAN)
FWSYTLASLY

SEQ ID NO: 72292 - protein, 9 aa, Artificial Sequence
  Description of Artificial Sequence: Synthetic peptide
  Seed: RAGREHFAF (MAGC1_HUMAN)
RVGREHFAW

SEQ ID NO: 72293 - protein, 10 aa, Artificial Sequence
  Description of Artificial Sequence: Synthetic peptide
  Seed: LQIPVSPSFS (MAGC1_HUMAN)
LRIPVSPSFY

SEQ ID NO: 72294 - protein, 9 aa, Artificial Sequence
  Description of Artificial Sequence: Synthetic peptide
  Seed: SSPERTQST (MAGC1_HUMAN)
SVPERTQSF

SEQ ID NO: 72295 - protein, 11 aa, Artificial Sequence
  Description of Artificial Sequence: Synthetic peptide
  Seed: SSFSYTLLSLF (MAGC1_HUMAN)
SKFSYTLLSLY

SEQ ID NO: 72296 - protein, 8 aa, Artificial Sequence
  Description of Artificial Sequence: Synthetic peptide
  Seed: LQSPVISF (MAGC1_HUMAN)
LQSPVISV

SEQ ID NO: 72297 - protein, 9 aa, Artificial Sequence
  Description of Artificial Sequence: Synthetic peptide
  Seed: NTHSPLQIV (MAGC1_HUMAN)
NAHSPLQIF

SEQ ID NO: 72298 - protein, 10 aa, Artificial Sequence
  Description of Artificial Sequence: Synthetic peptide
  Seed: SSFPSSTSSS (MAGC1_HUMAN)
SMFPSSTSSF

SEQ ID NO: 72299 - protein, 9 aa, Artificial Sequence
  Description of Artificial Sequence: Synthetic peptide
  Seed: GFPQSVLQI (MAGC1_HUMAN)
GAPQSVLQL

SEQ ID NO: 72300 - protein, 10 aa, Artificial Sequence
  Description of Artificial Sequence: Synthetic peptide
  Seed: SLSPLHFPQF (MAGC1_HUMAN)
SYSPLHFPQW

SEQ ID NO: 72301 - protein, 11 aa, Artificial Sequence
  Description of Artificial Sequence: Synthetic peptide
  Seed: SSFPSSTSSSL (MAGC1_HUMAN)
SVFPSSTSSSF

SEQ ID NO: 72302 - protein, 9 aa, Artificial Sequence
  Description of Artificial Sequence: Synthetic peptide
  Seed: DELARFLLL (MAGC1_HUMAN)
DELARFLLY

SEQ ID NO: 72303 - protein, 10 aa, Artificial Sequence
  Description of Artificial Sequence: Synthetic peptide
  Seed: MLKNTVPITF (MAGC1_HUMAN)
MYKNTVPITW

SEQ ID NO: 72304 - protein, 9 aa, Artificial Sequence
  Description of Artificial Sequence: Synthetic peptide
  Seed: FFSYTLASL (MAGC1_HUMAN)
FASYTLASV

SEQ ID NO: 72305 - protein, 9 aa, Artificial Sequence
  Description of Artificial Sequence: Synthetic peptide
  Seed: SSSSSSSTL (MAGC1_HUMAN)
SHSSSSSTM

SEQ ID NO: 72306 - protein, 10 aa, Artificial Sequence
  Description of Artificial Sequence: Synthetic peptide
  Seed: STSLSLPQSF (MAGC1_HUMAN)
SKSLSLPQSF

SEQ ID NO: 72307 - protein, 9 aa, Artificial Sequence
  Description of Artificial Sequence: Synthetic peptide
  Seed: IESEPLFTY (MAGC1_HUMAN)
IASEPLFTM

SEQ ID NO: 72308 - protein, 9 aa, Artificial Sequence
  Description of Artificial Sequence: Synthetic peptide
  Seed: SFSSTLVSL (MAGC1_HUMAN)
SLSSTLVSI

SEQ ID NO: 72309 - protein, 9 aa, Artificial Sequence
  Description of Artificial Sequence: Synthetic peptide
  Seed: TLDLTSEGC (MAGC1_HUMAN)
TFDLTSEGI

SEQ ID NO: 72310 - protein, 9 aa, Artificial Sequence
  Description of Artificial Sequence: Synthetic peptide
  Seed: VSAASSSTL (MAGC1_HUMAN)
VFAASSSTM

SEQ ID NO: 72311 - protein, 9 aa, Artificial Sequence
  Description of Artificial Sequence: Synthetic peptide
  Seed: SAQSTFEGF (MAGC1_HUMAN)
SMQSTFEGY

SEQ ID NO: 72312 - protein, 9 aa, Artificial Sequence
  Description of Artificial Sequence: Synthetic peptide
  Seed: SPLEGEDSL (MAGC1_HUMAN)
SPLEGEDSM

SEQ ID NO: 72313 - protein, 9 aa, Artificial Sequence
  Description of Artificial Sequence: Synthetic peptide
  Seed: SSPESTQSP (MAGC1_HUMAN)
SAPESTQSF

SEQ ID NO: 72314 - protein, 9 aa, Artificial Sequence
  Description of Artificial Sequence: Synthetic peptide
  Seed: IPVSSSFSY (MAGC1_HUMAN)
ILVSSSFSM

SEQ ID NO: 72315 - protein, 9 aa, Artificial Sequence
  Description of Artificial Sequence: Synthetic peptide
  Seed: LSDEQGMSQ (MAGC1_HUMAN)
LQDEQGMSF

SEQ ID NO: 72316 - protein, 9 aa, Artificial Sequence
  Description of Artificial Sequence: Synthetic peptide
  Seed: HFPQSPPEW (MAGC1_HUMAN)
HSPQSPPEF

SEQ ID NO: 72317 - protein, 9 aa, Artificial Sequence
  Description of Artificial Sequence: Synthetic peptide
  Seed: LQIVPSLPE (MAGC1_HUMAN)
LQIVPSLPL

SEQ ID NO: 72318 - protein, 9 aa, Artificial Sequence
  Description of Artificial Sequence: Synthetic peptide
  Seed: LQIPVSAAS (MAGC1_HUMAN)
LIIPVSAAL

SEQ ID NO: 72319 - protein, 9 aa, Artificial Sequence
  Description of Artificial Sequence: Synthetic peptide
  Seed: SSFPSSTSS (MAGC1_HUMAN)
SGFPSSTSM

SEQ ID NO: 72320 - protein, 10 aa, Artificial Sequence
  Description of Artificial Sequence: Synthetic peptide
  Seed: SSFPSSTSSS (MAGC1_HUMAN)
SMFPSSTSSM

SEQ ID NO: 72321 - protein, 11 aa, Artificial Sequence
  Description of Artificial Sequence: Synthetic peptide
  Seed: STFEGFAQSSL (MAGC1_HUMAN)
SIFEGFAQSSI

SEQ ID NO: 72322 - protein, 9 aa, Artificial Sequence
  Description of Artificial Sequence: Synthetic peptide
  Seed: AQSPLQSPV (MAGC1_HUMAN)
AMSPLQSPF

SEQ ID NO: 72323 - protein, 9 aa, Artificial Sequence
  Description of Artificial Sequence: Synthetic peptide
  Seed: TSSFSSTLL (MAGC1_HUMAN)
TSSFSSTLW

SEQ ID NO: 72324 - protein, 10 aa, Artificial Sequence
  Description of Artificial Sequence: Synthetic peptide
  Seed: GEDSLSSLHF (MAGC1_HUMAN)
GQDSLSSLHW

SEQ ID NO: 72325 - protein, 11 aa, Artificial Sequence
  Description of Artificial Sequence: Synthetic peptide
  Seed: SSFSYTLLSLF (MAGC1_HUMAN)
STFSYTLLSLY

SEQ ID NO: 72326 - protein, 10 aa, Artificial Sequence
  Description of Artificial Sequence: Synthetic peptide
  Seed: MTSSFSSTLL (MAGC1_HUMAN)
MMSSFSSTLL

SEQ ID NO: 72327 - protein, 9 aa, Artificial Sequence
  Description of Artificial Sequence: Synthetic peptide
  Seed: YTGYFPVIF (MAGC1_HUMAN)
YQGYFPVIL

SEQ ID NO: 72328 - protein, 9 aa, Artificial Sequence
  Description of Artificial Sequence: Synthetic peptide
  Seed: VSSFFSYTL (MAGC1_HUMAN)
VLSFFSYTI

SEQ ID NO: 72329 - protein, 9 aa, Artificial Sequence
  Description of Artificial Sequence: Synthetic peptide
  Seed: LASLLQSSH (MAGC1_HUMAN)
LASLLQSSY

SEQ ID NO: 72330 - protein, 11 aa, Artificial Sequence
  Description of Artificial Sequence: Synthetic peptide
  Seed: KDMPTAGMPSL (MAGC1_HUMAN)
KQMPTAGMPSF

SEQ ID NO: 72331 - protein, 9 aa, Artificial Sequence
  Description of Artificial Sequence: Synthetic peptide
  Seed: SEPLFTYTL (MAGC1_HUMAN)
SHPLFTYTI

SEQ ID NO: 72332 - protein, 9 aa, Artificial Sequence
  Description of Artificial Sequence: Synthetic peptide
  Seed: AGREHFAFG (MAGC1_HUMAN)
AGREHFAFA

SEQ ID NO: 72333 - protein, 9 aa, Artificial Sequence
  Description of Artificial Sequence: Synthetic peptide
  Seed: SRYTGYFPV (MAGC1_HUMAN)
SKYTGYFPA

SEQ ID NO: 72334 - protein, 9 aa, Artificial Sequence
  Description of Artificial Sequence: Synthetic peptide
  Seed: TTDDSTATE (MAGC1_HUMAN)
TIDDSTATW

SEQ ID NO: 72335 - protein, 9 aa, Artificial Sequence
  Description of Artificial Sequence: Synthetic peptide
  Seed: FSYTLASLL (MAGC1_HUMAN)
FLYTLASLC

SEQ ID NO: 72336 - protein, 8 aa, Artificial Sequence
  Description of Artificial Sequence: Synthetic peptide
  Seed: SSFSSTLL (MAGC1_HUMAN)
SSFSSTLW

SEQ ID NO: 72337 - protein, 11 aa, Artificial Sequence
  Description of Artificial Sequence: Synthetic peptide
  Seed: SLSQSSPVSSF (MAGC1_HUMAN)
SHSQSSPVSSF

SEQ ID NO: 72338 - protein, 10 aa, Artificial Sequence
  Description of Artificial Sequence: Synthetic peptide
  Seed: STLLSLFQSF (MAGC1_HUMAN)
SCLLSLFQSF

SEQ ID NO: 72339 - protein, 9 aa, Artificial Sequence
  Description of Artificial Sequence: Synthetic peptide
  Seed: SSFPSSTSS (MAGC1_HUMAN)
SIFPSSTSF

SEQ ID NO: 72340 - protein, 10 aa, Artificial Sequence
  Description of Artificial Sequence: Synthetic peptide
  Seed: FPQSLLQIPM (MAGC1_HUMAN)
FSQSLLQIPV

SEQ ID NO: 72341 - protein, 10 aa, Artificial Sequence
  Description of Artificial Sequence: Synthetic peptide
  Seed: SSPERTQSTF (MAGC1_HUMAN)
SIPERTQSTL

SEQ ID NO: 72342 - protein, 9 aa, Artificial Sequence
  Description of Artificial Sequence: Synthetic peptide
  Seed: IPVSSSFSY (MAGC1_HUMAN)
IGVSSSFSF

SEQ ID NO: 72343 - protein, 11 aa, Artificial Sequence
  Description of Artificial Sequence: Synthetic peptide
  Seed: KDMPTAGMPSL (MAGC1_HUMAN)
KPMPTAGMPSL

SEQ ID NO: 72344 - protein, 10 aa, Artificial Sequence
  Description of Artificial Sequence: Synthetic peptide
  Seed: KVDELARFLL (MAGC1_HUMAN)
KQDELARFLV

SEQ ID NO: 72345 - protein, 9 aa, Artificial Sequence
  Description of Artificial Sequence: Synthetic peptide
  Seed: RTQSTFEGF (MAGC1_HUMAN)
RQQSTFEGL

SEQ ID NO: 72346 - protein, 9 aa, Artificial Sequence
  Description of Artificial Sequence: Synthetic peptide
  Seed: FEGFPQSVL (MAGC1_HUMAN)
FMGFPQSVY

SEQ ID NO: 72347 - protein, 9 aa, Artificial Sequence
  Description of Artificial Sequence: Synthetic peptide
  Seed: GSPSFSSTL (MAGC1_HUMAN)
GMPSFSSTA

SEQ ID NO: 72348 - protein, 9 aa, Artificial Sequence
  Description of Artificial Sequence: Synthetic peptide
  Seed: SFSSTLVSL (MAGC1_HUMAN)
SLSSTLVSY

SEQ ID NO: 72349 - protein, 10 aa, Artificial Sequence
  Description of Artificial Sequence: Synthetic peptide
  Seed: TVPITFPSSY (MAGC1_HUMAN)
TYPITFPSSF

SEQ ID NO: 72350 - protein, 9 aa, Artificial Sequence
  Description of Artificial Sequence: Synthetic peptide
  Seed: VIWDVLSGI (MAGC1_HUMAN)
VTWDVLSGL

SEQ ID NO: 72351 - protein, 9 aa, Artificial Sequence
  Description of Artificial Sequence: Synthetic peptide
  Seed: FSYTLASLL (MAGC1_HUMAN)
FSYTLASLM

SEQ ID NO: 72352 - protein, 9 aa, Artificial Sequence
  Description of Artificial Sequence: Synthetic peptide
  Seed: VIWDVLSGI (MAGC1_HUMAN)
VQWDVLSGI

SEQ ID NO: 72353 - protein, 9 aa, Artificial Sequence
  Description of Artificial Sequence: Synthetic peptide
  Seed: SPESAQSAF (MAGC1_HUMAN)
SAESAQSAF

SEQ ID NO: 72354 - protein, 9 aa, Artificial Sequence
  Description of Artificial Sequence: Synthetic peptide
  Seed: AQSPLQSPV (MAGC1_HUMAN)
AMSPLQSPV

SEQ ID NO: 72355 - protein, 10 aa, Artificial Sequence
  Description of Artificial Sequence: Synthetic peptide
  Seed: FFSYTLASLL (MAGC1_HUMAN)
FVSYTLASLV

SEQ ID NO: 72356 - protein, 9 aa, Artificial Sequence
  Description of Artificial Sequence: Synthetic peptide
  Seed: EMLTNVISR (MAGC1_HUMAN)
ETLTNVISY

SEQ ID NO: 72357 - protein, 10 aa, Artificial Sequence
  Description of Artificial Sequence: Synthetic peptide
  Seed: FFSYTLASLL (MAGC1_HUMAN)
FLSYTLASLI

SEQ ID NO: 72358 - protein, 9 aa, Artificial Sequence
  Description of Artificial Sequence: Synthetic peptide
  Seed: SSPESPLQS (MAGC1_HUMAN)
SSPESPLQI

SEQ ID NO: 72359 - protein, 9 aa, Artificial Sequence
  Description of Artificial Sequence: Synthetic peptide
  Seed: LARFLLLKY (MAGC1_HUMAN)
LQRFLLLKM

SEQ ID NO: 72360 - protein, 11 aa, Artificial Sequence
  Description of Artificial Sequence: Synthetic peptide
  Seed: SPLQIPMTSSF (MAGC1_HUMAN)
SQLQIPMTSSY

SEQ ID NO: 72361 - protein, 10 aa, Artificial Sequence
  Description of Artificial Sequence: Synthetic peptide
  Seed: LQIPGSPSFS (MAGC1_HUMAN)
LQIPGSPSFQ

SEQ ID NO: 72362 - protein, 10 aa, Artificial Sequence
  Description of Artificial Sequence: Synthetic peptide
  Seed: RYTGYFPVIF (MAGC1_HUMAN)
RKTGYFPVIF

SEQ ID NO: 72363 - protein, 9 aa, Artificial Sequence
  Description of Artificial Sequence: Synthetic peptide
  Seed: FFSSALLSI (MAGC1_HUMAN)
FISSALLSY

SEQ ID NO: 72364 - protein, 9 aa, Artificial Sequence
  Description of Artificial Sequence: Synthetic peptide
  Seed: KAREFIEIL (MAGC1_HUMAN)
KGREFIEIW

SEQ ID NO: 72365 - protein, 10 aa, Artificial Sequence
  Description of Artificial Sequence: Synthetic peptide
  Seed: TGYFPVIFRK (MAGC1_HUMAN)
TAYFPVIFRC

SEQ ID NO: 72366 - protein, 10 aa, Artificial Sequence
  Description of Artificial Sequence: Synthetic peptide
  Seed: SFSSTLLSIF (MAGC1_HUMAN)
SVSSTLLSIY

SEQ ID NO: 72367 - protein, 10 aa, Artificial Sequence
  Description of Artificial Sequence: Synthetic peptide
  Seed: SFSERTQSTF (MAGC1_HUMAN)
SVSERTQSTY

SEQ ID NO: 72368 - protein, 10 aa, Artificial Sequence
  Description of Artificial Sequence: Synthetic peptide
  Seed: EVIWDVLSGI (MAGC1_HUMAN)
EFIWDVLSGI

SEQ ID NO: 72369 - protein, 9 aa, Artificial Sequence
  Description of Artificial Sequence: Synthetic peptide
  Seed: SGIGVRAGR (MAGC1_HUMAN)
STIGVRAGR

SEQ ID NO: 72370 - protein, 11 aa, Artificial Sequence
  Description of Artificial Sequence: Synthetic peptide
  Seed: SAASSSTLVSI (MAGC1_HUMAN)
SLASSSTLVSM

SEQ ID NO: 72371 - protein, 10 aa, Artificial Sequence
  Description of Artificial Sequence: Synthetic peptide
  Seed: STLLSLFQSF (MAGC1_HUMAN)
SALLSLFQSY

SEQ ID NO: 72372 - protein, 9 aa, Artificial Sequence
  Description of Artificial Sequence: Synthetic peptide
  Seed: FTYTLDEKV (MAGC1_HUMAN)
FRYTLDEKM

SEQ ID NO: 72373 - protein, 9 aa, Artificial Sequence
  Description of Artificial Sequence: Synthetic peptide
  Seed: LQIPMTSSF (MAGC1_HUMAN)
LEIPMTSSM

SEQ ID NO: 72374 - protein, 10 aa, Artificial Sequence
  Description of Artificial Sequence: Synthetic peptide
  Seed: MTSSFSSTLL (MAGC1_HUMAN)
MLSSFSSTLM

SEQ ID NO: 72375 - protein, 9 aa, Artificial Sequence
  Description of Artificial Sequence: Synthetic peptide
  Seed: MPSLLQSSS (MAGC1_HUMAN)
MVSLLQSSM

SEQ ID NO: 72376 - protein, 9 aa, Artificial Sequence
  Description of Artificial Sequence: Synthetic peptide
  Seed: LQNPASSFF (MAGC1_HUMAN)
LHNPASSFF

SEQ ID NO: 72377 - protein, 10 aa, Artificial Sequence
  Description of Artificial Sequence: Synthetic peptide
  Seed: EFLAMLKNTV (MAGC1_HUMAN)
EYLAMLKNTL

SEQ ID NO: 72378 - protein, 9 aa, Artificial Sequence
  Description of Artificial Sequence: Synthetic peptide
  Seed: SSPECTQST (MAGC1_HUMAN)
STPECTQSF

SEQ ID NO: 72379 - protein, 9 aa, Artificial Sequence
  Description of Artificial Sequence: Synthetic peptide
  Seed: SSFFSYTLA (MAGC1_HUMAN)
SVFFSYTLV

SEQ ID NO: 72380 - protein, 9 aa, Artificial Sequence
  Description of Artificial Sequence: Synthetic peptide
  Seed: VSSSSSSTL (MAGC1_HUMAN)
VPSSSSSTY

SEQ ID NO: 72381 - protein, 10 aa, Artificial Sequence
  Description of Artificial Sequence: Synthetic peptide
  Seed: EGPAQSPLQR (MAGC1_HUMAN)
EFPAQSPLQR

SEQ ID NO: 72382 - protein, 9 aa, Artificial Sequence
  Description of Artificial Sequence: Synthetic peptide
  Seed: SSPPRYEFL (MAGC1_HUMAN)
SVPPRYEFM

SEQ ID NO: 72383 - protein, 11 aa, Artificial Sequence
  Description of Artificial Sequence: Synthetic peptide
  Seed: IPVSSSSSSTL (MAGC1_HUMAN)
IMVSSSSSSTY

SEQ ID NO: 72384 - protein, 9 aa, Artificial Sequence
  Description of Artificial Sequence: Synthetic peptide
  Seed: FAFGEPREL (MAGC1_HUMAN)
FAFGEPREW

SEQ ID NO: 72385 - protein, 8 aa, Artificial Sequence
  Description of Artificial Sequence: Synthetic peptide
  Seed: FGEPRELL (MAGC1_HUMAN)
FAEPRELL

SEQ ID NO: 72386 - protein, 9 aa, Artificial Sequence
  Description of Artificial Sequence: Synthetic peptide
  Seed: TTDDSTATE (MAGC1_HUMAN)
TADDSTATT

SEQ ID NO: 72387 - protein, 10 aa, Artificial Sequence
  Description of Artificial Sequence: Synthetic peptide
  Seed: ASSSVMSPSF (MAGC1_HUMAN)
AMSSVMSPSF

SEQ ID NO: 72388 - protein, 9 aa, Artificial Sequence
  Description of Artificial Sequence: Synthetic peptide
  Seed: AQSSLQIPV (MAGC1_HUMAN)
ATSSLQIPY

SEQ ID NO: 72389 - protein, 11 aa, Artificial Sequence
  Description of Artificial Sequence: Synthetic peptide
  Seed: SPLQIPVSPSS (MAGC1_HUMAN)
SSLQIPVSPSY

SEQ ID NO: 72390 - protein, 10 aa, Artificial Sequence
  Description of Artificial Sequence: Synthetic peptide
  Seed: REFIEILFGI (MAGC1_HUMAN)
RAFIEILFGF

SEQ ID NO: 72391 - protein, 9 aa, Artificial Sequence
  Description of Artificial Sequence: Synthetic peptide
  Seed: VSSSSSSTL (MAGC1_HUMAN)
VMSSSSSTW

SEQ ID NO: 72392 - protein, 9 aa, Artificial Sequence
  Description of Artificial Sequence: Synthetic peptide
  Seed: FSSTLVSLF (MAGC1_HUMAN)
FPSTLVSLM

SEQ ID NO: 72393 - protein, 9 aa, Artificial Sequence
  Description of Artificial Sequence: Synthetic peptide
  Seed: ESDDTLYPL (MAGC1_HUMAN)
EADDTLYPM

SEQ ID NO: 72394 - protein, 10 aa, Artificial Sequence
  Description of Artificial Sequence: Synthetic peptide
  Seed: ISRYTGYFPV (MAGC1_HUMAN)
IMRYTGYFPK

SEQ ID NO: 72395 - protein, 9 aa, Artificial Sequence
  Description of Artificial Sequence: Synthetic peptide
  Seed: SSSFSYTLL (MAGC1_HUMAN)
SVSFSYTLV

SEQ ID NO: 72396 - protein, 11 aa, Artificial Sequence
  Description of Artificial Sequence: Synthetic peptide
  Seed: RPVSSFFSYTL (MAGC1_HUMAN)
RAVSSFFSYTF

SEQ ID NO: 72397 - protein, 9 aa, Artificial Sequence
  Description of Artificial Sequence: Synthetic peptide
  Seed: ESSSPVDEY (MAGC1_HUMAN)
ELSSPVDER

SEQ ID NO: 72398 - protein, 11 aa, Artificial Sequence
  Description of Artificial Sequence: Synthetic peptide
  Seed: STFEGFPQSLL (MAGC1_HUMAN)
SLFEGFPQSLI

SEQ ID NO: 72399 - protein, 9 aa, Artificial Sequence
  Description of Artificial Sequence: Synthetic peptide
  Seed: DVLSGIGVR (MAGC1_HUMAN)
DILSGIGVY

SEQ ID NO: 72400 - protein, 9 aa, Artificial Sequence
  Description of Artificial Sequence: Synthetic peptide
  Seed: GFPQSLLQI (MAGC1_HUMAN)
GAPQSLLQI

SEQ ID NO: 72401 - protein, 8 aa, Artificial Sequence
  Description of Artificial Sequence: Synthetic peptide
  Seed: QSSPVSSF (MAGC1_HUMAN)
QQSPVSSF

SEQ ID NO: 72402 - protein, 9 aa, Artificial Sequence
  Description of Artificial Sequence: Synthetic peptide
  Seed: LQIPVSAAS (MAGC1_HUMAN)
LTIPVSAAI

SEQ ID NO: 72403 - protein, 8 aa, Artificial Sequence
  Description of Artificial Sequence: Synthetic peptide
  Seed: SSFSSTLL (MAGC1_HUMAN)
STFSSTLF

SEQ ID NO: 72404 - protein, 10 aa, Artificial Sequence
  Description of Artificial Sequence: Synthetic peptide
  Seed: VISFSSSTSL (MAGC1_HUMAN)
VWSFSSSTSF

SEQ ID NO: 72405 - protein, 10 aa, Artificial Sequence
  Description of Artificial Sequence: Synthetic peptide
  Seed: SSSSSTLLSL (MAGC1_HUMAN)
STSSSTLLSV

SEQ ID NO: 72406 - protein, 9 aa, Artificial Sequence
  Description of Artificial Sequence: Synthetic peptide
  Seed: RSFSSTLLS (MAGC1_HUMAN)
RTFSSTLLS

SEQ ID NO: 72407 - protein, 9 aa, Artificial Sequence
  Description of Artificial Sequence: Synthetic peptide
  Seed: WVQEHYLEY (MAGC1_HUMAN)
WIQEHYLEF

SEQ ID NO: 72408 - protein, 9 aa, Artificial Sequence
  Description of Artificial Sequence: Synthetic peptide
  Seed: GSPSFSSTL (MAGC1_HUMAN)
GYPSFSSTF

SEQ ID NO: 72409 - protein, 10 aa, Artificial Sequence
  Description of Artificial Sequence: Synthetic peptide
  Seed: ESAQSAFEGF (MAGC1_HUMAN)
ETAQSAFEGW

SEQ ID NO: 72410 - protein, 9 aa, Artificial Sequence
  Description of Artificial Sequence: Synthetic peptide
  Seed: QVKQPITKA (MAGC1_HUMAN)
QSKQPITKK

SEQ ID NO: 72411 - protein, 9 aa, Artificial Sequence
  Description of Artificial Sequence: Synthetic peptide
  Seed: SSSSSSSTL (MAGC1_HUMAN)
SISSSSSTI

SEQ ID NO: 72412 - protein, 10 aa, Artificial Sequence
  Description of Artificial Sequence: Synthetic peptide
  Seed: SQSSPVSSFP (MAGC1_HUMAN)
SQSSPVSSFM

SEQ ID NO: 72413 - protein, 10 aa, Artificial Sequence
  Description of Artificial Sequence: Synthetic peptide
  Seed: SSSSSTLLSL (MAGC1_HUMAN)
SQSSSTLLSW

SEQ ID NO: 72414 - protein, 10 aa, Artificial Sequence
  Description of Artificial Sequence: Synthetic peptide
  Seed: QIPVSSSFSY (MAGC1_HUMAN)
QFPVSSSFSF

SEQ ID NO: 72415 - protein, 10 aa, Artificial Sequence
  Description of Artificial Sequence: Synthetic peptide
  Seed: SQSPPEGEDV (MAGC1_HUMAN)
SQSPPEGEDL

SEQ ID NO: 72416 - protein, 10 aa, Artificial Sequence
  Description of Artificial Sequence: Synthetic peptide
  Seed: SFPSSTSSSL (MAGC1_HUMAN)
SEPSSTSSSI

SEQ ID NO: 72417 - protein, 10 aa, Artificial Sequence
  Description of Artificial Sequence: Synthetic peptide
  Seed: SFSSTLLSIF (MAGC1_HUMAN)
SSSSTLLSIW

SEQ ID NO: 72418 - protein, 9 aa, Artificial Sequence
  Description of Artificial Sequence: Synthetic peptide
  Seed: SFSYTLLSL (MAGC1_HUMAN)
SYSYTLLSY

SEQ ID NO: 72419 - protein, 10 aa, Artificial Sequence
  Description of Artificial Sequence: Synthetic peptide
  Seed: VSRSFSSTLL (MAGC1_HUMAN)
VTRSFSSTLM

SEQ ID NO: 72420 - protein, 8 aa, Artificial Sequence
  Description of Artificial Sequence: Synthetic peptide
  Seed: SSPPRYEF (MAGC1_HUMAN)
SAPPRYEL

SEQ ID NO: 72421 - protein, 9 aa, Artificial Sequence
  Description of Artificial Sequence: Synthetic peptide
  Seed: KVVEFLAML (MAGC1_HUMAN)
KAVEFLAMW

SEQ ID NO: 72422 - protein, 9 aa, Artificial Sequence
  Description of Artificial Sequence: Synthetic peptide
  Seed: FSYTLLSLF (MAGC1_HUMAN)
FTYTLLSLM

SEQ ID NO: 72423 - protein, 11 aa, Artificial Sequence
  Description of Artificial Sequence: Synthetic peptide
  Seed: TTDDSTATESA (MAGC1_HUMAN)
TMDDSTATESM

SEQ ID NO: 72424 - protein, 11 aa, Artificial Sequence
  Description of Artificial Sequence: Synthetic peptide
  Seed: IPMTSSFSSTL (MAGC1_HUMAN)
INMTSSFSSTW

SEQ ID NO: 72425 - protein, 11 aa, Artificial Sequence
  Description of Artificial Sequence: Synthetic peptide
  Seed: STFEGFPQSLL (MAGC1_HUMAN)
SMFEGFPQSLL

SEQ ID NO: 72426 - protein, 10 aa, Artificial Sequence
  Description of Artificial Sequence: Synthetic peptide
  Seed: SPPEGPVQSP (MAGC1_HUMAN)
SPPEGPVQSM

SEQ ID NO: 72427 - protein, 9 aa, Artificial Sequence
  Description of Artificial Sequence: Synthetic peptide
  Seed: FQSSLQSPV (MAGC1_HUMAN)
FESSLQSPF

SEQ ID NO: 72428 - protein, 11 aa, Artificial Sequence
  Description of Artificial Sequence: Synthetic peptide
  Seed: SSTLLSLFQSF (MAGC1_HUMAN)
SQTLLSLFQSY

SEQ ID NO: 72429 - protein, 9 aa, Artificial Sequence
  Description of Artificial Sequence: Synthetic peptide
  Seed: RTHSTFEGF (MAGC1_HUMAN)
RQHSTFEGV

SEQ ID NO: 72430 - protein, 9 aa, Artificial Sequence
  Description of Artificial Sequence: Synthetic peptide
  Seed: IPVSRSFSS (MAGC1_HUMAN)
IIVSRSFSY

SEQ ID NO: 72431 - protein, 9 aa, Artificial Sequence
  Description of Artificial Sequence: Synthetic peptide
  Seed: FSEESSSPV (MAGC1_HUMAN)
FIEESSSPF

SEQ ID NO: 72432 - protein, 10 aa, Artificial Sequence
  Description of Artificial Sequence: Synthetic peptide
  Seed: SFPSSTSSSL (MAGC1_HUMAN)
SNPSSTSSSM

SEQ ID NO: 72433 - protein, 10 aa, Artificial Sequence
  Description of Artificial Sequence: Synthetic peptide
  Seed: SFFSYTLASL (MAGC1_HUMAN)
SYFSYTLASL

SEQ ID NO: 72434 - protein, 10 aa, Artificial Sequence
  Description of Artificial Sequence: Synthetic peptide
  Seed: VISFSSSTSL (MAGC1_HUMAN)
VFSFSSSTSF

SEQ ID NO: 72435 - protein, 9 aa, Artificial Sequence
  Description of Artificial Sequence: Synthetic peptide
  Seed: RPVSSFFSY (MAGC1_HUMAN)
REVSSFFSL

SEQ ID NO: 72436 - protein, 9 aa, Artificial Sequence
  Description of Artificial Sequence: Synthetic peptide
  Seed: SSPERTQST (MAGC1_HUMAN)
SYPERTQSV

SEQ ID NO: 72437 - protein, 10 aa, Artificial Sequence
  Description of Artificial Sequence: Synthetic peptide
  Seed: LLQIPMTSSF (MAGC1_HUMAN)
LRQIPMTSSM

SEQ ID NO: 72438 - protein, 10 aa, Artificial Sequence
  Description of Artificial Sequence: Synthetic peptide
  Seed: FAQSSLQIPV (MAGC1_HUMAN)
FSQSSLQIPV

SEQ ID NO: 72439 - protein, 10 aa, Artificial Sequence
  Description of Artificial Sequence: Synthetic peptide
  Seed: SSSSSTLLSL (MAGC1_HUMAN)
SESSSTLLSY

SEQ ID NO: 72440 - protein, 9 aa, Artificial Sequence
  Description of Artificial Sequence: Synthetic peptide
  Seed: YTGYFPVIF (MAGC1_HUMAN)
YLGYFPVIY

SEQ ID NO: 72441 - protein, 9 aa, Artificial Sequence
  Description of Artificial Sequence: Synthetic peptide
  Seed: SSHESPQSP (MAGC1_HUMAN)
STHESPQSY

SEQ ID NO: 72442 - protein, 9 aa, Artificial Sequence
  Description of Artificial Sequence: Synthetic peptide
  Seed: FSSALLSIF (MAGC1_HUMAN)
FVSALLSIW

SEQ ID NO: 72443 - protein, 9 aa, Artificial Sequence
  Description of Artificial Sequence: Synthetic peptide
  Seed: FQSSLQSPV (MAGC1_HUMAN)
FVSSLQSPM

SEQ ID NO: 72444 - protein, 9 aa, Artificial Sequence
  Description of Artificial Sequence: Synthetic peptide
  Seed: SSFPSSTSS (MAGC1_HUMAN)
SSFPSSTSH

SEQ ID NO: 72445 - protein, 9 aa, Artificial Sequence
  Description of Artificial Sequence: Synthetic peptide
  Seed: TLLSLFQSF (MAGC1_HUMAN)
TMLSLFQSA

SEQ ID NO: 72446 - protein, 10 aa, Artificial Sequence
  Description of Artificial Sequence: Synthetic peptide
  Seed: SSPESAQSTF (MAGC1_HUMAN)
SAPESAQSTW

SEQ ID NO: 72447 - protein, 9 aa, Artificial Sequence
  Description of Artificial Sequence: Synthetic peptide
  Seed: TPSSLPQSF (MAGC1_HUMAN)
TPSSLPQSY

SEQ ID NO: 72448 - protein, 10 aa, Artificial Sequence
  Description of Artificial Sequence: Synthetic peptide
  Seed: KAREFIEILF (MAGC1_HUMAN)
KTREFIEILL

SEQ ID NO: 72449 - protein, 9 aa, Artificial Sequence
  Description of Artificial Sequence: Synthetic peptide
  Seed: KVDELARFL (MAGC1_HUMAN)
KGDELARFI

SEQ ID NO: 72450 - protein, 9 aa, Artificial Sequence
  Description of Artificial Sequence: Synthetic peptide
  Seed: SSPEGKDSL (MAGC1_HUMAN)
SWPEGKDSM

SEQ ID NO: 72451 - protein, 11 aa, Artificial Sequence
  Description of Artificial Sequence: Synthetic peptide
  Seed: SSFPSSTSSSL (MAGC1_HUMAN)
STFPSSTSSSW

SEQ ID NO: 72452 - protein, 9 aa, Artificial Sequence
  Description of Artificial Sequence: Synthetic peptide
  Seed: NTVPITFPS (MAGC1_HUMAN)
NQVPITFPV

SEQ ID NO: 72453 - protein, 9 aa, Artificial Sequence
  Description of Artificial Sequence: Synthetic peptide
  Seed: RPVSSFFSY (MAGC1_HUMAN)
RPVSSFFSW

SEQ ID NO: 72454 - protein, 9 aa, Artificial Sequence
  Description of Artificial Sequence: Synthetic peptide
  Seed: LKYQVKQPI (MAGC1_HUMAN)
LFYQVKQPY

SEQ ID NO: 72455 - protein, 10 aa, Artificial Sequence
  Description of Artificial Sequence: Synthetic peptide
  Seed: FSSSTSLSPF (MAGC1_HUMAN)
FASSTSLSPF

SEQ ID NO: 72456 - protein, 9 aa, Artificial Sequence
  Description of Artificial Sequence: Synthetic peptide
  Seed: AQSPLQSPV (MAGC1_HUMAN)
ATSPLQSPV

SEQ ID NO: 72457 - protein, 9 aa, Artificial Sequence
  Description of Artificial Sequence: Synthetic peptide
  Seed: SSSSSSSTL (MAGC1_HUMAN)
SASSSSSTV

SEQ ID NO: 72458 - protein, 9 aa, Artificial Sequence
  Description of Artificial Sequence: Synthetic peptide
  Seed: TKVWVQEHY (MAGC1_HUMAN)
TVVWVQEHY

SEQ ID NO: 72459 - protein, 9 aa, Artificial Sequence
  Description of Artificial Sequence: Synthetic peptide
  Seed: ASEEVIWDV (MAGC1_HUMAN)
AMEEVIWDM

SEQ ID NO: 72460 - protein, 11 aa, Artificial Sequence
  Description of Artificial Sequence: Synthetic peptide
  Seed: REVDPDDSYVF (MAGC1_HUMAN)
REVDPDDSYVI

SEQ ID NO: 72461 - protein, 9 aa, Artificial Sequence
  Description of Artificial Sequence: Synthetic peptide
  Seed: TSLSLPQSF (MAGC1_HUMAN)
TKLSLPQSY

SEQ ID NO: 72462 - protein, 9 aa, Artificial Sequence
  Description of Artificial Sequence: Synthetic peptide
  Seed: TTDDSTATE (MAGC1_HUMAN)
TLDDSTATL

SEQ ID NO: 72463 - protein, 9 aa, Artificial Sequence
  Description of Artificial Sequence: Synthetic peptide
  Seed: AQSPLQRPV (MAGC1_HUMAN)
AMSPLQRPM

SEQ ID NO: 72464 - protein, 9 aa, Artificial Sequence
  Description of Artificial Sequence: Synthetic peptide
  Seed: MLTNVISRY (MAGC1_HUMAN)
MSTNVISRK

SEQ ID NO: 72465 - protein, 10 aa, Artificial Sequence
  Description of Artificial Sequence: Synthetic peptide
  Seed: AASSSTLVSI (MAGC1_HUMAN)
AVSSSTLVSF

SEQ ID NO: 72466 - protein, 9 aa, Artificial Sequence
  Description of Artificial Sequence: Synthetic peptide
  Seed: SICSSSTSL (MAGC1_HUMAN)
SVCSSSTSL

SEQ ID NO: 72467 - protein, 9 aa, Artificial Sequence
  Description of Artificial Sequence: Synthetic peptide
  Seed: GVRAGREHF (MAGC1_HUMAN)
GMRAGREHY

SEQ ID NO: 72468 - protein, 9 aa, Artificial Sequence
  Description of Artificial Sequence: Synthetic peptide
  Seed: SSSVMSPSF (MAGC1_HUMAN)
SESVMSPSF

SEQ ID NO: 72469 - protein, 10 aa, Artificial Sequence
  Description of Artificial Sequence: Synthetic peptide
  Seed: SRYTGYFPVI (MAGC1_HUMAN)
SQYTGYFPVW

SEQ ID NO: 72470 - protein, 10 aa, Artificial Sequence
  Description of Artificial Sequence: Synthetic peptide
  Seed: FSSTLVSLFQ (MAGC1_HUMAN)
FVSTLVSLFW

SEQ ID NO: 72471 - protein, 11 aa, Artificial Sequence
  Description of Artificial Sequence: Synthetic peptide
  Seed: ITFPSSYKDAL (MAGC1_HUMAN)
ISFPSSYKDAF

SEQ ID NO: 72472 - protein, 9 aa, Artificial Sequence
  Description of Artificial Sequence: Synthetic peptide
  Seed: SSPECTQST (MAGC1_HUMAN)
SVPECTQSL

SEQ ID NO: 72473 - protein, 9 aa, Artificial Sequence
  Description of Artificial Sequence: Synthetic peptide
  Seed: FFSYTLASL (MAGC1_HUMAN)
FTSYTLASL

SEQ ID NO: 72474 - protein, 11 aa, Artificial Sequence
  Description of Artificial Sequence: Synthetic peptide
  Seed: SFFSYTLASLL (MAGC1_HUMAN)
SLFSYTLASLF

SEQ ID NO: 72475 - protein, 10 aa, Artificial Sequence
  Description of Artificial Sequence: Synthetic peptide
  Seed: RSFSSTLLSI (MAGC1_HUMAN)
RCFSSTLLSF

SEQ ID NO: 72476 - protein, 9 aa, Artificial Sequence
  Description of Artificial Sequence: Synthetic peptide
  Seed: MGDKDMPTA (MAGC1_HUMAN)
MVDKDMPTI

SEQ ID NO: 72477 - protein, 9 aa, Artificial Sequence
  Description of Artificial Sequence: Synthetic peptide
  Seed: LQIPVSPSF (MAGC1_HUMAN)
LCIPVSPSY

SEQ ID NO: 72478 - protein, 11 aa, Artificial Sequence
  Description of Artificial Sequence: Synthetic peptide
  Seed: SPFSEESSSPV (MAGC1_HUMAN)
SPFSEESSSPF

SEQ ID NO: 72479 - protein, 9 aa, Artificial Sequence
  Description of Artificial Sequence: Synthetic peptide
  Seed: SAQSAFEGF (MAGC1_HUMAN)
STQSAFEGW

SEQ ID NO: 72480 - protein, 9 aa, Artificial Sequence
  Description of Artificial Sequence: Synthetic peptide
  Seed: SSSTSLSPF (MAGC1_HUMAN)
SSSTSLSPY

SEQ ID NO: 72481 - protein, 10 aa, Artificial Sequence
  Description of Artificial Sequence: Synthetic peptide
  Seed: KVVEFLAMLK (MAGC1_HUMAN)
KCVEFLAMLR

SEQ ID NO: 72482 - protein, 9 aa, Artificial Sequence
  Description of Artificial Sequence: Synthetic peptide
  Seed: MSQNRLLIL (MAGC1_HUMAN)
MMQNRLLIW

SEQ ID NO: 72483 - protein, 10 aa, Artificial Sequence
  Description of Artificial Sequence: Synthetic peptide
  Seed: RYTGYFPVIF (MAGC1_HUMAN)
RTTGYFPVIY

SEQ ID NO: 72484 - protein, 9 aa, Artificial Sequence
  Description of Artificial Sequence: Synthetic peptide
  Seed: SLTDSESLI (MAGC1_HUMAN)
SQTDSESLV

SEQ ID NO: 72485 - protein, 9 aa, Artificial Sequence
  Description of Artificial Sequence: Synthetic peptide
  Seed: SPLQRPVSS (MAGC1_HUMAN)
SLLQRPVSI

SEQ ID NO: 72486 - protein, 10 aa, Artificial Sequence
  Description of Artificial Sequence: Synthetic peptide
  Seed: SSSSSTLLSL (MAGC1_HUMAN)
SQSSSTLLSY

SEQ ID NO: 72487 - protein, 11 aa, Artificial Sequence
  Description of Artificial Sequence: Synthetic peptide
  Seed: QSSPESAQSAF (MAGC1_HUMAN)
QASPESAQSAY

SEQ ID NO: 72488 - protein, 9 aa, Artificial Sequence
  Description of Artificial Sequence: Synthetic peptide
  Seed: FPQFPPQGE (MAGC1_HUMAN)
FPQFPPQGP

SEQ ID NO: 72489 - protein, 11 aa, Artificial Sequence
  Description of Artificial Sequence: Synthetic peptide
  Seed: QSSPECTQSTF (MAGC1_HUMAN)
QPSPECTQSTY

SEQ ID NO: 72490 - protein, 11 aa, Artificial Sequence
  Description of Artificial Sequence: Synthetic peptide
  Seed: RSFSSTLLSIF (MAGC1_HUMAN)
RWFSSTLLSIW

SEQ ID NO: 72491 - protein, 10 aa, Artificial Sequence
  Description of Artificial Sequence: Synthetic peptide
  Seed: ASSFFSSALL (MAGC1_HUMAN)
AQSFFSSALW

SEQ ID NO: 72492 - protein, 9 aa, Artificial Sequence
  Description of Artificial Sequence: Synthetic peptide
  Seed: SLPEWEDSL (MAGC1_HUMAN)
SLPEWEDSA

SEQ ID NO: 72493 - protein, 10 aa, Artificial Sequence
  Description of Artificial Sequence: Synthetic peptide
  Seed: FPQSPLQIPV (MAGC1_HUMAN)
FTQSPLQIPI

SEQ ID NO: 72494 - protein, 9 aa, Artificial Sequence
  Description of Artificial Sequence: Synthetic peptide
  Seed: SQSSPVSSF (MAGC1_HUMAN)
SHSSPVSSI

SEQ ID NO: 72495 - protein, 9 aa, Artificial Sequence
  Description of Artificial Sequence: Synthetic peptide
  Seed: MTSSFSSTL (MAGC1_HUMAN)
MISSFSSTY

SEQ ID NO: 72496 - protein, 11 aa, Artificial Sequence
  Description of Artificial Sequence: Synthetic peptide
  Seed: IPVSAASSSTL (MAGC1_HUMAN)
IIVSAASSSTW

SEQ ID NO: 72497 - protein, 9 aa, Artificial Sequence
  Description of Artificial Sequence: Synthetic peptide
  Seed: DELARFLLL (MAGC1_HUMAN)
DALARFLLL

SEQ ID NO: 72498 - protein, 9 aa, Artificial Sequence
  Description of Artificial Sequence: Synthetic peptide
  Seed: FEGFAQSPL (MAGC1_HUMAN)
FEGFAQSPM

SEQ ID NO: 72499 - protein, 11 aa, Artificial Sequence
  Description of Artificial Sequence: Synthetic peptide
  Seed: SPLQRPVSSFF (MAGC1_HUMAN)
SPLQRPVSSFI

SEQ ID NO: 72500 - protein, 10 aa, Artificial Sequence
  Description of Artificial Sequence: Synthetic peptide
  Seed: VSRSFSSTLL (MAGC1_HUMAN)
VMRSFSSTLK

SEQ ID NO: 72501 - protein, 10 aa, Artificial Sequence
  Description of Artificial Sequence: Synthetic peptide
  Seed: PLQIPVSSSF (MAGC1_HUMAN)
PQQIPVSSSY

SEQ ID NO: 72502 - protein, 10 aa, Artificial Sequence
  Description of Artificial Sequence: Synthetic peptide
  Seed: IIDTTDDSTA (MAGC1_HUMAN)
ILDTTDDSTM

SEQ ID NO: 72503 - protein, 10 aa, Artificial Sequence
  Description of Artificial Sequence: Synthetic peptide
  Seed: REVDPDDSYV (MAGC1_HUMAN)
RMVDPDDSYW

SEQ ID NO: 72504 - protein, 10 aa, Artificial Sequence
  Description of Artificial Sequence: Synthetic peptide
  Seed: FPQSLLQIPM (MAGC1_HUMAN)
FQQSLLQIPA

SEQ ID NO: 72505 - protein, 9 aa, Artificial Sequence
  Description of Artificial Sequence: Synthetic peptide
  Seed: SFSSTLVSL (MAGC1_HUMAN)
SNSSTLVSY

SEQ ID NO: 72506 - protein, 10 aa, Artificial Sequence
  Description of Artificial Sequence: Synthetic peptide
  Seed: SFPSSTSSSL (MAGC1_HUMAN)
SYPSSTSSSF

SEQ ID NO: 72507 - protein, 10 aa, Artificial Sequence
  Description of Artificial Sequence: Synthetic peptide
  Seed: VISFSSSTSL (MAGC1_HUMAN)
VVSFSSSTSW

SEQ ID NO: 72508 - protein, 10 aa, Artificial Sequence
  Description of Artificial Sequence: Synthetic peptide
  Seed: FSSTLVSLFQ (MAGC1_HUMAN)
FSSTLVSLFF

SEQ ID NO: 72509 - protein, 11 aa, Artificial Sequence
  Description of Artificial Sequence: Synthetic peptide
  Seed: SLSQSSPVSSF (MAGC1_HUMAN)
SDSQSSPVSSY

SEQ ID NO: 72510 - protein, 9 aa, Artificial Sequence
  Description of Artificial Sequence: Synthetic peptide
  Seed: VSPSSSSTL (MAGC1_HUMAN)
VSPSSSSTW

SEQ ID NO: 72511 - protein, 10 aa, Artificial Sequence
  Description of Artificial Sequence: Synthetic peptide
  Seed: ATESASSSVM (MAGC1_HUMAN)
ANESASSSVF

SEQ ID NO: 72512 - protein, 9 aa, Artificial Sequence
  Description of Artificial Sequence: Synthetic peptide
  Seed: RKVVEFLAM (MAGC1_HUMAN)
RQVVEFLAH

SEQ ID NO: 72513 - protein, 10 aa, Artificial Sequence
  Description of Artificial Sequence: Synthetic peptide
  Seed: REVDPDDSYV (MAGC1_HUMAN)
RMVDPDDSYI

SEQ ID NO: 72514 - protein, 11 aa, Artificial Sequence
  Description of Artificial Sequence: Synthetic peptide
  Seed: SLFQSSPERTH (MAGC1_HUMAN)
SAFQSSPERTY

SEQ ID NO: 72515 - protein, 9 aa, Artificial Sequence
  Description of Artificial Sequence: Synthetic peptide
  Seed: VISRYTGYF (MAGC1_HUMAN)
VYSRYTGYY

SEQ ID NO: 72516 - protein, 9 aa, Artificial Sequence
  Description of Artificial Sequence: Synthetic peptide
  Seed: TESASSSVM (MAGC1_HUMAN)
TESASSSVY

SEQ ID NO: 72517 - protein, 9 aa, Artificial Sequence
  Description of Artificial Sequence: Synthetic peptide
  Seed: SICSSSTSL (MAGC1_HUMAN)
SACSSSTSM

SEQ ID NO: 72518 - protein, 9 aa, Artificial Sequence
  Description of Artificial Sequence: Synthetic peptide
  Seed: SSPECTQST (MAGC1_HUMAN)
SNPECTQSL

SEQ ID NO: 72519 - protein, 9 aa, Artificial Sequence
  Description of Artificial Sequence: Synthetic peptide
  Seed: SRYTGYFPV (MAGC1_HUMAN)
SMYTGYFPL

SEQ ID NO: 72520 - protein, 10 aa, Artificial Sequence
  Description of Artificial Sequence: Synthetic peptide
  Seed: EILFGISLRE (MAGC1_HUMAN)
EKLFGISLRR

SEQ ID NO: 72521 - protein, 9 aa, Artificial Sequence
  Description of Artificial Sequence: Synthetic peptide
  Seed: FPQSPPQGE (MAGC1_HUMAN)
FPQSPPQGP

SEQ ID NO: 72522 - protein, 9 aa, Artificial Sequence
  Description of Artificial Sequence: Synthetic peptide
  Seed: VSAASSSTL (MAGC1_HUMAN)
VIAASSSTW

SEQ ID NO: 72523 - protein, 9 aa, Artificial Sequence
  Description of Artificial Sequence: Synthetic peptide
  Seed: VQSPLHSPQ (MAGC1_HUMAN)
VLSPLHSPY

SEQ ID NO: 72524 - protein, 11 aa, Artificial Sequence
  Description of Artificial Sequence: Synthetic peptide
  Seed: STFEGFAQSSL (MAGC1_HUMAN)
SLFEGFAQSSI

SEQ ID NO: 72525 - protein, 10 aa, Artificial Sequence
  Description of Artificial Sequence: Synthetic peptide
  Seed: WGPRAHSEVI (MAGC1_HUMAN)
WRPRAHSEVV

SEQ ID NO: 72526 - protein, 9 aa, Artificial Sequence
  Description of Artificial Sequence: Synthetic peptide
  Seed: MTSSFSSTL (MAGC1_HUMAN)
MSSSFSSTF

SEQ ID NO: 72527 - protein, 9 aa, Artificial Sequence
  Description of Artificial Sequence: Synthetic peptide
  Seed: AQSPLQIPV (MAGC1_HUMAN)
AMSPLQIPM

SEQ ID NO: 72528 - protein, 10 aa, Artificial Sequence
  Description of Artificial Sequence: Synthetic peptide
  Seed: YVFVNTLDLT (MAGC1_HUMAN)
YTFVNTLDLV

SEQ ID NO: 72529 - protein, 10 aa, Artificial Sequence
  Description of Artificial Sequence: Synthetic peptide
  Seed: FSSSTSLSPF (MAGC1_HUMAN)
FWSSTSLSPW

SEQ ID NO: 72530 - protein, 10 aa, Artificial Sequence
  Description of Artificial Sequence: Synthetic peptide
  Seed: LAMLKNTVPI (MAGC1_HUMAN)
LVMLKNTVPL

SEQ ID NO: 72531 - protein, 11 aa, Artificial Sequence
  Description of Artificial Sequence: Synthetic peptide
  Seed: LWGPRAHSEVI (MAGC1_HUMAN)
LFGPRAHSEVL

SEQ ID NO: 72532 - protein, 9 aa, Artificial Sequence
  Description of Artificial Sequence: Synthetic peptide
  Seed: SSSTSLSPF (MAGC1_HUMAN)
SMSTSLSPI

SEQ ID NO: 72533 - protein, 9 aa, Artificial Sequence
  Description of Artificial Sequence: Synthetic peptide
  Seed: NSSPPRYEF (MAGC1_HUMAN)
NSSPPRYEM

SEQ ID NO: 72534 - protein, 10 aa, Artificial Sequence
  Description of Artificial Sequence: Synthetic peptide
  Seed: SVLQIPVSAA (MAGC1_HUMAN)
SMLQIPVSAL

SEQ ID NO: 72535 - protein, 9 aa, Artificial Sequence
  Description of Artificial Sequence: Synthetic peptide
  Seed: RPVSSFFSY (MAGC1_HUMAN)
RNVSSFFSF

SEQ ID NO: 72536 - protein, 9 aa, Artificial Sequence
  Description of Artificial Sequence: Synthetic peptide
  Seed: FSYTLLSLF (MAGC1_HUMAN)
FAYTLLSLL

SEQ ID NO: 72537 - protein, 9 aa, Artificial Sequence
  Description of Artificial Sequence: Synthetic peptide
  Seed: SPLQSPESA (MAGC1_HUMAN)
SHLQSPESI

SEQ ID NO: 72538 - protein, 9 aa, Artificial Sequence
  Description of Artificial Sequence: Synthetic peptide
  Seed: SSPESAQSA (MAGC1_HUMAN)
SGPESAQSY

SEQ ID NO: 72539 - protein, 9 aa, Artificial Sequence
  Description of Artificial Sequence: Synthetic peptide
  Seed: IPMTSSFSS (MAGC1_HUMAN)
IIMTSSFSM

SEQ ID NO: 72540 - protein, 10 aa, Artificial Sequence
  Description of Artificial Sequence: Synthetic peptide
  Seed: VSICSSSTSL (MAGC1_HUMAN)
VTICSSSTSY

SEQ ID NO: 72541 - protein, 9 aa, Artificial Sequence
  Description of Artificial Sequence: Synthetic peptide
  Seed: SFPSSTSSS (MAGC1_HUMAN)
SYPSSTSSY

SEQ ID NO: 72542 - protein, 9 aa, Artificial Sequence
  Description of Artificial Sequence: Synthetic peptide
  Seed: GEDSLSSLH (MAGC1_HUMAN)
GEDSLSSLW

SEQ ID NO: 72543 - protein, 9 aa, Artificial Sequence
  Description of Artificial Sequence: Synthetic peptide
  Seed: KVVEFLAML (MAGC1_HUMAN)
KTVEFLAML

SEQ ID NO: 72544 - protein, 10 aa, Artificial Sequence
  Description of Artificial Sequence: Synthetic peptide
  Seed: MTSSFSSTLL (MAGC1_HUMAN)
MSSSFSSTLV

SEQ ID NO: 72545 - protein, 10 aa, Artificial Sequence
  Description of Artificial Sequence: Synthetic peptide
  Seed: WGPRAHSEVI (MAGC1_HUMAN)
WHPRAHSEVM

SEQ ID NO: 72546 - protein, 9 aa, Artificial Sequence
  Description of Artificial Sequence: Synthetic peptide
  Seed: LQIPVSRSF (MAGC1_HUMAN)
LMIPVSRSI

SEQ ID NO: 72547 - protein, 9 aa, Artificial Sequence
  Description of Artificial Sequence: Synthetic peptide
  Seed: AQSPLQRPV (MAGC1_HUMAN)
ASSPLQRPV

SEQ ID NO: 72548 - protein, 9 aa, Artificial Sequence
  Description of Artificial Sequence: Synthetic peptide
  Seed: VIFRKAREF (MAGC1_HUMAN)
VVFRKAREF

SEQ ID NO: 72549 - protein, 9 aa, Artificial Sequence
  Description of Artificial Sequence: Synthetic peptide
  Seed: LQIPGSPSF (MAGC1_HUMAN)
LEIPGSPSV

SEQ ID NO: 72550 - protein, 10 aa, Artificial Sequence
  Description of Artificial Sequence: Synthetic peptide
  Seed: PLQIPVSRSF (MAGC1_HUMAN)
PLQIPVSRSY

SEQ ID NO: 72551 - protein, 9 aa, Artificial Sequence
  Description of Artificial Sequence: Synthetic peptide
  Seed: EGDDTQSPL (MAGC1_HUMAN)
EIDDTQSPM

SEQ ID NO: 72552 - protein, 9 aa, Artificial Sequence
  Description of Artificial Sequence: Synthetic peptide
  Seed: VSRSFSSTL (MAGC1_HUMAN)
VFRSFSSTY

SEQ ID NO: 72553 - protein, 11 aa, Artificial Sequence
  Description of Artificial Sequence: Synthetic peptide
  Seed: RSFSSTLLSIF (MAGC1_HUMAN)
RAFSSTLLSIM

SEQ ID NO: 72554 - protein, 10 aa, Artificial Sequence
  Description of Artificial Sequence: Synthetic peptide
  Seed: SPLQIPGSPS (MAGC1_HUMAN)
SPLQIPGSPI

SEQ ID NO: 72555 - protein, 9 aa, Artificial Sequence
  Description of Artificial Sequence: Synthetic peptide
  Seed: YTLLSLFQS (MAGC1_HUMAN)
YALLSLFQV

SEQ ID NO: 72556 - protein, 9 aa, Artificial Sequence
  Description of Artificial Sequence: Synthetic peptide
  Seed: SLSPHYFPQ (MAGC1_HUMAN)
STSPHYFPY

SEQ ID NO: 72557 - protein, 11 aa, Artificial Sequence
  Description of Artificial Sequence: Synthetic peptide
  Seed: SPLQIPVSRSF (MAGC1_HUMAN)
SQLQIPVSRSF

SEQ ID NO: 72558 - protein, 9 aa, Artificial Sequence
  Description of Artificial Sequence: Synthetic peptide
  Seed: QSPLQGEEF (MAGC1_HUMAN)
QYPLQGEEY

SEQ ID NO: 72559 - protein, 9 aa, Artificial Sequence
  Description of Artificial Sequence: Synthetic peptide
  Seed: ISFSSSTSL (MAGC1_HUMAN)
IWFSSSTSM

SEQ ID NO: 72560 - protein, 10 aa, Artificial Sequence
  Description of Artificial Sequence: Synthetic peptide
  Seed: RSFSSTLLSI (MAGC1_HUMAN)
RDFSSTLLSF

SEQ ID NO: 72561 - protein, 10 aa, Artificial Sequence
  Description of Artificial Sequence: Synthetic peptide
  Seed: EVIWDVLSGI (MAGC1_HUMAN)
ELIWDVLSGL

SEQ ID NO: 72562 - protein, 11 aa, Artificial Sequence
  Description of Artificial Sequence: Synthetic peptide
  Seed: SSTSLSLPQSF (MAGC1_HUMAN)
SSTSLSLPQSW

SEQ ID NO: 72563 - protein, 10 aa, Artificial Sequence
  Description of Artificial Sequence: Synthetic peptide
  Seed: KRKVVEFLAM (MAGC1_HUMAN)
KSKVVEFLAY

SEQ ID NO: 72564 - protein, 10 aa, Artificial Sequence
  Description of Artificial Sequence: Synthetic peptide
  Seed: KGTYASEEVI (MAGC1_HUMAN)
KMTYASEEVW

SEQ ID NO: 72565 - protein, 9 aa, Artificial Sequence
  Description of Artificial Sequence: Synthetic peptide
  Seed: EDSQSPLQI (MAGC1_HUMAN)
EESQSPLQW

SEQ ID NO: 72566 - protein, 9 aa, Artificial Sequence
  Description of Artificial Sequence: Synthetic peptide
  Seed: SSPESTQSP (MAGC1_HUMAN)
SCPESTQSI

SEQ ID NO: 72567 - protein, 9 aa, Artificial Sequence
  Description of Artificial Sequence: Synthetic peptide
  Seed: TTDDSTATE (MAGC1_HUMAN)
TCDDSTATL

SEQ ID NO: 72568 - protein, 9 aa, Artificial Sequence
  Description of Artificial Sequence: Synthetic peptide
  Seed: TLLSLFQSF (MAGC1_HUMAN)
THLSLFQSF

SEQ ID NO: 72569 - protein, 9 aa, Artificial Sequence
  Description of Artificial Sequence: Synthetic peptide
  Seed: SQSSPVSSF (MAGC1_HUMAN)
SSSSPVSSY

SEQ ID NO: 72570 - protein, 9 aa, Artificial Sequence
  Description of Artificial Sequence: Synthetic peptide
  Seed: SSFFSSALL (MAGC1_HUMAN)
SWFFSSALL

SEQ ID NO: 72571 - protein, 9 aa, Artificial Sequence
  Description of Artificial Sequence: Synthetic peptide
  Seed: SSSTSLSPF (MAGC1_HUMAN)
STSTSLSPY

SEQ ID NO: 72572 - protein, 10 aa, Artificial Sequence
  Description of Artificial Sequence: Synthetic peptide
  Seed: SSSSTLLSLF (MAGC1_HUMAN)
SDSSTLLSLW

SEQ ID NO: 72573 - protein, 9 aa, Artificial Sequence
  Description of Artificial Sequence: Synthetic peptide
  Seed: MTSSFSSTL (MAGC1_HUMAN)
MMSSFSSTS

SEQ ID NO: 72574 - protein, 9 aa, Artificial Sequence
  Description of Artificial Sequence: Synthetic peptide
  Seed: ISRYTGYFP (MAGC1_HUMAN)
IQRYTGYFK

SEQ ID NO: 72575 - protein, 9 aa, Artificial Sequence
  Description of Artificial Sequence: Synthetic peptide
  Seed: LQIPVSRSF (MAGC1_HUMAN)
LNIPVSRSF

SEQ ID NO: 72576 - protein, 9 aa, Artificial Sequence
  Description of Artificial Sequence: Synthetic peptide
  Seed: TESASSSVM (MAGC1_HUMAN)
TQSASSSVW

SEQ ID NO: 72577 - protein, 10 aa, Artificial Sequence
  Description of Artificial Sequence: Synthetic peptide
  Seed: SFSYTLLSLF (MAGC1_HUMAN)
SNSYTLLSLW

SEQ ID NO: 72578 - protein, 10 aa, Artificial Sequence
  Description of Artificial Sequence: Synthetic peptide
  Seed: RAGREHFAFG (MAGC1_HUMAN)
RQGREHFAFR

SEQ ID NO: 72579 - protein, 11 aa, Artificial Sequence
  Description of Artificial Sequence: Synthetic peptide
  Seed: TTDDSTATESA (MAGC1_HUMAN)
TTDDSTATESY

SEQ ID NO: 72580 - protein, 10 aa, Artificial Sequence
  Description of Artificial Sequence: Synthetic peptide
  Seed: EVDPDDSYVF (MAGC1_HUMAN)
ELDPDDSYVY

SEQ ID NO: 72581 - protein, 9 aa, Artificial Sequence
  Description of Artificial Sequence: Synthetic peptide
  Seed: IPMTSSFSS (MAGC1_HUMAN)
IPMTSSFSI

SEQ ID NO: 72582 - protein, 9 aa, Artificial Sequence
  Description of Artificial Sequence: Synthetic peptide
  Seed: LQIPGSPSF (MAGC1_HUMAN)
LMIPGSPSL

SEQ ID NO: 72583 - protein, 10 aa, Artificial Sequence
  Description of Artificial Sequence: Synthetic peptide
  Seed: GVRAGREHFA (MAGC1_HUMAN)
GARAGREHFK

SEQ ID NO: 72584 - protein, 9 aa, Artificial Sequence
  Description of Artificial Sequence: Synthetic peptide
  Seed: RTQSTFEGF (MAGC1_HUMAN)
RMQSTFEGF

SEQ ID NO: 72585 - protein, 9 aa, Artificial Sequence
  Description of Artificial Sequence: Synthetic peptide
  Seed: GYFPVIFRK (MAGC1_HUMAN)
GVFPVIFRR

SEQ ID NO: 72586 - protein, 11 aa, Artificial Sequence
  Description of Artificial Sequence: Synthetic peptide
  Seed: SFFSSALLSIF (MAGC1_HUMAN)
SWFSSALLSIY

SEQ ID NO: 72587 - protein, 10 aa, Artificial Sequence
  Description of Artificial Sequence: Synthetic peptide
  Seed: SFPSSTSSSL (MAGC1_HUMAN)
SIPSSTSSSI

SEQ ID NO: 72588 - protein, 9 aa, Artificial Sequence
  Description of Artificial Sequence: Synthetic peptide
  Seed: NTVPITFPS (MAGC1_HUMAN)
NTVPITFPY

SEQ ID NO: 72589 - protein, 9 aa, Artificial Sequence
  Description of Artificial Sequence: Synthetic peptide
  Seed: IESEPLFTY (MAGC1_HUMAN)
IRSEPLFTF

SEQ ID NO: 72590 - protein, 8 aa, Artificial Sequence
  Description of Artificial Sequence: Synthetic peptide
  Seed: SSFFSYTL (MAGC1_HUMAN)
STFFSYTF

SEQ ID NO: 72591 - protein, 9 aa, Artificial Sequence
  Description of Artificial Sequence: Synthetic peptide
  Seed: ISFSSSTSL (MAGC1_HUMAN)
IWFSSSTSY

SEQ ID NO: 72592 - protein, 9 aa, Artificial Sequence
  Description of Artificial Sequence: Synthetic peptide
  Seed: HYFPQSPPQ (MAGC1_HUMAN)
HYFPQSPPM

SEQ ID NO: 72593 - protein, 10 aa, Artificial Sequence
  Description of Artificial Sequence: Synthetic peptide
  Seed: RKVVEFLAML (MAGC1_HUMAN)
RKVVEFLAMV

SEQ ID NO: 72594 - protein, 9 aa, Artificial Sequence
  Description of Artificial Sequence: Synthetic peptide
  Seed: SFPSSTSSS (MAGC1_HUMAN)
SVPSSTSSF

SEQ ID NO: 72595 - protein, 9 aa, Artificial Sequence
  Description of Artificial Sequence: Synthetic peptide
  Seed: RKAREFIEI (MAGC1_HUMAN)
RQAREFIEH

SEQ ID NO: 72596 - protein, 9 aa, Artificial Sequence
  Description of Artificial Sequence: Synthetic peptide
  Seed: SSSTSLSPF (MAGC1_HUMAN)
SVSTSLSPY

SEQ ID NO: 72597 - protein, 9 aa, Artificial Sequence
  Description of Artificial Sequence: Synthetic peptide
  Seed: SFSYTLLSL (MAGC1_HUMAN)
SFSYTLLSM

SEQ ID NO: 72598 - protein, 9 aa, Artificial Sequence
  Description of Artificial Sequence: Synthetic peptide
  Seed: ISFSSSTSL (MAGC1_HUMAN)
ILFSSSTSV

SEQ ID NO: 72599 - protein, 11 aa, Artificial Sequence
  Description of Artificial Sequence: Synthetic peptide
  Seed: IPVSRSFSSTL (MAGC1_HUMAN)
IHVSRSFSSTW

SEQ ID NO: 72600 - protein, 9 aa, Artificial Sequence
  Description of Artificial Sequence: Synthetic peptide
  Seed: RYTGYFPVI (MAGC1_HUMAN)
RFTGYFPVY

SEQ ID NO: 72601 - protein, 10 aa, Artificial Sequence
  Description of Artificial Sequence: Synthetic peptide
  Seed: FPQSLLQIPM (MAGC1_HUMAN)
FPQSLLQIPS

SEQ ID NO: 72602 - protein, 9 aa, Artificial Sequence
  Description of Artificial Sequence: Synthetic peptide
  Seed: VQSPLHSPQ (MAGC1_HUMAN)
VGSPLHSPF

SEQ ID NO: 72603 - protein, 9 aa, Artificial Sequence
  Description of Artificial Sequence: Synthetic peptide
  Seed: FAFGEPREL (MAGC1_HUMAN)
FYFGEPREF

SEQ ID NO: 72604 - protein, 9 aa, Artificial Sequence
  Description of Artificial Sequence: Synthetic peptide
  Seed: IEILFGISL (MAGC1_HUMAN)
IPILFGISY

SEQ ID NO: 72605 - protein, 11 aa, Artificial Sequence
  Description of Artificial Sequence: Synthetic peptide
  Seed: IPMTSSFSSTL (MAGC1_HUMAN)
ISMTSSFSSTM

SEQ ID NO: 72606 - protein, 10 aa, Artificial Sequence
  Description of Artificial Sequence: Synthetic peptide
  Seed: YTLASLLQSS (MAGC1_HUMAN)
YCLASLLQSI

SEQ ID NO: 72607 - protein, 9 aa, Artificial Sequence
  Description of Artificial Sequence: Synthetic peptide
  Seed: TESASSSVM (MAGC1_HUMAN)
TQSASSSVY

SEQ ID NO: 72608 - protein, 9 aa, Artificial Sequence
  Description of Artificial Sequence: Synthetic peptide
  Seed: RYTGYFPVI (MAGC1_HUMAN)
RSTGYFPVY

SEQ ID NO: 72609 - protein, 9 aa, Artificial Sequence
  Description of Artificial Sequence: Synthetic peptide
  Seed: SQSSPVSSF (MAGC1_HUMAN)
STSSPVSSW

SEQ ID NO: 72610 - protein, 11 aa, Artificial Sequence
  Description of Artificial Sequence: Synthetic peptide
  Seed: SSSSSSTLLSL (MAGC1_HUMAN)
SRSSSSTLLSF

SEQ ID NO: 72611 - protein, 9 aa, Artificial Sequence
  Description of Artificial Sequence: Synthetic peptide
  Seed: RKVVEFLAM (MAGC1_HUMAN)
RSVVEFLAM

SEQ ID NO: 72612 - protein, 10 aa, Artificial Sequence
  Description of Artificial Sequence: Synthetic peptide
  Seed: WGPRAHSEVI (MAGC1_HUMAN)
WFPRAHSEVM

SEQ ID NO: 72613 - protein, 9 aa, Artificial Sequence
  Description of Artificial Sequence: Synthetic peptide
  Seed: VQSPLHSPQ (MAGC1_HUMAN)
VKSPLHSPY

SEQ ID NO: 72614 - protein, 9 aa, Artificial Sequence
  Description of Artificial Sequence: Synthetic peptide
  Seed: VPITFPSSY (MAGC1_HUMAN)
VRITFPSSY

SEQ ID NO: 72615 - protein, 9 aa, Artificial Sequence
  Description of Artificial Sequence: Synthetic peptide
  Seed: TTDDSTATE (MAGC1_HUMAN)
TGDDSTATF

SEQ ID NO: 72616 - protein, 10 aa, Artificial Sequence
  Description of Artificial Sequence: Synthetic peptide
  Seed: RKVVEFLAML (MAGC1_HUMAN)
RQVVEFLAML

SEQ ID NO: 72617 - protein, 9 aa, Artificial Sequence
  Description of Artificial Sequence: Synthetic peptide
  Seed: LQIPVSRSF (MAGC1_HUMAN)
LEIPVSRSF

SEQ ID NO: 72618 - protein, 9 aa, Artificial Sequence
  Description of Artificial Sequence: Synthetic peptide
  Seed: VSSFFSYTL (MAGC1_HUMAN)
VVSFFSYTM

SEQ ID NO: 72619 - protein, 9 aa, Artificial Sequence
  Description of Artificial Sequence: Synthetic peptide
  Seed: KVWVQEHYL (MAGC1_HUMAN)
KIWVQEHYF

SEQ ID NO: 72620 - protein, 9 aa, Artificial Sequence
  Description of Artificial Sequence: Synthetic peptide
  Seed: SVLQIPVSA (MAGC1_HUMAN)
SPLQIPVSC

SEQ ID NO: 72621 - protein, 9 aa, Artificial Sequence
  Description of Artificial Sequence: Synthetic peptide
  Seed: CSSSTPSSL (MAGC1_HUMAN)
CSSSTPSSW

SEQ ID NO: 72622 - protein, 9 aa, Artificial Sequence
  Description of Artificial Sequence: Synthetic peptide
  Seed: FSYTLLSLF (MAGC1_HUMAN)
FMYTLLSLF

SEQ ID NO: 72623 - protein, 9 aa, Artificial Sequence
  Description of Artificial Sequence: Synthetic peptide
  Seed: LSDEQGMSQ (MAGC1_HUMAN)
LNDEQGMSL

SEQ ID NO: 72624 - protein, 9 aa, Artificial Sequence
  Description of Artificial Sequence: Synthetic peptide
  Seed: VSPSFSSTL (MAGC1_HUMAN)
VSPSFSSTM

SEQ ID NO: 72625 - protein, 10 aa, Artificial Sequence
  Description of Artificial Sequence: Synthetic peptide
  Seed: LSQSSPVSSF (MAGC1_HUMAN)
LMQSSPVSSM

SEQ ID NO: 72626 - protein, 9 aa, Artificial Sequence
  Description of Artificial Sequence: Synthetic peptide
  Seed: SSFFSSALL (MAGC1_HUMAN)
SIFFSSALL

SEQ ID NO: 72627 - protein, 10 aa, Artificial Sequence
  Description of Artificial Sequence: Synthetic peptide
  Seed: FAQSSLQIPV (MAGC1_HUMAN)
FAQSSLQIPI

SEQ ID NO: 72628 - protein, 10 aa, Artificial Sequence
  Description of Artificial Sequence: Synthetic peptide
  Seed: AEMLTNVISR (MAGC1_HUMAN)
ATMLTNVISK

SEQ ID NO: 72629 - protein, 11 aa, Artificial Sequence
  Description of Artificial Sequence: Synthetic peptide
  Seed: SPLQIPGSPSF (MAGC1_HUMAN)
SLLQIPGSPSY

SEQ ID NO: 72630 - protein, 10 aa, Artificial Sequence
  Description of Artificial Sequence: Synthetic peptide
  Seed: VSSSSSSSTL (MAGC1_HUMAN)
VPSSSSSSTY

SEQ ID NO: 72631 - protein, 9 aa, Artificial Sequence
  Description of Artificial Sequence: Synthetic peptide
  Seed: SSLSQSSPV (MAGC1_HUMAN)
SMLSQSSPV

SEQ ID NO: 72632 - protein, 9 aa, Artificial Sequence
  Description of Artificial Sequence: Synthetic peptide
  Seed: SSPPRYEFL (MAGC1_HUMAN)
SGPPRYEFL

SEQ ID NO: 72633 - protein, 9 aa, Artificial Sequence
  Description of Artificial Sequence: Synthetic peptide
  Seed: LKYQVKQPI (MAGC1_HUMAN)
LMYQVKQPF

SEQ ID NO: 72634 - protein, 11 aa, Artificial Sequence
  Description of Artificial Sequence: Synthetic peptide
  Seed: LQRPVSSFFSY (MAGC1_HUMAN)
LIRPVSSFFSY

SEQ ID NO: 72635 - protein, 9 aa, Artificial Sequence
  Description of Artificial Sequence: Synthetic peptide
  Seed: LSDEQGMSQ (MAGC1_HUMAN)
LADEQGMSV

SEQ ID NO: 72636 - protein, 9 aa, Artificial Sequence
  Description of Artificial Sequence: Synthetic peptide
  Seed: ASSFFSSAL (MAGC1_HUMAN)
AYSFFSSAM

SEQ ID NO: 72637 - protein, 9 aa, Artificial Sequence
  Description of Artificial Sequence: Synthetic peptide
  Seed: LQSPVISFS (MAGC1_HUMAN)
LMSPVISFM

SEQ ID NO: 72638 - protein, 11 aa, Artificial Sequence
  Description of Artificial Sequence: Synthetic peptide
  Seed: IIDTTDDSTAT (MAGC1_HUMAN)
ITDTTDDSTAF

SEQ ID NO: 72639 - protein, 10 aa, Artificial Sequence
  Description of Artificial Sequence: Synthetic peptide
  Seed: LSGIGVRAGR (MAGC1_HUMAN)
LSGIGVRAGK

SEQ ID NO: 72640 - protein, 10 aa, Artificial Sequence
  Description of Artificial Sequence: Synthetic peptide
  Seed: TLDEKVDELA (MAGC1_HUMAN)
TIDEKVDELM

SEQ ID NO: 72641 - protein, 11 aa, Artificial Sequence
  Description of Artificial Sequence: Synthetic peptide
  Seed: MSPLYFPQSPL (MAGC1_HUMAN)
MSPLYFPQSPV

SEQ ID NO: 72642 - protein, 9 aa, Artificial Sequence
  Description of Artificial Sequence: Synthetic peptide
  Seed: TFEGFPQSL (MAGC1_HUMAN)
TYEGFPQSM

SEQ ID NO: 72643 - protein, 9 aa, Artificial Sequence
  Description of Artificial Sequence: Synthetic peptide
  Seed: TTDDSTATE (MAGC1_HUMAN)
TDDDSTATF

SEQ ID NO: 72644 - protein, 9 aa, Artificial Sequence
  Description of Artificial Sequence: Synthetic peptide
  Seed: SSPESDDTL (MAGC1_HUMAN)
SIPESDDTL

SEQ ID NO: 72645 - protein, 9 aa, Artificial Sequence
  Description of Artificial Sequence: Synthetic peptide
  Seed: EDSQSPLQI (MAGC1_HUMAN)
EESQSPLQL

SEQ ID NO: 72646 - protein, 10 aa, Artificial Sequence
  Description of Artificial Sequence: Synthetic peptide
  Seed: SRYTGYFPVI (MAGC1_HUMAN)
SIYTGYFPVM

SEQ ID NO: 72647 - protein, 10 aa, Artificial Sequence
  Description of Artificial Sequence: Synthetic peptide
  Seed: VISFSSSTSL (MAGC1_HUMAN)
VLSFSSSTSW

SEQ ID NO: 72648 - protein, 8 aa, Artificial Sequence
  Description of Artificial Sequence: Synthetic peptide
  Seed: FIEILFGI (MAGC1_HUMAN)
FMEILFGA

SEQ ID NO: 72649 - protein, 10 aa, Artificial Sequence
  Description of Artificial Sequence: Synthetic peptide
  Seed: VSSSFSYTLL (MAGC1_HUMAN)
VCSSFSYTLW

SEQ ID NO: 72650 - protein, 9 aa, Artificial Sequence
  Description of Artificial Sequence: Synthetic peptide
  Seed: IPVSAASSS (MAGC1_HUMAN)
IPVSAASSY

SEQ ID NO: 72651 - protein, 11 aa, Artificial Sequence
  Description of Artificial Sequence: Synthetic peptide
  Seed: SLREVDPDDSY (MAGC1_HUMAN)
SMREVDPDDSW

SEQ ID NO: 72652 - protein, 9 aa, Artificial Sequence
  Description of Artificial Sequence: Synthetic peptide
  Seed: FSYTLLSLF (MAGC1_HUMAN)
FQYTLLSLI

SEQ ID NO: 72653 - protein, 9 aa, Artificial Sequence
  Description of Artificial Sequence: Synthetic peptide
  Seed: SQSSPVSSF (MAGC1_HUMAN)
SISSPVSSM

SEQ ID NO: 72654 - protein, 11 aa, Artificial Sequence
  Description of Artificial Sequence: Synthetic peptide
  Seed: IPVSRSFSSTL (MAGC1_HUMAN)
IYVSRSFSSTW

SEQ ID NO: 72655 - protein, 9 aa, Artificial Sequence
  Description of Artificial Sequence: Synthetic peptide
  Seed: VQSPLHSPQ (MAGC1_HUMAN)
VMSPLHSPW

SEQ ID NO: 72656 - protein, 9 aa, Artificial Sequence
  Description of Artificial Sequence: Synthetic peptide
  Seed: LKYQVKQPI (MAGC1_HUMAN)
LMYQVKQPW

SEQ ID NO: 72657 - protein, 10 aa, Artificial Sequence
  Description of Artificial Sequence: Synthetic peptide
  Seed: LSIFQSSPER (MAGC1_HUMAN)
LIIFQSSPER

SEQ ID NO: 72658 - protein, 10 aa, Artificial Sequence
  Description of Artificial Sequence: Synthetic peptide
  Seed: ASSFFSSALL (MAGC1_HUMAN)
ALSFFSSALM

SEQ ID NO: 72659 - protein, 9 aa, Artificial Sequence
  Description of Artificial Sequence: Synthetic peptide
  Seed: LQIPGSPSF (MAGC1_HUMAN)
LVIPGSPSV

SEQ ID NO: 72660 - protein, 9 aa, Artificial Sequence
  Description of Artificial Sequence: Synthetic peptide
  Seed: KDSLSPLEI (MAGC1_HUMAN)
KQSLSPLEI

SEQ ID NO: 72661 - protein, 10 aa, Artificial Sequence
  Description of Artificial Sequence: Synthetic peptide
  Seed: PLQRPVSSFF (MAGC1_HUMAN)
PSQRPVSSFY

SEQ ID NO: 72662 - protein, 9 aa, Artificial Sequence
  Description of Artificial Sequence: Synthetic peptide
  Seed: AEMLTNVIS (MAGC1_HUMAN)
AEMLTNVIC

SEQ ID NO: 72663 - protein, 11 aa, Artificial Sequence
  Description of Artificial Sequence: Synthetic peptide
  Seed: YTGYFPVIFRK (MAGC1_HUMAN)
YKGYFPVIFRR

SEQ ID NO: 72664 - protein, 10 aa, Artificial Sequence
  Description of Artificial Sequence: Synthetic peptide
  Seed: FFSYTLASLL (MAGC1_HUMAN)
FMSYTLASLV

SEQ ID NO: 72665 - protein, 9 aa, Artificial Sequence
  Description of Artificial Sequence: Synthetic peptide
  Seed: SMSPLYFPQ (MAGC1_HUMAN)
SISPLYFPR

SEQ ID NO: 72666 - protein, 9 aa, Artificial Sequence
  Description of Artificial Sequence: Synthetic peptide
  Seed: REVDPDDSY (MAGC1_HUMAN)
RQVDPDDSY

SEQ ID NO: 72667 - protein, 9 aa, Artificial Sequence
  Description of Artificial Sequence: Synthetic peptide
  Seed: KAREFIEIL (MAGC1_HUMAN)
KFREFIEIK

SEQ ID NO: 72668 - protein, 9 aa, Artificial Sequence
  Description of Artificial Sequence: Synthetic peptide
  Seed: SQSSPVSSF (MAGC1_HUMAN)
SRSSPVSSV

SEQ ID NO: 72669 - protein, 11 aa, Artificial Sequence
  Description of Artificial Sequence: Synthetic peptide
  Seed: TLDEKVDELAR (MAGC1_HUMAN)
TTDEKVDELAF

SEQ ID NO: 72670 - protein, 10 aa, Artificial Sequence
  Description of Artificial Sequence: Synthetic peptide
  Seed: KGTYASEEVI (MAGC1_HUMAN)
KITYASEEVF

SEQ ID NO: 72671 - protein, 10 aa, Artificial Sequence
  Description of Artificial Sequence: Synthetic peptide
  Seed: FQSSLQSPVS (MAGC1_HUMAN)
FLSSLQSPVA

SEQ ID NO: 72672 - protein, 10 aa, Artificial Sequence
  Description of Artificial Sequence: Synthetic peptide
  Seed: SSFSYTLLSL (MAGC1_HUMAN)
SMFSYTLLSA

SEQ ID NO: 72673 - protein, 10 aa, Artificial Sequence
  Description of Artificial Sequence: Synthetic peptide
  Seed: SFFSYTLASL (MAGC1_HUMAN)
SYFSYTLASF

SEQ ID NO: 72674 - protein, 10 aa, Artificial Sequence
  Description of Artificial Sequence: Synthetic peptide
  Seed: SFPSSTSSSL (MAGC1_HUMAN)
SDPSSTSSSF

SEQ ID NO: 72675 - protein, 9 aa, Artificial Sequence
  Description of Artificial Sequence: Synthetic peptide
  Seed: SSPESPLQS (MAGC1_HUMAN)
SIPESPLQV

SEQ ID NO: 72676 - protein, 10 aa, Artificial Sequence
  Description of Artificial Sequence: Synthetic peptide
  Seed: STFEGFPQSL (MAGC1_HUMAN)
SIFEGFPQSM

SEQ ID NO: 72677 - protein, 9 aa, Artificial Sequence
  Description of Artificial Sequence: Synthetic peptide
  Seed: SQSSPVSSF (MAGC1_HUMAN)
SKSSPVSSM

SEQ ID NO: 72678 - protein, 9 aa, Artificial Sequence
  Description of Artificial Sequence: Synthetic peptide
  Seed: LQIPVSSSS (MAGC1_HUMAN)
LHIPVSSSY

SEQ ID NO: 72679 - protein, 9 aa, Artificial Sequence
  Description of Artificial Sequence: Synthetic peptide
  Seed: SSSSTLLSL (MAGC1_HUMAN)
SQSSTLLSI

SEQ ID NO: 72680 - protein, 9 aa, Artificial Sequence
  Description of Artificial Sequence: Synthetic peptide
  Seed: LSDEQGMSQ (MAGC1_HUMAN)
LVDEQGMSI

SEQ ID NO: 72681 - protein, 9 aa, Artificial Sequence
  Description of Artificial Sequence: Synthetic peptide
  Seed: LQIPVSAAS (MAGC1_HUMAN)
LQIPVSAAL

SEQ ID NO: 72682 - protein, 10 aa, Artificial Sequence
  Description of Artificial Sequence: Synthetic peptide
  Seed: SPPEGPVQSP (MAGC1_HUMAN)
SPPEGPVQSA

SEQ ID NO: 72683 - protein, 9 aa, Artificial Sequence
  Description of Artificial Sequence: Synthetic peptide
  Seed: VSRSFSSTL (MAGC1_HUMAN)
VPRSFSSTV

SEQ ID NO: 72684 - protein, 9 aa, Artificial Sequence
  Description of Artificial Sequence: Synthetic peptide
  Seed: ILILSIIFI (MAGC1_HUMAN)
IIILSIIFI

SEQ ID NO: 72685 - protein, 9 aa, Artificial Sequence
  Description of Artificial Sequence: Synthetic peptide
  Seed: RKAREFIEI (MAGC1_HUMAN)
RQAREFIEL

SEQ ID NO: 72686 - protein, 9 aa, Artificial Sequence
  Description of Artificial Sequence: Synthetic peptide
  Seed: LQRPVSSFF (MAGC1_HUMAN)
LTRPVSSFR

SEQ ID NO: 72687 - protein, 9 aa, Artificial Sequence
  Description of Artificial Sequence: Synthetic peptide
  Seed: KVVEFLAML (MAGC1_HUMAN)
KMVEFLAMA

SEQ ID NO: 72688 - protein, 8 aa, Artificial Sequence
  Description of Artificial Sequence: Synthetic peptide
  Seed: FSYTLASL (MAGC1_HUMAN)
FSYTLASY

SEQ ID NO: 72689 - protein, 10 aa, Artificial Sequence
  Description of Artificial Sequence: Synthetic peptide
  Seed: FPQSPLQIPV (MAGC1_HUMAN)
FIQSPLQIPI

SEQ ID NO: 72690 - protein, 9 aa, Artificial Sequence
  Description of Artificial Sequence: Synthetic peptide
  Seed: FSYTLLSLF (MAGC1_HUMAN)
FVYTLLSLW

SEQ ID NO: 72691 - protein, 9 aa, Artificial Sequence
  Description of Artificial Sequence: Synthetic peptide
  Seed: SSHESPQSP (MAGC1_HUMAN)
SIHESPQSV

SEQ ID NO: 72692 - protein, 11 aa, Artificial Sequence
  Description of Artificial Sequence: Synthetic peptide
  Seed: IPVSSSSSSTL (MAGC1_HUMAN)
ISVSSSSSSTY

SEQ ID NO: 72693 - protein, 9 aa, Artificial Sequence
  Description of Artificial Sequence: Synthetic peptide
  Seed: SPLQIVPSL (MAGC1_HUMAN)
SRLQIVPSM

SEQ ID NO: 72694 - protein, 9 aa, Artificial Sequence
  Description of Artificial Sequence: Synthetic peptide
  Seed: KVDELARFL (MAGC1_HUMAN)
KYDELARFI

SEQ ID NO: 72695 - protein, 10 aa, Artificial Sequence
  Description of Artificial Sequence: Synthetic peptide
  Seed: MTSSFSSTLL (MAGC1_HUMAN)
MFSSFSSTLV

SEQ ID NO: 72696 - protein, 11 aa, Artificial Sequence
  Description of Artificial Sequence: Synthetic peptide
  Seed: SSFPSSTSSSL (MAGC1_HUMAN)
SCFPSSTSSSM

SEQ ID NO: 72697 - protein, 9 aa, Artificial Sequence
  Description of Artificial Sequence: Synthetic peptide
  Seed: VIWDVLSGI (MAGC1_HUMAN)
VLWDVLSGR

SEQ ID NO: 72698 - protein, 9 aa, Artificial Sequence
  Description of Artificial Sequence: Synthetic peptide
  Seed: REVDPDDSY (MAGC1_HUMAN)
RTVDPDDSY

SEQ ID NO: 72699 - protein, 8 aa, Artificial Sequence
  Description of Artificial Sequence: Synthetic peptide
  Seed: LTDSESLI (MAGC1_HUMAN)
LADSESLM

SEQ ID NO: 72700 - protein, 9 aa, Artificial Sequence
  Description of Artificial Sequence: Synthetic peptide
  Seed: SGIGVRAGR (MAGC1_HUMAN)
SIIGVRAGY

SEQ ID NO: 72701 - protein, 10 aa, Artificial Sequence
  Description of Artificial Sequence: Synthetic peptide
  Seed: LSIFQSSPER (MAGC1_HUMAN)
LFIFQSSPER

SEQ ID NO: 72702 - protein, 9 aa, Artificial Sequence
  Description of Artificial Sequence: Synthetic peptide
  Seed: YQVKQPITK (MAGC1_HUMAN)
YIVKQPITY

SEQ ID NO: 72703 - protein, 11 aa, Artificial Sequence
  Description of Artificial Sequence: Synthetic peptide
  Seed: SPLQIPMTSSF (MAGC1_HUMAN)
SYLQIPMTSSY

SEQ ID NO: 72704 - protein, 9 aa, Artificial Sequence
  Description of Artificial Sequence: Synthetic peptide
  Seed: RTQSTFEGF (MAGC1_HUMAN)
RAQSTFEGY

SEQ ID NO: 72705 - protein, 10 aa, Artificial Sequence
  Description of Artificial Sequence: Synthetic peptide
  Seed: VSSSSSSTLL (MAGC1_HUMAN)
VTSSSSSTLF

SEQ ID NO: 72706 - protein, 9 aa, Artificial Sequence
  Description of Artificial Sequence: Synthetic peptide
  Seed: FEGFPQSVL (MAGC1_HUMAN)
FAGFPQSVF

SEQ ID NO: 72707 - protein, 9 aa, Artificial Sequence
  Description of Artificial Sequence: Synthetic peptide
  Seed: SSSTLLSLF (MAGC1_HUMAN)
SFSTLLSLY

SEQ ID NO: 72708 - protein, 9 aa, Artificial Sequence
  Description of Artificial Sequence: Synthetic peptide
  Seed: KDSQSPLQI (MAGC1_HUMAN)
KQSQSPLQV

SEQ ID NO: 72709 - protein, 9 aa, Artificial Sequence
  Description of Artificial Sequence: Synthetic peptide
  Seed: LQIPVSSSS (MAGC1_HUMAN)
LAIPVSSSM

SEQ ID NO: 72710 - protein, 9 aa, Artificial Sequence
  Description of Artificial Sequence: Synthetic peptide
  Seed: NTVPITFPS (MAGC1_HUMAN)
NLVPITFPV

SEQ ID NO: 72711 - protein, 10 aa, Artificial Sequence
  Description of Artificial Sequence: Synthetic peptide
  Seed: MTSSFSSTLL (MAGC1_HUMAN)
MYSSFSSTLV

SEQ ID NO: 72712 - protein, 9 aa, Artificial Sequence
  Description of Artificial Sequence: Synthetic peptide
  Seed: TPSSLPQSF (MAGC1_HUMAN)
TISSLPQSY

SEQ ID NO: 72713 - protein, 10 aa, Artificial Sequence
  Description of Artificial Sequence: Synthetic peptide
  Seed: YTLLSLFQSS (MAGC1_HUMAN)
YMLLSLFQSA

SEQ ID NO: 72714 - protein, 9 aa, Artificial Sequence
  Description of Artificial Sequence: Synthetic peptide
  Seed: TLLSIFQSS (MAGC1_HUMAN)
TALSIFQSL

SEQ ID NO: 72715 - protein, 10 aa, Artificial Sequence
  Description of Artificial Sequence: Synthetic peptide
  Seed: KRKVVEFLAM (MAGC1_HUMAN)
KAKVVEFLAY

SEQ ID NO: 72716 - protein, 9 aa, Artificial Sequence
  Description of Artificial Sequence: Synthetic peptide
  Seed: VSSSFSYTL (MAGC1_HUMAN)
VTSSFSYTY

SEQ ID NO: 72717 - protein, 10 aa, Artificial Sequence
  Description of Artificial Sequence: Synthetic peptide
  Seed: STLLSLFQSF (MAGC1_HUMAN)
SGLLSLFQSF

SEQ ID NO: 72718 - protein, 9 aa, Artificial Sequence
  Description of Artificial Sequence: Synthetic peptide
  Seed: LQRPVSSFF (MAGC1_HUMAN)
LVRPVSSFI

SEQ ID NO: 72719 - protein, 10 aa, Artificial Sequence
  Description of Artificial Sequence: Synthetic peptide
  Seed: LSQSSPVSSF (MAGC1_HUMAN)
LRQSSPVSSM

SEQ ID NO: 72720 - protein, 9 aa, Artificial Sequence
  Description of Artificial Sequence: Synthetic peptide
  Seed: SGIGVRAGR (MAGC1_HUMAN)
SSIGVRAGR

SEQ ID NO: 72721 - protein, 10 aa, Artificial Sequence
  Description of Artificial Sequence: Synthetic peptide
  Seed: YVFVNTLDLT (MAGC1_HUMAN)
YIFVNTLDLA

SEQ ID NO: 72722 - protein, 9 aa, Artificial Sequence
  Description of Artificial Sequence: Synthetic peptide
  Seed: GMSQNRLLI (MAGC1_HUMAN)
GQSQNRLLF

SEQ ID NO: 72723 - protein, 9 aa, Artificial Sequence
  Description of Artificial Sequence: Synthetic peptide
  Seed: SSSTSLSPF (MAGC1_HUMAN)
SYSTSLSPL

SEQ ID NO: 72724 - protein, 9 aa, Artificial Sequence
  Description of Artificial Sequence: Synthetic peptide
  Seed: RAHSEVIKR (MAGC1_HUMAN)
RQHSEVIKK

SEQ ID NO: 72725 - protein, 11 aa, Artificial Sequence
  Description of Artificial Sequence: Synthetic peptide
  Seed: SLSQSSPVSSF (MAGC1_HUMAN)
SASQSSPVSSL

SEQ ID NO: 72726 - protein, 9 aa, Artificial Sequence
  Description of Artificial Sequence: Synthetic peptide
  Seed: MTSSFSSTL (MAGC1_HUMAN)
MLSSFSSTC

SEQ ID NO: 72727 - protein, 9 aa, Artificial Sequence
  Description of Artificial Sequence: Synthetic peptide
  Seed: VSAASSSTL (MAGC1_HUMAN)
VTAASSSTI

SEQ ID NO: 72728 - protein, 10 aa, Artificial Sequence
  Description of Artificial Sequence: Synthetic peptide
  Seed: YTLDEKVDEL (MAGC1_HUMAN)
YTLDEKVDEV

SEQ ID NO: 72729 - protein, 9 aa, Artificial Sequence
  Description of Artificial Sequence: Synthetic peptide
  Seed: VSSFFSYTL (MAGC1_HUMAN)
VGSFFSYTY

SEQ ID NO: 72730 - protein, 9 aa, Artificial Sequence
  Description of Artificial Sequence: Synthetic peptide
  Seed: SFFSYTLAS (MAGC1_HUMAN)
SIFSYTLAM

SEQ ID NO: 72731 - protein, 10 aa, Artificial Sequence
  Description of Artificial Sequence: Synthetic peptide
  Seed: ICSSSTPSSL (MAGC1_HUMAN)
IESSSTPSSW

SEQ ID NO: 72732 - protein, 8 aa, Artificial Sequence
  Description of Artificial Sequence: Synthetic peptide
  Seed: AEMLTNVI (MAGC1_HUMAN)
AQMLTNVV

SEQ ID NO: 72733 - protein, 10 aa, Artificial Sequence
  Description of Artificial Sequence: Synthetic peptide
  Seed: LAMLKNTVPI (MAGC1_HUMAN)
LPMLKNTVPM

SEQ ID NO: 72734 - protein, 11 aa, Artificial Sequence
  Description of Artificial Sequence: Synthetic peptide
  Seed: IIDTTDDSTAT (MAGC1_HUMAN)
ISDTTDDSTAM

SEQ ID NO: 72735 - protein, 10 aa, Artificial Sequence
  Description of Artificial Sequence: Synthetic peptide
  Seed: TGYFPVIFRK (MAGC1_HUMAN)
TVYFPVIFRW

SEQ ID NO: 72736 - protein, 9 aa, Artificial Sequence
  Description of Artificial Sequence: Synthetic peptide
  Seed: LQIPVSAAS (MAGC1_HUMAN)
LTIPVSAAA

SEQ ID NO: 72737 - protein, 10 aa, Artificial Sequence
  Description of Artificial Sequence: Synthetic peptide
  Seed: SSFSYTLLSL (MAGC1_HUMAN)
SLFSYTLLSW

SEQ ID NO: 72738 - protein, 11 aa, Artificial Sequence
  Description of Artificial Sequence: Synthetic peptide
  Seed: LQIPVSSSFSY (MAGC1_HUMAN)
LQIPVSSSFSW

SEQ ID NO: 72739 - protein, 9 aa, Artificial Sequence
  Description of Artificial Sequence: Synthetic peptide
  Seed: SPLQNSQSS (MAGC1_HUMAN)
SPLQNSQSM

SEQ ID NO: 72740 - protein, 9 aa, Artificial Sequence
  Description of Artificial Sequence: Synthetic peptide
  Seed: WVQEHYLEY (MAGC1_HUMAN)
WYQEHYLEL

SEQ ID NO: 72741 - protein, 10 aa, Artificial Sequence
  Description of Artificial Sequence: Synthetic peptide
  Seed: MTSSFSSTLL (MAGC1_HUMAN)
MCSSFSSTLY

SEQ ID NO: 72742 - protein, 9 aa, Artificial Sequence
  Description of Artificial Sequence: Synthetic peptide
  Seed: ASSFFSSAL (MAGC1_HUMAN)
AMSFFSSAM

SEQ ID NO: 72743 - protein, 10 aa, Artificial Sequence
  Description of Artificial Sequence: Synthetic peptide
  Seed: SSSSTLLSLF (MAGC1_HUMAN)
STSSTLLSLY

SEQ ID NO: 72744 - protein, 10 aa, Artificial Sequence
  Description of Artificial Sequence: Synthetic peptide
  Seed: RAGREHFAFG (MAGC1_HUMAN)
RTGREHFAFL

SEQ ID NO: 72745 - protein, 11 aa, Artificial Sequence
  Description of Artificial Sequence: Synthetic peptide
  Seed: MSPLYFPQSPL (MAGC1_HUMAN)
MRPLYFPQSPV

SEQ ID NO: 72746 - protein, 9 aa, Artificial Sequence
  Description of Artificial Sequence: Synthetic peptide
  Seed: ISFSSSTSL (MAGC1_HUMAN)
IFFSSSTSI

SEQ ID NO: 72747 - protein, 10 aa, Artificial Sequence
  Description of Artificial Sequence: Synthetic peptide
  Seed: VPITFPSSYK (MAGC1_HUMAN)
VLITFPSSYK

SEQ ID NO: 72748 - protein, 9 aa, Artificial Sequence
  Description of Artificial Sequence: Synthetic peptide
  Seed: SPLQIVPSL (MAGC1_HUMAN)
SPLQIVPST

SEQ ID NO: 72749 - protein, 11 aa, Artificial Sequence
  Description of Artificial Sequence: Synthetic peptide
  Seed: SPLQIPMTSSF (MAGC1_HUMAN)
SLLQIPMTSSM

SEQ ID NO: 72750 - protein, 9 aa, Artificial Sequence
  Description of Artificial Sequence: Synthetic peptide
  Seed: LQIPVSRSF (MAGC1_HUMAN)
LCIPVSRSW

SEQ ID NO: 72751 - protein, 9 aa, Artificial Sequence
  Description of Artificial Sequence: Synthetic peptide
  Seed: KAREFIEIL (MAGC1_HUMAN)
KIREFIEIR

SEQ ID NO: 72752 - protein, 9 aa, Artificial Sequence
  Description of Artificial Sequence: Synthetic peptide
  Seed: FSYTLASLL (MAGC1_HUMAN)
FTYTLASLW

SEQ ID NO: 72753 - protein, 10 aa, Artificial Sequence
  Description of Artificial Sequence: Synthetic peptide
  Seed: SLQIPVSPSF (MAGC1_HUMAN)
SYQIPVSPSI

SEQ ID NO: 72754 - protein, 9 aa, Artificial Sequence
  Description of Artificial Sequence: Synthetic peptide
  Seed: FSSTLLSLF (MAGC1_HUMAN)
FPSTLLSLI

SEQ ID NO: 72755 - protein, 9 aa, Artificial Sequence
  Description of Artificial Sequence: Synthetic peptide
  Seed: RKAREFIEI (MAGC1_HUMAN)
RQAREFIEM

SEQ ID NO: 72756 - protein, 10 aa, Artificial Sequence
  Description of Artificial Sequence: Synthetic peptide
  Seed: VSAASSSTLV (MAGC1_HUMAN)
VVAASSSTLW

SEQ ID NO: 72757 - protein, 9 aa, Artificial Sequence
  Description of Artificial Sequence: Synthetic peptide
  Seed: SFSYTLLSL (MAGC1_HUMAN)
SRSYTLLSF

SEQ ID NO: 72758 - protein, 9 aa, Artificial Sequence
  Description of Artificial Sequence: Synthetic peptide
  Seed: DVLSGIGVR (MAGC1_HUMAN)
DTLSGIGVK

SEQ ID NO: 72759 - protein, 9 aa, Artificial Sequence
  Description of Artificial Sequence: Synthetic peptide
  Seed: VSRSFSSTL (MAGC1_HUMAN)
VSRSFSSTF

SEQ ID NO: 72760 - protein, 9 aa, Artificial Sequence
  Description of Artificial Sequence: Synthetic peptide
  Seed: SPLQSPVSS (MAGC1_HUMAN)
SPLQSPVSY

SEQ ID NO: 72761 - protein, 9 aa, Artificial Sequence
  Description of Artificial Sequence: Synthetic peptide
  Seed: TLLESDSLT (MAGC1_HUMAN)
TMLESDSLV

SEQ ID NO: 72762 - protein, 11 aa, Artificial Sequence
  Description of Artificial Sequence: Synthetic peptide
  Seed: VSSSSSSSTLL (MAGC1_HUMAN)
VGSSSSSSTLF

SEQ ID NO: 72763 - protein, 10 aa, Artificial Sequence
  Description of Artificial Sequence: Synthetic peptide
  Seed: SSPECTQSTF (MAGC1_HUMAN)
STPECTQSTL

SEQ ID NO: 72764 - protein, 9 aa, Artificial Sequence
  Description of Artificial Sequence: Synthetic peptide
  Seed: TFEGFPQSL (MAGC1_HUMAN)
TMEGFPQSL

SEQ ID NO: 72765 - protein, 8 aa, Artificial Sequence
  Description of Artificial Sequence: Synthetic peptide
  Seed: IWDVLSGI (MAGC1_HUMAN)
IFDVLSGL

SEQ ID NO: 72766 - protein, 9 aa, Artificial Sequence
  Description of Artificial Sequence: Synthetic peptide
  Seed: YQVKQPITK (MAGC1_HUMAN)
YRVKQPITV

SEQ ID NO: 72767 - protein, 9 aa, Artificial Sequence
  Description of Artificial Sequence: Synthetic peptide
  Seed: SSSTSLSPF (MAGC1_HUMAN)
SLSTSLSPM

SEQ ID NO: 72768 - protein, 9 aa, Artificial Sequence
  Description of Artificial Sequence: Synthetic peptide
  Seed: LQNPASSFF (MAGC1_HUMAN)
LPNPASSFY

SEQ ID NO: 72769 - protein, 9 aa, Artificial Sequence
  Description of Artificial Sequence: Synthetic peptide
  Seed: FFSYTLASL (MAGC1_HUMAN)
FRSYTLASL

SEQ ID NO: 72770 - protein, 11 aa, Artificial Sequence
  Description of Artificial Sequence: Synthetic peptide
  Seed: QSSPESDDTLY (MAGC1_HUMAN)
QLSPESDDTLW

SEQ ID NO: 72771 - protein, 9 aa, Artificial Sequence
  Description of Artificial Sequence: Synthetic peptide
  Seed: VSSSFSYTL (MAGC1_HUMAN)
VMSSFSYTL

SEQ ID NO: 72772 - protein, 9 aa, Artificial Sequence
  Description of Artificial Sequence: Synthetic peptide
  Seed: QIVPSLPEW (MAGC1_HUMAN)
QVVPSLPEW

SEQ ID NO: 72773 - protein, 9 aa, Artificial Sequence
  Description of Artificial Sequence: Synthetic peptide
  Seed: STFEGFAQS (MAGC1_HUMAN)
SAFEGFAQA

SEQ ID NO: 72774 - protein, 10 aa, Artificial Sequence
  Description of Artificial Sequence: Synthetic peptide
  Seed: SLFQSSPERT (MAGC1_HUMAN)
STFQSSPERV

SEQ ID NO: 72775 - protein, 9 aa, Artificial Sequence
  Description of Artificial Sequence: Synthetic peptide
  Seed: LQRPVSSFF (MAGC1_HUMAN)
LMRPVSSFV

SEQ ID NO: 72776 - protein, 9 aa, Artificial Sequence
  Description of Artificial Sequence: Synthetic peptide
  Seed: VSPSFSSTL (MAGC1_HUMAN)
VFPSFSSTY

SEQ ID NO: 72777 - protein, 11 aa, Artificial Sequence
  Description of Artificial Sequence: Synthetic peptide
  Seed: IPVSSSFSYTL (MAGC1_HUMAN)
IDVSSSFSYTF

SEQ ID NO: 72778 - protein, 10 aa, Artificial Sequence
  Description of Artificial Sequence: Synthetic peptide
  Seed: YTLASLLQSS (MAGC1_HUMAN)
YMLASLLQST

SEQ ID NO: 72779 - protein, 9 aa, Artificial Sequence
  Description of Artificial Sequence: Synthetic peptide
  Seed: SAQSAFEGF (MAGC1_HUMAN)
SAQSAFEGL

SEQ ID NO: 72780 - protein, 10 aa, Artificial Sequence
  Description of Artificial Sequence: Synthetic peptide
  Seed: SSSSTLLSLF (MAGC1_HUMAN)
SNSSTLLSLW

SEQ ID NO: 72781 - protein, 9 aa, Artificial Sequence
  Description of Artificial Sequence: Synthetic peptide
  Seed: FSSTLVSLF (MAGC1_HUMAN)
FISTLVSLL

SEQ ID NO: 72782 - protein, 10 aa, Artificial Sequence
  Description of Artificial Sequence: Synthetic peptide
  Seed: MPTAGMPSLL (MAGC1_HUMAN)
METAGMPSLL

SEQ ID NO: 72783 - protein, 11 aa, Artificial Sequence
  Description of Artificial Sequence: Synthetic peptide
  Seed: IPVSAASSSTL (MAGC1_HUMAN)
IFVSAASSSTW

SEQ ID NO: 72784 - protein, 10 aa, Artificial Sequence
  Description of Artificial Sequence: Synthetic peptide
  Seed: RYTGYFPVIF (MAGC1_HUMAN)
RHTGYFPVIW

SEQ ID NO: 72785 - protein, 9 aa, Artificial Sequence
  Description of Artificial Sequence: Synthetic peptide
  Seed: LKNTVPITF (MAGC1_HUMAN)
LINTVPITF

SEQ ID NO: 72786 - protein, 10 aa, Artificial Sequence
  Description of Artificial Sequence: Synthetic peptide
  Seed: RPVSSFFSYT (MAGC1_HUMAN)
RTVSSFFSYV

SEQ ID NO: 72787 - protein, 10 aa, Artificial Sequence
  Description of Artificial Sequence: Synthetic peptide
  Seed: TGYFPVIFRK (MAGC1_HUMAN)
TRYFPVIFRR

SEQ ID NO: 72788 - protein, 9 aa, Artificial Sequence
  Description of Artificial Sequence: Synthetic peptide
  Seed: REHFAFGEP (MAGC1_HUMAN)
REHFAFGEV

SEQ ID NO: 72789 - protein, 11 aa, Artificial Sequence
  Description of Artificial Sequence: Synthetic peptide
  Seed: IPVSAASSSTL (MAGC1_HUMAN)
ISVSAASSSTY

SEQ ID NO: 72790 - protein, 9 aa, Artificial Sequence
  Description of Artificial Sequence: Synthetic peptide
  Seed: VISRYTGYF (MAGC1_HUMAN)
VASRYTGYM

SEQ ID NO: 72791 - protein, 10 aa, Artificial Sequence
  Description of Artificial Sequence: Synthetic peptide
  Seed: LSQSSPVSSF (MAGC1_HUMAN)
LTQSSPVSSF

SEQ ID NO: 72792 - protein, 9 aa, Artificial Sequence
  Description of Artificial Sequence: Synthetic peptide
  Seed: SSSTLLSLF (MAGC1_HUMAN)
STSTLLSLV

SEQ ID NO: 72793 - protein, 9 aa, Artificial Sequence
  Description of Artificial Sequence: Synthetic peptide
  Seed: FAFGEPREL (MAGC1_HUMAN)
FTFGEPREW

SEQ ID NO: 72794 - protein, 9 aa, Artificial Sequence
  Description of Artificial Sequence: Synthetic peptide
  Seed: IPVSAASSS (MAGC1_HUMAN)
ISVSAASSY

SEQ ID NO: 72795 - protein, 9 aa, Artificial Sequence
  Description of Artificial Sequence: Synthetic peptide
  Seed: LQIPGSPSF (MAGC1_HUMAN)
LMIPGSPSH

SEQ ID NO: 72796 - protein, 10 aa, Artificial Sequence
  Description of Artificial Sequence: Synthetic peptide
  Seed: MTSSFSSTLL (MAGC1_HUMAN)
MYSSFSSTLF

SEQ ID NO: 72797 - protein, 9 aa, Artificial Sequence
  Description of Artificial Sequence: Synthetic peptide
  Seed: GSPSFSSTL (MAGC1_HUMAN)
GMPSFSSTV

SEQ ID NO: 72798 - protein, 10 aa, Artificial Sequence
  Description of Artificial Sequence: Synthetic peptide
  Seed: SFSSTLLSIL (MAGC1_HUMAN)
SRSSTLLSIF

SEQ ID NO: 72799 - protein, 9 aa, Artificial Sequence
  Description of Artificial Sequence: Synthetic peptide
  Seed: LSDEQGMSQ (MAGC1_HUMAN)
LDDEQGMSM

SEQ ID NO: 72800 - protein, 11 aa, Artificial Sequence
  Description of Artificial Sequence: Synthetic peptide
  Seed: RPVSSFFSYTL (MAGC1_HUMAN)
RVVSSFFSYTY

SEQ ID NO: 72801 - protein, 9 aa, Artificial Sequence
  Description of Artificial Sequence: Synthetic peptide
  Seed: CSSSTSLSL (MAGC1_HUMAN)
CASSTSLSY

SEQ ID NO: 72802 - protein, 9 aa, Artificial Sequence
  Description of Artificial Sequence: Synthetic peptide
  Seed: KVVEFLAML (MAGC1_HUMAN)
KIVEFLAMK

SEQ ID NO: 72803 - protein, 11 aa, Artificial Sequence
  Description of Artificial Sequence: Synthetic peptide
  Seed: LQRPVSSFFSY (MAGC1_HUMAN)
LPRPVSSFFSF

SEQ ID NO: 72804 - protein, 10 aa, Artificial Sequence
  Description of Artificial Sequence: Synthetic peptide
  Seed: LQIPGSPSFS (MAGC1_HUMAN)
LMIPGSPSFM

SEQ ID NO: 72805 - protein, 9 aa, Artificial Sequence
  Description of Artificial Sequence: Synthetic peptide
  Seed: KAREFIEIL (MAGC1_HUMAN)
KYREFIEIK

SEQ ID NO: 72806 - protein, 9 aa, Artificial Sequence
  Description of Artificial Sequence: Synthetic peptide
  Seed: TSSFSSTLL (MAGC1_HUMAN)
TASFSSTLL

SEQ ID NO: 72807 - protein, 9 aa, Artificial Sequence
  Description of Artificial Sequence: Synthetic peptide
  Seed: TLDEKVDEL (MAGC1_HUMAN)
TSDEKVDEM

SEQ ID NO: 72808 - protein, 9 aa, Artificial Sequence
  Description of Artificial Sequence: Synthetic peptide
  Seed: VSPSFSSTL (MAGC1_HUMAN)
VIPSFSSTV

SEQ ID NO: 72809 - protein, 9 aa, Artificial Sequence
  Description of Artificial Sequence: Synthetic peptide
  Seed: SSHESPQSP (MAGC1_HUMAN)
SMHESPQSF

SEQ ID NO: 72810 - protein, 9 aa, Artificial Sequence
  Description of Artificial Sequence: Synthetic peptide
  Seed: YVFVNTLDL (MAGC1_HUMAN)
YWFVNTLDM

SEQ ID NO: 72811 - protein, 9 aa, Artificial Sequence
  Description of Artificial Sequence: Synthetic peptide
  Seed: QIVPSLPEW (MAGC1_HUMAN)
QIVPSLPEL

SEQ ID NO: 72812 - protein, 10 aa, Artificial Sequence
  Description of Artificial Sequence: Synthetic peptide
  Seed: ASSSVMSPSF (MAGC1_HUMAN)
AQSSVMSPSW

SEQ ID NO: 72813 - protein, 9 aa, Artificial Sequence
  Description of Artificial Sequence: Synthetic peptide
  Seed: TPSSLPQSF (MAGC1_HUMAN)
TLSSLPQSF

SEQ ID NO: 72814 - protein, 9 aa, Artificial Sequence
  Description of Artificial Sequence: Synthetic peptide
  Seed: VSPSSSSTL (MAGC1_HUMAN)
VSPSSSSTI

SEQ ID NO: 72815 - protein, 9 aa, Artificial Sequence
  Description of Artificial Sequence: Synthetic peptide
  Seed: SPPQGEDSM (MAGC1_HUMAN)
SVPQGEDSM

SEQ ID NO: 72816 - protein, 9 aa, Artificial Sequence
  Description of Artificial Sequence: Synthetic peptide
  Seed: KVVEFLAML (MAGC1_HUMAN)
KWVEFLAMY

SEQ ID NO: 72817 - protein, 10 aa, Artificial Sequence
  Description of Artificial Sequence: Synthetic peptide
  Seed: RKVVEFLAML (MAGC1_HUMAN)
RSVVEFLAML

SEQ ID NO: 72818 - protein, 9 aa, Artificial Sequence
  Description of Artificial Sequence: Synthetic peptide
  Seed: YTLLSLFQS (MAGC1_HUMAN)
YLLLSLFQT

SEQ ID NO: 72819 - protein, 9 aa, Artificial Sequence
  Description of Artificial Sequence: Synthetic peptide
  Seed: NTVPITFPS (MAGC1_HUMAN)
NSVPITFPI

SEQ ID NO: 72820 - protein, 9 aa, Artificial Sequence
  Description of Artificial Sequence: Synthetic peptide
  Seed: RSFSSTLLS (MAGC1_HUMAN)
RSFSSTLLA

SEQ ID NO: 72821 - protein, 9 aa, Artificial Sequence
  Description of Artificial Sequence: Synthetic peptide
  Seed: VSPSSSSTL (MAGC1_HUMAN)
VTPSSSSTY

SEQ ID NO: 72822 - protein, 9 aa, Artificial Sequence
  Description of Artificial Sequence: Synthetic peptide
  Seed: NTVPITFPS (MAGC1_HUMAN)
NTVPITFPL

SEQ ID NO: 72823 - protein, 11 aa, Artificial Sequence
  Description of Artificial Sequence: Synthetic peptide
  Seed: RYTGYFPVIFR (MAGC1_HUMAN)
RYTGYFPVIFK

SEQ ID NO: 72824 - protein, 11 aa, Artificial Sequence
  Description of Artificial Sequence: Synthetic peptide
  Seed: SSFFSSALLSI (MAGC1_HUMAN)
STFFSSALLSL

SEQ ID NO: 72825 - protein, 9 aa, Artificial Sequence
  Description of Artificial Sequence: Synthetic peptide
  Seed: ELARFLLLK (MAGC1_HUMAN)
EQARFLLLK

SEQ ID NO: 72826 - protein, 11 aa, Artificial Sequence
  Description of Artificial Sequence: Synthetic peptide
  Seed: MSPLYFPQSPL (MAGC1_HUMAN)
MSPLYFPQSPF

SEQ ID NO: 72827 - protein, 10 aa, Artificial Sequence
  Description of Artificial Sequence: Synthetic peptide
  Seed: KVVEFLAMLK (MAGC1_HUMAN)
KQVEFLAMLR

SEQ ID NO: 72828 - protein, 10 aa, Artificial Sequence
  Description of Artificial Sequence: Synthetic peptide
  Seed: LQIPMTSSFS (MAGC1_HUMAN)
LQIPMTSSFT

SEQ ID NO: 72829 - protein, 9 aa, Artificial Sequence
  Description of Artificial Sequence: Synthetic peptide
  Seed: TSLSLPQSF (MAGC1_HUMAN)
TFLSLPQSW

SEQ ID NO: 72830 - protein, 9 aa, Artificial Sequence
  Description of Artificial Sequence: Synthetic peptide
  Seed: VSPSFSSTL (MAGC1_HUMAN)
VWPSFSSTF

SEQ ID NO: 72831 - protein, 9 aa, Artificial Sequence
  Description of Artificial Sequence: Synthetic peptide
  Seed: KAREFIEIL (MAGC1_HUMAN)
KRREFIEIF

SEQ ID NO: 72832 - protein, 10 aa, Artificial Sequence
  Description of Artificial Sequence: Synthetic peptide
  Seed: PLQIPMTSSF (MAGC1_HUMAN)
PQQIPMTSSY

SEQ ID NO: 72833 - protein, 9 aa, Artificial Sequence
  Description of Artificial Sequence: Synthetic peptide
  Seed: SQSSPVSSF (MAGC1_HUMAN)
SPSSPVSSF

SEQ ID NO: 72834 - protein, 11 aa, Artificial Sequence
  Description of Artificial Sequence: Synthetic peptide
  Seed: SEESSSPVDEY (MAGC1_HUMAN)
SVESSSPVDEY

SEQ ID NO: 72835 - protein, 9 aa, Artificial Sequence
  Description of Artificial Sequence: Synthetic peptide
  Seed: WVQEHYLEY (MAGC1_HUMAN)
WQQEHYLEW

SEQ ID NO: 72836 - protein, 10 aa, Artificial Sequence
  Description of Artificial Sequence: Synthetic peptide
  Seed: ASSSTLVSIF (MAGC1_HUMAN)
AGSSTLVSIW

SEQ ID NO: 72837 - protein, 9 aa, Artificial Sequence
  Description of Artificial Sequence: Synthetic peptide
  Seed: EFIEILFGI (MAGC1_HUMAN)
EIIEILFGS

SEQ ID NO: 72838 - protein, 9 aa, Artificial Sequence
  Description of Artificial Sequence: Synthetic peptide
  Seed: SICSSSTSL (MAGC1_HUMAN)
SMCSSSTSV

SEQ ID NO: 72839 - protein, 9 aa, Artificial Sequence
  Description of Artificial Sequence: Synthetic peptide
  Seed: AFGEPRELL (MAGC1_HUMAN)
AYGEPRELF

SEQ ID NO: 72840 - protein, 9 aa, Artificial Sequence
  Description of Artificial Sequence: Synthetic peptide
  Seed: TTDDSTATE (MAGC1_HUMAN)
TSDDSTATF

SEQ ID NO: 72841 - protein, 9 aa, Artificial Sequence
  Description of Artificial Sequence: Synthetic peptide
  Seed: LQIPMTSSF (MAGC1_HUMAN)
LKIPMTSSW

SEQ ID NO: 72842 - protein, 9 aa, Artificial Sequence
  Description of Artificial Sequence: Synthetic peptide
  Seed: ASSFFSSAL (MAGC1_HUMAN)
AYSFFSSAF

SEQ ID NO: 72843 - protein, 10 aa, Artificial Sequence
  Description of Artificial Sequence: Synthetic peptide
  Seed: LLQIPMTSSF (MAGC1_HUMAN)
LHQIPMTSSY

SEQ ID NO: 72844 - protein, 9 aa, Artificial Sequence
  Description of Artificial Sequence: Synthetic peptide
  Seed: AQSPLQSPV (MAGC1_HUMAN)
AASPLQSPY

SEQ ID NO: 72845 - protein, 11 aa, Artificial Sequence
  Description of Artificial Sequence: Synthetic peptide
  Seed: TTDDSTATESA (MAGC1_HUMAN)
TSDDSTATESV

SEQ ID NO: 72846 - protein, 9 aa, Artificial Sequence
  Description of Artificial Sequence: Synthetic peptide
  Seed: EDFQSSLQS (MAGC1_HUMAN)
EEFQSSLQL

SEQ ID NO: 72847 - protein, 10 aa, Artificial Sequence
  Description of Artificial Sequence: Synthetic peptide
  Seed: VPITFPSSYK (MAGC1_HUMAN)
VWITFPSSYR

SEQ ID NO: 72848 - protein, 9 aa, Artificial Sequence
  Description of Artificial Sequence: Synthetic peptide
  Seed: SLSPHYFPQ (MAGC1_HUMAN)
SMSPHYFPK

SEQ ID NO: 72849 - protein, 9 aa, Artificial Sequence
  Description of Artificial Sequence: Synthetic peptide
  Seed: ALLSIFQSS (MAGC1_HUMAN)
AQLSIFQSV

SEQ ID NO: 72850 - protein, 9 aa, Artificial Sequence
  Description of Artificial Sequence: Synthetic peptide
  Seed: EMLTNVISR (MAGC1_HUMAN)
EILTNVISK

SEQ ID NO: 72851 - protein, 9 aa, Artificial Sequence
  Description of Artificial Sequence: Synthetic peptide
  Seed: SRYTGYFPV (MAGC1_HUMAN)
SRYTGYFPK

SEQ ID NO: 72852 - protein, 9 aa, Artificial Sequence
  Description of Artificial Sequence: Synthetic peptide
  Seed: GYFPVIFRK (MAGC1_HUMAN)
GIFPVIFRR

SEQ ID NO: 72853 - protein, 10 aa, Artificial Sequence
  Description of Artificial Sequence: Synthetic peptide
  Seed: PLQIPMTSSF (MAGC1_HUMAN)
PHQIPMTSSY

SEQ ID NO: 72854 - protein, 10 aa, Artificial Sequence
  Description of Artificial Sequence: Synthetic peptide
  Seed: MTSSFSSTLL (MAGC1_HUMAN)
MGSSFSSTLL

SEQ ID NO: 72855 - protein, 10 aa, Artificial Sequence
  Description of Artificial Sequence: Synthetic peptide
  Seed: MSPLYFPQSP (MAGC1_HUMAN)
MGPLYFPQSV

SEQ ID NO: 72856 - protein, 9 aa, Artificial Sequence
  Description of Artificial Sequence: Synthetic peptide
  Seed: SPHYFPQSP (MAGC1_HUMAN)
SPHYFPQSL

SEQ ID NO: 72857 - protein, 9 aa, Artificial Sequence
  Description of Artificial Sequence: Synthetic peptide
  Seed: LASLLQSSH (MAGC1_HUMAN)
LASLLQSSM

SEQ ID NO: 72858 - protein, 9 aa, Artificial Sequence
  Description of Artificial Sequence: Synthetic peptide
  Seed: TLDEKVDEL (MAGC1_HUMAN)
TTDEKVDEC

SEQ ID NO: 72859 - protein, 9 aa, Artificial Sequence
  Description of Artificial Sequence: Synthetic peptide
  Seed: VIWDVLSGI (MAGC1_HUMAN)
VQWDVLSGF

SEQ ID NO: 72860 - protein, 10 aa, Artificial Sequence
  Description of Artificial Sequence: Synthetic peptide
  Seed: LQIPVSPSFS (MAGC1_HUMAN)
LMIPVSPSFY

SEQ ID NO: 72861 - protein, 9 aa, Artificial Sequence
  Description of Artificial Sequence: Synthetic peptide
  Seed: LQIPGSPSF (MAGC1_HUMAN)
LLIPGSPSM

SEQ ID NO: 72862 - protein, 9 aa, Artificial Sequence
  Description of Artificial Sequence: Synthetic peptide
  Seed: MSQNRLLIL (MAGC1_HUMAN)
MSQNRLLIV

SEQ ID NO: 72863 - protein, 9 aa, Artificial Sequence
  Description of Artificial Sequence: Synthetic peptide
  Seed: EHFAFGEPR (MAGC1_HUMAN)
EYFAFGEPK

SEQ ID NO: 72864 - protein, 9 aa, Artificial Sequence
  Description of Artificial Sequence: Synthetic peptide
  Seed: VIFRKAREF (MAGC1_HUMAN)
VFFRKAREM

SEQ ID NO: 72865 - protein, 9 aa, Artificial Sequence
  Description of Artificial Sequence: Synthetic peptide
  Seed: TLDEKVDEL (MAGC1_HUMAN)
TYDEKVDEA

SEQ ID NO: 72866 - protein, 10 aa, Artificial Sequence
  Description of Artificial Sequence: Synthetic peptide
  Seed: LAMLKNTVPI (MAGC1_HUMAN)
LKMLKNTVPI

SEQ ID NO: 72867 - protein, 10 aa, Artificial Sequence
  Description of Artificial Sequence: Synthetic peptide
  Seed: FFSYTLASLL (MAGC1_HUMAN)
FMSYTLASLC

SEQ ID NO: 72868 - protein, 9 aa, Artificial Sequence
  Description of Artificial Sequence: Synthetic peptide
  Seed: WVQEHYLEY (MAGC1_HUMAN)
WEQEHYLEY

SEQ ID NO: 72869 - protein, 10 aa, Artificial Sequence
  Description of Artificial Sequence: Synthetic peptide
  Seed: ASSSTLVSIF (MAGC1_HUMAN)
ASSSTLVSIW

SEQ ID NO: 72870 - protein, 9 aa, Artificial Sequence
  Description of Artificial Sequence: Synthetic peptide
  Seed: SSFFSYTLA (MAGC1_HUMAN)
SYFFSYTLK

SEQ ID NO: 72871 - protein, 9 aa, Artificial Sequence
  Description of Artificial Sequence: Synthetic peptide
  Seed: SSFFSSALL (MAGC1_HUMAN)
SEFFSSALF

SEQ ID NO: 72872 - protein, 10 aa, Artificial Sequence
  Description of Artificial Sequence: Synthetic peptide
  Seed: SLFQSSPERT (MAGC1_HUMAN)
SIFQSSPERL

SEQ ID NO: 72873 - protein, 9 aa, Artificial Sequence
  Description of Artificial Sequence: Synthetic peptide
  Seed: SIIFIKGTY (MAGC1_HUMAN)
SSIFIKGTM

SEQ ID NO: 72874 - protein, 9 aa, Artificial Sequence
  Description of Artificial Sequence: Synthetic peptide
  Seed: SKSSPESPL (MAGC1_HUMAN)
SLSSPESPY

SEQ ID NO: 72875 - protein, 9 aa, Artificial Sequence
  Description of Artificial Sequence: Synthetic peptide
  Seed: ASSSTLVSI (MAGC1_HUMAN)
ATSSTLVSL

SEQ ID NO: 72876 - protein, 9 aa, Artificial Sequence
  Description of Artificial Sequence: Synthetic peptide
  Seed: VIWDVLSGI (MAGC1_HUMAN)
VLWDVLSGM

SEQ ID NO: 72877 - protein, 9 aa, Artificial Sequence
  Description of Artificial Sequence: Synthetic peptide
  Seed: YPLQSPQSR (MAGC1_HUMAN)
YALQSPQSM

SEQ ID NO: 72878 - protein, 11 aa, Artificial Sequence
  Description of Artificial Sequence: Synthetic peptide
  Seed: STFEGFPQSPL (MAGC1_HUMAN)
SPFEGFPQSPM

SEQ ID NO: 72879 - protein, 10 aa, Artificial Sequence
  Description of Artificial Sequence: Synthetic peptide
  Seed: SFFSSALLSI (MAGC1_HUMAN)
SAFSSALLSF

SEQ ID NO: 72880 - protein, 9 aa, Artificial Sequence
  Description of Artificial Sequence: Synthetic peptide
  Seed: MPSLLQSSS (MAGC1_HUMAN)
MPSLLQSSH

SEQ ID NO: 72881 - protein, 9 aa, Artificial Sequence
  Description of Artificial Sequence: Synthetic peptide
  Seed: ASSFFSSAL (MAGC1_HUMAN)
AISFFSSAM

SEQ ID NO: 72882 - protein, 9 aa, Artificial Sequence
  Description of Artificial Sequence: Synthetic peptide
  Seed: TTDDSTATE (MAGC1_HUMAN)
TSDDSTATM

SEQ ID NO: 72883 - protein, 10 aa, Artificial Sequence
  Description of Artificial Sequence: Synthetic peptide
  Seed: RAGREHFAFG (MAGC1_HUMAN)
RTGREHFAFR

SEQ ID NO: 72884 - protein, 9 aa, Artificial Sequence
  Description of Artificial Sequence: Synthetic peptide
  Seed: SSSFSYTLL (MAGC1_HUMAN)
SSSFSYTLV

SEQ ID NO: 72885 - protein, 9 aa, Artificial Sequence
  Description of Artificial Sequence: Synthetic peptide
  Seed: IEILFGISL (MAGC1_HUMAN)
IQILFGISI

SEQ ID NO: 72886 - protein, 9 aa, Artificial Sequence
  Description of Artificial Sequence: Synthetic peptide
  Seed: IIDTTDDST (MAGC1_HUMAN)
IADTTDDSF

SEQ ID NO: 72887 - protein, 11 aa, Artificial Sequence
  Description of Artificial Sequence: Synthetic peptide
  Seed: SFFSYTLASLL (MAGC1_HUMAN)
SKFSYTLASLF

SEQ ID NO: 72888 - protein, 11 aa, Artificial Sequence
  Description of Artificial Sequence: Synthetic peptide
  Seed: IPVSAASSSTL (MAGC1_HUMAN)
IDVSAASSSTF

SEQ ID NO: 72889 - protein, 9 aa, Artificial Sequence
  Description of Artificial Sequence: Synthetic peptide
  Seed: STQSPFEGF (MAGC1_HUMAN)
SIQSPFEGR

SEQ ID NO: 72890 - protein, 9 aa, Artificial Sequence
  Description of Artificial Sequence: Synthetic peptide
  Seed: SSPEGKDSL (MAGC1_HUMAN)
SLPEGKDSY

SEQ ID NO: 72891 - protein, 9 aa, Artificial Sequence
  Description of Artificial Sequence: Synthetic peptide
  Seed: FLAMLKNTV (MAGC1_HUMAN)
FLAMLKNTA

SEQ ID NO: 72892 - protein, 10 aa, Artificial Sequence
  Description of Artificial Sequence: Synthetic peptide
  Seed: SFSSTLLSIF (MAGC1_HUMAN)
SYSSTLLSIF

SEQ ID NO: 72893 - protein, 11 aa, Artificial Sequence
  Description of Artificial Sequence: Synthetic peptide
  Seed: FLAMLKNTVPI (MAGC1_HUMAN)
FQAMLKNTVPV

SEQ ID NO: 72894 - protein, 9 aa, Artificial Sequence
  Description of Artificial Sequence: Synthetic peptide
  Seed: TLLSLFQSF (MAGC1_HUMAN)
TQLSLFQSM

SEQ ID NO: 72895 - protein, 10 aa, Artificial Sequence
  Description of Artificial Sequence: Synthetic peptide
  Seed: KVVEFLAMLK (MAGC1_HUMAN)
KMVEFLAMLM

SEQ ID NO: 72896 - protein, 10 aa, Artificial Sequence
  Description of Artificial Sequence: Synthetic peptide
  Seed: YTLASLLQSS (MAGC1_HUMAN)
YFLASLLQSM

SEQ ID NO: 72897 - protein, 10 aa, Artificial Sequence
  Description of Artificial Sequence: Synthetic peptide
  Seed: SSSSSTLLSL (MAGC1_HUMAN)
SQSSSTLLSL

SEQ ID NO: 72898 - protein, 10 aa, Artificial Sequence
  Description of Artificial Sequence: Synthetic peptide
  Seed: SFSYTLLSLF (MAGC1_HUMAN)
SSSYTLLSLW

SEQ ID NO: 72899 - protein, 9 aa, Artificial Sequence
  Description of Artificial Sequence: Synthetic peptide
  Seed: SSSTLVSIF (MAGC1_HUMAN)
SASTLVSIY

SEQ ID NO: 72900 - protein, 9 aa, Artificial Sequence
  Description of Artificial Sequence: Synthetic peptide
  Seed: YPLQSPQSR (MAGC1_HUMAN)
YALQSPQSF

SEQ ID NO: 72901 - protein, 11 aa, Artificial Sequence
  Description of Artificial Sequence: Synthetic peptide
  Seed: FQSSLQSPVSI (MAGC1_HUMAN)
FKSSLQSPVSF

SEQ ID NO: 72902 - protein, 9 aa, Artificial Sequence
  Description of Artificial Sequence: Synthetic peptide
  Seed: GSPSFSSTL (MAGC1_HUMAN)
GLPSFSSTL

SEQ ID NO: 72903 - protein, 10 aa, Artificial Sequence
  Description of Artificial Sequence: Synthetic peptide
  Seed: SSPECTQSTF (MAGC1_HUMAN)
SIPECTQSTM

SEQ ID NO: 72904 - protein, 10 aa, Artificial Sequence
  Description of Artificial Sequence: Synthetic peptide
  Seed: YTLASLLQSS (MAGC1_HUMAN)
YLLASLLQSV

SEQ ID NO: 72905 - protein, 9 aa, Artificial Sequence
  Description of Artificial Sequence: Synthetic peptide
  Seed: SSFFSSALL (MAGC1_HUMAN)
SPFFSSALY

SEQ ID NO: 72906 - protein, 11 aa, Artificial Sequence
  Description of Artificial Sequence: Synthetic peptide
  Seed: IPVSAASSSTL (MAGC1_HUMAN)
ITVSAASSSTF

SEQ ID NO: 72907 - protein, 10 aa, Artificial Sequence
  Description of Artificial Sequence: Synthetic peptide
  Seed: FPSSTSSSLS (MAGC1_HUMAN)
FPSSTSSSLV

SEQ ID NO: 72908 - protein, 9 aa, Artificial Sequence
  Description of Artificial Sequence: Synthetic peptide
  Seed: ASSFFSSAL (MAGC1_HUMAN)
AFSFFSSAL

SEQ ID NO: 72909 - protein, 10 aa, Artificial Sequence
  Description of Artificial Sequence: Synthetic peptide
  Seed: LQIPMTSSFS (MAGC1_HUMAN)
LMIPMTSSFY

SEQ ID NO: 72910 - protein, 10 aa, Artificial Sequence
  Description of Artificial Sequence: Synthetic peptide
  Seed: SSPERTQSTF (MAGC1_HUMAN)
SLPERTQSTM

SEQ ID NO: 72911 - protein, 9 aa, Artificial Sequence
  Description of Artificial Sequence: Synthetic peptide
  Seed: IIDTTDDST (MAGC1_HUMAN)
IIDTTDDSM

SEQ ID NO: 72912 - protein, 10 aa, Artificial Sequence
  Description of Artificial Sequence: Synthetic peptide
  Seed: RSFSSTLLSI (MAGC1_HUMAN)
RCFSSTLLSW

SEQ ID NO: 72913 - protein, 10 aa, Artificial Sequence
  Description of Artificial Sequence: Synthetic peptide
  Seed: AMLKNTVPIT (MAGC1_HUMAN)
ALLKNTVPII

SEQ ID NO: 72914 - protein, 9 aa, Artificial Sequence
  Description of Artificial Sequence: Synthetic peptide
  Seed: FSYTLASLL (MAGC1_HUMAN)
FLYTLASLV

SEQ ID NO: 72915 - protein, 9 aa, Artificial Sequence
  Description of Artificial Sequence: Synthetic peptide
  Seed: QIVPSLPEW (MAGC1_HUMAN)
QTVPSLPEW

SEQ ID NO: 72916 - protein, 10 aa, Artificial Sequence
  Description of Artificial Sequence: Synthetic peptide
  Seed: LQIPVSRSFS (MAGC1_HUMAN)
LQIPVSRSFK

SEQ ID NO: 72917 - protein, 9 aa, Artificial Sequence
  Description of Artificial Sequence: Synthetic peptide
  Seed: ISFSSSTSL (MAGC1_HUMAN)
IQFSSSTSL

SEQ ID NO: 72918 - protein, 10 aa, Artificial Sequence
  Description of Artificial Sequence: Synthetic peptide
  Seed: ASSFFSSALL (MAGC1_HUMAN)
ADSFFSSALM

SEQ ID NO: 72919 - protein, 10 aa, Artificial Sequence
  Description of Artificial Sequence: Synthetic peptide
  Seed: LLQIPMTSSF (MAGC1_HUMAN)
LKQIPMTSSW

SEQ ID NO: 72920 - protein, 10 aa, Artificial Sequence
  Description of Artificial Sequence: Synthetic peptide
  Seed: FFSYTLASLL (MAGC1_HUMAN)
FLSYTLASLY

SEQ ID NO: 72921 - protein, 10 aa, Artificial Sequence
  Description of Artificial Sequence: Synthetic peptide
  Seed: LQIVPSLPEW (MAGC1_HUMAN)
LTIVPSLPEM

SEQ ID NO: 72922 - protein, 9 aa, Artificial Sequence
  Description of Artificial Sequence: Synthetic peptide
  Seed: SQSSPVSSF (MAGC1_HUMAN)
SLSSPVSSV

SEQ ID NO: 72923 - protein, 9 aa, Artificial Sequence
  Description of Artificial Sequence: Synthetic peptide
  Seed: MTSSFSSTL (MAGC1_HUMAN)
MESSFSSTY

SEQ ID NO: 72924 - protein, 9 aa, Artificial Sequence
  Description of Artificial Sequence: Synthetic peptide
  Seed: LQRPVSSFF (MAGC1_HUMAN)
LTRPVSSFK

SEQ ID NO: 72925 - protein, 8 aa, Artificial Sequence
  Description of Artificial Sequence: Synthetic peptide
  Seed: SSFFSSAL (MAGC1_HUMAN)
SQFFSSAW

SEQ ID NO: 72926 - protein, 10 aa, Artificial Sequence
  Description of Artificial Sequence: Synthetic peptide
  Seed: SFSSTLVSLF (MAGC1_HUMAN)
SVSSTLVSLY

SEQ ID NO: 72927 - protein, 10 aa, Artificial Sequence
  Description of Artificial Sequence: Synthetic peptide
  Seed: FAQSSLQIPV (MAGC1_HUMAN)
FHQSSLQIPV

SEQ ID NO: 72928 - protein, 10 aa, Artificial Sequence
  Description of Artificial Sequence: Synthetic peptide
  Seed: LQNPASSFFS (MAGC1_HUMAN)
LINPASSFFF

SEQ ID NO: 72929 - protein, 9 aa, Artificial Sequence
  Description of Artificial Sequence: Synthetic peptide
  Seed: DSYVFVNTL (MAGC1_HUMAN)
DHYVFVNTI

SEQ ID NO: 72930 - protein, 8 aa, Artificial Sequence
  Description of Artificial Sequence: Synthetic peptide
  Seed: FSYTLASL (MAGC1_HUMAN)
FTYTLASY

SEQ ID NO: 72931 - protein, 11 aa, Artificial Sequence
  Description of Artificial Sequence: Synthetic peptide
  Seed: TESASSSVMSP (MAGC1_HUMAN)
TESASSSVMSV

SEQ ID NO: 72932 - protein, 9 aa, Artificial Sequence
  Description of Artificial Sequence: Synthetic peptide
  Seed: LQIPVSRSF (MAGC1_HUMAN)
LWIPVSRSL

SEQ ID NO: 72933 - protein, 11 aa, Artificial Sequence
  Description of Artificial Sequence: Synthetic peptide
  Seed: SPLQIPGSPSF (MAGC1_HUMAN)
SSLQIPGSPSY

SEQ ID NO: 72934 - protein, 10 aa, Artificial Sequence
  Description of Artificial Sequence: Synthetic peptide
  Seed: FSYTLLSLFQ (MAGC1_HUMAN)
FSYTLLSLFW

SEQ ID NO: 72935 - protein, 9 aa, Artificial Sequence
  Description of Artificial Sequence: Synthetic peptide
  Seed: FSSTLLSLF (MAGC1_HUMAN)
FQSTLLSLF

SEQ ID NO: 72936 - protein, 10 aa, Artificial Sequence
  Description of Artificial Sequence: Synthetic peptide
  Seed: ESAQSAFEGF (MAGC1_HUMAN)
ELAQSAFEGR

SEQ ID NO: 72937 - protein, 9 aa, Artificial Sequence
  Description of Artificial Sequence: Synthetic peptide
  Seed: YTLLSLFQS (MAGC1_HUMAN)
YSLLSLFQV

SEQ ID NO: 72938 - protein, 9 aa, Artificial Sequence
  Description of Artificial Sequence: Synthetic peptide
  Seed: SLSPFSEES (MAGC1_HUMAN)
SLSPFSEEV

SEQ ID NO: 72939 - protein, 10 aa, Artificial Sequence
  Description of Artificial Sequence: Synthetic peptide
  Seed: ESAQSTFEGF (MAGC1_HUMAN)
EAAQSTFEGK

SEQ ID NO: 72940 - protein, 10 aa, Artificial Sequence
  Description of Artificial Sequence: Synthetic peptide
  Seed: HSPQSPPEGM (MAGC1_HUMAN)
HVPQSPPEGM

SEQ ID NO: 72941 - protein, 9 aa, Artificial Sequence
  Description of Artificial Sequence: Synthetic peptide
  Seed: TSLSLPQSF (MAGC1_HUMAN)
TLLSLPQSL

SEQ ID NO: 72942 - protein, 9 aa, Artificial Sequence
  Description of Artificial Sequence: Synthetic peptide
  Seed: SSFFSSALL (MAGC1_HUMAN)
SFFFSSALY

SEQ ID NO: 72943 - protein, 9 aa, Artificial Sequence
  Description of Artificial Sequence: Synthetic peptide
  Seed: AMLKNTVPI (MAGC1_HUMAN)
AVLKNTVPR

SEQ ID NO: 72944 - protein, 10 aa, Artificial Sequence
  Description of Artificial Sequence: Synthetic peptide
  Seed: MTSSFSSTLL (MAGC1_HUMAN)
MPSSFSSTLW

SEQ ID NO: 72945 - protein, 11 aa, Artificial Sequence
  Description of Artificial Sequence: Synthetic peptide
  Seed: QSSPESAQSTF (MAGC1_HUMAN)
QTSPESAQSTF

SEQ ID NO: 72946 - protein, 11 aa, Artificial Sequence
  Description of Artificial Sequence: Synthetic peptide
  Seed: SICSSSTSLSL (MAGC1_HUMAN)
SACSSSTSLSY

SEQ ID NO: 72947 - protein, 10 aa, Artificial Sequence
  Description of Artificial Sequence: Synthetic peptide
  Seed: SPLQIPGSPS (MAGC1_HUMAN)
SPLQIPGSPP

SEQ ID NO: 72948 - protein, 9 aa, Artificial Sequence
  Description of Artificial Sequence: Synthetic peptide
  Seed: ESDDTLYPL (MAGC1_HUMAN)
EYDDTLYPL

SEQ ID NO: 72949 - protein, 10 aa, Artificial Sequence
  Description of Artificial Sequence: Synthetic peptide
  Seed: PLQIPVSRSF (MAGC1_HUMAN)
PYQIPVSRSF

SEQ ID NO: 72950 - protein, 8 aa, Artificial Sequence
  Description of Artificial Sequence: Synthetic peptide
  Seed: MSQNRLLI (MAGC1_HUMAN)
MAQNRLLF

SEQ ID NO: 72951 - protein, 9 aa, Artificial Sequence
  Description of Artificial Sequence: Synthetic peptide
  Seed: SSFFSSALL (MAGC1_HUMAN)
SYFFSSALV

SEQ ID NO: 72952 - protein, 10 aa, Artificial Sequence
  Description of Artificial Sequence: Synthetic peptide
  Seed: SFSYTLLSLF (MAGC1_HUMAN)
SESYTLLSLY

SEQ ID NO: 72953 - protein, 9 aa, Artificial Sequence
  Description of Artificial Sequence: Synthetic peptide
  Seed: TLDEKVDEL (MAGC1_HUMAN)
TIDEKVDEY

SEQ ID NO: 72954 - protein, 9 aa, Artificial Sequence
  Description of Artificial Sequence: Synthetic peptide
  Seed: LQIPVSSSS (MAGC1_HUMAN)
LEIPVSSSL

SEQ ID NO: 72955 - protein, 10 aa, Artificial Sequence
  Description of Artificial Sequence: Synthetic peptide
  Seed: NPASSFFSSA (MAGC1_HUMAN)
NVASSFFSSL

SEQ ID NO: 72956 - protein, 9 aa, Artificial Sequence
  Description of Artificial Sequence: Synthetic peptide
  Seed: AASSSTLVS (MAGC1_HUMAN)
AISSSTLVF

SEQ ID NO: 72957 - protein, 9 aa, Artificial Sequence
  Description of Artificial Sequence: Synthetic peptide
  Seed: VSAASSSTL (MAGC1_HUMAN)
VTAASSSTV

SEQ ID NO: 72958 - protein, 9 aa, Artificial Sequence
  Description of Artificial Sequence: Synthetic peptide
  Seed: FSSTLVSLF (MAGC1_HUMAN)
FYSTLVSLV

SEQ ID NO: 72959 - protein, 9 aa, Artificial Sequence
  Description of Artificial Sequence: Synthetic peptide
  Seed: VQSPLHSPQ (MAGC1_HUMAN)
VQSPLHSPF

SEQ ID NO: 72960 - protein, 9 aa, Artificial Sequence
  Description of Artificial Sequence: Synthetic peptide
  Seed: FSSTLLSIL (MAGC1_HUMAN)
FKSTLLSIM

SEQ ID NO: 72961 - protein, 9 aa, Artificial Sequence
  Description of Artificial Sequence: Synthetic peptide
  Seed: RTQSTFEGF (MAGC1_HUMAN)
RFQSTFEGM

SEQ ID NO: 72962 - protein, 10 aa, Artificial Sequence
  Description of Artificial Sequence: Synthetic peptide
  Seed: ASSFFSSALL (MAGC1_HUMAN)
ATSFFSSALW

SEQ ID NO: 72963 - protein, 9 aa, Artificial Sequence
  Description of Artificial Sequence: Synthetic peptide
  Seed: KVVEFLAML (MAGC1_HUMAN)
KQVEFLAMA

SEQ ID NO: 72964 - protein, 9 aa, Artificial Sequence
  Description of Artificial Sequence: Synthetic peptide
  Seed: SSPERTQST (MAGC1_HUMAN)
SIPERTQSF

SEQ ID NO: 72965 - protein, 9 aa, Artificial Sequence
  Description of Artificial Sequence: Synthetic peptide
  Seed: VIKRKVVEF (MAGC1_HUMAN)
VPKRKVVEI

SEQ ID NO: 72966 - protein, 9 aa, Artificial Sequence
  Description of Artificial Sequence: Synthetic peptide
  Seed: AMLKNTVPI (MAGC1_HUMAN)
AMLKNTVPV

SEQ ID NO: 72967 - protein, 9 aa, Artificial Sequence
  Description of Artificial Sequence: Synthetic peptide
  Seed: VSAASSSTL (MAGC1_HUMAN)
VVAASSSTF

SEQ ID NO: 72968 - protein, 10 aa, Artificial Sequence
  Description of Artificial Sequence: Synthetic peptide
  Seed: SSPESAQSAF (MAGC1_HUMAN)
SSPESAQSAL

SEQ ID NO: 72969 - protein, 9 aa, Artificial Sequence
  Description of Artificial Sequence: Synthetic peptide
  Seed: SFSYTLLSL (MAGC1_HUMAN)
SYSYTLLSV

SEQ ID NO: 72970 - protein, 10 aa, Artificial Sequence
  Description of Artificial Sequence: Synthetic peptide
  Seed: ISRYTGYFPV (MAGC1_HUMAN)
IIRYTGYFPF

SEQ ID NO: 72971 - protein, 9 aa, Artificial Sequence
  Description of Artificial Sequence: Synthetic peptide
  Seed: AGREHFAFG (MAGC1_HUMAN)
AAREHFAFS

SEQ ID NO: 72972 - protein, 11 aa, Artificial Sequence
  Description of Artificial Sequence: Synthetic peptide
  Seed: MSPLYFPQSPL (MAGC1_HUMAN)
MTPLYFPQSPY

SEQ ID NO: 72973 - protein, 9 aa, Artificial Sequence
  Description of Artificial Sequence: Synthetic peptide
  Seed: VQSPLHSPQ (MAGC1_HUMAN)
VNSPLHSPY

SEQ ID NO: 72974 - protein, 8 aa, Artificial Sequence
  Description of Artificial Sequence: Synthetic peptide
  Seed: FEGFPQSV (MAGC1_HUMAN)
FAGFPQSI

SEQ ID NO: 72975 - protein, 9 aa, Artificial Sequence
  Description of Artificial Sequence: Synthetic peptide
  Seed: VSSFFSYTL (MAGC1_HUMAN)
VKSFFSYTL

SEQ ID NO: 72976 - protein, 10 aa, Artificial Sequence
  Description of Artificial Sequence: Synthetic peptide
  Seed: SLFQSSPERT (MAGC1_HUMAN)
SVFQSSPERV

SEQ ID NO: 72977 - protein, 9 aa, Artificial Sequence
  Description of Artificial Sequence: Synthetic peptide
  Seed: ASSFFSSAL (MAGC1_HUMAN)
AMSFFSSAL

SEQ ID NO: 72978 - protein, 9 aa, Artificial Sequence
  Description of Artificial Sequence: Synthetic peptide
  Seed: RYTGYFPVI (MAGC1_HUMAN)
RYTGYFPVF

SEQ ID NO: 72979 - protein, 10 aa, Artificial Sequence
  Description of Artificial Sequence: Synthetic peptide
  Seed: EGPAQSPLQR (MAGC1_HUMAN)
EIPAQSPLQK

SEQ ID NO: 72980 - protein, 11 aa, Artificial Sequence
  Description of Artificial Sequence: Synthetic peptide
  Seed: SSFSYTLLSLF (MAGC1_HUMAN)
SCFSYTLLSLY

SEQ ID NO: 72981 - protein, 9 aa, Artificial Sequence
  Description of Artificial Sequence: Synthetic peptide
  Seed: LQSPVISFS (MAGC1_HUMAN)
LMSPVISFC

SEQ ID NO: 72982 - protein, 9 aa, Artificial Sequence
  Description of Artificial Sequence: Synthetic peptide
  Seed: RTHSTFEGF (MAGC1_HUMAN)
RHHSTFEGF

SEQ ID NO: 72983 - protein, 10 aa, Artificial Sequence
  Description of Artificial Sequence: Synthetic peptide
  Seed: GEDSQSPLQI (MAGC1_HUMAN)
GEDSQSPLQY

SEQ ID NO: 72984 - protein, 11 aa, Artificial Sequence
  Description of Artificial Sequence: Synthetic peptide
  Seed: IPVSRSFSSTL (MAGC1_HUMAN)
IFVSRSFSSTF

SEQ ID NO: 72985 - protein, 9 aa, Artificial Sequence
  Description of Artificial Sequence: Synthetic peptide
  Seed: RTHSTFEGF (MAGC1_HUMAN)
RYHSTFEGI

SEQ ID NO: 72986 - protein, 10 aa, Artificial Sequence
  Description of Artificial Sequence: Synthetic peptide
  Seed: SFFSYTLASL (MAGC1_HUMAN)
SIFSYTLASL

SEQ ID NO: 72987 - protein, 9 aa, Artificial Sequence
  Description of Artificial Sequence: Synthetic peptide
  Seed: KVWVQEHYL (MAGC1_HUMAN)
KAWVQEHYI

SEQ ID NO: 72988 - protein, 10 aa, Artificial Sequence
  Description of Artificial Sequence: Synthetic peptide
  Seed: YASEEVIWDV (MAGC1_HUMAN)
YQSEEVIWDM

SEQ ID NO: 72989 - protein, 10 aa, Artificial Sequence
  Description of Artificial Sequence: Synthetic peptide
  Seed: YVFVNTLDLT (MAGC1_HUMAN)
YQFVNTLDLM

SEQ ID NO: 72990 - protein, 10 aa, Artificial Sequence
  Description of Artificial Sequence: Synthetic peptide
  Seed: SLSPLHFPQF (MAGC1_HUMAN)
SVSPLHFPQY

SEQ ID NO: 72991 - protein, 9 aa, Artificial Sequence
  Description of Artificial Sequence: Synthetic peptide
  Seed: IPVSPSFSS (MAGC1_HUMAN)
IMVSPSFSY

SEQ ID NO: 72992 - protein, 10 aa, Artificial Sequence
  Description of Artificial Sequence: Synthetic peptide
  Seed: RAGREHFAFG (MAGC1_HUMAN)
RAGREHFAFM

SEQ ID NO: 72993 - protein, 9 aa, Artificial Sequence
  Description of Artificial Sequence: Synthetic peptide
  Seed: DVLSGIGVR (MAGC1_HUMAN)
DALSGIGVK

SEQ ID NO: 72994 - protein, 11 aa, Artificial Sequence
  Description of Artificial Sequence: Synthetic peptide
  Seed: STFEGFPQSLL (MAGC1_HUMAN)
SLFEGFPQSLK

SEQ ID NO: 72995 - protein, 10 aa, Artificial Sequence
  Description of Artificial Sequence: Synthetic peptide
  Seed: WGPRAHSEVI (MAGC1_HUMAN)
WMPRAHSEVI

SEQ ID NO: 72996 - protein, 9 aa, Artificial Sequence
  Description of Artificial Sequence: Synthetic peptide
  Seed: AQSSLQIPV (MAGC1_HUMAN)
AMSSLQIPI

SEQ ID NO: 72997 - protein, 9 aa, Artificial Sequence
  Description of Artificial Sequence: Synthetic peptide
  Seed: SSFFSSALL (MAGC1_HUMAN)
SQFFSSALW

SEQ ID NO: 72998 - protein, 10 aa, Artificial Sequence
  Description of Artificial Sequence: Synthetic peptide
  Seed: STPSSLPQSF (MAGC1_HUMAN)
SPPSSLPQSY

SEQ ID NO: 72999 - protein, 9 aa, Artificial Sequence
  Description of Artificial Sequence: Synthetic peptide
  Seed: SSSTLLSLF (MAGC1_HUMAN)
SRSTLLSLY

SEQ ID NO: 73000 - protein, 9 aa, Artificial Sequence
  Description of Artificial Sequence: Synthetic peptide
  Seed: LSDEQGMSQ (MAGC1_HUMAN)
LFDEQGMSV

SEQ ID NO: 73001 - protein, 9 aa, Artificial Sequence
  Description of Artificial Sequence: Synthetic peptide
  Seed: VISRYTGYF (MAGC1_HUMAN)
VSSRYTGYY

SEQ ID NO: 73002 - protein, 10 aa, Artificial Sequence
  Description of Artificial Sequence: Synthetic peptide
  Seed: AASSSTLVSI (MAGC1_HUMAN)
ATSSSTLVSV

SEQ ID NO: 73003 - protein, 11 aa, Artificial Sequence
  Description of Artificial Sequence: Synthetic peptide
  Seed: LLSLFQSFSER (MAGC1_HUMAN)
LFSLFQSFSER

SEQ ID NO: 73004 - protein, 10 aa, Artificial Sequence
  Description of Artificial Sequence: Synthetic peptide
  Seed: EILFGISLRE (MAGC1_HUMAN)
ESLFGISLRK

SEQ ID NO: 73005 - protein, 9 aa, Artificial Sequence
  Description of Artificial Sequence: Synthetic peptide
  Seed: FAFGEPREL (MAGC1_HUMAN)
FPFGEPREI

SEQ ID NO: 73006 - protein, 11 aa, Artificial Sequence
  Description of Artificial Sequence: Synthetic peptide
  Seed: STFEGFAQSPL (MAGC1_HUMAN)
SLFEGFAQSPM

SEQ ID NO: 73007 - protein, 9 aa, Artificial Sequence
  Description of Artificial Sequence: Synthetic peptide
  Seed: SLPEWEDSL (MAGC1_HUMAN)
SHPEWEDSV

SEQ ID NO: 73008 - protein, 9 aa, Artificial Sequence
  Description of Artificial Sequence: Synthetic peptide
  Seed: RAHSEVIKR (MAGC1_HUMAN)
RTHSEVIKL

SEQ ID NO: 73009 - protein, 9 aa, Artificial Sequence
  Description of Artificial Sequence: Synthetic peptide
  Seed: FFSSALLSI (MAGC1_HUMAN)
FLSSALLSA

SEQ ID NO: 73010 - protein, 10 aa, Artificial Sequence
  Description of Artificial Sequence: Synthetic peptide
  Seed: SSSSSSSTLL (MAGC1_HUMAN)
SHSSSSSTLW

SEQ ID NO: 73011 - protein, 9 aa, Artificial Sequence
  Description of Artificial Sequence: Synthetic peptide
  Seed: HESPQSPPE (MAGC1_HUMAN)
HESPQSPPT

SEQ ID NO: 73012 - protein, 9 aa, Artificial Sequence
  Description of Artificial Sequence: Synthetic peptide
  Seed: YQVKQPITK (MAGC1_HUMAN)
YFVKQPITM

SEQ ID NO: 73013 - protein, 9 aa, Artificial Sequence
  Description of Artificial Sequence: Synthetic peptide
  Seed: SFSSTLVSL (MAGC1_HUMAN)
SMSSTLVSM

SEQ ID NO: 73014 - protein, 9 aa, Artificial Sequence
  Description of Artificial Sequence: Synthetic peptide
  Seed: RKAREFIEI (MAGC1_HUMAN)
RRAREFIEF

SEQ ID NO: 73015 - protein, 9 aa, Artificial Sequence
  Description of Artificial Sequence: Synthetic peptide
  Seed: IESEPLFTY (MAGC1_HUMAN)
IGSEPLFTM

SEQ ID NO: 73016 - protein, 9 aa, Artificial Sequence
  Description of Artificial Sequence: Synthetic peptide
  Seed: KRKVVEFLA (MAGC1_HUMAN)
KRKVVEFLL

SEQ ID NO: 73017 - protein, 9 aa, Artificial Sequence
  Description of Artificial Sequence: Synthetic peptide
  Seed: FSYTLASLL (MAGC1_HUMAN)
FYYTLASLM

SEQ ID NO: 73018 - protein, 10 aa, Artificial Sequence
  Description of Artificial Sequence: Synthetic peptide
  Seed: SIFQSSPESA (MAGC1_HUMAN)
SLFQSSPESM

SEQ ID NO: 73019 - protein, 10 aa, Artificial Sequence
  Description of Artificial Sequence: Synthetic peptide
  Seed: SPERTHSTFE (MAGC1_HUMAN)
SPERTHSTFV

SEQ ID NO: 73020 - protein, 9 aa, Artificial Sequence
  Description of Artificial Sequence: Synthetic peptide
  Seed: IESEPLFTY (MAGC1_HUMAN)
IRSEPLFTM

SEQ ID NO: 73021 - protein, 9 aa, Artificial Sequence
  Description of Artificial Sequence: Synthetic peptide
  Seed: AEMLTNVIS (MAGC1_HUMAN)
AEMLTNVIV

SEQ ID NO: 73022 - protein, 9 aa, Artificial Sequence
  Description of Artificial Sequence: Synthetic peptide
  Seed: MPSLLQSSS (MAGC1_HUMAN)
MPSLLQSSA

SEQ ID NO: 73023 - protein, 9 aa, Artificial Sequence
  Description of Artificial Sequence: Synthetic peptide
  Seed: FSYTLLSLF (MAGC1_HUMAN)
FEYTLLSLM

SEQ ID NO: 73024 - protein, 9 aa, Artificial Sequence
  Description of Artificial Sequence: Synthetic peptide
  Seed: SSPERTQST (MAGC1_HUMAN)
SCPERTQSL

SEQ ID NO: 73025 - protein, 9 aa, Artificial Sequence
  Description of Artificial Sequence: Synthetic peptide
  Seed: SAASSSTLV (MAGC1_HUMAN)
SSASSSTLL

SEQ ID NO: 73026 - protein, 9 aa, Artificial Sequence
  Description of Artificial Sequence: Synthetic peptide
  Seed: HYFPQSPPQ (MAGC1_HUMAN)
HFFPQSPPI

SEQ ID NO: 73027 - protein, 9 aa, Artificial Sequence
  Description of Artificial Sequence: Synthetic peptide
  Seed: YTLLSLFQS (MAGC1_HUMAN)
YTLLSLFQI

SEQ ID NO: 73028 - protein, 9 aa, Artificial Sequence
  Description of Artificial Sequence: Synthetic peptide
  Seed: GFPQSLLQI (MAGC1_HUMAN)
GWPQSLLQF

SEQ ID NO: 73029 - protein, 9 aa, Artificial Sequence
  Description of Artificial Sequence: Synthetic peptide
  Seed: FFSYTLASL (MAGC1_HUMAN)
FMSYTLASY

SEQ ID NO: 73030 - protein, 11 aa, Artificial Sequence
  Description of Artificial Sequence: Synthetic peptide
  Seed: IPVSAASSSTL (MAGC1_HUMAN)
IWVSAASSSTF

SEQ ID NO: 73031 - protein, 9 aa, Artificial Sequence
  Description of Artificial Sequence: Synthetic peptide
  Seed: TKVWVQEHY (MAGC1_HUMAN)
TRVWVQEHY

SEQ ID NO: 73032 - protein, 9 aa, Artificial Sequence
  Description of Artificial Sequence: Synthetic peptide
  Seed: GFPQSVLQI (MAGC1_HUMAN)
GAPQSVLQI

SEQ ID NO: 73033 - protein, 10 aa, Artificial Sequence
  Description of Artificial Sequence: Synthetic peptide
  Seed: ASSFFSSALL (MAGC1_HUMAN)
AQSFFSSALY

SEQ ID NO: 73034 - protein, 9 aa, Artificial Sequence
  Description of Artificial Sequence: Synthetic peptide
  Seed: SAPEGEDSL (MAGC1_HUMAN)
SPPEGEDSY

SEQ ID NO: 73035 - protein, 10 aa, Artificial Sequence
  Description of Artificial Sequence: Synthetic peptide
  Seed: VSPSSSSTLL (MAGC1_HUMAN)
VMPSSSSTLM

SEQ ID NO: 73036 - protein, 9 aa, Artificial Sequence
  Description of Artificial Sequence: Synthetic peptide
  Seed: LQIPVSPSF (MAGC1_HUMAN)
LMIPVSPSM

SEQ ID NO: 73037 - protein, 9 aa, Artificial Sequence
  Description of Artificial Sequence: Synthetic peptide
  Seed: RAHSEVIKR (MAGC1_HUMAN)
RVHSEVIKF

SEQ ID NO: 73038 - protein, 9 aa, Artificial Sequence
  Description of Artificial Sequence: Synthetic peptide
  Seed: VSPSSSSTL (MAGC1_HUMAN)
VVPSSSSTF

SEQ ID NO: 73039 - protein, 9 aa, Artificial Sequence
  Description of Artificial Sequence: Synthetic peptide
  Seed: VSAASSSTL (MAGC1_HUMAN)
VFAASSSTY

SEQ ID NO: 73040 - protein, 10 aa, Artificial Sequence
  Description of Artificial Sequence: Synthetic peptide
  Seed: KGTYASEEVI (MAGC1_HUMAN)
KETYASEEVW

SEQ ID NO: 73041 - protein, 10 aa, Artificial Sequence
  Description of Artificial Sequence: Synthetic peptide
  Seed: ESAQSAFEGF (MAGC1_HUMAN)
ETAQSAFEGF

SEQ ID NO: 73042 - protein, 9 aa, Artificial Sequence
  Description of Artificial Sequence: Synthetic peptide
  Seed: LQIPMTSSF (MAGC1_HUMAN)
LQIPMTSSI

SEQ ID NO: 73043 - protein, 9 aa, Artificial Sequence
  Description of Artificial Sequence: Synthetic peptide
  Seed: VIWDVLSGI (MAGC1_HUMAN)
VMWDVLSGC

SEQ ID NO: 73044 - protein, 11 aa, Artificial Sequence
  Description of Artificial Sequence: Synthetic peptide
  Seed: SSFPSSTSSSL (MAGC1_HUMAN)
SGFPSSTSSSM

SEQ ID NO: 73045 - protein, 10 aa, Artificial Sequence
  Description of Artificial Sequence: Synthetic peptide
  Seed: YVFVNTLDLT (MAGC1_HUMAN)
YLFVNTLDLL

SEQ ID NO: 73046 - protein, 9 aa, Artificial Sequence
  Description of Artificial Sequence: Synthetic peptide
  Seed: KAREFIEIL (MAGC1_HUMAN)
KQREFIEIY

SEQ ID NO: 73047 - protein, 10 aa, Artificial Sequence
  Description of Artificial Sequence: Synthetic peptide
  Seed: AASSSTLVSI (MAGC1_HUMAN)
AASSSTLVSF

SEQ ID NO: 73048 - protein, 10 aa, Artificial Sequence
  Description of Artificial Sequence: Synthetic peptide
  Seed: STLLSLFQSF (MAGC1_HUMAN)
STLLSLFQSY

SEQ ID NO: 73049 - protein, 10 aa, Artificial Sequence
  Description of Artificial Sequence: Synthetic peptide
  Seed: SPLQSPVSSF (MAGC1_HUMAN)
SHLQSPVSSY

SEQ ID NO: 73050 - protein, 10 aa, Artificial Sequence
  Description of Artificial Sequence: Synthetic peptide
  Seed: GEDSQSPLQI (MAGC1_HUMAN)
GEDSQSPLQA

SEQ ID NO: 73051 - protein, 8 aa, Artificial Sequence
  Description of Artificial Sequence: Synthetic peptide
  Seed: SSFFSSAL (MAGC1_HUMAN)
SEFFSSAF

SEQ ID NO: 73052 - protein, 10 aa, Artificial Sequence
  Description of Artificial Sequence: Synthetic peptide
  Seed: FQSSLQSPVS (MAGC1_HUMAN)
FQSSLQSPVL

SEQ ID NO: 73053 - protein, 10 aa, Artificial Sequence
  Description of Artificial Sequence: Synthetic peptide
  Seed: SPLQSPVSSF (MAGC1_HUMAN)
SPLQSPVSSM

SEQ ID NO: 73054 - protein, 11 aa, Artificial Sequence
  Description of Artificial Sequence: Synthetic peptide
  Seed: SPLQIPVSSSS (MAGC1_HUMAN)
SELQIPVSSSY

SEQ ID NO: 73055 - protein, 9 aa, Artificial Sequence
  Description of Artificial Sequence: Synthetic peptide
  Seed: LQIPVSSSS (MAGC1_HUMAN)
LRIPVSSSY

SEQ ID NO: 73056 - protein, 9 aa, Artificial Sequence
  Description of Artificial Sequence: Synthetic peptide
  Seed: SSSTLVSIF (MAGC1_HUMAN)
SASTLVSIM

SEQ ID NO: 73057 - protein, 10 aa, Artificial Sequence
  Description of Artificial Sequence: Synthetic peptide
  Seed: SFPSSTSSSL (MAGC1_HUMAN)
SVPSSTSSSF

SEQ ID NO: 73058 - protein, 11 aa, Artificial Sequence
  Description of Artificial Sequence: Synthetic peptide
  Seed: KDMPTAGMPSL (MAGC1_HUMAN)
KEMPTAGMPSL

SEQ ID NO: 73059 - protein, 10 aa, Artificial Sequence
  Description of Artificial Sequence: Synthetic peptide
  Seed: AASSSTLVSI (MAGC1_HUMAN)
AQSSSTLVSV

SEQ ID NO: 73060 - protein, 9 aa, Artificial Sequence
  Description of Artificial Sequence: Synthetic peptide
  Seed: VSSSSSSTL (MAGC1_HUMAN)
VASSSSSTF

SEQ ID NO: 73061 - protein, 9 aa, Artificial Sequence
  Description of Artificial Sequence: Synthetic peptide
  Seed: TSSFSSTLL (MAGC1_HUMAN)
TASFSSTLV

SEQ ID NO: 73062 - protein, 9 aa, Artificial Sequence
  Description of Artificial Sequence: Synthetic peptide
  Seed: SICSSSTSL (MAGC1_HUMAN)
SACSSSTSY

SEQ ID NO: 73063 - protein, 9 aa, Artificial Sequence
  Description of Artificial Sequence: Synthetic peptide
  Seed: LQIPVSRSF (MAGC1_HUMAN)
LHIPVSRSF

SEQ ID NO: 73064 - protein, 8 aa, Artificial Sequence
  Description of Artificial Sequence: Synthetic peptide
  Seed: LYFPQSPL (MAGC1_HUMAN)
LYFPQSPM

SEQ ID NO: 73065 - protein, 9 aa, Artificial Sequence
  Description of Artificial Sequence: Synthetic peptide
  Seed: RTQSTFEGF (MAGC1_HUMAN)
RAQSTFEGW

SEQ ID NO: 73066 - protein, 10 aa, Artificial Sequence
  Description of Artificial Sequence: Synthetic peptide
  Seed: RAGREHFAFG (MAGC1_HUMAN)
RCGREHFAFA

SEQ ID NO: 73067 - protein, 10 aa, Artificial Sequence
  Description of Artificial Sequence: Synthetic peptide
  Seed: MTSSFSSTLL (MAGC1_HUMAN)
MSSSFSSTLW

SEQ ID NO: 73068 - protein, 9 aa, Artificial Sequence
  Description of Artificial Sequence: Synthetic peptide
  Seed: RTHSTFEGF (MAGC1_HUMAN)
RQHSTFEGK

SEQ ID NO: 73069 - protein, 9 aa, Artificial Sequence
  Description of Artificial Sequence: Synthetic peptide
  Seed: AGREHFAFG (MAGC1_HUMAN)
AGREHFAFK

SEQ ID NO: 73070 - protein, 9 aa, Artificial Sequence
  Description of Artificial Sequence: Synthetic peptide
  Seed: VSAASSSTL (MAGC1_HUMAN)
VVAASSSTM

SEQ ID NO: 73071 - protein, 10 aa, Artificial Sequence
  Description of Artificial Sequence: Synthetic peptide
  Seed: SPLQSPVSSF (MAGC1_HUMAN)
SRLQSPVSSY

SEQ ID NO: 73072 - protein, 8 aa, Artificial Sequence
  Description of Artificial Sequence: Synthetic peptide
  Seed: AGREHFAF (MAGC1_HUMAN)
AAREHFAL

SEQ ID NO: 73073 - protein, 10 aa, Artificial Sequence
  Description of Artificial Sequence: Synthetic peptide
  Seed: LQIPVSPSFS (MAGC1_HUMAN)
LMIPVSPSFL

SEQ ID NO: 73074 - protein, 9 aa, Artificial Sequence
  Description of Artificial Sequence: Synthetic peptide
  Seed: TLVSIFQSS (MAGC1_HUMAN)
TVVSIFQSM

SEQ ID NO: 73075 - protein, 9 aa, Artificial Sequence
  Description of Artificial Sequence: Synthetic peptide
  Seed: YTLLSLFQS (MAGC1_HUMAN)
YTLLSLFQT

SEQ ID NO: 73076 - protein, 9 aa, Artificial Sequence
  Description of Artificial Sequence: Synthetic peptide
  Seed: YTSSSDTLL (MAGC1_HUMAN)
YVSSSDTLW

SEQ ID NO: 73077 - protein, 9 aa, Artificial Sequence
  Description of Artificial Sequence: Synthetic peptide
  Seed: DVLSGIGVR (MAGC1_HUMAN)
DFLSGIGVR

SEQ ID NO: 73078 - protein, 9 aa, Artificial Sequence
  Description of Artificial Sequence: Synthetic peptide
  Seed: RAHSEVIKR (MAGC1_HUMAN)
RAHSEVIKH

SEQ ID NO: 73079 - protein, 9 aa, Artificial Sequence
  Description of Artificial Sequence: Synthetic peptide
  Seed: SVLQIPVSA (MAGC1_HUMAN)
SALQIPVSL

SEQ ID NO: 73080 - protein, 10 aa, Artificial Sequence
  Description of Artificial Sequence: Synthetic peptide
  Seed: SLQIPVSPSF (MAGC1_HUMAN)
SMQIPVSPSM

SEQ ID NO: 73081 - protein, 10 aa, Artificial Sequence
  Description of Artificial Sequence: Synthetic peptide
  Seed: LQIPMTSSFS (MAGC1_HUMAN)
LLIPMTSSFM

SEQ ID NO: 73082 - protein, 11 aa, Artificial Sequence
  Description of Artificial Sequence: Synthetic peptide
  Seed: STFEGFPQSLL (MAGC1_HUMAN)
SIFEGFPQSLI

SEQ ID NO: 73083 - protein, 10 aa, Artificial Sequence
  Description of Artificial Sequence: Synthetic peptide
  Seed: HSPQSPPEGM (MAGC1_HUMAN)
HMPQSPPEGM

SEQ ID NO: 73084 - protein, 9 aa, Artificial Sequence
  Description of Artificial Sequence: Synthetic peptide
  Seed: VSSSSSSTL (MAGC1_HUMAN)
VQSSSSSTH

SEQ ID NO: 73085 - protein, 9 aa, Artificial Sequence
  Description of Artificial Sequence: Synthetic peptide
  Seed: VIKRKVVEF (MAGC1_HUMAN)
VVKRKVVEI

SEQ ID NO: 73086 - protein, 9 aa, Artificial Sequence
  Description of Artificial Sequence: Synthetic peptide
  Seed: YVFVNTLDL (MAGC1_HUMAN)
YFFVNTLDF

SEQ ID NO: 73087 - protein, 9 aa, Artificial Sequence
  Description of Artificial Sequence: Synthetic peptide
  Seed: SSPERTQST (MAGC1_HUMAN)
STPERTQSV

SEQ ID NO: 73088 - protein, 9 aa, Artificial Sequence
  Description of Artificial Sequence: Synthetic peptide
  Seed: SLIESEPLF (MAGC1_HUMAN)
SWIESEPLI

SEQ ID NO: 73089 - protein, 8 aa, Artificial Sequence
  Description of Artificial Sequence: Synthetic peptide
  Seed: LQIPQSPL (MAGC1_HUMAN)
LMIPQSPF

SEQ ID NO: 73090 - protein, 9 aa, Artificial Sequence
  Description of Artificial Sequence: Synthetic peptide
  Seed: RSFSSTLLS (MAGC1_HUMAN)
RSFSSTLLK

SEQ ID NO: 73091 - protein, 10 aa, Artificial Sequence
  Description of Artificial Sequence: Synthetic peptide
  Seed: MPTAGMPSLL (MAGC1_HUMAN)
MLTAGMPSLF

SEQ ID NO: 73092 - protein, 9 aa, Artificial Sequence
  Description of Artificial Sequence: Synthetic peptide
  Seed: FPQSPPQGE (MAGC1_HUMAN)
FPQSPPQGM

SEQ ID NO: 73093 - protein, 9 aa, Artificial Sequence
  Description of Artificial Sequence: Synthetic peptide
  Seed: NVISRYTGY (MAGC1_HUMAN)
NVISRYTGM

SEQ ID NO: 73094 - protein, 10 aa, Artificial Sequence
  Description of Artificial Sequence: Synthetic peptide
  Seed: REFIEILFGI (MAGC1_HUMAN)
REFIEILFGL

SEQ ID NO: 73095 - protein, 9 aa, Artificial Sequence
  Description of Artificial Sequence: Synthetic peptide
  Seed: SPLEGEDSL (MAGC1_HUMAN)
SALEGEDSL

SEQ ID NO: 73096 - protein, 9 aa, Artificial Sequence
  Description of Artificial Sequence: Synthetic peptide
  Seed: YTSSSDTLL (MAGC1_HUMAN)
YMSSSDTLY

SEQ ID NO: 73097 - protein, 9 aa, Artificial Sequence
  Description of Artificial Sequence: Synthetic peptide
  Seed: KVVEFLAML (MAGC1_HUMAN)
KNVEFLAMY

SEQ ID NO: 73098 - protein, 10 aa, Artificial Sequence
  Description of Artificial Sequence: Synthetic peptide
  Seed: MPTAGMPSLL (MAGC1_HUMAN)
MHTAGMPSLA

SEQ ID NO: 73099 - protein, 10 aa, Artificial Sequence
  Description of Artificial Sequence: Synthetic peptide
  Seed: SSPESAQSTF (MAGC1_HUMAN)
SFPESAQSTL

SEQ ID NO: 73100 - protein, 9 aa, Artificial Sequence
  Description of Artificial Sequence: Synthetic peptide
  Seed: MPTAGMPSL (MAGC1_HUMAN)
MITAGMPSM

SEQ ID NO: 73101 - protein, 9 aa, Artificial Sequence
  Description of Artificial Sequence: Synthetic peptide
  Seed: IPVSRSFSS (MAGC1_HUMAN)
IPVSRSFSY

SEQ ID NO: 73102 - protein, 9 aa, Artificial Sequence
  Description of Artificial Sequence: Synthetic peptide
  Seed: AQSPLQIPV (MAGC1_HUMAN)
ALSPLQIPT

SEQ ID NO: 73103 - protein, 10 aa, Artificial Sequence
  Description of Artificial Sequence: Synthetic peptide
  Seed: ASSFFSSALL (MAGC1_HUMAN)
AYSFFSSALW

SEQ ID NO: 73104 - protein, 9 aa, Artificial Sequence
  Description of Artificial Sequence: Synthetic peptide
  Seed: VSSFFSYTL (MAGC1_HUMAN)
VHSFFSYTM

SEQ ID NO: 73105 - protein, 8 aa, Artificial Sequence
  Description of Artificial Sequence: Synthetic peptide
  Seed: FSSALLSI (MAGC1_HUMAN)
FSSALLSM

SEQ ID NO: 73106 - protein, 9 aa, Artificial Sequence
  Description of Artificial Sequence: Synthetic peptide
  Seed: TESASSSVM (MAGC1_HUMAN)
TISASSSVY

SEQ ID NO: 73107 - protein, 11 aa, Artificial Sequence
  Description of Artificial Sequence: Synthetic peptide
  Seed: ISRYTGYFPVI (MAGC1_HUMAN)
IARYTGYFPVF

SEQ ID NO: 73108 - protein, 10 aa, Artificial Sequence
  Description of Artificial Sequence: Synthetic peptide
  Seed: ATESASSSVM (MAGC1_HUMAN)
AHESASSSVF

SEQ ID NO: 73109 - protein, 9 aa, Artificial Sequence
  Description of Artificial Sequence: Synthetic peptide
  Seed: TLASLLQSS (MAGC1_HUMAN)
TAASLLQSV

SEQ ID NO: 73110 - protein, 9 aa, Artificial Sequence
  Description of Artificial Sequence: Synthetic peptide
  Seed: SQSPPEGPV (MAGC1_HUMAN)
SSSPPEGPY

SEQ ID NO: 73111 - protein, 10 aa, Artificial Sequence
  Description of Artificial Sequence: Synthetic peptide
  Seed: STLLSLFQSF (MAGC1_HUMAN)
SELLSLFQSF

SEQ ID NO: 73112 - protein, 11 aa, Artificial Sequence
  Description of Artificial Sequence: Synthetic peptide
  Seed: RPVSSFFSYTL (MAGC1_HUMAN)
RLVSSFFSYTF

SEQ ID NO: 73113 - protein, 9 aa, Artificial Sequence
  Description of Artificial Sequence: Synthetic peptide
  Seed: RLLILILSI (MAGC1_HUMAN)
RVLILILSK

SEQ ID NO: 73114 - protein, 9 aa, Artificial Sequence
  Description of Artificial Sequence: Synthetic peptide
  Seed: FQSSLQSPV (MAGC1_HUMAN)
FLSSLQSPC

SEQ ID NO: 73115 - protein, 8 aa, Artificial Sequence
  Description of Artificial Sequence: Synthetic peptide
  Seed: SSFFSSAL (MAGC1_HUMAN)
SKFFSSAF

SEQ ID NO: 73116 - protein, 11 aa, Artificial Sequence
  Description of Artificial Sequence: Synthetic peptide
  Seed: SSTSLSLPQSF (MAGC1_HUMAN)
SWTSLSLPQSW

SEQ ID NO: 73117 - protein, 10 aa, Artificial Sequence
  Description of Artificial Sequence: Synthetic peptide
  Seed: QIPVSSSFSY (MAGC1_HUMAN)
QIPVSSSFSF

SEQ ID NO: 73118 - protein, 9 aa, Artificial Sequence
  Description of Artificial Sequence: Synthetic peptide
  Seed: MTSSFSSTL (MAGC1_HUMAN)
MPSSFSSTV

SEQ ID NO: 73119 - protein, 9 aa, Artificial Sequence
  Description of Artificial Sequence: Synthetic peptide
  Seed: VSAASSSTL (MAGC1_HUMAN)
VPAASSSTF

SEQ ID NO: 73120 - protein, 9 aa, Artificial Sequence
  Description of Artificial Sequence: Synthetic peptide
  Seed: SIFQSSPER (MAGC1_HUMAN)
SVFQSSPER

SEQ ID NO: 73121 - protein, 9 aa, Artificial Sequence
  Description of Artificial Sequence: Synthetic peptide
  Seed: SICSSSTSL (MAGC1_HUMAN)
SQCSSSTSF

SEQ ID NO: 73122 - protein, 10 aa, Artificial Sequence
  Description of Artificial Sequence: Synthetic peptide
  Seed: ESEPLFTYTL (MAGC1_HUMAN)
EVEPLFTYTV

SEQ ID NO: 73123 - protein, 9 aa, Artificial Sequence
  Description of Artificial Sequence: Synthetic peptide
  Seed: SASSSVMSP (MAGC1_HUMAN)
SGSSSVMSF

SEQ ID NO: 73124 - protein, 9 aa, Artificial Sequence
  Description of Artificial Sequence: Synthetic peptide
  Seed: EGDDTQSPL (MAGC1_HUMAN)
ESDDTQSPL

SEQ ID NO: 73125 - protein, 11 aa, Artificial Sequence
  Description of Artificial Sequence: Synthetic peptide
  Seed: SPLQIPVSSSS (MAGC1_HUMAN)
SELQIPVSSSF

SEQ ID NO: 73126 - protein, 9 aa, Artificial Sequence
  Description of Artificial Sequence: Synthetic peptide
  Seed: LKNTVPITF (MAGC1_HUMAN)
LMNTVPITY

SEQ ID NO: 73127 - protein, 9 aa, Artificial Sequence
  Description of Artificial Sequence: Synthetic peptide
  Seed: KVDELARFL (MAGC1_HUMAN)
KTDELARFW

SEQ ID NO: 73128 - protein, 9 aa, Artificial Sequence
  Description of Artificial Sequence: Synthetic peptide
  Seed: QIVPSLPEW (MAGC1_HUMAN)
QVVPSLPEF

SEQ ID NO: 73129 - protein, 10 aa, Artificial Sequence
  Description of Artificial Sequence: Synthetic peptide
  Seed: SSPESAQSTF (MAGC1_HUMAN)
SIPESAQSTI

SEQ ID NO: 73130 - protein, 11 aa, Artificial Sequence
  Description of Artificial Sequence: Synthetic peptide
  Seed: RPVSSFFSYTL (MAGC1_HUMAN)
RHVSSFFSYTY

SEQ ID NO: 73131 - protein, 11 aa, Artificial Sequence
  Description of Artificial Sequence: Synthetic peptide
  Seed: SAASSSTLVSI (MAGC1_HUMAN)
SMASSSTLVSW

SEQ ID NO: 73132 - protein, 9 aa, Artificial Sequence
  Description of Artificial Sequence: Synthetic peptide
  Seed: FFSYTLASL (MAGC1_HUMAN)
FQSYTLASL

SEQ ID NO: 73133 - protein, 10 aa, Artificial Sequence
  Description of Artificial Sequence: Synthetic peptide
  Seed: SSSSTLLSLF (MAGC1_HUMAN)
STSSTLLSLF

SEQ ID NO: 73134 - protein, 9 aa, Artificial Sequence
  Description of Artificial Sequence: Synthetic peptide
  Seed: VPNSSPPRY (MAGC1_HUMAN)
VLNSSPPRY

SEQ ID NO: 73135 - protein, 9 aa, Artificial Sequence
  Description of Artificial Sequence: Synthetic peptide
  Seed: FSSTLLSLF (MAGC1_HUMAN)
FLSTLLSLL

SEQ ID NO: 73136 - protein, 10 aa, Artificial Sequence
  Description of Artificial Sequence: Synthetic peptide
  Seed: SFPSSTSSSL (MAGC1_HUMAN)
SFPSSTSSSF

SEQ ID NO: 73137 - protein, 9 aa, Artificial Sequence
  Description of Artificial Sequence: Synthetic peptide
  Seed: VSRSFSSTL (MAGC1_HUMAN)
VARSFSSTW

SEQ ID NO: 73138 - protein, 11 aa, Artificial Sequence
  Description of Artificial Sequence: Synthetic peptide
  Seed: STFEGFPQSLL (MAGC1_HUMAN)
SLFEGFPQSLV

SEQ ID NO: 73139 - protein, 11 aa, Artificial Sequence
  Description of Artificial Sequence: Synthetic peptide
  Seed: FQSSLQSPVSI (MAGC1_HUMAN)
FLSSLQSPVSI

SEQ ID NO: 73140 - protein, 9 aa, Artificial Sequence
  Description of Artificial Sequence: Synthetic peptide
  Seed: ISFSSSTSL (MAGC1_HUMAN)
IKFSSSTSA

SEQ ID NO: 73141 - protein, 9 aa, Artificial Sequence
  Description of Artificial Sequence: Synthetic peptide
  Seed: TLLSILQSS (MAGC1_HUMAN)
TALSILQSI

SEQ ID NO: 73142 - protein, 11 aa, Artificial Sequence
  Description of Artificial Sequence: Synthetic peptide
  Seed: GYFPVIFRKAR (MAGC1_HUMAN)
GSFPVIFRKAR

SEQ ID NO: 73143 - protein, 9 aa, Artificial Sequence
  Description of Artificial Sequence: Synthetic peptide
  Seed: TPSSLPQSF (MAGC1_HUMAN)
TQSSLPQSM

SEQ ID NO: 73144 - protein, 10 aa, Artificial Sequence
  Description of Artificial Sequence: Synthetic peptide
  Seed: MSPLYFPQSP (MAGC1_HUMAN)
MQPLYFPQSV

SEQ ID NO: 73145 - protein, 9 aa, Artificial Sequence
  Description of Artificial Sequence: Synthetic peptide
  Seed: FAFGEPREL (MAGC1_HUMAN)
FMFGEPREV

SEQ ID NO: 73146 - protein, 9 aa, Artificial Sequence
  Description of Artificial Sequence: Synthetic peptide
  Seed: YTSSSDTLL (MAGC1_HUMAN)
YVSSSDTLF

SEQ ID NO: 73147 - protein, 9 aa, Artificial Sequence
  Description of Artificial Sequence: Synthetic peptide
  Seed: SSPPRYEFL (MAGC1_HUMAN)
SAPPRYEFL

SEQ ID NO: 73148 - protein, 9 aa, Artificial Sequence
  Description of Artificial Sequence: Synthetic peptide
  Seed: FQSSLQSPV (MAGC1_HUMAN)
FASSLQSPA

SEQ ID NO: 73149 - protein, 10 aa, Artificial Sequence
  Description of Artificial Sequence: Synthetic peptide
  Seed: FAQSSLQIPV (MAGC1_HUMAN)
FKQSSLQIPI

SEQ ID NO: 73150 - protein, 9 aa, Artificial Sequence
  Description of Artificial Sequence: Synthetic peptide
  Seed: VPITFPSSY (MAGC1_HUMAN)
VPITFPSSV

SEQ ID NO: 73151 - protein, 9 aa, Artificial Sequence
  Description of Artificial Sequence: Synthetic peptide
  Seed: VQSPLHSPQ (MAGC1_HUMAN)
VFSPLHSPF

SEQ ID NO: 73152 - protein, 9 aa, Artificial Sequence
  Description of Artificial Sequence: Synthetic peptide
  Seed: SSPERTHST (MAGC1_HUMAN)
SYPERTHSF

SEQ ID NO: 73153 - protein, 9 aa, Artificial Sequence
  Description of Artificial Sequence: Synthetic peptide
  Seed: FLAMLKNTV (MAGC1_HUMAN)
FQAMLKNTL

SEQ ID NO: 73154 - protein, 9 aa, Artificial Sequence
  Description of Artificial Sequence: Synthetic peptide
  Seed: GSPSFSSTL (MAGC1_HUMAN)
GIPSFSSTL

SEQ ID NO: 73155 - protein, 9 aa, Artificial Sequence
  Description of Artificial Sequence: Synthetic peptide
  Seed: SEEVIWDVL (MAGC1_HUMAN)
SEEVIWDVI

SEQ ID NO: 73156 - protein, 10 aa, Artificial Sequence
  Description of Artificial Sequence: Synthetic peptide
  Seed: PLQIPVSSSF (MAGC1_HUMAN)
PWQIPVSSSF

SEQ ID NO: 73157 - protein, 9 aa, Artificial Sequence
  Description of Artificial Sequence: Synthetic peptide
  Seed: REVDPDDSY (MAGC1_HUMAN)
RLVDPDDSF

SEQ ID NO: 73158 - protein, 11 aa, Artificial Sequence
  Description of Artificial Sequence: Synthetic peptide
  Seed: PSFSSTLLSLF (MAGC1_HUMAN)
PSFSSTLLSLW

SEQ ID NO: 73159 - protein, 9 aa, Artificial Sequence
  Description of Artificial Sequence: Synthetic peptide
  Seed: TLLSLFQSF (MAGC1_HUMAN)
TTLSLFQSY

SEQ ID NO: 73160 - protein, 9 aa, Artificial Sequence
  Description of Artificial Sequence: Synthetic peptide
  Seed: DVLSGIGVR (MAGC1_HUMAN)
DLLSGIGVR

SEQ ID NO: 73161 - protein, 9 aa, Artificial Sequence
  Description of Artificial Sequence: Synthetic peptide
  Seed: SEPLFTYTL (MAGC1_HUMAN)
SSPLFTYTL

SEQ ID NO: 73162 - protein, 9 aa, Artificial Sequence
  Description of Artificial Sequence: Synthetic peptide
  Seed: FFSSALLSI (MAGC1_HUMAN)
FYSSALLSV

SEQ ID NO: 73163 - protein, 9 aa, Artificial Sequence
  Description of Artificial Sequence: Synthetic peptide
  Seed: ISFSSSTSL (MAGC1_HUMAN)
IQFSSSTSG

SEQ ID NO: 73164 - protein, 10 aa, Artificial Sequence
  Description of Artificial Sequence: Synthetic peptide
  Seed: RPVSSFFSYT (MAGC1_HUMAN)
RSVSSFFSYK

SEQ ID NO: 73165 - protein, 11 aa, Artificial Sequence
  Description of Artificial Sequence: Synthetic peptide
  Seed: SPLQIPMTSSF (MAGC1_HUMAN)
SALQIPMTSSY

SEQ ID NO: 73166 - protein, 11 aa, Artificial Sequence
  Description of Artificial Sequence: Synthetic peptide
  Seed: LWGPRAHSEVI (MAGC1_HUMAN)
LGGPRAHSEVL

SEQ ID NO: 73167 - protein, 9 aa, Artificial Sequence
  Description of Artificial Sequence: Synthetic peptide
  Seed: TTDDSTATE (MAGC1_HUMAN)
TVDDSTATY

SEQ ID NO: 73168 - protein, 11 aa, Artificial Sequence
  Description of Artificial Sequence: Synthetic peptide
  Seed: FLAMLKNTVPI (MAGC1_HUMAN)
FDAMLKNTVPI

SEQ ID NO: 73169 - protein, 9 aa, Artificial Sequence
  Description of Artificial Sequence: Synthetic peptide
  Seed: VSAASSSTL (MAGC1_HUMAN)
VQAASSSTM

SEQ ID NO: 73170 - protein, 9 aa, Artificial Sequence
  Description of Artificial Sequence: Synthetic peptide
  Seed: KVVEFLAML (MAGC1_HUMAN)
KGVEFLAMV

SEQ ID NO: 73171 - protein, 9 aa, Artificial Sequence
  Description of Artificial Sequence: Synthetic peptide
  Seed: SPLYFPQSP (MAGC1_HUMAN)
SPLYFPQSM

SEQ ID NO: 73172 - protein, 11 aa, Artificial Sequence
  Description of Artificial Sequence: Synthetic peptide
  Seed: KGTYASEEVIW (MAGC1_HUMAN)
KSTYASEEVIW

SEQ ID NO: 73173 - protein, 10 aa, Artificial Sequence
  Description of Artificial Sequence: Synthetic peptide
  Seed: LQIPVSPSFS (MAGC1_HUMAN)
LIIPVSPSFY

SEQ ID NO: 73174 - protein, 11 aa, Artificial Sequence
  Description of Artificial Sequence: Synthetic peptide
  Seed: RPVSSFFSYTL (MAGC1_HUMAN)
RSVSSFFSYTL

SEQ ID NO: 73175 - protein, 10 aa, Artificial Sequence
  Description of Artificial Sequence: Synthetic peptide
  Seed: STLLSLFQSF (MAGC1_HUMAN)
SWLLSLFQSF

SEQ ID NO: 73176 - protein, 10 aa, Artificial Sequence
  Description of Artificial Sequence: Synthetic peptide
  Seed: ASSFFSSALL (MAGC1_HUMAN)
AVSFFSSALF

SEQ ID NO: 73177 - protein, 9 aa, Artificial Sequence
  Description of Artificial Sequence: Synthetic peptide
  Seed: AQSPLQSPV (MAGC1_HUMAN)
AISPLQSPA

SEQ ID NO: 73178 - protein, 10 aa, Artificial Sequence
  Description of Artificial Sequence: Synthetic peptide
  Seed: LAMLKNTVPI (MAGC1_HUMAN)
LHMLKNTVPY

SEQ ID NO: 73179 - protein, 9 aa, Artificial Sequence
  Description of Artificial Sequence: Synthetic peptide
  Seed: SSPESTQSP (MAGC1_HUMAN)
SYPESTQSL

SEQ ID NO: 73180 - protein, 9 aa, Artificial Sequence
  Description of Artificial Sequence: Synthetic peptide
  Seed: LQRPVSSFF (MAGC1_HUMAN)
LARPVSSFA

SEQ ID NO: 73181 - protein, 8 aa, Artificial Sequence
  Description of Artificial Sequence: Synthetic peptide
  Seed: QIPVSSSF (MAGC1_HUMAN)
QFPVSSSF

SEQ ID NO: 73182 - protein, 9 aa, Artificial Sequence
  Description of Artificial Sequence: Synthetic peptide
  Seed: GPAQSPLQR (MAGC1_HUMAN)
GYAQSPLQL

SEQ ID NO: 73183 - protein, 9 aa, Artificial Sequence
  Description of Artificial Sequence: Synthetic peptide
  Seed: SFSSTLVSL (MAGC1_HUMAN)
SISSTLVSV

SEQ ID NO: 73184 - protein, 9 aa, Artificial Sequence
  Description of Artificial Sequence: Synthetic peptide
  Seed: SFSYTLLSL (MAGC1_HUMAN)
STSYTLLSM

SEQ ID NO: 73185 - protein, 11 aa, Artificial Sequence
  Description of Artificial Sequence: Synthetic peptide
  Seed: SSSSSTLLSLF (MAGC1_HUMAN)
SPSSSTLLSLW

SEQ ID NO: 73186 - protein, 10 aa, Artificial Sequence
  Description of Artificial Sequence: Synthetic peptide
  Seed: SLIESEPLFT (MAGC1_HUMAN)
SMIESEPLFM

SEQ ID NO: 73187 - protein, 11 aa, Artificial Sequence
  Description of Artificial Sequence: Synthetic peptide
  Seed: SSFPSSTSSSL (MAGC1_HUMAN)
SQFPSSTSSSI

SEQ ID NO: 73188 - protein, 9 aa, Artificial Sequence
  Description of Artificial Sequence: Synthetic peptide
  Seed: HFPQSPPEW (MAGC1_HUMAN)
HSPQSPPEL

SEQ ID NO: 73189 - protein, 10 aa, Artificial Sequence
  Description of Artificial Sequence: Synthetic peptide
  Seed: LQIVPSLPEW (MAGC1_HUMAN)
LGIVPSLPEW

SEQ ID NO: 73190 - protein, 9 aa, Artificial Sequence
  Description of Artificial Sequence: Synthetic peptide
  Seed: CSSSTSLSL (MAGC1_HUMAN)
CLSSTSLSW

SEQ ID NO: 73191 - protein, 9 aa, Artificial Sequence
  Description of Artificial Sequence: Synthetic peptide
  Seed: RLLILILSI (MAGC1_HUMAN)
RFLILILSY

SEQ ID NO: 73192 - protein, 9 aa, Artificial Sequence
  Description of Artificial Sequence: Synthetic peptide
  Seed: SSSTLLSLF (MAGC1_HUMAN)
STSTLLSLW

SEQ ID NO: 73193 - protein, 9 aa, Artificial Sequence
  Description of Artificial Sequence: Synthetic peptide
  Seed: KDSLSPLEI (MAGC1_HUMAN)
KESLSPLEM

SEQ ID NO: 73194 - protein, 9 aa, Artificial Sequence
  Description of Artificial Sequence: Synthetic peptide
  Seed: SQSSPVSSF (MAGC1_HUMAN)
SQSSPVSSV

SEQ ID NO: 73195 - protein, 9 aa, Artificial Sequence
  Description of Artificial Sequence: Synthetic peptide
  Seed: TESASSSVM (MAGC1_HUMAN)
TESASSSVV

SEQ ID NO: 73196 - protein, 9 aa, Artificial Sequence
  Description of Artificial Sequence: Synthetic peptide
  Seed: VIFRKAREF (MAGC1_HUMAN)
VKFRKAREM

SEQ ID NO: 73197 - protein, 9 aa, Artificial Sequence
  Description of Artificial Sequence: Synthetic peptide
  Seed: QSPPEGEDV (MAGC1_HUMAN)
QIPPEGEDM

SEQ ID NO: 73198 - protein, 9 aa, Artificial Sequence
  Description of Artificial Sequence: Synthetic peptide
  Seed: VISRYTGYF (MAGC1_HUMAN)
VWSRYTGYY

SEQ ID NO: 73199 - protein, 9 aa, Artificial Sequence
  Description of Artificial Sequence: Synthetic peptide
  Seed: FSSTLLSIL (MAGC1_HUMAN)
FISTLLSIM

SEQ ID NO: 73200 - protein, 9 aa, Artificial Sequence
  Description of Artificial Sequence: Synthetic peptide
  Seed: MLTNVISRY (MAGC1_HUMAN)
MPTNVISRM

SEQ ID NO: 73201 - protein, 10 aa, Artificial Sequence
  Description of Artificial Sequence: Synthetic peptide
  Seed: SRYTGYFPVI (MAGC1_HUMAN)
SGYTGYFPVM

SEQ ID NO: 73202 - protein, 9 aa, Artificial Sequence
  Description of Artificial Sequence: Synthetic peptide
  Seed: SPVSSFPSS (MAGC1_HUMAN)
SPVSSFPSL

SEQ ID NO: 73203 - protein, 9 aa, Artificial Sequence
  Description of Artificial Sequence: Synthetic peptide
  Seed: KVDELARFL (MAGC1_HUMAN)
KWDELARFV

SEQ ID NO: 73204 - protein, 9 aa, Artificial Sequence
  Description of Artificial Sequence: Synthetic peptide
  Seed: LSPLHFPQF (MAGC1_HUMAN)
LYPLHFPQY

SEQ ID NO: 73205 - protein, 10 aa, Artificial Sequence
  Description of Artificial Sequence: Synthetic peptide
  Seed: SFSYTLLSLF (MAGC1_HUMAN)
SYSYTLLSLI

SEQ ID NO: 73206 - protein, 10 aa, Artificial Sequence
  Description of Artificial Sequence: Synthetic peptide
  Seed: ISRYTGYFPV (MAGC1_HUMAN)
IVRYTGYFPM

SEQ ID NO: 73207 - protein, 11 aa, Artificial Sequence
  Description of Artificial Sequence: Synthetic peptide
  Seed: QSSPESAQSTF (MAGC1_HUMAN)
QQSPESAQSTL

SEQ ID NO: 73208 - protein, 9 aa, Artificial Sequence
  Description of Artificial Sequence: Synthetic peptide
  Seed: SQSPPEGPV (MAGC1_HUMAN)
SHSPPEGPA

SEQ ID NO: 73209 - protein, 9 aa, Artificial Sequence
  Description of Artificial Sequence: Synthetic peptide
  Seed: LQRPVSSFF (MAGC1_HUMAN)
LLRPVSSFM

SEQ ID NO: 73210 - protein, 10 aa, Artificial Sequence
  Description of Artificial Sequence: Synthetic peptide
  Seed: VSRSFSSTLL (MAGC1_HUMAN)
VQRSFSSTLK

SEQ ID NO: 73211 - protein, 9 aa, Artificial Sequence
  Description of Artificial Sequence: Synthetic peptide
  Seed: LQIPMTSSF (MAGC1_HUMAN)
LEIPMTSSW

SEQ ID NO: 73212 - protein, 9 aa, Artificial Sequence
  Description of Artificial Sequence: Synthetic peptide
  Seed: ASSFFSSAL (MAGC1_HUMAN)
AKSFFSSAW

SEQ ID NO: 73213 - protein, 9 aa, Artificial Sequence
  Description of Artificial Sequence: Synthetic peptide
  Seed: ESDDTLYPL (MAGC1_HUMAN)
ETDDTLYPI

SEQ ID NO: 73214 - protein, 11 aa, Artificial Sequence
  Description of Artificial Sequence: Synthetic peptide
  Seed: IPVSSSFSYTL (MAGC1_HUMAN)
IYVSSSFSYTY

SEQ ID NO: 73215 - protein, 9 aa, Artificial Sequence
  Description of Artificial Sequence: Synthetic peptide
  Seed: SSSTLVSIF (MAGC1_HUMAN)
SVSTLVSIF

SEQ ID NO: 73216 - protein, 9 aa, Artificial Sequence
  Description of Artificial Sequence: Synthetic peptide
  Seed: RAGREHFAF (MAGC1_HUMAN)
RFGREHFAI

SEQ ID NO: 73217 - protein, 9 aa, Artificial Sequence
  Description of Artificial Sequence: Synthetic peptide
  Seed: GEDSMSPLY (MAGC1_HUMAN)
GIDSMSPLY

SEQ ID NO: 73218 - protein, 9 aa, Artificial Sequence
  Description of Artificial Sequence: Synthetic peptide
  Seed: SQSSPVSSF (MAGC1_HUMAN)
SGSSPVSSL

SEQ ID NO: 73219 - protein, 10 aa, Artificial Sequence
  Description of Artificial Sequence: Synthetic peptide
  Seed: PLQIPGSPSF (MAGC1_HUMAN)
PIQIPGSPSF

SEQ ID NO: 73220 - protein, 9 aa, Artificial Sequence
  Description of Artificial Sequence: Synthetic peptide
  Seed: ELARFLLLK (MAGC1_HUMAN)
EMARFLLLR

SEQ ID NO: 73221 - protein, 9 aa, Artificial Sequence
  Description of Artificial Sequence: Synthetic peptide
  Seed: TPSSLPQSF (MAGC1_HUMAN)
TASSLPQSL

SEQ ID NO: 73222 - protein, 9 aa, Artificial Sequence
  Description of Artificial Sequence: Synthetic peptide
  Seed: SSFFSSALL (MAGC1_HUMAN)
SAFFSSALW

SEQ ID NO: 73223 - protein, 9 aa, Artificial Sequence
  Description of Artificial Sequence: Synthetic peptide
  Seed: SAQSAFEGF (MAGC1_HUMAN)
SVQSAFEGY

SEQ ID NO: 73224 - protein, 9 aa, Artificial Sequence
  Description of Artificial Sequence: Synthetic peptide
  Seed: EFIEILFGI (MAGC1_HUMAN)
EAIEILFGL

SEQ ID NO: 73225 - protein, 10 aa, Artificial Sequence
  Description of Artificial Sequence: Synthetic peptide
  Seed: FSSSTSLSPF (MAGC1_HUMAN)
FYSSTSLSPM

SEQ ID NO: 73226 - protein, 10 aa, Artificial Sequence
  Description of Artificial Sequence: Synthetic peptide
  Seed: VSRSFSSTLL (MAGC1_HUMAN)
VTRSFSSTLF

SEQ ID NO: 73227 - protein, 9 aa, Artificial Sequence
  Description of Artificial Sequence: Synthetic peptide
  Seed: VISRYTGYF (MAGC1_HUMAN)
VLSRYTGYY

SEQ ID NO: 73228 - protein, 9 aa, Artificial Sequence
  Description of Artificial Sequence: Synthetic peptide
  Seed: AMLKNTVPI (MAGC1_HUMAN)
AMLKNTVPR

SEQ ID NO: 73229 - protein, 10 aa, Artificial Sequence
  Description of Artificial Sequence: Synthetic peptide
  Seed: FPQSPLQIPV (MAGC1_HUMAN)
FWQSPLQIPV

SEQ ID NO: 73230 - protein, 9 aa, Artificial Sequence
  Description of Artificial Sequence: Synthetic peptide
  Seed: ISFSSSTSL (MAGC1_HUMAN)
ICFSSSTSW

SEQ ID NO: 73231 - protein, 11 aa, Artificial Sequence
  Description of Artificial Sequence: Synthetic peptide
  Seed: SAASSSTLVSI (MAGC1_HUMAN)
SAASSSTLVSW

SEQ ID NO: 73232 - protein, 9 aa, Artificial Sequence
  Description of Artificial Sequence: Synthetic peptide
  Seed: RLLILILSI (MAGC1_HUMAN)
RVLILILSV

SEQ ID NO: 73233 - protein, 11 aa, Artificial Sequence
  Description of Artificial Sequence: Synthetic peptide
  Seed: RKAREFIEILF (MAGC1_HUMAN)
RQAREFIEILF

SEQ ID NO: 73234 - protein, 9 aa, Artificial Sequence
  Description of Artificial Sequence: Synthetic peptide
  Seed: CSSSTPSSL (MAGC1_HUMAN)
CVSSTPSSF

SEQ ID NO: 73235 - protein, 9 aa, Artificial Sequence
  Description of Artificial Sequence: Synthetic peptide
  Seed: SSPEGKDSL (MAGC1_HUMAN)
SWPEGKDSF

SEQ ID NO: 73236 - protein, 9 aa, Artificial Sequence
  Description of Artificial Sequence: Synthetic peptide
  Seed: RKVVEFLAM (MAGC1_HUMAN)
RMVVEFLAH

SEQ ID NO: 73237 - protein, 11 aa, Artificial Sequence
  Description of Artificial Sequence: Synthetic peptide
  Seed: SSSSSTLLSLF (MAGC1_HUMAN)
SHSSSTLLSLW

SEQ ID NO: 73238 - protein, 9 aa, Artificial Sequence
  Description of Artificial Sequence: Synthetic peptide
  Seed: FTYTLDEKV (MAGC1_HUMAN)
FLYTLDEKI

SEQ ID NO: 73239 - protein, 9 aa, Artificial Sequence
  Description of Artificial Sequence: Synthetic peptide
  Seed: LQIPMTSSF (MAGC1_HUMAN)
LKIPMTSSV

SEQ ID NO: 73240 - protein, 9 aa, Artificial Sequence
  Description of Artificial Sequence: Synthetic peptide
  Seed: VPITFPSSY (MAGC1_HUMAN)
VNITFPSSF

SEQ ID NO: 73241 - protein, 9 aa, Artificial Sequence
  Description of Artificial Sequence: Synthetic peptide
  Seed: SSFPSSTSS (MAGC1_HUMAN)
STFPSSTSH

SEQ ID NO: 73242 - protein, 9 aa, Artificial Sequence
  Description of Artificial Sequence: Synthetic peptide
  Seed: GFPQSLLQI (MAGC1_HUMAN)
GYPQSLLQM

SEQ ID NO: 73243 - protein, 9 aa, Artificial Sequence
  Description of Artificial Sequence: Synthetic peptide
  Seed: VSSSFSYTL (MAGC1_HUMAN)
VISSFSYTV

SEQ ID NO: 73244 - protein, 10 aa, Artificial Sequence
  Description of Artificial Sequence: Synthetic peptide
  Seed: VSSSSSSSTL (MAGC1_HUMAN)
VRSSSSSSTW

SEQ ID NO: 73245 - protein, 9 aa, Artificial Sequence
  Description of Artificial Sequence: Synthetic peptide
  Seed: SSPERTQST (MAGC1_HUMAN)
SLPERTQSM

SEQ ID NO: 73246 - protein, 11 aa, Artificial Sequence
  Description of Artificial Sequence: Synthetic peptide
  Seed: SPLQIPGSPSF (MAGC1_HUMAN)
SGLQIPGSPSF

SEQ ID NO: 73247 - protein, 9 aa, Artificial Sequence
  Description of Artificial Sequence: Synthetic peptide
  Seed: LQIPGSPSF (MAGC1_HUMAN)
LYIPGSPSV

SEQ ID NO: 73248 - protein, 10 aa, Artificial Sequence
  Description of Artificial Sequence: Synthetic peptide
  Seed: LLQIPMTSSF (MAGC1_HUMAN)
LRQIPMTSSF

SEQ ID NO: 73249 - protein, 9 aa, Artificial Sequence
  Description of Artificial Sequence: Synthetic peptide
  Seed: LKNTVPITF (MAGC1_HUMAN)
LMNTVPITM

SEQ ID NO: 73250 - protein, 9 aa, Artificial Sequence
  Description of Artificial Sequence: Synthetic peptide
  Seed: FLAMLKNTV (MAGC1_HUMAN)
FLAMLKNTL

SEQ ID NO: 73251 - protein, 10 aa, Artificial Sequence
  Description of Artificial Sequence: Synthetic peptide
  Seed: LQIPVSPSFS (MAGC1_HUMAN)
LQIPVSPSFC

SEQ ID NO: 73252 - protein, 10 aa, Artificial Sequence
  Description of Artificial Sequence: Synthetic peptide
  Seed: RSFSSTLLSI (MAGC1_HUMAN)
RVFSSTLLSW

SEQ ID NO: 73253 - protein, 9 aa, Artificial Sequence
  Description of Artificial Sequence: Synthetic peptide
  Seed: ISFSSSTSL (MAGC1_HUMAN)
IPFSSSTSA

SEQ ID NO: 73254 - protein, 9 aa, Artificial Sequence
  Description of Artificial Sequence: Synthetic peptide
  Seed: VSRSFSSTL (MAGC1_HUMAN)
VARSFSSTH

SEQ ID NO: 73255 - protein, 9 aa, Artificial Sequence
  Description of Artificial Sequence: Synthetic peptide
  Seed: FSSTLLSLF (MAGC1_HUMAN)
FQSTLLSLI

SEQ ID NO: 73256 - protein, 10 aa, Artificial Sequence
  Description of Artificial Sequence: Synthetic peptide
  Seed: KGTYASEEVI (MAGC1_HUMAN)
KWTYASEEVY

SEQ ID NO: 73257 - protein, 9 aa, Artificial Sequence
  Description of Artificial Sequence: Synthetic peptide
  Seed: EILFGISLR (MAGC1_HUMAN)
ETLFGISLK

SEQ ID NO: 73258 - protein, 9 aa, Artificial Sequence
  Description of Artificial Sequence: Synthetic peptide
  Seed: IPGSPSFSS (MAGC1_HUMAN)
IPGSPSFSA

SEQ ID NO: 73259 - protein, 9 aa, Artificial Sequence
  Description of Artificial Sequence: Synthetic peptide
  Seed: LQIVPSLPE (MAGC1_HUMAN)
LSIVPSLPF

SEQ ID NO: 73260 - protein, 9 aa, Artificial Sequence
  Description of Artificial Sequence: Synthetic peptide
  Seed: LQNPASSFF (MAGC1_HUMAN)
LPNPASSFM

SEQ ID NO: 73261 - protein, 11 aa, Artificial Sequence
  Description of Artificial Sequence: Synthetic peptide
  Seed: QSSPESAQSAF (MAGC1_HUMAN)
QVSPESAQSAW

SEQ ID NO: 73262 - protein, 10 aa, Artificial Sequence
  Description of Artificial Sequence: Synthetic peptide
  Seed: ATESASSSVM (MAGC1_HUMAN)
AMESASSSVY

SEQ ID NO: 73263 - protein, 11 aa, Artificial Sequence
  Description of Artificial Sequence: Synthetic peptide
  Seed: EEVIWDVLSGI (MAGC1_HUMAN)
ETVIWDVLSGI

SEQ ID NO: 73264 - protein, 11 aa, Artificial Sequence
  Description of Artificial Sequence: Synthetic peptide
  Seed: TTDDSTATESA (MAGC1_HUMAN)
TMDDSTATESF

SEQ ID NO: 73265 - protein, 10 aa, Artificial Sequence
  Description of Artificial Sequence: Synthetic peptide
  Seed: RKVVEFLAML (MAGC1_HUMAN)
RAVVEFLAMY

SEQ ID NO: 73266 - protein, 9 aa, Artificial Sequence
  Description of Artificial Sequence: Synthetic peptide
  Seed: MGDKDMPTA (MAGC1_HUMAN)
MCDKDMPTL

SEQ ID NO: 73267 - protein, 11 aa, Artificial Sequence
  Description of Artificial Sequence: Synthetic peptide
  Seed: SFFSYTLASLL (MAGC1_HUMAN)
SYFSYTLASLM

SEQ ID NO: 73268 - protein, 9 aa, Artificial Sequence
  Description of Artificial Sequence: Synthetic peptide
  Seed: FQSSLQSPV (MAGC1_HUMAN)
FQSSLQSPH

SEQ ID NO: 73269 - protein, 10 aa, Artificial Sequence
  Description of Artificial Sequence: Synthetic peptide
  Seed: YTLASLLQSS (MAGC1_HUMAN)
YWLASLLQSV

SEQ ID NO: 73270 - protein, 10 aa, Artificial Sequence
  Description of Artificial Sequence: Synthetic peptide
  Seed: SSPESAQSTF (MAGC1_HUMAN)
STPESAQSTY

SEQ ID NO: 73271 - protein, 9 aa, Artificial Sequence
  Description of Artificial Sequence: Synthetic peptide
  Seed: VIWDVLSGI (MAGC1_HUMAN)
VLWDVLSGC

SEQ ID NO: 73272 - protein, 10 aa, Artificial Sequence
  Description of Artificial Sequence: Synthetic peptide
  Seed: RAGREHFAFG (MAGC1_HUMAN)
RMGREHFAFL

SEQ ID NO: 73273 - protein, 9 aa, Artificial Sequence
  Description of Artificial Sequence: Synthetic peptide
  Seed: SSPESAQSA (MAGC1_HUMAN)
SMPESAQSV

SEQ ID NO: 73274 - protein, 10 aa, Artificial Sequence
  Description of Artificial Sequence: Synthetic peptide
  Seed: STFEGFPQSL (MAGC1_HUMAN)
SPFEGFPQST

SEQ ID NO: 73275 - protein, 9 aa, Artificial Sequence
  Description of Artificial Sequence: Synthetic peptide
  Seed: AQSPLQSPV (MAGC1_HUMAN)
AMSPLQSPA

SEQ ID NO: 73276 - protein, 11 aa, Artificial Sequence
  Description of Artificial Sequence: Synthetic peptide
  Seed: RSFSSTLLSIF (MAGC1_HUMAN)
RSFSSTLLSIW

SEQ ID NO: 73277 - protein, 10 aa, Artificial Sequence
  Description of Artificial Sequence: Synthetic peptide
  Seed: PLQIPGSPSF (MAGC1_HUMAN)
PSQIPGSPSY

SEQ ID NO: 73278 - protein, 9 aa, Artificial Sequence
  Description of Artificial Sequence: Synthetic peptide
  Seed: NTVPITFPS (MAGC1_HUMAN)
NTVPITFPH

SEQ ID NO: 73279 - protein, 9 aa, Artificial Sequence
  Description of Artificial Sequence: Synthetic peptide
  Seed: SAASSSTLV (MAGC1_HUMAN)
SAASSSTLM

SEQ ID NO: 73280 - protein, 9 aa, Artificial Sequence
  Description of Artificial Sequence: Synthetic peptide
  Seed: ISFSSSTSL (MAGC1_HUMAN)
IYFSSSTSM

SEQ ID NO: 73281 - protein, 10 aa, Artificial Sequence
  Description of Artificial Sequence: Synthetic peptide
  Seed: KAEMLTNVIS (MAGC1_HUMAN)
KMEMLTNVIA

SEQ ID NO: 73282 - protein, 9 aa, Artificial Sequence
  Description of Artificial Sequence: Synthetic peptide
  Seed: TSLSLPQSF (MAGC1_HUMAN)
TPLSLPQSM

SEQ ID NO: 73283 - protein, 10 aa, Artificial Sequence
  Description of Artificial Sequence: Synthetic peptide
  Seed: SSPESAQSAF (MAGC1_HUMAN)
SCPESAQSAM

SEQ ID NO: 73284 - protein, 10 aa, Artificial Sequence
  Description of Artificial Sequence: Synthetic peptide
  Seed: AASSSTLVSI (MAGC1_HUMAN)
ASSSSTLVSL

SEQ ID NO: 73285 - protein, 11 aa, Artificial Sequence
  Description of Artificial Sequence: Synthetic peptide
  Seed: SSFSSTLLSIL (MAGC1_HUMAN)
SQFSSTLLSIY

SEQ ID NO: 73286 - protein, 10 aa, Artificial Sequence
  Description of Artificial Sequence: Synthetic peptide
  Seed: PLQRPVSSFF (MAGC1_HUMAN)
PMQRPVSSFF

SEQ ID NO: 73287 - protein, 9 aa, Artificial Sequence
  Description of Artificial Sequence: Synthetic peptide
  Seed: GMSQNRLLI (MAGC1_HUMAN)
GMSQNRLLV

SEQ ID NO: 73288 - protein, 9 aa, Artificial Sequence
  Description of Artificial Sequence: Synthetic peptide
  Seed: FPQSVLQIP (MAGC1_HUMAN)
FPQSVLQIS

SEQ ID NO: 73289 - protein, 10 aa, Artificial Sequence
  Description of Artificial Sequence: Synthetic peptide
  Seed: LTKVWVQEHY (MAGC1_HUMAN)
LQKVWVQEHY

SEQ ID NO: 73290 - protein, 10 aa, Artificial Sequence
  Description of Artificial Sequence: Synthetic peptide
  Seed: REFIEILFGI (MAGC1_HUMAN)
RIFIEILFGL

SEQ ID NO: 73291 - protein, 11 aa, Artificial Sequence
  Description of Artificial Sequence: Synthetic peptide
  Seed: SSFSSTLLSIF (MAGC1_HUMAN)
SVFSSTLLSIW

SEQ ID NO: 73292 - protein, 9 aa, Artificial Sequence
  Description of Artificial Sequence: Synthetic peptide
  Seed: LQIPVSRSF (MAGC1_HUMAN)
LVIPVSRSF

SEQ ID NO: 73293 - protein, 9 aa, Artificial Sequence
  Description of Artificial Sequence: Synthetic peptide
  Seed: SIFQSSPER (MAGC1_HUMAN)
SVFQSSPEV

SEQ ID NO: 73294 - protein, 10 aa, Artificial Sequence
  Description of Artificial Sequence: Synthetic peptide
  Seed: SFSSTLVSLF (MAGC1_HUMAN)
SRSSTLVSLF

SEQ ID NO: 73295 - protein, 9 aa, Artificial Sequence
  Description of Artificial Sequence: Synthetic peptide
  Seed: HESPQSPPE (MAGC1_HUMAN)
HESPQSPPS

SEQ ID NO: 73296 - protein, 9 aa, Artificial Sequence
  Description of Artificial Sequence: Synthetic peptide
  Seed: MPTAGMPSL (MAGC1_HUMAN)
MQTAGMPSY

SEQ ID NO: 73297 - protein, 8 aa, Artificial Sequence
  Description of Artificial Sequence: Synthetic peptide
  Seed: SSPPRYEF (MAGC1_HUMAN)
STPPRYEM

SEQ ID NO: 73298 - protein, 9 aa, Artificial Sequence
  Description of Artificial Sequence: Synthetic peptide
  Seed: TLVSLFQSS (MAGC1_HUMAN)
TVVSLFQSV

SEQ ID NO: 73299 - protein, 10 aa, Artificial Sequence
  Description of Artificial Sequence: Synthetic peptide
  Seed: RSFSSTLLSI (MAGC1_HUMAN)
RWFSSTLLSF

SEQ ID NO: 73300 - protein, 9 aa, Artificial Sequence
  Description of Artificial Sequence: Synthetic peptide
  Seed: KDSQSPLQI (MAGC1_HUMAN)
KMSQSPLQW

SEQ ID NO: 73301 - protein, 10 aa, Artificial Sequence
  Description of Artificial Sequence: Synthetic peptide
  Seed: ITKAEMLTNV (MAGC1_HUMAN)
IMKAEMLTNM

SEQ ID NO: 73302 - protein, 10 aa, Artificial Sequence
  Description of Artificial Sequence: Synthetic peptide
  Seed: YTLASLLQSS (MAGC1_HUMAN)
YQLASLLQSA

SEQ ID NO: 73303 - protein, 10 aa, Artificial Sequence
  Description of Artificial Sequence: Synthetic peptide
  Seed: SPLQSPVISF (MAGC1_HUMAN)
SPLQSPVISL

SEQ ID NO: 73304 - protein, 9 aa, Artificial Sequence
  Description of Artificial Sequence: Synthetic peptide
  Seed: YTSSSDTLL (MAGC1_HUMAN)
YASSSDTLW

SEQ ID NO: 73305 - protein, 10 aa, Artificial Sequence
  Description of Artificial Sequence: Synthetic peptide
  Seed: FSSSTSLSPF (MAGC1_HUMAN)
FVSSTSLSPF

SEQ ID NO: 73306 - protein, 9 aa, Artificial Sequence
  Description of Artificial Sequence: Synthetic peptide
  Seed: GYFPVIFRK (MAGC1_HUMAN)
GLFPVIFRK

SEQ ID NO: 73307 - protein, 10 aa, Artificial Sequence
  Description of Artificial Sequence: Synthetic peptide
  Seed: VSSSSSSSTL (MAGC1_HUMAN)
VDSSSSSSTW

SEQ ID NO: 73308 - protein, 9 aa, Artificial Sequence
  Description of Artificial Sequence: Synthetic peptide
  Seed: LQIPVSSSS (MAGC1_HUMAN)
LHIPVSSSI

SEQ ID NO: 73309 - protein, 9 aa, Artificial Sequence
  Description of Artificial Sequence: Synthetic peptide
  Seed: ASSFFSSAL (MAGC1_HUMAN)
AISFFSSAY

SEQ ID NO: 73310 - protein, 9 aa, Artificial Sequence
  Description of Artificial Sequence: Synthetic peptide
  Seed: SFSYTLLSL (MAGC1_HUMAN)
SYSYTLLSM

SEQ ID NO: 73311 - protein, 10 aa, Artificial Sequence
  Description of Artificial Sequence: Synthetic peptide
  Seed: SSSSSSSTLL (MAGC1_HUMAN)
SCSSSSSTLF

SEQ ID NO: 73312 - protein, 9 aa, Artificial Sequence
  Description of Artificial Sequence: Synthetic peptide
  Seed: NTHSPLQIV (MAGC1_HUMAN)
NQHSPLQII

SEQ ID NO: 73313 - protein, 9 aa, Artificial Sequence
  Description of Artificial Sequence: Synthetic peptide
  Seed: LKNTVPITF (MAGC1_HUMAN)
LRNTVPITY

SEQ ID NO: 73314 - protein, 10 aa, Artificial Sequence
  Description of Artificial Sequence: Synthetic peptide
  Seed: KVVEFLAMLK (MAGC1_HUMAN)
KLVEFLAMLL

SEQ ID NO: 73315 - protein, 10 aa, Artificial Sequence
  Description of Artificial Sequence: Synthetic peptide
  Seed: RAGREHFAFG (MAGC1_HUMAN)
RTGREHFAFY

SEQ ID NO: 73316 - protein, 9 aa, Artificial Sequence
  Description of Artificial Sequence: Synthetic peptide
  Seed: LQNPASSFF (MAGC1_HUMAN)
LRNPASSFL

SEQ ID NO: 73317 - protein, 9 aa, Artificial Sequence
  Description of Artificial Sequence: Synthetic peptide
  Seed: SSLSQSSPV (MAGC1_HUMAN)
SALSQSSPV

SEQ ID NO: 73318 - protein, 9 aa, Artificial Sequence
  Description of Artificial Sequence: Synthetic peptide
  Seed: YQVKQPITK (MAGC1_HUMAN)
YGVKQPITY

SEQ ID NO: 73319 - protein, 9 aa, Artificial Sequence
  Description of Artificial Sequence: Synthetic peptide
  Seed: FQSSLQSPV (MAGC1_HUMAN)
FHSSLQSPI

SEQ ID NO: 73320 - protein, 10 aa, Artificial Sequence
  Description of Artificial Sequence: Synthetic peptide
  Seed: VSLFQSSPER (MAGC1_HUMAN)
VTLFQSSPEK

SEQ ID NO: 73321 - protein, 9 aa, Artificial Sequence
  Description of Artificial Sequence: Synthetic peptide
  Seed: SQSSPVSSF (MAGC1_HUMAN)
SLSSPVSSW

SEQ ID NO: 73322 - protein, 10 aa, Artificial Sequence
  Description of Artificial Sequence: Synthetic peptide
  Seed: FAFGEPRELL (MAGC1_HUMAN)
FAFGEPRELV

SEQ ID NO: 73323 - protein, 11 aa, Artificial Sequence
  Description of Artificial Sequence: Synthetic peptide
  Seed: SSFSSTLLSIF (MAGC1_HUMAN)
STFSSTLLSIF

SEQ ID NO: 73324 - protein, 9 aa, Artificial Sequence
  Description of Artificial Sequence: Synthetic peptide
  Seed: VSSFFSYTL (MAGC1_HUMAN)
VTSFFSYTF

SEQ ID NO: 73325 - protein, 9 aa, Artificial Sequence
  Description of Artificial Sequence: Synthetic peptide
  Seed: VSAASSSTL (MAGC1_HUMAN)
VKAASSSTV

SEQ ID NO: 73326 - protein, 9 aa, Artificial Sequence
  Description of Artificial Sequence: Synthetic peptide
  Seed: TGYFPVIFR (MAGC1_HUMAN)
TSYFPVIFK

SEQ ID NO: 73327 - protein, 8 aa, Artificial Sequence
  Description of Artificial Sequence: Synthetic peptide
  Seed: REFIEILF (MAGC1_HUMAN)
REFIEILA

SEQ ID NO: 73328 - protein, 9 aa, Artificial Sequence
  Description of Artificial Sequence: Synthetic peptide
  Seed: FLWGPRAHS (MAGC1_HUMAN)
FVWGPRAHI

SEQ ID NO: 73329 - protein, 11 aa, Artificial Sequence
  Description of Artificial Sequence: Synthetic peptide
  Seed: IPVSAASSSTL (MAGC1_HUMAN)
IAVSAASSSTW

SEQ ID NO: 73330 - protein, 9 aa, Artificial Sequence
  Description of Artificial Sequence: Synthetic peptide
  Seed: MGDKDMPTA (MAGC1_HUMAN)
MTDKDMPTI

SEQ ID NO: 73331 - protein, 10 aa, Artificial Sequence
  Description of Artificial Sequence: Synthetic peptide
  Seed: EGPAQSPLQR (MAGC1_HUMAN)
EMPAQSPLQK

SEQ ID NO: 73332 - protein, 9 aa, Artificial Sequence
  Description of Artificial Sequence: Synthetic peptide
  Seed: ISFSSSTSL (MAGC1_HUMAN)
ICFSSSTSF

SEQ ID NO: 73333 - protein, 10 aa, Artificial Sequence
  Description of Artificial Sequence: Synthetic peptide
  Seed: WGPRAHSEVI (MAGC1_HUMAN)
WSPRAHSEVI

SEQ ID NO: 73334 - protein, 9 aa, Artificial Sequence
  Description of Artificial Sequence: Synthetic peptide
  Seed: AGREHFAFG (MAGC1_HUMAN)
AAREHFAFL

SEQ ID NO: 73335 - protein, 11 aa, Artificial Sequence
  Description of Artificial Sequence: Synthetic peptide
  Seed: SSFPSSTSSSL (MAGC1_HUMAN)
SCFPSSTSSSL

SEQ ID NO: 73336 - protein, 10 aa, Artificial Sequence
  Description of Artificial Sequence: Synthetic peptide
  Seed: SIFQSSPESA (MAGC1_HUMAN)
SMFQSSPESI

SEQ ID NO: 73337 - protein, 9 aa, Artificial Sequence
  Description of Artificial Sequence: Synthetic peptide
  Seed: ISFSSSTSL (MAGC1_HUMAN)
IAFSSSTSV

SEQ ID NO: 73338 - protein, 9 aa, Artificial Sequence
  Description of Artificial Sequence: Synthetic peptide
  Seed: SRYTGYFPV (MAGC1_HUMAN)
SIYTGYFPY

SEQ ID NO: 73339 - protein, 9 aa, Artificial Sequence
  Description of Artificial Sequence: Synthetic peptide
  Seed: HESPQSPPE (MAGC1_HUMAN)
HESPQSPPA

SEQ ID NO: 73340 - protein, 9 aa, Artificial Sequence
  Description of Artificial Sequence: Synthetic peptide
  Seed: LQNPASSFF (MAGC1_HUMAN)
LWNPASSFF

SEQ ID NO: 73341 - protein, 11 aa, Artificial Sequence
  Description of Artificial Sequence: Synthetic peptide
  Seed: RSFSSTLLSIF (MAGC1_HUMAN)
RAFSSTLLSIF

SEQ ID NO: 73342 - protein, 9 aa, Artificial Sequence
  Description of Artificial Sequence: Synthetic peptide
  Seed: SPLQIPQSS (MAGC1_HUMAN)
SHLQIPQSV

SEQ ID NO: 73343 - protein, 9 aa, Artificial Sequence
  Description of Artificial Sequence: Synthetic peptide
  Seed: FSSTLVSLF (MAGC1_HUMAN)
FWSTLVSLF

SEQ ID NO: 73344 - protein, 10 aa, Artificial Sequence
  Description of Artificial Sequence: Synthetic peptide
  Seed: LAMLKNTVPI (MAGC1_HUMAN)
LAMLKNTVPL

SEQ ID NO: 73345 - protein, 10 aa, Artificial Sequence
  Description of Artificial Sequence: Synthetic peptide
  Seed: ISRYTGYFPV (MAGC1_HUMAN)
IRRYTGYFPM

SEQ ID NO: 73346 - protein, 9 aa, Artificial Sequence
  Description of Artificial Sequence: Synthetic peptide
  Seed: MPSLLQSSS (MAGC1_HUMAN)
MVSLLQSSY

SEQ ID NO: 73347 - protein, 9 aa, Artificial Sequence
  Description of Artificial Sequence: Synthetic peptide
  Seed: KVWVQEHYL (MAGC1_HUMAN)
KCWVQEHYW

SEQ ID NO: 73348 - protein, 11 aa, Artificial Sequence
  Description of Artificial Sequence: Synthetic peptide
  Seed: SSFSYTLLSLF (MAGC1_HUMAN)
SSFSYTLLSLM

SEQ ID NO: 73349 - protein, 11 aa, Artificial Sequence
  Description of Artificial Sequence: Synthetic peptide
  Seed: QSSPECTQSTF (MAGC1_HUMAN)
QISPECTQSTW

SEQ ID NO: 73350 - protein, 8 aa, Artificial Sequence
  Description of Artificial Sequence: Synthetic peptide
  Seed: SPLQIVPS (MAGC1_HUMAN)
SPLQIVPA

SEQ ID NO: 73351 - protein, 9 aa, Artificial Sequence
  Description of Artificial Sequence: Synthetic peptide
  Seed: CSSSTSLSL (MAGC1_HUMAN)
CESSTSLSY

SEQ ID NO: 73352 - protein, 10 aa, Artificial Sequence
  Description of Artificial Sequence: Synthetic peptide
  Seed: FAFGEPRELL (MAGC1_HUMAN)
FVFGEPRELW

SEQ ID NO: 73353 - protein, 9 aa, Artificial Sequence
  Description of Artificial Sequence: Synthetic peptide
  Seed: IPMTSSFSS (MAGC1_HUMAN)
IAMTSSFSL

SEQ ID NO: 73354 - protein, 9 aa, Artificial Sequence
  Description of Artificial Sequence: Synthetic peptide
  Seed: AQSPLQRPV (MAGC1_HUMAN)
ARSPLQRPY

SEQ ID NO: 73355 - protein, 9 aa, Artificial Sequence
  Description of Artificial Sequence: Synthetic peptide
  Seed: RTHSTFEGF (MAGC1_HUMAN)
RTHSTFEGK

SEQ ID NO: 73356 - protein, 9 aa, Artificial Sequence
  Description of Artificial Sequence: Synthetic peptide
  Seed: WVQEHYLEY (MAGC1_HUMAN)
WAQEHYLEM

SEQ ID NO: 73357 - protein, 9 aa, Artificial Sequence
  Description of Artificial Sequence: Synthetic peptide
  Seed: SSPERTHST (MAGC1_HUMAN)
SQPERTHSL

SEQ ID NO: 73358 - protein, 11 aa, Artificial Sequence
  Description of Artificial Sequence: Synthetic peptide
  Seed: STFEGFPQSPL (MAGC1_HUMAN)
SPFEGFPQSPF

SEQ ID NO: 73359 - protein, 9 aa, Artificial Sequence
  Description of Artificial Sequence: Synthetic peptide
  Seed: VISRYTGYF (MAGC1_HUMAN)
VTSRYTGYW

SEQ ID NO: 73360 - protein, 11 aa, Artificial Sequence
  Description of Artificial Sequence: Synthetic peptide
  Seed: SASSSVMSPSF (MAGC1_HUMAN)
SKSSSVMSPSY

SEQ ID NO: 73361 - protein, 9 aa, Artificial Sequence
  Description of Artificial Sequence: Synthetic peptide
  Seed: WVQEHYLEY (MAGC1_HUMAN)
WMQEHYLEM

SEQ ID NO: 73362 - protein, 9 aa, Artificial Sequence
  Description of Artificial Sequence: Synthetic peptide
  Seed: SSSESPQSC (MAGC1_HUMAN)
SASESPQSV

SEQ ID NO: 73363 - protein, 10 aa, Artificial Sequence
  Description of Artificial Sequence: Synthetic peptide
  Seed: TTDDSTATES (MAGC1_HUMAN)
TGDDSTATEY

SEQ ID NO: 73364 - protein, 9 aa, Artificial Sequence
  Description of Artificial Sequence: Synthetic peptide
  Seed: FPQSLLQIP (MAGC1_HUMAN)
FPQSLLQII

SEQ ID NO: 73365 - protein, 10 aa, Artificial Sequence
  Description of Artificial Sequence: Synthetic peptide
  Seed: LAMLKNTVPI (MAGC1_HUMAN)
LDMLKNTVPY

SEQ ID NO: 73366 - protein, 10 aa, Artificial Sequence
  Description of Artificial Sequence: Synthetic peptide
  Seed: LQIPVSRSFS (MAGC1_HUMAN)
LQIPVSRSFQ

SEQ ID NO: 73367 - protein, 11 aa, Artificial Sequence
  Description of Artificial Sequence: Synthetic peptide
  Seed: SPLQIPMTSSF (MAGC1_HUMAN)
SVLQIPMTSSY

SEQ ID NO: 73368 - protein, 10 aa, Artificial Sequence
  Description of Artificial Sequence: Synthetic peptide
  Seed: STLLSLFQSF (MAGC1_HUMAN)
SPLLSLFQSF

SEQ ID NO: 73369 - protein, 9 aa, Artificial Sequence
  Description of Artificial Sequence: Synthetic peptide
  Seed: SFSSTLVSL (MAGC1_HUMAN)
SASSTLVSV

SEQ ID NO: 73370 - protein, 10 aa, Artificial Sequence
  Description of Artificial Sequence: Synthetic peptide
  Seed: LLQIPMTSSF (MAGC1_HUMAN)
LQQIPMTSSM

SEQ ID NO: 73371 - protein, 9 aa, Artificial Sequence
  Description of Artificial Sequence: Synthetic peptide
  Seed: SPPEGENTH (MAGC1_HUMAN)
SVPEGENTL

SEQ ID NO: 73372 - protein, 10 aa, Artificial Sequence
  Description of Artificial Sequence: Synthetic peptide
  Seed: LLQIPMTSSF (MAGC1_HUMAN)
LCQIPMTSSL

SEQ ID NO: 73373 - protein, 9 aa, Artificial Sequence
  Description of Artificial Sequence: Synthetic peptide
  Seed: ISFSSSTSL (MAGC1_HUMAN)
IQFSSSTST

SEQ ID NO: 73374 - protein, 10 aa, Artificial Sequence
  Description of Artificial Sequence: Synthetic peptide
  Seed: STPSSLPQSF (MAGC1_HUMAN)
SAPSSLPQSV

SEQ ID NO: 73375 - protein, 11 aa, Artificial Sequence
  Description of Artificial Sequence: Synthetic peptide
  Seed: SPLQIPVSPSS (MAGC1_HUMAN)
SSLQIPVSPSW

SEQ ID NO: 73376 - protein, 9 aa, Artificial Sequence
  Description of Artificial Sequence: Synthetic peptide
  Seed: LQIPVSSSS (MAGC1_HUMAN)
LAIPVSSSL

SEQ ID NO: 73377 - protein, 10 aa, Artificial Sequence
  Description of Artificial Sequence: Synthetic peptide
  Seed: REFIEILFGI (MAGC1_HUMAN)
RYFIEILFGM

SEQ ID NO: 73378 - protein, 10 aa, Artificial Sequence
  Description of Artificial Sequence: Synthetic peptide
  Seed: MTSSFSSTLL (MAGC1_HUMAN)
MTSSFSSTLY

SEQ ID NO: 73379 - protein, 10 aa, Artificial Sequence
  Description of Artificial Sequence: Synthetic peptide
  Seed: VSPSFSSTLV (MAGC1_HUMAN)
VLPSFSSTLA

SEQ ID NO: 73380 - protein, 9 aa, Artificial Sequence
  Description of Artificial Sequence: Synthetic peptide
  Seed: GFPQSPLQI (MAGC1_HUMAN)
GYPQSPLQI

SEQ ID NO: 73381 - protein, 10 aa, Artificial Sequence
  Description of Artificial Sequence: Synthetic peptide
  Seed: ILFGISLREV (MAGC1_HUMAN)
IIFGISLREV

SEQ ID NO: 73382 - protein, 8 aa, Artificial Sequence
  Description of Artificial Sequence: Synthetic peptide
  Seed: KAREFIEI (MAGC1_HUMAN)
KQREFIEV

SEQ ID NO: 73383 - protein, 10 aa, Artificial Sequence
  Description of Artificial Sequence: Synthetic peptide
  Seed: SFSYTLLSLF (MAGC1_HUMAN)
SISYTLLSLY

SEQ ID NO: 73384 - protein, 9 aa, Artificial Sequence
  Description of Artificial Sequence: Synthetic peptide
  Seed: SSPEGKDSL (MAGC1_HUMAN)
SAPEGKDSV

SEQ ID NO: 73385 - protein, 9 aa, Artificial Sequence
  Description of Artificial Sequence: Synthetic peptide
  Seed: GFPQSVLQI (MAGC1_HUMAN)
GFPQSVLQF

SEQ ID NO: 73386 - protein, 9 aa, Artificial Sequence
  Description of Artificial Sequence: Synthetic peptide
  Seed: QIVPSLPEW (MAGC1_HUMAN)
QTVPSLPEL

SEQ ID NO: 73387 - protein, 9 aa, Artificial Sequence
  Description of Artificial Sequence: Synthetic peptide
  Seed: EDSQSPLQI (MAGC1_HUMAN)
EESQSPLQT

SEQ ID NO: 73388 - protein, 11 aa, Artificial Sequence
  Description of Artificial Sequence: Synthetic peptide
  Seed: FLAMLKNTVPI (MAGC1_HUMAN)
FNAMLKNTVPV

SEQ ID NO: 73389 - protein, 10 aa, Artificial Sequence
  Description of Artificial Sequence: Synthetic peptide
  Seed: ASSFFSSALL (MAGC1_HUMAN)
AASFFSSALW

SEQ ID NO: 73390 - protein, 9 aa, Artificial Sequence
  Description of Artificial Sequence: Synthetic peptide
  Seed: FFSSALLSI (MAGC1_HUMAN)
FLSSALLSF

SEQ ID NO: 73391 - protein, 9 aa, Artificial Sequence
  Description of Artificial Sequence: Synthetic peptide
  Seed: NSSPPRYEF (MAGC1_HUMAN)
NVSPPRYEM

SEQ ID NO: 73392 - protein, 11 aa, Artificial Sequence
  Description of Artificial Sequence: Synthetic peptide
  Seed: SAASSSTLVSI (MAGC1_HUMAN)
STASSSTLVSL

SEQ ID NO: 73393 - protein, 9 aa, Artificial Sequence
  Description of Artificial Sequence: Synthetic peptide
  Seed: EPRELLTKV (MAGC1_HUMAN)
EPRELLTKL

SEQ ID NO: 73394 - protein, 11 aa, Artificial Sequence
  Description of Artificial Sequence: Synthetic peptide
  Seed: IPVSPSSSSTL (MAGC1_HUMAN)
IQVSPSSSSTY

SEQ ID NO: 73395 - protein, 11 aa, Artificial Sequence
  Description of Artificial Sequence: Synthetic peptide
  Seed: SPQSPPEGPAQ (MAGC1_HUMAN)
SPQSPPEGPAM

SEQ ID NO: 73396 - protein, 9 aa, Artificial Sequence
  Description of Artificial Sequence: Synthetic peptide
  Seed: FAFGEPREL (MAGC1_HUMAN)
FHFGEPREM

SEQ ID NO: 73397 - protein, 9 aa, Artificial Sequence
  Description of Artificial Sequence: Synthetic peptide
  Seed: LQIPVSRSF (MAGC1_HUMAN)
LAIPVSRSL

SEQ ID NO: 73398 - protein, 10 aa, Artificial Sequence
  Description of Artificial Sequence: Synthetic peptide
  Seed: ASSSVMSPSF (MAGC1_HUMAN)
ATSSVMSPSW

SEQ ID NO: 73399 - protein, 11 aa, Artificial Sequence
  Description of Artificial Sequence: Synthetic peptide
  Seed: KRKVVEFLAML (MAGC1_HUMAN)
KWKVVEFLAMV

SEQ ID NO: 73400 - protein, 9 aa, Artificial Sequence
  Description of Artificial Sequence: Synthetic peptide
  Seed: LQIPMTSSF (MAGC1_HUMAN)
LIIPMTSSF

SEQ ID NO: 73401 - protein, 10 aa, Artificial Sequence
  Description of Artificial Sequence: Synthetic peptide
  Seed: SSFSYTLLSL (MAGC1_HUMAN)
SGFSYTLLSF

SEQ ID NO: 73402 - protein, 10 aa, Artificial Sequence
  Description of Artificial Sequence: Synthetic peptide
  Seed: ITKAEMLTNV (MAGC1_HUMAN)
ILKAEMLTNV

SEQ ID NO: 73403 - protein, 9 aa, Artificial Sequence
  Description of Artificial Sequence: Synthetic peptide
  Seed: SSPERTQST (MAGC1_HUMAN)
SKPERTQSL

SEQ ID NO: 73404 - protein, 10 aa, Artificial Sequence
  Description of Artificial Sequence: Synthetic peptide
  Seed: KAREFIEILF (MAGC1_HUMAN)
KRREFIEILM

SEQ ID NO: 73405 - protein, 9 aa, Artificial Sequence
  Description of Artificial Sequence: Synthetic peptide
  Seed: GYFPVIFRK (MAGC1_HUMAN)
GIFPVIFRY

SEQ ID NO: 73406 - protein, 11 aa, Artificial Sequence
  Description of Artificial Sequence: Synthetic peptide
  Seed: RKAREFIEILF (MAGC1_HUMAN)
RRAREFIEILL

SEQ ID NO: 73407 - protein, 10 aa, Artificial Sequence
  Description of Artificial Sequence: Synthetic peptide
  Seed: ISRYTGYFPV (MAGC1_HUMAN)
IGRYTGYFPL

SEQ ID NO: 73408 - protein, 11 aa, Artificial Sequence
  Description of Artificial Sequence: Synthetic peptide
  Seed: RPVSSFFSYTL (MAGC1_HUMAN)
RGVSSFFSYTF

SEQ ID NO: 73409 - protein, 10 aa, Artificial Sequence
  Description of Artificial Sequence: Synthetic peptide
  Seed: STSLSLPQSF (MAGC1_HUMAN)
SPSLSLPQSW

SEQ ID NO: 73410 - protein, 9 aa, Artificial Sequence
  Description of Artificial Sequence: Synthetic peptide
  Seed: DSYVFVNTL (MAGC1_HUMAN)
DIYVFVNTK

SEQ ID NO: 73411 - protein, 11 aa, Artificial Sequence
  Description of Artificial Sequence: Synthetic peptide
  Seed: EGEDSSDPLQR (MAGC1_HUMAN)
EIEDSSDPLQR

SEQ ID NO: 73412 - protein, 11 aa, Artificial Sequence
  Description of Artificial Sequence: Synthetic peptide
  Seed: STFEGFPQSLL (MAGC1_HUMAN)
SMFEGFPQSLP

SEQ ID NO: 73413 - protein, 9 aa, Artificial Sequence
  Description of Artificial Sequence: Synthetic peptide
  Seed: FSSTLLSLF (MAGC1_HUMAN)
FSSTLLSLL

SEQ ID NO: 73414 - protein, 9 aa, Artificial Sequence
  Description of Artificial Sequence: Synthetic peptide
  Seed: MSQNRLLIL (MAGC1_HUMAN)
MKQNRLLIL

SEQ ID NO: 73415 - protein, 10 aa, Artificial Sequence
  Description of Artificial Sequence: Synthetic peptide
  Seed: MTSSFSSTLL (MAGC1_HUMAN)
MPSSFSSTLV

SEQ ID NO: 73416 - protein, 10 aa, Artificial Sequence
  Description of Artificial Sequence: Synthetic peptide
  Seed: FSSTLVSLFQ (MAGC1_HUMAN)
FSSTLVSLFY

SEQ ID NO: 73417 - protein, 9 aa, Artificial Sequence
  Description of Artificial Sequence: Synthetic peptide
  Seed: TLASLLQSS (MAGC1_HUMAN)
TMASLLQSM

SEQ ID NO: 73418 - protein, 9 aa, Artificial Sequence
  Description of Artificial Sequence: Synthetic peptide
  Seed: FSYTLASLL (MAGC1_HUMAN)
FSYTLASLV

SEQ ID NO: 73419 - protein, 9 aa, Artificial Sequence
  Description of Artificial Sequence: Synthetic peptide
  Seed: FSSTLVSLF (MAGC1_HUMAN)
FFSTLVSLY

SEQ ID NO: 73420 - protein, 11 aa, Artificial Sequence
  Description of Artificial Sequence: Synthetic peptide
  Seed: LQIPVSSSFSY (MAGC1_HUMAN)
LDIPVSSSFSW

SEQ ID NO: 73421 - protein, 10 aa, Artificial Sequence
  Description of Artificial Sequence: Synthetic peptide
  Seed: SSPESDDTLY (MAGC1_HUMAN)
SPPESDDTLY

SEQ ID NO: 73422 - protein, 9 aa, Artificial Sequence
  Description of Artificial Sequence: Synthetic peptide
  Seed: KAREFIEIL (MAGC1_HUMAN)
KSREFIEIS

SEQ ID NO: 73423 - protein, 10 aa, Artificial Sequence
  Description of Artificial Sequence: Synthetic peptide
  Seed: LSQSSPVSSF (MAGC1_HUMAN)
LWQSSPVSSF

SEQ ID NO: 73424 - protein, 9 aa, Artificial Sequence
  Description of Artificial Sequence: Synthetic peptide
  Seed: SRSFSSTLL (MAGC1_HUMAN)
SKSFSSTLF

SEQ ID NO: 73425 - protein, 9 aa, Artificial Sequence
  Description of Artificial Sequence: Synthetic peptide
  Seed: TLDLTSEGC (MAGC1_HUMAN)
TLDLTSEGI

SEQ ID NO: 73426 - protein, 10 aa, Artificial Sequence
  Description of Artificial Sequence: Synthetic peptide
  Seed: LQIPMTSSFS (MAGC1_HUMAN)
LVIPMTSSFY

SEQ ID NO: 73427 - protein, 9 aa, Artificial Sequence
  Description of Artificial Sequence: Synthetic peptide
  Seed: SSFFSSALL (MAGC1_HUMAN)
SQFFSSALK

SEQ ID NO: 73428 - protein, 8 aa, Artificial Sequence
  Description of Artificial Sequence: Synthetic peptide
  Seed: FIEILFGI (MAGC1_HUMAN)
FQEILFGV

SEQ ID NO: 73429 - protein, 9 aa, Artificial Sequence
  Description of Artificial Sequence: Synthetic peptide
  Seed: KAREFIEIL (MAGC1_HUMAN)
KPREFIEIA

SEQ ID NO: 73430 - protein, 10 aa, Artificial Sequence
  Description of Artificial Sequence: Synthetic peptide
  Seed: LQIPGSPSFS (MAGC1_HUMAN)
LQIPGSPSFG

SEQ ID NO: 73431 - protein, 10 aa, Artificial Sequence
  Description of Artificial Sequence: Synthetic peptide
  Seed: RYTGYFPVIF (MAGC1_HUMAN)
RKTGYFPVIY

SEQ ID NO: 73432 - protein, 10 aa, Artificial Sequence
  Description of Artificial Sequence: Synthetic peptide
  Seed: MLKNTVPITF (MAGC1_HUMAN)
MNKNTVPITF

SEQ ID NO: 73433 - protein, 10 aa, Artificial Sequence
  Description of Artificial Sequence: Synthetic peptide
  Seed: FSSTLVSLFQ (MAGC1_HUMAN)
FSSTLVSLFM

SEQ ID NO: 73434 - protein, 10 aa, Artificial Sequence
  Description of Artificial Sequence: Synthetic peptide
  Seed: ASSSVMSPSF (MAGC1_HUMAN)
ANSSVMSPSW

SEQ ID NO: 73435 - protein, 10 aa, Artificial Sequence
  Description of Artificial Sequence: Synthetic peptide
  Seed: SSPERTHSTF (MAGC1_HUMAN)
SCPERTHSTL

SEQ ID NO: 73436 - protein, 10 aa, Artificial Sequence
  Description of Artificial Sequence: Synthetic peptide
  Seed: VSSSFSYTLL (MAGC1_HUMAN)
VDSSFSYTLW

SEQ ID NO: 73437 - protein, 10 aa, Artificial Sequence
  Description of Artificial Sequence: Synthetic peptide
  Seed: TVPITFPSSY (MAGC1_HUMAN)
TLPITFPSSY

SEQ ID NO: 73438 - protein, 10 aa, Artificial Sequence
  Description of Artificial Sequence: Synthetic peptide
  Seed: RAGREHFAFG (MAGC1_HUMAN)
RAGREHFAFA

SEQ ID NO: 73439 - protein, 10 aa, Artificial Sequence
  Description of Artificial Sequence: Synthetic peptide
  Seed: PLQIPMTSSF (MAGC1_HUMAN)
PMQIPMTSSW

SEQ ID NO: 73440 - protein, 10 aa, Artificial Sequence
  Description of Artificial Sequence: Synthetic peptide
  Seed: SPLQSPVSSF (MAGC1_HUMAN)
SGLQSPVSSY

SEQ ID NO: 73441 - protein, 9 aa, Artificial Sequence
  Description of Artificial Sequence: Synthetic peptide
  Seed: RTHSTFEGF (MAGC1_HUMAN)
RTHSTFEGL

SEQ ID NO: 73442 - protein, 9 aa, Artificial Sequence
  Description of Artificial Sequence: Synthetic peptide
  Seed: VPITFPSSY (MAGC1_HUMAN)
VNITFPSSY

SEQ ID NO: 73443 - protein, 9 aa, Artificial Sequence
  Description of Artificial Sequence: Synthetic peptide
  Seed: AQSPLQRPV (MAGC1_HUMAN)
AASPLQRPY

SEQ ID NO: 73444 - protein, 9 aa, Artificial Sequence
  Description of Artificial Sequence: Synthetic peptide
  Seed: SPLQIVPSL (MAGC1_HUMAN)
SHLQIVPSI

SEQ ID NO: 73445 - protein, 9 aa, Artificial Sequence
  Description of Artificial Sequence: Synthetic peptide
  Seed: FQSSLQSPV (MAGC1_HUMAN)
FGSSLQSPY

SEQ ID NO: 73446 - protein, 10 aa, Artificial Sequence
  Description of Artificial Sequence: Synthetic peptide
  Seed: KAEMLTNVIS (MAGC1_HUMAN)
KCEMLTNVIA

SEQ ID NO: 73447 - protein, 10 aa, Artificial Sequence
  Description of Artificial Sequence: Synthetic peptide
  Seed: SFSYTLLSLF (MAGC1_HUMAN)
SLSYTLLSLW

SEQ ID NO: 73448 - protein, 10 aa, Artificial Sequence
  Description of Artificial Sequence: Synthetic peptide
  Seed: VSPSSSSTLL (MAGC1_HUMAN)
VAPSSSSTLL

SEQ ID NO: 73449 - protein, 9 aa, Artificial Sequence
  Description of Artificial Sequence: Synthetic peptide
  Seed: VIFRKAREF (MAGC1_HUMAN)
VAFRKAREL

SEQ ID NO: 73450 - protein, 9 aa, Artificial Sequence
  Description of Artificial Sequence: Synthetic peptide
  Seed: FAFGEPREL (MAGC1_HUMAN)
FQFGEPREA

SEQ ID NO: 73451 - protein, 9 aa, Artificial Sequence
  Description of Artificial Sequence: Synthetic peptide
  Seed: FSYTLLSLF (MAGC1_HUMAN)
FTYTLLSLI

SEQ ID NO: 73452 - protein, 10 aa, Artificial Sequence
  Description of Artificial Sequence: Synthetic peptide
  Seed: FAQSSLQIPV (MAGC1_HUMAN)
FVQSSLQIPL

SEQ ID NO: 73453 - protein, 10 aa, Artificial Sequence
  Description of Artificial Sequence: Synthetic peptide
  Seed: REHFAFGEPR (MAGC1_HUMAN)
RWHFAFGEPK

SEQ ID NO: 73454 - protein, 9 aa, Artificial Sequence
  Description of Artificial Sequence: Synthetic peptide
  Seed: SSSSSSTLL (MAGC1_HUMAN)
SVSSSSTLF

SEQ ID NO: 73455 - protein, 9 aa, Artificial Sequence
  Description of Artificial Sequence: Synthetic peptide
  Seed: VSPSFSSTL (MAGC1_HUMAN)
VYPSFSSTW

SEQ ID NO: 73456 - protein, 10 aa, Artificial Sequence
  Description of Artificial Sequence: Synthetic peptide
  Seed: SPLQSPVSSF (MAGC1_HUMAN)
SPLQSPVSSY

SEQ ID NO: 73457 - protein, 11 aa, Artificial Sequence
  Description of Artificial Sequence: Synthetic peptide
  Seed: SLFQSSPERTH (MAGC1_HUMAN)
SAFQSSPERTF

SEQ ID NO: 73458 - protein, 11 aa, Artificial Sequence
  Description of Artificial Sequence: Synthetic peptide
  Seed: SPLQRPVSSFF (MAGC1_HUMAN)
SHLQRPVSSFY

SEQ ID NO: 73459 - protein, 10 aa, Artificial Sequence
  Description of Artificial Sequence: Synthetic peptide
  Seed: VSSSSSSSTL (MAGC1_HUMAN)
VYSSSSSSTF

SEQ ID NO: 73460 - protein, 9 aa, Artificial Sequence
  Description of Artificial Sequence: Synthetic peptide
  Seed: NPASSFFSS (MAGC1_HUMAN)
NAASSFFSF

SEQ ID NO: 73461 - protein, 9 aa, Artificial Sequence
  Description of Artificial Sequence: Synthetic peptide
  Seed: SICSSSTSL (MAGC1_HUMAN)
SMCSSSTSI

SEQ ID NO: 73462 - protein, 9 aa, Artificial Sequence
  Description of Artificial Sequence: Synthetic peptide
  Seed: VSAASSSTL (MAGC1_HUMAN)
VSAASSSTY

SEQ ID NO: 73463 - protein, 9 aa, Artificial Sequence
  Description of Artificial Sequence: Synthetic peptide
  Seed: SSSSTLLSL (MAGC1_HUMAN)
STSSTLLSM

SEQ ID NO: 73464 - protein, 9 aa, Artificial Sequence
  Description of Artificial Sequence: Synthetic peptide
  Seed: ISFSSSTSL (MAGC1_HUMAN)
IYFSSSTSL

SEQ ID NO: 73465 - protein, 9 aa, Artificial Sequence
  Description of Artificial Sequence: Synthetic peptide
  Seed: SAQSAFEGF (MAGC1_HUMAN)
SMQSAFEGL

SEQ ID NO: 73466 - protein, 9 aa, Artificial Sequence
  Description of Artificial Sequence: Synthetic peptide
  Seed: IEILFGISL (MAGC1_HUMAN)
ITILFGISY

SEQ ID NO: 73467 - protein, 10 aa, Artificial Sequence
  Description of Artificial Sequence: Synthetic peptide
  Seed: WEDSLSPHYF (MAGC1_HUMAN)
WEDSLSPHYL

SEQ ID NO: 73468 - protein, 10 aa, Artificial Sequence
  Description of Artificial Sequence: Synthetic peptide
  Seed: WVQEHYLEYR (MAGC1_HUMAN)
WFQEHYLEYR

SEQ ID NO: 73469 - protein, 10 aa, Artificial Sequence
  Description of Artificial Sequence: Synthetic peptide
  Seed: STSLSLPQSF (MAGC1_HUMAN)
SQSLSLPQSY

SEQ ID NO: 73470 - protein, 9 aa, Artificial Sequence
  Description of Artificial Sequence: Synthetic peptide
  Seed: AQSPLQSPV (MAGC1_HUMAN)
AKSPLQSPL

SEQ ID NO: 73471 - protein, 11 aa, Artificial Sequence
  Description of Artificial Sequence: Synthetic peptide
  Seed: SPLQIPGSPSF (MAGC1_HUMAN)
SNLQIPGSPSY

SEQ ID NO: 73472 - protein, 11 aa, Artificial Sequence
  Description of Artificial Sequence: Synthetic peptide
  Seed: LHSPQSPPEGM (MAGC1_HUMAN)
LHSPQSPPEGI

SEQ ID NO: 73473 - protein, 9 aa, Artificial Sequence
  Description of Artificial Sequence: Synthetic peptide
  Seed: LKNTVPITF (MAGC1_HUMAN)
LFNTVPITF

SEQ ID NO: 73474 - protein, 10 aa, Artificial Sequence
  Description of Artificial Sequence: Synthetic peptide
  Seed: FFSSALLSIF (MAGC1_HUMAN)
FSSSALLSIF

SEQ ID NO: 73475 - protein, 9 aa, Artificial Sequence
  Description of Artificial Sequence: Synthetic peptide
  Seed: IEILFGISL (MAGC1_HUMAN)
IEILFGISF

SEQ ID NO: 73476 - protein, 10 aa, Artificial Sequence
  Description of Artificial Sequence: Synthetic peptide
  Seed: SSPERTQSTF (MAGC1_HUMAN)
STPERTQSTW

SEQ ID NO: 73477 - protein, 10 aa, Artificial Sequence
  Description of Artificial Sequence: Synthetic peptide
  Seed: FFSYTLASLL (MAGC1_HUMAN)
FMSYTLASLE

SEQ ID NO: 73478 - protein, 11 aa, Artificial Sequence
  Description of Artificial Sequence: Synthetic peptide
  Seed: VSSSSSSSTLL (MAGC1_HUMAN)
VASSSSSSTLY

SEQ ID NO: 73479 - protein, 9 aa, Artificial Sequence
  Description of Artificial Sequence: Synthetic peptide
  Seed: FQSSLQSPV (MAGC1_HUMAN)
FTSSLQSPL

SEQ ID NO: 73480 - protein, 9 aa, Artificial Sequence
  Description of Artificial Sequence: Synthetic peptide
  Seed: LQRPVSSFF (MAGC1_HUMAN)
LMRPVSSFF

SEQ ID NO: 73481 - protein, 10 aa, Artificial Sequence
  Description of Artificial Sequence: Synthetic peptide
  Seed: RKVVEFLAML (MAGC1_HUMAN)
RMVVEFLAMY

SEQ ID NO: 73482 - protein, 9 aa, Artificial Sequence
  Description of Artificial Sequence: Synthetic peptide
  Seed: VSSSSSSTL (MAGC1_HUMAN)
VASSSSSTI

SEQ ID NO: 73483 - protein, 9 aa, Artificial Sequence
  Description of Artificial Sequence: Synthetic peptide
  Seed: FSYTLASLL (MAGC1_HUMAN)
FQYTLASLL

SEQ ID NO: 73484 - protein, 9 aa, Artificial Sequence
  Description of Artificial Sequence: Synthetic peptide
  Seed: LQRPVSSFF (MAGC1_HUMAN)
LIRPVSSFV

SEQ ID NO: 73485 - protein, 10 aa, Artificial Sequence
  Description of Artificial Sequence: Synthetic peptide
  Seed: KGTYASEEVI (MAGC1_HUMAN)
KDTYASEEVY

SEQ ID NO: 73486 - protein, 10 aa, Artificial Sequence
  Description of Artificial Sequence: Synthetic peptide
  Seed: YTLLSLFQSS (MAGC1_HUMAN)
YTLLSLFQSI

SEQ ID NO: 73487 - protein, 10 aa, Artificial Sequence
  Description of Artificial Sequence: Synthetic peptide
  Seed: SSFSYTLLSL (MAGC1_HUMAN)
SYFSYTLLSV

SEQ ID NO: 73488 - protein, 10 aa, Artificial Sequence
  Description of Artificial Sequence: Synthetic peptide
  Seed: SFPSSTSSSL (MAGC1_HUMAN)
SEPSSTSSSL

SEQ ID NO: 73489 - protein, 9 aa, Artificial Sequence
  Description of Artificial Sequence: Synthetic peptide
  Seed: AGREHFAFG (MAGC1_HUMAN)
AVREHFAFI

SEQ ID NO: 73490 - protein, 10 aa, Artificial Sequence
  Description of Artificial Sequence: Synthetic peptide
  Seed: ESAQSTFEGF (MAGC1_HUMAN)
EVAQSTFEGR

SEQ ID NO: 73491 - protein, 11 aa, Artificial Sequence
  Description of Artificial Sequence: Synthetic peptide
  Seed: SPLQIPVSRSF (MAGC1_HUMAN)
SGLQIPVSRSY

SEQ ID NO: 73492 - protein, 11 aa, Artificial Sequence
  Description of Artificial Sequence: Synthetic peptide
  Seed: SPLQRPVSSFF (MAGC1_HUMAN)
SQLQRPVSSFY

SEQ ID NO: 73493 - protein, 9 aa, Artificial Sequence
  Description of Artificial Sequence: Synthetic peptide
  Seed: WVQEHYLEY (MAGC1_HUMAN)
WIQEHYLEM

SEQ ID NO: 73494 - protein, 10 aa, Artificial Sequence
  Description of Artificial Sequence: Synthetic peptide
  Seed: VPITFPSSYK (MAGC1_HUMAN)
VVITFPSSYR

SEQ ID NO: 73495 - protein, 9 aa, Artificial Sequence
  Description of Artificial Sequence: Synthetic peptide
  Seed: SSFPSSTSS (MAGC1_HUMAN)
SGFPSSTSF

SEQ ID NO: 73496 - protein, 10 aa, Artificial Sequence
  Description of Artificial Sequence: Synthetic peptide
  Seed: VISFSSSTSL (MAGC1_HUMAN)
VESFSSSTSL

SEQ ID NO: 73497 - protein, 9 aa, Artificial Sequence
  Description of Artificial Sequence: Synthetic peptide
  Seed: MLKNTVPIT (MAGC1_HUMAN)
MLKNTVPIV

SEQ ID NO: 73498 - protein, 10 aa, Artificial Sequence
  Description of Artificial Sequence: Synthetic peptide
  Seed: RAGREHFAFG (MAGC1_HUMAN)
RVGREHFAFA

SEQ ID NO: 73499 - protein, 8 aa, Artificial Sequence
  Description of Artificial Sequence: Synthetic peptide
  Seed: SSFFSSAL (MAGC1_HUMAN)
SEFFSSAY

SEQ ID NO: 73500 - protein, 9 aa, Artificial Sequence
  Description of Artificial Sequence: Synthetic peptide
  Seed: SFFSYTLAS (MAGC1_HUMAN)
SIFSYTLAL

SEQ ID NO: 73501 - protein, 9 aa, Artificial Sequence
  Description of Artificial Sequence: Synthetic peptide
  Seed: IESEPLFTY (MAGC1_HUMAN)
IDSEPLFTL

SEQ ID NO: 73502 - protein, 10 aa, Artificial Sequence
  Description of Artificial Sequence: Synthetic peptide
  Seed: SFFSYTLASL (MAGC1_HUMAN)
SMFSYTLAST

SEQ ID NO: 73503 - protein, 9 aa, Artificial Sequence
  Description of Artificial Sequence: Synthetic peptide
  Seed: LSDEQGMSQ (MAGC1_HUMAN)
LWDEQGMSI

SEQ ID NO: 73504 - protein, 11 aa, Artificial Sequence
  Description of Artificial Sequence: Synthetic peptide
  Seed: SPLQIPMTSSF (MAGC1_HUMAN)
SELQIPMTSSM

SEQ ID NO: 73505 - protein, 10 aa, Artificial Sequence
  Description of Artificial Sequence: Synthetic peptide
  Seed: YTLDEKVDEL (MAGC1_HUMAN)
YVLDEKVDEF

SEQ ID NO: 73506 - protein, 9 aa, Artificial Sequence
  Description of Artificial Sequence: Synthetic peptide
  Seed: SSSTLLSLF (MAGC1_HUMAN)
SASTLLSLY

SEQ ID NO: 73507 - protein, 9 aa, Artificial Sequence
  Description of Artificial Sequence: Synthetic peptide
  Seed: SSPECTQST (MAGC1_HUMAN)
SAPECTQSV

SEQ ID NO: 73508 - protein, 9 aa, Artificial Sequence
  Description of Artificial Sequence: Synthetic peptide
  Seed: DSYVFVNTL (MAGC1_HUMAN)
DPYVFVNTF

SEQ ID NO: 73509 - protein, 9 aa, Artificial Sequence
  Description of Artificial Sequence: Synthetic peptide
  Seed: SSSSSSSTL (MAGC1_HUMAN)
SQSSSSSTY

SEQ ID NO: 73510 - protein, 9 aa, Artificial Sequence
  Description of Artificial Sequence: Synthetic peptide
  Seed: RPVSSFFSY (MAGC1_HUMAN)
RTVSSFFSF

SEQ ID NO: 73511 - protein, 10 aa, Artificial Sequence
  Description of Artificial Sequence: Synthetic peptide
  Seed: YTLASLLQSS (MAGC1_HUMAN)
YHLASLLQSA

SEQ ID NO: 73512 - protein, 10 aa, Artificial Sequence
  Description of Artificial Sequence: Synthetic peptide
  Seed: PLQIPVSRSF (MAGC1_HUMAN)
PTQIPVSRSF

SEQ ID NO: 73513 - protein, 9 aa, Artificial Sequence
  Description of Artificial Sequence: Synthetic peptide
  Seed: FPSSTSSSL (MAGC1_HUMAN)
FYSSTSSSH

SEQ ID NO: 73514 - protein, 9 aa, Artificial Sequence
  Description of Artificial Sequence: Synthetic peptide
  Seed: SSTSSSLSK (MAGC1_HUMAN)
SATSSSLSV

SEQ ID NO: 73515 - protein, 10 aa, Artificial Sequence
  Description of Artificial Sequence: Synthetic peptide
  Seed: SSFSYTLLSL (MAGC1_HUMAN)
SFFSYTLLSL

SEQ ID NO: 73516 - protein, 9 aa, Artificial Sequence
  Description of Artificial Sequence: Synthetic peptide
  Seed: SRYTGYFPV (MAGC1_HUMAN)
SQYTGYFPM

SEQ ID NO: 73517 - protein, 9 aa, Artificial Sequence
  Description of Artificial Sequence: Synthetic peptide
  Seed: ISFSSSTSL (MAGC1_HUMAN)
IGFSSSTSW

SEQ ID NO: 73518 - protein, 10 aa, Artificial Sequence
  Description of Artificial Sequence: Synthetic peptide
  Seed: AASSSTLVSI (MAGC1_HUMAN)
ALSSSTLVSV

SEQ ID NO: 73519 - protein, 11 aa, Artificial Sequence
  Description of Artificial Sequence: Synthetic peptide
  Seed: SPVSICSSSTP (MAGC1_HUMAN)
SPVSICSSSTA

SEQ ID NO: 73520 - protein, 9 aa, Artificial Sequence
  Description of Artificial Sequence: Synthetic peptide
  Seed: SFFSYTLAS (MAGC1_HUMAN)
SYFSYTLAA

SEQ ID NO: 73521 - protein, 9 aa, Artificial Sequence
  Description of Artificial Sequence: Synthetic peptide
  Seed: KAREFIEIL (MAGC1_HUMAN)
KPREFIEIF

SEQ ID NO: 73522 - protein, 10 aa, Artificial Sequence
  Description of Artificial Sequence: Synthetic peptide
  Seed: GDKDMPTAGM (MAGC1_HUMAN)
GEKDMPTAGL

SEQ ID NO: 73523 - protein, 9 aa, Artificial Sequence
  Description of Artificial Sequence: Synthetic peptide
  Seed: YVFVNTLDL (MAGC1_HUMAN)
YPFVNTLDV

SEQ ID NO: 73524 - protein, 9 aa, Artificial Sequence
  Description of Artificial Sequence: Synthetic peptide
  Seed: TPSSLPQSF (MAGC1_HUMAN)
TASSLPQSV

SEQ ID NO: 73525 - protein, 10 aa, Artificial Sequence
  Description of Artificial Sequence: Synthetic peptide
  Seed: MSPLYFPQSP (MAGC1_HUMAN)
MTPLYFPQSV

SEQ ID NO: 73526 - protein, 9 aa, Artificial Sequence
  Description of Artificial Sequence: Synthetic peptide
  Seed: MPSLLQSSS (MAGC1_HUMAN)
MPSLLQSSW

SEQ ID NO: 73527 - protein, 9 aa, Artificial Sequence
  Description of Artificial Sequence: Synthetic peptide
  Seed: GEDSLSPHY (MAGC1_HUMAN)
GEDSLSPHL

SEQ ID NO: 73528 - protein, 10 aa, Artificial Sequence
  Description of Artificial Sequence: Synthetic peptide
  Seed: IEILFGISLR (MAGC1_HUMAN)
ISILFGISLR

SEQ ID NO: 73529 - protein, 9 aa, Artificial Sequence
  Description of Artificial Sequence: Synthetic peptide
  Seed: MSQNRLLIL (MAGC1_HUMAN)
MTQNRLLIK

SEQ ID NO: 73530 - protein, 9 aa, Artificial Sequence
  Description of Artificial Sequence: Synthetic peptide
  Seed: ESDDTLYPL (MAGC1_HUMAN)
ETDDTLYPM

SEQ ID NO: 73531 - protein, 11 aa, Artificial Sequence
  Description of Artificial Sequence: Synthetic peptide
  Seed: SPLQIPVSSSS (MAGC1_HUMAN)
SVLQIPVSSSM

SEQ ID NO: 73532 - protein, 9 aa, Artificial Sequence
  Description of Artificial Sequence: Synthetic peptide
  Seed: YVFVNTLDL (MAGC1_HUMAN)
YHFVNTLDF

SEQ ID NO: 73533 - protein, 9 aa, Artificial Sequence
  Description of Artificial Sequence: Synthetic peptide
  Seed: GSPSFSSTL (MAGC1_HUMAN)
GVPSFSSTY

SEQ ID NO: 73534 - protein, 9 aa, Artificial Sequence
  Description of Artificial Sequence: Synthetic peptide
  Seed: FSSTLLSIL (MAGC1_HUMAN)
FQSTLLSIF

SEQ ID NO: 73535 - protein, 10 aa, Artificial Sequence
  Description of Artificial Sequence: Synthetic peptide
  Seed: MSPLYFPQSP (MAGC1_HUMAN)
MGPLYFPQSA

SEQ ID NO: 73536 - protein, 10 aa, Artificial Sequence
  Description of Artificial Sequence: Synthetic peptide
  Seed: VISFSSSTSL (MAGC1_HUMAN)
VASFSSSTSY

SEQ ID NO: 73537 - protein, 11 aa, Artificial Sequence
  Description of Artificial Sequence: Synthetic peptide
  Seed: SFSSSTSLSPF (MAGC1_HUMAN)
SMSSSTSLSPF

SEQ ID NO: 73538 - protein, 9 aa, Artificial Sequence
  Description of Artificial Sequence: Synthetic peptide
  Seed: SSSVMSPSF (MAGC1_HUMAN)
SRSVMSPSL

SEQ ID NO: 73539 - protein, 10 aa, Artificial Sequence
  Description of Artificial Sequence: Synthetic peptide
  Seed: PLQIPMTSSF (MAGC1_HUMAN)
PIQIPMTSSF

SEQ ID NO: 73540 - protein, 9 aa, Artificial Sequence
  Description of Artificial Sequence: Synthetic peptide
  Seed: QVKQPITKA (MAGC1_HUMAN)
QSKQPITKL

SEQ ID NO: 73541 - protein, 9 aa, Artificial Sequence
  Description of Artificial Sequence: Synthetic peptide
  Seed: LQIPMTSSF (MAGC1_HUMAN)
LRIPMTSSY

SEQ ID NO: 73542 - protein, 9 aa, Artificial Sequence
  Description of Artificial Sequence: Synthetic peptide
  Seed: FAFGEPREL (MAGC1_HUMAN)
FAFGEPRET

SEQ ID NO: 73543 - protein, 9 aa, Artificial Sequence
  Description of Artificial Sequence: Synthetic peptide
  Seed: LQIPVSPSF (MAGC1_HUMAN)
LEIPVSPSV

SEQ ID NO: 73544 - protein, 9 aa, Artificial Sequence
  Description of Artificial Sequence: Synthetic peptide
  Seed: VSRSFSSTL (MAGC1_HUMAN)
VIRSFSSTF

SEQ ID NO: 73545 - protein, 10 aa, Artificial Sequence
  Description of Artificial Sequence: Synthetic peptide
  Seed: SPLYFPQSPL (MAGC1_HUMAN)
SFLYFPQSPA

SEQ ID NO: 73546 - protein, 11 aa, Artificial Sequence
  Description of Artificial Sequence: Synthetic peptide
  Seed: LQIPVSSSFSY (MAGC1_HUMAN)
LAIPVSSSFSF

SEQ ID NO: 73547 - protein, 9 aa, Artificial Sequence
  Description of Artificial Sequence: Synthetic peptide
  Seed: FPSSTSSSL (MAGC1_HUMAN)
FLSSTSSSM

SEQ ID NO: 73548 - protein, 9 aa, Artificial Sequence
  Description of Artificial Sequence: Synthetic peptide
  Seed: SQSSPVSSF (MAGC1_HUMAN)
SWSSPVSSF

SEQ ID NO: 73549 - protein, 10 aa, Artificial Sequence
  Description of Artificial Sequence: Synthetic peptide
  Seed: FFSSALLSIF (MAGC1_HUMAN)
FYSSALLSIW

SEQ ID NO: 73550 - protein, 10 aa, Artificial Sequence
  Description of Artificial Sequence: Synthetic peptide
  Seed: REFIEILFGI (MAGC1_HUMAN)
RMFIEILFGT

SEQ ID NO: 73551 - protein, 9 aa, Artificial Sequence
  Description of Artificial Sequence: Synthetic peptide
  Seed: ESSSPVDEY (MAGC1_HUMAN)
ETSSPVDEF

SEQ ID NO: 73552 - protein, 10 aa, Artificial Sequence
  Description of Artificial Sequence: Synthetic peptide
  Seed: IPMTSSFSST (MAGC1_HUMAN)
IPMTSSFSSF

SEQ ID NO: 73553 - protein, 9 aa, Artificial Sequence
  Description of Artificial Sequence: Synthetic peptide
  Seed: GEDSLSPHY (MAGC1_HUMAN)
GIDSLSPHY

SEQ ID NO: 73554 - protein, 9 aa, Artificial Sequence
  Description of Artificial Sequence: Synthetic peptide
  Seed: LQIPVSSSS (MAGC1_HUMAN)
LIIPVSSSF

SEQ ID NO: 73555 - protein, 10 aa, Artificial Sequence
  Description of Artificial Sequence: Synthetic peptide
  Seed: SSSSSSSTLL (MAGC1_HUMAN)
SSSSSSSTLF

SEQ ID NO: 73556 - protein, 9 aa, Artificial Sequence
  Description of Artificial Sequence: Synthetic peptide
  Seed: TESASSSVM (MAGC1_HUMAN)
TLSASSSVY

SEQ ID NO: 73557 - protein, 9 aa, Artificial Sequence
  Description of Artificial Sequence: Synthetic peptide
  Seed: RAHSEVIKR (MAGC1_HUMAN)
RSHSEVIKK

SEQ ID NO: 73558 - protein, 10 aa, Artificial Sequence
  Description of Artificial Sequence: Synthetic peptide
  Seed: SLIESEPLFT (MAGC1_HUMAN)
SLIESEPLFM

SEQ ID NO: 73559 - protein, 9 aa, Artificial Sequence
  Description of Artificial Sequence: Synthetic peptide
  Seed: LQIPVSAAS (MAGC1_HUMAN)
LMIPVSAAW

SEQ ID NO: 73560 - protein, 10 aa, Artificial Sequence
  Description of Artificial Sequence: Synthetic peptide
  Seed: YVFVNTLDLT (MAGC1_HUMAN)
YQFVNTLDLI

SEQ ID NO: 73561 - protein, 9 aa, Artificial Sequence
  Description of Artificial Sequence: Synthetic peptide
  Seed: GFPQSPLQI (MAGC1_HUMAN)
GAPQSPLQL

SEQ ID NO: 73562 - protein, 9 aa, Artificial Sequence
  Description of Artificial Sequence: Synthetic peptide
  Seed: SFSSTLVSL (MAGC1_HUMAN)
SYSSTLVSY

SEQ ID NO: 73563 - protein, 10 aa, Artificial Sequence
  Description of Artificial Sequence: Synthetic peptide
  Seed: FAFGEPRELL (MAGC1_HUMAN)
FLFGEPRELM

SEQ ID NO: 73564 - protein, 9 aa, Artificial Sequence
  Description of Artificial Sequence: Synthetic peptide
  Seed: LQIPVSPSF (MAGC1_HUMAN)
LIIPVSPSL

SEQ ID NO: 73565 - protein, 9 aa, Artificial Sequence
  Description of Artificial Sequence: Synthetic peptide
  Seed: SFSYTLLSL (MAGC1_HUMAN)
SSSYTLLSL

SEQ ID NO: 73566 - protein, 9 aa, Artificial Sequence
  Description of Artificial Sequence: Synthetic peptide
  Seed: SSFFSSALL (MAGC1_HUMAN)
SQFFSSALY

SEQ ID NO: 73567 - protein, 9 aa, Artificial Sequence
  Description of Artificial Sequence: Synthetic peptide
  Seed: IPVSPSFSS (MAGC1_HUMAN)
IPVSPSFSL

SEQ ID NO: 73568 - protein, 11 aa, Artificial Sequence
  Description of Artificial Sequence: Synthetic peptide
  Seed: IPVSSSSSSTL (MAGC1_HUMAN)
IVVSSSSSSTY

SEQ ID NO: 73569 - protein, 9 aa, Artificial Sequence
  Description of Artificial Sequence: Synthetic peptide
  Seed: RPVSSFFSY (MAGC1_HUMAN)
RMVSSFFSY

SEQ ID NO: 73570 - protein, 9 aa, Artificial Sequence
  Description of Artificial Sequence: Synthetic peptide
  Seed: MPTAGMPSL (MAGC1_HUMAN)
MSTAGMPSV

SEQ ID NO: 73571 - protein, 10 aa, Artificial Sequence
  Description of Artificial Sequence: Synthetic peptide
  Seed: VSSSFSYTLL (MAGC1_HUMAN)
VDSSFSYTLY

SEQ ID NO: 73572 - protein, 9 aa, Artificial Sequence
  Description of Artificial Sequence: Synthetic peptide
  Seed: VQSPLHSPQ (MAGC1_HUMAN)
VQSPLHSPI

SEQ ID NO: 73573 - protein, 9 aa, Artificial Sequence
  Description of Artificial Sequence: Synthetic peptide
  Seed: KVWVQEHYL (MAGC1_HUMAN)
KSWVQEHYK

SEQ ID NO: 73574 - protein, 9 aa, Artificial Sequence
  Description of Artificial Sequence: Synthetic peptide
  Seed: SPPEGMHSQ (MAGC1_HUMAN)
SAPEGMHSL

SEQ ID NO: 73575 - protein, 9 aa, Artificial Sequence
  Description of Artificial Sequence: Synthetic peptide
  Seed: RSFSSTLLS (MAGC1_HUMAN)
RGFSSTLLF

SEQ ID NO: 73576 - protein, 10 aa, Artificial Sequence
  Description of Artificial Sequence: Synthetic peptide
  Seed: REVDPDDSYV (MAGC1_HUMAN)
REVDPDDSYM

SEQ ID NO: 73577 - protein, 9 aa, Artificial Sequence
  Description of Artificial Sequence: Synthetic peptide
  Seed: NTVPITFPS (MAGC1_HUMAN)
NNVPITFPI

SEQ ID NO: 73578 - protein, 9 aa, Artificial Sequence
  Description of Artificial Sequence: Synthetic peptide
  Seed: LQIPVSSSS (MAGC1_HUMAN)
LTIPVSSSF

SEQ ID NO: 73579 - protein, 11 aa, Artificial Sequence
  Description of Artificial Sequence: Synthetic peptide
  Seed: IPVSAASSSTL (MAGC1_HUMAN)
IEVSAASSSTY

SEQ ID NO: 73580 - protein, 10 aa, Artificial Sequence
  Description of Artificial Sequence: Synthetic peptide
  Seed: RSFSSTLLSI (MAGC1_HUMAN)
RGFSSTLLSK

SEQ ID NO: 73581 - protein, 11 aa, Artificial Sequence
  Description of Artificial Sequence: Synthetic peptide
  Seed: SSFSSTLLSIL (MAGC1_HUMAN)
SMFSSTLLSIY

SEQ ID NO: 73582 - protein, 9 aa, Artificial Sequence
  Description of Artificial Sequence: Synthetic peptide
  Seed: HFPQSPPEW (MAGC1_HUMAN)
HWPQSPPEL

SEQ ID NO: 73583 - protein, 10 aa, Artificial Sequence
  Description of Artificial Sequence: Synthetic peptide
  Seed: SPPEGPVQSP (MAGC1_HUMAN)
SPPEGPVQSF

SEQ ID NO: 73584 - protein, 10 aa, Artificial Sequence
  Description of Artificial Sequence: Synthetic peptide
  Seed: FSSSTSLSPF (MAGC1_HUMAN)
FESSTSLSPY

SEQ ID NO: 73585 - protein, 9 aa, Artificial Sequence
  Description of Artificial Sequence: Synthetic peptide
  Seed: VSSFFSYTL (MAGC1_HUMAN)
VTSFFSYTV

SEQ ID NO: 73586 - protein, 11 aa, Artificial Sequence
  Description of Artificial Sequence: Synthetic peptide
  Seed: SPLQIPMTSSF (MAGC1_HUMAN)
SSLQIPMTSSF

SEQ ID NO: 73587 - protein, 9 aa, Artificial Sequence
  Description of Artificial Sequence: Synthetic peptide
  Seed: TLLSILQSS (MAGC1_HUMAN)
TVLSILQSL

SEQ ID NO: 73588 - protein, 9 aa, Artificial Sequence
  Description of Artificial Sequence: Synthetic peptide
  Seed: FPVIFRKAR (MAGC1_HUMAN)
FFVIFRKAR

SEQ ID NO: 73589 - protein, 9 aa, Artificial Sequence
  Description of Artificial Sequence: Synthetic peptide
  Seed: SSPERTHST (MAGC1_HUMAN)
SFPERTHSM

SEQ ID NO: 73590 - protein, 10 aa, Artificial Sequence
  Description of Artificial Sequence: Synthetic peptide
  Seed: EILFGISLRE (MAGC1_HUMAN)
EHLFGISLRK

SEQ ID NO: 73591 - protein, 9 aa, Artificial Sequence
  Description of Artificial Sequence: Synthetic peptide
  Seed: KAREFIEIL (MAGC1_HUMAN)
KAREFIEIM

SEQ ID NO: 73592 - protein, 10 aa, Artificial Sequence
  Description of Artificial Sequence: Synthetic peptide
  Seed: LSIIFIKGTY (MAGC1_HUMAN)
LQIIFIKGTM

SEQ ID NO: 73593 - protein, 9 aa, Artificial Sequence
  Description of Artificial Sequence: Synthetic peptide
  Seed: TLVSIFQSS (MAGC1_HUMAN)
TQVSIFQSA

SEQ ID NO: 73594 - protein, 10 aa, Artificial Sequence
  Description of Artificial Sequence: Synthetic peptide
  Seed: SLFQSFSERT (MAGC1_HUMAN)
SYFQSFSERR

SEQ ID NO: 73595 - protein, 9 aa, Artificial Sequence
  Description of Artificial Sequence: Synthetic peptide
  Seed: SLPEWEDSL (MAGC1_HUMAN)
SVPEWEDSM

SEQ ID NO: 73596 - protein, 9 aa, Artificial Sequence
  Description of Artificial Sequence: Synthetic peptide
  Seed: KVDELARFL (MAGC1_HUMAN)
KNDELARFY

SEQ ID NO: 73597 - protein, 9 aa, Artificial Sequence
  Description of Artificial Sequence: Synthetic peptide
  Seed: YVFVNTLDL (MAGC1_HUMAN)
YVFVNTLDV

SEQ ID NO: 73598 - protein, 10 aa, Artificial Sequence
  Description of Artificial Sequence: Synthetic peptide
  Seed: VSSSFSYTLL (MAGC1_HUMAN)
VVSSFSYTLW

SEQ ID NO: 73599 - protein, 9 aa, Artificial Sequence
  Description of Artificial Sequence: Synthetic peptide
  Seed: RYTGYFPVI (MAGC1_HUMAN)
RWTGYFPVY

SEQ ID NO: 73600 - protein, 9 aa, Artificial Sequence
  Description of Artificial Sequence: Synthetic peptide
  Seed: SSSTLLSLF (MAGC1_HUMAN)
SISTLLSLW

SEQ ID NO: 73601 - protein, 10 aa, Artificial Sequence
  Description of Artificial Sequence: Synthetic peptide
  Seed: STLLSLFQSF (MAGC1_HUMAN)
SFLLSLFQSF

SEQ ID NO: 73602 - protein, 9 aa, Artificial Sequence
  Description of Artificial Sequence: Synthetic peptide
  Seed: ELARFLLLK (MAGC1_HUMAN)
EVARFLLLY

SEQ ID NO: 73603 - protein, 9 aa, Artificial Sequence
  Description of Artificial Sequence: Synthetic peptide
  Seed: SLPQSFPES (MAGC1_HUMAN)
SIPQSFPEV

SEQ ID NO: 73604 - protein, 9 aa, Artificial Sequence
  Description of Artificial Sequence: Synthetic peptide
  Seed: SSSESPQSC (MAGC1_HUMAN)
SISESPQSV

SEQ ID NO: 73605 - protein, 9 aa, Artificial Sequence
  Description of Artificial Sequence: Synthetic peptide
  Seed: SSFFSSALL (MAGC1_HUMAN)
SVFFSSALV

SEQ ID NO: 73606 - protein, 9 aa, Artificial Sequence
  Description of Artificial Sequence: Synthetic peptide
  Seed: SPPQGEDSL (MAGC1_HUMAN)
SAPQGEDSI

SEQ ID NO: 73607 - protein, 10 aa, Artificial Sequence
  Description of Artificial Sequence: Synthetic peptide
  Seed: FPQSPLQIPV (MAGC1_HUMAN)
FGQSPLQIPV

SEQ ID NO: 73608 - protein, 10 aa, Artificial Sequence
  Description of Artificial Sequence: Synthetic peptide
  Seed: MLKNTVPITF (MAGC1_HUMAN)
MFKNTVPITF

SEQ ID NO: 73609 - protein, 10 aa, Artificial Sequence
  Description of Artificial Sequence: Synthetic peptide
  Seed: LAMLKNTVPI (MAGC1_HUMAN)
LMMLKNTVPM

SEQ ID NO: 73610 - protein, 9 aa, Artificial Sequence
  Description of Artificial Sequence: Synthetic peptide
  Seed: TLASLLQSS (MAGC1_HUMAN)
TQASLLQSL

SEQ ID NO: 73611 - protein, 9 aa, Artificial Sequence
  Description of Artificial Sequence: Synthetic peptide
  Seed: SLLQSSHES (MAGC1_HUMAN)
SLLQSSHEV

SEQ ID NO: 73612 - protein, 10 aa, Artificial Sequence
  Description of Artificial Sequence: Synthetic peptide
  Seed: MSQNRLLILI (MAGC1_HUMAN)
MAQNRLLILF

SEQ ID NO: 73613 - protein, 9 aa, Artificial Sequence
  Description of Artificial Sequence: Synthetic peptide
  Seed: TLDEKVDEL (MAGC1_HUMAN)
TRDEKVDEI

SEQ ID NO: 73614 - protein, 9 aa, Artificial Sequence
  Description of Artificial Sequence: Synthetic peptide
  Seed: VIWDVLSGI (MAGC1_HUMAN)
VSWDVLSGL

SEQ ID NO: 73615 - protein, 9 aa, Artificial Sequence
  Description of Artificial Sequence: Synthetic peptide
  Seed: GSPSFSSTL (MAGC1_HUMAN)
GSPSFSSTY

SEQ ID NO: 73616 - protein, 11 aa, Artificial Sequence
  Description of Artificial Sequence: Synthetic peptide
  Seed: SPQSPPEGPAQ (MAGC1_HUMAN)
SPQSPPEGPAT

SEQ ID NO: 73617 - protein, 10 aa, Artificial Sequence
  Description of Artificial Sequence: Synthetic peptide
  Seed: SPLQSPVISF (MAGC1_HUMAN)
SVLQSPVISY

SEQ ID NO: 73618 - protein, 10 aa, Artificial Sequence
  Description of Artificial Sequence: Synthetic peptide
  Seed: VWVQEHYLEY (MAGC1_HUMAN)
VMVQEHYLEF

SEQ ID NO: 73619 - protein, 10 aa, Artificial Sequence
  Description of Artificial Sequence: Synthetic peptide
  Seed: SIIFIKGTYA (MAGC1_HUMAN)
SFIFIKGTYV

SEQ ID NO: 73620 - protein, 9 aa, Artificial Sequence
  Description of Artificial Sequence: Synthetic peptide
  Seed: KVVEFLAML (MAGC1_HUMAN)
KVVEFLAMF

SEQ ID NO: 73621 - protein, 9 aa, Artificial Sequence
  Description of Artificial Sequence: Synthetic peptide
  Seed: LKNTVPITF (MAGC1_HUMAN)
LKNTVPITL

SEQ ID NO: 73622 - protein, 10 aa, Artificial Sequence
  Description of Artificial Sequence: Synthetic peptide
  Seed: NPASSFFSSA (MAGC1_HUMAN)
NTASSFFSSM

SEQ ID NO: 73623 - protein, 10 aa, Artificial Sequence
  Description of Artificial Sequence: Synthetic peptide
  Seed: VISFSSSTSL (MAGC1_HUMAN)
VLSFSSSTSV

SEQ ID NO: 73624 - protein, 10 aa, Artificial Sequence
  Description of Artificial Sequence: Synthetic peptide
  Seed: RPVSSFFSYT (MAGC1_HUMAN)
RAVSSFFSYA

SEQ ID NO: 73625 - protein, 9 aa, Artificial Sequence
  Description of Artificial Sequence: Synthetic peptide
  Seed: SASSSVMSP (MAGC1_HUMAN)
SSSSSVMSY

SEQ ID NO: 73626 - protein, 11 aa, Artificial Sequence
  Description of Artificial Sequence: Synthetic peptide
  Seed: REVDPDDSYVF (MAGC1_HUMAN)
RQVDPDDSYVY

SEQ ID NO: 73627 - protein, 9 aa, Artificial Sequence
  Description of Artificial Sequence: Synthetic peptide
  Seed: TESASSSVM (MAGC1_HUMAN)
TQSASSSVF

SEQ ID NO: 73628 - protein, 9 aa, Artificial Sequence
  Description of Artificial Sequence: Synthetic peptide
  Seed: TLLSLFQSF (MAGC1_HUMAN)
TFLSLFQSY

SEQ ID NO: 73629 - protein, 9 aa, Artificial Sequence
  Description of Artificial Sequence: Synthetic peptide
  Seed: VIKRKVVEF (MAGC1_HUMAN)
VSKRKVVEL

SEQ ID NO: 73630 - protein, 10 aa, Artificial Sequence
  Description of Artificial Sequence: Synthetic peptide
  Seed: RPVSSFFSYT (MAGC1_HUMAN)
RVVSSFFSYK

SEQ ID NO: 73631 - protein, 9 aa, Artificial Sequence
  Description of Artificial Sequence: Synthetic peptide
  Seed: FSEESSSPV (MAGC1_HUMAN)
FMEESSSPI

SEQ ID NO: 73632 - protein, 9 aa, Artificial Sequence
  Description of Artificial Sequence: Synthetic peptide
  Seed: FPSSTSSSL (MAGC1_HUMAN)
FKSSTSSSY

SEQ ID NO: 73633 - protein, 10 aa, Artificial Sequence
  Description of Artificial Sequence: Synthetic peptide
  Seed: YTLDEKVDEL (MAGC1_HUMAN)
YKLDEKVDEV

SEQ ID NO: 73634 - protein, 9 aa, Artificial Sequence
  Description of Artificial Sequence: Synthetic peptide
  Seed: SSSTLVSIF (MAGC1_HUMAN)
SESTLVSIF

SEQ ID NO: 73635 - protein, 11 aa, Artificial Sequence
  Description of Artificial Sequence: Synthetic peptide
  Seed: RYTGYFPVIFR (MAGC1_HUMAN)
RTTGYFPVIFR

SEQ ID NO: 73636 - protein, 9 aa, Artificial Sequence
  Description of Artificial Sequence: Synthetic peptide
  Seed: TFEGFPQSL (MAGC1_HUMAN)
TYEGFPQSV

SEQ ID NO: 73637 - protein, 11 aa, Artificial Sequence
  Description of Artificial Sequence: Synthetic peptide
  Seed: IPVSSSFSYTL (MAGC1_HUMAN)
IIVSSSFSYTF

SEQ ID NO: 73638 - protein, 10 aa, Artificial Sequence
  Description of Artificial Sequence: Synthetic peptide
  Seed: MTSSFSSTLL (MAGC1_HUMAN)
MASSFSSTLV

SEQ ID NO: 73639 - protein, 9 aa, Artificial Sequence
  Description of Artificial Sequence: Synthetic peptide
  Seed: GTYASEEVI (MAGC1_HUMAN)
GSYASEEVF

SEQ ID NO: 73640 - protein, 11 aa, Artificial Sequence
  Description of Artificial Sequence: Synthetic peptide
  Seed: IPVSAASSSTL (MAGC1_HUMAN)
IRVSAASSSTY

SEQ ID NO: 73641 - protein, 10 aa, Artificial Sequence
  Description of Artificial Sequence: Synthetic peptide
  Seed: YLEYREVPNS (MAGC1_HUMAN)
YMEYREVPNV

SEQ ID NO: 73642 - protein, 10 aa, Artificial Sequence
  Description of Artificial Sequence: Synthetic peptide
  Seed: SVLQIPVSAA (MAGC1_HUMAN)
STLQIPVSAV

SEQ ID NO: 73643 - protein, 8 aa, Artificial Sequence
  Description of Artificial Sequence: Synthetic peptide
  Seed: SYTLASLL (MAGC1_HUMAN)
SYTLASLF

SEQ ID NO: 73644 - protein, 9 aa, Artificial Sequence
  Description of Artificial Sequence: Synthetic peptide
  Seed: YVFVNTLDL (MAGC1_HUMAN)
YWFVNTLDL

SEQ ID NO: 73645 - protein, 10 aa, Artificial Sequence
  Description of Artificial Sequence: Synthetic peptide
  Seed: VWVQEHYLEY (MAGC1_HUMAN)
VYVQEHYLEF

SEQ ID NO: 73646 - protein, 9 aa, Artificial Sequence
  Description of Artificial Sequence: Synthetic peptide
  Seed: RKVVEFLAM (MAGC1_HUMAN)
RKVVEFLAL

SEQ ID NO: 73647 - protein, 9 aa, Artificial Sequence
  Description of Artificial Sequence: Synthetic peptide
  Seed: TKVWVQEHY (MAGC1_HUMAN)
TFVWVQEHY

SEQ ID NO: 73648 - protein, 10 aa, Artificial Sequence
  Description of Artificial Sequence: Synthetic peptide
  Seed: KVVEFLAMLK (MAGC1_HUMAN)
KLVEFLAMLM

SEQ ID NO: 73649 - protein, 11 aa, Artificial Sequence
  Description of Artificial Sequence: Synthetic peptide
  Seed: SAASSSTLVSI (MAGC1_HUMAN)
SSASSSTLVSF

SEQ ID NO: 73650 - protein, 10 aa, Artificial Sequence
  Description of Artificial Sequence: Synthetic peptide
  Seed: IPVSPSFSST (MAGC1_HUMAN)
IPVSPSFSSV

SEQ ID NO: 73651 - protein, 11 aa, Artificial Sequence
  Description of Artificial Sequence: Synthetic peptide
  Seed: IPVSPSSSSTL (MAGC1_HUMAN)
ITVSPSSSSTY

SEQ ID NO: 73652 - protein, 10 aa, Artificial Sequence
  Description of Artificial Sequence: Synthetic peptide
  Seed: SSFSSTLLSI (MAGC1_HUMAN)
SGFSSTLLSY

SEQ ID NO: 73653 - protein, 9 aa, Artificial Sequence
  Description of Artificial Sequence: Synthetic peptide
  Seed: VSSSSSSTL (MAGC1_HUMAN)
VESSSSSTM

SEQ ID NO: 73654 - protein, 10 aa, Artificial Sequence
  Description of Artificial Sequence: Synthetic peptide
  Seed: SSFPSSTSSS (MAGC1_HUMAN)
SSFPSSTSSF

SEQ ID NO: 73655 - protein, 10 aa, Artificial Sequence
  Description of Artificial Sequence: Synthetic peptide
  Seed: VSSSSSSTLL (MAGC1_HUMAN)
VFSSSSSTLW

SEQ ID NO: 73656 - protein, 9 aa, Artificial Sequence
  Description of Artificial Sequence: Synthetic peptide
  Seed: QIVPSLPEW (MAGC1_HUMAN)
QVVPSLPEY

SEQ ID NO: 73657 - protein, 10 aa, Artificial Sequence
  Description of Artificial Sequence: Synthetic peptide
  Seed: RKAREFIEIL (MAGC1_HUMAN)
RQAREFIEIF

SEQ ID NO: 73658 - protein, 9 aa, Artificial Sequence
  Description of Artificial Sequence: Synthetic peptide
  Seed: ASSSTLVSI (MAGC1_HUMAN)
AVSSTLVSL

SEQ ID NO: 73659 - protein, 9 aa, Artificial Sequence
  Description of Artificial Sequence: Synthetic peptide
  Seed: SPLEGEDSL (MAGC1_HUMAN)
SPLEGEDSA

SEQ ID NO: 73660 - protein, 9 aa, Artificial Sequence
  Description of Artificial Sequence: Synthetic peptide
  Seed: EFIEILFGI (MAGC1_HUMAN)
ENIEILFGV

SEQ ID NO: 73661 - protein, 9 aa, Artificial Sequence
  Description of Artificial Sequence: Synthetic peptide
  Seed: SFSSTLVSL (MAGC1_HUMAN)
SFSSTLVSW

SEQ ID NO: 73662 - protein, 9 aa, Artificial Sequence
  Description of Artificial Sequence: Synthetic peptide
  Seed: LQIPVSRSF (MAGC1_HUMAN)
LVIPVSRSL

SEQ ID NO: 73663 - protein, 9 aa, Artificial Sequence
  Description of Artificial Sequence: Synthetic peptide
  Seed: LQIPGSPSF (MAGC1_HUMAN)
LMIPGSPSY

SEQ ID NO: 73664 - protein, 9 aa, Artificial Sequence
  Description of Artificial Sequence: Synthetic peptide
  Seed: AQSSLQIPV (MAGC1_HUMAN)
AASSLQIPY

SEQ ID NO: 73665 - protein, 9 aa, Artificial Sequence
  Description of Artificial Sequence: Synthetic peptide
  Seed: MGDKDMPTA (MAGC1_HUMAN)
MMDKDMPTV

SEQ ID NO: 73666 - protein, 10 aa, Artificial Sequence
  Description of Artificial Sequence: Synthetic peptide
  Seed: SSSSSSSTLL (MAGC1_HUMAN)
STSSSSSTLW

SEQ ID NO: 73667 - protein, 9 aa, Artificial Sequence
  Description of Artificial Sequence: Synthetic peptide
  Seed: SQSSPVSSF (MAGC1_HUMAN)
SFSSPVSSI

SEQ ID NO: 73668 - protein, 9 aa, Artificial Sequence
  Description of Artificial Sequence: Synthetic peptide
  Seed: AGREHFAFG (MAGC1_HUMAN)
ATREHFAFS

SEQ ID NO: 73669 - protein, 10 aa, Artificial Sequence
  Description of Artificial Sequence: Synthetic peptide
  Seed: SSPESAQSAF (MAGC1_HUMAN)
STPESAQSAY

SEQ ID NO: 73670 - protein, 10 aa, Artificial Sequence
  Description of Artificial Sequence: Synthetic peptide
  Seed: YTLDEKVDEL (MAGC1_HUMAN)
YVLDEKVDEM

SEQ ID NO: 73671 - protein, 9 aa, Artificial Sequence
  Description of Artificial Sequence: Synthetic peptide
  Seed: TLDLTSEGC (MAGC1_HUMAN)
TADLTSEGM

SEQ ID NO: 73672 - protein, 10 aa, Artificial Sequence
  Description of Artificial Sequence: Synthetic peptide
  Seed: FSSSTSLSPF (MAGC1_HUMAN)
FRSSTSLSPF

SEQ ID NO: 73673 - protein, 11 aa, Artificial Sequence
  Description of Artificial Sequence: Synthetic peptide
  Seed: IPMTSSFSSTL (MAGC1_HUMAN)
IPMTSSFSSTW

SEQ ID NO: 73674 - protein, 9 aa, Artificial Sequence
  Description of Artificial Sequence: Synthetic peptide
  Seed: LKNTVPITF (MAGC1_HUMAN)
LNNTVPITY

SEQ ID NO: 73675 - protein, 9 aa, Artificial Sequence
  Description of Artificial Sequence: Synthetic peptide
  Seed: TLASLLQSS (MAGC1_HUMAN)
TSASLLQSI

SEQ ID NO: 73676 - protein, 11 aa, Artificial Sequence
  Description of Artificial Sequence: Synthetic peptide
  Seed: SAASSSTLVSI (MAGC1_HUMAN)
SMASSSTLVSV

SEQ ID NO: 73677 - protein, 10 aa, Artificial Sequence
  Description of Artificial Sequence: Synthetic peptide
  Seed: YTLASLLQSS (MAGC1_HUMAN)
YTLASLLQSA

SEQ ID NO: 73678 - protein, 9 aa, Artificial Sequence
  Description of Artificial Sequence: Synthetic peptide
  Seed: KDVEERAQA (MAGC1_HUMAN)
KEVEERAQA

SEQ ID NO: 73679 - protein, 9 aa, Artificial Sequence
  Description of Artificial Sequence: Synthetic peptide
  Seed: ISFSSSTSL (MAGC1_HUMAN)
IMFSSSTSI

SEQ ID NO: 73680 - protein, 10 aa, Artificial Sequence
  Description of Artificial Sequence: Synthetic peptide
  Seed: LLQIPMTSSF (MAGC1_HUMAN)
LAQIPMTSSW

SEQ ID NO: 73681 - protein, 10 aa, Artificial Sequence
  Description of Artificial Sequence: Synthetic peptide
  Seed: KVVEFLAMLK (MAGC1_HUMAN)
KVVEFLAMLI

SEQ ID NO: 73682 - protein, 10 aa, Artificial Sequence
  Description of Artificial Sequence: Synthetic peptide
  Seed: STPSSLPQSF (MAGC1_HUMAN)
SSPSSLPQSW

SEQ ID NO: 73683 - protein, 9 aa, Artificial Sequence
  Description of Artificial Sequence: Synthetic peptide
  Seed: AGREHFAFG (MAGC1_HUMAN)
AMREHFAFL

SEQ ID NO: 73684 - protein, 8 aa, Artificial Sequence
  Description of Artificial Sequence: Synthetic peptide
  Seed: LQSPVSSF (MAGC1_HUMAN)
LASPVSSL

SEQ ID NO: 73685 - protein, 11 aa, Artificial Sequence
  Description of Artificial Sequence: Synthetic peptide
  Seed: KRKVVEFLAML (MAGC1_HUMAN)
KCKVVEFLAMV

SEQ ID NO: 73686 - protein, 9 aa, Artificial Sequence
  Description of Artificial Sequence: Synthetic peptide
  Seed: FFSSALLSI (MAGC1_HUMAN)
FWSSALLSL

SEQ ID NO: 73687 - protein, 9 aa, Artificial Sequence
  Description of Artificial Sequence: Synthetic peptide
  Seed: LQIPVSRSF (MAGC1_HUMAN)
LTIPVSRSI

SEQ ID NO: 73688 - protein, 10 aa, Artificial Sequence
  Description of Artificial Sequence: Synthetic peptide
  Seed: EEFQSSLQSP (MAGC1_HUMAN)
EEFQSSLQSL

SEQ ID NO: 73689 - protein, 10 aa, Artificial Sequence
  Description of Artificial Sequence: Synthetic peptide
  Seed: KAREFIEILF (MAGC1_HUMAN)
KYREFIEILY

SEQ ID NO: 73690 - protein, 9 aa, Artificial Sequence
  Description of Artificial Sequence: Synthetic peptide
  Seed: FQSSLQSPV (MAGC1_HUMAN)
FVSSLQSPF

SEQ ID NO: 73691 - protein, 9 aa, Artificial Sequence
  Description of Artificial Sequence: Synthetic peptide
  Seed: IIDTTDDST (MAGC1_HUMAN)
IVDTTDDSV

SEQ ID NO: 73692 - protein, 9 aa, Artificial Sequence
  Description of Artificial Sequence: Synthetic peptide
  Seed: LQIPGSPSF (MAGC1_HUMAN)
LQIPGSPSL

SEQ ID NO: 73693 - protein, 9 aa, Artificial Sequence
  Description of Artificial Sequence: Synthetic peptide
  Seed: FAFGEPREL (MAGC1_HUMAN)
FGFGEPREI

SEQ ID NO: 73694 - protein, 9 aa, Artificial Sequence
  Description of Artificial Sequence: Synthetic peptide
  Seed: SAPEGEDSL (MAGC1_HUMAN)
SLPEGEDSL

SEQ ID NO: 73695 - protein, 8 aa, Artificial Sequence
  Description of Artificial Sequence: Synthetic peptide
  Seed: LAMLKNTV (MAGC1_HUMAN)
LAMLKNTL

SEQ ID NO: 73696 - protein, 9 aa, Artificial Sequence
  Description of Artificial Sequence: Synthetic peptide
  Seed: SSPECTQST (MAGC1_HUMAN)
SMPECTQSM

SEQ ID NO: 73697 - protein, 10 aa, Artificial Sequence
  Description of Artificial Sequence: Synthetic peptide
  Seed: STPSSLPQSF (MAGC1_HUMAN)
SAPSSLPQSY

SEQ ID NO: 73698 - protein, 9 aa, Artificial Sequence
  Description of Artificial Sequence: Synthetic peptide
  Seed: SVLQIPVSA (MAGC1_HUMAN)
SSLQIPVSY

SEQ ID NO: 73699 - protein, 8 aa, Artificial Sequence
  Description of Artificial Sequence: Synthetic peptide
  Seed: RSFSSTLL (MAGC1_HUMAN)
RAFSSTLY

SEQ ID NO: 73700 - protein, 9 aa, Artificial Sequence
  Description of Artificial Sequence: Synthetic peptide
  Seed: FSYTLLSLF (MAGC1_HUMAN)
FQYTLLSLF

SEQ ID NO: 73701 - protein, 9 aa, Artificial Sequence
  Description of Artificial Sequence: Synthetic peptide
  Seed: KVWVQEHYL (MAGC1_HUMAN)
KTWVQEHYI

SEQ ID NO: 73702 - protein, 9 aa, Artificial Sequence
  Description of Artificial Sequence: Synthetic peptide
  Seed: LKYQVKQPI (MAGC1_HUMAN)
LMYQVKQPM

SEQ ID NO: 73703 - protein, 9 aa, Artificial Sequence
  Description of Artificial Sequence: Synthetic peptide
  Seed: SQSSPVSSF (MAGC1_HUMAN)
SFSSPVSSM

SEQ ID NO: 73704 - protein, 9 aa, Artificial Sequence
  Description of Artificial Sequence: Synthetic peptide
  Seed: VSPSFSSTL (MAGC1_HUMAN)
VRPSFSSTM

SEQ ID NO: 73705 - protein, 11 aa, Artificial Sequence
  Description of Artificial Sequence: Synthetic peptide
  Seed: RPVSSFFSYTL (MAGC1_HUMAN)
RPVSSFFSYTY

SEQ ID NO: 73706 - protein, 9 aa, Artificial Sequence
  Description of Artificial Sequence: Synthetic peptide
  Seed: RTQSTFEGF (MAGC1_HUMAN)
RSQSTFEGY

SEQ ID NO: 73707 - protein, 9 aa, Artificial Sequence
  Description of Artificial Sequence: Synthetic peptide
  Seed: SVLQIPVSA (MAGC1_HUMAN)
SILQIPVSR

SEQ ID NO: 73708 - protein, 9 aa, Artificial Sequence
  Description of Artificial Sequence: Synthetic peptide
  Seed: CSSSTPSSL (MAGC1_HUMAN)
CMSSTPSSY

SEQ ID NO: 73709 - protein, 11 aa, Artificial Sequence
  Description of Artificial Sequence: Synthetic peptide
  Seed: SPLQIPVSSSS (MAGC1_HUMAN)
STLQIPVSSSF

SEQ ID NO: 73710 - protein, 9 aa, Artificial Sequence
  Description of Artificial Sequence: Synthetic peptide
  Seed: AMLKNTVPI (MAGC1_HUMAN)
ALLKNTVPR

SEQ ID NO: 73711 - protein, 10 aa, Artificial Sequence
  Description of Artificial Sequence: Synthetic peptide
  Seed: EVIWDVLSGI (MAGC1_HUMAN)
EMIWDVLSGV

SEQ ID NO: 73712 - protein, 10 aa, Artificial Sequence
  Description of Artificial Sequence: Synthetic peptide
  Seed: TTDDSTATES (MAGC1_HUMAN)
TQDDSTATEY

SEQ ID NO: 73713 - protein, 9 aa, Artificial Sequence
  Description of Artificial Sequence: Synthetic peptide
  Seed: FPSSYKDAL (MAGC1_HUMAN)
FASSYKDAW

SEQ ID NO: 73714 - protein, 9 aa, Artificial Sequence
  Description of Artificial Sequence: Synthetic peptide
  Seed: KVVEFLAML (MAGC1_HUMAN)
KIVEFLAML

SEQ ID NO: 73715 - protein, 9 aa, Artificial Sequence
  Description of Artificial Sequence: Synthetic peptide
  Seed: SPLQIPQSP (MAGC1_HUMAN)
SPLQIPQSM

SEQ ID NO: 73716 - protein, 9 aa, Artificial Sequence
  Description of Artificial Sequence: Synthetic peptide
  Seed: LQIPVSAAS (MAGC1_HUMAN)
LTIPVSAAL

SEQ ID NO: 73717 - protein, 9 aa, Artificial Sequence
  Description of Artificial Sequence: Synthetic peptide
  Seed: LQIVPSLPE (MAGC1_HUMAN)
LAIVPSLPM

SEQ ID NO: 73718 - protein, 9 aa, Artificial Sequence
  Description of Artificial Sequence: Synthetic peptide
  Seed: VSRSFSSTL (MAGC1_HUMAN)
VTRSFSSTG

SEQ ID NO: 73719 - protein, 10 aa, Artificial Sequence
  Description of Artificial Sequence: Synthetic peptide
  Seed: SFFSYTLASL (MAGC1_HUMAN)
SIFSYTLASA

SEQ ID NO: 73720 - protein, 9 aa, Artificial Sequence
  Description of Artificial Sequence: Synthetic peptide
  Seed: YTLLSLFQS (MAGC1_HUMAN)
YALLSLFQM

SEQ ID NO: 73721 - protein, 9 aa, Artificial Sequence
  Description of Artificial Sequence: Synthetic peptide
  Seed: VLSGIGVRA (MAGC1_HUMAN)
VTSGIGVRL

SEQ ID NO: 73722 - protein, 11 aa, Artificial Sequence
  Description of Artificial Sequence: Synthetic peptide
  Seed: IPVSPSSSSTL (MAGC1_HUMAN)
ISVSPSSSSTF

SEQ ID NO: 73723 - protein, 11 aa, Artificial Sequence
  Description of Artificial Sequence: Synthetic peptide
  Seed: IPVSPSSSSTL (MAGC1_HUMAN)
ISVSPSSSSTL

SEQ ID NO: 73724 - protein, 9 aa, Artificial Sequence
  Description of Artificial Sequence: Synthetic peptide
  Seed: SSPEGKDSL (MAGC1_HUMAN)
SYPEGKDSL

SEQ ID NO: 73725 - protein, 9 aa, Artificial Sequence
  Description of Artificial Sequence: Synthetic peptide
  Seed: AFGEPRELL (MAGC1_HUMAN)
AVGEPRELL

SEQ ID NO: 73726 - protein, 10 aa, Artificial Sequence
  Description of Artificial Sequence: Synthetic peptide
  Seed: SSPESTQSPF (MAGC1_HUMAN)
SAPESTQSPL

SEQ ID NO: 73727 - protein, 9 aa, Artificial Sequence
  Description of Artificial Sequence: Synthetic peptide
  Seed: SSPESAQSA (MAGC1_HUMAN)
SRPESAQSL

SEQ ID NO: 73728 - protein, 9 aa, Artificial Sequence
  Description of Artificial Sequence: Synthetic peptide
  Seed: SQSPPEGPV (MAGC1_HUMAN)
SVSPPEGPF

SEQ ID NO: 73729 - protein, 9 aa, Artificial Sequence
  Description of Artificial Sequence: Synthetic peptide
  Seed: YVFVNTLDL (MAGC1_HUMAN)
YQFVNTLDF

SEQ ID NO: 73730 - protein, 10 aa, Artificial Sequence
  Description of Artificial Sequence: Synthetic peptide
  Seed: FPSSTSSSLS (MAGC1_HUMAN)
FPSSTSSSLY

SEQ ID NO: 73731 - protein, 9 aa, Artificial Sequence
  Description of Artificial Sequence: Synthetic peptide
  Seed: IPVSSSFSY (MAGC1_HUMAN)
IPVSSSFSI

SEQ ID NO: 73732 - protein, 11 aa, Artificial Sequence
  Description of Artificial Sequence: Synthetic peptide
  Seed: SICSSSTPSSL (MAGC1_HUMAN)
SQCSSSTPSSY

SEQ ID NO: 73733 - protein, 10 aa, Artificial Sequence
  Description of Artificial Sequence: Synthetic peptide
  Seed: KAREFIEILF (MAGC1_HUMAN)
KTREFIEILA

SEQ ID NO: 73734 - protein, 9 aa, Artificial Sequence
  Description of Artificial Sequence: Synthetic peptide
  Seed: SSPESPLQS (MAGC1_HUMAN)
SGPESPLQL

SEQ ID NO: 73735 - protein, 10 aa, Artificial Sequence
  Description of Artificial Sequence: Synthetic peptide
  Seed: SRYTGYFPVI (MAGC1_HUMAN)
SLYTGYFPVM

SEQ ID NO: 73736 - protein, 9 aa, Artificial Sequence
  Description of Artificial Sequence: Synthetic peptide
  Seed: LQIPGSPSF (MAGC1_HUMAN)
LVIPGSPSM

SEQ ID NO: 73737 - protein, 9 aa, Artificial Sequence
  Description of Artificial Sequence: Synthetic peptide
  Seed: IPVSSSFSY (MAGC1_HUMAN)
ISVSSSFSM

SEQ ID NO: 73738 - protein, 8 aa, Artificial Sequence
  Description of Artificial Sequence: Synthetic peptide
  Seed: SDDTLYPL (MAGC1_HUMAN)
SSDTLYPL

SEQ ID NO: 73739 - protein, 9 aa, Artificial Sequence
  Description of Artificial Sequence: Synthetic peptide
  Seed: QIVPSLPEW (MAGC1_HUMAN)
QSVPSLPEY

SEQ ID NO: 73740 - protein, 9 aa, Artificial Sequence
  Description of Artificial Sequence: Synthetic peptide
  Seed: VQSPLHSPQ (MAGC1_HUMAN)
VSSPLHSPY

SEQ ID NO: 73741 - protein, 10 aa, Artificial Sequence
  Description of Artificial Sequence: Synthetic peptide
  Seed: LSQSSPVSSF (MAGC1_HUMAN)
LEQSSPVSSF

SEQ ID NO: 73742 - protein, 9 aa, Artificial Sequence
  Description of Artificial Sequence: Synthetic peptide
  Seed: SSSTSLSPF (MAGC1_HUMAN)
SISTSLSPY

SEQ ID NO: 73743 - protein, 10 aa, Artificial Sequence
  Description of Artificial Sequence: Synthetic peptide
  Seed: YTLASLLQSS (MAGC1_HUMAN)
YRLASLLQST

SEQ ID NO: 73744 - protein, 9 aa, Artificial Sequence
  Description of Artificial Sequence: Synthetic peptide
  Seed: RYTGYFPVI (MAGC1_HUMAN)
RFTGYFPVI

SEQ ID NO: 73745 - protein, 8 aa, Artificial Sequence
  Description of Artificial Sequence: Synthetic peptide
  Seed: SSFFSYTL (MAGC1_HUMAN)
SSFFSYTF

SEQ ID NO: 73746 - protein, 10 aa, Artificial Sequence
  Description of Artificial Sequence: Synthetic peptide
  Seed: TGYFPVIFRK (MAGC1_HUMAN)
TTYFPVIFRM

SEQ ID NO: 73747 - protein, 9 aa, Artificial Sequence
  Description of Artificial Sequence: Synthetic peptide
  Seed: SAASSSTLV (MAGC1_HUMAN)
SIASSSTLA

SEQ ID NO: 73748 - protein, 10 aa, Artificial Sequence
  Description of Artificial Sequence: Synthetic peptide
  Seed: KDVEERAQAI (MAGC1_HUMAN)
KEVEERAQAT

SEQ ID NO: 73749 - protein, 9 aa, Artificial Sequence
  Description of Artificial Sequence: Synthetic peptide
  Seed: VSPSFSSTL (MAGC1_HUMAN)
VVPSFSSTY

SEQ ID NO: 73750 - protein, 9 aa, Artificial Sequence
  Description of Artificial Sequence: Synthetic peptide
  Seed: LSPLHFPQF (MAGC1_HUMAN)
LYPLHFPQW

SEQ ID NO: 73751 - protein, 9 aa, Artificial Sequence
  Description of Artificial Sequence: Synthetic peptide
  Seed: KVDELARFL (MAGC1_HUMAN)
KSDELARFM

SEQ ID NO: 73752 - protein, 9 aa, Artificial Sequence
  Description of Artificial Sequence: Synthetic peptide
  Seed: SAASSSTLV (MAGC1_HUMAN)
STASSSTLI

SEQ ID NO: 73753 - protein, 10 aa, Artificial Sequence
  Description of Artificial Sequence: Synthetic peptide
  Seed: MLTNVISRYT (MAGC1_HUMAN)
MMTNVISRYM

SEQ ID NO: 73754 - protein, 9 aa, Artificial Sequence
  Description of Artificial Sequence: Synthetic peptide
  Seed: IFQSSPESA (MAGC1_HUMAN)
IYQSSPESY

SEQ ID NO: 73755 - protein, 9 aa, Artificial Sequence
  Description of Artificial Sequence: Synthetic peptide
  Seed: MTSSFSSTL (MAGC1_HUMAN)
MLSSFSSTS

SEQ ID NO: 73756 - protein, 9 aa, Artificial Sequence
  Description of Artificial Sequence: Synthetic peptide
  Seed: ESSSPVDEY (MAGC1_HUMAN)
ETSSPVDER

SEQ ID NO: 73757 - protein, 9 aa, Artificial Sequence
  Description of Artificial Sequence: Synthetic peptide
  Seed: VSRSFSSTL (MAGC1_HUMAN)
VFRSFSSTM

SEQ ID NO: 73758 - protein, 9 aa, Artificial Sequence
  Description of Artificial Sequence: Synthetic peptide
  Seed: LSPLHFPQF (MAGC1_HUMAN)
LVPLHFPQL

SEQ ID NO: 73759 - protein, 9 aa, Artificial Sequence
  Description of Artificial Sequence: Synthetic peptide
  Seed: LQIPVSPSF (MAGC1_HUMAN)
LMIPVSPSL

SEQ ID NO: 73760 - protein, 11 aa, Artificial Sequence
  Description of Artificial Sequence: Synthetic peptide
  Seed: IPVSSSFSYTL (MAGC1_HUMAN)
IRVSSSFSYTF

SEQ ID NO: 73761 - protein, 9 aa, Artificial Sequence
  Description of Artificial Sequence: Synthetic peptide
  Seed: CSSSTPSSL (MAGC1_HUMAN)
CHSSTPSSY

SEQ ID NO: 73762 - protein, 9 aa, Artificial Sequence
  Description of Artificial Sequence: Synthetic peptide
  Seed: TTDDSTATE (MAGC1_HUMAN)
TADDSTATA

SEQ ID NO: 73763 - protein, 9 aa, Artificial Sequence
  Description of Artificial Sequence: Synthetic peptide
  Seed: VSRSFSSTL (MAGC1_HUMAN)
VLRSFSSTK

SEQ ID NO: 73764 - protein, 9 aa, Artificial Sequence
  Description of Artificial Sequence: Synthetic peptide
  Seed: FSSTLVSLF (MAGC1_HUMAN)
FVSTLVSLL

SEQ ID NO: 73765 - protein, 9 aa, Artificial Sequence
  Description of Artificial Sequence: Synthetic peptide
  Seed: AMLKNTVPI (MAGC1_HUMAN)
AILKNTVPM

SEQ ID NO: 73766 - protein, 9 aa, Artificial Sequence
  Description of Artificial Sequence: Synthetic peptide
  Seed: TLLSILQSS (MAGC1_HUMAN)
TSLSILQSV

SEQ ID NO: 73767 - protein, 9 aa, Artificial Sequence
  Description of Artificial Sequence: Synthetic peptide
  Seed: LQIVPSLPE (MAGC1_HUMAN)
LGIVPSLPF

SEQ ID NO: 73768 - protein, 10 aa, Artificial Sequence
  Description of Artificial Sequence: Synthetic peptide
  Seed: QRPVSSFFSY (MAGC1_HUMAN)
QMPVSSFFSM

SEQ ID NO: 73769 - protein, 9 aa, Artificial Sequence
  Description of Artificial Sequence: Synthetic peptide
  Seed: RTQSTFEGF (MAGC1_HUMAN)
RYQSTFEGK

SEQ ID NO: 73770 - protein, 10 aa, Artificial Sequence
  Description of Artificial Sequence: Synthetic peptide
  Seed: VISFSSSTSL (MAGC1_HUMAN)
VVSFSSSTSF

SEQ ID NO: 73771 - protein, 9 aa, Artificial Sequence
  Description of Artificial Sequence: Synthetic peptide
  Seed: YTSSSDTLL (MAGC1_HUMAN)
YMSSSDTLL

SEQ ID NO: 73772 - protein, 9 aa, Artificial Sequence
  Description of Artificial Sequence: Synthetic peptide
  Seed: VQSPLQNPA (MAGC1_HUMAN)
VISPLQNPV

SEQ ID NO: 73773 - protein, 9 aa, Artificial Sequence
  Description of Artificial Sequence: Synthetic peptide
  Seed: SSPERTQST (MAGC1_HUMAN)
SQPERTQSI

SEQ ID NO: 73774 - protein, 10 aa, Artificial Sequence
  Description of Artificial Sequence: Synthetic peptide
  Seed: SFFSYTLASL (MAGC1_HUMAN)
SLFSYTLASL

SEQ ID NO: 73775 - protein, 10 aa, Artificial Sequence
  Description of Artificial Sequence: Synthetic peptide
  Seed: ASSFFSSALL (MAGC1_HUMAN)
ACSFFSSALY

SEQ ID NO: 73776 - protein, 10 aa, Artificial Sequence
  Description of Artificial Sequence: Synthetic peptide
  Seed: LQIPGSPSFS (MAGC1_HUMAN)
LHIPGSPSFY

SEQ ID NO: 73777 - protein, 9 aa, Artificial Sequence
  Description of Artificial Sequence: Synthetic peptide
  Seed: VIWDVLSGI (MAGC1_HUMAN)
VLWDVLSGT

SEQ ID NO: 73778 - protein, 9 aa, Artificial Sequence
  Description of Artificial Sequence: Synthetic peptide
  Seed: SPPEGPAQS (MAGC1_HUMAN)
SPPEGPAQV

SEQ ID NO: 73779 - protein, 9 aa, Artificial Sequence
  Description of Artificial Sequence: Synthetic peptide
  Seed: FSSTLLSIL (MAGC1_HUMAN)
FMSTLLSIW

SEQ ID NO: 73780 - protein, 11 aa, Artificial Sequence
  Description of Artificial Sequence: Synthetic peptide
  Seed: SAASSSTLVSI (MAGC1_HUMAN)
SVASSSTLVSV

SEQ ID NO: 73781 - protein, 10 aa, Artificial Sequence
  Description of Artificial Sequence: Synthetic peptide
  Seed: SPLQSPVISF (MAGC1_HUMAN)
STLQSPVISY

SEQ ID NO: 73782 - protein, 10 aa, Artificial Sequence
  Description of Artificial Sequence: Synthetic peptide
  Seed: FQSSLQSPVS (MAGC1_HUMAN)
FLSSLQSPVK

SEQ ID NO: 73783 - protein, 11 aa, Artificial Sequence
  Description of Artificial Sequence: Synthetic peptide
  Seed: RPVSSFFSYTL (MAGC1_HUMAN)
REVSSFFSYTY

SEQ ID NO: 73784 - protein, 11 aa, Artificial Sequence
  Description of Artificial Sequence: Synthetic peptide
  Seed: IPVSSSSSSTL (MAGC1_HUMAN)
IAVSSSSSSTW

SEQ ID NO: 73785 - protein, 11 aa, Artificial Sequence
  Description of Artificial Sequence: Synthetic peptide
  Seed: NTVPITFPSSY (MAGC1_HUMAN)
NIVPITFPSSK

SEQ ID NO: 73786 - protein, 9 aa, Artificial Sequence
  Description of Artificial Sequence: Synthetic peptide
  Seed: CSSSTSLSL (MAGC1_HUMAN)
CVSSTSLSY

SEQ ID NO: 73787 - protein, 9 aa, Artificial Sequence
  Description of Artificial Sequence: Synthetic peptide
  Seed: LQIVPSLPE (MAGC1_HUMAN)
LAIVPSLPF

SEQ ID NO: 73788 - protein, 10 aa, Artificial Sequence
  Description of Artificial Sequence: Synthetic peptide
  Seed: SPPEGPVQSP (MAGC1_HUMAN)
SPPEGPVQSL

SEQ ID NO: 73789 - protein, 9 aa, Artificial Sequence
  Description of Artificial Sequence: Synthetic peptide
  Seed: ISFSSSTSL (MAGC1_HUMAN)
ILFSSSTSY

SEQ ID NO: 73790 - protein, 9 aa, Artificial Sequence
  Description of Artificial Sequence: Synthetic peptide
  Seed: SSTSSSLSK (MAGC1_HUMAN)
SLTSSSLSR

SEQ ID NO: 73791 - protein, 9 aa, Artificial Sequence
  Description of Artificial Sequence: Synthetic peptide
  Seed: YFPVIFRKA (MAGC1_HUMAN)
YFPVIFRKF

SEQ ID NO: 73792 - protein, 10 aa, Artificial Sequence
  Description of Artificial Sequence: Synthetic peptide
  Seed: EVDPDDSYVF (MAGC1_HUMAN)
ESDPDDSYVY

SEQ ID NO: 73793 - protein, 9 aa, Artificial Sequence
  Description of Artificial Sequence: Synthetic peptide
  Seed: VIFRKAREF (MAGC1_HUMAN)
VSFRKAREM

SEQ ID NO: 73794 - protein, 10 aa, Artificial Sequence
  Description of Artificial Sequence: Synthetic peptide
  Seed: ISRYTGYFPV (MAGC1_HUMAN)
IYRYTGYFPK

SEQ ID NO: 73795 - protein, 9 aa, Artificial Sequence
  Description of Artificial Sequence: Synthetic peptide
  Seed: YTLASLLQS (MAGC1_HUMAN)
YLLASLLQS

SEQ ID NO: 73796 - protein, 9 aa, Artificial Sequence
  Description of Artificial Sequence: Synthetic peptide
  Seed: QSPLQGEEF (MAGC1_HUMAN)
QSPLQGEEM

SEQ ID NO: 73797 - protein, 9 aa, Artificial Sequence
  Description of Artificial Sequence: Synthetic peptide
  Seed: VIFRKAREF (MAGC1_HUMAN)
VQFRKAREY

SEQ ID NO: 73798 - protein, 9 aa, Artificial Sequence
  Description of Artificial Sequence: Synthetic peptide
  Seed: AGREHFAFG (MAGC1_HUMAN)
AVREHFAFL

SEQ ID NO: 73799 - protein, 9 aa, Artificial Sequence
  Description of Artificial Sequence: Synthetic peptide
  Seed: LQRPVSSFF (MAGC1_HUMAN)
LVRPVSSFG

SEQ ID NO: 73800 - protein, 9 aa, Artificial Sequence
  Description of Artificial Sequence: Synthetic peptide
  Seed: LQIPVSRSF (MAGC1_HUMAN)
LVIPVSRSV

SEQ ID NO: 73801 - protein, 10 aa, Artificial Sequence
  Description of Artificial Sequence: Synthetic peptide
  Seed: SPLYFPQSPL (MAGC1_HUMAN)
SWLYFPQSPI

SEQ ID NO: 73802 - protein, 9 aa, Artificial Sequence
  Description of Artificial Sequence: Synthetic peptide
  Seed: SSPERTQST (MAGC1_HUMAN)
SGPERTQSL

SEQ ID NO: 73803 - protein, 10 aa, Artificial Sequence
  Description of Artificial Sequence: Synthetic peptide
  Seed: FLAMLKNTVP (MAGC1_HUMAN)
FMAMLKNTVS

SEQ ID NO: 73804 - protein, 9 aa, Artificial Sequence
  Description of Artificial Sequence: Synthetic peptide
  Seed: SSFPSSTSS (MAGC1_HUMAN)
STFPSSTSM

SEQ ID NO: 73805 - protein, 9 aa, Artificial Sequence
  Description of Artificial Sequence: Synthetic peptide
  Seed: SSPESPLQS (MAGC1_HUMAN)
SMPESPLQV

SEQ ID NO: 73806 - protein, 9 aa, Artificial Sequence
  Description of Artificial Sequence: Synthetic peptide
  Seed: LSDEQGMSQ (MAGC1_HUMAN)
LGDEQGMSV

SEQ ID NO: 73807 - protein, 10 aa, Artificial Sequence
  Description of Artificial Sequence: Synthetic peptide
  Seed: LAMLKNTVPI (MAGC1_HUMAN)
LEMLKNTVPL

SEQ ID NO: 73808 - protein, 9 aa, Artificial Sequence
  Description of Artificial Sequence: Synthetic peptide
  Seed: YTLASLLQS (MAGC1_HUMAN)
YQLASLLQC

SEQ ID NO: 73809 - protein, 10 aa, Artificial Sequence
  Description of Artificial Sequence: Synthetic peptide
  Seed: MTSSFSSTLL (MAGC1_HUMAN)
MLSSFSSTLN

SEQ ID NO: 73810 - protein, 11 aa, Artificial Sequence
  Description of Artificial Sequence: Synthetic peptide
  Seed: SLIESEPLFTY (MAGC1_HUMAN)
SLIESEPLFTI

SEQ ID NO: 73811 - protein, 11 aa, Artificial Sequence
  Description of Artificial Sequence: Synthetic peptide
  Seed: IPVSSSFSYTL (MAGC1_HUMAN)
IGVSSSFSYTF

SEQ ID NO: 73812 - protein, 11 aa, Artificial Sequence
  Description of Artificial Sequence: Synthetic peptide
  Seed: SFFSYTLASLL (MAGC1_HUMAN)
SFFSYTLASLY

SEQ ID NO: 73813 - protein, 9 aa, Artificial Sequence
  Description of Artificial Sequence: Synthetic peptide
  Seed: AASSSTLVS (MAGC1_HUMAN)
AASSSTLVH

SEQ ID NO: 73814 - protein, 11 aa, Artificial Sequence
  Description of Artificial Sequence: Synthetic peptide
  Seed: RPVSSFFSYTL (MAGC1_HUMAN)
RCVSSFFSYTW

SEQ ID NO: 73815 - protein, 10 aa, Artificial Sequence
  Description of Artificial Sequence: Synthetic peptide
  Seed: LAMLKNTVPI (MAGC1_HUMAN)
LIMLKNTVPF

SEQ ID NO: 73816 - protein, 11 aa, Artificial Sequence
  Description of Artificial Sequence: Synthetic peptide
  Seed: SLFQSSPERTH (MAGC1_HUMAN)
SGFQSSPERTY

SEQ ID NO: 73817 - protein, 9 aa, Artificial Sequence
  Description of Artificial Sequence: Synthetic peptide
  Seed: SSSTLLSLF (MAGC1_HUMAN)
SKSTLLSLM

SEQ ID NO: 73818 - protein, 9 aa, Artificial Sequence
  Description of Artificial Sequence: Synthetic peptide
  Seed: LKNTVPITF (MAGC1_HUMAN)
LYNTVPITM

SEQ ID NO: 73819 - protein, 9 aa, Artificial Sequence
  Description of Artificial Sequence: Synthetic peptide
  Seed: FQSSLQSPV (MAGC1_HUMAN)
FLSSLQSPF

SEQ ID NO: 73820 - protein, 9 aa, Artificial Sequence
  Description of Artificial Sequence: Synthetic peptide
  Seed: MLTNVISRY (MAGC1_HUMAN)
MLTNVISRF

SEQ ID NO: 73821 - protein, 9 aa, Artificial Sequence
  Description of Artificial Sequence: Synthetic peptide
  Seed: TLDLTSEGC (MAGC1_HUMAN)
TIDLTSEGI

SEQ ID NO: 73822 - protein, 9 aa, Artificial Sequence
  Description of Artificial Sequence: Synthetic peptide
  Seed: SFSSTLVSL (MAGC1_HUMAN)
SMSSTLVSV

SEQ ID NO: 73823 - protein, 9 aa, Artificial Sequence
  Description of Artificial Sequence: Synthetic peptide
  Seed: LQNPASSFF (MAGC1_HUMAN)
LYNPASSFL

SEQ ID NO: 73824 - protein, 11 aa, Artificial Sequence
  Description of Artificial Sequence: Synthetic peptide
  Seed: SSFSYTLLSLF (MAGC1_HUMAN)
SPFSYTLLSLW

SEQ ID NO: 73825 - protein, 10 aa, Artificial Sequence
  Description of Artificial Sequence: Synthetic peptide
  Seed: FFSYTLASLL (MAGC1_HUMAN)
FTSYTLASLY

SEQ ID NO: 73826 - protein, 8 aa, Artificial Sequence
  Description of Artificial Sequence: Synthetic peptide
  Seed: SSSTLVSI (MAGC1_HUMAN)
SASTLVSL

SEQ ID NO: 73827 - protein, 10 aa, Artificial Sequence
  Description of Artificial Sequence: Synthetic peptide
  Seed: SSPERTQSTF (MAGC1_HUMAN)
SAPERTQSTM

SEQ ID NO: 73828 - protein, 10 aa, Artificial Sequence
  Description of Artificial Sequence: Synthetic peptide
  Seed: KVVEFLAMLK (MAGC1_HUMAN)
KVVEFLAMLL

SEQ ID NO: 73829 - protein, 10 aa, Artificial Sequence
  Description of Artificial Sequence: Synthetic peptide
  Seed: VISFSSSTSL (MAGC1_HUMAN)
VGSFSSSTSM

SEQ ID NO: 73830 - protein, 9 aa, Artificial Sequence
  Description of Artificial Sequence: Synthetic peptide
  Seed: NSSPPRYEF (MAGC1_HUMAN)
NSSPPRYEY

SEQ ID NO: 73831 - protein, 11 aa, Artificial Sequence
  Description of Artificial Sequence: Synthetic peptide
  Seed: IPVSSSFSYTL (MAGC1_HUMAN)
ISVSSSFSYTY

SEQ ID NO: 73832 - protein, 9 aa, Artificial Sequence
  Description of Artificial Sequence: Synthetic peptide
  Seed: MTSSFSSTL (MAGC1_HUMAN)
MMSSFSSTM

SEQ ID NO: 73833 - protein, 9 aa, Artificial Sequence
  Description of Artificial Sequence: Synthetic peptide
  Seed: AQSPLQIPV (MAGC1_HUMAN)
AYSPLQIPY

SEQ ID NO: 73834 - protein, 9 aa, Artificial Sequence
  Description of Artificial Sequence: Synthetic peptide
  Seed: SQSSPVSSF (MAGC1_HUMAN)
SFSSPVSSF

SEQ ID NO: 73835 - protein, 9 aa, Artificial Sequence
  Description of Artificial Sequence: Synthetic peptide
  Seed: SRYTGYFPV (MAGC1_HUMAN)
SAYTGYFPF

SEQ ID NO: 73836 - protein, 9 aa, Artificial Sequence
  Description of Artificial Sequence: Synthetic peptide
  Seed: VSAASSSTL (MAGC1_HUMAN)
VHAASSSTY

SEQ ID NO: 73837 - protein, 9 aa, Artificial Sequence
  Description of Artificial Sequence: Synthetic peptide
  Seed: LQNPASSFF (MAGC1_HUMAN)
LSNPASSFW

SEQ ID NO: 73838 - protein, 9 aa, Artificial Sequence
  Description of Artificial Sequence: Synthetic peptide
  Seed: SPLQIPMTS (MAGC1_HUMAN)
SMLQIPMTA

SEQ ID NO: 73839 - protein, 10 aa, Artificial Sequence
  Description of Artificial Sequence: Synthetic peptide
  Seed: SLQIPVSPSF (MAGC1_HUMAN)
SVQIPVSPSY

SEQ ID NO: 73840 - protein, 10 aa, Artificial Sequence
  Description of Artificial Sequence: Synthetic peptide
  Seed: SPESPLQSPV (MAGC1_HUMAN)
SPESPLQSPI

SEQ ID NO: 73841 - protein, 11 aa, Artificial Sequence
  Description of Artificial Sequence: Synthetic peptide
  Seed: EGEDSSDPLQR (MAGC1_HUMAN)
ELEDSSDPLQY

SEQ ID NO: 73842 - protein, 11 aa, Artificial Sequence
  Description of Artificial Sequence: Synthetic peptide
  Seed: KRKVVEFLAML (MAGC1_HUMAN)
KMKVVEFLAMV

SEQ ID NO: 73843 - protein, 11 aa, Artificial Sequence
  Description of Artificial Sequence: Synthetic peptide
  Seed: SQSSPEGKDSL (MAGC1_HUMAN)
SHSSPEGKDSM

SEQ ID NO: 73844 - protein, 10 aa, Artificial Sequence
  Description of Artificial Sequence: Synthetic peptide
  Seed: YTLASLLQSS (MAGC1_HUMAN)
YVLASLLQSV

SEQ ID NO: 73845 - protein, 9 aa, Artificial Sequence
  Description of Artificial Sequence: Synthetic peptide
  Seed: SPLQIVPSL (MAGC1_HUMAN)
SRLQIVPSI

SEQ ID NO: 73846 - protein, 9 aa, Artificial Sequence
  Description of Artificial Sequence: Synthetic peptide
  Seed: RSFSSTLLS (MAGC1_HUMAN)
RAFSSTLLA

SEQ ID NO: 73847 - protein, 9 aa, Artificial Sequence
  Description of Artificial Sequence: Synthetic peptide
  Seed: FSSTLVSLF (MAGC1_HUMAN)
FQSTLVSLY

SEQ ID NO: 73848 - protein, 10 aa, Artificial Sequence
  Description of Artificial Sequence: Synthetic peptide
  Seed: KGTYASEEVI (MAGC1_HUMAN)
KRTYASEEVW

SEQ ID NO: 73849 - protein, 9 aa, Artificial Sequence
  Description of Artificial Sequence: Synthetic peptide
  Seed: KVWVQEHYL (MAGC1_HUMAN)
KSWVQEHYR

SEQ ID NO: 73850 - protein, 11 aa, Artificial Sequence
  Description of Artificial Sequence: Synthetic peptide
  Seed: SSSSSSTLLSL (MAGC1_HUMAN)
SPSSSSTLLSI

SEQ ID NO: 73851 - protein, 9 aa, Artificial Sequence
  Description of Artificial Sequence: Synthetic peptide
  Seed: ISRYTGYFP (MAGC1_HUMAN)
ITRYTGYFS

SEQ ID NO: 73852 - protein, 9 aa, Artificial Sequence
  Description of Artificial Sequence: Synthetic peptide
  Seed: SSSSTLLSL (MAGC1_HUMAN)
SSSSTLLSY

SEQ ID NO: 73853 - protein, 11 aa, Artificial Sequence
  Description of Artificial Sequence: Synthetic peptide
  Seed: LQIPVSSSFSY (MAGC1_HUMAN)
LIIPVSSSFSM

SEQ ID NO: 73854 - protein, 10 aa, Artificial Sequence
  Description of Artificial Sequence: Synthetic peptide
  Seed: VSSSSSSTLL (MAGC1_HUMAN)
VASSSSSTLF

SEQ ID NO: 73855 - protein, 9 aa, Artificial Sequence
  Description of Artificial Sequence: Synthetic peptide
  Seed: TLDLTSEGC (MAGC1_HUMAN)
TMDLTSEGV

SEQ ID NO: 73856 - protein, 9 aa, Artificial Sequence
  Description of Artificial Sequence: Synthetic peptide
  Seed: GFPQSPLQI (MAGC1_HUMAN)
GSPQSPLQM

SEQ ID NO: 73857 - protein, 9 aa, Artificial Sequence
  Description of Artificial Sequence: Synthetic peptide
  Seed: SPLQSPESA (MAGC1_HUMAN)
SPLQSPESF

SEQ ID NO: 73858 - protein, 11 aa, Artificial Sequence
  Description of Artificial Sequence: Synthetic peptide
  Seed: LSDEQGMSQNR (MAGC1_HUMAN)
LMDEQGMSQNY

SEQ ID NO: 73859 - protein, 9 aa, Artificial Sequence
  Description of Artificial Sequence: Synthetic peptide
  Seed: SSSTLLSLF (MAGC1_HUMAN)
SLSTLLSLF

SEQ ID NO: 73860 - protein, 10 aa, Artificial Sequence
  Description of Artificial Sequence: Synthetic peptide
  Seed: SSPERTHSTF (MAGC1_HUMAN)
SLPERTHSTY

SEQ ID NO: 73861 - protein, 10 aa, Artificial Sequence
  Description of Artificial Sequence: Synthetic peptide
  Seed: SSPERTQSTF (MAGC1_HUMAN)
SMPERTQSTI

SEQ ID NO: 73862 - protein, 9 aa, Artificial Sequence
  Description of Artificial Sequence: Synthetic peptide
  Seed: KRKVVEFLA (MAGC1_HUMAN)
KRKVVEFLF

SEQ ID NO: 73863 - protein, 9 aa, Artificial Sequence
  Description of Artificial Sequence: Synthetic peptide
  Seed: SIIFIKGTY (MAGC1_HUMAN)
SMIFIKGTF

SEQ ID NO: 73864 - protein, 9 aa, Artificial Sequence
  Description of Artificial Sequence: Synthetic peptide
  Seed: STQSPFEGF (MAGC1_HUMAN)
SYQSPFEGY

SEQ ID NO: 73865 - protein, 9 aa, Artificial Sequence
  Description of Artificial Sequence: Synthetic peptide
  Seed: SSSFSYTLL (MAGC1_HUMAN)
SASFSYTLF

SEQ ID NO: 73866 - protein, 9 aa, Artificial Sequence
  Description of Artificial Sequence: Synthetic peptide
  Seed: GFPQSPLQI (MAGC1_HUMAN)
GGPQSPLQM

SEQ ID NO: 73867 - protein, 11 aa, Artificial Sequence
  Description of Artificial Sequence: Synthetic peptide
  Seed: TTDDSTATESA (MAGC1_HUMAN)
TSDDSTATESY

SEQ ID NO: 73868 - protein, 9 aa, Artificial Sequence
  Description of Artificial Sequence: Synthetic peptide
  Seed: RAHSEVIKR (MAGC1_HUMAN)
RWHSEVIKY

SEQ ID NO: 73869 - protein, 9 aa, Artificial Sequence
  Description of Artificial Sequence: Synthetic peptide
  Seed: SSSSSSSTL (MAGC1_HUMAN)
SISSSSSTM

SEQ ID NO: 73870 - protein, 10 aa, Artificial Sequence
  Description of Artificial Sequence: Synthetic peptide
  Seed: WEDSLSPLHF (MAGC1_HUMAN)
WQDSLSPLHY

SEQ ID NO: 73871 - protein, 11 aa, Artificial Sequence
  Description of Artificial Sequence: Synthetic peptide
  Seed: SSTSLSLPQSF (MAGC1_HUMAN)
SMTSLSLPQSW

SEQ ID NO: 73872 - protein, 9 aa, Artificial Sequence
  Description of Artificial Sequence: Synthetic peptide
  Seed: SSFPSSTSS (MAGC1_HUMAN)
SMFPSSTSF

SEQ ID NO: 73873 - protein, 9 aa, Artificial Sequence
  Description of Artificial Sequence: Synthetic peptide
  Seed: IFRKAREFI (MAGC1_HUMAN)
IMRKAREFK

SEQ ID NO: 73874 - protein, 9 aa, Artificial Sequence
  Description of Artificial Sequence: Synthetic peptide
  Seed: GFPQSPLQI (MAGC1_HUMAN)
GVPQSPLQI

SEQ ID NO: 73875 - protein, 9 aa, Artificial Sequence
  Description of Artificial Sequence: Synthetic peptide
  Seed: FAFGEPREL (MAGC1_HUMAN)
FEFGEPREF

SEQ ID NO: 73876 - protein, 10 aa, Artificial Sequence
  Description of Artificial Sequence: Synthetic peptide
  Seed: ILILSIIFIK (MAGC1_HUMAN)
IRILSIIFIR

SEQ ID NO: 73877 - protein, 9 aa, Artificial Sequence
  Description of Artificial Sequence: Synthetic peptide
  Seed: FQSSLQSPV (MAGC1_HUMAN)
FQSSLQSPL

SEQ ID NO: 73878 - protein, 9 aa, Artificial Sequence
  Description of Artificial Sequence: Synthetic peptide
  Seed: LSPLHFPQF (MAGC1_HUMAN)
LSPLHFPQL

SEQ ID NO: 73879 - protein, 9 aa, Artificial Sequence
  Description of Artificial Sequence: Synthetic peptide
  Seed: FSSALLSIF (MAGC1_HUMAN)
FCSALLSIY

SEQ ID NO: 73880 - protein, 9 aa, Artificial Sequence
  Description of Artificial Sequence: Synthetic peptide
  Seed: LQIPVSAAS (MAGC1_HUMAN)
LLIPVSAAL

SEQ ID NO: 73881 - protein, 9 aa, Artificial Sequence
  Description of Artificial Sequence: Synthetic peptide
  Seed: YTLASLLQS (MAGC1_HUMAN)
YQLASLLQV

SEQ ID NO: 73882 - protein, 10 aa, Artificial Sequence
  Description of Artificial Sequence: Synthetic peptide
  Seed: ESAQSAFEGF (MAGC1_HUMAN)
EIAQSAFEGR

SEQ ID NO: 73883 - protein, 9 aa, Artificial Sequence
  Description of Artificial Sequence: Synthetic peptide
  Seed: FQSSLQSPV (MAGC1_HUMAN)
FISSLQSPT

SEQ ID NO: 73884 - protein, 10 aa, Artificial Sequence
  Description of Artificial Sequence: Synthetic peptide
  Seed: SSSSSSSTLL (MAGC1_HUMAN)
SESSSSSTLF

SEQ ID NO: 73885 - protein, 10 aa, Artificial Sequence
  Description of Artificial Sequence: Synthetic peptide
  Seed: VSSSSSSSTL (MAGC1_HUMAN)
VYSSSSSSTW

SEQ ID NO: 73886 - protein, 9 aa, Artificial Sequence
  Description of Artificial Sequence: Synthetic peptide
  Seed: KAREFIEIL (MAGC1_HUMAN)
KYREFIEIF

SEQ ID NO: 73887 - protein, 10 aa, Artificial Sequence
  Description of Artificial Sequence: Synthetic peptide
  Seed: VSPSSSSTLL (MAGC1_HUMAN)
VMPSSSSTLL

SEQ ID NO: 73888 - protein, 9 aa, Artificial Sequence
  Description of Artificial Sequence: Synthetic peptide
  Seed: LQIPGSPSF (MAGC1_HUMAN)
LLIPGSPSL

SEQ ID NO: 73889 - protein, 10 aa, Artificial Sequence
  Description of Artificial Sequence: Synthetic peptide
  Seed: RAGREHFAFG (MAGC1_HUMAN)
RYGREHFAFL

SEQ ID NO: 73890 - protein, 9 aa, Artificial Sequence
  Description of Artificial Sequence: Synthetic peptide
  Seed: GSPSFSSTL (MAGC1_HUMAN)
GQPSFSSTL

SEQ ID NO: 73891 - protein, 9 aa, Artificial Sequence
  Description of Artificial Sequence: Synthetic peptide
  Seed: GSPSFSSTL (MAGC1_HUMAN)
GVPSFSSTI

SEQ ID NO: 73892 - protein, 11 aa, Artificial Sequence
  Description of Artificial Sequence: Synthetic peptide
  Seed: SSSSSSTLLSL (MAGC1_HUMAN)
SFSSSSTLLSF

SEQ ID NO: 73893 - protein, 9 aa, Artificial Sequence
  Description of Artificial Sequence: Synthetic peptide
  Seed: KVDELARFL (MAGC1_HUMAN)
KYDELARFL

SEQ ID NO: 73894 - protein, 9 aa, Artificial Sequence
  Description of Artificial Sequence: Synthetic peptide
  Seed: ASSSTLVSI (MAGC1_HUMAN)
ALSSTLVSV

SEQ ID NO: 73895 - protein, 9 aa, Artificial Sequence
  Description of Artificial Sequence: Synthetic peptide
  Seed: LQIPMTSSF (MAGC1_HUMAN)
LNIPMTSSM

SEQ ID NO: 73896 - protein, 10 aa, Artificial Sequence
  Description of Artificial Sequence: Synthetic peptide
  Seed: LAMLKNTVPI (MAGC1_HUMAN)
LQMLKNTVPF

SEQ ID NO: 73897 - protein, 9 aa, Artificial Sequence
  Description of Artificial Sequence: Synthetic peptide
  Seed: LQIVPSLPE (MAGC1_HUMAN)
LSIVPSLPY

SEQ ID NO: 73898 - protein, 9 aa, Artificial Sequence
  Description of Artificial Sequence: Synthetic peptide
  Seed: SPLEISQSP (MAGC1_HUMAN)
SPLEISQSM

SEQ ID NO: 73899 - protein, 9 aa, Artificial Sequence
  Description of Artificial Sequence: Synthetic peptide
  Seed: SSSDTLLES (MAGC1_HUMAN)
SQSDTLLEM

SEQ ID NO: 73900 - protein, 9 aa, Artificial Sequence
  Description of Artificial Sequence: Synthetic peptide
  Seed: ASEEVIWDV (MAGC1_HUMAN)
ALEEVIWDA

SEQ ID NO: 73901 - protein, 9 aa, Artificial Sequence
  Description of Artificial Sequence: Synthetic peptide
  Seed: TSSFSSTLL (MAGC1_HUMAN)
TASFSSTLM

SEQ ID NO: 73902 - protein, 11 aa, Artificial Sequence
  Description of Artificial Sequence: Synthetic peptide
  Seed: SICSSSTSLSL (MAGC1_HUMAN)
SLCSSSTSLSL

SEQ ID NO: 73903 - protein, 10 aa, Artificial Sequence
  Description of Artificial Sequence: Synthetic peptide
  Seed: LLQIPMTSSF (MAGC1_HUMAN)
LLQIPMTSSL

SEQ ID NO: 73904 - protein, 9 aa, Artificial Sequence
  Description of Artificial Sequence: Synthetic peptide
  Seed: SSTSSSLSK (MAGC1_HUMAN)
SATSSSLSF

SEQ ID NO: 73905 - protein, 9 aa, Artificial Sequence
  Description of Artificial Sequence: Synthetic peptide
  Seed: TLDLTSEGC (MAGC1_HUMAN)
TTDLTSEGL

SEQ ID NO: 73906 - protein, 9 aa, Artificial Sequence
  Description of Artificial Sequence: Synthetic peptide
  Seed: EVDPDDSYV (MAGC1_HUMAN)
EIDPDDSYM

SEQ ID NO: 73907 - protein, 8 aa, Artificial Sequence
  Description of Artificial Sequence: Synthetic peptide
  Seed: HYLEYREV (MAGC1_HUMAN)
HFLEYREY

SEQ ID NO: 73908 - protein, 11 aa, Artificial Sequence
  Description of Artificial Sequence: Synthetic peptide
  Seed: SSTPSSLPQSF (MAGC1_HUMAN)
SVTPSSLPQSW

SEQ ID NO: 73909 - protein, 8 aa, Artificial Sequence
  Description of Artificial Sequence: Synthetic peptide
  Seed: SPLQIPQS (MAGC1_HUMAN)
SPLQIPQA

SEQ ID NO: 73910 - protein, 10 aa, Artificial Sequence
  Description of Artificial Sequence: Synthetic peptide
  Seed: WGPRAHSEVI (MAGC1_HUMAN)
WNPRAHSEVL

SEQ ID NO: 73911 - protein, 9 aa, Artificial Sequence
  Description of Artificial Sequence: Synthetic peptide
  Seed: SSPESTQSP (MAGC1_HUMAN)
SMPESTQSM

SEQ ID NO: 73912 - protein, 9 aa, Artificial Sequence
  Description of Artificial Sequence: Synthetic peptide
  Seed: VIKRKVVEF (MAGC1_HUMAN)
VAKRKVVEY

SEQ ID NO: 73913 - protein, 9 aa, Artificial Sequence
  Description of Artificial Sequence: Synthetic peptide
  Seed: SSPERTQST (MAGC1_HUMAN)
SRPERTQSM

SEQ ID NO: 73914 - protein, 11 aa, Artificial Sequence
  Description of Artificial Sequence: Synthetic peptide
  Seed: IPVSSSFSYTL (MAGC1_HUMAN)
ITVSSSFSYTY

SEQ ID NO: 73915 - protein, 10 aa, Artificial Sequence
  Description of Artificial Sequence: Synthetic peptide
  Seed: KVVEFLAMLK (MAGC1_HUMAN)
KSVEFLAMLV

SEQ ID NO: 73916 - protein, 11 aa, Artificial Sequence
  Description of Artificial Sequence: Synthetic peptide
  Seed: RPVSSFFSYTL (MAGC1_HUMAN)
RAVSSFFSYTM

SEQ ID NO: 73917 - protein, 10 aa, Artificial Sequence
  Description of Artificial Sequence: Synthetic peptide
  Seed: YTLDEKVDEL (MAGC1_HUMAN)
YCLDEKVDEL

SEQ ID NO: 73918 - protein, 10 aa, Artificial Sequence
  Description of Artificial Sequence: Synthetic peptide
  Seed: PLQIPVSSSF (MAGC1_HUMAN)
PSQIPVSSSF

SEQ ID NO: 73919 - protein, 9 aa, Artificial Sequence
  Description of Artificial Sequence: Synthetic peptide
  Seed: FEGFAQSPL (MAGC1_HUMAN)
FVGFAQSPF

SEQ ID NO: 73920 - protein, 9 aa, Artificial Sequence
  Description of Artificial Sequence: Synthetic peptide
  Seed: FAFGEPREL (MAGC1_HUMAN)
FPFGEPREY

SEQ ID NO: 73921 - protein, 11 aa, Artificial Sequence
  Description of Artificial Sequence: Synthetic peptide
  Seed: STFEGFAQSPL (MAGC1_HUMAN)
STFEGFAQSPY

SEQ ID NO: 73922 - protein, 10 aa, Artificial Sequence
  Description of Artificial Sequence: Synthetic peptide
  Seed: LAMLKNTVPI (MAGC1_HUMAN)
LWMLKNTVPF

SEQ ID NO: 73923 - protein, 9 aa, Artificial Sequence
  Description of Artificial Sequence: Synthetic peptide
  Seed: SSPECTQST (MAGC1_HUMAN)
SIPECTQSV

SEQ ID NO: 73924 - protein, 8 aa, Artificial Sequence
  Description of Artificial Sequence: Synthetic peptide
  Seed: RSFSSTLL (MAGC1_HUMAN)
RTFSSTLF

SEQ ID NO: 73925 - protein, 10 aa, Artificial Sequence
  Description of Artificial Sequence: Synthetic peptide
  Seed: STSLSLPQSF (MAGC1_HUMAN)
SCSLSLPQSW

SEQ ID NO: 73926 - protein, 9 aa, Artificial Sequence
  Description of Artificial Sequence: Synthetic peptide
  Seed: FSYTLLSLF (MAGC1_HUMAN)
FEYTLLSLY

SEQ ID NO: 73927 - protein, 10 aa, Artificial Sequence
  Description of Artificial Sequence: Synthetic peptide
  Seed: FAQSSLQIPV (MAGC1_HUMAN)
FWQSSLQIPV

SEQ ID NO: 73928 - protein, 10 aa, Artificial Sequence
  Description of Artificial Sequence: Synthetic peptide
  Seed: ASSFFSSALL (MAGC1_HUMAN)
ACSFFSSALW

SEQ ID NO: 73929 - protein, 9 aa, Artificial Sequence
  Description of Artificial Sequence: Synthetic peptide
  Seed: IIFIKGTYA (MAGC1_HUMAN)
ILFIKGTYA

SEQ ID NO: 73930 - protein, 9 aa, Artificial Sequence
  Description of Artificial Sequence: Synthetic peptide
  Seed: REFIEILFG (MAGC1_HUMAN)
REFIEILFV

SEQ ID NO: 73931 - protein, 9 aa, Artificial Sequence
  Description of Artificial Sequence: Synthetic peptide
  Seed: MLTNVISRY (MAGC1_HUMAN)
MSTNVISRI

SEQ ID NO: 73932 - protein, 9 aa, Artificial Sequence
  Description of Artificial Sequence: Synthetic peptide
  Seed: KVWVQEHYL (MAGC1_HUMAN)
KTWVQEHYR

SEQ ID NO: 73933 - protein, 9 aa, Artificial Sequence
  Description of Artificial Sequence: Synthetic peptide
  Seed: RTHSTFEGF (MAGC1_HUMAN)
RIHSTFEGR

SEQ ID NO: 73934 - protein, 9 aa, Artificial Sequence
  Description of Artificial Sequence: Synthetic peptide
  Seed: FAFGEPREL (MAGC1_HUMAN)
FHFGEPREA

SEQ ID NO: 73935 - protein, 9 aa, Artificial Sequence
  Description of Artificial Sequence: Synthetic peptide
  Seed: YTGYFPVIF (MAGC1_HUMAN)
YKGYFPVIM

SEQ ID NO: 73936 - protein, 10 aa, Artificial Sequence
  Description of Artificial Sequence: Synthetic peptide
  Seed: FPQSVLQIPV (MAGC1_HUMAN)
FPQSVLQIPM

SEQ ID NO: 73937 - protein, 10 aa, Artificial Sequence
  Description of Artificial Sequence: Synthetic peptide
  Seed: YTLDEKVDEL (MAGC1_HUMAN)
YRLDEKVDEV

SEQ ID NO: 73938 - protein, 9 aa, Artificial Sequence
  Description of Artificial Sequence: Synthetic peptide
  Seed: FSSTLLSIL (MAGC1_HUMAN)
FVSTLLSIV

SEQ ID NO: 73939 - protein, 9 aa, Artificial Sequence
  Description of Artificial Sequence: Synthetic peptide
  Seed: LSDEQGMSQ (MAGC1_HUMAN)
LTDEQGMSC

SEQ ID NO: 73940 - protein, 9 aa, Artificial Sequence
  Description of Artificial Sequence: Synthetic peptide
  Seed: SPPEGMHSQ (MAGC1_HUMAN)
SPPEGMHSL

SEQ ID NO: 73941 - protein, 9 aa, Artificial Sequence
  Description of Artificial Sequence: Synthetic peptide
  Seed: AQSPLQSPV (MAGC1_HUMAN)
ASSPLQSPF

SEQ ID NO: 73942 - protein, 9 aa, Artificial Sequence
  Description of Artificial Sequence: Synthetic peptide
  Seed: SSTSSSLSK (MAGC1_HUMAN)
STTSSSLSR

SEQ ID NO: 73943 - protein, 10 aa, Artificial Sequence
  Description of Artificial Sequence: Synthetic peptide
  Seed: AMLKNTVPIT (MAGC1_HUMAN)
ALLKNTVPIL

SEQ ID NO: 73944 - protein, 9 aa, Artificial Sequence
  Description of Artificial Sequence: Synthetic peptide
  Seed: LARFLLLKY (MAGC1_HUMAN)
LSRFLLLKM

SEQ ID NO: 73945 - protein, 11 aa, Artificial Sequence
  Description of Artificial Sequence: Synthetic peptide
  Seed: RSFSSTLLSIF (MAGC1_HUMAN)
RMFSSTLLSIY

SEQ ID NO: 73946 - protein, 9 aa, Artificial Sequence
  Description of Artificial Sequence: Synthetic peptide
  Seed: SSPESPLQS (MAGC1_HUMAN)
SCPESPLQI

SEQ ID NO: 73947 - protein, 10 aa, Artificial Sequence
  Description of Artificial Sequence: Synthetic peptide
  Seed: SSPERTHSTF (MAGC1_HUMAN)
SWPERTHSTY

SEQ ID NO: 73948 - protein, 9 aa, Artificial Sequence
  Description of Artificial Sequence: Synthetic peptide
  Seed: FLWGPRAHS (MAGC1_HUMAN)
FIWGPRAHI

SEQ ID NO: 73949 - protein, 9 aa, Artificial Sequence
  Description of Artificial Sequence: Synthetic peptide
  Seed: AQSSLQIPV (MAGC1_HUMAN)
AKSSLQIPY

SEQ ID NO: 73950 - protein, 9 aa, Artificial Sequence
  Description of Artificial Sequence: Synthetic peptide
  Seed: SPLQIPQSP (MAGC1_HUMAN)
SPLQIPQSA

SEQ ID NO: 73951 - protein, 9 aa, Artificial Sequence
  Description of Artificial Sequence: Synthetic peptide
  Seed: SPLQRPVSS (MAGC1_HUMAN)
SLLQRPVSV

SEQ ID NO: 73952 - protein, 8 aa, Artificial Sequence
  Description of Artificial Sequence: Synthetic peptide
  Seed: QSSPVSSF (MAGC1_HUMAN)
QYSPVSSY

SEQ ID NO: 73953 - protein, 9 aa, Artificial Sequence
  Description of Artificial Sequence: Synthetic peptide
  Seed: SLTDSESLI (MAGC1_HUMAN)
SQTDSESLL

SEQ ID NO: 73954 - protein, 11 aa, Artificial Sequence
  Description of Artificial Sequence: Synthetic peptide
  Seed: SSFPSSTSSSL (MAGC1_HUMAN)
SYFPSSTSSSL

SEQ ID NO: 73955 - protein, 9 aa, Artificial Sequence
  Description of Artificial Sequence: Synthetic peptide
  Seed: DPDDSYVFV (MAGC1_HUMAN)
DTDDSYVFL

SEQ ID NO: 73956 - protein, 10 aa, Artificial Sequence
  Description of Artificial Sequence: Synthetic peptide
  Seed: SSPESAQSAF (MAGC1_HUMAN)
SPPESAQSAL

SEQ ID NO: 73957 - protein, 9 aa, Artificial Sequence
  Description of Artificial Sequence: Synthetic peptide
  Seed: IEILFGISL (MAGC1_HUMAN)
IEILFGISY

SEQ ID NO: 73958 - protein, 9 aa, Artificial Sequence
  Description of Artificial Sequence: Synthetic peptide
  Seed: MPSLLQSSS (MAGC1_HUMAN)
MVSLLQSSF

SEQ ID NO: 73959 - protein, 10 aa, Artificial Sequence
  Description of Artificial Sequence: Synthetic peptide
  Seed: SSFSYTLLSL (MAGC1_HUMAN)
SQFSYTLLSL

SEQ ID NO: 73960 - protein, 9 aa, Artificial Sequence
  Description of Artificial Sequence: Synthetic peptide
  Seed: TSLSLPQSF (MAGC1_HUMAN)
TYLSLPQSY

SEQ ID NO: 73961 - protein, 9 aa, Artificial Sequence
  Description of Artificial Sequence: Synthetic peptide
  Seed: WVQEHYLEY (MAGC1_HUMAN)
WTQEHYLER

SEQ ID NO: 73962 - protein, 10 aa, Artificial Sequence
  Description of Artificial Sequence: Synthetic peptide
  Seed: ASSSVMSPSF (MAGC1_HUMAN)
AGSSVMSPSW

SEQ ID NO: 73963 - protein, 11 aa, Artificial Sequence
  Description of Artificial Sequence: Synthetic peptide
  Seed: TTDDSTATESA (MAGC1_HUMAN)
TLDDSTATESI

SEQ ID NO: 73964 - protein, 9 aa, Artificial Sequence
  Description of Artificial Sequence: Synthetic peptide
  Seed: SIIFIKGTY (MAGC1_HUMAN)
SFIFIKGTY

SEQ ID NO: 73965 - protein, 9 aa, Artificial Sequence
  Description of Artificial Sequence: Synthetic peptide
  Seed: SPPEGENTH (MAGC1_HUMAN)
SIPEGENTF

SEQ ID NO: 73966 - protein, 10 aa, Artificial Sequence
  Description of Artificial Sequence: Synthetic peptide
  Seed: PLQIPMTSSF (MAGC1_HUMAN)
PSQIPMTSSY

SEQ ID NO: 73967 - protein, 10 aa, Artificial Sequence
  Description of Artificial Sequence: Synthetic peptide
  Seed: VPITFPSSYK (MAGC1_HUMAN)
VFITFPSSYR

SEQ ID NO: 73968 - protein, 9 aa, Artificial Sequence
  Description of Artificial Sequence: Synthetic peptide
  Seed: GFPQSPLQI (MAGC1_HUMAN)
GIPQSPLQM

SEQ ID NO: 73969 - protein, 10 aa, Artificial Sequence
  Description of Artificial Sequence: Synthetic peptide
  Seed: YTLDEKVDEL (MAGC1_HUMAN)
YLLDEKVDEL

SEQ ID NO: 73970 - protein, 9 aa, Artificial Sequence
  Description of Artificial Sequence: Synthetic peptide
  Seed: FSSTLVSLF (MAGC1_HUMAN)
FWSTLVSLI

SEQ ID NO: 73971 - protein, 11 aa, Artificial Sequence
  Description of Artificial Sequence: Synthetic peptide
  Seed: STFEGFPQSLL (MAGC1_HUMAN)
SMFEGFPQSLE

SEQ ID NO: 73972 - protein, 11 aa, Artificial Sequence
  Description of Artificial Sequence: Synthetic peptide
  Seed: FLAMLKNTVPI (MAGC1_HUMAN)
FIAMLKNTVPA

SEQ ID NO: 73973 - protein, 9 aa, Artificial Sequence
  Description of Artificial Sequence: Synthetic peptide
  Seed: FFSYTLASL (MAGC1_HUMAN)
FQSYTLASM

SEQ ID NO: 73974 - protein, 10 aa, Artificial Sequence
  Description of Artificial Sequence: Synthetic peptide
  Seed: MTSSFSSTLL (MAGC1_HUMAN)
MKSSFSSTLF

SEQ ID NO: 73975 - protein, 11 aa, Artificial Sequence
  Description of Artificial Sequence: Synthetic peptide
  Seed: STFEGFPQSLL (MAGC1_HUMAN)
SSFEGFPQSLY

SEQ ID NO: 73976 - protein, 10 aa, Artificial Sequence
  Description of Artificial Sequence: Synthetic peptide
  Seed: VSSSFSYTLL (MAGC1_HUMAN)
VISSFSYTLW

SEQ ID NO: 73977 - protein, 10 aa, Artificial Sequence
  Description of Artificial Sequence: Synthetic peptide
  Seed: LSQSSPVSSF (MAGC1_HUMAN)
LPQSSPVSSF

SEQ ID NO: 73978 - protein, 9 aa, Artificial Sequence
  Description of Artificial Sequence: Synthetic peptide
  Seed: MTSSFSSTL (MAGC1_HUMAN)
MQSSFSSTV

SEQ ID NO: 73979 - protein, 9 aa, Artificial Sequence
  Description of Artificial Sequence: Synthetic peptide
  Seed: LQIPVSAAS (MAGC1_HUMAN)
LAIPVSAAF

SEQ ID NO: 73980 - protein, 10 aa, Artificial Sequence
  Description of Artificial Sequence: Synthetic peptide
  Seed: NPASSFFSSA (MAGC1_HUMAN)
NLASSFFSSV

SEQ ID NO: 73981 - protein, 9 aa, Artificial Sequence
  Description of Artificial Sequence: Synthetic peptide
  Seed: FSSTLVSLF (MAGC1_HUMAN)
FASTLVSLW

SEQ ID NO: 73982 - protein, 9 aa, Artificial Sequence
  Description of Artificial Sequence: Synthetic peptide
  Seed: VSAASSSTL (MAGC1_HUMAN)
VSAASSSTW

SEQ ID NO: 73983 - protein, 11 aa, Artificial Sequence
  Description of Artificial Sequence: Synthetic peptide
  Seed: IPVSAASSSTL (MAGC1_HUMAN)
IAVSAASSSTY

SEQ ID NO: 73984 - protein, 10 aa, Artificial Sequence
  Description of Artificial Sequence: Synthetic peptide
  Seed: VSSSSSSSTL (MAGC1_HUMAN)
VKSSSSSSTY

SEQ ID NO: 73985 - protein, 10 aa, Artificial Sequence
  Description of Artificial Sequence: Synthetic peptide
  Seed: SRYTGYFPVI (MAGC1_HUMAN)
SEYTGYFPVW

SEQ ID NO: 73986 - protein, 9 aa, Artificial Sequence
  Description of Artificial Sequence: Synthetic peptide
  Seed: SAPEGEDSL (MAGC1_HUMAN)
SQPEGEDSY

SEQ ID NO: 73987 - protein, 9 aa, Artificial Sequence
  Description of Artificial Sequence: Synthetic peptide
  Seed: SLSPHYFPQ (MAGC1_HUMAN)
SASPHYFPR

SEQ ID NO: 73988 - protein, 10 aa, Artificial Sequence
  Description of Artificial Sequence: Synthetic peptide
  Seed: LQIPMTSSFS (MAGC1_HUMAN)
LEIPMTSSFY

SEQ ID NO: 73989 - protein, 10 aa, Artificial Sequence
  Description of Artificial Sequence: Synthetic peptide
  Seed: ILFGISLREV (MAGC1_HUMAN)
IMFGISLREV

SEQ ID NO: 73990 - protein, 10 aa, Artificial Sequence
  Description of Artificial Sequence: Synthetic peptide
  Seed: SSPESTQSPF (MAGC1_HUMAN)
SPPESTQSPL

SEQ ID NO: 73991 - protein, 10 aa, Artificial Sequence
  Description of Artificial Sequence: Synthetic peptide
  Seed: KAREFIEILF (MAGC1_HUMAN)
KVREFIEILW

SEQ ID NO: 73992 - protein, 9 aa, Artificial Sequence
  Description of Artificial Sequence: Synthetic peptide
  Seed: RLLILILSI (MAGC1_HUMAN)
RVLILILSR

SEQ ID NO: 73993 - protein, 9 aa, Artificial Sequence
  Description of Artificial Sequence: Synthetic peptide
  Seed: SASSSVMSP (MAGC1_HUMAN)
SSSSSVMSL

SEQ ID NO: 73994 - protein, 11 aa, Artificial Sequence
  Description of Artificial Sequence: Synthetic peptide
  Seed: QSSPERTHSTF (MAGC1_HUMAN)
QASPERTHSTW

SEQ ID NO: 73995 - protein, 9 aa, Artificial Sequence
  Description of Artificial Sequence: Synthetic peptide
  Seed: SPLQRPVSS (MAGC1_HUMAN)
SMLQRPVSM

SEQ ID NO: 73996 - protein, 10 aa, Artificial Sequence
  Description of Artificial Sequence: Synthetic peptide
  Seed: FFSSALLSIF (MAGC1_HUMAN)
FFSSALLSIW

SEQ ID NO: 73997 - protein, 9 aa, Artificial Sequence
  Description of Artificial Sequence: Synthetic peptide
  Seed: ISFSSSTSL (MAGC1_HUMAN)
IRFSSSTSY

SEQ ID NO: 73998 - protein, 9 aa, Artificial Sequence
  Description of Artificial Sequence: Synthetic peptide
  Seed: SSFFSYTLA (MAGC1_HUMAN)
SLFFSYTLV

SEQ ID NO: 73999 - protein, 10 aa, Artificial Sequence
  Description of Artificial Sequence: Synthetic peptide
  Seed: SSSSTLLSLF (MAGC1_HUMAN)
SLSSTLLSLW

SEQ ID NO: 74000 - protein, 10 aa, Artificial Sequence
  Description of Artificial Sequence: Synthetic peptide
  Seed: SRYTGYFPVI (MAGC1_HUMAN)
SVYTGYFPVW

SEQ ID NO: 74001 - protein, 11 aa, Artificial Sequence
  Description of Artificial Sequence: Synthetic peptide
  Seed: IPVSAASSSTL (MAGC1_HUMAN)
IAVSAASSSTL

SEQ ID NO: 74002 - protein, 9 aa, Artificial Sequence
  Description of Artificial Sequence: Synthetic peptide
  Seed: EILFGISLR (MAGC1_HUMAN)
EMLFGISLR

SEQ ID NO: 74003 - protein, 9 aa, Artificial Sequence
  Description of Artificial Sequence: Synthetic peptide
  Seed: YTGYFPVIF (MAGC1_HUMAN)
YMGYFPVIM

SEQ ID NO: 74004 - protein, 9 aa, Artificial Sequence
  Description of Artificial Sequence: Synthetic peptide
  Seed: LQIVPSLPE (MAGC1_HUMAN)
LVIVPSLPF

SEQ ID NO: 74005 - protein, 9 aa, Artificial Sequence
  Description of Artificial Sequence: Synthetic peptide
  Seed: TLLSLFQSF (MAGC1_HUMAN)
TILSLFQSK

SEQ ID NO: 74006 - protein, 10 aa, Artificial Sequence
  Description of Artificial Sequence: Synthetic peptide
  Seed: YTLASLLQSS (MAGC1_HUMAN)
YALASLLQSA

SEQ ID NO: 74007 - protein, 11 aa, Artificial Sequence
  Description of Artificial Sequence: Synthetic peptide
  Seed: SSFSYTLLSLF (MAGC1_HUMAN)
SFFSYTLLSLW

SEQ ID NO: 74008 - protein, 9 aa, Artificial Sequence
  Description of Artificial Sequence: Synthetic peptide
  Seed: GYFPVIFRK (MAGC1_HUMAN)
GSFPVIFRR

SEQ ID NO: 74009 - protein, 10 aa, Artificial Sequence
  Description of Artificial Sequence: Synthetic peptide
  Seed: WGPRAHSEVI (MAGC1_HUMAN)
WCPRAHSEVI

SEQ ID NO: 74010 - protein, 10 aa, Artificial Sequence
  Description of Artificial Sequence: Synthetic peptide
  Seed: FPQSLLQIPM (MAGC1_HUMAN)
FMQSLLQIPL

SEQ ID NO: 74011 - protein, 9 aa, Artificial Sequence
  Description of Artificial Sequence: Synthetic peptide
  Seed: SSSVMSPSF (MAGC1_HUMAN)
SHSVMSPSF

SEQ ID NO: 74012 - protein, 9 aa, Artificial Sequence
  Description of Artificial Sequence: Synthetic peptide
  Seed: AQSPLQIPV (MAGC1_HUMAN)
ASSPLQIPF

SEQ ID NO: 74013 - protein, 10 aa, Artificial Sequence
  Description of Artificial Sequence: Synthetic peptide
  Seed: SPLQRPVSSF (MAGC1_HUMAN)
SLLQRPVSSY

SEQ ID NO: 74014 - protein, 11 aa, Artificial Sequence
  Description of Artificial Sequence: Synthetic peptide
  Seed: SSFSYTLLSLF (MAGC1_HUMAN)
SEFSYTLLSLY

SEQ ID NO: 74015 - protein, 9 aa, Artificial Sequence
  Description of Artificial Sequence: Synthetic peptide
  Seed: FPESPQSPP (MAGC1_HUMAN)
FPESPQSPV

SEQ ID NO: 74016 - protein, 9 aa, Artificial Sequence
  Description of Artificial Sequence: Synthetic peptide
  Seed: VLSGIGVRA (MAGC1_HUMAN)
VVSGIGVRL

SEQ ID NO: 74017 - protein, 11 aa, Artificial Sequence
  Description of Artificial Sequence: Synthetic peptide
  Seed: VSSSSSSSTLL (MAGC1_HUMAN)
VRSSSSSSTLW

SEQ ID NO: 74018 - protein, 9 aa, Artificial Sequence
  Description of Artificial Sequence: Synthetic peptide
  Seed: MLTNVISRY (MAGC1_HUMAN)
MQTNVISRM

SEQ ID NO: 74019 - protein, 9 aa, Artificial Sequence
  Description of Artificial Sequence: Synthetic peptide
  Seed: SPLQRPVSS (MAGC1_HUMAN)
SALQRPVSM

SEQ ID NO: 74020 - protein, 10 aa, Artificial Sequence
  Description of Artificial Sequence: Synthetic peptide
  Seed: LAMLKNTVPI (MAGC1_HUMAN)
LPMLKNTVPY

SEQ ID NO: 74021 - protein, 9 aa, Artificial Sequence
  Description of Artificial Sequence: Synthetic peptide
  Seed: AQSPLQRPV (MAGC1_HUMAN)
AASPLQRPL

SEQ ID NO: 74022 - protein, 9 aa, Artificial Sequence
  Description of Artificial Sequence: Synthetic peptide
  Seed: SFSSTLVSL (MAGC1_HUMAN)
SMSSTLVSY

SEQ ID NO: 74023 - protein, 10 aa, Artificial Sequence
  Description of Artificial Sequence: Synthetic peptide
  Seed: VSRSFSSTLL (MAGC1_HUMAN)
VSRSFSSTLK

SEQ ID NO: 74024 - protein, 9 aa, Artificial Sequence
  Description of Artificial Sequence: Synthetic peptide
  Seed: LKNTVPITF (MAGC1_HUMAN)
LGNTVPITY

SEQ ID NO: 74025 - protein, 10 aa, Artificial Sequence
  Description of Artificial Sequence: Synthetic peptide
  Seed: SSPESAQSAF (MAGC1_HUMAN)
SFPESAQSAL

SEQ ID NO: 74026 - protein, 10 aa, Artificial Sequence
  Description of Artificial Sequence: Synthetic peptide
  Seed: RAGREHFAFG (MAGC1_HUMAN)
RLGREHFAFL

SEQ ID NO: 74027 - protein, 9 aa, Artificial Sequence
  Description of Artificial Sequence: Synthetic peptide
  Seed: GEDSMSPLY (MAGC1_HUMAN)
GEDSMSPLI

SEQ ID NO: 74028 - protein, 9 aa, Artificial Sequence
  Description of Artificial Sequence: Synthetic peptide
  Seed: VSRSFSSTL (MAGC1_HUMAN)
VVRSFSSTL

SEQ ID NO: 74029 - protein, 10 aa, Artificial Sequence
  Description of Artificial Sequence: Synthetic peptide
  Seed: SRYTGYFPVI (MAGC1_HUMAN)
SKYTGYFPVL

SEQ ID NO: 74030 - protein, 10 aa, Artificial Sequence
  Description of Artificial Sequence: Synthetic peptide
  Seed: SVLQIPVSAA (MAGC1_HUMAN)
SLLQIPVSAV

SEQ ID NO: 74031 - protein, 9 aa, Artificial Sequence
  Description of Artificial Sequence: Synthetic peptide
  Seed: ALLSIFQSS (MAGC1_HUMAN)
ALLSIFQSI

SEQ ID NO: 74032 - protein, 8 aa, Artificial Sequence
  Description of Artificial Sequence: Synthetic peptide
  Seed: LLILILSI (MAGC1_HUMAN)
LQILILSV

SEQ ID NO: 74033 - protein, 10 aa, Artificial Sequence
  Description of Artificial Sequence: Synthetic peptide
  Seed: VISFSSSTSL (MAGC1_HUMAN)
VISFSSSTSM

SEQ ID NO: 74034 - protein, 10 aa, Artificial Sequence
  Description of Artificial Sequence: Synthetic peptide
  Seed: SSPERTHSTF (MAGC1_HUMAN)
SIPERTHSTF

SEQ ID NO: 74035 - protein, 9 aa, Artificial Sequence
  Description of Artificial Sequence: Synthetic peptide
  Seed: SPHYFPQSP (MAGC1_HUMAN)
SPHYFPQST

SEQ ID NO: 74036 - protein, 9 aa, Artificial Sequence
  Description of Artificial Sequence: Synthetic peptide
  Seed: IPVSPSFSS (MAGC1_HUMAN)
IPVSPSFSI

SEQ ID NO: 74037 - protein, 9 aa, Artificial Sequence
  Description of Artificial Sequence: Synthetic peptide
  Seed: TGYFPVIFR (MAGC1_HUMAN)
TMYFPVIFR

SEQ ID NO: 74038 - protein, 9 aa, Artificial Sequence
  Description of Artificial Sequence: Synthetic peptide
  Seed: REVDPDDSY (MAGC1_HUMAN)
RIVDPDDSI

SEQ ID NO: 74039 - protein, 9 aa, Artificial Sequence
  Description of Artificial Sequence: Synthetic peptide
  Seed: SPLQIPMTS (MAGC1_HUMAN)
SQLQIPMTI

SEQ ID NO: 74040 - protein, 9 aa, Artificial Sequence
  Description of Artificial Sequence: Synthetic peptide
  Seed: VSAASSSTL (MAGC1_HUMAN)
VIAASSSTF

SEQ ID NO: 74041 - protein, 9 aa, Artificial Sequence
  Description of Artificial Sequence: Synthetic peptide
  Seed: ISFSSSTSL (MAGC1_HUMAN)
ITFSSSTSR

SEQ ID NO: 74042 - protein, 9 aa, Artificial Sequence
  Description of Artificial Sequence: Synthetic peptide
  Seed: LKYQVKQPI (MAGC1_HUMAN)
LAYQVKQPF

SEQ ID NO: 74043 - protein, 8 aa, Artificial Sequence
  Description of Artificial Sequence: Synthetic peptide
  Seed: LQIPQSPL (MAGC1_HUMAN)
LMIPQSPY

SEQ ID NO: 74044 - protein, 9 aa, Artificial Sequence
  Description of Artificial Sequence: Synthetic peptide
  Seed: GYFPVIFRK (MAGC1_HUMAN)
GTFPVIFRY

SEQ ID NO: 74045 - protein, 10 aa, Artificial Sequence
  Description of Artificial Sequence: Synthetic peptide
  Seed: KAREFIEILF (MAGC1_HUMAN)
KIREFIEILA

SEQ ID NO: 74046 - protein, 8 aa, Artificial Sequence
  Description of Artificial Sequence: Synthetic peptide
  Seed: LQIPVSAA (MAGC1_HUMAN)
LQIPVSAL

SEQ ID NO: 74047 - protein, 9 aa, Artificial Sequence
  Description of Artificial Sequence: Synthetic peptide
  Seed: RLLILILSI (MAGC1_HUMAN)
RLLILILSW

SEQ ID NO: 74048 - protein, 10 aa, Artificial Sequence
  Description of Artificial Sequence: Synthetic peptide
  Seed: SSFSSTLLSI (MAGC1_HUMAN)
SQFSSTLLSV

SEQ ID NO: 74049 - protein, 10 aa, Artificial Sequence
  Description of Artificial Sequence: Synthetic peptide
  Seed: SLFQSFSERT (MAGC1_HUMAN)
SLFQSFSERA

SEQ ID NO: 74050 - protein, 9 aa, Artificial Sequence
  Description of Artificial Sequence: Synthetic peptide
  Seed: FSYTLASLL (MAGC1_HUMAN)
FAYTLASLF

SEQ ID NO: 74051 - protein, 10 aa, Artificial Sequence
  Description of Artificial Sequence: Synthetic peptide
  Seed: MTSSFSSTLL (MAGC1_HUMAN)
MTSSFSSTLF

SEQ ID NO: 74052 - protein, 10 aa, Artificial Sequence
  Description of Artificial Sequence: Synthetic peptide
  Seed: WEDSLSPLHF (MAGC1_HUMAN)
WQDSLSPLHF

SEQ ID NO: 74053 - protein, 9 aa, Artificial Sequence
  Description of Artificial Sequence: Synthetic peptide
  Seed: MLTNVISRY (MAGC1_HUMAN)
MFTNVISRY

SEQ ID NO: 74054 - protein, 9 aa, Artificial Sequence
  Description of Artificial Sequence: Synthetic peptide
  Seed: ASSSTLVSI (MAGC1_HUMAN)
ALSSTLVST

SEQ ID NO: 74055 - protein, 10 aa, Artificial Sequence
  Description of Artificial Sequence: Synthetic peptide
  Seed: VSSSFSYTLL (MAGC1_HUMAN)
VMSSFSYTLW

SEQ ID NO: 74056 - protein, 9 aa, Artificial Sequence
  Description of Artificial Sequence: Synthetic peptide
  Seed: LEYREVPNS (MAGC1_HUMAN)
LEYREVPNI

SEQ ID NO: 74057 - protein, 10 aa, Artificial Sequence
  Description of Artificial Sequence: Synthetic peptide
  Seed: NSSPPRYEFL (MAGC1_HUMAN)
NTSPPRYEFV

SEQ ID NO: 74058 - protein, 9 aa, Artificial Sequence
  Description of Artificial Sequence: Synthetic peptide
  Seed: LSDEQGMSQ (MAGC1_HUMAN)
LIDEQGMSI

SEQ ID NO: 74059 - protein, 8 aa, Artificial Sequence
  Description of Artificial Sequence: Synthetic peptide
  Seed: IWDVLSGI (MAGC1_HUMAN)
IADVLSGL

SEQ ID NO: 74060 - protein, 9 aa, Artificial Sequence
  Description of Artificial Sequence: Synthetic peptide
  Seed: KDSQSPLQI (MAGC1_HUMAN)
KISQSPLQL

SEQ ID NO: 74061 - protein, 9 aa, Artificial Sequence
  Description of Artificial Sequence: Synthetic peptide
  Seed: SSLSQSSPV (MAGC1_HUMAN)
STLSQSSPW

SEQ ID NO: 74062 - protein, 9 aa, Artificial Sequence
  Description of Artificial Sequence: Synthetic peptide
  Seed: IPVSPSSSS (MAGC1_HUMAN)
IPVSPSSSI

SEQ ID NO: 74063 - protein, 9 aa, Artificial Sequence
  Description of Artificial Sequence: Synthetic peptide
  Seed: YTLLSLFQS (MAGC1_HUMAN)
YVLLSLFQI

SEQ ID NO: 74064 - protein, 10 aa, Artificial Sequence
  Description of Artificial Sequence: Synthetic peptide
  Seed: SLQIPVSPSF (MAGC1_HUMAN)
SQQIPVSPSF

SEQ ID NO: 74065 - protein, 10 aa, Artificial Sequence
  Description of Artificial Sequence: Synthetic peptide
  Seed: REHFAFGEPR (MAGC1_HUMAN)
RQHFAFGEPR

SEQ ID NO: 74066 - protein, 10 aa, Artificial Sequence
  Description of Artificial Sequence: Synthetic peptide
  Seed: YTLDEKVDEL (MAGC1_HUMAN)
YVLDEKVDEY

SEQ ID NO: 74067 - protein, 11 aa, Artificial Sequence
  Description of Artificial Sequence: Synthetic peptide
  Seed: SLSQSSPVSSF (MAGC1_HUMAN)
STSQSSPVSSY

SEQ ID NO: 74068 - protein, 10 aa, Artificial Sequence
  Description of Artificial Sequence: Synthetic peptide
  Seed: MLTNVISRYT (MAGC1_HUMAN)
MITNVISRYV

SEQ ID NO: 74069 - protein, 9 aa, Artificial Sequence
  Description of Artificial Sequence: Synthetic peptide
  Seed: VSSFFSYTL (MAGC1_HUMAN)
VVSFFSYTW

SEQ ID NO: 74070 - protein, 9 aa, Artificial Sequence
  Description of Artificial Sequence: Synthetic peptide
  Seed: SSFFSSALL (MAGC1_HUMAN)
SLFFSSALY

SEQ ID NO: 74071 - protein, 9 aa, Artificial Sequence
  Description of Artificial Sequence: Synthetic peptide
  Seed: LQIPVSRSF (MAGC1_HUMAN)
LKIPVSRSM

SEQ ID NO: 74072 - protein, 10 aa, Artificial Sequence
  Description of Artificial Sequence: Synthetic peptide
  Seed: REFIEILFGI (MAGC1_HUMAN)
RVFIEILFGL

SEQ ID NO: 74073 - protein, 10 aa, Artificial Sequence
  Description of Artificial Sequence: Synthetic peptide
  Seed: VSSSFSYTLL (MAGC1_HUMAN)
VYSSFSYTLW

SEQ ID NO: 74074 - protein, 10 aa, Artificial Sequence
  Description of Artificial Sequence: Synthetic peptide
  Seed: QIPVSSSFSY (MAGC1_HUMAN)
QPPVSSSFSY

SEQ ID NO: 74075 - protein, 9 aa, Artificial Sequence
  Description of Artificial Sequence: Synthetic peptide
  Seed: FQSSLQSPV (MAGC1_HUMAN)
FISSLQSPI

SEQ ID NO: 74076 - protein, 10 aa, Artificial Sequence
  Description of Artificial Sequence: Synthetic peptide
  Seed: WEDSLSPHYF (MAGC1_HUMAN)
WADSLSPHYM

SEQ ID NO: 74077 - protein, 10 aa, Artificial Sequence
  Description of Artificial Sequence: Synthetic peptide
  Seed: MLKNTVPITF (MAGC1_HUMAN)
MYKNTVPITM

SEQ ID NO: 74078 - protein, 9 aa, Artificial Sequence
  Description of Artificial Sequence: Synthetic peptide
  Seed: VSRSFSSTL (MAGC1_HUMAN)
VVRSFSSTW

SEQ ID NO: 74079 - protein, 9 aa, Artificial Sequence
  Description of Artificial Sequence: Synthetic peptide
  Seed: SQSPPEGPV (MAGC1_HUMAN)
STSPPEGPL

SEQ ID NO: 74080 - protein, 9 aa, Artificial Sequence
  Description of Artificial Sequence: Synthetic peptide
  Seed: RKAREFIEI (MAGC1_HUMAN)
RKAREFIEL

SEQ ID NO: 74081 - protein, 9 aa, Artificial Sequence
  Description of Artificial Sequence: Synthetic peptide
  Seed: FAFGEPREL (MAGC1_HUMAN)
FQFGEPREF

SEQ ID NO: 74082 - protein, 9 aa, Artificial Sequence
  Description of Artificial Sequence: Synthetic peptide
  Seed: RSFSSTLLS (MAGC1_HUMAN)
RNFSSTLLK

SEQ ID NO: 74083 - protein, 9 aa, Artificial Sequence
  Description of Artificial Sequence: Synthetic peptide
  Seed: RSFSSTLLS (MAGC1_HUMAN)
RFFSSTLLW

SEQ ID NO: 74084 - protein, 9 aa, Artificial Sequence
  Description of Artificial Sequence: Synthetic peptide
  Seed: DELARFLLL (MAGC1_HUMAN)
DRLARFLLM

SEQ ID NO: 74085 - protein, 10 aa, Artificial Sequence
  Description of Artificial Sequence: Synthetic peptide
  Seed: RFLLLKYQVK (MAGC1_HUMAN)
RFLLLKYQVR

SEQ ID NO: 74086 - protein, 8 aa, Artificial Sequence
  Description of Artificial Sequence: Synthetic peptide
  Seed: FGISLREV (MAGC1_HUMAN)
FAISLREL

SEQ ID NO: 74087 - protein, 10 aa, Artificial Sequence
  Description of Artificial Sequence: Synthetic peptide
  Seed: FPQSPLQIPV (MAGC1_HUMAN)
FAQSPLQIPY

SEQ ID NO: 74088 - protein, 10 aa, Artificial Sequence
  Description of Artificial Sequence: Synthetic peptide
  Seed: ELARFLLLKY (MAGC1_HUMAN)
ETARFLLLKR

SEQ ID NO: 74089 - protein, 9 aa, Artificial Sequence
  Description of Artificial Sequence: Synthetic peptide
  Seed: SSSTLLSLF (MAGC1_HUMAN)
SLSTLLSLW

SEQ ID NO: 74090 - protein, 9 aa, Artificial Sequence
  Description of Artificial Sequence: Synthetic peptide
  Seed: SSFPSSTSS (MAGC1_HUMAN)
SMFPSSTSY

SEQ ID NO: 74091 - protein, 10 aa, Artificial Sequence
  Description of Artificial Sequence: Synthetic peptide
  Seed: YTLDEKVDEL (MAGC1_HUMAN)
YQLDEKVDEM

SEQ ID NO: 74092 - protein, 9 aa, Artificial Sequence
  Description of Artificial Sequence: Synthetic peptide
  Seed: SSTSSSLSK (MAGC1_HUMAN)
SSTSSSLSM

SEQ ID NO: 74093 - protein, 9 aa, Artificial Sequence
  Description of Artificial Sequence: Synthetic peptide
  Seed: SLPEWEDSL (MAGC1_HUMAN)
SAPEWEDSM

SEQ ID NO: 74094 - protein, 11 aa, Artificial Sequence
  Description of Artificial Sequence: Synthetic peptide
  Seed: DEYTSSSDTLL (MAGC1_HUMAN)
DEYTSSSDTLW

SEQ ID NO: 74095 - protein, 9 aa, Artificial Sequence
  Description of Artificial Sequence: Synthetic peptide
  Seed: SPLQRPVSS (MAGC1_HUMAN)
SALQRPVSV

SEQ ID NO: 74096 - protein, 9 aa, Artificial Sequence
  Description of Artificial Sequence: Synthetic peptide
  Seed: IFRKAREFI (MAGC1_HUMAN)
IYRKAREFL

SEQ ID NO: 74097 - protein, 9 aa, Artificial Sequence
  Description of Artificial Sequence: Synthetic peptide
  Seed: KAREFIEIL (MAGC1_HUMAN)
KLREFIEIR

SEQ ID NO: 74098 - protein, 9 aa, Artificial Sequence
  Description of Artificial Sequence: Synthetic peptide
  Seed: AQSPLQRPV (MAGC1_HUMAN)
ALSPLQRPF

SEQ ID NO: 74099 - protein, 11 aa, Artificial Sequence
  Description of Artificial Sequence: Synthetic peptide
  Seed: SFFSYTLASLL (MAGC1_HUMAN)
SFFSYTLASLW

SEQ ID NO: 74100 - protein, 10 aa, Artificial Sequence
  Description of Artificial Sequence: Synthetic peptide
  Seed: PLQIPMTSSF (MAGC1_HUMAN)
PCQIPMTSSF

SEQ ID NO: 74101 - protein, 9 aa, Artificial Sequence
  Description of Artificial Sequence: Synthetic peptide
  Seed: SLFQSFSER (MAGC1_HUMAN)
SVFQSFSEM

SEQ ID NO: 74102 - protein, 10 aa, Artificial Sequence
  Description of Artificial Sequence: Synthetic peptide
  Seed: SLIESEPLFT (MAGC1_HUMAN)
SLIESEPLFA

SEQ ID NO: 74103 - protein, 10 aa, Artificial Sequence
  Description of Artificial Sequence: Synthetic peptide
  Seed: WEDSLSPHYF (MAGC1_HUMAN)
WIDSLSPHYM

SEQ ID NO: 74104 - protein, 10 aa, Artificial Sequence
  Description of Artificial Sequence: Synthetic peptide
  Seed: SSPERTQSTF (MAGC1_HUMAN)
SYPERTQSTM

SEQ ID NO: 74105 - protein, 10 aa, Artificial Sequence
  Description of Artificial Sequence: Synthetic peptide
  Seed: VSSSSSSTLL (MAGC1_HUMAN)
VLSSSSSTLW

SEQ ID NO: 74106 - protein, 9 aa, Artificial Sequence
  Description of Artificial Sequence: Synthetic peptide
  Seed: EDSLSPLQI (MAGC1_HUMAN)
EESLSPLQP

SEQ ID NO: 74107 - protein, 9 aa, Artificial Sequence
  Description of Artificial Sequence: Synthetic peptide
  Seed: FTYTLDEKV (MAGC1_HUMAN)
FLYTLDEKL

SEQ ID NO: 74108 - protein, 9 aa, Artificial Sequence
  Description of Artificial Sequence: Synthetic peptide
  Seed: SLSPHYFPQ (MAGC1_HUMAN)
SVSPHYFPY

SEQ ID NO: 74109 - protein, 9 aa, Artificial Sequence
  Description of Artificial Sequence: Synthetic peptide
  Seed: KRKVVEFLA (MAGC1_HUMAN)
KRKVVEFLV

SEQ ID NO: 74110 - protein, 9 aa, Artificial Sequence
  Description of Artificial Sequence: Synthetic peptide
  Seed: WVQEHYLEY (MAGC1_HUMAN)
WQQEHYLEL

SEQ ID NO: 74111 - protein, 9 aa, Artificial Sequence
  Description of Artificial Sequence: Synthetic peptide
  Seed: STQSPFEGF (MAGC1_HUMAN)
SWQSPFEGI

SEQ ID NO: 74112 - protein, 9 aa, Artificial Sequence
  Description of Artificial Sequence: Synthetic peptide
  Seed: VSAASSSTL (MAGC1_HUMAN)
VGAASSSTW

SEQ ID NO: 74113 - protein, 9 aa, Artificial Sequence
  Description of Artificial Sequence: Synthetic peptide
  Seed: TLLSLFQSF (MAGC1_HUMAN)
TQLSLFQSI

SEQ ID NO: 74114 - protein, 9 aa, Artificial Sequence
  Description of Artificial Sequence: Synthetic peptide
  Seed: SQNRLLILI (MAGC1_HUMAN)
SQNRLLILY

SEQ ID NO: 74115 - protein, 11 aa, Artificial Sequence
  Description of Artificial Sequence: Synthetic peptide
  Seed: REVDPDDSYVF (MAGC1_HUMAN)
RAVDPDDSYVM

SEQ ID NO: 74116 - protein, 9 aa, Artificial Sequence
  Description of Artificial Sequence: Synthetic peptide
  Seed: TLVSIFQSS (MAGC1_HUMAN)
TAVSIFQSV

SEQ ID NO: 74117 - protein, 8 aa, Artificial Sequence
  Description of Artificial Sequence: Synthetic peptide
  Seed: SSVMSPSF (MAGC1_HUMAN)
SSVMSPSW

SEQ ID NO: 74118 - protein, 10 aa, Artificial Sequence
  Description of Artificial Sequence: Synthetic peptide
  Seed: EILFGISLRE (MAGC1_HUMAN)
EFLFGISLRR

SEQ ID NO: 74119 - protein, 9 aa, Artificial Sequence
  Description of Artificial Sequence: Synthetic peptide
  Seed: WVQEHYLEY (MAGC1_HUMAN)
WMQEHYLEL

SEQ ID NO: 74120 - protein, 9 aa, Artificial Sequence
  Description of Artificial Sequence: Synthetic peptide
  Seed: IPVSSSFSY (MAGC1_HUMAN)
IPVSSSFSL

SEQ ID NO: 74121 - protein, 9 aa, Artificial Sequence
  Description of Artificial Sequence: Synthetic peptide
  Seed: TLLSLFQSF (MAGC1_HUMAN)
TNLSLFQSY

SEQ ID NO: 74122 - protein, 10 aa, Artificial Sequence
  Description of Artificial Sequence: Synthetic peptide
  Seed: VPITFPSSYK (MAGC1_HUMAN)
VYITFPSSYR

SEQ ID NO: 74123 - protein, 10 aa, Artificial Sequence
  Description of Artificial Sequence: Synthetic peptide
  Seed: LILILSIIFI (MAGC1_HUMAN)
LGLILSIIFV

SEQ ID NO: 74124 - protein, 10 aa, Artificial Sequence
  Description of Artificial Sequence: Synthetic peptide
  Seed: TGYFPVIFRK (MAGC1_HUMAN)
TVYFPVIFRK

SEQ ID NO: 74125 - protein, 9 aa, Artificial Sequence
  Description of Artificial Sequence: Synthetic peptide
  Seed: WGPRAHSEV (MAGC1_HUMAN)
WAPRAHSEL

SEQ ID NO: 74126 - protein, 10 aa, Artificial Sequence
  Description of Artificial Sequence: Synthetic peptide
  Seed: YTLDEKVDEL (MAGC1_HUMAN)
YTLDEKVDEF

SEQ ID NO: 74127 - protein, 9 aa, Artificial Sequence
  Description of Artificial Sequence: Synthetic peptide
  Seed: GSPSFSSTL (MAGC1_HUMAN)
GWPSFSSTM

SEQ ID NO: 74128 - protein, 11 aa, Artificial Sequence
  Description of Artificial Sequence: Synthetic peptide
  Seed: SPLQSPVISFS (MAGC1_HUMAN)
SPLQSPVISFA

SEQ ID NO: 74129 - protein, 9 aa, Artificial Sequence
  Description of Artificial Sequence: Synthetic peptide
  Seed: TKAEMLTNV (MAGC1_HUMAN)
THAEMLTNA

SEQ ID NO: 74130 - protein, 9 aa, Artificial Sequence
  Description of Artificial Sequence: Synthetic peptide
  Seed: VSSSSSSTL (MAGC1_HUMAN)
VASSSSSTL

SEQ ID NO: 74131 - protein, 10 aa, Artificial Sequence
  Description of Artificial Sequence: Synthetic peptide
  Seed: ESAQSTFEGF (MAGC1_HUMAN)
ETAQSTFEGW

SEQ ID NO: 74132 - protein, 9 aa, Artificial Sequence
  Description of Artificial Sequence: Synthetic peptide
  Seed: RTHSTFEGF (MAGC1_HUMAN)
RYHSTFEGV

SEQ ID NO: 74133 - protein, 10 aa, Artificial Sequence
  Description of Artificial Sequence: Synthetic peptide
  Seed: YTLASLLQSS (MAGC1_HUMAN)
YGLASLLQSM

SEQ ID NO: 74134 - protein, 10 aa, Artificial Sequence
  Description of Artificial Sequence: Synthetic peptide
  Seed: SPLQSPVSSF (MAGC1_HUMAN)
SPLQSPVSSW

SEQ ID NO: 74135 - protein, 9 aa, Artificial Sequence
  Description of Artificial Sequence: Synthetic peptide
  Seed: SPESAQSAF (MAGC1_HUMAN)
SPESAQSAL

SEQ ID NO: 74136 - protein, 9 aa, Artificial Sequence
  Description of Artificial Sequence: Synthetic peptide
  Seed: SPLQIPMTS (MAGC1_HUMAN)
SLLQIPMTI

SEQ ID NO: 74137 - protein, 9 aa, Artificial Sequence
  Description of Artificial Sequence: Synthetic peptide
  Seed: FPSSTSSSL (MAGC1_HUMAN)
FSSSTSSSF

SEQ ID NO: 74138 - protein, 10 aa, Artificial Sequence
  Description of Artificial Sequence: Synthetic peptide
  Seed: SPLQSPVISF (MAGC1_HUMAN)
SMLQSPVISM

SEQ ID NO: 74139 - protein, 11 aa, Artificial Sequence
  Description of Artificial Sequence: Synthetic peptide
  Seed: IPVSAASSSTL (MAGC1_HUMAN)
ICVSAASSSTY

SEQ ID NO: 74140 - protein, 10 aa, Artificial Sequence
  Description of Artificial Sequence: Synthetic peptide
  Seed: AASSSTLVSI (MAGC1_HUMAN)
ALSSSTLVST

SEQ ID NO: 74141 - protein, 9 aa, Artificial Sequence
  Description of Artificial Sequence: Synthetic peptide
  Seed: SRYTGYFPV (MAGC1_HUMAN)
SHYTGYFPV

SEQ ID NO: 74142 - protein, 9 aa, Artificial Sequence
  Description of Artificial Sequence: Synthetic peptide
  Seed: AMLKNTVPI (MAGC1_HUMAN)
ATLKNTVPY

SEQ ID NO: 74143 - protein, 9 aa, Artificial Sequence
  Description of Artificial Sequence: Synthetic peptide
  Seed: SSSESPQSC (MAGC1_HUMAN)
SMSESPQSF

SEQ ID NO: 74144 - protein, 10 aa, Artificial Sequence
  Description of Artificial Sequence: Synthetic peptide
  Seed: RAGREHFAFG (MAGC1_HUMAN)
RYGREHFAFK

SEQ ID NO: 74145 - protein, 10 aa, Artificial Sequence
  Description of Artificial Sequence: Synthetic peptide
  Seed: YTLDEKVDEL (MAGC1_HUMAN)
YMLDEKVDEW

SEQ ID NO: 74146 - protein, 9 aa, Artificial Sequence
  Description of Artificial Sequence: Synthetic peptide
  Seed: FAFGEPREL (MAGC1_HUMAN)
FVFGEPREH

SEQ ID NO: 74147 - protein, 9 aa, Artificial Sequence
  Description of Artificial Sequence: Synthetic peptide
  Seed: KDMPTAGMP (MAGC1_HUMAN)
KEMPTAGMV

SEQ ID NO: 74148 - protein, 9 aa, Artificial Sequence
  Description of Artificial Sequence: Synthetic peptide
  Seed: SSPESTQSP (MAGC1_HUMAN)
SMPESTQSL

SEQ ID NO: 74149 - protein, 9 aa, Artificial Sequence
  Description of Artificial Sequence: Synthetic peptide
  Seed: CSSSTSLSL (MAGC1_HUMAN)
CSSSTSLSM

SEQ ID NO: 74150 - protein, 10 aa, Artificial Sequence
  Description of Artificial Sequence: Synthetic peptide
  Seed: SPLYFPQSPL (MAGC1_HUMAN)
SPLYFPQSPA

SEQ ID NO: 74151 - protein, 10 aa, Artificial Sequence
  Description of Artificial Sequence: Synthetic peptide
  Seed: LLQIPMTSSF (MAGC1_HUMAN)
LWQIPMTSSL

SEQ ID NO: 74152 - protein, 10 aa, Artificial Sequence
  Description of Artificial Sequence: Synthetic peptide
  Seed: KDVEERAQAI (MAGC1_HUMAN)
KEVEERAQAF

SEQ ID NO: 74153 - protein, 10 aa, Artificial Sequence
  Description of Artificial Sequence: Synthetic peptide
  Seed: SSPPRYEFLW (MAGC1_HUMAN)
SFPPRYEFLL

SEQ ID NO: 74154 - protein, 9 aa, Artificial Sequence
  Description of Artificial Sequence: Synthetic peptide
  Seed: ALLSIFQSS (MAGC1_HUMAN)
AMLSIFQSI

SEQ ID NO: 74155 - protein, 9 aa, Artificial Sequence
  Description of Artificial Sequence: Synthetic peptide
  Seed: FAFGEPREL (MAGC1_HUMAN)
FTFGEPREI

SEQ ID NO: 74156 - protein, 8 aa, Artificial Sequence
  Description of Artificial Sequence: Synthetic peptide
  Seed: SSSTPSSL (MAGC1_HUMAN)
SASTPSSY

SEQ ID NO: 74157 - protein, 10 aa, Artificial Sequence
  Description of Artificial Sequence: Synthetic peptide
  Seed: SPVSICSSST (MAGC1_HUMAN)
SPVSICSSSL

SEQ ID NO: 74158 - protein, 9 aa, Artificial Sequence
  Description of Artificial Sequence: Synthetic peptide
  Seed: IESEPLFTY (MAGC1_HUMAN)
IKSEPLFTY

SEQ ID NO: 74159 - protein, 10 aa, Artificial Sequence
  Description of Artificial Sequence: Synthetic peptide
  Seed: LEYREVPNSS (MAGC1_HUMAN)
LEYREVPNSV

SEQ ID NO: 74160 - protein, 9 aa, Artificial Sequence
  Description of Artificial Sequence: Synthetic peptide
  Seed: RAGREHFAF (MAGC1_HUMAN)
RSGREHFAW

SEQ ID NO: 74161 - protein, 11 aa, Artificial Sequence
  Description of Artificial Sequence: Synthetic peptide
  Seed: SSSSSSTLLSL (MAGC1_HUMAN)
SMSSSSTLLSW

SEQ ID NO: 74162 - protein, 10 aa, Artificial Sequence
  Description of Artificial Sequence: Synthetic peptide
  Seed: STFEGFPQSL (MAGC1_HUMAN)
SPFEGFPQSY

SEQ ID NO: 74163 - protein, 10 aa, Artificial Sequence
  Description of Artificial Sequence: Synthetic peptide
  Seed: LILILSIIFI (MAGC1_HUMAN)
LMLILSIIFL

SEQ ID NO: 74164 - protein, 9 aa, Artificial Sequence
  Description of Artificial Sequence: Synthetic peptide
  Seed: SPLQRPVSS (MAGC1_HUMAN)
SLLQRPVSF

SEQ ID NO: 74165 - protein, 9 aa, Artificial Sequence
  Description of Artificial Sequence: Synthetic peptide
  Seed: TLDLTSEGC (MAGC1_HUMAN)
TSDLTSEGF

SEQ ID NO: 74166 - protein, 9 aa, Artificial Sequence
  Description of Artificial Sequence: Synthetic peptide
  Seed: KVDELARFL (MAGC1_HUMAN)
KADELARFW

SEQ ID NO: 74167 - protein, 9 aa, Artificial Sequence
  Description of Artificial Sequence: Synthetic peptide
  Seed: RKVVEFLAM (MAGC1_HUMAN)
RQVVEFLAY

SEQ ID NO: 74168 - protein, 9 aa, Artificial Sequence
  Description of Artificial Sequence: Synthetic peptide
  Seed: EDSMSPLYF (MAGC1_HUMAN)
EESMSPLYW

SEQ ID NO: 74169 - protein, 9 aa, Artificial Sequence
  Description of Artificial Sequence: Synthetic peptide
  Seed: SSPERTHST (MAGC1_HUMAN)
SAPERTHSV

SEQ ID NO: 74170 - protein, 11 aa, Artificial Sequence
  Description of Artificial Sequence: Synthetic peptide
  Seed: SPLQRPVSSFF (MAGC1_HUMAN)
SSLQRPVSSFY

SEQ ID NO: 74171 - protein, 9 aa, Artificial Sequence
  Description of Artificial Sequence: Synthetic peptide
  Seed: FSSALLSIF (MAGC1_HUMAN)
FQSALLSIM

SEQ ID NO: 74172 - protein, 9 aa, Artificial Sequence
  Description of Artificial Sequence: Synthetic peptide
  Seed: LQIPVSSSS (MAGC1_HUMAN)
LRIPVSSSL

SEQ ID NO: 74173 - protein, 10 aa, Artificial Sequence
  Description of Artificial Sequence: Synthetic peptide
  Seed: WGPRAHSEVI (MAGC1_HUMAN)
WHPRAHSEVF

SEQ ID NO: 74174 - protein, 9 aa, Artificial Sequence
  Description of Artificial Sequence: Synthetic peptide
  Seed: SPVSSFPSS (MAGC1_HUMAN)
SAVSSFPSM

SEQ ID NO: 74175 - protein, 10 aa, Artificial Sequence
  Description of Artificial Sequence: Synthetic peptide
  Seed: SSSSSTLLSL (MAGC1_HUMAN)
SQSSSTLLSM

SEQ ID NO: 74176 - protein, 11 aa, Artificial Sequence
  Description of Artificial Sequence: Synthetic peptide
  Seed: SICSSSTSLSL (MAGC1_HUMAN)
SMCSSSTSLSY

SEQ ID NO: 74177 - protein, 9 aa, Artificial Sequence
  Description of Artificial Sequence: Synthetic peptide
  Seed: SSPERTQST (MAGC1_HUMAN)
SAPERTQSL

SEQ ID NO: 74178 - protein, 9 aa, Artificial Sequence
  Description of Artificial Sequence: Synthetic peptide
  Seed: VIKRKVVEF (MAGC1_HUMAN)
VYKRKVVEF

SEQ ID NO: 74179 - protein, 10 aa, Artificial Sequence
  Description of Artificial Sequence: Synthetic peptide
  Seed: FSSSTSLSPF (MAGC1_HUMAN)
FNSSTSLSPF

SEQ ID NO: 74180 - protein, 10 aa, Artificial Sequence
  Description of Artificial Sequence: Synthetic peptide
  Seed: FPSSYKDALK (MAGC1_HUMAN)
FRSSYKDALR

SEQ ID NO: 74181 - protein, 9 aa, Artificial Sequence
  Description of Artificial Sequence: Synthetic peptide
  Seed: VVEFLAMLK (MAGC1_HUMAN)
VAEFLAMLR

SEQ ID NO: 74182 - protein, 9 aa, Artificial Sequence
  Description of Artificial Sequence: Synthetic peptide
  Seed: GFPQSVLQI (MAGC1_HUMAN)
GTPQSVLQM

SEQ ID NO: 74183 - protein, 10 aa, Artificial Sequence
  Description of Artificial Sequence: Synthetic peptide
  Seed: FAQSSLQIPV (MAGC1_HUMAN)
FFQSSLQIPL

SEQ ID NO: 74184 - protein, 9 aa, Artificial Sequence
  Description of Artificial Sequence: Synthetic peptide
  Seed: SLPEWEDSL (MAGC1_HUMAN)
SMPEWEDSI

SEQ ID NO: 74185 - protein, 11 aa, Artificial Sequence
  Description of Artificial Sequence: Synthetic peptide
  Seed: IPVSRSFSSTL (MAGC1_HUMAN)
ITVSRSFSSTW

SEQ ID NO: 74186 - protein, 9 aa, Artificial Sequence
  Description of Artificial Sequence: Synthetic peptide
  Seed: SFSSTLVSL (MAGC1_HUMAN)
STSSTLVSL

SEQ ID NO: 74187 - protein, 10 aa, Artificial Sequence
  Description of Artificial Sequence: Synthetic peptide
  Seed: PLQRPVSSFF (MAGC1_HUMAN)
PKQRPVSSFF

SEQ ID NO: 74188 - protein, 9 aa, Artificial Sequence
  Description of Artificial Sequence: Synthetic peptide
  Seed: LQIPVSRSF (MAGC1_HUMAN)
LIIPVSRSL

SEQ ID NO: 74189 - protein, 10 aa, Artificial Sequence
  Description of Artificial Sequence: Synthetic peptide
  Seed: SFSSTLLSIL (MAGC1_HUMAN)
SRSSTLLSIW

SEQ ID NO: 74190 - protein, 10 aa, Artificial Sequence
  Description of Artificial Sequence: Synthetic peptide
  Seed: SFFSSALLSI (MAGC1_HUMAN)
SYFSSALLSI

SEQ ID NO: 74191 - protein, 10 aa, Artificial Sequence
  Description of Artificial Sequence: Synthetic peptide
  Seed: TVPITFPSSY (MAGC1_HUMAN)
TQPITFPSSM

SEQ ID NO: 74192 - protein, 11 aa, Artificial Sequence
  Description of Artificial Sequence: Synthetic peptide
  Seed: REVDPDDSYVF (MAGC1_HUMAN)
RRVDPDDSYVL

SEQ ID NO: 74193 - protein, 10 aa, Artificial Sequence
  Description of Artificial Sequence: Synthetic peptide
  Seed: SSFPSSTSSS (MAGC1_HUMAN)
SMFPSSTSSY

SEQ ID NO: 74194 - protein, 9 aa, Artificial Sequence
  Description of Artificial Sequence: Synthetic peptide
  Seed: FSYTLASLL (MAGC1_HUMAN)
FIYTLASLY

SEQ ID NO: 74195 - protein, 9 aa, Artificial Sequence
  Description of Artificial Sequence: Synthetic peptide
  Seed: LQIPVSAAS (MAGC1_HUMAN)
LIIPVSAAA

SEQ ID NO: 74196 - protein, 9 aa, Artificial Sequence
  Description of Artificial Sequence: Synthetic peptide
  Seed: RSFSSTLLS (MAGC1_HUMAN)
RVFSSTLLG

SEQ ID NO: 74197 - protein, 9 aa, Artificial Sequence
  Description of Artificial Sequence: Synthetic peptide
  Seed: QVKQPITKA (MAGC1_HUMAN)
QIKQPITKF

SEQ ID NO: 74198 - protein, 9 aa, Artificial Sequence
  Description of Artificial Sequence: Synthetic peptide
  Seed: SQSSPVSSF (MAGC1_HUMAN)
SYSSPVSSW

SEQ ID NO: 74199 - protein, 10 aa, Artificial Sequence
  Description of Artificial Sequence: Synthetic peptide
  Seed: MSPLYFPQSP (MAGC1_HUMAN)
MIPLYFPQSA

SEQ ID NO: 74200 - protein, 9 aa, Artificial Sequence
  Description of Artificial Sequence: Synthetic peptide
  Seed: RKVVEFLAM (MAGC1_HUMAN)
RQVVEFLAL

SEQ ID NO: 74201 - protein, 9 aa, Artificial Sequence
  Description of Artificial Sequence: Synthetic peptide
  Seed: LQIPVSRSF (MAGC1_HUMAN)
LGIPVSRSM

SEQ ID NO: 74202 - protein, 10 aa, Artificial Sequence
  Description of Artificial Sequence: Synthetic peptide
  Seed: RSFSSTLLSI (MAGC1_HUMAN)
RKFSSTLLSF

SEQ ID NO: 74203 - protein, 9 aa, Artificial Sequence
  Description of Artificial Sequence: Synthetic peptide
  Seed: KAREFIEIL (MAGC1_HUMAN)
KTREFIEIM

SEQ ID NO: 74204 - protein, 9 aa, Artificial Sequence
  Description of Artificial Sequence: Synthetic peptide
  Seed: LQRPVSSFF (MAGC1_HUMAN)
LIRPVSSFY

SEQ ID NO: 74205 - protein, 11 aa, Artificial Sequence
  Description of Artificial Sequence: Synthetic peptide
  Seed: SEESSSPVDEY (MAGC1_HUMAN)
SEESSSPVDEL

SEQ ID NO: 74206 - protein, 9 aa, Artificial Sequence
  Description of Artificial Sequence: Synthetic peptide
  Seed: AGREHFAFG (MAGC1_HUMAN)
ATREHFAFM

SEQ ID NO: 74207 - protein, 10 aa, Artificial Sequence
  Description of Artificial Sequence: Synthetic peptide
  Seed: KRKVVEFLAM (MAGC1_HUMAN)
KEKVVEFLAM

SEQ ID NO: 74208 - protein, 9 aa, Artificial Sequence
  Description of Artificial Sequence: Synthetic peptide
  Seed: RKAREFIEI (MAGC1_HUMAN)
RQAREFIEF

SEQ ID NO: 74209 - protein, 10 aa, Artificial Sequence
  Description of Artificial Sequence: Synthetic peptide
  Seed: SFPSSTSSSL (MAGC1_HUMAN)
SWPSSTSSSF

SEQ ID NO: 74210 - protein, 9 aa, Artificial Sequence
  Description of Artificial Sequence: Synthetic peptide
  Seed: KAREFIEIL (MAGC1_HUMAN)
KLREFIEIL

SEQ ID NO: 74211 - protein, 10 aa, Artificial Sequence
  Description of Artificial Sequence: Synthetic peptide
  Seed: SPLQNPASSF (MAGC1_HUMAN)
SPLQNPASSI

SEQ ID NO: 74212 - protein, 9 aa, Artificial Sequence
  Description of Artificial Sequence: Synthetic peptide
  Seed: HFPQSPPEW (MAGC1_HUMAN)
HWPQSPPEW

SEQ ID NO: 74213 - protein, 9 aa, Artificial Sequence
  Description of Artificial Sequence: Synthetic peptide
  Seed: DSYVFVNTL (MAGC1_HUMAN)
DTYVFVNTR

SEQ ID NO: 74214 - protein, 9 aa, Artificial Sequence
  Description of Artificial Sequence: Synthetic peptide
  Seed: SSFPSSTSS (MAGC1_HUMAN)
SGFPSSTSL

SEQ ID NO: 74215 - protein, 9 aa, Artificial Sequence
  Description of Artificial Sequence: Synthetic peptide
  Seed: FSSTLLSIL (MAGC1_HUMAN)
FASTLLSIL

SEQ ID NO: 74216 - protein, 10 aa, Artificial Sequence
  Description of Artificial Sequence: Synthetic peptide
  Seed: KVDELARFLL (MAGC1_HUMAN)
KMDELARFLV

SEQ ID NO: 74217 - protein, 11 aa, Artificial Sequence
  Description of Artificial Sequence: Synthetic peptide
  Seed: QSFSERTQSTF (MAGC1_HUMAN)
QQFSERTQSTY

SEQ ID NO: 74218 - protein, 9 aa, Artificial Sequence
  Description of Artificial Sequence: Synthetic peptide
  Seed: LILSIIFIK (MAGC1_HUMAN)
LQLSIIFIR

SEQ ID NO: 74219 - protein, 10 aa, Artificial Sequence
  Description of Artificial Sequence: Synthetic peptide
  Seed: SSPESTQSPF (MAGC1_HUMAN)
SLPESTQSPM

SEQ ID NO: 74220 - protein, 10 aa, Artificial Sequence
  Description of Artificial Sequence: Synthetic peptide
  Seed: VSSSSSSTLL (MAGC1_HUMAN)
VVSSSSSTLF

SEQ ID NO: 74221 - protein, 11 aa, Artificial Sequence
  Description of Artificial Sequence: Synthetic peptide
  Seed: RYTGYFPVIFR (MAGC1_HUMAN)
RITGYFPVIFR

SEQ ID NO: 74222 - protein, 9 aa, Artificial Sequence
  Description of Artificial Sequence: Synthetic peptide
  Seed: SPLQIVPSL (MAGC1_HUMAN)
SVLQIVPSM

SEQ ID NO: 74223 - protein, 10 aa, Artificial Sequence
  Description of Artificial Sequence: Synthetic peptide
  Seed: ICSSSTPSSL (MAGC1_HUMAN)
IESSSTPSSF

SEQ ID NO: 74224 - protein, 9 aa, Artificial Sequence
  Description of Artificial Sequence: Synthetic peptide
  Seed: VQSPLHSPQ (MAGC1_HUMAN)
VVSPLHSPY

SEQ ID NO: 74225 - protein, 9 aa, Artificial Sequence
  Description of Artificial Sequence: Synthetic peptide
  Seed: AGREHFAFG (MAGC1_HUMAN)
AQREHFAFI

SEQ ID NO: 74226 - protein, 9 aa, Artificial Sequence
  Description of Artificial Sequence: Synthetic peptide
  Seed: SPESAQSTF (MAGC1_HUMAN)
SVESAQSTY

SEQ ID NO: 74227 - protein, 10 aa, Artificial Sequence
  Description of Artificial Sequence: Synthetic peptide
  Seed: ICSSSTSLSL (MAGC1_HUMAN)
IWSSSTSLSM

SEQ ID NO: 74228 - protein, 9 aa, Artificial Sequence
  Description of Artificial Sequence: Synthetic peptide
  Seed: VSRSFSSTL (MAGC1_HUMAN)
VWRSFSSTM

SEQ ID NO: 74229 - protein, 11 aa, Artificial Sequence
  Description of Artificial Sequence: Synthetic peptide
  Seed: SLSQSSPVSSF (MAGC1_HUMAN)
SESQSSPVSSY

SEQ ID NO: 74230 - protein, 11 aa, Artificial Sequence
  Description of Artificial Sequence: Synthetic peptide
  Seed: SICSSSTPSSL (MAGC1_HUMAN)
SACSSSTPSSF

SEQ ID NO: 74231 - protein, 9 aa, Artificial Sequence
  Description of Artificial Sequence: Synthetic peptide
  Seed: RPVSSFFSY (MAGC1_HUMAN)
REVSSFFSY

SEQ ID NO: 74232 - protein, 9 aa, Artificial Sequence
  Description of Artificial Sequence: Synthetic peptide
  Seed: QVKQPITKA (MAGC1_HUMAN)
QQKQPITKK

SEQ ID NO: 74233 - protein, 9 aa, Artificial Sequence
  Description of Artificial Sequence: Synthetic peptide
  Seed: SPESAQSAF (MAGC1_HUMAN)
SAESAQSAY

SEQ ID NO: 74234 - protein, 9 aa, Artificial Sequence
  Description of Artificial Sequence: Synthetic peptide
  Seed: FPSSTSSSL (MAGC1_HUMAN)
FPSSTSSSW

SEQ ID NO: 74235 - protein, 9 aa, Artificial Sequence
  Description of Artificial Sequence: Synthetic peptide
  Seed: SFSSTLVSL (MAGC1_HUMAN)
SWSSTLVSY

SEQ ID NO: 74236 - protein, 10 aa, Artificial Sequence
  Description of Artificial Sequence: Synthetic peptide
  Seed: ICSSSTPSSL (MAGC1_HUMAN)
INSSSTPSSF

SEQ ID NO: 74237 - protein, 11 aa, Artificial Sequence
  Description of Artificial Sequence: Synthetic peptide
  Seed: TSSFSSTLLSI (MAGC1_HUMAN)
TTSFSSTLLSF

SEQ ID NO: 74238 - protein, 9 aa, Artificial Sequence
  Description of Artificial Sequence: Synthetic peptide
  Seed: RKAREFIEI (MAGC1_HUMAN)
RKAREFIEM

SEQ ID NO: 74239 - protein, 10 aa, Artificial Sequence
  Description of Artificial Sequence: Synthetic peptide
  Seed: QIPVSSSFSY (MAGC1_HUMAN)
QLPVSSSFSM

SEQ ID NO: 74240 - protein, 10 aa, Artificial Sequence
  Description of Artificial Sequence: Synthetic peptide
  Seed: SPLQIPGSPS (MAGC1_HUMAN)
SPLQIPGSPF

SEQ ID NO: 74241 - protein, 10 aa, Artificial Sequence
  Description of Artificial Sequence: Synthetic peptide
  Seed: SFSYTLLSLF (MAGC1_HUMAN)
SQSYTLLSLM

SEQ ID NO: 74242 - protein, 10 aa, Artificial Sequence
  Description of Artificial Sequence: Synthetic peptide
  Seed: KVVEFLAMLK (MAGC1_HUMAN)
KMVEFLAMLL

SEQ ID NO: 74243 - protein, 9 aa, Artificial Sequence
  Description of Artificial Sequence: Synthetic peptide
  Seed: TLDEKVDEL (MAGC1_HUMAN)
TFDEKVDEV

SEQ ID NO: 74244 - protein, 9 aa, Artificial Sequence
  Description of Artificial Sequence: Synthetic peptide
  Seed: KVWVQEHYL (MAGC1_HUMAN)
KTWVQEHYW

SEQ ID NO: 74245 - protein, 9 aa, Artificial Sequence
  Description of Artificial Sequence: Synthetic peptide
  Seed: SLSPHYFPQ (MAGC1_HUMAN)
SSSPHYFPR

SEQ ID NO: 74246 - protein, 9 aa, Artificial Sequence
  Description of Artificial Sequence: Synthetic peptide
  Seed: TFEGFPQSL (MAGC1_HUMAN)
TVEGFPQSF

SEQ ID NO: 74247 - protein, 9 aa, Artificial Sequence
  Description of Artificial Sequence: Synthetic peptide
  Seed: YTGYFPVIF (MAGC1_HUMAN)
YWGYFPVIL

SEQ ID NO: 74248 - protein, 10 aa, Artificial Sequence
  Description of Artificial Sequence: Synthetic peptide
  Seed: ICSSSTPSSL (MAGC1_HUMAN)
IASSSTPSSL

SEQ ID NO: 74249 - protein, 9 aa, Artificial Sequence
  Description of Artificial Sequence: Synthetic peptide
  Seed: QFPPQGEDF (MAGC1_HUMAN)
QIPPQGEDM

SEQ ID NO: 74250 - protein, 9 aa, Artificial Sequence
  Description of Artificial Sequence: Synthetic peptide
  Seed: ISFSSSTSL (MAGC1_HUMAN)
IYFSSSTSV

SEQ ID NO: 74251 - protein, 11 aa, Artificial Sequence
  Description of Artificial Sequence: Synthetic peptide
  Seed: STFEGFPQSLL (MAGC1_HUMAN)
SLFEGFPQSLM

SEQ ID NO: 74252 - protein, 10 aa, Artificial Sequence
  Description of Artificial Sequence: Synthetic peptide
  Seed: MTSSFSSTLL (MAGC1_HUMAN)
MMSSFSSTLD

SEQ ID NO: 74253 - protein, 10 aa, Artificial Sequence
  Description of Artificial Sequence: Synthetic peptide
  Seed: VSPSFSSTLV (MAGC1_HUMAN)
VAPSFSSTLL

SEQ ID NO: 74254 - protein, 9 aa, Artificial Sequence
  Description of Artificial Sequence: Synthetic peptide
  Seed: LQIPMTSSF (MAGC1_HUMAN)
LAIPMTSSV

SEQ ID NO: 74255 - protein, 11 aa, Artificial Sequence
  Description of Artificial Sequence: Synthetic peptide
  Seed: MSPLYFPQSPL (MAGC1_HUMAN)
MAPLYFPQSPF

SEQ ID NO: 74256 - protein, 9 aa, Artificial Sequence
  Description of Artificial Sequence: Synthetic peptide
  Seed: SGIGVRAGR (MAGC1_HUMAN)
SYIGVRAGK

SEQ ID NO: 74257 - protein, 11 aa, Artificial Sequence
  Description of Artificial Sequence: Synthetic peptide
  Seed: SLIESEPLFTY (MAGC1_HUMAN)
STIESEPLFTW

SEQ ID NO: 74258 - protein, 9 aa, Artificial Sequence
  Description of Artificial Sequence: Synthetic peptide
  Seed: SSFFSSALL (MAGC1_HUMAN)
SLFFSSALF

SEQ ID NO: 74259 - protein, 9 aa, Artificial Sequence
  Description of Artificial Sequence: Synthetic peptide
  Seed: RPVSSFFSY (MAGC1_HUMAN)
RCVSSFFSY

SEQ ID NO: 74260 - protein, 9 aa, Artificial Sequence
  Description of Artificial Sequence: Synthetic peptide
  Seed: SSSTLLSLF (MAGC1_HUMAN)
SSSTLLSLW

SEQ ID NO: 74261 - protein, 9 aa, Artificial Sequence
  Description of Artificial Sequence: Synthetic peptide
  Seed: SLPQSFPES (MAGC1_HUMAN)
SVPQSFPEI

SEQ ID NO: 74262 - protein, 10 aa, Artificial Sequence
  Description of Artificial Sequence: Synthetic peptide
  Seed: SSSSSTLLSL (MAGC1_HUMAN)
SESSSTLLSW

SEQ ID NO: 74263 - protein, 10 aa, Artificial Sequence
  Description of Artificial Sequence: Synthetic peptide
  Seed: FAQSSLQIPV (MAGC1_HUMAN)
FCQSSLQIPI

SEQ ID NO: 74264 - protein, 11 aa, Artificial Sequence
  Description of Artificial Sequence: Synthetic peptide
  Seed: IPVSAASSSTL (MAGC1_HUMAN)
ISVSAASSSTW

SEQ ID NO: 74265 - protein, 9 aa, Artificial Sequence
  Description of Artificial Sequence: Synthetic peptide
  Seed: LQNPASSFF (MAGC1_HUMAN)
LYNPASSFY

SEQ ID NO: 74266 - protein, 9 aa, Artificial Sequence
  Description of Artificial Sequence: Synthetic peptide
  Seed: FSSTLVSLF (MAGC1_HUMAN)
FCSTLVSLW

SEQ ID NO: 74267 - protein, 9 aa, Artificial Sequence
  Description of Artificial Sequence: Synthetic peptide
  Seed: SSTSSSLSK (MAGC1_HUMAN)
SATSSSLSL

SEQ ID NO: 74268 - protein, 9 aa, Artificial Sequence
  Description of Artificial Sequence: Synthetic peptide
  Seed: SSFFSSALL (MAGC1_HUMAN)
SVFFSSALF

SEQ ID NO: 74269 - protein, 9 aa, Artificial Sequence
  Description of Artificial Sequence: Synthetic peptide
  Seed: SAQSAFEGF (MAGC1_HUMAN)
SMQSAFEGF

SEQ ID NO: 74270 - protein, 9 aa, Artificial Sequence
  Description of Artificial Sequence: Synthetic peptide
  Seed: FEGFAQSPL (MAGC1_HUMAN)
FQGFAQSPY

SEQ ID NO: 74271 - protein, 9 aa, Artificial Sequence
  Description of Artificial Sequence: Synthetic peptide
  Seed: TLDLTSEGC (MAGC1_HUMAN)
TGDLTSEGM

SEQ ID NO: 74272 - protein, 11 aa, Artificial Sequence
  Description of Artificial Sequence: Synthetic peptide
  Seed: SPLQIPGSPSF (MAGC1_HUMAN)
SSLQIPGSPSF

SEQ ID NO: 74273 - protein, 10 aa, Artificial Sequence
  Description of Artificial Sequence: Synthetic peptide
  Seed: RSFSSTLLSI (MAGC1_HUMAN)
RSFSSTLLSF

SEQ ID NO: 74274 - protein, 10 aa, Artificial Sequence
  Description of Artificial Sequence: Synthetic peptide
  Seed: KGTYASEEVI (MAGC1_HUMAN)
KQTYASEEVW

SEQ ID NO: 74275 - protein, 10 aa, Artificial Sequence
  Description of Artificial Sequence: Synthetic peptide
  Seed: LQIPVSRSFS (MAGC1_HUMAN)
LQIPVSRSFW

SEQ ID NO: 74276 - protein, 11 aa, Artificial Sequence
  Description of Artificial Sequence: Synthetic peptide
  Seed: SFFSYTLASLL (MAGC1_HUMAN)
SWFSYTLASLF

SEQ ID NO: 74277 - protein, 9 aa, Artificial Sequence
  Description of Artificial Sequence: Synthetic peptide
  Seed: AQSPLQSPV (MAGC1_HUMAN)
AVSPLQSPF

SEQ ID NO: 74278 - protein, 9 aa, Artificial Sequence
  Description of Artificial Sequence: Synthetic peptide
  Seed: RKVVEFLAM (MAGC1_HUMAN)
RTVVEFLAM

SEQ ID NO: 74279 - protein, 9 aa, Artificial Sequence
  Description of Artificial Sequence: Synthetic peptide
  Seed: SLFQSFSER (MAGC1_HUMAN)
STFQSFSEY

SEQ ID NO: 74280 - protein, 9 aa, Artificial Sequence
  Description of Artificial Sequence: Synthetic peptide
  Seed: FPVIFRKAR (MAGC1_HUMAN)
FPVIFRKAV

SEQ ID NO: 74281 - protein, 11 aa, Artificial Sequence
  Description of Artificial Sequence: Synthetic peptide
  Seed: SLSQSSPVSSF (MAGC1_HUMAN)
SVSQSSPVSSF

SEQ ID NO: 74282 - protein, 9 aa, Artificial Sequence
  Description of Artificial Sequence: Synthetic peptide
  Seed: NVISRYTGY (MAGC1_HUMAN)
NTISRYTGY

SEQ ID NO: 74283 - protein, 9 aa, Artificial Sequence
  Description of Artificial Sequence: Synthetic peptide
  Seed: FFSYTLASL (MAGC1_HUMAN)
FMSYTLAST

SEQ ID NO: 74284 - protein, 9 aa, Artificial Sequence
  Description of Artificial Sequence: Synthetic peptide
  Seed: VSRSFSSTL (MAGC1_HUMAN)
VMRSFSSTW

SEQ ID NO: 74285 - protein, 10 aa, Artificial Sequence
  Description of Artificial Sequence: Synthetic peptide
  Seed: YTLLSLFQSS (MAGC1_HUMAN)
YRLLSLFQSL

SEQ ID NO: 74286 - protein, 9 aa, Artificial Sequence
  Description of Artificial Sequence: Synthetic peptide
  Seed: NVISRYTGY (MAGC1_HUMAN)
NSISRYTGR

SEQ ID NO: 74287 - protein, 9 aa, Artificial Sequence
  Description of Artificial Sequence: Synthetic peptide
  Seed: VPITFPSSY (MAGC1_HUMAN)
VPITFPSSL

SEQ ID NO: 74288 - protein, 9 aa, Artificial Sequence
  Description of Artificial Sequence: Synthetic peptide
  Seed: FSEESSSPV (MAGC1_HUMAN)
FLEESSSPY

SEQ ID NO: 74289 - protein, 9 aa, Artificial Sequence
  Description of Artificial Sequence: Synthetic peptide
  Seed: ASSSTLVSI (MAGC1_HUMAN)
AMSSTLVST

SEQ ID NO: 74290 - protein, 9 aa, Artificial Sequence
  Description of Artificial Sequence: Synthetic peptide
  Seed: YTLASLLQS (MAGC1_HUMAN)
YILASLLQI

SEQ ID NO: 74291 - protein, 9 aa, Artificial Sequence
  Description of Artificial Sequence: Synthetic peptide
  Seed: VSSFFSYTL (MAGC1_HUMAN)
VISFFSYTY

SEQ ID NO: 74292 - protein, 9 aa, Artificial Sequence
  Description of Artificial Sequence: Synthetic peptide
  Seed: RTHSTFEGF (MAGC1_HUMAN)
RSHSTFEGF

SEQ ID NO: 74293 - protein, 10 aa, Artificial Sequence
  Description of Artificial Sequence: Synthetic peptide
  Seed: FFSSALLSIF (MAGC1_HUMAN)
FASSALLSIW

SEQ ID NO: 74294 - protein, 11 aa, Artificial Sequence
  Description of Artificial Sequence: Synthetic peptide
  Seed: LSDEQGMSQNR (MAGC1_HUMAN)
LVDEQGMSQNY

SEQ ID NO: 74295 - protein, 11 aa, Artificial Sequence
  Description of Artificial Sequence: Synthetic peptide
  Seed: SASSSVMSPSF (MAGC1_HUMAN)
SGSSSVMSPSW

SEQ ID NO: 74296 - protein, 10 aa, Artificial Sequence
  Description of Artificial Sequence: Synthetic peptide
  Seed: YTLDEKVDEL (MAGC1_HUMAN)
YILDEKVDEA

SEQ ID NO: 74297 - protein, 9 aa, Artificial Sequence
  Description of Artificial Sequence: Synthetic peptide
  Seed: ALLSIFQSS (MAGC1_HUMAN)
AMLSIFQST

SEQ ID NO: 74298 - protein, 9 aa, Artificial Sequence
  Description of Artificial Sequence: Synthetic peptide
  Seed: LQRPVSSFF (MAGC1_HUMAN)
LERPVSSFM

SEQ ID NO: 74299 - protein, 10 aa, Artificial Sequence
  Description of Artificial Sequence: Synthetic peptide
  Seed: FPQSPLQIPV (MAGC1_HUMAN)
FEQSPLQIPV

SEQ ID NO: 74300 - protein, 11 aa, Artificial Sequence
  Description of Artificial Sequence: Synthetic peptide
  Seed: SSFFSSALLSI (MAGC1_HUMAN)
SMFFSSALLSW

SEQ ID NO: 74301 - protein, 11 aa, Artificial Sequence
  Description of Artificial Sequence: Synthetic peptide
  Seed: SPLQNPASSFF (MAGC1_HUMAN)
SDLQNPASSFF

SEQ ID NO: 74302 - protein, 9 aa, Artificial Sequence
  Description of Artificial Sequence: Synthetic peptide
  Seed: YVFVNTLDL (MAGC1_HUMAN)
YAFVNTLDH

SEQ ID NO: 74303 - protein, 10 aa, Artificial Sequence
  Description of Artificial Sequence: Synthetic peptide
  Seed: RKVVEFLAML (MAGC1_HUMAN)
RKVVEFLAMY

SEQ ID NO: 74304 - protein, 9 aa, Artificial Sequence
  Description of Artificial Sequence: Synthetic peptide
  Seed: SPLQIVPSL (MAGC1_HUMAN)
SHLQIVPSC

SEQ ID NO: 74305 - protein, 9 aa, Artificial Sequence
  Description of Artificial Sequence: Synthetic peptide
  Seed: VSPSFSSTL (MAGC1_HUMAN)
VVPSFSSTF

SEQ ID NO: 74306 - protein, 11 aa, Artificial Sequence
  Description of Artificial Sequence: Synthetic peptide
  Seed: TVPITFPSSYK (MAGC1_HUMAN)
TVPITFPSSYR

SEQ ID NO: 74307 - protein, 9 aa, Artificial Sequence
  Description of Artificial Sequence: Synthetic peptide
  Seed: VIFRKAREF (MAGC1_HUMAN)
VSFRKAREL

SEQ ID NO: 74308 - protein, 10 aa, Artificial Sequence
  Description of Artificial Sequence: Synthetic peptide
  Seed: STFEGFPQSL (MAGC1_HUMAN)
SVFEGFPQSL

SEQ ID NO: 74309 - protein, 10 aa, Artificial Sequence
  Description of Artificial Sequence: Synthetic peptide
  Seed: FPQSVLQIPV (MAGC1_HUMAN)
FMQSVLQIPL

SEQ ID NO: 74310 - protein, 10 aa, Artificial Sequence
  Description of Artificial Sequence: Synthetic peptide
  Seed: LTKVWVQEHY (MAGC1_HUMAN)
LTKVWVQEHW

SEQ ID NO: 74311 - protein, 9 aa, Artificial Sequence
  Description of Artificial Sequence: Synthetic peptide
  Seed: LQIPGSPSF (MAGC1_HUMAN)
LPIPGSPSF

SEQ ID NO: 74312 - protein, 9 aa, Artificial Sequence
  Description of Artificial Sequence: Synthetic peptide
  Seed: VQSPLHSPQ (MAGC1_HUMAN)
VHSPLHSPF

SEQ ID NO: 74313 - protein, 10 aa, Artificial Sequence
  Description of Artificial Sequence: Synthetic peptide
  Seed: EMLTNVISRY (MAGC1_HUMAN)
EALTNVISRR

SEQ ID NO: 74314 - protein, 9 aa, Artificial Sequence
  Description of Artificial Sequence: Synthetic peptide
  Seed: STFEGFAQS (MAGC1_HUMAN)
SQFEGFAQA

SEQ ID NO: 74315 - protein, 9 aa, Artificial Sequence
  Description of Artificial Sequence: Synthetic peptide
  Seed: SPLQIPMTS (MAGC1_HUMAN)
SLLQIPMTT

SEQ ID NO: 74316 - protein, 9 aa, Artificial Sequence
  Description of Artificial Sequence: Synthetic peptide
  Seed: VSRSFSSTL (MAGC1_HUMAN)
VMRSFSSTF

SEQ ID NO: 74317 - protein, 9 aa, Artificial Sequence
  Description of Artificial Sequence: Synthetic peptide
  Seed: ASSSTLVSI (MAGC1_HUMAN)
ASSSTLVSY

SEQ ID NO: 74318 - protein, 9 aa, Artificial Sequence
  Description of Artificial Sequence: Synthetic peptide
  Seed: VSPSSSSTL (MAGC1_HUMAN)
VYPSSSSTM

SEQ ID NO: 74319 - protein, 9 aa, Artificial Sequence
  Description of Artificial Sequence: Synthetic peptide
  Seed: SSPESPLQS (MAGC1_HUMAN)
STPESPLQL

SEQ ID NO: 74320 - protein, 9 aa, Artificial Sequence
  Description of Artificial Sequence: Synthetic peptide
  Seed: RSFSSTLLS (MAGC1_HUMAN)
RGFSSTLLM

SEQ ID NO: 74321 - protein, 9 aa, Artificial Sequence
  Description of Artificial Sequence: Synthetic peptide
  Seed: SSSSTLLSL (MAGC1_HUMAN)
SLSSTLLSL

SEQ ID NO: 74322 - protein, 10 aa, Artificial Sequence
  Description of Artificial Sequence: Synthetic peptide
  Seed: SLFQSFSERT (MAGC1_HUMAN)
SFFQSFSERR

SEQ ID NO: 74323 - protein, 9 aa, Artificial Sequence
  Description of Artificial Sequence: Synthetic peptide
  Seed: KDSLSPLEI (MAGC1_HUMAN)
KISLSPLEL

SEQ ID NO: 74324 - protein, 10 aa, Artificial Sequence
  Description of Artificial Sequence: Synthetic peptide
  Seed: SSFSYTLLSL (MAGC1_HUMAN)
SAFSYTLLSF

SEQ ID NO: 74325 - protein, 10 aa, Artificial Sequence
  Description of Artificial Sequence: Synthetic peptide
  Seed: SSSSTLLSLF (MAGC1_HUMAN)
SSSSTLLSLY

SEQ ID NO: 74326 - protein, 10 aa, Artificial Sequence
  Description of Artificial Sequence: Synthetic peptide
  Seed: MSQNRLLILI (MAGC1_HUMAN)
MMQNRLLILW

SEQ ID NO: 74327 - protein, 10 aa, Artificial Sequence
  Description of Artificial Sequence: Synthetic peptide
  Seed: FFSYTLASLL (MAGC1_HUMAN)
FNSYTLASLW

SEQ ID NO: 74328 - protein, 10 aa, Artificial Sequence
  Description of Artificial Sequence: Synthetic peptide
  Seed: GEDSLSPLQI (MAGC1_HUMAN)
GEDSLSPLQL

SEQ ID NO: 74329 - protein, 9 aa, Artificial Sequence
  Description of Artificial Sequence: Synthetic peptide
  Seed: FSSALLSIF (MAGC1_HUMAN)
FQSALLSIW

SEQ ID NO: 74330 - protein, 10 aa, Artificial Sequence
  Description of Artificial Sequence: Synthetic peptide
  Seed: EILFGISLRE (MAGC1_HUMAN)
EDLFGISLRR

SEQ ID NO: 74331 - protein, 10 aa, Artificial Sequence
  Description of Artificial Sequence: Synthetic peptide
  Seed: FSSSTSLSPF (MAGC1_HUMAN)
FHSSTSLSPY

SEQ ID NO: 74332 - protein, 9 aa, Artificial Sequence
  Description of Artificial Sequence: Synthetic peptide
  Seed: AMLKNTVPI (MAGC1_HUMAN)
AQLKNTVPV

SEQ ID NO: 74333 - protein, 10 aa, Artificial Sequence
  Description of Artificial Sequence: Synthetic peptide
  Seed: DEQGMSQNRL (MAGC1_HUMAN)
DEQGMSQNRW

SEQ ID NO: 74334 - protein, 9 aa, Artificial Sequence
  Description of Artificial Sequence: Synthetic peptide
  Seed: FSSTLLSIL (MAGC1_HUMAN)
FLSTLLSIF

SEQ ID NO: 74335 - protein, 10 aa, Artificial Sequence
  Description of Artificial Sequence: Synthetic peptide
  Seed: SSSSTLLSLF (MAGC1_HUMAN)
SQSSTLLSLY

SEQ ID NO: 74336 - protein, 9 aa, Artificial Sequence
  Description of Artificial Sequence: Synthetic peptide
  Seed: LQIPVSSSS (MAGC1_HUMAN)
LYIPVSSSV

SEQ ID NO: 74337 - protein, 10 aa, Artificial Sequence
  Description of Artificial Sequence: Synthetic peptide
  Seed: ICSSSTSLSL (MAGC1_HUMAN)
IMSSSTSLSY

SEQ ID NO: 74338 - protein, 9 aa, Artificial Sequence
  Description of Artificial Sequence: Synthetic peptide
  Seed: SSFFSSALL (MAGC1_HUMAN)
SIFFSSALV

SEQ ID NO: 74339 - protein, 9 aa, Artificial Sequence
  Description of Artificial Sequence: Synthetic peptide
  Seed: FFSYTLASL (MAGC1_HUMAN)
FWSYTLASF

SEQ ID NO: 74340 - protein, 10 aa, Artificial Sequence
  Description of Artificial Sequence: Synthetic peptide
  Seed: QGEDSMSPLY (MAGC1_HUMAN)
QAEDSMSPLW

SEQ ID NO: 74341 - protein, 9 aa, Artificial Sequence
  Description of Artificial Sequence: Synthetic peptide
  Seed: LQNPASSFF (MAGC1_HUMAN)
LLNPASSFI

SEQ ID NO: 74342 - protein, 9 aa, Artificial Sequence
  Description of Artificial Sequence: Synthetic peptide
  Seed: SPLQRPVSS (MAGC1_HUMAN)
STLQRPVSL

SEQ ID NO: 74343 - protein, 9 aa, Artificial Sequence
  Description of Artificial Sequence: Synthetic peptide
  Seed: LSDEQGMSQ (MAGC1_HUMAN)
LTDEQGMSY

SEQ ID NO: 74344 - protein, 9 aa, Artificial Sequence
  Description of Artificial Sequence: Synthetic peptide
  Seed: SFFSYTLAS (MAGC1_HUMAN)
SYFSYTLAY

SEQ ID NO: 74345 - protein, 11 aa, Artificial Sequence
  Description of Artificial Sequence: Synthetic peptide
  Seed: RPVSSFFSYTL (MAGC1_HUMAN)
RAVSSFFSYTW

SEQ ID NO: 74346 - protein, 11 aa, Artificial Sequence
  Description of Artificial Sequence: Synthetic peptide
  Seed: ITFPSSYKDAL (MAGC1_HUMAN)
ITFPSSYKDAW

SEQ ID NO: 74347 - protein, 11 aa, Artificial Sequence
  Description of Artificial Sequence: Synthetic peptide
  Seed: SSPESPLQSPV (MAGC1_HUMAN)
SAPESPLQSPL

SEQ ID NO: 74348 - protein, 11 aa, Artificial Sequence
  Description of Artificial Sequence: Synthetic peptide
  Seed: FQSSLQSPVSI (MAGC1_HUMAN)
FKSSLQSPVSY

SEQ ID NO: 74349 - protein, 9 aa, Artificial Sequence
  Description of Artificial Sequence: Synthetic peptide
  Seed: VSRSFSSTL (MAGC1_HUMAN)
VWRSFSSTF

SEQ ID NO: 74350 - protein, 9 aa, Artificial Sequence
  Description of Artificial Sequence: Synthetic peptide
  Seed: KAREFIEIL (MAGC1_HUMAN)
KPREFIEIL

SEQ ID NO: 74351 - protein, 9 aa, Artificial Sequence
  Description of Artificial Sequence: Synthetic peptide
  Seed: DSYVFVNTL (MAGC1_HUMAN)
DAYVFVNTL

SEQ ID NO: 74352 - protein, 9 aa, Artificial Sequence
  Description of Artificial Sequence: Synthetic peptide
  Seed: FTYTLDEKV (MAGC1_HUMAN)
FAYTLDEKV

SEQ ID NO: 74353 - protein, 10 aa, Artificial Sequence
  Description of Artificial Sequence: Synthetic peptide
  Seed: SSFSYTLLSL (MAGC1_HUMAN)
STFSYTLLSV

SEQ ID NO: 74354 - protein, 10 aa, Artificial Sequence
  Description of Artificial Sequence: Synthetic peptide
  Seed: YTLASLLQSS (MAGC1_HUMAN)
YSLASLLQSV

SEQ ID NO: 74355 - protein, 10 aa, Artificial Sequence
  Description of Artificial Sequence: Synthetic peptide
  Seed: WGPRAHSEVI (MAGC1_HUMAN)
WMPRAHSEVL

SEQ ID NO: 74356 - protein, 10 aa, Artificial Sequence
  Description of Artificial Sequence: Synthetic peptide
  Seed: EVIWDVLSGI (MAGC1_HUMAN)
EPIWDVLSGV

SEQ ID NO: 74357 - protein, 10 aa, Artificial Sequence
  Description of Artificial Sequence: Synthetic peptide
  Seed: LQIPMTSSFS (MAGC1_HUMAN)
LQIPMTSSFY

SEQ ID NO: 74358 - protein, 11 aa, Artificial Sequence
  Description of Artificial Sequence: Synthetic peptide
  Seed: SPLQIPGSPSF (MAGC1_HUMAN)
SGLQIPGSPSY

SEQ ID NO: 74359 - protein, 10 aa, Artificial Sequence
  Description of Artificial Sequence: Synthetic peptide
  Seed: FSSSTSLSPF (MAGC1_HUMAN)
FYSSTSLSPY

SEQ ID NO: 74360 - protein, 10 aa, Artificial Sequence
  Description of Artificial Sequence: Synthetic peptide
  Seed: VSSSSSSSTL (MAGC1_HUMAN)
VNSSSSSSTW

SEQ ID NO: 74361 - protein, 9 aa, Artificial Sequence
  Description of Artificial Sequence: Synthetic peptide
  Seed: FAFGEPREL (MAGC1_HUMAN)
FMFGEPREC

SEQ ID NO: 74362 - protein, 10 aa, Artificial Sequence
  Description of Artificial Sequence: Synthetic peptide
  Seed: FSSSTSLSPF (MAGC1_HUMAN)
FISSTSLSPW

SEQ ID NO: 74363 - protein, 11 aa, Artificial Sequence
  Description of Artificial Sequence: Synthetic peptide
  Seed: VSSSSSSSTLL (MAGC1_HUMAN)
VKSSSSSSTLF

SEQ ID NO: 74364 - protein, 10 aa, Artificial Sequence
  Description of Artificial Sequence: Synthetic peptide
  Seed: SFPSSTSSSL (MAGC1_HUMAN)
SRPSSTSSSM

SEQ ID NO: 74365 - protein, 9 aa, Artificial Sequence
  Description of Artificial Sequence: Synthetic peptide
  Seed: FSSTLLSIL (MAGC1_HUMAN)
FASTLLSIW

SEQ ID NO: 74366 - protein, 10 aa, Artificial Sequence
  Description of Artificial Sequence: Synthetic peptide
  Seed: MPTAGMPSLL (MAGC1_HUMAN)
MVTAGMPSLV

SEQ ID NO: 74367 - protein, 10 aa, Artificial Sequence
  Description of Artificial Sequence: Synthetic peptide
  Seed: SSFSSTLLSI (MAGC1_HUMAN)
SIFSSTLLSV

SEQ ID NO: 74368 - protein, 9 aa, Artificial Sequence
  Description of Artificial Sequence: Synthetic peptide
  Seed: VVEFLAMLK (MAGC1_HUMAN)
VSEFLAMLK

SEQ ID NO: 74369 - protein, 9 aa, Artificial Sequence
  Description of Artificial Sequence: Synthetic peptide
  Seed: LQIPVSAAS (MAGC1_HUMAN)
LVIPVSAAF

SEQ ID NO: 74370 - protein, 9 aa, Artificial Sequence
  Description of Artificial Sequence: Synthetic peptide
  Seed: VIFRKAREF (MAGC1_HUMAN)
VLFRKAREW

SEQ ID NO: 74371 - protein, 10 aa, Artificial Sequence
  Description of Artificial Sequence: Synthetic peptide
  Seed: LAMLKNTVPI (MAGC1_HUMAN)
LAMLKNTVPM

SEQ ID NO: 74372 - protein, 9 aa, Artificial Sequence
  Description of Artificial Sequence: Synthetic peptide
  Seed: LQIPVSPSF (MAGC1_HUMAN)
LIIPVSPSF

SEQ ID NO: 74373 - protein, 10 aa, Artificial Sequence
  Description of Artificial Sequence: Synthetic peptide
  Seed: RSFSSTLLSI (MAGC1_HUMAN)
RMFSSTLLSF

SEQ ID NO: 74374 - protein, 8 aa, Artificial Sequence
  Description of Artificial Sequence: Synthetic peptide
  Seed: FSSTLVSL (MAGC1_HUMAN)
FQSTLVSV

SEQ ID NO: 74375 - protein, 9 aa, Artificial Sequence
  Description of Artificial Sequence: Synthetic peptide
  Seed: YQVKQPITK (MAGC1_HUMAN)
YVVKQPITF

SEQ ID NO: 74376 - protein, 9 aa, Artificial Sequence
  Description of Artificial Sequence: Synthetic peptide
  Seed: FSSALLSIF (MAGC1_HUMAN)
FQSALLSII

SEQ ID NO: 74377 - protein, 9 aa, Artificial Sequence
  Description of Artificial Sequence: Synthetic peptide
  Seed: SSPEGKDSL (MAGC1_HUMAN)
SIPEGKDSV

SEQ ID NO: 74378 - protein, 10 aa, Artificial Sequence
  Description of Artificial Sequence: Synthetic peptide
  Seed: LQIPVSRSFS (MAGC1_HUMAN)
LQIPVSRSFI

SEQ ID NO: 74379 - protein, 9 aa, Artificial Sequence
  Description of Artificial Sequence: Synthetic peptide
  Seed: SSFSYTLLS (MAGC1_HUMAN)
SVFSYTLLK

SEQ ID NO: 74380 - protein, 9 aa, Artificial Sequence
  Description of Artificial Sequence: Synthetic peptide
  Seed: QSPLQGEEF (MAGC1_HUMAN)
QTPLQGEEL

SEQ ID NO: 74381 - protein, 10 aa, Artificial Sequence
  Description of Artificial Sequence: Synthetic peptide
  Seed: SIFQSSPESA (MAGC1_HUMAN)
SIFQSSPESI

SEQ ID NO: 74382 - protein, 10 aa, Artificial Sequence
  Description of Artificial Sequence: Synthetic peptide
  Seed: SFSERTQSTF (MAGC1_HUMAN)
SMSERTQSTY

SEQ ID NO: 74383 - protein, 10 aa, Artificial Sequence
  Description of Artificial Sequence: Synthetic peptide
  Seed: FFSSALLSIF (MAGC1_HUMAN)
FASSALLSIL

SEQ ID NO: 74384 - protein, 10 aa, Artificial Sequence
  Description of Artificial Sequence: Synthetic peptide
  Seed: VISFSSSTSL (MAGC1_HUMAN)
VSSFSSSTSW

SEQ ID NO: 74385 - protein, 11 aa, Artificial Sequence
  Description of Artificial Sequence: Synthetic peptide
  Seed: IIDTTDDSTAT (MAGC1_HUMAN)
IMDTTDDSTAI

SEQ ID NO: 74386 - protein, 10 aa, Artificial Sequence
  Description of Artificial Sequence: Synthetic peptide
  Seed: VSPSSSSTLL (MAGC1_HUMAN)
VAPSSSSTLM

SEQ ID NO: 74387 - protein, 11 aa, Artificial Sequence
  Description of Artificial Sequence: Synthetic peptide
  Seed: LQIPGSPSFSS (MAGC1_HUMAN)
LKIPGSPSFSF

SEQ ID NO: 74388 - protein, 9 aa, Artificial Sequence
  Description of Artificial Sequence: Synthetic peptide
  Seed: LQSPVISFS (MAGC1_HUMAN)
LSSPVISFA

SEQ ID NO: 74389 - protein, 9 aa, Artificial Sequence
  Description of Artificial Sequence: Synthetic peptide
  Seed: LQIPVSAAS (MAGC1_HUMAN)
LSIPVSAAF

SEQ ID NO: 74390 - protein, 9 aa, Artificial Sequence
  Description of Artificial Sequence: Synthetic peptide
  Seed: SPLQSPVSS (MAGC1_HUMAN)
SVLQSPVSW

SEQ ID NO: 74391 - protein, 11 aa, Artificial Sequence
  Description of Artificial Sequence: Synthetic peptide
  Seed: SSSSSSTLLSL (MAGC1_HUMAN)
SQSSSSTLLSF

SEQ ID NO: 74392 - protein, 9 aa, Artificial Sequence
  Description of Artificial Sequence: Synthetic peptide
  Seed: SSSDTLLES (MAGC1_HUMAN)
SASDTLLEH

SEQ ID NO: 74393 - protein, 9 aa, Artificial Sequence
  Description of Artificial Sequence: Synthetic peptide
  Seed: SSPESAQSA (MAGC1_HUMAN)
SSPESAQSI

SEQ ID NO: 74394 - protein, 11 aa, Artificial Sequence
  Description of Artificial Sequence: Synthetic peptide
  Seed: IPVSSSFSYTL (MAGC1_HUMAN)
ISVSSSFSYTW

SEQ ID NO: 74395 - protein, 10 aa, Artificial Sequence
  Description of Artificial Sequence: Synthetic peptide
  Seed: STPSSLPQSF (MAGC1_HUMAN)
SAPSSLPQSM

SEQ ID NO: 74396 - protein, 10 aa, Artificial Sequence
  Description of Artificial Sequence: Synthetic peptide
  Seed: SFSSTLLSIL (MAGC1_HUMAN)
SASSTLLSIF

SEQ ID NO: 74397 - protein, 9 aa, Artificial Sequence
  Description of Artificial Sequence: Synthetic peptide
  Seed: VSSSSSSTL (MAGC1_HUMAN)
VLSSSSSTF

SEQ ID NO: 74398 - protein, 11 aa, Artificial Sequence
  Description of Artificial Sequence: Synthetic peptide
  Seed: SSSFSYTLLSL (MAGC1_HUMAN)
SKSFSYTLLSW

SEQ ID NO: 74399 - protein, 10 aa, Artificial Sequence
  Description of Artificial Sequence: Synthetic peptide
  Seed: SLFQSFSERT (MAGC1_HUMAN)
SMFQSFSERI

SEQ ID NO: 74400 - protein, 10 aa, Artificial Sequence
  Description of Artificial Sequence: Synthetic peptide
  Seed: SPLQNPASSF (MAGC1_HUMAN)
SQLQNPASSY

SEQ ID NO: 74401 - protein, 9 aa, Artificial Sequence
  Description of Artificial Sequence: Synthetic peptide
  Seed: MTSSFSSTL (MAGC1_HUMAN)
MQSSFSSTH

SEQ ID NO: 74402 - protein, 9 aa, Artificial Sequence
  Description of Artificial Sequence: Synthetic peptide
  Seed: LQIPMTSSF (MAGC1_HUMAN)
LGIPMTSSF

SEQ ID NO: 74403 - protein, 9 aa, Artificial Sequence
  Description of Artificial Sequence: Synthetic peptide
  Seed: SLLQSSHES (MAGC1_HUMAN)
SLLQSSHEI

SEQ ID NO: 74404 - protein, 10 aa, Artificial Sequence
  Description of Artificial Sequence: Synthetic peptide
  Seed: FPQSLLQIPM (MAGC1_HUMAN)
FFQSLLQIPF

SEQ ID NO: 74405 - protein, 9 aa, Artificial Sequence
  Description of Artificial Sequence: Synthetic peptide
  Seed: FAFGEPREL (MAGC1_HUMAN)
FAFGEPREI

SEQ ID NO: 74406 - protein, 9 aa, Artificial Sequence
  Description of Artificial Sequence: Synthetic peptide
  Seed: VSSSFSYTL (MAGC1_HUMAN)
VTSSFSYTV

SEQ ID NO: 74407 - protein, 10 aa, Artificial Sequence
  Description of Artificial Sequence: Synthetic peptide
  Seed: SIIFIKGTYA (MAGC1_HUMAN)
SLIFIKGTYA

SEQ ID NO: 74408 - protein, 9 aa, Artificial Sequence
  Description of Artificial Sequence: Synthetic peptide
  Seed: VSPSSSSTL (MAGC1_HUMAN)
VFPSSSSTV

SEQ ID NO: 74409 - protein, 11 aa, Artificial Sequence
  Description of Artificial Sequence: Synthetic peptide
  Seed: LQRPVSSFFSY (MAGC1_HUMAN)
LERPVSSFFSY

SEQ ID NO: 74410 - protein, 11 aa, Artificial Sequence
  Description of Artificial Sequence: Synthetic peptide
  Seed: IPVSAASSSTL (MAGC1_HUMAN)
IEVSAASSSTW

SEQ ID NO: 74411 - protein, 10 aa, Artificial Sequence
  Description of Artificial Sequence: Synthetic peptide
  Seed: KAREFIEILF (MAGC1_HUMAN)
KIREFIEILY

SEQ ID NO: 74412 - protein, 10 aa, Artificial Sequence
  Description of Artificial Sequence: Synthetic peptide
  Seed: SFFSSALLSI (MAGC1_HUMAN)
SYFSSALLSY

SEQ ID NO: 74413 - protein, 11 aa, Artificial Sequence
  Description of Artificial Sequence: Synthetic peptide
  Seed: IPMTSSFSSTL (MAGC1_HUMAN)
INMTSSFSSTY

SEQ ID NO: 74414 - protein, 9 aa, Artificial Sequence
  Description of Artificial Sequence: Synthetic peptide
  Seed: SFSERTQST (MAGC1_HUMAN)
SFSERTQSF

SEQ ID NO: 74415 - protein, 9 aa, Artificial Sequence
  Description of Artificial Sequence: Synthetic peptide
  Seed: RPVSSFFSY (MAGC1_HUMAN)
RMVSSFFSW

SEQ ID NO: 74416 - protein, 10 aa, Artificial Sequence
  Description of Artificial Sequence: Synthetic peptide
  Seed: ASSFFSSALL (MAGC1_HUMAN)
AHSFFSSALF

SEQ ID NO: 74417 - protein, 9 aa, Artificial Sequence
  Description of Artificial Sequence: Synthetic peptide
  Seed: STQSPFEGF (MAGC1_HUMAN)
SMQSPFEGR

SEQ ID NO: 74418 - protein, 9 aa, Artificial Sequence
  Description of Artificial Sequence: Synthetic peptide
  Seed: FQSSLQSPV (MAGC1_HUMAN)
FVSSLQSPA

SEQ ID NO: 74419 - protein, 9 aa, Artificial Sequence
  Description of Artificial Sequence: Synthetic peptide
  Seed: ISFSSSTSL (MAGC1_HUMAN)
IVFSSSTSF

SEQ ID NO: 74420 - protein, 9 aa, Artificial Sequence
  Description of Artificial Sequence: Synthetic peptide
  Seed: FQSSPERTH (MAGC1_HUMAN)
FGSSPERTY

SEQ ID NO: 74421 - protein, 10 aa, Artificial Sequence
  Description of Artificial Sequence: Synthetic peptide
  Seed: EILFGISLRE (MAGC1_HUMAN)
EYLFGISLRK

SEQ ID NO: 74422 - protein, 10 aa, Artificial Sequence
  Description of Artificial Sequence: Synthetic peptide
  Seed: RSFSSTLLSI (MAGC1_HUMAN)
RSFSSTLLSL

SEQ ID NO: 74423 - protein, 10 aa, Artificial Sequence
  Description of Artificial Sequence: Synthetic peptide
  Seed: STFEGFPQSL (MAGC1_HUMAN)
STFEGFPQSM

SEQ ID NO: 74424 - protein, 10 aa, Artificial Sequence
  Description of Artificial Sequence: Synthetic peptide
  Seed: LSQSSPVSSF (MAGC1_HUMAN)
LGQSSPVSSM

SEQ ID NO: 74425 - protein, 9 aa, Artificial Sequence
  Description of Artificial Sequence: Synthetic peptide
  Seed: FSSTLLSLF (MAGC1_HUMAN)
FQSTLLSLA

SEQ ID NO: 74426 - protein, 10 aa, Artificial Sequence
  Description of Artificial Sequence: Synthetic peptide
  Seed: FFSYTLASLL (MAGC1_HUMAN)
FASYTLASLY

SEQ ID NO: 74427 - protein, 10 aa, Artificial Sequence
  Description of Artificial Sequence: Synthetic peptide
  Seed: RSFSSTLLSI (MAGC1_HUMAN)
RTFSSTLLSY

SEQ ID NO: 74428 - protein, 10 aa, Artificial Sequence
  Description of Artificial Sequence: Synthetic peptide
  Seed: IPVSAASSST (MAGC1_HUMAN)
IPVSAASSSA

SEQ ID NO: 74429 - protein, 11 aa, Artificial Sequence
  Description of Artificial Sequence: Synthetic peptide
  Seed: VDEYTSSSDTL (MAGC1_HUMAN)
VSEYTSSSDTF

SEQ ID NO: 74430 - protein, 11 aa, Artificial Sequence
  Description of Artificial Sequence: Synthetic peptide
  Seed: SFFSYTLASLL (MAGC1_HUMAN)
STFSYTLASLF

SEQ ID NO: 74431 - protein, 11 aa, Artificial Sequence
  Description of Artificial Sequence: Synthetic peptide
  Seed: IPVSAASSSTL (MAGC1_HUMAN)
IMVSAASSSTF

SEQ ID NO: 74432 - protein, 9 aa, Artificial Sequence
  Description of Artificial Sequence: Synthetic peptide
  Seed: LILSIIFIK (MAGC1_HUMAN)
LYLSIIFIR

SEQ ID NO: 74433 - protein, 9 aa, Artificial Sequence
  Description of Artificial Sequence: Synthetic peptide
  Seed: KDSQSPLQI (MAGC1_HUMAN)
KLSQSPLQF

SEQ ID NO: 74434 - protein, 9 aa, Artificial Sequence
  Description of Artificial Sequence: Synthetic peptide
  Seed: TLDEKVDEL (MAGC1_HUMAN)
TNDEKVDEL

SEQ ID NO: 74435 - protein, 10 aa, Artificial Sequence
  Description of Artificial Sequence: Synthetic peptide
  Seed: SRYTGYFPVI (MAGC1_HUMAN)
SHYTGYFPVI

SEQ ID NO: 74436 - protein, 10 aa, Artificial Sequence
  Description of Artificial Sequence: Synthetic peptide
  Seed: STLLSLFQSF (MAGC1_HUMAN)
SILLSLFQSF

SEQ ID NO: 74437 - protein, 9 aa, Artificial Sequence
  Description of Artificial Sequence: Synthetic peptide
  Seed: FQSSLQSPV (MAGC1_HUMAN)
FMSSLQSPC

SEQ ID NO: 74438 - protein, 10 aa, Artificial Sequence
  Description of Artificial Sequence: Synthetic peptide
  Seed: YLEYREVPNS (MAGC1_HUMAN)
YLEYREVPNI

SEQ ID NO: 74439 - protein, 9 aa, Artificial Sequence
  Description of Artificial Sequence: Synthetic peptide
  Seed: WVQEHYLEY (MAGC1_HUMAN)
WGQEHYLEY

SEQ ID NO: 74440 - protein, 9 aa, Artificial Sequence
  Description of Artificial Sequence: Synthetic peptide
  Seed: FPSSTSSSL (MAGC1_HUMAN)
FRSSTSSSM

SEQ ID NO: 74441 - protein, 10 aa, Artificial Sequence
  Description of Artificial Sequence: Synthetic peptide
  Seed: SSPERTHSTF (MAGC1_HUMAN)
SNPERTHSTM

SEQ ID NO: 74442 - protein, 9 aa, Artificial Sequence
  Description of Artificial Sequence: Synthetic peptide
  Seed: SPLQIVPSL (MAGC1_HUMAN)
SQLQIVPSI

SEQ ID NO: 74443 - protein, 11 aa, Artificial Sequence
  Description of Artificial Sequence: Synthetic peptide
  Seed: TTDDSTATESA (MAGC1_HUMAN)
TSDDSTATESL

SEQ ID NO: 74444 - protein, 9 aa, Artificial Sequence
  Description of Artificial Sequence: Synthetic peptide
  Seed: SIIFIKGTY (MAGC1_HUMAN)
SHIFIKGTY

SEQ ID NO: 74445 - protein, 10 aa, Artificial Sequence
  Description of Artificial Sequence: Synthetic peptide
  Seed: SFFSYTLASL (MAGC1_HUMAN)
SLFSYTLASA

SEQ ID NO: 74446 - protein, 9 aa, Artificial Sequence
  Description of Artificial Sequence: Synthetic peptide
  Seed: KVWVQEHYL (MAGC1_HUMAN)
KQWVQEHYM

SEQ ID NO: 74447 - protein, 9 aa, Artificial Sequence
  Description of Artificial Sequence: Synthetic peptide
  Seed: EHFAFGEPR (MAGC1_HUMAN)
EFFAFGEPR

SEQ ID NO: 74448 - protein, 9 aa, Artificial Sequence
  Description of Artificial Sequence: Synthetic peptide
  Seed: RLLILILSI (MAGC1_HUMAN)
RILILILSY

SEQ ID NO: 74449 - protein, 11 aa, Artificial Sequence
  Description of Artificial Sequence: Synthetic peptide
  Seed: STFEGFAQSPL (MAGC1_HUMAN)
SLFEGFAQSPV

SEQ ID NO: 74450 - protein, 9 aa, Artificial Sequence
  Description of Artificial Sequence: Synthetic peptide
  Seed: IIDTTDDST (MAGC1_HUMAN)
IGDTTDDSV

SEQ ID NO: 74451 - protein, 9 aa, Artificial Sequence
  Description of Artificial Sequence: Synthetic peptide
  Seed: LQIPVSPSF (MAGC1_HUMAN)
LFIPVSPSF

SEQ ID NO: 74452 - protein, 10 aa, Artificial Sequence
  Description of Artificial Sequence: Synthetic peptide
  Seed: SSPPRYEFLW (MAGC1_HUMAN)
SWPPRYEFLI

SEQ ID NO: 74453 - protein, 9 aa, Artificial Sequence
  Description of Artificial Sequence: Synthetic peptide
  Seed: VISRYTGYF (MAGC1_HUMAN)
VKSRYTGYF

SEQ ID NO: 74454 - protein, 9 aa, Artificial Sequence
  Description of Artificial Sequence: Synthetic peptide
  Seed: FAFGEPREL (MAGC1_HUMAN)
FLFGEPREV

SEQ ID NO: 74455 - protein, 11 aa, Artificial Sequence
  Description of Artificial Sequence: Synthetic peptide
  Seed: SFFSSALLSIF (MAGC1_HUMAN)
SHFSSALLSIW

SEQ ID NO: 74456 - protein, 10 aa, Artificial Sequence
  Description of Artificial Sequence: Synthetic peptide
  Seed: KVVEFLAMLK (MAGC1_HUMAN)
KAVEFLAMLK

SEQ ID NO: 74457 - protein, 9 aa, Artificial Sequence
  Description of Artificial Sequence: Synthetic peptide
  Seed: AFGEPRELL (MAGC1_HUMAN)
AYGEPRELI

SEQ ID NO: 74458 - protein, 9 aa, Artificial Sequence
  Description of Artificial Sequence: Synthetic peptide
  Seed: RAGREHFAF (MAGC1_HUMAN)
RSGREHFAF

SEQ ID NO: 74459 - protein, 9 aa, Artificial Sequence
  Description of Artificial Sequence: Synthetic peptide
  Seed: ISFSSSTSL (MAGC1_HUMAN)
IIFSSSTSM

SEQ ID NO: 74460 - protein, 9 aa, Artificial Sequence
  Description of Artificial Sequence: Synthetic peptide
  Seed: SSSVMSPSF (MAGC1_HUMAN)
SESVMSPSY

SEQ ID NO: 74461 - protein, 9 aa, Artificial Sequence
  Description of Artificial Sequence: Synthetic peptide
  Seed: YTLASLLQS (MAGC1_HUMAN)
YVLASLLQA

SEQ ID NO: 74462 - protein, 9 aa, Artificial Sequence
  Description of Artificial Sequence: Synthetic peptide
  Seed: YTSSSDTLL (MAGC1_HUMAN)
YISSSDTLY

SEQ ID NO: 74463 - protein, 9 aa, Artificial Sequence
  Description of Artificial Sequence: Synthetic peptide
  Seed: GFPQSVLQI (MAGC1_HUMAN)
GYPQSVLQW

SEQ ID NO: 74464 - protein, 9 aa, Artificial Sequence
  Description of Artificial Sequence: Synthetic peptide
  Seed: SFSERTQST (MAGC1_HUMAN)
SFSERTQSM

SEQ ID NO: 74465 - protein, 11 aa, Artificial Sequence
  Description of Artificial Sequence: Synthetic peptide
  Seed: QSSPESAQSTF (MAGC1_HUMAN)
QVSPESAQSTF

SEQ ID NO: 74466 - protein, 9 aa, Artificial Sequence
  Description of Artificial Sequence: Synthetic peptide
  Seed: AQSPLQIPV (MAGC1_HUMAN)
AQSPLQIPL

SEQ ID NO: 74467 - protein, 9 aa, Artificial Sequence
  Description of Artificial Sequence: Synthetic peptide
  Seed: SQSPPEGPV (MAGC1_HUMAN)
SSSPPEGPL

SEQ ID NO: 74468 - protein, 10 aa, Artificial Sequence
  Description of Artificial Sequence: Synthetic peptide
  Seed: SRYTGYFPVI (MAGC1_HUMAN)
SHYTGYFPVM

SEQ ID NO: 74469 - protein, 10 aa, Artificial Sequence
  Description of Artificial Sequence: Synthetic peptide
  Seed: PLQIPMTSSF (MAGC1_HUMAN)
PHQIPMTSSF

SEQ ID NO: 74470 - protein, 9 aa, Artificial Sequence
  Description of Artificial Sequence: Synthetic peptide
  Seed: YQVKQPITK (MAGC1_HUMAN)
YTVKQPITV

SEQ ID NO: 74471 - protein, 10 aa, Artificial Sequence
  Description of Artificial Sequence: Synthetic peptide
  Seed: YTLLSLFQSS (MAGC1_HUMAN)
YCLLSLFQSI

SEQ ID NO: 74472 - protein, 10 aa, Artificial Sequence
  Description of Artificial Sequence: Synthetic peptide
  Seed: FPQSLLQIPM (MAGC1_HUMAN)
FQQSLLQIPI

SEQ ID NO: 74473 - protein, 9 aa, Artificial Sequence
  Description of Artificial Sequence: Synthetic peptide
  Seed: MSQNRLLIL (MAGC1_HUMAN)
MRQNRLLIL

SEQ ID NO: 74474 - protein, 8 aa, Artificial Sequence
  Description of Artificial Sequence: Synthetic peptide
  Seed: HYLEYREV (MAGC1_HUMAN)
HYLEYREY

SEQ ID NO: 74475 - protein, 10 aa, Artificial Sequence
  Description of Artificial Sequence: Synthetic peptide
  Seed: SLIESEPLFT (MAGC1_HUMAN)
SMIESEPLFI

SEQ ID NO: 74476 - protein, 9 aa, Artificial Sequence
  Description of Artificial Sequence: Synthetic peptide
  Seed: SIIFIKGTY (MAGC1_HUMAN)
SAIFIKGTR

SEQ ID NO: 74477 - protein, 8 aa, Artificial Sequence
  Description of Artificial Sequence: Synthetic peptide
  Seed: REVPNSSP (MAGC1_HUMAN)
REVPNSSA

SEQ ID NO: 74478 - protein, 9 aa, Artificial Sequence
  Description of Artificial Sequence: Synthetic peptide
  Seed: QVKQPITKA (MAGC1_HUMAN)
QAKQPITKM

SEQ ID NO: 74479 - protein, 9 aa, Artificial Sequence
  Description of Artificial Sequence: Synthetic peptide
  Seed: KVWVQEHYL (MAGC1_HUMAN)
KVWVQEHYW

SEQ ID NO: 74480 - protein, 9 aa, Artificial Sequence
  Description of Artificial Sequence: Synthetic peptide
  Seed: LQIPVSAAS (MAGC1_HUMAN)
LMIPVSAAF

SEQ ID NO: 74481 - protein, 9 aa, Artificial Sequence
  Description of Artificial Sequence: Synthetic peptide
  Seed: VSAASSSTL (MAGC1_HUMAN)
VWAASSSTY

SEQ ID NO: 74482 - protein, 9 aa, Artificial Sequence
  Description of Artificial Sequence: Synthetic peptide
  Seed: YVFVNTLDL (MAGC1_HUMAN)
YPFVNTLDH

SEQ ID NO: 74483 - protein, 9 aa, Artificial Sequence
  Description of Artificial Sequence: Synthetic peptide
  Seed: KDSLSPLEI (MAGC1_HUMAN)
KLSLSPLEL

SEQ ID NO: 74484 - protein, 8 aa, Artificial Sequence
  Description of Artificial Sequence: Synthetic peptide
  Seed: LAMLKNTV (MAGC1_HUMAN)
LPMLKNTL

SEQ ID NO: 74485 - protein, 9 aa, Artificial Sequence
  Description of Artificial Sequence: Synthetic peptide
  Seed: SSHESPQSP (MAGC1_HUMAN)
SVHESPQSF

SEQ ID NO: 74486 - protein, 9 aa, Artificial Sequence
  Description of Artificial Sequence: Synthetic peptide
  Seed: ISFSSSTSL (MAGC1_HUMAN)
IVFSSSTSA

SEQ ID NO: 74487 - protein, 9 aa, Artificial Sequence
  Description of Artificial Sequence: Synthetic peptide
  Seed: TLDEKVDEL (MAGC1_HUMAN)
TSDEKVDEL

SEQ ID NO: 74488 - protein, 9 aa, Artificial Sequence
  Description of Artificial Sequence: Synthetic peptide
  Seed: CSSSTPSSL (MAGC1_HUMAN)
CASSTPSSF

SEQ ID NO: 74489 - protein, 9 aa, Artificial Sequence
  Description of Artificial Sequence: Synthetic peptide
  Seed: SSSSTLLSL (MAGC1_HUMAN)
SFSSTLLSW

SEQ ID NO: 74490 - protein, 9 aa, Artificial Sequence
  Description of Artificial Sequence: Synthetic peptide
  Seed: MPSLLQSSS (MAGC1_HUMAN)
MMSLLQSSM

SEQ ID NO: 74491 - protein, 10 aa, Artificial Sequence
  Description of Artificial Sequence: Synthetic peptide
  Seed: KRKVVEFLAM (MAGC1_HUMAN)
KEKVVEFLAF

SEQ ID NO: 74492 - protein, 10 aa, Artificial Sequence
  Description of Artificial Sequence: Synthetic peptide
  Seed: LQIPVSSSFS (MAGC1_HUMAN)
LKIPVSSSFL

SEQ ID NO: 74493 - protein, 9 aa, Artificial Sequence
  Description of Artificial Sequence: Synthetic peptide
  Seed: FSSTLLSIL (MAGC1_HUMAN)
FLSTLLSIY

SEQ ID NO: 74494 - protein, 9 aa, Artificial Sequence
  Description of Artificial Sequence: Synthetic peptide
  Seed: TLDEKVDEL (MAGC1_HUMAN)
TLDEKVDEF

SEQ ID NO: 74495 - protein, 9 aa, Artificial Sequence
  Description of Artificial Sequence: Synthetic peptide
  Seed: VPITFPSSY (MAGC1_HUMAN)
VEITFPSSM

SEQ ID NO: 74496 - protein, 9 aa, Artificial Sequence
  Description of Artificial Sequence: Synthetic peptide
  Seed: EHFAFGEPR (MAGC1_HUMAN)
EYFAFGEPR

SEQ ID NO: 74497 - protein, 9 aa, Artificial Sequence
  Description of Artificial Sequence: Synthetic peptide
  Seed: AGREHFAFG (MAGC1_HUMAN)
AVREHFAFS

SEQ ID NO: 74498 - protein, 9 aa, Artificial Sequence
  Description of Artificial Sequence: Synthetic peptide
  Seed: LKYQVKQPI (MAGC1_HUMAN)
LQYQVKQPW

SEQ ID NO: 74499 - protein, 10 aa, Artificial Sequence
  Description of Artificial Sequence: Synthetic peptide
  Seed: LQIPVSPSFS (MAGC1_HUMAN)
LTIPVSPSFF

SEQ ID NO: 74500 - protein, 9 aa, Artificial Sequence
  Description of Artificial Sequence: Synthetic peptide
  Seed: KVVEFLAML (MAGC1_HUMAN)
KRVEFLAMV

SEQ ID NO: 74501 - protein, 9 aa, Artificial Sequence
  Description of Artificial Sequence: Synthetic peptide
  Seed: SSPESPLQS (MAGC1_HUMAN)
SIPESPLQI

SEQ ID NO: 74502 - protein, 11 aa, Artificial Sequence
  Description of Artificial Sequence: Synthetic peptide
  Seed: GENTHSPLQIV (MAGC1_HUMAN)
GENTHSPLQIL

SEQ ID NO: 74503 - protein, 10 aa, Artificial Sequence
  Description of Artificial Sequence: Synthetic peptide
  Seed: SSFSYTLLSL (MAGC1_HUMAN)
STFSYTLLSA

SEQ ID NO: 74504 - protein, 9 aa, Artificial Sequence
  Description of Artificial Sequence: Synthetic peptide
  Seed: SSPESTQSP (MAGC1_HUMAN)
SMPESTQSV

SEQ ID NO: 74505 - protein, 10 aa, Artificial Sequence
  Description of Artificial Sequence: Synthetic peptide
  Seed: RSFSSTLLSI (MAGC1_HUMAN)
RVFSSTLLSF

SEQ ID NO: 74506 - protein, 9 aa, Artificial Sequence
  Description of Artificial Sequence: Synthetic peptide
  Seed: FQSSLQSPV (MAGC1_HUMAN)
FTSSLQSPI

SEQ ID NO: 74507 - protein, 9 aa, Artificial Sequence
  Description of Artificial Sequence: Synthetic peptide
  Seed: FFSYTLASL (MAGC1_HUMAN)
FVSYTLASF

SEQ ID NO: 74508 - protein, 9 aa, Artificial Sequence
  Description of Artificial Sequence: Synthetic peptide
  Seed: LLILILSII (MAGC1_HUMAN)
LIILILSIV

SEQ ID NO: 74509 - protein, 8 aa, Artificial Sequence
  Description of Artificial Sequence: Synthetic peptide
  Seed: LTDSESLI (MAGC1_HUMAN)
LADSESLI

SEQ ID NO: 74510 - protein, 9 aa, Artificial Sequence
  Description of Artificial Sequence: Synthetic peptide
  Seed: SSLSQSSPV (MAGC1_HUMAN)
STLSQSSPL

SEQ ID NO: 74511 - protein, 11 aa, Artificial Sequence
  Description of Artificial Sequence: Synthetic peptide
  Seed: SLIESEPLFTY (MAGC1_HUMAN)
SQIESEPLFTM

SEQ ID NO: 74512 - protein, 9 aa, Artificial Sequence
  Description of Artificial Sequence: Synthetic peptide
  Seed: AGREHFAFG (MAGC1_HUMAN)
ATREHFAFH

SEQ ID NO: 74513 - protein, 9 aa, Artificial Sequence
  Description of Artificial Sequence: Synthetic peptide
  Seed: AQSPLQSPV (MAGC1_HUMAN)
AMSPLQSPM

SEQ ID NO: 74514 - protein, 10 aa, Artificial Sequence
  Description of Artificial Sequence: Synthetic peptide
  Seed: MPTAGMPSLL (MAGC1_HUMAN)
MTTAGMPSLM

SEQ ID NO: 74515 - protein, 9 aa, Artificial Sequence
  Description of Artificial Sequence: Synthetic peptide
  Seed: KAREFIEIL (MAGC1_HUMAN)
KMREFIEIL

SEQ ID NO: 74516 - protein, 9 aa, Artificial Sequence
  Description of Artificial Sequence: Synthetic peptide
  Seed: FFSSALLSI (MAGC1_HUMAN)
FMSSALLSI

SEQ ID NO: 74517 - protein, 11 aa, Artificial Sequence
  Description of Artificial Sequence: Synthetic peptide
  Seed: SLQIPVSPSFS (MAGC1_HUMAN)
SMQIPVSPSFY

SEQ ID NO: 74518 - protein, 9 aa, Artificial Sequence
  Description of Artificial Sequence: Synthetic peptide
  Seed: LQNPASSFF (MAGC1_HUMAN)
LVNPASSFV

SEQ ID NO: 74519 - protein, 9 aa, Artificial Sequence
  Description of Artificial Sequence: Synthetic peptide
  Seed: CSSSTSLSL (MAGC1_HUMAN)
CKSSTSLSY

SEQ ID NO: 74520 - protein, 10 aa, Artificial Sequence
  Description of Artificial Sequence: Synthetic peptide
  Seed: LQIPMTSSFS (MAGC1_HUMAN)
LTIPMTSSFF

SEQ ID NO: 74521 - protein, 9 aa, Artificial Sequence
  Description of Artificial Sequence: Synthetic peptide
  Seed: RSFSSTLLS (MAGC1_HUMAN)
RLFSSTLLF

SEQ ID NO: 74522 - protein, 10 aa, Artificial Sequence
  Description of Artificial Sequence: Synthetic peptide
  Seed: SRYTGYFPVI (MAGC1_HUMAN)
SNYTGYFPVF

SEQ ID NO: 74523 - protein, 10 aa, Artificial Sequence
  Description of Artificial Sequence: Synthetic peptide
  Seed: LAMLKNTVPI (MAGC1_HUMAN)
LSMLKNTVPF

SEQ ID NO: 74524 - protein, 9 aa, Artificial Sequence
  Description of Artificial Sequence: Synthetic peptide
  Seed: RYTGYFPVI (MAGC1_HUMAN)
RWTGYFPVF

SEQ ID NO: 74525 - protein, 10 aa, Artificial Sequence
  Description of Artificial Sequence: Synthetic peptide
  Seed: FFSYTLASLL (MAGC1_HUMAN)
FESYTLASLY

SEQ ID NO: 74526 - protein, 9 aa, Artificial Sequence
  Description of Artificial Sequence: Synthetic peptide
  Seed: LLSLFQSFS (MAGC1_HUMAN)
LISLFQSFI

SEQ ID NO: 74527 - protein, 9 aa, Artificial Sequence
  Description of Artificial Sequence: Synthetic peptide
  Seed: YVFVNTLDL (MAGC1_HUMAN)
YLFVNTLDM

SEQ ID NO: 74528 - protein, 9 aa, Artificial Sequence
  Description of Artificial Sequence: Synthetic peptide
  Seed: STQSPFEGF (MAGC1_HUMAN)
STQSPFEGY

SEQ ID NO: 74529 - protein, 9 aa, Artificial Sequence
  Description of Artificial Sequence: Synthetic peptide
  Seed: FSSTLLSLF (MAGC1_HUMAN)
FVSTLLSLV

SEQ ID NO: 74530 - protein, 9 aa, Artificial Sequence
  Description of Artificial Sequence: Synthetic peptide
  Seed: LQIPVSSSS (MAGC1_HUMAN)
LGIPVSSSL

SEQ ID NO: 74531 - protein, 10 aa, Artificial Sequence
  Description of Artificial Sequence: Synthetic peptide
  Seed: MTSSFSSTLL (MAGC1_HUMAN)
MHSSFSSTLF

SEQ ID NO: 74532 - protein, 10 aa, Artificial Sequence
  Description of Artificial Sequence: Synthetic peptide
  Seed: LSIIFIKGTY (MAGC1_HUMAN)
LQIIFIKGTF

SEQ ID NO: 74533 - protein, 10 aa, Artificial Sequence
  Description of Artificial Sequence: Synthetic peptide
  Seed: IIDTTDDSTA (MAGC1_HUMAN)
ISDTTDDSTM

SEQ ID NO: 74534 - protein, 9 aa, Artificial Sequence
  Description of Artificial Sequence: Synthetic peptide
  Seed: SSSSTLLSL (MAGC1_HUMAN)
SYSSTLLSV

SEQ ID NO: 74535 - protein, 9 aa, Artificial Sequence
  Description of Artificial Sequence: Synthetic peptide
  Seed: SPPEGENTH (MAGC1_HUMAN)
SQPEGENTF

SEQ ID NO: 74536 - protein, 10 aa, Artificial Sequence
  Description of Artificial Sequence: Synthetic peptide
  Seed: MPTAGMPSLL (MAGC1_HUMAN)
MGTAGMPSLW

SEQ ID NO: 74537 - protein, 10 aa, Artificial Sequence
  Description of Artificial Sequence: Synthetic peptide
  Seed: SQNRLLILIL (MAGC1_HUMAN)
SMNRLLILIF

SEQ ID NO: 74538 - protein, 10 aa, Artificial Sequence
  Description of Artificial Sequence: Synthetic peptide
  Seed: VSSSSSSSTL (MAGC1_HUMAN)
VSSSSSSSTW

SEQ ID NO: 74539 - protein, 9 aa, Artificial Sequence
  Description of Artificial Sequence: Synthetic peptide
  Seed: SPESDDTLY (MAGC1_HUMAN)
SLESDDTLY

SEQ ID NO: 74540 - protein, 10 aa, Artificial Sequence
  Description of Artificial Sequence: Synthetic peptide
  Seed: YTLASLLQSS (MAGC1_HUMAN)
YHLASLLQSV

SEQ ID NO: 74541 - protein, 10 aa, Artificial Sequence
  Description of Artificial Sequence: Synthetic peptide
  Seed: LAMLKNTVPI (MAGC1_HUMAN)
LCMLKNTVPV

SEQ ID NO: 74542 - protein, 9 aa, Artificial Sequence
  Description of Artificial Sequence: Synthetic peptide
  Seed: TPSSLPQSF (MAGC1_HUMAN)
TFSSLPQSL

SEQ ID NO: 74543 - protein, 9 aa, Artificial Sequence
  Description of Artificial Sequence: Synthetic peptide
  Seed: LQRPVSSFF (MAGC1_HUMAN)
LTRPVSSFG

SEQ ID NO: 74544 - protein, 10 aa, Artificial Sequence
  Description of Artificial Sequence: Synthetic peptide
  Seed: ISRYTGYFPV (MAGC1_HUMAN)
IYRYTGYFPL

SEQ ID NO: 74545 - protein, 10 aa, Artificial Sequence
  Description of Artificial Sequence: Synthetic peptide
  Seed: LQIPVSSSFS (MAGC1_HUMAN)
LQIPVSSSFP

SEQ ID NO: 74546 - protein, 9 aa, Artificial Sequence
  Description of Artificial Sequence: Synthetic peptide
  Seed: IPVSSSFSY (MAGC1_HUMAN)
IKVSSSFSV

SEQ ID NO: 74547 - protein, 9 aa, Artificial Sequence
  Description of Artificial Sequence: Synthetic peptide
  Seed: SAQSTFEGF (MAGC1_HUMAN)
SAQSTFEGY

SEQ ID NO: 74548 - protein, 9 aa, Artificial Sequence
  Description of Artificial Sequence: Synthetic peptide
  Seed: SAASSSTLV (MAGC1_HUMAN)
SIASSSTLV

SEQ ID NO: 74549 - protein, 8 aa, Artificial Sequence
  Description of Artificial Sequence: Synthetic peptide
  Seed: QIPVSSSF (MAGC1_HUMAN)
QYPVSSSF

SEQ ID NO: 74550 - protein, 10 aa, Artificial Sequence
  Description of Artificial Sequence: Synthetic peptide
  Seed: RKVVEFLAML (MAGC1_HUMAN)
RMVVEFLAMF

SEQ ID NO: 74551 - protein, 11 aa, Artificial Sequence
  Description of Artificial Sequence: Synthetic peptide
  Seed: ISRYTGYFPVI (MAGC1_HUMAN)
ISRYTGYFPVK

SEQ ID NO: 74552 - protein, 10 aa, Artificial Sequence
  Description of Artificial Sequence: Synthetic peptide
  Seed: YTLLSLFQSS (MAGC1_HUMAN)
YALLSLFQSI

SEQ ID NO: 74553 - protein, 9 aa, Artificial Sequence
  Description of Artificial Sequence: Synthetic peptide
  Seed: VSPSSSSTL (MAGC1_HUMAN)
VFPSSSSTF

SEQ ID NO: 74554 - protein, 9 aa, Artificial Sequence
  Description of Artificial Sequence: Synthetic peptide
  Seed: FSSTLVSLF (MAGC1_HUMAN)
FRSTLVSLL

SEQ ID NO: 74555 - protein, 9 aa, Artificial Sequence
  Description of Artificial Sequence: Synthetic peptide
  Seed: SPPRYEFLW (MAGC1_HUMAN)
SAPRYEFLW

SEQ ID NO: 74556 - protein, 9 aa, Artificial Sequence
  Description of Artificial Sequence: Synthetic peptide
  Seed: LQIPGSPSF (MAGC1_HUMAN)
LWIPGSPSY

SEQ ID NO: 74557 - protein, 9 aa, Artificial Sequence
  Description of Artificial Sequence: Synthetic peptide
  Seed: SSSTSLSPF (MAGC1_HUMAN)
SSSTSLSPL

SEQ ID NO: 74558 - protein, 9 aa, Artificial Sequence
  Description of Artificial Sequence: Synthetic peptide
  Seed: LQNPASSFF (MAGC1_HUMAN)
LHNPASSFL

SEQ ID NO: 74559 - protein, 10 aa, Artificial Sequence
  Description of Artificial Sequence: Synthetic peptide
  Seed: GEDSLSPHYF (MAGC1_HUMAN)
GQDSLSPHYL

SEQ ID NO: 74560 - protein, 9 aa, Artificial Sequence
  Description of Artificial Sequence: Synthetic peptide
  Seed: YVFVNTLDL (MAGC1_HUMAN)
YRFVNTLDF

SEQ ID NO: 74561 - protein, 9 aa, Artificial Sequence
  Description of Artificial Sequence: Synthetic peptide
  Seed: FPSSTSSSL (MAGC1_HUMAN)
FISSTSSSI

SEQ ID NO: 74562 - protein, 9 aa, Artificial Sequence
  Description of Artificial Sequence: Synthetic peptide
  Seed: SGIGVRAGR (MAGC1_HUMAN)
SYIGVRAGR

SEQ ID NO: 74563 - protein, 10 aa, Artificial Sequence
  Description of Artificial Sequence: Synthetic peptide
  Seed: SSSSSSSTLL (MAGC1_HUMAN)
SVSSSSSTLF

SEQ ID NO: 74564 - protein, 9 aa, Artificial Sequence
  Description of Artificial Sequence: Synthetic peptide
  Seed: RYTGYFPVI (MAGC1_HUMAN)
RFTGYFPVF

SEQ ID NO: 74565 - protein, 10 aa, Artificial Sequence
  Description of Artificial Sequence: Synthetic peptide
  Seed: PLQNPASSFF (MAGC1_HUMAN)
PHQNPASSFF

SEQ ID NO: 74566 - protein, 8 aa, Artificial Sequence
  Description of Artificial Sequence: Synthetic peptide
  Seed: RSFSSTLL (MAGC1_HUMAN)
RVFSSTLW

SEQ ID NO: 74567 - protein, 9 aa, Artificial Sequence
  Description of Artificial Sequence: Synthetic peptide
  Seed: WVQEHYLEY (MAGC1_HUMAN)
WSQEHYLEW

SEQ ID NO: 74568 - protein, 10 aa, Artificial Sequence
  Description of Artificial Sequence: Synthetic peptide
  Seed: NSSPPRYEFL (MAGC1_HUMAN)
NVSPPRYEFI

SEQ ID NO: 74569 - protein, 9 aa, Artificial Sequence
  Description of Artificial Sequence: Synthetic peptide
  Seed: VQSPLQNPA (MAGC1_HUMAN)
VLSPLQNPV

SEQ ID NO: 74570 - protein, 10 aa, Artificial Sequence
  Description of Artificial Sequence: Synthetic peptide
  Seed: LQIVPSLPEW (MAGC1_HUMAN)
LTIVPSLPEL

SEQ ID NO: 74571 - protein, 9 aa, Artificial Sequence
  Description of Artificial Sequence: Synthetic peptide
  Seed: RFLLLKYQV (MAGC1_HUMAN)
RFLLLKYQM

SEQ ID NO: 74572 - protein, 10 aa, Artificial Sequence
  Description of Artificial Sequence: Synthetic peptide
  Seed: SSPPRYEFLW (MAGC1_HUMAN)
SWPPRYEFLW

SEQ ID NO: 74573 - protein, 9 aa, Artificial Sequence
  Description of Artificial Sequence: Synthetic peptide
  Seed: FSEESSSPV (MAGC1_HUMAN)
FQEESSSPM

SEQ ID NO: 74574 - protein, 10 aa, Artificial Sequence
  Description of Artificial Sequence: Synthetic peptide
  Seed: LAMLKNTVPI (MAGC1_HUMAN)
LKMLKNTVPM

SEQ ID NO: 74575 - protein, 9 aa, Artificial Sequence
  Description of Artificial Sequence: Synthetic peptide
  Seed: ESDDTLYPL (MAGC1_HUMAN)
EFDDTLYPM

SEQ ID NO: 74576 - protein, 9 aa, Artificial Sequence
  Description of Artificial Sequence: Synthetic peptide
  Seed: VVEFLAMLK (MAGC1_HUMAN)
VAEFLAMLY

SEQ ID NO: 74577 - protein, 9 aa, Artificial Sequence
  Description of Artificial Sequence: Synthetic peptide
  Seed: SSFFSSALL (MAGC1_HUMAN)
STFFSSALF

SEQ ID NO: 74578 - protein, 9 aa, Artificial Sequence
  Description of Artificial Sequence: Synthetic peptide
  Seed: ISFSSSTSL (MAGC1_HUMAN)
IVFSSSTSI

SEQ ID NO: 74579 - protein, 11 aa, Artificial Sequence
  Description of Artificial Sequence: Synthetic peptide
  Seed: SPLQIPGSPSF (MAGC1_HUMAN)
SCLQIPGSPSF

SEQ ID NO: 74580 - protein, 9 aa, Artificial Sequence
  Description of Artificial Sequence: Synthetic peptide
  Seed: LQRPVSSFF (MAGC1_HUMAN)
LYRPVSSFV

SEQ ID NO: 74581 - protein, 9 aa, Artificial Sequence
  Description of Artificial Sequence: Synthetic peptide
  Seed: GMSQNRLLI (MAGC1_HUMAN)
GQSQNRLLL

SEQ ID NO: 74582 - protein, 11 aa, Artificial Sequence
  Description of Artificial Sequence: Synthetic peptide
  Seed: KDMPTAGMPSL (MAGC1_HUMAN)
KPMPTAGMPSM

SEQ ID NO: 74583 - protein, 9 aa, Artificial Sequence
  Description of Artificial Sequence: Synthetic peptide
  Seed: ASSFFSSAL (MAGC1_HUMAN)
ATSFFSSAM

SEQ ID NO: 74584 - protein, 9 aa, Artificial Sequence
  Description of Artificial Sequence: Synthetic peptide
  Seed: RTHSTFEGF (MAGC1_HUMAN)
RQHSTFEGH

SEQ ID NO: 74585 - protein, 9 aa, Artificial Sequence
  Description of Artificial Sequence: Synthetic peptide
  Seed: LQIPVSAAS (MAGC1_HUMAN)
LLIPVSAAY

SEQ ID NO: 74586 - protein, 9 aa, Artificial Sequence
  Description of Artificial Sequence: Synthetic peptide
  Seed: RSFSSTLLS (MAGC1_HUMAN)
RAFSSTLLF

SEQ ID NO: 74587 - protein, 9 aa, Artificial Sequence
  Description of Artificial Sequence: Synthetic peptide
  Seed: TLLSIFQSS (MAGC1_HUMAN)
TLLSIFQSM

SEQ ID NO: 74588 - protein, 9 aa, Artificial Sequence
  Description of Artificial Sequence: Synthetic peptide
  Seed: SFPSSTSSS (MAGC1_HUMAN)
SLPSSTSSF

SEQ ID NO: 74589 - protein, 9 aa, Artificial Sequence
  Description of Artificial Sequence: Synthetic peptide
  Seed: TESASSSVM (MAGC1_HUMAN)
TSSASSSVY

SEQ ID NO: 74590 - protein, 9 aa, Artificial Sequence
  Description of Artificial Sequence: Synthetic peptide
  Seed: DSYVFVNTL (MAGC1_HUMAN)
DMYVFVNTR

SEQ ID NO: 74591 - protein, 9 aa, Artificial Sequence
  Description of Artificial Sequence: Synthetic peptide
  Seed: THSPLQIVP (MAGC1_HUMAN)
THSPLQIVA

SEQ ID NO: 74592 - protein, 11 aa, Artificial Sequence
  Description of Artificial Sequence: Synthetic peptide
  Seed: VISRYTGYFPV (MAGC1_HUMAN)
VMSRYTGYFPI

SEQ ID NO: 74593 - protein, 9 aa, Artificial Sequence
  Description of Artificial Sequence: Synthetic peptide
  Seed: SSFFSSALL (MAGC1_HUMAN)
SVFFSSALY

SEQ ID NO: 74594 - protein, 10 aa, Artificial Sequence
  Description of Artificial Sequence: Synthetic peptide
  Seed: FPQSPLQIPV (MAGC1_HUMAN)
FLQSPLQIPM

SEQ ID NO: 74595 - protein, 9 aa, Artificial Sequence
  Description of Artificial Sequence: Synthetic peptide
  Seed: RPVSSFFSY (MAGC1_HUMAN)
RYVSSFFSM

SEQ ID NO: 74596 - protein, 10 aa, Artificial Sequence
  Description of Artificial Sequence: Synthetic peptide
  Seed: NPASSFFSSA (MAGC1_HUMAN)
NWASSFFSSV

SEQ ID NO: 74597 - protein, 9 aa, Artificial Sequence
  Description of Artificial Sequence: Synthetic peptide
  Seed: YTSSSDTLL (MAGC1_HUMAN)
YVSSSDTLV

SEQ ID NO: 74598 - protein, 10 aa, Artificial Sequence
  Description of Artificial Sequence: Synthetic peptide
  Seed: VSSSSSSSTL (MAGC1_HUMAN)
VQSSSSSSTF

SEQ ID NO: 74599 - protein, 11 aa, Artificial Sequence
  Description of Artificial Sequence: Synthetic peptide
  Seed: IPVSSSSSSTL (MAGC1_HUMAN)
IIVSSSSSSTW

SEQ ID NO: 74600 - protein, 9 aa, Artificial Sequence
  Description of Artificial Sequence: Synthetic peptide
  Seed: CSSSTSLSL (MAGC1_HUMAN)
CGSSTSLSW

SEQ ID NO: 74601 - protein, 11 aa, Artificial Sequence
  Description of Artificial Sequence: Synthetic peptide
  Seed: RPVSSFFSYTL (MAGC1_HUMAN)
RNVSSFFSYTF

SEQ ID NO: 74602 - protein, 10 aa, Artificial Sequence
  Description of Artificial Sequence: Synthetic peptide
  Seed: MPTAGMPSLL (MAGC1_HUMAN)
MRTAGMPSLI

SEQ ID NO: 74603 - protein, 11 aa, Artificial Sequence
  Description of Artificial Sequence: Synthetic peptide
  Seed: IPMTSSFSSTL (MAGC1_HUMAN)
IMMTSSFSSTY

SEQ ID NO: 74604 - protein, 9 aa, Artificial Sequence
  Description of Artificial Sequence: Synthetic peptide
  Seed: LQNPASSFF (MAGC1_HUMAN)
LENPASSFY

SEQ ID NO: 74605 - protein, 9 aa, Artificial Sequence
  Description of Artificial Sequence: Synthetic peptide
  Seed: TSSFSSTLL (MAGC1_HUMAN)
TTSFSSTLW

SEQ ID NO: 74606 - protein, 11 aa, Artificial Sequence
  Description of Artificial Sequence: Synthetic peptide
  Seed: SFFSSALLSIF (MAGC1_HUMAN)
SCFSSALLSIW

SEQ ID NO: 74607 - protein, 10 aa, Artificial Sequence
  Description of Artificial Sequence: Synthetic peptide
  Seed: ICSSSTPSSL (MAGC1_HUMAN)
IHSSSTPSSF

SEQ ID NO: 74608 - protein, 9 aa, Artificial Sequence
  Description of Artificial Sequence: Synthetic peptide
  Seed: YTGYFPVIF (MAGC1_HUMAN)
YTGYFPVIL

SEQ ID NO: 74609 - protein, 10 aa, Artificial Sequence
  Description of Artificial Sequence: Synthetic peptide
  Seed: SRYTGYFPVI (MAGC1_HUMAN)
SMYTGYFPVI

SEQ ID NO: 74610 - protein, 10 aa, Artificial Sequence
  Description of Artificial Sequence: Synthetic peptide
  Seed: SLFQSSPERT (MAGC1_HUMAN)
SVFQSSPERI

SEQ ID NO: 74611 - protein, 9 aa, Artificial Sequence
  Description of Artificial Sequence: Synthetic peptide
  Seed: AQSPLQRPV (MAGC1_HUMAN)
AESPLQRPF

SEQ ID NO: 74612 - protein, 9 aa, Artificial Sequence
  Description of Artificial Sequence: Synthetic peptide
  Seed: FSYTLLSLF (MAGC1_HUMAN)
FKYTLLSLM

SEQ ID NO: 74613 - protein, 9 aa, Artificial Sequence
  Description of Artificial Sequence: Synthetic peptide
  Seed: FAFGEPREL (MAGC1_HUMAN)
FSFGEPREF

SEQ ID NO: 74614 - protein, 9 aa, Artificial Sequence
  Description of Artificial Sequence: Synthetic peptide
  Seed: GFPQSVLQI (MAGC1_HUMAN)
GFPQSVLQW

SEQ ID NO: 74615 - protein, 10 aa, Artificial Sequence
  Description of Artificial Sequence: Synthetic peptide
  Seed: SFPSSTSSSL (MAGC1_HUMAN)
SHPSSTSSSF

SEQ ID NO: 74616 - protein, 9 aa, Artificial Sequence
  Description of Artificial Sequence: Synthetic peptide
  Seed: RLLILILSI (MAGC1_HUMAN)
RTLILILSI

SEQ ID NO: 74617 - protein, 11 aa, Artificial Sequence
  Description of Artificial Sequence: Synthetic peptide
  Seed: SSSSSTLLSLF (MAGC1_HUMAN)
SKSSSTLLSLW

SEQ ID NO: 74618 - protein, 10 aa, Artificial Sequence
  Description of Artificial Sequence: Synthetic peptide
  Seed: SFSSTLLSIF (MAGC1_HUMAN)
SYSSTLLSIM

SEQ ID NO: 74619 - protein, 10 aa, Artificial Sequence
  Description of Artificial Sequence: Synthetic peptide
  Seed: FFSSALLSIF (MAGC1_HUMAN)
FVSSALLSIF

SEQ ID NO: 74620 - protein, 9 aa, Artificial Sequence
  Description of Artificial Sequence: Synthetic peptide
  Seed: SSFFSYTLA (MAGC1_HUMAN)
SQFFSYTLV

SEQ ID NO: 74621 - protein, 11 aa, Artificial Sequence
  Description of Artificial Sequence: Synthetic peptide
  Seed: SFFSYTLASLL (MAGC1_HUMAN)
STFSYTLASLW

SEQ ID NO: 74622 - protein, 9 aa, Artificial Sequence
  Description of Artificial Sequence: Synthetic peptide
  Seed: SSTSSSLSK (MAGC1_HUMAN)
SATSSSLSI

SEQ ID NO: 74623 - protein, 9 aa, Artificial Sequence
  Description of Artificial Sequence: Synthetic peptide
  Seed: QIVPSLPEW (MAGC1_HUMAN)
QQVPSLPEF

SEQ ID NO: 74624 - protein, 9 aa, Artificial Sequence
  Description of Artificial Sequence: Synthetic peptide
  Seed: HFPQSPPEW (MAGC1_HUMAN)
HWPQSPPEM

SEQ ID NO: 74625 - protein, 9 aa, Artificial Sequence
  Description of Artificial Sequence: Synthetic peptide
  Seed: TTDDSTATE (MAGC1_HUMAN)
TGDDSTATL

SEQ ID NO: 74626 - protein, 11 aa, Artificial Sequence
  Description of Artificial Sequence: Synthetic peptide
  Seed: SSSSSSTLLSL (MAGC1_HUMAN)
SLSSSSTLLSF

SEQ ID NO: 74627 - protein, 9 aa, Artificial Sequence
  Description of Artificial Sequence: Synthetic peptide
  Seed: YTGYFPVIF (MAGC1_HUMAN)
YSGYFPVIW

SEQ ID NO: 74628 - protein, 10 aa, Artificial Sequence
  Description of Artificial Sequence: Synthetic peptide
  Seed: SPLQNPASSF (MAGC1_HUMAN)
STLQNPASSY

SEQ ID NO: 74629 - protein, 10 aa, Artificial Sequence
  Description of Artificial Sequence: Synthetic peptide
  Seed: EGPAQSPLQR (MAGC1_HUMAN)
EIPAQSPLQR

SEQ ID NO: 74630 - protein, 11 aa, Artificial Sequence
  Description of Artificial Sequence: Synthetic peptide
  Seed: FLAMLKNTVPI (MAGC1_HUMAN)
FYAMLKNTVPV

SEQ ID NO: 74631 - protein, 10 aa, Artificial Sequence
  Description of Artificial Sequence: Synthetic peptide
  Seed: VSRSFSSTLL (MAGC1_HUMAN)
VTRSFSSTLV

SEQ ID NO: 74632 - protein, 9 aa, Artificial Sequence
  Description of Artificial Sequence: Synthetic peptide
  Seed: SMSPLYFPQ (MAGC1_HUMAN)
SGSPLYFPK

SEQ ID NO: 74633 - protein, 9 aa, Artificial Sequence
  Description of Artificial Sequence: Synthetic peptide
  Seed: SSSDTLLES (MAGC1_HUMAN)
SGSDTLLEM

SEQ ID NO: 74634 - protein, 11 aa, Artificial Sequence
  Description of Artificial Sequence: Synthetic peptide
  Seed: LLQIPMTSSFS (MAGC1_HUMAN)
LKQIPMTSSFY

SEQ ID NO: 74635 - protein, 10 aa, Artificial Sequence
  Description of Artificial Sequence: Synthetic peptide
  Seed: SFSSTLLSIF (MAGC1_HUMAN)
SFSSTLLSIY

SEQ ID NO: 74636 - protein, 9 aa, Artificial Sequence
  Description of Artificial Sequence: Synthetic peptide
  Seed: SSPESPLQS (MAGC1_HUMAN)
SVPESPLQM

SEQ ID NO: 74637 - protein, 9 aa, Artificial Sequence
  Description of Artificial Sequence: Synthetic peptide
  Seed: RTHSTFEGF (MAGC1_HUMAN)
RGHSTFEGW

SEQ ID NO: 74638 - protein, 10 aa, Artificial Sequence
  Description of Artificial Sequence: Synthetic peptide
  Seed: RAHSEVIKRK (MAGC1_HUMAN)
RLHSEVIKRR

SEQ ID NO: 74639 - protein, 10 aa, Artificial Sequence
  Description of Artificial Sequence: Synthetic peptide
  Seed: RYTGYFPVIF (MAGC1_HUMAN)
RVTGYFPVIY

SEQ ID NO: 74640 - protein, 9 aa, Artificial Sequence
  Description of Artificial Sequence: Synthetic peptide
  Seed: TLLSLFQSF (MAGC1_HUMAN)
TALSLFQSV

SEQ ID NO: 74641 - protein, 9 aa, Artificial Sequence
  Description of Artificial Sequence: Synthetic peptide
  Seed: YTSSSDTLL (MAGC1_HUMAN)
YQSSSDTLI

SEQ ID NO: 74642 - protein, 9 aa, Artificial Sequence
  Description of Artificial Sequence: Synthetic peptide
  Seed: SSSTLVSIF (MAGC1_HUMAN)
SPSTLVSIF

SEQ ID NO: 74643 - protein, 10 aa, Artificial Sequence
  Description of Artificial Sequence: Synthetic peptide
  Seed: LAMLKNTVPI (MAGC1_HUMAN)
LVMLKNTVPV

SEQ ID NO: 74644 - protein, 9 aa, Artificial Sequence
  Description of Artificial Sequence: Synthetic peptide
  Seed: SSSESPQSC (MAGC1_HUMAN)
SISESPQSY

SEQ ID NO: 74645 - protein, 9 aa, Artificial Sequence
  Description of Artificial Sequence: Synthetic peptide
  Seed: ASEEVIWDV (MAGC1_HUMAN)
AIEEVIWDV

SEQ ID NO: 74646 - protein, 11 aa, Artificial Sequence
  Description of Artificial Sequence: Synthetic peptide
  Seed: RSFSSTLLSIF (MAGC1_HUMAN)
RDFSSTLLSIW

SEQ ID NO: 74647 - protein, 9 aa, Artificial Sequence
  Description of Artificial Sequence: Synthetic peptide
  Seed: TESASSSVM (MAGC1_HUMAN)
THSASSSVF

SEQ ID NO: 74648 - protein, 11 aa, Artificial Sequence
  Description of Artificial Sequence: Synthetic peptide
  Seed: LQRPVSSFFSY (MAGC1_HUMAN)
LFRPVSSFFSY

SEQ ID NO: 74649 - protein, 10 aa, Artificial Sequence
  Description of Artificial Sequence: Synthetic peptide
  Seed: KAREFIEILF (MAGC1_HUMAN)
KYREFIEILA

SEQ ID NO: 74650 - protein, 9 aa, Artificial Sequence
  Description of Artificial Sequence: Synthetic peptide
  Seed: VIWDVLSGI (MAGC1_HUMAN)
VMWDVLSGS

SEQ ID NO: 74651 - protein, 10 aa, Artificial Sequence
  Description of Artificial Sequence: Synthetic peptide
  Seed: AEMLTNVISR (MAGC1_HUMAN)
AFMLTNVISR

SEQ ID NO: 74652 - protein, 9 aa, Artificial Sequence
  Description of Artificial Sequence: Synthetic peptide
  Seed: NSSPPRYEF (MAGC1_HUMAN)
NLSPPRYEW

SEQ ID NO: 74653 - protein, 9 aa, Artificial Sequence
  Description of Artificial Sequence: Synthetic peptide
  Seed: AQSPLQSPV (MAGC1_HUMAN)
AVSPLQSPA

SEQ ID NO: 74654 - protein, 11 aa, Artificial Sequence
  Description of Artificial Sequence: Synthetic peptide
  Seed: FPSSTSSSLSK (MAGC1_HUMAN)
FPSSTSSSLSL

SEQ ID NO: 74655 - protein, 10 aa, Artificial Sequence
  Description of Artificial Sequence: Synthetic peptide
  Seed: HSPQSPPEGM (MAGC1_HUMAN)
HTPQSPPEGW

SEQ ID NO: 74656 - protein, 10 aa, Artificial Sequence
  Description of Artificial Sequence: Synthetic peptide
  Seed: NPASSFFSSA (MAGC1_HUMAN)
NAASSFFSSI

SEQ ID NO: 74657 - protein, 9 aa, Artificial Sequence
  Description of Artificial Sequence: Synthetic peptide
  Seed: QFPPQGEDF (MAGC1_HUMAN)
QVPPQGEDM

SEQ ID NO: 74658 - protein, 9 aa, Artificial Sequence
  Description of Artificial Sequence: Synthetic peptide
  Seed: LQNPASSFF (MAGC1_HUMAN)
LMNPASSFM

SEQ ID NO: 74659 - protein, 10 aa, Artificial Sequence
  Description of Artificial Sequence: Synthetic peptide
  Seed: FFSSALLSIF (MAGC1_HUMAN)
FPSSALLSIF

SEQ ID NO: 74660 - protein, 9 aa, Artificial Sequence
  Description of Artificial Sequence: Synthetic peptide
  Seed: VQSPLQNPA (MAGC1_HUMAN)
VESPLQNPV

SEQ ID NO: 74661 - protein, 9 aa, Artificial Sequence
  Description of Artificial Sequence: Synthetic peptide
  Seed: FQSSPERTH (MAGC1_HUMAN)
FKSSPERTY

SEQ ID NO: 74662 - protein, 9 aa, Artificial Sequence
  Description of Artificial Sequence: Synthetic peptide
  Seed: ESSSPVDEY (MAGC1_HUMAN)
EVSSPVDEW

SEQ ID NO: 74663 - protein, 9 aa, Artificial Sequence
  Description of Artificial Sequence: Synthetic peptide
  Seed: VSPSFSSTL (MAGC1_HUMAN)
VAPSFSSTY

SEQ ID NO: 74664 - protein, 9 aa, Artificial Sequence
  Description of Artificial Sequence: Synthetic peptide
  Seed: VSPSFSSTL (MAGC1_HUMAN)
VYPSFSSTY

SEQ ID NO: 74665 - protein, 9 aa, Artificial Sequence
  Description of Artificial Sequence: Synthetic peptide
  Seed: MPTAGMPSL (MAGC1_HUMAN)
MMTAGMPSY

SEQ ID NO: 74666 - protein, 9 aa, Artificial Sequence
  Description of Artificial Sequence: Synthetic peptide
  Seed: VSRSFSSTL (MAGC1_HUMAN)
VARSFSSTV

SEQ ID NO: 74667 - protein, 9 aa, Artificial Sequence
  Description of Artificial Sequence: Synthetic peptide
  Seed: DEQGMSQNR (MAGC1_HUMAN)
DYQGMSQNR

SEQ ID NO: 74668 - protein, 10 aa, Artificial Sequence
  Description of Artificial Sequence: Synthetic peptide
  Seed: MPTAGMPSLL (MAGC1_HUMAN)
MLTAGMPSLL

SEQ ID NO: 74669 - protein, 9 aa, Artificial Sequence
  Description of Artificial Sequence: Synthetic peptide
  Seed: VSPSFSSTL (MAGC1_HUMAN)
VWPSFSSTL

SEQ ID NO: 74670 - protein, 10 aa, Artificial Sequence
  Description of Artificial Sequence: Synthetic peptide
  Seed: YTGYFPVIFR (MAGC1_HUMAN)
YYGYFPVIFK

SEQ ID NO: 74671 - protein, 9 aa, Artificial Sequence
  Description of Artificial Sequence: Synthetic peptide
  Seed: YTSSSDTLL (MAGC1_HUMAN)
YISSSDTLL

SEQ ID NO: 74672 - protein, 9 aa, Artificial Sequence
  Description of Artificial Sequence: Synthetic peptide
  Seed: IFRKAREFI (MAGC1_HUMAN)
IVRKAREFK

SEQ ID NO: 74673 - protein, 10 aa, Artificial Sequence
  Description of Artificial Sequence: Synthetic peptide
  Seed: LQIPVSSSFS (MAGC1_HUMAN)
LQIPVSSSFC

SEQ ID NO: 74674 - protein, 10 aa, Artificial Sequence
  Description of Artificial Sequence: Synthetic peptide
  Seed: NRLLILILSI (MAGC1_HUMAN)
NSLLILILSV

SEQ ID NO: 74675 - protein, 11 aa, Artificial Sequence
  Description of Artificial Sequence: Synthetic peptide
  Seed: SPLQIPGSPSF (MAGC1_HUMAN)
SELQIPGSPSY

SEQ ID NO: 74676 - protein, 9 aa, Artificial Sequence
  Description of Artificial Sequence: Synthetic peptide
  Seed: AMLKNTVPI (MAGC1_HUMAN)
ASLKNTVPM

SEQ ID NO: 74677 - protein, 9 aa, Artificial Sequence
  Description of Artificial Sequence: Synthetic peptide
  Seed: MLTNVISRY (MAGC1_HUMAN)
MRTNVISRF

SEQ ID NO: 74678 - protein, 9 aa, Artificial Sequence
  Description of Artificial Sequence: Synthetic peptide
  Seed: SFSSTLVSL (MAGC1_HUMAN)
SPSSTLVSY

SEQ ID NO: 74679 - protein, 10 aa, Artificial Sequence
  Description of Artificial Sequence: Synthetic peptide
  Seed: SSPESTQSPF (MAGC1_HUMAN)
SWPESTQSPL

SEQ ID NO: 74680 - protein, 9 aa, Artificial Sequence
  Description of Artificial Sequence: Synthetic peptide
  Seed: LQSPVISFS (MAGC1_HUMAN)
LMSPVISFV

SEQ ID NO: 74681 - protein, 10 aa, Artificial Sequence
  Description of Artificial Sequence: Synthetic peptide
  Seed: SSFSYTLLSL (MAGC1_HUMAN)
SEFSYTLLSY

SEQ ID NO: 74682 - protein, 10 aa, Artificial Sequence
  Description of Artificial Sequence: Synthetic peptide
  Seed: TTDDSTATES (MAGC1_HUMAN)
TADDSTATEV

SEQ ID NO: 74683 - protein, 9 aa, Artificial Sequence
  Description of Artificial Sequence: Synthetic peptide
  Seed: SSSTLVSIF (MAGC1_HUMAN)
SASTLVSII

SEQ ID NO: 74684 - protein, 10 aa, Artificial Sequence
  Description of Artificial Sequence: Synthetic peptide
  Seed: SIFQSSPESA (MAGC1_HUMAN)
SMFQSSPESL

SEQ ID NO: 74685 - protein, 10 aa, Artificial Sequence
  Description of Artificial Sequence: Synthetic peptide
  Seed: ATESASSSVM (MAGC1_HUMAN)
ALESASSSVW

SEQ ID NO: 74686 - protein, 10 aa, Artificial Sequence
  Description of Artificial Sequence: Synthetic peptide
  Seed: STPSSLPQSF (MAGC1_HUMAN)
SQPSSLPQSY

SEQ ID NO: 74687 - protein, 10 aa, Artificial Sequence
  Description of Artificial Sequence: Synthetic peptide
  Seed: TGYFPVIFRK (MAGC1_HUMAN)
TAYFPVIFRG

SEQ ID NO: 74688 - protein, 10 aa, Artificial Sequence
  Description of Artificial Sequence: Synthetic peptide
  Seed: YASEEVIWDV (MAGC1_HUMAN)
YLSEEVIWDA

SEQ ID NO: 74689 - protein, 11 aa, Artificial Sequence
  Description of Artificial Sequence: Synthetic peptide
  Seed: SPLQIPVSRSF (MAGC1_HUMAN)
SFLQIPVSRSY

SEQ ID NO: 74690 - protein, 9 aa, Artificial Sequence
  Description of Artificial Sequence: Synthetic peptide
  Seed: RPVSSFFSY (MAGC1_HUMAN)
RQVSSFFSF

SEQ ID NO: 74691 - protein, 9 aa, Artificial Sequence
  Description of Artificial Sequence: Synthetic peptide
  Seed: QSPLQGEEF (MAGC1_HUMAN)
QFPLQGEEY

SEQ ID NO: 74692 - protein, 9 aa, Artificial Sequence
  Description of Artificial Sequence: Synthetic peptide
  Seed: LQIPMTSSF (MAGC1_HUMAN)
LRIPMTSSM

SEQ ID NO: 74693 - protein, 9 aa, Artificial Sequence
  Description of Artificial Sequence: Synthetic peptide
  Seed: VSSSFSYTL (MAGC1_HUMAN)
VWSSFSYTW

SEQ ID NO: 74694 - protein, 9 aa, Artificial Sequence
  Description of Artificial Sequence: Synthetic peptide
  Seed: SPQSPPEGP (MAGC1_HUMAN)
SAQSPPEGM

SEQ ID NO: 74695 - protein, 11 aa, Artificial Sequence
  Description of Artificial Sequence: Synthetic peptide
  Seed: FLAMLKNTVPI (MAGC1_HUMAN)
FNAMLKNTVPL

SEQ ID NO: 74696 - protein, 9 aa, Artificial Sequence
  Description of Artificial Sequence: Synthetic peptide
  Seed: SASSSVMSP (MAGC1_HUMAN)
SASSSVMSV

SEQ ID NO: 74697 - protein, 9 aa, Artificial Sequence
  Description of Artificial Sequence: Synthetic peptide
  Seed: AQSPLQIPV (MAGC1_HUMAN)
AESPLQIPM

SEQ ID NO: 74698 - protein, 9 aa, Artificial Sequence
  Description of Artificial Sequence: Synthetic peptide
  Seed: MGDKDMPTA (MAGC1_HUMAN)
MADKDMPTM

SEQ ID NO: 74699 - protein, 10 aa, Artificial Sequence
  Description of Artificial Sequence: Synthetic peptide
  Seed: TTDDSTATES (MAGC1_HUMAN)
TVDDSTATEM

SEQ ID NO: 74700 - protein, 10 aa, Artificial Sequence
  Description of Artificial Sequence: Synthetic peptide
  Seed: SSSSSTLLSL (MAGC1_HUMAN)
SRSSSTLLSY

SEQ ID NO: 74701 - protein, 11 aa, Artificial Sequence
  Description of Artificial Sequence: Synthetic peptide
  Seed: SPQSPPEGMHS (MAGC1_HUMAN)
SPQSPPEGMHM

SEQ ID NO: 74702 - protein, 9 aa, Artificial Sequence
  Description of Artificial Sequence: Synthetic peptide
  Seed: ASSFFSSAL (MAGC1_HUMAN)
AQSFFSSAL

SEQ ID NO: 74703 - protein, 9 aa, Artificial Sequence
  Description of Artificial Sequence: Synthetic peptide
  Seed: RTHSTFEGF (MAGC1_HUMAN)
RQHSTFEGY

SEQ ID NO: 74704 - protein, 10 aa, Artificial Sequence
  Description of Artificial Sequence: Synthetic peptide
  Seed: SSPESAQSAF (MAGC1_HUMAN)
SMPESAQSAM

SEQ ID NO: 74705 - protein, 10 aa, Artificial Sequence
  Description of Artificial Sequence: Synthetic peptide
  Seed: FPQSVLQIPV (MAGC1_HUMAN)
FGQSVLQIPV

SEQ ID NO: 74706 - protein, 10 aa, Artificial Sequence
  Description of Artificial Sequence: Synthetic peptide
  Seed: KRKVVEFLAM (MAGC1_HUMAN)
KHKVVEFLAM

SEQ ID NO: 74707 - protein, 10 aa, Artificial Sequence
  Description of Artificial Sequence: Synthetic peptide
  Seed: FFSYTLASLL (MAGC1_HUMAN)
FCSYTLASLM

SEQ ID NO: 74708 - protein, 9 aa, Artificial Sequence
  Description of Artificial Sequence: Synthetic peptide
  Seed: WVQEHYLEY (MAGC1_HUMAN)
WFQEHYLEM

SEQ ID NO: 74709 - protein, 9 aa, Artificial Sequence
  Description of Artificial Sequence: Synthetic peptide
  Seed: SSPEGKDSL (MAGC1_HUMAN)
SIPEGKDSY

SEQ ID NO: 74710 - protein, 11 aa, Artificial Sequence
  Description of Artificial Sequence: Synthetic peptide
  Seed: RSFSSTLLSIF (MAGC1_HUMAN)
RHFSSTLLSIW

SEQ ID NO: 74711 - protein, 10 aa, Artificial Sequence
  Description of Artificial Sequence: Synthetic peptide
  Seed: YTLDEKVDEL (MAGC1_HUMAN)
YELDEKVDEI

SEQ ID NO: 74712 - protein, 9 aa, Artificial Sequence
  Description of Artificial Sequence: Synthetic peptide
  Seed: YTGYFPVIF (MAGC1_HUMAN)
YTGYFPVIY

SEQ ID NO: 74713 - protein, 9 aa, Artificial Sequence
  Description of Artificial Sequence: Synthetic peptide
  Seed: ASSFFSSAL (MAGC1_HUMAN)
AHSFFSSAM

SEQ ID NO: 74714 - protein, 9 aa, Artificial Sequence
  Description of Artificial Sequence: Synthetic peptide
  Seed: STFEGFAQS (MAGC1_HUMAN)
SSFEGFAQL

SEQ ID NO: 74715 - protein, 10 aa, Artificial Sequence
  Description of Artificial Sequence: Synthetic peptide
  Seed: SSPESAQSAF (MAGC1_HUMAN)
SWPESAQSAL

SEQ ID NO: 74716 - protein, 10 aa, Artificial Sequence
  Description of Artificial Sequence: Synthetic peptide
  Seed: ASSSVMSPSF (MAGC1_HUMAN)
ATSSVMSPSY

SEQ ID NO: 74717 - protein, 9 aa, Artificial Sequence
  Description of Artificial Sequence: Synthetic peptide
  Seed: SSSTLVSIF (MAGC1_HUMAN)
SYSTLVSIF

SEQ ID NO: 74718 - protein, 11 aa, Artificial Sequence
  Description of Artificial Sequence: Synthetic peptide
  Seed: SPLQIPVSSSS (MAGC1_HUMAN)
SKLQIPVSSSM

SEQ ID NO: 74719 - protein, 10 aa, Artificial Sequence
  Description of Artificial Sequence: Synthetic peptide
  Seed: SFSYTLLSLF (MAGC1_HUMAN)
SYSYTLLSLM

SEQ ID NO: 74720 - protein, 10 aa, Artificial Sequence
  Description of Artificial Sequence: Synthetic peptide
  Seed: FAQSSLQIPV (MAGC1_HUMAN)
FAQSSLQIPY

SEQ ID NO: 74721 - protein, 9 aa, Artificial Sequence
  Description of Artificial Sequence: Synthetic peptide
  Seed: SQSSPVSSF (MAGC1_HUMAN)
SQSSPVSSW

SEQ ID NO: 74722 - protein, 9 aa, Artificial Sequence
  Description of Artificial Sequence: Synthetic peptide
  Seed: KQPITKAEM (MAGC1_HUMAN)
KAPITKAEI

SEQ ID NO: 74723 - protein, 9 aa, Artificial Sequence
  Description of Artificial Sequence: Synthetic peptide
  Seed: GFPQSVLQI (MAGC1_HUMAN)
GYPQSVLQI

SEQ ID NO: 74724 - protein, 9 aa, Artificial Sequence
  Description of Artificial Sequence: Synthetic peptide
  Seed: TTDDSTATE (MAGC1_HUMAN)
TLDDSTATV

SEQ ID NO: 74725 - protein, 10 aa, Artificial Sequence
  Description of Artificial Sequence: Synthetic peptide
  Seed: YTLDEKVDEL (MAGC1_HUMAN)
YDLDEKVDEL

SEQ ID NO: 74726 - protein, 9 aa, Artificial Sequence
  Description of Artificial Sequence: Synthetic peptide
  Seed: SICSSSTSL (MAGC1_HUMAN)
SACSSSTSF

SEQ ID NO: 74727 - protein, 10 aa, Artificial Sequence
  Description of Artificial Sequence: Synthetic peptide
  Seed: ATESASSSVM (MAGC1_HUMAN)
AAESASSSVW

SEQ ID NO: 74728 - protein, 9 aa, Artificial Sequence
  Description of Artificial Sequence: Synthetic peptide
  Seed: RTHSTFEGF (MAGC1_HUMAN)
RRHSTFEGM

SEQ ID NO: 74729 - protein, 9 aa, Artificial Sequence
  Description of Artificial Sequence: Synthetic peptide
  Seed: ASSFFSSAL (MAGC1_HUMAN)
ALSFFSSAL

SEQ ID NO: 74730 - protein, 9 aa, Artificial Sequence
  Description of Artificial Sequence: Synthetic peptide
  Seed: NVISRYTGY (MAGC1_HUMAN)
NAISRYTGR

SEQ ID NO: 74731 - protein, 9 aa, Artificial Sequence
  Description of Artificial Sequence: Synthetic peptide
  Seed: FSSALLSIF (MAGC1_HUMAN)
FCSALLSIW

SEQ ID NO: 74732 - protein, 10 aa, Artificial Sequence
  Description of Artificial Sequence: Synthetic peptide
  Seed: SSFSSTLLSI (MAGC1_HUMAN)
SSFSSTLLSL

SEQ ID NO: 74733 - protein, 8 aa, Artificial Sequence
  Description of Artificial Sequence: Synthetic peptide
  Seed: SFSSSTSL (MAGC1_HUMAN)
SYSSSTSM

SEQ ID NO: 74734 - protein, 9 aa, Artificial Sequence
  Description of Artificial Sequence: Synthetic peptide
  Seed: KVWVQEHYL (MAGC1_HUMAN)
KTWVQEHYV

SEQ ID NO: 74735 - protein, 11 aa, Artificial Sequence
  Description of Artificial Sequence: Synthetic peptide
  Seed: RYTGYFPVIFR (MAGC1_HUMAN)
RATGYFPVIFR

SEQ ID NO: 74736 - protein, 11 aa, Artificial Sequence
  Description of Artificial Sequence: Synthetic peptide
  Seed: SFFSYTLASLL (MAGC1_HUMAN)
SDFSYTLASLY

SEQ ID NO: 74737 - protein, 9 aa, Artificial Sequence
  Description of Artificial Sequence: Synthetic peptide
  Seed: YVFVNTLDL (MAGC1_HUMAN)
YWFVNTLDF

SEQ ID NO: 74738 - protein, 10 aa, Artificial Sequence
  Description of Artificial Sequence: Synthetic peptide
  Seed: MTSSFSSTLL (MAGC1_HUMAN)
MSSSFSSTLL

SEQ ID NO: 74739 - protein, 9 aa, Artificial Sequence
  Description of Artificial Sequence: Synthetic peptide
  Seed: SAQSAFEGF (MAGC1_HUMAN)
SLQSAFEGF

SEQ ID NO: 74740 - protein, 9 aa, Artificial Sequence
  Description of Artificial Sequence: Synthetic peptide
  Seed: YTSSSDTLL (MAGC1_HUMAN)
YVSSSDTLM

SEQ ID NO: 74741 - protein, 9 aa, Artificial Sequence
  Description of Artificial Sequence: Synthetic peptide
  Seed: VVEFLAMLK (MAGC1_HUMAN)
VMEFLAMLK

SEQ ID NO: 74742 - protein, 11 aa, Artificial Sequence
  Description of Artificial Sequence: Synthetic peptide
  Seed: SSFPSSTSSSL (MAGC1_HUMAN)
SYFPSSTSSSF

SEQ ID NO: 74743 - protein, 11 aa, Artificial Sequence
  Description of Artificial Sequence: Synthetic peptide
  Seed: IPVSRSFSSTL (MAGC1_HUMAN)
IEVSRSFSSTW

SEQ ID NO: 74744 - protein, 9 aa, Artificial Sequence
  Description of Artificial Sequence: Synthetic peptide
  Seed: TSLSLPQSF (MAGC1_HUMAN)
TFLSLPQSM

SEQ ID NO: 74745 - protein, 9 aa, Artificial Sequence
  Description of Artificial Sequence: Synthetic peptide
  Seed: FPSSTSSSL (MAGC1_HUMAN)
FASSTSSSL

SEQ ID NO: 74746 - protein, 9 aa, Artificial Sequence
  Description of Artificial Sequence: Synthetic peptide
  Seed: IESEPLFTY (MAGC1_HUMAN)
ILSEPLFTI

SEQ ID NO: 74747 - protein, 9 aa, Artificial Sequence
  Description of Artificial Sequence: Synthetic peptide
  Seed: SEVIKRKVV (MAGC1_HUMAN)
SHVIKRKVA

SEQ ID NO: 74748 - protein, 10 aa, Artificial Sequence
  Description of Artificial Sequence: Synthetic peptide
  Seed: LQIPVSSSFS (MAGC1_HUMAN)
LQIPVSSSFG

SEQ ID NO: 74749 - protein, 8 aa, Artificial Sequence
  Description of Artificial Sequence: Synthetic peptide
  Seed: SLSLPQSF (MAGC1_HUMAN)
SQSLPQSY

SEQ ID NO: 74750 - protein, 9 aa, Artificial Sequence
  Description of Artificial Sequence: Synthetic peptide
  Seed: EDFQSSLQS (MAGC1_HUMAN)
EEFQSSLQM

SEQ ID NO: 74751 - protein, 9 aa, Artificial Sequence
  Description of Artificial Sequence: Synthetic peptide
  Seed: LQSPVISFS (MAGC1_HUMAN)
LTSPVISFM

SEQ ID NO: 74752 - protein, 10 aa, Artificial Sequence
  Description of Artificial Sequence: Synthetic peptide
  Seed: SSFSYTLLSL (MAGC1_HUMAN)
SIFSYTLLSI

SEQ ID NO: 74753 - protein, 10 aa, Artificial Sequence
  Description of Artificial Sequence: Synthetic peptide
  Seed: SLQIPVSPSF (MAGC1_HUMAN)
SRQIPVSPSY

SEQ ID NO: 74754 - protein, 9 aa, Artificial Sequence
  Description of Artificial Sequence: Synthetic peptide
  Seed: VSSSFSYTL (MAGC1_HUMAN)
VSSSFSYTV

SEQ ID NO: 74755 - protein, 10 aa, Artificial Sequence
  Description of Artificial Sequence: Synthetic peptide
  Seed: RSFSSTLLSI (MAGC1_HUMAN)
REFSSTLLSV

SEQ ID NO: 74756 - protein, 9 aa, Artificial Sequence
  Description of Artificial Sequence: Synthetic peptide
  Seed: AQSPLQIPV (MAGC1_HUMAN)
ALSPLQIPI

SEQ ID NO: 74757 - protein, 10 aa, Artificial Sequence
  Description of Artificial Sequence: Synthetic peptide
  Seed: VSRSFSSTLL (MAGC1_HUMAN)
VSRSFSSTLF

SEQ ID NO: 74758 - protein, 9 aa, Artificial Sequence
  Description of Artificial Sequence: Synthetic peptide
  Seed: VSPSSSSTL (MAGC1_HUMAN)
VIPSSSSTY

SEQ ID NO: 74759 - protein, 9 aa, Artificial Sequence
  Description of Artificial Sequence: Synthetic peptide
  Seed: LQRPVSSFF (MAGC1_HUMAN)
LNRPVSSFK

SEQ ID NO: 74760 - protein, 11 aa, Artificial Sequence
  Description of Artificial Sequence: Synthetic peptide
  Seed: QSSPESTQSPF (MAGC1_HUMAN)
QQSPESTQSPY

SEQ ID NO: 74761 - protein, 11 aa, Artificial Sequence
  Description of Artificial Sequence: Synthetic peptide
  Seed: IPVSSSSSSTL (MAGC1_HUMAN)
IEVSSSSSSTW

SEQ ID NO: 74762 - protein, 9 aa, Artificial Sequence
  Description of Artificial Sequence: Synthetic peptide
  Seed: AQSPLQIPV (MAGC1_HUMAN)
AISPLQIPA

SEQ ID NO: 74763 - protein, 11 aa, Artificial Sequence
  Description of Artificial Sequence: Synthetic peptide
  Seed: SFFSYTLASLL (MAGC1_HUMAN)
SLFSYTLASLY

SEQ ID NO: 74764 - protein, 10 aa, Artificial Sequence
  Description of Artificial Sequence: Synthetic peptide
  Seed: PLQIPGSPSF (MAGC1_HUMAN)
PKQIPGSPSM

SEQ ID NO: 74765 - protein, 11 aa, Artificial Sequence
  Description of Artificial Sequence: Synthetic peptide
  Seed: SPLQIPVSSSS (MAGC1_HUMAN)
SNLQIPVSSSM

SEQ ID NO: 74766 - protein, 11 aa, Artificial Sequence
  Description of Artificial Sequence: Synthetic peptide
  Seed: TVPITFPSSYK (MAGC1_HUMAN)
TCPITFPSSYR

SEQ ID NO: 74767 - protein, 10 aa, Artificial Sequence
  Description of Artificial Sequence: Synthetic peptide
  Seed: SVLQIPVSAA (MAGC1_HUMAN)
SPLQIPVSAM

SEQ ID NO: 74768 - protein, 9 aa, Artificial Sequence
  Description of Artificial Sequence: Synthetic peptide
  Seed: GDKDMPTAG (MAGC1_HUMAN)
GEKDMPTAA

SEQ ID NO: 74769 - protein, 10 aa, Artificial Sequence
  Description of Artificial Sequence: Synthetic peptide
  Seed: ASSFFSSALL (MAGC1_HUMAN)
ANSFFSSALY

SEQ ID NO: 74770 - protein, 9 aa, Artificial Sequence
  Description of Artificial Sequence: Synthetic peptide
  Seed: FSSTLLSIL (MAGC1_HUMAN)
FTSTLLSIW

SEQ ID NO: 74771 - protein, 10 aa, Artificial Sequence
  Description of Artificial Sequence: Synthetic peptide
  Seed: FPQSLLQIPM (MAGC1_HUMAN)
FWQSLLQIPY

SEQ ID NO: 74772 - protein, 11 aa, Artificial Sequence
  Description of Artificial Sequence: Synthetic peptide
  Seed: SSSSSTLLSLF (MAGC1_HUMAN)
SASSSTLLSLF

SEQ ID NO: 74773 - protein, 10 aa, Artificial Sequence
  Description of Artificial Sequence: Synthetic peptide
  Seed: RAGREHFAFG (MAGC1_HUMAN)
RPGREHFAFA

SEQ ID NO: 74774 - protein, 11 aa, Artificial Sequence
  Description of Artificial Sequence: Synthetic peptide
  Seed: SQSSPEGKDSL (MAGC1_HUMAN)
SMSSPEGKDSL

SEQ ID NO: 74775 - protein, 8 aa, Artificial Sequence
  Description of Artificial Sequence: Synthetic peptide
  Seed: FSYTLASL (MAGC1_HUMAN)
FAYTLASL

SEQ ID NO: 74776 - protein, 10 aa, Artificial Sequence
  Description of Artificial Sequence: Synthetic peptide
  Seed: SSSSSTLLSL (MAGC1_HUMAN)
SHSSSTLLSY

SEQ ID NO: 74777 - protein, 9 aa, Artificial Sequence
  Description of Artificial Sequence: Synthetic peptide
  Seed: TLASLLQSS (MAGC1_HUMAN)
TLASLLQSA

SEQ ID NO: 74778 - protein, 10 aa, Artificial Sequence
  Description of Artificial Sequence: Synthetic peptide
  Seed: LSKSSPESPL (MAGC1_HUMAN)
LTKSSPESPW

SEQ ID NO: 74779 - protein, 9 aa, Artificial Sequence
  Description of Artificial Sequence: Synthetic peptide
  Seed: NPASSFFSS (MAGC1_HUMAN)
NPASSFFSV

SEQ ID NO: 74780 - protein, 10 aa, Artificial Sequence
  Description of Artificial Sequence: Synthetic peptide
  Seed: ASSSTLVSIF (MAGC1_HUMAN)
ALSSTLVSIW

SEQ ID NO: 74781 - protein, 9 aa, Artificial Sequence
  Description of Artificial Sequence: Synthetic peptide
  Seed: RTQSTFEGF (MAGC1_HUMAN)
RKQSTFEGM

SEQ ID NO: 74782 - protein, 10 aa, Artificial Sequence
  Description of Artificial Sequence: Synthetic peptide
  Seed: KAREFIEILF (MAGC1_HUMAN)
KSREFIEILW

SEQ ID NO: 74783 - protein, 11 aa, Artificial Sequence
  Description of Artificial Sequence: Synthetic peptide
  Seed: SFSSSTSLSPF (MAGC1_HUMAN)
STSSSTSLSPF

SEQ ID NO: 74784 - protein, 9 aa, Artificial Sequence
  Description of Artificial Sequence: Synthetic peptide
  Seed: AGREHFAFG (MAGC1_HUMAN)
AWREHFAFK

SEQ ID NO: 74785 - protein, 9 aa, Artificial Sequence
  Description of Artificial Sequence: Synthetic peptide
  Seed: YTLLSLFQS (MAGC1_HUMAN)
YQLLSLFQL

SEQ ID NO: 74786 - protein, 9 aa, Artificial Sequence
  Description of Artificial Sequence: Synthetic peptide
  Seed: FPSSYKDAL (MAGC1_HUMAN)
FISSYKDAF

SEQ ID NO: 74787 - protein, 11 aa, Artificial Sequence
  Description of Artificial Sequence: Synthetic peptide
  Seed: IPVSSSSSSTL (MAGC1_HUMAN)
INVSSSSSSTF

SEQ ID NO: 74788 - protein, 10 aa, Artificial Sequence
  Description of Artificial Sequence: Synthetic peptide
  Seed: ESAQSAFEGF (MAGC1_HUMAN)
EVAQSAFEGF

SEQ ID NO: 74789 - protein, 9 aa, Artificial Sequence
  Description of Artificial Sequence: Synthetic peptide
  Seed: SSPERTHST (MAGC1_HUMAN)
SEPERTHSM

SEQ ID NO: 74790 - protein, 9 aa, Artificial Sequence
  Description of Artificial Sequence: Synthetic peptide
  Seed: EHYLEYREV (MAGC1_HUMAN)
EQYLEYREL

SEQ ID NO: 74791 - protein, 9 aa, Artificial Sequence
  Description of Artificial Sequence: Synthetic peptide
  Seed: SLPEWEDSL (MAGC1_HUMAN)
SYPEWEDSL

SEQ ID NO: 74792 - protein, 11 aa, Artificial Sequence
  Description of Artificial Sequence: Synthetic peptide
  Seed: STFEGFAQSPL (MAGC1_HUMAN)
SMFEGFAQSPL

SEQ ID NO: 74793 - protein, 11 aa, Artificial Sequence
  Description of Artificial Sequence: Synthetic peptide
  Seed: SSSSSSTLLSL (MAGC1_HUMAN)
SWSSSSTLLSF

SEQ ID NO: 74794 - protein, 10 aa, Artificial Sequence
  Description of Artificial Sequence: Synthetic peptide
  Seed: SPLQNPASSF (MAGC1_HUMAN)
SMLQNPASSF

SEQ ID NO: 74795 - protein, 9 aa, Artificial Sequence
  Description of Artificial Sequence: Synthetic peptide
  Seed: RAGREHFAF (MAGC1_HUMAN)
RYGREHFAM

SEQ ID NO: 74796 - protein, 9 aa, Artificial Sequence
  Description of Artificial Sequence: Synthetic peptide
  Seed: SSSSSSSTL (MAGC1_HUMAN)
SLSSSSSTI

SEQ ID NO: 74797 - protein, 10 aa, Artificial Sequence
  Description of Artificial Sequence: Synthetic peptide
  Seed: SSPERTQSTF (MAGC1_HUMAN)
SFPERTQSTL

SEQ ID NO: 74798 - protein, 9 aa, Artificial Sequence
  Description of Artificial Sequence: Synthetic peptide
  Seed: ISRYTGYFP (MAGC1_HUMAN)
IWRYTGYFK

SEQ ID NO: 74799 - protein, 10 aa, Artificial Sequence
  Description of Artificial Sequence: Synthetic peptide
  Seed: LSQSSPVSSF (MAGC1_HUMAN)
LGQSSPVSSF

SEQ ID NO: 74800 - protein, 10 aa, Artificial Sequence
  Description of Artificial Sequence: Synthetic peptide
  Seed: TGYFPVIFRK (MAGC1_HUMAN)
TTYFPVIFRQ

SEQ ID NO: 74801 - protein, 9 aa, Artificial Sequence
  Description of Artificial Sequence: Synthetic peptide
  Seed: LQNPASSFF (MAGC1_HUMAN)
LSNPASSFF

SEQ ID NO: 74802 - protein, 9 aa, Artificial Sequence
  Description of Artificial Sequence: Synthetic peptide
  Seed: VSSSFSYTL (MAGC1_HUMAN)
VRSSFSYTF

SEQ ID NO: 74803 - protein, 10 aa, Artificial Sequence
  Description of Artificial Sequence: Synthetic peptide
  Seed: MPTAGMPSLL (MAGC1_HUMAN)
MLTAGMPSLA

SEQ ID NO: 74804 - protein, 9 aa, Artificial Sequence
  Description of Artificial Sequence: Synthetic peptide
  Seed: NTVPITFPS (MAGC1_HUMAN)
NLVPITFPI

SEQ ID NO: 74805 - protein, 11 aa, Artificial Sequence
  Description of Artificial Sequence: Synthetic peptide
  Seed: FLAMLKNTVPI (MAGC1_HUMAN)
FKAMLKNTVPI

SEQ ID NO: 74806 - protein, 9 aa, Artificial Sequence
  Description of Artificial Sequence: Synthetic peptide
  Seed: KDSLSPLEI (MAGC1_HUMAN)
KDSLSPLEF

SEQ ID NO: 74807 - protein, 11 aa, Artificial Sequence
  Description of Artificial Sequence: Synthetic peptide
  Seed: ISRYTGYFPVI (MAGC1_HUMAN)
IDRYTGYFPVF

SEQ ID NO: 74808 - protein, 10 aa, Artificial Sequence
  Description of Artificial Sequence: Synthetic peptide
  Seed: MSQNRLLILI (MAGC1_HUMAN)
MYQNRLLILV

SEQ ID NO: 74809 - protein, 9 aa, Artificial Sequence
  Description of Artificial Sequence: Synthetic peptide
  Seed: FPSSYKDAL (MAGC1_HUMAN)
FHSSYKDAI

SEQ ID NO: 74810 - protein, 9 aa, Artificial Sequence
  Description of Artificial Sequence: Synthetic peptide
  Seed: RLLILILSI (MAGC1_HUMAN)
RTLILILSK

SEQ ID NO: 74811 - protein, 10 aa, Artificial Sequence
  Description of Artificial Sequence: Synthetic peptide
  Seed: LQNPASSFFS (MAGC1_HUMAN)
LKNPASSFFY

SEQ ID NO: 74812 - protein, 9 aa, Artificial Sequence
  Description of Artificial Sequence: Synthetic peptide
  Seed: VSSFFSYTL (MAGC1_HUMAN)
VLSFFSYTW

SEQ ID NO: 74813 - protein, 9 aa, Artificial Sequence
  Description of Artificial Sequence: Synthetic peptide
  Seed: SQNRLLILI (MAGC1_HUMAN)
SHNRLLILV

SEQ ID NO: 74814 - protein, 11 aa, Artificial Sequence
  Description of Artificial Sequence: Synthetic peptide
  Seed: ISRYTGYFPVI (MAGC1_HUMAN)
IKRYTGYFPVF

SEQ ID NO: 74815 - protein, 9 aa, Artificial Sequence
  Description of Artificial Sequence: Synthetic peptide
  Seed: LQIPVSAAS (MAGC1_HUMAN)
LHIPVSAAF

SEQ ID NO: 74816 - protein, 9 aa, Artificial Sequence
  Description of Artificial Sequence: Synthetic peptide
  Seed: SLIESEPLF (MAGC1_HUMAN)
SAIESEPLI

SEQ ID NO: 74817 - protein, 9 aa, Artificial Sequence
  Description of Artificial Sequence: Synthetic peptide
  Seed: VSAASSSTL (MAGC1_HUMAN)
VMAASSSTI

SEQ ID NO: 74818 - protein, 10 aa, Artificial Sequence
  Description of Artificial Sequence: Synthetic peptide
  Seed: STLLSLFQSF (MAGC1_HUMAN)
SQLLSLFQSM

SEQ ID NO: 74819 - protein, 9 aa, Artificial Sequence
  Description of Artificial Sequence: Synthetic peptide
  Seed: SASSSVMSP (MAGC1_HUMAN)
SISSSVMSY

SEQ ID NO: 74820 - protein, 9 aa, Artificial Sequence
  Description of Artificial Sequence: Synthetic peptide
  Seed: SSSTSLSPF (MAGC1_HUMAN)
SESTSLSPM

SEQ ID NO: 74821 - protein, 9 aa, Artificial Sequence
  Description of Artificial Sequence: Synthetic peptide
  Seed: KDSLSPLEI (MAGC1_HUMAN)
KESLSPLEL

SEQ ID NO: 74822 - protein, 11 aa, Artificial Sequence
  Description of Artificial Sequence: Synthetic peptide
  Seed: IPMTSSFSSTL (MAGC1_HUMAN)
IQMTSSFSSTF

SEQ ID NO: 74823 - protein, 11 aa, Artificial Sequence
  Description of Artificial Sequence: Synthetic peptide
  Seed: MSPLYFPQSPL (MAGC1_HUMAN)
MFPLYFPQSPV

SEQ ID NO: 74824 - protein, 11 aa, Artificial Sequence
  Description of Artificial Sequence: Synthetic peptide
  Seed: VSSSSSSSTLL (MAGC1_HUMAN)
VNSSSSSSTLF

SEQ ID NO: 74825 - protein, 9 aa, Artificial Sequence
  Description of Artificial Sequence: Synthetic peptide
  Seed: SSPESPLQS (MAGC1_HUMAN)
SIPESPLQM

SEQ ID NO: 74826 - protein, 10 aa, Artificial Sequence
  Description of Artificial Sequence: Synthetic peptide
  Seed: EMLTNVISRY (MAGC1_HUMAN)
EILTNVISRF

SEQ ID NO: 74827 - protein, 9 aa, Artificial Sequence
  Description of Artificial Sequence: Synthetic peptide
  Seed: LQIPGSPSF (MAGC1_HUMAN)
LIIPGSPSM

SEQ ID NO: 74828 - protein, 9 aa, Artificial Sequence
  Description of Artificial Sequence: Synthetic peptide
  Seed: SPLEGEDSL (MAGC1_HUMAN)
SQLEGEDSF

SEQ ID NO: 74829 - protein, 9 aa, Artificial Sequence
  Description of Artificial Sequence: Synthetic peptide
  Seed: SLIESEPLF (MAGC1_HUMAN)
SFIESEPLW

SEQ ID NO: 74830 - protein, 9 aa, Artificial Sequence
  Description of Artificial Sequence: Synthetic peptide
  Seed: FPQFPPQGE (MAGC1_HUMAN)
FPQFPPQGV

SEQ ID NO: 74831 - protein, 10 aa, Artificial Sequence
  Description of Artificial Sequence: Synthetic peptide
  Seed: SSSSSSSTLL (MAGC1_HUMAN)
SPSSSSSTLW

SEQ ID NO: 74832 - protein, 11 aa, Artificial Sequence
  Description of Artificial Sequence: Synthetic peptide
  Seed: IPVSSSFSYTL (MAGC1_HUMAN)
ITVSSSFSYTM

SEQ ID NO: 74833 - protein, 10 aa, Artificial Sequence
  Description of Artificial Sequence: Synthetic peptide
  Seed: SPLQIPVSSS (MAGC1_HUMAN)
SPLQIPVSST

SEQ ID NO: 74834 - protein, 9 aa, Artificial Sequence
  Description of Artificial Sequence: Synthetic peptide
  Seed: SQSSPVSSF (MAGC1_HUMAN)
SHSSPVSSL

SEQ ID NO: 74835 - protein, 9 aa, Artificial Sequence
  Description of Artificial Sequence: Synthetic peptide
  Seed: FTYTLDEKV (MAGC1_HUMAN)
FMYTLDEKI

SEQ ID NO: 74836 - protein, 9 aa, Artificial Sequence
  Description of Artificial Sequence: Synthetic peptide
  Seed: ASSFFSSAL (MAGC1_HUMAN)
AVSFFSSAI

SEQ ID NO: 74837 - protein, 10 aa, Artificial Sequence
  Description of Artificial Sequence: Synthetic peptide
  Seed: YTLDEKVDEL (MAGC1_HUMAN)
YQLDEKVDEW

SEQ ID NO: 74838 - protein, 9 aa, Artificial Sequence
  Description of Artificial Sequence: Synthetic peptide
  Seed: NPASSFFSS (MAGC1_HUMAN)
NPASSFFSY

SEQ ID NO: 74839 - protein, 9 aa, Artificial Sequence
  Description of Artificial Sequence: Synthetic peptide
  Seed: YTGYFPVIF (MAGC1_HUMAN)
YRGYFPVIM

SEQ ID NO: 74840 - protein, 10 aa, Artificial Sequence
  Description of Artificial Sequence: Synthetic peptide
  Seed: SSFSYTLLSL (MAGC1_HUMAN)
SCFSYTLLSW

SEQ ID NO: 74841 - protein, 9 aa, Artificial Sequence
  Description of Artificial Sequence: Synthetic peptide
  Seed: SLFQSFSER (MAGC1_HUMAN)
SMFQSFSEF

SEQ ID NO: 74842 - protein, 10 aa, Artificial Sequence
  Description of Artificial Sequence: Synthetic peptide
  Seed: AASSSTLVSI (MAGC1_HUMAN)
AVSSSTLVSY

SEQ ID NO: 74843 - protein, 10 aa, Artificial Sequence
  Description of Artificial Sequence: Synthetic peptide
  Seed: RTHSTFEGFP (MAGC1_HUMAN)
RYHSTFEGFK

SEQ ID NO: 74844 - protein, 10 aa, Artificial Sequence
  Description of Artificial Sequence: Synthetic peptide
  Seed: LQIPVSSSFS (MAGC1_HUMAN)
LIIPVSSSFF

SEQ ID NO: 74845 - protein, 10 aa, Artificial Sequence
  Description of Artificial Sequence: Synthetic peptide
  Seed: SIIFIKGTYA (MAGC1_HUMAN)
SLIFIKGTYI

SEQ ID NO: 74846 - protein, 10 aa, Artificial Sequence
  Description of Artificial Sequence: Synthetic peptide
  Seed: LAMLKNTVPI (MAGC1_HUMAN)
LWMLKNTVPL

SEQ ID NO: 74847 - protein, 9 aa, Artificial Sequence
  Description of Artificial Sequence: Synthetic peptide
  Seed: EVDPDDSYV (MAGC1_HUMAN)
EVDPDDSYL

SEQ ID NO: 74848 - protein, 10 aa, Artificial Sequence
  Description of Artificial Sequence: Synthetic peptide
  Seed: SSSSSTLLSL (MAGC1_HUMAN)
SDSSSTLLSW

SEQ ID NO: 74849 - protein, 9 aa, Artificial Sequence
  Description of Artificial Sequence: Synthetic peptide
  Seed: TSLSLPQSF (MAGC1_HUMAN)
TFLSLPQSI

SEQ ID NO: 74850 - protein, 9 aa, Artificial Sequence
  Description of Artificial Sequence: Synthetic peptide
  Seed: KVVEFLAML (MAGC1_HUMAN)
KQVEFLAMT

SEQ ID NO: 74851 - protein, 9 aa, Artificial Sequence
  Description of Artificial Sequence: Synthetic peptide
  Seed: STFEGFAQS (MAGC1_HUMAN)
SIFEGFAQT

SEQ ID NO: 74852 - protein, 9 aa, Artificial Sequence
  Description of Artificial Sequence: Synthetic peptide
  Seed: VSPSFSSTL (MAGC1_HUMAN)
VWPSFSSTM

SEQ ID NO: 74853 - protein, 9 aa, Artificial Sequence
  Description of Artificial Sequence: Synthetic peptide
  Seed: LQIPVSSSS (MAGC1_HUMAN)
LHIPVSSSF

SEQ ID NO: 74854 - protein, 9 aa, Artificial Sequence
  Description of Artificial Sequence: Synthetic peptide
  Seed: YTSSSDTLL (MAGC1_HUMAN)
YTSSSDTLY

SEQ ID NO: 74855 - protein, 9 aa, Artificial Sequence
  Description of Artificial Sequence: Synthetic peptide
  Seed: VIKRKVVEF (MAGC1_HUMAN)
VLKRKVVEL

SEQ ID NO: 74856 - protein, 9 aa, Artificial Sequence
  Description of Artificial Sequence: Synthetic peptide
  Seed: SSPERTQST (MAGC1_HUMAN)
SCPERTQSI

SEQ ID NO: 74857 - protein, 9 aa, Artificial Sequence
  Description of Artificial Sequence: Synthetic peptide
  Seed: CSSSTPSSL (MAGC1_HUMAN)
CTSSTPSSM

SEQ ID NO: 74858 - protein, 9 aa, Artificial Sequence
  Description of Artificial Sequence: Synthetic peptide
  Seed: LQIPMTSSF (MAGC1_HUMAN)
LPIPMTSSH

SEQ ID NO: 74859 - protein, 9 aa, Artificial Sequence
  Description of Artificial Sequence: Synthetic peptide
  Seed: TGYFPVIFR (MAGC1_HUMAN)
TSYFPVIFR

SEQ ID NO: 74860 - protein, 9 aa, Artificial Sequence
  Description of Artificial Sequence: Synthetic peptide
  Seed: STQSPFEGF (MAGC1_HUMAN)
STQSPFEGL

SEQ ID NO: 74861 - protein, 10 aa, Artificial Sequence
  Description of Artificial Sequence: Synthetic peptide
  Seed: SSPESAQSAF (MAGC1_HUMAN)
SYPESAQSAL

SEQ ID NO: 74862 - protein, 11 aa, Artificial Sequence
  Description of Artificial Sequence: Synthetic peptide
  Seed: FPSSTSSSLSK (MAGC1_HUMAN)
FPSSTSSSLSM

SEQ ID NO: 74863 - protein, 9 aa, Artificial Sequence
  Description of Artificial Sequence: Synthetic peptide
  Seed: SIFQSSPER (MAGC1_HUMAN)
SMFQSSPER

SEQ ID NO: 74864 - protein, 9 aa, Artificial Sequence
  Description of Artificial Sequence: Synthetic peptide
  Seed: TESASSSVM (MAGC1_HUMAN)
TVSASSSVF

SEQ ID NO: 74865 - protein, 11 aa, Artificial Sequence
  Description of Artificial Sequence: Synthetic peptide
  Seed: IPVSSSFSYTL (MAGC1_HUMAN)
IGVSSSFSYTY

SEQ ID NO: 74866 - protein, 10 aa, Artificial Sequence
  Description of Artificial Sequence: Synthetic peptide
  Seed: SSPERTQSTF (MAGC1_HUMAN)
SRPERTQSTF

SEQ ID NO: 74867 - protein, 9 aa, Artificial Sequence
  Description of Artificial Sequence: Synthetic peptide
  Seed: TFEGFPQSL (MAGC1_HUMAN)
TYEGFPQSL

SEQ ID NO: 74868 - protein, 10 aa, Artificial Sequence
  Description of Artificial Sequence: Synthetic peptide
  Seed: LQIPVSRSFS (MAGC1_HUMAN)
LMIPVSRSFY

SEQ ID NO: 74869 - protein, 10 aa, Artificial Sequence
  Description of Artificial Sequence: Synthetic peptide
  Seed: EFLAMLKNTV (MAGC1_HUMAN)
EFLAMLKNTL

SEQ ID NO: 74870 - protein, 10 aa, Artificial Sequence
  Description of Artificial Sequence: Synthetic peptide
  Seed: FFSYTLASLL (MAGC1_HUMAN)
FISYTLASLW

SEQ ID NO: 74871 - protein, 9 aa, Artificial Sequence
  Description of Artificial Sequence: Synthetic peptide
  Seed: FPSSTSSSL (MAGC1_HUMAN)
FLSSTSSSF

SEQ ID NO: 74872 - protein, 10 aa, Artificial Sequence
  Description of Artificial Sequence: Synthetic peptide
  Seed: SFSYTLLSLF (MAGC1_HUMAN)
SMSYTLLSLW

SEQ ID NO: 74873 - protein, 9 aa, Artificial Sequence
  Description of Artificial Sequence: Synthetic peptide
  Seed: FPSSTSSSL (MAGC1_HUMAN)
FYSSTSSSY

SEQ ID NO: 74874 - protein, 9 aa, Artificial Sequence
  Description of Artificial Sequence: Synthetic peptide
  Seed: GPRAHSEVI (MAGC1_HUMAN)
GPRAHSEVM

SEQ ID NO: 74875 - protein, 9 aa, Artificial Sequence
  Description of Artificial Sequence: Synthetic peptide
  Seed: EDSLSPLQI (MAGC1_HUMAN)
EESLSPLQV

SEQ ID NO: 74876 - protein, 10 aa, Artificial Sequence
  Description of Artificial Sequence: Synthetic peptide
  Seed: MTSSFSSTLL (MAGC1_HUMAN)
MLSSFSSTLP

SEQ ID NO: 74877 - protein, 9 aa, Artificial Sequence
  Description of Artificial Sequence: Synthetic peptide
  Seed: SLSPHYFPQ (MAGC1_HUMAN)
SSSPHYFPK

SEQ ID NO: 74878 - protein, 10 aa, Artificial Sequence
  Description of Artificial Sequence: Synthetic peptide
  Seed: SILQSSPESA (MAGC1_HUMAN)
SLLQSSPESI

SEQ ID NO: 74879 - protein, 10 aa, Artificial Sequence
  Description of Artificial Sequence: Synthetic peptide
  Seed: REHFAFGEPR (MAGC1_HUMAN)
RFHFAFGEPR

SEQ ID NO: 74880 - protein, 10 aa, Artificial Sequence
  Description of Artificial Sequence: Synthetic peptide
  Seed: WVQEHYLEYR (MAGC1_HUMAN)
WMQEHYLEYR

SEQ ID NO: 74881 - protein, 9 aa, Artificial Sequence
  Description of Artificial Sequence: Synthetic peptide
  Seed: SSSVMSPSF (MAGC1_HUMAN)
SGSVMSPSW

SEQ ID NO: 74882 - protein, 9 aa, Artificial Sequence
  Description of Artificial Sequence: Synthetic peptide
  Seed: MTSSFSSTL (MAGC1_HUMAN)
MSSSFSSTM

SEQ ID NO: 74883 - protein, 11 aa, Artificial Sequence
  Description of Artificial Sequence: Synthetic peptide
  Seed: SSFSYTLLSLF (MAGC1_HUMAN)
SRFSYTLLSLY

SEQ ID NO: 74884 - protein, 9 aa, Artificial Sequence
  Description of Artificial Sequence: Synthetic peptide
  Seed: ISFSSSTSL (MAGC1_HUMAN)
IKFSSSTSM

SEQ ID NO: 74885 - protein, 9 aa, Artificial Sequence
  Description of Artificial Sequence: Synthetic peptide
  Seed: SPERTQSTF (MAGC1_HUMAN)
SPERTQSTY

SEQ ID NO: 74886 - protein, 9 aa, Artificial Sequence
  Description of Artificial Sequence: Synthetic peptide
  Seed: RLLILILSI (MAGC1_HUMAN)
RALILILSF

SEQ ID NO: 74887 - protein, 9 aa, Artificial Sequence
  Description of Artificial Sequence: Synthetic peptide
  Seed: TLVSIFQSS (MAGC1_HUMAN)
TMVSIFQSV

SEQ ID NO: 74888 - protein, 9 aa, Artificial Sequence
  Description of Artificial Sequence: Synthetic peptide
  Seed: TESASSSVM (MAGC1_HUMAN)
TKSASSSVL

SEQ ID NO: 74889 - protein, 9 aa, Artificial Sequence
  Description of Artificial Sequence: Synthetic peptide
  Seed: IESEPLFTY (MAGC1_HUMAN)
IRSEPLFTI

SEQ ID NO: 74890 - protein, 10 aa, Artificial Sequence
  Description of Artificial Sequence: Synthetic peptide
  Seed: YASEEVIWDV (MAGC1_HUMAN)
YLSEEVIWDS

SEQ ID NO: 74891 - protein, 10 aa, Artificial Sequence
  Description of Artificial Sequence: Synthetic peptide
  Seed: MPTAGMPSLL (MAGC1_HUMAN)
MMTAGMPSLF

SEQ ID NO: 74892 - protein, 10 aa, Artificial Sequence
  Description of Artificial Sequence: Synthetic peptide
  Seed: VSSSSSSTLL (MAGC1_HUMAN)
VISSSSSTLW

SEQ ID NO: 74893 - protein, 10 aa, Artificial Sequence
  Description of Artificial Sequence: Synthetic peptide
  Seed: WEDSLSPLHF (MAGC1_HUMAN)
WMDSLSPLHF

SEQ ID NO: 74894 - protein, 9 aa, Artificial Sequence
  Description of Artificial Sequence: Synthetic peptide
  Seed: RSFSSTLLS (MAGC1_HUMAN)
RTFSSTLLL

SEQ ID NO: 74895 - protein, 9 aa, Artificial Sequence
  Description of Artificial Sequence: Synthetic peptide
  Seed: SPLQSPVSS (MAGC1_HUMAN)
SALQSPVSW

SEQ ID NO: 74896 - protein, 10 aa, Artificial Sequence
  Description of Artificial Sequence: Synthetic peptide
  Seed: SSPERTQSTF (MAGC1_HUMAN)
SAPERTQSTF

SEQ ID NO: 74897 - protein, 11 aa, Artificial Sequence
  Description of Artificial Sequence: Synthetic peptide
  Seed: SAASSSTLVSI (MAGC1_HUMAN)
SAASSSTLVSY

SEQ ID NO: 74898 - protein, 10 aa, Artificial Sequence
  Description of Artificial Sequence: Synthetic peptide
  Seed: MLTNVISRYT (MAGC1_HUMAN)
MLTNVISRYM

SEQ ID NO: 74899 - protein, 9 aa, Artificial Sequence
  Description of Artificial Sequence: Synthetic peptide
  Seed: AFGEPRELL (MAGC1_HUMAN)
AFGEPRELY

SEQ ID NO: 74900 - protein, 9 aa, Artificial Sequence
  Description of Artificial Sequence: Synthetic peptide
  Seed: SMSPLYFPQ (MAGC1_HUMAN)
SYSPLYFPK

SEQ ID NO: 74901 - protein, 9 aa, Artificial Sequence
  Description of Artificial Sequence: Synthetic peptide
  Seed: FTYTLDEKV (MAGC1_HUMAN)
FMYTLDEKA

SEQ ID NO: 74902 - protein, 11 aa, Artificial Sequence
  Description of Artificial Sequence: Synthetic peptide
  Seed: STFEGFAQSPL (MAGC1_HUMAN)
SQFEGFAQSPV

SEQ ID NO: 74903 - protein, 11 aa, Artificial Sequence
  Description of Artificial Sequence: Synthetic peptide
  Seed: SICSSSTSLSL (MAGC1_HUMAN)
SQCSSSTSLSF

SEQ ID NO: 74904 - protein, 10 aa, Artificial Sequence
  Description of Artificial Sequence: Synthetic peptide
  Seed: FFSYTLASLL (MAGC1_HUMAN)
FLSYTLASLA

SEQ ID NO: 74905 - protein, 9 aa, Artificial Sequence
  Description of Artificial Sequence: Synthetic peptide
  Seed: SSPPRYEFL (MAGC1_HUMAN)
SAPPRYEFY

SEQ ID NO: 74906 - protein, 9 aa, Artificial Sequence
  Description of Artificial Sequence: Synthetic peptide
  Seed: MPSLLQSSS (MAGC1_HUMAN)
MSSLLQSSF

SEQ ID NO: 74907 - protein, 9 aa, Artificial Sequence
  Description of Artificial Sequence: Synthetic peptide
  Seed: ISRYTGYFP (MAGC1_HUMAN)
IYRYTGYFK

SEQ ID NO: 74908 - protein, 9 aa, Artificial Sequence
  Description of Artificial Sequence: Synthetic peptide
  Seed: DSYVFVNTL (MAGC1_HUMAN)
DQYVFVNTM

SEQ ID NO: 74909 - protein, 10 aa, Artificial Sequence
  Description of Artificial Sequence: Synthetic peptide
  Seed: SSPESTQSPF (MAGC1_HUMAN)
SAPESTQSPY

SEQ ID NO: 74910 - protein, 9 aa, Artificial Sequence
  Description of Artificial Sequence: Synthetic peptide
  Seed: AQSPLQIPV (MAGC1_HUMAN)
AVSPLQIPV

SEQ ID NO: 74911 - protein, 9 aa, Artificial Sequence
  Description of Artificial Sequence: Synthetic peptide
  Seed: VPITFPSSY (MAGC1_HUMAN)
VMITFPSSM

SEQ ID NO: 74912 - protein, 9 aa, Artificial Sequence
  Description of Artificial Sequence: Synthetic peptide
  Seed: SICSSSTSL (MAGC1_HUMAN)
SFCSSSTSM

SEQ ID NO: 74913 - protein, 9 aa, Artificial Sequence
  Description of Artificial Sequence: Synthetic peptide
  Seed: ASSFFSSAL (MAGC1_HUMAN)
AGSFFSSAF

SEQ ID NO: 74914 - protein, 9 aa, Artificial Sequence
  Description of Artificial Sequence: Synthetic peptide
  Seed: TLDEKVDEL (MAGC1_HUMAN)
TPDEKVDEL

SEQ ID NO: 74915 - protein, 9 aa, Artificial Sequence
  Description of Artificial Sequence: Synthetic peptide
  Seed: SPLQIVPSL (MAGC1_HUMAN)
SLLQIVPSV

SEQ ID NO: 74916 - protein, 10 aa, Artificial Sequence
  Description of Artificial Sequence: Synthetic peptide
  Seed: MPTAGMPSLL (MAGC1_HUMAN)
MNTAGMPSLY

SEQ ID NO: 74917 - protein, 9 aa, Artificial Sequence
  Description of Artificial Sequence: Synthetic peptide
  Seed: AEMLTNVIS (MAGC1_HUMAN)
AEMLTNVIP

SEQ ID NO: 74918 - protein, 10 aa, Artificial Sequence
  Description of Artificial Sequence: Synthetic peptide
  Seed: ASSFFSSALL (MAGC1_HUMAN)
AVSFFSSALW

SEQ ID NO: 74919 - protein, 9 aa, Artificial Sequence
  Description of Artificial Sequence: Synthetic peptide
  Seed: TLDEKVDEL (MAGC1_HUMAN)
TRDEKVDEF

SEQ ID NO: 74920 - protein, 9 aa, Artificial Sequence
  Description of Artificial Sequence: Synthetic peptide
  Seed: KVVEFLAML (MAGC1_HUMAN)
KTVEFLAMT

SEQ ID NO: 74921 - protein, 8 aa, Artificial Sequence
  Description of Artificial Sequence: Synthetic peptide
  Seed: AFGEPREL (MAGC1_HUMAN)
ASGEPREL

SEQ ID NO: 74922 - protein, 10 aa, Artificial Sequence
  Description of Artificial Sequence: Synthetic peptide
  Seed: SSPESAQSAF (MAGC1_HUMAN)
SYPESAQSAF

SEQ ID NO: 74923 - protein, 8 aa, Artificial Sequence
  Description of Artificial Sequence: Synthetic peptide
  Seed: KVDELARF (MAGC1_HUMAN)
KADELARM

SEQ ID NO: 74924 - protein, 9 aa, Artificial Sequence
  Description of Artificial Sequence: Synthetic peptide
  Seed: SPECTQSTF (MAGC1_HUMAN)
SPECTQSTY

SEQ ID NO: 74925 - protein, 9 aa, Artificial Sequence
  Description of Artificial Sequence: Synthetic peptide
  Seed: VSAASSSTL (MAGC1_HUMAN)
VKAASSSTY

SEQ ID NO: 74926 - protein, 9 aa, Artificial Sequence
  Description of Artificial Sequence: Synthetic peptide
  Seed: KQPITKAEM (MAGC1_HUMAN)
KSPITKAEL

SEQ ID NO: 74927 - protein, 11 aa, Artificial Sequence
  Description of Artificial Sequence: Synthetic peptide
  Seed: QSFSERTQSTF (MAGC1_HUMAN)
QAFSERTQSTY

SEQ ID NO: 74928 - protein, 9 aa, Artificial Sequence
  Description of Artificial Sequence: Synthetic peptide
  Seed: MPTAGMPSL (MAGC1_HUMAN)
MQTAGMPSL

SEQ ID NO: 74929 - protein, 9 aa, Artificial Sequence
  Description of Artificial Sequence: Synthetic peptide
  Seed: VSPSFSSTL (MAGC1_HUMAN)
VRPSFSSTL

SEQ ID NO: 74930 - protein, 10 aa, Artificial Sequence
  Description of Artificial Sequence: Synthetic peptide
  Seed: SLSPLHFPQF (MAGC1_HUMAN)
STSPLHFPQR

SEQ ID NO: 74931 - protein, 10 aa, Artificial Sequence
  Description of Artificial Sequence: Synthetic peptide
  Seed: LSQSSPVSSF (MAGC1_HUMAN)
LWQSSPVSSY

SEQ ID NO: 74932 - protein, 9 aa, Artificial Sequence
  Description of Artificial Sequence: Synthetic peptide
  Seed: SAQSTFEGF (MAGC1_HUMAN)
SSQSTFEGF

SEQ ID NO: 74933 - protein, 9 aa, Artificial Sequence
  Description of Artificial Sequence: Synthetic peptide
  Seed: AQSPLQRPV (MAGC1_HUMAN)
ALSPLQRPY

SEQ ID NO: 74934 - protein, 9 aa, Artificial Sequence
  Description of Artificial Sequence: Synthetic peptide
  Seed: SSSSSSSTL (MAGC1_HUMAN)
STSSSSSTI

SEQ ID NO: 74935 - protein, 10 aa, Artificial Sequence
  Description of Artificial Sequence: Synthetic peptide
  Seed: LQIPVSRSFS (MAGC1_HUMAN)
LSIPVSRSFY

SEQ ID NO: 74936 - protein, 11 aa, Artificial Sequence
  Description of Artificial Sequence: Synthetic peptide
  Seed: TVPITFPSSYK (MAGC1_HUMAN)
TQPITFPSSYR

SEQ ID NO: 74937 - protein, 9 aa, Artificial Sequence
  Description of Artificial Sequence: Synthetic peptide
  Seed: LQIPVSAAS (MAGC1_HUMAN)
LNIPVSAAM

SEQ ID NO: 74938 - protein, 10 aa, Artificial Sequence
  Description of Artificial Sequence: Synthetic peptide
  Seed: RSFSSTLLSI (MAGC1_HUMAN)
RNFSSTLLSW

SEQ ID NO: 74939 - protein, 9 aa, Artificial Sequence
  Description of Artificial Sequence: Synthetic peptide
  Seed: SSPERTHST (MAGC1_HUMAN)
SRPERTHSV

SEQ ID NO: 74940 - protein, 9 aa, Artificial Sequence
  Description of Artificial Sequence: Synthetic peptide
  Seed: FFSSALLSI (MAGC1_HUMAN)
FWSSALLSM

SEQ ID NO: 74941 - protein, 10 aa, Artificial Sequence
  Description of Artificial Sequence: Synthetic peptide
  Seed: SSPESTQSPF (MAGC1_HUMAN)
SLPESTQSPL

SEQ ID NO: 74942 - protein, 9 aa, Artificial Sequence
  Description of Artificial Sequence: Synthetic peptide
  Seed: VSPSFSSTL (MAGC1_HUMAN)
VVPSFSSTV

SEQ ID NO: 74943 - protein, 10 aa, Artificial Sequence
  Description of Artificial Sequence: Synthetic peptide
  Seed: KVVEFLAMLK (MAGC1_HUMAN)
KLVEFLAMLV

SEQ ID NO: 74944 - protein, 8 aa, Artificial Sequence
  Description of Artificial Sequence: Synthetic peptide
  Seed: SEVIKRKV (MAGC1_HUMAN)
SEVIKRKL

SEQ ID NO: 74945 - protein, 10 aa, Artificial Sequence
  Description of Artificial Sequence: Synthetic peptide
  Seed: KRKVVEFLAM (MAGC1_HUMAN)
KYKVVEFLAF

SEQ ID NO: 74946 - protein, 9 aa, Artificial Sequence
  Description of Artificial Sequence: Synthetic peptide
  Seed: KAREFIEIL (MAGC1_HUMAN)
KLREFIEIA

SEQ ID NO: 74947 - protein, 9 aa, Artificial Sequence
  Description of Artificial Sequence: Synthetic peptide
  Seed: RKVVEFLAM (MAGC1_HUMAN)
REVVEFLAM

SEQ ID NO: 74948 - protein, 11 aa, Artificial Sequence
  Description of Artificial Sequence: Synthetic peptide
  Seed: STFEGFAQSSL (MAGC1_HUMAN)
SSFEGFAQSSM

SEQ ID NO: 74949 - protein, 9 aa, Artificial Sequence
  Description of Artificial Sequence: Synthetic peptide
  Seed: SSLSQSSPV (MAGC1_HUMAN)
SSLSQSSPL

SEQ ID NO: 74950 - protein, 9 aa, Artificial Sequence
  Description of Artificial Sequence: Synthetic peptide
  Seed: EMLTNVISR (MAGC1_HUMAN)
ESLTNVISR

SEQ ID NO: 74951 - protein, 9 aa, Artificial Sequence
  Description of Artificial Sequence: Synthetic peptide
  Seed: LSPLHFPQF (MAGC1_HUMAN)
LLPLHFPQY

SEQ ID NO: 74952 - protein, 9 aa, Artificial Sequence
  Description of Artificial Sequence: Synthetic peptide
  Seed: LQIVPSLPE (MAGC1_HUMAN)
LKIVPSLPW

SEQ ID NO: 74953 - protein, 10 aa, Artificial Sequence
  Description of Artificial Sequence: Synthetic peptide
  Seed: SSFPSSTSSS (MAGC1_HUMAN)
SIFPSSTSSY

SEQ ID NO: 74954 - protein, 11 aa, Artificial Sequence
  Description of Artificial Sequence: Synthetic peptide
  Seed: SSSSSSTLLSL (MAGC1_HUMAN)
SISSSSTLLSF

SEQ ID NO: 74955 - protein, 9 aa, Artificial Sequence
  Description of Artificial Sequence: Synthetic peptide
  Seed: FFSSALLSI (MAGC1_HUMAN)
FISSALLSA

SEQ ID NO: 74956 - protein, 9 aa, Artificial Sequence
  Description of Artificial Sequence: Synthetic peptide
  Seed: VSAASSSTL (MAGC1_HUMAN)
VQAASSSTI

SEQ ID NO: 74957 - protein, 9 aa, Artificial Sequence
  Description of Artificial Sequence: Synthetic peptide
  Seed: SLPEWEDSL (MAGC1_HUMAN)
SIPEWEDSL

SEQ ID NO: 74958 - protein, 9 aa, Artificial Sequence
  Description of Artificial Sequence: Synthetic peptide
  Seed: FAFGEPREL (MAGC1_HUMAN)
FFFGEPREL

SEQ ID NO: 74959 - protein, 10 aa, Artificial Sequence
  Description of Artificial Sequence: Synthetic peptide
  Seed: MPTAGMPSLL (MAGC1_HUMAN)
MNTAGMPSLF

SEQ ID NO: 74960 - protein, 11 aa, Artificial Sequence
  Description of Artificial Sequence: Synthetic peptide
  Seed: FQSSLQSPVSI (MAGC1_HUMAN)
FMSSLQSPVSM

SEQ ID NO: 74961 - protein, 10 aa, Artificial Sequence
  Description of Artificial Sequence: Synthetic peptide
  Seed: RSFSSTLLSI (MAGC1_HUMAN)
RWFSSTLLSL

SEQ ID NO: 74962 - protein, 10 aa, Artificial Sequence
  Description of Artificial Sequence: Synthetic peptide
  Seed: LLQIPMTSSF (MAGC1_HUMAN)
LGQIPMTSSL

SEQ ID NO: 74963 - protein, 11 aa, Artificial Sequence
  Description of Artificial Sequence: Synthetic peptide
  Seed: ISRYTGYFPVI (MAGC1_HUMAN)
ILRYTGYFPVF

SEQ ID NO: 74964 - protein, 9 aa, Artificial Sequence
  Description of Artificial Sequence: Synthetic peptide
  Seed: KQPITKAEM (MAGC1_HUMAN)
KYPITKAEL

SEQ ID NO: 74965 - protein, 9 aa, Artificial Sequence
  Description of Artificial Sequence: Synthetic peptide
  Seed: MPSLLQSSS (MAGC1_HUMAN)
MISLLQSSY

SEQ ID NO: 74966 - protein, 9 aa, Artificial Sequence
  Description of Artificial Sequence: Synthetic peptide
  Seed: SPERTQSTF (MAGC1_HUMAN)
SMERTQSTY

SEQ ID NO: 74967 - protein, 10 aa, Artificial Sequence
  Description of Artificial Sequence: Synthetic peptide
  Seed: EVPNSSPPRY (MAGC1_HUMAN)
EAPNSSPPRK

SEQ ID NO: 74968 - protein, 9 aa, Artificial Sequence
  Description of Artificial Sequence: Synthetic peptide
  Seed: GFPQSLLQI (MAGC1_HUMAN)
GLPQSLLQL

SEQ ID NO: 74969 - protein, 11 aa, Artificial Sequence
  Description of Artificial Sequence: Synthetic peptide
  Seed: SPLQIPGSPSF (MAGC1_HUMAN)
SRLQIPGSPSF

SEQ ID NO: 74970 - protein, 9 aa, Artificial Sequence
  Description of Artificial Sequence: Synthetic peptide
  Seed: YTLASLLQS (MAGC1_HUMAN)
YMLASLLQM

SEQ ID NO: 74971 - protein, 9 aa, Artificial Sequence
  Description of Artificial Sequence: Synthetic peptide
  Seed: SLIESEPLF (MAGC1_HUMAN)
SQIESEPLL

SEQ ID NO: 74972 - protein, 10 aa, Artificial Sequence
  Description of Artificial Sequence: Synthetic peptide
  Seed: YTLASLLQSS (MAGC1_HUMAN)
YPLASLLQSM

SEQ ID NO: 74973 - protein, 9 aa, Artificial Sequence
  Description of Artificial Sequence: Synthetic peptide
  Seed: YTGYFPVIF (MAGC1_HUMAN)
YQGYFPVIY

SEQ ID NO: 74974 - protein, 9 aa, Artificial Sequence
  Description of Artificial Sequence: Synthetic peptide
  Seed: AFGEPRELL (MAGC1_HUMAN)
ARGEPRELL

SEQ ID NO: 74975 - protein, 9 aa, Artificial Sequence
  Description of Artificial Sequence: Synthetic peptide
  Seed: YVFVNTLDL (MAGC1_HUMAN)
YIFVNTLDL

SEQ ID NO: 74976 - protein, 9 aa, Artificial Sequence
  Description of Artificial Sequence: Synthetic peptide
  Seed: RLLILILSI (MAGC1_HUMAN)
RILILILSR

SEQ ID NO: 74977 - protein, 11 aa, Artificial Sequence
  Description of Artificial Sequence: Synthetic peptide
  Seed: IPVSAASSSTL (MAGC1_HUMAN)
IFVSAASSSTF

SEQ ID NO: 74978 - protein, 9 aa, Artificial Sequence
  Description of Artificial Sequence: Synthetic peptide
  Seed: VPITFPSSY (MAGC1_HUMAN)
VSITFPSSF

SEQ ID NO: 74979 - protein, 11 aa, Artificial Sequence
  Description of Artificial Sequence: Synthetic peptide
  Seed: TTDDSTATESA (MAGC1_HUMAN)
TADDSTATESL

SEQ ID NO: 74980 - protein, 10 aa, Artificial Sequence
  Description of Artificial Sequence: Synthetic peptide
  Seed: PLQIPGSPSF (MAGC1_HUMAN)
PVQIPGSPSY

SEQ ID NO: 74981 - protein, 9 aa, Artificial Sequence
  Description of Artificial Sequence: Synthetic peptide
  Seed: VSAASSSTL (MAGC1_HUMAN)
VAAASSSTY

SEQ ID NO: 74982 - protein, 9 aa, Artificial Sequence
  Description of Artificial Sequence: Synthetic peptide
  Seed: SSFFSYTLA (MAGC1_HUMAN)
SVFFSYTLL

SEQ ID NO: 74983 - protein, 9 aa, Artificial Sequence
  Description of Artificial Sequence: Synthetic peptide
  Seed: YQVKQPITK (MAGC1_HUMAN)
YQVKQPITM

SEQ ID NO: 74984 - protein, 9 aa, Artificial Sequence
  Description of Artificial Sequence: Synthetic peptide
  Seed: ESSSPVDEY (MAGC1_HUMAN)
EVSSPVDEF

SEQ ID NO: 74985 - protein, 10 aa, Artificial Sequence
  Description of Artificial Sequence: Synthetic peptide
  Seed: LLQIPMTSSF (MAGC1_HUMAN)
LLQIPMTSSM

SEQ ID NO: 74986 - protein, 9 aa, Artificial Sequence
  Description of Artificial Sequence: Synthetic peptide
  Seed: FSSALLSIF (MAGC1_HUMAN)
FFSALLSIM

SEQ ID NO: 74987 - protein, 10 aa, Artificial Sequence
  Description of Artificial Sequence: Synthetic peptide
  Seed: LSQSSPVSSF (MAGC1_HUMAN)
LFQSSPVSSF

SEQ ID NO: 74988 - protein, 10 aa, Artificial Sequence
  Description of Artificial Sequence: Synthetic peptide
  Seed: FFSYTLASLL (MAGC1_HUMAN)
FMSYTLASLQ

SEQ ID NO: 74989 - protein, 9 aa, Artificial Sequence
  Description of Artificial Sequence: Synthetic peptide
  Seed: SLIESEPLF (MAGC1_HUMAN)
SSIESEPLW

SEQ ID NO: 74990 - protein, 10 aa, Artificial Sequence
  Description of Artificial Sequence: Synthetic peptide
  Seed: PLQIPGSPSF (MAGC1_HUMAN)
PQQIPGSPSF

SEQ ID NO: 74991 - protein, 10 aa, Artificial Sequence
  Description of Artificial Sequence: Synthetic peptide
  Seed: FPSSYKDALK (MAGC1_HUMAN)
FPSSYKDALL

SEQ ID NO: 74992 - protein, 9 aa, Artificial Sequence
  Description of Artificial Sequence: Synthetic peptide
  Seed: TFEGFPQSL (MAGC1_HUMAN)
TIEGFPQSV

SEQ ID NO: 74993 - protein, 8 aa, Artificial Sequence
  Description of Artificial Sequence: Synthetic peptide
  Seed: FSSTLLSL (MAGC1_HUMAN)
FASTLLSF

SEQ ID NO: 74994 - protein, 9 aa, Artificial Sequence
  Description of Artificial Sequence: Synthetic peptide
  Seed: TFEGFPQSL (MAGC1_HUMAN)
TVEGFPQSY

SEQ ID NO: 74995 - protein, 10 aa, Artificial Sequence
  Description of Artificial Sequence: Synthetic peptide
  Seed: KVDELARFLL (MAGC1_HUMAN)
KIDELARFLV

SEQ ID NO: 74996 - protein, 9 aa, Artificial Sequence
  Description of Artificial Sequence: Synthetic peptide
  Seed: GFPQSPLQI (MAGC1_HUMAN)
GRPQSPLQY

SEQ ID NO: 74997 - protein, 10 aa, Artificial Sequence
  Description of Artificial Sequence: Synthetic peptide
  Seed: VSPSSSSTLL (MAGC1_HUMAN)
VSPSSSSTLW

SEQ ID NO: 74998 - protein, 9 aa, Artificial Sequence
  Description of Artificial Sequence: Synthetic peptide
  Seed: RAHSEVIKR (MAGC1_HUMAN)
RYHSEVIKR

SEQ ID NO: 74999 - protein, 10 aa, Artificial Sequence
  Description of Artificial Sequence: Synthetic peptide
  Seed: SSPESDDTLY (MAGC1_HUMAN)
STPESDDTLW

SEQ ID NO: 75000 - protein, 11 aa, Artificial Sequence
  Description of Artificial Sequence: Synthetic peptide
  Seed: SPLQRPVSSFF (MAGC1_HUMAN)
SQLQRPVSSFF

SEQ ID NO: 75001 - protein, 9 aa, Artificial Sequence
  Description of Artificial Sequence: Synthetic peptide
  Seed: RFLLLKYQV (MAGC1_HUMAN)
RYLLLKYQY

SEQ ID NO: 75002 - protein, 9 aa, Artificial Sequence
  Description of Artificial Sequence: Synthetic peptide
  Seed: SSPESTQSP (MAGC1_HUMAN)
SMPESTQSF

SEQ ID NO: 75003 - protein, 9 aa, Artificial Sequence
  Description of Artificial Sequence: Synthetic peptide
  Seed: RYTGYFPVI (MAGC1_HUMAN)
RATGYFPVY

SEQ ID NO: 75004 - protein, 9 aa, Artificial Sequence
  Description of Artificial Sequence: Synthetic peptide
  Seed: LSPLHFPQF (MAGC1_HUMAN)
LYPLHFPQL

SEQ ID NO: 75005 - protein, 11 aa, Artificial Sequence
  Description of Artificial Sequence: Synthetic peptide
  Seed: SLSQSSPVSSF (MAGC1_HUMAN)
SESQSSPVSSF

SEQ ID NO: 75006 - protein, 9 aa, Artificial Sequence
  Description of Artificial Sequence: Synthetic peptide
  Seed: LQSPVISFS (MAGC1_HUMAN)
LVSPVISFM

SEQ ID NO: 75007 - protein, 9 aa, Artificial Sequence
  Description of Artificial Sequence: Synthetic peptide
  Seed: RAGREHFAF (MAGC1_HUMAN)
RWGREHFAM

SEQ ID NO: 75008 - protein, 10 aa, Artificial Sequence
  Description of Artificial Sequence: Synthetic peptide
  Seed: EVIWDVLSGI (MAGC1_HUMAN)
ELIWDVLSGY

SEQ ID NO: 75009 - protein, 9 aa, Artificial Sequence
  Description of Artificial Sequence: Synthetic peptide
  Seed: VPITFPSSY (MAGC1_HUMAN)
VVITFPSSY

SEQ ID NO: 75010 - protein, 9 aa, Artificial Sequence
  Description of Artificial Sequence: Synthetic peptide
  Seed: VSSSFSYTL (MAGC1_HUMAN)
VLSSFSYTW

SEQ ID NO: 75011 - protein, 9 aa, Artificial Sequence
  Description of Artificial Sequence: Synthetic peptide
  Seed: CTQSTFEGF (MAGC1_HUMAN)
CYQSTFEGM

SEQ ID NO: 75012 - protein, 10 aa, Artificial Sequence
  Description of Artificial Sequence: Synthetic peptide
  Seed: SFPSSTSSSL (MAGC1_HUMAN)
SFPSSTSSSM

SEQ ID NO: 75013 - protein, 10 aa, Artificial Sequence
  Description of Artificial Sequence: Synthetic peptide
  Seed: SLQIPVSPSF (MAGC1_HUMAN)
SDQIPVSPSY

SEQ ID NO: 75014 - protein, 11 aa, Artificial Sequence
  Description of Artificial Sequence: Synthetic peptide
  Seed: RSFSSTLLSIF (MAGC1_HUMAN)
RAFSSTLLSII

SEQ ID NO: 75015 - protein, 9 aa, Artificial Sequence
  Description of Artificial Sequence: Synthetic peptide
  Seed: RTHSTFEGF (MAGC1_HUMAN)
RVHSTFEGR

SEQ ID NO: 75016 - protein, 9 aa, Artificial Sequence
  Description of Artificial Sequence: Synthetic peptide
  Seed: KDVEERAQA (MAGC1_HUMAN)
KEVEERAQL

SEQ ID NO: 75017 - protein, 9 aa, Artificial Sequence
  Description of Artificial Sequence: Synthetic peptide
  Seed: RLLILILSI (MAGC1_HUMAN)
RLLILILSV

SEQ ID NO: 75018 - protein, 10 aa, Artificial Sequence
  Description of Artificial Sequence: Synthetic peptide
  Seed: STSLSLPQSF (MAGC1_HUMAN)
SSSLSLPQSF

SEQ ID NO: 75019 - protein, 9 aa, Artificial Sequence
  Description of Artificial Sequence: Synthetic peptide
  Seed: MGDKDMPTA (MAGC1_HUMAN)
MTDKDMPTL

SEQ ID NO: 75020 - protein, 10 aa, Artificial Sequence
  Description of Artificial Sequence: Synthetic peptide
  Seed: MPTAGMPSLL (MAGC1_HUMAN)
MDTAGMPSLI

SEQ ID NO: 75021 - protein, 9 aa, Artificial Sequence
  Description of Artificial Sequence: Synthetic peptide
  Seed: FTYTLDEKV (MAGC1_HUMAN)
FQYTLDEKI

SEQ ID NO: 75022 - protein, 9 aa, Artificial Sequence
  Description of Artificial Sequence: Synthetic peptide
  Seed: STQSPFEGF (MAGC1_HUMAN)
SMQSPFEGF

SEQ ID NO: 75023 - protein, 10 aa, Artificial Sequence
  Description of Artificial Sequence: Synthetic peptide
  Seed: RAHSEVIKRK (MAGC1_HUMAN)
RLHSEVIKRK

SEQ ID NO: 75024 - protein, 11 aa, Artificial Sequence
  Description of Artificial Sequence: Synthetic peptide
  Seed: TLYPLQSPQSR (MAGC1_HUMAN)
TVYPLQSPQSR

SEQ ID NO: 75025 - protein, 9 aa, Artificial Sequence
  Description of Artificial Sequence: Synthetic peptide
  Seed: TTDDSTATE (MAGC1_HUMAN)
TWDDSTATV

SEQ ID NO: 75026 - protein, 9 aa, Artificial Sequence
  Description of Artificial Sequence: Synthetic peptide
  Seed: DELARFLLL (MAGC1_HUMAN)
DELARFLLM

SEQ ID NO: 75027 - protein, 9 aa, Artificial Sequence
  Description of Artificial Sequence: Synthetic peptide
  Seed: SSSDTLLES (MAGC1_HUMAN)
STSDTLLEM

SEQ ID NO: 75028 - protein, 9 aa, Artificial Sequence
  Description of Artificial Sequence: Synthetic peptide
  Seed: TFEGFPQSL (MAGC1_HUMAN)
TLEGFPQSM

SEQ ID NO: 75029 - protein, 10 aa, Artificial Sequence
  Description of Artificial Sequence: Synthetic peptide
  Seed: FPQSLLQIPM (MAGC1_HUMAN)
FPQSLLQIPL

SEQ ID NO: 75030 - protein, 9 aa, Artificial Sequence
  Description of Artificial Sequence: Synthetic peptide
  Seed: LQIPGSPSF (MAGC1_HUMAN)
LGIPGSPSF

SEQ ID NO: 75031 - protein, 9 aa, Artificial Sequence
  Description of Artificial Sequence: Synthetic peptide
  Seed: FEGFAQSPL (MAGC1_HUMAN)
FMGFAQSPM

SEQ ID NO: 75032 - protein, 9 aa, Artificial Sequence
  Description of Artificial Sequence: Synthetic peptide
  Seed: FFSYTLASL (MAGC1_HUMAN)
FTSYTLASA

SEQ ID NO: 75033 - protein, 10 aa, Artificial Sequence
  Description of Artificial Sequence: Synthetic peptide
  Seed: SSFSYTLLSL (MAGC1_HUMAN)
STFSYTLLSF

SEQ ID NO: 75034 - protein, 9 aa, Artificial Sequence
  Description of Artificial Sequence: Synthetic peptide
  Seed: SPLQSPVSS (MAGC1_HUMAN)
SPLQSPVSV

SEQ ID NO: 75035 - protein, 9 aa, Artificial Sequence
  Description of Artificial Sequence: Synthetic peptide
  Seed: TSLSLPQSF (MAGC1_HUMAN)
TYLSLPQSL

SEQ ID NO: 75036 - protein, 9 aa, Artificial Sequence
  Description of Artificial Sequence: Synthetic peptide
  Seed: SSSSSSSTL (MAGC1_HUMAN)
STSSSSSTL

SEQ ID NO: 75037 - protein, 9 aa, Artificial Sequence
  Description of Artificial Sequence: Synthetic peptide
  Seed: SSPERTHST (MAGC1_HUMAN)
SGPERTHSL

SEQ ID NO: 75038 - protein, 9 aa, Artificial Sequence
  Description of Artificial Sequence: Synthetic peptide
  Seed: LQNPASSFF (MAGC1_HUMAN)
LANPASSFL

SEQ ID NO: 75039 - protein, 9 aa, Artificial Sequence
  Description of Artificial Sequence: Synthetic peptide
  Seed: CSSSTSLSL (MAGC1_HUMAN)
CCSSTSLSW

SEQ ID NO: 75040 - protein, 9 aa, Artificial Sequence
  Description of Artificial Sequence: Synthetic peptide
  Seed: YVFVNTLDL (MAGC1_HUMAN)
YYFVNTLDV

SEQ ID NO: 75041 - protein, 9 aa, Artificial Sequence
  Description of Artificial Sequence: Synthetic peptide
  Seed: LPQSFPESS (MAGC1_HUMAN)
LPQSFPESL

SEQ ID NO: 75042 - protein, 10 aa, Artificial Sequence
  Description of Artificial Sequence: Synthetic peptide
  Seed: FAFGEPRELL (MAGC1_HUMAN)
FSFGEPRELL

SEQ ID NO: 75043 - protein, 9 aa, Artificial Sequence
  Description of Artificial Sequence: Synthetic peptide
  Seed: MLKNTVPIT (MAGC1_HUMAN)
MLKNTVPIA

SEQ ID NO: 75044 - protein, 9 aa, Artificial Sequence
  Description of Artificial Sequence: Synthetic peptide
  Seed: AMLKNTVPI (MAGC1_HUMAN)
AQLKNTVPA

SEQ ID NO: 75045 - protein, 9 aa, Artificial Sequence
  Description of Artificial Sequence: Synthetic peptide
  Seed: LQIPVSPSF (MAGC1_HUMAN)
LLIPVSPSA

SEQ ID NO: 75046 - protein, 9 aa, Artificial Sequence
  Description of Artificial Sequence: Synthetic peptide
  Seed: FSYTLASLL (MAGC1_HUMAN)
FQYTLASLY

SEQ ID NO: 75047 - protein, 9 aa, Artificial Sequence
  Description of Artificial Sequence: Synthetic peptide
  Seed: ISFSSSTSL (MAGC1_HUMAN)
INFSSSTSY

SEQ ID NO: 75048 - protein, 10 aa, Artificial Sequence
  Description of Artificial Sequence: Synthetic peptide
  Seed: SVLQIPVSAA (MAGC1_HUMAN)
SPLQIPVSAV

SEQ ID NO: 75049 - protein, 9 aa, Artificial Sequence
  Description of Artificial Sequence: Synthetic peptide
  Seed: KAREFIEIL (MAGC1_HUMAN)
KTREFIEIG

SEQ ID NO: 75050 - protein, 9 aa, Artificial Sequence
  Description of Artificial Sequence: Synthetic peptide
  Seed: LQIPVSRSF (MAGC1_HUMAN)
LMIPVSRSW

SEQ ID NO: 75051 - protein, 10 aa, Artificial Sequence
  Description of Artificial Sequence: Synthetic peptide
  Seed: VSPSFSSTLV (MAGC1_HUMAN)
VMPSFSSTLA

SEQ ID NO: 75052 - protein, 11 aa, Artificial Sequence
  Description of Artificial Sequence: Synthetic peptide
  Seed: IPVSSSSSSTL (MAGC1_HUMAN)
IKVSSSSSSTW

SEQ ID NO: 75053 - protein, 9 aa, Artificial Sequence
  Description of Artificial Sequence: Synthetic peptide
  Seed: AMLKNTVPI (MAGC1_HUMAN)
ANLKNTVPY

SEQ ID NO: 75054 - protein, 9 aa, Artificial Sequence
  Description of Artificial Sequence: Synthetic peptide
  Seed: SFSYTLLSL (MAGC1_HUMAN)
SSSYTLLSY

SEQ ID NO: 75055 - protein, 9 aa, Artificial Sequence
  Description of Artificial Sequence: Synthetic peptide
  Seed: SLFQSFSER (MAGC1_HUMAN)
STFQSFSEK

SEQ ID NO: 75056 - protein, 9 aa, Artificial Sequence
  Description of Artificial Sequence: Synthetic peptide
  Seed: SLIESEPLF (MAGC1_HUMAN)
SVIESEPLY

SEQ ID NO: 75057 - protein, 10 aa, Artificial Sequence
  Description of Artificial Sequence: Synthetic peptide
  Seed: SSSSSTLLSL (MAGC1_HUMAN)
SVSSSTLLSF

SEQ ID NO: 75058 - protein, 9 aa, Artificial Sequence
  Description of Artificial Sequence: Synthetic peptide
  Seed: FFSYTLASL (MAGC1_HUMAN)
FMSYTLASM

SEQ ID NO: 75059 - protein, 9 aa, Artificial Sequence
  Description of Artificial Sequence: Synthetic peptide
  Seed: YTGYFPVIF (MAGC1_HUMAN)
YQGYFPVIF

SEQ ID NO: 75060 - protein, 9 aa, Artificial Sequence
  Description of Artificial Sequence: Synthetic peptide
  Seed: SPESAQSAF (MAGC1_HUMAN)
SQESAQSAF

SEQ ID NO: 75061 - protein, 9 aa, Artificial Sequence
  Description of Artificial Sequence: Synthetic peptide
  Seed: SRYTGYFPV (MAGC1_HUMAN)
SQYTGYFPG

SEQ ID NO: 75062 - protein, 10 aa, Artificial Sequence
  Description of Artificial Sequence: Synthetic peptide
  Seed: SSSSSTLLSL (MAGC1_HUMAN)
SASSSTLLSM

SEQ ID NO: 75063 - protein, 9 aa, Artificial Sequence
  Description of Artificial Sequence: Synthetic peptide
  Seed: IFRKAREFI (MAGC1_HUMAN)
IYRKAREFW

SEQ ID NO: 75064 - protein, 9 aa, Artificial Sequence
  Description of Artificial Sequence: Synthetic peptide
  Seed: LQRPVSSFF (MAGC1_HUMAN)
LSRPVSSFR

SEQ ID NO: 75065 - protein, 9 aa, Artificial Sequence
  Description of Artificial Sequence: Synthetic peptide
  Seed: SRYTGYFPV (MAGC1_HUMAN)
SRYTGYFPI

SEQ ID NO: 75066 - protein, 9 aa, Artificial Sequence
  Description of Artificial Sequence: Synthetic peptide
  Seed: MSQNRLLIL (MAGC1_HUMAN)
MAQNRLLIL

SEQ ID NO: 75067 - protein, 9 aa, Artificial Sequence
  Description of Artificial Sequence: Synthetic peptide
  Seed: SPESAQSTF (MAGC1_HUMAN)
SPESAQSTY

SEQ ID NO: 75068 - protein, 10 aa, Artificial Sequence
  Description of Artificial Sequence: Synthetic peptide
  Seed: VSSSFSYTLL (MAGC1_HUMAN)
VGSSFSYTLF

SEQ ID NO: 75069 - protein, 10 aa, Artificial Sequence
  Description of Artificial Sequence: Synthetic peptide
  Seed: MSQNRLLILI (MAGC1_HUMAN)
MVQNRLLILW

SEQ ID NO: 75070 - protein, 11 aa, Artificial Sequence
  Description of Artificial Sequence: Synthetic peptide
  Seed: REVDPDDSYVF (MAGC1_HUMAN)
RQVDPDDSYVL

SEQ ID NO: 75071 - protein, 9 aa, Artificial Sequence
  Description of Artificial Sequence: Synthetic peptide
  Seed: SSSTLVSIF (MAGC1_HUMAN)
STSTLVSIF

SEQ ID NO: 75072 - protein, 9 aa, Artificial Sequence
  Description of Artificial Sequence: Synthetic peptide
  Seed: IFRKAREFI (MAGC1_HUMAN)
ITRKAREFK

SEQ ID NO: 75073 - protein, 9 aa, Artificial Sequence
  Description of Artificial Sequence: Synthetic peptide
  Seed: LSDEQGMSQ (MAGC1_HUMAN)
LSDEQGMSF

SEQ ID NO: 75074 - protein, 9 aa, Artificial Sequence
  Description of Artificial Sequence: Synthetic peptide
  Seed: MPTAGMPSL (MAGC1_HUMAN)
MSTAGMPSY

SEQ ID NO: 75075 - protein, 9 aa, Artificial Sequence
  Description of Artificial Sequence: Synthetic peptide
  Seed: AMLKNTVPI (MAGC1_HUMAN)
ATLKNTVPF

SEQ ID NO: 75076 - protein, 9 aa, Artificial Sequence
  Description of Artificial Sequence: Synthetic peptide
  Seed: SSPEGKDSL (MAGC1_HUMAN)
SLPEGKDSF

SEQ ID NO: 75077 - protein, 9 aa, Artificial Sequence
  Description of Artificial Sequence: Synthetic peptide
  Seed: SSSTLVSIF (MAGC1_HUMAN)
SKSTLVSIY

SEQ ID NO: 75078 - protein, 11 aa, Artificial Sequence
  Description of Artificial Sequence: Synthetic peptide
  Seed: IIDTTDDSTAT (MAGC1_HUMAN)
ILDTTDDSTAV

SEQ ID NO: 75079 - protein, 10 aa, Artificial Sequence
  Description of Artificial Sequence: Synthetic peptide
  Seed: SFPSSTSSSL (MAGC1_HUMAN)
SSPSSTSSSI

SEQ ID NO: 75080 - protein, 9 aa, Artificial Sequence
  Description of Artificial Sequence: Synthetic peptide
  Seed: SPERTHSTF (MAGC1_HUMAN)
SPERTHSTL

SEQ ID NO: 75081 - protein, 9 aa, Artificial Sequence
  Description of Artificial Sequence: Synthetic peptide
  Seed: IESEPLFTY (MAGC1_HUMAN)
IYSEPLFTL

SEQ ID NO: 75082 - protein, 9 aa, Artificial Sequence
  Description of Artificial Sequence: Synthetic peptide
  Seed: STQSPFEGF (MAGC1_HUMAN)
SQQSPFEGY

SEQ ID NO: 75083 - protein, 10 aa, Artificial Sequence
  Description of Artificial Sequence: Synthetic peptide
  Seed: SFSYTLLSLF (MAGC1_HUMAN)
SWSYTLLSLF

SEQ ID NO: 75084 - protein, 10 aa, Artificial Sequence
  Description of Artificial Sequence: Synthetic peptide
  Seed: PLQRPVSSFF (MAGC1_HUMAN)
PWQRPVSSFF

SEQ ID NO: 75085 - protein, 9 aa, Artificial Sequence
  Description of Artificial Sequence: Synthetic peptide
  Seed: FFSSALLSI (MAGC1_HUMAN)
FRSSALLSI

SEQ ID NO: 75086 - protein, 11 aa, Artificial Sequence
  Description of Artificial Sequence: Synthetic peptide
  Seed: SSFPSSTSSSL (MAGC1_HUMAN)
SSFPSSTSSSM

SEQ ID NO: 75087 - protein, 9 aa, Artificial Sequence
  Description of Artificial Sequence: Synthetic peptide
  Seed: VSPSFSSTL (MAGC1_HUMAN)
VIPSFSSTY

SEQ ID NO: 75088 - protein, 11 aa, Artificial Sequence
  Description of Artificial Sequence: Synthetic peptide
  Seed: SPLQNPASSFF (MAGC1_HUMAN)
SHLQNPASSFF

SEQ ID NO: 75089 - protein, 9 aa, Artificial Sequence
  Description of Artificial Sequence: Synthetic peptide
  Seed: FSSTLLSIL (MAGC1_HUMAN)
FSSTLLSIW

SEQ ID NO: 75090 - protein, 10 aa, Artificial Sequence
  Description of Artificial Sequence: Synthetic peptide
  Seed: EVIWDVLSGI (MAGC1_HUMAN)
EAIWDVLSGY

SEQ ID NO: 75091 - protein, 9 aa, Artificial Sequence
  Description of Artificial Sequence: Synthetic peptide
  Seed: FAFGEPREL (MAGC1_HUMAN)
FIFGEPREA

SEQ ID NO: 75092 - protein, 9 aa, Artificial Sequence
  Description of Artificial Sequence: Synthetic peptide
  Seed: EFIEILFGI (MAGC1_HUMAN)
EMIEILFGI

SEQ ID NO: 75093 - protein, 10 aa, Artificial Sequence
  Description of Artificial Sequence: Synthetic peptide
  Seed: SSPESAQSTF (MAGC1_HUMAN)
SAPESAQSTY

SEQ ID NO: 75094 - protein, 10 aa, Artificial Sequence
  Description of Artificial Sequence: Synthetic peptide
  Seed: KAREFIEILF (MAGC1_HUMAN)
KQREFIEILF

SEQ ID NO: 75095 - protein, 8 aa, Artificial Sequence
  Description of Artificial Sequence: Synthetic peptide
  Seed: SSPPRYEF (MAGC1_HUMAN)
SAPPRYEF

SEQ ID NO: 75096 - protein, 10 aa, Artificial Sequence
  Description of Artificial Sequence: Synthetic peptide
  Seed: SSFSYTLLSL (MAGC1_HUMAN)
SSFSYTLLSV

SEQ ID NO: 75097 - protein, 8 aa, Artificial Sequence
  Description of Artificial Sequence: Synthetic peptide
  Seed: RYTGYFPV (MAGC1_HUMAN)
RWTGYFPF

SEQ ID NO: 75098 - protein, 9 aa, Artificial Sequence
  Description of Artificial Sequence: Synthetic peptide
  Seed: SFSSTLVSL (MAGC1_HUMAN)
SISSTLVSY

SEQ ID NO: 75099 - protein, 9 aa, Artificial Sequence
  Description of Artificial Sequence: Synthetic peptide
  Seed: YVFVNTLDL (MAGC1_HUMAN)
YWFVNTLDY

SEQ ID NO: 75100 - protein, 9 aa, Artificial Sequence
  Description of Artificial Sequence: Synthetic peptide
  Seed: NTVPITFPS (MAGC1_HUMAN)
NNVPITFPK

SEQ ID NO: 75101 - protein, 9 aa, Artificial Sequence
  Description of Artificial Sequence: Synthetic peptide
  Seed: KVDELARFL (MAGC1_HUMAN)
KVDELARFI

SEQ ID NO: 75102 - protein, 9 aa, Artificial Sequence
  Description of Artificial Sequence: Synthetic peptide
  Seed: TLLSLFQSF (MAGC1_HUMAN)
TWLSLFQSV

SEQ ID NO: 75103 - protein, 9 aa, Artificial Sequence
  Description of Artificial Sequence: Synthetic peptide
  Seed: SSSESPQSC (MAGC1_HUMAN)
SVSESPQSL

SEQ ID NO: 75104 - protein, 9 aa, Artificial Sequence
  Description of Artificial Sequence: Synthetic peptide
  Seed: LQIPVSPSF (MAGC1_HUMAN)
LFIPVSPSL

SEQ ID NO: 75105 - protein, 10 aa, Artificial Sequence
  Description of Artificial Sequence: Synthetic peptide
  Seed: WEDSLSPHYF (MAGC1_HUMAN)
WMDSLSPHYM

SEQ ID NO: 75106 - protein, 10 aa, Artificial Sequence
  Description of Artificial Sequence: Synthetic peptide
  Seed: FQSSLQSPVS (MAGC1_HUMAN)
FMSSLQSPVT

SEQ ID NO: 75107 - protein, 10 aa, Artificial Sequence
  Description of Artificial Sequence: Synthetic peptide
  Seed: RSFSSTLLSI (MAGC1_HUMAN)
RYFSSTLLSV

SEQ ID NO: 75108 - protein, 9 aa, Artificial Sequence
  Description of Artificial Sequence: Synthetic peptide
  Seed: LKNTVPITF (MAGC1_HUMAN)
LGNTVPITF

SEQ ID NO: 75109 - protein, 10 aa, Artificial Sequence
  Description of Artificial Sequence: Synthetic peptide
  Seed: FFSSALLSIF (MAGC1_HUMAN)
FQSSALLSIY

SEQ ID NO: 75110 - protein, 10 aa, Artificial Sequence
  Description of Artificial Sequence: Synthetic peptide
  Seed: ASSSVMSPSF (MAGC1_HUMAN)
AKSSVMSPSF

SEQ ID NO: 75111 - protein, 9 aa, Artificial Sequence
  Description of Artificial Sequence: Synthetic peptide
  Seed: KAREFIEIL (MAGC1_HUMAN)
KQREFIEIW

SEQ ID NO: 75112 - protein, 9 aa, Artificial Sequence
  Description of Artificial Sequence: Synthetic peptide
  Seed: VSSFFSYTL (MAGC1_HUMAN)
VTSFFSYTY

SEQ ID NO: 75113 - protein, 9 aa, Artificial Sequence
  Description of Artificial Sequence: Synthetic peptide
  Seed: ISFSSSTSL (MAGC1_HUMAN)
IRFSSSTSI

SEQ ID NO: 75114 - protein, 9 aa, Artificial Sequence
  Description of Artificial Sequence: Synthetic peptide
  Seed: MPTAGMPSL (MAGC1_HUMAN)
MMTAGMPSF

SEQ ID NO: 75115 - protein, 9 aa, Artificial Sequence
  Description of Artificial Sequence: Synthetic peptide
  Seed: NSQSSPEGK (MAGC1_HUMAN)
NTQSSPEGR

SEQ ID NO: 75116 - protein, 9 aa, Artificial Sequence
  Description of Artificial Sequence: Synthetic peptide
  Seed: RPVSSFFSY (MAGC1_HUMAN)
RRVSSFFSM

SEQ ID NO: 75117 - protein, 9 aa, Artificial Sequence
  Description of Artificial Sequence: Synthetic peptide
  Seed: IPVSPSSSS (MAGC1_HUMAN)
IPVSPSSSF

SEQ ID NO: 75118 - protein, 9 aa, Artificial Sequence
  Description of Artificial Sequence: Synthetic peptide
  Seed: ESSSPVDEY (MAGC1_HUMAN)
EPSSPVDEY

SEQ ID NO: 75119 - protein, 10 aa, Artificial Sequence
  Description of Artificial Sequence: Synthetic peptide
  Seed: KRKVVEFLAM (MAGC1_HUMAN)
KPKVVEFLAY

SEQ ID NO: 75120 - protein, 10 aa, Artificial Sequence
  Description of Artificial Sequence: Synthetic peptide
  Seed: NSSPPRYEFL (MAGC1_HUMAN)
NVSPPRYEFV

SEQ ID NO: 75121 - protein, 10 aa, Artificial Sequence
  Description of Artificial Sequence: Synthetic peptide
  Seed: IWDVLSGIGV (MAGC1_HUMAN)
IFDVLSGIGM

SEQ ID NO: 75122 - protein, 9 aa, Artificial Sequence
  Description of Artificial Sequence: Synthetic peptide
  Seed: LQRPVSSFF (MAGC1_HUMAN)
LWRPVSSFK

SEQ ID NO: 75123 - protein, 9 aa, Artificial Sequence
  Description of Artificial Sequence: Synthetic peptide
  Seed: LLSLFQSFS (MAGC1_HUMAN)
LLSLFQSFL

SEQ ID NO: 75124 - protein, 9 aa, Artificial Sequence
  Description of Artificial Sequence: Synthetic peptide
  Seed: SSPPRYEFL (MAGC1_HUMAN)
SMPPRYEFF

SEQ ID NO: 75125 - protein, 11 aa, Artificial Sequence
  Description of Artificial Sequence: Synthetic peptide
  Seed: STFEGFPQSLL (MAGC1_HUMAN)
SIFEGFPQSLV

SEQ ID NO: 75126 - protein, 9 aa, Artificial Sequence
  Description of Artificial Sequence: Synthetic peptide
  Seed: SPLQIVPSL (MAGC1_HUMAN)
SPLQIVPSV

SEQ ID NO: 75127 - protein, 9 aa, Artificial Sequence
  Description of Artificial Sequence: Synthetic peptide
  Seed: SSSESPQSC (MAGC1_HUMAN)
SMSESPQSL

SEQ ID NO: 75128 - protein, 11 aa, Artificial Sequence
  Description of Artificial Sequence: Synthetic peptide
  Seed: VSSSSSSSTLL (MAGC1_HUMAN)
VHSSSSSSTLF

SEQ ID NO: 75129 - protein, 10 aa, Artificial Sequence
  Description of Artificial Sequence: Synthetic peptide
  Seed: SFSYTLLSLF (MAGC1_HUMAN)
SVSYTLLSLY

SEQ ID NO: 75130 - protein, 9 aa, Artificial Sequence
  Description of Artificial Sequence: Synthetic peptide
  Seed: SFSSTLVSL (MAGC1_HUMAN)
SSSSTLVSH

SEQ ID NO: 75131 - protein, 9 aa, Artificial Sequence
  Description of Artificial Sequence: Synthetic peptide
  Seed: VSSSFSYTL (MAGC1_HUMAN)
VFSSFSYTW

SEQ ID NO: 75132 - protein, 9 aa, Artificial Sequence
  Description of Artificial Sequence: Synthetic peptide
  Seed: TLVSIFQSS (MAGC1_HUMAN)
TTVSIFQSA

SEQ ID NO: 75133 - protein, 9 aa, Artificial Sequence
  Description of Artificial Sequence: Synthetic peptide
  Seed: FSYTLASLL (MAGC1_HUMAN)
FVYTLASLM

SEQ ID NO: 75134 - protein, 9 aa, Artificial Sequence
  Description of Artificial Sequence: Synthetic peptide
  Seed: SGIGVRAGR (MAGC1_HUMAN)
SIIGVRAGR

SEQ ID NO: 75135 - protein, 9 aa, Artificial Sequence
  Description of Artificial Sequence: Synthetic peptide
  Seed: VSPSFSSTL (MAGC1_HUMAN)
VFPSFSSTM

SEQ ID NO: 75136 - protein, 11 aa, Artificial Sequence
  Description of Artificial Sequence: Synthetic peptide
  Seed: STFEGFAQSSL (MAGC1_HUMAN)
STFEGFAQSSF

SEQ ID NO: 75137 - protein, 10 aa, Artificial Sequence
  Description of Artificial Sequence: Synthetic peptide
  Seed: VSSSSSSSTL (MAGC1_HUMAN)
VTSSSSSSTF

SEQ ID NO: 75138 - protein, 9 aa, Artificial Sequence
  Description of Artificial Sequence: Synthetic peptide
  Seed: FQSSLQSPV (MAGC1_HUMAN)
FASSLQSPM

SEQ ID NO: 75139 - protein, 10 aa, Artificial Sequence
  Description of Artificial Sequence: Synthetic peptide
  Seed: FFSYTLASLL (MAGC1_HUMAN)
FASYTLASLL

SEQ ID NO: 75140 - protein, 10 aa, Artificial Sequence
  Description of Artificial Sequence: Synthetic peptide
  Seed: SSPESAQSTF (MAGC1_HUMAN)
SLPESAQSTI

SEQ ID NO: 75141 - protein, 8 aa, Artificial Sequence
  Description of Artificial Sequence: Synthetic peptide
  Seed: QIPVSSSF (MAGC1_HUMAN)
QYPVSSSY

SEQ ID NO: 75142 - protein, 11 aa, Artificial Sequence
  Description of Artificial Sequence: Synthetic peptide
  Seed: IPVSPSSSSTL (MAGC1_HUMAN)
IPVSPSSSSTA

SEQ ID NO: 75143 - protein, 10 aa, Artificial Sequence
  Description of Artificial Sequence: Synthetic peptide
  Seed: SSSSSSSTLL (MAGC1_HUMAN)
SLSSSSSTLF

SEQ ID NO: 75144 - protein, 9 aa, Artificial Sequence
  Description of Artificial Sequence: Synthetic peptide
  Seed: FFSSALLSI (MAGC1_HUMAN)
FMSSALLSA

SEQ ID NO: 75145 - protein, 11 aa, Artificial Sequence
  Description of Artificial Sequence: Synthetic peptide
  Seed: IPVSRSFSSTL (MAGC1_HUMAN)
IRVSRSFSSTY

SEQ ID NO: 75146 - protein, 11 aa, Artificial Sequence
  Description of Artificial Sequence: Synthetic peptide
  Seed: ILFGISLREVD (MAGC1_HUMAN)
IMFGISLREVI

SEQ ID NO: 75147 - protein, 9 aa, Artificial Sequence
  Description of Artificial Sequence: Synthetic peptide
  Seed: AQSPLQSPV (MAGC1_HUMAN)
ASSPLQSPV

SEQ ID NO: 75148 - protein, 9 aa, Artificial Sequence
  Description of Artificial Sequence: Synthetic peptide
  Seed: FTYTLDEKV (MAGC1_HUMAN)
FLYTLDEKA

SEQ ID NO: 75149 - protein, 9 aa, Artificial Sequence
  Description of Artificial Sequence: Synthetic peptide
  Seed: IPVSPSSSS (MAGC1_HUMAN)
IPVSPSSSA

SEQ ID NO: 75150 - protein, 9 aa, Artificial Sequence
  Description of Artificial Sequence: Synthetic peptide
  Seed: TFEGFPQSL (MAGC1_HUMAN)
TLEGFPQSL

SEQ ID NO: 75151 - protein, 9 aa, Artificial Sequence
  Description of Artificial Sequence: Synthetic peptide
  Seed: LQIVPSLPE (MAGC1_HUMAN)
LEIVPSLPL

SEQ ID NO: 75152 - protein, 10 aa, Artificial Sequence
  Description of Artificial Sequence: Synthetic peptide
  Seed: LHFPQSPPEW (MAGC1_HUMAN)
LWFPQSPPEW

SEQ ID NO: 75153 - protein, 10 aa, Artificial Sequence
  Description of Artificial Sequence: Synthetic peptide
  Seed: NPASSFFSSA (MAGC1_HUMAN)
NGASSFFSSV

SEQ ID NO: 75154 - protein, 9 aa, Artificial Sequence
  Description of Artificial Sequence: Synthetic peptide
  Seed: STFEGFPQS (MAGC1_HUMAN)
SMFEGFPQY

SEQ ID NO: 75155 - protein, 10 aa, Artificial Sequence
  Description of Artificial Sequence: Synthetic peptide
  Seed: VSRSFSSTLL (MAGC1_HUMAN)
VSRSFSSTLM

SEQ ID NO: 75156 - protein, 10 aa, Artificial Sequence
  Description of Artificial Sequence: Synthetic peptide
  Seed: TGYFPVIFRK (MAGC1_HUMAN)
TNYFPVIFRR

SEQ ID NO: 75157 - protein, 9 aa, Artificial Sequence
  Description of Artificial Sequence: Synthetic peptide
  Seed: RTQSTFEGF (MAGC1_HUMAN)
RKQSTFEGY

SEQ ID NO: 75158 - protein, 9 aa, Artificial Sequence
  Description of Artificial Sequence: Synthetic peptide
  Seed: SSSSSSSTL (MAGC1_HUMAN)
SASSSSSTI

SEQ ID NO: 75159 - protein, 10 aa, Artificial Sequence
  Description of Artificial Sequence: Synthetic peptide
  Seed: ICSSSTSLSL (MAGC1_HUMAN)
IESSSTSLSY

SEQ ID NO: 75160 - protein, 11 aa, Artificial Sequence
  Description of Artificial Sequence: Synthetic peptide
  Seed: STFEGFPQSLL (MAGC1_HUMAN)
SVFEGFPQSLV

SEQ ID NO: 75161 - protein, 11 aa, Artificial Sequence
  Description of Artificial Sequence: Synthetic peptide
  Seed: IIDTTDDSTAT (MAGC1_HUMAN)
IADTTDDSTAF

SEQ ID NO: 75162 - protein, 10 aa, Artificial Sequence
  Description of Artificial Sequence: Synthetic peptide
  Seed: EVIWDVLSGI (MAGC1_HUMAN)
EMIWDVLSGA

SEQ ID NO: 75163 - protein, 9 aa, Artificial Sequence
  Description of Artificial Sequence: Synthetic peptide
  Seed: FSSALLSIF (MAGC1_HUMAN)
FASALLSIM

SEQ ID NO: 75164 - protein, 9 aa, Artificial Sequence
  Description of Artificial Sequence: Synthetic peptide
  Seed: SPLQIPQSS (MAGC1_HUMAN)
SHLQIPQSL

SEQ ID NO: 75165 - protein, 9 aa, Artificial Sequence
  Description of Artificial Sequence: Synthetic peptide
  Seed: SSFPSSTSS (MAGC1_HUMAN)
SCFPSSTSY

SEQ ID NO: 75166 - protein, 10 aa, Artificial Sequence
  Description of Artificial Sequence: Synthetic peptide
  Seed: FFSYTLASLL (MAGC1_HUMAN)
FQSYTLASLW

SEQ ID NO: 75167 - protein, 10 aa, Artificial Sequence
  Description of Artificial Sequence: Synthetic peptide
  Seed: YTLDEKVDEL (MAGC1_HUMAN)
YLLDEKVDEW

SEQ ID NO: 75168 - protein, 9 aa, Artificial Sequence
  Description of Artificial Sequence: Synthetic peptide
  Seed: RTHSTFEGF (MAGC1_HUMAN)
RLHSTFEGL

SEQ ID NO: 75169 - protein, 11 aa, Artificial Sequence
  Description of Artificial Sequence: Synthetic peptide
  Seed: SLIESEPLFTY (MAGC1_HUMAN)
SVIESEPLFTK

SEQ ID NO: 75170 - protein, 10 aa, Artificial Sequence
  Description of Artificial Sequence: Synthetic peptide
  Seed: SFPSSTSSSL (MAGC1_HUMAN)
SCPSSTSSSF

SEQ ID NO: 75171 - protein, 10 aa, Artificial Sequence
  Description of Artificial Sequence: Synthetic peptide
  Seed: LSLFQSSPER (MAGC1_HUMAN)
LTLFQSSPER

SEQ ID NO: 75172 - protein, 10 aa, Artificial Sequence
  Description of Artificial Sequence: Synthetic peptide
  Seed: NTVPITFPSS (MAGC1_HUMAN)
NLVPITFPSV

SEQ ID NO: 75173 - protein, 9 aa, Artificial Sequence
  Description of Artificial Sequence: Synthetic peptide
  Seed: STFEGFAQS (MAGC1_HUMAN)
SVFEGFAQY

SEQ ID NO: 75174 - protein, 11 aa, Artificial Sequence
  Description of Artificial Sequence: Synthetic peptide
  Seed: LSDEQGMSQNR (MAGC1_HUMAN)
LIDEQGMSQNY

SEQ ID NO: 75175 - protein, 9 aa, Artificial Sequence
  Description of Artificial Sequence: Synthetic peptide
  Seed: ASSFFSSAL (MAGC1_HUMAN)
AASFFSSAH

SEQ ID NO: 75176 - protein, 10 aa, Artificial Sequence
  Description of Artificial Sequence: Synthetic peptide
  Seed: STLLSLFQSF (MAGC1_HUMAN)
SWLLSLFQSI

SEQ ID NO: 75177 - protein, 10 aa, Artificial Sequence
  Description of Artificial Sequence: Synthetic peptide
  Seed: WDVLSGIGVR (MAGC1_HUMAN)
WVVLSGIGVR

SEQ ID NO: 75178 - protein, 9 aa, Artificial Sequence
  Description of Artificial Sequence: Synthetic peptide
  Seed: GFPQSLLQI (MAGC1_HUMAN)
GFPQSLLQM

SEQ ID NO: 75179 - protein, 9 aa, Artificial Sequence
  Description of Artificial Sequence: Synthetic peptide
  Seed: LQIPVSRSF (MAGC1_HUMAN)
LTIPVSRSL

SEQ ID NO: 75180 - protein, 10 aa, Artificial Sequence
  Description of Artificial Sequence: Synthetic peptide
  Seed: SFFSYTLASL (MAGC1_HUMAN)
SYFSYTLASY

SEQ ID NO: 75181 - protein, 9 aa, Artificial Sequence
  Description of Artificial Sequence: Synthetic peptide
  Seed: TSSFSSTLL (MAGC1_HUMAN)
TASFSSTLF

SEQ ID NO: 75182 - protein, 9 aa, Artificial Sequence
  Description of Artificial Sequence: Synthetic peptide
  Seed: FFSSALLSI (MAGC1_HUMAN)
FMSSALLSC

SEQ ID NO: 75183 - protein, 11 aa, Artificial Sequence
  Description of Artificial Sequence: Synthetic peptide
  Seed: SSTLLSLFQSF (MAGC1_HUMAN)
SMTLLSLFQSY

SEQ ID NO: 75184 - protein, 10 aa, Artificial Sequence
  Description of Artificial Sequence: Synthetic peptide
  Seed: SSFPSSTSSS (MAGC1_HUMAN)
SVFPSSTSSY

SEQ ID NO: 75185 - protein, 9 aa, Artificial Sequence
  Description of Artificial Sequence: Synthetic peptide
  Seed: KVVEFLAML (MAGC1_HUMAN)
KIVEFLAMR

SEQ ID NO: 75186 - protein, 9 aa, Artificial Sequence
  Description of Artificial Sequence: Synthetic peptide
  Seed: ESDDTLYPL (MAGC1_HUMAN)
EYDDTLYPM

SEQ ID NO: 75187 - protein, 9 aa, Artificial Sequence
  Description of Artificial Sequence: Synthetic peptide
  Seed: EDFQSSLQS (MAGC1_HUMAN)
EEFQSSLQW

SEQ ID NO: 75188 - protein, 9 aa, Artificial Sequence
  Description of Artificial Sequence: Synthetic peptide
  Seed: LSPLHFPQF (MAGC1_HUMAN)
LYPLHFPQF

SEQ ID NO: 75189 - protein, 10 aa, Artificial Sequence
  Description of Artificial Sequence: Synthetic peptide
  Seed: LQIPVSRSFS (MAGC1_HUMAN)
LQIPVSRSFD

SEQ ID NO: 75190 - protein, 9 aa, Artificial Sequence
  Description of Artificial Sequence: Synthetic peptide
  Seed: LQIPVSPSF (MAGC1_HUMAN)
LEIPVSPSM

SEQ ID NO: 75191 - protein, 9 aa, Artificial Sequence
  Description of Artificial Sequence: Synthetic peptide
  Seed: SSPPRYEFL (MAGC1_HUMAN)
SIPPRYEFI

SEQ ID NO: 75192 - protein, 9 aa, Artificial Sequence
  Description of Artificial Sequence: Synthetic peptide
  Seed: VLSGIGVRA (MAGC1_HUMAN)
VMSGIGVRV

SEQ ID NO: 75193 - protein, 9 aa, Artificial Sequence
  Description of Artificial Sequence: Synthetic peptide
  Seed: FQSSPERTH (MAGC1_HUMAN)
FISSPERTL

SEQ ID NO: 75194 - protein, 10 aa, Artificial Sequence
  Description of Artificial Sequence: Synthetic peptide
  Seed: ARFLLLKYQV (MAGC1_HUMAN)
ARFLLLKYQI

SEQ ID NO: 75195 - protein, 9 aa, Artificial Sequence
  Description of Artificial Sequence: Synthetic peptide
  Seed: FSYTLASLL (MAGC1_HUMAN)
FMYTLASLV

SEQ ID NO: 75196 - protein, 9 aa, Artificial Sequence
  Description of Artificial Sequence: Synthetic peptide
  Seed: SPPEGPVQS (MAGC1_HUMAN)
SAPEGPVQV

SEQ ID NO: 75197 - protein, 10 aa, Artificial Sequence
  Description of Artificial Sequence: Synthetic peptide
  Seed: YTLLSLFQSS (MAGC1_HUMAN)
YNLLSLFQSV

SEQ ID NO: 75198 - protein, 9 aa, Artificial Sequence
  Description of Artificial Sequence: Synthetic peptide
  Seed: TLASLLQSS (MAGC1_HUMAN)
TMASLLQST

SEQ ID NO: 75199 - protein, 10 aa, Artificial Sequence
  Description of Artificial Sequence: Synthetic peptide
  Seed: FFSYTLASLL (MAGC1_HUMAN)
FPSYTLASLV

SEQ ID NO: 75200 - protein, 9 aa, Artificial Sequence
  Description of Artificial Sequence: Synthetic peptide
  Seed: FSSTLLSIL (MAGC1_HUMAN)
FPSTLLSIY

SEQ ID NO: 75201 - protein, 10 aa, Artificial Sequence
  Description of Artificial Sequence: Synthetic peptide
  Seed: ISRYTGYFPV (MAGC1_HUMAN)
IQRYTGYFPK

SEQ ID NO: 75202 - protein, 9 aa, Artificial Sequence
  Description of Artificial Sequence: Synthetic peptide
  Seed: SQNRLLILI (MAGC1_HUMAN)
SENRLLILT

SEQ ID NO: 75203 - protein, 9 aa, Artificial Sequence
  Description of Artificial Sequence: Synthetic peptide
  Seed: LQIPGSPSF (MAGC1_HUMAN)
LYIPGSPSW

SEQ ID NO: 75204 - protein, 10 aa, Artificial Sequence
  Description of Artificial Sequence: Synthetic peptide
  Seed: RSFSSTLLSI (MAGC1_HUMAN)
RSFSSTLLSK

SEQ ID NO: 75205 - protein, 9 aa, Artificial Sequence
  Description of Artificial Sequence: Synthetic peptide
  Seed: FQSSLQSPV (MAGC1_HUMAN)
FHSSLQSPV

SEQ ID NO: 75206 - protein, 10 aa, Artificial Sequence
  Description of Artificial Sequence: Synthetic peptide
  Seed: LHFPQSPPEW (MAGC1_HUMAN)
LTFPQSPPEF

SEQ ID NO: 75207 - protein, 11 aa, Artificial Sequence
  Description of Artificial Sequence: Synthetic peptide
  Seed: STFEGFAQSSL (MAGC1_HUMAN)
SAFEGFAQSSL

SEQ ID NO: 75208 - protein, 10 aa, Artificial Sequence
  Description of Artificial Sequence: Synthetic peptide
  Seed: VPITFPSSYK (MAGC1_HUMAN)
VFITFPSSYK

SEQ ID NO: 75209 - protein, 10 aa, Artificial Sequence
  Description of Artificial Sequence: Synthetic peptide
  Seed: LAMLKNTVPI (MAGC1_HUMAN)
LQMLKNTVPV

SEQ ID NO: 75210 - protein, 10 aa, Artificial Sequence
  Description of Artificial Sequence: Synthetic peptide
  Seed: ASSFFSSALL (MAGC1_HUMAN)
AQSFFSSALV

SEQ ID NO: 75211 - protein, 10 aa, Artificial Sequence
  Description of Artificial Sequence: Synthetic peptide
  Seed: MPTAGMPSLL (MAGC1_HUMAN)
MTTAGMPSLW

SEQ ID NO: 75212 - protein, 9 aa, Artificial Sequence
  Description of Artificial Sequence: Synthetic peptide
  Seed: LQIVPSLPE (MAGC1_HUMAN)
LIIVPSLPM

SEQ ID NO: 75213 - protein, 9 aa, Artificial Sequence
  Description of Artificial Sequence: Synthetic peptide
  Seed: SIFQSSPER (MAGC1_HUMAN)
SIFQSSPEK

SEQ ID NO: 75214 - protein, 10 aa, Artificial Sequence
  Description of Artificial Sequence: Synthetic peptide
  Seed: ISRYTGYFPV (MAGC1_HUMAN)
IARYTGYFPI

SEQ ID NO: 75215 - protein, 10 aa, Artificial Sequence
  Description of Artificial Sequence: Synthetic peptide
  Seed: SSPESAQSTF (MAGC1_HUMAN)
STPESAQSTW

SEQ ID NO: 75216 - protein, 11 aa, Artificial Sequence
  Description of Artificial Sequence: Synthetic peptide
  Seed: SFFSSALLSIF (MAGC1_HUMAN)
SSFSSALLSIW

SEQ ID NO: 75217 - protein, 11 aa, Artificial Sequence
  Description of Artificial Sequence: Synthetic peptide
  Seed: IPVSSSFSYTL (MAGC1_HUMAN)
IHVSSSFSYTW

SEQ ID NO: 75218 - protein, 9 aa, Artificial Sequence
  Description of Artificial Sequence: Synthetic peptide
  Seed: DSYVFVNTL (MAGC1_HUMAN)
DRYVFVNTM

SEQ ID NO: 75219 - protein, 9 aa, Artificial Sequence
  Description of Artificial Sequence: Synthetic peptide
  Seed: LQNPASSFF (MAGC1_HUMAN)
LFNPASSFF

SEQ ID NO: 75220 - protein, 9 aa, Artificial Sequence
  Description of Artificial Sequence: Synthetic peptide
  Seed: LQIPVSPSF (MAGC1_HUMAN)
LEIPVSPSW

SEQ ID NO: 75221 - protein, 9 aa, Artificial Sequence
  Description of Artificial Sequence: Synthetic peptide
  Seed: VIKRKVVEF (MAGC1_HUMAN)
VQKRKVVEM

SEQ ID NO: 75222 - protein, 10 aa, Artificial Sequence
  Description of Artificial Sequence: Synthetic peptide
  Seed: VSSSFSYTLL (MAGC1_HUMAN)
VRSSFSYTLW

SEQ ID NO: 75223 - protein, 9 aa, Artificial Sequence
  Description of Artificial Sequence: Synthetic peptide
  Seed: AQSPLQRPV (MAGC1_HUMAN)
AMSPLQRPA

SEQ ID NO: 75224 - protein, 9 aa, Artificial Sequence
  Description of Artificial Sequence: Synthetic peptide
  Seed: SSPECTQST (MAGC1_HUMAN)
SIPECTQSI

SEQ ID NO: 75225 - protein, 9 aa, Artificial Sequence
  Description of Artificial Sequence: Synthetic peptide
  Seed: FFSYTLASL (MAGC1_HUMAN)
FFSYTLASF

SEQ ID NO: 75226 - protein, 9 aa, Artificial Sequence
  Description of Artificial Sequence: Synthetic peptide
  Seed: SSFFSSALL (MAGC1_HUMAN)
SVFFSSALI

SEQ ID NO: 75227 - protein, 9 aa, Artificial Sequence
  Description of Artificial Sequence: Synthetic peptide
  Seed: VQEHYLEYR (MAGC1_HUMAN)
VSEHYLEYY

SEQ ID NO: 75228 - protein, 9 aa, Artificial Sequence
  Description of Artificial Sequence: Synthetic peptide
  Seed: CSSSTPSSL (MAGC1_HUMAN)
CLSSTPSSF

SEQ ID NO: 75229 - protein, 9 aa, Artificial Sequence
  Description of Artificial Sequence: Synthetic peptide
  Seed: CSSSTSLSL (MAGC1_HUMAN)
CKSSTSLSI

SEQ ID NO: 75230 - protein, 9 aa, Artificial Sequence
  Description of Artificial Sequence: Synthetic peptide
  Seed: DSYVFVNTL (MAGC1_HUMAN)
DHYVFVNTL

SEQ ID NO: 75231 - protein, 11 aa, Artificial Sequence
  Description of Artificial Sequence: Synthetic peptide
  Seed: REVDPDDSYVF (MAGC1_HUMAN)
REVDPDDSYVW

SEQ ID NO: 75232 - protein, 8 aa, Artificial Sequence
  Description of Artificial Sequence: Synthetic peptide
  Seed: KVDELARF (MAGC1_HUMAN)
KMDELARL

SEQ ID NO: 75233 - protein, 9 aa, Artificial Sequence
  Description of Artificial Sequence: Synthetic peptide
  Seed: ESPLQSPVI (MAGC1_HUMAN)
EAPLQSPVV

SEQ ID NO: 75234 - protein, 10 aa, Artificial Sequence
  Description of Artificial Sequence: Synthetic peptide
  Seed: LLQIPMTSSF (MAGC1_HUMAN)
LVQIPMTSSM

SEQ ID NO: 75235 - protein, 9 aa, Artificial Sequence
  Description of Artificial Sequence: Synthetic peptide
  Seed: HFPQSPPEW (MAGC1_HUMAN)
HLPQSPPEL

SEQ ID NO: 75236 - protein, 9 aa, Artificial Sequence
  Description of Artificial Sequence: Synthetic peptide
  Seed: SLIESEPLF (MAGC1_HUMAN)
SMIESEPLI

SEQ ID NO: 75237 - protein, 10 aa, Artificial Sequence
  Description of Artificial Sequence: Synthetic peptide
  Seed: YPLQSPQSRS (MAGC1_HUMAN)
YPLQSPQSRA

SEQ ID NO: 75238 - protein, 9 aa, Artificial Sequence
  Description of Artificial Sequence: Synthetic peptide
  Seed: SVLQIPVSA (MAGC1_HUMAN)
SFLQIPVSR

SEQ ID NO: 75239 - protein, 9 aa, Artificial Sequence
  Description of Artificial Sequence: Synthetic peptide
  Seed: CSSSTPSSL (MAGC1_HUMAN)
CKSSTPSSL

SEQ ID NO: 75240 - protein, 9 aa, Artificial Sequence
  Description of Artificial Sequence: Synthetic peptide
  Seed: ISFSSSTSL (MAGC1_HUMAN)
IEFSSSTSY

SEQ ID NO: 75241 - protein, 9 aa, Artificial Sequence
  Description of Artificial Sequence: Synthetic peptide
  Seed: ISFSSSTSL (MAGC1_HUMAN)
INFSSSTSW

SEQ ID NO: 75242 - protein, 9 aa, Artificial Sequence
  Description of Artificial Sequence: Synthetic peptide
  Seed: VSRSFSSTL (MAGC1_HUMAN)
VIRSFSSTV

SEQ ID NO: 75243 - protein, 11 aa, Artificial Sequence
  Description of Artificial Sequence: Synthetic peptide
  Seed: RPVSSFFSYTL (MAGC1_HUMAN)
RYVSSFFSYTW

SEQ ID NO: 75244 - protein, 9 aa, Artificial Sequence
  Description of Artificial Sequence: Synthetic peptide
  Seed: SSPESAQSA (MAGC1_HUMAN)
SAPESAQSI

SEQ ID NO: 75245 - protein, 10 aa, Artificial Sequence
  Description of Artificial Sequence: Synthetic peptide
  Seed: KAREFIEILF (MAGC1_HUMAN)
KSREFIEILA

SEQ ID NO: 75246 - protein, 9 aa, Artificial Sequence
  Description of Artificial Sequence: Synthetic peptide
  Seed: SSSVMSPSF (MAGC1_HUMAN)
SSSVMSPSI

SEQ ID NO: 75247 - protein, 10 aa, Artificial Sequence
  Description of Artificial Sequence: Synthetic peptide
  Seed: MLTNVISRYT (MAGC1_HUMAN)
MQTNVISRYL

SEQ ID NO: 75248 - protein, 10 aa, Artificial Sequence
  Description of Artificial Sequence: Synthetic peptide
  Seed: SLSPLHFPQF (MAGC1_HUMAN)
SYSPLHFPQM

SEQ ID NO: 75249 - protein, 9 aa, Artificial Sequence
  Description of Artificial Sequence: Synthetic peptide
  Seed: SSSTSLSPF (MAGC1_HUMAN)
SKSTSLSPF

SEQ ID NO: 75250 - protein, 10 aa, Artificial Sequence
  Description of Artificial Sequence: Synthetic peptide
  Seed: ISRYTGYFPV (MAGC1_HUMAN)
IRRYTGYFPF

SEQ ID NO: 75251 - protein, 10 aa, Artificial Sequence
  Description of Artificial Sequence: Synthetic peptide
  Seed: REVDPDDSYV (MAGC1_HUMAN)
RVVDPDDSYI

SEQ ID NO: 75252 - protein, 9 aa, Artificial Sequence
  Description of Artificial Sequence: Synthetic peptide
  Seed: AQSSLQIPV (MAGC1_HUMAN)
ALSSLQIPA

SEQ ID NO: 75253 - protein, 9 aa, Artificial Sequence
  Description of Artificial Sequence: Synthetic peptide
  Seed: RTHSTFEGF (MAGC1_HUMAN)
RYHSTFEGW

SEQ ID NO: 75254 - protein, 10 aa, Artificial Sequence
  Description of Artificial Sequence: Synthetic peptide
  Seed: LLQIPMTSSF (MAGC1_HUMAN)
LSQIPMTSSY

SEQ ID NO: 75255 - protein, 10 aa, Artificial Sequence
  Description of Artificial Sequence: Synthetic peptide
  Seed: LLQIPMTSSF (MAGC1_HUMAN)
LVQIPMTSSW

SEQ ID NO: 75256 - protein, 10 aa, Artificial Sequence
  Description of Artificial Sequence: Synthetic peptide
  Seed: SSFSYTLLSL (MAGC1_HUMAN)
SSFSYTLLSI

SEQ ID NO: 75257 - protein, 10 aa, Artificial Sequence
  Description of Artificial Sequence: Synthetic peptide
  Seed: FFSYTLASLL (MAGC1_HUMAN)
FYSYTLASLI

SEQ ID NO: 75258 - protein, 10 aa, Artificial Sequence
  Description of Artificial Sequence: Synthetic peptide
  Seed: FPQSLLQIPM (MAGC1_HUMAN)
FPQSLLQIPV

SEQ ID NO: 75259 - protein, 10 aa, Artificial Sequence
  Description of Artificial Sequence: Synthetic peptide
  Seed: RLLILILSII (MAGC1_HUMAN)
RMLILILSIL

SEQ ID NO: 75260 - protein, 9 aa, Artificial Sequence
  Description of Artificial Sequence: Synthetic peptide
  Seed: SSFFSSALL (MAGC1_HUMAN)
SLFFSSALW

SEQ ID NO: 75261 - protein, 9 aa, Artificial Sequence
  Description of Artificial Sequence: Synthetic peptide
  Seed: SLIESEPLF (MAGC1_HUMAN)
SAIESEPLW

SEQ ID NO: 75262 - protein, 9 aa, Artificial Sequence
  Description of Artificial Sequence: Synthetic peptide
  Seed: VPITFPSSY (MAGC1_HUMAN)
VMITFPSSI

SEQ ID NO: 75263 - protein, 10 aa, Artificial Sequence
  Description of Artificial Sequence: Synthetic peptide
  Seed: ASSFFSSALL (MAGC1_HUMAN)
APSFFSSALF

SEQ ID NO: 75264 - protein, 9 aa, Artificial Sequence
  Description of Artificial Sequence: Synthetic peptide
  Seed: RPVSSFFSY (MAGC1_HUMAN)
RQVSSFFSI

SEQ ID NO: 75265 - protein, 11 aa, Artificial Sequence
  Description of Artificial Sequence: Synthetic peptide
  Seed: SPLQRPVSSFF (MAGC1_HUMAN)
SVLQRPVSSFY

SEQ ID NO: 75266 - protein, 9 aa, Artificial Sequence
  Description of Artificial Sequence: Synthetic peptide
  Seed: ESDDTLYPL (MAGC1_HUMAN)
EWDDTLYPL

SEQ ID NO: 75267 - protein, 9 aa, Artificial Sequence
  Description of Artificial Sequence: Synthetic peptide
  Seed: RKVVEFLAM (MAGC1_HUMAN)
RGVVEFLAF

SEQ ID NO: 75268 - protein, 10 aa, Artificial Sequence
  Description of Artificial Sequence: Synthetic peptide
  Seed: SSSSSSSTLL (MAGC1_HUMAN)
SHSSSSSTLF

SEQ ID NO: 75269 - protein, 9 aa, Artificial Sequence
  Description of Artificial Sequence: Synthetic peptide
  Seed: RLLILILSI (MAGC1_HUMAN)
RMLILILSV

SEQ ID NO: 75270 - protein, 10 aa, Artificial Sequence
  Description of Artificial Sequence: Synthetic peptide
  Seed: ASSSVMSPSF (MAGC1_HUMAN)
ATSSVMSPSF

SEQ ID NO: 75271 - protein, 11 aa, Artificial Sequence
  Description of Artificial Sequence: Synthetic peptide
  Seed: FLAMLKNTVPI (MAGC1_HUMAN)
FMAMLKNTVPA

SEQ ID NO: 75272 - protein, 10 aa, Artificial Sequence
  Description of Artificial Sequence: Synthetic peptide
  Seed: WVQEHYLEYR (MAGC1_HUMAN)
WIQEHYLEYR

SEQ ID NO: 75273 - protein, 9 aa, Artificial Sequence
  Description of Artificial Sequence: Synthetic peptide
  Seed: TTDDSTATE (MAGC1_HUMAN)
TADDSTATL

SEQ ID NO: 75274 - protein, 9 aa, Artificial Sequence
  Description of Artificial Sequence: Synthetic peptide
  Seed: LSDEQGMSQ (MAGC1_HUMAN)
LADEQGMSM

SEQ ID NO: 75275 - protein, 10 aa, Artificial Sequence
  Description of Artificial Sequence: Synthetic peptide
  Seed: FAQSSLQIPV (MAGC1_HUMAN)
FEQSSLQIPV

SEQ ID NO: 75276 - protein, 9 aa, Artificial Sequence
  Description of Artificial Sequence: Synthetic peptide
  Seed: AQSPLQIPV (MAGC1_HUMAN)
AVSPLQIPA

SEQ ID NO: 75277 - protein, 10 aa, Artificial Sequence
  Description of Artificial Sequence: Synthetic peptide
  Seed: LQIPGSPSFS (MAGC1_HUMAN)
LQIPGSPSFP

SEQ ID NO: 75278 - protein, 10 aa, Artificial Sequence
  Description of Artificial Sequence: Synthetic peptide
  Seed: RPVSSFFSYT (MAGC1_HUMAN)
RAVSSFFSYK

SEQ ID NO: 75279 - protein, 9 aa, Artificial Sequence
  Description of Artificial Sequence: Synthetic peptide
  Seed: SSSTLLSLF (MAGC1_HUMAN)
SHSTLLSLY

SEQ ID NO: 75280 - protein, 9 aa, Artificial Sequence
  Description of Artificial Sequence: Synthetic peptide
  Seed: YTLASLLQS (MAGC1_HUMAN)
YTLASLLQI

SEQ ID NO: 75281 - protein, 9 aa, Artificial Sequence
  Description of Artificial Sequence: Synthetic peptide
  Seed: FQSSLQSPV (MAGC1_HUMAN)
FSSSLQSPY

SEQ ID NO: 75282 - protein, 9 aa, Artificial Sequence
  Description of Artificial Sequence: Synthetic peptide
  Seed: MSQNRLLIL (MAGC1_HUMAN)
MNQNRLLIF

SEQ ID NO: 75283 - protein, 11 aa, Artificial Sequence
  Description of Artificial Sequence: Synthetic peptide
  Seed: FLAMLKNTVPI (MAGC1_HUMAN)
FPAMLKNTVPL

SEQ ID NO: 75284 - protein, 10 aa, Artificial Sequence
  Description of Artificial Sequence: Synthetic peptide
  Seed: RAGREHFAFG (MAGC1_HUMAN)
RYGREHFAFR

SEQ ID NO: 75285 - protein, 9 aa, Artificial Sequence
  Description of Artificial Sequence: Synthetic peptide
  Seed: SPLQIVPSL (MAGC1_HUMAN)
SALQIVPSM

SEQ ID NO: 75286 - protein, 9 aa, Artificial Sequence
  Description of Artificial Sequence: Synthetic peptide
  Seed: ASSSTLVSI (MAGC1_HUMAN)
ATSSTLVSA

SEQ ID NO: 75287 - protein, 11 aa, Artificial Sequence
  Description of Artificial Sequence: Synthetic peptide
  Seed: SLSQSSPVSSF (MAGC1_HUMAN)
SMSQSSPVSSF

SEQ ID NO: 75288 - protein, 10 aa, Artificial Sequence
  Description of Artificial Sequence: Synthetic peptide
  Seed: RAGREHFAFG (MAGC1_HUMAN)
RAGREHFAFK

SEQ ID NO: 75289 - protein, 9 aa, Artificial Sequence
  Description of Artificial Sequence: Synthetic peptide
  Seed: IIDTTDDST (MAGC1_HUMAN)
IIDTTDDSV

SEQ ID NO: 75290 - protein, 11 aa, Artificial Sequence
  Description of Artificial Sequence: Synthetic peptide
  Seed: REVPNSSPPRY (MAGC1_HUMAN)
REVPNSSPPRI

SEQ ID NO: 75291 - protein, 10 aa, Artificial Sequence
  Description of Artificial Sequence: Synthetic peptide
  Seed: LQIPVSPSFS (MAGC1_HUMAN)
LLIPVSPSFM

SEQ ID NO: 75292 - protein, 10 aa, Artificial Sequence
  Description of Artificial Sequence: Synthetic peptide
  Seed: SSPESAQSTF (MAGC1_HUMAN)
SMPESAQSTL

SEQ ID NO: 75293 - protein, 10 aa, Artificial Sequence
  Description of Artificial Sequence: Synthetic peptide
  Seed: SSPESAQSAF (MAGC1_HUMAN)
SQPESAQSAM

SEQ ID NO: 75294 - protein, 10 aa, Artificial Sequence
  Description of Artificial Sequence: Synthetic peptide
  Seed: RSFSSTLLSI (MAGC1_HUMAN)
RKFSSTLLSY

SEQ ID NO: 75295 - protein, 10 aa, Artificial Sequence
  Description of Artificial Sequence: Synthetic peptide
  Seed: REVDPDDSYV (MAGC1_HUMAN)
RVVDPDDSYW

SEQ ID NO: 75296 - protein, 9 aa, Artificial Sequence
  Description of Artificial Sequence: Synthetic peptide
  Seed: SICSSSTSL (MAGC1_HUMAN)
SRCSSSTSY

SEQ ID NO: 75297 - protein, 9 aa, Artificial Sequence
  Description of Artificial Sequence: Synthetic peptide
  Seed: SFPSSTSSS (MAGC1_HUMAN)
SLPSSTSSL

SEQ ID NO: 75298 - protein, 10 aa, Artificial Sequence
  Description of Artificial Sequence: Synthetic peptide
  Seed: SPLYFPQSPL (MAGC1_HUMAN)
SLLYFPQSPI

SEQ ID NO: 75299 - protein, 9 aa, Artificial Sequence
  Description of Artificial Sequence: Synthetic peptide
  Seed: TPSSLPQSF (MAGC1_HUMAN)
TMSSLPQSF

SEQ ID NO: 75300 - protein, 9 aa, Artificial Sequence
  Description of Artificial Sequence: Synthetic peptide
  Seed: SPVSSFPSS (MAGC1_HUMAN)
SPVSSFPSF

SEQ ID NO: 75301 - protein, 11 aa, Artificial Sequence
  Description of Artificial Sequence: Synthetic peptide
  Seed: SSTPSSLPQSF (MAGC1_HUMAN)
SSTPSSLPQSW

SEQ ID NO: 75302 - protein, 9 aa, Artificial Sequence
  Description of Artificial Sequence: Synthetic peptide
  Seed: ISFSSSTSL (MAGC1_HUMAN)
IEFSSSTSF

SEQ ID NO: 75303 - protein, 9 aa, Artificial Sequence
  Description of Artificial Sequence: Synthetic peptide
  Seed: HESPQSPPE (MAGC1_HUMAN)
HESPQSPPL

SEQ ID NO: 75304 - protein, 9 aa, Artificial Sequence
  Description of Artificial Sequence: Synthetic peptide
  Seed: SPPEGENTH (MAGC1_HUMAN)
SLPEGENTM

SEQ ID NO: 75305 - protein, 9 aa, Artificial Sequence
  Description of Artificial Sequence: Synthetic peptide
  Seed: LQIPGSPSF (MAGC1_HUMAN)
LDIPGSPSL

SEQ ID NO: 75306 - protein, 9 aa, Artificial Sequence
  Description of Artificial Sequence: Synthetic peptide
  Seed: SSSVMSPSF (MAGC1_HUMAN)
SPSVMSPSF

SEQ ID NO: 75307 - protein, 11 aa, Artificial Sequence
  Description of Artificial Sequence: Synthetic peptide
  Seed: TTDDSTATESA (MAGC1_HUMAN)
TIDDSTATESV

SEQ ID NO: 75308 - protein, 10 aa, Artificial Sequence
  Description of Artificial Sequence: Synthetic peptide
  Seed: MPTAGMPSLL (MAGC1_HUMAN)
MKTAGMPSLW

SEQ ID NO: 75309 - protein, 10 aa, Artificial Sequence
  Description of Artificial Sequence: Synthetic peptide
  Seed: QRPVSSFFSY (MAGC1_HUMAN)
QTPVSSFFSY

SEQ ID NO: 75310 - protein, 10 aa, Artificial Sequence
  Description of Artificial Sequence: Synthetic peptide
  Seed: SFSYTLLSLF (MAGC1_HUMAN)
SHSYTLLSLF

SEQ ID NO: 75311 - protein, 9 aa, Artificial Sequence
  Description of Artificial Sequence: Synthetic peptide
  Seed: SICSSSTSL (MAGC1_HUMAN)
SVCSSSTSY

SEQ ID NO: 75312 - protein, 11 aa, Artificial Sequence
  Description of Artificial Sequence: Synthetic peptide
  Seed: MSPLYFPQSPL (MAGC1_HUMAN)
MGPLYFPQSPV

SEQ ID NO: 75313 - protein, 9 aa, Artificial Sequence
  Description of Artificial Sequence: Synthetic peptide
  Seed: KDSQSPLQI (MAGC1_HUMAN)
KMSQSPLQF

SEQ ID NO: 75314 - protein, 9 aa, Artificial Sequence
  Description of Artificial Sequence: Synthetic peptide
  Seed: SSHESPQSP (MAGC1_HUMAN)
SGHESPQSY

SEQ ID NO: 75315 - protein, 11 aa, Artificial Sequence
  Description of Artificial Sequence: Synthetic peptide
  Seed: SSFSYTLLSLF (MAGC1_HUMAN)
SGFSYTLLSLW

SEQ ID NO: 75316 - protein, 9 aa, Artificial Sequence
  Description of Artificial Sequence: Synthetic peptide
  Seed: ISFSSSTSL (MAGC1_HUMAN)
ITFSSSTSI

SEQ ID NO: 75317 - protein, 10 aa, Artificial Sequence
  Description of Artificial Sequence: Synthetic peptide
  Seed: VSSSSSSSTL (MAGC1_HUMAN)
VFSSSSSSTW

SEQ ID NO: 75318 - protein, 11 aa, Artificial Sequence
  Description of Artificial Sequence: Synthetic peptide
  Seed: SSSFSYTLLSL (MAGC1_HUMAN)
SSSFSYTLLSW

SEQ ID NO: 75319 - protein, 9 aa, Artificial Sequence
  Description of Artificial Sequence: Synthetic peptide
  Seed: MTSSFSSTL (MAGC1_HUMAN)
MPSSFSSTL

SEQ ID NO: 75320 - protein, 9 aa, Artificial Sequence
  Description of Artificial Sequence: Synthetic peptide
  Seed: VSSFFSYTL (MAGC1_HUMAN)
VTSFFSYTA

SEQ ID NO: 75321 - protein, 9 aa, Artificial Sequence
  Description of Artificial Sequence: Synthetic peptide
  Seed: SSFFSSALL (MAGC1_HUMAN)
SSFFSSALK

SEQ ID NO: 75322 - protein, 9 aa, Artificial Sequence
  Description of Artificial Sequence: Synthetic peptide
  Seed: LQIVPSLPE (MAGC1_HUMAN)
LRIVPSLPM

SEQ ID NO: 75323 - protein, 10 aa, Artificial Sequence
  Description of Artificial Sequence: Synthetic peptide
  Seed: ASSFFSSALL (MAGC1_HUMAN)
AHSFFSSALM

SEQ ID NO: 75324 - protein, 9 aa, Artificial Sequence
  Description of Artificial Sequence: Synthetic peptide
  Seed: AGREHFAFG (MAGC1_HUMAN)
ASREHFAFI

SEQ ID NO: 75325 - protein, 10 aa, Artificial Sequence
  Description of Artificial Sequence: Synthetic peptide
  Seed: LAMLKNTVPI (MAGC1_HUMAN)
LNMLKNTVPM

SEQ ID NO: 75326 - protein, 10 aa, Artificial Sequence
  Description of Artificial Sequence: Synthetic peptide
  Seed: YQVKQPITKA (MAGC1_HUMAN)
YLVKQPITKV

SEQ ID NO: 75327 - protein, 9 aa, Artificial Sequence
  Description of Artificial Sequence: Synthetic peptide
  Seed: SLLQSSHES (MAGC1_HUMAN)
SMLQSSHEM

SEQ ID NO: 75328 - protein, 11 aa, Artificial Sequence
  Description of Artificial Sequence: Synthetic peptide
  Seed: SFFSSALLSIF (MAGC1_HUMAN)
SYFSSALLSIL

SEQ ID NO: 75329 - protein, 10 aa, Artificial Sequence
  Description of Artificial Sequence: Synthetic peptide
  Seed: VSSSSSSTLL (MAGC1_HUMAN)
VDSSSSSTLY

SEQ ID NO: 75330 - protein, 11 aa, Artificial Sequence
  Description of Artificial Sequence: Synthetic peptide
  Seed: VIWDVLSGIGV (MAGC1_HUMAN)
VLWDVLSGIGV

SEQ ID NO: 75331 - protein, 9 aa, Artificial Sequence
  Description of Artificial Sequence: Synthetic peptide
  Seed: GVRAGREHF (MAGC1_HUMAN)
GARAGREHY

SEQ ID NO: 75332 - protein, 9 aa, Artificial Sequence
  Description of Artificial Sequence: Synthetic peptide
  Seed: ASSSTLVSI (MAGC1_HUMAN)
AVSSTLVSY

SEQ ID NO: 75333 - protein, 9 aa, Artificial Sequence
  Description of Artificial Sequence: Synthetic peptide
  Seed: YQVKQPITK (MAGC1_HUMAN)
YHVKQPITM

SEQ ID NO: 75334 - protein, 9 aa, Artificial Sequence
  Description of Artificial Sequence: Synthetic peptide
  Seed: SSSTLVSIF (MAGC1_HUMAN)
SQSTLVSIF

SEQ ID NO: 75335 - protein, 11 aa, Artificial Sequence
  Description of Artificial Sequence: Synthetic peptide
  Seed: SLSQSSPVSSF (MAGC1_HUMAN)
SGSQSSPVSSY

SEQ ID NO: 75336 - protein, 9 aa, Artificial Sequence
  Description of Artificial Sequence: Synthetic peptide
  Seed: SRYTGYFPV (MAGC1_HUMAN)
SHYTGYFPL

SEQ ID NO: 75337 - protein, 9 aa, Artificial Sequence
  Description of Artificial Sequence: Synthetic peptide
  Seed: SIIFIKGTY (MAGC1_HUMAN)
SSIFIKGTK

SEQ ID NO: 75338 - protein, 11 aa, Artificial Sequence
  Description of Artificial Sequence: Synthetic peptide
  Seed: SSFSYTLLSLF (MAGC1_HUMAN)
SLFSYTLLSLY

SEQ ID NO: 75339 - protein, 9 aa, Artificial Sequence
  Description of Artificial Sequence: Synthetic peptide
  Seed: SLIESEPLF (MAGC1_HUMAN)
SVIESEPLF

SEQ ID NO: 75340 - protein, 10 aa, Artificial Sequence
  Description of Artificial Sequence: Synthetic peptide
  Seed: EILFGISLRE (MAGC1_HUMAN)
ELLFGISLRK

SEQ ID NO: 75341 - protein, 9 aa, Artificial Sequence
  Description of Artificial Sequence: Synthetic peptide
  Seed: LSDEQGMSQ (MAGC1_HUMAN)
LWDEQGMSV

SEQ ID NO: 75342 - protein, 10 aa, Artificial Sequence
  Description of Artificial Sequence: Synthetic peptide
  Seed: RKVVEFLAML (MAGC1_HUMAN)
RWVVEFLAMV

SEQ ID NO: 75343 - protein, 10 aa, Artificial Sequence
  Description of Artificial Sequence: Synthetic peptide
  Seed: TGYFPVIFRK (MAGC1_HUMAN)
TWYFPVIFRR

SEQ ID NO: 75344 - protein, 9 aa, Artificial Sequence
  Description of Artificial Sequence: Synthetic peptide
  Seed: SFSSTLVSL (MAGC1_HUMAN)
SRSSTLVSL

SEQ ID NO: 75345 - protein, 11 aa, Artificial Sequence
  Description of Artificial Sequence: Synthetic peptide
  Seed: LQIPVSSSFSY (MAGC1_HUMAN)
LPIPVSSSFSY

SEQ ID NO: 75346 - protein, 11 aa, Artificial Sequence
  Description of Artificial Sequence: Synthetic peptide
  Seed: SPPEGPAQSPL (MAGC1_HUMAN)
SSPEGPAQSPL

SEQ ID NO: 75347 - protein, 9 aa, Artificial Sequence
  Description of Artificial Sequence: Synthetic peptide
  Seed: DVLSGIGVR (MAGC1_HUMAN)
DSLSGIGVK

SEQ ID NO: 75348 - protein, 9 aa, Artificial Sequence
  Description of Artificial Sequence: Synthetic peptide
  Seed: RTHSTFEGF (MAGC1_HUMAN)
RFHSTFEGW

SEQ ID NO: 75349 - protein, 10 aa, Artificial Sequence
  Description of Artificial Sequence: Synthetic peptide
  Seed: MPTAGMPSLL (MAGC1_HUMAN)
MKTAGMPSLF

SEQ ID NO: 75350 - protein, 9 aa, Artificial Sequence
  Description of Artificial Sequence: Synthetic peptide
  Seed: SQSPPEGPV (MAGC1_HUMAN)
STSPPEGPM

SEQ ID NO: 75351 - protein, 9 aa, Artificial Sequence
  Description of Artificial Sequence: Synthetic peptide
  Seed: LQIPVSSSS (MAGC1_HUMAN)
LKIPVSSSV

SEQ ID NO: 75352 - protein, 10 aa, Artificial Sequence
  Description of Artificial Sequence: Synthetic peptide
  Seed: RKVVEFLAML (MAGC1_HUMAN)
RDVVEFLAMV

SEQ ID NO: 75353 - protein, 10 aa, Artificial Sequence
  Description of Artificial Sequence: Synthetic peptide
  Seed: SSPECTQSTF (MAGC1_HUMAN)
SVPECTQSTY

SEQ ID NO: 75354 - protein, 9 aa, Artificial Sequence
  Description of Artificial Sequence: Synthetic peptide
  Seed: MGDKDMPTA (MAGC1_HUMAN)
MLDKDMPTL

SEQ ID NO: 75355 - protein, 10 aa, Artificial Sequence
  Description of Artificial Sequence: Synthetic peptide
  Seed: FFSYTLASLL (MAGC1_HUMAN)
FDSYTLASLW

SEQ ID NO: 75356 - protein, 9 aa, Artificial Sequence
  Description of Artificial Sequence: Synthetic peptide
  Seed: VIKRKVVEF (MAGC1_HUMAN)
VRKRKVVEL

SEQ ID NO: 75357 - protein, 10 aa, Artificial Sequence
  Description of Artificial Sequence: Synthetic peptide
  Seed: SSPERTQSTF (MAGC1_HUMAN)
SAPERTQSTY

SEQ ID NO: 75358 - protein, 10 aa, Artificial Sequence
  Description of Artificial Sequence: Synthetic peptide
  Seed: SFSSTLVSLF (MAGC1_HUMAN)
SHSSTLVSLF

SEQ ID NO: 75359 - protein, 10 aa, Artificial Sequence
  Description of Artificial Sequence: Synthetic peptide
  Seed: FSSSTSLSPF (MAGC1_HUMAN)
FTSSTSLSPY

SEQ ID NO: 75360 - protein, 10 aa, Artificial Sequence
  Description of Artificial Sequence: Synthetic peptide
  Seed: PLQIPVSSSF (MAGC1_HUMAN)
PKQIPVSSSM

SEQ ID NO: 75361 - protein, 10 aa, Artificial Sequence
  Description of Artificial Sequence: Synthetic peptide
  Seed: VISFSSSTSL (MAGC1_HUMAN)
VISFSSSTSV

SEQ ID NO: 75362 - protein, 10 aa, Artificial Sequence
  Description of Artificial Sequence: Synthetic peptide
  Seed: VSSSSSSTLL (MAGC1_HUMAN)
VHSSSSSTLY

SEQ ID NO: 75363 - protein, 9 aa, Artificial Sequence
  Description of Artificial Sequence: Synthetic peptide
  Seed: RAHSEVIKR (MAGC1_HUMAN)
RMHSEVIKK

SEQ ID NO: 75364 - protein, 9 aa, Artificial Sequence
  Description of Artificial Sequence: Synthetic peptide
  Seed: IESEPLFTY (MAGC1_HUMAN)
ILSEPLFTY

SEQ ID NO: 75365 - protein, 10 aa, Artificial Sequence
  Description of Artificial Sequence: Synthetic peptide
  Seed: RSFSSTLLSI (MAGC1_HUMAN)
RAFSSTLLSF

SEQ ID NO: 75366 - protein, 11 aa, Artificial Sequence
  Description of Artificial Sequence: Synthetic peptide
  Seed: SSFPSSTSSSL (MAGC1_HUMAN)
SRFPSSTSSSY

SEQ ID NO: 75367 - protein, 9 aa, Artificial Sequence
  Description of Artificial Sequence: Synthetic peptide
  Seed: FQSSLQSPV (MAGC1_HUMAN)
FMSSLQSPT

SEQ ID NO: 75368 - protein, 9 aa, Artificial Sequence
  Description of Artificial Sequence: Synthetic peptide
  Seed: FSERTQSTF (MAGC1_HUMAN)
FPERTQSTL

SEQ ID NO: 75369 - protein, 11 aa, Artificial Sequence
  Description of Artificial Sequence: Synthetic peptide
  Seed: SSFPSSTSSSL (MAGC1_HUMAN)
SAFPSSTSSSH

SEQ ID NO: 75370 - protein, 10 aa, Artificial Sequence
  Description of Artificial Sequence: Synthetic peptide
  Seed: SFPSSTSSSL (MAGC1_HUMAN)
SYPSSTSSSV

SEQ ID NO: 75371 - protein, 10 aa, Artificial Sequence
  Description of Artificial Sequence: Synthetic peptide
  Seed: SPLQSPVSSF (MAGC1_HUMAN)
SQLQSPVSSY

SEQ ID NO: 75372 - protein, 9 aa, Artificial Sequence
  Description of Artificial Sequence: Synthetic peptide
  Seed: SSSDTLLES (MAGC1_HUMAN)
SASDTLLEA

SEQ ID NO: 75373 - protein, 11 aa, Artificial Sequence
  Description of Artificial Sequence: Synthetic peptide
  Seed: TLYPLQSPQSR (MAGC1_HUMAN)
TTYPLQSPQSR

SEQ ID NO: 75374 - protein, 9 aa, Artificial Sequence
  Description of Artificial Sequence: Synthetic peptide
  Seed: YTLLSLFQS (MAGC1_HUMAN)
YQLLSLFQF

SEQ ID NO: 75375 - protein, 10 aa, Artificial Sequence
  Description of Artificial Sequence: Synthetic peptide
  Seed: MTSSFSSTLL (MAGC1_HUMAN)
MRSSFSSTLW

SEQ ID NO: 75376 - protein, 9 aa, Artificial Sequence
  Description of Artificial Sequence: Synthetic peptide
  Seed: TLLSLFQSF (MAGC1_HUMAN)
TILSLFQSF

SEQ ID NO: 75377 - protein, 10 aa, Artificial Sequence
  Description of Artificial Sequence: Synthetic peptide
  Seed: LLQIPMTSSF (MAGC1_HUMAN)
LYQIPMTSSW

SEQ ID NO: 75378 - protein, 10 aa, Artificial Sequence
  Description of Artificial Sequence: Synthetic peptide
  Seed: DELARFLLLK (MAGC1_HUMAN)
DVLARFLLLK

SEQ ID NO: 75379 - protein, 9 aa, Artificial Sequence
  Description of Artificial Sequence: Synthetic peptide
  Seed: VSSSFSYTL (MAGC1_HUMAN)
VTSSFSYTM

SEQ ID NO: 75380 - protein, 10 aa, Artificial Sequence
  Description of Artificial Sequence: Synthetic peptide
  Seed: FPQSVLQIPV (MAGC1_HUMAN)
FLQSVLQIPT

SEQ ID NO: 75381 - protein, 9 aa, Artificial Sequence
  Description of Artificial Sequence: Synthetic peptide
  Seed: FSSALLSIF (MAGC1_HUMAN)
FISALLSIY

SEQ ID NO: 75382 - protein, 10 aa, Artificial Sequence
  Description of Artificial Sequence: Synthetic peptide
  Seed: SSFSYTLLSL (MAGC1_HUMAN)
STFSYTLLSM

SEQ ID NO: 75383 - protein, 9 aa, Artificial Sequence
  Description of Artificial Sequence: Synthetic peptide
  Seed: MLTNVISRY (MAGC1_HUMAN)
MGTNVISRY

SEQ ID NO: 75384 - protein, 10 aa, Artificial Sequence
  Description of Artificial Sequence: Synthetic peptide
  Seed: FFSYTLASLL (MAGC1_HUMAN)
FTSYTLASLV

SEQ ID NO: 75385 - protein, 10 aa, Artificial Sequence
  Description of Artificial Sequence: Synthetic peptide
  Seed: MPTAGMPSLL (MAGC1_HUMAN)
MITAGMPSLA

SEQ ID NO: 75386 - protein, 10 aa, Artificial Sequence
  Description of Artificial Sequence: Synthetic peptide
  Seed: SSFSYTLLSL (MAGC1_HUMAN)
SSFSYTLLSW

SEQ ID NO: 75387 - protein, 9 aa, Artificial Sequence
  Description of Artificial Sequence: Synthetic peptide
  Seed: TTDDSTATE (MAGC1_HUMAN)
TMDDSTATV

SEQ ID NO: 75388 - protein, 9 aa, Artificial Sequence
  Description of Artificial Sequence: Synthetic peptide
  Seed: IFRKAREFI (MAGC1_HUMAN)
IARKAREFK

SEQ ID NO: 75389 - protein, 10 aa, Artificial Sequence
  Description of Artificial Sequence: Synthetic peptide
  Seed: LQIVPSLPEW (MAGC1_HUMAN)
LIIVPSLPEY

SEQ ID NO: 75390 - protein, 10 aa, Artificial Sequence
  Description of Artificial Sequence: Synthetic peptide
  Seed: RKVVEFLAML (MAGC1_HUMAN)
RLVVEFLAMI

SEQ ID NO: 75391 - protein, 9 aa, Artificial Sequence
  Description of Artificial Sequence: Synthetic peptide
  Seed: GYFPVIFRK (MAGC1_HUMAN)
GQFPVIFRK

SEQ ID NO: 75392 - protein, 11 aa, Artificial Sequence
  Description of Artificial Sequence: Synthetic peptide
  Seed: SPLQIPMTSSF (MAGC1_HUMAN)
SQLQIPMTSSF

SEQ ID NO: 75393 - protein, 9 aa, Artificial Sequence
  Description of Artificial Sequence: Synthetic peptide
  Seed: YTLASLLQS (MAGC1_HUMAN)
YILASLLQL

SEQ ID NO: 75394 - protein, 9 aa, Artificial Sequence
  Description of Artificial Sequence: Synthetic peptide
  Seed: YTSSSDTLL (MAGC1_HUMAN)
YASSSDTLI

SEQ ID NO: 75395 - protein, 9 aa, Artificial Sequence
  Description of Artificial Sequence: Synthetic peptide
  Seed: SSSVMSPSF (MAGC1_HUMAN)
SASVMSPSY

SEQ ID NO: 75396 - protein, 9 aa, Artificial Sequence
  Description of Artificial Sequence: Synthetic peptide
  Seed: LQIPVSAAS (MAGC1_HUMAN)
LMIPVSAAA

SEQ ID NO: 75397 - protein, 9 aa, Artificial Sequence
  Description of Artificial Sequence: Synthetic peptide
  Seed: VSPSSSSTL (MAGC1_HUMAN)
VVPSSSSTY

SEQ ID NO: 75398 - protein, 9 aa, Artificial Sequence
  Description of Artificial Sequence: Synthetic peptide
  Seed: EDSSDPLQR (MAGC1_HUMAN)
EMSSDPLQR

SEQ ID NO: 75399 - protein, 9 aa, Artificial Sequence
  Description of Artificial Sequence: Synthetic peptide
  Seed: SSSTSLSPF (MAGC1_HUMAN)
SMSTSLSPM

SEQ ID NO: 75400 - protein, 9 aa, Artificial Sequence
  Description of Artificial Sequence: Synthetic peptide
  Seed: KVDELARFL (MAGC1_HUMAN)
KADELARFF

SEQ ID NO: 75401 - protein, 9 aa, Artificial Sequence
  Description of Artificial Sequence: Synthetic peptide
  Seed: GFPQSVLQI (MAGC1_HUMAN)
GTPQSVLQL

SEQ ID NO: 75402 - protein, 9 aa, Artificial Sequence
  Description of Artificial Sequence: Synthetic peptide
  Seed: EVPNSSPPR (MAGC1_HUMAN)
ETPNSSPPK

SEQ ID NO: 75403 - protein, 9 aa, Artificial Sequence
  Description of Artificial Sequence: Synthetic peptide
  Seed: EFIEILFGI (MAGC1_HUMAN)
ESIEILFGV

SEQ ID NO: 75404 - protein, 9 aa, Artificial Sequence
  Description of Artificial Sequence: Synthetic peptide
  Seed: QIVPSLPEW (MAGC1_HUMAN)
QMVPSLPEF

SEQ ID NO: 75405 - protein, 10 aa, Artificial Sequence
  Description of Artificial Sequence: Synthetic peptide
  Seed: YTLASLLQSS (MAGC1_HUMAN)
YSLASLLQSI

SEQ ID NO: 75406 - protein, 9 aa, Artificial Sequence
  Description of Artificial Sequence: Synthetic peptide
  Seed: VQSPLHSPQ (MAGC1_HUMAN)
VMSPLHSPF

SEQ ID NO: 75407 - protein, 9 aa, Artificial Sequence
  Description of Artificial Sequence: Synthetic peptide
  Seed: SSPEGKDSL (MAGC1_HUMAN)
SRPEGKDSF

SEQ ID NO: 75408 - protein, 9 aa, Artificial Sequence
  Description of Artificial Sequence: Synthetic peptide
  Seed: LQIPVSRSF (MAGC1_HUMAN)
LPIPVSRSY

SEQ ID NO: 75409 - protein, 9 aa, Artificial Sequence
  Description of Artificial Sequence: Synthetic peptide
  Seed: KQPITKAEM (MAGC1_HUMAN)
KSPITKAEM

SEQ ID NO: 75410 - protein, 9 aa, Artificial Sequence
  Description of Artificial Sequence: Synthetic peptide
  Seed: KVDELARFL (MAGC1_HUMAN)
KVDELARFM

SEQ ID NO: 75411 - protein, 9 aa, Artificial Sequence
  Description of Artificial Sequence: Synthetic peptide
  Seed: TTDDSTATE (MAGC1_HUMAN)
TTDDSTATA

SEQ ID NO: 75412 - protein, 10 aa, Artificial Sequence
  Description of Artificial Sequence: Synthetic peptide
  Seed: FPQSLLQIPM (MAGC1_HUMAN)
FPQSLLQIPW

SEQ ID NO: 75413 - protein, 9 aa, Artificial Sequence
  Description of Artificial Sequence: Synthetic peptide
  Seed: SVLQIPVSA (MAGC1_HUMAN)
SVLQIPVSL

SEQ ID NO: 75414 - protein, 11 aa, Artificial Sequence
  Description of Artificial Sequence: Synthetic peptide
  Seed: IPVSRSFSSTL (MAGC1_HUMAN)
IFVSRSFSSTY

SEQ ID NO: 75415 - protein, 10 aa, Artificial Sequence
  Description of Artificial Sequence: Synthetic peptide
  Seed: ASSFFSSALL (MAGC1_HUMAN)
APSFFSSALW

SEQ ID NO: 75416 - protein, 9 aa, Artificial Sequence
  Description of Artificial Sequence: Synthetic peptide
  Seed: TLVSIFQSS (MAGC1_HUMAN)
TQVSIFQSL

SEQ ID NO: 75417 - protein, 9 aa, Artificial Sequence
  Description of Artificial Sequence: Synthetic peptide
  Seed: FSSALLSIF (MAGC1_HUMAN)
FPSALLSII

SEQ ID NO: 75418 - protein, 9 aa, Artificial Sequence
  Description of Artificial Sequence: Synthetic peptide
  Seed: VIKRKVVEF (MAGC1_HUMAN)
VVKRKVVEF

SEQ ID NO: 75419 - protein, 11 aa, Artificial Sequence
  Description of Artificial Sequence: Synthetic peptide
  Seed: IPVSSSFSYTL (MAGC1_HUMAN)
IRVSSSFSYTY

SEQ ID NO: 75420 - protein, 9 aa, Artificial Sequence
  Description of Artificial Sequence: Synthetic peptide
  Seed: KDSQSPLQI (MAGC1_HUMAN)
KMSQSPLQM

SEQ ID NO: 75421 - protein, 9 aa, Artificial Sequence
  Description of Artificial Sequence: Synthetic peptide
  Seed: SSSTLLSLF (MAGC1_HUMAN)
SASTLLSLM

SEQ ID NO: 75422 - protein, 9 aa, Artificial Sequence
  Description of Artificial Sequence: Synthetic peptide
  Seed: RKVVEFLAM (MAGC1_HUMAN)
RMVVEFLAI

SEQ ID NO: 75423 - protein, 10 aa, Artificial Sequence
  Description of Artificial Sequence: Synthetic peptide
  Seed: MLKNTVPITF (MAGC1_HUMAN)
MSKNTVPITF

SEQ ID NO: 75424 - protein, 9 aa, Artificial Sequence
  Description of Artificial Sequence: Synthetic peptide
  Seed: DELARFLLL (MAGC1_HUMAN)
DRLARFLLI

SEQ ID NO: 75425 - protein, 9 aa, Artificial Sequence
  Description of Artificial Sequence: Synthetic peptide
  Seed: SSFFSSALL (MAGC1_HUMAN)
SRFFSSALY

SEQ ID NO: 75426 - protein, 10 aa, Artificial Sequence
  Description of Artificial Sequence: Synthetic peptide
  Seed: SSFSYTLLSL (MAGC1_HUMAN)
SYFSYTLLSM

SEQ ID NO: 75427 - protein, 9 aa, Artificial Sequence
  Description of Artificial Sequence: Synthetic peptide
  Seed: EHFAFGEPR (MAGC1_HUMAN)
EAFAFGEPY

SEQ ID NO: 75428 - protein, 10 aa, Artificial Sequence
  Description of Artificial Sequence: Synthetic peptide
  Seed: VSSSSSSSTL (MAGC1_HUMAN)
VCSSSSSSTW

SEQ ID NO: 75429 - protein, 9 aa, Artificial Sequence
  Description of Artificial Sequence: Synthetic peptide
  Seed: EFIEILFGI (MAGC1_HUMAN)
ELIEILFGT

SEQ ID NO: 75430 - protein, 9 aa, Artificial Sequence
  Description of Artificial Sequence: Synthetic peptide
  Seed: VIKRKVVEF (MAGC1_HUMAN)
VQKRKVVEL

SEQ ID NO: 75431 - protein, 9 aa, Artificial Sequence
  Description of Artificial Sequence: Synthetic peptide
  Seed: QIVPSLPEW (MAGC1_HUMAN)
QMVPSLPEM

SEQ ID NO: 75432 - protein, 9 aa, Artificial Sequence
  Description of Artificial Sequence: Synthetic peptide
  Seed: SSPESAQSA (MAGC1_HUMAN)
SAPESAQSM

SEQ ID NO: 75433 - protein, 9 aa, Artificial Sequence
  Description of Artificial Sequence: Synthetic peptide
  Seed: FFSYTLASL (MAGC1_HUMAN)
FQSYTLASA

SEQ ID NO: 75434 - protein, 10 aa, Artificial Sequence
  Description of Artificial Sequence: Synthetic peptide
  Seed: FLAMLKNTVP (MAGC1_HUMAN)
FLAMLKNTVV

SEQ ID NO: 75435 - protein, 9 aa, Artificial Sequence
  Description of Artificial Sequence: Synthetic peptide
  Seed: TTDDSTATE (MAGC1_HUMAN)
TGDDSTATM

SEQ ID NO: 75436 - protein, 9 aa, Artificial Sequence
  Description of Artificial Sequence: Synthetic peptide
  Seed: MPTAGMPSL (MAGC1_HUMAN)
MQTAGMPSF

SEQ ID NO: 75437 - protein, 10 aa, Artificial Sequence
  Description of Artificial Sequence: Synthetic peptide
  Seed: RSFSSTLLSI (MAGC1_HUMAN)
RHFSSTLLSY

SEQ ID NO: 75438 - protein, 10 aa, Artificial Sequence
  Description of Artificial Sequence: Synthetic peptide
  Seed: ILFGISLREV (MAGC1_HUMAN)
ILFGISLREA

SEQ ID NO: 75439 - protein, 10 aa, Artificial Sequence
  Description of Artificial Sequence: Synthetic peptide
  Seed: STSLSLPQSF (MAGC1_HUMAN)
STSLSLPQSY

SEQ ID NO: 75440 - protein, 9 aa, Artificial Sequence
  Description of Artificial Sequence: Synthetic peptide
  Seed: LSDEQGMSQ (MAGC1_HUMAN)
LTDEQGMSL

SEQ ID NO: 75441 - protein, 9 aa, Artificial Sequence
  Description of Artificial Sequence: Synthetic peptide
  Seed: FSSALLSIF (MAGC1_HUMAN)
FNSALLSIY

SEQ ID NO: 75442 - protein, 9 aa, Artificial Sequence
  Description of Artificial Sequence: Synthetic peptide
  Seed: YTLLSLFQS (MAGC1_HUMAN)
YILLSLFQT

SEQ ID NO: 75443 - protein, 9 aa, Artificial Sequence
  Description of Artificial Sequence: Synthetic peptide
  Seed: ESSSPVDEY (MAGC1_HUMAN)
EMSSPVDER

SEQ ID NO: 75444 - protein, 11 aa, Artificial Sequence
  Description of Artificial Sequence: Synthetic peptide
  Seed: SSTSLSLPQSF (MAGC1_HUMAN)
SITSLSLPQSW

SEQ ID NO: 75445 - protein, 10 aa, Artificial Sequence
  Description of Artificial Sequence: Synthetic peptide
  Seed: FFSSALLSIF (MAGC1_HUMAN)
FRSSALLSIY

SEQ ID NO: 75446 - protein, 9 aa, Artificial Sequence
  Description of Artificial Sequence: Synthetic peptide
  Seed: FFSSALLSI (MAGC1_HUMAN)
FYSSALLSA

SEQ ID NO: 75447 - protein, 10 aa, Artificial Sequence
  Description of Artificial Sequence: Synthetic peptide
  Seed: SLQIPVSPSF (MAGC1_HUMAN)
SLQIPVSPSY

SEQ ID NO: 75448 - protein, 9 aa, Artificial Sequence
  Description of Artificial Sequence: Synthetic peptide
  Seed: SSPEGKDSL (MAGC1_HUMAN)
SAPEGKDSF

SEQ ID NO: 75449 - protein, 10 aa, Artificial Sequence
  Description of Artificial Sequence: Synthetic peptide
  Seed: SPSFSSTLVS (MAGC1_HUMAN)
SPSFSSTLVA

SEQ ID NO: 75450 - protein, 9 aa, Artificial Sequence
  Description of Artificial Sequence: Synthetic peptide
  Seed: TLDEKVDEL (MAGC1_HUMAN)
TWDEKVDEL

SEQ ID NO: 75451 - protein, 9 aa, Artificial Sequence
  Description of Artificial Sequence: Synthetic peptide
  Seed: SPLQIVPSL (MAGC1_HUMAN)
SQLQIVPSF

SEQ ID NO: 75452 - protein, 9 aa, Artificial Sequence
  Description of Artificial Sequence: Synthetic peptide
  Seed: HFPQSPPEW (MAGC1_HUMAN)
HSPQSPPEM

SEQ ID NO: 75453 - protein, 10 aa, Artificial Sequence
  Description of Artificial Sequence: Synthetic peptide
  Seed: SSPERTHSTF (MAGC1_HUMAN)
SRPERTHSTL

SEQ ID NO: 75454 - protein, 9 aa, Artificial Sequence
  Description of Artificial Sequence: Synthetic peptide
  Seed: EMLTNVISR (MAGC1_HUMAN)
ETLTNVISK

SEQ ID NO: 75455 - protein, 10 aa, Artificial Sequence
  Description of Artificial Sequence: Synthetic peptide
  Seed: KAREFIEILF (MAGC1_HUMAN)
KSREFIEILF

SEQ ID NO: 75456 - protein, 8 aa, Artificial Sequence
  Description of Artificial Sequence: Synthetic peptide
  Seed: FSSTLVSL (MAGC1_HUMAN)
FASTLVSM

SEQ ID NO: 75457 - protein, 9 aa, Artificial Sequence
  Description of Artificial Sequence: Synthetic peptide
  Seed: REVPNSSPP (MAGC1_HUMAN)
REVPNSSPF

SEQ ID NO: 75458 - protein, 10 aa, Artificial Sequence
  Description of Artificial Sequence: Synthetic peptide
  Seed: SILQSSPESA (MAGC1_HUMAN)
SMLQSSPESI

SEQ ID NO: 75459 - protein, 9 aa, Artificial Sequence
  Description of Artificial Sequence: Synthetic peptide
  Seed: TLLSLFQSF (MAGC1_HUMAN)
TVLSLFQSI

SEQ ID NO: 75460 - protein, 11 aa, Artificial Sequence
  Description of Artificial Sequence: Synthetic peptide
  Seed: SPLQIPMTSSF (MAGC1_HUMAN)
SSLQIPMTSSM

SEQ ID NO: 75461 - protein, 9 aa, Artificial Sequence
  Description of Artificial Sequence: Synthetic peptide
  Seed: SSFFSSALL (MAGC1_HUMAN)
SIFFSSALM

SEQ ID NO: 75462 - protein, 9 aa, Artificial Sequence
  Description of Artificial Sequence: Synthetic peptide
  Seed: RFLLLKYQV (MAGC1_HUMAN)
RMLLLKYQF

SEQ ID NO: 75463 - protein, 9 aa, Artificial Sequence
  Description of Artificial Sequence: Synthetic peptide
  Seed: LQIPGSPSF (MAGC1_HUMAN)
LKIPGSPSV

SEQ ID NO: 75464 - protein, 9 aa, Artificial Sequence
  Description of Artificial Sequence: Synthetic peptide
  Seed: IPVSPSFSS (MAGC1_HUMAN)
IIVSPSFSY

SEQ ID NO: 75465 - protein, 11 aa, Artificial Sequence
  Description of Artificial Sequence: Synthetic peptide
  Seed: SLIESEPLFTY (MAGC1_HUMAN)
SVIESEPLFTY

SEQ ID NO: 75466 - protein, 9 aa, Artificial Sequence
  Description of Artificial Sequence: Synthetic peptide
  Seed: FFSSALLSI (MAGC1_HUMAN)
FLSSALLSV

SEQ ID NO: 75467 - protein, 9 aa, Artificial Sequence
  Description of Artificial Sequence: Synthetic peptide
  Seed: FSSTLLSLF (MAGC1_HUMAN)
FYSTLLSLL

SEQ ID NO: 75468 - protein, 10 aa, Artificial Sequence
  Description of Artificial Sequence: Synthetic peptide
  Seed: SRYTGYFPVI (MAGC1_HUMAN)
SMYTGYFPVF

SEQ ID NO: 75469 - protein, 9 aa, Artificial Sequence
  Description of Artificial Sequence: Synthetic peptide
  Seed: SLIESEPLF (MAGC1_HUMAN)
SGIESEPLW

SEQ ID NO: 75470 - protein, 9 aa, Artificial Sequence
  Description of Artificial Sequence: Synthetic peptide
  Seed: EFIEILFGI (MAGC1_HUMAN)
ELIEILFGM

SEQ ID NO: 75471 - protein, 10 aa, Artificial Sequence
  Description of Artificial Sequence: Synthetic peptide
  Seed: SSPESAQSAF (MAGC1_HUMAN)
SDPESAQSAM

SEQ ID NO: 75472 - protein, 9 aa, Artificial Sequence
  Description of Artificial Sequence: Synthetic peptide
  Seed: FAFGEPREL (MAGC1_HUMAN)
FEFGEPREI

SEQ ID NO: 75473 - protein, 10 aa, Artificial Sequence
  Description of Artificial Sequence: Synthetic peptide
  Seed: MTSSFSSTLL (MAGC1_HUMAN)
MLSSFSSTLV

SEQ ID NO: 75474 - protein, 10 aa, Artificial Sequence
  Description of Artificial Sequence: Synthetic peptide
  Seed: SSFSSTLLSI (MAGC1_HUMAN)
SAFSSTLLSM

SEQ ID NO: 75475 - protein, 9 aa, Artificial Sequence
  Description of Artificial Sequence: Synthetic peptide
  Seed: FSSTLVSLF (MAGC1_HUMAN)
FMSTLVSLM

SEQ ID NO: 75476 - protein, 8 aa, Artificial Sequence
  Description of Artificial Sequence: Synthetic peptide
  Seed: FSYTLLSL (MAGC1_HUMAN)
FSYTLLSY

SEQ ID NO: 75477 - protein, 11 aa, Artificial Sequence
  Description of Artificial Sequence: Synthetic peptide
  Seed: STFEGFPQSLL (MAGC1_HUMAN)
SLFEGFPQSLF

SEQ ID NO: 75478 - protein, 9 aa, Artificial Sequence
  Description of Artificial Sequence: Synthetic peptide
  Seed: MGDKDMPTA (MAGC1_HUMAN)
MADKDMPTI

SEQ ID NO: 75479 - protein, 10 aa, Artificial Sequence
  Description of Artificial Sequence: Synthetic peptide
  Seed: SSPERTQSTF (MAGC1_HUMAN)
SAPERTQSTI

SEQ ID NO: 75480 - protein, 9 aa, Artificial Sequence
  Description of Artificial Sequence: Synthetic peptide
  Seed: FSERTQSTF (MAGC1_HUMAN)
FMERTQSTF

SEQ ID NO: 75481 - protein, 9 aa, Artificial Sequence
  Description of Artificial Sequence: Synthetic peptide
  Seed: RPVSSFFSY (MAGC1_HUMAN)
RQVSSFFSA

SEQ ID NO: 75482 - protein, 9 aa, Artificial Sequence
  Description of Artificial Sequence: Synthetic peptide
  Seed: SLIESEPLF (MAGC1_HUMAN)
SYIESEPLI

SEQ ID NO: 75483 - protein, 9 aa, Artificial Sequence
  Description of Artificial Sequence: Synthetic peptide
  Seed: VSPSSSSTL (MAGC1_HUMAN)
VSPSSSSTM

SEQ ID NO: 75484 - protein, 10 aa, Artificial Sequence
  Description of Artificial Sequence: Synthetic peptide
  Seed: QGEDSMSPLY (MAGC1_HUMAN)
QIEDSMSPLW

SEQ ID NO: 75485 - protein, 9 aa, Artificial Sequence
  Description of Artificial Sequence: Synthetic peptide
  Seed: AQSPLQIPV (MAGC1_HUMAN)
AASPLQIPF

SEQ ID NO: 75486 - protein, 9 aa, Artificial Sequence
  Description of Artificial Sequence: Synthetic peptide
  Seed: VVEFLAMLK (MAGC1_HUMAN)
VVEFLAMLY

SEQ ID NO: 75487 - protein, 9 aa, Artificial Sequence
  Description of Artificial Sequence: Synthetic peptide
  Seed: KVWVQEHYL (MAGC1_HUMAN)
KSWVQEHYV

SEQ ID NO: 75488 - protein, 10 aa, Artificial Sequence
  Description of Artificial Sequence: Synthetic peptide
  Seed: PLQIPGSPSF (MAGC1_HUMAN)
PMQIPGSPSM

SEQ ID NO: 75489 - protein, 10 aa, Artificial Sequence
  Description of Artificial Sequence: Synthetic peptide
  Seed: REFIEILFGI (MAGC1_HUMAN)
RWFIEILFGF

SEQ ID NO: 75490 - protein, 9 aa, Artificial Sequence
  Description of Artificial Sequence: Synthetic peptide
  Seed: MPTAGMPSL (MAGC1_HUMAN)
MVTAGMPSF

SEQ ID NO: 75491 - protein, 10 aa, Artificial Sequence
  Description of Artificial Sequence: Synthetic peptide
  Seed: STLLSLFQSF (MAGC1_HUMAN)
SRLLSLFQSF

SEQ ID NO: 75492 - protein, 10 aa, Artificial Sequence
  Description of Artificial Sequence: Synthetic peptide
  Seed: LLQIPMTSSF (MAGC1_HUMAN)
LPQIPMTSSM

SEQ ID NO: 75493 - protein, 9 aa, Artificial Sequence
  Description of Artificial Sequence: Synthetic peptide
  Seed: FFSYTLASL (MAGC1_HUMAN)
FWSYTLASL

SEQ ID NO: 75494 - protein, 9 aa, Artificial Sequence
  Description of Artificial Sequence: Synthetic peptide
  Seed: SSFFSSALL (MAGC1_HUMAN)
SMFFSSALK

SEQ ID NO: 75495 - protein, 11 aa, Artificial Sequence
  Description of Artificial Sequence: Synthetic peptide
  Seed: RPVSSFFSYTL (MAGC1_HUMAN)
RSVSSFFSYTY

SEQ ID NO: 75496 - protein, 9 aa, Artificial Sequence
  Description of Artificial Sequence: Synthetic peptide
  Seed: EVPNSSPPR (MAGC1_HUMAN)
EIPNSSPPK

SEQ ID NO: 75497 - protein, 11 aa, Artificial Sequence
  Description of Artificial Sequence: Synthetic peptide
  Seed: SFFSYTLASLL (MAGC1_HUMAN)
SWFSYTLASLW

SEQ ID NO: 75498 - protein, 9 aa, Artificial Sequence
  Description of Artificial Sequence: Synthetic peptide
  Seed: SSPPRYEFL (MAGC1_HUMAN)
SMPPRYEFY

SEQ ID NO: 75499 - protein, 10 aa, Artificial Sequence
  Description of Artificial Sequence: Synthetic peptide
  Seed: FLAMLKNTVP (MAGC1_HUMAN)
FLAMLKNTVT

SEQ ID NO: 75500 - protein, 9 aa, Artificial Sequence
  Description of Artificial Sequence: Synthetic peptide
  Seed: YTLLSLFQS (MAGC1_HUMAN)
YVLLSLFQA

SEQ ID NO: 75501 - protein, 9 aa, Artificial Sequence
  Description of Artificial Sequence: Synthetic peptide
  Seed: TFEGFPQSL (MAGC1_HUMAN)
TMEGFPQSF

SEQ ID NO: 75502 - protein, 10 aa, Artificial Sequence
  Description of Artificial Sequence: Synthetic peptide
  Seed: LQIPVSSSFS (MAGC1_HUMAN)
LKIPVSSSFY

SEQ ID NO: 75503 - protein, 11 aa, Artificial Sequence
  Description of Artificial Sequence: Synthetic peptide
  Seed: SPLQIPVSPSS (MAGC1_HUMAN)
SFLQIPVSPSF

SEQ ID NO: 75504 - protein, 10 aa, Artificial Sequence
  Description of Artificial Sequence: Synthetic peptide
  Seed: TTDDSTATES (MAGC1_HUMAN)
TSDDSTATEM

SEQ ID NO: 75505 - protein, 10 aa, Artificial Sequence
  Description of Artificial Sequence: Synthetic peptide
  Seed: FPQSLLQIPM (MAGC1_HUMAN)
FRQSLLQIPF

SEQ ID NO: 75506 - protein, 9 aa, Artificial Sequence
  Description of Artificial Sequence: Synthetic peptide
  Seed: IEILFGISL (MAGC1_HUMAN)
IMILFGISM

SEQ ID NO: 75507 - protein, 9 aa, Artificial Sequence
  Description of Artificial Sequence: Synthetic peptide
  Seed: SSHESPQSP (MAGC1_HUMAN)
SIHESPQSL

SEQ ID NO: 75508 - protein, 9 aa, Artificial Sequence
  Description of Artificial Sequence: Synthetic peptide
  Seed: SRYTGYFPV (MAGC1_HUMAN)
SMYTGYFPV

SEQ ID NO: 75509 - protein, 9 aa, Artificial Sequence
  Description of Artificial Sequence: Synthetic peptide
  Seed: LILSIIFIK (MAGC1_HUMAN)
LALSIIFIK

SEQ ID NO: 75510 - protein, 11 aa, Artificial Sequence
  Description of Artificial Sequence: Synthetic peptide
  Seed: REVDPDDSYVF (MAGC1_HUMAN)
RLVDPDDSYVL

SEQ ID NO: 75511 - protein, 11 aa, Artificial Sequence
  Description of Artificial Sequence: Synthetic peptide
  Seed: SPLQIPVSPSS (MAGC1_HUMAN)
SPLQIPVSPSF

SEQ ID NO: 75512 - protein, 9 aa, Artificial Sequence
  Description of Artificial Sequence: Synthetic peptide
  Seed: RTQSTFEGF (MAGC1_HUMAN)
RWQSTFEGL

SEQ ID NO: 75513 - protein, 9 aa, Artificial Sequence
  Description of Artificial Sequence: Synthetic peptide
  Seed: FAFGEPREL (MAGC1_HUMAN)
FLFGEPREF

SEQ ID NO: 75514 - protein, 9 aa, Artificial Sequence
  Description of Artificial Sequence: Synthetic peptide
  Seed: IPVSSSFSY (MAGC1_HUMAN)
IYVSSSFSY

SEQ ID NO: 75515 - protein, 10 aa, Artificial Sequence
  Description of Artificial Sequence: Synthetic peptide
  Seed: FSSSTSLSPF (MAGC1_HUMAN)
FASSTSLSPY

SEQ ID NO: 75516 - protein, 9 aa, Artificial Sequence
  Description of Artificial Sequence: Synthetic peptide
  Seed: SLSPFSEES (MAGC1_HUMAN)
SVSPFSEEV

SEQ ID NO: 75517 - protein, 9 aa, Artificial Sequence
  Description of Artificial Sequence: Synthetic peptide
  Seed: EGDDTQSPL (MAGC1_HUMAN)
EFDDTQSPL

SEQ ID NO: 75518 - protein, 9 aa, Artificial Sequence
  Description of Artificial Sequence: Synthetic peptide
  Seed: TTDDSTATE (MAGC1_HUMAN)
TLDDSTATI

SEQ ID NO: 75519 - protein, 9 aa, Artificial Sequence
  Description of Artificial Sequence: Synthetic peptide
  Seed: TLLESDSLT (MAGC1_HUMAN)
TVLESDSLV

SEQ ID NO: 75520 - protein, 9 aa, Artificial Sequence
  Description of Artificial Sequence: Synthetic peptide
  Seed: FSYTLASLL (MAGC1_HUMAN)
FMYTLASLM

SEQ ID NO: 75521 - protein, 10 aa, Artificial Sequence
  Description of Artificial Sequence: Synthetic peptide
  Seed: SSFSSTLLSI (MAGC1_HUMAN)
SLFSSTLLSW

SEQ ID NO: 75522 - protein, 9 aa, Artificial Sequence
  Description of Artificial Sequence: Synthetic peptide
  Seed: IFQSSPESA (MAGC1_HUMAN)
IYQSSPESF

SEQ ID NO: 75523 - protein, 10 aa, Artificial Sequence
  Description of Artificial Sequence: Synthetic peptide
  Seed: SSPESAQSAF (MAGC1_HUMAN)
SVPESAQSAY

SEQ ID NO: 75524 - protein, 10 aa, Artificial Sequence
  Description of Artificial Sequence: Synthetic peptide
  Seed: ASSFFSSALL (MAGC1_HUMAN)
ADSFFSSALY

SEQ ID NO: 75525 - protein, 10 aa, Artificial Sequence
  Description of Artificial Sequence: Synthetic peptide
  Seed: MTSSFSSTLL (MAGC1_HUMAN)
MMSSFSSTLS

SEQ ID NO: 75526 - protein, 10 aa, Artificial Sequence
  Description of Artificial Sequence: Synthetic peptide
  Seed: LLQIPMTSSF (MAGC1_HUMAN)
LDQIPMTSSM

SEQ ID NO: 75527 - protein, 11 aa, Artificial Sequence
  Description of Artificial Sequence: Synthetic peptide
  Seed: AMLKNTVPITF (MAGC1_HUMAN)
ASLKNTVPITF

SEQ ID NO: 75528 - protein, 10 aa, Artificial Sequence
  Description of Artificial Sequence: Synthetic peptide
  Seed: SLFQSSPECT (MAGC1_HUMAN)
SLFQSSPECA

SEQ ID NO: 75529 - protein, 10 aa, Artificial Sequence
  Description of Artificial Sequence: Synthetic peptide
  Seed: NRLLILILSI (MAGC1_HUMAN)
NRLLILILSM

SEQ ID NO: 75530 - protein, 10 aa, Artificial Sequence
  Description of Artificial Sequence: Synthetic peptide
  Seed: SPLQSPVSSF (MAGC1_HUMAN)
SMLQSPVSSY

SEQ ID NO: 75531 - protein, 10 aa, Artificial Sequence
  Description of Artificial Sequence: Synthetic peptide
  Seed: EVPNSSPPRY (MAGC1_HUMAN)
ETPNSSPPRR

SEQ ID NO: 75532 - protein, 10 aa, Artificial Sequence
  Description of Artificial Sequence: Synthetic peptide
  Seed: SSPERTQSTF (MAGC1_HUMAN)
SLPERTQSTL

SEQ ID NO: 75533 - protein, 11 aa, Artificial Sequence
  Description of Artificial Sequence: Synthetic peptide
  Seed: SPLQIPVSRSF (MAGC1_HUMAN)
SDLQIPVSRSY

SEQ ID NO: 75534 - protein, 11 aa, Artificial Sequence
  Description of Artificial Sequence: Synthetic peptide
  Seed: SPFEGFPQSVL (MAGC1_HUMAN)
SPFEGFPQSVW

SEQ ID NO: 75535 - protein, 11 aa, Artificial Sequence
  Description of Artificial Sequence: Synthetic peptide
  Seed: RYTGYFPVIFR (MAGC1_HUMAN)
RTTGYFPVIFK

SEQ ID NO: 75536 - protein, 9 aa, Artificial Sequence
  Description of Artificial Sequence: Synthetic peptide
  Seed: SSFFSSALL (MAGC1_HUMAN)
SAFFSSALA

SEQ ID NO: 75537 - protein, 9 aa, Artificial Sequence
  Description of Artificial Sequence: Synthetic peptide
  Seed: RKVVEFLAM (MAGC1_HUMAN)
RQVVEFLAA

SEQ ID NO: 75538 - protein, 9 aa, Artificial Sequence
  Description of Artificial Sequence: Synthetic peptide
  Seed: FSSTLVSLF (MAGC1_HUMAN)
FCSTLVSLY

SEQ ID NO: 75539 - protein, 9 aa, Artificial Sequence
  Description of Artificial Sequence: Synthetic peptide
  Seed: FAFGEPREL (MAGC1_HUMAN)
FTFGEPREH

SEQ ID NO: 75540 - protein, 9 aa, Artificial Sequence
  Description of Artificial Sequence: Synthetic peptide
  Seed: SQSSPVSSF (MAGC1_HUMAN)
SHSSPVSSY

SEQ ID NO: 75541 - protein, 9 aa, Artificial Sequence
  Description of Artificial Sequence: Synthetic peptide
  Seed: SSSESPQSC (MAGC1_HUMAN)
SASESPQSM

SEQ ID NO: 75542 - protein, 9 aa, Artificial Sequence
  Description of Artificial Sequence: Synthetic peptide
  Seed: NVISRYTGY (MAGC1_HUMAN)
NAISRYTGF

SEQ ID NO: 75543 - protein, 10 aa, Artificial Sequence
  Description of Artificial Sequence: Synthetic peptide
  Seed: SSSSSTLLSL (MAGC1_HUMAN)
SHSSSTLLSW

SEQ ID NO: 75544 - protein, 11 aa, Artificial Sequence
  Description of Artificial Sequence: Synthetic peptide
  Seed: SPLQIPVSPSS (MAGC1_HUMAN)
SALQIPVSPSY

SEQ ID NO: 75545 - protein, 11 aa, Artificial Sequence
  Description of Artificial Sequence: Synthetic peptide
  Seed: TESASSSVMSP (MAGC1_HUMAN)
TESASSSVMSC

SEQ ID NO: 75546 - protein, 10 aa, Artificial Sequence
  Description of Artificial Sequence: Synthetic peptide
  Seed: EVIWDVLSGI (MAGC1_HUMAN)
ESIWDVLSGI

SEQ ID NO: 75547 - protein, 9 aa, Artificial Sequence
  Description of Artificial Sequence: Synthetic peptide
  Seed: YVFVNTLDL (MAGC1_HUMAN)
YYFVNTLDA

SEQ ID NO: 75548 - protein, 10 aa, Artificial Sequence
  Description of Artificial Sequence: Synthetic peptide
  Seed: LLQIPMTSSF (MAGC1_HUMAN)
LIQIPMTSSM

SEQ ID NO: 75549 - protein, 8 aa, Artificial Sequence
  Description of Artificial Sequence: Synthetic peptide
  Seed: MSQNRLLI (MAGC1_HUMAN)
MAQNRLLM

SEQ ID NO: 75550 - protein, 9 aa, Artificial Sequence
  Description of Artificial Sequence: Synthetic peptide
  Seed: VSSSFSYTL (MAGC1_HUMAN)
VTSSFSYTF

SEQ ID NO: 75551 - protein, 10 aa, Artificial Sequence
  Description of Artificial Sequence: Synthetic peptide
  Seed: REFIEILFGI (MAGC1_HUMAN)
RRFIEILFGM

SEQ ID NO: 75552 - protein, 9 aa, Artificial Sequence
  Description of Artificial Sequence: Synthetic peptide
  Seed: FAFGEPREL (MAGC1_HUMAN)
FDFGEPREL

SEQ ID NO: 75553 - protein, 10 aa, Artificial Sequence
  Description of Artificial Sequence: Synthetic peptide
  Seed: SPLQRPVSSF (MAGC1_HUMAN)
SLLQRPVSSF

SEQ ID NO: 75554 - protein, 9 aa, Artificial Sequence
  Description of Artificial Sequence: Synthetic peptide
  Seed: TSLSLPQSF (MAGC1_HUMAN)
TTLSLPQSV

SEQ ID NO: 75555 - protein, 9 aa, Artificial Sequence
  Description of Artificial Sequence: Synthetic peptide
  Seed: SFFSYTLAS (MAGC1_HUMAN)
SLFSYTLAL

SEQ ID NO: 75556 - protein, 11 aa, Artificial Sequence
  Description of Artificial Sequence: Synthetic peptide
  Seed: SPLQRPVSSFF (MAGC1_HUMAN)
SLLQRPVSSFF

SEQ ID NO: 75557 - protein, 9 aa, Artificial Sequence
  Description of Artificial Sequence: Synthetic peptide
  Seed: FSSTLLSLF (MAGC1_HUMAN)
FISTLLSLW

SEQ ID NO: 75558 - protein, 8 aa, Artificial Sequence
  Description of Artificial Sequence: Synthetic peptide
  Seed: SLSLPQSF (MAGC1_HUMAN)
SSSLPQSL

SEQ ID NO: 75559 - protein, 11 aa, Artificial Sequence
  Description of Artificial Sequence: Synthetic peptide
  Seed: SSFPSSTSSSL (MAGC1_HUMAN)
STFPSSTSSSH

SEQ ID NO: 75560 - protein, 9 aa, Artificial Sequence
  Description of Artificial Sequence: Synthetic peptide
  Seed: AQSPLQIPV (MAGC1_HUMAN)
AESPLQIPA

SEQ ID NO: 75561 - protein, 10 aa, Artificial Sequence
  Description of Artificial Sequence: Synthetic peptide
  Seed: ATESASSSVM (MAGC1_HUMAN)
AHESASSSVW

SEQ ID NO: 75562 - protein, 10 aa, Artificial Sequence
  Description of Artificial Sequence: Synthetic peptide
  Seed: STSLSLPQSF (MAGC1_HUMAN)
SESLSLPQSW

SEQ ID NO: 75563 - protein, 9 aa, Artificial Sequence
  Description of Artificial Sequence: Synthetic peptide
  Seed: VSPSFSSTL (MAGC1_HUMAN)
VFPSFSSTW

SEQ ID NO: 75564 - protein, 9 aa, Artificial Sequence
  Description of Artificial Sequence: Synthetic peptide
  Seed: SQSSPVSSF (MAGC1_HUMAN)
SKSSPVSSY

SEQ ID NO: 75565 - protein, 9 aa, Artificial Sequence
  Description of Artificial Sequence: Synthetic peptide
  Seed: FAFGEPREL (MAGC1_HUMAN)
FVFGEPRER

SEQ ID NO: 75566 - protein, 9 aa, Artificial Sequence
  Description of Artificial Sequence: Synthetic peptide
  Seed: SICSSSTSL (MAGC1_HUMAN)
SMCSSSTSY

SEQ ID NO: 75567 - protein, 9 aa, Artificial Sequence
  Description of Artificial Sequence: Synthetic peptide
  Seed: SPLQSPESA (MAGC1_HUMAN)
SALQSPESV

SEQ ID NO: 75568 - protein, 9 aa, Artificial Sequence
  Description of Artificial Sequence: Synthetic peptide
  Seed: FSSTLLSIL (MAGC1_HUMAN)
FRSTLLSIF

SEQ ID NO: 75569 - protein, 10 aa, Artificial Sequence
  Description of Artificial Sequence: Synthetic peptide
  Seed: RSFSSTLLSI (MAGC1_HUMAN)
RLFSSTLLSI

SEQ ID NO: 75570 - protein, 9 aa, Artificial Sequence
  Description of Artificial Sequence: Synthetic peptide
  Seed: SQSSPVSSF (MAGC1_HUMAN)
SYSSPVSSF

SEQ ID NO: 75571 - protein, 10 aa, Artificial Sequence
  Description of Artificial Sequence: Synthetic peptide
  Seed: SLSPLHFPQF (MAGC1_HUMAN)
SYSPLHFPQY

SEQ ID NO: 75572 - protein, 8 aa, Artificial Sequence
  Description of Artificial Sequence: Synthetic peptide
  Seed: SSPPRYEF (MAGC1_HUMAN)
SFPPRYEL

SEQ ID NO: 75573 - protein, 11 aa, Artificial Sequence
  Description of Artificial Sequence: Synthetic peptide
  Seed: IPVSRSFSSTL (MAGC1_HUMAN)
IEVSRSFSSTY

SEQ ID NO: 75574 - protein, 10 aa, Artificial Sequence
  Description of Artificial Sequence: Synthetic peptide
  Seed: YTLDEKVDEL (MAGC1_HUMAN)
YALDEKVDEW

SEQ ID NO: 75575 - protein, 10 aa, Artificial Sequence
  Description of Artificial Sequence: Synthetic peptide
  Seed: RFLLLKYQVK (MAGC1_HUMAN)
RILLLKYQVR

SEQ ID NO: 75576 - protein, 9 aa, Artificial Sequence
  Description of Artificial Sequence: Synthetic peptide
  Seed: KAREFIEIL (MAGC1_HUMAN)
KTREFIEIT

SEQ ID NO: 75577 - protein, 9 aa, Artificial Sequence
  Description of Artificial Sequence: Synthetic peptide
  Seed: MSQNRLLIL (MAGC1_HUMAN)
MAQNRLLII

SEQ ID NO: 75578 - protein, 9 aa, Artificial Sequence
  Description of Artificial Sequence: Synthetic peptide
  Seed: SRSFSSTLL (MAGC1_HUMAN)
SHSFSSTLF

SEQ ID NO: 75579 - protein, 11 aa, Artificial Sequence
  Description of Artificial Sequence: Synthetic peptide
  Seed: TVPITFPSSYK (MAGC1_HUMAN)
TWPITFPSSYR

SEQ ID NO: 75580 - protein, 10 aa, Artificial Sequence
  Description of Artificial Sequence: Synthetic peptide
  Seed: ISRYTGYFPV (MAGC1_HUMAN)
IFRYTGYFPM

SEQ ID NO: 75581 - protein, 10 aa, Artificial Sequence
  Description of Artificial Sequence: Synthetic peptide
  Seed: VPITFPSSYK (MAGC1_HUMAN)
VRITFPSSYK

SEQ ID NO: 75582 - protein, 10 aa, Artificial Sequence
  Description of Artificial Sequence: Synthetic peptide
  Seed: MPTAGMPSLL (MAGC1_HUMAN)
MLTAGMPSLV

SEQ ID NO: 75583 - protein, 10 aa, Artificial Sequence
  Description of Artificial Sequence: Synthetic peptide
  Seed: SRYTGYFPVI (MAGC1_HUMAN)
SWYTGYFPVY

SEQ ID NO: 75584 - protein, 9 aa, Artificial Sequence
  Description of Artificial Sequence: Synthetic peptide
  Seed: MTSSFSSTL (MAGC1_HUMAN)
MPSSFSSTA

SEQ ID NO: 75585 - protein, 10 aa, Artificial Sequence
  Description of Artificial Sequence: Synthetic peptide
  Seed: SLQIPVSPSF (MAGC1_HUMAN)
SQQIPVSPSM

SEQ ID NO: 75586 - protein, 10 aa, Artificial Sequence
  Description of Artificial Sequence: Synthetic peptide
  Seed: LQIPVSPSFS (MAGC1_HUMAN)
LHIPVSPSFY

SEQ ID NO: 75587 - protein, 10 aa, Artificial Sequence
  Description of Artificial Sequence: Synthetic peptide
  Seed: AFEGFPQSPL (MAGC1_HUMAN)
AEEGFPQSPL

SEQ ID NO: 75588 - protein, 9 aa, Artificial Sequence
  Description of Artificial Sequence: Synthetic peptide
  Seed: SSSSSSSTL (MAGC1_HUMAN)
SVSSSSSTI

SEQ ID NO: 75589 - protein, 9 aa, Artificial Sequence
  Description of Artificial Sequence: Synthetic peptide
  Seed: VIWDVLSGI (MAGC1_HUMAN)
VVWDVLSGM

SEQ ID NO: 75590 - protein, 10 aa, Artificial Sequence
  Description of Artificial Sequence: Synthetic peptide
  Seed: FFSYTLASLL (MAGC1_HUMAN)
FQSYTLASLV

SEQ ID NO: 75591 - protein, 8 aa, Artificial Sequence
  Description of Artificial Sequence: Synthetic peptide
  Seed: SPLQSPVS (MAGC1_HUMAN)
SQLQSPVI

SEQ ID NO: 75592 - protein, 9 aa, Artificial Sequence
  Description of Artificial Sequence: Synthetic peptide
  Seed: SICSSSTSL (MAGC1_HUMAN)
SPCSSSTSY

SEQ ID NO: 75593 - protein, 9 aa, Artificial Sequence
  Description of Artificial Sequence: Synthetic peptide
  Seed: LQRPVSSFF (MAGC1_HUMAN)
LFRPVSSFK

SEQ ID NO: 75594 - protein, 10 aa, Artificial Sequence
  Description of Artificial Sequence: Synthetic peptide
  Seed: ISRYTGYFPV (MAGC1_HUMAN)
IWRYTGYFPM

SEQ ID NO: 75595 - protein, 10 aa, Artificial Sequence
  Description of Artificial Sequence: Synthetic peptide
  Seed: REFIEILFGI (MAGC1_HUMAN)
RLFIEILFGV

SEQ ID NO: 75596 - protein, 10 aa, Artificial Sequence
  Description of Artificial Sequence: Synthetic peptide
  Seed: SPLQIPQSPP (MAGC1_HUMAN)
SPLQIPQSPV

SEQ ID NO: 75597 - protein, 9 aa, Artificial Sequence
  Description of Artificial Sequence: Synthetic peptide
  Seed: ASSSTLVSI (MAGC1_HUMAN)
AMSSTLVSF

SEQ ID NO: 75598 - protein, 10 aa, Artificial Sequence
  Description of Artificial Sequence: Synthetic peptide
  Seed: SSPESAQSAF (MAGC1_HUMAN)
SIPESAQSAL

SEQ ID NO: 75599 - protein, 10 aa, Artificial Sequence
  Description of Artificial Sequence: Synthetic peptide
  Seed: VSSSFSYTLL (MAGC1_HUMAN)
VWSSFSYTLF

SEQ ID NO: 75600 - protein, 10 aa, Artificial Sequence
  Description of Artificial Sequence: Synthetic peptide
  Seed: ELARFLLLKY (MAGC1_HUMAN)
EVARFLLLKR

SEQ ID NO: 75601 - protein, 9 aa, Artificial Sequence
  Description of Artificial Sequence: Synthetic peptide
  Seed: FAFGEPREL (MAGC1_HUMAN)
FSFGEPREW

SEQ ID NO: 75602 - protein, 9 aa, Artificial Sequence
  Description of Artificial Sequence: Synthetic peptide
  Seed: VSSFFSYTL (MAGC1_HUMAN)
VMSFFSYTA

SEQ ID NO: 75603 - protein, 9 aa, Artificial Sequence
  Description of Artificial Sequence: Synthetic peptide
  Seed: SSSESPQSC (MAGC1_HUMAN)
STSESPQSF

SEQ ID NO: 75604 - protein, 9 aa, Artificial Sequence
  Description of Artificial Sequence: Synthetic peptide
  Seed: RYTGYFPVI (MAGC1_HUMAN)
RMTGYFPVW

SEQ ID NO: 75605 - protein, 10 aa, Artificial Sequence
  Description of Artificial Sequence: Synthetic peptide
  Seed: STPSSLPQSF (MAGC1_HUMAN)
SAPSSLPQSI

SEQ ID NO: 75606 - protein, 9 aa, Artificial Sequence
  Description of Artificial Sequence: Synthetic peptide
  Seed: ELARFLLLK (MAGC1_HUMAN)
EQARFLLLR

SEQ ID NO: 75607 - protein, 10 aa, Artificial Sequence
  Description of Artificial Sequence: Synthetic peptide
  Seed: FSSSTSLSPF (MAGC1_HUMAN)
FQSSTSLSPY

SEQ ID NO: 75608 - protein, 9 aa, Artificial Sequence
  Description of Artificial Sequence: Synthetic peptide
  Seed: MGDKDMPTA (MAGC1_HUMAN)
MFDKDMPTL

SEQ ID NO: 75609 - protein, 11 aa, Artificial Sequence
  Description of Artificial Sequence: Synthetic peptide
  Seed: SICSSSTSLSL (MAGC1_HUMAN)
SSCSSSTSLSF

SEQ ID NO: 75610 - protein, 9 aa, Artificial Sequence
  Description of Artificial Sequence: Synthetic peptide
  Seed: SSSSSSSTL (MAGC1_HUMAN)
SISSSSSTW

SEQ ID NO: 75611 - protein, 10 aa, Artificial Sequence
  Description of Artificial Sequence: Synthetic peptide
  Seed: LQIPGSPSFS (MAGC1_HUMAN)
LMIPGSPSFC

SEQ ID NO: 75612 - protein, 9 aa, Artificial Sequence
  Description of Artificial Sequence: Synthetic peptide
  Seed: SSPERTQST (MAGC1_HUMAN)
SGPERTQSI

SEQ ID NO: 75613 - protein, 10 aa, Artificial Sequence
  Description of Artificial Sequence: Synthetic peptide
  Seed: SSFSSTLLSI (MAGC1_HUMAN)
SSFSSTLLSV

SEQ ID NO: 75614 - protein, 9 aa, Artificial Sequence
  Description of Artificial Sequence: Synthetic peptide
  Seed: NSSPPRYEF (MAGC1_HUMAN)
NASPPRYEL

SEQ ID NO: 75615 - protein, 10 aa, Artificial Sequence
  Description of Artificial Sequence: Synthetic peptide
  Seed: FFSYTLASLL (MAGC1_HUMAN)
FISYTLASLL

SEQ ID NO: 75616 - protein, 9 aa, Artificial Sequence
  Description of Artificial Sequence: Synthetic peptide
  Seed: FFSYTLASL (MAGC1_HUMAN)
FGSYTLASL

SEQ ID NO: 75617 - protein, 9 aa, Artificial Sequence
  Description of Artificial Sequence: Synthetic peptide
  Seed: FSSTLLSLF (MAGC1_HUMAN)
FSSTLLSLY

SEQ ID NO: 75618 - protein, 9 aa, Artificial Sequence
  Description of Artificial Sequence: Synthetic peptide
  Seed: LSPLHFPQF (MAGC1_HUMAN)
LAPLHFPQF

SEQ ID NO: 75619 - protein, 9 aa, Artificial Sequence
  Description of Artificial Sequence: Synthetic peptide
  Seed: FSSTLLSLF (MAGC1_HUMAN)
FISTLLSLF

SEQ ID NO: 75620 - protein, 10 aa, Artificial Sequence
  Description of Artificial Sequence: Synthetic peptide
  Seed: RAGREHFAFG (MAGC1_HUMAN)
RVGREHFAFL

SEQ ID NO: 75621 - protein, 9 aa, Artificial Sequence
  Description of Artificial Sequence: Synthetic peptide
  Seed: WGPRAHSEV (MAGC1_HUMAN)
WGPRAHSEL

SEQ ID NO: 75622 - protein, 10 aa, Artificial Sequence
  Description of Artificial Sequence: Synthetic peptide
  Seed: PLQIPVSSSF (MAGC1_HUMAN)
PRQIPVSSSY

SEQ ID NO: 75623 - protein, 9 aa, Artificial Sequence
  Description of Artificial Sequence: Synthetic peptide
  Seed: SICSSSTSL (MAGC1_HUMAN)
SLCSSSTSL

SEQ ID NO: 75624 - protein, 9 aa, Artificial Sequence
  Description of Artificial Sequence: Synthetic peptide
  Seed: RTHSTFEGF (MAGC1_HUMAN)
RVHSTFEGY

SEQ ID NO: 75625 - protein, 10 aa, Artificial Sequence
  Description of Artificial Sequence: Synthetic peptide
  Seed: VSSSSSSSTL (MAGC1_HUMAN)
VMSSSSSSTY

SEQ ID NO: 75626 - protein, 10 aa, Artificial Sequence
  Description of Artificial Sequence: Synthetic peptide
  Seed: SSSSSSSTLL (MAGC1_HUMAN)
SQSSSSSTLW

SEQ ID NO: 75627 - protein, 10 aa, Artificial Sequence
  Description of Artificial Sequence: Synthetic peptide
  Seed: WGPRAHSEVI (MAGC1_HUMAN)
WKPRAHSEVL

SEQ ID NO: 75628 - protein, 10 aa, Artificial Sequence
  Description of Artificial Sequence: Synthetic peptide
  Seed: LSGIGVRAGR (MAGC1_HUMAN)
LMGIGVRAGR

SEQ ID NO: 75629 - protein, 9 aa, Artificial Sequence
  Description of Artificial Sequence: Synthetic peptide
  Seed: DSYVFVNTL (MAGC1_HUMAN)
DIYVFVNTY

SEQ ID NO: 75630 - protein, 9 aa, Artificial Sequence
  Description of Artificial Sequence: Synthetic peptide
  Seed: FSYTLASLL (MAGC1_HUMAN)
FSYTLASLF

SEQ ID NO: 75631 - protein, 9 aa, Artificial Sequence
  Description of Artificial Sequence: Synthetic peptide
  Seed: TLVSIFQSS (MAGC1_HUMAN)
TLVSIFQSA

SEQ ID NO: 75632 - protein, 9 aa, Artificial Sequence
  Description of Artificial Sequence: Synthetic peptide
  Seed: REHFAFGEP (MAGC1_HUMAN)
REHFAFGEC

SEQ ID NO: 75633 - protein, 10 aa, Artificial Sequence
  Description of Artificial Sequence: Synthetic peptide
  Seed: REVDPDDSYV (MAGC1_HUMAN)
REVDPDDSYY

SEQ ID NO: 75634 - protein, 10 aa, Artificial Sequence
  Description of Artificial Sequence: Synthetic peptide
  Seed: SFSSTLVSLF (MAGC1_HUMAN)
SCSSTLVSLF

SEQ ID NO: 75635 - protein, 9 aa, Artificial Sequence
  Description of Artificial Sequence: Synthetic peptide
  Seed: LQIPVSRSF (MAGC1_HUMAN)
LQIPVSRSY

SEQ ID NO: 75636 - protein, 10 aa, Artificial Sequence
  Description of Artificial Sequence: Synthetic peptide
  Seed: SFSYTLLSLF (MAGC1_HUMAN)
SKSYTLLSLW

SEQ ID NO: 75637 - protein, 9 aa, Artificial Sequence
  Description of Artificial Sequence: Synthetic peptide
  Seed: STFEGFPQS (MAGC1_HUMAN)
SPFEGFPQM

SEQ ID NO: 75638 - protein, 9 aa, Artificial Sequence
  Description of Artificial Sequence: Synthetic peptide
  Seed: WVQEHYLEY (MAGC1_HUMAN)
WLQEHYLEM

SEQ ID NO: 75639 - protein, 9 aa, Artificial Sequence
  Description of Artificial Sequence: Synthetic peptide
  Seed: SAPEGEDSL (MAGC1_HUMAN)
SLPEGEDSI

SEQ ID NO: 75640 - protein, 9 aa, Artificial Sequence
  Description of Artificial Sequence: Synthetic peptide
  Seed: SPPEGENTH (MAGC1_HUMAN)
SSPEGENTM

SEQ ID NO: 75641 - protein, 11 aa, Artificial Sequence
  Description of Artificial Sequence: Synthetic peptide
  Seed: VDEYTSSSDTL (MAGC1_HUMAN)
VNEYTSSSDTF

SEQ ID NO: 75642 - protein, 9 aa, Artificial Sequence
  Description of Artificial Sequence: Synthetic peptide
  Seed: EDSLSPLHF (MAGC1_HUMAN)
EESLSPLHY

SEQ ID NO: 75643 - protein, 10 aa, Artificial Sequence
  Description of Artificial Sequence: Synthetic peptide
  Seed: VSSSSSSTLL (MAGC1_HUMAN)
VESSSSSTLW

SEQ ID NO: 75644 - protein, 9 aa, Artificial Sequence
  Description of Artificial Sequence: Synthetic peptide
  Seed: FLAMLKNTV (MAGC1_HUMAN)
FQAMLKNTI

SEQ ID NO: 75645 - protein, 11 aa, Artificial Sequence
  Description of Artificial Sequence: Synthetic peptide
  Seed: EEVIWDVLSGI (MAGC1_HUMAN)
EIVIWDVLSGV

SEQ ID NO: 75646 - protein, 11 aa, Artificial Sequence
  Description of Artificial Sequence: Synthetic peptide
  Seed: RPVSSFFSYTL (MAGC1_HUMAN)
RLVSSFFSYTY

SEQ ID NO: 75647 - protein, 9 aa, Artificial Sequence
  Description of Artificial Sequence: Synthetic peptide
  Seed: GSPSFSSTL (MAGC1_HUMAN)
GLPSFSSTV

SEQ ID NO: 75648 - protein, 11 aa, Artificial Sequence
  Description of Artificial Sequence: Synthetic peptide
  Seed: REVDPDDSYVF (MAGC1_HUMAN)
RIVDPDDSYVY

SEQ ID NO: 75649 - protein, 9 aa, Artificial Sequence
  Description of Artificial Sequence: Synthetic peptide
  Seed: AGREHFAFG (MAGC1_HUMAN)
AVREHFAFA

SEQ ID NO: 75650 - protein, 9 aa, Artificial Sequence
  Description of Artificial Sequence: Synthetic peptide
  Seed: SSSSSSSTL (MAGC1_HUMAN)
SHSSSSSTF

SEQ ID NO: 75651 - protein, 11 aa, Artificial Sequence
  Description of Artificial Sequence: Synthetic peptide
  Seed: SLHFPQSPPEW (MAGC1_HUMAN)
SYHFPQSPPEF

SEQ ID NO: 75652 - protein, 11 aa, Artificial Sequence
  Description of Artificial Sequence: Synthetic peptide
  Seed: RYTGYFPVIFR (MAGC1_HUMAN)
RFTGYFPVIFF

SEQ ID NO: 75653 - protein, 9 aa, Artificial Sequence
  Description of Artificial Sequence: Synthetic peptide
  Seed: SAPEGEDSL (MAGC1_HUMAN)
SFPEGEDSM

SEQ ID NO: 75654 - protein, 9 aa, Artificial Sequence
  Description of Artificial Sequence: Synthetic peptide
  Seed: LSDEQGMSQ (MAGC1_HUMAN)
LNDEQGMSV

SEQ ID NO: 75655 - protein, 9 aa, Artificial Sequence
  Description of Artificial Sequence: Synthetic peptide
  Seed: SLPEWEDSL (MAGC1_HUMAN)
SRPEWEDSL

SEQ ID NO: 75656 - protein, 9 aa, Artificial Sequence
  Description of Artificial Sequence: Synthetic peptide
  Seed: RYTGYFPVI (MAGC1_HUMAN)
RRTGYFPVY

SEQ ID NO: 75657 - protein, 9 aa, Artificial Sequence
  Description of Artificial Sequence: Synthetic peptide
  Seed: SQSPPEGPV (MAGC1_HUMAN)
SLSPPEGPI

SEQ ID NO: 75658 - protein, 9 aa, Artificial Sequence
  Description of Artificial Sequence: Synthetic peptide
  Seed: RSFSSTLLS (MAGC1_HUMAN)
RPFSSTLLW

SEQ ID NO: 75659 - protein, 9 aa, Artificial Sequence
  Description of Artificial Sequence: Synthetic peptide
  Seed: FPSSTSSSL (MAGC1_HUMAN)
FNSSTSSSY

SEQ ID NO: 75660 - protein, 9 aa, Artificial Sequence
  Description of Artificial Sequence: Synthetic peptide
  Seed: LSPLHFPQF (MAGC1_HUMAN)
LFPLHFPQM

SEQ ID NO: 75661 - protein, 9 aa, Artificial Sequence
  Description of Artificial Sequence: Synthetic peptide
  Seed: RPVSSFFSY (MAGC1_HUMAN)
RWVSSFFSY

SEQ ID NO: 75662 - protein, 9 aa, Artificial Sequence
  Description of Artificial Sequence: Synthetic peptide
  Seed: LQIVPSLPE (MAGC1_HUMAN)
LMIVPSLPH

SEQ ID NO: 75663 - protein, 10 aa, Artificial Sequence
  Description of Artificial Sequence: Synthetic peptide
  Seed: RAGREHFAFG (MAGC1_HUMAN)
RTGREHFAFM

SEQ ID NO: 75664 - protein, 9 aa, Artificial Sequence
  Description of Artificial Sequence: Synthetic peptide
  Seed: SPLQIVPSL (MAGC1_HUMAN)
SILQIVPSI

SEQ ID NO: 75665 - protein, 9 aa, Artificial Sequence
  Description of Artificial Sequence: Synthetic peptide
  Seed: LQIVPSLPE (MAGC1_HUMAN)
LHIVPSLPM

SEQ ID NO: 75666 - protein, 10 aa, Artificial Sequence
  Description of Artificial Sequence: Synthetic peptide
  Seed: LQRPVSSFFS (MAGC1_HUMAN)
LIRPVSSFFY

SEQ ID NO: 75667 - protein, 11 aa, Artificial Sequence
  Description of Artificial Sequence: Synthetic peptide
  Seed: QSSPECTQSTF (MAGC1_HUMAN)
QASPECTQSTW

SEQ ID NO: 75668 - protein, 9 aa, Artificial Sequence
  Description of Artificial Sequence: Synthetic peptide
  Seed: SSSDTLLES (MAGC1_HUMAN)
SASDTLLEL

SEQ ID NO: 75669 - protein, 10 aa, Artificial Sequence
  Description of Artificial Sequence: Synthetic peptide
  Seed: FAQSSLQIPV (MAGC1_HUMAN)
FGQSSLQIPL

SEQ ID NO: 75670 - protein, 10 aa, Artificial Sequence
  Description of Artificial Sequence: Synthetic peptide
  Seed: SSSSSSSTLL (MAGC1_HUMAN)
SMSSSSSTLW

SEQ ID NO: 75671 - protein, 9 aa, Artificial Sequence
  Description of Artificial Sequence: Synthetic peptide
  Seed: LQIPVSPSF (MAGC1_HUMAN)
LTIPVSPSV

SEQ ID NO: 75672 - protein, 11 aa, Artificial Sequence
  Description of Artificial Sequence: Synthetic peptide
  Seed: IPMTSSFSSTL (MAGC1_HUMAN)
IPMTSSFSSTY

SEQ ID NO: 75673 - protein, 10 aa, Artificial Sequence
  Description of Artificial Sequence: Synthetic peptide
  Seed: VSSSSSSSTL (MAGC1_HUMAN)
VTSSSSSSTY

SEQ ID NO: 75674 - protein, 11 aa, Artificial Sequence
  Description of Artificial Sequence: Synthetic peptide
  Seed: SSSFSYTLLSL (MAGC1_HUMAN)
SASFSYTLLSW

SEQ ID NO: 75675 - protein, 9 aa, Artificial Sequence
  Description of Artificial Sequence: Synthetic peptide
  Seed: GTYASEEVI (MAGC1_HUMAN)
GQYASEEVI

SEQ ID NO: 75676 - protein, 9 aa, Artificial Sequence
  Description of Artificial Sequence: Synthetic peptide
  Seed: SLPEWEDSL (MAGC1_HUMAN)
SFPEWEDSF

SEQ ID NO: 75677 - protein, 10 aa, Artificial Sequence
  Description of Artificial Sequence: Synthetic peptide
  Seed: LQIPGSPSFS (MAGC1_HUMAN)
LLIPGSPSFM

SEQ ID NO: 75678 - protein, 10 aa, Artificial Sequence
  Description of Artificial Sequence: Synthetic peptide
  Seed: WGPRAHSEVI (MAGC1_HUMAN)
WSPRAHSEVM

SEQ ID NO: 75679 - protein, 9 aa, Artificial Sequence
  Description of Artificial Sequence: Synthetic peptide
  Seed: KVDELARFL (MAGC1_HUMAN)
KWDELARFI

SEQ ID NO: 75680 - protein, 10 aa, Artificial Sequence
  Description of Artificial Sequence: Synthetic peptide
  Seed: ATESASSSVM (MAGC1_HUMAN)
AYESASSSVF

SEQ ID NO: 75681 - protein, 11 aa, Artificial Sequence
  Description of Artificial Sequence: Synthetic peptide
  Seed: VDEYTSSSDTL (MAGC1_HUMAN)
VEEYTSSSDTF

SEQ ID NO: 75682 - protein, 10 aa, Artificial Sequence
  Description of Artificial Sequence: Synthetic peptide
  Seed: MTSSFSSTLL (MAGC1_HUMAN)
MNSSFSSTLL

SEQ ID NO: 75683 - protein, 11 aa, Artificial Sequence
  Description of Artificial Sequence: Synthetic peptide
  Seed: SSSSSTLLSLF (MAGC1_HUMAN)
SDSSSTLLSLW

SEQ ID NO: 75684 - protein, 11 aa, Artificial Sequence
  Description of Artificial Sequence: Synthetic peptide
  Seed: LQIPMTSSFSS (MAGC1_HUMAN)
LMIPMTSSFSF

SEQ ID NO: 75685 - protein, 10 aa, Artificial Sequence
  Description of Artificial Sequence: Synthetic peptide
  Seed: EVIKRKVVEF (MAGC1_HUMAN)
EVIKRKVVER

SEQ ID NO: 75686 - protein, 11 aa, Artificial Sequence
  Description of Artificial Sequence: Synthetic peptide
  Seed: SSFSYTLLSLF (MAGC1_HUMAN)
SQFSYTLLSLY

SEQ ID NO: 75687 - protein, 10 aa, Artificial Sequence
  Description of Artificial Sequence: Synthetic peptide
  Seed: LSQSSPVSSF (MAGC1_HUMAN)
LAQSSPVSSF

SEQ ID NO: 75688 - protein, 9 aa, Artificial Sequence
  Description of Artificial Sequence: Synthetic peptide
  Seed: FAFGEPREL (MAGC1_HUMAN)
FLFGEPREA

SEQ ID NO: 75689 - protein, 10 aa, Artificial Sequence
  Description of Artificial Sequence: Synthetic peptide
  Seed: RSFSSTLLSI (MAGC1_HUMAN)
RAFSSTLLSM

SEQ ID NO: 75690 - protein, 9 aa, Artificial Sequence
  Description of Artificial Sequence: Synthetic peptide
  Seed: VLSGIGVRA (MAGC1_HUMAN)
VQSGIGVRV

SEQ ID NO: 75691 - protein, 10 aa, Artificial Sequence
  Description of Artificial Sequence: Synthetic peptide
  Seed: MTSSFSSTLL (MAGC1_HUMAN)
MMSSFSSTLE

SEQ ID NO: 75692 - protein, 9 aa, Artificial Sequence
  Description of Artificial Sequence: Synthetic peptide
  Seed: SQNRLLILI (MAGC1_HUMAN)
SVNRLLILY

SEQ ID NO: 75693 - protein, 9 aa, Artificial Sequence
  Description of Artificial Sequence: Synthetic peptide
  Seed: KVDELARFL (MAGC1_HUMAN)
KLDELARFF

SEQ ID NO: 75694 - protein, 10 aa, Artificial Sequence
  Description of Artificial Sequence: Synthetic peptide
  Seed: LQIPVSSSFS (MAGC1_HUMAN)
LQIPVSSSFR

SEQ ID NO: 75695 - protein, 11 aa, Artificial Sequence
  Description of Artificial Sequence: Synthetic peptide
  Seed: VSSSSSSSTLL (MAGC1_HUMAN)
VGSSSSSSTLW

SEQ ID NO: 75696 - protein, 9 aa, Artificial Sequence
  Description of Artificial Sequence: Synthetic peptide
  Seed: SAQSTFEGF (MAGC1_HUMAN)
SMQSTFEGL

SEQ ID NO: 75697 - protein, 10 aa, Artificial Sequence
  Description of Artificial Sequence: Synthetic peptide
  Seed: STPSSLPQSF (MAGC1_HUMAN)
SSPSSLPQSM

SEQ ID NO: 75698 - protein, 9 aa, Artificial Sequence
  Description of Artificial Sequence: Synthetic peptide
  Seed: LQIPVSRSF (MAGC1_HUMAN)
LNIPVSRSY

SEQ ID NO: 75699 - protein, 9 aa, Artificial Sequence
  Description of Artificial Sequence: Synthetic peptide
  Seed: LQIPVSSSS (MAGC1_HUMAN)
LFIPVSSSM

SEQ ID NO: 75700 - protein, 10 aa, Artificial Sequence
  Description of Artificial Sequence: Synthetic peptide
  Seed: ISRYTGYFPV (MAGC1_HUMAN)
IFRYTGYFPL

SEQ ID NO: 75701 - protein, 10 aa, Artificial Sequence
  Description of Artificial Sequence: Synthetic peptide
  Seed: REFIEILFGI (MAGC1_HUMAN)
REFIEILFGY

SEQ ID NO: 75702 - protein, 9 aa, Artificial Sequence
  Description of Artificial Sequence: Synthetic peptide
  Seed: TTDDSTATE (MAGC1_HUMAN)
TFDDSTATM

SEQ ID NO: 75703 - protein, 9 aa, Artificial Sequence
  Description of Artificial Sequence: Synthetic peptide
  Seed: SSPPRYEFL (MAGC1_HUMAN)
SAPPRYEFI

SEQ ID NO: 75704 - protein, 10 aa, Artificial Sequence
  Description of Artificial Sequence: Synthetic peptide
  Seed: SVLQIPVSAA (MAGC1_HUMAN)
SLLQIPVSAI

SEQ ID NO: 75705 - protein, 9 aa, Artificial Sequence
  Description of Artificial Sequence: Synthetic peptide
  Seed: SGIGVRAGR (MAGC1_HUMAN)
SAIGVRAGK

SEQ ID NO: 75706 - protein, 9 aa, Artificial Sequence
  Description of Artificial Sequence: Synthetic peptide
  Seed: NVISRYTGY (MAGC1_HUMAN)
NMISRYTGR

SEQ ID NO: 75707 - protein, 9 aa, Artificial Sequence
  Description of Artificial Sequence: Synthetic peptide
  Seed: SSSSSSSTL (MAGC1_HUMAN)
STSSSSSTM

SEQ ID NO: 75708 - protein, 9 aa, Artificial Sequence
  Description of Artificial Sequence: Synthetic peptide
  Seed: SFPSSTSSS (MAGC1_HUMAN)
SMPSSTSSF

SEQ ID NO: 75709 - protein, 9 aa, Artificial Sequence
  Description of Artificial Sequence: Synthetic peptide
  Seed: SIIFIKGTY (MAGC1_HUMAN)
SQIFIKGTM

SEQ ID NO: 75710 - protein, 9 aa, Artificial Sequence
  Description of Artificial Sequence: Synthetic peptide
  Seed: LQRPVSSFF (MAGC1_HUMAN)
LARPVSSFM

SEQ ID NO: 75711 - protein, 9 aa, Artificial Sequence
  Description of Artificial Sequence: Synthetic peptide
  Seed: FAFGEPREL (MAGC1_HUMAN)
FPFGEPREF

SEQ ID NO: 75712 - protein, 9 aa, Artificial Sequence
  Description of Artificial Sequence: Synthetic peptide
  Seed: LKYQVKQPI (MAGC1_HUMAN)
LKYQVKQPM

SEQ ID NO: 75713 - protein, 9 aa, Artificial Sequence
  Description of Artificial Sequence: Synthetic peptide
  Seed: VSSSSSSTL (MAGC1_HUMAN)
VVSSSSSTL

SEQ ID NO: 75714 - protein, 11 aa, Artificial Sequence
  Description of Artificial Sequence: Synthetic peptide
  Seed: RYTGYFPVIFR (MAGC1_HUMAN)
RLTGYFPVIFR

SEQ ID NO: 75715 - protein, 11 aa, Artificial Sequence
  Description of Artificial Sequence: Synthetic peptide
  Seed: QSSPESAQSTF (MAGC1_HUMAN)
QASPESAQSTF

SEQ ID NO: 75716 - protein, 9 aa, Artificial Sequence
  Description of Artificial Sequence: Synthetic peptide
  Seed: EFIEILFGI (MAGC1_HUMAN)
EGIEILFGA

SEQ ID NO: 75717 - protein, 11 aa, Artificial Sequence
  Description of Artificial Sequence: Synthetic peptide
  Seed: IPVSRSFSSTL (MAGC1_HUMAN)
IMVSRSFSSTW

SEQ ID NO: 75718 - protein, 9 aa, Artificial Sequence
  Description of Artificial Sequence: Synthetic peptide
  Seed: SAPEGEDSL (MAGC1_HUMAN)
SMPEGEDSM

SEQ ID NO: 75719 - protein, 9 aa, Artificial Sequence
  Description of Artificial Sequence: Synthetic peptide
  Seed: ASSFFSSAL (MAGC1_HUMAN)
AMSFFSSAF

SEQ ID NO: 75720 - protein, 10 aa, Artificial Sequence
  Description of Artificial Sequence: Synthetic peptide
  Seed: SSPERTQSTF (MAGC1_HUMAN)
SMPERTQSTM

SEQ ID NO: 75721 - protein, 10 aa, Artificial Sequence
  Description of Artificial Sequence: Synthetic peptide
  Seed: RKVVEFLAML (MAGC1_HUMAN)
RVVVEFLAMV

SEQ ID NO: 75722 - protein, 9 aa, Artificial Sequence
  Description of Artificial Sequence: Synthetic peptide
  Seed: SRYTGYFPV (MAGC1_HUMAN)
SRYTGYFPM

SEQ ID NO: 75723 - protein, 9 aa, Artificial Sequence
  Description of Artificial Sequence: Synthetic peptide
  Seed: SFFSYTLAS (MAGC1_HUMAN)
SYFSYTLAT

SEQ ID NO: 75724 - protein, 9 aa, Artificial Sequence
  Description of Artificial Sequence: Synthetic peptide
  Seed: TPSSLPQSF (MAGC1_HUMAN)
TTSSLPQSL

SEQ ID NO: 75725 - protein, 9 aa, Artificial Sequence
  Description of Artificial Sequence: Synthetic peptide
  Seed: ERAQAIIDT (MAGC1_HUMAN)
EHAQAIIDA

SEQ ID NO: 75726 - protein, 9 aa, Artificial Sequence
  Description of Artificial Sequence: Synthetic peptide
  Seed: ALLSIFQSS (MAGC1_HUMAN)
AILSIFQSM

SEQ ID NO: 75727 - protein, 9 aa, Artificial Sequence
  Description of Artificial Sequence: Synthetic peptide
  Seed: FSSALLSIF (MAGC1_HUMAN)
FVSALLSIY

SEQ ID NO: 75728 - protein, 9 aa, Artificial Sequence
  Description of Artificial Sequence: Synthetic peptide
  Seed: GSPSFSSTL (MAGC1_HUMAN)
GIPSFSSTV

SEQ ID NO: 75729 - protein, 9 aa, Artificial Sequence
  Description of Artificial Sequence: Synthetic peptide
  Seed: LQIPGSPSF (MAGC1_HUMAN)
LGIPGSPSL

SEQ ID NO: 75730 - protein, 10 aa, Artificial Sequence
  Description of Artificial Sequence: Synthetic peptide
  Seed: IPVSPSSSST (MAGC1_HUMAN)
IPVSPSSSSM

SEQ ID NO: 75731 - protein, 10 aa, Artificial Sequence
  Description of Artificial Sequence: Synthetic peptide
  Seed: MLKNTVPITF (MAGC1_HUMAN)
MWKNTVPITY

SEQ ID NO: 75732 - protein, 9 aa, Artificial Sequence
  Description of Artificial Sequence: Synthetic peptide
  Seed: SLPEWEDSL (MAGC1_HUMAN)
SAPEWEDSY

SEQ ID NO: 75733 - protein, 9 aa, Artificial Sequence
  Description of Artificial Sequence: Synthetic peptide
  Seed: LQIPVSPSF (MAGC1_HUMAN)
LFIPVSPSY

SEQ ID NO: 75734 - protein, 10 aa, Artificial Sequence
  Description of Artificial Sequence: Synthetic peptide
  Seed: TTDDSTATES (MAGC1_HUMAN)
TSDDSTATEF

SEQ ID NO: 75735 - protein, 10 aa, Artificial Sequence
  Description of Artificial Sequence: Synthetic peptide
  Seed: WGPRAHSEVI (MAGC1_HUMAN)
WGPRAHSEVV

SEQ ID NO: 75736 - protein, 9 aa, Artificial Sequence
  Description of Artificial Sequence: Synthetic peptide
  Seed: SSPPRYEFL (MAGC1_HUMAN)
SIPPRYEFL

SEQ ID NO: 75737 - protein, 11 aa, Artificial Sequence
  Description of Artificial Sequence: Synthetic peptide
  Seed: SPLQIPMTSSF (MAGC1_HUMAN)
SNLQIPMTSSF

SEQ ID NO: 75738 - protein, 9 aa, Artificial Sequence
  Description of Artificial Sequence: Synthetic peptide
  Seed: NVISRYTGY (MAGC1_HUMAN)
NMISRYTGK

SEQ ID NO: 75739 - protein, 10 aa, Artificial Sequence
  Description of Artificial Sequence: Synthetic peptide
  Seed: HESPQSPPEG (MAGC1_HUMAN)
HESPQSPPEA

SEQ ID NO: 75740 - protein, 10 aa, Artificial Sequence
  Description of Artificial Sequence: Synthetic peptide
  Seed: YTLASLLQSS (MAGC1_HUMAN)
YVLASLLQSM

SEQ ID NO: 75741 - protein, 9 aa, Artificial Sequence
  Description of Artificial Sequence: Synthetic peptide
  Seed: FSSALLSIF (MAGC1_HUMAN)
FKSALLSIY

SEQ ID NO: 75742 - protein, 9 aa, Artificial Sequence
  Description of Artificial Sequence: Synthetic peptide
  Seed: SSPECTQST (MAGC1_HUMAN)
SSPECTQSV

SEQ ID NO: 75743 - protein, 9 aa, Artificial Sequence
  Description of Artificial Sequence: Synthetic peptide
  Seed: SSSESPQSC (MAGC1_HUMAN)
SMSESPQSY

SEQ ID NO: 75744 - protein, 9 aa, Artificial Sequence
  Description of Artificial Sequence: Synthetic peptide
  Seed: LARFLLLKY (MAGC1_HUMAN)
LSRFLLLKL

SEQ ID NO: 75745 - protein, 9 aa, Artificial Sequence
  Description of Artificial Sequence: Synthetic peptide
  Seed: FQSSLQSPV (MAGC1_HUMAN)
FHSSLQSPM

SEQ ID NO: 75746 - protein, 8 aa, Artificial Sequence
  Description of Artificial Sequence: Synthetic peptide
  Seed: FSSTLLSL (MAGC1_HUMAN)
FQSTLLSV

SEQ ID NO: 75747 - protein, 9 aa, Artificial Sequence
  Description of Artificial Sequence: Synthetic peptide
  Seed: RLLILILSI (MAGC1_HUMAN)
RTLILILSF

SEQ ID NO: 75748 - protein, 9 aa, Artificial Sequence
  Description of Artificial Sequence: Synthetic peptide
  Seed: FQSSLQSPV (MAGC1_HUMAN)
FLSSLQSPM

SEQ ID NO: 75749 - protein, 9 aa, Artificial Sequence
  Description of Artificial Sequence: Synthetic peptide
  Seed: SSHESPQSP (MAGC1_HUMAN)
STHESPQSV

SEQ ID NO: 75750 - protein, 9 aa, Artificial Sequence
  Description of Artificial Sequence: Synthetic peptide
  Seed: FSYTLLSLF (MAGC1_HUMAN)
FQYTLLSLY

SEQ ID NO: 75751 - protein, 9 aa, Artificial Sequence
  Description of Artificial Sequence: Synthetic peptide
  Seed: SICSSSTSL (MAGC1_HUMAN)
SFCSSSTSY

SEQ ID NO: 75752 - protein, 9 aa, Artificial Sequence
  Description of Artificial Sequence: Synthetic peptide
  Seed: SRYTGYFPV (MAGC1_HUMAN)
SRYTGYFPL

SEQ ID NO: 75753 - protein, 11 aa, Artificial Sequence
  Description of Artificial Sequence: Synthetic peptide
  Seed: QSSPESAQSTF (MAGC1_HUMAN)
QLSPESAQSTL

SEQ ID NO: 75754 - protein, 10 aa, Artificial Sequence
  Description of Artificial Sequence: Synthetic peptide
  Seed: KGTYASEEVI (MAGC1_HUMAN)
KGTYASEEVY

SEQ ID NO: 75755 - protein, 10 aa, Artificial Sequence
  Description of Artificial Sequence: Synthetic peptide
  Seed: RSFSSTLLSI (MAGC1_HUMAN)
RFFSSTLLSW

SEQ ID NO: 75756 - protein, 11 aa, Artificial Sequence
  Description of Artificial Sequence: Synthetic peptide
  Seed: SSSSSSTLLSL (MAGC1_HUMAN)
SLSSSSTLLSW

SEQ ID NO: 75757 - protein, 9 aa, Artificial Sequence
  Description of Artificial Sequence: Synthetic peptide
  Seed: IFRKAREFI (MAGC1_HUMAN)
IYRKAREFI

SEQ ID NO: 75758 - protein, 9 aa, Artificial Sequence
  Description of Artificial Sequence: Synthetic peptide
  Seed: VSRSFSSTL (MAGC1_HUMAN)
VQRSFSSTM

SEQ ID NO: 75759 - protein, 9 aa, Artificial Sequence
  Description of Artificial Sequence: Synthetic peptide
  Seed: VQEHYLEYR (MAGC1_HUMAN)
VYEHYLEYR

SEQ ID NO: 75760 - protein, 10 aa, Artificial Sequence
  Description of Artificial Sequence: Synthetic peptide
  Seed: YTLDEKVDEL (MAGC1_HUMAN)
YILDEKVDEI

SEQ ID NO: 75761 - protein, 10 aa, Artificial Sequence
  Description of Artificial Sequence: Synthetic peptide
  Seed: FPQSPLQIPV (MAGC1_HUMAN)
FTQSPLQIPV

SEQ ID NO: 75762 - protein, 10 aa, Artificial Sequence
  Description of Artificial Sequence: Synthetic peptide
  Seed: REFIEILFGI (MAGC1_HUMAN)
RWFIEILFGI

SEQ ID NO: 75763 - protein, 9 aa, Artificial Sequence
  Description of Artificial Sequence: Synthetic peptide
  Seed: SSSSTLLSL (MAGC1_HUMAN)
SWSSTLLSW

SEQ ID NO: 75764 - protein, 9 aa, Artificial Sequence
  Description of Artificial Sequence: Synthetic peptide
  Seed: LQIPVSSSS (MAGC1_HUMAN)
LWIPVSSSI

SEQ ID NO: 75765 - protein, 11 aa, Artificial Sequence
  Description of Artificial Sequence: Synthetic peptide
  Seed: SPLQIPGSPSF (MAGC1_HUMAN)
SMLQIPGSPSY

SEQ ID NO: 75766 - protein, 9 aa, Artificial Sequence
  Description of Artificial Sequence: Synthetic peptide
  Seed: FTYTLDEKV (MAGC1_HUMAN)
FAYTLDEKF

SEQ ID NO: 75767 - protein, 10 aa, Artificial Sequence
  Description of Artificial Sequence: Synthetic peptide
  Seed: RKVVEFLAML (MAGC1_HUMAN)
REVVEFLAMI

SEQ ID NO: 75768 - protein, 9 aa, Artificial Sequence
  Description of Artificial Sequence: Synthetic peptide
  Seed: ASSFFSSAL (MAGC1_HUMAN)
ATSFFSSAY

SEQ ID NO: 75769 - protein, 11 aa, Artificial Sequence
  Description of Artificial Sequence: Synthetic peptide
  Seed: KGTYASEEVIW (MAGC1_HUMAN)
KATYASEEVIW

SEQ ID NO: 75770 - protein, 11 aa, Artificial Sequence
  Description of Artificial Sequence: Synthetic peptide
  Seed: SPLQIPMTSSF (MAGC1_HUMAN)
SVLQIPMTSSM

SEQ ID NO: 75771 - protein, 11 aa, Artificial Sequence
  Description of Artificial Sequence: Synthetic peptide
  Seed: AMLKNTVPITF (MAGC1_HUMAN)
AVLKNTVPITW

SEQ ID NO: 75772 - protein, 11 aa, Artificial Sequence
  Description of Artificial Sequence: Synthetic peptide
  Seed: RPVSSFFSYTL (MAGC1_HUMAN)
RPVSSFFSYTM

SEQ ID NO: 75773 - protein, 9 aa, Artificial Sequence
  Description of Artificial Sequence: Synthetic peptide
  Seed: AGREHFAFG (MAGC1_HUMAN)
AQREHFAFR

SEQ ID NO: 75774 - protein, 10 aa, Artificial Sequence
  Description of Artificial Sequence: Synthetic peptide
  Seed: FSSSTSLSPF (MAGC1_HUMAN)
FLSSTSLSPF

SEQ ID NO: 75775 - protein, 9 aa, Artificial Sequence
  Description of Artificial Sequence: Synthetic peptide
  Seed: LQRPVSSFF (MAGC1_HUMAN)
LHRPVSSFM

SEQ ID NO: 75776 - protein, 9 aa, Artificial Sequence
  Description of Artificial Sequence: Synthetic peptide
  Seed: DALKDVEER (MAGC1_HUMAN)
DSLKDVEER

SEQ ID NO: 75777 - protein, 9 aa, Artificial Sequence
  Description of Artificial Sequence: Synthetic peptide
  Seed: REVDPDDSY (MAGC1_HUMAN)
RAVDPDDSF

SEQ ID NO: 75778 - protein, 9 aa, Artificial Sequence
  Description of Artificial Sequence: Synthetic peptide
  Seed: SSPERTHST (MAGC1_HUMAN)
SLPERTHSL

SEQ ID NO: 75779 - protein, 10 aa, Artificial Sequence
  Description of Artificial Sequence: Synthetic peptide
  Seed: MSPLYFPQSP (MAGC1_HUMAN)
MSPLYFPQSA

SEQ ID NO: 75780 - protein, 10 aa, Artificial Sequence
  Description of Artificial Sequence: Synthetic peptide
  Seed: ISRYTGYFPV (MAGC1_HUMAN)
ITRYTGYFPA

SEQ ID NO: 75781 - protein, 11 aa, Artificial Sequence
  Description of Artificial Sequence: Synthetic peptide
  Seed: SPFEGFPQSVL (MAGC1_HUMAN)
SPFEGFPQSVA

SEQ ID NO: 75782 - protein, 10 aa, Artificial Sequence
  Description of Artificial Sequence: Synthetic peptide
  Seed: SRYTGYFPVI (MAGC1_HUMAN)
SLYTGYFPVI

SEQ ID NO: 75783 - protein, 10 aa, Artificial Sequence
  Description of Artificial Sequence: Synthetic peptide
  Seed: YASEEVIWDV (MAGC1_HUMAN)
YLSEEVIWDV

SEQ ID NO: 75784 - protein, 10 aa, Artificial Sequence
  Description of Artificial Sequence: Synthetic peptide
  Seed: LQIVPSLPEW (MAGC1_HUMAN)
LMIVPSLPEF

SEQ ID NO: 75785 - protein, 11 aa, Artificial Sequence
  Description of Artificial Sequence: Synthetic peptide
  Seed: FLAMLKNTVPI (MAGC1_HUMAN)
FSAMLKNTVPI

SEQ ID NO: 75786 - protein, 10 aa, Artificial Sequence
  Description of Artificial Sequence: Synthetic peptide
  Seed: ASSSTLVSIF (MAGC1_HUMAN)
AVSSTLVSIW

SEQ ID NO: 75787 - protein, 9 aa, Artificial Sequence
  Description of Artificial Sequence: Synthetic peptide
  Seed: LQIPVSSSS (MAGC1_HUMAN)
LMIPVSSSI

SEQ ID NO: 75788 - protein, 9 aa, Artificial Sequence
  Description of Artificial Sequence: Synthetic peptide
  Seed: VIWDVLSGI (MAGC1_HUMAN)
VLWDVLSGS

SEQ ID NO: 75789 - protein, 9 aa, Artificial Sequence
  Description of Artificial Sequence: Synthetic peptide
  Seed: TKVWVQEHY (MAGC1_HUMAN)
TAVWVQEHY

SEQ ID NO: 75790 - protein, 11 aa, Artificial Sequence
  Description of Artificial Sequence: Synthetic peptide
  Seed: QSFSERTQSTF (MAGC1_HUMAN)
QSFSERTQSTW

SEQ ID NO: 75791 - protein, 9 aa, Artificial Sequence
  Description of Artificial Sequence: Synthetic peptide
  Seed: FFSSALLSI (MAGC1_HUMAN)
FSSSALLSV

SEQ ID NO: 75792 - protein, 9 aa, Artificial Sequence
  Description of Artificial Sequence: Synthetic peptide
  Seed: VSSSFSYTL (MAGC1_HUMAN)
VFSSFSYTL

SEQ ID NO: 75793 - protein, 10 aa, Artificial Sequence
  Description of Artificial Sequence: Synthetic peptide
  Seed: SSPERTHSTF (MAGC1_HUMAN)
STPERTHSTL

SEQ ID NO: 75794 - protein, 9 aa, Artificial Sequence
  Description of Artificial Sequence: Synthetic peptide
  Seed: SRYTGYFPV (MAGC1_HUMAN)
SKYTGYFPF

SEQ ID NO: 75795 - protein, 9 aa, Artificial Sequence
  Description of Artificial Sequence: Synthetic peptide
  Seed: RTHSTFEGF (MAGC1_HUMAN)
RYHSTFEGL

SEQ ID NO: 75796 - protein, 9 aa, Artificial Sequence
  Description of Artificial Sequence: Synthetic peptide
  Seed: SSSSTLLSL (MAGC1_HUMAN)
SASSTLLSM

SEQ ID NO: 75797 - protein, 10 aa, Artificial Sequence
  Description of Artificial Sequence: Synthetic peptide
  Seed: LQIPVSPSFS (MAGC1_HUMAN)
LTIPVSPSFY

SEQ ID NO: 75798 - protein, 9 aa, Artificial Sequence
  Description of Artificial Sequence: Synthetic peptide
  Seed: IPVSSSFSY (MAGC1_HUMAN)
IQVSSSFSH

SEQ ID NO: 75799 - protein, 10 aa, Artificial Sequence
  Description of Artificial Sequence: Synthetic peptide
  Seed: ICSSSTPSSL (MAGC1_HUMAN)
IYSSSTPSSF

SEQ ID NO: 75800 - protein, 10 aa, Artificial Sequence
  Description of Artificial Sequence: Synthetic peptide
  Seed: LAMLKNTVPI (MAGC1_HUMAN)
LEMLKNTVPM

SEQ ID NO: 75801 - protein, 11 aa, Artificial Sequence
  Description of Artificial Sequence: Synthetic peptide
  Seed: SICSSSTSLSL (MAGC1_HUMAN)
SLCSSSTSLSF

SEQ ID NO: 75802 - protein, 10 aa, Artificial Sequence
  Description of Artificial Sequence: Synthetic peptide
  Seed: SSPESAQSTF (MAGC1_HUMAN)
SGPESAQSTL

SEQ ID NO: 75803 - protein, 9 aa, Artificial Sequence
  Description of Artificial Sequence: Synthetic peptide
  Seed: LQIPVSRSF (MAGC1_HUMAN)
LHIPVSRSM

SEQ ID NO: 75804 - protein, 9 aa, Artificial Sequence
  Description of Artificial Sequence: Synthetic peptide
  Seed: VSRSFSSTL (MAGC1_HUMAN)
VFRSFSSTF

SEQ ID NO: 75805 - protein, 10 aa, Artificial Sequence
  Description of Artificial Sequence: Synthetic peptide
  Seed: IPVSSSFSYT (MAGC1_HUMAN)
IPVSSSFSYF

SEQ ID NO: 75806 - protein, 10 aa, Artificial Sequence
  Description of Artificial Sequence: Synthetic peptide
  Seed: SSPESAQSTF (MAGC1_HUMAN)
SRPESAQSTY

SEQ ID NO: 75807 - protein, 10 aa, Artificial Sequence
  Description of Artificial Sequence: Synthetic peptide
  Seed: SSFSYTLLSL (MAGC1_HUMAN)
STFSYTLLSW

SEQ ID NO: 75808 - protein, 9 aa, Artificial Sequence
  Description of Artificial Sequence: Synthetic peptide
  Seed: LQIPVSSSS (MAGC1_HUMAN)
LPIPVSSSF

SEQ ID NO: 75809 - protein, 11 aa, Artificial Sequence
  Description of Artificial Sequence: Synthetic peptide
  Seed: REVDPDDSYVF (MAGC1_HUMAN)
RIVDPDDSYVW

SEQ ID NO: 75810 - protein, 9 aa, Artificial Sequence
  Description of Artificial Sequence: Synthetic peptide
  Seed: SGIGVRAGR (MAGC1_HUMAN)
SVIGVRAGY

SEQ ID NO: 75811 - protein, 11 aa, Artificial Sequence
  Description of Artificial Sequence: Synthetic peptide
  Seed: SPLQIPVSSSS (MAGC1_HUMAN)
SWLQIPVSSSF

SEQ ID NO: 75812 - protein, 10 aa, Artificial Sequence
  Description of Artificial Sequence: Synthetic peptide
  Seed: SFPSSTSSSL (MAGC1_HUMAN)
SIPSSTSSSM

SEQ ID NO: 75813 - protein, 10 aa, Artificial Sequence
  Description of Artificial Sequence: Synthetic peptide
  Seed: FFSYTLASLL (MAGC1_HUMAN)
FMSYTLASLD

SEQ ID NO: 75814 - protein, 9 aa, Artificial Sequence
  Description of Artificial Sequence: Synthetic peptide
  Seed: SSSSSSSTL (MAGC1_HUMAN)
STSSSSSTF

SEQ ID NO: 75815 - protein, 9 aa, Artificial Sequence
  Description of Artificial Sequence: Synthetic peptide
  Seed: VSRSFSSTL (MAGC1_HUMAN)
VQRSFSSTF

SEQ ID NO: 75816 - protein, 9 aa, Artificial Sequence
  Description of Artificial Sequence: Synthetic peptide
  Seed: TLLSILQSS (MAGC1_HUMAN)
TILSILQSV

SEQ ID NO: 75817 - protein, 9 aa, Artificial Sequence
  Description of Artificial Sequence: Synthetic peptide
  Seed: FSEESSSPV (MAGC1_HUMAN)
FMEESSSPY

SEQ ID NO: 75818 - protein, 11 aa, Artificial Sequence
  Description of Artificial Sequence: Synthetic peptide
  Seed: SPLQRPVSSFF (MAGC1_HUMAN)
SFLQRPVSSFY

SEQ ID NO: 75819 - protein, 10 aa, Artificial Sequence
  Description of Artificial Sequence: Synthetic peptide
  Seed: SQSPPEGEDV (MAGC1_HUMAN)
SMSPPEGEDW

SEQ ID NO: 75820 - protein, 9 aa, Artificial Sequence
  Description of Artificial Sequence: Synthetic peptide
  Seed: FQSSLQSPV (MAGC1_HUMAN)
FRSSLQSPY

SEQ ID NO: 75821 - protein, 9 aa, Artificial Sequence
  Description of Artificial Sequence: Synthetic peptide
  Seed: MTSSFSSTL (MAGC1_HUMAN)
MGSSFSSTM

SEQ ID NO: 75822 - protein, 10 aa, Artificial Sequence
  Description of Artificial Sequence: Synthetic peptide
  Seed: FSSSTSLSPF (MAGC1_HUMAN)
FSSSTSLSPM

SEQ ID NO: 75823 - protein, 11 aa, Artificial Sequence
  Description of Artificial Sequence: Synthetic peptide
  Seed: SSFSYTLLSLF (MAGC1_HUMAN)
SKFSYTLLSLF

SEQ ID NO: 75824 - protein, 10 aa, Artificial Sequence
  Description of Artificial Sequence: Synthetic peptide
  Seed: FFSSALLSIF (MAGC1_HUMAN)
FLSSALLSIF

SEQ ID NO: 75825 - protein, 11 aa, Artificial Sequence
  Description of Artificial Sequence: Synthetic peptide
  Seed: REVPNSSPPRY (MAGC1_HUMAN)
RMVPNSSPPRF

SEQ ID NO: 75826 - protein, 10 aa, Artificial Sequence
  Description of Artificial Sequence: Synthetic peptide
  Seed: SSPESTQSPF (MAGC1_HUMAN)
SEPESTQSPM

SEQ ID NO: 75827 - protein, 9 aa, Artificial Sequence
  Description of Artificial Sequence: Synthetic peptide
  Seed: EDSLSPHYF (MAGC1_HUMAN)
EESLSPHYL

SEQ ID NO: 75828 - protein, 9 aa, Artificial Sequence
  Description of Artificial Sequence: Synthetic peptide
  Seed: IPVSPSFSS (MAGC1_HUMAN)
IPVSPSFSP

SEQ ID NO: 75829 - protein, 9 aa, Artificial Sequence
  Description of Artificial Sequence: Synthetic peptide
  Seed: MPTAGMPSL (MAGC1_HUMAN)
MTTAGMPSL

SEQ ID NO: 75830 - protein, 8 aa, Artificial Sequence
  Description of Artificial Sequence: Synthetic peptide
  Seed: FSYTLLSL (MAGC1_HUMAN)
FSYTLLSM

SEQ ID NO: 75831 - protein, 9 aa, Artificial Sequence
  Description of Artificial Sequence: Synthetic peptide
  Seed: FPSSYKDAL (MAGC1_HUMAN)
FQSSYKDAL

SEQ ID NO: 75832 - protein, 9 aa, Artificial Sequence
  Description of Artificial Sequence: Synthetic peptide
  Seed: LQIPVSPSF (MAGC1_HUMAN)
LEIPVSPSL

SEQ ID NO: 75833 - protein, 9 aa, Artificial Sequence
  Description of Artificial Sequence: Synthetic peptide
  Seed: ASSFFSSAL (MAGC1_HUMAN)
AFSFFSSAM

SEQ ID NO: 75834 - protein, 10 aa, Artificial Sequence
  Description of Artificial Sequence: Synthetic peptide
  Seed: TVPITFPSSY (MAGC1_HUMAN)
TTPITFPSSK

SEQ ID NO: 75835 - protein, 9 aa, Artificial Sequence
  Description of Artificial Sequence: Synthetic peptide
  Seed: FQSSLQSPV (MAGC1_HUMAN)
FLSSLQSPI

SEQ ID NO: 75836 - protein, 10 aa, Artificial Sequence
  Description of Artificial Sequence: Synthetic peptide
  Seed: FFSYTLASLL (MAGC1_HUMAN)
FFSYTLASLF

SEQ ID NO: 75837 - protein, 11 aa, Artificial Sequence
  Description of Artificial Sequence: Synthetic peptide
  Seed: FLAMLKNTVPI (MAGC1_HUMAN)
FFAMLKNTVPL

SEQ ID NO: 75838 - protein, 9 aa, Artificial Sequence
  Description of Artificial Sequence: Synthetic peptide
  Seed: VQSPLQNPA (MAGC1_HUMAN)
VVSPLQNPV

SEQ ID NO: 75839 - protein, 10 aa, Artificial Sequence
  Description of Artificial Sequence: Synthetic peptide
  Seed: GENTHSPLQI (MAGC1_HUMAN)
GENTHSPLQV

SEQ ID NO: 75840 - protein, 9 aa, Artificial Sequence
  Description of Artificial Sequence: Synthetic peptide
  Seed: TKVWVQEHY (MAGC1_HUMAN)
TWVWVQEHY

SEQ ID NO: 75841 - protein, 9 aa, Artificial Sequence
  Description of Artificial Sequence: Synthetic peptide
  Seed: SRYTGYFPV (MAGC1_HUMAN)
SEYTGYFPM

SEQ ID NO: 75842 - protein, 9 aa, Artificial Sequence
  Description of Artificial Sequence: Synthetic peptide
  Seed: ASSSTLVSI (MAGC1_HUMAN)
AKSSTLVSY

SEQ ID NO: 75843 - protein, 11 aa, Artificial Sequence
  Description of Artificial Sequence: Synthetic peptide
  Seed: IPVSSSFSYTL (MAGC1_HUMAN)
IAVSSSFSYTW

SEQ ID NO: 75844 - protein, 10 aa, Artificial Sequence
  Description of Artificial Sequence: Synthetic peptide
  Seed: PLQIPVSSSF (MAGC1_HUMAN)
PTQIPVSSSF

SEQ ID NO: 75845 - protein, 11 aa, Artificial Sequence
  Description of Artificial Sequence: Synthetic peptide
  Seed: IPVSSSSSSTL (MAGC1_HUMAN)
IGVSSSSSSTF

SEQ ID NO: 75846 - protein, 10 aa, Artificial Sequence
  Description of Artificial Sequence: Synthetic peptide
  Seed: FSSSTSLSPF (MAGC1_HUMAN)
FPSSTSLSPL

SEQ ID NO: 75847 - protein, 9 aa, Artificial Sequence
  Description of Artificial Sequence: Synthetic peptide
  Seed: YTSSSDTLL (MAGC1_HUMAN)
YSSSSDTLM

SEQ ID NO: 75848 - protein, 10 aa, Artificial Sequence
  Description of Artificial Sequence: Synthetic peptide
  Seed: SSPERTHSTF (MAGC1_HUMAN)
SQPERTHSTL

SEQ ID NO: 75849 - protein, 10 aa, Artificial Sequence
  Description of Artificial Sequence: Synthetic peptide
  Seed: FQSSLQSPVS (MAGC1_HUMAN)
FMSSLQSPVV

SEQ ID NO: 75850 - protein, 10 aa, Artificial Sequence
  Description of Artificial Sequence: Synthetic peptide
  Seed: ATESASSSVM (MAGC1_HUMAN)
AGESASSSVL

SEQ ID NO: 75851 - protein, 10 aa, Artificial Sequence
  Description of Artificial Sequence: Synthetic peptide
  Seed: ATESASSSVM (MAGC1_HUMAN)
AYESASSSVL

SEQ ID NO: 75852 - protein, 9 aa, Artificial Sequence
  Description of Artificial Sequence: Synthetic peptide
  Seed: KDSQSPLQI (MAGC1_HUMAN)
KISQSPLQV

SEQ ID NO: 75853 - protein, 9 aa, Artificial Sequence
  Description of Artificial Sequence: Synthetic peptide
  Seed: SLPQSFPES (MAGC1_HUMAN)
SMPQSFPEI

SEQ ID NO: 75854 - protein, 9 aa, Artificial Sequence
  Description of Artificial Sequence: Synthetic peptide
  Seed: FSEESSSPV (MAGC1_HUMAN)
FTEESSSPF

SEQ ID NO: 75855 - protein, 9 aa, Artificial Sequence
  Description of Artificial Sequence: Synthetic peptide
  Seed: TSLSLPQSF (MAGC1_HUMAN)
TRLSLPQSV

SEQ ID NO: 75856 - protein, 10 aa, Artificial Sequence
  Description of Artificial Sequence: Synthetic peptide
  Seed: LQIPVSPSFS (MAGC1_HUMAN)
LLIPVSPSFY

SEQ ID NO: 75857 - protein, 10 aa, Artificial Sequence
  Description of Artificial Sequence: Synthetic peptide
  Seed: GEDSLSPHYF (MAGC1_HUMAN)
GEDSLSPHYM

SEQ ID NO: 75858 - protein, 10 aa, Artificial Sequence
  Description of Artificial Sequence: Synthetic peptide
  Seed: SSPESTQSPF (MAGC1_HUMAN)
SNPESTQSPL

SEQ ID NO: 75859 - protein, 9 aa, Artificial Sequence
  Description of Artificial Sequence: Synthetic peptide
  Seed: VSSSSSSTL (MAGC1_HUMAN)
VTSSSSSTL

SEQ ID NO: 75860 - protein, 9 aa, Artificial Sequence
  Description of Artificial Sequence: Synthetic peptide
  Seed: LSDEQGMSQ (MAGC1_HUMAN)
LCDEQGMSF

SEQ ID NO: 75861 - protein, 9 aa, Artificial Sequence
  Description of Artificial Sequence: Synthetic peptide
  Seed: ASSSTLVSI (MAGC1_HUMAN)
AISSTLVSI

SEQ ID NO: 75862 - protein, 9 aa, Artificial Sequence
  Description of Artificial Sequence: Synthetic peptide
  Seed: VPITFPSSY (MAGC1_HUMAN)
VMITFPSSW

SEQ ID NO: 75863 - protein, 11 aa, Artificial Sequence
  Description of Artificial Sequence: Synthetic peptide
  Seed: SQSSPEGKDSL (MAGC1_HUMAN)
SLSSPEGKDSW

SEQ ID NO: 75864 - protein, 10 aa, Artificial Sequence
  Description of Artificial Sequence: Synthetic peptide
  Seed: EVIWDVLSGI (MAGC1_HUMAN)
EVIWDVLSGA

SEQ ID NO: 75865 - protein, 9 aa, Artificial Sequence
  Description of Artificial Sequence: Synthetic peptide
  Seed: SSFFSYTLA (MAGC1_HUMAN)
SAFFSYTLV

SEQ ID NO: 75866 - protein, 10 aa, Artificial Sequence
  Description of Artificial Sequence: Synthetic peptide
  Seed: SSPESAQSAF (MAGC1_HUMAN)
SMPESAQSAL

SEQ ID NO: 75867 - protein, 9 aa, Artificial Sequence
  Description of Artificial Sequence: Synthetic peptide
  Seed: SSPPRYEFL (MAGC1_HUMAN)
SYPPRYEFF

SEQ ID NO: 75868 - protein, 9 aa, Artificial Sequence
  Description of Artificial Sequence: Synthetic peptide
  Seed: LSDEQGMSQ (MAGC1_HUMAN)
LGDEQGMSM

SEQ ID NO: 75869 - protein, 10 aa, Artificial Sequence
  Description of Artificial Sequence: Synthetic peptide
  Seed: TVPITFPSSY (MAGC1_HUMAN)
TMPITFPSSM

SEQ ID NO: 75870 - protein, 9 aa, Artificial Sequence
  Description of Artificial Sequence: Synthetic peptide
  Seed: TLDLTSEGC (MAGC1_HUMAN)
TSDLTSEGM

SEQ ID NO: 75871 - protein, 9 aa, Artificial Sequence
  Description of Artificial Sequence: Synthetic peptide
  Seed: IESEPLFTY (MAGC1_HUMAN)
ITSEPLFTV

SEQ ID NO: 75872 - protein, 9 aa, Artificial Sequence
  Description of Artificial Sequence: Synthetic peptide
  Seed: RTHSTFEGF (MAGC1_HUMAN)
RSHSTFEGW

SEQ ID NO: 75873 - protein, 10 aa, Artificial Sequence
  Description of Artificial Sequence: Synthetic peptide
  Seed: YTLDEKVDEL (MAGC1_HUMAN)
YILDEKVDEL

SEQ ID NO: 75874 - protein, 8 aa, Artificial Sequence
  Description of Artificial Sequence: Synthetic peptide
  Seed: IFRKAREF (MAGC1_HUMAN)
IYRKAREL

SEQ ID NO: 75875 - protein, 9 aa, Artificial Sequence
  Description of Artificial Sequence: Synthetic peptide
  Seed: RPVSSFFSY (MAGC1_HUMAN)
RFVSSFFSF

SEQ ID NO: 75876 - protein, 9 aa, Artificial Sequence
  Description of Artificial Sequence: Synthetic peptide
  Seed: YQVKQPITK (MAGC1_HUMAN)
YKVKQPITF

SEQ ID NO: 75877 - protein, 10 aa, Artificial Sequence
  Description of Artificial Sequence: Synthetic peptide
  Seed: SFSSTLVSLF (MAGC1_HUMAN)
SSSSTLVSLF

SEQ ID NO: 75878 - protein, 9 aa, Artificial Sequence
  Description of Artificial Sequence: Synthetic peptide
  Seed: GDKDMPTAG (MAGC1_HUMAN)
GEKDMPTAM

SEQ ID NO: 75879 - protein, 9 aa, Artificial Sequence
  Description of Artificial Sequence: Synthetic peptide
  Seed: TLDEKVDEL (MAGC1_HUMAN)
TVDEKVDEI

SEQ ID NO: 75880 - protein, 11 aa, Artificial Sequence
  Description of Artificial Sequence: Synthetic peptide
  Seed: LLSLFQSFSER (MAGC1_HUMAN)
LYSLFQSFSER

SEQ ID NO: 75881 - protein, 9 aa, Artificial Sequence
  Description of Artificial Sequence: Synthetic peptide
  Seed: FSSTLLSLF (MAGC1_HUMAN)
FRSTLLSLY

SEQ ID NO: 75882 - protein, 9 aa, Artificial Sequence
  Description of Artificial Sequence: Synthetic peptide
  Seed: VSPSFSSTL (MAGC1_HUMAN)
VSPSFSSTW

SEQ ID NO: 75883 - protein, 9 aa, Artificial Sequence
  Description of Artificial Sequence: Synthetic peptide
  Seed: LQNPASSFF (MAGC1_HUMAN)
LMNPASSFW

SEQ ID NO: 75884 - protein, 9 aa, Artificial Sequence
  Description of Artificial Sequence: Synthetic peptide
  Seed: SPLQIVPSL (MAGC1_HUMAN)
SGLQIVPSY

SEQ ID NO: 75885 - protein, 9 aa, Artificial Sequence
  Description of Artificial Sequence: Synthetic peptide
  Seed: AQSPLQSPV (MAGC1_HUMAN)
AQSPLQSPL

SEQ ID NO: 75886 - protein, 9 aa, Artificial Sequence
  Description of Artificial Sequence: Synthetic peptide
  Seed: SPERTHSTF (MAGC1_HUMAN)
SAERTHSTY

SEQ ID NO: 75887 - protein, 9 aa, Artificial Sequence
  Description of Artificial Sequence: Synthetic peptide
  Seed: LQIPGSPSF (MAGC1_HUMAN)
LTIPGSPSI

SEQ ID NO: 75888 - protein, 9 aa, Artificial Sequence
  Description of Artificial Sequence: Synthetic peptide
  Seed: SSPERTHST (MAGC1_HUMAN)
SAPERTHSC

SEQ ID NO: 75889 - protein, 9 aa, Artificial Sequence
  Description of Artificial Sequence: Synthetic peptide
  Seed: FSYTLASLL (MAGC1_HUMAN)
FRYTLASLF

SEQ ID NO: 75890 - protein, 9 aa, Artificial Sequence
  Description of Artificial Sequence: Synthetic peptide
  Seed: WVQEHYLEY (MAGC1_HUMAN)
WSQEHYLEI

SEQ ID NO: 75891 - protein, 11 aa, Artificial Sequence
  Description of Artificial Sequence: Synthetic peptide
  Seed: SSSSSSTLLSL (MAGC1_HUMAN)
SASSSSTLLSF

SEQ ID NO: 75892 - protein, 9 aa, Artificial Sequence
  Description of Artificial Sequence: Synthetic peptide
  Seed: AQSPLQIPV (MAGC1_HUMAN)
AESPLQIPV

SEQ ID NO: 75893 - protein, 10 aa, Artificial Sequence
  Description of Artificial Sequence: Synthetic peptide
  Seed: SSPESAQSAF (MAGC1_HUMAN)
SPPESAQSAM

SEQ ID NO: 75894 - protein, 9 aa, Artificial Sequence
  Description of Artificial Sequence: Synthetic peptide
  Seed: KQPITKAEM (MAGC1_HUMAN)
KFPITKAEF

SEQ ID NO: 75895 - protein, 10 aa, Artificial Sequence
  Description of Artificial Sequence: Synthetic peptide
  Seed: KRKVVEFLAM (MAGC1_HUMAN)
KLKVVEFLAM

SEQ ID NO: 75896 - protein, 11 aa, Artificial Sequence
  Description of Artificial Sequence: Synthetic peptide
  Seed: SPLQIPGSPSF (MAGC1_HUMAN)
SMLQIPGSPSF

SEQ ID NO: 75897 - protein, 9 aa, Artificial Sequence
  Description of Artificial Sequence: Synthetic peptide
  Seed: SSSTLVSIF (MAGC1_HUMAN)
SKSTLVSIM

SEQ ID NO: 75898 - protein, 11 aa, Artificial Sequence
  Description of Artificial Sequence: Synthetic peptide
  Seed: SPLQIPVSSSS (MAGC1_HUMAN)
SALQIPVSSSF

SEQ ID NO: 75899 - protein, 10 aa, Artificial Sequence
  Description of Artificial Sequence: Synthetic peptide
  Seed: LHFPQSPPEW (MAGC1_HUMAN)
LWFPQSPPEF

SEQ ID NO: 75900 - protein, 9 aa, Artificial Sequence
  Description of Artificial Sequence: Synthetic peptide
  Seed: FAFGEPREL (MAGC1_HUMAN)
FPFGEPREW

SEQ ID NO: 75901 - protein, 9 aa, Artificial Sequence
  Description of Artificial Sequence: Synthetic peptide
  Seed: TLLSILQSS (MAGC1_HUMAN)
TLLSILQSM

SEQ ID NO: 75902 - protein, 9 aa, Artificial Sequence
  Description of Artificial Sequence: Synthetic peptide
  Seed: SIFQSSPER (MAGC1_HUMAN)
STFQSSPEM

SEQ ID NO: 75903 - protein, 9 aa, Artificial Sequence
  Description of Artificial Sequence: Synthetic peptide
  Seed: TFEGFPQSL (MAGC1_HUMAN)
TAEGFPQSY

SEQ ID NO: 75904 - protein, 9 aa, Artificial Sequence
  Description of Artificial Sequence: Synthetic peptide
  Seed: LQIPMTSSF (MAGC1_HUMAN)
LCIPMTSSW

SEQ ID NO: 75905 - protein, 9 aa, Artificial Sequence
  Description of Artificial Sequence: Synthetic peptide
  Seed: STQSPFEGF (MAGC1_HUMAN)
SQQSPFEGL

SEQ ID NO: 75906 - protein, 9 aa, Artificial Sequence
  Description of Artificial Sequence: Synthetic peptide
  Seed: SPHYFPQSP (MAGC1_HUMAN)
SPHYFPQSI

SEQ ID NO: 75907 - protein, 10 aa, Artificial Sequence
  Description of Artificial Sequence: Synthetic peptide
  Seed: AASSSTLVSI (MAGC1_HUMAN)
AASSSTLVSL

SEQ ID NO: 75908 - protein, 9 aa, Artificial Sequence
  Description of Artificial Sequence: Synthetic peptide
  Seed: VSSSSSSTL (MAGC1_HUMAN)
VSSSSSSTW

SEQ ID NO: 75909 - protein, 11 aa, Artificial Sequence
  Description of Artificial Sequence: Synthetic peptide
  Seed: SSTSLSLPQSF (MAGC1_HUMAN)
SPTSLSLPQSW

SEQ ID NO: 75910 - protein, 10 aa, Artificial Sequence
  Description of Artificial Sequence: Synthetic peptide
  Seed: VSRSFSSTLL (MAGC1_HUMAN)
VYRSFSSTLK

SEQ ID NO: 75911 - protein, 9 aa, Artificial Sequence
  Description of Artificial Sequence: Synthetic peptide
  Seed: STQSPFEGF (MAGC1_HUMAN)
SAQSPFEGW

SEQ ID NO: 75912 - protein, 11 aa, Artificial Sequence
  Description of Artificial Sequence: Synthetic peptide
  Seed: FLAMLKNTVPI (MAGC1_HUMAN)
FVAMLKNTVPI

SEQ ID NO: 75913 - protein, 10 aa, Artificial Sequence
  Description of Artificial Sequence: Synthetic peptide
  Seed: SSPESAQSTF (MAGC1_HUMAN)
SIPESAQSTF

SEQ ID NO: 75914 - protein, 11 aa, Artificial Sequence
  Description of Artificial Sequence: Synthetic peptide
  Seed: FLAMLKNTVPI (MAGC1_HUMAN)
FRAMLKNTVPV

SEQ ID NO: 75915 - protein, 9 aa, Artificial Sequence
  Description of Artificial Sequence: Synthetic peptide
  Seed: SEPLFTYTL (MAGC1_HUMAN)
SEPLFTYTW

SEQ ID NO: 75916 - protein, 10 aa, Artificial Sequence
  Description of Artificial Sequence: Synthetic peptide
  Seed: TESASSSVMS (MAGC1_HUMAN)
TESASSSVMA

SEQ ID NO: 75917 - protein, 10 aa, Artificial Sequence
  Description of Artificial Sequence: Synthetic peptide
  Seed: ASSSTLVSIF (MAGC1_HUMAN)
ASSSTLVSIY

SEQ ID NO: 75918 - protein, 10 aa, Artificial Sequence
  Description of Artificial Sequence: Synthetic peptide
  Seed: SFPSSTSSSL (MAGC1_HUMAN)
STPSSTSSSF

SEQ ID NO: 75919 - protein, 9 aa, Artificial Sequence
  Description of Artificial Sequence: Synthetic peptide
  Seed: MGDKDMPTA (MAGC1_HUMAN)
MYDKDMPTL

SEQ ID NO: 75920 - protein, 11 aa, Artificial Sequence
  Description of Artificial Sequence: Synthetic peptide
  Seed: IPVSPSSSSTL (MAGC1_HUMAN)
IAVSPSSSSTY

SEQ ID NO: 75921 - protein, 10 aa, Artificial Sequence
  Description of Artificial Sequence: Synthetic peptide
  Seed: LQIPVSPSFS (MAGC1_HUMAN)
LQIPVSPSFK

SEQ ID NO: 75922 - protein, 9 aa, Artificial Sequence
  Description of Artificial Sequence: Synthetic peptide
  Seed: TLDLTSEGC (MAGC1_HUMAN)
TLDLTSEGM

SEQ ID NO: 75923 - protein, 10 aa, Artificial Sequence
  Description of Artificial Sequence: Synthetic peptide
  Seed: ISRYTGYFPV (MAGC1_HUMAN)
ICRYTGYFPL

SEQ ID NO: 75924 - protein, 9 aa, Artificial Sequence
  Description of Artificial Sequence: Synthetic peptide
  Seed: SSSSTLLSL (MAGC1_HUMAN)
SFSSTLLSY

SEQ ID NO: 75925 - protein, 10 aa, Artificial Sequence
  Description of Artificial Sequence: Synthetic peptide
  Seed: LQIPGSPSFS (MAGC1_HUMAN)
LMIPGSPSFN

SEQ ID NO: 75926 - protein, 9 aa, Artificial Sequence
  Description of Artificial Sequence: Synthetic peptide
  Seed: LQIPVSAAS (MAGC1_HUMAN)
LQIPVSAAG

SEQ ID NO: 75927 - protein, 10 aa, Artificial Sequence
  Description of Artificial Sequence: Synthetic peptide
  Seed: FAQSSLQIPV (MAGC1_HUMAN)
FWQSSLQIPL

SEQ ID NO: 75928 - protein, 10 aa, Artificial Sequence
  Description of Artificial Sequence: Synthetic peptide
  Seed: PLQIPVSRSF (MAGC1_HUMAN)
PAQIPVSRSY

SEQ ID NO: 75929 - protein, 10 aa, Artificial Sequence
  Description of Artificial Sequence: Synthetic peptide
  Seed: SLSPLHFPQF (MAGC1_HUMAN)
SLSPLHFPQI

SEQ ID NO: 75930 - protein, 9 aa, Artificial Sequence
  Description of Artificial Sequence: Synthetic peptide
  Seed: FFSYTLASL (MAGC1_HUMAN)
FRSYTLASY

SEQ ID NO: 75931 - protein, 9 aa, Artificial Sequence
  Description of Artificial Sequence: Synthetic peptide
  Seed: IESEPLFTY (MAGC1_HUMAN)
IMSEPLFTF

SEQ ID NO: 75932 - protein, 9 aa, Artificial Sequence
  Description of Artificial Sequence: Synthetic peptide
  Seed: LQIPGSPSF (MAGC1_HUMAN)
LTIPGSPSY

SEQ ID NO: 75933 - protein, 9 aa, Artificial Sequence
  Description of Artificial Sequence: Synthetic peptide
  Seed: SEPLFTYTL (MAGC1_HUMAN)
SEPLFTYTV

SEQ ID NO: 75934 - protein, 9 aa, Artificial Sequence
  Description of Artificial Sequence: Synthetic peptide
  Seed: YTSSSDTLL (MAGC1_HUMAN)
YASSSDTLM

SEQ ID NO: 75935 - protein, 10 aa, Artificial Sequence
  Description of Artificial Sequence: Synthetic peptide
  Seed: SFPSSTSSSL (MAGC1_HUMAN)
SYPSSTSSSI

SEQ ID NO: 75936 - protein, 10 aa, Artificial Sequence
  Description of Artificial Sequence: Synthetic peptide
  Seed: MPTAGMPSLL (MAGC1_HUMAN)
MVTAGMPSLW

SEQ ID NO: 75937 - protein, 9 aa, Artificial Sequence
  Description of Artificial Sequence: Synthetic peptide
  Seed: VSPSSSSTL (MAGC1_HUMAN)
VPPSSSSTY

SEQ ID NO: 75938 - protein, 11 aa, Artificial Sequence
  Description of Artificial Sequence: Synthetic peptide
  Seed: SSFFSSALLSI (MAGC1_HUMAN)
STFFSSALLSW

SEQ ID NO: 75939 - protein, 9 aa, Artificial Sequence
  Description of Artificial Sequence: Synthetic peptide
  Seed: AGREHFAFG (MAGC1_HUMAN)
AAREHFAFK

SEQ ID NO: 75940 - protein, 10 aa, Artificial Sequence
  Description of Artificial Sequence: Synthetic peptide
  Seed: MLKNTVPITF (MAGC1_HUMAN)
MEKNTVPITM

SEQ ID NO: 75941 - protein, 10 aa, Artificial Sequence
  Description of Artificial Sequence: Synthetic peptide
  Seed: SFSSTLVSLF (MAGC1_HUMAN)
SQSSTLVSLF

SEQ ID NO: 75942 - protein, 9 aa, Artificial Sequence
  Description of Artificial Sequence: Synthetic peptide
  Seed: AGREHFAFG (MAGC1_HUMAN)
ASREHFAFY

SEQ ID NO: 75943 - protein, 10 aa, Artificial Sequence
  Description of Artificial Sequence: Synthetic peptide
  Seed: SFFSYTLASL (MAGC1_HUMAN)
SYFSYTLASW

SEQ ID NO: 75944 - protein, 9 aa, Artificial Sequence
  Description of Artificial Sequence: Synthetic peptide
  Seed: SFPSSTSSS (MAGC1_HUMAN)
SFPSSTSSY

SEQ ID NO: 75945 - protein, 9 aa, Artificial Sequence
  Description of Artificial Sequence: Synthetic peptide
  Seed: VSAASSSTL (MAGC1_HUMAN)
VVAASSSTV

SEQ ID NO: 75946 - protein, 10 aa, Artificial Sequence
  Description of Artificial Sequence: Synthetic peptide
  Seed: SSSSSTLLSL (MAGC1_HUMAN)
SASSSTLLSV

SEQ ID NO: 75947 - protein, 9 aa, Artificial Sequence
  Description of Artificial Sequence: Synthetic peptide
  Seed: AQSPLQRPV (MAGC1_HUMAN)
AHSPLQRPA

SEQ ID NO: 75948 - protein, 9 aa, Artificial Sequence
  Description of Artificial Sequence: Synthetic peptide
  Seed: LQIPVSPSF (MAGC1_HUMAN)
LDIPVSPSF

SEQ ID NO: 75949 - protein, 10 aa, Artificial Sequence
  Description of Artificial Sequence: Synthetic peptide
  Seed: SFPSSTSSSL (MAGC1_HUMAN)
SAPSSTSSSI

SEQ ID NO: 75950 - protein, 11 aa, Artificial Sequence
  Description of Artificial Sequence: Synthetic peptide
  Seed: LQRPVSSFFSY (MAGC1_HUMAN)
LNRPVSSFFSF

SEQ ID NO: 75951 - protein, 9 aa, Artificial Sequence
  Description of Artificial Sequence: Synthetic peptide
  Seed: SSFPSSTSS (MAGC1_HUMAN)
SSFPSSTSL

SEQ ID NO: 75952 - protein, 9 aa, Artificial Sequence
  Description of Artificial Sequence: Synthetic peptide
  Seed: SESLIESEP (MAGC1_HUMAN)
SESLIESEV

SEQ ID NO: 75953 - protein, 10 aa, Artificial Sequence
  Description of Artificial Sequence: Synthetic peptide
  Seed: LQIPVSSSFS (MAGC1_HUMAN)
LLIPVSSSFM

SEQ ID NO: 75954 - protein, 10 aa, Artificial Sequence
  Description of Artificial Sequence: Synthetic peptide
  Seed: TNVISRYTGY (MAGC1_HUMAN)
TTVISRYTGK

SEQ ID NO: 75955 - protein, 11 aa, Artificial Sequence
  Description of Artificial Sequence: Synthetic peptide
  Seed: VSSSSSSSTLL (MAGC1_HUMAN)
VESSSSSSTLW

SEQ ID NO: 75956 - protein, 9 aa, Artificial Sequence
  Description of Artificial Sequence: Synthetic peptide
  Seed: FSSTLLSLF (MAGC1_HUMAN)
FKSTLLSLF

SEQ ID NO: 75957 - protein, 10 aa, Artificial Sequence
  Description of Artificial Sequence: Synthetic peptide
  Seed: SPERTHSTFE (MAGC1_HUMAN)
SPERTHSTFI

SEQ ID NO: 75958 - protein, 11 aa, Artificial Sequence
  Description of Artificial Sequence: Synthetic peptide
  Seed: SLSQSSPVSSF (MAGC1_HUMAN)
SVSQSSPVSSY

SEQ ID NO: 75959 - protein, 10 aa, Artificial Sequence
  Description of Artificial Sequence: Synthetic peptide
  Seed: NPASSFFSSA (MAGC1_HUMAN)
NYASSFFSSV

SEQ ID NO: 75960 - protein, 11 aa, Artificial Sequence
  Description of Artificial Sequence: Synthetic peptide
  Seed: REVDPDDSYVF (MAGC1_HUMAN)
RLVDPDDSYVI

SEQ ID NO: 75961 - protein, 9 aa, Artificial Sequence
  Description of Artificial Sequence: Synthetic peptide
  Seed: MLTNVISRY (MAGC1_HUMAN)
MITNVISRW

SEQ ID NO: 75962 - protein, 8 aa, Artificial Sequence
  Description of Artificial Sequence: Synthetic peptide
  Seed: FSYTLASL (MAGC1_HUMAN)
FQYTLASV

SEQ ID NO: 75963 - protein, 10 aa, Artificial Sequence
  Description of Artificial Sequence: Synthetic peptide
  Seed: EVIWDVLSGI (MAGC1_HUMAN)
EYIWDVLSGI

SEQ ID NO: 75964 - protein, 10 aa, Artificial Sequence
  Description of Artificial Sequence: Synthetic peptide
  Seed: SFPSSTSSSL (MAGC1_HUMAN)
SAPSSTSSSV

SEQ ID NO: 75965 - protein, 9 aa, Artificial Sequence
  Description of Artificial Sequence: Synthetic peptide
  Seed: REVDPDDSY (MAGC1_HUMAN)
RIVDPDDSW

SEQ ID NO: 75966 - protein, 11 aa, Artificial Sequence
  Description of Artificial Sequence: Synthetic peptide
  Seed: SPLQIPVSRSF (MAGC1_HUMAN)
SHLQIPVSRSY

SEQ ID NO: 75967 - protein, 11 aa, Artificial Sequence
  Description of Artificial Sequence: Synthetic peptide
  Seed: SSSSSSTLLSL (MAGC1_HUMAN)
SSSSSSTLLSF

SEQ ID NO: 75968 - protein, 11 aa, Artificial Sequence
  Description of Artificial Sequence: Synthetic peptide
  Seed: IPVSSSSSSTL (MAGC1_HUMAN)
ILVSSSSSSTY

SEQ ID NO: 75969 - protein, 9 aa, Artificial Sequence
  Description of Artificial Sequence: Synthetic peptide
  Seed: FAFGEPREL (MAGC1_HUMAN)
FIFGEPREI

SEQ ID NO: 75970 - protein, 9 aa, Artificial Sequence
  Description of Artificial Sequence: Synthetic peptide
  Seed: VSSFFSYTL (MAGC1_HUMAN)
VVSFFSYTY

SEQ ID NO: 75971 - protein, 9 aa, Artificial Sequence
  Description of Artificial Sequence: Synthetic peptide
  Seed: LQNPASSFF (MAGC1_HUMAN)
LLNPASSFW

SEQ ID NO: 75972 - protein, 10 aa, Artificial Sequence
  Description of Artificial Sequence: Synthetic peptide
  Seed: MLKNTVPITF (MAGC1_HUMAN)
MMKNTVPITY

SEQ ID NO: 75973 - protein, 10 aa, Artificial Sequence
  Description of Artificial Sequence: Synthetic peptide
  Seed: YQVKQPITKA (MAGC1_HUMAN)
YMVKQPITKV

SEQ ID NO: 75974 - protein, 9 aa, Artificial Sequence
  Description of Artificial Sequence: Synthetic peptide
  Seed: SSPESDDTL (MAGC1_HUMAN)
SHPESDDTF

SEQ ID NO: 75975 - protein, 9 aa, Artificial Sequence
  Description of Artificial Sequence: Synthetic peptide
  Seed: MSQNRLLIL (MAGC1_HUMAN)
MSQNRLLII

SEQ ID NO: 75976 - protein, 9 aa, Artificial Sequence
  Description of Artificial Sequence: Synthetic peptide
  Seed: ASSSTLVSI (MAGC1_HUMAN)
ALSSTLVSW

SEQ ID NO: 75977 - protein, 9 aa, Artificial Sequence
  Description of Artificial Sequence: Synthetic peptide
  Seed: QVKQPITKA (MAGC1_HUMAN)
QMKQPITKY

SEQ ID NO: 75978 - protein, 9 aa, Artificial Sequence
  Description of Artificial Sequence: Synthetic peptide
  Seed: LQIPGSPSF (MAGC1_HUMAN)
LEIPGSPSA

SEQ ID NO: 75979 - protein, 9 aa, Artificial Sequence
  Description of Artificial Sequence: Synthetic peptide
  Seed: KAREFIEIL (MAGC1_HUMAN)
KSREFIEIA

SEQ ID NO: 75980 - protein, 9 aa, Artificial Sequence
  Description of Artificial Sequence: Synthetic peptide
  Seed: VSSFFSYTL (MAGC1_HUMAN)
VASFFSYTW

SEQ ID NO: 75981 - protein, 9 aa, Artificial Sequence
  Description of Artificial Sequence: Synthetic peptide
  Seed: KVWVQEHYL (MAGC1_HUMAN)
KTWVQEHYK

SEQ ID NO: 75982 - protein, 9 aa, Artificial Sequence
  Description of Artificial Sequence: Synthetic peptide
  Seed: SSPERTHST (MAGC1_HUMAN)
SRPERTHSI

SEQ ID NO: 75983 - protein, 9 aa, Artificial Sequence
  Description of Artificial Sequence: Synthetic peptide
  Seed: IPVSRSFSS (MAGC1_HUMAN)
IAVSRSFSY

SEQ ID NO: 75984 - protein, 9 aa, Artificial Sequence
  Description of Artificial Sequence: Synthetic peptide
  Seed: FPSSTSSSL (MAGC1_HUMAN)
FVSSTSSSM

SEQ ID NO: 75985 - protein, 9 aa, Artificial Sequence
  Description of Artificial Sequence: Synthetic peptide
  Seed: GEDSMSPLY (MAGC1_HUMAN)
GEDSMSPLF

SEQ ID NO: 75986 - protein, 10 aa, Artificial Sequence
  Description of Artificial Sequence: Synthetic peptide
  Seed: SYVFVNTLDL (MAGC1_HUMAN)
SYVFVNTLDM

SEQ ID NO: 75987 - protein, 10 aa, Artificial Sequence
  Description of Artificial Sequence: Synthetic peptide
  Seed: VSSSSSSSTL (MAGC1_HUMAN)
VGSSSSSSTY

SEQ ID NO: 75988 - protein, 11 aa, Artificial Sequence
  Description of Artificial Sequence: Synthetic peptide
  Seed: STFEGFPQSLL (MAGC1_HUMAN)
SMFEGFPQSLR

SEQ ID NO: 75989 - protein, 9 aa, Artificial Sequence
  Description of Artificial Sequence: Synthetic peptide
  Seed: SICSSSTSL (MAGC1_HUMAN)
SMCSSSTSF

SEQ ID NO: 75990 - protein, 10 aa, Artificial Sequence
  Description of Artificial Sequence: Synthetic peptide
  Seed: YTLASLLQSS (MAGC1_HUMAN)
YDLASLLQSM

SEQ ID NO: 75991 - protein, 9 aa, Artificial Sequence
  Description of Artificial Sequence: Synthetic peptide
  Seed: VSSFFSYTL (MAGC1_HUMAN)
VGSFFSYTW

SEQ ID NO: 75992 - protein, 10 aa, Artificial Sequence
  Description of Artificial Sequence: Synthetic peptide
  Seed: YTLDEKVDEL (MAGC1_HUMAN)
YFLDEKVDEV

SEQ ID NO: 75993 - protein, 10 aa, Artificial Sequence
  Description of Artificial Sequence: Synthetic peptide
  Seed: SPLQSPVISF (MAGC1_HUMAN)
SLLQSPVISF

SEQ ID NO: 75994 - protein, 8 aa, Artificial Sequence
  Description of Artificial Sequence: Synthetic peptide
  Seed: KVDELARF (MAGC1_HUMAN)
KIDELARL

SEQ ID NO: 75995 - protein, 9 aa, Artificial Sequence
  Description of Artificial Sequence: Synthetic peptide
  Seed: SSPEGKDSL (MAGC1_HUMAN)
SHPEGKDSI

SEQ ID NO: 75996 - protein, 11 aa, Artificial Sequence
  Description of Artificial Sequence: Synthetic peptide
  Seed: SPLQIPVSPSS (MAGC1_HUMAN)
SFLQIPVSPSY

SEQ ID NO: 75997 - protein, 11 aa, Artificial Sequence
  Description of Artificial Sequence: Synthetic peptide
  Seed: RYTGYFPVIFR (MAGC1_HUMAN)
RYTGYFPVIFL

SEQ ID NO: 75998 - protein, 10 aa, Artificial Sequence
  Description of Artificial Sequence: Synthetic peptide
  Seed: TVPITFPSSY (MAGC1_HUMAN)
TFPITFPSSM

SEQ ID NO: 75999 - protein, 9 aa, Artificial Sequence
  Description of Artificial Sequence: Synthetic peptide
  Seed: VSAASSSTL (MAGC1_HUMAN)
VMAASSSTM

SEQ ID NO: 76000 - protein, 9 aa, Artificial Sequence
  Description of Artificial Sequence: Synthetic peptide
  Seed: LKNTVPITF (MAGC1_HUMAN)
LENTVPITY

SEQ ID NO: 76001 - protein, 9 aa, Artificial Sequence
  Description of Artificial Sequence: Synthetic peptide
  Seed: SFFSYTLAS (MAGC1_HUMAN)
SAFSYTLAF

SEQ ID NO: 76002 - protein, 9 aa, Artificial Sequence
  Description of Artificial Sequence: Synthetic peptide
  Seed: FLWGPRAHS (MAGC1_HUMAN)
FLWGPRAHA

SEQ ID NO: 76003 - protein, 10 aa, Artificial Sequence
  Description of Artificial Sequence: Synthetic peptide
  Seed: PLQIPVSSSF (MAGC1_HUMAN)
PMQIPVSSSM

SEQ ID NO: 76004 - protein, 9 aa, Artificial Sequence
  Description of Artificial Sequence: Synthetic peptide
  Seed: ISFSSSTSL (MAGC1_HUMAN)
IPFSSSTSF

SEQ ID NO: 76005 - protein, 9 aa, Artificial Sequence
  Description of Artificial Sequence: Synthetic peptide
  Seed: SSFFSSALL (MAGC1_HUMAN)
SQFFSSALL

SEQ ID NO: 76006 - protein, 9 aa, Artificial Sequence
  Description of Artificial Sequence: Synthetic peptide
  Seed: LKNTVPITF (MAGC1_HUMAN)
LSNTVPITY

SEQ ID NO: 76007 - protein, 9 aa, Artificial Sequence
  Description of Artificial Sequence: Synthetic peptide
  Seed: SKSSPESPL (MAGC1_HUMAN)
SKSSPESPY

SEQ ID NO: 76008 - protein, 9 aa, Artificial Sequence
  Description of Artificial Sequence: Synthetic peptide
  Seed: KVDELARFL (MAGC1_HUMAN)
KVDELARFF

SEQ ID NO: 76009 - protein, 9 aa, Artificial Sequence
  Description of Artificial Sequence: Synthetic peptide
  Seed: KVWVQEHYL (MAGC1_HUMAN)
KLWVQEHYW

SEQ ID NO: 76010 - protein, 9 aa, Artificial Sequence
  Description of Artificial Sequence: Synthetic peptide
  Seed: SSPESTQSP (MAGC1_HUMAN)
SAPESTQSV

SEQ ID NO: 76011 - protein, 9 aa, Artificial Sequence
  Description of Artificial Sequence: Synthetic peptide
  Seed: LQSPVISFS (MAGC1_HUMAN)
LLSPVISFC

SEQ ID NO: 76012 - protein, 10 aa, Artificial Sequence
  Description of Artificial Sequence: Synthetic peptide
  Seed: LQIPVSPSFS (MAGC1_HUMAN)
LLIPVSPSFF

SEQ ID NO: 76013 - protein, 11 aa, Artificial Sequence
  Description of Artificial Sequence: Synthetic peptide
  Seed: LWGPRAHSEVI (MAGC1_HUMAN)
LEGPRAHSEVL

SEQ ID NO: 76014 - protein, 10 aa, Artificial Sequence
  Description of Artificial Sequence: Synthetic peptide
  Seed: WEDSLSPHYF (MAGC1_HUMAN)
WSDSLSPHYM

SEQ ID NO: 76015 - protein, 11 aa, Artificial Sequence
  Description of Artificial Sequence: Synthetic peptide
  Seed: RPVSSFFSYTL (MAGC1_HUMAN)
RNVSSFFSYTY

SEQ ID NO: 76016 - protein, 9 aa, Artificial Sequence
  Description of Artificial Sequence: Synthetic peptide
  Seed: FTYTLDEKV (MAGC1_HUMAN)
FTYTLDEKL

SEQ ID NO: 76017 - protein, 9 aa, Artificial Sequence
  Description of Artificial Sequence: Synthetic peptide
  Seed: FPSSYKDAL (MAGC1_HUMAN)
FRSSYKDAM

SEQ ID NO: 76018 - protein, 9 aa, Artificial Sequence
  Description of Artificial Sequence: Synthetic peptide
  Seed: LQIPMTSSF (MAGC1_HUMAN)
LTIPMTSSI

SEQ ID NO: 76019 - protein, 9 aa, Artificial Sequence
  Description of Artificial Sequence: Synthetic peptide
  Seed: MLTNVISRY (MAGC1_HUMAN)
MHTNVISRY

SEQ ID NO: 76020 - protein, 11 aa, Artificial Sequence
  Description of Artificial Sequence: Synthetic peptide
  Seed: IPVSSSFSYTL (MAGC1_HUMAN)
ILVSSSFSYTW

SEQ ID NO: 76021 - protein, 9 aa, Artificial Sequence
  Description of Artificial Sequence: Synthetic peptide
  Seed: STQSPFEGF (MAGC1_HUMAN)
SWQSPFEGF

SEQ ID NO: 76022 - protein, 9 aa, Artificial Sequence
  Description of Artificial Sequence: Synthetic peptide
  Seed: TLVSLFQSS (MAGC1_HUMAN)
TLVSLFQSV

SEQ ID NO: 76023 - protein, 10 aa, Artificial Sequence
  Description of Artificial Sequence: Synthetic peptide
  Seed: REFIEILFGI (MAGC1_HUMAN)
RMFIEILFGV

SEQ ID NO: 76024 - protein, 10 aa, Artificial Sequence
  Description of Artificial Sequence: Synthetic peptide
  Seed: LAMLKNTVPI (MAGC1_HUMAN)
LKMLKNTVPV

SEQ ID NO: 76025 - protein, 10 aa, Artificial Sequence
  Description of Artificial Sequence: Synthetic peptide
  Seed: EMLTNVISRY (MAGC1_HUMAN)
EVLTNVISRL

SEQ ID NO: 76026 - protein, 10 aa, Artificial Sequence
  Description of Artificial Sequence: Synthetic peptide
  Seed: SVLQIPVSAA (MAGC1_HUMAN)
SLLQIPVSAM

SEQ ID NO: 76027 - protein, 9 aa, Artificial Sequence
  Description of Artificial Sequence: Synthetic peptide
  Seed: WVQEHYLEY (MAGC1_HUMAN)
WYQEHYLEV

SEQ ID NO: 76028 - protein, 9 aa, Artificial Sequence
  Description of Artificial Sequence: Synthetic peptide
  Seed: MTSSFSSTL (MAGC1_HUMAN)
MPSSFSSTQ

SEQ ID NO: 76029 - protein, 10 aa, Artificial Sequence
  Description of Artificial Sequence: Synthetic peptide
  Seed: SFSSTLVSLF (MAGC1_HUMAN)
SASSTLVSLY

SEQ ID NO: 76030 - protein, 9 aa, Artificial Sequence
  Description of Artificial Sequence: Synthetic peptide
  Seed: CSSSTPSSL (MAGC1_HUMAN)
CSSSTPSSY

SEQ ID NO: 76031 - protein, 11 aa, Artificial Sequence
  Description of Artificial Sequence: Synthetic peptide
  Seed: MSPLYFPQSPL (MAGC1_HUMAN)
MTPLYFPQSPF

SEQ ID NO: 76032 - protein, 9 aa, Artificial Sequence
  Description of Artificial Sequence: Synthetic peptide
  Seed: FEGFPQSVL (MAGC1_HUMAN)
FAGFPQSVY

SEQ ID NO: 76033 - protein, 9 aa, Artificial Sequence
  Description of Artificial Sequence: Synthetic peptide
  Seed: SSSFSYTLL (MAGC1_HUMAN)
SMSFSYTLA

SEQ ID NO: 76034 - protein, 9 aa, Artificial Sequence
  Description of Artificial Sequence: Synthetic peptide
  Seed: SEPLFTYTL (MAGC1_HUMAN)
SQPLFTYTV

SEQ ID NO: 76035 - protein, 9 aa, Artificial Sequence
  Description of Artificial Sequence: Synthetic peptide
  Seed: SSFFSSALL (MAGC1_HUMAN)
SFFFSSALF

SEQ ID NO: 76036 - protein, 11 aa, Artificial Sequence
  Description of Artificial Sequence: Synthetic peptide
  Seed: RPVSSFFSYTL (MAGC1_HUMAN)
RTVSSFFSYTI

SEQ ID NO: 76037 - protein, 9 aa, Artificial Sequence
  Description of Artificial Sequence: Synthetic peptide
  Seed: TLVSIFQSS (MAGC1_HUMAN)
TIVSIFQSL

SEQ ID NO: 76038 - protein, 9 aa, Artificial Sequence
  Description of Artificial Sequence: Synthetic peptide
  Seed: SSPERTHST (MAGC1_HUMAN)
SWPERTHSY

SEQ ID NO: 76039 - protein, 9 aa, Artificial Sequence
  Description of Artificial Sequence: Synthetic peptide
  Seed: LQIPMTSSF (MAGC1_HUMAN)
LMIPMTSSV

SEQ ID NO: 76040 - protein, 9 aa, Artificial Sequence
  Description of Artificial Sequence: Synthetic peptide
  Seed: IEILFGISL (MAGC1_HUMAN)
IEILFGIST

SEQ ID NO: 76041 - protein, 11 aa, Artificial Sequence
  Description of Artificial Sequence: Synthetic peptide
  Seed: SRYTGYFPVIF (MAGC1_HUMAN)
SMYTGYFPVIF

SEQ ID NO: 76042 - protein, 8 aa, Artificial Sequence
  Description of Artificial Sequence: Synthetic peptide
  Seed: SSFSYTLL (MAGC1_HUMAN)
SQFSYTLI

SEQ ID NO: 76043 - protein, 10 aa, Artificial Sequence
  Description of Artificial Sequence: Synthetic peptide
  Seed: SFFSSALLSI (MAGC1_HUMAN)
SIFSSALLSF

SEQ ID NO: 76044 - protein, 9 aa, Artificial Sequence
  Description of Artificial Sequence: Synthetic peptide
  Seed: YQVKQPITK (MAGC1_HUMAN)
YMVKQPITM

SEQ ID NO: 76045 - protein, 9 aa, Artificial Sequence
  Description of Artificial Sequence: Synthetic peptide
  Seed: ASSSTLVSI (MAGC1_HUMAN)
AMSSTLVSA

SEQ ID NO: 76046 - protein, 9 aa, Artificial Sequence
  Description of Artificial Sequence: Synthetic peptide
  Seed: FQSSLQSPV (MAGC1_HUMAN)
FVSSLQSPT

SEQ ID NO: 76047 - protein, 11 aa, Artificial Sequence
  Description of Artificial Sequence: Synthetic peptide
  Seed: RSFSSTLLSIF (MAGC1_HUMAN)
RVFSSTLLSIW

SEQ ID NO: 76048 - protein, 10 aa, Artificial Sequence
  Description of Artificial Sequence: Synthetic peptide
  Seed: TTDDSTATES (MAGC1_HUMAN)
TGDDSTATEM

SEQ ID NO: 76049 - protein, 9 aa, Artificial Sequence
  Description of Artificial Sequence: Synthetic peptide
  Seed: SFFSYTLAS (MAGC1_HUMAN)
SVFSYTLAM

SEQ ID NO: 76050 - protein, 11 aa, Artificial Sequence
  Description of Artificial Sequence: Synthetic peptide
  Seed: QSSPERTQSTF (MAGC1_HUMAN)
QMSPERTQSTW

SEQ ID NO: 76051 - protein, 10 aa, Artificial Sequence
  Description of Artificial Sequence: Synthetic peptide
  Seed: FFSYTLASLL (MAGC1_HUMAN)
FVSYTLASLW

SEQ ID NO: 76052 - protein, 11 aa, Artificial Sequence
  Description of Artificial Sequence: Synthetic peptide
  Seed: IPVSSSFSYTL (MAGC1_HUMAN)
IQVSSSFSYTW

SEQ ID NO: 76053 - protein, 11 aa, Artificial Sequence
  Description of Artificial Sequence: Synthetic peptide
  Seed: VDEYTSSSDTL (MAGC1_HUMAN)
VFEYTSSSDTF

SEQ ID NO: 76054 - protein, 9 aa, Artificial Sequence
  Description of Artificial Sequence: Synthetic peptide
  Seed: SSFFSYTLA (MAGC1_HUMAN)
SMFFSYTLV

SEQ ID NO: 76055 - protein, 10 aa, Artificial Sequence
  Description of Artificial Sequence: Synthetic peptide
  Seed: SSSSSSSTLL (MAGC1_HUMAN)
SLSSSSSTLW

SEQ ID NO: 76056 - protein, 9 aa, Artificial Sequence
  Description of Artificial Sequence: Synthetic peptide
  Seed: SASSSVMSP (MAGC1_HUMAN)
SGSSSVMSY

SEQ ID NO: 76057 - protein, 9 aa, Artificial Sequence
  Description of Artificial Sequence: Synthetic peptide
  Seed: STQSPFEGF (MAGC1_HUMAN)
SAQSPFEGY

SEQ ID NO: 76058 - protein, 9 aa, Artificial Sequence
  Description of Artificial Sequence: Synthetic peptide
  Seed: VSAASSSTL (MAGC1_HUMAN)
VKAASSSTL

SEQ ID NO: 76059 - protein, 11 aa, Artificial Sequence
  Description of Artificial Sequence: Synthetic peptide
  Seed: AIIDTTDDSTA (MAGC1_HUMAN)
AMIDTTDDSTI

SEQ ID NO: 76060 - protein, 9 aa, Artificial Sequence
  Description of Artificial Sequence: Synthetic peptide
  Seed: FSYTLASLL (MAGC1_HUMAN)
FLYTLASLF

SEQ ID NO: 76061 - protein, 9 aa, Artificial Sequence
  Description of Artificial Sequence: Synthetic peptide
  Seed: VPITFPSSY (MAGC1_HUMAN)
VVITFPSSM

SEQ ID NO: 76062 - protein, 11 aa, Artificial Sequence
  Description of Artificial Sequence: Synthetic peptide
  Seed: TTDDSTATESA (MAGC1_HUMAN)
TVDDSTATESY

SEQ ID NO: 76063 - protein, 10 aa, Artificial Sequence
  Description of Artificial Sequence: Synthetic peptide
  Seed: LAMLKNTVPI (MAGC1_HUMAN)
LGMLKNTVPM

SEQ ID NO: 76064 - protein, 9 aa, Artificial Sequence
  Description of Artificial Sequence: Synthetic peptide
  Seed: MSQNRLLIL (MAGC1_HUMAN)
MLQNRLLIV

SEQ ID NO: 76065 - protein, 11 aa, Artificial Sequence
  Description of Artificial Sequence: Synthetic peptide
  Seed: SPLQIPMTSSF (MAGC1_HUMAN)
SFLQIPMTSSF

SEQ ID NO: 76066 - protein, 10 aa, Artificial Sequence
  Description of Artificial Sequence: Synthetic peptide
  Seed: SQSPPEGEDV (MAGC1_HUMAN)
SHSPPEGEDL

SEQ ID NO: 76067 - protein, 9 aa, Artificial Sequence
  Description of Artificial Sequence: Synthetic peptide
  Seed: RSFSSTLLS (MAGC1_HUMAN)
RVFSSTLLF

SEQ ID NO: 76068 - protein, 10 aa, Artificial Sequence
  Description of Artificial Sequence: Synthetic peptide
  Seed: ISRYTGYFPV (MAGC1_HUMAN)
IHRYTGYFPL

SEQ ID NO: 76069 - protein, 9 aa, Artificial Sequence
  Description of Artificial Sequence: Synthetic peptide
  Seed: ASSSTLVSI (MAGC1_HUMAN)
AASSTLVSY

SEQ ID NO: 76070 - protein, 10 aa, Artificial Sequence
  Description of Artificial Sequence: Synthetic peptide
  Seed: SLQIPVSPSF (MAGC1_HUMAN)
SNQIPVSPSY

SEQ ID NO: 76071 - protein, 11 aa, Artificial Sequence
  Description of Artificial Sequence: Synthetic peptide
  Seed: SSFSYTLLSLF (MAGC1_HUMAN)
SHFSYTLLSLW

SEQ ID NO: 76072 - protein, 9 aa, Artificial Sequence
  Description of Artificial Sequence: Synthetic peptide
  Seed: FSEESSSPV (MAGC1_HUMAN)
FSEESSSPL

SEQ ID NO: 76073 - protein, 10 aa, Artificial Sequence
  Description of Artificial Sequence: Synthetic peptide
  Seed: YTLASLLQSS (MAGC1_HUMAN)
YFLASLLQSI

SEQ ID NO: 76074 - protein, 10 aa, Artificial Sequence
  Description of Artificial Sequence: Synthetic peptide
  Seed: EILFGISLRE (MAGC1_HUMAN)
EQLFGISLRK

SEQ ID NO: 76075 - protein, 9 aa, Artificial Sequence
  Description of Artificial Sequence: Synthetic peptide
  Seed: LSPLHFPQF (MAGC1_HUMAN)
LFPLHFPQF

SEQ ID NO: 76076 - protein, 9 aa, Artificial Sequence
  Description of Artificial Sequence: Synthetic peptide
  Seed: YVFVNTLDL (MAGC1_HUMAN)
YTFVNTLDL

SEQ ID NO: 76077 - protein, 10 aa, Artificial Sequence
  Description of Artificial Sequence: Synthetic peptide
  Seed: WGPRAHSEVI (MAGC1_HUMAN)
WTPRAHSEVM

SEQ ID NO: 76078 - protein, 10 aa, Artificial Sequence
  Description of Artificial Sequence: Synthetic peptide
  Seed: SSSSSTLLSL (MAGC1_HUMAN)
SLSSSTLLSV

SEQ ID NO: 76079 - protein, 10 aa, Artificial Sequence
  Description of Artificial Sequence: Synthetic peptide
  Seed: FPQSLLQIPM (MAGC1_HUMAN)
FYQSLLQIPY

SEQ ID NO: 76080 - protein, 11 aa, Artificial Sequence
  Description of Artificial Sequence: Synthetic peptide
  Seed: LQIPVSSSFSY (MAGC1_HUMAN)
LPIPVSSSFSM

SEQ ID NO: 76081 - protein, 9 aa, Artificial Sequence
  Description of Artificial Sequence: Synthetic peptide
  Seed: SSSSSSSTL (MAGC1_HUMAN)
SFSSSSSTY

SEQ ID NO: 76082 - protein, 9 aa, Artificial Sequence
  Description of Artificial Sequence: Synthetic peptide
  Seed: SSFSSTLLS (MAGC1_HUMAN)
SYFSSTLLK

SEQ ID NO: 76083 - protein, 10 aa, Artificial Sequence
  Description of Artificial Sequence: Synthetic peptide
  Seed: PMTSSFSSTL (MAGC1_HUMAN)
PYTSSFSSTV

SEQ ID NO: 76084 - protein, 9 aa, Artificial Sequence
  Description of Artificial Sequence: Synthetic peptide
  Seed: SLSPFSEES (MAGC1_HUMAN)
SMSPFSEEM

SEQ ID NO: 76085 - protein, 9 aa, Artificial Sequence
  Description of Artificial Sequence: Synthetic peptide
  Seed: EDSSDPLQR (MAGC1_HUMAN)
ETSSDPLQR

SEQ ID NO: 76086 - protein, 8 aa, Artificial Sequence
  Description of Artificial Sequence: Synthetic peptide
  Seed: QSSPVSSF (MAGC1_HUMAN)
QFSPVSSF

SEQ ID NO: 76087 - protein, 10 aa, Artificial Sequence
  Description of Artificial Sequence: Synthetic peptide
  Seed: FSSSTSLSPF (MAGC1_HUMAN)
FPSSTSLSPW

SEQ ID NO: 76088 - protein, 9 aa, Artificial Sequence
  Description of Artificial Sequence: Synthetic peptide
  Seed: VPITFPSSY (MAGC1_HUMAN)
VRITFPSSL

SEQ ID NO: 76089 - protein, 9 aa, Artificial Sequence
  Description of Artificial Sequence: Synthetic peptide
  Seed: FSSTLVSLF (MAGC1_HUMAN)
FASTLVSLL

SEQ ID NO: 76090 - protein, 9 aa, Artificial Sequence
  Description of Artificial Sequence: Synthetic peptide
  Seed: GSPSFSSTL (MAGC1_HUMAN)
GQPSFSSTY

SEQ ID NO: 76091 - protein, 9 aa, Artificial Sequence
  Description of Artificial Sequence: Synthetic peptide
  Seed: AGREHFAFG (MAGC1_HUMAN)
ASREHFAFN

SEQ ID NO: 76092 - protein, 10 aa, Artificial Sequence
  Description of Artificial Sequence: Synthetic peptide
  Seed: VISFSSSTSL (MAGC1_HUMAN)
VTSFSSSTSW

SEQ ID NO: 76093 - protein, 9 aa, Artificial Sequence
  Description of Artificial Sequence: Synthetic peptide
  Seed: STFEGFAQS (MAGC1_HUMAN)
SSFEGFAQA

SEQ ID NO: 76094 - protein, 9 aa, Artificial Sequence
  Description of Artificial Sequence: Synthetic peptide
  Seed: SPERTHSTF (MAGC1_HUMAN)
SPERTHSTI

SEQ ID NO: 76095 - protein, 10 aa, Artificial Sequence
  Description of Artificial Sequence: Synthetic peptide
  Seed: ISRYTGYFPV (MAGC1_HUMAN)
IGRYTGYFPM

SEQ ID NO: 76096 - protein, 9 aa, Artificial Sequence
  Description of Artificial Sequence: Synthetic peptide
  Seed: MSQNRLLIL (MAGC1_HUMAN)
MEQNRLLIM

SEQ ID NO: 76097 - protein, 11 aa, Artificial Sequence
  Description of Artificial Sequence: Synthetic peptide
  Seed: FQSSLQSPVSI (MAGC1_HUMAN)
FQSSLQSPVSY

SEQ ID NO: 76098 - protein, 11 aa, Artificial Sequence
  Description of Artificial Sequence: Synthetic peptide
  Seed: YTGYFPVIFRK (MAGC1_HUMAN)
YWGYFPVIFRR

SEQ ID NO: 76099 - protein, 10 aa, Artificial Sequence
  Description of Artificial Sequence: Synthetic peptide
  Seed: ESAQSAFEGF (MAGC1_HUMAN)
ETAQSAFEGK

SEQ ID NO: 76100 - protein, 9 aa, Artificial Sequence
  Description of Artificial Sequence: Synthetic peptide
  Seed: RTQSTFEGF (MAGC1_HUMAN)
RFQSTFEGL

SEQ ID NO: 76101 - protein, 9 aa, Artificial Sequence
  Description of Artificial Sequence: Synthetic peptide
  Seed: FSYTLLSLF (MAGC1_HUMAN)
FHYTLLSLY

SEQ ID NO: 76102 - protein, 10 aa, Artificial Sequence
  Description of Artificial Sequence: Synthetic peptide
  Seed: MSQNRLLILI (MAGC1_HUMAN)
MLQNRLLILA

SEQ ID NO: 76103 - protein, 9 aa, Artificial Sequence
  Description of Artificial Sequence: Synthetic peptide
  Seed: FSSALLSIF (MAGC1_HUMAN)
FKSALLSIM

SEQ ID NO: 76104 - protein, 11 aa, Artificial Sequence
  Description of Artificial Sequence: Synthetic peptide
  Seed: TLDEKVDELAR (MAGC1_HUMAN)
TADEKVDELAM

SEQ ID NO: 76105 - protein, 11 aa, Artificial Sequence
  Description of Artificial Sequence: Synthetic peptide
  Seed: IPVSRSFSSTL (MAGC1_HUMAN)
IVVSRSFSSTF

SEQ ID NO: 76106 - protein, 9 aa, Artificial Sequence
  Description of Artificial Sequence: Synthetic peptide
  Seed: NSSPPRYEF (MAGC1_HUMAN)
NFSPPRYEF

SEQ ID NO: 76107 - protein, 11 aa, Artificial Sequence
  Description of Artificial Sequence: Synthetic peptide
  Seed: RYTGYFPVIFR (MAGC1_HUMAN)
RHTGYFPVIFR

SEQ ID NO: 76108 - protein, 10 aa, Artificial Sequence
  Description of Artificial Sequence: Synthetic peptide
  Seed: LHFPQSPPEW (MAGC1_HUMAN)
LAFPQSPPEW

SEQ ID NO: 76109 - protein, 9 aa, Artificial Sequence
  Description of Artificial Sequence: Synthetic peptide
  Seed: ILILSIIFI (MAGC1_HUMAN)
ILILSIIFV

SEQ ID NO: 76110 - protein, 9 aa, Artificial Sequence
  Description of Artificial Sequence: Synthetic peptide
  Seed: TLLSILQSS (MAGC1_HUMAN)
TMLSILQSI

SEQ ID NO: 76111 - protein, 9 aa, Artificial Sequence
  Description of Artificial Sequence: Synthetic peptide
  Seed: SSSESPQSC (MAGC1_HUMAN)
STSESPQSV

SEQ ID NO: 76112 - protein, 9 aa, Artificial Sequence
  Description of Artificial Sequence: Synthetic peptide
  Seed: LQIVPSLPE (MAGC1_HUMAN)
LNIVPSLPM

SEQ ID NO: 76113 - protein, 9 aa, Artificial Sequence
  Description of Artificial Sequence: Synthetic peptide
  Seed: SSSTLLSLF (MAGC1_HUMAN)
SMSTLLSLF

SEQ ID NO: 76114 - protein, 11 aa, Artificial Sequence
  Description of Artificial Sequence: Synthetic peptide
  Seed: QSSPESDDTLY (MAGC1_HUMAN)
QTSPESDDTLF

SEQ ID NO: 76115 - protein, 9 aa, Artificial Sequence
  Description of Artificial Sequence: Synthetic peptide
  Seed: MLTNVISRY (MAGC1_HUMAN)
MMTNVISRR

SEQ ID NO: 76116 - protein, 10 aa, Artificial Sequence
  Description of Artificial Sequence: Synthetic peptide
  Seed: SSSSSTLLSL (MAGC1_HUMAN)
SQSSSTLLSF

SEQ ID NO: 76117 - protein, 9 aa, Artificial Sequence
  Description of Artificial Sequence: Synthetic peptide
  Seed: KVWVQEHYL (MAGC1_HUMAN)
KQWVQEHYY

SEQ ID NO: 76118 - protein, 9 aa, Artificial Sequence
  Description of Artificial Sequence: Synthetic peptide
  Seed: RPVSSFFSY (MAGC1_HUMAN)
RMVSSFFSF

SEQ ID NO: 76119 - protein, 9 aa, Artificial Sequence
  Description of Artificial Sequence: Synthetic peptide
  Seed: SAQSAFEGF (MAGC1_HUMAN)
SVQSAFEGF

SEQ ID NO: 76120 - protein, 10 aa, Artificial Sequence
  Description of Artificial Sequence: Synthetic peptide
  Seed: ATESASSSVM (MAGC1_HUMAN)
AFESASSSVW

SEQ ID NO: 76121 - protein, 9 aa, Artificial Sequence
  Description of Artificial Sequence: Synthetic peptide
  Seed: SSSVMSPSF (MAGC1_HUMAN)
SISVMSPSF

SEQ ID NO: 76122 - protein, 9 aa, Artificial Sequence
  Description of Artificial Sequence: Synthetic peptide
  Seed: FPQSLLQIP (MAGC1_HUMAN)
FPQSLLQIV

SEQ ID NO: 76123 - protein, 9 aa, Artificial Sequence
  Description of Artificial Sequence: Synthetic peptide
  Seed: KDMPTAGMP (MAGC1_HUMAN)
KEMPTAGMI

SEQ ID NO: 76124 - protein, 9 aa, Artificial Sequence
  Description of Artificial Sequence: Synthetic peptide
  Seed: STFEGFAQS (MAGC1_HUMAN)
SMFEGFAQC

SEQ ID NO: 76125 - protein, 9 aa, Artificial Sequence
  Description of Artificial Sequence: Synthetic peptide
  Seed: SPLQSPVSS (MAGC1_HUMAN)
SPLQSPVSP

SEQ ID NO: 76126 - protein, 11 aa, Artificial Sequence
  Description of Artificial Sequence: Synthetic peptide
  Seed: SSFSYTLLSLF (MAGC1_HUMAN)
SMFSYTLLSLY

SEQ ID NO: 76127 - protein, 11 aa, Artificial Sequence
  Description of Artificial Sequence: Synthetic peptide
  Seed: SAASSSTLVSI (MAGC1_HUMAN)
SAASSSTLVSL

SEQ ID NO: 76128 - protein, 10 aa, Artificial Sequence
  Description of Artificial Sequence: Synthetic peptide
  Seed: VISFSSSTSL (MAGC1_HUMAN)
VSSFSSSTSF

SEQ ID NO: 76129 - protein, 9 aa, Artificial Sequence
  Description of Artificial Sequence: Synthetic peptide
  Seed: AGREHFAFG (MAGC1_HUMAN)
AIREHFAFM

SEQ ID NO: 76130 - protein, 9 aa, Artificial Sequence
  Description of Artificial Sequence: Synthetic peptide
  Seed: NPASSFFSS (MAGC1_HUMAN)
NMASSFFSM

SEQ ID NO: 76131 - protein, 10 aa, Artificial Sequence
  Description of Artificial Sequence: Synthetic peptide
  Seed: LLQIPMTSSF (MAGC1_HUMAN)
LDQIPMTSSF

SEQ ID NO: 76132 - protein, 9 aa, Artificial Sequence
  Description of Artificial Sequence: Synthetic peptide
  Seed: EVDPDDSYV (MAGC1_HUMAN)
EVDPDDSYM

SEQ ID NO: 76133 - protein, 9 aa, Artificial Sequence
  Description of Artificial Sequence: Synthetic peptide
  Seed: SPVSICSSS (MAGC1_HUMAN)
SPVSICSSM

SEQ ID NO: 76134 - protein, 10 aa, Artificial Sequence
  Description of Artificial Sequence: Synthetic peptide
  Seed: SQSPPEGEDV (MAGC1_HUMAN)
SESPPEGEDA

SEQ ID NO: 76135 - protein, 10 aa, Artificial Sequence
  Description of Artificial Sequence: Synthetic peptide
  Seed: LLQIPMTSSF (MAGC1_HUMAN)
LRQIPMTSSY

SEQ ID NO: 76136 - protein, 9 aa, Artificial Sequence
  Description of Artificial Sequence: Synthetic peptide
  Seed: FSSALLSIF (MAGC1_HUMAN)
FLSALLSIY

SEQ ID NO: 76137 - protein, 11 aa, Artificial Sequence
  Description of Artificial Sequence: Synthetic peptide
  Seed: IPVSPSFSSTL (MAGC1_HUMAN)
IPVSPSFSSTA

SEQ ID NO: 76138 - protein, 10 aa, Artificial Sequence
  Description of Artificial Sequence: Synthetic peptide
  Seed: RAGREHFAFG (MAGC1_HUMAN)
RSGREHFAFY

SEQ ID NO: 76139 - protein, 11 aa, Artificial Sequence
  Description of Artificial Sequence: Synthetic peptide
  Seed: IPMTSSFSSTL (MAGC1_HUMAN)
IYMTSSFSSTY

SEQ ID NO: 76140 - protein, 10 aa, Artificial Sequence
  Description of Artificial Sequence: Synthetic peptide
  Seed: RAGREHFAFG (MAGC1_HUMAN)
RWGREHFAFV

SEQ ID NO: 76141 - protein, 9 aa, Artificial Sequence
  Description of Artificial Sequence: Synthetic peptide
  Seed: VIKRKVVEF (MAGC1_HUMAN)
VPKRKVVEM

SEQ ID NO: 76142 - protein, 9 aa, Artificial Sequence
  Description of Artificial Sequence: Synthetic peptide
  Seed: VSPSFSSTL (MAGC1_HUMAN)
VCPSFSSTL

SEQ ID NO: 76143 - protein, 9 aa, Artificial Sequence
  Description of Artificial Sequence: Synthetic peptide
  Seed: DSYVFVNTL (MAGC1_HUMAN)
DPYVFVNTW

SEQ ID NO: 76144 - protein, 10 aa, Artificial Sequence
  Description of Artificial Sequence: Synthetic peptide
  Seed: MLTNVISRYT (MAGC1_HUMAN)
MQTNVISRYV

SEQ ID NO: 76145 - protein, 9 aa, Artificial Sequence
  Description of Artificial Sequence: Synthetic peptide
  Seed: SSPECTQST (MAGC1_HUMAN)
SMPECTQSL

SEQ ID NO: 76146 - protein, 9 aa, Artificial Sequence
  Description of Artificial Sequence: Synthetic peptide
  Seed: FPSSYKDAL (MAGC1_HUMAN)
FHSSYKDAV

SEQ ID NO: 76147 - protein, 10 aa, Artificial Sequence
  Description of Artificial Sequence: Synthetic peptide
  Seed: YVFVNTLDLT (MAGC1_HUMAN)
YQFVNTLDLA

SEQ ID NO: 76148 - protein, 9 aa, Artificial Sequence
  Description of Artificial Sequence: Synthetic peptide
  Seed: KAREFIEIL (MAGC1_HUMAN)
KAREFIEIA

SEQ ID NO: 76149 - protein, 11 aa, Artificial Sequence
  Description of Artificial Sequence: Synthetic peptide
  Seed: IPMTSSFSSTL (MAGC1_HUMAN)
IKMTSSFSSTY

SEQ ID NO: 76150 - protein, 10 aa, Artificial Sequence
  Description of Artificial Sequence: Synthetic peptide
  Seed: LAMLKNTVPI (MAGC1_HUMAN)
LMMLKNTVPL

SEQ ID NO: 76151 - protein, 9 aa, Artificial Sequence
  Description of Artificial Sequence: Synthetic peptide
  Seed: FSSTLLSLF (MAGC1_HUMAN)
FTSTLLSLV

SEQ ID NO: 76152 - protein, 11 aa, Artificial Sequence
  Description of Artificial Sequence: Synthetic peptide
  Seed: FLAMLKNTVPI (MAGC1_HUMAN)
FEAMLKNTVPV

SEQ ID NO: 76153 - protein, 9 aa, Artificial Sequence
  Description of Artificial Sequence: Synthetic peptide
  Seed: LQIPVSRSF (MAGC1_HUMAN)
LLIPVSRSF

SEQ ID NO: 76154 - protein, 10 aa, Artificial Sequence
  Description of Artificial Sequence: Synthetic peptide
  Seed: FQSSLQSPVS (MAGC1_HUMAN)
FISSLQSPVV

SEQ ID NO: 76155 - protein, 9 aa, Artificial Sequence
  Description of Artificial Sequence: Synthetic peptide
  Seed: FLAMLKNTV (MAGC1_HUMAN)
FTAMLKNTY

SEQ ID NO: 76156 - protein, 10 aa, Artificial Sequence
  Description of Artificial Sequence: Synthetic peptide
  Seed: YTLASLLQSS (MAGC1_HUMAN)
YNLASLLQSA

SEQ ID NO: 76157 - protein, 9 aa, Artificial Sequence
  Description of Artificial Sequence: Synthetic peptide
  Seed: TLDEKVDEL (MAGC1_HUMAN)
TADEKVDEL

SEQ ID NO: 76158 - protein, 10 aa, Artificial Sequence
  Description of Artificial Sequence: Synthetic peptide
  Seed: LAMLKNTVPI (MAGC1_HUMAN)
LRMLKNTVPV

SEQ ID NO: 76159 - protein, 10 aa, Artificial Sequence
  Description of Artificial Sequence: Synthetic peptide
  Seed: GPAQSPLQSP (MAGC1_HUMAN)
GPAQSPLQSL

SEQ ID NO: 76160 - protein, 10 aa, Artificial Sequence
  Description of Artificial Sequence: Synthetic peptide
  Seed: SSPESTQSPF (MAGC1_HUMAN)
SAPESTQSPM

SEQ ID NO: 76161 - protein, 10 aa, Artificial Sequence
  Description of Artificial Sequence: Synthetic peptide
  Seed: MLKNTVPITF (MAGC1_HUMAN)
MAKNTVPITF

SEQ ID NO: 76162 - protein, 9 aa, Artificial Sequence
  Description of Artificial Sequence: Synthetic peptide
  Seed: SSPESPLQS (MAGC1_HUMAN)
STPESPLQM

SEQ ID NO: 76163 - protein, 10 aa, Artificial Sequence
  Description of Artificial Sequence: Synthetic peptide
  Seed: FPQSPLQIPV (MAGC1_HUMAN)
FFQSPLQIPV

SEQ ID NO: 76164 - protein, 9 aa, Artificial Sequence
  Description of Artificial Sequence: Synthetic peptide
  Seed: FSSTLLSIL (MAGC1_HUMAN)
FHSTLLSIY

SEQ ID NO: 76165 - protein, 10 aa, Artificial Sequence
  Description of Artificial Sequence: Synthetic peptide
  Seed: ATESASSSVM (MAGC1_HUMAN)
ASESASSSVW

SEQ ID NO: 76166 - protein, 9 aa, Artificial Sequence
  Description of Artificial Sequence: Synthetic peptide
  Seed: TSSFSSTLL (MAGC1_HUMAN)
TVSFSSTLV

SEQ ID NO: 76167 - protein, 11 aa, Artificial Sequence
  Description of Artificial Sequence: Synthetic peptide
  Seed: SSTSLSLPQSF (MAGC1_HUMAN)
SGTSLSLPQSW

SEQ ID NO: 76168 - protein, 11 aa, Artificial Sequence
  Description of Artificial Sequence: Synthetic peptide
  Seed: LLQIPMTSSFS (MAGC1_HUMAN)
LRQIPMTSSFY

SEQ ID NO: 76169 - protein, 10 aa, Artificial Sequence
  Description of Artificial Sequence: Synthetic peptide
  Seed: SFSSTLLSIL (MAGC1_HUMAN)
SDSSTLLSIW

SEQ ID NO: 76170 - protein, 10 aa, Artificial Sequence
  Description of Artificial Sequence: Synthetic peptide
  Seed: QRPVSSFFSY (MAGC1_HUMAN)
QFPVSSFFSM

SEQ ID NO: 76171 - protein, 10 aa, Artificial Sequence
  Description of Artificial Sequence: Synthetic peptide
  Seed: SRYTGYFPVI (MAGC1_HUMAN)
SIYTGYFPVW

SEQ ID NO: 76172 - protein, 9 aa, Artificial Sequence
  Description of Artificial Sequence: Synthetic peptide
  Seed: STFEGFAQS (MAGC1_HUMAN)
STFEGFAQR

SEQ ID NO: 76173 - protein, 9 aa, Artificial Sequence
  Description of Artificial Sequence: Synthetic peptide
  Seed: SPLQSPESA (MAGC1_HUMAN)
SRLQSPESA

SEQ ID NO: 76174 - protein, 9 aa, Artificial Sequence
  Description of Artificial Sequence: Synthetic peptide
  Seed: SPLQNPASS (MAGC1_HUMAN)
SALQNPASA

SEQ ID NO: 76175 - protein, 9 aa, Artificial Sequence
  Description of Artificial Sequence: Synthetic peptide
  Seed: YQVKQPITK (MAGC1_HUMAN)
YTVKQPITR

SEQ ID NO: 76176 - protein, 9 aa, Artificial Sequence
  Description of Artificial Sequence: Synthetic peptide
  Seed: YTGYFPVIF (MAGC1_HUMAN)
YWGYFPVIW

SEQ ID NO: 76177 - protein, 9 aa, Artificial Sequence
  Description of Artificial Sequence: Synthetic peptide
  Seed: SLSPHYFPQ (MAGC1_HUMAN)
STSPHYFPR

SEQ ID NO: 76178 - protein, 9 aa, Artificial Sequence
  Description of Artificial Sequence: Synthetic peptide
  Seed: AQSSLQIPV (MAGC1_HUMAN)
AESSLQIPM

SEQ ID NO: 76179 - protein, 10 aa, Artificial Sequence
  Description of Artificial Sequence: Synthetic peptide
  Seed: MTSSFSSTLL (MAGC1_HUMAN)
MISSFSSTLL

SEQ ID NO: 76180 - protein, 9 aa, Artificial Sequence
  Description of Artificial Sequence: Synthetic peptide
  Seed: IKRKVVEFL (MAGC1_HUMAN)
IQRKVVEFY

SEQ ID NO: 76181 - protein, 8 aa, Artificial Sequence
  Description of Artificial Sequence: Synthetic peptide
  Seed: LTDSESLI (MAGC1_HUMAN)
LADSESLF

SEQ ID NO: 76182 - protein, 9 aa, Artificial Sequence
  Description of Artificial Sequence: Synthetic peptide
  Seed: IPVSRSFSS (MAGC1_HUMAN)
ITVSRSFSY

SEQ ID NO: 76183 - protein, 10 aa, Artificial Sequence
  Description of Artificial Sequence: Synthetic peptide
  Seed: MSQNRLLILI (MAGC1_HUMAN)
MAQNRLLILW

SEQ ID NO: 76184 - protein, 9 aa, Artificial Sequence
  Description of Artificial Sequence: Synthetic peptide
  Seed: TLDLTSEGC (MAGC1_HUMAN)
TMDLTSEGI

SEQ ID NO: 76185 - protein, 10 aa, Artificial Sequence
  Description of Artificial Sequence: Synthetic peptide
  Seed: SPLYFPQSPL (MAGC1_HUMAN)
SLLYFPQSPV

SEQ ID NO: 76186 - protein, 9 aa, Artificial Sequence
  Description of Artificial Sequence: Synthetic peptide
  Seed: SFSSTLVSL (MAGC1_HUMAN)
SYSSTLVSF

SEQ ID NO: 76187 - protein, 9 aa, Artificial Sequence
  Description of Artificial Sequence: Synthetic peptide
  Seed: VSRSFSSTL (MAGC1_HUMAN)
VGRSFSSTY

SEQ ID NO: 76188 - protein, 9 aa, Artificial Sequence
  Description of Artificial Sequence: Synthetic peptide
  Seed: AMLKNTVPI (MAGC1_HUMAN)
ALLKNTVPM

SEQ ID NO: 76189 - protein, 9 aa, Artificial Sequence
  Description of Artificial Sequence: Synthetic peptide
  Seed: YVFVNTLDL (MAGC1_HUMAN)
YIFVNTLDW

SEQ ID NO: 76190 - protein, 11 aa, Artificial Sequence
  Description of Artificial Sequence: Synthetic peptide
  Seed: LQIPMTSSFSS (MAGC1_HUMAN)
LKIPMTSSFSF

SEQ ID NO: 76191 - protein, 10 aa, Artificial Sequence
  Description of Artificial Sequence: Synthetic peptide
  Seed: ISRYTGYFPV (MAGC1_HUMAN)
IDRYTGYFPM

SEQ ID NO: 76192 - protein, 9 aa, Artificial Sequence
  Description of Artificial Sequence: Synthetic peptide
  Seed: VSPSFSSTL (MAGC1_HUMAN)
VFPSFSSTV

SEQ ID NO: 76193 - protein, 9 aa, Artificial Sequence
  Description of Artificial Sequence: Synthetic peptide
  Seed: FLWGPRAHS (MAGC1_HUMAN)
FMWGPRAHA

SEQ ID NO: 76194 - protein, 9 aa, Artificial Sequence
  Description of Artificial Sequence: Synthetic peptide
  Seed: LLSLFQSFS (MAGC1_HUMAN)
LTSLFQSFV

SEQ ID NO: 76195 - protein, 9 aa, Artificial Sequence
  Description of Artificial Sequence: Synthetic peptide
  Seed: SSSSSSTLL (MAGC1_HUMAN)
SPSSSSTLW

SEQ ID NO: 76196 - protein, 9 aa, Artificial Sequence
  Description of Artificial Sequence: Synthetic peptide
  Seed: KVVEFLAML (MAGC1_HUMAN)
KSVEFLAML

SEQ ID NO: 76197 - protein, 10 aa, Artificial Sequence
  Description of Artificial Sequence: Synthetic peptide
  Seed: RKVVEFLAML (MAGC1_HUMAN)
RGVVEFLAML

SEQ ID NO: 76198 - protein, 9 aa, Artificial Sequence
  Description of Artificial Sequence: Synthetic peptide
  Seed: TESASSSVM (MAGC1_HUMAN)
TKSASSSVY

SEQ ID NO: 76199 - protein, 9 aa, Artificial Sequence
  Description of Artificial Sequence: Synthetic peptide
  Seed: YVFVNTLDL (MAGC1_HUMAN)
YPFVNTLDW

SEQ ID NO: 76200 - protein, 10 aa, Artificial Sequence
  Description of Artificial Sequence: Synthetic peptide
  Seed: TGYFPVIFRK (MAGC1_HUMAN)
TTYFPVIFRI

SEQ ID NO: 76201 - protein, 9 aa, Artificial Sequence
  Description of Artificial Sequence: Synthetic peptide
  Seed: SPLQNSQSS (MAGC1_HUMAN)
SPLQNSQSI

SEQ ID NO: 76202 - protein, 9 aa, Artificial Sequence
  Description of Artificial Sequence: Synthetic peptide
  Seed: LKNTVPITF (MAGC1_HUMAN)
LHNTVPITY

SEQ ID NO: 76203 - protein, 8 aa, Artificial Sequence
  Description of Artificial Sequence: Synthetic peptide
  Seed: LQIPVSAA (MAGC1_HUMAN)
LQIPVSAV

SEQ ID NO: 76204 - protein, 10 aa, Artificial Sequence
  Description of Artificial Sequence: Synthetic peptide
  Seed: FPSSTSSSLS (MAGC1_HUMAN)
FASSTSSSLM

SEQ ID NO: 76205 - protein, 11 aa, Artificial Sequence
  Description of Artificial Sequence: Synthetic peptide
  Seed: IPVSSSSSSTL (MAGC1_HUMAN)
ILVSSSSSSTF

SEQ ID NO: 76206 - protein, 9 aa, Artificial Sequence
  Description of Artificial Sequence: Synthetic peptide
  Seed: ASSFFSSAL (MAGC1_HUMAN)
ASSFFSSAV

SEQ ID NO: 76207 - protein, 11 aa, Artificial Sequence
  Description of Artificial Sequence: Synthetic peptide
  Seed: SPLQIPMTSSF (MAGC1_HUMAN)
SHLQIPMTSSM

SEQ ID NO: 76208 - protein, 9 aa, Artificial Sequence
  Description of Artificial Sequence: Synthetic peptide
  Seed: ASEEVIWDV (MAGC1_HUMAN)
ALEEVIWDM

SEQ ID NO: 76209 - protein, 9 aa, Artificial Sequence
  Description of Artificial Sequence: Synthetic peptide
  Seed: SIIFIKGTY (MAGC1_HUMAN)
SVIFIKGTK

SEQ ID NO: 76210 - protein, 9 aa, Artificial Sequence
  Description of Artificial Sequence: Synthetic peptide
  Seed: YTLASLLQS (MAGC1_HUMAN)
YLLASLLQT

SEQ ID NO: 76211 - protein, 10 aa, Artificial Sequence
  Description of Artificial Sequence: Synthetic peptide
  Seed: DVLSGIGVRA (MAGC1_HUMAN)
DVLSGIGVRV

SEQ ID NO: 76212 - protein, 10 aa, Artificial Sequence
  Description of Artificial Sequence: Synthetic peptide
  Seed: ICSSSTSLSL (MAGC1_HUMAN)
ITSSSTSLSF

SEQ ID NO: 76213 - protein, 11 aa, Artificial Sequence
  Description of Artificial Sequence: Synthetic peptide
  Seed: SEVIKRKVVEF (MAGC1_HUMAN)
SEVIKRKVVEL

SEQ ID NO: 76214 - protein, 10 aa, Artificial Sequence
  Description of Artificial Sequence: Synthetic peptide
  Seed: ISRYTGYFPV (MAGC1_HUMAN)
ITRYTGYFPM

SEQ ID NO: 76215 - protein, 9 aa, Artificial Sequence
  Description of Artificial Sequence: Synthetic peptide
  Seed: LQNPASSFF (MAGC1_HUMAN)
LTNPASSFW

SEQ ID NO: 76216 - protein, 9 aa, Artificial Sequence
  Description of Artificial Sequence: Synthetic peptide
  Seed: MLTNVISRY (MAGC1_HUMAN)
MTTNVISRR

SEQ ID NO: 76217 - protein, 9 aa, Artificial Sequence
  Description of Artificial Sequence: Synthetic peptide
  Seed: GPAQSPLQR (MAGC1_HUMAN)
GYAQSPLQF

SEQ ID NO: 76218 - protein, 9 aa, Artificial Sequence
  Description of Artificial Sequence: Synthetic peptide
  Seed: AQSPLQRPV (MAGC1_HUMAN)
AQSPLQRPF

SEQ ID NO: 76219 - protein, 11 aa, Artificial Sequence
  Description of Artificial Sequence: Synthetic peptide
  Seed: GYFPVIFRKAR (MAGC1_HUMAN)
GTFPVIFRKAR

SEQ ID NO: 76220 - protein, 9 aa, Artificial Sequence
  Description of Artificial Sequence: Synthetic peptide
  Seed: RTHSTFEGF (MAGC1_HUMAN)
RLHSTFEGF

SEQ ID NO: 76221 - protein, 9 aa, Artificial Sequence
  Description of Artificial Sequence: Synthetic peptide
  Seed: RPVSSFFSY (MAGC1_HUMAN)
RAVSSFFSY

SEQ ID NO: 76222 - protein, 9 aa, Artificial Sequence
  Description of Artificial Sequence: Synthetic peptide
  Seed: LSDEQGMSQ (MAGC1_HUMAN)
LSDEQGMSC

SEQ ID NO: 76223 - protein, 11 aa, Artificial Sequence
  Description of Artificial Sequence: Synthetic peptide
  Seed: SPLQIPVSSSS (MAGC1_HUMAN)
SRLQIPVSSSY

SEQ ID NO: 76224 - protein, 10 aa, Artificial Sequence
  Description of Artificial Sequence: Synthetic peptide
  Seed: REVPNSSPPR (MAGC1_HUMAN)
RAVPNSSPPR

SEQ ID NO: 76225 - protein, 9 aa, Artificial Sequence
  Description of Artificial Sequence: Synthetic peptide
  Seed: FFSSALLSI (MAGC1_HUMAN)
FLSSALLSG

SEQ ID NO: 76226 - protein, 9 aa, Artificial Sequence
  Description of Artificial Sequence: Synthetic peptide
  Seed: FSSALLSIF (MAGC1_HUMAN)
FSSALLSII

SEQ ID NO: 76227 - protein, 11 aa, Artificial Sequence
  Description of Artificial Sequence: Synthetic peptide
  Seed: SSFPSSTSSSL (MAGC1_HUMAN)
SKFPSSTSSSL

SEQ ID NO: 76228 - protein, 10 aa, Artificial Sequence
  Description of Artificial Sequence: Synthetic peptide
  Seed: SPLQRPVSSF (MAGC1_HUMAN)
SMLQRPVSSL

SEQ ID NO: 76229 - protein, 11 aa, Artificial Sequence
  Description of Artificial Sequence: Synthetic peptide
  Seed: IPVSAASSSTL (MAGC1_HUMAN)
ICVSAASSSTF

SEQ ID NO: 76230 - protein, 9 aa, Artificial Sequence
  Description of Artificial Sequence: Synthetic peptide
  Seed: FSEESSSPV (MAGC1_HUMAN)
FTEESSSPI

SEQ ID NO: 76231 - protein, 9 aa, Artificial Sequence
  Description of Artificial Sequence: Synthetic peptide
  Seed: RTHSTFEGF (MAGC1_HUMAN)
RMHSTFEGF

SEQ ID NO: 76232 - protein, 10 aa, Artificial Sequence
  Description of Artificial Sequence: Synthetic peptide
  Seed: FAQSSLQIPV (MAGC1_HUMAN)
FEQSSLQIPL

SEQ ID NO: 76233 - protein, 9 aa, Artificial Sequence
  Description of Artificial Sequence: Synthetic peptide
  Seed: SLPQSFPES (MAGC1_HUMAN)
STPQSFPEV

SEQ ID NO: 76234 - protein, 10 aa, Artificial Sequence
  Description of Artificial Sequence: Synthetic peptide
  Seed: KRKVVEFLAM (MAGC1_HUMAN)
KKKVVEFLAY

SEQ ID NO: 76235 - protein, 9 aa, Artificial Sequence
  Description of Artificial Sequence: Synthetic peptide
  Seed: VSSSSSSTL (MAGC1_HUMAN)
VCSSSSSTW

SEQ ID NO: 76236 - protein, 9 aa, Artificial Sequence
  Description of Artificial Sequence: Synthetic peptide
  Seed: VIKRKVVEF (MAGC1_HUMAN)
VIKRKVVEL

SEQ ID NO: 76237 - protein, 9 aa, Artificial Sequence
  Description of Artificial Sequence: Synthetic peptide
  Seed: LQNPASSFF (MAGC1_HUMAN)
LSNPASSFI

SEQ ID NO: 76238 - protein, 9 aa, Artificial Sequence
  Description of Artificial Sequence: Synthetic peptide
  Seed: FQSSLQSPV (MAGC1_HUMAN)
FLSSLQSPT

SEQ ID NO: 76239 - protein, 9 aa, Artificial Sequence
  Description of Artificial Sequence: Synthetic peptide
  Seed: MGDKDMPTA (MAGC1_HUMAN)
MMDKDMPTF

SEQ ID NO: 76240 - protein, 11 aa, Artificial Sequence
  Description of Artificial Sequence: Synthetic peptide
  Seed: SPLQIPVSRSF (MAGC1_HUMAN)
SMLQIPVSRSY

SEQ ID NO: 76241 - protein, 9 aa, Artificial Sequence
  Description of Artificial Sequence: Synthetic peptide
  Seed: WVQEHYLEY (MAGC1_HUMAN)
WSQEHYLEF

SEQ ID NO: 76242 - protein, 9 aa, Artificial Sequence
  Description of Artificial Sequence: Synthetic peptide
  Seed: SSPESAQSA (MAGC1_HUMAN)
SFPESAQSF

SEQ ID NO: 76243 - protein, 9 aa, Artificial Sequence
  Description of Artificial Sequence: Synthetic peptide
  Seed: ISRYTGYFP (MAGC1_HUMAN)
IVRYTGYFA

SEQ ID NO: 76244 - protein, 11 aa, Artificial Sequence
  Description of Artificial Sequence: Synthetic peptide
  Seed: SRYTGYFPVIF (MAGC1_HUMAN)
SQYTGYFPVIY

SEQ ID NO: 76245 - protein, 9 aa, Artificial Sequence
  Description of Artificial Sequence: Synthetic peptide
  Seed: AQSPLQSPV (MAGC1_HUMAN)
ATSPLQSPY

SEQ ID NO: 76246 - protein, 9 aa, Artificial Sequence
  Description of Artificial Sequence: Synthetic peptide
  Seed: FSYTLASLL (MAGC1_HUMAN)
FKYTLASLY

SEQ ID NO: 76247 - protein, 9 aa, Artificial Sequence
  Description of Artificial Sequence: Synthetic peptide
  Seed: SPLEGEDSL (MAGC1_HUMAN)
SHLEGEDSA

SEQ ID NO: 76248 - protein, 10 aa, Artificial Sequence
  Description of Artificial Sequence: Synthetic peptide
  Seed: KDVEERAQAI (MAGC1_HUMAN)
KEVEERAQAC

SEQ ID NO: 76249 - protein, 10 aa, Artificial Sequence
  Description of Artificial Sequence: Synthetic peptide
  Seed: TTDDSTATES (MAGC1_HUMAN)
TGDDSTATEF

SEQ ID NO: 76250 - protein, 10 aa, Artificial Sequence
  Description of Artificial Sequence: Synthetic peptide
  Seed: KGTYASEEVI (MAGC1_HUMAN)
KSTYASEEVY

SEQ ID NO: 76251 - protein, 10 aa, Artificial Sequence
  Description of Artificial Sequence: Synthetic peptide
  Seed: ICSSSTSLSL (MAGC1_HUMAN)
IASSSTSLSW

SEQ ID NO: 76252 - protein, 10 aa, Artificial Sequence
  Description of Artificial Sequence: Synthetic peptide
  Seed: AASSSTLVSI (MAGC1_HUMAN)
AMSSSTLVSA

SEQ ID NO: 76253 - protein, 10 aa, Artificial Sequence
  Description of Artificial Sequence: Synthetic peptide
  Seed: SFFSSALLSI (MAGC1_HUMAN)
SFFSSALLSY

SEQ ID NO: 76254 - protein, 9 aa, Artificial Sequence
  Description of Artificial Sequence: Synthetic peptide
  Seed: SSSTLVSIF (MAGC1_HUMAN)
SYSTLVSIY

SEQ ID NO: 76255 - protein, 9 aa, Artificial Sequence
  Description of Artificial Sequence: Synthetic peptide
  Seed: FFSYTLASL (MAGC1_HUMAN)
FYSYTLASW

SEQ ID NO: 76256 - protein, 11 aa, Artificial Sequence
  Description of Artificial Sequence: Synthetic peptide
  Seed: ITFPSSYKDAL (MAGC1_HUMAN)
ITFPSSYKDAM

SEQ ID NO: 76257 - protein, 10 aa, Artificial Sequence
  Description of Artificial Sequence: Synthetic peptide
  Seed: SFPSSTSSSL (MAGC1_HUMAN)
STPSSTSSSM

SEQ ID NO: 76258 - protein, 10 aa, Artificial Sequence
  Description of Artificial Sequence: Synthetic peptide
  Seed: SRYTGYFPVI (MAGC1_HUMAN)
SQYTGYFPVL

SEQ ID NO: 76259 - protein, 9 aa, Artificial Sequence
  Description of Artificial Sequence: Synthetic peptide
  Seed: SSPERTHST (MAGC1_HUMAN)
SAPERTHSW

SEQ ID NO: 76260 - protein, 11 aa, Artificial Sequence
  Description of Artificial Sequence: Synthetic peptide
  Seed: LWGPRAHSEVI (MAGC1_HUMAN)
LRGPRAHSEVL

SEQ ID NO: 76261 - protein, 10 aa, Artificial Sequence
  Description of Artificial Sequence: Synthetic peptide
  Seed: RAGREHFAFG (MAGC1_HUMAN)
RMGREHFAFY

SEQ ID NO: 76262 - protein, 9 aa, Artificial Sequence
  Description of Artificial Sequence: Synthetic peptide
  Seed: LQNPASSFF (MAGC1_HUMAN)
LKNPASSFL

SEQ ID NO: 76263 - protein, 9 aa, Artificial Sequence
  Description of Artificial Sequence: Synthetic peptide
  Seed: VSAASSSTL (MAGC1_HUMAN)
VFAASSSTV

SEQ ID NO: 76264 - protein, 10 aa, Artificial Sequence
  Description of Artificial Sequence: Synthetic peptide
  Seed: AASSSTLVSI (MAGC1_HUMAN)
ASSSSTLVSY

SEQ ID NO: 76265 - protein, 10 aa, Artificial Sequence
  Description of Artificial Sequence: Synthetic peptide
  Seed: SPLQNPASSF (MAGC1_HUMAN)
SKLQNPASSY

SEQ ID NO: 76266 - protein, 9 aa, Artificial Sequence
  Description of Artificial Sequence: Synthetic peptide
  Seed: FSSALLSIF (MAGC1_HUMAN)
FASALLSIL

SEQ ID NO: 76267 - protein, 11 aa, Artificial Sequence
  Description of Artificial Sequence: Synthetic peptide
  Seed: TTDDSTATESA (MAGC1_HUMAN)
TNDDSTATESL

SEQ ID NO: 76268 - protein, 9 aa, Artificial Sequence
  Description of Artificial Sequence: Synthetic peptide
  Seed: GFPQSVLQI (MAGC1_HUMAN)
GVPQSVLQM

SEQ ID NO: 76269 - protein, 9 aa, Artificial Sequence
  Description of Artificial Sequence: Synthetic peptide
  Seed: MGDKDMPTA (MAGC1_HUMAN)
MSDKDMPTF

SEQ ID NO: 76270 - protein, 9 aa, Artificial Sequence
  Description of Artificial Sequence: Synthetic peptide
  Seed: MPTAGMPSL (MAGC1_HUMAN)
MCTAGMPSY

SEQ ID NO: 76271 - protein, 10 aa, Artificial Sequence
  Description of Artificial Sequence: Synthetic peptide
  Seed: ASSSTLVSIF (MAGC1_HUMAN)
AMSSTLVSIM

SEQ ID NO: 76272 - protein, 11 aa, Artificial Sequence
  Description of Artificial Sequence: Synthetic peptide
  Seed: LQIPVSSSFSY (MAGC1_HUMAN)
LFIPVSSSFSF

SEQ ID NO: 76273 - protein, 9 aa, Artificial Sequence
  Description of Artificial Sequence: Synthetic peptide
  Seed: TSSFSSTLL (MAGC1_HUMAN)
TSSFSSTLY

SEQ ID NO: 76274 - protein, 10 aa, Artificial Sequence
  Description of Artificial Sequence: Synthetic peptide
  Seed: LSQSSPVSSF (MAGC1_HUMAN)
LRQSSPVSSY

SEQ ID NO: 76275 - protein, 9 aa, Artificial Sequence
  Description of Artificial Sequence: Synthetic peptide
  Seed: SQNRLLILI (MAGC1_HUMAN)
SANRLLILY

SEQ ID NO: 76276 - protein, 10 aa, Artificial Sequence
  Description of Artificial Sequence: Synthetic peptide
  Seed: ISRYTGYFPV (MAGC1_HUMAN)
IHRYTGYFPI

SEQ ID NO: 76277 - protein, 10 aa, Artificial Sequence
  Description of Artificial Sequence: Synthetic peptide
  Seed: LLQIPMTSSF (MAGC1_HUMAN)
LAQIPMTSSM

SEQ ID NO: 76278 - protein, 10 aa, Artificial Sequence
  Description of Artificial Sequence: Synthetic peptide
  Seed: ATESASSSVM (MAGC1_HUMAN)
ATESASSSVL

SEQ ID NO: 76279 - protein, 8 aa, Artificial Sequence
  Description of Artificial Sequence: Synthetic peptide
  Seed: LTDSESLI (MAGC1_HUMAN)
LSDSESLI

SEQ ID NO: 76280 - protein, 10 aa, Artificial Sequence
  Description of Artificial Sequence: Synthetic peptide
  Seed: ATESASSSVM (MAGC1_HUMAN)
AGESASSSVW

SEQ ID NO: 76281 - protein, 9 aa, Artificial Sequence
  Description of Artificial Sequence: Synthetic peptide
  Seed: LQIPVSSSS (MAGC1_HUMAN)
LTIPVSSSW

SEQ ID NO: 76282 - protein, 9 aa, Artificial Sequence
  Description of Artificial Sequence: Synthetic peptide
  Seed: LKYQVKQPI (MAGC1_HUMAN)
LVYQVKQPY

SEQ ID NO: 76283 - protein, 9 aa, Artificial Sequence
  Description of Artificial Sequence: Synthetic peptide
  Seed: SQNRLLILI (MAGC1_HUMAN)
SVNRLLILI

SEQ ID NO: 76284 - protein, 9 aa, Artificial Sequence
  Description of Artificial Sequence: Synthetic peptide
  Seed: SLPQSFPES (MAGC1_HUMAN)
SQPQSFPEL

SEQ ID NO: 76285 - protein, 9 aa, Artificial Sequence
  Description of Artificial Sequence: Synthetic peptide
  Seed: RAHSEVIKR (MAGC1_HUMAN)
RNHSEVIKY

SEQ ID NO: 76286 - protein, 9 aa, Artificial Sequence
  Description of Artificial Sequence: Synthetic peptide
  Seed: KDSQSPLQI (MAGC1_HUMAN)
KMSQSPLQL

SEQ ID NO: 76287 - protein, 10 aa, Artificial Sequence
  Description of Artificial Sequence: Synthetic peptide
  Seed: LQIVPSLPEW (MAGC1_HUMAN)
LVIVPSLPEW

SEQ ID NO: 76288 - protein, 10 aa, Artificial Sequence
  Description of Artificial Sequence: Synthetic peptide
  Seed: SPVDEYTSSS (MAGC1_HUMAN)
SPVDEYTSSA

SEQ ID NO: 76289 - protein, 9 aa, Artificial Sequence
  Description of Artificial Sequence: Synthetic peptide
  Seed: LQRPVSSFF (MAGC1_HUMAN)
LVRPVSSFF

SEQ ID NO: 76290 - protein, 10 aa, Artificial Sequence
  Description of Artificial Sequence: Synthetic peptide
  Seed: SLSPLHFPQF (MAGC1_HUMAN)
SWSPLHFPQF

SEQ ID NO: 76291 - protein, 10 aa, Artificial Sequence
  Description of Artificial Sequence: Synthetic peptide
  Seed: YTLDEKVDEL (MAGC1_HUMAN)
YALDEKVDEM

SEQ ID NO: 76292 - protein, 11 aa, Artificial Sequence
  Description of Artificial Sequence: Synthetic peptide
  Seed: IPVSRSFSSTL (MAGC1_HUMAN)
IFVSRSFSSTW

SEQ ID NO: 76293 - protein, 10 aa, Artificial Sequence
  Description of Artificial Sequence: Synthetic peptide
  Seed: YTLASLLQSS (MAGC1_HUMAN)
YYLASLLQSL

SEQ ID NO: 76294 - protein, 9 aa, Artificial Sequence
  Description of Artificial Sequence: Synthetic peptide
  Seed: KQPITKAEM (MAGC1_HUMAN)
KVPITKAEY

SEQ ID NO: 76295 - protein, 10 aa, Artificial Sequence
  Description of Artificial Sequence: Synthetic peptide
  Seed: ISRYTGYFPV (MAGC1_HUMAN)
IWRYTGYFPF

SEQ ID NO: 76296 - protein, 9 aa, Artificial Sequence
  Description of Artificial Sequence: Synthetic peptide
  Seed: FLAMLKNTV (MAGC1_HUMAN)
FIAMLKNTL

SEQ ID NO: 76297 - protein, 11 aa, Artificial Sequence
  Description of Artificial Sequence: Synthetic peptide
  Seed: SPLQIPGSPSF (MAGC1_HUMAN)
SDLQIPGSPSF

SEQ ID NO: 76298 - protein, 10 aa, Artificial Sequence
  Description of Artificial Sequence: Synthetic peptide
  Seed: MTSSFSSTLL (MAGC1_HUMAN)
MISSFSSTLF

SEQ ID NO: 76299 - protein, 10 aa, Artificial Sequence
  Description of Artificial Sequence: Synthetic peptide
  Seed: SSPESAQSTF (MAGC1_HUMAN)
STPESAQSTF

SEQ ID NO: 76300 - protein, 11 aa, Artificial Sequence
  Description of Artificial Sequence: Synthetic peptide
  Seed: SICSSSTSLSL (MAGC1_HUMAN)
SACSSSTSLSF

SEQ ID NO: 76301 - protein, 10 aa, Artificial Sequence
  Description of Artificial Sequence: Synthetic peptide
  Seed: SSSSSTLLSL (MAGC1_HUMAN)
SISSSTLLSW

SEQ ID NO: 76302 - protein, 10 aa, Artificial Sequence
  Description of Artificial Sequence: Synthetic peptide
  Seed: FPQSPLQIPV (MAGC1_HUMAN)
FMQSPLQIPY

SEQ ID NO: 76303 - protein, 9 aa, Artificial Sequence
  Description of Artificial Sequence: Synthetic peptide
  Seed: LSDEQGMSQ (MAGC1_HUMAN)
LIDEQGMSA

SEQ ID NO: 76304 - protein, 11 aa, Artificial Sequence
  Description of Artificial Sequence: Synthetic peptide
  Seed: SPLQIPGSPSF (MAGC1_HUMAN)
SYLQIPGSPSF

SEQ ID NO: 76305 - protein, 9 aa, Artificial Sequence
  Description of Artificial Sequence: Synthetic peptide
  Seed: YTSSSDTLL (MAGC1_HUMAN)
YQSSSDTLV

SEQ ID NO: 76306 - protein, 9 aa, Artificial Sequence
  Description of Artificial Sequence: Synthetic peptide
  Seed: GFPQSLLQI (MAGC1_HUMAN)
GRPQSLLQY

SEQ ID NO: 76307 - protein, 10 aa, Artificial Sequence
  Description of Artificial Sequence: Synthetic peptide
  Seed: TGYFPVIFRK (MAGC1_HUMAN)
TTYFPVIFRW

SEQ ID NO: 76308 - protein, 10 aa, Artificial Sequence
  Description of Artificial Sequence: Synthetic peptide
  Seed: LLQIPMTSSF (MAGC1_HUMAN)
LGQIPMTSSM

SEQ ID NO: 76309 - protein, 10 aa, Artificial Sequence
  Description of Artificial Sequence: Synthetic peptide
  Seed: PLQIPVSSSF (MAGC1_HUMAN)
PKQIPVSSSY

SEQ ID NO: 76310 - protein, 10 aa, Artificial Sequence
  Description of Artificial Sequence: Synthetic peptide
  Seed: VSSSFSYTLL (MAGC1_HUMAN)
VRSSFSYTLF

SEQ ID NO: 76311 - protein, 9 aa, Artificial Sequence
  Description of Artificial Sequence: Synthetic peptide
  Seed: ELARFLLLK (MAGC1_HUMAN)
EAARFLLLR

SEQ ID NO: 76312 - protein, 9 aa, Artificial Sequence
  Description of Artificial Sequence: Synthetic peptide
  Seed: LSDEQGMSQ (MAGC1_HUMAN)
LMDEQGMSI

SEQ ID NO: 76313 - protein, 11 aa, Artificial Sequence
  Description of Artificial Sequence: Synthetic peptide
  Seed: RPVSSFFSYTL (MAGC1_HUMAN)
RLVSSFFSYTW

SEQ ID NO: 76314 - protein, 10 aa, Artificial Sequence
  Description of Artificial Sequence: Synthetic peptide
  Seed: ICSSSTPSSL (MAGC1_HUMAN)
ITSSSTPSSF

SEQ ID NO: 76315 - protein, 10 aa, Artificial Sequence
  Description of Artificial Sequence: Synthetic peptide
  Seed: STSLSLPQSF (MAGC1_HUMAN)
SDSLSLPQSW

SEQ ID NO: 76316 - protein, 9 aa, Artificial Sequence
  Description of Artificial Sequence: Synthetic peptide
  Seed: YQVKQPITK (MAGC1_HUMAN)
YSVKQPITV

SEQ ID NO: 76317 - protein, 10 aa, Artificial Sequence
  Description of Artificial Sequence: Synthetic peptide
  Seed: STPSSLPQSF (MAGC1_HUMAN)
SFPSSLPQSM

SEQ ID NO: 76318 - protein, 10 aa, Artificial Sequence
  Description of Artificial Sequence: Synthetic peptide
  Seed: SSFSSTLLSI (MAGC1_HUMAN)
SQFSSTLLSM

SEQ ID NO: 76319 - protein, 9 aa, Artificial Sequence
  Description of Artificial Sequence: Synthetic peptide
  Seed: GSPSFSSTL (MAGC1_HUMAN)
GAPSFSSTL

SEQ ID NO: 76320 - protein, 9 aa, Artificial Sequence
  Description of Artificial Sequence: Synthetic peptide
  Seed: SICSSSTSL (MAGC1_HUMAN)
SLCSSSTSV

SEQ ID NO: 76321 - protein, 9 aa, Artificial Sequence
  Description of Artificial Sequence: Synthetic peptide
  Seed: VIFRKAREF (MAGC1_HUMAN)
VQFRKAREM

SEQ ID NO: 76322 - protein, 9 aa, Artificial Sequence
  Description of Artificial Sequence: Synthetic peptide
  Seed: MPSLLQSSS (MAGC1_HUMAN)
MASLLQSSY

SEQ ID NO: 76323 - protein, 9 aa, Artificial Sequence
  Description of Artificial Sequence: Synthetic peptide
  Seed: RSFSSTLLS (MAGC1_HUMAN)
RFFSSTLLA

SEQ ID NO: 76324 - protein, 9 aa, Artificial Sequence
  Description of Artificial Sequence: Synthetic peptide
  Seed: MPTAGMPSL (MAGC1_HUMAN)
MPTAGMPST

SEQ ID NO: 76325 - protein, 10 aa, Artificial Sequence
  Description of Artificial Sequence: Synthetic peptide
  Seed: LQIPMTSSFS (MAGC1_HUMAN)
LVIPMTSSFF

SEQ ID NO: 76326 - protein, 9 aa, Artificial Sequence
  Description of Artificial Sequence: Synthetic peptide
  Seed: FSYTLASLL (MAGC1_HUMAN)
FYYTLASLF

SEQ ID NO: 76327 - protein, 9 aa, Artificial Sequence
  Description of Artificial Sequence: Synthetic peptide
  Seed: LQIPVSSSS (MAGC1_HUMAN)
LGIPVSSSW

SEQ ID NO: 76328 - protein, 9 aa, Artificial Sequence
  Description of Artificial Sequence: Synthetic peptide
  Seed: RTQSTFEGF (MAGC1_HUMAN)
RWQSTFEGF

SEQ ID NO: 76329 - protein, 9 aa, Artificial Sequence
  Description of Artificial Sequence: Synthetic peptide
  Seed: VVEFLAMLK (MAGC1_HUMAN)
VYEFLAMLR

SEQ ID NO: 76330 - protein, 9 aa, Artificial Sequence
  Description of Artificial Sequence: Synthetic peptide
  Seed: TYASEEVIW (MAGC1_HUMAN)
TTASEEVIW

SEQ ID NO: 76331 - protein, 9 aa, Artificial Sequence
  Description of Artificial Sequence: Synthetic peptide
  Seed: TESASSSVM (MAGC1_HUMAN)
TQSASSSVL

SEQ ID NO: 76332 - protein, 9 aa, Artificial Sequence
  Description of Artificial Sequence: Synthetic peptide
  Seed: FQSSLQSPV (MAGC1_HUMAN)
FHSSLQSPL

SEQ ID NO: 76333 - protein, 10 aa, Artificial Sequence
  Description of Artificial Sequence: Synthetic peptide
  Seed: ASSFFSSALL (MAGC1_HUMAN)
AMSFFSSALV

SEQ ID NO: 76334 - protein, 11 aa, Artificial Sequence
  Description of Artificial Sequence: Synthetic peptide
  Seed: FLAMLKNTVPI (MAGC1_HUMAN)
FNAMLKNTVPA

SEQ ID NO: 76335 - protein, 9 aa, Artificial Sequence
  Description of Artificial Sequence: Synthetic peptide
  Seed: SSPESTQSP (MAGC1_HUMAN)
SSPESTQSL

SEQ ID NO: 76336 - protein, 10 aa, Artificial Sequence
  Description of Artificial Sequence: Synthetic peptide
  Seed: LAMLKNTVPI (MAGC1_HUMAN)
LFMLKNTVPL

SEQ ID NO: 76337 - protein, 8 aa, Artificial Sequence
  Description of Artificial Sequence: Synthetic peptide
  Seed: IWDVLSGI (MAGC1_HUMAN)
IADVLSGI

SEQ ID NO: 76338 - protein, 11 aa, Artificial Sequence
  Description of Artificial Sequence: Synthetic peptide
  Seed: IIDTTDDSTAT (MAGC1_HUMAN)
ISDTTDDSTAV

SEQ ID NO: 76339 - protein, 9 aa, Artificial Sequence
  Description of Artificial Sequence: Synthetic peptide
  Seed: FSSTLLSLF (MAGC1_HUMAN)
FRSTLLSLF

SEQ ID NO: 76340 - protein, 8 aa, Artificial Sequence
  Description of Artificial Sequence: Synthetic peptide
  Seed: QSSPVSSF (MAGC1_HUMAN)
QFSPVSSY

SEQ ID NO: 76341 - protein, 9 aa, Artificial Sequence
  Description of Artificial Sequence: Synthetic peptide
  Seed: TLLSILQSS (MAGC1_HUMAN)
TMLSILQSM

SEQ ID NO: 76342 - protein, 10 aa, Artificial Sequence
  Description of Artificial Sequence: Synthetic peptide
  Seed: SFFSSALLSI (MAGC1_HUMAN)
SVFSSALLSF

SEQ ID NO: 76343 - protein, 9 aa, Artificial Sequence
  Description of Artificial Sequence: Synthetic peptide
  Seed: TLDLTSEGC (MAGC1_HUMAN)
TADLTSEGI

SEQ ID NO: 76344 - protein, 10 aa, Artificial Sequence
  Description of Artificial Sequence: Synthetic peptide
  Seed: LQIPVSSSFS (MAGC1_HUMAN)
LMIPVSSSFQ

SEQ ID NO: 76345 - protein, 9 aa, Artificial Sequence
  Description of Artificial Sequence: Synthetic peptide
  Seed: ISFSSSTSL (MAGC1_HUMAN)
IVFSSSTSK

SEQ ID NO: 76346 - protein, 9 aa, Artificial Sequence
  Description of Artificial Sequence: Synthetic peptide
  Seed: SQNRLLILI (MAGC1_HUMAN)
SLNRLLILY

SEQ ID NO: 76347 - protein, 11 aa, Artificial Sequence
  Description of Artificial Sequence: Synthetic peptide
  Seed: STFEGFAQSPL (MAGC1_HUMAN)
SMFEGFAQSPT

SEQ ID NO: 76348 - protein, 10 aa, Artificial Sequence
  Description of Artificial Sequence: Synthetic peptide
  Seed: HSPQSPPEGM (MAGC1_HUMAN)
HYPQSPPEGY

SEQ ID NO: 76349 - protein, 9 aa, Artificial Sequence
  Description of Artificial Sequence: Synthetic peptide
  Seed: FSERTQSTF (MAGC1_HUMAN)
FPERTQSTF

SEQ ID NO: 76350 - protein, 10 aa, Artificial Sequence
  Description of Artificial Sequence: Synthetic peptide
  Seed: STPSSLPQSF (MAGC1_HUMAN)
SIPSSLPQSM

SEQ ID NO: 76351 - protein, 9 aa, Artificial Sequence
  Description of Artificial Sequence: Synthetic peptide
  Seed: SSSDTLLES (MAGC1_HUMAN)
SASDTLLEI

SEQ ID NO: 76352 - protein, 9 aa, Artificial Sequence
  Description of Artificial Sequence: Synthetic peptide
  Seed: SIIFIKGTY (MAGC1_HUMAN)
SAIFIKGTY

SEQ ID NO: 76353 - protein, 9 aa, Artificial Sequence
  Description of Artificial Sequence: Synthetic peptide
  Seed: LSDEQGMSQ (MAGC1_HUMAN)
LMDEQGMSY

SEQ ID NO: 76354 - protein, 10 aa, Artificial Sequence
  Description of Artificial Sequence: Synthetic peptide
  Seed: EVPNSSPPRY (MAGC1_HUMAN)
ELPNSSPPRR

SEQ ID NO: 76355 - protein, 10 aa, Artificial Sequence
  Description of Artificial Sequence: Synthetic peptide
  Seed: VSSSFSYTLL (MAGC1_HUMAN)
VGSSFSYTLY

SEQ ID NO: 76356 - protein, 8 aa, Artificial Sequence
  Description of Artificial Sequence: Synthetic peptide
  Seed: FSYTLLSL (MAGC1_HUMAN)
FQYTLLSI

SEQ ID NO: 76357 - protein, 10 aa, Artificial Sequence
  Description of Artificial Sequence: Synthetic peptide
  Seed: MSPLYFPQSP (MAGC1_HUMAN)
MCPLYFPQSV

SEQ ID NO: 76358 - protein, 9 aa, Artificial Sequence
  Description of Artificial Sequence: Synthetic peptide
  Seed: SSFFSYTLA (MAGC1_HUMAN)
SLFFSYTLL

SEQ ID NO: 76359 - protein, 11 aa, Artificial Sequence
  Description of Artificial Sequence: Synthetic peptide
  Seed: SPFSEESSSPV (MAGC1_HUMAN)
SPFSEESSSPL

SEQ ID NO: 76360 - protein, 9 aa, Artificial Sequence
  Description of Artificial Sequence: Synthetic peptide
  Seed: ESDDTLYPL (MAGC1_HUMAN)
EIDDTLYPI

SEQ ID NO: 76361 - protein, 11 aa, Artificial Sequence
  Description of Artificial Sequence: Synthetic peptide
  Seed: IPVSPSSSSTL (MAGC1_HUMAN)
IMVSPSSSSTY

SEQ ID NO: 76362 - protein, 11 aa, Artificial Sequence
  Description of Artificial Sequence: Synthetic peptide
  Seed: SSFPSSTSSSL (MAGC1_HUMAN)
SQFPSSTSSSV

SEQ ID NO: 76363 - protein, 9 aa, Artificial Sequence
  Description of Artificial Sequence: Synthetic peptide
  Seed: LQRPVSSFF (MAGC1_HUMAN)
LSRPVSSFF

SEQ ID NO: 76364 - protein, 9 aa, Artificial Sequence
  Description of Artificial Sequence: Synthetic peptide
  Seed: NTVPITFPS (MAGC1_HUMAN)
NFVPITFPV

SEQ ID NO: 76365 - protein, 9 aa, Artificial Sequence
  Description of Artificial Sequence: Synthetic peptide
  Seed: LQIPVSAAS (MAGC1_HUMAN)
LIIPVSAAY

SEQ ID NO: 76366 - protein, 9 aa, Artificial Sequence
  Description of Artificial Sequence: Synthetic peptide
  Seed: MPTAGMPSL (MAGC1_HUMAN)
MATAGMPSM

SEQ ID NO: 76367 - protein, 9 aa, Artificial Sequence
  Description of Artificial Sequence: Synthetic peptide
  Seed: IESEPLFTY (MAGC1_HUMAN)
IKSEPLFTM

SEQ ID NO: 76368 - protein, 9 aa, Artificial Sequence
  Description of Artificial Sequence: Synthetic peptide
  Seed: SSPESDDTL (MAGC1_HUMAN)
SSPESDDTM

SEQ ID NO: 76369 - protein, 9 aa, Artificial Sequence
  Description of Artificial Sequence: Synthetic peptide
  Seed: MSQNRLLIL (MAGC1_HUMAN)
MTQNRLLIL

SEQ ID NO: 76370 - protein, 9 aa, Artificial Sequence
  Description of Artificial Sequence: Synthetic peptide
  Seed: SICSSSTSL (MAGC1_HUMAN)
SVCSSSTSM

SEQ ID NO: 76371 - protein, 9 aa, Artificial Sequence
  Description of Artificial Sequence: Synthetic peptide
  Seed: IPVSSSFSY (MAGC1_HUMAN)
IMVSSSFSM

SEQ ID NO: 76372 - protein, 11 aa, Artificial Sequence
  Description of Artificial Sequence: Synthetic peptide
  Seed: IPVSAASSSTL (MAGC1_HUMAN)
ILVSAASSSTF

SEQ ID NO: 76373 - protein, 9 aa, Artificial Sequence
  Description of Artificial Sequence: Synthetic peptide
  Seed: VSPSFSSTL (MAGC1_HUMAN)
VLPSFSSTI

SEQ ID NO: 76374 - protein, 9 aa, Artificial Sequence
  Description of Artificial Sequence: Synthetic peptide
  Seed: AQSPLQRPV (MAGC1_HUMAN)
AMSPLQRPV

SEQ ID NO: 76375 - protein, 9 aa, Artificial Sequence
  Description of Artificial Sequence: Synthetic peptide
  Seed: YVFVNTLDL (MAGC1_HUMAN)
YPFVNTLDY

SEQ ID NO: 76376 - protein, 9 aa, Artificial Sequence
  Description of Artificial Sequence: Synthetic peptide
  Seed: GFPQSVLQI (MAGC1_HUMAN)
GMPQSVLQL

SEQ ID NO: 76377 - protein, 9 aa, Artificial Sequence
  Description of Artificial Sequence: Synthetic peptide
  Seed: GFPQSPLQI (MAGC1_HUMAN)
GYPQSPLQL

SEQ ID NO: 76378 - protein, 9 aa, Artificial Sequence
  Description of Artificial Sequence: Synthetic peptide
  Seed: ESDDTLYPL (MAGC1_HUMAN)
EADDTLYPL

SEQ ID NO: 76379 - protein, 9 aa, Artificial Sequence
  Description of Artificial Sequence: Synthetic peptide
  Seed: SSPERTQST (MAGC1_HUMAN)
SVPERTQSV

SEQ ID NO: 76380 - protein, 9 aa, Artificial Sequence
  Description of Artificial Sequence: Synthetic peptide
  Seed: DSYVFVNTL (MAGC1_HUMAN)
DEYVFVNTL

SEQ ID NO: 76381 - protein, 10 aa, Artificial Sequence
  Description of Artificial Sequence: Synthetic peptide
  Seed: SVLQIPVSAA (MAGC1_HUMAN)
SVLQIPVSAI

SEQ ID NO: 76382 - protein, 9 aa, Artificial Sequence
  Description of Artificial Sequence: Synthetic peptide
  Seed: FPSSTSSSL (MAGC1_HUMAN)
FHSSTSSSM

SEQ ID NO: 76383 - protein, 9 aa, Artificial Sequence
  Description of Artificial Sequence: Synthetic peptide
  Seed: SSPESTQSP (MAGC1_HUMAN)
SCPESTQSL

SEQ ID NO: 76384 - protein, 8 aa, Artificial Sequence
  Description of Artificial Sequence: Synthetic peptide
  Seed: SSFFSSAL (MAGC1_HUMAN)
SLFFSSAY

SEQ ID NO: 76385 - protein, 9 aa, Artificial Sequence
  Description of Artificial Sequence: Synthetic peptide
  Seed: SLFQSFSER (MAGC1_HUMAN)
SMFQSFSEK

SEQ ID NO: 76386 - protein, 9 aa, Artificial Sequence
  Description of Artificial Sequence: Synthetic peptide
  Seed: SQSPPEGPV (MAGC1_HUMAN)
SESPPEGPI

SEQ ID NO: 76387 - protein, 9 aa, Artificial Sequence
  Description of Artificial Sequence: Synthetic peptide
  Seed: SFSYTLLSL (MAGC1_HUMAN)
SSSYTLLSM

SEQ ID NO: 76388 - protein, 11 aa, Artificial Sequence
  Description of Artificial Sequence: Synthetic peptide
  Seed: SFFSYTLASLL (MAGC1_HUMAN)
SYFSYTLASLW

SEQ ID NO: 76389 - protein, 9 aa, Artificial Sequence
  Description of Artificial Sequence: Synthetic peptide
  Seed: LQIPGSPSF (MAGC1_HUMAN)
LSIPGSPSI

SEQ ID NO: 76390 - protein, 9 aa, Artificial Sequence
  Description of Artificial Sequence: Synthetic peptide
  Seed: VSSFFSYTL (MAGC1_HUMAN)
VISFFSYTI

SEQ ID NO: 76391 - protein, 10 aa, Artificial Sequence
  Description of Artificial Sequence: Synthetic peptide
  Seed: EVIWDVLSGI (MAGC1_HUMAN)
EWIWDVLSGV

SEQ ID NO: 76392 - protein, 9 aa, Artificial Sequence
  Description of Artificial Sequence: Synthetic peptide
  Seed: IPVSPSFSS (MAGC1_HUMAN)
IVVSPSFSY

SEQ ID NO: 76393 - protein, 9 aa, Artificial Sequence
  Description of Artificial Sequence: Synthetic peptide
  Seed: LKNTVPITF (MAGC1_HUMAN)
LGNTVPITL

SEQ ID NO: 76394 - protein, 9 aa, Artificial Sequence
  Description of Artificial Sequence: Synthetic peptide
  Seed: GYFPVIFRK (MAGC1_HUMAN)
GLFPVIFRY

SEQ ID NO: 76395 - protein, 10 aa, Artificial Sequence
  Description of Artificial Sequence: Synthetic peptide
  Seed: SPVSICSSST (MAGC1_HUMAN)
SPVSICSSSF

SEQ ID NO: 76396 - protein, 9 aa, Artificial Sequence
  Description of Artificial Sequence: Synthetic peptide
  Seed: TGYFPVIFR (MAGC1_HUMAN)
TGYFPVIFK

SEQ ID NO: 76397 - protein, 9 aa, Artificial Sequence
  Description of Artificial Sequence: Synthetic peptide
  Seed: YVFVNTLDL (MAGC1_HUMAN)
YAFVNTLDF

SEQ ID NO: 76398 - protein, 10 aa, Artificial Sequence
  Description of Artificial Sequence: Synthetic peptide
  Seed: VSAASSSTLV (MAGC1_HUMAN)
VTAASSSTLW

SEQ ID NO: 76399 - protein, 9 aa, Artificial Sequence
  Description of Artificial Sequence: Synthetic peptide
  Seed: YTLLSLFQS (MAGC1_HUMAN)
YQLLSLFQM

SEQ ID NO: 76400 - protein, 9 aa, Artificial Sequence
  Description of Artificial Sequence: Synthetic peptide
  Seed: TTDDSTATE (MAGC1_HUMAN)
TPDDSTATL

SEQ ID NO: 76401 - protein, 8 aa, Artificial Sequence
  Description of Artificial Sequence: Synthetic peptide
  Seed: GYFPVIFR (MAGC1_HUMAN)
GMFPVIFR

SEQ ID NO: 76402 - protein, 11 aa, Artificial Sequence
  Description of Artificial Sequence: Synthetic peptide
  Seed: RPVSSFFSYTL (MAGC1_HUMAN)
RRVSSFFSYTY

SEQ ID NO: 76403 - protein, 9 aa, Artificial Sequence
  Description of Artificial Sequence: Synthetic peptide
  Seed: SASSSVMSP (MAGC1_HUMAN)
SVSSSVMSM

SEQ ID NO: 76404 - protein, 9 aa, Artificial Sequence
  Description of Artificial Sequence: Synthetic peptide
  Seed: DSYVFVNTL (MAGC1_HUMAN)
DSYVFVNTF

SEQ ID NO: 76405 - protein, 9 aa, Artificial Sequence
  Description of Artificial Sequence: Synthetic peptide
  Seed: FSSTLVSLF (MAGC1_HUMAN)
FASTLVSLY

SEQ ID NO: 76406 - protein, 10 aa, Artificial Sequence
  Description of Artificial Sequence: Synthetic peptide
  Seed: MSQNRLLILI (MAGC1_HUMAN)
MTQNRLLILF

SEQ ID NO: 76407 - protein, 10 aa, Artificial Sequence
  Description of Artificial Sequence: Synthetic peptide
  Seed: KVDELARFLL (MAGC1_HUMAN)
KLDELARFLI

SEQ ID NO: 76408 - protein, 9 aa, Artificial Sequence
  Description of Artificial Sequence: Synthetic peptide
  Seed: YTSSSDTLL (MAGC1_HUMAN)
YMSSSDTLA

SEQ ID NO: 76409 - protein, 10 aa, Artificial Sequence
  Description of Artificial Sequence: Synthetic peptide
  Seed: SSFPSSTSSS (MAGC1_HUMAN)
SGFPSSTSSY

SEQ ID NO: 76410 - protein, 10 aa, Artificial Sequence
  Description of Artificial Sequence: Synthetic peptide
  Seed: REFIEILFGI (MAGC1_HUMAN)
RRFIEILFGA

SEQ ID NO: 76411 - protein, 10 aa, Artificial Sequence
  Description of Artificial Sequence: Synthetic peptide
  Seed: MTSSFSSTLL (MAGC1_HUMAN)
MCSSFSSTLV

SEQ ID NO: 76412 - protein, 11 aa, Artificial Sequence
  Description of Artificial Sequence: Synthetic peptide
  Seed: LLQIPMTSSFS (MAGC1_HUMAN)
LQQIPMTSSFF

SEQ ID NO: 76413 - protein, 10 aa, Artificial Sequence
  Description of Artificial Sequence: Synthetic peptide
  Seed: IPVSPSSSST (MAGC1_HUMAN)
IPVSPSSSSF

SEQ ID NO: 76414 - protein, 10 aa, Artificial Sequence
  Description of Artificial Sequence: Synthetic peptide
  Seed: FAFGEPRELL (MAGC1_HUMAN)
FTFGEPRELI

SEQ ID NO: 76415 - protein, 10 aa, Artificial Sequence
  Description of Artificial Sequence: Synthetic peptide
  Seed: YTLLSLFQSS (MAGC1_HUMAN)
YLLLSLFQSA

SEQ ID NO: 76416 - protein, 9 aa, Artificial Sequence
  Description of Artificial Sequence: Synthetic peptide
  Seed: MPTAGMPSL (MAGC1_HUMAN)
MHTAGMPSV

SEQ ID NO: 76417 - protein, 11 aa, Artificial Sequence
  Description of Artificial Sequence: Synthetic peptide
  Seed: IPVSPSFSSTL (MAGC1_HUMAN)
IPVSPSFSSTM

SEQ ID NO: 76418 - protein, 9 aa, Artificial Sequence
  Description of Artificial Sequence: Synthetic peptide
  Seed: SFFSYTLAS (MAGC1_HUMAN)
SHFSYTLAY

SEQ ID NO: 76419 - protein, 10 aa, Artificial Sequence
  Description of Artificial Sequence: Synthetic peptide
  Seed: STPSSLPQSF (MAGC1_HUMAN)
SLPSSLPQSI

SEQ ID NO: 76420 - protein, 10 aa, Artificial Sequence
  Description of Artificial Sequence: Synthetic peptide
  Seed: SSFSYTLLSL (MAGC1_HUMAN)
SIFSYTLLSM

SEQ ID NO: 76421 - protein, 9 aa, Artificial Sequence
  Description of Artificial Sequence: Synthetic peptide
  Seed: TESASSSVM (MAGC1_HUMAN)
TTSASSSVY

SEQ ID NO: 76422 - protein, 9 aa, Artificial Sequence
  Description of Artificial Sequence: Synthetic peptide
  Seed: SSFFSSALL (MAGC1_HUMAN)
SLFFSSALV

SEQ ID NO: 76423 - protein, 11 aa, Artificial Sequence
  Description of Artificial Sequence: Synthetic peptide
  Seed: SFFSYTLASLL (MAGC1_HUMAN)
SSFSYTLASLF

SEQ ID NO: 76424 - protein, 9 aa, Artificial Sequence
  Description of Artificial Sequence: Synthetic peptide
  Seed: VQSPLHSPQ (MAGC1_HUMAN)
VHSPLHSPY

SEQ ID NO: 76425 - protein, 9 aa, Artificial Sequence
  Description of Artificial Sequence: Synthetic peptide
  Seed: VIKRKVVEF (MAGC1_HUMAN)
VTKRKVVEW

SEQ ID NO: 76426 - protein, 9 aa, Artificial Sequence
  Description of Artificial Sequence: Synthetic peptide
  Seed: SSHESPQSP (MAGC1_HUMAN)
SLHESPQSY

SEQ ID NO: 76427 - protein, 9 aa, Artificial Sequence
  Description of Artificial Sequence: Synthetic peptide
  Seed: SSFSSTLLS (MAGC1_HUMAN)
STFSSTLLK

SEQ ID NO: 76428 - protein, 9 aa, Artificial Sequence
  Description of Artificial Sequence: Synthetic peptide
  Seed: FAFGEPREL (MAGC1_HUMAN)
FYFGEPREI

SEQ ID NO: 76429 - protein, 9 aa, Artificial Sequence
  Description of Artificial Sequence: Synthetic peptide
  Seed: VIFRKAREF (MAGC1_HUMAN)
VYFRKAREF

SEQ ID NO: 76430 - protein, 10 aa, Artificial Sequence
  Description of Artificial Sequence: Synthetic peptide
  Seed: STLLSLFQSF (MAGC1_HUMAN)
SYLLSLFQSF

SEQ ID NO: 76431 - protein, 11 aa, Artificial Sequence
  Description of Artificial Sequence: Synthetic peptide
  Seed: REVDPDDSYVF (MAGC1_HUMAN)
RVVDPDDSYVY

SEQ ID NO: 76432 - protein, 9 aa, Artificial Sequence
  Description of Artificial Sequence: Synthetic peptide
  Seed: IESEPLFTY (MAGC1_HUMAN)
IFSEPLFTY

SEQ ID NO: 76433 - protein, 9 aa, Artificial Sequence
  Description of Artificial Sequence: Synthetic peptide
  Seed: GFPQSPLQI (MAGC1_HUMAN)
GGPQSPLQL

SEQ ID NO: 76434 - protein, 9 aa, Artificial Sequence
  Description of Artificial Sequence: Synthetic peptide
  Seed: SAASSSTLV (MAGC1_HUMAN)
SAASSSTLH

SEQ ID NO: 76435 - protein, 9 aa, Artificial Sequence
  Description of Artificial Sequence: Synthetic peptide
  Seed: RLLILILSI (MAGC1_HUMAN)
RVLILILSI

SEQ ID NO: 76436 - protein, 9 aa, Artificial Sequence
  Description of Artificial Sequence: Synthetic peptide
  Seed: SASSSVMSP (MAGC1_HUMAN)
SVSSSVMSF

SEQ ID NO: 76437 - protein, 10 aa, Artificial Sequence
  Description of Artificial Sequence: Synthetic peptide
  Seed: TDDSTATESA (MAGC1_HUMAN)
TEDSTATESA

SEQ ID NO: 76438 - protein, 10 aa, Artificial Sequence
  Description of Artificial Sequence: Synthetic peptide
  Seed: LQIPVSSSFS (MAGC1_HUMAN)
LMIPVSSSFG

SEQ ID NO: 76439 - protein, 10 aa, Artificial Sequence
  Description of Artificial Sequence: Synthetic peptide
  Seed: LIESEPLFTY (MAGC1_HUMAN)
LMESEPLFTF

SEQ ID NO: 76440 - protein, 10 aa, Artificial Sequence
  Description of Artificial Sequence: Synthetic peptide
  Seed: LQIPGSPSFS (MAGC1_HUMAN)
LMIPGSPSFR

SEQ ID NO: 76441 - protein, 9 aa, Artificial Sequence
  Description of Artificial Sequence: Synthetic peptide
  Seed: QIVPSLPEW (MAGC1_HUMAN)
QTVPSLPEM

SEQ ID NO: 76442 - protein, 11 aa, Artificial Sequence
  Description of Artificial Sequence: Synthetic peptide
  Seed: AASSSTLVSIF (MAGC1_HUMAN)
AVSSSTLVSIW

SEQ ID NO: 76443 - protein, 10 aa, Artificial Sequence
  Description of Artificial Sequence: Synthetic peptide
  Seed: MTSSFSSTLL (MAGC1_HUMAN)
MLSSFSSTLY

SEQ ID NO: 76444 - protein, 9 aa, Artificial Sequence
  Description of Artificial Sequence: Synthetic peptide
  Seed: SAPEGEDSL (MAGC1_HUMAN)
STPEGEDSL

SEQ ID NO: 76445 - protein, 11 aa, Artificial Sequence
  Description of Artificial Sequence: Synthetic peptide
  Seed: REVDPDDSYVF (MAGC1_HUMAN)
RMVDPDDSYVL

SEQ ID NO: 76446 - protein, 9 aa, Artificial Sequence
  Description of Artificial Sequence: Synthetic peptide
  Seed: RLLILILSI (MAGC1_HUMAN)
RILILILSV

SEQ ID NO: 76447 - protein, 9 aa, Artificial Sequence
  Description of Artificial Sequence: Synthetic peptide
  Seed: TLLSILQSS (MAGC1_HUMAN)
TMLSILQST

SEQ ID NO: 76448 - protein, 10 aa, Artificial Sequence
  Description of Artificial Sequence: Synthetic peptide
  Seed: FSSSTSLSPF (MAGC1_HUMAN)
FVSSTSLSPW

SEQ ID NO: 76449 - protein, 9 aa, Artificial Sequence
  Description of Artificial Sequence: Synthetic peptide
  Seed: IFQSSPESA (MAGC1_HUMAN)
IWQSSPESY

SEQ ID NO: 76450 - protein, 10 aa, Artificial Sequence
  Description of Artificial Sequence: Synthetic peptide
  Seed: SPLQNPASSF (MAGC1_HUMAN)
SMLQNPASSY

SEQ ID NO: 76451 - protein, 9 aa, Artificial Sequence
  Description of Artificial Sequence: Synthetic peptide
  Seed: RKAREFIEI (MAGC1_HUMAN)
RQAREFIEY

SEQ ID NO: 76452 - protein, 9 aa, Artificial Sequence
  Description of Artificial Sequence: Synthetic peptide
  Seed: FSSTLLSLF (MAGC1_HUMAN)
FSSTLLSLA

SEQ ID NO: 76453 - protein, 9 aa, Artificial Sequence
  Description of Artificial Sequence: Synthetic peptide
  Seed: SSPERTHST (MAGC1_HUMAN)
SAPERTHSI

SEQ ID NO: 76454 - protein, 9 aa, Artificial Sequence
  Description of Artificial Sequence: Synthetic peptide
  Seed: RKVVEFLAM (MAGC1_HUMAN)
RYVVEFLAF

SEQ ID NO: 76455 - protein, 9 aa, Artificial Sequence
  Description of Artificial Sequence: Synthetic peptide
  Seed: SMSPLYFPQ (MAGC1_HUMAN)
SVSPLYFPR

SEQ ID NO: 76456 - protein, 9 aa, Artificial Sequence
  Description of Artificial Sequence: Synthetic peptide
  Seed: MSQNRLLIL (MAGC1_HUMAN)
MSQNRLLIM

SEQ ID NO: 76457 - protein, 9 aa, Artificial Sequence
  Description of Artificial Sequence: Synthetic peptide
  Seed: IFRKAREFI (MAGC1_HUMAN)
IYRKAREFM

SEQ ID NO: 76458 - protein, 10 aa, Artificial Sequence
  Description of Artificial Sequence: Synthetic peptide
  Seed: REFIEILFGI (MAGC1_HUMAN)
RRFIEILFGT

SEQ ID NO: 76459 - protein, 10 aa, Artificial Sequence
  Description of Artificial Sequence: Synthetic peptide
  Seed: SFSERTQSTF (MAGC1_HUMAN)
SASERTQSTF

SEQ ID NO: 76460 - protein, 9 aa, Artificial Sequence
  Description of Artificial Sequence: Synthetic peptide
  Seed: FSSTLLSIL (MAGC1_HUMAN)
FASTLLSII

SEQ ID NO: 76461 - protein, 10 aa, Artificial Sequence
  Description of Artificial Sequence: Synthetic peptide
  Seed: YLEYREVPNS (MAGC1_HUMAN)
YMEYREVPNM

SEQ ID NO: 76462 - protein, 10 aa, Artificial Sequence
  Description of Artificial Sequence: Synthetic peptide
  Seed: SFPSSTSSSL (MAGC1_HUMAN)
SKPSSTSSSF

SEQ ID NO: 76463 - protein, 10 aa, Artificial Sequence
  Description of Artificial Sequence: Synthetic peptide
  Seed: EVIWDVLSGI (MAGC1_HUMAN)
EAIWDVLSGW

SEQ ID NO: 76464 - protein, 9 aa, Artificial Sequence
  Description of Artificial Sequence: Synthetic peptide
  Seed: SICSSSTSL (MAGC1_HUMAN)
SYCSSSTSM

SEQ ID NO: 76465 - protein, 10 aa, Artificial Sequence
  Description of Artificial Sequence: Synthetic peptide
  Seed: VSPSSSSTLL (MAGC1_HUMAN)
VAPSSSSTLY

SEQ ID NO: 76466 - protein, 10 aa, Artificial Sequence
  Description of Artificial Sequence: Synthetic peptide
  Seed: TLDEKVDELA (MAGC1_HUMAN)
TIDEKVDELL

SEQ ID NO: 76467 - protein, 9 aa, Artificial Sequence
  Description of Artificial Sequence: Synthetic peptide
  Seed: TLASLLQSS (MAGC1_HUMAN)
TAASLLQSI

SEQ ID NO: 76468 - protein, 10 aa, Artificial Sequence
  Description of Artificial Sequence: Synthetic peptide
  Seed: FPQSVLQIPV (MAGC1_HUMAN)
FTQSVLQIPI

SEQ ID NO: 76469 - protein, 10 aa, Artificial Sequence
  Description of Artificial Sequence: Synthetic peptide
  Seed: YTLLSLFQSS (MAGC1_HUMAN)
YQLLSLFQSL

SEQ ID NO: 76470 - protein, 9 aa, Artificial Sequence
  Description of Artificial Sequence: Synthetic peptide
  Seed: MTSSFSSTL (MAGC1_HUMAN)
MPSSFSSTH

SEQ ID NO: 76471 - protein, 11 aa, Artificial Sequence
  Description of Artificial Sequence: Synthetic peptide
  Seed: TVPITFPSSYK (MAGC1_HUMAN)
TTPITFPSSYK

SEQ ID NO: 76472 - protein, 11 aa, Artificial Sequence
  Description of Artificial Sequence: Synthetic peptide
  Seed: TLDEKVDELAR (MAGC1_HUMAN)
TTDEKVDELAL

SEQ ID NO: 76473 - protein, 9 aa, Artificial Sequence
  Description of Artificial Sequence: Synthetic peptide
  Seed: TLDEKVDEL (MAGC1_HUMAN)
TGDEKVDEV

SEQ ID NO: 76474 - protein, 10 aa, Artificial Sequence
  Description of Artificial Sequence: Synthetic peptide
  Seed: RAGREHFAFG (MAGC1_HUMAN)
RMGREHFAFK

SEQ ID NO: 76475 - protein, 10 aa, Artificial Sequence
  Description of Artificial Sequence: Synthetic peptide
  Seed: FPQSLLQIPM (MAGC1_HUMAN)
FDQSLLQIPF

SEQ ID NO: 76476 - protein, 10 aa, Artificial Sequence
  Description of Artificial Sequence: Synthetic peptide
  Seed: EWEDSLSPHY (MAGC1_HUMAN)
ESEDSLSPHY

SEQ ID NO: 76477 - protein, 9 aa, Artificial Sequence
  Description of Artificial Sequence: Synthetic peptide
  Seed: SPLEGEDSL (MAGC1_HUMAN)
SHLEGEDSL

SEQ ID NO: 76478 - protein, 10 aa, Artificial Sequence
  Description of Artificial Sequence: Synthetic peptide
  Seed: VISFSSSTSL (MAGC1_HUMAN)
VRSFSSSTSM

SEQ ID NO: 76479 - protein, 9 aa, Artificial Sequence
  Description of Artificial Sequence: Synthetic peptide
  Seed: FSSTLVSLF (MAGC1_HUMAN)
FRSTLVSLI

SEQ ID NO: 76480 - protein, 9 aa, Artificial Sequence
  Description of Artificial Sequence: Synthetic peptide
  Seed: FSSTLLSIL (MAGC1_HUMAN)
FSSTLLSIV

SEQ ID NO: 76481 - protein, 10 aa, Artificial Sequence
  Description of Artificial Sequence: Synthetic peptide
  Seed: RTHSTFEGFP (MAGC1_HUMAN)
RFHSTFEGFK

SEQ ID NO: 76482 - protein, 9 aa, Artificial Sequence
  Description of Artificial Sequence: Synthetic peptide
  Seed: EVDPDDSYV (MAGC1_HUMAN)
ELDPDDSYL

SEQ ID NO: 76483 - protein, 10 aa, Artificial Sequence
  Description of Artificial Sequence: Synthetic peptide
  Seed: LAMLKNTVPI (MAGC1_HUMAN)
LMMLKNTVPF

SEQ ID NO: 76484 - protein, 10 aa, Artificial Sequence
  Description of Artificial Sequence: Synthetic peptide
  Seed: FSSSTSLSPF (MAGC1_HUMAN)
FGSSTSLSPW

SEQ ID NO: 76485 - protein, 9 aa, Artificial Sequence
  Description of Artificial Sequence: Synthetic peptide
  Seed: SPLQSPVIS (MAGC1_HUMAN)
SPLQSPVIM

SEQ ID NO: 76486 - protein, 10 aa, Artificial Sequence
  Description of Artificial Sequence: Synthetic peptide
  Seed: SSFSYTLLSL (MAGC1_HUMAN)
SEFSYTLLSF

SEQ ID NO: 76487 - protein, 9 aa, Artificial Sequence
  Description of Artificial Sequence: Synthetic peptide
  Seed: MTSSFSSTL (MAGC1_HUMAN)
MASSFSSTR

SEQ ID NO: 76488 - protein, 9 aa, Artificial Sequence
  Description of Artificial Sequence: Synthetic peptide
  Seed: NSSPPRYEF (MAGC1_HUMAN)
NTSPPRYEW

SEQ ID NO: 76489 - protein, 9 aa, Artificial Sequence
  Description of Artificial Sequence: Synthetic peptide
  Seed: LQIPVSAAS (MAGC1_HUMAN)
LQIPVSAAM

SEQ ID NO: 76490 - protein, 9 aa, Artificial Sequence
  Description of Artificial Sequence: Synthetic peptide
  Seed: TSSFSSTLL (MAGC1_HUMAN)
TISFSSTLV

SEQ ID NO: 76491 - protein, 9 aa, Artificial Sequence
  Description of Artificial Sequence: Synthetic peptide
  Seed: AQSSLQIPV (MAGC1_HUMAN)
AESSLQIPV

SEQ ID NO: 76492 - protein, 9 aa, Artificial Sequence
  Description of Artificial Sequence: Synthetic peptide
  Seed: IEILFGISL (MAGC1_HUMAN)
IAILFGISF

SEQ ID NO: 76493 - protein, 9 aa, Artificial Sequence
  Description of Artificial Sequence: Synthetic peptide
  Seed: LQRPVSSFF (MAGC1_HUMAN)
LKRPVSSFY

SEQ ID NO: 76494 - protein, 9 aa, Artificial Sequence
  Description of Artificial Sequence: Synthetic peptide
  Seed: SSPERTQST (MAGC1_HUMAN)
SMPERTQSI

SEQ ID NO: 76495 - protein, 9 aa, Artificial Sequence
  Description of Artificial Sequence: Synthetic peptide
  Seed: SSSSTLLSL (MAGC1_HUMAN)
SGSSTLLSF

SEQ ID NO: 76496 - protein, 9 aa, Artificial Sequence
  Description of Artificial Sequence: Synthetic peptide
  Seed: VSPSFSSTL (MAGC1_HUMAN)
VTPSFSSTW

SEQ ID NO: 76497 - protein, 9 aa, Artificial Sequence
  Description of Artificial Sequence: Synthetic peptide
  Seed: SIIFIKGTY (MAGC1_HUMAN)
STIFIKGTF

SEQ ID NO: 76498 - protein, 10 aa, Artificial Sequence
  Description of Artificial Sequence: Synthetic peptide
  Seed: SLFQSSPERT (MAGC1_HUMAN)
SMFQSSPERI

SEQ ID NO: 76499 - protein, 9 aa, Artificial Sequence
  Description of Artificial Sequence: Synthetic peptide
  Seed: LQIPVSRSF (MAGC1_HUMAN)
LLIPVSRSW

SEQ ID NO: 76500 - protein, 9 aa, Artificial Sequence
  Description of Artificial Sequence: Synthetic peptide
  Seed: LKYQVKQPI (MAGC1_HUMAN)
LQYQVKQPI

SEQ ID NO: 76501 - protein, 9 aa, Artificial Sequence
  Description of Artificial Sequence: Synthetic peptide
  Seed: SFSSTLVSL (MAGC1_HUMAN)
SWSSTLVSM

SEQ ID NO: 76502 - protein, 9 aa, Artificial Sequence
  Description of Artificial Sequence: Synthetic peptide
  Seed: VSRSFSSTL (MAGC1_HUMAN)
VVRSFSSTI

SEQ ID NO: 76503 - protein, 9 aa, Artificial Sequence
  Description of Artificial Sequence: Synthetic peptide
  Seed: LILSIIFIK (MAGC1_HUMAN)
LLLSIIFIK

SEQ ID NO: 76504 - protein, 11 aa, Artificial Sequence
  Description of Artificial Sequence: Synthetic peptide
  Seed: SPLQIPVSSSS (MAGC1_HUMAN)
SALQIPVSSSM

SEQ ID NO: 76505 - protein, 11 aa, Artificial Sequence
  Description of Artificial Sequence: Synthetic peptide
  Seed: SSSFSYTLLSL (MAGC1_HUMAN)
SRSFSYTLLSW

SEQ ID NO: 76506 - protein, 10 aa, Artificial Sequence
  Description of Artificial Sequence: Synthetic peptide
  Seed: RTQSTFEGFA (MAGC1_HUMAN)
RVQSTFEGFK

SEQ ID NO: 76507 - protein, 9 aa, Artificial Sequence
  Description of Artificial Sequence: Synthetic peptide
  Seed: ELARFLLLK (MAGC1_HUMAN)
EAARFLLLK

SEQ ID NO: 76508 - protein, 9 aa, Artificial Sequence
  Description of Artificial Sequence: Synthetic peptide
  Seed: FEGFAQSPL (MAGC1_HUMAN)
FEGFAQSPF

SEQ ID NO: 76509 - protein, 9 aa, Artificial Sequence
  Description of Artificial Sequence: Synthetic peptide
  Seed: FSEESSSPV (MAGC1_HUMAN)
FMEESSSPT

SEQ ID NO: 76510 - protein, 9 aa, Artificial Sequence
  Description of Artificial Sequence: Synthetic peptide
  Seed: TSLSLPQSF (MAGC1_HUMAN)
TALSLPQSI

SEQ ID NO: 76511 - protein, 10 aa, Artificial Sequence
  Description of Artificial Sequence: Synthetic peptide
  Seed: SLQIPVSPSF (MAGC1_HUMAN)
SAQIPVSPSY

SEQ ID NO: 76512 - protein, 9 aa, Artificial Sequence
  Description of Artificial Sequence: Synthetic peptide
  Seed: LQIPMTSSF (MAGC1_HUMAN)
LQIPMTSSL

SEQ ID NO: 76513 - protein, 9 aa, Artificial Sequence
  Description of Artificial Sequence: Synthetic peptide
  Seed: LEYREVPNS (MAGC1_HUMAN)
LEYREVPNA

SEQ ID NO: 76514 - protein, 9 aa, Artificial Sequence
  Description of Artificial Sequence: Synthetic peptide
  Seed: SLFQSFSER (MAGC1_HUMAN)
SVFQSFSEY

SEQ ID NO: 76515 - protein, 9 aa, Artificial Sequence
  Description of Artificial Sequence: Synthetic peptide
  Seed: SGIGVRAGR (MAGC1_HUMAN)
SAIGVRAGM

SEQ ID NO: 76516 - protein, 10 aa, Artificial Sequence
  Description of Artificial Sequence: Synthetic peptide
  Seed: SPLHSPQSPP (MAGC1_HUMAN)
SPLHSPQSPA

SEQ ID NO: 76517 - protein, 8 aa, Artificial Sequence
  Description of Artificial Sequence: Synthetic peptide
  Seed: SPLQIPGS (MAGC1_HUMAN)
SPLQIPGA

SEQ ID NO: 76518 - protein, 9 aa, Artificial Sequence
  Description of Artificial Sequence: Synthetic peptide
  Seed: FQSSLQSPV (MAGC1_HUMAN)
FRSSLQSPL

SEQ ID NO: 76519 - protein, 9 aa, Artificial Sequence
  Description of Artificial Sequence: Synthetic peptide
  Seed: YQVKQPITK (MAGC1_HUMAN)
YLVKQPITK

SEQ ID NO: 76520 - protein, 10 aa, Artificial Sequence
  Description of Artificial Sequence: Synthetic peptide
  Seed: MLKNTVPITF (MAGC1_HUMAN)
MAKNTVPITW

SEQ ID NO: 76521 - protein, 9 aa, Artificial Sequence
  Description of Artificial Sequence: Synthetic peptide
  Seed: GTYASEEVI (MAGC1_HUMAN)
GAYASEEVW

SEQ ID NO: 76522 - protein, 11 aa, Artificial Sequence
  Description of Artificial Sequence: Synthetic peptide
  Seed: VSSSSSSSTLL (MAGC1_HUMAN)
VMSSSSSSTLW

SEQ ID NO: 76523 - protein, 9 aa, Artificial Sequence
  Description of Artificial Sequence: Synthetic peptide
  Seed: FQSSPERTH (MAGC1_HUMAN)
FMSSPERTM

SEQ ID NO: 76524 - protein, 9 aa, Artificial Sequence
  Description of Artificial Sequence: Synthetic peptide
  Seed: NTVPITFPS (MAGC1_HUMAN)
NTVPITFPT

SEQ ID NO: 76525 - protein, 9 aa, Artificial Sequence
  Description of Artificial Sequence: Synthetic peptide
  Seed: LQRPVSSFF (MAGC1_HUMAN)
LVRPVSSFA

SEQ ID NO: 76526 - protein, 9 aa, Artificial Sequence
  Description of Artificial Sequence: Synthetic peptide
  Seed: LQIPVSSSS (MAGC1_HUMAN)
LWIPVSSSM

SEQ ID NO: 76527 - protein, 9 aa, Artificial Sequence
  Description of Artificial Sequence: Synthetic peptide
  Seed: SSSFSYTLL (MAGC1_HUMAN)
SVSFSYTLY

SEQ ID NO: 76528 - protein, 10 aa, Artificial Sequence
  Description of Artificial Sequence: Synthetic peptide
  Seed: LAMLKNTVPI (MAGC1_HUMAN)
LTMLKNTVPL

SEQ ID NO: 76529 - protein, 10 aa, Artificial Sequence
  Description of Artificial Sequence: Synthetic peptide
  Seed: SFSYTLLSLF (MAGC1_HUMAN)
SKSYTLLSLY

SEQ ID NO: 76530 - protein, 9 aa, Artificial Sequence
  Description of Artificial Sequence: Synthetic peptide
  Seed: LSDEQGMSQ (MAGC1_HUMAN)
LDDEQGMSF

SEQ ID NO: 76531 - protein, 9 aa, Artificial Sequence
  Description of Artificial Sequence: Synthetic peptide
  Seed: REVDPDDSY (MAGC1_HUMAN)
RIVDPDDSF

SEQ ID NO: 76532 - protein, 9 aa, Artificial Sequence
  Description of Artificial Sequence: Synthetic peptide
  Seed: LQSPVISFS (MAGC1_HUMAN)
LVSPVISFT

SEQ ID NO: 76533 - protein, 10 aa, Artificial Sequence
  Description of Artificial Sequence: Synthetic peptide
  Seed: SQSPPEGEDV (MAGC1_HUMAN)
SQSPPEGEDF

SEQ ID NO: 76534 - protein, 9 aa, Artificial Sequence
  Description of Artificial Sequence: Synthetic peptide
  Seed: VSRSFSSTL (MAGC1_HUMAN)
VTRSFSSTK

SEQ ID NO: 76535 - protein, 10 aa, Artificial Sequence
  Description of Artificial Sequence: Synthetic peptide
  Seed: SSFSYTLLSL (MAGC1_HUMAN)
SQFSYTLLSW

SEQ ID NO: 76536 - protein, 10 aa, Artificial Sequence
  Description of Artificial Sequence: Synthetic peptide
  Seed: VISFSSSTSL (MAGC1_HUMAN)
VFSFSSSTSW

SEQ ID NO: 76537 - protein, 10 aa, Artificial Sequence
  Description of Artificial Sequence: Synthetic peptide
  Seed: KVVEFLAMLK (MAGC1_HUMAN)
KIVEFLAMLR

SEQ ID NO: 76538 - protein, 9 aa, Artificial Sequence
  Description of Artificial Sequence: Synthetic peptide
  Seed: SSPERTHST (MAGC1_HUMAN)
SQPERTHSI

SEQ ID NO: 76539 - protein, 9 aa, Artificial Sequence
  Description of Artificial Sequence: Synthetic peptide
  Seed: YTGYFPVIF (MAGC1_HUMAN)
YRGYFPVIL

SEQ ID NO: 76540 - protein, 9 aa, Artificial Sequence
  Description of Artificial Sequence: Synthetic peptide
  Seed: AQSPLQSPV (MAGC1_HUMAN)
AQSPLQSPY

SEQ ID NO: 76541 - protein, 9 aa, Artificial Sequence
  Description of Artificial Sequence: Synthetic peptide
  Seed: SSSFSYTLL (MAGC1_HUMAN)
SQSFSYTLI

SEQ ID NO: 76542 - protein, 9 aa, Artificial Sequence
  Description of Artificial Sequence: Synthetic peptide
  Seed: KVVEFLAML (MAGC1_HUMAN)
KAVEFLAMF

SEQ ID NO: 76543 - protein, 9 aa, Artificial Sequence
  Description of Artificial Sequence: Synthetic peptide
  Seed: FSSTLLSLF (MAGC1_HUMAN)
FRSTLLSLM

SEQ ID NO: 76544 - protein, 8 aa, Artificial Sequence
  Description of Artificial Sequence: Synthetic peptide
  Seed: IFRKAREF (MAGC1_HUMAN)
IARKAREL

SEQ ID NO: 76545 - protein, 10 aa, Artificial Sequence
  Description of Artificial Sequence: Synthetic peptide
  Seed: STSLSLPQSF (MAGC1_HUMAN)
SMSLSLPQSW

SEQ ID NO: 76546 - protein, 11 aa, Artificial Sequence
  Description of Artificial Sequence: Synthetic peptide
  Seed: RPVSSFFSYTL (MAGC1_HUMAN)
RGVSSFFSYTW

SEQ ID NO: 76547 - protein, 9 aa, Artificial Sequence
  Description of Artificial Sequence: Synthetic peptide
  Seed: EDSQSPLQI (MAGC1_HUMAN)
EESQSPLQY

SEQ ID NO: 76548 - protein, 10 aa, Artificial Sequence
  Description of Artificial Sequence: Synthetic peptide
  Seed: RAGREHFAFG (MAGC1_HUMAN)
RWGREHFAFA

SEQ ID NO: 76549 - protein, 9 aa, Artificial Sequence
  Description of Artificial Sequence: Synthetic peptide
  Seed: SRYTGYFPV (MAGC1_HUMAN)
SIYTGYFPF

SEQ ID NO: 76550 - protein, 9 aa, Artificial Sequence
  Description of Artificial Sequence: Synthetic peptide
  Seed: CSSSTSLSL (MAGC1_HUMAN)
CTSSTSLSY

SEQ ID NO: 76551 - protein, 9 aa, Artificial Sequence
  Description of Artificial Sequence: Synthetic peptide
  Seed: EILFGISLR (MAGC1_HUMAN)
ESLFGISLK

SEQ ID NO: 76552 - protein, 11 aa, Artificial Sequence
  Description of Artificial Sequence: Synthetic peptide
  Seed: QSSPESAQSTF (MAGC1_HUMAN)
QCSPESAQSTW

SEQ ID NO: 76553 - protein, 10 aa, Artificial Sequence
  Description of Artificial Sequence: Synthetic peptide
  Seed: WGPRAHSEVI (MAGC1_HUMAN)
WTPRAHSEVI

SEQ ID NO: 76554 - protein, 10 aa, Artificial Sequence
  Description of Artificial Sequence: Synthetic peptide
  Seed: KAEMLTNVIS (MAGC1_HUMAN)
KVEMLTNVIA

SEQ ID NO: 76555 - protein, 9 aa, Artificial Sequence
  Description of Artificial Sequence: Synthetic peptide
  Seed: EGDDTQSPL (MAGC1_HUMAN)
EIDDTQSPL

SEQ ID NO: 76556 - protein, 10 aa, Artificial Sequence
  Description of Artificial Sequence: Synthetic peptide
  Seed: STFEGFPQSL (MAGC1_HUMAN)
SHFEGFPQSC

SEQ ID NO: 76557 - protein, 10 aa, Artificial Sequence
  Description of Artificial Sequence: Synthetic peptide
  Seed: RPVSSFFSYT (MAGC1_HUMAN)
RPVSSFFSYV

SEQ ID NO: 76558 - protein, 10 aa, Artificial Sequence
  Description of Artificial Sequence: Synthetic peptide
  Seed: SVLQIPVSAA (MAGC1_HUMAN)
SALQIPVSAV

SEQ ID NO: 76559 - protein, 10 aa, Artificial Sequence
  Description of Artificial Sequence: Synthetic peptide
  Seed: ASSSVMSPSF (MAGC1_HUMAN)
AASSVMSPSW

SEQ ID NO: 76560 - protein, 9 aa, Artificial Sequence
  Description of Artificial Sequence: Synthetic peptide
  Seed: GSPSFSSTL (MAGC1_HUMAN)
GAPSFSSTM

SEQ ID NO: 76561 - protein, 9 aa, Artificial Sequence
  Description of Artificial Sequence: Synthetic peptide
  Seed: RYTGYFPVI (MAGC1_HUMAN)
RQTGYFPVY

SEQ ID NO: 76562 - protein, 9 aa, Artificial Sequence
  Description of Artificial Sequence: Synthetic peptide
  Seed: ASSFFSSAL (MAGC1_HUMAN)
AQSFFSSAW

SEQ ID NO: 76563 - protein, 10 aa, Artificial Sequence
  Description of Artificial Sequence: Synthetic peptide
  Seed: PLQIPVSSSF (MAGC1_HUMAN)
PSQIPVSSSM

SEQ ID NO: 76564 - protein, 9 aa, Artificial Sequence
  Description of Artificial Sequence: Synthetic peptide
  Seed: VPITFPSSY (MAGC1_HUMAN)
VSITFPSSY

SEQ ID NO: 76565 - protein, 9 aa, Artificial Sequence
  Description of Artificial Sequence: Synthetic peptide
  Seed: KVWVQEHYL (MAGC1_HUMAN)
KLWVQEHYR

SEQ ID NO: 76566 - protein, 9 aa, Artificial Sequence
  Description of Artificial Sequence: Synthetic peptide
  Seed: VSAASSSTL (MAGC1_HUMAN)
VKAASSSTM

SEQ ID NO: 76567 - protein, 9 aa, Artificial Sequence
  Description of Artificial Sequence: Synthetic peptide
  Seed: GSPSFSSTL (MAGC1_HUMAN)
GTPSFSSTV

SEQ ID NO: 76568 - protein, 10 aa, Artificial Sequence
  Description of Artificial Sequence: Synthetic peptide
  Seed: FPSSYKDALK (MAGC1_HUMAN)
FFSSYKDALR

SEQ ID NO: 76569 - protein, 10 aa, Artificial Sequence
  Description of Artificial Sequence: Synthetic peptide
  Seed: KAREFIEILF (MAGC1_HUMAN)
KAREFIEILY

SEQ ID NO: 76570 - protein, 9 aa, Artificial Sequence
  Description of Artificial Sequence: Synthetic peptide
  Seed: SSTSSSLSK (MAGC1_HUMAN)
SSTSSSLSF

SEQ ID NO: 76571 - protein, 10 aa, Artificial Sequence
  Description of Artificial Sequence: Synthetic peptide
  Seed: MTSSFSSTLL (MAGC1_HUMAN)
MQSSFSSTLW

SEQ ID NO: 76572 - protein, 10 aa, Artificial Sequence
  Description of Artificial Sequence: Synthetic peptide
  Seed: SRYTGYFPVI (MAGC1_HUMAN)
SPYTGYFPVI

SEQ ID NO: 76573 - protein, 10 aa, Artificial Sequence
  Description of Artificial Sequence: Synthetic peptide
  Seed: LAMLKNTVPI (MAGC1_HUMAN)
LDMLKNTVPM

SEQ ID NO: 76574 - protein, 9 aa, Artificial Sequence
  Description of Artificial Sequence: Synthetic peptide
  Seed: KAREFIEIL (MAGC1_HUMAN)
KVREFIEIA

SEQ ID NO: 76575 - protein, 9 aa, Artificial Sequence
  Description of Artificial Sequence: Synthetic peptide
  Seed: SFSSTLVSL (MAGC1_HUMAN)
SRSSTLVSM

SEQ ID NO: 76576 - protein, 9 aa, Artificial Sequence
  Description of Artificial Sequence: Synthetic peptide
  Seed: FSSALLSIF (MAGC1_HUMAN)
FESALLSIF

SEQ ID NO: 76577 - protein, 9 aa, Artificial Sequence
  Description of Artificial Sequence: Synthetic peptide
  Seed: NPASSFFSS (MAGC1_HUMAN)
NSASSFFSY

SEQ ID NO: 76578 - protein, 9 aa, Artificial Sequence
  Description of Artificial Sequence: Synthetic peptide
  Seed: IPVSRSFSS (MAGC1_HUMAN)
IPVSRSFSW

SEQ ID NO: 76579 - protein, 10 aa, Artificial Sequence
  Description of Artificial Sequence: Synthetic peptide
  Seed: ELARFLLLKY (MAGC1_HUMAN)
EMARFLLLKK

SEQ ID NO: 76580 - protein, 9 aa, Artificial Sequence
  Description of Artificial Sequence: Synthetic peptide
  Seed: SGIGVRAGR (MAGC1_HUMAN)
STIGVRAGY

SEQ ID NO: 76581 - protein, 9 aa, Artificial Sequence
  Description of Artificial Sequence: Synthetic peptide
  Seed: AFGEPRELL (MAGC1_HUMAN)
AAGEPRELM

SEQ ID NO: 76582 - protein, 10 aa, Artificial Sequence
  Description of Artificial Sequence: Synthetic peptide
  Seed: YTLDEKVDEL (MAGC1_HUMAN)
YFLDEKVDEI

SEQ ID NO: 76583 - protein, 10 aa, Artificial Sequence
  Description of Artificial Sequence: Synthetic peptide
  Seed: ESAQSTFEGF (MAGC1_HUMAN)
EMAQSTFEGY

SEQ ID NO: 76584 - protein, 10 aa, Artificial Sequence
  Description of Artificial Sequence: Synthetic peptide
  Seed: GEDSLSPHYF (MAGC1_HUMAN)
GEDSLSPHYI

SEQ ID NO: 76585 - protein, 10 aa, Artificial Sequence
  Description of Artificial Sequence: Synthetic peptide
  Seed: MSQNRLLILI (MAGC1_HUMAN)
MIQNRLLILW

SEQ ID NO: 76586 - protein, 10 aa, Artificial Sequence
  Description of Artificial Sequence: Synthetic peptide
  Seed: KGTYASEEVI (MAGC1_HUMAN)
KNTYASEEVY

SEQ ID NO: 76587 - protein, 9 aa, Artificial Sequence
  Description of Artificial Sequence: Synthetic peptide
  Seed: AQSSLQIPV (MAGC1_HUMAN)
AVSSLQIPI

SEQ ID NO: 76588 - protein, 10 aa, Artificial Sequence
  Description of Artificial Sequence: Synthetic peptide
  Seed: FPQSVLQIPV (MAGC1_HUMAN)
FVQSVLQIPI

SEQ ID NO: 76589 - protein, 9 aa, Artificial Sequence
  Description of Artificial Sequence: Synthetic peptide
  Seed: GSPSFSSTL (MAGC1_HUMAN)
GAPSFSSTY

SEQ ID NO: 76590 - protein, 11 aa, Artificial Sequence
  Description of Artificial Sequence: Synthetic peptide
  Seed: TTDDSTATESA (MAGC1_HUMAN)
TLDDSTATESL

SEQ ID NO: 76591 - protein, 10 aa, Artificial Sequence
  Description of Artificial Sequence: Synthetic peptide
  Seed: RTHSTFEGFP (MAGC1_HUMAN)
RVHSTFEGFK

SEQ ID NO: 76592 - protein, 9 aa, Artificial Sequence
  Description of Artificial Sequence: Synthetic peptide
  Seed: IPVSRSFSS (MAGC1_HUMAN)
IPVSRSFSF

SEQ ID NO: 76593 - protein, 11 aa, Artificial Sequence
  Description of Artificial Sequence: Synthetic peptide
  Seed: TLYPLQSPQSR (MAGC1_HUMAN)
TMYPLQSPQSR

SEQ ID NO: 76594 - protein, 11 aa, Artificial Sequence
  Description of Artificial Sequence: Synthetic peptide
  Seed: SLIESEPLFTY (MAGC1_HUMAN)
SLIESEPLFTV

SEQ ID NO: 76595 - protein, 9 aa, Artificial Sequence
  Description of Artificial Sequence: Synthetic peptide
  Seed: IPVSPSSSS (MAGC1_HUMAN)
IAVSPSSSF

SEQ ID NO: 76596 - protein, 9 aa, Artificial Sequence
  Description of Artificial Sequence: Synthetic peptide
  Seed: SSHESPQSP (MAGC1_HUMAN)
SAHESPQSF

SEQ ID NO: 76597 - protein, 10 aa, Artificial Sequence
  Description of Artificial Sequence: Synthetic peptide
  Seed: LQIPVSSSFS (MAGC1_HUMAN)
LMIPVSSSFA

SEQ ID NO: 76598 - protein, 10 aa, Artificial Sequence
  Description of Artificial Sequence: Synthetic peptide
  Seed: SQNRLLILIL (MAGC1_HUMAN)
SRNRLLILIF

SEQ ID NO: 76599 - protein, 9 aa, Artificial Sequence
  Description of Artificial Sequence: Synthetic peptide
  Seed: SPESDDTLY (MAGC1_HUMAN)
SMESDDTLY

SEQ ID NO: 76600 - protein, 9 aa, Artificial Sequence
  Description of Artificial Sequence: Synthetic peptide
  Seed: LKYQVKQPI (MAGC1_HUMAN)
LSYQVKQPF

SEQ ID NO: 76601 - protein, 9 aa, Artificial Sequence
  Description of Artificial Sequence: Synthetic peptide
  Seed: VSPSSSSTL (MAGC1_HUMAN)
VRPSSSSTL

SEQ ID NO: 76602 - protein, 10 aa, Artificial Sequence
  Description of Artificial Sequence: Synthetic peptide
  Seed: TGYFPVIFRK (MAGC1_HUMAN)
TAYFPVIFRY

SEQ ID NO: 76603 - protein, 9 aa, Artificial Sequence
  Description of Artificial Sequence: Synthetic peptide
  Seed: YTGYFPVIF (MAGC1_HUMAN)
YMGYFPVIW

SEQ ID NO: 76604 - protein, 10 aa, Artificial Sequence
  Description of Artificial Sequence: Synthetic peptide
  Seed: QRPVSSFFSY (MAGC1_HUMAN)
QLPVSSFFSY

SEQ ID NO: 76605 - protein, 9 aa, Artificial Sequence
  Description of Artificial Sequence: Synthetic peptide
  Seed: GYFPVIFRK (MAGC1_HUMAN)
GAFPVIFRR

SEQ ID NO: 76606 - protein, 9 aa, Artificial Sequence
  Description of Artificial Sequence: Synthetic peptide
  Seed: SSSESPQSC (MAGC1_HUMAN)
SQSESPQSY

SEQ ID NO: 76607 - protein, 9 aa, Artificial Sequence
  Description of Artificial Sequence: Synthetic peptide
  Seed: STFEGFAQS (MAGC1_HUMAN)
SGFEGFAQV

SEQ ID NO: 76608 - protein, 9 aa, Artificial Sequence
  Description of Artificial Sequence: Synthetic peptide
  Seed: SFFSYTLAS (MAGC1_HUMAN)
SFFSYTLAL

SEQ ID NO: 76609 - protein, 9 aa, Artificial Sequence
  Description of Artificial Sequence: Synthetic peptide
  Seed: GYFPVIFRK (MAGC1_HUMAN)
GSFPVIFRY

SEQ ID NO: 76610 - protein, 9 aa, Artificial Sequence
  Description of Artificial Sequence: Synthetic peptide
  Seed: MTSSFSSTL (MAGC1_HUMAN)
MYSSFSSTW

SEQ ID NO: 76611 - protein, 10 aa, Artificial Sequence
  Description of Artificial Sequence: Synthetic peptide
  Seed: YVFVNTLDLT (MAGC1_HUMAN)
YLFVNTLDLA

SEQ ID NO: 76612 - protein, 9 aa, Artificial Sequence
  Description of Artificial Sequence: Synthetic peptide
  Seed: YTSSSDTLL (MAGC1_HUMAN)
YTSSSDTLV

SEQ ID NO: 76613 - protein, 9 aa, Artificial Sequence
  Description of Artificial Sequence: Synthetic peptide
  Seed: SSSSSSSTL (MAGC1_HUMAN)
SISSSSSTL

SEQ ID NO: 76614 - protein, 9 aa, Artificial Sequence
  Description of Artificial Sequence: Synthetic peptide
  Seed: IESEPLFTY (MAGC1_HUMAN)
IASEPLFTY

SEQ ID NO: 76615 - protein, 11 aa, Artificial Sequence
  Description of Artificial Sequence: Synthetic peptide
  Seed: RYTGYFPVIFR (MAGC1_HUMAN)
RVTGYFPVIFR

SEQ ID NO: 76616 - protein, 10 aa, Artificial Sequence
  Description of Artificial Sequence: Synthetic peptide
  Seed: VSSFFSYTLA (MAGC1_HUMAN)
VVSFFSYTLV

SEQ ID NO: 76617 - protein, 9 aa, Artificial Sequence
  Description of Artificial Sequence: Synthetic peptide
  Seed: AQSPLQRPV (MAGC1_HUMAN)
AQSPLQRPM

SEQ ID NO: 76618 - protein, 10 aa, Artificial Sequence
  Description of Artificial Sequence: Synthetic peptide
  Seed: FSSSTSLSPF (MAGC1_HUMAN)
FKSSTSLSPF

SEQ ID NO: 76619 - protein, 10 aa, Artificial Sequence
  Description of Artificial Sequence: Synthetic peptide
  Seed: WGPRAHSEVI (MAGC1_HUMAN)
WIPRAHSEVF

SEQ ID NO: 76620 - protein, 9 aa, Artificial Sequence
  Description of Artificial Sequence: Synthetic peptide
  Seed: MPTAGMPSL (MAGC1_HUMAN)
MPTAGMPSM

SEQ ID NO: 76621 - protein, 9 aa, Artificial Sequence
  Description of Artificial Sequence: Synthetic peptide
  Seed: IPMTSSFSS (MAGC1_HUMAN)
IMMTSSFSF

SEQ ID NO: 76622 - protein, 9 aa, Artificial Sequence
  Description of Artificial Sequence: Synthetic peptide
  Seed: SPLQIPMTS (MAGC1_HUMAN)
SMLQIPMTI

SEQ ID NO: 76623 - protein, 10 aa, Artificial Sequence
  Description of Artificial Sequence: Synthetic peptide
  Seed: SPERTHSTFE (MAGC1_HUMAN)
SPERTHSTFF

SEQ ID NO: 76624 - protein, 9 aa, Artificial Sequence
  Description of Artificial Sequence: Synthetic peptide
  Seed: VIFRKAREF (MAGC1_HUMAN)
VYFRKAREY

SEQ ID NO: 76625 - protein, 9 aa, Artificial Sequence
  Description of Artificial Sequence: Synthetic peptide
  Seed: SMSPLYFPQ (MAGC1_HUMAN)
SGSPLYFPR

SEQ ID NO: 76626 - protein, 9 aa, Artificial Sequence
  Description of Artificial Sequence: Synthetic peptide
  Seed: IPVSSSSSS (MAGC1_HUMAN)
IPVSSSSSM

SEQ ID NO: 76627 - protein, 9 aa, Artificial Sequence
  Description of Artificial Sequence: Synthetic peptide
  Seed: FSSTLVSLF (MAGC1_HUMAN)
FPSTLVSLV

SEQ ID NO: 76628 - protein, 9 aa, Artificial Sequence
  Description of Artificial Sequence: Synthetic peptide
  Seed: NTVPITFPS (MAGC1_HUMAN)
NQVPITFPR

SEQ ID NO: 76629 - protein, 10 aa, Artificial Sequence
  Description of Artificial Sequence: Synthetic peptide
  Seed: VSSSFSYTLL (MAGC1_HUMAN)
VRSSFSYTLY

SEQ ID NO: 76630 - protein, 9 aa, Artificial Sequence
  Description of Artificial Sequence: Synthetic peptide
  Seed: FSYTLLSLF (MAGC1_HUMAN)
FRYTLLSLL

SEQ ID NO: 76631 - protein, 9 aa, Artificial Sequence
  Description of Artificial Sequence: Synthetic peptide
  Seed: SSFPSSTSS (MAGC1_HUMAN)
SGFPSSTSH

SEQ ID NO: 76632 - protein, 11 aa, Artificial Sequence
  Description of Artificial Sequence: Synthetic peptide
  Seed: LWGPRAHSEVI (MAGC1_HUMAN)
LWGPRAHSEVL

SEQ ID NO: 76633 - protein, 9 aa, Artificial Sequence
  Description of Artificial Sequence: Synthetic peptide
  Seed: RPVSSFFSY (MAGC1_HUMAN)
RQVSSFFSV

SEQ ID NO: 76634 - protein, 11 aa, Artificial Sequence
  Description of Artificial Sequence: Synthetic peptide
  Seed: FLAMLKNTVPI (MAGC1_HUMAN)
FTAMLKNTVPI

SEQ ID NO: 76635 - protein, 10 aa, Artificial Sequence
  Description of Artificial Sequence: Synthetic peptide
  Seed: PLQIPGSPSF (MAGC1_HUMAN)
PYQIPGSPSF

SEQ ID NO: 76636 - protein, 10 aa, Artificial Sequence
  Description of Artificial Sequence: Synthetic peptide
  Seed: SPLQSPVSSF (MAGC1_HUMAN)
SMLQSPVSSM

SEQ ID NO: 76637 - protein, 11 aa, Artificial Sequence
  Description of Artificial Sequence: Synthetic peptide
  Seed: YTGYFPVIFRK (MAGC1_HUMAN)
YVGYFPVIFRR

SEQ ID NO: 76638 - protein, 9 aa, Artificial Sequence
  Description of Artificial Sequence: Synthetic peptide
  Seed: IPVSPSSSS (MAGC1_HUMAN)
IAVSPSSSL

SEQ ID NO: 76639 - protein, 10 aa, Artificial Sequence
  Description of Artificial Sequence: Synthetic peptide
  Seed: SYVFVNTLDL (MAGC1_HUMAN)
SWVFVNTLDF

SEQ ID NO: 76640 - protein, 10 aa, Artificial Sequence
  Description of Artificial Sequence: Synthetic peptide
  Seed: LQIPVSSSFS (MAGC1_HUMAN)
LMIPVSSSFH

SEQ ID NO: 76641 - protein, 8 aa, Artificial Sequence
  Description of Artificial Sequence: Synthetic peptide
  Seed: LAMLKNTV (MAGC1_HUMAN)
LAMLKNTM

SEQ ID NO: 76642 - protein, 10 aa, Artificial Sequence
  Description of Artificial Sequence: Synthetic peptide
  Seed: RSFSSTLLSI (MAGC1_HUMAN)
RQFSSTLLSA

SEQ ID NO: 76643 - protein, 11 aa, Artificial Sequence
  Description of Artificial Sequence: Synthetic peptide
  Seed: NTLDLTSEGCL (MAGC1_HUMAN)
NSLDLTSEGCW

SEQ ID NO: 76644 - protein, 10 aa, Artificial Sequence
  Description of Artificial Sequence: Synthetic peptide
  Seed: ASSFFSSALL (MAGC1_HUMAN)
AESFFSSALM

SEQ ID NO: 76645 - protein, 9 aa, Artificial Sequence
  Description of Artificial Sequence: Synthetic peptide
  Seed: ALKDVEERA (MAGC1_HUMAN)
AQKDVEERI

SEQ ID NO: 76646 - protein, 11 aa, Artificial Sequence
  Description of Artificial Sequence: Synthetic peptide
  Seed: RYTGYFPVIFR (MAGC1_HUMAN)
RCTGYFPVIFR

SEQ ID NO: 76647 - protein, 8 aa, Artificial Sequence
  Description of Artificial Sequence: Synthetic peptide
  Seed: PSSTSSSL (MAGC1_HUMAN)
PRSTSSSM

SEQ ID NO: 76648 - protein, 9 aa, Artificial Sequence
  Description of Artificial Sequence: Synthetic peptide
  Seed: TLVSIFQSS (MAGC1_HUMAN)
TMVSIFQST

SEQ ID NO: 76649 - protein, 11 aa, Artificial Sequence
  Description of Artificial Sequence: Synthetic peptide
  Seed: TLYPLQSPQSR (MAGC1_HUMAN)
TAYPLQSPQSK

SEQ ID NO: 76650 - protein, 9 aa, Artificial Sequence
  Description of Artificial Sequence: Synthetic peptide
  Seed: VISRYTGYF (MAGC1_HUMAN)
VQSRYTGYY

SEQ ID NO: 76651 - protein, 9 aa, Artificial Sequence
  Description of Artificial Sequence: Synthetic peptide
  Seed: RPVSSFFSY (MAGC1_HUMAN)
RQVSSFFSH

SEQ ID NO: 76652 - protein, 10 aa, Artificial Sequence
  Description of Artificial Sequence: Synthetic peptide
  Seed: FFSSALLSIF (MAGC1_HUMAN)
FSSSALLSIW

SEQ ID NO: 76653 - protein, 10 aa, Artificial Sequence
  Description of Artificial Sequence: Synthetic peptide
  Seed: MLKNTVPITF (MAGC1_HUMAN)
MIKNTVPITW

SEQ ID NO: 76654 - protein, 9 aa, Artificial Sequence
  Description of Artificial Sequence: Synthetic peptide
  Seed: MSQNRLLIL (MAGC1_HUMAN)
MIQNRLLIL

SEQ ID NO: 76655 - protein, 11 aa, Artificial Sequence
  Description of Artificial Sequence: Synthetic peptide
  Seed: SSSFSYTLLSL (MAGC1_HUMAN)
STSFSYTLLSF

SEQ ID NO: 76656 - protein, 10 aa, Artificial Sequence
  Description of Artificial Sequence: Synthetic peptide
  Seed: FPQSPLQIPV (MAGC1_HUMAN)
FHQSPLQIPI

SEQ ID NO: 76657 - protein, 9 aa, Artificial Sequence
  Description of Artificial Sequence: Synthetic peptide
  Seed: REVDPDDSY (MAGC1_HUMAN)
RIVDPDDSM

SEQ ID NO: 76658 - protein, 10 aa, Artificial Sequence
  Description of Artificial Sequence: Synthetic peptide
  Seed: SFSSTLVSLF (MAGC1_HUMAN)
SFSSTLVSLY

SEQ ID NO: 76659 - protein, 10 aa, Artificial Sequence
  Description of Artificial Sequence: Synthetic peptide
  Seed: RSFSSTLLSI (MAGC1_HUMAN)
RQFSSTLLSL

SEQ ID NO: 76660 - protein, 9 aa, Artificial Sequence
  Description of Artificial Sequence: Synthetic peptide
  Seed: FSSTLVSLF (MAGC1_HUMAN)
FISTLVSLY

SEQ ID NO: 76661 - protein, 9 aa, Artificial Sequence
  Description of Artificial Sequence: Synthetic peptide
  Seed: RKVVEFLAM (MAGC1_HUMAN)
RNVVEFLAF

SEQ ID NO: 76662 - protein, 9 aa, Artificial Sequence
  Description of Artificial Sequence: Synthetic peptide
  Seed: KDSQSPLQI (MAGC1_HUMAN)
KVSQSPLQL

SEQ ID NO: 76663 - protein, 11 aa, Artificial Sequence
  Description of Artificial Sequence: Synthetic peptide
  Seed: SPSFSSTLVSL (MAGC1_HUMAN)
SPSFSSTLVSW

SEQ ID NO: 76664 - protein, 10 aa, Artificial Sequence
  Description of Artificial Sequence: Synthetic peptide
  Seed: SRYTGYFPVI (MAGC1_HUMAN)
SNYTGYFPVM

SEQ ID NO: 76665 - protein, 9 aa, Artificial Sequence
  Description of Artificial Sequence: Synthetic peptide
  Seed: SRYTGYFPV (MAGC1_HUMAN)
SQYTGYFPL

SEQ ID NO: 76666 - protein, 11 aa, Artificial Sequence
  Description of Artificial Sequence: Synthetic peptide
  Seed: FLAMLKNTVPI (MAGC1_HUMAN)
FGAMLKNTVPI

SEQ ID NO: 76667 - protein, 9 aa, Artificial Sequence
  Description of Artificial Sequence: Synthetic peptide
  Seed: ASSSTLVSI (MAGC1_HUMAN)
AQSSTLVSL

SEQ ID NO: 76668 - protein, 8 aa, Artificial Sequence
  Description of Artificial Sequence: Synthetic peptide
  Seed: LYFPQSPL (MAGC1_HUMAN)
LFFPQSPL

SEQ ID NO: 76669 - protein, 9 aa, Artificial Sequence
  Description of Artificial Sequence: Synthetic peptide
  Seed: AMLKNTVPI (MAGC1_HUMAN)
AQLKNTVPF

SEQ ID NO: 76670 - protein, 9 aa, Artificial Sequence
  Description of Artificial Sequence: Synthetic peptide
  Seed: WVQEHYLEY (MAGC1_HUMAN)
WMQEHYLEW

SEQ ID NO: 76671 - protein, 9 aa, Artificial Sequence
  Description of Artificial Sequence: Synthetic peptide
  Seed: SSSSTLLSL (MAGC1_HUMAN)
SRSSTLLSF

SEQ ID NO: 76672 - protein, 10 aa, Artificial Sequence
  Description of Artificial Sequence: Synthetic peptide
  Seed: MTSSFSSTLL (MAGC1_HUMAN)
MMSSFSSTLV

SEQ ID NO: 76673 - protein, 9 aa, Artificial Sequence
  Description of Artificial Sequence: Synthetic peptide
  Seed: FSSTLLSLF (MAGC1_HUMAN)
FLSTLLSLF

SEQ ID NO: 76674 - protein, 10 aa, Artificial Sequence
  Description of Artificial Sequence: Synthetic peptide
  Seed: HFAFGEPREL (MAGC1_HUMAN)
HYAFGEPREF

SEQ ID NO: 76675 - protein, 11 aa, Artificial Sequence
  Description of Artificial Sequence: Synthetic peptide
  Seed: TTDDSTATESA (MAGC1_HUMAN)
TADDSTATESM

SEQ ID NO: 76676 - protein, 9 aa, Artificial Sequence
  Description of Artificial Sequence: Synthetic peptide
  Seed: GFPQSPLQI (MAGC1_HUMAN)
GFPQSPLQF

SEQ ID NO: 76677 - protein, 10 aa, Artificial Sequence
  Description of Artificial Sequence: Synthetic peptide
  Seed: VISFSSSTSL (MAGC1_HUMAN)
VMSFSSSTSA

SEQ ID NO: 76678 - protein, 10 aa, Artificial Sequence
  Description of Artificial Sequence: Synthetic peptide
  Seed: ASSSTLVSIF (MAGC1_HUMAN)
APSSTLVSIW

SEQ ID NO: 76679 - protein, 9 aa, Artificial Sequence
  Description of Artificial Sequence: Synthetic peptide
  Seed: SPERTHSTF (MAGC1_HUMAN)
SMERTHSTF

SEQ ID NO: 76680 - protein, 9 aa, Artificial Sequence
  Description of Artificial Sequence: Synthetic peptide
  Seed: RAGREHFAF (MAGC1_HUMAN)
RSGREHFAY

SEQ ID NO: 76681 - protein, 10 aa, Artificial Sequence
  Description of Artificial Sequence: Synthetic peptide
  Seed: SIFQSSPESA (MAGC1_HUMAN)
SIFQSSPESV

SEQ ID NO: 76682 - protein, 10 aa, Artificial Sequence
  Description of Artificial Sequence: Synthetic peptide
  Seed: AASSSTLVSI (MAGC1_HUMAN)
AISSSTLVSV

SEQ ID NO: 76683 - protein, 10 aa, Artificial Sequence
  Description of Artificial Sequence: Synthetic peptide
  Seed: ESAQSTFEGF (MAGC1_HUMAN)
EVAQSTFEGY

SEQ ID NO: 76684 - protein, 9 aa, Artificial Sequence
  Description of Artificial Sequence: Synthetic peptide
  Seed: CSSSTSLSL (MAGC1_HUMAN)
CQSSTSLSY

SEQ ID NO: 76685 - protein, 10 aa, Artificial Sequence
  Description of Artificial Sequence: Synthetic peptide
  Seed: TTDDSTATES (MAGC1_HUMAN)
TLDDSTATEF

SEQ ID NO: 76686 - protein, 9 aa, Artificial Sequence
  Description of Artificial Sequence: Synthetic peptide
  Seed: MPTAGMPSL (MAGC1_HUMAN)
MRTAGMPSF

SEQ ID NO: 76687 - protein, 11 aa, Artificial Sequence
  Description of Artificial Sequence: Synthetic peptide
  Seed: STFEGFPQSLL (MAGC1_HUMAN)
SLFEGFPQSLT

SEQ ID NO: 76688 - protein, 11 aa, Artificial Sequence
  Description of Artificial Sequence: Synthetic peptide
  Seed: SSFSSTLLSIL (MAGC1_HUMAN)
SAFSSTLLSIW

SEQ ID NO: 76689 - protein, 10 aa, Artificial Sequence
  Description of Artificial Sequence: Synthetic peptide
  Seed: LAMLKNTVPI (MAGC1_HUMAN)
LNMLKNTVPV

SEQ ID NO: 76690 - protein, 9 aa, Artificial Sequence
  Description of Artificial Sequence: Synthetic peptide
  Seed: TLLSLFQSF (MAGC1_HUMAN)
TTLSLFQSK

SEQ ID NO: 76691 - protein, 9 aa, Artificial Sequence
  Description of Artificial Sequence: Synthetic peptide
  Seed: VIKRKVVEF (MAGC1_HUMAN)
VFKRKVVEY

SEQ ID NO: 76692 - protein, 9 aa, Artificial Sequence
  Description of Artificial Sequence: Synthetic peptide
  Seed: FLWGPRAHS (MAGC1_HUMAN)
FMWGPRAHT

SEQ ID NO: 76693 - protein, 10 aa, Artificial Sequence
  Description of Artificial Sequence: Synthetic peptide
  Seed: KGTYASEEVI (MAGC1_HUMAN)
KFTYASEEVW

SEQ ID NO: 76694 - protein, 8 aa, Artificial Sequence
  Description of Artificial Sequence: Synthetic peptide
  Seed: IWDVLSGI (MAGC1_HUMAN)
IADVLSGM

SEQ ID NO: 76695 - protein, 9 aa, Artificial Sequence
  Description of Artificial Sequence: Synthetic peptide
  Seed: KVDELARFL (MAGC1_HUMAN)
KMDELARFM

SEQ ID NO: 76696 - protein, 10 aa, Artificial Sequence
  Description of Artificial Sequence: Synthetic peptide
  Seed: SSPESAQSAF (MAGC1_HUMAN)
SVPESAQSAW

SEQ ID NO: 76697 - protein, 10 aa, Artificial Sequence
  Description of Artificial Sequence: Synthetic peptide
  Seed: FFSSALLSIF (MAGC1_HUMAN)
FCSSALLSIY

SEQ ID NO: 76698 - protein, 9 aa, Artificial Sequence
  Description of Artificial Sequence: Synthetic peptide
  Seed: SQSSPVSSF (MAGC1_HUMAN)
SMSSPVSSY

SEQ ID NO: 76699 - protein, 9 aa, Artificial Sequence
  Description of Artificial Sequence: Synthetic peptide
  Seed: ALKDVEERA (MAGC1_HUMAN)
AQKDVEERL

SEQ ID NO: 76700 - protein, 9 aa, Artificial Sequence
  Description of Artificial Sequence: Synthetic peptide
  Seed: MLTNVISRY (MAGC1_HUMAN)
MATNVISRK

SEQ ID NO: 76701 - protein, 9 aa, Artificial Sequence
  Description of Artificial Sequence: Synthetic peptide
  Seed: FSSTLVSLF (MAGC1_HUMAN)
FFSTLVSLF

SEQ ID NO: 76702 - protein, 9 aa, Artificial Sequence
  Description of Artificial Sequence: Synthetic peptide
  Seed: FEGFAQSSL (MAGC1_HUMAN)
FEGFAQSSV

SEQ ID NO: 76703 - protein, 10 aa, Artificial Sequence
  Description of Artificial Sequence: Synthetic peptide
  Seed: ATESASSSVM (MAGC1_HUMAN)
AQESASSSVF

SEQ ID NO: 76704 - protein, 10 aa, Artificial Sequence
  Description of Artificial Sequence: Synthetic peptide
  Seed: SSPERTHSTF (MAGC1_HUMAN)
SIPERTHSTY

SEQ ID NO: 76705 - protein, 10 aa, Artificial Sequence
  Description of Artificial Sequence: Synthetic peptide
  Seed: FSSSTSLSPF (MAGC1_HUMAN)
FESSTSLSPM

SEQ ID NO: 76706 - protein, 10 aa, Artificial Sequence
  Description of Artificial Sequence: Synthetic peptide
  Seed: FPQSLLQIPM (MAGC1_HUMAN)
FSQSLLQIPF

SEQ ID NO: 76707 - protein, 11 aa, Artificial Sequence
  Description of Artificial Sequence: Synthetic peptide
  Seed: RSFSSTLLSIF (MAGC1_HUMAN)
RTFSSTLLSIY

SEQ ID NO: 76708 - protein, 9 aa, Artificial Sequence
  Description of Artificial Sequence: Synthetic peptide
  Seed: RYTGYFPVI (MAGC1_HUMAN)
RLTGYFPVY

SEQ ID NO: 76709 - protein, 10 aa, Artificial Sequence
  Description of Artificial Sequence: Synthetic peptide
  Seed: VSSSSSSTLL (MAGC1_HUMAN)
VVSSSSSTLY

SEQ ID NO: 76710 - protein, 9 aa, Artificial Sequence
  Description of Artificial Sequence: Synthetic peptide
  Seed: KAREFIEIL (MAGC1_HUMAN)
KTREFIEIR

SEQ ID NO: 76711 - protein, 10 aa, Artificial Sequence
  Description of Artificial Sequence: Synthetic peptide
  Seed: FPQSLLQIPM (MAGC1_HUMAN)
FMQSLLQIPI

SEQ ID NO: 76712 - protein, 10 aa, Artificial Sequence
  Description of Artificial Sequence: Synthetic peptide
  Seed: QRPVSSFFSY (MAGC1_HUMAN)
QVPVSSFFSY

SEQ ID NO: 76713 - protein, 9 aa, Artificial Sequence
  Description of Artificial Sequence: Synthetic peptide
  Seed: AMLKNTVPI (MAGC1_HUMAN)
AILKNTVPR

SEQ ID NO: 76714 - protein, 11 aa, Artificial Sequence
  Description of Artificial Sequence: Synthetic peptide
  Seed: REVDPDDSYVF (MAGC1_HUMAN)
REVDPDDSYVM

SEQ ID NO: 76715 - protein, 10 aa, Artificial Sequence
  Description of Artificial Sequence: Synthetic peptide
  Seed: FAFGEPRELL (MAGC1_HUMAN)
FIFGEPRELI

SEQ ID NO: 76716 - protein, 9 aa, Artificial Sequence
  Description of Artificial Sequence: Synthetic peptide
  Seed: FSEESSSPV (MAGC1_HUMAN)
FQEESSSPV

SEQ ID NO: 76717 - protein, 9 aa, Artificial Sequence
  Description of Artificial Sequence: Synthetic peptide
  Seed: SFSSTLVSL (MAGC1_HUMAN)
SISSTLVSF

SEQ ID NO: 76718 - protein, 10 aa, Artificial Sequence
  Description of Artificial Sequence: Synthetic peptide
  Seed: SRYTGYFPVI (MAGC1_HUMAN)
SYYTGYFPVL

SEQ ID NO: 76719 - protein, 9 aa, Artificial Sequence
  Description of Artificial Sequence: Synthetic peptide
  Seed: SSFSSTLLS (MAGC1_HUMAN)
SQFSSTLLK

SEQ ID NO: 76720 - protein, 11 aa, Artificial Sequence
  Description of Artificial Sequence: Synthetic peptide
  Seed: REVDPDDSYVF (MAGC1_HUMAN)
RMVDPDDSYVM

SEQ ID NO: 76721 - protein, 11 aa, Artificial Sequence
  Description of Artificial Sequence: Synthetic peptide
  Seed: REVDPDDSYVF (MAGC1_HUMAN)
RYVDPDDSYVY

SEQ ID NO: 76722 - protein, 10 aa, Artificial Sequence
  Description of Artificial Sequence: Synthetic peptide
  Seed: MPTAGMPSLL (MAGC1_HUMAN)
MMTAGMPSLL

SEQ ID NO: 76723 - protein, 10 aa, Artificial Sequence
  Description of Artificial Sequence: Synthetic peptide
  Seed: SPQSPPEGPA (MAGC1_HUMAN)
SPQSPPEGPV

SEQ ID NO: 76724 - protein, 9 aa, Artificial Sequence
  Description of Artificial Sequence: Synthetic peptide
  Seed: AGREHFAFG (MAGC1_HUMAN)
AVREHFAFM

SEQ ID NO: 76725 - protein, 10 aa, Artificial Sequence
  Description of Artificial Sequence: Synthetic peptide
  Seed: KGTYASEEVI (MAGC1_HUMAN)
KHTYASEEVW

SEQ ID NO: 76726 - protein, 9 aa, Artificial Sequence
  Description of Artificial Sequence: Synthetic peptide
  Seed: KVWVQEHYL (MAGC1_HUMAN)
KAWVQEHYV

SEQ ID NO: 76727 - protein, 9 aa, Artificial Sequence
  Description of Artificial Sequence: Synthetic peptide
  Seed: SSPERTQST (MAGC1_HUMAN)
SSPERTQSF

SEQ ID NO: 76728 - protein, 10 aa, Artificial Sequence
  Description of Artificial Sequence: Synthetic peptide
  Seed: ICSSSTPSSL (MAGC1_HUMAN)
ITSSSTPSSY

SEQ ID NO: 76729 - protein, 9 aa, Artificial Sequence
  Description of Artificial Sequence: Synthetic peptide
  Seed: VQSPLQNPA (MAGC1_HUMAN)
VISPLQNPL

SEQ ID NO: 76730 - protein, 9 aa, Artificial Sequence
  Description of Artificial Sequence: Synthetic peptide
  Seed: LQNPASSFF (MAGC1_HUMAN)
LANPASSFW

SEQ ID NO: 76731 - protein, 10 aa, Artificial Sequence
  Description of Artificial Sequence: Synthetic peptide
  Seed: QRPVSSFFSY (MAGC1_HUMAN)
QQPVSSFFSY

SEQ ID NO: 76732 - protein, 10 aa, Artificial Sequence
  Description of Artificial Sequence: Synthetic peptide
  Seed: YTLLSLFQSS (MAGC1_HUMAN)
YDLLSLFQSI

SEQ ID NO: 76733 - protein, 10 aa, Artificial Sequence
  Description of Artificial Sequence: Synthetic peptide
  Seed: FAQSSLQIPV (MAGC1_HUMAN)
FVQSSLQIPA

SEQ ID NO: 76734 - protein, 9 aa, Artificial Sequence
  Description of Artificial Sequence: Synthetic peptide
  Seed: EVDPDDSYV (MAGC1_HUMAN)
EFDPDDSYL

SEQ ID NO: 76735 - protein, 10 aa, Artificial Sequence
  Description of Artificial Sequence: Synthetic peptide
  Seed: SRYTGYFPVI (MAGC1_HUMAN)
SGYTGYFPVL

SEQ ID NO: 76736 - protein, 9 aa, Artificial Sequence
  Description of Artificial Sequence: Synthetic peptide
  Seed: QIVPSLPEW (MAGC1_HUMAN)
QSVPSLPEW

SEQ ID NO: 76737 - protein, 9 aa, Artificial Sequence
  Description of Artificial Sequence: Synthetic peptide
  Seed: TLDEKVDEL (MAGC1_HUMAN)
TVDEKVDEL

SEQ ID NO: 76738 - protein, 9 aa, Artificial Sequence
  Description of Artificial Sequence: Synthetic peptide
  Seed: LQIPVSPSF (MAGC1_HUMAN)
LAIPVSPSL

SEQ ID NO: 76739 - protein, 11 aa, Artificial Sequence
  Description of Artificial Sequence: Synthetic peptide
  Seed: SLSQSSPVSSF (MAGC1_HUMAN)
SRSQSSPVSSF

SEQ ID NO: 76740 - protein, 11 aa, Artificial Sequence
  Description of Artificial Sequence: Synthetic peptide
  Seed: SPLQIPGSPSF (MAGC1_HUMAN)
SPLQIPGSPSL

SEQ ID NO: 76741 - protein, 9 aa, Artificial Sequence
  Description of Artificial Sequence: Synthetic peptide
  Seed: RAHSEVIKR (MAGC1_HUMAN)
RSHSEVIKR

SEQ ID NO: 76742 - protein, 9 aa, Artificial Sequence
  Description of Artificial Sequence: Synthetic peptide
  Seed: VSSFFSYTL (MAGC1_HUMAN)
VTSFFSYTM

SEQ ID NO: 76743 - protein, 10 aa, Artificial Sequence
  Description of Artificial Sequence: Synthetic peptide
  Seed: SLQIPVSPSF (MAGC1_HUMAN)
SSQIPVSPSY

SEQ ID NO: 76744 - protein, 9 aa, Artificial Sequence
  Description of Artificial Sequence: Synthetic peptide
  Seed: SPLQIPMTS (MAGC1_HUMAN)
SILQIPMTL

SEQ ID NO: 76745 - protein, 10 aa, Artificial Sequence
  Description of Artificial Sequence: Synthetic peptide
  Seed: FFSSALLSIF (MAGC1_HUMAN)
FFSSALLSIM

SEQ ID NO: 76746 - protein, 9 aa, Artificial Sequence
  Description of Artificial Sequence: Synthetic peptide
  Seed: FFSSALLSI (MAGC1_HUMAN)
FISSALLSF

SEQ ID NO: 76747 - protein, 9 aa, Artificial Sequence
  Description of Artificial Sequence: Synthetic peptide
  Seed: SSSSSSSTL (MAGC1_HUMAN)
SMSSSSSTV

SEQ ID NO: 76748 - protein, 10 aa, Artificial Sequence
  Description of Artificial Sequence: Synthetic peptide
  Seed: VSSSFSYTLL (MAGC1_HUMAN)
VQSSFSYTLY

SEQ ID NO: 76749 - protein, 10 aa, Artificial Sequence
  Description of Artificial Sequence: Synthetic peptide
  Seed: SLQIPVSPSF (MAGC1_HUMAN)
STQIPVSPSM

SEQ ID NO: 76750 - protein, 9 aa, Artificial Sequence
  Description of Artificial Sequence: Synthetic peptide
  Seed: FPESSQSPP (MAGC1_HUMAN)
FPESSQSPA

SEQ ID NO: 76751 - protein, 10 aa, Artificial Sequence
  Description of Artificial Sequence: Synthetic peptide
  Seed: VWVQEHYLEY (MAGC1_HUMAN)
VVVQEHYLEY

SEQ ID NO: 76752 - protein, 9 aa, Artificial Sequence
  Description of Artificial Sequence: Synthetic peptide
  Seed: RAHSEVIKR (MAGC1_HUMAN)
RVHSEVIKM

SEQ ID NO: 76753 - protein, 9 aa, Artificial Sequence
  Description of Artificial Sequence: Synthetic peptide
  Seed: YVFVNTLDL (MAGC1_HUMAN)
YGFVNTLDY

SEQ ID NO: 76754 - protein, 10 aa, Artificial Sequence
  Description of Artificial Sequence: Synthetic peptide
  Seed: SSFSSTLLSI (MAGC1_HUMAN)
SVFSSTLLSI

SEQ ID NO: 76755 - protein, 11 aa, Artificial Sequence
  Description of Artificial Sequence: Synthetic peptide
  Seed: SQSPLQSPESA (MAGC1_HUMAN)
SESPLQSPESV

SEQ ID NO: 76756 - protein, 10 aa, Artificial Sequence
  Description of Artificial Sequence: Synthetic peptide
  Seed: EVIWDVLSGI (MAGC1_HUMAN)
EVIWDVLSGW

SEQ ID NO: 76757 - protein, 9 aa, Artificial Sequence
  Description of Artificial Sequence: Synthetic peptide
  Seed: SQSSPVSSF (MAGC1_HUMAN)
SRSSPVSSF

SEQ ID NO: 76758 - protein, 9 aa, Artificial Sequence
  Description of Artificial Sequence: Synthetic peptide
  Seed: CSSSTSLSL (MAGC1_HUMAN)
CHSSTSLSY

SEQ ID NO: 76759 - protein, 10 aa, Artificial Sequence
  Description of Artificial Sequence: Synthetic peptide
  Seed: DVLSGIGVRA (MAGC1_HUMAN)
DSLSGIGVRK

SEQ ID NO: 76760 - protein, 11 aa, Artificial Sequence
  Description of Artificial Sequence: Synthetic peptide
  Seed: SRYTGYFPVIF (MAGC1_HUMAN)
SQYTGYFPVIF

SEQ ID NO: 76761 - protein, 9 aa, Artificial Sequence
  Description of Artificial Sequence: Synthetic peptide
  Seed: SSPECTQST (MAGC1_HUMAN)
SQPECTQSM

SEQ ID NO: 76762 - protein, 9 aa, Artificial Sequence
  Description of Artificial Sequence: Synthetic peptide
  Seed: SSPESAQSA (MAGC1_HUMAN)
SLPESAQSM

SEQ ID NO: 76763 - protein, 9 aa, Artificial Sequence
  Description of Artificial Sequence: Synthetic peptide
  Seed: SSPESTQSP (MAGC1_HUMAN)
SGPESTQSF

SEQ ID NO: 76764 - protein, 11 aa, Artificial Sequence
  Description of Artificial Sequence: Synthetic peptide
  Seed: FLAMLKNTVPI (MAGC1_HUMAN)
FLAMLKNTVPV

SEQ ID NO: 76765 - protein, 9 aa, Artificial Sequence
  Description of Artificial Sequence: Synthetic peptide
  Seed: SSFFSYTLA (MAGC1_HUMAN)
SLFFSYTLA

SEQ ID NO: 76766 - protein, 9 aa, Artificial Sequence
  Description of Artificial Sequence: Synthetic peptide
  Seed: HFPQSPPEW (MAGC1_HUMAN)
HIPQSPPEF

SEQ ID NO: 76767 - protein, 9 aa, Artificial Sequence
  Description of Artificial Sequence: Synthetic peptide
  Seed: AFGEPRELL (MAGC1_HUMAN)
AFGEPRELM

SEQ ID NO: 76768 - protein, 9 aa, Artificial Sequence
  Description of Artificial Sequence: Synthetic peptide
  Seed: TTDDSTATE (MAGC1_HUMAN)
TEDDSTATL

SEQ ID NO: 76769 - protein, 9 aa, Artificial Sequence
  Description of Artificial Sequence: Synthetic peptide
  Seed: KAREFIEIL (MAGC1_HUMAN)
KTREFIEIY

SEQ ID NO: 76770 - protein, 11 aa, Artificial Sequence
  Description of Artificial Sequence: Synthetic peptide
  Seed: MSPLYFPQSPL (MAGC1_HUMAN)
MRPLYFPQSPL

SEQ ID NO: 76771 - protein, 9 aa, Artificial Sequence
  Description of Artificial Sequence: Synthetic peptide
  Seed: QSPPEGEDV (MAGC1_HUMAN)
QTPPEGEDL

SEQ ID NO: 76772 - protein, 9 aa, Artificial Sequence
  Description of Artificial Sequence: Synthetic peptide
  Seed: RTQSTFEGF (MAGC1_HUMAN)
RYQSTFEGV

SEQ ID NO: 76773 - protein, 9 aa, Artificial Sequence
  Description of Artificial Sequence: Synthetic peptide
  Seed: RYTGYFPVI (MAGC1_HUMAN)
RYTGYFPVY

SEQ ID NO: 76774 - protein, 9 aa, Artificial Sequence
  Description of Artificial Sequence: Synthetic peptide
  Seed: SPLEISQSP (MAGC1_HUMAN)
SPLEISQSI

SEQ ID NO: 76775 - protein, 9 aa, Artificial Sequence
  Description of Artificial Sequence: Synthetic peptide
  Seed: SAPEGEDSL (MAGC1_HUMAN)
SMPEGEDSI

SEQ ID NO: 76776 - protein, 10 aa, Artificial Sequence
  Description of Artificial Sequence: Synthetic peptide
  Seed: SLIESEPLFT (MAGC1_HUMAN)
STIESEPLFV

SEQ ID NO: 76777 - protein, 9 aa, Artificial Sequence
  Description of Artificial Sequence: Synthetic peptide
  Seed: FSERTQSTF (MAGC1_HUMAN)
FVERTQSTF

SEQ ID NO: 76778 - protein, 9 aa, Artificial Sequence
  Description of Artificial Sequence: Synthetic peptide
  Seed: STQSPFEGF (MAGC1_HUMAN)
STQSPFEGK

SEQ ID NO: 76779 - protein, 10 aa, Artificial Sequence
  Description of Artificial Sequence: Synthetic peptide
  Seed: RPVSSFFSYT (MAGC1_HUMAN)
RYVSSFFSYA

SEQ ID NO: 76780 - protein, 10 aa, Artificial Sequence
  Description of Artificial Sequence: Synthetic peptide
  Seed: MPTAGMPSLL (MAGC1_HUMAN)
MSTAGMPSLA

SEQ ID NO: 76781 - protein, 9 aa, Artificial Sequence
  Description of Artificial Sequence: Synthetic peptide
  Seed: IFRKAREFI (MAGC1_HUMAN)
IVRKAREFV

SEQ ID NO: 76782 - protein, 9 aa, Artificial Sequence
  Description of Artificial Sequence: Synthetic peptide
  Seed: ALLSIFQSS (MAGC1_HUMAN)
AALSIFQSL

SEQ ID NO: 76783 - protein, 9 aa, Artificial Sequence
  Description of Artificial Sequence: Synthetic peptide
  Seed: SFFSYTLAS (MAGC1_HUMAN)
SSFSYTLAF

SEQ ID NO: 76784 - protein, 9 aa, Artificial Sequence
  Description of Artificial Sequence: Synthetic peptide
  Seed: STFEGFAQS (MAGC1_HUMAN)
SMFEGFAQS

SEQ ID NO: 76785 - protein, 10 aa, Artificial Sequence
  Description of Artificial Sequence: Synthetic peptide
  Seed: ESAQSAFEGF (MAGC1_HUMAN)
EMAQSAFEGR

SEQ ID NO: 76786 - protein, 10 aa, Artificial Sequence
  Description of Artificial Sequence: Synthetic peptide
  Seed: SSFPSSTSSS (MAGC1_HUMAN)
SVFPSSTSSF

SEQ ID NO: 76787 - protein, 10 aa, Artificial Sequence
  Description of Artificial Sequence: Synthetic peptide
  Seed: LSLFQSFSER (MAGC1_HUMAN)
LSLFQSFSEK

SEQ ID NO: 76788 - protein, 9 aa, Artificial Sequence
  Description of Artificial Sequence: Synthetic peptide
  Seed: RPVSSFFSY (MAGC1_HUMAN)
RMVSSFFSI

SEQ ID NO: 76789 - protein, 10 aa, Artificial Sequence
  Description of Artificial Sequence: Synthetic peptide
  Seed: GEDSLSPHYF (MAGC1_HUMAN)
GEDSLSPHYY

SEQ ID NO: 76790 - protein, 11 aa, Artificial Sequence
  Description of Artificial Sequence: Synthetic peptide
  Seed: STFEGFPQSLL (MAGC1_HUMAN)
SLFEGFPQSLH

SEQ ID NO: 76791 - protein, 8 aa, Artificial Sequence
  Description of Artificial Sequence: Synthetic peptide
  Seed: SSFFSSAL (MAGC1_HUMAN)
SRFFSSAF

SEQ ID NO: 76792 - protein, 9 aa, Artificial Sequence
  Description of Artificial Sequence: Synthetic peptide
  Seed: FSEESSSPV (MAGC1_HUMAN)
FVEESSSPV

SEQ ID NO: 76793 - protein, 10 aa, Artificial Sequence
  Description of Artificial Sequence: Synthetic peptide
  Seed: ISRYTGYFPV (MAGC1_HUMAN)
ILRYTGYFPA

SEQ ID NO: 76794 - protein, 9 aa, Artificial Sequence
  Description of Artificial Sequence: Synthetic peptide
  Seed: SSPEGKDSL (MAGC1_HUMAN)
SHPEGKDSF

SEQ ID NO: 76795 - protein, 9 aa, Artificial Sequence
  Description of Artificial Sequence: Synthetic peptide
  Seed: SSSTSLSPF (MAGC1_HUMAN)
SMSTSLSPF

SEQ ID NO: 76796 - protein, 10 aa, Artificial Sequence
  Description of Artificial Sequence: Synthetic peptide
  Seed: WGPRAHSEVI (MAGC1_HUMAN)
WLPRAHSEVV

SEQ ID NO: 76797 - protein, 9 aa, Artificial Sequence
  Description of Artificial Sequence: Synthetic peptide
  Seed: RLLILILSI (MAGC1_HUMAN)
RMLILILSA

SEQ ID NO: 76798 - protein, 9 aa, Artificial Sequence
  Description of Artificial Sequence: Synthetic peptide
  Seed: SAPEGEDSL (MAGC1_HUMAN)
SIPEGEDSL

SEQ ID NO: 76799 - protein, 9 aa, Artificial Sequence
  Description of Artificial Sequence: Synthetic peptide
  Seed: LQIPVSRSF (MAGC1_HUMAN)
LMIPVSRSM

SEQ ID NO: 76800 - protein, 10 aa, Artificial Sequence
  Description of Artificial Sequence: Synthetic peptide
  Seed: ISRYTGYFPV (MAGC1_HUMAN)
IIRYTGYFPM

SEQ ID NO: 76801 - protein, 9 aa, Artificial Sequence
  Description of Artificial Sequence: Synthetic peptide
  Seed: AQSPLQRPV (MAGC1_HUMAN)
AKSPLQRPY

SEQ ID NO: 76802 - protein, 9 aa, Artificial Sequence
  Description of Artificial Sequence: Synthetic peptide
  Seed: TKVWVQEHY (MAGC1_HUMAN)
TMVWVQEHY

SEQ ID NO: 76803 - protein, 9 aa, Artificial Sequence
  Description of Artificial Sequence: Synthetic peptide
  Seed: YVFVNTLDL (MAGC1_HUMAN)
YFFVNTLDI

SEQ ID NO: 76804 - protein, 9 aa, Artificial Sequence
  Description of Artificial Sequence: Synthetic peptide
  Seed: SPLQRPVSS (MAGC1_HUMAN)
SMLQRPVSV

SEQ ID NO: 76805 - protein, 11 aa, Artificial Sequence
  Description of Artificial Sequence: Synthetic peptide
  Seed: LQIPVSSSFSY (MAGC1_HUMAN)
LTIPVSSSFSF

SEQ ID NO: 76806 - protein, 9 aa, Artificial Sequence
  Description of Artificial Sequence: Synthetic peptide
  Seed: VPNSSPPRY (MAGC1_HUMAN)
VPNSSPPRW

SEQ ID NO: 76807 - protein, 10 aa, Artificial Sequence
  Description of Artificial Sequence: Synthetic peptide
  Seed: ESAQSTFEGF (MAGC1_HUMAN)
EMAQSTFEGR

SEQ ID NO: 76808 - protein, 11 aa, Artificial Sequence
  Description of Artificial Sequence: Synthetic peptide
  Seed: IPMTSSFSSTL (MAGC1_HUMAN)
IEMTSSFSSTY

SEQ ID NO: 76809 - protein, 9 aa, Artificial Sequence
  Description of Artificial Sequence: Synthetic peptide
  Seed: QSPPEGEDV (MAGC1_HUMAN)
QAPPEGEDM

SEQ ID NO: 76810 - protein, 9 aa, Artificial Sequence
  Description of Artificial Sequence: Synthetic peptide
  Seed: VEERAQAII (MAGC1_HUMAN)
VEERAQAIL

SEQ ID NO: 76811 - protein, 9 aa, Artificial Sequence
  Description of Artificial Sequence: Synthetic peptide
  Seed: EDFQSSLQS (MAGC1_HUMAN)
EEFQSSLQI

SEQ ID NO: 76812 - protein, 9 aa, Artificial Sequence
  Description of Artificial Sequence: Synthetic peptide
  Seed: SFSSTLVSL (MAGC1_HUMAN)
SSSSTLVSV

SEQ ID NO: 76813 - protein, 10 aa, Artificial Sequence
  Description of Artificial Sequence: Synthetic peptide
  Seed: SLSPLHFPQF (MAGC1_HUMAN)
SISPLHFPQY

SEQ ID NO: 76814 - protein, 9 aa, Artificial Sequence
  Description of Artificial Sequence: Synthetic peptide
  Seed: VSSSFSYTL (MAGC1_HUMAN)
VSSSFSYTW

SEQ ID NO: 76815 - protein, 9 aa, Artificial Sequence
  Description of Artificial Sequence: Synthetic peptide
  Seed: VPITFPSSY (MAGC1_HUMAN)
VAITFPSSL

SEQ ID NO: 76816 - protein, 10 aa, Artificial Sequence
  Description of Artificial Sequence: Synthetic peptide
  Seed: SSFSYTLLSL (MAGC1_HUMAN)
SYFSYTLLSI

SEQ ID NO: 76817 - protein, 9 aa, Artificial Sequence
  Description of Artificial Sequence: Synthetic peptide
  Seed: FSSTLVSLF (MAGC1_HUMAN)
FVSTLVSLA

SEQ ID NO: 76818 - protein, 10 aa, Artificial Sequence
  Description of Artificial Sequence: Synthetic peptide
  Seed: ESAQSAFEGF (MAGC1_HUMAN)
EVAQSAFEGW

SEQ ID NO: 76819 - protein, 11 aa, Artificial Sequence
  Description of Artificial Sequence: Synthetic peptide
  Seed: SPLQIPVSPSS (MAGC1_HUMAN)
SGLQIPVSPSY

SEQ ID NO: 76820 - protein, 9 aa, Artificial Sequence
  Description of Artificial Sequence: Synthetic peptide
  Seed: SFSSTLVSL (MAGC1_HUMAN)
SRSSTLVSV

SEQ ID NO: 76821 - protein, 11 aa, Artificial Sequence
  Description of Artificial Sequence: Synthetic peptide
  Seed: IPVSRSFSSTL (MAGC1_HUMAN)
IRVSRSFSSTF

SEQ ID NO: 76822 - protein, 9 aa, Artificial Sequence
  Description of Artificial Sequence: Synthetic peptide
  Seed: FSYTLASLL (MAGC1_HUMAN)
FYYTLASLH

SEQ ID NO: 76823 - protein, 10 aa, Artificial Sequence
  Description of Artificial Sequence: Synthetic peptide
  Seed: SRYTGYFPVI (MAGC1_HUMAN)
SRYTGYFPVR

SEQ ID NO: 76824 - protein, 10 aa, Artificial Sequence
  Description of Artificial Sequence: Synthetic peptide
  Seed: SSFSSTLLSI (MAGC1_HUMAN)
SQFSSTLLSF

SEQ ID NO: 76825 - protein, 9 aa, Artificial Sequence
  Description of Artificial Sequence: Synthetic peptide
  Seed: STQSPFEGF (MAGC1_HUMAN)
SVQSPFEGK

SEQ ID NO: 76826 - protein, 9 aa, Artificial Sequence
  Description of Artificial Sequence: Synthetic peptide
  Seed: WVQEHYLEY (MAGC1_HUMAN)
WRQEHYLEL

SEQ ID NO: 76827 - protein, 9 aa, Artificial Sequence
  Description of Artificial Sequence: Synthetic peptide
  Seed: MPTAGMPSL (MAGC1_HUMAN)
MHTAGMPSM

SEQ ID NO: 76828 - protein, 10 aa, Artificial Sequence
  Description of Artificial Sequence: Synthetic peptide
  Seed: LAMLKNTVPI (MAGC1_HUMAN)
LGMLKNTVPF

SEQ ID NO: 76829 - protein, 9 aa, Artificial Sequence
  Description of Artificial Sequence: Synthetic peptide
  Seed: ASSFFSSAL (MAGC1_HUMAN)
ANSFFSSAY

SEQ ID NO: 76830 - protein, 9 aa, Artificial Sequence
  Description of Artificial Sequence: Synthetic peptide
  Seed: VSRSFSSTL (MAGC1_HUMAN)
VGRSFSSTF

SEQ ID NO: 76831 - protein, 11 aa, Artificial Sequence
  Description of Artificial Sequence: Synthetic peptide
  Seed: SLIESEPLFTY (MAGC1_HUMAN)
SMIESEPLFTI

SEQ ID NO: 76832 - protein, 10 aa, Artificial Sequence
  Description of Artificial Sequence: Synthetic peptide
  Seed: SPLQSPVISF (MAGC1_HUMAN)
SMLQSPVISY

SEQ ID NO: 76833 - protein, 9 aa, Artificial Sequence
  Description of Artificial Sequence: Synthetic peptide
  Seed: SPPRYEFLW (MAGC1_HUMAN)
STPRYEFLW

SEQ ID NO: 76834 - protein, 9 aa, Artificial Sequence
  Description of Artificial Sequence: Synthetic peptide
  Seed: TLLSLFQSF (MAGC1_HUMAN)
TLLSLFQSV

SEQ ID NO: 76835 - protein, 9 aa, Artificial Sequence
  Description of Artificial Sequence: Synthetic peptide
  Seed: FSYTLASLL (MAGC1_HUMAN)
FVYTLASLL

SEQ ID NO: 76836 - protein, 9 aa, Artificial Sequence
  Description of Artificial Sequence: Synthetic peptide
  Seed: SSFPSSTSS (MAGC1_HUMAN)
SAFPSSTSI

SEQ ID NO: 76837 - protein, 9 aa, Artificial Sequence
  Description of Artificial Sequence: Synthetic peptide
  Seed: FLWGPRAHS (MAGC1_HUMAN)
FSWGPRAHV

SEQ ID NO: 76838 - protein, 10 aa, Artificial Sequence
  Description of Artificial Sequence: Synthetic peptide
  Seed: ICSSSTSLSL (MAGC1_HUMAN)
ICSSSTSLSM

SEQ ID NO: 76839 - protein, 9 aa, Artificial Sequence
  Description of Artificial Sequence: Synthetic peptide
  Seed: VQSPLHSPQ (MAGC1_HUMAN)
VMSPLHSPL

SEQ ID NO: 76840 - protein, 9 aa, Artificial Sequence
  Description of Artificial Sequence: Synthetic peptide
  Seed: VSAASSSTL (MAGC1_HUMAN)
VTAASSSTY

SEQ ID NO: 76841 - protein, 10 aa, Artificial Sequence
  Description of Artificial Sequence: Synthetic peptide
  Seed: TTDDSTATES (MAGC1_HUMAN)
TNDDSTATEF

SEQ ID NO: 76842 - protein, 10 aa, Artificial Sequence
  Description of Artificial Sequence: Synthetic peptide
  Seed: FAQSSLQIPV (MAGC1_HUMAN)
FDQSSLQIPV

SEQ ID NO: 76843 - protein, 10 aa, Artificial Sequence
  Description of Artificial Sequence: Synthetic peptide
  Seed: LQIPMTSSFS (MAGC1_HUMAN)
LMIPMTSSFR

SEQ ID NO: 76844 - protein, 9 aa, Artificial Sequence
  Description of Artificial Sequence: Synthetic peptide
  Seed: STFEGFPQS (MAGC1_HUMAN)
SVFEGFPQY

SEQ ID NO: 76845 - protein, 9 aa, Artificial Sequence
  Description of Artificial Sequence: Synthetic peptide
  Seed: NTVPITFPS (MAGC1_HUMAN)
NIVPITFPT

SEQ ID NO: 76846 - protein, 9 aa, Artificial Sequence
  Description of Artificial Sequence: Synthetic peptide
  Seed: EHFAFGEPR (MAGC1_HUMAN)
ECFAFGEPR

SEQ ID NO: 76847 - protein, 10 aa, Artificial Sequence
  Description of Artificial Sequence: Synthetic peptide
  Seed: SSPECTQSTF (MAGC1_HUMAN)
SAPECTQSTF

SEQ ID NO: 76848 - protein, 10 aa, Artificial Sequence
  Description of Artificial Sequence: Synthetic peptide
  Seed: VSSSSSSSTL (MAGC1_HUMAN)
VHSSSSSSTY

SEQ ID NO: 76849 - protein, 9 aa, Artificial Sequence
  Description of Artificial Sequence: Synthetic peptide
  Seed: AQSPLQRPV (MAGC1_HUMAN)
AASPLQRPI

SEQ ID NO: 76850 - protein, 9 aa, Artificial Sequence
  Description of Artificial Sequence: Synthetic peptide
  Seed: LQSPVISFS (MAGC1_HUMAN)
LVSPVISFV

SEQ ID NO: 76851 - protein, 9 aa, Artificial Sequence
  Description of Artificial Sequence: Synthetic peptide
  Seed: AQSPLQIPV (MAGC1_HUMAN)
AGSPLQIPY

SEQ ID NO: 76852 - protein, 11 aa, Artificial Sequence
  Description of Artificial Sequence: Synthetic peptide
  Seed: IPVSPSSSSTL (MAGC1_HUMAN)
IVVSPSSSSTL

SEQ ID NO: 76853 - protein, 10 aa, Artificial Sequence
  Description of Artificial Sequence: Synthetic peptide
  Seed: YTLLSLFQSS (MAGC1_HUMAN)
YHLLSLFQSV

SEQ ID NO: 76854 - protein, 10 aa, Artificial Sequence
  Description of Artificial Sequence: Synthetic peptide
  Seed: FFSYTLASLL (MAGC1_HUMAN)
FSSYTLASLV

SEQ ID NO: 76855 - protein, 9 aa, Artificial Sequence
  Description of Artificial Sequence: Synthetic peptide
  Seed: STFEGFPQS (MAGC1_HUMAN)
SAFEGFPQI

SEQ ID NO: 76856 - protein, 9 aa, Artificial Sequence
  Description of Artificial Sequence: Synthetic peptide
  Seed: AQSSLQIPV (MAGC1_HUMAN)
AESSLQIPA

SEQ ID NO: 76857 - protein, 9 aa, Artificial Sequence
  Description of Artificial Sequence: Synthetic peptide
  Seed: LSPLHFPQF (MAGC1_HUMAN)
LYPLHFPQI

SEQ ID NO: 76858 - protein, 9 aa, Artificial Sequence
  Description of Artificial Sequence: Synthetic peptide
  Seed: EFIEILFGI (MAGC1_HUMAN)
EQIEILFGV

SEQ ID NO: 76859 - protein, 9 aa, Artificial Sequence
  Description of Artificial Sequence: Synthetic peptide
  Seed: SPLQIPQSP (MAGC1_HUMAN)
SPLQIPQSI

SEQ ID NO: 76860 - protein, 9 aa, Artificial Sequence
  Description of Artificial Sequence: Synthetic peptide
  Seed: KAREFIEIL (MAGC1_HUMAN)
KRREFIEIV

SEQ ID NO: 76861 - protein, 11 aa, Artificial Sequence
  Description of Artificial Sequence: Synthetic peptide
  Seed: SPPEGPAQSPL (MAGC1_HUMAN)
SIPEGPAQSPL

SEQ ID NO: 76862 - protein, 10 aa, Artificial Sequence
  Description of Artificial Sequence: Synthetic peptide
  Seed: SPLQRPVSSF (MAGC1_HUMAN)
SQLQRPVSSF

SEQ ID NO: 76863 - protein, 10 aa, Artificial Sequence
  Description of Artificial Sequence: Synthetic peptide
  Seed: SSSSSTLLSL (MAGC1_HUMAN)
SMSSSTLLSF

SEQ ID NO: 76864 - protein, 11 aa, Artificial Sequence
  Description of Artificial Sequence: Synthetic peptide
  Seed: IPVSRSFSSTL (MAGC1_HUMAN)
IQVSRSFSSTW

SEQ ID NO: 76865 - protein, 9 aa, Artificial Sequence
  Description of Artificial Sequence: Synthetic peptide
  Seed: SSSSTLLSL (MAGC1_HUMAN)
SFSSTLLSV

SEQ ID NO: 76866 - protein, 9 aa, Artificial Sequence
  Description of Artificial Sequence: Synthetic peptide
  Seed: MLTNVISRY (MAGC1_HUMAN)
MSTNVISRL

SEQ ID NO: 76867 - protein, 9 aa, Artificial Sequence
  Description of Artificial Sequence: Synthetic peptide
  Seed: SIFQSSPER (MAGC1_HUMAN)
STFQSSPEV

SEQ ID NO: 76868 - protein, 9 aa, Artificial Sequence
  Description of Artificial Sequence: Synthetic peptide
  Seed: SQNRLLILI (MAGC1_HUMAN)
SHNRLLILI

SEQ ID NO: 76869 - protein, 9 aa, Artificial Sequence
  Description of Artificial Sequence: Synthetic peptide
  Seed: SRYTGYFPV (MAGC1_HUMAN)
SRYTGYFPC

SEQ ID NO: 76870 - protein, 9 aa, Artificial Sequence
  Description of Artificial Sequence: Synthetic peptide
  Seed: ISFSSSTSL (MAGC1_HUMAN)
INFSSSTSF

SEQ ID NO: 76871 - protein, 11 aa, Artificial Sequence
  Description of Artificial Sequence: Synthetic peptide
  Seed: TTDDSTATESA (MAGC1_HUMAN)
TLDDSTATESY

SEQ ID NO: 76872 - protein, 9 aa, Artificial Sequence
  Description of Artificial Sequence: Synthetic peptide
  Seed: DPDDSYVFV (MAGC1_HUMAN)
DIDDSYVFL

SEQ ID NO: 76873 - protein, 9 aa, Artificial Sequence
  Description of Artificial Sequence: Synthetic peptide
  Seed: VQSPLHSPQ (MAGC1_HUMAN)
VISPLHSPY

SEQ ID NO: 76874 - protein, 10 aa, Artificial Sequence
  Description of Artificial Sequence: Synthetic peptide
  Seed: EVIWDVLSGI (MAGC1_HUMAN)
EQIWDVLSGY

SEQ ID NO: 76875 - protein, 9 aa, Artificial Sequence
  Description of Artificial Sequence: Synthetic peptide
  Seed: IPVSAASSS (MAGC1_HUMAN)
IAVSAASSF

SEQ ID NO: 76876 - protein, 9 aa, Artificial Sequence
  Description of Artificial Sequence: Synthetic peptide
  Seed: NPASSFFSS (MAGC1_HUMAN)
NSASSFFSF

SEQ ID NO: 76877 - protein, 10 aa, Artificial Sequence
  Description of Artificial Sequence: Synthetic peptide
  Seed: DELARFLLLK (MAGC1_HUMAN)
DTLARFLLLR

SEQ ID NO: 76878 - protein, 9 aa, Artificial Sequence
  Description of Artificial Sequence: Synthetic peptide
  Seed: FLAMLKNTV (MAGC1_HUMAN)
FSAMLKNTY

SEQ ID NO: 76879 - protein, 9 aa, Artificial Sequence
  Description of Artificial Sequence: Synthetic peptide
  Seed: RLLILILSI (MAGC1_HUMAN)
RSLILILSI

SEQ ID NO: 76880 - protein, 9 aa, Artificial Sequence
  Description of Artificial Sequence: Synthetic peptide
  Seed: FAFGEPREL (MAGC1_HUMAN)
FTFGEPREF

SEQ ID NO: 76881 - protein, 10 aa, Artificial Sequence
  Description of Artificial Sequence: Synthetic peptide
  Seed: MPTAGMPSLL (MAGC1_HUMAN)
MMTAGMPSLM

SEQ ID NO: 76882 - protein, 10 aa, Artificial Sequence
  Description of Artificial Sequence: Synthetic peptide
  Seed: VSSSFSYTLL (MAGC1_HUMAN)
VSSSFSYTLF

SEQ ID NO: 76883 - protein, 11 aa, Artificial Sequence
  Description of Artificial Sequence: Synthetic peptide
  Seed: SLSQSSPVSSF (MAGC1_HUMAN)
SQSQSSPVSSY

SEQ ID NO: 76884 - protein, 8 aa, Artificial Sequence
  Description of Artificial Sequence: Synthetic peptide
  Seed: LQSPVSSF (MAGC1_HUMAN)
LMSPVSSF

SEQ ID NO: 76885 - protein, 9 aa, Artificial Sequence
  Description of Artificial Sequence: Synthetic peptide
  Seed: MTSSFSSTL (MAGC1_HUMAN)
MFSSFSSTI

SEQ ID NO: 76886 - protein, 10 aa, Artificial Sequence
  Description of Artificial Sequence: Synthetic peptide
  Seed: VISFSSSTSL (MAGC1_HUMAN)
VLSFSSSTSF

SEQ ID NO: 76887 - protein, 9 aa, Artificial Sequence
  Description of Artificial Sequence: Synthetic peptide
  Seed: FFSYTLASL (MAGC1_HUMAN)
FASYTLASI

SEQ ID NO: 76888 - protein, 10 aa, Artificial Sequence
  Description of Artificial Sequence: Synthetic peptide
  Seed: LLQIPMTSSF (MAGC1_HUMAN)
LRQIPMTSSL

SEQ ID NO: 76889 - protein, 9 aa, Artificial Sequence
  Description of Artificial Sequence: Synthetic peptide
  Seed: SPESTQSPF (MAGC1_HUMAN)
SPESTQSPM

SEQ ID NO: 76890 - protein, 10 aa, Artificial Sequence
  Description of Artificial Sequence: Synthetic peptide
  Seed: SILQSSPESA (MAGC1_HUMAN)
SILQSSPESV

SEQ ID NO: 76891 - protein, 9 aa, Artificial Sequence
  Description of Artificial Sequence: Synthetic peptide
  Seed: VSAASSSTL (MAGC1_HUMAN)
VYAASSSTF

SEQ ID NO: 76892 - protein, 9 aa, Artificial Sequence
  Description of Artificial Sequence: Synthetic peptide
  Seed: VSSSSSSTL (MAGC1_HUMAN)
VGSSSSSTY

SEQ ID NO: 76893 - protein, 10 aa, Artificial Sequence
  Description of Artificial Sequence: Synthetic peptide
  Seed: VISFSSSTSL (MAGC1_HUMAN)
VHSFSSSTSY

SEQ ID NO: 76894 - protein, 9 aa, Artificial Sequence
  Description of Artificial Sequence: Synthetic peptide
  Seed: VIKRKVVEF (MAGC1_HUMAN)
VAKRKVVEI

SEQ ID NO: 76895 - protein, 9 aa, Artificial Sequence
  Description of Artificial Sequence: Synthetic peptide
  Seed: IPVSSSFSY (MAGC1_HUMAN)
IPVSSSFSW

SEQ ID NO: 76896 - protein, 9 aa, Artificial Sequence
  Description of Artificial Sequence: Synthetic peptide
  Seed: SSSFSYTLL (MAGC1_HUMAN)
SLSFSYTLA

SEQ ID NO: 76897 - protein, 9 aa, Artificial Sequence
  Description of Artificial Sequence: Synthetic peptide
  Seed: VQSPLHSPQ (MAGC1_HUMAN)
VRSPLHSPY

SEQ ID NO: 76898 - protein, 10 aa, Artificial Sequence
  Description of Artificial Sequence: Synthetic peptide
  Seed: SPLYFPQSPL (MAGC1_HUMAN)
STLYFPQSPV

SEQ ID NO: 76899 - protein, 9 aa, Artificial Sequence
  Description of Artificial Sequence: Synthetic peptide
  Seed: AQSPLQIPV (MAGC1_HUMAN)
AMSPLQIPT

SEQ ID NO: 76900 - protein, 10 aa, Artificial Sequence
  Description of Artificial Sequence: Synthetic peptide
  Seed: MLTNVISRYT (MAGC1_HUMAN)
MVTNVISRYV

SEQ ID NO: 76901 - protein, 9 aa, Artificial Sequence
  Description of Artificial Sequence: Synthetic peptide
  Seed: NPASSFFSS (MAGC1_HUMAN)
NPASSFFSI

SEQ ID NO: 76902 - protein, 9 aa, Artificial Sequence
  Description of Artificial Sequence: Synthetic peptide
  Seed: VSAASSSTL (MAGC1_HUMAN)
VLAASSSTW

SEQ ID NO: 76903 - protein, 10 aa, Artificial Sequence
  Description of Artificial Sequence: Synthetic peptide
  Seed: VSSSSSSSTL (MAGC1_HUMAN)
VMSSSSSSTF

SEQ ID NO: 76904 - protein, 11 aa, Artificial Sequence
  Description of Artificial Sequence: Synthetic peptide
  Seed: TLDEKVDELAR (MAGC1_HUMAN)
TSDEKVDELAM

SEQ ID NO: 76905 - protein, 11 aa, Artificial Sequence
  Description of Artificial Sequence: Synthetic peptide
  Seed: LWGPRAHSEVI (MAGC1_HUMAN)
LDGPRAHSEVL

SEQ ID NO: 76906 - protein, 8 aa, Artificial Sequence
  Description of Artificial Sequence: Synthetic peptide
  Seed: FSYTLLSL (MAGC1_HUMAN)
FQYTLLSL

SEQ ID NO: 76907 - protein, 10 aa, Artificial Sequence
  Description of Artificial Sequence: Synthetic peptide
  Seed: IPVSPSFSST (MAGC1_HUMAN)
IPVSPSFSSA

SEQ ID NO: 76908 - protein, 9 aa, Artificial Sequence
  Description of Artificial Sequence: Synthetic peptide
  Seed: TLLSLFQSF (MAGC1_HUMAN)
TMLSLFQSL

SEQ ID NO: 76909 - protein, 9 aa, Artificial Sequence
  Description of Artificial Sequence: Synthetic peptide
  Seed: NTVPITFPS (MAGC1_HUMAN)
NIVPITFPL

SEQ ID NO: 76910 - protein, 10 aa, Artificial Sequence
  Description of Artificial Sequence: Synthetic peptide
  Seed: RLLILILSII (MAGC1_HUMAN)
RYLILILSIV

SEQ ID NO: 76911 - protein, 9 aa, Artificial Sequence
  Description of Artificial Sequence: Synthetic peptide
  Seed: SSPESTQSP (MAGC1_HUMAN)
STPESTQSL

SEQ ID NO: 76912 - protein, 11 aa, Artificial Sequence
  Description of Artificial Sequence: Synthetic peptide
  Seed: RSFSSTLLSIF (MAGC1_HUMAN)
RWFSSTLLSIY

SEQ ID NO: 76913 - protein, 9 aa, Artificial Sequence
  Description of Artificial Sequence: Synthetic peptide
  Seed: SSSSTLLSL (MAGC1_HUMAN)
SLSSTLLSM

SEQ ID NO: 76914 - protein, 10 aa, Artificial Sequence
  Description of Artificial Sequence: Synthetic peptide
  Seed: FPSSYKDALK (MAGC1_HUMAN)
FHSSYKDALR

SEQ ID NO: 76915 - protein, 9 aa, Artificial Sequence
  Description of Artificial Sequence: Synthetic peptide
  Seed: FFSYTLASL (MAGC1_HUMAN)
FISYTLAST

SEQ ID NO: 76916 - protein, 11 aa, Artificial Sequence
  Description of Artificial Sequence: Synthetic peptide
  Seed: SLIESEPLFTY (MAGC1_HUMAN)
SQIESEPLFTY

SEQ ID NO: 76917 - protein, 10 aa, Artificial Sequence
  Description of Artificial Sequence: Synthetic peptide
  Seed: PLQIPMTSSF (MAGC1_HUMAN)
PIQIPMTSSM

SEQ ID NO: 76918 - protein, 9 aa, Artificial Sequence
  Description of Artificial Sequence: Synthetic peptide
  Seed: FSYTLASLL (MAGC1_HUMAN)
FKYTLASLL

SEQ ID NO: 76919 - protein, 10 aa, Artificial Sequence
  Description of Artificial Sequence: Synthetic peptide
  Seed: ELARFLLLKY (MAGC1_HUMAN)
EAARFLLLKK

SEQ ID NO: 76920 - protein, 10 aa, Artificial Sequence
  Description of Artificial Sequence: Synthetic peptide
  Seed: VSSSSSSTLL (MAGC1_HUMAN)
VTSSSSSTLW

SEQ ID NO: 76921 - protein, 10 aa, Artificial Sequence
  Description of Artificial Sequence: Synthetic peptide
  Seed: FPQSPLQIPV (MAGC1_HUMAN)
FTQSPLQIPL

SEQ ID NO: 76922 - protein, 10 aa, Artificial Sequence
  Description of Artificial Sequence: Synthetic peptide
  Seed: LSGIGVRAGR (MAGC1_HUMAN)
LAGIGVRAGR

SEQ ID NO: 76923 - protein, 9 aa, Artificial Sequence
  Description of Artificial Sequence: Synthetic peptide
  Seed: CSSSTPSSL (MAGC1_HUMAN)
CESSTPSSF

SEQ ID NO: 76924 - protein, 11 aa, Artificial Sequence
  Description of Artificial Sequence: Synthetic peptide
  Seed: RPVSSFFSYTL (MAGC1_HUMAN)
RRVSSFFSYTF

SEQ ID NO: 76925 - protein, 9 aa, Artificial Sequence
  Description of Artificial Sequence: Synthetic peptide
  Seed: LQRPVSSFF (MAGC1_HUMAN)
LVRPVSSFS

SEQ ID NO: 76926 - protein, 9 aa, Artificial Sequence
  Description of Artificial Sequence: Synthetic peptide
  Seed: RELLTKVWV (MAGC1_HUMAN)
RELLTKVWW

SEQ ID NO: 76927 - protein, 9 aa, Artificial Sequence
  Description of Artificial Sequence: Synthetic peptide
  Seed: VQSPLQNPA (MAGC1_HUMAN)
VVSPLQNPI

SEQ ID NO: 76928 - protein, 9 aa, Artificial Sequence
  Description of Artificial Sequence: Synthetic peptide
  Seed: TLLSLFQSF (MAGC1_HUMAN)
TKLSLFQSF

SEQ ID NO: 76929 - protein, 9 aa, Artificial Sequence
  Description of Artificial Sequence: Synthetic peptide
  Seed: SSPESTQSP (MAGC1_HUMAN)
SVPESTQSV

SEQ ID NO: 76930 - protein, 9 aa, Artificial Sequence
  Description of Artificial Sequence: Synthetic peptide
  Seed: LQIPVSSSS (MAGC1_HUMAN)
LKIPVSSSW

SEQ ID NO: 76931 - protein, 9 aa, Artificial Sequence
  Description of Artificial Sequence: Synthetic peptide
  Seed: NSSPPRYEF (MAGC1_HUMAN)
NASPPRYEF

SEQ ID NO: 76932 - protein, 10 aa, Artificial Sequence
  Description of Artificial Sequence: Synthetic peptide
  Seed: ISRYTGYFPV (MAGC1_HUMAN)
IGRYTGYFPF

SEQ ID NO: 76933 - protein, 9 aa, Artificial Sequence
  Description of Artificial Sequence: Synthetic peptide
  Seed: SPLQIVPSL (MAGC1_HUMAN)
SPLQIVPSF

SEQ ID NO: 76934 - protein, 9 aa, Artificial Sequence
  Description of Artificial Sequence: Synthetic peptide
  Seed: AQSPLQIPV (MAGC1_HUMAN)
AHSPLQIPI

SEQ ID NO: 76935 - protein, 9 aa, Artificial Sequence
  Description of Artificial Sequence: Synthetic peptide
  Seed: FSYTLASLL (MAGC1_HUMAN)
FWYTLASLL

SEQ ID NO: 76936 - protein, 10 aa, Artificial Sequence
  Description of Artificial Sequence: Synthetic peptide
  Seed: STFEGFAQSS (MAGC1_HUMAN)
STFEGFAQSV

SEQ ID NO: 76937 - protein, 9 aa, Artificial Sequence
  Description of Artificial Sequence: Synthetic peptide
  Seed: KAEMLTNVI (MAGC1_HUMAN)
KTEMLTNVF

SEQ ID NO: 76938 - protein, 10 aa, Artificial Sequence
  Description of Artificial Sequence: Synthetic peptide
  Seed: SSFSYTLLSL (MAGC1_HUMAN)
SFFSYTLLSF

SEQ ID NO: 76939 - protein, 9 aa, Artificial Sequence
  Description of Artificial Sequence: Synthetic peptide
  Seed: IPMTSSFSS (MAGC1_HUMAN)
IPMTSSFSW

SEQ ID NO: 76940 - protein, 9 aa, Artificial Sequence
  Description of Artificial Sequence: Synthetic peptide
  Seed: TPSSLPQSF (MAGC1_HUMAN)
TASSLPQSY

SEQ ID NO: 76941 - protein, 9 aa, Artificial Sequence
  Description of Artificial Sequence: Synthetic peptide
  Seed: SRYTGYFPV (MAGC1_HUMAN)
SAYTGYFPL

SEQ ID NO: 76942 - protein, 9 aa, Artificial Sequence
  Description of Artificial Sequence: Synthetic peptide
  Seed: SAQSTFEGF (MAGC1_HUMAN)
SSQSTFEGW

SEQ ID NO: 76943 - protein, 9 aa, Artificial Sequence
  Description of Artificial Sequence: Synthetic peptide
  Seed: RLLILILSI (MAGC1_HUMAN)
RQLILILSY

SEQ ID NO: 76944 - protein, 10 aa, Artificial Sequence
  Description of Artificial Sequence: Synthetic peptide
  Seed: SLSPLHFPQF (MAGC1_HUMAN)
SWSPLHFPQY

SEQ ID NO: 76945 - protein, 10 aa, Artificial Sequence
  Description of Artificial Sequence: Synthetic peptide
  Seed: ASSSTLVSIF (MAGC1_HUMAN)
AQSSTLVSIW

SEQ ID NO: 76946 - protein, 10 aa, Artificial Sequence
  Description of Artificial Sequence: Synthetic peptide
  Seed: ISRYTGYFPV (MAGC1_HUMAN)
IYRYTGYFPI

SEQ ID NO: 76947 - protein, 9 aa, Artificial Sequence
  Description of Artificial Sequence: Synthetic peptide
  Seed: SSSTLLSLF (MAGC1_HUMAN)
SISTLLSLF

SEQ ID NO: 76948 - protein, 9 aa, Artificial Sequence
  Description of Artificial Sequence: Synthetic peptide
  Seed: IPVSSSFSY (MAGC1_HUMAN)
IKVSSSFSF

SEQ ID NO: 76949 - protein, 9 aa, Artificial Sequence
  Description of Artificial Sequence: Synthetic peptide
  Seed: NPASSFFSS (MAGC1_HUMAN)
NAASSFFSY

SEQ ID NO: 76950 - protein, 9 aa, Artificial Sequence
  Description of Artificial Sequence: Synthetic peptide
  Seed: IPMTSSFSS (MAGC1_HUMAN)
IIMTSSFSY

SEQ ID NO: 76951 - protein, 11 aa, Artificial Sequence
  Description of Artificial Sequence: Synthetic peptide
  Seed: SSFPSSTSSSL (MAGC1_HUMAN)
SQFPSSTSSSW

SEQ ID NO: 76952 - protein, 9 aa, Artificial Sequence
  Description of Artificial Sequence: Synthetic peptide
  Seed: RYTGYFPVI (MAGC1_HUMAN)
RYTGYFPVM

SEQ ID NO: 76953 - protein, 9 aa, Artificial Sequence
  Description of Artificial Sequence: Synthetic peptide
  Seed: SSPESPLQS (MAGC1_HUMAN)
SYPESPLQM

SEQ ID NO: 76954 - protein, 10 aa, Artificial Sequence
  Description of Artificial Sequence: Synthetic peptide
  Seed: RSFSSTLLSI (MAGC1_HUMAN)
RTFSSTLLSI

SEQ ID NO: 76955 - protein, 11 aa, Artificial Sequence
  Description of Artificial Sequence: Synthetic peptide
  Seed: SPLQIPGSPSF (MAGC1_HUMAN)
SALQIPGSPSM

SEQ ID NO: 76956 - protein, 9 aa, Artificial Sequence
  Description of Artificial Sequence: Synthetic peptide
  Seed: SLIESEPLF (MAGC1_HUMAN)
SMIESEPLF

SEQ ID NO: 76957 - protein, 9 aa, Artificial Sequence
  Description of Artificial Sequence: Synthetic peptide
  Seed: AGREHFAFG (MAGC1_HUMAN)
AIREHFAFS

SEQ ID NO: 76958 - protein, 9 aa, Artificial Sequence
  Description of Artificial Sequence: Synthetic peptide
  Seed: RPVSSFFSY (MAGC1_HUMAN)
RMVSSFFSM

SEQ ID NO: 76959 - protein, 11 aa, Artificial Sequence
  Description of Artificial Sequence: Synthetic peptide
  Seed: LQIPVSSSFSY (MAGC1_HUMAN)
LNIPVSSSFSM

SEQ ID NO: 76960 - protein, 11 aa, Artificial Sequence
  Description of Artificial Sequence: Synthetic peptide
  Seed: IPVSSSSSSTL (MAGC1_HUMAN)
IEVSSSSSSTF

SEQ ID NO: 76961 - protein, 11 aa, Artificial Sequence
  Description of Artificial Sequence: Synthetic peptide
  Seed: SEVIKRKVVEF (MAGC1_HUMAN)
SEVIKRKVVEA

SEQ ID NO: 76962 - protein, 9 aa, Artificial Sequence
  Description of Artificial Sequence: Synthetic peptide
  Seed: AQSPLQSPV (MAGC1_HUMAN)
AMSPLQSPI

SEQ ID NO: 76963 - protein, 9 aa, Artificial Sequence
  Description of Artificial Sequence: Synthetic peptide
  Seed: SSSSTLLSL (MAGC1_HUMAN)
SWSSTLLSF

SEQ ID NO: 76964 - protein, 9 aa, Artificial Sequence
  Description of Artificial Sequence: Synthetic peptide
  Seed: FFSSALLSI (MAGC1_HUMAN)
FVSSALLSF

SEQ ID NO: 76965 - protein, 10 aa, Artificial Sequence
  Description of Artificial Sequence: Synthetic peptide
  Seed: SLFQSSPECT (MAGC1_HUMAN)
SLFQSSPECV

SEQ ID NO: 76966 - protein, 9 aa, Artificial Sequence
  Description of Artificial Sequence: Synthetic peptide
  Seed: DSYVFVNTL (MAGC1_HUMAN)
DGYVFVNTV

SEQ ID NO: 76967 - protein, 11 aa, Artificial Sequence
  Description of Artificial Sequence: Synthetic peptide
  Seed: SSFPSSTSSSL (MAGC1_HUMAN)
SIFPSSTSSSY

SEQ ID NO: 76968 - protein, 9 aa, Artificial Sequence
  Description of Artificial Sequence: Synthetic peptide
  Seed: RTQSTFEGF (MAGC1_HUMAN)
RYQSTFEGL

SEQ ID NO: 76969 - protein, 9 aa, Artificial Sequence
  Description of Artificial Sequence: Synthetic peptide
  Seed: RSFSSTLLS (MAGC1_HUMAN)
RGFSSTLLY

SEQ ID NO: 76970 - protein, 9 aa, Artificial Sequence
  Description of Artificial Sequence: Synthetic peptide
  Seed: GSPSFSSTL (MAGC1_HUMAN)
GAPSFSSTW

SEQ ID NO: 76971 - protein, 9 aa, Artificial Sequence
  Description of Artificial Sequence: Synthetic peptide
  Seed: KAREFIEIL (MAGC1_HUMAN)
KEREFIEIF

SEQ ID NO: 76972 - protein, 9 aa, Artificial Sequence
  Description of Artificial Sequence: Synthetic peptide
  Seed: AMLKNTVPI (MAGC1_HUMAN)
AILKNTVPY

SEQ ID NO: 76973 - protein, 11 aa, Artificial Sequence
  Description of Artificial Sequence: Synthetic peptide
  Seed: SLSQSSPVSSF (MAGC1_HUMAN)
SQSQSSPVSSF

SEQ ID NO: 76974 - protein, 9 aa, Artificial Sequence
  Description of Artificial Sequence: Synthetic peptide
  Seed: SAASSSTLV (MAGC1_HUMAN)
SIASSSTLI

SEQ ID NO: 76975 - protein, 11 aa, Artificial Sequence
  Description of Artificial Sequence: Synthetic peptide
  Seed: RYTGYFPVIFR (MAGC1_HUMAN)
RYTGYFPVIFF

SEQ ID NO: 76976 - protein, 10 aa, Artificial Sequence
  Description of Artificial Sequence: Synthetic peptide
  Seed: STLLSLFQSF (MAGC1_HUMAN)
SDLLSLFQSF

SEQ ID NO: 76977 - protein, 11 aa, Artificial Sequence
  Description of Artificial Sequence: Synthetic peptide
  Seed: SSFFSSALLSI (MAGC1_HUMAN)
STFFSSALLSY

SEQ ID NO: 76978 - protein, 11 aa, Artificial Sequence
  Description of Artificial Sequence: Synthetic peptide
  Seed: SPLQIPMTSSF (MAGC1_HUMAN)
SRLQIPMTSSY

SEQ ID NO: 76979 - protein, 10 aa, Artificial Sequence
  Description of Artificial Sequence: Synthetic peptide
  Seed: FPQSVLQIPV (MAGC1_HUMAN)
FVQSVLQIPV

SEQ ID NO: 76980 - protein, 10 aa, Artificial Sequence
  Description of Artificial Sequence: Synthetic peptide
  Seed: SFSERTQSTF (MAGC1_HUMAN)
SLSERTQSTY

SEQ ID NO: 76981 - protein, 9 aa, Artificial Sequence
  Description of Artificial Sequence: Synthetic peptide
  Seed: KAREFIEIL (MAGC1_HUMAN)
KFREFIEIA

SEQ ID NO: 76982 - protein, 9 aa, Artificial Sequence
  Description of Artificial Sequence: Synthetic peptide
  Seed: SSPESAQSA (MAGC1_HUMAN)
SMPESAQSI

SEQ ID NO: 76983 - protein, 10 aa, Artificial Sequence
  Description of Artificial Sequence: Synthetic peptide
  Seed: SFSYTLLSLF (MAGC1_HUMAN)
SKSYTLLSLM

SEQ ID NO: 76984 - protein, 9 aa, Artificial Sequence
  Description of Artificial Sequence: Synthetic peptide
  Seed: YPLQSPQSR (MAGC1_HUMAN)
YTLQSPQSR

SEQ ID NO: 76985 - protein, 10 aa, Artificial Sequence
  Description of Artificial Sequence: Synthetic peptide
  Seed: FFSYTLASLL (MAGC1_HUMAN)
FYSYTLASLW

SEQ ID NO: 76986 - protein, 10 aa, Artificial Sequence
  Description of Artificial Sequence: Synthetic peptide
  Seed: TTDDSTATES (MAGC1_HUMAN)
TYDDSTATEI

SEQ ID NO: 76987 - protein, 9 aa, Artificial Sequence
  Description of Artificial Sequence: Synthetic peptide
  Seed: YTGYFPVIF (MAGC1_HUMAN)
YAGYFPVIV

SEQ ID NO: 76988 - protein, 10 aa, Artificial Sequence
  Description of Artificial Sequence: Synthetic peptide
  Seed: FFSYTLASLL (MAGC1_HUMAN)
FHSYTLASLF

SEQ ID NO: 76989 - protein, 9 aa, Artificial Sequence
  Description of Artificial Sequence: Synthetic peptide
  Seed: RPVSSFFSY (MAGC1_HUMAN)
RSVSSFFSF

SEQ ID NO: 76990 - protein, 9 aa, Artificial Sequence
  Description of Artificial Sequence: Synthetic peptide
  Seed: KAEMLTNVI (MAGC1_HUMAN)
KTEMLTNVW

SEQ ID NO: 76991 - protein, 9 aa, Artificial Sequence
  Description of Artificial Sequence: Synthetic peptide
  Seed: RAHSEVIKR (MAGC1_HUMAN)
RSHSEVIKL

SEQ ID NO: 76992 - protein, 9 aa, Artificial Sequence
  Description of Artificial Sequence: Synthetic peptide
  Seed: LSPLHFPQF (MAGC1_HUMAN)
LWPLHFPQL

SEQ ID NO: 76993 - protein, 10 aa, Artificial Sequence
  Description of Artificial Sequence: Synthetic peptide
  Seed: SVLQIPVSAA (MAGC1_HUMAN)
SPLQIPVSAI

SEQ ID NO: 76994 - protein, 9 aa, Artificial Sequence
  Description of Artificial Sequence: Synthetic peptide
  Seed: SPLQIPGSP (MAGC1_HUMAN)
SPLQIPGSF

SEQ ID NO: 76995 - protein, 10 aa, Artificial Sequence
  Description of Artificial Sequence: Synthetic peptide
  Seed: FAFGEPRELL (MAGC1_HUMAN)
FSFGEPRELW

SEQ ID NO: 76996 - protein, 10 aa, Artificial Sequence
  Description of Artificial Sequence: Synthetic peptide
  Seed: SSSSSTLLSL (MAGC1_HUMAN)
SLSSSTLLSW

SEQ ID NO: 76997 - protein, 9 aa, Artificial Sequence
  Description of Artificial Sequence: Synthetic peptide
  Seed: IPMTSSFSS (MAGC1_HUMAN)
IIMTSSFSF

SEQ ID NO: 76998 - protein, 9 aa, Artificial Sequence
  Description of Artificial Sequence: Synthetic peptide
  Seed: LKNTVPITF (MAGC1_HUMAN)
LMNTVPITF

SEQ ID NO: 76999 - protein, 10 aa, Artificial Sequence
  Description of Artificial Sequence: Synthetic peptide
  Seed: KVVEFLAMLK (MAGC1_HUMAN)
KYVEFLAMLK

SEQ ID NO: 77000 - protein, 11 aa, Artificial Sequence
  Description of Artificial Sequence: Synthetic peptide
  Seed: STFEGFPQSLL (MAGC1_HUMAN)
SMFEGFPQSLW

SEQ ID NO: 77001 - protein, 9 aa, Artificial Sequence
  Description of Artificial Sequence: Synthetic peptide
  Seed: SSFFSSALL (MAGC1_HUMAN)
SQFFSSALI

SEQ ID NO: 77002 - protein, 10 aa, Artificial Sequence
  Description of Artificial Sequence: Synthetic peptide
  Seed: SFSSTLLSIL (MAGC1_HUMAN)
SCSSTLLSIF

SEQ ID NO: 77003 - protein, 9 aa, Artificial Sequence
  Description of Artificial Sequence: Synthetic peptide
  Seed: LQIPGSPSF (MAGC1_HUMAN)
LGIPGSPSM

SEQ ID NO: 77004 - protein, 11 aa, Artificial Sequence
  Description of Artificial Sequence: Synthetic peptide
  Seed: RSFSSTLLSIF (MAGC1_HUMAN)
RKFSSTLLSIY

SEQ ID NO: 77005 - protein, 11 aa, Artificial Sequence
  Description of Artificial Sequence: Synthetic peptide
  Seed: SPLQRPVSSFF (MAGC1_HUMAN)
SILQRPVSSFY

SEQ ID NO: 77006 - protein, 9 aa, Artificial Sequence
  Description of Artificial Sequence: Synthetic peptide
  Seed: IESEPLFTY (MAGC1_HUMAN)
ILSEPLFTF

SEQ ID NO: 77007 - protein, 11 aa, Artificial Sequence
  Description of Artificial Sequence: Synthetic peptide
  Seed: SSFPSSTSSSL (MAGC1_HUMAN)
SLFPSSTSSSY

SEQ ID NO: 77008 - protein, 9 aa, Artificial Sequence
  Description of Artificial Sequence: Synthetic peptide
  Seed: SSPEGKDSL (MAGC1_HUMAN)
SVPEGKDSY

SEQ ID NO: 77009 - protein, 10 aa, Artificial Sequence
  Description of Artificial Sequence: Synthetic peptide
  Seed: LQIPVSRSFS (MAGC1_HUMAN)
LMIPVSRSFM

SEQ ID NO: 77010 - protein, 10 aa, Artificial Sequence
  Description of Artificial Sequence: Synthetic peptide
  Seed: NTVPITFPSS (MAGC1_HUMAN)
NVVPITFPSL

SEQ ID NO: 77011 - protein, 9 aa, Artificial Sequence
  Description of Artificial Sequence: Synthetic peptide
  Seed: ESDDTLYPL (MAGC1_HUMAN)
EFDDTLYPL

SEQ ID NO: 77012 - protein, 9 aa, Artificial Sequence
  Description of Artificial Sequence: Synthetic peptide
  Seed: FQSSLQSPV (MAGC1_HUMAN)
FSSSLQSPF

SEQ ID NO: 77013 - protein, 10 aa, Artificial Sequence
  Description of Artificial Sequence: Synthetic peptide
  Seed: IESEPLFTYT (MAGC1_HUMAN)
IESEPLFTYV

SEQ ID NO: 77014 - protein, 8 aa, Artificial Sequence
  Description of Artificial Sequence: Synthetic peptide
  Seed: LTDSESLI (MAGC1_HUMAN)
LADSESLL

SEQ ID NO: 77015 - protein, 10 aa, Artificial Sequence
  Description of Artificial Sequence: Synthetic peptide
  Seed: SFPSSTSSSL (MAGC1_HUMAN)
SSPSSTSSSM

SEQ ID NO: 77016 - protein, 9 aa, Artificial Sequence
  Description of Artificial Sequence: Synthetic peptide
  Seed: FSSTLVSLF (MAGC1_HUMAN)
FASTLVSLV

SEQ ID NO: 77017 - protein, 10 aa, Artificial Sequence
  Description of Artificial Sequence: Synthetic peptide
  Seed: REVDPDDSYV (MAGC1_HUMAN)
RMVDPDDSYM

SEQ ID NO: 77018 - protein, 10 aa, Artificial Sequence
  Description of Artificial Sequence: Synthetic peptide
  Seed: EFLAMLKNTV (MAGC1_HUMAN)
EMLAMLKNTV

SEQ ID NO: 77019 - protein, 10 aa, Artificial Sequence
  Description of Artificial Sequence: Synthetic peptide
  Seed: VISFSSSTSL (MAGC1_HUMAN)
VPSFSSSTSY

SEQ ID NO: 77020 - protein, 9 aa, Artificial Sequence
  Description of Artificial Sequence: Synthetic peptide
  Seed: LQIPVSRSF (MAGC1_HUMAN)
LEIPVSRSW

SEQ ID NO: 77021 - protein, 9 aa, Artificial Sequence
  Description of Artificial Sequence: Synthetic peptide
  Seed: AASSSTLVS (MAGC1_HUMAN)
AVSSSTLVY

SEQ ID NO: 77022 - protein, 10 aa, Artificial Sequence
  Description of Artificial Sequence: Synthetic peptide
  Seed: RTHSTFEGFP (MAGC1_HUMAN)
RAHSTFEGFK

SEQ ID NO: 77023 - protein, 9 aa, Artificial Sequence
  Description of Artificial Sequence: Synthetic peptide
  Seed: IPVSPSSSS (MAGC1_HUMAN)
IPVSPSSST

SEQ ID NO: 77024 - protein, 9 aa, Artificial Sequence
  Description of Artificial Sequence: Synthetic peptide
  Seed: FSSALLSIF (MAGC1_HUMAN)
FWSALLSIM

SEQ ID NO: 77025 - protein, 9 aa, Artificial Sequence
  Description of Artificial Sequence: Synthetic peptide
  Seed: SAPEGEDSL (MAGC1_HUMAN)
SHPEGEDSM

SEQ ID NO: 77026 - protein, 9 aa, Artificial Sequence
  Description of Artificial Sequence: Synthetic peptide
  Seed: HFPQSPPEW (MAGC1_HUMAN)
HTPQSPPEL

SEQ ID NO: 77027 - protein, 10 aa, Artificial Sequence
  Description of Artificial Sequence: Synthetic peptide
  Seed: VSSSSSSTLL (MAGC1_HUMAN)
VSSSSSSTLW

SEQ ID NO: 77028 - protein, 11 aa, Artificial Sequence
  Description of Artificial Sequence: Synthetic peptide
  Seed: IPMTSSFSSTL (MAGC1_HUMAN)
IAMTSSFSSTY

SEQ ID NO: 77029 - protein, 9 aa, Artificial Sequence
  Description of Artificial Sequence: Synthetic peptide
  Seed: IIDTTDDST (MAGC1_HUMAN)
IIDTTDDSL

SEQ ID NO: 77030 - protein, 9 aa, Artificial Sequence
  Description of Artificial Sequence: Synthetic peptide
  Seed: SSTSSSLSK (MAGC1_HUMAN)
SVTSSSLSK

SEQ ID NO: 77031 - protein, 9 aa, Artificial Sequence
  Description of Artificial Sequence: Synthetic peptide
  Seed: SSPECTQST (MAGC1_HUMAN)
SWPECTQSM

SEQ ID NO: 77032 - protein, 10 aa, Artificial Sequence
  Description of Artificial Sequence: Synthetic peptide
  Seed: FFSYTLASLL (MAGC1_HUMAN)
FMSYTLASLR

SEQ ID NO: 77033 - protein, 10 aa, Artificial Sequence
  Description of Artificial Sequence: Synthetic peptide
  Seed: MTSSFSSTLL (MAGC1_HUMAN)
MVSSFSSTLW

SEQ ID NO: 77034 - protein, 10 aa, Artificial Sequence
  Description of Artificial Sequence: Synthetic peptide
  Seed: RKVVEFLAML (MAGC1_HUMAN)
RCVVEFLAMI

SEQ ID NO: 77035 - protein, 10 aa, Artificial Sequence
  Description of Artificial Sequence: Synthetic peptide
  Seed: SFFSYTLASL (MAGC1_HUMAN)
SLFSYTLAST

SEQ ID NO: 77036 - protein, 9 aa, Artificial Sequence
  Description of Artificial Sequence: Synthetic peptide
  Seed: SFFSYTLAS (MAGC1_HUMAN)
SSFSYTLAM

SEQ ID NO: 77037 - protein, 11 aa, Artificial Sequence
  Description of Artificial Sequence: Synthetic peptide
  Seed: SSFPSSTSSSL (MAGC1_HUMAN)
STFPSSTSSSF

SEQ ID NO: 77038 - protein, 10 aa, Artificial Sequence
  Description of Artificial Sequence: Synthetic peptide
  Seed: WGPRAHSEVI (MAGC1_HUMAN)
WQPRAHSEVF

SEQ ID NO: 77039 - protein, 9 aa, Artificial Sequence
  Description of Artificial Sequence: Synthetic peptide
  Seed: SSPERTHST (MAGC1_HUMAN)
SGPERTHSV

SEQ ID NO: 77040 - protein, 10 aa, Artificial Sequence
  Description of Artificial Sequence: Synthetic peptide
  Seed: SPLYFPQSPL (MAGC1_HUMAN)
SMLYFPQSPI

SEQ ID NO: 77041 - protein, 9 aa, Artificial Sequence
  Description of Artificial Sequence: Synthetic peptide
  Seed: SSSTLVSIF (MAGC1_HUMAN)
SSSTLVSIY

SEQ ID NO: 77042 - protein, 10 aa, Artificial Sequence
  Description of Artificial Sequence: Synthetic peptide
  Seed: KGTYASEEVI (MAGC1_HUMAN)
KATYASEEVF

SEQ ID NO: 77043 - protein, 11 aa, Artificial Sequence
  Description of Artificial Sequence: Synthetic peptide
  Seed: SSFFSYTLASL (MAGC1_HUMAN)
SSFFSYTLASY

SEQ ID NO: 77044 - protein, 9 aa, Artificial Sequence
  Description of Artificial Sequence: Synthetic peptide
  Seed: FLAMLKNTV (MAGC1_HUMAN)
FIAMLKNTI

SEQ ID NO: 77045 - protein, 9 aa, Artificial Sequence
  Description of Artificial Sequence: Synthetic peptide
  Seed: YQVKQPITK (MAGC1_HUMAN)
YAVKQPITA

SEQ ID NO: 77046 - protein, 9 aa, Artificial Sequence
  Description of Artificial Sequence: Synthetic peptide
  Seed: LQIVPSLPE (MAGC1_HUMAN)
LVIVPSLPY

SEQ ID NO: 77047 - protein, 9 aa, Artificial Sequence
  Description of Artificial Sequence: Synthetic peptide
  Seed: TTDDSTATE (MAGC1_HUMAN)
TIDDSTATI

SEQ ID NO: 77048 - protein, 9 aa, Artificial Sequence
  Description of Artificial Sequence: Synthetic peptide
  Seed: SPLQIPQSS (MAGC1_HUMAN)
SRLQIPQSA

SEQ ID NO: 77049 - protein, 9 aa, Artificial Sequence
  Description of Artificial Sequence: Synthetic peptide
  Seed: CSSSTPSSL (MAGC1_HUMAN)
CTSSTPSSF

SEQ ID NO: 77050 - protein, 9 aa, Artificial Sequence
  Description of Artificial Sequence: Synthetic peptide
  Seed: SICSSSTSL (MAGC1_HUMAN)
SSCSSSTSL

SEQ ID NO: 77051 - protein, 9 aa, Artificial Sequence
  Description of Artificial Sequence: Synthetic peptide
  Seed: SFSERTQST (MAGC1_HUMAN)
SFSERTQSY

SEQ ID NO: 77052 - protein, 9 aa, Artificial Sequence
  Description of Artificial Sequence: Synthetic peptide
  Seed: LQRPVSSFF (MAGC1_HUMAN)
LYRPVSSFK

SEQ ID NO: 77053 - protein, 11 aa, Artificial Sequence
  Description of Artificial Sequence: Synthetic peptide
  Seed: VDEYTSSSDTL (MAGC1_HUMAN)
VPEYTSSSDTF

SEQ ID NO: 77054 - protein, 10 aa, Artificial Sequence
  Description of Artificial Sequence: Synthetic peptide
  Seed: VPITFPSSYK (MAGC1_HUMAN)
VLITFPSSYR

SEQ ID NO: 77055 - protein, 11 aa, Artificial Sequence
  Description of Artificial Sequence: Synthetic peptide
  Seed: REVDPDDSYVF (MAGC1_HUMAN)
RMVDPDDSYVI

SEQ ID NO: 77056 - protein, 10 aa, Artificial Sequence
  Description of Artificial Sequence: Synthetic peptide
  Seed: VSSSFSYTLL (MAGC1_HUMAN)
VYSSFSYTLY

SEQ ID NO: 77057 - protein, 9 aa, Artificial Sequence
  Description of Artificial Sequence: Synthetic peptide
  Seed: TLASLLQSS (MAGC1_HUMAN)
TVASLLQSL

SEQ ID NO: 77058 - protein, 9 aa, Artificial Sequence
  Description of Artificial Sequence: Synthetic peptide
  Seed: YPLQSPQSR (MAGC1_HUMAN)
YTLQSPQSY

SEQ ID NO: 77059 - protein, 11 aa, Artificial Sequence
  Description of Artificial Sequence: Synthetic peptide
  Seed: SPLQIPGSPSF (MAGC1_HUMAN)
SPLQIPGSPSV

SEQ ID NO: 77060 - protein, 10 aa, Artificial Sequence
  Description of Artificial Sequence: Synthetic peptide
  Seed: ISRYTGYFPV (MAGC1_HUMAN)
IIRYTGYFPK

SEQ ID NO: 77061 - protein, 9 aa, Artificial Sequence
  Description of Artificial Sequence: Synthetic peptide
  Seed: IPVSRSFSS (MAGC1_HUMAN)
IAVSRSFSM

SEQ ID NO: 77062 - protein, 11 aa, Artificial Sequence
  Description of Artificial Sequence: Synthetic peptide
  Seed: SPLQIPVSPSS (MAGC1_HUMAN)
SVLQIPVSPSF

SEQ ID NO: 77063 - protein, 10 aa, Artificial Sequence
  Description of Artificial Sequence: Synthetic peptide
  Seed: AASSSTLVSI (MAGC1_HUMAN)
AMSSSTLVSL

SEQ ID NO: 77064 - protein, 9 aa, Artificial Sequence
  Description of Artificial Sequence: Synthetic peptide
  Seed: SPLQSPVSS (MAGC1_HUMAN)
SALQSPVSI

SEQ ID NO: 77065 - protein, 9 aa, Artificial Sequence
  Description of Artificial Sequence: Synthetic peptide
  Seed: ESSSPVDEY (MAGC1_HUMAN)
EVSSPVDEK

SEQ ID NO: 77066 - protein, 9 aa, Artificial Sequence
  Description of Artificial Sequence: Synthetic peptide
  Seed: GSPSFSSTL (MAGC1_HUMAN)
GLPSFSSTM

SEQ ID NO: 77067 - protein, 9 aa, Artificial Sequence
  Description of Artificial Sequence: Synthetic peptide
  Seed: SSPERTQST (MAGC1_HUMAN)
SMPERTQSF

SEQ ID NO: 77068 - protein, 11 aa, Artificial Sequence
  Description of Artificial Sequence: Synthetic peptide
  Seed: QSSPERTHSTF (MAGC1_HUMAN)
QQSPERTHSTY

SEQ ID NO: 77069 - protein, 9 aa, Artificial Sequence
  Description of Artificial Sequence: Synthetic peptide
  Seed: AQSPLQIPV (MAGC1_HUMAN)
ATSPLQIPF

SEQ ID NO: 77070 - protein, 9 aa, Artificial Sequence
  Description of Artificial Sequence: Synthetic peptide
  Seed: VSRSFSSTL (MAGC1_HUMAN)
VHRSFSSTF

SEQ ID NO: 77071 - protein, 11 aa, Artificial Sequence
  Description of Artificial Sequence: Synthetic peptide
  Seed: SPLQIPMTSSF (MAGC1_HUMAN)
SILQIPMTSSF

SEQ ID NO: 77072 - protein, 10 aa, Artificial Sequence
  Description of Artificial Sequence: Synthetic peptide
  Seed: PLQIPVSRSF (MAGC1_HUMAN)
PRQIPVSRSF

SEQ ID NO: 77073 - protein, 11 aa, Artificial Sequence
  Description of Artificial Sequence: Synthetic peptide
  Seed: SFFSYTLASLL (MAGC1_HUMAN)
SSFSYTLASLL

SEQ ID NO: 77074 - protein, 9 aa, Artificial Sequence
  Description of Artificial Sequence: Synthetic peptide
  Seed: WVQEHYLEY (MAGC1_HUMAN)
WFQEHYLEY

SEQ ID NO: 77075 - protein, 9 aa, Artificial Sequence
  Description of Artificial Sequence: Synthetic peptide
  Seed: SIFQSSPER (MAGC1_HUMAN)
SAFQSSPER

SEQ ID NO: 77076 - protein, 11 aa, Artificial Sequence
  Description of Artificial Sequence: Synthetic peptide
  Seed: MSPLYFPQSPL (MAGC1_HUMAN)
MLPLYFPQSPV

SEQ ID NO: 77077 - protein, 9 aa, Artificial Sequence
  Description of Artificial Sequence: Synthetic peptide
  Seed: SRYTGYFPV (MAGC1_HUMAN)
SLYTGYFPF

SEQ ID NO: 77078 - protein, 9 aa, Artificial Sequence
  Description of Artificial Sequence: Synthetic peptide
  Seed: QIVPSLPEW (MAGC1_HUMAN)
QMVPSLPEY

SEQ ID NO: 77079 - protein, 9 aa, Artificial Sequence
  Description of Artificial Sequence: Synthetic peptide
  Seed: SSPERTHST (MAGC1_HUMAN)
SLPERTHSI

SEQ ID NO: 77080 - protein, 11 aa, Artificial Sequence
  Description of Artificial Sequence: Synthetic peptide
  Seed: SSFSYTLLSLF (MAGC1_HUMAN)
SSFSYTLLSLY

SEQ ID NO: 77081 - protein, 9 aa, Artificial Sequence
  Description of Artificial Sequence: Synthetic peptide
  Seed: LQIPVSSSS (MAGC1_HUMAN)
LHIPVSSSM

SEQ ID NO: 77082 - protein, 9 aa, Artificial Sequence
  Description of Artificial Sequence: Synthetic peptide
  Seed: EMLTNVISR (MAGC1_HUMAN)
ELLTNVISR

SEQ ID NO: 77083 - protein, 9 aa, Artificial Sequence
  Description of Artificial Sequence: Synthetic peptide
  Seed: SFFSYTLAS (MAGC1_HUMAN)
SSFSYTLAL

SEQ ID NO: 77084 - protein, 9 aa, Artificial Sequence
  Description of Artificial Sequence: Synthetic peptide
  Seed: MPSLLQSSS (MAGC1_HUMAN)
MASLLQSSL

SEQ ID NO: 77085 - protein, 10 aa, Artificial Sequence
  Description of Artificial Sequence: Synthetic peptide
  Seed: MPTAGMPSLL (MAGC1_HUMAN)
MATAGMPSLM

SEQ ID NO: 77086 - protein, 10 aa, Artificial Sequence
  Description of Artificial Sequence: Synthetic peptide
  Seed: PLQIPMTSSF (MAGC1_HUMAN)
PRQIPMTSSF

SEQ ID NO: 77087 - protein, 10 aa, Artificial Sequence
  Description of Artificial Sequence: Synthetic peptide
  Seed: FPQSPLQIPV (MAGC1_HUMAN)
FMQSPLQIPV

SEQ ID NO: 77088 - protein, 9 aa, Artificial Sequence
  Description of Artificial Sequence: Synthetic peptide
  Seed: RTQSTFEGF (MAGC1_HUMAN)
RYQSTFEGF

SEQ ID NO: 77089 - protein, 10 aa, Artificial Sequence
  Description of Artificial Sequence: Synthetic peptide
  Seed: MPTAGMPSLL (MAGC1_HUMAN)
MVTAGMPSLI

SEQ ID NO: 77090 - protein, 10 aa, Artificial Sequence
  Description of Artificial Sequence: Synthetic peptide
  Seed: PLQIPMTSSF (MAGC1_HUMAN)
PFQIPMTSSY

SEQ ID NO: 77091 - protein, 9 aa, Artificial Sequence
  Description of Artificial Sequence: Synthetic peptide
  Seed: YVFVNTLDL (MAGC1_HUMAN)
YMFVNTLDM

SEQ ID NO: 77092 - protein, 9 aa, Artificial Sequence
  Description of Artificial Sequence: Synthetic peptide
  Seed: SVLQIPVSA (MAGC1_HUMAN)
SALQIPVSM

SEQ ID NO: 77093 - protein, 10 aa, Artificial Sequence
  Description of Artificial Sequence: Synthetic peptide
  Seed: MSPLYFPQSP (MAGC1_HUMAN)
MFPLYFPQSV

SEQ ID NO: 77094 - protein, 9 aa, Artificial Sequence
  Description of Artificial Sequence: Synthetic peptide
  Seed: VSPSFSSTL (MAGC1_HUMAN)
VQPSFSSTI

SEQ ID NO: 77095 - protein, 9 aa, Artificial Sequence
  Description of Artificial Sequence: Synthetic peptide
  Seed: FSSTLVSLF (MAGC1_HUMAN)
FQSTLVSLI

SEQ ID NO: 77096 - protein, 9 aa, Artificial Sequence
  Description of Artificial Sequence: Synthetic peptide
  Seed: SSPERTHST (MAGC1_HUMAN)
SGPERTHSY

SEQ ID NO: 77097 - protein, 11 aa, Artificial Sequence
  Description of Artificial Sequence: Synthetic peptide
  Seed: EGEDSSDPLQR (MAGC1_HUMAN)
EVEDSSDPLQY

SEQ ID NO: 77098 - protein, 10 aa, Artificial Sequence
  Description of Artificial Sequence: Synthetic peptide
  Seed: TVPITFPSSY (MAGC1_HUMAN)
TYPITFPSSY

SEQ ID NO: 77099 - protein, 9 aa, Artificial Sequence
  Description of Artificial Sequence: Synthetic peptide
  Seed: GENTHSPLQ (MAGC1_HUMAN)
GENTHSPLT

SEQ ID NO: 77100 - protein, 9 aa, Artificial Sequence
  Description of Artificial Sequence: Synthetic peptide
  Seed: LSPLHFPQF (MAGC1_HUMAN)
LRPLHFPQY

SEQ ID NO: 77101 - protein, 11 aa, Artificial Sequence
  Description of Artificial Sequence: Synthetic peptide
  Seed: AASSSTLVSIF (MAGC1_HUMAN)
ASSSSTLVSIF

SEQ ID NO: 77102 - protein, 10 aa, Artificial Sequence
  Description of Artificial Sequence: Synthetic peptide
  Seed: YTLASLLQSS (MAGC1_HUMAN)
YWLASLLQSA

SEQ ID NO: 77103 - protein, 10 aa, Artificial Sequence
  Description of Artificial Sequence: Synthetic peptide
  Seed: SFSSTLLSIF (MAGC1_HUMAN)
SLSSTLLSIF

SEQ ID NO: 77104 - protein, 9 aa, Artificial Sequence
  Description of Artificial Sequence: Synthetic peptide
  Seed: SSPESAQSA (MAGC1_HUMAN)
STPESAQSF

SEQ ID NO: 77105 - protein, 9 aa, Artificial Sequence
  Description of Artificial Sequence: Synthetic peptide
  Seed: SSPESTQSP (MAGC1_HUMAN)
SWPESTQSL

SEQ ID NO: 77106 - protein, 10 aa, Artificial Sequence
  Description of Artificial Sequence: Synthetic peptide
  Seed: YTLDEKVDEL (MAGC1_HUMAN)
YALDEKVDEL

SEQ ID NO: 77107 - protein, 9 aa, Artificial Sequence
  Description of Artificial Sequence: Synthetic peptide
  Seed: VQSPLQNPA (MAGC1_HUMAN)
VSSPLQNPY

SEQ ID NO: 77108 - protein, 10 aa, Artificial Sequence
  Description of Artificial Sequence: Synthetic peptide
  Seed: ASSFFSSALL (MAGC1_HUMAN)
AMSFFSSALW

SEQ ID NO: 77109 - protein, 9 aa, Artificial Sequence
  Description of Artificial Sequence: Synthetic peptide
  Seed: IGVRAGREH (MAGC1_HUMAN)
IAVRAGREM

SEQ ID NO: 77110 - protein, 9 aa, Artificial Sequence
  Description of Artificial Sequence: Synthetic peptide
  Seed: SAQSAFEGF (MAGC1_HUMAN)
SEQSAFEGF

SEQ ID NO: 77111 - protein, 10 aa, Artificial Sequence
  Description of Artificial Sequence: Synthetic peptide
  Seed: RKVVEFLAML (MAGC1_HUMAN)
RHVVEFLAMF

SEQ ID NO: 77112 - protein, 9 aa, Artificial Sequence
  Description of Artificial Sequence: Synthetic peptide
  Seed: SVLQIPVSA (MAGC1_HUMAN)
SSLQIPVSR

SEQ ID NO: 77113 - protein, 10 aa, Artificial Sequence
  Description of Artificial Sequence: Synthetic peptide
  Seed: FSSTLVSLFQ (MAGC1_HUMAN)
FMSTLVSLFW

SEQ ID NO: 77114 - protein, 10 aa, Artificial Sequence
  Description of Artificial Sequence: Synthetic peptide
  Seed: SSPESAQSAF (MAGC1_HUMAN)
SVPESAQSAL

SEQ ID NO: 77115 - protein, 10 aa, Artificial Sequence
  Description of Artificial Sequence: Synthetic peptide
  Seed: SSPESAQSTF (MAGC1_HUMAN)
SYPESAQSTY

SEQ ID NO: 77116 - protein, 11 aa, Artificial Sequence
  Description of Artificial Sequence: Synthetic peptide
  Seed: LWGPRAHSEVI (MAGC1_HUMAN)
LYGPRAHSEVL

SEQ ID NO: 77117 - protein, 11 aa, Artificial Sequence
  Description of Artificial Sequence: Synthetic peptide
  Seed: ILFGISLREVD (MAGC1_HUMAN)
IMFGISLREVV

SEQ ID NO: 77118 - protein, 10 aa, Artificial Sequence
  Description of Artificial Sequence: Synthetic peptide
  Seed: SPLQIVPSLP (MAGC1_HUMAN)
SPLQIVPSLA

SEQ ID NO: 77119 - protein, 9 aa, Artificial Sequence
  Description of Artificial Sequence: Synthetic peptide
  Seed: SSPERTHST (MAGC1_HUMAN)
SQPERTHSM

SEQ ID NO: 77120 - protein, 9 aa, Artificial Sequence
  Description of Artificial Sequence: Synthetic peptide
  Seed: QSPPEGEDV (MAGC1_HUMAN)
QVPPEGEDL

SEQ ID NO: 77121 - protein, 9 aa, Artificial Sequence
  Description of Artificial Sequence: Synthetic peptide
  Seed: RPVSSFFSY (MAGC1_HUMAN)
RRVSSFFSF

SEQ ID NO: 77122 - protein, 9 aa, Artificial Sequence
  Description of Artificial Sequence: Synthetic peptide
  Seed: AQSPLQSPV (MAGC1_HUMAN)
AQSPLQSPI

SEQ ID NO: 77123 - protein, 10 aa, Artificial Sequence
  Description of Artificial Sequence: Synthetic peptide
  Seed: SFSYTLLSLF (MAGC1_HUMAN)
SLSYTLLSLY

SEQ ID NO: 77124 - protein, 8 aa, Artificial Sequence
  Description of Artificial Sequence: Synthetic peptide
  Seed: IWDVLSGI (MAGC1_HUMAN)
IFDVLSGM

SEQ ID NO: 77125 - protein, 9 aa, Artificial Sequence
  Description of Artificial Sequence: Synthetic peptide
  Seed: FSSTLLSLF (MAGC1_HUMAN)
FISTLLSLA

SEQ ID NO: 77126 - protein, 9 aa, Artificial Sequence
  Description of Artificial Sequence: Synthetic peptide
  Seed: REVDPDDSY (MAGC1_HUMAN)
RKVDPDDSY

SEQ ID NO: 77127 - protein, 9 aa, Artificial Sequence
  Description of Artificial Sequence: Synthetic peptide
  Seed: SAPEGEDSL (MAGC1_HUMAN)
SRPEGEDSL

SEQ ID NO: 77128 - protein, 11 aa, Artificial Sequence
  Description of Artificial Sequence: Synthetic peptide
  Seed: TSSFSSTLLSI (MAGC1_HUMAN)
TSSFSSTLLSW

SEQ ID NO: 77129 - protein, 9 aa, Artificial Sequence
  Description of Artificial Sequence: Synthetic peptide
  Seed: FSSTLVSLF (MAGC1_HUMAN)
FRSTLVSLM

SEQ ID NO: 77130 - protein, 11 aa, Artificial Sequence
  Description of Artificial Sequence: Synthetic peptide
  Seed: SQSSPEGKDSL (MAGC1_HUMAN)
SESSPEGKDSA

SEQ ID NO: 77131 - protein, 9 aa, Artificial Sequence
  Description of Artificial Sequence: Synthetic peptide
  Seed: SSPERTHST (MAGC1_HUMAN)
SCPERTHSL

SEQ ID NO: 77132 - protein, 9 aa, Artificial Sequence
  Description of Artificial Sequence: Synthetic peptide
  Seed: TLDEKVDEL (MAGC1_HUMAN)
TFDEKVDEC

SEQ ID NO: 77133 - protein, 9 aa, Artificial Sequence
  Description of Artificial Sequence: Synthetic peptide
  Seed: SEPLFTYTL (MAGC1_HUMAN)
SEPLFTYTF

SEQ ID NO: 77134 - protein, 9 aa, Artificial Sequence
  Description of Artificial Sequence: Synthetic peptide
  Seed: FFSYTLASL (MAGC1_HUMAN)
FYSYTLASV

SEQ ID NO: 77135 - protein, 8 aa, Artificial Sequence
  Description of Artificial Sequence: Synthetic peptide
  Seed: FSSTLLSL (MAGC1_HUMAN)
FASTLLSL

SEQ ID NO: 77136 - protein, 11 aa, Artificial Sequence
  Description of Artificial Sequence: Synthetic peptide
  Seed: REVDPDDSYVF (MAGC1_HUMAN)
RAVDPDDSYVW

SEQ ID NO: 77137 - protein, 10 aa, Artificial Sequence
  Description of Artificial Sequence: Synthetic peptide
  Seed: ILFGISLREV (MAGC1_HUMAN)
IIFGISLREL

SEQ ID NO: 77138 - protein, 10 aa, Artificial Sequence
  Description of Artificial Sequence: Synthetic peptide
  Seed: STFEGFPQSL (MAGC1_HUMAN)
SPFEGFPQSL

SEQ ID NO: 77139 - protein, 9 aa, Artificial Sequence
  Description of Artificial Sequence: Synthetic peptide
  Seed: VIKRKVVEF (MAGC1_HUMAN)
VSKRKVVEY

SEQ ID NO: 77140 - protein, 9 aa, Artificial Sequence
  Description of Artificial Sequence: Synthetic peptide
  Seed: ASSFFSSAL (MAGC1_HUMAN)
AYSFFSSAV

SEQ ID NO: 77141 - protein, 11 aa, Artificial Sequence
  Description of Artificial Sequence: Synthetic peptide
  Seed: REVPNSSPPRY (MAGC1_HUMAN)
RVVPNSSPPRY

SEQ ID NO: 77142 - protein, 10 aa, Artificial Sequence
  Description of Artificial Sequence: Synthetic peptide
  Seed: PLQNPASSFF (MAGC1_HUMAN)
PFQNPASSFY

SEQ ID NO: 77143 - protein, 9 aa, Artificial Sequence
  Description of Artificial Sequence: Synthetic peptide
  Seed: SQSSPVSSF (MAGC1_HUMAN)
SRSSPVSSI

SEQ ID NO: 77144 - protein, 10 aa, Artificial Sequence
  Description of Artificial Sequence: Synthetic peptide
  Seed: LAMLKNTVPI (MAGC1_HUMAN)
LNMLKNTVPI

SEQ ID NO: 77145 - protein, 9 aa, Artificial Sequence
  Description of Artificial Sequence: Synthetic peptide
  Seed: SIIFIKGTY (MAGC1_HUMAN)
SQIFIKGTL

SEQ ID NO: 77146 - protein, 10 aa, Artificial Sequence
  Description of Artificial Sequence: Synthetic peptide
  Seed: MPTAGMPSLL (MAGC1_HUMAN)
MATAGMPSLI

SEQ ID NO: 77147 - protein, 9 aa, Artificial Sequence
  Description of Artificial Sequence: Synthetic peptide
  Seed: TFEGFPQSL (MAGC1_HUMAN)
TVEGFPQSW

SEQ ID NO: 77148 - protein, 10 aa, Artificial Sequence
  Description of Artificial Sequence: Synthetic peptide
  Seed: VSSSSSSTLL (MAGC1_HUMAN)
VYSSSSSTLY

SEQ ID NO: 77149 - protein, 9 aa, Artificial Sequence
  Description of Artificial Sequence: Synthetic peptide
  Seed: VSRSFSSTL (MAGC1_HUMAN)
VYRSFSSTV

SEQ ID NO: 77150 - protein, 10 aa, Artificial Sequence
  Description of Artificial Sequence: Synthetic peptide
  Seed: YTLDEKVDEL (MAGC1_HUMAN)
YDLDEKVDEV

SEQ ID NO: 77151 - protein, 10 aa, Artificial Sequence
  Description of Artificial Sequence: Synthetic peptide
  Seed: YTLLSLFQSS (MAGC1_HUMAN)
YLLLSLFQSL

SEQ ID NO: 77152 - protein, 8 aa, Artificial Sequence
  Description of Artificial Sequence: Synthetic peptide
  Seed: LTDSESLI (MAGC1_HUMAN)
LMDSESLL

SEQ ID NO: 77153 - protein, 9 aa, Artificial Sequence
  Description of Artificial Sequence: Synthetic peptide
  Seed: TLLSIFQSS (MAGC1_HUMAN)
TSLSIFQSV

SEQ ID NO: 77154 - protein, 10 aa, Artificial Sequence
  Description of Artificial Sequence: Synthetic peptide
  Seed: LQIPMTSSFS (MAGC1_HUMAN)
LIIPMTSSFF

SEQ ID NO: 77155 - protein, 9 aa, Artificial Sequence
  Description of Artificial Sequence: Synthetic peptide
  Seed: NTVPITFPS (MAGC1_HUMAN)
NAVPITFPV

SEQ ID NO: 77156 - protein, 9 aa, Artificial Sequence
  Description of Artificial Sequence: Synthetic peptide
  Seed: AGREHFAFG (MAGC1_HUMAN)
ASREHFAFK

SEQ ID NO: 77157 - protein, 9 aa, Artificial Sequence
  Description of Artificial Sequence: Synthetic peptide
  Seed: RKVVEFLAM (MAGC1_HUMAN)
RVVVEFLAM

SEQ ID NO: 77158 - protein, 9 aa, Artificial Sequence
  Description of Artificial Sequence: Synthetic peptide
  Seed: SSSFSYTLL (MAGC1_HUMAN)
STSFSYTLM

SEQ ID NO: 77159 - protein, 9 aa, Artificial Sequence
  Description of Artificial Sequence: Synthetic peptide
  Seed: TLLSILQSS (MAGC1_HUMAN)
TQLSILQSI

SEQ ID NO: 77160 - protein, 10 aa, Artificial Sequence
  Description of Artificial Sequence: Synthetic peptide
  Seed: PLQIPVSSSF (MAGC1_HUMAN)
PLQIPVSSSY

SEQ ID NO: 77161 - protein, 9 aa, Artificial Sequence
  Description of Artificial Sequence: Synthetic peptide
  Seed: ASSSTLVSI (MAGC1_HUMAN)
ALSSTLVSY

SEQ ID NO: 77162 - protein, 9 aa, Artificial Sequence
  Description of Artificial Sequence: Synthetic peptide
  Seed: VSRSFSSTL (MAGC1_HUMAN)
VSRSFSSTK

SEQ ID NO: 77163 - protein, 9 aa, Artificial Sequence
  Description of Artificial Sequence: Synthetic peptide
  Seed: FPSSTSSSL (MAGC1_HUMAN)
FYSSTSSSM

SEQ ID NO: 77164 - protein, 11 aa, Artificial Sequence
  Description of Artificial Sequence: Synthetic peptide
  Seed: SSFPSSTSSSL (MAGC1_HUMAN)
SNFPSSTSSSM

SEQ ID NO: 77165 - protein, 9 aa, Artificial Sequence
  Description of Artificial Sequence: Synthetic peptide
  Seed: STFEGFAQS (MAGC1_HUMAN)
SQFEGFAQV

SEQ ID NO: 77166 - protein, 10 aa, Artificial Sequence
  Description of Artificial Sequence: Synthetic peptide
  Seed: SLQIPVSPSF (MAGC1_HUMAN)
SFQIPVSPSY

SEQ ID NO: 77167 - protein, 9 aa, Artificial Sequence
  Description of Artificial Sequence: Synthetic peptide
  Seed: SSPERTQST (MAGC1_HUMAN)
STPERTQSF

SEQ ID NO: 77168 - protein, 9 aa, Artificial Sequence
  Description of Artificial Sequence: Synthetic peptide
  Seed: AGREHFAFG (MAGC1_HUMAN)
ASREHFAFA

SEQ ID NO: 77169 - protein, 10 aa, Artificial Sequence
  Description of Artificial Sequence: Synthetic peptide
  Seed: LSQSSPVSSF (MAGC1_HUMAN)
LAQSSPVSSY

SEQ ID NO: 77170 - protein, 9 aa, Artificial Sequence
  Description of Artificial Sequence: Synthetic peptide
  Seed: NTVPITFPS (MAGC1_HUMAN)
NLVPITFPM

SEQ ID NO: 77171 - protein, 9 aa, Artificial Sequence
  Description of Artificial Sequence: Synthetic peptide
  Seed: FSYTLASLL (MAGC1_HUMAN)
FTYTLASLY

SEQ ID NO: 77172 - protein, 9 aa, Artificial Sequence
  Description of Artificial Sequence: Synthetic peptide
  Seed: VLSGIGVRA (MAGC1_HUMAN)
VQSGIGVRI

SEQ ID NO: 77173 - protein, 9 aa, Artificial Sequence
  Description of Artificial Sequence: Synthetic peptide
  Seed: LARFLLLKY (MAGC1_HUMAN)
LKRFLLLKF

SEQ ID NO: 77174 - protein, 11 aa, Artificial Sequence
  Description of Artificial Sequence: Synthetic peptide
  Seed: TLDEKVDELAR (MAGC1_HUMAN)
TTDEKVDELAY

SEQ ID NO: 77175 - protein, 9 aa, Artificial Sequence
  Description of Artificial Sequence: Synthetic peptide
  Seed: ASSSTLVSI (MAGC1_HUMAN)
ANSSTLVSY

SEQ ID NO: 77176 - protein, 10 aa, Artificial Sequence
  Description of Artificial Sequence: Synthetic peptide
  Seed: SLQIPVSPSF (MAGC1_HUMAN)
SHQIPVSPSF

SEQ ID NO: 77177 - protein, 9 aa, Artificial Sequence
  Description of Artificial Sequence: Synthetic peptide
  Seed: SRYTGYFPV (MAGC1_HUMAN)
SKYTGYFPY

SEQ ID NO: 77178 - protein, 9 aa, Artificial Sequence
  Description of Artificial Sequence: Synthetic peptide
  Seed: LSPLHFPQF (MAGC1_HUMAN)
LQPLHFPQF

SEQ ID NO: 77179 - protein, 9 aa, Artificial Sequence
  Description of Artificial Sequence: Synthetic peptide
  Seed: SLFQSFSER (MAGC1_HUMAN)
SQFQSFSEF

SEQ ID NO: 77180 - protein, 10 aa, Artificial Sequence
  Description of Artificial Sequence: Synthetic peptide
  Seed: SSPERTHSTF (MAGC1_HUMAN)
SLPERTHSTF

SEQ ID NO: 77181 - protein, 9 aa, Artificial Sequence
  Description of Artificial Sequence: Synthetic peptide
  Seed: TSLSLPQSF (MAGC1_HUMAN)
TALSLPQSM

SEQ ID NO: 77182 - protein, 10 aa, Artificial Sequence
  Description of Artificial Sequence: Synthetic peptide
  Seed: STPSSLPQSF (MAGC1_HUMAN)
SSPSSLPQSL

SEQ ID NO: 77183 - protein, 11 aa, Artificial Sequence
  Description of Artificial Sequence: Synthetic peptide
  Seed: SAASSSTLVSI (MAGC1_HUMAN)
SIASSSTLVSV

SEQ ID NO: 77184 - protein, 10 aa, Artificial Sequence
  Description of Artificial Sequence: Synthetic peptide
  Seed: ASSSTLVSIF (MAGC1_HUMAN)
AASSTLVSIW

SEQ ID NO: 77185 - protein, 10 aa, Artificial Sequence
  Description of Artificial Sequence: Synthetic peptide
  Seed: FAQSSLQIPV (MAGC1_HUMAN)
FIQSSLQIPV

SEQ ID NO: 77186 - protein, 9 aa, Artificial Sequence
  Description of Artificial Sequence: Synthetic peptide
  Seed: SSSSSSTLL (MAGC1_HUMAN)
SMSSSSTLF

SEQ ID NO: 77187 - protein, 9 aa, Artificial Sequence
  Description of Artificial Sequence: Synthetic peptide
  Seed: GFPQSPLQI (MAGC1_HUMAN)
GFPQSPLQY

SEQ ID NO: 77188 - protein, 10 aa, Artificial Sequence
  Description of Artificial Sequence: Synthetic peptide
  Seed: FAFGEPRELL (MAGC1_HUMAN)
FVFGEPRELI

SEQ ID NO: 77189 - protein, 10 aa, Artificial Sequence
  Description of Artificial Sequence: Synthetic peptide
  Seed: SRYTGYFPVI (MAGC1_HUMAN)
SFYTGYFPVL

SEQ ID NO: 77190 - protein, 8 aa, Artificial Sequence
  Description of Artificial Sequence: Synthetic peptide
  Seed: MLKNTVPI (MAGC1_HUMAN)
MMKNTVPL

SEQ ID NO: 77191 - protein, 9 aa, Artificial Sequence
  Description of Artificial Sequence: Synthetic peptide
  Seed: FFSYTLASL (MAGC1_HUMAN)
FLSYTLASI

SEQ ID NO: 77192 - protein, 9 aa, Artificial Sequence
  Description of Artificial Sequence: Synthetic peptide
  Seed: MTSSFSSTL (MAGC1_HUMAN)
MTSSFSSTT

SEQ ID NO: 77193 - protein, 10 aa, Artificial Sequence
  Description of Artificial Sequence: Synthetic peptide
  Seed: KAREFIEILF (MAGC1_HUMAN)
KAREFIEILW

SEQ ID NO: 77194 - protein, 9 aa, Artificial Sequence
  Description of Artificial Sequence: Synthetic peptide
  Seed: EFIEILFGI (MAGC1_HUMAN)
EGIEILFGL

SEQ ID NO: 77195 - protein, 9 aa, Artificial Sequence
  Description of Artificial Sequence: Synthetic peptide
  Seed: STFEGFAQS (MAGC1_HUMAN)
SSFEGFAQM

SEQ ID NO: 77196 - protein, 10 aa, Artificial Sequence
  Description of Artificial Sequence: Synthetic peptide
  Seed: QGEDSLSPHY (MAGC1_HUMAN)
QTEDSLSPHY

SEQ ID NO: 77197 - protein, 9 aa, Artificial Sequence
  Description of Artificial Sequence: Synthetic peptide
  Seed: TSLSLPQSF (MAGC1_HUMAN)
TVLSLPQSW

SEQ ID NO: 77198 - protein, 11 aa, Artificial Sequence
  Description of Artificial Sequence: Synthetic peptide
  Seed: IPMTSSFSSTL (MAGC1_HUMAN)
ICMTSSFSSTW

SEQ ID NO: 77199 - protein, 9 aa, Artificial Sequence
  Description of Artificial Sequence: Synthetic peptide
  Seed: LQRPVSSFF (MAGC1_HUMAN)
LQRPVSSFA

SEQ ID NO: 77200 - protein, 10 aa, Artificial Sequence
  Description of Artificial Sequence: Synthetic peptide
  Seed: RAHSEVIKRK (MAGC1_HUMAN)
RMHSEVIKRR

SEQ ID NO: 77201 - protein, 10 aa, Artificial Sequence
  Description of Artificial Sequence: Synthetic peptide
  Seed: SSFPSSTSSS (MAGC1_HUMAN)
SVFPSSTSSM

SEQ ID NO: 77202 - protein, 9 aa, Artificial Sequence
  Description of Artificial Sequence: Synthetic peptide
  Seed: SSFPSSTSS (MAGC1_HUMAN)
SVFPSSTSM

SEQ ID NO: 77203 - protein, 10 aa, Artificial Sequence
  Description of Artificial Sequence: Synthetic peptide
  Seed: VSSSSSSTLL (MAGC1_HUMAN)
VKSSSSSTLF

SEQ ID NO: 77204 - protein, 10 aa, Artificial Sequence
  Description of Artificial Sequence: Synthetic peptide
  Seed: EVIWDVLSGI (MAGC1_HUMAN)
ETIWDVLSGV

SEQ ID NO: 77205 - protein, 10 aa, Artificial Sequence
  Description of Artificial Sequence: Synthetic peptide
  Seed: WGPRAHSEVI (MAGC1_HUMAN)
WSPRAHSEVF

SEQ ID NO: 77206 - protein, 9 aa, Artificial Sequence
  Description of Artificial Sequence: Synthetic peptide
  Seed: CSSSTSLSL (MAGC1_HUMAN)
CLSSTSLSF

SEQ ID NO: 77207 - protein, 10 aa, Artificial Sequence
  Description of Artificial Sequence: Synthetic peptide
  Seed: RSFSSTLLSI (MAGC1_HUMAN)
RAFSSTLLSY

SEQ ID NO: 77208 - protein, 9 aa, Artificial Sequence
  Description of Artificial Sequence: Synthetic peptide
  Seed: SPLHSPQSP (MAGC1_HUMAN)
SPLHSPQSV

SEQ ID NO: 77209 - protein, 9 aa, Artificial Sequence
  Description of Artificial Sequence: Synthetic peptide
  Seed: SQSSPVSSF (MAGC1_HUMAN)
SVSSPVSSH

SEQ ID NO: 77210 - protein, 9 aa, Artificial Sequence
  Description of Artificial Sequence: Synthetic peptide
  Seed: YVFVNTLDL (MAGC1_HUMAN)
YMFVNTLDL

SEQ ID NO: 77211 - protein, 9 aa, Artificial Sequence
  Description of Artificial Sequence: Synthetic peptide
  Seed: SLTDSESLI (MAGC1_HUMAN)
SMTDSESLV

SEQ ID NO: 77212 - protein, 9 aa, Artificial Sequence
  Description of Artificial Sequence: Synthetic peptide
  Seed: SLIESEPLF (MAGC1_HUMAN)
SSIESEPLM

SEQ ID NO: 77213 - protein, 9 aa, Artificial Sequence
  Description of Artificial Sequence: Synthetic peptide
  Seed: SGIGVRAGR (MAGC1_HUMAN)
SAIGVRAGF

SEQ ID NO: 77214 - protein, 8 aa, Artificial Sequence
  Description of Artificial Sequence: Synthetic peptide
  Seed: FGEPRELL (MAGC1_HUMAN)
FTEPRELL

SEQ ID NO: 77215 - protein, 10 aa, Artificial Sequence
  Description of Artificial Sequence: Synthetic peptide
  Seed: SSSSSTLLSL (MAGC1_HUMAN)
SFSSSTLLSY

SEQ ID NO: 77216 - protein, 9 aa, Artificial Sequence
  Description of Artificial Sequence: Synthetic peptide
  Seed: RTQSTFEGF (MAGC1_HUMAN)
RSQSTFEGM

SEQ ID NO: 77217 - protein, 9 aa, Artificial Sequence
  Description of Artificial Sequence: Synthetic peptide
  Seed: TLLSLFQSF (MAGC1_HUMAN)
TFLSLFQSW

SEQ ID NO: 77218 - protein, 9 aa, Artificial Sequence
  Description of Artificial Sequence: Synthetic peptide
  Seed: VEERAQAII (MAGC1_HUMAN)
VEERAQAIW

SEQ ID NO: 77219 - protein, 9 aa, Artificial Sequence
  Description of Artificial Sequence: Synthetic peptide
  Seed: FTYTLDEKV (MAGC1_HUMAN)
FRYTLDEKI

SEQ ID NO: 77220 - protein, 9 aa, Artificial Sequence
  Description of Artificial Sequence: Synthetic peptide
  Seed: LSDEQGMSQ (MAGC1_HUMAN)
LMDEQGMSF

SEQ ID NO: 77221 - protein, 9 aa, Artificial Sequence
  Description of Artificial Sequence: Synthetic peptide
  Seed: SSFFSYTLA (MAGC1_HUMAN)
SMFFSYTLK

SEQ ID NO: 77222 - protein, 9 aa, Artificial Sequence
  Description of Artificial Sequence: Synthetic peptide
  Seed: SSSSTLLSL (MAGC1_HUMAN)
SYSSTLLSL

SEQ ID NO: 77223 - protein, 9 aa, Artificial Sequence
  Description of Artificial Sequence: Synthetic peptide
  Seed: EYTSSSDTL (MAGC1_HUMAN)
EHTSSSDTF

SEQ ID NO: 77224 - protein, 10 aa, Artificial Sequence
  Description of Artificial Sequence: Synthetic peptide
  Seed: PLQIPVSRSF (MAGC1_HUMAN)
PHQIPVSRSF

SEQ ID NO: 77225 - protein, 11 aa, Artificial Sequence
  Description of Artificial Sequence: Synthetic peptide
  Seed: IPVSAASSSTL (MAGC1_HUMAN)
IHVSAASSSTY

SEQ ID NO: 77226 - protein, 11 aa, Artificial Sequence
  Description of Artificial Sequence: Synthetic peptide
  Seed: EVDPDDSYVFV (MAGC1_HUMAN)
EADPDDSYVFL

SEQ ID NO: 77227 - protein, 10 aa, Artificial Sequence
  Description of Artificial Sequence: Synthetic peptide
  Seed: SSSSSSSTLL (MAGC1_HUMAN)
SDSSSSSTLF

SEQ ID NO: 77228 - protein, 11 aa, Artificial Sequence
  Description of Artificial Sequence: Synthetic peptide
  Seed: SFFSSALLSIF (MAGC1_HUMAN)
SHFSSALLSIF

SEQ ID NO: 77229 - protein, 10 aa, Artificial Sequence
  Description of Artificial Sequence: Synthetic peptide
  Seed: STFEGFPQSL (MAGC1_HUMAN)
SPFEGFPQSF

SEQ ID NO: 77230 - protein, 9 aa, Artificial Sequence
  Description of Artificial Sequence: Synthetic peptide
  Seed: SPPRYEFLW (MAGC1_HUMAN)
STPRYEFLF

SEQ ID NO: 77231 - protein, 9 aa, Artificial Sequence
  Description of Artificial Sequence: Synthetic peptide
  Seed: SLPEWEDSL (MAGC1_HUMAN)
SQPEWEDSV

SEQ ID NO: 77232 - protein, 10 aa, Artificial Sequence
  Description of Artificial Sequence: Synthetic peptide
  Seed: WGPRAHSEVI (MAGC1_HUMAN)
WRPRAHSEVF

SEQ ID NO: 77233 - protein, 9 aa, Artificial Sequence
  Description of Artificial Sequence: Synthetic peptide
  Seed: REVDPDDSY (MAGC1_HUMAN)
RIVDPDDSY

SEQ ID NO: 77234 - protein, 10 aa, Artificial Sequence
  Description of Artificial Sequence: Synthetic peptide
  Seed: ISRYTGYFPV (MAGC1_HUMAN)
IGRYTGYFPK

SEQ ID NO: 77235 - protein, 9 aa, Artificial Sequence
  Description of Artificial Sequence: Synthetic peptide
  Seed: MPTAGMPSL (MAGC1_HUMAN)
MHTAGMPSI

SEQ ID NO: 77236 - protein, 10 aa, Artificial Sequence
  Description of Artificial Sequence: Synthetic peptide
  Seed: SFSERTQSTF (MAGC1_HUMAN)
SISERTQSTY

SEQ ID NO: 77237 - protein, 9 aa, Artificial Sequence
  Description of Artificial Sequence: Synthetic peptide
  Seed: MSQNRLLIL (MAGC1_HUMAN)
MMQNRLLIV

SEQ ID NO: 77238 - protein, 9 aa, Artificial Sequence
  Description of Artificial Sequence: Synthetic peptide
  Seed: AGREHFAFG (MAGC1_HUMAN)
ATREHFAFR

SEQ ID NO: 77239 - protein, 9 aa, Artificial Sequence
  Description of Artificial Sequence: Synthetic peptide
  Seed: TGYFPVIFR (MAGC1_HUMAN)
TQYFPVIFK

SEQ ID NO: 77240 - protein, 11 aa, Artificial Sequence
  Description of Artificial Sequence: Synthetic peptide
  Seed: SSTPSSLPQSF (MAGC1_HUMAN)
SGTPSSLPQSW

SEQ ID NO: 77241 - protein, 9 aa, Artificial Sequence
  Description of Artificial Sequence: Synthetic peptide
  Seed: ASSFFSSAL (MAGC1_HUMAN)
AESFFSSAY

SEQ ID NO: 77242 - protein, 10 aa, Artificial Sequence
  Description of Artificial Sequence: Synthetic peptide
  Seed: FLAMLKNTVP (MAGC1_HUMAN)
FIAMLKNTVL

SEQ ID NO: 77243 - protein, 9 aa, Artificial Sequence
  Description of Artificial Sequence: Synthetic peptide
  Seed: ASSFFSSAL (MAGC1_HUMAN)
AVSFFSSAL

SEQ ID NO: 77244 - protein, 9 aa, Artificial Sequence
  Description of Artificial Sequence: Synthetic peptide
  Seed: RSFSSTLLS (MAGC1_HUMAN)
RTFSSTLLA

SEQ ID NO: 77245 - protein, 9 aa, Artificial Sequence
  Description of Artificial Sequence: Synthetic peptide
  Seed: FSSALLSIF (MAGC1_HUMAN)
FISALLSIW

SEQ ID NO: 77246 - protein, 10 aa, Artificial Sequence
  Description of Artificial Sequence: Synthetic peptide
  Seed: FIEILFGISL (MAGC1_HUMAN)
FHEILFGISL

SEQ ID NO: 77247 - protein, 11 aa, Artificial Sequence
  Description of Artificial Sequence: Synthetic peptide
  Seed: IPVSSSSSSTL (MAGC1_HUMAN)
IVVSSSSSSTF

SEQ ID NO: 77248 - protein, 10 aa, Artificial Sequence
  Description of Artificial Sequence: Synthetic peptide
  Seed: RAHSEVIKRK (MAGC1_HUMAN)
RIHSEVIKRK

SEQ ID NO: 77249 - protein, 11 aa, Artificial Sequence
  Description of Artificial Sequence: Synthetic peptide
  Seed: SSSSSTLLSLF (MAGC1_HUMAN)
SRSSSTLLSLW

SEQ ID NO: 77250 - protein, 10 aa, Artificial Sequence
  Description of Artificial Sequence: Synthetic peptide
  Seed: MLTNVISRYT (MAGC1_HUMAN)
MLTNVISRYA

SEQ ID NO: 77251 - protein, 10 aa, Artificial Sequence
  Description of Artificial Sequence: Synthetic peptide
  Seed: MSQNRLLILI (MAGC1_HUMAN)
MQQNRLLILL

SEQ ID NO: 77252 - protein, 9 aa, Artificial Sequence
  Description of Artificial Sequence: Synthetic peptide
  Seed: SVLQIPVSA (MAGC1_HUMAN)
SALQIPVSR

SEQ ID NO: 77253 - protein, 9 aa, Artificial Sequence
  Description of Artificial Sequence: Synthetic peptide
  Seed: LQIPVSSSS (MAGC1_HUMAN)
LSIPVSSSY

SEQ ID NO: 77254 - protein, 9 aa, Artificial Sequence
  Description of Artificial Sequence: Synthetic peptide
  Seed: SPLEGEDSL (MAGC1_HUMAN)
SALEGEDSF

SEQ ID NO: 77255 - protein, 9 aa, Artificial Sequence
  Description of Artificial Sequence: Synthetic peptide
  Seed: TSSFSSTLL (MAGC1_HUMAN)
TASFSSTLW

SEQ ID NO: 77256 - protein, 9 aa, Artificial Sequence
  Description of Artificial Sequence: Synthetic peptide
  Seed: SQSSPVSSF (MAGC1_HUMAN)
SESSPVSSL

SEQ ID NO: 77257 - protein, 11 aa, Artificial Sequence
  Description of Artificial Sequence: Synthetic peptide
  Seed: SPLQRPVSSFF (MAGC1_HUMAN)
SPLQRPVSSFY

SEQ ID NO: 77258 - protein, 9 aa, Artificial Sequence
  Description of Artificial Sequence: Synthetic peptide
  Seed: KVVEFLAML (MAGC1_HUMAN)
KIVEFLAMF

SEQ ID NO: 77259 - protein, 10 aa, Artificial Sequence
  Description of Artificial Sequence: Synthetic peptide
  Seed: LQIPMTSSFS (MAGC1_HUMAN)
LIIPMTSSFY

SEQ ID NO: 77260 - protein, 10 aa, Artificial Sequence
  Description of Artificial Sequence: Synthetic peptide
  Seed: RKVVEFLAML (MAGC1_HUMAN)
RHVVEFLAMV

SEQ ID NO: 77261 - protein, 10 aa, Artificial Sequence
  Description of Artificial Sequence: Synthetic peptide
  Seed: SSPESAQSAF (MAGC1_HUMAN)
SGPESAQSAM

SEQ ID NO: 77262 - protein, 9 aa, Artificial Sequence
  Description of Artificial Sequence: Synthetic peptide
  Seed: LKYQVKQPI (MAGC1_HUMAN)
LLYQVKQPY

SEQ ID NO: 77263 - protein, 9 aa, Artificial Sequence
  Description of Artificial Sequence: Synthetic peptide
  Seed: QFPPQGEDF (MAGC1_HUMAN)
QSPPQGEDL

SEQ ID NO: 77264 - protein, 10 aa, Artificial Sequence
  Description of Artificial Sequence: Synthetic peptide
  Seed: RKVVEFLAML (MAGC1_HUMAN)
RVVVEFLAML

SEQ ID NO: 77265 - protein, 10 aa, Artificial Sequence
  Description of Artificial Sequence: Synthetic peptide
  Seed: YTLASLLQSS (MAGC1_HUMAN)
YCLASLLQST

SEQ ID NO: 77266 - protein, 9 aa, Artificial Sequence
  Description of Artificial Sequence: Synthetic peptide
  Seed: VSRSFSSTL (MAGC1_HUMAN)
VSRSFSSTA

SEQ ID NO: 77267 - protein, 9 aa, Artificial Sequence
  Description of Artificial Sequence: Synthetic peptide
  Seed: RTHSTFEGF (MAGC1_HUMAN)
RSHSTFEGY

SEQ ID NO: 77268 - protein, 9 aa, Artificial Sequence
  Description of Artificial Sequence: Synthetic peptide
  Seed: AGREHFAFG (MAGC1_HUMAN)
AQREHFAFY

SEQ ID NO: 77269 - protein, 10 aa, Artificial Sequence
  Description of Artificial Sequence: Synthetic peptide
  Seed: VISFSSSTSL (MAGC1_HUMAN)
VGSFSSSTSW

SEQ ID NO: 77270 - protein, 8 aa, Artificial Sequence
  Description of Artificial Sequence: Synthetic peptide
  Seed: FSSALLSI (MAGC1_HUMAN)
FSSALLSL

SEQ ID NO: 77271 - protein, 9 aa, Artificial Sequence
  Description of Artificial Sequence: Synthetic peptide
  Seed: SAQSTFEGF (MAGC1_HUMAN)
SQQSTFEGI

SEQ ID NO: 77272 - protein, 9 aa, Artificial Sequence
  Description of Artificial Sequence: Synthetic peptide
  Seed: AMLKNTVPI (MAGC1_HUMAN)
ALLKNTVPI

SEQ ID NO: 77273 - protein, 11 aa, Artificial Sequence
  Description of Artificial Sequence: Synthetic peptide
  Seed: RPVSSFFSYTL (MAGC1_HUMAN)
RWVSSFFSYTW

SEQ ID NO: 77274 - protein, 11 aa, Artificial Sequence
  Description of Artificial Sequence: Synthetic peptide
  Seed: SPLQIPVSSSS (MAGC1_HUMAN)
SWLQIPVSSSM

SEQ ID NO: 77275 - protein, 9 aa, Artificial Sequence
  Description of Artificial Sequence: Synthetic peptide
  Seed: MGDKDMPTA (MAGC1_HUMAN)
MTDKDMPTF

SEQ ID NO: 77276 - protein, 10 aa, Artificial Sequence
  Description of Artificial Sequence: Synthetic peptide
  Seed: KVVEFLAMLK (MAGC1_HUMAN)
KTVEFLAMLK

SEQ ID NO: 77277 - protein, 10 aa, Artificial Sequence
  Description of Artificial Sequence: Synthetic peptide
  Seed: SSPERTHSTF (MAGC1_HUMAN)
STPERTHSTW

SEQ ID NO: 77278 - protein, 9 aa, Artificial Sequence
  Description of Artificial Sequence: Synthetic peptide
  Seed: SSFFSSALL (MAGC1_HUMAN)
SLFFSSALL

SEQ ID NO: 77279 - protein, 10 aa, Artificial Sequence
  Description of Artificial Sequence: Synthetic peptide
  Seed: LAMLKNTVPI (MAGC1_HUMAN)
LAMLKNTVPV

SEQ ID NO: 77280 - protein, 9 aa, Artificial Sequence
  Description of Artificial Sequence: Synthetic peptide
  Seed: LQIPMTSSF (MAGC1_HUMAN)
LWIPMTSSW

SEQ ID NO: 77281 - protein, 9 aa, Artificial Sequence
  Description of Artificial Sequence: Synthetic peptide
  Seed: KAREFIEIL (MAGC1_HUMAN)
KQREFIEIL

SEQ ID NO: 77282 - protein, 10 aa, Artificial Sequence
  Description of Artificial Sequence: Synthetic peptide
  Seed: MTSSFSSTLL (MAGC1_HUMAN)
MLSSFSSTLC

SEQ ID NO: 77283 - protein, 9 aa, Artificial Sequence
  Description of Artificial Sequence: Synthetic peptide
  Seed: SSPESTQSP (MAGC1_HUMAN)
SYPESTQSM

SEQ ID NO: 77284 - protein, 9 aa, Artificial Sequence
  Description of Artificial Sequence: Synthetic peptide
  Seed: DALKDVEER (MAGC1_HUMAN)
DVLKDVEER

SEQ ID NO: 77285 - protein, 11 aa, Artificial Sequence
  Description of Artificial Sequence: Synthetic peptide
  Seed: RPVSSFFSYTL (MAGC1_HUMAN)
RTVSSFFSYTL

SEQ ID NO: 77286 - protein, 9 aa, Artificial Sequence
  Description of Artificial Sequence: Synthetic peptide
  Seed: SSPERTQST (MAGC1_HUMAN)
SCPERTQSV

SEQ ID NO: 77287 - protein, 9 aa, Artificial Sequence
  Description of Artificial Sequence: Synthetic peptide
  Seed: TLVSIFQSS (MAGC1_HUMAN)
TMVSIFQSM

SEQ ID NO: 77288 - protein, 11 aa, Artificial Sequence
  Description of Artificial Sequence: Synthetic peptide
  Seed: IIDTTDDSTAT (MAGC1_HUMAN)
IIDTTDDSTAV

SEQ ID NO: 77289 - protein, 10 aa, Artificial Sequence
  Description of Artificial Sequence: Synthetic peptide
  Seed: SPLQNPASSF (MAGC1_HUMAN)
SSLQNPASSY

SEQ ID NO: 77290 - protein, 10 aa, Artificial Sequence
  Description of Artificial Sequence: Synthetic peptide
  Seed: EVIWDVLSGI (MAGC1_HUMAN)
ETIWDVLSGT

SEQ ID NO: 77291 - protein, 10 aa, Artificial Sequence
  Description of Artificial Sequence: Synthetic peptide
  Seed: KVVEFLAMLK (MAGC1_HUMAN)
KVVEFLAMLV

SEQ ID NO: 77292 - protein, 9 aa, Artificial Sequence
  Description of Artificial Sequence: Synthetic peptide
  Seed: AFGEPRELL (MAGC1_HUMAN)
ASGEPRELL

SEQ ID NO: 77293 - protein, 9 aa, Artificial Sequence
  Description of Artificial Sequence: Synthetic peptide
  Seed: KAREFIEIL (MAGC1_HUMAN)
KVREFIEIS

SEQ ID NO: 77294 - protein, 10 aa, Artificial Sequence
  Description of Artificial Sequence: Synthetic peptide
  Seed: SLSPLHFPQF (MAGC1_HUMAN)
STSPLHFPQW

SEQ ID NO: 77295 - protein, 9 aa, Artificial Sequence
  Description of Artificial Sequence: Synthetic peptide
  Seed: TSSFSSTLL (MAGC1_HUMAN)
TTSFSSTLA

SEQ ID NO: 77296 - protein, 9 aa, Artificial Sequence
  Description of Artificial Sequence: Synthetic peptide
  Seed: SPQSPPEGP (MAGC1_HUMAN)
SMQSPPEGY

SEQ ID NO: 77297 - protein, 10 aa, Artificial Sequence
  Description of Artificial Sequence: Synthetic peptide
  Seed: LQIPMTSSFS (MAGC1_HUMAN)
LMIPMTSSFH

SEQ ID NO: 77298 - protein, 10 aa, Artificial Sequence
  Description of Artificial Sequence: Synthetic peptide
  Seed: RKVVEFLAML (MAGC1_HUMAN)
RIVVEFLAML

SEQ ID NO: 77299 - protein, 9 aa, Artificial Sequence
  Description of Artificial Sequence: Synthetic peptide
  Seed: LQNPASSFF (MAGC1_HUMAN)
LVNPASSFW

SEQ ID NO: 77300 - protein, 9 aa, Artificial Sequence
  Description of Artificial Sequence: Synthetic peptide
  Seed: VSSSFSYTL (MAGC1_HUMAN)
VQSSFSYTA

SEQ ID NO: 77301 - protein, 11 aa, Artificial Sequence
  Description of Artificial Sequence: Synthetic peptide
  Seed: SEESSSPVDEY (MAGC1_HUMAN)
SMESSSPVDEY

SEQ ID NO: 77302 - protein, 10 aa, Artificial Sequence
  Description of Artificial Sequence: Synthetic peptide
  Seed: LILILSIIFI (MAGC1_HUMAN)
LFLILSIIFV

SEQ ID NO: 77303 - protein, 9 aa, Artificial Sequence
  Description of Artificial Sequence: Synthetic peptide
  Seed: FLWGPRAHS (MAGC1_HUMAN)
FQWGPRAHI

SEQ ID NO: 77304 - protein, 10 aa, Artificial Sequence
  Description of Artificial Sequence: Synthetic peptide
  Seed: QIPVSSSFSY (MAGC1_HUMAN)
QMPVSSSFSM

SEQ ID NO: 77305 - protein, 9 aa, Artificial Sequence
  Description of Artificial Sequence: Synthetic peptide
  Seed: AMLKNTVPI (MAGC1_HUMAN)
AALKNTVPY

SEQ ID NO: 77306 - protein, 9 aa, Artificial Sequence
  Description of Artificial Sequence: Synthetic peptide
  Seed: DEQGMSQNR (MAGC1_HUMAN)
DLQGMSQNR

SEQ ID NO: 77307 - protein, 10 aa, Artificial Sequence
  Description of Artificial Sequence: Synthetic peptide
  Seed: SSFSYTLLSL (MAGC1_HUMAN)
SVFSYTLLSV

SEQ ID NO: 77308 - protein, 9 aa, Artificial Sequence
  Description of Artificial Sequence: Synthetic peptide
  Seed: SSPESAQSA (MAGC1_HUMAN)
SLPESAQSY

SEQ ID NO: 77309 - protein, 11 aa, Artificial Sequence
  Description of Artificial Sequence: Synthetic peptide
  Seed: SFFSSALLSIF (MAGC1_HUMAN)
SMFSSALLSIF

SEQ ID NO: 77310 - protein, 9 aa, Artificial Sequence
  Description of Artificial Sequence: Synthetic peptide
  Seed: KDSLSPLEI (MAGC1_HUMAN)
KLSLSPLEF

SEQ ID NO: 77311 - protein, 9 aa, Artificial Sequence
  Description of Artificial Sequence: Synthetic peptide
  Seed: WVQEHYLEY (MAGC1_HUMAN)
WHQEHYLEY

SEQ ID NO: 77312 - protein, 11 aa, Artificial Sequence
  Description of Artificial Sequence: Synthetic peptide
  Seed: MSPLYFPQSPL (MAGC1_HUMAN)
MMPLYFPQSPV

SEQ ID NO: 77313 - protein, 9 aa, Artificial Sequence
  Description of Artificial Sequence: Synthetic peptide
  Seed: SPLQNPASS (MAGC1_HUMAN)
SPLQNPASV

SEQ ID NO: 77314 - protein, 10 aa, Artificial Sequence
  Description of Artificial Sequence: Synthetic peptide
  Seed: ICSSSTSLSL (MAGC1_HUMAN)
IASSSTSLSM

SEQ ID NO: 77315 - protein, 9 aa, Artificial Sequence
  Description of Artificial Sequence: Synthetic peptide
  Seed: RPVSSFFSY (MAGC1_HUMAN)
RIVSSFFSF

SEQ ID NO: 77316 - protein, 9 aa, Artificial Sequence
  Description of Artificial Sequence: Synthetic peptide
  Seed: MSQNRLLIL (MAGC1_HUMAN)
MVQNRLLIW

SEQ ID NO: 77317 - protein, 9 aa, Artificial Sequence
  Description of Artificial Sequence: Synthetic peptide
  Seed: IPVSPSSSS (MAGC1_HUMAN)
IAVSPSSSM

SEQ ID NO: 77318 - protein, 9 aa, Artificial Sequence
  Description of Artificial Sequence: Synthetic peptide
  Seed: FEGFAQSPL (MAGC1_HUMAN)
FEGFAQSPY

SEQ ID NO: 77319 - protein, 9 aa, Artificial Sequence
  Description of Artificial Sequence: Synthetic peptide
  Seed: NTVPITFPS (MAGC1_HUMAN)
NMVPITFPR

SEQ ID NO: 77320 - protein, 11 aa, Artificial Sequence
  Description of Artificial Sequence: Synthetic peptide
  Seed: SPLQIPVSPSS (MAGC1_HUMAN)
SLLQIPVSPSF

SEQ ID NO: 77321 - protein, 9 aa, Artificial Sequence
  Description of Artificial Sequence: Synthetic peptide
  Seed: LSDEQGMSQ (MAGC1_HUMAN)
LSDEQGMSA

SEQ ID NO: 77322 - protein, 9 aa, Artificial Sequence
  Description of Artificial Sequence: Synthetic peptide
  Seed: SFSERTQST (MAGC1_HUMAN)
SWSERTQSL

SEQ ID NO: 77323 - protein, 9 aa, Artificial Sequence
  Description of Artificial Sequence: Synthetic peptide
  Seed: YVFVNTLDL (MAGC1_HUMAN)
YKFVNTLDF

SEQ ID NO: 77324 - protein, 9 aa, Artificial Sequence
  Description of Artificial Sequence: Synthetic peptide
  Seed: NSSPPRYEF (MAGC1_HUMAN)
NQSPPRYEF

SEQ ID NO: 77325 - protein, 9 aa, Artificial Sequence
  Description of Artificial Sequence: Synthetic peptide
  Seed: MTSSFSSTL (MAGC1_HUMAN)
MKSSFSSTV

SEQ ID NO: 77326 - protein, 9 aa, Artificial Sequence
  Description of Artificial Sequence: Synthetic peptide
  Seed: SFSSTLVSL (MAGC1_HUMAN)
SMSSTLVSA

SEQ ID NO: 77327 - protein, 10 aa, Artificial Sequence
  Description of Artificial Sequence: Synthetic peptide
  Seed: SLSPLHFPQF (MAGC1_HUMAN)
SASPLHFPQY

SEQ ID NO: 77328 - protein, 10 aa, Artificial Sequence
  Description of Artificial Sequence: Synthetic peptide
  Seed: RSFSSTLLSI (MAGC1_HUMAN)
RAFSSTLLSI

SEQ ID NO: 77329 - protein, 9 aa, Artificial Sequence
  Description of Artificial Sequence: Synthetic peptide
  Seed: YTGYFPVIF (MAGC1_HUMAN)
YMGYFPVIY

SEQ ID NO: 77330 - protein, 10 aa, Artificial Sequence
  Description of Artificial Sequence: Synthetic peptide
  Seed: MLKNTVPITF (MAGC1_HUMAN)
MKKNTVPITM

SEQ ID NO: 77331 - protein, 11 aa, Artificial Sequence
  Description of Artificial Sequence: Synthetic peptide
  Seed: STFEGFPQSLL (MAGC1_HUMAN)
SLFEGFPQSLW

SEQ ID NO: 77332 - protein, 9 aa, Artificial Sequence
  Description of Artificial Sequence: Synthetic peptide
  Seed: SPLQIVPSL (MAGC1_HUMAN)
SELQIVPSY

SEQ ID NO: 77333 - protein, 9 aa, Artificial Sequence
  Description of Artificial Sequence: Synthetic peptide
  Seed: FFSSALLSI (MAGC1_HUMAN)
FVSSALLSI

SEQ ID NO: 77334 - protein, 9 aa, Artificial Sequence
  Description of Artificial Sequence: Synthetic peptide
  Seed: YVFVNTLDL (MAGC1_HUMAN)
YTFVNTLDI

SEQ ID NO: 77335 - protein, 10 aa, Artificial Sequence
  Description of Artificial Sequence: Synthetic peptide
  Seed: STLLSLFQSF (MAGC1_HUMAN)
SELLSLFQSY

SEQ ID NO: 77336 - protein, 9 aa, Artificial Sequence
  Description of Artificial Sequence: Synthetic peptide
  Seed: SFSSTLVSL (MAGC1_HUMAN)
SFSSTLVSV

SEQ ID NO: 77337 - protein, 10 aa, Artificial Sequence
  Description of Artificial Sequence: Synthetic peptide
  Seed: FPQSVLQIPV (MAGC1_HUMAN)
FAQSVLQIPV

SEQ ID NO: 77338 - protein, 10 aa, Artificial Sequence
  Description of Artificial Sequence: Synthetic peptide
  Seed: SLIESEPLFT (MAGC1_HUMAN)
SLIESEPLFV

SEQ ID NO: 77339 - protein, 9 aa, Artificial Sequence
  Description of Artificial Sequence: Synthetic peptide
  Seed: EFIEILFGI (MAGC1_HUMAN)
EQIEILFGT

SEQ ID NO: 77340 - protein, 10 aa, Artificial Sequence
  Description of Artificial Sequence: Synthetic peptide
  Seed: LAMLKNTVPI (MAGC1_HUMAN)
LTMLKNTVPV

SEQ ID NO: 77341 - protein, 9 aa, Artificial Sequence
  Description of Artificial Sequence: Synthetic peptide
  Seed: SIIFIKGTY (MAGC1_HUMAN)
STIFIKGTW

SEQ ID NO: 77342 - protein, 10 aa, Artificial Sequence
  Description of Artificial Sequence: Synthetic peptide
  Seed: VSSSSSSSTL (MAGC1_HUMAN)
VESSSSSSTY

SEQ ID NO: 77343 - protein, 11 aa, Artificial Sequence
  Description of Artificial Sequence: Synthetic peptide
  Seed: IPVSRSFSSTL (MAGC1_HUMAN)
ISVSRSFSSTY

SEQ ID NO: 77344 - protein, 9 aa, Artificial Sequence
  Description of Artificial Sequence: Synthetic peptide
  Seed: TGYFPVIFR (MAGC1_HUMAN)
TCYFPVIFR

SEQ ID NO: 77345 - protein, 11 aa, Artificial Sequence
  Description of Artificial Sequence: Synthetic peptide
  Seed: SSSSSSTLLSL (MAGC1_HUMAN)
SGSSSSTLLSW

SEQ ID NO: 77346 - protein, 9 aa, Artificial Sequence
  Description of Artificial Sequence: Synthetic peptide
  Seed: RAGREHFAF (MAGC1_HUMAN)
RIGREHFAF

SEQ ID NO: 77347 - protein, 11 aa, Artificial Sequence
  Description of Artificial Sequence: Synthetic peptide
  Seed: LQRPVSSFFSY (MAGC1_HUMAN)
LTRPVSSFFSY

SEQ ID NO: 77348 - protein, 9 aa, Artificial Sequence
  Description of Artificial Sequence: Synthetic peptide
  Seed: AQSSLQIPV (MAGC1_HUMAN)
ARSSLQIPF

SEQ ID NO: 77349 - protein, 8 aa, Artificial Sequence
  Description of Artificial Sequence: Synthetic peptide
  Seed: FSYTLLSL (MAGC1_HUMAN)
FTYTLLSF

SEQ ID NO: 77350 - protein, 10 aa, Artificial Sequence
  Description of Artificial Sequence: Synthetic peptide
  Seed: LAMLKNTVPI (MAGC1_HUMAN)
LLMLKNTVPA

SEQ ID NO: 77351 - protein, 9 aa, Artificial Sequence
  Description of Artificial Sequence: Synthetic peptide
  Seed: LQIPGSPSF (MAGC1_HUMAN)
LNIPGSPSF

SEQ ID NO: 77352 - protein, 9 aa, Artificial Sequence
  Description of Artificial Sequence: Synthetic peptide
  Seed: KDSQSPLQI (MAGC1_HUMAN)
KESQSPLQP

SEQ ID NO: 77353 - protein, 10 aa, Artificial Sequence
  Description of Artificial Sequence: Synthetic peptide
  Seed: SRYTGYFPVI (MAGC1_HUMAN)
SHYTGYFPVL

SEQ ID NO: 77354 - protein, 10 aa, Artificial Sequence
  Description of Artificial Sequence: Synthetic peptide
  Seed: SFSSTLVSLF (MAGC1_HUMAN)
SNSSTLVSLW

SEQ ID NO: 77355 - protein, 9 aa, Artificial Sequence
  Description of Artificial Sequence: Synthetic peptide
  Seed: SRYTGYFPV (MAGC1_HUMAN)
SKYTGYFPW

SEQ ID NO: 77356 - protein, 10 aa, Artificial Sequence
  Description of Artificial Sequence: Synthetic peptide
  Seed: TTDDSTATES (MAGC1_HUMAN)
TPDDSTATEL

SEQ ID NO: 77357 - protein, 10 aa, Artificial Sequence
  Description of Artificial Sequence: Synthetic peptide
  Seed: LILILSIIFI (MAGC1_HUMAN)
LLLILSIIFV

SEQ ID NO: 77358 - protein, 9 aa, Artificial Sequence
  Description of Artificial Sequence: Synthetic peptide
  Seed: SAASSSTLV (MAGC1_HUMAN)
SMASSSTLL

SEQ ID NO: 77359 - protein, 9 aa, Artificial Sequence
  Description of Artificial Sequence: Synthetic peptide
  Seed: TLLSLFQSF (MAGC1_HUMAN)
TRLSLFQSY

SEQ ID NO: 77360 - protein, 10 aa, Artificial Sequence
  Description of Artificial Sequence: Synthetic peptide
  Seed: MTSSFSSTLL (MAGC1_HUMAN)
MQSSFSSTLV

SEQ ID NO: 77361 - protein, 10 aa, Artificial Sequence
  Description of Artificial Sequence: Synthetic peptide
  Seed: SSSSTLLSLF (MAGC1_HUMAN)
SRSSTLLSLW

SEQ ID NO: 77362 - protein, 9 aa, Artificial Sequence
  Description of Artificial Sequence: Synthetic peptide
  Seed: VEERAQAII (MAGC1_HUMAN)
VEERAQAIA

SEQ ID NO: 77363 - protein, 10 aa, Artificial Sequence
  Description of Artificial Sequence: Synthetic peptide
  Seed: SSSSTLLSLF (MAGC1_HUMAN)
SDSSTLLSLF

SEQ ID NO: 77364 - protein, 10 aa, Artificial Sequence
  Description of Artificial Sequence: Synthetic peptide
  Seed: GENTHSPLQI (MAGC1_HUMAN)
GENTHSPLQW

SEQ ID NO: 77365 - protein, 10 aa, Artificial Sequence
  Description of Artificial Sequence: Synthetic peptide
  Seed: YTLASLLQSS (MAGC1_HUMAN)
YQLASLLQSM

SEQ ID NO: 77366 - protein, 9 aa, Artificial Sequence
  Description of Artificial Sequence: Synthetic peptide
  Seed: LQIPMTSSF (MAGC1_HUMAN)
LVIPMTSSW

SEQ ID NO: 77367 - protein, 11 aa, Artificial Sequence
  Description of Artificial Sequence: Synthetic peptide
  Seed: SSSSSSTLLSL (MAGC1_HUMAN)
SESSSSTLLSW

SEQ ID NO: 77368 - protein, 10 aa, Artificial Sequence
  Description of Artificial Sequence: Synthetic peptide
  Seed: YTLLSLFQSS (MAGC1_HUMAN)
YMLLSLFQSL

SEQ ID NO: 77369 - protein, 11 aa, Artificial Sequence
  Description of Artificial Sequence: Synthetic peptide
  Seed: SAASSSTLVSI (MAGC1_HUMAN)
SLASSSTLVSL

SEQ ID NO: 77370 - protein, 9 aa, Artificial Sequence
  Description of Artificial Sequence: Synthetic peptide
  Seed: TPSSLPQSF (MAGC1_HUMAN)
TRSSLPQSL

SEQ ID NO: 77371 - protein, 10 aa, Artificial Sequence
  Description of Artificial Sequence: Synthetic peptide
  Seed: EILFGISLRE (MAGC1_HUMAN)
EVLFGISLRK

SEQ ID NO: 77372 - protein, 9 aa, Artificial Sequence
  Description of Artificial Sequence: Synthetic peptide
  Seed: LQIPGSPSF (MAGC1_HUMAN)
LLIPGSPSI

SEQ ID NO: 77373 - protein, 10 aa, Artificial Sequence
  Description of Artificial Sequence: Synthetic peptide
  Seed: TVPITFPSSY (MAGC1_HUMAN)
TFPITFPSSY

SEQ ID NO: 77374 - protein, 11 aa, Artificial Sequence
  Description of Artificial Sequence: Synthetic peptide
  Seed: IPMTSSFSSTL (MAGC1_HUMAN)
IHMTSSFSSTF

SEQ ID NO: 77375 - protein, 9 aa, Artificial Sequence
  Description of Artificial Sequence: Synthetic peptide
  Seed: RYTGYFPVI (MAGC1_HUMAN)
RYTGYFPVW

SEQ ID NO: 77376 - protein, 10 aa, Artificial Sequence
  Description of Artificial Sequence: Synthetic peptide
  Seed: ARFLLLKYQV (MAGC1_HUMAN)
ARFLLLKYQL

SEQ ID NO: 77377 - protein, 9 aa, Artificial Sequence
  Description of Artificial Sequence: Synthetic peptide
  Seed: CSSSTPSSL (MAGC1_HUMAN)
CKSSTPSSM

SEQ ID NO: 77378 - protein, 10 aa, Artificial Sequence
  Description of Artificial Sequence: Synthetic peptide
  Seed: FPQSLLQIPM (MAGC1_HUMAN)
FLQSLLQIPV

SEQ ID NO: 77379 - protein, 10 aa, Artificial Sequence
  Description of Artificial Sequence: Synthetic peptide
  Seed: TTDDSTATES (MAGC1_HUMAN)
TTDDSTATEL

SEQ ID NO: 77380 - protein, 10 aa, Artificial Sequence
  Description of Artificial Sequence: Synthetic peptide
  Seed: VISFSSSTSL (MAGC1_HUMAN)
VNSFSSSTSW

SEQ ID NO: 77381 - protein, 10 aa, Artificial Sequence
  Description of Artificial Sequence: Synthetic peptide
  Seed: RAGREHFAFG (MAGC1_HUMAN)
RMGREHFAFI

SEQ ID NO: 77382 - protein, 9 aa, Artificial Sequence
  Description of Artificial Sequence: Synthetic peptide
  Seed: SSPESDDTL (MAGC1_HUMAN)
SQPESDDTL

SEQ ID NO: 77383 - protein, 9 aa, Artificial Sequence
  Description of Artificial Sequence: Synthetic peptide
  Seed: CSSSTSLSL (MAGC1_HUMAN)
CVSSTSLSW

SEQ ID NO: 77384 - protein, 9 aa, Artificial Sequence
  Description of Artificial Sequence: Synthetic peptide
  Seed: VSPSFSSTL (MAGC1_HUMAN)
VWPSFSSTI

SEQ ID NO: 77385 - protein, 9 aa, Artificial Sequence
  Description of Artificial Sequence: Synthetic peptide
  Seed: RSFSSTLLS (MAGC1_HUMAN)
RTFSSTLLY

SEQ ID NO: 77386 - protein, 9 aa, Artificial Sequence
  Description of Artificial Sequence: Synthetic peptide
  Seed: SSPESTQSP (MAGC1_HUMAN)
SFPESTQSF

SEQ ID NO: 77387 - protein, 9 aa, Artificial Sequence
  Description of Artificial Sequence: Synthetic peptide
  Seed: SSFFSYTLA (MAGC1_HUMAN)
SQFFSYTLA

SEQ ID NO: 77388 - protein, 11 aa, Artificial Sequence
  Description of Artificial Sequence: Synthetic peptide
  Seed: IPVSSSFSYTL (MAGC1_HUMAN)
IKVSSSFSYTF

SEQ ID NO: 77389 - protein, 9 aa, Artificial Sequence
  Description of Artificial Sequence: Synthetic peptide
  Seed: FQSSLQSPV (MAGC1_HUMAN)
FKSSLQSPL

SEQ ID NO: 77390 - protein, 10 aa, Artificial Sequence
  Description of Artificial Sequence: Synthetic peptide
  Seed: SSFSSTLLSI (MAGC1_HUMAN)
SVFSSTLLSL

SEQ ID NO: 77391 - protein, 8 aa, Artificial Sequence
  Description of Artificial Sequence: Synthetic peptide
  Seed: LQIPQSPL (MAGC1_HUMAN)
LQIPQSPY

SEQ ID NO: 77392 - protein, 9 aa, Artificial Sequence
  Description of Artificial Sequence: Synthetic peptide
  Seed: NTHSPLQIV (MAGC1_HUMAN)
NSHSPLQIL

SEQ ID NO: 77393 - protein, 9 aa, Artificial Sequence
  Description of Artificial Sequence: Synthetic peptide
  Seed: YTGYFPVIF (MAGC1_HUMAN)
YAGYFPVIM

SEQ ID NO: 77394 - protein, 10 aa, Artificial Sequence
  Description of Artificial Sequence: Synthetic peptide
  Seed: RKVVEFLAML (MAGC1_HUMAN)
RAVVEFLAMV

SEQ ID NO: 77395 - protein, 9 aa, Artificial Sequence
  Description of Artificial Sequence: Synthetic peptide
  Seed: KDMPTAGMP (MAGC1_HUMAN)
KEMPTAGMT

SEQ ID NO: 77396 - protein, 10 aa, Artificial Sequence
  Description of Artificial Sequence: Synthetic peptide
  Seed: FIEILFGISL (MAGC1_HUMAN)
FREILFGISL

SEQ ID NO: 77397 - protein, 10 aa, Artificial Sequence
  Description of Artificial Sequence: Synthetic peptide
  Seed: SLSPLHFPQF (MAGC1_HUMAN)
SWSPLHFPQL

SEQ ID NO: 77398 - protein, 10 aa, Artificial Sequence
  Description of Artificial Sequence: Synthetic peptide
  Seed: ASSFFSSALL (MAGC1_HUMAN)
AQSFFSSALF

SEQ ID NO: 77399 - protein, 9 aa, Artificial Sequence
  Description of Artificial Sequence: Synthetic peptide
  Seed: FSSTLLSLF (MAGC1_HUMAN)
FMSTLLSLA

SEQ ID NO: 77400 - protein, 8 aa, Artificial Sequence
  Description of Artificial Sequence: Synthetic peptide
  Seed: SSFFSSAL (MAGC1_HUMAN)
SQFFSSAY

SEQ ID NO: 77401 - protein, 10 aa, Artificial Sequence
  Description of Artificial Sequence: Synthetic peptide
  Seed: SSSSTLLSLF (MAGC1_HUMAN)
SPSSTLLSLW

SEQ ID NO: 77402 - protein, 11 aa, Artificial Sequence
  Description of Artificial Sequence: Synthetic peptide
  Seed: SPLQIPGSPSF (MAGC1_HUMAN)
SLLQIPGSPSM

SEQ ID NO: 77403 - protein, 10 aa, Artificial Sequence
  Description of Artificial Sequence: Synthetic peptide
  Seed: FPQSVLQIPV (MAGC1_HUMAN)
FLQSVLQIPA

SEQ ID NO: 77404 - protein, 10 aa, Artificial Sequence
  Description of Artificial Sequence: Synthetic peptide
  Seed: SSSSTLLSLF (MAGC1_HUMAN)
SISSTLLSLY

SEQ ID NO: 77405 - protein, 9 aa, Artificial Sequence
  Description of Artificial Sequence: Synthetic peptide
  Seed: LQIPMTSSF (MAGC1_HUMAN)
LCIPMTSSY

SEQ ID NO: 77406 - protein, 9 aa, Artificial Sequence
  Description of Artificial Sequence: Synthetic peptide
  Seed: RAGREHFAF (MAGC1_HUMAN)
RMGREHFAM

SEQ ID NO: 77407 - protein, 9 aa, Artificial Sequence
  Description of Artificial Sequence: Synthetic peptide
  Seed: GFPQSPLQI (MAGC1_HUMAN)
GRPQSPLQM

SEQ ID NO: 77408 - protein, 10 aa, Artificial Sequence
  Description of Artificial Sequence: Synthetic peptide
  Seed: VSRSFSSTLL (MAGC1_HUMAN)
VSRSFSSTLA

SEQ ID NO: 77409 - protein, 9 aa, Artificial Sequence
  Description of Artificial Sequence: Synthetic peptide
  Seed: FFSSALLSI (MAGC1_HUMAN)
FLSSALLSS

SEQ ID NO: 77410 - protein, 10 aa, Artificial Sequence
  Description of Artificial Sequence: Synthetic peptide
  Seed: QIPVSSSFSY (MAGC1_HUMAN)
QTPVSSSFSF

SEQ ID NO: 77411 - protein, 11 aa, Artificial Sequence
  Description of Artificial Sequence: Synthetic peptide
  Seed: SPLQIPMTSSF (MAGC1_HUMAN)
SKLQIPMTSSM

SEQ ID NO: 77412 - protein, 9 aa, Artificial Sequence
  Description of Artificial Sequence: Synthetic peptide
  Seed: CTQSTFEGF (MAGC1_HUMAN)
CQQSTFEGY

SEQ ID NO: 77413 - protein, 9 aa, Artificial Sequence
  Description of Artificial Sequence: Synthetic peptide
  Seed: ASSSTLVSI (MAGC1_HUMAN)
AGSSTLVSF

SEQ ID NO: 77414 - protein, 9 aa, Artificial Sequence
  Description of Artificial Sequence: Synthetic peptide
  Seed: TSLSLPQSF (MAGC1_HUMAN)
TRLSLPQSI

SEQ ID NO: 77415 - protein, 10 aa, Artificial Sequence
  Description of Artificial Sequence: Synthetic peptide
  Seed: SPLEISQSPP (MAGC1_HUMAN)
SPLEISQSPA

SEQ ID NO: 77416 - protein, 9 aa, Artificial Sequence
  Description of Artificial Sequence: Synthetic peptide
  Seed: FSSALLSIF (MAGC1_HUMAN)
FGSALLSIM

SEQ ID NO: 77417 - protein, 10 aa, Artificial Sequence
  Description of Artificial Sequence: Synthetic peptide
  Seed: EILFGISLRE (MAGC1_HUMAN)
EMLFGISLRK

SEQ ID NO: 77418 - protein, 9 aa, Artificial Sequence
  Description of Artificial Sequence: Synthetic peptide
  Seed: NTVPITFPS (MAGC1_HUMAN)
NMVPITFPA

SEQ ID NO: 77419 - protein, 10 aa, Artificial Sequence
  Description of Artificial Sequence: Synthetic peptide
  Seed: HSPQSPPEGM (MAGC1_HUMAN)
HVPQSPPEGY

SEQ ID NO: 77420 - protein, 10 aa, Artificial Sequence
  Description of Artificial Sequence: Synthetic peptide
  Seed: SVLQIPVSAA (MAGC1_HUMAN)
SPLQIPVSAL

SEQ ID NO: 77421 - protein, 9 aa, Artificial Sequence
  Description of Artificial Sequence: Synthetic peptide
  Seed: FAFGEPREL (MAGC1_HUMAN)
FSFGEPREL

SEQ ID NO: 77422 - protein, 10 aa, Artificial Sequence
  Description of Artificial Sequence: Synthetic peptide
  Seed: EMLTNVISRY (MAGC1_HUMAN)
ETLTNVISRR

SEQ ID NO: 77423 - protein, 9 aa, Artificial Sequence
  Description of Artificial Sequence: Synthetic peptide
  Seed: FTYTLDEKV (MAGC1_HUMAN)
FAYTLDEKM

SEQ ID NO: 77424 - protein, 9 aa, Artificial Sequence
  Description of Artificial Sequence: Synthetic peptide
  Seed: TFEGFPQSL (MAGC1_HUMAN)
TIEGFPQSF

SEQ ID NO: 77425 - protein, 9 aa, Artificial Sequence
  Description of Artificial Sequence: Synthetic peptide
  Seed: FSSTLLSLF (MAGC1_HUMAN)
FQSTLLSLL

SEQ ID NO: 77426 - protein, 11 aa, Artificial Sequence
  Description of Artificial Sequence: Synthetic peptide
  Seed: IIDTTDDSTAT (MAGC1_HUMAN)
IFDTTDDSTAM

SEQ ID NO: 77427 - protein, 10 aa, Artificial Sequence
  Description of Artificial Sequence: Synthetic peptide
  Seed: KVVEFLAMLK (MAGC1_HUMAN)
KTVEFLAMLI

SEQ ID NO: 77428 - protein, 10 aa, Artificial Sequence
  Description of Artificial Sequence: Synthetic peptide
  Seed: YTLDEKVDEL (MAGC1_HUMAN)
YMLDEKVDEV

SEQ ID NO: 77429 - protein, 11 aa, Artificial Sequence
  Description of Artificial Sequence: Synthetic peptide
  Seed: FLAMLKNTVPI (MAGC1_HUMAN)
FAAMLKNTVPV

SEQ ID NO: 77430 - protein, 9 aa, Artificial Sequence
  Description of Artificial Sequence: Synthetic peptide
  Seed: NTVPITFPS (MAGC1_HUMAN)
NIVPITFPR

SEQ ID NO: 77431 - protein, 9 aa, Artificial Sequence
  Description of Artificial Sequence: Synthetic peptide
  Seed: VIKRKVVEF (MAGC1_HUMAN)
VPKRKVVEA

SEQ ID NO: 77432 - protein, 9 aa, Artificial Sequence
  Description of Artificial Sequence: Synthetic peptide
  Seed: LSDEQGMSQ (MAGC1_HUMAN)
LNDEQGMSM

SEQ ID NO: 77433 - protein, 10 aa, Artificial Sequence
  Description of Artificial Sequence: Synthetic peptide
  Seed: REFIEILFGI (MAGC1_HUMAN)
RIFIEILFGM

SEQ ID NO: 77434 - protein, 10 aa, Artificial Sequence
  Description of Artificial Sequence: Synthetic peptide
  Seed: SSSSTLLSLF (MAGC1_HUMAN)
SNSSTLLSLF

SEQ ID NO: 77435 - protein, 11 aa, Artificial Sequence
  Description of Artificial Sequence: Synthetic peptide
  Seed: STFEGFPQSLL (MAGC1_HUMAN)
SLFEGFPQSLA

SEQ ID NO: 77436 - protein, 9 aa, Artificial Sequence
  Description of Artificial Sequence: Synthetic peptide
  Seed: KVWVQEHYL (MAGC1_HUMAN)
KQWVQEHYF

SEQ ID NO: 77437 - protein, 9 aa, Artificial Sequence
  Description of Artificial Sequence: Synthetic peptide
  Seed: RLLILILSI (MAGC1_HUMAN)
RALILILSV

SEQ ID NO: 77438 - protein, 9 aa, Artificial Sequence
  Description of Artificial Sequence: Synthetic peptide
  Seed: AQSPLQIPV (MAGC1_HUMAN)
AYSPLQIPF

SEQ ID NO: 77439 - protein, 10 aa, Artificial Sequence
  Description of Artificial Sequence: Synthetic peptide
  Seed: LLQIPMTSSF (MAGC1_HUMAN)
LWQIPMTSSF

SEQ ID NO: 77440 - protein, 10 aa, Artificial Sequence
  Description of Artificial Sequence: Synthetic peptide
  Seed: MPTAGMPSLL (MAGC1_HUMAN)
MDTAGMPSLW

SEQ ID NO: 77441 - protein, 9 aa, Artificial Sequence
  Description of Artificial Sequence: Synthetic peptide
  Seed: TTDDSTATE (MAGC1_HUMAN)
TSDDSTATL

SEQ ID NO: 77442 - protein, 9 aa, Artificial Sequence
  Description of Artificial Sequence: Synthetic peptide
  Seed: IFRKAREFI (MAGC1_HUMAN)
ISRKAREFV

SEQ ID NO: 77443 - protein, 9 aa, Artificial Sequence
  Description of Artificial Sequence: Synthetic peptide
  Seed: MLTNVISRY (MAGC1_HUMAN)
MTTNVISRL

SEQ ID NO: 77444 - protein, 10 aa, Artificial Sequence
  Description of Artificial Sequence: Synthetic peptide
  Seed: SSPERTHSTF (MAGC1_HUMAN)
SEPERTHSTL

SEQ ID NO: 77445 - protein, 10 aa, Artificial Sequence
  Description of Artificial Sequence: Synthetic peptide
  Seed: SSFSYTLLSL (MAGC1_HUMAN)
SVFSYTLLSM

SEQ ID NO: 77446 - protein, 9 aa, Artificial Sequence
  Description of Artificial Sequence: Synthetic peptide
  Seed: FSSALLSIF (MAGC1_HUMAN)
FWSALLSIL

SEQ ID NO: 77447 - protein, 9 aa, Artificial Sequence
  Description of Artificial Sequence: Synthetic peptide
  Seed: SPLEGEDSL (MAGC1_HUMAN)
SPLEGEDSF

SEQ ID NO: 77448 - protein, 11 aa, Artificial Sequence
  Description of Artificial Sequence: Synthetic peptide
  Seed: SSTPSSLPQSF (MAGC1_HUMAN)
SKTPSSLPQSY

SEQ ID NO: 77449 - protein, 8 aa, Artificial Sequence
  Description of Artificial Sequence: Synthetic peptide
  Seed: IWDVLSGI (MAGC1_HUMAN)
IWDVLSGL

SEQ ID NO: 77450 - protein, 9 aa, Artificial Sequence
  Description of Artificial Sequence: Synthetic peptide
  Seed: TLLSIFQSS (MAGC1_HUMAN)
TLLSIFQSI

SEQ ID NO: 77451 - protein, 11 aa, Artificial Sequence
  Description of Artificial Sequence: Synthetic peptide
  Seed: YTGYFPVIFRK (MAGC1_HUMAN)
YRGYFPVIFRR

SEQ ID NO: 77452 - protein, 9 aa, Artificial Sequence
  Description of Artificial Sequence: Synthetic peptide
  Seed: SSPESPLQS (MAGC1_HUMAN)
SPPESPLQM

SEQ ID NO: 77453 - protein, 9 aa, Artificial Sequence
  Description of Artificial Sequence: Synthetic peptide
  Seed: KAREFIEIL (MAGC1_HUMAN)
KAREFIEIV

SEQ ID NO: 77454 - protein, 9 aa, Artificial Sequence
  Description of Artificial Sequence: Synthetic peptide
  Seed: FEGFPQSLL (MAGC1_HUMAN)
FEGFPQSLA

SEQ ID NO: 77455 - protein, 10 aa, Artificial Sequence
  Description of Artificial Sequence: Synthetic peptide
  Seed: VRAGREHFAF (MAGC1_HUMAN)
VQAGREHFAY

SEQ ID NO: 77456 - protein, 9 aa, Artificial Sequence
  Description of Artificial Sequence: Synthetic peptide
  Seed: SPLEGEDSL (MAGC1_HUMAN)
SMLEGEDSY

SEQ ID NO: 77457 - protein, 10 aa, Artificial Sequence
  Description of Artificial Sequence: Synthetic peptide
  Seed: SPLQRPVSSF (MAGC1_HUMAN)
SMLQRPVSSM

SEQ ID NO: 77458 - protein, 9 aa, Artificial Sequence
  Description of Artificial Sequence: Synthetic peptide
  Seed: ASSFFSSAL (MAGC1_HUMAN)
AGSFFSSAY

SEQ ID NO: 77459 - protein, 9 aa, Artificial Sequence
  Description of Artificial Sequence: Synthetic peptide
  Seed: TLLSLFQSF (MAGC1_HUMAN)
TYLSLFQSV

SEQ ID NO: 77460 - protein, 10 aa, Artificial Sequence
  Description of Artificial Sequence: Synthetic peptide
  Seed: YTLASLLQSS (MAGC1_HUMAN)
YQLASLLQST

SEQ ID NO: 77461 - protein, 9 aa, Artificial Sequence
  Description of Artificial Sequence: Synthetic peptide
  Seed: LQRPVSSFF (MAGC1_HUMAN)
LHRPVSSFF

SEQ ID NO: 77462 - protein, 9 aa, Artificial Sequence
  Description of Artificial Sequence: Synthetic peptide
  Seed: KDSQSPLQI (MAGC1_HUMAN)
KLSQSPLQM

SEQ ID NO: 77463 - protein, 9 aa, Artificial Sequence
  Description of Artificial Sequence: Synthetic peptide
  Seed: KQPITKAEM (MAGC1_HUMAN)
KMPITKAEL

SEQ ID NO: 77464 - protein, 11 aa, Artificial Sequence
  Description of Artificial Sequence: Synthetic peptide
  Seed: SPLQIPVSSSS (MAGC1_HUMAN)
SHLQIPVSSSF

SEQ ID NO: 77465 - protein, 9 aa, Artificial Sequence
  Description of Artificial Sequence: Synthetic peptide
  Seed: RTQSTFEGF (MAGC1_HUMAN)
RTQSTFEGK

SEQ ID NO: 77466 - protein, 9 aa, Artificial Sequence
  Description of Artificial Sequence: Synthetic peptide
  Seed: SSPESAQSA (MAGC1_HUMAN)
SCPESAQSM

SEQ ID NO: 77467 - protein, 10 aa, Artificial Sequence
  Description of Artificial Sequence: Synthetic peptide
  Seed: TGYFPVIFRK (MAGC1_HUMAN)
TTYFPVIFRA

SEQ ID NO: 77468 - protein, 10 aa, Artificial Sequence
  Description of Artificial Sequence: Synthetic peptide
  Seed: PLQIPGSPSF (MAGC1_HUMAN)
PMQIPGSPSF

SEQ ID NO: 77469 - protein, 8 aa, Artificial Sequence
  Description of Artificial Sequence: Synthetic peptide
  Seed: SSFSSTLL (MAGC1_HUMAN)
SQFSSTLI

SEQ ID NO: 77470 - protein, 10 aa, Artificial Sequence
  Description of Artificial Sequence: Synthetic peptide
  Seed: SSSSSTLLSL (MAGC1_HUMAN)
SYSSSTLLSY

SEQ ID NO: 77471 - protein, 10 aa, Artificial Sequence
  Description of Artificial Sequence: Synthetic peptide
  Seed: ICSSSTPSSL (MAGC1_HUMAN)
INSSSTPSSW

SEQ ID NO: 77472 - protein, 10 aa, Artificial Sequence
  Description of Artificial Sequence: Synthetic peptide
  Seed: SSPERTQSTF (MAGC1_HUMAN)
SIPERTQSTM

SEQ ID NO: 77473 - protein, 9 aa, Artificial Sequence
  Description of Artificial Sequence: Synthetic peptide
  Seed: SSPECTQST (MAGC1_HUMAN)
SWPECTQSL

SEQ ID NO: 77474 - protein, 9 aa, Artificial Sequence
  Description of Artificial Sequence: Synthetic peptide
  Seed: FSSTLLSIL (MAGC1_HUMAN)
FSSTLLSIM

SEQ ID NO: 77475 - protein, 10 aa, Artificial Sequence
  Description of Artificial Sequence: Synthetic peptide
  Seed: EVIWDVLSGI (MAGC1_HUMAN)
EMIWDVLSGI

SEQ ID NO: 77476 - protein, 9 aa, Artificial Sequence
  Description of Artificial Sequence: Synthetic peptide
  Seed: SSPECTQST (MAGC1_HUMAN)
SVPECTQSM

SEQ ID NO: 77477 - protein, 9 aa, Artificial Sequence
  Description of Artificial Sequence: Synthetic peptide
  Seed: LQIVPSLPE (MAGC1_HUMAN)
LHIVPSLPF

SEQ ID NO: 77478 - protein, 9 aa, Artificial Sequence
  Description of Artificial Sequence: Synthetic peptide
  Seed: NTVPITFPS (MAGC1_HUMAN)
NAVPITFPT

SEQ ID NO: 77479 - protein, 9 aa, Artificial Sequence
  Description of Artificial Sequence: Synthetic peptide
  Seed: TLDEKVDEL (MAGC1_HUMAN)
TVDEKVDEF

SEQ ID NO: 77480 - protein, 9 aa, Artificial Sequence
  Description of Artificial Sequence: Synthetic peptide
  Seed: FSSTLLSLF (MAGC1_HUMAN)
FMSTLLSLV

SEQ ID NO: 77481 - protein, 10 aa, Artificial Sequence
  Description of Artificial Sequence: Synthetic peptide
  Seed: ISRYTGYFPV (MAGC1_HUMAN)
IMRYTGYFPI

SEQ ID NO: 77482 - protein, 9 aa, Artificial Sequence
  Description of Artificial Sequence: Synthetic peptide
  Seed: SSPECTQST (MAGC1_HUMAN)
SVPECTQSF

SEQ ID NO: 77483 - protein, 9 aa, Artificial Sequence
  Description of Artificial Sequence: Synthetic peptide
  Seed: SSPESTQSP (MAGC1_HUMAN)
SNPESTQSM

SEQ ID NO: 77484 - protein, 11 aa, Artificial Sequence
  Description of Artificial Sequence: Synthetic peptide
  Seed: SPLQIPVSPSS (MAGC1_HUMAN)
SELQIPVSPSY

SEQ ID NO: 77485 - protein, 9 aa, Artificial Sequence
  Description of Artificial Sequence: Synthetic peptide
  Seed: RLLILILSI (MAGC1_HUMAN)
RTLILILSY

SEQ ID NO: 77486 - protein, 11 aa, Artificial Sequence
  Description of Artificial Sequence: Synthetic peptide
  Seed: IPVSPSSSSTL (MAGC1_HUMAN)
IPVSPSSSSTY

SEQ ID NO: 77487 - protein, 9 aa, Artificial Sequence
  Description of Artificial Sequence: Synthetic peptide
  Seed: FSSTLVSLF (MAGC1_HUMAN)
FVSTLVSLV

SEQ ID NO: 77488 - protein, 9 aa, Artificial Sequence
  Description of Artificial Sequence: Synthetic peptide
  Seed: AQSPLQRPV (MAGC1_HUMAN)
ALSPLQRPI

SEQ ID NO: 77489 - protein, 9 aa, Artificial Sequence
  Description of Artificial Sequence: Synthetic peptide
  Seed: LQRPVSSFF (MAGC1_HUMAN)
LLRPVSSFW

SEQ ID NO: 77490 - protein, 10 aa, Artificial Sequence
  Description of Artificial Sequence: Synthetic peptide
  Seed: FQSSLQSPVS (MAGC1_HUMAN)
FTSSLQSPVV

SEQ ID NO: 77491 - protein, 10 aa, Artificial Sequence
  Description of Artificial Sequence: Synthetic peptide
  Seed: LQIPGSPSFS (MAGC1_HUMAN)
LMIPGSPSFD

SEQ ID NO: 77492 - protein, 10 aa, Artificial Sequence
  Description of Artificial Sequence: Synthetic peptide
  Seed: RKVVEFLAML (MAGC1_HUMAN)
RIVVEFLAMI

SEQ ID NO: 77493 - protein, 9 aa, Artificial Sequence
  Description of Artificial Sequence: Synthetic peptide
  Seed: SSPERTQST (MAGC1_HUMAN)
SYPERTQSL

SEQ ID NO: 77494 - protein, 9 aa, Artificial Sequence
  Description of Artificial Sequence: Synthetic peptide
  Seed: SPLEGEDSL (MAGC1_HUMAN)
SRLEGEDSL

SEQ ID NO: 77495 - protein, 9 aa, Artificial Sequence
  Description of Artificial Sequence: Synthetic peptide
  Seed: LQRPVSSFF (MAGC1_HUMAN)
LYRPVSSFA

SEQ ID NO: 77496 - protein, 9 aa, Artificial Sequence
  Description of Artificial Sequence: Synthetic peptide
  Seed: SPVDEYTSS (MAGC1_HUMAN)
SPVDEYTST

SEQ ID NO: 77497 - protein, 9 aa, Artificial Sequence
  Description of Artificial Sequence: Synthetic peptide
  Seed: SEVIKRKVV (MAGC1_HUMAN)
SEVIKRKVW

SEQ ID NO: 77498 - protein, 11 aa, Artificial Sequence
  Description of Artificial Sequence: Synthetic peptide
  Seed: SPLQIPGSPSF (MAGC1_HUMAN)
SLLQIPGSPSF

SEQ ID NO: 77499 - protein, 10 aa, Artificial Sequence
  Description of Artificial Sequence: Synthetic peptide
  Seed: VSRSFSSTLL (MAGC1_HUMAN)
VARSFSSTLK

SEQ ID NO: 77500 - protein, 10 aa, Artificial Sequence
  Description of Artificial Sequence: Synthetic peptide
  Seed: LSIIFIKGTY (MAGC1_HUMAN)
LTIIFIKGTF

SEQ ID NO: 77501 - protein, 10 aa, Artificial Sequence
  Description of Artificial Sequence: Synthetic peptide
  Seed: FQSSLQSPVS (MAGC1_HUMAN)
FISSLQSPVI

SEQ ID NO: 77502 - protein, 10 aa, Artificial Sequence
  Description of Artificial Sequence: Synthetic peptide
  Seed: QGEDSMSPLY (MAGC1_HUMAN)
QHEDSMSPLW

SEQ ID NO: 77503 - protein, 9 aa, Artificial Sequence
  Description of Artificial Sequence: Synthetic peptide
  Seed: YPLQSPQSR (MAGC1_HUMAN)
YPLQSPQSF

SEQ ID NO: 77504 - protein, 10 aa, Artificial Sequence
  Description of Artificial Sequence: Synthetic peptide
  Seed: STPSSLPQSF (MAGC1_HUMAN)
SAPSSLPQSW

SEQ ID NO: 77505 - protein, 9 aa, Artificial Sequence
  Description of Artificial Sequence: Synthetic peptide
  Seed: TLDEKVDEL (MAGC1_HUMAN)
TTDEKVDEF

SEQ ID NO: 77506 - protein, 10 aa, Artificial Sequence
  Description of Artificial Sequence: Synthetic peptide
  Seed: LQIPVSPSFS (MAGC1_HUMAN)
LQIPVSPSFR

SEQ ID NO: 77507 - protein, 9 aa, Artificial Sequence
  Description of Artificial Sequence: Synthetic peptide
  Seed: FSEESSSPV (MAGC1_HUMAN)
FVEESSSPM

SEQ ID NO: 77508 - protein, 11 aa, Artificial Sequence
  Description of Artificial Sequence: Synthetic peptide
  Seed: SPLQIPGSPSF (MAGC1_HUMAN)
SVLQIPGSPSM

SEQ ID NO: 77509 - protein, 9 aa, Artificial Sequence
  Description of Artificial Sequence: Synthetic peptide
  Seed: FQSSLQSPV (MAGC1_HUMAN)
FHSSLQSPF

SEQ ID NO: 77510 - protein, 10 aa, Artificial Sequence
  Description of Artificial Sequence: Synthetic peptide
  Seed: SLFQSSPERT (MAGC1_HUMAN)
SMFQSSPERV

SEQ ID NO: 77511 - protein, 9 aa, Artificial Sequence
  Description of Artificial Sequence: Synthetic peptide
  Seed: ESDDTLYPL (MAGC1_HUMAN)
ELDDTLYPL

SEQ ID NO: 77512 - protein, 9 aa, Artificial Sequence
  Description of Artificial Sequence: Synthetic peptide
  Seed: TFEGFPQSL (MAGC1_HUMAN)
TVEGFPQSI

SEQ ID NO: 77513 - protein, 10 aa, Artificial Sequence
  Description of Artificial Sequence: Synthetic peptide
  Seed: SPLQRPVSSF (MAGC1_HUMAN)
SQLQRPVSSY

SEQ ID NO: 77514 - protein, 9 aa, Artificial Sequence
  Description of Artificial Sequence: Synthetic peptide
  Seed: ESSSPVDEY (MAGC1_HUMAN)
ETSSPVDEW

SEQ ID NO: 77515 - protein, 9 aa, Artificial Sequence
  Description of Artificial Sequence: Synthetic peptide
  Seed: SLTDSESLI (MAGC1_HUMAN)
STTDSESLL

SEQ ID NO: 77516 - protein, 9 aa, Artificial Sequence
  Description of Artificial Sequence: Synthetic peptide
  Seed: AQSPLQRPV (MAGC1_HUMAN)
AVSPLQRPV

SEQ ID NO: 77517 - protein, 10 aa, Artificial Sequence
  Description of Artificial Sequence: Synthetic peptide
  Seed: LQIPMTSSFS (MAGC1_HUMAN)
LTIPMTSSFY

SEQ ID NO: 77518 - protein, 11 aa, Artificial Sequence
  Description of Artificial Sequence: Synthetic peptide
  Seed: KDMPTAGMPSL (MAGC1_HUMAN)
KEMPTAGMPSA

SEQ ID NO: 77519 - protein, 9 aa, Artificial Sequence
  Description of Artificial Sequence: Synthetic peptide
  Seed: FPSSYKDAL (MAGC1_HUMAN)
FRSSYKDAL

SEQ ID NO: 77520 - protein, 11 aa, Artificial Sequence
  Description of Artificial Sequence: Synthetic peptide
  Seed: LLQIPMTSSFS (MAGC1_HUMAN)
LRQIPMTSSFF

SEQ ID NO: 77521 - protein, 11 aa, Artificial Sequence
  Description of Artificial Sequence: Synthetic peptide
  Seed: IPVSSSFSYTL (MAGC1_HUMAN)
IPVSSSFSYTA

SEQ ID NO: 77522 - protein, 11 aa, Artificial Sequence
  Description of Artificial Sequence: Synthetic peptide
  Seed: SSFSYTLLSLF (MAGC1_HUMAN)
SQFSYTLLSLW

SEQ ID NO: 77523 - protein, 9 aa, Artificial Sequence
  Description of Artificial Sequence: Synthetic peptide
  Seed: AGREHFAFG (MAGC1_HUMAN)
AVREHFAFK

SEQ ID NO: 77524 - protein, 11 aa, Artificial Sequence
  Description of Artificial Sequence: Synthetic peptide
  Seed: VISRYTGYFPV (MAGC1_HUMAN)
VLSRYTGYFPL

SEQ ID NO: 77525 - protein, 9 aa, Artificial Sequence
  Description of Artificial Sequence: Synthetic peptide
  Seed: ILILSIIFI (MAGC1_HUMAN)
IQILSIIFI

SEQ ID NO: 77526 - protein, 11 aa, Artificial Sequence
  Description of Artificial Sequence: Synthetic peptide
  Seed: IPVSAASSSTL (MAGC1_HUMAN)
IPVSAASSSTY

SEQ ID NO: 77527 - protein, 9 aa, Artificial Sequence
  Description of Artificial Sequence: Synthetic peptide
  Seed: SSFPSSTSS (MAGC1_HUMAN)
STFPSSTSY

SEQ ID NO: 77528 - protein, 9 aa, Artificial Sequence
  Description of Artificial Sequence: Synthetic peptide
  Seed: GFPQSVLQI (MAGC1_HUMAN)
GQPQSVLQL

SEQ ID NO: 77529 - protein, 10 aa, Artificial Sequence
  Description of Artificial Sequence: Synthetic peptide
  Seed: YTGYFPVIFR (MAGC1_HUMAN)
YFGYFPVIFR

SEQ ID NO: 77530 - protein, 10 aa, Artificial Sequence
  Description of Artificial Sequence: Synthetic peptide
  Seed: WGPRAHSEVI (MAGC1_HUMAN)
WCPRAHSEVM

SEQ ID NO: 77531 - protein, 9 aa, Artificial Sequence
  Description of Artificial Sequence: Synthetic peptide
  Seed: SQSSPVSSF (MAGC1_HUMAN)
SMSSPVSSM

SEQ ID NO: 77532 - protein, 9 aa, Artificial Sequence
  Description of Artificial Sequence: Synthetic peptide
  Seed: SLIESEPLF (MAGC1_HUMAN)
SVIESEPLV

SEQ ID NO: 77533 - protein, 9 aa, Artificial Sequence
  Description of Artificial Sequence: Synthetic peptide
  Seed: ASEEVIWDV (MAGC1_HUMAN)
AVEEVIWDV

SEQ ID NO: 77534 - protein, 10 aa, Artificial Sequence
  Description of Artificial Sequence: Synthetic peptide
  Seed: YTLDEKVDEL (MAGC1_HUMAN)
YRLDEKVDEI

SEQ ID NO: 77535 - protein, 9 aa, Artificial Sequence
  Description of Artificial Sequence: Synthetic peptide
  Seed: TFEGFPQSL (MAGC1_HUMAN)
TWEGFPQSF

SEQ ID NO: 77536 - protein, 11 aa, Artificial Sequence
  Description of Artificial Sequence: Synthetic peptide
  Seed: IPVSSSSSSTL (MAGC1_HUMAN)
IQVSSSSSSTW

SEQ ID NO: 77537 - protein, 10 aa, Artificial Sequence
  Description of Artificial Sequence: Synthetic peptide
  Seed: FPQSLLQIPM (MAGC1_HUMAN)
FVQSLLQIPF

SEQ ID NO: 77538 - protein, 9 aa, Artificial Sequence
  Description of Artificial Sequence: Synthetic peptide
  Seed: VSPSFSSTL (MAGC1_HUMAN)
VFPSFSSTL

SEQ ID NO: 77539 - protein, 8 aa, Artificial Sequence
  Description of Artificial Sequence: Synthetic peptide
  Seed: ITFPSSYK (MAGC1_HUMAN)
IMFPSSYK

SEQ ID NO: 77540 - protein, 10 aa, Artificial Sequence
  Description of Artificial Sequence: Synthetic peptide
  Seed: REVDPDDSYV (MAGC1_HUMAN)
RQVDPDDSYW

SEQ ID NO: 77541 - protein, 10 aa, Artificial Sequence
  Description of Artificial Sequence: Synthetic peptide
  Seed: FAFGEPRELL (MAGC1_HUMAN)
FMFGEPRELT

SEQ ID NO: 77542 - protein, 9 aa, Artificial Sequence
  Description of Artificial Sequence: Synthetic peptide
  Seed: SSTSSSLSK (MAGC1_HUMAN)
SQTSSSLSK

SEQ ID NO: 77543 - protein, 9 aa, Artificial Sequence
  Description of Artificial Sequence: Synthetic peptide
  Seed: VSSSSSSTL (MAGC1_HUMAN)
VQSSSSSTV

SEQ ID NO: 77544 - protein, 9 aa, Artificial Sequence
  Description of Artificial Sequence: Synthetic peptide
  Seed: YTLLSLFQS (MAGC1_HUMAN)
YMLLSLFQA

SEQ ID NO: 77545 - protein, 9 aa, Artificial Sequence
  Description of Artificial Sequence: Synthetic peptide
  Seed: TPSSLPQSF (MAGC1_HUMAN)
TVSSLPQSY

SEQ ID NO: 77546 - protein, 9 aa, Artificial Sequence
  Description of Artificial Sequence: Synthetic peptide
  Seed: FSSALLSIF (MAGC1_HUMAN)
FNSALLSIF

SEQ ID NO: 77547 - protein, 10 aa, Artificial Sequence
  Description of Artificial Sequence: Synthetic peptide
  Seed: LQIPVSSSFS (MAGC1_HUMAN)
LQIPVSSSFA

SEQ ID NO: 77548 - protein, 10 aa, Artificial Sequence
  Description of Artificial Sequence: Synthetic peptide
  Seed: QGEDSMSPLY (MAGC1_HUMAN)
QGEDSMSPLW

SEQ ID NO: 77549 - protein, 9 aa, Artificial Sequence
  Description of Artificial Sequence: Synthetic peptide
  Seed: FEGFPQSVL (MAGC1_HUMAN)
FEGFPQSVW

SEQ ID NO: 77550 - protein, 11 aa, Artificial Sequence
  Description of Artificial Sequence: Synthetic peptide
  Seed: SSFPSSTSSSL (MAGC1_HUMAN)
SLFPSSTSSSV

SEQ ID NO: 77551 - protein, 10 aa, Artificial Sequence
  Description of Artificial Sequence: Synthetic peptide
  Seed: LSQSSPVSSF (MAGC1_HUMAN)
LEQSSPVSSY

SEQ ID NO: 77552 - protein, 9 aa, Artificial Sequence
  Description of Artificial Sequence: Synthetic peptide
  Seed: FEGFAQSPL (MAGC1_HUMAN)
FMGFAQSPY

SEQ ID NO: 77553 - protein, 10 aa, Artificial Sequence
  Description of Artificial Sequence: Synthetic peptide
  Seed: IIDTTDDSTA (MAGC1_HUMAN)
IIDTTDDSTF

SEQ ID NO: 77554 - protein, 9 aa, Artificial Sequence
  Description of Artificial Sequence: Synthetic peptide
  Seed: VSSFFSYTL (MAGC1_HUMAN)
VMSFFSYTW

SEQ ID NO: 77555 - protein, 9 aa, Artificial Sequence
  Description of Artificial Sequence: Synthetic peptide
  Seed: FSYTLASLL (MAGC1_HUMAN)
FCYTLASLW

SEQ ID NO: 77556 - protein, 9 aa, Artificial Sequence
  Description of Artificial Sequence: Synthetic peptide
  Seed: KVWVQEHYL (MAGC1_HUMAN)
KTWVQEHYM

SEQ ID NO: 77557 - protein, 9 aa, Artificial Sequence
  Description of Artificial Sequence: Synthetic peptide
  Seed: VSSSFSYTL (MAGC1_HUMAN)
VHSSFSYTM

SEQ ID NO: 77558 - protein, 10 aa, Artificial Sequence
  Description of Artificial Sequence: Synthetic peptide
  Seed: RFLLLKYQVK (MAGC1_HUMAN)
RVLLLKYQVR

SEQ ID NO: 77559 - protein, 11 aa, Artificial Sequence
  Description of Artificial Sequence: Synthetic peptide
  Seed: QSSPESAQSTF (MAGC1_HUMAN)
QQSPESAQSTF

SEQ ID NO: 77560 - protein, 9 aa, Artificial Sequence
  Description of Artificial Sequence: Synthetic peptide
  Seed: SLTDSESLI (MAGC1_HUMAN)
SVTDSESLV

SEQ ID NO: 77561 - protein, 10 aa, Artificial Sequence
  Description of Artificial Sequence: Synthetic peptide
  Seed: ASSSTLVSIF (MAGC1_HUMAN)
AMSSTLVSIW

SEQ ID NO: 77562 - protein, 10 aa, Artificial Sequence
  Description of Artificial Sequence: Synthetic peptide
  Seed: SFFSSALLSI (MAGC1_HUMAN)
SQFSSALLSF

SEQ ID NO: 77563 - protein, 11 aa, Artificial Sequence
  Description of Artificial Sequence: Synthetic peptide
  Seed: FLAMLKNTVPI (MAGC1_HUMAN)
FDAMLKNTVPL

SEQ ID NO: 77564 - protein, 10 aa, Artificial Sequence
  Description of Artificial Sequence: Synthetic peptide
  Seed: MLKNTVPITF (MAGC1_HUMAN)
MIKNTVPITF

SEQ ID NO: 77565 - protein, 9 aa, Artificial Sequence
  Description of Artificial Sequence: Synthetic peptide
  Seed: LQIPVSPSF (MAGC1_HUMAN)
LLIPVSPSV

SEQ ID NO: 77566 - protein, 9 aa, Artificial Sequence
  Description of Artificial Sequence: Synthetic peptide
  Seed: VSRSFSSTL (MAGC1_HUMAN)
VMRSFSSTM

SEQ ID NO: 77567 - protein, 9 aa, Artificial Sequence
  Description of Artificial Sequence: Synthetic peptide
  Seed: QGEEFQSSL (MAGC1_HUMAN)
QAEEFQSSL

SEQ ID NO: 77568 - protein, 9 aa, Artificial Sequence
  Description of Artificial Sequence: Synthetic peptide
  Seed: LPQSFPESS (MAGC1_HUMAN)
LPQSFPESA

SEQ ID NO: 77569 - protein, 9 aa, Artificial Sequence
  Description of Artificial Sequence: Synthetic peptide
  Seed: SSSSSSSTL (MAGC1_HUMAN)
SISSSSSTY

SEQ ID NO: 77570 - protein, 10 aa, Artificial Sequence
  Description of Artificial Sequence: Synthetic peptide
  Seed: MPTAGMPSLL (MAGC1_HUMAN)
MLTAGMPSLY

SEQ ID NO: 77571 - protein, 11 aa, Artificial Sequence
  Description of Artificial Sequence: Synthetic peptide
  Seed: STFEGFPQSLL (MAGC1_HUMAN)
SMFEGFPQSLI

SEQ ID NO: 77572 - protein, 9 aa, Artificial Sequence
  Description of Artificial Sequence: Synthetic peptide
  Seed: FFSYTLASL (MAGC1_HUMAN)
FYSYTLASI

SEQ ID NO: 77573 - protein, 10 aa, Artificial Sequence
  Description of Artificial Sequence: Synthetic peptide
  Seed: SSFPSSTSSS (MAGC1_HUMAN)
SAFPSSTSSM

SEQ ID NO: 77574 - protein, 8 aa, Artificial Sequence
  Description of Artificial Sequence: Synthetic peptide
  Seed: SSFFSSAL (MAGC1_HUMAN)
SMFFSSAM

SEQ ID NO: 77575 - protein, 10 aa, Artificial Sequence
  Description of Artificial Sequence: Synthetic peptide
  Seed: EILFGISLRE (MAGC1_HUMAN)
EKLFGISLRK

SEQ ID NO: 77576 - protein, 10 aa, Artificial Sequence
  Description of Artificial Sequence: Synthetic peptide
  Seed: RAGREHFAFG (MAGC1_HUMAN)
RIGREHFAFL

SEQ ID NO: 77577 - protein, 10 aa, Artificial Sequence
  Description of Artificial Sequence: Synthetic peptide
  Seed: SPLYFPQSPL (MAGC1_HUMAN)
SQLYFPQSPV

SEQ ID NO: 77578 - protein, 9 aa, Artificial Sequence
  Description of Artificial Sequence: Synthetic peptide
  Seed: ISFSSSTSL (MAGC1_HUMAN)
IMFSSSTSM

SEQ ID NO: 77579 - protein, 9 aa, Artificial Sequence
  Description of Artificial Sequence: Synthetic peptide
  Seed: YVFVNTLDL (MAGC1_HUMAN)
YMFVNTLDT

SEQ ID NO: 77580 - protein, 10 aa, Artificial Sequence
  Description of Artificial Sequence: Synthetic peptide
  Seed: EVPNSSPPRY (MAGC1_HUMAN)
EIPNSSPPRK

SEQ ID NO: 77581 - protein, 9 aa, Artificial Sequence
  Description of Artificial Sequence: Synthetic peptide
  Seed: SPLQIVPSL (MAGC1_HUMAN)
SLLQIVPSF

SEQ ID NO: 77582 - protein, 9 aa, Artificial Sequence
  Description of Artificial Sequence: Synthetic peptide
  Seed: SQSPPEGPV (MAGC1_HUMAN)
SISPPEGPY

SEQ ID NO: 77583 - protein, 10 aa, Artificial Sequence
  Description of Artificial Sequence: Synthetic peptide
  Seed: FPQSLLQIPM (MAGC1_HUMAN)
FCQSLLQIPV

SEQ ID NO: 77584 - protein, 10 aa, Artificial Sequence
  Description of Artificial Sequence: Synthetic peptide
  Seed: FFSYTLASLL (MAGC1_HUMAN)
FYSYTLASLL

SEQ ID NO: 77585 - protein, 10 aa, Artificial Sequence
  Description of Artificial Sequence: Synthetic peptide
  Seed: FFSYTLASLL (MAGC1_HUMAN)
FISYTLASLI

SEQ ID NO: 77586 - protein, 10 aa, Artificial Sequence
  Description of Artificial Sequence: Synthetic peptide
  Seed: FFSYTLASLL (MAGC1_HUMAN)
FLSYTLASLP

SEQ ID NO: 77587 - protein, 9 aa, Artificial Sequence
  Description of Artificial Sequence: Synthetic peptide
  Seed: AQSPLQRPV (MAGC1_HUMAN)
ALSPLQRPL

SEQ ID NO: 77588 - protein, 10 aa, Artificial Sequence
  Description of Artificial Sequence: Synthetic peptide
  Seed: TGYFPVIFRK (MAGC1_HUMAN)
TVYFPVIFRF

SEQ ID NO: 77589 - protein, 9 aa, Artificial Sequence
  Description of Artificial Sequence: Synthetic peptide
  Seed: SQSSPVSSF (MAGC1_HUMAN)
SASSPVSSH

SEQ ID NO: 77590 - protein, 9 aa, Artificial Sequence
  Description of Artificial Sequence: Synthetic peptide
  Seed: SLFQSFSER (MAGC1_HUMAN)
SGFQSFSEF

SEQ ID NO: 77591 - protein, 9 aa, Artificial Sequence
  Description of Artificial Sequence: Synthetic peptide
  Seed: SSTSSSLSK (MAGC1_HUMAN)
SATSSSLSM

SEQ ID NO: 77592 - protein, 10 aa, Artificial Sequence
  Description of Artificial Sequence: Synthetic peptide
  Seed: RAGREHFAFG (MAGC1_HUMAN)
RDGREHFAFA

SEQ ID NO: 77593 - protein, 9 aa, Artificial Sequence
  Description of Artificial Sequence: Synthetic peptide
  Seed: TTDDSTATE (MAGC1_HUMAN)
TWDDSTATF

SEQ ID NO: 77594 - protein, 11 aa, Artificial Sequence
  Description of Artificial Sequence: Synthetic peptide
  Seed: SSFFSSALLSI (MAGC1_HUMAN)
SSFFSSALLSY

SEQ ID NO: 77595 - protein, 9 aa, Artificial Sequence
  Description of Artificial Sequence: Synthetic peptide
  Seed: TLASLLQSS (MAGC1_HUMAN)
TLASLLQSM

SEQ ID NO: 77596 - protein, 11 aa, Artificial Sequence
  Description of Artificial Sequence: Synthetic peptide
  Seed: AASSSTLVSIF (MAGC1_HUMAN)
AASSSTLVSIY

SEQ ID NO: 77597 - protein, 10 aa, Artificial Sequence
  Description of Artificial Sequence: Synthetic peptide
  Seed: VSPSSSSTLL (MAGC1_HUMAN)
VSPSSSSTLF

SEQ ID NO: 77598 - protein, 11 aa, Artificial Sequence
  Description of Artificial Sequence: Synthetic peptide
  Seed: FLAMLKNTVPI (MAGC1_HUMAN)
FVAMLKNTVPL

SEQ ID NO: 77599 - protein, 10 aa, Artificial Sequence
  Description of Artificial Sequence: Synthetic peptide
  Seed: TLDEKVDELA (MAGC1_HUMAN)
TIDEKVDELF

SEQ ID NO: 77600 - protein, 10 aa, Artificial Sequence
  Description of Artificial Sequence: Synthetic peptide
  Seed: RYTGYFPVIF (MAGC1_HUMAN)
RWTGYFPVIW

SEQ ID NO: 77601 - protein, 10 aa, Artificial Sequence
  Description of Artificial Sequence: Synthetic peptide
  Seed: QGEDSMSPLY (MAGC1_HUMAN)
QVEDSMSPLY

SEQ ID NO: 77602 - protein, 10 aa, Artificial Sequence
  Description of Artificial Sequence: Synthetic peptide
  Seed: TLDEKVDELA (MAGC1_HUMAN)
TLDEKVDELF

SEQ ID NO: 77603 - protein, 11 aa, Artificial Sequence
  Description of Artificial Sequence: Synthetic peptide
  Seed: IPVSSSSSSTL (MAGC1_HUMAN)
IMVSSSSSSTF

SEQ ID NO: 77604 - protein, 9 aa, Artificial Sequence
  Description of Artificial Sequence: Synthetic peptide
  Seed: TGYFPVIFR (MAGC1_HUMAN)
TLYFPVIFR

SEQ ID NO: 77605 - protein, 9 aa, Artificial Sequence
  Description of Artificial Sequence: Synthetic peptide
  Seed: FFSYTLASL (MAGC1_HUMAN)
FASYTLASA

SEQ ID NO: 77606 - protein, 9 aa, Artificial Sequence
  Description of Artificial Sequence: Synthetic peptide
  Seed: REVDPDDSY (MAGC1_HUMAN)
RVVDPDDSW

SEQ ID NO: 77607 - protein, 9 aa, Artificial Sequence
  Description of Artificial Sequence: Synthetic peptide
  Seed: SRYTGYFPV (MAGC1_HUMAN)
SLYTGYFPY

SEQ ID NO: 77608 - protein, 9 aa, Artificial Sequence
  Description of Artificial Sequence: Synthetic peptide
  Seed: LQIPMTSSF (MAGC1_HUMAN)
LRIPMTSSF

SEQ ID NO: 77609 - protein, 9 aa, Artificial Sequence
  Description of Artificial Sequence: Synthetic peptide
  Seed: SLSPFSEES (MAGC1_HUMAN)
SSSPFSEEV

SEQ ID NO: 77610 - protein, 9 aa, Artificial Sequence
  Description of Artificial Sequence: Synthetic peptide
  Seed: SSSSTLLSL (MAGC1_HUMAN)
SVSSTLLSL

SEQ ID NO: 77611 - protein, 10 aa, Artificial Sequence
  Description of Artificial Sequence: Synthetic peptide
  Seed: SSFSSTLLSI (MAGC1_HUMAN)
STFSSTLLSW

SEQ ID NO: 77612 - protein, 9 aa, Artificial Sequence
  Description of Artificial Sequence: Synthetic peptide
  Seed: VSPSFSSTL (MAGC1_HUMAN)
VSPSFSSTY

SEQ ID NO: 77613 - protein, 9 aa, Artificial Sequence
  Description of Artificial Sequence: Synthetic peptide
  Seed: REVPNSSPP (MAGC1_HUMAN)
REVPNSSPT

SEQ ID NO: 77614 - protein, 9 aa, Artificial Sequence
  Description of Artificial Sequence: Synthetic peptide
  Seed: FSSTLLSIL (MAGC1_HUMAN)
FGSTLLSIY

SEQ ID NO: 77615 - protein, 9 aa, Artificial Sequence
  Description of Artificial Sequence: Synthetic peptide
  Seed: FSYTLASLL (MAGC1_HUMAN)
FLYTLASLT

SEQ ID NO: 77616 - protein, 9 aa, Artificial Sequence
  Description of Artificial Sequence: Synthetic peptide
  Seed: FSSTLLSLF (MAGC1_HUMAN)
FISTLLSLY

SEQ ID NO: 77617 - protein, 11 aa, Artificial Sequence
  Description of Artificial Sequence: Synthetic peptide
  Seed: IPVSSSSSSTL (MAGC1_HUMAN)
ICVSSSSSSTW

SEQ ID NO: 77618 - protein, 10 aa, Artificial Sequence
  Description of Artificial Sequence: Synthetic peptide
  Seed: STLLSLFQSF (MAGC1_HUMAN)
SPLLSLFQSY

SEQ ID NO: 77619 - protein, 10 aa, Artificial Sequence
  Description of Artificial Sequence: Synthetic peptide
  Seed: FAQSSLQIPV (MAGC1_HUMAN)
FDQSSLQIPI

SEQ ID NO: 77620 - protein, 11 aa, Artificial Sequence
  Description of Artificial Sequence: Synthetic peptide
  Seed: SICSSSTPSSL (MAGC1_HUMAN)
SVCSSSTPSSY

SEQ ID NO: 77621 - protein, 10 aa, Artificial Sequence
  Description of Artificial Sequence: Synthetic peptide
  Seed: LILILSIIFI (MAGC1_HUMAN)
LCLILSIIFV

SEQ ID NO: 77622 - protein, 10 aa, Artificial Sequence
  Description of Artificial Sequence: Synthetic peptide
  Seed: SFSSTLVSLF (MAGC1_HUMAN)
SPSSTLVSLW

SEQ ID NO: 77623 - protein, 10 aa, Artificial Sequence
  Description of Artificial Sequence: Synthetic peptide
  Seed: LQIPVSRSFS (MAGC1_HUMAN)
LKIPVSRSFM

SEQ ID NO: 77624 - protein, 9 aa, Artificial Sequence
  Description of Artificial Sequence: Synthetic peptide
  Seed: KVDELARFL (MAGC1_HUMAN)
KFDELARFF

SEQ ID NO: 77625 - protein, 10 aa, Artificial Sequence
  Description of Artificial Sequence: Synthetic peptide
  Seed: VSSSFSYTLL (MAGC1_HUMAN)
VKSSFSYTLF

SEQ ID NO: 77626 - protein, 10 aa, Artificial Sequence
  Description of Artificial Sequence: Synthetic peptide
  Seed: LAMLKNTVPI (MAGC1_HUMAN)
LYMLKNTVPM

SEQ ID NO: 77627 - protein, 9 aa, Artificial Sequence
  Description of Artificial Sequence: Synthetic peptide
  Seed: SEPLFTYTL (MAGC1_HUMAN)
SRPLFTYTL

SEQ ID NO: 77628 - protein, 10 aa, Artificial Sequence
  Description of Artificial Sequence: Synthetic peptide
  Seed: SFSSTLVSLF (MAGC1_HUMAN)
SNSSTLVSLF

SEQ ID NO: 77629 - protein, 10 aa, Artificial Sequence
  Description of Artificial Sequence: Synthetic peptide
  Seed: VRAGREHFAF (MAGC1_HUMAN)
VKAGREHFAY

SEQ ID NO: 77630 - protein, 9 aa, Artificial Sequence
  Description of Artificial Sequence: Synthetic peptide
  Seed: VSRSFSSTL (MAGC1_HUMAN)
VSRSFSSTS

SEQ ID NO: 77631 - protein, 9 aa, Artificial Sequence
  Description of Artificial Sequence: Synthetic peptide
  Seed: AQSSLQIPV (MAGC1_HUMAN)
AMSSLQIPF

SEQ ID NO: 77632 - protein, 11 aa, Artificial Sequence
  Description of Artificial Sequence: Synthetic peptide
  Seed: SFFSYTLASLL (MAGC1_HUMAN)
SSFSYTLASLW

SEQ ID NO: 77633 - protein, 10 aa, Artificial Sequence
  Description of Artificial Sequence: Synthetic peptide
  Seed: MTSSFSSTLL (MAGC1_HUMAN)
MKSSFSSTLV

SEQ ID NO: 77634 - protein, 10 aa, Artificial Sequence
  Description of Artificial Sequence: Synthetic peptide
  Seed: EVIWDVLSGI (MAGC1_HUMAN)
ELIWDVLSGI

SEQ ID NO: 77635 - protein, 10 aa, Artificial Sequence
  Description of Artificial Sequence: Synthetic peptide
  Seed: PLQIPGSPSF (MAGC1_HUMAN)
PFQIPGSPSF

SEQ ID NO: 77636 - protein, 9 aa, Artificial Sequence
  Description of Artificial Sequence: Synthetic peptide
  Seed: FLAMLKNTV (MAGC1_HUMAN)
FSAMLKNTL

SEQ ID NO: 77637 - protein, 10 aa, Artificial Sequence
  Description of Artificial Sequence: Synthetic peptide
  Seed: WGPRAHSEVI (MAGC1_HUMAN)
WYPRAHSEVV

SEQ ID NO: 77638 - protein, 10 aa, Artificial Sequence
  Description of Artificial Sequence: Synthetic peptide
  Seed: YTLASLLQSS (MAGC1_HUMAN)
YGLASLLQSL

SEQ ID NO: 77639 - protein, 9 aa, Artificial Sequence
  Description of Artificial Sequence: Synthetic peptide
  Seed: KAREFIEIL (MAGC1_HUMAN)
KYREFIEIY

SEQ ID NO: 77640 - protein, 9 aa, Artificial Sequence
  Description of Artificial Sequence: Synthetic peptide
  Seed: CTQSTFEGF (MAGC1_HUMAN)
CYQSTFEGW

SEQ ID NO: 77641 - protein, 10 aa, Artificial Sequence
  Description of Artificial Sequence: Synthetic peptide
  Seed: GENTHSPLQI (MAGC1_HUMAN)
GENTHSPLQA

SEQ ID NO: 77642 - protein, 9 aa, Artificial Sequence
  Description of Artificial Sequence: Synthetic peptide
  Seed: SPPRYEFLW (MAGC1_HUMAN)
SSPRYEFLW

SEQ ID NO: 77643 - protein, 10 aa, Artificial Sequence
  Description of Artificial Sequence: Synthetic peptide
  Seed: SPQSPPEGPA (MAGC1_HUMAN)
SPQSPPEGPL

SEQ ID NO: 77644 - protein, 9 aa, Artificial Sequence
  Description of Artificial Sequence: Synthetic peptide
  Seed: FTYTLDEKV (MAGC1_HUMAN)
FVYTLDEKA

SEQ ID NO: 77645 - protein, 9 aa, Artificial Sequence
  Description of Artificial Sequence: Synthetic peptide
  Seed: STFEGFPQS (MAGC1_HUMAN)
SAFEGFPQF

SEQ ID NO: 77646 - protein, 10 aa, Artificial Sequence
  Description of Artificial Sequence: Synthetic peptide
  Seed: YTLDEKVDEL (MAGC1_HUMAN)
YPLDEKVDEV

SEQ ID NO: 77647 - protein, 9 aa, Artificial Sequence
  Description of Artificial Sequence: Synthetic peptide
  Seed: FPSSTSSSL (MAGC1_HUMAN)
FPSSTSSSV

SEQ ID NO: 77648 - protein, 10 aa, Artificial Sequence
  Description of Artificial Sequence: Synthetic peptide
  Seed: NSSPPRYEFL (MAGC1_HUMAN)
NTSPPRYEFI

SEQ ID NO: 77649 - protein, 9 aa, Artificial Sequence
  Description of Artificial Sequence: Synthetic peptide
  Seed: FSSTLLSLF (MAGC1_HUMAN)
FLSTLLSLI

SEQ ID NO: 77650 - protein, 9 aa, Artificial Sequence
  Description of Artificial Sequence: Synthetic peptide
  Seed: KVVEFLAML (MAGC1_HUMAN)
KMVEFLAMK

SEQ ID NO: 77651 - protein, 10 aa, Artificial Sequence
  Description of Artificial Sequence: Synthetic peptide
  Seed: VSSSSSSSTL (MAGC1_HUMAN)
VRSSSSSSTY

SEQ ID NO: 77652 - protein, 9 aa, Artificial Sequence
  Description of Artificial Sequence: Synthetic peptide
  Seed: SVLQIPVSA (MAGC1_HUMAN)
SPLQIPVSM

SEQ ID NO: 77653 - protein, 10 aa, Artificial Sequence
  Description of Artificial Sequence: Synthetic peptide
  Seed: LAMLKNTVPI (MAGC1_HUMAN)
LYMLKNTVPI

SEQ ID NO: 77654 - protein, 9 aa, Artificial Sequence
  Description of Artificial Sequence: Synthetic peptide
  Seed: SSFSYTLLS (MAGC1_HUMAN)
SYFSYTLLK

SEQ ID NO: 77655 - protein, 9 aa, Artificial Sequence
  Description of Artificial Sequence: Synthetic peptide
  Seed: VPITFPSSY (MAGC1_HUMAN)
VYITFPSSM

SEQ ID NO: 77656 - protein, 10 aa, Artificial Sequence
  Description of Artificial Sequence: Synthetic peptide
  Seed: LQIPMTSSFS (MAGC1_HUMAN)
LMIPMTSSFN

SEQ ID NO: 77657 - protein, 9 aa, Artificial Sequence
  Description of Artificial Sequence: Synthetic peptide
  Seed: SPLQSPESA (MAGC1_HUMAN)
SPLQSPEST

SEQ ID NO: 77658 - protein, 10 aa, Artificial Sequence
  Description of Artificial Sequence: Synthetic peptide
  Seed: ICSSSTSLSL (MAGC1_HUMAN)
ITSSSTSLSW

SEQ ID NO: 77659 - protein, 11 aa, Artificial Sequence
  Description of Artificial Sequence: Synthetic peptide
  Seed: RPVSSFFSYTL (MAGC1_HUMAN)
RSVSSFFSYTW

SEQ ID NO: 77660 - protein, 9 aa, Artificial Sequence
  Description of Artificial Sequence: Synthetic peptide
  Seed: SSSTLLSLF (MAGC1_HUMAN)
SMSTLLSLY

SEQ ID NO: 77661 - protein, 9 aa, Artificial Sequence
  Description of Artificial Sequence: Synthetic peptide
  Seed: FAFGEPREL (MAGC1_HUMAN)
FEFGEPREA

SEQ ID NO: 77662 - protein, 10 aa, Artificial Sequence
  Description of Artificial Sequence: Synthetic peptide
  Seed: SILQSSPESA (MAGC1_HUMAN)
SLLQSSPESV

SEQ ID NO: 77663 - protein, 9 aa, Artificial Sequence
  Description of Artificial Sequence: Synthetic peptide
  Seed: TSLSLPQSF (MAGC1_HUMAN)
TPLSLPQSW

SEQ ID NO: 77664 - protein, 11 aa, Artificial Sequence
  Description of Artificial Sequence: Synthetic peptide
  Seed: SPLQIPVSSSS (MAGC1_HUMAN)
SPLQIPVSSSA

SEQ ID NO: 77665 - protein, 10 aa, Artificial Sequence
  Description of Artificial Sequence: Synthetic peptide
  Seed: FPQSLLQIPM (MAGC1_HUMAN)
FKQSLLQIPY

SEQ ID NO: 77666 - protein, 9 aa, Artificial Sequence
  Description of Artificial Sequence: Synthetic peptide
  Seed: FSYTLASLL (MAGC1_HUMAN)
FPYTLASLY

SEQ ID NO: 77667 - protein, 9 aa, Artificial Sequence
  Description of Artificial Sequence: Synthetic peptide
  Seed: VIWDVLSGI (MAGC1_HUMAN)
VVWDVLSGL

SEQ ID NO: 77668 - protein, 10 aa, Artificial Sequence
  Description of Artificial Sequence: Synthetic peptide
  Seed: SPLYFPQSPL (MAGC1_HUMAN)
SDLYFPQSPV

SEQ ID NO: 77669 - protein, 9 aa, Artificial Sequence
  Description of Artificial Sequence: Synthetic peptide
  Seed: ISRYTGYFP (MAGC1_HUMAN)
ISRYTGYFL

SEQ ID NO: 77670 - protein, 10 aa, Artificial Sequence
  Description of Artificial Sequence: Synthetic peptide
  Seed: SMSPLYFPQS (MAGC1_HUMAN)
SMSPLYFPQM

SEQ ID NO: 77671 - protein, 9 aa, Artificial Sequence
  Description of Artificial Sequence: Synthetic peptide
  Seed: VIFRKAREF (MAGC1_HUMAN)
VMFRKAREY

SEQ ID NO: 77672 - protein, 10 aa, Artificial Sequence
  Description of Artificial Sequence: Synthetic peptide
  Seed: PLQNPASSFF (MAGC1_HUMAN)
PIQNPASSFF

SEQ ID NO: 77673 - protein, 10 aa, Artificial Sequence
  Description of Artificial Sequence: Synthetic peptide
  Seed: SIFQSSPESA (MAGC1_HUMAN)
SMFQSSPESV

SEQ ID NO: 77674 - protein, 9 aa, Artificial Sequence
  Description of Artificial Sequence: Synthetic peptide
  Seed: AQSPLQSPV (MAGC1_HUMAN)
AESPLQSPL

SEQ ID NO: 77675 - protein, 9 aa, Artificial Sequence
  Description of Artificial Sequence: Synthetic peptide
  Seed: LSPLHFPQF (MAGC1_HUMAN)
LGPLHFPQL

SEQ ID NO: 77676 - protein, 9 aa, Artificial Sequence
  Description of Artificial Sequence: Synthetic peptide
  Seed: LKYQVKQPI (MAGC1_HUMAN)
LAYQVKQPY

SEQ ID NO: 77677 - protein, 9 aa, Artificial Sequence
  Description of Artificial Sequence: Synthetic peptide
  Seed: SPLQIVPSL (MAGC1_HUMAN)
SHLQIVPST

SEQ ID NO: 77678 - protein, 9 aa, Artificial Sequence
  Description of Artificial Sequence: Synthetic peptide
  Seed: REVDPDDSY (MAGC1_HUMAN)
RMVDPDDSI

SEQ ID NO: 77679 - protein, 9 aa, Artificial Sequence
  Description of Artificial Sequence: Synthetic peptide
  Seed: FFSSALLSI (MAGC1_HUMAN)
FMSSALLSG

SEQ ID NO: 77680 - protein, 9 aa, Artificial Sequence
  Description of Artificial Sequence: Synthetic peptide
  Seed: ESSSPVDEY (MAGC1_HUMAN)
EISSPVDEK

SEQ ID NO: 77681 - protein, 10 aa, Artificial Sequence
  Description of Artificial Sequence: Synthetic peptide
  Seed: SRYTGYFPVI (MAGC1_HUMAN)
SLYTGYFPVF

SEQ ID NO: 77682 - protein, 10 aa, Artificial Sequence
  Description of Artificial Sequence: Synthetic peptide
  Seed: FSSSTSLSPF (MAGC1_HUMAN)
FGSSTSLSPM

SEQ ID NO: 77683 - protein, 10 aa, Artificial Sequence
  Description of Artificial Sequence: Synthetic peptide
  Seed: SFSSTLLSIF (MAGC1_HUMAN)
SLSSTLLSIY

SEQ ID NO: 77684 - protein, 9 aa, Artificial Sequence
  Description of Artificial Sequence: Synthetic peptide
  Seed: WVQEHYLEY (MAGC1_HUMAN)
WWQEHYLEF

SEQ ID NO: 77685 - protein, 9 aa, Artificial Sequence
  Description of Artificial Sequence: Synthetic peptide
  Seed: FSEESSSPV (MAGC1_HUMAN)
FTEESSSPL

SEQ ID NO: 77686 - protein, 9 aa, Artificial Sequence
  Description of Artificial Sequence: Synthetic peptide
  Seed: FLAMLKNTV (MAGC1_HUMAN)
FVAMLKNTL

SEQ ID NO: 77687 - protein, 9 aa, Artificial Sequence
  Description of Artificial Sequence: Synthetic peptide
  Seed: TLASLLQSS (MAGC1_HUMAN)
TQASLLQSI

SEQ ID NO: 77688 - protein, 11 aa, Artificial Sequence
  Description of Artificial Sequence: Synthetic peptide
  Seed: LSDEQGMSQNR (MAGC1_HUMAN)
LLDEQGMSQNY

SEQ ID NO: 77689 - protein, 9 aa, Artificial Sequence
  Description of Artificial Sequence: Synthetic peptide
  Seed: VQSPLHSPQ (MAGC1_HUMAN)
VASPLHSPM

SEQ ID NO: 77690 - protein, 9 aa, Artificial Sequence
  Description of Artificial Sequence: Synthetic peptide
  Seed: KVWVQEHYL (MAGC1_HUMAN)
KVWVQEHYV

SEQ ID NO: 77691 - protein, 9 aa, Artificial Sequence
  Description of Artificial Sequence: Synthetic peptide
  Seed: AQSPLQSPV (MAGC1_HUMAN)
ALSPLQSPL

SEQ ID NO: 77692 - protein, 9 aa, Artificial Sequence
  Description of Artificial Sequence: Synthetic peptide
  Seed: FQSSLQSPV (MAGC1_HUMAN)
FRSSLQSPA

SEQ ID NO: 77693 - protein, 9 aa, Artificial Sequence
  Description of Artificial Sequence: Synthetic peptide
  Seed: LQIPVSSSS (MAGC1_HUMAN)
LKIPVSSSY

SEQ ID NO: 77694 - protein, 10 aa, Artificial Sequence
  Description of Artificial Sequence: Synthetic peptide
  Seed: LQIVPSLPEW (MAGC1_HUMAN)
LVIVPSLPEY

SEQ ID NO: 77695 - protein, 9 aa, Artificial Sequence
  Description of Artificial Sequence: Synthetic peptide
  Seed: SSTSSSLSK (MAGC1_HUMAN)
SATSSSLSY

SEQ ID NO: 77696 - protein, 9 aa, Artificial Sequence
  Description of Artificial Sequence: Synthetic peptide
  Seed: RTQSTFEGF (MAGC1_HUMAN)
RQQSTFEGY

SEQ ID NO: 77697 - protein, 10 aa, Artificial Sequence
  Description of Artificial Sequence: Synthetic peptide
  Seed: YTLLSLFQSS (MAGC1_HUMAN)
YELLSLFQSI

SEQ ID NO: 77698 - protein, 9 aa, Artificial Sequence
  Description of Artificial Sequence: Synthetic peptide
  Seed: AQSSLQIPV (MAGC1_HUMAN)
AISSLQIPI

SEQ ID NO: 77699 - protein, 9 aa, Artificial Sequence
  Description of Artificial Sequence: Synthetic peptide
  Seed: LSDEQGMSQ (MAGC1_HUMAN)
LDDEQGMSL

SEQ ID NO: 77700 - protein, 10 aa, Artificial Sequence
  Description of Artificial Sequence: Synthetic peptide
  Seed: SPLQIPVSSS (MAGC1_HUMAN)
SPLQIPVSSV

SEQ ID NO: 77701 - protein, 9 aa, Artificial Sequence
  Description of Artificial Sequence: Synthetic peptide
  Seed: GEDSLSPHY (MAGC1_HUMAN)
GVDSLSPHY

SEQ ID NO: 77702 - protein, 9 aa, Artificial Sequence
  Description of Artificial Sequence: Synthetic peptide
  Seed: SSSSSSSTL (MAGC1_HUMAN)
SGSSSSSTY

SEQ ID NO: 77703 - protein, 10 aa, Artificial Sequence
  Description of Artificial Sequence: Synthetic peptide
  Seed: KAREFIEILF (MAGC1_HUMAN)
KQREFIEILM

SEQ ID NO: 77704 - protein, 9 aa, Artificial Sequence
  Description of Artificial Sequence: Synthetic peptide
  Seed: SFSSTLVSL (MAGC1_HUMAN)
SWSSTLVSL

SEQ ID NO: 77705 - protein, 11 aa, Artificial Sequence
  Description of Artificial Sequence: Synthetic peptide
  Seed: SPLQRPVSSFF (MAGC1_HUMAN)
SRLQRPVSSFY

SEQ ID NO: 77706 - protein, 11 aa, Artificial Sequence
  Description of Artificial Sequence: Synthetic peptide
  Seed: SRYTGYFPVIF (MAGC1_HUMAN)
SYYTGYFPVIL

SEQ ID NO: 77707 - protein, 9 aa, Artificial Sequence
  Description of Artificial Sequence: Synthetic peptide
  Seed: TLDEKVDEL (MAGC1_HUMAN)
TGDEKVDEM

SEQ ID NO: 77708 - protein, 9 aa, Artificial Sequence
  Description of Artificial Sequence: Synthetic peptide
  Seed: FQSSLQSPV (MAGC1_HUMAN)
FISSLQSPY

SEQ ID NO: 77709 - protein, 9 aa, Artificial Sequence
  Description of Artificial Sequence: Synthetic peptide
  Seed: LQNPASSFF (MAGC1_HUMAN)
LPNPASSFF

SEQ ID NO: 77710 - protein, 9 aa, Artificial Sequence
  Description of Artificial Sequence: Synthetic peptide
  Seed: TLDEKVDEL (MAGC1_HUMAN)
TGDEKVDEI

SEQ ID NO: 77711 - protein, 10 aa, Artificial Sequence
  Description of Artificial Sequence: Synthetic peptide
  Seed: FLAMLKNTVP (MAGC1_HUMAN)
FLAMLKNTVI

SEQ ID NO: 77712 - protein, 9 aa, Artificial Sequence
  Description of Artificial Sequence: Synthetic peptide
  Seed: KDSLSPLEI (MAGC1_HUMAN)
KQSLSPLEM

SEQ ID NO: 77713 - protein, 10 aa, Artificial Sequence
  Description of Artificial Sequence: Synthetic peptide
  Seed: LILILSIIFI (MAGC1_HUMAN)
LRLILSIIFV

SEQ ID NO: 77714 - protein, 10 aa, Artificial Sequence
  Description of Artificial Sequence: Synthetic peptide
  Seed: WEDSLSPHYF (MAGC1_HUMAN)
WEDSLSPHYM

SEQ ID NO: 77715 - protein, 11 aa, Artificial Sequence
  Description of Artificial Sequence: Synthetic peptide
  Seed: SFFSSALLSIF (MAGC1_HUMAN)
SAFSSALLSIW

SEQ ID NO: 77716 - protein, 9 aa, Artificial Sequence
  Description of Artificial Sequence: Synthetic peptide
  Seed: LLSLFQSFS (MAGC1_HUMAN)
LLSLFQSFM

SEQ ID NO: 77717 - protein, 11 aa, Artificial Sequence
  Description of Artificial Sequence: Synthetic peptide
  Seed: KGTYASEEVIW (MAGC1_HUMAN)
KVTYASEEVIW

SEQ ID NO: 77718 - protein, 10 aa, Artificial Sequence
  Description of Artificial Sequence: Synthetic peptide
  Seed: VSAASSSTLV (MAGC1_HUMAN)
VTAASSSTLF

SEQ ID NO: 77719 - protein, 11 aa, Artificial Sequence
  Description of Artificial Sequence: Synthetic peptide
  Seed: LQIPVSSSFSY (MAGC1_HUMAN)
LLIPVSSSFSW

SEQ ID NO: 77720 - protein, 9 aa, Artificial Sequence
  Description of Artificial Sequence: Synthetic peptide
  Seed: REVDPDDSY (MAGC1_HUMAN)
RMVDPDDSW

SEQ ID NO: 77721 - protein, 9 aa, Artificial Sequence
  Description of Artificial Sequence: Synthetic peptide
  Seed: YQVKQPITK (MAGC1_HUMAN)
YNVKQPITY

SEQ ID NO: 77722 - protein, 9 aa, Artificial Sequence
  Description of Artificial Sequence: Synthetic peptide
  Seed: FQSSPERTH (MAGC1_HUMAN)
FKSSPERTF

SEQ ID NO: 77723 - protein, 11 aa, Artificial Sequence
  Description of Artificial Sequence: Synthetic peptide
  Seed: IPVSRSFSSTL (MAGC1_HUMAN)
IPVSRSFSSTM

SEQ ID NO: 77724 - protein, 11 aa, Artificial Sequence
  Description of Artificial Sequence: Synthetic peptide
  Seed: SPPEGPVQSPL (MAGC1_HUMAN)
SAPEGPVQSPL

SEQ ID NO: 77725 - protein, 10 aa, Artificial Sequence
  Description of Artificial Sequence: Synthetic peptide
  Seed: LAMLKNTVPI (MAGC1_HUMAN)
LYMLKNTVPF

SEQ ID NO: 77726 - protein, 9 aa, Artificial Sequence
  Description of Artificial Sequence: Synthetic peptide
  Seed: RFLLLKYQV (MAGC1_HUMAN)
RWLLLKYQW

SEQ ID NO: 77727 - protein, 9 aa, Artificial Sequence
  Description of Artificial Sequence: Synthetic peptide
  Seed: SPERTHSTF (MAGC1_HUMAN)
SPERTHSTW

SEQ ID NO: 77728 - protein, 9 aa, Artificial Sequence
  Description of Artificial Sequence: Synthetic peptide
  Seed: SFSSTLVSL (MAGC1_HUMAN)
SVSSTLVSM

SEQ ID NO: 77729 - protein, 10 aa, Artificial Sequence
  Description of Artificial Sequence: Synthetic peptide
  Seed: WGPRAHSEVI (MAGC1_HUMAN)
WCPRAHSEVL

SEQ ID NO: 77730 - protein, 10 aa, Artificial Sequence
  Description of Artificial Sequence: Synthetic peptide
  Seed: LSLFQSFSER (MAGC1_HUMAN)
LWLFQSFSER

SEQ ID NO: 77731 - protein, 10 aa, Artificial Sequence
  Description of Artificial Sequence: Synthetic peptide
  Seed: YASEEVIWDV (MAGC1_HUMAN)
YVSEEVIWDV

SEQ ID NO: 77732 - protein, 9 aa, Artificial Sequence
  Description of Artificial Sequence: Synthetic peptide
  Seed: SESLIESEP (MAGC1_HUMAN)
SESLIESEM

SEQ ID NO: 77733 - protein, 10 aa, Artificial Sequence
  Description of Artificial Sequence: Synthetic peptide
  Seed: SSPESTQSPF (MAGC1_HUMAN)
SRPESTQSPM

SEQ ID NO: 77734 - protein, 11 aa, Artificial Sequence
  Description of Artificial Sequence: Synthetic peptide
  Seed: MSPLYFPQSPL (MAGC1_HUMAN)
MPPLYFPQSPL

SEQ ID NO: 77735 - protein, 10 aa, Artificial Sequence
  Description of Artificial Sequence: Synthetic peptide
  Seed: STFEGFPQSL (MAGC1_HUMAN)
SQFEGFPQSI

SEQ ID NO: 77736 - protein, 8 aa, Artificial Sequence
  Description of Artificial Sequence: Synthetic peptide
  Seed: AEMLTNVI (MAGC1_HUMAN)
ADMLTNVL

SEQ ID NO: 77737 - protein, 9 aa, Artificial Sequence
  Description of Artificial Sequence: Synthetic peptide
  Seed: LQRPVSSFF (MAGC1_HUMAN)
LHRPVSSFY

SEQ ID NO: 77738 - protein, 9 aa, Artificial Sequence
  Description of Artificial Sequence: Synthetic peptide
  Seed: LKNTVPITF (MAGC1_HUMAN)
LENTVPITF

SEQ ID NO: 77739 - protein, 8 aa, Artificial Sequence
  Description of Artificial Sequence: Synthetic peptide
  Seed: KVDELARF (MAGC1_HUMAN)
KADELARV

SEQ ID NO: 77740 - protein, 10 aa, Artificial Sequence
  Description of Artificial Sequence: Synthetic peptide
  Seed: ICSSSTSLSL (MAGC1_HUMAN)
IFSSSTSLSM

SEQ ID NO: 77741 - protein, 10 aa, Artificial Sequence
  Description of Artificial Sequence: Synthetic peptide
  Seed: EGPAQSPLQR (MAGC1_HUMAN)
ETPAQSPLQR

SEQ ID NO: 77742 - protein, 10 aa, Artificial Sequence
  Description of Artificial Sequence: Synthetic peptide
  Seed: LLQIPMTSSF (MAGC1_HUMAN)
LNQIPMTSSL

SEQ ID NO: 77743 - protein, 9 aa, Artificial Sequence
  Description of Artificial Sequence: Synthetic peptide
  Seed: LKNTVPITF (MAGC1_HUMAN)
LINTVPITY

SEQ ID NO: 77744 - protein, 9 aa, Artificial Sequence
  Description of Artificial Sequence: Synthetic peptide
  Seed: FFSSALLSI (MAGC1_HUMAN)
FFSSALLSM

SEQ ID NO: 77745 - protein, 9 aa, Artificial Sequence
  Description of Artificial Sequence: Synthetic peptide
  Seed: FSYTLASLL (MAGC1_HUMAN)
FNYTLASLM

SEQ ID NO: 77746 - protein, 9 aa, Artificial Sequence
  Description of Artificial Sequence: Synthetic peptide
  Seed: LQIPMTSSF (MAGC1_HUMAN)
LIIPMTSSY

SEQ ID NO: 77747 - protein, 9 aa, Artificial Sequence
  Description of Artificial Sequence: Synthetic peptide
  Seed: EDFQSSLQS (MAGC1_HUMAN)
EEFQSSLQT

SEQ ID NO: 77748 - protein, 11 aa, Artificial Sequence
  Description of Artificial Sequence: Synthetic peptide
  Seed: SSFSYTLLSLF (MAGC1_HUMAN)
SAFSYTLLSLF

SEQ ID NO: 77749 - protein, 9 aa, Artificial Sequence
  Description of Artificial Sequence: Synthetic peptide
  Seed: LQIPGSPSF (MAGC1_HUMAN)
LWIPGSPSW

SEQ ID NO: 77750 - protein, 10 aa, Artificial Sequence
  Description of Artificial Sequence: Synthetic peptide
  Seed: PLQNPASSFF (MAGC1_HUMAN)
PYQNPASSFF

SEQ ID NO: 77751 - protein, 9 aa, Artificial Sequence
  Description of Artificial Sequence: Synthetic peptide
  Seed: IESEPLFTY (MAGC1_HUMAN)
IGSEPLFTY

SEQ ID NO: 77752 - protein, 10 aa, Artificial Sequence
  Description of Artificial Sequence: Synthetic peptide
  Seed: YASEEVIWDV (MAGC1_HUMAN)
YLSEEVIWDI

SEQ ID NO: 77753 - protein, 9 aa, Artificial Sequence
  Description of Artificial Sequence: Synthetic peptide
  Seed: FAFGEPREL (MAGC1_HUMAN)
FHFGEPREL

SEQ ID NO: 77754 - protein, 9 aa, Artificial Sequence
  Description of Artificial Sequence: Synthetic peptide
  Seed: IPMTSSFSS (MAGC1_HUMAN)
IQMTSSFSY

SEQ ID NO: 77755 - protein, 11 aa, Artificial Sequence
  Description of Artificial Sequence: Synthetic peptide
  Seed: IPVSPSSSSTL (MAGC1_HUMAN)
IPVSPSSSSTM

SEQ ID NO: 77756 - protein, 9 aa, Artificial Sequence
  Description of Artificial Sequence: Synthetic peptide
  Seed: SSSFSYTLL (MAGC1_HUMAN)
SQSFSYTLW

SEQ ID NO: 77757 - protein, 9 aa, Artificial Sequence
  Description of Artificial Sequence: Synthetic peptide
  Seed: LKNTVPITF (MAGC1_HUMAN)
LANTVPITM

SEQ ID NO: 77758 - protein, 10 aa, Artificial Sequence
  Description of Artificial Sequence: Synthetic peptide
  Seed: ISRYTGYFPV (MAGC1_HUMAN)
IMRYTGYFPL

SEQ ID NO: 77759 - protein, 10 aa, Artificial Sequence
  Description of Artificial Sequence: Synthetic peptide
  Seed: PRYEFLWGPR (MAGC1_HUMAN)
PMYEFLWGPR

SEQ ID NO: 77760 - protein, 9 aa, Artificial Sequence
  Description of Artificial Sequence: Synthetic peptide
  Seed: IESEPLFTY (MAGC1_HUMAN)
IQSEPLFTI

SEQ ID NO: 77761 - protein, 10 aa, Artificial Sequence
  Description of Artificial Sequence: Synthetic peptide
  Seed: FLAMLKNTVP (MAGC1_HUMAN)
FMAMLKNTVM

SEQ ID NO: 77762 - protein, 10 aa, Artificial Sequence
  Description of Artificial Sequence: Synthetic peptide
  Seed: LAMLKNTVPI (MAGC1_HUMAN)
LAMLKNTVPY

SEQ ID NO: 77763 - protein, 9 aa, Artificial Sequence
  Description of Artificial Sequence: Synthetic peptide
  Seed: ISFSSSTSL (MAGC1_HUMAN)
IFFSSSTSY

SEQ ID NO: 77764 - protein, 9 aa, Artificial Sequence
  Description of Artificial Sequence: Synthetic peptide
  Seed: VIKRKVVEF (MAGC1_HUMAN)
VIKRKVVEI

SEQ ID NO: 77765 - protein, 9 aa, Artificial Sequence
  Description of Artificial Sequence: Synthetic peptide
  Seed: LQIPGSPSF (MAGC1_HUMAN)
LFIPGSPSF

SEQ ID NO: 77766 - protein, 9 aa, Artificial Sequence
  Description of Artificial Sequence: Synthetic peptide
  Seed: SQSPPEGPV (MAGC1_HUMAN)
SESPPEGPL

SEQ ID NO: 77767 - protein, 10 aa, Artificial Sequence
  Description of Artificial Sequence: Synthetic peptide
  Seed: REHFAFGEPR (MAGC1_HUMAN)
RLHFAFGEPR

SEQ ID NO: 77768 - protein, 9 aa, Artificial Sequence
  Description of Artificial Sequence: Synthetic peptide
  Seed: SRYTGYFPV (MAGC1_HUMAN)
SMYTGYFPY

SEQ ID NO: 77769 - protein, 9 aa, Artificial Sequence
  Description of Artificial Sequence: Synthetic peptide
  Seed: SSSSSSSTL (MAGC1_HUMAN)
SMSSSSSTF

SEQ ID NO: 77770 - protein, 9 aa, Artificial Sequence
  Description of Artificial Sequence: Synthetic peptide
  Seed: IPMTSSFSS (MAGC1_HUMAN)
ITMTSSFSY

SEQ ID NO: 77771 - protein, 9 aa, Artificial Sequence
  Description of Artificial Sequence: Synthetic peptide
  Seed: KVVEFLAML (MAGC1_HUMAN)
KQVEFLAMV

SEQ ID NO: 77772 - protein, 10 aa, Artificial Sequence
  Description of Artificial Sequence: Synthetic peptide
  Seed: SFPSSTSSSL (MAGC1_HUMAN)
SLPSSTSSSM

SEQ ID NO: 77773 - protein, 10 aa, Artificial Sequence
  Description of Artificial Sequence: Synthetic peptide
  Seed: RKAREFIEIL (MAGC1_HUMAN)
RKAREFIEIY

SEQ ID NO: 77774 - protein, 10 aa, Artificial Sequence
  Description of Artificial Sequence: Synthetic peptide
  Seed: SSSSSTLLSL (MAGC1_HUMAN)
SYSSSTLLSW

SEQ ID NO: 77775 - protein, 9 aa, Artificial Sequence
  Description of Artificial Sequence: Synthetic peptide
  Seed: LQNPASSFF (MAGC1_HUMAN)
LFNPASSFL

SEQ ID NO: 77776 - protein, 9 aa, Artificial Sequence
  Description of Artificial Sequence: Synthetic peptide
  Seed: LQIPVSAAS (MAGC1_HUMAN)
LQIPVSAAY

SEQ ID NO: 77777 - protein, 9 aa, Artificial Sequence
  Description of Artificial Sequence: Synthetic peptide
  Seed: SSPESAQSA (MAGC1_HUMAN)
SGPESAQSI

SEQ ID NO: 77778 - protein, 10 aa, Artificial Sequence
  Description of Artificial Sequence: Synthetic peptide
  Seed: RKVVEFLAML (MAGC1_HUMAN)
RFVVEFLAMV

SEQ ID NO: 77779 - protein, 9 aa, Artificial Sequence
  Description of Artificial Sequence: Synthetic peptide
  Seed: FSSALLSIF (MAGC1_HUMAN)
FYSALLSIY

SEQ ID NO: 77780 - protein, 9 aa, Artificial Sequence
  Description of Artificial Sequence: Synthetic peptide
  Seed: SSFPSSTSS (MAGC1_HUMAN)
SIFPSSTSL

SEQ ID NO: 77781 - protein, 9 aa, Artificial Sequence
  Description of Artificial Sequence: Synthetic peptide
  Seed: LQIPVSSSS (MAGC1_HUMAN)
LNIPVSSSF

SEQ ID NO: 77782 - protein, 10 aa, Artificial Sequence
  Description of Artificial Sequence: Synthetic peptide
  Seed: REVDPDDSYV (MAGC1_HUMAN)
RIVDPDDSYF

SEQ ID NO: 77783 - protein, 9 aa, Artificial Sequence
  Description of Artificial Sequence: Synthetic peptide
  Seed: NTVPITFPS (MAGC1_HUMAN)
NTVPITFPI

SEQ ID NO: 77784 - protein, 10 aa, Artificial Sequence
  Description of Artificial Sequence: Synthetic peptide
  Seed: SFSSTLLSIF (MAGC1_HUMAN)
SSSSTLLSIY

SEQ ID NO: 77785 - protein, 9 aa, Artificial Sequence
  Description of Artificial Sequence: Synthetic peptide
  Seed: VPITFPSSY (MAGC1_HUMAN)
VIITFPSSF

SEQ ID NO: 77786 - protein, 9 aa, Artificial Sequence
  Description of Artificial Sequence: Synthetic peptide
  Seed: SSSSTLLSL (MAGC1_HUMAN)
SMSSTLLSA

SEQ ID NO: 77787 - protein, 10 aa, Artificial Sequence
  Description of Artificial Sequence: Synthetic peptide
  Seed: WEDSLSPHYF (MAGC1_HUMAN)
WLDSLSPHYL

SEQ ID NO: 77788 - protein, 9 aa, Artificial Sequence
  Description of Artificial Sequence: Synthetic peptide
  Seed: RSFSSTLLS (MAGC1_HUMAN)
RVFSSTLLM

SEQ ID NO: 77789 - protein, 11 aa, Artificial Sequence
  Description of Artificial Sequence: Synthetic peptide
  Seed: SSSSSSTLLSL (MAGC1_HUMAN)
SVSSSSTLLSF

SEQ ID NO: 77790 - protein, 9 aa, Artificial Sequence
  Description of Artificial Sequence: Synthetic peptide
  Seed: ISFSSSTSL (MAGC1_HUMAN)
IQFSSSTSM

SEQ ID NO: 77791 - protein, 9 aa, Artificial Sequence
  Description of Artificial Sequence: Synthetic peptide
  Seed: YFPVIFRKA (MAGC1_HUMAN)
YFPVIFRKY

SEQ ID NO: 77792 - protein, 8 aa, Artificial Sequence
  Description of Artificial Sequence: Synthetic peptide
  Seed: FSYTLLSL (MAGC1_HUMAN)
FSYTLLSF

SEQ ID NO: 77793 - protein, 10 aa, Artificial Sequence
  Description of Artificial Sequence: Synthetic peptide
  Seed: YTLLSLFQSS (MAGC1_HUMAN)
YHLLSLFQSL

SEQ ID NO: 77794 - protein, 9 aa, Artificial Sequence
  Description of Artificial Sequence: Synthetic peptide
  Seed: MSQNRLLIL (MAGC1_HUMAN)
MKQNRLLIY

SEQ ID NO: 77795 - protein, 10 aa, Artificial Sequence
  Description of Artificial Sequence: Synthetic peptide
  Seed: SSPESAQSTF (MAGC1_HUMAN)
SVPESAQSTF

SEQ ID NO: 77796 - protein, 10 aa, Artificial Sequence
  Description of Artificial Sequence: Synthetic peptide
  Seed: PLQIPMTSSF (MAGC1_HUMAN)
PWQIPMTSSY

SEQ ID NO: 77797 - protein, 9 aa, Artificial Sequence
  Description of Artificial Sequence: Synthetic peptide
  Seed: AFGEPRELL (MAGC1_HUMAN)
AWGEPRELW

SEQ ID NO: 77798 - protein, 11 aa, Artificial Sequence
  Description of Artificial Sequence: Synthetic peptide
  Seed: SLSQSSPVSSF (MAGC1_HUMAN)
SASQSSPVSSF

SEQ ID NO: 77799 - protein, 10 aa, Artificial Sequence
  Description of Artificial Sequence: Synthetic peptide
  Seed: LTKVWVQEHY (MAGC1_HUMAN)
LQKVWVQEHF

SEQ ID NO: 77800 - protein, 9 aa, Artificial Sequence
  Description of Artificial Sequence: Synthetic peptide
  Seed: KVWVQEHYL (MAGC1_HUMAN)
KLWVQEHYM

SEQ ID NO: 77801 - protein, 9 aa, Artificial Sequence
  Description of Artificial Sequence: Synthetic peptide
  Seed: SAQSTFEGF (MAGC1_HUMAN)
SMQSTFEGM

SEQ ID NO: 77802 - protein, 9 aa, Artificial Sequence
  Description of Artificial Sequence: Synthetic peptide
  Seed: FSERTQSTF (MAGC1_HUMAN)
FTERTQSTL

SEQ ID NO: 77803 - protein, 9 aa, Artificial Sequence
  Description of Artificial Sequence: Synthetic peptide
  Seed: FSYTLASLL (MAGC1_HUMAN)
FGYTLASLM

SEQ ID NO: 77804 - protein, 10 aa, Artificial Sequence
  Description of Artificial Sequence: Synthetic peptide
  Seed: FQSSLQSPVS (MAGC1_HUMAN)
FLSSLQSPVY

SEQ ID NO: 77805 - protein, 9 aa, Artificial Sequence
  Description of Artificial Sequence: Synthetic peptide
  Seed: LQIPMTSSF (MAGC1_HUMAN)
LLIPMTSSW

SEQ ID NO: 77806 - protein, 10 aa, Artificial Sequence
  Description of Artificial Sequence: Synthetic peptide
  Seed: WGPRAHSEVI (MAGC1_HUMAN)
WKPRAHSEVI

SEQ ID NO: 77807 - protein, 9 aa, Artificial Sequence
  Description of Artificial Sequence: Synthetic peptide
  Seed: MTSSFSSTL (MAGC1_HUMAN)
MRSSFSSTY

SEQ ID NO: 77808 - protein, 9 aa, Artificial Sequence
  Description of Artificial Sequence: Synthetic peptide
  Seed: SSSVMSPSF (MAGC1_HUMAN)
SRSVMSPSM

SEQ ID NO: 77809 - protein, 10 aa, Artificial Sequence
  Description of Artificial Sequence: Synthetic peptide
  Seed: EVIWDVLSGI (MAGC1_HUMAN)
EAIWDVLSGI

SEQ ID NO: 77810 - protein, 9 aa, Artificial Sequence
  Description of Artificial Sequence: Synthetic peptide
  Seed: ASSSVMSPS (MAGC1_HUMAN)
AMSSVMSPK

SEQ ID NO: 77811 - protein, 9 aa, Artificial Sequence
  Description of Artificial Sequence: Synthetic peptide
  Seed: ISFSSSTSL (MAGC1_HUMAN)
IQFSSSTSF

SEQ ID NO: 77812 - protein, 10 aa, Artificial Sequence
  Description of Artificial Sequence: Synthetic peptide
  Seed: LSQSSPVSSF (MAGC1_HUMAN)
LNQSSPVSSF

SEQ ID NO: 77813 - protein, 9 aa, Artificial Sequence
  Description of Artificial Sequence: Synthetic peptide
  Seed: SFPSSTSSS (MAGC1_HUMAN)
SHPSSTSSM

SEQ ID NO: 77814 - protein, 9 aa, Artificial Sequence
  Description of Artificial Sequence: Synthetic peptide
  Seed: IFRKAREFI (MAGC1_HUMAN)
ITRKAREFV

SEQ ID NO: 77815 - protein, 10 aa, Artificial Sequence
  Description of Artificial Sequence: Synthetic peptide
  Seed: SRYTGYFPVI (MAGC1_HUMAN)
SRYTGYFPVK

SEQ ID NO: 77816 - protein, 9 aa, Artificial Sequence
  Description of Artificial Sequence: Synthetic peptide
  Seed: KVWVQEHYL (MAGC1_HUMAN)
KQWVQEHYW

SEQ ID NO: 77817 - protein, 10 aa, Artificial Sequence
  Description of Artificial Sequence: Synthetic peptide
  Seed: MLKNTVPITF (MAGC1_HUMAN)
MTKNTVPITY

SEQ ID NO: 77818 - protein, 10 aa, Artificial Sequence
  Description of Artificial Sequence: Synthetic peptide
  Seed: KVVEFLAMLK (MAGC1_HUMAN)
KIVEFLAMLI

SEQ ID NO: 77819 - protein, 10 aa, Artificial Sequence
  Description of Artificial Sequence: Synthetic peptide
  Seed: ICSSSTPSSL (MAGC1_HUMAN)
IRSSSTPSSW

SEQ ID NO: 77820 - protein, 10 aa, Artificial Sequence
  Description of Artificial Sequence: Synthetic peptide
  Seed: FFSYTLASLL (MAGC1_HUMAN)
FASYTLASLI

SEQ ID NO: 77821 - protein, 9 aa, Artificial Sequence
  Description of Artificial Sequence: Synthetic peptide
  Seed: SSFSSTLLS (MAGC1_HUMAN)
SLFSSTLLK

SEQ ID NO: 77822 - protein, 10 aa, Artificial Sequence
  Description of Artificial Sequence: Synthetic peptide
  Seed: LQIPGSPSFS (MAGC1_HUMAN)
LQIPGSPSFM

SEQ ID NO: 77823 - protein, 9 aa, Artificial Sequence
  Description of Artificial Sequence: Synthetic peptide
  Seed: ILILSIIFI (MAGC1_HUMAN)
IQILSIIFA

SEQ ID NO: 77824 - protein, 9 aa, Artificial Sequence
  Description of Artificial Sequence: Synthetic peptide
  Seed: LKNTVPITF (MAGC1_HUMAN)
LLNTVPITM

SEQ ID NO: 77825 - protein, 9 aa, Artificial Sequence
  Description of Artificial Sequence: Synthetic peptide
  Seed: SFSYTLLSL (MAGC1_HUMAN)
STSYTLLSF

SEQ ID NO: 77826 - protein, 10 aa, Artificial Sequence
  Description of Artificial Sequence: Synthetic peptide
  Seed: ICSSSTSLSL (MAGC1_HUMAN)
IKSSSTSLSF

SEQ ID NO: 77827 - protein, 10 aa, Artificial Sequence
  Description of Artificial Sequence: Synthetic peptide
  Seed: HSPLQIVPSL (MAGC1_HUMAN)
HAPLQIVPSL

SEQ ID NO: 77828 - protein, 9 aa, Artificial Sequence
  Description of Artificial Sequence: Synthetic peptide
  Seed: VSSFFSYTL (MAGC1_HUMAN)
VVSFFSYTI

SEQ ID NO: 77829 - protein, 9 aa, Artificial Sequence
  Description of Artificial Sequence: Synthetic peptide
  Seed: SSTSSSLSK (MAGC1_HUMAN)
SLTSSSLSK

SEQ ID NO: 77830 - protein, 9 aa, Artificial Sequence
  Description of Artificial Sequence: Synthetic peptide
  Seed: SSSTSLSPF (MAGC1_HUMAN)
SASTSLSPW

SEQ ID NO: 77831 - protein, 9 aa, Artificial Sequence
  Description of Artificial Sequence: Synthetic peptide
  Seed: SPLQRPVSS (MAGC1_HUMAN)
SILQRPVSI

SEQ ID NO: 77832 - protein, 11 aa, Artificial Sequence
  Description of Artificial Sequence: Synthetic peptide
  Seed: KDMPTAGMPSL (MAGC1_HUMAN)
KEMPTAGMPSF

SEQ ID NO: 77833 - protein, 9 aa, Artificial Sequence
  Description of Artificial Sequence: Synthetic peptide
  Seed: FSSTLVSLF (MAGC1_HUMAN)
FMSTLVSLA

SEQ ID NO: 77834 - protein, 9 aa, Artificial Sequence
  Description of Artificial Sequence: Synthetic peptide
  Seed: DVLSGIGVR (MAGC1_HUMAN)
DILSGIGVR

SEQ ID NO: 77835 - protein, 11 aa, Artificial Sequence
  Description of Artificial Sequence: Synthetic peptide
  Seed: RSFSSTLLSIF (MAGC1_HUMAN)
REFSSTLLSIF

SEQ ID NO: 77836 - protein, 9 aa, Artificial Sequence
  Description of Artificial Sequence: Synthetic peptide
  Seed: YTLLSLFQS (MAGC1_HUMAN)
YMLLSLFQL

SEQ ID NO: 77837 - protein, 9 aa, Artificial Sequence
  Description of Artificial Sequence: Synthetic peptide
  Seed: TGYFPVIFR (MAGC1_HUMAN)
TTYFPVIFY

SEQ ID NO: 77838 - protein, 10 aa, Artificial Sequence
  Description of Artificial Sequence: Synthetic peptide
  Seed: SPLQSPVISF (MAGC1_HUMAN)
SQLQSPVISY

SEQ ID NO: 77839 - protein, 10 aa, Artificial Sequence
  Description of Artificial Sequence: Synthetic peptide
  Seed: LQGEEFQSSL (MAGC1_HUMAN)
LHGEEFQSSL

SEQ ID NO: 77840 - protein, 9 aa, Artificial Sequence
  Description of Artificial Sequence: Synthetic peptide
  Seed: VISRYTGYF (MAGC1_HUMAN)
VTSRYTGYY

SEQ ID NO: 77841 - protein, 9 aa, Artificial Sequence
  Description of Artificial Sequence: Synthetic peptide
  Seed: SSPEGKDSL (MAGC1_HUMAN)
SHPEGKDSV

SEQ ID NO: 77842 - protein, 11 aa, Artificial Sequence
  Description of Artificial Sequence: Synthetic peptide
  Seed: NTVPITFPSSY (MAGC1_HUMAN)
NSVPITFPSSW

SEQ ID NO: 77843 - protein, 10 aa, Artificial Sequence
  Description of Artificial Sequence: Synthetic peptide
  Seed: PLQIPVSRSF (MAGC1_HUMAN)
PSQIPVSRSF

SEQ ID NO: 77844 - protein, 10 aa, Artificial Sequence
  Description of Artificial Sequence: Synthetic peptide
  Seed: LLQIPMTSSF (MAGC1_HUMAN)
LIQIPMTSSL

SEQ ID NO: 77845 - protein, 10 aa, Artificial Sequence
  Description of Artificial Sequence: Synthetic peptide
  Seed: SSSSSSSTLL (MAGC1_HUMAN)
SASSSSSTLY

SEQ ID NO: 77846 - protein, 10 aa, Artificial Sequence
  Description of Artificial Sequence: Synthetic peptide
  Seed: MTSSFSSTLL (MAGC1_HUMAN)
MMSSFSSTLM

SEQ ID NO: 77847 - protein, 9 aa, Artificial Sequence
  Description of Artificial Sequence: Synthetic peptide
  Seed: MTSSFSSTL (MAGC1_HUMAN)
MCSSFSSTW

SEQ ID NO: 77848 - protein, 10 aa, Artificial Sequence
  Description of Artificial Sequence: Synthetic peptide
  Seed: SFFSYTLASL (MAGC1_HUMAN)
SFFSYTLASF

SEQ ID NO: 77849 - protein, 9 aa, Artificial Sequence
  Description of Artificial Sequence: Synthetic peptide
  Seed: RFLLLKYQV (MAGC1_HUMAN)
RWLLLKYQM

SEQ ID NO: 77850 - protein, 10 aa, Artificial Sequence
  Description of Artificial Sequence: Synthetic peptide
  Seed: SSSSSTLLSL (MAGC1_HUMAN)
SISSSTLLSV

SEQ ID NO: 77851 - protein, 10 aa, Artificial Sequence
  Description of Artificial Sequence: Synthetic peptide
  Seed: FQSSLQSPVS (MAGC1_HUMAN)
FLSSLQSPVF

SEQ ID NO: 77852 - protein, 9 aa, Artificial Sequence
  Description of Artificial Sequence: Synthetic peptide
  Seed: LSDEQGMSQ (MAGC1_HUMAN)
LYDEQGMSF

SEQ ID NO: 77853 - protein, 9 aa, Artificial Sequence
  Description of Artificial Sequence: Synthetic peptide
  Seed: VSPSFSSTL (MAGC1_HUMAN)
VLPSFSSTA

SEQ ID NO: 77854 - protein, 9 aa, Artificial Sequence
  Description of Artificial Sequence: Synthetic peptide
  Seed: FPSSTSSSL (MAGC1_HUMAN)
FSSSTSSSL

SEQ ID NO: 77855 - protein, 9 aa, Artificial Sequence
  Description of Artificial Sequence: Synthetic peptide
  Seed: RTHSTFEGF (MAGC1_HUMAN)
RTHSTFEGR

SEQ ID NO: 77856 - protein, 9 aa, Artificial Sequence
  Description of Artificial Sequence: Synthetic peptide
  Seed: LQIPVSAAS (MAGC1_HUMAN)
LMIPVSAAL

SEQ ID NO: 77857 - protein, 9 aa, Artificial Sequence
  Description of Artificial Sequence: Synthetic peptide
  Seed: LQIPVSSSS (MAGC1_HUMAN)
LQIPVSSSM

SEQ ID NO: 77858 - protein, 9 aa, Artificial Sequence
  Description of Artificial Sequence: Synthetic peptide
  Seed: VSRSFSSTL (MAGC1_HUMAN)
VTRSFSSTV

SEQ ID NO: 77859 - protein, 9 aa, Artificial Sequence
  Description of Artificial Sequence: Synthetic peptide
  Seed: SPLQIVPSL (MAGC1_HUMAN)
SSLQIVPSV

SEQ ID NO: 77860 - protein, 9 aa, Artificial Sequence
  Description of Artificial Sequence: Synthetic peptide
  Seed: FFSYTLASL (MAGC1_HUMAN)
FCSYTLASM

SEQ ID NO: 77861 - protein, 11 aa, Artificial Sequence
  Description of Artificial Sequence: Synthetic peptide
  Seed: SPLQIPMTSSF (MAGC1_HUMAN)
SDLQIPMTSSF

SEQ ID NO: 77862 - protein, 10 aa, Artificial Sequence
  Description of Artificial Sequence: Synthetic peptide
  Seed: SFPSSTSSSL (MAGC1_HUMAN)
SKPSSTSSSM

SEQ ID NO: 77863 - protein, 9 aa, Artificial Sequence
  Description of Artificial Sequence: Synthetic peptide
  Seed: SPLQIVPSL (MAGC1_HUMAN)
SILQIVPSA

SEQ ID NO: 77864 - protein, 8 aa, Artificial Sequence
  Description of Artificial Sequence: Synthetic peptide
  Seed: LYFPQSPL (MAGC1_HUMAN)
LYFPQSPF

SEQ ID NO: 77865 - protein, 9 aa, Artificial Sequence
  Description of Artificial Sequence: Synthetic peptide
  Seed: NSSPPRYEF (MAGC1_HUMAN)
NSSPPRYEW

SEQ ID NO: 77866 - protein, 9 aa, Artificial Sequence
  Description of Artificial Sequence: Synthetic peptide
  Seed: RAGREHFAF (MAGC1_HUMAN)
RQGREHFAY

SEQ ID NO: 77867 - protein, 9 aa, Artificial Sequence
  Description of Artificial Sequence: Synthetic peptide
  Seed: LQIPVSAAS (MAGC1_HUMAN)
LSIPVSAAL

SEQ ID NO: 77868 - protein, 9 aa, Artificial Sequence
  Description of Artificial Sequence: Synthetic peptide
  Seed: IEILFGISL (MAGC1_HUMAN)
IEILFGISW

SEQ ID NO: 77869 - protein, 9 aa, Artificial Sequence
  Description of Artificial Sequence: Synthetic peptide
  Seed: KDSLSPLEI (MAGC1_HUMAN)
KVSLSPLEL

SEQ ID NO: 77870 - protein, 10 aa, Artificial Sequence
  Description of Artificial Sequence: Synthetic peptide
  Seed: ICSSSTSLSL (MAGC1_HUMAN)
IHSSSTSLSW

SEQ ID NO: 77871 - protein, 10 aa, Artificial Sequence
  Description of Artificial Sequence: Synthetic peptide
  Seed: LQIPVSRSFS (MAGC1_HUMAN)
LVIPVSRSFF

SEQ ID NO: 77872 - protein, 10 aa, Artificial Sequence
  Description of Artificial Sequence: Synthetic peptide
  Seed: RSFSSTLLSI (MAGC1_HUMAN)
RMFSSTLLSV

SEQ ID NO: 77873 - protein, 9 aa, Artificial Sequence
  Description of Artificial Sequence: Synthetic peptide
  Seed: LQIPVSSSS (MAGC1_HUMAN)
LMIPVSSSH

SEQ ID NO: 77874 - protein, 9 aa, Artificial Sequence
  Description of Artificial Sequence: Synthetic peptide
  Seed: YVFVNTLDL (MAGC1_HUMAN)
YPFVNTLDA

SEQ ID NO: 77875 - protein, 9 aa, Artificial Sequence
  Description of Artificial Sequence: Synthetic peptide
  Seed: SQNRLLILI (MAGC1_HUMAN)
SSNRLLILV

SEQ ID NO: 77876 - protein, 9 aa, Artificial Sequence
  Description of Artificial Sequence: Synthetic peptide
  Seed: TLLSILQSS (MAGC1_HUMAN)
TALSILQSV

SEQ ID NO: 77877 - protein, 9 aa, Artificial Sequence
  Description of Artificial Sequence: Synthetic peptide
  Seed: ESSSPVDEY (MAGC1_HUMAN)
EASSPVDEY

SEQ ID NO: 77878 - protein, 9 aa, Artificial Sequence
  Description of Artificial Sequence: Synthetic peptide
  Seed: SIIFIKGTY (MAGC1_HUMAN)
SQIFIKGTF

SEQ ID NO: 77879 - protein, 10 aa, Artificial Sequence
  Description of Artificial Sequence: Synthetic peptide
  Seed: SSSSSTLLSL (MAGC1_HUMAN)
SGSSSTLLSY

SEQ ID NO: 77880 - protein, 10 aa, Artificial Sequence
  Description of Artificial Sequence: Synthetic peptide
  Seed: SFSSTLVSLF (MAGC1_HUMAN)
SQSSTLVSLW

SEQ ID NO: 77881 - protein, 11 aa, Artificial Sequence
  Description of Artificial Sequence: Synthetic peptide
  Seed: SPLQIPGSPSF (MAGC1_HUMAN)
SCLQIPGSPSY

SEQ ID NO: 77882 - protein, 9 aa, Artificial Sequence
  Description of Artificial Sequence: Synthetic peptide
  Seed: VSSSSSSTL (MAGC1_HUMAN)
VKSSSSSTI

SEQ ID NO: 77883 - protein, 11 aa, Artificial Sequence
  Description of Artificial Sequence: Synthetic peptide
  Seed: IPMTSSFSSTL (MAGC1_HUMAN)
IVMTSSFSSTW

SEQ ID NO: 77884 - protein, 9 aa, Artificial Sequence
  Description of Artificial Sequence: Synthetic peptide
  Seed: IPVSSSFSY (MAGC1_HUMAN)
IIVSSSFSY

SEQ ID NO: 77885 - protein, 11 aa, Artificial Sequence
  Description of Artificial Sequence: Synthetic peptide
  Seed: RPVSSFFSYTL (MAGC1_HUMAN)
RQVSSFFSYTY

SEQ ID NO: 77886 - protein, 10 aa, Artificial Sequence
  Description of Artificial Sequence: Synthetic peptide
  Seed: SSPESTQSPF (MAGC1_HUMAN)
SVPESTQSPY

SEQ ID NO: 77887 - protein, 9 aa, Artificial Sequence
  Description of Artificial Sequence: Synthetic peptide
  Seed: SPPEGENTH (MAGC1_HUMAN)
SSPEGENTY

SEQ ID NO: 77888 - protein, 9 aa, Artificial Sequence
  Description of Artificial Sequence: Synthetic peptide
  Seed: AGREHFAFG (MAGC1_HUMAN)
ASREHFAFQ

SEQ ID NO: 77889 - protein, 9 aa, Artificial Sequence
  Description of Artificial Sequence: Synthetic peptide
  Seed: NVISRYTGY (MAGC1_HUMAN)
NTISRYTGM

SEQ ID NO: 77890 - protein, 9 aa, Artificial Sequence
  Description of Artificial Sequence: Synthetic peptide
  Seed: ALLSIFQSS (MAGC1_HUMAN)
ATLSIFQSV

SEQ ID NO: 77891 - protein, 11 aa, Artificial Sequence
  Description of Artificial Sequence: Synthetic peptide
  Seed: SQSSPEGKDSL (MAGC1_HUMAN)
SHSSPEGKDSV

SEQ ID NO: 77892 - protein, 9 aa, Artificial Sequence
  Description of Artificial Sequence: Synthetic peptide
  Seed: LQIPVSAAS (MAGC1_HUMAN)
LKIPVSAAL

SEQ ID NO: 77893 - protein, 9 aa, Artificial Sequence
  Description of Artificial Sequence: Synthetic peptide
  Seed: DSYVFVNTL (MAGC1_HUMAN)
DTYVFVNTA

SEQ ID NO: 77894 - protein, 10 aa, Artificial Sequence
  Description of Artificial Sequence: Synthetic peptide
  Seed: PLQIPMTSSF (MAGC1_HUMAN)
PTQIPMTSSY

SEQ ID NO: 77895 - protein, 10 aa, Artificial Sequence
  Description of Artificial Sequence: Synthetic peptide
  Seed: PLQIPVSSSF (MAGC1_HUMAN)
PYQIPVSSSY

SEQ ID NO: 77896 - protein, 9 aa, Artificial Sequence
  Description of Artificial Sequence: Synthetic peptide
  Seed: KVDELARFL (MAGC1_HUMAN)
KQDELARFF

SEQ ID NO: 77897 - protein, 9 aa, Artificial Sequence
  Description of Artificial Sequence: Synthetic peptide
  Seed: LDEKVDELA (MAGC1_HUMAN)
LEEKVDELA

SEQ ID NO: 77898 - protein, 9 aa, Artificial Sequence
  Description of Artificial Sequence: Synthetic peptide
  Seed: VIKRKVVEF (MAGC1_HUMAN)
VIKRKVVEV

SEQ ID NO: 77899 - protein, 11 aa, Artificial Sequence
  Description of Artificial Sequence: Synthetic peptide
  Seed: FPQSPQGEDSL (MAGC1_HUMAN)
FAQSPQGEDSL

SEQ ID NO: 77900 - protein, 9 aa, Artificial Sequence
  Description of Artificial Sequence: Synthetic peptide
  Seed: EFIEILFGI (MAGC1_HUMAN)
ESIEILFGS

SEQ ID NO: 77901 - protein, 9 aa, Artificial Sequence
  Description of Artificial Sequence: Synthetic peptide
  Seed: SSSTLVSIF (MAGC1_HUMAN)
SRSTLVSIL

SEQ ID NO: 77902 - protein, 9 aa, Artificial Sequence
  Description of Artificial Sequence: Synthetic peptide
  Seed: SLPQSFPES (MAGC1_HUMAN)
STPQSFPEI

SEQ ID NO: 77903 - protein, 9 aa, Artificial Sequence
  Description of Artificial Sequence: Synthetic peptide
  Seed: FSSTLLSIL (MAGC1_HUMAN)
FASTLLSIV

SEQ ID NO: 77904 - protein, 11 aa, Artificial Sequence
  Description of Artificial Sequence: Synthetic peptide
  Seed: YASEEVIWDVL (MAGC1_HUMAN)
YESEEVIWDVL

SEQ ID NO: 77905 - protein, 9 aa, Artificial Sequence
  Description of Artificial Sequence: Synthetic peptide
  Seed: SPLEGEDSL (MAGC1_HUMAN)
SPLEGEDSY

SEQ ID NO: 77906 - protein, 9 aa, Artificial Sequence
  Description of Artificial Sequence: Synthetic peptide
  Seed: SQSSPVSSF (MAGC1_HUMAN)
SLSSPVSSF

SEQ ID NO: 77907 - protein, 9 aa, Artificial Sequence
  Description of Artificial Sequence: Synthetic peptide
  Seed: TLDLTSEGC (MAGC1_HUMAN)
TGDLTSEGL

SEQ ID NO: 77908 - protein, 9 aa, Artificial Sequence
  Description of Artificial Sequence: Synthetic peptide
  Seed: KVWVQEHYL (MAGC1_HUMAN)
KAWVQEHYW

SEQ ID NO: 77909 - protein, 10 aa, Artificial Sequence
  Description of Artificial Sequence: Synthetic peptide
  Seed: MPTAGMPSLL (MAGC1_HUMAN)
MTTAGMPSLV

SEQ ID NO: 77910 - protein, 9 aa, Artificial Sequence
  Description of Artificial Sequence: Synthetic peptide
  Seed: FSEESSSPV (MAGC1_HUMAN)
FVEESSSPY

SEQ ID NO: 77911 - protein, 9 aa, Artificial Sequence
  Description of Artificial Sequence: Synthetic peptide
  Seed: DPDDSYVFV (MAGC1_HUMAN)
DMDDSYVFL

SEQ ID NO: 77912 - protein, 9 aa, Artificial Sequence
  Description of Artificial Sequence: Synthetic peptide
  Seed: CSSSTSLSL (MAGC1_HUMAN)
CISSTSLSW

SEQ ID NO: 77913 - protein, 9 aa, Artificial Sequence
  Description of Artificial Sequence: Synthetic peptide
  Seed: SSPECTQST (MAGC1_HUMAN)
SAPECTQSI

SEQ ID NO: 77914 - protein, 10 aa, Artificial Sequence
  Description of Artificial Sequence: Synthetic peptide
  Seed: FFSSALLSIF (MAGC1_HUMAN)
FMSSALLSIM

SEQ ID NO: 77915 - protein, 11 aa, Artificial Sequence
  Description of Artificial Sequence: Synthetic peptide
  Seed: SSFSYTLLSLF (MAGC1_HUMAN)
SAFSYTLLSLW

SEQ ID NO: 77916 - protein, 9 aa, Artificial Sequence
  Description of Artificial Sequence: Synthetic peptide
  Seed: NSSPPRYEF (MAGC1_HUMAN)
NRSPPRYEI

SEQ ID NO: 77917 - protein, 10 aa, Artificial Sequence
  Description of Artificial Sequence: Synthetic peptide
  Seed: QRPVSSFFSY (MAGC1_HUMAN)
QMPVSSFFSY

SEQ ID NO: 77918 - protein, 9 aa, Artificial Sequence
  Description of Artificial Sequence: Synthetic peptide
  Seed: DVLSGIGVR (MAGC1_HUMAN)
DSLSGIGVY

SEQ ID NO: 77919 - protein, 10 aa, Artificial Sequence
  Description of Artificial Sequence: Synthetic peptide
  Seed: ASSFFSSALL (MAGC1_HUMAN)
AWSFFSSALF

SEQ ID NO: 77920 - protein, 9 aa, Artificial Sequence
  Description of Artificial Sequence: Synthetic peptide
  Seed: TLDLTSEGC (MAGC1_HUMAN)
TADLTSEGL

SEQ ID NO: 77921 - protein, 10 aa, Artificial Sequence
  Description of Artificial Sequence: Synthetic peptide
  Seed: SSFSSTLLSI (MAGC1_HUMAN)
STFSSTLLSI

SEQ ID NO: 77922 - protein, 9 aa, Artificial Sequence
  Description of Artificial Sequence: Synthetic peptide
  Seed: AGREHFAFG (MAGC1_HUMAN)
ATREHFAFG

SEQ ID NO: 77923 - protein, 9 aa, Artificial Sequence
  Description of Artificial Sequence: Synthetic peptide
  Seed: SSSFSYTLL (MAGC1_HUMAN)
SISFSYTLL

SEQ ID NO: 77924 - protein, 10 aa, Artificial Sequence
  Description of Artificial Sequence: Synthetic peptide
  Seed: FSSSTSLSPF (MAGC1_HUMAN)
FASSTSLSPM

SEQ ID NO: 77925 - protein, 9 aa, Artificial Sequence
  Description of Artificial Sequence: Synthetic peptide
  Seed: KAREFIEIL (MAGC1_HUMAN)
KMREFIEIM

SEQ ID NO: 77926 - protein, 9 aa, Artificial Sequence
  Description of Artificial Sequence: Synthetic peptide
  Seed: LQIPVSSSS (MAGC1_HUMAN)
LRIPVSSSI

SEQ ID NO: 77927 - protein, 10 aa, Artificial Sequence
  Description of Artificial Sequence: Synthetic peptide
  Seed: SSFSYTLLSL (MAGC1_HUMAN)
SQFSYTLLSF

SEQ ID NO: 77928 - protein, 11 aa, Artificial Sequence
  Description of Artificial Sequence: Synthetic peptide
  Seed: VDEYTSSSDTL (MAGC1_HUMAN)
VHEYTSSSDTF

SEQ ID NO: 77929 - protein, 10 aa, Artificial Sequence
  Description of Artificial Sequence: Synthetic peptide
  Seed: STFEGFPQSL (MAGC1_HUMAN)
SHFEGFPQSM

SEQ ID NO: 77930 - protein, 10 aa, Artificial Sequence
  Description of Artificial Sequence: Synthetic peptide
  Seed: RSFSSTLLSI (MAGC1_HUMAN)
RWFSSTLLSY

SEQ ID NO: 77931 - protein, 9 aa, Artificial Sequence
  Description of Artificial Sequence: Synthetic peptide
  Seed: TFEGFPQSL (MAGC1_HUMAN)
TVEGFPQSV

SEQ ID NO: 77932 - protein, 9 aa, Artificial Sequence
  Description of Artificial Sequence: Synthetic peptide
  Seed: GPAQSPLQR (MAGC1_HUMAN)
GYAQSPLQY

SEQ ID NO: 77933 - protein, 9 aa, Artificial Sequence
  Description of Artificial Sequence: Synthetic peptide
  Seed: SSFFSSALL (MAGC1_HUMAN)
SKFFSSALY

SEQ ID NO: 77934 - protein, 9 aa, Artificial Sequence
  Description of Artificial Sequence: Synthetic peptide
  Seed: LQIPVSAAS (MAGC1_HUMAN)
LFIPVSAAY

SEQ ID NO: 77935 - protein, 11 aa, Artificial Sequence
  Description of Artificial Sequence: Synthetic peptide
  Seed: SSFSYTLLSLF (MAGC1_HUMAN)
STFSYTLLSLM

SEQ ID NO: 77936 - protein, 11 aa, Artificial Sequence
  Description of Artificial Sequence: Synthetic peptide
  Seed: GEDSSDPLQRP (MAGC1_HUMAN)
GEDSSDPLQRL

SEQ ID NO: 77937 - protein, 9 aa, Artificial Sequence
  Description of Artificial Sequence: Synthetic peptide
  Seed: RKVVEFLAM (MAGC1_HUMAN)
RLVVEFLAF

SEQ ID NO: 77938 - protein, 9 aa, Artificial Sequence
  Description of Artificial Sequence: Synthetic peptide
  Seed: SSSSSSSTL (MAGC1_HUMAN)
SASSSSSTM

SEQ ID NO: 77939 - protein, 9 aa, Artificial Sequence
  Description of Artificial Sequence: Synthetic peptide
  Seed: ALKDVEERA (MAGC1_HUMAN)
ALKDVEERI

SEQ ID NO: 77940 - protein, 9 aa, Artificial Sequence
  Description of Artificial Sequence: Synthetic peptide
  Seed: KQPITKAEM (MAGC1_HUMAN)
KCPITKAEL

SEQ ID NO: 77941 - protein, 11 aa, Artificial Sequence
  Description of Artificial Sequence: Synthetic peptide
  Seed: SFFSSALLSIF (MAGC1_HUMAN)
SQFSSALLSIM

SEQ ID NO: 77942 - protein, 10 aa, Artificial Sequence
  Description of Artificial Sequence: Synthetic peptide
  Seed: TGYFPVIFRK (MAGC1_HUMAN)
TVYFPVIFRL

SEQ ID NO: 77943 - protein, 10 aa, Artificial Sequence
  Description of Artificial Sequence: Synthetic peptide
  Seed: KVDELARFLL (MAGC1_HUMAN)
KVDELARFLW

SEQ ID NO: 77944 - protein, 9 aa, Artificial Sequence
  Description of Artificial Sequence: Synthetic peptide
  Seed: SVLQIPVSA (MAGC1_HUMAN)
SALQIPVSK

SEQ ID NO: 77945 - protein, 10 aa, Artificial Sequence
  Description of Artificial Sequence: Synthetic peptide
  Seed: SLQIPVSPSF (MAGC1_HUMAN)
SEQIPVSPSY

SEQ ID NO: 77946 - protein, 8 aa, Artificial Sequence
  Description of Artificial Sequence: Synthetic peptide
  Seed: LQSPVISF (MAGC1_HUMAN)
LASPVISL

SEQ ID NO: 77947 - protein, 10 aa, Artificial Sequence
  Description of Artificial Sequence: Synthetic peptide
  Seed: PLQIPVSSSF (MAGC1_HUMAN)
PGQIPVSSSF

SEQ ID NO: 77948 - protein, 10 aa, Artificial Sequence
  Description of Artificial Sequence: Synthetic peptide
  Seed: ASSSVMSPSF (MAGC1_HUMAN)
AKSSVMSPSY

SEQ ID NO: 77949 - protein, 9 aa, Artificial Sequence
  Description of Artificial Sequence: Synthetic peptide
  Seed: SSPERTQST (MAGC1_HUMAN)
SIPERTQSL

SEQ ID NO: 77950 - protein, 9 aa, Artificial Sequence
  Description of Artificial Sequence: Synthetic peptide
  Seed: SPPRYEFLW (MAGC1_HUMAN)
SSPRYEFLF

SEQ ID NO: 77951 - protein, 10 aa, Artificial Sequence
  Description of Artificial Sequence: Synthetic peptide
  Seed: VSAASSSTLV (MAGC1_HUMAN)
VSAASSSTLF

SEQ ID NO: 77952 - protein, 9 aa, Artificial Sequence
  Description of Artificial Sequence: Synthetic peptide
  Seed: LQIPVSAAS (MAGC1_HUMAN)
LLIPVSAAI

SEQ ID NO: 77953 - protein, 10 aa, Artificial Sequence
  Description of Artificial Sequence: Synthetic peptide
  Seed: TGYFPVIFRK (MAGC1_HUMAN)
TDYFPVIFRR

SEQ ID NO: 77954 - protein, 10 aa, Artificial Sequence
  Description of Artificial Sequence: Synthetic peptide
  Seed: PLQIPGSPSF (MAGC1_HUMAN)
PLQIPGSPSY

SEQ ID NO: 77955 - protein, 10 aa, Artificial Sequence
  Description of Artificial Sequence: Synthetic peptide
  Seed: LLQIPMTSSF (MAGC1_HUMAN)
LEQIPMTSSL

SEQ ID NO: 77956 - protein, 11 aa, Artificial Sequence
  Description of Artificial Sequence: Synthetic peptide
  Seed: SPLQIPGSPSF (MAGC1_HUMAN)
SPLQIPGSPSM

SEQ ID NO: 77957 - protein, 9 aa, Artificial Sequence
  Description of Artificial Sequence: Synthetic peptide
  Seed: DVLSGIGVR (MAGC1_HUMAN)
DVLSGIGVF

SEQ ID NO: 77958 - protein, 9 aa, Artificial Sequence
  Description of Artificial Sequence: Synthetic peptide
  Seed: FQSSPERTH (MAGC1_HUMAN)
FQSSPERTL

SEQ ID NO: 77959 - protein, 9 aa, Artificial Sequence
  Description of Artificial Sequence: Synthetic peptide
  Seed: KVWVQEHYL (MAGC1_HUMAN)
KFWVQEHYY

SEQ ID NO: 77960 - protein, 11 aa, Artificial Sequence
  Description of Artificial Sequence: Synthetic peptide
  Seed: IPVSPSSSSTL (MAGC1_HUMAN)
IQVSPSSSSTF

SEQ ID NO: 77961 - protein, 9 aa, Artificial Sequence
  Description of Artificial Sequence: Synthetic peptide
  Seed: SMSPLYFPQ (MAGC1_HUMAN)
SLSPLYFPR

SEQ ID NO: 77962 - protein, 10 aa, Artificial Sequence
  Description of Artificial Sequence: Synthetic peptide
  Seed: IWDVLSGIGV (MAGC1_HUMAN)
IFDVLSGIGL

SEQ ID NO: 77963 - protein, 8 aa, Artificial Sequence
  Description of Artificial Sequence: Synthetic peptide
  Seed: FGISLREV (MAGC1_HUMAN)
FQISLREI

SEQ ID NO: 77964 - protein, 9 aa, Artificial Sequence
  Description of Artificial Sequence: Synthetic peptide
  Seed: SSSSSSTLL (MAGC1_HUMAN)
SISSSSTLY

SEQ ID NO: 77965 - protein, 9 aa, Artificial Sequence
  Description of Artificial Sequence: Synthetic peptide
  Seed: SSPESTQSP (MAGC1_HUMAN)
SLPESTQSV

SEQ ID NO: 77966 - protein, 9 aa, Artificial Sequence
  Description of Artificial Sequence: Synthetic peptide
  Seed: DEQGMSQNR (MAGC1_HUMAN)
DVQGMSQNR

SEQ ID NO: 77967 - protein, 9 aa, Artificial Sequence
  Description of Artificial Sequence: Synthetic peptide
  Seed: VSAASSSTL (MAGC1_HUMAN)
VAAASSSTH

SEQ ID NO: 77968 - protein, 10 aa, Artificial Sequence
  Description of Artificial Sequence: Synthetic peptide
  Seed: YTLDEKVDEL (MAGC1_HUMAN)
YLLDEKVDEA

SEQ ID NO: 77969 - protein, 10 aa, Artificial Sequence
  Description of Artificial Sequence: Synthetic peptide
  Seed: MSPLYFPQSP (MAGC1_HUMAN)
MPPLYFPQSA

SEQ ID NO: 77970 - protein, 9 aa, Artificial Sequence
  Description of Artificial Sequence: Synthetic peptide
  Seed: VSSSFSYTL (MAGC1_HUMAN)
VMSSFSYTT

SEQ ID NO: 77971 - protein, 9 aa, Artificial Sequence
  Description of Artificial Sequence: Synthetic peptide
  Seed: SSFFSYTLA (MAGC1_HUMAN)
SMFFSYTLA

SEQ ID NO: 77972 - protein, 10 aa, Artificial Sequence
  Description of Artificial Sequence: Synthetic peptide
  Seed: SFFSYTLASL (MAGC1_HUMAN)
SFFSYTLASY

SEQ ID NO: 77973 - protein, 9 aa, Artificial Sequence
  Description of Artificial Sequence: Synthetic peptide
  Seed: IPVSPSFSS (MAGC1_HUMAN)
IPVSPSFST

SEQ ID NO: 77974 - protein, 9 aa, Artificial Sequence
  Description of Artificial Sequence: Synthetic peptide
  Seed: SPLHSPQSP (MAGC1_HUMAN)
SPLHSPQSM

SEQ ID NO: 77975 - protein, 9 aa, Artificial Sequence
  Description of Artificial Sequence: Synthetic peptide
  Seed: VSPSFSSTL (MAGC1_HUMAN)
VYPSFSSTH

SEQ ID NO: 77976 - protein, 9 aa, Artificial Sequence
  Description of Artificial Sequence: Synthetic peptide
  Seed: KVDELARFL (MAGC1_HUMAN)
KTDELARFV

SEQ ID NO: 77977 - protein, 9 aa, Artificial Sequence
  Description of Artificial Sequence: Synthetic peptide
  Seed: FQSSLQSPV (MAGC1_HUMAN)
FMSSLQSPS

SEQ ID NO: 77978 - protein, 10 aa, Artificial Sequence
  Description of Artificial Sequence: Synthetic peptide
  Seed: LLQIPMTSSF (MAGC1_HUMAN)
LQQIPMTSSW

SEQ ID NO: 77979 - protein, 9 aa, Artificial Sequence
  Description of Artificial Sequence: Synthetic peptide
  Seed: LQIPVSSSS (MAGC1_HUMAN)
LQIPVSSSA

SEQ ID NO: 77980 - protein, 9 aa, Artificial Sequence
  Description of Artificial Sequence: Synthetic peptide
  Seed: ESDDTLYPL (MAGC1_HUMAN)
ESDDTLYPI

SEQ ID NO: 77981 - protein, 9 aa, Artificial Sequence
  Description of Artificial Sequence: Synthetic peptide
  Seed: FFSSALLSI (MAGC1_HUMAN)
FLSSALLSL

SEQ ID NO: 77982 - protein, 9 aa, Artificial Sequence
  Description of Artificial Sequence: Synthetic peptide
  Seed: RKVVEFLAM (MAGC1_HUMAN)
RMVVEFLAF

SEQ ID NO: 77983 - protein, 9 aa, Artificial Sequence
  Description of Artificial Sequence: Synthetic peptide
  Seed: SQNRLLILI (MAGC1_HUMAN)
SSNRLLILI

SEQ ID NO: 77984 - protein, 10 aa, Artificial Sequence
  Description of Artificial Sequence: Synthetic peptide
  Seed: FSSSTSLSPF (MAGC1_HUMAN)
FHSSTSLSPF

SEQ ID NO: 77985 - protein, 10 aa, Artificial Sequence
  Description of Artificial Sequence: Synthetic peptide
  Seed: WGPRAHSEVI (MAGC1_HUMAN)
WQPRAHSEVL

SEQ ID NO: 77986 - protein, 9 aa, Artificial Sequence
  Description of Artificial Sequence: Synthetic peptide
  Seed: SSPECTQST (MAGC1_HUMAN)
SFPECTQSL

SEQ ID NO: 77987 - protein, 9 aa, Artificial Sequence
  Description of Artificial Sequence: Synthetic peptide
  Seed: FFSYTLASL (MAGC1_HUMAN)
FSSYTLASA

SEQ ID NO: 77988 - protein, 10 aa, Artificial Sequence
  Description of Artificial Sequence: Synthetic peptide
  Seed: VSLFQSSPER (MAGC1_HUMAN)
VILFQSSPEK

SEQ ID NO: 77989 - protein, 10 aa, Artificial Sequence
  Description of Artificial Sequence: Synthetic peptide
  Seed: ILFGISLREV (MAGC1_HUMAN)
IVFGISLREV

SEQ ID NO: 77990 - protein, 11 aa, Artificial Sequence
  Description of Artificial Sequence: Synthetic peptide
  Seed: SSFFSSALLSI (MAGC1_HUMAN)
SAFFSSALLSW

SEQ ID NO: 77991 - protein, 10 aa, Artificial Sequence
  Description of Artificial Sequence: Synthetic peptide
  Seed: SSFSSTLLSI (MAGC1_HUMAN)
SAFSSTLLSH

SEQ ID NO: 77992 - protein, 9 aa, Artificial Sequence
  Description of Artificial Sequence: Synthetic peptide
  Seed: FEGFAQSPL (MAGC1_HUMAN)
FRGFAQSPF

SEQ ID NO: 77993 - protein, 9 aa, Artificial Sequence
  Description of Artificial Sequence: Synthetic peptide
  Seed: LQSPVISFS (MAGC1_HUMAN)
LMSPVISFT

SEQ ID NO: 77994 - protein, 9 aa, Artificial Sequence
  Description of Artificial Sequence: Synthetic peptide
  Seed: LARFLLLKY (MAGC1_HUMAN)
LSRFLLLKW

SEQ ID NO: 77995 - protein, 9 aa, Artificial Sequence
  Description of Artificial Sequence: Synthetic peptide
  Seed: REFIEILFG (MAGC1_HUMAN)
REFIEILFM

SEQ ID NO: 77996 - protein, 9 aa, Artificial Sequence
  Description of Artificial Sequence: Synthetic peptide
  Seed: SPLQIVPSL (MAGC1_HUMAN)
SPLQIVPSW

SEQ ID NO: 77997 - protein, 9 aa, Artificial Sequence
  Description of Artificial Sequence: Synthetic peptide
  Seed: WEDSLSPHY (MAGC1_HUMAN)
WFDSLSPHY

SEQ ID NO: 77998 - protein, 11 aa, Artificial Sequence
  Description of Artificial Sequence: Synthetic peptide
  Seed: RPVSSFFSYTL (MAGC1_HUMAN)
RSVSSFFSYTM

SEQ ID NO: 77999 - protein, 9 aa, Artificial Sequence
  Description of Artificial Sequence: Synthetic peptide
  Seed: LQIPVSPSF (MAGC1_HUMAN)
LTIPVSPSL

SEQ ID NO: 78000 - protein, 10 aa, Artificial Sequence
  Description of Artificial Sequence: Synthetic peptide
  Seed: DVLSGIGVRA (MAGC1_HUMAN)
DMLSGIGVRK

SEQ ID NO: 78001 - protein, 9 aa, Artificial Sequence
  Description of Artificial Sequence: Synthetic peptide
  Seed: CSSSTSLSL (MAGC1_HUMAN)
CKSSTSLSL

SEQ ID NO: 78002 - protein, 9 aa, Artificial Sequence
  Description of Artificial Sequence: Synthetic peptide
  Seed: EVDPDDSYV (MAGC1_HUMAN)
EADPDDSYM

SEQ ID NO: 78003 - protein, 11 aa, Artificial Sequence
  Description of Artificial Sequence: Synthetic peptide
  Seed: SLSQSSPVSSF (MAGC1_HUMAN)
SQSQSSPVSSW

SEQ ID NO: 78004 - protein, 11 aa, Artificial Sequence
  Description of Artificial Sequence: Synthetic peptide
  Seed: IPVSRSFSSTL (MAGC1_HUMAN)
ITVSRSFSSTM

SEQ ID NO: 78005 - protein, 10 aa, Artificial Sequence
  Description of Artificial Sequence: Synthetic peptide
  Seed: PLQIPVSRSF (MAGC1_HUMAN)
PIQIPVSRSF

SEQ ID NO: 78006 - protein, 9 aa, Artificial Sequence
  Description of Artificial Sequence: Synthetic peptide
  Seed: SSPERTHST (MAGC1_HUMAN)
SLPERTHSY

SEQ ID NO: 78007 - protein, 9 aa, Artificial Sequence
  Description of Artificial Sequence: Synthetic peptide
  Seed: RSFSSTLLS (MAGC1_HUMAN)
RSFSSTLLY

SEQ ID NO: 78008 - protein, 9 aa, Artificial Sequence
  Description of Artificial Sequence: Synthetic peptide
  Seed: FSSTLLSLF (MAGC1_HUMAN)
FWSTLLSLY

SEQ ID NO: 78009 - protein, 9 aa, Artificial Sequence
  Description of Artificial Sequence: Synthetic peptide
  Seed: KVVEFLAML (MAGC1_HUMAN)
KLVEFLAMF

SEQ ID NO: 78010 - protein, 10 aa, Artificial Sequence
  Description of Artificial Sequence: Synthetic peptide
  Seed: RAGREHFAFG (MAGC1_HUMAN)
RPGREHFAFK

SEQ ID NO: 78011 - protein, 10 aa, Artificial Sequence
  Description of Artificial Sequence: Synthetic peptide
  Seed: ISRYTGYFPV (MAGC1_HUMAN)
IMRYTGYFPM

SEQ ID NO: 78012 - protein, 10 aa, Artificial Sequence
  Description of Artificial Sequence: Synthetic peptide
  Seed: MTSSFSSTLL (MAGC1_HUMAN)
MCSSFSSTLW

SEQ ID NO: 78013 - protein, 9 aa, Artificial Sequence
  Description of Artificial Sequence: Synthetic peptide
  Seed: LQIPMTSSF (MAGC1_HUMAN)
LMIPMTSSH

SEQ ID NO: 78014 - protein, 9 aa, Artificial Sequence
  Description of Artificial Sequence: Synthetic peptide
  Seed: SSSVMSPSF (MAGC1_HUMAN)
SSSVMSPSM

SEQ ID NO: 78015 - protein, 10 aa, Artificial Sequence
  Description of Artificial Sequence: Synthetic peptide
  Seed: FPQSPLQIPQ (MAGC1_HUMAN)
FTQSPLQIPA

SEQ ID NO: 78016 - protein, 9 aa, Artificial Sequence
  Description of Artificial Sequence: Synthetic peptide
  Seed: LQNPASSFF (MAGC1_HUMAN)
LANPASSFM

SEQ ID NO: 78017 - protein, 10 aa, Artificial Sequence
  Description of Artificial Sequence: Synthetic peptide
  Seed: REFIEILFGI (MAGC1_HUMAN)
RPFIEILFGF

SEQ ID NO: 78018 - protein, 11 aa, Artificial Sequence
  Description of Artificial Sequence: Synthetic peptide
  Seed: AIIDTTDDSTA (MAGC1_HUMAN)
AMIDTTDDSTL

SEQ ID NO: 78019 - protein, 9 aa, Artificial Sequence
  Description of Artificial Sequence: Synthetic peptide
  Seed: EHFAFGEPR (MAGC1_HUMAN)
EMFAFGEPK

SEQ ID NO: 78020 - protein, 9 aa, Artificial Sequence
  Description of Artificial Sequence: Synthetic peptide
  Seed: LQIPVSSSS (MAGC1_HUMAN)
LRIPVSSSM

SEQ ID NO: 78021 - protein, 9 aa, Artificial Sequence
  Description of Artificial Sequence: Synthetic peptide
  Seed: SSSSTLLSL (MAGC1_HUMAN)
SVSSTLLSY

SEQ ID NO: 78022 - protein, 10 aa, Artificial Sequence
  Description of Artificial Sequence: Synthetic peptide
  Seed: FSSSTSLSPF (MAGC1_HUMAN)
FQSSTSLSPW

SEQ ID NO: 78023 - protein, 10 aa, Artificial Sequence
  Description of Artificial Sequence: Synthetic peptide
  Seed: GEDSSDPLQR (MAGC1_HUMAN)
GEDSSDPLQF

SEQ ID NO: 78024 - protein, 9 aa, Artificial Sequence
  Description of Artificial Sequence: Synthetic peptide
  Seed: MTSSFSSTL (MAGC1_HUMAN)
MISSFSSTI

SEQ ID NO: 78025 - protein, 9 aa, Artificial Sequence
  Description of Artificial Sequence: Synthetic peptide
  Seed: SQNRLLILI (MAGC1_HUMAN)
SENRLLILM

SEQ ID NO: 78026 - protein, 9 aa, Artificial Sequence
  Description of Artificial Sequence: Synthetic peptide
  Seed: RTQSTFEGF (MAGC1_HUMAN)
RIQSTFEGY

SEQ ID NO: 78027 - protein, 10 aa, Artificial Sequence
  Description of Artificial Sequence: Synthetic peptide
  Seed: SSFPSSTSSS (MAGC1_HUMAN)
SLFPSSTSSY

SEQ ID NO: 78028 - protein, 10 aa, Artificial Sequence
  Description of Artificial Sequence: Synthetic peptide
  Seed: YTLLSLFQSS (MAGC1_HUMAN)
YGLLSLFQSI

SEQ ID NO: 78029 - protein, 9 aa, Artificial Sequence
  Description of Artificial Sequence: Synthetic peptide
  Seed: FQSSPERTH (MAGC1_HUMAN)
FMSSPERTL

SEQ ID NO: 78030 - protein, 10 aa, Artificial Sequence
  Description of Artificial Sequence: Synthetic peptide
  Seed: YTLLSLFQSS (MAGC1_HUMAN)
YPLLSLFQSI

SEQ ID NO: 78031 - protein, 11 aa, Artificial Sequence
  Description of Artificial Sequence: Synthetic peptide
  Seed: IPVSRSFSSTL (MAGC1_HUMAN)
IHVSRSFSSTF

SEQ ID NO: 78032 - protein, 9 aa, Artificial Sequence
  Description of Artificial Sequence: Synthetic peptide
  Seed: VSSSSSSTL (MAGC1_HUMAN)
VRSSSSSTM

SEQ ID NO: 78033 - protein, 10 aa, Artificial Sequence
  Description of Artificial Sequence: Synthetic peptide
  Seed: FPSSYKDALK (MAGC1_HUMAN)
FYSSYKDALR

SEQ ID NO: 78034 - protein, 9 aa, Artificial Sequence
  Description of Artificial Sequence: Synthetic peptide
  Seed: FEGFAQSSL (MAGC1_HUMAN)
FQGFAQSSF

SEQ ID NO: 78035 - protein, 11 aa, Artificial Sequence
  Description of Artificial Sequence: Synthetic peptide
  Seed: SPLQIPVSPSS (MAGC1_HUMAN)
SALQIPVSPSF

SEQ ID NO: 78036 - protein, 9 aa, Artificial Sequence
  Description of Artificial Sequence: Synthetic peptide
  Seed: VSSSSSSTL (MAGC1_HUMAN)
VMSSSSSTF

SEQ ID NO: 78037 - protein, 9 aa, Artificial Sequence
  Description of Artificial Sequence: Synthetic peptide
  Seed: LSDEQGMSQ (MAGC1_HUMAN)
LLDEQGMSL

SEQ ID NO: 78038 - protein, 9 aa, Artificial Sequence
  Description of Artificial Sequence: Synthetic peptide
  Seed: SQNRLLILI (MAGC1_HUMAN)
SRNRLLILF

SEQ ID NO: 78039 - protein, 10 aa, Artificial Sequence
  Description of Artificial Sequence: Synthetic peptide
  Seed: FPQSLLQIPM (MAGC1_HUMAN)
FFQSLLQIPY

SEQ ID NO: 78040 - protein, 9 aa, Artificial Sequence
  Description of Artificial Sequence: Synthetic peptide
  Seed: SQSPPEGPV (MAGC1_HUMAN)
SESPPEGPA

SEQ ID NO: 78041 - protein, 10 aa, Artificial Sequence
  Description of Artificial Sequence: Synthetic peptide
  Seed: LSLFQSSPER (MAGC1_HUMAN)
LMLFQSSPER

SEQ ID NO: 78042 - protein, 9 aa, Artificial Sequence
  Description of Artificial Sequence: Synthetic peptide
  Seed: ISFSSSTSL (MAGC1_HUMAN)
IAFSSSTSL

SEQ ID NO: 78043 - protein, 9 aa, Artificial Sequence
  Description of Artificial Sequence: Synthetic peptide
  Seed: RAHSEVIKR (MAGC1_HUMAN)
RTHSEVIKY

SEQ ID NO: 78044 - protein, 8 aa, Artificial Sequence
  Description of Artificial Sequence: Synthetic peptide
  Seed: FSYTLASL (MAGC1_HUMAN)
FEYTLASV

SEQ ID NO: 78045 - protein, 10 aa, Artificial Sequence
  Description of Artificial Sequence: Synthetic peptide
  Seed: PLQIPGSPSF (MAGC1_HUMAN)
PCQIPGSPSF

SEQ ID NO: 78046 - protein, 10 aa, Artificial Sequence
  Description of Artificial Sequence: Synthetic peptide
  Seed: SLFQSFSERT (MAGC1_HUMAN)
SLFQSFSERV

SEQ ID NO: 78047 - protein, 9 aa, Artificial Sequence
  Description of Artificial Sequence: Synthetic peptide
  Seed: FSSTLVSLF (MAGC1_HUMAN)
FLSTLVSLM

SEQ ID NO: 78048 - protein, 9 aa, Artificial Sequence
  Description of Artificial Sequence: Synthetic peptide
  Seed: TESASSSVM (MAGC1_HUMAN)
TMSASSSVF

SEQ ID NO: 78049 - protein, 9 aa, Artificial Sequence
  Description of Artificial Sequence: Synthetic peptide
  Seed: SESPQSCPE (MAGC1_HUMAN)
SESPQSCPT

SEQ ID NO: 78050 - protein, 10 aa, Artificial Sequence
  Description of Artificial Sequence: Synthetic peptide
  Seed: SPLQIPGSPS (MAGC1_HUMAN)
SPLQIPGSPM

SEQ ID NO: 78051 - protein, 9 aa, Artificial Sequence
  Description of Artificial Sequence: Synthetic peptide
  Seed: RPVSSFFSY (MAGC1_HUMAN)
RRVSSFFSI

SEQ ID NO: 78052 - protein, 9 aa, Artificial Sequence
  Description of Artificial Sequence: Synthetic peptide
  Seed: SIIFIKGTY (MAGC1_HUMAN)
SYIFIKGTY

SEQ ID NO: 78053 - protein, 9 aa, Artificial Sequence
  Description of Artificial Sequence: Synthetic peptide
  Seed: LSPLHFPQF (MAGC1_HUMAN)
LGPLHFPQM

SEQ ID NO: 78054 - protein, 10 aa, Artificial Sequence
  Description of Artificial Sequence: Synthetic peptide
  Seed: YTLASLLQSS (MAGC1_HUMAN)
YCLASLLQSL

SEQ ID NO: 78055 - protein, 9 aa, Artificial Sequence
  Description of Artificial Sequence: Synthetic peptide
  Seed: YTSSSDTLL (MAGC1_HUMAN)
YQSSSDTLW

SEQ ID NO: 78056 - protein, 9 aa, Artificial Sequence
  Description of Artificial Sequence: Synthetic peptide
  Seed: SSPERTHST (MAGC1_HUMAN)
STPERTHSL

SEQ ID NO: 78057 - protein, 10 aa, Artificial Sequence
  Description of Artificial Sequence: Synthetic peptide
  Seed: ICSSSTSLSL (MAGC1_HUMAN)
ILSSSTSLSW

SEQ ID NO: 78058 - protein, 9 aa, Artificial Sequence
  Description of Artificial Sequence: Synthetic peptide
  Seed: RPVSSFFSY (MAGC1_HUMAN)
REVSSFFSF

SEQ ID NO: 78059 - protein, 11 aa, Artificial Sequence
  Description of Artificial Sequence: Synthetic peptide
  Seed: RPVSSFFSYTL (MAGC1_HUMAN)
RSVSSFFSYTI

SEQ ID NO: 78060 - protein, 10 aa, Artificial Sequence
  Description of Artificial Sequence: Synthetic peptide
  Seed: FSSSTSLSPF (MAGC1_HUMAN)
FQSSTSLSPF

SEQ ID NO: 78061 - protein, 9 aa, Artificial Sequence
  Description of Artificial Sequence: Synthetic peptide
  Seed: VPITFPSSY (MAGC1_HUMAN)
VPITFPSSP

SEQ ID NO: 78062 - protein, 9 aa, Artificial Sequence
  Description of Artificial Sequence: Synthetic peptide
  Seed: LQRPVSSFF (MAGC1_HUMAN)
LLRPVSSFF

SEQ ID NO: 78063 - protein, 9 aa, Artificial Sequence
  Description of Artificial Sequence: Synthetic peptide
  Seed: NTHSPLQIV (MAGC1_HUMAN)
NQHSPLQIV

SEQ ID NO: 78064 - protein, 9 aa, Artificial Sequence
  Description of Artificial Sequence: Synthetic peptide
  Seed: TLDEKVDEL (MAGC1_HUMAN)
TIDEKVDEI

SEQ ID NO: 78065 - protein, 10 aa, Artificial Sequence
  Description of Artificial Sequence: Synthetic peptide
  Seed: SFFSYTLASL (MAGC1_HUMAN)
SRFSYTLASL

SEQ ID NO: 78066 - protein, 9 aa, Artificial Sequence
  Description of Artificial Sequence: Synthetic peptide
  Seed: VSRSFSSTL (MAGC1_HUMAN)
VARSFSSTK

SEQ ID NO: 78067 - protein, 9 aa, Artificial Sequence
  Description of Artificial Sequence: Synthetic peptide
  Seed: AGREHFAFG (MAGC1_HUMAN)
ATREHFAFA

SEQ ID NO: 78068 - protein, 9 aa, Artificial Sequence
  Description of Artificial Sequence: Synthetic peptide
  Seed: FPSSYKDAL (MAGC1_HUMAN)
FPSSYKDAF

SEQ ID NO: 78069 - protein, 9 aa, Artificial Sequence
  Description of Artificial Sequence: Synthetic peptide
  Seed: FPSSTSSSL (MAGC1_HUMAN)
FSSSTSSSI

SEQ ID NO: 78070 - protein, 10 aa, Artificial Sequence
  Description of Artificial Sequence: Synthetic peptide
  Seed: SESLIESEPL (MAGC1_HUMAN)
SESLIESEPA

SEQ ID NO: 78071 - protein, 9 aa, Artificial Sequence
  Description of Artificial Sequence: Synthetic peptide
  Seed: RAGREHFAF (MAGC1_HUMAN)
RQGREHFAL

SEQ ID NO: 78072 - protein, 10 aa, Artificial Sequence
  Description of Artificial Sequence: Synthetic peptide
  Seed: ASEEVIWDVL (MAGC1_HUMAN)
AEEEVIWDVM

SEQ ID NO: 78073 - protein, 10 aa, Artificial Sequence
  Description of Artificial Sequence: Synthetic peptide
  Seed: YTGYFPVIFR (MAGC1_HUMAN)
YCGYFPVIFR

SEQ ID NO: 78074 - protein, 9 aa, Artificial Sequence
  Description of Artificial Sequence: Synthetic peptide
  Seed: TLDEKVDEL (MAGC1_HUMAN)
TSDEKVDEA

SEQ ID NO: 78075 - protein, 11 aa, Artificial Sequence
  Description of Artificial Sequence: Synthetic peptide
  Seed: SLIESEPLFTY (MAGC1_HUMAN)
SLIESEPLFTL

SEQ ID NO: 78076 - protein, 9 aa, Artificial Sequence
  Description of Artificial Sequence: Synthetic peptide
  Seed: ISRYTGYFP (MAGC1_HUMAN)
IFRYTGYFA

SEQ ID NO: 78077 - protein, 10 aa, Artificial Sequence
  Description of Artificial Sequence: Synthetic peptide
  Seed: FPQSVLQIPV (MAGC1_HUMAN)
FKQSVLQIPV

SEQ ID NO: 78078 - protein, 9 aa, Artificial Sequence
  Description of Artificial Sequence: Synthetic peptide
  Seed: TTDDSTATE (MAGC1_HUMAN)
TIDDSTATV

SEQ ID NO: 78079 - protein, 10 aa, Artificial Sequence
  Description of Artificial Sequence: Synthetic peptide
  Seed: RSFSSTLLSI (MAGC1_HUMAN)
RHFSSTLLSM

SEQ ID NO: 78080 - protein, 9 aa, Artificial Sequence
  Description of Artificial Sequence: Synthetic peptide
  Seed: FFSSALLSI (MAGC1_HUMAN)
FYSSALLSF

SEQ ID NO: 78081 - protein, 11 aa, Artificial Sequence
  Description of Artificial Sequence: Synthetic peptide
  Seed: TVPITFPSSYK (MAGC1_HUMAN)
TPPITFPSSYR

SEQ ID NO: 78082 - protein, 9 aa, Artificial Sequence
  Description of Artificial Sequence: Synthetic peptide
  Seed: VSPSSSSTL (MAGC1_HUMAN)
VIPSSSSTV

SEQ ID NO: 78083 - protein, 9 aa, Artificial Sequence
  Description of Artificial Sequence: Synthetic peptide
  Seed: KAREFIEIL (MAGC1_HUMAN)
KRREFIEII

SEQ ID NO: 78084 - protein, 10 aa, Artificial Sequence
  Description of Artificial Sequence: Synthetic peptide
  Seed: SSPPRYEFLW (MAGC1_HUMAN)
SWPPRYEFLM

SEQ ID NO: 78085 - protein, 10 aa, Artificial Sequence
  Description of Artificial Sequence: Synthetic peptide
  Seed: RSFSSTLLSI (MAGC1_HUMAN)
RQFSSTLLSH

SEQ ID NO: 78086 - protein, 9 aa, Artificial Sequence
  Description of Artificial Sequence: Synthetic peptide
  Seed: YVFVNTLDL (MAGC1_HUMAN)
YKFVNTLDL

SEQ ID NO: 78087 - protein, 8 aa, Artificial Sequence
  Description of Artificial Sequence: Synthetic peptide
  Seed: SQNRLLIL (MAGC1_HUMAN)
SQNRLLIY

SEQ ID NO: 78088 - protein, 10 aa, Artificial Sequence
  Description of Artificial Sequence: Synthetic peptide
  Seed: FAQSSLQIPV (MAGC1_HUMAN)
FYQSSLQIPI

SEQ ID NO: 78089 - protein, 11 aa, Artificial Sequence
  Description of Artificial Sequence: Synthetic peptide
  Seed: IPVSSSFSYTL (MAGC1_HUMAN)
IIVSSSFSYTY

SEQ ID NO: 78090 - protein, 10 aa, Artificial Sequence
  Description of Artificial Sequence: Synthetic peptide
  Seed: REFIEILFGI (MAGC1_HUMAN)
RYFIEILFGV

SEQ ID NO: 78091 - protein, 9 aa, Artificial Sequence
  Description of Artificial Sequence: Synthetic peptide
  Seed: LKNTVPITF (MAGC1_HUMAN)
LHNTVPITV

SEQ ID NO: 78092 - protein, 9 aa, Artificial Sequence
  Description of Artificial Sequence: Synthetic peptide
  Seed: LTKVWVQEH (MAGC1_HUMAN)
LSKVWVQEF

SEQ ID NO: 78093 - protein, 10 aa, Artificial Sequence
  Description of Artificial Sequence: Synthetic peptide
  Seed: YTLASLLQSS (MAGC1_HUMAN)
YGLASLLQSV

SEQ ID NO: 78094 - protein, 9 aa, Artificial Sequence
  Description of Artificial Sequence: Synthetic peptide
  Seed: SLPQSFPES (MAGC1_HUMAN)
SLPQSFPEL

SEQ ID NO: 78095 - protein, 10 aa, Artificial Sequence
  Description of Artificial Sequence: Synthetic peptide
  Seed: SFSYTLLSLF (MAGC1_HUMAN)
SGSYTLLSLY

SEQ ID NO: 78096 - protein, 9 aa, Artificial Sequence
  Description of Artificial Sequence: Synthetic peptide
  Seed: YTLASLLQS (MAGC1_HUMAN)
YILASLLQT

SEQ ID NO: 78097 - protein, 8 aa, Artificial Sequence
  Description of Artificial Sequence: Synthetic peptide
  Seed: SPLQSPVS (MAGC1_HUMAN)
SQLQSPVL

SEQ ID NO: 78098 - protein, 9 aa, Artificial Sequence
  Description of Artificial Sequence: Synthetic peptide
  Seed: VSSSFSYTL (MAGC1_HUMAN)
VVSSFSYTY

SEQ ID NO: 78099 - protein, 11 aa, Artificial Sequence
  Description of Artificial Sequence: Synthetic peptide
  Seed: RYTGYFPVIFR (MAGC1_HUMAN)
RFTGYFPVIFR

SEQ ID NO: 78100 - protein, 9 aa, Artificial Sequence
  Description of Artificial Sequence: Synthetic peptide
  Seed: IESEPLFTY (MAGC1_HUMAN)
IQSEPLFTW

SEQ ID NO: 78101 - protein, 9 aa, Artificial Sequence
  Description of Artificial Sequence: Synthetic peptide
  Seed: FPSSTSSSL (MAGC1_HUMAN)
FASSTSSSY

SEQ ID NO: 78102 - protein, 9 aa, Artificial Sequence
  Description of Artificial Sequence: Synthetic peptide
  Seed: MTSSFSSTL (MAGC1_HUMAN)
MESSFSSTF

SEQ ID NO: 78103 - protein, 9 aa, Artificial Sequence
  Description of Artificial Sequence: Synthetic peptide
  Seed: LQIPVSAAS (MAGC1_HUMAN)
LQIPVSAAI

SEQ ID NO: 78104 - protein, 10 aa, Artificial Sequence
  Description of Artificial Sequence: Synthetic peptide
  Seed: FPQSVLQIPV (MAGC1_HUMAN)
FCQSVLQIPV

SEQ ID NO: 78105 - protein, 9 aa, Artificial Sequence
  Description of Artificial Sequence: Synthetic peptide
  Seed: FPSSTSSSL (MAGC1_HUMAN)
FCSSTSSSL

SEQ ID NO: 78106 - protein, 10 aa, Artificial Sequence
  Description of Artificial Sequence: Synthetic peptide
  Seed: RTHSTFEGFP (MAGC1_HUMAN)
RVHSTFEGFA

SEQ ID NO: 78107 - protein, 9 aa, Artificial Sequence
  Description of Artificial Sequence: Synthetic peptide
  Seed: ISFSSSTSL (MAGC1_HUMAN)
IPFSSSTSW

SEQ ID NO: 78108 - protein, 9 aa, Artificial Sequence
  Description of Artificial Sequence: Synthetic peptide
  Seed: FSSTLLSIL (MAGC1_HUMAN)
FESTLLSIF

SEQ ID NO: 78109 - protein, 9 aa, Artificial Sequence
  Description of Artificial Sequence: Synthetic peptide
  Seed: MPTAGMPSL (MAGC1_HUMAN)
MTTAGMPSM

SEQ ID NO: 78110 - protein, 9 aa, Artificial Sequence
  Description of Artificial Sequence: Synthetic peptide
  Seed: KDVEERAQA (MAGC1_HUMAN)
KDVEERAQL

SEQ ID NO: 78111 - protein, 9 aa, Artificial Sequence
  Description of Artificial Sequence: Synthetic peptide
  Seed: IIDTTDDST (MAGC1_HUMAN)
IFDTTDDSV

SEQ ID NO: 78112 - protein, 9 aa, Artificial Sequence
  Description of Artificial Sequence: Synthetic peptide
  Seed: HFPQSPPEW (MAGC1_HUMAN)
HRPQSPPEF

SEQ ID NO: 78113 - protein, 9 aa, Artificial Sequence
  Description of Artificial Sequence: Synthetic peptide
  Seed: SPPEGPVQS (MAGC1_HUMAN)
SAPEGPVQY

SEQ ID NO: 78114 - protein, 9 aa, Artificial Sequence
  Description of Artificial Sequence: Synthetic peptide
  Seed: MGDKDMPTA (MAGC1_HUMAN)
MIDKDMPTF

SEQ ID NO: 78115 - protein, 10 aa, Artificial Sequence
  Description of Artificial Sequence: Synthetic peptide
  Seed: FSSSTSLSPF (MAGC1_HUMAN)
FLSSTSLSPY

SEQ ID NO: 78116 - protein, 9 aa, Artificial Sequence
  Description of Artificial Sequence: Synthetic peptide
  Seed: SRYTGYFPV (MAGC1_HUMAN)
SRYTGYFPA

SEQ ID NO: 78117 - protein, 9 aa, Artificial Sequence
  Description of Artificial Sequence: Synthetic peptide
  Seed: SSSSSSSTL (MAGC1_HUMAN)
SHSSSSSTY

SEQ ID NO: 78118 - protein, 9 aa, Artificial Sequence
  Description of Artificial Sequence: Synthetic peptide
  Seed: FSYTLASLL (MAGC1_HUMAN)
FWYTLASLF

SEQ ID NO: 78119 - protein, 9 aa, Artificial Sequence
  Description of Artificial Sequence: Synthetic peptide
  Seed: SYKDALKDV (MAGC1_HUMAN)
SFKDALKDL

SEQ ID NO: 78120 - protein, 9 aa, Artificial Sequence
  Description of Artificial Sequence: Synthetic peptide
  Seed: RYTGYFPVI (MAGC1_HUMAN)
RFTGYFPVW

SEQ ID NO: 78121 - protein, 11 aa, Artificial Sequence
  Description of Artificial Sequence: Synthetic peptide
  Seed: IPVSRSFSSTL (MAGC1_HUMAN)
IEVSRSFSSTF

SEQ ID NO: 78122 - protein, 9 aa, Artificial Sequence
  Description of Artificial Sequence: Synthetic peptide
  Seed: IPVSSSFSY (MAGC1_HUMAN)
IVVSSSFSW

SEQ ID NO: 78123 - protein, 10 aa, Artificial Sequence
  Description of Artificial Sequence: Synthetic peptide
  Seed: PLQIPMTSSF (MAGC1_HUMAN)
PKQIPMTSSM

SEQ ID NO: 78124 - protein, 10 aa, Artificial Sequence
  Description of Artificial Sequence: Synthetic peptide
  Seed: RKVVEFLAML (MAGC1_HUMAN)
RDVVEFLAML

SEQ ID NO: 78125 - protein, 10 aa, Artificial Sequence
  Description of Artificial Sequence: Synthetic peptide
  Seed: REHFAFGEPR (MAGC1_HUMAN)
RYHFAFGEPK

SEQ ID NO: 78126 - protein, 9 aa, Artificial Sequence
  Description of Artificial Sequence: Synthetic peptide
  Seed: NTVPITFPS (MAGC1_HUMAN)
NLVPITFPA

SEQ ID NO: 78127 - protein, 9 aa, Artificial Sequence
  Description of Artificial Sequence: Synthetic peptide
  Seed: EVPNSSPPR (MAGC1_HUMAN)
EAPNSSPPR

SEQ ID NO: 78128 - protein, 10 aa, Artificial Sequence
  Description of Artificial Sequence: Synthetic peptide
  Seed: VSPSSSSTLL (MAGC1_HUMAN)
VAPSSSSTLW

SEQ ID NO: 78129 - protein, 10 aa, Artificial Sequence
  Description of Artificial Sequence: Synthetic peptide
  Seed: SVLQIPVSAA (MAGC1_HUMAN)
STLQIPVSAI

SEQ ID NO: 78130 - protein, 9 aa, Artificial Sequence
  Description of Artificial Sequence: Synthetic peptide
  Seed: LQIPMTSSF (MAGC1_HUMAN)
LWIPMTSSM

SEQ ID NO: 78131 - protein, 10 aa, Artificial Sequence
  Description of Artificial Sequence: Synthetic peptide
  Seed: REFIEILFGI (MAGC1_HUMAN)
RSFIEILFGL

SEQ ID NO: 78132 - protein, 9 aa, Artificial Sequence
  Description of Artificial Sequence: Synthetic peptide
  Seed: VSSFFSYTL (MAGC1_HUMAN)
VVSFFSYTA

SEQ ID NO: 78133 - protein, 9 aa, Artificial Sequence
  Description of Artificial Sequence: Synthetic peptide
  Seed: VSRSFSSTL (MAGC1_HUMAN)
VSRSFSSTY

SEQ ID NO: 78134 - protein, 9 aa, Artificial Sequence
  Description of Artificial Sequence: Synthetic peptide
  Seed: FEGFAQSSL (MAGC1_HUMAN)
FMGFAQSSY

SEQ ID NO: 78135 - protein, 9 aa, Artificial Sequence
  Description of Artificial Sequence: Synthetic peptide
  Seed: LQIPGSPSF (MAGC1_HUMAN)
LSIPGSPSY

SEQ ID NO: 78136 - protein, 9 aa, Artificial Sequence
  Description of Artificial Sequence: Synthetic peptide
  Seed: VIWDVLSGI (MAGC1_HUMAN)
VIWDVLSGR

SEQ ID NO: 78137 - protein, 11 aa, Artificial Sequence
  Description of Artificial Sequence: Synthetic peptide
  Seed: ISRYTGYFPVI (MAGC1_HUMAN)
IQRYTGYFPVF

SEQ ID NO: 78138 - protein, 10 aa, Artificial Sequence
  Description of Artificial Sequence: Synthetic peptide
  Seed: SLQIPVSPSF (MAGC1_HUMAN)
SWQIPVSPSM

SEQ ID NO: 78139 - protein, 10 aa, Artificial Sequence
  Description of Artificial Sequence: Synthetic peptide
  Seed: KAREFIEILF (MAGC1_HUMAN)
KMREFIEILA

SEQ ID NO: 78140 - protein, 9 aa, Artificial Sequence
  Description of Artificial Sequence: Synthetic peptide
  Seed: TTDDSTATE (MAGC1_HUMAN)
TFDDSTATV

SEQ ID NO: 78141 - protein, 10 aa, Artificial Sequence
  Description of Artificial Sequence: Synthetic peptide
  Seed: ASSSVMSPSF (MAGC1_HUMAN)
AQSSVMSPSF

SEQ ID NO: 78142 - protein, 10 aa, Artificial Sequence
  Description of Artificial Sequence: Synthetic peptide
  Seed: LQIPGSPSFS (MAGC1_HUMAN)
LQIPGSPSFA

SEQ ID NO: 78143 - protein, 9 aa, Artificial Sequence
  Description of Artificial Sequence: Synthetic peptide
  Seed: EILFGISLR (MAGC1_HUMAN)
EGLFGISLR

SEQ ID NO: 78144 - protein, 9 aa, Artificial Sequence
  Description of Artificial Sequence: Synthetic peptide
  Seed: AQSPLQIPV (MAGC1_HUMAN)
AHSPLQIPM

SEQ ID NO: 78145 - protein, 10 aa, Artificial Sequence
  Description of Artificial Sequence: Synthetic peptide
  Seed: YTLASLLQSS (MAGC1_HUMAN)
YILASLLQSM

SEQ ID NO: 78146 - protein, 10 aa, Artificial Sequence
  Description of Artificial Sequence: Synthetic peptide
  Seed: FAQSSLQIPV (MAGC1_HUMAN)
FLQSSLQIPV

SEQ ID NO: 78147 - protein, 10 aa, Artificial Sequence
  Description of Artificial Sequence: Synthetic peptide
  Seed: ISRYTGYFPV (MAGC1_HUMAN)
IHRYTGYFPM

SEQ ID NO: 78148 - protein, 9 aa, Artificial Sequence
  Description of Artificial Sequence: Synthetic peptide
  Seed: GFPQSPLQI (MAGC1_HUMAN)
GYPQSPLQY

SEQ ID NO: 78149 - protein, 10 aa, Artificial Sequence
  Description of Artificial Sequence: Synthetic peptide
  Seed: RSFSSTLLSI (MAGC1_HUMAN)
RIFSSTLLSY

SEQ ID NO: 78150 - protein, 10 aa, Artificial Sequence
  Description of Artificial Sequence: Synthetic peptide
  Seed: RKVVEFLAML (MAGC1_HUMAN)
RLVVEFLAMT

SEQ ID NO: 78151 - protein, 9 aa, Artificial Sequence
  Description of Artificial Sequence: Synthetic peptide
  Seed: LQIPVSRSF (MAGC1_HUMAN)
LLIPVSRSM

SEQ ID NO: 78152 - protein, 10 aa, Artificial Sequence
  Description of Artificial Sequence: Synthetic peptide
  Seed: VSAASSSTLV (MAGC1_HUMAN)
VMAASSSTLL

SEQ ID NO: 78153 - protein, 10 aa, Artificial Sequence
  Description of Artificial Sequence: Synthetic peptide
  Seed: FSSTLVSLFQ (MAGC1_HUMAN)
FASTLVSLFY

SEQ ID NO: 78154 - protein, 9 aa, Artificial Sequence
  Description of Artificial Sequence: Synthetic peptide
  Seed: YTSSSDTLL (MAGC1_HUMAN)
YISSSDTLV

SEQ ID NO: 78155 - protein, 10 aa, Artificial Sequence
  Description of Artificial Sequence: Synthetic peptide
  Seed: LSLFQSFSER (MAGC1_HUMAN)
LILFQSFSER

SEQ ID NO: 78156 - protein, 9 aa, Artificial Sequence
  Description of Artificial Sequence: Synthetic peptide
  Seed: SPPEGENTH (MAGC1_HUMAN)
SSPEGENTL

SEQ ID NO: 78157 - protein, 9 aa, Artificial Sequence
  Description of Artificial Sequence: Synthetic peptide
  Seed: SPLQRPVSS (MAGC1_HUMAN)
SILQRPVSM

SEQ ID NO: 78158 - protein, 9 aa, Artificial Sequence
  Description of Artificial Sequence: Synthetic peptide
  Seed: VSSSFSYTL (MAGC1_HUMAN)
VKSSFSYTI

SEQ ID NO: 78159 - protein, 11 aa, Artificial Sequence
  Description of Artificial Sequence: Synthetic peptide
  Seed: STFEGFAQSSL (MAGC1_HUMAN)
SLFEGFAQSST

SEQ ID NO: 78160 - protein, 9 aa, Artificial Sequence
  Description of Artificial Sequence: Synthetic peptide
  Seed: AGREHFAFG (MAGC1_HUMAN)
AIREHFAFR

SEQ ID NO: 78161 - protein, 10 aa, Artificial Sequence
  Description of Artificial Sequence: Synthetic peptide
  Seed: LQIVPSLPEW (MAGC1_HUMAN)
LRIVPSLPEF

SEQ ID NO: 78162 - protein, 10 aa, Artificial Sequence
  Description of Artificial Sequence: Synthetic peptide
  Seed: SSFPSSTSSS (MAGC1_HUMAN)
STFPSSTSSL

SEQ ID NO: 78163 - protein, 10 aa, Artificial Sequence
  Description of Artificial Sequence: Synthetic peptide
  Seed: LAMLKNTVPI (MAGC1_HUMAN)
LTMLKNTVPM

SEQ ID NO: 78164 - protein, 10 aa, Artificial Sequence
  Description of Artificial Sequence: Synthetic peptide
  Seed: MPTAGMPSLL (MAGC1_HUMAN)
MATAGMPSLL

SEQ ID NO: 78165 - protein, 10 aa, Artificial Sequence
  Description of Artificial Sequence: Synthetic peptide
  Seed: YTLASLLQSS (MAGC1_HUMAN)
YELASLLQSA

SEQ ID NO: 78166 - protein, 9 aa, Artificial Sequence
  Description of Artificial Sequence: Synthetic peptide
  Seed: SSPECTQST (MAGC1_HUMAN)
SVPECTQSI

SEQ ID NO: 78167 - protein, 10 aa, Artificial Sequence
  Description of Artificial Sequence: Synthetic peptide
  Seed: FPQSLLQIPM (MAGC1_HUMAN)
FVQSLLQIPV

SEQ ID NO: 78168 - protein, 9 aa, Artificial Sequence
  Description of Artificial Sequence: Synthetic peptide
  Seed: RSFSSTLLS (MAGC1_HUMAN)
RWFSSTLLK

SEQ ID NO: 78169 - protein, 9 aa, Artificial Sequence
  Description of Artificial Sequence: Synthetic peptide
  Seed: LILILSIIF (MAGC1_HUMAN)
LTLILSIIF

SEQ ID NO: 78170 - protein, 10 aa, Artificial Sequence
  Description of Artificial Sequence: Synthetic peptide
  Seed: YTLDEKVDEL (MAGC1_HUMAN)
YSLDEKVDEW

SEQ ID NO: 78171 - protein, 9 aa, Artificial Sequence
  Description of Artificial Sequence: Synthetic peptide
  Seed: FFSYTLASL (MAGC1_HUMAN)
FCSYTLASY

SEQ ID NO: 78172 - protein, 10 aa, Artificial Sequence
  Description of Artificial Sequence: Synthetic peptide
  Seed: RAGREHFAFG (MAGC1_HUMAN)
RTGREHFAFP

SEQ ID NO: 78173 - protein, 10 aa, Artificial Sequence
  Description of Artificial Sequence: Synthetic peptide
  Seed: SSSSSSSTLL (MAGC1_HUMAN)
SISSSSSTLW

SEQ ID NO: 78174 - protein, 10 aa, Artificial Sequence
  Description of Artificial Sequence: Synthetic peptide
  Seed: PLQIPGSPSF (MAGC1_HUMAN)
PCQIPGSPSY

SEQ ID NO: 78175 - protein, 9 aa, Artificial Sequence
  Description of Artificial Sequence: Synthetic peptide
  Seed: VSSSFSYTL (MAGC1_HUMAN)
VASSFSYTW

SEQ ID NO: 78176 - protein, 9 aa, Artificial Sequence
  Description of Artificial Sequence: Synthetic peptide
  Seed: VSSFFSYTL (MAGC1_HUMAN)
VRSFFSYTF

SEQ ID NO: 78177 - protein, 9 aa, Artificial Sequence
  Description of Artificial Sequence: Synthetic peptide
  Seed: DPDDSYVFV (MAGC1_HUMAN)
DTDDSYVFM

SEQ ID NO: 78178 - protein, 10 aa, Artificial Sequence
  Description of Artificial Sequence: Synthetic peptide
  Seed: LQIPVSRSFS (MAGC1_HUMAN)
LIIPVSRSFY

SEQ ID NO: 78179 - protein, 10 aa, Artificial Sequence
  Description of Artificial Sequence: Synthetic peptide
  Seed: AASSSTLVSI (MAGC1_HUMAN)
ATSSSTLVSL

SEQ ID NO: 78180 - protein, 9 aa, Artificial Sequence
  Description of Artificial Sequence: Synthetic peptide
  Seed: SPESPLQSP (MAGC1_HUMAN)
SPESPLQSV

SEQ ID NO: 78181 - protein, 10 aa, Artificial Sequence
  Description of Artificial Sequence: Synthetic peptide
  Seed: STFEGFPQSL (MAGC1_HUMAN)
SHFEGFPQSL

SEQ ID NO: 78182 - protein, 9 aa, Artificial Sequence
  Description of Artificial Sequence: Synthetic peptide
  Seed: AQSPLQSPV (MAGC1_HUMAN)
ATSPLQSPF

SEQ ID NO: 78183 - protein, 10 aa, Artificial Sequence
  Description of Artificial Sequence: Synthetic peptide
  Seed: RYTGYFPVIF (MAGC1_HUMAN)
RRTGYFPVIW

SEQ ID NO: 78184 - protein, 11 aa, Artificial Sequence
  Description of Artificial Sequence: Synthetic peptide
  Seed: FLAMLKNTVPI (MAGC1_HUMAN)
FHAMLKNTVPA

SEQ ID NO: 78185 - protein, 9 aa, Artificial Sequence
  Description of Artificial Sequence: Synthetic peptide
  Seed: NSSPPRYEF (MAGC1_HUMAN)
NRSPPRYEL

SEQ ID NO: 78186 - protein, 9 aa, Artificial Sequence
  Description of Artificial Sequence: Synthetic peptide
  Seed: SSPESAQSA (MAGC1_HUMAN)
STPESAQSI

SEQ ID NO: 78187 - protein, 9 aa, Artificial Sequence
  Description of Artificial Sequence: Synthetic peptide
  Seed: SRSFSSTLL (MAGC1_HUMAN)
SQSFSSTLY

SEQ ID NO: 78188 - protein, 10 aa, Artificial Sequence
  Description of Artificial Sequence: Synthetic peptide
  Seed: LSQSSPVSSF (MAGC1_HUMAN)
LRQSSPVSSF

SEQ ID NO: 78189 - protein, 11 aa, Artificial Sequence
  Description of Artificial Sequence: Synthetic peptide
  Seed: IPVSAASSSTL (MAGC1_HUMAN)
INVSAASSSTW

SEQ ID NO: 78190 - protein, 10 aa, Artificial Sequence
  Description of Artificial Sequence: Synthetic peptide
  Seed: AEMLTNVISR (MAGC1_HUMAN)
ASMLTNVISK

SEQ ID NO: 78191 - protein, 9 aa, Artificial Sequence
  Description of Artificial Sequence: Synthetic peptide
  Seed: SFFSYTLAS (MAGC1_HUMAN)
SRFSYTLAL

SEQ ID NO: 78192 - protein, 9 aa, Artificial Sequence
  Description of Artificial Sequence: Synthetic peptide
  Seed: SSPERTHST (MAGC1_HUMAN)
SAPERTHSM

SEQ ID NO: 78193 - protein, 9 aa, Artificial Sequence
  Description of Artificial Sequence: Synthetic peptide
  Seed: SSFPSSTSS (MAGC1_HUMAN)
SNFPSSTSF

SEQ ID NO: 78194 - protein, 9 aa, Artificial Sequence
  Description of Artificial Sequence: Synthetic peptide
  Seed: KVVEFLAML (MAGC1_HUMAN)
KIVEFLAMA

SEQ ID NO: 78195 - protein, 9 aa, Artificial Sequence
  Description of Artificial Sequence: Synthetic peptide
  Seed: SSPERTQST (MAGC1_HUMAN)
SRPERTQSV

SEQ ID NO: 78196 - protein, 9 aa, Artificial Sequence
  Description of Artificial Sequence: Synthetic peptide
  Seed: LQIPVSSSS (MAGC1_HUMAN)
LAIPVSSSI

SEQ ID NO: 78197 - protein, 11 aa, Artificial Sequence
  Description of Artificial Sequence: Synthetic peptide
  Seed: YTGYFPVIFRK (MAGC1_HUMAN)
YYGYFPVIFRR

SEQ ID NO: 78198 - protein, 10 aa, Artificial Sequence
  Description of Artificial Sequence: Synthetic peptide
  Seed: SPVSICSSST (MAGC1_HUMAN)
SPVSICSSSV

SEQ ID NO: 78199 - protein, 9 aa, Artificial Sequence
  Description of Artificial Sequence: Synthetic peptide
  Seed: EHFAFGEPR (MAGC1_HUMAN)
EVFAFGEPR

SEQ ID NO: 78200 - protein, 9 aa, Artificial Sequence
  Description of Artificial Sequence: Synthetic peptide
  Seed: SPPEGENTH (MAGC1_HUMAN)
SQPEGENTY

SEQ ID NO: 78201 - protein, 9 aa, Artificial Sequence
  Description of Artificial Sequence: Synthetic peptide
  Seed: RYTGYFPVI (MAGC1_HUMAN)
RVTGYFPVY

SEQ ID NO: 78202 - protein, 11 aa, Artificial Sequence
  Description of Artificial Sequence: Synthetic peptide
  Seed: TTDDSTATESA (MAGC1_HUMAN)
TMDDSTATESI

SEQ ID NO: 78203 - protein, 11 aa, Artificial Sequence
  Description of Artificial Sequence: Synthetic peptide
  Seed: RYTGYFPVIFR (MAGC1_HUMAN)
RFTGYFPVIFK

SEQ ID NO: 78204 - protein, 9 aa, Artificial Sequence
  Description of Artificial Sequence: Synthetic peptide
  Seed: YQVKQPITK (MAGC1_HUMAN)
YQVKQPITL

SEQ ID NO: 78205 - protein, 10 aa, Artificial Sequence
  Description of Artificial Sequence: Synthetic peptide
  Seed: YTLDEKVDEL (MAGC1_HUMAN)
YWLDEKVDEI

SEQ ID NO: 78206 - protein, 9 aa, Artificial Sequence
  Description of Artificial Sequence: Synthetic peptide
  Seed: RAGREHFAF (MAGC1_HUMAN)
RTGREHFAW

SEQ ID NO: 78207 - protein, 10 aa, Artificial Sequence
  Description of Artificial Sequence: Synthetic peptide
  Seed: WGPRAHSEVI (MAGC1_HUMAN)
WIPRAHSEVV

SEQ ID NO: 78208 - protein, 9 aa, Artificial Sequence
  Description of Artificial Sequence: Synthetic peptide
  Seed: TSLSLPQSF (MAGC1_HUMAN)
TMLSLPQSI

SEQ ID NO: 78209 - protein, 11 aa, Artificial Sequence
  Description of Artificial Sequence: Synthetic peptide
  Seed: REVDPDDSYVF (MAGC1_HUMAN)
RTVDPDDSYVF

SEQ ID NO: 78210 - protein, 9 aa, Artificial Sequence
  Description of Artificial Sequence: Synthetic peptide
  Seed: FSSALLSIF (MAGC1_HUMAN)
FFSALLSIF

SEQ ID NO: 78211 - protein, 10 aa, Artificial Sequence
  Description of Artificial Sequence: Synthetic peptide
  Seed: LAMLKNTVPI (MAGC1_HUMAN)
LVMLKNTVPF

SEQ ID NO: 78212 - protein, 10 aa, Artificial Sequence
  Description of Artificial Sequence: Synthetic peptide
  Seed: MPTAGMPSLL (MAGC1_HUMAN)
MYTAGMPSLW

SEQ ID NO: 78213 - protein, 10 aa, Artificial Sequence
  Description of Artificial Sequence: Synthetic peptide
  Seed: LAMLKNTVPI (MAGC1_HUMAN)
LQMLKNTVPI

SEQ ID NO: 78214 - protein, 9 aa, Artificial Sequence
  Description of Artificial Sequence: Synthetic peptide
  Seed: AQSPLQRPV (MAGC1_HUMAN)
AESPLQRPT

SEQ ID NO: 78215 - protein, 11 aa, Artificial Sequence
  Description of Artificial Sequence: Synthetic peptide
  Seed: SPLQIPVSRSF (MAGC1_HUMAN)
STLQIPVSRSY

SEQ ID NO: 78216 - protein, 10 aa, Artificial Sequence
  Description of Artificial Sequence: Synthetic peptide
  Seed: SSPESTQSPF (MAGC1_HUMAN)
SHPESTQSPM

SEQ ID NO: 78217 - protein, 9 aa, Artificial Sequence
  Description of Artificial Sequence: Synthetic peptide
  Seed: TLASLLQSS (MAGC1_HUMAN)
TLASLLQSV

SEQ ID NO: 78218 - protein, 9 aa, Artificial Sequence
  Description of Artificial Sequence: Synthetic peptide
  Seed: FSEESSSPV (MAGC1_HUMAN)
FSEESSSPY

SEQ ID NO: 78219 - protein, 9 aa, Artificial Sequence
  Description of Artificial Sequence: Synthetic peptide
  Seed: VSAASSSTL (MAGC1_HUMAN)
VGAASSSTF

SEQ ID NO: 78220 - protein, 10 aa, Artificial Sequence
  Description of Artificial Sequence: Synthetic peptide
  Seed: LQIPVSSSFS (MAGC1_HUMAN)
LMIPVSSSFN

SEQ ID NO: 78221 - protein, 9 aa, Artificial Sequence
  Description of Artificial Sequence: Synthetic peptide
  Seed: LARFLLLKY (MAGC1_HUMAN)
LTRFLLLKW

SEQ ID NO: 78222 - protein, 9 aa, Artificial Sequence
  Description of Artificial Sequence: Synthetic peptide
  Seed: VSAASSSTL (MAGC1_HUMAN)
VFAASSSTL

SEQ ID NO: 78223 - protein, 10 aa, Artificial Sequence
  Description of Artificial Sequence: Synthetic peptide
  Seed: HESPQSPPEG (MAGC1_HUMAN)
HESPQSPPEL

SEQ ID NO: 78224 - protein, 9 aa, Artificial Sequence
  Description of Artificial Sequence: Synthetic peptide
  Seed: FPSSYKDAL (MAGC1_HUMAN)
FASSYKDAI

SEQ ID NO: 78225 - protein, 10 aa, Artificial Sequence
  Description of Artificial Sequence: Synthetic peptide
  Seed: WGPRAHSEVI (MAGC1_HUMAN)
WSPRAHSEVV

SEQ ID NO: 78226 - protein, 10 aa, Artificial Sequence
  Description of Artificial Sequence: Synthetic peptide
  Seed: RKVVEFLAML (MAGC1_HUMAN)
RTVVEFLAMA

SEQ ID NO: 78227 - protein, 9 aa, Artificial Sequence
  Description of Artificial Sequence: Synthetic peptide
  Seed: TLDEKVDEL (MAGC1_HUMAN)
TEDEKVDEF

SEQ ID NO: 78228 - protein, 9 aa, Artificial Sequence
  Description of Artificial Sequence: Synthetic peptide
  Seed: YVFVNTLDL (MAGC1_HUMAN)
YSFVNTLDY

SEQ ID NO: 78229 - protein, 9 aa, Artificial Sequence
  Description of Artificial Sequence: Synthetic peptide
  Seed: LQIPVSSSS (MAGC1_HUMAN)
LYIPVSSSI

SEQ ID NO: 78230 - protein, 9 aa, Artificial Sequence
  Description of Artificial Sequence: Synthetic peptide
  Seed: SFSSTLVSL (MAGC1_HUMAN)
SLSSTLVSA

SEQ ID NO: 78231 - protein, 10 aa, Artificial Sequence
  Description of Artificial Sequence: Synthetic peptide
  Seed: FFSYTLASLL (MAGC1_HUMAN)
FASYTLASLF

SEQ ID NO: 78232 - protein, 10 aa, Artificial Sequence
  Description of Artificial Sequence: Synthetic peptide
  Seed: ITKAEMLTNV (MAGC1_HUMAN)
ILKAEMLTNL

SEQ ID NO: 78233 - protein, 10 aa, Artificial Sequence
  Description of Artificial Sequence: Synthetic peptide
  Seed: FFSYTLASLL (MAGC1_HUMAN)
FCSYTLASLW

SEQ ID NO: 78234 - protein, 9 aa, Artificial Sequence
  Description of Artificial Sequence: Synthetic peptide
  Seed: MPTAGMPSL (MAGC1_HUMAN)
MSTAGMPSI

SEQ ID NO: 78235 - protein, 9 aa, Artificial Sequence
  Description of Artificial Sequence: Synthetic peptide
  Seed: SPQSPPEGP (MAGC1_HUMAN)
SAQSPPEGY

SEQ ID NO: 78236 - protein, 9 aa, Artificial Sequence
  Description of Artificial Sequence: Synthetic peptide
  Seed: IIDTTDDST (MAGC1_HUMAN)
INDTTDDSL

SEQ ID NO: 78237 - protein, 9 aa, Artificial Sequence
  Description of Artificial Sequence: Synthetic peptide
  Seed: SFSSTLVSL (MAGC1_HUMAN)
SSSSTLVSY

SEQ ID NO: 78238 - protein, 9 aa, Artificial Sequence
  Description of Artificial Sequence: Synthetic peptide
  Seed: TLDLTSEGC (MAGC1_HUMAN)
TADLTSEGV

SEQ ID NO: 78239 - protein, 9 aa, Artificial Sequence
  Description of Artificial Sequence: Synthetic peptide
  Seed: FSSTLLSIL (MAGC1_HUMAN)
FQSTLLSIM

SEQ ID NO: 78240 - protein, 9 aa, Artificial Sequence
  Description of Artificial Sequence: Synthetic peptide
  Seed: SSPESPLQS (MAGC1_HUMAN)
SFPESPLQM

SEQ ID NO: 78241 - protein, 9 aa, Artificial Sequence
  Description of Artificial Sequence: Synthetic peptide
  Seed: FEGFPQSVL (MAGC1_HUMAN)
FHGFPQSVM

SEQ ID NO: 78242 - protein, 9 aa, Artificial Sequence
  Description of Artificial Sequence: Synthetic peptide
  Seed: SSPPRYEFL (MAGC1_HUMAN)
STPPRYEFV

SEQ ID NO: 78243 - protein, 10 aa, Artificial Sequence
  Description of Artificial Sequence: Synthetic peptide
  Seed: SSFSYTLLSL (MAGC1_HUMAN)
SAFSYTLLSY

SEQ ID NO: 78244 - protein, 10 aa, Artificial Sequence
  Description of Artificial Sequence: Synthetic peptide
  Seed: LQIPGSPSFS (MAGC1_HUMAN)
LMIPGSPSFQ

SEQ ID NO: 78245 - protein, 9 aa, Artificial Sequence
  Description of Artificial Sequence: Synthetic peptide
  Seed: FPSSTSSSL (MAGC1_HUMAN)
FKSSTSSSL

SEQ ID NO: 78246 - protein, 10 aa, Artificial Sequence
  Description of Artificial Sequence: Synthetic peptide
  Seed: SSSSSSSTLL (MAGC1_HUMAN)
SNSSSSSTLW

SEQ ID NO: 78247 - protein, 9 aa, Artificial Sequence
  Description of Artificial Sequence: Synthetic peptide
  Seed: IPVSSSSSS (MAGC1_HUMAN)
IPVSSSSSV

SEQ ID NO: 78248 - protein, 10 aa, Artificial Sequence
  Description of Artificial Sequence: Synthetic peptide
  Seed: REFIEILFGI (MAGC1_HUMAN)
RQFIEILFGV

SEQ ID NO: 78249 - protein, 9 aa, Artificial Sequence
  Description of Artificial Sequence: Synthetic peptide
  Seed: IPVSSSFSY (MAGC1_HUMAN)
IKVSSSFSW

SEQ ID NO: 78250 - protein, 10 aa, Artificial Sequence
  Description of Artificial Sequence: Synthetic peptide
  Seed: SSPESTQSPF (MAGC1_HUMAN)
SDPESTQSPL

SEQ ID NO: 78251 - protein, 9 aa, Artificial Sequence
  Description of Artificial Sequence: Synthetic peptide
  Seed: STQSPFEGF (MAGC1_HUMAN)
SMQSPFEGW

SEQ ID NO: 78252 - protein, 9 aa, Artificial Sequence
  Description of Artificial Sequence: Synthetic peptide
  Seed: SQNRLLILI (MAGC1_HUMAN)
SINRLLILI

SEQ ID NO: 78253 - protein, 9 aa, Artificial Sequence
  Description of Artificial Sequence: Synthetic peptide
  Seed: SQSSPVSSF (MAGC1_HUMAN)
STSSPVSSM

SEQ ID NO: 78254 - protein, 9 aa, Artificial Sequence
  Description of Artificial Sequence: Synthetic peptide
  Seed: RFLLLKYQV (MAGC1_HUMAN)
RFLLLKYQL

SEQ ID NO: 78255 - protein, 10 aa, Artificial Sequence
  Description of Artificial Sequence: Synthetic peptide
  Seed: SFSYTLLSLF (MAGC1_HUMAN)
STSYTLLSLM

SEQ ID NO: 78256 - protein, 10 aa, Artificial Sequence
  Description of Artificial Sequence: Synthetic peptide
  Seed: VSRSFSSTLL (MAGC1_HUMAN)
VTRSFSSTLK

SEQ ID NO: 78257 - protein, 11 aa, Artificial Sequence
  Description of Artificial Sequence: Synthetic peptide
  Seed: SPLQIPVSRSF (MAGC1_HUMAN)
SKLQIPVSRSY

SEQ ID NO: 78258 - protein, 9 aa, Artificial Sequence
  Description of Artificial Sequence: Synthetic peptide
  Seed: LQIPVSSSS (MAGC1_HUMAN)
LAIPVSSSV

SEQ ID NO: 78259 - protein, 11 aa, Artificial Sequence
  Description of Artificial Sequence: Synthetic peptide
  Seed: TVPITFPSSYK (MAGC1_HUMAN)
TSPITFPSSYR

SEQ ID NO: 78260 - protein, 9 aa, Artificial Sequence
  Description of Artificial Sequence: Synthetic peptide
  Seed: KAREFIEIL (MAGC1_HUMAN)
KTREFIEIW

SEQ ID NO: 78261 - protein, 9 aa, Artificial Sequence
  Description of Artificial Sequence: Synthetic peptide
  Seed: STQSPFEGF (MAGC1_HUMAN)
SQQSPFEGW

SEQ ID NO: 78262 - protein, 9 aa, Artificial Sequence
  Description of Artificial Sequence: Synthetic peptide
  Seed: AQSSLQIPV (MAGC1_HUMAN)
AISSLQIPV

SEQ ID NO: 78263 - protein, 9 aa, Artificial Sequence
  Description of Artificial Sequence: Synthetic peptide
  Seed: SSHESPQSP (MAGC1_HUMAN)
SMHESPQSL

SEQ ID NO: 78264 - protein, 10 aa, Artificial Sequence
  Description of Artificial Sequence: Synthetic peptide
  Seed: SLSPLHFPQF (MAGC1_HUMAN)
STSPLHFPQF

SEQ ID NO: 78265 - protein, 11 aa, Artificial Sequence
  Description of Artificial Sequence: Synthetic peptide
  Seed: STFEGFAQSPL (MAGC1_HUMAN)
SVFEGFAQSPV

SEQ ID NO: 78266 - protein, 10 aa, Artificial Sequence
  Description of Artificial Sequence: Synthetic peptide
  Seed: HSPQSPPEGM (MAGC1_HUMAN)
HIPQSPPEGL

SEQ ID NO: 78267 - protein, 9 aa, Artificial Sequence
  Description of Artificial Sequence: Synthetic peptide
  Seed: NSSPPRYEF (MAGC1_HUMAN)
NRSPPRYEY

SEQ ID NO: 78268 - protein, 10 aa, Artificial Sequence
  Description of Artificial Sequence: Synthetic peptide
  Seed: RKVVEFLAML (MAGC1_HUMAN)
RHVVEFLAML

SEQ ID NO: 78269 - protein, 10 aa, Artificial Sequence
  Description of Artificial Sequence: Synthetic peptide
  Seed: SLFQSFSERT (MAGC1_HUMAN)
SLFQSFSERL

SEQ ID NO: 78270 - protein, 9 aa, Artificial Sequence
  Description of Artificial Sequence: Synthetic peptide
  Seed: SSPEGKDSL (MAGC1_HUMAN)
STPEGKDSM

SEQ ID NO: 78271 - protein, 9 aa, Artificial Sequence
  Description of Artificial Sequence: Synthetic peptide
  Seed: YTLLSLFQS (MAGC1_HUMAN)
YILLSLFQI

SEQ ID NO: 78272 - protein, 9 aa, Artificial Sequence
  Description of Artificial Sequence: Synthetic peptide
  Seed: SVLQIPVSA (MAGC1_HUMAN)
SSLQIPVSK

SEQ ID NO: 78273 - protein, 11 aa, Artificial Sequence
  Description of Artificial Sequence: Synthetic peptide
  Seed: FQSSLQSPVSI (MAGC1_HUMAN)
FMSSLQSPVSL

SEQ ID NO: 78274 - protein, 11 aa, Artificial Sequence
  Description of Artificial Sequence: Synthetic peptide
  Seed: SPLQIPMTSSF (MAGC1_HUMAN)
SKLQIPMTSSF

SEQ ID NO: 78275 - protein, 9 aa, Artificial Sequence
  Description of Artificial Sequence: Synthetic peptide
  Seed: SRYTGYFPV (MAGC1_HUMAN)
SAYTGYFPY

SEQ ID NO: 78276 - protein, 10 aa, Artificial Sequence
  Description of Artificial Sequence: Synthetic peptide
  Seed: SSFSSTLLSI (MAGC1_HUMAN)
SGFSSTLLSW

SEQ ID NO: 78277 - protein, 9 aa, Artificial Sequence
  Description of Artificial Sequence: Synthetic peptide
  Seed: SAQSAFEGF (MAGC1_HUMAN)
SLQSAFEGW

SEQ ID NO: 78278 - protein, 11 aa, Artificial Sequence
  Description of Artificial Sequence: Synthetic peptide
  Seed: SICSSSTSLSL (MAGC1_HUMAN)
SMCSSSTSLSF

SEQ ID NO: 78279 - protein, 10 aa, Artificial Sequence
  Description of Artificial Sequence: Synthetic peptide
  Seed: EILFGISLRE (MAGC1_HUMAN)
EGLFGISLRK

SEQ ID NO: 78280 - protein, 9 aa, Artificial Sequence
  Description of Artificial Sequence: Synthetic peptide
  Seed: FEGFAQSPL (MAGC1_HUMAN)
FKGFAQSPM

SEQ ID NO: 78281 - protein, 9 aa, Artificial Sequence
  Description of Artificial Sequence: Synthetic peptide
  Seed: TLLSILQSS (MAGC1_HUMAN)
TTLSILQSI

SEQ ID NO: 78282 - protein, 10 aa, Artificial Sequence
  Description of Artificial Sequence: Synthetic peptide
  Seed: YTLASLLQSS (MAGC1_HUMAN)
YVLASLLQST

SEQ ID NO: 78283 - protein, 11 aa, Artificial Sequence
  Description of Artificial Sequence: Synthetic peptide
  Seed: FPQSPLQGEEF (MAGC1_HUMAN)
FPQSPLQGEEL

SEQ ID NO: 78284 - protein, 10 aa, Artificial Sequence
  Description of Artificial Sequence: Synthetic peptide
  Seed: SSPESAQSAF (MAGC1_HUMAN)
SFPESAQSAY

SEQ ID NO: 78285 - protein, 9 aa, Artificial Sequence
  Description of Artificial Sequence: Synthetic peptide
  Seed: IPVSSSFSY (MAGC1_HUMAN)
IAVSSSFSL

SEQ ID NO: 78286 - protein, 9 aa, Artificial Sequence
  Description of Artificial Sequence: Synthetic peptide
  Seed: SPLQIPMTS (MAGC1_HUMAN)
SQLQIPMTL

SEQ ID NO: 78287 - protein, 9 aa, Artificial Sequence
  Description of Artificial Sequence: Synthetic peptide
  Seed: VPNSSPPRY (MAGC1_HUMAN)
VPNSSPPRL

SEQ ID NO: 78288 - protein, 8 aa, Artificial Sequence
  Description of Artificial Sequence: Synthetic peptide
  Seed: SFFSSALL (MAGC1_HUMAN)
SYFSSALL

SEQ ID NO: 78289 - protein, 10 aa, Artificial Sequence
  Description of Artificial Sequence: Synthetic peptide
  Seed: ASSFFSSALL (MAGC1_HUMAN)
AISFFSSALF

SEQ ID NO: 78290 - protein, 10 aa, Artificial Sequence
  Description of Artificial Sequence: Synthetic peptide
  Seed: TGYFPVIFRK (MAGC1_HUMAN)
TVYFPVIFRR

SEQ ID NO: 78291 - protein, 10 aa, Artificial Sequence
  Description of Artificial Sequence: Synthetic peptide
  Seed: YASEEVIWDV (MAGC1_HUMAN)
YMSEEVIWDI

SEQ ID NO: 78292 - protein, 10 aa, Artificial Sequence
  Description of Artificial Sequence: Synthetic peptide
  Seed: FPQSPLQIPV (MAGC1_HUMAN)
FPQSPLQIPF

SEQ ID NO: 78293 - protein, 9 aa, Artificial Sequence
  Description of Artificial Sequence: Synthetic peptide
  Seed: SSFFSYTLA (MAGC1_HUMAN)
SIFFSYTLL

SEQ ID NO: 78294 - protein, 9 aa, Artificial Sequence
  Description of Artificial Sequence: Synthetic peptide
  Seed: SPPEGPAQS (MAGC1_HUMAN)
SPPEGPAQL

SEQ ID NO: 78295 - protein, 9 aa, Artificial Sequence
  Description of Artificial Sequence: Synthetic peptide
  Seed: YTLASLLQS (MAGC1_HUMAN)
YQLASLLQA

SEQ ID NO: 78296 - protein, 9 aa, Artificial Sequence
  Description of Artificial Sequence: Synthetic peptide
  Seed: KVDELARFL (MAGC1_HUMAN)
KIDELARFM

SEQ ID NO: 78297 - protein, 9 aa, Artificial Sequence
  Description of Artificial Sequence: Synthetic peptide
  Seed: TLLSLFQSF (MAGC1_HUMAN)
TVLSLFQSK

SEQ ID NO: 78298 - protein, 11 aa, Artificial Sequence
  Description of Artificial Sequence: Synthetic peptide
  Seed: LQIPGSPSFSS (MAGC1_HUMAN)
LQIPGSPSFSM

SEQ ID NO: 78299 - protein, 10 aa, Artificial Sequence
  Description of Artificial Sequence: Synthetic peptide
  Seed: SSPECTQSTF (MAGC1_HUMAN)
SVPECTQSTW

SEQ ID NO: 78300 - protein, 10 aa, Artificial Sequence
  Description of Artificial Sequence: Synthetic peptide
  Seed: LLQIPMTSSF (MAGC1_HUMAN)
LTQIPMTSSF

SEQ ID NO: 78301 - protein, 9 aa, Artificial Sequence
  Description of Artificial Sequence: Synthetic peptide
  Seed: FAFGEPREL (MAGC1_HUMAN)
FSFGEPREH

SEQ ID NO: 78302 - protein, 9 aa, Artificial Sequence
  Description of Artificial Sequence: Synthetic peptide
  Seed: IPVSSSFSY (MAGC1_HUMAN)
IVVSSSFSY

SEQ ID NO: 78303 - protein, 10 aa, Artificial Sequence
  Description of Artificial Sequence: Synthetic peptide
  Seed: QGEDSMSPLY (MAGC1_HUMAN)
QWEDSMSPLW

SEQ ID NO: 78304 - protein, 9 aa, Artificial Sequence
  Description of Artificial Sequence: Synthetic peptide
  Seed: ISFSSSTSL (MAGC1_HUMAN)
IGFSSSTSM

SEQ ID NO: 78305 - protein, 9 aa, Artificial Sequence
  Description of Artificial Sequence: Synthetic peptide
  Seed: SLLQSSHES (MAGC1_HUMAN)
SLLQSSHEL

SEQ ID NO: 78306 - protein, 11 aa, Artificial Sequence
  Description of Artificial Sequence: Synthetic peptide
  Seed: SPLQIPVSSSS (MAGC1_HUMAN)
SDLQIPVSSSF

SEQ ID NO: 78307 - protein, 10 aa, Artificial Sequence
  Description of Artificial Sequence: Synthetic peptide
  Seed: WGPRAHSEVI (MAGC1_HUMAN)
WWPRAHSEVV

SEQ ID NO: 78308 - protein, 9 aa, Artificial Sequence
  Description of Artificial Sequence: Synthetic peptide
  Seed: LSDEQGMSQ (MAGC1_HUMAN)
LQDEQGMSM

SEQ ID NO: 78309 - protein, 9 aa, Artificial Sequence
  Description of Artificial Sequence: Synthetic peptide
  Seed: KVVEFLAML (MAGC1_HUMAN)
KQVEFLAMF

SEQ ID NO: 78310 - protein, 8 aa, Artificial Sequence
  Description of Artificial Sequence: Synthetic peptide
  Seed: QIPMTSSF (MAGC1_HUMAN)
QYPMTSSY

SEQ ID NO: 78311 - protein, 9 aa, Artificial Sequence
  Description of Artificial Sequence: Synthetic peptide
  Seed: SSSFSYTLL (MAGC1_HUMAN)
SISFSYTLW

SEQ ID NO: 78312 - protein, 9 aa, Artificial Sequence
  Description of Artificial Sequence: Synthetic peptide
  Seed: STFEGFAQS (MAGC1_HUMAN)
SIFEGFAQV

SEQ ID NO: 78313 - protein, 10 aa, Artificial Sequence
  Description of Artificial Sequence: Synthetic peptide
  Seed: TTDDSTATES (MAGC1_HUMAN)
TQDDSTATEF

SEQ ID NO: 78314 - protein, 9 aa, Artificial Sequence
  Description of Artificial Sequence: Synthetic peptide
  Seed: TTDDSTATE (MAGC1_HUMAN)
TIDDSTATY

SEQ ID NO: 78315 - protein, 9 aa, Artificial Sequence
  Description of Artificial Sequence: Synthetic peptide
  Seed: SSPPRYEFL (MAGC1_HUMAN)
SWPPRYEFY

SEQ ID NO: 78316 - protein, 9 aa, Artificial Sequence
  Description of Artificial Sequence: Synthetic peptide
  Seed: MTSSFSSTL (MAGC1_HUMAN)
MMSSFSSTK

SEQ ID NO: 78317 - protein, 9 aa, Artificial Sequence
  Description of Artificial Sequence: Synthetic peptide
  Seed: GTYASEEVI (MAGC1_HUMAN)
GQYASEEVW

SEQ ID NO: 78318 - protein, 9 aa, Artificial Sequence
  Description of Artificial Sequence: Synthetic peptide
  Seed: RFLLLKYQV (MAGC1_HUMAN)
RWLLLKYQI

SEQ ID NO: 78319 - protein, 10 aa, Artificial Sequence
  Description of Artificial Sequence: Synthetic peptide
  Seed: ASSFFSSALL (MAGC1_HUMAN)
AQSFFSSALM

SEQ ID NO: 78320 - protein, 9 aa, Artificial Sequence
  Description of Artificial Sequence: Synthetic peptide
  Seed: NPASSFFSS (MAGC1_HUMAN)
NPASSFFSL

SEQ ID NO: 78321 - protein, 9 aa, Artificial Sequence
  Description of Artificial Sequence: Synthetic peptide
  Seed: SIFQSSPER (MAGC1_HUMAN)
SSFQSSPEM

SEQ ID NO: 78322 - protein, 10 aa, Artificial Sequence
  Description of Artificial Sequence: Synthetic peptide
  Seed: AASSSTLVSI (MAGC1_HUMAN)
AVSSSTLVSM

SEQ ID NO: 78323 - protein, 9 aa, Artificial Sequence
  Description of Artificial Sequence: Synthetic peptide
  Seed: VSPSFSSTL (MAGC1_HUMAN)
VPPSFSSTY

SEQ ID NO: 78324 - protein, 9 aa, Artificial Sequence
  Description of Artificial Sequence: Synthetic peptide
  Seed: FPSSTSSSL (MAGC1_HUMAN)
FWSSTSSSF

SEQ ID NO: 78325 - protein, 9 aa, Artificial Sequence
  Description of Artificial Sequence: Synthetic peptide
  Seed: FPSSTSSSL (MAGC1_HUMAN)
FWSSTSSSM

SEQ ID NO: 78326 - protein, 10 aa, Artificial Sequence
  Description of Artificial Sequence: Synthetic peptide
  Seed: MSPLYFPQSP (MAGC1_HUMAN)
MWPLYFPQSA

SEQ ID NO: 78327 - protein, 9 aa, Artificial Sequence
  Description of Artificial Sequence: Synthetic peptide
  Seed: CTQSTFEGF (MAGC1_HUMAN)
CKQSTFEGF

SEQ ID NO: 78328 - protein, 9 aa, Artificial Sequence
  Description of Artificial Sequence: Synthetic peptide
  Seed: LQIPVSRSF (MAGC1_HUMAN)
LEIPVSRSV

SEQ ID NO: 78329 - protein, 10 aa, Artificial Sequence
  Description of Artificial Sequence: Synthetic peptide
  Seed: SSSSTLLSLF (MAGC1_HUMAN)
SVSSTLLSLY

SEQ ID NO: 78330 - protein, 9 aa, Artificial Sequence
  Description of Artificial Sequence: Synthetic peptide
  Seed: SSSSSSSTL (MAGC1_HUMAN)
SQSSSSSTI

SEQ ID NO: 78331 - protein, 10 aa, Artificial Sequence
  Description of Artificial Sequence: Synthetic peptide
  Seed: SFSSTLVSLF (MAGC1_HUMAN)
SWSSTLVSLW

SEQ ID NO: 78332 - protein, 9 aa, Artificial Sequence
  Description of Artificial Sequence: Synthetic peptide
  Seed: EMLTNVISR (MAGC1_HUMAN)
EYLTNVISR

SEQ ID NO: 78333 - protein, 9 aa, Artificial Sequence
  Description of Artificial Sequence: Synthetic peptide
  Seed: LSDEQGMSQ (MAGC1_HUMAN)
LWDEQGMSM

SEQ ID NO: 78334 - protein, 9 aa, Artificial Sequence
  Description of Artificial Sequence: Synthetic peptide
  Seed: AQSPLQIPV (MAGC1_HUMAN)
ALSPLQIPW

SEQ ID NO: 78335 - protein, 9 aa, Artificial Sequence
  Description of Artificial Sequence: Synthetic peptide
  Seed: ISFSSSTSL (MAGC1_HUMAN)
IWFSSSTSV

SEQ ID NO: 78336 - protein, 10 aa, Artificial Sequence
  Description of Artificial Sequence: Synthetic peptide
  Seed: SLQIPVSPSF (MAGC1_HUMAN)
SKQIPVSPSM

SEQ ID NO: 78337 - protein, 10 aa, Artificial Sequence
  Description of Artificial Sequence: Synthetic peptide
  Seed: RTHSTFEGFP (MAGC1_HUMAN)
RTHSTFEGFV

SEQ ID NO: 78338 - protein, 9 aa, Artificial Sequence
  Description of Artificial Sequence: Synthetic peptide
  Seed: LQIPVSRSF (MAGC1_HUMAN)
LQIPVSRSW

SEQ ID NO: 78339 - protein, 9 aa, Artificial Sequence
  Description of Artificial Sequence: Synthetic peptide
  Seed: TLDLTSEGC (MAGC1_HUMAN)
TVDLTSEGM

SEQ ID NO: 78340 - protein, 8 aa, Artificial Sequence
  Description of Artificial Sequence: Synthetic peptide
  Seed: FGISLREV (MAGC1_HUMAN)
FQISLREV

SEQ ID NO: 78341 - protein, 10 aa, Artificial Sequence
  Description of Artificial Sequence: Synthetic peptide
  Seed: MLKNTVPITF (MAGC1_HUMAN)
MRKNTVPITF

SEQ ID NO: 78342 - protein, 11 aa, Artificial Sequence
  Description of Artificial Sequence: Synthetic peptide
  Seed: SSTPSSLPQSF (MAGC1_HUMAN)
SLTPSSLPQSW

SEQ ID NO: 78343 - protein, 10 aa, Artificial Sequence
  Description of Artificial Sequence: Synthetic peptide
  Seed: MLTNVISRYT (MAGC1_HUMAN)
MLTNVISRYI

SEQ ID NO: 78344 - protein, 9 aa, Artificial Sequence
  Description of Artificial Sequence: Synthetic peptide
  Seed: LSPLHFPQF (MAGC1_HUMAN)
LMPLHFPQW

SEQ ID NO: 78345 - protein, 10 aa, Artificial Sequence
  Description of Artificial Sequence: Synthetic peptide
  Seed: SPERTHSTFE (MAGC1_HUMAN)
SPERTHSTFL

SEQ ID NO: 78346 - protein, 9 aa, Artificial Sequence
  Description of Artificial Sequence: Synthetic peptide
  Seed: FTYTLDEKV (MAGC1_HUMAN)
FTYTLDEKW

SEQ ID NO: 78347 - protein, 9 aa, Artificial Sequence
  Description of Artificial Sequence: Synthetic peptide
  Seed: LQIPVSPSF (MAGC1_HUMAN)
LNIPVSPSY

SEQ ID NO: 78348 - protein, 9 aa, Artificial Sequence
  Description of Artificial Sequence: Synthetic peptide
  Seed: REVDPDDSY (MAGC1_HUMAN)
REVDPDDSF

SEQ ID NO: 78349 - protein, 10 aa, Artificial Sequence
  Description of Artificial Sequence: Synthetic peptide
  Seed: LAMLKNTVPI (MAGC1_HUMAN)
LLMLKNTVPM

SEQ ID NO: 78350 - protein, 10 aa, Artificial Sequence
  Description of Artificial Sequence: Synthetic peptide
  Seed: RKVVEFLAML (MAGC1_HUMAN)
RYVVEFLAMI

SEQ ID NO: 78351 - protein, 9 aa, Artificial Sequence
  Description of Artificial Sequence: Synthetic peptide
  Seed: AMLKNTVPI (MAGC1_HUMAN)
AVLKNTVPY

SEQ ID NO: 78352 - protein, 9 aa, Artificial Sequence
  Description of Artificial Sequence: Synthetic peptide
  Seed: YVFVNTLDL (MAGC1_HUMAN)
YLFVNTLDL

SEQ ID NO: 78353 - protein, 10 aa, Artificial Sequence
  Description of Artificial Sequence: Synthetic peptide
  Seed: SSFSYTLLSL (MAGC1_HUMAN)
SFFSYTLLSY

SEQ ID NO: 78354 - protein, 9 aa, Artificial Sequence
  Description of Artificial Sequence: Synthetic peptide
  Seed: KVVEFLAML (MAGC1_HUMAN)
KTVEFLAMM

SEQ ID NO: 78355 - protein, 10 aa, Artificial Sequence
  Description of Artificial Sequence: Synthetic peptide
  Seed: AASSSTLVSI (MAGC1_HUMAN)
AISSSTLVSA

SEQ ID NO: 78356 - protein, 9 aa, Artificial Sequence
  Description of Artificial Sequence: Synthetic peptide
  Seed: TESASSSVM (MAGC1_HUMAN)
TRSASSSVY

SEQ ID NO: 78357 - protein, 10 aa, Artificial Sequence
  Description of Artificial Sequence: Synthetic peptide
  Seed: WGPRAHSEVI (MAGC1_HUMAN)
WRPRAHSEVI

SEQ ID NO: 78358 - protein, 9 aa, Artificial Sequence
  Description of Artificial Sequence: Synthetic peptide
  Seed: SSFFSSALL (MAGC1_HUMAN)
STFFSSALY

SEQ ID NO: 78359 - protein, 9 aa, Artificial Sequence
  Description of Artificial Sequence: Synthetic peptide
  Seed: YQVKQPITK (MAGC1_HUMAN)
YIVKQPITM

SEQ ID NO: 78360 - protein, 9 aa, Artificial Sequence
  Description of Artificial Sequence: Synthetic peptide
  Seed: SMSPLYFPQ (MAGC1_HUMAN)
SASPLYFPK

SEQ ID NO: 78361 - protein, 9 aa, Artificial Sequence
  Description of Artificial Sequence: Synthetic peptide
  Seed: SSPPRYEFL (MAGC1_HUMAN)
SWPPRYEFM

SEQ ID NO: 78362 - protein, 9 aa, Artificial Sequence
  Description of Artificial Sequence: Synthetic peptide
  Seed: VSSFFSYTL (MAGC1_HUMAN)
VCSFFSYTW

SEQ ID NO: 78363 - protein, 9 aa, Artificial Sequence
  Description of Artificial Sequence: Synthetic peptide
  Seed: RSFSSTLLS (MAGC1_HUMAN)
RCFSSTLLM

SEQ ID NO: 78364 - protein, 9 aa, Artificial Sequence
  Description of Artificial Sequence: Synthetic peptide
  Seed: VSRSFSSTL (MAGC1_HUMAN)
VRRSFSSTY

SEQ ID NO: 78365 - protein, 9 aa, Artificial Sequence
  Description of Artificial Sequence: Synthetic peptide
  Seed: TLLSILQSS (MAGC1_HUMAN)
TILSILQSI

SEQ ID NO: 78366 - protein, 11 aa, Artificial Sequence
  Description of Artificial Sequence: Synthetic peptide
  Seed: STFEGFPQSLL (MAGC1_HUMAN)
SMFEGFPQSLK

SEQ ID NO: 78367 - protein, 10 aa, Artificial Sequence
  Description of Artificial Sequence: Synthetic peptide
  Seed: ISRYTGYFPV (MAGC1_HUMAN)
IARYTGYFPF

SEQ ID NO: 78368 - protein, 9 aa, Artificial Sequence
  Description of Artificial Sequence: Synthetic peptide
  Seed: SVLQIPVSA (MAGC1_HUMAN)
STLQIPVSL

SEQ ID NO: 78369 - protein, 9 aa, Artificial Sequence
  Description of Artificial Sequence: Synthetic peptide
  Seed: RSFSSTLLS (MAGC1_HUMAN)
RAFSSTLLI

SEQ ID NO: 78370 - protein, 11 aa, Artificial Sequence
  Description of Artificial Sequence: Synthetic peptide
  Seed: QSFSERTQSTF (MAGC1_HUMAN)
QMFSERTQSTY

SEQ ID NO: 78371 - protein, 9 aa, Artificial Sequence
  Description of Artificial Sequence: Synthetic peptide
  Seed: FSYTLLSLF (MAGC1_HUMAN)
FMYTLLSLL

SEQ ID NO: 78372 - protein, 11 aa, Artificial Sequence
  Description of Artificial Sequence: Synthetic peptide
  Seed: KDMPTAGMPSL (MAGC1_HUMAN)
KPMPTAGMPSV

SEQ ID NO: 78373 - protein, 11 aa, Artificial Sequence
  Description of Artificial Sequence: Synthetic peptide
  Seed: SSFSYTLLSLF (MAGC1_HUMAN)
SKFSYTLLSLW

SEQ ID NO: 78374 - protein, 9 aa, Artificial Sequence
  Description of Artificial Sequence: Synthetic peptide
  Seed: SSPESDDTL (MAGC1_HUMAN)
SYPESDDTM

SEQ ID NO: 78375 - protein, 11 aa, Artificial Sequence
  Description of Artificial Sequence: Synthetic peptide
  Seed: SLSQSSPVSSF (MAGC1_HUMAN)
SWSQSSPVSSF

SEQ ID NO: 78376 - protein, 9 aa, Artificial Sequence
  Description of Artificial Sequence: Synthetic peptide
  Seed: CTQSTFEGF (MAGC1_HUMAN)
CYQSTFEGI

SEQ ID NO: 78377 - protein, 9 aa, Artificial Sequence
  Description of Artificial Sequence: Synthetic peptide
  Seed: YVFVNTLDL (MAGC1_HUMAN)
YFFVNTLDV

SEQ ID NO: 78378 - protein, 10 aa, Artificial Sequence
  Description of Artificial Sequence: Synthetic peptide
  Seed: REVDPDDSYV (MAGC1_HUMAN)
RQVDPDDSYL

SEQ ID NO: 78379 - protein, 10 aa, Artificial Sequence
  Description of Artificial Sequence: Synthetic peptide
  Seed: RSFSSTLLSI (MAGC1_HUMAN)
RTFSSTLLSW

SEQ ID NO: 78380 - protein, 9 aa, Artificial Sequence
  Description of Artificial Sequence: Synthetic peptide
  Seed: WVQEHYLEY (MAGC1_HUMAN)
WVQEHYLEK

SEQ ID NO: 78381 - protein, 10 aa, Artificial Sequence
  Description of Artificial Sequence: Synthetic peptide
  Seed: SFSSTLLSIF (MAGC1_HUMAN)
SWSSTLLSIW

SEQ ID NO: 78382 - protein, 9 aa, Artificial Sequence
  Description of Artificial Sequence: Synthetic peptide
  Seed: FSSTLLSIL (MAGC1_HUMAN)
FESTLLSIY

SEQ ID NO: 78383 - protein, 10 aa, Artificial Sequence
  Description of Artificial Sequence: Synthetic peptide
  Seed: YTLASLLQSS (MAGC1_HUMAN)
YHLASLLQST

SEQ ID NO: 78384 - protein, 9 aa, Artificial Sequence
  Description of Artificial Sequence: Synthetic peptide
  Seed: RPVSSFFSY (MAGC1_HUMAN)
RLVSSFFSF

SEQ ID NO: 78385 - protein, 10 aa, Artificial Sequence
  Description of Artificial Sequence: Synthetic peptide
  Seed: LEISQSPPEG (MAGC1_HUMAN)
LEISQSPPEA

SEQ ID NO: 78386 - protein, 10 aa, Artificial Sequence
  Description of Artificial Sequence: Synthetic peptide
  Seed: REVDPDDSYV (MAGC1_HUMAN)
REVDPDDSYI

SEQ ID NO: 78387 - protein, 9 aa, Artificial Sequence
  Description of Artificial Sequence: Synthetic peptide
  Seed: YQVKQPITK (MAGC1_HUMAN)
YAVKQPITK

SEQ ID NO: 78388 - protein, 10 aa, Artificial Sequence
  Description of Artificial Sequence: Synthetic peptide
  Seed: SSPESAQSTF (MAGC1_HUMAN)
SFPESAQSTY

SEQ ID NO: 78389 - protein, 10 aa, Artificial Sequence
  Description of Artificial Sequence: Synthetic peptide
  Seed: SSFSSTLLSI (MAGC1_HUMAN)
SAFSSTLLSF

SEQ ID NO: 78390 - protein, 10 aa, Artificial Sequence
  Description of Artificial Sequence: Synthetic peptide
  Seed: TTDDSTATES (MAGC1_HUMAN)
TQDDSTATEI

SEQ ID NO: 78391 - protein, 11 aa, Artificial Sequence
  Description of Artificial Sequence: Synthetic peptide
  Seed: SPFEGFPQSVL (MAGC1_HUMAN)
SPFEGFPQSVY

SEQ ID NO: 78392 - protein, 9 aa, Artificial Sequence
  Description of Artificial Sequence: Synthetic peptide
  Seed: ISFSSSTSL (MAGC1_HUMAN)
IEFSSSTSM

SEQ ID NO: 78393 - protein, 11 aa, Artificial Sequence
  Description of Artificial Sequence: Synthetic peptide
  Seed: QSSPESAQSAF (MAGC1_HUMAN)
QLSPESAQSAY

SEQ ID NO: 78394 - protein, 9 aa, Artificial Sequence
  Description of Artificial Sequence: Synthetic peptide
  Seed: FQSSLQSPV (MAGC1_HUMAN)
FESSLQSPY

SEQ ID NO: 78395 - protein, 9 aa, Artificial Sequence
  Description of Artificial Sequence: Synthetic peptide
  Seed: SRYTGYFPV (MAGC1_HUMAN)
SEYTGYFPF

SEQ ID NO: 78396 - protein, 9 aa, Artificial Sequence
  Description of Artificial Sequence: Synthetic peptide
  Seed: SSLSQSSPV (MAGC1_HUMAN)
SILSQSSPL

SEQ ID NO: 78397 - protein, 9 aa, Artificial Sequence
  Description of Artificial Sequence: Synthetic peptide
  Seed: ALLSIFQSS (MAGC1_HUMAN)
AQLSIFQSI

SEQ ID NO: 78398 - protein, 9 aa, Artificial Sequence
  Description of Artificial Sequence: Synthetic peptide
  Seed: STFEGFAQS (MAGC1_HUMAN)
SIFEGFAQI

SEQ ID NO: 78399 - protein, 10 aa, Artificial Sequence
  Description of Artificial Sequence: Synthetic peptide
  Seed: MTSSFSSTLL (MAGC1_HUMAN)
MNSSFSSTLY

SEQ ID NO: 78400 - protein, 9 aa, Artificial Sequence
  Description of Artificial Sequence: Synthetic peptide
  Seed: WVQEHYLEY (MAGC1_HUMAN)
WIQEHYLEY

SEQ ID NO: 78401 - protein, 11 aa, Artificial Sequence
  Description of Artificial Sequence: Synthetic peptide
  Seed: TTDDSTATESA (MAGC1_HUMAN)
TQDDSTATESL

SEQ ID NO: 78402 - protein, 9 aa, Artificial Sequence
  Description of Artificial Sequence: Synthetic peptide
  Seed: VSAASSSTL (MAGC1_HUMAN)
VLAASSSTV

SEQ ID NO: 78403 - protein, 10 aa, Artificial Sequence
  Description of Artificial Sequence: Synthetic peptide
  Seed: AASSSTLVSI (MAGC1_HUMAN)
AQSSSTLVSL

SEQ ID NO: 78404 - protein, 9 aa, Artificial Sequence
  Description of Artificial Sequence: Synthetic peptide
  Seed: SSPERTHST (MAGC1_HUMAN)
SGPERTHSI

SEQ ID NO: 78405 - protein, 9 aa, Artificial Sequence
  Description of Artificial Sequence: Synthetic peptide
  Seed: AQSPLQIPV (MAGC1_HUMAN)
ALSPLQIPL

SEQ ID NO: 78406 - protein, 9 aa, Artificial Sequence
  Description of Artificial Sequence: Synthetic peptide
  Seed: RAGREHFAF (MAGC1_HUMAN)
RMGREHFAI

SEQ ID NO: 78407 - protein, 9 aa, Artificial Sequence
  Description of Artificial Sequence: Synthetic peptide
  Seed: LILSIIFIK (MAGC1_HUMAN)
LMLSIIFIR

SEQ ID NO: 78408 - protein, 9 aa, Artificial Sequence
  Description of Artificial Sequence: Synthetic peptide
  Seed: GFPQSVLQI (MAGC1_HUMAN)
GRPQSVLQF

SEQ ID NO: 78409 - protein, 8 aa, Artificial Sequence
  Description of Artificial Sequence: Synthetic peptide
  Seed: SSPPRYEF (MAGC1_HUMAN)
SFPPRYEM

SEQ ID NO: 78410 - protein, 10 aa, Artificial Sequence
  Description of Artificial Sequence: Synthetic peptide
  Seed: MPTAGMPSLL (MAGC1_HUMAN)
MNTAGMPSLI

SEQ ID NO: 78411 - protein, 9 aa, Artificial Sequence
  Description of Artificial Sequence: Synthetic peptide
  Seed: SICSSSTSL (MAGC1_HUMAN)
SKCSSSTSY

SEQ ID NO: 78412 - protein, 9 aa, Artificial Sequence
  Description of Artificial Sequence: Synthetic peptide
  Seed: SSSESPQSC (MAGC1_HUMAN)
SLSESPQSF

SEQ ID NO: 78413 - protein, 11 aa, Artificial Sequence
  Description of Artificial Sequence: Synthetic peptide
  Seed: IPVSAASSSTL (MAGC1_HUMAN)
ITVSAASSSTM

SEQ ID NO: 78414 - protein, 9 aa, Artificial Sequence
  Description of Artificial Sequence: Synthetic peptide
  Seed: VIWDVLSGI (MAGC1_HUMAN)
VAWDVLSGA

SEQ ID NO: 78415 - protein, 9 aa, Artificial Sequence
  Description of Artificial Sequence: Synthetic peptide
  Seed: SRYTGYFPV (MAGC1_HUMAN)
SYYTGYFPF

SEQ ID NO: 78416 - protein, 10 aa, Artificial Sequence
  Description of Artificial Sequence: Synthetic peptide
  Seed: KAREFIEILF (MAGC1_HUMAN)
KFREFIEILY

SEQ ID NO: 78417 - protein, 10 aa, Artificial Sequence
  Description of Artificial Sequence: Synthetic peptide
  Seed: SFSSTLLSIF (MAGC1_HUMAN)
SPSSTLLSIW

SEQ ID NO: 78418 - protein, 9 aa, Artificial Sequence
  Description of Artificial Sequence: Synthetic peptide
  Seed: AGREHFAFG (MAGC1_HUMAN)
ATREHFAFC

SEQ ID NO: 78419 - protein, 11 aa, Artificial Sequence
  Description of Artificial Sequence: Synthetic peptide
  Seed: IPVSSSSSSTL (MAGC1_HUMAN)
IGVSSSSSSTW

SEQ ID NO: 78420 - protein, 9 aa, Artificial Sequence
  Description of Artificial Sequence: Synthetic peptide
  Seed: FFSSALLSI (MAGC1_HUMAN)
FRSSALLSV

SEQ ID NO: 78421 - protein, 9 aa, Artificial Sequence
  Description of Artificial Sequence: Synthetic peptide
  Seed: YVFVNTLDL (MAGC1_HUMAN)
YPFVNTLDL

SEQ ID NO: 78422 - protein, 9 aa, Artificial Sequence
  Description of Artificial Sequence: Synthetic peptide
  Seed: FAFGEPREL (MAGC1_HUMAN)
FPFGEPREA

SEQ ID NO: 78423 - protein, 9 aa, Artificial Sequence
  Description of Artificial Sequence: Synthetic peptide
  Seed: SQSSPVSSF (MAGC1_HUMAN)
SVSSPVSSV

SEQ ID NO: 78424 - protein, 9 aa, Artificial Sequence
  Description of Artificial Sequence: Synthetic peptide
  Seed: VQSPLHSPQ (MAGC1_HUMAN)
VQSPLHSPM

SEQ ID NO: 78425 - protein, 9 aa, Artificial Sequence
  Description of Artificial Sequence: Synthetic peptide
  Seed: LQIPVSSSS (MAGC1_HUMAN)
LFIPVSSSV

SEQ ID NO: 78426 - protein, 8 aa, Artificial Sequence
  Description of Artificial Sequence: Synthetic peptide
  Seed: RSFSSTLL (MAGC1_HUMAN)
RTFSSTLM

SEQ ID NO: 78427 - protein, 9 aa, Artificial Sequence
  Description of Artificial Sequence: Synthetic peptide
  Seed: SPLYFPQSP (MAGC1_HUMAN)
SPLYFPQSI

SEQ ID NO: 78428 - protein, 10 aa, Artificial Sequence
  Description of Artificial Sequence: Synthetic peptide
  Seed: YTLASLLQSS (MAGC1_HUMAN)
YPLASLLQSL

SEQ ID NO: 78429 - protein, 9 aa, Artificial Sequence
  Description of Artificial Sequence: Synthetic peptide
  Seed: FSEESSSPV (MAGC1_HUMAN)
FVEESSSPI

SEQ ID NO: 78430 - protein, 9 aa, Artificial Sequence
  Description of Artificial Sequence: Synthetic peptide
  Seed: LQIPGSPSF (MAGC1_HUMAN)
LYIPGSPSY

SEQ ID NO: 78431 - protein, 9 aa, Artificial Sequence
  Description of Artificial Sequence: Synthetic peptide
  Seed: IIDTTDDST (MAGC1_HUMAN)
IGDTTDDSL

SEQ ID NO: 78432 - protein, 9 aa, Artificial Sequence
  Description of Artificial Sequence: Synthetic peptide
  Seed: YQVKQPITK (MAGC1_HUMAN)
YAVKQPITH

SEQ ID NO: 78433 - protein, 9 aa, Artificial Sequence
  Description of Artificial Sequence: Synthetic peptide
  Seed: SPLQIVPSL (MAGC1_HUMAN)
SVLQIVPSV

SEQ ID NO: 78434 - protein, 9 aa, Artificial Sequence
  Description of Artificial Sequence: Synthetic peptide
  Seed: FSYTLASLL (MAGC1_HUMAN)
FAYTLASLH

SEQ ID NO: 78435 - protein, 9 aa, Artificial Sequence
  Description of Artificial Sequence: Synthetic peptide
  Seed: SSLSQSSPV (MAGC1_HUMAN)
SLLSQSSPL

SEQ ID NO: 78436 - protein, 9 aa, Artificial Sequence
  Description of Artificial Sequence: Synthetic peptide
  Seed: SLPEWEDSL (MAGC1_HUMAN)
SQPEWEDSL

SEQ ID NO: 78437 - protein, 10 aa, Artificial Sequence
  Description of Artificial Sequence: Synthetic peptide
  Seed: FFSYTLASLL (MAGC1_HUMAN)
FQSYTLASLI

SEQ ID NO: 78438 - protein, 11 aa, Artificial Sequence
  Description of Artificial Sequence: Synthetic peptide
  Seed: RSFSSTLLSIF (MAGC1_HUMAN)
RAFSSTLLSIL

SEQ ID NO: 78439 - protein, 9 aa, Artificial Sequence
  Description of Artificial Sequence: Synthetic peptide
  Seed: VPITFPSSY (MAGC1_HUMAN)
VFITFPSSY

SEQ ID NO: 78440 - protein, 10 aa, Artificial Sequence
  Description of Artificial Sequence: Synthetic peptide
  Seed: MSQNRLLILI (MAGC1_HUMAN)
MFQNRLLILV

SEQ ID NO: 78441 - protein, 9 aa, Artificial Sequence
  Description of Artificial Sequence: Synthetic peptide
  Seed: RELLTKVWV (MAGC1_HUMAN)
RELLTKVWA

SEQ ID NO: 78442 - protein, 9 aa, Artificial Sequence
  Description of Artificial Sequence: Synthetic peptide
  Seed: SSPESPLQS (MAGC1_HUMAN)
STPESPLQV

SEQ ID NO: 78443 - protein, 9 aa, Artificial Sequence
  Description of Artificial Sequence: Synthetic peptide
  Seed: SPLQSPVSS (MAGC1_HUMAN)
SALQSPVSM

SEQ ID NO: 78444 - protein, 10 aa, Artificial Sequence
  Description of Artificial Sequence: Synthetic peptide
  Seed: LQIPGSPSFS (MAGC1_HUMAN)
LMIPGSPSFS

SEQ ID NO: 78445 - protein, 11 aa, Artificial Sequence
  Description of Artificial Sequence: Synthetic peptide
  Seed: SPLQIPVSRSF (MAGC1_HUMAN)
SVLQIPVSRSY

SEQ ID NO: 78446 - protein, 9 aa, Artificial Sequence
  Description of Artificial Sequence: Synthetic peptide
  Seed: NSSPPRYEF (MAGC1_HUMAN)
NWSPPRYEF

SEQ ID NO: 78447 - protein, 9 aa, Artificial Sequence
  Description of Artificial Sequence: Synthetic peptide
  Seed: FLAMLKNTV (MAGC1_HUMAN)
FMAMLKNTI

SEQ ID NO: 78448 - protein, 10 aa, Artificial Sequence
  Description of Artificial Sequence: Synthetic peptide
  Seed: SFPSSTSSSL (MAGC1_HUMAN)
SLPSSTSSSI

SEQ ID NO: 78449 - protein, 9 aa, Artificial Sequence
  Description of Artificial Sequence: Synthetic peptide
  Seed: ASSFFSSAL (MAGC1_HUMAN)
AISFFSSAL

SEQ ID NO: 78450 - protein, 9 aa, Artificial Sequence
  Description of Artificial Sequence: Synthetic peptide
  Seed: SPLQSPESA (MAGC1_HUMAN)
SALQSPESY

SEQ ID NO: 78451 - protein, 9 aa, Artificial Sequence
  Description of Artificial Sequence: Synthetic peptide
  Seed: TSSFSSTLL (MAGC1_HUMAN)
TTSFSSTLF

SEQ ID NO: 78452 - protein, 9 aa, Artificial Sequence
  Description of Artificial Sequence: Synthetic peptide
  Seed: SSLSQSSPV (MAGC1_HUMAN)
SMLSQSSPL

SEQ ID NO: 78453 - protein, 10 aa, Artificial Sequence
  Description of Artificial Sequence: Synthetic peptide
  Seed: LAMLKNTVPI (MAGC1_HUMAN)
LGMLKNTVPL

SEQ ID NO: 78454 - protein, 9 aa, Artificial Sequence
  Description of Artificial Sequence: Synthetic peptide
  Seed: VIFRKAREF (MAGC1_HUMAN)
VFFRKAREF

SEQ ID NO: 78455 - protein, 11 aa, Artificial Sequence
  Description of Artificial Sequence: Synthetic peptide
  Seed: LQIPVSSSFSY (MAGC1_HUMAN)
LPIPVSSSFSW

SEQ ID NO: 78456 - protein, 10 aa, Artificial Sequence
  Description of Artificial Sequence: Synthetic peptide
  Seed: FAQSSLQIPV (MAGC1_HUMAN)
FHQSSLQIPI

SEQ ID NO: 78457 - protein, 10 aa, Artificial Sequence
  Description of Artificial Sequence: Synthetic peptide
  Seed: FPQSVLQIPV (MAGC1_HUMAN)
FPQSVLQIPT

SEQ ID NO: 78458 - protein, 10 aa, Artificial Sequence
  Description of Artificial Sequence: Synthetic peptide
  Seed: MPTAGMPSLL (MAGC1_HUMAN)
MHTAGMPSLW

SEQ ID NO: 78459 - protein, 9 aa, Artificial Sequence
  Description of Artificial Sequence: Synthetic peptide
  Seed: NTVPITFPS (MAGC1_HUMAN)
NMVPITFPM

SEQ ID NO: 78460 - protein, 10 aa, Artificial Sequence
  Description of Artificial Sequence: Synthetic peptide
  Seed: SLSPLHFPQF (MAGC1_HUMAN)
SKSPLHFPQY

SEQ ID NO: 78461 - protein, 8 aa, Artificial Sequence
  Description of Artificial Sequence: Synthetic peptide
  Seed: KVDELARF (MAGC1_HUMAN)
KSDELARM

SEQ ID NO: 78462 - protein, 9 aa, Artificial Sequence
  Description of Artificial Sequence: Synthetic peptide
  Seed: FQSSLQSPV (MAGC1_HUMAN)
FFSSLQSPF

SEQ ID NO: 78463 - protein, 9 aa, Artificial Sequence
  Description of Artificial Sequence: Synthetic peptide
  Seed: SSHESPQSP (MAGC1_HUMAN)
SAHESPQSY

SEQ ID NO: 78464 - protein, 9 aa, Artificial Sequence
  Description of Artificial Sequence: Synthetic peptide
  Seed: IESEPLFTY (MAGC1_HUMAN)
IESEPLFTA

SEQ ID NO: 78465 - protein, 10 aa, Artificial Sequence
  Description of Artificial Sequence: Synthetic peptide
  Seed: FFSSALLSIF (MAGC1_HUMAN)
FTSSALLSIW

SEQ ID NO: 78466 - protein, 11 aa, Artificial Sequence
  Description of Artificial Sequence: Synthetic peptide
  Seed: VIWDVLSGIGV (MAGC1_HUMAN)
VLWDVLSGIGL

SEQ ID NO: 78467 - protein, 9 aa, Artificial Sequence
  Description of Artificial Sequence: Synthetic peptide
  Seed: LEGEDSLSS (MAGC1_HUMAN)
LEGEDSLSV

SEQ ID NO: 78468 - protein, 10 aa, Artificial Sequence
  Description of Artificial Sequence: Synthetic peptide
  Seed: SQNRLLILIL (MAGC1_HUMAN)
SQNRLLILIM

SEQ ID NO: 78469 - protein, 9 aa, Artificial Sequence
  Description of Artificial Sequence: Synthetic peptide
  Seed: IPVSSSFSY (MAGC1_HUMAN)
IRVSSSFSF

SEQ ID NO: 78470 - protein, 10 aa, Artificial Sequence
  Description of Artificial Sequence: Synthetic peptide
  Seed: FPQSLLQIPM (MAGC1_HUMAN)
FLQSLLQIPY

SEQ ID NO: 78471 - protein, 11 aa, Artificial Sequence
  Description of Artificial Sequence: Synthetic peptide
  Seed: TLDEKVDELAR (MAGC1_HUMAN)
TVDEKVDELAL

SEQ ID NO: 78472 - protein, 9 aa, Artificial Sequence
  Description of Artificial Sequence: Synthetic peptide
  Seed: RPVSSFFSY (MAGC1_HUMAN)
RQVSSFFSM

SEQ ID NO: 78473 - protein, 9 aa, Artificial Sequence
  Description of Artificial Sequence: Synthetic peptide
  Seed: FLWGPRAHS (MAGC1_HUMAN)
FLWGPRAHT

SEQ ID NO: 78474 - protein, 10 aa, Artificial Sequence
  Description of Artificial Sequence: Synthetic peptide
  Seed: SSPESAQSAF (MAGC1_HUMAN)
SAPESAQSAY

SEQ ID NO: 78475 - protein, 10 aa, Artificial Sequence
  Description of Artificial Sequence: Synthetic peptide
  Seed: SFSSTLVSLF (MAGC1_HUMAN)
SYSSTLVSLM

SEQ ID NO: 78476 - protein, 11 aa, Artificial Sequence
  Description of Artificial Sequence: Synthetic peptide
  Seed: LLQIPMTSSFS (MAGC1_HUMAN)
LMQIPMTSSFY

SEQ ID NO: 78477 - protein, 11 aa, Artificial Sequence
  Description of Artificial Sequence: Synthetic peptide
  Seed: RPVSSFFSYTL (MAGC1_HUMAN)
RKVSSFFSYTW

SEQ ID NO: 78478 - protein, 9 aa, Artificial Sequence
  Description of Artificial Sequence: Synthetic peptide
  Seed: VSRSFSSTL (MAGC1_HUMAN)
VMRSFSSTA

SEQ ID NO: 78479 - protein, 10 aa, Artificial Sequence
  Description of Artificial Sequence: Synthetic peptide
  Seed: SFSSTLVSLF (MAGC1_HUMAN)
SSSSTLVSLW

SEQ ID NO: 78480 - protein, 10 aa, Artificial Sequence
  Description of Artificial Sequence: Synthetic peptide
  Seed: LTKVWVQEHY (MAGC1_HUMAN)
LVKVWVQEHW

SEQ ID NO: 78481 - protein, 9 aa, Artificial Sequence
  Description of Artificial Sequence: Synthetic peptide
  Seed: SIIFIKGTY (MAGC1_HUMAN)
SMIFIKGTM

SEQ ID NO: 78482 - protein, 9 aa, Artificial Sequence
  Description of Artificial Sequence: Synthetic peptide
  Seed: LESDSLTDS (MAGC1_HUMAN)
LESDSLTDV

SEQ ID NO: 78483 - protein, 9 aa, Artificial Sequence
  Description of Artificial Sequence: Synthetic peptide
  Seed: SAPEGEDSL (MAGC1_HUMAN)
SMPEGEDSV

SEQ ID NO: 78484 - protein, 10 aa, Artificial Sequence
  Description of Artificial Sequence: Synthetic peptide
  Seed: AASSSTLVSI (MAGC1_HUMAN)
AASSSTLVSV

SEQ ID NO: 78485 - protein, 11 aa, Artificial Sequence
  Description of Artificial Sequence: Synthetic peptide
  Seed: RSFSSTLLSIF (MAGC1_HUMAN)
RCFSSTLLSIW

SEQ ID NO: 78486 - protein, 11 aa, Artificial Sequence
  Description of Artificial Sequence: Synthetic peptide
  Seed: KVWVQEHYLEY (MAGC1_HUMAN)
KMWVQEHYLEF

SEQ ID NO: 78487 - protein, 9 aa, Artificial Sequence
  Description of Artificial Sequence: Synthetic peptide
  Seed: QIVPSLPEW (MAGC1_HUMAN)
QSVPSLPEL

SEQ ID NO: 78488 - protein, 10 aa, Artificial Sequence
  Description of Artificial Sequence: Synthetic peptide
  Seed: TGYFPVIFRK (MAGC1_HUMAN)
TAYFPVIFRH

SEQ ID NO: 78489 - protein, 9 aa, Artificial Sequence
  Description of Artificial Sequence: Synthetic peptide
  Seed: SIFQSSPER (MAGC1_HUMAN)
SMFQSSPEV

SEQ ID NO: 78490 - protein, 9 aa, Artificial Sequence
  Description of Artificial Sequence: Synthetic peptide
  Seed: NTVPITFPS (MAGC1_HUMAN)
NIVPITFPY

SEQ ID NO: 78491 - protein, 10 aa, Artificial Sequence
  Description of Artificial Sequence: Synthetic peptide
  Seed: SSPERTHSTF (MAGC1_HUMAN)
SIPERTHSTL

SEQ ID NO: 78492 - protein, 9 aa, Artificial Sequence
  Description of Artificial Sequence: Synthetic peptide
  Seed: FSYTLLSLF (MAGC1_HUMAN)
FIYTLLSLM

SEQ ID NO: 78493 - protein, 10 aa, Artificial Sequence
  Description of Artificial Sequence: Synthetic peptide
  Seed: LHFPQSPPEW (MAGC1_HUMAN)
LGFPQSPPEW

SEQ ID NO: 78494 - protein, 10 aa, Artificial Sequence
  Description of Artificial Sequence: Synthetic peptide
  Seed: SLIESEPLFT (MAGC1_HUMAN)
SMIESEPLFA

SEQ ID NO: 78495 - protein, 9 aa, Artificial Sequence
  Description of Artificial Sequence: Synthetic peptide
  Seed: SSPPRYEFL (MAGC1_HUMAN)
SQPPRYEFF

SEQ ID NO: 78496 - protein, 10 aa, Artificial Sequence
  Description of Artificial Sequence: Synthetic peptide
  Seed: NPASSFFSSA (MAGC1_HUMAN)
NCASSFFSSV

SEQ ID NO: 78497 - protein, 9 aa, Artificial Sequence
  Description of Artificial Sequence: Synthetic peptide
  Seed: SQSSPVSSF (MAGC1_HUMAN)
SRSSPVSSY

SEQ ID NO: 78498 - protein, 10 aa, Artificial Sequence
  Description of Artificial Sequence: Synthetic peptide
  Seed: HSPQSPPEGM (MAGC1_HUMAN)
HAPQSPPEGL

SEQ ID NO: 78499 - protein, 10 aa, Artificial Sequence
  Description of Artificial Sequence: Synthetic peptide
  Seed: RAGREHFAFG (MAGC1_HUMAN)
RLGREHFAFA

SEQ ID NO: 78500 - protein, 9 aa, Artificial Sequence
  Description of Artificial Sequence: Synthetic peptide
  Seed: AQSPLQIPV (MAGC1_HUMAN)
AMSPLQIPI

SEQ ID NO: 78501 - protein, 9 aa, Artificial Sequence
  Description of Artificial Sequence: Synthetic peptide
  Seed: NSSPPRYEF (MAGC1_HUMAN)
NTSPPRYEL

SEQ ID NO: 78502 - protein, 11 aa, Artificial Sequence
  Description of Artificial Sequence: Synthetic peptide
  Seed: SFFSYTLASLL (MAGC1_HUMAN)
SAFSYTLASLW

SEQ ID NO: 78503 - protein, 9 aa, Artificial Sequence
  Description of Artificial Sequence: Synthetic peptide
  Seed: SSSESPQSC (MAGC1_HUMAN)
SSSESPQSV

SEQ ID NO: 78504 - protein, 10 aa, Artificial Sequence
  Description of Artificial Sequence: Synthetic peptide
  Seed: FSSSTSLSPF (MAGC1_HUMAN)
FQSSTSLSPM

SEQ ID NO: 78505 - protein, 10 aa, Artificial Sequence
  Description of Artificial Sequence: Synthetic peptide
  Seed: KGTYASEEVI (MAGC1_HUMAN)
KGTYASEEVW

SEQ ID NO: 78506 - protein, 10 aa, Artificial Sequence
  Description of Artificial Sequence: Synthetic peptide
  Seed: QRPVSSFFSY (MAGC1_HUMAN)
QCPVSSFFSF

SEQ ID NO: 78507 - protein, 9 aa, Artificial Sequence
  Description of Artificial Sequence: Synthetic peptide
  Seed: SQSSPVSSF (MAGC1_HUMAN)
SESSPVSSI

SEQ ID NO: 78508 - protein, 9 aa, Artificial Sequence
  Description of Artificial Sequence: Synthetic peptide
  Seed: VIKRKVVEF (MAGC1_HUMAN)
VPKRKVVEL

SEQ ID NO: 78509 - protein, 10 aa, Artificial Sequence
  Description of Artificial Sequence: Synthetic peptide
  Seed: SPLQNPASSF (MAGC1_HUMAN)
SKLQNPASSM

SEQ ID NO: 78510 - protein, 9 aa, Artificial Sequence
  Description of Artificial Sequence: Synthetic peptide
  Seed: VSSSSSSTL (MAGC1_HUMAN)
VSSSSSSTY

SEQ ID NO: 78511 - protein, 9 aa, Artificial Sequence
  Description of Artificial Sequence: Synthetic peptide
  Seed: EMLTNVISR (MAGC1_HUMAN)
ETLTNVISR

SEQ ID NO: 78512 - protein, 9 aa, Artificial Sequence
  Description of Artificial Sequence: Synthetic peptide
  Seed: SSFPSSTSS (MAGC1_HUMAN)
SMFPSSTSM

SEQ ID NO: 78513 - protein, 9 aa, Artificial Sequence
  Description of Artificial Sequence: Synthetic peptide
  Seed: KDVEERAQA (MAGC1_HUMAN)
KDVEERAQM

SEQ ID NO: 78514 - protein, 9 aa, Artificial Sequence
  Description of Artificial Sequence: Synthetic peptide
  Seed: ASSFFSSAL (MAGC1_HUMAN)
ATSFFSSAV

SEQ ID NO: 78515 - protein, 9 aa, Artificial Sequence
  Description of Artificial Sequence: Synthetic peptide
  Seed: TLLESDSLT (MAGC1_HUMAN)
TMLESDSLI

SEQ ID NO: 78516 - protein, 10 aa, Artificial Sequence
  Description of Artificial Sequence: Synthetic peptide
  Seed: YASEEVIWDV (MAGC1_HUMAN)
YMSEEVIWDA

SEQ ID NO: 78517 - protein, 9 aa, Artificial Sequence
  Description of Artificial Sequence: Synthetic peptide
  Seed: SSPERTHST (MAGC1_HUMAN)
SRPERTHSF

SEQ ID NO: 78518 - protein, 9 aa, Artificial Sequence
  Description of Artificial Sequence: Synthetic peptide
  Seed: TKVWVQEHY (MAGC1_HUMAN)
TIVWVQEHY

SEQ ID NO: 78519 - protein, 10 aa, Artificial Sequence
  Description of Artificial Sequence: Synthetic peptide
  Seed: RTHSTFEGFP (MAGC1_HUMAN)
RQHSTFEGFK

SEQ ID NO: 78520 - protein, 9 aa, Artificial Sequence
  Description of Artificial Sequence: Synthetic peptide
  Seed: SEEVIWDVL (MAGC1_HUMAN)
SEEVIWDVM

SEQ ID NO: 78521 - protein, 9 aa, Artificial Sequence
  Description of Artificial Sequence: Synthetic peptide
  Seed: AREFIEILF (MAGC1_HUMAN)
AHEFIEILF

SEQ ID NO: 78522 - protein, 9 aa, Artificial Sequence
  Description of Artificial Sequence: Synthetic peptide
  Seed: SSSSTLLSL (MAGC1_HUMAN)
SFSSTLLSM

SEQ ID NO: 78523 - protein, 11 aa, Artificial Sequence
  Description of Artificial Sequence: Synthetic peptide
  Seed: TTDDSTATESA (MAGC1_HUMAN)
TSDDSTATESM

SEQ ID NO: 78524 - protein, 11 aa, Artificial Sequence
  Description of Artificial Sequence: Synthetic peptide
  Seed: SPLQIPVSSSS (MAGC1_HUMAN)
SLLQIPVSSSM

SEQ ID NO: 78525 - protein, 9 aa, Artificial Sequence
  Description of Artificial Sequence: Synthetic peptide
  Seed: SSFFSSALL (MAGC1_HUMAN)
SMFFSSALF

SEQ ID NO: 78526 - protein, 9 aa, Artificial Sequence
  Description of Artificial Sequence: Synthetic peptide
  Seed: MPTAGMPSL (MAGC1_HUMAN)
MLTAGMPSM

SEQ ID NO: 78527 - protein, 9 aa, Artificial Sequence
  Description of Artificial Sequence: Synthetic peptide
  Seed: MSQNRLLIL (MAGC1_HUMAN)
MHQNRLLIY

SEQ ID NO: 78528 - protein, 9 aa, Artificial Sequence
  Description of Artificial Sequence: Synthetic peptide
  Seed: RPVSSFFSY (MAGC1_HUMAN)
RSVSSFFSM

SEQ ID NO: 78529 - protein, 9 aa, Artificial Sequence
  Description of Artificial Sequence: Synthetic peptide
  Seed: VSPSSSSTL (MAGC1_HUMAN)
VVPSSSSTL

SEQ ID NO: 78530 - protein, 10 aa, Artificial Sequence
  Description of Artificial Sequence: Synthetic peptide
  Seed: YVFVNTLDLT (MAGC1_HUMAN)
YIFVNTLDLI

SEQ ID NO: 78531 - protein, 9 aa, Artificial Sequence
  Description of Artificial Sequence: Synthetic peptide
  Seed: SPESAQSAF (MAGC1_HUMAN)
SMESAQSAY

SEQ ID NO: 78532 - protein, 10 aa, Artificial Sequence
  Description of Artificial Sequence: Synthetic peptide
  Seed: REFIEILFGI (MAGC1_HUMAN)
REFIEILFGM

SEQ ID NO: 78533 - protein, 9 aa, Artificial Sequence
  Description of Artificial Sequence: Synthetic peptide
  Seed: IIDTTDDST (MAGC1_HUMAN)
ITDTTDDSF

SEQ ID NO: 78534 - protein, 9 aa, Artificial Sequence
  Description of Artificial Sequence: Synthetic peptide
  Seed: SSPERTQST (MAGC1_HUMAN)
SLPERTQSI

SEQ ID NO: 78535 - protein, 9 aa, Artificial Sequence
  Description of Artificial Sequence: Synthetic peptide
  Seed: FSYTLASLL (MAGC1_HUMAN)
FTYTLASLA

SEQ ID NO: 78536 - protein, 9 aa, Artificial Sequence
  Description of Artificial Sequence: Synthetic peptide
  Seed: NTVPITFPS (MAGC1_HUMAN)
NVVPITFPS

SEQ ID NO: 78537 - protein, 11 aa, Artificial Sequence
  Description of Artificial Sequence: Synthetic peptide
  Seed: SPLQRPVSSFF (MAGC1_HUMAN)
SLLQRPVSSFY

SEQ ID NO: 78538 - protein, 10 aa, Artificial Sequence
  Description of Artificial Sequence: Synthetic peptide
  Seed: LLQIPMTSSF (MAGC1_HUMAN)
LEQIPMTSSM

SEQ ID NO: 78539 - protein, 10 aa, Artificial Sequence
  Description of Artificial Sequence: Synthetic peptide
  Seed: KVDELARFLL (MAGC1_HUMAN)
KVDELARFLV

SEQ ID NO: 78540 - protein, 9 aa, Artificial Sequence
  Description of Artificial Sequence: Synthetic peptide
  Seed: SSFPSSTSS (MAGC1_HUMAN)
SLFPSSTSF

SEQ ID NO: 78541 - protein, 9 aa, Artificial Sequence
  Description of Artificial Sequence: Synthetic peptide
  Seed: QFPPQGEDF (MAGC1_HUMAN)
QYPPQGEDY

SEQ ID NO: 78542 - protein, 9 aa, Artificial Sequence
  Description of Artificial Sequence: Synthetic peptide
  Seed: KVWVQEHYL (MAGC1_HUMAN)
KMWVQEHYW

SEQ ID NO: 78543 - protein, 9 aa, Artificial Sequence
  Description of Artificial Sequence: Synthetic peptide
  Seed: LQIPVSRSF (MAGC1_HUMAN)
LFIPVSRSY

SEQ ID NO: 78544 - protein, 10 aa, Artificial Sequence
  Description of Artificial Sequence: Synthetic peptide
  Seed: SLQIPVSPSF (MAGC1_HUMAN)
STQIPVSPSF

SEQ ID NO: 78545 - protein, 9 aa, Artificial Sequence
  Description of Artificial Sequence: Synthetic peptide
  Seed: SAQSTFEGF (MAGC1_HUMAN)
SSQSTFEGY

SEQ ID NO: 78546 - protein, 9 aa, Artificial Sequence
  Description of Artificial Sequence: Synthetic peptide
  Seed: YVFVNTLDL (MAGC1_HUMAN)
YQFVNTLDW

SEQ ID NO: 78547 - protein, 10 aa, Artificial Sequence
  Description of Artificial Sequence: Synthetic peptide
  Seed: SSPERTQSTF (MAGC1_HUMAN)
SMPERTQSTL

SEQ ID NO: 78548 - protein, 9 aa, Artificial Sequence
  Description of Artificial Sequence: Synthetic peptide
  Seed: IIDTTDDST (MAGC1_HUMAN)
ILDTTDDSI

SEQ ID NO: 78549 - protein, 9 aa, Artificial Sequence
  Description of Artificial Sequence: Synthetic peptide
  Seed: SSPESDDTL (MAGC1_HUMAN)
SHPESDDTV

SEQ ID NO: 78550 - protein, 10 aa, Artificial Sequence
  Description of Artificial Sequence: Synthetic peptide
  Seed: EMLTNVISRY (MAGC1_HUMAN)
EILTNVISRK

SEQ ID NO: 78551 - protein, 8 aa, Artificial Sequence
  Description of Artificial Sequence: Synthetic peptide
  Seed: SFSSSTSL (MAGC1_HUMAN)
SYSSSTSY

SEQ ID NO: 78552 - protein, 10 aa, Artificial Sequence
  Description of Artificial Sequence: Synthetic peptide
  Seed: MSQNRLLILI (MAGC1_HUMAN)
MSQNRLLILW

SEQ ID NO: 78553 - protein, 9 aa, Artificial Sequence
  Description of Artificial Sequence: Synthetic peptide
  Seed: IIDTTDDST (MAGC1_HUMAN)
IIDTTDDSI

SEQ ID NO: 78554 - protein, 9 aa, Artificial Sequence
  Description of Artificial Sequence: Synthetic peptide
  Seed: RELLTKVWV (MAGC1_HUMAN)
RELLTKVWM

SEQ ID NO: 78555 - protein, 9 aa, Artificial Sequence
  Description of Artificial Sequence: Synthetic peptide
  Seed: FSEESSSPV (MAGC1_HUMAN)
FAEESSSPI

SEQ ID NO: 78556 - protein, 8 aa, Artificial Sequence
  Description of Artificial Sequence: Synthetic peptide
  Seed: SSVMSPSF (MAGC1_HUMAN)
SKVMSPSY

SEQ ID NO: 78557 - protein, 10 aa, Artificial Sequence
  Description of Artificial Sequence: Synthetic peptide
  Seed: VPITFPSSYK (MAGC1_HUMAN)
VCITFPSSYK

SEQ ID NO: 78558 - protein, 10 aa, Artificial Sequence
  Description of Artificial Sequence: Synthetic peptide
  Seed: ICSSSTPSSL (MAGC1_HUMAN)
IKSSSTPSSF

SEQ ID NO: 78559 - protein, 9 aa, Artificial Sequence
  Description of Artificial Sequence: Synthetic peptide
  Seed: LQIPVSRSF (MAGC1_HUMAN)
LRIPVSRSF

SEQ ID NO: 78560 - protein, 11 aa, Artificial Sequence
  Description of Artificial Sequence: Synthetic peptide
  Seed: SSFPSSTSSSL (MAGC1_HUMAN)
SHFPSSTSSSM

SEQ ID NO: 78561 - protein, 10 aa, Artificial Sequence
  Description of Artificial Sequence: Synthetic peptide
  Seed: RSFSSTLLSI (MAGC1_HUMAN)
RMFSSTLLSA

SEQ ID NO: 78562 - protein, 10 aa, Artificial Sequence
  Description of Artificial Sequence: Synthetic peptide
  Seed: ISRYTGYFPV (MAGC1_HUMAN)
ILRYTGYFPI

SEQ ID NO: 78563 - protein, 10 aa, Artificial Sequence
  Description of Artificial Sequence: Synthetic peptide
  Seed: SPLQRPVSSF (MAGC1_HUMAN)
SILQRPVSSY

SEQ ID NO: 78564 - protein, 10 aa, Artificial Sequence
  Description of Artificial Sequence: Synthetic peptide
  Seed: ICSSSTSLSL (MAGC1_HUMAN)
IHSSSTSLSY

SEQ ID NO: 78565 - protein, 10 aa, Artificial Sequence
  Description of Artificial Sequence: Synthetic peptide
  Seed: SESLIESEPL (MAGC1_HUMAN)
SESLIESEPF

SEQ ID NO: 78566 - protein, 11 aa, Artificial Sequence
  Description of Artificial Sequence: Synthetic peptide
  Seed: LSDEQGMSQNR (MAGC1_HUMAN)
LADEQGMSQNY

SEQ ID NO: 78567 - protein, 10 aa, Artificial Sequence
  Description of Artificial Sequence: Synthetic peptide
  Seed: LQIPMTSSFS (MAGC1_HUMAN)
LMIPMTSSFL

SEQ ID NO: 78568 - protein, 9 aa, Artificial Sequence
  Description of Artificial Sequence: Synthetic peptide
  Seed: LQNPASSFF (MAGC1_HUMAN)
LYNPASSFV

SEQ ID NO: 78569 - protein, 10 aa, Artificial Sequence
  Description of Artificial Sequence: Synthetic peptide
  Seed: DVLSGIGVRA (MAGC1_HUMAN)
DVLSGIGVRL

SEQ ID NO: 78570 - protein, 9 aa, Artificial Sequence
  Description of Artificial Sequence: Synthetic peptide
  Seed: FAFGEPREL (MAGC1_HUMAN)
FHFGEPREV

SEQ ID NO: 78571 - protein, 10 aa, Artificial Sequence
  Description of Artificial Sequence: Synthetic peptide
  Seed: YTLLSLFQSS (MAGC1_HUMAN)
YRLLSLFQSI

SEQ ID NO: 78572 - protein, 9 aa, Artificial Sequence
  Description of Artificial Sequence: Synthetic peptide
  Seed: RTQSTFEGF (MAGC1_HUMAN)
RMQSTFEGI

SEQ ID NO: 78573 - protein, 9 aa, Artificial Sequence
  Description of Artificial Sequence: Synthetic peptide
  Seed: VSSSFSYTL (MAGC1_HUMAN)
VQSSFSYTH

SEQ ID NO: 78574 - protein, 9 aa, Artificial Sequence
  Description of Artificial Sequence: Synthetic peptide
  Seed: RTQSTFEGF (MAGC1_HUMAN)
RTQSTFEGM

SEQ ID NO: 78575 - protein, 11 aa, Artificial Sequence
  Description of Artificial Sequence: Synthetic peptide
  Seed: ISRYTGYFPVI (MAGC1_HUMAN)
IMRYTGYFPVF

SEQ ID NO: 78576 - protein, 9 aa, Artificial Sequence
  Description of Artificial Sequence: Synthetic peptide
  Seed: TESASSSVM (MAGC1_HUMAN)
TTSASSSVF

SEQ ID NO: 78577 - protein, 11 aa, Artificial Sequence
  Description of Artificial Sequence: Synthetic peptide
  Seed: FIKGTYASEEV (MAGC1_HUMAN)
FLKGTYASEEL

SEQ ID NO: 78578 - protein, 11 aa, Artificial Sequence
  Description of Artificial Sequence: Synthetic peptide
  Seed: IPVSPSSSSTL (MAGC1_HUMAN)
IAVSPSSSSTI

SEQ ID NO: 78579 - protein, 11 aa, Artificial Sequence
  Description of Artificial Sequence: Synthetic peptide
  Seed: LQRPVSSFFSY (MAGC1_HUMAN)
LMRPVSSFFSF

SEQ ID NO: 78580 - protein, 10 aa, Artificial Sequence
  Description of Artificial Sequence: Synthetic peptide
  Seed: SLQIPVSPSF (MAGC1_HUMAN)
SPQIPVSPSF

SEQ ID NO: 78581 - protein, 8 aa, Artificial Sequence
  Description of Artificial Sequence: Synthetic peptide
  Seed: SSPPRYEF (MAGC1_HUMAN)
SAPPRYEM

SEQ ID NO: 78582 - protein, 10 aa, Artificial Sequence
  Description of Artificial Sequence: Synthetic peptide
  Seed: YTLDEKVDEL (MAGC1_HUMAN)
YDLDEKVDEI

SEQ ID NO: 78583 - protein, 9 aa, Artificial Sequence
  Description of Artificial Sequence: Synthetic peptide
  Seed: LQIPVSSSS (MAGC1_HUMAN)
LMIPVSSSM

SEQ ID NO: 78584 - protein, 9 aa, Artificial Sequence
  Description of Artificial Sequence: Synthetic peptide
  Seed: SLIESEPLF (MAGC1_HUMAN)
STIESEPLL

SEQ ID NO: 78585 - protein, 9 aa, Artificial Sequence
  Description of Artificial Sequence: Synthetic peptide
  Seed: FPSSTSSSL (MAGC1_HUMAN)
FMSSTSSSL

SEQ ID NO: 78586 - protein, 9 aa, Artificial Sequence
  Description of Artificial Sequence: Synthetic peptide
  Seed: QIVPSLPEW (MAGC1_HUMAN)
QIVPSLPEF

SEQ ID NO: 78587 - protein, 9 aa, Artificial Sequence
  Description of Artificial Sequence: Synthetic peptide
  Seed: VSPSSSSTL (MAGC1_HUMAN)
VYPSSSSTY

SEQ ID NO: 78588 - protein, 11 aa, Artificial Sequence
  Description of Artificial Sequence: Synthetic peptide
  Seed: SPLQIPVSSSS (MAGC1_HUMAN)
SALQIPVSSSY

SEQ ID NO: 78589 - protein, 10 aa, Artificial Sequence
  Description of Artificial Sequence: Synthetic peptide
  Seed: SSFPSSTSSS (MAGC1_HUMAN)
SSFPSSTSSL

SEQ ID NO: 78590 - protein, 9 aa, Artificial Sequence
  Description of Artificial Sequence: Synthetic peptide
  Seed: SSSTSLSPF (MAGC1_HUMAN)
SHSTSLSPF

SEQ ID NO: 78591 - protein, 8 aa, Artificial Sequence
  Description of Artificial Sequence: Synthetic peptide
  Seed: HYLEYREV (MAGC1_HUMAN)
HFLEYREF

SEQ ID NO: 78592 - protein, 9 aa, Artificial Sequence
  Description of Artificial Sequence: Synthetic peptide
  Seed: SLSPFSEES (MAGC1_HUMAN)
SLSPFSEEL

SEQ ID NO: 78593 - protein, 10 aa, Artificial Sequence
  Description of Artificial Sequence: Synthetic peptide
  Seed: LQIPVSRSFS (MAGC1_HUMAN)
LQIPVSRSFR

SEQ ID NO: 78594 - protein, 9 aa, Artificial Sequence
  Description of Artificial Sequence: Synthetic peptide
  Seed: SSSTLLSLF (MAGC1_HUMAN)
SVSTLLSLL

SEQ ID NO: 78595 - protein, 9 aa, Artificial Sequence
  Description of Artificial Sequence: Synthetic peptide
  Seed: NTVPITFPS (MAGC1_HUMAN)
NSVPITFPA

SEQ ID NO: 78596 - protein, 10 aa, Artificial Sequence
  Description of Artificial Sequence: Synthetic peptide
  Seed: TTDDSTATES (MAGC1_HUMAN)
TYDDSTATEV

SEQ ID NO: 78597 - protein, 9 aa, Artificial Sequence
  Description of Artificial Sequence: Synthetic peptide
  Seed: LQIPGSPSF (MAGC1_HUMAN)
LHIPGSPSF

SEQ ID NO: 78598 - protein, 9 aa, Artificial Sequence
  Description of Artificial Sequence: Synthetic peptide
  Seed: AGREHFAFG (MAGC1_HUMAN)
AAREHFAFY

SEQ ID NO: 78599 - protein, 9 aa, Artificial Sequence
  Description of Artificial Sequence: Synthetic peptide
  Seed: MTSSFSSTL (MAGC1_HUMAN)
MFSSFSSTM

SEQ ID NO: 78600 - protein, 10 aa, Artificial Sequence
  Description of Artificial Sequence: Synthetic peptide
  Seed: REFIEILFGI (MAGC1_HUMAN)
RQFIEILFGM

SEQ ID NO: 78601 - protein, 9 aa, Artificial Sequence
  Description of Artificial Sequence: Synthetic peptide
  Seed: TLLSIFQSS (MAGC1_HUMAN)
TMLSIFQSM

SEQ ID NO: 78602 - protein, 10 aa, Artificial Sequence
  Description of Artificial Sequence: Synthetic peptide
  Seed: EVDPDDSYVF (MAGC1_HUMAN)
EIDPDDSYVY

SEQ ID NO: 78603 - protein, 9 aa, Artificial Sequence
  Description of Artificial Sequence: Synthetic peptide
  Seed: QVKQPITKA (MAGC1_HUMAN)
QSKQPITKR

SEQ ID NO: 78604 - protein, 9 aa, Artificial Sequence
  Description of Artificial Sequence: Synthetic peptide
  Seed: SSPEGKDSL (MAGC1_HUMAN)
SGPEGKDSM

SEQ ID NO: 78605 - protein, 10 aa, Artificial Sequence
  Description of Artificial Sequence: Synthetic peptide
  Seed: FPQSLLQIPM (MAGC1_HUMAN)
FQQSLLQIPM

SEQ ID NO: 78606 - protein, 9 aa, Artificial Sequence
  Description of Artificial Sequence: Synthetic peptide
  Seed: SSFSSTLLS (MAGC1_HUMAN)
SVFSSTLLK

SEQ ID NO: 78607 - protein, 10 aa, Artificial Sequence
  Description of Artificial Sequence: Synthetic peptide
  Seed: TDDSTATESA (MAGC1_HUMAN)
TEDSTATESV

SEQ ID NO: 78608 - protein, 9 aa, Artificial Sequence
  Description of Artificial Sequence: Synthetic peptide
  Seed: SSPERTQST (MAGC1_HUMAN)
SVPERTQSI

SEQ ID NO: 78609 - protein, 10 aa, Artificial Sequence
  Description of Artificial Sequence: Synthetic peptide
  Seed: TLDEKVDELA (MAGC1_HUMAN)
TADEKVDELI

SEQ ID NO: 78610 - protein, 9 aa, Artificial Sequence
  Description of Artificial Sequence: Synthetic peptide
  Seed: TLVSLFQSS (MAGC1_HUMAN)
TQVSLFQSV

SEQ ID NO: 78611 - protein, 9 aa, Artificial Sequence
  Description of Artificial Sequence: Synthetic peptide
  Seed: LQIPVSSSS (MAGC1_HUMAN)
LEIPVSSSM

SEQ ID NO: 78612 - protein, 9 aa, Artificial Sequence
  Description of Artificial Sequence: Synthetic peptide
  Seed: SSSSSSSTL (MAGC1_HUMAN)
SKSSSSSTM

SEQ ID NO: 78613 - protein, 9 aa, Artificial Sequence
  Description of Artificial Sequence: Synthetic peptide
  Seed: LQNPASSFF (MAGC1_HUMAN)
LMNPASSFL

SEQ ID NO: 78614 - protein, 9 aa, Artificial Sequence
  Description of Artificial Sequence: Synthetic peptide
  Seed: YQVKQPITK (MAGC1_HUMAN)
YIVKQPITI

SEQ ID NO: 78615 - protein, 11 aa, Artificial Sequence
  Description of Artificial Sequence: Synthetic peptide
  Seed: ISRYTGYFPVI (MAGC1_HUMAN)
IPRYTGYFPVF

SEQ ID NO: 78616 - protein, 8 aa, Artificial Sequence
  Description of Artificial Sequence: Synthetic peptide
  Seed: FSYTLLSL (MAGC1_HUMAN)
FTYTLLSW

SEQ ID NO: 78617 - protein, 11 aa, Artificial Sequence
  Description of Artificial Sequence: Synthetic peptide
  Seed: SPLQRPVSSFF (MAGC1_HUMAN)
SYLQRPVSSFY

SEQ ID NO: 78618 - protein, 11 aa, Artificial Sequence
  Description of Artificial Sequence: Synthetic peptide
  Seed: SSSFSYTLLSL (MAGC1_HUMAN)
STSFSYTLLSW

SEQ ID NO: 78619 - protein, 9 aa, Artificial Sequence
  Description of Artificial Sequence: Synthetic peptide
  Seed: FAFGEPREL (MAGC1_HUMAN)
FFFGEPREF

SEQ ID NO: 78620 - protein, 9 aa, Artificial Sequence
  Description of Artificial Sequence: Synthetic peptide
  Seed: VSPSFSSTL (MAGC1_HUMAN)
VMPSFSSTY

SEQ ID NO: 78621 - protein, 10 aa, Artificial Sequence
  Description of Artificial Sequence: Synthetic peptide
  Seed: AASSSTLVSI (MAGC1_HUMAN)
AISSSTLVSI

SEQ ID NO: 78622 - protein, 11 aa, Artificial Sequence
  Description of Artificial Sequence: Synthetic peptide
  Seed: STFEGFPQSLL (MAGC1_HUMAN)
SMFEGFPQSLM

SEQ ID NO: 78623 - protein, 9 aa, Artificial Sequence
  Description of Artificial Sequence: Synthetic peptide
  Seed: FQSSLQSPV (MAGC1_HUMAN)
FHSSLQSPY

SEQ ID NO: 78624 - protein, 11 aa, Artificial Sequence
  Description of Artificial Sequence: Synthetic peptide
  Seed: TTDDSTATESA (MAGC1_HUMAN)
TTDDSTATESI

SEQ ID NO: 78625 - protein, 10 aa, Artificial Sequence
  Description of Artificial Sequence: Synthetic peptide
  Seed: SLQIPVSPSF (MAGC1_HUMAN)
SNQIPVSPSF

SEQ ID NO: 78626 - protein, 9 aa, Artificial Sequence
  Description of Artificial Sequence: Synthetic peptide
  Seed: RSFSSTLLS (MAGC1_HUMAN)
RQFSSTLLW

SEQ ID NO: 78627 - protein, 10 aa, Artificial Sequence
  Description of Artificial Sequence: Synthetic peptide
  Seed: VSSSSSSTLL (MAGC1_HUMAN)
VESSSSSTLF

SEQ ID NO: 78628 - protein, 9 aa, Artificial Sequence
  Description of Artificial Sequence: Synthetic peptide
  Seed: SSPPRYEFL (MAGC1_HUMAN)
SWPPRYEFL

SEQ ID NO: 78629 - protein, 9 aa, Artificial Sequence
  Description of Artificial Sequence: Synthetic peptide
  Seed: SRSFSSTLL (MAGC1_HUMAN)
SQSFSSTLM

SEQ ID NO: 78630 - protein, 9 aa, Artificial Sequence
  Description of Artificial Sequence: Synthetic peptide
  Seed: SSFFSSALL (MAGC1_HUMAN)
SVFFSSALW

SEQ ID NO: 78631 - protein, 9 aa, Artificial Sequence
  Description of Artificial Sequence: Synthetic peptide
  Seed: YVFVNTLDL (MAGC1_HUMAN)
YYFVNTLDY

SEQ ID NO: 78632 - protein, 9 aa, Artificial Sequence
  Description of Artificial Sequence: Synthetic peptide
  Seed: FFSYTLASL (MAGC1_HUMAN)
FISYTLASV

SEQ ID NO: 78633 - protein, 10 aa, Artificial Sequence
  Description of Artificial Sequence: Synthetic peptide
  Seed: SFSSTLLSIF (MAGC1_HUMAN)
SISSTLLSIF

SEQ ID NO: 78634 - protein, 10 aa, Artificial Sequence
  Description of Artificial Sequence: Synthetic peptide
  Seed: ICSSSTPSSL (MAGC1_HUMAN)
IHSSSTPSSW

SEQ ID NO: 78635 - protein, 10 aa, Artificial Sequence
  Description of Artificial Sequence: Synthetic peptide
  Seed: GEDSLSPHYF (MAGC1_HUMAN)
GEDSLSPHYA

SEQ ID NO: 78636 - protein, 10 aa, Artificial Sequence
  Description of Artificial Sequence: Synthetic peptide
  Seed: SFSSTLLSIL (MAGC1_HUMAN)
SASSTLLSIW

SEQ ID NO: 78637 - protein, 11 aa, Artificial Sequence
  Description of Artificial Sequence: Synthetic peptide
  Seed: STFEGFAQSSL (MAGC1_HUMAN)
SAFEGFAQSSW

SEQ ID NO: 78638 - protein, 10 aa, Artificial Sequence
  Description of Artificial Sequence: Synthetic peptide
  Seed: SIFQSSPESA (MAGC1_HUMAN)
SQFQSSPESL

SEQ ID NO: 78639 - protein, 11 aa, Artificial Sequence
  Description of Artificial Sequence: Synthetic peptide
  Seed: SSFPSSTSSSL (MAGC1_HUMAN)
SAFPSSTSSSR

SEQ ID NO: 78640 - protein, 9 aa, Artificial Sequence
  Description of Artificial Sequence: Synthetic peptide
  Seed: GEDSMSPLY (MAGC1_HUMAN)
GEDSMSPLW

SEQ ID NO: 78641 - protein, 9 aa, Artificial Sequence
  Description of Artificial Sequence: Synthetic peptide
  Seed: SSPERTHST (MAGC1_HUMAN)
SFPERTHSY

SEQ ID NO: 78642 - protein, 10 aa, Artificial Sequence
  Description of Artificial Sequence: Synthetic peptide
  Seed: KVVEFLAMLK (MAGC1_HUMAN)
KTVEFLAMLR

SEQ ID NO: 78643 - protein, 9 aa, Artificial Sequence
  Description of Artificial Sequence: Synthetic peptide
  Seed: STFEGFAQS (MAGC1_HUMAN)
SAFEGFAQL

SEQ ID NO: 78644 - protein, 10 aa, Artificial Sequence
  Description of Artificial Sequence: Synthetic peptide
  Seed: LLQIPMTSSF (MAGC1_HUMAN)
LAQIPMTSSF

SEQ ID NO: 78645 - protein, 10 aa, Artificial Sequence
  Description of Artificial Sequence: Synthetic peptide
  Seed: SSFSYTLLSL (MAGC1_HUMAN)
SLFSYTLLSV

SEQ ID NO: 78646 - protein, 9 aa, Artificial Sequence
  Description of Artificial Sequence: Synthetic peptide
  Seed: SIFQSSPER (MAGC1_HUMAN)
SAFQSSPEK

SEQ ID NO: 78647 - protein, 9 aa, Artificial Sequence
  Description of Artificial Sequence: Synthetic peptide
  Seed: VIWDVLSGI (MAGC1_HUMAN)
VIWDVLSGL

SEQ ID NO: 78648 - protein, 10 aa, Artificial Sequence
  Description of Artificial Sequence: Synthetic peptide
  Seed: RKVVEFLAML (MAGC1_HUMAN)
RAVVEFLAMA

SEQ ID NO: 78649 - protein, 10 aa, Artificial Sequence
  Description of Artificial Sequence: Synthetic peptide
  Seed: AMLKNTVPIT (MAGC1_HUMAN)
AILKNTVPIV

SEQ ID NO: 78650 - protein, 9 aa, Artificial Sequence
  Description of Artificial Sequence: Synthetic peptide
  Seed: TFEGFPQSL (MAGC1_HUMAN)
TAEGFPQSF

SEQ ID NO: 78651 - protein, 10 aa, Artificial Sequence
  Description of Artificial Sequence: Synthetic peptide
  Seed: AASSSTLVSI (MAGC1_HUMAN)
AISSSTLVSL

SEQ ID NO: 78652 - protein, 9 aa, Artificial Sequence
  Description of Artificial Sequence: Synthetic peptide
  Seed: SQSPPEGPV (MAGC1_HUMAN)
SASPPEGPH

SEQ ID NO: 78653 - protein, 9 aa, Artificial Sequence
  Description of Artificial Sequence: Synthetic peptide
  Seed: VSAASSSTL (MAGC1_HUMAN)
VQAASSSTV

SEQ ID NO: 78654 - protein, 11 aa, Artificial Sequence
  Description of Artificial Sequence: Synthetic peptide
  Seed: LQIPGSPSFSS (MAGC1_HUMAN)
LQIPGSPSFSF

SEQ ID NO: 78655 - protein, 9 aa, Artificial Sequence
  Description of Artificial Sequence: Synthetic peptide
  Seed: TLASLLQSS (MAGC1_HUMAN)
TIASLLQSA

SEQ ID NO: 78656 - protein, 9 aa, Artificial Sequence
  Description of Artificial Sequence: Synthetic peptide
  Seed: REVDPDDSY (MAGC1_HUMAN)
RQVDPDDSL

SEQ ID NO: 78657 - protein, 9 aa, Artificial Sequence
  Description of Artificial Sequence: Synthetic peptide
  Seed: SFSSTLVSL (MAGC1_HUMAN)
SYSSTLVSL

SEQ ID NO: 78658 - protein, 9 aa, Artificial Sequence
  Description of Artificial Sequence: Synthetic peptide
  Seed: SSPESPLQS (MAGC1_HUMAN)
STPESPLQI

SEQ ID NO: 78659 - protein, 10 aa, Artificial Sequence
  Description of Artificial Sequence: Synthetic peptide
  Seed: GEDSLSPLQI (MAGC1_HUMAN)
GEDSLSPLQA

SEQ ID NO: 78660 - protein, 11 aa, Artificial Sequence
  Description of Artificial Sequence: Synthetic peptide
  Seed: QSFSERTQSTF (MAGC1_HUMAN)
QTFSERTQSTY

SEQ ID NO: 78661 - protein, 10 aa, Artificial Sequence
  Description of Artificial Sequence: Synthetic peptide
  Seed: STLLSLFQSF (MAGC1_HUMAN)
SVLLSLFQSF

SEQ ID NO: 78662 - protein, 9 aa, Artificial Sequence
  Description of Artificial Sequence: Synthetic peptide
  Seed: LQIPVSPSF (MAGC1_HUMAN)
LHIPVSPSV

SEQ ID NO: 78663 - protein, 9 aa, Artificial Sequence
  Description of Artificial Sequence: Synthetic peptide
  Seed: SSSESPQSC (MAGC1_HUMAN)
SSSESPQSI

SEQ ID NO: 78664 - protein, 9 aa, Artificial Sequence
  Description of Artificial Sequence: Synthetic peptide
  Seed: LQIPVSSSS (MAGC1_HUMAN)
LVIPVSSSI

SEQ ID NO: 78665 - protein, 9 aa, Artificial Sequence
  Description of Artificial Sequence: Synthetic peptide
  Seed: ESSSPVDEY (MAGC1_HUMAN)
EVSSPVDEY

SEQ ID NO: 78666 - protein, 9 aa, Artificial Sequence
  Description of Artificial Sequence: Synthetic peptide
  Seed: KDSQSPLQI (MAGC1_HUMAN)
KLSQSPLQI

SEQ ID NO: 78667 - protein, 10 aa, Artificial Sequence
  Description of Artificial Sequence: Synthetic peptide
  Seed: SSPERTHSTF (MAGC1_HUMAN)
SSPERTHSTW

SEQ ID NO: 78668 - protein, 9 aa, Artificial Sequence
  Description of Artificial Sequence: Synthetic peptide
  Seed: SPESAQSAF (MAGC1_HUMAN)
SPESAQSAI

SEQ ID NO: 78669 - protein, 9 aa, Artificial Sequence
  Description of Artificial Sequence: Synthetic peptide
  Seed: SSPESTQSP (MAGC1_HUMAN)
SSPESTQSF

SEQ ID NO: 78670 - protein, 9 aa, Artificial Sequence
  Description of Artificial Sequence: Synthetic peptide
  Seed: QVKQPITKA (MAGC1_HUMAN)
QSKQPITKF

SEQ ID NO: 78671 - protein, 10 aa, Artificial Sequence
  Description of Artificial Sequence: Synthetic peptide
  Seed: REFIEILFGI (MAGC1_HUMAN)
RHFIEILFGF

SEQ ID NO: 78672 - protein, 9 aa, Artificial Sequence
  Description of Artificial Sequence: Synthetic peptide
  Seed: ELARFLLLK (MAGC1_HUMAN)
EIARFLLLR

SEQ ID NO: 78673 - protein, 10 aa, Artificial Sequence
  Description of Artificial Sequence: Synthetic peptide
  Seed: EVDPDDSYVF (MAGC1_HUMAN)
ETDPDDSYVY

SEQ ID NO: 78674 - protein, 10 aa, Artificial Sequence
  Description of Artificial Sequence: Synthetic peptide
  Seed: SFFSYTLASL (MAGC1_HUMAN)
SVFSYTLASV

SEQ ID NO: 78675 - protein, 11 aa, Artificial Sequence
  Description of Artificial Sequence: Synthetic peptide
  Seed: RSFSSTLLSIF (MAGC1_HUMAN)
RIFSSTLLSIW

SEQ ID NO: 78676 - protein, 9 aa, Artificial Sequence
  Description of Artificial Sequence: Synthetic peptide
  Seed: FPSSTSSSL (MAGC1_HUMAN)
FPSSTSSSF

SEQ ID NO: 78677 - protein, 10 aa, Artificial Sequence
  Description of Artificial Sequence: Synthetic peptide
  Seed: TTDDSTATES (MAGC1_HUMAN)
TNDDSTATEY

SEQ ID NO: 78678 - protein, 9 aa, Artificial Sequence
  Description of Artificial Sequence: Synthetic peptide
  Seed: CSSSTSLSL (MAGC1_HUMAN)
CRSSTSLSM

SEQ ID NO: 78679 - protein, 10 aa, Artificial Sequence
  Description of Artificial Sequence: Synthetic peptide
  Seed: MTSSFSSTLL (MAGC1_HUMAN)
MMSSFSSTLI

SEQ ID NO: 78680 - protein, 10 aa, Artificial Sequence
  Description of Artificial Sequence: Synthetic peptide
  Seed: SSPESAQSTF (MAGC1_HUMAN)
SVPESAQSTY

SEQ ID NO: 78681 - protein, 9 aa, Artificial Sequence
  Description of Artificial Sequence: Synthetic peptide
  Seed: VIFRKAREF (MAGC1_HUMAN)
VAFRKAREF

SEQ ID NO: 78682 - protein, 9 aa, Artificial Sequence
  Description of Artificial Sequence: Synthetic peptide
  Seed: VSSSFSYTL (MAGC1_HUMAN)
VVSSFSYTI

SEQ ID NO: 78683 - protein, 9 aa, Artificial Sequence
  Description of Artificial Sequence: Synthetic peptide
  Seed: KQPITKAEM (MAGC1_HUMAN)
KQPITKAEV

SEQ ID NO: 78684 - protein, 11 aa, Artificial Sequence
  Description of Artificial Sequence: Synthetic peptide
  Seed: SLSQSSPVSSF (MAGC1_HUMAN)
SASQSSPVSSW

SEQ ID NO: 78685 - protein, 10 aa, Artificial Sequence
  Description of Artificial Sequence: Synthetic peptide
  Seed: RPVSSFFSYT (MAGC1_HUMAN)
RSVSSFFSYA

SEQ ID NO: 78686 - protein, 9 aa, Artificial Sequence
  Description of Artificial Sequence: Synthetic peptide
  Seed: AGREHFAFG (MAGC1_HUMAN)
ASREHFAFP

SEQ ID NO: 78687 - protein, 9 aa, Artificial Sequence
  Description of Artificial Sequence: Synthetic peptide
  Seed: RAHSEVIKR (MAGC1_HUMAN)
RIHSEVIKY

SEQ ID NO: 78688 - protein, 9 aa, Artificial Sequence
  Description of Artificial Sequence: Synthetic peptide
  Seed: VSSSSSSTL (MAGC1_HUMAN)
VMSSSSSTM

SEQ ID NO: 78689 - protein, 10 aa, Artificial Sequence
  Description of Artificial Sequence: Synthetic peptide
  Seed: FAQSSLQIPV (MAGC1_HUMAN)
FKQSSLQIPV

SEQ ID NO: 78690 - protein, 9 aa, Artificial Sequence
  Description of Artificial Sequence: Synthetic peptide
  Seed: FFSYTLASL (MAGC1_HUMAN)
FLSYTLASM

SEQ ID NO: 78691 - protein, 11 aa, Artificial Sequence
  Description of Artificial Sequence: Synthetic peptide
  Seed: SFFSSALLSIF (MAGC1_HUMAN)
SSFSSALLSIY

SEQ ID NO: 78692 - protein, 11 aa, Artificial Sequence
  Description of Artificial Sequence: Synthetic peptide
  Seed: QSSPESAQSAF (MAGC1_HUMAN)
QPSPESAQSAY

SEQ ID NO: 78693 - protein, 10 aa, Artificial Sequence
  Description of Artificial Sequence: Synthetic peptide
  Seed: SSPESAQSAF (MAGC1_HUMAN)
SIPESAQSAY

SEQ ID NO: 78694 - protein, 11 aa, Artificial Sequence
  Description of Artificial Sequence: Synthetic peptide
  Seed: IPMTSSFSSTL (MAGC1_HUMAN)
IIMTSSFSSTW

SEQ ID NO: 78695 - protein, 9 aa, Artificial Sequence
  Description of Artificial Sequence: Synthetic peptide
  Seed: FPSSTSSSL (MAGC1_HUMAN)
FMSSTSSSI

SEQ ID NO: 78696 - protein, 8 aa, Artificial Sequence
  Description of Artificial Sequence: Synthetic peptide
  Seed: IPVSPSSS (MAGC1_HUMAN)
IPVSPSSA

SEQ ID NO: 78697 - protein, 9 aa, Artificial Sequence
  Description of Artificial Sequence: Synthetic peptide
  Seed: YTGYFPVIF (MAGC1_HUMAN)
YHGYFPVIY

SEQ ID NO: 78698 - protein, 10 aa, Artificial Sequence
  Description of Artificial Sequence: Synthetic peptide
  Seed: LSQSSPVSSF (MAGC1_HUMAN)
LVQSSPVSSM

SEQ ID NO: 78699 - protein, 9 aa, Artificial Sequence
  Description of Artificial Sequence: Synthetic peptide
  Seed: FFSYTLASL (MAGC1_HUMAN)
FQSYTLASI

SEQ ID NO: 78700 - protein, 8 aa, Artificial Sequence
  Description of Artificial Sequence: Synthetic peptide
  Seed: SSPPRYEF (MAGC1_HUMAN)
SYPPRYEM

SEQ ID NO: 78701 - protein, 9 aa, Artificial Sequence
  Description of Artificial Sequence: Synthetic peptide
  Seed: SSPPRYEFL (MAGC1_HUMAN)
SRPPRYEFI

SEQ ID NO: 78702 - protein, 10 aa, Artificial Sequence
  Description of Artificial Sequence: Synthetic peptide
  Seed: VISFSSSTSL (MAGC1_HUMAN)
VQSFSSSTSI

SEQ ID NO: 78703 - protein, 9 aa, Artificial Sequence
  Description of Artificial Sequence: Synthetic peptide
  Seed: SRYTGYFPV (MAGC1_HUMAN)
SHYTGYFPM

SEQ ID NO: 78704 - protein, 9 aa, Artificial Sequence
  Description of Artificial Sequence: Synthetic peptide
  Seed: SAPEGEDSL (MAGC1_HUMAN)
SIPEGEDSV

SEQ ID NO: 78705 - protein, 9 aa, Artificial Sequence
  Description of Artificial Sequence: Synthetic peptide
  Seed: VIWDVLSGI (MAGC1_HUMAN)
VMWDVLSGV

SEQ ID NO: 78706 - protein, 9 aa, Artificial Sequence
  Description of Artificial Sequence: Synthetic peptide
  Seed: AGREHFAFG (MAGC1_HUMAN)
AVREHFAFP

SEQ ID NO: 78707 - protein, 9 aa, Artificial Sequence
  Description of Artificial Sequence: Synthetic peptide
  Seed: DSYVFVNTL (MAGC1_HUMAN)
DMYVFVNTY

SEQ ID NO: 78708 - protein, 10 aa, Artificial Sequence
  Description of Artificial Sequence: Synthetic peptide
  Seed: FPQSPLQIPV (MAGC1_HUMAN)
FIQSPLQIPV

SEQ ID NO: 78709 - protein, 9 aa, Artificial Sequence
  Description of Artificial Sequence: Synthetic peptide
  Seed: RLLILILSI (MAGC1_HUMAN)
RSLILILSV

SEQ ID NO: 78710 - protein, 11 aa, Artificial Sequence
  Description of Artificial Sequence: Synthetic peptide
  Seed: SSFPSSTSSSL (MAGC1_HUMAN)
STFPSSTSSSY

SEQ ID NO: 78711 - protein, 10 aa, Artificial Sequence
  Description of Artificial Sequence: Synthetic peptide
  Seed: MTSSFSSTLL (MAGC1_HUMAN)
MLSSFSSTLA

SEQ ID NO: 78712 - protein, 10 aa, Artificial Sequence
  Description of Artificial Sequence: Synthetic peptide
  Seed: VSSSFSYTLL (MAGC1_HUMAN)
VASSFSYTLW

SEQ ID NO: 78713 - protein, 10 aa, Artificial Sequence
  Description of Artificial Sequence: Synthetic peptide
  Seed: FPQSLLQIPM (MAGC1_HUMAN)
FMQSLLQIPM

SEQ ID NO: 78714 - protein, 9 aa, Artificial Sequence
  Description of Artificial Sequence: Synthetic peptide
  Seed: FTYTLDEKV (MAGC1_HUMAN)
FMYTLDEKV

SEQ ID NO: 78715 - protein, 9 aa, Artificial Sequence
  Description of Artificial Sequence: Synthetic peptide
  Seed: RAHSEVIKR (MAGC1_HUMAN)
RTHSEVIKM

SEQ ID NO: 78716 - protein, 9 aa, Artificial Sequence
  Description of Artificial Sequence: Synthetic peptide
  Seed: SVLQIPVSA (MAGC1_HUMAN)
SYLQIPVSR

SEQ ID NO: 78717 - protein, 10 aa, Artificial Sequence
  Description of Artificial Sequence: Synthetic peptide
  Seed: SSFSYTLLSL (MAGC1_HUMAN)
SMFSYTLLSI

SEQ ID NO: 78718 - protein, 9 aa, Artificial Sequence
  Description of Artificial Sequence: Synthetic peptide
  Seed: MPSLLQSSS (MAGC1_HUMAN)
MMSLLQSSF

SEQ ID NO: 78719 - protein, 9 aa, Artificial Sequence
  Description of Artificial Sequence: Synthetic peptide
  Seed: NSSPPRYEF (MAGC1_HUMAN)
NHSPPRYEY

SEQ ID NO: 78720 - protein, 9 aa, Artificial Sequence
  Description of Artificial Sequence: Synthetic peptide
  Seed: AQSPLQRPV (MAGC1_HUMAN)
ATSPLQRPL

SEQ ID NO: 78721 - protein, 9 aa, Artificial Sequence
  Description of Artificial Sequence: Synthetic peptide
  Seed: LKNTVPITF (MAGC1_HUMAN)
LHNTVPITM

SEQ ID NO: 78722 - protein, 9 aa, Artificial Sequence
  Description of Artificial Sequence: Synthetic peptide
  Seed: SSPESAQSA (MAGC1_HUMAN)
SIPESAQSM

SEQ ID NO: 78723 - protein, 9 aa, Artificial Sequence
  Description of Artificial Sequence: Synthetic peptide
  Seed: NSSPPRYEF (MAGC1_HUMAN)
NYSPPRYEY

SEQ ID NO: 78724 - protein, 9 aa, Artificial Sequence
  Description of Artificial Sequence: Synthetic peptide
  Seed: SSFFSSALL (MAGC1_HUMAN)
STFFSSALA

SEQ ID NO: 78725 - protein, 9 aa, Artificial Sequence
  Description of Artificial Sequence: Synthetic peptide
  Seed: SFFSYTLAS (MAGC1_HUMAN)
SMFSYTLAY

SEQ ID NO: 78726 - protein, 9 aa, Artificial Sequence
  Description of Artificial Sequence: Synthetic peptide
  Seed: SFSSTLVSL (MAGC1_HUMAN)
STSSTLVSM

SEQ ID NO: 78727 - protein, 10 aa, Artificial Sequence
  Description of Artificial Sequence: Synthetic peptide
  Seed: SPLQIPVSSS (MAGC1_HUMAN)
SPLQIPVSSA

SEQ ID NO: 78728 - protein, 11 aa, Artificial Sequence
  Description of Artificial Sequence: Synthetic peptide
  Seed: SSSSSTLLSLF (MAGC1_HUMAN)
SGSSSTLLSLW

SEQ ID NO: 78729 - protein, 11 aa, Artificial Sequence
  Description of Artificial Sequence: Synthetic peptide
  Seed: IPVSSSSSSTL (MAGC1_HUMAN)
IAVSSSSSSTM

SEQ ID NO: 78730 - protein, 9 aa, Artificial Sequence
  Description of Artificial Sequence: Synthetic peptide
  Seed: EFIEILFGI (MAGC1_HUMAN)
EAIEILFGA

SEQ ID NO: 78731 - protein, 10 aa, Artificial Sequence
  Description of Artificial Sequence: Synthetic peptide
  Seed: MPTAGMPSLL (MAGC1_HUMAN)
MKTAGMPSLA

SEQ ID NO: 78732 - protein, 9 aa, Artificial Sequence
  Description of Artificial Sequence: Synthetic peptide
  Seed: AQSPLQIPV (MAGC1_HUMAN)
AKSPLQIPM

SEQ ID NO: 78733 - protein, 9 aa, Artificial Sequence
  Description of Artificial Sequence: Synthetic peptide
  Seed: LKYQVKQPI (MAGC1_HUMAN)
LKYQVKQPL

SEQ ID NO: 78734 - protein, 10 aa, Artificial Sequence
  Description of Artificial Sequence: Synthetic peptide
  Seed: LQIPGSPSFS (MAGC1_HUMAN)
LMIPGSPSFT

SEQ ID NO: 78735 - protein, 9 aa, Artificial Sequence
  Description of Artificial Sequence: Synthetic peptide
  Seed: SRYTGYFPV (MAGC1_HUMAN)
SKYTGYFPV

SEQ ID NO: 78736 - protein, 9 aa, Artificial Sequence
  Description of Artificial Sequence: Synthetic peptide
  Seed: LQNPASSFF (MAGC1_HUMAN)
LPNPASSFL

SEQ ID NO: 78737 - protein, 9 aa, Artificial Sequence
  Description of Artificial Sequence: Synthetic peptide
  Seed: RPVSSFFSY (MAGC1_HUMAN)
REVSSFFSM

SEQ ID NO: 78738 - protein, 9 aa, Artificial Sequence
  Description of Artificial Sequence: Synthetic peptide
  Seed: YVFVNTLDL (MAGC1_HUMAN)
YRFVNTLDY

SEQ ID NO: 78739 - protein, 9 aa, Artificial Sequence
  Description of Artificial Sequence: Synthetic peptide
  Seed: VSSSFSYTL (MAGC1_HUMAN)
VASSFSYTV

SEQ ID NO: 78740 - protein, 10 aa, Artificial Sequence
  Description of Artificial Sequence: Synthetic peptide
  Seed: SFSSTLLSIL (MAGC1_HUMAN)
SQSSTLLSIM

SEQ ID NO: 78741 - protein, 9 aa, Artificial Sequence
  Description of Artificial Sequence: Synthetic peptide
  Seed: FSSTLLSLF (MAGC1_HUMAN)
FSSTLLSLM

SEQ ID NO: 78742 - protein, 9 aa, Artificial Sequence
  Description of Artificial Sequence: Synthetic peptide
  Seed: TGYFPVIFR (MAGC1_HUMAN)
TWYFPVIFR

SEQ ID NO: 78743 - protein, 11 aa, Artificial Sequence
  Description of Artificial Sequence: Synthetic peptide
  Seed: ITFPSSYKDAL (MAGC1_HUMAN)
IVFPSSYKDAW

SEQ ID NO: 78744 - protein, 10 aa, Artificial Sequence
  Description of Artificial Sequence: Synthetic peptide
  Seed: MPTAGMPSLL (MAGC1_HUMAN)
MWTAGMPSLW

SEQ ID NO: 78745 - protein, 9 aa, Artificial Sequence
  Description of Artificial Sequence: Synthetic peptide
  Seed: KVDELARFL (MAGC1_HUMAN)
KSDELARFV

SEQ ID NO: 78746 - protein, 10 aa, Artificial Sequence
  Description of Artificial Sequence: Synthetic peptide
  Seed: RKVVEFLAML (MAGC1_HUMAN)
RQVVEFLAMM

SEQ ID NO: 78747 - protein, 9 aa, Artificial Sequence
  Description of Artificial Sequence: Synthetic peptide
  Seed: WVQEHYLEY (MAGC1_HUMAN)
WWQEHYLEM

SEQ ID NO: 78748 - protein, 9 aa, Artificial Sequence
  Description of Artificial Sequence: Synthetic peptide
  Seed: FSSTLVSLF (MAGC1_HUMAN)
FASTLVSLA

SEQ ID NO: 78749 - protein, 10 aa, Artificial Sequence
  Description of Artificial Sequence: Synthetic peptide
  Seed: FLAMLKNTVP (MAGC1_HUMAN)
FLAMLKNTVW

SEQ ID NO: 78750 - protein, 9 aa, Artificial Sequence
  Description of Artificial Sequence: Synthetic peptide
  Seed: IFQSSPESA (MAGC1_HUMAN)
IYQSSPESV

SEQ ID NO: 78751 - protein, 10 aa, Artificial Sequence
  Description of Artificial Sequence: Synthetic peptide
  Seed: KGTYASEEVI (MAGC1_HUMAN)
KNTYASEEVF

SEQ ID NO: 78752 - protein, 10 aa, Artificial Sequence
  Description of Artificial Sequence: Synthetic peptide
  Seed: LLQIPMTSSF (MAGC1_HUMAN)
LGQIPMTSSF

SEQ ID NO: 78753 - protein, 9 aa, Artificial Sequence
  Description of Artificial Sequence: Synthetic peptide
  Seed: LSPLHFPQF (MAGC1_HUMAN)
LTPLHFPQY

SEQ ID NO: 78754 - protein, 10 aa, Artificial Sequence
  Description of Artificial Sequence: Synthetic peptide
  Seed: VISFSSSTSL (MAGC1_HUMAN)
VESFSSSTSM

SEQ ID NO: 78755 - protein, 10 aa, Artificial Sequence
  Description of Artificial Sequence: Synthetic peptide
  Seed: STLLSLFQSF (MAGC1_HUMAN)
SHLLSLFQSF

SEQ ID NO: 78756 - protein, 10 aa, Artificial Sequence
  Description of Artificial Sequence: Synthetic peptide
  Seed: SFFSSALLSI (MAGC1_HUMAN)
SMFSSALLSF

SEQ ID NO: 78757 - protein, 9 aa, Artificial Sequence
  Description of Artificial Sequence: Synthetic peptide
  Seed: FSYTLLSLF (MAGC1_HUMAN)
FTYTLLSLY

SEQ ID NO: 78758 - protein, 9 aa, Artificial Sequence
  Description of Artificial Sequence: Synthetic peptide
  Seed: YTGYFPVIF (MAGC1_HUMAN)
YKGYFPVIF

SEQ ID NO: 78759 - protein, 9 aa, Artificial Sequence
  Description of Artificial Sequence: Synthetic peptide
  Seed: ASSSTLVSI (MAGC1_HUMAN)
ALSSTLVSL

SEQ ID NO: 78760 - protein, 10 aa, Artificial Sequence
  Description of Artificial Sequence: Synthetic peptide
  Seed: FPQSLLQIPM (MAGC1_HUMAN)
FIQSLLQIPV

SEQ ID NO: 78761 - protein, 10 aa, Artificial Sequence
  Description of Artificial Sequence: Synthetic peptide
  Seed: MPTAGMPSLL (MAGC1_HUMAN)
MYTAGMPSLI

SEQ ID NO: 78762 - protein, 9 aa, Artificial Sequence
  Description of Artificial Sequence: Synthetic peptide
  Seed: SIFQSSPER (MAGC1_HUMAN)
SSFQSSPEY

SEQ ID NO: 78763 - protein, 10 aa, Artificial Sequence
  Description of Artificial Sequence: Synthetic peptide
  Seed: MTSSFSSTLL (MAGC1_HUMAN)
MNSSFSSTLM

SEQ ID NO: 78764 - protein, 9 aa, Artificial Sequence
  Description of Artificial Sequence: Synthetic peptide
  Seed: SLFQSFSER (MAGC1_HUMAN)
SYFQSFSEK

SEQ ID NO: 78765 - protein, 10 aa, Artificial Sequence
  Description of Artificial Sequence: Synthetic peptide
  Seed: RAGREHFAFG (MAGC1_HUMAN)
RMGREHFAFR

SEQ ID NO: 78766 - protein, 10 aa, Artificial Sequence
  Description of Artificial Sequence: Synthetic peptide
  Seed: SLQIPVSPSF (MAGC1_HUMAN)
SCQIPVSPSM

SEQ ID NO: 78767 - protein, 10 aa, Artificial Sequence
  Description of Artificial Sequence: Synthetic peptide
  Seed: VSSSSSSTLL (MAGC1_HUMAN)
VNSSSSSTLW

SEQ ID NO: 78768 - protein, 9 aa, Artificial Sequence
  Description of Artificial Sequence: Synthetic peptide
  Seed: SLPQSFPES (MAGC1_HUMAN)
SLPQSFPEM

SEQ ID NO: 78769 - protein, 9 aa, Artificial Sequence
  Description of Artificial Sequence: Synthetic peptide
  Seed: CSSSTPSSL (MAGC1_HUMAN)
CKSSTPSSF

SEQ ID NO: 78770 - protein, 9 aa, Artificial Sequence
  Description of Artificial Sequence: Synthetic peptide
  Seed: LQIVPSLPE (MAGC1_HUMAN)
LTIVPSLPY

SEQ ID NO: 78771 - protein, 9 aa, Artificial Sequence
  Description of Artificial Sequence: Synthetic peptide
  Seed: SSFFSSALL (MAGC1_HUMAN)
SQFFSSALM

SEQ ID NO: 78772 - protein, 9 aa, Artificial Sequence
  Description of Artificial Sequence: Synthetic peptide
  Seed: SQSSPVSSF (MAGC1_HUMAN)
SESSPVSSY

SEQ ID NO: 78773 - protein, 10 aa, Artificial Sequence
  Description of Artificial Sequence: Synthetic peptide
  Seed: SSPERTQSTF (MAGC1_HUMAN)
SIPERTQSTY

SEQ ID NO: 78774 - protein, 9 aa, Artificial Sequence
  Description of Artificial Sequence: Synthetic peptide
  Seed: SSSTLVSIF (MAGC1_HUMAN)
SQSTLVSIL

SEQ ID NO: 78775 - protein, 10 aa, Artificial Sequence
  Description of Artificial Sequence: Synthetic peptide
  Seed: STPSSLPQSF (MAGC1_HUMAN)
SMPSSLPQSF

SEQ ID NO: 78776 - protein, 9 aa, Artificial Sequence
  Description of Artificial Sequence: Synthetic peptide
  Seed: NSSPPRYEF (MAGC1_HUMAN)
NASPPRYEY

SEQ ID NO: 78777 - protein, 9 aa, Artificial Sequence
  Description of Artificial Sequence: Synthetic peptide
  Seed: CSSSTPSSL (MAGC1_HUMAN)
CMSSTPSSF

SEQ ID NO: 78778 - protein, 10 aa, Artificial Sequence
  Description of Artificial Sequence: Synthetic peptide
  Seed: FPQSVLQIPV (MAGC1_HUMAN)
FAQSVLQIPY

SEQ ID NO: 78779 - protein, 10 aa, Artificial Sequence
  Description of Artificial Sequence: Synthetic peptide
  Seed: LSKSSPESPL (MAGC1_HUMAN)
LSKSSPESPW

SEQ ID NO: 78780 - protein, 9 aa, Artificial Sequence
  Description of Artificial Sequence: Synthetic peptide
  Seed: SPLEGEDSL (MAGC1_HUMAN)
SHLEGEDSM

SEQ ID NO: 78781 - protein, 9 aa, Artificial Sequence
  Description of Artificial Sequence: Synthetic peptide
  Seed: SSPESPLQS (MAGC1_HUMAN)
SVPESPLQV

SEQ ID NO: 78782 - protein, 9 aa, Artificial Sequence
  Description of Artificial Sequence: Synthetic peptide
  Seed: LQIPVSSSS (MAGC1_HUMAN)
LAIPVSSSY

SEQ ID NO: 78783 - protein, 10 aa, Artificial Sequence
  Description of Artificial Sequence: Synthetic peptide
  Seed: STFEGFPQSL (MAGC1_HUMAN)
SSFEGFPQSV

SEQ ID NO: 78784 - protein, 9 aa, Artificial Sequence
  Description of Artificial Sequence: Synthetic peptide
  Seed: FSSTLVSLF (MAGC1_HUMAN)
FYSTLVSLW

SEQ ID NO: 78785 - protein, 10 aa, Artificial Sequence
  Description of Artificial Sequence: Synthetic peptide
  Seed: SSFSYTLLSL (MAGC1_HUMAN)
SAFSYTLLSL

SEQ ID NO: 78786 - protein, 9 aa, Artificial Sequence
  Description of Artificial Sequence: Synthetic peptide
  Seed: TLDEKVDEL (MAGC1_HUMAN)
TTDEKVDEA

SEQ ID NO: 78787 - protein, 10 aa, Artificial Sequence
  Description of Artificial Sequence: Synthetic peptide
  Seed: FFSYTLASLL (MAGC1_HUMAN)
FMSYTLASLK

SEQ ID NO: 78788 - protein, 9 aa, Artificial Sequence
  Description of Artificial Sequence: Synthetic peptide
  Seed: SLPEWEDSL (MAGC1_HUMAN)
SQPEWEDSW

SEQ ID NO: 78789 - protein, 10 aa, Artificial Sequence
  Description of Artificial Sequence: Synthetic peptide
  Seed: SSPECTQSTF (MAGC1_HUMAN)
SQPECTQSTY

SEQ ID NO: 78790 - protein, 9 aa, Artificial Sequence
  Description of Artificial Sequence: Synthetic peptide
  Seed: SSFFSSALL (MAGC1_HUMAN)
SQFFSSALH

SEQ ID NO: 78791 - protein, 10 aa, Artificial Sequence
  Description of Artificial Sequence: Synthetic peptide
  Seed: RKVVEFLAML (MAGC1_HUMAN)
RNVVEFLAMA

SEQ ID NO: 78792 - protein, 9 aa, Artificial Sequence
  Description of Artificial Sequence: Synthetic peptide
  Seed: LARFLLLKY (MAGC1_HUMAN)
LSRFLLLKY

SEQ ID NO: 78793 - protein, 9 aa, Artificial Sequence
  Description of Artificial Sequence: Synthetic peptide
  Seed: FPSSYKDAL (MAGC1_HUMAN)
FPSSYKDAA

SEQ ID NO: 78794 - protein, 9 aa, Artificial Sequence
  Description of Artificial Sequence: Synthetic peptide
  Seed: MTSSFSSTL (MAGC1_HUMAN)
MTSSFSSTY

SEQ ID NO: 78795 - protein, 9 aa, Artificial Sequence
  Description of Artificial Sequence: Synthetic peptide
  Seed: SFPSSTSSS (MAGC1_HUMAN)
SLPSSTSSY

SEQ ID NO: 78796 - protein, 11 aa, Artificial Sequence
  Description of Artificial Sequence: Synthetic peptide
  Seed: TLYPLQSPQSR (MAGC1_HUMAN)
TFYPLQSPQSR

SEQ ID NO: 78797 - protein, 10 aa, Artificial Sequence
  Description of Artificial Sequence: Synthetic peptide
  Seed: SPLYFPQSPL (MAGC1_HUMAN)
SHLYFPQSPV

SEQ ID NO: 78798 - protein, 11 aa, Artificial Sequence
  Description of Artificial Sequence: Synthetic peptide
  Seed: FPQSPQGEDSL (MAGC1_HUMAN)
FPQSPQGEDSF

SEQ ID NO: 78799 - protein, 9 aa, Artificial Sequence
  Description of Artificial Sequence: Synthetic peptide
  Seed: VVEFLAMLK (MAGC1_HUMAN)
VTEFLAMLY

SEQ ID NO: 78800 - protein, 10 aa, Artificial Sequence
  Description of Artificial Sequence: Synthetic peptide
  Seed: REHFAFGEPR (MAGC1_HUMAN)
RFHFAFGEPK

SEQ ID NO: 78801 - protein, 10 aa, Artificial Sequence
  Description of Artificial Sequence: Synthetic peptide
  Seed: RAGREHFAFG (MAGC1_HUMAN)
RIGREHFAFV

SEQ ID NO: 78802 - protein, 11 aa, Artificial Sequence
  Description of Artificial Sequence: Synthetic peptide
  Seed: EGEDSSDPLQR (MAGC1_HUMAN)
EAEDSSDPLQY

SEQ ID NO: 78803 - protein, 9 aa, Artificial Sequence
  Description of Artificial Sequence: Synthetic peptide
  Seed: TLLSLFQSF (MAGC1_HUMAN)
TQLSLFQSW

SEQ ID NO: 78804 - protein, 9 aa, Artificial Sequence
  Description of Artificial Sequence: Synthetic peptide
  Seed: TPSSLPQSF (MAGC1_HUMAN)
TRSSLPQSY

SEQ ID NO: 78805 - protein, 11 aa, Artificial Sequence
  Description of Artificial Sequence: Synthetic peptide
  Seed: SFFSSALLSIF (MAGC1_HUMAN)
SYFSSALLSII

SEQ ID NO: 78806 - protein, 10 aa, Artificial Sequence
  Description of Artificial Sequence: Synthetic peptide
  Seed: ICSSSTPSSL (MAGC1_HUMAN)
ICSSSTPSSF

SEQ ID NO: 78807 - protein, 10 aa, Artificial Sequence
  Description of Artificial Sequence: Synthetic peptide
  Seed: SSSSSSSTLL (MAGC1_HUMAN)
SASSSSSTLW

SEQ ID NO: 78808 - protein, 9 aa, Artificial Sequence
  Description of Artificial Sequence: Synthetic peptide
  Seed: VQSPLQNPA (MAGC1_HUMAN)
VESPLQNPA

SEQ ID NO: 78809 - protein, 10 aa, Artificial Sequence
  Description of Artificial Sequence: Synthetic peptide
  Seed: ASSFFSSALL (MAGC1_HUMAN)
AFSFFSSALM

SEQ ID NO: 78810 - protein, 9 aa, Artificial Sequence
  Description of Artificial Sequence: Synthetic peptide
  Seed: RLLILILSI (MAGC1_HUMAN)
RMLILILSY

SEQ ID NO: 78811 - protein, 10 aa, Artificial Sequence
  Description of Artificial Sequence: Synthetic peptide
  Seed: FPQSPLQIPV (MAGC1_HUMAN)
FLQSPLQIPT

SEQ ID NO: 78812 - protein, 10 aa, Artificial Sequence
  Description of Artificial Sequence: Synthetic peptide
  Seed: TLDEKVDELA (MAGC1_HUMAN)
TSDEKVDELF

SEQ ID NO: 78813 - protein, 9 aa, Artificial Sequence
  Description of Artificial Sequence: Synthetic peptide
  Seed: SRYTGYFPV (MAGC1_HUMAN)
SNYTGYFPY

SEQ ID NO: 78814 - protein, 10 aa, Artificial Sequence
  Description of Artificial Sequence: Synthetic peptide
  Seed: KVVEFLAMLK (MAGC1_HUMAN)
KMVEFLAMLY

SEQ ID NO: 78815 - protein, 9 aa, Artificial Sequence
  Description of Artificial Sequence: Synthetic peptide
  Seed: LQIPVSPSF (MAGC1_HUMAN)
LAIPVSPSY

SEQ ID NO: 78816 - protein, 11 aa, Artificial Sequence
  Description of Artificial Sequence: Synthetic peptide
  Seed: SFFSYTLASLL (MAGC1_HUMAN)
SGFSYTLASLY

SEQ ID NO: 78817 - protein, 9 aa, Artificial Sequence
  Description of Artificial Sequence: Synthetic peptide
  Seed: SSSFSYTLL (MAGC1_HUMAN)
STSFSYTLW

SEQ ID NO: 78818 - protein, 9 aa, Artificial Sequence
  Description of Artificial Sequence: Synthetic peptide
  Seed: AASSSTLVS (MAGC1_HUMAN)
AASSSTLVL

SEQ ID NO: 78819 - protein, 9 aa, Artificial Sequence
  Description of Artificial Sequence: Synthetic peptide
  Seed: ASSFFSSAL (MAGC1_HUMAN)
APSFFSSAY

SEQ ID NO: 78820 - protein, 9 aa, Artificial Sequence
  Description of Artificial Sequence: Synthetic peptide
  Seed: VPNSSPPRY (MAGC1_HUMAN)
VPNSSPPRA

SEQ ID NO: 78821 - protein, 9 aa, Artificial Sequence
  Description of Artificial Sequence: Synthetic peptide
  Seed: LQIPVSRSF (MAGC1_HUMAN)
LFIPVSRSF

SEQ ID NO: 78822 - protein, 9 aa, Artificial Sequence
  Description of Artificial Sequence: Synthetic peptide
  Seed: VSPSSSSTL (MAGC1_HUMAN)
VLPSSSSTL

SEQ ID NO: 78823 - protein, 9 aa, Artificial Sequence
  Description of Artificial Sequence: Synthetic peptide
  Seed: SPVSSFPSS (MAGC1_HUMAN)
SAVSSFPSY

SEQ ID NO: 78824 - protein, 10 aa, Artificial Sequence
  Description of Artificial Sequence: Synthetic peptide
  Seed: EGPAQSPLQR (MAGC1_HUMAN)
ESPAQSPLQR

SEQ ID NO: 78825 - protein, 11 aa, Artificial Sequence
  Description of Artificial Sequence: Synthetic peptide
  Seed: LQRPVSSFFSY (MAGC1_HUMAN)
LNRPVSSFFSY

SEQ ID NO: 78826 - protein, 11 aa, Artificial Sequence
  Description of Artificial Sequence: Synthetic peptide
  Seed: SPLQIPMTSSF (MAGC1_HUMAN)
SCLQIPMTSSM

SEQ ID NO: 78827 - protein, 9 aa, Artificial Sequence
  Description of Artificial Sequence: Synthetic peptide
  Seed: MTSSFSSTL (MAGC1_HUMAN)
MASSFSSTF

SEQ ID NO: 78828 - protein, 11 aa, Artificial Sequence
  Description of Artificial Sequence: Synthetic peptide
  Seed: MSPLYFPQSPL (MAGC1_HUMAN)
MLPLYFPQSPI

SEQ ID NO: 78829 - protein, 11 aa, Artificial Sequence
  Description of Artificial Sequence: Synthetic peptide
  Seed: SSTPSSLPQSF (MAGC1_HUMAN)
SQTPSSLPQSF

SEQ ID NO: 78830 - protein, 10 aa, Artificial Sequence
  Description of Artificial Sequence: Synthetic peptide
  Seed: TLDEKVDELA (MAGC1_HUMAN)
TMDEKVDELF

SEQ ID NO: 78831 - protein, 9 aa, Artificial Sequence
  Description of Artificial Sequence: Synthetic peptide
  Seed: YTSSSDTLL (MAGC1_HUMAN)
YMSSSDTLF

SEQ ID NO: 78832 - protein, 9 aa, Artificial Sequence
  Description of Artificial Sequence: Synthetic peptide
  Seed: STFEGFAQS (MAGC1_HUMAN)
SQFEGFAQF

SEQ ID NO: 78833 - protein, 9 aa, Artificial Sequence
  Description of Artificial Sequence: Synthetic peptide
  Seed: VSRSFSSTL (MAGC1_HUMAN)
VPRSFSSTY

SEQ ID NO: 78834 - protein, 10 aa, Artificial Sequence
  Description of Artificial Sequence: Synthetic peptide
  Seed: STLLSLFQSF (MAGC1_HUMAN)
SQLLSLFQSY

SEQ ID NO: 78835 - protein, 10 aa, Artificial Sequence
  Description of Artificial Sequence: Synthetic peptide
  Seed: RPVSSFFSYT (MAGC1_HUMAN)
RMVSSFFSYA

SEQ ID NO: 78836 - protein, 10 aa, Artificial Sequence
  Description of Artificial Sequence: Synthetic peptide
  Seed: SSPESAQSTF (MAGC1_HUMAN)
SPPESAQSTY

SEQ ID NO: 78837 - protein, 9 aa, Artificial Sequence
  Description of Artificial Sequence: Synthetic peptide
  Seed: FSYTLASLL (MAGC1_HUMAN)
FVYTLASLA

SEQ ID NO: 78838 - protein, 9 aa, Artificial Sequence
  Description of Artificial Sequence: Synthetic peptide
  Seed: TLVSLFQSS (MAGC1_HUMAN)
TLVSLFQSA

SEQ ID NO: 78839 - protein, 10 aa, Artificial Sequence
  Description of Artificial Sequence: Synthetic peptide
  Seed: SFPSSTSSSL (MAGC1_HUMAN)
SFPSSTSSSI

SEQ ID NO: 78840 - protein, 9 aa, Artificial Sequence
  Description of Artificial Sequence: Synthetic peptide
  Seed: KVWVQEHYL (MAGC1_HUMAN)
KMWVQEHYL

SEQ ID NO: 78841 - protein, 9 aa, Artificial Sequence
  Description of Artificial Sequence: Synthetic peptide
  Seed: SSPESTQSP (MAGC1_HUMAN)
SFPESTQSV

SEQ ID NO: 78842 - protein, 10 aa, Artificial Sequence
  Description of Artificial Sequence: Synthetic peptide
  Seed: NTVPITFPSS (MAGC1_HUMAN)
NIVPITFPSV

SEQ ID NO: 78843 - protein, 9 aa, Artificial Sequence
  Description of Artificial Sequence: Synthetic peptide
  Seed: TTDDSTATE (MAGC1_HUMAN)
TNDDSTATV

SEQ ID NO: 78844 - protein, 9 aa, Artificial Sequence
  Description of Artificial Sequence: Synthetic peptide
  Seed: SSSSTLLSL (MAGC1_HUMAN)
SQSSTLLSL

SEQ ID NO: 78845 - protein, 10 aa, Artificial Sequence
  Description of Artificial Sequence: Synthetic peptide
  Seed: RKVVEFLAML (MAGC1_HUMAN)
RAVVEFLAML

SEQ ID NO: 78846 - protein, 9 aa, Artificial Sequence
  Description of Artificial Sequence: Synthetic peptide
  Seed: VSSFFSYTL (MAGC1_HUMAN)
VASFFSYTI

SEQ ID NO: 78847 - protein, 10 aa, Artificial Sequence
  Description of Artificial Sequence: Synthetic peptide
  Seed: SPLQIPVSPS (MAGC1_HUMAN)
SPLQIPVSPI

SEQ ID NO: 78848 - protein, 9 aa, Artificial Sequence
  Description of Artificial Sequence: Synthetic peptide
  Seed: SFSYTLLSL (MAGC1_HUMAN)
SFSYTLLSY

SEQ ID NO: 78849 - protein, 8 aa, Artificial Sequence
  Description of Artificial Sequence: Synthetic peptide
  Seed: LQRPVSSF (MAGC1_HUMAN)
LARPVSSY

SEQ ID NO: 78850 - protein, 9 aa, Artificial Sequence
  Description of Artificial Sequence: Synthetic peptide
  Seed: TLLSIFQSS (MAGC1_HUMAN)
TQLSIFQSA

SEQ ID NO: 78851 - protein, 9 aa, Artificial Sequence
  Description of Artificial Sequence: Synthetic peptide
  Seed: TPSSLPQSF (MAGC1_HUMAN)
TISSLPQSM

SEQ ID NO: 78852 - protein, 10 aa, Artificial Sequence
  Description of Artificial Sequence: Synthetic peptide
  Seed: LAMLKNTVPI (MAGC1_HUMAN)
LHMLKNTVPL

SEQ ID NO: 78853 - protein, 9 aa, Artificial Sequence
  Description of Artificial Sequence: Synthetic peptide
  Seed: IPVSSSFSY (MAGC1_HUMAN)
IVVSSSFSF

SEQ ID NO: 78854 - protein, 10 aa, Artificial Sequence
  Description of Artificial Sequence: Synthetic peptide
  Seed: ISRYTGYFPV (MAGC1_HUMAN)
INRYTGYFPF

SEQ ID NO: 78855 - protein, 10 aa, Artificial Sequence
  Description of Artificial Sequence: Synthetic peptide
  Seed: REFIEILFGI (MAGC1_HUMAN)
RYFIEILFGF

SEQ ID NO: 78856 - protein, 10 aa, Artificial Sequence
  Description of Artificial Sequence: Synthetic peptide
  Seed: TGYFPVIFRK (MAGC1_HUMAN)
TVYFPVIFRN

SEQ ID NO: 78857 - protein, 10 aa, Artificial Sequence
  Description of Artificial Sequence: Synthetic peptide
  Seed: FPQSPLQIPV (MAGC1_HUMAN)
FVQSPLQIPL

SEQ ID NO: 78858 - protein, 10 aa, Artificial Sequence
  Description of Artificial Sequence: Synthetic peptide
  Seed: LQIPMTSSFS (MAGC1_HUMAN)
LKIPMTSSFY

SEQ ID NO: 78859 - protein, 10 aa, Artificial Sequence
  Description of Artificial Sequence: Synthetic peptide
  Seed: VSPSFSSTLV (MAGC1_HUMAN)
VVPSFSSTLV

SEQ ID NO: 78860 - protein, 10 aa, Artificial Sequence
  Description of Artificial Sequence: Synthetic peptide
  Seed: VSSSSSSSTL (MAGC1_HUMAN)
VDSSSSSSTY

SEQ ID NO: 78861 - protein, 10 aa, Artificial Sequence
  Description of Artificial Sequence: Synthetic peptide
  Seed: SFPSSTSSSL (MAGC1_HUMAN)
SRPSSTSSSV

SEQ ID NO: 78862 - protein, 10 aa, Artificial Sequence
  Description of Artificial Sequence: Synthetic peptide
  Seed: ATESASSSVM (MAGC1_HUMAN)
AKESASSSVL

SEQ ID NO: 78863 - protein, 9 aa, Artificial Sequence
  Description of Artificial Sequence: Synthetic peptide
  Seed: SSPERTHST (MAGC1_HUMAN)
SIPERTHSY

SEQ ID NO: 78864 - protein, 11 aa, Artificial Sequence
  Description of Artificial Sequence: Synthetic peptide
  Seed: SPLQIPGSPSF (MAGC1_HUMAN)
SKLQIPGSPSM

SEQ ID NO: 78865 - protein, 9 aa, Artificial Sequence
  Description of Artificial Sequence: Synthetic peptide
  Seed: SSFFSYTLA (MAGC1_HUMAN)
STFFSYTLM

SEQ ID NO: 78866 - protein, 11 aa, Artificial Sequence
  Description of Artificial Sequence: Synthetic peptide
  Seed: KGTYASEEVIW (MAGC1_HUMAN)
KTTYASEEVIF

SEQ ID NO: 78867 - protein, 10 aa, Artificial Sequence
  Description of Artificial Sequence: Synthetic peptide
  Seed: ASSFFSSALL (MAGC1_HUMAN)
APSFFSSALY

SEQ ID NO: 78868 - protein, 9 aa, Artificial Sequence
  Description of Artificial Sequence: Synthetic peptide
  Seed: ASSFFSSAL (MAGC1_HUMAN)
AVSFFSSAM

SEQ ID NO: 78869 - protein, 9 aa, Artificial Sequence
  Description of Artificial Sequence: Synthetic peptide
  Seed: RPVSSFFSY (MAGC1_HUMAN)
RKVSSFFSW

SEQ ID NO: 78870 - protein, 10 aa, Artificial Sequence
  Description of Artificial Sequence: Synthetic peptide
  Seed: RAGREHFAFG (MAGC1_HUMAN)
RQGREHFAFM

SEQ ID NO: 78871 - protein, 11 aa, Artificial Sequence
  Description of Artificial Sequence: Synthetic peptide
  Seed: TVPITFPSSYK (MAGC1_HUMAN)
TFPITFPSSYR

SEQ ID NO: 78872 - protein, 10 aa, Artificial Sequence
  Description of Artificial Sequence: Synthetic peptide
  Seed: LQGEEFQSSL (MAGC1_HUMAN)
LLGEEFQSSV

SEQ ID NO: 78873 - protein, 9 aa, Artificial Sequence
  Description of Artificial Sequence: Synthetic peptide
  Seed: MPTAGMPSL (MAGC1_HUMAN)
MTTAGMPSY

SEQ ID NO: 78874 - protein, 9 aa, Artificial Sequence
  Description of Artificial Sequence: Synthetic peptide
  Seed: YTSSSDTLL (MAGC1_HUMAN)
YLSSSDTLV

SEQ ID NO: 78875 - protein, 9 aa, Artificial Sequence
  Description of Artificial Sequence: Synthetic peptide
  Seed: ESSSPVDEY (MAGC1_HUMAN)
ESSSPVDER

SEQ ID NO: 78876 - protein, 10 aa, Artificial Sequence
  Description of Artificial Sequence: Synthetic peptide
  Seed: EILFGISLRE (MAGC1_HUMAN)
EVLFGISLRR

SEQ ID NO: 78877 - protein, 9 aa, Artificial Sequence
  Description of Artificial Sequence: Synthetic peptide
  Seed: EILFGISLR (MAGC1_HUMAN)
EALFGISLK

SEQ ID NO: 78878 - protein, 10 aa, Artificial Sequence
  Description of Artificial Sequence: Synthetic peptide
  Seed: FAQSSLQIPV (MAGC1_HUMAN)
FMQSSLQIPI

SEQ ID NO: 78879 - protein, 11 aa, Artificial Sequence
  Description of Artificial Sequence: Synthetic peptide
  Seed: SSSSSTLLSLF (MAGC1_HUMAN)
SMSSSTLLSLF

SEQ ID NO: 78880 - protein, 10 aa, Artificial Sequence
  Description of Artificial Sequence: Synthetic peptide
  Seed: STLLSLFQSF (MAGC1_HUMAN)
SYLLSLFQSL

SEQ ID NO: 78881 - protein, 9 aa, Artificial Sequence
  Description of Artificial Sequence: Synthetic peptide
  Seed: SIFQSSPER (MAGC1_HUMAN)
SVFQSSPEK

SEQ ID NO: 78882 - protein, 10 aa, Artificial Sequence
  Description of Artificial Sequence: Synthetic peptide
  Seed: KGTYASEEVI (MAGC1_HUMAN)
KPTYASEEVW

SEQ ID NO: 78883 - protein, 9 aa, Artificial Sequence
  Description of Artificial Sequence: Synthetic peptide
  Seed: KAREFIEIL (MAGC1_HUMAN)
KKREFIEIY

SEQ ID NO: 78884 - protein, 11 aa, Artificial Sequence
  Description of Artificial Sequence: Synthetic peptide
  Seed: IPVSRSFSSTL (MAGC1_HUMAN)
INVSRSFSSTY

SEQ ID NO: 78885 - protein, 9 aa, Artificial Sequence
  Description of Artificial Sequence: Synthetic peptide
  Seed: AMLKNTVPI (MAGC1_HUMAN)
AVLKNTVPF

SEQ ID NO: 78886 - protein, 10 aa, Artificial Sequence
  Description of Artificial Sequence: Synthetic peptide
  Seed: EILFGISLRE (MAGC1_HUMAN)
EALFGISLRR

SEQ ID NO: 78887 - protein, 9 aa, Artificial Sequence
  Description of Artificial Sequence: Synthetic peptide
  Seed: FSSTLVSLF (MAGC1_HUMAN)
FPSTLVSLW

SEQ ID NO: 78888 - protein, 11 aa, Artificial Sequence
  Description of Artificial Sequence: Synthetic peptide
  Seed: FLWGPRAHSEV (MAGC1_HUMAN)
FMWGPRAHSEI

SEQ ID NO: 78889 - protein, 9 aa, Artificial Sequence
  Description of Artificial Sequence: Synthetic peptide
  Seed: SSSTSLSPF (MAGC1_HUMAN)
SSSTSLSPM

SEQ ID NO: 78890 - protein, 10 aa, Artificial Sequence
  Description of Artificial Sequence: Synthetic peptide
  Seed: SPLQRPVSSF (MAGC1_HUMAN)
SQLQRPVSSM

SEQ ID NO: 78891 - protein, 10 aa, Artificial Sequence
  Description of Artificial Sequence: Synthetic peptide
  Seed: SLQIPVSPSF (MAGC1_HUMAN)
SIQIPVSPSF

SEQ ID NO: 78892 - protein, 9 aa, Artificial Sequence
  Description of Artificial Sequence: Synthetic peptide
  Seed: FEGFPQSVL (MAGC1_HUMAN)
FHGFPQSVL

SEQ ID NO: 78893 - protein, 9 aa, Artificial Sequence
  Description of Artificial Sequence: Synthetic peptide
  Seed: RAHSEVIKR (MAGC1_HUMAN)
RIHSEVIKK

SEQ ID NO: 78894 - protein, 9 aa, Artificial Sequence
  Description of Artificial Sequence: Synthetic peptide
  Seed: VIFRKAREF (MAGC1_HUMAN)
VYFRKAREM

SEQ ID NO: 78895 - protein, 10 aa, Artificial Sequence
  Description of Artificial Sequence: Synthetic peptide
  Seed: TGYFPVIFRK (MAGC1_HUMAN)
TRYFPVIFRK

SEQ ID NO: 78896 - protein, 10 aa, Artificial Sequence
  Description of Artificial Sequence: Synthetic peptide
  Seed: YTLDEKVDEL (MAGC1_HUMAN)
YILDEKVDEM

SEQ ID NO: 78897 - protein, 9 aa, Artificial Sequence
  Description of Artificial Sequence: Synthetic peptide
  Seed: ESDDTLYPL (MAGC1_HUMAN)
EVDDTLYPM

SEQ ID NO: 78898 - protein, 9 aa, Artificial Sequence
  Description of Artificial Sequence: Synthetic peptide
  Seed: FSYTLASLL (MAGC1_HUMAN)
FAYTLASLI

SEQ ID NO: 78899 - protein, 9 aa, Artificial Sequence
  Description of Artificial Sequence: Synthetic peptide
  Seed: FSYTLASLL (MAGC1_HUMAN)
FHYTLASLY

SEQ ID NO: 78900 - protein, 9 aa, Artificial Sequence
  Description of Artificial Sequence: Synthetic peptide
  Seed: SSPPRYEFL (MAGC1_HUMAN)
SMPPRYEFL

SEQ ID NO: 78901 - protein, 9 aa, Artificial Sequence
  Description of Artificial Sequence: Synthetic peptide
  Seed: RSFSSTLLS (MAGC1_HUMAN)
RVFSSTLLW

SEQ ID NO: 78902 - protein, 9 aa, Artificial Sequence
  Description of Artificial Sequence: Synthetic peptide
  Seed: SFSSTLVSL (MAGC1_HUMAN)
SSSSTLVSL

SEQ ID NO: 78903 - protein, 10 aa, Artificial Sequence
  Description of Artificial Sequence: Synthetic peptide
  Seed: LQGEEFQSSL (MAGC1_HUMAN)
LQGEEFQSSF

SEQ ID NO: 78904 - protein, 10 aa, Artificial Sequence
  Description of Artificial Sequence: Synthetic peptide
  Seed: LSLFQSSPER (MAGC1_HUMAN)
LFLFQSSPER

SEQ ID NO: 78905 - protein, 9 aa, Artificial Sequence
  Description of Artificial Sequence: Synthetic peptide
  Seed: SKSSPESPL (MAGC1_HUMAN)
SQSSPESPF

SEQ ID NO: 78906 - protein, 9 aa, Artificial Sequence
  Description of Artificial Sequence: Synthetic peptide
  Seed: FSSTLLSIL (MAGC1_HUMAN)
FVSTLLSIM

SEQ ID NO: 78907 - protein, 9 aa, Artificial Sequence
  Description of Artificial Sequence: Synthetic peptide
  Seed: LQIPVSRSF (MAGC1_HUMAN)
LPIPVSRSL

SEQ ID NO: 78908 - protein, 9 aa, Artificial Sequence
  Description of Artificial Sequence: Synthetic peptide
  Seed: NTVPITFPS (MAGC1_HUMAN)
NAVPITFPI

SEQ ID NO: 78909 - protein, 9 aa, Artificial Sequence
  Description of Artificial Sequence: Synthetic peptide
  Seed: NTHSPLQIV (MAGC1_HUMAN)
NAHSPLQIY

SEQ ID NO: 78910 - protein, 11 aa, Artificial Sequence
  Description of Artificial Sequence: Synthetic peptide
  Seed: RSFSSTLLSIF (MAGC1_HUMAN)
RKFSSTLLSIM

SEQ ID NO: 78911 - protein, 9 aa, Artificial Sequence
  Description of Artificial Sequence: Synthetic peptide
  Seed: SLIESEPLF (MAGC1_HUMAN)
SIIESEPLL

SEQ ID NO: 78912 - protein, 10 aa, Artificial Sequence
  Description of Artificial Sequence: Synthetic peptide
  Seed: FFSYTLASLL (MAGC1_HUMAN)
FNSYTLASLM

SEQ ID NO: 78913 - protein, 9 aa, Artificial Sequence
  Description of Artificial Sequence: Synthetic peptide
  Seed: SSSTSLSPF (MAGC1_HUMAN)
SKSTSLSPM

SEQ ID NO: 78914 - protein, 9 aa, Artificial Sequence
  Description of Artificial Sequence: Synthetic peptide
  Seed: IPVSSSFSY (MAGC1_HUMAN)
IQVSSSFSW

SEQ ID NO: 78915 - protein, 10 aa, Artificial Sequence
  Description of Artificial Sequence: Synthetic peptide
  Seed: DVLSGIGVRA (MAGC1_HUMAN)
DMLSGIGVRR

SEQ ID NO: 78916 - protein, 10 aa, Artificial Sequence
  Description of Artificial Sequence: Synthetic peptide
  Seed: RFLLLKYQVK (MAGC1_HUMAN)
RMLLLKYQVR

SEQ ID NO: 78917 - protein, 9 aa, Artificial Sequence
  Description of Artificial Sequence: Synthetic peptide
  Seed: MSQNRLLIL (MAGC1_HUMAN)
MLQNRLLII

SEQ ID NO: 78918 - protein, 9 aa, Artificial Sequence
  Description of Artificial Sequence: Synthetic peptide
  Seed: VIWDVLSGI (MAGC1_HUMAN)
VLWDVLSGW

SEQ ID NO: 78919 - protein, 9 aa, Artificial Sequence
  Description of Artificial Sequence: Synthetic peptide
  Seed: EFIEILFGI (MAGC1_HUMAN)
EIIEILFGT

SEQ ID NO: 78920 - protein, 10 aa, Artificial Sequence
  Description of Artificial Sequence: Synthetic peptide
  Seed: REFIEILFGI (MAGC1_HUMAN)
RLFIEILFGS

SEQ ID NO: 78921 - protein, 9 aa, Artificial Sequence
  Description of Artificial Sequence: Synthetic peptide
  Seed: YQVKQPITK (MAGC1_HUMAN)
YSVKQPITH

SEQ ID NO: 78922 - protein, 10 aa, Artificial Sequence
  Description of Artificial Sequence: Synthetic peptide
  Seed: LQIPGSPSFS (MAGC1_HUMAN)
LKIPGSPSFM

SEQ ID NO: 78923 - protein, 11 aa, Artificial Sequence
  Description of Artificial Sequence: Synthetic peptide
  Seed: RYTGYFPVIFR (MAGC1_HUMAN)
RGTGYFPVIFR

SEQ ID NO: 78924 - protein, 10 aa, Artificial Sequence
  Description of Artificial Sequence: Synthetic peptide
  Seed: FQSSLQSPVS (MAGC1_HUMAN)
FMSSLQSPVL

SEQ ID NO: 78925 - protein, 9 aa, Artificial Sequence
  Description of Artificial Sequence: Synthetic peptide
  Seed: SPLEGEDSL (MAGC1_HUMAN)
SALEGEDSM

SEQ ID NO: 78926 - protein, 10 aa, Artificial Sequence
  Description of Artificial Sequence: Synthetic peptide
  Seed: STFEGFPQSL (MAGC1_HUMAN)
SPFEGFPQSM

SEQ ID NO: 78927 - protein, 9 aa, Artificial Sequence
  Description of Artificial Sequence: Synthetic peptide
  Seed: SRYTGYFPV (MAGC1_HUMAN)
SNYTGYFPF

SEQ ID NO: 78928 - protein, 10 aa, Artificial Sequence
  Description of Artificial Sequence: Synthetic peptide
  Seed: KAREFIEILF (MAGC1_HUMAN)
KTREFIEILF

SEQ ID NO: 78929 - protein, 9 aa, Artificial Sequence
  Description of Artificial Sequence: Synthetic peptide
  Seed: FFSSALLSI (MAGC1_HUMAN)
FRSSALLSL

SEQ ID NO: 78930 - protein, 9 aa, Artificial Sequence
  Description of Artificial Sequence: Synthetic peptide
  Seed: FPSSTSSSL (MAGC1_HUMAN)
FASSTSSSV

SEQ ID NO: 78931 - protein, 9 aa, Artificial Sequence
  Description of Artificial Sequence: Synthetic peptide
  Seed: SSPERTHST (MAGC1_HUMAN)
SSPERTHSV

SEQ ID NO: 78932 - protein, 10 aa, Artificial Sequence
  Description of Artificial Sequence: Synthetic peptide
  Seed: LQIPMTSSFS (MAGC1_HUMAN)
LSIPMTSSFF

SEQ ID NO: 78933 - protein, 10 aa, Artificial Sequence
  Description of Artificial Sequence: Synthetic peptide
  Seed: MPTAGMPSLL (MAGC1_HUMAN)
MITAGMPSLV

SEQ ID NO: 78934 - protein, 9 aa, Artificial Sequence
  Description of Artificial Sequence: Synthetic peptide
  Seed: AGREHFAFG (MAGC1_HUMAN)
ASREHFAFH

SEQ ID NO: 78935 - protein, 9 aa, Artificial Sequence
  Description of Artificial Sequence: Synthetic peptide
  Seed: IIDTTDDST (MAGC1_HUMAN)
ITDTTDDSL

SEQ ID NO: 78936 - protein, 10 aa, Artificial Sequence
  Description of Artificial Sequence: Synthetic peptide
  Seed: WGPRAHSEVI (MAGC1_HUMAN)
WAPRAHSEVF

SEQ ID NO: 78937 - protein, 11 aa, Artificial Sequence
  Description of Artificial Sequence: Synthetic peptide
  Seed: SSFPSSTSSSL (MAGC1_HUMAN)
SQFPSSTSSSY

SEQ ID NO: 78938 - protein, 9 aa, Artificial Sequence
  Description of Artificial Sequence: Synthetic peptide
  Seed: DPDDSYVFV (MAGC1_HUMAN)
DIDDSYVFM

SEQ ID NO: 78939 - protein, 9 aa, Artificial Sequence
  Description of Artificial Sequence: Synthetic peptide
  Seed: VSRSFSSTL (MAGC1_HUMAN)
VQRSFSSTW

SEQ ID NO: 78940 - protein, 9 aa, Artificial Sequence
  Description of Artificial Sequence: Synthetic peptide
  Seed: SSPECTQST (MAGC1_HUMAN)
SGPECTQSL

SEQ ID NO: 78941 - protein, 9 aa, Artificial Sequence
  Description of Artificial Sequence: Synthetic peptide
  Seed: IPVSPSFSS (MAGC1_HUMAN)
IAVSPSFSM

SEQ ID NO: 78942 - protein, 11 aa, Artificial Sequence
  Description of Artificial Sequence: Synthetic peptide
  Seed: SSFPSSTSSSL (MAGC1_HUMAN)
SWFPSSTSSSL

SEQ ID NO: 78943 - protein, 8 aa, Artificial Sequence
  Description of Artificial Sequence: Synthetic peptide
  Seed: FGEPRELL (MAGC1_HUMAN)
FWEPRELL

SEQ ID NO: 78944 - protein, 9 aa, Artificial Sequence
  Description of Artificial Sequence: Synthetic peptide
  Seed: SPLEGEDSL (MAGC1_HUMAN)
SILEGEDSY

SEQ ID NO: 78945 - protein, 11 aa, Artificial Sequence
  Description of Artificial Sequence: Synthetic peptide
  Seed: SSFSYTLLSLF (MAGC1_HUMAN)
SPFSYTLLSLY

SEQ ID NO: 78946 - protein, 9 aa, Artificial Sequence
  Description of Artificial Sequence: Synthetic peptide
  Seed: TLDEKVDEL (MAGC1_HUMAN)
TADEKVDEM

SEQ ID NO: 78947 - protein, 11 aa, Artificial Sequence
  Description of Artificial Sequence: Synthetic peptide
  Seed: SRYTGYFPVIF (MAGC1_HUMAN)
SKYTGYFPVIF

SEQ ID NO: 78948 - protein, 9 aa, Artificial Sequence
  Description of Artificial Sequence: Synthetic peptide
  Seed: AEMLTNVIS (MAGC1_HUMAN)
AEMLTNVII

SEQ ID NO: 78949 - protein, 11 aa, Artificial Sequence
  Description of Artificial Sequence: Synthetic peptide
  Seed: SFFSYTLASLL (MAGC1_HUMAN)
SYFSYTLASLY

SEQ ID NO: 78950 - protein, 9 aa, Artificial Sequence
  Description of Artificial Sequence: Synthetic peptide
  Seed: SPQSPPEGP (MAGC1_HUMAN)
SMQSPPEGL

SEQ ID NO: 78951 - protein, 9 aa, Artificial Sequence
  Description of Artificial Sequence: Synthetic peptide
  Seed: HYFPQSPPQ (MAGC1_HUMAN)
HYFPQSPPV

SEQ ID NO: 78952 - protein, 11 aa, Artificial Sequence
  Description of Artificial Sequence: Synthetic peptide
  Seed: KRKVVEFLAML (MAGC1_HUMAN)
KQKVVEFLAMV

SEQ ID NO: 78953 - protein, 10 aa, Artificial Sequence
  Description of Artificial Sequence: Synthetic peptide
  Seed: TGYFPVIFRK (MAGC1_HUMAN)
TTYFPVIFRT

SEQ ID NO: 78954 - protein, 10 aa, Artificial Sequence
  Description of Artificial Sequence: Synthetic peptide
  Seed: VSPSFSSTLV (MAGC1_HUMAN)
VMPSFSSTLL

SEQ ID NO: 78955 - protein, 9 aa, Artificial Sequence
  Description of Artificial Sequence: Synthetic peptide
  Seed: FSYTLLSLF (MAGC1_HUMAN)
FKYTLLSLY

SEQ ID NO: 78956 - protein, 9 aa, Artificial Sequence
  Description of Artificial Sequence: Synthetic peptide
  Seed: FQSSPERTH (MAGC1_HUMAN)
FASSPERTH

SEQ ID NO: 78957 - protein, 9 aa, Artificial Sequence
  Description of Artificial Sequence: Synthetic peptide
  Seed: SLPEWEDSL (MAGC1_HUMAN)
SVPEWEDSI

SEQ ID NO: 78958 - protein, 9 aa, Artificial Sequence
  Description of Artificial Sequence: Synthetic peptide
  Seed: FAFGEPREL (MAGC1_HUMAN)
FIFGEPREW

SEQ ID NO: 78959 - protein, 10 aa, Artificial Sequence
  Description of Artificial Sequence: Synthetic peptide
  Seed: FFSYTLASLL (MAGC1_HUMAN)
FYSYTLASLF

SEQ ID NO: 78960 - protein, 9 aa, Artificial Sequence
  Description of Artificial Sequence: Synthetic peptide
  Seed: GFPQSVLQI (MAGC1_HUMAN)
GRPQSVLQM

SEQ ID NO: 78961 - protein, 9 aa, Artificial Sequence
  Description of Artificial Sequence: Synthetic peptide
  Seed: TSLSLPQSF (MAGC1_HUMAN)
TQLSLPQSV

SEQ ID NO: 78962 - protein, 10 aa, Artificial Sequence
  Description of Artificial Sequence: Synthetic peptide
  Seed: FSSSTSLSPF (MAGC1_HUMAN)
FHSSTSLSPM

SEQ ID NO: 78963 - protein, 9 aa, Artificial Sequence
  Description of Artificial Sequence: Synthetic peptide
  Seed: VSSSFSYTL (MAGC1_HUMAN)
VLSSFSYTA

SEQ ID NO: 78964 - protein, 10 aa, Artificial Sequence
  Description of Artificial Sequence: Synthetic peptide
  Seed: LQIVPSLPEW (MAGC1_HUMAN)
LKIVPSLPEY

SEQ ID NO: 78965 - protein, 10 aa, Artificial Sequence
  Description of Artificial Sequence: Synthetic peptide
  Seed: MTSSFSSTLL (MAGC1_HUMAN)
MVSSFSSTLL

SEQ ID NO: 78966 - protein, 10 aa, Artificial Sequence
  Description of Artificial Sequence: Synthetic peptide
  Seed: PLQIPVSSSF (MAGC1_HUMAN)
PIQIPVSSSY

SEQ ID NO: 78967 - protein, 10 aa, Artificial Sequence
  Description of Artificial Sequence: Synthetic peptide
  Seed: SSFSYTLLSL (MAGC1_HUMAN)
SSFSYTLLSM

SEQ ID NO: 78968 - protein, 9 aa, Artificial Sequence
  Description of Artificial Sequence: Synthetic peptide
  Seed: AQSSLQIPV (MAGC1_HUMAN)
ALSSLQIPM

SEQ ID NO: 78969 - protein, 9 aa, Artificial Sequence
  Description of Artificial Sequence: Synthetic peptide
  Seed: SAPEGEDSL (MAGC1_HUMAN)
SVPEGEDSF

SEQ ID NO: 78970 - protein, 11 aa, Artificial Sequence
  Description of Artificial Sequence: Synthetic peptide
  Seed: SFSSSTSLSPF (MAGC1_HUMAN)
SSSSSTSLSPW

SEQ ID NO: 78971 - protein, 9 aa, Artificial Sequence
  Description of Artificial Sequence: Synthetic peptide
  Seed: SSPERTQST (MAGC1_HUMAN)
SNPERTQSM

SEQ ID NO: 78972 - protein, 9 aa, Artificial Sequence
  Description of Artificial Sequence: Synthetic peptide
  Seed: LQIPVSPSF (MAGC1_HUMAN)
LPIPVSPSW

SEQ ID NO: 78973 - protein, 10 aa, Artificial Sequence
  Description of Artificial Sequence: Synthetic peptide
  Seed: ASSFFSSALL (MAGC1_HUMAN)
ATSFFSSALY

SEQ ID NO: 78974 - protein, 9 aa, Artificial Sequence
  Description of Artificial Sequence: Synthetic peptide
  Seed: LKYQVKQPI (MAGC1_HUMAN)
LIYQVKQPY

SEQ ID NO: 78975 - protein, 9 aa, Artificial Sequence
  Description of Artificial Sequence: Synthetic peptide
  Seed: VSPSFSSTL (MAGC1_HUMAN)
VAPSFSSTF

SEQ ID NO: 78976 - protein, 11 aa, Artificial Sequence
  Description of Artificial Sequence: Synthetic peptide
  Seed: SFFSSALLSIF (MAGC1_HUMAN)
SFFSSALLSIW

SEQ ID NO: 78977 - protein, 10 aa, Artificial Sequence
  Description of Artificial Sequence: Synthetic peptide
  Seed: SRYTGYFPVI (MAGC1_HUMAN)
SWYTGYFPVL

SEQ ID NO: 78978 - protein, 9 aa, Artificial Sequence
  Description of Artificial Sequence: Synthetic peptide
  Seed: FFSSALLSI (MAGC1_HUMAN)
FYSSALLSH

SEQ ID NO: 78979 - protein, 9 aa, Artificial Sequence
  Description of Artificial Sequence: Synthetic peptide
  Seed: GEDSLSPHY (MAGC1_HUMAN)
GEDSLSPHA

SEQ ID NO: 78980 - protein, 11 aa, Artificial Sequence
  Description of Artificial Sequence: Synthetic peptide
  Seed: FPQSPQGEDSL (MAGC1_HUMAN)
FPQSPQGEDSM

SEQ ID NO: 78981 - protein, 9 aa, Artificial Sequence
  Description of Artificial Sequence: Synthetic peptide
  Seed: IPVSAASSS (MAGC1_HUMAN)
IPVSAASSL

SEQ ID NO: 78982 - protein, 11 aa, Artificial Sequence
  Description of Artificial Sequence: Synthetic peptide
  Seed: RPVSSFFSYTL (MAGC1_HUMAN)
RMVSSFFSYTY

SEQ ID NO: 78983 - protein, 9 aa, Artificial Sequence
  Description of Artificial Sequence: Synthetic peptide
  Seed: VPITFPSSY (MAGC1_HUMAN)
VHITFPSSF

SEQ ID NO: 78984 - protein, 9 aa, Artificial Sequence
  Description of Artificial Sequence: Synthetic peptide
  Seed: LQIPMTSSF (MAGC1_HUMAN)
LSIPMTSSL

SEQ ID NO: 78985 - protein, 9 aa, Artificial Sequence
  Description of Artificial Sequence: Synthetic peptide
  Seed: CSSSTSLSL (MAGC1_HUMAN)
CESSTSLSM

SEQ ID NO: 78986 - protein, 9 aa, Artificial Sequence
  Description of Artificial Sequence: Synthetic peptide
  Seed: YTGYFPVIF (MAGC1_HUMAN)
YAGYFPVII

SEQ ID NO: 78987 - protein, 11 aa, Artificial Sequence
  Description of Artificial Sequence: Synthetic peptide
  Seed: AASSSTLVSIF (MAGC1_HUMAN)
AGSSSTLVSIW

SEQ ID NO: 78988 - protein, 11 aa, Artificial Sequence
  Description of Artificial Sequence: Synthetic peptide
  Seed: RSFSSTLLSIF (MAGC1_HUMAN)
RNFSSTLLSIW

SEQ ID NO: 78989 - protein, 9 aa, Artificial Sequence
  Description of Artificial Sequence: Synthetic peptide
  Seed: SPLQIPMTS (MAGC1_HUMAN)
STLQIPMTL

SEQ ID NO: 78990 - protein, 10 aa, Artificial Sequence
  Description of Artificial Sequence: Synthetic peptide
  Seed: KVDELARFLL (MAGC1_HUMAN)
KLDELARFLV

SEQ ID NO: 78991 - protein, 11 aa, Artificial Sequence
  Description of Artificial Sequence: Synthetic peptide
  Seed: REVDPDDSYVF (MAGC1_HUMAN)
RVVDPDDSYVW

SEQ ID NO: 78992 - protein, 9 aa, Artificial Sequence
  Description of Artificial Sequence: Synthetic peptide
  Seed: SSPESAQSA (MAGC1_HUMAN)
SQPESAQSL

SEQ ID NO: 78993 - protein, 9 aa, Artificial Sequence
  Description of Artificial Sequence: Synthetic peptide
  Seed: VIKRKVVEF (MAGC1_HUMAN)
VMKRKVVEY

SEQ ID NO: 78994 - protein, 10 aa, Artificial Sequence
  Description of Artificial Sequence: Synthetic peptide
  Seed: SPLQNPASSF (MAGC1_HUMAN)
SKLQNPASSF

SEQ ID NO: 78995 - protein, 11 aa, Artificial Sequence
  Description of Artificial Sequence: Synthetic peptide
  Seed: SPLQIPGSPSF (MAGC1_HUMAN)
STLQIPGSPSY

SEQ ID NO: 78996 - protein, 9 aa, Artificial Sequence
  Description of Artificial Sequence: Synthetic peptide
  Seed: SPPEGENTH (MAGC1_HUMAN)
SAPEGENTV

SEQ ID NO: 78997 - protein, 10 aa, Artificial Sequence
  Description of Artificial Sequence: Synthetic peptide
  Seed: TTDDSTATES (MAGC1_HUMAN)
TCDDSTATEI

SEQ ID NO: 78998 - protein, 9 aa, Artificial Sequence
  Description of Artificial Sequence: Synthetic peptide
  Seed: SRYTGYFPV (MAGC1_HUMAN)
SNYTGYFPM

SEQ ID NO: 78999 - protein, 9 aa, Artificial Sequence
  Description of Artificial Sequence: Synthetic peptide
  Seed: GFPQSPLQI (MAGC1_HUMAN)
GSPQSPLQL

SEQ ID NO: 79000 - protein, 10 aa, Artificial Sequence
  Description of Artificial Sequence: Synthetic peptide
  Seed: WEDSLSPHYF (MAGC1_HUMAN)
WTDSLSPHYL

SEQ ID NO: 79001 - protein, 10 aa, Artificial Sequence
  Description of Artificial Sequence: Synthetic peptide
  Seed: KGTYASEEVI (MAGC1_HUMAN)
KRTYASEEVF

SEQ ID NO: 79002 - protein, 10 aa, Artificial Sequence
  Description of Artificial Sequence: Synthetic peptide
  Seed: FQSSLQSPVS (MAGC1_HUMAN)
FLSSLQSPVQ

SEQ ID NO: 79003 - protein, 9 aa, Artificial Sequence
  Description of Artificial Sequence: Synthetic peptide
  Seed: TLLSILQSS (MAGC1_HUMAN)
TMLSILQSA

SEQ ID NO: 79004 - protein, 10 aa, Artificial Sequence
  Description of Artificial Sequence: Synthetic peptide
  Seed: SSFPSSTSSS (MAGC1_HUMAN)
SVFPSSTSSL

SEQ ID NO: 79005 - protein, 9 aa, Artificial Sequence
  Description of Artificial Sequence: Synthetic peptide
  Seed: FSYTLASLL (MAGC1_HUMAN)
FFYTLASLI

SEQ ID NO: 79006 - protein, 9 aa, Artificial Sequence
  Description of Artificial Sequence: Synthetic peptide
  Seed: SFPSSTSSS (MAGC1_HUMAN)
SIPSSTSSM

SEQ ID NO: 79007 - protein, 9 aa, Artificial Sequence
  Description of Artificial Sequence: Synthetic peptide
  Seed: SSPESTQSP (MAGC1_HUMAN)
STPESTQSM

SEQ ID NO: 79008 - protein, 9 aa, Artificial Sequence
  Description of Artificial Sequence: Synthetic peptide
  Seed: ASSFFSSAL (MAGC1_HUMAN)
AQSFFSSAA

SEQ ID NO: 79009 - protein, 8 aa, Artificial Sequence
  Description of Artificial Sequence: Synthetic peptide
  Seed: RYTGYFPV (MAGC1_HUMAN)
RFTGYFPF

SEQ ID NO: 79010 - protein, 9 aa, Artificial Sequence
  Description of Artificial Sequence: Synthetic peptide
  Seed: LQSPVISFS (MAGC1_HUMAN)
LQSPVISFL

SEQ ID NO: 79011 - protein, 9 aa, Artificial Sequence
  Description of Artificial Sequence: Synthetic peptide
  Seed: RSFSSTLLS (MAGC1_HUMAN)
RMFSSTLLM

SEQ ID NO: 79012 - protein, 11 aa, Artificial Sequence
  Description of Artificial Sequence: Synthetic peptide
  Seed: TTDDSTATESA (MAGC1_HUMAN)
TADDSTATESI

SEQ ID NO: 79013 - protein, 9 aa, Artificial Sequence
  Description of Artificial Sequence: Synthetic peptide
  Seed: EYTSSSDTL (MAGC1_HUMAN)
EHTSSSDTM

SEQ ID NO: 79014 - protein, 9 aa, Artificial Sequence
  Description of Artificial Sequence: Synthetic peptide
  Seed: RPVSSFFSY (MAGC1_HUMAN)
RGVSSFFSF

SEQ ID NO: 79015 - protein, 11 aa, Artificial Sequence
  Description of Artificial Sequence: Synthetic peptide
  Seed: VDEYTSSSDTL (MAGC1_HUMAN)
VGEYTSSSDTF

SEQ ID NO: 79016 - protein, 9 aa, Artificial Sequence
  Description of Artificial Sequence: Synthetic peptide
  Seed: SRYTGYFPV (MAGC1_HUMAN)
SQYTGYFPV

SEQ ID NO: 79017 - protein, 9 aa, Artificial Sequence
  Description of Artificial Sequence: Synthetic peptide
  Seed: LQIPVSSSS (MAGC1_HUMAN)
LAIPVSSSW

SEQ ID NO: 79018 - protein, 11 aa, Artificial Sequence
  Description of Artificial Sequence: Synthetic peptide
  Seed: SSTSLSLPQSF (MAGC1_HUMAN)
SHTSLSLPQSW

SEQ ID NO: 79019 - protein, 9 aa, Artificial Sequence
  Description of Artificial Sequence: Synthetic peptide
  Seed: FFSYTLASL (MAGC1_HUMAN)
FYSYTLASL

SEQ ID NO: 79020 - protein, 11 aa, Artificial Sequence
  Description of Artificial Sequence: Synthetic peptide
  Seed: IPVSSSSSSTL (MAGC1_HUMAN)
ISVSSSSSSTF

SEQ ID NO: 79021 - protein, 10 aa, Artificial Sequence
  Description of Artificial Sequence: Synthetic peptide
  Seed: WGPRAHSEVI (MAGC1_HUMAN)
WRPRAHSEVM

SEQ ID NO: 79022 - protein, 9 aa, Artificial Sequence
  Description of Artificial Sequence: Synthetic peptide
  Seed: SSHESPQSP (MAGC1_HUMAN)
SIHESPQSF

SEQ ID NO: 79023 - protein, 9 aa, Artificial Sequence
  Description of Artificial Sequence: Synthetic peptide
  Seed: TLLSIFQSS (MAGC1_HUMAN)
TMLSIFQSV

SEQ ID NO: 79024 - protein, 9 aa, Artificial Sequence
  Description of Artificial Sequence: Synthetic peptide
  Seed: VPITFPSSY (MAGC1_HUMAN)
VKITFPSSM

SEQ ID NO: 79025 - protein, 9 aa, Artificial Sequence
  Description of Artificial Sequence: Synthetic peptide
  Seed: SSPESAQSA (MAGC1_HUMAN)
SSPESAQSF

SEQ ID NO: 79026 - protein, 10 aa, Artificial Sequence
  Description of Artificial Sequence: Synthetic peptide
  Seed: RLLILILSII (MAGC1_HUMAN)
RHLILILSIV

SEQ ID NO: 79027 - protein, 9 aa, Artificial Sequence
  Description of Artificial Sequence: Synthetic peptide
  Seed: TESASSSVM (MAGC1_HUMAN)
TSSASSSVF

SEQ ID NO: 79028 - protein, 9 aa, Artificial Sequence
  Description of Artificial Sequence: Synthetic peptide
  Seed: QSPLQGEEF (MAGC1_HUMAN)
QIPLQGEEM

SEQ ID NO: 79029 - protein, 11 aa, Artificial Sequence
  Description of Artificial Sequence: Synthetic peptide
  Seed: SPVSSFPSSTS (MAGC1_HUMAN)
SPVSSFPSSTM

SEQ ID NO: 79030 - protein, 9 aa, Artificial Sequence
  Description of Artificial Sequence: Synthetic peptide
  Seed: HYFPQSPPQ (MAGC1_HUMAN)
HFFPQSPPY

SEQ ID NO: 79031 - protein, 9 aa, Artificial Sequence
  Description of Artificial Sequence: Synthetic peptide
  Seed: MPTAGMPSL (MAGC1_HUMAN)
MPTAGMPSA

SEQ ID NO: 79032 - protein, 9 aa, Artificial Sequence
  Description of Artificial Sequence: Synthetic peptide
  Seed: ASEEVIWDV (MAGC1_HUMAN)
ALEEVIWDI

SEQ ID NO: 79033 - protein, 10 aa, Artificial Sequence
  Description of Artificial Sequence: Synthetic peptide
  Seed: LQIPGSPSFS (MAGC1_HUMAN)
LHIPGSPSFF

SEQ ID NO: 79034 - protein, 9 aa, Artificial Sequence
  Description of Artificial Sequence: Synthetic peptide
  Seed: SQSSPVSSF (MAGC1_HUMAN)
SRSSPVSSL

SEQ ID NO: 79035 - protein, 9 aa, Artificial Sequence
  Description of Artificial Sequence: Synthetic peptide
  Seed: FTYTLDEKV (MAGC1_HUMAN)
FLYTLDEKV

SEQ ID NO: 79036 - protein, 9 aa, Artificial Sequence
  Description of Artificial Sequence: Synthetic peptide
  Seed: ELARFLLLK (MAGC1_HUMAN)
ETARFLLLH

SEQ ID NO: 79037 - protein, 10 aa, Artificial Sequence
  Description of Artificial Sequence: Synthetic peptide
  Seed: ATESASSSVM (MAGC1_HUMAN)
ARESASSSVF

SEQ ID NO: 79038 - protein, 10 aa, Artificial Sequence
  Description of Artificial Sequence: Synthetic peptide
  Seed: QRPVSSFFSY (MAGC1_HUMAN)
QWPVSSFFSM

SEQ ID NO: 79039 - protein, 9 aa, Artificial Sequence
  Description of Artificial Sequence: Synthetic peptide
  Seed: SSPERTQST (MAGC1_HUMAN)
SIPERTQSV

SEQ ID NO: 79040 - protein, 11 aa, Artificial Sequence
  Description of Artificial Sequence: Synthetic peptide
  Seed: RSFSSTLLSIF (MAGC1_HUMAN)
RMFSSTLLSII

SEQ ID NO: 79041 - protein, 9 aa, Artificial Sequence
  Description of Artificial Sequence: Synthetic peptide
  Seed: SSSDTLLES (MAGC1_HUMAN)
SMSDTLLEY

SEQ ID NO: 79042 - protein, 9 aa, Artificial Sequence
  Description of Artificial Sequence: Synthetic peptide
  Seed: IPVSSSSSS (MAGC1_HUMAN)
IPVSSSSSF

SEQ ID NO: 79043 - protein, 10 aa, Artificial Sequence
  Description of Artificial Sequence: Synthetic peptide
  Seed: LQNPASSFFS (MAGC1_HUMAN)
LQNPASSFFH

SEQ ID NO: 79044 - protein, 11 aa, Artificial Sequence
  Description of Artificial Sequence: Synthetic peptide
  Seed: SPLQIPVSSSS (MAGC1_HUMAN)
SDLQIPVSSSY

SEQ ID NO: 79045 - protein, 9 aa, Artificial Sequence
  Description of Artificial Sequence: Synthetic peptide
  Seed: FSYTLLSLF (MAGC1_HUMAN)
FSYTLLSLW

SEQ ID NO: 79046 - protein, 11 aa, Artificial Sequence
  Description of Artificial Sequence: Synthetic peptide
  Seed: FLWGPRAHSEV (MAGC1_HUMAN)
FLWGPRAHSEL

SEQ ID NO: 79047 - protein, 10 aa, Artificial Sequence
  Description of Artificial Sequence: Synthetic peptide
  Seed: VSRSFSSTLL (MAGC1_HUMAN)
VTRSFSSTLA

SEQ ID NO: 79048 - protein, 9 aa, Artificial Sequence
  Description of Artificial Sequence: Synthetic peptide
  Seed: EFIEILFGI (MAGC1_HUMAN)
ETIEILFGT

SEQ ID NO: 79049 - protein, 9 aa, Artificial Sequence
  Description of Artificial Sequence: Synthetic peptide
  Seed: DSYVFVNTL (MAGC1_HUMAN)
DSYVFVNTY

SEQ ID NO: 79050 - protein, 9 aa, Artificial Sequence
  Description of Artificial Sequence: Synthetic peptide
  Seed: CSSSTSLSL (MAGC1_HUMAN)
CLSSTSLSM

SEQ ID NO: 79051 - protein, 9 aa, Artificial Sequence
  Description of Artificial Sequence: Synthetic peptide
  Seed: FSSTLLSLF (MAGC1_HUMAN)
FYSTLLSLV

SEQ ID NO: 79052 - protein, 9 aa, Artificial Sequence
  Description of Artificial Sequence: Synthetic peptide
  Seed: MPTAGMPSL (MAGC1_HUMAN)
MPTAGMPSS

SEQ ID NO: 79053 - protein, 10 aa, Artificial Sequence
  Description of Artificial Sequence: Synthetic peptide
  Seed: YQVKQPITKA (MAGC1_HUMAN)
YLVKQPITKI

SEQ ID NO: 79054 - protein, 9 aa, Artificial Sequence
  Description of Artificial Sequence: Synthetic peptide
  Seed: SICSSSTSL (MAGC1_HUMAN)
SECSSSTSL

SEQ ID NO: 79055 - protein, 9 aa, Artificial Sequence
  Description of Artificial Sequence: Synthetic peptide
  Seed: GFPQSPLQI (MAGC1_HUMAN)
GVPQSPLQL

SEQ ID NO: 79056 - protein, 11 aa, Artificial Sequence
  Description of Artificial Sequence: Synthetic peptide
  Seed: AREFIEILFGI (MAGC1_HUMAN)
AREFIEILFGL

SEQ ID NO: 79057 - protein, 9 aa, Artificial Sequence
  Description of Artificial Sequence: Synthetic peptide
  Seed: SLLQSSHES (MAGC1_HUMAN)
SILQSSHEI

SEQ ID NO: 79058 - protein, 9 aa, Artificial Sequence
  Description of Artificial Sequence: Synthetic peptide
  Seed: LQIPVSRSF (MAGC1_HUMAN)
LSIPVSRSW

SEQ ID NO: 79059 - protein, 10 aa, Artificial Sequence
  Description of Artificial Sequence: Synthetic peptide
  Seed: RKVVEFLAML (MAGC1_HUMAN)
RMVVEFLAMM

SEQ ID NO: 79060 - protein, 8 aa, Artificial Sequence
  Description of Artificial Sequence: Synthetic peptide
  Seed: FSYTLASL (MAGC1_HUMAN)
FAYTLASF

SEQ ID NO: 79061 - protein, 9 aa, Artificial Sequence
  Description of Artificial Sequence: Synthetic peptide
  Seed: WVQEHYLEY (MAGC1_HUMAN)
WRQEHYLEM

SEQ ID NO: 79062 - protein, 9 aa, Artificial Sequence
  Description of Artificial Sequence: Synthetic peptide
  Seed: RTQSTFEGF (MAGC1_HUMAN)
RWQSTFEGI

SEQ ID NO: 79063 - protein, 9 aa, Artificial Sequence
  Description of Artificial Sequence: Synthetic peptide
  Seed: TTDDSTATE (MAGC1_HUMAN)
TTDDSTATI

SEQ ID NO: 79064 - protein, 10 aa, Artificial Sequence
  Description of Artificial Sequence: Synthetic peptide
  Seed: MTSSFSSTLL (MAGC1_HUMAN)
MISSFSSTLY

SEQ ID NO: 79065 - protein, 10 aa, Artificial Sequence
  Description of Artificial Sequence: Synthetic peptide
  Seed: SLSPLHFPQF (MAGC1_HUMAN)
SWSPLHFPQW

SEQ ID NO: 79066 - protein, 9 aa, Artificial Sequence
  Description of Artificial Sequence: Synthetic peptide
  Seed: SIIFIKGTY (MAGC1_HUMAN)
SAIFIKGTL

SEQ ID NO: 79067 - protein, 9 aa, Artificial Sequence
  Description of Artificial Sequence: Synthetic peptide
  Seed: AGREHFAFG (MAGC1_HUMAN)
AGREHFAFV

SEQ ID NO: 79068 - protein, 9 aa, Artificial Sequence
  Description of Artificial Sequence: Synthetic peptide
  Seed: ILILSIIFI (MAGC1_HUMAN)
ILILSIIFL

SEQ ID NO: 79069 - protein, 9 aa, Artificial Sequence
  Description of Artificial Sequence: Synthetic peptide
  Seed: IPVSRSFSS (MAGC1_HUMAN)
IMVSRSFSY

SEQ ID NO: 79070 - protein, 10 aa, Artificial Sequence
  Description of Artificial Sequence: Synthetic peptide
  Seed: ASSFFSSALL (MAGC1_HUMAN)
AVSFFSSALV

SEQ ID NO: 79071 - protein, 10 aa, Artificial Sequence
  Description of Artificial Sequence: Synthetic peptide
  Seed: MTSSFSSTLL (MAGC1_HUMAN)
MMSSFSSTLT

SEQ ID NO: 79072 - protein, 11 aa, Artificial Sequence
  Description of Artificial Sequence: Synthetic peptide
  Seed: STFEGFAQSSL (MAGC1_HUMAN)
SSFEGFAQSSF

SEQ ID NO: 79073 - protein, 11 aa, Artificial Sequence
  Description of Artificial Sequence: Synthetic peptide
  Seed: RYTGYFPVIFR (MAGC1_HUMAN)
RMTGYFPVIFR

SEQ ID NO: 79074 - protein, 9 aa, Artificial Sequence
  Description of Artificial Sequence: Synthetic peptide
  Seed: SSSTLLSLF (MAGC1_HUMAN)
STSTLLSLF

SEQ ID NO: 79075 - protein, 10 aa, Artificial Sequence
  Description of Artificial Sequence: Synthetic peptide
  Seed: VSSSSSSTLL (MAGC1_HUMAN)
VESSSSSTLY

SEQ ID NO: 79076 - protein, 10 aa, Artificial Sequence
  Description of Artificial Sequence: Synthetic peptide
  Seed: LQIPVSRSFS (MAGC1_HUMAN)
LQIPVSRSFG

SEQ ID NO: 79077 - protein, 9 aa, Artificial Sequence
  Description of Artificial Sequence: Synthetic peptide
  Seed: RAHSEVIKR (MAGC1_HUMAN)
RVHSEVIKL

SEQ ID NO: 79078 - protein, 10 aa, Artificial Sequence
  Description of Artificial Sequence: Synthetic peptide
  Seed: SFFSSALLSI (MAGC1_HUMAN)
SGFSSALLSF

SEQ ID NO: 79079 - protein, 10 aa, Artificial Sequence
  Description of Artificial Sequence: Synthetic peptide
  Seed: TTDDSTATES (MAGC1_HUMAN)
TMDDSTATEL

SEQ ID NO: 79080 - protein, 10 aa, Artificial Sequence
  Description of Artificial Sequence: Synthetic peptide
  Seed: KRKVVEFLAM (MAGC1_HUMAN)
KIKVVEFLAF

SEQ ID NO: 79081 - protein, 10 aa, Artificial Sequence
  Description of Artificial Sequence: Synthetic peptide
  Seed: ICSSSTSLSL (MAGC1_HUMAN)
IHSSSTSLSF

SEQ ID NO: 79082 - protein, 10 aa, Artificial Sequence
  Description of Artificial Sequence: Synthetic peptide
  Seed: LQIPGSPSFS (MAGC1_HUMAN)
LMIPGSPSFP

SEQ ID NO: 79083 - protein, 9 aa, Artificial Sequence
  Description of Artificial Sequence: Synthetic peptide
  Seed: MTSSFSSTL (MAGC1_HUMAN)
MSSSFSSTI

SEQ ID NO: 79084 - protein, 11 aa, Artificial Sequence
  Description of Artificial Sequence: Synthetic peptide
  Seed: LLSLFQSFSER (MAGC1_HUMAN)
LMSLFQSFSER

SEQ ID NO: 79085 - protein, 9 aa, Artificial Sequence
  Description of Artificial Sequence: Synthetic peptide
  Seed: SSSTLLSLF (MAGC1_HUMAN)
SQSTLLSLY

SEQ ID NO: 79086 - protein, 9 aa, Artificial Sequence
  Description of Artificial Sequence: Synthetic peptide
  Seed: SEPLFTYTL (MAGC1_HUMAN)
SQPLFTYTI

SEQ ID NO: 79087 - protein, 9 aa, Artificial Sequence
  Description of Artificial Sequence: Synthetic peptide
  Seed: FAFGEPREL (MAGC1_HUMAN)
FTFGEPREM

SEQ ID NO: 79088 - protein, 10 aa, Artificial Sequence
  Description of Artificial Sequence: Synthetic peptide
  Seed: SSSSSSSTLL (MAGC1_HUMAN)
SQSSSSSTLF

SEQ ID NO: 79089 - protein, 10 aa, Artificial Sequence
  Description of Artificial Sequence: Synthetic peptide
  Seed: AASSSTLVSI (MAGC1_HUMAN)
AQSSSTLVSI

SEQ ID NO: 79090 - protein, 9 aa, Artificial Sequence
  Description of Artificial Sequence: Synthetic peptide
  Seed: LQIPGSPSF (MAGC1_HUMAN)
LKIPGSPSL

SEQ ID NO: 79091 - protein, 9 aa, Artificial Sequence
  Description of Artificial Sequence: Synthetic peptide
  Seed: YVFVNTLDL (MAGC1_HUMAN)
YKFVNTLDM

SEQ ID NO: 79092 - protein, 9 aa, Artificial Sequence
  Description of Artificial Sequence: Synthetic peptide
  Seed: KVWVQEHYL (MAGC1_HUMAN)
KMWVQEHYK

SEQ ID NO: 79093 - protein, 10 aa, Artificial Sequence
  Description of Artificial Sequence: Synthetic peptide
  Seed: PLQIPVSSSF (MAGC1_HUMAN)
PIQIPVSSSF

SEQ ID NO: 79094 - protein, 10 aa, Artificial Sequence
  Description of Artificial Sequence: Synthetic peptide
  Seed: ESAQSTFEGF (MAGC1_HUMAN)
EVAQSTFEGF

SEQ ID NO: 79095 - protein, 9 aa, Artificial Sequence
  Description of Artificial Sequence: Synthetic peptide
  Seed: EFIEILFGI (MAGC1_HUMAN)
ENIEILFGA

SEQ ID NO: 79096 - protein, 9 aa, Artificial Sequence
  Description of Artificial Sequence: Synthetic peptide
  Seed: SPLQIVPSL (MAGC1_HUMAN)
SLLQIVPSL

SEQ ID NO: 79097 - protein, 9 aa, Artificial Sequence
  Description of Artificial Sequence: Synthetic peptide
  Seed: NVISRYTGY (MAGC1_HUMAN)
NIISRYTGK

SEQ ID NO: 79098 - protein, 9 aa, Artificial Sequence
  Description of Artificial Sequence: Synthetic peptide
  Seed: QFPPQGEDF (MAGC1_HUMAN)
QAPPQGEDM

SEQ ID NO: 79099 - protein, 10 aa, Artificial Sequence
  Description of Artificial Sequence: Synthetic peptide
  Seed: GPAQSPLQSP (MAGC1_HUMAN)
GPAQSPLQSI

SEQ ID NO: 79100 - protein, 10 aa, Artificial Sequence
  Description of Artificial Sequence: Synthetic peptide
  Seed: IEILFGISLR (MAGC1_HUMAN)
IFILFGISLR

SEQ ID NO: 79101 - protein, 10 aa, Artificial Sequence
  Description of Artificial Sequence: Synthetic peptide
  Seed: VSSSSSSTLL (MAGC1_HUMAN)
VWSSSSSTLF

SEQ ID NO: 79102 - protein, 9 aa, Artificial Sequence
  Description of Artificial Sequence: Synthetic peptide
  Seed: LQIPMTSSF (MAGC1_HUMAN)
LYIPMTSSF

SEQ ID NO: 79103 - protein, 9 aa, Artificial Sequence
  Description of Artificial Sequence: Synthetic peptide
  Seed: AGREHFAFG (MAGC1_HUMAN)
ATREHFAFN

SEQ ID NO: 79104 - protein, 9 aa, Artificial Sequence
  Description of Artificial Sequence: Synthetic peptide
  Seed: FSSTLLSLF (MAGC1_HUMAN)
FQSTLLSLW

SEQ ID NO: 79105 - protein, 9 aa, Artificial Sequence
  Description of Artificial Sequence: Synthetic peptide
  Seed: VIKRKVVEF (MAGC1_HUMAN)
VAKRKVVEL

SEQ ID NO: 79106 - protein, 9 aa, Artificial Sequence
  Description of Artificial Sequence: Synthetic peptide
  Seed: TGYFPVIFR (MAGC1_HUMAN)
TFYFPVIFK

SEQ ID NO: 79107 - protein, 9 aa, Artificial Sequence
  Description of Artificial Sequence: Synthetic peptide
  Seed: YVFVNTLDL (MAGC1_HUMAN)
YIFVNTLDV

SEQ ID NO: 79108 - protein, 11 aa, Artificial Sequence
  Description of Artificial Sequence: Synthetic peptide
  Seed: SSFFSSALLSI (MAGC1_HUMAN)
SAFFSSALLSF

SEQ ID NO: 79109 - protein, 9 aa, Artificial Sequence
  Description of Artificial Sequence: Synthetic peptide
  Seed: YVFVNTLDL (MAGC1_HUMAN)
YFFVNTLDM

SEQ ID NO: 79110 - protein, 10 aa, Artificial Sequence
  Description of Artificial Sequence: Synthetic peptide
  Seed: VISFSSSTSL (MAGC1_HUMAN)
VRSFSSSTSF

SEQ ID NO: 79111 - protein, 9 aa, Artificial Sequence
  Description of Artificial Sequence: Synthetic peptide
  Seed: FPQSPLQGE (MAGC1_HUMAN)
FPQSPLQGL

SEQ ID NO: 79112 - protein, 9 aa, Artificial Sequence
  Description of Artificial Sequence: Synthetic peptide
  Seed: SKSSPESPL (MAGC1_HUMAN)
SKSSPESPF

SEQ ID NO: 79113 - protein, 9 aa, Artificial Sequence
  Description of Artificial Sequence: Synthetic peptide
  Seed: LQIPVSSSS (MAGC1_HUMAN)
LLIPVSSSM

SEQ ID NO: 79114 - protein, 9 aa, Artificial Sequence
  Description of Artificial Sequence: Synthetic peptide
  Seed: SPLQIVPSL (MAGC1_HUMAN)
SSLQIVPSI

SEQ ID NO: 79115 - protein, 11 aa, Artificial Sequence
  Description of Artificial Sequence: Synthetic peptide
  Seed: LQIPVSSSFSY (MAGC1_HUMAN)
LKIPVSSSFSW

SEQ ID NO: 79116 - protein, 9 aa, Artificial Sequence
  Description of Artificial Sequence: Synthetic peptide
  Seed: LQRPVSSFF (MAGC1_HUMAN)
LERPVSSFW

SEQ ID NO: 79117 - protein, 10 aa, Artificial Sequence
  Description of Artificial Sequence: Synthetic peptide
  Seed: SPLYFPQSPL (MAGC1_HUMAN)
SFLYFPQSPV

SEQ ID NO: 79118 - protein, 11 aa, Artificial Sequence
  Description of Artificial Sequence: Synthetic peptide
  Seed: SSTPSSLPQSF (MAGC1_HUMAN)
SCTPSSLPQSW

SEQ ID NO: 79119 - protein, 11 aa, Artificial Sequence
  Description of Artificial Sequence: Synthetic peptide
  Seed: IIDTTDDSTAT (MAGC1_HUMAN)
IFDTTDDSTAL

SEQ ID NO: 79120 - protein, 9 aa, Artificial Sequence
  Description of Artificial Sequence: Synthetic peptide
  Seed: SSSSSSSTL (MAGC1_HUMAN)
SVSSSSSTV

SEQ ID NO: 79121 - protein, 11 aa, Artificial Sequence
  Description of Artificial Sequence: Synthetic peptide
  Seed: RPVSSFFSYTL (MAGC1_HUMAN)
RTVSSFFSYTY

SEQ ID NO: 79122 - protein, 9 aa, Artificial Sequence
  Description of Artificial Sequence: Synthetic peptide
  Seed: SSFFSSALL (MAGC1_HUMAN)
SQFFSSALA

SEQ ID NO: 79123 - protein, 9 aa, Artificial Sequence
  Description of Artificial Sequence: Synthetic peptide
  Seed: MTSSFSSTL (MAGC1_HUMAN)
MKSSFSSTM

SEQ ID NO: 79124 - protein, 10 aa, Artificial Sequence
  Description of Artificial Sequence: Synthetic peptide
  Seed: SFPSSTSSSL (MAGC1_HUMAN)
SPPSSTSSSI

SEQ ID NO: 79125 - protein, 9 aa, Artificial Sequence
  Description of Artificial Sequence: Synthetic peptide
  Seed: STFEGFAQS (MAGC1_HUMAN)
STFEGFAQY

SEQ ID NO: 79126 - protein, 9 aa, Artificial Sequence
  Description of Artificial Sequence: Synthetic peptide
  Seed: SSPERTQST (MAGC1_HUMAN)
SIPERTQSY

SEQ ID NO: 79127 - protein, 11 aa, Artificial Sequence
  Description of Artificial Sequence: Synthetic peptide
  Seed: NTVPITFPSSY (MAGC1_HUMAN)
NTVPITFPSSR

SEQ ID NO: 79128 - protein, 11 aa, Artificial Sequence
  Description of Artificial Sequence: Synthetic peptide
  Seed: QSSPESTQSPF (MAGC1_HUMAN)
QASPESTQSPW

SEQ ID NO: 79129 - protein, 8 aa, Artificial Sequence
  Description of Artificial Sequence: Synthetic peptide
  Seed: SSVMSPSF (MAGC1_HUMAN)
SMVMSPSY

SEQ ID NO: 79130 - protein, 10 aa, Artificial Sequence
  Description of Artificial Sequence: Synthetic peptide
  Seed: SLQIPVSPSF (MAGC1_HUMAN)
SPQIPVSPSY

SEQ ID NO: 79131 - protein, 9 aa, Artificial Sequence
  Description of Artificial Sequence: Synthetic peptide
  Seed: SFFSYTLAS (MAGC1_HUMAN)
SYFSYTLAM

SEQ ID NO: 79132 - protein, 9 aa, Artificial Sequence
  Description of Artificial Sequence: Synthetic peptide
  Seed: RTHSTFEGF (MAGC1_HUMAN)
RIHSTFEGF

SEQ ID NO: 79133 - protein, 9 aa, Artificial Sequence
  Description of Artificial Sequence: Synthetic peptide
  Seed: FFSSALLSI (MAGC1_HUMAN)
FNSSALLSV

SEQ ID NO: 79134 - protein, 10 aa, Artificial Sequence
  Description of Artificial Sequence: Synthetic peptide
  Seed: QIPVSSSFSY (MAGC1_HUMAN)
QHPVSSSFSF

SEQ ID NO: 79135 - protein, 9 aa, Artificial Sequence
  Description of Artificial Sequence: Synthetic peptide
  Seed: YTLLSLFQS (MAGC1_HUMAN)
YQLLSLFQI

SEQ ID NO: 79136 - protein, 9 aa, Artificial Sequence
  Description of Artificial Sequence: Synthetic peptide
  Seed: KAREFIEIL (MAGC1_HUMAN)
KVREFIEIL

SEQ ID NO: 79137 - protein, 11 aa, Artificial Sequence
  Description of Artificial Sequence: Synthetic peptide
  Seed: SPLQIPMTSSF (MAGC1_HUMAN)
SMLQIPMTSSF

SEQ ID NO: 79138 - protein, 9 aa, Artificial Sequence
  Description of Artificial Sequence: Synthetic peptide
  Seed: FSSTLVSLF (MAGC1_HUMAN)
FKSTLVSLY

SEQ ID NO: 79139 - protein, 9 aa, Artificial Sequence
  Description of Artificial Sequence: Synthetic peptide
  Seed: SPLQIVPSL (MAGC1_HUMAN)
SILQIVPSV

SEQ ID NO: 79140 - protein, 9 aa, Artificial Sequence
  Description of Artificial Sequence: Synthetic peptide
  Seed: SSPERTHST (MAGC1_HUMAN)
SWPERTHSL

SEQ ID NO: 79141 - protein, 11 aa, Artificial Sequence
  Description of Artificial Sequence: Synthetic peptide
  Seed: FIKGTYASEEV (MAGC1_HUMAN)
FMKGTYASEEV

SEQ ID NO: 79142 - protein, 10 aa, Artificial Sequence
  Description of Artificial Sequence: Synthetic peptide
  Seed: REFIEILFGI (MAGC1_HUMAN)
RFFIEILFGF

SEQ ID NO: 79143 - protein, 9 aa, Artificial Sequence
  Description of Artificial Sequence: Synthetic peptide
  Seed: TGYFPVIFR (MAGC1_HUMAN)
TYYFPVIFR

SEQ ID NO: 79144 - protein, 9 aa, Artificial Sequence
  Description of Artificial Sequence: Synthetic peptide
  Seed: SSPERTQST (MAGC1_HUMAN)
SNPERTQSL

SEQ ID NO: 79145 - protein, 9 aa, Artificial Sequence
  Description of Artificial Sequence: Synthetic peptide
  Seed: LQNPASSFF (MAGC1_HUMAN)
LNNPASSFF

SEQ ID NO: 79146 - protein, 9 aa, Artificial Sequence
  Description of Artificial Sequence: Synthetic peptide
  Seed: MLTNVISRY (MAGC1_HUMAN)
MATNVISRW

SEQ ID NO: 79147 - protein, 10 aa, Artificial Sequence
  Description of Artificial Sequence: Synthetic peptide
  Seed: FIEILFGISL (MAGC1_HUMAN)
FKEILFGISL

SEQ ID NO: 79148 - protein, 10 aa, Artificial Sequence
  Description of Artificial Sequence: Synthetic peptide
  Seed: WGPRAHSEVI (MAGC1_HUMAN)
WPPRAHSEVV

SEQ ID NO: 79149 - protein, 10 aa, Artificial Sequence
  Description of Artificial Sequence: Synthetic peptide
  Seed: SPLQNPASSF (MAGC1_HUMAN)
SALQNPASSY

SEQ ID NO: 79150 - protein, 9 aa, Artificial Sequence
  Description of Artificial Sequence: Synthetic peptide
  Seed: MPTAGMPSL (MAGC1_HUMAN)
MATAGMPSW

SEQ ID NO: 79151 - protein, 9 aa, Artificial Sequence
  Description of Artificial Sequence: Synthetic peptide
  Seed: EFIEILFGI (MAGC1_HUMAN)
EGIEILFGV

SEQ ID NO: 79152 - protein, 10 aa, Artificial Sequence
  Description of Artificial Sequence: Synthetic peptide
  Seed: SLFQSFSERT (MAGC1_HUMAN)
SLFQSFSERI

SEQ ID NO: 79153 - protein, 10 aa, Artificial Sequence
  Description of Artificial Sequence: Synthetic peptide
  Seed: SFPSSTSSSL (MAGC1_HUMAN)
SPPSSTSSSM

SEQ ID NO: 79154 - protein, 10 aa, Artificial Sequence
  Description of Artificial Sequence: Synthetic peptide
  Seed: ILFGISLREV (MAGC1_HUMAN)
ITFGISLREV

SEQ ID NO: 79155 - protein, 11 aa, Artificial Sequence
  Description of Artificial Sequence: Synthetic peptide
  Seed: SSFSYTLLSLF (MAGC1_HUMAN)
SQFSYTLLSLF

SEQ ID NO: 79156 - protein, 10 aa, Artificial Sequence
  Description of Artificial Sequence: Synthetic peptide
  Seed: EILFGISLRE (MAGC1_HUMAN)
ERLFGISLRR

SEQ ID NO: 79157 - protein, 9 aa, Artificial Sequence
  Description of Artificial Sequence: Synthetic peptide
  Seed: SQSSPVSSF (MAGC1_HUMAN)
SYSSPVSSL

SEQ ID NO: 79158 - protein, 9 aa, Artificial Sequence
  Description of Artificial Sequence: Synthetic peptide
  Seed: ASSSTLVSI (MAGC1_HUMAN)
AVSSTLVSI

SEQ ID NO: 79159 - protein, 10 aa, Artificial Sequence
  Description of Artificial Sequence: Synthetic peptide
  Seed: PLQNPASSFF (MAGC1_HUMAN)
PVQNPASSFF

SEQ ID NO: 79160 - protein, 9 aa, Artificial Sequence
  Description of Artificial Sequence: Synthetic peptide
  Seed: LQIPGSPSF (MAGC1_HUMAN)
LHIPGSPSV

SEQ ID NO: 79161 - protein, 9 aa, Artificial Sequence
  Description of Artificial Sequence: Synthetic peptide
  Seed: FSERTQSTF (MAGC1_HUMAN)
FTERTQSTW

SEQ ID NO: 79162 - protein, 10 aa, Artificial Sequence
  Description of Artificial Sequence: Synthetic peptide
  Seed: SFPSSTSSSL (MAGC1_HUMAN)
SDPSSTSSSL

SEQ ID NO: 79163 - protein, 9 aa, Artificial Sequence
  Description of Artificial Sequence: Synthetic peptide
  Seed: QIVPSLPEW (MAGC1_HUMAN)
QPVPSLPEW

SEQ ID NO: 79164 - protein, 9 aa, Artificial Sequence
  Description of Artificial Sequence: Synthetic peptide
  Seed: AQSSLQIPV (MAGC1_HUMAN)
AESSLQIPI

SEQ ID NO: 79165 - protein, 9 aa, Artificial Sequence
  Description of Artificial Sequence: Synthetic peptide
  Seed: KDSLSPLEI (MAGC1_HUMAN)
KQSLSPLEV

SEQ ID NO: 79166 - protein, 9 aa, Artificial Sequence
  Description of Artificial Sequence: Synthetic peptide
  Seed: SSPPRYEFL (MAGC1_HUMAN)
SIPPRYEFM

SEQ ID NO: 79167 - protein, 10 aa, Artificial Sequence
  Description of Artificial Sequence: Synthetic peptide
  Seed: STSLSLPQSF (MAGC1_HUMAN)
SQSLSLPQSM

SEQ ID NO: 79168 - protein, 9 aa, Artificial Sequence
  Description of Artificial Sequence: Synthetic peptide
  Seed: SPLQIPMTS (MAGC1_HUMAN)
SMLQIPMTM

SEQ ID NO: 79169 - protein, 9 aa, Artificial Sequence
  Description of Artificial Sequence: Synthetic peptide
  Seed: WVQEHYLEY (MAGC1_HUMAN)
WKQEHYLEL

SEQ ID NO: 79170 - protein, 9 aa, Artificial Sequence
  Description of Artificial Sequence: Synthetic peptide
  Seed: EILFGISLR (MAGC1_HUMAN)
EALFGISLR

SEQ ID NO: 79171 - protein, 9 aa, Artificial Sequence
  Description of Artificial Sequence: Synthetic peptide
  Seed: FSYTLASLL (MAGC1_HUMAN)
FKYTLASLI

SEQ ID NO: 79172 - protein, 11 aa, Artificial Sequence
  Description of Artificial Sequence: Synthetic peptide
  Seed: RSFSSTLLSIF (MAGC1_HUMAN)
RAFSSTLLSIY

SEQ ID NO: 79173 - protein, 10 aa, Artificial Sequence
  Description of Artificial Sequence: Synthetic peptide
  Seed: RFLLLKYQVK (MAGC1_HUMAN)
RALLLKYQVR

SEQ ID NO: 79174 - protein, 9 aa, Artificial Sequence
  Description of Artificial Sequence: Synthetic peptide
  Seed: AGREHFAFG (MAGC1_HUMAN)
ANREHFAFA

SEQ ID NO: 79175 - protein, 11 aa, Artificial Sequence
  Description of Artificial Sequence: Synthetic peptide
  Seed: RSFSSTLLSIF (MAGC1_HUMAN)
RPFSSTLLSIW

SEQ ID NO: 79176 - protein, 9 aa, Artificial Sequence
  Description of Artificial Sequence: Synthetic peptide
  Seed: HFPQSPPEW (MAGC1_HUMAN)
HMPQSPPEM

SEQ ID NO: 79177 - protein, 9 aa, Artificial Sequence
  Description of Artificial Sequence: Synthetic peptide
  Seed: LQRPVSSFF (MAGC1_HUMAN)
LTRPVSSFY

SEQ ID NO: 79178 - protein, 9 aa, Artificial Sequence
  Description of Artificial Sequence: Synthetic peptide
  Seed: VLSGIGVRA (MAGC1_HUMAN)
VISGIGVRI

SEQ ID NO: 79179 - protein, 9 aa, Artificial Sequence
  Description of Artificial Sequence: Synthetic peptide
  Seed: SSPPRYEFL (MAGC1_HUMAN)
SYPPRYEFV

SEQ ID NO: 79180 - protein, 10 aa, Artificial Sequence
  Description of Artificial Sequence: Synthetic peptide
  Seed: VSRSFSSTLL (MAGC1_HUMAN)
VTRSFSSTLY

SEQ ID NO: 79181 - protein, 9 aa, Artificial Sequence
  Description of Artificial Sequence: Synthetic peptide
  Seed: DVLSGIGVR (MAGC1_HUMAN)
DALSGIGVR

SEQ ID NO: 79182 - protein, 9 aa, Artificial Sequence
  Description of Artificial Sequence: Synthetic peptide
  Seed: AGREHFAFG (MAGC1_HUMAN)
ASREHFAFG

SEQ ID NO: 79183 - protein, 9 aa, Artificial Sequence
  Description of Artificial Sequence: Synthetic peptide
  Seed: IPVSSSFSY (MAGC1_HUMAN)
IQVSSSFSA

SEQ ID NO: 79184 - protein, 9 aa, Artificial Sequence
  Description of Artificial Sequence: Synthetic peptide
  Seed: VSRSFSSTL (MAGC1_HUMAN)
VPRSFSSTC

SEQ ID NO: 79185 - protein, 10 aa, Artificial Sequence
  Description of Artificial Sequence: Synthetic peptide
  Seed: PLQRPVSSFF (MAGC1_HUMAN)
PWQRPVSSFY

SEQ ID NO: 79186 - protein, 10 aa, Artificial Sequence
  Description of Artificial Sequence: Synthetic peptide
  Seed: SSPERTHSTF (MAGC1_HUMAN)
SCPERTHSTM

SEQ ID NO: 79187 - protein, 9 aa, Artificial Sequence
  Description of Artificial Sequence: Synthetic peptide
  Seed: NTHSPLQIV (MAGC1_HUMAN)
NIHSPLQIF

SEQ ID NO: 79188 - protein, 10 aa, Artificial Sequence
  Description of Artificial Sequence: Synthetic peptide
  Seed: FAFGEPRELL (MAGC1_HUMAN)
FQFGEPRELV

SEQ ID NO: 79189 - protein, 9 aa, Artificial Sequence
  Description of Artificial Sequence: Synthetic peptide
  Seed: LQIPVSSSS (MAGC1_HUMAN)
LYIPVSSSW

SEQ ID NO: 79190 - protein, 9 aa, Artificial Sequence
  Description of Artificial Sequence: Synthetic peptide
  Seed: NVISRYTGY (MAGC1_HUMAN)
NPISRYTGY

SEQ ID NO: 79191 - protein, 10 aa, Artificial Sequence
  Description of Artificial Sequence: Synthetic peptide
  Seed: VPITFPSSYK (MAGC1_HUMAN)
VNITFPSSYR

SEQ ID NO: 79192 - protein, 9 aa, Artificial Sequence
  Description of Artificial Sequence: Synthetic peptide
  Seed: KVDELARFL (MAGC1_HUMAN)
KMDELARFI

SEQ ID NO: 79193 - protein, 9 aa, Artificial Sequence
  Description of Artificial Sequence: Synthetic peptide
  Seed: KVWVQEHYL (MAGC1_HUMAN)
KVWVQEHYR

SEQ ID NO: 79194 - protein, 9 aa, Artificial Sequence
  Description of Artificial Sequence: Synthetic peptide
  Seed: MSQNRLLIL (MAGC1_HUMAN)
MYQNRLLIY

SEQ ID NO: 79195 - protein, 9 aa, Artificial Sequence
  Description of Artificial Sequence: Synthetic peptide
  Seed: MPTAGMPSL (MAGC1_HUMAN)
MPTAGMPSH

SEQ ID NO: 79196 - protein, 10 aa, Artificial Sequence
  Description of Artificial Sequence: Synthetic peptide
  Seed: YVFVNTLDLT (MAGC1_HUMAN)
YIFVNTLDLV

SEQ ID NO: 79197 - protein, 10 aa, Artificial Sequence
  Description of Artificial Sequence: Synthetic peptide
  Seed: SFSYTLLSLF (MAGC1_HUMAN)
SDSYTLLSLF

SEQ ID NO: 79198 - protein, 9 aa, Artificial Sequence
  Description of Artificial Sequence: Synthetic peptide
  Seed: IPVSPSSSS (MAGC1_HUMAN)
IAVSPSSSY

SEQ ID NO: 79199 - protein, 9 aa, Artificial Sequence
  Description of Artificial Sequence: Synthetic peptide
  Seed: SSSSSSTLL (MAGC1_HUMAN)
SASSSSTLL

SEQ ID NO: 79200 - protein, 9 aa, Artificial Sequence
  Description of Artificial Sequence: Synthetic peptide
  Seed: YPLQSPQSR (MAGC1_HUMAN)
YVLQSPQSR

SEQ ID NO: 79201 - protein, 10 aa, Artificial Sequence
  Description of Artificial Sequence: Synthetic peptide
  Seed: RAGREHFAFG (MAGC1_HUMAN)
RFGREHFAFY

SEQ ID NO: 79202 - protein, 10 aa, Artificial Sequence
  Description of Artificial Sequence: Synthetic peptide
  Seed: YTLDEKVDEL (MAGC1_HUMAN)
YLLDEKVDEI

SEQ ID NO: 79203 - protein, 10 aa, Artificial Sequence
  Description of Artificial Sequence: Synthetic peptide
  Seed: FPQSVLQIPV (MAGC1_HUMAN)
FQQSVLQIPA

SEQ ID NO: 79204 - protein, 10 aa, Artificial Sequence
  Description of Artificial Sequence: Synthetic peptide
  Seed: WGPRAHSEVI (MAGC1_HUMAN)
WWPRAHSEVI

SEQ ID NO: 79205 - protein, 9 aa, Artificial Sequence
  Description of Artificial Sequence: Synthetic peptide
  Seed: AGREHFAFG (MAGC1_HUMAN)
ALREHFAFY

SEQ ID NO: 79206 - protein, 9 aa, Artificial Sequence
  Description of Artificial Sequence: Synthetic peptide
  Seed: LQSPVISFS (MAGC1_HUMAN)
LASPVISFA

SEQ ID NO: 79207 - protein, 10 aa, Artificial Sequence
  Description of Artificial Sequence: Synthetic peptide
  Seed: SPLQSPVSSF (MAGC1_HUMAN)
SDLQSPVSSY

SEQ ID NO: 79208 - protein, 9 aa, Artificial Sequence
  Description of Artificial Sequence: Synthetic peptide
  Seed: FAFGEPREL (MAGC1_HUMAN)
FSFGEPREV

SEQ ID NO: 79209 - protein, 10 aa, Artificial Sequence
  Description of Artificial Sequence: Synthetic peptide
  Seed: LSQSSPVSSF (MAGC1_HUMAN)
LHQSSPVSSM

SEQ ID NO: 79210 - protein, 10 aa, Artificial Sequence
  Description of Artificial Sequence: Synthetic peptide
  Seed: LSQSSPVSSF (MAGC1_HUMAN)
LNQSSPVSSM

SEQ ID NO: 79211 - protein, 10 aa, Artificial Sequence
  Description of Artificial Sequence: Synthetic peptide
  Seed: LQIPVSSSFS (MAGC1_HUMAN)
LQIPVSSSFI

SEQ ID NO: 79212 - protein, 9 aa, Artificial Sequence
  Description of Artificial Sequence: Synthetic peptide
  Seed: SQNRLLILI (MAGC1_HUMAN)
STNRLLILL

SEQ ID NO: 79213 - protein, 9 aa, Artificial Sequence
  Description of Artificial Sequence: Synthetic peptide
  Seed: IESEPLFTY (MAGC1_HUMAN)
INSEPLFTY

SEQ ID NO: 79214 - protein, 9 aa, Artificial Sequence
  Description of Artificial Sequence: Synthetic peptide
  Seed: SSPPRYEFL (MAGC1_HUMAN)
SVPPRYEFF

SEQ ID NO: 79215 - protein, 11 aa, Artificial Sequence
  Description of Artificial Sequence: Synthetic peptide
  Seed: SSFFSSALLSI (MAGC1_HUMAN)
SSFFSSALLSM

SEQ ID NO: 79216 - protein, 10 aa, Artificial Sequence
  Description of Artificial Sequence: Synthetic peptide
  Seed: MLKNTVPITF (MAGC1_HUMAN)
MHKNTVPITF

SEQ ID NO: 79217 - protein, 11 aa, Artificial Sequence
  Description of Artificial Sequence: Synthetic peptide
  Seed: STFEGFAQSPL (MAGC1_HUMAN)
SMFEGFAQSPI

SEQ ID NO: 79218 - protein, 9 aa, Artificial Sequence
  Description of Artificial Sequence: Synthetic peptide
  Seed: LQIVPSLPE (MAGC1_HUMAN)
LIIVPSLPF

SEQ ID NO: 79219 - protein, 9 aa, Artificial Sequence
  Description of Artificial Sequence: Synthetic peptide
  Seed: YQVKQPITK (MAGC1_HUMAN)
YEVKQPITF

SEQ ID NO: 79220 - protein, 11 aa, Artificial Sequence
  Description of Artificial Sequence: Synthetic peptide
  Seed: RSFSSTLLSIF (MAGC1_HUMAN)
RMFSSTLLSIW

SEQ ID NO: 79221 - protein, 9 aa, Artificial Sequence
  Description of Artificial Sequence: Synthetic peptide
  Seed: RFLLLKYQV (MAGC1_HUMAN)
RWLLLKYQF

SEQ ID NO: 79222 - protein, 9 aa, Artificial Sequence
  Description of Artificial Sequence: Synthetic peptide
  Seed: AGREHFAFG (MAGC1_HUMAN)
AIREHFAFA

SEQ ID NO: 79223 - protein, 10 aa, Artificial Sequence
  Description of Artificial Sequence: Synthetic peptide
  Seed: PLQIPGSPSF (MAGC1_HUMAN)
PRQIPGSPSY

SEQ ID NO: 79224 - protein, 10 aa, Artificial Sequence
  Description of Artificial Sequence: Synthetic peptide
  Seed: SVLQIPVSAA (MAGC1_HUMAN)
SFLQIPVSAV

SEQ ID NO: 79225 - protein, 10 aa, Artificial Sequence
  Description of Artificial Sequence: Synthetic peptide
  Seed: FLAMLKNTVP (MAGC1_HUMAN)
FLAMLKNTVE

SEQ ID NO: 79226 - protein, 10 aa, Artificial Sequence
  Description of Artificial Sequence: Synthetic peptide
  Seed: RAGREHFAFG (MAGC1_HUMAN)
RSGREHFAFL

SEQ ID NO: 79227 - protein, 9 aa, Artificial Sequence
  Description of Artificial Sequence: Synthetic peptide
  Seed: IEILFGISL (MAGC1_HUMAN)
IVILFGISY

SEQ ID NO: 79228 - protein, 11 aa, Artificial Sequence
  Description of Artificial Sequence: Synthetic peptide
  Seed: STFEGFAQSPL (MAGC1_HUMAN)
SMFEGFAQSPV

SEQ ID NO: 79229 - protein, 9 aa, Artificial Sequence
  Description of Artificial Sequence: Synthetic peptide
  Seed: MPTAGMPSL (MAGC1_HUMAN)
MATAGMPSF

SEQ ID NO: 79230 - protein, 11 aa, Artificial Sequence
  Description of Artificial Sequence: Synthetic peptide
  Seed: ITFPSSYKDAL (MAGC1_HUMAN)
IAFPSSYKDAW

SEQ ID NO: 79231 - protein, 9 aa, Artificial Sequence
  Description of Artificial Sequence: Synthetic peptide
  Seed: SFSSTLVSL (MAGC1_HUMAN)
SWSSTLVSI

SEQ ID NO: 79232 - protein, 10 aa, Artificial Sequence
  Description of Artificial Sequence: Synthetic peptide
  Seed: STPSSLPQSF (MAGC1_HUMAN)
SCPSSLPQSL

SEQ ID NO: 79233 - protein, 9 aa, Artificial Sequence
  Description of Artificial Sequence: Synthetic peptide
  Seed: HFPQSPPEW (MAGC1_HUMAN)
HTPQSPPEW

SEQ ID NO: 79234 - protein, 10 aa, Artificial Sequence
  Description of Artificial Sequence: Synthetic peptide
  Seed: ISRYTGYFPV (MAGC1_HUMAN)
ITRYTGYFPK

SEQ ID NO: 79235 - protein, 9 aa, Artificial Sequence
  Description of Artificial Sequence: Synthetic peptide
  Seed: WVQEHYLEY (MAGC1_HUMAN)
WVQEHYLEW

SEQ ID NO: 79236 - protein, 9 aa, Artificial Sequence
  Description of Artificial Sequence: Synthetic peptide
  Seed: KVVEFLAML (MAGC1_HUMAN)
KCVEFLAMW

SEQ ID NO: 79237 - protein, 10 aa, Artificial Sequence
  Description of Artificial Sequence: Synthetic peptide
  Seed: PLQIPMTSSF (MAGC1_HUMAN)
PSQIPMTSSM

SEQ ID NO: 79238 - protein, 9 aa, Artificial Sequence
  Description of Artificial Sequence: Synthetic peptide
  Seed: SSPESAQSA (MAGC1_HUMAN)
STPESAQSY

SEQ ID NO: 79239 - protein, 10 aa, Artificial Sequence
  Description of Artificial Sequence: Synthetic peptide
  Seed: KAEMLTNVIS (MAGC1_HUMAN)
KHEMLTNVIA

SEQ ID NO: 79240 - protein, 10 aa, Artificial Sequence
  Description of Artificial Sequence: Synthetic peptide
  Seed: TLDEKVDELA (MAGC1_HUMAN)
TADEKVDELM

SEQ ID NO: 79241 - protein, 9 aa, Artificial Sequence
  Description of Artificial Sequence: Synthetic peptide
  Seed: YTGYFPVIF (MAGC1_HUMAN)
YYGYFPVIM

SEQ ID NO: 79242 - protein, 9 aa, Artificial Sequence
  Description of Artificial Sequence: Synthetic peptide
  Seed: FPSSTSSSL (MAGC1_HUMAN)
FPSSTSSSH

SEQ ID NO: 79243 - protein, 9 aa, Artificial Sequence
  Description of Artificial Sequence: Synthetic peptide
  Seed: IPVSAASSS (MAGC1_HUMAN)
IPVSAASSI

SEQ ID NO: 79244 - protein, 8 aa, Artificial Sequence
  Description of Artificial Sequence: Synthetic peptide
  Seed: QIPVSSSF (MAGC1_HUMAN)
QMPVSSSF

SEQ ID NO: 79245 - protein, 9 aa, Artificial Sequence
  Description of Artificial Sequence: Synthetic peptide
  Seed: RPVSSFFSY (MAGC1_HUMAN)
RKVSSFFSL

SEQ ID NO: 79246 - protein, 10 aa, Artificial Sequence
  Description of Artificial Sequence: Synthetic peptide
  Seed: YTLDEKVDEL (MAGC1_HUMAN)
YQLDEKVDEV

SEQ ID NO: 79247 - protein, 8 aa, Artificial Sequence
  Description of Artificial Sequence: Synthetic peptide
  Seed: FIEILFGI (MAGC1_HUMAN)
FIEILFGV

SEQ ID NO: 79248 - protein, 10 aa, Artificial Sequence
  Description of Artificial Sequence: Synthetic peptide
  Seed: RTHSTFEGFP (MAGC1_HUMAN)
RTHSTFEGFL

SEQ ID NO: 79249 - protein, 10 aa, Artificial Sequence
  Description of Artificial Sequence: Synthetic peptide
  Seed: FAQSSLQIPV (MAGC1_HUMAN)
FTQSSLQIPA

SEQ ID NO: 79250 - protein, 11 aa, Artificial Sequence
  Description of Artificial Sequence: Synthetic peptide
  Seed: YTGYFPVIFRK (MAGC1_HUMAN)
YMGYFPVIFRR

SEQ ID NO: 79251 - protein, 9 aa, Artificial Sequence
  Description of Artificial Sequence: Synthetic peptide
  Seed: VSPSSSSTL (MAGC1_HUMAN)
VWPSSSSTY

SEQ ID NO: 79252 - protein, 10 aa, Artificial Sequence
  Description of Artificial Sequence: Synthetic peptide
  Seed: SVLQIPVSAA (MAGC1_HUMAN)
SPLQIPVSAA

SEQ ID NO: 79253 - protein, 9 aa, Artificial Sequence
  Description of Artificial Sequence: Synthetic peptide
  Seed: RLLILILSI (MAGC1_HUMAN)
RLLILILSY

SEQ ID NO: 79254 - protein, 9 aa, Artificial Sequence
  Description of Artificial Sequence: Synthetic peptide
  Seed: FSEESSSPV (MAGC1_HUMAN)
FTEESSSPM

SEQ ID NO: 79255 - protein, 9 aa, Artificial Sequence
  Description of Artificial Sequence: Synthetic peptide
  Seed: FTYTLDEKV (MAGC1_HUMAN)
FVYTLDEKV

SEQ ID NO: 79256 - protein, 9 aa, Artificial Sequence
  Description of Artificial Sequence: Synthetic peptide
  Seed: SSPPRYEFL (MAGC1_HUMAN)
SSPPRYEFI

SEQ ID NO: 79257 - protein, 10 aa, Artificial Sequence
  Description of Artificial Sequence: Synthetic peptide
  Seed: RTHSTFEGFP (MAGC1_HUMAN)
RSHSTFEGFV

SEQ ID NO: 79258 - protein, 9 aa, Artificial Sequence
  Description of Artificial Sequence: Synthetic peptide
  Seed: ASSSTLVSI (MAGC1_HUMAN)
AMSSTLVSL

SEQ ID NO: 79259 - protein, 9 aa, Artificial Sequence
  Description of Artificial Sequence: Synthetic peptide
  Seed: FAFGEPREL (MAGC1_HUMAN)
FIFGEPRER

SEQ ID NO: 79260 - protein, 10 aa, Artificial Sequence
  Description of Artificial Sequence: Synthetic peptide
  Seed: LILILSIIFI (MAGC1_HUMAN)
LQLILSIIFV

SEQ ID NO: 79261 - protein, 9 aa, Artificial Sequence
  Description of Artificial Sequence: Synthetic peptide
  Seed: SLFQSFSER (MAGC1_HUMAN)
SIFQSFSEL

SEQ ID NO: 79262 - protein, 9 aa, Artificial Sequence
  Description of Artificial Sequence: Synthetic peptide
  Seed: KVDELARFL (MAGC1_HUMAN)
KRDELARFM

SEQ ID NO: 79263 - protein, 9 aa, Artificial Sequence
  Description of Artificial Sequence: Synthetic peptide
  Seed: VSAASSSTL (MAGC1_HUMAN)
VCAASSSTW

SEQ ID NO: 79264 - protein, 9 aa, Artificial Sequence
  Description of Artificial Sequence: Synthetic peptide
  Seed: EHFAFGEPR (MAGC1_HUMAN)
ETFAFGEPH

SEQ ID NO: 79265 - protein, 10 aa, Artificial Sequence
  Description of Artificial Sequence: Synthetic peptide
  Seed: SSPESAQSTF (MAGC1_HUMAN)
SVPESAQSTL

SEQ ID NO: 79266 - protein, 10 aa, Artificial Sequence
  Description of Artificial Sequence: Synthetic peptide
  Seed: FAFGEPRELL (MAGC1_HUMAN)
FTFGEPRELL

SEQ ID NO: 79267 - protein, 10 aa, Artificial Sequence
  Description of Artificial Sequence: Synthetic peptide
  Seed: FPQSPLQIPV (MAGC1_HUMAN)
FWQSPLQIPI

SEQ ID NO: 79268 - protein, 9 aa, Artificial Sequence
  Description of Artificial Sequence: Synthetic peptide
  Seed: LSDEQGMSQ (MAGC1_HUMAN)
LQDEQGMSY

SEQ ID NO: 79269 - protein, 9 aa, Artificial Sequence
  Description of Artificial Sequence: Synthetic peptide
  Seed: RKAREFIEI (MAGC1_HUMAN)
RKAREFIEY

SEQ ID NO: 79270 - protein, 10 aa, Artificial Sequence
  Description of Artificial Sequence: Synthetic peptide
  Seed: SPLQNPASSF (MAGC1_HUMAN)
SVLQNPASSF

SEQ ID NO: 79271 - protein, 10 aa, Artificial Sequence
  Description of Artificial Sequence: Synthetic peptide
  Seed: RSFSSTLLSI (MAGC1_HUMAN)
RRFSSTLLSF

SEQ ID NO: 79272 - protein, 9 aa, Artificial Sequence
  Description of Artificial Sequence: Synthetic peptide
  Seed: REVDPDDSY (MAGC1_HUMAN)
RQVDPDDSF

SEQ ID NO: 79273 - protein, 10 aa, Artificial Sequence
  Description of Artificial Sequence: Synthetic peptide
  Seed: RAGREHFAFG (MAGC1_HUMAN)
RVGREHFAFR

SEQ ID NO: 79274 - protein, 8 aa, Artificial Sequence
  Description of Artificial Sequence: Synthetic peptide
  Seed: SFFSSALL (MAGC1_HUMAN)
SYFSSALM

SEQ ID NO: 79275 - protein, 10 aa, Artificial Sequence
  Description of Artificial Sequence: Synthetic peptide
  Seed: STPSSLPQSF (MAGC1_HUMAN)
SLPSSLPQSF

SEQ ID NO: 79276 - protein, 11 aa, Artificial Sequence
  Description of Artificial Sequence: Synthetic peptide
  Seed: SPLQIPVSPSS (MAGC1_HUMAN)
SDLQIPVSPSF

SEQ ID NO: 79277 - protein, 9 aa, Artificial Sequence
  Description of Artificial Sequence: Synthetic peptide
  Seed: SSHESPQSP (MAGC1_HUMAN)
SSHESPQSV

SEQ ID NO: 79278 - protein, 9 aa, Artificial Sequence
  Description of Artificial Sequence: Synthetic peptide
  Seed: SSSSTLLSL (MAGC1_HUMAN)
SISSTLLSM

SEQ ID NO: 79279 - protein, 9 aa, Artificial Sequence
  Description of Artificial Sequence: Synthetic peptide
  Seed: VSSSSSSTL (MAGC1_HUMAN)
VVSSSSSTY

SEQ ID NO: 79280 - protein, 9 aa, Artificial Sequence
  Description of Artificial Sequence: Synthetic peptide
  Seed: SPLQIVPSL (MAGC1_HUMAN)
SYLQIVPSY

SEQ ID NO: 79281 - protein, 9 aa, Artificial Sequence
  Description of Artificial Sequence: Synthetic peptide
  Seed: GSPSFSSTL (MAGC1_HUMAN)
GAPSFSSTF

SEQ ID NO: 79282 - protein, 10 aa, Artificial Sequence
  Description of Artificial Sequence: Synthetic peptide
  Seed: RPVSSFFSYT (MAGC1_HUMAN)
RTVSSFFSYL

SEQ ID NO: 79283 - protein, 11 aa, Artificial Sequence
  Description of Artificial Sequence: Synthetic peptide
  Seed: SPLQRPVSSFF (MAGC1_HUMAN)
STLQRPVSSFY

SEQ ID NO: 79284 - protein, 10 aa, Artificial Sequence
  Description of Artificial Sequence: Synthetic peptide
  Seed: MTSSFSSTLL (MAGC1_HUMAN)
MMSSFSSTLY

SEQ ID NO: 79285 - protein, 10 aa, Artificial Sequence
  Description of Artificial Sequence: Synthetic peptide
  Seed: MTSSFSSTLL (MAGC1_HUMAN)
MYSSFSSTLL

SEQ ID NO: 79286 - protein, 9 aa, Artificial Sequence
  Description of Artificial Sequence: Synthetic peptide
  Seed: TESASSSVM (MAGC1_HUMAN)
THSASSSVY

SEQ ID NO: 79287 - protein, 10 aa, Artificial Sequence
  Description of Artificial Sequence: Synthetic peptide
  Seed: ESAQSTFEGF (MAGC1_HUMAN)
ETAQSTFEGR

SEQ ID NO: 79288 - protein, 10 aa, Artificial Sequence
  Description of Artificial Sequence: Synthetic peptide
  Seed: VSSSSSSTLL (MAGC1_HUMAN)
VCSSSSSTLY

SEQ ID NO: 79289 - protein, 9 aa, Artificial Sequence
  Description of Artificial Sequence: Synthetic peptide
  Seed: VPITFPSSY (MAGC1_HUMAN)
VEITFPSSF

SEQ ID NO: 79290 - protein, 9 aa, Artificial Sequence
  Description of Artificial Sequence: Synthetic peptide
  Seed: LQIPMTSSF (MAGC1_HUMAN)
LKIPMTSSL

SEQ ID NO: 79291 - protein, 9 aa, Artificial Sequence
  Description of Artificial Sequence: Synthetic peptide
  Seed: SLPEWEDSL (MAGC1_HUMAN)
SSPEWEDSM

SEQ ID NO: 79292 - protein, 9 aa, Artificial Sequence
  Description of Artificial Sequence: Synthetic peptide
  Seed: SESPQSCPE (MAGC1_HUMAN)
SESPQSCPP

SEQ ID NO: 79293 - protein, 10 aa, Artificial Sequence
  Description of Artificial Sequence: Synthetic peptide
  Seed: SIFQSSPESA (MAGC1_HUMAN)
SLFQSSPESA

SEQ ID NO: 79294 - protein, 9 aa, Artificial Sequence
  Description of Artificial Sequence: Synthetic peptide
  Seed: SSSSSSSTL (MAGC1_HUMAN)
SLSSSSSTY

SEQ ID NO: 79295 - protein, 10 aa, Artificial Sequence
  Description of Artificial Sequence: Synthetic peptide
  Seed: YTLASLLQSS (MAGC1_HUMAN)
YILASLLQSV

SEQ ID NO: 79296 - protein, 9 aa, Artificial Sequence
  Description of Artificial Sequence: Synthetic peptide
  Seed: VIFRKAREF (MAGC1_HUMAN)
VMFRKAREW

SEQ ID NO: 79297 - protein, 9 aa, Artificial Sequence
  Description of Artificial Sequence: Synthetic peptide
  Seed: ASSSTLVSI (MAGC1_HUMAN)
AQSSTLVSY

SEQ ID NO: 79298 - protein, 9 aa, Artificial Sequence
  Description of Artificial Sequence: Synthetic peptide
  Seed: YQVKQPITK (MAGC1_HUMAN)
YSVKQPITI

SEQ ID NO: 79299 - protein, 11 aa, Artificial Sequence
  Description of Artificial Sequence: Synthetic peptide
  Seed: SICSSSTPSSL (MAGC1_HUMAN)
SACSSSTPSSL

SEQ ID NO: 79300 - protein, 10 aa, Artificial Sequence
  Description of Artificial Sequence: Synthetic peptide
  Seed: SFPSSTSSSL (MAGC1_HUMAN)
SLPSSTSSSV

SEQ ID NO: 79301 - protein, 9 aa, Artificial Sequence
  Description of Artificial Sequence: Synthetic peptide
  Seed: SSFPSSTSS (MAGC1_HUMAN)
SAFPSSTSH

SEQ ID NO: 79302 - protein, 10 aa, Artificial Sequence
  Description of Artificial Sequence: Synthetic peptide
  Seed: SSPESAQSTF (MAGC1_HUMAN)
SAPESAQSTF

SEQ ID NO: 79303 - protein, 10 aa, Artificial Sequence
  Description of Artificial Sequence: Synthetic peptide
  Seed: SSPERTHSTF (MAGC1_HUMAN)
SAPERTHSTY

SEQ ID NO: 79304 - protein, 9 aa, Artificial Sequence
  Description of Artificial Sequence: Synthetic peptide
  Seed: LQIPVSPSF (MAGC1_HUMAN)
LMIPVSPSI

SEQ ID NO: 79305 - protein, 9 aa, Artificial Sequence
  Description of Artificial Sequence: Synthetic peptide
  Seed: CTQSTFEGF (MAGC1_HUMAN)
CMQSTFEGF

SEQ ID NO: 79306 - protein, 9 aa, Artificial Sequence
  Description of Artificial Sequence: Synthetic peptide
  Seed: TTDDSTATE (MAGC1_HUMAN)
TQDDSTATF

SEQ ID NO: 79307 - protein, 9 aa, Artificial Sequence
  Description of Artificial Sequence: Synthetic peptide
  Seed: LKNTVPITF (MAGC1_HUMAN)
LHNTVPITI

SEQ ID NO: 79308 - protein, 9 aa, Artificial Sequence
  Description of Artificial Sequence: Synthetic peptide
  Seed: LQIPVSSSS (MAGC1_HUMAN)
LKIPVSSSL

SEQ ID NO: 79309 - protein, 10 aa, Artificial Sequence
  Description of Artificial Sequence: Synthetic peptide
  Seed: FAQSSLQIPV (MAGC1_HUMAN)
FQQSSLQIPV

SEQ ID NO: 79310 - protein, 10 aa, Artificial Sequence
  Description of Artificial Sequence: Synthetic peptide
  Seed: KAREFIEILF (MAGC1_HUMAN)
KQREFIEILY

SEQ ID NO: 79311 - protein, 11 aa, Artificial Sequence
  Description of Artificial Sequence: Synthetic peptide
  Seed: SFFSYTLASLL (MAGC1_HUMAN)
SLFSYTLASLW

SEQ ID NO: 79312 - protein, 11 aa, Artificial Sequence
  Description of Artificial Sequence: Synthetic peptide
  Seed: SESLIESEPLF (MAGC1_HUMAN)
SESLIESEPLL

SEQ ID NO: 79313 - protein, 11 aa, Artificial Sequence
  Description of Artificial Sequence: Synthetic peptide
  Seed: SPLQNPASSFF (MAGC1_HUMAN)
SKLQNPASSFY

SEQ ID NO: 79314 - protein, 11 aa, Artificial Sequence
  Description of Artificial Sequence: Synthetic peptide
  Seed: QSSPESAQSTF (MAGC1_HUMAN)
QASPESAQSTW

SEQ ID NO: 79315 - protein, 10 aa, Artificial Sequence
  Description of Artificial Sequence: Synthetic peptide
  Seed: IIDTTDDSTA (MAGC1_HUMAN)
IADTTDDSTF

SEQ ID NO: 79316 - protein, 9 aa, Artificial Sequence
  Description of Artificial Sequence: Synthetic peptide
  Seed: VIWDVLSGI (MAGC1_HUMAN)
VTWDVLSGW

SEQ ID NO: 79317 - protein, 11 aa, Artificial Sequence
  Description of Artificial Sequence: Synthetic peptide
  Seed: SSFFSYTLASL (MAGC1_HUMAN)
SSFFSYTLASW

SEQ ID NO: 79318 - protein, 10 aa, Artificial Sequence
  Description of Artificial Sequence: Synthetic peptide
  Seed: WGPRAHSEVI (MAGC1_HUMAN)
WKPRAHSEVF

SEQ ID NO: 79319 - protein, 11 aa, Artificial Sequence
  Description of Artificial Sequence: Synthetic peptide
  Seed: AASSSTLVSIF (MAGC1_HUMAN)
ASSSSTLVSIW

SEQ ID NO: 79320 - protein, 9 aa, Artificial Sequence
  Description of Artificial Sequence: Synthetic peptide
  Seed: AQSSLQIPV (MAGC1_HUMAN)
AQSSLQIPI

SEQ ID NO: 79321 - protein, 10 aa, Artificial Sequence
  Description of Artificial Sequence: Synthetic peptide
  Seed: LAMLKNTVPI (MAGC1_HUMAN)
LLMLKNTVPY

SEQ ID NO: 79322 - protein, 9 aa, Artificial Sequence
  Description of Artificial Sequence: Synthetic peptide
  Seed: ISFSSSTSL (MAGC1_HUMAN)
ILFSSSTSR

SEQ ID NO: 79323 - protein, 9 aa, Artificial Sequence
  Description of Artificial Sequence: Synthetic peptide
  Seed: ISFSSSTSL (MAGC1_HUMAN)
IRFSSSTSL

SEQ ID NO: 79324 - protein, 9 aa, Artificial Sequence
  Description of Artificial Sequence: Synthetic peptide
  Seed: AQSPLQRPV (MAGC1_HUMAN)
ATSPLQRPF

SEQ ID NO: 79325 - protein, 9 aa, Artificial Sequence
  Description of Artificial Sequence: Synthetic peptide
  Seed: SPLQSPESA (MAGC1_HUMAN)
SPLQSPESV

SEQ ID NO: 79326 - protein, 9 aa, Artificial Sequence
  Description of Artificial Sequence: Synthetic peptide
  Seed: SRYTGYFPV (MAGC1_HUMAN)
SFYTGYFPF

SEQ ID NO: 79327 - protein, 10 aa, Artificial Sequence
  Description of Artificial Sequence: Synthetic peptide
  Seed: TTDDSTATES (MAGC1_HUMAN)
TQDDSTATEV

SEQ ID NO: 79328 - protein, 9 aa, Artificial Sequence
  Description of Artificial Sequence: Synthetic peptide
  Seed: SLIESEPLF (MAGC1_HUMAN)
SVIESEPLW

SEQ ID NO: 79329 - protein, 9 aa, Artificial Sequence
  Description of Artificial Sequence: Synthetic peptide
  Seed: TGYFPVIFR (MAGC1_HUMAN)
TAYFPVIFK

SEQ ID NO: 79330 - protein, 10 aa, Artificial Sequence
  Description of Artificial Sequence: Synthetic peptide
  Seed: KAEMLTNVIS (MAGC1_HUMAN)
KNEMLTNVIA

SEQ ID NO: 79331 - protein, 9 aa, Artificial Sequence
  Description of Artificial Sequence: Synthetic peptide
  Seed: RLLILILSI (MAGC1_HUMAN)
RLLILILSF

SEQ ID NO: 79332 - protein, 10 aa, Artificial Sequence
  Description of Artificial Sequence: Synthetic peptide
  Seed: ISRYTGYFPV (MAGC1_HUMAN)
IWRYTGYFPL

SEQ ID NO: 79333 - protein, 10 aa, Artificial Sequence
  Description of Artificial Sequence: Synthetic peptide
  Seed: ICSSSTSLSL (MAGC1_HUMAN)
IVSSSTSLSW

SEQ ID NO: 79334 - protein, 9 aa, Artificial Sequence
  Description of Artificial Sequence: Synthetic peptide
  Seed: VSPSSSSTL (MAGC1_HUMAN)
VGPSSSSTI

SEQ ID NO: 79335 - protein, 9 aa, Artificial Sequence
  Description of Artificial Sequence: Synthetic peptide
  Seed: TTDDSTATE (MAGC1_HUMAN)
TADDSTATI

SEQ ID NO: 79336 - protein, 9 aa, Artificial Sequence
  Description of Artificial Sequence: Synthetic peptide
  Seed: MTSSFSSTL (MAGC1_HUMAN)
MMSSFSSTH

SEQ ID NO: 79337 - protein, 9 aa, Artificial Sequence
  Description of Artificial Sequence: Synthetic peptide
  Seed: NTVPITFPS (MAGC1_HUMAN)
NIVPITFPI

SEQ ID NO: 79338 - protein, 9 aa, Artificial Sequence
  Description of Artificial Sequence: Synthetic peptide
  Seed: TESASSSVM (MAGC1_HUMAN)
TISASSSVF

SEQ ID NO: 79339 - protein, 9 aa, Artificial Sequence
  Description of Artificial Sequence: Synthetic peptide
  Seed: FQSSPERTH (MAGC1_HUMAN)
FGSSPERTF

SEQ ID NO: 79340 - protein, 10 aa, Artificial Sequence
  Description of Artificial Sequence: Synthetic peptide
  Seed: ILFGISLREV (MAGC1_HUMAN)
IMFGISLREL

SEQ ID NO: 79341 - protein, 11 aa, Artificial Sequence
  Description of Artificial Sequence: Synthetic peptide
  Seed: LQIPVSSSFSY (MAGC1_HUMAN)
LPIPVSSSFSF

SEQ ID NO: 79342 - protein, 10 aa, Artificial Sequence
  Description of Artificial Sequence: Synthetic peptide
  Seed: LTKVWVQEHY (MAGC1_HUMAN)
LSKVWVQEHW

SEQ ID NO: 79343 - protein, 11 aa, Artificial Sequence
  Description of Artificial Sequence: Synthetic peptide
  Seed: RSFSSTLLSIF (MAGC1_HUMAN)
RMFSSTLLSIF

SEQ ID NO: 79344 - protein, 9 aa, Artificial Sequence
  Description of Artificial Sequence: Synthetic peptide
  Seed: SSPESAQSA (MAGC1_HUMAN)
SCPESAQSI

SEQ ID NO: 79345 - protein, 9 aa, Artificial Sequence
  Description of Artificial Sequence: Synthetic peptide
  Seed: IIDTTDDST (MAGC1_HUMAN)
IMDTTDDSM

SEQ ID NO: 79346 - protein, 10 aa, Artificial Sequence
  Description of Artificial Sequence: Synthetic peptide
  Seed: SSFSSTLLSI (MAGC1_HUMAN)
STFSSTLLSF

SEQ ID NO: 79347 - protein, 10 aa, Artificial Sequence
  Description of Artificial Sequence: Synthetic peptide
  Seed: PLQRPVSSFF (MAGC1_HUMAN)
PMQRPVSSFY

SEQ ID NO: 79348 - protein, 9 aa, Artificial Sequence
  Description of Artificial Sequence: Synthetic peptide
  Seed: SIFQSSPER (MAGC1_HUMAN)
SIFQSSPEL

SEQ ID NO: 79349 - protein, 9 aa, Artificial Sequence
  Description of Artificial Sequence: Synthetic peptide
  Seed: TLLSLFQSF (MAGC1_HUMAN)
TLLSLFQSW

SEQ ID NO: 79350 - protein, 9 aa, Artificial Sequence
  Description of Artificial Sequence: Synthetic peptide
  Seed: SSSDTLLES (MAGC1_HUMAN)
SLSDTLLEY

SEQ ID NO: 79351 - protein, 9 aa, Artificial Sequence
  Description of Artificial Sequence: Synthetic peptide
  Seed: SPPEGENTH (MAGC1_HUMAN)
SLPEGENTF

SEQ ID NO: 79352 - protein, 9 aa, Artificial Sequence
  Description of Artificial Sequence: Synthetic peptide
  Seed: SSPESPLQS (MAGC1_HUMAN)
SVPESPLQF

SEQ ID NO: 79353 - protein, 8 aa, Artificial Sequence
  Description of Artificial Sequence: Synthetic peptide
  Seed: FSSTLLSL (MAGC1_HUMAN)
FSSTLLSM

SEQ ID NO: 79354 - protein, 10 aa, Artificial Sequence
  Description of Artificial Sequence: Synthetic peptide
  Seed: STPSSLPQSF (MAGC1_HUMAN)
SWPSSLPQSY

SEQ ID NO: 79355 - protein, 9 aa, Artificial Sequence
  Description of Artificial Sequence: Synthetic peptide
  Seed: GSPSFSSTL (MAGC1_HUMAN)
GVPSFSSTL

SEQ ID NO: 79356 - protein, 10 aa, Artificial Sequence
  Description of Artificial Sequence: Synthetic peptide
  Seed: FSSSTSLSPF (MAGC1_HUMAN)
FMSSTSLSPY

SEQ ID NO: 79357 - protein, 9 aa, Artificial Sequence
  Description of Artificial Sequence: Synthetic peptide
  Seed: RKAREFIEI (MAGC1_HUMAN)
RLAREFIEF

SEQ ID NO: 79358 - protein, 9 aa, Artificial Sequence
  Description of Artificial Sequence: Synthetic peptide
  Seed: SSPESDDTL (MAGC1_HUMAN)
SVPESDDTL

SEQ ID NO: 79359 - protein, 9 aa, Artificial Sequence
  Description of Artificial Sequence: Synthetic peptide
  Seed: MPSLLQSSS (MAGC1_HUMAN)
MASLLQSSA

SEQ ID NO: 79360 - protein, 9 aa, Artificial Sequence
  Description of Artificial Sequence: Synthetic peptide
  Seed: LKYQVKQPI (MAGC1_HUMAN)
LAYQVKQPM

SEQ ID NO: 79361 - protein, 9 aa, Artificial Sequence
  Description of Artificial Sequence: Synthetic peptide
  Seed: KVVEFLAML (MAGC1_HUMAN)
KLVEFLAMY

SEQ ID NO: 79362 - protein, 10 aa, Artificial Sequence
  Description of Artificial Sequence: Synthetic peptide
  Seed: QIPVSSSFSY (MAGC1_HUMAN)
QWPVSSSFSY

SEQ ID NO: 79363 - protein, 9 aa, Artificial Sequence
  Description of Artificial Sequence: Synthetic peptide
  Seed: RFLLLKYQV (MAGC1_HUMAN)
RFLLLKYQI

SEQ ID NO: 79364 - protein, 8 aa, Artificial Sequence
  Description of Artificial Sequence: Synthetic peptide
  Seed: FSYTLASL (MAGC1_HUMAN)
FEYTLASI

SEQ ID NO: 79365 - protein, 9 aa, Artificial Sequence
  Description of Artificial Sequence: Synthetic peptide
  Seed: KVVEFLAML (MAGC1_HUMAN)
KVVEFLAMK

SEQ ID NO: 79366 - protein, 8 aa, Artificial Sequence
  Description of Artificial Sequence: Synthetic peptide
  Seed: FSYTLLSL (MAGC1_HUMAN)
FQYTLLSV

SEQ ID NO: 79367 - protein, 9 aa, Artificial Sequence
  Description of Artificial Sequence: Synthetic peptide
  Seed: VSPSSSSTL (MAGC1_HUMAN)
VQPSSSSTY

SEQ ID NO: 79368 - protein, 9 aa, Artificial Sequence
  Description of Artificial Sequence: Synthetic peptide
  Seed: TGYFPVIFR (MAGC1_HUMAN)
TFYFPVIFR

SEQ ID NO: 79369 - protein, 9 aa, Artificial Sequence
  Description of Artificial Sequence: Synthetic peptide
  Seed: SLLQSSHES (MAGC1_HUMAN)
SMLQSSHEL

SEQ ID NO: 79370 - protein, 9 aa, Artificial Sequence
  Description of Artificial Sequence: Synthetic peptide
  Seed: KVWVQEHYL (MAGC1_HUMAN)
KSWVQEHYF

SEQ ID NO: 79371 - protein, 11 aa, Artificial Sequence
  Description of Artificial Sequence: Synthetic peptide
  Seed: SFFSSALLSIF (MAGC1_HUMAN)
SLFSSALLSIY

SEQ ID NO: 79372 - protein, 9 aa, Artificial Sequence
  Description of Artificial Sequence: Synthetic peptide
  Seed: WVQEHYLEY (MAGC1_HUMAN)
WFQEHYLEI

SEQ ID NO: 79373 - protein, 9 aa, Artificial Sequence
  Description of Artificial Sequence: Synthetic peptide
  Seed: YTLLSLFQS (MAGC1_HUMAN)
YMLLSLFQT

SEQ ID NO: 79374 - protein, 11 aa, Artificial Sequence
  Description of Artificial Sequence: Synthetic peptide
  Seed: QSFSERTQSTF (MAGC1_HUMAN)
QTFSERTQSTF

SEQ ID NO: 79375 - protein, 10 aa, Artificial Sequence
  Description of Artificial Sequence: Synthetic peptide
  Seed: SYVFVNTLDL (MAGC1_HUMAN)
SFVFVNTLDF

SEQ ID NO: 79376 - protein, 11 aa, Artificial Sequence
  Description of Artificial Sequence: Synthetic peptide
  Seed: VSSSSSSSTLL (MAGC1_HUMAN)
VDSSSSSSTLW

SEQ ID NO: 79377 - protein, 9 aa, Artificial Sequence
  Description of Artificial Sequence: Synthetic peptide
  Seed: IPVSSSFSY (MAGC1_HUMAN)
IWVSSSFSY

SEQ ID NO: 79378 - protein, 9 aa, Artificial Sequence
  Description of Artificial Sequence: Synthetic peptide
  Seed: ASSFFSSAL (MAGC1_HUMAN)
AQSFFSSAM

SEQ ID NO: 79379 - protein, 9 aa, Artificial Sequence
  Description of Artificial Sequence: Synthetic peptide
  Seed: MLTNVISRY (MAGC1_HUMAN)
MQTNVISRF

SEQ ID NO: 79380 - protein, 11 aa, Artificial Sequence
  Description of Artificial Sequence: Synthetic peptide
  Seed: FLWGPRAHSEV (MAGC1_HUMAN)
FMWGPRAHSEA

SEQ ID NO: 79381 - protein, 10 aa, Artificial Sequence
  Description of Artificial Sequence: Synthetic peptide
  Seed: PLQIPGSPSF (MAGC1_HUMAN)
PLQIPGSPSM

SEQ ID NO: 79382 - protein, 11 aa, Artificial Sequence
  Description of Artificial Sequence: Synthetic peptide
  Seed: SPLQIPVSRSF (MAGC1_HUMAN)
SPLQIPVSRSY

SEQ ID NO: 79383 - protein, 9 aa, Artificial Sequence
  Description of Artificial Sequence: Synthetic peptide
  Seed: TLDLTSEGC (MAGC1_HUMAN)
TMDLTSEGM

SEQ ID NO: 79384 - protein, 10 aa, Artificial Sequence
  Description of Artificial Sequence: Synthetic peptide
  Seed: SSPERTHSTF (MAGC1_HUMAN)
SYPERTHSTL

SEQ ID NO: 79385 - protein, 9 aa, Artificial Sequence
  Description of Artificial Sequence: Synthetic peptide
  Seed: WGPRAHSEV (MAGC1_HUMAN)
WTPRAHSEM

SEQ ID NO: 79386 - protein, 9 aa, Artificial Sequence
  Description of Artificial Sequence: Synthetic peptide
  Seed: TSLSLPQSF (MAGC1_HUMAN)
TALSLPQSW

SEQ ID NO: 79387 - protein, 11 aa, Artificial Sequence
  Description of Artificial Sequence: Synthetic peptide
  Seed: SPLQIPVSSSS (MAGC1_HUMAN)
SMLQIPVSSSF

SEQ ID NO: 79388 - protein, 11 aa, Artificial Sequence
  Description of Artificial Sequence: Synthetic peptide
  Seed: QSSPESAQSTF (MAGC1_HUMAN)
QPSPESAQSTF

SEQ ID NO: 79389 - protein, 11 aa, Artificial Sequence
  Description of Artificial Sequence: Synthetic peptide
  Seed: SAASSSTLVSI (MAGC1_HUMAN)
SIASSSTLVSW

SEQ ID NO: 79390 - protein, 9 aa, Artificial Sequence
  Description of Artificial Sequence: Synthetic peptide
  Seed: SSFPSSTSS (MAGC1_HUMAN)
SLFPSSTSM

SEQ ID NO: 79391 - protein, 9 aa, Artificial Sequence
  Description of Artificial Sequence: Synthetic peptide
  Seed: KVWVQEHYL (MAGC1_HUMAN)
KLWVQEHYV

SEQ ID NO: 79392 - protein, 11 aa, Artificial Sequence
  Description of Artificial Sequence: Synthetic peptide
  Seed: QSSPESAQSAF (MAGC1_HUMAN)
QTSPESAQSAW

SEQ ID NO: 79393 - protein, 10 aa, Artificial Sequence
  Description of Artificial Sequence: Synthetic peptide
  Seed: SPLQNPASSF (MAGC1_HUMAN)
SLLQNPASSF

SEQ ID NO: 79394 - protein, 9 aa, Artificial Sequence
  Description of Artificial Sequence: Synthetic peptide
  Seed: NTVPITFPS (MAGC1_HUMAN)
NSVPITFPL

SEQ ID NO: 79395 - protein, 10 aa, Artificial Sequence
  Description of Artificial Sequence: Synthetic peptide
  Seed: SSPESAQSAF (MAGC1_HUMAN)
SSPESAQSAW

SEQ ID NO: 79396 - protein, 9 aa, Artificial Sequence
  Description of Artificial Sequence: Synthetic peptide
  Seed: LQIPVSAAS (MAGC1_HUMAN)
LKIPVSAAV

SEQ ID NO: 79397 - protein, 10 aa, Artificial Sequence
  Description of Artificial Sequence: Synthetic peptide
  Seed: SFFSYTLASL (MAGC1_HUMAN)
SYFSYTLASM

SEQ ID NO: 79398 - protein, 9 aa, Artificial Sequence
  Description of Artificial Sequence: Synthetic peptide
  Seed: LQIPVSAAS (MAGC1_HUMAN)
LIIPVSAAM

SEQ ID NO: 79399 - protein, 10 aa, Artificial Sequence
  Description of Artificial Sequence: Synthetic peptide
  Seed: FFSYTLASLL (MAGC1_HUMAN)
FASYTLASLM

SEQ ID NO: 79400 - protein, 9 aa, Artificial Sequence
  Description of Artificial Sequence: Synthetic peptide
  Seed: KQPITKAEM (MAGC1_HUMAN)
KRPITKAEY

SEQ ID NO: 79401 - protein, 9 aa, Artificial Sequence
  Description of Artificial Sequence: Synthetic peptide
  Seed: EDSMSPLYF (MAGC1_HUMAN)
EESMSPLYF

SEQ ID NO: 79402 - protein, 9 aa, Artificial Sequence
  Description of Artificial Sequence: Synthetic peptide
  Seed: MLTNVISRY (MAGC1_HUMAN)
MMTNVISRL

SEQ ID NO: 79403 - protein, 9 aa, Artificial Sequence
  Description of Artificial Sequence: Synthetic peptide
  Seed: SSSTLLSLF (MAGC1_HUMAN)
SMSTLLSLW

SEQ ID NO: 79404 - protein, 10 aa, Artificial Sequence
  Description of Artificial Sequence: Synthetic peptide
  Seed: SLFQSFSERT (MAGC1_HUMAN)
SAFQSFSERR

SEQ ID NO: 79405 - protein, 10 aa, Artificial Sequence
  Description of Artificial Sequence: Synthetic peptide
  Seed: LQIPVSRSFS (MAGC1_HUMAN)
LQIPVSRSFT

SEQ ID NO: 79406 - protein, 9 aa, Artificial Sequence
  Description of Artificial Sequence: Synthetic peptide
  Seed: EFIEILFGI (MAGC1_HUMAN)
ENIEILFGI

SEQ ID NO: 79407 - protein, 9 aa, Artificial Sequence
  Description of Artificial Sequence: Synthetic peptide
  Seed: LKYQVKQPI (MAGC1_HUMAN)
LQYQVKQPV

SEQ ID NO: 79408 - protein, 9 aa, Artificial Sequence
  Description of Artificial Sequence: Synthetic peptide
  Seed: VSSFFSYTL (MAGC1_HUMAN)
VMSFFSYTY

SEQ ID NO: 79409 - protein, 9 aa, Artificial Sequence
  Description of Artificial Sequence: Synthetic peptide
  Seed: AQSSLQIPV (MAGC1_HUMAN)
AQSSLQIPL

SEQ ID NO: 79410 - protein, 9 aa, Artificial Sequence
  Description of Artificial Sequence: Synthetic peptide
  Seed: SSSTLLSLF (MAGC1_HUMAN)
SSSTLLSLI

SEQ ID NO: 79411 - protein, 9 aa, Artificial Sequence
  Description of Artificial Sequence: Synthetic peptide
  Seed: SPLQIVPSL (MAGC1_HUMAN)
STLQIVPSV

SEQ ID NO: 79412 - protein, 9 aa, Artificial Sequence
  Description of Artificial Sequence: Synthetic peptide
  Seed: MSQNRLLIL (MAGC1_HUMAN)
MQQNRLLIK

SEQ ID NO: 79413 - protein, 11 aa, Artificial Sequence
  Description of Artificial Sequence: Synthetic peptide
  Seed: IPMTSSFSSTL (MAGC1_HUMAN)
ICMTSSFSSTF

SEQ ID NO: 79414 - protein, 9 aa, Artificial Sequence
  Description of Artificial Sequence: Synthetic peptide
  Seed: FPSSTSSSL (MAGC1_HUMAN)
FASSTSSSH

SEQ ID NO: 79415 - protein, 10 aa, Artificial Sequence
  Description of Artificial Sequence: Synthetic peptide
  Seed: SFPSSTSSSL (MAGC1_HUMAN)
SRPSSTSSSF

SEQ ID NO: 79416 - protein, 11 aa, Artificial Sequence
  Description of Artificial Sequence: Synthetic peptide
  Seed: VDEYTSSSDTL (MAGC1_HUMAN)
VKEYTSSSDTF

SEQ ID NO: 79417 - protein, 10 aa, Artificial Sequence
  Description of Artificial Sequence: Synthetic peptide
  Seed: FFSYTLASLL (MAGC1_HUMAN)
FDSYTLASLF

SEQ ID NO: 79418 - protein, 9 aa, Artificial Sequence
  Description of Artificial Sequence: Synthetic peptide
  Seed: STFEGFPQS (MAGC1_HUMAN)
SPFEGFPQI

SEQ ID NO: 79419 - protein, 10 aa, Artificial Sequence
  Description of Artificial Sequence: Synthetic peptide
  Seed: FPQSLLQIPM (MAGC1_HUMAN)
FEQSLLQIPV

SEQ ID NO: 79420 - protein, 9 aa, Artificial Sequence
  Description of Artificial Sequence: Synthetic peptide
  Seed: FSSALLSIF (MAGC1_HUMAN)
FMSALLSIL

SEQ ID NO: 79421 - protein, 9 aa, Artificial Sequence
  Description of Artificial Sequence: Synthetic peptide
  Seed: RAHSEVIKR (MAGC1_HUMAN)
RAHSEVIKV

SEQ ID NO: 79422 - protein, 9 aa, Artificial Sequence
  Description of Artificial Sequence: Synthetic peptide
  Seed: TSLSLPQSF (MAGC1_HUMAN)
TFLSLPQSF

SEQ ID NO: 79423 - protein, 10 aa, Artificial Sequence
  Description of Artificial Sequence: Synthetic peptide
  Seed: FFSYTLASLL (MAGC1_HUMAN)
FGSYTLASLF

SEQ ID NO: 79424 - protein, 9 aa, Artificial Sequence
  Description of Artificial Sequence: Synthetic peptide
  Seed: MTSSFSSTL (MAGC1_HUMAN)
MCSSFSSTY

SEQ ID NO: 79425 - protein, 9 aa, Artificial Sequence
  Description of Artificial Sequence: Synthetic peptide
  Seed: LQNPASSFF (MAGC1_HUMAN)
LQNPASSFI

SEQ ID NO: 79426 - protein, 9 aa, Artificial Sequence
  Description of Artificial Sequence: Synthetic peptide
  Seed: SSSSSSSTL (MAGC1_HUMAN)
SKSSSSSTY

SEQ ID NO: 79427 - protein, 9 aa, Artificial Sequence
  Description of Artificial Sequence: Synthetic peptide
  Seed: IPVSSSFSY (MAGC1_HUMAN)
IQVSSSFSY

SEQ ID NO: 79428 - protein, 10 aa, Artificial Sequence
  Description of Artificial Sequence: Synthetic peptide
  Seed: WVQEHYLEYR (MAGC1_HUMAN)
WSQEHYLEYR

SEQ ID NO: 79429 - protein, 10 aa, Artificial Sequence
  Description of Artificial Sequence: Synthetic peptide
  Seed: LQIPGSPSFS (MAGC1_HUMAN)
LSIPGSPSFF

SEQ ID NO: 79430 - protein, 11 aa, Artificial Sequence
  Description of Artificial Sequence: Synthetic peptide
  Seed: RSFSSTLLSIF (MAGC1_HUMAN)
RYFSSTLLSIY

SEQ ID NO: 79431 - protein, 9 aa, Artificial Sequence
  Description of Artificial Sequence: Synthetic peptide
  Seed: FLWGPRAHS (MAGC1_HUMAN)
FLWGPRAHL

SEQ ID NO: 79432 - protein, 10 aa, Artificial Sequence
  Description of Artificial Sequence: Synthetic peptide
  Seed: FPQSLLQIPM (MAGC1_HUMAN)
FKQSLLQIPV

SEQ ID NO: 79433 - protein, 9 aa, Artificial Sequence
  Description of Artificial Sequence: Synthetic peptide
  Seed: FFSYTLASL (MAGC1_HUMAN)
FWSYTLASI

SEQ ID NO: 79434 - protein, 10 aa, Artificial Sequence
  Description of Artificial Sequence: Synthetic peptide
  Seed: FFSYTLASLL (MAGC1_HUMAN)
FESYTLASLW

SEQ ID NO: 79435 - protein, 10 aa, Artificial Sequence
  Description of Artificial Sequence: Synthetic peptide
  Seed: NTVPITFPSS (MAGC1_HUMAN)
NTVPITFPSA

SEQ ID NO: 79436 - protein, 9 aa, Artificial Sequence
  Description of Artificial Sequence: Synthetic peptide
  Seed: GFPQSVLQI (MAGC1_HUMAN)
GFPQSVLQY

SEQ ID NO: 79437 - protein, 9 aa, Artificial Sequence
  Description of Artificial Sequence: Synthetic peptide
  Seed: RLLILILSI (MAGC1_HUMAN)
RILILILSI

SEQ ID NO: 79438 - protein, 9 aa, Artificial Sequence
  Description of Artificial Sequence: Synthetic peptide
  Seed: FPSSTSSSL (MAGC1_HUMAN)
FCSSTSSSY

SEQ ID NO: 79439 - protein, 9 aa, Artificial Sequence
  Description of Artificial Sequence: Synthetic peptide
  Seed: TSLSLPQSF (MAGC1_HUMAN)
TLLSLPQSI

SEQ ID NO: 79440 - protein, 9 aa, Artificial Sequence
  Description of Artificial Sequence: Synthetic peptide
  Seed: FFSSALLSI (MAGC1_HUMAN)
FASSALLSM

SEQ ID NO: 79441 - protein, 10 aa, Artificial Sequence
  Description of Artificial Sequence: Synthetic peptide
  Seed: MLKNTVPITF (MAGC1_HUMAN)
MCKNTVPITW

SEQ ID NO: 79442 - protein, 10 aa, Artificial Sequence
  Description of Artificial Sequence: Synthetic peptide
  Seed: RAGREHFAFG (MAGC1_HUMAN)
RFGREHFAFA

SEQ ID NO: 79443 - protein, 11 aa, Artificial Sequence
  Description of Artificial Sequence: Synthetic peptide
  Seed: SSFPSSTSSSL (MAGC1_HUMAN)
SRFPSSTSSSM

SEQ ID NO: 79444 - protein, 9 aa, Artificial Sequence
  Description of Artificial Sequence: Synthetic peptide
  Seed: TLLSILQSS (MAGC1_HUMAN)
TILSILQSA

SEQ ID NO: 79445 - protein, 9 aa, Artificial Sequence
  Description of Artificial Sequence: Synthetic peptide
  Seed: TFEGFPQSL (MAGC1_HUMAN)
TWEGFPQSV

SEQ ID NO: 79446 - protein, 9 aa, Artificial Sequence
  Description of Artificial Sequence: Synthetic peptide
  Seed: LSDEQGMSQ (MAGC1_HUMAN)
LTDEQGMSA

SEQ ID NO: 79447 - protein, 10 aa, Artificial Sequence
  Description of Artificial Sequence: Synthetic peptide
  Seed: LQIPGSPSFS (MAGC1_HUMAN)
LQIPGSPSFD

SEQ ID NO: 79448 - protein, 9 aa, Artificial Sequence
  Description of Artificial Sequence: Synthetic peptide
  Seed: YVFVNTLDL (MAGC1_HUMAN)
YQFVNTLDV

SEQ ID NO: 79449 - protein, 9 aa, Artificial Sequence
  Description of Artificial Sequence: Synthetic peptide
  Seed: AASSSTLVS (MAGC1_HUMAN)
AVSSSTLVM

SEQ ID NO: 79450 - protein, 9 aa, Artificial Sequence
  Description of Artificial Sequence: Synthetic peptide
  Seed: MLKNTVPIT (MAGC1_HUMAN)
MLKNTVPIL

SEQ ID NO: 79451 - protein, 10 aa, Artificial Sequence
  Description of Artificial Sequence: Synthetic peptide
  Seed: LIESEPLFTY (MAGC1_HUMAN)
LMESEPLFTY

SEQ ID NO: 79452 - protein, 9 aa, Artificial Sequence
  Description of Artificial Sequence: Synthetic peptide
  Seed: SSPEGKDSL (MAGC1_HUMAN)
SMPEGKDSI

SEQ ID NO: 79453 - protein, 9 aa, Artificial Sequence
  Description of Artificial Sequence: Synthetic peptide
  Seed: MSQNRLLIL (MAGC1_HUMAN)
MAQNRLLIM

SEQ ID NO: 79454 - protein, 9 aa, Artificial Sequence
  Description of Artificial Sequence: Synthetic peptide
  Seed: QVKQPITKA (MAGC1_HUMAN)
QVKQPITKK

SEQ ID NO: 79455 - protein, 9 aa, Artificial Sequence
  Description of Artificial Sequence: Synthetic peptide
  Seed: VPITFPSSY (MAGC1_HUMAN)
VGITFPSSY

SEQ ID NO: 79456 - protein, 8 aa, Artificial Sequence
  Description of Artificial Sequence: Synthetic peptide
  Seed: EDSLSPHY (MAGC1_HUMAN)
EESLSPHY

SEQ ID NO: 79457 - protein, 11 aa, Artificial Sequence
  Description of Artificial Sequence: Synthetic peptide
  Seed: SQSSPEGKDSL (MAGC1_HUMAN)
SESSPEGKDSL

SEQ ID NO: 79458 - protein, 9 aa, Artificial Sequence
  Description of Artificial Sequence: Synthetic peptide
  Seed: TLDEKVDEL (MAGC1_HUMAN)
TADEKVDEV

SEQ ID NO: 79459 - protein, 10 aa, Artificial Sequence
  Description of Artificial Sequence: Synthetic peptide
  Seed: SSFSYTLLSL (MAGC1_HUMAN)
SWFSYTLLSM

SEQ ID NO: 79460 - protein, 11 aa, Artificial Sequence
  Description of Artificial Sequence: Synthetic peptide
  Seed: SLREVDPDDSY (MAGC1_HUMAN)
SMREVDPDDSY

SEQ ID NO: 79461 - protein, 9 aa, Artificial Sequence
  Description of Artificial Sequence: Synthetic peptide
  Seed: AMLKNTVPI (MAGC1_HUMAN)
AELKNTVPY

SEQ ID NO: 79462 - protein, 9 aa, Artificial Sequence
  Description of Artificial Sequence: Synthetic peptide
  Seed: SPLQRPVSS (MAGC1_HUMAN)
SMLQRPVSI

SEQ ID NO: 79463 - protein, 9 aa, Artificial Sequence
  Description of Artificial Sequence: Synthetic peptide
  Seed: SSFFSYTLA (MAGC1_HUMAN)
SFFFSYTLK

SEQ ID NO: 79464 - protein, 9 aa, Artificial Sequence
  Description of Artificial Sequence: Synthetic peptide
  Seed: TLDEKVDEL (MAGC1_HUMAN)
TMDEKVDEW

SEQ ID NO: 79465 - protein, 10 aa, Artificial Sequence
  Description of Artificial Sequence: Synthetic peptide
  Seed: MPTAGMPSLL (MAGC1_HUMAN)
MFTAGMPSLY

SEQ ID NO: 79466 - protein, 10 aa, Artificial Sequence
  Description of Artificial Sequence: Synthetic peptide
  Seed: LILILSIIFI (MAGC1_HUMAN)
LMLILSIIFV

SEQ ID NO: 79467 - protein, 9 aa, Artificial Sequence
  Description of Artificial Sequence: Synthetic peptide
  Seed: LQRPVSSFF (MAGC1_HUMAN)
LTRPVSSFS

SEQ ID NO: 79468 - protein, 10 aa, Artificial Sequence
  Description of Artificial Sequence: Synthetic peptide
  Seed: VKQPITKAEM (MAGC1_HUMAN)
VMQPITKAEY

SEQ ID NO: 79469 - protein, 11 aa, Artificial Sequence
  Description of Artificial Sequence: Synthetic peptide
  Seed: RSFSSTLLSIF (MAGC1_HUMAN)
RQFSSTLLSIW

SEQ ID NO: 79470 - protein, 11 aa, Artificial Sequence
  Description of Artificial Sequence: Synthetic peptide
  Seed: FPSSTSSSLSK (MAGC1_HUMAN)
FSSSTSSSLSL

SEQ ID NO: 79471 - protein, 9 aa, Artificial Sequence
  Description of Artificial Sequence: Synthetic peptide
  Seed: AQSPLQIPV (MAGC1_HUMAN)
ATSPLQIPV

SEQ ID NO: 79472 - protein, 10 aa, Artificial Sequence
  Description of Artificial Sequence: Synthetic peptide
  Seed: KDVEERAQAI (MAGC1_HUMAN)
KEVEERAQAV

SEQ ID NO: 79473 - protein, 9 aa, Artificial Sequence
  Description of Artificial Sequence: Synthetic peptide
  Seed: KVVEFLAML (MAGC1_HUMAN)
KTVEFLAMK

SEQ ID NO: 79474 - protein, 10 aa, Artificial Sequence
  Description of Artificial Sequence: Synthetic peptide
  Seed: TLDEKVDELA (MAGC1_HUMAN)
TADEKVDELL

SEQ ID NO: 79475 - protein, 10 aa, Artificial Sequence
  Description of Artificial Sequence: Synthetic peptide
  Seed: MTSSFSSTLL (MAGC1_HUMAN)
MWSSFSSTLF

SEQ ID NO: 79476 - protein, 9 aa, Artificial Sequence
  Description of Artificial Sequence: Synthetic peptide
  Seed: FPSSTSSSL (MAGC1_HUMAN)
FMSSTSSSV

SEQ ID NO: 79477 - protein, 11 aa, Artificial Sequence
  Description of Artificial Sequence: Synthetic peptide
  Seed: IPMTSSFSSTL (MAGC1_HUMAN)
IHMTSSFSSTW

SEQ ID NO: 79478 - protein, 9 aa, Artificial Sequence
  Description of Artificial Sequence: Synthetic peptide
  Seed: IPVSSSFSY (MAGC1_HUMAN)
IAVSSSFSF

SEQ ID NO: 79479 - protein, 10 aa, Artificial Sequence
  Description of Artificial Sequence: Synthetic peptide
  Seed: AASSSTLVSI (MAGC1_HUMAN)
AMSSSTLVSM

SEQ ID NO: 79480 - protein, 9 aa, Artificial Sequence
  Description of Artificial Sequence: Synthetic peptide
  Seed: RKAREFIEI (MAGC1_HUMAN)
RAAREFIEF

SEQ ID NO: 79481 - protein, 9 aa, Artificial Sequence
  Description of Artificial Sequence: Synthetic peptide
  Seed: FSYTLLSLF (MAGC1_HUMAN)
FYYTLLSLL

SEQ ID NO: 79482 - protein, 9 aa, Artificial Sequence
  Description of Artificial Sequence: Synthetic peptide
  Seed: SSFFSYTLA (MAGC1_HUMAN)
SAFFSYTLI

SEQ ID NO: 79483 - protein, 10 aa, Artificial Sequence
  Description of Artificial Sequence: Synthetic peptide
  Seed: YVFVNTLDLT (MAGC1_HUMAN)
YTFVNTLDLL

SEQ ID NO: 79484 - protein, 10 aa, Artificial Sequence
  Description of Artificial Sequence: Synthetic peptide
  Seed: FAFGEPRELL (MAGC1_HUMAN)
FTFGEPRELF

SEQ ID NO: 79485 - protein, 9 aa, Artificial Sequence
  Description of Artificial Sequence: Synthetic peptide
  Seed: VIFRKAREF (MAGC1_HUMAN)
VAFRKAREW

SEQ ID NO: 79486 - protein, 10 aa, Artificial Sequence
  Description of Artificial Sequence: Synthetic peptide
  Seed: REFIEILFGI (MAGC1_HUMAN)
RYFIEILFGI

SEQ ID NO: 79487 - protein, 9 aa, Artificial Sequence
  Description of Artificial Sequence: Synthetic peptide
  Seed: CSSSTSLSL (MAGC1_HUMAN)
CMSSTSLSL

SEQ ID NO: 79488 - protein, 11 aa, Artificial Sequence
  Description of Artificial Sequence: Synthetic peptide
  Seed: LQIPVSSSFSY (MAGC1_HUMAN)
LDIPVSSSFSY

SEQ ID NO: 79489 - protein, 10 aa, Artificial Sequence
  Description of Artificial Sequence: Synthetic peptide
  Seed: VISFSSSTSL (MAGC1_HUMAN)
VNSFSSSTSM

SEQ ID NO: 79490 - protein, 9 aa, Artificial Sequence
  Description of Artificial Sequence: Synthetic peptide
  Seed: IPMTSSFSS (MAGC1_HUMAN)
ISMTSSFSY

SEQ ID NO: 79491 - protein, 11 aa, Artificial Sequence
  Description of Artificial Sequence: Synthetic peptide
  Seed: SFFSSALLSIF (MAGC1_HUMAN)
SGFSSALLSIW

SEQ ID NO: 79492 - protein, 8 aa, Artificial Sequence
  Description of Artificial Sequence: Synthetic peptide
  Seed: IWDVLSGI (MAGC1_HUMAN)
IGDVLSGL

SEQ ID NO: 79493 - protein, 8 aa, Artificial Sequence
  Description of Artificial Sequence: Synthetic peptide
  Seed: FSSTLVSL (MAGC1_HUMAN)
FSSTLVSY

SEQ ID NO: 79494 - protein, 9 aa, Artificial Sequence
  Description of Artificial Sequence: Synthetic peptide
  Seed: VPITFPSSY (MAGC1_HUMAN)
VQITFPSSH

SEQ ID NO: 79495 - protein, 9 aa, Artificial Sequence
  Description of Artificial Sequence: Synthetic peptide
  Seed: SLPQSFPES (MAGC1_HUMAN)
SLPQSFPEA

SEQ ID NO: 79496 - protein, 10 aa, Artificial Sequence
  Description of Artificial Sequence: Synthetic peptide
  Seed: MSQNRLLILI (MAGC1_HUMAN)
MTQNRLLILY

SEQ ID NO: 79497 - protein, 9 aa, Artificial Sequence
  Description of Artificial Sequence: Synthetic peptide
  Seed: TTDDSTATE (MAGC1_HUMAN)
TMDDSTATF

SEQ ID NO: 79498 - protein, 10 aa, Artificial Sequence
  Description of Artificial Sequence: Synthetic peptide
  Seed: ISRYTGYFPV (MAGC1_HUMAN)
IPRYTGYFPL

SEQ ID NO: 79499 - protein, 9 aa, Artificial Sequence
  Description of Artificial Sequence: Synthetic peptide
  Seed: LLSLFQSFS (MAGC1_HUMAN)
LQSLFQSFL

SEQ ID NO: 79500 - protein, 10 aa, Artificial Sequence
  Description of Artificial Sequence: Synthetic peptide
  Seed: MTSSFSSTLL (MAGC1_HUMAN)
MESSFSSTLF

SEQ ID NO: 79501 - protein, 10 aa, Artificial Sequence
  Description of Artificial Sequence: Synthetic peptide
  Seed: TTDDSTATES (MAGC1_HUMAN)
TNDDSTATEL

SEQ ID NO: 79502 - protein, 10 aa, Artificial Sequence
  Description of Artificial Sequence: Synthetic peptide
  Seed: ICSSSTPSSL (MAGC1_HUMAN)
IPSSSTPSSF

SEQ ID NO: 79503 - protein, 10 aa, Artificial Sequence
  Description of Artificial Sequence: Synthetic peptide
  Seed: MPTAGMPSLL (MAGC1_HUMAN)
MKTAGMPSLI

SEQ ID NO: 79504 - protein, 9 aa, Artificial Sequence
  Description of Artificial Sequence: Synthetic peptide
  Seed: RLLILILSI (MAGC1_HUMAN)
RQLILILSW

SEQ ID NO: 79505 - protein, 11 aa, Artificial Sequence
  Description of Artificial Sequence: Synthetic peptide
  Seed: STFEGFAQSPL (MAGC1_HUMAN)
SIFEGFAQSPL

SEQ ID NO: 79506 - protein, 9 aa, Artificial Sequence
  Description of Artificial Sequence: Synthetic peptide
  Seed: SSPERTQST (MAGC1_HUMAN)
STPERTQSI

SEQ ID NO: 79507 - protein, 9 aa, Artificial Sequence
  Description of Artificial Sequence: Synthetic peptide
  Seed: LQIPVSSSS (MAGC1_HUMAN)
LFIPVSSSL

SEQ ID NO: 79508 - protein, 10 aa, Artificial Sequence
  Description of Artificial Sequence: Synthetic peptide
  Seed: MSQNRLLILI (MAGC1_HUMAN)
MMQNRLLILA

SEQ ID NO: 79509 - protein, 10 aa, Artificial Sequence
  Description of Artificial Sequence: Synthetic peptide
  Seed: SSFSYTLLSL (MAGC1_HUMAN)
SQFSYTLLSV

SEQ ID NO: 79510 - protein, 10 aa, Artificial Sequence
  Description of Artificial Sequence: Synthetic peptide
  Seed: PLQIPVSSSF (MAGC1_HUMAN)
PNQIPVSSSF

SEQ ID NO: 79511 - protein, 10 aa, Artificial Sequence
  Description of Artificial Sequence: Synthetic peptide
  Seed: MLKNTVPITF (MAGC1_HUMAN)
MNKNTVPITY

SEQ ID NO: 79512 - protein, 10 aa, Artificial Sequence
  Description of Artificial Sequence: Synthetic peptide
  Seed: FPQSPLQIPV (MAGC1_HUMAN)
FSQSPLQIPL

SEQ ID NO: 79513 - protein, 10 aa, Artificial Sequence
  Description of Artificial Sequence: Synthetic peptide
  Seed: MTSSFSSTLL (MAGC1_HUMAN)
MCSSFSSTLM

SEQ ID NO: 79514 - protein, 10 aa, Artificial Sequence
  Description of Artificial Sequence: Synthetic peptide
  Seed: SSSSSTLLSL (MAGC1_HUMAN)
SSSSSTLLSW

SEQ ID NO: 79515 - protein, 10 aa, Artificial Sequence
  Description of Artificial Sequence: Synthetic peptide
  Seed: FPQSVLQIPV (MAGC1_HUMAN)
FLQSVLQIPM

SEQ ID NO: 79516 - protein, 9 aa, Artificial Sequence
  Description of Artificial Sequence: Synthetic peptide
  Seed: EFIEILFGI (MAGC1_HUMAN)
ELIEILFGL

SEQ ID NO: 79517 - protein, 10 aa, Artificial Sequence
  Description of Artificial Sequence: Synthetic peptide
  Seed: FFSYTLASLL (MAGC1_HUMAN)
FSSYTLASLI

SEQ ID NO: 79518 - protein, 11 aa, Artificial Sequence
  Description of Artificial Sequence: Synthetic peptide
  Seed: KRKVVEFLAML (MAGC1_HUMAN)
KLKVVEFLAMI

SEQ ID NO: 79519 - protein, 11 aa, Artificial Sequence
  Description of Artificial Sequence: Synthetic peptide
  Seed: IPVSSSSSSTL (MAGC1_HUMAN)
ISVSSSSSSTW

SEQ ID NO: 79520 - protein, 9 aa, Artificial Sequence
  Description of Artificial Sequence: Synthetic peptide
  Seed: TTDDSTATE (MAGC1_HUMAN)
TNDDSTATF

SEQ ID NO: 79521 - protein, 9 aa, Artificial Sequence
  Description of Artificial Sequence: Synthetic peptide
  Seed: LQIPVSPSF (MAGC1_HUMAN)
LIIPVSPSM

SEQ ID NO: 79522 - protein, 9 aa, Artificial Sequence
  Description of Artificial Sequence: Synthetic peptide
  Seed: SSSTLVSIF (MAGC1_HUMAN)
SASTLVSIF

SEQ ID NO: 79523 - protein, 9 aa, Artificial Sequence
  Description of Artificial Sequence: Synthetic peptide
  Seed: SSLSQSSPV (MAGC1_HUMAN)
SILSQSSPI

SEQ ID NO: 79524 - protein, 9 aa, Artificial Sequence
  Description of Artificial Sequence: Synthetic peptide
  Seed: RAGREHFAF (MAGC1_HUMAN)
RIGREHFAY

SEQ ID NO: 79525 - protein, 10 aa, Artificial Sequence
  Description of Artificial Sequence: Synthetic peptide
  Seed: NPASSFFSSA (MAGC1_HUMAN)
NEASSFFSSV

SEQ ID NO: 79526 - protein, 10 aa, Artificial Sequence
  Description of Artificial Sequence: Synthetic peptide
  Seed: VSSSSSSTLL (MAGC1_HUMAN)
VNSSSSSTLF

SEQ ID NO: 79527 - protein, 9 aa, Artificial Sequence
  Description of Artificial Sequence: Synthetic peptide
  Seed: MLTNVISRY (MAGC1_HUMAN)
MKTNVISRM

SEQ ID NO: 79528 - protein, 10 aa, Artificial Sequence
  Description of Artificial Sequence: Synthetic peptide
  Seed: ISRYTGYFPV (MAGC1_HUMAN)
IDRYTGYFPF

SEQ ID NO: 79529 - protein, 9 aa, Artificial Sequence
  Description of Artificial Sequence: Synthetic peptide
  Seed: LQIPVSPSF (MAGC1_HUMAN)
LLIPVSPST

SEQ ID NO: 79530 - protein, 9 aa, Artificial Sequence
  Description of Artificial Sequence: Synthetic peptide
  Seed: LQIPVSPSF (MAGC1_HUMAN)
LQIPVSPSW

SEQ ID NO: 79531 - protein, 9 aa, Artificial Sequence
  Description of Artificial Sequence: Synthetic peptide
  Seed: IESEPLFTY (MAGC1_HUMAN)
IQSEPLFTY

SEQ ID NO: 79532 - protein, 11 aa, Artificial Sequence
  Description of Artificial Sequence: Synthetic peptide
  Seed: QSSPESDDTLY (MAGC1_HUMAN)
QVSPESDDTLY

SEQ ID NO: 79533 - protein, 8 aa, Artificial Sequence
  Description of Artificial Sequence: Synthetic peptide
  Seed: LQIPQSPL (MAGC1_HUMAN)
LKIPQSPF

SEQ ID NO: 79534 - protein, 8 aa, Artificial Sequence
  Description of Artificial Sequence: Synthetic peptide
  Seed: SSFFSSAL (MAGC1_HUMAN)
SKFFSSAM

SEQ ID NO: 79535 - protein, 10 aa, Artificial Sequence
  Description of Artificial Sequence: Synthetic peptide
  Seed: FAFGEPRELL (MAGC1_HUMAN)
FLFGEPRELA

SEQ ID NO: 79536 - protein, 10 aa, Artificial Sequence
  Description of Artificial Sequence: Synthetic peptide
  Seed: STPSSLPQSF (MAGC1_HUMAN)
SMPSSLPQSV

SEQ ID NO: 79537 - protein, 9 aa, Artificial Sequence
  Description of Artificial Sequence: Synthetic peptide
  Seed: VPNSSPPRY (MAGC1_HUMAN)
VMNSSPPRF

SEQ ID NO: 79538 - protein, 9 aa, Artificial Sequence
  Description of Artificial Sequence: Synthetic peptide
  Seed: IPVSAASSS (MAGC1_HUMAN)
IVVSAASSY

SEQ ID NO: 79539 - protein, 9 aa, Artificial Sequence
  Description of Artificial Sequence: Synthetic peptide
  Seed: LQIPVSPSF (MAGC1_HUMAN)
LVIPVSPSY

SEQ ID NO: 79540 - protein, 10 aa, Artificial Sequence
  Description of Artificial Sequence: Synthetic peptide
  Seed: SSFSYTLLSL (MAGC1_HUMAN)
SMFSYTLLSF

SEQ ID NO: 79541 - protein, 8 aa, Artificial Sequence
  Description of Artificial Sequence: Synthetic peptide
  Seed: SSVMSPSF (MAGC1_HUMAN)
SQVMSPSM

SEQ ID NO: 79542 - protein, 10 aa, Artificial Sequence
  Description of Artificial Sequence: Synthetic peptide
  Seed: LQIPVSPSFS (MAGC1_HUMAN)
LQIPVSPSFW

SEQ ID NO: 79543 - protein, 9 aa, Artificial Sequence
  Description of Artificial Sequence: Synthetic peptide
  Seed: LQRPVSSFF (MAGC1_HUMAN)
LKRPVSSFF

SEQ ID NO: 79544 - protein, 10 aa, Artificial Sequence
  Description of Artificial Sequence: Synthetic peptide
  Seed: RAGREHFAFG (MAGC1_HUMAN)
RQGREHFAFY

SEQ ID NO: 79545 - protein, 11 aa, Artificial Sequence
  Description of Artificial Sequence: Synthetic peptide
  Seed: SPLQIPVSSSS (MAGC1_HUMAN)
SKLQIPVSSSY

SEQ ID NO: 79546 - protein, 10 aa, Artificial Sequence
  Description of Artificial Sequence: Synthetic peptide
  Seed: KVVEFLAMLK (MAGC1_HUMAN)
KCVEFLAMLK

SEQ ID NO: 79547 - protein, 9 aa, Artificial Sequence
  Description of Artificial Sequence: Synthetic peptide
  Seed: SPLEISQSP (MAGC1_HUMAN)
SPLEISQSF

SEQ ID NO: 79548 - protein, 10 aa, Artificial Sequence
  Description of Artificial Sequence: Synthetic peptide
  Seed: MSQNRLLILI (MAGC1_HUMAN)
MSQNRLLILV

SEQ ID NO: 79549 - protein, 8 aa, Artificial Sequence
  Description of Artificial Sequence: Synthetic peptide
  Seed: LQNPASSF (MAGC1_HUMAN)
LQNPASSY

SEQ ID NO: 79550 - protein, 10 aa, Artificial Sequence
  Description of Artificial Sequence: Synthetic peptide
  Seed: VSRSFSSTLL (MAGC1_HUMAN)
VTRSFSSTLW

SEQ ID NO: 79551 - protein, 10 aa, Artificial Sequence
  Description of Artificial Sequence: Synthetic peptide
  Seed: FSSSTSLSPF (MAGC1_HUMAN)
FISSTSLSPM

SEQ ID NO: 79552 - protein, 11 aa, Artificial Sequence
  Description of Artificial Sequence: Synthetic peptide
  Seed: IPMTSSFSSTL (MAGC1_HUMAN)
ITMTSSFSSTL

SEQ ID NO: 79553 - protein, 10 aa, Artificial Sequence
  Description of Artificial Sequence: Synthetic peptide
  Seed: GEDSLSPHYF (MAGC1_HUMAN)
GEDSLSPHYV

SEQ ID NO: 79554 - protein, 8 aa, Artificial Sequence
  Description of Artificial Sequence: Synthetic peptide
  Seed: AFGEPREL (MAGC1_HUMAN)
AAGEPREY

SEQ ID NO: 79555 - protein, 9 aa, Artificial Sequence
  Description of Artificial Sequence: Synthetic peptide
  Seed: GFPQSLLQI (MAGC1_HUMAN)
GTPQSLLQL

SEQ ID NO: 79556 - protein, 9 aa, Artificial Sequence
  Description of Artificial Sequence: Synthetic peptide
  Seed: LLSLFQSFS (MAGC1_HUMAN)
LISLFQSFL

SEQ ID NO: 79557 - protein, 11 aa, Artificial Sequence
  Description of Artificial Sequence: Synthetic peptide
  Seed: LQIPVSSSFSY (MAGC1_HUMAN)
LRIPVSSSFSF

SEQ ID NO: 79558 - protein, 9 aa, Artificial Sequence
  Description of Artificial Sequence: Synthetic peptide
  Seed: FAQSPLQIP (MAGC1_HUMAN)
FPQSPLQIY

SEQ ID NO: 79559 - protein, 9 aa, Artificial Sequence
  Description of Artificial Sequence: Synthetic peptide
  Seed: FSSTLVSLF (MAGC1_HUMAN)
FPSTLVSLL

SEQ ID NO: 79560 - protein, 10 aa, Artificial Sequence
  Description of Artificial Sequence: Synthetic peptide
  Seed: FPQSLLQIPM (MAGC1_HUMAN)
FMQSLLQIPF

SEQ ID NO: 79561 - protein, 9 aa, Artificial Sequence
  Description of Artificial Sequence: Synthetic peptide
  Seed: KVDELARFL (MAGC1_HUMAN)
KGDELARFM

SEQ ID NO: 79562 - protein, 9 aa, Artificial Sequence
  Description of Artificial Sequence: Synthetic peptide
  Seed: TLLSIFQSS (MAGC1_HUMAN)
TQLSIFQSL

SEQ ID NO: 79563 - protein, 10 aa, Artificial Sequence
  Description of Artificial Sequence: Synthetic peptide
  Seed: LHFPQSPPEW (MAGC1_HUMAN)
LHFPQSPPEI

SEQ ID NO: 79564 - protein, 10 aa, Artificial Sequence
  Description of Artificial Sequence: Synthetic peptide
  Seed: ASSFFSSALL (MAGC1_HUMAN)
AESFFSSALW

SEQ ID NO: 79565 - protein, 9 aa, Artificial Sequence
  Description of Artificial Sequence: Synthetic peptide
  Seed: MTSSFSSTL (MAGC1_HUMAN)
MNSSFSSTW

SEQ ID NO: 79566 - protein, 9 aa, Artificial Sequence
  Description of Artificial Sequence: Synthetic peptide
  Seed: LQIVPSLPE (MAGC1_HUMAN)
LKIVPSLPM

SEQ ID NO: 79567 - protein, 11 aa, Artificial Sequence
  Description of Artificial Sequence: Synthetic peptide
  Seed: TVPITFPSSYK (MAGC1_HUMAN)
TYPITFPSSYR

SEQ ID NO: 79568 - protein, 10 aa, Artificial Sequence
  Description of Artificial Sequence: Synthetic peptide
  Seed: SPLQRPVSSF (MAGC1_HUMAN)
SPLQRPVSSV

SEQ ID NO: 79569 - protein, 9 aa, Artificial Sequence
  Description of Artificial Sequence: Synthetic peptide
  Seed: SSPECTQST (MAGC1_HUMAN)
SGPECTQSF

SEQ ID NO: 79570 - protein, 9 aa, Artificial Sequence
  Description of Artificial Sequence: Synthetic peptide
  Seed: SICSSSTSL (MAGC1_HUMAN)
SACSSSTSV

SEQ ID NO: 79571 - protein, 9 aa, Artificial Sequence
  Description of Artificial Sequence: Synthetic peptide
  Seed: SSFFSYTLA (MAGC1_HUMAN)
STFFSYTLI

SEQ ID NO: 79572 - protein, 9 aa, Artificial Sequence
  Description of Artificial Sequence: Synthetic peptide
  Seed: AQSPLQRPV (MAGC1_HUMAN)
AASPLQRPV

SEQ ID NO: 79573 - protein, 8 aa, Artificial Sequence
  Description of Artificial Sequence: Synthetic peptide
  Seed: IWDVLSGI (MAGC1_HUMAN)
ITDVLSGM

SEQ ID NO: 79574 - protein, 9 aa, Artificial Sequence
  Description of Artificial Sequence: Synthetic peptide
  Seed: SPLQIVPSL (MAGC1_HUMAN)
SRLQIVPSA

SEQ ID NO: 79575 - protein, 8 aa, Artificial Sequence
  Description of Artificial Sequence: Synthetic peptide
  Seed: FIEILFGI (MAGC1_HUMAN)
FLEILFGV

SEQ ID NO: 79576 - protein, 9 aa, Artificial Sequence
  Description of Artificial Sequence: Synthetic peptide
  Seed: VSRSFSSTL (MAGC1_HUMAN)
VTRSFSSTL

SEQ ID NO: 79577 - protein, 9 aa, Artificial Sequence
  Description of Artificial Sequence: Synthetic peptide
  Seed: ISRYTGYFP (MAGC1_HUMAN)
ITRYTGYFV

SEQ ID NO: 79578 - protein, 11 aa, Artificial Sequence
  Description of Artificial Sequence: Synthetic peptide
  Seed: SPLQIPVSPSS (MAGC1_HUMAN)
SRLQIPVSPSY

SEQ ID NO: 79579 - protein, 10 aa, Artificial Sequence
  Description of Artificial Sequence: Synthetic peptide
  Seed: STPSSLPQSF (MAGC1_HUMAN)
SYPSSLPQSL

SEQ ID NO: 79580 - protein, 10 aa, Artificial Sequence
  Description of Artificial Sequence: Synthetic peptide
  Seed: LQIPVSSSFS (MAGC1_HUMAN)
LAIPVSSSFY

SEQ ID NO: 79581 - protein, 9 aa, Artificial Sequence
  Description of Artificial Sequence: Synthetic peptide
  Seed: MGDKDMPTA (MAGC1_HUMAN)
MMDKDMPTL

SEQ ID NO: 79582 - protein, 9 aa, Artificial Sequence
  Description of Artificial Sequence: Synthetic peptide
  Seed: RAHSEVIKR (MAGC1_HUMAN)
RLHSEVIKY

SEQ ID NO: 79583 - protein, 10 aa, Artificial Sequence
  Description of Artificial Sequence: Synthetic peptide
  Seed: LQIPVSSSFS (MAGC1_HUMAN)
LMIPVSSSFP

SEQ ID NO: 79584 - protein, 9 aa, Artificial Sequence
  Description of Artificial Sequence: Synthetic peptide
  Seed: STFEGFPQS (MAGC1_HUMAN)
SMFEGFPQF

SEQ ID NO: 79585 - protein, 9 aa, Artificial Sequence
  Description of Artificial Sequence: Synthetic peptide
  Seed: GSPSFSSTL (MAGC1_HUMAN)
GVPSFSSTF

SEQ ID NO: 79586 - protein, 9 aa, Artificial Sequence
  Description of Artificial Sequence: Synthetic peptide
  Seed: FSSTLVSLF (MAGC1_HUMAN)
FLSTLVSLA

SEQ ID NO: 79587 - protein, 9 aa, Artificial Sequence
  Description of Artificial Sequence: Synthetic peptide
  Seed: GFPQSVLQI (MAGC1_HUMAN)
GGPQSVLQL

SEQ ID NO: 79588 - protein, 9 aa, Artificial Sequence
  Description of Artificial Sequence: Synthetic peptide
  Seed: IEILFGISL (MAGC1_HUMAN)
IGILFGISY

SEQ ID NO: 79589 - protein, 9 aa, Artificial Sequence
  Description of Artificial Sequence: Synthetic peptide
  Seed: SFFSYTLAS (MAGC1_HUMAN)
SAFSYTLAL

SEQ ID NO: 79590 - protein, 10 aa, Artificial Sequence
  Description of Artificial Sequence: Synthetic peptide
  Seed: SSSSSTLLSL (MAGC1_HUMAN)
SISSSTLLSL

SEQ ID NO: 79591 - protein, 10 aa, Artificial Sequence
  Description of Artificial Sequence: Synthetic peptide
  Seed: ICSSSTPSSL (MAGC1_HUMAN)
ITSSSTPSSW

SEQ ID NO: 79592 - protein, 9 aa, Artificial Sequence
  Description of Artificial Sequence: Synthetic peptide
  Seed: KAREFIEIL (MAGC1_HUMAN)
KTREFIEIF

SEQ ID NO: 79593 - protein, 9 aa, Artificial Sequence
  Description of Artificial Sequence: Synthetic peptide
  Seed: TSSFSSTLL (MAGC1_HUMAN)
TVSFSSTLW

SEQ ID NO: 79594 - protein, 11 aa, Artificial Sequence
  Description of Artificial Sequence: Synthetic peptide
  Seed: LQRPVSSFFSY (MAGC1_HUMAN)
LPRPVSSFFSY

SEQ ID NO: 79595 - protein, 11 aa, Artificial Sequence
  Description of Artificial Sequence: Synthetic peptide
  Seed: MSPLYFPQSPL (MAGC1_HUMAN)
MCPLYFPQSPV

SEQ ID NO: 79596 - protein, 11 aa, Artificial Sequence
  Description of Artificial Sequence: Synthetic peptide
  Seed: IPVSSSFSYTL (MAGC1_HUMAN)
ICVSSSFSYTW

SEQ ID NO: 79597 - protein, 10 aa, Artificial Sequence
  Description of Artificial Sequence: Synthetic peptide
  Seed: HSPLQIVPSL (MAGC1_HUMAN)
HTPLQIVPSF

SEQ ID NO: 79598 - protein, 11 aa, Artificial Sequence
  Description of Artificial Sequence: Synthetic peptide
  Seed: STFEGFAQSPL (MAGC1_HUMAN)
SMFEGFAQSPM

SEQ ID NO: 79599 - protein, 9 aa, Artificial Sequence
  Description of Artificial Sequence: Synthetic peptide
  Seed: SPLQIVPSL (MAGC1_HUMAN)
SALQIVPSA

SEQ ID NO: 79600 - protein, 10 aa, Artificial Sequence
  Description of Artificial Sequence: Synthetic peptide
  Seed: RAGREHFAFG (MAGC1_HUMAN)
RYGREHFAFV

SEQ ID NO: 79601 - protein, 9 aa, Artificial Sequence
  Description of Artificial Sequence: Synthetic peptide
  Seed: SVLQIPVSA (MAGC1_HUMAN)
SSLQIPVSL

SEQ ID NO: 79602 - protein, 9 aa, Artificial Sequence
  Description of Artificial Sequence: Synthetic peptide
  Seed: MPSLLQSSS (MAGC1_HUMAN)
MPSLLQSSF

SEQ ID NO: 79603 - protein, 11 aa, Artificial Sequence
  Description of Artificial Sequence: Synthetic peptide
  Seed: SSSFSYTLLSL (MAGC1_HUMAN)
SHSFSYTLLSW

SEQ ID NO: 79604 - protein, 9 aa, Artificial Sequence
  Description of Artificial Sequence: Synthetic peptide
  Seed: TTDDSTATE (MAGC1_HUMAN)
TCDDSTATV

SEQ ID NO: 79605 - protein, 9 aa, Artificial Sequence
  Description of Artificial Sequence: Synthetic peptide
  Seed: LKNTVPITF (MAGC1_HUMAN)
LKNTVPITY

SEQ ID NO: 79606 - protein, 9 aa, Artificial Sequence
  Description of Artificial Sequence: Synthetic peptide
  Seed: FAFGEPREL (MAGC1_HUMAN)
FKFGEPREY

SEQ ID NO: 79607 - protein, 9 aa, Artificial Sequence
  Description of Artificial Sequence: Synthetic peptide
  Seed: VQSPLHSPQ (MAGC1_HUMAN)
VQSPLHSPH

SEQ ID NO: 79608 - protein, 9 aa, Artificial Sequence
  Description of Artificial Sequence: Synthetic peptide
  Seed: SPPEGENTH (MAGC1_HUMAN)
SIPEGENTY

SEQ ID NO: 79609 - protein, 8 aa, Artificial Sequence
  Description of Artificial Sequence: Synthetic peptide
  Seed: FIEILFGI (MAGC1_HUMAN)
FLEILFGA

SEQ ID NO: 79610 - protein, 9 aa, Artificial Sequence
  Description of Artificial Sequence: Synthetic peptide
  Seed: SSSVMSPSF (MAGC1_HUMAN)
SCSVMSPSW

SEQ ID NO: 79611 - protein, 10 aa, Artificial Sequence
  Description of Artificial Sequence: Synthetic peptide
  Seed: VPITFPSSYK (MAGC1_HUMAN)
VYITFPSSYK

SEQ ID NO: 79612 - protein, 10 aa, Artificial Sequence
  Description of Artificial Sequence: Synthetic peptide
  Seed: YTLDEKVDEL (MAGC1_HUMAN)
YSLDEKVDEY

SEQ ID NO: 79613 - protein, 10 aa, Artificial Sequence
  Description of Artificial Sequence: Synthetic peptide
  Seed: MPTAGMPSLL (MAGC1_HUMAN)
MKTAGMPSLV

SEQ ID NO: 79614 - protein, 9 aa, Artificial Sequence
  Description of Artificial Sequence: Synthetic peptide
  Seed: SSFFSSALL (MAGC1_HUMAN)
SAFFSSALV

SEQ ID NO: 79615 - protein, 9 aa, Artificial Sequence
  Description of Artificial Sequence: Synthetic peptide
  Seed: SIIFIKGTY (MAGC1_HUMAN)
STIFIKGTM

SEQ ID NO: 79616 - protein, 11 aa, Artificial Sequence
  Description of Artificial Sequence: Synthetic peptide
  Seed: IIDTTDDSTAT (MAGC1_HUMAN)
IVDTTDDSTAF

SEQ ID NO: 79617 - protein, 10 aa, Artificial Sequence
  Description of Artificial Sequence: Synthetic peptide
  Seed: SFPSSTSSSL (MAGC1_HUMAN)
SHPSSTSSSV

SEQ ID NO: 79618 - protein, 9 aa, Artificial Sequence
  Description of Artificial Sequence: Synthetic peptide
  Seed: FEGFAQSSL (MAGC1_HUMAN)
FEGFAQSSM

SEQ ID NO: 79619 - protein, 10 aa, Artificial Sequence
  Description of Artificial Sequence: Synthetic peptide
  Seed: YTLASLLQSS (MAGC1_HUMAN)
YSLASLLQSA

SEQ ID NO: 79620 - protein, 9 aa, Artificial Sequence
  Description of Artificial Sequence: Synthetic peptide
  Seed: EMLTNVISR (MAGC1_HUMAN)
ENLTNVISR

SEQ ID NO: 79621 - protein, 9 aa, Artificial Sequence
  Description of Artificial Sequence: Synthetic peptide
  Seed: ASSFFSSAL (MAGC1_HUMAN)
AKSFFSSAF

SEQ ID NO: 79622 - protein, 9 aa, Artificial Sequence
  Description of Artificial Sequence: Synthetic peptide
  Seed: SEEVIWDVL (MAGC1_HUMAN)
SEEVIWDVA

SEQ ID NO: 79623 - protein, 9 aa, Artificial Sequence
  Description of Artificial Sequence: Synthetic peptide
  Seed: FSERTQSTF (MAGC1_HUMAN)
FIERTQSTL

SEQ ID NO: 79624 - protein, 9 aa, Artificial Sequence
  Description of Artificial Sequence: Synthetic peptide
  Seed: KVDELARFL (MAGC1_HUMAN)
KCDELARFM

SEQ ID NO: 79625 - protein, 11 aa, Artificial Sequence
  Description of Artificial Sequence: Synthetic peptide
  Seed: AMLKNTVPITF (MAGC1_HUMAN)
AQLKNTVPITF

SEQ ID NO: 79626 - protein, 9 aa, Artificial Sequence
  Description of Artificial Sequence: Synthetic peptide
  Seed: EFIEILFGI (MAGC1_HUMAN)
ETIEILFGV

SEQ ID NO: 79627 - protein, 9 aa, Artificial Sequence
  Description of Artificial Sequence: Synthetic peptide
  Seed: FSSTLVSLF (MAGC1_HUMAN)
FYSTLVSLM

SEQ ID NO: 79628 - protein, 9 aa, Artificial Sequence
  Description of Artificial Sequence: Synthetic peptide
  Seed: RPVSSFFSY (MAGC1_HUMAN)
RHVSSFFSY

SEQ ID NO: 79629 - protein, 9 aa, Artificial Sequence
  Description of Artificial Sequence: Synthetic peptide
  Seed: LKNTVPITF (MAGC1_HUMAN)
LYNTVPITY

SEQ ID NO: 79630 - protein, 9 aa, Artificial Sequence
  Description of Artificial Sequence: Synthetic peptide
  Seed: SFFSYTLAS (MAGC1_HUMAN)
SVFSYTLAY

SEQ ID NO: 79631 - protein, 9 aa, Artificial Sequence
  Description of Artificial Sequence: Synthetic peptide
  Seed: SSPEGKDSL (MAGC1_HUMAN)
SEPEGKDSL

SEQ ID NO: 79632 - protein, 10 aa, Artificial Sequence
  Description of Artificial Sequence: Synthetic peptide
  Seed: LAMLKNTVPI (MAGC1_HUMAN)
LDMLKNTVPI

SEQ ID NO: 79633 - protein, 11 aa, Artificial Sequence
  Description of Artificial Sequence: Synthetic peptide
  Seed: STFEGFPQSLL (MAGC1_HUMAN)
SSFEGFPQSLW

SEQ ID NO: 79634 - protein, 9 aa, Artificial Sequence
  Description of Artificial Sequence: Synthetic peptide
  Seed: SSPERTHST (MAGC1_HUMAN)
SIPERTHSL

SEQ ID NO: 79635 - protein, 9 aa, Artificial Sequence
  Description of Artificial Sequence: Synthetic peptide
  Seed: MLTNVISRY (MAGC1_HUMAN)
MLTNVISRK

SEQ ID NO: 79636 - protein, 9 aa, Artificial Sequence
  Description of Artificial Sequence: Synthetic peptide
  Seed: LQIPMTSSF (MAGC1_HUMAN)
LIIPMTSSW

SEQ ID NO: 79637 - protein, 9 aa, Artificial Sequence
  Description of Artificial Sequence: Synthetic peptide
  Seed: SFSERTQST (MAGC1_HUMAN)
SYSERTQSF

SEQ ID NO: 79638 - protein, 8 aa, Artificial Sequence
  Description of Artificial Sequence: Synthetic peptide
  Seed: AEMLTNVI (MAGC1_HUMAN)
AEMLTNVW

SEQ ID NO: 79639 - protein, 9 aa, Artificial Sequence
  Description of Artificial Sequence: Synthetic peptide
  Seed: VIWDVLSGI (MAGC1_HUMAN)
VMWDVLSGA

SEQ ID NO: 79640 - protein, 10 aa, Artificial Sequence
  Description of Artificial Sequence: Synthetic peptide
  Seed: KAREFIEILF (MAGC1_HUMAN)
KIREFIEILW

SEQ ID NO: 79641 - protein, 9 aa, Artificial Sequence
  Description of Artificial Sequence: Synthetic peptide
  Seed: YTLLSLFQS (MAGC1_HUMAN)
YSLLSLFQL

SEQ ID NO: 79642 - protein, 9 aa, Artificial Sequence
  Description of Artificial Sequence: Synthetic peptide
  Seed: KVWVQEHYL (MAGC1_HUMAN)
KQWVQEHYR

SEQ ID NO: 79643 - protein, 11 aa, Artificial Sequence
  Description of Artificial Sequence: Synthetic peptide
  Seed: IPMTSSFSSTL (MAGC1_HUMAN)
IPMTSSFSSTM

SEQ ID NO: 79644 - protein, 9 aa, Artificial Sequence
  Description of Artificial Sequence: Synthetic peptide
  Seed: SSPECTQST (MAGC1_HUMAN)
STPECTQSI

SEQ ID NO: 79645 - protein, 9 aa, Artificial Sequence
  Description of Artificial Sequence: Synthetic peptide
  Seed: FAFGEPREL (MAGC1_HUMAN)
FEFGEPREL

SEQ ID NO: 79646 - protein, 9 aa, Artificial Sequence
  Description of Artificial Sequence: Synthetic peptide
  Seed: ISFSSSTSL (MAGC1_HUMAN)
IMFSSSTSL

SEQ ID NO: 79647 - protein, 9 aa, Artificial Sequence
  Description of Artificial Sequence: Synthetic peptide
  Seed: LQIPMTSSF (MAGC1_HUMAN)
LPIPMTSSY

SEQ ID NO: 79648 - protein, 11 aa, Artificial Sequence
  Description of Artificial Sequence: Synthetic peptide
  Seed: ITFPSSYKDAL (MAGC1_HUMAN)
ISFPSSYKDAY

SEQ ID NO: 79649 - protein, 9 aa, Artificial Sequence
  Description of Artificial Sequence: Synthetic peptide
  Seed: SSSFSYTLL (MAGC1_HUMAN)
SLSFSYTLV

SEQ ID NO: 79650 - protein, 9 aa, Artificial Sequence
  Description of Artificial Sequence: Synthetic peptide
  Seed: IPVSPSSSS (MAGC1_HUMAN)
IPVSPSSSP

SEQ ID NO: 79651 - protein, 10 aa, Artificial Sequence
  Description of Artificial Sequence: Synthetic peptide
  Seed: MPTAGMPSLL (MAGC1_HUMAN)
MSTAGMPSLY

SEQ ID NO: 79652 - protein, 10 aa, Artificial Sequence
  Description of Artificial Sequence: Synthetic peptide
  Seed: RKVVEFLAML (MAGC1_HUMAN)
RYVVEFLAML

SEQ ID NO: 79653 - protein, 10 aa, Artificial Sequence
  Description of Artificial Sequence: Synthetic peptide
  Seed: SLQIPVSPSF (MAGC1_HUMAN)
SLQIPVSPSM

SEQ ID NO: 79654 - protein, 9 aa, Artificial Sequence
  Description of Artificial Sequence: Synthetic peptide
  Seed: FPSSYKDAL (MAGC1_HUMAN)
FSSSYKDAY

SEQ ID NO: 79655 - protein, 9 aa, Artificial Sequence
  Description of Artificial Sequence: Synthetic peptide
  Seed: LQIPGSPSF (MAGC1_HUMAN)
LDIPGSPSF

SEQ ID NO: 79656 - protein, 9 aa, Artificial Sequence
  Description of Artificial Sequence: Synthetic peptide
  Seed: SSSTLLSLF (MAGC1_HUMAN)
SSSTLLSLY

SEQ ID NO: 79657 - protein, 9 aa, Artificial Sequence
  Description of Artificial Sequence: Synthetic peptide
  Seed: SLSPFSEES (MAGC1_HUMAN)
SISPFSEEI

SEQ ID NO: 79658 - protein, 9 aa, Artificial Sequence
  Description of Artificial Sequence: Synthetic peptide
  Seed: SPLQSPVSS (MAGC1_HUMAN)
SALQSPVSA

SEQ ID NO: 79659 - protein, 9 aa, Artificial Sequence
  Description of Artificial Sequence: Synthetic peptide
  Seed: FSYTLLSLF (MAGC1_HUMAN)
FWYTLLSLM

SEQ ID NO: 79660 - protein, 11 aa, Artificial Sequence
  Description of Artificial Sequence: Synthetic peptide
  Seed: SLIESEPLFTY (MAGC1_HUMAN)
SVIESEPLFTR

SEQ ID NO: 79661 - protein, 9 aa, Artificial Sequence
  Description of Artificial Sequence: Synthetic peptide
  Seed: SSSSTLLSL (MAGC1_HUMAN)
STSSTLLSV

SEQ ID NO: 79662 - protein, 9 aa, Artificial Sequence
  Description of Artificial Sequence: Synthetic peptide
  Seed: YTLLSLFQS (MAGC1_HUMAN)
YTLLSLFQM

SEQ ID NO: 79663 - protein, 9 aa, Artificial Sequence
  Description of Artificial Sequence: Synthetic peptide
  Seed: KVDELARFL (MAGC1_HUMAN)
KIDELARFW

SEQ ID NO: 79664 - protein, 11 aa, Artificial Sequence
  Description of Artificial Sequence: Synthetic peptide
  Seed: LQIPVSSSFSY (MAGC1_HUMAN)
LYIPVSSSFSW

SEQ ID NO: 79665 - protein, 10 aa, Artificial Sequence
  Description of Artificial Sequence: Synthetic peptide
  Seed: LSQSSPVSSF (MAGC1_HUMAN)
LYQSSPVSSY

SEQ ID NO: 79666 - protein, 10 aa, Artificial Sequence
  Description of Artificial Sequence: Synthetic peptide
  Seed: LHFPQSPPEW (MAGC1_HUMAN)
LFFPQSPPEF

SEQ ID NO: 79667 - protein, 10 aa, Artificial Sequence
  Description of Artificial Sequence: Synthetic peptide
  Seed: SVLQIPVSAA (MAGC1_HUMAN)
SILQIPVSAI

SEQ ID NO: 79668 - protein, 10 aa, Artificial Sequence
  Description of Artificial Sequence: Synthetic peptide
  Seed: IPVSAASSST (MAGC1_HUMAN)
IPVSAASSSM

SEQ ID NO: 79669 - protein, 10 aa, Artificial Sequence
  Description of Artificial Sequence: Synthetic peptide
  Seed: FPQSPLQIPV (MAGC1_HUMAN)
FCQSPLQIPI

SEQ ID NO: 79670 - protein, 9 aa, Artificial Sequence
  Description of Artificial Sequence: Synthetic peptide
  Seed: LQRPVSSFF (MAGC1_HUMAN)
LNRPVSSFW

SEQ ID NO: 79671 - protein, 9 aa, Artificial Sequence
  Description of Artificial Sequence: Synthetic peptide
  Seed: LQIPMTSSF (MAGC1_HUMAN)
LRIPMTSSV

SEQ ID NO: 79672 - protein, 9 aa, Artificial Sequence
  Description of Artificial Sequence: Synthetic peptide
  Seed: TLDEKVDEL (MAGC1_HUMAN)
TMDEKVDEA

SEQ ID NO: 79673 - protein, 10 aa, Artificial Sequence
  Description of Artificial Sequence: Synthetic peptide
  Seed: STPSSLPQSF (MAGC1_HUMAN)
SAPSSLPQSF

SEQ ID NO: 79674 - protein, 9 aa, Artificial Sequence
  Description of Artificial Sequence: Synthetic peptide
  Seed: LQIPVSPSF (MAGC1_HUMAN)
LRIPVSPSM
